United States Patent 11,640,849 (METHODS FOR HISTOLOGICAL DIAGNOSIS AND TREATMENT OF DISEASES) - sequence listing, part 64

SEQ ID NO: 2443218 - protein, 9 aa, Entamoeba dispar
LNKGSEYTK

SEQ ID NO: 2443219 - protein, 4 aa, Entamoeba dispar
LNKI

SEQ ID NO: 2443220 - protein, 10 aa, Entamoeba dispar
LNKIQNENLE

SEQ ID NO: 2443221 - protein, 7 aa, Entamoeba dispar
LNKKDQY

SEQ ID NO: 2443222 - protein, 12 aa, Entamoeba dispar
LNKKEKKKSKTI

SEQ ID NO: 2443223 - protein, 7 aa, Entamoeba dispar
LNKKQLE

SEQ ID NO: 2443224 - protein, 17 aa, Entamoeba dispar
LNKKRQSKRFEEINSQS

SEQ ID NO: 2443225 - protein, 8 aa, Entamoeba dispar
LNKLQSKT

SEQ ID NO: 2443226 - protein, 12 aa, Entamoeba dispar
LNKNENGSTKVE

SEQ ID NO: 2443227 - protein, 11 aa, Entamoeba dispar
LNKNKEIQQHT

SEQ ID NO: 2443228 - protein, 8 aa, Entamoeba dispar
LNKNKREL

SEQ ID NO: 2443229 - protein, 10 aa, Entamoeba dispar
LNKNKSNEFP

SEQ ID NO: 2443230 - protein, 10 aa, Entamoeba dispar
LNKNNSLSDI

SEQ ID NO: 2443231 - protein, 8 aa, Entamoeba dispar
LNKNQDTC

SEQ ID NO: 2443232 - protein, 8 aa, Entamoeba dispar
LNKNSEAV

SEQ ID NO: 2443233 - protein, 9 aa, Entamoeba dispar
LNKNSELNL

SEQ ID NO: 2443234 - protein, 17 aa, Entamoeba dispar
LNKNSFSLPEISSQVKS

SEQ ID NO: 2443235 - protein, 8 aa, Entamoeba dispar
LNKRGIKS

SEQ ID NO: 2443236 - protein, 24 aa, Entamoeba dispar
LNKRNKRESTKNTPIREKSNEKLN

SEQ ID NO: 2443237 - protein, 9 aa, Entamoeba dispar
LNKRTSSSK

SEQ ID NO: 2443238 - protein, 8 aa, Entamoeba dispar
LNKSTNSF

SEQ ID NO: 2443239 - protein, 6 aa, Entamoeba dispar
LNKSVG

SEQ ID NO: 2443240 - protein, 15 aa, Entamoeba dispar
LNKSVKKSHTQHEES

SEQ ID NO: 2443241 - protein, 4 aa, Entamoeba dispar
LNKT

SEQ ID NO: 2443242 - protein, 9 aa, Entamoeba dispar
LNKTEEEPF

SEQ ID NO: 2443243 - protein, 5 aa, Entamoeba dispar
LNKTH

SEQ ID NO: 2443244 - protein, 49 aa, Entamoeba dispar
LNKTKKDKKTRKDSTTNESISLEKDTKQSGTQIKNKKITKLSTGSVGNG

SEQ ID NO: 2443245 - protein, 20 aa, Entamoeba dispar
LNKTKTSSISEKDTNKHMDE

SEQ ID NO: 2443246 - protein, 8 aa, Entamoeba dispar
LNKTQKVD

SEQ ID NO: 2443247 - protein, 11 aa, Entamoeba dispar
LNKTTNDFDNQ

SEQ ID NO: 2443248 - protein, 30 aa, Entamoeba dispar
LNKVQGKKYYNNYHQKEERKDDKEKNGHEH

SEQ ID NO: 2443249 - protein, 4 aa, Entamoeba dispar
LNLD

SEQ ID NO: 2443250 - protein, 9 aa, Entamoeba dispar
LNLGGNNFD

SEQ ID NO: 2443251 - protein, 10 aa, Entamoeba dispar
LNLGGNNFDD

SEQ ID NO: 2443252 - protein, 7 aa, Entamoeba dispar
LNMSEKT

SEQ ID NO: 2443253 - protein, 17 aa, Entamoeba dispar
LNNAINNNSNLSDEKRT

SEQ ID NO: 2443254 - protein, 6 aa, Entamoeba dispar
LNNDQV

SEQ ID NO: 2443255 - protein, 16 aa, Entamoeba dispar
LNNDSTRKTPITLSGN

SEQ ID NO: 2443256 - protein, 4 aa, Entamoeba dispar
LNNE

SEQ ID NO: 2443257 - protein, 9 aa, Entamoeba dispar
LNNEDSSKY

SEQ ID NO: 2443258 - protein, 7 aa, Entamoeba dispar
LNNEEVK

SEQ ID NO: 2443259 - protein, 39 aa, Entamoeba dispar
LNNEKKKQTLKKNAKKIAQKTSSIQEKQMKKIAKKVFSK

SEQ ID NO: 2443260 - protein, 6 aa, Entamoeba dispar
LNNENA

SEQ ID NO: 2443261 - protein, 5 aa, Entamoeba dispar
LNNEV

SEQ ID NO: 2443262 - protein, 8 aa, Entamoeba dispar
LNNGDNQT

SEQ ID NO: 2443263 - protein, 9 aa, Entamoeba dispar
LNNGEKEKY

SEQ ID NO: 2443264 - protein, 13 aa, Entamoeba dispar
LNNGSLESTARTV

SEQ ID NO: 2443265 - protein, 9 aa, Entamoeba dispar
LNNNDQSRT

SEQ ID NO: 2443266 - protein, 8 aa, Entamoeba dispar
LNNNEINT

SEQ ID NO: 2443267 - protein, 5 aa, Entamoeba dispar
LNNNI

SEQ ID NO: 2443268 - protein, 7 aa, Entamoeba dispar
LNNNKEK

SEQ ID NO: 2443269 - protein, 7 aa, Entamoeba dispar
LNNPQKT

SEQ ID NO: 2443270 - protein, 6 aa, Entamoeba dispar
LNNPTI

SEQ ID NO: 2443271 - protein, 5 aa, Entamoeba dispar
LNNQS

SEQ ID NO: 2443272 - protein, 7 aa, Entamoeba dispar
LNNQSGT

SEQ ID NO: 2443273 - protein, 7 aa, Entamoeba dispar
LNNSINQ

SEQ ID NO: 2443274 - protein, 18 aa, Entamoeba dispar
LNNSQQEQQTKQLPENTK

SEQ ID NO: 2443275 - protein, 9 aa, Entamoeba dispar
LNNSQQQVN

SEQ ID NO: 2443276 - protein, 8 aa, Entamoeba dispar
LNNTETLR

SEQ ID NO: 2443277 - protein, 7 aa, Entamoeba dispar
LNNTQIN

SEQ ID NO: 2443278 - protein, 12 aa, Entamoeba dispar
LNNTQTPYIPTK

SEQ ID NO: 2443279 - protein, 7 aa, Entamoeba dispar
LNNTSKK

SEQ ID NO: 2443280 - protein, 5 aa, Entamoeba dispar
LNNYP

SEQ ID NO: 2443281 - protein, 15 aa, Entamoeba dispar
LNNYQNNNPLGMTEE

SEQ ID NO: 2443282 - protein, 9 aa, Entamoeba dispar
LNPAQFPDR

SEQ ID NO: 2443283 - protein, 4 aa, Entamoeba dispar
LNPD

SEQ ID NO: 2443284 - protein, 10 aa, Entamoeba dispar
LNPDNAKAYK

SEQ ID NO: 2443285 - protein, 5 aa, Entamoeba dispar
LNPDT

SEQ ID NO: 2443286 - protein, 7 aa, Entamoeba dispar
LNPEETT

SEQ ID NO: 2443287 - protein, 7 aa, Entamoeba dispar
LNPEKHP

SEQ ID NO: 2443288 - protein, 9 aa, Entamoeba dispar
LNPETEERN

SEQ ID NO: 2443289 - protein, 4 aa, Entamoeba dispar
LNPF

SEQ ID NO: 2443290 - protein, 4 aa, Entamoeba dispar
LNPG

SEQ ID NO: 2443291 - protein, 7 aa, Entamoeba dispar
LNPGIQK

SEQ ID NO: 2443292 - protein, 8 aa, Entamoeba dispar
LNPHEENP

SEQ ID NO: 2443293 - protein, 5 aa, Entamoeba dispar
LNPIG

SEQ ID NO: 2443294 - protein, 33 aa, Entamoeba dispar
LNPKEDSKKSSNKKSGKKQSEKNGEKKKGGCVL

SEQ ID NO: 2443295 - protein, 11 aa, Entamoeba dispar
LNPKGLEKRLP

SEQ ID NO: 2443296 - protein, 6 aa, Entamoeba dispar
LNPKKL

SEQ ID NO: 2443297 - protein, 4 aa, Entamoeba dispar
LNPL

SEQ ID NO: 2443298 - protein, 7 aa, Entamoeba dispar
LNPNAAT

SEQ ID NO: 2443299 - protein, 12 aa, Entamoeba dispar
LNPNADPEKLQQ

SEQ ID NO: 2443300 - protein, 8 aa, Entamoeba dispar
LNPPSEEI

SEQ ID NO: 2443301 - protein, 9 aa, Entamoeba dispar
LNPQEEIER

SEQ ID NO: 2443302 - protein, 7 aa, Entamoeba dispar
LNPQENA

SEQ ID NO: 2443303 - protein, 5 aa, Entamoeba dispar
LNPQG

SEQ ID NO: 2443304 - protein, 5 aa, Entamoeba dispar
LNPQN

SEQ ID NO: 2443305 - protein, 5 aa, Entamoeba dispar
LNPRR

SEQ ID NO: 2443306 - protein, 4 aa, Entamoeba dispar
LNPS

SEQ ID NO: 2443307 - protein, 5 aa, Entamoeba dispar
LNPSG

SEQ ID NO: 2443308 - protein, 18 aa, Entamoeba dispar
LNPSQLAQAIKSKTIKQI

SEQ ID NO: 2443309 - protein, 12 aa, Entamoeba dispar
LNPTPQPKQGQD

SEQ ID NO: 2443310 - protein, 9 aa, Entamoeba dispar
LNPTPVDLP

SEQ ID NO: 2443311 - protein, 7 aa, Entamoeba dispar
LNPYEDE

SEQ ID NO: 2443312 - protein, 6 aa, Entamoeba dispar
LNQEKS

SEQ ID NO: 2443313 - protein, 8 aa, Entamoeba dispar
LNQGKVPQ

SEQ ID NO: 2443314 - protein, 12 aa, Entamoeba dispar
LNQKQKNRNTVV

SEQ ID NO: 2443315 - protein, 11 aa, Entamoeba dispar
LNQNETISEQL

SEQ ID NO: 2443316 - protein, 7 aa, Entamoeba dispar
LNQNGKI

SEQ ID NO: 2443317 - protein, 6 aa, Entamoeba dispar
LNQNKS

SEQ ID NO: 2443318 - protein, 27 aa, Entamoeba dispar
LNQNLNKKQSLYQSEQPTLPKISTTKD

SEQ ID NO: 2443319 - protein, 12 aa, Entamoeba dispar
LNQPSQDRQSFT

SEQ ID NO: 2443320 - protein, 8 aa, Entamoeba dispar
LNQPTDND

SEQ ID NO: 2443321 - protein, 4 aa, Entamoeba dispar
LNQQ

SEQ ID NO: 2443322 - protein, 7 aa, Entamoeba dispar
LNQQTKK

SEQ ID NO: 2443323 - protein, 9 aa, Entamoeba dispar
LNQTNNQGN

SEQ ID NO: 2443324 - protein, 18 aa, Entamoeba dispar
LNQTREVQTSEGEELAKK

SEQ ID NO: 2443325 - protein, 9 aa, Entamoeba dispar
LNRDGTNKI

SEQ ID NO: 2443326 - protein, 4 aa, Entamoeba dispar
LNRI

SEQ ID NO: 2443327 - protein, 5 aa, Entamoeba dispar
LNRKK

SEQ ID NO: 2443328 - protein, 5 aa, Entamoeba dispar
LNRKV

SEQ ID NO: 2443329 - protein, 4 aa, Entamoeba dispar
LNRL

SEQ ID NO: 2443330 - protein, 7 aa, Entamoeba dispar
LNRNDED

SEQ ID NO: 2443331 - protein, 28 aa, Entamoeba dispar
LNRRKKKSEINEDSSRCESDSEITSERS

SEQ ID NO: 2443332 - protein, 9 aa, Entamoeba dispar
LNSEEFKKS

SEQ ID NO: 2443333 - protein, 7 aa, Entamoeba dispar
LNSEERV

SEQ ID NO: 2443334 - protein, 7 aa, Entamoeba dispar
LNSEQKE

SEQ ID NO: 2443335 - protein, 7 aa, Entamoeba dispar
LNSEQTN

SEQ ID NO: 2443336 - protein, 13 aa, Entamoeba dispar
LNSETSSCEPCPD

SEQ ID NO: 2443337 - protein, 7 aa, Entamoeba dispar
LNSETVG

SEQ ID NO: 2443338 - protein, 7 aa, Entamoeba dispar
LNSGYST

SEQ ID NO: 2443339 - protein, 4 aa, Entamoeba dispar
LNSI

SEQ ID NO: 2443340 - protein, 8 aa, Entamoeba dispar
LNSKQATA

SEQ ID NO: 2443341 - protein, 12 aa, Entamoeba dispar
LNSLNGDTQYTE

SEQ ID NO: 2443342 - protein, 4 aa, Entamoeba dispar
LNSN

SEQ ID NO: 2443343 - protein, 7 aa, Entamoeba dispar
LNSNDKT

SEQ ID NO: 2443344 - protein, 9 aa, Entamoeba dispar
LNSNNELDR

SEQ ID NO: 2443345 - protein, 6 aa, Entamoeba dispar
LNSNNS

SEQ ID NO: 2443346 - protein, 15 aa, Entamoeba dispar
LNSNSINEARIEPKD

SEQ ID NO: 2443347 - protein, 7 aa, Entamoeba dispar
LNSPENE

SEQ ID NO: 2443348 - protein, 10 aa, Entamoeba dispar
LNSPHTSLSN

SEQ ID NO: 2443349 - protein, 15 aa, Entamoeba dispar
LNSPPRVKEVNQQGI

SEQ ID NO: 2443350 - protein, 12 aa, Entamoeba dispar
LNSQLKNEINTA

SEQ ID NO: 2443351 - protein, 9 aa, Entamoeba dispar
LNSQRYTRK

SEQ ID NO: 2443352 - protein, 8 aa, Entamoeba dispar
LNSQSKVT

SEQ ID NO: 2443353 - protein, 14 aa, Entamoeba dispar
LNSQSTIDDLPKDI

SEQ ID NO: 2443354 - protein, 5 aa, Entamoeba dispar
LNSRG

SEQ ID NO: 2443355 - protein, 5 aa, Entamoeba dispar
LNSRK

SEQ ID NO: 2443356 - protein, 11 aa, Entamoeba dispar
LNSSDNQAGVV

SEQ ID NO: 2443357 - protein, 8 aa, Entamoeba dispar
LNSSFDNK

SEQ ID NO: 2443358 - protein, 5 aa, Entamoeba dispar
LNSSG

SEQ ID NO: 2443359 - protein, 10 aa, Entamoeba dispar
LNSSKGGTVL

SEQ ID NO: 2443360 - protein, 9 aa, Entamoeba dispar
LNSSSSIKN

SEQ ID NO: 2443361 - protein, 6 aa, Entamoeba dispar
LNSSTN

SEQ ID NO: 2443362 - protein, 5 aa, Entamoeba dispar
LNSTD

SEQ ID NO: 2443363 - protein, 6 aa, Entamoeba dispar
LNSYDK

SEQ ID NO: 2443364 - protein, 11 aa, Entamoeba dispar
LNTDKKDFQDK

SEQ ID NO: 2443365 - protein, 12 aa, Entamoeba dispar
LNTDQVSNNPEI

SEQ ID NO: 2443366 - protein, 14 aa, Entamoeba dispar
LNTESDKLKKQIQT

SEQ ID NO: 2443367 - protein, 12 aa, Entamoeba dispar
LNTFDPEFDPEY

SEQ ID NO: 2443368 - protein, 5 aa, Entamoeba dispar
LNTFN

SEQ ID NO: 2443369 - protein, 4 aa, Entamoeba dispar
LNTK

SEQ ID NO: 2443370 - protein, 6 aa, Entamoeba dispar
LNTKEN

SEQ ID NO: 2443371 - protein, 5 aa, Entamoeba dispar
LNTKG

SEQ ID NO: 2443372 - protein, 6 aa, Entamoeba dispar
LNTKRE

SEQ ID NO: 2443373 - protein, 6 aa, Entamoeba dispar
LNTLSS

SEQ ID NO: 2443374 - protein, 4 aa, Entamoeba dispar
LNTN

SEQ ID NO: 2443375 - protein, 10 aa, Entamoeba dispar
LNTPSPQQSL

SEQ ID NO: 2443376 - protein, 6 aa, Entamoeba dispar
LNTPSS

SEQ ID NO: 2443377 - protein, 4 aa, Entamoeba dispar
LNTQ

SEQ ID NO: 2443378 - protein, 8 aa, Entamoeba dispar
LNTQVETK

SEQ ID NO: 2443379 - protein, 12 aa, Entamoeba dispar
LNTSNDKTSVDP

SEQ ID NO: 2443380 - protein, 8 aa, Entamoeba dispar
LNTSSSNL

SEQ ID NO: 2443381 - protein, 10 aa, Entamoeba dispar
LNTTNNRIND

SEQ ID NO: 2443382 - protein, 7 aa, Entamoeba dispar
LNTTQIT

SEQ ID NO: 2443383 - protein, 14 aa, Entamoeba dispar
LNTTQNTPSKMMDL

SEQ ID NO: 2443384 - protein, 16 aa, Entamoeba dispar
LNTTSSTSTNSSSSTC

SEQ ID NO: 2443385 - protein, 9 aa, Entamoeba dispar
LNTTTSSVP

SEQ ID NO: 2443386 - protein, 6 aa, Entamoeba dispar
LNVSPI

SEQ ID NO: 2443387 - protein, 27 aa, Entamoeba dispar
LNYDDEDELLNNSEYGRTSESSEDNCE

SEQ ID NO: 2443388 - protein, 8 aa, Entamoeba dispar
LNYDGDKR

SEQ ID NO: 2443389 - protein, 59 aa, Entamoeba dispar
LNYERTSKHQTINNPEEVLTEKTDKIKNQIGGVSSSKKKKLCTDDYPDNQKTEEKEEID

SEQ ID NO: 2443390 - protein, 4 aa, Entamoeba dispar
LNYS

SEQ ID NO: 2443391 - protein, 6 aa, Entamoeba dispar
LNYTQG

SEQ ID NO: 2443392 - protein, 4 aa, Entamoeba dispar
LPAE

SEQ ID NO: 2443393 - protein, 5 aa, Entamoeba dispar
LPAEN

SEQ ID NO: 2443394 - protein, 6 aa, Entamoeba dispar
LPAGQN

SEQ ID NO: 2443395 - protein, 7 aa, Entamoeba dispar
LPAGSSN

SEQ ID NO: 2443396 - protein, 12 aa, Entamoeba dispar
LPAKKPKNSCLI

SEQ ID NO: 2443397 - protein, 15 aa, Entamoeba dispar
LPANGENVRNSHERV

SEQ ID NO: 2443398 - protein, 7 aa, Entamoeba dispar
LPANPNV

SEQ ID NO: 2443399 - protein, 26 aa, Entamoeba dispar
LPAPNNSAKTSDSLNSSVTSEKQQTY

SEQ ID NO: 2443400 - protein, 5 aa, Entamoeba dispar
LPATL

SEQ ID NO: 2443401 - protein, 11 aa, Entamoeba dispar
LPATNGSKQSI

SEQ ID NO: 2443402 - protein, 4 aa, Entamoeba dispar
LPCS

SEQ ID NO: 2443403 - protein, 4 aa, Entamoeba dispar
LPDA

SEQ ID NO: 2443404 - protein, 22 aa, Entamoeba dispar
LPDARTYKNTPIYQKRHTDGIS

SEQ ID NO: 2443405 - protein, 4 aa, Entamoeba dispar
LPDD

SEQ ID NO: 2443406 - protein, 6 aa, Entamoeba dispar
LPDDEI

SEQ ID NO: 2443407 - protein, 15 aa, Entamoeba dispar
LPDEGSDNARSEKEI

SEQ ID NO: 2443408 - protein, 4 aa, Entamoeba dispar
LPDG

SEQ ID NO: 2443409 - protein, 8 aa, Entamoeba dispar
LPDGTEFS

SEQ ID NO: 2443410 - protein, 5 aa, Entamoeba dispar
LPDKE

SEQ ID NO: 2443411 - protein, 6 aa, Entamoeba dispar
LPDNDS

SEQ ID NO: 2443412 - protein, 5 aa, Entamoeba dispar
LPDNI

SEQ ID NO: 2443413 - protein, 9 aa, Entamoeba dispar
LPDNLPPDI

SEQ ID NO: 2443414 - protein, 8 aa, Entamoeba dispar
LPDNQVRN

SEQ ID NO: 2443415 - protein, 7 aa, Entamoeba dispar
LPDRAKA

SEQ ID NO: 2443416 - protein, 6 aa, Entamoeba dispar
LPDRRQ

SEQ ID NO: 2443417 - protein, 4 aa, Entamoeba dispar
LPDS

SEQ ID NO: 2443418 - protein, 8 aa, Entamoeba dispar
LPDSPKDY

SEQ ID NO: 2443419 - protein, 6 aa, Entamoeba dispar
LPDSQR

SEQ ID NO: 2443420 - protein, 6 aa, Entamoeba dispar
LPDTPE

SEQ ID NO: 2443421 - protein, 6 aa, Entamoeba dispar
LPDVNK

SEQ ID NO: 2443422 - protein, 6 aa, Entamoeba dispar
LPDVSS

SEQ ID NO: 2443423 - protein, 16 aa, Entamoeba dispar
LPEAKELQKRNNRKLM

SEQ ID NO: 2443424 - protein, 11 aa, Entamoeba dispar
LPEAPNLSQFP

SEQ ID NO: 2443425 - protein, 9 aa, Entamoeba dispar
LPEDEDTPA

SEQ ID NO: 2443426 - protein, 9 aa, Entamoeba dispar
LPEDEQEEI

SEQ ID NO: 2443427 - protein, 6 aa, Entamoeba dispar
LPEDGE

SEQ ID NO: 2443428 - protein, 8 aa, Entamoeba dispar
LPEDTKSI

SEQ ID NO: 2443429 - protein, 5 aa, Entamoeba dispar
LPEDV

SEQ ID NO: 2443430 - protein, 9 aa, Entamoeba dispar
LPEEDDDAL

SEQ ID NO: 2443431 - protein, 47 aa, Entamoeba dispar
LPEEDKERYQELAKQNKAKDCIKTNDQPAQDQPPSIPQIINSLLSSN

SEQ ID NO: 2443432 - protein, 6 aa, Entamoeba dispar
LPEEED

SEQ ID NO: 2443433 - protein, 20 aa, Entamoeba dispar
LPEEEKNKKKKYCDSYGSPN

SEQ ID NO: 2443434 - protein, 23 aa, Entamoeba dispar
LPEEGPQYGLTPNQLNKQNNNNC

SEQ ID NO: 2443435 - protein, 6 aa, Entamoeba dispar
LPEEPA

SEQ ID NO: 2443436 - protein, 9 aa, Entamoeba dispar
LPEEQKKKY

SEQ ID NO: 2443437 - protein, 8 aa, Entamoeba dispar
LPEGGDDL

SEQ ID NO: 2443438 - protein, 5 aa, Entamoeba dispar
LPEGL

SEQ ID NO: 2443439 - protein, 6 aa, Entamoeba dispar
LPEGSS

SEQ ID NO: 2443440 - protein, 13 aa, Entamoeba dispar
LPEGSTITAYKNG

SEQ ID NO: 2443441 - protein, 7 aa, Entamoeba dispar
LPEGTLY

SEQ ID NO: 2443442 - protein, 6 aa, Entamoeba dispar
LPEIEK

SEQ ID NO: 2443443 - protein, 4 aa, Entamoeba dispar
LPEK

SEQ ID NO: 2443444 - protein, 9 aa, Entamoeba dispar
LPEKKNQTY

SEQ ID NO: 2443445 - protein, 8 aa, Entamoeba dispar
LPEKSARY

SEQ ID NO: 2443446 - protein, 7 aa, Entamoeba dispar
LPENEGN

SEQ ID NO: 2443447 - protein, 8 aa, Entamoeba dispar
LPENEPPL

SEQ ID NO: 2443448 - protein, 9 aa, Entamoeba dispar
LPEPTSTSQ

SEQ ID NO: 2443449 - protein, 11 aa, Entamoeba dispar
LPEQPKNQECY

SEQ ID NO: 2443450 - protein, 8 aa, Entamoeba dispar
LPEQPNSI

SEQ ID NO: 2443451 - protein, 11 aa, Entamoeba dispar
LPEQSGDLQRV

SEQ ID NO: 2443452 - protein, 26 aa, Entamoeba dispar
LPEQTQPEHSESLADDLEKSTKEINE

SEQ ID NO: 2443453 - protein, 25 aa, Entamoeba dispar
LPERAINENQDNQENEKSNKDDDQF

SEQ ID NO: 2443454 - protein, 10 aa, Entamoeba dispar
LPERDPDKDY

SEQ ID NO: 2443455 - protein, 12 aa, Entamoeba dispar
LPERGKDDEQIH

SEQ ID NO: 2443456 - protein, 7 aa, Entamoeba dispar
LPESGLD

SEQ ID NO: 2443457 - protein, 9 aa, Entamoeba dispar
LPESGSPYI

SEQ ID NO: 2443458 - protein, 8 aa, Entamoeba dispar
LPETEKTR

SEQ ID NO: 2443459 - protein, 19 aa, Entamoeba dispar
LPETTETNLDTKGKQQSTC

SEQ ID NO: 2443460 - protein, 6 aa, Entamoeba dispar
LPFKDS

SEQ ID NO: 2443461 - protein, 6 aa, Entamoeba dispar
LPGAAA

SEQ ID NO: 2443462 - protein, 12 aa, Entamoeba dispar
LPGCDDKGKPLR

SEQ ID NO: 2443463 - protein, 4 aa, Entamoeba dispar
LPGD

SEQ ID NO: 2443464 - protein, 7 aa, Entamoeba dispar
LPGDNQL

SEQ ID NO: 2443465 - protein, 7 aa, Entamoeba dispar
LPGDSDN

SEQ ID NO: 2443466 - protein, 7 aa, Entamoeba dispar
LPGGPYY

SEQ ID NO: 2443467 - protein, 16 aa, Entamoeba dispar
LPGIAGNDSSKTSIPD

SEQ ID NO: 2443468 - protein, 6 aa, Entamoeba dispar
LPGIGP

SEQ ID NO: 2443469 - protein, 8 aa, Entamoeba dispar
LPGLETAS

SEQ ID NO: 2443470 - protein, 6 aa, Entamoeba dispar
LPGLNK

SEQ ID NO: 2443471 - protein, 5 aa, Entamoeba dispar
LPGNS

SEQ ID NO: 2443472 - protein, 4 aa, Entamoeba dispar
LPGP

SEQ ID NO: 2443473 - protein, 12 aa, Entamoeba dispar
LPGPENPKEDEQ

SEQ ID NO: 2443474 - protein, 11 aa, Entamoeba dispar
LPGRAPNSVKN

SEQ ID NO: 2443475 - protein, 4 aa, Entamoeba dispar
LPGS

SEQ ID NO: 2443476 - protein, 11 aa, Entamoeba dispar
LPGTNAVNTTC

SEQ ID NO: 2443477 - protein, 12 aa, Entamoeba dispar
LPGTSPFTGEES

SEQ ID NO: 2443478 - protein, 6 aa, Entamoeba dispar
LPGYST

SEQ ID NO: 2443479 - protein, 8 aa, Entamoeba dispar
LPHKSSNS

SEQ ID NO: 2443480 - protein, 4 aa, Entamoeba dispar
LPHL

SEQ ID NO: 2443481 - protein, 6 aa, Entamoeba dispar
LPHSQT

SEQ ID NO: 2443482 - protein, 11 aa, Entamoeba dispar
LPIDEDKPGFG

SEQ ID NO: 2443483 - protein, 7 aa, Entamoeba dispar
LPIEKGS

SEQ ID NO: 2443484 - protein, 4 aa, Entamoeba dispar
LPIG

SEQ ID NO: 2443485 - protein, 17 aa, Entamoeba dispar
LPIGTNASKDKQSKEKS

SEQ ID NO: 2443486 - protein, 6 aa, Entamoeba dispar
LPIGVS

SEQ ID NO: 2443487 - protein, 7 aa, Entamoeba dispar
LPIKGGN

SEQ ID NO: 2443488 - protein, 12 aa, Entamoeba dispar
LPINKKPKTIKE

SEQ ID NO: 2443489 - protein, 6 aa, Entamoeba dispar
LPIPQK

SEQ ID NO: 2443490 - protein, 4 aa, Entamoeba dispar
LPIQ

SEQ ID NO: 2443491 - protein, 6 aa, Entamoeba dispar
LPIQGS

SEQ ID NO: 2443492 - protein, 19 aa, Entamoeba dispar
LPIQTTSSIQKSNSSQKRT

SEQ ID NO: 2443493 - protein, 4 aa, Entamoeba dispar
LPIY

SEQ ID NO: 2443494 - protein, 8 aa, Entamoeba dispar
LPKDADFQ

SEQ ID NO: 2443495 - protein, 8 aa, Entamoeba dispar
LPKEDGNF

SEQ ID NO: 2443496 - protein, 15 aa, Entamoeba dispar
LPKEERIEADGTTKE

SEQ ID NO: 2443497 - protein, 14 aa, Entamoeba dispar
LPKEIKEEKSGMRS

SEQ ID NO: 2443498 - protein, 25 aa, Entamoeba dispar
LPKEPRKMTPLSENSDNRKILPEPI

SEQ ID NO: 2443499 - protein, 7 aa, Entamoeba dispar
LPKEPVL

SEQ ID NO: 2443500 - protein, 9 aa, Entamoeba dispar
LPKESEGYR

SEQ ID NO: 2443501 - protein, 7 aa, Entamoeba dispar
LPKETIT

SEQ ID NO: 2443502 - protein, 7 aa, Entamoeba dispar
LPKETNS

SEQ ID NO: 2443503 - protein, 10 aa, Entamoeba dispar
LPKEYKGSCD

SEQ ID NO: 2443504 - protein, 4 aa, Entamoeba dispar
LPKG

SEQ ID NO: 2443505 - protein, 5 aa, Entamoeba dispar
LPKGG

SEQ ID NO: 2443506 - protein, 5 aa, Entamoeba dispar
LPKGL

SEQ ID NO: 2443507 - protein, 9 aa, Entamoeba dispar
LPKGRSSID

SEQ ID NO: 2443508 - protein, 5 aa, Entamoeba dispar
LPKKC

SEQ ID NO: 2443509 - protein, 8 aa, Entamoeba dispar
LPKKEEYN

SEQ ID NO: 2443510 - protein, 10 aa, Entamoeba dispar
LPKKKGKVLQ

SEQ ID NO: 2443511 - protein, 10 aa, Entamoeba dispar
LPKKNRNSIQ

SEQ ID NO: 2443512 - protein, 5 aa, Entamoeba dispar
LPKLQ

SEQ ID NO: 2443513 - protein, 6 aa, Entamoeba dispar
LPKLTE

SEQ ID NO: 2443514 - protein, 6 aa, Entamoeba dispar
LPKNSK

SEQ ID NO: 2443515 - protein, 11 aa, Entamoeba dispar
LPKPIEDTEKS

SEQ ID NO: 2443516 - protein, 15 aa, Entamoeba dispar
LPKPITSSSEKRIIK

SEQ ID NO: 2443517 - protein, 7 aa, Entamoeba dispar
LPKPNPE

SEQ ID NO: 2443518 - protein, 12 aa, Entamoeba dispar
LPKPSSVPMKDE

SEQ ID NO: 2443519 - protein, 8 aa, Entamoeba dispar
LPKQKLPK

SEQ ID NO: 2443520 - protein, 7 aa, Entamoeba dispar
LPKQQTP

SEQ ID NO: 2443521 - protein, 6 aa, Entamoeba dispar
LPKRGS

SEQ ID NO: 2443522 - protein, 11 aa, Entamoeba dispar
LPKSQRSNLDP

SEQ ID NO: 2443523 - protein, 6 aa, Entamoeba dispar
LPKSSA

SEQ ID NO: 2443524 - protein, 12 aa, Entamoeba dispar
LPKSTDSFNASN

SEQ ID NO: 2443525 - protein, 9 aa, Entamoeba dispar
LPKTETKGT

SEQ ID NO: 2443526 - protein, 8 aa, Entamoeba dispar
LPKTPTGN

SEQ ID NO: 2443527 - protein, 22 aa, Entamoeba dispar
LPKTQREKIKNKKSKDENDQEF

SEQ ID NO: 2443528 - protein, 11 aa, Entamoeba dispar
LPKTSQNNVSS

SEQ ID NO: 2443529 - protein, 10 aa, Entamoeba dispar
LPLEGNSGGF

SEQ ID NO: 2443530 - protein, 13 aa, Entamoeba dispar
LPLPPKEINSPSP

SEQ ID NO: 2443531 - protein, 23 aa, Entamoeba dispar
LPLPSSSSTFDPLQPPSLECIVN

SEQ ID NO: 2443532 - protein, 13 aa, Entamoeba dispar
LPLSPDDTNQTTF

SEQ ID NO: 2443533 - protein, 14 aa, Entamoeba dispar
LPLSRGTQPYLSSS

SEQ ID NO: 2443534 - protein, 19 aa, Entamoeba dispar
LPLSSSLSQGISSIPKQET

SEQ ID NO: 2443535 - protein, 5 aa, Entamoeba dispar
LPLTT

SEQ ID NO: 2443536 - protein, 5 aa, Entamoeba dispar
LPMDG

SEQ ID NO: 2443537 - protein, 11 aa, Entamoeba dispar
LPNDEDSHYVG

SEQ ID NO: 2443538 - protein, 7 aa, Entamoeba dispar
LPNDQGR

SEQ ID NO: 2443539 - protein, 5 aa, Entamoeba dispar
LPNEN

SEQ ID NO: 2443540 - protein, 16 aa, Entamoeba dispar
LPNERRNEFAQQSQIS

SEQ ID NO: 2443541 - protein, 22 aa, Entamoeba dispar
LPNESKSLIHSDDKSDNTEKTK

SEQ ID NO: 2443542 - protein, 8 aa, Entamoeba dispar
LPNEVSEK

SEQ ID NO: 2443543 - protein, 5 aa, Entamoeba dispar
LPNGL

SEQ ID NO: 2443544 - protein, 20 aa, Entamoeba dispar
LPNGQTVQKEASSKKKGKKG

SEQ ID NO: 2443545 - protein, 7 aa, Entamoeba dispar
LPNKKQK

SEQ ID NO: 2443546 - protein, 8 aa, Entamoeba dispar
LPNQLTDN

SEQ ID NO: 2443547 - protein, 5 aa, Entamoeba dispar
LPNQS

SEQ ID NO: 2443548 - protein, 13 aa, Entamoeba dispar
LPNQSGATAESVV

SEQ ID NO: 2443549 - protein, 13 aa, Entamoeba dispar
LPNQSGGTAESVV

SEQ ID NO: 2443550 - protein, 7 aa, Entamoeba dispar
LPNSDAR

SEQ ID NO: 2443551 - protein, 8 aa, Entamoeba dispar
LPNSINSI

SEQ ID NO: 2443552 - protein, 7 aa, Entamoeba dispar
LPNSQTN

SEQ ID NO: 2443553 - protein, 5 aa, Entamoeba dispar
LPNST

SEQ ID NO: 2443554 - protein, 10 aa, Entamoeba dispar
LPNTSINSKA

SEQ ID NO: 2443555 - protein, 4 aa, Entamoeba dispar
LPNY

SEQ ID NO: 2443556 - protein, 36 aa, Entamoeba dispar
LPPASTPVKTIEPSLSKSSLDTENGPSTPTKTHKGL

SEQ ID NO: 2443557 - protein, 13 aa, Entamoeba dispar
LPPDVRKKANRYL

SEQ ID NO: 2443558 - protein, 4 aa, Entamoeba dispar
LPPE

SEQ ID NO: 2443559 - protein, 7 aa, Entamoeba dispar
LPPEDSY

SEQ ID NO: 2443560 - protein, 5 aa, Entamoeba dispar
LPPEE

SEQ ID NO: 2443561 - protein, 7 aa, Entamoeba dispar
LPPELQD

SEQ ID NO: 2443562 - protein, 16 aa, Entamoeba dispar
LPPESNNQQLAKPEPK

SEQ ID NO: 2443563 - protein, 5 aa, Entamoeba dispar
LPPFG

SEQ ID NO: 2443564 - protein, 7 aa, Entamoeba dispar
LPPGLKA

SEQ ID NO: 2443565 - protein, 8 aa, Entamoeba dispar
LPPGLKEG

SEQ ID NO: 2443566 - protein, 17 aa, Entamoeba dispar
LPPGQMSNNELPLSTKG

SEQ ID NO: 2443567 - protein, 16 aa, Entamoeba dispar
LPPGTDVKDESERPKK

SEQ ID NO: 2443568 - protein, 13 aa, Entamoeba dispar
LPPGTETKDVSQN

SEQ ID NO: 2443569 - protein, 13 aa, Entamoeba dispar
LPPGTETRDVSQN

SEQ ID NO: 2443570 - protein, 4 aa, Entamoeba dispar
LPPI

SEQ ID NO: 2443571 - protein, 14 aa, Entamoeba dispar
LPPINTTTKHEQYE

SEQ ID NO: 2443572 - protein, 11 aa, Entamoeba dispar
LPPIQEKTENF

SEQ ID NO: 2443573 - protein, 7 aa, Entamoeba dispar
LPPKESY

SEQ ID NO: 2443574 - protein, 17 aa, Entamoeba dispar
LPPKETTQPKGEEKDEI

SEQ ID NO: 2443575 - protein, 6 aa, Entamoeba dispar
LPPKIR

SEQ ID NO: 2443576 - protein, 17 aa, Entamoeba dispar
LPPKPSQKEGDKRSCKI

SEQ ID NO: 2443577 - protein, 17 aa, Entamoeba dispar
LPPKVTTPSVKSSNHNM

SEQ ID NO: 2443578 - protein, 5 aa, Entamoeba dispar
LPPLG

SEQ ID NO: 2443579 - protein, 7 aa, Entamoeba dispar
LPPLPDN

SEQ ID NO: 2443580 - protein, 7 aa, Entamoeba dispar
LPPNQEI

SEQ ID NO: 2443581 - protein, 17 aa, Entamoeba dispar
LPPPNPSKIKPKKEKVP

SEQ ID NO: 2443582 - protein, 30 aa, Entamoeba dispar
LPPPPPPSAYACPPPPSPPGACPPPPGSSS

SEQ ID NO: 2443583 - protein, 9 aa, Entamoeba dispar
LPPPPPSVV

SEQ ID NO: 2443584 - protein, 7 aa, Entamoeba dispar
LPPPPPV

SEQ ID NO: 2443585 - protein, 9 aa, Entamoeba dispar
LPPPSSPKL

SEQ ID NO: 2443586 - protein, 14 aa, Entamoeba dispar
LPPQHSEYSSLNKS

SEQ ID NO: 2443587 - protein, 8 aa, Entamoeba dispar
LPPQNKYP

SEQ ID NO: 2443588 - protein, 4 aa, Entamoeba dispar
LPPS

SEQ ID NO: 2443589 - protein, 9 aa, Entamoeba dispar
LPPSFQTNF

SEQ ID NO: 2443590 - protein, 7 aa, Entamoeba dispar
LPPSNRT

SEQ ID NO: 2443591 - protein, 5 aa, Entamoeba dispar
LPPTI

SEQ ID NO: 2443592 - protein, 6 aa, Entamoeba dispar
LPPTIK

SEQ ID NO: 2443593 - protein, 6 aa, Entamoeba dispar
LPPTIT

SEQ ID NO: 2443594 - protein, 5 aa, Entamoeba dispar
LPPTN

SEQ ID NO: 2443595 - protein, 18 aa, Entamoeba dispar
LPPTPPKQQNYPTPPPQD

SEQ ID NO: 2443596 - protein, 15 aa, Entamoeba dispar
LPPTWDRFYNFENKI

SEQ ID NO: 2443597 - protein, 4 aa, Entamoeba dispar
LPPV

SEQ ID NO: 2443598 - protein, 15 aa, Entamoeba dispar
LPPYQLTNEEKMTAD

SEQ ID NO: 2443599 - protein, 10 aa, Entamoeba dispar
LPQDNQQPSV

SEQ ID NO: 2443600 - protein, 9 aa, Entamoeba dispar
LPQEEDEKH

SEQ ID NO: 2443601 - protein, 4 aa, Entamoeba dispar
LPQG

SEQ ID NO: 2443602 - protein, 10 aa, Entamoeba dispar
LPQHKNEDYD

SEQ ID NO: 2443603 - protein, 16 aa, Entamoeba dispar
LPQKKNKENKDDIPVQ

SEQ ID NO: 2443604 - protein, 14 aa, Entamoeba dispar
LPQLPSRKDGYPLR

SEQ ID NO: 2443605 - protein, 8 aa, Entamoeba dispar
LPQNAPSF

SEQ ID NO: 2443606 - protein, 6 aa, Entamoeba dispar
LPQNEE

SEQ ID NO: 2443607 - protein, 13 aa, Entamoeba dispar
LPQPDGEDNEAEV

SEQ ID NO: 2443608 - protein, 7 aa, Entamoeba dispar
LPQPDSE

SEQ ID NO: 2443609 - protein, 8 aa, Entamoeba dispar
LPQQEQQR

SEQ ID NO: 2443610 - protein, 11 aa, Entamoeba dispar
LPQQQQNTNSL

SEQ ID NO: 2443611 - protein, 4 aa, Entamoeba dispar
LPQR

SEQ ID NO: 2443612 - protein, 9 aa, Entamoeba dispar
LPQRETKGL

SEQ ID NO: 2443613 - protein, 38 aa, Entamoeba dispar
LPQSAISPREDNKEFQPSQISDGESGVGSPRVINGDDL

SEQ ID NO: 2443614 - protein, 7 aa, Entamoeba dispar
LPQSKEG

SEQ ID NO: 2443615 - protein, 8 aa, Entamoeba dispar
LPQSLKSS

SEQ ID NO: 2443616 - protein, 17 aa, Entamoeba dispar
LPQTIPRNSIPSNEPLS

SEQ ID NO: 2443617 - protein, 5 aa, Entamoeba dispar
LPQTM

SEQ ID NO: 2443618 - protein, 48 aa, Entamoeba dispar
LPQTPSPNHSQHHQPISTKSETSVGRSLPPIPQKRSGIVTQHTSYPQI

SEQ ID NO: 2443619 - protein, 7 aa, Entamoeba dispar
LPQTQQE

SEQ ID NO: 2443620 - protein, 5 aa, Entamoeba dispar
LPRGP

SEQ ID NO: 2443621 - protein, 6 aa, Entamoeba dispar
LPRGSG

SEQ ID NO: 2443622 - protein, 4 aa, Entamoeba dispar
LPRI

SEQ ID NO: 2443623 - protein, 11 aa, Entamoeba dispar
LPRKEGNSIYQ

SEQ ID NO: 2443624 - protein, 6 aa, Entamoeba dispar
LPRNEF

SEQ ID NO: 2443625 - protein, 6 aa, Entamoeba dispar
LPRNER

SEQ ID NO: 2443626 - protein, 8 aa, Entamoeba dispar
LPRTDITS

SEQ ID NO: 2443627 - protein, 5 aa, Entamoeba dispar
LPRTI

SEQ ID NO: 2443628 - protein, 9 aa, Entamoeba dispar
LPRTPSARK

SEQ ID NO: 2443629 - protein, 11 aa, Entamoeba dispar
LPSAVGGGANL

SEQ ID NO: 2443630 - protein, 5 aa, Entamoeba dispar
LPSEK

SEQ ID NO: 2443631 - protein, 6 aa, Entamoeba dispar
LPSEKI

SEQ ID NO: 2443632 - protein, 8 aa, Entamoeba dispar
LPSEKSRV

SEQ ID NO: 2443633 - protein, 6 aa, Entamoeba dispar
LPSENG

SEQ ID NO: 2443634 - protein, 13 aa, Entamoeba dispar
LPSGSTPPMKDDK

SEQ ID NO: 2443635 - protein, 5 aa, Entamoeba dispar
LPSGV

SEQ ID NO: 2443636 - protein, 4 aa, Entamoeba dispar
LPSI

SEQ ID NO: 2443637 - protein, 5 aa, Entamoeba dispar
LPSIS

SEQ ID NO: 2443638 - protein, 4 aa, Entamoeba dispar
LPSK

SEQ ID NO: 2443639 - protein, 29 aa, Entamoeba dispar
LPSKITTENDRQQKRNENLKTARDTTINI

SEQ ID NO: 2443640 - protein, 40 aa, Entamoeba dispar
LPSKNENALMETNKASIDLERDEEENKDDNCHSSQIHQSD

SEQ ID NO: 2443641 - protein, 134 aa, Entamoeba dispar
LPSKPSDLSSQSLKKIQQPSQLSSSEPPHSSTMKQKSLKQDTSITTPEPLDSSTDKKEVQPIKRAQPSIPQRQQSNSSIQKTKPQLPSRGNTTNPSSTITNSKPLVPSRTLPKVNTQTTTPNVDGTQHENNSFK

SEQ ID NO: 2443642 - protein, 8 aa, Entamoeba dispar
LPSKSRNA

SEQ ID NO: 2443643 - protein, 6 aa, Entamoeba dispar
LPSKTQ

SEQ ID NO: 2443644 - protein, 4 aa, Entamoeba dispar
LPSL

SEQ ID NO: 2443645 - protein, 6 aa, Entamoeba dispar
LPSLDE

SEQ ID NO: 2443646 - protein, 23 aa, Entamoeba dispar
LPSLPYEKSYGYNQRDAIDTINN

SEQ ID NO: 2443647 - protein, 7 aa, Entamoeba dispar
LPSLSDK

SEQ ID NO: 2443648 - protein, 7 aa, Entamoeba dispar
LPSLSSS

SEQ ID NO: 2443649 - protein, 6 aa, Entamoeba dispar
LPSNEN

SEQ ID NO: 2443650 - protein, 5 aa, Entamoeba dispar
LPSNK

SEQ ID NO: 2443651 - protein, 9 aa, Entamoeba dispar
LPSNLSEIG

SEQ ID NO: 2443652 - protein, 6 aa, Entamoeba dispar
LPSNLT

SEQ ID NO: 2443653 - protein, 6 aa, Entamoeba dispar
LPSNNI

SEQ ID NO: 2443654 - protein, 5 aa, Entamoeba dispar
LPSPI

SEQ ID NO: 2443655 - protein, 28 aa, Entamoeba dispar
LPSPQDQPQNQSDNSKKENTLTKPLSTE

SEQ ID NO: 2443656 - protein, 6 aa, Entamoeba dispar
LPSPRY

SEQ ID NO: 2443657 - protein, 5 aa, Entamoeba dispar
LPSPV

SEQ ID NO: 2443658 - protein, 5 aa, Entamoeba dispar
LPSQE

SEQ ID NO: 2443659 - protein, 20 aa, Entamoeba dispar
LPSQEKKDELTESSPNYLTT

SEQ ID NO: 2443660 - protein, 6 aa, Entamoeba dispar
LPSSDV

SEQ ID NO: 2443661 - protein, 5 aa, Entamoeba dispar
LPSSF

SEQ ID NO: 2443662 - protein, 9 aa, Entamoeba dispar
LPSSISKLG

SEQ ID NO: 2443663 - protein, 8 aa, Entamoeba dispar
LPSSITSL

SEQ ID NO: 2443664 - protein, 12 aa, Entamoeba dispar
LPSSLENINIFS

SEQ ID NO: 2443665 - protein, 6 aa, Entamoeba dispar
LPSSLQ

SEQ ID NO: 2443666 - protein, 6 aa, Entamoeba dispar
LPSSLT

SEQ ID NO: 2443667 - protein, 8 aa, Entamoeba dispar
LPSSLTKI

SEQ ID NO: 2443668 - protein, 6 aa, Entamoeba dispar
LPSSSF

SEQ ID NO: 2443669 - protein, 6 aa, Entamoeba dispar
LPSSSR

SEQ ID NO: 2443670 - protein, 14 aa, Entamoeba dispar
LPSSTTEEPSEGNL

SEQ ID NO: 2443671 - protein, 8 aa, Entamoeba dispar
LPSSVSEI

SEQ ID NO: 2443672 - protein, 7 aa, Entamoeba dispar
LPSTEQK

SEQ ID NO: 2443673 - protein, 6 aa, Entamoeba dispar
LPSTFN

SEQ ID NO: 2443674 - protein, 6 aa, Entamoeba dispar
LPSTIQ

SEQ ID NO: 2443675 - protein, 7 aa, Entamoeba dispar
LPSTNYC

SEQ ID NO: 2443676 - protein, 5 aa, Entamoeba dispar
LPSTP

SEQ ID NO: 2443677 - protein, 9 aa, Entamoeba dispar
LPSTPVNGY

SEQ ID NO: 2443678 - protein, 5 aa, Entamoeba dispar
LPSYK

SEQ ID NO: 2443679 - protein, 6 aa, Entamoeba dispar
LPSYPE

SEQ ID NO: 2443680 - protein, 4 aa, Entamoeba dispar
LPTD

SEQ ID NO: 2443681 - protein, 16 aa, Entamoeba dispar
LPTDVDGEKIKAKYQD

SEQ ID NO: 2443682 - protein, 12 aa, Entamoeba dispar
LPTEKKERIRTP

SEQ ID NO: 2443683 - protein, 5 aa, Entamoeba dispar
LPTGD

SEQ ID NO: 2443684 - protein, 8 aa, Entamoeba dispar
LPTGPTIQ

SEQ ID NO: 2443685 - protein, 18 aa, Entamoeba dispar
LPTKNINSNEDESENDLP

SEQ ID NO: 2443686 - protein, 5 aa, Entamoeba dispar
LPTMD

SEQ ID NO: 2443687 - protein, 6 aa, Entamoeba dispar
LPTNGS

SEQ ID NO: 2443688 - protein, 5 aa, Entamoeba dispar
LPTNQ

SEQ ID NO: 2443689 - protein, 9 aa, Entamoeba dispar
LPTNTTDDT

SEQ ID NO: 2443690 - protein, 5 aa, Entamoeba dispar
LPTPI

SEQ ID NO: 2443691 - protein, 14 aa, Entamoeba dispar
LPTPKQPPGASQCS

SEQ ID NO: 2443692 - protein, 7 aa, Entamoeba dispar
LPTPQKR

SEQ ID NO: 2443693 - protein, 6 aa, Entamoeba dispar
LPTPTQ

SEQ ID NO: 2443694 - protein, 44 aa, Entamoeba dispar
LPTQFPNEKQNTPSQTEIITESGGGVKRKINPINDKKKKKPKNI

SEQ ID NO: 2443695 - protein, 6 aa, Entamoeba dispar
LPTQKF

SEQ ID NO: 2443696 - protein, 5 aa, Entamoeba dispar
LPTRD

SEQ ID NO: 2443697 - protein, 4 aa, Entamoeba dispar
LPTS

SEQ ID NO: 2443698 - protein, 6 aa, Entamoeba dispar
LPTSIS

SEQ ID NO: 2443699 - protein, 6 aa, Entamoeba dispar
LPTTEP

SEQ ID NO: 2443700 - protein, 5 aa, Entamoeba dispar
LPTTI

SEQ ID NO: 2443701 - protein, 7 aa, Entamoeba dispar
LPTTVSK

SEQ ID NO: 2443702 - protein, 13 aa, Entamoeba dispar
LPVASSDKDEPGL

SEQ ID NO: 2443703 - protein, 7 aa, Entamoeba dispar
LPVQENK

SEQ ID NO: 2443704 - protein, 19 aa, Entamoeba dispar
LPVRPTSQSRPTINENEKE

SEQ ID NO: 2443705 - protein, 12 aa, Entamoeba dispar
LPVTEDIKGYGS

SEQ ID NO: 2443706 - protein, 15 aa, Entamoeba dispar
LPYESQEKQETITEN

SEQ ID NO: 2443707 - protein, 6 aa, Entamoeba dispar
LPYNPS

SEQ ID NO: 2443708 - protein, 4 aa, Entamoeba dispar
LPYP

SEQ ID NO: 2443709 - protein, 7 aa, Entamoeba dispar
LPYSPKV

SEQ ID NO: 2443710 - protein, 4 aa, Entamoeba dispar
LPYT

SEQ ID NO: 2443711 - protein, 11 aa, Entamoeba dispar
LPYTHDDGSFS

SEQ ID NO: 2443712 - protein, 102 aa, Entamoeba dispar
LQAEMDKEKEEPQKKVLSQESLTTQQEEKLIEQNNDIPRITEGSMEPTKDQQTKISDSISNLESVDSSKEKPITSELPTKESNESTTLEINNENKKPTITHR

SEQ ID NO: 2443713 - protein, 10 aa, Entamoeba dispar
LQAGGHQGCI

SEQ ID NO: 2443714 - protein, 12 aa, Entamoeba dispar
LQAKESGKGVNQ

SEQ ID NO: 2443715 - protein, 7 aa, Entamoeba dispar
LQAVASK

SEQ ID NO: 2443716 - protein, 8 aa, Entamoeba dispar
LQCSQPQD

SEQ ID NO: 2443717 - protein, 5 aa, Entamoeba dispar
LQDDL

SEQ ID NO: 2443718 - protein, 6 aa, Entamoeba dispar
LQDKNH

SEQ ID NO: 2443719 - protein, 22 aa, Entamoeba dispar
LQDKYDEIKDMPEDQESEDISP

SEQ ID NO: 2443720 - protein, 6 aa, Entamoeba dispar
LQDPES

SEQ ID NO: 2443721 - protein, 7 aa, Entamoeba dispar
LQDPSKR

SEQ ID NO: 2443722 - protein, 14 aa, Entamoeba dispar
LQDPTEGVNRNQMG

SEQ ID NO: 2443723 - protein, 7 aa, Entamoeba dispar
LQDPTGH

SEQ ID NO: 2443724 - protein, 6 aa, Entamoeba dispar
LQDQNK

SEQ ID NO: 2443725 - protein, 10 aa, Entamoeba dispar
LQDQTEKSNR

SEQ ID NO: 2443726 - protein, 6 aa, Entamoeba dispar
LQDSKN

SEQ ID NO: 2443727 - protein, 12 aa, Entamoeba dispar
LQDSNKVDSQIE

SEQ ID NO: 2443728 - protein, 9 aa, Entamoeba dispar
LQEDGKWAS

SEQ ID NO: 2443729 - protein, 10 aa, Entamoeba dispar
LQEDNNGKYP

SEQ ID NO: 2443730 - protein, 9 aa, Entamoeba dispar
LQEKEKGNI

SEQ ID NO: 2443731 - protein, 7 aa, Entamoeba dispar
LQEKKQL

SEQ ID NO: 2443732 - protein, 7 aa, Entamoeba dispar
LQEKVNQ

SEQ ID NO: 2443733 - protein, 23 aa, Entamoeba dispar
LQEKYDSIKDIPDEQDSEETNPI

SEQ ID NO: 2443734 - protein, 23 aa, Entamoeba dispar
LQEKYDSIKDIPDEQESEETNPI

SEQ ID NO: 2443735 - protein, 14 aa, Entamoeba dispar
LQELQDKKESIEKE

SEQ ID NO: 2443736 - protein, 4 aa, Entamoeba dispar
LQEM

SEQ ID NO: 2443737 - protein, 18 aa, Entamoeba dispar
LQENKRVKDNKREQARIQ

SEQ ID NO: 2443738 - protein, 8 aa, Entamoeba dispar
LQENNDCS

SEQ ID NO: 2443739 - protein, 6 aa, Entamoeba dispar
LQEQRY

SEQ ID NO: 2443740 - protein, 7 aa, Entamoeba dispar
LQEQYQH

SEQ ID NO: 2443741 - protein, 7 aa, Entamoeba dispar
LQERNEL

SEQ ID NO: 2443742 - protein, 4 aa, Entamoeba dispar
LQES

SEQ ID NO: 2443743 - protein, 15 aa, Entamoeba dispar
LQESGLSASLIKSII

SEQ ID NO: 2443744 - protein, 10 aa, Entamoeba dispar
LQETKGKEGL

SEQ ID NO: 2443745 - protein, 19 aa, Entamoeba dispar
LQETKSTKKRGRKPKTRSV

SEQ ID NO: 2443746 - protein, 7 aa, Entamoeba dispar
LQEVKDK

SEQ ID NO: 2443747 - protein, 11 aa, Entamoeba dispar
LQEYKNKNSNA

SEQ ID NO: 2443748 - protein, 5 aa, Entamoeba dispar
LQEYN

SEQ ID NO: 2443749 - protein, 13 aa, Entamoeba dispar
LQGAQGVSEVPYE

SEQ ID NO: 2443750 - protein, 6 aa, Entamoeba dispar
LQGDES

SEQ ID NO: 2443751 - protein, 20 aa, Entamoeba dispar
LQGDSTVAVGSDGKNLPPNE

SEQ ID NO: 2443752 - protein, 4 aa, Entamoeba dispar
LQGF

SEQ ID NO: 2443753 - protein, 10 aa, Entamoeba dispar
LQGGTPVSTS

SEQ ID NO: 2443754 - protein, 6 aa, Entamoeba dispar
LQGKDI

SEQ ID NO: 2443755 - protein, 9 aa, Entamoeba dispar
LQGKEEGNI

SEQ ID NO: 2443756 - protein, 9 aa, Entamoeba dispar
LQGKPGKKI

SEQ ID NO: 2443757 - protein, 24 aa, Entamoeba dispar
LQGNNSTTGPSTSTQPATATIPPM

SEQ ID NO: 2443758 - protein, 25 aa, Entamoeba dispar
LQGNNSTTGPSTSTQPATATIPPMA

SEQ ID NO: 2443759 - protein, 41 aa, Entamoeba dispar
LQGQNKIKESSIQETKMEEERKKIEDQTETTKEKSLNSLTQ

SEQ ID NO: 2443760 - protein, 9 aa, Entamoeba dispar
LQGQQSEWK

SEQ ID NO: 2443761 - protein, 11 aa, Entamoeba dispar
LQGTQNDPFTH

SEQ ID NO: 2443762 - protein, 17 aa, Entamoeba dispar
LQGTTTFSNEINKQPSL

SEQ ID NO: 2443763 - protein, 11 aa, Entamoeba dispar
LQIEQKKEIEK

SEQ ID NO: 2443764 - protein, 6 aa, Entamoeba dispar
LQIRKS

SEQ ID NO: 2443765 - protein, 22 aa, Entamoeba dispar
LQKANKKKDKLARLTGRRNSLE

SEQ ID NO: 2443766 - protein, 7 aa, Entamoeba dispar
LQKDAGV

SEQ ID NO: 2443767 - protein, 4 aa, Entamoeba dispar
LQKE

SEQ ID NO: 2443768 - protein, 14 aa, Entamoeba dispar
LQKEEERRKEEQRI

SEQ ID NO: 2443769 - protein, 23 aa, Entamoeba dispar
LQKEGEEKEETINKINEEKRALE

SEQ ID NO: 2443770 - protein, 13 aa, Entamoeba dispar
LQKEKEQKKETIC

SEQ ID NO: 2443771 - protein, 10 aa, Entamoeba dispar
LQKENGTSSI

SEQ ID NO: 2443772 - protein, 5 aa, Entamoeba dispar
LQKEP

SEQ ID NO: 2443773 - protein, 17 aa, Entamoeba dispar
LQKEPIRESRSRRIEQK

SEQ ID NO: 2443774 - protein, 12 aa, Entamoeba dispar
LQKESLHTQNDL

SEQ ID NO: 2443775 - protein, 130 aa, Entamoeba dispar
LQKETEEEERKAREEAERLKKEAERKAREEAERKAREEAERKAKEEAERKAREEAERKAKEEAERKAKEEAERKAREEAERKAREEAERKAKEEAERKAKEEAERKAREEEERKAREEAERKAREEEEKI

SEQ ID NO: 2443776 - protein, 6 aa, Entamoeba dispar
LQKEVE

SEQ ID NO: 2443777 - protein, 4 aa, Entamoeba dispar
LQKK

SEQ ID NO: 2443778 - protein, 24 aa, Entamoeba dispar
LQKKESNKDEETHINKEDKHSYSI

SEQ ID NO: 2443779 - protein, 7 aa, Entamoeba dispar
LQKNLNN

SEQ ID NO: 2443780 - protein, 13 aa, Entamoeba dispar
LQKNTNDLSQRAA

SEQ ID NO: 2443781 - protein, 6 aa, Entamoeba dispar
LQKQNP

SEQ ID NO: 2443782 - protein, 5 aa, Entamoeba dispar
LQKQP

SEQ ID NO: 2443783 - protein, 17 aa, Entamoeba dispar
LQKQQEEDWEKSRQQRF

SEQ ID NO: 2443784 - protein, 6 aa, Entamoeba dispar
LQKQYD

SEQ ID NO: 2443785 - protein, 12 aa, Entamoeba dispar
LQKQYDKQKRIN

SEQ ID NO: 2443786 - protein, 17 aa, Entamoeba dispar
LQKRAEEKEKEKIKERE

SEQ ID NO: 2443787 - protein, 5 aa, Entamoeba dispar
LQKRE

SEQ ID NO: 2443788 - protein, 15 aa, Entamoeba dispar
LQKRKEKNERREGLA

SEQ ID NO: 2443789 - protein, 10 aa, Entamoeba dispar
LQKSQEGLNY

SEQ ID NO: 2443790 - protein, 12 aa, Entamoeba dispar
LQKSSSDKEEIE

SEQ ID NO: 2443791 - protein, 7 aa, Entamoeba dispar
LQKTNEQ

SEQ ID NO: 2443792 - protein, 10 aa, Entamoeba dispar
LQKTPGNEGF

SEQ ID NO: 2443793 - protein, 15 aa, Entamoeba dispar
LQKTVSCTSSDKKFS

SEQ ID NO: 2443794 - protein, 5 aa, Entamoeba dispar
LQLDP

SEQ ID NO: 2443795 - protein, 5 aa, Entamoeba dispar
LQNEI

SEQ ID NO: 2443796 - protein, 30 aa, Entamoeba dispar
LQNEKKRLKSLTQPKTNESNTKKWKSIRKE

SEQ ID NO: 2443797 - protein, 7 aa, Entamoeba dispar
LQNEKVE

SEQ ID NO: 2443798 - protein, 18 aa, Entamoeba dispar
LQNEKYERIGLSEKKELE

SEQ ID NO: 2443799 - protein, 6 aa, Entamoeba dispar
LQNENV

SEQ ID NO: 2443800 - protein, 20 aa, Entamoeba dispar
LQNEQDTEQIVSETKKLQNE

SEQ ID NO: 2443801 - protein, 9 aa, Entamoeba dispar
LQNGELSNA

SEQ ID NO: 2443802 - protein, 4 aa, Entamoeba dispar
LQNK

SEQ ID NO: 2443803 - protein, 32 aa, Entamoeba dispar
LQNKIREEKGKLDRISKEIKRAEEQTRKREIE

SEQ ID NO: 2443804 - protein, 9 aa, Entamoeba dispar
LQNNSTAIN

SEQ ID NO: 2443805 - protein, 4 aa, Entamoeba dispar
LQNP

SEQ ID NO: 2443806 - protein, 7 aa, Entamoeba dispar
LQNPKPY

SEQ ID NO: 2443807 - protein, 15 aa, Entamoeba dispar
LQNPQTTLGTANTEK

SEQ ID NO: 2443808 - protein, 13 aa, Entamoeba dispar
LQNQEKEELENKI

SEQ ID NO: 2443809 - protein, 9 aa, Entamoeba dispar
LQNQNDPSL

SEQ ID NO: 2443810 - protein, 9 aa, Entamoeba dispar
LQNQTQNTQ

SEQ ID NO: 2443811 - protein, 34 aa, Entamoeba dispar
LQNRTSKDYSIKQKQTDSIDLTSDVNSELPPIDN

SEQ ID NO: 2443812 - protein, 18 aa, Entamoeba dispar
LQNSETANGVHRDKEYAE

SEQ ID NO: 2443813 - protein, 7 aa, Entamoeba dispar
LQNTKDE

SEQ ID NO: 2443814 - protein, 6 aa, Entamoeba dispar
LQPAQF

SEQ ID NO: 2443815 - protein, 12 aa, Entamoeba dispar
LQPETNNPFPNL

SEQ ID NO: 2443816 - protein, 8 aa, Entamoeba dispar
LQPGQEKL

SEQ ID NO: 2443817 - protein, 5 aa, Entamoeba dispar
LQPHQ

SEQ ID NO: 2443818 - protein, 4 aa, Entamoeba dispar
LQPI

SEQ ID NO: 2443819 - protein, 6 aa, Entamoeba dispar
LQPITN

SEQ ID NO: 2443820 - protein, 6 aa, Entamoeba dispar
LQPKGK

SEQ ID NO: 2443821 - protein, 4 aa, Entamoeba dispar
LQPL

SEQ ID NO: 2443822 - protein, 43 aa, Entamoeba dispar
LQPLTEPKKEQPKPQTSTKIEKQENNSIKKVEQPNSKKRAVKN

SEQ ID NO: 2443823 - protein, 4 aa, Entamoeba dispar
LQPN

SEQ ID NO: 2443824 - protein, 19 aa, Entamoeba dispar
LQPPIQQINQQNQKIPLQQ

SEQ ID NO: 2443825 - protein, 9 aa, Entamoeba dispar
LQPPPDLKT

SEQ ID NO: 2443826 - protein, 9 aa, Entamoeba dispar
LQPPPQQQV

SEQ ID NO: 2443827 - protein, 7 aa, Entamoeba dispar
LQPPPSQ

SEQ ID NO: 2443828 - protein, 13 aa, Entamoeba dispar
LQPPTINETPTIS

SEQ ID NO: 2443829 - protein, 11 aa, Entamoeba dispar
LQPRGKRTKTL

SEQ ID NO: 2443830 - protein, 8 aa, Entamoeba dispar
LQPSELGK

SEQ ID NO: 2443831 - protein, 9 aa, Entamoeba dispar
LQPSNFEGW

SEQ ID NO: 2443832 - protein, 9 aa, Entamoeba dispar
LQPSPQQLA

SEQ ID NO: 2443833 - protein, 7 aa, Entamoeba dispar
LQPSQPN

SEQ ID NO: 2443834 - protein, 9 aa, Entamoeba dispar
LQPSQPNQS

SEQ ID NO: 2443835 - protein, 9 aa, Entamoeba dispar
LQPSTSNTR

SEQ ID NO: 2443836 - protein, 4 aa, Entamoeba dispar
LQPT

SEQ ID NO: 2443837 - protein, 22 aa, Entamoeba dispar
LQQHSKNKDITQPSNENKSITE

SEQ ID NO: 2443838 - protein, 27 aa, Entamoeba dispar
LQQKENKSILDEGNNNVPQIQQNYSTD

SEQ ID NO: 2443839 - protein, 9 aa, Entamoeba dispar
LQQKEPGRV

SEQ ID NO: 2443840 - protein, 8 aa, Entamoeba dispar
LQQKTQKF

SEQ ID NO: 2443841 - protein, 11 aa, Entamoeba dispar
LQQLERKKDIT

SEQ ID NO: 2443842 - protein, 9 aa, Entamoeba dispar
LQQNKGEYK

SEQ ID NO: 2443843 - protein, 20 aa, Entamoeba dispar
LQQNQKPDDEYITPENFDKE

SEQ ID NO: 2443844 - protein, 15 aa, Entamoeba dispar
LQQNQSTPSTQPKIE

SEQ ID NO: 2443845 - protein, 17 aa, Entamoeba dispar
LQQPEVKDTIPQSIPSD

SEQ ID NO: 2443846 - protein, 11 aa, Entamoeba dispar
LQQQQPVNNTN

SEQ ID NO: 2443847 - protein, 14 aa, Entamoeba dispar
LQQRESEEKSLKNE

SEQ ID NO: 2443848 - protein, 13 aa, Entamoeba dispar
LQQRMNTSNKREM

SEQ ID NO: 2443849 - protein, 5 aa, Entamoeba dispar
LQQTQ

SEQ ID NO: 2443850 - protein, 4 aa, Entamoeba dispar
LQRD

SEQ ID NO: 2443851 - protein, 14 aa, Entamoeba dispar
LQRGDKCLQCILSL

SEQ ID NO: 2443852 - protein, 11 aa, Entamoeba dispar
LQRGTSQPQST

SEQ ID NO: 2443853 - protein, 4 aa, Entamoeba dispar
LQRI

SEQ ID NO: 2443854 - protein, 6 aa, Entamoeba dispar
LQRKGI

SEQ ID NO: 2443855 - protein, 10 aa, Entamoeba dispar
LQRLDDPSPL

SEQ ID NO: 2443856 - protein, 14 aa, Entamoeba dispar
LQRNFEDKKYINTI

SEQ ID NO: 2443857 - protein, 8 aa, Entamoeba dispar
LQRNGNDL

SEQ ID NO: 2443858 - protein, 8 aa, Entamoeba dispar
LQRNKDQK

SEQ ID NO: 2443859 - protein, 7 aa, Entamoeba dispar
LQRQKEL

SEQ ID NO: 2443860 - protein, 5 aa, Entamoeba dispar
LQRVG

SEQ ID NO: 2443861 - protein, 7 aa, Entamoeba dispar
LQSADVK

SEQ ID NO: 2443862 - protein, 9 aa, Entamoeba dispar
LQSASIPNF

SEQ ID NO: 2443863 - protein, 7 aa, Entamoeba dispar
LQSEPIT

SEQ ID NO: 2443864 - protein, 8 aa, Entamoeba dispar
LQSINKPY

SEQ ID NO: 2443865 - protein, 46 aa, Entamoeba dispar
LQSNSKEEEALSVASDDESEEEEKPNKKHYDAAKLQNPPTAEDCKT

SEQ ID NO: 2443866 - protein, 9 aa, Entamoeba dispar
LQSPDEEKR

SEQ ID NO: 2443867 - protein, 7 aa, Entamoeba dispar
LQSPTAI

SEQ ID NO: 2443868 - protein, 5 aa, Entamoeba dispar
LQSQI

SEQ ID NO: 2443869 - protein, 14 aa, Entamoeba dispar
LQSSDISKTTNQNT

SEQ ID NO: 2443870 - protein, 6 aa, Entamoeba dispar
LQSSLS

SEQ ID NO: 2443871 - protein, 9 aa, Entamoeba dispar
LQSTNKETC

SEQ ID NO: 2443872 - protein, 9 aa, Entamoeba dispar
LQSTNPIDF

SEQ ID NO: 2443873 - protein, 9 aa, Entamoeba dispar
LQSTTGPSF

SEQ ID NO: 2443874 - protein, 6 aa, Entamoeba dispar
LQSYSP

SEQ ID NO: 2443875 - protein, 7 aa, Entamoeba dispar
LQTEEMN

SEQ ID NO: 2443876 - protein, 5 aa, Entamoeba dispar
LQTES

SEQ ID NO: 2443877 - protein, 9 aa, Entamoeba dispar
LQTKDDSPA

SEQ ID NO: 2443878 - protein, 7 aa, Entamoeba dispar
LQTKDLS

SEQ ID NO: 2443879 - protein, 6 aa, Entamoeba dispar
LQTNHE

SEQ ID NO: 2443880 - protein, 6 aa, Entamoeba dispar
LQTNHP

SEQ ID NO: 2443881 - protein, 30 aa, Entamoeba dispar
LQTNKKNNSLAKDRKRKTIPIKEAQASLKE

SEQ ID NO: 2443882 - protein, 10 aa, Entamoeba dispar
LQTPGEERTL

SEQ ID NO: 2443883 - protein, 6 aa, Entamoeba dispar
LQTQEQ

SEQ ID NO: 2443884 - protein, 7 aa, Entamoeba dispar
LQTQSKK

SEQ ID NO: 2443885 - protein, 8 aa, Entamoeba dispar
LQWDPSKI

SEQ ID NO: 2443886 - protein, 4 aa, Entamoeba dispar
LRAT

SEQ ID NO: 2443887 - protein, 11 aa, Entamoeba dispar
LRATGTAREIA

SEQ ID NO: 2443888 - protein, 5 aa, Entamoeba dispar
LRCPN

SEQ ID NO: 2443889 - protein, 28 aa, Entamoeba dispar
LRDDPKEVKSLQDNGEVPYTKEDGDKLA

SEQ ID NO: 2443890 - protein, 13 aa, Entamoeba dispar
LRDGDKKRYGGKG

SEQ ID NO: 2443891 - protein, 15 aa, Entamoeba dispar
LRDNAAEVKKITDQG

SEQ ID NO: 2443892 - protein, 12 aa, Entamoeba dispar
LRDNGAKKNIAE

SEQ ID NO: 2443893 - protein, 11 aa, Entamoeba dispar
LRDSTKKPVCC

SEQ ID NO: 2443894 - protein, 7 aa, Entamoeba dispar
LRDTTTT

SEQ ID NO: 2443895 - protein, 62 aa, Entamoeba dispar
LREESKKRDSINPTSSNTKIVETTNEEPQSSASSDKPKDTKVKEETKKEVTPPARKKRPPPL

SEQ ID NO: 2443896 - protein, 7 aa, Entamoeba dispar
LREETES

SEQ ID NO: 2443897 - protein, 4 aa, Entamoeba dispar
LREG

SEQ ID NO: 2443898 - protein, 8 aa, Entamoeba dispar
LREKKKNV

SEQ ID NO: 2443899 - protein, 49 aa, Entamoeba dispar
LREKPEEQFERPKEVTKRKVEEVSTKTEDKTTKKVVERKPDTDSARIRQ

SEQ ID NO: 2443900 - protein, 9 aa, Entamoeba dispar
LREQPEISK

SEQ ID NO: 2443901 - protein, 11 aa, Entamoeba dispar
LRGDEEVRKSY

SEQ ID NO: 2443902 - protein, 4 aa, Entamoeba dispar
LRGF

SEQ ID NO: 2443903 - protein, 16 aa, Entamoeba dispar
LRGGYDNTTEQYPDAF

SEQ ID NO: 2443904 - protein, 4 aa, Entamoeba dispar
LRGM

SEQ ID NO: 2443905 - protein, 17 aa, Entamoeba dispar
LRGNQNESHYLGGTTKC

SEQ ID NO: 2443906 - protein, 9 aa, Entamoeba dispar
LRGQEKNDI

SEQ ID NO: 2443907 - protein, 7 aa, Entamoeba dispar
LRGSGNE

SEQ ID NO: 2443908 - protein, 6 aa, Entamoeba dispar
LRHKAP

SEQ ID NO: 2443909 - protein, 122 aa, Entamoeba dispar
LRKEAEEKLRKEAEEKARLEAEERLKEAEEKLRKEAEEKLRKEAEEKAKKEAEEKARLEAEERLKEAEEKLRKEAEEKLRKEAKENKKQKKNKKQKKRLKKERKKKKDNNLNKGISRKKQKM

SEQ ID NO: 2443910 - protein, 13 aa, Entamoeba dispar
LRKEDPAKEGKDI

SEQ ID NO: 2443911 - protein, 9 aa, Entamoeba dispar
LRKEGVDEL

SEQ ID NO: 2443912 - protein, 9 aa, Entamoeba dispar
LRKEKEDQI

SEQ ID NO: 2443913 - protein, 13 aa, Entamoeba dispar
LRKEQNLSTRSDE

SEQ ID NO: 2443914 - protein, 10 aa, Entamoeba dispar
LRKGSQEHAI

SEQ ID NO: 2443915 - protein, 5 aa, Entamoeba dispar
LRKIQ

SEQ ID NO: 2443916 - protein, 8 aa, Entamoeba dispar
LRKKTKQA

SEQ ID NO: 2443917 - protein, 12 aa, Entamoeba dispar
LRKNERIPEYCF

SEQ ID NO: 2443918 - protein, 6 aa, Entamoeba dispar
LRKNTI

SEQ ID NO: 2443919 - protein, 26 aa, Entamoeba dispar
LRKQKEEEEKKKREEEEADQQKKLER

SEQ ID NO: 2443920 - protein, 47 aa, Entamoeba dispar
LRKRIESKKPKVIKEPKPKKPQIKLPKERKKREGSGMVSLNALRRHK

SEQ ID NO: 2443921 - protein, 5 aa, Entamoeba dispar
LRNDT

SEQ ID NO: 2443922 - protein, 9 aa, Entamoeba dispar
LRNEEDCEK

SEQ ID NO: 2443923 - protein, 10 aa, Entamoeba dispar
LRNERNEKVN

SEQ ID NO: 2443924 - protein, 10 aa, Entamoeba dispar
LRNEVSPEIA

SEQ ID NO: 2443925 - protein, 8 aa, Entamoeba dispar
LRNGNGTE

SEQ ID NO: 2443926 - protein, 10 aa, Entamoeba dispar
LRNNSQPLPI

SEQ ID NO: 2443927 - protein, 7 aa, Entamoeba dispar
LRNPNGK

SEQ ID NO: 2443928 - protein, 9 aa, Entamoeba dispar
LRNQKNTSV

SEQ ID NO: 2443929 - protein, 7 aa, Entamoeba dispar
LRNQRRQ

SEQ ID NO: 2443930 - protein, 4 aa, Entamoeba dispar
LRNR

SEQ ID NO: 2443931 - protein, 11 aa, Entamoeba dispar
LRNRGKDKKTI

SEQ ID NO: 2443932 - protein, 10 aa, Entamoeba dispar
LRNSSGYISY

SEQ ID NO: 2443933 - protein, 7 aa, Entamoeba dispar
LRNTESK

SEQ ID NO: 2443934 - protein, 6 aa, Entamoeba dispar
LRPEDV

SEQ ID NO: 2443935 - protein, 15 aa, Entamoeba dispar
LRPEISQQQITRRSP

SEQ ID NO: 2443936 - protein, 9 aa, Entamoeba dispar
LRPGEDIQQ

SEQ ID NO: 2443937 - protein, 18 aa, Entamoeba dispar
LRPTPKEDKEEKKQGKKE

SEQ ID NO: 2443938 - protein, 7 aa, Entamoeba dispar
LRPTQGK

SEQ ID NO: 2443939 - protein, 6 aa, Entamoeba dispar
LRPTSE

SEQ ID NO: 2443940 - protein, 6 aa, Entamoeba dispar
LRPTSI

SEQ ID NO: 2443941 - protein, 8 aa, Entamoeba dispar
LRPTYEDS

SEQ ID NO: 2443942 - protein, 9 aa, Entamoeba dispar
LRPYGNAGV

SEQ ID NO: 2443943 - protein, 10 aa, Entamoeba dispar
LRQDGRKTFS

SEQ ID NO: 2443944 - protein, 6 aa, Entamoeba dispar
LRQEEQ

SEQ ID NO: 2443945 - protein, 19 aa, Entamoeba dispar
LRQENENKRSSNEKIRKEE

SEQ ID NO: 2443946 - protein, 7 aa, Entamoeba dispar
LRQQSED

SEQ ID NO: 2443947 - protein, 10 aa, Entamoeba dispar
LRQTKKLQEA

SEQ ID NO: 2443948 - protein, 16 aa, Entamoeba dispar
LRQTSGDVQDKINTKK

SEQ ID NO: 2443949 - protein, 4 aa, Entamoeba dispar
LRRE

SEQ ID NO: 2443950 - protein, 9 aa, Entamoeba dispar
LRRGNDSIK

SEQ ID NO: 2443951 - protein, 8 aa, Entamoeba dispar
LRRKSAKV

SEQ ID NO: 2443952 - protein, 6 aa, Entamoeba dispar
LRRKSN

SEQ ID NO: 2443953 - protein, 9 aa, Entamoeba dispar
LRRNGGNEF

SEQ ID NO: 2443954 - protein, 16 aa, Entamoeba dispar
LRRQQEESDIKGAERL

SEQ ID NO: 2443955 - protein, 24 aa, Entamoeba dispar
LRRSGLKSHASGVSTSHMNSDDVT

SEQ ID NO: 2443956 - protein, 4 aa, Entamoeba dispar
LRSE

SEQ ID NO: 2443957 - protein, 9 aa, Entamoeba dispar
LRSKDEKAM

SEQ ID NO: 2443958 - protein, 7 aa, Entamoeba dispar
LRSKERE

SEQ ID NO: 2443959 - protein, 7 aa, Entamoeba dispar
LRSKERI

SEQ ID NO: 2443960 - protein, 31 aa, Entamoeba dispar
LRSKRRTQSWSPIQSPKETSIQVGDQQFEDR

SEQ ID NO: 2443961 - protein, 10 aa, Entamoeba dispar
LRSNAGNEQA

SEQ ID NO: 2443962 - protein, 8 aa, Entamoeba dispar
LRSNENLE

SEQ ID NO: 2443963 - protein, 5 aa, Entamoeba dispar
LRSNG

SEQ ID NO: 2443964 - protein, 8 aa, Entamoeba dispar
LRSNPLNS

SEQ ID NO: 2443965 - protein, 7 aa, Entamoeba dispar
LRSPMSL

SEQ ID NO: 2443966 - protein, 8 aa, Entamoeba dispar
LRSQISAK

SEQ ID NO: 2443967 - protein, 7 aa, Entamoeba dispar
LRSRGTS

SEQ ID NO: 2443968 - protein, 4 aa, Entamoeba dispar
LRSS

SEQ ID NO: 2443969 - protein, 9 aa, Entamoeba dispar
LRSSYEHSS

SEQ ID NO: 2443970 - protein, 10 aa, Entamoeba dispar
LRSTEEVEKE

SEQ ID NO: 2443971 - protein, 10 aa, Entamoeba dispar
LRSVNEKGDN

SEQ ID NO: 2443972 - protein, 40 aa, Entamoeba dispar
LRTEARELQREGSRYGPFTDRGMTPDDSGDGDLDSEDYND

SEQ ID NO: 2443973 - protein, 6 aa, Entamoeba dispar
LRTENG

SEQ ID NO: 2443974 - protein, 13 aa, Entamoeba dispar
LRTERRKKFQNEK

SEQ ID NO: 2443975 - protein, 6 aa, Entamoeba dispar
LRTKEN

SEQ ID NO: 2443976 - protein, 8 aa, Entamoeba dispar
LRTKENEM

SEQ ID NO: 2443977 - protein, 18 aa, Entamoeba dispar
LRTLTESGVHPERLTEQK

SEQ ID NO: 2443978 - protein, 10 aa, Entamoeba dispar
LRTPTKRSVP

SEQ ID NO: 2443979 - protein, 10 aa, Entamoeba dispar
LRTPVKKESS

SEQ ID NO: 2443980 - protein, 64 aa, Entamoeba dispar
LRTSKQTPTIENQNDLPKQFTQEQSNKTINVKSTNTFNNGYEEKTKVQEKKSQIEKNEESPRSK

SEQ ID NO: 2443981 - protein, 7 aa, Entamoeba dispar
LRTSPQT

SEQ ID NO: 2443982 - protein, 5 aa, Entamoeba dispar
LRTTQ

SEQ ID NO: 2443983 - protein, 17 aa, Entamoeba dispar
LRTTQTRKWSERGKSVA

SEQ ID NO: 2443984 - protein, 8 aa, Entamoeba dispar
LSAEKEKF

SEQ ID NO: 2443985 - protein, 9 aa, Entamoeba dispar
LSAGATPIG

SEQ ID NO: 2443986 - protein, 8 aa, Entamoeba dispar
LSALGKKY

SEQ ID NO: 2443987 - protein, 43 aa, Entamoeba dispar
LSAMSGSSQQSSQEGIQSNSNGNSTQNLGEGNTNSQSGEPHKV

SEQ ID NO: 2443988 - protein, 10 aa, Entamoeba dispar
LSAPKKKSVV

SEQ ID NO: 2443989 - protein, 7 aa, Entamoeba dispar
LSATPER

SEQ ID NO: 2443990 - protein, 8 aa, Entamoeba dispar
LSDDPKAL

SEQ ID NO: 2443991 - protein, 6 aa, Entamoeba dispar
LSDDQI

SEQ ID NO: 2443992 - protein, 9 aa, Entamoeba dispar
LSDDSPNSL

SEQ ID NO: 2443993 - protein, 25 aa, Entamoeba dispar
LSDEEKEEIKKQIAKRKRRSSLTPL

SEQ ID NO: 2443994 - protein, 7 aa, Entamoeba dispar
LSDEELT

SEQ ID NO: 2443995 - protein, 16 aa, Entamoeba dispar
LSDEEMAQEDEEIPAE

SEQ ID NO: 2443996 - protein, 7 aa, Entamoeba dispar
LSDEESK

SEQ ID NO: 2443997 - protein, 16 aa, Entamoeba dispar
LSDEESKTIFTNKDYH

SEQ ID NO: 2443998 - protein, 9 aa, Entamoeba dispar
LSDEKKTKV

SEQ ID NO: 2443999 - protein, 8 aa, Entamoeba dispar
LSDENNSL

SEQ ID NO: 2444000 - protein, 9 aa, Entamoeba dispar
LSDESQKDV

SEQ ID NO: 2444001 - protein, 6 aa, Entamoeba dispar
LSDEVR

SEQ ID NO: 2444002 - protein, 9 aa, Entamoeba dispar
LSDISAQPK

SEQ ID NO: 2444003 - protein, 20 aa, Entamoeba dispar
LSDKANKLAQQNNGTSKPVN

SEQ ID NO: 2444004 - protein, 11 aa, Entamoeba dispar
LSDKDDSYPIT

SEQ ID NO: 2444005 - protein, 8 aa, Entamoeba dispar
LSDKKDEV

SEQ ID NO: 2444006 - protein, 12 aa, Entamoeba dispar
LSDKKEVINEKE

SEQ ID NO: 2444007 - protein, 9 aa, Entamoeba dispar
LSDKKYAER

SEQ ID NO: 2444008 - protein, 9 aa, Entamoeba dispar
LSDKQLDSK

SEQ ID NO: 2444009 - protein, 14 aa, Entamoeba dispar
LSDKVSKGLTSTKR

SEQ ID NO: 2444010 - protein, 13 aa, Entamoeba dispar
LSDLPDKSSNFSS

SEQ ID NO: 2444011 - protein, 10 aa, Entamoeba dispar
LSDNKIDTLT

SEQ ID NO: 2444012 - protein, 5 aa, Entamoeba dispar
LSDNP

SEQ ID NO: 2444013 - protein, 7 aa, Entamoeba dispar
LSDPKIV

SEQ ID NO: 2444014 - protein, 47 aa, Entamoeba dispar
LSDPKKKEIYDRYGEDGLKSGMGANGFSREGGFPGGTYTFTSNGDFN

SEQ ID NO: 2444015 - protein, 31 aa, Entamoeba dispar
LSDPKKKEIYDRYGEEGLKNGMGGAGGFPGG

SEQ ID NO: 2444016 - protein, 16 aa, Entamoeba dispar
LSDPRYDRDPFPRDNL

SEQ ID NO: 2444017 - protein, 132 aa, Entamoeba dispar
LSDPRYDRDPFPRDPRYMGDPRAPFERNPLERDPRLDPRAPLDRPPMDRPPLDPRASLDRPPIDARAPLDRPPLERTPLDRDPRIPLDRPPIERDPRLNTDIHDRSERIDRSDRSGAEKKRNFLPINNNPPP

SEQ ID NO: 2444018 - protein, 13 aa, Entamoeba dispar
LSDPSSYKKSVSP

SEQ ID NO: 2444019 - protein, 13 aa, Entamoeba dispar
LSDQKKTLTAEVE

SEQ ID NO: 2444020 - protein, 5 aa, Entamoeba dispar
LSDRI

SEQ ID NO: 2444021 - protein, 7 aa, Entamoeba dispar
LSDSERF

SEQ ID NO: 2444022 - protein, 14 aa, Entamoeba dispar
LSDSNTIEEEEESI

SEQ ID NO: 2444023 - protein, 8 aa, Entamoeba dispar
LSDSSELV

SEQ ID NO: 2444024 - protein, 6 aa, Entamoeba dispar
LSDTED

SEQ ID NO: 2444025 - protein, 11 aa, Entamoeba dispar
LSDTKTGDNKR

SEQ ID NO: 2444026 - protein, 14 aa, Entamoeba dispar
LSDTTGLNKNKEVL

SEQ ID NO: 2444027 - protein, 12 aa, Entamoeba dispar
LSEASNSPSFDI

SEQ ID NO: 2444028 - protein, 4 aa, Entamoeba dispar
LSED

SEQ ID NO: 2444029 - protein, 5 aa, Entamoeba dispar
LSEDD

SEQ ID NO: 2444030 - protein, 9 aa, Entamoeba dispar
LSEDDIKTI

SEQ ID NO: 2444031 - protein, 9 aa, Entamoeba dispar
LSEDGKNWR

SEQ ID NO: 2444032 - protein, 9 aa, Entamoeba dispar
LSEDPSSDL

SEQ ID NO: 2444033 - protein, 27 aa, Entamoeba dispar
LSEDQQRRKRKSVPNGLDDSSPISSPD

SEQ ID NO: 2444034 - protein, 24 aa, Entamoeba dispar
LSEEAQNENSNQNTSQQHQTPPGF

SEQ ID NO: 2444035 - protein, 9 aa, Entamoeba dispar
LSEEEIDGN

SEQ ID NO: 2444036 - protein, 7 aa, Entamoeba dispar
LSEEEVN

SEQ ID NO: 2444037 - protein, 13 aa, Entamoeba dispar
LSEEIKGKEIPKV

SEQ ID NO: 2444038 - protein, 15 aa, Entamoeba dispar
LSEEKEKKEVERNNS

SEQ ID NO: 2444039 - protein, 29 aa, Entamoeba dispar
LSEEKEKLEKEYLEEQTKRNNEEANRIKE

SEQ ID NO: 2444040 - protein, 16 aa, Entamoeba dispar
LSEELKDTKLNSIQRT

SEQ ID NO: 2444041 - protein, 22 aa, Entamoeba dispar
LSEEPVSVDNMNNKQYNRTREA

SEQ ID NO: 2444042 - protein, 7 aa, Entamoeba dispar
LSEEQKK

SEQ ID NO: 2444043 - protein, 4 aa, Entamoeba dispar
LSEF

SEQ ID NO: 2444044 - protein, 9 aa, Entamoeba dispar
LSEGSPDVS

SEQ ID NO: 2444045 - protein, 12 aa, Entamoeba dispar
LSEKCTENSDIP

SEQ ID NO: 2444046 - protein, 6 aa, Entamoeba dispar
LSEKEL

SEQ ID NO: 2444047 - protein, 9 aa, Entamoeba dispar
LSEKGQTLY

SEQ ID NO: 2444048 - protein, 13 aa, Entamoeba dispar
LSEKIKGKEIPKV

SEQ ID NO: 2444049 - protein, 7 aa, Entamoeba dispar
LSENIPE

SEQ ID NO: 2444050 - protein, 5 aa, Entamoeba dispar
LSENQ

SEQ ID NO: 2444051 - protein, 5 aa, Entamoeba dispar
LSEPI

SEQ ID NO: 2444052 - protein, 9 aa, Entamoeba dispar
LSEPKQEDI

SEQ ID NO: 2444053 - protein, 7 aa, Entamoeba dispar
LSEPSKI

SEQ ID NO: 2444054 - protein, 5 aa, Entamoeba dispar
LSEPY

SEQ ID NO: 2444055 - protein, 10 aa, Entamoeba dispar
LSEPYGKNFD

SEQ ID NO: 2444056 - protein, 10 aa, Entamoeba dispar
LSEQDPGAQR

SEQ ID NO: 2444057 - protein, 5 aa, Entamoeba dispar
LSEQF

SEQ ID NO: 2444058 - protein, 25 aa, Entamoeba dispar
LSEQQKQIKPRHSRSRSRSFSYHSQ

SEQ ID NO: 2444059 - protein, 8 aa, Entamoeba dispar
LSEQTARS

SEQ ID NO: 2444060 - protein, 4 aa, Entamoeba dispar
LSER

SEQ ID NO: 2444061 - protein, 7 aa, Entamoeba dispar
LSERDAE

SEQ ID NO: 2444062 - protein, 5 aa, Entamoeba dispar
LSERR

SEQ ID NO: 2444063 - protein, 17 aa, Entamoeba dispar
LSERRIEKAKIEKNKIK

SEQ ID NO: 2444064 - protein, 16 aa, Entamoeba dispar
LSERSINKEETNKSFG

SEQ ID NO: 2444065 - protein, 7 aa, Entamoeba dispar
LSESGSL

SEQ ID NO: 2444066 - protein, 6 aa, Entamoeba dispar
LSESKC

SEQ ID NO: 2444067 - protein, 8 aa, Entamoeba dispar
LSESSLTT

SEQ ID NO: 2444068 - protein, 16 aa, Entamoeba dispar
LSETPSSLPNNPEERR

SEQ ID NO: 2444069 - protein, 10 aa, Entamoeba dispar
LSETSTDVNR

SEQ ID NO: 2444070 - protein, 18 aa, Entamoeba dispar
LSETTQRELDEIDDEMRS

SEQ ID NO: 2444071 - protein, 6 aa, Entamoeba dispar
LSETVE

SEQ ID NO: 2444072 - protein, 6 aa, Entamoeba dispar
LSFDSK

SEQ ID NO: 2444073 - protein, 4 aa, Entamoeba dispar
LSFE

SEQ ID NO: 2444074 - protein, 6 aa, Entamoeba dispar
LSFNEE

SEQ ID NO: 2444075 - protein, 4 aa, Entamoeba dispar
LSGA

SEQ ID NO: 2444076 - protein, 6 aa, Entamoeba dispar
LSGCSS

SEQ ID NO: 2444077 - protein, 38 aa, Entamoeba dispar
LSGDKKNNTSNPITSQTTYVPPPNVSSVSEPMVPPPMT

SEQ ID NO: 2444078 - protein, 4 aa, Entamoeba dispar
LSGE

SEQ ID NO: 2444079 - protein, 14 aa, Entamoeba dispar
LSGEDGSPFDSTGM

SEQ ID NO: 2444080 - protein, 6 aa, Entamoeba dispar
LSGEED

SEQ ID NO: 2444081 - protein, 4 aa, Entamoeba dispar
LSGF

SEQ ID NO: 2444082 - protein, 9 aa, Entamoeba dispar
LSGGNISKE

SEQ ID NO: 2444083 - protein, 5 aa, Entamoeba dispar
LSGGQ

SEQ ID NO: 2444084 - protein, 7 aa, Entamoeba dispar
LSGGQKS

SEQ ID NO: 2444085 - protein, 6 aa, Entamoeba dispar
LSGGQS

SEQ ID NO: 2444086 - protein, 9 aa, Entamoeba dispar
LSGKEKDNY

SEQ ID NO: 2444087 - protein, 12 aa, Entamoeba dispar
LSGKKAPRYFPN

SEQ ID NO: 2444088 - protein, 9 aa, Entamoeba dispar
LSGKTDSEL

SEQ ID NO: 2444089 - protein, 8 aa, Entamoeba dispar
LSGKTKRV

SEQ ID NO: 2444090 - protein, 4 aa, Entamoeba dispar
LSGL

SEQ ID NO: 2444091 - protein, 8 aa, Entamoeba dispar
LSGNDGMG

SEQ ID NO: 2444092 - protein, 11 aa, Entamoeba dispar
LSGNNNNLTQA

SEQ ID NO: 2444093 - protein, 11 aa, Entamoeba dispar
LSGNNRQSESS

SEQ ID NO: 2444094 - protein, 10 aa, Entamoeba dispar
LSGNTKELST

SEQ ID NO: 2444095 - protein, 7 aa, Entamoeba dispar
LSGPALD

SEQ ID NO: 2444096 - protein, 7 aa, Entamoeba dispar
LSGPTNF

SEQ ID NO: 2444097 - protein, 8 aa, Entamoeba dispar
LSGPTSFA

SEQ ID NO: 2444098 - protein, 28 aa, Entamoeba dispar
LSGQQRKMEEEEESNTKPNQTKEQQEII

SEQ ID NO: 2444099 - protein, 16 aa, Entamoeba dispar
LSGQYPEGDDFEEYNS

SEQ ID NO: 2444100 - protein, 6 aa, Entamoeba dispar
LSGSIS

SEQ ID NO: 2444101 - protein, 9 aa, Entamoeba dispar
LSGSKSSTC

SEQ ID NO: 2444102 - protein, 7 aa, Entamoeba dispar
LSGTTLT

SEQ ID NO: 2444103 - protein, 11 aa, Entamoeba dispar
LSHKGDGEKRR

SEQ ID NO: 2444104 - protein, 5 aa, Entamoeba dispar
LSHPE

SEQ ID NO: 2444105 - protein, 5 aa, Entamoeba dispar
LSHPH

SEQ ID NO: 2444106 - protein, 8 aa, Entamoeba dispar
LSHPQSND

SEQ ID NO: 2444107 - protein, 4 aa, Entamoeba dispar
LSHR

SEQ ID NO: 2444108 - protein, 5 aa, Entamoeba dispar
LSIDK

SEQ ID NO: 2444109 - protein, 13 aa, Entamoeba dispar
LSINENPSSSSTN

SEQ ID NO: 2444110 - protein, 8 aa, Entamoeba dispar
LSINPETT

SEQ ID NO: 2444111 - protein, 38 aa, Entamoeba dispar
LSIPPPQIVPPPPITTPTIPPPKDLTPEAKSVLQGGGM

SEQ ID NO: 2444112 - protein, 7 aa, Entamoeba dispar
LSIPPTK

SEQ ID NO: 2444113 - protein, 5 aa, Entamoeba dispar
LSIPQ

SEQ ID NO: 2444114 - protein, 7 aa, Entamoeba dispar
LSIPSNL

SEQ ID NO: 2444115 - protein, 4 aa, Entamoeba dispar
LSIR

SEQ ID NO: 2444116 - protein, 5 aa, Entamoeba dispar
LSISS

SEQ ID NO: 2444117 - protein, 9 aa, Entamoeba dispar
LSISSQPFS

SEQ ID NO: 2444118 - protein, 25 aa, Entamoeba dispar
LSITSEKKKGKLTQTTINQLKVLSL

SEQ ID NO: 2444119 - protein, 9 aa, Entamoeba dispar
LSKDGSGLG

SEQ ID NO: 2444120 - protein, 8 aa, Entamoeba dispar
LSKDNMEK

SEQ ID NO: 2444121 - protein, 12 aa, Entamoeba dispar
LSKDNSDGNTAM

SEQ ID NO: 2444122 - protein, 7 aa, Entamoeba dispar
LSKDSTI

SEQ ID NO: 2444123 - protein, 12 aa, Entamoeba dispar
LSKDTKKSIAET

SEQ ID NO: 2444124 - protein, 11 aa, Entamoeba dispar
LSKEDYAGKQA

SEQ ID NO: 2444125 - protein, 25 aa, Entamoeba dispar
LSKEPAVKKKIKQEVSENKNTKVKN

SEQ ID NO: 2444126 - protein, 12 aa, Entamoeba dispar
LSKEQEKKEGDK

SEQ ID NO: 2444127 - protein, 9 aa, Entamoeba dispar
LSKERLNTP

SEQ ID NO: 2444128 - protein, 17 aa, Entamoeba dispar
LSKKAKNIEGKKQWPYS

SEQ ID NO: 2444129 - protein, 5 aa, Entamoeba dispar
LSKKG

SEQ ID NO: 2444130 - protein, 9 aa, Entamoeba dispar
LSKKKEGRT

SEQ ID NO: 2444131 - protein, 19 aa, Entamoeba dispar
LSKKKGASTIRVPQGEEPH

SEQ ID NO: 2444132 - protein, 23 aa, Entamoeba dispar
LSKKKGTKKGSSKGKKGKVTSEV

SEQ ID NO: 2444133 - protein, 9 aa, Entamoeba dispar
LSKKSNDPE

SEQ ID NO: 2444134 - protein, 47 aa, Entamoeba dispar
LSKKSRQKRKQELKQERKKGANSKKPKKEKPVRVTRSRKHQGVPKAI

SEQ ID NO: 2444135 - protein, 4 aa, Entamoeba dispar
LSKL

SEQ ID NO: 2444136 - protein, 14 aa, Entamoeba dispar
LSKLSKNGIAKQVR

SEQ ID NO: 2444137 - protein, 5 aa, Entamoeba dispar
LSKND

SEQ ID NO: 2444138 - protein, 7 aa, Entamoeba dispar
LSKNEEK

SEQ ID NO: 2444139 - protein, 8 aa, Entamoeba dispar
LSKNGSEY

SEQ ID NO: 2444140 - protein, 11 aa, Entamoeba dispar
LSKNSKLYEAQ

SEQ ID NO: 2444141 - protein, 9 aa, Entamoeba dispar
LSKNSSEQP

SEQ ID NO: 2444142 - protein, 12 aa, Entamoeba dispar
LSKQNNSQNQID

SEQ ID NO: 2444143 - protein, 28 aa, Entamoeba dispar
LSKQQEHKQENTTESNQITTSVSQIGEI

SEQ ID NO: 2444144 - protein, 12 aa, Entamoeba dispar
LSKQSVDEQQQE

SEQ ID NO: 2444145 - protein, 9 aa, Entamoeba dispar
LSKRNKQTF

SEQ ID NO: 2444146 - protein, 13 aa, Entamoeba dispar
LSKRTKREQRDSL

SEQ ID NO: 2444147 - protein, 10 aa, Entamoeba dispar
LSKSEEKEIS

SEQ ID NO: 2444148 - protein, 7 aa, Entamoeba dispar
LSKSGED

SEQ ID NO: 2444149 - protein, 11 aa, Entamoeba dispar
LSKSKDEIDPK

SEQ ID NO: 2444150 - protein, 10 aa, Entamoeba dispar
LSKSLNPDNV

SEQ ID NO: 2444151 - protein, 4 aa, Entamoeba dispar
LSKT

SEQ ID NO: 2444152 - protein, 7 aa, Entamoeba dispar
LSKTASK

SEQ ID NO: 2444153 - protein, 8 aa, Entamoeba dispar
LSKTHAGA

SEQ ID NO: 2444154 - protein, 21 aa, Entamoeba dispar
LSKTPVKAPHVRTSLTGEKPY

SEQ ID NO: 2444155 - protein, 44 aa, Entamoeba dispar
LSLEETETTTTPTENQQHQESTTVVQTKQKENGPNNTPSKKRFD

SEQ ID NO: 2444156 - protein, 10 aa, Entamoeba dispar
LSLQAKRDSF

SEQ ID NO: 2444157 - protein, 11 aa, Entamoeba dispar
LSLSPSTSHWS

SEQ ID NO: 2444158 - protein, 4 aa, Entamoeba dispar
LSMN

SEQ ID NO: 2444159 - protein, 12 aa, Entamoeba dispar
LSNAVDKAENID

SEQ ID NO: 2444160 - protein, 13 aa, Entamoeba dispar
LSNDIETQLPKTI

SEQ ID NO: 2444161 - protein, 8 aa, Entamoeba dispar
LSNDPEIS

SEQ ID NO: 2444162 - protein, 14 aa, Entamoeba dispar
LSNDSQKIEEGITN

SEQ ID NO: 2444163 - protein, 6 aa, Entamoeba dispar
LSNDTI

SEQ ID NO: 2444164 - protein, 7 aa, Entamoeba dispar
LSNEAQK

SEQ ID NO: 2444165 - protein, 8 aa, Entamoeba dispar
LSNEDEGV

SEQ ID NO: 2444166 - protein, 26 aa, Entamoeba dispar
LSNEDKQKKESAPKKRLTAKEKRANR

SEQ ID NO: 2444167 - protein, 5 aa, Entamoeba dispar
LSNEE

SEQ ID NO: 2444168 - protein, 6 aa, Entamoeba dispar
LSNEGL

SEQ ID NO: 2444169 - protein, 19 aa, Entamoeba dispar
LSNELNNKHKQLNDSIKGI

SEQ ID NO: 2444170 - protein, 10 aa, Entamoeba dispar
LSNENQKYFN

SEQ ID NO: 2444171 - protein, 5 aa, Entamoeba dispar
LSNEP

SEQ ID NO: 2444172 - protein, 7 aa, Entamoeba dispar
LSNEPSL

SEQ ID NO: 2444173 - protein, 9 aa, Entamoeba dispar
LSNEQKNYM

SEQ ID NO: 2444174 - protein, 16 aa, Entamoeba dispar
LSNETNNKSKKNQSYK

SEQ ID NO: 2444175 - protein, 8 aa, Entamoeba dispar
LSNGDTVQ

SEQ ID NO: 2444176 - protein, 7 aa, Entamoeba dispar
LSNGEFE

SEQ ID NO: 2444177 - protein, 11 aa, Entamoeba dispar
LSNGTAQPIQQ

SEQ ID NO: 2444178 - protein, 9 aa, Entamoeba dispar
LSNKESSPL

SEQ ID NO: 2444179 - protein, 9 aa, Entamoeba dispar
LSNKSKTTK

SEQ ID NO: 2444180 - protein, 14 aa, Entamoeba dispar
LSNKVKDAFRENGV

SEQ ID NO: 2444181 - protein, 6 aa, Entamoeba dispar
LSNNDM

SEQ ID NO: 2444182 - protein, 9 aa, Entamoeba dispar
LSNNENVSN

SEQ ID NO: 2444183 - protein, 19 aa, Entamoeba dispar
LSNNESPSLMPTPTKPNKM

SEQ ID NO: 2444184 - protein, 12 aa, Entamoeba dispar
LSNNKINDFPTE

SEQ ID NO: 2444185 - protein, 5 aa, Entamoeba dispar
LSNNN

SEQ ID NO: 2444186 - protein, 5 aa, Entamoeba dispar
LSNNQ

SEQ ID NO: 2444187 - protein, 21 aa, Entamoeba dispar
LSNNTNESKKDSSKQQEDDNE

SEQ ID NO: 2444188 - protein, 7 aa, Entamoeba dispar
LSNPASL

SEQ ID NO: 2444189 - protein, 9 aa, Entamoeba dispar
LSNPDASSD

SEQ ID NO: 2444190 - protein, 8 aa, Entamoeba dispar
LSNPDNDE

SEQ ID NO: 2444191 - protein, 13 aa, Entamoeba dispar
LSNPLDENDDSDK

SEQ ID NO: 2444192 - protein, 10 aa, Entamoeba dispar
LSNPTTDCTS

SEQ ID NO: 2444193 - protein, 5 aa, Entamoeba dispar
LSNQF

SEQ ID NO: 2444194 - protein, 10 aa, Entamoeba dispar
LSNQKSGEII

SEQ ID NO: 2444195 - protein, 19 aa, Entamoeba dispar
LSNQSSEKSIYGKSKQRQK

SEQ ID NO: 2444196 - protein, 5 aa, Entamoeba dispar
LSNSI

SEQ ID NO: 2444197 - protein, 8 aa, Entamoeba dispar
LSNSSLNT

SEQ ID NO: 2444198 - protein, 8 aa, Entamoeba dispar
LSNSTLGI

SEQ ID NO: 2444199 - protein, 10 aa, Entamoeba dispar
LSNSTNIPTE

SEQ ID NO: 2444200 - protein, 7 aa, Entamoeba dispar
LSNTNDK

SEQ ID NO: 2444201 - protein, 9 aa, Entamoeba dispar
LSNTNEKKQ

SEQ ID NO: 2444202 - protein, 5 aa, Entamoeba dispar
LSNTS

SEQ ID NO: 2444203 - protein, 11 aa, Entamoeba dispar
LSNTSPQNEIK

SEQ ID NO: 2444204 - protein, 40 aa, Entamoeba dispar
LSNTSSNQSFIENESEEEEKNTQENDTQKITAKTQTKNII

SEQ ID NO: 2444205 - protein, 4 aa, Entamoeba dispar
LSNV

SEQ ID NO: 2444206 - protein, 14 aa, Entamoeba dispar
LSNYDDDEDDYAKY

SEQ ID NO: 2444207 - protein, 8 aa, Entamoeba dispar
LSPATRTT

SEQ ID NO: 2444208 - protein, 9 aa, Entamoeba dispar
LSPDEQSKP

SEQ ID NO: 2444209 - protein, 6 aa, Entamoeba dispar
LSPDGD

SEQ ID NO: 2444210 - protein, 5 aa, Entamoeba dispar
LSPDS

SEQ ID NO: 2444211 - protein, 25 aa, Entamoeba dispar
LSPDTKEERIKELEEQTSKLQNTQD

SEQ ID NO: 2444212 - protein, 6 aa, Entamoeba dispar
LSPEIK

SEQ ID NO: 2444213 - protein, 8 aa, Entamoeba dispar
LSPEKKPF

SEQ ID NO: 2444214 - protein, 11 aa, Entamoeba dispar
LSPEPLNTQQR

SEQ ID NO: 2444215 - protein, 5 aa, Entamoeba dispar
LSPEQ

SEQ ID NO: 2444216 - protein, 8 aa, Entamoeba dispar
LSPESKPF

SEQ ID NO: 2444217 - protein, 6 aa, Entamoeba dispar
LSPFQG

SEQ ID NO: 2444218 - protein, 8 aa, Entamoeba dispar
LSPGFKKG

SEQ ID NO: 2444219 - protein, 13 aa, Entamoeba dispar
LSPGRGIRETTQF

SEQ ID NO: 2444220 - protein, 6 aa, Entamoeba dispar
LSPGVD

SEQ ID NO: 2444221 - protein, 6 aa, Entamoeba dispar
LSPKDF

SEQ ID NO: 2444222 - protein, 133 aa, Entamoeba dispar
LSPKGVAAPPSSTPTAAPPPPSGVTSVPPPPPPPGVTSVPPPPPPGVTSVPPPPPPPGMPGMPPPPPLPGVPGMPPPPPPPGMPGMPPPPPGMPGMPPPPPGMPGMPPPPPGMPGMPPPPPGMPGMPPPPPGF

SEQ ID NO: 2444223 - protein, 6 aa, Entamoeba dispar
LSPKVR

SEQ ID NO: 2444224 - protein, 6 aa, Entamoeba dispar
LSPLEK

SEQ ID NO: 2444225 - protein, 9 aa, Entamoeba dispar
LSPLNQTNH

SEQ ID NO: 2444226 - protein, 10 aa, Entamoeba dispar
LSPNDSCQSL

SEQ ID NO: 2444227 - protein, 6 aa, Entamoeba dispar
LSPNEI

SEQ ID NO: 2444228 - protein, 5 aa, Entamoeba dispar
LSPNH

SEQ ID NO: 2444229 - protein, 5 aa, Entamoeba dispar
LSPNY

SEQ ID NO: 2444230 - protein, 7 aa, Entamoeba dispar
LSPPIAK

SEQ ID NO: 2444231 - protein, 5 aa, Entamoeba dispar
LSPPL

SEQ ID NO: 2444232 - protein, 7 aa, Entamoeba dispar
LSPPPNC

SEQ ID NO: 2444233 - protein, 9 aa, Entamoeba dispar
LSPPSYHSS

SEQ ID NO: 2444234 - protein, 5 aa, Entamoeba dispar
LSPQD

SEQ ID NO: 2444235 - protein, 6 aa, Entamoeba dispar
LSPQES

SEQ ID NO: 2444236 - protein, 10 aa, Entamoeba dispar
LSPQLSQQQQ

SEQ ID NO: 2444237 - protein, 44 aa, Entamoeba dispar
LSPQPRKEEESITKTEKEEENINKTEKKEDDLEKTITQSNMEEQ

SEQ ID NO: 2444238 - protein, 5 aa, Entamoeba dispar
LSPQT

SEQ ID NO: 2444239 - protein, 4 aa, Entamoeba dispar
LSPR

SEQ ID NO: 2444240 - protein, 6 aa, Entamoeba dispar
LSPRDL

SEQ ID NO: 2444241 - protein, 16 aa, Entamoeba dispar
LSPRRRGNSSGEYEKL

SEQ ID NO: 2444242 - protein, 14 aa, Entamoeba dispar
LSPRSSSQSKKSPD

SEQ ID NO: 2444243 - protein, 13 aa, Entamoeba dispar
LSPRVNDKNKYYS

SEQ ID NO: 2444244 - protein, 12 aa, Entamoeba dispar
LSPSAVKSGYDL

SEQ ID NO: 2444245 - protein, 7 aa, Entamoeba dispar
LSPSLKK

SEQ ID NO: 2444246 - protein, 10 aa, Entamoeba dispar
LSPSNNIPNI

SEQ ID NO: 2444247 - protein, 16 aa, Entamoeba dispar
LSPSPMGSSASSLRNS

SEQ ID NO: 2444248 - protein, 8 aa, Entamoeba dispar
LSPSPSDW

SEQ ID NO: 2444249 - protein, 11 aa, Entamoeba dispar
LSPSSESQHRS

SEQ ID NO: 2444250 - protein, 5 aa, Entamoeba dispar
LSPSV

SEQ ID NO: 2444251 - protein, 10 aa, Entamoeba dispar
LSPSVQSQTS

SEQ ID NO: 2444252 - protein, 5 aa, Entamoeba dispar
LSPTL

SEQ ID NO: 2444253 - protein, 10 aa, Entamoeba dispar
LSPTNPGETK

SEQ ID NO: 2444254 - protein, 10 aa, Entamoeba dispar
LSPTTSSQIS

SEQ ID NO: 2444255 - protein, 67 aa, Entamoeba dispar
LSPVEEKNEEITQKEEETTKAEDKKEETTKGEEKNKETVKAEDKNVENKTTQKDEKNKKENDDRTKN

SEQ ID NO: 2444256 - protein, 6 aa, Entamoeba dispar
LSPVEV

SEQ ID NO: 2444257 - protein, 4 aa, Entamoeba dispar
LSPY

SEQ ID NO: 2444258 - protein, 5 aa, Entamoeba dispar
LSQAI

SEQ ID NO: 2444259 - protein, 4 aa, Entamoeba dispar
LSQE

SEQ ID NO: 2444260 - protein, 9 aa, Entamoeba dispar
LSQEGLELK

SEQ ID NO: 2444261 - protein, 6 aa, Entamoeba dispar
LSQEKL

SEQ ID NO: 2444262 - protein, 6 aa, Entamoeba dispar
LSQESD

SEQ ID NO: 2444263 - protein, 5 aa, Entamoeba dispar
LSQFN

SEQ ID NO: 2444264 - protein, 5 aa, Entamoeba dispar
LSQKE

SEQ ID NO: 2444265 - protein, 5 aa, Entamoeba dispar
LSQKQ

SEQ ID NO: 2444266 - protein, 9 aa, Entamoeba dispar
LSQKSINPT

SEQ ID NO: 2444267 - protein, 13 aa, Entamoeba dispar
LSQKTQNWIVQNW

SEQ ID NO: 2444268 - protein, 8 aa, Entamoeba dispar
LSQKYSQK

SEQ ID NO: 2444269 - protein, 13 aa, Entamoeba dispar
LSQNDNKCNEYGK

SEQ ID NO: 2444270 - protein, 5 aa, Entamoeba dispar
LSQNE

SEQ ID NO: 2444271 - protein, 9 aa, Entamoeba dispar
LSQNKISDG

SEQ ID NO: 2444272 - protein, 29 aa, Entamoeba dispar
LSQNKPTQLQLSNSNTSQLQETSSAQITQ

SEQ ID NO: 2444273 - protein, 14 aa, Entamoeba dispar
LSQNKRIPRKCFNK

SEQ ID NO: 2444274 - protein, 4 aa, Entamoeba dispar
LSQP

SEQ ID NO: 2444275 - protein, 6 aa, Entamoeba dispar
LSQPQS

SEQ ID NO: 2444276 - protein, 10 aa, Entamoeba dispar
LSQPTSPESM

SEQ ID NO: 2444277 - protein, 8 aa, Entamoeba dispar
LSQQKKID

SEQ ID NO: 2444278 - protein, 6 aa, Entamoeba dispar
LSQQTM

SEQ ID NO: 2444279 - protein, 9 aa, Entamoeba dispar
LSQREGYQQ

SEQ ID NO: 2444280 - protein, 28 aa, Entamoeba dispar
LSQSEFNKVQEELKEIKENKTVKELKEQ

SEQ ID NO: 2444281 - protein, 5 aa, Entamoeba dispar
LSQSG

SEQ ID NO: 2444282 - protein, 20 aa, Entamoeba dispar
LSQSKKIRKSTTTLNKERTR

SEQ ID NO: 2444283 - protein, 8 aa, Entamoeba dispar
LSQSKTKL

SEQ ID NO: 2444284 - protein, 8 aa, Entamoeba dispar
LSQSMKEK

SEQ ID NO: 2444285 - protein, 16 aa, Entamoeba dispar
LSQSPPEGISACPDED

SEQ ID NO: 2444286 - protein, 6 aa, Entamoeba dispar
LSQSRG

SEQ ID NO: 2444287 - protein, 4 aa, Entamoeba dispar
LSQT

SEQ ID NO: 2444288 - protein, 9 aa, Entamoeba dispar
LSQTATALD

SEQ ID NO: 2444289 - protein, 19 aa, Entamoeba dispar
LSQTEYSGDIGYTPLSTYD

SEQ ID NO: 2444290 - protein, 5 aa, Entamoeba dispar
LSQTM

SEQ ID NO: 2444291 - protein, 8 aa, Entamoeba dispar
LSQTPPAR

SEQ ID NO: 2444292 - protein, 12 aa, Entamoeba dispar
LSQTTIKEDIKE

SEQ ID NO: 2444293 - protein, 4 aa, Entamoeba dispar
LSQV

SEQ ID NO: 2444294 - protein, 18 aa, Entamoeba dispar
LSQVNGNISETTSLNEAN

SEQ ID NO: 2444295 - protein, 39 aa, Entamoeba dispar
LSQVSQNTSQMNVSQGSGQGTFPPTRKQKVTKDKKMSMS

SEQ ID NO: 2444296 - protein, 7 aa, Entamoeba dispar
LSREKSR

SEQ ID NO: 2444297 - protein, 16 aa, Entamoeba dispar
LSRIPTKSVKDRHEKI

SEQ ID NO: 2444298 - protein, 6 aa, Entamoeba dispar
LSRKTM

SEQ ID NO: 2444299 - protein, 6 aa, Entamoeba dispar
LSRNDT

SEQ ID NO: 2444300 - protein, 7 aa, Entamoeba dispar
LSRNGTI

SEQ ID NO: 2444301 - protein, 8 aa, Entamoeba dispar
LSRPSELY

SEQ ID NO: 2444302 - protein, 9 aa, Entamoeba dispar
LSRPTNNKL

SEQ ID NO: 2444303 - protein, 5 aa, Entamoeba dispar
LSRQE

SEQ ID NO: 2444304 - protein, 6 aa, Entamoeba dispar
LSRQSD

SEQ ID NO: 2444305 - protein, 14 aa, Entamoeba dispar
LSRQTADGNYTTQS

SEQ ID NO: 2444306 - protein, 10 aa, Entamoeba dispar
LSRRSGKAMQ

SEQ ID NO: 2444307 - protein, 5 aa, Entamoeba dispar
LSRSD

SEQ ID NO: 2444308 - protein, 6 aa, Entamoeba dispar
LSRSDP

SEQ ID NO: 2444309 - protein, 4 aa, Entamoeba dispar
LSRT

SEQ ID NO: 2444310 - protein, 12 aa, Entamoeba dispar
LSRTSTYESITN

SEQ ID NO: 2444311 - protein, 6 aa, Entamoeba dispar
LSSDAG

SEQ ID NO: 2444312 - protein, 7 aa, Entamoeba dispar
LSSDDPL

SEQ ID NO: 2444313 - protein, 7 aa, Entamoeba dispar
LSSDEPL

SEQ ID NO: 2444314 - protein, 9 aa, Entamoeba dispar
LSSDGSITS

SEQ ID NO: 2444315 - protein, 7 aa, Entamoeba dispar
LSSDITS

SEQ ID NO: 2444316 - protein, 10 aa, Entamoeba dispar
LSSDKKPDEC

SEQ ID NO: 2444317 - protein, 5 aa, Entamoeba dispar
LSSDM

SEQ ID NO: 2444318 - protein, 5 aa, Entamoeba dispar
LSSDN

SEQ ID NO: 2444319 - protein, 6 aa, Entamoeba dispar
LSSDPI

SEQ ID NO: 2444320 - protein, 11 aa, Entamoeba dispar
LSSDTKKPTYV

SEQ ID NO: 2444321 - protein, 10 aa, Entamoeba dispar
LSSECNSELE

SEQ ID NO: 2444322 - protein, 11 aa, Entamoeba dispar
LSSEGKNNKED

SEQ ID NO: 2444323 - protein, 13 aa, Entamoeba dispar
LSSEHEPSPFPSS

SEQ ID NO: 2444324 - protein, 7 aa, Entamoeba dispar
LSSEKAR

SEQ ID NO: 2444325 - protein, 19 aa, Entamoeba dispar
LSSERNSPNKENKKVIETK

SEQ ID NO: 2444326 - protein, 6 aa, Entamoeba dispar
LSSESE

SEQ ID NO: 2444327 - protein, 4 aa, Entamoeba dispar
LSSG

SEQ ID NO: 2444328 - protein, 8 aa, Entamoeba dispar
LSSGDEKV

SEQ ID NO: 2444329 - protein, 7 aa, Entamoeba dispar
LSSGESK

SEQ ID NO: 2444330 - protein, 5 aa, Entamoeba dispar
LSSGT

SEQ ID NO: 2444331 - protein, 10 aa, Entamoeba dispar
LSSIKNGNLR

SEQ ID NO: 2444332 - protein, 14 aa, Entamoeba dispar
LSSIKQWKEQCILS

SEQ ID NO: 2444333 - protein, 8 aa, Entamoeba dispar
LSSIQTQT

SEQ ID NO: 2444334 - protein, 9 aa, Entamoeba dispar
LSSKEQVEE

SEQ ID NO: 2444335 - protein, 6 aa, Entamoeba dispar
LSSKIS

SEQ ID NO: 2444336 - protein, 5 aa, Entamoeba dispar
LSSKK

SEQ ID NO: 2444337 - protein, 7 aa, Entamoeba dispar
LSSKKKE

SEQ ID NO: 2444338 - protein, 17 aa, Entamoeba dispar
LSSKKNEVMSASTEGTV

SEQ ID NO: 2444339 - protein, 10 aa, Entamoeba dispar
LSSKNSTIRK

SEQ ID NO: 2444340 - protein, 7 aa, Entamoeba dispar
LSSKSEL

SEQ ID NO: 2444341 - protein, 11 aa, Entamoeba dispar
LSSKSSEDEKR

SEQ ID NO: 2444342 - protein, 9 aa, Entamoeba dispar
LSSKSTPIV

SEQ ID NO: 2444343 - protein, 24 aa, Entamoeba dispar
LSSLKKRTKREISHDKKIKPNKRI

SEQ ID NO: 2444344 - protein, 11 aa, Entamoeba dispar
LSSNEKKNENL

SEQ ID NO: 2444345 - protein, 12 aa, Entamoeba dispar
LSSNEKNESNGF

SEQ ID NO: 2444346 - protein, 9 aa, Entamoeba dispar
LSSNKDSLN

SEQ ID NO: 2444347 - protein, 7 aa, Entamoeba dispar
LSSNNDS

SEQ ID NO: 2444348 - protein, 9 aa, Entamoeba dispar
LSSNTSPLN

SEQ ID NO: 2444349 - protein, 18 aa, Entamoeba dispar
LSSNTSSITSSSTQSTPC

SEQ ID NO: 2444350 - protein, 10 aa, Entamoeba dispar
LSSPDRTTQR

SEQ ID NO: 2444351 - protein, 8 aa, Entamoeba dispar
LSSPEQVK

SEQ ID NO: 2444352 - protein, 5 aa, Entamoeba dispar
LSSPI

SEQ ID NO: 2444353 - protein, 8 aa, Entamoeba dispar
LSSPPPHL

SEQ ID NO: 2444354 - protein, 9 aa, Entamoeba dispar
LSSPQFEEN

SEQ ID NO: 2444355 - protein, 6 aa, Entamoeba dispar
LSSPVK

SEQ ID NO: 2444356 - protein, 7 aa, Entamoeba dispar
LSSQREK

SEQ ID NO: 2444357 - protein, 4 aa, Entamoeba dispar
LSSS

SEQ ID NO: 2444358 - protein, 22 aa, Entamoeba dispar
LSSSDDSSDFIETNSNEESLTK

SEQ ID NO: 2444359 - protein, 8 aa, Entamoeba dispar
LSSSGRRK

SEQ ID NO: 2444360 - protein, 6 aa, Entamoeba dispar
LSSSLA

SEQ ID NO: 2444361 - protein, 7 aa, Entamoeba dispar
LSSSLDG

SEQ ID NO: 2444362 - protein, 14 aa, Entamoeba dispar
LSSSMNKKVEDLEK

SEQ ID NO: 2444363 - protein, 5 aa, Entamoeba dispar
LSSSN

SEQ ID NO: 2444364 - protein, 13 aa, Entamoeba dispar
LSSSPDGKYTGIG

SEQ ID NO: 2444365 - protein, 8 aa, Entamoeba dispar
LSSSPKAF

SEQ ID NO: 2444366 - protein, 14 aa, Entamoeba dispar
LSSSSGSRRQEAQR

SEQ ID NO: 2444367 - protein, 9 aa, Entamoeba dispar
LSSSSPNIK

SEQ ID NO: 2444368 - protein, 8 aa, Entamoeba dispar
LSSSTSLG

SEQ ID NO: 2444369 - protein, 7 aa, Entamoeba dispar
LSSSVNK

SEQ ID NO: 2444370 - protein, 4 aa, Entamoeba dispar
LSST

SEQ ID NO: 2444371 - protein, 5 aa, Entamoeba dispar
LSSTG

SEQ ID NO: 2444372 - protein, 15 aa, Entamoeba dispar
LSSTKSPLQTDLNPD

SEQ ID NO: 2444373 - protein, 12 aa, Entamoeba dispar
LSSTNDLASNKA

SEQ ID NO: 2444374 - protein, 6 aa, Entamoeba dispar
LSSTNK

SEQ ID NO: 2444375 - protein, 8 aa, Entamoeba dispar
LSSTNKDN

SEQ ID NO: 2444376 - protein, 10 aa, Entamoeba dispar
LSSTPNNSSE

SEQ ID NO: 2444377 - protein, 12 aa, Entamoeba dispar
LSSTPRAQPRLG

SEQ ID NO: 2444378 - protein, 9 aa, Entamoeba dispar
LSSTPSISP

SEQ ID NO: 2444379 - protein, 8 aa, Entamoeba dispar
LSSTSCNE

SEQ ID NO: 2444380 - protein, 7 aa, Entamoeba dispar
LSSTSSI

SEQ ID NO: 2444381 - protein, 9 aa, Entamoeba dispar
LSSYSPNNQ

SEQ ID NO: 2444382 - protein, 8 aa, Entamoeba dispar
LSSYTYST

SEQ ID NO: 2444383 - protein, 9 aa, Entamoeba dispar
LSTAQTAAF

SEQ ID NO: 2444384 - protein, 6 aa, Entamoeba dispar
LSTASS

SEQ ID NO: 2444385 - protein, 11 aa, Entamoeba dispar
LSTDDSIELNQ

SEQ ID NO: 2444386 - protein, 8 aa, Entamoeba dispar
LSTDEPHQ

SEQ ID NO: 2444387 - protein, 7 aa, Entamoeba dispar
LSTDQVT

SEQ ID NO: 2444388 - protein, 5 aa, Entamoeba dispar
LSTDT

SEQ ID NO: 2444389 - protein, 8 aa, Entamoeba dispar
LSTEQQKK

SEQ ID NO: 2444390 - protein, 6 aa, Entamoeba dispar
LSTESQ

SEQ ID NO: 2444391 - protein, 7 aa, Entamoeba dispar
LSTGDEK

SEQ ID NO: 2444392 - protein, 8 aa, Entamoeba dispar
LSTGKRDL

SEQ ID NO: 2444393 - protein, 6 aa, Entamoeba dispar
LSTGTI

SEQ ID NO: 2444394 - protein, 16 aa, Entamoeba dispar
LSTKDDKKDKKRLKKQ

SEQ ID NO: 2444395 - protein, 24 aa, Entamoeba dispar
LSTKEMQKSSRQVSPKLSPVQSPN

SEQ ID NO: 2444396 - protein, 7 aa, Entamoeba dispar
LSTKIKE

SEQ ID NO: 2444397 - protein, 7 aa, Entamoeba dispar
LSTKLDH

SEQ ID NO: 2444398 - protein, 11 aa, Entamoeba dispar
LSTKTSKSERF

SEQ ID NO: 2444399 - protein, 4 aa, Entamoeba dispar
LSTL

SEQ ID NO: 2444400 - protein, 8 aa, Entamoeba dispar
LSTNEDGD

SEQ ID NO: 2444401 - protein, 7 aa, Entamoeba dispar
LSTNHRN

SEQ ID NO: 2444402 - protein, 7 aa, Entamoeba dispar
LSTNKDV

SEQ ID NO: 2444403 - protein, 8 aa, Entamoeba dispar
LSTNKPTD

SEQ ID NO: 2444404 - protein, 8 aa, Entamoeba dispar
LSTNKSNN

SEQ ID NO: 2444405 - protein, 9 aa, Entamoeba dispar
LSTNKSTDI

SEQ ID NO: 2444406 - protein, 9 aa, Entamoeba dispar
LSTNPKATL

SEQ ID NO: 2444407 - protein, 10 aa, Entamoeba dispar
LSTNQIEKCP

SEQ ID NO: 2444408 - protein, 11 aa, Entamoeba dispar
LSTNTKKEKSD

SEQ ID NO: 2444409 - protein, 8 aa, Entamoeba dispar
LSTPEGEK

SEQ ID NO: 2444410 - protein, 12 aa, Entamoeba dispar
LSTPGNSNAKPI

SEQ ID NO: 2444411 - protein, 26 aa, Entamoeba dispar
LSTPPPTTKPVKSTTKKEKVREPPPV

SEQ ID NO: 2444412 - protein, 7 aa, Entamoeba dispar
LSTPQIG

SEQ ID NO: 2444413 - protein, 8 aa, Entamoeba dispar
LSTPQQKQ

SEQ ID NO: 2444414 - protein, 4 aa, Entamoeba dispar
LSTQ

SEQ ID NO: 2444415 - protein, 6 aa, Entamoeba dispar
LSTQHQ

SEQ ID NO: 2444416 - protein, 6 aa, Entamoeba dispar
LSTQNA

SEQ ID NO: 2444417 - protein, 5 aa, Entamoeba dispar
LSTQQ

SEQ ID NO: 2444418 - protein, 4 aa, Entamoeba dispar
LSTR

SEQ ID NO: 2444419 - protein, 8 aa, Entamoeba dispar
LSTRNEKK

SEQ ID NO: 2444420 - protein, 4 aa, Entamoeba dispar
LSTS

SEQ ID NO: 2444421 - protein, 9 aa, Entamoeba dispar
LSTSKELST

SEQ ID NO: 2444422 - protein, 19 aa, Entamoeba dispar
LSTSLPTTTQKKTTLTRQT

SEQ ID NO: 2444423 - protein, 7 aa, Entamoeba dispar
LSTSQEI

SEQ ID NO: 2444424 - protein, 5 aa, Entamoeba dispar
LSTSS

SEQ ID NO: 2444425 - protein, 27 aa, Entamoeba dispar
LSTSSKYTMEADEEKLTIGKRSKKSVT

SEQ ID NO: 2444426 - protein, 4 aa, Entamoeba dispar
LSTT

SEQ ID NO: 2444427 - protein, 6 aa, Entamoeba dispar
LSTTKE

SEQ ID NO: 2444428 - protein, 11 aa, Entamoeba dispar
LSTTKEHSHTI

SEQ ID NO: 2444429 - protein, 7 aa, Entamoeba dispar
LSTTPNH

SEQ ID NO: 2444430 - protein, 14 aa, Entamoeba dispar
LSVKKNSLEPQTSS

SEQ ID NO: 2444431 - protein, 11 aa, Entamoeba dispar
LSVSTKPEKVA

SEQ ID NO: 2444432 - protein, 4 aa, Entamoeba dispar
LSYA

SEQ ID NO: 2444433 - protein, 4 aa, Entamoeba dispar
LSYD

SEQ ID NO: 2444434 - protein, 9 aa, Entamoeba dispar
LSYDASKSD

SEQ ID NO: 2444435 - protein, 7 aa, Entamoeba dispar
LSYNNPE

SEQ ID NO: 2444436 - protein, 5 aa, Entamoeba dispar
LSYPE

SEQ ID NO: 2444437 - protein, 6 aa, Entamoeba dispar
LSYPGT

SEQ ID NO: 2444438 - protein, 4 aa, Entamoeba dispar
LSYS

SEQ ID NO: 2444439 - protein, 7 aa, Entamoeba dispar
LSYTTTT

SEQ ID NO: 2444440 - protein, 9 aa, Entamoeba dispar
LTANSTKDS

SEQ ID NO: 2444441 - protein, 9 aa, Entamoeba dispar
LTATRGEDK

SEQ ID NO: 2444442 - protein, 8 aa, Entamoeba dispar
LTAYEKGG

SEQ ID NO: 2444443 - protein, 6 aa, Entamoeba dispar
LTDDNY

SEQ ID NO: 2444444 - protein, 7 aa, Entamoeba dispar
LTDEDGY

SEQ ID NO: 2444445 - protein, 27 aa, Entamoeba dispar
LTDEETNNEFTSVENSPPSKSHYSKET

SEQ ID NO: 2444446 - protein, 5 aa, Entamoeba dispar
LTDEN

SEQ ID NO: 2444447 - protein, 11 aa, Entamoeba dispar
LTDENKELNKR

SEQ ID NO: 2444448 - protein, 10 aa, Entamoeba dispar
LTDGEEEGEY

SEQ ID NO: 2444449 - protein, 10 aa, Entamoeba dispar
LTDGKPGTKV

SEQ ID NO: 2444450 - protein, 5 aa, Entamoeba dispar
LTDKE

SEQ ID NO: 2444451 - protein, 11 aa, Entamoeba dispar
LTDKKKSQIER

SEQ ID NO: 2444452 - protein, 7 aa, Entamoeba dispar
LTDNGKE

SEQ ID NO: 2444453 - protein, 5 aa, Entamoeba dispar
LTDNL

SEQ ID NO: 2444454 - protein, 11 aa, Entamoeba dispar
LTDNNSVNNGS

SEQ ID NO: 2444455 - protein, 5 aa, Entamoeba dispar
LTDNP

SEQ ID NO: 2444456 - protein, 10 aa, Entamoeba dispar
LTDNPSYYKK

SEQ ID NO: 2444457 - protein, 6 aa, Entamoeba dispar
LTDNRV

SEQ ID NO: 2444458 - protein, 5 aa, Entamoeba dispar
LTDNS

SEQ ID NO: 2444459 - protein, 11 aa, Entamoeba dispar
LTDPKDGSYPN

SEQ ID NO: 2444460 - protein, 15 aa, Entamoeba dispar
LTDQYRSWQNGSKIE

SEQ ID NO: 2444461 - protein, 12 aa, Entamoeba dispar
LTDRRTSTKKNE

SEQ ID NO: 2444462 - protein, 9 aa, Entamoeba dispar
LTDSADSNV

SEQ ID NO: 2444463 - protein, 7 aa, Entamoeba dispar
LTDSAKY

SEQ ID NO: 2444464 - protein, 5 aa, Entamoeba dispar
LTDSG

SEQ ID NO: 2444465 - protein, 6 aa, Entamoeba dispar
LTDSGG

SEQ ID NO: 2444466 - protein, 8 aa, Entamoeba dispar
LTDSPQQI

SEQ ID NO: 2444467 - protein, 10 aa, Entamoeba dispar
LTDSTKECYQ

SEQ ID NO: 2444468 - protein, 10 aa, Entamoeba dispar
LTDTEKEDLQ

SEQ ID NO: 2444469 - protein, 4 aa, Entamoeba dispar
LTEA

SEQ ID NO: 2444470 - protein, 6 aa, Entamoeba dispar
LTEDPE

SEQ ID NO: 2444471 - protein, 6 aa, Entamoeba dispar
LTEDSL

SEQ ID NO: 2444472 - protein, 5 aa, Entamoeba dispar
LTEEE

SEQ ID NO: 2444473 - protein, 28 aa, Entamoeba dispar
LTEEEKEMISNEPRKMEEDDETTPIRQE

SEQ ID NO: 2444474 - protein, 11 aa, Entamoeba dispar
LTEEEREKNSQ

SEQ ID NO: 2444475 - protein, 6 aa, Entamoeba dispar
LTEESD

SEQ ID NO: 2444476 - protein, 11 aa, Entamoeba dispar
LTEETSASGPY

SEQ ID NO: 2444477 - protein, 10 aa, Entamoeba dispar
LTEETTPTLK

SEQ ID NO: 2444478 - protein, 11 aa, Entamoeba dispar
LTEFDKSYNEK

SEQ ID NO: 2444479 - protein, 4 aa, Entamoeba dispar
LTEI

SEQ ID NO: 2444480 - protein, 10 aa, Entamoeba dispar
LTEKNKKDPM

SEQ ID NO: 2444481 - protein, 18 aa, Entamoeba dispar
LTENDNNSFRKAASRSRS

SEQ ID NO: 2444482 - protein, 6 aa, Entamoeba dispar
LTENES

SEQ ID NO: 2444483 - protein, 6 aa, Entamoeba dispar
LTENGI

SEQ ID NO: 2444484 - protein, 7 aa, Entamoeba dispar
LTENKKT

SEQ ID NO: 2444485 - protein, 8 aa, Entamoeba dispar
LTENNSRG

SEQ ID NO: 2444486 - protein, 10 aa, Entamoeba dispar
LTENPPETKY

SEQ ID NO: 2444487 - protein, 10 aa, Entamoeba dispar
LTENSKSQGI

SEQ ID NO: 2444488 - protein, 10 aa, Entamoeba dispar
LTEREDMGGI

SEQ ID NO: 2444489 - protein, 16 aa, Entamoeba dispar
LTERKERANKKEEPID

SEQ ID NO: 2444490 - protein, 8 aa, Entamoeba dispar
LTERSKAM

SEQ ID NO: 2444491 - protein, 6 aa, Entamoeba dispar
LTESHQ

SEQ ID NO: 2444492 - protein, 11 aa, Entamoeba dispar
LTESQKQPKVR

SEQ ID NO: 2444493 - protein, 5 aa, Entamoeba dispar
LTESS

SEQ ID NO: 2444494 - protein, 5 aa, Entamoeba dispar
LTESV

SEQ ID NO: 2444495 - protein, 10 aa, Entamoeba dispar
LTETEQKLES

SEQ ID NO: 2444496 - protein, 14 aa, Entamoeba dispar
LTETPKKLSKGLKE

SEQ ID NO: 2444497 - protein, 5 aa, Entamoeba dispar
LTETT

SEQ ID NO: 2444498 - protein, 5 aa, Entamoeba dispar
LTEVS

SEQ ID NO: 2444499 - protein, 12 aa, Entamoeba dispar
LTGAQNKKRFNS

SEQ ID NO: 2444500 - protein, 12 aa, Entamoeba dispar
LTGDEKEEHEGI

SEQ ID NO: 2444501 - protein, 6 aa, Entamoeba dispar
LTGDGV

SEQ ID NO: 2444502 - protein, 11 aa, Entamoeba dispar
LTGEETSKSIP

SEQ ID NO: 2444503 - protein, 5 aa, Entamoeba dispar
LTGEL

SEQ ID NO: 2444504 - protein, 16 aa, Entamoeba dispar
LTGELDTKQSSGFEVE

SEQ ID NO: 2444505 - protein, 8 aa, Entamoeba dispar
LTGHNGKV

SEQ ID NO: 2444506 - protein, 10 aa, Entamoeba dispar
LTGKDSQAKL

SEQ ID NO: 2444507 - protein, 6 aa, Entamoeba dispar
LTGKKE

SEQ ID NO: 2444508 - protein, 5 aa, Entamoeba dispar
LTGLN

SEQ ID NO: 2444509 - protein, 5 aa, Entamoeba dispar
LTGNP

SEQ ID NO: 2444510 - protein, 5 aa, Entamoeba dispar
LTGQT

SEQ ID NO: 2444511 - protein, 6 aa, Entamoeba dispar
LTGRTS

SEQ ID NO: 2444512 - protein, 10 aa, Entamoeba dispar
LTGTKKTISP

SEQ ID NO: 2444513 - protein, 9 aa, Entamoeba dispar
LTGVPKETG

SEQ ID NO: 2444514 - protein, 7 aa, Entamoeba dispar
LTHPLTT

SEQ ID NO: 2444515 - protein, 8 aa, Entamoeba dispar
LTHTPSSH

SEQ ID NO: 2444516 - protein, 6 aa, Entamoeba dispar
LTIEPS

SEQ ID NO: 2444517 - protein, 4 aa, Entamoeba dispar
LTIG

SEQ ID NO: 2444518 - protein, 12 aa, Entamoeba dispar
LTIKEEKRGTFS

SEQ ID NO: 2444519 - protein, 10 aa, Entamoeba dispar
LTINDSKEQL

SEQ ID NO: 2444520 - protein, 7 aa, Entamoeba dispar
LTISPND

SEQ ID NO: 2444521 - protein, 16 aa, Entamoeba dispar
LTKAQKEEKDIDNYHR

SEQ ID NO: 2444522 - protein, 7 aa, Entamoeba dispar
LTKDNND

SEQ ID NO: 2444523 - protein, 17 aa, Entamoeba dispar
LTKEGIYRQTKQNRTIE

SEQ ID NO: 2444524 - protein, 12 aa, Entamoeba dispar
LTKEKEQLTNEV

SEQ ID NO: 2444525 - protein, 5 aa, Entamoeba dispar
LTKEP

SEQ ID NO: 2444526 - protein, 6 aa, Entamoeba dispar
LTKEQI

SEQ ID NO: 2444527 - protein, 5 aa, Entamoeba dispar
LTKES

SEQ ID NO: 2444528 - protein, 7 aa, Entamoeba dispar
LTKGYGK

SEQ ID NO: 2444529 - protein, 8 aa, Entamoeba dispar
LTKKDSPK

SEQ ID NO: 2444530 - protein, 9 aa, Entamoeba dispar
LTKKEKIND

SEQ ID NO: 2444531 - protein, 6 aa, Entamoeba dispar
LTKKSE

SEQ ID NO: 2444532 - protein, 11 aa, Entamoeba dispar
LTKKTNTDPNS

SEQ ID NO: 2444533 - protein, 18 aa, Entamoeba dispar
LTKPLASKSSTKLETSSI

SEQ ID NO: 2444534 - protein, 8 aa, Entamoeba dispar
LTKPSEDL

SEQ ID NO: 2444535 - protein, 12 aa, Entamoeba dispar
LTKQKSNRTSIV

SEQ ID NO: 2444536 - protein, 23 aa, Entamoeba dispar
LTKRAKKEYKKQKLQRLYHLLHL

SEQ ID NO: 2444537 - protein, 23 aa, Entamoeba dispar
LTKRGFNEQKRTENVSSKIASIE

SEQ ID NO: 2444538 - protein, 7 aa, Entamoeba dispar
LTKRQRV

SEQ ID NO: 2444539 - protein, 11 aa, Entamoeba dispar
LTKSPNHSPST

SEQ ID NO: 2444540 - protein, 12 aa, Entamoeba dispar
LTKSRSTKKTQK

SEQ ID NO: 2444541 - protein, 13 aa, Entamoeba dispar
LTKSSDSVDNVVK

SEQ ID NO: 2444542 - protein, 6 aa, Entamoeba dispar
LTKSSL

SEQ ID NO: 2444543 - protein, 7 aa, Entamoeba dispar
LTKSYNK

SEQ ID NO: 2444544 - protein, 6 aa, Entamoeba dispar
LTKTTQ

SEQ ID NO: 2444545 - protein, 5 aa, Entamoeba dispar
LTLDQ

SEQ ID NO: 2444546 - protein, 11 aa, Entamoeba dispar
LTLPETKEEVA

SEQ ID NO: 2444547 - protein, 6 aa, Entamoeba dispar
LTLQGK

SEQ ID NO: 2444548 - protein, 11 aa, Entamoeba dispar
LTLSGKAKKMT

SEQ ID NO: 2444549 - protein, 18 aa, Entamoeba dispar
LTNDAQQSLRRTMETGSE

SEQ ID NO: 2444550 - protein, 8 aa, Entamoeba dispar
LTNDEKTH

SEQ ID NO: 2444551 - protein, 54 aa, Entamoeba dispar
LTNDKNTTIPGDNVSSEHTNEPPSQEIAKQKRTEEAKKPKRIKEAKKPKGIEEA

SEQ ID NO: 2444552 - protein, 63 aa, Entamoeba dispar
LTNDKNTTITGDNASSEHTNEPPSQEIAKQKRTEEAKKPKRIKEAKKPKRIKEAKKPKGIEEG

SEQ ID NO: 2444553 - protein, 5 aa, Entamoeba dispar
LTNEE

SEQ ID NO: 2444554 - protein, 19 aa, Entamoeba dispar
LTNEKNLHDTEKKKKEEEV

SEQ ID NO: 2444555 - protein, 9 aa, Entamoeba dispar
LTNEKQYKT

SEQ ID NO: 2444556 - protein, 10 aa, Entamoeba dispar
LTNEKVKGQP

SEQ ID NO: 2444557 - protein, 6 aa, Entamoeba dispar
LTNEQQ

SEQ ID NO: 2444558 - protein, 7 aa, Entamoeba dispar
LTNETKF

SEQ ID NO: 2444559 - protein, 11 aa, Entamoeba dispar
LTNGNDGINQL

SEQ ID NO: 2444560 - protein, 5 aa, Entamoeba dispar
LTNGT

SEQ ID NO: 2444561 - protein, 7 aa, Entamoeba dispar
LTNGTLR

SEQ ID NO: 2444562 - protein, 9 aa, Entamoeba dispar
LTNGTNDIE

SEQ ID NO: 2444563 - protein, 19 aa, Entamoeba dispar
LTNIQNSSSLPQDTTCDKV

SEQ ID NO: 2444564 - protein, 5 aa, Entamoeba dispar
LTNIT

SEQ ID NO: 2444565 - protein, 12 aa, Entamoeba dispar
LTNKKGDHREEF

SEQ ID NO: 2444566 - protein, 6 aa, Entamoeba dispar
LTNKKR

SEQ ID NO: 2444567 - protein, 11 aa, Entamoeba dispar
LTNNSTKKHIG

SEQ ID NO: 2444568 - protein, 8 aa, Entamoeba dispar
LTNQTEEL

SEQ ID NO: 2444569 - protein, 6 aa, Entamoeba dispar
LTNSEY

SEQ ID NO: 2444570 - protein, 13 aa, Entamoeba dispar
LTNTDIPSTVKEI

SEQ ID NO: 2444571 - protein, 8 aa, Entamoeba dispar
LTNTKEPA

SEQ ID NO: 2444572 - protein, 9 aa, Entamoeba dispar
LTNTKYDYN

SEQ ID NO: 2444573 - protein, 7 aa, Entamoeba dispar
LTNTNGK

SEQ ID NO: 2444574 - protein, 5 aa, Entamoeba dispar
LTNTQ

SEQ ID NO: 2444575 - protein, 7 aa, Entamoeba dispar
LTPCSQE

SEQ ID NO: 2444576 - protein, 7 aa, Entamoeba dispar
LTPDESN

SEQ ID NO: 2444577 - protein, 16 aa, Entamoeba dispar
LTPDLTTQPGSNTLKQ

SEQ ID NO: 2444578 - protein, 5 aa, Entamoeba dispar
LTPEE

SEQ ID NO: 2444579 - protein, 7 aa, Entamoeba dispar
LTPEELS

SEQ ID NO: 2444580 - protein, 6 aa, Entamoeba dispar
LTPEMQ

SEQ ID NO: 2444581 - protein, 7 aa, Entamoeba dispar
LTPEQKR

SEQ ID NO: 2444582 - protein, 6 aa, Entamoeba dispar
LTPFAQ

SEQ ID NO: 2444583 - protein, 7 aa, Entamoeba dispar
LTPGITG

SEQ ID NO: 2444584 - protein, 19 aa, Entamoeba dispar
LTPGTIGKDGYMNKKDAQK

SEQ ID NO: 2444585 - protein, 6 aa, Entamoeba dispar
LTPIPT

SEQ ID NO: 2444586 - protein, 6 aa, Entamoeba dispar
LTPKGL

SEQ ID NO: 2444587 - protein, 18 aa, Entamoeba dispar
LTPKSKDRNEKPISKKVD

SEQ ID NO: 2444588 - protein, 8 aa, Entamoeba dispar
LTPNVGNI

SEQ ID NO: 2444589 - protein, 6 aa, Entamoeba dispar
LTPPIH

SEQ ID NO: 2444590 - protein, 7 aa, Entamoeba dispar
LTPPPEF

SEQ ID NO: 2444591 - protein, 17 aa, Entamoeba dispar
LTPQLAPQHQNKRELSE

SEQ ID NO: 2444592 - protein, 6 aa, Entamoeba dispar
LTPQQL

SEQ ID NO: 2444593 - protein, 5 aa, Entamoeba dispar
LTPQT

SEQ ID NO: 2444594 - protein, 4 aa, Entamoeba dispar
LTPS

SEQ ID NO: 2444595 - protein, 9 aa, Entamoeba dispar
LTPSETKSI

SEQ ID NO: 2444596 - protein, 10 aa, Entamoeba dispar
LTPSKSPSSS

SEQ ID NO: 2444597 - protein, 6 aa, Entamoeba dispar
LTPSLK

SEQ ID NO: 2444598 - protein, 5 aa, Entamoeba dispar
LTPSQ

SEQ ID NO: 2444599 - protein, 6 aa, Entamoeba dispar
LTPSQS

SEQ ID NO: 2444600 - protein, 19 aa, Entamoeba dispar
LTPSQSPCPMSPVNSNNGN

SEQ ID NO: 2444601 - protein, 7 aa, Entamoeba dispar
LTPSQSY

SEQ ID NO: 2444602 - protein, 7 aa, Entamoeba dispar
LTPSYNN

SEQ ID NO: 2444603 - protein, 36 aa, Entamoeba dispar
LTPTPQDRSEDICNNENNKTNDKKEYITSSSLKTNT

SEQ ID NO: 2444604 - protein, 7 aa, Entamoeba dispar
LTPTQTN

SEQ ID NO: 2444605 - protein, 4 aa, Entamoeba dispar
LTQE

SEQ ID NO: 2444606 - protein, 22 aa, Entamoeba dispar
LTQENKNLKTDLDELTKKYEET

SEQ ID NO: 2444607 - protein, 13 aa, Entamoeba dispar
LTQESEGFEPEEI

SEQ ID NO: 2444608 - protein, 7 aa, Entamoeba dispar
LTQFNAR

SEQ ID NO: 2444609 - protein, 5 aa, Entamoeba dispar
LTQKC

SEQ ID NO: 2444610 - protein, 23 aa, Entamoeba dispar
LTQKSKSEKTEIKSEELKEEINN

SEQ ID NO: 2444611 - protein, 26 aa, Entamoeba dispar
LTQKSKSEKTEIKSEELKEEINNHEE

SEQ ID NO: 2444612 - protein, 13 aa, Entamoeba dispar
LTQNTEGFEPEEV

SEQ ID NO: 2444613 - protein, 21 aa, Entamoeba dispar
LTQPQPPQVLQQGQQQIQQTG

SEQ ID NO: 2444614 - protein, 7 aa, Entamoeba dispar
LTQPQQQ

SEQ ID NO: 2444615 - protein, 5 aa, Entamoeba dispar
LTQPS

SEQ ID NO: 2444616 - protein, 4 aa, Entamoeba dispar
LTQQ

SEQ ID NO: 2444617 - protein, 7 aa, Entamoeba dispar
LTQQEKD

SEQ ID NO: 2444618 - protein, 4 aa, Entamoeba dispar
LTQS

SEQ ID NO: 2444619 - protein, 15 aa, Entamoeba dispar
LTQSTLSSSSKSKIE

SEQ ID NO: 2444620 - protein, 9 aa, Entamoeba dispar
LTQSTPREL

SEQ ID NO: 2444621 - protein, 21 aa, Entamoeba dispar
LTQTNDNQSELVTETHEENTL

SEQ ID NO: 2444622 - protein, 12 aa, Entamoeba dispar
LTQVNDSSNTQI

SEQ ID NO: 2444623 - protein, 15 aa, Entamoeba dispar
LTRASAAQCLTHSWF

SEQ ID NO: 2444624 - protein, 5 aa, Entamoeba dispar
LTRDD

SEQ ID NO: 2444625 - protein, 32 aa, Entamoeba dispar
LTRDNQSAEEELNELRSKADKDKKKISELEEQ

SEQ ID NO: 2444626 - protein, 6 aa, Entamoeba dispar
LTREDI

SEQ ID NO: 2444627 - protein, 7 aa, Entamoeba dispar
LTRENER

SEQ ID NO: 2444628 - protein, 7 aa, Entamoeba dispar
LTREPKT

SEQ ID NO: 2444629 - protein, 6 aa, Entamoeba dispar
LTRGRS

SEQ ID NO: 2444630 - protein, 5 aa, Entamoeba dispar
LTRNG

SEQ ID NO: 2444631 - protein, 6 aa, Entamoeba dispar
LTRNQY

SEQ ID NO: 2444632 - protein, 33 aa, Entamoeba dispar
LTRPKKGVNTNESEEQDLHTQQPTEKSQQRKGF

SEQ ID NO: 2444633 - protein, 12 aa, Entamoeba dispar
LTRREETKITTV

SEQ ID NO: 2444634 - protein, 9 aa, Entamoeba dispar
LTSDDEKTI

SEQ ID NO: 2444635 - protein, 9 aa, Entamoeba dispar
LTSDEEERF

SEQ ID NO: 2444636 - protein, 6 aa, Entamoeba dispar
LTSEDI

SEQ ID NO: 2444637 - protein, 11 aa, Entamoeba dispar
LTSETKKDIES

SEQ ID NO: 2444638 - protein, 10 aa, Entamoeba dispar
LTSGGTIEDI

SEQ ID NO: 2444639 - protein, 13 aa, Entamoeba dispar
LTSGSTMMSGERS

SEQ ID NO: 2444640 - protein, 9 aa, Entamoeba dispar
LTSIPGSSA

SEQ ID NO: 2444641 - protein, 7 aa, Entamoeba dispar
LTSIPSL

SEQ ID NO: 2444642 - protein, 5 aa, Entamoeba dispar
LTSKE

SEQ ID NO: 2444643 - protein, 11 aa, Entamoeba dispar
LTSKGDKVSTI

SEQ ID NO: 2444644 - protein, 6 aa, Entamoeba dispar
LTSKKQ

SEQ ID NO: 2444645 - protein, 8 aa, Entamoeba dispar
LTSKSAKK

SEQ ID NO: 2444646 - protein, 4 aa, Entamoeba dispar
LTSL

SEQ ID NO: 2444647 - protein, 6 aa, Entamoeba dispar
LTSLPN

SEQ ID NO: 2444648 - protein, 4 aa, Entamoeba dispar
LTSM

SEQ ID NO: 2444649 - protein, 14 aa, Entamoeba dispar
LTSNDINNILIQIQ

SEQ ID NO: 2444650 - protein, 9 aa, Entamoeba dispar
LTSNDSEQI

SEQ ID NO: 2444651 - protein, 10 aa, Entamoeba dispar
LTSNKDLNKE

SEQ ID NO: 2444652 - protein, 5 aa, Entamoeba dispar
LTSNP

SEQ ID NO: 2444653 - protein, 14 aa, Entamoeba dispar
LTSPCDSQTRQSAE

SEQ ID NO: 2444654 - protein, 19 aa, Entamoeba dispar
LTSSAVERLNDKSTPVRKN

SEQ ID NO: 2444655 - protein, 8 aa, Entamoeba dispar
LTSSGDST

SEQ ID NO: 2444656 - protein, 18 aa, Entamoeba dispar
LTSSGESDNSVGSNFNGI

SEQ ID NO: 2444657 - protein, 5 aa, Entamoeba dispar
LTSST

SEQ ID NO: 2444658 - protein, 5 aa, Entamoeba dispar
LTSTN

SEQ ID NO: 2444659 - protein, 10 aa, Entamoeba dispar
LTSTNNEIEK

SEQ ID NO: 2444660 - protein, 7 aa, Entamoeba dispar
LTSTTKS

SEQ ID NO: 2444661 - protein, 5 aa, Entamoeba dispar
LTSVT

SEQ ID NO: 2444662 - protein, 13 aa, Entamoeba dispar
LTTDTIKDDEYRR

SEQ ID NO: 2444663 - protein, 4 aa, Entamoeba dispar
LTTE

SEQ ID NO: 2444664 - protein, 8 aa, Entamoeba dispar
LTTEEEIR

SEQ ID NO: 2444665 - protein, 9 aa, Entamoeba dispar
LTTEEGYQS

SEQ ID NO: 2444666 - protein, 17 aa, Entamoeba dispar
LTTEGGIKKGLKEKLAD

SEQ ID NO: 2444667 - protein, 6 aa, Entamoeba dispar
LTTEQV

SEQ ID NO: 2444668 - protein, 5 aa, Entamoeba dispar
LTTER

SEQ ID NO: 2444669 - protein, 5 aa, Entamoeba dispar
LTTEY

SEQ ID NO: 2444670 - protein, 5 aa, Entamoeba dispar
LTTGN

SEQ ID NO: 2444671 - protein, 8 aa, Entamoeba dispar
LTTGPTQF

SEQ ID NO: 2444672 - protein, 5 aa, Entamoeba dispar
LTTKD

SEQ ID NO: 2444673 - protein, 11 aa, Entamoeba dispar
LTTKPDTNTHW

SEQ ID NO: 2444674 - protein, 10 aa, Entamoeba dispar
LTTKPGQPTH

SEQ ID NO: 2444675 - protein, 5 aa, Entamoeba dispar
LTTLP

SEQ ID NO: 2444676 - protein, 4 aa, Entamoeba dispar
LTTN

SEQ ID NO: 2444677 - protein, 7 aa, Entamoeba dispar
LTTNTYR

SEQ ID NO: 2444678 - protein, 15 aa, Entamoeba dispar
LTTQKESKSEEELND

SEQ ID NO: 2444679 - protein, 4 aa, Entamoeba dispar
LTTS

SEQ ID NO: 2444680 - protein, 5 aa, Entamoeba dispar
LTTSL

SEQ ID NO: 2444681 - protein, 9 aa, Entamoeba dispar
LTTSPTYET

SEQ ID NO: 2444682 - protein, 6 aa, Entamoeba dispar
LTTSRI

SEQ ID NO: 2444683 - protein, 8 aa, Entamoeba dispar
LTTTPPMT

SEQ ID NO: 2444684 - protein, 5 aa, Entamoeba dispar
LTTTR

SEQ ID NO: 2444685 - protein, 6 aa, Entamoeba dispar
LTTTST

SEQ ID NO: 2444686 - protein, 23 aa, Entamoeba dispar
LTTTTQSLKPPNKNERDDDINDV

SEQ ID NO: 2444687 - protein, 5 aa, Entamoeba dispar
LTTTW

SEQ ID NO: 2444688 - protein, 9 aa, Entamoeba dispar
LTTYRGDYG

SEQ ID NO: 2444689 - protein, 8 aa, Entamoeba dispar
LTVPTNSD

SEQ ID NO: 2444690 - protein, 4 aa, Entamoeba dispar
LTYS

SEQ ID NO: 2444691 - protein, 8 aa, Entamoeba dispar
LTYSSEPL

SEQ ID NO: 2444692 - protein, 11 aa, Entamoeba dispar
LVAQEGSQFNK

SEQ ID NO: 2444693 - protein, 12 aa, Entamoeba dispar
LVDDDNEEKVDD

SEQ ID NO: 2444694 - protein, 20 aa, Entamoeba dispar
LVDNQNKNKGITKENESKKF

SEQ ID NO: 2444695 - protein, 8 aa, Entamoeba dispar
LVDPSNGN

SEQ ID NO: 2444696 - protein, 30 aa, Entamoeba dispar
LVEEKEKLNNESEQIRQDIDEAYKRKQTTR

SEQ ID NO: 2444697 - protein, 11 aa, Entamoeba dispar
LVEESTISGKG

SEQ ID NO: 2444698 - protein, 9 aa, Entamoeba dispar
LVEKENQEA

SEQ ID NO: 2444699 - protein, 9 aa, Entamoeba dispar
LVEKTDKET

SEQ ID NO: 2444700 - protein, 10 aa, Entamoeba dispar
LVENDSPSHL

SEQ ID NO: 2444701 - protein, 8 aa, Entamoeba dispar
LVETSNSL

SEQ ID NO: 2444702 - protein, 17 aa, Entamoeba dispar
LVETSQSVSIGKLEGNT

SEQ ID NO: 2444703 - protein, 5 aa, Entamoeba dispar
LVGAK

SEQ ID NO: 2444704 - protein, 11 aa, Entamoeba dispar
LVGPNGATQKA

SEQ ID NO: 2444705 - protein, 19 aa, Entamoeba dispar
LVGSNDSTFTVQRILVLEF

SEQ ID NO: 2444706 - protein, 17 aa, Entamoeba dispar
LVKRDEKCDKEINIEHG

SEQ ID NO: 2444707 - protein, 9 aa, Entamoeba dispar
LVPGGGASE

SEQ ID NO: 2444708 - protein, 31 aa, Entamoeba dispar
LVPSTNKQNVTELSEDDSSSDTKVTKKMSED

SEQ ID NO: 2444709 - protein, 14 aa, Entamoeba dispar
LVQSESSAQPMEQK

SEQ ID NO: 2444710 - protein, 7 aa, Entamoeba dispar
LVSASQD

SEQ ID NO: 2444711 - protein, 5 aa, Entamoeba dispar
LVSDE

SEQ ID NO: 2444712 - protein, 5 aa, Entamoeba dispar
LVSDR

SEQ ID NO: 2444713 - protein, 10 aa, Entamoeba dispar
LVSKEDGYKT

SEQ ID NO: 2444714 - protein, 6 aa, Entamoeba dispar
LVSTRA

SEQ ID NO: 2444715 - protein, 4 aa, Entamoeba dispar
LVTT

SEQ ID NO: 2444716 - protein, 16 aa, Entamoeba dispar
LVTTKTGKTFATSSED

SEQ ID NO: 2444717 - protein, 9 aa, Entamoeba dispar
LVTTTKEQL

SEQ ID NO: 2444718 - protein, 7 aa, Entamoeba dispar
LYAGSDQ

SEQ ID NO: 2444719 - protein, 6 aa, Entamoeba dispar
LYDGNK

SEQ ID NO: 2444720 - protein, 4 aa, Entamoeba dispar
LYDR

SEQ ID NO: 2444721 - protein, 8 aa, Entamoeba dispar
LYEKKSAT

SEQ ID NO: 2444722 - protein, 4 aa, Entamoeba dispar
LYER

SEQ ID NO: 2444723 - protein, 13 aa, Entamoeba dispar
LYGNGESGDPRIE

SEQ ID NO: 2444724 - protein, 10 aa, Entamoeba dispar
LYGNNIPDGV

SEQ ID NO: 2444725 - protein, 8 aa, Entamoeba dispar
LYGSKTAK

SEQ ID NO: 2444726 - protein, 18 aa, Entamoeba dispar
LYHNREGKDSFETFTSKT

SEQ ID NO: 2444727 - protein, 9 aa, Entamoeba dispar
LYKKDDKAF

SEQ ID NO: 2444728 - protein, 10 aa, Entamoeba dispar
LYKKEDPRYT

SEQ ID NO: 2444729 - protein, 14 aa, Entamoeba dispar
LYKQPERRKKSIEE

SEQ ID NO: 2444730 - protein, 6 aa, Entamoeba dispar
LYKQPQ

SEQ ID NO: 2444731 - protein, 25 aa, Entamoeba dispar
LYNPSSTNEDGNEMSEEEIENDDLS

SEQ ID NO: 2444732 - protein, 19 aa, Entamoeba dispar
LYNPSSTNEDGNEMSEEKL

SEQ ID NO: 2444733 - protein, 7 aa, Entamoeba dispar
LYNTNQE

SEQ ID NO: 2444734 - protein, 6 aa, Entamoeba dispar
LYPDSP

SEQ ID NO: 2444735 - protein, 7 aa, Entamoeba dispar
LYPNGYN

SEQ ID NO: 2444736 - protein, 5 aa, Entamoeba dispar
LYPPQ

SEQ ID NO: 2444737 - protein, 6 aa, Entamoeba dispar
LYPQNM

SEQ ID NO: 2444738 - protein, 21 aa, Entamoeba dispar
LYPSPRRVPDFQPDDGRHREQ

SEQ ID NO: 2444739 - protein, 9 aa, Entamoeba dispar
LYSGSNEGH

SEQ ID NO: 2444740 - protein, 6 aa, Entamoeba dispar
LYSNEE

SEQ ID NO: 2444741 - protein, 10 aa, Entamoeba dispar
LYSQANPQLS

SEQ ID NO: 2444742 - protein, 5 aa, Entamoeba dispar
LYSRE

SEQ ID NO: 2444743 - protein, 9 aa, Entamoeba dispar
LYSSSKKTT

SEQ ID NO: 2444744 - protein, 21 aa, Entamoeba dispar
LYSSTGHSIDNSTTNNQSEIE

SEQ ID NO: 2444745 - protein, 6 aa, Entamoeba dispar
LYTPTN

SEQ ID NO: 2444746 - protein, 11 aa, Entamoeba dispar
LYTQQNQTWKN

SEQ ID NO: 2444747 - protein, 19 aa, Entamoeba dispar
MAASSPNSCASPKSIGSIS

SEQ ID NO: 2444748 - protein, 9 aa, Entamoeba dispar
MADDDEDIH

SEQ ID NO: 2444749 - protein, 5 aa, Entamoeba dispar
MADDV

SEQ ID NO: 2444750 - protein, 7 aa, Entamoeba dispar
MADTGDL

SEQ ID NO: 2444751 - protein, 58 aa, Entamoeba dispar
MAEPDDEDMDDEDMEDGCGDDCDCEDHDDEDDDDDEEDKQHGNTSNTTAPPVPQECPQ

SEQ ID NO: 2444752 - protein, 8 aa, Entamoeba dispar
MAKKGKKY

SEQ ID NO: 2444753 - protein, 9 aa, Entamoeba dispar
MAKTSNDSF

SEQ ID NO: 2444754 - protein, 18 aa, Entamoeba dispar
MANSGDEKIKKQPEKKDY

SEQ ID NO: 2444755 - protein, 7 aa, Entamoeba dispar
MANTQGN

SEQ ID NO: 2444756 - protein, 23 aa, Entamoeba dispar
MANTQQQQQQQEPKENKSNQNEE

SEQ ID NO: 2444757 - protein, 13 aa, Entamoeba dispar
MAPEATGSMKDAA

SEQ ID NO: 2444758 - protein, 8 aa, Entamoeba dispar
MAPECNTN

SEQ ID NO: 2444759 - protein, 22 aa, Entamoeba dispar
MAPQQIRRQNQSMRYAQPYNYP

SEQ ID NO: 2444760 - protein, 9 aa, Entamoeba dispar
MAQPNKKEE

SEQ ID NO: 2444761 - protein, 30 aa, Entamoeba dispar
MASDDSEDILSSSSLSQDPIDTKDQNQDFN

SEQ ID NO: 2444762 - protein, 13 aa, Entamoeba dispar
MASENKKKKPIVP

SEQ ID NO: 2444763 - protein, 9 aa, Entamoeba dispar
MATAGKDGN

SEQ ID NO: 2444764 - protein, 13 aa, Entamoeba dispar
MATRNMNGGYKDF

SEQ ID NO: 2444765 - protein, 12 aa, Entamoeba dispar
MDEDPSKRAVSV

SEQ ID NO: 2444766 - protein, 32 aa, Entamoeba dispar
MDEESGDNNESDVNVQETVPTRKEKVSKTQEE

SEQ ID NO: 2444767 - protein, 5 aa, Entamoeba dispar
MDEQG

SEQ ID NO: 2444768 - protein, 6 aa, Entamoeba dispar
MDEQSV

SEQ ID NO: 2444769 - protein, 12 aa, Entamoeba dispar
MDESEDNEENLR

SEQ ID NO: 2444770 - protein, 17 aa, Entamoeba dispar
MDEVSKEDSSQKINGQD

SEQ ID NO: 2444771 - protein, 4 aa, Entamoeba dispar
MDGD

SEQ ID NO: 2444772 - protein, 4 aa, Entamoeba dispar
MDID

SEQ ID NO: 2444773 - protein, 8 aa, Entamoeba dispar
MDKGSELR

SEQ ID NO: 2444774 - protein, 10 aa, Entamoeba dispar
MDKNKGRLGD

SEQ ID NO: 2444775 - protein, 22 aa, Entamoeba dispar
MDKNSTSSDIYDQNKNSPTTKG

SEQ ID NO: 2444776 - protein, 10 aa, Entamoeba dispar
MDKQNTNHPF

SEQ ID NO: 2444777 - protein, 15 aa, Entamoeba dispar
MDKYNEKASSIDPQK

SEQ ID NO: 2444778 - protein, 6 aa, Entamoeba dispar
MDNEDT

SEQ ID NO: 2444779 - protein, 9 aa, Entamoeba dispar
MDNNTTNKE

SEQ ID NO: 2444780 - protein, 11 aa, Entamoeba dispar
MDPKKTKIYEN

SEQ ID NO: 2444781 - protein, 9 aa, Entamoeba dispar
MDPPAYEDD

SEQ ID NO: 2444782 - protein, 4 aa, Entamoeba dispar
MDPR

SEQ ID NO: 2444783 - protein, 8 aa, Entamoeba dispar
MDPSGKAP

SEQ ID NO: 2444784 - protein, 7 aa, Entamoeba dispar
MDPSTFG

SEQ ID NO: 2444785 - protein, 7 aa, Entamoeba dispar
MDQHNDY

SEQ ID NO: 2444786 - protein, 41 aa, Entamoeba dispar
MDRPNSDRDYYPSDRMRESGPYRRDDIGRDIPYSRDRYDPH

SEQ ID NO: 2444787 - protein, 12 aa, Entamoeba dispar
MDRQSSKLSNNQ

SEQ ID NO: 2444788 - protein, 16 aa, Entamoeba dispar
MDSDAVDAQTIKTNSN

SEQ ID NO: 2444789 - protein, 30 aa, Entamoeba dispar
MDSEDEIEPENNTLKTVPKECSKSPQTPVI

SEQ ID NO: 2444790 - protein, 6 aa, Entamoeba dispar
MDSSEK

SEQ ID NO: 2444791 - protein, 5 aa, Entamoeba dispar
MDSTL

SEQ ID NO: 2444792 - protein, 10 aa, Entamoeba dispar
MDSYQDYKEL

SEQ ID NO: 2444793 - protein, 11 aa, Entamoeba dispar
MDTKERTKVQK

SEQ ID NO: 2444794 - protein, 7 aa, Entamoeba dispar
MDTSNPE

SEQ ID NO: 2444795 - protein, 7 aa, Entamoeba dispar
MDTSNSE

SEQ ID NO: 2444796 - protein, 10 aa, Entamoeba dispar
MDVEEEQQTI

SEQ ID NO: 2444797 - protein, 6 aa, Entamoeba dispar
MEASGC

SEQ ID NO: 2444798 - protein, 5 aa, Entamoeba dispar
MEDDA

SEQ ID NO: 2444799 - protein, 35 aa, Entamoeba dispar
MEDETRDKKDKKDKKDKKDKEKRKHNGSIFKKIFG

SEQ ID NO: 2444800 - protein, 9 aa, Entamoeba dispar
MEDKENNQV

SEQ ID NO: 2444801 - protein, 8 aa, Entamoeba dispar
MEDPSSID

SEQ ID NO: 2444802 - protein, 9 aa, Entamoeba dispar
MEDSDNGIS

SEQ ID NO: 2444803 - protein, 11 aa, Entamoeba dispar
MEDTPEEQIET

SEQ ID NO: 2444804 - protein, 4 aa, Entamoeba dispar
MEEE

SEQ ID NO: 2444805 - protein, 25 aa, Entamoeba dispar
MEEEDDDQEVYDENEADALEEDEDI

SEQ ID NO: 2444806 - protein, 19 aa, Entamoeba dispar
MEEEDEEHLNETDEERTNR

SEQ ID NO: 2444807 - protein, 11 aa, Entamoeba dispar
MEEEEEESEFT

SEQ ID NO: 2444808 - protein, 26 aa, Entamoeba dispar
MEEEKEEAGEIEYAEEGLDAEDEKKK

SEQ ID NO: 2444809 - protein, 43 aa, Entamoeba dispar
MEEENEEEENEEIKTNNKSEKKKNKKDKLDSISVERSDGTKEH

SEQ ID NO: 2444810 - protein, 11 aa, Entamoeba dispar
MEEKNDEITRL

SEQ ID NO: 2444811 - protein, 4 aa, Entamoeba dispar
MEEL

SEQ ID NO: 2444812 - protein, 15 aa, Entamoeba dispar
MEEQQSNQNKITTKR

SEQ ID NO: 2444813 - protein, 8 aa, Entamoeba dispar
MEEQTRNE

SEQ ID NO: 2444814 - protein, 5 aa, Entamoeba dispar
MEERN

SEQ ID NO: 2444815 - protein, 13 aa, Entamoeba dispar
MEERNKTNRVTTE

SEQ ID NO: 2444816 - protein, 29 aa, Entamoeba dispar
MEERRKRRKEIREKKEQEEYEKKHPTISQ

SEQ ID NO: 2444817 - protein, 18 aa, Entamoeba dispar
MEESTDDKTKKMKKLESK

SEQ ID NO: 2444818 - protein, 11 aa, Entamoeba dispar
MEETKNEEGDL

SEQ ID NO: 2444819 - protein, 6 aa, Entamoeba dispar
MEETNE

SEQ ID NO: 2444820 - protein, 4 aa, Entamoeba dispar
MEEV

SEQ ID NO: 2444821 - protein, 48 aa, Entamoeba dispar
MEGGVKTKKGSNEQPEDLDVPGSRVPKAFNEGEEDGDDDDDIVSRIAN

SEQ ID NO: 2444822 - protein, 15 aa, Entamoeba dispar
MEGIESPNRNNSLEK

SEQ ID NO: 2444823 - protein, 8 aa, Entamoeba dispar
MEGRGTWG

SEQ ID NO: 2444824 - protein, 11 aa, Entamoeba dispar
MEGSEVKETGF

SEQ ID NO: 2444825 - protein, 17 aa, Entamoeba dispar
MEGSTARYGYKDNTTVE

SEQ ID NO: 2444826 - protein, 6 aa, Entamoeba dispar
MEGTVS

SEQ ID NO: 2444827 - protein, 8 aa, Entamoeba dispar
MEKERNEL

SEQ ID NO: 2444828 - protein, 19 aa, Entamoeba dispar
MEKEYPNLSPKEREHTVAK

SEQ ID NO: 2444829 - protein, 6 aa, Entamoeba dispar
MEKGEI

SEQ ID NO: 2444830 - protein, 9 aa, Entamoeba dispar
MEKNRGRLG

SEQ ID NO: 2444831 - protein, 8 aa, Entamoeba dispar
MEKTGNDG

SEQ ID NO: 2444832 - protein, 11 aa, Entamoeba dispar
MENAVKQSPEF

SEQ ID NO: 2444833 - protein, 19 aa, Entamoeba dispar
MENHDRDDNSSEDYEQHEN

SEQ ID NO: 2444834 - protein, 8 aa, Entamoeba dispar
MENNKEKA

SEQ ID NO: 2444835 - protein, 4 aa, Entamoeba dispar
MENQ

SEQ ID NO: 2444836 - protein, 8 aa, Entamoeba dispar
MENSEEDL

SEQ ID NO: 2444837 - protein, 11 aa, Entamoeba dispar
MEPGTTNPRES

SEQ ID NO: 2444838 - protein, 6 aa, Entamoeba dispar
MEPPID

SEQ ID NO: 2444839 - protein, 8 aa, Entamoeba dispar
MEPTDAYV

SEQ ID NO: 2444840 - protein, 12 aa, Entamoeba dispar
MEPYSDDDDEFS

SEQ ID NO: 2444841 - protein, 6 aa, Entamoeba dispar
MEQDTP

SEQ ID NO: 2444842 - protein, 4 aa, Entamoeba dispar
MEQF

SEQ ID NO: 2444843 - protein, 4 aa, Entamoeba dispar
MEQP

SEQ ID NO: 2444844 - protein, 9 aa, Entamoeba dispar
MEQPDNKNK

SEQ ID NO: 2444845 - protein, 29 aa, Entamoeba dispar
MEQRTEMTTKQNGISFGKRKTKQAKKTIQ

SEQ ID NO: 2444846 - protein, 10 aa, Entamoeba dispar
MEQRTEMTTS

SEQ ID NO: 2444847 - protein, 11 aa, Entamoeba dispar
MEREERPTQNI

SEQ ID NO: 2444848 - protein, 13 aa, Entamoeba dispar
MERESTENRADNL

SEQ ID NO: 2444849 - protein, 9 aa, Entamoeba dispar
MERNRGRLG

SEQ ID NO: 2444850 - protein, 7 aa, Entamoeba dispar
MERTDYS

SEQ ID NO: 2444851 - protein, 23 aa, Entamoeba dispar
MESDDSIKFQQNSNESIDSSERM

SEQ ID NO: 2444852 - protein, 7 aa, Entamoeba dispar
MESEEKL

SEQ ID NO: 2444853 - protein, 5 aa, Entamoeba dispar
MESKE

SEQ ID NO: 2444854 - protein, 31 aa, Entamoeba dispar
  misc_feature (28)..(29): Xaa can be any naturally occurring amino acid
MESKKTKDKSKKQSGLFRSHAQTNQKIXXCF

SEQ ID NO: 2444855 - protein, 14 aa, Entamoeba dispar
MESLPSSSKERQLV

SEQ ID NO: 2444856 - protein, 6 aa, Entamoeba dispar
MESPTK

SEQ ID NO: 2444857 - protein, 25 aa, Entamoeba dispar
METDNQKDVIAQEETKGGDNQNNIT

SEQ ID NO: 2444858 - protein, 10 aa, Entamoeba dispar
METEAQEIRE

SEQ ID NO: 2444859 - protein, 5 aa, Entamoeba dispar
METNP

SEQ ID NO: 2444860 - protein, 20 aa, Entamoeba dispar
METNQKGRDVKTLSGGERSF

SEQ ID NO: 2444861 - protein, 4 aa, Entamoeba dispar
METP

SEQ ID NO: 2444862 - protein, 6 aa, Entamoeba dispar
METPDE

SEQ ID NO: 2444863 - protein, 8 aa, Entamoeba dispar
METPSECE

SEQ ID NO: 2444864 - protein, 6 aa, Entamoeba dispar
METSQK

SEQ ID NO: 2444865 - protein, 4 aa, Entamoeba dispar
METT

SEQ ID NO: 2444866 - protein, 12 aa, Entamoeba dispar
METTGQKNPYFP

SEQ ID NO: 2444867 - protein, 6 aa, Entamoeba dispar
MGATPR

SEQ ID NO: 2444868 - protein, 9 aa, Entamoeba dispar
MGDDTVEDI

SEQ ID NO: 2444869 - protein, 21 aa, Entamoeba dispar
MGDEDEYGYGYNQAKRPVKAD

SEQ ID NO: 2444870 - protein, 10 aa, Entamoeba dispar
MGDKNEAEIK

SEQ ID NO: 2444871 - protein, 9 aa, Entamoeba dispar
MGDQPPYNT

SEQ ID NO: 2444872 - protein, 10 aa, Entamoeba dispar
MGDTNKSVRE

SEQ ID NO: 2444873 - protein, 4 aa, Entamoeba dispar
MGDV

SEQ ID NO: 2444874 - protein, 13 aa, Entamoeba dispar
MGDVNGGTEFYDE

SEQ ID NO: 2444875 - protein, 5 aa, Entamoeba dispar
MGEEE

SEQ ID NO: 2444876 - protein, 7 aa, Entamoeba dispar
MGERTEM

SEQ ID NO: 2444877 - protein, 4 aa, Entamoeba dispar
MGGD

SEQ ID NO: 2444878 - protein, 142 aa, Entamoeba dispar
MGGFGNNNTFGNTGFGSTTTGFGNNNNTGFGSGFGNNNNTGFGSGFGNTTNTGFGSTTSGFGNTTTGLGGGFGSALGNGLSGGFGNNNTGLGGGFGNNNTGLGGGFGTTNTTIGFGNNGGFGSGLGTPFGNGLGNNNNGGFN

SEQ ID NO: 2444879 - protein, 5 aa, Entamoeba dispar
MGIEQ

SEQ ID NO: 2444880 - protein, 4 aa, Entamoeba dispar
MGIP

SEQ ID NO: 2444881 - protein, 10 aa, Entamoeba dispar
MGKDKQEVQR

SEQ ID NO: 2444882 - protein, 4 aa, Entamoeba dispar
MGKE

SEQ ID NO: 2444883 - protein, 13 aa, Entamoeba dispar
MGKEYPKHDKSDA

SEQ ID NO: 2444884 - protein, 7 aa, Entamoeba dispar
MGKGKIA

SEQ ID NO: 2444885 - protein, 19 aa, Entamoeba dispar
MGKNPASATKYLQDPEVRS

SEQ ID NO: 2444886 - protein, 10 aa, Entamoeba dispar
MGLNGEEKKV

SEQ ID NO: 2444887 - protein, 8 aa, Entamoeba dispar
MGNDSATG

SEQ ID NO: 2444888 - protein, 7 aa, Entamoeba dispar
MGNEEAT

SEQ ID NO: 2444889 - protein, 11 aa, Entamoeba dispar
MGNLPSKASKM

SEQ ID NO: 2444890 - protein, 10 aa, Entamoeba dispar
MGNPTTFNSN

SEQ ID NO: 2444891 - protein, 7 aa, Entamoeba dispar
MGNQKAQ

SEQ ID NO: 2444892 - protein, 13 aa, Entamoeba dispar
MGQPPHGLAQYLA

SEQ ID NO: 2444893 - protein, 8 aa, Entamoeba dispar
MGREARQR

SEQ ID NO: 2444894 - protein, 6 aa, Entamoeba dispar
MGSQDN

SEQ ID NO: 2444895 - protein, 4 aa, Entamoeba dispar
MGSS

SEQ ID NO: 2444896 - protein, 23 aa, Entamoeba dispar
MGSSQRGGNMGHPGSSRDGADVE

SEQ ID NO: 2444897 - protein, 7 aa, Entamoeba dispar
MGTSASD

SEQ ID NO: 2444898 - protein, 8 aa, Entamoeba dispar
MHKTNQTP

SEQ ID NO: 2444899 - protein, 19 aa, Entamoeba dispar
MHPDNEDLGIKESDLQQSD

SEQ ID NO: 2444900 - protein, 7 aa, Entamoeba dispar
MHVPGED

SEQ ID NO: 2444901 - protein, 16 aa, Entamoeba dispar
MIEKGSEETTSGEDKI

SEQ ID NO: 2444902 - protein, 9 aa, Entamoeba dispar
MINGSDGEG

SEQ ID NO: 2444903 - protein, 7 aa, Entamoeba dispar
MKAEGND

SEQ ID NO: 2444904 - protein, 6 aa, Entamoeba dispar
MKAGGV

SEQ ID NO: 2444905 - protein, 13 aa, Entamoeba dispar
MKAKEGASEEYDD

SEQ ID NO: 2444906 - protein, 11 aa, Entamoeba dispar
MKASQQKRPFE

SEQ ID NO: 2444907 - protein, 5 aa, Entamoeba dispar
MKDAK

SEQ ID NO: 2444908 - protein, 9 aa, Entamoeba dispar
MKDDDEEIT

SEQ ID NO: 2444909 - protein, 5 aa, Entamoeba dispar
MKDDS

SEQ ID NO: 2444910 - protein, 17 aa, Entamoeba dispar
MKDEDFDNLNKHSPKKD

SEQ ID NO: 2444911 - protein, 11 aa, Entamoeba dispar
MKDEENALNSI

SEQ ID NO: 2444912 - protein, 6 aa, Entamoeba dispar
MKDEEV

SEQ ID NO: 2444913 - protein, 10 aa, Entamoeba dispar
MKDESKDDGY

SEQ ID NO: 2444914 - protein, 9 aa, Entamoeba dispar
MKDETGLKD

SEQ ID NO: 2444915 - protein, 7 aa, Entamoeba dispar
MKDRSYN

SEQ ID NO: 2444916 - protein, 5 aa, Entamoeba dispar
MKDSQ

SEQ ID NO: 2444917 - protein, 12 aa, Entamoeba dispar
MKEDGKKLEEKL

SEQ ID NO: 2444918 - protein, 12 aa, Entamoeba dispar
MKEDPDVYIPPS

SEQ ID NO: 2444919 - protein, 4 aa, Entamoeba dispar
MKEE

SEQ ID NO: 2444920 - protein, 15 aa, Entamoeba dispar
MKEEDLSQSTTNDEK

SEQ ID NO: 2444921 - protein, 16 aa, Entamoeba dispar
MKEEEFKEGAEEEANI

SEQ ID NO: 2444922 - protein, 19 aa, Entamoeba dispar
MKEEKEKNHEKLSDINQSE

SEQ ID NO: 2444923 - protein, 8 aa, Entamoeba dispar
MKEGEEKE

SEQ ID NO: 2444924 - protein, 9 aa, Entamoeba dispar
MKENEPDES

SEQ ID NO: 2444925 - protein, 22 aa, Entamoeba dispar
MKENETIKETEIKRSDYKQRKR

SEQ ID NO: 2444926 - protein, 7 aa, Entamoeba dispar
MKENETW

SEQ ID NO: 2444927 - protein, 9 aa, Entamoeba dispar
MKENTSEHH

SEQ ID NO: 2444928 - protein, 7 aa, Entamoeba dispar
MKEPEAV

SEQ ID NO: 2444929 - protein, 11 aa, Entamoeba dispar
MKEPKPSYESL

SEQ ID NO: 2444930 - protein, 4 aa, Entamoeba dispar
MKER

SEQ ID NO: 2444931 - protein, 16 aa, Entamoeba dispar
MKERQRKMNKKEKGFI

SEQ ID NO: 2444932 - protein, 7 aa, Entamoeba dispar
MKESDGI

SEQ ID NO: 2444933 - protein, 11 aa, Entamoeba dispar
MKESKPSYESL

SEQ ID NO: 2444934 - protein, 16 aa, Entamoeba dispar
MKESQSKDLKSSEGDI

SEQ ID NO: 2444935 - protein, 8 aa, Entamoeba dispar
MKETKKNE

SEQ ID NO: 2444936 - protein, 12 aa, Entamoeba dispar
MKGANEKKNFNK

SEQ ID NO: 2444937 - protein, 8 aa, Entamoeba dispar
MKGDEECE

SEQ ID NO: 2444938 - protein, 7 aa, Entamoeba dispar
MKGDIGG

SEQ ID NO: 2444939 - protein, 9 aa, Entamoeba dispar
MKGKSETKK

SEQ ID NO: 2444940 - protein, 6 aa, Entamoeba dispar
MKGKTS

SEQ ID NO: 2444941 - protein, 9 aa, Entamoeba dispar
MKGNKDIEY

SEQ ID NO: 2444942 - protein, 4 aa, Entamoeba dispar
MKGR

SEQ ID NO: 2444943 - protein, 5 aa, Entamoeba dispar
MKGSD

SEQ ID NO: 2444944 - protein, 8 aa, Entamoeba dispar
MKHRSKGR

SEQ ID NO: 2444945 - protein, 6 aa, Entamoeba dispar
MKIGQE

SEQ ID NO: 2444946 - protein, 13 aa, Entamoeba dispar
MKIPKDKNSLGDD

SEQ ID NO: 2444947 - protein, 8 aa, Entamoeba dispar
MKKATSDV

SEQ ID NO: 2444948 - protein, 25 aa, Entamoeba dispar
MKKDEEEREQREVRYKEKKQTEQKE

SEQ ID NO: 2444949 - protein, 15 aa, Entamoeba dispar
MKKDKNEKKPKKNNK

SEQ ID NO: 2444950 - protein, 8 aa, Entamoeba dispar
MKKEGRSK

SEQ ID NO: 2444951 - protein, 9 aa, Entamoeba dispar
MKKEKDPNE

SEQ ID NO: 2444952 - protein, 5 aa, Entamoeba dispar
MKKEL

SEQ ID NO: 2444953 - protein, 10 aa, Entamoeba dispar
MKKERKRVYK

SEQ ID NO: 2444954 - protein, 12 aa, Entamoeba dispar
MKKETNLEKYMI

SEQ ID NO: 2444955 - protein, 7 aa, Entamoeba dispar
MKKGNEM

SEQ ID NO: 2444956 - protein, 17 aa, Entamoeba dispar
MKKKETKKTKTIKPKKL

SEQ ID NO: 2444957 - protein, 8 aa, Entamoeba dispar
MKKNEKKI

SEQ ID NO: 2444958 - protein, 8 aa, Entamoeba dispar
MKKNGRTI

SEQ ID NO: 2444959 - protein, 14 aa, Entamoeba dispar
MKKQEKPKSNGSTL

SEQ ID NO: 2444960 - protein, 10 aa, Entamoeba dispar
MKKQTQEIEY

SEQ ID NO: 2444961 - protein, 8 aa, Entamoeba dispar
MKKRNSNI

SEQ ID NO: 2444962 - protein, 8 aa, Entamoeba dispar
MKKSDNEE

SEQ ID NO: 2444963 - protein, 7 aa, Entamoeba dispar
MKLEETN

SEQ ID NO: 2444964 - protein, 7 aa, Entamoeba dispar
MKNEGIE

SEQ ID NO: 2444965 - protein, 7 aa, Entamoeba dispar
MKNELGD

SEQ ID NO: 2444966 - protein, 7 aa, Entamoeba dispar
MKNERED

SEQ ID NO: 2444967 - protein, 10 aa, Entamoeba dispar
MKNNGKVQGI

SEQ ID NO: 2444968 - protein, 12 aa, Entamoeba dispar
MKNPNKEGKKLC

SEQ ID NO: 2444969 - protein, 9 aa, Entamoeba dispar
MKNPRKPTE

SEQ ID NO: 2444970 - protein, 9 aa, Entamoeba dispar
MKNPSSYSI

SEQ ID NO: 2444971 - protein, 9 aa, Entamoeba dispar
MKPEDLTDE

SEQ ID NO: 2444972 - protein, 4 aa, Entamoeba dispar
MKPG

SEQ ID NO: 2444973 - protein, 5 aa, Entamoeba dispar
MKPKV

SEQ ID NO: 2444974 - protein, 14 aa, Entamoeba dispar
MKPKVEYDEFGQPK

SEQ ID NO: 2444975 - protein, 6 aa, Entamoeba dispar
MKPNAK

SEQ ID NO: 2444976 - protein, 6 aa, Entamoeba dispar
MKPNTF

SEQ ID NO: 2444977 - protein, 8 aa, Entamoeba dispar
MKPTTHSS

SEQ ID NO: 2444978 - protein, 8 aa, Entamoeba dispar
MKQAEREI

SEQ ID NO: 2444979 - protein, 5 aa, Entamoeba dispar
MKQEE

SEQ ID NO: 2444980 - protein, 9 aa, Entamoeba dispar
MKQESPQNK

SEQ ID NO: 2444981 - protein, 5 aa, Entamoeba dispar
MKQPH

SEQ ID NO: 2444982 - protein, 14 aa, Entamoeba dispar
MKRAPQQRREIKNK

SEQ ID NO: 2444983 - protein, 6 aa, Entamoeba dispar
MKRDSA

SEQ ID NO: 2444984 - protein, 8 aa, Entamoeba dispar
MKREEYQK

SEQ ID NO: 2444985 - protein, 14 aa, Entamoeba dispar
MKRKDDDPSTYEYV

SEQ ID NO: 2444986 - protein, 13 aa, Entamoeba dispar
MKRKEEEEEDNKN

SEQ ID NO: 2444987 - protein, 11 aa, Entamoeba dispar
MKRNRKGEKYK

SEQ ID NO: 2444988 - protein, 8 aa, Entamoeba dispar
MKSEEEHE

SEQ ID NO: 2444989 - protein, 10 aa, Entamoeba dispar
MKSEKGKIQR

SEQ ID NO: 2444990 - protein, 10 aa, Entamoeba dispar
MKSKKGKSFE

SEQ ID NO: 2444991 - protein, 15 aa, Entamoeba dispar
MKSPDVVSKQNKSDL

SEQ ID NO: 2444992 - protein, 7 aa, Entamoeba dispar
MKSSSQL

SEQ ID NO: 2444993 - protein, 8 aa, Entamoeba dispar
MKSSTEDD

SEQ ID NO: 2444994 - protein, 7 aa, Entamoeba dispar
MKSTQHE

SEQ ID NO: 2444995 - protein, 11 aa, Entamoeba dispar
MKTASTEQKLT

SEQ ID NO: 2444996 - protein, 4 aa, Entamoeba dispar
MKTD

SEQ ID NO: 2444997 - protein, 12 aa, Entamoeba dispar
MKTEEKKQDEGF

SEQ ID NO: 2444998 - protein, 10 aa, Entamoeba dispar
MKTESDPTKM

SEQ ID NO: 2444999 - protein, 11 aa, Entamoeba dispar
MKTPSQESTPI

SEQ ID NO: 2445000 - protein, 11 aa, Entamoeba dispar
MKTPSTSSTPF

SEQ ID NO: 2445001 - protein, 10 aa, Entamoeba dispar
MKTRRGSAQP

SEQ ID NO: 2445002 - protein, 6 aa, Entamoeba dispar
MKTTPV

SEQ ID NO: 2445003 - protein, 10 aa, Entamoeba dispar
MLGEKKQENI

SEQ ID NO: 2445004 - protein, 9 aa, Entamoeba dispar
MLKGSKRKF

SEQ ID NO: 2445005 - protein, 13 aa, Entamoeba dispar
MLPPSQQSTQNIR

SEQ ID NO: 2445006 - protein, 16 aa, Entamoeba dispar
MLSKDSTKKKRAHPGA

SEQ ID NO: 2445007 - protein, 9 aa, Entamoeba dispar
MLTNEQKER

SEQ ID NO: 2445008 - protein, 17 aa, Entamoeba dispar
MMPPPGAYPPPGYPPMQ

SEQ ID NO: 2445009 - protein, 16 aa, Entamoeba dispar
MNATNKKDTQPQQNIS

SEQ ID NO: 2445010 - protein, 6 aa, Entamoeba dispar
MNDEGE

SEQ ID NO: 2445011 - protein, 10 aa, Entamoeba dispar
MNDIGTPSKN

SEQ ID NO: 2445012 - protein, 10 aa, Entamoeba dispar
MNDNTNSSEI

SEQ ID NO: 2445013 - protein, 4 aa, Entamoeba dispar
MNED

SEQ ID NO: 2445014 - protein, 4 aa, Entamoeba dispar
MNEE

SEQ ID NO: 2445015 - protein, 6 aa, Entamoeba dispar
MNEEEA

SEQ ID NO: 2445016 - protein, 14 aa, Entamoeba dispar
MNEEQEITTTNNRK

SEQ ID NO: 2445017 - protein, 6 aa, Entamoeba dispar
MNEERR

SEQ ID NO: 2445018 - protein, 28 aa, Entamoeba dispar
MNEETRKKMEEKRQELKEKAKENYLDPR

SEQ ID NO: 2445019 - protein, 15 aa, Entamoeba dispar
MNEFDDKKSIYTPTL

SEQ ID NO: 2445020 - protein, 7 aa, Entamoeba dispar
MNENPKQ

SEQ ID NO: 2445021 - protein, 7 aa, Entamoeba dispar
MNENPPY

SEQ ID NO: 2445022 - protein, 24 aa, Entamoeba dispar
MNEPIPPPNPPYTGHIPTETSEFN

SEQ ID NO: 2445023 - protein, 7 aa, Entamoeba dispar
MNETELT

SEQ ID NO: 2445024 - protein, 8 aa, Entamoeba dispar
MNETPDSQ

SEQ ID NO: 2445025 - protein, 9 aa, Entamoeba dispar
MNETSEKIK

SEQ ID NO: 2445026 - protein, 11 aa, Entamoeba dispar
MNGDRRKNSTA

SEQ ID NO: 2445027 - protein, 4 aa, Entamoeba dispar
MNGE

SEQ ID NO: 2445028 - protein, 8 aa, Entamoeba dispar
MNGEPDER

SEQ ID NO: 2445029 - protein, 6 aa, Entamoeba dispar
MNGKNV

SEQ ID NO: 2445030 - protein, 20 aa, Entamoeba dispar
MNGNEKQEGGSDEDPIGTPN

SEQ ID NO: 2445031 - protein, 7 aa, Entamoeba dispar
MNGQEVE

SEQ ID NO: 2445032 - protein, 14 aa, Entamoeba dispar
MNHPDASQKRESIA

SEQ ID NO: 2445033 - protein, 13 aa, Entamoeba dispar
MNIPENSPSGNIH

SEQ ID NO: 2445034 - protein, 7 aa, Entamoeba dispar
MNKEDRR

SEQ ID NO: 2445035 - protein, 11 aa, Entamoeba dispar
MNKEKRPDINK

SEQ ID NO: 2445036 - protein, 8 aa, Entamoeba dispar
MNKGESEK

SEQ ID NO: 2445037 - protein, 4 aa, Entamoeba dispar
MNKK

SEQ ID NO: 2445038 - protein, 10 aa, Entamoeba dispar
MNKNEDMGIG

SEQ ID NO: 2445039 - protein, 17 aa, Entamoeba dispar
MNKNPPRSKSRTTNQKR

SEQ ID NO: 2445040 - protein, 11 aa, Entamoeba dispar
MNLTDSDISQL

SEQ ID NO: 2445041 - protein, 50 aa, Entamoeba dispar
MNNDNTKQVKESKKITETPKPKIIKKERRSKTQKKKKERNENEEESSTQI

SEQ ID NO: 2445042 - protein, 5 aa, Entamoeba dispar
MNNDT

SEQ ID NO: 2445043 - protein, 7 aa, Entamoeba dispar
MNNGETT

SEQ ID NO: 2445044 - protein, 69 aa, Entamoeba dispar
MNNNNSISSLEDKEEVQEDKKEIKEEKEVQEEKRVQEEKEVQEEKEVQEEKEEKIEEVEKPTKETGQNQ

SEQ ID NO: 2445045 - protein, 10 aa, Entamoeba dispar
MNNPSNTPPV

SEQ ID NO: 2445046 - protein, 7 aa, Entamoeba dispar
MNNQPFD

SEQ ID NO: 2445047 - protein, 4 aa, Entamoeba dispar
MNNS

SEQ ID NO: 2445048 - protein, 14 aa, Entamoeba dispar
MNNSPLKPEPIIPP

SEQ ID NO: 2445049 - protein, 19 aa, Entamoeba dispar
MNPEITVGNKEEQLDEDDW

SEQ ID NO: 2445050 - protein, 11 aa, Entamoeba dispar
MNPSTNKDSPF

SEQ ID NO: 2445051 - protein, 9 aa, Entamoeba dispar
MNPTTNPEN

SEQ ID NO: 2445052 - protein, 15 aa, Entamoeba dispar
MNQDTRDGVSQKTAW

SEQ ID NO: 2445053 - protein, 13 aa, Entamoeba dispar
MNQPESPAFNTPV

SEQ ID NO: 2445054 - protein, 5 aa, Entamoeba dispar
MNQPH

SEQ ID NO: 2445055 - protein, 8 aa, Entamoeba dispar
MNQQETNI

SEQ ID NO: 2445056 - protein, 15 aa, Entamoeba dispar
MNQTKPKKKSGGCSL

SEQ ID NO: 2445057 - protein, 85 aa, Entamoeba dispar
MNQTNNRFPTFEQQETQQNQFSGMGNDNKFPSLDASYQQPQFPSINNDNKFPSFGAPQQQNQFPSIGNDSKFPSIDNDSKFPSFE

SEQ ID NO: 2445058 - protein, 6 aa, Entamoeba dispar
MNQTNV

SEQ ID NO: 2445059 - protein, 11 aa, Entamoeba dispar
MNRAPGPTDRW

SEQ ID NO: 2445060 - protein, 8 aa, Entamoeba dispar
MNSEEDHE

SEQ ID NO: 2445061 - protein, 10 aa, Entamoeba dispar
MNSGEKPRII

SEQ ID NO: 2445062 - protein, 8 aa, Entamoeba dispar
MNSKGENE

SEQ ID NO: 2445063 - protein, 13 aa, Entamoeba dispar
MNSQDNLKTVREK

SEQ ID NO: 2445064 - protein, 5 aa, Entamoeba dispar
MNTEN

SEQ ID NO: 2445065 - protein, 4 aa, Entamoeba dispar
MNTH

SEQ ID NO: 2445066 - protein, 18 aa, Entamoeba dispar
MNTPSQQTSTPQTNSNTF

SEQ ID NO: 2445067 - protein, 8 aa, Entamoeba dispar
MPDEREPR

SEQ ID NO: 2445068 - protein, 11 aa, Entamoeba dispar
MPESAPTGQMP

SEQ ID NO: 2445069 - protein, 7 aa, Entamoeba dispar
MPEYSDT

SEQ ID NO: 2445070 - protein, 9 aa, Entamoeba dispar
MPKDTYKEG

SEQ ID NO: 2445071 - protein, 4 aa, Entamoeba dispar
MPKE

SEQ ID NO: 2445072 - protein, 9 aa, Entamoeba dispar
MPKENNKIN

SEQ ID NO: 2445073 - protein, 13 aa, Entamoeba dispar
MPKKRDDIARPAV

SEQ ID NO: 2445074 - protein, 9 aa, Entamoeba dispar
MPKPNKKKT

SEQ ID NO: 2445075 - protein, 6 aa, Entamoeba dispar
MPKSSI

SEQ ID NO: 2445076 - protein, 28 aa, Entamoeba dispar
MPKTSSGKLQKDVEGDSSSQKSNCCCTL

SEQ ID NO: 2445077 - protein, 7 aa, Entamoeba dispar
MPNDPKN

SEQ ID NO: 2445078 - protein, 5 aa, Entamoeba dispar
MPNGI

SEQ ID NO: 2445079 - protein, 5 aa, Entamoeba dispar
MPNKK

SEQ ID NO: 2445080 - protein, 19 aa, Entamoeba dispar
MPNKQGTCKAHGEPPGTEL

SEQ ID NO: 2445081 - protein, 5 aa, Entamoeba dispar
MPNMG

SEQ ID NO: 2445082 - protein, 6 aa, Entamoeba dispar
MPNPSS

SEQ ID NO: 2445083 - protein, 5 aa, Entamoeba dispar
MPPED

SEQ ID NO: 2445084 - protein, 25 aa, Entamoeba dispar
MPPPGAYPPPGYPPMQPGMMHPPGF

SEQ ID NO: 2445085 - protein, 10 aa, Entamoeba dispar
MPPPGYPPMQ

SEQ ID NO: 2445086 - protein, 10 aa, Entamoeba dispar
MPPTSQNSDL

SEQ ID NO: 2445087 - protein, 16 aa, Entamoeba dispar
MPQEDLPSNPSEFEKY

SEQ ID NO: 2445088 - protein, 10 aa, Entamoeba dispar
MPQGKGQPTI

SEQ ID NO: 2445089 - protein, 4 aa, Entamoeba dispar
MPQL

SEQ ID NO: 2445090 - protein, 9 aa, Entamoeba dispar
MPQNESRAG

SEQ ID NO: 2445091 - protein, 15 aa, Entamoeba dispar
MPQSSYKREQSERYL

SEQ ID NO: 2445092 - protein, 5 aa, Entamoeba dispar
MPSEE

SEQ ID NO: 2445093 - protein, 14 aa, Entamoeba dispar
MPSEEETEKYNEYR

SEQ ID NO: 2445094 - protein, 10 aa, Entamoeba dispar
MPSSINKIGD

SEQ ID NO: 2445095 - protein, 5 aa, Entamoeba dispar
MPSTL

SEQ ID NO: 2445096 - protein, 14 aa, Entamoeba dispar
MPTDDQCEKISTRG

SEQ ID NO: 2445097 - protein, 10 aa, Entamoeba dispar
MPTTDELPPI

SEQ ID NO: 2445098 - protein, 10 aa, Entamoeba dispar
MQAQPGQNPP

SEQ ID NO: 2445099 - protein, 16 aa, Entamoeba dispar
MQDANEGKNKNSFKLP

SEQ ID NO: 2445100 - protein, 17 aa, Entamoeba dispar
MQEEERKQKELADKREK

SEQ ID NO: 2445101 - protein, 7 aa, Entamoeba dispar
MQEESTP

SEQ ID NO: 2445102 - protein, 12 aa, Entamoeba dispar
MQEKKEEEKKEE

SEQ ID NO: 2445103 - protein, 10 aa, Entamoeba dispar
MQGMQGKQPI

SEQ ID NO: 2445104 - protein, 11 aa, Entamoeba dispar
MQHPKSIESEF

SEQ ID NO: 2445105 - protein, 26 aa, Entamoeba dispar
MQKRREDIADDDDDGDDFEDDSDEWD

SEQ ID NO: 2445106 - protein, 8 aa, Entamoeba dispar
MQKSGSFK

SEQ ID NO: 2445107 - protein, 17 aa, Entamoeba dispar
MQKSSTVTKETEDKDPL

SEQ ID NO: 2445108 - protein, 5 aa, Entamoeba dispar
MQNTE

SEQ ID NO: 2445109 - protein, 9 aa, Entamoeba dispar
MQPNNNPII

SEQ ID NO: 2445110 - protein, 7 aa, Entamoeba dispar
MQPSEIN

SEQ ID NO: 2445111 - protein, 58 aa, Entamoeba dispar
MQQPGMPPMGYPPMQPGQYPPQGYPPMQQPGMPPMGYPPMQPGQYPPQGYPPMQPGAQ

SEQ ID NO: 2445112 - protein, 6 aa, Entamoeba dispar
MQSQEE

SEQ ID NO: 2445113 - protein, 4 aa, Entamoeba dispar
MQYT

SEQ ID NO: 2445114 - protein, 4 aa, Entamoeba dispar
MRDE

SEQ ID NO: 2445115 - protein, 8 aa, Entamoeba dispar
MRDEVKNT

SEQ ID NO: 2445116 - protein, 6 aa, Entamoeba dispar
MREDNL

SEQ ID NO: 2445117 - protein, 17 aa, Entamoeba dispar
MREKEEKERKKQELENK

SEQ ID NO: 2445118 - protein, 9 aa, Entamoeba dispar
MREKIRPKN

SEQ ID NO: 2445119 - protein, 9 aa, Entamoeba dispar
MRENGKSIG

SEQ ID NO: 2445120 - protein, 18 aa, Entamoeba dispar
MRETKTNRIQPPPDIESD

SEQ ID NO: 2445121 - protein, 5 aa, Entamoeba dispar
MRGGE

SEQ ID NO: 2445122 - protein, 11 aa, Entamoeba dispar
MRGGPLKKGQS

SEQ ID NO: 2445123 - protein, 14 aa, Entamoeba dispar
MRGGRFFGKDFPRF

SEQ ID NO: 2445124 - protein, 12 aa, Entamoeba dispar
MRGTDHKNFEQK

SEQ ID NO: 2445125 - protein, 13 aa, Entamoeba dispar
MRHEGRTDEARRN

SEQ ID NO: 2445126 - protein, 9 aa, Entamoeba dispar
MRKNPKEVE

SEQ ID NO: 2445127 - protein, 4 aa, Entamoeba dispar
MRKS

SEQ ID NO: 2445128 - protein, 8 aa, Entamoeba dispar
MRNEETKR

SEQ ID NO: 2445129 - protein, 8 aa, Entamoeba dispar
MRNPDPDL

SEQ ID NO: 2445130 - protein, 9 aa, Entamoeba dispar
MRNPEERIN

SEQ ID NO: 2445131 - protein, 8 aa, Entamoeba dispar
MRNTSISE

SEQ ID NO: 2445132 - protein, 7 aa, Entamoeba dispar
MRPADFD

SEQ ID NO: 2445133 - protein, 5 aa, Entamoeba dispar
MRPDQ

SEQ ID NO: 2445134 - protein, 22 aa, Entamoeba dispar
MRPGSSSNPLSKFDGKSEKALY

SEQ ID NO: 2445135 - protein, 11 aa, Entamoeba dispar
MRRNASSVDTI

SEQ ID NO: 2445136 - protein, 7 aa, Entamoeba dispar
MRSKDEE

SEQ ID NO: 2445137 - protein, 4 aa, Entamoeba dispar
MRSS

SEQ ID NO: 2445138 - protein, 7 aa, Entamoeba dispar
MRSSNAE

SEQ ID NO: 2445139 - protein, 7 aa, Entamoeba dispar
MRSTDTD

SEQ ID NO: 2445140 - protein, 19 aa, Entamoeba dispar
MRTQADGEAVPSDKAEMQE

SEQ ID NO: 2445141 - protein, 39 aa, Entamoeba dispar
MRVETNAKDEKSSTSYKLNNNEKKETKTVPKIPVGGGAV

SEQ ID NO: 2445142 - protein, 8 aa, Entamoeba dispar
MRVGTKKS

SEQ ID NO: 2445143 - protein, 7 aa, Entamoeba dispar
MSANGKQ

SEQ ID NO: 2445144 - protein, 6 aa, Entamoeba dispar
MSCNRA

SEQ ID NO: 2445145 - protein, 15 aa, Entamoeba dispar
MSDAYEKKISTMKFS

SEQ ID NO: 2445146 - protein, 10 aa, Entamoeba dispar
MSDDARGFET

SEQ ID NO: 2445147 - protein, 7 aa, Entamoeba dispar
MSDEEYN

SEQ ID NO: 2445148 - protein, 10 aa, Entamoeba dispar
MSDGTTGTYF

SEQ ID NO: 2445149 - protein, 5 aa, Entamoeba dispar
MSDGV

SEQ ID NO: 2445150 - protein, 9 aa, Entamoeba dispar
MSDKNSEQM

SEQ ID NO: 2445151 - protein, 7 aa, Entamoeba dispar
MSDPGGG

SEQ ID NO: 2445152 - protein, 6 aa, Entamoeba dispar
MSDQGN

SEQ ID NO: 2445153 - protein, 6 aa, Entamoeba dispar
MSDRNE

SEQ ID NO: 2445154 - protein, 7 aa, Entamoeba dispar
MSDTNLT

SEQ ID NO: 2445155 - protein, 8 aa, Entamoeba dispar
MSDTQAGI

SEQ ID NO: 2445156 - protein, 7 aa, Entamoeba dispar
MSEADEK

SEQ ID NO: 2445157 - protein, 5 aa, Entamoeba dispar
MSEDG

SEQ ID NO: 2445158 - protein, 39 aa, Entamoeba dispar
MSEEEKAKFKPKPRVGPKGKLAKKETPEEKKEETKEEKE

SEQ ID NO: 2445159 - protein, 6 aa, Entamoeba dispar
MSEEGI

SEQ ID NO: 2445160 - protein, 11 aa, Entamoeba dispar
MSEGNPEARER

SEQ ID NO: 2445161 - protein, 17 aa, Entamoeba dispar
MSENSSRSKNSAPASDY

SEQ ID NO: 2445162 - protein, 5 aa, Entamoeba dispar
MSEPL

SEQ ID NO: 2445163 - protein, 33 aa, Entamoeba dispar
MSETSPNECSSGFSSSYSSNHSSPKPPQESPFR

SEQ ID NO: 2445164 - protein, 7 aa, Entamoeba dispar
MSGEDPL

SEQ ID NO: 2445165 - protein, 7 aa, Entamoeba dispar
MSGETFG

SEQ ID NO: 2445166 - protein, 7 aa, Entamoeba dispar
MSGGGLI

SEQ ID NO: 2445167 - protein, 9 aa, Entamoeba dispar
MSGKRPTII

SEQ ID NO: 2445168 - protein, 19 aa, Entamoeba dispar
MSGNENDIIEAKKDKETYM

SEQ ID NO: 2445169 - protein, 8 aa, Entamoeba dispar
MSGQGSMN

SEQ ID NO: 2445170 - protein, 8 aa, Entamoeba dispar
MSGSENIG

SEQ ID NO: 2445171 - protein, 5 aa, Entamoeba dispar
MSGTT

SEQ ID NO: 2445172 - protein, 7 aa, Entamoeba dispar
MSHDEDQ

SEQ ID NO: 2445173 - protein, 6 aa, Entamoeba dispar
MSHDQK

SEQ ID NO: 2445174 - protein, 10 aa, Entamoeba dispar
MSINEDEKEL

SEQ ID NO: 2445175 - protein, 7 aa, Entamoeba dispar
MSKDEQK

SEQ ID NO: 2445176 - protein, 7 aa, Entamoeba dispar
MSKDPMK

SEQ ID NO: 2445177 - protein, 20 aa, Entamoeba dispar
MSKEADKDKMKSMKTQLKKS

SEQ ID NO: 2445178 - protein, 9 aa, Entamoeba dispar
MSKEDIQQK

SEQ ID NO: 2445179 - protein, 13 aa, Entamoeba dispar
MSKGEKKARKALE

SEQ ID NO: 2445180 - protein, 9 aa, Entamoeba dispar
MSKPRKPTE

SEQ ID NO: 2445181 - protein, 9 aa, Entamoeba dispar
MSKPRKSTE

SEQ ID NO: 2445182 - protein, 14 aa, Entamoeba dispar
MSKQAPGTFKEDKY

SEQ ID NO: 2445183 - protein, 9 aa, Entamoeba dispar
MSKRSKRGF

SEQ ID NO: 2445184 - protein, 8 aa, Entamoeba dispar
MSKYSDSS

SEQ ID NO: 2445185 - protein, 19 aa, Entamoeba dispar
MSLERSPKKKGIKSYSTTK

SEQ ID NO: 2445186 - protein, 10 aa, Entamoeba dispar
MSMTKNENDY

SEQ ID NO: 2445187 - protein, 5 aa, Entamoeba dispar
MSNAT

SEQ ID NO: 2445188 - protein, 13 aa, Entamoeba dispar
MSNEDARKRRKNS

SEQ ID NO: 2445189 - protein, 15 aa, Entamoeba dispar
MSNERTKKYLKDESF

SEQ ID NO: 2445190 - protein, 11 aa, Entamoeba dispar
MSNGGPAPLEV

SEQ ID NO: 2445191 - protein, 6 aa, Entamoeba dispar
MSNKPN

SEQ ID NO: 2445192 - protein, 4 aa, Entamoeba dispar
MSNS

SEQ ID NO: 2445193 - protein, 7 aa, Entamoeba dispar
MSNTSDI

SEQ ID NO: 2445194 - protein, 12 aa, Entamoeba dispar
MSPAAIERRERI

SEQ ID NO: 2445195 - protein, 16 aa, Entamoeba dispar
MSPITSPYSFKKGSSM

SEQ ID NO: 2445196 - protein, 8 aa, Entamoeba dispar
MSPMKQKA

SEQ ID NO: 2445197 - protein, 5 aa, Entamoeba dispar
MSQAD

SEQ ID NO: 2445198 - protein, 6 aa, Entamoeba dispar
MSQCSA

SEQ ID NO: 2445199 - protein, 6 aa, Entamoeba dispar
MSQNEI

SEQ ID NO: 2445200 - protein, 11 aa, Entamoeba dispar
MSQNNQPEINA

SEQ ID NO: 2445201 - protein, 4 aa, Entamoeba dispar
MSQQ

SEQ ID NO: 2445202 - protein, 5 aa, Entamoeba dispar
MSQRG

SEQ ID NO: 2445203 - protein, 6 aa, Entamoeba dispar
MSSDNY

SEQ ID NO: 2445204 - protein, 11 aa, Entamoeba dispar
MSSKDTEDHSS

SEQ ID NO: 2445205 - protein, 5 aa, Entamoeba dispar
MSSKS

SEQ ID NO: 2445206 - protein, 4 aa, Entamoeba dispar
MSSR

SEQ ID NO: 2445207 - protein, 10 aa, Entamoeba dispar
MSSSQNENKC

SEQ ID NO: 2445208 - protein, 5 aa, Entamoeba dispar
MSSTQ

SEQ ID NO: 2445209 - protein, 34 aa, Entamoeba dispar
MSSVHSPKPISLSNTVTQKKYTTPRDTSPQQPIT

SEQ ID NO: 2445210 - protein, 9 aa, Entamoeba dispar
MSTDENEDL

SEQ ID NO: 2445211 - protein, 16 aa, Entamoeba dispar
MSTKEVEKGYTKHEGI

SEQ ID NO: 2445212 - protein, 20 aa, Entamoeba dispar
MSTNGLGGIGMSTSGLGGIG

SEQ ID NO: 2445213 - protein, 5 aa, Entamoeba dispar
MSTNN

SEQ ID NO: 2445214 - protein, 7 aa, Entamoeba dispar
MSTPETA

SEQ ID NO: 2445215 - protein, 6 aa, Entamoeba dispar
MSTQEK

SEQ ID NO: 2445216 - protein, 11 aa, Entamoeba dispar
MSTVSSEKSHE

SEQ ID NO: 2445217 - protein, 5 aa, Entamoeba dispar
MSYPD

SEQ ID NO: 2445218 - protein, 5 aa, Entamoeba dispar
MSYPN

SEQ ID NO: 2445219 - protein, 9 aa, Entamoeba dispar
MTAADPEIL

SEQ ID NO: 2445220 - protein, 17 aa, Entamoeba dispar
MTAEITSEEIQAENTAL

SEQ ID NO: 2445221 - protein, 6 aa, Entamoeba dispar
MTAQDI

SEQ ID NO: 2445222 - protein, 4 aa, Entamoeba dispar
MTDD

SEQ ID NO: 2445223 - protein, 17 aa, Entamoeba dispar
MTDENQIKGMSSNADIT

SEQ ID NO: 2445224 - protein, 5 aa, Entamoeba dispar
MTDEQ

SEQ ID NO: 2445225 - protein, 14 aa, Entamoeba dispar
MTDPDMAIAMMVSL

SEQ ID NO: 2445226 - protein, 12 aa, Entamoeba dispar
MTEDEKKNGRLP

SEQ ID NO: 2445227 - protein, 4 aa, Entamoeba dispar
MTEE

SEQ ID NO: 2445228 - protein, 7 aa, Entamoeba dispar
MTEESVS

SEQ ID NO: 2445229 - protein, 4 aa, Entamoeba dispar
MTEQ

SEQ ID NO: 2445230 - protein, 7 aa, Entamoeba dispar
MTEQTRY

SEQ ID NO: 2445231 - protein, 14 aa, Entamoeba dispar
MTERIRKGNELSKQ

SEQ ID NO: 2445232 - protein, 14 aa, Entamoeba dispar
MTGAYNTKAGNVTQ

SEQ ID NO: 2445233 - protein, 5 aa, Entamoeba dispar
MTGDA

SEQ ID NO: 2445234 - protein, 8 aa, Entamoeba dispar
MTGDEESI

SEQ ID NO: 2445235 - protein, 11 aa, Entamoeba dispar
MTGESNKNFKN

SEQ ID NO: 2445236 - protein, 6 aa, Entamoeba dispar
MTGHKG

SEQ ID NO: 2445237 - protein, 9 aa, Entamoeba dispar
MTGSHDRTL

SEQ ID NO: 2445238 - protein, 16 aa, Entamoeba dispar
MTIDESDREEQPLSEE

SEQ ID NO: 2445239 - protein, 7 aa, Entamoeba dispar
MTKDGNT

SEQ ID NO: 2445240 - protein, 8 aa, Entamoeba dispar
MTKKSKME

SEQ ID NO: 2445241 - protein, 9 aa, Entamoeba dispar
MTKPTKEIA

SEQ ID NO: 2445242 - protein, 5 aa, Entamoeba dispar
MTKTA

SEQ ID NO: 2445243 - protein, 5 aa, Entamoeba dispar
MTNNP

SEQ ID NO: 2445244 - protein, 5 aa, Entamoeba dispar
MTNTI

SEQ ID NO: 2445245 - protein, 4 aa, Entamoeba dispar
MTNY

SEQ ID NO: 2445246 - protein, 16 aa, Entamoeba dispar
MTPDEVRNNIKSNLRG

SEQ ID NO: 2445247 - protein, 15 aa, Entamoeba dispar
MTPSPTSYSSFYGLK

SEQ ID NO: 2445248 - protein, 8 aa, Entamoeba dispar
MTPTESKI

SEQ ID NO: 2445249 - protein, 12 aa, Entamoeba dispar
MTPTESKIAAYE

SEQ ID NO: 2445250 - protein, 7 aa, Entamoeba dispar
MTQDDRL

SEQ ID NO: 2445251 - protein, 5 aa, Entamoeba dispar
MTQED

SEQ ID NO: 2445252 - protein, 13 aa, Entamoeba dispar
MTQNQSKNAMEVE

SEQ ID NO: 2445253 - protein, 5 aa, Entamoeba dispar
MTRPE

SEQ ID NO: 2445254 - protein, 10 aa, Entamoeba dispar
MTSGIHEEKK

SEQ ID NO: 2445255 - protein, 6 aa, Entamoeba dispar
MTSGND

SEQ ID NO: 2445256 - protein, 7 aa, Entamoeba dispar
MTSKSEL

SEQ ID NO: 2445257 - protein, 12 aa, Entamoeba dispar
MTSNKSEEDTMK

SEQ ID NO: 2445258 - protein, 7 aa, Entamoeba dispar
MTSNSES

SEQ ID NO: 2445259 - protein, 7 aa, Entamoeba dispar
MTSPNMK

SEQ ID NO: 2445260 - protein, 6 aa, Entamoeba dispar
MTSSAV

SEQ ID NO: 2445261 - protein, 6 aa, Entamoeba dispar
MTSSSG

SEQ ID NO: 2445262 - protein, 8 aa, Entamoeba dispar
MTSTPSPL

SEQ ID NO: 2445263 - protein, 4 aa, Entamoeba dispar
MTTA

SEQ ID NO: 2445264 - protein, 4 aa, Entamoeba dispar
MTTK

SEQ ID NO: 2445265 - protein, 10 aa, Entamoeba dispar
MTTPPDVTDS

SEQ ID NO: 2445266 - protein, 5 aa, Entamoeba dispar
MTTSP

SEQ ID NO: 2445267 - protein, 28 aa, Entamoeba dispar
MVEEDECEKPISITKPQEIPRDNSSLGE

SEQ ID NO: 2445268 - protein, 10 aa, Entamoeba dispar
MVEEKTKKGF

SEQ ID NO: 2445269 - protein, 9 aa, Entamoeba dispar
MVKDGKNTI

SEQ ID NO: 2445270 - protein, 4 aa, Entamoeba dispar
MVNT

SEQ ID NO: 2445271 - protein, 4 aa, Entamoeba dispar
MVPN

SEQ ID NO: 2445272 - protein, 11 aa, Entamoeba dispar
MVTEDKMKSTI

SEQ ID NO: 2445273 - protein, 15 aa, Entamoeba dispar
MVTENEESSISETFE

SEQ ID NO: 2445274 - protein, 12 aa, Entamoeba dispar
MYPPNSPEMTTS

SEQ ID NO: 2445275 - protein, 10 aa, Entamoeba dispar
MYPSQYDKIP

SEQ ID NO: 2445276 - protein, 17 aa, Entamoeba dispar
MYSKDEPHHNNTEDEYK

SEQ ID NO: 2445277 - protein, 30 aa, Entamoeba dispar
MYSPSISPTLSKSFKEETTSFKRKKRLSGL

SEQ ID NO: 2445278 - protein, 17 aa, Entamoeba dispar
NAAAPPPEKKDKKKCVL

SEQ ID NO: 2445279 - protein, 33 aa, Entamoeba dispar
NAAASLNASTGVSNPTHTEAVNKPTNPTHPRAN

SEQ ID NO: 2445280 - protein, 28 aa, Entamoeba dispar
NAAATLKKGSASVTSRAGNSGNSNVKKA

SEQ ID NO: 2445281 - protein, 10 aa, Entamoeba dispar
NAAEKAKLNY

SEQ ID NO: 2445282 - protein, 9 aa, Entamoeba dispar
NAAKDNISE

SEQ ID NO: 2445283 - protein, 5 aa, Entamoeba dispar
NAANV

SEQ ID NO: 2445284 - protein, 9 aa, Entamoeba dispar
NAAQDERSR

SEQ ID NO: 2445285 - protein, 10 aa, Entamoeba dispar
NAATNRQSTA

SEQ ID NO: 2445286 - protein, 7 aa, Entamoeba dispar
NADDGNY

SEQ ID NO: 2445287 - protein, 9 aa, Entamoeba dispar
NADDLDTTH

SEQ ID NO: 2445288 - protein, 4 aa, Entamoeba dispar
NADE

SEQ ID NO: 2445289 - protein, 4 aa, Entamoeba dispar
NADG

SEQ ID NO: 2445290 - protein, 23 aa, Entamoeba dispar
NADGENERKILGTDKVDNLNENH

SEQ ID NO: 2445291 - protein, 8 aa, Entamoeba dispar
NADGKKKV

SEQ ID NO: 2445292 - protein, 5 aa, Entamoeba dispar
NADNS

SEQ ID NO: 2445293 - protein, 15 aa, Entamoeba dispar
NADNSNKPSINPDTV

SEQ ID NO: 2445294 - protein, 14 aa, Entamoeba dispar
NADNSSKPSINPDT

SEQ ID NO: 2445295 - protein, 26 aa, Entamoeba dispar
NADNSSKPSINPDTVYNATDSSYTNG

SEQ ID NO: 2445296 - protein, 26 aa, Entamoeba dispar
NADNSSKPSINPDTVYNSGDQTYSNG

SEQ ID NO: 2445297 - protein, 10 aa, Entamoeba dispar
NADPDKLGGT

SEQ ID NO: 2445298 - protein, 6 aa, Entamoeba dispar
NADPTN

SEQ ID NO: 2445299 - protein, 5 aa, Entamoeba dispar
NADRY

SEQ ID NO: 2445300 - protein, 6 aa, Entamoeba dispar
NADSGE

SEQ ID NO: 2445301 - protein, 8 aa, Entamoeba dispar
NADSQPIL

SEQ ID NO: 2445302 - protein, 16 aa, Entamoeba dispar
NADTSEHDYGIPTNAL

SEQ ID NO: 2445303 - protein, 5 aa, Entamoeba dispar
NADYP

SEQ ID NO: 2445304 - protein, 15 aa, Entamoeba dispar
NAEDEEKRKIEEEEA

SEQ ID NO: 2445305 - protein, 9 aa, Entamoeba dispar
NAEDGKKII

SEQ ID NO: 2445306 - protein, 7 aa, Entamoeba dispar
NAEDIST

SEQ ID NO: 2445307 - protein, 10 aa, Entamoeba dispar
NAEDLEGATI

SEQ ID NO: 2445308 - protein, 7 aa, Entamoeba dispar
NAEEGIS

SEQ ID NO: 2445309 - protein, 25 aa, Entamoeba dispar
NAEEIKEEEEKKEIKKEEIKTEREI

SEQ ID NO: 2445310 - protein, 7 aa, Entamoeba dispar
NAEHSGV

SEQ ID NO: 2445311 - protein, 6 aa, Entamoeba dispar
NAEING

SEQ ID NO: 2445312 - protein, 14 aa, Entamoeba dispar
NAEKVQRLTAKRQA

SEQ ID NO: 2445313 - protein, 6 aa, Entamoeba dispar
NAENRT

SEQ ID NO: 2445314 - protein, 10 aa, Entamoeba dispar
NAEQQLSDNK

SEQ ID NO: 2445315 - protein, 6 aa, Entamoeba dispar
NAERIG

SEQ ID NO: 2445316 - protein, 6 aa, Entamoeba dispar
NAETLE

SEQ ID NO: 2445317 - protein, 8 aa, Entamoeba dispar
NAEYNPKR

SEQ ID NO: 2445318 - protein, 4 aa, Entamoeba dispar
NAFP

SEQ ID NO: 2445319 - protein, 6 aa, Entamoeba dispar
NAFPTE

SEQ ID NO: 2445320 - protein, 6 aa, Entamoeba dispar
NAFSGC

SEQ ID NO: 2445321 - protein, 8 aa, Entamoeba dispar
NAGAANDA

SEQ ID NO: 2445322 - protein, 9 aa, Entamoeba dispar
NAGDKDDME

SEQ ID NO: 2445323 - protein, 13 aa, Entamoeba dispar
NAGGKYSMSLQCS

SEQ ID NO: 2445324 - protein, 6 aa, Entamoeba dispar
NAGIDG

SEQ ID NO: 2445325 - protein, 6 aa, Entamoeba dispar
NAGKDM

SEQ ID NO: 2445326 - protein, 8 aa, Entamoeba dispar
NAGNSPLS

SEQ ID NO: 2445327 - protein, 9 aa, Entamoeba dispar
NAGPNTNGS

SEQ ID NO: 2445328 - protein, 7 aa, Entamoeba dispar
NAGPQID

SEQ ID NO: 2445329 - protein, 6 aa, Entamoeba dispar
NAGQID

SEQ ID NO: 2445330 - protein, 7 aa, Entamoeba dispar
NAGTQRR

SEQ ID NO: 2445331 - protein, 7 aa, Entamoeba dispar
NAGYDSA

SEQ ID NO: 2445332 - protein, 4 aa, Entamoeba dispar
NAHE

SEQ ID NO: 2445333 - protein, 6 aa, Entamoeba dispar
NAHENQ

SEQ ID NO: 2445334 - protein, 4 aa, Entamoeba dispar
NAHN

SEQ ID NO: 2445335 - protein, 13 aa, Entamoeba dispar
NAHQKATDIQEMP

SEQ ID NO: 2445336 - protein, 13 aa, Entamoeba dispar
NAHQNATDIQEMP

SEQ ID NO: 2445337 - protein, 6 aa, Entamoeba dispar
NAIGDQ

SEQ ID NO: 2445338 - protein, 6 aa, Entamoeba dispar
NAIGYS

SEQ ID NO: 2445339 - protein, 6 aa, Entamoeba dispar
NAIKNN

SEQ ID NO: 2445340 - protein, 13 aa, Entamoeba dispar
NAINDETINTLQG

SEQ ID NO: 2445341 - protein, 8 aa, Entamoeba dispar
NAINGDHQ

SEQ ID NO: 2445342 - protein, 6 aa, Entamoeba dispar
NAIQPT

SEQ ID NO: 2445343 - protein, 7 aa, Entamoeba dispar
NAISKEA

SEQ ID NO: 2445344 - protein, 6 aa, Entamoeba dispar
NAISQV

SEQ ID NO: 2445345 - protein, 4 aa, Entamoeba dispar
NAIT

SEQ ID NO: 2445346 - protein, 8 aa, Entamoeba dispar
NAITPGTE

SEQ ID NO: 2445347 - protein, 7 aa, Entamoeba dispar
NAITPQQ

SEQ ID NO: 2445348 - protein, 4 aa, Entamoeba dispar
NAIY

SEQ ID NO: 2445349 - protein, 10 aa, Entamoeba dispar
NAKAVSGSKF

SEQ ID NO: 2445350 - protein, 6 aa, Entamoeba dispar
NAKDST

SEQ ID NO: 2445351 - protein, 12 aa, Entamoeba dispar
NAKEQPNGITRK

SEQ ID NO: 2445352 - protein, 4 aa, Entamoeba dispar
NAKG

SEQ ID NO: 2445353 - protein, 15 aa, Entamoeba dispar
NAKIPLPKKSSEGLK

SEQ ID NO: 2445354 - protein, 7 aa, Entamoeba dispar
NAKIRKE

SEQ ID NO: 2445355 - protein, 5 aa, Entamoeba dispar
NAKPE

SEQ ID NO: 2445356 - protein, 6 aa, Entamoeba dispar
NAKQRS

SEQ ID NO: 2445357 - protein, 8 aa, Entamoeba dispar
NAKQVERK

SEQ ID NO: 2445358 - protein, 7 aa, Entamoeba dispar
NAKRSGG

SEQ ID NO: 2445359 - protein, 8 aa, Entamoeba dispar
NAKSGLTS

SEQ ID NO: 2445360 - protein, 10 aa, Entamoeba dispar
NAKSKDVKTV

SEQ ID NO: 2445361 - protein, 26 aa, Entamoeba dispar
NAKSKTGSKTFNIENEYKQATQIDGK

SEQ ID NO: 2445362 - protein, 8 aa, Entamoeba dispar
NAKTETAK

SEQ ID NO: 2445363 - protein, 12 aa, Entamoeba dispar
NAKTQEDKDKAA

SEQ ID NO: 2445364 - protein, 10 aa, Entamoeba dispar
NAKTRVDSRT

SEQ ID NO: 2445365 - protein, 13 aa, Entamoeba dispar
NAKTVKNNNSSRF

SEQ ID NO: 2445366 - protein, 8 aa, Entamoeba dispar
NALDGDNN

SEQ ID NO: 2445367 - protein, 21 aa, Entamoeba dispar
NALEKDSKDNISVVVVQIHTV

SEQ ID NO: 2445368 - protein, 7 aa, Entamoeba dispar
NALGESP

SEQ ID NO: 2445369 - protein, 10 aa, Entamoeba dispar
NALGKKGEIK

SEQ ID NO: 2445370 - protein, 11 aa, Entamoeba dispar
NALKDGRYSQT

SEQ ID NO: 2445371 - protein, 11 aa, Entamoeba dispar
NALKDSRYSQT

SEQ ID NO: 2445372 - protein, 9 aa, Entamoeba dispar
NALKGSYEK

SEQ ID NO: 2445373 - protein, 13 aa, Entamoeba dispar
NALNGKITSSNDY

SEQ ID NO: 2445374 - protein, 9 aa, Entamoeba dispar
NALRETEDL

SEQ ID NO: 2445375 - protein, 4 aa, Entamoeba dispar
NALT

SEQ ID NO: 2445376 - protein, 7 aa, Entamoeba dispar
NANAPEE

SEQ ID NO: 2445377 - protein, 6 aa, Entamoeba dispar
NANAQT

SEQ ID NO: 2445378 - protein, 9 aa, Entamoeba dispar
NANDNKKEM

SEQ ID NO: 2445379 - protein, 7 aa, Entamoeba dispar
NANDSPI

SEQ ID NO: 2445380 - protein, 11 aa, Entamoeba dispar
NANDYLRSRGK

SEQ ID NO: 2445381 - protein, 7 aa, Entamoeba dispar
NANEESI

SEQ ID NO: 2445382 - protein, 16 aa, Entamoeba dispar
NANGEQGTVPLNYLRK

SEQ ID NO: 2445383 - protein, 8 aa, Entamoeba dispar
NANGSERY

SEQ ID NO: 2445384 - protein, 9 aa, Entamoeba dispar
NANGTPGFI

SEQ ID NO: 2445385 - protein, 7 aa, Entamoeba dispar
NANINEG

SEQ ID NO: 2445386 - protein, 8 aa, Entamoeba dispar
NANIPSDL

SEQ ID NO: 2445387 - protein, 8 aa, Entamoeba dispar
NANLTPMD

SEQ ID NO: 2445388 - protein, 9 aa, Entamoeba dispar
NANNKLKAF

SEQ ID NO: 2445389 - protein, 16 aa, Entamoeba dispar
NANQQKGVDTKEELVE

SEQ ID NO: 2445390 - protein, 10 aa, Entamoeba dispar
NANRTLSKRG

SEQ ID NO: 2445391 - protein, 8 aa, Entamoeba dispar
NANSQIET

SEQ ID NO: 2445392 - protein, 6 aa, Entamoeba dispar
NANTIN

SEQ ID NO: 2445393 - protein, 4 aa, Entamoeba dispar
NANV

SEQ ID NO: 2445394 - protein, 7 aa, Entamoeba dispar
NANVPPT

SEQ ID NO: 2445395 - protein, 8 aa, Entamoeba dispar
NAPEAQRV

SEQ ID NO: 2445396 - protein, 8 aa, Entamoeba dispar
NAPEEPHK

SEQ ID NO: 2445397 - protein, 8 aa, Entamoeba dispar
NAPKSGEV

SEQ ID NO: 2445398 - protein, 16 aa, Entamoeba dispar
NAPLRPPKSNPRHGSF

SEQ ID NO: 2445399 - protein, 12 aa, Entamoeba dispar
NAPNMSVEGRTY

SEQ ID NO: 2445400 - protein, 15 aa, Entamoeba dispar
NAPPFKKRKGVEQPI

SEQ ID NO: 2445401 - protein, 4 aa, Entamoeba dispar
NAPQ

SEQ ID NO: 2445402 - protein, 14 aa, Entamoeba dispar
NAPQGANGAEVEKA

SEQ ID NO: 2445403 - protein, 16 aa, Entamoeba dispar
NAPQGAQSAEMQKAQE

SEQ ID NO: 2445404 - protein, 4 aa, Entamoeba dispar
NAPR

SEQ ID NO: 2445405 - protein, 16 aa, Entamoeba dispar
NAPRDCPKREANPDRA

SEQ ID NO: 2445406 - protein, 5 aa, Entamoeba dispar
NAPRI

SEQ ID NO: 2445407 - protein, 13 aa, Entamoeba dispar
NAPRSKYKPKPIY

SEQ ID NO: 2445408 - protein, 13 aa, Entamoeba dispar
NAPSNGLFSVVSL

SEQ ID NO: 2445409 - protein, 18 aa, Entamoeba dispar
NAPSSVAQEEEKQRLESD

SEQ ID NO: 2445410 - protein, 6 aa, Entamoeba dispar
NAPTQQ

SEQ ID NO: 2445411 - protein, 20 aa, Entamoeba dispar
NAQASKMLEEDKSEQRLRRY

SEQ ID NO: 2445412 - protein, 12 aa, Entamoeba dispar
NAQDDGYEPRKE

SEQ ID NO: 2445413 - protein, 5 aa, Entamoeba dispar
NAQEG

SEQ ID NO: 2445414 - protein, 8 aa, Entamoeba dispar
NAQEKLKK

SEQ ID NO: 2445415 - protein, 7 aa, Entamoeba dispar
NAQGEDV

SEQ ID NO: 2445416 - protein, 17 aa, Entamoeba dispar
NAQIEEENKRLQNEIEE

SEQ ID NO: 2445417 - protein, 26 aa, Entamoeba dispar
NAQNEEGDDEEDDDDEYEYEEVEEDE

SEQ ID NO: 2445418 - protein, 6 aa, Entamoeba dispar
NAQNPK

SEQ ID NO: 2445419 - protein, 11 aa, Entamoeba dispar
NAQPEDAITAS

SEQ ID NO: 2445420 - protein, 5 aa, Entamoeba dispar
NAQQF

SEQ ID NO: 2445421 - protein, 19 aa, Entamoeba dispar
NAQQTAKPASGNKPMGSET

SEQ ID NO: 2445422 - protein, 9 aa, Entamoeba dispar
NAQQTDTQV

SEQ ID NO: 2445423 - protein, 7 aa, Entamoeba dispar
NAQQTMD

SEQ ID NO: 2445424 - protein, 8 aa, Entamoeba dispar
NAQSGTKY

SEQ ID NO: 2445425 - protein, 5 aa, Entamoeba dispar
NAQSK

SEQ ID NO: 2445426 - protein, 8 aa, Entamoeba dispar
NAQSKNRG

SEQ ID NO: 2445427 - protein, 15 aa, Entamoeba dispar
NAQTNAKPTNSGPET

SEQ ID NO: 2445428 - protein, 6 aa, Entamoeba dispar
NAQTTE

SEQ ID NO: 2445429 - protein, 7 aa, Entamoeba dispar
NARETAI

SEQ ID NO: 2445430 - protein, 48 aa, Entamoeba dispar
NARKDNAKAKEQEEKEKKKAEEAKKKAQLAAARKAGGKVDALGDVDTM

SEQ ID NO: 2445431 - protein, 9 aa, Entamoeba dispar
NARKSSNSE

SEQ ID NO: 2445432 - protein, 12 aa, Entamoeba dispar
NARNSEINTEIR

SEQ ID NO: 2445433 - protein, 16 aa, Entamoeba dispar
NARNTRKQQLVQLAEL

SEQ ID NO: 2445434 - protein, 5 aa, Entamoeba dispar
NARPS

SEQ ID NO: 2445435 - protein, 11 aa, Entamoeba dispar
NARPSKSEQIK

SEQ ID NO: 2445436 - protein, 14 aa, Entamoeba dispar
NARTYDKKGVTIPS

SEQ ID NO: 2445437 - protein, 6 aa, Entamoeba dispar
NASCSR

SEQ ID NO: 2445438 - protein, 14 aa, Entamoeba dispar
NASDEVKNKPIESI

SEQ ID NO: 2445439 - protein, 10 aa, Entamoeba dispar
NASESKQNKC

SEQ ID NO: 2445440 - protein, 7 aa, Entamoeba dispar
NASEYPR

SEQ ID NO: 2445441 - protein, 7 aa, Entamoeba dispar
NASKAAV

SEQ ID NO: 2445442 - protein, 14 aa, Entamoeba dispar
NASNDLNGKEIEYT

SEQ ID NO: 2445443 - protein, 4 aa, Entamoeba dispar
NASP

SEQ ID NO: 2445444 - protein, 10 aa, Entamoeba dispar
NASQNDFTSI

SEQ ID NO: 2445445 - protein, 24 aa, Entamoeba dispar
NASQSINSSYTPQLSKNKSNRFNQ

SEQ ID NO: 2445446 - protein, 15 aa, Entamoeba dispar
NASRGEIQKNKSLEE

SEQ ID NO: 2445447 - protein, 6 aa, Entamoeba dispar
NASSKM

SEQ ID NO: 2445448 - protein, 10 aa, Entamoeba dispar
NASSSNPAPL

SEQ ID NO: 2445449 - protein, 8 aa, Entamoeba dispar
NASSTFHG

SEQ ID NO: 2445450 - protein, 5 aa, Entamoeba dispar
NASTI

SEQ ID NO: 2445451 - protein, 5 aa, Entamoeba dispar
NASTN

SEQ ID NO: 2445452 - protein, 18 aa, Entamoeba dispar
NASTVEETSNDKPAEKPD

SEQ ID NO: 2445453 - protein, 4 aa, Entamoeba dispar
NASY

SEQ ID NO: 2445454 - protein, 5 aa, Entamoeba dispar
NASYN

SEQ ID NO: 2445455 - protein, 6 aa, Entamoeba dispar
NASYPL

SEQ ID NO: 2445456 - protein, 8 aa, Entamoeba dispar
NATAEDGI

SEQ ID NO: 2445457 - protein, 13 aa, Entamoeba dispar
NATDAAKCYQDKD

SEQ ID NO: 2445458 - protein, 8 aa, Entamoeba dispar
NATDAQRT

SEQ ID NO: 2445459 - protein, 10 aa, Entamoeba dispar
NATDDQRRAM

SEQ ID NO: 2445460 - protein, 8 aa, Entamoeba dispar
NATDKDKS

SEQ ID NO: 2445461 - protein, 10 aa, Entamoeba dispar
NATDSSYTNG

SEQ ID NO: 2445462 - protein, 9 aa, Entamoeba dispar
NATEGFSGA

SEQ ID NO: 2445463 - protein, 8 aa, Entamoeba dispar
NATEKGDM

SEQ ID NO: 2445464 - protein, 6 aa, Entamoeba dispar
NATEPI

SEQ ID NO: 2445465 - protein, 6 aa, Entamoeba dispar
NATFSS

SEQ ID NO: 2445466 - protein, 5 aa, Entamoeba dispar
NATGL

SEQ ID NO: 2445467 - protein, 11 aa, Entamoeba dispar
NATKKSKPNLL

SEQ ID NO: 2445468 - protein, 14 aa, Entamoeba dispar
NATMTTQNDDLITK

SEQ ID NO: 2445469 - protein, 7 aa, Entamoeba dispar
NATPSAI

SEQ ID NO: 2445470 - protein, 5 aa, Entamoeba dispar
NATQR

SEQ ID NO: 2445471 - protein, 6 aa, Entamoeba dispar
NATRIQ

SEQ ID NO: 2445472 - protein, 14 aa, Entamoeba dispar
NATRYANGYTKDTP

SEQ ID NO: 2445473 - protein, 6 aa, Entamoeba dispar
NATTMV

SEQ ID NO: 2445474 - protein, 28 aa, Entamoeba dispar
NATVAQKNSIKEETAKEKKDVYNRDANW

SEQ ID NO: 2445475 - protein, 34 aa, Entamoeba dispar
NAVKEEKKQIEEEKEKEKTEIKEEKEKIEEEKNE

SEQ ID NO: 2445476 - protein, 10 aa, Entamoeba dispar
NAVKNAGNRR

SEQ ID NO: 2445477 - protein, 9 aa, Entamoeba dispar
NAVKPKKNI

SEQ ID NO: 2445478 - protein, 4 aa, Entamoeba dispar
NAVP

SEQ ID NO: 2445479 - protein, 12 aa, Entamoeba dispar
NAWTKSGAYTGE

SEQ ID NO: 2445480 - protein, 11 aa, Entamoeba dispar
NAYADHPDPKI

SEQ ID NO: 2445481 - protein, 7 aa, Entamoeba dispar
NAYEKQD

SEQ ID NO: 2445482 - protein, 6 aa, Entamoeba dispar
NAYETS

SEQ ID NO: 2445483 - protein, 4 aa, Entamoeba dispar
NAYT

SEQ ID NO: 2445484 - protein, 5 aa, Entamoeba dispar
NCEDS

SEQ ID NO: 2445485 - protein, 10 aa, Entamoeba dispar
NCEDSSKTQI

SEQ ID NO: 2445486 - protein, 14 aa, Entamoeba dispar
NCEDYSEENNKSYV

SEQ ID NO: 2445487 - protein, 8 aa, Entamoeba dispar
NCESPANV

SEQ ID NO: 2445488 - protein, 25 aa, Entamoeba dispar
NCGENEESRLSGNFKREYEDNGQTI

SEQ ID NO: 2445489 - protein, 7 aa, Entamoeba dispar
NCGKDDP

SEQ ID NO: 2445490 - protein, 10 aa, Entamoeba dispar
NCISEDEKKQ

SEQ ID NO: 2445491 - protein, 9 aa, Entamoeba dispar
NCKDGISNK

SEQ ID NO: 2445492 - protein, 8 aa, Entamoeba dispar
NCKTETVT

SEQ ID NO: 2445493 - protein, 24 aa, Entamoeba dispar
NCKTMDEKSKQEKINEQRKYYKEK

SEQ ID NO: 2445494 - protein, 19 aa, Entamoeba dispar
NCNANENETIKRFGDSTQG

SEQ ID NO: 2445495 - protein, 7 aa, Entamoeba dispar
NCNSNEA

SEQ ID NO: 2445496 - protein, 12 aa, Entamoeba dispar
NCNSQGVDLSGS

SEQ ID NO: 2445497 - protein, 9 aa, Entamoeba dispar
NCPESKMDN

SEQ ID NO: 2445498 - protein, 19 aa, Entamoeba dispar
NCPKNKGASFSAVFKRISL

SEQ ID NO: 2445499 - protein, 4 aa, Entamoeba dispar
NCQG

SEQ ID NO: 2445500 - protein, 4 aa, Entamoeba dispar
NCQY

SEQ ID NO: 2445501 - protein, 15 aa, Entamoeba dispar
NCSDTTMDLEPIIEG

SEQ ID NO: 2445502 - protein, 8 aa, Entamoeba dispar
NCSPSSKM

SEQ ID NO: 2445503 - protein, 18 aa, Entamoeba dispar
NCTPRSATSIDSERHSDL

SEQ ID NO: 2445504 - protein, 5 aa, Entamoeba dispar
NCTQQ

SEQ ID NO: 2445505 - protein, 39 aa, Entamoeba dispar
NCTREKEAALRKKEQVETDLKEKSEEYDALNEKQRELNS

SEQ ID NO: 2445506 - protein, 9 aa, Entamoeba dispar
NDADECNED

SEQ ID NO: 2445507 - protein, 8 aa, Entamoeba dispar
NDADKQRS

SEQ ID NO: 2445508 - protein, 8 aa, Entamoeba dispar
NDAEGAKK

SEQ ID NO: 2445509 - protein, 7 aa, Entamoeba dispar
NDAERQK

SEQ ID NO: 2445510 - protein, 14 aa, Entamoeba dispar
NDAGEITDYCNKLL

SEQ ID NO: 2445511 - protein, 7 aa, Entamoeba dispar
NDAKTAF

SEQ ID NO: 2445512 - protein, 14 aa, Entamoeba dispar
NDAKVKSNKDNKYP

SEQ ID NO: 2445513 - protein, 21 aa, Entamoeba dispar
NDALEEDMSEDEEVFENESSK

SEQ ID NO: 2445514 - protein, 6 aa, Entamoeba dispar
NDAPFL

SEQ ID NO: 2445515 - protein, 9 aa, Entamoeba dispar
NDAPNNQFE

SEQ ID NO: 2445516 - protein, 7 aa, Entamoeba dispar
NDAPSRE

SEQ ID NO: 2445517 - protein, 8 aa, Entamoeba dispar
NDASNTYK

SEQ ID NO: 2445518 - protein, 6 aa, Entamoeba dispar
NDASSV

SEQ ID NO: 2445519 - protein, 4 aa, Entamoeba dispar
NDAT

SEQ ID NO: 2445520 - protein, 9 aa, Entamoeba dispar
NDAYNGTKM

SEQ ID NO: 2445521 - protein, 4 aa, Entamoeba dispar
NDCE

SEQ ID NO: 2445522 - protein, 6 aa, Entamoeba dispar
NDCTNE

SEQ ID NO: 2445523 - protein, 29 aa, Entamoeba dispar
NDDASDAYRTAEKTASTNNGNSTHDPRKK

SEQ ID NO: 2445524 - protein, 4 aa, Entamoeba dispar
NDDD

SEQ ID NO: 2445525 - protein, 4 aa, Entamoeba dispar
NDDE

SEQ ID NO: 2445526 - protein, 8 aa, Entamoeba dispar
NDDEAKEA

SEQ ID NO: 2445527 - protein, 7 aa, Entamoeba dispar
NDDEIES

SEQ ID NO: 2445528 - protein, 7 aa, Entamoeba dispar
NDDENDI

SEQ ID NO: 2445529 - protein, 5 aa, Entamoeba dispar
NDDET

SEQ ID NO: 2445530 - protein, 12 aa, Entamoeba dispar
NDDFNDKKKEGV

SEQ ID NO: 2445531 - protein, 4 aa, Entamoeba dispar
NDDG

SEQ ID NO: 2445532 - protein, 6 aa, Entamoeba dispar
NDDGEI

SEQ ID NO: 2445533 - protein, 13 aa, Entamoeba dispar
NDDGIGRSTEETI

SEQ ID NO: 2445534 - protein, 22 aa, Entamoeba dispar
NDDGTCKECSKNFGSECTKCTA

SEQ ID NO: 2445535 - protein, 6 aa, Entamoeba dispar
NDDIDV

SEQ ID NO: 2445536 - protein, 17 aa, Entamoeba dispar
NDDIKKKESKPEKIPPL

SEQ ID NO: 2445537 - protein, 8 aa, Entamoeba dispar
NDDINNRQ

SEQ ID NO: 2445538 - protein, 7 aa, Entamoeba dispar
NDDIRKD

SEQ ID NO: 2445539 - protein, 5 aa, Entamoeba dispar
NDDKT

SEQ ID NO: 2445540 - protein, 7 aa, Entamoeba dispar
NDDKTPK

SEQ ID NO: 2445541 - protein, 10 aa, Entamoeba dispar
NDDNFNKKQD

SEQ ID NO: 2445542 - protein, 6 aa, Entamoeba dispar
NDDPED

SEQ ID NO: 2445543 - protein, 135 aa, Entamoeba dispar
NDDPIKHKSKRISKRSLDHSEDESSEDEPKRRRHRRRRRRHSTSDSSSEDSESSSSEDDRRKRKRKHKRSHSRHSKRRHHRKTKDSSSSSEEEQRRRRKRKERKRYSRSSSSSSRTTTSEERHKRRKTKKIEQIP

SEQ ID NO: 2445544 - protein, 6 aa, Entamoeba dispar
NDDPTF

SEQ ID NO: 2445545 - protein, 7 aa, Entamoeba dispar
NDDQVEK

SEQ ID NO: 2445546 - protein, 6 aa, Entamoeba dispar
NDDTIG

SEQ ID NO: 2445547 - protein, 8 aa, Entamoeba dispar
NDDTKNEI

SEQ ID NO: 2445548 - protein, 14 aa, Entamoeba dispar
NDDTKQKQYRSGKT

SEQ ID NO: 2445549 - protein, 7 aa, Entamoeba dispar
NDDTPYV

SEQ ID NO: 2445550 - protein, 13 aa, Entamoeba dispar
NDDTRVKLNNNGY

SEQ ID NO: 2445551 - protein, 5 aa, Entamoeba dispar
NDDTV

SEQ ID NO: 2445552 - protein, 7 aa, Entamoeba dispar
NDDVEDV

SEQ ID NO: 2445553 - protein, 6 aa, Entamoeba dispar
NDDVVS

SEQ ID NO: 2445554 - protein, 4 aa, Entamoeba dispar
NDED

SEQ ID NO: 2445555 - protein, 11 aa, Entamoeba dispar
NDEDEDGAPME

SEQ ID NO: 2445556 - protein, 14 aa, Entamoeba dispar
NDEDEPIKDELSDS

SEQ ID NO: 2445557 - protein, 10 aa, Entamoeba dispar
NDEDKIINDD

SEQ ID NO: 2445558 - protein, 5 aa, Entamoeba dispar
NDEDL

SEQ ID NO: 2445559 - protein, 15 aa, Entamoeba dispar
NDEDLDKKIGDLQKG

SEQ ID NO: 2445560 - protein, 6 aa, Entamoeba dispar
NDEDPH

SEQ ID NO: 2445561 - protein, 5 aa, Entamoeba dispar
NDEDS

SEQ ID NO: 2445562 - protein, 24 aa, Entamoeba dispar
NDEEAVEEIKNDEYSAYYKGREPK

SEQ ID NO: 2445563 - protein, 8 aa, Entamoeba dispar
NDEEFEDV

SEQ ID NO: 2445564 - protein, 20 aa, Entamoeba dispar
NDEEFNDETIDAKMQKDEGG

SEQ ID NO: 2445565 - protein, 15 aa, Entamoeba dispar
NDEELEEVKTEVQSE

SEQ ID NO: 2445566 - protein, 7 aa, Entamoeba dispar
NDEENSI

SEQ ID NO: 2445567 - protein, 7 aa, Entamoeba dispar
NDEEQIN

SEQ ID NO: 2445568 - protein, 30 aa, Entamoeba dispar
  misc_feature (16)..(17): Xaa can be any naturally occurring amino acid
NDEERGVVWEEVIMSXXHYVFCKKKEELPS

SEQ ID NO: 2445569 - protein, 6 aa, Entamoeba dispar
NDEERR

SEQ ID NO: 2445570 - protein, 7 aa, Entamoeba dispar
NDEETHD

SEQ ID NO: 2445571 - protein, 19 aa, Entamoeba dispar
NDEGEDLDEDEDAYDEKPL

SEQ ID NO: 2445572 - protein, 8 aa, Entamoeba dispar
NDEGELKE

SEQ ID NO: 2445573 - protein, 8 aa, Entamoeba dispar
NDEGQNEI

SEQ ID NO: 2445574 - protein, 4 aa, Entamoeba dispar
NDEH

SEQ ID NO: 2445575 - protein, 5 aa, Entamoeba dispar
NDEHT

SEQ ID NO: 2445576 - protein, 4 aa, Entamoeba dispar
NDEI

SEQ ID NO: 2445577 - protein, 7 aa, Entamoeba dispar
NDEIEKY

SEQ ID NO: 2445578 - protein, 11 aa, Entamoeba dispar
NDEIESCPSIP

SEQ ID NO: 2445579 - protein, 12 aa, Entamoeba dispar
NDEKEFYCNAYI

SEQ ID NO: 2445580 - protein, 6 aa, Entamoeba dispar
NDEKGA

SEQ ID NO: 2445581 - protein, 9 aa, Entamoeba dispar
NDEKKSYNF

SEQ ID NO: 2445582 - protein, 11 aa, Entamoeba dispar
NDEKREQNQLP

SEQ ID NO: 2445583 - protein, 5 aa, Entamoeba dispar
NDEKS

SEQ ID NO: 2445584 - protein, 6 aa, Entamoeba dispar
NDEKSK

SEQ ID NO: 2445585 - protein, 7 aa, Entamoeba dispar
NDELGKR

SEQ ID NO: 2445586 - protein, 13 aa, Entamoeba dispar
NDELKGNPGINSL

SEQ ID NO: 2445587 - protein, 8 aa, Entamoeba dispar
NDELKKAA

SEQ ID NO: 2445588 - protein, 5 aa, Entamoeba dispar
NDELS

SEQ ID NO: 2445589 - protein, 10 aa, Entamoeba dispar
NDELSNPRIG

SEQ ID NO: 2445590 - protein, 4 aa, Entamoeba dispar
NDEM

SEQ ID NO: 2445591 - protein, 6 aa, Entamoeba dispar
NDEMSK

SEQ ID NO: 2445592 - protein, 8 aa, Entamoeba dispar
NDENEEKV

SEQ ID NO: 2445593 - protein, 7 aa, Entamoeba dispar
NDENNVK

SEQ ID NO: 2445594 - protein, 10 aa, Entamoeba dispar
NDENPQRDDM

SEQ ID NO: 2445595 - protein, 38 aa, Entamoeba dispar
NDEQIAYDEDSFQEGTTNQKDSHYQTKKNHHDTTPSHQ

SEQ ID NO: 2445596 - protein, 7 aa, Entamoeba dispar
NDERRDT

SEQ ID NO: 2445597 - protein, 38 aa, Entamoeba dispar
NDESNNGSSEEQINEESIHQNNSEESQYDTTTTQPLNQ

SEQ ID NO: 2445598 - protein, 11 aa, Entamoeba dispar
NDESSEDEIPH

SEQ ID NO: 2445599 - protein, 9 aa, Entamoeba dispar
NDEVHEKTN

SEQ ID NO: 2445600 - protein, 6 aa, Entamoeba dispar
NDEYKG

SEQ ID NO: 2445601 - protein, 9 aa, Entamoeba dispar
NDEYNNNTR

SEQ ID NO: 2445602 - protein, 7 aa, Entamoeba dispar
NDFAQPS

SEQ ID NO: 2445603 - protein, 4 aa, Entamoeba dispar
NDFD

SEQ ID NO: 2445604 - protein, 6 aa, Entamoeba dispar
NDFEEN

SEQ ID NO: 2445605 - protein, 12 aa, Entamoeba dispar
NDFKKAKAKSVA

SEQ ID NO: 2445606 - protein, 4 aa, Entamoeba dispar
NDFN

SEQ ID NO: 2445607 - protein, 12 aa, Entamoeba dispar
NDFNEARQSGQY

SEQ ID NO: 2445608 - protein, 7 aa, Entamoeba dispar
NDFPSDY

SEQ ID NO: 2445609 - protein, 6 aa, Entamoeba dispar
NDFPSG

SEQ ID NO: 2445610 - protein, 6 aa, Entamoeba dispar
NDFQSE

SEQ ID NO: 2445611 - protein, 6 aa, Entamoeba dispar
NDFRDK

SEQ ID NO: 2445612 - protein, 7 aa, Entamoeba dispar
NDFSEED

SEQ ID NO: 2445613 - protein, 13 aa, Entamoeba dispar
NDFTDPTTSGFKD

SEQ ID NO: 2445614 - protein, 4 aa, Entamoeba dispar
NDGA

SEQ ID NO: 2445615 - protein, 10 aa, Entamoeba dispar
NDGEVKRIRG

SEQ ID NO: 2445616 - protein, 23 aa, Entamoeba dispar
NDGFDTEISEESFDEDSDDFPEH

SEQ ID NO: 2445617 - protein, 5 aa, Entamoeba dispar
NDGKE

SEQ ID NO: 2445618 - protein, 5 aa, Entamoeba dispar
NDGKI

SEQ ID NO: 2445619 - protein, 8 aa, Entamoeba dispar
NDGKVPTD

SEQ ID NO: 2445620 - protein, 4 aa, Entamoeba dispar
NDGL

SEQ ID NO: 2445621 - protein, 15 aa, Entamoeba dispar
NDGLSSPSLINPNNT

SEQ ID NO: 2445622 - protein, 8 aa, Entamoeba dispar
NDGNAKTS

SEQ ID NO: 2445623 - protein, 7 aa, Entamoeba dispar
NDGNKSI

SEQ ID NO: 2445624 - protein, 6 aa, Entamoeba dispar
NDGNPY

SEQ ID NO: 2445625 - protein, 6 aa, Entamoeba dispar
NDGQTS

SEQ ID NO: 2445626 - protein, 17 aa, Entamoeba dispar
NDGREEDELEDQEYEKE

SEQ ID NO: 2445627 - protein, 5 aa, Entamoeba dispar
NDGRI

SEQ ID NO: 2445628 - protein, 4 aa, Entamoeba dispar
NDGT

SEQ ID NO: 2445629 - protein, 6 aa, Entamoeba dispar
NDGTDF

SEQ ID NO: 2445630 - protein, 5 aa, Entamoeba dispar
NDGTI

SEQ ID NO: 2445631 - protein, 9 aa, Entamoeba dispar
NDGTTTEGP

SEQ ID NO: 2445632 - protein, 21 aa, Entamoeba dispar
NDGTTTEGPWGCNSKRQFDEV

SEQ ID NO: 2445633 - protein, 8 aa, Entamoeba dispar
NDGTYKKD

SEQ ID NO: 2445634 - protein, 8 aa, Entamoeba dispar
NDGVKGRI

SEQ ID NO: 2445635 - protein, 4 aa, Entamoeba dispar
NDGY

SEQ ID NO: 2445636 - protein, 26 aa, Entamoeba dispar
NDGYNPNVTDQHEVEKDEEAKTTMKN

SEQ ID NO: 2445637 - protein, 8 aa, Entamoeba dispar
NDHDREIT

SEQ ID NO: 2445638 - protein, 6 aa, Entamoeba dispar
NDHEEK

SEQ ID NO: 2445639 - protein, 6 aa, Entamoeba dispar
NDHESD

SEQ ID NO: 2445640 - protein, 6 aa, Entamoeba dispar
NDHPRI

SEQ ID NO: 2445641 - protein, 9 aa, Entamoeba dispar
NDIDAQNDL

SEQ ID NO: 2445642 - protein, 8 aa, Entamoeba dispar
NDIDDEPD

SEQ ID NO: 2445643 - protein, 4 aa, Entamoeba dispar
NDIE

SEQ ID NO: 2445644 - protein, 6 aa, Entamoeba dispar
NDIEDY

SEQ ID NO: 2445645 - protein, 26 aa, Entamoeba dispar
NDIEKERNKTKENKEERTNKQIDTKE

SEQ ID NO: 2445646 - protein, 9 aa, Entamoeba dispar
NDIEKKKND

SEQ ID NO: 2445647 - protein, 6 aa, Entamoeba dispar
NDIEPN

SEQ ID NO: 2445648 - protein, 7 aa, Entamoeba dispar
NDIGPAR

SEQ ID NO: 2445649 - protein, 4 aa, Entamoeba dispar
NDIH

SEQ ID NO: 2445650 - protein, 18 aa, Entamoeba dispar
NDIITNEDEQLLESKSKE

SEQ ID NO: 2445651 - protein, 5 aa, Entamoeba dispar
NDILE

SEQ ID NO: 2445652 - protein, 7 aa, Entamoeba dispar
NDINDFE

SEQ ID NO: 2445653 - protein, 9 aa, Entamoeba dispar
NDINENENI

SEQ ID NO: 2445654 - protein, 7 aa, Entamoeba dispar
NDINESL

SEQ ID NO: 2445655 - protein, 20 aa, Entamoeba dispar
NDINKDDINDINKEKEEEEI

SEQ ID NO: 2445656 - protein, 20 aa, Entamoeba dispar
NDIPSSLNDIPSSLNNQPSS

SEQ ID NO: 2445657 - protein, 5 aa, Entamoeba dispar
NDIPV

SEQ ID NO: 2445658 - protein, 8 aa, Entamoeba dispar
NDIQTRQY

SEQ ID NO: 2445659 - protein, 40 aa, Entamoeba dispar
NDIQTSSSSNKNEENYTDNEFNEEEKSESQKDIEVYEISD

SEQ ID NO: 2445660 - protein, 4 aa, Entamoeba dispar
NDIS

SEQ ID NO: 2445661 - protein, 9 aa, Entamoeba dispar
NDISRTIQQ

SEQ ID NO: 2445662 - protein, 6 aa, Entamoeba dispar
NDITGE

SEQ ID NO: 2445663 - protein, 8 aa, Entamoeba dispar
NDITRKKS

SEQ ID NO: 2445664 - protein, 4 aa, Entamoeba dispar
NDKA

SEQ ID NO: 2445665 - protein, 13 aa, Entamoeba dispar
NDKANSPTGYEEY

SEQ ID NO: 2445666 - protein, 4 aa, Entamoeba dispar
NDKE

SEQ ID NO: 2445667 - protein, 18 aa, Entamoeba dispar
NDKELRTSHDLNGFEVLD

SEQ ID NO: 2445668 - protein, 8 aa, Entamoeba dispar
NDKEWSKS

SEQ ID NO: 2445669 - protein, 12 aa, Entamoeba dispar
NDKGKRTTIKGS

SEQ ID NO: 2445670 - protein, 9 aa, Entamoeba dispar
NDKITNSSN

SEQ ID NO: 2445671 - protein, 17 aa, Entamoeba dispar
  misc_feature (16)..(17): Xaa can be any naturally occurring amino acid
NDKKECYLPRNNTVLXX

SEQ ID NO: 2445672 - protein, 5 aa, Entamoeba dispar
NDKKF

SEQ ID NO: 2445673 - protein, 7 aa, Entamoeba dispar
NDKKIER

SEQ ID NO: 2445674 - protein, 8 aa, Entamoeba dispar
NDKKIKEV

SEQ ID NO: 2445675 - protein, 4 aa, Entamoeba dispar
NDKL

SEQ ID NO: 2445676 - protein, 17 aa, Entamoeba dispar
NDKLEDKIDLNDDKKVS

SEQ ID NO: 2445677 - protein, 10 aa, Entamoeba dispar
NDKLTNSNDS

SEQ ID NO: 2445678 - protein, 4 aa, Entamoeba dispar
NDKN

SEQ ID NO: 2445679 - protein, 10 aa, Entamoeba dispar
NDKNESGSTA

SEQ ID NO: 2445680 - protein, 7 aa, Entamoeba dispar
NDKNESN

SEQ ID NO: 2445681 - protein, 6 aa, Entamoeba dispar
NDKNFN

SEQ ID NO: 2445682 - protein, 9 aa, Entamoeba dispar
NDKNGTFEE

SEQ ID NO: 2445683 - protein, 5 aa, Entamoeba dispar
NDKNI

SEQ ID NO: 2445684 - protein, 9 aa, Entamoeba dispar
NDKNSSIDL

SEQ ID NO: 2445685 - protein, 11 aa, Entamoeba dispar
NDKQGESSSSL

SEQ ID NO: 2445686 - protein, 6 aa, Entamoeba dispar
NDKQIN

SEQ ID NO: 2445687 - protein, 13 aa, Entamoeba dispar
NDKQQTKIPTPIT

SEQ ID NO: 2445688 - protein, 8 aa, Entamoeba dispar
NDKQRDAT

SEQ ID NO: 2445689 - protein, 9 aa, Entamoeba dispar
NDKQRDATL

SEQ ID NO: 2445690 - protein, 11 aa, Entamoeba dispar
NDKRLKLKGGN

SEQ ID NO: 2445691 - protein, 7 aa, Entamoeba dispar
NDKRNEK

SEQ ID NO: 2445692 - protein, 9 aa, Entamoeba dispar
NDKRNETLK

SEQ ID NO: 2445693 - protein, 4 aa, Entamoeba dispar
NDKS

SEQ ID NO: 2445694 - protein, 6 aa, Entamoeba dispar
NDKSEI

SEQ ID NO: 2445695 - protein, 6 aa, Entamoeba dispar
NDKSSN

SEQ ID NO: 2445696 - protein, 5 aa, Entamoeba dispar
NDKSY

SEQ ID NO: 2445697 - protein, 10 aa, Entamoeba dispar
NDKYDQKQIN

SEQ ID NO: 2445698 - protein, 51 aa, Entamoeba dispar
NDLAKKRNAEENNNEEQNMSYSTEGSNESSEEREKSKGIDKDVILEPDDFI

SEQ ID NO: 2445699 - protein, 17 aa, Entamoeba dispar
NDLEDDRQVTKEEGINY

SEQ ID NO: 2445700 - protein, 22 aa, Entamoeba dispar
NDLEDDRQVTKEEGINYADSTN

SEQ ID NO: 2445701 - protein, 11 aa, Entamoeba dispar
NDLEKQTNEIK

SEQ ID NO: 2445702 - protein, 5 aa, Entamoeba dispar
NDLEQ

SEQ ID NO: 2445703 - protein, 4 aa, Entamoeba dispar
NDLF

SEQ ID NO: 2445704 - protein, 5 aa, Entamoeba dispar
NDLGY

SEQ ID NO: 2445705 - protein, 21 aa, Entamoeba dispar
NDLHGKEKDIEKTIKKQKNEI

SEQ ID NO: 2445706 - protein, 22 aa, Entamoeba dispar
NDLHGKEKDIEKTIKKQKNEIF

SEQ ID NO: 2445707 - protein, 11 aa, Entamoeba dispar
NDLKVENKELN

SEQ ID NO: 2445708 - protein, 4 aa, Entamoeba dispar
NDLN

SEQ ID NO: 2445709 - protein, 12 aa, Entamoeba dispar
NDLNDTDENNLN

SEQ ID NO: 2445710 - protein, 10 aa, Entamoeba dispar
NDLNEPNFNG

SEQ ID NO: 2445711 - protein, 8 aa, Entamoeba dispar
NDLNHPNE

SEQ ID NO: 2445712 - protein, 18 aa, Entamoeba dispar
NDLNNELRTAVEKSGRHL

SEQ ID NO: 2445713 - protein, 8 aa, Entamoeba dispar
NDLNNESL

SEQ ID NO: 2445714 - protein, 22 aa, Entamoeba dispar
NDLNNTESFKTKTKDEQDKEIR

SEQ ID NO: 2445715 - protein, 7 aa, Entamoeba dispar
NDLPDVE

SEQ ID NO: 2445716 - protein, 7 aa, Entamoeba dispar
NDLPSSP

SEQ ID NO: 2445717 - protein, 4 aa, Entamoeba dispar
NDLS

SEQ ID NO: 2445718 - protein, 19 aa, Entamoeba dispar
NDLTQGTFSYSREDSENKF

SEQ ID NO: 2445719 - protein, 7 aa, Entamoeba dispar
NDLTQSS

SEQ ID NO: 2445720 - protein, 4 aa, Entamoeba dispar
NDLY

SEQ ID NO: 2445721 - protein, 5 aa, Entamoeba dispar
NDMIT

SEQ ID NO: 2445722 - protein, 6 aa, Entamoeba dispar
NDMKDL

SEQ ID NO: 2445723 - protein, 6 aa, Entamoeba dispar
NDMQRT

SEQ ID NO: 2445724 - protein, 4 aa, Entamoeba dispar
NDNC

SEQ ID NO: 2445725 - protein, 5 aa, Entamoeba dispar
NDNDH

SEQ ID NO: 2445726 - protein, 8 aa, Entamoeba dispar
NDNDKRAV

SEQ ID NO: 2445727 - protein, 8 aa, Entamoeba dispar
NDNDSVVE

SEQ ID NO: 2445728 - protein, 4 aa, Entamoeba dispar
NDNE

SEQ ID NO: 2445729 - protein, 10 aa, Entamoeba dispar
NDNEDDKYQM

SEQ ID NO: 2445730 - protein, 9 aa, Entamoeba dispar
NDNEETKRN

SEQ ID NO: 2445731 - protein, 6 aa, Entamoeba dispar
NDNEFA

SEQ ID NO: 2445732 - protein, 9 aa, Entamoeba dispar
NDNEINEEY

SEQ ID NO: 2445733 - protein, 5 aa, Entamoeba dispar
NDNEL

SEQ ID NO: 2445734 - protein, 21 aa, Entamoeba dispar
NDNELDGSQELRINEDRSIQS

SEQ ID NO: 2445735 - protein, 9 aa, Entamoeba dispar
NDNERDEAA

SEQ ID NO: 2445736 - protein, 4 aa, Entamoeba dispar
NDNF

SEQ ID NO: 2445737 - protein, 4 aa, Entamoeba dispar
NDNG

SEQ ID NO: 2445738 - protein, 7 aa, Entamoeba dispar
NDNGEML

SEQ ID NO: 2445739 - protein, 7 aa, Entamoeba dispar
NDNGIDV

SEQ ID NO: 2445740 - protein, 9 aa, Entamoeba dispar
NDNGSKTIK

SEQ ID NO: 2445741 - protein, 6 aa, Entamoeba dispar
NDNGVF

SEQ ID NO: 2445742 - protein, 5 aa, Entamoeba dispar
NDNHP

SEQ ID NO: 2445743 - protein, 8 aa, Entamoeba dispar
NDNIQNKI

SEQ ID NO: 2445744 - protein, 5 aa, Entamoeba dispar
NDNKE

SEQ ID NO: 2445745 - protein, 8 aa, Entamoeba dispar
NDNKEKVQ

SEQ ID NO: 2445746 - protein, 5 aa, Entamoeba dispar
NDNKK

SEQ ID NO: 2445747 - protein, 7 aa, Entamoeba dispar
NDNKLNQ

SEQ ID NO: 2445748 - protein, 54 aa, Entamoeba dispar
NDNKQDHEQTLNELDKTDKIDNNELNEENTSIKNEKKEEVTSQLTNKKSDVIEI

SEQ ID NO: 2445749 - protein, 12 aa, Entamoeba dispar
NDNKTKDLEEVK

SEQ ID NO: 2445750 - protein, 15 aa, Entamoeba dispar
NDNLENKKMRKDDDN

SEQ ID NO: 2445751 - protein, 7 aa, Entamoeba dispar
NDNLNNN

SEQ ID NO: 2445752 - protein, 7 aa, Entamoeba dispar
NDNLSNN

SEQ ID NO: 2445753 - protein, 4 aa, Entamoeba dispar
NDNN

SEQ ID NO: 2445754 - protein, 8 aa, Entamoeba dispar
NDNNDELK

SEQ ID NO: 2445755 - protein, 6 aa, Entamoeba dispar
NDNNIK

SEQ ID NO: 2445756 - protein, 8 aa, Entamoeba dispar
NDNNINST

SEQ ID NO: 2445757 - protein, 10 aa, Entamoeba dispar
NDNRDFEDAQ

SEQ ID NO: 2445758 - protein, 13 aa, Entamoeba dispar
NDNRSHFAEDEPA

SEQ ID NO: 2445759 - protein, 29 aa, Entamoeba dispar
NDNSNKEVKKTDDVLPSTNTNQPKQPQNT

SEQ ID NO: 2445760 - protein, 9 aa, Entamoeba dispar
NDNSNPLSI

SEQ ID NO: 2445761 - protein, 13 aa, Entamoeba dispar
NDNTKKEKNRTLT

SEQ ID NO: 2445762 - protein, 6 aa, Entamoeba dispar
NDNTKQ

SEQ ID NO: 2445763 - protein, 21 aa, Entamoeba dispar
NDNTLSQSPRLTEISNEEYKE

SEQ ID NO: 2445764 - protein, 29 aa, Entamoeba dispar
NDNVGPIKPVQQQQNQSTLNIQNEQPKKK

SEQ ID NO: 2445765 - protein, 16 aa, Entamoeba dispar
NDNYNEQKDINKLNKE

SEQ ID NO: 2445766 - protein, 8 aa, Entamoeba dispar
NDPDADRL

SEQ ID NO: 2445767 - protein, 5 aa, Entamoeba dispar
NDPDI

SEQ ID NO: 2445768 - protein, 5 aa, Entamoeba dispar
NDPEK

SEQ ID NO: 2445769 - protein, 5 aa, Entamoeba dispar
NDPEW

SEQ ID NO: 2445770 - protein, 4 aa, Entamoeba dispar
NDPF

SEQ ID NO: 2445771 - protein, 7 aa, Entamoeba dispar
NDPIPKK

SEQ ID NO: 2445772 - protein, 15 aa, Entamoeba dispar
NDPIYDEKGNASFEE

SEQ ID NO: 2445773 - protein, 6 aa, Entamoeba dispar
NDPKEL

SEQ ID NO: 2445774 - protein, 6 aa, Entamoeba dispar
NDPKKC

SEQ ID NO: 2445775 - protein, 10 aa, Entamoeba dispar
NDPKTCNKRG

SEQ ID NO: 2445776 - protein, 6 aa, Entamoeba dispar
NDPLTS

SEQ ID NO: 2445777 - protein, 16 aa, Entamoeba dispar
NDPNNKGNTDKLNELN

SEQ ID NO: 2445778 - protein, 14 aa, Entamoeba dispar
NDPNNSGAQFGEED

SEQ ID NO: 2445779 - protein, 10 aa, Entamoeba dispar
NDPNSQEQYE

SEQ ID NO: 2445780 - protein, 6 aa, Entamoeba dispar
NDPNTI

SEQ ID NO: 2445781 - protein, 14 aa, Entamoeba dispar
NDPRSISSLTGLKK

SEQ ID NO: 2445782 - protein, 9 aa, Entamoeba dispar
NDPSSDKTH

SEQ ID NO: 2445783 - protein, 9 aa, Entamoeba dispar
NDPTEIGSD

SEQ ID NO: 2445784 - protein, 5 aa, Entamoeba dispar
NDPTG

SEQ ID NO: 2445785 - protein, 6 aa, Entamoeba dispar
NDPTIN

SEQ ID NO: 2445786 - protein, 13 aa, Entamoeba dispar
NDQANKDAFTEDG

SEQ ID NO: 2445787 - protein, 6 aa, Entamoeba dispar
NDQARK

SEQ ID NO: 2445788 - protein, 16 aa, Entamoeba dispar
NDQCNNKYCKSSSSFV

SEQ ID NO: 2445789 - protein, 15 aa, Entamoeba dispar
NDQDDEESDETKSKT

SEQ ID NO: 2445790 - protein, 6 aa, Entamoeba dispar
NDQEFN

SEQ ID NO: 2445791 - protein, 7 aa, Entamoeba dispar
NDQEIGN

SEQ ID NO: 2445792 - protein, 6 aa, Entamoeba dispar
NDQELN

SEQ ID NO: 2445793 - protein, 4 aa, Entamoeba dispar
NDQH

SEQ ID NO: 2445794 - protein, 9 aa, Entamoeba dispar
NDQIERDND

SEQ ID NO: 2445795 - protein, 6 aa, Entamoeba dispar
NDQKTM

SEQ ID NO: 2445796 - protein, 17 aa, Entamoeba dispar
NDQKYSEDNLNKLKIKS

SEQ ID NO: 2445797 - protein, 4 aa, Entamoeba dispar
NDQN

SEQ ID NO: 2445798 - protein, 14 aa, Entamoeba dispar
NDQNITTDEAREDL

SEQ ID NO: 2445799 - protein, 7 aa, Entamoeba dispar
NDQNPLG

SEQ ID NO: 2445800 - protein, 16 aa, Entamoeba dispar
NDQPRPSSVSNNTNSV

SEQ ID NO: 2445801 - protein, 12 aa, Entamoeba dispar
NDQQLDKKRHIG

SEQ ID NO: 2445802 - protein, 7 aa, Entamoeba dispar
NDQRRYD

SEQ ID NO: 2445803 - protein, 9 aa, Entamoeba dispar
NDQSKETQA

SEQ ID NO: 2445804 - protein, 8 aa, Entamoeba dispar
NDQTTQQS

SEQ ID NO: 2445805 - protein, 4 aa, Entamoeba dispar
NDQV

SEQ ID NO: 2445806 - protein, 6 aa, Entamoeba dispar
NDRADQ

SEQ ID NO: 2445807 - protein, 4 aa, Entamoeba dispar
NDRE

SEQ ID NO: 2445808 - protein, 12 aa, Entamoeba dispar
NDRENQSASTSN

SEQ ID NO: 2445809 - protein, 7 aa, Entamoeba dispar
NDRIRTY

SEQ ID NO: 2445810 - protein, 4 aa, Entamoeba dispar
NDRK

SEQ ID NO: 2445811 - protein, 8 aa, Entamoeba dispar
NDRKYTSE

SEQ ID NO: 2445812 - protein, 7 aa, Entamoeba dispar
NDRNSKF

SEQ ID NO: 2445813 - protein, 6 aa, Entamoeba dispar
NDRPSL

SEQ ID NO: 2445814 - protein, 7 aa, Entamoeba dispar
NDRQRDA

SEQ ID NO: 2445815 - protein, 7 aa, Entamoeba dispar
NDRQREA

SEQ ID NO: 2445816 - protein, 66 aa, Entamoeba dispar
NDRRCSKKRITDIQKSVEKDYNKQEKKEEKLSQKRNQQQKKEKNYFDKKERRRKKMNRQEKQEEAY

SEQ ID NO: 2445817 - protein, 4 aa, Entamoeba dispar
NDRS

SEQ ID NO: 2445818 - protein, 8 aa, Entamoeba dispar
NDRSIKNI

SEQ ID NO: 2445819 - protein, 17 aa, Entamoeba dispar
NDRTDSKYEIPKERGDQ

SEQ ID NO: 2445820 - protein, 8 aa, Entamoeba dispar
NDSCSSLK

SEQ ID NO: 2445821 - protein, 19 aa, Entamoeba dispar
NDSDDEEQNSRDEDKQQPF

SEQ ID NO: 2445822 - protein, 10 aa, Entamoeba dispar
NDSDEETIGR

SEQ ID NO: 2445823 - protein, 8 aa, Entamoeba dispar
NDSDESQS

SEQ ID NO: 2445824 - protein, 9 aa, Entamoeba dispar
NDSDNEKIK

SEQ ID NO: 2445825 - protein, 8 aa, Entamoeba dispar
NDSDTTMT

SEQ ID NO: 2445826 - protein, 7 aa, Entamoeba dispar
NDSDYKR

SEQ ID NO: 2445827 - protein, 8 aa, Entamoeba dispar
NDSFPTPT

SEQ ID NO: 2445828 - protein, 4 aa, Entamoeba dispar
NDSH

SEQ ID NO: 2445829 - protein, 13 aa, Entamoeba dispar
NDSIKQLNKFFKI

SEQ ID NO: 2445830 - protein, 4 aa, Entamoeba dispar
NDSK

SEQ ID NO: 2445831 - protein, 10 aa, Entamoeba dispar
NDSKKKQKQM

SEQ ID NO: 2445832 - protein, 10 aa, Entamoeba dispar
NDSKKPQPTI

SEQ ID NO: 2445833 - protein, 8 aa, Entamoeba dispar
NDSKSIED

SEQ ID NO: 2445834 - protein, 4 aa, Entamoeba dispar
NDSL

SEQ ID NO: 2445835 - protein, 22 aa, Entamoeba dispar
NDSLTPQKKKRIKKNTSFKSGD

SEQ ID NO: 2445836 - protein, 4 aa, Entamoeba dispar
NDSN

SEQ ID NO: 2445837 - protein, 8 aa, Entamoeba dispar
NDSNKQQY

SEQ ID NO: 2445838 - protein, 11 aa, Entamoeba dispar
NDSNKSLDQIN

SEQ ID NO: 2445839 - protein, 9 aa, Entamoeba dispar
NDSNKTVKE

SEQ ID NO: 2445840 - protein, 21 aa, Entamoeba dispar
NDSPNPETKTTTGSYGEGDRS

SEQ ID NO: 2445841 - protein, 5 aa, Entamoeba dispar
NDSQI

SEQ ID NO: 2445842 - protein, 7 aa, Entamoeba dispar
NDSQNKF

SEQ ID NO: 2445843 - protein, 15 aa, Entamoeba dispar
NDSQRESTKNAGKIA

SEQ ID NO: 2445844 - protein, 7 aa, Entamoeba dispar
NDSRFEN

SEQ ID NO: 2445845 - protein, 27 aa, Entamoeba dispar
NDSSAETLTQPTPEKITNKQHESTIER

SEQ ID NO: 2445846 - protein, 12 aa, Entamoeba dispar
NDSSDETNQWSP

SEQ ID NO: 2445847 - protein, 6 aa, Entamoeba dispar
NDSSDY

SEQ ID NO: 2445848 - protein, 9 aa, Entamoeba dispar
NDSSFSQEQ

SEQ ID NO: 2445849 - protein, 8 aa, Entamoeba dispar
NDSSKIQK

SEQ ID NO: 2445850 - protein, 7 aa, Entamoeba dispar
NDSSNSL

SEQ ID NO: 2445851 - protein, 23 aa, Entamoeba dispar
NDSSPLSHDDKTPNSSFDTPRNE

SEQ ID NO: 2445852 - protein, 17 aa, Entamoeba dispar
NDSSTSKIEGTKENIVS

SEQ ID NO: 2445853 - protein, 6 aa, Entamoeba dispar
NDSTEI

SEQ ID NO: 2445854 - protein, 13 aa, Entamoeba dispar
NDSTETEDNPPNL

SEQ ID NO: 2445855 - protein, 6 aa, Entamoeba dispar
NDSTGI

SEQ ID NO: 2445856 - protein, 30 aa, Entamoeba dispar
NDSTNLPKELDRARDEAKSNKSKANDEWKK

SEQ ID NO: 2445857 - protein, 9 aa, Entamoeba dispar
NDSVGQGSS

SEQ ID NO: 2445858 - protein, 6 aa, Entamoeba dispar
NDSVND

SEQ ID NO: 2445859 - protein, 6 aa, Entamoeba dispar
NDSVNE

SEQ ID NO: 2445860 - protein, 6 aa, Entamoeba dispar
NDSVTD

SEQ ID NO: 2445861 - protein, 9 aa, Entamoeba dispar
NDSVTKSKF

SEQ ID NO: 2445862 - protein, 10 aa, Entamoeba dispar
NDSYGGLSGR

SEQ ID NO: 2445863 - protein, 6 aa, Entamoeba dispar
NDSYNQ

SEQ ID NO: 2445864 - protein, 4 aa, Entamoeba dispar
NDTA

SEQ ID NO: 2445865 - protein, 8 aa, Entamoeba dispar
NDTAGQER

SEQ ID NO: 2445866 - protein, 4 aa, Entamoeba dispar
NDTD

SEQ ID NO: 2445867 - protein, 20 aa, Entamoeba dispar
NDTDKKIIEEKKPKPPLPIP

SEQ ID NO: 2445868 - protein, 5 aa, Entamoeba dispar
NDTDN

SEQ ID NO: 2445869 - protein, 5 aa, Entamoeba dispar
NDTDS

SEQ ID NO: 2445870 - protein, 4 aa, Entamoeba dispar
NDTE

SEQ ID NO: 2445871 - protein, 7 aa, Entamoeba dispar
NDTEDIQ

SEQ ID NO: 2445872 - protein, 5 aa, Entamoeba dispar
NDTEP

SEQ ID NO: 2445873 - protein, 7 aa, Entamoeba dispar
NDTFDSN

SEQ ID NO: 2445874 - protein, 18 aa, Entamoeba dispar
NDTFSVGSSEMCGNRDQM

SEQ ID NO: 2445875 - protein, 8 aa, Entamoeba dispar
NDTGFQSV

SEQ ID NO: 2445876 - protein, 18 aa, Entamoeba dispar
NDTGSQCENSEDVEVISS

SEQ ID NO: 2445877 - protein, 4 aa, Entamoeba dispar
NDTI

SEQ ID NO: 2445878 - protein, 18 aa, Entamoeba dispar
NDTISSKESQHKEEQNNS

SEQ ID NO: 2445879 - protein, 5 aa, Entamoeba dispar
NDTIT

SEQ ID NO: 2445880 - protein, 9 aa, Entamoeba dispar
NDTKEPFKY

SEQ ID NO: 2445881 - protein, 10 aa, Entamoeba dispar
NDTKVTTNEM

SEQ ID NO: 2445882 - protein, 8 aa, Entamoeba dispar
NDTLKGNS

SEQ ID NO: 2445883 - protein, 7 aa, Entamoeba dispar
NDTLTPI

SEQ ID NO: 2445884 - protein, 16 aa, Entamoeba dispar
NDTNSGLFSKSSSSCF

SEQ ID NO: 2445885 - protein, 8 aa, Entamoeba dispar
NDTPEDRC

SEQ ID NO: 2445886 - protein, 17 aa, Entamoeba dispar
NDTPSTNQQNTQQDELD

SEQ ID NO: 2445887 - protein, 5 aa, Entamoeba dispar
NDTQR

SEQ ID NO: 2445888 - protein, 7 aa, Entamoeba dispar
NDTSAGH

SEQ ID NO: 2445889 - protein, 8 aa, Entamoeba dispar
NDTSLQGL

SEQ ID NO: 2445890 - protein, 7 aa, Entamoeba dispar
NDTSPIR

SEQ ID NO: 2445891 - protein, 10 aa, Entamoeba dispar
NDTSQTSETW

SEQ ID NO: 2445892 - protein, 9 aa, Entamoeba dispar
NDTSRTDLE

SEQ ID NO: 2445893 - protein, 7 aa, Entamoeba dispar
NDTTEDD

SEQ ID NO: 2445894 - protein, 9 aa, Entamoeba dispar
NDTTENETI

SEQ ID NO: 2445895 - protein, 7 aa, Entamoeba dispar
NDVDPKR

SEQ ID NO: 2445896 - protein, 6 aa, Entamoeba dispar
NDVDTA

SEQ ID NO: 2445897 - protein, 11 aa, Entamoeba dispar
NDVETTTNGRL

SEQ ID NO: 2445898 - protein, 8 aa, Entamoeba dispar
NDVKGKEV

SEQ ID NO: 2445899 - protein, 4 aa, Entamoeba dispar
NDVP

SEQ ID NO: 2445900 - protein, 8 aa, Entamoeba dispar
NDVPDAKT

SEQ ID NO: 2445901 - protein, 7 aa, Entamoeba dispar
NDVPSSF

SEQ ID NO: 2445902 - protein, 6 aa, Entamoeba dispar
NDVQRK

SEQ ID NO: 2445903 - protein, 4 aa, Entamoeba dispar
NDVR

SEQ ID NO: 2445904 - protein, 6 aa, Entamoeba dispar
NDVRES

SEQ ID NO: 2445905 - protein, 5 aa, Entamoeba dispar
NDVSS

SEQ ID NO: 2445906 - protein, 8 aa, Entamoeba dispar
NDVSTNSL

SEQ ID NO: 2445907 - protein, 4 aa, Entamoeba dispar
NDVT

SEQ ID NO: 2445908 - protein, 12 aa, Entamoeba dispar
NDWNEASKTPYF

SEQ ID NO: 2445909 - protein, 4 aa, Entamoeba dispar
NDWP

SEQ ID NO: 2445910 - protein, 26 aa, Entamoeba dispar
NDYDDEYDIDPTIKREEFEKECENRG

SEQ ID NO: 2445911 - protein, 14 aa, Entamoeba dispar
NDYDDEYDIYPIIK

SEQ ID NO: 2445912 - protein, 11 aa, Entamoeba dispar
NDYDPKEIGES

SEQ ID NO: 2445913 - protein, 4 aa, Entamoeba dispar
NDYE

SEQ ID NO: 2445914 - protein, 35 aa, Entamoeba dispar
NDYREEDDDDDIGEEEIDKEIKERLSNIKGENQIK

SEQ ID NO: 2445915 - protein, 8 aa, Entamoeba dispar
NDYSAEGY

SEQ ID NO: 2445916 - protein, 8 aa, Entamoeba dispar
NDYSSLTT

SEQ ID NO: 2445917 - protein, 6 aa, Entamoeba dispar
NEACEE

SEQ ID NO: 2445918 - protein, 5 aa, Entamoeba dispar
NEADL

SEQ ID NO: 2445919 - protein, 6 aa, Entamoeba dispar
NEAEIQ

SEQ ID NO: 2445920 - protein, 12 aa, Entamoeba dispar
NEAEKEKLDSTI

SEQ ID NO: 2445921 - protein, 21 aa, Entamoeba dispar
NEAEKTITSITDSRKTKYRKR

SEQ ID NO: 2445922 - protein, 10 aa, Entamoeba dispar
NEAEKTVQKG

SEQ ID NO: 2445923 - protein, 12 aa, Entamoeba dispar
NEAFKQKSKDNI

SEQ ID NO: 2445924 - protein, 9 aa, Entamoeba dispar
NEAGRSYRT

SEQ ID NO: 2445925 - protein, 5 aa, Entamoeba dispar
NEAHS

SEQ ID NO: 2445926 - protein, 7 aa, Entamoeba dispar
NEAKATL

SEQ ID NO: 2445927 - protein, 33 aa, Entamoeba dispar
NEAKKEFEKANEEQKNKDNKEENNTSKRFKENI

SEQ ID NO: 2445928 - protein, 7 aa, Entamoeba dispar
NEAKKVS

SEQ ID NO: 2445929 - protein, 12 aa, Entamoeba dispar
NEAKPKNPTISQ

SEQ ID NO: 2445930 - protein, 7 aa, Entamoeba dispar
NEAKSKA

SEQ ID NO: 2445931 - protein, 5 aa, Entamoeba dispar
NEANK

SEQ ID NO: 2445932 - protein, 10 aa, Entamoeba dispar
NEAPKERVRR

SEQ ID NO: 2445933 - protein, 11 aa, Entamoeba dispar
NEAPKERVRRD

SEQ ID NO: 2445934 - protein, 7 aa, Entamoeba dispar
NEAPRPV

SEQ ID NO: 2445935 - protein, 10 aa, Entamoeba dispar
NEAQEKEKEL

SEQ ID NO: 2445936 - protein, 6 aa, Entamoeba dispar
NEAQNK

SEQ ID NO: 2445937 - protein, 5 aa, Entamoeba dispar
NEASF

SEQ ID NO: 2445938 - protein, 9 aa, Entamoeba dispar
NEASHEVSD

SEQ ID NO: 2445939 - protein, 20 aa, Entamoeba dispar
NEATQLNETRKEQVLQSANS

SEQ ID NO: 2445940 - protein, 6 aa, Entamoeba dispar
NEATSV

SEQ ID NO: 2445941 - protein, 10 aa, Entamoeba dispar
NEAYGESQEL

SEQ ID NO: 2445942 - protein, 5 aa, Entamoeba dispar
NECSS

SEQ ID NO: 2445943 - protein, 29 aa, Entamoeba dispar
NECTSKPVPVSDAQQSINSSEKDTQINQL

SEQ ID NO: 2445944 - protein, 9 aa, Entamoeba dispar
NECTTTEDA

SEQ ID NO: 2445945 - protein, 11 aa, Entamoeba dispar
NEDAKMEKIAK

SEQ ID NO: 2445946 - protein, 6 aa, Entamoeba dispar
NEDAQE

SEQ ID NO: 2445947 - protein, 17 aa, Entamoeba dispar
NEDCINQKEENEKSNNL

SEQ ID NO: 2445948 - protein, 4 aa, Entamoeba dispar
NEDD

SEQ ID NO: 2445949 - protein, 6 aa, Entamoeba dispar
NEDDAR

SEQ ID NO: 2445950 - protein, 9 aa, Entamoeba dispar
NEDDELKYG

SEQ ID NO: 2445951 - protein, 11 aa, Entamoeba dispar
NEDDKKLKQKH

SEQ ID NO: 2445952 - protein, 5 aa, Entamoeba dispar
NEDDL

SEQ ID NO: 2445953 - protein, 17 aa, Entamoeba dispar
NEDDNEYCSRCSNPGIF

SEQ ID NO: 2445954 - protein, 8 aa, Entamoeba dispar
NEDDTLSD

SEQ ID NO: 2445955 - protein, 10 aa, Entamoeba dispar
NEDDTSLSNW

SEQ ID NO: 2445956 - protein, 9 aa, Entamoeba dispar
NEDEEVKKK

SEQ ID NO: 2445957 - protein, 8 aa, Entamoeba dispar
NEDEIKEW

SEQ ID NO: 2445958 - protein, 8 aa, Entamoeba dispar
NEDEQSIN

SEQ ID NO: 2445959 - protein, 5 aa, Entamoeba dispar
NEDFF

SEQ ID NO: 2445960 - protein, 5 aa, Entamoeba dispar
NEDGA

SEQ ID NO: 2445961 - protein, 11 aa, Entamoeba dispar
NEDGEKEWNEY

SEQ ID NO: 2445962 - protein, 25 aa, Entamoeba dispar
NEDGESQEITKEKYTQKKYKKSLSS

SEQ ID NO: 2445963 - protein, 7 aa, Entamoeba dispar
NEDGNWY

SEQ ID NO: 2445964 - protein, 8 aa, Entamoeba dispar
NEDGSFEI

SEQ ID NO: 2445965 - protein, 6 aa, Entamoeba dispar
NEDIDY

SEQ ID NO: 2445966 - protein, 6 aa, Entamoeba dispar
NEDIRK

SEQ ID NO: 2445967 - protein, 27 aa, Entamoeba dispar
NEDISKSSLPQLTDPSTQRKTTKAPRL

SEQ ID NO: 2445968 - protein, 7 aa, Entamoeba dispar
NEDITPK

SEQ ID NO: 2445969 - protein, 10 aa, Entamoeba dispar
NEDKIGVENE

SEQ ID NO: 2445970 - protein, 15 aa, Entamoeba dispar
NEDKRPFKKPVSNPC

SEQ ID NO: 2445971 - protein, 7 aa, Entamoeba dispar
NEDLEAT

SEQ ID NO: 2445972 - protein, 7 aa, Entamoeba dispar
NEDNDEE

SEQ ID NO: 2445973 - protein, 24 aa, Entamoeba dispar
NEDNETTNLKNNFNSESKASTKLR

SEQ ID NO: 2445974 - protein, 6 aa, Entamoeba dispar
NEDNEY

SEQ ID NO: 2445975 - protein, 9 aa, Entamoeba dispar
NEDNRWDDE

SEQ ID NO: 2445976 - protein, 5 aa, Entamoeba dispar
NEDPA

SEQ ID NO: 2445977 - protein, 8 aa, Entamoeba dispar
NEDPEGDP

SEQ ID NO: 2445978 - protein, 9 aa, Entamoeba dispar
NEDPESKKK

SEQ ID NO: 2445979 - protein, 4 aa, Entamoeba dispar
NEDQ

SEQ ID NO: 2445980 - protein, 10 aa, Entamoeba dispar
NEDQAQTAIT

SEQ ID NO: 2445981 - protein, 19 aa, Entamoeba dispar
NEDQNSQLPPATTQNDISQ

SEQ ID NO: 2445982 - protein, 11 aa, Entamoeba dispar
NEDRMKAEEEV

SEQ ID NO: 2445983 - protein, 7 aa, Entamoeba dispar
NEDRSMI

SEQ ID NO: 2445984 - protein, 14 aa, Entamoeba dispar
NEDSESSSDDSYES

SEQ ID NO: 2445985 - protein, 5 aa, Entamoeba dispar
NEDSL

SEQ ID NO: 2445986 - protein, 8 aa, Entamoeba dispar
NEDTEESV

SEQ ID NO: 2445987 - protein, 5 aa, Entamoeba dispar
NEDTI

SEQ ID NO: 2445988 - protein, 7 aa, Entamoeba dispar
NEDTKYR

SEQ ID NO: 2445989 - protein, 4 aa, Entamoeba dispar
NEDV

SEQ ID NO: 2445990 - protein, 6 aa, Entamoeba dispar
NEDWAE

SEQ ID NO: 2445991 - protein, 18 aa, Entamoeba dispar
NEEADEAVKEANPDADGY

SEQ ID NO: 2445992 - protein, 4 aa, Entamoeba dispar
NEEC

SEQ ID NO: 2445993 - protein, 5 aa, Entamoeba dispar
NEECD

SEQ ID NO: 2445994 - protein, 8 aa, Entamoeba dispar
NEECRNAC

SEQ ID NO: 2445995 - protein, 6 aa, Entamoeba dispar
NEEDAF

SEQ ID NO: 2445996 - protein, 6 aa, Entamoeba dispar
NEEDES

SEQ ID NO: 2445997 - protein, 11 aa, Entamoeba dispar
NEEDHQKKNDV

SEQ ID NO: 2445998 - protein, 15 aa, Entamoeba dispar
NEEDIQKEKKIKQLQ

SEQ ID NO: 2445999 - protein, 7 aa, Entamoeba dispar
NEEDKEY

SEQ ID NO: 2446000 - protein, 14 aa, Entamoeba dispar
NEEDLEKNEEIRKG

SEQ ID NO: 2446001 - protein, 8 aa, Entamoeba dispar
NEEDPKQI

SEQ ID NO: 2446002 - protein, 8 aa, Entamoeba dispar
NEEDPSYK

SEQ ID NO: 2446003 - protein, 10 aa, Entamoeba dispar
NEEDTFRPKG

SEQ ID NO: 2446004 - protein, 6 aa, Entamoeba dispar
NEEDTQ

SEQ ID NO: 2446005 - protein, 6 aa, Entamoeba dispar
NEEDVL

SEQ ID NO: 2446006 - protein, 6 aa, Entamoeba dispar
NEEDVN

SEQ ID NO: 2446007 - protein, 4 aa, Entamoeba dispar
NEEE

SEQ ID NO: 2446008 - protein, 5 aa, Entamoeba dispar
NEEEA

SEQ ID NO: 2446009 - protein, 14 aa, Entamoeba dispar
NEEEDDKDEGINKA

SEQ ID NO: 2446010 - protein, 22 aa, Entamoeba dispar
NEEEEPEKLDEEELKRKRKKEI

SEQ ID NO: 2446011 - protein, 30 aa, Entamoeba dispar
NEEEGKKEKIKETEEESSTRSESESESTSE

SEQ ID NO: 2446012 - protein, 7 aa, Entamoeba dispar
NEEEHTC

SEQ ID NO: 2446013 - protein, 15 aa, Entamoeba dispar
NEEEIEQEIKNEEEV

SEQ ID NO: 2446014 - protein, 5 aa, Entamoeba dispar
NEEEK

SEQ ID NO: 2446015 - protein, 7 aa, Entamoeba dispar
NEEEKRE

SEQ ID NO: 2446016 - protein, 10 aa, Entamoeba dispar
NEEEKTRKQF

SEQ ID NO: 2446017 - protein, 5 aa, Entamoeba dispar
NEEEM

SEQ ID NO: 2446018 - protein, 10 aa, Entamoeba dispar
NEEEPITPEQ

SEQ ID NO: 2446019 - protein, 39 aa, Entamoeba dispar
NEEEQNKSEEDVEEEQNEDGMEKEKKVVEQKTPKTRTFE

SEQ ID NO: 2446020 - protein, 6 aa, Entamoeba dispar
NEEESP

SEQ ID NO: 2446021 - protein, 6 aa, Entamoeba dispar
NEEETE

SEQ ID NO: 2446022 - protein, 9 aa, Entamoeba dispar
NEEETSGSI

SEQ ID NO: 2446023 - protein, 12 aa, Entamoeba dispar
NEEEVKERFKQR

SEQ ID NO: 2446024 - protein, 5 aa, Entamoeba dispar
NEEEY

SEQ ID NO: 2446025 - protein, 4 aa, Entamoeba dispar
NEEF

SEQ ID NO: 2446026 - protein, 4 aa, Entamoeba dispar
NEEG

SEQ ID NO: 2446027 - protein, 9 aa, Entamoeba dispar
NEEGDFEMK

SEQ ID NO: 2446028 - protein, 18 aa, Entamoeba dispar
NEEGKISLTGGETRIKKD

SEQ ID NO: 2446029 - protein, 8 aa, Entamoeba dispar
NEEGTRLE

SEQ ID NO: 2446030 - protein, 5 aa, Entamoeba dispar
NEEHP

SEQ ID NO: 2446031 - protein, 6 aa, Entamoeba dispar
NEEIEE

SEQ ID NO: 2446032 - protein, 14 aa, Entamoeba dispar
NEEIEKSYKAMNAR

SEQ ID NO: 2446033 - protein, 14 aa, Entamoeba dispar
NEEIEKSYKTMNAR

SEQ ID NO: 2446034 - protein, 7 aa, Entamoeba dispar
NEEIESY

SEQ ID NO: 2446035 - protein, 7 aa, Entamoeba dispar
NEEIKQE

SEQ ID NO: 2446036 - protein, 5 aa, Entamoeba dispar
NEEIP

SEQ ID NO: 2446037 - protein, 22 aa, Entamoeba dispar
NEEITSKQVETYQTSNKKKDLK

SEQ ID NO: 2446038 - protein, 14 aa, Entamoeba dispar
NEEKAKADKENEKK

SEQ ID NO: 2446039 - protein, 27 aa, Entamoeba dispar
NEEKAKKDFDEYKAKYDGKYKSDVSKV

SEQ ID NO: 2446040 - protein, 8 aa, Entamoeba dispar
NEEKCEEQ

SEQ ID NO: 2446041 - protein, 8 aa, Entamoeba dispar
NEEKDNQL

SEQ ID NO: 2446042 - protein, 5 aa, Entamoeba dispar
NEEKI

SEQ ID NO: 2446043 - protein, 7 aa, Entamoeba dispar
NEEKKEL

SEQ ID NO: 2446044 - protein, 16 aa, Entamoeba dispar
NEEKPEIPMNEEEPKK

SEQ ID NO: 2446045 - protein, 16 aa, Entamoeba dispar
NEEKPEVPMNEEEPKK

SEQ ID NO: 2446046 - protein, 19 aa, Entamoeba dispar
NEEKPIKQDKSEKERMKRE

SEQ ID NO: 2446047 - protein, 13 aa, Entamoeba dispar
NEEKQDKSISSKI

SEQ ID NO: 2446048 - protein, 7 aa, Entamoeba dispar
NEEKRQE

SEQ ID NO: 2446049 - protein, 7 aa, Entamoeba dispar
NEELETC

SEQ ID NO: 2446050 - protein, 17 aa, Entamoeba dispar
NEELQSQIKQNEEEINR

SEQ ID NO: 2446051 - protein, 5 aa, Entamoeba dispar
NEELY

SEQ ID NO: 2446052 - protein, 5 aa, Entamoeba dispar
NEEMK

SEQ ID NO: 2446053 - protein, 22 aa, Entamoeba dispar
NEENAKKAVEEMNGRGVEGGEL

SEQ ID NO: 2446054 - protein, 10 aa, Entamoeba dispar
NEENGEPGLI

SEQ ID NO: 2446055 - protein, 20 aa, Entamoeba dispar
NEENGEPGLINEKNESTSED

SEQ ID NO: 2446056 - protein, 7 aa, Entamoeba dispar
NEENGSV

SEQ ID NO: 2446057 - protein, 10 aa, Entamoeba dispar
NEENIKNPFD

SEQ ID NO: 2446058 - protein, 14 aa, Entamoeba dispar
NEENKGRTEEEEFQ

SEQ ID NO: 2446059 - protein, 7 aa, Entamoeba dispar
NEENNSY

SEQ ID NO: 2446060 - protein, 49 aa, Entamoeba dispar
NEENPQKEEVKEEVKEKTEEEKKPESKKEKRNKKRNYKREYEEEQIEEQ

SEQ ID NO: 2446061 - protein, 24 aa, Entamoeba dispar
  misc_feature (22)..(23): Xaa can be any naturally occurring amino acid
NEENRKKRKDLVIKIQEELDEXXS

SEQ ID NO: 2446062 - protein, 7 aa, Entamoeba dispar
NEENRKN

SEQ ID NO: 2446063 - protein, 7 aa, Entamoeba dispar
NEENRTC

SEQ ID NO: 2446064 - protein, 14 aa, Entamoeba dispar
NEENSKDENKEIKE

SEQ ID NO: 2446065 - protein, 9 aa, Entamoeba dispar
NEENTQDGN

SEQ ID NO: 2446066 - protein, 15 aa, Entamoeba dispar
NEEPTVPYSSMFEGI

SEQ ID NO: 2446067 - protein, 22 aa, Entamoeba dispar
NEEQNERSTEDITKTKKIAKKR

SEQ ID NO: 2446068 - protein, 5 aa, Entamoeba dispar
NEEQR

SEQ ID NO: 2446069 - protein, 10 aa, Entamoeba dispar
NEEQSKKELI

SEQ ID NO: 2446070 - protein, 6 aa, Entamoeba dispar
NEEQVI

SEQ ID NO: 2446071 - protein, 4 aa, Entamoeba dispar
NEER

SEQ ID NO: 2446072 - protein, 6 aa, Entamoeba dispar
NEERIT

SEQ ID NO: 2446073 - protein, 10 aa, Entamoeba dispar
NEERVTKGIE

SEQ ID NO: 2446074 - protein, 9 aa, Entamoeba dispar
NEESDRDSW

SEQ ID NO: 2446075 - protein, 7 aa, Entamoeba dispar
NEESECS

SEQ ID NO: 2446076 - protein, 6 aa, Entamoeba dispar
NEESFQ

SEQ ID NO: 2446077 - protein, 7 aa, Entamoeba dispar
NEESIQK

SEQ ID NO: 2446078 - protein, 10 aa, Entamoeba dispar
NEESQIKGKK

SEQ ID NO: 2446079 - protein, 11 aa, Entamoeba dispar
NEESSSDPLNA

SEQ ID NO: 2446080 - protein, 11 aa, Entamoeba dispar
NEESTESSYHE

SEQ ID NO: 2446081 - protein, 5 aa, Entamoeba dispar
NEETE

SEQ ID NO: 2446082 - protein, 9 aa, Entamoeba dispar
NEETEVDGF

SEQ ID NO: 2446083 - protein, 5 aa, Entamoeba dispar
NEETK

SEQ ID NO: 2446084 - protein, 9 aa, Entamoeba dispar
NEETKIGEP

SEQ ID NO: 2446085 - protein, 8 aa, Entamoeba dispar
NEETKMER

SEQ ID NO: 2446086 - protein, 6 aa, Entamoeba dispar
NEETRN

SEQ ID NO: 2446087 - protein, 8 aa, Entamoeba dispar
NEETSDVE

SEQ ID NO: 2446088 - protein, 8 aa, Entamoeba dispar
NEETTIKK

SEQ ID NO: 2446089 - protein, 9 aa, Entamoeba dispar
NEETTLDPL

SEQ ID NO: 2446090 - protein, 4 aa, Entamoeba dispar
NEEV

SEQ ID NO: 2446091 - protein, 10 aa, Entamoeba dispar
NEEVEERQRR

SEQ ID NO: 2446092 - protein, 6 aa, Entamoeba dispar
NEEVGR

SEQ ID NO: 2446093 - protein, 6 aa, Entamoeba dispar
NEEYKE

SEQ ID NO: 2446094 - protein, 5 aa, Entamoeba dispar
NEEYR

SEQ ID NO: 2446095 - protein, 13 aa, Entamoeba dispar
NEFANDPNVTDGA

SEQ ID NO: 2446096 - protein, 4 aa, Entamoeba dispar
NEFD

SEQ ID NO: 2446097 - protein, 13 aa, Entamoeba dispar
NEFDGEKVNNELE

SEQ ID NO: 2446098 - protein, 5 aa, Entamoeba dispar
NEFDQ

SEQ ID NO: 2446099 - protein, 6 aa, Entamoeba dispar
NEFDQR

SEQ ID NO: 2446100 - protein, 4 aa, Entamoeba dispar
NEFE

SEQ ID NO: 2446101 - protein, 14 aa, Entamoeba dispar
NEFEGDSSENSARI

SEQ ID NO: 2446102 - protein, 7 aa, Entamoeba dispar
NEFEPEK

SEQ ID NO: 2446103 - protein, 16 aa, Entamoeba dispar
NEFFGGESDPQEPEGT

SEQ ID NO: 2446104 - protein, 9 aa, Entamoeba dispar
NEFGNEEGK

SEQ ID NO: 2446105 - protein, 7 aa, Entamoeba dispar
NEFKGKP

SEQ ID NO: 2446106 - protein, 13 aa, Entamoeba dispar
NEFKGRMKKKNVE

SEQ ID NO: 2446107 - protein, 7 aa, Entamoeba dispar
NEFKSKK

SEQ ID NO: 2446108 - protein, 11 aa, Entamoeba dispar
NEFNENYKEQL

SEQ ID NO: 2446109 - protein, 11 aa, Entamoeba dispar
NEFQKCQTKKL

SEQ ID NO: 2446110 - protein, 4 aa, Entamoeba dispar
NEFS

SEQ ID NO: 2446111 - protein, 9 aa, Entamoeba dispar
NEFSNPKIT

SEQ ID NO: 2446112 - protein, 5 aa, Entamoeba dispar
NEFTE

SEQ ID NO: 2446113 - protein, 6 aa, Entamoeba dispar
NEFTQM

SEQ ID NO: 2446114 - protein, 5 aa, Entamoeba dispar
NEGAK

SEQ ID NO: 2446115 - protein, 14 aa, Entamoeba dispar
NEGAKTSVVFRMGS

SEQ ID NO: 2446116 - protein, 38 aa, Entamoeba dispar
NEGAVKALSTKPVLPPNWKQTPKGNNLFSEEKDALKRV

SEQ ID NO: 2446117 - protein, 8 aa, Entamoeba dispar
NEGDCNHY

SEQ ID NO: 2446118 - protein, 5 aa, Entamoeba dispar
NEGDK

SEQ ID NO: 2446119 - protein, 18 aa, Entamoeba dispar
NEGDKKQNIIESGAGTGM

SEQ ID NO: 2446120 - protein, 8 aa, Entamoeba dispar
NEGEETEE

SEQ ID NO: 2446121 - protein, 8 aa, Entamoeba dispar
NEGEGNPI

SEQ ID NO: 2446122 - protein, 6 aa, Entamoeba dispar
NEGEIK

SEQ ID NO: 2446123 - protein, 8 aa, Entamoeba dispar
NEGHPGNR

SEQ ID NO: 2446124 - protein, 6 aa, Entamoeba dispar
NEGIKE

SEQ ID NO: 2446125 - protein, 11 aa, Entamoeba dispar
NEGIKGMASAE

SEQ ID NO: 2446126 - protein, 23 aa, Entamoeba dispar
NEGIPIKKTPIEDKIENKKKLNY

SEQ ID NO: 2446127 - protein, 11 aa, Entamoeba dispar
NEGKEGVASAE

SEQ ID NO: 2446128 - protein, 5 aa, Entamoeba dispar
NEGKI

SEQ ID NO: 2446129 - protein, 13 aa, Entamoeba dispar
NEGKTFTPINTPQ

SEQ ID NO: 2446130 - protein, 9 aa, Entamoeba dispar
NEGKTNIKC

SEQ ID NO: 2446131 - protein, 12 aa, Entamoeba dispar
NEGNEGSRLSHD

SEQ ID NO: 2446132 - protein, 5 aa, Entamoeba dispar
NEGNI

SEQ ID NO: 2446133 - protein, 5 aa, Entamoeba dispar
NEGPI

SEQ ID NO: 2446134 - protein, 7 aa, Entamoeba dispar
NEGQFSD

SEQ ID NO: 2446135 - protein, 5 aa, Entamoeba dispar
NEGRN

SEQ ID NO: 2446136 - protein, 10 aa, Entamoeba dispar
NEGRNGSAVD

SEQ ID NO: 2446137 - protein, 7 aa, Entamoeba dispar
NEGRTPP

SEQ ID NO: 2446138 - protein, 9 aa, Entamoeba dispar
NEGRVNEKE

SEQ ID NO: 2446139 - protein, 5 aa, Entamoeba dispar
NEGSQ

SEQ ID NO: 2446140 - protein, 4 aa, Entamoeba dispar
NEGT

SEQ ID NO: 2446141 - protein, 7 aa, Entamoeba dispar
NEGTSHS

SEQ ID NO: 2446142 - protein, 5 aa, Entamoeba dispar
NEGTT

SEQ ID NO: 2446143 - protein, 11 aa, Entamoeba dispar
NEGYDEAQERV

SEQ ID NO: 2446144 - protein, 15 aa, Entamoeba dispar
NEGYEGDDIEEETEL

SEQ ID NO: 2446145 - protein, 12 aa, Entamoeba dispar
NEGYSNRTDSRT

SEQ ID NO: 2446146 - protein, 9 aa, Entamoeba dispar
NEHDPKRKA

SEQ ID NO: 2446147 - protein, 17 aa, Entamoeba dispar
NEHEGGDKKKKKKEQTI

SEQ ID NO: 2446148 - protein, 7 aa, Entamoeba dispar
NEHEREI

SEQ ID NO: 2446149 - protein, 4 aa, Entamoeba dispar
NEHK

SEQ ID NO: 2446150 - protein, 9 aa, Entamoeba dispar
NEHKDENIT

SEQ ID NO: 2446151 - protein, 17 aa, Entamoeba dispar
NEHKESIEKQMGETKDA

SEQ ID NO: 2446152 - protein, 6 aa, Entamoeba dispar
NEHKQT

SEQ ID NO: 2446153 - protein, 7 aa, Entamoeba dispar
NEHNSDV

SEQ ID NO: 2446154 - protein, 6 aa, Entamoeba dispar
NEHPDK

SEQ ID NO: 2446155 - protein, 5 aa, Entamoeba dispar
NEHPH

SEQ ID NO: 2446156 - protein, 12 aa, Entamoeba dispar
NEHQESTSEALK

SEQ ID NO: 2446157 - protein, 6 aa, Entamoeba dispar
NEHQII

SEQ ID NO: 2446158 - protein, 5 aa, Entamoeba dispar
NEHSA

SEQ ID NO: 2446159 - protein, 8 aa, Entamoeba dispar
NEHSSKAA

SEQ ID NO: 2446160 - protein, 4 aa, Entamoeba dispar
NEID

SEQ ID NO: 2446161 - protein, 8 aa, Entamoeba dispar
NEIDCSKE

SEQ ID NO: 2446162 - protein, 6 aa, Entamoeba dispar
NEIDGK

SEQ ID NO: 2446163 - protein, 5 aa, Entamoeba dispar
NEIDS

SEQ ID NO: 2446164 - protein, 7 aa, Entamoeba dispar
NEIDTNS

SEQ ID NO: 2446165 - protein, 6 aa, Entamoeba dispar
NEIEEQ

SEQ ID NO: 2446166 - protein, 8 aa, Entamoeba dispar
NEIEPSSG

SEQ ID NO: 2446167 - protein, 10 aa, Entamoeba dispar
NEIEQQDSIY

SEQ ID NO: 2446168 - protein, 6 aa, Entamoeba dispar
NEIESP

SEQ ID NO: 2446169 - protein, 4 aa, Entamoeba dispar
NEIF

SEQ ID NO: 2446170 - protein, 12 aa, Entamoeba dispar
NEIGGEVQGEEY

SEQ ID NO: 2446171 - protein, 8 aa, Entamoeba dispar
NEIGQENL

SEQ ID NO: 2446172 - protein, 9 aa, Entamoeba dispar
NEIKDGNIE

SEQ ID NO: 2446173 - protein, 13 aa, Entamoeba dispar
NEIKEEKEQINKY

SEQ ID NO: 2446174 - protein, 11 aa, Entamoeba dispar
NEIKESEETAF

SEQ ID NO: 2446175 - protein, 14 aa, Entamoeba dispar
NEIKNKTRENNENN

SEQ ID NO: 2446176 - protein, 28 aa, Entamoeba dispar
NEIKRQEEQKVSLEKENNTQKNTIEQNS

SEQ ID NO: 2446177 - protein, 6 aa, Entamoeba dispar
NEINEH

SEQ ID NO: 2446178 - protein, 10 aa, Entamoeba dispar
NEINEKGGID

SEQ ID NO: 2446179 - protein, 13 aa, Entamoeba dispar
NEINENKRRFENK

SEQ ID NO: 2446180 - protein, 16 aa, Entamoeba dispar
NEINEREEKKRQEKLE

SEQ ID NO: 2446181 - protein, 37 aa, Entamoeba dispar
NEINKQNEELNEKVNELKEEKMKNENSIEKSKQQEEL

SEQ ID NO: 2446182 - protein, 5 aa, Entamoeba dispar
NEINN

SEQ ID NO: 2446183 - protein, 48 aa, Entamoeba dispar
NEINSPQMEETKTDIQINEEKEEKIEEEEKKKIEKPQTRKDREEYQKQ

SEQ ID NO: 2446184 - protein, 4 aa, Entamoeba dispar
NEIP

SEQ ID NO: 2446185 - protein, 7 aa, Entamoeba dispar
NEIPPPI

SEQ ID NO: 2446186 - protein, 13 aa, Entamoeba dispar
NEIPTITENEEKS

SEQ ID NO: 2446187 - protein, 8 aa, Entamoeba dispar
NEIQEKNK

SEQ ID NO: 2446188 - protein, 9 aa, Entamoeba dispar
NEIQKRNGD

SEQ ID NO: 2446189 - protein, 21 aa, Entamoeba dispar
NEIQNALSQNDSTSKSGGIER

SEQ ID NO: 2446190 - protein, 20 aa, Entamoeba dispar
NEIQPSAQLTPSQKETQRDC

SEQ ID NO: 2446191 - protein, 6 aa, Entamoeba dispar
NEIRKN

SEQ ID NO: 2446192 - protein, 6 aa, Entamoeba dispar
NEISEK

SEQ ID NO: 2446193 - protein, 12 aa, Entamoeba dispar
NEISGSYAEKIR

SEQ ID NO: 2446194 - protein, 10 aa, Entamoeba dispar
NEISQVTGKL

SEQ ID NO: 2446195 - protein, 11 aa, Entamoeba dispar
NEISTEPEPIL

SEQ ID NO: 2446196 - protein, 4 aa, Entamoeba dispar
NEIT

SEQ ID NO: 2446197 - protein, 6 aa, Entamoeba dispar
NEITPS

SEQ ID NO: 2446198 - protein, 4 aa, Entamoeba dispar
NEIY

SEQ ID NO: 2446199 - protein, 4 aa, Entamoeba dispar
NEKA

SEQ ID NO: 2446200 - protein, 15 aa, Entamoeba dispar
NEKAKLSAQKDSSSF

SEQ ID NO: 2446201 - protein, 8 aa, Entamoeba dispar
NEKANRKN

SEQ ID NO: 2446202 - protein, 15 aa, Entamoeba dispar
NEKAPEPNKKRKKEE

SEQ ID NO: 2446203 - protein, 9 aa, Entamoeba dispar
NEKASTFTL

SEQ ID NO: 2446204 - protein, 5 aa, Entamoeba dispar
NEKAV

SEQ ID NO: 2446205 - protein, 4 aa, Entamoeba dispar
NEKC

SEQ ID NO: 2446206 - protein, 5 aa, Entamoeba dispar
NEKCE

SEQ ID NO: 2446207 - protein, 9 aa, Entamoeba dispar
NEKDKREKK

SEQ ID NO: 2446208 - protein, 9 aa, Entamoeba dispar
NEKDNTQSE

SEQ ID NO: 2446209 - protein, 8 aa, Entamoeba dispar
NEKDPNIL

SEQ ID NO: 2446210 - protein, 7 aa, Entamoeba dispar
NEKDQDV

SEQ ID NO: 2446211 - protein, 7 aa, Entamoeba dispar
NEKEEEL

SEQ ID NO: 2446212 - protein, 7 aa, Entamoeba dispar
NEKEIGE

SEQ ID NO: 2446213 - protein, 9 aa, Entamoeba dispar
NEKEKIRRT

SEQ ID NO: 2446214 - protein, 9 aa, Entamoeba dispar
NEKEKRSTY

SEQ ID NO: 2446215 - protein, 15 aa, Entamoeba dispar
NEKEKTSEKNEKENI

SEQ ID NO: 2446216 - protein, 18 aa, Entamoeba dispar
NEKEKVVSSTKENDKKIN

SEQ ID NO: 2446217 - protein, 5 aa, Entamoeba dispar
NEKEM

SEQ ID NO: 2446218 - protein, 9 aa, Entamoeba dispar
NEKENGNEC

SEQ ID NO: 2446219 - protein, 9 aa, Entamoeba dispar
NEKENKNII

SEQ ID NO: 2446220 - protein, 11 aa, Entamoeba dispar
NEKEQNQFENY

SEQ ID NO: 2446221 - protein, 20 aa, Entamoeba dispar
NEKERKKLEKKKKREEEERA

SEQ ID NO: 2446222 - protein, 8 aa, Entamoeba dispar
NEKESNQL

SEQ ID NO: 2446223 - protein, 10 aa, Entamoeba dispar
NEKEYNKERK

SEQ ID NO: 2446224 - protein, 14 aa, Entamoeba dispar
NEKEYNKERKVYDS

SEQ ID NO: 2446225 - protein, 6 aa, Entamoeba dispar
NEKEYQ

SEQ ID NO: 2446226 - protein, 4 aa, Entamoeba dispar
NEKF

SEQ ID NO: 2446227 - protein, 7 aa, Entamoeba dispar
NEKGCDL

SEQ ID NO: 2446228 - protein, 5 aa, Entamoeba dispar
NEKGE

SEQ ID NO: 2446229 - protein, 8 aa, Entamoeba dispar
NEKGIVGE

SEQ ID NO: 2446230 - protein, 12 aa, Entamoeba dispar
NEKGSSQNTHSH

SEQ ID NO: 2446231 - protein, 5 aa, Entamoeba dispar
NEKGY

SEQ ID NO: 2446232 - protein, 6 aa, Entamoeba dispar
NEKGYI

SEQ ID NO: 2446233 - protein, 4 aa, Entamoeba dispar
NEKH

SEQ ID NO: 2446234 - protein, 18 aa, Entamoeba dispar
NEKHRDKISSTNQKEEID

SEQ ID NO: 2446235 - protein, 8 aa, Entamoeba dispar
NEKIPDHK

SEQ ID NO: 2446236 - protein, 7 aa, Entamoeba dispar
NEKISNE

SEQ ID NO: 2446237 - protein, 11 aa, Entamoeba dispar
NEKITGKSNHE

SEQ ID NO: 2446238 - protein, 9 aa, Entamoeba dispar
NEKKDSNHL

SEQ ID NO: 2446239 - protein, 21 aa, Entamoeba dispar
NEKKEKKKIQISSKEENEKYS

SEQ ID NO: 2446240 - protein, 10 aa, Entamoeba dispar
NEKKESNIKT

SEQ ID NO: 2446241 - protein, 8 aa, Entamoeba dispar
NEKKEYND

SEQ ID NO: 2446242 - protein, 21 aa, Entamoeba dispar
NEKKIESIKSEFNSKERELGT

SEQ ID NO: 2446243 - protein, 14 aa, Entamoeba dispar
NEKKINKDKNEIND

SEQ ID NO: 2446244 - protein, 8 aa, Entamoeba dispar
NEKKKRQL

SEQ ID NO: 2446245 - protein, 6 aa, Entamoeba dispar
NEKKLE

SEQ ID NO: 2446246 - protein, 6 aa, Entamoeba dispar
NEKKLP

SEQ ID NO: 2446247 - protein, 12 aa, Entamoeba dispar
NEKKRTKEEYNQ

SEQ ID NO: 2446248 - protein, 14 aa, Entamoeba dispar
NEKKSQKKRKEEGL

SEQ ID NO: 2446249 - protein, 6 aa, Entamoeba dispar
NEKKSY

SEQ ID NO: 2446250 - protein, 9 aa, Entamoeba dispar
NEKKTQLAQ

SEQ ID NO: 2446251 - protein, 23 aa, Entamoeba dispar
NEKKVSSSTVKSSLCSSEERDKG

SEQ ID NO: 2446252 - protein, 10 aa, Entamoeba dispar
NEKLPPETTI

SEQ ID NO: 2446253 - protein, 6 aa, Entamoeba dispar
NEKLTT

SEQ ID NO: 2446254 - protein, 4 aa, Entamoeba dispar
NEKN

SEQ ID NO: 2446255 - protein, 14 aa, Entamoeba dispar
NEKNENSNDSENET

SEQ ID NO: 2446256 - protein, 8 aa, Entamoeba dispar
NEKNEQTI

SEQ ID NO: 2446257 - protein, 7 aa, Entamoeba dispar
NEKNETM

SEQ ID NO: 2446258 - protein, 8 aa, Entamoeba dispar
NEKNGNEI

SEQ ID NO: 2446259 - protein, 6 aa, Entamoeba dispar
NEKNLN

SEQ ID NO: 2446260 - protein, 8 aa, Entamoeba dispar
NEKNQSII

SEQ ID NO: 2446261 - protein, 8 aa, Entamoeba dispar
NEKQIKKY

SEQ ID NO: 2446262 - protein, 9 aa, Entamoeba dispar
NEKQINDSH

SEQ ID NO: 2446263 - protein, 6 aa, Entamoeba dispar
NEKQKT

SEQ ID NO: 2446264 - protein, 8 aa, Entamoeba dispar
NEKQMEKN

SEQ ID NO: 2446265 - protein, 14 aa, Entamoeba dispar
NEKQQIKKEENMMR

SEQ ID NO: 2446266 - protein, 19 aa, Entamoeba dispar
NEKRDTFDPIEDDSESWSD

SEQ ID NO: 2446267 - protein, 125 aa, Entamoeba dispar
NEKRYRRRNRSSSRRRHYSRRYSSRSRSRSRSPYSRRHSRSSSRRHRHSSSRSDSRSRSRSPYSRHSQRYSRHRHRSDSSSSFSRSSPSPKRDSSKRENKSIKNEDKSIKKDTETITPKDSENQQ

SEQ ID NO: 2446268 - protein, 6 aa, Entamoeba dispar
NEKSKW

SEQ ID NO: 2446269 - protein, 25 aa, Entamoeba dispar
NEKTEEGIESKESVDQKESEKDNIQ

SEQ ID NO: 2446270 - protein, 7 aa, Entamoeba dispar
NEKTEKK

SEQ ID NO: 2446271 - protein, 8 aa, Entamoeba dispar
NEKTENIE

SEQ ID NO: 2446272 - protein, 7 aa, Entamoeba dispar
NEKTGIP

SEQ ID NO: 2446273 - protein, 9 aa, Entamoeba dispar
NEKTGITKQ

SEQ ID NO: 2446274 - protein, 5 aa, Entamoeba dispar
NEKTK

SEQ ID NO: 2446275 - protein, 9 aa, Entamoeba dispar
NEKTKDSDI

SEQ ID NO: 2446276 - protein, 9 aa, Entamoeba dispar
NEKTTQPNP

SEQ ID NO: 2446277 - protein, 5 aa, Entamoeba dispar
NEKVT

SEQ ID NO: 2446278 - protein, 4 aa, Entamoeba dispar
NEKY

SEQ ID NO: 2446279 - protein, 9 aa, Entamoeba dispar
NEKYESSYN

SEQ ID NO: 2446280 - protein, 8 aa, Entamoeba dispar
NEKYQIQS

SEQ ID NO: 2446281 - protein, 6 aa, Entamoeba dispar
NEKYQP

SEQ ID NO: 2446282 - protein, 4 aa, Entamoeba dispar
NELA

SEQ ID NO: 2446283 - protein, 9 aa, Entamoeba dispar
NELAQSEAY

SEQ ID NO: 2446284 - protein, 5 aa, Entamoeba dispar
NELAT

SEQ ID NO: 2446285 - protein, 7 aa, Entamoeba dispar
NELDEFP

SEQ ID NO: 2446286 - protein, 10 aa, Entamoeba dispar
NELDNNKKST

SEQ ID NO: 2446287 - protein, 4 aa, Entamoeba dispar
NELE

SEQ ID NO: 2446288 - protein, 5 aa, Entamoeba dispar
NELEE

SEQ ID NO: 2446289 - protein, 17 aa, Entamoeba dispar
NELEKQRKLRKRYSKPR

SEQ ID NO: 2446290 - protein, 5 aa, Entamoeba dispar
NELEN

SEQ ID NO: 2446291 - protein, 7 aa, Entamoeba dispar
NELENRG

SEQ ID NO: 2446292 - protein, 16 aa, Entamoeba dispar
NELEPHSSYLPEIKED

SEQ ID NO: 2446293 - protein, 6 aa, Entamoeba dispar
NELEPN

SEQ ID NO: 2446294 - protein, 10 aa, Entamoeba dispar
NELGNASGEL

SEQ ID NO: 2446295 - protein, 11 aa, Entamoeba dispar
NELHGSCTSDQ

SEQ ID NO: 2446296 - protein, 13 aa, Entamoeba dispar
NELKEAQSKRVLL

SEQ ID NO: 2446297 - protein, 6 aa, Entamoeba dispar
NELKEE

SEQ ID NO: 2446298 - protein, 9 aa, Entamoeba dispar
NELKEKNNI

SEQ ID NO: 2446299 - protein, 5 aa, Entamoeba dispar
NELKG

SEQ ID NO: 2446300 - protein, 10 aa, Entamoeba dispar
NELKKGGKLL

SEQ ID NO: 2446301 - protein, 11 aa, Entamoeba dispar
NELKNNSHSSI

SEQ ID NO: 2446302 - protein, 5 aa, Entamoeba dispar
NELKQ

SEQ ID NO: 2446303 - protein, 17 aa, Entamoeba dispar
NELKSQSIQTKTVLIES

SEQ ID NO: 2446304 - protein, 4 aa, Entamoeba dispar
NELN

SEQ ID NO: 2446305 - protein, 5 aa, Entamoeba dispar
NELNE

SEQ ID NO: 2446306 - protein, 13 aa, Entamoeba dispar
NELNETGKMSIQD

SEQ ID NO: 2446307 - protein, 6 aa, Entamoeba dispar
NELNKS

SEQ ID NO: 2446308 - protein, 9 aa, Entamoeba dispar
NELNNGVEK

SEQ ID NO: 2446309 - protein, 14 aa, Entamoeba dispar
NELNTQKEEYEEQI

SEQ ID NO: 2446310 - protein, 6 aa, Entamoeba dispar
NELPAE

SEQ ID NO: 2446311 - protein, 5 aa, Entamoeba dispar
NELPP

SEQ ID NO: 2446312 - protein, 8 aa, Entamoeba dispar
NELPPMPI

SEQ ID NO: 2446313 - protein, 10 aa, Entamoeba dispar
NELQPQSDLL

SEQ ID NO: 2446314 - protein, 5 aa, Entamoeba dispar
NELQT

SEQ ID NO: 2446315 - protein, 5 aa, Entamoeba dispar
NELSE

SEQ ID NO: 2446316 - protein, 11 aa, Entamoeba dispar
NELSEAPNRTV

SEQ ID NO: 2446317 - protein, 10 aa, Entamoeba dispar
NELSNKSTKE

SEQ ID NO: 2446318 - protein, 18 aa, Entamoeba dispar
NELSQEISAEKEGDVETM

SEQ ID NO: 2446319 - protein, 11 aa, Entamoeba dispar
NELSSNKTILN

SEQ ID NO: 2446320 - protein, 11 aa, Entamoeba dispar
NELSTKDDENS

SEQ ID NO: 2446321 - protein, 4 aa, Entamoeba dispar
NELT

SEQ ID NO: 2446322 - protein, 8 aa, Entamoeba dispar
NELTDNED

SEQ ID NO: 2446323 - protein, 13 aa, Entamoeba dispar
NELTESEKKELQR

SEQ ID NO: 2446324 - protein, 8 aa, Entamoeba dispar
NELTQKQQ

SEQ ID NO: 2446325 - protein, 4 aa, Entamoeba dispar
NEMA

SEQ ID NO: 2446326 - protein, 6 aa, Entamoeba dispar
NEMENQ

SEQ ID NO: 2446327 - protein, 6 aa, Entamoeba dispar
NEMGES

SEQ ID NO: 2446328 - protein, 15 aa, Entamoeba dispar
NEMKEEQAQERQQQK

SEQ ID NO: 2446329 - protein, 13 aa, Entamoeba dispar
NEMKESSQPVEEE

SEQ ID NO: 2446330 - protein, 5 aa, Entamoeba dispar
NEMKG

SEQ ID NO: 2446331 - protein, 7 aa, Entamoeba dispar
NEMKGKE

SEQ ID NO: 2446332 - protein, 16 aa, Entamoeba dispar
NEMNEEQDITTTNNRR

SEQ ID NO: 2446333 - protein, 6 aa, Entamoeba dispar
NEMNQE

SEQ ID NO: 2446334 - protein, 7 aa, Entamoeba dispar
NEMPKDE

SEQ ID NO: 2446335 - protein, 5 aa, Entamoeba dispar
NEMQQ

SEQ ID NO: 2446336 - protein, 7 aa, Entamoeba dispar
NEMTGKK

SEQ ID NO: 2446337 - protein, 14 aa, Entamoeba dispar
NEMTPEELKKVPTA

SEQ ID NO: 2446338 - protein, 4 aa, Entamoeba dispar
NEND

SEQ ID NO: 2446339 - protein, 6 aa, Entamoeba dispar
NENDFP

SEQ ID NO: 2446340 - protein, 6 aa, Entamoeba dispar
NENDIK

SEQ ID NO: 2446341 - protein, 4 aa, Entamoeba dispar
NENE

SEQ ID NO: 2446342 - protein, 13 aa, Entamoeba dispar
NENEEESQESEEK

SEQ ID NO: 2446343 - protein, 7 aa, Entamoeba dispar
NENEEKD

SEQ ID NO: 2446344 - protein, 5 aa, Entamoeba dispar
NENEH

SEQ ID NO: 2446345 - protein, 16 aa, Entamoeba dispar
NENEKKNSLVKEDNGF

SEQ ID NO: 2446346 - protein, 5 aa, Entamoeba dispar
NENEL

SEQ ID NO: 2446347 - protein, 9 aa, Entamoeba dispar
NENENTSEM

SEQ ID NO: 2446348 - protein, 7 aa, Entamoeba dispar
NENESVR

SEQ ID NO: 2446349 - protein, 4 aa, Entamoeba dispar
NENF

SEQ ID NO: 2446350 - protein, 14 aa, Entamoeba dispar
NENFKPEDYQGITN

SEQ ID NO: 2446351 - protein, 4 aa, Entamoeba dispar
NENG

SEQ ID NO: 2446352 - protein, 12 aa, Entamoeba dispar
NENGERLSSTGR

SEQ ID NO: 2446353 - protein, 7 aa, Entamoeba dispar
NENGLKD

SEQ ID NO: 2446354 - protein, 7 aa, Entamoeba dispar
NENGTYD

SEQ ID NO: 2446355 - protein, 15 aa, Entamoeba dispar
NENGVISQKGKMKSI

SEQ ID NO: 2446356 - protein, 47 aa, Entamoeba dispar
NENINDITEENDMSEISNEENEEIKEIKEESEEDNNKEDIEENNKEF

SEQ ID NO: 2446357 - protein, 6 aa, Entamoeba dispar
NENKEI

SEQ ID NO: 2446358 - protein, 21 aa, Entamoeba dispar
NENKEKKKIQISSKEENEKYS

SEQ ID NO: 2446359 - protein, 25 aa, Entamoeba dispar
NENKEKKKIQISSKEENEKYSIRTN

SEQ ID NO: 2446360 - protein, 9 aa, Entamoeba dispar
NENKIEEKT

SEQ ID NO: 2446361 - protein, 10 aa, Entamoeba dispar
NENKLEEKQF

SEQ ID NO: 2446362 - protein, 33 aa, Entamoeba dispar
NENKQSVTEKVKKEEEVNKKIENENNDKEFNTM

SEQ ID NO: 2446363 - protein, 6 aa, Entamoeba dispar
NENKSQ

SEQ ID NO: 2446364 - protein, 7 aa, Entamoeba dispar
NENKTYN

SEQ ID NO: 2446365 - protein, 4 aa, Entamoeba dispar
NENN

SEQ ID NO: 2446366 - protein, 6 aa, Entamoeba dispar
NENNEI

SEQ ID NO: 2446367 - protein, 9 aa, Entamoeba dispar
NENNKLERE

SEQ ID NO: 2446368 - protein, 8 aa, Entamoeba dispar
NENNKQKM

SEQ ID NO: 2446369 - protein, 6 aa, Entamoeba dispar
NENNKT

SEQ ID NO: 2446370 - protein, 7 aa, Entamoeba dispar
NENQENV

SEQ ID NO: 2446371 - protein, 5 aa, Entamoeba dispar
NENQI

SEQ ID NO: 2446372 - protein, 13 aa, Entamoeba dispar
NENQKKEITKNIS

SEQ ID NO: 2446373 - protein, 7 aa, Entamoeba dispar
NENQKSI

SEQ ID NO: 2446374 - protein, 16 aa, Entamoeba dispar
NENQPQNTTKQNQSQL

SEQ ID NO: 2446375 - protein, 4 aa, Entamoeba dispar
NENR

SEQ ID NO: 2446376 - protein, 43 aa, Entamoeba dispar
NENREKKLKRTLGEDEEDDKEKKKRKERRKEGKKKSKKEKMDK

SEQ ID NO: 2446377 - protein, 14 aa, Entamoeba dispar
NENRPRTELENEDD

SEQ ID NO: 2446378 - protein, 8 aa, Entamoeba dispar
NENRSSNC

SEQ ID NO: 2446379 - protein, 4 aa, Entamoeba dispar
NENS

SEQ ID NO: 2446380 - protein, 5 aa, Entamoeba dispar
NENSD

SEQ ID NO: 2446381 - protein, 9 aa, Entamoeba dispar
NENSDNIIE

SEQ ID NO: 2446382 - protein, 10 aa, Entamoeba dispar
NENSKRKSYV

SEQ ID NO: 2446383 - protein, 7 aa, Entamoeba dispar
NENSNIK

SEQ ID NO: 2446384 - protein, 29 aa, Entamoeba dispar
NENSNNLIKRTKDEIYNPSTFSRIGYQNY

SEQ ID NO: 2446385 - protein, 7 aa, Entamoeba dispar
NENTDDT

SEQ ID NO: 2446386 - protein, 7 aa, Entamoeba dispar
NENTLGN

SEQ ID NO: 2446387 - protein, 7 aa, Entamoeba dispar
NENTLYN

SEQ ID NO: 2446388 - protein, 8 aa, Entamoeba dispar
NENTPYVA

SEQ ID NO: 2446389 - protein, 10 aa, Entamoeba dispar
NENTTSQKIE

SEQ ID NO: 2446390 - protein, 54 aa, Entamoeba dispar
NENTVPNEKDESCPSIKSPKKPLIEPQENSIKKEIGKKEDYTDVSTIKKDTNKL

SEQ ID NO: 2446391 - protein, 4 aa, Entamoeba dispar
NENV

SEQ ID NO: 2446392 - protein, 4 aa, Entamoeba dispar
NENW

SEQ ID NO: 2446393 - protein, 11 aa, Entamoeba dispar
NENYSSYGGNR

SEQ ID NO: 2446394 - protein, 4 aa, Entamoeba dispar
NEPA

SEQ ID NO: 2446395 - protein, 7 aa, Entamoeba dispar
NEPAESC

SEQ ID NO: 2446396 - protein, 8 aa, Entamoeba dispar
NEPAPGYN

SEQ ID NO: 2446397 - protein, 5 aa, Entamoeba dispar
NEPDS

SEQ ID NO: 2446398 - protein, 14 aa, Entamoeba dispar
NEPEQISNTYDYTN

SEQ ID NO: 2446399 - protein, 17 aa, Entamoeba dispar
NEPGIKASTEDKRKKAV

SEQ ID NO: 2446400 - protein, 6 aa, Entamoeba dispar
NEPGKY

SEQ ID NO: 2446401 - protein, 12 aa, Entamoeba dispar
NEPIKEEEINNK

SEQ ID NO: 2446402 - protein, 13 aa, Entamoeba dispar
NEPIKSDDQPFKE

SEQ ID NO: 2446403 - protein, 7 aa, Entamoeba dispar
NEPITKQ

SEQ ID NO: 2446404 - protein, 11 aa, Entamoeba dispar
NEPKKSASDRL

SEQ ID NO: 2446405 - protein, 8 aa, Entamoeba dispar
NEPKMSGG

SEQ ID NO: 2446406 - protein, 35 aa, Entamoeba dispar
NEPKTPRLTPRKTGDTRSISTITPKKKQMSGDNTR

SEQ ID NO: 2446407 - protein, 15 aa, Entamoeba dispar
NEPLGQLKSRSECDT

SEQ ID NO: 2446408 - protein, 21 aa, Entamoeba dispar
NEPLKSEKSEESCGDEISAEV

SEQ ID NO: 2446409 - protein, 15 aa, Entamoeba dispar
NEPLKTPCGTQDYAA

SEQ ID NO: 2446410 - protein, 5 aa, Entamoeba dispar
NEPLN

SEQ ID NO: 2446411 - protein, 11 aa, Entamoeba dispar
NEPNNEGNEIK

SEQ ID NO: 2446412 - protein, 7 aa, Entamoeba dispar
NEPPIQD

SEQ ID NO: 2446413 - protein, 10 aa, Entamoeba dispar
NEPQENNESM

SEQ ID NO: 2446414 - protein, 14 aa, Entamoeba dispar
NEPQYSIPKTGSVI

SEQ ID NO: 2446415 - protein, 5 aa, Entamoeba dispar
NEPSA

SEQ ID NO: 2446416 - protein, 5 aa, Entamoeba dispar
NEPSC

SEQ ID NO: 2446417 - protein, 10 aa, Entamoeba dispar
NEPTDNKSTV

SEQ ID NO: 2446418 - protein, 16 aa, Entamoeba dispar
NEPTKTEPKEEQQTKQ

SEQ ID NO: 2446419 - protein, 5 aa, Entamoeba dispar
NEPTQ

SEQ ID NO: 2446420 - protein, 8 aa, Entamoeba dispar
NEPTTLPQ

SEQ ID NO: 2446421 - protein, 6 aa, Entamoeba dispar
NEPTTM

SEQ ID NO: 2446422 - protein, 5 aa, Entamoeba dispar
NEPVK

SEQ ID NO: 2446423 - protein, 7 aa, Entamoeba dispar
NEPVNGE

SEQ ID NO: 2446424 - protein, 12 aa, Entamoeba dispar
NEPYESPLKPFG

SEQ ID NO: 2446425 - protein, 8 aa, Entamoeba dispar
NEPYHGGL

SEQ ID NO: 2446426 - protein, 15 aa, Entamoeba dispar
NEQAEKSSFSSPEYL

SEQ ID NO: 2446427 - protein, 19 aa, Entamoeba dispar
NEQAKAELKKEQLKKSQRC

SEQ ID NO: 2446428 - protein, 6 aa, Entamoeba dispar
NEQAKE

SEQ ID NO: 2446429 - protein, 5 aa, Entamoeba dispar
NEQCT

SEQ ID NO: 2446430 - protein, 9 aa, Entamoeba dispar
NEQDSESFE

SEQ ID NO: 2446431 - protein, 9 aa, Entamoeba dispar
NEQDYPESP

SEQ ID NO: 2446432 - protein, 17 aa, Entamoeba dispar
NEQEGEGELLTQNQQNT

SEQ ID NO: 2446433 - protein, 8 aa, Entamoeba dispar
NEQEKSDW

SEQ ID NO: 2446434 - protein, 5 aa, Entamoeba dispar
NEQET

SEQ ID NO: 2446435 - protein, 6 aa, Entamoeba dispar
NEQHKR

SEQ ID NO: 2446436 - protein, 8 aa, Entamoeba dispar
NEQHNDGV

SEQ ID NO: 2446437 - protein, 5 aa, Entamoeba dispar
NEQIG

SEQ ID NO: 2446438 - protein, 8 aa, Entamoeba dispar
NEQINSNE

SEQ ID NO: 2446439 - protein, 5 aa, Entamoeba dispar
NEQKI

SEQ ID NO: 2446440 - protein, 10 aa, Entamoeba dispar
NEQKIEENPE

SEQ ID NO: 2446441 - protein, 4 aa, Entamoeba dispar
NEQL

SEQ ID NO: 2446442 - protein, 8 aa, Entamoeba dispar
NEQLNENK

SEQ ID NO: 2446443 - protein, 13 aa, Entamoeba dispar
NEQLTKKPKIPKE

SEQ ID NO: 2446444 - protein, 6 aa, Entamoeba dispar
NEQNQL

SEQ ID NO: 2446445 - protein, 4 aa, Entamoeba dispar
NEQP

SEQ ID NO: 2446446 - protein, 8 aa, Entamoeba dispar
NEQPGASF

SEQ ID NO: 2446447 - protein, 5 aa, Entamoeba dispar
NEQPH

SEQ ID NO: 2446448 - protein, 11 aa, Entamoeba dispar
NEQPTHKPIKG

SEQ ID NO: 2446449 - protein, 4 aa, Entamoeba dispar
NEQQ

SEQ ID NO: 2446450 - protein, 36 aa, Entamoeba dispar
NEQQQESTDTSSNQQENQVEDIKDDDMKKKESKETL

SEQ ID NO: 2446451 - protein, 6 aa, Entamoeba dispar
NEQQSY

SEQ ID NO: 2446452 - protein, 7 aa, Entamoeba dispar
NEQRNEV

SEQ ID NO: 2446453 - protein, 11 aa, Entamoeba dispar
NEQSSPQPKQC

SEQ ID NO: 2446454 - protein, 28 aa, Entamoeba dispar
NEQTPHPSLESNQTQPQPTKPVIGSDGK

SEQ ID NO: 2446455 - protein, 8 aa, Entamoeba dispar
NEQTPKQW

SEQ ID NO: 2446456 - protein, 7 aa, Entamoeba dispar
NEQTPTS

SEQ ID NO: 2446457 - protein, 6 aa, Entamoeba dispar
NEQVEE

SEQ ID NO: 2446458 - protein, 11 aa, Entamoeba dispar
NEQVSSEECQK

SEQ ID NO: 2446459 - protein, 5 aa, Entamoeba dispar
NEQYN

SEQ ID NO: 2446460 - protein, 6 aa, Entamoeba dispar
NERDGC

SEQ ID NO: 2446461 - protein, 5 aa, Entamoeba dispar
NEREY

SEQ ID NO: 2446462 - protein, 7 aa, Entamoeba dispar
NERHSNS

SEQ ID NO: 2446463 - protein, 6 aa, Entamoeba dispar
NERIDS

SEQ ID NO: 2446464 - protein, 11 aa, Entamoeba dispar
NERKEDKQDEL

SEQ ID NO: 2446465 - protein, 6 aa, Entamoeba dispar
NERKGM

SEQ ID NO: 2446466 - protein, 28 aa, Entamoeba dispar
NERKIEEKSDKEEKKIRKQRYKKEEEII

SEQ ID NO: 2446467 - protein, 28 aa, Entamoeba dispar
NERKIEEKTDKEEKKIRKQRYKKEEEII

SEQ ID NO: 2446468 - protein, 10 aa, Entamoeba dispar
NERKKSEYPT

SEQ ID NO: 2446469 - protein, 5 aa, Entamoeba dispar
NERKL

SEQ ID NO: 2446470 - protein, 10 aa, Entamoeba dispar
NERKNNTSDL

SEQ ID NO: 2446471 - protein, 19 aa, Entamoeba dispar
NERKRKNEEIEEPVIPPFT

SEQ ID NO: 2446472 - protein, 10 aa, Entamoeba dispar
NERLEQTKQD

SEQ ID NO: 2446473 - protein, 16 aa, Entamoeba dispar
NERLKEENQKCEGVSE

SEQ ID NO: 2446474 - protein, 9 aa, Entamoeba dispar
NERMTPTEA

SEQ ID NO: 2446475 - protein, 7 aa, Entamoeba dispar
NERNGIY

SEQ ID NO: 2446476 - protein, 7 aa, Entamoeba dispar
NERNWPG

SEQ ID NO: 2446477 - protein, 6 aa, Entamoeba dispar
NERPSF

SEQ ID NO: 2446478 - protein, 13 aa, Entamoeba dispar
NERRKEKDERLNE

SEQ ID NO: 2446479 - protein, 8 aa, Entamoeba dispar
NERSDEKK

SEQ ID NO: 2446480 - protein, 12 aa, Entamoeba dispar
NERSKMVQTKEQ

SEQ ID NO: 2446481 - protein, 10 aa, Entamoeba dispar
NERTKDIDRR

SEQ ID NO: 2446482 - protein, 6 aa, Entamoeba dispar
NERTKQ

SEQ ID NO: 2446483 - protein, 4 aa, Entamoeba dispar
NERY

SEQ ID NO: 2446484 - protein, 7 aa, Entamoeba dispar
NERYKES

SEQ ID NO: 2446485 - protein, 7 aa, Entamoeba dispar
NESAQPL

SEQ ID NO: 2446486 - protein, 7 aa, Entamoeba dispar
NESAQRV

SEQ ID NO: 2446487 - protein, 7 aa, Entamoeba dispar
NESATQR

SEQ ID NO: 2446488 - protein, 19 aa, Entamoeba dispar
NESDASKAKNTENGKEWNG

SEQ ID NO: 2446489 - protein, 7 aa, Entamoeba dispar
NESDDEE

SEQ ID NO: 2446490 - protein, 8 aa, Entamoeba dispar
NESDNRKY

SEQ ID NO: 2446491 - protein, 8 aa, Entamoeba dispar
NESDYSNV

SEQ ID NO: 2446492 - protein, 12 aa, Entamoeba dispar
NESEHQGDSEQK

SEQ ID NO: 2446493 - protein, 6 aa, Entamoeba dispar
NESETD

SEQ ID NO: 2446494 - protein, 11 aa, Entamoeba dispar
NESFDDEYVPR

SEQ ID NO: 2446495 - protein, 6 aa, Entamoeba dispar
NESFKE

SEQ ID NO: 2446496 - protein, 11 aa, Entamoeba dispar
NESFPNKLPPA

SEQ ID NO: 2446497 - protein, 4 aa, Entamoeba dispar
NESH

SEQ ID NO: 2446498 - protein, 9 aa, Entamoeba dispar
NESHEQKQT

SEQ ID NO: 2446499 - protein, 6 aa, Entamoeba dispar
NESHNL

SEQ ID NO: 2446500 - protein, 4 aa, Entamoeba dispar
NESI

SEQ ID NO: 2446501 - protein, 23 aa, Entamoeba dispar
NESIDIGKNGISQLKQQNQQLKR

SEQ ID NO: 2446502 - protein, 5 aa, Entamoeba dispar
NESIK

SEQ ID NO: 2446503 - protein, 25 aa, Entamoeba dispar
NESIPQKQQTDTSITKTNIQQNQIS

SEQ ID NO: 2446504 - protein, 7 aa, Entamoeba dispar
NESIPQL

SEQ ID NO: 2446505 - protein, 5 aa, Entamoeba dispar
NESIQ

SEQ ID NO: 2446506 - protein, 26 aa, Entamoeba dispar
NESKEFSTIEQEKNKTQKQHQNEMKK

SEQ ID NO: 2446507 - protein, 8 aa, Entamoeba dispar
NESKHEEI

SEQ ID NO: 2446508 - protein, 8 aa, Entamoeba dispar
NESKKVGS

SEQ ID NO: 2446509 - protein, 7 aa, Entamoeba dispar
NESKKVN

SEQ ID NO: 2446510 - protein, 8 aa, Entamoeba dispar
NESKNDIK

SEQ ID NO: 2446511 - protein, 9 aa, Entamoeba dispar
NESKNETKV

SEQ ID NO: 2446512 - protein, 44 aa, Entamoeba dispar
NESKPISSEEKNTTQKTSIKSERRKRATTLANSNNPMKKEIMQL

SEQ ID NO: 2446513 - protein, 10 aa, Entamoeba dispar
NESKPNESDL

SEQ ID NO: 2446514 - protein, 9 aa, Entamoeba dispar
NESKPTFSE

SEQ ID NO: 2446515 - protein, 15 aa, Entamoeba dispar
NESKSIKNEKKYKEI

SEQ ID NO: 2446516 - protein, 7 aa, Entamoeba dispar
NESLEDR

SEQ ID NO: 2446517 - protein, 14 aa, Entamoeba dispar
NESLKEQLDSKNDE

SEQ ID NO: 2446518 - protein, 4 aa, Entamoeba dispar
NESN

SEQ ID NO: 2446519 - protein, 11 aa, Entamoeba dispar
NESNGLNTEEC

SEQ ID NO: 2446520 - protein, 5 aa, Entamoeba dispar
NESNL

SEQ ID NO: 2446521 - protein, 8 aa, Entamoeba dispar
NESNNDCN

SEQ ID NO: 2446522 - protein, 8 aa, Entamoeba dispar
NESNNVPL

SEQ ID NO: 2446523 - protein, 11 aa, Entamoeba dispar
NESNNVPSNEI

SEQ ID NO: 2446524 - protein, 9 aa, Entamoeba dispar
NESNQENTV

SEQ ID NO: 2446525 - protein, 8 aa, Entamoeba dispar
NESNTTRL

SEQ ID NO: 2446526 - protein, 8 aa, Entamoeba dispar
NESPEITD

SEQ ID NO: 2446527 - protein, 5 aa, Entamoeba dispar
NESPK

SEQ ID NO: 2446528 - protein, 10 aa, Entamoeba dispar
NESQEDNASM

SEQ ID NO: 2446529 - protein, 10 aa, Entamoeba dispar
NESQENNSSI

SEQ ID NO: 2446530 - protein, 11 aa, Entamoeba dispar
NESQENNSSMV

SEQ ID NO: 2446531 - protein, 8 aa, Entamoeba dispar
NESQKKML

SEQ ID NO: 2446532 - protein, 15 aa, Entamoeba dispar
NESREIKLTSTDHPI

SEQ ID NO: 2446533 - protein, 10 aa, Entamoeba dispar
NESRSDDDKT

SEQ ID NO: 2446534 - protein, 5 aa, Entamoeba dispar
NESSF

SEQ ID NO: 2446535 - protein, 20 aa, Entamoeba dispar
NESTDSLEKSAEIDQPYPPT

SEQ ID NO: 2446536 - protein, 10 aa, Entamoeba dispar
NESTERTENI

SEQ ID NO: 2446537 - protein, 5 aa, Entamoeba dispar
NESTF

SEQ ID NO: 2446538 - protein, 41 aa, Entamoeba dispar
NESTPTQTDTSSTTIKTKTSQLSSSYEKHQNYQSHSQEKTI

SEQ ID NO: 2446539 - protein, 15 aa, Entamoeba dispar
NESTSDSDGEKQKKK

SEQ ID NO: 2446540 - protein, 5 aa, Entamoeba dispar
NESYE

SEQ ID NO: 2446541 - protein, 6 aa, Entamoeba dispar
NETASF

SEQ ID NO: 2446542 - protein, 8 aa, Entamoeba dispar
NETDINNG

SEQ ID NO: 2446543 - protein, 5 aa, Entamoeba dispar
NETDK

SEQ ID NO: 2446544 - protein, 14 aa, Entamoeba dispar
NETDVQFASVMELM

SEQ ID NO: 2446545 - protein, 4 aa, Entamoeba dispar
NETE

SEQ ID NO: 2446546 - protein, 15 aa, Entamoeba dispar
NETEKKPRKPKEDNQ

SEQ ID NO: 2446547 - protein, 10 aa, Entamoeba dispar
NETENERNSI

SEQ ID NO: 2446548 - protein, 10 aa, Entamoeba dispar
NETESYASDL

SEQ ID NO: 2446549 - protein, 13 aa, Entamoeba dispar
NETETKTDVTTET

SEQ ID NO: 2446550 - protein, 5 aa, Entamoeba dispar
NETFS

SEQ ID NO: 2446551 - protein, 5 aa, Entamoeba dispar
NETGE

SEQ ID NO: 2446552 - protein, 6 aa, Entamoeba dispar
NETGEI

SEQ ID NO: 2446553 - protein, 4 aa, Entamoeba dispar
NETH

SEQ ID NO: 2446554 - protein, 4 aa, Entamoeba dispar
NETI

SEQ ID NO: 2446555 - protein, 10 aa, Entamoeba dispar
NETISQNNPD

SEQ ID NO: 2446556 - protein, 6 aa, Entamoeba dispar
NETKAK

SEQ ID NO: 2446557 - protein, 5 aa, Entamoeba dispar
NETKH

SEQ ID NO: 2446558 - protein, 8 aa, Entamoeba dispar
NETKKIGD

SEQ ID NO: 2446559 - protein, 14 aa, Entamoeba dispar
NETKNQGTKEQENI

SEQ ID NO: 2446560 - protein, 11 aa, Entamoeba dispar
NETKQENQPTL

SEQ ID NO: 2446561 - protein, 10 aa, Entamoeba dispar
NETKQPFEKA

SEQ ID NO: 2446562 - protein, 5 aa, Entamoeba dispar
NETKR

SEQ ID NO: 2446563 - protein, 11 aa, Entamoeba dispar
NETKTTQQKKL

SEQ ID NO: 2446564 - protein, 6 aa, Entamoeba dispar
NETLDT

SEQ ID NO: 2446565 - protein, 14 aa, Entamoeba dispar
NETNCYSKNEYKNT

SEQ ID NO: 2446566 - protein, 9 aa, Entamoeba dispar
NETNEFNER

SEQ ID NO: 2446567 - protein, 11 aa, Entamoeba dispar
NETNEKKSKLD

SEQ ID NO: 2446568 - protein, 6 aa, Entamoeba dispar
NETNEY

SEQ ID NO: 2446569 - protein, 6 aa, Entamoeba dispar
NETNGE

SEQ ID NO: 2446570 - protein, 7 aa, Entamoeba dispar
NETNGNE

SEQ ID NO: 2446571 - protein, 7 aa, Entamoeba dispar
NETNKYR

SEQ ID NO: 2446572 - protein, 6 aa, Entamoeba dispar
NETNPV

SEQ ID NO: 2446573 - protein, 7 aa, Entamoeba dispar
NETNQMS

SEQ ID NO: 2446574 - protein, 4 aa, Entamoeba dispar
NETP

SEQ ID NO: 2446575 - protein, 5 aa, Entamoeba dispar
NETPG

SEQ ID NO: 2446576 - protein, 6 aa, Entamoeba dispar
NETPGM

SEQ ID NO: 2446577 - protein, 7 aa, Entamoeba dispar
NETQDYY

SEQ ID NO: 2446578 - protein, 4 aa, Entamoeba dispar
NETS

SEQ ID NO: 2446579 - protein, 6 aa, Entamoeba dispar
NETSIR

SEQ ID NO: 2446580 - protein, 9 aa, Entamoeba dispar
NETSKQTKV

SEQ ID NO: 2446581 - protein, 8 aa, Entamoeba dispar
NETSPNDI

SEQ ID NO: 2446582 - protein, 8 aa, Entamoeba dispar
NETSPQKD

SEQ ID NO: 2446583 - protein, 6 aa, Entamoeba dispar
NETSTI

SEQ ID NO: 2446584 - protein, 14 aa, Entamoeba dispar
NETSWHDPRDNPLP

SEQ ID NO: 2446585 - protein, 9 aa, Entamoeba dispar
NETTGTTEN

SEQ ID NO: 2446586 - protein, 8 aa, Entamoeba dispar
NETTKFSS

SEQ ID NO: 2446587 - protein, 11 aa, Entamoeba dispar
NETTKKESNQW

SEQ ID NO: 2446588 - protein, 8 aa, Entamoeba dispar
NETTKKQL

SEQ ID NO: 2446589 - protein, 10 aa, Entamoeba dispar
NETTTSSSIP

SEQ ID NO: 2446590 - protein, 7 aa, Entamoeba dispar
NETVQAE

SEQ ID NO: 2446591 - protein, 5 aa, Entamoeba dispar
NETVR

SEQ ID NO: 2446592 - protein, 4 aa, Entamoeba dispar
NETY

SEQ ID NO: 2446593 - protein, 10 aa, Entamoeba dispar
NETYQEKTRT

SEQ ID NO: 2446594 - protein, 14 aa, Entamoeba dispar
NETYQGKITEYRNK

SEQ ID NO: 2446595 - protein, 10 aa, Entamoeba dispar
NETYQKKEKE

SEQ ID NO: 2446596 - protein, 6 aa, Entamoeba dispar
NEVAKV

SEQ ID NO: 2446597 - protein, 7 aa, Entamoeba dispar
NEVATDK

SEQ ID NO: 2446598 - protein, 8 aa, Entamoeba dispar
NEVEEERK

SEQ ID NO: 2446599 - protein, 8 aa, Entamoeba dispar
NEVESIST

SEQ ID NO: 2446600 - protein, 8 aa, Entamoeba dispar
NEVETVKD

SEQ ID NO: 2446601 - protein, 5 aa, Entamoeba dispar
NEVFS

SEQ ID NO: 2446602 - protein, 4 aa, Entamoeba dispar
NEVG

SEQ ID NO: 2446603 - protein, 8 aa, Entamoeba dispar
NEVGHKTS

SEQ ID NO: 2446604 - protein, 25 aa, Entamoeba dispar
NEVKAQEQAKEDKRKALQKKIETAG

SEQ ID NO: 2446605 - protein, 27 aa, Entamoeba dispar
NEVKSDAKAIKKYTQQFTGKDSSSAVK

SEQ ID NO: 2446606 - protein, 14 aa, Entamoeba dispar
NEVKTEEESHKKTI

SEQ ID NO: 2446607 - protein, 4 aa, Entamoeba dispar
NEVN

SEQ ID NO: 2446608 - protein, 18 aa, Entamoeba dispar
NEVNADEKLASEKEEISN

SEQ ID NO: 2446609 - protein, 10 aa, Entamoeba dispar
NEVNKYNEST

SEQ ID NO: 2446610 - protein, 7 aa, Entamoeba dispar
NEVNNNN

SEQ ID NO: 2446611 - protein, 7 aa, Entamoeba dispar
NEVQQSN

SEQ ID NO: 2446612 - protein, 7 aa, Entamoeba dispar
NEVRPTC

SEQ ID NO: 2446613 - protein, 9 aa, Entamoeba dispar
NEVSSSQVS

SEQ ID NO: 2446614 - protein, 7 aa, Entamoeba dispar
NEVSTDK

SEQ ID NO: 2446615 - protein, 9 aa, Entamoeba dispar
NEVSTTNNL

SEQ ID NO: 2446616 - protein, 4 aa, Entamoeba dispar
NEVT

SEQ ID NO: 2446617 - protein, 5 aa, Entamoeba dispar
NEVTE

SEQ ID NO: 2446618 - protein, 7 aa, Entamoeba dispar
NEVTSTR

SEQ ID NO: 2446619 - protein, 24 aa, Entamoeba dispar
NEVTTSEDDRESNNNTNSDSQISV

SEQ ID NO: 2446620 - protein, 11 aa, Entamoeba dispar
NEWDPDDPEWE

SEQ ID NO: 2446621 - protein, 4 aa, Entamoeba dispar
NEWE

SEQ ID NO: 2446622 - protein, 7 aa, Entamoeba dispar
NEWNPSS

SEQ ID NO: 2446623 - protein, 4 aa, Entamoeba dispar
NEYC

SEQ ID NO: 2446624 - protein, 4 aa, Entamoeba dispar
NEYD

SEQ ID NO: 2446625 - protein, 14 aa, Entamoeba dispar
NEYDKSAKEAEDCY

SEQ ID NO: 2446626 - protein, 6 aa, Entamoeba dispar
NEYENH

SEQ ID NO: 2446627 - protein, 6 aa, Entamoeba dispar
NEYERI

SEQ ID NO: 2446628 - protein, 6 aa, Entamoeba dispar
NEYGNS

SEQ ID NO: 2446629 - protein, 7 aa, Entamoeba dispar
NEYKAND

SEQ ID NO: 2446630 - protein, 6 aa, Entamoeba dispar
NEYKRN

SEQ ID NO: 2446631 - protein, 9 aa, Entamoeba dispar
NEYLNDSEK

SEQ ID NO: 2446632 - protein, 5 aa, Entamoeba dispar
NEYLQ

SEQ ID NO: 2446633 - protein, 5 aa, Entamoeba dispar
NEYNT

SEQ ID NO: 2446634 - protein, 7 aa, Entamoeba dispar
NEYPKSK

SEQ ID NO: 2446635 - protein, 10 aa, Entamoeba dispar
NEYPPELSQE

SEQ ID NO: 2446636 - protein, 5 aa, Entamoeba dispar
NEYQS

SEQ ID NO: 2446637 - protein, 4 aa, Entamoeba dispar
NEYR

SEQ ID NO: 2446638 - protein, 4 aa, Entamoeba dispar
NEYS

SEQ ID NO: 2446639 - protein, 11 aa, Entamoeba dispar
NEYSTTQLPEK

SEQ ID NO: 2446640 - protein, 6 aa, Entamoeba dispar
NEYSYE

SEQ ID NO: 2446641 - protein, 8 aa, Entamoeba dispar
NEYTKTAP

SEQ ID NO: 2446642 - protein, 7 aa, Entamoeba dispar
NEYTNQP

SEQ ID NO: 2446643 - protein, 8 aa, Entamoeba dispar
NEYYDKRP

SEQ ID NO: 2446644 - protein, 4 aa, Entamoeba dispar
NFDD

SEQ ID NO: 2446645 - protein, 20 aa, Entamoeba dispar
NFDDDHEEENGINDEIAEKT

SEQ ID NO: 2446646 - protein, 10 aa, Entamoeba dispar
NFDPTKITGI

SEQ ID NO: 2446647 - protein, 6 aa, Entamoeba dispar
NFDSIS

SEQ ID NO: 2446648 - protein, 9 aa, Entamoeba dispar
NFEDDEKET

SEQ ID NO: 2446649 - protein, 13 aa, Entamoeba dispar
NFEDIESNSEQID

SEQ ID NO: 2446650 - protein, 19 aa, Entamoeba dispar
NFEDSDEEKEKPKTSKKKI

SEQ ID NO: 2446651 - protein, 16 aa, Entamoeba dispar
NFEEEGKKKDKEIEDL

SEQ ID NO: 2446652 - protein, 4 aa, Entamoeba dispar
NFEG

SEQ ID NO: 2446653 - protein, 9 aa, Entamoeba dispar
NFEKTPPIP

SEQ ID NO: 2446654 - protein, 5 aa, Entamoeba dispar
NFEQK

SEQ ID NO: 2446655 - protein, 17 aa, Entamoeba dispar
NFEQQAKDKAAGDDEAQ

SEQ ID NO: 2446656 - protein, 9 aa, Entamoeba dispar
NFETEEKMK

SEQ ID NO: 2446657 - protein, 4 aa, Entamoeba dispar
NFGE

SEQ ID NO: 2446658 - protein, 5 aa, Entamoeba dispar
NFGGS

SEQ ID NO: 2446659 - protein, 9 aa, Entamoeba dispar
NFGGTSDGY

SEQ ID NO: 2446660 - protein, 11 aa, Entamoeba dispar
NFGKNDNLGST

SEQ ID NO: 2446661 - protein, 6 aa, Entamoeba dispar
NFGTIN

SEQ ID NO: 2446662 - protein, 36 aa, Entamoeba dispar
NFGTSSNVEKTSENEKGKKGNDKSTEQTNTTSTPFT

SEQ ID NO: 2446663 - protein, 9 aa, Entamoeba dispar
NFKEEGVSQ

SEQ ID NO: 2446664 - protein, 7 aa, Entamoeba dispar
NFKGSEE

SEQ ID NO: 2446665 - protein, 9 aa, Entamoeba dispar
NFKKKNTEW

SEQ ID NO: 2446666 - protein, 6 aa, Entamoeba dispar
NFKKQP

SEQ ID NO: 2446667 - protein, 12 aa, Entamoeba dispar
NFKNKKLQNDTS

SEQ ID NO: 2446668 - protein, 14 aa, Entamoeba dispar
NFKRRESLAFDLLN

SEQ ID NO: 2446669 - protein, 5 aa, Entamoeba dispar
NFKTK

SEQ ID NO: 2446670 - protein, 5 aa, Entamoeba dispar
NFNES

SEQ ID NO: 2446671 - protein, 8 aa, Entamoeba dispar
NFNPKSKD

SEQ ID NO: 2446672 - protein, 35 aa, Entamoeba dispar
NFNTTSPKGITTTRSSQYNSLNSNSAQLSIQSRST

SEQ ID NO: 2446673 - protein, 12 aa, Entamoeba dispar
NFNYSNKRKTLP

SEQ ID NO: 2446674 - protein, 7 aa, Entamoeba dispar
NFPESNG

SEQ ID NO: 2446675 - protein, 5 aa, Entamoeba dispar
NFPPQ

SEQ ID NO: 2446676 - protein, 15 aa, Entamoeba dispar
NFPQIDKEKVKEEVS

SEQ ID NO: 2446677 - protein, 4 aa, Entamoeba dispar
NFRN

SEQ ID NO: 2446678 - protein, 28 aa, Entamoeba dispar
NFRYQGKKDFKPYKKHQQESKPRPHQNK

SEQ ID NO: 2446679 - protein, 15 aa, Entamoeba dispar
NFSATGNFGFGIEEQ

SEQ ID NO: 2446680 - protein, 29 aa, Entamoeba dispar
NFSDESPQLPNETYVPSRSADNCIEPQKE

SEQ ID NO: 2446681 - protein, 10 aa, Entamoeba dispar
NFSEQRNTAR

SEQ ID NO: 2446682 - protein, 7 aa, Entamoeba dispar
NFSKTKQ

SEQ ID NO: 2446683 - protein, 5 aa, Entamoeba dispar
NFSNS

SEQ ID NO: 2446684 - protein, 10 aa, Entamoeba dispar
NFSPEKCKSI

SEQ ID NO: 2446685 - protein, 6 aa, Entamoeba dispar
NFSQNS

SEQ ID NO: 2446686 - protein, 16 aa, Entamoeba dispar
NFSSEQRDATAAAAEI

SEQ ID NO: 2446687 - protein, 8 aa, Entamoeba dispar
NFSSNDEV

SEQ ID NO: 2446688 - protein, 11 aa, Entamoeba dispar
NFSSQQEQTPI

SEQ ID NO: 2446689 - protein, 8 aa, Entamoeba dispar
NFSSQQSI

SEQ ID NO: 2446690 - protein, 10 aa, Entamoeba dispar
NFSTRSKITQ

SEQ ID NO: 2446691 - protein, 5 aa, Entamoeba dispar
NFTDS

SEQ ID NO: 2446692 - protein, 6 aa, Entamoeba dispar
NFTESE

SEQ ID NO: 2446693 - protein, 12 aa, Entamoeba dispar
NFTEYSKEGNTI

SEQ ID NO: 2446694 - protein, 10 aa, Entamoeba dispar
NFTSNTRGSL

SEQ ID NO: 2446695 - protein, 12 aa, Entamoeba dispar
NFTTEIDEEKEQ

SEQ ID NO: 2446696 - protein, 13 aa, Entamoeba dispar
NFTTSYDDNSYYE

SEQ ID NO: 2446697 - protein, 6 aa, Entamoeba dispar
NFVSGD

SEQ ID NO: 2446698 - protein, 5 aa, Entamoeba dispar
NFYGT

SEQ ID NO: 2446699 - protein, 5 aa, Entamoeba dispar
NGAER

SEQ ID NO: 2446700 - protein, 8 aa, Entamoeba dispar
NGAGKTSI

SEQ ID NO: 2446701 - protein, 15 aa, Entamoeba dispar
NGAGQVTIKKNNKSN

SEQ ID NO: 2446702 - protein, 9 aa, Entamoeba dispar
NGAIDTNHQ

SEQ ID NO: 2446703 - protein, 9 aa, Entamoeba dispar
NGALDKPEK

SEQ ID NO: 2446704 - protein, 7 aa, Entamoeba dispar
NGALSLQ

SEQ ID NO: 2446705 - protein, 8 aa, Entamoeba dispar
NGANKSGG

SEQ ID NO: 2446706 - protein, 4 aa, Entamoeba dispar
NGAS

SEQ ID NO: 2446707 - protein, 18 aa, Entamoeba dispar
NGASRIGASAGIAILNGI

SEQ ID NO: 2446708 - protein, 6 aa, Entamoeba dispar
NGATFK

SEQ ID NO: 2446709 - protein, 5 aa, Entamoeba dispar
NGCDS

SEQ ID NO: 2446710 - protein, 4 aa, Entamoeba dispar
NGCK

SEQ ID NO: 2446711 - protein, 4 aa, Entamoeba dispar
NGCL

SEQ ID NO: 2446712 - protein, 5 aa, Entamoeba dispar
NGCNK

SEQ ID NO: 2446713 - protein, 10 aa, Entamoeba dispar
NGDEDLIPNY

SEQ ID NO: 2446714 - protein, 5 aa, Entamoeba dispar
NGDEK

SEQ ID NO: 2446715 - protein, 7 aa, Entamoeba dispar
NGDEVKE

SEQ ID NO: 2446716 - protein, 9 aa, Entamoeba dispar
NGDGAVSYE

SEQ ID NO: 2446717 - protein, 16 aa, Entamoeba dispar
NGDGEKGTGKKHGGIW

SEQ ID NO: 2446718 - protein, 5 aa, Entamoeba dispar
NGDGS

SEQ ID NO: 2446719 - protein, 9 aa, Entamoeba dispar
NGDGSVSYE

SEQ ID NO: 2446720 - protein, 5 aa, Entamoeba dispar
NGDHH

SEQ ID NO: 2446721 - protein, 4 aa, Entamoeba dispar
NGDI

SEQ ID NO: 2446722 - protein, 27 aa, Entamoeba dispar
NGDINTQPVYTPNDQSMINESNQRINE

SEQ ID NO: 2446723 - protein, 9 aa, Entamoeba dispar
NGDKSIEKE

SEQ ID NO: 2446724 - protein, 7 aa, Entamoeba dispar
NGDLETS

SEQ ID NO: 2446725 - protein, 13 aa, Entamoeba dispar
NGDLNNEENELEE

SEQ ID NO: 2446726 - protein, 9 aa, Entamoeba dispar
NGDNEQRQT

SEQ ID NO: 2446727 - protein, 12 aa, Entamoeba dispar
NGDPNGKDDEFE

SEQ ID NO: 2446728 - protein, 8 aa, Entamoeba dispar
NGDPNGVT

SEQ ID NO: 2446729 - protein, 10 aa, Entamoeba dispar
NGDSANDEFT

SEQ ID NO: 2446730 - protein, 6 aa, Entamoeba dispar
NGDTET

SEQ ID NO: 2446731 - protein, 8 aa, Entamoeba dispar
NGDVPSKL

SEQ ID NO: 2446732 - protein, 5 aa, Entamoeba dispar
NGDVR

SEQ ID NO: 2446733 - protein, 6 aa, Entamoeba dispar
NGDWKV

SEQ ID NO: 2446734 - protein, 9 aa, Entamoeba dispar
NGDYKGAFE

SEQ ID NO: 2446735 - protein, 7 aa, Entamoeba dispar
NGDYSGA

SEQ ID NO: 2446736 - protein, 8 aa, Entamoeba dispar
NGEAEAEN

SEQ ID NO: 2446737 - protein, 5 aa, Entamoeba dispar
NGEDL

SEQ ID NO: 2446738 - protein, 5 aa, Entamoeba dispar
NGEEC

SEQ ID NO: 2446739 - protein, 5 aa, Entamoeba dispar
NGEEI

SEQ ID NO: 2446740 - protein, 7 aa, Entamoeba dispar
NGEFTET

SEQ ID NO: 2446741 - protein, 7 aa, Entamoeba dispar
NGEGYFS

SEQ ID NO: 2446742 - protein, 8 aa, Entamoeba dispar
NGEGYKFN

SEQ ID NO: 2446743 - protein, 6 aa, Entamoeba dispar
NGEHNG

SEQ ID NO: 2446744 - protein, 4 aa, Entamoeba dispar
NGEI

SEQ ID NO: 2446745 - protein, 6 aa, Entamoeba dispar
NGEIEE

SEQ ID NO: 2446746 - protein, 12 aa, Entamoeba dispar
NGEIKTSLQGFS

SEQ ID NO: 2446747 - protein, 5 aa, Entamoeba dispar
NGEIS

SEQ ID NO: 2446748 - protein, 10 aa, Entamoeba dispar
NGEKKTNDDI

SEQ ID NO: 2446749 - protein, 6 aa, Entamoeba dispar
NGEKSI

SEQ ID NO: 2446750 - protein, 6 aa, Entamoeba dispar
NGEKTR

SEQ ID NO: 2446751 - protein, 5 aa, Entamoeba dispar
NGEKV

SEQ ID NO: 2446752 - protein, 16 aa, Entamoeba dispar
NGELFSSEKKQFDEET

SEQ ID NO: 2446753 - protein, 5 aa, Entamoeba dispar
NGENE

SEQ ID NO: 2446754 - protein, 6 aa, Entamoeba dispar
NGENHE

SEQ ID NO: 2446755 - protein, 5 aa, Entamoeba dispar
NGENI

SEQ ID NO: 2446756 - protein, 10 aa, Entamoeba dispar
NGENIEKKDI

SEQ ID NO: 2446757 - protein, 11 aa, Entamoeba dispar
NGENQENENYE

SEQ ID NO: 2446758 - protein, 9 aa, Entamoeba dispar
NGENTMKST

SEQ ID NO: 2446759 - protein, 4 aa, Entamoeba dispar
NGEP

SEQ ID NO: 2446760 - protein, 6 aa, Entamoeba dispar
NGEPKP

SEQ ID NO: 2446761 - protein, 13 aa, Entamoeba dispar
NGEQISIPSNTHT

SEQ ID NO: 2446762 - protein, 8 aa, Entamoeba dispar
NGEQPKEV

SEQ ID NO: 2446763 - protein, 5 aa, Entamoeba dispar
NGEQS

SEQ ID NO: 2446764 - protein, 5 aa, Entamoeba dispar
NGEQV

SEQ ID NO: 2446765 - protein, 5 aa, Entamoeba dispar
NGERA

SEQ ID NO: 2446766 - protein, 11 aa, Entamoeba dispar
NGERASLESPQ

SEQ ID NO: 2446767 - protein, 5 aa, Entamoeba dispar
NGERS

SEQ ID NO: 2446768 - protein, 5 aa, Entamoeba dispar
NGERT

SEQ ID NO: 2446769 - protein, 7 aa, Entamoeba dispar
NGESEIS

SEQ ID NO: 2446770 - protein, 11 aa, Entamoeba dispar
NGESMKDGSPI

SEQ ID NO: 2446771 - protein, 10 aa, Entamoeba dispar
NGESSALNET

SEQ ID NO: 2446772 - protein, 7 aa, Entamoeba dispar
NGESVSV

SEQ ID NO: 2446773 - protein, 7 aa, Entamoeba dispar
NGETGRA

SEQ ID NO: 2446774 - protein, 27 aa, Entamoeba dispar
NGETRDDLKLPEGEMGQKIQADYDDGK

SEQ ID NO: 2446775 - protein, 6 aa, Entamoeba dispar
NGETYK

SEQ ID NO: 2446776 - protein, 5 aa, Entamoeba dispar
NGEVA

SEQ ID NO: 2446777 - protein, 32 aa, Entamoeba dispar
NGEVKIQDESKKKVSKEKKGQQGDEEETNTNP

SEQ ID NO: 2446778 - protein, 12 aa, Entamoeba dispar
NGEVVNQEENIG

SEQ ID NO: 2446779 - protein, 13 aa, Entamoeba dispar
NGEVVNQEENIGT

SEQ ID NO: 2446780 - protein, 5 aa, Entamoeba dispar
NGFNA

SEQ ID NO: 2446781 - protein, 35 aa, Entamoeba dispar
NGFNKQGIRSNRDKRAKQVKNADLDTVTDEGIEEA

SEQ ID NO: 2446782 - protein, 12 aa, Entamoeba dispar
NGFSMSEGKLGK

SEQ ID NO: 2446783 - protein, 5 aa, Entamoeba dispar
NGFSV

SEQ ID NO: 2446784 - protein, 8 aa, Entamoeba dispar
NGFTSRRE

SEQ ID NO: 2446785 - protein, 4 aa, Entamoeba dispar
NGGA

SEQ ID NO: 2446786 - protein, 19 aa, Entamoeba dispar
NGGAGNNWGKGHYSEGSSL

SEQ ID NO: 2446787 - protein, 5 aa, Entamoeba dispar
NGGAY

SEQ ID NO: 2446788 - protein, 4 aa, Entamoeba dispar
NGGE

SEQ ID NO: 2446789 - protein, 10 aa, Entamoeba dispar
NGGEKTTTLY

SEQ ID NO: 2446790 - protein, 7 aa, Entamoeba dispar
NGGHSGV

SEQ ID NO: 2446791 - protein, 4 aa, Entamoeba dispar
NGGK

SEQ ID NO: 2446792 - protein, 6 aa, Entamoeba dispar
NGGKDW

SEQ ID NO: 2446793 - protein, 6 aa, Entamoeba dispar
NGGNIN

SEQ ID NO: 2446794 - protein, 12 aa, Entamoeba dispar
NGGNKIRNENPK

SEQ ID NO: 2446795 - protein, 5 aa, Entamoeba dispar
NGGPN

SEQ ID NO: 2446796 - protein, 10 aa, Entamoeba dispar
NGGSKLPTKM

SEQ ID NO: 2446797 - protein, 6 aa, Entamoeba dispar
NGGSYK

SEQ ID NO: 2446798 - protein, 6 aa, Entamoeba dispar
NGGTGL

SEQ ID NO: 2446799 - protein, 7 aa, Entamoeba dispar
NGGTGNV

SEQ ID NO: 2446800 - protein, 5 aa, Entamoeba dispar
NGGVN

SEQ ID NO: 2446801 - protein, 5 aa, Entamoeba dispar
NGGYA

SEQ ID NO: 2446802 - protein, 12 aa, Entamoeba dispar
NGHAQKHSLKRG

SEQ ID NO: 2446803 - protein, 12 aa, Entamoeba dispar
NGHEICDDKSNR

SEQ ID NO: 2446804 - protein, 5 aa, Entamoeba dispar
NGHGS

SEQ ID NO: 2446805 - protein, 7 aa, Entamoeba dispar
NGHPNAI

SEQ ID NO: 2446806 - protein, 4 aa, Entamoeba dispar
NGHQ

SEQ ID NO: 2446807 - protein, 4 aa, Entamoeba dispar
NGID

SEQ ID NO: 2446808 - protein, 5 aa, Entamoeba dispar
NGIDT

SEQ ID NO: 2446809 - protein, 8 aa, Entamoeba dispar
NGIDTDTP

SEQ ID NO: 2446810 - protein, 15 aa, Entamoeba dispar
NGIEKVESKLEDCNT

SEQ ID NO: 2446811 - protein, 8 aa, Entamoeba dispar
NGIESDEK

SEQ ID NO: 2446812 - protein, 5 aa, Entamoeba dispar
NGIGK

SEQ ID NO: 2446813 - protein, 8 aa, Entamoeba dispar
NGIGSSQD

SEQ ID NO: 2446814 - protein, 8 aa, Entamoeba dispar
NGIGTDAS

SEQ ID NO: 2446815 - protein, 8 aa, Entamoeba dispar
NGIGTDAT

SEQ ID NO: 2446816 - protein, 4 aa, Entamoeba dispar
NGII

SEQ ID NO: 2446817 - protein, 6 aa, Entamoeba dispar
NGIKTY

SEQ ID NO: 2446818 - protein, 6 aa, Entamoeba dispar
NGINAN

SEQ ID NO: 2446819 - protein, 6 aa, Entamoeba dispar
NGINNG

SEQ ID NO: 2446820 - protein, 4 aa, Entamoeba dispar
NGIP

SEQ ID NO: 2446821 - protein, 5 aa, Entamoeba dispar
NGIPA

SEQ ID NO: 2446822 - protein, 8 aa, Entamoeba dispar
NGIPESEI

SEQ ID NO: 2446823 - protein, 7 aa, Entamoeba dispar
NGIPPDT

SEQ ID NO: 2446824 - protein, 7 aa, Entamoeba dispar
NGIPQGG

SEQ ID NO: 2446825 - protein, 12 aa, Entamoeba dispar
NGIPTAKRGEQK

SEQ ID NO: 2446826 - protein, 5 aa, Entamoeba dispar
NGIRS

SEQ ID NO: 2446827 - protein, 17 aa, Entamoeba dispar
NGISEKTARRRSESNKR

SEQ ID NO: 2446828 - protein, 6 aa, Entamoeba dispar
NGISNS

SEQ ID NO: 2446829 - protein, 7 aa, Entamoeba dispar
NGISTER

SEQ ID NO: 2446830 - protein, 6 aa, Entamoeba dispar
NGITNE

SEQ ID NO: 2446831 - protein, 7 aa, Entamoeba dispar
NGITNEE

SEQ ID NO: 2446832 - protein, 6 aa, Entamoeba dispar
NGITPQ

SEQ ID NO: 2446833 - protein, 6 aa, Entamoeba dispar
NGITTD

SEQ ID NO: 2446834 - protein, 21 aa, Entamoeba dispar
NGKDEEEEEGNKKKKSGGCIF

SEQ ID NO: 2446835 - protein, 7 aa, Entamoeba dispar
NGKDENE

SEQ ID NO: 2446836 - protein, 6 aa, Entamoeba dispar
NGKDNT

SEQ ID NO: 2446837 - protein, 8 aa, Entamoeba dispar
NGKEDIEK

SEQ ID NO: 2446838 - protein, 24 aa, Entamoeba dispar
NGKEELRNTVEREKNEVNKSIGEV

SEQ ID NO: 2446839 - protein, 6 aa, Entamoeba dispar
NGKEEY

SEQ ID NO: 2446840 - protein, 5 aa, Entamoeba dispar
NGKEF

SEQ ID NO: 2446841 - protein, 9 aa, Entamoeba dispar
NGKEIERRD

SEQ ID NO: 2446842 - protein, 10 aa, Entamoeba dispar
NGKESDDQLS

SEQ ID NO: 2446843 - protein, 19 aa, Entamoeba dispar
NGKEYKTTHDNNTSEPKWE

SEQ ID NO: 2446844 - protein, 4 aa, Entamoeba dispar
NGKF

SEQ ID NO: 2446845 - protein, 5 aa, Entamoeba dispar
NGKFT

SEQ ID NO: 2446846 - protein, 8 aa, Entamoeba dispar
NGKGIGCG

SEQ ID NO: 2446847 - protein, 4 aa, Entamoeba dispar
NGKH

SEQ ID NO: 2446848 - protein, 10 aa, Entamoeba dispar
NGKISGGGAI

SEQ ID NO: 2446849 - protein, 9 aa, Entamoeba dispar
NGKKIKNSI

SEQ ID NO: 2446850 - protein, 8 aa, Entamoeba dispar
NGKKKTNY

SEQ ID NO: 2446851 - protein, 10 aa, Entamoeba dispar
NGKKRRNSLS

SEQ ID NO: 2446852 - protein, 9 aa, Entamoeba dispar
NGKKTPKQV

SEQ ID NO: 2446853 - protein, 4 aa, Entamoeba dispar
NGKL

SEQ ID NO: 2446854 - protein, 5 aa, Entamoeba dispar
NGKLI

SEQ ID NO: 2446855 - protein, 20 aa, Entamoeba dispar
NGKLLKSKESKDVDQKYSNS

SEQ ID NO: 2446856 - protein, 12 aa, Entamoeba dispar
NGKMNATATVRT

SEQ ID NO: 2446857 - protein, 5 aa, Entamoeba dispar
NGKNI

SEQ ID NO: 2446858 - protein, 10 aa, Entamoeba dispar
NGKNIEKKDI

SEQ ID NO: 2446859 - protein, 5 aa, Entamoeba dispar
NGKNS

SEQ ID NO: 2446860 - protein, 7 aa, Entamoeba dispar
NGKPVFS

SEQ ID NO: 2446861 - protein, 9 aa, Entamoeba dispar
NGKQKECKK

SEQ ID NO: 2446862 - protein, 8 aa, Entamoeba dispar
NGKRIPLK

SEQ ID NO: 2446863 - protein, 8 aa, Entamoeba dispar
NGKRTNDC

SEQ ID NO: 2446864 - protein, 5 aa, Entamoeba dispar
NGKRV

SEQ ID NO: 2446865 - protein, 16 aa, Entamoeba dispar
NGKSNIQSSEKRRKEL

SEQ ID NO: 2446866 - protein, 5 aa, Entamoeba dispar
NGKTM

SEQ ID NO: 2446867 - protein, 12 aa, Entamoeba dispar
NGKTTPISCSTP

SEQ ID NO: 2446868 - protein, 4 aa, Entamoeba dispar
NGKY

SEQ ID NO: 2446869 - protein, 5 aa, Entamoeba dispar
NGKYP

SEQ ID NO: 2446870 - protein, 11 aa, Entamoeba dispar
NGLDDDNGRKF

SEQ ID NO: 2446871 - protein, 37 aa, Entamoeba dispar
NGLEQNEKSTMKNNTTEEKEDDENESLNQEEQTEHYA

SEQ ID NO: 2446872 - protein, 11 aa, Entamoeba dispar
NGLIEEGQATT

SEQ ID NO: 2446873 - protein, 9 aa, Entamoeba dispar
NGLKANEND

SEQ ID NO: 2446874 - protein, 9 aa, Entamoeba dispar
NGLKNEEEF

SEQ ID NO: 2446875 - protein, 23 aa, Entamoeba dispar
NGLKPVPETRQRNTRLKERRQVQ

SEQ ID NO: 2446876 - protein, 10 aa, Entamoeba dispar
NGLKRTVATK

SEQ ID NO: 2446877 - protein, 21 aa, Entamoeba dispar
NGLKTSDIKKAMDDHPTIHFV

SEQ ID NO: 2446878 - protein, 27 aa, Entamoeba dispar
NGLPEQRDTIDKTTTCLETKDNEVLSN

SEQ ID NO: 2446879 - protein, 12 aa, Entamoeba dispar
NGLREKKRDEML

SEQ ID NO: 2446880 - protein, 15 aa, Entamoeba dispar
NGLRGDTFAQVLEGR

SEQ ID NO: 2446881 - protein, 6 aa, Entamoeba dispar
NGLSEG

SEQ ID NO: 2446882 - protein, 6 aa, Entamoeba dispar
NGLSEK

SEQ ID NO: 2446883 - protein, 9 aa, Entamoeba dispar
NGLSQSEDI

SEQ ID NO: 2446884 - protein, 6 aa, Entamoeba dispar
NGLSQY

SEQ ID NO: 2446885 - protein, 9 aa, Entamoeba dispar
NGLSSLGNG

SEQ ID NO: 2446886 - protein, 7 aa, Entamoeba dispar
NGLTDNE

SEQ ID NO: 2446887 - protein, 6 aa, Entamoeba dispar
NGMEGV

SEQ ID NO: 2446888 - protein, 5 aa, Entamoeba dispar
NGMKK

SEQ ID NO: 2446889 - protein, 14 aa, Entamoeba dispar
NGMKTHSNDVMEQT

SEQ ID NO: 2446890 - protein, 13 aa, Entamoeba dispar
NGMNNGDTSTKDF

SEQ ID NO: 2446891 - protein, 11 aa, Entamoeba dispar
NGMTDGTEKRK

SEQ ID NO: 2446892 - protein, 12 aa, Entamoeba dispar
NGMTDGTKKRKD

SEQ ID NO: 2446893 - protein, 10 aa, Entamoeba dispar
NGNATRSQLE

SEQ ID NO: 2446894 - protein, 13 aa, Entamoeba dispar
NGNCADDFEKGND

SEQ ID NO: 2446895 - protein, 8 aa, Entamoeba dispar
NGNDAQHA

SEQ ID NO: 2446896 - protein, 12 aa, Entamoeba dispar
NGNDENFTDEDG

SEQ ID NO: 2446897 - protein, 9 aa, Entamoeba dispar
NGNDETSFR

SEQ ID NO: 2446898 - protein, 7 aa, Entamoeba dispar
NGNELAN

SEQ ID NO: 2446899 - protein, 12 aa, Entamoeba dispar
NGNELQKRKPAE

SEQ ID NO: 2446900 - protein, 6 aa, Entamoeba dispar
NGNENI

SEQ ID NO: 2446901 - protein, 5 aa, Entamoeba dispar
NGNFE

SEQ ID NO: 2446902 - protein, 9 aa, Entamoeba dispar
NGNHEGHDY

SEQ ID NO: 2446903 - protein, 7 aa, Entamoeba dispar
NGNIENQ

SEQ ID NO: 2446904 - protein, 8 aa, Entamoeba dispar
NGNISSSS

SEQ ID NO: 2446905 - protein, 11 aa, Entamoeba dispar
NGNKEDEDDEL

SEQ ID NO: 2446906 - protein, 8 aa, Entamoeba dispar
NGNKNHIR

SEQ ID NO: 2446907 - protein, 9 aa, Entamoeba dispar
NGNKTTLSI

SEQ ID NO: 2446908 - protein, 10 aa, Entamoeba dispar
NGNLSGQKIG

SEQ ID NO: 2446909 - protein, 4 aa, Entamoeba dispar
NGNM

SEQ ID NO: 2446910 - protein, 4 aa, Entamoeba dispar
NGNN

SEQ ID NO: 2446911 - protein, 6 aa, Entamoeba dispar
NGNNAQ

SEQ ID NO: 2446912 - protein, 12 aa, Entamoeba dispar
NGNNELGGNNFD

SEQ ID NO: 2446913 - protein, 17 aa, Entamoeba dispar
NGNNKEQENVTLTEKQK

SEQ ID NO: 2446914 - protein, 6 aa, Entamoeba dispar
NGNNNK

SEQ ID NO: 2446915 - protein, 7 aa, Entamoeba dispar
NGNNNKI

SEQ ID NO: 2446916 - protein, 5 aa, Entamoeba dispar
NGNNV

SEQ ID NO: 2446917 - protein, 9 aa, Entamoeba dispar
NGNNYSQYN

SEQ ID NO: 2446918 - protein, 16 aa, Entamoeba dispar
NGNPKTKRKLNKNSYL

SEQ ID NO: 2446919 - protein, 5 aa, Entamoeba dispar
NGNPL

SEQ ID NO: 2446920 - protein, 5 aa, Entamoeba dispar
NGNPV

SEQ ID NO: 2446921 - protein, 4 aa, Entamoeba dispar
NGNQ

SEQ ID NO: 2446922 - protein, 12 aa, Entamoeba dispar
NGNRVSRTATWT

SEQ ID NO: 2446923 - protein, 4 aa, Entamoeba dispar
NGNT

SEQ ID NO: 2446924 - protein, 4 aa, Entamoeba dispar
NGNY

SEQ ID NO: 2446925 - protein, 6 aa, Entamoeba dispar
NGNYKE

SEQ ID NO: 2446926 - protein, 5 aa, Entamoeba dispar
NGNYP

SEQ ID NO: 2446927 - protein, 14 aa, Entamoeba dispar
NGNYRSVPLSNQEV

SEQ ID NO: 2446928 - protein, 13 aa, Entamoeba dispar
NGNYSGQPNVFGA

SEQ ID NO: 2446929 - protein, 7 aa, Entamoeba dispar
NGNYTYQ

SEQ ID NO: 2446930 - protein, 6 aa, Entamoeba dispar
NGPFND

SEQ ID NO: 2446931 - protein, 6 aa, Entamoeba dispar
NGPKLD

SEQ ID NO: 2446932 - protein, 6 aa, Entamoeba dispar
NGPLSQ

SEQ ID NO: 2446933 - protein, 5 aa, Entamoeba dispar
NGPLT

SEQ ID NO: 2446934 - protein, 7 aa, Entamoeba dispar
NGPPTIV

SEQ ID NO: 2446935 - protein, 10 aa, Entamoeba dispar
NGPQHNENDI

SEQ ID NO: 2446936 - protein, 8 aa, Entamoeba dispar
NGPQLDKD

SEQ ID NO: 2446937 - protein, 7 aa, Entamoeba dispar
NGPSCSH

SEQ ID NO: 2446938 - protein, 5 aa, Entamoeba dispar
NGPTL

SEQ ID NO: 2446939 - protein, 5 aa, Entamoeba dispar
NGPVY

SEQ ID NO: 2446940 - protein, 7 aa, Entamoeba dispar
NGPYVGL

SEQ ID NO: 2446941 - protein, 5 aa, Entamoeba dispar
NGQCS

SEQ ID NO: 2446942 - protein, 5 aa, Entamoeba dispar
NGQEE

SEQ ID NO: 2446943 - protein, 16 aa, Entamoeba dispar
NGQEVPKSNIRGGKNS

SEQ ID NO: 2446944 - protein, 6 aa, Entamoeba dispar
NGQFNK

SEQ ID NO: 2446945 - protein, 17 aa, Entamoeba dispar
NGQGFKPTISKNEMSEE

SEQ ID NO: 2446946 - protein, 7 aa, Entamoeba dispar
NGQKPRK

SEQ ID NO: 2446947 - protein, 5 aa, Entamoeba dispar
NGQNY

SEQ ID NO: 2446948 - protein, 19 aa, Entamoeba dispar
NGQQKRRTRKVDDITPELS

SEQ ID NO: 2446949 - protein, 5 aa, Entamoeba dispar
NGQRV

SEQ ID NO: 2446950 - protein, 6 aa, Entamoeba dispar
NGQSIR

SEQ ID NO: 2446951 - protein, 11 aa, Entamoeba dispar
NGQSYNEKTDI

SEQ ID NO: 2446952 - protein, 4 aa, Entamoeba dispar
NGQT

SEQ ID NO: 2446953 - protein, 6 aa, Entamoeba dispar
NGQTAE

SEQ ID NO: 2446954 - protein, 14 aa, Entamoeba dispar
NGQTGQFPSNYVTL

SEQ ID NO: 2446955 - protein, 9 aa, Entamoeba dispar
NGQTPPPVT

SEQ ID NO: 2446956 - protein, 19 aa, Entamoeba dispar
NGQYQQMSGRAGRKGFDDY

SEQ ID NO: 2446957 - protein, 4 aa, Entamoeba dispar
NGRF

SEQ ID NO: 2446958 - protein, 8 aa, Entamoeba dispar
NGRFNSPT

SEQ ID NO: 2446959 - protein, 4 aa, Entamoeba dispar
NGRI

SEQ ID NO: 2446960 - protein, 12 aa, Entamoeba dispar
NGRIDSNPKFAS

SEQ ID NO: 2446961 - protein, 5 aa, Entamoeba dispar
NGRIT

SEQ ID NO: 2446962 - protein, 11 aa, Entamoeba dispar
NGRKEQEKNNK

SEQ ID NO: 2446963 - protein, 22 aa, Entamoeba dispar
NGRLNRKEKVEYEPINEQETQK

SEQ ID NO: 2446964 - protein, 9 aa, Entamoeba dispar
NGRLQDPQK

SEQ ID NO: 2446965 - protein, 15 aa, Entamoeba dispar
NGRNQGGNIRSTQRV

SEQ ID NO: 2446966 - protein, 6 aa, Entamoeba dispar
NGRPQV

SEQ ID NO: 2446967 - protein, 9 aa, Entamoeba dispar
NGRSPNAVK

SEQ ID NO: 2446968 - protein, 6 aa, Entamoeba dispar
NGRSRR

SEQ ID NO: 2446969 - protein, 4 aa, Entamoeba dispar
NGRT

SEQ ID NO: 2446970 - protein, 6 aa, Entamoeba dispar
NGRTNK

SEQ ID NO: 2446971 - protein, 10 aa, Entamoeba dispar
NGRTTNNSML

SEQ ID NO: 2446972 - protein, 8 aa, Entamoeba dispar
NGRTYQKR

SEQ ID NO: 2446973 - protein, 8 aa, Entamoeba dispar
NGRVNGNL

SEQ ID NO: 2446974 - protein, 7 aa, Entamoeba dispar
NGRYKIK

SEQ ID NO: 2446975 - protein, 7 aa, Entamoeba dispar
NGSAPAT

SEQ ID NO: 2446976 - protein, 6 aa, Entamoeba dispar
NGSDAY

SEQ ID NO: 2446977 - protein, 12 aa, Entamoeba dispar
NGSDTQLKTQAS

SEQ ID NO: 2446978 - protein, 5 aa, Entamoeba dispar
NGSER

SEQ ID NO: 2446979 - protein, 7 aa, Entamoeba dispar
NGSFYTS

SEQ ID NO: 2446980 - protein, 10 aa, Entamoeba dispar
NGSGSQNECS

SEQ ID NO: 2446981 - protein, 8 aa, Entamoeba dispar
NGSGSSEY

SEQ ID NO: 2446982 - protein, 4 aa, Entamoeba dispar
NGSI

SEQ ID NO: 2446983 - protein, 5 aa, Entamoeba dispar
NGSIT

SEQ ID NO: 2446984 - protein, 11 aa, Entamoeba dispar
NGSKKKITRAW

SEQ ID NO: 2446985 - protein, 12 aa, Entamoeba dispar
NGSKMSQNPYPF

SEQ ID NO: 2446986 - protein, 5 aa, Entamoeba dispar
NGSLG

SEQ ID NO: 2446987 - protein, 4 aa, Entamoeba dispar
NGSM

SEQ ID NO: 2446988 - protein, 6 aa, Entamoeba dispar
NGSNFA

SEQ ID NO: 2446989 - protein, 8 aa, Entamoeba dispar
NGSNIKKN

SEQ ID NO: 2446990 - protein, 7 aa, Entamoeba dispar
NGSNQNV

SEQ ID NO: 2446991 - protein, 9 aa, Entamoeba dispar
NGSNRIDET

SEQ ID NO: 2446992 - protein, 6 aa, Entamoeba dispar
NGSNVD

SEQ ID NO: 2446993 - protein, 7 aa, Entamoeba dispar
NGSPFTA

SEQ ID NO: 2446994 - protein, 8 aa, Entamoeba dispar
NGSPQNTL

SEQ ID NO: 2446995 - protein, 10 aa, Entamoeba dispar
NGSQSISETS

SEQ ID NO: 2446996 - protein, 8 aa, Entamoeba dispar
NGSRVTPR

SEQ ID NO: 2446997 - protein, 6 aa, Entamoeba dispar
NGSSDY

SEQ ID NO: 2446998 - protein, 21 aa, Entamoeba dispar
NGSSGIQTKECPSSYLQVSLS

SEQ ID NO: 2446999 - protein, 5 aa, Entamoeba dispar
NGSSI

SEQ ID NO: 2447000 - protein, 6 aa, Entamoeba dispar
NGSSQC

SEQ ID NO: 2447001 - protein, 8 aa, Entamoeba dispar
NGSSVIPK

SEQ ID NO: 2447002 - protein, 8 aa, Entamoeba dispar
NGSSYKRI

SEQ ID NO: 2447003 - protein, 13 aa, Entamoeba dispar
NGSTLRCSWGRES

SEQ ID NO: 2447004 - protein, 9 aa, Entamoeba dispar
NGSTNKVNE

SEQ ID NO: 2447005 - protein, 6 aa, Entamoeba dispar
NGSTWN

SEQ ID NO: 2447006 - protein, 17 aa, Entamoeba dispar
NGSVEIGSSGRGDNFDG

SEQ ID NO: 2447007 - protein, 99 aa, Entamoeba dispar
NGSVNENTPLNKETKNQKPVQQQNNDQTYQGVENKTTTTTTTETVPSNKQETKPTETTSTEKPIENKPAEGTHVPKPKGDAPVIEDRPNGKKEVVSGDK

SEQ ID NO: 2447008 - protein, 6 aa, Entamoeba dispar
NGTCDS

SEQ ID NO: 2447009 - protein, 4 aa, Entamoeba dispar
NGTD

SEQ ID NO: 2447010 - protein, 8 aa, Entamoeba dispar
NGTDSLGI

SEQ ID NO: 2447011 - protein, 4 aa, Entamoeba dispar
NGTE

SEQ ID NO: 2447012 - protein, 6 aa, Entamoeba dispar
NGTEKN

SEQ ID NO: 2447013 - protein, 5 aa, Entamoeba dispar
NGTEQ

SEQ ID NO: 2447014 - protein, 13 aa, Entamoeba dispar
NGTESSVIIFEPN

SEQ ID NO: 2447015 - protein, 6 aa, Entamoeba dispar
NGTETY

SEQ ID NO: 2447016 - protein, 8 aa, Entamoeba dispar
NGTGDGKV

SEQ ID NO: 2447017 - protein, 6 aa, Entamoeba dispar
NGTGYS

SEQ ID NO: 2447018 - protein, 4 aa, Entamoeba dispar
NGTI

SEQ ID NO: 2447019 - protein, 5 aa, Entamoeba dispar
NGTIK

SEQ ID NO: 2447020 - protein, 7 aa, Entamoeba dispar
NGTKRVN

SEQ ID NO: 2447021 - protein, 5 aa, Entamoeba dispar
NGTLG

SEQ ID NO: 2447022 - protein, 7 aa, Entamoeba dispar
NGTLPHE

SEQ ID NO: 2447023 - protein, 7 aa, Entamoeba dispar
NGTMSNT

SEQ ID NO: 2447024 - protein, 9 aa, Entamoeba dispar
NGTNEEEEK

SEQ ID NO: 2447025 - protein, 10 aa, Entamoeba dispar
NGTNETQEKL

SEQ ID NO: 2447026 - protein, 5 aa, Entamoeba dispar
NGTNY

SEQ ID NO: 2447027 - protein, 6 aa, Entamoeba dispar
NGTPER

SEQ ID NO: 2447028 - protein, 14 aa, Entamoeba dispar
NGTPRQGLLSPTTR

SEQ ID NO: 2447029 - protein, 5 aa, Entamoeba dispar
NGTPV

SEQ ID NO: 2447030 - protein, 9 aa, Entamoeba dispar
NGTPYDGSK

SEQ ID NO: 2447031 - protein, 5 aa, Entamoeba dispar
NGTRK

SEQ ID NO: 2447032 - protein, 7 aa, Entamoeba dispar
NGTRPDV

SEQ ID NO: 2447033 - protein, 8 aa, Entamoeba dispar
NGTSKEIE

SEQ ID NO: 2447034 - protein, 16 aa, Entamoeba dispar
NGTSPTLPSQFDTKNW

SEQ ID NO: 2447035 - protein, 7 aa, Entamoeba dispar
NGTTELN

SEQ ID NO: 2447036 - protein, 8 aa, Entamoeba dispar
NGTTIKER

SEQ ID NO: 2447037 - protein, 6 aa, Entamoeba dispar
NGTTIR

SEQ ID NO: 2447038 - protein, 5 aa, Entamoeba dispar
NGTTN

SEQ ID NO: 2447039 - protein, 6 aa, Entamoeba dispar
NGTVER

SEQ ID NO: 2447040 - protein, 5 aa, Entamoeba dispar
NGTVF

SEQ ID NO: 2447041 - protein, 4 aa, Entamoeba dispar
NGTW

SEQ ID NO: 2447042 - protein, 17 aa, Entamoeba dispar
NGTYEYTPNPSTDGISK

SEQ ID NO: 2447043 - protein, 5 aa, Entamoeba dispar
NGTYN

SEQ ID NO: 2447044 - protein, 10 aa, Entamoeba dispar
NGVDGEDRFD

SEQ ID NO: 2447045 - protein, 6 aa, Entamoeba dispar
NGVEEK

SEQ ID NO: 2447046 - protein, 12 aa, Entamoeba dispar
NGVEGLTAEEEL

SEQ ID NO: 2447047 - protein, 10 aa, Entamoeba dispar
NGVESGTTIT

SEQ ID NO: 2447048 - protein, 5 aa, Entamoeba dispar
NGVGK

SEQ ID NO: 2447049 - protein, 12 aa, Entamoeba dispar
NGVNNANKTIGF

SEQ ID NO: 2447050 - protein, 7 aa, Entamoeba dispar
NGVPTIS

SEQ ID NO: 2447051 - protein, 6 aa, Entamoeba dispar
NGVQNP

SEQ ID NO: 2447052 - protein, 5 aa, Entamoeba dispar
NGVQP

SEQ ID NO: 2447053 - protein, 4 aa, Entamoeba dispar
NGVS

SEQ ID NO: 2447054 - protein, 11 aa, Entamoeba dispar
NGVSEKTAYRR

SEQ ID NO: 2447055 - protein, 4 aa, Entamoeba dispar
NGVT

SEQ ID NO: 2447056 - protein, 7 aa, Entamoeba dispar
NGVTEDR

SEQ ID NO: 2447057 - protein, 6 aa, Entamoeba dispar
NGVTKI

SEQ ID NO: 2447058 - protein, 5 aa, Entamoeba dispar
NGVTP

SEQ ID NO: 2447059 - protein, 8 aa, Entamoeba dispar
NGVTSDGQ

SEQ ID NO: 2447060 - protein, 8 aa, Entamoeba dispar
NGYDEKGL

SEQ ID NO: 2447061 - protein, 8 aa, Entamoeba dispar
NGYEEKGL

SEQ ID NO: 2447062 - protein, 5 aa, Entamoeba dispar
NGYER

SEQ ID NO: 2447063 - protein, 8 aa, Entamoeba dispar
NGYESKEC

SEQ ID NO: 2447064 - protein, 20 aa, Entamoeba dispar
NGYKIENNQCNGDKEDQCYY

SEQ ID NO: 2447065 - protein, 20 aa, Entamoeba dispar
NGYKIENNQCNGDNDDQCYY

SEQ ID NO: 2447066 - protein, 6 aa, Entamoeba dispar
NGYKIQ

SEQ ID NO: 2447067 - protein, 4 aa, Entamoeba dispar
NGYQ

SEQ ID NO: 2447068 - protein, 7 aa, Entamoeba dispar
NGYRGGL

SEQ ID NO: 2447069 - protein, 13 aa, Entamoeba dispar
NGYSPINQQPMPY

SEQ ID NO: 2447070 - protein, 9 aa, Entamoeba dispar
NHAKNNEIK

SEQ ID NO: 2447071 - protein, 4 aa, Entamoeba dispar
NHDI

SEQ ID NO: 2447072 - protein, 5 aa, Entamoeba dispar
NHDPF

SEQ ID NO: 2447073 - protein, 54 aa, Entamoeba dispar
NHDSPGRRRPRSRKRSYSSKRKSFSSRRSRSYNNRSNSRSRNYKLDRSNPNHSP

SEQ ID NO: 2447074 - protein, 10 aa, Entamoeba dispar
NHEDADPAQC

SEQ ID NO: 2447075 - protein, 5 aa, Entamoeba dispar
NHEDE

SEQ ID NO: 2447076 - protein, 6 aa, Entamoeba dispar
NHEDEK

SEQ ID NO: 2447077 - protein, 13 aa, Entamoeba dispar
NHEGSRVNGSTQV

SEQ ID NO: 2447078 - protein, 7 aa, Entamoeba dispar
NHENGCD

SEQ ID NO: 2447079 - protein, 7 aa, Entamoeba dispar
NHEPSTR

SEQ ID NO: 2447080 - protein, 8 aa, Entamoeba dispar
NHEQTDVQ

SEQ ID NO: 2447081 - protein, 7 aa, Entamoeba dispar
NHESRAI

SEQ ID NO: 2447082 - protein, 8 aa, Entamoeba dispar
NHESRNMT

SEQ ID NO: 2447083 - protein, 7 aa, Entamoeba dispar
NHESRQV

SEQ ID NO: 2447084 - protein, 8 aa, Entamoeba dispar
NHESRSMT

SEQ ID NO: 2447085 - protein, 6 aa, Entamoeba dispar
NHESSN

SEQ ID NO: 2447086 - protein, 7 aa, Entamoeba dispar
NHESSSM

SEQ ID NO: 2447087 - protein, 10 aa, Entamoeba dispar
NHESSTGETI

SEQ ID NO: 2447088 - protein, 9 aa, Entamoeba dispar
NHETRQISQ

SEQ ID NO: 2447089 - protein, 5 aa, Entamoeba dispar
NHFNT

SEQ ID NO: 2447090 - protein, 6 aa, Entamoeba dispar
NHFPET

SEQ ID NO: 2447091 - protein, 6 aa, Entamoeba dispar
NHGPEK

SEQ ID NO: 2447092 - protein, 4 aa, Entamoeba dispar
NHHD

SEQ ID NO: 2447093 - protein, 12 aa, Entamoeba dispar
NHHGSEHSNNAE

SEQ ID NO: 2447094 - protein, 4 aa, Entamoeba dispar
NHHN

SEQ ID NO: 2447095 - protein, 18 aa, Entamoeba dispar
NHHSNRSNEDQPSSQHPI

SEQ ID NO: 2447096 - protein, 5 aa, Entamoeba dispar
NHISK

SEQ ID NO: 2447097 - protein, 7 aa, Entamoeba dispar
NHISSKA

SEQ ID NO: 2447098 - protein, 5 aa, Entamoeba dispar
NHKEC

SEQ ID NO: 2447099 - protein, 12 aa, Entamoeba dispar
NHKKTTKKLPNG

SEQ ID NO: 2447100 - protein, 15 aa, Entamoeba dispar
NHKPSQMSGGEQQRV

SEQ ID NO: 2447101 - protein, 9 aa, Entamoeba dispar
NHKTIRSRK

SEQ ID NO: 2447102 - protein, 11 aa, Entamoeba dispar
NHLISPQNRTE

SEQ ID NO: 2447103 - protein, 8 aa, Entamoeba dispar
NHLTDENE

SEQ ID NO: 2447104 - protein, 8 aa, Entamoeba dispar
NHLTKGKK

SEQ ID NO: 2447105 - protein, 7 aa, Entamoeba dispar
NHNETSE

SEQ ID NO: 2447106 - protein, 5 aa, Entamoeba dispar
NHNPL

SEQ ID NO: 2447107 - protein, 11 aa, Entamoeba dispar
NHNQDPSYGYP

SEQ ID NO: 2447108 - protein, 15 aa, Entamoeba dispar
NHNQIKQSSSHDEMI

SEQ ID NO: 2447109 - protein, 8 aa, Entamoeba dispar
NHNSDIEN

SEQ ID NO: 2447110 - protein, 6 aa, Entamoeba dispar
NHNVTA

SEQ ID NO: 2447111 - protein, 9 aa, Entamoeba dispar
NHPAIKTKG

SEQ ID NO: 2447112 - protein, 5 aa, Entamoeba dispar
NHPFP

SEQ ID NO: 2447113 - protein, 6 aa, Entamoeba dispar
NHPIAN

SEQ ID NO: 2447114 - protein, 8 aa, Entamoeba dispar
NHPKGSSI

SEQ ID NO: 2447115 - protein, 12 aa, Entamoeba dispar
NHPMNDKMGTNT

SEQ ID NO: 2447116 - protein, 11 aa, Entamoeba dispar
NHPNDEIRESA

SEQ ID NO: 2447117 - protein, 5 aa, Entamoeba dispar
NHPNH

SEQ ID NO: 2447118 - protein, 5 aa, Entamoeba dispar
NHPNI

SEQ ID NO: 2447119 - protein, 6 aa, Entamoeba dispar
NHPNTL

SEQ ID NO: 2447120 - protein, 7 aa, Entamoeba dispar
NHPPTSF

SEQ ID NO: 2447121 - protein, 10 aa, Entamoeba dispar
NHPSLTKDKE

SEQ ID NO: 2447122 - protein, 6 aa, Entamoeba dispar
NHPTID

SEQ ID NO: 2447123 - protein, 22 aa, Entamoeba dispar
NHQERQQRQPRAEGEKKEDDGL

SEQ ID NO: 2447124 - protein, 10 aa, Entamoeba dispar
NHQHKPGQNC

SEQ ID NO: 2447125 - protein, 11 aa, Entamoeba dispar
NHQNDKIRDAG

SEQ ID NO: 2447126 - protein, 9 aa, Entamoeba dispar
NHQNKEENI

SEQ ID NO: 2447127 - protein, 5 aa, Entamoeba dispar
NHQNR

SEQ ID NO: 2447128 - protein, 8 aa, Entamoeba dispar
NHQQTIER

SEQ ID NO: 2447129 - protein, 18 aa, Entamoeba dispar
NHRNYREEFNKRSNNERI

SEQ ID NO: 2447130 - protein, 16 aa, Entamoeba dispar
NHRQQGQFDKSRHSHN

SEQ ID NO: 2447131 - protein, 7 aa, Entamoeba dispar
NHSATFE

SEQ ID NO: 2447132 - protein, 5 aa, Entamoeba dispar
NHSEE

SEQ ID NO: 2447133 - protein, 7 aa, Entamoeba dispar
NHSENTC

SEQ ID NO: 2447134 - protein, 8 aa, Entamoeba dispar
NHSPHQNY

SEQ ID NO: 2447135 - protein, 6 aa, Entamoeba dispar
NHSYNT

SEQ ID NO: 2447136 - protein, 6 aa, Entamoeba dispar
NHTDIE

SEQ ID NO: 2447137 - protein, 6 aa, Entamoeba dispar
NHTEVD

SEQ ID NO: 2447138 - protein, 7 aa, Entamoeba dispar
NHTITEM

SEQ ID NO: 2447139 - protein, 30 aa, Entamoeba dispar
NHTTNTTKDRRKRATTLTNSTPMKKEIMQL

SEQ ID NO: 2447140 - protein, 4 aa, Entamoeba dispar
NHVG

SEQ ID NO: 2447141 - protein, 12 aa, Entamoeba dispar
NHVNGKSLDTHL

SEQ ID NO: 2447142 - protein, 7 aa, Entamoeba dispar
NHVNGTN

SEQ ID NO: 2447143 - protein, 7 aa, Entamoeba dispar
NHVNYKG

SEQ ID NO: 2447144 - protein, 4 aa, Entamoeba dispar
NHYD

SEQ ID NO: 2447145 - protein, 4 aa, Entamoeba dispar
NIAE

SEQ ID NO: 2447146 - protein, 31 aa, Entamoeba dispar
NIAEPIKEETKDSTPEELTQEKVEETAKEEI

SEQ ID NO: 2447147 - protein, 9 aa, Entamoeba dispar
NIATNTRDG

SEQ ID NO: 2447148 - protein, 10 aa, Entamoeba dispar
NIDAKKEAKD

SEQ ID NO: 2447149 - protein, 4 aa, Entamoeba dispar
NIDK

SEQ ID NO: 2447150 - protein, 9 aa, Entamoeba dispar
NIDKSQSVN

SEQ ID NO: 2447151 - protein, 12 aa, Entamoeba dispar
NIDPNTGKEVGY

SEQ ID NO: 2447152 - protein, 20 aa, Entamoeba dispar
NIDSKQKENKTIKTQTTHDN

SEQ ID NO: 2447153 - protein, 10 aa, Entamoeba dispar
NIDSSYPYSL

SEQ ID NO: 2447154 - protein, 7 aa, Entamoeba dispar
NIDVKEN

SEQ ID NO: 2447155 - protein, 10 aa, Entamoeba dispar
NIEDNHKEIE

SEQ ID NO: 2447156 - protein, 12 aa, Entamoeba dispar
NIEDYKNGSNVT

SEQ ID NO: 2447157 - protein, 37 aa, Entamoeba dispar
NIEEDNDDDDENTCYDDKENNEEENDDDQLFEPDTSD

SEQ ID NO: 2447158 - protein, 37 aa, Entamoeba dispar
NIEEDNDDDENTCYDDKENNEEEENDDDQLFEPNTSD

SEQ ID NO: 2447159 - protein, 28 aa, Entamoeba dispar
NIEEDNDDENTYYDDKENNEEENDDDQL

SEQ ID NO: 2447160 - protein, 10 aa, Entamoeba dispar
NIEEGGHDIT

SEQ ID NO: 2447161 - protein, 5 aa, Entamoeba dispar
NIEEQ

SEQ ID NO: 2447162 - protein, 9 aa, Entamoeba dispar
NIEEQEKKR

SEQ ID NO: 2447163 - protein, 7 aa, Entamoeba dispar
NIEESKI

SEQ ID NO: 2447164 - protein, 16 aa, Entamoeba dispar
NIEESTDVYQILKQTD

SEQ ID NO: 2447165 - protein, 7 aa, Entamoeba dispar
NIEKKDI

SEQ ID NO: 2447166 - protein, 15 aa, Entamoeba dispar
NIEKYEQEFNWLNQS

SEQ ID NO: 2447167 - protein, 6 aa, Entamoeba dispar
NIEKYT

SEQ ID NO: 2447168 - protein, 4 aa, Entamoeba dispar
NIEL

SEQ ID NO: 2447169 - protein, 4 aa, Entamoeba dispar
NIEN

SEQ ID NO: 2447170 - protein, 5 aa, Entamoeba dispar
NIENE

SEQ ID NO: 2447171 - protein, 11 aa, Entamoeba dispar
NIENNNSSLQK

SEQ ID NO: 2447172 - protein, 5 aa, Entamoeba dispar
NIEPG

SEQ ID NO: 2447173 - protein, 10 aa, Entamoeba dispar
NIEPKKSPRI

SEQ ID NO: 2447174 - protein, 7 aa, Entamoeba dispar
NIEPSRG

SEQ ID NO: 2447175 - protein, 6 aa, Entamoeba dispar
NIERNT

SEQ ID NO: 2447176 - protein, 11 aa, Entamoeba dispar
NIESDVKGKEV

SEQ ID NO: 2447177 - protein, 13 aa, Entamoeba dispar
NIESHPKTKEQKV

SEQ ID NO: 2447178 - protein, 7 aa, Entamoeba dispar
NIESSDG

SEQ ID NO: 2447179 - protein, 17 aa, Entamoeba dispar
NIETEEKKQSNEEEKTI

SEQ ID NO: 2447180 - protein, 7 aa, Entamoeba dispar
NIETGKN

SEQ ID NO: 2447181 - protein, 7 aa, Entamoeba dispar
NIETKSD

SEQ ID NO: 2447182 - protein, 5 aa, Entamoeba dispar
NIEVR

SEQ ID NO: 2447183 - protein, 9 aa, Entamoeba dispar
NIGAGGAEL

SEQ ID NO: 2447184 - protein, 4 aa, Entamoeba dispar
NIGE

SEQ ID NO: 2447185 - protein, 10 aa, Entamoeba dispar
NIGKLSSPSI

SEQ ID NO: 2447186 - protein, 5 aa, Entamoeba dispar
NIGNE

SEQ ID NO: 2447187 - protein, 11 aa, Entamoeba dispar
NIGRSTSDDYS

SEQ ID NO: 2447188 - protein, 12 aa, Entamoeba dispar
NIGRTNSDEYYA

SEQ ID NO: 2447189 - protein, 11 aa, Entamoeba dispar
NIGSAFSKEGE

SEQ ID NO: 2447190 - protein, 7 aa, Entamoeba dispar
NIGTPSV

SEQ ID NO: 2447191 - protein, 11 aa, Entamoeba dispar
NIHQNPEETTF

SEQ ID NO: 2447192 - protein, 7 aa, Entamoeba dispar
NIIPPEV

SEQ ID NO: 2447193 - protein, 8 aa, Entamoeba dispar
NIIPPSVT

SEQ ID NO: 2447194 - protein, 17 aa, Entamoeba dispar
NIIRPTTKEDGIGQRKM

SEQ ID NO: 2447195 - protein, 23 aa, Entamoeba dispar
NIKDGIGKTRIKPGKGEKSLSMS

SEQ ID NO: 2447196 - protein, 8 aa, Entamoeba dispar
NIKDGTRF

SEQ ID NO: 2447197 - protein, 6 aa, Entamoeba dispar
NIKDKS

SEQ ID NO: 2447198 - protein, 37 aa, Entamoeba dispar
NIKEDNDDDENTCYDDKENNEEEENDDDQLFEPDTSD

SEQ ID NO: 2447199 - protein, 36 aa, Entamoeba dispar
NIKEDNDDDENTCYDDKENNEEENDDDQLFEPDTSD

SEQ ID NO: 2447200 - protein, 8 aa, Entamoeba dispar
NIKEKSKA

SEQ ID NO: 2447201 - protein, 9 aa, Entamoeba dispar
NIKEQDNYR

SEQ ID NO: 2447202 - protein, 4 aa, Entamoeba dispar
NIKG

SEQ ID NO: 2447203 - protein, 9 aa, Entamoeba dispar
NIKKENDKI

SEQ ID NO: 2447204 - protein, 6 aa, Entamoeba dispar
NIKKGN

SEQ ID NO: 2447205 - protein, 26 aa, Entamoeba dispar
NIKPNQSQEEKKDESDNKKMEEDKKN

SEQ ID NO: 2447206 - protein, 8 aa, Entamoeba dispar
NIKQQQRD

SEQ ID NO: 2447207 - protein, 9 aa, Entamoeba dispar
NIKQTEEQF

SEQ ID NO: 2447208 - protein, 19 aa, Entamoeba dispar
NIKSPNGIDSFGGKKIEMT

SEQ ID NO: 2447209 - protein, 9 aa, Entamoeba dispar
NIKTLEEKN

SEQ ID NO: 2447210 - protein, 9 aa, Entamoeba dispar
NIKYTQRGR

SEQ ID NO: 2447211 - protein, 7 aa, Entamoeba dispar
NILGNER

SEQ ID NO: 2447212 - protein, 10 aa, Entamoeba dispar
NIMEEDGDHS

SEQ ID NO: 2447213 - protein, 6 aa, Entamoeba dispar
NINDGF

SEQ ID NO: 2447214 - protein, 25 aa, Entamoeba dispar
NINEQPDEEEYEEEQQREDIPEEET

SEQ ID NO: 2447215 - protein, 8 aa, Entamoeba dispar
NINESTVE

SEQ ID NO: 2447216 - protein, 7 aa, Entamoeba dispar
NINGENI

SEQ ID NO: 2447217 - protein, 7 aa, Entamoeba dispar
NINGENV

SEQ ID NO: 2447218 - protein, 5 aa, Entamoeba dispar
NINIG

SEQ ID NO: 2447219 - protein, 4 aa, Entamoeba dispar
NINK

SEQ ID NO: 2447220 - protein, 8 aa, Entamoeba dispar
NINKETHD

SEQ ID NO: 2447221 - protein, 9 aa, Entamoeba dispar
NINNEDIEE

SEQ ID NO: 2447222 - protein, 11 aa, Entamoeba dispar
NINNKKQEGSL

SEQ ID NO: 2447223 - protein, 7 aa, Entamoeba dispar
NINNTLQ

SEQ ID NO: 2447224 - protein, 12 aa, Entamoeba dispar
NINREEIDSSQD

SEQ ID NO: 2447225 - protein, 13 aa, Entamoeba dispar
NINRQQEQTQRVS

SEQ ID NO: 2447226 - protein, 14 aa, Entamoeba dispar
NINSDVTIENVKIQ

SEQ ID NO: 2447227 - protein, 9 aa, Entamoeba dispar
NINSEEAQT

SEQ ID NO: 2447228 - protein, 4 aa, Entamoeba dispar
NINT

SEQ ID NO: 2447229 - protein, 4 aa, Entamoeba dispar
NIPA

SEQ ID NO: 2447230 - protein, 20 aa, Entamoeba dispar
NIPDQPAGGYEEEDPQEPNS

SEQ ID NO: 2447231 - protein, 7 aa, Entamoeba dispar
NIPDSVT

SEQ ID NO: 2447232 - protein, 10 aa, Entamoeba dispar
NIPEDADDEL

SEQ ID NO: 2447233 - protein, 17 aa, Entamoeba dispar
NIPGDKKVKRRNIDATT

SEQ ID NO: 2447234 - protein, 20 aa, Entamoeba dispar
NIPGGKALPKGYKMSKDKTV

SEQ ID NO: 2447235 - protein, 4 aa, Entamoeba dispar
NIPH

SEQ ID NO: 2447236 - protein, 6 aa, Entamoeba dispar
NIPIDS

SEQ ID NO: 2447237 - protein, 13 aa, Entamoeba dispar
NIPKECFKQRPIK

SEQ ID NO: 2447238 - protein, 6 aa, Entamoeba dispar
NIPKEN

SEQ ID NO: 2447239 - protein, 21 aa, Entamoeba dispar
NIPKIDDSGRLKSGLTPPTNR

SEQ ID NO: 2447240 - protein, 11 aa, Entamoeba dispar
NIPKNNTEEIM

SEQ ID NO: 2447241 - protein, 7 aa, Entamoeba dispar
NIPKNSN

SEQ ID NO: 2447242 - protein, 5 aa, Entamoeba dispar
NIPKT

SEQ ID NO: 2447243 - protein, 11 aa, Entamoeba dispar
NIPNKQGETPL

SEQ ID NO: 2447244 - protein, 7 aa, Entamoeba dispar
NIPNNKR

SEQ ID NO: 2447245 - protein, 16 aa, Entamoeba dispar
NIPNTTTPSTQSSTNL

SEQ ID NO: 2447246 - protein, 7 aa, Entamoeba dispar
NIPPSLT

SEQ ID NO: 2447247 - protein, 9 aa, Entamoeba dispar
NIPPSNELK

SEQ ID NO: 2447248 - protein, 7 aa, Entamoeba dispar
NIPPSVR

SEQ ID NO: 2447249 - protein, 8 aa, Entamoeba dispar
NIPPSVSE

SEQ ID NO: 2447250 - protein, 6 aa, Entamoeba dispar
NIPQKL

SEQ ID NO: 2447251 - protein, 6 aa, Entamoeba dispar
NIPQPV

SEQ ID NO: 2447252 - protein, 11 aa, Entamoeba dispar
NIPSEQQDQKI

SEQ ID NO: 2447253 - protein, 11 aa, Entamoeba dispar
NIPSGKSYTPY

SEQ ID NO: 2447254 - protein, 10 aa, Entamoeba dispar
NIPSGVSKLG

SEQ ID NO: 2447255 - protein, 5 aa, Entamoeba dispar
NIPSI

SEQ ID NO: 2447256 - protein, 5 aa, Entamoeba dispar
NIPSL

SEQ ID NO: 2447257 - protein, 9 aa, Entamoeba dispar
NIPSNEIND

SEQ ID NO: 2447258 - protein, 8 aa, Entamoeba dispar
NIPSPITS

SEQ ID NO: 2447259 - protein, 6 aa, Entamoeba dispar
NIPSSE

SEQ ID NO: 2447260 - protein, 9 aa, Entamoeba dispar
NIPSSIKSF

SEQ ID NO: 2447261 - protein, 9 aa, Entamoeba dispar
NIPSSINEI

SEQ ID NO: 2447262 - protein, 14 aa, Entamoeba dispar
NIPSSINEIGFYCF

SEQ ID NO: 2447263 - protein, 13 aa, Entamoeba dispar
NIPSSISEIGDCV

SEQ ID NO: 2447264 - protein, 9 aa, Entamoeba dispar
NIPSSISGL

SEQ ID NO: 2447265 - protein, 10 aa, Entamoeba dispar
NIPSSISKLG

SEQ ID NO: 2447266 - protein, 12 aa, Entamoeba dispar
NIPSSISKLRDE

SEQ ID NO: 2447267 - protein, 9 aa, Entamoeba dispar
NIPSSITEL

SEQ ID NO: 2447268 - protein, 8 aa, Entamoeba dispar
NIPSSITK

SEQ ID NO: 2447269 - protein, 8 aa, Entamoeba dispar
NIPSSITS

SEQ ID NO: 2447270 - protein, 9 aa, Entamoeba dispar
NIPSSITSI

SEQ ID NO: 2447271 - protein, 10 aa, Entamoeba dispar
NIPSSTTSFG

SEQ ID NO: 2447272 - protein, 10 aa, Entamoeba dispar
NIPSSVKTLG

SEQ ID NO: 2447273 - protein, 9 aa, Entamoeba dispar
NIPSSVNKI

SEQ ID NO: 2447274 - protein, 9 aa, Entamoeba dispar
NIPSSVSEL

SEQ ID NO: 2447275 - protein, 9 aa, Entamoeba dispar
NIPSSVSKL

SEQ ID NO: 2447276 - protein, 10 aa, Entamoeba dispar
NIPSSVSKLG

SEQ ID NO: 2447277 - protein, 12 aa, Entamoeba dispar
NIPSSVSKLGDN

SEQ ID NO: 2447278 - protein, 11 aa, Entamoeba dispar
NIPSSVSTLGD

SEQ ID NO: 2447279 - protein, 13 aa, Entamoeba dispar
NIPSSVVKSSNSN

SEQ ID NO: 2447280 - protein, 6 aa, Entamoeba dispar
NIPSTI

SEQ ID NO: 2447281 - protein, 8 aa, Entamoeba dispar
NIPSTISK

SEQ ID NO: 2447282 - protein, 8 aa, Entamoeba dispar
NIPSTITS

SEQ ID NO: 2447283 - protein, 10 aa, Entamoeba dispar
NIPSTTSKIG

SEQ ID NO: 2447284 - protein, 9 aa, Entamoeba dispar
NIPSTVKEI

SEQ ID NO: 2447285 - protein, 10 aa, Entamoeba dispar
NIPTKVTTIG

SEQ ID NO: 2447286 - protein, 12 aa, Entamoeba dispar
NIPTNKKKKETQ

SEQ ID NO: 2447287 - protein, 8 aa, Entamoeba dispar
NIPTSVSE

SEQ ID NO: 2447288 - protein, 9 aa, Entamoeba dispar
NIPTSVSEI

SEQ ID NO: 2447289 - protein, 11 aa, Entamoeba dispar
NIPTSVSKIGD

SEQ ID NO: 2447290 - protein, 12 aa, Entamoeba dispar
NIPTSVSKIGDG

SEQ ID NO: 2447291 - protein, 12 aa, Entamoeba dispar
NIPTSVSKIGND

SEQ ID NO: 2447292 - protein, 13 aa, Entamoeba dispar
NIPTSVSKIGNSS

SEQ ID NO: 2447293 - protein, 9 aa, Entamoeba dispar
NIPTSVSKL

SEQ ID NO: 2447294 - protein, 5 aa, Entamoeba dispar
NIPVG

SEQ ID NO: 2447295 - protein, 13 aa, Entamoeba dispar
NIPYAGKNWRNST

SEQ ID NO: 2447296 - protein, 26 aa, Entamoeba dispar
NIQEEGSDSEESNSVPIAPTPPDSRL

SEQ ID NO: 2447297 - protein, 6 aa, Entamoeba dispar
NIQEEI

SEQ ID NO: 2447298 - protein, 19 aa, Entamoeba dispar
NIQGGAEQRRNLQATDTLD

SEQ ID NO: 2447299 - protein, 18 aa, Entamoeba dispar
NIQNTQRTNPVQSLVDLQ

SEQ ID NO: 2447300 - protein, 11 aa, Entamoeba dispar
NIQNTSDNSSI

SEQ ID NO: 2447301 - protein, 12 aa, Entamoeba dispar
NIQRRKTGQCDH

SEQ ID NO: 2447302 - protein, 8 aa, Entamoeba dispar
NIQSSVSK

SEQ ID NO: 2447303 - protein, 6 aa, Entamoeba dispar
NIQTKQ

SEQ ID NO: 2447304 - protein, 5 aa, Entamoeba dispar
NIQTR

SEQ ID NO: 2447305 - protein, 5 aa, Entamoeba dispar
NIRGE

SEQ ID NO: 2447306 - protein, 9 aa, Entamoeba dispar
NIRSKESND

SEQ ID NO: 2447307 - protein, 8 aa, Entamoeba dispar
NIRTNGDS

SEQ ID NO: 2447308 - protein, 14 aa, Entamoeba dispar
NISDESVSESTTSE

SEQ ID NO: 2447309 - protein, 20 aa, Entamoeba dispar
NISDNGTYNYTPSPSTDGIS

SEQ ID NO: 2447310 - protein, 23 aa, Entamoeba dispar
NISEKTNGNNIDNTTERSPSSVE

SEQ ID NO: 2447311 - protein, 14 aa, Entamoeba dispar
NISESVSTPEKSYS

SEQ ID NO: 2447312 - protein, 4 aa, Entamoeba dispar
NISF

SEQ ID NO: 2447313 - protein, 14 aa, Entamoeba dispar
NISKGLKTKQSSFE

SEQ ID NO: 2447314 - protein, 13 aa, Entamoeba dispar
NISKQKSKNLESF

SEQ ID NO: 2447315 - protein, 6 aa, Entamoeba dispar
NISNEE

SEQ ID NO: 2447316 - protein, 6 aa, Entamoeba dispar
NISNEQ

SEQ ID NO: 2447317 - protein, 5 aa, Entamoeba dispar
NISNV

SEQ ID NO: 2447318 - protein, 5 aa, Entamoeba dispar
NISPA

SEQ ID NO: 2447319 - protein, 9 aa, Entamoeba dispar
NISPRSQTV

SEQ ID NO: 2447320 - protein, 22 aa, Entamoeba dispar
NISPSFDSNTSENPVNSKPLQP

SEQ ID NO: 2447321 - protein, 9 aa, Entamoeba dispar
NISPSMKKS

SEQ ID NO: 2447322 - protein, 7 aa, Entamoeba dispar
NISPSRV

SEQ ID NO: 2447323 - protein, 4 aa, Entamoeba dispar
NISQ

SEQ ID NO: 2447324 - protein, 8 aa, Entamoeba dispar
NISQEDFD

SEQ ID NO: 2447325 - protein, 8 aa, Entamoeba dispar
NISQQPGV

SEQ ID NO: 2447326 - protein, 9 aa, Entamoeba dispar
NISSDGGRV

SEQ ID NO: 2447327 - protein, 6 aa, Entamoeba dispar
NISSGI

SEQ ID NO: 2447328 - protein, 6 aa, Entamoeba dispar
NISSIT

SEQ ID NO: 2447329 - protein, 28 aa, Entamoeba dispar
NISSKNPKGYKDEDKKNKEVKETKRANA

SEQ ID NO: 2447330 - protein, 4 aa, Entamoeba dispar
NIST

SEQ ID NO: 2447331 - protein, 10 aa, Entamoeba dispar
NISTKTQQVK

SEQ ID NO: 2447332 - protein, 9 aa, Entamoeba dispar
NISTNNQLE

SEQ ID NO: 2447333 - protein, 9 aa, Entamoeba dispar
NISTNSKLK

SEQ ID NO: 2447334 - protein, 8 aa, Entamoeba dispar
NISTRRNT

SEQ ID NO: 2447335 - protein, 17 aa, Entamoeba dispar
NITDDNGKIYPALPEGN

SEQ ID NO: 2447336 - protein, 17 aa, Entamoeba dispar
NITDNDPEVRAAASNAI

SEQ ID NO: 2447337 - protein, 13 aa, Entamoeba dispar
NITDSGYLQKENQ

SEQ ID NO: 2447338 - protein, 5 aa, Entamoeba dispar
NITER

SEQ ID NO: 2447339 - protein, 6 aa, Entamoeba dispar
NITGIG

SEQ ID NO: 2447340 - protein, 5 aa, Entamoeba dispar
NITKE

SEQ ID NO: 2447341 - protein, 13 aa, Entamoeba dispar
NITKELEKKGIKD

SEQ ID NO: 2447342 - protein, 12 aa, Entamoeba dispar
NITNESTTDYED

SEQ ID NO: 2447343 - protein, 7 aa, Entamoeba dispar
NITSIGN

SEQ ID NO: 2447344 - protein, 6 aa, Entamoeba dispar
NITSKP

SEQ ID NO: 2447345 - protein, 17 aa, Entamoeba dispar
NITSSIKSGAEKVKQAA

SEQ ID NO: 2447346 - protein, 19 aa, Entamoeba dispar
NITSSRGKTVTVQLDDFLF

SEQ ID NO: 2447347 - protein, 10 aa, Entamoeba dispar
NITSTDKVGR

SEQ ID NO: 2447348 - protein, 8 aa, Entamoeba dispar
NITTDGKS

SEQ ID NO: 2447349 - protein, 5 aa, Entamoeba dispar
NITTE

SEQ ID NO: 2447350 - protein, 7 aa, Entamoeba dispar
NITTHDY

SEQ ID NO: 2447351 - protein, 25 aa, Entamoeba dispar
NIYENSTLKSTESINSLTPEQQEQL

SEQ ID NO: 2447352 - protein, 4 aa, Entamoeba dispar
NIYP

SEQ ID NO: 2447353 - protein, 7 aa, Entamoeba dispar
NIYPPGH

SEQ ID NO: 2447354 - protein, 6 aa, Entamoeba dispar
NKAAGM

SEQ ID NO: 2447355 - protein, 7 aa, Entamoeba dispar
NKADELE

SEQ ID NO: 2447356 - protein, 6 aa, Entamoeba dispar
NKAEQT

SEQ ID NO: 2447357 - protein, 4 aa, Entamoeba dispar
NKAG

SEQ ID NO: 2447358 - protein, 7 aa, Entamoeba dispar
NKAGEVS

SEQ ID NO: 2447359 - protein, 4 aa, Entamoeba dispar
NKAI

SEQ ID NO: 2447360 - protein, 5 aa, Entamoeba dispar
NKAKE

SEQ ID NO: 2447361 - protein, 5 aa, Entamoeba dispar
NKAKL

SEQ ID NO: 2447362 - protein, 13 aa, Entamoeba dispar
NKAKLKKERSIKI

SEQ ID NO: 2447363 - protein, 7 aa, Entamoeba dispar
NKAKSLS

SEQ ID NO: 2447364 - protein, 18 aa, Entamoeba dispar
NKALDNAESALKIDGKNV

SEQ ID NO: 2447365 - protein, 7 aa, Entamoeba dispar
NKANDIR

SEQ ID NO: 2447366 - protein, 8 aa, Entamoeba dispar
NKANFNQN

SEQ ID NO: 2447367 - protein, 8 aa, Entamoeba dispar
NKANSLNI

SEQ ID NO: 2447368 - protein, 8 aa, Entamoeba dispar
NKAPSSIK

SEQ ID NO: 2447369 - protein, 22 aa, Entamoeba dispar
NKAPSTKPILKPKKSKKTISDP

SEQ ID NO: 2447370 - protein, 5 aa, Entamoeba dispar
NKAQI

SEQ ID NO: 2447371 - protein, 25 aa, Entamoeba dispar
NKARKEAKSSKVGNKKPSKEIKEKE

SEQ ID NO: 2447372 - protein, 8 aa, Entamoeba dispar
NKASEEII

SEQ ID NO: 2447373 - protein, 9 aa, Entamoeba dispar
NKASKKPIT

SEQ ID NO: 2447374 - protein, 6 aa, Entamoeba dispar
NKASRD

SEQ ID NO: 2447375 - protein, 5 aa, Entamoeba dispar
NKASS

SEQ ID NO: 2447376 - protein, 8 aa, Entamoeba dispar
NKASTAAR

SEQ ID NO: 2447377 - protein, 7 aa, Entamoeba dispar
NKASYEA

SEQ ID NO: 2447378 - protein, 15 aa, Entamoeba dispar
NKATDSALSTTRRFT

SEQ ID NO: 2447379 - protein, 7 aa, Entamoeba dispar
NKATEEY

SEQ ID NO: 2447380 - protein, 7 aa, Entamoeba dispar
NKATNKS

SEQ ID NO: 2447381 - protein, 11 aa, Entamoeba dispar
NKATTKPPKYS

SEQ ID NO: 2447382 - protein, 6 aa, Entamoeba dispar
NKCDEK

SEQ ID NO: 2447383 - protein, 4 aa, Entamoeba dispar
NKCK

SEQ ID NO: 2447384 - protein, 15 aa, Entamoeba dispar
NKCNDKKKNVSSKEV

SEQ ID NO: 2447385 - protein, 14 aa, Entamoeba dispar
NKDCTNEKKTDLRQ

SEQ ID NO: 2447386 - protein, 18 aa, Entamoeba dispar
NKDDNNIQYNKRSDITIH

SEQ ID NO: 2447387 - protein, 4 aa, Entamoeba dispar
NKDE

SEQ ID NO: 2447388 - protein, 12 aa, Entamoeba dispar
NKDEEDRKGIND

SEQ ID NO: 2447389 - protein, 18 aa, Entamoeba dispar
NKDEEEVERKEKEERSEG

SEQ ID NO: 2447390 - protein, 8 aa, Entamoeba dispar
NKDEENVG

SEQ ID NO: 2447391 - protein, 7 aa, Entamoeba dispar
NKDESNS

SEQ ID NO: 2447392 - protein, 6 aa, Entamoeba dispar
NKDGDI

SEQ ID NO: 2447393 - protein, 8 aa, Entamoeba dispar
NKDGSYNL

SEQ ID NO: 2447394 - protein, 6 aa, Entamoeba dispar
NKDIKG

SEQ ID NO: 2447395 - protein, 5 aa, Entamoeba dispar
NKDKG

SEQ ID NO: 2447396 - protein, 8 aa, Entamoeba dispar
NKDKNISQ

SEQ ID NO: 2447397 - protein, 7 aa, Entamoeba dispar
NKDKTDY

SEQ ID NO: 2447398 - protein, 10 aa, Entamoeba dispar
NKDNGERKEV

SEQ ID NO: 2447399 - protein, 7 aa, Entamoeba dispar
NKDNGID

SEQ ID NO: 2447400 - protein, 16 aa, Entamoeba dispar
NKDNQTSTSNDCKEDV

SEQ ID NO: 2447401 - protein, 16 aa, Entamoeba dispar
NKDNSSDTPLSSSPLK

SEQ ID NO: 2447402 - protein, 8 aa, Entamoeba dispar
NKDNTPEI

SEQ ID NO: 2447403 - protein, 9 aa, Entamoeba dispar
NKDPSSIDK

SEQ ID NO: 2447404 - protein, 7 aa, Entamoeba dispar
NKDQKIT

SEQ ID NO: 2447405 - protein, 16 aa, Entamoeba dispar
NKDRDKYGNTIPPEVK

SEQ ID NO: 2447406 - protein, 6 aa, Entamoeba dispar
NKDSDI

SEQ ID NO: 2447407 - protein, 7 aa, Entamoeba dispar
NKDSLQN

SEQ ID NO: 2447408 - protein, 8 aa, Entamoeba dispar
NKDSPERI

SEQ ID NO: 2447409 - protein, 4 aa, Entamoeba dispar
NKDT

SEQ ID NO: 2447410 - protein, 9 aa, Entamoeba dispar
NKDTERTEQ

SEQ ID NO: 2447411 - protein, 7 aa, Entamoeba dispar
NKDTKMA

SEQ ID NO: 2447412 - protein, 5 aa, Entamoeba dispar
NKDTV

SEQ ID NO: 2447413 - protein, 8 aa, Entamoeba dispar
NKDTVTEL

SEQ ID NO: 2447414 - protein, 4 aa, Entamoeba dispar
NKEA

SEQ ID NO: 2447415 - protein, 7 aa, Entamoeba dispar
NKEAQSA

SEQ ID NO: 2447416 - protein, 20 aa, Entamoeba dispar
NKEARQKERSQLRTSRRVQS

SEQ ID NO: 2447417 - protein, 30 aa, Entamoeba dispar
NKEASSIPPKPPKQKQKRTRKQTVLFPNLV

SEQ ID NO: 2447418 - protein, 4 aa, Entamoeba dispar
NKEC

SEQ ID NO: 2447419 - protein, 8 aa, Entamoeba dispar
NKECKEKL

SEQ ID NO: 2447420 - protein, 6 aa, Entamoeba dispar
NKECQI

SEQ ID NO: 2447421 - protein, 7 aa, Entamoeba dispar
NKECQYD

SEQ ID NO: 2447422 - protein, 12 aa, Entamoeba dispar
NKECTKKKKVTI

SEQ ID NO: 2447423 - protein, 63 aa, Entamoeba dispar
NKEDAFNNFSKSNEESEEGNSMSEELKESSEENESNEENYSMSEEEENNESNKEESEEDEADK

SEQ ID NO: 2447424 - protein, 74 aa, Entamoeba dispar
NKEDAFNNFSKSNEESEEGNSMSEEMKESSEENESNEENYSMSEEEENDESNDEEGEENNESNKEESEEDEADK

SEQ ID NO: 2447425 - protein, 8 aa, Entamoeba dispar
NKEDEHLQ

SEQ ID NO: 2447426 - protein, 7 aa, Entamoeba dispar
NKEDKVK

SEQ ID NO: 2447427 - protein, 7 aa, Entamoeba dispar
NKEDNEK

SEQ ID NO: 2447428 - protein, 7 aa, Entamoeba dispar
NKEDNIT

SEQ ID NO: 2447429 - protein, 5 aa, Entamoeba dispar
NKEDT

SEQ ID NO: 2447430 - protein, 8 aa, Entamoeba dispar
NKEDVQKG

SEQ ID NO: 2447431 - protein, 12 aa, Entamoeba dispar
NKEEDNGDALSP

SEQ ID NO: 2447432 - protein, 7 aa, Entamoeba dispar
NKEEEFK

SEQ ID NO: 2447433 - protein, 7 aa, Entamoeba dispar
NKEEEKI

SEQ ID NO: 2447434 - protein, 10 aa, Entamoeba dispar
NKEEENNQIE

SEQ ID NO: 2447435 - protein, 12 aa, Entamoeba dispar
NKEEESNEDVTP

SEQ ID NO: 2447436 - protein, 7 aa, Entamoeba dispar
NKEEGIC

SEQ ID NO: 2447437 - protein, 7 aa, Entamoeba dispar
NKEEIDS

SEQ ID NO: 2447438 - protein, 8 aa, Entamoeba dispar
NKEEIKKE

SEQ ID NO: 2447439 - protein, 8 aa, Entamoeba dispar
NKEEMNKE

SEQ ID NO: 2447440 - protein, 8 aa, Entamoeba dispar
NKEENEKL

SEQ ID NO: 2447441 - protein, 6 aa, Entamoeba dispar
NKEENI

SEQ ID NO: 2447442 - protein, 7 aa, Entamoeba dispar
NKEEQDL

SEQ ID NO: 2447443 - protein, 14 aa, Entamoeba dispar
NKEEQNEGLEQEDK

SEQ ID NO: 2447444 - protein, 8 aa, Entamoeba dispar
NKEERDST

SEQ ID NO: 2447445 - protein, 43 aa, Entamoeba dispar
NKEESDRELQIENETKIPSSKKEEKEVNKPKELTSSKKGSYQT

SEQ ID NO: 2447446 - protein, 9 aa, Entamoeba dispar
NKEESTNYL

SEQ ID NO: 2447447 - protein, 8 aa, Entamoeba dispar
NKEETKKI

SEQ ID NO: 2447448 - protein, 12 aa, Entamoeba dispar
NKEETYNIGSCQ

SEQ ID NO: 2447449 - protein, 10 aa, Entamoeba dispar
NKEEVNNTRN

SEQ ID NO: 2447450 - protein, 4 aa, Entamoeba dispar
NKEF

SEQ ID NO: 2447451 - protein, 6 aa, Entamoeba dispar
NKEFNE

SEQ ID NO: 2447452 - protein, 7 aa, Entamoeba dispar
NKEGIKE

SEQ ID NO: 2447453 - protein, 8 aa, Entamoeba dispar
NKEGNDKE

SEQ ID NO: 2447454 - protein, 7 aa, Entamoeba dispar
NKEGPYS

SEQ ID NO: 2447455 - protein, 7 aa, Entamoeba dispar
NKEIEQQ

SEQ ID NO: 2447456 - protein, 50 aa, Entamoeba dispar; identical to SEQ ID NO: 2370761

SEQ ID NO: 2447457 - protein, 7 aa, Entamoeba dispar
NKEKDNE

SEQ ID NO: 2447458 - protein, 7 aa, Entamoeba dispar
NKEKENH

SEQ ID NO: 2447459 - protein, 9 aa, Entamoeba dispar
NKEKENNKV

SEQ ID NO: 2447460 - protein, 7 aa, Entamoeba dispar
NKEKEPI

SEQ ID NO: 2447461 - protein, 98 aa, Entamoeba dispar
NKEKHPKTKKEKKDKSSMKKKLTEETKEEKEQGEEEIKEEEITKEERDIRGDGPTIKMEEDDSSEDFSSKDIQKEIKKEIKQKRQEELNEKRADEDDI

SEQ ID NO: 2447462 - protein, 5 aa, Entamoeba dispar
NKEKI

SEQ ID NO: 2447463 - protein, 23 aa, Entamoeba dispar
NKEKKAQKQEEFTKKKKRYEKGI

SEQ ID NO: 2447464 - protein, 9 aa, Entamoeba dispar
NKEKKQPLK

SEQ ID NO: 2447465 - protein, 7 aa, Entamoeba dispar
NKEKMEK

SEQ ID NO: 2447466 - protein, 7 aa, Entamoeba dispar
NKEKNQQ

SEQ ID NO: 2447467 - protein, 11 aa, Entamoeba dispar
NKEKPKEEEKK

SEQ ID NO: 2447468 - protein, 6 aa, Entamoeba dispar
NKEKQT

SEQ ID NO: 2447469 - protein, 14 aa, Entamoeba dispar
NKEKRTIKGNKRGV

SEQ ID NO: 2447470 - protein, 7 aa, Entamoeba dispar
NKEKSEI

SEQ ID NO: 2447471 - protein, 10 aa, Entamoeba dispar
NKEKTKIENE

SEQ ID NO: 2447472 - protein, 7 aa, Entamoeba dispar
NKEKTNT

SEQ ID NO: 2447473 - protein, 29 aa, Entamoeba dispar
NKEKTQPTTIEEEDTYKRIDNKRKEFNEL

SEQ ID NO: 2447474 - protein, 5 aa, Entamoeba dispar
NKELK

SEQ ID NO: 2447475 - protein, 15 aa, Entamoeba dispar
NKELKNRIKEKDEKL

SEQ ID NO: 2447476 - protein, 12 aa, Entamoeba dispar
NKELKTKLSKEV

SEQ ID NO: 2447477 - protein, 7 aa, Entamoeba dispar
NKELQNE

SEQ ID NO: 2447478 - protein, 6 aa, Entamoeba dispar
NKELQT

SEQ ID NO: 2447479 - protein, 10 aa, Entamoeba dispar
NKELSNKNDK

SEQ ID NO: 2447480 - protein, 5 aa, Entamoeba dispar
NKELT

SEQ ID NO: 2447481 - protein, 8 aa, Entamoeba dispar
NKEMKEEN

SEQ ID NO: 2447482 - protein, 6 aa, Entamoeba dispar
NKEMTR

SEQ ID NO: 2447483 - protein, 4 aa, Entamoeba dispar
NKEN

SEQ ID NO: 2447484 - protein, 8 aa, Entamoeba dispar
NKENIDGM

SEQ ID NO: 2447485 - protein, 12 aa, Entamoeba dispar
NKENKQKKIKQS

SEQ ID NO: 2447486 - protein, 9 aa, Entamoeba dispar
NKENKYEKK

SEQ ID NO: 2447487 - protein, 7 aa, Entamoeba dispar
NKENKYI

SEQ ID NO: 2447488 - protein, 9 aa, Entamoeba dispar
NKENLDKNT

SEQ ID NO: 2447489 - protein, 13 aa, Entamoeba dispar
NKENNKEEYRAEL

SEQ ID NO: 2447490 - protein, 9 aa, Entamoeba dispar
NKENPPTKE

SEQ ID NO: 2447491 - protein, 13 aa, Entamoeba dispar
NKENPVDKTESTL

SEQ ID NO: 2447492 - protein, 14 aa, Entamoeba dispar
NKENPYLQPEMPQE

SEQ ID NO: 2447493 - protein, 8 aa, Entamoeba dispar
NKENSQAM

SEQ ID NO: 2447494 - protein, 10 aa, Entamoeba dispar
NKENSSNGSS

SEQ ID NO: 2447495 - protein, 6 aa, Entamoeba dispar
NKEPIM

SEQ ID NO: 2447496 - protein, 14 aa, Entamoeba dispar
NKEPLTNEIRPGFT

SEQ ID NO: 2447497 - protein, 35 aa, Entamoeba dispar
NKEPNKNPIVPEQPKEKKHQRKRKLRSAEERKPSM

SEQ ID NO: 2447498 - protein, 7 aa, Entamoeba dispar
NKEPPRI

SEQ ID NO: 2447499 - protein, 7 aa, Entamoeba dispar
NKEQGIT

SEQ ID NO: 2447500 - protein, 14 aa, Entamoeba dispar
NKEQIDGETSEERE

SEQ ID NO: 2447501 - protein, 10 aa, Entamoeba dispar
NKEQISTLGD

SEQ ID NO: 2447502 - protein, 21 aa, Entamoeba dispar
NKEQKKEANRLNERLKEETIA

SEQ ID NO: 2447503 - protein, 7 aa, Entamoeba dispar
NKEQQTL

SEQ ID NO: 2447504 - protein, 5 aa, Entamoeba dispar
NKEQY

SEQ ID NO: 2447505 - protein, 11 aa, Entamoeba dispar
NKERNKPNKIY

SEQ ID NO: 2447506 - protein, 4 aa, Entamoeba dispar
NKES

SEQ ID NO: 2447507 - protein, 7 aa, Entamoeba dispar
NKESFEE

SEQ ID NO: 2447508 - protein, 7 aa, Entamoeba dispar
NKESFEN

SEQ ID NO: 2447509 - protein, 7 aa, Entamoeba dispar
NKESFST

SEQ ID NO: 2447510 - protein, 7 aa, Entamoeba dispar
NKESPYY

SEQ ID NO: 2447511 - protein, 7 aa, Entamoeba dispar
NKESQIK

SEQ ID NO: 2447512 - protein, 9 aa, Entamoeba dispar
NKESSSQIN

SEQ ID NO: 2447513 - protein, 71 aa, Entamoeba dispar
NKETDEQMSESESSSSCDESKVKNTTNVKPTSRHSLNTKSKSSPMSESETSSSGSSGKSSSESSSTPPSVK

SEQ ID NO: 2447514 - protein, 8 aa, Entamoeba dispar
NKETDKNT

SEQ ID NO: 2447515 - protein, 20 aa, Entamoeba dispar
NKETEEEKEERIKKEEHQGI

SEQ ID NO: 2447516 - protein, 7 aa, Entamoeba dispar
NKETGAT

SEQ ID NO: 2447517 - protein, 6 aa, Entamoeba dispar
NKETIK

SEQ ID NO: 2447518 - protein, 8 aa, Entamoeba dispar
NKETKMRD

SEQ ID NO: 2447519 - protein, 14 aa, Entamoeba dispar
NKETKRDRKSEVKQ

SEQ ID NO: 2447520 - protein, 5 aa, Entamoeba dispar
NKETL

SEQ ID NO: 2447521 - protein, 7 aa, Entamoeba dispar
NKETPKI

SEQ ID NO: 2447522 - protein, 6 aa, Entamoeba dispar
NKETQT

SEQ ID NO: 2447523 - protein, 10 aa, Entamoeba dispar
NKETREALRT

SEQ ID NO: 2447524 - protein, 6 aa, Entamoeba dispar
NKETTQ

SEQ ID NO: 2447525 - protein, 13 aa, Entamoeba dispar
NKETVQPKITARP

SEQ ID NO: 2447526 - protein, 5 aa, Entamoeba dispar
NKEVK

SEQ ID NO: 2447527 - protein, 11 aa, Entamoeba dispar
NKEYEKSKQTI

SEQ ID NO: 2447528 - protein, 5 aa, Entamoeba dispar
NKEYS

SEQ ID NO: 2447529 - protein, 4 aa, Entamoeba dispar
NKFE

SEQ ID NO: 2447530 - protein, 7 aa, Entamoeba dispar
NKFNKDH

SEQ ID NO: 2447531 - protein, 8 aa, Entamoeba dispar
NKFNKNKY

SEQ ID NO: 2447532 - protein, 4 aa, Entamoeba dispar
NKFP

SEQ ID NO: 2447533 - protein, 8 aa, Entamoeba dispar
NKFPQSNT

SEQ ID NO: 2447534 - protein, 14 aa, Entamoeba dispar
NKFSNSSTNLGENG

SEQ ID NO: 2447535 - protein, 5 aa, Entamoeba dispar
NKFSQ

SEQ ID NO: 2447536 - protein, 13 aa, Entamoeba dispar
NKFSSSLKTPITG

SEQ ID NO: 2447537 - protein, 8 aa, Entamoeba dispar
NKGDYSLS

SEQ ID NO: 2447538 - protein, 8 aa, Entamoeba dispar
NKGEFEKQ

SEQ ID NO: 2447539 - protein, 7 aa, Entamoeba dispar
NKGESLT

SEQ ID NO: 2447540 - protein, 9 aa, Entamoeba dispar
NKGGDEHPQ

SEQ ID NO: 2447541 - protein, 5 aa, Entamoeba dispar
NKGGH

SEQ ID NO: 2447542 - protein, 6 aa, Entamoeba dispar
NKGGIG

SEQ ID NO: 2447543 - protein, 10 aa, Entamoeba dispar
NKGGKYPESK

SEQ ID NO: 2447544 - protein, 5 aa, Entamoeba dispar
NKGGL

SEQ ID NO: 2447545 - protein, 4 aa, Entamoeba dispar
NKGI

SEQ ID NO: 2447546 - protein, 9 aa, Entamoeba dispar
NKGINENQK

SEQ ID NO: 2447547 - protein, 9 aa, Entamoeba dispar
NKGITKESV

SEQ ID NO: 2447548 - protein, 6 aa, Entamoeba dispar
NKGLDQ

SEQ ID NO: 2447549 - protein, 5 aa, Entamoeba dispar
NKGNE

SEQ ID NO: 2447550 - protein, 7 aa, Entamoeba dispar
NKGNEQA

SEQ ID NO: 2447551 - protein, 9 aa, Entamoeba dispar
NKGNGDRVQ

SEQ ID NO: 2447552 - protein, 23 aa, Entamoeba dispar
NKGNIAKPAELSKAFPGKSGDEI

SEQ ID NO: 2447553 - protein, 7 aa, Entamoeba dispar
NKGNYPN

SEQ ID NO: 2447554 - protein, 4 aa, Entamoeba dispar
NKGS

SEQ ID NO: 2447555 - protein, 9 aa, Entamoeba dispar
NKGSQTKVE

SEQ ID NO: 2447556 - protein, 7 aa, Entamoeba dispar
NKGTREQ

SEQ ID NO: 2447557 - protein, 10 aa, Entamoeba dispar
NKGVNESSPS

SEQ ID NO: 2447558 - protein, 7 aa, Entamoeba dispar
NKGVPGY

SEQ ID NO: 2447559 - protein, 5 aa, Entamoeba dispar
NKGVT

SEQ ID NO: 2447560 - protein, 6 aa, Entamoeba dispar
NKGYSS

SEQ ID NO: 2447561 - protein, 4 aa, Entamoeba dispar
NKHC

SEQ ID NO: 2447562 - protein, 12 aa, Entamoeba dispar
NKHEALTNELND

SEQ ID NO: 2447563 - protein, 20 aa, Entamoeba dispar
NKHEALTNELNDMEKELVKN

SEQ ID NO: 2447564 - protein, 10 aa, Entamoeba dispar
NKHGEYPESV

SEQ ID NO: 2447565 - protein, 7 aa, Entamoeba dispar
NKHGGAV

SEQ ID NO: 2447566 - protein, 15 aa, Entamoeba dispar
NKHIKEQLKAGGLQH

SEQ ID NO: 2447567 - protein, 14 aa, Entamoeba dispar
NKHKSDNETLQRSS

SEQ ID NO: 2447568 - protein, 18 aa, Entamoeba dispar
NKHQNKTMNEKDEVIEND

SEQ ID NO: 2447569 - protein, 7 aa, Entamoeba dispar
NKHQPKG

SEQ ID NO: 2447570 - protein, 4 aa, Entamoeba dispar
NKHT

SEQ ID NO: 2447571 - protein, 5 aa, Entamoeba dispar
NKHTE

SEQ ID NO: 2447572 - protein, 4 aa, Entamoeba dispar
NKIA

SEQ ID NO: 2447573 - protein, 6 aa, Entamoeba dispar
NKIASS

SEQ ID NO: 2447574 - protein, 7 aa, Entamoeba dispar
NKIATGQ

SEQ ID NO: 2447575 - protein, 4 aa, Entamoeba dispar
NKIE

SEQ ID NO: 2447576 - protein, 14 aa, Entamoeba dispar
NKIEEAKKKLEEIQ

SEQ ID NO: 2447577 - protein, 34 aa, Entamoeba dispar
NKIEEEIKSTEEKYASIDRTEYEKEFKEATKLGD

SEQ ID NO: 2447578 - protein, 8 aa, Entamoeba dispar
NKIEETSF

SEQ ID NO: 2447579 - protein, 14 aa, Entamoeba dispar
NKIEKVKKSSKQDE

SEQ ID NO: 2447580 - protein, 9 aa, Entamoeba dispar
NKIEQDNNC

SEQ ID NO: 2447581 - protein, 13 aa, Entamoeba dispar
NKIEQQNKNYEDL

SEQ ID NO: 2447582 - protein, 47 aa, Entamoeba dispar
NKIEREEEKKQVEQQIEELKKEKKEEENKKEELKKQLNEEQKEKSNV

SEQ ID NO: 2447583 - protein, 6 aa, Entamoeba dispar
NKIERM

SEQ ID NO: 2447584 - protein, 21 aa, Entamoeba dispar
NKIESEDKKVNDTKTICDKNE

SEQ ID NO: 2447585 - protein, 7 aa, Entamoeba dispar
NKIGAGE

SEQ ID NO: 2447586 - protein, 6 aa, Entamoeba dispar
NKIGDE

SEQ ID NO: 2447587 - protein, 11 aa, Entamoeba dispar
NKIGDPKRGLA

SEQ ID NO: 2447588 - protein, 7 aa, Entamoeba dispar
NKIGKGG

SEQ ID NO: 2447589 - protein, 9 aa, Entamoeba dispar
NKIKKNENF

SEQ ID NO: 2447590 - protein, 15 aa, Entamoeba dispar
NKIKPKEKEERKKLT

SEQ ID NO: 2447591 - protein, 5 aa, Entamoeba dispar
NKIKR

SEQ ID NO: 2447592 - protein, 4 aa, Entamoeba dispar
NKIL

SEQ ID NO: 2447593 - protein, 4 aa, Entamoeba dispar
NKIM

SEQ ID NO: 2447594 - protein, 7 aa, Entamoeba dispar
NKINANT

SEQ ID NO: 2447595 - protein, 18 aa, Entamoeba dispar
NKINEEEDKKEERSNIGE

SEQ ID NO: 2447596 - protein, 8 aa, Entamoeba dispar
NKINENDS

SEQ ID NO: 2447597 - protein, 10 aa, Entamoeba dispar
NKINENSDTP

SEQ ID NO: 2447598 - protein, 9 aa, Entamoeba dispar
NKINGLTPN

SEQ ID NO: 2447599 - protein, 6 aa, Entamoeba dispar
NKINKP

SEQ ID NO: 2447600 - protein, 8 aa, Entamoeba dispar
NKINQRNH

SEQ ID NO: 2447601 - protein, 4 aa, Entamoeba dispar
NKIP

SEQ ID NO: 2447602 - protein, 6 aa, Entamoeba dispar
NKIPQA

SEQ ID NO: 2447603 - protein, 8 aa, Entamoeba dispar
NKIPRSLN

SEQ ID NO: 2447604 - protein, 8 aa, Entamoeba dispar
NKIPSNPQ

SEQ ID NO: 2447605 - protein, 5 aa, Entamoeba dispar
NKIPV

SEQ ID NO: 2447606 - protein, 31 aa, Entamoeba dispar
NKIQGKSPKIPSTPRKEVEKKERKEPTEKTK

SEQ ID NO: 2447607 - protein, 5 aa, Entamoeba dispar
NKIQQ

SEQ ID NO: 2447608 - protein, 9 aa, Entamoeba dispar
NKIQQPGTL

SEQ ID NO: 2447609 - protein, 8 aa, Entamoeba dispar
NKIREKAH

SEQ ID NO: 2447610 - protein, 5 aa, Entamoeba dispar
NKISE

SEQ ID NO: 2447611 - protein, 39 aa, Entamoeba dispar
NKISEGEETKQEDDDGWEEVGKKSKKIQLRSEKTDGTSI

SEQ ID NO: 2447612 - protein, 8 aa, Entamoeba dispar
NKISGSPI

SEQ ID NO: 2447613 - protein, 5 aa, Entamoeba dispar
NKISQ

SEQ ID NO: 2447614 - protein, 39 aa, Entamoeba dispar
NKISSGRNGNVKNNLNSKNYTGAVNSNNIGNNNIQGSNA

SEQ ID NO: 2447615 - protein, 5 aa, Entamoeba dispar
NKITK

SEQ ID NO: 2447616 - protein, 7 aa, Entamoeba dispar
NKITKES

SEQ ID NO: 2447617 - protein, 12 aa, Entamoeba dispar
NKITQNEDPLTR

SEQ ID NO: 2447618 - protein, 5 aa, Entamoeba dispar
NKITS

SEQ ID NO: 2447619 - protein, 8 aa, Entamoeba dispar
NKITSDEA

SEQ ID NO: 2447620 - protein, 14 aa, Entamoeba dispar
NKITSLPNKPDMSR

SEQ ID NO: 2447621 - protein, 9 aa, Entamoeba dispar
NKKAASENL

SEQ ID NO: 2447622 - protein, 8 aa, Entamoeba dispar
NKKASNEV

SEQ ID NO: 2447623 - protein, 11 aa, Entamoeba dispar
NKKATSSISYT

SEQ ID NO: 2447624 - protein, 8 aa, Entamoeba dispar
NKKDEDTL

SEQ ID NO: 2447625 - protein, 6 aa, Entamoeba dispar
NKKDEL

SEQ ID NO: 2447626 - protein, 8 aa, Entamoeba dispar
NKKDKNEI

SEQ ID NO: 2447627 - protein, 10 aa, Entamoeba dispar
NKKDVDNESF

SEQ ID NO: 2447628 - protein, 4 aa, Entamoeba dispar
NKKE

SEQ ID NO: 2447629 - protein, 69 aa, Entamoeba dispar
NKKEEKKEEERKEEIEHKQKEEIKKEEIKEERIKKEEIKEEEIKKEEIKEEEIKKENIEEKGESEERNR

SEQ ID NO: 2447630 - protein, 8 aa, Entamoeba dispar
NKKEEKLK

SEQ ID NO: 2447631 - protein, 12 aa, Entamoeba dispar
NKKEKINNKEYP

SEQ ID NO: 2447632 - protein, 10 aa, Entamoeba dispar
NKKELKKEVE

SEQ ID NO: 2447633 - protein, 9 aa, Entamoeba dispar
NKKENENKI

SEQ ID NO: 2447634 - protein, 7 aa, Entamoeba dispar
NKKENTC

SEQ ID NO: 2447635 - protein, 6 aa, Entamoeba dispar
NKKEPI

SEQ ID NO: 2447636 - protein, 9 aa, Entamoeba dispar
NKKEPKFDD

SEQ ID NO: 2447637 - protein, 5 aa, Entamoeba dispar
NKKEY

SEQ ID NO: 2447638 - protein, 4 aa, Entamoeba dispar
NKKG

SEQ ID NO: 2447639 - protein, 14 aa, Entamoeba dispar
NKKGDLRKEYPGNI

SEQ ID NO: 2447640 - protein, 9 aa, Entamoeba dispar
NKKGEITTE

SEQ ID NO: 2447641 - protein, 14 aa, Entamoeba dispar
NKKGEQLPSIPNYP

SEQ ID NO: 2447642 - protein, 8 aa, Entamoeba dispar
NKKGERTV

SEQ ID NO: 2447643 - protein, 10 aa, Entamoeba dispar
NKKGQQGYLK

SEQ ID NO: 2447644 - protein, 5 aa, Entamoeba dispar
NKKHK

SEQ ID NO: 2447645 - protein, 7 aa, Entamoeba dispar
NKKIAKD

SEQ ID NO: 2447646 - protein, 7 aa, Entamoeba dispar
NKKIDED

SEQ ID NO: 2447647 - protein, 6 aa, Entamoeba dispar
NKKIDT

SEQ ID NO: 2447648 - protein, 9 aa, Entamoeba dispar
NKKIKKSVG

SEQ ID NO: 2447649 - protein, 15 aa, Entamoeba dispar
NKKINANDVERNSME

SEQ ID NO: 2447650 - protein, 8 aa, Entamoeba dispar
NKKIPKES

SEQ ID NO: 2447651 - protein, 18 aa, Entamoeba dispar
NKKIQQEISYNQQPSLQT

SEQ ID NO: 2447652 - protein, 7 aa, Entamoeba dispar
NKKIQRE

SEQ ID NO: 2447653 - protein, 14 aa, Entamoeba dispar
NKKKAQSDKELNSL

SEQ ID NO: 2447654 - protein, 47 aa, Entamoeba dispar
NKKKKAIAIKEANKEKEQKELKAQGKLNNSKQEKPIDLIGEEDEDII

SEQ ID NO: 2447655 - protein, 8 aa, Entamoeba dispar
NKKKKGIK

SEQ ID NO: 2447656 - protein, 10 aa, Entamoeba dispar
NKKKNTNKYS

SEQ ID NO: 2447657 - protein, 15 aa, Entamoeba dispar
NKKKQDLKNSKEQLQ

SEQ ID NO: 2447658 - protein, 16 aa, Entamoeba dispar
NKKKRSMSESNNPEIK

SEQ ID NO: 2447659 - protein, 8 aa, Entamoeba dispar
NKKKSNPI

SEQ ID NO: 2447660 - protein, 7 aa, Entamoeba dispar
NKKKTRV

SEQ ID NO: 2447661 - protein, 19 aa, Entamoeba dispar
NKKKYQEQEQKINQENASN

SEQ ID NO: 2447662 - protein, 10 aa, Entamoeba dispar
NKKLEQDDKE

SEQ ID NO: 2447663 - protein, 12 aa, Entamoeba dispar
NKKLGEQEDPSL

SEQ ID NO: 2447664 - protein, 5 aa, Entamoeba dispar
NKKMG

SEQ ID NO: 2447665 - protein, 8 aa, Entamoeba dispar
NKKMSKEI

SEQ ID NO: 2447666 - protein, 9 aa, Entamoeba dispar
NKKNGKVEE

SEQ ID NO: 2447667 - protein, 7 aa, Entamoeba dispar
NKKNKKL

SEQ ID NO: 2447668 - protein, 10 aa, Entamoeba dispar
NKKNKLNKLN

SEQ ID NO: 2447669 - protein, 5 aa, Entamoeba dispar
NKKNN

SEQ ID NO: 2447670 - protein, 8 aa, Entamoeba dispar
NKKNPEVE

SEQ ID NO: 2447671 - protein, 7 aa, Entamoeba dispar
NKKNSIT

SEQ ID NO: 2447672 - protein, 9 aa, Entamoeba dispar
NKKPKSIDF

SEQ ID NO: 2447673 - protein, 8 aa, Entamoeba dispar
NKKPLYQQ

SEQ ID NO: 2447674 - protein, 18 aa, Entamoeba dispar
NKKPSQLKDDTITPKTTN

SEQ ID NO: 2447675 - protein, 7 aa, Entamoeba dispar
NKKPYYA

SEQ ID NO: 2447676 - protein, 5 aa, Entamoeba dispar
NKKQI

SEQ ID NO: 2447677 - protein, 8 aa, Entamoeba dispar
NKKQRHAR

SEQ ID NO: 2447678 - protein, 8 aa, Entamoeba dispar
NKKQSYVN

SEQ ID NO: 2447679 - protein, 6 aa, Entamoeba dispar
NKKQTG

SEQ ID NO: 2447680 - protein, 10 aa, Entamoeba dispar
NKKQTSRNSN

SEQ ID NO: 2447681 - protein, 10 aa, Entamoeba dispar
NKKRDTKRTI

SEQ ID NO: 2447682 - protein, 6 aa, Entamoeba dispar
NKKRPN

SEQ ID NO: 2447683 - protein, 18 aa, Entamoeba dispar
NKKSFDKNEWKTKEKINK

SEQ ID NO: 2447684 - protein, 12 aa, Entamoeba dispar
NKKSGKSVVNGT

SEQ ID NO: 2447685 - protein, 7 aa, Entamoeba dispar
NKKSIEG

SEQ ID NO: 2447686 - protein, 7 aa, Entamoeba dispar
NKKSISF

SEQ ID NO: 2447687 - protein, 13 aa, Entamoeba dispar
NKKSLYDSSLSNH

SEQ ID NO: 2447688 - protein, 8 aa, Entamoeba dispar
NKKSNGNC

SEQ ID NO: 2447689 - protein, 8 aa, Entamoeba dispar
NKKSPQEL

SEQ ID NO: 2447690 - protein, 9 aa, Entamoeba dispar
NKKSTYTEK

SEQ ID NO: 2447691 - protein, 5 aa, Entamoeba dispar
NKKSV

SEQ ID NO: 2447692 - protein, 7 aa, Entamoeba dispar
NKKTDAI

SEQ ID NO: 2447693 - protein, 9 aa, Entamoeba dispar
NKKTDTVAR

SEQ ID NO: 2447694 - protein, 7 aa, Entamoeba dispar
NKKTEKA

SEQ ID NO: 2447695 - protein, 8 aa, Entamoeba dispar
NKKTGAAL

SEQ ID NO: 2447696 - protein, 13 aa, Entamoeba dispar
NKKTKNKEVKSQV

SEQ ID NO: 2447697 - protein, 5 aa, Entamoeba dispar
NKKTL

SEQ ID NO: 2447698 - protein, 7 aa, Entamoeba dispar
NKKTLSK

SEQ ID NO: 2447699 - protein, 8 aa, Entamoeba dispar
NKKTLSSM

SEQ ID NO: 2447700 - protein, 7 aa, Entamoeba dispar
NKKTNVV

SEQ ID NO: 2447701 - protein, 12 aa, Entamoeba dispar
NKKTREEKEIER

SEQ ID NO: 2447702 - protein, 13 aa, Entamoeba dispar
NKKTSPNDKSDSL

SEQ ID NO: 2447703 - protein, 8 aa, Entamoeba dispar
NKKVETIR

SEQ ID NO: 2447704 - protein, 8 aa, Entamoeba dispar
NKKWSKRS

SEQ ID NO: 2447705 - protein, 9 aa, Entamoeba dispar
NKKYSDTRE

SEQ ID NO: 2447706 - protein, 6 aa, Entamoeba dispar
NKLAYD

SEQ ID NO: 2447707 - protein, 5 aa, Entamoeba dispar
NKLDQ

SEQ ID NO: 2447708 - protein, 8 aa, Entamoeba dispar
NKLDSEKI

SEQ ID NO: 2447709 - protein, 18 aa, Entamoeba dispar
NKLEEATNNKVDNTIDSL

SEQ ID NO: 2447710 - protein, 6 aa, Entamoeba dispar
NKLEEY

SEQ ID NO: 2447711 - protein, 13 aa, Entamoeba dispar
NKLEQSKTLTKEA

SEQ ID NO: 2447712 - protein, 11 aa, Entamoeba dispar
NKLEQVPDPIS

SEQ ID NO: 2447713 - protein, 6 aa, Entamoeba dispar
NKLEYE

SEQ ID NO: 2447714 - protein, 8 aa, Entamoeba dispar
NKLGNRPI

SEQ ID NO: 2447715 - protein, 11 aa, Entamoeba dispar
NKLKKGEELND

SEQ ID NO: 2447716 - protein, 6 aa, Entamoeba dispar
NKLKKI

SEQ ID NO: 2447717 - protein, 8 aa, Entamoeba dispar
NKLKNGKS

SEQ ID NO: 2447718 - protein, 5 aa, Entamoeba dispar
NKLKT

SEQ ID NO: 2447719 - protein, 4 aa, Entamoeba dispar
NKLN

SEQ ID NO: 2447720 - protein, 12 aa, Entamoeba dispar
NKLNKQKKQLCE

SEQ ID NO: 2447721 - protein, 8 aa, Entamoeba dispar
NKLPSTSV

SEQ ID NO: 2447722 - protein, 15 aa, Entamoeba dispar
NKLPTECKRQVTGHS

SEQ ID NO: 2447723 - protein, 16 aa, Entamoeba dispar
NKLQKDAKKFCETRKQ

SEQ ID NO: 2447724 - protein, 6 aa, Entamoeba dispar
NKLQQQ

SEQ ID NO: 2447725 - protein, 16 aa, Entamoeba dispar
NKLQQRIEQLENSSNE

SEQ ID NO: 2447726 - protein, 23 aa, Entamoeba dispar
NKLQSDLKEEQIEGNKIKKQIDE

SEQ ID NO: 2447727 - protein, 14 aa, Entamoeba dispar
NKLRRDENKQHYSV

SEQ ID NO: 2447728 - protein, 5 aa, Entamoeba dispar
NKLSD

SEQ ID NO: 2447729 - protein, 10 aa, Entamoeba dispar
NKLSKIPPSI

SEQ ID NO: 2447730 - protein, 6 aa, Entamoeba dispar
NKLSNE

SEQ ID NO: 2447731 - protein, 8 aa, Entamoeba dispar
NKLSQSNP

SEQ ID NO: 2447732 - protein, 4 aa, Entamoeba dispar
NKLT

SEQ ID NO: 2447733 - protein, 13 aa, Entamoeba dispar
NKLTESVKNDTYQ

SEQ ID NO: 2447734 - protein, 13 aa, Entamoeba dispar
NKLTKQETELYQS

SEQ ID NO: 2447735 - protein, 12 aa, Entamoeba dispar
NKLTSNSVSTQK

SEQ ID NO: 2447736 - protein, 8 aa, Entamoeba dispar
NKMDTNGN

SEQ ID NO: 2447737 - protein, 7 aa, Entamoeba dispar
NKMGETE

SEQ ID NO: 2447738 - protein, 8 aa, Entamoeba dispar
NKMIPQGK

SEQ ID NO: 2447739 - protein, 8 aa, Entamoeba dispar
NKMNPRDV

SEQ ID NO: 2447740 - protein, 4 aa, Entamoeba dispar
NKMT

SEQ ID NO: 2447741 - protein, 16 aa, Entamoeba dispar
NKMTKTPIHETKIPET

SEQ ID NO: 2447742 - protein, 10 aa, Entamoeba dispar
NKMTTPEYRA

SEQ ID NO: 2447743 - protein, 4 aa, Entamoeba dispar
NKNC

SEQ ID NO: 2447744 - protein, 5 aa, Entamoeba dispar
NKNCE

SEQ ID NO: 2447745 - protein, 7 aa, Entamoeba dispar
NKNDDKG

SEQ ID NO: 2447746 - protein, 7 aa, Entamoeba dispar
NKNDDNL

SEQ ID NO: 2447747 - protein, 10 aa, Entamoeba dispar
NKNDIDSYKK

SEQ ID NO: 2447748 - protein, 9 aa, Entamoeba dispar
NKNDPDEIY

SEQ ID NO: 2447749 - protein, 12 aa, Entamoeba dispar
NKNECPNDDYSS

SEQ ID NO: 2447750 - protein, 10 aa, Entamoeba dispar
NKNEDVSRNA

SEQ ID NO: 2447751 - protein, 14 aa, Entamoeba dispar
NKNEERRSISPKRK

SEQ ID NO: 2447752 - protein, 6 aa, Entamoeba dispar
NKNEGN

SEQ ID NO: 2447753 - protein, 21 aa, Entamoeba dispar
NKNEKQKIEEVEKEIDKTDSV

SEQ ID NO: 2447754 - protein, 8 aa, Entamoeba dispar
NKNELTSV

SEQ ID NO: 2447755 - protein, 8 aa, Entamoeba dispar
NKNENGIN

SEQ ID NO: 2447756 - protein, 8 aa, Entamoeba dispar
NKNEQALE

SEQ ID NO: 2447757 - protein, 35 aa, Entamoeba dispar
NKNEQKIEDKKESKSIKDNNNDNKKPNDTKKAETF

SEQ ID NO: 2447758 - protein, 7 aa, Entamoeba dispar
NKNESIP

SEQ ID NO: 2447759 - protein, 6 aa, Entamoeba dispar
NKNESL

SEQ ID NO: 2447760 - protein, 7 aa, Entamoeba dispar
NKNESTK

SEQ ID NO: 2447761 - protein, 6 aa, Entamoeba dispar
NKNEYH

SEQ ID NO: 2447762 - protein, 9 aa, Entamoeba dispar
NKNGVGDPT

SEQ ID NO: 2447763 - protein, 5 aa, Entamoeba dispar
NKNIT

SEQ ID NO: 2447764 - protein, 9 aa, Entamoeba dispar
NKNKEDEKY

SEQ ID NO: 2447765 - protein, 18 aa, Entamoeba dispar
NKNKEEEKEKVQQLSENK

SEQ ID NO: 2447766 - protein, 15 aa, Entamoeba dispar
NKNKEVAANYLFERG

SEQ ID NO: 2447767 - protein, 8 aa, Entamoeba dispar
NKNKFTRH

SEQ ID NO: 2447768 - protein, 7 aa, Entamoeba dispar
NKNKGFS

SEQ ID NO: 2447769 - protein, 8 aa, Entamoeba dispar
NKNKKGKV

SEQ ID NO: 2447770 - protein, 9 aa, Entamoeba dispar
NKNKNYSLP

SEQ ID NO: 2447771 - protein, 12 aa, Entamoeba dispar
NKNKRKYPTESC

SEQ ID NO: 2447772 - protein, 8 aa, Entamoeba dispar
NKNKTLKD

SEQ ID NO: 2447773 - protein, 7 aa, Entamoeba dispar
NKNLNGE

SEQ ID NO: 2447774 - protein, 7 aa, Entamoeba dispar
NKNMPVE

SEQ ID NO: 2447775 - protein, 6 aa, Entamoeba dispar
NKNNDD

SEQ ID NO: 2447776 - protein, 8 aa, Entamoeba dispar
NKNNKYDD

SEQ ID NO: 2447777 - protein, 6 aa, Entamoeba dispar
NKNNNQ

SEQ ID NO: 2447778 - protein, 7 aa, Entamoeba dispar
NKNNYLP

SEQ ID NO: 2447779 - protein, 5 aa, Entamoeba dispar
NKNPI

SEQ ID NO: 2447780 - protein, 7 aa, Entamoeba dispar
NKNPNCS

SEQ ID NO: 2447781 - protein, 6 aa, Entamoeba dispar
NKNPVD

SEQ ID NO: 2447782 - protein, 7 aa, Entamoeba dispar
NKNQFET

SEQ ID NO: 2447783 - protein, 7 aa, Entamoeba dispar
NKNQPNI

SEQ ID NO: 2447784 - protein, 7 aa, Entamoeba dispar
NKNQSTL

SEQ ID NO: 2447785 - protein, 5 aa, Entamoeba dispar
NKNRI

SEQ ID NO: 2447786 - protein, 5 aa, Entamoeba dispar
NKNSF

SEQ ID NO: 2447787 - protein, 8 aa, Entamoeba dispar
NKNSIEGA

SEQ ID NO: 2447788 - protein, 6 aa, Entamoeba dispar
NKNSYL

SEQ ID NO: 2447789 - protein, 7 aa, Entamoeba dispar
NKNTILE

SEQ ID NO: 2447790 - protein, 5 aa, Entamoeba dispar
NKNTS

SEQ ID NO: 2447791 - protein, 18 aa, Entamoeba dispar
NKNTTPPSRSNGLSQSLN

SEQ ID NO: 2447792 - protein, 9 aa, Entamoeba dispar
NKNVPEEGL

SEQ ID NO: 2447793 - protein, 7 aa, Entamoeba dispar
NKNYNQR

SEQ ID NO: 2447794 - protein, 6 aa, Entamoeba dispar
NKNYQI

SEQ ID NO: 2447795 - protein, 8 aa, Entamoeba dispar
NKNYQKTG

SEQ ID NO: 2447796 - protein, 13 aa, Entamoeba dispar
NKNYQWNNENESI

SEQ ID NO: 2447797 - protein, 7 aa, Entamoeba dispar
NKNYSSQ

SEQ ID NO: 2447798 - protein, 12 aa, Entamoeba dispar
NKPCPQPQTSEH

SEQ ID NO: 2447799 - protein, 5 aa, Entamoeba dispar
NKPDP

SEQ ID NO: 2447800 - protein, 5 aa, Entamoeba dispar
NKPEL

SEQ ID NO: 2447801 - protein, 5 aa, Entamoeba dispar
NKPEM

SEQ ID NO: 2447802 - protein, 16 aa, Entamoeba dispar
NKPENKEQKRSNQLKS

SEQ ID NO: 2447803 - protein, 9 aa, Entamoeba dispar
NKPENVSSI

SEQ ID NO: 2447804 - protein, 6 aa, Entamoeba dispar
NKPERD

SEQ ID NO: 2447805 - protein, 8 aa, Entamoeba dispar
NKPEYRKK

SEQ ID NO: 2447806 - protein, 7 aa, Entamoeba dispar
NKPFDDE

SEQ ID NO: 2447807 - protein, 5 aa, Entamoeba dispar
NKPFE

SEQ ID NO: 2447808 - protein, 14 aa, Entamoeba dispar
NKPFTTDRIIILQL

SEQ ID NO: 2447809 - protein, 8 aa, Entamoeba dispar
NKPGTLPQ

SEQ ID NO: 2447810 - protein, 6 aa, Entamoeba dispar
NKPIIE

SEQ ID NO: 2447811 - protein, 5 aa, Entamoeba dispar
NKPIK

SEQ ID NO: 2447812 - protein, 20 aa, Entamoeba dispar
NKPIRQENIASSAPPSDNPI

SEQ ID NO: 2447813 - protein, 11 aa, Entamoeba dispar
NKPKEGKPGKI

SEQ ID NO: 2447814 - protein, 12 aa, Entamoeba dispar
NKPKKERENSQM

SEQ ID NO: 2447815 - protein, 5 aa, Entamoeba dispar
NKPKT

SEQ ID NO: 2447816 - protein, 8 aa, Entamoeba dispar
NKPKTEDC

SEQ ID NO: 2447817 - protein, 16 aa, Entamoeba dispar
NKPKTILEGEKGIKEL

SEQ ID NO: 2447818 - protein, 7 aa, Entamoeba dispar
NKPKVNR

SEQ ID NO: 2447819 - protein, 8 aa, Entamoeba dispar
NKPLPSDR

SEQ ID NO: 2447820 - protein, 7 aa, Entamoeba dispar
NKPLSKT

SEQ ID NO: 2447821 - protein, 10 aa, Entamoeba dispar
NKPNEDISRS

SEQ ID NO: 2447822 - protein, 8 aa, Entamoeba dispar
NKPNGSLT

SEQ ID NO: 2447823 - protein, 12 aa, Entamoeba dispar
NKPNKKYKENEI

SEQ ID NO: 2447824 - protein, 7 aa, Entamoeba dispar
NKPNKPA

SEQ ID NO: 2447825 - protein, 6 aa, Entamoeba dispar
NKPNQK

SEQ ID NO: 2447826 - protein, 8 aa, Entamoeba dispar
NKPNSYSF

SEQ ID NO: 2447827 - protein, 7 aa, Entamoeba dispar
NKPPISV

SEQ ID NO: 2447828 - protein, 7 aa, Entamoeba dispar
NKPQEDF

SEQ ID NO: 2447829 - protein, 7 aa, Entamoeba dispar
NKPQKAI

SEQ ID NO: 2447830 - protein, 8 aa, Entamoeba dispar
NKPQYRNE

SEQ ID NO: 2447831 - protein, 5 aa, Entamoeba dispar
NKPRV

SEQ ID NO: 2447832 - protein, 8 aa, Entamoeba dispar
NKPSDALT

SEQ ID NO: 2447833 - protein, 7 aa, Entamoeba dispar
NKPSNEI

SEQ ID NO: 2447834 - protein, 8 aa, Entamoeba dispar
NKPSYTEV

SEQ ID NO: 2447835 - protein, 5 aa, Entamoeba dispar
NKPTG

SEQ ID NO: 2447836 - protein, 12 aa, Entamoeba dispar
NKPTHCVKVVIQ

SEQ ID NO: 2447837 - protein, 5 aa, Entamoeba dispar
NKPTK

SEQ ID NO: 2447838 - protein, 29 aa, Entamoeba dispar
NKPTPKASTTTQPKSQESTQQKKKSKCLL

SEQ ID NO: 2447839 - protein, 9 aa, Entamoeba dispar
NKPTPLSDE

SEQ ID NO: 2447840 - protein, 16 aa, Entamoeba dispar
NKPTSDIEQPLSKRKL

SEQ ID NO: 2447841 - protein, 12 aa, Entamoeba dispar
NKPVEVGKTGEE

SEQ ID NO: 2447842 - protein, 5 aa, Entamoeba dispar
NKPVN

SEQ ID NO: 2447843 - protein, 14 aa, Entamoeba dispar
NKPYPDKPFSTVEK

SEQ ID NO: 2447844 - protein, 7 aa, Entamoeba dispar
NKPYPTI

SEQ ID NO: 2447845 - protein, 5 aa, Entamoeba dispar
NKQAM

SEQ ID NO: 2447846 - protein, 10 aa, Entamoeba dispar
NKQDKPVPKL

SEQ ID NO: 2447847 - protein, 6 aa, Entamoeba dispar
NKQDTM

SEQ ID NO: 2447848 - protein, 4 aa, Entamoeba dispar
NKQE

SEQ ID NO: 2447849 - protein, 11 aa, Entamoeba dispar
NKQEETIGKYS

SEQ ID NO: 2447850 - protein, 7 aa, Entamoeba dispar
NKQENLR

SEQ ID NO: 2447851 - protein, 6 aa, Entamoeba dispar
NKQEPI

SEQ ID NO: 2447852 - protein, 4 aa, Entamoeba dispar
NKQF

SEQ ID NO: 2447853 - protein, 4 aa, Entamoeba dispar
NKQG

SEQ ID NO: 2447854 - protein, 6 aa, Entamoeba dispar
NKQGIT

SEQ ID NO: 2447855 - protein, 6 aa, Entamoeba dispar
NKQGLK

SEQ ID NO: 2447856 - protein, 7 aa, Entamoeba dispar
NKQIEGD

SEQ ID NO: 2447857 - protein, 6 aa, Entamoeba dispar
NKQIRN

SEQ ID NO: 2447858 - protein, 7 aa, Entamoeba dispar
NKQKDIN

SEQ ID NO: 2447859 - protein, 9 aa, Entamoeba dispar
NKQKKGLQL

SEQ ID NO: 2447860 - protein, 5 aa, Entamoeba dispar
NKQKR

SEQ ID NO: 2447861 - protein, 61 aa, Entamoeba dispar
NKQKRVEAYSPRSSSSENDDSQLKRKRGRSRSKSKEKQSRDSRENSSLGSVGDSPYTSPLH

SEQ ID NO: 2447862 - protein, 7 aa, Entamoeba dispar
NKQKTEI

SEQ ID NO: 2447863 - protein, 6 aa, Entamoeba dispar
NKQKTK

SEQ ID NO: 2447864 - protein, 4 aa, Entamoeba dispar
NKQL

SEQ ID NO: 2447865 - protein, 8 aa, Entamoeba dispar
NKQLSRED

SEQ ID NO: 2447866 - protein, 7 aa, Entamoeba dispar
NKQNEEI

SEQ ID NO: 2447867 - protein, 7 aa, Entamoeba dispar
NKQNGYK

SEQ ID NO: 2447868 - protein, 11 aa, Entamoeba dispar
NKQNKESKEKI

SEQ ID NO: 2447869 - protein, 14 aa, Entamoeba dispar
NKQPNTPVTSPSQF

SEQ ID NO: 2447870 - protein, 7 aa, Entamoeba dispar
NKQPPYK

SEQ ID NO: 2447871 - protein, 7 aa, Entamoeba dispar
NKQPTQI

SEQ ID NO: 2447872 - protein, 4 aa, Entamoeba dispar
NKQQ

SEQ ID NO: 2447873 - protein, 14 aa, Entamoeba dispar
NKQQSPTTETTPLL

SEQ ID NO: 2447874 - protein, 10 aa, Entamoeba dispar
NKQQTDALKS

SEQ ID NO: 2447875 - protein, 11 aa, Entamoeba dispar
NKQRPADQQAA

SEQ ID NO: 2447876 - protein, 13 aa, Entamoeba dispar
NKQSLDNKTPSSK

SEQ ID NO: 2447877 - protein, 6 aa, Entamoeba dispar
NKQTGK

SEQ ID NO: 2447878 - protein, 5 aa, Entamoeba dispar
NKQTL

SEQ ID NO: 2447879 - protein, 7 aa, Entamoeba dispar
NKQTLQD

SEQ ID NO: 2447880 - protein, 5 aa, Entamoeba dispar
NKQTN

SEQ ID NO: 2447881 - protein, 13 aa, Entamoeba dispar
NKQTTEDNPVKGK

SEQ ID NO: 2447882 - protein, 6 aa, Entamoeba dispar
NKQVKK

SEQ ID NO: 2447883 - protein, 24 aa, Entamoeba dispar
NKQYEKLKKQYKRLAAAKDSDDDS

SEQ ID NO: 2447884 - protein, 6 aa, Entamoeba dispar
NKRCTE

SEQ ID NO: 2447885 - protein, 9 aa, Entamoeba dispar
NKRDELDSP

SEQ ID NO: 2447886 - protein, 5 aa, Entamoeba dispar
NKREE

SEQ ID NO: 2447887 - protein, 22 aa, Entamoeba dispar
NKREGSSGKIFDKKKSESLSLN

SEQ ID NO: 2447888 - protein, 8 aa, Entamoeba dispar
NKREMNED

SEQ ID NO: 2447889 - protein, 12 aa, Entamoeba dispar
NKRERGEALSKT

SEQ ID NO: 2447890 - protein, 10 aa, Entamoeba dispar
NKRGEEVEGC

SEQ ID NO: 2447891 - protein, 8 aa, Entamoeba dispar
NKRGSQTK

SEQ ID NO: 2447892 - protein, 7 aa, Entamoeba dispar
NKRGYRE

SEQ ID NO: 2447893 - protein, 7 aa, Entamoeba dispar
NKRHPTI

SEQ ID NO: 2447894 - protein, 4 aa, Entamoeba dispar
NKRI

SEQ ID NO: 2447895 - protein, 12 aa, Entamoeba dispar
NKRIPRECFDRG

SEQ ID NO: 2447896 - protein, 6 aa, Entamoeba dispar
NKRKDC

SEQ ID NO: 2447897 - protein, 6 aa, Entamoeba dispar
NKRKDV

SEQ ID NO: 2447898 - protein, 8 aa, Entamoeba dispar
NKRKKEIN

SEQ ID NO: 2447899 - protein, 8 aa, Entamoeba dispar
NKRKMENQ

SEQ ID NO: 2447900 - protein, 8 aa, Entamoeba dispar
NKRLDEAT

SEQ ID NO: 2447901 - protein, 10 aa, Entamoeba dispar
NKRMTEKSKL

SEQ ID NO: 2447902 - protein, 11 aa, Entamoeba dispar
NKRNHTAATNN

SEQ ID NO: 2447903 - protein, 9 aa, Entamoeba dispar
NKRNLLPSS

SEQ ID NO: 2447904 - protein, 6 aa, Entamoeba dispar
NKRNNI

SEQ ID NO: 2447905 - protein, 35 aa, Entamoeba dispar
NKRNYYDNLESSDDELSSNDEMSSSAFEEEYENNN

SEQ ID NO: 2447906 - protein, 13 aa, Entamoeba dispar
NKRPDEKKSEVHK

SEQ ID NO: 2447907 - protein, 6 aa, Entamoeba dispar
NKRPNI

SEQ ID NO: 2447908 - protein, 8 aa, Entamoeba dispar
NKRPSIVK

SEQ ID NO: 2447909 - protein, 5 aa, Entamoeba dispar
NKRPV

SEQ ID NO: 2447910 - protein, 4 aa, Entamoeba dispar
NKRQ

SEQ ID NO: 2447911 - protein, 6 aa, Entamoeba dispar
NKRQMK

SEQ ID NO: 2447912 - protein, 10 aa, Entamoeba dispar
NKRSNARQRK

SEQ ID NO: 2447913 - protein, 8 aa, Entamoeba dispar
NKRSVQAK

SEQ ID NO: 2447914 - protein, 4 aa, Entamoeba dispar
NKRT

SEQ ID NO: 2447915 - protein, 8 aa, Entamoeba dispar
NKRTKKEF

SEQ ID NO: 2447916 - protein, 41 aa, Entamoeba dispar
NKSAGDDDIKQGMNYSKKPVDVMNENSNDSPIEEFPKEEIP

SEQ ID NO: 2447917 - protein, 8 aa, Entamoeba dispar
NKSANEIE

SEQ ID NO: 2447918 - protein, 7 aa, Entamoeba dispar
NKSDDSI

SEQ ID NO: 2447919 - protein, 65 aa, Entamoeba dispar
NKSDEEAKSVEEEKADGENEDMVETKELEQDLTGDINQNQDNGKGNMNEEQKNTEDIEAEHTPMD

SEQ ID NO: 2447920 - protein, 7 aa, Entamoeba dispar
NKSDLDP

SEQ ID NO: 2447921 - protein, 10 aa, Entamoeba dispar
NKSDLSNART

SEQ ID NO: 2447922 - protein, 8 aa, Entamoeba dispar
NKSDSNWR

SEQ ID NO: 2447923 - protein, 12 aa, Entamoeba dispar
NKSDSPNPTVSK

SEQ ID NO: 2447924 - protein, 11 aa, Entamoeba dispar
NKSDYTNPEIE

SEQ ID NO: 2447925 - protein, 4 aa, Entamoeba dispar
NKSE

SEQ ID NO: 2447926 - protein, 4 aa, Entamoeba dispar
NKSG

SEQ ID NO: 2447927 - protein, 7 aa, Entamoeba dispar
NKSGKIP

SEQ ID NO: 2447928 - protein, 7 aa, Entamoeba dispar
NKSGYFD

SEQ ID NO: 2447929 - protein, 7 aa, Entamoeba dispar
NKSHNIK

SEQ ID NO: 2447930 - protein, 8 aa, Entamoeba dispar
NKSIEKDD

SEQ ID NO: 2447931 - protein, 5 aa, Entamoeba dispar
NKSII

SEQ ID NO: 2447932 - protein, 5 aa, Entamoeba dispar
NKSIK

SEQ ID NO: 2447933 - protein, 8 aa, Entamoeba dispar
NKSINEHQ

SEQ ID NO: 2447934 - protein, 14 aa, Entamoeba dispar
NKSIPEYCFKDPNE

SEQ ID NO: 2447935 - protein, 6 aa, Entamoeba dispar
NKSISS

SEQ ID NO: 2447936 - protein, 9 aa, Entamoeba dispar
NKSKALEGK

SEQ ID NO: 2447937 - protein, 17 aa, Entamoeba dispar
NKSKFYDHQKPLAIPIE

SEQ ID NO: 2447938 - protein, 6 aa, Entamoeba dispar
NKSKIG

SEQ ID NO: 2447939 - protein, 8 aa, Entamoeba dispar
NKSKITKR

SEQ ID NO: 2447940 - protein, 7 aa, Entamoeba dispar
NKSKQLE

SEQ ID NO: 2447941 - protein, 5 aa, Entamoeba dispar
NKSKV

SEQ ID NO: 2447942 - protein, 6 aa, Entamoeba dispar
NKSLPY

SEQ ID NO: 2447943 - protein, 35 aa, Entamoeba dispar
NKSLQKESKDFSDSKDSRNGSKSSSLGSSIFKERF

SEQ ID NO: 2447944 - protein, 10 aa, Entamoeba dispar
NKSLQQNGEI

SEQ ID NO: 2447945 - protein, 12 aa, Entamoeba dispar
NKSMNYSKIDPS

SEQ ID NO: 2447946 - protein, 9 aa, Entamoeba dispar
NKSMTTKQM

SEQ ID NO: 2447947 - protein, 7 aa, Entamoeba dispar
NKSNDVR

SEQ ID NO: 2447948 - protein, 9 aa, Entamoeba dispar
NKSNEKEKG

SEQ ID NO: 2447949 - protein, 13 aa, Entamoeba dispar
NKSNEMDREEANY

SEQ ID NO: 2447950 - protein, 17 aa, Entamoeba dispar
NKSNGKEFTEEECNTIK

SEQ ID NO: 2447951 - protein, 9 aa, Entamoeba dispar
NKSNKKSEL

SEQ ID NO: 2447952 - protein, 8 aa, Entamoeba dispar
NKSNMTQT

SEQ ID NO: 2447953 - protein, 7 aa, Entamoeba dispar
NKSNQYT

SEQ ID NO: 2447954 - protein, 7 aa, Entamoeba dispar
NKSNTAF

SEQ ID NO: 2447955 - protein, 7 aa, Entamoeba dispar
NKSNYPK

SEQ ID NO: 2447956 - protein, 20 aa, Entamoeba dispar
NKSQSKSSSKVSNSGRQPLS

SEQ ID NO: 2447957 - protein, 11 aa, Entamoeba dispar
NKSRKHSLDQP

SEQ ID NO: 2447958 - protein, 17 aa, Entamoeba dispar
NKSSANSIIKEKTGSSH

SEQ ID NO: 2447959 - protein, 8 aa, Entamoeba dispar
NKSSDWEN

SEQ ID NO: 2447960 - protein, 9 aa, Entamoeba dispar
NKSSFNQFS

SEQ ID NO: 2447961 - protein, 10 aa, Entamoeba dispar
NKSSKEPSLS

SEQ ID NO: 2447962 - protein, 9 aa, Entamoeba dispar
NKSSPSVVA

SEQ ID NO: 2447963 - protein, 9 aa, Entamoeba dispar
NKSSSESIQ

SEQ ID NO: 2447964 - protein, 9 aa, Entamoeba dispar
NKSSTSKKN

SEQ ID NO: 2447965 - protein, 5 aa, Entamoeba dispar
NKSSV

SEQ ID NO: 2447966 - protein, 5 aa, Entamoeba dispar
NKSTF

SEQ ID NO: 2447967 - protein, 9 aa, Entamoeba dispar
NKSTGELDI

SEQ ID NO: 2447968 - protein, 9 aa, Entamoeba dispar
NKSTGKQNF

SEQ ID NO: 2447969 - protein, 8 aa, Entamoeba dispar
NKSTQTEI

SEQ ID NO: 2447970 - protein, 8 aa, Entamoeba dispar
NKSTTNKD

SEQ ID NO: 2447971 - protein, 9 aa, Entamoeba dispar
NKSTTPSII

SEQ ID NO: 2447972 - protein, 12 aa, Entamoeba dispar
NKSVTRPTRDIS

SEQ ID NO: 2447973 - protein, 6 aa, Entamoeba dispar
NKSYEI

SEQ ID NO: 2447974 - protein, 8 aa, Entamoeba dispar
NKTAGEVR

SEQ ID NO: 2447975 - protein, 5 aa, Entamoeba dispar
NKTAL

SEQ ID NO: 2447976 - protein, 7 aa, Entamoeba dispar
NKTAPLG

SEQ ID NO: 2447977 - protein, 7 aa, Entamoeba dispar
NKTCEED

SEQ ID NO: 2447978 - protein, 19 aa, Entamoeba dispar
NKTCEEEKIKNQNGKCNNN

SEQ ID NO: 2447979 - protein, 4 aa, Entamoeba dispar
NKTD

SEQ ID NO: 2447980 - protein, 8 aa, Entamoeba dispar
NKTDESLK

SEQ ID NO: 2447981 - protein, 5 aa, Entamoeba dispar
NKTDF

SEQ ID NO: 2447982 - protein, 9 aa, Entamoeba dispar
NKTDLESTR

SEQ ID NO: 2447983 - protein, 7 aa, Entamoeba dispar
NKTDLTR

SEQ ID NO: 2447984 - protein, 6 aa, Entamoeba dispar
NKTEAF

SEQ ID NO: 2447985 - protein, 16 aa, Entamoeba dispar
NKTEPFARSFNDEKKW

SEQ ID NO: 2447986 - protein, 7 aa, Entamoeba dispar
NKTEPVS

SEQ ID NO: 2447987 - protein, 8 aa, Entamoeba dispar
NKTFSESI

SEQ ID NO: 2447988 - protein, 10 aa, Entamoeba dispar
NKTGEFDGHD

SEQ ID NO: 2447989 - protein, 17 aa, Entamoeba dispar
NKTGELSQKEKRKIPKQ

SEQ ID NO: 2447990 - protein, 12 aa, Entamoeba dispar
NKTGIDSQNKLG

SEQ ID NO: 2447991 - protein, 5 aa, Entamoeba dispar
NKTHQ

SEQ ID NO: 2447992 - protein, 12 aa, Entamoeba dispar
NKTHRDQQQQYR

SEQ ID NO: 2447993 - protein, 4 aa, Entamoeba dispar
NKTI

SEQ ID NO: 2447994 - protein, 17 aa, Entamoeba dispar
NKTIEDAKDQEKDLRDE

SEQ ID NO: 2447995 - protein, 11 aa, Entamoeba dispar
NKTIEGGRSYK

SEQ ID NO: 2447996 - protein, 11 aa, Entamoeba dispar
NKTIEHKPMNE

SEQ ID NO: 2447997 - protein, 5 aa, Entamoeba dispar
NKTIK

SEQ ID NO: 2447998 - protein, 6 aa, Entamoeba dispar
NKTIPE

SEQ ID NO: 2447999 - protein, 12 aa, Entamoeba dispar
NKTIPRNCFDEW

SEQ ID NO: 2448000 - protein, 7 aa, Entamoeba dispar
NKTKDEF

SEQ ID NO: 2448001 - protein, 9 aa, Entamoeba dispar
NKTKEAAKQ

SEQ ID NO: 2448002 - protein, 6 aa, Entamoeba dispar
NKTKEC

SEQ ID NO: 2448003 - protein, 5 aa, Entamoeba dispar
NKTKM

SEQ ID NO: 2448004 - protein, 6 aa, Entamoeba dispar
NKTKMR

SEQ ID NO: 2448005 - protein, 5 aa, Entamoeba dispar
NKTLT

SEQ ID NO: 2448006 - protein, 6 aa, Entamoeba dispar
NKTNES

SEQ ID NO: 2448007 - protein, 11 aa, Entamoeba dispar
NKTNKEVTPNA

SEQ ID NO: 2448008 - protein, 12 aa, Entamoeba dispar
NKTNNTNNIQPK

SEQ ID NO: 2448009 - protein, 9 aa, Entamoeba dispar
NKTNTGDEF

SEQ ID NO: 2448010 - protein, 6 aa, Entamoeba dispar
NKTPAL

SEQ ID NO: 2448011 - protein, 6 aa, Entamoeba dispar
NKTPGF

SEQ ID NO: 2448012 - protein, 7 aa, Entamoeba dispar
NKTPSTV

SEQ ID NO: 2448013 - protein, 18 aa, Entamoeba dispar
NKTPTQIRDKVNNTRSSY

SEQ ID NO: 2448014 - protein, 26 aa, Entamoeba dispar
NKTPTSNSTTTGNNTTTTTGSNPFGN

SEQ ID NO: 2448015 - protein, 6 aa, Entamoeba dispar
NKTPTV

SEQ ID NO: 2448016 - protein, 7 aa, Entamoeba dispar
NKTQEPT

SEQ ID NO: 2448017 - protein, 21 aa, Entamoeba dispar
NKTQHEPKTIKEKKEKLIKNM

SEQ ID NO: 2448018 - protein, 7 aa, Entamoeba dispar
NKTQIKY

SEQ ID NO: 2448019 - protein, 10 aa, Entamoeba dispar
NKTRQRKNDF

SEQ ID NO: 2448020 - protein, 7 aa, Entamoeba dispar
NKTSAFA

SEQ ID NO: 2448021 - protein, 6 aa, Entamoeba dispar
NKTSEN

SEQ ID NO: 2448022 - protein, 6 aa, Entamoeba dispar
NKTSFE

SEQ ID NO: 2448023 - protein, 10 aa, Entamoeba dispar
NKTSTQIRDK

SEQ ID NO: 2448024 - protein, 14 aa, Entamoeba dispar
NKTTAQADDSLEGI

SEQ ID NO: 2448025 - protein, 7 aa, Entamoeba dispar
NKTTDAY

SEQ ID NO: 2448026 - protein, 8 aa, Entamoeba dispar
NKTTEKAE

SEQ ID NO: 2448027 - protein, 36 aa, Entamoeba dispar
NKTTHKNKESIIRNSENQIPINTNDAPSSSPQNDDQ

SEQ ID NO: 2448028 - protein, 12 aa, Entamoeba dispar
NKTTSDKELIGP

SEQ ID NO: 2448029 - protein, 13 aa, Entamoeba dispar
NKTTSEVMNETGL

SEQ ID NO: 2448030 - protein, 7 aa, Entamoeba dispar
NKTTYGI

SEQ ID NO: 2448031 - protein, 8 aa, Entamoeba dispar
NKTTYNRD

SEQ ID NO: 2448032 - protein, 8 aa, Entamoeba dispar
NKTVEEHD

SEQ ID NO: 2448033 - protein, 12 aa, Entamoeba dispar
NKTYATTISPSS

SEQ ID NO: 2448034 - protein, 4 aa, Entamoeba dispar
NKVE

SEQ ID NO: 2448035 - protein, 6 aa, Entamoeba dispar
NKVEDQ

SEQ ID NO: 2448036 - protein, 7 aa, Entamoeba dispar
NKVEEKS

SEQ ID NO: 2448037 - protein, 14 aa, Entamoeba dispar
NKVKTTFKTTSTAA

SEQ ID NO: 2448038 - protein, 4 aa, Entamoeba dispar
NKVN

SEQ ID NO: 2448039 - protein, 5 aa, Entamoeba dispar
NKVNE

SEQ ID NO: 2448040 - protein, 8 aa, Entamoeba dispar
NKVNEDHI

SEQ ID NO: 2448041 - protein, 19 aa, Entamoeba dispar
NKVNETSKINELTEETQKY

SEQ ID NO: 2448042 - protein, 10 aa, Entamoeba dispar
NKVNKLPQTT

SEQ ID NO: 2448043 - protein, 5 aa, Entamoeba dispar
NKVNN

SEQ ID NO: 2448044 - protein, 6 aa, Entamoeba dispar
NKVPSK

SEQ ID NO: 2448045 - protein, 14 aa, Entamoeba dispar
NKVQKRWKKENDRK

SEQ ID NO: 2448046 - protein, 5 aa, Entamoeba dispar
NKVRQ

SEQ ID NO: 2448047 - protein, 8 aa, Entamoeba dispar
NKVTSSNE

SEQ ID NO: 2448048 - protein, 9 aa, Entamoeba dispar
NKVTSSNEY

SEQ ID NO: 2448049 - protein, 12 aa, Entamoeba dispar
NKYDNNASEKVE

SEQ ID NO: 2448050 - protein, 17 aa, Entamoeba dispar
NKYDSTGESTTAKEIDE

SEQ ID NO: 2448051 - protein, 7 aa, Entamoeba dispar
NKYDTQN

SEQ ID NO: 2448052 - protein, 13 aa, Entamoeba dispar
NKYESQSRDNLSS

SEQ ID NO: 2448053 - protein, 8 aa, Entamoeba dispar
NKYGCASQ

SEQ ID NO: 2448054 - protein, 5 aa, Entamoeba dispar
NKYGI

SEQ ID NO: 2448055 - protein, 13 aa, Entamoeba dispar
NKYKESKSRISKK

SEQ ID NO: 2448056 - protein, 6 aa, Entamoeba dispar
NKYKSN

SEQ ID NO: 2448057 - protein, 6 aa, Entamoeba dispar
NKYNSS

SEQ ID NO: 2448058 - protein, 4 aa, Entamoeba dispar
NKYS

SEQ ID NO: 2448059 - protein, 13 aa, Entamoeba dispar
NKYSDDGRSVNTP

SEQ ID NO: 2448060 - protein, 28 aa, Entamoeba dispar
NKYSDNEFTTEKTIETAEGLNPDKNQEL

SEQ ID NO: 2448061 - protein, 15 aa, Entamoeba dispar
NKYSEKQKPSSYEEA

SEQ ID NO: 2448062 - protein, 8 aa, Entamoeba dispar
NLAEEVSK

SEQ ID NO: 2448063 - protein, 9 aa, Entamoeba dispar
NLAGGKNDE

SEQ ID NO: 2448064 - protein, 6 aa, Entamoeba dispar
NLAQNI

SEQ ID NO: 2448065 - protein, 16 aa, Entamoeba dispar
NLAQSKDQSKSQTSEV

SEQ ID NO: 2448066 - protein, 16 aa, Entamoeba dispar
NLAQSRDQSISQTSEV

SEQ ID NO: 2448067 - protein, 4 aa, Entamoeba dispar
NLDD

SEQ ID NO: 2448068 - protein, 8 aa, Entamoeba dispar
NLDDCQQQ

SEQ ID NO: 2448069 - protein, 34 aa, Entamoeba dispar
NLDDEENDMIEKEKAQNLTKKTKKKVIKKTISLD

SEQ ID NO: 2448070 - protein, 7 aa, Entamoeba dispar
NLDKEAP

SEQ ID NO: 2448071 - protein, 8 aa, Entamoeba dispar
NLDNTTLS

SEQ ID NO: 2448072 - protein, 12 aa, Entamoeba dispar
NLDPSDDNIEGN

SEQ ID NO: 2448073 - protein, 12 aa, Entamoeba dispar
NLDSKDDNYTKS

SEQ ID NO: 2448074 - protein, 12 aa, Entamoeba dispar
NLEDESLQGNMG

SEQ ID NO: 2448075 - protein, 5 aa, Entamoeba dispar
NLEEA

SEQ ID NO: 2448076 - protein, 13 aa, Entamoeba dispar
NLEEDKEELKETI

SEQ ID NO: 2448077 - protein, 25 aa, Entamoeba dispar
NLEEDSDDESRYHDDNESSDEENDE

SEQ ID NO: 2448078 - protein, 25 aa, Entamoeba dispar
NLEEDTDDESRYHDDNESSDEENDE

SEQ ID NO: 2448079 - protein, 6 aa, Entamoeba dispar
NLEEEY

SEQ ID NO: 2448080 - protein, 27 aa, Entamoeba dispar
NLEEKYSQDMNVSKQKIKELEERKPAL

SEQ ID NO: 2448081 - protein, 10 aa, Entamoeba dispar
NLEETNEVSQ

SEQ ID NO: 2448082 - protein, 24 aa, Entamoeba dispar
NLEETRKRKRENRANANRNDYGNE

SEQ ID NO: 2448083 - protein, 5 aa, Entamoeba dispar
NLEPF

SEQ ID NO: 2448084 - protein, 6 aa, Entamoeba dispar
NLEPKY

SEQ ID NO: 2448085 - protein, 16 aa, Entamoeba dispar
NLEQSEDQSKSQTSEV

SEQ ID NO: 2448086 - protein, 16 aa, Entamoeba dispar
NLEQSGDKSKSQTSEV

SEQ ID NO: 2448087 - protein, 16 aa, Entamoeba dispar
NLEQSKDQSKSQTSKV

SEQ ID NO: 2448088 - protein, 15 aa, Entamoeba dispar
NLEQSRDQSISQTSK

SEQ ID NO: 2448089 - protein, 5 aa, Entamoeba dispar
NLETV

SEQ ID NO: 2448090 - protein, 4 aa, Entamoeba dispar
NLGE

SEQ ID NO: 2448091 - protein, 6 aa, Entamoeba dispar
NLGEND

SEQ ID NO: 2448092 - protein, 6 aa, Entamoeba dispar
NLGESF

SEQ ID NO: 2448093 - protein, 6 aa, Entamoeba dispar
NLGKDR

SEQ ID NO: 2448094 - protein, 23 aa, Entamoeba dispar
NLGKFNKKKGKLPKSDYKSLTEK

SEQ ID NO: 2448095 - protein, 8 aa, Entamoeba dispar
NLGNKKDE

SEQ ID NO: 2448096 - protein, 10 aa, Entamoeba dispar
NLGNTKEDKI

SEQ ID NO: 2448097 - protein, 11 aa, Entamoeba dispar
NLGPKVTEEDI

SEQ ID NO: 2448098 - protein, 5 aa, Entamoeba dispar
NLGQN

SEQ ID NO: 2448099 - protein, 9 aa, Entamoeba dispar
NLGSNEISE

SEQ ID NO: 2448100 - protein, 5 aa, Entamoeba dispar
NLGYP

SEQ ID NO: 2448101 - protein, 11 aa, Entamoeba dispar
NLGYTPNELPE

SEQ ID NO: 2448102 - protein, 6 aa, Entamoeba dispar
NLIGKK

SEQ ID NO: 2448103 - protein, 8 aa, Entamoeba dispar
NLIKPTNS

SEQ ID NO: 2448104 - protein, 24 aa, Entamoeba dispar
NLKEEFEKKKIQNQKKEEGSQTKN

SEQ ID NO: 2448105 - protein, 6 aa, Entamoeba dispar
NLKEEL

SEQ ID NO: 2448106 - protein, 21 aa, Entamoeba dispar
NLKEKESLEKINQNLNNDINS

SEQ ID NO: 2448107 - protein, 7 aa, Entamoeba dispar
NLKEKQR

SEQ ID NO: 2448108 - protein, 11 aa, Entamoeba dispar
NLKEPKEAFRQ

SEQ ID NO: 2448109 - protein, 20 aa, Entamoeba dispar
NLKEVPKTCSPFTEFDLETM

SEQ ID NO: 2448110 - protein, 14 aa, Entamoeba dispar
NLKGADFGGLSSDP

SEQ ID NO: 2448111 - protein, 5 aa, Entamoeba dispar
NLKGT

SEQ ID NO: 2448112 - protein, 11 aa, Entamoeba dispar
NLKKEKENTVE

SEQ ID NO: 2448113 - protein, 9 aa, Entamoeba dispar
NLKNEKENI

SEQ ID NO: 2448114 - protein, 12 aa, Entamoeba dispar
NLKNEKENTLKK

SEQ ID NO: 2448115 - protein, 8 aa, Entamoeba dispar
NLKNKYKS

SEQ ID NO: 2448116 - protein, 13 aa, Entamoeba dispar
NLKPYKKEEIPNV

SEQ ID NO: 2448117 - protein, 45 aa, Entamoeba dispar
NLKQQKDEKGEKLSDEKKGIKKEETKMDEQTQQDLSQEENEEEKL

SEQ ID NO: 2448118 - protein, 16 aa, Entamoeba dispar
NLKQSGDQSKSQTSEV

SEQ ID NO: 2448119 - protein, 16 aa, Entamoeba dispar
NLKQSGDQSKSQTSKV

SEQ ID NO: 2448120 - protein, 6 aa, Entamoeba dispar
NLKRKE

SEQ ID NO: 2448121 - protein, 16 aa, Entamoeba dispar
NLKRRTKKTNKKKVQK

SEQ ID NO: 2448122 - protein, 4 aa, Entamoeba dispar
NLKT

SEQ ID NO: 2448123 - protein, 22 aa, Entamoeba dispar
NLKTSSDNKKVFTATSSTVSFP

SEQ ID NO: 2448124 - protein, 12 aa, Entamoeba dispar
NLLSENSDNYVK

SEQ ID NO: 2448125 - protein, 5 aa, Entamoeba dispar
NLMNE

SEQ ID NO: 2448126 - protein, 4 aa, Entamoeba dispar
NLNE

SEQ ID NO: 2448127 - protein, 10 aa, Entamoeba dispar
NLNEKEKNIV

SEQ ID NO: 2448128 - protein, 9 aa, Entamoeba dispar
NLNESIKDN

SEQ ID NO: 2448129 - protein, 8 aa, Entamoeba dispar
NLNGEIKT

SEQ ID NO: 2448130 - protein, 11 aa, Entamoeba dispar
NLNGSEQGIGH

SEQ ID NO: 2448131 - protein, 28 aa, Entamoeba dispar
NLNKEEDKEEEKPKEQEEIADDAFENDG

SEQ ID NO: 2448132 - protein, 9 aa, Entamoeba dispar
NLNKEFEDS

SEQ ID NO: 2448133 - protein, 16 aa, Entamoeba dispar
NLNNKYKEQSSPGDSF

SEQ ID NO: 2448134 - protein, 4 aa, Entamoeba dispar
NLNP

SEQ ID NO: 2448135 - protein, 9 aa, Entamoeba dispar
NLNSSKEHF

SEQ ID NO: 2448136 - protein, 12 aa, Entamoeba dispar
NLNTDETPVSIL

SEQ ID NO: 2448137 - protein, 7 aa, Entamoeba dispar
NLPADEE

SEQ ID NO: 2448138 - protein, 13 aa, Entamoeba dispar
NLPEEIKEVPDAT

SEQ ID NO: 2448139 - protein, 5 aa, Entamoeba dispar
NLPEN

SEQ ID NO: 2448140 - protein, 4 aa, Entamoeba dispar
NLPF

SEQ ID NO: 2448141 - protein, 4 aa, Entamoeba dispar
NLPG

SEQ ID NO: 2448142 - protein, 5 aa, Entamoeba dispar
NLPGA

SEQ ID NO: 2448143 - protein, 4 aa, Entamoeba dispar
NLPI

SEQ ID NO: 2448144 - protein, 12 aa, Entamoeba dispar
NLPKADPTGLSD

SEQ ID NO: 2448145 - protein, 7 aa, Entamoeba dispar
NLPKTTS

SEQ ID NO: 2448146 - protein, 4 aa, Entamoeba dispar
NLPN

SEQ ID NO: 2448147 - protein, 6 aa, Entamoeba dispar
NLPNPY

SEQ ID NO: 2448148 - protein, 11 aa, Entamoeba dispar
NLPPKEDYSPF

SEQ ID NO: 2448149 - protein, 8 aa, Entamoeba dispar
NLPPNSRL

SEQ ID NO: 2448150 - protein, 5 aa, Entamoeba dispar
NLPPT

SEQ ID NO: 2448151 - protein, 4 aa, Entamoeba dispar
NLPQ

SEQ ID NO: 2448152 - protein, 5 aa, Entamoeba dispar
NLPQH

SEQ ID NO: 2448153 - protein, 5 aa, Entamoeba dispar
NLPQQ

SEQ ID NO: 2448154 - protein, 11 aa, Entamoeba dispar
NLPRMEGGKDL

SEQ ID NO: 2448155 - protein, 5 aa, Entamoeba dispar
NLPRT

SEQ ID NO: 2448156 - protein, 15 aa, Entamoeba dispar
NLPSQDPSVRQPQQY

SEQ ID NO: 2448157 - protein, 8 aa, Entamoeba dispar
NLPSSINE

SEQ ID NO: 2448158 - protein, 6 aa, Entamoeba dispar
NLPSSL

SEQ ID NO: 2448159 - protein, 10 aa, Entamoeba dispar
NLPSSVSELG

SEQ ID NO: 2448160 - protein, 13 aa, Entamoeba dispar
NLPTKTSKPPLLK

SEQ ID NO: 2448161 - protein, 8 aa, Entamoeba dispar
NLPTPSLT

SEQ ID NO: 2448162 - protein, 9 aa, Entamoeba dispar
NLPTSVNEL

SEQ ID NO: 2448163 - protein, 6 aa, Entamoeba dispar
NLPYGE

SEQ ID NO: 2448164 - protein, 7 aa, Entamoeba dispar
NLPYGNE

SEQ ID NO: 2448165 - protein, 10 aa, Entamoeba dispar
NLQDGNGPKF

SEQ ID NO: 2448166 - protein, 12 aa, Entamoeba dispar
NLQDKTGETPLH

SEQ ID NO: 2448167 - protein, 6 aa, Entamoeba dispar
NLQDQY

SEQ ID NO: 2448168 - protein, 7 aa, Entamoeba dispar
NLQEPSE

SEQ ID NO: 2448169 - protein, 5 aa, Entamoeba dispar
NLQES

SEQ ID NO: 2448170 - protein, 62 aa, Entamoeba dispar
NLQETKENEVTTNKETEIKDKEIKENELTTKDEETKENETTQKDEETKENETTQKDEETEIT

SEQ ID NO: 2448171 - protein, 9 aa, Entamoeba dispar
NLQIKTGRV

SEQ ID NO: 2448172 - protein, 5 aa, Entamoeba dispar
NLQNE

SEQ ID NO: 2448173 - protein, 25 aa, Entamoeba dispar
NLQNKQEEASPENKSTIHKEPNNKL

SEQ ID NO: 2448174 - protein, 8 aa, Entamoeba dispar
NLQNNSDE

SEQ ID NO: 2448175 - protein, 10 aa, Entamoeba dispar
NLQPSTSNTR

SEQ ID NO: 2448176 - protein, 5 aa, Entamoeba dispar
NLQQE

SEQ ID NO: 2448177 - protein, 5 aa, Entamoeba dispar
NLQRI

SEQ ID NO: 2448178 - protein, 9 aa, Entamoeba dispar
NLQSFPGDD

SEQ ID NO: 2448179 - protein, 9 aa, Entamoeba dispar
NLQSISPQS

SEQ ID NO: 2448180 - protein, 14 aa, Entamoeba dispar
NLQTINGKSIEKKG

SEQ ID NO: 2448181 - protein, 8 aa, Entamoeba dispar
NLQTPRTG

SEQ ID NO: 2448182 - protein, 23 aa, Entamoeba dispar
NLQTTAKVNSLQETLRQEEEKKR

SEQ ID NO: 2448183 - protein, 9 aa, Entamoeba dispar
NLRDEKGVP

SEQ ID NO: 2448184 - protein, 12 aa, Entamoeba dispar
NLRDTISSSQQP

SEQ ID NO: 2448185 - protein, 21 aa, Entamoeba dispar
NLREAERNTRLVESKKKETEN

SEQ ID NO: 2448186 - protein, 11 aa, Entamoeba dispar
NLRNEKSPFAK

SEQ ID NO: 2448187 - protein, 26 aa, Entamoeba dispar
NLRNTAKPITNATEDKQPKEEKKEEV

SEQ ID NO: 2448188 - protein, 26 aa, Entamoeba dispar
NLRNTAKPVTNVTEDKQPKEEKKEEV

SEQ ID NO: 2448189 - protein, 5 aa, Entamoeba dispar
NLRQN

SEQ ID NO: 2448190 - protein, 17 aa, Entamoeba dispar
NLRRENDSLKSAGEEAF

SEQ ID NO: 2448191 - protein, 8 aa, Entamoeba dispar
NLSAEGKS

SEQ ID NO: 2448192 - protein, 6 aa, Entamoeba dispar
NLSDEI

SEQ ID NO: 2448193 - protein, 5 aa, Entamoeba dispar
NLSDG

SEQ ID NO: 2448194 - protein, 12 aa, Entamoeba dispar
NLSDKKYITKEE

SEQ ID NO: 2448195 - protein, 8 aa, Entamoeba dispar
NLSDKNVH

SEQ ID NO: 2448196 - protein, 8 aa, Entamoeba dispar
NLSDNKFT

SEQ ID NO: 2448197 - protein, 9 aa, Entamoeba dispar
NLSEGTTKD

SEQ ID NO: 2448198 - protein, 5 aa, Entamoeba dispar
NLSES

SEQ ID NO: 2448199 - protein, 8 aa, Entamoeba dispar
NLSGESEL

SEQ ID NO: 2448200 - protein, 14 aa, Entamoeba dispar
NLSGTSSKSKSSRE

SEQ ID NO: 2448201 - protein, 10 aa, Entamoeba dispar
NLSKETQASI

SEQ ID NO: 2448202 - protein, 9 aa, Entamoeba dispar
NLSKNEDND

SEQ ID NO: 2448203 - protein, 12 aa, Entamoeba dispar
NLSKNNKNEKLK

SEQ ID NO: 2448204 - protein, 5 aa, Entamoeba dispar
NLSKR

SEQ ID NO: 2448205 - protein, 41 aa, Entamoeba dispar
NLSNIEEDNFDEQETQKDGTLQQSKVNREDTKRRKSDSANI

SEQ ID NO: 2448206 - protein, 11 aa, Entamoeba dispar
NLSNNKISQLP

SEQ ID NO: 2448207 - protein, 13 aa, Entamoeba dispar
NLSNTEECKNNTY

SEQ ID NO: 2448208 - protein, 5 aa, Entamoeba dispar
NLSQK

SEQ ID NO: 2448209 - protein, 5 aa, Entamoeba dispar
NLSRL

SEQ ID NO: 2448210 - protein, 4 aa, Entamoeba dispar
NLST

SEQ ID NO: 2448211 - protein, 7 aa, Entamoeba dispar
NLSTREE

SEQ ID NO: 2448212 - protein, 4 aa, Entamoeba dispar
NLSY

SEQ ID NO: 2448213 - protein, 4 aa, Entamoeba dispar
NLTE

SEQ ID NO: 2448214 - protein, 16 aa, Entamoeba dispar
NLTENKKETDSVPIRT

SEQ ID NO: 2448215 - protein, 15 aa, Entamoeba dispar
NLTKARGAMTGARVD

SEQ ID NO: 2448216 - protein, 6 aa, Entamoeba dispar
NLTNER

SEQ ID NO: 2448217 - protein, 10 aa, Entamoeba dispar
NLTPDSKISE

SEQ ID NO: 2448218 - protein, 7 aa, Entamoeba dispar
NLTPEQV

SEQ ID NO: 2448219 - protein, 6 aa, Entamoeba dispar
NLYPEE

SEQ ID NO: 2448220 - protein, 4 aa, Entamoeba dispar
NLYS

SEQ ID NO: 2448221 - protein, 9 aa, Entamoeba dispar
NMAGGDKKV

SEQ ID NO: 2448222 - protein, 6 aa, Entamoeba dispar
NMDERI

SEQ ID NO: 2448223 - protein, 6 aa, Entamoeba dispar
NMETPS

SEQ ID NO: 2448224 - protein, 28 aa, Entamoeba dispar
NMKEQQANNEEKKEEPAAETEAPVTNEV

SEQ ID NO: 2448225 - protein, 20 aa, Entamoeba dispar
NMKEQQANNEERRKKNQPLK

SEQ ID NO: 2448226 - protein, 9 aa, Entamoeba dispar
NMKPKSKKM

SEQ ID NO: 2448227 - protein, 10 aa, Entamoeba dispar
NMKSETRSIP

SEQ ID NO: 2448228 - protein, 4 aa, Entamoeba dispar
NMLS

SEQ ID NO: 2448229 - protein, 6 aa, Entamoeba dispar
NMNEKC

SEQ ID NO: 2448230 - protein, 4 aa, Entamoeba dispar
NMNN

SEQ ID NO: 2448231 - protein, 10 aa, Entamoeba dispar
NMNSNKCDEQ

SEQ ID NO: 2448232 - protein, 6 aa, Entamoeba dispar
NMPEAS

SEQ ID NO: 2448233 - protein, 4 aa, Entamoeba dispar
NMPN

SEQ ID NO: 2448234 - protein, 14 aa, Entamoeba dispar
NMPPSGPQFAEASR

SEQ ID NO: 2448235 - protein, 21 aa, Entamoeba dispar
NMPSIGSETQEQHNVQEKSGM

SEQ ID NO: 2448236 - protein, 11 aa, Entamoeba dispar
NMSDDDMTKYS

SEQ ID NO: 2448237 - protein, 9 aa, Entamoeba dispar
NMSNQTKGV

SEQ ID NO: 2448238 - protein, 11 aa, Entamoeba dispar
NMSQSTNDAFP

SEQ ID NO: 2448239 - protein, 54 aa, Entamoeba dispar
NMTSYEKQRSKYFNNTPNDNTMEEEDYDDDDDYSNGPLEHTPFGGKNDDIDIIY

SEQ ID NO: 2448240 - protein, 7 aa, Entamoeba dispar
NNAAKSV

SEQ ID NO: 2448241 - protein, 10 aa, Entamoeba dispar
NNADDHSEQF

SEQ ID NO: 2448242 - protein, 17 aa, Entamoeba dispar
NNAEEIKKSFSGNVSYS

SEQ ID NO: 2448243 - protein, 6 aa, Entamoeba dispar
NNAEKI

SEQ ID NO: 2448244 - protein, 12 aa, Entamoeba dispar
NNAERQRAQSDP

SEQ ID NO: 2448245 - protein, 8 aa, Entamoeba dispar
NNAHDKNE

SEQ ID NO: 2448246 - protein, 9 aa, Entamoeba dispar
NNALKEDKQ

SEQ ID NO: 2448247 - protein, 4 aa, Entamoeba dispar
NNAP

SEQ ID NO: 2448248 - protein, 5 aa, Entamoeba dispar
NNAPD

SEQ ID NO: 2448249 - protein, 10 aa, Entamoeba dispar
NNAQTDHNHI

SEQ ID NO: 2448250 - protein, 8 aa, Entamoeba dispar
NNASDGSV

SEQ ID NO: 2448251 - protein, 36 aa, Entamoeba dispar
NNASFGTSNISSFGNSTSNVFTSTNGIGSLSTGNIN

SEQ ID NO: 2448252 - protein, 20 aa, Entamoeba dispar
NNCDKTKSQSKEDTDTTNRE

SEQ ID NO: 2448253 - protein, 7 aa, Entamoeba dispar
NNCGGSL

SEQ ID NO: 2448254 - protein, 9 aa, Entamoeba dispar
NNCSSSEDM

SEQ ID NO: 2448255 - protein, 15 aa, Entamoeba dispar
NNCSVPMNTEIFMEL

SEQ ID NO: 2448256 - protein, 5 aa, Entamoeba dispar
NNCYD

SEQ ID NO: 2448257 - protein, 4 aa, Entamoeba dispar
NNDE

SEQ ID NO: 2448258 - protein, 8 aa, Entamoeba dispar
NNDEDEHK

SEQ ID NO: 2448259 - protein, 12 aa, Entamoeba dispar
NNDEDKKRNKEI

SEQ ID NO: 2448260 - protein, 9 aa, Entamoeba dispar
NNDENIKEI

SEQ ID NO: 2448261 - protein, 16 aa, Entamoeba dispar
NNDEVKESKSVSQINN

SEQ ID NO: 2448262 - protein, 9 aa, Entamoeba dispar
NNDFNESTI

SEQ ID NO: 2448263 - protein, 5 aa, Entamoeba dispar
NNDGS

SEQ ID NO: 2448264 - protein, 9 aa, Entamoeba dispar
NNDGTYTGS

SEQ ID NO: 2448265 - protein, 6 aa, Entamoeba dispar
NNDIDK

SEQ ID NO: 2448266 - protein, 6 aa, Entamoeba dispar
NNDIRD

SEQ ID NO: 2448267 - protein, 5 aa, Entamoeba dispar
NNDLQ

SEQ ID NO: 2448268 - protein, 8 aa, Entamoeba dispar
NNDNDGLK

SEQ ID NO: 2448269 - protein, 16 aa, Entamoeba dispar
NNDNNSIKQFTTRSRK

SEQ ID NO: 2448270 - protein, 4 aa, Entamoeba dispar
NNDP

SEQ ID NO: 2448271 - protein, 9 aa, Entamoeba dispar
NNDPNVESK

SEQ ID NO: 2448272 - protein, 6 aa, Entamoeba dispar
NNDPSL

SEQ ID NO: 2448273 - protein, 7 aa, Entamoeba dispar
NNDQARM

SEQ ID NO: 2448274 - protein, 7 aa, Entamoeba dispar
NNDRPTL

SEQ ID NO: 2448275 - protein, 5 aa, Entamoeba dispar
NNDSM

SEQ ID NO: 2448276 - protein, 8 aa, Entamoeba dispar
NNDSSLEW

SEQ ID NO: 2448277 - protein, 4 aa, Entamoeba dispar
NNDT

SEQ ID NO: 2448278 - protein, 11 aa, Entamoeba dispar
NNDTQSHQSTH

SEQ ID NO: 2448279 - protein, 6 aa, Entamoeba dispar
NNDTTS

SEQ ID NO: 2448280 - protein, 9 aa, Entamoeba dispar
NNDVKGKEV

SEQ ID NO: 2448281 - protein, 8 aa, Entamoeba dispar
NNDVTGTD

SEQ ID NO: 2448282 - protein, 11 aa, Entamoeba dispar
NNEASKKVEKI

SEQ ID NO: 2448283 - protein, 8 aa, Entamoeba dispar
NNEDLSQE

SEQ ID NO: 2448284 - protein, 8 aa, Entamoeba dispar
NNEEEEPF

SEQ ID NO: 2448285 - protein, 7 aa, Entamoeba dispar
NNEELQK

SEQ ID NO: 2448286 - protein, 10 aa, Entamoeba dispar
NNEENNSIER

SEQ ID NO: 2448287 - protein, 8 aa, Entamoeba dispar
NNEESNGL

SEQ ID NO: 2448288 - protein, 15 aa, Entamoeba dispar
NNEEVNESYGLKETK

SEQ ID NO: 2448289 - protein, 12 aa, Entamoeba dispar
NNEFSERSVPVK

SEQ ID NO: 2448290 - protein, 6 aa, Entamoeba dispar
NNEGNS

SEQ ID NO: 2448291 - protein, 8 aa, Entamoeba dispar
NNEGYNED

SEQ ID NO: 2448292 - protein, 14 aa, Entamoeba dispar
NNEIDEIKEKMKET

SEQ ID NO: 2448293 - protein, 8 aa, Entamoeba dispar
NNEIEKQK

SEQ ID NO: 2448294 - protein, 10 aa, Entamoeba dispar
NNEITNLPKE

SEQ ID NO: 2448295 - protein, 11 aa, Entamoeba dispar
NNEITNLPKEM

SEQ ID NO: 2448296 - protein, 4 aa, Entamoeba dispar
NNEK

SEQ ID NO: 2448297 - protein, 13 aa, Entamoeba dispar
NNEKANKESYTED

SEQ ID NO: 2448298 - protein, 6 aa, Entamoeba dispar
NNEKLQ

SEQ ID NO: 2448299 - protein, 5 aa, Entamoeba dispar
NNEKM

SEQ ID NO: 2448300 - protein, 7 aa, Entamoeba dispar
NNEKNQM

SEQ ID NO: 2448301 - protein, 5 aa, Entamoeba dispar
NNEKY

SEQ ID NO: 2448302 - protein, 4 aa, Entamoeba dispar
NNEL

SEQ ID NO: 2448303 - protein, 7 aa, Entamoeba dispar
NNELGEG

SEQ ID NO: 2448304 - protein, 4 aa, Entamoeba dispar
NNEM

SEQ ID NO: 2448305 - protein, 15 aa, Entamoeba dispar
NNENKIELKQNNQEE

SEQ ID NO: 2448306 - protein, 22 aa, Entamoeba dispar
NNENMCNDNTEVSTDKDEIFDE

SEQ ID NO: 2448307 - protein, 9 aa, Entamoeba dispar
NNENPEVSL

SEQ ID NO: 2448308 - protein, 5 aa, Entamoeba dispar
NNENR

SEQ ID NO: 2448309 - protein, 5 aa, Entamoeba dispar
NNEPL

SEQ ID NO: 2448310 - protein, 4 aa, Entamoeba dispar
NNEQ

SEQ ID NO: 2448311 - protein, 8 aa, Entamoeba dispar
NNEQEGKE

SEQ ID NO: 2448312 - protein, 7 aa, Entamoeba dispar
NNEQIAE

SEQ ID NO: 2448313 - protein, 7 aa, Entamoeba dispar
NNEQPLE

SEQ ID NO: 2448314 - protein, 12 aa, Entamoeba dispar
NNEQTKQNSNVI

SEQ ID NO: 2448315 - protein, 6 aa, Entamoeba dispar
NNEREM

SEQ ID NO: 2448316 - protein, 24 aa, Entamoeba dispar
NNERHQKGEEIRTKQKHIKKNKRN

SEQ ID NO: 2448317 - protein, 6 aa, Entamoeba dispar
NNESFK

SEQ ID NO: 2448318 - protein, 6 aa, Entamoeba dispar
NNESFR

SEQ ID NO: 2448319 - protein, 12 aa, Entamoeba dispar
NNESPTQSDTKK

SEQ ID NO: 2448320 - protein, 20 aa, Entamoeba dispar
NNETCEAPKTLTPPTETEKL

SEQ ID NO: 2448321 - protein, 10 aa, Entamoeba dispar
NNETINKREE

SEQ ID NO: 2448322 - protein, 6 aa, Entamoeba dispar
NNETKF

SEQ ID NO: 2448323 - protein, 29 aa, Entamoeba dispar
NNETPENKAASNKLSGLDLSETDQNENHQ

SEQ ID NO: 2448324 - protein, 9 aa, Entamoeba dispar
NNETTQITS

SEQ ID NO: 2448325 - protein, 7 aa, Entamoeba dispar
NNEWNAQ

SEQ ID NO: 2448326 - protein, 4 aa, Entamoeba dispar
NNEY

SEQ ID NO: 2448327 - protein, 4 aa, Entamoeba dispar
NNFE

SEQ ID NO: 2448328 - protein, 8 aa, Entamoeba dispar
NNFEGAGA

SEQ ID NO: 2448329 - protein, 8 aa, Entamoeba dispar
NNFENTRE

SEQ ID NO: 2448330 - protein, 16 aa, Entamoeba dispar
NNFGGEEIKPKEIRVE

SEQ ID NO: 2448331 - protein, 11 aa, Entamoeba dispar
NNFKDARDELN

SEQ ID NO: 2448332 - protein, 17 aa, Entamoeba dispar
NNFSNSESKTSSLNTTN

SEQ ID NO: 2448333 - protein, 5 aa, Entamoeba dispar
NNGCK

SEQ ID NO: 2448334 - protein, 4 aa, Entamoeba dispar
NNGD

SEQ ID NO: 2448335 - protein, 8 aa, Entamoeba dispar
NNGDEKEL

SEQ ID NO: 2448336 - protein, 4 aa, Entamoeba dispar
NNGE

SEQ ID NO: 2448337 - protein, 21 aa, Entamoeba dispar
NNGEDSRESLSRSVSRSSSNI

SEQ ID NO: 2448338 - protein, 6 aa, Entamoeba dispar
NNGEHS

SEQ ID NO: 2448339 - protein, 5 aa, Entamoeba dispar
NNGEL

SEQ ID NO: 2448340 - protein, 8 aa, Entamoeba dispar
NNGEPMDD

SEQ ID NO: 2448341 - protein, 13 aa, Entamoeba dispar
NNGFGKFGKGTFY

SEQ ID NO: 2448342 - protein, 7 aa, Entamoeba dispar
NNGFGVD

SEQ ID NO: 2448343 - protein, 7 aa, Entamoeba dispar
NNGGSFI

SEQ ID NO: 2448344 - protein, 10 aa, Entamoeba dispar
NNGKEGKKSD

SEQ ID NO: 2448345 - protein, 7 aa, Entamoeba dispar
NNGKGIP

SEQ ID NO: 2448346 - protein, 14 aa, Entamoeba dispar
NNGKKVNGGDRLSQ

SEQ ID NO: 2448347 - protein, 8 aa, Entamoeba dispar
NNGKPVKS

SEQ ID NO: 2448348 - protein, 9 aa, Entamoeba dispar
NNGKVEQGA

SEQ ID NO: 2448349 - protein, 5 aa, Entamoeba dispar
NNGLT

SEQ ID NO: 2448350 - protein, 6 aa, Entamoeba dispar
NNGMPE

SEQ ID NO: 2448351 - protein, 9 aa, Entamoeba dispar
NNGMTPYDY

SEQ ID NO: 2448352 - protein, 7 aa, Entamoeba dispar
NNGNEKE

SEQ ID NO: 2448353 - protein, 8 aa, Entamoeba dispar
NNGNGDCG

SEQ ID NO: 2448354 - protein, 9 aa, Entamoeba dispar
NNGNRPAAI

SEQ ID NO: 2448355 - protein, 18 aa, Entamoeba dispar
NNGPHANDPKYKSGYNNQ

SEQ ID NO: 2448356 - protein, 9 aa, Entamoeba dispar
NNGPQYSNK

SEQ ID NO: 2448357 - protein, 8 aa, Entamoeba dispar
NNGRGCDE

SEQ ID NO: 2448358 - protein, 7 aa, Entamoeba dispar
NNGRSEQ

SEQ ID NO: 2448359 - protein, 7 aa, Entamoeba dispar
NNGSTSQ

SEQ ID NO: 2448360 - protein, 7 aa, Entamoeba dispar
NNGTIPS

SEQ ID NO: 2448361 - protein, 5 aa, Entamoeba dispar
NNGTM

SEQ ID NO: 2448362 - protein, 12 aa, Entamoeba dispar
NNGTNEIFTSTM

SEQ ID NO: 2448363 - protein, 8 aa, Entamoeba dispar
NNGTSGDV

SEQ ID NO: 2448364 - protein, 4 aa, Entamoeba dispar
NNGY

SEQ ID NO: 2448365 - protein, 6 aa, Entamoeba dispar
NNHIEE

SEQ ID NO: 2448366 - protein, 15 aa, Entamoeba dispar
NNHKGYEQSRRDDLE

SEQ ID NO: 2448367 - protein, 17 aa, Entamoeba dispar
NNHQPEPQIARKKETGY

SEQ ID NO: 2448368 - protein, 14 aa, Entamoeba dispar
NNHRGREQSRRDDL

SEQ ID NO: 2448369 - protein, 5 aa, Entamoeba dispar
NNHSI

SEQ ID NO: 2448370 - protein, 4 aa, Entamoeba dispar
NNHT

SEQ ID NO: 2448371 - protein, 5 aa, Entamoeba dispar
NNIEC

SEQ ID NO: 2448372 - protein, 7 aa, Entamoeba dispar
NNIEETK

SEQ ID NO: 2448373 - protein, 15 aa, Entamoeba dispar
NNIEKEGKEDELIEE

SEQ ID NO: 2448374 - protein, 8 aa, Entamoeba dispar
NNIEKKQF

SEQ ID NO: 2448375 - protein, 6 aa, Entamoeba dispar
NNIEQL

SEQ ID NO: 2448376 - protein, 5 aa, Entamoeba dispar
NNIES

SEQ ID NO: 2448377 - protein, 10 aa, Entamoeba dispar
NNIESHDNQS

SEQ ID NO: 2448378 - protein, 30 aa, Entamoeba dispar
NNIGKNNPNKQSDEIEGKKEKRNGNEWKDG

SEQ ID NO: 2448379 - protein, 7 aa, Entamoeba dispar
NNIGSEN

SEQ ID NO: 2448380 - protein, 6 aa, Entamoeba dispar
NNIGVD

SEQ ID NO: 2448381 - protein, 5 aa, Entamoeba dispar
NNIKD

SEQ ID NO: 2448382 - protein, 7 aa, Entamoeba dispar
NNINPTR

SEQ ID NO: 2448383 - protein, 8 aa, Entamoeba dispar
NNINYPDG

SEQ ID NO: 2448384 - protein, 20 aa, Entamoeba dispar
NNIPGGGKRPRIDPKTEKEN

SEQ ID NO: 2448385 - protein, 9 aa, Entamoeba dispar
NNIPKGITE

SEQ ID NO: 2448386 - protein, 12 aa, Entamoeba dispar
NNIPKLSTQSTQ

SEQ ID NO: 2448387 - protein, 6 aa, Entamoeba dispar
NNIQIN

SEQ ID NO: 2448388 - protein, 6 aa, Entamoeba dispar
NNIQLS

SEQ ID NO: 2448389 - protein, 21 aa, Entamoeba dispar
NNIQSFSETKYKTYQEAKKEC

SEQ ID NO: 2448390 - protein, 39 aa, Entamoeba dispar
NNISQTTPPGLNKNSSCPSQSPKVITPTPIQTKEKQPNV

SEQ ID NO: 2448391 - protein, 4 aa, Entamoeba dispar
NNIT

SEQ ID NO: 2448392 - protein, 6 aa, Entamoeba dispar
NNITTN

SEQ ID NO: 2448393 - protein, 7 aa, Entamoeba dispar
NNKADEI

SEQ ID NO: 2448394 - protein, 8 aa, Entamoeba dispar
NNKAPQCE

SEQ ID NO: 2448395 - protein, 6 aa, Entamoeba dispar
NNKDLN

SEQ ID NO: 2448396 - protein, 4 aa, Entamoeba dispar
NNKE

SEQ ID NO: 2448397 - protein, 10 aa, Entamoeba dispar
NNKEEQINEM

SEQ ID NO: 2448398 - protein, 10 aa, Entamoeba dispar
NNKEERKEEQ

SEQ ID NO: 2448399 - protein, 6 aa, Entamoeba dispar
NNKEFN

SEQ ID NO: 2448400 - protein, 6 aa, Entamoeba dispar
NNKEIH

SEQ ID NO: 2448401 - protein, 8 aa, Entamoeba dispar
NNKEKKDV

SEQ ID NO: 2448402 - protein, 14 aa, Entamoeba dispar
NNKEKKEQTVSISQ

SEQ ID NO: 2448403 - protein, 10 aa, Entamoeba dispar
NNKEKRTDYQ

SEQ ID NO: 2448404 - protein, 8 aa, Entamoeba dispar
NNKENLLR

SEQ ID NO: 2448405 - protein, 40 aa, Entamoeba dispar
NNKEQDDYDEEEDDEEEDYSDEPMEHQPFGGNGNDPDIIY

SEQ ID NO: 2448406 - protein, 5 aa, Entamoeba dispar
NNKET

SEQ ID NO: 2448407 - protein, 6 aa, Entamoeba dispar
NNKETE

SEQ ID NO: 2448408 - protein, 17 aa, Entamoeba dispar
NNKETRFNNQDNRSKIG

SEQ ID NO: 2448409 - protein, 18 aa, Entamoeba dispar
NNKETRFNNQDNRSTIGY

SEQ ID NO: 2448410 - protein, 11 aa, Entamoeba dispar
NNKETSEGFKS

SEQ ID NO: 2448411 - protein, 8 aa, Entamoeba dispar
NNKETSYK

SEQ ID NO: 2448412 - protein, 60 aa, Entamoeba dispar
NNKGKKEKGKRKNEKIKDETNEKEAIEEPTLNEEKGSCTDTKPNEDNQIVKGKEGEKEEY

SEQ ID NO: 2448413 - protein, 5 aa, Entamoeba dispar
NNKGV

SEQ ID NO: 2448414 - protein, 8 aa, Entamoeba dispar
NNKHPTAG

SEQ ID NO: 2448415 - protein, 5 aa, Entamoeba dispar
NNKIE

SEQ ID NO: 2448416 - protein, 6 aa, Entamoeba dispar
NNKIEK

SEQ ID NO: 2448417 - protein, 10 aa, Entamoeba dispar
NNKIESIPKN

SEQ ID NO: 2448418 - protein, 10 aa, Entamoeba dispar
NNKIGGEMSP

SEQ ID NO: 2448419 - protein, 13 aa, Entamoeba dispar
NNKINNKWNDERE

SEQ ID NO: 2448420 - protein, 10 aa, Entamoeba dispar
NNKKDGDPVC

SEQ ID NO: 2448421 - protein, 5 aa, Entamoeba dispar
NNKKF

SEQ ID NO: 2448422 - protein, 6 aa, Entamoeba dispar
NNKKNI

SEQ ID NO: 2448423 - protein, 7 aa, Entamoeba dispar
NNKKNRN

SEQ ID NO: 2448424 - protein, 9 aa, Entamoeba dispar
NNKNASLGK

SEQ ID NO: 2448425 - protein, 10 aa, Entamoeba dispar
NNKNTGNTEM

SEQ ID NO: 2448426 - protein, 7 aa, Entamoeba dispar
NNKNTPV

SEQ ID NO: 2448427 - protein, 5 aa, Entamoeba dispar
NNKPL

SEQ ID NO: 2448428 - protein, 8 aa, Entamoeba dispar
NNKQKTIK

SEQ ID NO: 2448429 - protein, 20 aa, Entamoeba dispar
NNKQKVPNLPPIKREPIEPT

SEQ ID NO: 2448430 - protein, 7 aa, Entamoeba dispar
NNKRNDI

SEQ ID NO: 2448431 - protein, 9 aa, Entamoeba dispar
NNKSGKAIG

SEQ ID NO: 2448432 - protein, 6 aa, Entamoeba dispar
NNKSLQ

SEQ ID NO: 2448433 - protein, 25 aa, Entamoeba dispar
NNKSSTCSNDDKTIDMEQKTEIDDC

SEQ ID NO: 2448434 - protein, 9 aa, Entamoeba dispar
NNKTEDYSK

SEQ ID NO: 2448435 - protein, 10 aa, Entamoeba dispar
NNKTEGSLDD

SEQ ID NO: 2448436 - protein, 8 aa, Entamoeba dispar
NNKTGGLR

SEQ ID NO: 2448437 - protein, 5 aa, Entamoeba dispar
NNKTI

SEQ ID NO: 2448438 - protein, 7 aa, Entamoeba dispar
NNKTITE

SEQ ID NO: 2448439 - protein, 6 aa, Entamoeba dispar
NNKTLP

SEQ ID NO: 2448440 - protein, 11 aa, Entamoeba dispar
NNKTNKKGFNN

SEQ ID NO: 2448441 - protein, 7 aa, Entamoeba dispar
NNKTTIE

SEQ ID NO: 2448442 - protein, 4 aa, Entamoeba dispar
NNKV

SEQ ID NO: 2448443 - protein, 10 aa, Entamoeba dispar
NNKVSKNGSY

SEQ ID NO: 2448444 - protein, 6 aa, Entamoeba dispar
NNKVSN

SEQ ID NO: 2448445 - protein, 35 aa, Entamoeba dispar
NNKVTKKSTKNTEKKNGLKKVSLTPKAKKCVSALK

SEQ ID NO: 2448446 - protein, 8 aa, Entamoeba dispar
NNKYHTKV

SEQ ID NO: 2448447 - protein, 7 aa, Entamoeba dispar
NNLAEEA

SEQ ID NO: 2448448 - protein, 5 aa, Entamoeba dispar
NNLAP

SEQ ID NO: 2448449 - protein, 4 aa, Entamoeba dispar
NNLD

SEQ ID NO: 2448450 - protein, 6 aa, Entamoeba dispar
NNLDKD

SEQ ID NO: 2448451 - protein, 29 aa, Entamoeba dispar
NNLDNQQMSNDESINQSGNGSDRTYQTTQ

SEQ ID NO: 2448452 - protein, 6 aa, Entamoeba dispar
NNLEEA

SEQ ID NO: 2448453 - protein, 40 aa, Entamoeba dispar
NNLEKRIEETKESITKKSLEEVKKNNKDPLSGEISSEAAT

SEQ ID NO: 2448454 - protein, 7 aa, Entamoeba dispar
NNLGDAN

SEQ ID NO: 2448455 - protein, 5 aa, Entamoeba dispar
NNLGN

SEQ ID NO: 2448456 - protein, 6 aa, Entamoeba dispar
NNLGNN

SEQ ID NO: 2448457 - protein, 8 aa, Entamoeba dispar
NNLKNQPL

SEQ ID NO: 2448458 - protein, 18 aa, Entamoeba dispar
NNLKPTEIEERQKEEDEV

SEQ ID NO: 2448459 - protein, 10 aa, Entamoeba dispar
NNLKSKEKEL

SEQ ID NO: 2448460 - protein, 18 aa, Entamoeba dispar
NNLLQSKKKYSQKPLNRS

SEQ ID NO: 2448461 - protein, 34 aa, Entamoeba dispar
NNLNAPESSSSNVSLEKDDKSDDSSKSIQTPRGG

SEQ ID NO: 2448462 - protein, 9 aa, Entamoeba dispar
NNLNESELG

SEQ ID NO: 2448463 - protein, 5 aa, Entamoeba dispar
NNLQQ

SEQ ID NO: 2448464 - protein, 6 aa, Entamoeba dispar
NNLQTE

SEQ ID NO: 2448465 - protein, 6 aa, Entamoeba dispar
NNLRTD

SEQ ID NO: 2448466 - protein, 34 aa, Entamoeba dispar
NNLSASLSNEQEELQKPESPFSTDNKNDKMHSEE

SEQ ID NO: 2448467 - protein, 13 aa, Entamoeba dispar
NNLSTLPKSLSRL

SEQ ID NO: 2448468 - protein, 6 aa, Entamoeba dispar
NNLTNN

SEQ ID NO: 2448469 - protein, 10 aa, Entamoeba dispar
NNLTSIPKSI

SEQ ID NO: 2448470 - protein, 7 aa, Entamoeba dispar
NNMENEL

SEQ ID NO: 2448471 - protein, 6 aa, Entamoeba dispar
NNMKET

SEQ ID NO: 2448472 - protein, 7 aa, Entamoeba dispar
NNMKGGM

SEQ ID NO: 2448473 - protein, 13 aa, Entamoeba dispar
NNMPTKSKMNCTI

SEQ ID NO: 2448474 - protein, 8 aa, Entamoeba dispar
NNMTDGAT

SEQ ID NO: 2448475 - protein, 10 aa, Entamoeba dispar
NNNDEKNVQC

SEQ ID NO: 2448476 - protein, 10 aa, Entamoeba dispar
NNNDEQSLER

SEQ ID NO: 2448477 - protein, 4 aa, Entamoeba dispar
NNNE

SEQ ID NO: 2448478 - protein, 5 aa, Entamoeba dispar
NNNEA

SEQ ID NO: 2448479 - protein, 10 aa, Entamoeba dispar
NNNEFAGNGD

SEQ ID NO: 2448480 - protein, 5 aa, Entamoeba dispar
NNNEI

SEQ ID NO: 2448481 - protein, 8 aa, Entamoeba dispar
NNNEKKKI

SEQ ID NO: 2448482 - protein, 8 aa, Entamoeba dispar
NNNESTYN

SEQ ID NO: 2448483 - protein, 5 aa, Entamoeba dispar
NNNEV

SEQ ID NO: 2448484 - protein, 5 aa, Entamoeba dispar
NNNGE

SEQ ID NO: 2448485 - protein, 6 aa, Entamoeba dispar
NNNGHY

SEQ ID NO: 2448486 - protein, 9 aa, Entamoeba dispar
NNNGSPIPE

SEQ ID NO: 2448487 - protein, 6 aa, Entamoeba dispar
NNNGYG

SEQ ID NO: 2448488 - protein, 6 aa, Entamoeba dispar
NNNHEI

SEQ ID NO: 2448489 - protein, 59 aa, Entamoeba dispar
NNNIPSPRELKTKGKKIDTSLSSTQPNTPKGTSAFYSSYSEDKYDSPRINESSLNPKTF

SEQ ID NO: 2448490 - protein, 4 aa, Entamoeba dispar
NNNK

SEQ ID NO: 2448491 - protein, 6 aa, Entamoeba dispar
NNNKPI

SEQ ID NO: 2448492 - protein, 9 aa, Entamoeba dispar
NNNKPSQMV

SEQ ID NO: 2448493 - protein, 33 aa, Entamoeba dispar
NNNKSATNTQTTNSSIVSTENSAKGSNTTVMQT

SEQ ID NO: 2448494 - protein, 16 aa, Entamoeba dispar
NNNLNEQNEIKQNNIP

SEQ ID NO: 2448495 - protein, 5 aa, Entamoeba dispar
NNNLT

SEQ ID NO: 2448496 - protein, 5 aa, Entamoeba dispar
NNNMN

SEQ ID NO: 2448497 - protein, 12 aa, Entamoeba dispar
NNNNAQAQTGDN

SEQ ID NO: 2448498 - protein, 7 aa, Entamoeba dispar
NNNNDFI

SEQ ID NO: 2448499 - protein, 9 aa, Entamoeba dispar
NNNNDNNNV

SEQ ID NO: 2448500 - protein, 7 aa, Entamoeba dispar
NNNNEEI

SEQ ID NO: 2448501 - protein, 14 aa, Entamoeba dispar
NNNNEFTENITKTE

SEQ ID NO: 2448502 - protein, 7 aa, Entamoeba dispar
NNNNGVE

SEQ ID NO: 2448503 - protein, 5 aa, Entamoeba dispar
NNNNL

SEQ ID NO: 2448504 - protein, 19 aa, Entamoeba dispar
NNNNNNDTNNNTSEYKEEI

SEQ ID NO: 2448505 - protein, 9 aa, Entamoeba dispar
NNNNNNNYK

SEQ ID NO: 2448506 - protein, 9 aa, Entamoeba dispar
NNNNSPSDI

SEQ ID NO: 2448507 - protein, 5 aa, Entamoeba dispar
NNNNT

SEQ ID NO: 2448508 - protein, 6 aa, Entamoeba dispar
NNNPGL

SEQ ID NO: 2448509 - protein, 6 aa, Entamoeba dispar
NNNPID

SEQ ID NO: 2448510 - protein, 7 aa, Entamoeba dispar
NNNPPSA

SEQ ID NO: 2448511 - protein, 12 aa, Entamoeba dispar
NNNQIKELPKQV

SEQ ID NO: 2448512 - protein, 6 aa, Entamoeba dispar
NNNQKD

SEQ ID NO: 2448513 - protein, 16 aa, Entamoeba dispar
NNNQKSEKFFIRRLLI

SEQ ID NO: 2448514 - protein, 8 aa, Entamoeba dispar
NNNQNEYN

SEQ ID NO: 2448515 - protein, 7 aa, Entamoeba dispar
NNNRPLS

SEQ ID NO: 2448516 - protein, 14 aa, Entamoeba dispar
NNNSINNKVSSGTI

SEQ ID NO: 2448517 - protein, 24 aa, Entamoeba dispar
NNNSKKPKITRSTKKKGGKKNKNP

SEQ ID NO: 2448518 - protein, 5 aa, Entamoeba dispar
NNNSS

SEQ ID NO: 2448519 - protein, 10 aa, Entamoeba dispar
NNNSSTLPSG

SEQ ID NO: 2448520 - protein, 36 aa, Entamoeba dispar
NNNTFGKTTNTTNGFGTGFGSTTSGFGNNNNTGFGL

SEQ ID NO: 2448521 - protein, 5 aa, Entamoeba dispar
NNNTK

SEQ ID NO: 2448522 - protein, 6 aa, Entamoeba dispar
NNNTPL

SEQ ID NO: 2448523 - protein, 10 aa, Entamoeba dispar
NNNTSITSTY

SEQ ID NO: 2448524 - protein, 14 aa, Entamoeba dispar
NNNTTQQEEEKLEE

SEQ ID NO: 2448525 - protein, 4 aa, Entamoeba dispar
NNNV

SEQ ID NO: 2448526 - protein, 5 aa, Entamoeba dispar
NNNVE

SEQ ID NO: 2448527 - protein, 4 aa, Entamoeba dispar
NNNW

SEQ ID NO: 2448528 - protein, 4 aa, Entamoeba dispar
NNPD

SEQ ID NO: 2448529 - protein, 9 aa, Entamoeba dispar
NNPDIEPSQ

SEQ ID NO: 2448530 - protein, 4 aa, Entamoeba dispar
NNPE

SEQ ID NO: 2448531 - protein, 12 aa, Entamoeba dispar
NNPEANKQAFTE

SEQ ID NO: 2448532 - protein, 5 aa, Entamoeba dispar
NNPEF

SEQ ID NO: 2448533 - protein, 7 aa, Entamoeba dispar
NNPEFSI

SEQ ID NO: 2448534 - protein, 5 aa, Entamoeba dispar
NNPEG

SEQ ID NO: 2448535 - protein, 6 aa, Entamoeba dispar
NNPESQ

SEQ ID NO: 2448536 - protein, 6 aa, Entamoeba dispar
NNPETQ

SEQ ID NO: 2448537 - protein, 12 aa, Entamoeba dispar
NNPGANKQAFTN

SEQ ID NO: 2448538 - protein, 7 aa, Entamoeba dispar
NNPIGQH

SEQ ID NO: 2448539 - protein, 7 aa, Entamoeba dispar
NNPIGQR

SEQ ID NO: 2448540 - protein, 5 aa, Entamoeba dispar
NNPIK

SEQ ID NO: 2448541 - protein, 5 aa, Entamoeba dispar
NNPIT

SEQ ID NO: 2448542 - protein, 7 aa, Entamoeba dispar
NNPKDGV

SEQ ID NO: 2448543 - protein, 9 aa, Entamoeba dispar
NNPKQRTPK

SEQ ID NO: 2448544 - protein, 5 aa, Entamoeba dispar
NNPKR

SEQ ID NO: 2448545 - protein, 5 aa, Entamoeba dispar
NNPKS

SEQ ID NO: 2448546 - protein, 11 aa, Entamoeba dispar
NNPKSLSSAET

SEQ ID NO: 2448547 - protein, 6 aa, Entamoeba dispar
NNPKTL

SEQ ID NO: 2448548 - protein, 9 aa, Entamoeba dispar
NNPLGTSGK

SEQ ID NO: 2448549 - protein, 7 aa, Entamoeba dispar
NNPLPND

SEQ ID NO: 2448550 - protein, 9 aa, Entamoeba dispar
NNPMSGKEL

SEQ ID NO: 2448551 - protein, 9 aa, Entamoeba dispar
NNPNASESD

SEQ ID NO: 2448552 - protein, 8 aa, Entamoeba dispar
NNPNINQN

SEQ ID NO: 2448553 - protein, 7 aa, Entamoeba dispar
NNPNISF

SEQ ID NO: 2448554 - protein, 26 aa, Entamoeba dispar
NNPNLTNKYSSQSMSKSTTESGLNQS

SEQ ID NO: 2448555 - protein, 9 aa, Entamoeba dispar
NNPPEGMSQ

SEQ ID NO: 2448556 - protein, 8 aa, Entamoeba dispar
NNPPSLRI

SEQ ID NO: 2448557 - protein, 6 aa, Entamoeba dispar
NNPPVP

SEQ ID NO: 2448558 - protein, 8 aa, Entamoeba dispar
NNPQGEDI

SEQ ID NO: 2448559 - protein, 5 aa, Entamoeba dispar
NNPQM

SEQ ID NO: 2448560 - protein, 5 aa, Entamoeba dispar
NNPQV

SEQ ID NO: 2448561 - protein, 45 aa, Entamoeba dispar
NNPQYKQSLKKGFNGKKSIEKTKKASISLRSSQSNKKEKQGCCIL

SEQ ID NO: 2448562 - protein, 4 aa, Entamoeba dispar
NNPR

SEQ ID NO: 2448563 - protein, 9 aa, Entamoeba dispar
NNPSKAKFH

SEQ ID NO: 2448564 - protein, 6 aa, Entamoeba dispar
NNPSNQ

SEQ ID NO: 2448565 - protein, 7 aa, Entamoeba dispar
NNPTDRN

SEQ ID NO: 2448566 - protein, 7 aa, Entamoeba dispar
NNPTEDC

SEQ ID NO: 2448567 - protein, 6 aa, Entamoeba dispar
NNPTEQ

SEQ ID NO: 2448568 - protein, 21 aa, Entamoeba dispar
NNPTGAQDKPKKAVVIADCGQ

SEQ ID NO: 2448569 - protein, 6 aa, Entamoeba dispar
NNPTII

SEQ ID NO: 2448570 - protein, 8 aa, Entamoeba dispar
NNPVKGKH

SEQ ID NO: 2448571 - protein, 4 aa, Entamoeba dispar
NNQD

SEQ ID NO: 2448572 - protein, 10 aa, Entamoeba dispar
NNQDFEGAEV

SEQ ID NO: 2448573 - protein, 6 aa, Entamoeba dispar
NNQEKA

SEQ ID NO: 2448574 - protein, 7 aa, Entamoeba dispar
NNQESIK

SEQ ID NO: 2448575 - protein, 9 aa, Entamoeba dispar
NNQETQREE

SEQ ID NO: 2448576 - protein, 8 aa, Entamoeba dispar
NNQFDPQY

SEQ ID NO: 2448577 - protein, 5 aa, Entamoeba dispar
NNQHY

SEQ ID NO: 2448578 - protein, 11 aa, Entamoeba dispar
NNQINSSKQKS

SEQ ID NO: 2448579 - protein, 8 aa, Entamoeba dispar
NNQINTSR

SEQ ID NO: 2448580 - protein, 5 aa, Entamoeba dispar
NNQKR

SEQ ID NO: 2448581 - protein, 13 aa, Entamoeba dispar
NNQLDSSKNKESL

SEQ ID NO: 2448582 - protein, 5 aa, Entamoeba dispar
NNQLR

SEQ ID NO: 2448583 - protein, 5 aa, Entamoeba dispar
NNQNN

SEQ ID NO: 2448584 - protein, 7 aa, Entamoeba dispar
NNQNQNE

SEQ ID NO: 2448585 - protein, 10 aa, Entamoeba dispar
NNQNQTQQVT

SEQ ID NO: 2448586 - protein, 27 aa, Entamoeba dispar
NNQNRNSNSELAVSDSPSPRISKTPDL

SEQ ID NO: 2448587 - protein, 8 aa, Entamoeba dispar
NNQNTYNS

SEQ ID NO: 2448588 - protein, 10 aa, Entamoeba dispar
NNQPKTISTG

SEQ ID NO: 2448589 - protein, 7 aa, Entamoeba dispar
NNQQEGE

SEQ ID NO: 2448590 - protein, 6 aa, Entamoeba dispar
NNQQME

SEQ ID NO: 2448591 - protein, 12 aa, Entamoeba dispar
NNQQPQNQYEQG

SEQ ID NO: 2448592 - protein, 6 aa, Entamoeba dispar
NNQREG

SEQ ID NO: 2448593 - protein, 4 aa, Entamoeba dispar
NNQS

SEQ ID NO: 2448594 - protein, 33 aa, Entamoeba dispar
NNQSDDENERNDINQVNEEQPIDEKEEEKRNEM

SEQ ID NO: 2448595 - protein, 9 aa, Entamoeba dispar
NNQSRIREE

SEQ ID NO: 2448596 - protein, 10 aa, Entamoeba dispar
NNQSTNPQPN

SEQ ID NO: 2448597 - protein, 13 aa, Entamoeba dispar
NNQTDASEESSEV

SEQ ID NO: 2448598 - protein, 8 aa, Entamoeba dispar
NNQTNTEN

SEQ ID NO: 2448599 - protein, 16 aa, Entamoeba dispar
NNQTQIKLSTNKSTDI

SEQ ID NO: 2448600 - protein, 5 aa, Entamoeba dispar
NNQTV

SEQ ID NO: 2448601 - protein, 5 aa, Entamoeba dispar
NNQTY

SEQ ID NO: 2448602 - protein, 4 aa, Entamoeba dispar
NNQW

SEQ ID NO: 2448603 - protein, 7 aa, Entamoeba dispar
NNQYNRE

SEQ ID NO: 2448604 - protein, 5 aa, Entamoeba dispar
NNRCA

SEQ ID NO: 2448605 - protein, 4 aa, Entamoeba dispar
NNRD

SEQ ID NO: 2448606 - protein, 11 aa, Entamoeba dispar
NNRDRNYAYED

SEQ ID NO: 2448607 - protein, 8 aa, Entamoeba dispar
NNREEFKK

SEQ ID NO: 2448608 - protein, 6 aa, Entamoeba dispar
NNREGS

SEQ ID NO: 2448609 - protein, 5 aa, Entamoeba dispar
NNRGC

SEQ ID NO: 2448610 - protein, 4 aa, Entamoeba dispar
NNRI

SEQ ID NO: 2448611 - protein, 8 aa, Entamoeba dispar
NNRKERRD

SEQ ID NO: 2448612 - protein, 13 aa, Entamoeba dispar
NNRKKFEEETETF

SEQ ID NO: 2448613 - protein, 6 aa, Entamoeba dispar
NNRKNS

SEQ ID NO: 2448614 - protein, 5 aa, Entamoeba dispar
NNRLI

SEQ ID NO: 2448615 - protein, 10 aa, Entamoeba dispar
NNRMEQRGRY

SEQ ID NO: 2448616 - protein, 7 aa, Entamoeba dispar
NNRNSNQ

SEQ ID NO: 2448617 - protein, 6 aa, Entamoeba dispar
NNRPHK

SEQ ID NO: 2448618 - protein, 26 aa, Entamoeba dispar
NNRQQQGVNKSLQQQINDANRIANEA

SEQ ID NO: 2448619 - protein, 7 aa, Entamoeba dispar
NNRQREI

SEQ ID NO: 2448620 - protein, 9 aa, Entamoeba dispar
NNRRETTIP

SEQ ID NO: 2448621 - protein, 5 aa, Entamoeba dispar
NNRRR

SEQ ID NO: 2448622 - protein, 10 aa, Entamoeba dispar
NNRSSGKIHN

SEQ ID NO: 2448623 - protein, 5 aa, Entamoeba dispar
NNRTI

SEQ ID NO: 2448624 - protein, 7 aa, Entamoeba dispar
NNRTPAI

SEQ ID NO: 2448625 - protein, 8 aa, Entamoeba dispar
NNRTPNCE

SEQ ID NO: 2448626 - protein, 5 aa, Entamoeba dispar
NNRVS

SEQ ID NO: 2448627 - protein, 17 aa, Entamoeba dispar
NNRYRKDTKLGEGTYGE

SEQ ID NO: 2448628 - protein, 6 aa, Entamoeba dispar
NNSDFT

SEQ ID NO: 2448629 - protein, 5 aa, Entamoeba dispar
NNSDI

SEQ ID NO: 2448630 - protein, 7 aa, Entamoeba dispar
NNSDNNF

SEQ ID NO: 2448631 - protein, 10 aa, Entamoeba dispar
NNSEDEEEEI

SEQ ID NO: 2448632 - protein, 24 aa, Entamoeba dispar
NNSEKSPFLNKEESTFQSGDQKEK

SEQ ID NO: 2448633 - protein, 10 aa, Entamoeba dispar
NNSELSGSAL

SEQ ID NO: 2448634 - protein, 4 aa, Entamoeba dispar
NNSF

SEQ ID NO: 2448635 - protein, 9 aa, Entamoeba dispar
NNSFGTSRH

SEQ ID NO: 2448636 - protein, 6 aa, Entamoeba dispar
NNSFNQ

SEQ ID NO: 2448637 - protein, 9 aa, Entamoeba dispar
NNSGIPSAN

SEQ ID NO: 2448638 - protein, 5 aa, Entamoeba dispar
NNSGW

SEQ ID NO: 2448639 - protein, 6 aa, Entamoeba dispar
NNSHDA

SEQ ID NO: 2448640 - protein, 59 aa, Entamoeba dispar
NNSIPRRGQLRQRPQSRVGDNRPQSRMGDTRSQSRLGNCQSNRIPEQQQMNQQKQNTQE

SEQ ID NO: 2448641 - protein, 4 aa, Entamoeba dispar
NNSK

SEQ ID NO: 2448642 - protein, 11 aa, Entamoeba dispar
NNSKGRGSAID

SEQ ID NO: 2448643 - protein, 6 aa, Entamoeba dispar
NNSKID

SEQ ID NO: 2448644 - protein, 6 aa, Entamoeba dispar
NNSKSQ

SEQ ID NO: 2448645 - protein, 18 aa, Entamoeba dispar
NNSLSESVQKETKKCAQL

SEQ ID NO: 2448646 - protein, 25 aa, Entamoeba dispar
NNSLTKSESENKERKDNEIEDQENE

SEQ ID NO: 2448647 - protein, 12 aa, Entamoeba dispar
NNSNEKTDDLDK

SEQ ID NO: 2448648 - protein, 10 aa, Entamoeba dispar
NNSNGELDGE

SEQ ID NO: 2448649 - protein, 9 aa, Entamoeba dispar
NNSNIPSSS

SEQ ID NO: 2448650 - protein, 6 aa, Entamoeba dispar
NNSNKY

SEQ ID NO: 2448651 - protein, 7 aa, Entamoeba dispar
NNSNNGM

SEQ ID NO: 2448652 - protein, 6 aa, Entamoeba dispar
NNSNQL

SEQ ID NO: 2448653 - protein, 11 aa, Entamoeba dispar
NNSNRENTASN

SEQ ID NO: 2448654 - protein, 9 aa, Entamoeba dispar
NNSNVEDKD

SEQ ID NO: 2448655 - protein, 4 aa, Entamoeba dispar
NNSP

SEQ ID NO: 2448656 - protein, 11 aa, Entamoeba dispar
NNSPETKSDID

SEQ ID NO: 2448657 - protein, 10 aa, Entamoeba dispar
NNSPETKTDI

SEQ ID NO: 2448658 - protein, 8 aa, Entamoeba dispar
NNSPKEIK

SEQ ID NO: 2448659 - protein, 6 aa, Entamoeba dispar
NNSPLQ

SEQ ID NO: 2448660 - protein, 8 aa, Entamoeba dispar
NNSQKPLT

SEQ ID NO: 2448661 - protein, 7 aa, Entamoeba dispar
NNSRTEI

SEQ ID NO: 2448662 - protein, 5 aa, Entamoeba dispar
NNSSF

SEQ ID NO: 2448663 - protein, 6 aa, Entamoeba dispar
NNSSIY

SEQ ID NO: 2448664 - protein, 12 aa, Entamoeba dispar
NNSSNLSDSAPL

SEQ ID NO: 2448665 - protein, 15 aa, Entamoeba dispar
NNSSNTHSPQPKSQT

SEQ ID NO: 2448666 - protein, 10 aa, Entamoeba dispar
NNSSRQNHPP

SEQ ID NO: 2448667 - protein, 7 aa, Entamoeba dispar
NNSSSHL

SEQ ID NO: 2448668 - protein, 7 aa, Entamoeba dispar
NNSTGVN

SEQ ID NO: 2448669 - protein, 7 aa, Entamoeba dispar
NNSTNEE

SEQ ID NO: 2448670 - protein, 5 aa, Entamoeba dispar
NNSTP

SEQ ID NO: 2448671 - protein, 6 aa, Entamoeba dispar
NNSVEI

SEQ ID NO: 2448672 - protein, 4 aa, Entamoeba dispar
NNSY

SEQ ID NO: 2448673 - protein, 5 aa, Entamoeba dispar
NNSYQ

SEQ ID NO: 2448674 - protein, 7 aa, Entamoeba dispar
NNTCESC

SEQ ID NO: 2448675 - protein, 8 aa, Entamoeba dispar
NNTDNTYK

SEQ ID NO: 2448676 - protein, 8 aa, Entamoeba dispar
NNTDSTYK

SEQ ID NO: 2448677 - protein, 6 aa, Entamoeba dispar
NNTEKV

SEQ ID NO: 2448678 - protein, 6 aa, Entamoeba dispar
NNTFTD

SEQ ID NO: 2448679 - protein, 10 aa, Entamoeba dispar
NNTGAGQPVS

SEQ ID NO: 2448680 - protein, 18 aa, Entamoeba dispar
NNTIPKVQEDNKQEDVQN

SEQ ID NO: 2448681 - protein, 6 aa, Entamoeba dispar
NNTKME

SEQ ID NO: 2448682 - protein, 11 aa, Entamoeba dispar
NNTKNINTGTN

SEQ ID NO: 2448683 - protein, 7 aa, Entamoeba dispar
NNTKPES

SEQ ID NO: 2448684 - protein, 11 aa, Entamoeba dispar
NNTLSQQQQTQ

SEQ ID NO: 2448685 - protein, 4 aa, Entamoeba dispar
NNTN

SEQ ID NO: 2448686 - protein, 8 aa, Entamoeba dispar
NNTNKIEE

SEQ ID NO: 2448687 - protein, 8 aa, Entamoeba dispar
NNTNSNRV

SEQ ID NO: 2448688 - protein, 14 aa, Entamoeba dispar
NNTNSNRVKSFFVW

SEQ ID NO: 2448689 - protein, 5 aa, Entamoeba dispar
NNTNT

SEQ ID NO: 2448690 - protein, 6 aa, Entamoeba dispar
NNTPGE

SEQ ID NO: 2448691 - protein, 6 aa, Entamoeba dispar
NNTPMF

SEQ ID NO: 2448692 - protein, 7 aa, Entamoeba dispar
NNTQEKG

SEQ ID NO: 2448693 - protein, 9 aa, Entamoeba dispar
NNTSDCDTE

SEQ ID NO: 2448694 - protein, 8 aa, Entamoeba dispar
NNTSIEGV

SEQ ID NO: 2448695 - protein, 11 aa, Entamoeba dispar
NNTSQYKKSGF

SEQ ID NO: 2448696 - protein, 16 aa, Entamoeba dispar
NNTSSRINQSKIKSDV

SEQ ID NO: 2448697 - protein, 4 aa, Entamoeba dispar
NNTT

SEQ ID NO: 2448698 - protein, 34 aa, Entamoeba dispar
NNTTTQLNNSTEPNNSKRPSNITQLNTTNNLTNS

SEQ ID NO: 2448699 - protein, 7 aa, Entamoeba dispar
NNTTVTL

SEQ ID NO: 2448700 - protein, 6 aa, Entamoeba dispar
NNTWSG

SEQ ID NO: 2448701 - protein, 9 aa, Entamoeba dispar
NNVETNGIE

SEQ ID NO: 2448702 - protein, 6 aa, Entamoeba dispar
NNVGRT

SEQ ID NO: 2448703 - protein, 7 aa, Entamoeba dispar
NNVGVSG

SEQ ID NO: 2448704 - protein, 11 aa, Entamoeba dispar
NNVIRKRGKNL

SEQ ID NO: 2448705 - protein, 6 aa, Entamoeba dispar
NNVKDD

SEQ ID NO: 2448706 - protein, 8 aa, Entamoeba dispar
NNVKGKDV

SEQ ID NO: 2448707 - protein, 21 aa, Entamoeba dispar
NNVKSGYKKDKKALRDSPHSD

SEQ ID NO: 2448708 - protein, 21 aa, Entamoeba dispar
NNVNLTKKRRATLISGKEKHE

SEQ ID NO: 2448709 - protein, 6 aa, Entamoeba dispar
NNVNPS

SEQ ID NO: 2448710 - protein, 12 aa, Entamoeba dispar
NNVQQSAREREV

SEQ ID NO: 2448711 - protein, 6 aa, Entamoeba dispar
NNVSTK

SEQ ID NO: 2448712 - protein, 5 aa, Entamoeba dispar
NNVTD

SEQ ID NO: 2448713 - protein, 14 aa, Entamoeba dispar
NNVTPGCEKNEDAL

SEQ ID NO: 2448714 - protein, 11 aa, Entamoeba dispar
NNVTSTKEPYF

SEQ ID NO: 2448715 - protein, 10 aa, Entamoeba dispar
NNYEPLNDPT

SEQ ID NO: 2448716 - protein, 11 aa, Entamoeba dispar
NNYGDKITNDT

SEQ ID NO: 2448717 - protein, 9 aa, Entamoeba dispar
NNYGDKTVT

SEQ ID NO: 2448718 - protein, 6 aa, Entamoeba dispar
NNYGLK

SEQ ID NO: 2448719 - protein, 6 aa, Entamoeba dispar
NNYISE

SEQ ID NO: 2448720 - protein, 7 aa, Entamoeba dispar
NNYNTNG

SEQ ID NO: 2448721 - protein, 12 aa, Entamoeba dispar
NNYQEKVQSSFK

SEQ ID NO: 2448722 - protein, 5 aa, Entamoeba dispar
NNYQI

SEQ ID NO: 2448723 - protein, 10 aa, Entamoeba dispar
NNYQTKNGKV

SEQ ID NO: 2448724 - protein, 6 aa, Entamoeba dispar
NNYSDG

SEQ ID NO: 2448725 - protein, 13 aa, Entamoeba dispar
NNYSTSTSGLSSI

SEQ ID NO: 2448726 - protein, 9 aa, Entamoeba dispar
NNYTSPQLY

SEQ ID NO: 2448727 - protein, 7 aa, Entamoeba dispar
NNYVSPA

SEQ ID NO: 2448728 - protein, 8 aa, Entamoeba dispar
NPAEKTTR

SEQ ID NO: 2448729 - protein, 15 aa, Entamoeba dispar
NPAFDSQTKETLKTQ

SEQ ID NO: 2448730 - protein, 4 aa, Entamoeba dispar
NPAI

SEQ ID NO: 2448731 - protein, 6 aa, Entamoeba dispar
NPANTN

SEQ ID NO: 2448732 - protein, 5 aa, Entamoeba dispar
NPASE

SEQ ID NO: 2448733 - protein, 6 aa, Entamoeba dispar
NPATRP

SEQ ID NO: 2448734 - protein, 6 aa, Entamoeba dispar
NPCGIT

SEQ ID NO: 2448735 - protein, 7 aa, Entamoeba dispar
NPCGRCS

SEQ ID NO: 2448736 - protein, 11 aa, Entamoeba dispar
NPDAEADKELS

SEQ ID NO: 2448737 - protein, 13 aa, Entamoeba dispar
NPDAPKRASAEEL

SEQ ID NO: 2448738 - protein, 8 aa, Entamoeba dispar
NPDDPNHT

SEQ ID NO: 2448739 - protein, 8 aa, Entamoeba dispar
NPDDPPIS

SEQ ID NO: 2448740 - protein, 5 aa, Entamoeba dispar
NPDDT

SEQ ID NO: 2448741 - protein, 4 aa, Entamoeba dispar
NPDE

SEQ ID NO: 2448742 - protein, 5 aa, Entamoeba dispar
NPDEI

SEQ ID NO: 2448743 - protein, 4 aa, Entamoeba dispar
NPDF

SEQ ID NO: 2448744 - protein, 4 aa, Entamoeba dispar
NPDI

SEQ ID NO: 2448745 - protein, 6 aa, Entamoeba dispar
NPDIDS

SEQ ID NO: 2448746 - protein, 6 aa, Entamoeba dispar
NPDKTA

SEQ ID NO: 2448747 - protein, 6 aa, Entamoeba dispar
NPDPCN

SEQ ID NO: 2448748 - protein, 23 aa, Entamoeba dispar
NPDPNEISSKNNLYGTQRKGNGI

SEQ ID NO: 2448749 - protein, 18 aa, Entamoeba dispar
NPDQTDSKGRRKQRINDE

SEQ ID NO: 2448750 - protein, 26 aa, Entamoeba dispar
NPDSTDSSDSQPSCHSSSSQPPPSQF

SEQ ID NO: 2448751 - protein, 16 aa, Entamoeba dispar
NPDTFAATDRWKEDLE

SEQ ID NO: 2448752 - protein, 5 aa, Entamoeba dispar
NPDVK

SEQ ID NO: 2448753 - protein, 8 aa, Entamoeba dispar
NPEAINDQ

SEQ ID NO: 2448754 - protein, 16 aa, Entamoeba dispar
NPEEPQVNPDEPPNFN

SEQ ID NO: 2448755 - protein, 6 aa, Entamoeba dispar
NPEEVE

SEQ ID NO: 2448756 - protein, 13 aa, Entamoeba dispar
NPEIKTDNENIQP

SEQ ID NO: 2448757 - protein, 10 aa, Entamoeba dispar
NPEKESSHQE

SEQ ID NO: 2448758 - protein, 6 aa, Entamoeba dispar
NPEKHL

SEQ ID NO: 2448759 - protein, 6 aa, Entamoeba dispar
NPELPS

SEQ ID NO: 2448760 - protein, 5 aa, Entamoeba dispar
NPELS

SEQ ID NO: 2448761 - protein, 5 aa, Entamoeba dispar
NPEMM

SEQ ID NO: 2448762 - protein, 4 aa, Entamoeba dispar
NPEN

SEQ ID NO: 2448763 - protein, 31 aa, Entamoeba dispar
NPENKEIDISNTDTITTEDTIPSLKTNEEAI

SEQ ID NO: 2448764 - protein, 9 aa, Entamoeba dispar
NPENPEEFK

SEQ ID NO: 2448765 - protein, 4 aa, Entamoeba dispar
NPEP

SEQ ID NO: 2448766 - protein, 5 aa, Entamoeba dispar
NPEPQ

SEQ ID NO: 2448767 - protein, 5 aa, Entamoeba dispar
NPEQL

SEQ ID NO: 2448768 - protein, 9 aa, Entamoeba dispar
NPEQTNDFK

SEQ ID NO: 2448769 - protein, 8 aa, Entamoeba dispar
NPESNTDV

SEQ ID NO: 2448770 - protein, 6 aa, Entamoeba dispar
NPETGM

SEQ ID NO: 2448771 - protein, 7 aa, Entamoeba dispar
NPETGNY

SEQ ID NO: 2448772 - protein, 5 aa, Entamoeba dispar
NPETI

SEQ ID NO: 2448773 - protein, 10 aa, Entamoeba dispar
NPETKSWGQA

SEQ ID NO: 2448774 - protein, 5 aa, Entamoeba dispar
NPETQ

SEQ ID NO: 2448775 - protein, 6 aa, Entamoeba dispar
NPETTK

SEQ ID NO: 2448776 - protein, 13 aa, Entamoeba dispar
NPEVYEAKAGTHG

SEQ ID NO: 2448777 - protein, 5 aa, Entamoeba dispar
NPEYK

SEQ ID NO: 2448778 - protein, 26 aa, Entamoeba dispar
NPFEELPDRDDIKSFDKSAVDKSLKT

SEQ ID NO: 2448779 - protein, 10 aa, Entamoeba dispar
NPFKSKVSSS

SEQ ID NO: 2448780 - protein, 4 aa, Entamoeba dispar
NPFN

SEQ ID NO: 2448781 - protein, 6 aa, Entamoeba dispar
NPFPQI

SEQ ID NO: 2448782 - protein, 14 aa, Entamoeba dispar
NPFQNLSSTDNSGY

SEQ ID NO: 2448783 - protein, 21 aa, Entamoeba dispar
NPFQYQSDKKRHQKERERNEG

SEQ ID NO: 2448784 - protein, 4 aa, Entamoeba dispar
NPFR

SEQ ID NO: 2448785 - protein, 24 aa, Entamoeba dispar
NPFSNQTNQPPSTKPNEATQTQST

SEQ ID NO: 2448786 - protein, 6 aa, Entamoeba dispar
NPFSPT

SEQ ID NO: 2448787 - protein, 15 aa, Entamoeba dispar
NPFSSRLNQNTTTNS

SEQ ID NO: 2448788 - protein, 6 aa, Entamoeba dispar
NPFYSG

SEQ ID NO: 2448789 - protein, 15 aa, Entamoeba dispar
NPGGDFGKRELSPAM

SEQ ID NO: 2448790 - protein, 19 aa, Entamoeba dispar
NPGKRISAREAMKDPFFIK

SEQ ID NO: 2448791 - protein, 11 aa, Entamoeba dispar
NPGSATGAYSP

SEQ ID NO: 2448792 - protein, 11 aa, Entamoeba dispar
NPGSKTMTEEA

SEQ ID NO: 2448793 - protein, 10 aa, Entamoeba dispar
NPGTGSGKEL

SEQ ID NO: 2448794 - protein, 4 aa, Entamoeba dispar
NPHI

SEQ ID NO: 2448795 - protein, 5 aa, Entamoeba dispar
NPHLP

SEQ ID NO: 2448796 - protein, 4 aa, Entamoeba dispar
NPHT

SEQ ID NO: 2448797 - protein, 11 aa, Entamoeba dispar
NPHTNKSKGYG

SEQ ID NO: 2448798 - protein, 5 aa, Entamoeba dispar
NPIED

SEQ ID NO: 2448799 - protein, 7 aa, Entamoeba dispar
NPIGDKA

SEQ ID NO: 2448800 - protein, 11 aa, Entamoeba dispar
NPIKKERDKNI

SEQ ID NO: 2448801 - protein, 5 aa, Entamoeba dispar
NPIKR

SEQ ID NO: 2448802 - protein, 4 aa, Entamoeba dispar
NPIN

SEQ ID NO: 2448803 - protein, 7 aa, Entamoeba dispar
NPINGEI

SEQ ID NO: 2448804 - protein, 7 aa, Entamoeba dispar
NPINSNN

SEQ ID NO: 2448805 - protein, 25 aa, Entamoeba dispar
NPINSPSEEQIQQSDAMSEQPIIED

SEQ ID NO: 2448806 - protein, 8 aa, Entamoeba dispar
NPINSPTI

SEQ ID NO: 2448807 - protein, 8 aa, Entamoeba dispar
NPINTVPP

SEQ ID NO: 2448808 - protein, 8 aa, Entamoeba dispar
NPIPEGTT

SEQ ID NO: 2448809 - protein, 7 aa, Entamoeba dispar
NPIPLND

SEQ ID NO: 2448810 - protein, 19 aa, Entamoeba dispar
NPIPPSSHNNTISNSNSTL

SEQ ID NO: 2448811 - protein, 4 aa, Entamoeba dispar
NPIQ

SEQ ID NO: 2448812 - protein, 21 aa, Entamoeba dispar
NPIQPQNGQQQNTQVQPQNNM

SEQ ID NO: 2448813 - protein, 8 aa, Entamoeba dispar
NPISRPNA

SEQ ID NO: 2448814 - protein, 6 aa, Entamoeba dispar
NPISSV

SEQ ID NO: 2448815 - protein, 6 aa, Entamoeba dispar
NPITNE

SEQ ID NO: 2448816 - protein, 5 aa, Entamoeba dispar
NPKAQ

SEQ ID NO: 2448817 - protein, 8 aa, Entamoeba dispar
NPKDLAPY

SEQ ID NO: 2448818 - protein, 8 aa, Entamoeba dispar
NPKDPNIF

SEQ ID NO: 2448819 - protein, 9 aa, Entamoeba dispar
NPKDVREDI

SEQ ID NO: 2448820 - protein, 8 aa, Entamoeba dispar
NPKEGAQK

SEQ ID NO: 2448821 - protein, 8 aa, Entamoeba dispar
NPKESSSK

SEQ ID NO: 2448822 - protein, 8 aa, Entamoeba dispar
NPKGKAQD

SEQ ID NO: 2448823 - protein, 4 aa, Entamoeba dispar
NPKK

SEQ ID NO: 2448824 - protein, 6 aa, Entamoeba dispar
NPKKHG

SEQ ID NO: 2448825 - protein, 18 aa, Entamoeba dispar
NPKKKSTGLLSKAKKQCS

SEQ ID NO: 2448826 - protein, 17 aa, Entamoeba dispar
NPKKRIDDGEALERDEK

SEQ ID NO: 2448827 - protein, 8 aa, Entamoeba dispar
NPKKTNPM

SEQ ID NO: 2448828 - protein, 18 aa, Entamoeba dispar
NPKMNKKETKEPFSFGKS

SEQ ID NO: 2448829 - protein, 5 aa, Entamoeba dispar
NPKPV

SEQ ID NO: 2448830 - protein, 6 aa, Entamoeba dispar
NPKSFE

SEQ ID NO: 2448831 - protein, 10 aa, Entamoeba dispar
NPKSQDTEGF

SEQ ID NO: 2448832 - protein, 18 aa, Entamoeba dispar
NPKSVPNKSNGKGQGLVA

SEQ ID NO: 2448833 - protein, 10 aa, Entamoeba dispar
NPKTGKDEGE

SEQ ID NO: 2448834 - protein, 8 aa, Entamoeba dispar
NPKTIEGE

SEQ ID NO: 2448835 - protein, 5 aa, Entamoeba dispar
NPKTT

SEQ ID NO: 2448836 - protein, 8 aa, Entamoeba dispar
NPKVQENL

SEQ ID NO: 2448837 - protein, 4 aa, Entamoeba dispar
NPKY

SEQ ID NO: 2448838 - protein, 10 aa, Entamoeba dispar
NPKYEDTKYT

SEQ ID NO: 2448839 - protein, 8 aa, Entamoeba dispar
NPKYSNSM

SEQ ID NO: 2448840 - protein, 4 aa, Entamoeba dispar
NPLA

SEQ ID NO: 2448841 - protein, 9 aa, Entamoeba dispar
NPLDPNSKG

SEQ ID NO: 2448842 - protein, 13 aa, Entamoeba dispar
NPLDPTDEESPHR

SEQ ID NO: 2448843 - protein, 7 aa, Entamoeba dispar
NPLGMSK

SEQ ID NO: 2448844 - protein, 8 aa, Entamoeba dispar
NPLKKGKS

SEQ ID NO: 2448845 - protein, 44 aa, Entamoeba dispar
NPLPPTVPSRTYQNRNNQQPPSSGIDQTFPPVPQRSYQQQPIPQ

SEQ ID NO: 2448846 - protein, 10 aa, Entamoeba dispar
NPLPQQPKKK

SEQ ID NO: 2448847 - protein, 28 aa, Entamoeba dispar
NPLPSNYTLPPTTEPLRSFPPGTQLTTE

SEQ ID NO: 2448848 - protein, 10 aa, Entamoeba dispar
NPLSSIGELP

SEQ ID NO: 2448849 - protein, 5 aa, Entamoeba dispar
NPLTN

SEQ ID NO: 2448850 - protein, 14 aa, Entamoeba dispar
NPLTQDNEEFEPEE

SEQ ID NO: 2448851 - protein, 7 aa, Entamoeba dispar
NPMNTPK

SEQ ID NO: 2448852 - protein, 6 aa, Entamoeba dispar
NPNAFS

SEQ ID NO: 2448853 - protein, 6 aa, Entamoeba dispar
NPNAYP

SEQ ID NO: 2448854 - protein, 5 aa, Entamoeba dispar
NPNCE

SEQ ID NO: 2448855 - protein, 6 aa, Entamoeba dispar
NPNCPK

SEQ ID NO: 2448856 - protein, 4 aa, Entamoeba dispar
NPNE

SEQ ID NO: 2448857 - protein, 8 aa, Entamoeba dispar
NPNEIPSS

SEQ ID NO: 2448858 - protein, 10 aa, Entamoeba dispar
NPNEIQKNKR

SEQ ID NO: 2448859 - protein, 6 aa, Entamoeba dispar
NPNFGS

SEQ ID NO: 2448860 - protein, 4 aa, Entamoeba dispar
NPNG

SEQ ID NO: 2448861 - protein, 9 aa, Entamoeba dispar
NPNGPHGTR

SEQ ID NO: 2448862 - protein, 9 aa, Entamoeba dispar
NPNGTNLGS

SEQ ID NO: 2448863 - protein, 16 aa, Entamoeba dispar
NPNGVTKQLSLIIDED

SEQ ID NO: 2448864 - protein, 5 aa, Entamoeba dispar
NPNHV

SEQ ID NO: 2448865 - protein, 12 aa, Entamoeba dispar
NPNHYSSLLFAS

SEQ ID NO: 2448866 - protein, 7 aa, Entamoeba dispar
NPNIAPK

SEQ ID NO: 2448867 - protein, 5 aa, Entamoeba dispar
NPNKI

SEQ ID NO: 2448868 - protein, 6 aa, Entamoeba dispar
NPNKKK

SEQ ID NO: 2448869 - protein, 18 aa, Entamoeba dispar
NPNKKNKKKGEKKNTSEF

SEQ ID NO: 2448870 - protein, 8 aa, Entamoeba dispar
NPNKRISC

SEQ ID NO: 2448871 - protein, 4 aa, Entamoeba dispar
NPNN

SEQ ID NO: 2448872 - protein, 7 aa, Entamoeba dispar
NPNNEQA

SEQ ID NO: 2448873 - protein, 7 aa, Entamoeba dispar
NPNNPHI

SEQ ID NO: 2448874 - protein, 7 aa, Entamoeba dispar
NPNNQEQ

SEQ ID NO: 2448875 - protein, 8 aa, Entamoeba dispar
NPNNQEQV

SEQ ID NO: 2448876 - protein, 8 aa, Entamoeba dispar
NPNNQQFN

SEQ ID NO: 2448877 - protein, 8 aa, Entamoeba dispar
NPNNSSIQ

SEQ ID NO: 2448878 - protein, 23 aa, Entamoeba dispar
NPNPRPKTEIGENGMEKEQDYDE

SEQ ID NO: 2448879 - protein, 9 aa, Entamoeba dispar
NPNSPYTKI

SEQ ID NO: 2448880 - protein, 12 aa, Entamoeba dispar
NPNSTTQKTSED

SEQ ID NO: 2448881 - protein, 6 aa, Entamoeba dispar
NPNTGE

SEQ ID NO: 2448882 - protein, 17 aa, Entamoeba dispar
NPNTISSVREKVESTLE

SEQ ID NO: 2448883 - protein, 16 aa, Entamoeba dispar
NPNTISSVRERVESTL

SEQ ID NO: 2448884 - protein, 6 aa, Entamoeba dispar
NPNVES

SEQ ID NO: 2448885 - protein, 7 aa, Entamoeba dispar
NPNVGKS

SEQ ID NO: 2448886 - protein, 7 aa, Entamoeba dispar
NPNYKDK

SEQ ID NO: 2448887 - protein, 7 aa, Entamoeba dispar
NPPEESD

SEQ ID NO: 2448888 - protein, 5 aa, Entamoeba dispar
NPPEF

SEQ ID NO: 2448889 - protein, 5 aa, Entamoeba dispar
NPPEP

SEQ ID NO: 2448890 - protein, 7 aa, Entamoeba dispar
NPPEPIV

SEQ ID NO: 2448891 - protein, 5 aa, Entamoeba dispar
NPPEY

SEQ ID NO: 2448892 - protein, 9 aa, Entamoeba dispar
NPPFPNDNE

SEQ ID NO: 2448893 - protein, 5 aa, Entamoeba dispar
NPPIP

SEQ ID NO: 2448894 - protein, 7 aa, Entamoeba dispar
NPPKEGI

SEQ ID NO: 2448895 - protein, 5 aa, Entamoeba dispar
NPPKF

SEQ ID NO: 2448896 - protein, 8 aa, Entamoeba dispar
NPPKIPEI

SEQ ID NO: 2448897 - protein, 16 aa, Entamoeba dispar
NPPKPLPPKAPYQKGD

SEQ ID NO: 2448898 - protein, 6 aa, Entamoeba dispar
NPPLND

SEQ ID NO: 2448899 - protein, 13 aa, Entamoeba dispar
NPPLSDAPGTQNQ

SEQ ID NO: 2448900 - protein, 8 aa, Entamoeba dispar
NPPMPRQA

SEQ ID NO: 2448901 - protein, 13 aa, Entamoeba dispar
NPPPKLKNESEHS

SEQ ID NO: 2448902 - protein, 6 aa, Entamoeba dispar
NPPPTL

SEQ ID NO: 2448903 - protein, 15 aa, Entamoeba dispar
NPPQIQTNNTQEPSI

SEQ ID NO: 2448904 - protein, 7 aa, Entamoeba dispar
NPPRSLQ

SEQ ID NO: 2448905 - protein, 7 aa, Entamoeba dispar
NPPSEIK

SEQ ID NO: 2448906 - protein, 6 aa, Entamoeba dispar
NPPSIY

SEQ ID NO: 2448907 - protein, 6 aa, Entamoeba dispar
NPPSLG

SEQ ID NO: 2448908 - protein, 7 aa, Entamoeba dispar
NPPSSLP

SEQ ID NO: 2448909 - protein, 16 aa, Entamoeba dispar
NPPTDVGKKDLSPGIK

SEQ ID NO: 2448910 - protein, 9 aa, Entamoeba dispar
NPPTEEEIN

SEQ ID NO: 2448911 - protein, 6 aa, Entamoeba dispar
NPPTSQ

SEQ ID NO: 2448912 - protein, 4 aa, Entamoeba dispar
NPQC

SEQ ID NO: 2448913 - protein, 10 aa, Entamoeba dispar
NPQDPTFNPY

SEQ ID NO: 2448914 - protein, 5 aa, Entamoeba dispar
NPQEN

SEQ ID NO: 2448915 - protein, 4 aa, Entamoeba dispar
NPQG

SEQ ID NO: 2448916 - protein, 14 aa, Entamoeba dispar
NPQHQKMTEEEKER

SEQ ID NO: 2448917 - protein, 5 aa, Entamoeba dispar
NPQKR

SEQ ID NO: 2448918 - protein, 8 aa, Entamoeba dispar
NPQLPPPD

SEQ ID NO: 2448919 - protein, 13 aa, Entamoeba dispar
NPQLTEQQKNDTM

SEQ ID NO: 2448920 - protein, 6 aa, Entamoeba dispar
NPQMSI

SEQ ID NO: 2448921 - protein, 4 aa, Entamoeba dispar
NPQN

SEQ ID NO: 2448922 - protein, 4 aa, Entamoeba dispar
NPQQ

SEQ ID NO: 2448923 - protein, 5 aa, Entamoeba dispar
NPQQA

SEQ ID NO: 2448924 - protein, 8 aa, Entamoeba dispar
NPQQFQQQ

SEQ ID NO: 2448925 - protein, 8 aa, Entamoeba dispar
NPQRPEGM

SEQ ID NO: 2448926 - protein, 5 aa, Entamoeba dispar
NPQSV

SEQ ID NO: 2448927 - protein, 7 aa, Entamoeba dispar
NPQTIAE

SEQ ID NO: 2448928 - protein, 7 aa, Entamoeba dispar
NPQTNEN

SEQ ID NO: 2448929 - protein, 8 aa, Entamoeba dispar
NPQTNKNG

SEQ ID NO: 2448930 - protein, 10 aa, Entamoeba dispar
NPQTNPKRMN

SEQ ID NO: 2448931 - protein, 9 aa, Entamoeba dispar
NPQTQPKTF

SEQ ID NO: 2448932 - protein, 6 aa, Entamoeba dispar
NPQTSG

SEQ ID NO: 2448933 - protein, 5 aa, Entamoeba dispar
NPQTT

SEQ ID NO: 2448934 - protein, 5 aa, Entamoeba dispar
NPQVG

SEQ ID NO: 2448935 - protein, 6 aa, Entamoeba dispar
NPQYDA

SEQ ID NO: 2448936 - protein, 6 aa, Entamoeba dispar
NPQYIS

SEQ ID NO: 2448937 - protein, 4 aa, Entamoeba dispar
NPRA

SEQ ID NO: 2448938 - protein, 8 aa, Entamoeba dispar
NPRARRIA

SEQ ID NO: 2448939 - protein, 7 aa, Entamoeba dispar
NPRKGVK

SEQ ID NO: 2448940 - protein, 35 aa, Entamoeba dispar
NPRKVDDNAIEEKKEEETKDNDAKEKKSKENDVTT

SEQ ID NO: 2448941 - protein, 6 aa, Entamoeba dispar
NPRSFE

SEQ ID NO: 2448942 - protein, 10 aa, Entamoeba dispar
NPRSTSTKYT

SEQ ID NO: 2448943 - protein, 6 aa, Entamoeba dispar
NPRTQP

SEQ ID NO: 2448944 - protein, 5 aa, Entamoeba dispar
NPRYC

SEQ ID NO: 2448945 - protein, 4 aa, Entamoeba dispar
NPSA

SEQ ID NO: 2448946 - protein, 6 aa, Entamoeba dispar
NPSCSE

SEQ ID NO: 2448947 - protein, 9 aa, Entamoeba dispar
NPSDDEITT

SEQ ID NO: 2448948 - protein, 9 aa, Entamoeba dispar
NPSDNKSLQ

SEQ ID NO: 2448949 - protein, 11 aa, Entamoeba dispar
NPSEKDKRKQL

SEQ ID NO: 2448950 - protein, 12 aa, Entamoeba dispar
NPSEQYNERQTI

SEQ ID NO: 2448951 - protein, 4 aa, Entamoeba dispar
NPSF

SEQ ID NO: 2448952 - protein, 7 aa, Entamoeba dispar
NPSFEHP

SEQ ID NO: 2448953 - protein, 8 aa, Entamoeba dispar
NPSGEPCT

SEQ ID NO: 2448954 - protein, 5 aa, Entamoeba dispar
NPSGL

SEQ ID NO: 2448955 - protein, 8 aa, Entamoeba dispar
NPSGSKKL

SEQ ID NO: 2448956 - protein, 9 aa, Entamoeba dispar
NPSGVSHSI

SEQ ID NO: 2448957 - protein, 4 aa, Entamoeba dispar
NPSI

SEQ ID NO: 2448958 - protein, 8 aa, Entamoeba dispar
NPSKKNCC

SEQ ID NO: 2448959 - protein, 5 aa, Entamoeba dispar
NPSKL

SEQ ID NO: 2448960 - protein, 8 aa, Entamoeba dispar
NPSKNQRF

SEQ ID NO: 2448961 - protein, 7 aa, Entamoeba dispar
NPSKNYL

SEQ ID NO: 2448962 - protein, 6 aa, Entamoeba dispar
NPSKRI

SEQ ID NO: 2448963 - protein, 42 aa, Entamoeba dispar
NPSLGKEGIETQEEKLTSPIEVEQPQNTTPNTLSEKTEESTL

SEQ ID NO: 2448964 - protein, 5 aa, Entamoeba dispar
NPSLP

SEQ ID NO: 2448965 - protein, 13 aa, Entamoeba dispar
NPSLQSSSSYDYQ

SEQ ID NO: 2448966 - protein, 5 aa, Entamoeba dispar
NPSLS

SEQ ID NO: 2448967 - protein, 9 aa, Entamoeba dispar
NPSNEEGRE

SEQ ID NO: 2448968 - protein, 9 aa, Entamoeba dispar
NPSNISQTE

SEQ ID NO: 2448969 - protein, 8 aa, Entamoeba dispar
NPSNKRGF

SEQ ID NO: 2448970 - protein, 5 aa, Entamoeba dispar
NPSQA

SEQ ID NO: 2448971 - protein, 15 aa, Entamoeba dispar
NPSQKEPPPLSESAT

SEQ ID NO: 2448972 - protein, 8 aa, Entamoeba dispar
NPSQSRSG

SEQ ID NO: 2448973 - protein, 4 aa, Entamoeba dispar
NPSR

SEQ ID NO: 2448974 - protein, 57 aa, Entamoeba dispar
NPSSKNISEESNEDISENETEESTIKEESEGELSISSGEGNEENTNEISITTTEGKN

SEQ ID NO: 2448975 - protein, 8 aa, Entamoeba dispar
NPSSSERD

SEQ ID NO: 2448976 - protein, 39 aa, Entamoeba dispar
NPSSTNGSQQFNTMGNTSNSIPNMGTNTFGGNGTGTNLF

SEQ ID NO: 2448977 - protein, 4 aa, Entamoeba dispar
NPST

SEQ ID NO: 2448978 - protein, 8 aa, Entamoeba dispar
NPSTSFGD

SEQ ID NO: 2448979 - protein, 6 aa, Entamoeba dispar
NPSVKE

SEQ ID NO: 2448980 - protein, 5 aa, Entamoeba dispar
NPSYY

SEQ ID NO: 2448981 - protein, 7 aa, Entamoeba dispar
NPTCPLN

SEQ ID NO: 2448982 - protein, 4 aa, Entamoeba dispar
NPTE

SEQ ID NO: 2448983 - protein, 4 aa, Entamoeba dispar
NPTF

SEQ ID NO: 2448984 - protein, 10 aa, Entamoeba dispar
NPTGYGGITQ

SEQ ID NO: 2448985 - protein, 4 aa, Entamoeba dispar
NPTI

SEQ ID NO: 2448986 - protein, 8 aa, Entamoeba dispar
NPTIEDSY

SEQ ID NO: 2448987 - protein, 7 aa, Entamoeba dispar
NPTISDE

SEQ ID NO: 2448988 - protein, 9 aa, Entamoeba dispar
NPTKEEKQN

SEQ ID NO: 2448989 - protein, 8 aa, Entamoeba dispar
NPTKELDG

SEQ ID NO: 2448990 - protein, 8 aa, Entamoeba dispar
NPTKNTPI

SEQ ID NO: 2448991 - protein, 5 aa, Entamoeba dispar
NPTKQ

SEQ ID NO: 2448992 - protein, 15 aa, Entamoeba dispar
NPTKQNSLKQQPEIP

SEQ ID NO: 2448993 - protein, 6 aa, Entamoeba dispar
NPTLPR

SEQ ID NO: 2448994 - protein, 7 aa, Entamoeba dispar
NPTNKAP

SEQ ID NO: 2448995 - protein, 5 aa, Entamoeba dispar
NPTNN

SEQ ID NO: 2448996 - protein, 22 aa, Entamoeba dispar
NPTNPEVSLSESHTDSKDMSPR

SEQ ID NO: 2448997 - protein, 6 aa, Entamoeba dispar
NPTPDD

SEQ ID NO: 2448998 - protein, 15 aa, Entamoeba dispar
NPTPTKTDSAGISEE

SEQ ID NO: 2448999 - protein, 8 aa, Entamoeba dispar
NPTSISDN

SEQ ID NO: 2449000 - protein, 7 aa, Entamoeba dispar
NPTSKMN

SEQ ID NO: 2449001 - protein, 8 aa, Entamoeba dispar
NPTSKTEI

SEQ ID NO: 2449002 - protein, 20 aa, Entamoeba dispar
NPTSRVSVGNNSTCDNTSPS

SEQ ID NO: 2449003 - protein, 5 aa, Entamoeba dispar
NPTTC

SEQ ID NO: 2449004 - protein, 6 aa, Entamoeba dispar
NPTTEQ

SEQ ID NO: 2449005 - protein, 5 aa, Entamoeba dispar
NPTVP

SEQ ID NO: 2449006 - protein, 5 aa, Entamoeba dispar
NPTWG

SEQ ID NO: 2449007 - protein, 16 aa, Entamoeba dispar
NPTYFGETENEDDQRL

SEQ ID NO: 2449008 - protein, 5 aa, Entamoeba dispar
NPTYT

SEQ ID NO: 2449009 - protein, 23 aa, Entamoeba dispar
NPVDDQGGEILPTQEPDHSGNPN

SEQ ID NO: 2449010 - protein, 35 aa, Entamoeba dispar
NPVERPQQQPVAQEEITEFKKKQRKLRDESERVKW

SEQ ID NO: 2449011 - protein, 21 aa, Entamoeba dispar
NPVQPQSKAQQNTQPQPQKDV

SEQ ID NO: 2449012 - protein, 6 aa, Entamoeba dispar
NPVRPD

SEQ ID NO: 2449013 - protein, 8 aa, Entamoeba dispar
NPVYDGSG

SEQ ID NO: 2449014 - protein, 12 aa, Entamoeba dispar
NPYAPDNDGQSP

SEQ ID NO: 2449015 - protein, 6 aa, Entamoeba dispar
NPYDGY

SEQ ID NO: 2449016 - protein, 8 aa, Entamoeba dispar
NPYDTSPR

SEQ ID NO: 2449017 - protein, 6 aa, Entamoeba dispar
NPYEPN

SEQ ID NO: 2449018 - protein, 5 aa, Entamoeba dispar
NPYFT

SEQ ID NO: 2449019 - protein, 5 aa, Entamoeba dispar
NPYGH

SEQ ID NO: 2449020 - protein, 6 aa, Entamoeba dispar
NPYPPL

SEQ ID NO: 2449021 - protein, 12 aa, Entamoeba dispar
NPYQDKESSEMM

SEQ ID NO: 2449022 - protein, 8 aa, Entamoeba dispar
NPYQRPTG

SEQ ID NO: 2449023 - protein, 11 aa, Entamoeba dispar
NQAIEGRTEDW

SEQ ID NO: 2449024 - protein, 6 aa, Entamoeba dispar
NQAKDL

SEQ ID NO: 2449025 - protein, 13 aa, Entamoeba dispar
NQAKEPPKQTQYI

SEQ ID NO: 2449026 - protein, 8 aa, Entamoeba dispar
NQANESSV

SEQ ID NO: 2449027 - protein, 8 aa, Entamoeba dispar
NQANQEGI

SEQ ID NO: 2449028 - protein, 7 aa, Entamoeba dispar
NQAPHLK

SEQ ID NO: 2449029 - protein, 4 aa, Entamoeba dispar
NQAR

SEQ ID NO: 2449030 - protein, 5 aa, Entamoeba dispar
NQCKS

SEQ ID NO: 2449031 - protein, 6 aa, Entamoeba dispar
NQCKSI

SEQ ID NO: 2449032 - protein, 34 aa, Entamoeba dispar
NQCTSGNSSSKKEIKGQSKPLTKQDYSKQSQPIQ

SEQ ID NO: 2449033 - protein, 8 aa, Entamoeba dispar
NQDDEDEY

SEQ ID NO: 2449034 - protein, 5 aa, Entamoeba dispar
NQDEP

SEQ ID NO: 2449035 - protein, 8 aa, Entamoeba dispar
NQDERKFG

SEQ ID NO: 2449036 - protein, 4 aa, Entamoeba dispar
NQDF

SEQ ID NO: 2449037 - protein, 6 aa, Entamoeba dispar
NQDKYR

SEQ ID NO: 2449038 - protein, 6 aa, Entamoeba dispar
NQDNPD

SEQ ID NO: 2449039 - protein, 8 aa, Entamoeba dispar
NQDNPDIV

SEQ ID NO: 2449040 - protein, 9 aa, Entamoeba dispar
NQDPKNRWG

SEQ ID NO: 2449041 - protein, 10 aa, Entamoeba dispar
NQDPNKAEFD

SEQ ID NO: 2449042 - protein, 29 aa, Entamoeba dispar
NQDQNIEKEEKKKERKKEELDLDEEIEDK

SEQ ID NO: 2449043 - protein, 8 aa, Entamoeba dispar
NQDSKRKY

SEQ ID NO: 2449044 - protein, 9 aa, Entamoeba dispar
NQDTERTEE

SEQ ID NO: 2449045 - protein, 5 aa, Entamoeba dispar
NQDTI

SEQ ID NO: 2449046 - protein, 5 aa, Entamoeba dispar
NQDVN

SEQ ID NO: 2449047 - protein, 6 aa, Entamoeba dispar
NQDVPQ

SEQ ID NO: 2449048 - protein, 7 aa, Entamoeba dispar
NQDVTVR

SEQ ID NO: 2449049 - protein, 7 aa, Entamoeba dispar
NQDYTTQ

SEQ ID NO: 2449050 - protein, 4 aa, Entamoeba dispar
NQEA

SEQ ID NO: 2449051 - protein, 4 aa, Entamoeba dispar
NQED

SEQ ID NO: 2449052 - protein, 12 aa, Entamoeba dispar
NQEDFKKAKEKV

SEQ ID NO: 2449053 - protein, 8 aa, Entamoeba dispar
NQEDIGGA

SEQ ID NO: 2449054 - protein, 48 aa, Entamoeba dispar
NQEDKELNKEFENESDTGSSSSNNNNKEEEEDNEEIQEEEEGKQELSD

SEQ ID NO: 2449055 - protein, 8 aa, Entamoeba dispar
NQEDKKEW

SEQ ID NO: 2449056 - protein, 5 aa, Entamoeba dispar
NQEDP

SEQ ID NO: 2449057 - protein, 5 aa, Entamoeba dispar
NQEEK

SEQ ID NO: 2449058 - protein, 11 aa, Entamoeba dispar
NQEEQFQPTFS

SEQ ID NO: 2449059 - protein, 9 aa, Entamoeba dispar
NQEETEKGK

SEQ ID NO: 2449060 - protein, 10 aa, Entamoeba dispar
NQEETHGLSD

SEQ ID NO: 2449061 - protein, 9 aa, Entamoeba dispar
NQEGSSAYK

SEQ ID NO: 2449062 - protein, 11 aa, Entamoeba dispar
NQEKEQVENEC

SEQ ID NO: 2449063 - protein, 8 aa, Entamoeba dispar
NQEKQLSD

SEQ ID NO: 2449064 - protein, 13 aa, Entamoeba dispar
NQELKKTEQETEE

SEQ ID NO: 2449065 - protein, 6 aa, Entamoeba dispar
NQEMKE

SEQ ID NO: 2449066 - protein, 11 aa, Entamoeba dispar
NQENDIDENRV

SEQ ID NO: 2449067 - protein, 14 aa, Entamoeba dispar
NQENQSQKKLMETE

SEQ ID NO: 2449068 - protein, 28 aa, Entamoeba dispar
NQEQIKPKEELEKDSRQKVEELRGSPLE

SEQ ID NO: 2449069 - protein, 4 aa, Entamoeba dispar
NQER

SEQ ID NO: 2449070 - protein, 4 aa, Entamoeba dispar
NQES

SEQ ID NO: 2449071 - protein, 9 aa, Entamoeba dispar
NQESVGGDP

SEQ ID NO: 2449072 - protein, 6 aa, Entamoeba dispar
NQETQL

SEQ ID NO: 2449073 - protein, 7 aa, Entamoeba dispar
NQETSEV

SEQ ID NO: 2449074 - protein, 15 aa, Entamoeba dispar
NQEVSGTRSELSTPP

SEQ ID NO: 2449075 - protein, 4 aa, Entamoeba dispar
NQEY

SEQ ID NO: 2449076 - protein, 5 aa, Entamoeba dispar
NQFDS

SEQ ID NO: 2449077 - protein, 24 aa, Entamoeba dispar
NQFEEEKKELENKLQSEEKEREKL

SEQ ID NO: 2449078 - protein, 15 aa, Entamoeba dispar
NQFKEKEDSWEKEKN

SEQ ID NO: 2449079 - protein, 5 aa, Entamoeba dispar
NQFNE

SEQ ID NO: 2449080 - protein, 6 aa, Entamoeba dispar
NQFNES

SEQ ID NO: 2449081 - protein, 7 aa, Entamoeba dispar
NQFNKDQ

SEQ ID NO: 2449082 - protein, 11 aa, Entamoeba dispar
NQFNSEELRKM

SEQ ID NO: 2449083 - protein, 7 aa, Entamoeba dispar
NQFSESK

SEQ ID NO: 2449084 - protein, 13 aa, Entamoeba dispar
NQGAKHPNSNAAF

SEQ ID NO: 2449085 - protein, 6 aa, Entamoeba dispar
NQGEFP

SEQ ID NO: 2449086 - protein, 7 aa, Entamoeba dispar
NQGGEQL

SEQ ID NO: 2449087 - protein, 8 aa, Entamoeba dispar
NQGKEDEE

SEQ ID NO: 2449088 - protein, 10 aa, Entamoeba dispar
NQGKIANSPI

SEQ ID NO: 2449089 - protein, 7 aa, Entamoeba dispar
NQGNIPL

SEQ ID NO: 2449090 - protein, 12 aa, Entamoeba dispar
NQGNNSTLPNNP

SEQ ID NO: 2449091 - protein, 18 aa, Entamoeba dispar
NQGRQNPTDPDLPNPNDT

SEQ ID NO: 2449092 - protein, 9 aa, Entamoeba dispar
NQGRSHPQI

SEQ ID NO: 2449093 - protein, 22 aa, Entamoeba dispar
NQGSEHSPDDTSSSFSTQTEIR

SEQ ID NO: 2449094 - protein, 20 aa, Entamoeba dispar
NQGSKALGESGKGKGYRGIQ

SEQ ID NO: 2449095 - protein, 7 aa, Entamoeba dispar
NQGTARA

SEQ ID NO: 2449096 - protein, 9 aa, Entamoeba dispar
NQGYDEEHI

SEQ ID NO: 2449097 - protein, 18 aa, Entamoeba dispar
NQHKEEAANILTAIVLNV

SEQ ID NO: 2449098 - protein, 6 aa, Entamoeba dispar
NQHQQV

SEQ ID NO: 2449099 - protein, 17 aa, Entamoeba dispar
NQIDEAQSVESQNTTSY

SEQ ID NO: 2449100 - protein, 7 aa, Entamoeba dispar
NQIDESD

SEQ ID NO: 2449101 - protein, 12 aa, Entamoeba dispar
NQIDETISSNEN

SEQ ID NO: 2449102 - protein, 5 aa, Entamoeba dispar
NQIEE

SEQ ID NO: 2449103 - protein, 18 aa, Entamoeba dispar
NQIEEEIKKEKERNEKKI

SEQ ID NO: 2449104 - protein, 7 aa, Entamoeba dispar
NQIGGID

SEQ ID NO: 2449105 - protein, 10 aa, Entamoeba dispar
NQIKEEKSKL

SEQ ID NO: 2449106 - protein, 14 aa, Entamoeba dispar
NQIKNDKEELTEKN

SEQ ID NO: 2449107 - protein, 31 aa, Entamoeba dispar
NQIKNERDNITNEFNKTKEEIQQKENEITQL

SEQ ID NO: 2449108 - protein, 8 aa, Entamoeba dispar
NQIKSSSL

SEQ ID NO: 2449109 - protein, 13 aa, Entamoeba dispar
NQIKTEKQEIENE

SEQ ID NO: 2449110 - protein, 7 aa, Entamoeba dispar
NQIMNQK

SEQ ID NO: 2449111 - protein, 7 aa, Entamoeba dispar
NQINEKE

SEQ ID NO: 2449112 - protein, 15 aa, Entamoeba dispar
NQINGVDEKTIKRRQ

SEQ ID NO: 2449113 - protein, 6 aa, Entamoeba dispar
NQINKY

SEQ ID NO: 2449114 - protein, 7 aa, Entamoeba dispar
NQIPKRT

SEQ ID NO: 2449115 - protein, 16 aa, Entamoeba dispar
NQIPSNDKELTTQEKN

SEQ ID NO: 2449116 - protein, 5 aa, Entamoeba dispar
NQIPT

SEQ ID NO: 2449117 - protein, 20 aa, Entamoeba dispar
NQIPTKSNKEERKKNKERNI

SEQ ID NO: 2449118 - protein, 12 aa, Entamoeba dispar
NQIQQQNLSSSH

SEQ ID NO: 2449119 - protein, 15 aa, Entamoeba dispar
NQISQQKDKKREDIL

SEQ ID NO: 2449120 - protein, 8 aa, Entamoeba dispar
NQISQTYH

SEQ ID NO: 2449121 - protein, 8 aa, Entamoeba dispar
NQISSFPT

SEQ ID NO: 2449122 - protein, 5 aa, Entamoeba dispar
NQITQ

SEQ ID NO: 2449123 - protein, 10 aa, Entamoeba dispar
NQITSIGDID

SEQ ID NO: 2449124 - protein, 8 aa, Entamoeba dispar
NQKEENKI

SEQ ID NO: 2449125 - protein, 9 aa, Entamoeba dispar
NQKEETNLI

SEQ ID NO: 2449126 - protein, 5 aa, Entamoeba dispar
NQKEM

SEQ ID NO: 2449127 - protein, 9 aa, Entamoeba dispar
NQKESYPTI

SEQ ID NO: 2449128 - protein, 13 aa, Entamoeba dispar
NQKFISTKDYLIR

SEQ ID NO: 2449129 - protein, 12 aa, Entamoeba dispar
NQKGELTQRGQK

SEQ ID NO: 2449130 - protein, 8 aa, Entamoeba dispar
NQKKGTMT

SEQ ID NO: 2449131 - protein, 7 aa, Entamoeba dispar
NQKLSKI

SEQ ID NO: 2449132 - protein, 6 aa, Entamoeba dispar
NQKMEI

SEQ ID NO: 2449133 - protein, 8 aa, Entamoeba dispar
NQKNEKDC

SEQ ID NO: 2449134 - protein, 7 aa, Entamoeba dispar
NQKNNAI

SEQ ID NO: 2449135 - protein, 6 aa, Entamoeba dispar
NQKNYS

SEQ ID NO: 2449136 - protein, 4 aa, Entamoeba dispar
NQKP

SEQ ID NO: 2449137 - protein, 17 aa, Entamoeba dispar
NQKPIEYHNTKKEGEVY

SEQ ID NO: 2449138 - protein, 27 aa, Entamoeba dispar
NQKPIRKPSSQKHREEEDDDDNDTEEI

SEQ ID NO: 2449139 - protein, 9 aa, Entamoeba dispar
NQKQKDKRI

SEQ ID NO: 2449140 - protein, 7 aa, Entamoeba dispar
NQKQTIE

SEQ ID NO: 2449141 - protein, 8 aa, Entamoeba dispar
NQKRVEDD

SEQ ID NO: 2449142 - protein, 8 aa, Entamoeba dispar
NQKSELTY

SEQ ID NO: 2449143 - protein, 7 aa, Entamoeba dispar
NQKSINE

SEQ ID NO: 2449144 - protein, 8 aa, Entamoeba dispar
NQKSPSWC

SEQ ID NO: 2449145 - protein, 9 aa, Entamoeba dispar
NQKSQNIQA

SEQ ID NO: 2449146 - protein, 7 aa, Entamoeba dispar
NQKSQSQ

SEQ ID NO: 2449147 - protein, 13 aa, Entamoeba dispar
NQKSSPPTNQPRR

SEQ ID NO: 2449148 - protein, 4 aa, Entamoeba dispar
NQKT

SEQ ID NO: 2449149 - protein, 9 aa, Entamoeba dispar
NQKTDLEYD

SEQ ID NO: 2449150 - protein, 7 aa, Entamoeba dispar
NQKTQLS

SEQ ID NO: 2449151 - protein, 5 aa, Entamoeba dispar
NQKVP

SEQ ID NO: 2449152 - protein, 8 aa, Entamoeba dispar
NQKYDIKK

SEQ ID NO: 2449153 - protein, 5 aa, Entamoeba dispar
NQKYP

SEQ ID NO: 2449154 - protein, 7 aa, Entamoeba dispar
NQLDGIP

SEQ ID NO: 2449155 - protein, 6 aa, Entamoeba dispar
NQLDQA

SEQ ID NO: 2449156 - protein, 5 aa, Entamoeba dispar
NQLDS

SEQ ID NO: 2449157 - protein, 14 aa, Entamoeba dispar
NQLEEEIKKKNQLI

SEQ ID NO: 2449158 - protein, 8 aa, Entamoeba dispar
NQLEEEPF

SEQ ID NO: 2449159 - protein, 18 aa, Entamoeba dispar
NQLENDKQLNEKEKLETL

SEQ ID NO: 2449160 - protein, 8 aa, Entamoeba dispar
NQLKSNSN

SEQ ID NO: 2449161 - protein, 4 aa, Entamoeba dispar
NQLL

SEQ ID NO: 2449162 - protein, 9 aa, Entamoeba dispar
NQLNEDNKV

SEQ ID NO: 2449163 - protein, 5 aa, Entamoeba dispar
NQLNQ

SEQ ID NO: 2449164 - protein, 13 aa, Entamoeba dispar
NQLPEDQDIDDED

SEQ ID NO: 2449165 - protein, 6 aa, Entamoeba dispar
NQLPEE

SEQ ID NO: 2449166 - protein, 14 aa, Entamoeba dispar
NQLPGTKRRSSRIR

SEQ ID NO: 2449167 - protein, 9 aa, Entamoeba dispar
NQLPNNDNI

SEQ ID NO: 2449168 - protein, 7 aa, Entamoeba dispar
NQLPQQD

SEQ ID NO: 2449169 - protein, 5 aa, Entamoeba dispar
NQLRA

SEQ ID NO: 2449170 - protein, 4 aa, Entamoeba dispar
NQLT

SEQ ID NO: 2449171 - protein, 18 aa, Entamoeba dispar
NQLTESKKTLKSPSQVQD

SEQ ID NO: 2449172 - protein, 16 aa, Entamoeba dispar
NQLTETRKKFILSFFD

SEQ ID NO: 2449173 - protein, 16 aa, Entamoeba dispar
NQLYSQSHDDKLKKEQ

SEQ ID NO: 2449174 - protein, 9 aa, Entamoeba dispar
NQMKPKKLS

SEQ ID NO: 2449175 - protein, 5 aa, Entamoeba dispar
NQMNE

SEQ ID NO: 2449176 - protein, 10 aa, Entamoeba dispar
NQMSQDNESI

SEQ ID NO: 2449177 - protein, 20 aa, Entamoeba dispar
NQNASTEEYENKMKEVEGKV

SEQ ID NO: 2449178 - protein, 4 aa, Entamoeba dispar
NQNC

SEQ ID NO: 2449179 - protein, 16 aa, Entamoeba dispar
NQNDEEKSQNGDKCVI

SEQ ID NO: 2449180 - protein, 4 aa, Entamoeba dispar
NQNE

SEQ ID NO: 2449181 - protein, 8 aa, Entamoeba dispar
NQNGIETT

SEQ ID NO: 2449182 - protein, 13 aa, Entamoeba dispar
NQNIQDEALDPKL

SEQ ID NO: 2449183 - protein, 8 aa, Entamoeba dispar
NQNKEEVE

SEQ ID NO: 2449184 - protein, 10 aa, Entamoeba dispar
NQNKKHPEEE

SEQ ID NO: 2449185 - protein, 9 aa, Entamoeba dispar
NQNKMGENT

SEQ ID NO: 2449186 - protein, 9 aa, Entamoeba dispar
NQNKNNEII

SEQ ID NO: 2449187 - protein, 10 aa, Entamoeba dispar
NQNNDQDNNS

SEQ ID NO: 2449188 - protein, 6 aa, Entamoeba dispar
NQNNKR

SEQ ID NO: 2449189 - protein, 8 aa, Entamoeba dispar
NQNPITTT

SEQ ID NO: 2449190 - protein, 10 aa, Entamoeba dispar
NQNPSIPTNV

SEQ ID NO: 2449191 - protein, 14 aa, Entamoeba dispar
NQNQEEDYSEKENE

SEQ ID NO: 2449192 - protein, 21 aa, Entamoeba dispar
NQNQQNQNTTQTVKPVPGEPD

SEQ ID NO: 2449193 - protein, 16 aa, Entamoeba dispar
NQNQSTFQPYENEETI

SEQ ID NO: 2449194 - protein, 11 aa, Entamoeba dispar
NQNSEASRRDQ

SEQ ID NO: 2449195 - protein, 16 aa, Entamoeba dispar
NQNSSTTNSQKDSKCN

SEQ ID NO: 2449196 - protein, 9 aa, Entamoeba dispar
NQNTEQIQA

SEQ ID NO: 2449197 - protein, 5 aa, Entamoeba dispar
NQNTI

SEQ ID NO: 2449198 - protein, 6 aa, Entamoeba dispar
NQNTNS

SEQ ID NO: 2449199 - protein, 5 aa, Entamoeba dispar
NQNYN

SEQ ID NO: 2449200 - protein, 8 aa, Entamoeba dispar
NQPDKNSQ

SEQ ID NO: 2449201 - protein, 6 aa, Entamoeba dispar
NQPDTI

SEQ ID NO: 2449202 - protein, 15 aa, Entamoeba dispar
NQPELNDSNDSSRDT

SEQ ID NO: 2449203 - protein, 6 aa, Entamoeba dispar
NQPESK

SEQ ID NO: 2449204 - protein, 38 aa, Entamoeba dispar
NQPETKREEPTTTPLSSEKKKEPKIQNNQSKQEITKKE

SEQ ID NO: 2449205 - protein, 10 aa, Entamoeba dispar
NQPFDGNTSY

SEQ ID NO: 2449206 - protein, 6 aa, Entamoeba dispar
NQPIDN

SEQ ID NO: 2449207 - protein, 18 aa, Entamoeba dispar
NQPINSPLNSSLSQIDQA

SEQ ID NO: 2449208 - protein, 18 aa, Entamoeba dispar
NQPINTNPFNQTTTNNPF

SEQ ID NO: 2449209 - protein, 10 aa, Entamoeba dispar
NQPKEENNEI

SEQ ID NO: 2449210 - protein, 33 aa, Entamoeba dispar
NQPKQPKRQKTPKPTDQISYTPPKQINKPVIPK

SEQ ID NO: 2449211 - protein, 8 aa, Entamoeba dispar
NQPKYRND

SEQ ID NO: 2449212 - protein, 5 aa, Entamoeba dispar
NQPLQ

SEQ ID NO: 2449213 - protein, 7 aa, Entamoeba dispar
NQPNEYQ

SEQ ID NO: 2449214 - protein, 12 aa, Entamoeba dispar
NQPNLKSQKGKT

SEQ ID NO: 2449215 - protein, 4 aa, Entamoeba dispar
NQPQ

SEQ ID NO: 2449216 - protein, 5 aa, Entamoeba dispar
NQPQH

SEQ ID NO: 2449217 - protein, 5 aa, Entamoeba dispar
NQPQT

SEQ ID NO: 2449218 - protein, 8 aa, Entamoeba dispar
NQPSENEI

SEQ ID NO: 2449219 - protein, 5 aa, Entamoeba dispar
NQPSL

SEQ ID NO: 2449220 - protein, 5 aa, Entamoeba dispar
NQPTD

SEQ ID NO: 2449221 - protein, 7 aa, Entamoeba dispar
NQPTSLT

SEQ ID NO: 2449222 - protein, 8 aa, Entamoeba dispar
NQPYDSKT

SEQ ID NO: 2449223 - protein, 11 aa, Entamoeba dispar
NQPYTKTPIDK

SEQ ID NO: 2449224 - protein, 9 aa, Entamoeba dispar
NQQDKDGNT

SEQ ID NO: 2449225 - protein, 8 aa, Entamoeba dispar
NQQDKINR

SEQ ID NO: 2449226 - protein, 10 aa, Entamoeba dispar
NQQEEQSEDS

SEQ ID NO: 2449227 - protein, 8 aa, Entamoeba dispar
NQQELNNK

SEQ ID NO: 2449228 - protein, 6 aa, Entamoeba dispar
NQQETI

SEQ ID NO: 2449229 - protein, 9 aa, Entamoeba dispar
NQQETQQNK

SEQ ID NO: 2449230 - protein, 8 aa, Entamoeba dispar
NQQETTFT

SEQ ID NO: 2449231 - protein, 29 aa, Entamoeba dispar
NQQHPESQNQNNVTNQQPQSTTQQHQDNT

SEQ ID NO: 2449232 - protein, 20 aa, Entamoeba dispar
NQQISDQNNVFEQKKEKDTI

SEQ ID NO: 2449233 - protein, 4 aa, Entamoeba dispar
NQQK

SEQ ID NO: 2449234 - protein, 9 aa, Entamoeba dispar
NQQKFQENS

SEQ ID NO: 2449235 - protein, 6 aa, Entamoeba dispar
NQQKNQ

SEQ ID NO: 2449236 - protein, 64 aa, Entamoeba dispar
NQQKSKKQSTNNPETTPPQSSPNKKWEQPKNETTERVTTTQCTPKVANTKPVVPIQEKPKIQVQ

SEQ ID NO: 2449237 - protein, 15 aa, Entamoeba dispar
NQQLPASTQPLAQQQ

SEQ ID NO: 2449238 - protein, 10 aa, Entamoeba dispar
NQQLSQNTIV

SEQ ID NO: 2449239 - protein, 9 aa, Entamoeba dispar
NQQNDSEDM

SEQ ID NO: 2449240 - protein, 19 aa, Entamoeba dispar
NQQNDSEDMIRQKIWCLWK

SEQ ID NO: 2449241 - protein, 6 aa, Entamoeba dispar
NQQNEL

SEQ ID NO: 2449242 - protein, 5 aa, Entamoeba dispar
NQQNL

SEQ ID NO: 2449243 - protein, 10 aa, Entamoeba dispar
NQQNNVIPNG

SEQ ID NO: 2449244 - protein, 25 aa, Entamoeba dispar
NQQNQSIVPNQSTMKLSSSHGPFSP

SEQ ID NO: 2449245 - protein, 14 aa, Entamoeba dispar
NQQNTKEQSDYSSS

SEQ ID NO: 2449246 - protein, 11 aa, Entamoeba dispar
NQQPFGFGTTN

SEQ ID NO: 2449247 - protein, 6 aa, Entamoeba dispar
NQQPMT

SEQ ID NO: 2449248 - protein, 6 aa, Entamoeba dispar
NQQQEL

SEQ ID NO: 2449249 - protein, 10 aa, Entamoeba dispar
NQQQPDTFET

SEQ ID NO: 2449250 - protein, 7 aa, Entamoeba dispar
NQQQPFE

SEQ ID NO: 2449251 - protein, 7 aa, Entamoeba dispar
NQQRQGL

SEQ ID NO: 2449252 - protein, 22 aa, Entamoeba dispar
NQQSISPKPKRSFFSFGKKDDK

SEQ ID NO: 2449253 - protein, 6 aa, Entamoeba dispar
NQQSSQ

SEQ ID NO: 2449254 - protein, 5 aa, Entamoeba dispar
NQQTT

SEQ ID NO: 2449255 - protein, 11 aa, Entamoeba dispar
NQQVNSSGVIE

SEQ ID NO: 2449256 - protein, 5 aa, Entamoeba dispar
NQRDR

SEQ ID NO: 2449257 - protein, 6 aa, Entamoeba dispar
NQRGND

SEQ ID NO: 2449258 - protein, 20 aa, Entamoeba dispar
NQRHEMKEEKNLKYKTAYTN

SEQ ID NO: 2449259 - protein, 10 aa, Entamoeba dispar
NQRHNTQTLQ

SEQ ID NO: 2449260 - protein, 12 aa, Entamoeba dispar
NQRIPRNCFKDW

SEQ ID NO: 2449261 - protein, 11 aa, Entamoeba dispar
NQRISSSKTIE

SEQ ID NO: 2449262 - protein, 8 aa, Entamoeba dispar
NQRNQISS

SEQ ID NO: 2449263 - protein, 8 aa, Entamoeba dispar
NQRQKIDD

SEQ ID NO: 2449264 - protein, 7 aa, Entamoeba dispar
NQRQQEA

SEQ ID NO: 2449265 - protein, 4 aa, Entamoeba dispar
NQRR

SEQ ID NO: 2449266 - protein, 6 aa, Entamoeba dispar
NQRRIE

SEQ ID NO: 2449267 - protein, 37 aa, Entamoeba dispar
NQRYVRPKKTQSEKEEENKEEEEKAIELEKKSNSERI

SEQ ID NO: 2449268 - protein, 8 aa, Entamoeba dispar
NQSASQMS

SEQ ID NO: 2449269 - protein, 11 aa, Entamoeba dispar
NQSDSDDSFFD

SEQ ID NO: 2449270 - protein, 8 aa, Entamoeba dispar
NQSDSLKK

SEQ ID NO: 2449271 - protein, 20 aa, Entamoeba dispar
NQSEKSEKKEDEEPAPIQTS

SEQ ID NO: 2449272 - protein, 5 aa, Entamoeba dispar
NQSEM

SEQ ID NO: 2449273 - protein, 7 aa, Entamoeba dispar
NQSENDY

SEQ ID NO: 2449274 - protein, 8 aa, Entamoeba dispar
NQSERSRI

SEQ ID NO: 2449275 - protein, 7 aa, Entamoeba dispar
NQSERVK

SEQ ID NO: 2449276 - protein, 4 aa, Entamoeba dispar
NQSF

SEQ ID NO: 2449277 - protein, 5 aa, Entamoeba dispar
NQSFE

SEQ ID NO: 2449278 - protein, 11 aa, Entamoeba dispar
NQSFKNYGKSD

SEQ ID NO: 2449279 - protein, 10 aa, Entamoeba dispar
NQSGKEKGRI

SEQ ID NO: 2449280 - protein, 7 aa, Entamoeba dispar
NQSGRRK

SEQ ID NO: 2449281 - protein, 15 aa, Entamoeba dispar
NQSHRDGISNTPEQW

SEQ ID NO: 2449282 - protein, 4 aa, Entamoeba dispar
NQSI

SEQ ID NO: 2449283 - protein, 12 aa, Entamoeba dispar
NQSISANNESGI

SEQ ID NO: 2449284 - protein, 26 aa, Entamoeba dispar
NQSISSKPEEKKQEEIKPTPNATVNT

SEQ ID NO: 2449285 - protein, 6 aa, Entamoeba dispar
NQSITQ

SEQ ID NO: 2449286 - protein, 5 aa, Entamoeba dispar
NQSNG

SEQ ID NO: 2449287 - protein, 65 aa, Entamoeba dispar
NQSPPFQEKRKEEMNSLEESREDDSSEYTEEDSFVSSQTESYSSESSQSIQLSQNSERSTDSMEQ

SEQ ID NO: 2449288 - protein, 29 aa, Entamoeba dispar
NQSPSQEKRVESKPIKEQSHKTKKVKKMG

SEQ ID NO: 2449289 - protein, 4 aa, Entamoeba dispar
NQSQ

SEQ ID NO: 2449290 - protein, 11 aa, Entamoeba dispar
NQSQEKAKKTV

SEQ ID NO: 2449291 - protein, 10 aa, Entamoeba dispar
NQSQKEKREI

SEQ ID NO: 2449292 - protein, 14 aa, Entamoeba dispar
NQSQKSKKDIHSED

SEQ ID NO: 2449293 - protein, 7 aa, Entamoeba dispar
NQSQPVG

SEQ ID NO: 2449294 - protein, 6 aa, Entamoeba dispar
NQSSCD

SEQ ID NO: 2449295 - protein, 8 aa, Entamoeba dispar
NQSSEENG

SEQ ID NO: 2449296 - protein, 18 aa, Entamoeba dispar
NQSSIEISGKNLSEFPKQ

SEQ ID NO: 2449297 - protein, 10 aa, Entamoeba dispar
NQSTDENELE

SEQ ID NO: 2449298 - protein, 8 aa, Entamoeba dispar
NQSTDGVT

SEQ ID NO: 2449299 - protein, 46 aa, Entamoeba dispar
NQSTIPPPSEDLPDETTNNNGSMEDGDDDDDSNDGEDSIKTEENVA

SEQ ID NO: 2449300 - protein, 23 aa, Entamoeba dispar
NQSTTPYTQSNYPKQQPYYQHPS

SEQ ID NO: 2449301 - protein, 17 aa, Entamoeba dispar
NQTAARKTGDAQLPVDQ

SEQ ID NO: 2449302 - protein, 7 aa, Entamoeba dispar
NQTCGGN

SEQ ID NO: 2449303 - protein, 11 aa, Entamoeba dispar
NQTCTKCNSID

SEQ ID NO: 2449304 - protein, 9 aa, Entamoeba dispar
NQTDGDPVT

SEQ ID NO: 2449305 - protein, 5 aa, Entamoeba dispar
NQTEA

SEQ ID NO: 2449306 - protein, 21 aa, Entamoeba dispar
NQTEITPADIDYDDKTSRQLV

SEQ ID NO: 2449307 - protein, 6 aa, Entamoeba dispar
NQTENI

SEQ ID NO: 2449308 - protein, 7 aa, Entamoeba dispar
NQTERLK

SEQ ID NO: 2449309 - protein, 6 aa, Entamoeba dispar
NQTGKL

SEQ ID NO: 2449310 - protein, 4 aa, Entamoeba dispar
NQTI

SEQ ID NO: 2449311 - protein, 7 aa, Entamoeba dispar
NQTIGSS

SEQ ID NO: 2449312 - protein, 20 aa, Entamoeba dispar
NQTIKEAYNATRKQNTDSEI

SEQ ID NO: 2449313 - protein, 5 aa, Entamoeba dispar
NQTIN

SEQ ID NO: 2449314 - protein, 11 aa, Entamoeba dispar
NQTKGRGRENR

SEQ ID NO: 2449315 - protein, 5 aa, Entamoeba dispar
NQTLG

SEQ ID NO: 2449316 - protein, 10 aa, Entamoeba dispar
NQTLQSNTLS

SEQ ID NO: 2449317 - protein, 6 aa, Entamoeba dispar
NQTNEK

SEQ ID NO: 2449318 - protein, 7 aa, Entamoeba dispar
NQTNQSL

SEQ ID NO: 2449319 - protein, 4 aa, Entamoeba dispar
NQTQ

SEQ ID NO: 2449320 - protein, 17 aa, Entamoeba dispar
NQTQQEQIKKDENDENE

SEQ ID NO: 2449321 - protein, 7 aa, Entamoeba dispar
NQTRYSD

SEQ ID NO: 2449322 - protein, 38 aa, Entamoeba dispar
NQTSSSERITKEIQEQEMAKKKREIEIEQRQKEHEAKM

SEQ ID NO: 2449323 - protein, 13 aa, Entamoeba dispar
NQTSTITESQQNQ

SEQ ID NO: 2449324 - protein, 19 aa, Entamoeba dispar
NQTTKTENDIHKGEGPKSV

SEQ ID NO: 2449325 - protein, 17 aa, Entamoeba dispar
NQTTLSKSARKKIIQNK

SEQ ID NO: 2449326 - protein, 11 aa, Entamoeba dispar
NQTTPSSPRKL

SEQ ID NO: 2449327 - protein, 5 aa, Entamoeba dispar
NQTTS

SEQ ID NO: 2449328 - protein, 8 aa, Entamoeba dispar
NQTTTNNP

SEQ ID NO: 2449329 - protein, 4 aa, Entamoeba dispar
NQTV

SEQ ID NO: 2449330 - protein, 11 aa, Entamoeba dispar
NQTVGRSLTQS

SEQ ID NO: 2449331 - protein, 5 aa, Entamoeba dispar
NQTVN

SEQ ID NO: 2449332 - protein, 14 aa, Entamoeba dispar
NQVEEIKGELSESK

SEQ ID NO: 2449333 - protein, 6 aa, Entamoeba dispar
NQVKDK

SEQ ID NO: 2449334 - protein, 11 aa, Entamoeba dispar
NQVPPQYTEQA

SEQ ID NO: 2449335 - protein, 15 aa, Entamoeba dispar
NQVTSEARGRPNSEM

SEQ ID NO: 2449336 - protein, 7 aa, Entamoeba dispar
NQWDENT

SEQ ID NO: 2449337 - protein, 11 aa, Entamoeba dispar
NQYISNSTNMS

SEQ ID NO: 2449338 - protein, 5 aa, Entamoeba dispar
NQYKP

SEQ ID NO: 2449339 - protein, 21 aa, Entamoeba dispar
NQYNPAKRITARDALHHPYFS

SEQ ID NO: 2449340 - protein, 5 aa, Entamoeba dispar
NQYNT

SEQ ID NO: 2449341 - protein, 23 aa, Entamoeba dispar
NQYPPASSYSSTEEYRKQAVSNE

SEQ ID NO: 2449342 - protein, 7 aa, Entamoeba dispar
NQYPSYQ

SEQ ID NO: 2449343 - protein, 16 aa, Entamoeba dispar
NQYSNASEQTDEQEEI

SEQ ID NO: 2449344 - protein, 8 aa, Entamoeba dispar
NQYSPSKT

SEQ ID NO: 2449345 - protein, 8 aa, Entamoeba dispar
NQYSPTFA

SEQ ID NO: 2449346 - protein, 6 aa, Entamoeba dispar
NQYTES

SEQ ID NO: 2449347 - protein, 8 aa, Entamoeba dispar
NRADSLDP

SEQ ID NO: 2449348 - protein, 5 aa, Entamoeba dispar
NRAEF

SEQ ID NO: 2449349 - protein, 7 aa, Entamoeba dispar
NRAKTNL

SEQ ID NO: 2449350 - protein, 6 aa, Entamoeba dispar
NRCEQQ

SEQ ID NO: 2449351 - protein, 29 aa, Entamoeba dispar
NRCQESKKIETKENQGITNTQKKKTRFTL

SEQ ID NO: 2449352 - protein, 6 aa, Entamoeba dispar
NRDAFS

SEQ ID NO: 2449353 - protein, 10 aa, Entamoeba dispar
NRDEKVKTYC

SEQ ID NO: 2449354 - protein, 12 aa, Entamoeba dispar
NRDINPEINDSW

SEQ ID NO: 2449355 - protein, 9 aa, Entamoeba dispar
NRDKAEELA

SEQ ID NO: 2449356 - protein, 5 aa, Entamoeba dispar
NRDNN

SEQ ID NO: 2449357 - protein, 5 aa, Entamoeba dispar
NRDNV

SEQ ID NO: 2449358 - protein, 14 aa, Entamoeba dispar
NRDRVKAEGHTGNE

SEQ ID NO: 2449359 - protein, 5 aa, Entamoeba dispar
NRDSF

SEQ ID NO: 2449360 - protein, 4 aa, Entamoeba dispar
NREE

SEQ ID NO: 2449361 - protein, 7 aa, Entamoeba dispar
NREEAEQ

SEQ ID NO: 2449362 - protein, 5 aa, Entamoeba dispar
NREEI

SEQ ID NO: 2449363 - protein, 7 aa, Entamoeba dispar
NREERKS

SEQ ID NO: 2449364 - protein, 10 aa, Entamoeba dispar
NREGYLKPSE

SEQ ID NO: 2449365 - protein, 8 aa, Entamoeba dispar
NREKENWT

SEQ ID NO: 2449366 - protein, 6 aa, Entamoeba dispar
NRELHS

SEQ ID NO: 2449367 - protein, 5 aa, Entamoeba dispar
NRELM

SEQ ID NO: 2449368 - protein, 13 aa, Entamoeba dispar
NRENESSKFGTVP

SEQ ID NO: 2449369 - protein, 31 aa, Entamoeba dispar
NRENKKRINKNNEEKKPKKEEEKTLKKKGKF

SEQ ID NO: 2449370 - protein, 7 aa, Entamoeba dispar
NRERKIE

SEQ ID NO: 2449371 - protein, 6 aa, Entamoeba dispar
NRESLS

SEQ ID NO: 2449372 - protein, 5 aa, Entamoeba dispar
NRETF

SEQ ID NO: 2449373 - protein, 6 aa, Entamoeba dispar
NRETNQ

SEQ ID NO: 2449374 - protein, 5 aa, Entamoeba dispar
NREVN

SEQ ID NO: 2449375 - protein, 13 aa, Entamoeba dispar
NREVSTESNSSFY

SEQ ID NO: 2449376 - protein, 7 aa, Entamoeba dispar
NRFTPET

SEQ ID NO: 2449377 - protein, 4 aa, Entamoeba dispar
NRFV

SEQ ID NO: 2449378 - protein, 11 aa, Entamoeba dispar
NRGDNNIKSLN

SEQ ID NO: 2449379 - protein, 14 aa, Entamoeba dispar
NRGEGAMDKEKYGD

SEQ ID NO: 2449380 - protein, 4 aa, Entamoeba dispar
NRGI

SEQ ID NO: 2449381 - protein, 6 aa, Entamoeba dispar
NRGITN

SEQ ID NO: 2449382 - protein, 5 aa, Entamoeba dispar
NRGLY

SEQ ID NO: 2449383 - protein, 4 aa, Entamoeba dispar
NRGN

SEQ ID NO: 2449384 - protein, 11 aa, Entamoeba dispar
NRGNKKYGYRN

SEQ ID NO: 2449385 - protein, 19 aa, Entamoeba dispar
NRGNVKIRGTEEISPHGIP

SEQ ID NO: 2449386 - protein, 4 aa, Entamoeba dispar
NRGP

SEQ ID NO: 2449387 - protein, 10 aa, Entamoeba dispar
NRGPYANSIK

SEQ ID NO: 2449388 - protein, 12 aa, Entamoeba dispar
NRGVSDADKKNK

SEQ ID NO: 2449389 - protein, 8 aa, Entamoeba dispar
NRGYKPAV

SEQ ID NO: 2449390 - protein, 4 aa, Entamoeba dispar
NRID

SEQ ID NO: 2449391 - protein, 5 aa, Entamoeba dispar
NRIDE

SEQ ID NO: 2449392 - protein, 5 aa, Entamoeba dispar
NRIDK

SEQ ID NO: 2449393 - protein, 5 aa, Entamoeba dispar
NRIDS

SEQ ID NO: 2449394 - protein, 23 aa, Entamoeba dispar
NRIEAKISEEKFKKQKEQEEEFE

SEQ ID NO: 2449395 - protein, 5 aa, Entamoeba dispar
NRIED

SEQ ID NO: 2449396 - protein, 5 aa, Entamoeba dispar
NRIEP

SEQ ID NO: 2449397 - protein, 9 aa, Entamoeba dispar
NRIEPTEYT

SEQ ID NO: 2449398 - protein, 4 aa, Entamoeba dispar
NRIQ

SEQ ID NO: 2449399 - protein, 22 aa, Entamoeba dispar
NRIQTSSSFSAGKNGRIKTETI

SEQ ID NO: 2449400 - protein, 5 aa, Entamoeba dispar
NRISD

SEQ ID NO: 2449401 - protein, 6 aa, Entamoeba dispar
NRISDE

SEQ ID NO: 2449402 - protein, 8 aa, Entamoeba dispar
NRISKQEE

SEQ ID NO: 2449403 - protein, 14 aa, Entamoeba dispar
NRITQVKDKEEMKT

SEQ ID NO: 2449404 - protein, 16 aa, Entamoeba dispar
NRITSIPDSIQKASNL

SEQ ID NO: 2449405 - protein, 8 aa, Entamoeba dispar
NRKASSIR

SEQ ID NO: 2449406 - protein, 7 aa, Entamoeba dispar
NRKDAKW

SEQ ID NO: 2449407 - protein, 7 aa, Entamoeba dispar
NRKEETI

SEQ ID NO: 2449408 - protein, 5 aa, Entamoeba dispar
NRKEL

SEQ ID NO: 2449409 - protein, 9 aa, Entamoeba dispar
NRKENEQEV

SEQ ID NO: 2449410 - protein, 8 aa, Entamoeba dispar
NRKGIDNK

SEQ ID NO: 2449411 - protein, 7 aa, Entamoeba dispar
NRKGKKR

SEQ ID NO: 2449412 - protein, 4 aa, Entamoeba dispar
NRKK

SEQ ID NO: 2449413 - protein, 6 aa, Entamoeba dispar
NRKMQH

SEQ ID NO: 2449414 - protein, 7 aa, Entamoeba dispar
NRKNNKK

SEQ ID NO: 2449415 - protein, 9 aa, Entamoeba dispar
NRKNYSPGD

SEQ ID NO: 2449416 - protein, 17 aa, Entamoeba dispar
NRKPDGFSDNKNKKYIS

SEQ ID NO: 2449417 - protein, 7 aa, Entamoeba dispar
NRKRKYG

SEQ ID NO: 2449418 - protein, 8 aa, Entamoeba dispar
NRKRKYGA

SEQ ID NO: 2449419 - protein, 24 aa, Entamoeba dispar
NRKSKSSNSQSKVIQPSTNTNPLI

SEQ ID NO: 2449420 - protein, 9 aa, Entamoeba dispar
NRKSSTPIS

SEQ ID NO: 2449421 - protein, 7 aa, Entamoeba dispar
NRKTPIT

SEQ ID NO: 2449422 - protein, 13 aa, Entamoeba dispar
NRLDSSLRKTDSK

SEQ ID NO: 2449423 - protein, 14 aa, Entamoeba dispar
NRLDSSLRKTDSKN

SEQ ID NO: 2449424 - protein, 12 aa, Entamoeba dispar
NRLGEEKVKSYD

SEQ ID NO: 2449425 - protein, 7 aa, Entamoeba dispar
NRLGTET

SEQ ID NO: 2449426 - protein, 20 aa, Entamoeba dispar
NRLKQKDISTREKRLDTEMS

SEQ ID NO: 2449427 - protein, 14 aa, Entamoeba dispar
NRLNPNGKLETEYD

SEQ ID NO: 2449428 - protein, 5 aa, Entamoeba dispar
NRLSD

SEQ ID NO: 2449429 - protein, 15 aa, Entamoeba dispar
NRLSGGGTESSGSYK

SEQ ID NO: 2449430 - protein, 24 aa, Entamoeba dispar
NRMEEEDSYNNSDNENDQKPKYSY

SEQ ID NO: 2449431 - protein, 7 aa, Entamoeba dispar
NRMEKDE

SEQ ID NO: 2449432 - protein, 4 aa, Entamoeba dispar
NRMT

SEQ ID NO: 2449433 - protein, 13 aa, Entamoeba dispar
NRNEITSNPETQN

SEQ ID NO: 2449434 - protein, 10 aa, Entamoeba dispar
NRNEQIGNGL

SEQ ID NO: 2449435 - protein, 6 aa, Entamoeba dispar
NRNGFI

SEQ ID NO: 2449436 - protein, 9 aa, Entamoeba dispar
NRNKQNPYQ

SEQ ID NO: 2449437 - protein, 7 aa, Entamoeba dispar
NRNLPRT

SEQ ID NO: 2449438 - protein, 10 aa, Entamoeba dispar
NRNNNNNTKL

SEQ ID NO: 2449439 - protein, 91 aa, Entamoeba dispar
NRNNPTNIIPSDRKKETDELNNNNQKSSGKGANKNYSNRQNGNNRYNNEQSNANTKKNEKYNNQLGNNNYKTQNQKNNSNKKEMDPNNNPI

SEQ ID NO: 2449440 - protein, 5 aa, Entamoeba dispar
NRNNS

SEQ ID NO: 2449441 - protein, 17 aa, Entamoeba dispar
NRNPPPIPPPPENPFSI

SEQ ID NO: 2449442 - protein, 6 aa, Entamoeba dispar
NRNPQK

SEQ ID NO: 2449443 - protein, 12 aa, Entamoeba dispar
NRPASDKDRNAY

SEQ ID NO: 2449444 - protein, 6 aa, Entamoeba dispar
NRPAYY

SEQ ID NO: 2449445 - protein, 5 aa, Entamoeba dispar
NRPDL

SEQ ID NO: 2449446 - protein, 10 aa, Entamoeba dispar
NRPEETDQQL

SEQ ID NO: 2449447 - protein, 16 aa, Entamoeba dispar
NRPIVGGGTAISPDEI

SEQ ID NO: 2449448 - protein, 5 aa, Entamoeba dispar
NRPKR

SEQ ID NO: 2449449 - protein, 76 aa, Entamoeba dispar
NRPKRRFNRRPGYANRNNRGRRDRGKKEYTKPEEKKEAGKAEEKKEQPKEEKATPKNDLRSRAKPKGYGKYHKHYE

SEQ ID NO: 2449450 - protein, 31 aa, Entamoeba dispar
NRPLPSIPQPKIIPTKEDELNQKTKEQEIDL

SEQ ID NO: 2449451 - protein, 36 aa, Entamoeba dispar
NRPLTPNQEEVFSPKTITRSVSETNDFNTLETQGKV

SEQ ID NO: 2449452 - protein, 5 aa, Entamoeba dispar
NRPME

SEQ ID NO: 2449453 - protein, 8 aa, Entamoeba dispar
NRPPPDPV

SEQ ID NO: 2449454 - protein, 15 aa, Entamoeba dispar
NRPPPTLSAPEEVSK

SEQ ID NO: 2449455 - protein, 4 aa, Entamoeba dispar
NRPR

SEQ ID NO: 2449456 - protein, 7 aa, Entamoeba dispar
NRPRDDI

SEQ ID NO: 2449457 - protein, 5 aa, Entamoeba dispar
NRPVR

SEQ ID NO: 2449458 - protein, 5 aa, Entamoeba dispar
NRPYT

SEQ ID NO: 2449459 - protein, 13 aa, Entamoeba dispar
NRQDEEVRIPPGK

SEQ ID NO: 2449460 - protein, 5 aa, Entamoeba dispar
NRQFQ

SEQ ID NO: 2449461 - protein, 9 aa, Entamoeba dispar
NRQGKEITP

SEQ ID NO: 2449462 - protein, 9 aa, Entamoeba dispar
NRQNNTEKF

SEQ ID NO: 2449463 - protein, 5 aa, Entamoeba dispar
NRQNQ

SEQ ID NO: 2449464 - protein, 8 aa, Entamoeba dispar
NRQPTLHK

SEQ ID NO: 2449465 - protein, 10 aa, Entamoeba dispar
NRQTDELGAY

SEQ ID NO: 2449466 - protein, 9 aa, Entamoeba dispar
NRQWNGEIN

SEQ ID NO: 2449467 - protein, 13 aa, Entamoeba dispar
NRRASDEKATAST

SEQ ID NO: 2449468 - protein, 18 aa, Entamoeba dispar
NRRGKRSNDDEPTGEAES

SEQ ID NO: 2449469 - protein, 6 aa, Entamoeba dispar
NRRGLP

SEQ ID NO: 2449470 - protein, 8 aa, Entamoeba dispar
NRRNERKQ

SEQ ID NO: 2449471 - protein, 5 aa, Entamoeba dispar
NRRQP

SEQ ID NO: 2449472 - protein, 22 aa, Entamoeba dispar
NRRSCSSRRSYSSSSRSRSRRR

SEQ ID NO: 2449473 - protein, 20 aa, Entamoeba dispar
NRRSIKSEDEHEEQNVNPPQ

SEQ ID NO: 2449474 - protein, 8 aa, Entamoeba dispar
NRRTGEKK

SEQ ID NO: 2449475 - protein, 7 aa, Entamoeba dispar
NRRTPLG

SEQ ID NO: 2449476 - protein, 5 aa, Entamoeba dispar
NRSDV

SEQ ID NO: 2449477 - protein, 5 aa, Entamoeba dispar
NRSEW

SEQ ID NO: 2449478 - protein, 8 aa, Entamoeba dispar
NRSGDGMN

SEQ ID NO: 2449479 - protein, 9 aa, Entamoeba dispar
NRSGKELTV

SEQ ID NO: 2449480 - protein, 12 aa, Entamoeba dispar
NRSIEDKRKTIR

SEQ ID NO: 2449481 - protein, 8 aa, Entamoeba dispar
NRSITEAR

SEQ ID NO: 2449482 - protein, 11 aa, Entamoeba dispar
NRSKFKKSKGI

SEQ ID NO: 2449483 - protein, 12 aa, Entamoeba dispar
NRSMYEDTDTFT

SEQ ID NO: 2449484 - protein, 8 aa, Entamoeba dispar
NRSNEDQA

SEQ ID NO: 2449485 - protein, 6 aa, Entamoeba dispar
NRSQSI

SEQ ID NO: 2449486 - protein, 7 aa, Entamoeba dispar
NRSRASC

SEQ ID NO: 2449487 - protein, 10 aa, Entamoeba dispar
NRSSENKELI

SEQ ID NO: 2449488 - protein, 11 aa, Entamoeba dispar
NRSSINKPLPE

SEQ ID NO: 2449489 - protein, 5 aa, Entamoeba dispar
NRSTF

SEQ ID NO: 2449490 - protein, 6 aa, Entamoeba dispar
NRSYRD

SEQ ID NO: 2449491 - protein, 10 aa, Entamoeba dispar
NRTFEKPEQI

SEQ ID NO: 2449492 - protein, 4 aa, Entamoeba dispar
NRTH

SEQ ID NO: 2449493 - protein, 9 aa, Entamoeba dispar
NRTITGTEN

SEQ ID NO: 2449494 - protein, 8 aa, Entamoeba dispar
NRTKTTGI

SEQ ID NO: 2449495 - protein, 7 aa, Entamoeba dispar
NRTNESF

SEQ ID NO: 2449496 - protein, 8 aa, Entamoeba dispar
NRTNGGLA

SEQ ID NO: 2449497 - protein, 13 aa, Entamoeba dispar
NRTQSSYEVSPQM

SEQ ID NO: 2449498 - protein, 5 aa, Entamoeba dispar
NRTTF

SEQ ID NO: 2449499 - protein, 4 aa, Entamoeba dispar
NRTV

SEQ ID NO: 2449500 - protein, 5 aa, Entamoeba dispar
NRTYE

SEQ ID NO: 2449501 - protein, 4 aa, Entamoeba dispar
NRVD

SEQ ID NO: 2449502 - protein, 9 aa, Entamoeba dispar
NRVDQSRDA

SEQ ID NO: 2449503 - protein, 4 aa, Entamoeba dispar
NRVE

SEQ ID NO: 2449504 - protein, 17 aa, Entamoeba dispar
NRVEDKEDKIKKLVKKW

SEQ ID NO: 2449505 - protein, 10 aa, Entamoeba dispar
NRVEEGDVTL

SEQ ID NO: 2449506 - protein, 9 aa, Entamoeba dispar
NRVTKTKDF

SEQ ID NO: 2449507 - protein, 17 aa, Entamoeba dispar
NRVTPKGINNPRSKAKI

SEQ ID NO: 2449508 - protein, 11 aa, Entamoeba dispar
NRYDKTQQEDI

SEQ ID NO: 2449509 - protein, 6 aa, Entamoeba dispar
NRYNEN

SEQ ID NO: 2449510 - protein, 16 aa, Entamoeba dispar
NSAASGIKKRKSWTEE

SEQ ID NO: 2449511 - protein, 9 aa, Entamoeba dispar
NSAEEGKSI

SEQ ID NO: 2449512 - protein, 4 aa, Entamoeba dispar
NSAH

SEQ ID NO: 2449513 - protein, 8 aa, Entamoeba dispar
NSAKDDIH

SEQ ID NO: 2449514 - protein, 10 aa, Entamoeba dispar
NSALSNNIQP

SEQ ID NO: 2449515 - protein, 6 aa, Entamoeba dispar
NSANET

SEQ ID NO: 2449516 - protein, 9 aa, Entamoeba dispar
NSAPHSNTE

SEQ ID NO: 2449517 - protein, 24 aa, Entamoeba dispar
NSAPQQQTNQRNSSASQQPNTAQN

SEQ ID NO: 2449518 - protein, 11 aa, Entamoeba dispar
NSARKELAEIG

SEQ ID NO: 2449519 - protein, 6 aa, Entamoeba dispar
NSASGL

SEQ ID NO: 2449520 - protein, 9 aa, Entamoeba dispar
NSATTQGKV

SEQ ID NO: 2449521 - protein, 6 aa, Entamoeba dispar
NSAWKT

SEQ ID NO: 2449522 - protein, 9 aa, Entamoeba dispar
NSCGYSRDK

SEQ ID NO: 2449523 - protein, 6 aa, Entamoeba dispar
NSCNSP

SEQ ID NO: 2449524 - protein, 5 aa, Entamoeba dispar
NSCPR

SEQ ID NO: 2449525 - protein, 15 aa, Entamoeba dispar
NSCTKVTGKSLDPTT

SEQ ID NO: 2449526 - protein, 8 aa, Entamoeba dispar
NSDAQPVT

SEQ ID NO: 2449527 - protein, 11 aa, Entamoeba dispar
NSDDADPATRL

SEQ ID NO: 2449528 - protein, 7 aa, Entamoeba dispar
NSDDCSE

SEQ ID NO: 2449529 - protein, 11 aa, Entamoeba dispar
NSDDKTQAVNK

SEQ ID NO: 2449530 - protein, 11 aa, Entamoeba dispar
NSDDLGSDMER

SEQ ID NO: 2449531 - protein, 10 aa, Entamoeba dispar
NSDEAVKKEQ

SEQ ID NO: 2449532 - protein, 8 aa, Entamoeba dispar
NSDFDEDE

SEQ ID NO: 2449533 - protein, 6 aa, Entamoeba dispar
NSDHTQ

SEQ ID NO: 2449534 - protein, 5 aa, Entamoeba dispar
NSDIK

SEQ ID NO: 2449535 - protein, 7 aa, Entamoeba dispar
NSDIRTQ

SEQ ID NO: 2449536 - protein, 6 aa, Entamoeba dispar
NSDITS

SEQ ID NO: 2449537 - protein, 9 aa, Entamoeba dispar
NSDKGCSDK

SEQ ID NO: 2449538 - protein, 25 aa, Entamoeba dispar
NSDKSIESKYQGNMTETMKQGRSSP

SEQ ID NO: 2449539 - protein, 6 aa, Entamoeba dispar
NSDKTM

SEQ ID NO: 2449540 - protein, 14 aa, Entamoeba dispar
NSDKVKTDEERQDL

SEQ ID NO: 2449541 - protein, 8 aa, Entamoeba dispar
NSDLEEVK

SEQ ID NO: 2449542 - protein, 12 aa, Entamoeba dispar
NSDLGVEEPLND

SEQ ID NO: 2449543 - protein, 9 aa, Entamoeba dispar
NSDLSSTGA

SEQ ID NO: 2449544 - protein, 4 aa, Entamoeba dispar
NSDN

SEQ ID NO: 2449545 - protein, 13 aa, Entamoeba dispar
NSDNQSIEEGEEY

SEQ ID NO: 2449546 - protein, 37 aa, Entamoeba dispar
NSDNVETGDNALQNNTEEIDNPLAPKQIQKPNRSSFT

SEQ ID NO: 2449547 - protein, 5 aa, Entamoeba dispar
NSDPI

SEQ ID NO: 2449548 - protein, 6 aa, Entamoeba dispar
NSDPVA

SEQ ID NO: 2449549 - protein, 15 aa, Entamoeba dispar
NSDRKLTEEGNGKKV

SEQ ID NO: 2449550 - protein, 7 aa, Entamoeba dispar
NSDSTVT

SEQ ID NO: 2449551 - protein, 5 aa, Entamoeba dispar
NSECD

SEQ ID NO: 2449552 - protein, 8 aa, Entamoeba dispar
NSECQQQF

SEQ ID NO: 2449553 - protein, 80 aa, Entamoeba dispar
NSECQSDQSPQTEGGQNTREGNQTQQPQNEEPKPSQDSVTDNSTPPPPEPSSTNLGMDETSDDNKNPIPMEEEPNNNNDI

SEQ ID NO: 2449554 - protein, 5 aa, Entamoeba dispar
NSEDF

SEQ ID NO: 2449555 - protein, 6 aa, Entamoeba dispar
NSEDRT

SEQ ID NO: 2449556 - protein, 7 aa, Entamoeba dispar
NSEEEDP

SEQ ID NO: 2449557 - protein, 7 aa, Entamoeba dispar
NSEEERD

SEQ ID NO: 2449558 - protein, 18 aa, Entamoeba dispar
NSEEIEEEIKTRNDIENI

SEQ ID NO: 2449559 - protein, 6 aa, Entamoeba dispar
NSEERP

SEQ ID NO: 2449560 - protein, 7 aa, Entamoeba dispar
NSEESLE

SEQ ID NO: 2449561 - protein, 11 aa, Entamoeba dispar
NSEFETDSSQT

SEQ ID NO: 2449562 - protein, 32 aa, Entamoeba dispar
NSEFNSPTNPSSPFNEPVNTQHHNQYFHPIYT

SEQ ID NO: 2449563 - protein, 7 aa, Entamoeba dispar
NSEIEET

SEQ ID NO: 2449564 - protein, 6 aa, Entamoeba dispar
NSEIEG

SEQ ID NO: 2449565 - protein, 20 aa, Entamoeba dispar
NSEIQKKDIPQPSIKQEDEI

SEQ ID NO: 2449566 - protein, 7 aa, Entamoeba dispar
NSEKKIE

SEQ ID NO: 2449567 - protein, 6 aa, Entamoeba dispar
NSEKSD

SEQ ID NO: 2449568 - protein, 4 aa, Entamoeba dispar
NSEL

SEQ ID NO: 2449569 - protein, 7 aa, Entamoeba dispar
NSENAYS

SEQ ID NO: 2449570 - protein, 13 aa, Entamoeba dispar
NSENIGEKLTINW

SEQ ID NO: 2449571 - protein, 5 aa, Entamoeba dispar
NSENS

SEQ ID NO: 2449572 - protein, 7 aa, Entamoeba dispar
NSENTEI

SEQ ID NO: 2449573 - protein, 30 aa, Entamoeba dispar
NSEPNQDTKQKIDIPEYQPSRQSNLTSPRT

SEQ ID NO: 2449574 - protein, 6 aa, Entamoeba dispar
NSEPTD

SEQ ID NO: 2449575 - protein, 11 aa, Entamoeba dispar
NSEPTNSYRRD

SEQ ID NO: 2449576 - protein, 31 aa, Entamoeba dispar
NSEPYDQDQYYDSGIPYDDYNNGYQQPSYIP

SEQ ID NO: 2449577 - protein, 8 aa, Entamoeba dispar
NSEREVQP

SEQ ID NO: 2449578 - protein, 16 aa, Entamoeba dispar
NSERQQKSLEDTHSYT

SEQ ID NO: 2449579 - protein, 13 aa, Entamoeba dispar
NSERTTTHSSGST

SEQ ID NO: 2449580 - protein, 13 aa, Entamoeba dispar
NSERVKTDDERRD

SEQ ID NO: 2449581 - protein, 5 aa, Entamoeba dispar
NSESI

SEQ ID NO: 2449582 - protein, 5 aa, Entamoeba dispar
NSESL

SEQ ID NO: 2449583 - protein, 8 aa, Entamoeba dispar
NSESTPDS

SEQ ID NO: 2449584 - protein, 6 aa, Entamoeba dispar
NSETET

SEQ ID NO: 2449585 - protein, 7 aa, Entamoeba dispar
NSETKEV

SEQ ID NO: 2449586 - protein, 14 aa, Entamoeba dispar
NSETTADSSTNTID

SEQ ID NO: 2449587 - protein, 8 aa, Entamoeba dispar
NSETTESV

SEQ ID NO: 2449588 - protein, 15 aa, Entamoeba dispar
NSETTNTSNTTTQEI

SEQ ID NO: 2449589 - protein, 6 aa, Entamoeba dispar
NSETYG

SEQ ID NO: 2449590 - protein, 8 aa, Entamoeba dispar
NSEVSSEA

SEQ ID NO: 2449591 - protein, 5 aa, Entamoeba dispar
NSFAQ

SEQ ID NO: 2449592 - protein, 14 aa, Entamoeba dispar
NSFEEQREKQMNEV

SEQ ID NO: 2449593 - protein, 6 aa, Entamoeba dispar
NSFEGC

SEQ ID NO: 2449594 - protein, 9 aa, Entamoeba dispar
NSFESSDTF

SEQ ID NO: 2449595 - protein, 15 aa, Entamoeba dispar
NSFKPENECLKDQKE

SEQ ID NO: 2449596 - protein, 5 aa, Entamoeba dispar
NSFLS

SEQ ID NO: 2449597 - protein, 10 aa, Entamoeba dispar
NSFNNKAVDE

SEQ ID NO: 2449598 - protein, 6 aa, Entamoeba dispar
NSFPDT

SEQ ID NO: 2449599 - protein, 6 aa, Entamoeba dispar
NSFPEL

SEQ ID NO: 2449600 - protein, 7 aa, Entamoeba dispar
NSFPNSQ

SEQ ID NO: 2449601 - protein, 6 aa, Entamoeba dispar
NSFPTL

SEQ ID NO: 2449602 - protein, 6 aa, Entamoeba dispar
NSFRSE

SEQ ID NO: 2449603 - protein, 20 aa, Entamoeba dispar
NSFSKQDEKPISITQNKHSN

SEQ ID NO: 2449604 - protein, 7 aa, Entamoeba dispar
NSFSSNE

SEQ ID NO: 2449605 - protein, 4 aa, Entamoeba dispar
NSFT

SEQ ID NO: 2449606 - protein, 7 aa, Entamoeba dispar
NSGDIPI

SEQ ID NO: 2449607 - protein, 10 aa, Entamoeba dispar
NSGDSESSFI

SEQ ID NO: 2449608 - protein, 7 aa, Entamoeba dispar
NSGEIPS

SEQ ID NO: 2449609 - protein, 4 aa, Entamoeba dispar
NSGL

SEQ ID NO: 2449610 - protein, 8 aa, Entamoeba dispar
NSGLKGTS

SEQ ID NO: 2449611 - protein, 16 aa, Entamoeba dispar
NSGNETTTSNKQETEQ

SEQ ID NO: 2449612 - protein, 9 aa, Entamoeba dispar
NSGNSDYVS

SEQ ID NO: 2449613 - protein, 8 aa, Entamoeba dispar
NSGNWRKN

SEQ ID NO: 2449614 - protein, 4 aa, Entamoeba dispar
NSGP

SEQ ID NO: 2449615 - protein, 8 aa, Entamoeba dispar
NSGPNTNG

SEQ ID NO: 2449616 - protein, 7 aa, Entamoeba dispar
NSGPTSL

SEQ ID NO: 2449617 - protein, 8 aa, Entamoeba dispar
NSGSELSQ

SEQ ID NO: 2449618 - protein, 11 aa, Entamoeba dispar
NSGSITEKKET

SEQ ID NO: 2449619 - protein, 4 aa, Entamoeba dispar
NSGT

SEQ ID NO: 2449620 - protein, 10 aa, Entamoeba dispar
NSGTAKGNVA

SEQ ID NO: 2449621 - protein, 4 aa, Entamoeba dispar
NSHE

SEQ ID NO: 2449622 - protein, 17 aa, Entamoeba dispar
NSHEGIVPSQYSKKLSD

SEQ ID NO: 2449623 - protein, 5 aa, Entamoeba dispar
NSHGG

SEQ ID NO: 2449624 - protein, 5 aa, Entamoeba dispar
NSHGN

SEQ ID NO: 2449625 - protein, 17 aa, Entamoeba dispar
NSHKISGYQSSKTPKIG

SEQ ID NO: 2449626 - protein, 7 aa, Entamoeba dispar
NSHKSSM

SEQ ID NO: 2449627 - protein, 4 aa, Entamoeba dispar
NSHN

SEQ ID NO: 2449628 - protein, 5 aa, Entamoeba dispar
NSIDE

SEQ ID NO: 2449629 - protein, 13 aa, Entamoeba dispar
NSIDKKKITQGTR

SEQ ID NO: 2449630 - protein, 7 aa, Entamoeba dispar
NSIDNEN

SEQ ID NO: 2449631 - protein, 10 aa, Entamoeba dispar
NSIDSTGKKI

SEQ ID NO: 2449632 - protein, 9 aa, Entamoeba dispar
NSIEKGPGI

SEQ ID NO: 2449633 - protein, 15 aa, Entamoeba dispar
NSIEKRQKRIKGSSN

SEQ ID NO: 2449634 - protein, 12 aa, Entamoeba dispar
NSIERDKEALKM

SEQ ID NO: 2449635 - protein, 14 aa, Entamoeba dispar
NSIGEETKKGIKEY

SEQ ID NO: 2449636 - protein, 6 aa, Entamoeba dispar
NSIGIK

SEQ ID NO: 2449637 - protein, 6 aa, Entamoeba dispar
NSIGNA

SEQ ID NO: 2449638 - protein, 6 aa, Entamoeba dispar
NSIGQD

SEQ ID NO: 2449639 - protein, 45 aa, Entamoeba dispar
NSIGRSTRMSTPRKSSKSSLGSRLDRSSVSAIEKEEESYIPSTDD

SEQ ID NO: 2449640 - protein, 5 aa, Entamoeba dispar
NSIHE

SEQ ID NO: 2449641 - protein, 4 aa, Entamoeba dispar
NSIK

SEQ ID NO: 2449642 - protein, 7 aa, Entamoeba dispar
NSIKEIP

SEQ ID NO: 2449643 - protein, 10 aa, Entamoeba dispar
NSIKETKEIK

SEQ ID NO: 2449644 - protein, 9 aa, Entamoeba dispar
NSIKQQNEI

SEQ ID NO: 2449645 - protein, 6 aa, Entamoeba dispar
NSIKTY

SEQ ID NO: 2449646 - protein, 4 aa, Entamoeba dispar
NSIN

SEQ ID NO: 2449647 - protein, 22 aa, Entamoeba dispar
NSINDNYDPDAGDEEYTEEDDV

SEQ ID NO: 2449648 - protein, 29 aa, Entamoeba dispar
NSINGNEIKEINGETKNLKNGMLKDEKKK

SEQ ID NO: 2449649 - protein, 10 aa, Entamoeba dispar
NSINKNNENK

SEQ ID NO: 2449650 - protein, 8 aa, Entamoeba dispar
NSIPEQTM

SEQ ID NO: 2449651 - protein, 6 aa, Entamoeba dispar
NSIPYG

SEQ ID NO: 2449652 - protein, 4 aa, Entamoeba dispar
NSIQ

SEQ ID NO: 2449653 - protein, 7 aa, Entamoeba dispar
NSIQERY

SEQ ID NO: 2449654 - protein, 6 aa, Entamoeba dispar
NSIQFQ

SEQ ID NO: 2449655 - protein, 10 aa, Entamoeba dispar
NSIQNVNDSS

SEQ ID NO: 2449656 - protein, 8 aa, Entamoeba dispar
NSIRKSKS

SEQ ID NO: 2449657 - protein, 7 aa, Entamoeba dispar
NSIRSLP

SEQ ID NO: 2449658 - protein, 8 aa, Entamoeba dispar
NSISDNGS

SEQ ID NO: 2449659 - protein, 12 aa, Entamoeba dispar
NSISKSVEVTKT

SEQ ID NO: 2449660 - protein, 12 aa, Entamoeba dispar
NSISNYKVEDSI

SEQ ID NO: 2449661 - protein, 7 aa, Entamoeba dispar
NSISSQI

SEQ ID NO: 2449662 - protein, 31 aa, Entamoeba dispar
NSISTPQQPIDRSHQQQRYQQPQYQTFPNQQ

SEQ ID NO: 2449663 - protein, 10 aa, Entamoeba dispar
NSISTRRGKQ

SEQ ID NO: 2449664 - protein, 12 aa, Entamoeba dispar
NSITKKSKEEIM

SEQ ID NO: 2449665 - protein, 6 aa, Entamoeba dispar
NSITTI

SEQ ID NO: 2449666 - protein, 14 aa, Entamoeba dispar
NSKAMNKAKDIRNQ

SEQ ID NO: 2449667 - protein, 5 aa, Entamoeba dispar
NSKCA

SEQ ID NO: 2449668 - protein, 15 aa, Entamoeba dispar
NSKDTKTVKRMKEKR

SEQ ID NO: 2449669 - protein, 4 aa, Entamoeba dispar
NSKE

SEQ ID NO: 2449670 - protein, 7 aa, Entamoeba dispar
NSKEDPY

SEQ ID NO: 2449671 - protein, 7 aa, Entamoeba dispar
NSKEEIA

SEQ ID NO: 2449672 - protein, 22 aa, Entamoeba dispar
NSKEKEGYYEVNGNEEKKEAIE

SEQ ID NO: 2449673 - protein, 6 aa, Entamoeba dispar
NSKENA

SEQ ID NO: 2449674 - protein, 5 aa, Entamoeba dispar
NSKFS

SEQ ID NO: 2449675 - protein, 7 aa, Entamoeba dispar
NSKGERR

SEQ ID NO: 2449676 - protein, 7 aa, Entamoeba dispar
NSKGFNP

SEQ ID NO: 2449677 - protein, 5 aa, Entamoeba dispar
NSKGL

SEQ ID NO: 2449678 - protein, 8 aa, Entamoeba dispar
NSKGPKGY

SEQ ID NO: 2449679 - protein, 5 aa, Entamoeba dispar
NSKIG

SEQ ID NO: 2449680 - protein, 7 aa, Entamoeba dispar
NSKIIEE

SEQ ID NO: 2449681 - protein, 15 aa, Entamoeba dispar
NSKITEEEIKYEKER

SEQ ID NO: 2449682 - protein, 8 aa, Entamoeba dispar
NSKKDSIK

SEQ ID NO: 2449683 - protein, 8 aa, Entamoeba dispar
NSKKGVKP

SEQ ID NO: 2449684 - protein, 10 aa, Entamoeba dispar
NSKKKGSQRL

SEQ ID NO: 2449685 - protein, 16 aa, Entamoeba dispar
NSKKLNENEVLPNTDL

SEQ ID NO: 2449686 - protein, 18 aa, Entamoeba dispar
NSKNKSPSSKSPSCKSPL

SEQ ID NO: 2449687 - protein, 9 aa, Entamoeba dispar
NSKNSESLI

SEQ ID NO: 2449688 - protein, 7 aa, Entamoeba dispar
NSKNTNI

SEQ ID NO: 2449689 - protein, 5 aa, Entamoeba dispar
NSKPS

SEQ ID NO: 2449690 - protein, 14 aa, Entamoeba dispar
NSKPSNRAGSKAYM

SEQ ID NO: 2449691 - protein, 10 aa, Entamoeba dispar
NSKPVNRSKT

SEQ ID NO: 2449692 - protein, 9 aa, Entamoeba dispar
NSKQRDDTV

SEQ ID NO: 2449693 - protein, 26 aa, Entamoeba dispar
NSKQSTSVSQQNYIQNTQNNPQNNYM

SEQ ID NO: 2449694 - protein, 7 aa, Entamoeba dispar
NSKRKLT

SEQ ID NO: 2449695 - protein, 11 aa, Entamoeba dispar
NSKSGGQTGKS

SEQ ID NO: 2449696 - protein, 8 aa, Entamoeba dispar
NSKSLNEI

SEQ ID NO: 2449697 - protein, 8 aa, Entamoeba dispar
NSKSPIGF

SEQ ID NO: 2449698 - protein, 7 aa, Entamoeba dispar
NSKSTTI

SEQ ID NO: 2449699 - protein, 6 aa, Entamoeba dispar
NSKTEF

SEQ ID NO: 2449700 - protein, 4 aa, Entamoeba dispar
NSKY

SEQ ID NO: 2449701 - protein, 8 aa, Entamoeba dispar
NSKYKKTT

SEQ ID NO: 2449702 - protein, 8 aa, Entamoeba dispar
NSKYPSIP

SEQ ID NO: 2449703 - protein, 7 aa, Entamoeba dispar
NSKYQNK

SEQ ID NO: 2449704 - protein, 5 aa, Entamoeba dispar
NSKYR

SEQ ID NO: 2449705 - protein, 5 aa, Entamoeba dispar
NSLAD

SEQ ID NO: 2449706 - protein, 9 aa, Entamoeba dispar
NSLASKDTI

SEQ ID NO: 2449707 - protein, 11 aa, Entamoeba dispar
NSLASNDEVRT

SEQ ID NO: 2449708 - protein, 8 aa, Entamoeba dispar
NSLDEYTK

SEQ ID NO: 2449709 - protein, 5 aa, Entamoeba dispar
NSLEP

SEQ ID NO: 2449710 - protein, 24 aa, Entamoeba dispar
NSLGGTLNKVKSEKQEIKQEIKQE

SEQ ID NO: 2449711 - protein, 7 aa, Entamoeba dispar
NSLGTDG

SEQ ID NO: 2449712 - protein, 5 aa, Entamoeba dispar
NSLKE

SEQ ID NO: 2449713 - protein, 11 aa, Entamoeba dispar
NSLKESSKGTI

SEQ ID NO: 2449714 - protein, 14 aa, Entamoeba dispar
NSLKKENEENGNAY

SEQ ID NO: 2449715 - protein, 20 aa, Entamoeba dispar
NSLKNQLNDMSKPRTNEQKA

SEQ ID NO: 2449716 - protein, 9 aa, Entamoeba dispar
NSLKTEHKL

SEQ ID NO: 2449717 - protein, 11 aa, Entamoeba dispar
NSLNEKDKENI

SEQ ID NO: 2449718 - protein, 10 aa, Entamoeba dispar
NSLNEKSMGK

SEQ ID NO: 2449719 - protein, 5 aa, Entamoeba dispar
NSLNQ

SEQ ID NO: 2449720 - protein, 13 aa, Entamoeba dispar
NSLNSDTKKKLKD

SEQ ID NO: 2449721 - protein, 14 aa, Entamoeba dispar
NSLPVKTKPRSNTI

SEQ ID NO: 2449722 - protein, 5 aa, Entamoeba dispar
NSLQE

SEQ ID NO: 2449723 - protein, 9 aa, Entamoeba dispar
NSLQEQVRT

SEQ ID NO: 2449724 - protein, 6 aa, Entamoeba dispar
NSLQQV

SEQ ID NO: 2449725 - protein, 5 aa, Entamoeba dispar
NSLQY

SEQ ID NO: 2449726 - protein, 7 aa, Entamoeba dispar
NSLRKRK

SEQ ID NO: 2449727 - protein, 7 aa, Entamoeba dispar
NSLSSGS

SEQ ID NO: 2449728 - protein, 5 aa, Entamoeba dispar
NSLTS

SEQ ID NO: 2449729 - protein, 5 aa, Entamoeba dispar
NSLVK

SEQ ID NO: 2449730 - protein, 16 aa, Entamoeba dispar
NSLYTQRTSFDRQQMD

SEQ ID NO: 2449731 - protein, 11 aa, Entamoeba dispar
NSMDKESRSFS

SEQ ID NO: 2449732 - protein, 6 aa, Entamoeba dispar
NSMDKQ

SEQ ID NO: 2449733 - protein, 6 aa, Entamoeba dispar
NSMENE

SEQ ID NO: 2449734 - protein, 6 aa, Entamoeba dispar
NSMNSK

SEQ ID NO: 2449735 - protein, 8 aa, Entamoeba dispar
NSMTKRSI

SEQ ID NO: 2449736 - protein, 11 aa, Entamoeba dispar
NSMVNNEASKR

SEQ ID NO: 2449737 - protein, 7 aa, Entamoeba dispar
NSNAIEK

SEQ ID NO: 2449738 - protein, 4 aa, Entamoeba dispar
NSND

SEQ ID NO: 2449739 - protein, 11 aa, Entamoeba dispar
NSNDESLYPDE

SEQ ID NO: 2449740 - protein, 13 aa, Entamoeba dispar
NSNDESMVTTGNE

SEQ ID NO: 2449741 - protein, 7 aa, Entamoeba dispar
NSNDFQS

SEQ ID NO: 2449742 - protein, 6 aa, Entamoeba dispar
NSNDPQ

SEQ ID NO: 2449743 - protein, 17 aa, Entamoeba dispar
NSNDTINCQPSISRGSY

SEQ ID NO: 2449744 - protein, 6 aa, Entamoeba dispar
NSNDTL

SEQ ID NO: 2449745 - protein, 6 aa, Entamoeba dispar
NSNEEI

SEQ ID NO: 2449746 - protein, 12 aa, Entamoeba dispar
NSNEITSVELIK

SEQ ID NO: 2449747 - protein, 5 aa, Entamoeba dispar
NSNEK

SEQ ID NO: 2449748 - protein, 6 aa, Entamoeba dispar
NSNEKQ

SEQ ID NO: 2449749 - protein, 6 aa, Entamoeba dispar
NSNENH

SEQ ID NO: 2449750 - protein, 8 aa, Entamoeba dispar
NSNEPTRE

SEQ ID NO: 2449751 - protein, 31 aa, Entamoeba dispar
NSNEQKIIKPNQPISEDKSQPQLSKKEQMSI

SEQ ID NO: 2449752 - protein, 10 aa, Entamoeba dispar
NSNESADSLE

SEQ ID NO: 2449753 - protein, 20 aa, Entamoeba dispar
NSNETQKLTPSSHLSSTPLS

SEQ ID NO: 2449754 - protein, 4 aa, Entamoeba dispar
NSNF

SEQ ID NO: 2449755 - protein, 6 aa, Entamoeba dispar
NSNGSQ

SEQ ID NO: 2449756 - protein, 27 aa, Entamoeba dispar
NSNGSTPSDGRELYTPPNRCENPDISE

SEQ ID NO: 2449757 - protein, 5 aa, Entamoeba dispar
NSNGY

SEQ ID NO: 2449758 - protein, 7 aa, Entamoeba dispar
NSNGYEE

SEQ ID NO: 2449759 - protein, 7 aa, Entamoeba dispar
NSNHDKI

SEQ ID NO: 2449760 - protein, 6 aa, Entamoeba dispar
NSNIDE

SEQ ID NO: 2449761 - protein, 10 aa, Entamoeba dispar
NSNIKNPMTG

SEQ ID NO: 2449762 - protein, 4 aa, Entamoeba dispar
NSNK

SEQ ID NO: 2449763 - protein, 6 aa, Entamoeba dispar
NSNKER

SEQ ID NO: 2449764 - protein, 7 aa, Entamoeba dispar
NSNKTGE

SEQ ID NO: 2449765 - protein, 13 aa, Entamoeba dispar
NSNLIKTDYSIFF

SEQ ID NO: 2449766 - protein, 34 aa, Entamoeba dispar
NSNLPNSVSPVQTNEHLGKQREKTLTHKDDEISI

SEQ ID NO: 2449767 - protein, 22 aa, Entamoeba dispar
NSNLSEKDKSELRDELNEKESE

SEQ ID NO: 2449768 - protein, 12 aa, Entamoeba dispar
NSNNIIREKADF

SEQ ID NO: 2449769 - protein, 8 aa, Entamoeba dispar
NSNNKWEP

SEQ ID NO: 2449770 - protein, 9 aa, Entamoeba dispar
NSNNNSNKL

SEQ ID NO: 2449771 - protein, 74 aa, Entamoeba dispar
NSNPIEKPTEEEKKIETNEKKNEINTIQGEKQEEEKKTEEKQVPEVKKEETKHEELPKTLGDPKSIPNKDEKIL

SEQ ID NO: 2449772 - protein, 13 aa, Entamoeba dispar
NSNPIKNPPQSAM

SEQ ID NO: 2449773 - protein, 8 aa, Entamoeba dispar
NSNPPPSF

SEQ ID NO: 2449774 - protein, 15 aa, Entamoeba dispar
NSNPQEIKHSPEKYV

SEQ ID NO: 2449775 - protein, 15 aa, Entamoeba dispar
NSNPSNRAGSKSYMA

SEQ ID NO: 2449776 - protein, 9 aa, Entamoeba dispar
NSNPTVEGR

SEQ ID NO: 2449777 - protein, 4 aa, Entamoeba dispar
NSNQ

SEQ ID NO: 2449778 - protein, 5 aa, Entamoeba dispar
NSNQE

SEQ ID NO: 2449779 - protein, 8 aa, Entamoeba dispar
NSNQQYDI

SEQ ID NO: 2449780 - protein, 10 aa, Entamoeba dispar
NSNSEAQSKY

SEQ ID NO: 2449781 - protein, 17 aa, Entamoeba dispar
NSNSSISNNQKPLPPLP

SEQ ID NO: 2449782 - protein, 10 aa, Entamoeba dispar
NSNSTSNEKE

SEQ ID NO: 2449783 - protein, 9 aa, Entamoeba dispar
NSNSVDHSQ

SEQ ID NO: 2449784 - protein, 7 aa, Entamoeba dispar
NSNTINK

SEQ ID NO: 2449785 - protein, 42 aa, Entamoeba dispar
NSNTISDIDRTPKESSHSTRRGSNQLLPPPSSTGIPIRQTPQ

SEQ ID NO: 2449786 - protein, 9 aa, Entamoeba dispar
NSNTNDEKV

SEQ ID NO: 2449787 - protein, 9 aa, Entamoeba dispar
NSNTPSSKI

SEQ ID NO: 2449788 - protein, 4 aa, Entamoeba dispar
NSNY

SEQ ID NO: 2449789 - protein, 7 aa, Entamoeba dispar
NSNYKNY

SEQ ID NO: 2449790 - protein, 11 aa, Entamoeba dispar
NSNYNEAMPQK

SEQ ID NO: 2449791 - protein, 14 aa, Entamoeba dispar
NSNYNEAMPQNNPD

SEQ ID NO: 2449792 - protein, 14 aa, Entamoeba dispar
NSNYNETISQNPDF

SEQ ID NO: 2449793 - protein, 14 aa, Entamoeba dispar
NSNYNETVSQNPDF

SEQ ID NO: 2449794 - protein, 8 aa, Entamoeba dispar
NSNYSYSA

SEQ ID NO: 2449795 - protein, 7 aa, Entamoeba dispar
NSPDDDS

SEQ ID NO: 2449796 - protein, 12 aa, Entamoeba dispar
NSPDFEKNKSSH

SEQ ID NO: 2449797 - protein, 6 aa, Entamoeba dispar
NSPDPF

SEQ ID NO: 2449798 - protein, 10 aa, Entamoeba dispar
NSPEEAKRNA

SEQ ID NO: 2449799 - protein, 11 aa, Entamoeba dispar
NSPELNKKNKK

SEQ ID NO: 2449800 - protein, 11 aa, Entamoeba dispar
NSPESVEENEI

SEQ ID NO: 2449801 - protein, 4 aa, Entamoeba dispar
NSPF

SEQ ID NO: 2449802 - protein, 10 aa, Entamoeba dispar
NSPFSPKPLK

SEQ ID NO: 2449803 - protein, 21 aa, Entamoeba dispar
NSPFSTQAEPRRDGGNEPEKI

SEQ ID NO: 2449804 - protein, 6 aa, Entamoeba dispar
NSPGIK

SEQ ID NO: 2449805 - protein, 7 aa, Entamoeba dispar
NSPIGQQ

SEQ ID NO: 2449806 - protein, 12 aa, Entamoeba dispar
NSPIMSDKDNEM

SEQ ID NO: 2449807 - protein, 13 aa, Entamoeba dispar
NSPIPNEKNIDGD

SEQ ID NO: 2449808 - protein, 23 aa, Entamoeba dispar
NSPIPNRLPTKQQEEKYVPPSPK

SEQ ID NO: 2449809 - protein, 9 aa, Entamoeba dispar
NSPIPSTKI

SEQ ID NO: 2449810 - protein, 8 aa, Entamoeba dispar
NSPISSDM

SEQ ID NO: 2449811 - protein, 4 aa, Entamoeba dispar
NSPK

SEQ ID NO: 2449812 - protein, 8 aa, Entamoeba dispar
NSPKGVTF

SEQ ID NO: 2449813 - protein, 7 aa, Entamoeba dispar
NSPLPSD

SEQ ID NO: 2449814 - protein, 6 aa, Entamoeba dispar
NSPLTT

SEQ ID NO: 2449815 - protein, 7 aa, Entamoeba dispar
NSPNFRT

SEQ ID NO: 2449816 - protein, 5 aa, Entamoeba dispar
NSPNP

SEQ ID NO: 2449817 - protein, 10 aa, Entamoeba dispar
NSPNPQKSYE

SEQ ID NO: 2449818 - protein, 8 aa, Entamoeba dispar
NSPPSLQE

SEQ ID NO: 2449819 - protein, 8 aa, Entamoeba dispar
NSPPYIKN

SEQ ID NO: 2449820 - protein, 9 aa, Entamoeba dispar
NSPQNEQTN

SEQ ID NO: 2449821 - protein, 7 aa, Entamoeba dispar
NSPQQPP

SEQ ID NO: 2449822 - protein, 6 aa, Entamoeba dispar
NSPQYQ

SEQ ID NO: 2449823 - protein, 12 aa, Entamoeba dispar
NSPRGRDVSELS

SEQ ID NO: 2449824 - protein, 7 aa, Entamoeba dispar
NSPRKAT

SEQ ID NO: 2449825 - protein, 24 aa, Entamoeba dispar
NSPRSSPKSSRTPRKNMTSKESNG

SEQ ID NO: 2449826 - protein, 8 aa, Entamoeba dispar
NSPSENPL

SEQ ID NO: 2449827 - protein, 7 aa, Entamoeba dispar
NSPSISH

SEQ ID NO: 2449828 - protein, 7 aa, Entamoeba dispar
NSPSNEI

SEQ ID NO: 2449829 - protein, 10 aa, Entamoeba dispar
NSPSNKYNEL

SEQ ID NO: 2449830 - protein, 8 aa, Entamoeba dispar
NSPSQINL

SEQ ID NO: 2449831 - protein, 4 aa, Entamoeba dispar
NSPT

SEQ ID NO: 2449832 - protein, 7 aa, Entamoeba dispar
NSPTHET

SEQ ID NO: 2449833 - protein, 13 aa, Entamoeba dispar
NSPTSTTQQSHKE

SEQ ID NO: 2449834 - protein, 7 aa, Entamoeba dispar
NSPTTSM

SEQ ID NO: 2449835 - protein, 7 aa, Entamoeba dispar
NSPYTGA

SEQ ID NO: 2449836 - protein, 11 aa, Entamoeba dispar
NSQAEEEYQEA

SEQ ID NO: 2449837 - protein, 6 aa, Entamoeba dispar
NSQAGV

SEQ ID NO: 2449838 - protein, 8 aa, Entamoeba dispar
NSQDLTSA

SEQ ID NO: 2449839 - protein, 7 aa, Entamoeba dispar
NSQEKAT

SEQ ID NO: 2449840 - protein, 7 aa, Entamoeba dispar
NSQGGDD

SEQ ID NO: 2449841 - protein, 16 aa, Entamoeba dispar
NSQGQSGFVPENFVEV

SEQ ID NO: 2449842 - protein, 5 aa, Entamoeba dispar
NSQGV

SEQ ID NO: 2449843 - protein, 7 aa, Entamoeba dispar
NSQITEV

SEQ ID NO: 2449844 - protein, 17 aa, Entamoeba dispar
NSQKNIEEKPKRKSLKL

SEQ ID NO: 2449845 - protein, 10 aa, Entamoeba dispar
NSQKQNTELQ

SEQ ID NO: 2449846 - protein, 14 aa, Entamoeba dispar
NSQLQQDTKSEEQM

SEQ ID NO: 2449847 - protein, 7 aa, Entamoeba dispar
NSQLSEV

SEQ ID NO: 2449848 - protein, 8 aa, Entamoeba dispar
NSQNGSCD

SEQ ID NO: 2449849 - protein, 10 aa, Entamoeba dispar
NSQPNISNNP

SEQ ID NO: 2449850 - protein, 8 aa, Entamoeba dispar
NSQQTKLD

SEQ ID NO: 2449851 - protein, 14 aa, Entamoeba dispar
NSQQYQSNYNSIPP

SEQ ID NO: 2449852 - protein, 8 aa, Entamoeba dispar
NSQREKIE

SEQ ID NO: 2449853 - protein, 5 aa, Entamoeba dispar
NSQRS

SEQ ID NO: 2449854 - protein, 6 aa, Entamoeba dispar
NSQRYN

SEQ ID NO: 2449855 - protein, 13 aa, Entamoeba dispar
NSQSKAPSQYGMK

SEQ ID NO: 2449856 - protein, 12 aa, Entamoeba dispar
NSQSNDSTHVTP

SEQ ID NO: 2449857 - protein, 7 aa, Entamoeba dispar
NSQTDPL

SEQ ID NO: 2449858 - protein, 8 aa, Entamoeba dispar
NSQTEVTD

SEQ ID NO: 2449859 - protein, 7 aa, Entamoeba dispar
NSQYFKE

SEQ ID NO: 2449860 - protein, 5 aa, Entamoeba dispar
NSQYS

SEQ ID NO: 2449861 - protein, 13 aa, Entamoeba dispar
NSREGTLTSPPIK

SEQ ID NO: 2449862 - protein, 10 aa, Entamoeba dispar
NSRGDYDDDV

SEQ ID NO: 2449863 - protein, 6 aa, Entamoeba dispar
NSRIQD

SEQ ID NO: 2449864 - protein, 5 aa, Entamoeba dispar
NSRPI

SEQ ID NO: 2449865 - protein, 9 aa, Entamoeba dispar
NSRPTQGIH

SEQ ID NO: 2449866 - protein, 5 aa, Entamoeba dispar
NSRVS

SEQ ID NO: 2449867 - protein, 7 aa, Entamoeba dispar
NSSAIPD

SEQ ID NO: 2449868 - protein, 7 aa, Entamoeba dispar
NSSAISR

SEQ ID NO: 2449869 - protein, 10 aa, Entamoeba dispar
NSSAQSINSH

SEQ ID NO: 2449870 - protein, 8 aa, Entamoeba dispar
NSSEEETV

SEQ ID NO: 2449871 - protein, 8 aa, Entamoeba dispar
NSSEEQHK

SEQ ID NO: 2449872 - protein, 15 aa, Entamoeba dispar
NSSEETEIEETNASI

SEQ ID NO: 2449873 - protein, 8 aa, Entamoeba dispar
NSSEFPMG

SEQ ID NO: 2449874 - protein, 5 aa, Entamoeba dispar
NSSEI

SEQ ID NO: 2449875 - protein, 5 aa, Entamoeba dispar
NSSES

SEQ ID NO: 2449876 - protein, 9 aa, Entamoeba dispar
NSSETNPEI

SEQ ID NO: 2449877 - protein, 11 aa, Entamoeba dispar
NSSFRSPRSVR

SEQ ID NO: 2449878 - protein, 7 aa, Entamoeba dispar
NSSGANI

SEQ ID NO: 2449879 - protein, 14 aa, Entamoeba dispar
NSSGEEQKGGVSVE

SEQ ID NO: 2449880 - protein, 9 aa, Entamoeba dispar
NSSGEIKSE

SEQ ID NO: 2449881 - protein, 7 aa, Entamoeba dispar
NSSHRYP

SEQ ID NO: 2449882 - protein, 13 aa, Entamoeba dispar
NSSHSSLSQNTDF

SEQ ID NO: 2449883 - protein, 9 aa, Entamoeba dispar
NSSHYKGQE

SEQ ID NO: 2449884 - protein, 7 aa, Entamoeba dispar
NSSIQEF

SEQ ID NO: 2449885 - protein, 5 aa, Entamoeba dispar
NSSIT

SEQ ID NO: 2449886 - protein, 9 aa, Entamoeba dispar
NSSITKPLT

SEQ ID NO: 2449887 - protein, 4 aa, Entamoeba dispar
NSSK

SEQ ID NO: 2449888 - protein, 7 aa, Entamoeba dispar
NSSKHDY

SEQ ID NO: 2449889 - protein, 9 aa, Entamoeba dispar
NSSKKEERF

SEQ ID NO: 2449890 - protein, 10 aa, Entamoeba dispar
NSSKRNQNNF

SEQ ID NO: 2449891 - protein, 17 aa, Entamoeba dispar
NSSKWNNIRKKGNQNVF

SEQ ID NO: 2449892 - protein, 8 aa, Entamoeba dispar
NSSLGTTK

SEQ ID NO: 2449893 - protein, 10 aa, Entamoeba dispar
NSSLIGEDRS

SEQ ID NO: 2449894 - protein, 7 aa, Entamoeba dispar
NSSLKVP

SEQ ID NO: 2449895 - protein, 5 aa, Entamoeba dispar
NSSLP

SEQ ID NO: 2449896 - protein, 6 aa, Entamoeba dispar
NSSLPL

SEQ ID NO: 2449897 - protein, 28 aa, Entamoeba dispar
NSSLPPSTDPAYKETPHSITNSSVSTSV

SEQ ID NO: 2449898 - protein, 17 aa, Entamoeba dispar
NSSLSRLASNFASFYQI

SEQ ID NO: 2449899 - protein, 6 aa, Entamoeba dispar
NSSLTD

SEQ ID NO: 2449900 - protein, 6 aa, Entamoeba dispar
NSSMAS

SEQ ID NO: 2449901 - protein, 6 aa, Entamoeba dispar
NSSNPE

SEQ ID NO: 2449902 - protein, 4 aa, Entamoeba dispar
NSSP

SEQ ID NO: 2449903 - protein, 5 aa, Entamoeba dispar
NSSPN

SEQ ID NO: 2449904 - protein, 5 aa, Entamoeba dispar
NSSPQ

SEQ ID NO: 2449905 - protein, 11 aa, Entamoeba dispar
NSSPTVEKERE

SEQ ID NO: 2449906 - protein, 4 aa, Entamoeba dispar
NSSQ

SEQ ID NO: 2449907 - protein, 9 aa, Entamoeba dispar
NSSQIQQPI

SEQ ID NO: 2449908 - protein, 6 aa, Entamoeba dispar
NSSQNV

SEQ ID NO: 2449909 - protein, 9 aa, Entamoeba dispar
NSSQREDKN

SEQ ID NO: 2449910 - protein, 11 aa, Entamoeba dispar
NSSRAKKNGLG

SEQ ID NO: 2449911 - protein, 6 aa, Entamoeba dispar
NSSRED

SEQ ID NO: 2449912 - protein, 9 aa, Entamoeba dispar
NSSSARRPY

SEQ ID NO: 2449913 - protein, 7 aa, Entamoeba dispar
NSSSDEI

SEQ ID NO: 2449914 - protein, 10 aa, Entamoeba dispar
NSSSLTNKEF

SEQ ID NO: 2449915 - protein, 6 aa, Entamoeba dispar
NSSSNL

SEQ ID NO: 2449916 - protein, 16 aa, Entamoeba dispar
NSSSQNQNVASYNMPS

SEQ ID NO: 2449917 - protein, 12 aa, Entamoeba dispar
NSSSSFNVSNQR

SEQ ID NO: 2449918 - protein, 5 aa, Entamoeba dispar
NSSST

SEQ ID NO: 2449919 - protein, 15 aa, Entamoeba dispar
NSSSVIKKREEMTGI

SEQ ID NO: 2449920 - protein, 4 aa, Entamoeba dispar
NSST

SEQ ID NO: 2449921 - protein, 13 aa, Entamoeba dispar
NSSTATNNQPLGS

SEQ ID NO: 2449922 - protein, 5 aa, Entamoeba dispar
NSSTE

SEQ ID NO: 2449923 - protein, 9 aa, Entamoeba dispar
NSSTNGPNV

SEQ ID NO: 2449924 - protein, 7 aa, Entamoeba dispar
NSSTPDL

SEQ ID NO: 2449925 - protein, 7 aa, Entamoeba dispar
NSSTQCN

SEQ ID NO: 2449926 - protein, 8 aa, Entamoeba dispar
NSSTQIYD

SEQ ID NO: 2449927 - protein, 26 aa, Entamoeba dispar
NSSTTGTQTNGNQPTTNDIQSSIQKE

SEQ ID NO: 2449928 - protein, 26 aa, Entamoeba dispar
NSSVEEYQRSKREERARERKEKREQI

SEQ ID NO: 2449929 - protein, 8 aa, Entamoeba dispar
NSSVGKKG

SEQ ID NO: 2449930 - protein, 8 aa, Entamoeba dispar
NSSVKRTT

SEQ ID NO: 2449931 - protein, 6 aa, Entamoeba dispar
NSSVPN

SEQ ID NO: 2449932 - protein, 9 aa, Entamoeba dispar
NSSYEEIKQ

SEQ ID NO: 2449933 - protein, 22 aa, Entamoeba dispar
NSSYTQSCSPPTPTQEYDGRNT

SEQ ID NO: 2449934 - protein, 7 aa, Entamoeba dispar
NSTDKHI

SEQ ID NO: 2449935 - protein, 11 aa, Entamoeba dispar
NSTDVKCSEIS

SEQ ID NO: 2449936 - protein, 9 aa, Entamoeba dispar
NSTEEERKQ

SEQ ID NO: 2449937 - protein, 10 aa, Entamoeba dispar
NSTFKRKTEE

SEQ ID NO: 2449938 - protein, 10 aa, Entamoeba dispar
NSTGSDILDK

SEQ ID NO: 2449939 - protein, 12 aa, Entamoeba dispar
NSTHSPRTYRSH

SEQ ID NO: 2449940 - protein, 5 aa, Entamoeba dispar
NSTID

SEQ ID NO: 2449941 - protein, 6 aa, Entamoeba dispar
NSTIQQ

SEQ ID NO: 2449942 - protein, 9 aa, Entamoeba dispar
NSTKQSTVE

SEQ ID NO: 2449943 - protein, 6 aa, Entamoeba dispar
NSTKVK

SEQ ID NO: 2449944 - protein, 4 aa, Entamoeba dispar
NSTL

SEQ ID NO: 2449945 - protein, 19 aa, Entamoeba dispar
NSTLKVPKGKLYESYVRTE

SEQ ID NO: 2449946 - protein, 8 aa, Entamoeba dispar
NSTLQSSN

SEQ ID NO: 2449947 - protein, 7 aa, Entamoeba dispar
NSTNCEP

SEQ ID NO: 2449948 - protein, 6 aa, Entamoeba dispar
NSTNIE

SEQ ID NO: 2449949 - protein, 7 aa, Entamoeba dispar
NSTNNLK

SEQ ID NO: 2449950 - protein, 16 aa, Entamoeba dispar
NSTNSEQQYFPEKYEN

SEQ ID NO: 2449951 - protein, 9 aa, Entamoeba dispar
NSTNSMTTI

SEQ ID NO: 2449952 - protein, 9 aa, Entamoeba dispar
NSTPPLDAP

SEQ ID NO: 2449953 - protein, 6 aa, Entamoeba dispar
NSTPVG

SEQ ID NO: 2449954 - protein, 7 aa, Entamoeba dispar
NSTPYSW

SEQ ID NO: 2449955 - protein, 4 aa, Entamoeba dispar
NSTR

SEQ ID NO: 2449956 - protein, 7 aa, Entamoeba dispar
NSTRKKR

SEQ ID NO: 2449957 - protein, 5 aa, Entamoeba dispar
NSTRV

SEQ ID NO: 2449958 - protein, 10 aa, Entamoeba dispar
NSTSEDAEKG

SEQ ID NO: 2449959 - protein, 8 aa, Entamoeba dispar
NSTSIQPS

SEQ ID NO: 2449960 - protein, 9 aa, Entamoeba dispar
NSTSITDTI

SEQ ID NO: 2449961 - protein, 6 aa, Entamoeba dispar
NSTSIV

SEQ ID NO: 2449962 - protein, 10 aa, Entamoeba dispar
NSTSKESNLK

SEQ ID NO: 2449963 - protein, 7 aa, Entamoeba dispar
NSTSNEW

SEQ ID NO: 2449964 - protein, 10 aa, Entamoeba dispar
NSTSPSPEGI

SEQ ID NO: 2449965 - protein, 16 aa, Entamoeba dispar
NSTSQPPKVSFPNGSI

SEQ ID NO: 2449966 - protein, 12 aa, Entamoeba dispar
NSTSSQKGGDQL

SEQ ID NO: 2449967 - protein, 6 aa, Entamoeba dispar
NSTTKN

SEQ ID NO: 2449968 - protein, 12 aa, Entamoeba dispar
NSTTNNSNENEK

SEQ ID NO: 2449969 - protein, 8 aa, Entamoeba dispar
NSTTTELS

SEQ ID NO: 2449970 - protein, 10 aa, Entamoeba dispar
NSTYDDESTN

SEQ ID NO: 2449971 - protein, 8 aa, Entamoeba dispar
NSVDEEKL

SEQ ID NO: 2449972 - protein, 8 aa, Entamoeba dispar
NSVDPNQR

SEQ ID NO: 2449973 - protein, 9 aa, Entamoeba dispar
NSVENIGDN

SEQ ID NO: 2449974 - protein, 13 aa, Entamoeba dispar
NSVEQKLNSPITQ

SEQ ID NO: 2449975 - protein, 13 aa, Entamoeba dispar
NSVIKSKKELTPK

SEQ ID NO: 2449976 - protein, 12 aa, Entamoeba dispar
NSVISYEKDSSL

SEQ ID NO: 2449977 - protein, 6 aa, Entamoeba dispar
NSVITE

SEQ ID NO: 2449978 - protein, 10 aa, Entamoeba dispar
NSVITPHSQP

SEQ ID NO: 2449979 - protein, 6 aa, Entamoeba dispar
NSVPDM

SEQ ID NO: 2449980 - protein, 9 aa, Entamoeba dispar
NSVQPTKEC

SEQ ID NO: 2449981 - protein, 8 aa, Entamoeba dispar
NSVRPTGD

SEQ ID NO: 2449982 - protein, 5 aa, Entamoeba dispar
NSVTE

SEQ ID NO: 2449983 - protein, 17 aa, Entamoeba dispar
NSVTKEGAGYFGEGDRS

SEQ ID NO: 2449984 - protein, 6 aa, Entamoeba dispar
NSVTNR

SEQ ID NO: 2449985 - protein, 5 aa, Entamoeba dispar
NSVTR

SEQ ID NO: 2449986 - protein, 4 aa, Entamoeba dispar
NSVY

SEQ ID NO: 2449987 - protein, 13 aa, Entamoeba dispar
NSYDIEAKRSGEK

SEQ ID NO: 2449988 - protein, 10 aa, Entamoeba dispar
NSYEDEIKNK

SEQ ID NO: 2449989 - protein, 7 aa, Entamoeba dispar
NSYERET

SEQ ID NO: 2449990 - protein, 20 aa, Entamoeba dispar
NSYFDPDNEPERANKPDIID

SEQ ID NO: 2449991 - protein, 41 aa, Entamoeba dispar
NSYFDPDNEPERANKPDIIDEEYNKTEESLFDDPDYEEYNK

SEQ ID NO: 2449992 - protein, 41 aa, Entamoeba dispar
NSYFDPDNEPERANKPDIIDEEYNKTEESLFDDPDYEEYNR

SEQ ID NO: 2449993 - protein, 41 aa, Entamoeba dispar
NSYFDPDNEPERANKPDIIDEEYNKTEESMFDDPDYEEYNK

SEQ ID NO: 2449994 - protein, 20 aa, Entamoeba dispar
NSYFDPDNEPERANKPDLID

SEQ ID NO: 2449995 - protein, 7 aa, Entamoeba dispar
NSYGETP

SEQ ID NO: 2449996 - protein, 5 aa, Entamoeba dispar
NSYGL

SEQ ID NO: 2449997 - protein, 4 aa, Entamoeba dispar
NSYI

SEQ ID NO: 2449998 - protein, 11 aa, Entamoeba dispar
NSYLPSSIGRT

SEQ ID NO: 2449999 - protein, 10 aa, Entamoeba dispar
NSYNVDPSFK

SEQ ID NO: 2450000 - protein, 10 aa, Entamoeba dispar
NSYTSRTGDI

SEQ ID NO: 2450001 - protein, 6 aa, Entamoeba dispar
NTADSV

SEQ ID NO: 2450002 - protein, 7 aa, Entamoeba dispar
NTAGYKD

SEQ ID NO: 2450003 - protein, 17 aa, Entamoeba dispar
NTAKNNQEEFTKTNEGI

SEQ ID NO: 2450004 - protein, 4 aa, Entamoeba dispar
NTAP

SEQ ID NO: 2450005 - protein, 9 aa, Entamoeba dispar
NTARDSRVN

SEQ ID NO: 2450006 - protein, 7 aa, Entamoeba dispar
NTCKDDS

SEQ ID NO: 2450007 - protein, 4 aa, Entamoeba dispar
NTCT

SEQ ID NO: 2450008 - protein, 11 aa, Entamoeba dispar
NTCTTETNSVD

SEQ ID NO: 2450009 - protein, 7 aa, Entamoeba dispar
NTDDDQL

SEQ ID NO: 2450010 - protein, 5 aa, Entamoeba dispar
NTDDS

SEQ ID NO: 2450011 - protein, 4 aa, Entamoeba dispar
NTDE

SEQ ID NO: 2450012 - protein, 6 aa, Entamoeba dispar
NTDECR

SEQ ID NO: 2450013 - protein, 6 aa, Entamoeba dispar
NTDEIV

SEQ ID NO: 2450014 - protein, 15 aa, Entamoeba dispar
NTDEKEKEATKIDEE

SEQ ID NO: 2450015 - protein, 11 aa, Entamoeba dispar
NTDGTKSDRTI

SEQ ID NO: 2450016 - protein, 5 aa, Entamoeba dispar
NTDGW

SEQ ID NO: 2450017 - protein, 6 aa, Entamoeba dispar
NTDHTQ

SEQ ID NO: 2450018 - protein, 6 aa, Entamoeba dispar
NTDIQI

SEQ ID NO: 2450019 - protein, 5 aa, Entamoeba dispar
NTDIT

SEQ ID NO: 2450020 - protein, 4 aa, Entamoeba dispar
NTDL

SEQ ID NO: 2450021 - protein, 12 aa, Entamoeba dispar
NTDNDRFDESKT

SEQ ID NO: 2450022 - protein, 5 aa, Entamoeba dispar
NTDNE

SEQ ID NO: 2450023 - protein, 17 aa, Entamoeba dispar
NTDNTTVSSCSLSGEDE

SEQ ID NO: 2450024 - protein, 12 aa, Entamoeba dispar
NTDPKDKLNEHK

SEQ ID NO: 2450025 - protein, 6 aa, Entamoeba dispar
NTDPTL

SEQ ID NO: 2450026 - protein, 7 aa, Entamoeba dispar
NTDTDNY

SEQ ID NO: 2450027 - protein, 11 aa, Entamoeba dispar
NTDTFSNDENI

SEQ ID NO: 2450028 - protein, 16 aa, Entamoeba dispar
NTDTSEHDYGIPTNAL

SEQ ID NO: 2450029 - protein, 9 aa, Entamoeba dispar
NTDTTAEAA

SEQ ID NO: 2450030 - protein, 8 aa, Entamoeba dispar
NTDVTHSQ

SEQ ID NO: 2450031 - protein, 9 aa, Entamoeba dispar
NTEAKDGYK

SEQ ID NO: 2450032 - protein, 7 aa, Entamoeba dispar
NTEDNKR

SEQ ID NO: 2450033 - protein, 17 aa, Entamoeba dispar
NTEDSSDIEDESEVDEI

SEQ ID NO: 2450034 - protein, 10 aa, Entamoeba dispar
NTEEDKEKKE

SEQ ID NO: 2450035 - protein, 5 aa, Entamoeba dispar
NTEEF

SEQ ID NO: 2450036 - protein, 15 aa, Entamoeba dispar
NTEEKSNENEIQQNN

SEQ ID NO: 2450037 - protein, 8 aa, Entamoeba dispar
NTEFSEKR

SEQ ID NO: 2450038 - protein, 15 aa, Entamoeba dispar
NTEGKINSDDEEVPK

SEQ ID NO: 2450039 - protein, 5 aa, Entamoeba dispar
NTEGP

SEQ ID NO: 2450040 - protein, 5 aa, Entamoeba dispar
NTEGR

SEQ ID NO: 2450041 - protein, 8 aa, Entamoeba dispar
NTEIEKQP

SEQ ID NO: 2450042 - protein, 12 aa, Entamoeba dispar
NTEKEEAKEEQE

SEQ ID NO: 2450043 - protein, 9 aa, Entamoeba dispar
NTEKIETPK

SEQ ID NO: 2450044 - protein, 13 aa, Entamoeba dispar
NTEKTPARSSSAF

SEQ ID NO: 2450045 - protein, 7 aa, Entamoeba dispar
NTENPMS

SEQ ID NO: 2450046 - protein, 9 aa, Entamoeba dispar
NTENQSYQE

SEQ ID NO: 2450047 - protein, 7 aa, Entamoeba dispar
NTEPQQM

SEQ ID NO: 2450048 - protein, 8 aa, Entamoeba dispar
NTEQATAV

SEQ ID NO: 2450049 - protein, 20 aa, Entamoeba dispar
NTEQKLKEEVSAKEKEFQEQ

SEQ ID NO: 2450050 - protein, 5 aa, Entamoeba dispar
NTEQL

SEQ ID NO: 2450051 - protein, 17 aa, Entamoeba dispar
NTEQRPSFEDILNILKQ

SEQ ID NO: 2450052 - protein, 34 aa, Entamoeba dispar
NTERDRTPSPPKQYNENQQEITREMRREEKLKNE

SEQ ID NO: 2450053 - protein, 6 aa, Entamoeba dispar
NTERIE

SEQ ID NO: 2450054 - protein, 6 aa, Entamoeba dispar
NTERYD

SEQ ID NO: 2450055 - protein, 5 aa, Entamoeba dispar
NTESI

SEQ ID NO: 2450056 - protein, 6 aa, Entamoeba dispar
NTESSV

SEQ ID NO: 2450057 - protein, 12 aa, Entamoeba dispar
NTETAKGITGCE

SEQ ID NO: 2450058 - protein, 8 aa, Entamoeba dispar
NTETKELT

SEQ ID NO: 2450059 - protein, 9 aa, Entamoeba dispar
NTETKKLAE

SEQ ID NO: 2450060 - protein, 12 aa, Entamoeba dispar
NTEVEQTSPIQD

SEQ ID NO: 2450061 - protein, 18 aa, Entamoeba dispar
NTFEPTEKITDQRKKEGV

SEQ ID NO: 2450062 - protein, 4 aa, Entamoeba dispar
NTFG

SEQ ID NO: 2450063 - protein, 5 aa, Entamoeba dispar
NTFKH

SEQ ID NO: 2450064 - protein, 18 aa, Entamoeba dispar
NTFNENKETSNSQNQIEE

SEQ ID NO: 2450065 - protein, 4 aa, Entamoeba dispar
NTGD

SEQ ID NO: 2450066 - protein, 7 aa, Entamoeba dispar
NTGETTN

SEQ ID NO: 2450067 - protein, 17 aa, Entamoeba dispar
NTGFGTNTTTGLGTTNS

SEQ ID NO: 2450068 - protein, 6 aa, Entamoeba dispar
NTGGLV

SEQ ID NO: 2450069 - protein, 4 aa, Entamoeba dispar
NTGH

SEQ ID NO: 2450070 - protein, 10 aa, Entamoeba dispar
NTGIKDITKP

SEQ ID NO: 2450071 - protein, 9 aa, Entamoeba dispar
NTGIKSKKT

SEQ ID NO: 2450072 - protein, 18 aa, Entamoeba dispar
NTGKEKNIKEINEKKEIT

SEQ ID NO: 2450073 - protein, 7 aa, Entamoeba dispar
NTGKKEI

SEQ ID NO: 2450074 - protein, 6 aa, Entamoeba dispar
NTGKLI

SEQ ID NO: 2450075 - protein, 4 aa, Entamoeba dispar
NTGL

SEQ ID NO: 2450076 - protein, 7 aa, Entamoeba dispar
NTGLDTS

SEQ ID NO: 2450077 - protein, 14 aa, Entamoeba dispar
NTGLGNSTTGNNNP

SEQ ID NO: 2450078 - protein, 8 aa, Entamoeba dispar
NTGLSSTD

SEQ ID NO: 2450079 - protein, 4 aa, Entamoeba dispar
NTGM

SEQ ID NO: 2450080 - protein, 7 aa, Entamoeba dispar
NTGNEKI

SEQ ID NO: 2450081 - protein, 7 aa, Entamoeba dispar
NTGNENI

SEQ ID NO: 2450082 - protein, 6 aa, Entamoeba dispar
NTGNQP

SEQ ID NO: 2450083 - protein, 10 aa, Entamoeba dispar
NTGPRHPDQP

SEQ ID NO: 2450084 - protein, 6 aa, Entamoeba dispar
NTGRAV

SEQ ID NO: 2450085 - protein, 10 aa, Entamoeba dispar
NTGSAQPKGV

SEQ ID NO: 2450086 - protein, 6 aa, Entamoeba dispar
NTGSII

SEQ ID NO: 2450087 - protein, 7 aa, Entamoeba dispar
NTGTFEG

SEQ ID NO: 2450088 - protein, 9 aa, Entamoeba dispar
NTGTIKEKV

SEQ ID NO: 2450089 - protein, 5 aa, Entamoeba dispar
NTGYT

SEQ ID NO: 2450090 - protein, 5 aa, Entamoeba dispar
NTHDP

SEQ ID NO: 2450091 - protein, 4 aa, Entamoeba dispar
NTHE

SEQ ID NO: 2450092 - protein, 9 aa, Entamoeba dispar
NTHKGDLEV

SEQ ID NO: 2450093 - protein, 5 aa, Entamoeba dispar
NTHNG

SEQ ID NO: 2450094 - protein, 6 aa, Entamoeba dispar
NTHSKT

SEQ ID NO: 2450095 - protein, 28 aa, Entamoeba dispar
NTIADQAKVNVNNQDDDEIYRSIFTSSQ

SEQ ID NO: 2450096 - protein, 6 aa, Entamoeba dispar
NTIDDD

SEQ ID NO: 2450097 - protein, 7 aa, Entamoeba dispar
NTIDESE

SEQ ID NO: 2450098 - protein, 7 aa, Entamoeba dispar
NTIDPEV

SEQ ID NO: 2450099 - protein, 7 aa, Entamoeba dispar
NTIDPTQ

SEQ ID NO: 2450100 - protein, 7 aa, Entamoeba dispar
NTIDVKG

SEQ ID NO: 2450101 - protein, 4 aa, Entamoeba dispar
NTIE

SEQ ID NO: 2450102 - protein, 6 aa, Entamoeba dispar
NTIEDL

SEQ ID NO: 2450103 - protein, 14 aa, Entamoeba dispar
NTIGSKFDGRNEDR

SEQ ID NO: 2450104 - protein, 11 aa, Entamoeba dispar
NTIKDKYKEGI

SEQ ID NO: 2450105 - protein, 19 aa, Entamoeba dispar
NTIKGIEKGELKEEKGRNE

SEQ ID NO: 2450106 - protein, 6 aa, Entamoeba dispar
NTIKTH

SEQ ID NO: 2450107 - protein, 10 aa, Entamoeba dispar
NTINEENKEI

SEQ ID NO: 2450108 - protein, 7 aa, Entamoeba dispar
NTINGKK

SEQ ID NO: 2450109 - protein, 10 aa, Entamoeba dispar
NTINNGEEVT

SEQ ID NO: 2450110 - protein, 7 aa, Entamoeba dispar
NTIPPEV

SEQ ID NO: 2450111 - protein, 8 aa, Entamoeba dispar
NTIPPEVK

SEQ ID NO: 2450112 - protein, 7 aa, Entamoeba dispar
NTIPSEV

SEQ ID NO: 2450113 - protein, 8 aa, Entamoeba dispar
NTIPYNDR

SEQ ID NO: 2450114 - protein, 7 aa, Entamoeba dispar
NTIQPGE

SEQ ID NO: 2450115 - protein, 9 aa, Entamoeba dispar
NTIQTPNTP

SEQ ID NO: 2450116 - protein, 6 aa, Entamoeba dispar
NTISGT

SEQ ID NO: 2450117 - protein, 11 aa, Entamoeba dispar
NTISHKGEGID

SEQ ID NO: 2450118 - protein, 11 aa, Entamoeba dispar
NTITEEGNDKY

SEQ ID NO: 2450119 - protein, 14 aa, Entamoeba dispar
NTITPSKISQETPA

SEQ ID NO: 2450120 - protein, 8 aa, Entamoeba dispar
NTITQSSQ

SEQ ID NO: 2450121 - protein, 20 aa, Entamoeba dispar
NTKDCKYNRCGRTDKGVSAF

SEQ ID NO: 2450122 - protein, 6 aa, Entamoeba dispar
NTKDVD

SEQ ID NO: 2450123 - protein, 31 aa, Entamoeba dispar
NTKEEEGNDKKENVNERKSIEINEKEVTQPI

SEQ ID NO: 2450124 - protein, 6 aa, Entamoeba dispar
NTKEEI

SEQ ID NO: 2450125 - protein, 6 aa, Entamoeba dispar
NTKEEV

SEQ ID NO: 2450126 - protein, 7 aa, Entamoeba dispar
NTKEQPE

SEQ ID NO: 2450127 - protein, 8 aa, Entamoeba dispar
NTKESDIE

SEQ ID NO: 2450128 - protein, 14 aa, Entamoeba dispar
NTKETKADSKSNNR

SEQ ID NO: 2450129 - protein, 9 aa, Entamoeba dispar
NTKFGDNAS

SEQ ID NO: 2450130 - protein, 13 aa, Entamoeba dispar
NTKGNGDQTISYN

SEQ ID NO: 2450131 - protein, 6 aa, Entamoeba dispar
NTKGYP

SEQ ID NO: 2450132 - protein, 19 aa, Entamoeba dispar
NTKKCPSCGDRIQKNGGCN

SEQ ID NO: 2450133 - protein, 11 aa, Entamoeba dispar
NTKKDIEIETD

SEQ ID NO: 2450134 - protein, 11 aa, Entamoeba dispar
NTKKENSAKLK

SEQ ID NO: 2450135 - protein, 26 aa, Entamoeba dispar
NTKKFDSKEFEKDCDKADKDSKEQFQ

SEQ ID NO: 2450136 - protein, 9 aa, Entamoeba dispar
NTKKIQKSI

SEQ ID NO: 2450137 - protein, 23 aa, Entamoeba dispar
NTKKKGYRNGDTSVPEAASLNKS

SEQ ID NO: 2450138 - protein, 7 aa, Entamoeba dispar
NTKKNEC

SEQ ID NO: 2450139 - protein, 7 aa, Entamoeba dispar
NTKKSGI

SEQ ID NO: 2450140 - protein, 24 aa, Entamoeba dispar
NTKPEKKESNQSTKTNHKTATKNE

SEQ ID NO: 2450141 - protein, 7 aa, Entamoeba dispar
NTKPGVP

SEQ ID NO: 2450142 - protein, 11 aa, Entamoeba dispar
NTKPIENNDNK

SEQ ID NO: 2450143 - protein, 9 aa, Entamoeba dispar
NTKQARKEV

SEQ ID NO: 2450144 - protein, 5 aa, Entamoeba dispar
NTKQY

SEQ ID NO: 2450145 - protein, 6 aa, Entamoeba dispar
NTKREQ

SEQ ID NO: 2450146 - protein, 5 aa, Entamoeba dispar
NTKRT

SEQ ID NO: 2450147 - protein, 6 aa, Entamoeba dispar
NTKSGF

SEQ ID NO: 2450148 - protein, 5 aa, Entamoeba dispar
NTKSN

SEQ ID NO: 2450149 - protein, 8 aa, Entamoeba dispar
NTKSSSVT

SEQ ID NO: 2450150 - protein, 22 aa, Entamoeba dispar
NTKSYKTLGTDGSSSVSVHRPS

SEQ ID NO: 2450151 - protein, 5 aa, Entamoeba dispar
NTKTI

SEQ ID NO: 2450152 - protein, 8 aa, Entamoeba dispar
NTKTNGCR

SEQ ID NO: 2450153 - protein, 8 aa, Entamoeba dispar
NTKTQRDW

SEQ ID NO: 2450154 - protein, 7 aa, Entamoeba dispar
NTKTSQI

SEQ ID NO: 2450155 - protein, 9 aa, Entamoeba dispar
NTKVNIDKD

SEQ ID NO: 2450156 - protein, 8 aa, Entamoeba dispar
NTKVSDDI

SEQ ID NO: 2450157 - protein, 7 aa, Entamoeba dispar
NTKYFSS

SEQ ID NO: 2450158 - protein, 9 aa, Entamoeba dispar
NTKYNDGTI

SEQ ID NO: 2450159 - protein, 5 aa, Entamoeba dispar
NTLCT

SEQ ID NO: 2450160 - protein, 17 aa, Entamoeba dispar
NTLKQKNEFRRGQSQAD

SEQ ID NO: 2450161 - protein, 7 aa, Entamoeba dispar
NTLKTEQ

SEQ ID NO: 2450162 - protein, 9 aa, Entamoeba dispar
NTLNAEKEE

SEQ ID NO: 2450163 - protein, 7 aa, Entamoeba dispar
NTLPEGI

SEQ ID NO: 2450164 - protein, 7 aa, Entamoeba dispar
NTLPKTI

SEQ ID NO: 2450165 - protein, 8 aa, Entamoeba dispar
NTLPPNAL

SEQ ID NO: 2450166 - protein, 6 aa, Entamoeba dispar
NTLRRQ

SEQ ID NO: 2450167 - protein, 17 aa, Entamoeba dispar
NTLSPSEAIQKENNNVW

SEQ ID NO: 2450168 - protein, 10 aa, Entamoeba dispar
NTLSSADKIK

SEQ ID NO: 2450169 - protein, 11 aa, Entamoeba dispar
NTLSSKTKATL

SEQ ID NO: 2450170 - protein, 11 aa, Entamoeba dispar
NTLTEEGNNKY

SEQ ID NO: 2450171 - protein, 6 aa, Entamoeba dispar
NTLYKK

SEQ ID NO: 2450172 - protein, 5 aa, Entamoeba dispar
NTLYP

SEQ ID NO: 2450173 - protein, 5 aa, Entamoeba dispar
NTMEK

SEQ ID NO: 2450174 - protein, 4 aa, Entamoeba dispar
NTMI

SEQ ID NO: 2450175 - protein, 8 aa, Entamoeba dispar
NTNCKSIK

SEQ ID NO: 2450176 - protein, 8 aa, Entamoeba dispar
NTNEEDLK

SEQ ID NO: 2450177 - protein, 7 aa, Entamoeba dispar
NTNETSK

SEQ ID NO: 2450178 - protein, 9 aa, Entamoeba dispar
NTNGNISNE

SEQ ID NO: 2450179 - protein, 10 aa, Entamoeba dispar
NTNKDGIYEG

SEQ ID NO: 2450180 - protein, 21 aa, Entamoeba dispar
NTNKDIEIETDKKYVIIRNIH

SEQ ID NO: 2450181 - protein, 19 aa, Entamoeba dispar
NTNKDIEIETDKTHIIIRN

SEQ ID NO: 2450182 - protein, 4 aa, Entamoeba dispar
NTNL

SEQ ID NO: 2450183 - protein, 4 aa, Entamoeba dispar
NTNN

SEQ ID NO: 2450184 - protein, 5 aa, Entamoeba dispar
NTNNE

SEQ ID NO: 2450185 - protein, 9 aa, Entamoeba dispar
NTNNNGWNT

SEQ ID NO: 2450186 - protein, 7 aa, Entamoeba dispar
NTNNSQS

SEQ ID NO: 2450187 - protein, 29 aa, Entamoeba dispar
NTNNTSTPNILSSSTQNSEGEIKKKVQRD

SEQ ID NO: 2450188 - protein, 5 aa, Entamoeba dispar
NTNPE

SEQ ID NO: 2450189 - protein, 33 aa, Entamoeba dispar
NTNPFVSDTPPSTSNNPFSEQSSSLTNNTNPFI

SEQ ID NO: 2450190 - protein, 23 aa, Entamoeba dispar
NTNPKKGSISSKPLIPTRRTFVC

SEQ ID NO: 2450191 - protein, 7 aa, Entamoeba dispar
NTNPLTD

SEQ ID NO: 2450192 - protein, 7 aa, Entamoeba dispar
NTNSIAN

SEQ ID NO: 2450193 - protein, 14 aa, Entamoeba dispar
NTNSKEEDYDAFEK

SEQ ID NO: 2450194 - protein, 20 aa, Entamoeba dispar
NTNSPISSNKQIEDNKLSSG

SEQ ID NO: 2450195 - protein, 7 aa, Entamoeba dispar
NTNSPYY

SEQ ID NO: 2450196 - protein, 14 aa, Entamoeba dispar
NTNSRYTTKSASAM

SEQ ID NO: 2450197 - protein, 24 aa, Entamoeba dispar
NTNSSSSEKDQSETHSESKESSVQ

SEQ ID NO: 2450198 - protein, 11 aa, Entamoeba dispar
NTNTPTTKNER

SEQ ID NO: 2450199 - protein, 6 aa, Entamoeba dispar
NTNTRL

SEQ ID NO: 2450200 - protein, 11 aa, Entamoeba dispar
NTNTSTSQQYK

SEQ ID NO: 2450201 - protein, 7 aa, Entamoeba dispar
NTNYPRN

SEQ ID NO: 2450202 - protein, 7 aa, Entamoeba dispar
NTNYSQQ

SEQ ID NO: 2450203 - protein, 5 aa, Entamoeba dispar
NTNYV

SEQ ID NO: 2450204 - protein, 13 aa, Entamoeba dispar
NTPDNLRKINGKK

SEQ ID NO: 2450205 - protein, 26 aa, Entamoeba dispar
NTPEAMEKGKPSKIKVERSGKPKWSK

SEQ ID NO: 2450206 - protein, 6 aa, Entamoeba dispar
NTPELD

SEQ ID NO: 2450207 - protein, 6 aa, Entamoeba dispar
NTPEQL

SEQ ID NO: 2450208 - protein, 8 aa, Entamoeba dispar
NTPESCSP

SEQ ID NO: 2450209 - protein, 4 aa, Entamoeba dispar
NTPF

SEQ ID NO: 2450210 - protein, 5 aa, Entamoeba dispar
NTPFE

SEQ ID NO: 2450211 - protein, 7 aa, Entamoeba dispar
NTPGEES

SEQ ID NO: 2450212 - protein, 5 aa, Entamoeba dispar
NTPGM

SEQ ID NO: 2450213 - protein, 20 aa, Entamoeba dispar
NTPISKQDYISSEKENKCQP

SEQ ID NO: 2450214 - protein, 16 aa, Entamoeba dispar
NTPKIKKLSKTQNVWP

SEQ ID NO: 2450215 - protein, 6 aa, Entamoeba dispar
NTPKIN

SEQ ID NO: 2450216 - protein, 8 aa, Entamoeba dispar
NTPKPDYN

SEQ ID NO: 2450217 - protein, 6 aa, Entamoeba dispar
NTPKVV

SEQ ID NO: 2450218 - protein, 6 aa, Entamoeba dispar
NTPLGN

SEQ ID NO: 2450219 - protein, 5 aa, Entamoeba dispar
NTPLT

SEQ ID NO: 2450220 - protein, 24 aa, Entamoeba dispar
NTPLTNPEINGRRKRKNNHAGNDA

SEQ ID NO: 2450221 - protein, 6 aa, Entamoeba dispar
NTPNFP

SEQ ID NO: 2450222 - protein, 6 aa, Entamoeba dispar
NTPNIT

SEQ ID NO: 2450223 - protein, 9 aa, Entamoeba dispar
NTPNKRPRF

SEQ ID NO: 2450224 - protein, 5 aa, Entamoeba dispar
NTPNL

SEQ ID NO: 2450225 - protein, 7 aa, Entamoeba dispar
NTPNSTP

SEQ ID NO: 2450226 - protein, 7 aa, Entamoeba dispar
NTPNTKT

SEQ ID NO: 2450227 - protein, 14 aa, Entamoeba dispar
NTPNTLSPAQPEAF

SEQ ID NO: 2450228 - protein, 15 aa, Entamoeba dispar
NTPPIESPGKTPPID

SEQ ID NO: 2450229 - protein, 6 aa, Entamoeba dispar
NTPPSK

SEQ ID NO: 2450230 - protein, 6 aa, Entamoeba dispar
NTPQPN

SEQ ID NO: 2450231 - protein, 6 aa, Entamoeba dispar
NTPQQL

SEQ ID NO: 2450232 - protein, 6 aa, Entamoeba dispar
NTPQSS

SEQ ID NO: 2450233 - protein, 6 aa, Entamoeba dispar
NTPRIQ

SEQ ID NO: 2450234 - protein, 6 aa, Entamoeba dispar
NTPRTL

SEQ ID NO: 2450235 - protein, 14 aa, Entamoeba dispar
NTPSFGKEDPKKFL

SEQ ID NO: 2450236 - protein, 10 aa, Entamoeba dispar
NTPSKAEFAE

SEQ ID NO: 2450237 - protein, 11 aa, Entamoeba dispar
NTPSKKRHAQG

SEQ ID NO: 2450238 - protein, 9 aa, Entamoeba dispar
NTPSNTAKF

SEQ ID NO: 2450239 - protein, 10 aa, Entamoeba dispar
NTPSSQGGIG

SEQ ID NO: 2450240 - protein, 9 aa, Entamoeba dispar
NTPTPINEI

SEQ ID NO: 2450241 - protein, 5 aa, Entamoeba dispar
NTPTT

SEQ ID NO: 2450242 - protein, 6 aa, Entamoeba dispar
NTPTTK

SEQ ID NO: 2450243 - protein, 6 aa, Entamoeba dispar
NTPTVE

SEQ ID NO: 2450244 - protein, 10 aa, Entamoeba dispar
NTPVPSKETI

SEQ ID NO: 2450245 - protein, 4 aa, Entamoeba dispar
NTQD

SEQ ID NO: 2450246 - protein, 7 aa, Entamoeba dispar
NTQDKNT

SEQ ID NO: 2450247 - protein, 10 aa, Entamoeba dispar
NTQDKTRTSD

SEQ ID NO: 2450248 - protein, 11 aa, Entamoeba dispar
NTQDKYTKEAL

SEQ ID NO: 2450249 - protein, 7 aa, Entamoeba dispar
NTQDQNI

SEQ ID NO: 2450250 - protein, 17 aa, Entamoeba dispar
NTQDSSDIEDESEVDEI

SEQ ID NO: 2450251 - protein, 28 aa, Entamoeba dispar
NTQEAVNGEPKNEHEESLVKGQKEEPID

SEQ ID NO: 2450252 - protein, 4 aa, Entamoeba dispar
NTQG

SEQ ID NO: 2450253 - protein, 6 aa, Entamoeba dispar
NTQGTL

SEQ ID NO: 2450254 - protein, 7 aa, Entamoeba dispar
NTQKKQR

SEQ ID NO: 2450255 - protein, 7 aa, Entamoeba dispar
NTQLNED

SEQ ID NO: 2450256 - protein, 7 aa, Entamoeba dispar
NTQLQTN

SEQ ID NO: 2450257 - protein, 5 aa, Entamoeba dispar
NTQPI

SEQ ID NO: 2450258 - protein, 7 aa, Entamoeba dispar
NTQQGRT

SEQ ID NO: 2450259 - protein, 8 aa, Entamoeba dispar
NTQQGTQS

SEQ ID NO: 2450260 - protein, 11 aa, Entamoeba dispar
NTQQVQFSPSQ

SEQ ID NO: 2450261 - protein, 5 aa, Entamoeba dispar
NTQRK

SEQ ID NO: 2450262 - protein, 10 aa, Entamoeba dispar
NTQSKKVKTM

SEQ ID NO: 2450263 - protein, 7 aa, Entamoeba dispar
NTQSLSD

SEQ ID NO: 2450264 - protein, 16 aa, Entamoeba dispar
NTQSSKPEQQTQNEIK

SEQ ID NO: 2450265 - protein, 13 aa, Entamoeba dispar
NTQTHQKEECCSS

SEQ ID NO: 2450266 - protein, 9 aa, Entamoeba dispar
NTQTPTDDF

SEQ ID NO: 2450267 - protein, 7 aa, Entamoeba dispar
NTQTTSW

SEQ ID NO: 2450268 - protein, 6 aa, Entamoeba dispar
NTRAKQ

SEQ ID NO: 2450269 - protein, 10 aa, Entamoeba dispar
NTRGSKSYEY

SEQ ID NO: 2450270 - protein, 8 aa, Entamoeba dispar
NTRHPKIA

SEQ ID NO: 2450271 - protein, 12 aa, Entamoeba dispar
NTRKASSAGSAA

SEQ ID NO: 2450272 - protein, 10 aa, Entamoeba dispar
NTRKPNPNGV

SEQ ID NO: 2450273 - protein, 13 aa, Entamoeba dispar
NTRPKKQQRQLPP

SEQ ID NO: 2450274 - protein, 6 aa, Entamoeba dispar
NTRPSF

SEQ ID NO: 2450275 - protein, 5 aa, Entamoeba dispar
NTRTM

SEQ ID NO: 2450276 - protein, 8 aa, Entamoeba dispar
NTRTPIEV

SEQ ID NO: 2450277 - protein, 11 aa, Entamoeba dispar
NTSCEDESIED

SEQ ID NO: 2450278 - protein, 21 aa, Entamoeba dispar
NTSDPKNSSPDKSCSLTQNKR

SEQ ID NO: 2450279 - protein, 4 aa, Entamoeba dispar
NTSE

SEQ ID NO: 2450280 - protein, 6 aa, Entamoeba dispar
NTSEYE

SEQ ID NO: 2450281 - protein, 5 aa, Entamoeba dispar
NTSFY

SEQ ID NO: 2450282 - protein, 14 aa, Entamoeba dispar
NTSGKVKDDEERRD

SEQ ID NO: 2450283 - protein, 6 aa, Entamoeba dispar
NTSGTI

SEQ ID NO: 2450284 - protein, 8 aa, Entamoeba dispar
NTSHGGTH

SEQ ID NO: 2450285 - protein, 9 aa, Entamoeba dispar
NTSHPDFDT

SEQ ID NO: 2450286 - protein, 9 aa, Entamoeba dispar
NTSIDREAI

SEQ ID NO: 2450287 - protein, 6 aa, Entamoeba dispar
NTSIEK

SEQ ID NO: 2450288 - protein, 18 aa, Entamoeba dispar
NTSINGPQIADSGRSKLI

SEQ ID NO: 2450289 - protein, 7 aa, Entamoeba dispar
NTSISRT

SEQ ID NO: 2450290 - protein, 15 aa, Entamoeba dispar
NTSKEKTTTTTSKNC

SEQ ID NO: 2450291 - protein, 8 aa, Entamoeba dispar
NTSKLQQQ

SEQ ID NO: 2450292 - protein, 19 aa, Entamoeba dispar
NTSKQSSNPSVSLRRTKSM

SEQ ID NO: 2450293 - protein, 4 aa, Entamoeba dispar
NTSL

SEQ ID NO: 2450294 - protein, 9 aa, Entamoeba dispar
NTSLDDGSV

SEQ ID NO: 2450295 - protein, 6 aa, Entamoeba dispar
NTSLPF

SEQ ID NO: 2450296 - protein, 10 aa, Entamoeba dispar
NTSLTDEQKA

SEQ ID NO: 2450297 - protein, 6 aa, Entamoeba dispar
NTSLTS

SEQ ID NO: 2450298 - protein, 55 aa, Entamoeba dispar
NTSNDQSKPTTVNSDNNKSDNSTTAPTLNTNQSKTTTTTKSSEQSKTNNNTFATT

SEQ ID NO: 2450299 - protein, 10 aa, Entamoeba dispar
NTSNLKAVSS

SEQ ID NO: 2450300 - protein, 8 aa, Entamoeba dispar
NTSNMPVA

SEQ ID NO: 2450301 - protein, 7 aa, Entamoeba dispar
NTSPETC

SEQ ID NO: 2450302 - protein, 41 aa, Entamoeba dispar
NTSPNESQSEKEGSPIKTQISTNDNNSQEEIINKSGEEELL

SEQ ID NO: 2450303 - protein, 27 aa, Entamoeba dispar
NTSPSNSPSFSSSQKKSSTTSTVDSND

SEQ ID NO: 2450304 - protein, 8 aa, Entamoeba dispar
NTSPTASV

SEQ ID NO: 2450305 - protein, 8 aa, Entamoeba dispar
NTSPTMKS

SEQ ID NO: 2450306 - protein, 28 aa, Entamoeba dispar
NTSQPEDSTLNSSTNSNQENQNEISEQH

SEQ ID NO: 2450307 - protein, 6 aa, Entamoeba dispar
NTSREI

SEQ ID NO: 2450308 - protein, 5 aa, Entamoeba dispar
NTSRN

SEQ ID NO: 2450309 - protein, 6 aa, Entamoeba dispar
NTSRTM

SEQ ID NO: 2450310 - protein, 8 aa, Entamoeba dispar
NTSSFHPE

SEQ ID NO: 2450311 - protein, 6 aa, Entamoeba dispar
NTSSFT

SEQ ID NO: 2450312 - protein, 12 aa, Entamoeba dispar
NTSSGADAPVDV

SEQ ID NO: 2450313 - protein, 6 aa, Entamoeba dispar
NTSSID

SEQ ID NO: 2450314 - protein, 12 aa, Entamoeba dispar
NTSSINEKDDIP

SEQ ID NO: 2450315 - protein, 20 aa, Entamoeba dispar
NTSSLSSDLPISSDVIQYLM

SEQ ID NO: 2450316 - protein, 7 aa, Entamoeba dispar
NTSSNTC

SEQ ID NO: 2450317 - protein, 9 aa, Entamoeba dispar
NTSSSNSQF

SEQ ID NO: 2450318 - protein, 9 aa, Entamoeba dispar
NTSSTSQEI

SEQ ID NO: 2450319 - protein, 7 aa, Entamoeba dispar
NTSTERL

SEQ ID NO: 2450320 - protein, 5 aa, Entamoeba dispar
NTSTL

SEQ ID NO: 2450321 - protein, 8 aa, Entamoeba dispar
NTSTNDAS

SEQ ID NO: 2450322 - protein, 5 aa, Entamoeba dispar
NTSYD

SEQ ID NO: 2450323 - protein, 8 aa, Entamoeba dispar
NTSYHGKD

SEQ ID NO: 2450324 - protein, 14 aa, Entamoeba dispar
NTSYQQDNLDTKTQ

SEQ ID NO: 2450325 - protein, 9 aa, Entamoeba dispar
NTTEENKEI

SEQ ID NO: 2450326 - protein, 12 aa, Entamoeba dispar
NTTEKNEIPNGV

SEQ ID NO: 2450327 - protein, 4 aa, Entamoeba dispar
NTTG

SEQ ID NO: 2450328 - protein, 7 aa, Entamoeba dispar
NTTGGYE

SEQ ID NO: 2450329 - protein, 6 aa, Entamoeba dispar
NTTHEI

SEQ ID NO: 2450330 - protein, 7 aa, Entamoeba dispar
NTTHVQG

SEQ ID NO: 2450331 - protein, 11 aa, Entamoeba dispar
NTTIDKSSFTV

SEQ ID NO: 2450332 - protein, 7 aa, Entamoeba dispar
NTTIPKE

SEQ ID NO: 2450333 - protein, 140 aa, Entamoeba dispar
NTTITNNATGTVHPPPPPPGASSIPPPPPPPGASSIPPPPPPPGMPGMPPPPPPGMPGMPPPPPPGMPGMPPPPPPPGMPGMPPPPPGMPGMPPPPPGMPGMPPPPPGMPGMPPPPPGMPGMPPPPPGMPGMPPPPPGGF

SEQ ID NO: 2450334 - protein, 9 aa, Entamoeba dispar
NTTKARAKK

SEQ ID NO: 2450335 - protein, 10 aa, Entamoeba dispar
NTTKKYGKNY

SEQ ID NO: 2450336 - protein, 33 aa, Entamoeba dispar
NTTKSKSLSPNIQQTSGDSFWKGTKDSFDFNGQ

SEQ ID NO: 2450337 - protein, 8 aa, Entamoeba dispar
NTTLPPKE

SEQ ID NO: 2450338 - protein, 6 aa, Entamoeba dispar
NTTLSA

SEQ ID NO: 2450339 - protein, 6 aa, Entamoeba dispar
NTTLTE

SEQ ID NO: 2450340 - protein, 4 aa, Entamoeba dispar
NTTM

SEQ ID NO: 2450341 - protein, 5 aa, Entamoeba dispar
NTTND

SEQ ID NO: 2450342 - protein, 10 aa, Entamoeba dispar
NTTNSPQQMM

SEQ ID NO: 2450343 - protein, 4 aa, Entamoeba dispar
NTTP

SEQ ID NO: 2450344 - protein, 19 aa, Entamoeba dispar
NTTPKQAQNELKQYQTEHK

SEQ ID NO: 2450345 - protein, 12 aa, Entamoeba dispar
NTTPSAEKEKIE

SEQ ID NO: 2450346 - protein, 7 aa, Entamoeba dispar
NTTQHPE

SEQ ID NO: 2450347 - protein, 14 aa, Entamoeba dispar
NTTQQLPSLSSSGL

SEQ ID NO: 2450348 - protein, 7 aa, Entamoeba dispar
NTTSKQH

SEQ ID NO: 2450349 - protein, 23 aa, Entamoeba dispar
NTTTHNTSSNNTTTVPRKNVPIE

SEQ ID NO: 2450350 - protein, 24 aa, Entamoeba dispar
NTTTHNTSSNNTTTVSRKNVPIKG

SEQ ID NO: 2450351 - protein, 6 aa, Entamoeba dispar
NTTTKE

SEQ ID NO: 2450352 - protein, 6 aa, Entamoeba dispar
NTTTKP

SEQ ID NO: 2450353 - protein, 11 aa, Entamoeba dispar
NTTTPAQLQTV

SEQ ID NO: 2450354 - protein, 6 aa, Entamoeba dispar
NTTTPL

SEQ ID NO: 2450355 - protein, 9 aa, Entamoeba dispar
NTTTSNPHR

SEQ ID NO: 2450356 - protein, 8 aa, Entamoeba dispar
NTTVSPDE

SEQ ID NO: 2450357 - protein, 10 aa, Entamoeba dispar
NTTYDQSSIA

SEQ ID NO: 2450358 - protein, 14 aa, Entamoeba dispar
NTVIDGSSLKNGTT

SEQ ID NO: 2450359 - protein, 11 aa, Entamoeba dispar
NTVKSNDDYAK

SEQ ID NO: 2450360 - protein, 9 aa, Entamoeba dispar
NTVNPSCST

SEQ ID NO: 2450361 - protein, 4 aa, Entamoeba dispar
NTVR

SEQ ID NO: 2450362 - protein, 5 aa, Entamoeba dispar
NTVRG

SEQ ID NO: 2450363 - protein, 8 aa, Entamoeba dispar
NTWNSGNE

SEQ ID NO: 2450364 - protein, 4 aa, Entamoeba dispar
NTYC

SEQ ID NO: 2450365 - protein, 8 aa, Entamoeba dispar
NTYDSPDR

SEQ ID NO: 2450366 - protein, 9 aa, Entamoeba dispar
NTYGIKDGS

SEQ ID NO: 2450367 - protein, 6 aa, Entamoeba dispar
NTYLKD

SEQ ID NO: 2450368 - protein, 4 aa, Entamoeba dispar
NTYN

SEQ ID NO: 2450369 - protein, 15 aa, Entamoeba dispar
NTYNGDAYLMIWNSV

SEQ ID NO: 2450370 - protein, 9 aa, Entamoeba dispar
NTYSDSKHI

SEQ ID NO: 2450371 - protein, 8 aa, Entamoeba dispar
NVASGDAV

SEQ ID NO: 2450372 - protein, 14 aa, Entamoeba dispar
NVCDELRDKKKELV

SEQ ID NO: 2450373 - protein, 10 aa, Entamoeba dispar
NVDDPKLKAA

SEQ ID NO: 2450374 - protein, 7 aa, Entamoeba dispar
NVDGQNH

SEQ ID NO: 2450375 - protein, 5 aa, Entamoeba dispar
NVDLG

SEQ ID NO: 2450376 - protein, 10 aa, Entamoeba dispar
NVDNNNTLSE

SEQ ID NO: 2450377 - protein, 19 aa, Entamoeba dispar
NVDNRLSPKETLKILFQSQ

SEQ ID NO: 2450378 - protein, 7 aa, Entamoeba dispar
NVDSETI

SEQ ID NO: 2450379 - protein, 9 aa, Entamoeba dispar
NVDSNGLQI

SEQ ID NO: 2450380 - protein, 16 aa, Entamoeba dispar
NVDSSSSNLSRTRTPL

SEQ ID NO: 2450381 - protein, 7 aa, Entamoeba dispar
NVDTNDD

SEQ ID NO: 2450382 - protein, 10 aa, Entamoeba dispar
NVDTQPYPFT

SEQ ID NO: 2450383 - protein, 8 aa, Entamoeba dispar
NVEEGTIS

SEQ ID NO: 2450384 - protein, 9 aa, Entamoeba dispar
NVEENADEG

SEQ ID NO: 2450385 - protein, 5 aa, Entamoeba dispar
NVEEQ

SEQ ID NO: 2450386 - protein, 29 aa, Entamoeba dispar
NVEKSKSPSGRRSTGRKEKLKNQKKVESM

SEQ ID NO: 2450387 - protein, 5 aa, Entamoeba dispar
NVENK

SEQ ID NO: 2450388 - protein, 7 aa, Entamoeba dispar
NVEPSLR

SEQ ID NO: 2450389 - protein, 102 aa, Entamoeba dispar
NVETTEELKENLPTENTKNNNNNEGEEHKSDENVKEEEKHKREESVKEEVKEESAEELFPSEDEDIKDEFSDEETPFEQSAKKTNLKEAKIKAEAAEEMQTN

SEQ ID NO: 2450390 - protein, 6 aa, Entamoeba dispar
NVFGGY

SEQ ID NO: 2450391 - protein, 5 aa, Entamoeba dispar
NVFGS

SEQ ID NO: 2450392 - protein, 5 aa, Entamoeba dispar
NVGDF

SEQ ID NO: 2450393 - protein, 5 aa, Entamoeba dispar
NVGDT

SEQ ID NO: 2450394 - protein, 65 aa, Entamoeba dispar
NVGGSQPSSLNTTQNLNNSIQSNTSPQQSTLQQSNQIISSSQETSTQSPLLDKPQNQAPKPQKKA

SEQ ID NO: 2450395 - protein, 5 aa, Entamoeba dispar
NVGSG

SEQ ID NO: 2450396 - protein, 10 aa, Entamoeba dispar
NVGTPKPTSI

SEQ ID NO: 2450397 - protein, 4 aa, Entamoeba dispar
NVHG

SEQ ID NO: 2450398 - protein, 4 aa, Entamoeba dispar
NVIE

SEQ ID NO: 2450399 - protein, 5 aa, Entamoeba dispar
NVIST

SEQ ID NO: 2450400 - protein, 14 aa, Entamoeba dispar
NVITGSVDGSIRSS

SEQ ID NO: 2450401 - protein, 16 aa, Entamoeba dispar
NVKDEKKPKEIHRDGK

SEQ ID NO: 2450402 - protein, 16 aa, Entamoeba dispar
NVKEENKDDSEEEQEF

SEQ ID NO: 2450403 - protein, 5 aa, Entamoeba dispar
NVKNI

SEQ ID NO: 2450404 - protein, 26 aa, Entamoeba dispar
NVKPNEKEGVGIKEEEEENGTVIEIA

SEQ ID NO: 2450405 - protein, 28 aa, Entamoeba dispar
NVKPSSQTKTVTITENTTTTITPDNNIP

SEQ ID NO: 2450406 - protein, 8 aa, Entamoeba dispar
NVKQKTAL

SEQ ID NO: 2450407 - protein, 5 aa, Entamoeba dispar
NVKQS

SEQ ID NO: 2450408 - protein, 22 aa, Entamoeba dispar
NVLKPKGRKSTTKQKSDRHEEI

SEQ ID NO: 2450409 - protein, 6 aa, Entamoeba dispar
NVLQKD

SEQ ID NO: 2450410 - protein, 7 aa, Entamoeba dispar
NVMEEEE

SEQ ID NO: 2450411 - protein, 8 aa, Entamoeba dispar
NVNDTDQQ

SEQ ID NO: 2450412 - protein, 4 aa, Entamoeba dispar
NVNE

SEQ ID NO: 2450413 - protein, 7 aa, Entamoeba dispar
NVNEEDL

SEQ ID NO: 2450414 - protein, 12 aa, Entamoeba dispar
NVNENDLKKAYR

SEQ ID NO: 2450415 - protein, 9 aa, Entamoeba dispar
NVNGSPKHH

SEQ ID NO: 2450416 - protein, 11 aa, Entamoeba dispar
NVNIQNNKGIT

SEQ ID NO: 2450417 - protein, 6 aa, Entamoeba dispar
NVNKQR

SEQ ID NO: 2450418 - protein, 5 aa, Entamoeba dispar
NVNQQ

SEQ ID NO: 2450419 - protein, 6 aa, Entamoeba dispar
NVPEEA

SEQ ID NO: 2450420 - protein, 5 aa, Entamoeba dispar
NVPEG

SEQ ID NO: 2450421 - protein, 12 aa, Entamoeba dispar
NVPGAGFGGETN

SEQ ID NO: 2450422 - protein, 5 aa, Entamoeba dispar
NVPHN

SEQ ID NO: 2450423 - protein, 4 aa, Entamoeba dispar
NVPI

SEQ ID NO: 2450424 - protein, 6 aa, Entamoeba dispar
NVPKVA

SEQ ID NO: 2450425 - protein, 126 aa, Entamoeba dispar
NVPPPPPPASYGVPPPPPPASYGVPPPPPPASYGVPPPPPPASYGVPPPPPPASYGVPPPPPPARGTSSGAPPPLNAPPPPPPLNAPPPPPPPARGTSSGAPPPPPPSLNNPPSNISTPKVSAPSL

SEQ ID NO: 2450426 - protein, 8 aa, Entamoeba dispar
NVPSDDGD

SEQ ID NO: 2450427 - protein, 9 aa, Entamoeba dispar
NVPSSIKTL

SEQ ID NO: 2450428 - protein, 8 aa, Entamoeba dispar
NVPSSISE

SEQ ID NO: 2450429 - protein, 6 aa, Entamoeba dispar
NVPTDD

SEQ ID NO: 2450430 - protein, 5 aa, Entamoeba dispar
NVPTI

SEQ ID NO: 2450431 - protein, 8 aa, Entamoeba dispar
NVPTQCSQ

SEQ ID NO: 2450432 - protein, 8 aa, Entamoeba dispar
NVPTSVKK

SEQ ID NO: 2450433 - protein, 14 aa, Entamoeba dispar
NVPTTFDTYDNPKG

SEQ ID NO: 2450434 - protein, 4 aa, Entamoeba dispar
NVQK

SEQ ID NO: 2450435 - protein, 18 aa, Entamoeba dispar
NVQPTEETINKTYTESGY

SEQ ID NO: 2450436 - protein, 18 aa, Entamoeba dispar
NVQPTEETISKTYTESGY

SEQ ID NO: 2450437 - protein, 12 aa, Entamoeba dispar
NVQQKKQPRIGD

SEQ ID NO: 2450438 - protein, 11 aa, Entamoeba dispar
NVQQPQQQSIK

SEQ ID NO: 2450439 - protein, 10 aa, Entamoeba dispar
NVQRPGETHR

SEQ ID NO: 2450440 - protein, 7 aa, Entamoeba dispar
NVQSSIN

SEQ ID NO: 2450441 - protein, 9 aa, Entamoeba dispar
NVRDEVKAK

SEQ ID NO: 2450442 - protein, 8 aa, Entamoeba dispar
NVRETKEP

SEQ ID NO: 2450443 - protein, 13 aa, Entamoeba dispar
NVRGVTKITEEKI

SEQ ID NO: 2450444 - protein, 6 aa, Entamoeba dispar
NVRLTA

SEQ ID NO: 2450445 - protein, 8 aa, Entamoeba dispar
NVSDEDRE

SEQ ID NO: 2450446 - protein, 5 aa, Entamoeba dispar
NVSDH

SEQ ID NO: 2450447 - protein, 5 aa, Entamoeba dispar
NVSDY

SEQ ID NO: 2450448 - protein, 6 aa, Entamoeba dispar
NVSGDT

SEQ ID NO: 2450449 - protein, 11 aa, Entamoeba dispar
NVSGTRDKTPL

SEQ ID NO: 2450450 - protein, 4 aa, Entamoeba dispar
NVSK

SEQ ID NO: 2450451 - protein, 8 aa, Entamoeba dispar
NVSKNEGE

SEQ ID NO: 2450452 - protein, 8 aa, Entamoeba dispar
NVSKPVGF

SEQ ID NO: 2450453 - protein, 9 aa, Entamoeba dispar
NVSNEVNET

SEQ ID NO: 2450454 - protein, 10 aa, Entamoeba dispar
NVSNKDKNKL

SEQ ID NO: 2450455 - protein, 13 aa, Entamoeba dispar
NVSPIQEQQKAKL

SEQ ID NO: 2450456 - protein, 7 aa, Entamoeba dispar
NVSQERP

SEQ ID NO: 2450457 - protein, 6 aa, Entamoeba dispar
NVSRED

SEQ ID NO: 2450458 - protein, 7 aa, Entamoeba dispar
NVSRQDD

SEQ ID NO: 2450459 - protein, 4 aa, Entamoeba dispar
NVSS

SEQ ID NO: 2450460 - protein, 21 aa, Entamoeba dispar
NVSSNFYKAKEKKSNLAEEIS

SEQ ID NO: 2450461 - protein, 5 aa, Entamoeba dispar
NVSTE

SEQ ID NO: 2450462 - protein, 7 aa, Entamoeba dispar
NVSTNSF

SEQ ID NO: 2450463 - protein, 5 aa, Entamoeba dispar
NVSYQ

SEQ ID NO: 2450464 - protein, 9 aa, Entamoeba dispar
NVSYSQQTK

SEQ ID NO: 2450465 - protein, 10 aa, Entamoeba dispar
NVTDETTDAD

SEQ ID NO: 2450466 - protein, 12 aa, Entamoeba dispar
NVTDKKKEYEEV

SEQ ID NO: 2450467 - protein, 6 aa, Entamoeba dispar
NVTDSG

SEQ ID NO: 2450468 - protein, 9 aa, Entamoeba dispar
NVTKEEKQK

SEQ ID NO: 2450469 - protein, 8 aa, Entamoeba dispar
NVTPRKTK

SEQ ID NO: 2450470 - protein, 7 aa, Entamoeba dispar
NVTSKED

SEQ ID NO: 2450471 - protein, 4 aa, Entamoeba dispar
NVTT

SEQ ID NO: 2450472 - protein, 5 aa, Entamoeba dispar
NVTTN

SEQ ID NO: 2450473 - protein, 9 aa, Entamoeba dispar
NVTTTQKGE

SEQ ID NO: 2450474 - protein, 4 aa, Entamoeba dispar
NVYD

SEQ ID NO: 2450475 - protein, 18 aa, Entamoeba dispar
NVYGGEGCSWDESCDDEN

SEQ ID NO: 2450476 - protein, 8 aa, Entamoeba dispar
NWDHGEMP

SEQ ID NO: 2450477 - protein, 24 aa, Entamoeba dispar
NWGSSPVKETTSAEDVEMPPEEQY

SEQ ID NO: 2450478 - protein, 5 aa, Entamoeba dispar
NWGYT

SEQ ID NO: 2450479 - protein, 6 aa, Entamoeba dispar
NWNYSK

SEQ ID NO: 2450480 - protein, 6 aa, Entamoeba dispar
NWSLSG

SEQ ID NO: 2450481 - protein, 10 aa, Entamoeba dispar
NWSPVEGETN

SEQ ID NO: 2450482 - protein, 7 aa, Entamoeba dispar
NWSQPKV

SEQ ID NO: 2450483 - protein, 6 aa, Entamoeba dispar
NWSTQT

SEQ ID NO: 2450484 - protein, 5 aa, Entamoeba dispar
NWTGE

SEQ ID NO: 2450485 - protein, 5 aa, Entamoeba dispar
NWTKD

SEQ ID NO: 2450486 - protein, 4 aa, Entamoeba dispar
NWTN

SEQ ID NO: 2450487 - protein, 5 aa, Entamoeba dispar
NYADP

SEQ ID NO: 2450488 - protein, 7 aa, Entamoeba dispar
NYAEAVT

SEQ ID NO: 2450489 - protein, 6 aa, Entamoeba dispar
NYAGQG

SEQ ID NO: 2450490 - protein, 7 aa, Entamoeba dispar
NYAKTNS

SEQ ID NO: 2450491 - protein, 14 aa, Entamoeba dispar
NYASDKIDKSTILT

SEQ ID NO: 2450492 - protein, 6 aa, Entamoeba dispar
NYASQG

SEQ ID NO: 2450493 - protein, 5 aa, Entamoeba dispar
NYCPQ

SEQ ID NO: 2450494 - protein, 28 aa, Entamoeba dispar
NYDASDKNKEEKREEENEEENKLKKEVE

SEQ ID NO: 2450495 - protein, 10 aa, Entamoeba dispar
NYDDDYDDVG

SEQ ID NO: 2450496 - protein, 8 aa, Entamoeba dispar
NYDDLSQT

SEQ ID NO: 2450497 - protein, 11 aa, Entamoeba dispar
NYDDSRKVDEA

SEQ ID NO: 2450498 - protein, 4 aa, Entamoeba dispar
NYDG

SEQ ID NO: 2450499 - protein, 13 aa, Entamoeba dispar
NYDPDKDKRFAGS

SEQ ID NO: 2450500 - protein, 7 aa, Entamoeba dispar
NYDSDEM

SEQ ID NO: 2450501 - protein, 7 aa, Entamoeba dispar
NYDSNDV

SEQ ID NO: 2450502 - protein, 6 aa, Entamoeba dispar
NYDTTA

SEQ ID NO: 2450503 - protein, 9 aa, Entamoeba dispar
NYDTTSDSA

SEQ ID NO: 2450504 - protein, 13 aa, Entamoeba dispar
NYEDKQNKLIEES

SEQ ID NO: 2450505 - protein, 4 aa, Entamoeba dispar
NYEE

SEQ ID NO: 2450506 - protein, 12 aa, Entamoeba dispar
NYEENRRRHQRR

SEQ ID NO: 2450507 - protein, 4 aa, Entamoeba dispar
NYEN

SEQ ID NO: 2450508 - protein, 11 aa, Entamoeba dispar
NYESTTAPSSL

SEQ ID NO: 2450509 - protein, 10 aa, Entamoeba dispar
NYETSQGGID

SEQ ID NO: 2450510 - protein, 9 aa, Entamoeba dispar
NYGEGDQRL

SEQ ID NO: 2450511 - protein, 6 aa, Entamoeba dispar
NYGNQI

SEQ ID NO: 2450512 - protein, 12 aa, Entamoeba dispar
NYGRNKRPGIGM

SEQ ID NO: 2450513 - protein, 38 aa, Entamoeba dispar
NYGRNKSITNNRSPVTLKSKSELTKPIKEEKSPNEKKK

SEQ ID NO: 2450514 - protein, 58 aa, Entamoeba dispar
NYHERSRSRSRRRDSSDRRRHSSHSRRHSHRRNRSHRSRSRSHERLHDRSRERSRDRR

SEQ ID NO: 2450515 - protein, 6 aa, Entamoeba dispar
NYHGQD

SEQ ID NO: 2450516 - protein, 4 aa, Entamoeba dispar
NYHP

SEQ ID NO: 2450517 - protein, 13 aa, Entamoeba dispar
NYHPEKPKQPPLC

SEQ ID NO: 2450518 - protein, 4 aa, Entamoeba dispar
NYHR

SEQ ID NO: 2450519 - protein, 6 aa, Entamoeba dispar
NYHSSS

SEQ ID NO: 2450520 - protein, 8 aa, Entamoeba dispar
NYIKPTPI

SEQ ID NO: 2450521 - protein, 9 aa, Entamoeba dispar
NYKAKETEI

SEQ ID NO: 2450522 - protein, 9 aa, Entamoeba dispar
NYKATNKVA

SEQ ID NO: 2450523 - protein, 7 aa, Entamoeba dispar
NYKEKEF

SEQ ID NO: 2450524 - protein, 9 aa, Entamoeba dispar
NYKEKYQNE

SEQ ID NO: 2450525 - protein, 8 aa, Entamoeba dispar
NYKEPTTW

SEQ ID NO: 2450526 - protein, 12 aa, Entamoeba dispar
NYKGNGLSNECV

SEQ ID NO: 2450527 - protein, 8 aa, Entamoeba dispar
NYKINEEK

SEQ ID NO: 2450528 - protein, 21 aa, Entamoeba dispar
NYKKEQRKNTKQHKDKQAQIK

SEQ ID NO: 2450529 - protein, 11 aa, Entamoeba dispar
NYKKPLKKEIS

SEQ ID NO: 2450530 - protein, 9 aa, Entamoeba dispar
NYKNTNVNF

SEQ ID NO: 2450531 - protein, 9 aa, Entamoeba dispar
NYKPSKTHR

SEQ ID NO: 2450532 - protein, 6 aa, Entamoeba dispar
NYKQTS

SEQ ID NO: 2450533 - protein, 19 aa, Entamoeba dispar
NYKSKKEKKPKKNQISSNR

SEQ ID NO: 2450534 - protein, 6 aa, Entamoeba dispar
NYLNDK

SEQ ID NO: 2450535 - protein, 4 aa, Entamoeba dispar
NYLP

SEQ ID NO: 2450536 - protein, 5 aa, Entamoeba dispar
NYLPP

SEQ ID NO: 2450537 - protein, 14 aa, Entamoeba dispar
NYLQPEETKQSGYM

SEQ ID NO: 2450538 - protein, 5 aa, Entamoeba dispar
NYNDY

SEQ ID NO: 2450539 - protein, 10 aa, Entamoeba dispar
NYNEKKETDM

SEQ ID NO: 2450540 - protein, 10 aa, Entamoeba dispar
NYNEPSGKGN

SEQ ID NO: 2450541 - protein, 7 aa, Entamoeba dispar
NYNGSNN

SEQ ID NO: 2450542 - protein, 7 aa, Entamoeba dispar
NYNHNNE

SEQ ID NO: 2450543 - protein, 5 aa, Entamoeba dispar
NYNKE

SEQ ID NO: 2450544 - protein, 4 aa, Entamoeba dispar
NYNN

SEQ ID NO: 2450545 - protein, 9 aa, Entamoeba dispar
NYNNPEIGK

SEQ ID NO: 2450546 - protein, 9 aa, Entamoeba dispar
NYNNYKKEL

SEQ ID NO: 2450547 - protein, 6 aa, Entamoeba dispar
NYNPKH

SEQ ID NO: 2450548 - protein, 17 aa, Entamoeba dispar
NYNPQKMNKKQKQLSDL

SEQ ID NO: 2450549 - protein, 10 aa, Entamoeba dispar
NYNSKEEMKQ

SEQ ID NO: 2450550 - protein, 6 aa, Entamoeba dispar
NYNSSN

SEQ ID NO: 2450551 - protein, 8 aa, Entamoeba dispar
NYPDRKSV

SEQ ID NO: 2450552 - protein, 4 aa, Entamoeba dispar
NYPE

SEQ ID NO: 2450553 - protein, 10 aa, Entamoeba dispar
NYPIGDDGRP

SEQ ID NO: 2450554 - protein, 4 aa, Entamoeba dispar
NYPK

SEQ ID NO: 2450555 - protein, 12 aa, Entamoeba dispar
NYPKCDTVGKKY

SEQ ID NO: 2450556 - protein, 10 aa, Entamoeba dispar
NYPKGNDDEY

SEQ ID NO: 2450557 - protein, 12 aa, Entamoeba dispar
NYPKVPTRSQTK

SEQ ID NO: 2450558 - protein, 5 aa, Entamoeba dispar
NYPPG

SEQ ID NO: 2450559 - protein, 53 aa, Entamoeba dispar
NYPPNLKTNTQTVNFGSSNNLTEKKHSTSLRPKLQKRTNRQKEEVKLKASGEF

SEQ ID NO: 2450560 - protein, 17 aa, Entamoeba dispar
NYPPNTQTYQQQVQQPY

SEQ ID NO: 2450561 - protein, 22 aa, Entamoeba dispar
NYPPSTPAMNSQYTTQTPMPNY

SEQ ID NO: 2450562 - protein, 7 aa, Entamoeba dispar
NYPRSSI

SEQ ID NO: 2450563 - protein, 7 aa, Entamoeba dispar
NYPSHSS

SEQ ID NO: 2450564 - protein, 9 aa, Entamoeba dispar
NYPSNNTKL

SEQ ID NO: 2450565 - protein, 14 aa, Entamoeba dispar
NYPTDFYPLYAFLL

SEQ ID NO: 2450566 - protein, 6 aa, Entamoeba dispar
NYPTEN

SEQ ID NO: 2450567 - protein, 5 aa, Entamoeba dispar
NYPTG

SEQ ID NO: 2450568 - protein, 6 aa, Entamoeba dispar
NYQASS

SEQ ID NO: 2450569 - protein, 5 aa, Entamoeba dispar
NYQAT

SEQ ID NO: 2450570 - protein, 8 aa, Entamoeba dispar
NYQDDSSI

SEQ ID NO: 2450571 - protein, 8 aa, Entamoeba dispar
NYQPPEEM

SEQ ID NO: 2450572 - protein, 6 aa, Entamoeba dispar
NYQPQF

SEQ ID NO: 2450573 - protein, 5 aa, Entamoeba dispar
NYQPS

SEQ ID NO: 2450574 - protein, 7 aa, Entamoeba dispar
NYQSEQE

SEQ ID NO: 2450575 - protein, 7 aa, Entamoeba dispar
NYRDTSL

SEQ ID NO: 2450576 - protein, 12 aa, Entamoeba dispar
NYRKNSTKGKVK

SEQ ID NO: 2450577 - protein, 9 aa, Entamoeba dispar
NYRPENAKK

SEQ ID NO: 2450578 - protein, 6 aa, Entamoeba dispar
NYSADS

SEQ ID NO: 2450579 - protein, 5 aa, Entamoeba dispar
NYSEY

SEQ ID NO: 2450580 - protein, 6 aa, Entamoeba dispar
NYSEYK

SEQ ID NO: 2450581 - protein, 17 aa, Entamoeba dispar
NYSLPSSERVSKIEPSE

SEQ ID NO: 2450582 - protein, 4 aa, Entamoeba dispar
NYSN

SEQ ID NO: 2450583 - protein, 4 aa, Entamoeba dispar
NYSP

SEQ ID NO: 2450584 - protein, 5 aa, Entamoeba dispar
NYSPL

SEQ ID NO: 2450585 - protein, 6 aa, Entamoeba dispar
NYSSES

SEQ ID NO: 2450586 - protein, 17 aa, Entamoeba dispar
NYSSKDNTWETEDEIRT

SEQ ID NO: 2450587 - protein, 4 aa, Entamoeba dispar
NYST

SEQ ID NO: 2450588 - protein, 5 aa, Entamoeba dispar
NYSTE

SEQ ID NO: 2450589 - protein, 5 aa, Entamoeba dispar
NYSYG

SEQ ID NO: 2450590 - protein, 7 aa, Entamoeba dispar
NYTEKYP

SEQ ID NO: 2450591 - protein, 5 aa, Entamoeba dispar
NYTKP

SEQ ID NO: 2450592 - protein, 9 aa, Entamoeba dispar
NYTNSRDSW

SEQ ID NO: 2450593 - protein, 12 aa, Entamoeba dispar
NYTPKNKLEKDK

SEQ ID NO: 2450594 - protein, 10 aa, Entamoeba dispar
NYTPTQNDEI

SEQ ID NO: 2450595 - protein, 41 aa, Entamoeba dispar
  misc_feature (16)..(17): Xaa can be any naturally occurring amino acid
NYTTNDIKLASQIIDXXFFCSRELKENKCHKESRPTNSKKE

SEQ ID NO: 2450596 - protein, 8 aa, Entamoeba dispar
NYVDNESI

SEQ ID NO: 2450597 - protein, 10 aa, Entamoeba dispar
NYYKEDSSIQ

SEQ ID NO: 2450598 - protein, 4 aa, Entamoeba dispar
NYYT

SEQ ID NO: 2450599 - protein, 10 aa, Entamoeba dispar
PAALSNSKER

SEQ ID NO: 2450600 - protein, 8 aa, Entamoeba dispar
PAAPKPNA

SEQ ID NO: 2450601 - protein, 7 aa, Entamoeba dispar
PAASHPR

SEQ ID NO: 2450602 - protein, 8 aa, Entamoeba dispar
PADKVGDS

SEQ ID NO: 2450603 - protein, 14 aa, Entamoeba dispar
PADSMEKETNVQQR

SEQ ID NO: 2450604 - protein, 5 aa, Entamoeba dispar
PADSS

SEQ ID NO: 2450605 - protein, 5 aa, Entamoeba dispar
PAEDG

SEQ ID NO: 2450606 - protein, 7 aa, Entamoeba dispar
PAEELTK

SEQ ID NO: 2450607 - protein, 7 aa, Entamoeba dispar
PAEKGEY

SEQ ID NO: 2450608 - protein, 4 aa, Entamoeba dispar
PAET

SEQ ID NO: 2450609 - protein, 15 aa, Entamoeba dispar
PAFSGDQSDLDHSDK

SEQ ID NO: 2450610 - protein, 5 aa, Entamoeba dispar
PAFSS

SEQ ID NO: 2450611 - protein, 8 aa, Entamoeba dispar
PAGDKPIP

SEQ ID NO: 2450612 - protein, 9 aa, Entamoeba dispar
PAGEKNGVE

SEQ ID NO: 2450613 - protein, 4 aa, Entamoeba dispar
PAGF

SEQ ID NO: 2450614 - protein, 6 aa, Entamoeba dispar
PAGPID

SEQ ID NO: 2450615 - protein, 10 aa, Entamoeba dispar
PAGSTGYSKS

SEQ ID NO: 2450616 - protein, 11 aa, Entamoeba dispar
PAIGRTTTGLE

SEQ ID NO: 2450617 - protein, 11 aa, Entamoeba dispar
PAIPSTVGQSK

SEQ ID NO: 2450618 - protein, 8 aa, Entamoeba dispar
PAKPHGEA

SEQ ID NO: 2450619 - protein, 8 aa, Entamoeba dispar
PAKQPYPY

SEQ ID NO: 2450620 - protein, 5 aa, Entamoeba dispar
PAKRR

SEQ ID NO: 2450621 - protein, 25 aa, Entamoeba dispar
PAKSPLKKEIESKPKKVEERKPGQL

SEQ ID NO: 2450622 - protein, 5 aa, Entamoeba dispar
PAKSV

SEQ ID NO: 2450623 - protein, 8 aa, Entamoeba dispar
PAKYGRNS

SEQ ID NO: 2450624 - protein, 22 aa, Entamoeba dispar
PALNGEKKKQIQQLPPSRSVLP

SEQ ID NO: 2450625 - protein, 80 aa, Entamoeba dispar
PALPPRRSVSTTQAIPTVPSRTYPTKNNSKQLEQQTKITSGRANLSSSLTSPRTIERTEPTNKRPLPPVPNKRTNFKINY

SEQ ID NO: 2450626 - protein, 15 aa, Entamoeba dispar
PAMANQNRKPPSRNL

SEQ ID NO: 2450627 - protein, 13 aa, Entamoeba dispar
PAMTDSNKSQFIE

SEQ ID NO: 2450628 - protein, 10 aa, Entamoeba dispar
PANCSERHNS

SEQ ID NO: 2450629 - protein, 6 aa, Entamoeba dispar
PANSRG

SEQ ID NO: 2450630 - protein, 9 aa, Entamoeba dispar
PAPAPKEIN

SEQ ID NO: 2450631 - protein, 10 aa, Entamoeba dispar
PAPEGSAPGM

SEQ ID NO: 2450632 - protein, 9 aa, Entamoeba dispar
PAPISIDGR

SEQ ID NO: 2450633 - protein, 9 aa, Entamoeba dispar
PAPKDKEKQ

SEQ ID NO: 2450634 - protein, 5 aa, Entamoeba dispar
PAPPI

SEQ ID NO: 2450635 - protein, 8 aa, Entamoeba dispar
PAPQPEWY

SEQ ID NO: 2450636 - protein, 8 aa, Entamoeba dispar
PAPTDVEA

SEQ ID NO: 2450637 - protein, 7 aa, Entamoeba dispar
PAPTSIP

SEQ ID NO: 2450638 - protein, 14 aa, Entamoeba dispar
PAQKVPNKETIKNA

SEQ ID NO: 2450639 - protein, 13 aa, Entamoeba dispar
PAQKVPSKETIKS

SEQ ID NO: 2450640 - protein, 4 aa, Entamoeba dispar
PAQM

SEQ ID NO: 2450641 - protein, 12 aa, Entamoeba dispar
PARGDKLSSPFQ

SEQ ID NO: 2450642 - protein, 6 aa, Entamoeba dispar
PASATL

SEQ ID NO: 2450643 - protein, 6 aa, Entamoeba dispar
PASATN

SEQ ID NO: 2450644 - protein, 13 aa, Entamoeba dispar
PASGEAAKAYTTS

SEQ ID NO: 2450645 - protein, 6 aa, Entamoeba dispar
PASGYV

SEQ ID NO: 2450646 - protein, 7 aa, Entamoeba dispar
PASGYVQ

SEQ ID NO: 2450647 - protein, 11 aa, Entamoeba dispar
PASINKQGTVK

SEQ ID NO: 2450648 - protein, 9 aa, Entamoeba dispar
PASPSENAA

SEQ ID NO: 2450649 - protein, 18 aa, Entamoeba dispar
PASRSIQQEPDGDDETLE

SEQ ID NO: 2450650 - protein, 13 aa, Entamoeba dispar
PASSKFCGSCGHK

SEQ ID NO: 2450651 - protein, 7 aa, Entamoeba dispar
PASVSKI

SEQ ID NO: 2450652 - protein, 5 aa, Entamoeba dispar
PATDT

SEQ ID NO: 2450653 - protein, 4 aa, Entamoeba dispar
PATE

SEQ ID NO: 2450654 - protein, 7 aa, Entamoeba dispar
PATGSEM

SEQ ID NO: 2450655 - protein, 10 aa, Entamoeba dispar
PATGSNDLDI

SEQ ID NO: 2450656 - protein, 8 aa, Entamoeba dispar
PATGTETN

SEQ ID NO: 2450657 - protein, 8 aa, Entamoeba dispar
PATPDGVA

SEQ ID NO: 2450658 - protein, 13 aa, Entamoeba dispar
PATPIDSPPLIQF

SEQ ID NO: 2450659 - protein, 18 aa, Entamoeba dispar
PATPMTPSLARAPPKTPG

SEQ ID NO: 2450660 - protein, 4 aa, Entamoeba dispar
PATS

SEQ ID NO: 2450661 - protein, 6 aa, Entamoeba dispar
PATSHF

SEQ ID NO: 2450662 - protein, 10 aa, Entamoeba dispar
PAVPSKPSRL

SEQ ID NO: 2450663 - protein, 16 aa, Entamoeba dispar
PAWTPDMTAEELDRVE

SEQ ID NO: 2450664 - protein, 11 aa, Entamoeba dispar
PCKSIDPDKAV

SEQ ID NO: 2450665 - protein, 30 aa, Entamoeba dispar
PCLKSSELKKHVQAKKPKKNNKKPALVQSS

SEQ ID NO: 2450666 - protein, 7 aa, Entamoeba dispar
PCPSKNE

SEQ ID NO: 2450667 - protein, 5 aa, Entamoeba dispar
PCQTP

SEQ ID NO: 2450668 - protein, 8 aa, Entamoeba dispar
PCRNKPPF

SEQ ID NO: 2450669 - protein, 4 aa, Entamoeba dispar
PCSE

SEQ ID NO: 2450670 - protein, 14 aa, Entamoeba dispar
PCSGDGTLRKSSNP

SEQ ID NO: 2450671 - protein, 10 aa, Entamoeba dispar
PCSPGDKGAM

SEQ ID NO: 2450672 - protein, 15 aa, Entamoeba dispar
PCWEDKENKSGSTIT

SEQ ID NO: 2450673 - protein, 7 aa, Entamoeba dispar
PDAEEKI

SEQ ID NO: 2450674 - protein, 7 aa, Entamoeba dispar
PDALPEE

SEQ ID NO: 2450675 - protein, 7 aa, Entamoeba dispar
PDASARA

SEQ ID NO: 2450676 - protein, 6 aa, Entamoeba dispar
PDASTA

SEQ ID NO: 2450677 - protein, 4 aa, Entamoeba dispar
PDAV

SEQ ID NO: 2450678 - protein, 4 aa, Entamoeba dispar
PDCD

SEQ ID NO: 2450679 - protein, 13 aa, Entamoeba dispar
PDCTDACKDDNEF

SEQ ID NO: 2450680 - protein, 10 aa, Entamoeba dispar
PDDEEVPKEE

SEQ ID NO: 2450681 - protein, 12 aa, Entamoeba dispar
PDDGVENSDYGE

SEQ ID NO: 2450682 - protein, 12 aa, Entamoeba dispar
PDDLKEIPSTYY

SEQ ID NO: 2450683 - protein, 14 aa, Entamoeba dispar
PDDLSTNKSIRNSI

SEQ ID NO: 2450684 - protein, 9 aa, Entamoeba dispar
PDDPNRSGF

SEQ ID NO: 2450685 - protein, 25 aa, Entamoeba dispar
PDDPRASRDHRNEFREQRNPQPFYS

SEQ ID NO: 2450686 - protein, 7 aa, Entamoeba dispar
PDDPTLP

SEQ ID NO: 2450687 - protein, 12 aa, Entamoeba dispar
PDDSHGSRQGSV

SEQ ID NO: 2450688 - protein, 6 aa, Entamoeba dispar
PDDSIS

SEQ ID NO: 2450689 - protein, 5 aa, Entamoeba dispar
PDDTI

SEQ ID NO: 2450690 - protein, 8 aa, Entamoeba dispar
PDEDENGM

SEQ ID NO: 2450691 - protein, 5 aa, Entamoeba dispar
PDEEL

SEQ ID NO: 2450692 - protein, 7 aa, Entamoeba dispar
PDEEPEE

SEQ ID NO: 2450693 - protein, 21 aa, Entamoeba dispar
PDEESDAVSSPLQNPSSTAPI

SEQ ID NO: 2450694 - protein, 5 aa, Entamoeba dispar
PDEHG

SEQ ID NO: 2450695 - protein, 9 aa, Entamoeba dispar
PDEKDTVIG

SEQ ID NO: 2450696 - protein, 6 aa, Entamoeba dispar
PDEKEE

SEQ ID NO: 2450697 - protein, 5 aa, Entamoeba dispar
PDELQ

SEQ ID NO: 2450698 - protein, 7 aa, Entamoeba dispar
PDENHYG

SEQ ID NO: 2450699 - protein, 10 aa, Entamoeba dispar
PDENLKTKTD

SEQ ID NO: 2450700 - protein, 7 aa, Entamoeba dispar
PDEQEWP

SEQ ID NO: 2450701 - protein, 11 aa, Entamoeba dispar
PDERSERMKED

SEQ ID NO: 2450702 - protein, 6 aa, Entamoeba dispar
PDETGL

SEQ ID NO: 2450703 - protein, 14 aa, Entamoeba dispar
PDETYSEAIKRGEG

SEQ ID NO: 2450704 - protein, 23 aa, Entamoeba dispar
PDFDQNKSSKSHTSNSSIEHSKR

SEQ ID NO: 2450705 - protein, 5 aa, Entamoeba dispar
PDFES

SEQ ID NO: 2450706 - protein, 10 aa, Entamoeba dispar
PDFGETTSTL

SEQ ID NO: 2450707 - protein, 9 aa, Entamoeba dispar
PDFQEPEKT

SEQ ID NO: 2450708 - protein, 11 aa, Entamoeba dispar
PDFQPDSERET

SEQ ID NO: 2450709 - protein, 6 aa, Entamoeba dispar
PDGIDE

SEQ ID NO: 2450710 - protein, 17 aa, Entamoeba dispar
PDGIQKPRFGEKLNKEA

SEQ ID NO: 2450711 - protein, 13 aa, Entamoeba dispar
PDGKNILSRYDIL

SEQ ID NO: 2450712 - protein, 4 aa, Entamoeba dispar
PDGR

SEQ ID NO: 2450713 - protein, 8 aa, Entamoeba dispar
PDGRPRNV

SEQ ID NO: 2450714 - protein, 4 aa, Entamoeba dispar
PDGS

SEQ ID NO: 2450715 - protein, 34 aa, Entamoeba dispar
PDGSEKGPKVKAEIEVKEKKQKKQPKKVEQTTEK

SEQ ID NO: 2450716 - protein, 11 aa, Entamoeba dispar
PDGSLSTNEFI

SEQ ID NO: 2450717 - protein, 8 aa, Entamoeba dispar
PDGSSHKI

SEQ ID NO: 2450718 - protein, 6 aa, Entamoeba dispar
PDGTDY

SEQ ID NO: 2450719 - protein, 5 aa, Entamoeba dispar
PDGTE

SEQ ID NO: 2450720 - protein, 7 aa, Entamoeba dispar
PDGTKPY

SEQ ID NO: 2450721 - protein, 10 aa, Entamoeba dispar
PDGVDERKAP

SEQ ID NO: 2450722 - protein, 7 aa, Entamoeba dispar
PDGVTSP

SEQ ID NO: 2450723 - protein, 12 aa, Entamoeba dispar
PDIENKIDSPQR

SEQ ID NO: 2450724 - protein, 8 aa, Entamoeba dispar
PDIKGVSS

SEQ ID NO: 2450725 - protein, 7 aa, Entamoeba dispar
PDINKPL

SEQ ID NO: 2450726 - protein, 17 aa, Entamoeba dispar
PDIPEERERIEKNGGHC

SEQ ID NO: 2450727 - protein, 13 aa, Entamoeba dispar
PDIPEQQDVTGKE

SEQ ID NO: 2450728 - protein, 4 aa, Entamoeba dispar
PDIS

SEQ ID NO: 2450729 - protein, 24 aa, Entamoeba dispar
PDITETPKEEIKAKKNKTNNKEKM

SEQ ID NO: 2450730 - protein, 5 aa, Entamoeba dispar
PDKAN

SEQ ID NO: 2450731 - protein, 7 aa, Entamoeba dispar
PDKEQSE

SEQ ID NO: 2450732 - protein, 7 aa, Entamoeba dispar
PDKIEKE

SEQ ID NO: 2450733 - protein, 7 aa, Entamoeba dispar
PDKPTID

SEQ ID NO: 2450734 - protein, 15 aa, Entamoeba dispar
PDKPTPQPSKDSKLK

SEQ ID NO: 2450735 - protein, 8 aa, Entamoeba dispar
PDKQIPEL

SEQ ID NO: 2450736 - protein, 9 aa, Entamoeba dispar
PDKQTTFGV

SEQ ID NO: 2450737 - protein, 10 aa, Entamoeba dispar
PDLETNQTIN

SEQ ID NO: 2450738 - protein, 18 aa, Entamoeba dispar
PDLGSGNDIKLGTNSSVQ

SEQ ID NO: 2450739 - protein, 7 aa, Entamoeba dispar
PDLHSSN

SEQ ID NO: 2450740 - protein, 6 aa, Entamoeba dispar
PDLPTT

SEQ ID NO: 2450741 - protein, 4 aa, Entamoeba dispar
PDLT

SEQ ID NO: 2450742 - protein, 6 aa, Entamoeba dispar
PDMYPT

SEQ ID NO: 2450743 - protein, 5 aa, Entamoeba dispar
PDNDL

SEQ ID NO: 2450744 - protein, 16 aa, Entamoeba dispar
PDNDYPRRIKRDKQSF

SEQ ID NO: 2450745 - protein, 4 aa, Entamoeba dispar
PDNG

SEQ ID NO: 2450746 - protein, 9 aa, Entamoeba dispar
PDNHGSGDL

SEQ ID NO: 2450747 - protein, 4 aa, Entamoeba dispar
PDNN

SEQ ID NO: 2450748 - protein, 21 aa, Entamoeba dispar
PDNSSEDKKKKRRNADAKTND

SEQ ID NO: 2450749 - protein, 4 aa, Entamoeba dispar
PDNT

SEQ ID NO: 2450750 - protein, 7 aa, Entamoeba dispar
PDNVKDN

SEQ ID NO: 2450751 - protein, 5 aa, Entamoeba dispar
PDNYT

SEQ ID NO: 2450752 - protein, 6 aa, Entamoeba dispar
PDNYTD

SEQ ID NO: 2450753 - protein, 14 aa, Entamoeba dispar
PDPAMRAGAKRRFD

SEQ ID NO: 2450754 - protein, 9 aa, Entamoeba dispar
PDPELPDDT

SEQ ID NO: 2450755 - protein, 7 aa, Entamoeba dispar
PDPGDFD

SEQ ID NO: 2450756 - protein, 7 aa, Entamoeba dispar
PDPKKLK

SEQ ID NO: 2450757 - protein, 8 aa, Entamoeba dispar
PDPKKPDI

SEQ ID NO: 2450758 - protein, 6 aa, Entamoeba dispar
PDPPKY

SEQ ID NO: 2450759 - protein, 5 aa, Entamoeba dispar
PDPQI

SEQ ID NO: 2450760 - protein, 9 aa, Entamoeba dispar
PDPSFKKGF

SEQ ID NO: 2450761 - protein, 7 aa, Entamoeba dispar
PDPTPTQ

SEQ ID NO: 2450762 - protein, 13 aa, Entamoeba dispar
PDPVTENKKLKEE

SEQ ID NO: 2450763 - protein, 5 aa, Entamoeba dispar
PDPYE

SEQ ID NO: 2450764 - protein, 4 aa, Entamoeba dispar
PDQF

SEQ ID NO: 2450765 - protein, 6 aa, Entamoeba dispar
PDQISQ

SEQ ID NO: 2450766 - protein, 20 aa, Entamoeba dispar
PDQNGNFQKPEGMYTDGGVP

SEQ ID NO: 2450767 - protein, 7 aa, Entamoeba dispar
PDQTEEN

SEQ ID NO: 2450768 - protein, 5 aa, Entamoeba dispar
PDQYN

SEQ ID NO: 2450769 - protein, 4 aa, Entamoeba dispar
PDRN

SEQ ID NO: 2450770 - protein, 16 aa, Entamoeba dispar
PDRNPNNKEEASEKFK

SEQ ID NO: 2450771 - protein, 5 aa, Entamoeba dispar
PDRNS

SEQ ID NO: 2450772 - protein, 12 aa, Entamoeba dispar
PDSDEEGEEEYF

SEQ ID NO: 2450773 - protein, 8 aa, Entamoeba dispar
PDSDSPEC

SEQ ID NO: 2450774 - protein, 19 aa, Entamoeba dispar
PDSEATKNFKGIYKEIITK

SEQ ID NO: 2450775 - protein, 8 aa, Entamoeba dispar
PDSEKEKY

SEQ ID NO: 2450776 - protein, 8 aa, Entamoeba dispar
PDSKSQVT

SEQ ID NO: 2450777 - protein, 5 aa, Entamoeba dispar
PDSPF

SEQ ID NO: 2450778 - protein, 5 aa, Entamoeba dispar
PDSPM

SEQ ID NO: 2450779 - protein, 8 aa, Entamoeba dispar
PDSRSLES

SEQ ID NO: 2450780 - protein, 7 aa, Entamoeba dispar
PDSSLEE

SEQ ID NO: 2450781 - protein, 8 aa, Entamoeba dispar
PDSSNLKC

SEQ ID NO: 2450782 - protein, 18 aa, Entamoeba dispar
PDSTPEDSEDNPNGFQYD

SEQ ID NO: 2450783 - protein, 4 aa, Entamoeba dispar
PDTD

SEQ ID NO: 2450784 - protein, 16 aa, Entamoeba dispar
PDTEEQGDLASTQQVI

SEQ ID NO: 2450785 - protein, 6 aa, Entamoeba dispar
PDTENN

SEQ ID NO: 2450786 - protein, 7 aa, Entamoeba dispar
PDTETSE

SEQ ID NO: 2450787 - protein, 4 aa, Entamoeba dispar
PDTF

SEQ ID NO: 2450788 - protein, 5 aa, Entamoeba dispar
PDTHQ

SEQ ID NO: 2450789 - protein, 12 aa, Entamoeba dispar
PDTNPLDSNRQG

SEQ ID NO: 2450790 - protein, 7 aa, Entamoeba dispar
PDTPGID

SEQ ID NO: 2450791 - protein, 4 aa, Entamoeba dispar
PDTQ

SEQ ID NO: 2450792 - protein, 5 aa, Entamoeba dispar
PDTQE

SEQ ID NO: 2450793 - protein, 5 aa, Entamoeba dispar
PDTRN

SEQ ID NO: 2450794 - protein, 7 aa, Entamoeba dispar
PDTSKLA

SEQ ID NO: 2450795 - protein, 5 aa, Entamoeba dispar
PDTSS

SEQ ID NO: 2450796 - protein, 7 aa, Entamoeba dispar
PDTTPNC

SEQ ID NO: 2450797 - protein, 7 aa, Entamoeba dispar
PDTTRLS

SEQ ID NO: 2450798 - protein, 8 aa, Entamoeba dispar
PDVPPEIQ

SEQ ID NO: 2450799 - protein, 7 aa, Entamoeba dispar
PDVSNRV

SEQ ID NO: 2450800 - protein, 4 aa, Entamoeba dispar
PDVT

SEQ ID NO: 2450801 - protein, 5 aa, Entamoeba dispar
PDYHN

SEQ ID NO: 2450802 - protein, 4 aa, Entamoeba dispar
PDYK

SEQ ID NO: 2450803 - protein, 6 aa, Entamoeba dispar
PDYPPA

SEQ ID NO: 2450804 - protein, 13 aa, Entamoeba dispar
PEAEKKNERIKGT

SEQ ID NO: 2450805 - protein, 18 aa, Entamoeba dispar
PEAISQAKSHYKESKLNK

SEQ ID NO: 2450806 - protein, 8 aa, Entamoeba dispar
PEAKPKYR

SEQ ID NO: 2450807 - protein, 8 aa, Entamoeba dispar
PEAPMEKE

SEQ ID NO: 2450808 - protein, 7 aa, Entamoeba dispar
PEARPTF

SEQ ID NO: 2450809 - protein, 6 aa, Entamoeba dispar
PEARYG

SEQ ID NO: 2450810 - protein, 7 aa, Entamoeba dispar
PEDDELN

SEQ ID NO: 2450811 - protein, 10 aa, Entamoeba dispar
PEDDNDTIHK

SEQ ID NO: 2450812 - protein, 19 aa, Entamoeba dispar
PEDDSNETLNHEDERDELK

SEQ ID NO: 2450813 - protein, 4 aa, Entamoeba dispar
PEDF

SEQ ID NO: 2450814 - protein, 11 aa, Entamoeba dispar
PEDGSVPTTKI

SEQ ID NO: 2450815 - protein, 6 aa, Entamoeba dispar
PEDIKK

SEQ ID NO: 2450816 - protein, 8 aa, Entamoeba dispar
PEDISQSE

SEQ ID NO: 2450817 - protein, 7 aa, Entamoeba dispar
PEDKEIE

SEQ ID NO: 2450818 - protein, 10 aa, Entamoeba dispar
PEDKETESNL

SEQ ID NO: 2450819 - protein, 8 aa, Entamoeba dispar
PEDKTKTT

SEQ ID NO: 2450820 - protein, 10 aa, Entamoeba dispar
PEDMKTTEKR

SEQ ID NO: 2450821 - protein, 4 aa, Entamoeba dispar
PEDN

SEQ ID NO: 2450822 - protein, 7 aa, Entamoeba dispar
PEDPLGK

SEQ ID NO: 2450823 - protein, 11 aa, Entamoeba dispar
PEDPLNDNLTG

SEQ ID NO: 2450824 - protein, 10 aa, Entamoeba dispar
PEDRGKDFPN

SEQ ID NO: 2450825 - protein, 20 aa, Entamoeba dispar
PEDSLKKEKEEEKEKEKEFL

SEQ ID NO: 2450826 - protein, 7 aa, Entamoeba dispar
PEDSPYD

SEQ ID NO: 2450827 - protein, 7 aa, Entamoeba dispar
PEDTTTS

SEQ ID NO: 2450828 - protein, 6 aa, Entamoeba dispar
PEEACQ

SEQ ID NO: 2450829 - protein, 8 aa, Entamoeba dispar
PEEDKEIT

SEQ ID NO: 2450830 - protein, 13 aa, Entamoeba dispar
PEEEDSKKPKERH

SEQ ID NO: 2450831 - protein, 16 aa, Entamoeba dispar
PEEEKIEIKDNSQTTP

SEQ ID NO: 2450832 - protein, 8 aa, Entamoeba dispar
PEEEKKEM

SEQ ID NO: 2450833 - protein, 20 aa, Entamoeba dispar
PEEENDDGSGLDNKGNIGKK

SEQ ID NO: 2450834 - protein, 8 aa, Entamoeba dispar
PEEENNLN

SEQ ID NO: 2450835 - protein, 5 aa, Entamoeba dispar
PEEID

SEQ ID NO: 2450836 - protein, 11 aa, Entamoeba dispar
PEEIDKCKEEE

SEQ ID NO: 2450837 - protein, 7 aa, Entamoeba dispar
PEEITPK

SEQ ID NO: 2450838 - protein, 10 aa, Entamoeba dispar
PEEKKMEEEP

SEQ ID NO: 2450839 - protein, 9 aa, Entamoeba dispar
PEEKLRKDR

SEQ ID NO: 2450840 - protein, 6 aa, Entamoeba dispar
PEEKQE

SEQ ID NO: 2450841 - protein, 4 aa, Entamoeba dispar
PEEL

SEQ ID NO: 2450842 - protein, 4 aa, Entamoeba dispar
PEEM

SEQ ID NO: 2450843 - protein, 5 aa, Entamoeba dispar
PEENY

SEQ ID NO: 2450844 - protein, 10 aa, Entamoeba dispar
PEEPAEPSNF

SEQ ID NO: 2450845 - protein, 13 aa, Entamoeba dispar
PEERIDRTNASNA

SEQ ID NO: 2450846 - protein, 10 aa, Entamoeba dispar
PEETGKAPAE

SEQ ID NO: 2450847 - protein, 5 aa, Entamoeba dispar
PEETK

SEQ ID NO: 2450848 - protein, 9 aa, Entamoeba dispar
PEETLSRTG

SEQ ID NO: 2450849 - protein, 9 aa, Entamoeba dispar
PEETNTKEL

SEQ ID NO: 2450850 - protein, 11 aa, Entamoeba dispar
PEEVPEDKRNF

SEQ ID NO: 2450851 - protein, 5 aa, Entamoeba dispar
PEEVR

SEQ ID NO: 2450852 - protein, 5 aa, Entamoeba dispar
PEEYQ

SEQ ID NO: 2450853 - protein, 6 aa, Entamoeba dispar
PEFGNK

SEQ ID NO: 2450854 - protein, 5 aa, Entamoeba dispar
PEFGT

SEQ ID NO: 2450855 - protein, 6 aa, Entamoeba dispar
PEFNNK

SEQ ID NO: 2450856 - protein, 10 aa, Entamoeba dispar
PEFPEPKNIM

SEQ ID NO: 2450857 - protein, 5 aa, Entamoeba dispar
PEGCT

SEQ ID NO: 2450858 - protein, 10 aa, Entamoeba dispar
PEGDITPEYT

SEQ ID NO: 2450859 - protein, 9 aa, Entamoeba dispar
PEGENNKEF

SEQ ID NO: 2450860 - protein, 6 aa, Entamoeba dispar
PEGEPI

SEQ ID NO: 2450861 - protein, 16 aa, Entamoeba dispar
PEGKGNGLKVKDGDQV

SEQ ID NO: 2450862 - protein, 10 aa, Entamoeba dispar
PEGLDPKSLE

SEQ ID NO: 2450863 - protein, 8 aa, Entamoeba dispar
PEGNVDSK

SEQ ID NO: 2450864 - protein, 5 aa, Entamoeba dispar
PEGPK

SEQ ID NO: 2450865 - protein, 8 aa, Entamoeba dispar
PEGSEKAQ

SEQ ID NO: 2450866 - protein, 7 aa, Entamoeba dispar
PEGSELG

SEQ ID NO: 2450867 - protein, 7 aa, Entamoeba dispar
PEGSKEL

SEQ ID NO: 2450868 - protein, 5 aa, Entamoeba dispar
PEHED

SEQ ID NO: 2450869 - protein, 30 aa, Entamoeba dispar
PEHKNTAATRTGLPDAIDQSTIPSSNNDIA

SEQ ID NO: 2450870 - protein, 9 aa, Entamoeba dispar
PEHKTSDRI

SEQ ID NO: 2450871 - protein, 6 aa, Entamoeba dispar
PEHSPI

SEQ ID NO: 2450872 - protein, 7 aa, Entamoeba dispar
PEIDSQV

SEQ ID NO: 2450873 - protein, 6 aa, Entamoeba dispar
PEIKNQ

SEQ ID NO: 2450874 - protein, 11 aa, Entamoeba dispar
PEINSHPPAIY

SEQ ID NO: 2450875 - protein, 6 aa, Entamoeba dispar
PEIQEQ

SEQ ID NO: 2450876 - protein, 5 aa, Entamoeba dispar
PEIQN

SEQ ID NO: 2450877 - protein, 59 aa, Entamoeba dispar
PEIRNGEGRIPRPTQRSVGVSNQRTKLTVSSSISSSGQDSIPSSQNPSPRLEDSEITNE

SEQ ID NO: 2450878 - protein, 8 aa, Entamoeba dispar
PEISDDTS

SEQ ID NO: 2450879 - protein, 13 aa, Entamoeba dispar
PEISTSNSYDQAS

SEQ ID NO: 2450880 - protein, 13 aa, Entamoeba dispar
PEITSKDASYTSQ

SEQ ID NO: 2450881 - protein, 19 aa, Entamoeba dispar
PEKESDKTRIKSKKKFVSQ

SEQ ID NO: 2450882 - protein, 13 aa, Entamoeba dispar
PEKFNPKEAPIGF

SEQ ID NO: 2450883 - protein, 9 aa, Entamoeba dispar
PEKKIASYD

SEQ ID NO: 2450884 - protein, 10 aa, Entamoeba dispar
PEKLKEPYSE

SEQ ID NO: 2450885 - protein, 9 aa, Entamoeba dispar
PEKNRNCSI

SEQ ID NO: 2450886 - protein, 8 aa, Entamoeba dispar
PEKQEINN

SEQ ID NO: 2450887 - protein, 15 aa, Entamoeba dispar
PEKQHSKPINKNNEI

SEQ ID NO: 2450888 - protein, 13 aa, Entamoeba dispar
PEKRATAEKALES

SEQ ID NO: 2450889 - protein, 10 aa, Entamoeba dispar
PEKTKDLEKY

SEQ ID NO: 2450890 - protein, 11 aa, Entamoeba dispar
PEKTTEDNNKY

SEQ ID NO: 2450891 - protein, 20 aa, Entamoeba dispar
PEKVKPVADAAPKETKKQGP

SEQ ID NO: 2450892 - protein, 5 aa, Entamoeba dispar
PEKVQ

SEQ ID NO: 2450893 - protein, 5 aa, Entamoeba dispar
PEKYP

SEQ ID NO: 2450894 - protein, 7 aa, Entamoeba dispar
PEKYSNK

SEQ ID NO: 2450895 - protein, 6 aa, Entamoeba dispar
PELKDK

SEQ ID NO: 2450896 - protein, 7 aa, Entamoeba dispar
PELKESA

SEQ ID NO: 2450897 - protein, 13 aa, Entamoeba dispar
PELKNCKSKNEQI

SEQ ID NO: 2450898 - protein, 10 aa, Entamoeba dispar
PELKNEDDIE

SEQ ID NO: 2450899 - protein, 4 aa, Entamoeba dispar
PELP

SEQ ID NO: 2450900 - protein, 10 aa, Entamoeba dispar
PELPKTRIPH

SEQ ID NO: 2450901 - protein, 8 aa, Entamoeba dispar
PELPNSSA

SEQ ID NO: 2450902 - protein, 7 aa, Entamoeba dispar
PELPQNN

SEQ ID NO: 2450903 - protein, 6 aa, Entamoeba dispar
PELPQS

SEQ ID NO: 2450904 - protein, 9 aa, Entamoeba dispar
PELQSAKDI

SEQ ID NO: 2450905 - protein, 5 aa, Entamoeba dispar
PELRR

SEQ ID NO: 2450906 - protein, 5 aa, Entamoeba dispar
PELRV

SEQ ID NO: 2450907 - protein, 4 aa, Entamoeba dispar
PELT

SEQ ID NO: 2450908 - protein, 5 aa, Entamoeba dispar
PEMEF

SEQ ID NO: 2450909 - protein, 6 aa, Entamoeba dispar
PEMEPG

SEQ ID NO: 2450910 - protein, 4 aa, Entamoeba dispar
PEMN

SEQ ID NO: 2450911 - protein, 9 aa, Entamoeba dispar
PENAQGTFN

SEQ ID NO: 2450912 - protein, 7 aa, Entamoeba dispar
PENDKNI

SEQ ID NO: 2450913 - protein, 9 aa, Entamoeba dispar
PENDSKKEE

SEQ ID NO: 2450914 - protein, 8 aa, Entamoeba dispar
PENEIEEV

SEQ ID NO: 2450915 - protein, 11 aa, Entamoeba dispar
PENELVEKEDV

SEQ ID NO: 2450916 - protein, 5 aa, Entamoeba dispar
PENEN

SEQ ID NO: 2450917 - protein, 4 aa, Entamoeba dispar
PENG

SEQ ID NO: 2450918 - protein, 7 aa, Entamoeba dispar
PENGEAI

SEQ ID NO: 2450919 - protein, 13 aa, Entamoeba dispar
PENGEKTGSVGEE

SEQ ID NO: 2450920 - protein, 7 aa, Entamoeba dispar
PENIEEL

SEQ ID NO: 2450921 - protein, 6 aa, Entamoeba dispar
PENLES

SEQ ID NO: 2450922 - protein, 9 aa, Entamoeba dispar
PENNIEEDE

SEQ ID NO: 2450923 - protein, 26 aa, Entamoeba dispar
PENQPNKEIKIEDPKEKEEEKKERIK

SEQ ID NO: 2450924 - protein, 6 aa, Entamoeba dispar
PENRMT

SEQ ID NO: 2450925 - protein, 7 aa, Entamoeba dispar
PENSNEF

SEQ ID NO: 2450926 - protein, 4 aa, Entamoeba dispar
PENT

SEQ ID NO: 2450927 - protein, 24 aa, Entamoeba dispar
PENVQESGETFQKPDYIGQSSNKC

SEQ ID NO: 2450928 - protein, 6 aa, Entamoeba dispar
PEPEGY

SEQ ID NO: 2450929 - protein, 7 aa, Entamoeba dispar
PEPEKRP

SEQ ID NO: 2450930 - protein, 7 aa, Entamoeba dispar
PEPIPEG

SEQ ID NO: 2450931 - protein, 40 aa, Entamoeba dispar
PEPKDTIQKERDAHDENNNSNITKITKPNENLEIKKEEKK

SEQ ID NO: 2450932 - protein, 11 aa, Entamoeba dispar
PEPMGKRNKTI

SEQ ID NO: 2450933 - protein, 10 aa, Entamoeba dispar
PEPNELEYPE

SEQ ID NO: 2450934 - protein, 12 aa, Entamoeba dispar
PEPPKYENSPTN

SEQ ID NO: 2450935 - protein, 7 aa, Entamoeba dispar
PEPPQGQ

SEQ ID NO: 2450936 - protein, 7 aa, Entamoeba dispar
PEPTAAA

SEQ ID NO: 2450937 - protein, 14 aa, Entamoeba dispar
PEPTQTIQSSEKSI

SEQ ID NO: 2450938 - protein, 5 aa, Entamoeba dispar
PEPVR

SEQ ID NO: 2450939 - protein, 15 aa, Entamoeba dispar
PEPVSPRKEQTPRVS

SEQ ID NO: 2450940 - protein, 4 aa, Entamoeba dispar
PEQE

SEQ ID NO: 2450941 - protein, 13 aa, Entamoeba dispar
PEQELKKHKTADL

SEQ ID NO: 2450942 - protein, 4 aa, Entamoeba dispar
PEQF

SEQ ID NO: 2450943 - protein, 6 aa, Entamoeba dispar
PEQHPN

SEQ ID NO: 2450944 - protein, 10 aa, Entamoeba dispar
PEQKKRWKDI

SEQ ID NO: 2450945 - protein, 5 aa, Entamoeba dispar
PEQMT

SEQ ID NO: 2450946 - protein, 6 aa, Entamoeba dispar
PEQNTE

SEQ ID NO: 2450947 - protein, 10 aa, Entamoeba dispar
PEQPGDLQRV

SEQ ID NO: 2450948 - protein, 11 aa, Entamoeba dispar
PERKNDEDQQG

SEQ ID NO: 2450949 - protein, 5 aa, Entamoeba dispar
PERLA

SEQ ID NO: 2450950 - protein, 10 aa, Entamoeba dispar
PERLPTGQIG

SEQ ID NO: 2450951 - protein, 5 aa, Entamoeba dispar
PERNE

SEQ ID NO: 2450952 - protein, 16 aa, Entamoeba dispar
PERNKSSGSLQSSSPD

SEQ ID NO: 2450953 - protein, 14 aa, Entamoeba dispar
PERQAAISSNNNKF

SEQ ID NO: 2450954 - protein, 5 aa, Entamoeba dispar
PERQL

SEQ ID NO: 2450955 - protein, 5 aa, Entamoeba dispar
PERVP

SEQ ID NO: 2450956 - protein, 7 aa, Entamoeba dispar
PERVPKA

SEQ ID NO: 2450957 - protein, 18 aa, Entamoeba dispar
PERYNPPEISEIVAMDEM

SEQ ID NO: 2450958 - protein, 9 aa, Entamoeba dispar
PESDSTTDY

SEQ ID NO: 2450959 - protein, 16 aa, Entamoeba dispar
PESEKPIPPRVTPSFF

SEQ ID NO: 2450960 - protein, 16 aa, Entamoeba dispar
PESEKPVPPRTTPSFF

SEQ ID NO: 2450961 - protein, 4 aa, Entamoeba dispar
PESL

SEQ ID NO: 2450962 - protein, 4 aa, Entamoeba dispar
PESM

SEQ ID NO: 2450963 - protein, 7 aa, Entamoeba dispar
PESPIEN

SEQ ID NO: 2450964 - protein, 7 aa, Entamoeba dispar
PESPLCP

SEQ ID NO: 2450965 - protein, 5 aa, Entamoeba dispar
PESQG

SEQ ID NO: 2450966 - protein, 8 aa, Entamoeba dispar
PESQGCDY

SEQ ID NO: 2450967 - protein, 5 aa, Entamoeba dispar
PESRS

SEQ ID NO: 2450968 - protein, 5 aa, Entamoeba dispar
PESSL

SEQ ID NO: 2450969 - protein, 6 aa, Entamoeba dispar
PESTGV

SEQ ID NO: 2450970 - protein, 9 aa, Entamoeba dispar
PESTIEDDT

SEQ ID NO: 2450971 - protein, 6 aa, Entamoeba dispar
PESTQQ

SEQ ID NO: 2450972 - protein, 11 aa, Entamoeba dispar
PETATQGPLPT

SEQ ID NO: 2450973 - protein, 9 aa, Entamoeba dispar
PETCQRRRG

SEQ ID NO: 2450974 - protein, 8 aa, Entamoeba dispar
PETDGDRA

SEQ ID NO: 2450975 - protein, 8 aa, Entamoeba dispar
PETDPPSQ

SEQ ID NO: 2450976 - protein, 35 aa, Entamoeba dispar
PETERNVEKEIKPSSQPNQKEQVIGSSNEISATDD

SEQ ID NO: 2450977 - protein, 12 aa, Entamoeba dispar
PETIKNNKISYN

SEQ ID NO: 2450978 - protein, 12 aa, Entamoeba dispar
PETKDENKDSTF

SEQ ID NO: 2450979 - protein, 5 aa, Entamoeba dispar
PETKI

SEQ ID NO: 2450980 - protein, 11 aa, Entamoeba dispar
PETKSLPKEYG

SEQ ID NO: 2450981 - protein, 4 aa, Entamoeba dispar
PETN

SEQ ID NO: 2450982 - protein, 6 aa, Entamoeba dispar
PETPND

SEQ ID NO: 2450983 - protein, 4 aa, Entamoeba dispar
PETQ

SEQ ID NO: 2450984 - protein, 15 aa, Entamoeba dispar
PETQSKDEIKEEEEI

SEQ ID NO: 2450985 - protein, 17 aa, Entamoeba dispar
PETRPALKDRVDLDDDE

SEQ ID NO: 2450986 - protein, 7 aa, Entamoeba dispar
PETSQLQ

SEQ ID NO: 2450987 - protein, 10 aa, Entamoeba dispar
PETVDGEEVQ

SEQ ID NO: 2450988 - protein, 7 aa, Entamoeba dispar
PETWSPS

SEQ ID NO: 2450989 - protein, 4 aa, Entamoeba dispar
PEVE

SEQ ID NO: 2450990 - protein, 12 aa, Entamoeba dispar
PEVIPGSTKDAF

SEQ ID NO: 2450991 - protein, 11 aa, Entamoeba dispar
PEVNKEEYTSK

SEQ ID NO: 2450992 - protein, 5 aa, Entamoeba dispar
PEVPE

SEQ ID NO: 2450993 - protein, 6 aa, Entamoeba dispar
PEVPSN

SEQ ID NO: 2450994 - protein, 7 aa, Entamoeba dispar
PEVSPKV

SEQ ID NO: 2450995 - protein, 9 aa, Entamoeba dispar
PEVSQEQKR

SEQ ID NO: 2450996 - protein, 49 aa, Entamoeba dispar
PEYSNSQKQQFVQSSPQQPSPSQTLQQTSNSSDDRKQSEPNTQPTYNPY

SEQ ID NO: 2450997 - protein, 16 aa, Entamoeba dispar
PFANSNNTNDSIPPPV

SEQ ID NO: 2450998 - protein, 5 aa, Entamoeba dispar
PFARG

SEQ ID NO: 2450999 - protein, 12 aa, Entamoeba dispar
PFDEKRHKSQTE

SEQ ID NO: 2451000 - protein, 10 aa, Entamoeba dispar
PFDETSNLTP

SEQ ID NO: 2451001 - protein, 6 aa, Entamoeba dispar
PFDPVT

SEQ ID NO: 2451002 - protein, 10 aa, Entamoeba dispar
PFEDDEDPIE

SEQ ID NO: 2451003 - protein, 7 aa, Entamoeba dispar
PFEEDST

SEQ ID NO: 2451004 - protein, 9 aa, Entamoeba dispar
PFEEGNKKE

SEQ ID NO: 2451005 - protein, 10 aa, Entamoeba dispar
PFEESRKKIT

SEQ ID NO: 2451006 - protein, 14 aa, Entamoeba dispar
PFEGSNNSRTEEEI

SEQ ID NO: 2451007 - protein, 11 aa, Entamoeba dispar
PFEGVNGSGKH

SEQ ID NO: 2451008 - protein, 7 aa, Entamoeba dispar
PFESSPK

SEQ ID NO: 2451009 - protein, 4 aa, Entamoeba dispar
PFET

SEQ ID NO: 2451010 - protein, 6 aa, Entamoeba dispar
PFGAPY

SEQ ID NO: 2451011 - protein, 13 aa, Entamoeba dispar
PFGGKNDDMDIIY

SEQ ID NO: 2451012 - protein, 4 aa, Entamoeba dispar
PFGP

SEQ ID NO: 2451013 - protein, 4 aa, Entamoeba dispar
PFGR

SEQ ID NO: 2451014 - protein, 5 aa, Entamoeba dispar
PFGTT

SEQ ID NO: 2451015 - protein, 11 aa, Entamoeba dispar
PFINSEGDQVI

SEQ ID NO: 2451016 - protein, 9 aa, Entamoeba dispar
PFKENYSST

SEQ ID NO: 2451017 - protein, 10 aa, Entamoeba dispar
PFKGHSVNSI

SEQ ID NO: 2451018 - protein, 20 aa, Entamoeba dispar
PFKKTARKEQNIPEKESIQV

SEQ ID NO: 2451019 - protein, 4 aa, Entamoeba dispar
PFKM

SEQ ID NO: 2451020 - protein, 22 aa, Entamoeba dispar
PFKTKQERSSANNYYNGTGIPG

SEQ ID NO: 2451021 - protein, 8 aa, Entamoeba dispar
PFNASTPE

SEQ ID NO: 2451022 - protein, 9 aa, Entamoeba dispar
PFNDKTPEA

SEQ ID NO: 2451023 - protein, 9 aa, Entamoeba dispar
PFNQIDESE

SEQ ID NO: 2451024 - protein, 10 aa, Entamoeba dispar
PFNSPDENGM

SEQ ID NO: 2451025 - protein, 8 aa, Entamoeba dispar
PFNSSTRE

SEQ ID NO: 2451026 - protein, 5 aa, Entamoeba dispar
PFNTE

SEQ ID NO: 2451027 - protein, 5 aa, Entamoeba dispar
PFPKT

SEQ ID NO: 2451028 - protein, 10 aa, Entamoeba dispar
PFPKTSYPHP

SEQ ID NO: 2451029 - protein, 4 aa, Entamoeba dispar
PFPP

SEQ ID NO: 2451030 - protein, 10 aa, Entamoeba dispar
PFPPSNYKYD

SEQ ID NO: 2451031 - protein, 6 aa, Entamoeba dispar
PFPQPW

SEQ ID NO: 2451032 - protein, 4 aa, Entamoeba dispar
PFPR

SEQ ID NO: 2451033 - protein, 5 aa, Entamoeba dispar
PFPSL

SEQ ID NO: 2451034 - protein, 12 aa, Entamoeba dispar
PFPTQSEDGNFG

SEQ ID NO: 2451035 - protein, 4 aa, Entamoeba dispar
PFQD

SEQ ID NO: 2451036 - protein, 5 aa, Entamoeba dispar
PFQGK

SEQ ID NO: 2451037 - protein, 10 aa, Entamoeba dispar
PFQKGEEEAY

SEQ ID NO: 2451038 - protein, 13 aa, Entamoeba dispar
PFQPLTNEQKNEI

SEQ ID NO: 2451039 - protein, 10 aa, Entamoeba dispar
PFQSDNGQKY

SEQ ID NO: 2451040 - protein, 10 aa, Entamoeba dispar
PFRGKSDKLT

SEQ ID NO: 2451041 - protein, 10 aa, Entamoeba dispar
PFRNNNVSSV

SEQ ID NO: 2451042 - protein, 4 aa, Entamoeba dispar
PFRQ

SEQ ID NO: 2451043 - protein, 9 aa, Entamoeba dispar
PFRQENSIE

SEQ ID NO: 2451044 - protein, 20 aa, Entamoeba dispar
PFRTNAENTRRQQIACIAAK

SEQ ID NO: 2451045 - protein, 4 aa, Entamoeba dispar
PFSD

SEQ ID NO: 2451046 - protein, 10 aa, Entamoeba dispar
PFSEDNDLLT

SEQ ID NO: 2451047 - protein, 5 aa, Entamoeba dispar
PFSPN

SEQ ID NO: 2451048 - protein, 12 aa, Entamoeba dispar
PFSPSDKLNESN

SEQ ID NO: 2451049 - protein, 7 aa, Entamoeba dispar
PFSPSSV

SEQ ID NO: 2451050 - protein, 4 aa, Entamoeba dispar
PFSS

SEQ ID NO: 2451051 - protein, 5 aa, Entamoeba dispar
PFSSS

SEQ ID NO: 2451052 - protein, 12 aa, Entamoeba dispar
PFSTTKKEFYSQ

SEQ ID NO: 2451053 - protein, 6 aa, Entamoeba dispar
PFTDKS

SEQ ID NO: 2451054 - protein, 5 aa, Entamoeba dispar
PFTGR

SEQ ID NO: 2451055 - protein, 5 aa, Entamoeba dispar
PFTME

SEQ ID NO: 2451056 - protein, 6 aa, Entamoeba dispar
PFTNPN

SEQ ID NO: 2451057 - protein, 4 aa, Entamoeba dispar
PFTP

SEQ ID NO: 2451058 - protein, 4 aa, Entamoeba dispar
PFTS

SEQ ID NO: 2451059 - protein, 10 aa, Entamoeba dispar
PFTSQPKEVV

SEQ ID NO: 2451060 - protein, 6 aa, Entamoeba dispar
PFTTKS

SEQ ID NO: 2451061 - protein, 12 aa, Entamoeba dispar
PFYPQPEKNKNE

SEQ ID NO: 2451062 - protein, 7 aa, Entamoeba dispar
PGADPRE

SEQ ID NO: 2451063 - protein, 6 aa, Entamoeba dispar
PGAFPD

SEQ ID NO: 2451064 - protein, 11 aa, Entamoeba dispar
PGAGKKKKKGI

SEQ ID NO: 2451065 - protein, 10 aa, Entamoeba dispar
PGAKGTEWEG

SEQ ID NO: 2451066 - protein, 4 aa, Entamoeba dispar
PGAR

SEQ ID NO: 2451067 - protein, 6 aa, Entamoeba dispar
PGATQT

SEQ ID NO: 2451068 - protein, 5 aa, Entamoeba dispar
PGCGK

SEQ ID NO: 2451069 - protein, 6 aa, Entamoeba dispar
PGCGKT

SEQ ID NO: 2451070 - protein, 12 aa, Entamoeba dispar
PGCSKTTSINPD

SEQ ID NO: 2451071 - protein, 5 aa, Entamoeba dispar
PGCVP

SEQ ID NO: 2451072 - protein, 6 aa, Entamoeba dispar
PGDAAT

SEQ ID NO: 2451073 - protein, 8 aa, Entamoeba dispar
PGDFEKRS

SEQ ID NO: 2451074 - protein, 5 aa, Entamoeba dispar
PGDKI

SEQ ID NO: 2451075 - protein, 15 aa, Entamoeba dispar
PGDNDLTPVKSTDFP

SEQ ID NO: 2451076 - protein, 6 aa, Entamoeba dispar
PGDSEI

SEQ ID NO: 2451077 - protein, 8 aa, Entamoeba dispar
PGDSPYYP

SEQ ID NO: 2451078 - protein, 5 aa, Entamoeba dispar
PGDSS

SEQ ID NO: 2451079 - protein, 7 aa, Entamoeba dispar
PGEAEAQ

SEQ ID NO: 2451080 - protein, 6 aa, Entamoeba dispar
PGEELP

SEQ ID NO: 2451081 - protein, 15 aa, Entamoeba dispar
PGEEMTESYTPEQIE

SEQ ID NO: 2451082 - protein, 10 aa, Entamoeba dispar
PGESDQAPGI

SEQ ID NO: 2451083 - protein, 8 aa, Entamoeba dispar
PGETDEEF

SEQ ID NO: 2451084 - protein, 8 aa, Entamoeba dispar
PGETEDQR

SEQ ID NO: 2451085 - protein, 16 aa, Entamoeba dispar
PGETITSVPTSKCNNS

SEQ ID NO: 2451086 - protein, 7 aa, Entamoeba dispar
PGETKTI

SEQ ID NO: 2451087 - protein, 13 aa, Entamoeba dispar
PGEVASTAGTSGV

SEQ ID NO: 2451088 - protein, 6 aa, Entamoeba dispar
PGFGGQ

SEQ ID NO: 2451089 - protein, 5 aa, Entamoeba dispar
PGFGT

SEQ ID NO: 2451090 - protein, 17 aa, Entamoeba dispar
PGFNDSNGKEKEKKNIE

SEQ ID NO: 2451091 - protein, 13 aa, Entamoeba dispar
PGFNDTSSFDSKN

SEQ ID NO: 2451092 - protein, 15 aa, Entamoeba dispar
PGFQDSHGAETDTEH

SEQ ID NO: 2451093 - protein, 12 aa, Entamoeba dispar
PGFTSDSTPFTD

SEQ ID NO: 2451094 - protein, 11 aa, Entamoeba dispar
PGGEDDDTEGI

SEQ ID NO: 2451095 - protein, 4 aa, Entamoeba dispar
PGGS

SEQ ID NO: 2451096 - protein, 13 aa, Entamoeba dispar
PGGVSTEEIYDEN

SEQ ID NO: 2451097 - protein, 20 aa, Entamoeba dispar
PGHIGKNCPEQGVQESTDQV

SEQ ID NO: 2451098 - protein, 5 aa, Entamoeba dispar
PGHKD

SEQ ID NO: 2451099 - protein, 7 aa, Entamoeba dispar
PGHPDLT

SEQ ID NO: 2451100 - protein, 10 aa, Entamoeba dispar
PGIDKKTLSV

SEQ ID NO: 2451101 - protein, 15 aa, Entamoeba dispar
PGIDKRPWSSEEDEK

SEQ ID NO: 2451102 - protein, 8 aa, Entamoeba dispar
PGIFPKEA

SEQ ID NO: 2451103 - protein, 7 aa, Entamoeba dispar
PGIGKTT

SEQ ID NO: 2451104 - protein, 6 aa, Entamoeba dispar
PGIKEI

SEQ ID NO: 2451105 - protein, 8 aa, Entamoeba dispar
PGIKPNES

SEQ ID NO: 2451106 - protein, 4 aa, Entamoeba dispar
PGIP

SEQ ID NO: 2451107 - protein, 6 aa, Entamoeba dispar
PGIPTP

SEQ ID NO: 2451108 - protein, 13 aa, Entamoeba dispar
PGIQDSSEMDENQ

SEQ ID NO: 2451109 - protein, 13 aa, Entamoeba dispar
PGIQESGEMDENK

SEQ ID NO: 2451110 - protein, 5 aa, Entamoeba dispar
PGISN

SEQ ID NO: 2451111 - protein, 4 aa, Entamoeba dispar
PGIT

SEQ ID NO: 2451112 - protein, 5 aa, Entamoeba dispar
PGITE

SEQ ID NO: 2451113 - protein, 6 aa, Entamoeba dispar
PGIVSG

SEQ ID NO: 2451114 - protein, 5 aa, Entamoeba dispar
PGKEY

SEQ ID NO: 2451115 - protein, 10 aa, Entamoeba dispar
PGKKGVKPED

SEQ ID NO: 2451116 - protein, 9 aa, Entamoeba dispar
PGKQDDIDG

SEQ ID NO: 2451117 - protein, 7 aa, Entamoeba dispar
PGKSAET

SEQ ID NO: 2451118 - protein, 10 aa, Entamoeba dispar
PGKSDEPEIT

SEQ ID NO: 2451119 - protein, 14 aa, Entamoeba dispar
PGKTIGAPTLEQAG

SEQ ID NO: 2451120 - protein, 4 aa, Entamoeba dispar
PGKV

SEQ ID NO: 2451121 - protein, 11 aa, Entamoeba dispar
PGKYPALTQSS

SEQ ID NO: 2451122 - protein, 4 aa, Entamoeba dispar
PGLD

SEQ ID NO: 2451123 - protein, 4 aa, Entamoeba dispar
PGLE

SEQ ID NO: 2451124 - protein, 6 aa, Entamoeba dispar
PGLERE

SEQ ID NO: 2451125 - protein, 9 aa, Entamoeba dispar
PGLGRDESV

SEQ ID NO: 2451126 - protein, 8 aa, Entamoeba dispar
PGLKPQNM

SEQ ID NO: 2451127 - protein, 13 aa, Entamoeba dispar
PGLNDTSGFDSKN

SEQ ID NO: 2451128 - protein, 13 aa, Entamoeba dispar
PGLPKKYDENVEN

SEQ ID NO: 2451129 - protein, 7 aa, Entamoeba dispar
PGLPSRL

SEQ ID NO: 2451130 - protein, 13 aa, Entamoeba dispar
PGLQDPEGRERQY

SEQ ID NO: 2451131 - protein, 13 aa, Entamoeba dispar
PGLQDSEGRGKQY

SEQ ID NO: 2451132 - protein, 16 aa, Entamoeba dispar
PGLQDSGGLDKDRQHM

SEQ ID NO: 2451133 - protein, 14 aa, Entamoeba dispar
PGLQDSSEMDESEL

SEQ ID NO: 2451134 - protein, 13 aa, Entamoeba dispar
PGLQDSSGPNKDI

SEQ ID NO: 2451135 - protein, 12 aa, Entamoeba dispar
PGLQDSVEVNEN

SEQ ID NO: 2451136 - protein, 14 aa, Entamoeba dispar
PGLQEQPSSTPRFK

SEQ ID NO: 2451137 - protein, 14 aa, Entamoeba dispar
PGLTSAGGKLPDDI

SEQ ID NO: 2451138 - protein, 8 aa, Entamoeba dispar
PGNDTEKV

SEQ ID NO: 2451139 - protein, 4 aa, Entamoeba dispar
PGNI

SEQ ID NO: 2451140 - protein, 19 aa, Entamoeba dispar
PGNIKEESEENDTTSSSAL

SEQ ID NO: 2451141 - protein, 5 aa, Entamoeba dispar
PGNKY

SEQ ID NO: 2451142 - protein, 8 aa, Entamoeba dispar
PGNNGGDG

SEQ ID NO: 2451143 - protein, 7 aa, Entamoeba dispar
PGNNGGF

SEQ ID NO: 2451144 - protein, 6 aa, Entamoeba dispar
PGNPCG

SEQ ID NO: 2451145 - protein, 7 aa, Entamoeba dispar
PGNPTGQ

SEQ ID NO: 2451146 - protein, 8 aa, Entamoeba dispar
PGNPTTGY

SEQ ID NO: 2451147 - protein, 7 aa, Entamoeba dispar
PGNRKAE

SEQ ID NO: 2451148 - protein, 8 aa, Entamoeba dispar
PGNRPTNS

SEQ ID NO: 2451149 - protein, 5 aa, Entamoeba dispar
PGNSE

SEQ ID NO: 2451150 - protein, 7 aa, Entamoeba dispar
PGNSEYN

SEQ ID NO: 2451151 - protein, 9 aa, Entamoeba dispar
PGPDMNSVG

SEQ ID NO: 2451152 - protein, 6 aa, Entamoeba dispar
PGPLPL

SEQ ID NO: 2451153 - protein, 7 aa, Entamoeba dispar
PGQGKYF

SEQ ID NO: 2451154 - protein, 17 aa, Entamoeba dispar
PGQIPSSGGVQQQPPHV

SEQ ID NO: 2451155 - protein, 11 aa, Entamoeba dispar
PGQNDSDEELK

SEQ ID NO: 2451156 - protein, 5 aa, Entamoeba dispar
PGQPF

SEQ ID NO: 2451157 - protein, 4 aa, Entamoeba dispar
PGQY

SEQ ID NO: 2451158 - protein, 9 aa, Entamoeba dispar
PGRAPNSIK

SEQ ID NO: 2451159 - protein, 10 aa, Entamoeba dispar
PGRTANQVKN

SEQ ID NO: 2451160 - protein, 5 aa, Entamoeba dispar
PGSDT

SEQ ID NO: 2451161 - protein, 5 aa, Entamoeba dispar
PGSGE

SEQ ID NO: 2451162 - protein, 5 aa, Entamoeba dispar
PGSGL

SEQ ID NO: 2451163 - protein, 9 aa, Entamoeba dispar
PGSHTMTKE

SEQ ID NO: 2451164 - protein, 5 aa, Entamoeba dispar
PGSIL

SEQ ID NO: 2451165 - protein, 13 aa, Entamoeba dispar
PGSRERKKGYISE

SEQ ID NO: 2451166 - protein, 8 aa, Entamoeba dispar
PGSSEYNE

SEQ ID NO: 2451167 - protein, 8 aa, Entamoeba dispar
PGSSEYNQ

SEQ ID NO: 2451168 - protein, 4 aa, Entamoeba dispar
PGTE

SEQ ID NO: 2451169 - protein, 4 aa, Entamoeba dispar
PGTI

SEQ ID NO: 2451170 - protein, 8 aa, Entamoeba dispar
PGTKNNER

SEQ ID NO: 2451171 - protein, 8 aa, Entamoeba dispar
PGTLGNSK

SEQ ID NO: 2451172 - protein, 11 aa, Entamoeba dispar
PGTPAAKMKQI

SEQ ID NO: 2451173 - protein, 13 aa, Entamoeba dispar
PGTPNYSSSAGRC

SEQ ID NO: 2451174 - protein, 10 aa, Entamoeba dispar
PGTSPSDISF

SEQ ID NO: 2451175 - protein, 9 aa, Entamoeba dispar
PGTYKANSE

SEQ ID NO: 2451176 - protein, 8 aa, Entamoeba dispar
PGVGGDRS

SEQ ID NO: 2451177 - protein, 4 aa, Entamoeba dispar
PGVP

SEQ ID NO: 2451178 - protein, 7 aa, Entamoeba dispar
PGVPPER

SEQ ID NO: 2451179 - protein, 11 aa, Entamoeba dispar
PGVQDSEGMDT

SEQ ID NO: 2451180 - protein, 4 aa, Entamoeba dispar
PGVS

SEQ ID NO: 2451181 - protein, 4 aa, Entamoeba dispar
PGYD

SEQ ID NO: 2451182 - protein, 4 aa, Entamoeba dispar
PGYI

SEQ ID NO: 2451183 - protein, 5 aa, Entamoeba dispar
PHAQF

SEQ ID NO: 2451184 - protein, 4 aa, Entamoeba dispar
PHCP

SEQ ID NO: 2451185 - protein, 5 aa, Entamoeba dispar
PHEER

SEQ ID NO: 2451186 - protein, 12 aa, Entamoeba dispar
PHEKRDNELEGK

SEQ ID NO: 2451187 - protein, 14 aa, Entamoeba dispar
PHENSSETVSDDKI

SEQ ID NO: 2451188 - protein, 7 aa, Entamoeba dispar
PHFPSSI

SEQ ID NO: 2451189 - protein, 8 aa, Entamoeba dispar
PHGEFNED

SEQ ID NO: 2451190 - protein, 4 aa, Entamoeba dispar
PHGI

SEQ ID NO: 2451191 - protein, 4 aa, Entamoeba dispar
PHGN

SEQ ID NO: 2451192 - protein, 8 aa, Entamoeba dispar
PHGSLDNY

SEQ ID NO: 2451193 - protein, 13 aa, Entamoeba dispar
PHGYPQQSYPYPQ

SEQ ID NO: 2451194 - protein, 11 aa, Entamoeba dispar
PHHESTPEAYY

SEQ ID NO: 2451195 - protein, 6 aa, Entamoeba dispar
PHHTTA

SEQ ID NO: 2451196 - protein, 4 aa, Entamoeba dispar
PHIS

SEQ ID NO: 2451197 - protein, 21 aa, Entamoeba dispar
PHKGNGGAVCGNDGGVWGRSE

SEQ ID NO: 2451198 - protein, 8 aa, Entamoeba dispar
PHKKTEDT

SEQ ID NO: 2451199 - protein, 8 aa, Entamoeba dispar
PHLPKGDI

SEQ ID NO: 2451200 - protein, 4 aa, Entamoeba dispar
PHLS

SEQ ID NO: 2451201 - protein, 6 aa, Entamoeba dispar
PHPDDD

SEQ ID NO: 2451202 - protein, 21 aa, Entamoeba dispar
PHPDTDRIEHQKQIEKAKGYD

SEQ ID NO: 2451203 - protein, 12 aa, Entamoeba dispar
PHPKRNTSKTQF

SEQ ID NO: 2451204 - protein, 4 aa, Entamoeba dispar
PHPP

SEQ ID NO: 2451205 - protein, 5 aa, Entamoeba dispar
PHPTF

SEQ ID NO: 2451206 - protein, 5 aa, Entamoeba dispar
PHQKA

SEQ ID NO: 2451207 - protein, 7 aa, Entamoeba dispar
PHQLTSN

SEQ ID NO: 2451208 - protein, 13 aa, Entamoeba dispar
PHRGKGSSKNSSL

SEQ ID NO: 2451209 - protein, 5 aa, Entamoeba dispar
PHRID

SEQ ID NO: 2451210 - protein, 7 aa, Entamoeba dispar
PHRNSRL

SEQ ID NO: 2451211 - protein, 6 aa, Entamoeba dispar
PHSETY

SEQ ID NO: 2451212 - protein, 4 aa, Entamoeba dispar
PHSF

SEQ ID NO: 2451213 - protein, 10 aa, Entamoeba dispar
PHSINTTPSA

SEQ ID NO: 2451214 - protein, 11 aa, Entamoeba dispar
PHSKDEEKDFM

SEQ ID NO: 2451215 - protein, 7 aa, Entamoeba dispar
PHSNTVQ

SEQ ID NO: 2451216 - protein, 10 aa, Entamoeba dispar
PHSQTQNSQM

SEQ ID NO: 2451217 - protein, 6 aa, Entamoeba dispar
PHSRIQ

SEQ ID NO: 2451218 - protein, 4 aa, Entamoeba dispar
PHTA

SEQ ID NO: 2451219 - protein, 20 aa, Entamoeba dispar
PHTEEPMDSKGKKDKKDKKK

SEQ ID NO: 2451220 - protein, 4 aa, Entamoeba dispar
PHTN

SEQ ID NO: 2451221 - protein, 17 aa, Entamoeba dispar
PHTSTNNTLVSDSSLNN

SEQ ID NO: 2451222 - protein, 4 aa, Entamoeba dispar
PIAL

SEQ ID NO: 2451223 - protein, 5 aa, Entamoeba dispar
PIAND

SEQ ID NO: 2451224 - protein, 10 aa, Entamoeba dispar
PIASDKIPEK

SEQ ID NO: 2451225 - protein, 17 aa, Entamoeba dispar
PIATSVNQQQQQPTTAI

SEQ ID NO: 2451226 - protein, 13 aa, Entamoeba dispar
PIDEKEISKLSGE

SEQ ID NO: 2451227 - protein, 12 aa, Entamoeba dispar
PIDENDAGEEQV

SEQ ID NO: 2451228 - protein, 12 aa, Entamoeba dispar
PIDENDASKEQV

SEQ ID NO: 2451229 - protein, 12 aa, Entamoeba dispar
PIDENKEKGRRE

SEQ ID NO: 2451230 - protein, 16 aa, Entamoeba dispar
PIDKEEINKLSGEYKE

SEQ ID NO: 2451231 - protein, 8 aa, Entamoeba dispar
PIDKTGNG

SEQ ID NO: 2451232 - protein, 10 aa, Entamoeba dispar
PIDNSLKESA

SEQ ID NO: 2451233 - protein, 6 aa, Entamoeba dispar
PIDPTM

SEQ ID NO: 2451234 - protein, 10 aa, Entamoeba dispar
PIDSEESDEM

SEQ ID NO: 2451235 - protein, 10 aa, Entamoeba dispar
PIDSKEEQFR

SEQ ID NO: 2451236 - protein, 16 aa, Entamoeba dispar
PIDSTKKKYIKGKKNP

SEQ ID NO: 2451237 - protein, 31 aa, Entamoeba dispar
PIEASVNSSAHESQRMNEENRLDSSKTEAEI

SEQ ID NO: 2451238 - protein, 6 aa, Entamoeba dispar
PIEDAN

SEQ ID NO: 2451239 - protein, 5 aa, Entamoeba dispar
PIEDT

SEQ ID NO: 2451240 - protein, 8 aa, Entamoeba dispar
PIEEEAEV

SEQ ID NO: 2451241 - protein, 10 aa, Entamoeba dispar
PIEENKEHPV

SEQ ID NO: 2451242 - protein, 5 aa, Entamoeba dispar
PIEEP

SEQ ID NO: 2451243 - protein, 10 aa, Entamoeba dispar
PIEESEEKTL

SEQ ID NO: 2451244 - protein, 4 aa, Entamoeba dispar
PIEG

SEQ ID NO: 2451245 - protein, 5 aa, Entamoeba dispar
PIEGN

SEQ ID NO: 2451246 - protein, 13 aa, Entamoeba dispar
PIEGYQKNGRYIN

SEQ ID NO: 2451247 - protein, 11 aa, Entamoeba dispar
PIEKEQSKSEQ

SEQ ID NO: 2451248 - protein, 8 aa, Entamoeba dispar
PIEKNGGC

SEQ ID NO: 2451249 - protein, 11 aa, Entamoeba dispar
PIEKPKKGISV

SEQ ID NO: 2451250 - protein, 4 aa, Entamoeba dispar
PIEN

SEQ ID NO: 2451251 - protein, 10 aa, Entamoeba dispar
PIENKIPTSI

SEQ ID NO: 2451252 - protein, 7 aa, Entamoeba dispar
PIENPSK

SEQ ID NO: 2451253 - protein, 4 aa, Entamoeba dispar
PIEP

SEQ ID NO: 2451254 - protein, 45 aa, Entamoeba dispar
PIEQPQPIEQPQPIEQPQPIEQPQPIEQPQPIEQPQPIEQPQPQN

SEQ ID NO: 2451255 - protein, 7 aa, Entamoeba dispar
PIEQRRK

SEQ ID NO: 2451256 - protein, 10 aa, Entamoeba dispar
PIESEESLTI

SEQ ID NO: 2451257 - protein, 8 aa, Entamoeba dispar
PIESEGLN

SEQ ID NO: 2451258 - protein, 8 aa, Entamoeba dispar
PIESTNKC

SEQ ID NO: 2451259 - protein, 7 aa, Entamoeba dispar
PIETRGS

SEQ ID NO: 2451260 - protein, 8 aa, Entamoeba dispar
PIEVEGEN

SEQ ID NO: 2451261 - protein, 8 aa, Entamoeba dispar
PIGDNSSN

SEQ ID NO: 2451262 - protein, 13 aa, Entamoeba dispar
PIGGGQDNDTGKI

SEQ ID NO: 2451263 - protein, 5 aa, Entamoeba dispar
PIGKT

SEQ ID NO: 2451264 - protein, 5 aa, Entamoeba dispar
PIGRK

SEQ ID NO: 2451265 - protein, 4 aa, Entamoeba dispar
PIGS

SEQ ID NO: 2451266 - protein, 6 aa, Entamoeba dispar
PIGSDG

SEQ ID NO: 2451267 - protein, 5 aa, Entamoeba dispar
PIGSG

SEQ ID NO: 2451268 - protein, 14 aa, Entamoeba dispar
PIGSKEDVSSGKGI

SEQ ID NO: 2451269 - protein, 5 aa, Entamoeba dispar
PIGTH

SEQ ID NO: 2451270 - protein, 10 aa, Entamoeba dispar
PIHRASQADR

SEQ ID NO: 2451271 - protein, 4 aa, Entamoeba dispar
PIIS

SEQ ID NO: 2451272 - protein, 10 aa, Entamoeba dispar
PIISPNSGFE

SEQ ID NO: 2451273 - protein, 4 aa, Entamoeba dispar
PIKE

SEQ ID NO: 2451274 - protein, 9 aa, Entamoeba dispar
PIKEEKNEL

SEQ ID NO: 2451275 - protein, 10 aa, Entamoeba dispar
PIKESYDNGD

SEQ ID NO: 2451276 - protein, 34 aa, Entamoeba dispar
PIKETYTEEEIKSPTIKEPKELDQKITSEQKENE

SEQ ID NO: 2451277 - protein, 11 aa, Entamoeba dispar
PIKGRKRGGGI

SEQ ID NO: 2451278 - protein, 5 aa, Entamoeba dispar
PIKGS

SEQ ID NO: 2451279 - protein, 14 aa, Entamoeba dispar
PIKKETSLITNTTR

SEQ ID NO: 2451280 - protein, 24 aa, Entamoeba dispar
PIKNDDKKKSQTSLKVENKTDDWG

SEQ ID NO: 2451281 - protein, 7 aa, Entamoeba dispar
PIKPISQ

SEQ ID NO: 2451282 - protein, 7 aa, Entamoeba dispar
PIKPRRI

SEQ ID NO: 2451283 - protein, 39 aa, Entamoeba dispar
PIKSTSKADSHRKTKLNKSCSETKPKKLSKVKKESKKFA

SEQ ID NO: 2451284 - protein, 4 aa, Entamoeba dispar
PIKT

SEQ ID NO: 2451285 - protein, 46 aa, Entamoeba dispar
PINCTTPPLPPELNNKQTSKSCITKPTDGGCKRPQHDLPPIEPRHI

SEQ ID NO: 2451286 - protein, 7 aa, Entamoeba dispar
PINDRKS

SEQ ID NO: 2451287 - protein, 8 aa, Entamoeba dispar
PINDTSEV

SEQ ID NO: 2451288 - protein, 4 aa, Entamoeba dispar
PINE

SEQ ID NO: 2451289 - protein, 8 aa, Entamoeba dispar
PINKRKGY

SEQ ID NO: 2451290 - protein, 7 aa, Entamoeba dispar
PINNNNT

SEQ ID NO: 2451291 - protein, 5 aa, Entamoeba dispar
PINQK

SEQ ID NO: 2451292 - protein, 5 aa, Entamoeba dispar
PINQN

SEQ ID NO: 2451293 - protein, 9 aa, Entamoeba dispar
PINQQQKVS

SEQ ID NO: 2451294 - protein, 8 aa, Entamoeba dispar
PINSEHQY

SEQ ID NO: 2451295 - protein, 24 aa, Entamoeba dispar
PINSKQKENEIKYNNYSRKNQTKS

SEQ ID NO: 2451296 - protein, 8 aa, Entamoeba dispar
PINTNGQS

SEQ ID NO: 2451297 - protein, 25 aa, Entamoeba dispar
PINTNSFSTQQINTRGYPRPVSATG

SEQ ID NO: 2451298 - protein, 11 aa, Entamoeba dispar
PINVNKKEKEE

SEQ ID NO: 2451299 - protein, 5 aa, Entamoeba dispar
PIPAI

SEQ ID NO: 2451300 - protein, 8 aa, Entamoeba dispar
PIPEIQRS

SEQ ID NO: 2451301 - protein, 7 aa, Entamoeba dispar
PIPLPSR

SEQ ID NO: 2451302 - protein, 4 aa, Entamoeba dispar
PIPN

SEQ ID NO: 2451303 - protein, 14 aa, Entamoeba dispar
PIPNAPLKPGKGID

SEQ ID NO: 2451304 - protein, 7 aa, Entamoeba dispar
PIPNELT

SEQ ID NO: 2451305 - protein, 6 aa, Entamoeba dispar
PIPPTK

SEQ ID NO: 2451306 - protein, 4 aa, Entamoeba dispar
PIPQ

SEQ ID NO: 2451307 - protein, 27 aa, Entamoeba dispar
PIPQKLSTKSSSSSSDEETDQMTYSGR

SEQ ID NO: 2451308 - protein, 4 aa, Entamoeba dispar
PIPS

SEQ ID NO: 2451309 - protein, 8 aa, Entamoeba dispar
PIPSPIST

SEQ ID NO: 2451310 - protein, 11 aa, Entamoeba dispar
PIPSQGSHESH

SEQ ID NO: 2451311 - protein, 10 aa, Entamoeba dispar
PIPSQPSTGH

SEQ ID NO: 2451312 - protein, 6 aa, Entamoeba dispar
PIPSTT

SEQ ID NO: 2451313 - protein, 7 aa, Entamoeba dispar
PIPTPKT

SEQ ID NO: 2451314 - protein, 5 aa, Entamoeba dispar
PIPTQ

SEQ ID NO: 2451315 - protein, 5 aa, Entamoeba dispar
PIPYT

SEQ ID NO: 2451316 - protein, 10 aa, Entamoeba dispar
PIQGGAGTSL

SEQ ID NO: 2451317 - protein, 7 aa, Entamoeba dispar
PIQHSGE

SEQ ID NO: 2451318 - protein, 4 aa, Entamoeba dispar
PIQL

SEQ ID NO: 2451319 - protein, 7 aa, Entamoeba dispar
PIQNEKK

SEQ ID NO: 2451320 - protein, 5 aa, Entamoeba dispar
PIQPI

SEQ ID NO: 2451321 - protein, 12 aa, Entamoeba dispar
PIQRGKNPPEQR

SEQ ID NO: 2451322 - protein, 6 aa, Entamoeba dispar
PIQSSY

SEQ ID NO: 2451323 - protein, 4 aa, Entamoeba dispar
PIQT

SEQ ID NO: 2451324 - protein, 8 aa, Entamoeba dispar
PIQTQRSQ

SEQ ID NO: 2451325 - protein, 12 aa, Entamoeba dispar
PISASESLRGGG

SEQ ID NO: 2451326 - protein, 5 aa, Entamoeba dispar
PISEP

SEQ ID NO: 2451327 - protein, 25 aa, Entamoeba dispar
PISGQTMGTSGLRKRASEVENTPNY

SEQ ID NO: 2451328 - protein, 7 aa, Entamoeba dispar
PISIEGN

SEQ ID NO: 2451329 - protein, 4 aa, Entamoeba dispar
PISK

SEQ ID NO: 2451330 - protein, 7 aa, Entamoeba dispar
PISNENN

SEQ ID NO: 2451331 - protein, 8 aa, Entamoeba dispar
PISNTTPL

SEQ ID NO: 2451332 - protein, 7 aa, Entamoeba dispar
PISPGDE

SEQ ID NO: 2451333 - protein, 16 aa, Entamoeba dispar
PISPSQDSTNSSTELN

SEQ ID NO: 2451334 - protein, 5 aa, Entamoeba dispar
PISQE

SEQ ID NO: 2451335 - protein, 36 aa, Entamoeba dispar
PISQNSQNTLPTAQRHSITSELEKDDDNKQQINEDE

SEQ ID NO: 2451336 - protein, 10 aa, Entamoeba dispar
PISRNGTTKF

SEQ ID NO: 2451337 - protein, 15 aa, Entamoeba dispar
PISSSEFDKRCENSG

SEQ ID NO: 2451338 - protein, 16 aa, Entamoeba dispar
PISTETINSWKNEESL

SEQ ID NO: 2451339 - protein, 14 aa, Entamoeba dispar
PISTVGSSQYKPNI

SEQ ID NO: 2451340 - protein, 21 aa, Entamoeba dispar
PITEKGDKDHCGKCGKEVSSG

SEQ ID NO: 2451341 - protein, 5 aa, Entamoeba dispar
PITGE

SEQ ID NO: 2451342 - protein, 13 aa, Entamoeba dispar
PITIGKKASDVTE

SEQ ID NO: 2451343 - protein, 7 aa, Entamoeba dispar
PITNDTN

SEQ ID NO: 2451344 - protein, 6 aa, Entamoeba dispar
PITPPL

SEQ ID NO: 2451345 - protein, 7 aa, Entamoeba dispar
PITPSPV

SEQ ID NO: 2451346 - protein, 8 aa, Entamoeba dispar
PITPSPVE

SEQ ID NO: 2451347 - protein, 9 aa, Entamoeba dispar
PITPTPLSN

SEQ ID NO: 2451348 - protein, 11 aa, Entamoeba dispar
PITQKDKENNL

SEQ ID NO: 2451349 - protein, 7 aa, Entamoeba dispar
PITQTSS

SEQ ID NO: 2451350 - protein, 17 aa, Entamoeba dispar
PITSKDNEKKPKKVELD

SEQ ID NO: 2451351 - protein, 23 aa, Entamoeba dispar
PITSKKDKTTKENNYPADLDDED

SEQ ID NO: 2451352 - protein, 20 aa, Entamoeba dispar
PITSPSTPTGNMNRDNENND

SEQ ID NO: 2451353 - protein, 11 aa, Entamoeba dispar
PITSSPNIYTS

SEQ ID NO: 2451354 - protein, 19 aa, Entamoeba dispar
PITTPNLGQGHIPTTSQIR

SEQ ID NO: 2451355 - protein, 24 aa, Entamoeba dispar
PITTPSSVETKPSETKQPSNELSE

SEQ ID NO: 2451356 - protein, 10 aa, Entamoeba dispar
PIVSEKAGER

SEQ ID NO: 2451357 - protein, 11 aa, Entamoeba dispar
PIYPSEEPYCE

SEQ ID NO: 2451358 - protein, 4 aa, Entamoeba dispar
PIYV

SEQ ID NO: 2451359 - protein, 17 aa, Entamoeba dispar
PKAAKGYSANAIKERQI

SEQ ID NO: 2451360 - protein, 25 aa, Entamoeba dispar
  misc_feature (15)..(16): Xaa can be any naturally occurring amino acid
PKAEKRMKELKEQNXXKYSFSSFNS

SEQ ID NO: 2451361 - protein, 13 aa, Entamoeba dispar
PKALSEHKHGTTT

SEQ ID NO: 2451362 - protein, 6 aa, Entamoeba dispar
PKANAS

SEQ ID NO: 2451363 - protein, 7 aa, Entamoeba dispar
PKAPRSF

SEQ ID NO: 2451364 - protein, 10 aa, Entamoeba dispar
PKARKYSHIQ

SEQ ID NO: 2451365 - protein, 8 aa, Entamoeba dispar
PKASFNTY

SEQ ID NO: 2451366 - protein, 7 aa, Entamoeba dispar
PKASSLT

SEQ ID NO: 2451367 - protein, 9 aa, Entamoeba dispar
PKASTAESK

SEQ ID NO: 2451368 - protein, 7 aa, Entamoeba dispar
PKATSNS

SEQ ID NO: 2451369 - protein, 4 aa, Entamoeba dispar
PKAV

SEQ ID NO: 2451370 - protein, 12 aa, Entamoeba dispar
PKAVDAVSADEY

SEQ ID NO: 2451371 - protein, 4 aa, Entamoeba dispar
PKCK

SEQ ID NO: 2451372 - protein, 9 aa, Entamoeba dispar
PKCKDTKRK

SEQ ID NO: 2451373 - protein, 5 aa, Entamoeba dispar
PKCKG

SEQ ID NO: 2451374 - protein, 5 aa, Entamoeba dispar
PKCQS

SEQ ID NO: 2451375 - protein, 9 aa, Entamoeba dispar
PKDANGSVL

SEQ ID NO: 2451376 - protein, 14 aa, Entamoeba dispar
PKDAYYGAQTMRAT

SEQ ID NO: 2451377 - protein, 8 aa, Entamoeba dispar
PKDDSGLT

SEQ ID NO: 2451378 - protein, 9 aa, Entamoeba dispar
PKDDSNDNL

SEQ ID NO: 2451379 - protein, 10 aa, Entamoeba dispar
PKDEKYKITT

SEQ ID NO: 2451380 - protein, 7 aa, Entamoeba dispar
PKDENNI

SEQ ID NO: 2451381 - protein, 6 aa, Entamoeba dispar
PKDGQQ

SEQ ID NO: 2451382 - protein, 5 aa, Entamoeba dispar
PKDIN

SEQ ID NO: 2451383 - protein, 11 aa, Entamoeba dispar
PKDNAAEKPHL

SEQ ID NO: 2451384 - protein, 5 aa, Entamoeba dispar
PKDNE

SEQ ID NO: 2451385 - protein, 15 aa, Entamoeba dispar
PKDNEINKTDSLENH

SEQ ID NO: 2451386 - protein, 13 aa, Entamoeba dispar
PKDPIIPQSNPED

SEQ ID NO: 2451387 - protein, 5 aa, Entamoeba dispar
PKDQE

SEQ ID NO: 2451388 - protein, 10 aa, Entamoeba dispar
PKDQGKSAEE

SEQ ID NO: 2451389 - protein, 8 aa, Entamoeba dispar
PKDRNVSQ

SEQ ID NO: 2451390 - protein, 8 aa, Entamoeba dispar
PKDRPDTN

SEQ ID NO: 2451391 - protein, 5 aa, Entamoeba dispar
PKDSL

SEQ ID NO: 2451392 - protein, 8 aa, Entamoeba dispar
PKDSSEEE

SEQ ID NO: 2451393 - protein, 6 aa, Entamoeba dispar
PKDTIN

SEQ ID NO: 2451394 - protein, 9 aa, Entamoeba dispar
PKEAKRPTL

SEQ ID NO: 2451395 - protein, 5 aa, Entamoeba dispar
PKEAV

SEQ ID NO: 2451396 - protein, 4 aa, Entamoeba dispar
PKED

SEQ ID NO: 2451397 - protein, 7 aa, Entamoeba dispar
PKEEDMK

SEQ ID NO: 2451398 - protein, 12 aa, Entamoeba dispar
PKEEKKSFIETT

SEQ ID NO: 2451399 - protein, 7 aa, Entamoeba dispar
PKEENVT

SEQ ID NO: 2451400 - protein, 13 aa, Entamoeba dispar
PKEFKAKSKPKFA

SEQ ID NO: 2451401 - protein, 12 aa, Entamoeba dispar
PKEGDKNEIKIQ

SEQ ID NO: 2451402 - protein, 9 aa, Entamoeba dispar
PKEGDPSYP

SEQ ID NO: 2451403 - protein, 9 aa, Entamoeba dispar
PKEGKTSTL

SEQ ID NO: 2451404 - protein, 4 aa, Entamoeba dispar
PKEI

SEQ ID NO: 2451405 - protein, 10 aa, Entamoeba dispar
PKEKAQIADT

SEQ ID NO: 2451406 - protein, 6 aa, Entamoeba dispar
PKEKTL

SEQ ID NO: 2451407 - protein, 4 aa, Entamoeba dispar
PKEL

SEQ ID NO: 2451408 - protein, 7 aa, Entamoeba dispar
PKEMESK

SEQ ID NO: 2451409 - protein, 9 aa, Entamoeba dispar
PKENKYSTA

SEQ ID NO: 2451410 - protein, 15 aa, Entamoeba dispar
PKEPEEKSKADAAKA

SEQ ID NO: 2451411 - protein, 8 aa, Entamoeba dispar
PKEPLYSQ

SEQ ID NO: 2451412 - protein, 8 aa, Entamoeba dispar
PKEPSQAL

SEQ ID NO: 2451413 - protein, 6 aa, Entamoeba dispar
PKEQEE

SEQ ID NO: 2451414 - protein, 35 aa, Entamoeba dispar
PKEQNVDIQKKADEHKLKGNEYLNAKDYSKAIDEY

SEQ ID NO: 2451415 - protein, 4 aa, Entamoeba dispar
PKER

SEQ ID NO: 2451416 - protein, 8 aa, Entamoeba dispar
PKERKKEI

SEQ ID NO: 2451417 - protein, 13 aa, Entamoeba dispar
PKESAMKYASDNE

SEQ ID NO: 2451418 - protein, 7 aa, Entamoeba dispar
PKESKGF

SEQ ID NO: 2451419 - protein, 45 aa, Entamoeba dispar
PKETENNQKQQKQAKSNSQVTVGTKKVNQKKVGQKEKENSLKDEK

SEQ ID NO: 2451420 - protein, 5 aa, Entamoeba dispar
PKETR

SEQ ID NO: 2451421 - protein, 6 aa, Entamoeba dispar
PKETTK

SEQ ID NO: 2451422 - protein, 5 aa, Entamoeba dispar
PKETV

SEQ ID NO: 2451423 - protein, 4 aa, Entamoeba dispar
PKEV

SEQ ID NO: 2451424 - protein, 5 aa, Entamoeba dispar
PKEVG

SEQ ID NO: 2451425 - protein, 7 aa, Entamoeba dispar
PKEVGKF

SEQ ID NO: 2451426 - protein, 24 aa, Entamoeba dispar
PKEYGKLKEETGEKKKKKDEKKRE

SEQ ID NO: 2451427 - protein, 7 aa, Entamoeba dispar
PKEYPDF

SEQ ID NO: 2451428 - protein, 6 aa, Entamoeba dispar
PKEYQN

SEQ ID NO: 2451429 - protein, 7 aa, Entamoeba dispar
PKEYSES

SEQ ID NO: 2451430 - protein, 6 aa, Entamoeba dispar
PKFGDK

SEQ ID NO: 2451431 - protein, 4 aa, Entamoeba dispar
PKFT

SEQ ID NO: 2451432 - protein, 8 aa, Entamoeba dispar
PKGARALK

SEQ ID NO: 2451433 - protein, 4 aa, Entamoeba dispar
PKGG

SEQ ID NO: 2451434 - protein, 6 aa, Entamoeba dispar
PKGGGQ

SEQ ID NO: 2451435 - protein, 7 aa, Entamoeba dispar
PKGGSNI

SEQ ID NO: 2451436 - protein, 4 aa, Entamoeba dispar
PKGI

SEQ ID NO: 2451437 - protein, 5 aa, Entamoeba dispar
PKGIE

SEQ ID NO: 2451438 - protein, 7 aa, Entamoeba dispar
PKGISKI

SEQ ID NO: 2451439 - protein, 4 aa, Entamoeba dispar
PKGK

SEQ ID NO: 2451440 - protein, 9 aa, Entamoeba dispar
PKGNSSEAI

SEQ ID NO: 2451441 - protein, 7 aa, Entamoeba dispar
PKGRHDF

SEQ ID NO: 2451442 - protein, 6 aa, Entamoeba dispar
PKGTEI

SEQ ID NO: 2451443 - protein, 5 aa, Entamoeba dispar
PKGTI

SEQ ID NO: 2451444 - protein, 5 aa, Entamoeba dispar
PKGVS

SEQ ID NO: 2451445 - protein, 4 aa, Entamoeba dispar
PKGY

SEQ ID NO: 2451446 - protein, 15 aa, Entamoeba dispar
PKIANSFQNNTNQEK

SEQ ID NO: 2451447 - protein, 10 aa, Entamoeba dispar
PKIEEEITGK

SEQ ID NO: 2451448 - protein, 12 aa, Entamoeba dispar
PKIGPSTKTIGK

SEQ ID NO: 2451449 - protein, 4 aa, Entamoeba dispar
PKIK

SEQ ID NO: 2451450 - protein, 15 aa, Entamoeba dispar
PKIKESEESVGPEDK

SEQ ID NO: 2451451 - protein, 9 aa, Entamoeba dispar
PKIKSTSPQ

SEQ ID NO: 2451452 - protein, 5 aa, Entamoeba dispar
PKIKT

SEQ ID NO: 2451453 - protein, 4 aa, Entamoeba dispar
PKIN

SEQ ID NO: 2451454 - protein, 21 aa, Entamoeba dispar
PKINEQQTQKVDESKSINDEI

SEQ ID NO: 2451455 - protein, 4 aa, Entamoeba dispar
PKIP

SEQ ID NO: 2451456 - protein, 8 aa, Entamoeba dispar
PKIPKPVA

SEQ ID NO: 2451457 - protein, 5 aa, Entamoeba dispar
PKIPN

SEQ ID NO: 2451458 - protein, 4 aa, Entamoeba dispar
PKIS

SEQ ID NO: 2451459 - protein, 6 aa, Entamoeba dispar
PKISDK

SEQ ID NO: 2451460 - protein, 6 aa, Entamoeba dispar
PKISTL

SEQ ID NO: 2451461 - protein, 13 aa, Entamoeba dispar
PKITQIADGGASI

SEQ ID NO: 2451462 - protein, 9 aa, Entamoeba dispar
PKKAKGEDS

SEQ ID NO: 2451463 - protein, 4 aa, Entamoeba dispar
PKKD

SEQ ID NO: 2451464 - protein, 8 aa, Entamoeba dispar
PKKDDKIR

SEQ ID NO: 2451465 - protein, 20 aa, Entamoeba dispar
PKKDGDKSVGQEIKEKQERE

SEQ ID NO: 2451466 - protein, 4 aa, Entamoeba dispar
PKKE

SEQ ID NO: 2451467 - protein, 13 aa, Entamoeba dispar
PKKGKGKRFWSPE

SEQ ID NO: 2451468 - protein, 6 aa, Entamoeba dispar
PKKGTA

SEQ ID NO: 2451469 - protein, 12 aa, Entamoeba dispar
PKKHGRGGQSSV

SEQ ID NO: 2451470 - protein, 8 aa, Entamoeba dispar
PKKKKELK

SEQ ID NO: 2451471 - protein, 18 aa, Entamoeba dispar
PKKKREKKRNSSSRESVS

SEQ ID NO: 2451472 - protein, 14 aa, Entamoeba dispar
PKKKTDKKPLSVTN

SEQ ID NO: 2451473 - protein, 10 aa, Entamoeba dispar
PKKKVPKGTL

SEQ ID NO: 2451474 - protein, 15 aa, Entamoeba dispar
PKKLEKQMSSKKDEF

SEQ ID NO: 2451475 - protein, 14 aa, Entamoeba dispar
PKKLSLTSKNIRST

SEQ ID NO: 2451476 - protein, 4 aa, Entamoeba dispar
PKKM

SEQ ID NO: 2451477 - protein, 8 aa, Entamoeba dispar
PKKNEEKM

SEQ ID NO: 2451478 - protein, 5 aa, Entamoeba dispar
PKKNN

SEQ ID NO: 2451479 - protein, 8 aa, Entamoeba dispar
PKKNTPRV

SEQ ID NO: 2451480 - protein, 11 aa, Entamoeba dispar
PKKPIEEPDCQ

SEQ ID NO: 2451481 - protein, 10 aa, Entamoeba dispar
PKKPLSEELN

SEQ ID NO: 2451482 - protein, 7 aa, Entamoeba dispar
PKKPNNV

SEQ ID NO: 2451483 - protein, 13 aa, Entamoeba dispar
PKKPTSNKEESIS

SEQ ID NO: 2451484 - protein, 12 aa, Entamoeba dispar
PKKQHSESEVQL

SEQ ID NO: 2451485 - protein, 8 aa, Entamoeba dispar
PKKRSTVA

SEQ ID NO: 2451486 - protein, 7 aa, Entamoeba dispar
PKKSGGV

SEQ ID NO: 2451487 - protein, 8 aa, Entamoeba dispar
PKKSPEQF

SEQ ID NO: 2451488 - protein, 7 aa, Entamoeba dispar
PKKTKEK

SEQ ID NO: 2451489 - protein, 50 aa, Entamoeba dispar
PKKTKKNEKKHKKEEISSLEEKKKKDDDESKTKIPTKTSPKGDNRAHRRG

SEQ ID NO: 2451490 - protein, 104 aa, Entamoeba dispar
PKKTPPQPHQKGLPKPSVSAQSTPKVSFSKRPTKNMSSAMSTPHTETNPFDDSSDDEPKGVTTDSIKSSQSKNPFSDSDSNSKSPKVKNNSNTDGKGSSRHISP

SEQ ID NO: 2451491 - protein, 8 aa, Entamoeba dispar
PKKTQSKL

SEQ ID NO: 2451492 - protein, 8 aa, Entamoeba dispar
PKKTTTTS

SEQ ID NO: 2451493 - protein, 4 aa, Entamoeba dispar
PKKY

SEQ ID NO: 2451494 - protein, 15 aa, Entamoeba dispar
PKLAAEEADEAYKDV

SEQ ID NO: 2451495 - protein, 15 aa, Entamoeba dispar
PKLAAEEADGAYKDV

SEQ ID NO: 2451496 - protein, 47 aa, Entamoeba dispar
PKLASEERKSFPFPEHTKTPQRSKHSLSPTTKAMKPQRPSKKKVEQR

SEQ ID NO: 2451497 - protein, 6 aa, Entamoeba dispar
PKLCSG

SEQ ID NO: 2451498 - protein, 15 aa, Entamoeba dispar
PKLDDANKAGTKEGN

SEQ ID NO: 2451499 - protein, 51 aa, Entamoeba dispar
PKLDGNDSVESKKIKTLENEDSKRKVQKKSKTSEVQEDKKEKKAKKRKSLI

SEQ ID NO: 2451500 - protein, 6 aa, Entamoeba dispar
PKLGTN

SEQ ID NO: 2451501 - protein, 6 aa, Entamoeba dispar
PKLKKS

SEQ ID NO: 2451502 - protein, 7 aa, Entamoeba dispar
PKLKRTD

SEQ ID NO: 2451503 - protein, 6 aa, Entamoeba dispar
PKLPGY

SEQ ID NO: 2451504 - protein, 72 aa, Entamoeba dispar
PKLPISQQKERIKNAKKQTKNSKKKVKEVKKQQKQEIKKAKKDMKETKKVEKETKKLAKKELKDEKKMTKGL

SEQ ID NO: 2451505 - protein, 6 aa, Entamoeba dispar
PKLPKE

SEQ ID NO: 2451506 - protein, 11 aa, Entamoeba dispar
PKLPKEEPPYN

SEQ ID NO: 2451507 - protein, 7 aa, Entamoeba dispar
PKLSEPV

SEQ ID NO: 2451508 - protein, 9 aa, Entamoeba dispar
PKLSSGVVE

SEQ ID NO: 2451509 - protein, 27 aa, Entamoeba dispar
PKLTEEKTQKKDKKRPDSIDKESEPTL

SEQ ID NO: 2451510 - protein, 4 aa, Entamoeba dispar
PKMN

SEQ ID NO: 2451511 - protein, 8 aa, Entamoeba dispar
PKNDTTIY

SEQ ID NO: 2451512 - protein, 5 aa, Entamoeba dispar
PKNEF

SEQ ID NO: 2451513 - protein, 13 aa, Entamoeba dispar
PKNEKYSKKKYNG

SEQ ID NO: 2451514 - protein, 7 aa, Entamoeba dispar
PKNETLT

SEQ ID NO: 2451515 - protein, 8 aa, Entamoeba dispar
PKNGESAL

SEQ ID NO: 2451516 - protein, 8 aa, Entamoeba dispar
PKNGQPLR

SEQ ID NO: 2451517 - protein, 8 aa, Entamoeba dispar
PKNHCKTT

SEQ ID NO: 2451518 - protein, 128 aa, Entamoeba dispar
PKNKIKNEPKIEESKEEPKKEEHGERGNDKHEERKTHQSEKRDDRDKENKREDRDKESKREERDRERRREDKERERRRESRDKESRRENRDKESRRERDEYKRREHESRKEHSRRSRSRRRERSPRRK

SEQ ID NO: 2451519 - protein, 119 aa, Entamoeba dispar
PKNKIKNEPKIEESKEEPKKEEHGERGNDKHEERKTHQSEKRDDRDKESKREERDRERRRKDKERERRRENRDKESRRENRDKESRRERDEYKRREHESRKEHSRRSRSRRRERSPRRK

SEQ ID NO: 2451520 - protein, 130 aa, Entamoeba dispar
PKNKIKNEPKIEESKEEPKKEEHRERGNDKHEERKTHQSEKRDDRDKENKREDGDKESKREERDRERRRENRDKERERKRESRDKESRRENRDKESRRERDEYKRREHESRKEHSRRSRSRRRERSPRRK

SEQ ID NO: 2451521 - protein, 10 aa, Entamoeba dispar
PKNKKEPIPK

SEQ ID NO: 2451522 - protein, 4 aa, Entamoeba dispar
PKNM

SEQ ID NO: 2451523 - protein, 9 aa, Entamoeba dispar
PKNPISPEA

SEQ ID NO: 2451524 - protein, 8 aa, Entamoeba dispar
PKNQGEDH

SEQ ID NO: 2451525 - protein, 16 aa, Entamoeba dispar
PKNQRRTTDPKTPDIE

SEQ ID NO: 2451526 - protein, 5 aa, Entamoeba dispar
PKNRQ

SEQ ID NO: 2451527 - protein, 10 aa, Entamoeba dispar
PKNSHSKEKG

SEQ ID NO: 2451528 - protein, 7 aa, Entamoeba dispar
PKNTALE

SEQ ID NO: 2451529 - protein, 9 aa, Entamoeba dispar
PKNVESDDL

SEQ ID NO: 2451530 - protein, 8 aa, Entamoeba dispar
PKNVKARE

SEQ ID NO: 2451531 - protein, 4 aa, Entamoeba dispar
PKNY

SEQ ID NO: 2451532 - protein, 6 aa, Entamoeba dispar
PKNYYQ

SEQ ID NO: 2451533 - protein, 8 aa, Entamoeba dispar
PKPDHKTR

SEQ ID NO: 2451534 - protein, 5 aa, Entamoeba dispar
PKPDI

SEQ ID NO: 2451535 - protein, 7 aa, Entamoeba dispar
PKPGTFI

SEQ ID NO: 2451536 - protein, 5 aa, Entamoeba dispar
PKPIG

SEQ ID NO: 2451537 - protein, 7 aa, Entamoeba dispar
PKPIPKR

SEQ ID NO: 2451538 - protein, 6 aa, Entamoeba dispar
PKPLNK

SEQ ID NO: 2451539 - protein, 7 aa, Entamoeba dispar
PKPMSSQ

SEQ ID NO: 2451540 - protein, 4 aa, Entamoeba dispar
PKPN

SEQ ID NO: 2451541 - protein, 5 aa, Entamoeba dispar
PKPPE

SEQ ID NO: 2451542 - protein, 15 aa, Entamoeba dispar
PKPPPKDSVTPEPPL

SEQ ID NO: 2451543 - protein, 6 aa, Entamoeba dispar
PKPPQT

SEQ ID NO: 2451544 - protein, 4 aa, Entamoeba dispar
PKPQ

SEQ ID NO: 2451545 - protein, 8 aa, Entamoeba dispar
PKPRPNGG

SEQ ID NO: 2451546 - protein, 5 aa, Entamoeba dispar
PKPSY

SEQ ID NO: 2451547 - protein, 7 aa, Entamoeba dispar
PKPTKKV

SEQ ID NO: 2451548 - protein, 8 aa, Entamoeba dispar
PKPTSTIK

SEQ ID NO: 2451549 - protein, 19 aa, Entamoeba dispar
PKPVGDDRIKDSVPTPETR

SEQ ID NO: 2451550 - protein, 17 aa, Entamoeba dispar
PKPVGDGRIKDSVPIPE

SEQ ID NO: 2451551 - protein, 10 aa, Entamoeba dispar
PKQEDKDNPF

SEQ ID NO: 2451552 - protein, 17 aa, Entamoeba dispar
PKQEQLPLTGNTTLDSA

SEQ ID NO: 2451553 - protein, 15 aa, Entamoeba dispar
PKQERRSKEAEVSNG

SEQ ID NO: 2451554 - protein, 15 aa, Entamoeba dispar
PKQGLKTGRTNSARF

SEQ ID NO: 2451555 - protein, 19 aa, Entamoeba dispar
PKQISNDVKSRKEAEAKEK

SEQ ID NO: 2451556 - protein, 10 aa, Entamoeba dispar
PKQKPQPTVD

SEQ ID NO: 2451557 - protein, 7 aa, Entamoeba dispar
PKQNEYD

SEQ ID NO: 2451558 - protein, 16 aa, Entamoeba dispar
PKQPKHLSNEQIKNTI

SEQ ID NO: 2451559 - protein, 8 aa, Entamoeba dispar
PKQPTVQD

SEQ ID NO: 2451560 - protein, 4 aa, Entamoeba dispar
PKQS

SEQ ID NO: 2451561 - protein, 8 aa, Entamoeba dispar
PKQSKNEH

SEQ ID NO: 2451562 - protein, 8 aa, Entamoeba dispar
PKQSMQQY

SEQ ID NO: 2451563 - protein, 8 aa, Entamoeba dispar
PKQTKMRE

SEQ ID NO: 2451564 - protein, 16 aa, Entamoeba dispar
PKQVNAPKRGKGYSSV

SEQ ID NO: 2451565 - protein, 15 aa, Entamoeba dispar
PKQVPGLSSTPTDKI

SEQ ID NO: 2451566 - protein, 8 aa, Entamoeba dispar
PKRCSGRK

SEQ ID NO: 2451567 - protein, 13 aa, Entamoeba dispar
PKRESHGGSTYSF

SEQ ID NO: 2451568 - protein, 5 aa, Entamoeba dispar
PKRFS

SEQ ID NO: 2451569 - protein, 7 aa, Entamoeba dispar
PKRIDQN

SEQ ID NO: 2451570 - protein, 8 aa, Entamoeba dispar
PKRKEGEV

SEQ ID NO: 2451571 - protein, 5 aa, Entamoeba dispar
PKRKN

SEQ ID NO: 2451572 - protein, 15 aa, Entamoeba dispar
PKRMPNPKQAYGDSG

SEQ ID NO: 2451573 - protein, 30 aa, Entamoeba dispar
PKRPKLPNSLQEKRLKEKRTSITTNRSYDV

SEQ ID NO: 2451574 - protein, 4 aa, Entamoeba dispar
PKRQ

SEQ ID NO: 2451575 - protein, 10 aa, Entamoeba dispar
PKRSNAGINE

SEQ ID NO: 2451576 - protein, 10 aa, Entamoeba dispar
PKSDKESVTT

SEQ ID NO: 2451577 - protein, 7 aa, Entamoeba dispar
PKSDNID

SEQ ID NO: 2451578 - protein, 10 aa, Entamoeba dispar
PKSDTQISNL

SEQ ID NO: 2451579 - protein, 8 aa, Entamoeba dispar
PKSELENA

SEQ ID NO: 2451580 - protein, 6 aa, Entamoeba dispar
PKSFNA

SEQ ID NO: 2451581 - protein, 7 aa, Entamoeba dispar
PKSFNAQ

SEQ ID NO: 2451582 - protein, 7 aa, Entamoeba dispar
PKSFNAR

SEQ ID NO: 2451583 - protein, 10 aa, Entamoeba dispar
PKSMKENEIR

SEQ ID NO: 2451584 - protein, 11 aa, Entamoeba dispar
PKSNKNDVEPE

SEQ ID NO: 2451585 - protein, 16 aa, Entamoeba dispar
PKSPFKADRIISVSFD

SEQ ID NO: 2451586 - protein, 8 aa, Entamoeba dispar
PKSRFTAE

SEQ ID NO: 2451587 - protein, 6 aa, Entamoeba dispar
PKSSPI

SEQ ID NO: 2451588 - protein, 7 aa, Entamoeba dispar
PKSSYTD

SEQ ID NO: 2451589 - protein, 4 aa, Entamoeba dispar
PKST

SEQ ID NO: 2451590 - protein, 8 aa, Entamoeba dispar
PKSTIDNW

SEQ ID NO: 2451591 - protein, 15 aa, Entamoeba dispar
PKSTITTKPNSTNVM

SEQ ID NO: 2451592 - protein, 9 aa, Entamoeba dispar
PKSTNPNRL

SEQ ID NO: 2451593 - protein, 17 aa, Entamoeba dispar
PKSTTPNHQIASKVVKK

SEQ ID NO: 2451594 - protein, 7 aa, Entamoeba dispar
PKSYMKE

SEQ ID NO: 2451595 - protein, 8 aa, Entamoeba dispar
PKSYSSKR

SEQ ID NO: 2451596 - protein, 5 aa, Entamoeba dispar
PKTAE

SEQ ID NO: 2451597 - protein, 13 aa, Entamoeba dispar
PKTEPFKPKKGKT

SEQ ID NO: 2451598 - protein, 6 aa, Entamoeba dispar
PKTGLT

SEQ ID NO: 2451599 - protein, 4 aa, Entamoeba dispar
PKTH

SEQ ID NO: 2451600 - protein, 8 aa, Entamoeba dispar
PKTHQEDL

SEQ ID NO: 2451601 - protein, 11 aa, Entamoeba dispar
PKTIKGTIEQR

SEQ ID NO: 2451602 - protein, 7 aa, Entamoeba dispar
PKTIKYG

SEQ ID NO: 2451603 - protein, 7 aa, Entamoeba dispar
PKTKGVI

SEQ ID NO: 2451604 - protein, 7 aa, Entamoeba dispar
PKTKITQ

SEQ ID NO: 2451605 - protein, 9 aa, Entamoeba dispar
PKTKNKEEY

SEQ ID NO: 2451606 - protein, 7 aa, Entamoeba dispar
PKTKQEG

SEQ ID NO: 2451607 - protein, 10 aa, Entamoeba dispar
PKTKQQTILN

SEQ ID NO: 2451608 - protein, 7 aa, Entamoeba dispar
PKTKTGI

SEQ ID NO: 2451609 - protein, 12 aa, Entamoeba dispar
PKTKTKETERKS

SEQ ID NO: 2451610 - protein, 9 aa, Entamoeba dispar
PKTKTLAKA

SEQ ID NO: 2451611 - protein, 8 aa, Entamoeba dispar
PKTKTPSI

SEQ ID NO: 2451612 - protein, 4 aa, Entamoeba dispar
PKTL

SEQ ID NO: 2451613 - protein, 11 aa, Entamoeba dispar
PKTLNDVKGGT

SEQ ID NO: 2451614 - protein, 9 aa, Entamoeba dispar
PKTLTGEWE

SEQ ID NO: 2451615 - protein, 4 aa, Entamoeba dispar
PKTM

SEQ ID NO: 2451616 - protein, 6 aa, Entamoeba dispar
PKTMKY

SEQ ID NO: 2451617 - protein, 6 aa, Entamoeba dispar
PKTNIV

SEQ ID NO: 2451618 - protein, 11 aa, Entamoeba dispar
PKTNPQALYKP

SEQ ID NO: 2451619 - protein, 12 aa, Entamoeba dispar
PKTNTENKPTNI

SEQ ID NO: 2451620 - protein, 6 aa, Entamoeba dispar
PKTNTL

SEQ ID NO: 2451621 - protein, 6 aa, Entamoeba dispar
PKTPGN

SEQ ID NO: 2451622 - protein, 11 aa, Entamoeba dispar
PKTPNVTSTPL

SEQ ID NO: 2451623 - protein, 9 aa, Entamoeba dispar
PKTPSIEKS

SEQ ID NO: 2451624 - protein, 5 aa, Entamoeba dispar
PKTPT

SEQ ID NO: 2451625 - protein, 7 aa, Entamoeba dispar
PKTPVNK

SEQ ID NO: 2451626 - protein, 7 aa, Entamoeba dispar
PKTQESI

SEQ ID NO: 2451627 - protein, 8 aa, Entamoeba dispar
PKTQQEQP

SEQ ID NO: 2451628 - protein, 21 aa, Entamoeba dispar
PKTQQITRPERFDATRLHNNK

SEQ ID NO: 2451629 - protein, 5 aa, Entamoeba dispar
PKTQY

SEQ ID NO: 2451630 - protein, 29 aa, Entamoeba dispar
PKTRAKPKRADKKKPQIKPIAERSALDLF

SEQ ID NO: 2451631 - protein, 8 aa, Entamoeba dispar
PKTRLRER

SEQ ID NO: 2451632 - protein, 18 aa, Entamoeba dispar
PKTRYSTATGKINEITDG

SEQ ID NO: 2451633 - protein, 18 aa, Entamoeba dispar
PKTSEEVTEEKKKEAEIH

SEQ ID NO: 2451634 - protein, 6 aa, Entamoeba dispar
PKTSSM

SEQ ID NO: 2451635 - protein, 5 aa, Entamoeba dispar
PKTST

SEQ ID NO: 2451636 - protein, 15 aa, Entamoeba dispar
PKTTQEIRGLSNNEN

SEQ ID NO: 2451637 - protein, 5 aa, Entamoeba dispar
PKTVQ

SEQ ID NO: 2451638 - protein, 9 aa, Entamoeba dispar
PKTVSNISG

SEQ ID NO: 2451639 - protein, 9 aa, Entamoeba dispar
PKVAGYATG

SEQ ID NO: 2451640 - protein, 14 aa, Entamoeba dispar
PKVEKKQREKKEVQ

SEQ ID NO: 2451641 - protein, 4 aa, Entamoeba dispar
PKVH

SEQ ID NO: 2451642 - protein, 12 aa, Entamoeba dispar
PKVITDPRAGRL

SEQ ID NO: 2451643 - protein, 11 aa, Entamoeba dispar
PKVKGKDSWAK

SEQ ID NO: 2451644 - protein, 7 aa, Entamoeba dispar
PKVPPKG

SEQ ID NO: 2451645 - protein, 7 aa, Entamoeba dispar
PKVPRES

SEQ ID NO: 2451646 - protein, 7 aa, Entamoeba dispar
PKVQENL

SEQ ID NO: 2451647 - protein, 11 aa, Entamoeba dispar
PKVQKSFEARK

SEQ ID NO: 2451648 - protein, 7 aa, Entamoeba dispar
PKVQTGR

SEQ ID NO: 2451649 - protein, 31 aa, Entamoeba dispar
PKVSGADDVSNIDEEFTNEDAQKMTPSENVA

SEQ ID NO: 2451650 - protein, 4 aa, Entamoeba dispar
PKVT

SEQ ID NO: 2451651 - protein, 4 aa, Entamoeba dispar
PKWI

SEQ ID NO: 2451652 - protein, 9 aa, Entamoeba dispar
PKWSGTVGS

SEQ ID NO: 2451653 - protein, 4 aa, Entamoeba dispar
PKWT

SEQ ID NO: 2451654 - protein, 9 aa, Entamoeba dispar
PKYCSQRNE

SEQ ID NO: 2451655 - protein, 15 aa, Entamoeba dispar
PKYDSRMKEYEQANQ

SEQ ID NO: 2451656 - protein, 4 aa, Entamoeba dispar
PKYF

SEQ ID NO: 2451657 - protein, 5 aa, Entamoeba dispar
PKYKQ

SEQ ID NO: 2451658 - protein, 7 aa, Entamoeba dispar
PKYNEKT

SEQ ID NO: 2451659 - protein, 6 aa, Entamoeba dispar
PKYRKE

SEQ ID NO: 2451660 - protein, 7 aa, Entamoeba dispar
PKYSKRV

SEQ ID NO: 2451661 - protein, 6 aa, Entamoeba dispar
PKYSSM

SEQ ID NO: 2451662 - protein, 5 aa, Entamoeba dispar
PKYSV

SEQ ID NO: 2451663 - protein, 6 aa, Entamoeba dispar
PKYTES

SEQ ID NO: 2451664 - protein, 4 aa, Entamoeba dispar
PLAG

SEQ ID NO: 2451665 - protein, 28 aa, Entamoeba dispar
PLAGSGGDKKDDEKKEEPLKQYNESEWE

SEQ ID NO: 2451666 - protein, 27 aa, Entamoeba dispar
PLAGSGGDNKEEEKKEEPQKQYNENNW

SEQ ID NO: 2451667 - protein, 14 aa, Entamoeba dispar
PLALEDSNESGDTP

SEQ ID NO: 2451668 - protein, 10 aa, Entamoeba dispar
PLAPTIQPSF

SEQ ID NO: 2451669 - protein, 20 aa, Entamoeba dispar
PLDGQPCADHDRASGEGVIP

SEQ ID NO: 2451670 - protein, 4 aa, Entamoeba dispar
PLDQ

SEQ ID NO: 2451671 - protein, 5 aa, Entamoeba dispar
PLDSL

SEQ ID NO: 2451672 - protein, 8 aa, Entamoeba dispar
PLDTESTN

SEQ ID NO: 2451673 - protein, 10 aa, Entamoeba dispar
PLEDSKEEQE

SEQ ID NO: 2451674 - protein, 10 aa, Entamoeba dispar
PLEKNNESFE

SEQ ID NO: 2451675 - protein, 6 aa, Entamoeba dispar
PLEPSQ

SEQ ID NO: 2451676 - protein, 5 aa, Entamoeba dispar
PLEQR

SEQ ID NO: 2451677 - protein, 4 aa, Entamoeba dispar
PLES

SEQ ID NO: 2451678 - protein, 6 aa, Entamoeba dispar
PLESPR

SEQ ID NO: 2451679 - protein, 7 aa, Entamoeba dispar
PLETKKP

SEQ ID NO: 2451680 - protein, 14 aa, Entamoeba dispar
PLETPRSGNNTPPH

SEQ ID NO: 2451681 - protein, 6 aa, Entamoeba dispar
PLFDSD

SEQ ID NO: 2451682 - protein, 11 aa, Entamoeba dispar
PLFPGSSTLNQ

SEQ ID NO: 2451683 - protein, 10 aa, Entamoeba dispar
PLGEKESNEF

SEQ ID NO: 2451684 - protein, 6 aa, Entamoeba dispar
PLGHGT

SEQ ID NO: 2451685 - protein, 9 aa, Entamoeba dispar
PLGNCSQKT

SEQ ID NO: 2451686 - protein, 9 aa, Entamoeba dispar
PLGPDGRRD

SEQ ID NO: 2451687 - protein, 7 aa, Entamoeba dispar
PLGPEPK

SEQ ID NO: 2451688 - protein, 6 aa, Entamoeba dispar
PLHTEE

SEQ ID NO: 2451689 - protein, 4 aa, Entamoeba dispar
PLIS

SEQ ID NO: 2451690 - protein, 6 aa, Entamoeba dispar
PLKAPK

SEQ ID NO: 2451691 - protein, 24 aa, Entamoeba dispar
PLKEEETDVIKQKGQQTIITPTAT

SEQ ID NO: 2451692 - protein, 11 aa, Entamoeba dispar
PLKENQKLGIP

SEQ ID NO: 2451693 - protein, 10 aa, Entamoeba dispar
PLKEQTEKNL

SEQ ID NO: 2451694 - protein, 11 aa, Entamoeba dispar
PLKETEERQIL

SEQ ID NO: 2451695 - protein, 7 aa, Entamoeba dispar
PLKKDTI

SEQ ID NO: 2451696 - protein, 5 aa, Entamoeba dispar
PLKKG

SEQ ID NO: 2451697 - protein, 4 aa, Entamoeba dispar
PLKN

SEQ ID NO: 2451698 - protein, 6 aa, Entamoeba dispar
PLKPPK

SEQ ID NO: 2451699 - protein, 19 aa, Entamoeba dispar
PLKQKENIEKRGRPEEKDY

SEQ ID NO: 2451700 - protein, 11 aa, Entamoeba dispar
PLKRESKGHKE

SEQ ID NO: 2451701 - protein, 25 aa, Entamoeba dispar
PLLGNKDVDEVNEIEDYPRKYVKEE

SEQ ID NO: 2451702 - protein, 4 aa, Entamoeba dispar
PLLP

SEQ ID NO: 2451703 - protein, 23 aa, Entamoeba dispar
PLLSPGRSLSLSSNDSSLAASED

SEQ ID NO: 2451704 - protein, 7 aa, Entamoeba dispar
PLNEEEL

SEQ ID NO: 2451705 - protein, 27 aa, Entamoeba dispar
PLNEKQKKQKRISESPSKILQSPSQRI

SEQ ID NO: 2451706 - protein, 11 aa, Entamoeba dispar
PLNENKGIIPK

SEQ ID NO: 2451707 - protein, 6 aa, Entamoeba dispar
PLNESP

SEQ ID NO: 2451708 - protein, 4 aa, Entamoeba dispar
PLNG

SEQ ID NO: 2451709 - protein, 10 aa, Entamoeba dispar
PLNGDSKNEY

SEQ ID NO: 2451710 - protein, 7 aa, Entamoeba dispar
PLNHPSN

SEQ ID NO: 2451711 - protein, 4 aa, Entamoeba dispar
PLNK

SEQ ID NO: 2451712 - protein, 5 aa, Entamoeba dispar
PLNKA

SEQ ID NO: 2451713 - protein, 9 aa, Entamoeba dispar
PLNKQERTE

SEQ ID NO: 2451714 - protein, 4 aa, Entamoeba dispar
PLNN

SEQ ID NO: 2451715 - protein, 12 aa, Entamoeba dispar
PLNNPSKNSSLH

SEQ ID NO: 2451716 - protein, 8 aa, Entamoeba dispar
PLNNTTSC

SEQ ID NO: 2451717 - protein, 11 aa, Entamoeba dispar
PLNQHNSSLNS

SEQ ID NO: 2451718 - protein, 10 aa, Entamoeba dispar
PLNQSETESF

SEQ ID NO: 2451719 - protein, 6 aa, Entamoeba dispar
PLNQST

SEQ ID NO: 2451720 - protein, 5 aa, Entamoeba dispar
PLNQV

SEQ ID NO: 2451721 - protein, 5 aa, Entamoeba dispar
PLNSP

SEQ ID NO: 2451722 - protein, 12 aa, Entamoeba dispar
PLNSPKTYDKAG

SEQ ID NO: 2451723 - protein, 26 aa, Entamoeba dispar
PLNSTTKPEDESEEEGYDDDDSWDND

SEQ ID NO: 2451724 - protein, 7 aa, Entamoeba dispar
PLNTEKE

SEQ ID NO: 2451725 - protein, 4 aa, Entamoeba dispar
PLPA

SEQ ID NO: 2451726 - protein, 8 aa, Entamoeba dispar
PLPDEKEV

SEQ ID NO: 2451727 - protein, 4 aa, Entamoeba dispar
PLPE

SEQ ID NO: 2451728 - protein, 5 aa, Entamoeba dispar
PLPEE

SEQ ID NO: 2451729 - protein, 5 aa, Entamoeba dispar
PLPEG

SEQ ID NO: 2451730 - protein, 13 aa, Entamoeba dispar
PLPEKNDTIDTDY

SEQ ID NO: 2451731 - protein, 5 aa, Entamoeba dispar
PLPFE

SEQ ID NO: 2451732 - protein, 6 aa, Entamoeba dispar
PLPFSN

SEQ ID NO: 2451733 - protein, 8 aa, Entamoeba dispar
PLPGFSDS

SEQ ID NO: 2451734 - protein, 14 aa, Entamoeba dispar
PLPGPITPPQNTPA

SEQ ID NO: 2451735 - protein, 4 aa, Entamoeba dispar
PLPI

SEQ ID NO: 2451736 - protein, 20 aa, Entamoeba dispar
PLPLPSNTLTENPSSSALEE

SEQ ID NO: 2451737 - protein, 9 aa, Entamoeba dispar
PLPNAEDLK

SEQ ID NO: 2451738 - protein, 13 aa, Entamoeba dispar
PLPNESDGKEDPM

SEQ ID NO: 2451739 - protein, 65 aa, Entamoeba dispar
PLPPAGTTGQQPNYEIQQQNGQAEGYNTYPNMPNTQQQMSNTVPQQITPQQPKTQPSGPQYPGYN

SEQ ID NO: 2451740 - protein, 30 aa, Entamoeba dispar
PLPPARRRGTRGAIPAQCASAPDPRTRPRH

SEQ ID NO: 2451741 - protein, 20 aa, Entamoeba dispar
PLPPIESNESSSEQESEEID

SEQ ID NO: 2451742 - protein, 72 aa, Entamoeba dispar
PLPPLPPKVHGKRKKALPPIPTDVPSQEQPTQSSTEELIPPPVPAPRKSKQPRLSANLTNEDVPDRSNRDRS

SEQ ID NO: 2451743 - protein, 43 aa, Entamoeba dispar
PLPPQSTLEEPEKRPSPVHNEVNTNPSSTKSSTQSKPKILQKG

SEQ ID NO: 2451744 - protein, 8 aa, Entamoeba dispar
PLPPSNVP

SEQ ID NO: 2451745 - protein, 6 aa, Entamoeba dispar
PLPQSD

SEQ ID NO: 2451746 - protein, 4 aa, Entamoeba dispar
PLPS

SEQ ID NO: 2451747 - protein, 13 aa, Entamoeba dispar
PLPSGFESLDSST

SEQ ID NO: 2451748 - protein, 11 aa, Entamoeba dispar
PLPSPSQQNLE

SEQ ID NO: 2451749 - protein, 5 aa, Entamoeba dispar
PLPTE

SEQ ID NO: 2451750 - protein, 12 aa, Entamoeba dispar
PLPTNLTPNTTI

SEQ ID NO: 2451751 - protein, 5 aa, Entamoeba dispar
PLPTS

SEQ ID NO: 2451752 - protein, 7 aa, Entamoeba dispar
PLQETTY

SEQ ID NO: 2451753 - protein, 5 aa, Entamoeba dispar
PLQNS

SEQ ID NO: 2451754 - protein, 9 aa, Entamoeba dispar
PLQNSTEPK

SEQ ID NO: 2451755 - protein, 4 aa, Entamoeba dispar
PLQQ

SEQ ID NO: 2451756 - protein, 19 aa, Entamoeba dispar
PLQQKRNIETRGRPEEKDY

SEQ ID NO: 2451757 - protein, 7 aa, Entamoeba dispar
PLQQQKE

SEQ ID NO: 2451758 - protein, 9 aa, Entamoeba dispar
PLQRSYSES

SEQ ID NO: 2451759 - protein, 10 aa, Entamoeba dispar
PLQSQEQRVQ

SEQ ID NO: 2451760 - protein, 10 aa, Entamoeba dispar
PLRDEQITNK

SEQ ID NO: 2451761 - protein, 9 aa, Entamoeba dispar
PLRDNKQRK

SEQ ID NO: 2451762 - protein, 20 aa, Entamoeba dispar
PLRESSTRELKVNTSRRNTV

SEQ ID NO: 2451763 - protein, 5 aa, Entamoeba dispar
PLRKD

SEQ ID NO: 2451764 - protein, 19 aa, Entamoeba dispar
PLRLNTTRNDGKKKQSITL

SEQ ID NO: 2451765 - protein, 7 aa, Entamoeba dispar
PLRQPVP

SEQ ID NO: 2451766 - protein, 27 aa, Entamoeba dispar
PLSEEETNEEETNEEEEYEEGSDEEEF

SEQ ID NO: 2451767 - protein, 13 aa, Entamoeba dispar
PLSGNTTPRSKKE

SEQ ID NO: 2451768 - protein, 4 aa, Entamoeba dispar
PLSK

SEQ ID NO: 2451769 - protein, 11 aa, Entamoeba dispar
PLSKEPIPDDG

SEQ ID NO: 2451770 - protein, 10 aa, Entamoeba dispar
PLSKQQKYCP

SEQ ID NO: 2451771 - protein, 26 aa, Entamoeba dispar
PLSKSEAASGVKRKKPTTKAKESRKK

SEQ ID NO: 2451772 - protein, 6 aa, Entamoeba dispar
PLSKSQ

SEQ ID NO: 2451773 - protein, 19 aa, Entamoeba dispar
PLSLKKKRSVEDILKIFEN

SEQ ID NO: 2451774 - protein, 9 aa, Entamoeba dispar
PLSLPSTPI

SEQ ID NO: 2451775 - protein, 10 aa, Entamoeba dispar
PLSNPPKDQQ

SEQ ID NO: 2451776 - protein, 16 aa, Entamoeba dispar
PLSPGSPQSTSSSPLL

SEQ ID NO: 2451777 - protein, 7 aa, Entamoeba dispar
PLSPNAL

SEQ ID NO: 2451778 - protein, 6 aa, Entamoeba dispar
PLSPPE

SEQ ID NO: 2451779 - protein, 7 aa, Entamoeba dispar
PLSPSDS

SEQ ID NO: 2451780 - protein, 8 aa, Entamoeba dispar
PLSRPEKL

SEQ ID NO: 2451781 - protein, 4 aa, Entamoeba dispar
PLSS

SEQ ID NO: 2451782 - protein, 6 aa, Entamoeba dispar
PLSSGD

SEQ ID NO: 2451783 - protein, 8 aa, Entamoeba dispar
PLSSNDEK

SEQ ID NO: 2451784 - protein, 6 aa, Entamoeba dispar
PLSSPQ

SEQ ID NO: 2451785 - protein, 24 aa, Entamoeba dispar
PLSTKEKNTLSGTSIRVESDGNSY

SEQ ID NO: 2451786 - protein, 8 aa, Entamoeba dispar
PLSTPQEY

SEQ ID NO: 2451787 - protein, 40 aa, Entamoeba dispar
PLSTTLSSQRLEDGTLQPPPVPPRRSPKPKPCSYAPPADF

SEQ ID NO: 2451788 - protein, 4 aa, Entamoeba dispar
PLSV

SEQ ID NO: 2451789 - protein, 8 aa, Entamoeba dispar
PLTEENSK

SEQ ID NO: 2451790 - protein, 51 aa, Entamoeba dispar
PLTETTTIDTSYKTEAIQEDSTKESNKFTPTESLTSSSEDITSQPEDINDN

SEQ ID NO: 2451791 - protein, 6 aa, Entamoeba dispar
PLTGSL

SEQ ID NO: 2451792 - protein, 10 aa, Entamoeba dispar
PLTPSKTTTY

SEQ ID NO: 2451793 - protein, 5 aa, Entamoeba dispar
PLTQE

SEQ ID NO: 2451794 - protein, 4 aa, Entamoeba dispar
PLTS

SEQ ID NO: 2451795 - protein, 6 aa, Entamoeba dispar
PLTSEV

SEQ ID NO: 2451796 - protein, 9 aa, Entamoeba dispar
PLTTREKAR

SEQ ID NO: 2451797 - protein, 5 aa, Entamoeba dispar
PLTTT

SEQ ID NO: 2451798 - protein, 4 aa, Entamoeba dispar
PLTY

SEQ ID NO: 2451799 - protein, 20 aa, Entamoeba dispar
PLVEEKKDRQQTLLGEGDSD

SEQ ID NO: 2451800 - protein, 10 aa, Entamoeba dispar
PLYDAPKYKK

SEQ ID NO: 2451801 - protein, 23 aa, Entamoeba dispar
PLYKPKDPAHPNLQTEKSISKRK

SEQ ID NO: 2451802 - protein, 9 aa, Entamoeba dispar
PLYSPGPKE

SEQ ID NO: 2451803 - protein, 13 aa, Entamoeba dispar
PMAATRSKAAEVT

SEQ ID NO: 2451804 - protein, 4 aa, Entamoeba dispar
PMAE

SEQ ID NO: 2451805 - protein, 5 aa, Entamoeba dispar
PMDAP

SEQ ID NO: 2451806 - protein, 5 aa, Entamoeba dispar
PMDDP

SEQ ID NO: 2451807 - protein, 20 aa, Entamoeba dispar
PMEDSLSSSSNPFEASTGYE

SEQ ID NO: 2451808 - protein, 34 aa, Entamoeba dispar
PMEEEETNNTSQNNQINEQNKKEEESPKKEEKKI

SEQ ID NO: 2451809 - protein, 5 aa, Entamoeba dispar
PMEFP

SEQ ID NO: 2451810 - protein, 17 aa, Entamoeba dispar
PMESNPIDLNQPSQIEP

SEQ ID NO: 2451811 - protein, 19 aa, Entamoeba dispar
PMGEDSEMDSVFSQESNDD

SEQ ID NO: 2451812 - protein, 9 aa, Entamoeba dispar
PMGPPPQMN

SEQ ID NO: 2451813 - protein, 4 aa, Entamoeba dispar
PMIG

SEQ ID NO: 2451814 - protein, 8 aa, Entamoeba dispar
PMKPDQIQ

SEQ ID NO: 2451815 - protein, 5 aa, Entamoeba dispar
PMKRS

SEQ ID NO: 2451816 - protein, 5 aa, Entamoeba dispar
PMKSL

SEQ ID NO: 2451817 - protein, 12 aa, Entamoeba dispar
PMNDKDDDNNPY

SEQ ID NO: 2451818 - protein, 22 aa, Entamoeba dispar
PMNEGNEEEIATEYDDKYEEKL

SEQ ID NO: 2451819 - protein, 21 aa, Entamoeba dispar
PMNQSLYDPSVNYSRNEGNNE

SEQ ID NO: 2451820 - protein, 4 aa, Entamoeba dispar
PMPD

SEQ ID NO: 2451821 - protein, 23 aa, Entamoeba dispar
PMPIAPPKSKSKIPSSSLGSSLS

SEQ ID NO: 2451822 - protein, 8 aa, Entamoeba dispar
PMPIPPKP

SEQ ID NO: 2451823 - protein, 8 aa, Entamoeba dispar
PMPPSSKG

SEQ ID NO: 2451824 - protein, 10 aa, Entamoeba dispar
PMPSKKRVSF

SEQ ID NO: 2451825 - protein, 11 aa, Entamoeba dispar
PMRTDDSSHNK

SEQ ID NO: 2451826 - protein, 6 aa, Entamoeba dispar
PMSEDT

SEQ ID NO: 2451827 - protein, 31 aa, Entamoeba dispar
PMSKAEKKRKRKERIKKEKEQNKMKQIDENI

SEQ ID NO: 2451828 - protein, 6 aa, Entamoeba dispar
PMSPVE

SEQ ID NO: 2451829 - protein, 11 aa, Entamoeba dispar
PMTHAEKERMK

SEQ ID NO: 2451830 - protein, 7 aa, Entamoeba dispar
PMTPDSF

SEQ ID NO: 2451831 - protein, 6 aa, Entamoeba dispar
PMTPSS

SEQ ID NO: 2451832 - protein, 24 aa, Entamoeba dispar
PMYGRSGSLSPIDQPFKESSKEVF

SEQ ID NO: 2451833 - protein, 5 aa, Entamoeba dispar
PNAFD

SEQ ID NO: 2451834 - protein, 5 aa, Entamoeba dispar
PNAQS

SEQ ID NO: 2451835 - protein, 9 aa, Entamoeba dispar
PNASTSESK

SEQ ID NO: 2451836 - protein, 6 aa, Entamoeba dispar
PNATKV

SEQ ID NO: 2451837 - protein, 4 aa, Entamoeba dispar
PNCE

SEQ ID NO: 2451838 - protein, 4 aa, Entamoeba dispar
PNCS

SEQ ID NO: 2451839 - protein, 4 aa, Entamoeba dispar
PNDE

SEQ ID NO: 2451840 - protein, 10 aa, Entamoeba dispar
PNDFKDDDAP

SEQ ID NO: 2451841 - protein, 14 aa, Entamoeba dispar
PNDFTNDPTLESRR

SEQ ID NO: 2451842 - protein, 7 aa, Entamoeba dispar
PNDGYVN

SEQ ID NO: 2451843 - protein, 10 aa, Entamoeba dispar
PNDKCASTLP

SEQ ID NO: 2451844 - protein, 5 aa, Entamoeba dispar
PNDKN

SEQ ID NO: 2451845 - protein, 8 aa, Entamoeba dispar
PNDKRTPL

SEQ ID NO: 2451846 - protein, 10 aa, Entamoeba dispar
PNDLADSNFS

SEQ ID NO: 2451847 - protein, 5 aa, Entamoeba dispar
PNDQI

SEQ ID NO: 2451848 - protein, 8 aa, Entamoeba dispar
PNDQTTYS

SEQ ID NO: 2451849 - protein, 10 aa, Entamoeba dispar
PNDTTLPKGM

SEQ ID NO: 2451850 - protein, 5 aa, Entamoeba dispar
PNDVK

SEQ ID NO: 2451851 - protein, 6 aa, Entamoeba dispar
PNEEAA

SEQ ID NO: 2451852 - protein, 5 aa, Entamoeba dispar
PNEEN

SEQ ID NO: 2451853 - protein, 10 aa, Entamoeba dispar
PNEENELQLN

SEQ ID NO: 2451854 - protein, 8 aa, Entamoeba dispar
PNEEPSID

SEQ ID NO: 2451855 - protein, 4 aa, Entamoeba dispar
PNEH

SEQ ID NO: 2451856 - protein, 12 aa, Entamoeba dispar
PNEHNTSQPSQI

SEQ ID NO: 2451857 - protein, 7 aa, Entamoeba dispar
PNEHSPE

SEQ ID NO: 2451858 - protein, 15 aa, Entamoeba dispar
PNEIPPMYDPKPQQV

SEQ ID NO: 2451859 - protein, 7 aa, Entamoeba dispar
PNEKKDF

SEQ ID NO: 2451860 - protein, 4 aa, Entamoeba dispar
PNEL

SEQ ID NO: 2451861 - protein, 7 aa, Entamoeba dispar
PNELVQN

SEQ ID NO: 2451862 - protein, 7 aa, Entamoeba dispar
PNENNQR

SEQ ID NO: 2451863 - protein, 7 aa, Entamoeba dispar
PNENQQL

SEQ ID NO: 2451864 - protein, 8 aa, Entamoeba dispar
PNENSKKA

SEQ ID NO: 2451865 - protein, 8 aa, Entamoeba dispar
PNEPIPSL

SEQ ID NO: 2451866 - protein, 15 aa, Entamoeba dispar
PNEPKQVEEKESNMT

SEQ ID NO: 2451867 - protein, 10 aa, Entamoeba dispar
PNEQFTDDSD

SEQ ID NO: 2451868 - protein, 7 aa, Entamoeba dispar
PNETAKV

SEQ ID NO: 2451869 - protein, 8 aa, Entamoeba dispar
PNETGIES

SEQ ID NO: 2451870 - protein, 13 aa, Entamoeba dispar
PNETKKPQDWDAD

SEQ ID NO: 2451871 - protein, 5 aa, Entamoeba dispar
PNETN

SEQ ID NO: 2451872 - protein, 6 aa, Entamoeba dispar
PNETNN

SEQ ID NO: 2451873 - protein, 16 aa, Entamoeba dispar
PNETNTSQTLTNENPN

SEQ ID NO: 2451874 - protein, 8 aa, Entamoeba dispar
PNETRPHS

SEQ ID NO: 2451875 - protein, 9 aa, Entamoeba dispar
PNETTKALS

SEQ ID NO: 2451876 - protein, 6 aa, Entamoeba dispar
PNETTQ

SEQ ID NO: 2451877 - protein, 10 aa, Entamoeba dispar
PNEWKTDDLQ

SEQ ID NO: 2451878 - protein, 6 aa, Entamoeba dispar
PNFNNE

SEQ ID NO: 2451879 - protein, 11 aa, Entamoeba dispar
PNFRPTSATPT

SEQ ID NO: 2451880 - protein, 20 aa, Entamoeba dispar
PNFTNNPEDPYWTEPEVPGT

SEQ ID NO: 2451881 - protein, 7 aa, Entamoeba dispar
PNGDKYK

SEQ ID NO: 2451882 - protein, 17 aa, Entamoeba dispar
PNGDPLYNENGEIEEIT

SEQ ID NO: 2451883 - protein, 5 aa, Entamoeba dispar
PNGDR

SEQ ID NO: 2451884 - protein, 7 aa, Entamoeba dispar
PNGECDR

SEQ ID NO: 2451885 - protein, 7 aa, Entamoeba dispar
PNGEGGV

SEQ ID NO: 2451886 - protein, 7 aa, Entamoeba dispar
PNGGKLE

SEQ ID NO: 2451887 - protein, 6 aa, Entamoeba dispar
PNGIGK

SEQ ID NO: 2451888 - protein, 4 aa, Entamoeba dispar
PNGK

SEQ ID NO: 2451889 - protein, 16 aa, Entamoeba dispar
PNGKKIQRRFNKTDKI

SEQ ID NO: 2451890 - protein, 12 aa, Entamoeba dispar
PNGLHGEPAEYE

SEQ ID NO: 2451891 - protein, 6 aa, Entamoeba dispar
PNGNPI

SEQ ID NO: 2451892 - protein, 8 aa, Entamoeba dispar
PNGPPTYS

SEQ ID NO: 2451893 - protein, 8 aa, Entamoeba dispar
PNGPYYNQ

SEQ ID NO: 2451894 - protein, 8 aa, Entamoeba dispar
PNGQQKEL

SEQ ID NO: 2451895 - protein, 6 aa, Entamoeba dispar
PNGQSK

SEQ ID NO: 2451896 - protein, 5 aa, Entamoeba dispar
PNGQY

SEQ ID NO: 2451897 - protein, 7 aa, Entamoeba dispar
PNGRNGV

SEQ ID NO: 2451898 - protein, 14 aa, Entamoeba dispar
PNGRNIDVTDKNKQ

SEQ ID NO: 2451899 - protein, 5 aa, Entamoeba dispar
PNGSL

SEQ ID NO: 2451900 - protein, 6 aa, Entamoeba dispar
PNGSLQ

SEQ ID NO: 2451901 - protein, 7 aa, Entamoeba dispar
PNGSRYQ

SEQ ID NO: 2451902 - protein, 8 aa, Entamoeba dispar
PNGTKKSI

SEQ ID NO: 2451903 - protein, 5 aa, Entamoeba dispar
PNGWE

SEQ ID NO: 2451904 - protein, 4 aa, Entamoeba dispar
PNHG

SEQ ID NO: 2451905 - protein, 6 aa, Entamoeba dispar
PNHGPH

SEQ ID NO: 2451906 - protein, 11 aa, Entamoeba dispar
PNHHKERQELT

SEQ ID NO: 2451907 - protein, 5 aa, Entamoeba dispar
PNHPE

SEQ ID NO: 2451908 - protein, 9 aa, Entamoeba dispar
PNIATRENA

SEQ ID NO: 2451909 - protein, 4 aa, Entamoeba dispar
PNID

SEQ ID NO: 2451910 - protein, 4 aa, Entamoeba dispar
PNIP

SEQ ID NO: 2451911 - protein, 17 aa, Entamoeba dispar
PNIPIKGSKRLENHEKG

SEQ ID NO: 2451912 - protein, 8 aa, Entamoeba dispar
PNIPNKES

SEQ ID NO: 2451913 - protein, 7 aa, Entamoeba dispar
PNIREPK

SEQ ID NO: 2451914 - protein, 4 aa, Entamoeba dispar
PNIT

SEQ ID NO: 2451915 - protein, 5 aa, Entamoeba dispar
PNITK

SEQ ID NO: 2451916 - protein, 12 aa, Entamoeba dispar
PNKEEIKRKTDN

SEQ ID NO: 2451917 - protein, 7 aa, Entamoeba dispar
PNKHEGV

SEQ ID NO: 2451918 - protein, 11 aa, Entamoeba dispar
PNKKRVSSLPK

SEQ ID NO: 2451919 - protein, 7 aa, Entamoeba dispar
PNKLPNE

SEQ ID NO: 2451920 - protein, 8 aa, Entamoeba dispar
PNKNEYKI

SEQ ID NO: 2451921 - protein, 8 aa, Entamoeba dispar
PNKNNPFS

SEQ ID NO: 2451922 - protein, 5 aa, Entamoeba dispar
PNKPF

SEQ ID NO: 2451923 - protein, 8 aa, Entamoeba dispar
PNKPGKKE

SEQ ID NO: 2451924 - protein, 8 aa, Entamoeba dispar
PNKPLPSV

SEQ ID NO: 2451925 - protein, 6 aa, Entamoeba dispar
PNKPSD

SEQ ID NO: 2451926 - protein, 7 aa, Entamoeba dispar
PNKQNSV

SEQ ID NO: 2451927 - protein, 13 aa, Entamoeba dispar
PNKTQEEKVSSGI

SEQ ID NO: 2451928 - protein, 7 aa, Entamoeba dispar
PNKYSPI

SEQ ID NO: 2451929 - protein, 5 aa, Entamoeba dispar
PNLGE

SEQ ID NO: 2451930 - protein, 5 aa, Entamoeba dispar
PNLKK

SEQ ID NO: 2451931 - protein, 5 aa, Entamoeba dispar
PNLNK

SEQ ID NO: 2451932 - protein, 4 aa, Entamoeba dispar
PNLQ

SEQ ID NO: 2451933 - protein, 5 aa, Entamoeba dispar
PNLQK

SEQ ID NO: 2451934 - protein, 15 aa, Entamoeba dispar
PNLRPSIDTCAKLIL

SEQ ID NO: 2451935 - protein, 4 aa, Entamoeba dispar
PNLS

SEQ ID NO: 2451936 - protein, 11 aa, Entamoeba dispar
PNLSDSSKMNE

SEQ ID NO: 2451937 - protein, 4 aa, Entamoeba dispar
PNLT

SEQ ID NO: 2451938 - protein, 10 aa, Entamoeba dispar
PNLTDGTTND

SEQ ID NO: 2451939 - protein, 13 aa, Entamoeba dispar
PNLTTLSEKGAQQ

SEQ ID NO: 2451940 - protein, 8 aa, Entamoeba dispar
PNMGGKST

SEQ ID NO: 2451941 - protein, 9 aa, Entamoeba dispar
PNMGGKSTY

SEQ ID NO: 2451942 - protein, 8 aa, Entamoeba dispar
PNNDSENV

SEQ ID NO: 2451943 - protein, 7 aa, Entamoeba dispar
PNNDSNL

SEQ ID NO: 2451944 - protein, 4 aa, Entamoeba dispar
PNNE

SEQ ID NO: 2451945 - protein, 13 aa, Entamoeba dispar
PNNEQEKNTLPSV

SEQ ID NO: 2451946 - protein, 6 aa, Entamoeba dispar
PNNERN

SEQ ID NO: 2451947 - protein, 6 aa, Entamoeba dispar
PNNESY

SEQ ID NO: 2451948 - protein, 12 aa, Entamoeba dispar
PNNETNIKFVRS

SEQ ID NO: 2451949 - protein, 6 aa, Entamoeba dispar
PNNGLS

SEQ ID NO: 2451950 - protein, 4 aa, Entamoeba dispar
PNNK

SEQ ID NO: 2451951 - protein, 6 aa, Entamoeba dispar
PNNLPK

SEQ ID NO: 2451952 - protein, 7 aa, Entamoeba dispar
PNNNDKL

SEQ ID NO: 2451953 - protein, 5 aa, Entamoeba dispar
PNNPL

SEQ ID NO: 2451954 - protein, 19 aa, Entamoeba dispar
PNNQFNPQHQKMTEEEKER

SEQ ID NO: 2451955 - protein, 13 aa, Entamoeba dispar
PNNQLQRSESQEK

SEQ ID NO: 2451956 - protein, 8 aa, Entamoeba dispar
PNNQNESL

SEQ ID NO: 2451957 - protein, 8 aa, Entamoeba dispar
PNNSNEDS

SEQ ID NO: 2451958 - protein, 5 aa, Entamoeba dispar
PNNTR

SEQ ID NO: 2451959 - protein, 7 aa, Entamoeba dispar
PNNTTEK

SEQ ID NO: 2451960 - protein, 5 aa, Entamoeba dispar
PNNYK

SEQ ID NO: 2451961 - protein, 6 aa, Entamoeba dispar
PNNYYS

SEQ ID NO: 2451962 - protein, 6 aa, Entamoeba dispar
PNPCPE

SEQ ID NO: 2451963 - protein, 17 aa, Entamoeba dispar
PNPDDPLNTEAGETMKR

SEQ ID NO: 2451964 - protein, 10 aa, Entamoeba dispar
PNPEHKESKI

SEQ ID NO: 2451965 - protein, 4 aa, Entamoeba dispar
PNPF

SEQ ID NO: 2451966 - protein, 7 aa, Entamoeba dispar
PNPFTQP

SEQ ID NO: 2451967 - protein, 8 aa, Entamoeba dispar
PNPKNYTE

SEQ ID NO: 2451968 - protein, 9 aa, Entamoeba dispar
PNPKQPNGQ

SEQ ID NO: 2451969 - protein, 4 aa, Entamoeba dispar
PNPL

SEQ ID NO: 2451970 - protein, 7 aa, Entamoeba dispar
PNPLITE

SEQ ID NO: 2451971 - protein, 7 aa, Entamoeba dispar
PNPLPEE

SEQ ID NO: 2451972 - protein, 28 aa, Entamoeba dispar
PNPMSTQPNGQFYEQQPSVLNPQQAPQQ

SEQ ID NO: 2451973 - protein, 7 aa, Entamoeba dispar
PNPNPIR

SEQ ID NO: 2451974 - protein, 14 aa, Entamoeba dispar
PNPRDPDQPIPESQ

SEQ ID NO: 2451975 - protein, 13 aa, Entamoeba dispar
PNPSQFSDEEANK

SEQ ID NO: 2451976 - protein, 20 aa, Entamoeba dispar
PNPSTKTSQVFSGPNSSVVS

SEQ ID NO: 2451977 - protein, 9 aa, Entamoeba dispar
PNPSTMNDG

SEQ ID NO: 2451978 - protein, 11 aa, Entamoeba dispar
PNQAGATAESV

SEQ ID NO: 2451979 - protein, 10 aa, Entamoeba dispar
PNQARVAVPD

SEQ ID NO: 2451980 - protein, 8 aa, Entamoeba dispar
PNQEFTDA

SEQ ID NO: 2451981 - protein, 17 aa, Entamoeba dispar
PNQEGDAQKLERKRHVG

SEQ ID NO: 2451982 - protein, 19 aa, Entamoeba dispar
PNQNDENNIFTTSANDCSP

SEQ ID NO: 2451983 - protein, 16 aa, Entamoeba dispar
PNQNKTQTENAMEEEN

SEQ ID NO: 2451984 - protein, 7 aa, Entamoeba dispar
PNQPTND

SEQ ID NO: 2451985 - protein, 7 aa, Entamoeba dispar
PNQPYQS

SEQ ID NO: 2451986 - protein, 23 aa, Entamoeba dispar
PNQQEIKNEKINEELDPSQNHYE

SEQ ID NO: 2451987 - protein, 7 aa, Entamoeba dispar
PNQQPTL

SEQ ID NO: 2451988 - protein, 22 aa, Entamoeba dispar
PNQQYRQTATQPTGIHPTTTEA

SEQ ID NO: 2451989 - protein, 12 aa, Entamoeba dispar
PNQSGATAESVV

SEQ ID NO: 2451990 - protein, 7 aa, Entamoeba dispar
PNQSIEN

SEQ ID NO: 2451991 - protein, 16 aa, Entamoeba dispar
PNQSQQDSLPPPVNPL

SEQ ID NO: 2451992 - protein, 8 aa, Entamoeba dispar
PNQTETTV

SEQ ID NO: 2451993 - protein, 4 aa, Entamoeba dispar
PNQY

SEQ ID NO: 2451994 - protein, 46 aa, Entamoeba dispar
PNQYPSVGYASGYPPQPSLYRPSQQYLPSQYTSPNSCVTTKSPSIQ

SEQ ID NO: 2451995 - protein, 15 aa, Entamoeba dispar
PNRKEEYKTLSSKFD

SEQ ID NO: 2451996 - protein, 6 aa, Entamoeba dispar
PNRSHY

SEQ ID NO: 2451997 - protein, 7 aa, Entamoeba dispar
PNRTDAQ

SEQ ID NO: 2451998 - protein, 8 aa, Entamoeba dispar
PNRTKYNL

SEQ ID NO: 2451999 - protein, 8 aa, Entamoeba dispar
PNSFTTNN

SEQ ID NO: 2452000 - protein, 8 aa, Entamoeba dispar
PNSIANKI

SEQ ID NO: 2452001 - protein, 5 aa, Entamoeba dispar
PNSKE

SEQ ID NO: 2452002 - protein, 8 aa, Entamoeba dispar
PNSKKAKK

SEQ ID NO: 2452003 - protein, 43 aa, Entamoeba dispar
PNSKSFDNEIHTNSSSNSVINNENTPSRSIESVPISSSGPSVG

SEQ ID NO: 2452004 - protein, 5 aa, Entamoeba dispar
PNSKV

SEQ ID NO: 2452005 - protein, 7 aa, Entamoeba dispar
PNSLEEK

SEQ ID NO: 2452006 - protein, 16 aa, Entamoeba dispar
PNSLKTKDKKKPDWER

SEQ ID NO: 2452007 - protein, 12 aa, Entamoeba dispar
PNSNISKGTNSV

SEQ ID NO: 2452008 - protein, 5 aa, Entamoeba dispar
PNSNQ

SEQ ID NO: 2452009 - protein, 8 aa, Entamoeba dispar
PNSNQISS

SEQ ID NO: 2452010 - protein, 6 aa, Entamoeba dispar
PNSPDV

SEQ ID NO: 2452011 - protein, 9 aa, Entamoeba dispar
PNSPREINS

SEQ ID NO: 2452012 - protein, 6 aa, Entamoeba dispar
PNSPRN

SEQ ID NO: 2452013 - protein, 4 aa, Entamoeba dispar
PNSS

SEQ ID NO: 2452014 - protein, 6 aa, Entamoeba dispar
PNSSVS

SEQ ID NO: 2452015 - protein, 5 aa, Entamoeba dispar
PNSTI

SEQ ID NO: 2452016 - protein, 20 aa, Entamoeba dispar
PNSTITEYYDDGKKKQHTVH

SEQ ID NO: 2452017 - protein, 9 aa, Entamoeba dispar
PNSTNIPGN

SEQ ID NO: 2452018 - protein, 5 aa, Entamoeba dispar
PNSVE

SEQ ID NO: 2452019 - protein, 8 aa, Entamoeba dispar
PNSVNEIG

SEQ ID NO: 2452020 - protein, 5 aa, Entamoeba dispar
PNSVS

SEQ ID NO: 2452021 - protein, 8 aa, Entamoeba dispar
PNSYEEGV

SEQ ID NO: 2452022 - protein, 7 aa, Entamoeba dispar
PNTEAPA

SEQ ID NO: 2452023 - protein, 7 aa, Entamoeba dispar
PNTEAPS

SEQ ID NO: 2452024 - protein, 7 aa, Entamoeba dispar
PNTFSGN

SEQ ID NO: 2452025 - protein, 4 aa, Entamoeba dispar
PNTI

SEQ ID NO: 2452026 - protein, 7 aa, Entamoeba dispar
PNTINSN

SEQ ID NO: 2452027 - protein, 6 aa, Entamoeba dispar
PNTIPT

SEQ ID NO: 2452028 - protein, 10 aa, Entamoeba dispar
PNTKKKKIKI

SEQ ID NO: 2452029 - protein, 35 aa, Entamoeba dispar
PNTKRLKDKPKTKSHLHEEEKVDQTIQQTKRATFS

SEQ ID NO: 2452030 - protein, 4 aa, Entamoeba dispar
PNTN

SEQ ID NO: 2452031 - protein, 5 aa, Entamoeba dispar
PNTNR

SEQ ID NO: 2452032 - protein, 8 aa, Entamoeba dispar
PNTNSIPL

SEQ ID NO: 2452033 - protein, 10 aa, Entamoeba dispar
PNTPLNPNTI

SEQ ID NO: 2452034 - protein, 33 aa, Entamoeba dispar
PNTRTEHYKREKGSTSRSRSSSSSPSRNTLTRS

SEQ ID NO: 2452035 - protein, 15 aa, Entamoeba dispar
PNTSQAKKLKLRFDS

SEQ ID NO: 2452036 - protein, 5 aa, Entamoeba dispar
PNTTT

SEQ ID NO: 2452037 - protein, 20 aa, Entamoeba dispar
PNTVNTNSVAQSSISQISEI

SEQ ID NO: 2452038 - protein, 30 aa, Entamoeba dispar
PNTVPETPIIPSPKHERQDELTKTNSIGPD

SEQ ID NO: 2452039 - protein, 9 aa, Entamoeba dispar
PNVESPTEM

SEQ ID NO: 2452040 - protein, 9 aa, Entamoeba dispar
PNVIKNEKT

SEQ ID NO: 2452041 - protein, 5 aa, Entamoeba dispar
PNVNS

SEQ ID NO: 2452042 - protein, 45 aa, Entamoeba dispar
PNVQTKRVKSEAKKPEKILTNNSKRSITKTIEKKPKKLNELTDEE

SEQ ID NO: 2452043 - protein, 5 aa, Entamoeba dispar
PNVSS

SEQ ID NO: 2452044 - protein, 10 aa, Entamoeba dispar
PNWASSPQHF

SEQ ID NO: 2452045 - protein, 14 aa, Entamoeba dispar
PNWRESVNTQQTNP

SEQ ID NO: 2452046 - protein, 12 aa, Entamoeba dispar
PNWSQRRERYDQ

SEQ ID NO: 2452047 - protein, 8 aa, Entamoeba dispar
PNYDSTCD

SEQ ID NO: 2452048 - protein, 32 aa, Entamoeba dispar
PNYESDEQLSRNSNNSKPYGKARISNSSRKSL

SEQ ID NO: 2452049 - protein, 4 aa, Entamoeba dispar
PNYF

SEQ ID NO: 2452050 - protein, 4 aa, Entamoeba dispar
PNYK

SEQ ID NO: 2452051 - protein, 4 aa, Entamoeba dispar
PNYP

SEQ ID NO: 2452052 - protein, 7 aa, Entamoeba dispar
PNYPNHG

SEQ ID NO: 2452053 - protein, 9 aa, Entamoeba dispar
PNYPSPYGA

SEQ ID NO: 2452054 - protein, 11 aa, Entamoeba dispar
PNYSDRNKGAG

SEQ ID NO: 2452055 - protein, 11 aa, Entamoeba dispar
PNYSFKTQKKE

SEQ ID NO: 2452056 - protein, 7 aa, Entamoeba dispar
PNYTYPQ

SEQ ID NO: 2452057 - protein, 12 aa, Entamoeba dispar
PNYYGYDGKEQI

SEQ ID NO: 2452058 - protein, 6 aa, Entamoeba dispar
PPAPEL

SEQ ID NO: 2452059 - protein, 20 aa, Entamoeba dispar
PPCGKSKSAHFASASKEKPI

SEQ ID NO: 2452060 - protein, 4 aa, Entamoeba dispar
PPDE

SEQ ID NO: 2452061 - protein, 10 aa, Entamoeba dispar
PPDKVKIDNK

SEQ ID NO: 2452062 - protein, 15 aa, Entamoeba dispar
PPDLPPASYFGPKGL

SEQ ID NO: 2452063 - protein, 16 aa, Entamoeba dispar
PPDPNNYKQNAQGVDS

SEQ ID NO: 2452064 - protein, 5 aa, Entamoeba dispar
PPDQH

SEQ ID NO: 2452065 - protein, 9 aa, Entamoeba dispar
PPDQQQQKD

SEQ ID NO: 2452066 - protein, 4 aa, Entamoeba dispar
PPDT

SEQ ID NO: 2452067 - protein, 9 aa, Entamoeba dispar
PPDTDPTKY

SEQ ID NO: 2452068 - protein, 5 aa, Entamoeba dispar
PPDTI

SEQ ID NO: 2452069 - protein, 7 aa, Entamoeba dispar
PPDTYYE

SEQ ID NO: 2452070 - protein, 6 aa, Entamoeba dispar
PPEADS

SEQ ID NO: 2452071 - protein, 9 aa, Entamoeba dispar
PPEDISQSE

SEQ ID NO: 2452072 - protein, 13 aa, Entamoeba dispar
PPEDISQSEVSQI

SEQ ID NO: 2452073 - protein, 11 aa, Entamoeba dispar
PPEEPNTIDSL

SEQ ID NO: 2452074 - protein, 22 aa, Entamoeba dispar
PPEFTQNQRDSNYIEIDSEEQL

SEQ ID NO: 2452075 - protein, 4 aa, Entamoeba dispar
PPEK

SEQ ID NO: 2452076 - protein, 6 aa, Entamoeba dispar
PPELPE

SEQ ID NO: 2452077 - protein, 5 aa, Entamoeba dispar
PPEMT

SEQ ID NO: 2452078 - protein, 8 aa, Entamoeba dispar
PPENEIQN

SEQ ID NO: 2452079 - protein, 5 aa, Entamoeba dispar
PPENS

SEQ ID NO: 2452080 - protein, 10 aa, Entamoeba dispar
PPENTPNGSI

SEQ ID NO: 2452081 - protein, 5 aa, Entamoeba dispar
PPEPS

SEQ ID NO: 2452082 - protein, 8 aa, Entamoeba dispar
PPESPIEN

SEQ ID NO: 2452083 - protein, 6 aa, Entamoeba dispar
PPFEGI

SEQ ID NO: 2452084 - protein, 4 aa, Entamoeba dispar
PPFP

SEQ ID NO: 2452085 - protein, 36 aa, Entamoeba dispar
PPFPSQNNNQAINEETTPAGNETNIGNHDSPNPSPN

SEQ ID NO: 2452086 - protein, 12 aa, Entamoeba dispar
PPFQATTEAETL

SEQ ID NO: 2452087 - protein, 9 aa, Entamoeba dispar
PPFSNQNTN

SEQ ID NO: 2452088 - protein, 4 aa, Entamoeba dispar
PPFV

SEQ ID NO: 2452089 - protein, 7 aa, Entamoeba dispar
PPGDSVT

SEQ ID NO: 2452090 - protein, 16 aa, Entamoeba dispar
PPGEDEFGYESAAERW

SEQ ID NO: 2452091 - protein, 12 aa, Entamoeba dispar
PPGEDEMSGELA

SEQ ID NO: 2452092 - protein, 6 aa, Entamoeba dispar
PPGIGS

SEQ ID NO: 2452093 - protein, 5 aa, Entamoeba dispar
PPGIP

SEQ ID NO: 2452094 - protein, 6 aa, Entamoeba dispar
PPGQIP

SEQ ID NO: 2452095 - protein, 9 aa, Entamoeba dispar
PPGSGKTTS

SEQ ID NO: 2452096 - protein, 7 aa, Entamoeba dispar
PPGTGKT

SEQ ID NO: 2452097 - protein, 7 aa, Entamoeba dispar
PPGTYFT

SEQ ID NO: 2452098 - protein, 8 aa, Entamoeba dispar
PPGVSNED

SEQ ID NO: 2452099 - protein, 14 aa, Entamoeba dispar
PPGYSTLQPNPNVR

SEQ ID NO: 2452100 - protein, 5 aa, Entamoeba dispar
PPHGF

SEQ ID NO: 2452101 - protein, 4 aa, Entamoeba dispar
PPHY

SEQ ID NO: 2452102 - protein, 4 aa, Entamoeba dispar
PPID

SEQ ID NO: 2452103 - protein, 14 aa, Entamoeba dispar
PPINETESKHTKTH

SEQ ID NO: 2452104 - protein, 4 aa, Entamoeba dispar
PPIP

SEQ ID NO: 2452105 - protein, 12 aa, Entamoeba dispar
PPIPDKQSPTKQ

SEQ ID NO: 2452106 - protein, 7 aa, Entamoeba dispar
PPIPPEL

SEQ ID NO: 2452107 - protein, 4 aa, Entamoeba dispar
PPIR

SEQ ID NO: 2452108 - protein, 26 aa, Entamoeba dispar
PPISTASNTAVSLPPISTRQETRVRT

SEQ ID NO: 2452109 - protein, 12 aa, Entamoeba dispar
PPKEGDESYPKY

SEQ ID NO: 2452110 - protein, 22 aa, Entamoeba dispar
PPKEKKCSQGATRKSTSSTKGR

SEQ ID NO: 2452111 - protein, 8 aa, Entamoeba dispar
PPKGDEAL

SEQ ID NO: 2452112 - protein, 27 aa, Entamoeba dispar
PPKGTIPLNSSPKKKNDNTTQKKSYKI

SEQ ID NO: 2452113 - protein, 4 aa, Entamoeba dispar
PPKI

SEQ ID NO: 2452114 - protein, 7 aa, Entamoeba dispar
PPKIDPS

SEQ ID NO: 2452115 - protein, 5 aa, Entamoeba dispar
PPKIK

SEQ ID NO: 2452116 - protein, 8 aa, Entamoeba dispar
PPKKASVY

SEQ ID NO: 2452117 - protein, 17 aa, Entamoeba dispar
PPKKEKRIRREKKQEEV

SEQ ID NO: 2452118 - protein, 7 aa, Entamoeba dispar
PPKKPME

SEQ ID NO: 2452119 - protein, 5 aa, Entamoeba dispar
PPKNN

SEQ ID NO: 2452120 - protein, 8 aa, Entamoeba dispar
PPKPINTS

SEQ ID NO: 2452121 - protein, 10 aa, Entamoeba dispar
PPKQCNYDES

SEQ ID NO: 2452122 - protein, 22 aa, Entamoeba dispar
PPKRGKKTSVFTTRSPHRPNNI

SEQ ID NO: 2452123 - protein, 7 aa, Entamoeba dispar
PPKSKSC

SEQ ID NO: 2452124 - protein, 8 aa, Entamoeba dispar
PPKSPPVM

SEQ ID NO: 2452125 - protein, 4 aa, Entamoeba dispar
PPKV

SEQ ID NO: 2452126 - protein, 37 aa, Entamoeba dispar
PPKVPEKPKKLQHKPNSENGSNNDEKINEINQKIEEN

SEQ ID NO: 2452127 - protein, 8 aa, Entamoeba dispar
PPKYPKDS

SEQ ID NO: 2452128 - protein, 15 aa, Entamoeba dispar
PPKYQYQTNLPSGEY

SEQ ID NO: 2452129 - protein, 8 aa, Entamoeba dispar
PPLKNNKD

SEQ ID NO: 2452130 - protein, 4 aa, Entamoeba dispar
PPLP

SEQ ID NO: 2452131 - protein, 10 aa, Entamoeba dispar
PPLPPPRPQQ

SEQ ID NO: 2452132 - protein, 8 aa, Entamoeba dispar
PPLPQDSP

SEQ ID NO: 2452133 - protein, 13 aa, Entamoeba dispar
PPLQSSNSFDNQL

SEQ ID NO: 2452134 - protein, 5 aa, Entamoeba dispar
PPLSD

SEQ ID NO: 2452135 - protein, 5 aa, Entamoeba dispar
PPLSP

SEQ ID NO: 2452136 - protein, 9 aa, Entamoeba dispar
PPLSPRRKK

SEQ ID NO: 2452137 - protein, 4 aa, Entamoeba dispar
PPLT

SEQ ID NO: 2452138 - protein, 6 aa, Entamoeba dispar
PPLTYN

SEQ ID NO: 2452139 - protein, 10 aa, Entamoeba dispar
PPMKTEESRQ

SEQ ID NO: 2452140 - protein, 10 aa, Entamoeba dispar
PPMNPPENRE

SEQ ID NO: 2452141 - protein, 6 aa, Entamoeba dispar
PPMPKD

SEQ ID NO: 2452142 - protein, 89 aa, Entamoeba dispar
PPMTEEQKQHAKEEASKAGKTAYSGATKAVKSEEFKQAKSQVASDLKERGKEASKTAKTSYEKASQTEEWKQAKEQTKTISKEVYESEQ

SEQ ID NO: 2452143 - protein, 9 aa, Entamoeba dispar
PPMTPDSFR

SEQ ID NO: 2452144 - protein, 6 aa, Entamoeba dispar
PPNEGE

SEQ ID NO: 2452145 - protein, 6 aa, Entamoeba dispar
PPNKEM

SEQ ID NO: 2452146 - protein, 7 aa, Entamoeba dispar
PPNNDGI

SEQ ID NO: 2452147 - protein, 4 aa, Entamoeba dispar
PPNP

SEQ ID NO: 2452148 - protein, 4 aa, Entamoeba dispar
PPNS

SEQ ID NO: 2452149 - protein, 6 aa, Entamoeba dispar
PPNVTG

SEQ ID NO: 2452150 - protein, 5 aa, Entamoeba dispar
PPPFE

SEQ ID NO: 2452151 - protein, 8 aa, Entamoeba dispar
PPPHTATP

SEQ ID NO: 2452152 - protein, 27 aa, Entamoeba dispar
PPPIPKTNPVPSTTTLPTQPQTTSFQN

SEQ ID NO: 2452153 - protein, 6 aa, Entamoeba dispar
PPPLKK

SEQ ID NO: 2452154 - protein, 18 aa, Entamoeba dispar
PPPNIPPNGYLPIPQYIQ

SEQ ID NO: 2452155 - protein, 6 aa, Entamoeba dispar
PPPNLI

SEQ ID NO: 2452156 - protein, 25 aa, Entamoeba dispar
PPPPPPPAPDKSMQQVANPHEDKKT

SEQ ID NO: 2452157 - protein, 12 aa, Entamoeba dispar
PPPRQNTTPNKP

SEQ ID NO: 2452158 - protein, 4 aa, Entamoeba dispar
PPPS

SEQ ID NO: 2452159 - protein, 40 aa, Entamoeba dispar
PPPSQRGTSQKIHRSSVESKVISSQTNPTFKTPTKGDDFN

SEQ ID NO: 2452160 - protein, 14 aa, Entamoeba dispar
PPPVTEVEEEEDIE

SEQ ID NO: 2452161 - protein, 11 aa, Entamoeba dispar
PPQFTTTSNNP

SEQ ID NO: 2452162 - protein, 4 aa, Entamoeba dispar
PPQL

SEQ ID NO: 2452163 - protein, 5 aa, Entamoeba dispar
PPQPG

SEQ ID NO: 2452164 - protein, 4 aa, Entamoeba dispar
PPQR

SEQ ID NO: 2452165 - protein, 7 aa, Entamoeba dispar
PPQRQRI

SEQ ID NO: 2452166 - protein, 18 aa, Entamoeba dispar
PPQRVGVTPNGQPPSGMQ

SEQ ID NO: 2452167 - protein, 5 aa, Entamoeba dispar
PPQSK

SEQ ID NO: 2452168 - protein, 17 aa, Entamoeba dispar
PPQSPQEIQQELQQEPH

SEQ ID NO: 2452169 - protein, 7 aa, Entamoeba dispar
PPQSPQI

SEQ ID NO: 2452170 - protein, 14 aa, Entamoeba dispar
PPQVQSMVPQQQLY

SEQ ID NO: 2452171 - protein, 7 aa, Entamoeba dispar
PPRAAQK

SEQ ID NO: 2452172 - protein, 7 aa, Entamoeba dispar
PPRDSNP

SEQ ID NO: 2452173 - protein, 10 aa, Entamoeba dispar
PPRQHLSDEE

SEQ ID NO: 2452174 - protein, 12 aa, Entamoeba dispar
PPRQPGSSIMPG

SEQ ID NO: 2452175 - protein, 8 aa, Entamoeba dispar
PPRSKSCL

SEQ ID NO: 2452176 - protein, 4 aa, Entamoeba dispar
PPRT

SEQ ID NO: 2452177 - protein, 9 aa, Entamoeba dispar
PPRTGIHPT

SEQ ID NO: 2452178 - protein, 4 aa, Entamoeba dispar
PPRV

SEQ ID NO: 2452179 - protein, 5 aa, Entamoeba dispar
PPRVS

SEQ ID NO: 2452180 - protein, 4 aa, Entamoeba dispar
PPSD

SEQ ID NO: 2452181 - protein, 11 aa, Entamoeba dispar
PPSDVQQEVEN

SEQ ID NO: 2452182 - protein, 13 aa, Entamoeba dispar
PPSEEEESDDGGY

SEQ ID NO: 2452183 - protein, 9 aa, Entamoeba dispar
PPSEFKSTE

SEQ ID NO: 2452184 - protein, 4 aa, Entamoeba dispar
PPSF

SEQ ID NO: 2452185 - protein, 8 aa, Entamoeba dispar
PPSGPDAW

SEQ ID NO: 2452186 - protein, 5 aa, Entamoeba dispar
PPSGY

SEQ ID NO: 2452187 - protein, 4 aa, Entamoeba dispar
PPSH

SEQ ID NO: 2452188 - protein, 5 aa, Entamoeba dispar
PPSIS

SEQ ID NO: 2452189 - protein, 26 aa, Entamoeba dispar
PPSKYPQSPSQQRKQQVQVSSSASPL

SEQ ID NO: 2452190 - protein, 4 aa, Entamoeba dispar
PPSL

SEQ ID NO: 2452191 - protein, 5 aa, Entamoeba dispar
PPSLA

SEQ ID NO: 2452192 - protein, 7 aa, Entamoeba dispar
PPSLPEK

SEQ ID NO: 2452193 - protein, 6 aa, Entamoeba dispar
PPSNSI

SEQ ID NO: 2452194 - protein, 8 aa, Entamoeba dispar
PPSQPIYE

SEQ ID NO: 2452195 - protein, 4 aa, Entamoeba dispar
PPSR

SEQ ID NO: 2452196 - protein, 5 aa, Entamoeba dispar
PPSVP

SEQ ID NO: 2452197 - protein, 8 aa, Entamoeba dispar
PPSVPGQV

SEQ ID NO: 2452198 - protein, 14 aa, Entamoeba dispar
PPSVSPGTAYADNE

SEQ ID NO: 2452199 - protein, 5 aa, Entamoeba dispar
PPSYI

SEQ ID NO: 2452200 - protein, 10 aa, Entamoeba dispar
PPTEDPTHYE

SEQ ID NO: 2452201 - protein, 15 aa, Entamoeba dispar
PPTELQEKSNPIQPK

SEQ ID NO: 2452202 - protein, 22 aa, Entamoeba dispar
PPTESESDNGTLSMTVNLVMII

SEQ ID NO: 2452203 - protein, 7 aa, Entamoeba dispar
PPTFQTP

SEQ ID NO: 2452204 - protein, 4 aa, Entamoeba dispar
PPTI

SEQ ID NO: 2452205 - protein, 5 aa, Entamoeba dispar
PPTIE

SEQ ID NO: 2452206 - protein, 4 aa, Entamoeba dispar
PPTK

SEQ ID NO: 2452207 - protein, 6 aa, Entamoeba dispar
PPTKAS

SEQ ID NO: 2452208 - protein, 9 aa, Entamoeba dispar
PPTKSSDIV

SEQ ID NO: 2452209 - protein, 5 aa, Entamoeba dispar
PPTPE

SEQ ID NO: 2452210 - protein, 11 aa, Entamoeba dispar
PPTPPKLAGCD

SEQ ID NO: 2452211 - protein, 5 aa, Entamoeba dispar
PPTRK

SEQ ID NO: 2452212 - protein, 4 aa, Entamoeba dispar
PPTT

SEQ ID NO: 2452213 - protein, 7 aa, Entamoeba dispar
PPTTADV

SEQ ID NO: 2452214 - protein, 6 aa, Entamoeba dispar
PPTTIT

SEQ ID NO: 2452215 - protein, 6 aa, Entamoeba dispar
PPTTNT

SEQ ID NO: 2452216 - protein, 4 aa, Entamoeba dispar
PPTY

SEQ ID NO: 2452217 - protein, 11 aa, Entamoeba dispar
PPTYGPGPMRR

SEQ ID NO: 2452218 - protein, 19 aa, Entamoeba dispar
PPVNQPTISTQQSNISPIQ

SEQ ID NO: 2452219 - protein, 21 aa, Entamoeba dispar
PPVPQQQSTSSQTTNNSSSNW

SEQ ID NO: 2452220 - protein, 14 aa, Entamoeba dispar
PPVPSPSSGIPTLP

SEQ ID NO: 2452221 - protein, 6 aa, Entamoeba dispar
PPVPTP

SEQ ID NO: 2452222 - protein, 7 aa, Entamoeba dispar
PPVSPPT

SEQ ID NO: 2452223 - protein, 4 aa, Entamoeba dispar
PPVT

SEQ ID NO: 2452224 - protein, 8 aa, Entamoeba dispar
PPVTPGES

SEQ ID NO: 2452225 - protein, 8 aa, Entamoeba dispar
PPVTSEGC

SEQ ID NO: 2452226 - protein, 6 aa, Entamoeba dispar
PPWGET

SEQ ID NO: 2452227 - protein, 6 aa, Entamoeba dispar
PPWNDS

SEQ ID NO: 2452228 - protein, 9 aa, Entamoeba dispar
PPYDGPNKR

SEQ ID NO: 2452229 - protein, 11 aa, Entamoeba dispar
PPYGYNTSPYC

SEQ ID NO: 2452230 - protein, 8 aa, Entamoeba dispar
PPYKNKEI

SEQ ID NO: 2452231 - protein, 7 aa, Entamoeba dispar
PPYMDDP

SEQ ID NO: 2452232 - protein, 6 aa, Entamoeba dispar
PPYNSP

SEQ ID NO: 2452233 - protein, 12 aa, Entamoeba dispar
PPYPAVTPTAAV

SEQ ID NO: 2452234 - protein, 5 aa, Entamoeba dispar
PPYYP

SEQ ID NO: 2452235 - protein, 15 aa, Entamoeba dispar
PPYYQQQNPATPKVL

SEQ ID NO: 2452236 - protein, 10 aa, Entamoeba dispar
PQADPKACQC

SEQ ID NO: 2452237 - protein, 12 aa, Entamoeba dispar
PQALTEDSGNID

SEQ ID NO: 2452238 - protein, 8 aa, Entamoeba dispar
PQARPSAY

SEQ ID NO: 2452239 - protein, 6 aa, Entamoeba dispar
PQASEE

SEQ ID NO: 2452240 - protein, 8 aa, Entamoeba dispar
PQCPNTPE

SEQ ID NO: 2452241 - protein, 9 aa, Entamoeba dispar
PQDEIGKEQ

SEQ ID NO: 2452242 - protein, 10 aa, Entamoeba dispar
PQDTNDNKEL

SEQ ID NO: 2452243 - protein, 4 aa, Entamoeba dispar
PQDY

SEQ ID NO: 2452244 - protein, 10 aa, Entamoeba dispar
PQEADQETET

SEQ ID NO: 2452245 - protein, 17 aa, Entamoeba dispar
PQEESTNNDHINKDQNR

SEQ ID NO: 2452246 - protein, 14 aa, Entamoeba dispar
PQEGEINKEETDSS

SEQ ID NO: 2452247 - protein, 4 aa, Entamoeba dispar
PQEI

SEQ ID NO: 2452248 - protein, 9 aa, Entamoeba dispar
PQEITGNDK

SEQ ID NO: 2452249 - protein, 6 aa, Entamoeba dispar
PQEPIK

SEQ ID NO: 2452250 - protein, 8 aa, Entamoeba dispar
PQERATAA

SEQ ID NO: 2452251 - protein, 9 aa, Entamoeba dispar
PQERQGEDL

SEQ ID NO: 2452252 - protein, 4 aa, Entamoeba dispar
PQEV

SEQ ID NO: 2452253 - protein, 4 aa, Entamoeba dispar
PQEY

SEQ ID NO: 2452254 - protein, 4 aa, Entamoeba dispar
PQFN

SEQ ID NO: 2452255 - protein, 12 aa, Entamoeba dispar
PQGENSGKCTFN

SEQ ID NO: 2452256 - protein, 9 aa, Entamoeba dispar
PQGEQETTF

SEQ ID NO: 2452257 - protein, 8 aa, Entamoeba dispar
PQGETPLT

SEQ ID NO: 2452258 - protein, 6 aa, Entamoeba dispar
PQGNQK

SEQ ID NO: 2452259 - protein, 4 aa, Entamoeba dispar
PQGV

SEQ ID NO: 2452260 - protein, 5 aa, Entamoeba dispar
PQHDE

SEQ ID NO: 2452261 - protein, 9 aa, Entamoeba dispar
PQHQQPKQI

SEQ ID NO: 2452262 - protein, 7 aa, Entamoeba dispar
PQIDDPE

SEQ ID NO: 2452263 - protein, 6 aa, Entamoeba dispar
PQIGRA

SEQ ID NO: 2452264 - protein, 8 aa, Entamoeba dispar
PQINSNNR

SEQ ID NO: 2452265 - protein, 6 aa, Entamoeba dispar
PQIPDS

SEQ ID NO: 2452266 - protein, 6 aa, Entamoeba dispar
PQIPQA

SEQ ID NO: 2452267 - protein, 6 aa, Entamoeba dispar
PQIQPS

SEQ ID NO: 2452268 - protein, 4 aa, Entamoeba dispar
PQIR

SEQ ID NO: 2452269 - protein, 8 aa, Entamoeba dispar
PQISEDTN

SEQ ID NO: 2452270 - protein, 8 aa, Entamoeba dispar
PQITPDDI

SEQ ID NO: 2452271 - protein, 5 aa, Entamoeba dispar
PQITT

SEQ ID NO: 2452272 - protein, 7 aa, Entamoeba dispar
PQKDEEY

SEQ ID NO: 2452273 - protein, 8 aa, Entamoeba dispar
PQKDENGL

SEQ ID NO: 2452274 - protein, 5 aa, Entamoeba dispar
PQKEN

SEQ ID NO: 2452275 - protein, 8 aa, Entamoeba dispar
PQKENETE

SEQ ID NO: 2452276 - protein, 9 aa, Entamoeba dispar
PQKKQIGRG

SEQ ID NO: 2452277 - protein, 7 aa, Entamoeba dispar
PQKLNGN

SEQ ID NO: 2452278 - protein, 15 aa, Entamoeba dispar
PQKMKDTDVTNPIPI

SEQ ID NO: 2452279 - protein, 8 aa, Entamoeba dispar
PQKPKNTI

SEQ ID NO: 2452280 - protein, 5 aa, Entamoeba dispar
PQKQE

SEQ ID NO: 2452281 - protein, 14 aa, Entamoeba dispar
PQKQEKKKKERALK

SEQ ID NO: 2452282 - protein, 5 aa, Entamoeba dispar
PQKQQ

SEQ ID NO: 2452283 - protein, 7 aa, Entamoeba dispar
PQKRPTF

SEQ ID NO: 2452284 - protein, 10 aa, Entamoeba dispar
PQKSKTPIVK

SEQ ID NO: 2452285 - protein, 6 aa, Entamoeba dispar
PQKSQT

SEQ ID NO: 2452286 - protein, 10 aa, Entamoeba dispar
PQKTKGVPEI

SEQ ID NO: 2452287 - protein, 5 aa, Entamoeba dispar
PQLFG

SEQ ID NO: 2452288 - protein, 4 aa, Entamoeba dispar
PQLK

SEQ ID NO: 2452289 - protein, 4 aa, Entamoeba dispar
PQLM

SEQ ID NO: 2452290 - protein, 8 aa, Entamoeba dispar
PQLNEEAK

SEQ ID NO: 2452291 - protein, 14 aa, Entamoeba dispar
PQLPPQEGESGTDM

SEQ ID NO: 2452292 - protein, 4 aa, Entamoeba dispar
PQLQ

SEQ ID NO: 2452293 - protein, 4 aa, Entamoeba dispar
PQLS

SEQ ID NO: 2452294 - protein, 13 aa, Entamoeba dispar
PQLSNQPIKTLDL

SEQ ID NO: 2452295 - protein, 21 aa, Entamoeba dispar
PQLSPRQNKGKTIIASPRKKL

SEQ ID NO: 2452296 - protein, 5 aa, Entamoeba dispar
PQLTK

SEQ ID NO: 2452297 - protein, 6 aa, Entamoeba dispar
PQLYTE

SEQ ID NO: 2452298 - protein, 7 aa, Entamoeba dispar
PQNEREV

SEQ ID NO: 2452299 - protein, 9 aa, Entamoeba dispar
PQNGTGVSV

SEQ ID NO: 2452300 - protein, 4 aa, Entamoeba dispar
PQNN

SEQ ID NO: 2452301 - protein, 13 aa, Entamoeba dispar
PQNPFSDPETTTL

SEQ ID NO: 2452302 - protein, 8 aa, Entamoeba dispar
PQNPTGRV

SEQ ID NO: 2452303 - protein, 8 aa, Entamoeba dispar
PQNPTQSQ

SEQ ID NO: 2452304 - protein, 18 aa, Entamoeba dispar
PQNSASTAINIPAGSATQ

SEQ ID NO: 2452305 - protein, 5 aa, Entamoeba dispar
PQNSH

SEQ ID NO: 2452306 - protein, 4 aa, Entamoeba dispar
PQNT

SEQ ID NO: 2452307 - protein, 5 aa, Entamoeba dispar
PQNTN

SEQ ID NO: 2452308 - protein, 8 aa, Entamoeba dispar
PQNVSKQR

SEQ ID NO: 2452309 - protein, 4 aa, Entamoeba dispar
PQPF

SEQ ID NO: 2452310 - protein, 15 aa, Entamoeba dispar
PQPKNLQAATTIETM

SEQ ID NO: 2452311 - protein, 15 aa, Entamoeba dispar
PQPKPRKEGITPEEE

SEQ ID NO: 2452312 - protein, 8 aa, Entamoeba dispar
PQPPQPTD

SEQ ID NO: 2452313 - protein, 4 aa, Entamoeba dispar
PQPQ

SEQ ID NO: 2452314 - protein, 15 aa, Entamoeba dispar
PQPQPNGTNPTDSAD

SEQ ID NO: 2452315 - protein, 34 aa, Entamoeba dispar
PQPQQEKNDEKSRRRGRNRERKRKDSGREYKQER

SEQ ID NO: 2452316 - protein, 9 aa, Entamoeba dispar
PQPSATRNT

SEQ ID NO: 2452317 - protein, 6 aa, Entamoeba dispar
PQPSET

SEQ ID NO: 2452318 - protein, 8 aa, Entamoeba dispar
PQPSSGRI

SEQ ID NO: 2452319 - protein, 6 aa, Entamoeba dispar
PQPYPT

SEQ ID NO: 2452320 - protein, 4 aa, Entamoeba dispar
PQQA

SEQ ID NO: 2452321 - protein, 4 aa, Entamoeba dispar
PQQF

SEQ ID NO: 2452322 - protein, 7 aa, Entamoeba dispar
PQQIADK

SEQ ID NO: 2452323 - protein, 14 aa, Entamoeba dispar
PQQIPEETTKADQY

SEQ ID NO: 2452324 - protein, 6 aa, Entamoeba dispar
PQQLPA

SEQ ID NO: 2452325 - protein, 8 aa, Entamoeba dispar
PQQPYQGY

SEQ ID NO: 2452326 - protein, 4 aa, Entamoeba dispar
PQQQ

SEQ ID NO: 2452327 - protein, 31 aa, Entamoeba dispar
PQQQPPMQGFSQENQYPPIQENIPQTPIGQG

SEQ ID NO: 2452328 - protein, 10 aa, Entamoeba dispar
PQQQTEEERK

SEQ ID NO: 2452329 - protein, 15 aa, Entamoeba dispar
PQQRQQVNVEPTEEN

SEQ ID NO: 2452330 - protein, 16 aa, Entamoeba dispar
PQQSLQPSGPKRISTF

SEQ ID NO: 2452331 - protein, 5 aa, Entamoeba dispar
PQQSY

SEQ ID NO: 2452332 - protein, 4 aa, Entamoeba dispar
PQQT

SEQ ID NO: 2452333 - protein, 10 aa, Entamoeba dispar
PQQTQKQQSS

SEQ ID NO: 2452334 - protein, 7 aa, Entamoeba dispar
PQQYDGR

SEQ ID NO: 2452335 - protein, 12 aa, Entamoeba dispar
PQRDYSSIGKYY

SEQ ID NO: 2452336 - protein, 4 aa, Entamoeba dispar
PQRI

SEQ ID NO: 2452337 - protein, 4 aa, Entamoeba dispar
PQRL

SEQ ID NO: 2452338 - protein, 5 aa, Entamoeba dispar
PQRPL

SEQ ID NO: 2452339 - protein, 25 aa, Entamoeba dispar
PQRPSQIDNSNKGPKKESKIPSTSL

SEQ ID NO: 2452340 - protein, 5 aa, Entamoeba dispar
PQRST

SEQ ID NO: 2452341 - protein, 5 aa, Entamoeba dispar
PQRTS

SEQ ID NO: 2452342 - protein, 4 aa, Entamoeba dispar
PQSA

SEQ ID NO: 2452343 - protein, 17 aa, Entamoeba dispar
PQSDKKIGNENEEKRKM

SEQ ID NO: 2452344 - protein, 13 aa, Entamoeba dispar
PQSGEVLTTSPYQ

SEQ ID NO: 2452345 - protein, 7 aa, Entamoeba dispar
PQSKEHW

SEQ ID NO: 2452346 - protein, 33 aa, Entamoeba dispar
PQSKKPEEETPTNKPKQVRKEKDIEPKRPTNEI

SEQ ID NO: 2452347 - protein, 7 aa, Entamoeba dispar
PQSKTEA

SEQ ID NO: 2452348 - protein, 6 aa, Entamoeba dispar
PQSLHN

SEQ ID NO: 2452349 - protein, 6 aa, Entamoeba dispar
PQSLNK

SEQ ID NO: 2452350 - protein, 10 aa, Entamoeba dispar
PQSNISKQFK

SEQ ID NO: 2452351 - protein, 7 aa, Entamoeba dispar
PQSPLPH

SEQ ID NO: 2452352 - protein, 7 aa, Entamoeba dispar
PQSPLSL

SEQ ID NO: 2452353 - protein, 28 aa, Entamoeba dispar
PQSRKDAEVKPHQPEDLPYKEENDLKIP

SEQ ID NO: 2452354 - protein, 10 aa, Entamoeba dispar
PQSSKQLEQR

SEQ ID NO: 2452355 - protein, 8 aa, Entamoeba dispar
PQSSNTSL

SEQ ID NO: 2452356 - protein, 8 aa, Entamoeba dispar
PQSTAATA

SEQ ID NO: 2452357 - protein, 18 aa, Entamoeba dispar
PQSTASTAINIPAGAATQ

SEQ ID NO: 2452358 - protein, 18 aa, Entamoeba dispar
PQSTASTAINIPAGSATQ

SEQ ID NO: 2452359 - protein, 18 aa, Entamoeba dispar
PQSTASTAINIPAGSTTQ

SEQ ID NO: 2452360 - protein, 5 aa, Entamoeba dispar
PQSTL

SEQ ID NO: 2452361 - protein, 17 aa, Entamoeba dispar
PQSTPRMTGELKATEEL

SEQ ID NO: 2452362 - protein, 17 aa, Entamoeba dispar
PQSTQITQQIDKDQTQL

SEQ ID NO: 2452363 - protein, 4 aa, Entamoeba dispar
PQSV

SEQ ID NO: 2452364 - protein, 7 aa, Entamoeba dispar
PQTEEAR

SEQ ID NO: 2452365 - protein, 15 aa, Entamoeba dispar
PQTEQQNDKDNATEL

SEQ ID NO: 2452366 - protein, 8 aa, Entamoeba dispar
PQTHEPEK

SEQ ID NO: 2452367 - protein, 11 aa, Entamoeba dispar
PQTKNTDNKIN

SEQ ID NO: 2452368 - protein, 7 aa, Entamoeba dispar
PQTLKDE

SEQ ID NO: 2452369 - protein, 5 aa, Entamoeba dispar
PQTNV

SEQ ID NO: 2452370 - protein, 7 aa, Entamoeba dispar
PQTPMYS

SEQ ID NO: 2452371 - protein, 27 aa, Entamoeba dispar
PQTQNFSDISSTDEDSNRLPVFEQLSH

SEQ ID NO: 2452372 - protein, 9 aa, Entamoeba dispar
PQTQNQETR

SEQ ID NO: 2452373 - protein, 5 aa, Entamoeba dispar
PQTQR

SEQ ID NO: 2452374 - protein, 33 aa, Entamoeba dispar
PQTRTNTKVQKQSSKIKLSKTPELINEPEEQIK

SEQ ID NO: 2452375 - protein, 21 aa, Entamoeba dispar
PQTTEPKRSNSTKPKSPIHQQ

SEQ ID NO: 2452376 - protein, 14 aa, Entamoeba dispar
PQTTIQEETGMNVP

SEQ ID NO: 2452377 - protein, 7 aa, Entamoeba dispar
PQTVGNY

SEQ ID NO: 2452378 - protein, 9 aa, Entamoeba dispar
PQVEAAQGF

SEQ ID NO: 2452379 - protein, 4 aa, Entamoeba dispar
PQVR

SEQ ID NO: 2452380 - protein, 5 aa, Entamoeba dispar
PQWAN

SEQ ID NO: 2452381 - protein, 8 aa, Entamoeba dispar
PQYGDPNE

SEQ ID NO: 2452382 - protein, 18 aa, Entamoeba dispar
PQYGKGEFARVDDKSGQV

SEQ ID NO: 2452383 - protein, 4 aa, Entamoeba dispar
PQYK

SEQ ID NO: 2452384 - protein, 6 aa, Entamoeba dispar
PQYKPL

SEQ ID NO: 2452385 - protein, 11 aa, Entamoeba dispar
PQYSRKTSISR

SEQ ID NO: 2452386 - protein, 4 aa, Entamoeba dispar
PQYY

SEQ ID NO: 2452387 - protein, 7 aa, Entamoeba dispar
PRANISS

SEQ ID NO: 2452388 - protein, 5 aa, Entamoeba dispar
PRCEQ

SEQ ID NO: 2452389 - protein, 4 aa, Entamoeba dispar
PRCT

SEQ ID NO: 2452390 - protein, 20 aa, Entamoeba dispar
PRDDENEELKKFNEESKAAV

SEQ ID NO: 2452391 - protein, 7 aa, Entamoeba dispar
PRDGVNA

SEQ ID NO: 2452392 - protein, 10 aa, Entamoeba dispar
PRDKLDEDID

SEQ ID NO: 2452393 - protein, 5 aa, Entamoeba dispar
PRDNQ

SEQ ID NO: 2452394 - protein, 16 aa, Entamoeba dispar
PRDPADIEEADDDDEI

SEQ ID NO: 2452395 - protein, 6 aa, Entamoeba dispar
PREAKV

SEQ ID NO: 2452396 - protein, 15 aa, Entamoeba dispar
PREENPRDRQKNGPI

SEQ ID NO: 2452397 - protein, 6 aa, Entamoeba dispar
PREGPT

SEQ ID NO: 2452398 - protein, 4 aa, Entamoeba dispar
PREK

SEQ ID NO: 2452399 - protein, 10 aa, Entamoeba dispar
PREKEKKGEI

SEQ ID NO: 2452400 - protein, 32 aa, Entamoeba dispar
PREKKTITRYKNSSYDKETIEGEGKALKEIPE

SEQ ID NO: 2452401 - protein, 14 aa, Entamoeba dispar
PREKPLPASKEPTK

SEQ ID NO: 2452402 - protein, 10 aa, Entamoeba dispar
PREKQSQHIN

SEQ ID NO: 2452403 - protein, 4 aa, Entamoeba dispar
PREL

SEQ ID NO: 2452404 - protein, 23 aa, Entamoeba dispar
PREPEEEKSDDSFINRPNGEIFP

SEQ ID NO: 2452405 - protein, 9 aa, Entamoeba dispar
PRERSQLKP

SEQ ID NO: 2452406 - protein, 9 aa, Entamoeba dispar
PRESIAEKR

SEQ ID NO: 2452407 - protein, 4 aa, Entamoeba dispar
PRET

SEQ ID NO: 2452408 - protein, 9 aa, Entamoeba dispar
PRETEEGTV

SEQ ID NO: 2452409 - protein, 35 aa, Entamoeba dispar
PRETIEKTQPRGERFPRDGDDRNANFKHEFTKPKR

SEQ ID NO: 2452410 - protein, 13 aa, Entamoeba dispar
PREYFGTNSSLSI

SEQ ID NO: 2452411 - protein, 7 aa, Entamoeba dispar
PRFGGKS

SEQ ID NO: 2452412 - protein, 5 aa, Entamoeba dispar
PRFPE

SEQ ID NO: 2452413 - protein, 6 aa, Entamoeba dispar
PRFQQS

SEQ ID NO: 2452414 - protein, 41 aa, Entamoeba dispar
PRGDNQKRLEKDSGAKISIRGKDPKKLGKLSGYGDRENEDS

SEQ ID NO: 2452415 - protein, 6 aa, Entamoeba dispar
PRGGYI

SEQ ID NO: 2452416 - protein, 14 aa, Entamoeba dispar
PRGMYTSGRGSSAV

SEQ ID NO: 2452417 - protein, 5 aa, Entamoeba dispar
PRGSE

SEQ ID NO: 2452418 - protein, 6 aa, Entamoeba dispar
PRGSGM

SEQ ID NO: 2452419 - protein, 9 aa, Entamoeba dispar
PRGTLAGST

SEQ ID NO: 2452420 - protein, 29 aa, Entamoeba dispar
PRGTNAKMEISTTTKFNPIKQDLNKDGSL

SEQ ID NO: 2452421 - protein, 4 aa, Entamoeba dispar
PRHE

SEQ ID NO: 2452422 - protein, 8 aa, Entamoeba dispar
PRINGKGM

SEQ ID NO: 2452423 - protein, 14 aa, Entamoeba dispar
PRIPRPNKKDLKKN

SEQ ID NO: 2452424 - protein, 7 aa, Entamoeba dispar
PRKDTDW

SEQ ID NO: 2452425 - protein, 20 aa, Entamoeba dispar
PRKEDDDKRKRKQEKELEEI

SEQ ID NO: 2452426 - protein, 7 aa, Entamoeba dispar
PRKINTE

SEQ ID NO: 2452427 - protein, 10 aa, Entamoeba dispar
PRKKSSKTAN

SEQ ID NO: 2452428 - protein, 8 aa, Entamoeba dispar
PRKPGMQR

SEQ ID NO: 2452429 - protein, 14 aa, Entamoeba dispar
PRKPNDSISKQATK

SEQ ID NO: 2452430 - protein, 18 aa, Entamoeba dispar
PRKQQTRRSMYPRFGMND

SEQ ID NO: 2452431 - protein, 6 aa, Entamoeba dispar
PRKRSK

SEQ ID NO: 2452432 - protein, 11 aa, Entamoeba dispar
PRKSLDKSREV

SEQ ID NO: 2452433 - protein, 11 aa, Entamoeba dispar
PRKSLKQSREV

SEQ ID NO: 2452434 - protein, 10 aa, Entamoeba dispar
PRKSLNKSRQ

SEQ ID NO: 2452435 - protein, 6 aa, Entamoeba dispar
PRKSSE

SEQ ID NO: 2452436 - protein, 12 aa, Entamoeba dispar
PRLFETSPSGLY

SEQ ID NO: 2452437 - protein, 16 aa, Entamoeba dispar
PRLNSTEVQSKKRAFS

SEQ ID NO: 2452438 - protein, 6 aa, Entamoeba dispar
PRLSDG

SEQ ID NO: 2452439 - protein, 6 aa, Entamoeba dispar
PRLSDN

SEQ ID NO: 2452440 - protein, 7 aa, Entamoeba dispar
PRNAENK

SEQ ID NO: 2452441 - protein, 4 aa, Entamoeba dispar
PRNC

SEQ ID NO: 2452442 - protein, 7 aa, Entamoeba dispar
PRNDPLT

SEQ ID NO: 2452443 - protein, 7 aa, Entamoeba dispar
PRNDTDW

SEQ ID NO: 2452444 - protein, 18 aa, Entamoeba dispar
PRNEEESKEEENKGDESL

SEQ ID NO: 2452445 - protein, 8 aa, Entamoeba dispar
PRNEENKN

SEQ ID NO: 2452446 - protein, 4 aa, Entamoeba dispar
PRNQ

SEQ ID NO: 2452447 - protein, 7 aa, Entamoeba dispar
PRNTLSH

SEQ ID NO: 2452448 - protein, 23 aa, Entamoeba dispar
PRNYNTTTNPEQNLTSSNQSYSM

SEQ ID NO: 2452449 - protein, 5 aa, Entamoeba dispar
PRPEL

SEQ ID NO: 2452450 - protein, 4 aa, Entamoeba dispar
PRPL

SEQ ID NO: 2452451 - protein, 7 aa, Entamoeba dispar
PRPPPYS

SEQ ID NO: 2452452 - protein, 24 aa, Entamoeba dispar
PRPTKLAPKPSTIPPKPQSNPPRF

SEQ ID NO: 2452453 - protein, 22 aa, Entamoeba dispar
PRQDYDKLDKTVRKVIESLIKP

SEQ ID NO: 2452454 - protein, 6 aa, Entamoeba dispar
PRQENN

SEQ ID NO: 2452455 - protein, 4 aa, Entamoeba dispar
PRQG

SEQ ID NO: 2452456 - protein, 7 aa, Entamoeba dispar
PRQQTVA

SEQ ID NO: 2452457 - protein, 10 aa, Entamoeba dispar
PRQSNTPIQI

SEQ ID NO: 2452458 - protein, 5 aa, Entamoeba dispar
PRQTD

SEQ ID NO: 2452459 - protein, 11 aa, Entamoeba dispar
PRREDGFKNNP

SEQ ID NO: 2452460 - protein, 8 aa, Entamoeba dispar
PRRLPSPM

SEQ ID NO: 2452461 - protein, 14 aa, Entamoeba dispar
PRRPSGPRKGQSIQ

SEQ ID NO: 2452462 - protein, 66 aa, Entamoeba dispar
PRRRKTKKITMPTRKRKQTKIEEKEDDYEEYFGTDDGDDYPVKRKYTTQEEQEDDESLKDENAELL

SEQ ID NO: 2452463 - protein, 8 aa, Entamoeba dispar
PRRSPTHL

SEQ ID NO: 2452464 - protein, 6 aa, Entamoeba dispar
PRRTPN

SEQ ID NO: 2452465 - protein, 5 aa, Entamoeba dispar
PRSAR

SEQ ID NO: 2452466 - protein, 4 aa, Entamoeba dispar
PRSD

SEQ ID NO: 2452467 - protein, 7 aa, Entamoeba dispar
PRSDNCS

SEQ ID NO: 2452468 - protein, 7 aa, Entamoeba dispar
PRSEQTK

SEQ ID NO: 2452469 - protein, 5 aa, Entamoeba dispar
PRSFK

SEQ ID NO: 2452470 - protein, 7 aa, Entamoeba dispar
PRSGSTF

SEQ ID NO: 2452471 - protein, 7 aa, Entamoeba dispar
PRSGSTT

SEQ ID NO: 2452472 - protein, 6 aa, Entamoeba dispar
PRSNSN

SEQ ID NO: 2452473 - protein, 9 aa, Entamoeba dispar
PRSTIRKDD

SEQ ID NO: 2452474 - protein, 7 aa, Entamoeba dispar
PRSYNAQ

SEQ ID NO: 2452475 - protein, 9 aa, Entamoeba dispar
PRTKKQSRK

SEQ ID NO: 2452476 - protein, 11 aa, Entamoeba dispar
PRTKKRQNRLS

SEQ ID NO: 2452477 - protein, 4 aa, Entamoeba dispar
PRTN

SEQ ID NO: 2452478 - protein, 8 aa, Entamoeba dispar
PRTPKEVR

SEQ ID NO: 2452479 - protein, 14 aa, Entamoeba dispar
PRTSFTPKKLRTGF

SEQ ID NO: 2452480 - protein, 6 aa, Entamoeba dispar
PRTTFK

SEQ ID NO: 2452481 - protein, 11 aa, Entamoeba dispar
PRTVKPRNNGY

SEQ ID NO: 2452482 - protein, 4 aa, Entamoeba dispar
PRTW

SEQ ID NO: 2452483 - protein, 9 aa, Entamoeba dispar
PRVEENQYQ

SEQ ID NO: 2452484 - protein, 7 aa, Entamoeba dispar
PRVSSES

SEQ ID NO: 2452485 - protein, 5 aa, Entamoeba dispar
PRYDN

SEQ ID NO: 2452486 - protein, 6 aa, Entamoeba dispar
PRYEGL

SEQ ID NO: 2452487 - protein, 4 aa, Entamoeba dispar
PRYG

SEQ ID NO: 2452488 - protein, 5 aa, Entamoeba dispar
PRYNP

SEQ ID NO: 2452489 - protein, 4 aa, Entamoeba dispar
PSAA

SEQ ID NO: 2452490 - protein, 7 aa, Entamoeba dispar
PSACNSE

SEQ ID NO: 2452491 - protein, 10 aa, Entamoeba dispar
PSAFSTKGGQ

SEQ ID NO: 2452492 - protein, 6 aa, Entamoeba dispar
PSARNL

SEQ ID NO: 2452493 - protein, 10 aa, Entamoeba dispar
PSARSLNTER

SEQ ID NO: 2452494 - protein, 10 aa, Entamoeba dispar
PSATNDHEND

SEQ ID NO: 2452495 - protein, 5 aa, Entamoeba dispar
PSATY

SEQ ID NO: 2452496 - protein, 9 aa, Entamoeba dispar
PSCNGSDKV

SEQ ID NO: 2452497 - protein, 9 aa, Entamoeba dispar
PSDDEKNQN

SEQ ID NO: 2452498 - protein, 5 aa, Entamoeba dispar
PSDET

SEQ ID NO: 2452499 - protein, 10 aa, Entamoeba dispar
PSDGDKEDVL

SEQ ID NO: 2452500 - protein, 4 aa, Entamoeba dispar
PSDI

SEQ ID NO: 2452501 - protein, 5 aa, Entamoeba dispar
PSDIR

SEQ ID NO: 2452502 - protein, 15 aa, Entamoeba dispar
PSDKEYAPKYSYSSD

SEQ ID NO: 2452503 - protein, 5 aa, Entamoeba dispar
PSDKN

SEQ ID NO: 2452504 - protein, 17 aa, Entamoeba dispar
PSDLEKEIRNGRLKTDP

SEQ ID NO: 2452505 - protein, 7 aa, Entamoeba dispar
PSDLGKS

SEQ ID NO: 2452506 - protein, 9 aa, Entamoeba dispar
PSDSNNIVN

SEQ ID NO: 2452507 - protein, 8 aa, Entamoeba dispar
PSDTEPAP

SEQ ID NO: 2452508 - protein, 13 aa, Entamoeba dispar
PSDVRAYSICLFS

SEQ ID NO: 2452509 - protein, 4 aa, Entamoeba dispar
PSEA

SEQ ID NO: 2452510 - protein, 6 aa, Entamoeba dispar
PSEDLS

SEQ ID NO: 2452511 - protein, 7 aa, Entamoeba dispar
PSEEEDH

SEQ ID NO: 2452512 - protein, 5 aa, Entamoeba dispar
PSEER

SEQ ID NO: 2452513 - protein, 6 aa, Entamoeba dispar
PSEEWT

SEQ ID NO: 2452514 - protein, 4 aa, Entamoeba dispar
PSEG

SEQ ID NO: 2452515 - protein, 9 aa, Entamoeba dispar
PSEHNSPFV

SEQ ID NO: 2452516 - protein, 4 aa, Entamoeba dispar
PSEI

SEQ ID NO: 2452517 - protein, 21 aa, Entamoeba dispar
PSEIDTEKNNDKIKELTERNT

SEQ ID NO: 2452518 - protein, 20 aa, Entamoeba dispar
PSEKGNDKYLSSQIEGESAT

SEQ ID NO: 2452519 - protein, 9 aa, Entamoeba dispar
PSEKGSDKF

SEQ ID NO: 2452520 - protein, 9 aa, Entamoeba dispar
PSEKSAEKV

SEQ ID NO: 2452521 - protein, 12 aa, Entamoeba dispar
PSELSGGEQQRV

SEQ ID NO: 2452522 - protein, 9 aa, Entamoeba dispar
PSENELKDF

SEQ ID NO: 2452523 - protein, 7 aa, Entamoeba dispar
PSENNAI

SEQ ID NO: 2452524 - protein, 18 aa, Entamoeba dispar
PSENNSEITEDISKYEKV

SEQ ID NO: 2452525 - protein, 9 aa, Entamoeba dispar
PSEPEEHSG

SEQ ID NO: 2452526 - protein, 5 aa, Entamoeba dispar
PSEPI

SEQ ID NO: 2452527 - protein, 8 aa, Entamoeba dispar
PSETEPSV

SEQ ID NO: 2452528 - protein, 22 aa, Entamoeba dispar
PSETPNTLKDGEEEEDDDDNIK

SEQ ID NO: 2452529 - protein, 4 aa, Entamoeba dispar
PSEY

SEQ ID NO: 2452530 - protein, 5 aa, Entamoeba dispar
PSEYF

SEQ ID NO: 2452531 - protein, 4 aa, Entamoeba dispar
PSFD

SEQ ID NO: 2452532 - protein, 7 aa, Entamoeba dispar
PSFEPLD

SEQ ID NO: 2452533 - protein, 12 aa, Entamoeba dispar
PSFKNEEDKTSF

SEQ ID NO: 2452534 - protein, 12 aa, Entamoeba dispar
PSFKSRRPQIKK

SEQ ID NO: 2452535 - protein, 8 aa, Entamoeba dispar
PSFKSSFG

SEQ ID NO: 2452536 - protein, 5 aa, Entamoeba dispar
PSFNA

SEQ ID NO: 2452537 - protein, 15 aa, Entamoeba dispar
PSFNDSKGPESQREY

SEQ ID NO: 2452538 - protein, 9 aa, Entamoeba dispar
PSFNNQSYS

SEQ ID NO: 2452539 - protein, 16 aa, Entamoeba dispar
PSFNTSSIEPKEIQDD

SEQ ID NO: 2452540 - protein, 5 aa, Entamoeba dispar
PSFRR

SEQ ID NO: 2452541 - protein, 8 aa, Entamoeba dispar
PSFSPDGQ

SEQ ID NO: 2452542 - protein, 8 aa, Entamoeba dispar
PSGAGKST

SEQ ID NO: 2452543 - protein, 9 aa, Entamoeba dispar
PSGASTGVH

SEQ ID NO: 2452544 - protein, 8 aa, Entamoeba dispar
PSGCAKTS

SEQ ID NO: 2452545 - protein, 8 aa, Entamoeba dispar
PSGCGKTT

SEQ ID NO: 2452546 - protein, 7 aa, Entamoeba dispar
PSGDRCV

SEQ ID NO: 2452547 - protein, 8 aa, Entamoeba dispar
PSGDVHQK

SEQ ID NO: 2452548 - protein, 5 aa, Entamoeba dispar
PSGET

SEQ ID NO: 2452549 - protein, 14 aa, Entamoeba dispar
PSGEYVASGGDDGS

SEQ ID NO: 2452550 - protein, 5 aa, Entamoeba dispar
PSGGI

SEQ ID NO: 2452551 - protein, 13 aa, Entamoeba dispar
PSGIPVHPTGRYN

SEQ ID NO: 2452552 - protein, 6 aa, Entamoeba dispar
PSGIQP

SEQ ID NO: 2452553 - protein, 9 aa, Entamoeba dispar
PSGKARDSI

SEQ ID NO: 2452554 - protein, 6 aa, Entamoeba dispar
PSGKFN

SEQ ID NO: 2452555 - protein, 5 aa, Entamoeba dispar
PSGLE

SEQ ID NO: 2452556 - protein, 7 aa, Entamoeba dispar
PSGQARL

SEQ ID NO: 2452557 - protein, 8 aa, Entamoeba dispar
PSGSPIEQ

SEQ ID NO: 2452558 - protein, 5 aa, Entamoeba dispar
PSGSY

SEQ ID NO: 2452559 - protein, 7 aa, Entamoeba dispar
PSGTEIP

SEQ ID NO: 2452560 - protein, 7 aa, Entamoeba dispar
PSGVEEM

SEQ ID NO: 2452561 - protein, 9 aa, Entamoeba dispar
PSGVGTKAQ

SEQ ID NO: 2452562 - protein, 4 aa, Entamoeba dispar
PSHA

SEQ ID NO: 2452563 - protein, 5 aa, Entamoeba dispar
PSHAE

SEQ ID NO: 2452564 - protein, 16 aa, Entamoeba dispar
PSHKTEEKPREEEEEI

SEQ ID NO: 2452565 - protein, 4 aa, Entamoeba dispar
PSID

SEQ ID NO: 2452566 - protein, 5 aa, Entamoeba dispar
PSIDE

SEQ ID NO: 2452567 - protein, 8 aa, Entamoeba dispar
PSIDGAGE

SEQ ID NO: 2452568 - protein, 16 aa, Entamoeba dispar
PSIDGAGEITIIKNDV

SEQ ID NO: 2452569 - protein, 6 aa, Entamoeba dispar
PSIDGD

SEQ ID NO: 2452570 - protein, 9 aa, Entamoeba dispar
PSIEGNEER

SEQ ID NO: 2452571 - protein, 9 aa, Entamoeba dispar
PSIEGNEKR

SEQ ID NO: 2452572 - protein, 9 aa, Entamoeba dispar
PSIEKEEGE

SEQ ID NO: 2452573 - protein, 15 aa, Entamoeba dispar
PSIEKNSELSSLQDL

SEQ ID NO: 2452574 - protein, 5 aa, Entamoeba dispar
PSIKE

SEQ ID NO: 2452575 - protein, 6 aa, Entamoeba dispar
PSIKQP

SEQ ID NO: 2452576 - protein, 12 aa, Entamoeba dispar
PSILEENGSVGD

SEQ ID NO: 2452577 - protein, 27 aa, Entamoeba dispar
PSILNTSQQVSTLQNEGSSNNALEQYT

SEQ ID NO: 2452578 - protein, 5 aa, Entamoeba dispar
PSINL

SEQ ID NO: 2452579 - protein, 9 aa, Entamoeba dispar
PSINPKNPM

SEQ ID NO: 2452580 - protein, 7 aa, Entamoeba dispar
PSIPEQQ

SEQ ID NO: 2452581 - protein, 14 aa, Entamoeba dispar
PSIPGSRAGNNIAG

SEQ ID NO: 2452582 - protein, 5 aa, Entamoeba dispar
PSIQP

SEQ ID NO: 2452583 - protein, 4 aa, Entamoeba dispar
PSIR

SEQ ID NO: 2452584 - protein, 4 aa, Entamoeba dispar
PSIS

SEQ ID NO: 2452585 - protein, 8 aa, Entamoeba dispar
PSISEKKE

SEQ ID NO: 2452586 - protein, 6 aa, Entamoeba dispar
PSITEG

SEQ ID NO: 2452587 - protein, 6 aa, Entamoeba dispar
PSITKN

SEQ ID NO: 2452588 - protein, 7 aa, Entamoeba dispar
PSITPSL

SEQ ID NO: 2452589 - protein, 5 aa, Entamoeba dispar
PSITR

SEQ ID NO: 2452590 - protein, 6 aa, Entamoeba dispar
PSITSR

SEQ ID NO: 2452591 - protein, 7 aa, Entamoeba dispar
PSKASKP

SEQ ID NO: 2452592 - protein, 5 aa, Entamoeba dispar
PSKCN

SEQ ID NO: 2452593 - protein, 7 aa, Entamoeba dispar
PSKCQQQ

SEQ ID NO: 2452594 - protein, 4 aa, Entamoeba dispar
PSKD

SEQ ID NO: 2452595 - protein, 28 aa, Entamoeba dispar
PSKEIEEEEKKIKQKEEDSKKIKSKESS

SEQ ID NO: 2452596 - protein, 7 aa, Entamoeba dispar
PSKENLE

SEQ ID NO: 2452597 - protein, 5 aa, Entamoeba dispar
PSKES

SEQ ID NO: 2452598 - protein, 7 aa, Entamoeba dispar
PSKFNGD

SEQ ID NO: 2452599 - protein, 11 aa, Entamoeba dispar
PSKFTTQPIPA

SEQ ID NO: 2452600 - protein, 6 aa, Entamoeba dispar
PSKFYE

SEQ ID NO: 2452601 - protein, 4 aa, Entamoeba dispar
PSKG

SEQ ID NO: 2452602 - protein, 6 aa, Entamoeba dispar
PSKGLN

SEQ ID NO: 2452603 - protein, 9 aa, Entamoeba dispar
PSKIQRDDY

SEQ ID NO: 2452604 - protein, 8 aa, Entamoeba dispar
PSKISKLG

SEQ ID NO: 2452605 - protein, 4 aa, Entamoeba dispar
PSKK

SEQ ID NO: 2452606 - protein, 10 aa, Entamoeba dispar
PSKKDSSIDF

SEQ ID NO: 2452607 - protein, 8 aa, Entamoeba dispar
PSKKSVND

SEQ ID NO: 2452608 - protein, 4 aa, Entamoeba dispar
PSKL

SEQ ID NO: 2452609 - protein, 10 aa, Entamoeba dispar
PSKPKECENN

SEQ ID NO: 2452610 - protein, 13 aa, Entamoeba dispar
PSKPQQRRSINDQ

SEQ ID NO: 2452611 - protein, 8 aa, Entamoeba dispar
PSKQVSAQ

SEQ ID NO: 2452612 - protein, 9 aa, Entamoeba dispar
PSKRITPNE

SEQ ID NO: 2452613 - protein, 7 aa, Entamoeba dispar
PSKSALK

SEQ ID NO: 2452614 - protein, 29 aa, Entamoeba dispar
PSKSASPQFDQLPSSQPINTKEESQESTF

SEQ ID NO: 2452615 - protein, 33 aa, Entamoeba dispar
PSKSTEIPDLKKDNESKTYLEEGVDQNDLTEIP

SEQ ID NO: 2452616 - protein, 13 aa, Entamoeba dispar
PSKTCQKGNKTGT

SEQ ID NO: 2452617 - protein, 6 aa, Entamoeba dispar
PSKTEP

SEQ ID NO: 2452618 - protein, 9 aa, Entamoeba dispar
PSKTGTNSI

SEQ ID NO: 2452619 - protein, 9 aa, Entamoeba dispar
PSKTNPKFP

SEQ ID NO: 2452620 - protein, 37 aa, Entamoeba dispar
PSKTSEQNVEEEDDDTAEMPDIQNPEEVLPEKESDLT

SEQ ID NO: 2452621 - protein, 7 aa, Entamoeba dispar
PSKWGEP

SEQ ID NO: 2452622 - protein, 8 aa, Entamoeba dispar
PSKYEPCT

SEQ ID NO: 2452623 - protein, 6 aa, Entamoeba dispar
PSLEEE

SEQ ID NO: 2452624 - protein, 16 aa, Entamoeba dispar
PSLENNGFDSNNRGTG

SEQ ID NO: 2452625 - protein, 10 aa, Entamoeba dispar
PSLESTHQQE

SEQ ID NO: 2452626 - protein, 64 aa, Entamoeba dispar
PSLGSSSSSLINKSNTNPPLQQSQKQSVQKEIKQQTNTPLNTSCQKKSQKTSKKTKKSRKNKKI

SEQ ID NO: 2452627 - protein, 4 aa, Entamoeba dispar
PSLH

SEQ ID NO: 2452628 - protein, 6 aa, Entamoeba dispar
PSLKDN

SEQ ID NO: 2452629 - protein, 12 aa, Entamoeba dispar
PSLKDTSPSNGI

SEQ ID NO: 2452630 - protein, 4 aa, Entamoeba dispar
PSLL

SEQ ID NO: 2452631 - protein, 7 aa, Entamoeba dispar
PSLLSSE

SEQ ID NO: 2452632 - protein, 13 aa, Entamoeba dispar
PSLNDSDGFDNEG

SEQ ID NO: 2452633 - protein, 6 aa, Entamoeba dispar
PSLNNS

SEQ ID NO: 2452634 - protein, 20 aa, Entamoeba dispar
PSLNQQPKTPLQENEIQTNP

SEQ ID NO: 2452635 - protein, 7 aa, Entamoeba dispar
PSLPEKM

SEQ ID NO: 2452636 - protein, 11 aa, Entamoeba dispar
PSLPLPKPNDI

SEQ ID NO: 2452637 - protein, 7 aa, Entamoeba dispar
PSLPPKE

SEQ ID NO: 2452638 - protein, 12 aa, Entamoeba dispar
PSLPTPNIENEE

SEQ ID NO: 2452639 - protein, 7 aa, Entamoeba dispar
PSLPTRQ

SEQ ID NO: 2452640 - protein, 4 aa, Entamoeba dispar
PSLQ

SEQ ID NO: 2452641 - protein, 7 aa, Entamoeba dispar
PSLQNKN

SEQ ID NO: 2452642 - protein, 8 aa, Entamoeba dispar
PSLQPPLR

SEQ ID NO: 2452643 - protein, 11 aa, Entamoeba dispar
PSLSPHNNEPL

SEQ ID NO: 2452644 - protein, 36 aa, Entamoeba dispar
PSLSRSDKQRKVSLEESNELSTPTLQSSHSEKKGNL

SEQ ID NO: 2452645 - protein, 15 aa, Entamoeba dispar
PSLSSEDLVKQTGSL

SEQ ID NO: 2452646 - protein, 6 aa, Entamoeba dispar
PSLSYT

SEQ ID NO: 2452647 - protein, 8 aa, Entamoeba dispar
PSLYKGNN

SEQ ID NO: 2452648 - protein, 19 aa, Entamoeba dispar
PSMSPPPFAQTYQQQDDDF

SEQ ID NO: 2452649 - protein, 6 aa, Entamoeba dispar
PSNDNL

SEQ ID NO: 2452650 - protein, 18 aa, Entamoeba dispar
PSNDSKKDKIRNAVPSKY

SEQ ID NO: 2452651 - protein, 8 aa, Entamoeba dispar
PSNDSQIE

SEQ ID NO: 2452652 - protein, 28 aa, Entamoeba dispar
PSNEENKKKLLPKETNTSIKRKTYINSN

SEQ ID NO: 2452653 - protein, 18 aa, Entamoeba dispar
PSNEKDVTGIDDGLNNLG

SEQ ID NO: 2452654 - protein, 10 aa, Entamoeba dispar
PSNEPSHSYD

SEQ ID NO: 2452655 - protein, 8 aa, Entamoeba dispar
PSNESQEE

SEQ ID NO: 2452656 - protein, 8 aa, Entamoeba dispar
PSNFRSNS

SEQ ID NO: 2452657 - protein, 6 aa, Entamoeba dispar
PSNGEA

SEQ ID NO: 2452658 - protein, 5 aa, Entamoeba dispar
PSNGI

SEQ ID NO: 2452659 - protein, 9 aa, Entamoeba dispar
PSNGIDEYT

SEQ ID NO: 2452660 - protein, 6 aa, Entamoeba dispar
PSNHKQ

SEQ ID NO: 2452661 - protein, 7 aa, Entamoeba dispar
PSNIQTN

SEQ ID NO: 2452662 - protein, 5 aa, Entamoeba dispar
PSNKP

SEQ ID NO: 2452663 - protein, 7 aa, Entamoeba dispar
PSNKRGY

SEQ ID NO: 2452664 - protein, 8 aa, Entamoeba dispar
PSNKRGYV

SEQ ID NO: 2452665 - protein, 11 aa, Entamoeba dispar
PSNLSKPKDTD

SEQ ID NO: 2452666 - protein, 4 aa, Entamoeba dispar
PSNP

SEQ ID NO: 2452667 - protein, 7 aa, Entamoeba dispar
PSNPAPF

SEQ ID NO: 2452668 - protein, 5 aa, Entamoeba dispar
PSNPW

SEQ ID NO: 2452669 - protein, 6 aa, Entamoeba dispar
PSNQNR

SEQ ID NO: 2452670 - protein, 36 aa, Entamoeba dispar
PSNQTNSMQKKSEVIQPSESISSIGEGLKERANTEI

SEQ ID NO: 2452671 - protein, 6 aa, Entamoeba dispar
PSNSRY

SEQ ID NO: 2452672 - protein, 5 aa, Entamoeba dispar
PSNTK

SEQ ID NO: 2452673 - protein, 6 aa, Entamoeba dispar
PSNTPF

SEQ ID NO: 2452674 - protein, 12 aa, Entamoeba dispar
PSNVNRTTRSHS

SEQ ID NO: 2452675 - protein, 8 aa, Entamoeba dispar
PSNYPQPL

SEQ ID NO: 2452676 - protein, 4 aa, Entamoeba dispar
PSPD

SEQ ID NO: 2452677 - protein, 4 aa, Entamoeba dispar
PSPE

SEQ ID NO: 2452678 - protein, 9 aa, Entamoeba dispar
PSPERNSSL

SEQ ID NO: 2452679 - protein, 7 aa, Entamoeba dispar
PSPFATL

SEQ ID NO: 2452680 - protein, 6 aa, Entamoeba dispar
PSPHPL

SEQ ID NO: 2452681 - protein, 13 aa, Entamoeba dispar
PSPIFNANNMSIT

SEQ ID NO: 2452682 - protein, 8 aa, Entamoeba dispar
PSPIKGKD

SEQ ID NO: 2452683 - protein, 6 aa, Entamoeba dispar
PSPINP

SEQ ID NO: 2452684 - protein, 5 aa, Entamoeba dispar
PSPKI

SEQ ID NO: 2452685 - protein, 7 aa, Entamoeba dispar
PSPKIPG

SEQ ID NO: 2452686 - protein, 6 aa, Entamoeba dispar
PSPKQM

SEQ ID NO: 2452687 - protein, 4 aa, Entamoeba dispar
PSPL

SEQ ID NO: 2452688 - protein, 41 aa, Entamoeba dispar
PSPPPPPPNKEIEDSITVNSQPSVIDKQKDQTQPSAIPHSS

SEQ ID NO: 2452689 - protein, 4 aa, Entamoeba dispar
PSPQ

SEQ ID NO: 2452690 - protein, 10 aa, Entamoeba dispar
PSPQFNSNES

SEQ ID NO: 2452691 - protein, 11 aa, Entamoeba dispar
PSPQQQNEGKT

SEQ ID NO: 2452692 - protein, 14 aa, Entamoeba dispar
PSPRNLEEGSKRGK

SEQ ID NO: 2452693 - protein, 135 aa, Entamoeba dispar
PSPSSAKQNASAYPPQQGYGQPGAYPPQQGYPPQGGYPQPGYPPQQPGAYPGYPPQQGGYPQPGYPPQQGYGQPGAYPPQGGYPQPGYPPQQPGAYPGYPPQQGGYPPQQPGAYPGYPPQQPGAYPGYPQGVPQK

SEQ ID NO: 2452694 - protein, 5 aa, Entamoeba dispar
PSQEV

SEQ ID NO: 2452695 - protein, 11 aa, Entamoeba dispar
PSQFSSPPSTT

SEQ ID NO: 2452696 - protein, 16 aa, Entamoeba dispar
PSQITKPSRKQSIKDD

SEQ ID NO: 2452697 - protein, 4 aa, Entamoeba dispar
PSQK

SEQ ID NO: 2452698 - protein, 5 aa, Entamoeba dispar
PSQKI

SEQ ID NO: 2452699 - protein, 9 aa, Entamoeba dispar
PSQKQPNGR

SEQ ID NO: 2452700 - protein, 11 aa, Entamoeba dispar
PSQKSSKEDLK

SEQ ID NO: 2452701 - protein, 4 aa, Entamoeba dispar
PSQM

SEQ ID NO: 2452702 - protein, 4 aa, Entamoeba dispar
PSQP

SEQ ID NO: 2452703 - protein, 21 aa, Entamoeba dispar
PSQPIQLSQSTSMLNRGFESG

SEQ ID NO: 2452704 - protein, 4 aa, Entamoeba dispar
PSQQ

SEQ ID NO: 2452705 - protein, 6 aa, Entamoeba dispar
PSQQET

SEQ ID NO: 2452706 - protein, 10 aa, Entamoeba dispar
PSQQGQEYSQ

SEQ ID NO: 2452707 - protein, 19 aa, Entamoeba dispar
PSQREDGKAIEIKSNADIS

SEQ ID NO: 2452708 - protein, 10 aa, Entamoeba dispar
PSQTTKTIEI

SEQ ID NO: 2452709 - protein, 26 aa, Entamoeba dispar
PSRAYSSSYSSDKLLGRSRHKPLPSE

SEQ ID NO: 2452710 - protein, 10 aa, Entamoeba dispar
PSRDDPTNAV

SEQ ID NO: 2452711 - protein, 4 aa, Entamoeba dispar
PSRF

SEQ ID NO: 2452712 - protein, 8 aa, Entamoeba dispar
PSRGDYQI

SEQ ID NO: 2452713 - protein, 6 aa, Entamoeba dispar
PSRNNM

SEQ ID NO: 2452714 - protein, 4 aa, Entamoeba dispar
PSRT

SEQ ID NO: 2452715 - protein, 9 aa, Entamoeba dispar
PSRTQTADG

SEQ ID NO: 2452716 - protein, 7 aa, Entamoeba dispar
PSSAEPL

SEQ ID NO: 2452717 - protein, 6 aa, Entamoeba dispar
PSSDES

SEQ ID NO: 2452718 - protein, 15 aa, Entamoeba dispar
PSSETIKQPFEKTDT

SEQ ID NO: 2452719 - protein, 7 aa, Entamoeba dispar
PSSFENI

SEQ ID NO: 2452720 - protein, 9 aa, Entamoeba dispar
PSSFKAPPN

SEQ ID NO: 2452721 - protein, 5 aa, Entamoeba dispar
PSSGH

SEQ ID NO: 2452722 - protein, 5 aa, Entamoeba dispar
PSSGL

SEQ ID NO: 2452723 - protein, 7 aa, Entamoeba dispar
PSSINEI

SEQ ID NO: 2452724 - protein, 7 aa, Entamoeba dispar
PSSINEL

SEQ ID NO: 2452725 - protein, 7 aa, Entamoeba dispar
PSSIPPV

SEQ ID NO: 2452726 - protein, 6 aa, Entamoeba dispar
PSSISK

SEQ ID NO: 2452727 - protein, 7 aa, Entamoeba dispar
PSSISKI

SEQ ID NO: 2452728 - protein, 8 aa, Entamoeba dispar
PSSISKIG

SEQ ID NO: 2452729 - protein, 32 aa, Entamoeba dispar
PSSISNETISEKEQRKHSCSKDPEYEEKRTLN

SEQ ID NO: 2452730 - protein, 7 aa, Entamoeba dispar
PSSISSI

SEQ ID NO: 2452731 - protein, 7 aa, Entamoeba dispar
PSSITKI

SEQ ID NO: 2452732 - protein, 4 aa, Entamoeba dispar
PSSK

SEQ ID NO: 2452733 - protein, 15 aa, Entamoeba dispar
PSSKQTKPNSTSSST

SEQ ID NO: 2452734 - protein, 13 aa, Entamoeba dispar
PSSKRGIEKMSET

SEQ ID NO: 2452735 - protein, 7 aa, Entamoeba dispar
PSSLSEL

SEQ ID NO: 2452736 - protein, 7 aa, Entamoeba dispar
PSSLTKI

SEQ ID NO: 2452737 - protein, 12 aa, Entamoeba dispar
PSSLTSNSNGKI

SEQ ID NO: 2452738 - protein, 7 aa, Entamoeba dispar
PSSNTTI

SEQ ID NO: 2452739 - protein, 5 aa, Entamoeba dispar
PSSPL

SEQ ID NO: 2452740 - protein, 8 aa, Entamoeba dispar
PSSPMAEN

SEQ ID NO: 2452741 - protein, 5 aa, Entamoeba dispar
PSSPS

SEQ ID NO: 2452742 - protein, 11 aa, Entamoeba dispar
PSSQCSKEEME

SEQ ID NO: 2452743 - protein, 8 aa, Entamoeba dispar
PSSQNENS

SEQ ID NO: 2452744 - protein, 7 aa, Entamoeba dispar
PSSQRPK

SEQ ID NO: 2452745 - protein, 18 aa, Entamoeba dispar
PSSSNLQQKTVTYTSNGI

SEQ ID NO: 2452746 - protein, 14 aa, Entamoeba dispar
PSSSPYTVTYGGEL

SEQ ID NO: 2452747 - protein, 41 aa, Entamoeba dispar
PSSSTKQRKTKKVNTEIRQQEVKEVKEPSQESEEIQDIPKR

SEQ ID NO: 2452748 - protein, 31 aa, Entamoeba dispar
PSSTNEETKKEIKYSQEINQTIREDENDNEM

SEQ ID NO: 2452749 - protein, 35 aa, Entamoeba dispar
PSSVNSLNNPYTPYSTTYPPNKNQTISSSIPSTLS

SEQ ID NO: 2452750 - protein, 7 aa, Entamoeba dispar
PSSVSEI

SEQ ID NO: 2452751 - protein, 7 aa, Entamoeba dispar
PSSVSTL

SEQ ID NO: 2452752 - protein, 8 aa, Entamoeba dispar
PSSVSTLG

SEQ ID NO: 2452753 - protein, 9 aa, Entamoeba dispar
PSSVSTLGD

SEQ ID NO: 2452754 - protein, 6 aa, Entamoeba dispar
PSSVTS

SEQ ID NO: 2452755 - protein, 6 aa, Entamoeba dispar
PSSYNE

SEQ ID NO: 2452756 - protein, 11 aa, Entamoeba dispar
PSTAQSSSLNT

SEQ ID NO: 2452757 - protein, 8 aa, Entamoeba dispar
PSTCYTSK

SEQ ID NO: 2452758 - protein, 6 aa, Entamoeba dispar
PSTELN

SEQ ID NO: 2452759 - protein, 17 aa, Entamoeba dispar
PSTETSTEHSGSTNRTL

SEQ ID NO: 2452760 - protein, 8 aa, Entamoeba dispar
PSTETTEW

SEQ ID NO: 2452761 - protein, 5 aa, Entamoeba dispar
PSTHL

SEQ ID NO: 2452762 - protein, 8 aa, Entamoeba dispar
PSTIGTNK

SEQ ID NO: 2452763 - protein, 6 aa, Entamoeba dispar
PSTISK

SEQ ID NO: 2452764 - protein, 11 aa, Entamoeba dispar
PSTISSNNNQI

SEQ ID NO: 2452765 - protein, 7 aa, Entamoeba dispar
PSTITSL

SEQ ID NO: 2452766 - protein, 9 aa, Entamoeba dispar
PSTKGEAQK

SEQ ID NO: 2452767 - protein, 12 aa, Entamoeba dispar
PSTKKRASNELR

SEQ ID NO: 2452768 - protein, 10 aa, Entamoeba dispar
PSTKRSRSIL

SEQ ID NO: 2452769 - protein, 16 aa, Entamoeba dispar
PSTKSQLEQEFGNKKD

SEQ ID NO: 2452770 - protein, 8 aa, Entamoeba dispar
PSTKYYQQ

SEQ ID NO: 2452771 - protein, 6 aa, Entamoeba dispar
PSTLKR

SEQ ID NO: 2452772 - protein, 7 aa, Entamoeba dispar
PSTLSQG

SEQ ID NO: 2452773 - protein, 6 aa, Entamoeba dispar
PSTNHT

SEQ ID NO: 2452774 - protein, 8 aa, Entamoeba dispar
PSTNQVDT

SEQ ID NO: 2452775 - protein, 5 aa, Entamoeba dispar
PSTPI

SEQ ID NO: 2452776 - protein, 5 aa, Entamoeba dispar
PSTPL

SEQ ID NO: 2452777 - protein, 14 aa, Entamoeba dispar
PSTPLSDNQNDNEC

SEQ ID NO: 2452778 - protein, 7 aa, Entamoeba dispar
PSTPNKC

SEQ ID NO: 2452779 - protein, 4 aa, Entamoeba dispar
PSTR

SEQ ID NO: 2452780 - protein, 12 aa, Entamoeba dispar
PSTSNLPLTKDP

SEQ ID NO: 2452781 - protein, 5 aa, Entamoeba dispar
PSTSY

SEQ ID NO: 2452782 - protein, 16 aa, Entamoeba dispar
PSTTNSVTLKGRNELK

SEQ ID NO: 2452783 - protein, 14 aa, Entamoeba dispar
PSTTPRNKRGLRPS

SEQ ID NO: 2452784 - protein, 4 aa, Entamoeba dispar
PSTV

SEQ ID NO: 2452785 - protein, 7 aa, Entamoeba dispar
PSTVSEI

SEQ ID NO: 2452786 - protein, 5 aa, Entamoeba dispar
PSTVT

SEQ ID NO: 2452787 - protein, 4 aa, Entamoeba dispar
PSVA

SEQ ID NO: 2452788 - protein, 7 aa, Entamoeba dispar
PSVESIR

SEQ ID NO: 2452789 - protein, 10 aa, Entamoeba dispar
PSVGGNEKFH

SEQ ID NO: 2452790 - protein, 11 aa, Entamoeba dispar
PSVKDGSTEEI

SEQ ID NO: 2452791 - protein, 4 aa, Entamoeba dispar
PSVQ

SEQ ID NO: 2452792 - protein, 12 aa, Entamoeba dispar
PSVQYQSDGTYG

SEQ ID NO: 2452793 - protein, 7 aa, Entamoeba dispar
PSVRATA

SEQ ID NO: 2452794 - protein, 8 aa, Entamoeba dispar
PSVRSDQQ

SEQ ID NO: 2452795 - protein, 4 aa, Entamoeba dispar
PSVS

SEQ ID NO: 2452796 - protein, 7 aa, Entamoeba dispar
PSVSASS

SEQ ID NO: 2452797 - protein, 31 aa, Entamoeba dispar
PSVSDSSATTLSSSSTTTAPISVQPKEEEPI

SEQ ID NO: 2452798 - protein, 44 aa, Entamoeba dispar
PSVSPRKPLKEGEKRTEQLSVENSSKAKQQQLKSSTTDTQKSLG

SEQ ID NO: 2452799 - protein, 4 aa, Entamoeba dispar
PSVT

SEQ ID NO: 2452800 - protein, 25 aa, Entamoeba dispar
PSVTNYDNKIGKQDLPKPTLSPNEY

SEQ ID NO: 2452801 - protein, 9 aa, Entamoeba dispar
PSWAKYSKQ

SEQ ID NO: 2452802 - protein, 8 aa, Entamoeba dispar
PSWSDDGS

SEQ ID NO: 2452803 - protein, 22 aa, Entamoeba dispar
PSYEDNPKEETPIECREKDKKL

SEQ ID NO: 2452804 - protein, 5 aa, Entamoeba dispar
PSYGG

SEQ ID NO: 2452805 - protein, 4 aa, Entamoeba dispar
PSYK

SEQ ID NO: 2452806 - protein, 4 aa, Entamoeba dispar
PSYN

SEQ ID NO: 2452807 - protein, 17 aa, Entamoeba dispar
PSYNSYSMSSQYHPYTP

SEQ ID NO: 2452808 - protein, 5 aa, Entamoeba dispar
PSYPH

SEQ ID NO: 2452809 - protein, 44 aa, Entamoeba dispar
PSYPQPGQYPPPQQLYPPTQSGQYLPPQGYPQPQQPYPPAQYPL

SEQ ID NO: 2452810 - protein, 4 aa, Entamoeba dispar
PSYR

SEQ ID NO: 2452811 - protein, 4 aa, Entamoeba dispar
PSYS

SEQ ID NO: 2452812 - protein, 28 aa, Entamoeba dispar
PSYSSTFKTHSPVSSLSPGTPSSEISNP

SEQ ID NO: 2452813 - protein, 7 aa, Entamoeba dispar
PSYYPQE

SEQ ID NO: 2452814 - protein, 10 aa, Entamoeba dispar
PTADKKASEK

SEQ ID NO: 2452815 - protein, 4 aa, Entamoeba dispar
PTAE

SEQ ID NO: 2452816 - protein, 6 aa, Entamoeba dispar
PTAEAD

SEQ ID NO: 2452817 - protein, 7 aa, Entamoeba dispar
PTAEADI

SEQ ID NO: 2452818 - protein, 6 aa, Entamoeba dispar
PTAEAN

SEQ ID NO: 2452819 - protein, 10 aa, Entamoeba dispar
PTAKQSELTQ

SEQ ID NO: 2452820 - protein, 5 aa, Entamoeba dispar
PTAPA

SEQ ID NO: 2452821 - protein, 7 aa, Entamoeba dispar
PTASGKT

SEQ ID NO: 2452822 - protein, 7 aa, Entamoeba dispar
PTASLKS

SEQ ID NO: 2452823 - protein, 17 aa, Entamoeba dispar
PTAVNSKGKKKPAQSQV

SEQ ID NO: 2452824 - protein, 17 aa, Entamoeba dispar
PTAVNSKGKKKPASSQV

SEQ ID NO: 2452825 - protein, 4 aa, Entamoeba dispar
PTDD

SEQ ID NO: 2452826 - protein, 9 aa, Entamoeba dispar
PTDEEQSYK

SEQ ID NO: 2452827 - protein, 4 aa, Entamoeba dispar
PTDK

SEQ ID NO: 2452828 - protein, 10 aa, Entamoeba dispar
PTDLKPPQLA

SEQ ID NO: 2452829 - protein, 5 aa, Entamoeba dispar
PTDNK

SEQ ID NO: 2452830 - protein, 10 aa, Entamoeba dispar
PTDPKFPGTK

SEQ ID NO: 2452831 - protein, 10 aa, Entamoeba dispar
PTDQISESSY

SEQ ID NO: 2452832 - protein, 10 aa, Entamoeba dispar
PTDRQTPETN

SEQ ID NO: 2452833 - protein, 4 aa, Entamoeba dispar
PTDS

SEQ ID NO: 2452834 - protein, 17 aa, Entamoeba dispar
PTDSSRGTTTIYNTEKQ

SEQ ID NO: 2452835 - protein, 16 aa, Entamoeba dispar
PTEADMGNSEVGHNAL

SEQ ID NO: 2452836 - protein, 9 aa, Entamoeba dispar
PTEENLNNS

SEQ ID NO: 2452837 - protein, 7 aa, Entamoeba dispar
PTEEPYS

SEQ ID NO: 2452838 - protein, 7 aa, Entamoeba dispar
PTEIKDG

SEQ ID NO: 2452839 - protein, 9 aa, Entamoeba dispar
PTEIPKSKY

SEQ ID NO: 2452840 - protein, 8 aa, Entamoeba dispar
PTEKKVGE

SEQ ID NO: 2452841 - protein, 7 aa, Entamoeba dispar
PTEKPEE

SEQ ID NO: 2452842 - protein, 8 aa, Entamoeba dispar
PTENKTQF

SEQ ID NO: 2452843 - protein, 6 aa, Entamoeba dispar
PTENLN

SEQ ID NO: 2452844 - protein, 5 aa, Entamoeba dispar
PTEQE

SEQ ID NO: 2452845 - protein, 9 aa, Entamoeba dispar
PTEQYEEGR

SEQ ID NO: 2452846 - protein, 33 aa, Entamoeba dispar
PTERKKTNKEVIERNDTNKEVIERNDTDKSRMK

SEQ ID NO: 2452847 - protein, 11 aa, Entamoeba dispar
PTETDEDHKKT

SEQ ID NO: 2452848 - protein, 8 aa, Entamoeba dispar
PTETKQTD

SEQ ID NO: 2452849 - protein, 5 aa, Entamoeba dispar
PTETQ

SEQ ID NO: 2452850 - protein, 12 aa, Entamoeba dispar
PTETSDDEDLIS

SEQ ID NO: 2452851 - protein, 6 aa, Entamoeba dispar
PTFAPT

SEQ ID NO: 2452852 - protein, 5 aa, Entamoeba dispar
PTFDY

SEQ ID NO: 2452853 - protein, 4 aa, Entamoeba dispar
PTFE

SEQ ID NO: 2452854 - protein, 12 aa, Entamoeba dispar
PTFGGTTASYAM

SEQ ID NO: 2452855 - protein, 12 aa, Entamoeba dispar
PTFGKEKKKAEL

SEQ ID NO: 2452856 - protein, 4 aa, Entamoeba dispar
PTFK

SEQ ID NO: 2452857 - protein, 9 aa, Entamoeba dispar
PTFPPQKEL

SEQ ID NO: 2452858 - protein, 10 aa, Entamoeba dispar
PTFTSQPNYM

SEQ ID NO: 2452859 - protein, 4 aa, Entamoeba dispar
PTFV

SEQ ID NO: 2452860 - protein, 10 aa, Entamoeba dispar
PTGAFSSKGK

SEQ ID NO: 2452861 - protein, 8 aa, Entamoeba dispar
PTGAGKTT

SEQ ID NO: 2452862 - protein, 8 aa, Entamoeba dispar
PTGDDYKK

SEQ ID NO: 2452863 - protein, 4 aa, Entamoeba dispar
PTGE

SEQ ID NO: 2452864 - protein, 4 aa, Entamoeba dispar
PTGG

SEQ ID NO: 2452865 - protein, 6 aa, Entamoeba dispar
PTGGGK

SEQ ID NO: 2452866 - protein, 7 aa, Entamoeba dispar
PTGGGKS

SEQ ID NO: 2452867 - protein, 4 aa, Entamoeba dispar
PTGK

SEQ ID NO: 2452868 - protein, 13 aa, Entamoeba dispar
PTGKIGQSLGVQE

SEQ ID NO: 2452869 - protein, 8 aa, Entamoeba dispar
PTGPQNQR

SEQ ID NO: 2452870 - protein, 16 aa, Entamoeba dispar
PTGSEAVDRKNTWRTR

SEQ ID NO: 2452871 - protein, 6 aa, Entamoeba dispar
PTHEAN

SEQ ID NO: 2452872 - protein, 11 aa, Entamoeba dispar
PTHNNGFDNEG

SEQ ID NO: 2452873 - protein, 24 aa, Entamoeba dispar
PTHPHERSSSISPQRKQRKQYTIT

SEQ ID NO: 2452874 - protein, 5 aa, Entamoeba dispar
PTHTI

SEQ ID NO: 2452875 - protein, 8 aa, Entamoeba dispar
PTIDGTGF

SEQ ID NO: 2452876 - protein, 17 aa, Entamoeba dispar
PTIEETFSKTTEIDGTT

SEQ ID NO: 2452877 - protein, 6 aa, Entamoeba dispar
PTIEQT

SEQ ID NO: 2452878 - protein, 4 aa, Entamoeba dispar
PTIF

SEQ ID NO: 2452879 - protein, 4 aa, Entamoeba dispar
PTIG

SEQ ID NO: 2452880 - protein, 10 aa, Entamoeba dispar
PTILTTPREV

SEQ ID NO: 2452881 - protein, 10 aa, Entamoeba dispar
PTIPASTPLS

SEQ ID NO: 2452882 - protein, 8 aa, Entamoeba dispar
PTIPNSYP

SEQ ID NO: 2452883 - protein, 11 aa, Entamoeba dispar
PTIPPSTPQKM

SEQ ID NO: 2452884 - protein, 22 aa, Entamoeba dispar
PTIPTASHPFKPQEENNNKCTI

SEQ ID NO: 2452885 - protein, 6 aa, Entamoeba dispar
PTIPTD

SEQ ID NO: 2452886 - protein, 13 aa, Entamoeba dispar
PTIPTEKEVPALT

SEQ ID NO: 2452887 - protein, 5 aa, Entamoeba dispar
PTIQN

SEQ ID NO: 2452888 - protein, 4 aa, Entamoeba dispar
PTIR

SEQ ID NO: 2452889 - protein, 7 aa, Entamoeba dispar
PTISEQP

SEQ ID NO: 2452890 - protein, 5 aa, Entamoeba dispar
PTITE

SEQ ID NO: 2452891 - protein, 5 aa, Entamoeba dispar
PTITH

SEQ ID NO: 2452892 - protein, 6 aa, Entamoeba dispar
PTITIP

SEQ ID NO: 2452893 - protein, 6 aa, Entamoeba dispar
PTITQR

SEQ ID NO: 2452894 - protein, 10 aa, Entamoeba dispar
PTKALSNQKY

SEQ ID NO: 2452895 - protein, 7 aa, Entamoeba dispar
PTKCPKA

SEQ ID NO: 2452896 - protein, 5 aa, Entamoeba dispar
PTKDC

SEQ ID NO: 2452897 - protein, 8 aa, Entamoeba dispar
PTKEDREN

SEQ ID NO: 2452898 - protein, 5 aa, Entamoeba dispar
PTKEL

SEQ ID NO: 2452899 - protein, 8 aa, Entamoeba dispar
PTKEQETE

SEQ ID NO: 2452900 - protein, 7 aa, Entamoeba dispar
PTKESRD

SEQ ID NO: 2452901 - protein, 5 aa, Entamoeba dispar
PTKGN

SEQ ID NO: 2452902 - protein, 6 aa, Entamoeba dispar
PTKGNA

SEQ ID NO: 2452903 - protein, 17 aa, Entamoeba dispar
PTKGSLNKPSDCLKGNE

SEQ ID NO: 2452904 - protein, 14 aa, Entamoeba dispar
PTKKPSTKSSLKKK

SEQ ID NO: 2452905 - protein, 4 aa, Entamoeba dispar
PTKL

SEQ ID NO: 2452906 - protein, 8 aa, Entamoeba dispar
PTKNGLPE

SEQ ID NO: 2452907 - protein, 9 aa, Entamoeba dispar
PTKNWTKND

SEQ ID NO: 2452908 - protein, 7 aa, Entamoeba dispar
PTKPQLD

SEQ ID NO: 2452909 - protein, 5 aa, Entamoeba dispar
PTKQG

SEQ ID NO: 2452910 - protein, 9 aa, Entamoeba dispar
PTKQNYPVI

SEQ ID NO: 2452911 - protein, 17 aa, Entamoeba dispar
PTKRNGNTQNHPTNDAI

SEQ ID NO: 2452912 - protein, 7 aa, Entamoeba dispar
PTKSEQD

SEQ ID NO: 2452913 - protein, 9 aa, Entamoeba dispar
PTKSNIKPI

SEQ ID NO: 2452914 - protein, 10 aa, Entamoeba dispar
PTKTINNKID

SEQ ID NO: 2452915 - protein, 15 aa, Entamoeba dispar
PTLNGQPNITTIPNG

SEQ ID NO: 2452916 - protein, 5 aa, Entamoeba dispar
PTLPE

SEQ ID NO: 2452917 - protein, 10 aa, Entamoeba dispar
PTLPEDWKTN

SEQ ID NO: 2452918 - protein, 20 aa, Entamoeba dispar
PTLPPPRRKTNYFKENTGEI

SEQ ID NO: 2452919 - protein, 5 aa, Entamoeba dispar
PTLSD

SEQ ID NO: 2452920 - protein, 12 aa, Entamoeba dispar
PTMSATKKTDAY

SEQ ID NO: 2452921 - protein, 6 aa, Entamoeba dispar
PTNDIP

SEQ ID NO: 2452922 - protein, 7 aa, Entamoeba dispar
PTNEPQH

SEQ ID NO: 2452923 - protein, 6 aa, Entamoeba dispar
PTNGAI

SEQ ID NO: 2452924 - protein, 10 aa, Entamoeba dispar
PTNGNENNPA

SEQ ID NO: 2452925 - protein, 4 aa, Entamoeba dispar
PTNH

SEQ ID NO: 2452926 - protein, 9 aa, Entamoeba dispar
PTNHLDADS

SEQ ID NO: 2452927 - protein, 6 aa, Entamoeba dispar
PTNKSI

SEQ ID NO: 2452928 - protein, 7 aa, Entamoeba dispar
PTNMKSA

SEQ ID NO: 2452929 - protein, 5 aa, Entamoeba dispar
PTNNK

SEQ ID NO: 2452930 - protein, 17 aa, Entamoeba dispar
PTNTLQNTTTGQPIQQP

SEQ ID NO: 2452931 - protein, 4 aa, Entamoeba dispar
PTNV

SEQ ID NO: 2452932 - protein, 6 aa, Entamoeba dispar
PTNVQK

SEQ ID NO: 2452933 - protein, 6 aa, Entamoeba dispar
PTPAQI

SEQ ID NO: 2452934 - protein, 4 aa, Entamoeba dispar
PTPD

SEQ ID NO: 2452935 - protein, 4 aa, Entamoeba dispar
PTPE

SEQ ID NO: 2452936 - protein, 5 aa, Entamoeba dispar
PTPFE

SEQ ID NO: 2452937 - protein, 10 aa, Entamoeba dispar
PTPIGIEEGG

SEQ ID NO: 2452938 - protein, 7 aa, Entamoeba dispar
PTPKKTL

SEQ ID NO: 2452939 - protein, 6 aa, Entamoeba dispar
PTPLIS

SEQ ID NO: 2452940 - protein, 5 aa, Entamoeba dispar
PTPMI

SEQ ID NO: 2452941 - protein, 11 aa, Entamoeba dispar
PTPNVESPTEM

SEQ ID NO: 2452942 - protein, 7 aa, Entamoeba dispar
PTPPNAR

SEQ ID NO: 2452943 - protein, 7 aa, Entamoeba dispar
PTPPSCN

SEQ ID NO: 2452944 - protein, 5 aa, Entamoeba dispar
PTPQK

SEQ ID NO: 2452945 - protein, 6 aa, Entamoeba dispar
PTPSCE

SEQ ID NO: 2452946 - protein, 13 aa, Entamoeba dispar
PTPSNSTKESITP

SEQ ID NO: 2452947 - protein, 5 aa, Entamoeba dispar
PTPST

SEQ ID NO: 2452948 - protein, 4 aa, Entamoeba dispar
PTPV

SEQ ID NO: 2452949 - protein, 5 aa, Entamoeba dispar
PTPYK

SEQ ID NO: 2452950 - protein, 18 aa, Entamoeba dispar
PTQADDQQQLTKKRHVGN

SEQ ID NO: 2452951 - protein, 5 aa, Entamoeba dispar
PTQFQ

SEQ ID NO: 2452952 - protein, 9 aa, Entamoeba dispar
PTQIKPSKY

SEQ ID NO: 2452953 - protein, 7 aa, Entamoeba dispar
PTQPMTY

SEQ ID NO: 2452954 - protein, 5 aa, Entamoeba dispar
PTQRA

SEQ ID NO: 2452955 - protein, 4 aa, Entamoeba dispar
PTQS

SEQ ID NO: 2452956 - protein, 5 aa, Entamoeba dispar
PTQTR

SEQ ID NO: 2452957 - protein, 5 aa, Entamoeba dispar
PTQYG

SEQ ID NO: 2452958 - protein, 16 aa, Entamoeba dispar
PTREDLGYDPEGSDST

SEQ ID NO: 2452959 - protein, 7 aa, Entamoeba dispar
PTRELAS

SEQ ID NO: 2452960 - protein, 15 aa, Entamoeba dispar
PTRKEEYSKYIEETK

SEQ ID NO: 2452961 - protein, 4 aa, Entamoeba dispar
PTRP

SEQ ID NO: 2452962 - protein, 8 aa, Entamoeba dispar
PTRTKTGE

SEQ ID NO: 2452963 - protein, 10 aa, Entamoeba dispar
PTSDHPSATV

SEQ ID NO: 2452964 - protein, 10 aa, Entamoeba dispar
PTSDNDIQKL

SEQ ID NO: 2452965 - protein, 10 aa, Entamoeba dispar
PTSESTKGIT

SEQ ID NO: 2452966 - protein, 5 aa, Entamoeba dispar
PTSFD

SEQ ID NO: 2452967 - protein, 12 aa, Entamoeba dispar
PTSIPQRTLPPA

SEQ ID NO: 2452968 - protein, 7 aa, Entamoeba dispar
PTSISEL

SEQ ID NO: 2452969 - protein, 11 aa, Entamoeba dispar
PTSKKESMRHK

SEQ ID NO: 2452970 - protein, 9 aa, Entamoeba dispar
PTSNWTNEE

SEQ ID NO: 2452971 - protein, 6 aa, Entamoeba dispar
PTSPID

SEQ ID NO: 2452972 - protein, 8 aa, Entamoeba dispar
PTSQDHWT

SEQ ID NO: 2452973 - protein, 7 aa, Entamoeba dispar
PTSRELP

SEQ ID NO: 2452974 - protein, 5 aa, Entamoeba dispar
PTSTI

SEQ ID NO: 2452975 - protein, 4 aa, Entamoeba dispar
PTSV

SEQ ID NO: 2452976 - protein, 5 aa, Entamoeba dispar
PTSVS

SEQ ID NO: 2452977 - protein, 7 aa, Entamoeba dispar
PTSVSEL

SEQ ID NO: 2452978 - protein, 6 aa, Entamoeba dispar
PTSVSK

SEQ ID NO: 2452979 - protein, 9 aa, Entamoeba dispar
PTSVSKLGN

SEQ ID NO: 2452980 - protein, 5 aa, Entamoeba dispar
PTSVT

SEQ ID NO: 2452981 - protein, 7 aa, Entamoeba dispar
PTSVTEI

SEQ ID NO: 2452982 - protein, 4 aa, Entamoeba dispar
PTTA

SEQ ID NO: 2452983 - protein, 4 aa, Entamoeba dispar
PTTE

SEQ ID NO: 2452984 - protein, 13 aa, Entamoeba dispar
PTTESNKNEQQFK

SEQ ID NO: 2452985 - protein, 5 aa, Entamoeba dispar
PTTGI

SEQ ID NO: 2452986 - protein, 7 aa, Entamoeba dispar
PTTIEPN

SEQ ID NO: 2452987 - protein, 5 aa, Entamoeba dispar
PTTIP

SEQ ID NO: 2452988 - protein, 6 aa, Entamoeba dispar
PTTIPN

SEQ ID NO: 2452989 - protein, 4 aa, Entamoeba dispar
PTTL

SEQ ID NO: 2452990 - protein, 15 aa, Entamoeba dispar
PTTLPIKGGDEEIKE

SEQ ID NO: 2452991 - protein, 7 aa, Entamoeba dispar
PTTNPIY

SEQ ID NO: 2452992 - protein, 22 aa, Entamoeba dispar
PTTPHLKPKLNESLSQPITPSL

SEQ ID NO: 2452993 - protein, 5 aa, Entamoeba dispar
PTTRS

SEQ ID NO: 2452994 - protein, 5 aa, Entamoeba dispar
PTTSE

SEQ ID NO: 2452995 - protein, 11 aa, Entamoeba dispar
PTTSLSKKKDS

SEQ ID NO: 2452996 - protein, 14 aa, Entamoeba dispar
PTTSNVQSDSKDNF

SEQ ID NO: 2452997 - protein, 28 aa, Entamoeba dispar
PTTSSIQMEKEEQYPPLPQPQRIDGHTN

SEQ ID NO: 2452998 - protein, 15 aa, Entamoeba dispar
PTTSTRSDNTGNQFR

SEQ ID NO: 2452999 - protein, 4 aa, Entamoeba dispar
PTTT

SEQ ID NO: 2453000 - protein, 11 aa, Entamoeba dispar
PTTTEIKNSLN

SEQ ID NO: 2453001 - protein, 9 aa, Entamoeba dispar
PTTTHSGEF

SEQ ID NO: 2453002 - protein, 5 aa, Entamoeba dispar
PTTVP

SEQ ID NO: 2453003 - protein, 5 aa, Entamoeba dispar
PTTVS

SEQ ID NO: 2453004 - protein, 15 aa, Entamoeba dispar
PTTVSKIEDESFQEC

SEQ ID NO: 2453005 - protein, 5 aa, Entamoeba dispar
PTTYP

SEQ ID NO: 2453006 - protein, 9 aa, Entamoeba dispar
PTVKGKESW

SEQ ID NO: 2453007 - protein, 4 aa, Entamoeba dispar
PTVN

SEQ ID NO: 2453008 - protein, 10 aa, Entamoeba dispar
PTVTDSKPPI

SEQ ID NO: 2453009 - protein, 6 aa, Entamoeba dispar
PTVTTE

SEQ ID NO: 2453010 - protein, 7 aa, Entamoeba dispar
PTYGGGN

SEQ ID NO: 2453011 - protein, 22 aa, Entamoeba dispar
PTYLSQEQKDELKKVLSNINNW

SEQ ID NO: 2453012 - protein, 22 aa, Entamoeba dispar
PTYLSQQQKDDLKKVLKTVHNW

SEQ ID NO: 2453013 - protein, 4 aa, Entamoeba dispar
PTYP

SEQ ID NO: 2453014 - protein, 6 aa, Entamoeba dispar
PTYPKD

SEQ ID NO: 2453015 - protein, 6 aa, Entamoeba dispar
PTYPQG

SEQ ID NO: 2453016 - protein, 5 aa, Entamoeba dispar
PTYRT

SEQ ID NO: 2453017 - protein, 8 aa, Entamoeba dispar
PTYTQQQK

SEQ ID NO: 2453018 - protein, 7 aa, Entamoeba dispar
PTYTSDQ

SEQ ID NO: 2453019 - protein, 52 aa, Entamoeba dispar
PVAEQVKASNHKSRISRHTHSGEKKEKQDNTITETKEEKEGSPIVAMEEENK

SEQ ID NO: 2453020 - protein, 6 aa, Entamoeba dispar
PVAGET

SEQ ID NO: 2453021 - protein, 11 aa, Entamoeba dispar
PVDASKDGIKA

SEQ ID NO: 2453022 - protein, 8 aa, Entamoeba dispar
PVDDPNYN

SEQ ID NO: 2453023 - protein, 5 aa, Entamoeba dispar
PVDEY

SEQ ID NO: 2453024 - protein, 5 aa, Entamoeba dispar
PVDPF

SEQ ID NO: 2453025 - protein, 5 aa, Entamoeba dispar
PVDPK

SEQ ID NO: 2453026 - protein, 7 aa, Entamoeba dispar
PVDPQLT

SEQ ID NO: 2453027 - protein, 8 aa, Entamoeba dispar
PVDVPKEG

SEQ ID NO: 2453028 - protein, 5 aa, Entamoeba dispar
PVEEL

SEQ ID NO: 2453029 - protein, 15 aa, Entamoeba dispar
PVEGTETRVNASADC

SEQ ID NO: 2453030 - protein, 14 aa, Entamoeba dispar
PVEKDNDDKETSQI

SEQ ID NO: 2453031 - protein, 12 aa, Entamoeba dispar
PVEKDTDGNNPH

SEQ ID NO: 2453032 - protein, 7 aa, Entamoeba dispar
PVEQNET

SEQ ID NO: 2453033 - protein, 18 aa, Entamoeba dispar
PVETANEWKEGTSNEPDM

SEQ ID NO: 2453034 - protein, 12 aa, Entamoeba dispar
PVGDKPQPPEPN

SEQ ID NO: 2453035 - protein, 11 aa, Entamoeba dispar
PVGKYTQPFKT

SEQ ID NO: 2453036 - protein, 5 aa, Entamoeba dispar
PVGNG

SEQ ID NO: 2453037 - protein, 9 aa, Entamoeba dispar
PVGSSEATL

SEQ ID NO: 2453038 - protein, 5 aa, Entamoeba dispar
PVGVP

SEQ ID NO: 2453039 - protein, 4 aa, Entamoeba dispar
PVHN

SEQ ID NO: 2453040 - protein, 4 aa, Entamoeba dispar
PVID

SEQ ID NO: 2453041 - protein, 11 aa, Entamoeba dispar
PVIDEEPTKRI

SEQ ID NO: 2453042 - protein, 8 aa, Entamoeba dispar
PVKETPGW

SEQ ID NO: 2453043 - protein, 4 aa, Entamoeba dispar
PVKK

SEQ ID NO: 2453044 - protein, 10 aa, Entamoeba dispar
PVKKDKGEIE

SEQ ID NO: 2453045 - protein, 8 aa, Entamoeba dispar
PVKSTPQL

SEQ ID NO: 2453046 - protein, 11 aa, Entamoeba dispar
PVKTRKGIAPS

SEQ ID NO: 2453047 - protein, 10 aa, Entamoeba dispar
PVLTQEGKEI

SEQ ID NO: 2453048 - protein, 24 aa, Entamoeba dispar
PVNDEKTFSSNNDGGYFSPRSSRY

SEQ ID NO: 2453049 - protein, 4 aa, Entamoeba dispar
PVNK

SEQ ID NO: 2453050 - protein, 9 aa, Entamoeba dispar
PVNKPTYGK

SEQ ID NO: 2453051 - protein, 6 aa, Entamoeba dispar
PVNPNL

SEQ ID NO: 2453052 - protein, 7 aa, Entamoeba dispar
PVNSSQI

SEQ ID NO: 2453053 - protein, 5 aa, Entamoeba dispar
PVPDN

SEQ ID NO: 2453054 - protein, 5 aa, Entamoeba dispar
PVPER

SEQ ID NO: 2453055 - protein, 13 aa, Entamoeba dispar
PVPGTQPTLPSIP

SEQ ID NO: 2453056 - protein, 11 aa, Entamoeba dispar
PVPKKTEEWVK

SEQ ID NO: 2453057 - protein, 15 aa, Entamoeba dispar
PVPSYPVPPSLDMTF

SEQ ID NO: 2453058 - protein, 4 aa, Entamoeba dispar
PVQH

SEQ ID NO: 2453059 - protein, 10 aa, Entamoeba dispar
PVQNDTSITF

SEQ ID NO: 2453060 - protein, 10 aa, Entamoeba dispar
PVQQSKKTIE

SEQ ID NO: 2453061 - protein, 77 aa, Entamoeba dispar
PVQSIQKEETSNTLPSVQQKPTIPQIKSSKKGNEIVTDKNPTTGLSTISKEDKKKSSEKKEIKTTTPQGNEIKEEIN

SEQ ID NO: 2453062 - protein, 8 aa, Entamoeba dispar
PVRDGNAK

SEQ ID NO: 2453063 - protein, 7 aa, Entamoeba dispar
PVREPTQ

SEQ ID NO: 2453064 - protein, 4 aa, Entamoeba dispar
PVRG

SEQ ID NO: 2453065 - protein, 6 aa, Entamoeba dispar
PVRIPT

SEQ ID NO: 2453066 - protein, 12 aa, Entamoeba dispar
PVRNTKNSSKIS

SEQ ID NO: 2453067 - protein, 5 aa, Entamoeba dispar
PVRRD

SEQ ID NO: 2453068 - protein, 10 aa, Entamoeba dispar
PVSASESLRG

SEQ ID NO: 2453069 - protein, 5 aa, Entamoeba dispar
PVSDN

SEQ ID NO: 2453070 - protein, 10 aa, Entamoeba dispar
PVSDRDSVRN

SEQ ID NO: 2453071 - protein, 5 aa, Entamoeba dispar
PVSEL

SEQ ID NO: 2453072 - protein, 4 aa, Entamoeba dispar
PVSF

SEQ ID NO: 2453073 - protein, 15 aa, Entamoeba dispar
PVSGEKFDPVDKNQF

SEQ ID NO: 2453074 - protein, 7 aa, Entamoeba dispar
PVSKGKE

SEQ ID NO: 2453075 - protein, 34 aa, Entamoeba dispar
PVSNTGPLSPTFKKRGRTFSQTRNASFDKKSSPL

SEQ ID NO: 2453076 - protein, 16 aa, Entamoeba dispar
PVSPKPSQQSKPSDIL

SEQ ID NO: 2453077 - protein, 8 aa, Entamoeba dispar
PVSRRSSF

SEQ ID NO: 2453078 - protein, 6 aa, Entamoeba dispar
PVSSIQ

SEQ ID NO: 2453079 - protein, 5 aa, Entamoeba dispar
PVTGT

SEQ ID NO: 2453080 - protein, 4 aa, Entamoeba dispar
PVTL

SEQ ID NO: 2453081 - protein, 5 aa, Entamoeba dispar
PVTPI

SEQ ID NO: 2453082 - protein, 20 aa, Entamoeba dispar
PVTPREFTSTKEVDGVEILD

SEQ ID NO: 2453083 - protein, 31 aa, Entamoeba dispar
PVVAEEPKKVVEKKDEKKTEKKSKAGKKNAK

SEQ ID NO: 2453084 - protein, 31 aa, Entamoeba dispar
PVVAEEPKKVVEKKEEKKTEKKSKAGKKTAK

SEQ ID NO: 2453085 - protein, 5 aa, Entamoeba dispar
PVVPT

SEQ ID NO: 2453086 - protein, 4 aa, Entamoeba dispar
PVYQ

SEQ ID NO: 2453087 - protein, 13 aa, Entamoeba dispar
PVYTTQVQNTGGV

SEQ ID NO: 2453088 - protein, 28 aa, Entamoeba dispar
PWGETPSTKKANKEKKTNEESYQSQQQH

SEQ ID NO: 2453089 - protein, 14 aa, Entamoeba dispar
PWGGPTKCRNKRSL

SEQ ID NO: 2453090 - protein, 4 aa, Entamoeba dispar
PWQG

SEQ ID NO: 2453091 - protein, 9 aa, Entamoeba dispar
PWTEESNDR

SEQ ID NO: 2453092 - protein, 10 aa, Entamoeba dispar
PWTSNDDEKL

SEQ ID NO: 2453093 - protein, 5 aa, Entamoeba dispar
PWTTK

SEQ ID NO: 2453094 - protein, 7 aa, Entamoeba dispar
PYAPSAL

SEQ ID NO: 2453095 - protein, 8 aa, Entamoeba dispar
PYAQDSMK

SEQ ID NO: 2453096 - protein, 4 aa, Entamoeba dispar
PYCE

SEQ ID NO: 2453097 - protein, 11 aa, Entamoeba dispar
PYDDDVPDDWG

SEQ ID NO: 2453098 - protein, 21 aa, Entamoeba dispar
PYDDDVPDDWGYTTEQSIELN

SEQ ID NO: 2453099 - protein, 6 aa, Entamoeba dispar
PYDGEV

SEQ ID NO: 2453100 - protein, 7 aa, Entamoeba dispar
PYDGSKN

SEQ ID NO: 2453101 - protein, 5 aa, Entamoeba dispar
PYDQK

SEQ ID NO: 2453102 - protein, 6 aa, Entamoeba dispar
PYDREA

SEQ ID NO: 2453103 - protein, 14 aa, Entamoeba dispar
PYDSKQSTRYSSTD

SEQ ID NO: 2453104 - protein, 4 aa, Entamoeba dispar
PYDT

SEQ ID NO: 2453105 - protein, 5 aa, Entamoeba dispar
PYEDT

SEQ ID NO: 2453106 - protein, 6 aa, Entamoeba dispar
PYEENE

SEQ ID NO: 2453107 - protein, 6 aa, Entamoeba dispar
PYEGYE

SEQ ID NO: 2453108 - protein, 10 aa, Entamoeba dispar
PYEKEQFTQS

SEQ ID NO: 2453109 - protein, 4 aa, Entamoeba dispar
PYFD

SEQ ID NO: 2453110 - protein, 6 aa, Entamoeba dispar
PYFGNG

SEQ ID NO: 2453111 - protein, 5 aa, Entamoeba dispar
PYGAP

SEQ ID NO: 2453112 - protein, 5 aa, Entamoeba dispar
PYGDL

SEQ ID NO: 2453113 - protein, 6 aa, Entamoeba dispar
PYGGNQ

SEQ ID NO: 2453114 - protein, 14 aa, Entamoeba dispar
PYGNPRVTKDGVSV

SEQ ID NO: 2453115 - protein, 4 aa, Entamoeba dispar
PYGQ

SEQ ID NO: 2453116 - protein, 6 aa, Entamoeba dispar
PYGTKP

SEQ ID NO: 2453117 - protein, 6 aa, Entamoeba dispar
PYGTSY

SEQ ID NO: 2453118 - protein, 7 aa, Entamoeba dispar
PYIDDPP

SEQ ID NO: 2453119 - protein, 8 aa, Entamoeba dispar
PYIKKDQA

SEQ ID NO: 2453120 - protein, 13 aa, Entamoeba dispar
PYIPTSPKPKIPK

SEQ ID NO: 2453121 - protein, 35 aa, Entamoeba dispar
PYKQTKERVEYPTNTTNEKKVSRTSSFYSQNGTNE

SEQ ID NO: 2453122 - protein, 12 aa, Entamoeba dispar
PYKSNGYTSSQV

SEQ ID NO: 2453123 - protein, 4 aa, Entamoeba dispar
PYLK

SEQ ID NO: 2453124 - protein, 6 aa, Entamoeba dispar
PYLTEP

SEQ ID NO: 2453125 - protein, 5 aa, Entamoeba dispar
PYNNV

SEQ ID NO: 2453126 - protein, 4 aa, Entamoeba dispar
PYNP

SEQ ID NO: 2453127 - protein, 13 aa, Entamoeba dispar
PYNQSNILHSMSN

SEQ ID NO: 2453128 - protein, 11 aa, Entamoeba dispar
PYNSTQSPCQE

SEQ ID NO: 2453129 - protein, 5 aa, Entamoeba dispar
PYNTP

SEQ ID NO: 2453130 - protein, 12 aa, Entamoeba dispar
PYNYPQQPNTYP

SEQ ID NO: 2453131 - protein, 5 aa, Entamoeba dispar
PYPDH

SEQ ID NO: 2453132 - protein, 5 aa, Entamoeba dispar
PYPIS

SEQ ID NO: 2453133 - protein, 5 aa, Entamoeba dispar
PYPKE

SEQ ID NO: 2453134 - protein, 6 aa, Entamoeba dispar
PYPSEL

SEQ ID NO: 2453135 - protein, 12 aa, Entamoeba dispar
PYPSPFEKYIQF

SEQ ID NO: 2453136 - protein, 6 aa, Entamoeba dispar
PYPYNY

SEQ ID NO: 2453137 - protein, 8 aa, Entamoeba dispar
PYQPPYQP

SEQ ID NO: 2453138 - protein, 21 aa, Entamoeba dispar
PYQSSKPIRTNMSEDNEPRSF

SEQ ID NO: 2453139 - protein, 46 aa, Entamoeba dispar
PYRDISPQPSLQAQESLPSSLPSSFSLSPQSSYKPGNGFIQFFQKD

SEQ ID NO: 2453140 - protein, 4 aa, Entamoeba dispar
PYRG

SEQ ID NO: 2453141 - protein, 5 aa, Entamoeba dispar
PYRHD

SEQ ID NO: 2453142 - protein, 5 aa, Entamoeba dispar
PYRRA

SEQ ID NO: 2453143 - protein, 6 aa, Entamoeba dispar
PYRRTT

SEQ ID NO: 2453144 - protein, 7 aa, Entamoeba dispar
PYRSPTI

SEQ ID NO: 2453145 - protein, 7 aa, Entamoeba dispar
PYSEHSS

SEQ ID NO: 2453146 - protein, 7 aa, Entamoeba dispar
PYSEPSN

SEQ ID NO: 2453147 - protein, 8 aa, Entamoeba dispar
PYSGKKEI

SEQ ID NO: 2453148 - protein, 4 aa, Entamoeba dispar
PYSI

SEQ ID NO: 2453149 - protein, 8 aa, Entamoeba dispar
PYSNSQTI

SEQ ID NO: 2453150 - protein, 16 aa, Entamoeba dispar
PYSPSCESNENSSLSV

SEQ ID NO: 2453151 - protein, 9 aa, Entamoeba dispar
PYSQQGLST

SEQ ID NO: 2453152 - protein, 5 aa, Entamoeba dispar
PYTAS

SEQ ID NO: 2453153 - protein, 5 aa, Entamoeba dispar
PYTGQ

SEQ ID NO: 2453154 - protein, 7 aa, Entamoeba dispar
PYTGRDS

SEQ ID NO: 2453155 - protein, 4 aa, Entamoeba dispar
PYTI

SEQ ID NO: 2453156 - protein, 7 aa, Entamoeba dispar
PYTNTYD

SEQ ID NO: 2453157 - protein, 15 aa, Entamoeba dispar
PYTSKGYSSSQVPKN

SEQ ID NO: 2453158 - protein, 5 aa, Entamoeba dispar
PYTTI

SEQ ID NO: 2453159 - protein, 10 aa, Entamoeba dispar
PYTYPPSPND

SEQ ID NO: 2453160 - protein, 13 aa, Entamoeba dispar
PYVPSEEPVDERS

SEQ ID NO: 2453161 - protein, 4 aa, Entamoeba dispar
PYYG

SEQ ID NO: 2453162 - protein, 6 aa, Entamoeba dispar
QAAEDA

SEQ ID NO: 2453163 - protein, 9 aa, Entamoeba dispar
QAANDLNIK

SEQ ID NO: 2453164 - protein, 10 aa, Entamoeba dispar
QAANDLSIKT

SEQ ID NO: 2453165 - protein, 12 aa, Entamoeba dispar
QAANNASGINSD

SEQ ID NO: 2453166 - protein, 14 aa, Entamoeba dispar
QAAQKEMEEVFNKK

SEQ ID NO: 2453167 - protein, 4 aa, Entamoeba dispar
QAAR

SEQ ID NO: 2453168 - protein, 23 aa, Entamoeba dispar
QAAREAARREAEERRNKKQEERL

SEQ ID NO: 2453169 - protein, 6 aa, Entamoeba dispar
QAASEG

SEQ ID NO: 2453170 - protein, 10 aa, Entamoeba dispar
QAATDPETGI

SEQ ID NO: 2453171 - protein, 11 aa, Entamoeba dispar
QACEAAQKENI

SEQ ID NO: 2453172 - protein, 22 aa, Entamoeba dispar
QADDEEVDNEEEYLNSSDSIEE

SEQ ID NO: 2453173 - protein, 4 aa, Entamoeba dispar
QADE

SEQ ID NO: 2453174 - protein, 5 aa, Entamoeba dispar
QADIK

SEQ ID NO: 2453175 - protein, 6 aa, Entamoeba dispar
QADKIE

SEQ ID NO: 2453176 - protein, 35 aa, Entamoeba dispar
QADPAVSNAPSLSPNPVQPKEETFKPQISTSSSAG

SEQ ID NO: 2453177 - protein, 6 aa, Entamoeba dispar
QADPSS

SEQ ID NO: 2453178 - protein, 10 aa, Entamoeba dispar
QADQKPREEV

SEQ ID NO: 2453179 - protein, 13 aa, Entamoeba dispar
QADSFRKSKPELL

SEQ ID NO: 2453180 - protein, 46 aa, Entamoeba dispar
QAEAVEEDLSSFDETLEKPEDDATQSPQQTQKKGRTKKNRTNTQKI

SEQ ID NO: 2453181 - protein, 4 aa, Entamoeba dispar
QAED

SEQ ID NO: 2453182 - protein, 5 aa, Entamoeba dispar
QAEDE

SEQ ID NO: 2453183 - protein, 7 aa, Entamoeba dispar
QAEDPKA

SEQ ID NO: 2453184 - protein, 4 aa, Entamoeba dispar
QAEH

SEQ ID NO: 2453185 - protein, 4 aa, Entamoeba dispar
QAEM

SEQ ID NO: 2453186 - protein, 39 aa, Entamoeba dispar
QAEPPKEKIEKEVEEQPQQVTKEDTQSGPFENKYYTPQK

SEQ ID NO: 2453187 - protein, 41 aa, Entamoeba dispar
QAGAAGGMPGGMPNGFPGAGAAPQGNAQPKSSGKGPTIEEV

SEQ ID NO: 2453188 - protein, 5 aa, Entamoeba dispar
QAGAD

SEQ ID NO: 2453189 - protein, 8 aa, Entamoeba dispar
QAGGDIGK

SEQ ID NO: 2453190 - protein, 8 aa, Entamoeba dispar
QAHEGQHS

SEQ ID NO: 2453191 - protein, 4 aa, Entamoeba dispar
QAHN

SEQ ID NO: 2453192 - protein, 13 aa, Entamoeba dispar
QAIDPISKKPYTF

SEQ ID NO: 2453193 - protein, 5 aa, Entamoeba dispar
QAIES

SEQ ID NO: 2453194 - protein, 12 aa, Entamoeba dispar
QAIGARSQSCRT

SEQ ID NO: 2453195 - protein, 4 aa, Entamoeba dispar
QAIH

SEQ ID NO: 2453196 - protein, 23 aa, Entamoeba dispar
QAIKKTKEQLAARKVAKKAAKKM

SEQ ID NO: 2453197 - protein, 22 aa, Entamoeba dispar
QAINEKDKIGKELSEKIQKEDI

SEQ ID NO: 2453198 - protein, 7 aa, Entamoeba dispar
QAIPSDL

SEQ ID NO: 2453199 - protein, 6 aa, Entamoeba dispar
QAKAEY

SEQ ID NO: 2453200 - protein, 10 aa, Entamoeba dispar
QAKDSITSIS

SEQ ID NO: 2453201 - protein, 9 aa, Entamoeba dispar
QAKEIGGNK

SEQ ID NO: 2453202 - protein, 34 aa, Entamoeba dispar
QAKKEESKFTSKIPNVSEKEIEKKKEKAQETKTI

SEQ ID NO: 2453203 - protein, 11 aa, Entamoeba dispar
QAKKHGEEAKF

SEQ ID NO: 2453204 - protein, 11 aa, Entamoeba dispar
QAKKHPESGAV

SEQ ID NO: 2453205 - protein, 22 aa, Entamoeba dispar
QAKKKAEEQQKLNSQEEEKKII

SEQ ID NO: 2453206 - protein, 9 aa, Entamoeba dispar
QAKNVLPKT

SEQ ID NO: 2453207 - protein, 14 aa, Entamoeba dispar
QAKPDDIEECNDGN

SEQ ID NO: 2453208 - protein, 5 aa, Entamoeba dispar
QAKSA

SEQ ID NO: 2453209 - protein, 6 aa, Entamoeba dispar
QAKSEE

SEQ ID NO: 2453210 - protein, 6 aa, Entamoeba dispar
QAKTND

SEQ ID NO: 2453211 - protein, 21 aa, Entamoeba dispar
QALDNASQMSSGSETIKTKDE

SEQ ID NO: 2453212 - protein, 6 aa, Entamoeba dispar
QALENS

SEQ ID NO: 2453213 - protein, 12 aa, Entamoeba dispar
QALPPSKVKYQP

SEQ ID NO: 2453214 - protein, 9 aa, Entamoeba dispar
QALSPDEKI

SEQ ID NO: 2453215 - protein, 7 aa, Entamoeba dispar
QALTENA

SEQ ID NO: 2453216 - protein, 11 aa, Entamoeba dispar
QANKGLKKSHF

SEQ ID NO: 2453217 - protein, 12 aa, Entamoeba dispar
QANNTSSSSDGV

SEQ ID NO: 2453218 - protein, 19 aa, Entamoeba dispar
QANPLSSDSSKSKETTKSF

SEQ ID NO: 2453219 - protein, 6 aa, Entamoeba dispar
QANQED

SEQ ID NO: 2453220 - protein, 60 aa, Entamoeba dispar
QANSEIKSLETENNSLKSSIQNLENKVSDLSRTSTSVKKVSTEEPKIGYSGSKTPQSTVN

SEQ ID NO: 2453221 - protein, 8 aa, Entamoeba dispar
QANTLTQS

SEQ ID NO: 2453222 - protein, 10 aa, Entamoeba dispar
QANTTHEKAY

SEQ ID NO: 2453223 - protein, 7 aa, Entamoeba dispar
QANYEKK

SEQ ID NO: 2453224 - protein, 9 aa, Entamoeba dispar
QANYKYKQE

SEQ ID NO: 2453225 - protein, 11 aa, Entamoeba dispar
QAPAKAKGQIS

SEQ ID NO: 2453226 - protein, 7 aa, Entamoeba dispar
QAPEERA

SEQ ID NO: 2453227 - protein, 5 aa, Entamoeba dispar
QAPKV

SEQ ID NO: 2453228 - protein, 6 aa, Entamoeba dispar
QAPNKY

SEQ ID NO: 2453229 - protein, 23 aa, Entamoeba dispar
QAPPKPIPQPSTKPPKKQSPSKT

SEQ ID NO: 2453230 - protein, 7 aa, Entamoeba dispar
QAPTEDD

SEQ ID NO: 2453231 - protein, 6 aa, Entamoeba dispar
QAPTLE

SEQ ID NO: 2453232 - protein, 22 aa, Entamoeba dispar
QAQQEQHEEQKVEESTQKDSKF

SEQ ID NO: 2453233 - protein, 25 aa, Entamoeba dispar
QAQRDASMSNGSNQNFTPPLPQSPA

SEQ ID NO: 2453234 - protein, 25 aa, Entamoeba dispar
QAQREAKKAEIEQQKQEEELSRQEE

SEQ ID NO: 2453235 - protein, 16 aa, Entamoeba dispar
QAQRTEKLSKITGRHA

SEQ ID NO: 2453236 - protein, 11 aa, Entamoeba dispar
QAQSGTGKTAA

SEQ ID NO: 2453237 - protein, 4 aa, Entamoeba dispar
QAQT

SEQ ID NO: 2453238 - protein, 7 aa, Entamoeba dispar
QAREDRN

SEQ ID NO: 2453239 - protein, 7 aa, Entamoeba dispar
QARNQNE

SEQ ID NO: 2453240 - protein, 6 aa, Entamoeba dispar
QASEHS

SEQ ID NO: 2453241 - protein, 6 aa, Entamoeba dispar
QASPHS

SEQ ID NO: 2453242 - protein, 10 aa, Entamoeba dispar
QASQGEPGEI

SEQ ID NO: 2453243 - protein, 6 aa, Entamoeba dispar
QASQGL

SEQ ID NO: 2453244 - protein, 8 aa, Entamoeba dispar
QASSNITS

SEQ ID NO: 2453245 - protein, 10 aa, Entamoeba dispar
QASTDPGARG

SEQ ID NO: 2453246 - protein, 12 aa, Entamoeba dispar
QASWNKNCSENI

SEQ ID NO: 2453247 - protein, 9 aa, Entamoeba dispar
QATESAQEL

SEQ ID NO: 2453248 - protein, 5 aa, Entamoeba dispar
QATFS

SEQ ID NO: 2453249 - protein, 9 aa, Entamoeba dispar
QATGKSEQL

SEQ ID NO: 2453250 - protein, 12 aa, Entamoeba dispar
QATGYASDAYTA

SEQ ID NO: 2453251 - protein, 10 aa, Entamoeba dispar
QATIETGKDY

SEQ ID NO: 2453252 - protein, 13 aa, Entamoeba dispar
QATKTSAQQLETK

SEQ ID NO: 2453253 - protein, 9 aa, Entamoeba dispar
QATQIQQQQ

SEQ ID NO: 2453254 - protein, 7 aa, Entamoeba dispar
QATSDLY

SEQ ID NO: 2453255 - protein, 4 aa, Entamoeba dispar
QATV

SEQ ID NO: 2453256 - protein, 6 aa, Entamoeba dispar
QAVKEG

SEQ ID NO: 2453257 - protein, 8 aa, Entamoeba dispar
QAVQENKP

SEQ ID NO: 2453258 - protein, 12 aa, Entamoeba dispar
QAVSTQIERGTP

SEQ ID NO: 2453259 - protein, 17 aa, Entamoeba dispar
QAYSSQDQEYEKNEFYG

SEQ ID NO: 2453260 - protein, 7 aa, Entamoeba dispar
QCEGGST

SEQ ID NO: 2453261 - protein, 6 aa, Entamoeba dispar
QCESSH

SEQ ID NO: 2453262 - protein, 17 aa, Entamoeba dispar
QCGAGQPKIPPAKKADF

SEQ ID NO: 2453263 - protein, 17 aa, Entamoeba dispar
QCGKQNDAQRSERYKEL

SEQ ID NO: 2453264 - protein, 5 aa, Entamoeba dispar
QCGNA

SEQ ID NO: 2453265 - protein, 12 aa, Entamoeba dispar
QCIGDKEDQCYY

SEQ ID NO: 2453266 - protein, 8 aa, Entamoeba dispar
QCKNTKEI

SEQ ID NO: 2453267 - protein, 8 aa, Entamoeba dispar
QCKSTDNT

SEQ ID NO: 2453268 - protein, 8 aa, Entamoeba dispar
QCLTETRS

SEQ ID NO: 2453269 - protein, 9 aa, Entamoeba dispar
QCNDPRTKE

SEQ ID NO: 2453270 - protein, 4 aa, Entamoeba dispar
QCPC

SEQ ID NO: 2453271 - protein, 8 aa, Entamoeba dispar
QCPSPSEF

SEQ ID NO: 2453272 - protein, 5 aa, Entamoeba dispar
QCPSY

SEQ ID NO: 2453273 - protein, 8 aa, Entamoeba dispar
QCQNATRI

SEQ ID NO: 2453274 - protein, 11 aa, Entamoeba dispar
QCQTQNVKTIK

SEQ ID NO: 2453275 - protein, 7 aa, Entamoeba dispar
QCRDDEK

SEQ ID NO: 2453276 - protein, 9 aa, Entamoeba dispar
QCSKSNFNE

SEQ ID NO: 2453277 - protein, 9 aa, Entamoeba dispar
QCSNAEKKL

SEQ ID NO: 2453278 - protein, 5 aa, Entamoeba dispar
QCSPP

SEQ ID NO: 2453279 - protein, 11 aa, Entamoeba dispar
QCSRKESKVTF

SEQ ID NO: 2453280 - protein, 8 aa, Entamoeba dispar
QCTNEQKS

SEQ ID NO: 2453281 - protein, 5 aa, Entamoeba dispar
QCTQQ

SEQ ID NO: 2453282 - protein, 14 aa, Entamoeba dispar
QCVKQSSASIVSPN

SEQ ID NO: 2453283 - protein, 11 aa, Entamoeba dispar
QDADDRPKEQF

SEQ ID NO: 2453284 - protein, 5 aa, Entamoeba dispar
QDAPD

SEQ ID NO: 2453285 - protein, 9 aa, Entamoeba dispar
QDCEEEEGI

SEQ ID NO: 2453286 - protein, 10 aa, Entamoeba dispar
QDCYPDTKKI

SEQ ID NO: 2453287 - protein, 6 aa, Entamoeba dispar
QDDFGN

SEQ ID NO: 2453288 - protein, 8 aa, Entamoeba dispar
QDDGTATI

SEQ ID NO: 2453289 - protein, 12 aa, Entamoeba dispar
QDDKETDDTKNV

SEQ ID NO: 2453290 - protein, 9 aa, Entamoeba dispar
QDDNDKELK

SEQ ID NO: 2453291 - protein, 6 aa, Entamoeba dispar
QDDNYN

SEQ ID NO: 2453292 - protein, 7 aa, Entamoeba dispar
QDDSIQE

SEQ ID NO: 2453293 - protein, 8 aa, Entamoeba dispar
QDDSPNTA

SEQ ID NO: 2453294 - protein, 8 aa, Entamoeba dispar
QDDTERYK

SEQ ID NO: 2453295 - protein, 14 aa, Entamoeba dispar
QDEAKEKNSTIGEL

SEQ ID NO: 2453296 - protein, 8 aa, Entamoeba dispar
QDEDEKTL

SEQ ID NO: 2453297 - protein, 24 aa, Entamoeba dispar
QDEEDEDDSENADPLKPKIEEDLD

SEQ ID NO: 2453298 - protein, 29 aa, Entamoeba dispar
QDEKSISCQQSHGSERKKFKKDEAKYTLK

SEQ ID NO: 2453299 - protein, 8 aa, Entamoeba dispar
QDEKSKKV

SEQ ID NO: 2453300 - protein, 6 aa, Entamoeba dispar
QDEKTE

SEQ ID NO: 2453301 - protein, 7 aa, Entamoeba dispar
QDELNLS

SEQ ID NO: 2453302 - protein, 5 aa, Entamoeba dispar
QDELV

SEQ ID NO: 2453303 - protein, 10 aa, Entamoeba dispar
QDEPQKKEIK

SEQ ID NO: 2453304 - protein, 4 aa, Entamoeba dispar
QDEQ

SEQ ID NO: 2453305 - protein, 4 aa, Entamoeba dispar
QDES

SEQ ID NO: 2453306 - protein, 7 aa, Entamoeba dispar
QDETIET

SEQ ID NO: 2453307 - protein, 4 aa, Entamoeba dispar
QDFE

SEQ ID NO: 2453308 - protein, 5 aa, Entamoeba dispar
QDFQD

SEQ ID NO: 2453309 - protein, 4 aa, Entamoeba dispar
QDFS

SEQ ID NO: 2453310 - protein, 5 aa, Entamoeba dispar
QDFSE

SEQ ID NO: 2453311 - protein, 8 aa, Entamoeba dispar
QDFSSTTK

SEQ ID NO: 2453312 - protein, 14 aa, Entamoeba dispar
QDGDVTVSNDGATI

SEQ ID NO: 2453313 - protein, 8 aa, Entamoeba dispar
QDGKTTMA

SEQ ID NO: 2453314 - protein, 14 aa, Entamoeba dispar
QDGKYSSDEQSCNK

SEQ ID NO: 2453315 - protein, 5 aa, Entamoeba dispar
QDGLE

SEQ ID NO: 2453316 - protein, 4 aa, Entamoeba dispar
QDGQ

SEQ ID NO: 2453317 - protein, 6 aa, Entamoeba dispar
QDHNNA

SEQ ID NO: 2453318 - protein, 4 aa, Entamoeba dispar
QDHP

SEQ ID NO: 2453319 - protein, 6 aa, Entamoeba dispar
QDHPPF

SEQ ID NO: 2453320 - protein, 5 aa, Entamoeba dispar
QDHQP

SEQ ID NO: 2453321 - protein, 6 aa, Entamoeba dispar
QDIATV

SEQ ID NO: 2453322 - protein, 7 aa, Entamoeba dispar
QDIDQDN

SEQ ID NO: 2453323 - protein, 28 aa, Entamoeba dispar
QDIEDAKTLYKDKTEKKEFEKERKENEL

SEQ ID NO: 2453324 - protein, 24 aa, Entamoeba dispar
QDIEKKEPNEIKLPPNSPTRHTSN

SEQ ID NO: 2453325 - protein, 13 aa, Entamoeba dispar
QDIEQPNQEEKQF

SEQ ID NO: 2453326 - protein, 9 aa, Entamoeba dispar
QDIETERKR

SEQ ID NO: 2453327 - protein, 4 aa, Entamoeba dispar
QDIG

SEQ ID NO: 2453328 - protein, 14 aa, Entamoeba dispar
QDIKERKRKSAMYT

SEQ ID NO: 2453329 - protein, 19 aa, Entamoeba dispar
QDIKNYKKEHIRKPNTRNH

SEQ ID NO: 2453330 - protein, 6 aa, Entamoeba dispar
QDIPRR

SEQ ID NO: 2453331 - protein, 6 aa, Entamoeba dispar
QDISNY

SEQ ID NO: 2453332 - protein, 12 aa, Entamoeba dispar
QDISSETKGIDS

SEQ ID NO: 2453333 - protein, 6 aa, Entamoeba dispar
QDITDE

SEQ ID NO: 2453334 - protein, 9 aa, Entamoeba dispar
QDKDERPSI

SEQ ID NO: 2453335 - protein, 13 aa, Entamoeba dispar
QDKDFIEKVEEMI

SEQ ID NO: 2453336 - protein, 12 aa, Entamoeba dispar
QDKDGKIKASDL

SEQ ID NO: 2453337 - protein, 8 aa, Entamoeba dispar
QDKENEID

SEQ ID NO: 2453338 - protein, 11 aa, Entamoeba dispar
QDKEVGDGTTS

SEQ ID NO: 2453339 - protein, 4 aa, Entamoeba dispar
QDKG

SEQ ID NO: 2453340 - protein, 6 aa, Entamoeba dispar
QDKQEI

SEQ ID NO: 2453341 - protein, 5 aa, Entamoeba dispar
QDKSD

SEQ ID NO: 2453342 - protein, 7 aa, Entamoeba dispar
QDKSEFN

SEQ ID NO: 2453343 - protein, 18 aa, Entamoeba dispar
QDKTEVKPPQKSSGKCVV

SEQ ID NO: 2453344 - protein, 14 aa, Entamoeba dispar
QDKTKIITGGGDGY

SEQ ID NO: 2453345 - protein, 7 aa, Entamoeba dispar
QDKYNEI

SEQ ID NO: 2453346 - protein, 9 aa, Entamoeba dispar
QDKYPNKWR

SEQ ID NO: 2453347 - protein, 7 aa, Entamoeba dispar
QDKYTEA

SEQ ID NO: 2453348 - protein, 4 aa, Entamoeba dispar
QDLE

SEQ ID NO: 2453349 - protein, 18 aa, Entamoeba dispar
QDLEKKRRRFEEANRKTN

SEQ ID NO: 2453350 - protein, 9 aa, Entamoeba dispar
QDLESSNEY

SEQ ID NO: 2453351 - protein, 4 aa, Entamoeba dispar
QDLG

SEQ ID NO: 2453352 - protein, 5 aa, Entamoeba dispar
QDLPT

SEQ ID NO: 2453353 - protein, 8 aa, Entamoeba dispar
QDLQDEIT

SEQ ID NO: 2453354 - protein, 8 aa, Entamoeba dispar
QDLQPSNI

SEQ ID NO: 2453355 - protein, 5 aa, Entamoeba dispar
QDLTP

SEQ ID NO: 2453356 - protein, 10 aa, Entamoeba dispar
QDMEKQEKLG

SEQ ID NO: 2453357 - protein, 4 aa, Entamoeba dispar
QDMS

SEQ ID NO: 2453358 - protein, 9 aa, Entamoeba dispar
QDNEVIPEE

SEQ ID NO: 2453359 - protein, 5 aa, Entamoeba dispar
QDNFD

SEQ ID NO: 2453360 - protein, 14 aa, Entamoeba dispar
QDNITIKSKEEKKF

SEQ ID NO: 2453361 - protein, 6 aa, Entamoeba dispar
QDNKNG

SEQ ID NO: 2453362 - protein, 6 aa, Entamoeba dispar
QDNQIK

SEQ ID NO: 2453363 - protein, 5 aa, Entamoeba dispar
QDNQV

SEQ ID NO: 2453364 - protein, 4 aa, Entamoeba dispar
QDNS

SEQ ID NO: 2453365 - protein, 8 aa, Entamoeba dispar
QDNSHASD

SEQ ID NO: 2453366 - protein, 7 aa, Entamoeba dispar
QDNSQTF

SEQ ID NO: 2453367 - protein, 7 aa, Entamoeba dispar
QDNSTEV

SEQ ID NO: 2453368 - protein, 11 aa, Entamoeba dispar
QDNVDVGNFEP

SEQ ID NO: 2453369 - protein, 5 aa, Entamoeba dispar
QDPAF

SEQ ID NO: 2453370 - protein, 12 aa, Entamoeba dispar
QDPDEQKGSIEV

SEQ ID NO: 2453371 - protein, 5 aa, Entamoeba dispar
QDPHS

SEQ ID NO: 2453372 - protein, 7 aa, Entamoeba dispar
QDPINGL

SEQ ID NO: 2453373 - protein, 6 aa, Entamoeba dispar
QDPIPS

SEQ ID NO: 2453374 - protein, 6 aa, Entamoeba dispar
QDPLSQ

SEQ ID NO: 2453375 - protein, 13 aa, Entamoeba dispar
QDPQTPKTCSYDG

SEQ ID NO: 2453376 - protein, 9 aa, Entamoeba dispar
QDPRDRPSF

SEQ ID NO: 2453377 - protein, 8 aa, Entamoeba dispar
QDPSHAEL

SEQ ID NO: 2453378 - protein, 10 aa, Entamoeba dispar
QDPVNEINGN

SEQ ID NO: 2453379 - protein, 7 aa, Entamoeba dispar
QDQFDSK

SEQ ID NO: 2453380 - protein, 14 aa, Entamoeba dispar
QDQKEKINQNVIRL

SEQ ID NO: 2453381 - protein, 9 aa, Entamoeba dispar
QDQKKSIQD

SEQ ID NO: 2453382 - protein, 9 aa, Entamoeba dispar
QDQKQRNEL

SEQ ID NO: 2453383 - protein, 4 aa, Entamoeba dispar
QDQL

SEQ ID NO: 2453384 - protein, 8 aa, Entamoeba dispar
QDQMNSDE

SEQ ID NO: 2453385 - protein, 13 aa, Entamoeba dispar
QDQPNQTSINDQF

SEQ ID NO: 2453386 - protein, 22 aa, Entamoeba dispar
QDQVNNSKGENQVQAKQKYERS

SEQ ID NO: 2453387 - protein, 10 aa, Entamoeba dispar
QDREETIDET

SEQ ID NO: 2453388 - protein, 7 aa, Entamoeba dispar
QDRFAGG

SEQ ID NO: 2453389 - protein, 12 aa, Entamoeba dispar
QDRKKKYSQKHH

SEQ ID NO: 2453390 - protein, 9 aa, Entamoeba dispar
QDRQAAESV

SEQ ID NO: 2453391 - protein, 9 aa, Entamoeba dispar
QDRQSPETI

SEQ ID NO: 2453392 - protein, 16 aa, Entamoeba dispar
QDRRDRRRSPRRGFEN

SEQ ID NO: 2453393 - protein, 69 aa, Entamoeba dispar
QDSETRSNKNKEYEKSKEKKKMEEEEDSESESESESESESDDQKEVEKDSDTTEKDSNNGEEKEEKKEV

SEQ ID NO: 2453394 - protein, 71 aa, Entamoeba dispar
QDSETRSNKNKEYEKSKEKKKMEEEEDSESESESESESESESDDQKEVEKDSDTTEKDSNNGEEKEEKKEV

SEQ ID NO: 2453395 - protein, 8 aa, Entamoeba dispar
QDSNKSTA

SEQ ID NO: 2453396 - protein, 7 aa, Entamoeba dispar
QDSPGVD

SEQ ID NO: 2453397 - protein, 7 aa, Entamoeba dispar
QDSPTRK

SEQ ID NO: 2453398 - protein, 8 aa, Entamoeba dispar
QDSQNPLE

SEQ ID NO: 2453399 - protein, 5 aa, Entamoeba dispar
QDSSK

SEQ ID NO: 2453400 - protein, 11 aa, Entamoeba dispar
QDTKDMTPLND

SEQ ID NO: 2453401 - protein, 6 aa, Entamoeba dispar
QDTLNN

SEQ ID NO: 2453402 - protein, 7 aa, Entamoeba dispar
QDTQNTQ

SEQ ID NO: 2453403 - protein, 8 aa, Entamoeba dispar
QDTQSNVR

SEQ ID NO: 2453404 - protein, 8 aa, Entamoeba dispar
QDTSGSDL

SEQ ID NO: 2453405 - protein, 12 aa, Entamoeba dispar
QDTVESSTTVTQ

SEQ ID NO: 2453406 - protein, 4 aa, Entamoeba dispar
QDVN

SEQ ID NO: 2453407 - protein, 8 aa, Entamoeba dispar
QDYEEAPI

SEQ ID NO: 2453408 - protein, 11 aa, Entamoeba dispar
QDYQENEKTFK

SEQ ID NO: 2453409 - protein, 8 aa, Entamoeba dispar
QDYSSPYR

SEQ ID NO: 2453410 - protein, 7 aa, Entamoeba dispar
QDYTNAD

SEQ ID NO: 2453411 - protein, 5 aa, Entamoeba dispar
QEADE

SEQ ID NO: 2453412 - protein, 9 aa, Entamoeba dispar
QEAHTRGEL

SEQ ID NO: 2453413 - protein, 8 aa, Entamoeba dispar
QEAKEAID

SEQ ID NO: 2453414 - protein, 7 aa, Entamoeba dispar
QEAKKIE

SEQ ID NO: 2453415 - protein, 19 aa, Entamoeba dispar
QEAKQSMAEAAAHSRVNSS

SEQ ID NO: 2453416 - protein, 14 aa, Entamoeba dispar
QEAKTDEKVGEKLN

SEQ ID NO: 2453417 - protein, 6 aa, Entamoeba dispar
QEAREI

SEQ ID NO: 2453418 - protein, 6 aa, Entamoeba dispar
QECGNS

SEQ ID NO: 2453419 - protein, 12 aa, Entamoeba dispar
QECPSTSNPSYW

SEQ ID NO: 2453420 - protein, 11 aa, Entamoeba dispar
QECSNEIPSGC

SEQ ID NO: 2453421 - protein, 12 aa, Entamoeba dispar
QEDAEKKTEWGY

SEQ ID NO: 2453422 - protein, 8 aa, Entamoeba dispar
QEDDKKEL

SEQ ID NO: 2453423 - protein, 10 aa, Entamoeba dispar
QEDDLTDIGD

SEQ ID NO: 2453424 - protein, 12 aa, Entamoeba dispar
QEDEDVGKMSGN

SEQ ID NO: 2453425 - protein, 16 aa, Entamoeba dispar
QEDEEINDIEKTSKLN

SEQ ID NO: 2453426 - protein, 8 aa, Entamoeba dispar
QEDENEIE

SEQ ID NO: 2453427 - protein, 17 aa, Entamoeba dispar
QEDETPNPIMNRSGGCA

SEQ ID NO: 2453428 - protein, 10 aa, Entamoeba dispar
QEDIGEEDNV

SEQ ID NO: 2453429 - protein, 50 aa, Entamoeba dispar
QEDLDEKEENNEVKKQDKKGHKKHEKKPKSAQSKKETKDNNIKEKTSNQI

SEQ ID NO: 2453430 - protein, 13 aa, Entamoeba dispar
QEDLKDKSSKEKK

SEQ ID NO: 2453431 - protein, 5 aa, Entamoeba dispar
QEDNN

SEQ ID NO: 2453432 - protein, 27 aa, Entamoeba dispar
QEDQQQLTQSTPVIGQKKEEPKKSSDM

SEQ ID NO: 2453433 - protein, 11 aa, Entamoeba dispar
QEDSKPKKFTY

SEQ ID NO: 2453434 - protein, 14 aa, Entamoeba dispar
QEDTLEDNEIPYDD

SEQ ID NO: 2453435 - protein, 5 aa, Entamoeba dispar
QEEAI

SEQ ID NO: 2453436 - protein, 6 aa, Entamoeba dispar
QEEANE

SEQ ID NO: 2453437 - protein, 8 aa, Entamoeba dispar
QEEAQTEI

SEQ ID NO: 2453438 - protein, 15 aa, Entamoeba dispar
QEEDGEDEQMKKENN

SEQ ID NO: 2453439 - protein, 11 aa, Entamoeba dispar
QEEEEANDEEM

SEQ ID NO: 2453440 - protein, 20 aa, Entamoeba dispar
QEEEERRRIEKEKKKETIKM

SEQ ID NO: 2453441 - protein, 9 aa, Entamoeba dispar
QEEEKRTGS

SEQ ID NO: 2453442 - protein, 5 aa, Entamoeba dispar
QEEES

SEQ ID NO: 2453443 - protein, 8 aa, Entamoeba dispar
QEEFQEGC

SEQ ID NO: 2453444 - protein, 4 aa, Entamoeba dispar
QEEI

SEQ ID NO: 2453445 - protein, 7 aa, Entamoeba dispar
QEEIERE

SEQ ID NO: 2453446 - protein, 6 aa, Entamoeba dispar
QEEIES

SEQ ID NO: 2453447 - protein, 6 aa, Entamoeba dispar
QEEIRK

SEQ ID NO: 2453448 - protein, 5 aa, Entamoeba dispar
QEEKI

SEQ ID NO: 2453449 - protein, 40 aa, Entamoeba dispar
QEEKIKEKEFTPEEREELKKELESKEDLKKQNEKKEEELN

SEQ ID NO: 2453450 - protein, 23 aa, Entamoeba dispar
QEEKKEESKDGVQKKSESTKEVN

SEQ ID NO: 2453451 - protein, 15 aa, Entamoeba dispar
QEEKKENRLKGVEAT

SEQ ID NO: 2453452 - protein, 6 aa, Entamoeba dispar
QEEKNE

SEQ ID NO: 2453453 - protein, 4 aa, Entamoeba dispar
QEEL

SEQ ID NO: 2453454 - protein, 38 aa, Entamoeba dispar
QEELEEEERRNNEIQKEQPENDENNITQQHKTKQPQLS

SEQ ID NO: 2453455 - protein, 11 aa, Entamoeba dispar
QEELKERKEYS

SEQ ID NO: 2453456 - protein, 13 aa, Entamoeba dispar
QEEMDKEEAEMKQ

SEQ ID NO: 2453457 - protein, 4 aa, Entamoeba dispar
QEEN

SEQ ID NO: 2453458 - protein, 8 aa, Entamoeba dispar
QEENYENA

SEQ ID NO: 2453459 - protein, 6 aa, Entamoeba dispar
QEEQNF

SEQ ID NO: 2453460 - protein, 6 aa, Entamoeba dispar
QEEQRR

SEQ ID NO: 2453461 - protein, 10 aa, Entamoeba dispar
QEERENKTEI

SEQ ID NO: 2453462 - protein, 5 aa, Entamoeba dispar
QEERI

SEQ ID NO: 2453463 - protein, 10 aa, Entamoeba dispar
QEERNDYSIT

SEQ ID NO: 2453464 - protein, 5 aa, Entamoeba dispar
QEESI

SEQ ID NO: 2453465 - protein, 6 aa, Entamoeba dispar
QEESKE

SEQ ID NO: 2453466 - protein, 7 aa, Entamoeba dispar
QEESQNR

SEQ ID NO: 2453467 - protein, 5 aa, Entamoeba dispar
QEESS

SEQ ID NO: 2453468 - protein, 7 aa, Entamoeba dispar
QEETKEV

SEQ ID NO: 2453469 - protein, 24 aa, Entamoeba dispar
QEETKSQEGTPKRSDSSSNELERV

SEQ ID NO: 2453470 - protein, 15 aa, Entamoeba dispar
QEETNKEKQKETEIN

SEQ ID NO: 2453471 - protein, 7 aa, Entamoeba dispar
QEETQNI

SEQ ID NO: 2453472 - protein, 7 aa, Entamoeba dispar
QEETTTY

SEQ ID NO: 2453473 - protein, 30 aa, Entamoeba dispar
QEEVDDEEKEEESNEMSEEEISEPQNNTTT

SEQ ID NO: 2453474 - protein, 7 aa, Entamoeba dispar
QEEVDEC

SEQ ID NO: 2453475 - protein, 35 aa, Entamoeba dispar
QEEVKKEGLDEENSMELEPQQIKEEKTEEKAMEED

SEQ ID NO: 2453476 - protein, 4 aa, Entamoeba dispar
QEFE

SEQ ID NO: 2453477 - protein, 10 aa, Entamoeba dispar
QEFKDTEADY

SEQ ID NO: 2453478 - protein, 5 aa, Entamoeba dispar
QEFKE

SEQ ID NO: 2453479 - protein, 8 aa, Entamoeba dispar
QEFKPEAD

SEQ ID NO: 2453480 - protein, 8 aa, Entamoeba dispar
QEFPEDAG

SEQ ID NO: 2453481 - protein, 13 aa, Entamoeba dispar
QEFQKEIGKEEYK

SEQ ID NO: 2453482 - protein, 8 aa, Entamoeba dispar
QEGDQTDV

SEQ ID NO: 2453483 - protein, 4 aa, Entamoeba dispar
QEGF

SEQ ID NO: 2453484 - protein, 13 aa, Entamoeba dispar
QEGHCDTGKKKRV

SEQ ID NO: 2453485 - protein, 7 aa, Entamoeba dispar
QEGKENK

SEQ ID NO: 2453486 - protein, 11 aa, Entamoeba dispar
QEGLRQAGLES

SEQ ID NO: 2453487 - protein, 6 aa, Entamoeba dispar
QEGNPH

SEQ ID NO: 2453488 - protein, 5 aa, Entamoeba dispar
QEGNY

SEQ ID NO: 2453489 - protein, 5 aa, Entamoeba dispar
QEGQT

SEQ ID NO: 2453490 - protein, 8 aa, Entamoeba dispar
QEGSPAYK

SEQ ID NO: 2453491 - protein, 5 aa, Entamoeba dispar
QEGVE

SEQ ID NO: 2453492 - protein, 7 aa, Entamoeba dispar
QEGVTEF

SEQ ID NO: 2453493 - protein, 18 aa, Entamoeba dispar
QEHKESLSKISSSISEKT

SEQ ID NO: 2453494 - protein, 8 aa, Entamoeba dispar
QEHPEDDE

SEQ ID NO: 2453495 - protein, 11 aa, Entamoeba dispar
QEHQGEEVDGR

SEQ ID NO: 2453496 - protein, 4 aa, Entamoeba dispar
QEIA

SEQ ID NO: 2453497 - protein, 9 aa, Entamoeba dispar
QEIDEESKK

SEQ ID NO: 2453498 - protein, 5 aa, Entamoeba dispar
QEIDP

SEQ ID NO: 2453499 - protein, 7 aa, Entamoeba dispar
QEIEADK

SEQ ID NO: 2453500 - protein, 13 aa, Entamoeba dispar
QEIENKNKADRRR

SEQ ID NO: 2453501 - protein, 31 aa, Entamoeba dispar
QEIKETKEELKPLKENQPRSSIPTKVVSDYL

SEQ ID NO: 2453502 - protein, 5 aa, Entamoeba dispar
QEING

SEQ ID NO: 2453503 - protein, 11 aa, Entamoeba dispar
QEINNSLSMGQ

SEQ ID NO: 2453504 - protein, 7 aa, Entamoeba dispar
QEIPEVG

SEQ ID NO: 2453505 - protein, 4 aa, Entamoeba dispar
QEIR

SEQ ID NO: 2453506 - protein, 5 aa, Entamoeba dispar
QEISS

SEQ ID NO: 2453507 - protein, 5 aa, Entamoeba dispar
QEITD

SEQ ID NO: 2453508 - protein, 14 aa, Entamoeba dispar
QEITESSDNEDLVD

SEQ ID NO: 2453509 - protein, 7 aa, Entamoeba dispar
QEITPDI

SEQ ID NO: 2453510 - protein, 11 aa, Entamoeba dispar
QEITSGAQRIH

SEQ ID NO: 2453511 - protein, 6 aa, Entamoeba dispar
QEKAGN

SEQ ID NO: 2453512 - protein, 9 aa, Entamoeba dispar
QEKAKELKR

SEQ ID NO: 2453513 - protein, 13 aa, Entamoeba dispar
QEKDAKKEKRNAG

SEQ ID NO: 2453514 - protein, 10 aa, Entamoeba dispar
QEKDLDKEVS

SEQ ID NO: 2453515 - protein, 5 aa, Entamoeba dispar
QEKDS

SEQ ID NO: 2453516 - protein, 17 aa, Entamoeba dispar
QEKDSTKEQIKKSEKLI

SEQ ID NO: 2453517 - protein, 13 aa, Entamoeba dispar
QEKDVENSSTVNY

SEQ ID NO: 2453518 - protein, 4 aa, Entamoeba dispar
QEKE

SEQ ID NO: 2453519 - protein, 9 aa, Entamoeba dispar
QEKEDLKKK

SEQ ID NO: 2453520 - protein, 6 aa, Entamoeba dispar
QEKEEY

SEQ ID NO: 2453521 - protein, 6 aa, Entamoeba dispar
QEKEFG

SEQ ID NO: 2453522 - protein, 6 aa, Entamoeba dispar
QEKEIE

SEQ ID NO: 2453523 - protein, 9 aa, Entamoeba dispar
QEKEINNKL

SEQ ID NO: 2453524 - protein, 6 aa, Entamoeba dispar
QEKEIQ

SEQ ID NO: 2453525 - protein, 17 aa, Entamoeba dispar
QEKEKCEKKEQEMNSEQ

SEQ ID NO: 2453526 - protein, 9 aa, Entamoeba dispar
QEKEKEKHI

SEQ ID NO: 2453527 - protein, 15 aa, Entamoeba dispar
QEKENQQEGQQKLEP

SEQ ID NO: 2453528 - protein, 11 aa, Entamoeba dispar
QEKEQEQTQQA

SEQ ID NO: 2453529 - protein, 8 aa, Entamoeba dispar
QEKEQGNI

SEQ ID NO: 2453530 - protein, 9 aa, Entamoeba dispar
QEKGPSSKN

SEQ ID NO: 2453531 - protein, 13 aa, Entamoeba dispar
QEKGQTEIDQQQL

SEQ ID NO: 2453532 - protein, 8 aa, Entamoeba dispar
QEKGTGNI

SEQ ID NO: 2453533 - protein, 9 aa, Entamoeba dispar
QEKGTGNKY

SEQ ID NO: 2453534 - protein, 7 aa, Entamoeba dispar
QEKIEEV

SEQ ID NO: 2453535 - protein, 6 aa, Entamoeba dispar
QEKKED

SEQ ID NO: 2453536 - protein, 12 aa, Entamoeba dispar
QEKKEEEREITA

SEQ ID NO: 2453537 - protein, 14 aa, Entamoeba dispar
QEKKESDNTTNQSI

SEQ ID NO: 2453538 - protein, 15 aa, Entamoeba dispar
QEKKIKTKEEYERKK

SEQ ID NO: 2453539 - protein, 8 aa, Entamoeba dispar
QEKKIRKK

SEQ ID NO: 2453540 - protein, 8 aa, Entamoeba dispar
QEKKKDKI

SEQ ID NO: 2453541 - protein, 19 aa, Entamoeba dispar
QEKKPIDPLNSYRASAPEC

SEQ ID NO: 2453542 - protein, 8 aa, Entamoeba dispar
QEKKQGNI

SEQ ID NO: 2453543 - protein, 10 aa, Entamoeba dispar
QEKKQYQQNR

SEQ ID NO: 2453544 - protein, 5 aa, Entamoeba dispar
QEKKR

SEQ ID NO: 2453545 - protein, 9 aa, Entamoeba dispar
QEKLEEKGR

SEQ ID NO: 2453546 - protein, 11 aa, Entamoeba dispar
QEKLNTKKKER

SEQ ID NO: 2453547 - protein, 12 aa, Entamoeba dispar
QEKNDLNNKIKE

SEQ ID NO: 2453548 - protein, 8 aa, Entamoeba dispar
QEKNEHAK

SEQ ID NO: 2453549 - protein, 6 aa, Entamoeba dispar
QEKNFS

SEQ ID NO: 2453550 - protein, 8 aa, Entamoeba dispar
QEKNKNGI

SEQ ID NO: 2453551 - protein, 9 aa, Entamoeba dispar
QEKQKKLST

SEQ ID NO: 2453552 - protein, 13 aa, Entamoeba dispar
QEKQKQEETIETK

SEQ ID NO: 2453553 - protein, 6 aa, Entamoeba dispar
QEKQTI

SEQ ID NO: 2453554 - protein, 8 aa, Entamoeba dispar
QEKRDNFV

SEQ ID NO: 2453555 - protein, 11 aa, Entamoeba dispar
QEKRMNDNNRR

SEQ ID NO: 2453556 - protein, 7 aa, Entamoeba dispar
QEKSGTV

SEQ ID NO: 2453557 - protein, 7 aa, Entamoeba dispar
QEKSIKT

SEQ ID NO: 2453558 - protein, 10 aa, Entamoeba dispar
QEKSNLGEEY

SEQ ID NO: 2453559 - protein, 13 aa, Entamoeba dispar
QEKTLKDQTEKEI

SEQ ID NO: 2453560 - protein, 13 aa, Entamoeba dispar
QEKTNEDTVPQIQ

SEQ ID NO: 2453561 - protein, 9 aa, Entamoeba dispar
QEKTTGNNF

SEQ ID NO: 2453562 - protein, 7 aa, Entamoeba dispar
QEKTYKK

SEQ ID NO: 2453563 - protein, 4 aa, Entamoeba dispar
QEKY

SEQ ID NO: 2453564 - protein, 4 aa, Entamoeba dispar
QELD

SEQ ID NO: 2453565 - protein, 4 aa, Entamoeba dispar
QELE

SEQ ID NO: 2453566 - protein, 20 aa, Entamoeba dispar
QELEEEENKNKNLTNELQQT

SEQ ID NO: 2453567 - protein, 6 aa, Entamoeba dispar
QELEEV

SEQ ID NO: 2453568 - protein, 6 aa, Entamoeba dispar
QELEGR

SEQ ID NO: 2453569 - protein, 21 aa, Entamoeba dispar
QELEKKEKENQLIKDSNEKLQ

SEQ ID NO: 2453570 - protein, 8 aa, Entamoeba dispar
QELEQTKN

SEQ ID NO: 2453571 - protein, 9 aa, Entamoeba dispar
QELETENKY

SEQ ID NO: 2453572 - protein, 23 aa, Entamoeba dispar
QELKEEFKRNTQIYSRSPHDKQL

SEQ ID NO: 2453573 - protein, 5 aa, Entamoeba dispar
QELKK

SEQ ID NO: 2453574 - protein, 33 aa, Entamoeba dispar
QELKNGADITSKFEEQSKANKKLEEEVTELEEE

SEQ ID NO: 2453575 - protein, 9 aa, Entamoeba dispar
QELNKKHTK

SEQ ID NO: 2453576 - protein, 6 aa, Entamoeba dispar
QELPEN

SEQ ID NO: 2453577 - protein, 50 aa, Entamoeba dispar
QELQENDNDFEEYKETADKRINTLSAQKDDLQKELEKERGLKQDSEKEVQ

SEQ ID NO: 2453578 - protein, 23 aa, Entamoeba dispar
QELQQQLEEEERKKKELEEQEKI

SEQ ID NO: 2453579 - protein, 7 aa, Entamoeba dispar
QELRPDE

SEQ ID NO: 2453580 - protein, 9 aa, Entamoeba dispar
QELSTDAGL

SEQ ID NO: 2453581 - protein, 10 aa, Entamoeba dispar
QELTDSEKTQ

SEQ ID NO: 2453582 - protein, 5 aa, Entamoeba dispar
QELTG

SEQ ID NO: 2453583 - protein, 31 aa, Entamoeba dispar
QEMEERRNQPLNEQQTTNTHSEEKTNNQQEI

SEQ ID NO: 2453584 - protein, 7 aa, Entamoeba dispar
QEMTTSY

SEQ ID NO: 2453585 - protein, 7 aa, Entamoeba dispar
QENAGAM

SEQ ID NO: 2453586 - protein, 10 aa, Entamoeba dispar
QENDNSPYSF

SEQ ID NO: 2453587 - protein, 16 aa, Entamoeba dispar
QENETTRKKIQENELQ

SEQ ID NO: 2453588 - protein, 5 aa, Entamoeba dispar
QENFP

SEQ ID NO: 2453589 - protein, 7 aa, Entamoeba dispar
QENGGPI

SEQ ID NO: 2453590 - protein, 8 aa, Entamoeba dispar
QENIDNNT

SEQ ID NO: 2453591 - protein, 15 aa, Entamoeba dispar
QENKKVEKKIPLEGS

SEQ ID NO: 2453592 - protein, 9 aa, Entamoeba dispar
QENKPSKEY

SEQ ID NO: 2453593 - protein, 14 aa, Entamoeba dispar
QENKRTTDINDNKF

SEQ ID NO: 2453594 - protein, 25 aa, Entamoeba dispar
QENKSSYSLPSDFESDDQNDGPGTT

SEQ ID NO: 2453595 - protein, 5 aa, Entamoeba dispar
QENNA

SEQ ID NO: 2453596 - protein, 12 aa, Entamoeba dispar
QENNEKKELELA

SEQ ID NO: 2453597 - protein, 14 aa, Entamoeba dispar
QENNENTKIEEYPN

SEQ ID NO: 2453598 - protein, 11 aa, Entamoeba dispar
QENNSEHTAPH

SEQ ID NO: 2453599 - protein, 10 aa, Entamoeba dispar
QENNTATPKV

SEQ ID NO: 2453600 - protein, 26 aa, Entamoeba dispar
QENNTKKKTDSALITSSQKQIDTTIP

SEQ ID NO: 2453601 - protein, 12 aa, Entamoeba dispar
QENPVTDGEAEA

SEQ ID NO: 2453602 - protein, 20 aa, Entamoeba dispar
QENQPHTPTHPLSSTPIHSE

SEQ ID NO: 2453603 - protein, 8 aa, Entamoeba dispar
QENRQNTV

SEQ ID NO: 2453604 - protein, 4 aa, Entamoeba dispar
QENS

SEQ ID NO: 2453605 - protein, 7 aa, Entamoeba dispar
QENSKGS

SEQ ID NO: 2453606 - protein, 22 aa, Entamoeba dispar
QENSLKDELDKIKEDSNTIQQT

SEQ ID NO: 2453607 - protein, 12 aa, Entamoeba dispar
QENSSQSTKKLE

SEQ ID NO: 2453608 - protein, 4 aa, Entamoeba dispar
QEPI

SEQ ID NO: 2453609 - protein, 6 aa, Entamoeba dispar
QEPKRD

SEQ ID NO: 2453610 - protein, 6 aa, Entamoeba dispar
QEPKSM

SEQ ID NO: 2453611 - protein, 27 aa, Entamoeba dispar
QEPLQKNEQLTQPTVNPSQKKRWNLPP

SEQ ID NO: 2453612 - protein, 16 aa, Entamoeba dispar
QEPNPGFGEDAAEKVQ

SEQ ID NO: 2453613 - protein, 7 aa, Entamoeba dispar
QEPPEDG

SEQ ID NO: 2453614 - protein, 12 aa, Entamoeba dispar
QEPPKRKTLAGR

SEQ ID NO: 2453615 - protein, 7 aa, Entamoeba dispar
QEPPTGS

SEQ ID NO: 2453616 - protein, 27 aa, Entamoeba dispar
QEPQPNIQDDEGEWQEVKSKTQKKKGG

SEQ ID NO: 2453617 - protein, 8 aa, Entamoeba dispar
QEPQPPSN

SEQ ID NO: 2453618 - protein, 4 aa, Entamoeba dispar
QEPS

SEQ ID NO: 2453619 - protein, 5 aa, Entamoeba dispar
QEPYD

SEQ ID NO: 2453620 - protein, 18 aa, Entamoeba dispar
QEQENLPKRSSQTTNDCS

SEQ ID NO: 2453621 - protein, 18 aa, Entamoeba dispar
QEQENLPKRSSQTTNECS

SEQ ID NO: 2453622 - protein, 6 aa, Entamoeba dispar
QEQERK

SEQ ID NO: 2453623 - protein, 4 aa, Entamoeba dispar
QEQF

SEQ ID NO: 2453624 - protein, 6 aa, Entamoeba dispar
QEQGEV

SEQ ID NO: 2453625 - protein, 6 aa, Entamoeba dispar
QEQGNV

SEQ ID NO: 2453626 - protein, 8 aa, Entamoeba dispar
QEQHSKAY

SEQ ID NO: 2453627 - protein, 6 aa, Entamoeba dispar
QEQIHP

SEQ ID NO: 2453628 - protein, 4 aa, Entamoeba dispar
QEQK

SEQ ID NO: 2453629 - protein, 20 aa, Entamoeba dispar
QEQKPNNGIYTSKTNTGKNY

SEQ ID NO: 2453630 - protein, 11 aa, Entamoeba dispar
QEQLDNNKIGK

SEQ ID NO: 2453631 - protein, 49 aa, Entamoeba dispar
QEQNHETIPIRSSQSNDESQPKEDMNKQTSIKEEKLTPPQCQPVPPSVT

SEQ ID NO: 2453632 - protein, 8 aa, Entamoeba dispar
QEQPIEED

SEQ ID NO: 2453633 - protein, 5 aa, Entamoeba dispar
QEQPL

SEQ ID NO: 2453634 - protein, 10 aa, Entamoeba dispar
QEQSEKNSII

SEQ ID NO: 2453635 - protein, 11 aa, Entamoeba dispar
QEQSSSQQYPL

SEQ ID NO: 2453636 - protein, 13 aa, Entamoeba dispar
QEQSSSQQYPPLG

SEQ ID NO: 2453637 - protein, 7 aa, Entamoeba dispar
QEQSTSY

SEQ ID NO: 2453638 - protein, 7 aa, Entamoeba dispar
QEQVEEL

SEQ ID NO: 2453639 - protein, 4 aa, Entamoeba dispar
QERD

SEQ ID NO: 2453640 - protein, 9 aa, Entamoeba dispar
QERDPHKEE

SEQ ID NO: 2453641 - protein, 5 aa, Entamoeba dispar
QEREG

SEQ ID NO: 2453642 - protein, 5 aa, Entamoeba dispar
QERIE

SEQ ID NO: 2453643 - protein, 9 aa, Entamoeba dispar
QERKANSNH

SEQ ID NO: 2453644 - protein, 9 aa, Entamoeba dispar
QERKEEQKV

SEQ ID NO: 2453645 - protein, 4 aa, Entamoeba dispar
QERN

SEQ ID NO: 2453646 - protein, 9 aa, Entamoeba dispar
QERPSNTLS

SEQ ID NO: 2453647 - protein, 12 aa, Entamoeba dispar
QERTDTSKEIQA

SEQ ID NO: 2453648 - protein, 10 aa, Entamoeba dispar
QESAEEKRIG

SEQ ID NO: 2453649 - protein, 9 aa, Entamoeba dispar
QESDAKDWK

SEQ ID NO: 2453650 - protein, 6 aa, Entamoeba dispar
QESDRF

SEQ ID NO: 2453651 - protein, 10 aa, Entamoeba dispar
QESDTGLAPV

SEQ ID NO: 2453652 - protein, 14 aa, Entamoeba dispar
QESEEESDENEIQN

SEQ ID NO: 2453653 - protein, 7 aa, Entamoeba dispar
QESEINI

SEQ ID NO: 2453654 - protein, 8 aa, Entamoeba dispar
QESEISIP

SEQ ID NO: 2453655 - protein, 9 aa, Entamoeba dispar
QESENNNKN

SEQ ID NO: 2453656 - protein, 4 aa, Entamoeba dispar
QESF

SEQ ID NO: 2453657 - protein, 14 aa, Entamoeba dispar
QESIEKVKGKEQHK

SEQ ID NO: 2453658 - protein, 6 aa, Entamoeba dispar
QESINS

SEQ ID NO: 2453659 - protein, 11 aa, Entamoeba dispar
QESIRKIDETN

SEQ ID NO: 2453660 - protein, 6 aa, Entamoeba dispar
QESKPI

SEQ ID NO: 2453661 - protein, 5 aa, Entamoeba dispar
QESKS

SEQ ID NO: 2453662 - protein, 17 aa, Entamoeba dispar
QESKSRRKVNNYNYTSE

SEQ ID NO: 2453663 - protein, 6 aa, Entamoeba dispar
QESLTE

SEQ ID NO: 2453664 - protein, 8 aa, Entamoeba dispar
QESNELDV

SEQ ID NO: 2453665 - protein, 6 aa, Entamoeba dispar
QESPEM

SEQ ID NO: 2453666 - protein, 8 aa, Entamoeba dispar
QESPSEIK

SEQ ID NO: 2453667 - protein, 10 aa, Entamoeba dispar
QESQGDLPTV

SEQ ID NO: 2453668 - protein, 7 aa, Entamoeba dispar
QESSAHQ

SEQ ID NO: 2453669 - protein, 5 aa, Entamoeba dispar
QESSF

SEQ ID NO: 2453670 - protein, 8 aa, Entamoeba dispar
QESTTNRM

SEQ ID NO: 2453671 - protein, 6 aa, Entamoeba dispar
QESVKP

SEQ ID NO: 2453672 - protein, 7 aa, Entamoeba dispar
QESVRQR

SEQ ID NO: 2453673 - protein, 4 aa, Entamoeba dispar
QESY

SEQ ID NO: 2453674 - protein, 7 aa, Entamoeba dispar
QESYDKS

SEQ ID NO: 2453675 - protein, 37 aa, Entamoeba dispar
QESYYKSSKRKGQFTEINKSTKKFVTPQFDGPFGGRI

SEQ ID NO: 2453676 - protein, 9 aa, Entamoeba dispar
QETAKENDA

SEQ ID NO: 2453677 - protein, 7 aa, Entamoeba dispar
QETAYKK

SEQ ID NO: 2453678 - protein, 13 aa, Entamoeba dispar
QETEESSNQKGVL

SEQ ID NO: 2453679 - protein, 7 aa, Entamoeba dispar
QETEMTN

SEQ ID NO: 2453680 - protein, 6 aa, Entamoeba dispar
QETFRN

SEQ ID NO: 2453681 - protein, 30 aa, Entamoeba dispar
QETHSNQISQSTIPTQSLPTVTSESLKETS

SEQ ID NO: 2453682 - protein, 11 aa, Entamoeba dispar
QETIDKNNESI

SEQ ID NO: 2453683 - protein, 7 aa, Entamoeba dispar
QETKPAL

SEQ ID NO: 2453684 - protein, 10 aa, Entamoeba dispar
QETKYNEELR

SEQ ID NO: 2453685 - protein, 12 aa, Entamoeba dispar
QETLNDAQLTPE

SEQ ID NO: 2453686 - protein, 7 aa, Entamoeba dispar
QETMKKS

SEQ ID NO: 2453687 - protein, 7 aa, Entamoeba dispar
QETNIDE

SEQ ID NO: 2453688 - protein, 7 aa, Entamoeba dispar
QETNQFR

SEQ ID NO: 2453689 - protein, 7 aa, Entamoeba dispar
QETPPLQ

SEQ ID NO: 2453690 - protein, 10 aa, Entamoeba dispar
QETQPSSELF

SEQ ID NO: 2453691 - protein, 6 aa, Entamoeba dispar
QETSER

SEQ ID NO: 2453692 - protein, 5 aa, Entamoeba dispar
QETSK

SEQ ID NO: 2453693 - protein, 11 aa, Entamoeba dispar
QETSNDVKNQI

SEQ ID NO: 2453694 - protein, 5 aa, Entamoeba dispar
QETYE

SEQ ID NO: 2453695 - protein, 6 aa, Entamoeba dispar
QETYTN

SEQ ID NO: 2453696 - protein, 4 aa, Entamoeba dispar
QEVD

SEQ ID NO: 2453697 - protein, 9 aa, Entamoeba dispar
QEVDQSNGN

SEQ ID NO: 2453698 - protein, 9 aa, Entamoeba dispar
QEVDSTEDI

SEQ ID NO: 2453699 - protein, 27 aa, Entamoeba dispar
QEVENVKRREKMKKQEELDRQKTIAEL

SEQ ID NO: 2453700 - protein, 19 aa, Entamoeba dispar
QEVSESIEETIDSNSIDIE

SEQ ID NO: 2453701 - protein, 11 aa, Entamoeba dispar
QEVTEQEAQEI

SEQ ID NO: 2453702 - protein, 7 aa, Entamoeba dispar
QEWSNKN

SEQ ID NO: 2453703 - protein, 5 aa, Entamoeba dispar
QEYGA

SEQ ID NO: 2453704 - protein, 9 aa, Entamoeba dispar
QEYNQSSDI

SEQ ID NO: 2453705 - protein, 4 aa, Entamoeba dispar
QEYP

SEQ ID NO: 2453706 - protein, 6 aa, Entamoeba dispar
QEYRER

SEQ ID NO: 2453707 - protein, 7 aa, Entamoeba dispar
QEYRSEE

SEQ ID NO: 2453708 - protein, 6 aa, Entamoeba dispar
QEYSGI

SEQ ID NO: 2453709 - protein, 72 aa, Entamoeba dispar
QEYSKSESYSPSRSRSYSRSYSHSRSRSTSRSRKRSYYSSERRRSYSRRRSYSRSHSRRRSYSRRSNRHYKY

SEQ ID NO: 2453710 - protein, 5 aa, Entamoeba dispar
QEYSQ

SEQ ID NO: 2453711 - protein, 6 aa, Entamoeba dispar
QEYTKQ

SEQ ID NO: 2453712 - protein, 6 aa, Entamoeba dispar
QEYTPI

SEQ ID NO: 2453713 - protein, 7 aa, Entamoeba dispar
QEYTSDE

SEQ ID NO: 2453714 - protein, 52 aa, Entamoeba dispar
QEYVSKEQEIKSKEKVKDDIRSRLKDRSKDDFKSRLKDKSKYELKDKPKELD

SEQ ID NO: 2453715 - protein, 10 aa, Entamoeba dispar
QFDEGENNAN

SEQ ID NO: 2453716 - protein, 12 aa, Entamoeba dispar
QFDGEGSTISIN

SEQ ID NO: 2453717 - protein, 11 aa, Entamoeba dispar
QFDNSNQSPRL

SEQ ID NO: 2453718 - protein, 17 aa, Entamoeba dispar
QFDSGVDEDGVSLPKNL

SEQ ID NO: 2453719 - protein, 5 aa, Entamoeba dispar
QFDTA

SEQ ID NO: 2453720 - protein, 7 aa, Entamoeba dispar
QFDTDNR

SEQ ID NO: 2453721 - protein, 19 aa, Entamoeba dispar
QFEAQPKWKQQNQKHALKL

SEQ ID NO: 2453722 - protein, 15 aa, Entamoeba dispar
QFEAQTAISGDVQNL

SEQ ID NO: 2453723 - protein, 4 aa, Entamoeba dispar
QFED

SEQ ID NO: 2453724 - protein, 4 aa, Entamoeba dispar
QFEE

SEQ ID NO: 2453725 - protein, 10 aa, Entamoeba dispar
QFEEPTGYAK

SEQ ID NO: 2453726 - protein, 8 aa, Entamoeba dispar
QFEEQTMT

SEQ ID NO: 2453727 - protein, 6 aa, Entamoeba dispar
QFEESS

SEQ ID NO: 2453728 - protein, 5 aa, Entamoeba dispar
QFEGM

SEQ ID NO: 2453729 - protein, 6 aa, Entamoeba dispar
QFEKTR

SEQ ID NO: 2453730 - protein, 8 aa, Entamoeba dispar
QFENCSDK

SEQ ID NO: 2453731 - protein, 10 aa, Entamoeba dispar
QFEPKSNYKE

SEQ ID NO: 2453732 - protein, 12 aa, Entamoeba dispar
QFEQNKKELREF

SEQ ID NO: 2453733 - protein, 5 aa, Entamoeba dispar
QFGEE

SEQ ID NO: 2453734 - protein, 15 aa, Entamoeba dispar
QFGNKTNRKEHRGFR

SEQ ID NO: 2453735 - protein, 11 aa, Entamoeba dispar
QFGNPDNTAAH

SEQ ID NO: 2453736 - protein, 29 aa, Entamoeba dispar
QFGNRRGGRGAPRGRGARKDGASDGWTPV

SEQ ID NO: 2453737 - protein, 18 aa, Entamoeba dispar
QFGNSTLQNYKDNGVNTS

SEQ ID NO: 2453738 - protein, 8 aa, Entamoeba dispar
QFGSNEKS

SEQ ID NO: 2453739 - protein, 9 aa, Entamoeba dispar
QFKDNDSFR

SEQ ID NO: 2453740 - protein, 13 aa, Entamoeba dispar
QFKGKKQIESAKA

SEQ ID NO: 2453741 - protein, 8 aa, Entamoeba dispar
QFKKEPSF

SEQ ID NO: 2453742 - protein, 10 aa, Entamoeba dispar
QFKKREPPRM

SEQ ID NO: 2453743 - protein, 8 aa, Entamoeba dispar
QFNEKNNI

SEQ ID NO: 2453744 - protein, 6 aa, Entamoeba dispar
QFNEPQ

SEQ ID NO: 2453745 - protein, 5 aa, Entamoeba dispar
QFNKE

SEQ ID NO: 2453746 - protein, 5 aa, Entamoeba dispar
QFNST

SEQ ID NO: 2453747 - protein, 4 aa, Entamoeba dispar
QFPG

SEQ ID NO: 2453748 - protein, 5 aa, Entamoeba dispar
QFPNG

SEQ ID NO: 2453749 - protein, 6 aa, Entamoeba dispar
QFPSTG

SEQ ID NO: 2453750 - protein, 4 aa, Entamoeba dispar
QFPT

SEQ ID NO: 2453751 - protein, 7 aa, Entamoeba dispar
QFQKDDK

SEQ ID NO: 2453752 - protein, 4 aa, Entamoeba dispar
QFQQ

SEQ ID NO: 2453753 - protein, 9 aa, Entamoeba dispar
QFQRKSAQL

SEQ ID NO: 2453754 - protein, 11 aa, Entamoeba dispar
QFREKRNYQVA

SEQ ID NO: 2453755 - protein, 10 aa, Entamoeba dispar
QFSEQSKSIL

SEQ ID NO: 2453756 - protein, 83 aa, Entamoeba dispar
QFSHTSSKEYYANELKKGESNRRGDENERKRSRSRHSRSHSRHFKGSKRHHSRSRSRRERHRSRSRSPRRDKDRDRSKRDSHR

SEQ ID NO: 2453757 - protein, 5 aa, Entamoeba dispar
QFSNS

SEQ ID NO: 2453758 - protein, 11 aa, Entamoeba dispar
QFSPDTSTGAK

SEQ ID NO: 2453759 - protein, 7 aa, Entamoeba dispar
QFSPSSS

SEQ ID NO: 2453760 - protein, 10 aa, Entamoeba dispar
QFSRNTSELF

SEQ ID NO: 2453761 - protein, 10 aa, Entamoeba dispar
QFSSQYKATI

SEQ ID NO: 2453762 - protein, 5 aa, Entamoeba dispar
QFTDP

SEQ ID NO: 2453763 - protein, 10 aa, Entamoeba dispar
QFTDSKSRIT

SEQ ID NO: 2453764 - protein, 18 aa, Entamoeba dispar
QFTNRGKRASDVIKTGES

SEQ ID NO: 2453765 - protein, 4 aa, Entamoeba dispar
QFTQ

SEQ ID NO: 2453766 - protein, 4 aa, Entamoeba dispar
QFTS

SEQ ID NO: 2453767 - protein, 8 aa, Entamoeba dispar
QGAARYAY

SEQ ID NO: 2453768 - protein, 9 aa, Entamoeba dispar
QGAHDSTKL

SEQ ID NO: 2453769 - protein, 8 aa, Entamoeba dispar
QGANPESI

SEQ ID NO: 2453770 - protein, 30 aa, Entamoeba dispar
QGANYSQNHQGPISEIQPTLQRKTYSTIPE

SEQ ID NO: 2453771 - protein, 5 aa, Entamoeba dispar
QGAPE

SEQ ID NO: 2453772 - protein, 11 aa, Entamoeba dispar
QGASEDDTKNL

SEQ ID NO: 2453773 - protein, 10 aa, Entamoeba dispar
QGASQENGAN

SEQ ID NO: 2453774 - protein, 7 aa, Entamoeba dispar
QGCENTL

SEQ ID NO: 2453775 - protein, 6 aa, Entamoeba dispar
QGDACS

SEQ ID NO: 2453776 - protein, 7 aa, Entamoeba dispar
QGDGKSG

SEQ ID NO: 2453777 - protein, 16 aa, Entamoeba dispar
QGDGLNSGFGEEDEYN

SEQ ID NO: 2453778 - protein, 7 aa, Entamoeba dispar
QGDKTAL

SEQ ID NO: 2453779 - protein, 6 aa, Entamoeba dispar
QGDKYR

SEQ ID NO: 2453780 - protein, 6 aa, Entamoeba dispar
QGDRYR

SEQ ID NO: 2453781 - protein, 8 aa, Entamoeba dispar
QGEEDSGS

SEQ ID NO: 2453782 - protein, 7 aa, Entamoeba dispar
QGEIERA

SEQ ID NO: 2453783 - protein, 7 aa, Entamoeba dispar
QGEIKAN

SEQ ID NO: 2453784 - protein, 15 aa, Entamoeba dispar
QGEIQSRGVTVHKKK

SEQ ID NO: 2453785 - protein, 4 aa, Entamoeba dispar
QGEK

SEQ ID NO: 2453786 - protein, 19 aa, Entamoeba dispar
QGEKTKEETKEDNNQTNDL

SEQ ID NO: 2453787 - protein, 5 aa, Entamoeba dispar
QGELN

SEQ ID NO: 2453788 - protein, 15 aa, Entamoeba dispar
QGEREKKIEEEEKVE

SEQ ID NO: 2453789 - protein, 9 aa, Entamoeba dispar
QGESASDQI

SEQ ID NO: 2453790 - protein, 6 aa, Entamoeba dispar
QGFNEQ

SEQ ID NO: 2453791 - protein, 9 aa, Entamoeba dispar
QGFSRSSSV

SEQ ID NO: 2453792 - protein, 9 aa, Entamoeba dispar
QGGKGKKIE

SEQ ID NO: 2453793 - protein, 4 aa, Entamoeba dispar
QGGS

SEQ ID NO: 2453794 - protein, 8 aa, Entamoeba dispar
QGGTSTLF

SEQ ID NO: 2453795 - protein, 6 aa, Entamoeba dispar
QGGYGK

SEQ ID NO: 2453796 - protein, 6 aa, Entamoeba dispar
QGHEVR

SEQ ID NO: 2453797 - protein, 7 aa, Entamoeba dispar
QGHNGGI

SEQ ID NO: 2453798 - protein, 4 aa, Entamoeba dispar
QGID

SEQ ID NO: 2453799 - protein, 37 aa, Entamoeba dispar
QGIESVEEKVNNEKIKIEEKQKGIEEEKKKEEKELEA

SEQ ID NO: 2453800 - protein, 5 aa, Entamoeba dispar
QGIGL

SEQ ID NO: 2453801 - protein, 4 aa, Entamoeba dispar
QGIK

SEQ ID NO: 2453802 - protein, 8 aa, Entamoeba dispar
QGIKPQTT

SEQ ID NO: 2453803 - protein, 4 aa, Entamoeba dispar
QGIN

SEQ ID NO: 2453804 - protein, 4 aa, Entamoeba dispar
QGIP

SEQ ID NO: 2453805 - protein, 5 aa, Entamoeba dispar
QGIPA

SEQ ID NO: 2453806 - protein, 18 aa, Entamoeba dispar
QGIPQTPTQPVHKNSTST

SEQ ID NO: 2453807 - protein, 5 aa, Entamoeba dispar
QGIQK

SEQ ID NO: 2453808 - protein, 11 aa, Entamoeba dispar
QGIVSTSADGT

SEQ ID NO: 2453809 - protein, 7 aa, Entamoeba dispar
QGKAKME

SEQ ID NO: 2453810 - protein, 8 aa, Entamoeba dispar
QGKDNDED

SEQ ID NO: 2453811 - protein, 5 aa, Entamoeba dispar
QGKEI

SEQ ID NO: 2453812 - protein, 7 aa, Entamoeba dispar
QGKEPKE

SEQ ID NO: 2453813 - protein, 7 aa, Entamoeba dispar
QGKFNEA

SEQ ID NO: 2453814 - protein, 23 aa, Entamoeba dispar
QGKFNPQKDHKPPKKPSFIGKEM

SEQ ID NO: 2453815 - protein, 15 aa, Entamoeba dispar
QGKGKKGKKTTEGKL

SEQ ID NO: 2453816 - protein, 7 aa, Entamoeba dispar
QGKGYGS

SEQ ID NO: 2453817 - protein, 8 aa, Entamoeba dispar
QGKIDKGH

SEQ ID NO: 2453818 - protein, 8 aa, Entamoeba dispar
QGKKRKPV

SEQ ID NO: 2453819 - protein, 8 aa, Entamoeba dispar
QGKKVNDI

SEQ ID NO: 2453820 - protein, 10 aa, Entamoeba dispar
QGKKYYKEKQ

SEQ ID NO: 2453821 - protein, 9 aa, Entamoeba dispar
QGKMSTGKL

SEQ ID NO: 2453822 - protein, 7 aa, Entamoeba dispar
QGKNGPV

SEQ ID NO: 2453823 - protein, 4 aa, Entamoeba dispar
QGKP

SEQ ID NO: 2453824 - protein, 4 aa, Entamoeba dispar
QGKR

SEQ ID NO: 2453825 - protein, 7 aa, Entamoeba dispar
QGKRNVE

SEQ ID NO: 2453826 - protein, 8 aa, Entamoeba dispar
QGKSVSVQ

SEQ ID NO: 2453827 - protein, 5 aa, Entamoeba dispar
QGKVS

SEQ ID NO: 2453828 - protein, 14 aa, Entamoeba dispar
QGKYPDDAKLPSQL

SEQ ID NO: 2453829 - protein, 11 aa, Entamoeba dispar
QGKYQTEKSHE

SEQ ID NO: 2453830 - protein, 11 aa, Entamoeba dispar
QGKYRQEGRNY

SEQ ID NO: 2453831 - protein, 8 aa, Entamoeba dispar
QGLDKRRV

SEQ ID NO: 2453832 - protein, 11 aa, Entamoeba dispar
QGLREAGLESS

SEQ ID NO: 2453833 - protein, 15 aa, Entamoeba dispar
QGLRERKIQARNQLK

SEQ ID NO: 2453834 - protein, 4 aa, Entamoeba dispar
QGLT

SEQ ID NO: 2453835 - protein, 5 aa, Entamoeba dispar
QGMDP

SEQ ID NO: 2453836 - protein, 9 aa, Entamoeba dispar
QGMDTDSGA

SEQ ID NO: 2453837 - protein, 14 aa, Entamoeba dispar
QGMTPSIQPQTAMG

SEQ ID NO: 2453838 - protein, 4 aa, Entamoeba dispar
QGNE

SEQ ID NO: 2453839 - protein, 9 aa, Entamoeba dispar
QGNEERKEV

SEQ ID NO: 2453840 - protein, 8 aa, Entamoeba dispar
QGNENGKA

SEQ ID NO: 2453841 - protein, 4 aa, Entamoeba dispar
QGNI

SEQ ID NO: 2453842 - protein, 6 aa, Entamoeba dispar
QGNIKK

SEQ ID NO: 2453843 - protein, 8 aa, Entamoeba dispar
QGNNIETQ

SEQ ID NO: 2453844 - protein, 17 aa, Entamoeba dispar
QGNNRPVKGKHKTNAIK

SEQ ID NO: 2453845 - protein, 8 aa, Entamoeba dispar
QGNNWQDQ

SEQ ID NO: 2453846 - protein, 5 aa, Entamoeba dispar
QGNQY

SEQ ID NO: 2453847 - protein, 7 aa, Entamoeba dispar
QGNRCKE

SEQ ID NO: 2453848 - protein, 9 aa, Entamoeba dispar
QGNRNEIEG

SEQ ID NO: 2453849 - protein, 12 aa, Entamoeba dispar
QGNRRSQTKDMP

SEQ ID NO: 2453850 - protein, 10 aa, Entamoeba dispar
QGNSLKETCE

SEQ ID NO: 2453851 - protein, 7 aa, Entamoeba dispar
QGNSPLF

SEQ ID NO: 2453852 - protein, 8 aa, Entamoeba dispar
QGNSSYTE

SEQ ID NO: 2453853 - protein, 6 aa, Entamoeba dispar
QGNTFE

SEQ ID NO: 2453854 - protein, 11 aa, Entamoeba dispar
QGNTGSTTEEC

SEQ ID NO: 2453855 - protein, 6 aa, Entamoeba dispar
QGNTRT

SEQ ID NO: 2453856 - protein, 11 aa, Entamoeba dispar
QGNVPQAYKET

SEQ ID NO: 2453857 - protein, 9 aa, Entamoeba dispar
QGPNGEPTC

SEQ ID NO: 2453858 - protein, 11 aa, Entamoeba dispar
QGPPGTGKTKT

SEQ ID NO: 2453859 - protein, 13 aa, Entamoeba dispar
QGPPGTGKTVTSA

SEQ ID NO: 2453860 - protein, 9 aa, Entamoeba dispar
QGPPPPSMF

SEQ ID NO: 2453861 - protein, 14 aa, Entamoeba dispar
QGPPQRQRSRPSNT

SEQ ID NO: 2453862 - protein, 18 aa, Entamoeba dispar
QGPPTHPIPEDDGKIDTE

SEQ ID NO: 2453863 - protein, 14 aa, Entamoeba dispar
QGPQVTEQKVEEQQ

SEQ ID NO: 2453864 - protein, 14 aa, Entamoeba dispar
QGPSFNKRSKPVAN

SEQ ID NO: 2453865 - protein, 10 aa, Entamoeba dispar
QGQDLSDDKI

SEQ ID NO: 2453866 - protein, 4 aa, Entamoeba dispar
QGQY

SEQ ID NO: 2453867 - protein, 17 aa, Entamoeba dispar
QGRCSTQNGIKEISNEL

SEQ ID NO: 2453868 - protein, 9 aa, Entamoeba dispar
QGRDVGSPA

SEQ ID NO: 2453869 - protein, 16 aa, Entamoeba dispar
QGRKIKEKEKINLPQM

SEQ ID NO: 2453870 - protein, 8 aa, Entamoeba dispar
QGRRREDV

SEQ ID NO: 2453871 - protein, 10 aa, Entamoeba dispar
QGRVEPKSEI

SEQ ID NO: 2453872 - protein, 9 aa, Entamoeba dispar
QGSEEPNKF

SEQ ID NO: 2453873 - protein, 18 aa, Entamoeba dispar
QGSENEYHYATDEGNKDL

SEQ ID NO: 2453874 - protein, 7 aa, Entamoeba dispar
QGSFNDK

SEQ ID NO: 2453875 - protein, 19 aa, Entamoeba dispar
QGSIGELRKKSAQQEKGIQ

SEQ ID NO: 2453876 - protein, 18 aa, Entamoeba dispar
QGSINSNYDINDDSENIV

SEQ ID NO: 2453877 - protein, 11 aa, Entamoeba dispar
QGSNKDYVNPA

SEQ ID NO: 2453878 - protein, 12 aa, Entamoeba dispar
QGSPTTSIYSTD

SEQ ID NO: 2453879 - protein, 6 aa, Entamoeba dispar
QGSQES

SEQ ID NO: 2453880 - protein, 8 aa, Entamoeba dispar
QGSRQIRG

SEQ ID NO: 2453881 - protein, 5 aa, Entamoeba dispar
QGSSF

SEQ ID NO: 2453882 - protein, 7 aa, Entamoeba dispar
QGSSKNI

SEQ ID NO: 2453883 - protein, 6 aa, Entamoeba dispar
QGSSNL

SEQ ID NO: 2453884 - protein, 9 aa, Entamoeba dispar
QGSSNTEFT

SEQ ID NO: 2453885 - protein, 5 aa, Entamoeba dispar
QGSSY

SEQ ID NO: 2453886 - protein, 4 aa, Entamoeba dispar
QGST

SEQ ID NO: 2453887 - protein, 11 aa, Entamoeba dispar
QGTDPKSMEIK

SEQ ID NO: 2453888 - protein, 9 aa, Entamoeba dispar
QGTECNGKT

SEQ ID NO: 2453889 - protein, 4 aa, Entamoeba dispar
QGTF

SEQ ID NO: 2453890 - protein, 5 aa, Entamoeba dispar
QGTGN

SEQ ID NO: 2453891 - protein, 4 aa, Entamoeba dispar
QGTL

SEQ ID NO: 2453892 - protein, 12 aa, Entamoeba dispar
QGTNERRIPGNK

SEQ ID NO: 2453893 - protein, 4 aa, Entamoeba dispar
QGTP

SEQ ID NO: 2453894 - protein, 6 aa, Entamoeba dispar
QGTSVT

SEQ ID NO: 2453895 - protein, 4 aa, Entamoeba dispar
QGTT

SEQ ID NO: 2453896 - protein, 5 aa, Entamoeba dispar
QGTTQ

SEQ ID NO: 2453897 - protein, 8 aa, Entamoeba dispar
QGTTTQNF

SEQ ID NO: 2453898 - protein, 5 aa, Entamoeba dispar
QGTTV

SEQ ID NO: 2453899 - protein, 4 aa, Entamoeba dispar
QGTV

SEQ ID NO: 2453900 - protein, 7 aa, Entamoeba dispar
QGTVNSR

SEQ ID NO: 2453901 - protein, 16 aa, Entamoeba dispar
QGVAPKTAARRCENNR

SEQ ID NO: 2453902 - protein, 10 aa, Entamoeba dispar
QGVDTQNVTP

SEQ ID NO: 2453903 - protein, 6 aa, Entamoeba dispar
QGVEEC

SEQ ID NO: 2453904 - protein, 6 aa, Entamoeba dispar
QGVEGV

SEQ ID NO: 2453905 - protein, 6 aa, Entamoeba dispar
QGVETE

SEQ ID NO: 2453906 - protein, 4 aa, Entamoeba dispar
QGVG

SEQ ID NO: 2453907 - protein, 8 aa, Entamoeba dispar
QGVGRTQT

SEQ ID NO: 2453908 - protein, 18 aa, Entamoeba dispar
QGVNGSGPVKVKQDQTNT

SEQ ID NO: 2453909 - protein, 13 aa, Entamoeba dispar
QGVPQPSSTPQRR

SEQ ID NO: 2453910 - protein, 5 aa, Entamoeba dispar
QGVTK

SEQ ID NO: 2453911 - protein, 4 aa, Entamoeba dispar
QGVY

SEQ ID NO: 2453912 - protein, 11 aa, Entamoeba dispar
QGVYQGEHGGI

SEQ ID NO: 2453913 - protein, 4 aa, Entamoeba dispar
QGWN

SEQ ID NO: 2453914 - protein, 4 aa, Entamoeba dispar
QGYE

SEQ ID NO: 2453915 - protein, 4 aa, Entamoeba dispar
QGYI

SEQ ID NO: 2453916 - protein, 6 aa, Entamoeba dispar
QGYIDA

SEQ ID NO: 2453917 - protein, 12 aa, Entamoeba dispar
QGYRGTGPQNDH

SEQ ID NO: 2453918 - protein, 7 aa, Entamoeba dispar
QGYTSGK

SEQ ID NO: 2453919 - protein, 9 aa, Entamoeba dispar
QHAGRASTQ

SEQ ID NO: 2453920 - protein, 5 aa, Entamoeba dispar
QHAPG

SEQ ID NO: 2453921 - protein, 4 aa, Entamoeba dispar
QHCP

SEQ ID NO: 2453922 - protein, 5 aa, Entamoeba dispar
QHEFT

SEQ ID NO: 2453923 - protein, 17 aa, Entamoeba dispar
QHEREISEKKIAKEIQK

SEQ ID NO: 2453924 - protein, 17 aa, Entamoeba dispar
QHINENEPSVSIKTTRK

SEQ ID NO: 2453925 - protein, 5 aa, Entamoeba dispar
QHKEN

SEQ ID NO: 2453926 - protein, 9 aa, Entamoeba dispar
QHKETQQSA

SEQ ID NO: 2453927 - protein, 12 aa, Entamoeba dispar
QHKGISQQKAET

SEQ ID NO: 2453928 - protein, 11 aa, Entamoeba dispar
QHKKTKRSYKE

SEQ ID NO: 2453929 - protein, 20 aa, Entamoeba dispar
QHKNDDEKAQYDISLQIQPR

SEQ ID NO: 2453930 - protein, 6 aa, Entamoeba dispar
QHKNDE

SEQ ID NO: 2453931 - protein, 6 aa, Entamoeba dispar
QHKNQN

SEQ ID NO: 2453932 - protein, 9 aa, Entamoeba dispar
QHKSEQTKL

SEQ ID NO: 2453933 - protein, 9 aa, Entamoeba dispar
QHKTTTTTV

SEQ ID NO: 2453934 - protein, 8 aa, Entamoeba dispar
QHLDEDSI

SEQ ID NO: 2453935 - protein, 12 aa, Entamoeba dispar
QHLSSESNISEN

SEQ ID NO: 2453936 - protein, 10 aa, Entamoeba dispar
QHMKGSLPTI

SEQ ID NO: 2453937 - protein, 7 aa, Entamoeba dispar
QHNKEKL

SEQ ID NO: 2453938 - protein, 7 aa, Entamoeba dispar
QHNNNEE

SEQ ID NO: 2453939 - protein, 7 aa, Entamoeba dispar
QHNPTIG

SEQ ID NO: 2453940 - protein, 10 aa, Entamoeba dispar
QHPGKTISTG

SEQ ID NO: 2453941 - protein, 10 aa, Entamoeba dispar
QHPKDQITIT

SEQ ID NO: 2453942 - protein, 24 aa, Entamoeba dispar
QHPPKEPTPNQPLTSEEIAKQGQM

SEQ ID NO: 2453943 - protein, 42 aa, Entamoeba dispar
QHPQNQNKEKDHRKKSTREESRKPKPIAEKQTKAEKAPVVTE

SEQ ID NO: 2453944 - protein, 6 aa, Entamoeba dispar
QHPSIQ

SEQ ID NO: 2453945 - protein, 4 aa, Entamoeba dispar
QHPT

SEQ ID NO: 2453946 - protein, 5 aa, Entamoeba dispar
QHPTK

SEQ ID NO: 2453947 - protein, 23 aa, Entamoeba dispar
QHQDNSAPVEAAPVTEEKGEVVE

SEQ ID NO: 2453948 - protein, 8 aa, Entamoeba dispar
QHQEDKEL

SEQ ID NO: 2453949 - protein, 5 aa, Entamoeba dispar
QHQKN

SEQ ID NO: 2453950 - protein, 7 aa, Entamoeba dispar
QHQSEYN

SEQ ID NO: 2453951 - protein, 9 aa, Entamoeba dispar
QHQTQQDSR

SEQ ID NO: 2453952 - protein, 11 aa, Entamoeba dispar
QHREQSPSDFT

SEQ ID NO: 2453953 - protein, 9 aa, Entamoeba dispar
QHRRKSEIE

SEQ ID NO: 2453954 - protein, 9 aa, Entamoeba dispar
QHRSQKTTV

SEQ ID NO: 2453955 - protein, 9 aa, Entamoeba dispar
QHSNDQDKV

SEQ ID NO: 2453956 - protein, 6 aa, Entamoeba dispar
QHSPKQ

SEQ ID NO: 2453957 - protein, 18 aa, Entamoeba dispar
QHSPKTTTLTFDYQNFEE

SEQ ID NO: 2453958 - protein, 5 aa, Entamoeba dispar
QHSPT

SEQ ID NO: 2453959 - protein, 13 aa, Entamoeba dispar
QHSQPIQNNQFSN

SEQ ID NO: 2453960 - protein, 21 aa, Entamoeba dispar
QHSSNSINTSSFNPIKRTNPI

SEQ ID NO: 2453961 - protein, 10 aa, Entamoeba dispar
QHSSQYPQQF

SEQ ID NO: 2453962 - protein, 4 aa, Entamoeba dispar
QHTD

SEQ ID NO: 2453963 - protein, 10 aa, Entamoeba dispar
QHTEKEEQKA

SEQ ID NO: 2453964 - protein, 9 aa, Entamoeba dispar
QHTNNRNKK

SEQ ID NO: 2453965 - protein, 20 aa, Entamoeba dispar
QHTSPRQSPKKRFKKEKQFN

SEQ ID NO: 2453966 - protein, 6 aa, Entamoeba dispar
QHTTRN

SEQ ID NO: 2453967 - protein, 17 aa, Entamoeba dispar
QHTTSDSDLAPSSSLSS

SEQ ID NO: 2453968 - protein, 17 aa, Entamoeba dispar
QHVKEREFKNKENRVEE

SEQ ID NO: 2453969 - protein, 6 aa, Entamoeba dispar
QHVNSQ

SEQ ID NO: 2453970 - protein, 11 aa, Entamoeba dispar
QHYEEHKGKGF

SEQ ID NO: 2453971 - protein, 10 aa, Entamoeba dispar
QHYQYTQTRI

SEQ ID NO: 2453972 - protein, 5 aa, Entamoeba dispar
QIAGE

SEQ ID NO: 2453973 - protein, 17 aa, Entamoeba dispar
QIAKEKEYKQRRTISQT

SEQ ID NO: 2453974 - protein, 18 aa, Entamoeba dispar
QIAKLQKSTEKDQKIVST

SEQ ID NO: 2453975 - protein, 7 aa, Entamoeba dispar
QIAPTWE

SEQ ID NO: 2453976 - protein, 37 aa, Entamoeba dispar
QIATSNNYSPENRQPIKRSSSCGKQTPNYPSTYSQQL

SEQ ID NO: 2453977 - protein, 4 aa, Entamoeba dispar
QIDD

SEQ ID NO: 2453978 - protein, 4 aa, Entamoeba dispar
QIDE

SEQ ID NO: 2453979 - protein, 6 aa, Entamoeba dispar
QIDEEV

SEQ ID NO: 2453980 - protein, 4 aa, Entamoeba dispar
QIDF

SEQ ID NO: 2453981 - protein, 5 aa, Entamoeba dispar
QIDGK

SEQ ID NO: 2453982 - protein, 6 aa, Entamoeba dispar
QIDGNE

SEQ ID NO: 2453983 - protein, 12 aa, Entamoeba dispar
QIDKDEDKMKEF

SEQ ID NO: 2453984 - protein, 12 aa, Entamoeba dispar
QIDKDENKMKEF

SEQ ID NO: 2453985 - protein, 7 aa, Entamoeba dispar
QIDQIGE

SEQ ID NO: 2453986 - protein, 5 aa, Entamoeba dispar
QIDQR

SEQ ID NO: 2453987 - protein, 18 aa, Entamoeba dispar
QIDQSGKIINQTDQHSTL

SEQ ID NO: 2453988 - protein, 9 aa, Entamoeba dispar
QIDRQNTIQ

SEQ ID NO: 2453989 - protein, 10 aa, Entamoeba dispar
QIDSGTHQKS

SEQ ID NO: 2453990 - protein, 14 aa, Entamoeba dispar
QIDVEGKKEYERQR

SEQ ID NO: 2453991 - protein, 6 aa, Entamoeba dispar
QIDYAA

SEQ ID NO: 2453992 - protein, 11 aa, Entamoeba dispar
QIEDNKKGPQL

SEQ ID NO: 2453993 - protein, 7 aa, Entamoeba dispar
QIEDTSN

SEQ ID NO: 2453994 - protein, 4 aa, Entamoeba dispar
QIEE

SEQ ID NO: 2453995 - protein, 7 aa, Entamoeba dispar
QIEEDPE

SEQ ID NO: 2453996 - protein, 11 aa, Entamoeba dispar
QIEEEKKEIKT

SEQ ID NO: 2453997 - protein, 13 aa, Entamoeba dispar
QIEEENDKEKEEL

SEQ ID NO: 2453998 - protein, 14 aa, Entamoeba dispar
QIEEGKKKGRIELN

SEQ ID NO: 2453999 - protein, 9 aa, Entamoeba dispar
QIEEGKKKY

SEQ ID NO: 2454000 - protein, 12 aa, Entamoeba dispar
QIEENENKMKEF

SEQ ID NO: 2454001 - protein, 12 aa, Entamoeba dispar
QIEENKNKMKEF

SEQ ID NO: 2454002 - protein, 8 aa, Entamoeba dispar
QIEETDQG

SEQ ID NO: 2454003 - protein, 7 aa, Entamoeba dispar
QIEKPQE

SEQ ID NO: 2454004 - protein, 9 aa, Entamoeba dispar
QIENEAKQQ

SEQ ID NO: 2454005 - protein, 8 aa, Entamoeba dispar
QIENETTL

SEQ ID NO: 2454006 - protein, 7 aa, Entamoeba dispar
QIENPSV

SEQ ID NO: 2454007 - protein, 4 aa, Entamoeba dispar
QIEP

SEQ ID NO: 2454008 - protein, 6 aa, Entamoeba dispar
QIEPKE

SEQ ID NO: 2454009 - protein, 17 aa, Entamoeba dispar
QIEPQLKRSHSNQITRK

SEQ ID NO: 2454010 - protein, 10 aa, Entamoeba dispar
QIEQDQCSGV

SEQ ID NO: 2454011 - protein, 92 aa, Entamoeba dispar
QIEQEKQRKLKEEQKRKEEEIKRKKEEEERKRKEEEKRKREEAERKRKEEEERKRKEEEAKRKIKEERQRKIEEERRKKEEEEQRKLEEEKK

SEQ ID NO: 2454012 - protein, 10 aa, Entamoeba dispar
QIEQTDEELK

SEQ ID NO: 2454013 - protein, 12 aa, Entamoeba dispar
QIEQTEKDEWKK

SEQ ID NO: 2454014 - protein, 20 aa, Entamoeba dispar
QIESEEKEKITKERDELQKR

SEQ ID NO: 2454015 - protein, 9 aa, Entamoeba dispar
QIESEGGSC

SEQ ID NO: 2454016 - protein, 13 aa, Entamoeba dispar
QIESGKDKSVGRG

SEQ ID NO: 2454017 - protein, 11 aa, Entamoeba dispar
QIESKLKDSYL

SEQ ID NO: 2454018 - protein, 5 aa, Entamoeba dispar
QIESL

SEQ ID NO: 2454019 - protein, 6 aa, Entamoeba dispar
QIETKT

SEQ ID NO: 2454020 - protein, 7 aa, Entamoeba dispar
QIETSVS

SEQ ID NO: 2454021 - protein, 9 aa, Entamoeba dispar
QIGDQEPIA

SEQ ID NO: 2454022 - protein, 10 aa, Entamoeba dispar
QIGDSSEKKM

SEQ ID NO: 2454023 - protein, 9 aa, Entamoeba dispar
QIGDVADAE

SEQ ID NO: 2454024 - protein, 5 aa, Entamoeba dispar
QIGEA

SEQ ID NO: 2454025 - protein, 13 aa, Entamoeba dispar
QIGGNKLTRESRY

SEQ ID NO: 2454026 - protein, 10 aa, Entamoeba dispar
QIGKEAPEFK

SEQ ID NO: 2454027 - protein, 6 aa, Entamoeba dispar
QIGNEL

SEQ ID NO: 2454028 - protein, 8 aa, Entamoeba dispar
QIGTNSYD

SEQ ID NO: 2454029 - protein, 4 aa, Entamoeba dispar
QIKD

SEQ ID NO: 2454030 - protein, 17 aa, Entamoeba dispar
QIKDETNHTDSKTEQLN

SEQ ID NO: 2454031 - protein, 10 aa, Entamoeba dispar
QIKDNDLEVQ

SEQ ID NO: 2454032 - protein, 12 aa, Entamoeba dispar
QIKDSVEERKIS

SEQ ID NO: 2454033 - protein, 8 aa, Entamoeba dispar
QIKEAGGI

SEQ ID NO: 2454034 - protein, 43 aa, Entamoeba dispar
QIKEDNNQIKNDTKTEQQTTETITQNTFTQSGQKENKKEVSSL

SEQ ID NO: 2454035 - protein, 15 aa, Entamoeba dispar
QIKEEKQKIEEEKSN

SEQ ID NO: 2454036 - protein, 22 aa, Entamoeba dispar
QIKEENNNSQIQQKSFNSENIP

SEQ ID NO: 2454037 - protein, 10 aa, Entamoeba dispar
QIKEGKEVPL

SEQ ID NO: 2454038 - protein, 53 aa, Entamoeba dispar
QIKENETPNTPNHVRSSLPGNPEEMKRHTKKRSIFGRKDKEEKEKKEESKNEK

SEQ ID NO: 2454039 - protein, 53 aa, Entamoeba dispar
QIKENETSNTSNHVRSSLPGNPEEMKRHTKKRSIFGRKDKEEKEKKEESKNEK

SEQ ID NO: 2454040 - protein, 6 aa, Entamoeba dispar
QIKENK

SEQ ID NO: 2454041 - protein, 11 aa, Entamoeba dispar
QIKNDNAELRE

SEQ ID NO: 2454042 - protein, 12 aa, Entamoeba dispar
QIKNGSSRSPRL

SEQ ID NO: 2454043 - protein, 5 aa, Entamoeba dispar
QIKPF

SEQ ID NO: 2454044 - protein, 5 aa, Entamoeba dispar
QIKPI

SEQ ID NO: 2454045 - protein, 10 aa, Entamoeba dispar
QIKPQPRRQT

SEQ ID NO: 2454046 - protein, 7 aa, Entamoeba dispar
QIKQDEE

SEQ ID NO: 2454047 - protein, 7 aa, Entamoeba dispar
QIKSGKE

SEQ ID NO: 2454048 - protein, 11 aa, Entamoeba dispar
QIKTKKEKVLP

SEQ ID NO: 2454049 - protein, 5 aa, Entamoeba dispar
QIKTS

SEQ ID NO: 2454050 - protein, 15 aa, Entamoeba dispar
QILSPEDKKSPKEAE

SEQ ID NO: 2454051 - protein, 27 aa, Entamoeba dispar
QINASTPPSDSSPSINVASPPPVSPRS

SEQ ID NO: 2454052 - protein, 4 aa, Entamoeba dispar
QINE

SEQ ID NO: 2454053 - protein, 5 aa, Entamoeba dispar
QINEI

SEQ ID NO: 2454054 - protein, 13 aa, Entamoeba dispar
QINEKKKKLNYNG

SEQ ID NO: 2454055 - protein, 5 aa, Entamoeba dispar
QINEL

SEQ ID NO: 2454056 - protein, 7 aa, Entamoeba dispar
QINEREL

SEQ ID NO: 2454057 - protein, 5 aa, Entamoeba dispar
QINET

SEQ ID NO: 2454058 - protein, 7 aa, Entamoeba dispar
QINGNNN

SEQ ID NO: 2454059 - protein, 8 aa, Entamoeba dispar
QINKEYPK

SEQ ID NO: 2454060 - protein, 7 aa, Entamoeba dispar
QINKQQM

SEQ ID NO: 2454061 - protein, 17 aa, Entamoeba dispar
QINNEEDVKEEKESDEC

SEQ ID NO: 2454062 - protein, 8 aa, Entamoeba dispar
QINNQNTH

SEQ ID NO: 2454063 - protein, 7 aa, Entamoeba dispar
QINPKSS

SEQ ID NO: 2454064 - protein, 10 aa, Entamoeba dispar
QINPPDEDAS

SEQ ID NO: 2454065 - protein, 8 aa, Entamoeba dispar
QINQSQKE

SEQ ID NO: 2454066 - protein, 6 aa, Entamoeba dispar
QINQST

SEQ ID NO: 2454067 - protein, 20 aa, Entamoeba dispar
QINSPSKEDTDNDDGTFDEV

SEQ ID NO: 2454068 - protein, 10 aa, Entamoeba dispar
QINSQPNNLN

SEQ ID NO: 2454069 - protein, 6 aa, Entamoeba dispar
QINSSQ

SEQ ID NO: 2454070 - protein, 12 aa, Entamoeba dispar
QINTHGKSLNNS

SEQ ID NO: 2454071 - protein, 5 aa, Entamoeba dispar
QINTK

SEQ ID NO: 2454072 - protein, 24 aa, Entamoeba dispar
QINTPQIENQIDDYDKDVHKDNPL

SEQ ID NO: 2454073 - protein, 36 aa, Entamoeba dispar
QIPDQQINTTTPTTCQGIQSNQSPTISIQNTVSHPS

SEQ ID NO: 2454074 - protein, 8 aa, Entamoeba dispar
QIPESKKN

SEQ ID NO: 2454075 - protein, 6 aa, Entamoeba dispar
QIPKEV

SEQ ID NO: 2454076 - protein, 11 aa, Entamoeba dispar
QIPKSEDSGYG

SEQ ID NO: 2454077 - protein, 11 aa, Entamoeba dispar
QIPNLQNEKED

SEQ ID NO: 2454078 - protein, 12 aa, Entamoeba dispar
QIPNTPPTEMQE

SEQ ID NO: 2454079 - protein, 8 aa, Entamoeba dispar
QIPPPPRL

SEQ ID NO: 2454080 - protein, 14 aa, Entamoeba dispar
QIPPQQPQGQQQFQ

SEQ ID NO: 2454081 - protein, 6 aa, Entamoeba dispar
QIPPQS

SEQ ID NO: 2454082 - protein, 5 aa, Entamoeba dispar
QIPSI

SEQ ID NO: 2454083 - protein, 6 aa, Entamoeba dispar
QIPSKT

SEQ ID NO: 2454084 - protein, 9 aa, Entamoeba dispar
QIPSNNELD

SEQ ID NO: 2454085 - protein, 7 aa, Entamoeba dispar
QIQEAEG

SEQ ID NO: 2454086 - protein, 4 aa, Entamoeba dispar
QIQF

SEQ ID NO: 2454087 - protein, 5 aa, Entamoeba dispar
QIQGN

SEQ ID NO: 2454088 - protein, 9 aa, Entamoeba dispar
QIQNQMKGQ

SEQ ID NO: 2454089 - protein, 21 aa, Entamoeba dispar
QIQPPPSKLMSSKQRKVKTPC

SEQ ID NO: 2454090 - protein, 8 aa, Entamoeba dispar
QIQPSDLN

SEQ ID NO: 2454091 - protein, 26 aa, Entamoeba dispar
QIQQTPLEAQLTSPQNNFTSTSTTTT

SEQ ID NO: 2454092 - protein, 24 aa, Entamoeba dispar
QIQQTSLKAQENKENFDDLERKKQ

SEQ ID NO: 2454093 - protein, 8 aa, Entamoeba dispar
QIQTEDEI

SEQ ID NO: 2454094 - protein, 11 aa, Entamoeba dispar
QIQTIQNETER

SEQ ID NO: 2454095 - protein, 8 aa, Entamoeba dispar
QIQTNETI

SEQ ID NO: 2454096 - protein, 15 aa, Entamoeba dispar
QIQTPRGDTSDPTSL

SEQ ID NO: 2454097 - protein, 18 aa, Entamoeba dispar
QIRNKGEGVQQTDNKKEV

SEQ ID NO: 2454098 - protein, 6 aa, Entamoeba dispar
QIRNQQ

SEQ ID NO: 2454099 - protein, 8 aa, Entamoeba dispar
QIRSTEGF

SEQ ID NO: 2454100 - protein, 10 aa, Entamoeba dispar
QIRTEKAKTQ

SEQ ID NO: 2454101 - protein, 19 aa, Entamoeba dispar
QISDSSLKQRQEKLIQKIT

SEQ ID NO: 2454102 - protein, 6 aa, Entamoeba dispar
QISEKD

SEQ ID NO: 2454103 - protein, 8 aa, Entamoeba dispar
QISENEKK

SEQ ID NO: 2454104 - protein, 5 aa, Entamoeba dispar
QISEP

SEQ ID NO: 2454105 - protein, 9 aa, Entamoeba dispar
QISKGKKSY

SEQ ID NO: 2454106 - protein, 6 aa, Entamoeba dispar
QISNRE

SEQ ID NO: 2454107 - protein, 12 aa, Entamoeba dispar
QISQDDDTKTKD

SEQ ID NO: 2454108 - protein, 9 aa, Entamoeba dispar
QISQIPNDV

SEQ ID NO: 2454109 - protein, 6 aa, Entamoeba dispar
QISQTN

SEQ ID NO: 2454110 - protein, 4 aa, Entamoeba dispar
QISR

SEQ ID NO: 2454111 - protein, 7 aa, Entamoeba dispar
QISSEPI

SEQ ID NO: 2454112 - protein, 18 aa, Entamoeba dispar
QISSRTSAIDVMKRLIQP

SEQ ID NO: 2454113 - protein, 15 aa, Entamoeba dispar
QISSTGTTQATNGRI

SEQ ID NO: 2454114 - protein, 4 aa, Entamoeba dispar
QISV

SEQ ID NO: 2454115 - protein, 25 aa, Entamoeba dispar
QISYQSKRPVKSENSSFKRPSSFPR

SEQ ID NO: 2454116 - protein, 6 aa, Entamoeba dispar
QITGNH

SEQ ID NO: 2454117 - protein, 5 aa, Entamoeba dispar
QITGY

SEQ ID NO: 2454118 - protein, 5 aa, Entamoeba dispar
QITHS

SEQ ID NO: 2454119 - protein, 10 aa, Entamoeba dispar
QITNDNNKKY

SEQ ID NO: 2454120 - protein, 44 aa, Entamoeba dispar
QITNQQQPSHIPNQQQPPNIPSQQPPSQTSSSNQQQEKKGDDEI

SEQ ID NO: 2454121 - protein, 8 aa, Entamoeba dispar
QITNTDNF

SEQ ID NO: 2454122 - protein, 4 aa, Entamoeba dispar
QITP

SEQ ID NO: 2454123 - protein, 6 aa, Entamoeba dispar
QITPSM

SEQ ID NO: 2454124 - protein, 22 aa, Entamoeba dispar
QITQSYEKARSRYEEIKPDDDN

SEQ ID NO: 2454125 - protein, 4 aa, Entamoeba dispar
QITS

SEQ ID NO: 2454126 - protein, 5 aa, Entamoeba dispar
QITSI

SEQ ID NO: 2454127 - protein, 5 aa, Entamoeba dispar
QITTE

SEQ ID NO: 2454128 - protein, 13 aa, Entamoeba dispar
QITTSGSDKYGKL

SEQ ID NO: 2454129 - protein, 6 aa, Entamoeba dispar
QKAAGK

SEQ ID NO: 2454130 - protein, 7 aa, Entamoeba dispar
QKADGEF

SEQ ID NO: 2454131 - protein, 6 aa, Entamoeba dispar
QKAEDV

SEQ ID NO: 2454132 - protein, 13 aa, Entamoeba dispar
QKAEETLKNAELT

SEQ ID NO: 2454133 - protein, 7 aa, Entamoeba dispar
QKAEEYI

SEQ ID NO: 2454134 - protein, 4 aa, Entamoeba dispar
QKAG

SEQ ID NO: 2454135 - protein, 8 aa, Entamoeba dispar
QKAGFPVP

SEQ ID NO: 2454136 - protein, 8 aa, Entamoeba dispar
QKAGLESS

SEQ ID NO: 2454137 - protein, 17 aa, Entamoeba dispar
QKAKEEIKKKDNEIKSL

SEQ ID NO: 2454138 - protein, 15 aa, Entamoeba dispar
QKAKITTKIDPNNNV

SEQ ID NO: 2454139 - protein, 10 aa, Entamoeba dispar
QKAQKQNIES

SEQ ID NO: 2454140 - protein, 8 aa, Entamoeba dispar
QKAQSEER

SEQ ID NO: 2454141 - protein, 18 aa, Entamoeba dispar
QKARGRGRNQLGTLGSGN

SEQ ID NO: 2454142 - protein, 10 aa, Entamoeba dispar
QKARKALSDS

SEQ ID NO: 2454143 - protein, 25 aa, Entamoeba dispar
QKASFPQQQLQTKQESNQLPQMPQQ

SEQ ID NO: 2454144 - protein, 6 aa, Entamoeba dispar
QKASNI

SEQ ID NO: 2454145 - protein, 8 aa, Entamoeba dispar
QKCSKQLQ

SEQ ID NO: 2454146 - protein, 7 aa, Entamoeba dispar
QKCSSSN

SEQ ID NO: 2454147 - protein, 7 aa, Entamoeba dispar
QKCVEEE

SEQ ID NO: 2454148 - protein, 8 aa, Entamoeba dispar
QKDEQKKK

SEQ ID NO: 2454149 - protein, 9 aa, Entamoeba dispar
QKDESGNLS

SEQ ID NO: 2454150 - protein, 4 aa, Entamoeba dispar
QKDF

SEQ ID NO: 2454151 - protein, 8 aa, Entamoeba dispar
QKDFTSSR

SEQ ID NO: 2454152 - protein, 7 aa, Entamoeba dispar
QKDGSAQ

SEQ ID NO: 2454153 - protein, 7 aa, Entamoeba dispar
QKDGYSF

SEQ ID NO: 2454154 - protein, 9 aa, Entamoeba dispar
QKDITTNPI

SEQ ID NO: 2454155 - protein, 4 aa, Entamoeba dispar
QKDK

SEQ ID NO: 2454156 - protein, 4 aa, Entamoeba dispar
QKDM

SEQ ID NO: 2454157 - protein, 4 aa, Entamoeba dispar
QKDN

SEQ ID NO: 2454158 - protein, 9 aa, Entamoeba dispar
QKDNETLNQ

SEQ ID NO: 2454159 - protein, 10 aa, Entamoeba dispar
QKDNGNEEKI

SEQ ID NO: 2454160 - protein, 5 aa, Entamoeba dispar
QKDNH

SEQ ID NO: 2454161 - protein, 7 aa, Entamoeba dispar
QKDNTIA

SEQ ID NO: 2454162 - protein, 11 aa, Entamoeba dispar
QKDPEDRLTNP

SEQ ID NO: 2454163 - protein, 7 aa, Entamoeba dispar
QKDPTMD

SEQ ID NO: 2454164 - protein, 8 aa, Entamoeba dispar
QKDPVYAT

SEQ ID NO: 2454165 - protein, 37 aa, Entamoeba dispar
QKDRVKQEEKKEEEKKEEEKKEEEKKEEEKKEEETVG

SEQ ID NO: 2454166 - protein, 27 aa, Entamoeba dispar
QKDRVKQEEKKEEEKKEEEKKEEETVG

SEQ ID NO: 2454167 - protein, 9 aa, Entamoeba dispar
QKDTEASEM

SEQ ID NO: 2454168 - protein, 21 aa, Entamoeba dispar
QKDTQKSYQQYKQNDELRQKI

SEQ ID NO: 2454169 - protein, 16 aa, Entamoeba dispar
QKDVDERKASNEELRK

SEQ ID NO: 2454170 - protein, 6 aa, Entamoeba dispar
QKEADK

SEQ ID NO: 2454171 - protein, 8 aa, Entamoeba dispar
QKEAEEWQ

SEQ ID NO: 2454172 - protein, 8 aa, Entamoeba dispar
QKEAIPES

SEQ ID NO: 2454173 - protein, 46 aa, Entamoeba dispar
QKEAQDNEEMSEEDEEKENEEKEDEKQEEKKVNEKKVNEKKENKIE

SEQ ID NO: 2454174 - protein, 45 aa, Entamoeba dispar
QKEAQDNEEMSEEDEEKESEEKESEEKEDEKQEEKKVNEKKENKI

SEQ ID NO: 2454175 - protein, 7 aa, Entamoeba dispar
QKECDEE

SEQ ID NO: 2454176 - protein, 9 aa, Entamoeba dispar
QKEDIQSSL

SEQ ID NO: 2454177 - protein, 7 aa, Entamoeba dispar
QKEDQAL

SEQ ID NO: 2454178 - protein, 24 aa, Entamoeba dispar
QKEEAELLEGNNDEEFEISSRTSV

SEQ ID NO: 2454179 - protein, 8 aa, Entamoeba dispar
QKEECQKR

SEQ ID NO: 2454180 - protein, 8 aa, Entamoeba dispar
QKEEEIKK

SEQ ID NO: 2454181 - protein, 5 aa, Entamoeba dispar
QKEEI

SEQ ID NO: 2454182 - protein, 5 aa, Entamoeba dispar
QKEEK

SEQ ID NO: 2454183 - protein, 17 aa, Entamoeba dispar
QKEEKKDVKKDKGISEK

SEQ ID NO: 2454184 - protein, 8 aa, Entamoeba dispar
QKEEKTNK

SEQ ID NO: 2454185 - protein, 5 aa, Entamoeba dispar
QKEEL

SEQ ID NO: 2454186 - protein, 15 aa, Entamoeba dispar
QKEELTRQIAQLSKK

SEQ ID NO: 2454187 - protein, 9 aa, Entamoeba dispar
QKEENESDN

SEQ ID NO: 2454188 - protein, 103 aa, Entamoeba dispar
QKEEQRKQEEEQRKQEEERRKQEEERKKQEEERKKQEEERKKQEEEQRKQEEERKRQEEEQRRQEEEQRRQEEEQRKQEEERKKQEEERKKQEEEQRKQEEED

SEQ ID NO: 2454189 - protein, 8 aa, Entamoeba dispar
QKEETEYS

SEQ ID NO: 2454190 - protein, 12 aa, Entamoeba dispar
QKEETLNQYEVP

SEQ ID NO: 2454191 - protein, 9 aa, Entamoeba dispar
QKEEYEKRV

SEQ ID NO: 2454192 - protein, 22 aa, Entamoeba dispar
QKEEYSNEEEEEEIEDKLDEQL

SEQ ID NO: 2454193 - protein, 5 aa, Entamoeba dispar
QKEFQ

SEQ ID NO: 2454194 - protein, 8 aa, Entamoeba dispar
QKEGEDIS

SEQ ID NO: 2454195 - protein, 5 aa, Entamoeba dispar
QKEGH

SEQ ID NO: 2454196 - protein, 10 aa, Entamoeba dispar
QKEGKFPSNY

SEQ ID NO: 2454197 - protein, 4 aa, Entamoeba dispar
QKEI

SEQ ID NO: 2454198 - protein, 18 aa, Entamoeba dispar
QKEIEEEERKAREEEERH

SEQ ID NO: 2454199 - protein, 62 aa, Entamoeba dispar
QKEIEKEKEESAQTQVEIETDKPKEEEPEKEEKEDGLIEEERKQLTQQEQEESTKEELEQTQ

SEQ ID NO: 2454200 - protein, 8 aa, Entamoeba dispar
QKEIETTF

SEQ ID NO: 2454201 - protein, 52 aa, Entamoeba dispar
QKEIKDEKQNEKKIINEKKKPKEKVKKEKKPKKNDDKKKAKKPKKVHKEQIE

SEQ ID NO: 2454202 - protein, 28 aa, Entamoeba dispar
QKEISEEKKKAKGKKRNKIKPRKRPARV

SEQ ID NO: 2454203 - protein, 9 aa, Entamoeba dispar
QKEISKPIE

SEQ ID NO: 2454204 - protein, 19 aa, Entamoeba dispar
QKEITTSSNNEIKEENVNT

SEQ ID NO: 2454205 - protein, 13 aa, Entamoeba dispar
QKEKEESKQYEEN

SEQ ID NO: 2454206 - protein, 10 aa, Entamoeba dispar
QKEKHPNEGA

SEQ ID NO: 2454207 - protein, 29 aa, Entamoeba dispar
QKEKKEIDKHEIKEEKDNKTIEKQKEIKE

SEQ ID NO: 2454208 - protein, 7 aa, Entamoeba dispar
QKEKKEL

SEQ ID NO: 2454209 - protein, 7 aa, Entamoeba dispar
QKEKREI

SEQ ID NO: 2454210 - protein, 6 aa, Entamoeba dispar
QKEKRR

SEQ ID NO: 2454211 - protein, 8 aa, Entamoeba dispar
QKEKTEQA

SEQ ID NO: 2454212 - protein, 7 aa, Entamoeba dispar
QKELDEL

SEQ ID NO: 2454213 - protein, 8 aa, Entamoeba dispar
QKELDNTS

SEQ ID NO: 2454214 - protein, 6 aa, Entamoeba dispar
QKELPI

SEQ ID NO: 2454215 - protein, 15 aa, Entamoeba dispar
QKEMDRQMKEREDKN

SEQ ID NO: 2454216 - protein, 22 aa, Entamoeba dispar
QKENAGLNETVSTISPDLKNTK

SEQ ID NO: 2454217 - protein, 9 aa, Entamoeba dispar
QKENILNGT

SEQ ID NO: 2454218 - protein, 9 aa, Entamoeba dispar
QKENNEKFE

SEQ ID NO: 2454219 - protein, 7 aa, Entamoeba dispar
QKENNLS

SEQ ID NO: 2454220 - protein, 19 aa, Entamoeba dispar
QKENNNQESFEKELTESYR

SEQ ID NO: 2454221 - protein, 5 aa, Entamoeba dispar
QKEPL

SEQ ID NO: 2454222 - protein, 23 aa, Entamoeba dispar
QKEQEKNKKEKPKKPKKKKSREL

SEQ ID NO: 2454223 - protein, 12 aa, Entamoeba dispar
QKERCPTCGAYF

SEQ ID NO: 2454224 - protein, 6 aa, Entamoeba dispar
QKERER

SEQ ID NO: 2454225 - protein, 8 aa, Entamoeba dispar
QKERHPND

SEQ ID NO: 2454226 - protein, 7 aa, Entamoeba dispar
QKERKTP

SEQ ID NO: 2454227 - protein, 9 aa, Entamoeba dispar
QKERNNEII

SEQ ID NO: 2454228 - protein, 9 aa, Entamoeba dispar
QKERQTKRV

SEQ ID NO: 2454229 - protein, 20 aa, Entamoeba dispar
QKERRSGNGITTGLAKGTES

SEQ ID NO: 2454230 - protein, 6 aa, Entamoeba dispar
QKESDV

SEQ ID NO: 2454231 - protein, 16 aa, Entamoeba dispar
QKESETIDDSKEKIKR

SEQ ID NO: 2454232 - protein, 9 aa, Entamoeba dispar
QKESGNEYK

SEQ ID NO: 2454233 - protein, 5 aa, Entamoeba dispar
QKESN

SEQ ID NO: 2454234 - protein, 8 aa, Entamoeba dispar
QKESSKNI

SEQ ID NO: 2454235 - protein, 8 aa, Entamoeba dispar
QKESVDPI

SEQ ID NO: 2454236 - protein, 12 aa, Entamoeba dispar
QKESVSTTSQLQ

SEQ ID NO: 2454237 - protein, 16 aa, Entamoeba dispar
QKETIHPRKSYKMNSS

SEQ ID NO: 2454238 - protein, 19 aa, Entamoeba dispar
QKETIKSNEDVKSETLNSN

SEQ ID NO: 2454239 - protein, 6 aa, Entamoeba dispar
QKETIP

SEQ ID NO: 2454240 - protein, 17 aa, Entamoeba dispar
QKEVEEKEMSDKRRMER

SEQ ID NO: 2454241 - protein, 7 aa, Entamoeba dispar
QKEVEGY

SEQ ID NO: 2454242 - protein, 7 aa, Entamoeba dispar
QKEVREV

SEQ ID NO: 2454243 - protein, 6 aa, Entamoeba dispar
QKEYQN

SEQ ID NO: 2454244 - protein, 4 aa, Entamoeba dispar
QKFE

SEQ ID NO: 2454245 - protein, 15 aa, Entamoeba dispar
QKFQSSTEKTSTPQF

SEQ ID NO: 2454246 - protein, 8 aa, Entamoeba dispar
QKFTDGSA

SEQ ID NO: 2454247 - protein, 39 aa, Entamoeba dispar
QKGALPQAQGLEVTDENEGIKVDKKKYKDATKPSKLKYK

SEQ ID NO: 2454248 - protein, 20 aa, Entamoeba dispar
QKGAQLKKVDTNAPRPSMAN

SEQ ID NO: 2454249 - protein, 5 aa, Entamoeba dispar
QKGCG

SEQ ID NO: 2454250 - protein, 7 aa, Entamoeba dispar
QKGDYKN

SEQ ID NO: 2454251 - protein, 4 aa, Entamoeba dispar
QKGE

SEQ ID NO: 2454252 - protein, 9 aa, Entamoeba dispar
QKGEVNEQM

SEQ ID NO: 2454253 - protein, 12 aa, Entamoeba dispar
QKGGINDSSVLD

SEQ ID NO: 2454254 - protein, 15 aa, Entamoeba dispar
QKGIGQSEGIVLQFA

SEQ ID NO: 2454255 - protein, 8 aa, Entamoeba dispar
QKGLDNWP

SEQ ID NO: 2454256 - protein, 5 aa, Entamoeba dispar
QKGND

SEQ ID NO: 2454257 - protein, 5 aa, Entamoeba dispar
QKGNK

SEQ ID NO: 2454258 - protein, 10 aa, Entamoeba dispar
QKGNNAYQAP

SEQ ID NO: 2454259 - protein, 8 aa, Entamoeba dispar
QKGPYPKE

SEQ ID NO: 2454260 - protein, 6 aa, Entamoeba dispar
QKGQEL

SEQ ID NO: 2454261 - protein, 6 aa, Entamoeba dispar
QKGQIT

SEQ ID NO: 2454262 - protein, 12 aa, Entamoeba dispar
QKGRDGPLNTPE

SEQ ID NO: 2454263 - protein, 14 aa, Entamoeba dispar
QKGSKIEKDKEQTL

SEQ ID NO: 2454264 - protein, 4 aa, Entamoeba dispar
QKGT

SEQ ID NO: 2454265 - protein, 9 aa, Entamoeba dispar
QKGTSNDKA

SEQ ID NO: 2454266 - protein, 11 aa, Entamoeba dispar
QKGTSNQKTEL

SEQ ID NO: 2454267 - protein, 8 aa, Entamoeba dispar
QKGWKESD

SEQ ID NO: 2454268 - protein, 5 aa, Entamoeba dispar
QKGYD

SEQ ID NO: 2454269 - protein, 9 aa, Entamoeba dispar
QKGYGELSG

SEQ ID NO: 2454270 - protein, 16 aa, Entamoeba dispar
QKGYIEKENQKANEYI

SEQ ID NO: 2454271 - protein, 8 aa, Entamoeba dispar
QKHEPKVT

SEQ ID NO: 2454272 - protein, 11 aa, Entamoeba dispar
QKHKSTNDSFI

SEQ ID NO: 2454273 - protein, 12 aa, Entamoeba dispar
QKHNASSLLRSG

SEQ ID NO: 2454274 - protein, 7 aa, Entamoeba dispar
QKHPNEE

SEQ ID NO: 2454275 - protein, 8 aa, Entamoeba dispar
QKIDDAED

SEQ ID NO: 2454276 - protein, 8 aa, Entamoeba dispar
QKIDSQVH

SEQ ID NO: 2454277 - protein, 4 aa, Entamoeba dispar
QKIE

SEQ ID NO: 2454278 - protein, 10 aa, Entamoeba dispar
QKIEGENGEV

SEQ ID NO: 2454279 - protein, 8 aa, Entamoeba dispar
QKIEGSAN

SEQ ID NO: 2454280 - protein, 21 aa, Entamoeba dispar
QKIEKKSRVSETSKKNRKSHY

SEQ ID NO: 2454281 - protein, 10 aa, Entamoeba dispar
QKIENKQRTL

SEQ ID NO: 2454282 - protein, 9 aa, Entamoeba dispar
QKIEPNENE

SEQ ID NO: 2454283 - protein, 7 aa, Entamoeba dispar
QKIGNGG

SEQ ID NO: 2454284 - protein, 10 aa, Entamoeba dispar
QKIKPSENEY

SEQ ID NO: 2454285 - protein, 8 aa, Entamoeba dispar
QKIKSSEF

SEQ ID NO: 2454286 - protein, 12 aa, Entamoeba dispar
QKINGENIEKKD

SEQ ID NO: 2454287 - protein, 18 aa, Entamoeba dispar
QKINKYGNLARKEKIEEM

SEQ ID NO: 2454288 - protein, 5 aa, Entamoeba dispar
QKINN

SEQ ID NO: 2454289 - protein, 7 aa, Entamoeba dispar
QKINYSM

SEQ ID NO: 2454290 - protein, 15 aa, Entamoeba dispar
QKIQNSRGTAHRPSA

SEQ ID NO: 2454291 - protein, 10 aa, Entamoeba dispar
QKIRENQEKY

SEQ ID NO: 2454292 - protein, 5 aa, Entamoeba dispar
QKITD

SEQ ID NO: 2454293 - protein, 11 aa, Entamoeba dispar
QKITKEDYNRF

SEQ ID NO: 2454294 - protein, 11 aa, Entamoeba dispar
QKITKKSTLGE

SEQ ID NO: 2454295 - protein, 15 aa, Entamoeba dispar
QKITQSKQDSSYPEI

SEQ ID NO: 2454296 - protein, 8 aa, Entamoeba dispar
QKKADSIR

SEQ ID NO: 2454297 - protein, 12 aa, Entamoeba dispar
QKKASGVDSTKN

SEQ ID NO: 2454298 - protein, 7 aa, Entamoeba dispar
QKKDGYS

SEQ ID NO: 2454299 - protein, 14 aa, Entamoeba dispar
QKKDKETNYPLPKP

SEQ ID NO: 2454300 - protein, 9 aa, Entamoeba dispar
QKKDKQHVT

SEQ ID NO: 2454301 - protein, 8 aa, Entamoeba dispar
QKKDLNEF

SEQ ID NO: 2454302 - protein, 8 aa, Entamoeba dispar
QKKEEKKK

SEQ ID NO: 2454303 - protein, 17 aa, Entamoeba dispar
QKKEITQKIKKDKNNYI

SEQ ID NO: 2454304 - protein, 11 aa, Entamoeba dispar
QKKEKKEQKII

SEQ ID NO: 2454305 - protein, 18 aa, Entamoeba dispar
QKKEMEEELNEKEKVKEK

SEQ ID NO: 2454306 - protein, 7 aa, Entamoeba dispar
QKKEMKE

SEQ ID NO: 2454307 - protein, 5 aa, Entamoeba dispar
QKKEN

SEQ ID NO: 2454308 - protein, 10 aa, Entamoeba dispar
QKKEQNELNK

SEQ ID NO: 2454309 - protein, 19 aa, Entamoeba dispar
QKKESEEESIEKKKVEEAR

SEQ ID NO: 2454310 - protein, 19 aa, Entamoeba dispar
QKKESHDKIEDKSNKIEKG

SEQ ID NO: 2454311 - protein, 24 aa, Entamoeba dispar
QKKESTITNNVEAQKEKSPQEIRP

SEQ ID NO: 2454312 - protein, 11 aa, Entamoeba dispar
QKKFENEEGQD

SEQ ID NO: 2454313 - protein, 9 aa, Entamoeba dispar
QKKFSKKVD

SEQ ID NO: 2454314 - protein, 4 aa, Entamoeba dispar
QKKG

SEQ ID NO: 2454315 - protein, 5 aa, Entamoeba dispar
QKKGI

SEQ ID NO: 2454316 - protein, 11 aa, Entamoeba dispar
QKKGKKDRTCI

SEQ ID NO: 2454317 - protein, 8 aa, Entamoeba dispar
QKKGTKEF

SEQ ID NO: 2454318 - protein, 8 aa, Entamoeba dispar
QKKGYYYG

SEQ ID NO: 2454319 - protein, 12 aa, Entamoeba dispar
QKKIEEKKLKSG

SEQ ID NO: 2454320 - protein, 8 aa, Entamoeba dispar
QKKIEKDK

SEQ ID NO: 2454321 - protein, 5 aa, Entamoeba dispar
QKKIT

SEQ ID NO: 2454322 - protein, 13 aa, Entamoeba dispar
QKKKEEELKETSP

SEQ ID NO: 2454323 - protein, 8 aa, Entamoeba dispar
QKKKEVES

SEQ ID NO: 2454324 - protein, 9 aa, Entamoeba dispar
QKKKGTFEY

SEQ ID NO: 2454325 - protein, 14 aa, Entamoeba dispar
QKKKKELRKDEDFQ

SEQ ID NO: 2454326 - protein, 8 aa, Entamoeba dispar
QKKKLEKE

SEQ ID NO: 2454327 - protein, 11 aa, Entamoeba dispar
QKKKLGDKVEK

SEQ ID NO: 2454328 - protein, 15 aa, Entamoeba dispar
QKKKQQFESEIGEMQ

SEQ ID NO: 2454329 - protein, 13 aa, Entamoeba dispar
QKKKSETAQRESE

SEQ ID NO: 2454330 - protein, 4 aa, Entamoeba dispar
QKKN

SEQ ID NO: 2454331 - protein, 42 aa, Entamoeba dispar
QKKNDAKKLAQQKASELSAEKKSREKMEKQKGKEQRAIDEKY

SEQ ID NO: 2454332 - protein, 11 aa, Entamoeba dispar
QKKNELEPGKY

SEQ ID NO: 2454333 - protein, 15 aa, Entamoeba dispar
QKKNIQEISEDHESA

SEQ ID NO: 2454334 - protein, 16 aa, Entamoeba dispar
QKKNIQNKAKTRIDKD

SEQ ID NO: 2454335 - protein, 9 aa, Entamoeba dispar
QKKNTKRQS

SEQ ID NO: 2454336 - protein, 6 aa, Entamoeba dispar
QKKPKL

SEQ ID NO: 2454337 - protein, 8 aa, Entamoeba dispar
QKKPPKSL

SEQ ID NO: 2454338 - protein, 59 aa, Entamoeba dispar
QKKQAEDEDTITESNQHNSDTDTSTETRDDGENNPTTGEEKNQKSKNEKSITVPVDPNQ

SEQ ID NO: 2454339 - protein, 5 aa, Entamoeba dispar
QKKQP

SEQ ID NO: 2454340 - protein, 13 aa, Entamoeba dispar
QKKQVQSVGDSEI

SEQ ID NO: 2454341 - protein, 9 aa, Entamoeba dispar
QKKREADNN

SEQ ID NO: 2454342 - protein, 20 aa, Entamoeba dispar
QKKRKTEKNDEKKWSKEEDR

SEQ ID NO: 2454343 - protein, 8 aa, Entamoeba dispar
QKKRNEIT

SEQ ID NO: 2454344 - protein, 9 aa, Entamoeba dispar
QKKRRISPE

SEQ ID NO: 2454345 - protein, 9 aa, Entamoeba dispar
QKKSCSDEF

SEQ ID NO: 2454346 - protein, 12 aa, Entamoeba dispar
QKKSKQKQKPIE

SEQ ID NO: 2454347 - protein, 16 aa, Entamoeba dispar
QKKSYITGKAGRFDTH

SEQ ID NO: 2454348 - protein, 35 aa, Entamoeba dispar
QKKTLKTNKGVPSKSKLNSSKQENELEKVLKAHQH

SEQ ID NO: 2454349 - protein, 7 aa, Entamoeba dispar
QKKTRHN

SEQ ID NO: 2454350 - protein, 10 aa, Entamoeba dispar
QKKVQVDEKD

SEQ ID NO: 2454351 - protein, 7 aa, Entamoeba dispar
QKKVTAK

SEQ ID NO: 2454352 - protein, 6 aa, Entamoeba dispar
QKKYYE

SEQ ID NO: 2454353 - protein, 6 aa, Entamoeba dispar
QKLAPR

SEQ ID NO: 2454354 - protein, 7 aa, Entamoeba dispar
QKLERYN

SEQ ID NO: 2454355 - protein, 9 aa, Entamoeba dispar
QKLGERALP

SEQ ID NO: 2454356 - protein, 6 aa, Entamoeba dispar
QKLPKT

SEQ ID NO: 2454357 - protein, 5 aa, Entamoeba dispar
QKLPP

SEQ ID NO: 2454358 - protein, 6 aa, Entamoeba dispar
QKLPYM

SEQ ID NO: 2454359 - protein, 15 aa, Entamoeba dispar
QKLQRDEFEKQKSEI

SEQ ID NO: 2454360 - protein, 5 aa, Entamoeba dispar
QKLTI

SEQ ID NO: 2454361 - protein, 8 aa, Entamoeba dispar
QKLTKTVK

SEQ ID NO: 2454362 - protein, 8 aa, Entamoeba dispar
QKLTNMKA

SEQ ID NO: 2454363 - protein, 4 aa, Entamoeba dispar
QKME

SEQ ID NO: 2454364 - protein, 10 aa, Entamoeba dispar
QKMKDNENKV

SEQ ID NO: 2454365 - protein, 10 aa, Entamoeba dispar
QKMNEHQQEL

SEQ ID NO: 2454366 - protein, 4 aa, Entamoeba dispar
QKMR

SEQ ID NO: 2454367 - protein, 10 aa, Entamoeba dispar
QKMSGKNAQF

SEQ ID NO: 2454368 - protein, 8 aa, Entamoeba dispar
QKNADAKA

SEQ ID NO: 2454369 - protein, 6 aa, Entamoeba dispar
QKNCDE

SEQ ID NO: 2454370 - protein, 6 aa, Entamoeba dispar
QKNEEF

SEQ ID NO: 2454371 - protein, 13 aa, Entamoeba dispar
QKNEEKIQHQKEK

SEQ ID NO: 2454372 - protein, 10 aa, Entamoeba dispar
QKNEIDADSA

SEQ ID NO: 2454373 - protein, 4 aa, Entamoeba dispar
QKNG

SEQ ID NO: 2454374 - protein, 5 aa, Entamoeba dispar
QKNGD

SEQ ID NO: 2454375 - protein, 7 aa, Entamoeba dispar
QKNGLDG

SEQ ID NO: 2454376 - protein, 7 aa, Entamoeba dispar
QKNGNKE

SEQ ID NO: 2454377 - protein, 13 aa, Entamoeba dispar
QKNGTGNGEEYNS

SEQ ID NO: 2454378 - protein, 7 aa, Entamoeba dispar
QKNGTIQ

SEQ ID NO: 2454379 - protein, 15 aa, Entamoeba dispar
QKNHSKRHREKSKMR

SEQ ID NO: 2454380 - protein, 11 aa, Entamoeba dispar
QKNIEKEEEHI

SEQ ID NO: 2454381 - protein, 20 aa, Entamoeba dispar
QKNIPSGVGTTSNQTLTEKE

SEQ ID NO: 2454382 - protein, 11 aa, Entamoeba dispar
QKNISQKVNEY

SEQ ID NO: 2454383 - protein, 5 aa, Entamoeba dispar
QKNKL

SEQ ID NO: 2454384 - protein, 43 aa, Entamoeba dispar
QKNKNSSTKSSSYYQDTERKSQDVKRNPSSSLTQNNVKEEPKK

SEQ ID NO: 2454385 - protein, 9 aa, Entamoeba dispar
QKNLNQQTE

SEQ ID NO: 2454386 - protein, 7 aa, Entamoeba dispar
QKNLSTI

SEQ ID NO: 2454387 - protein, 6 aa, Entamoeba dispar
QKNMTN

SEQ ID NO: 2454388 - protein, 9 aa, Entamoeba dispar
QKNNDSSLY

SEQ ID NO: 2454389 - protein, 9 aa, Entamoeba dispar
QKNNNIKQV

SEQ ID NO: 2454390 - protein, 9 aa, Entamoeba dispar
QKNPEEAEK

SEQ ID NO: 2454391 - protein, 9 aa, Entamoeba dispar
QKNPPTDLS

SEQ ID NO: 2454392 - protein, 5 aa, Entamoeba dispar
QKNQI

SEQ ID NO: 2454393 - protein, 8 aa, Entamoeba dispar
QKNQISES

SEQ ID NO: 2454394 - protein, 10 aa, Entamoeba dispar
QKNRDQSKLS

SEQ ID NO: 2454395 - protein, 7 aa, Entamoeba dispar
QKNREVI

SEQ ID NO: 2454396 - protein, 4 aa, Entamoeba dispar
QKNS

SEQ ID NO: 2454397 - protein, 9 aa, Entamoeba dispar
QKNSEGLNG

SEQ ID NO: 2454398 - protein, 7 aa, Entamoeba dispar
QKNTLSP

SEQ ID NO: 2454399 - protein, 5 aa, Entamoeba dispar
QKNTP

SEQ ID NO: 2454400 - protein, 11 aa, Entamoeba dispar
QKNTPKDHKDY

SEQ ID NO: 2454401 - protein, 5 aa, Entamoeba dispar
QKNTQ

SEQ ID NO: 2454402 - protein, 13 aa, Entamoeba dispar
QKNVQTDANVNDN

SEQ ID NO: 2454403 - protein, 5 aa, Entamoeba dispar
QKPAE

SEQ ID NO: 2454404 - protein, 5 aa, Entamoeba dispar
QKPDI

SEQ ID NO: 2454405 - protein, 6 aa, Entamoeba dispar
QKPDIA

SEQ ID NO: 2454406 - protein, 8 aa, Entamoeba dispar
QKPDTKSK

SEQ ID NO: 2454407 - protein, 4 aa, Entamoeba dispar
QKPE

SEQ ID NO: 2454408 - protein, 9 aa, Entamoeba dispar
QKPENFTKT

SEQ ID NO: 2454409 - protein, 4 aa, Entamoeba dispar
QKPF

SEQ ID NO: 2454410 - protein, 5 aa, Entamoeba dispar
QKPFD

SEQ ID NO: 2454411 - protein, 10 aa, Entamoeba dispar
QKPIEGGFDG

SEQ ID NO: 2454412 - protein, 5 aa, Entamoeba dispar
QKPIG

SEQ ID NO: 2454413 - protein, 9 aa, Entamoeba dispar
QKPISSLTE

SEQ ID NO: 2454414 - protein, 21 aa, Entamoeba dispar
QKPKGIPDIKEKPKRTPTKPI

SEQ ID NO: 2454415 - protein, 8 aa, Entamoeba dispar
QKPKIKTI

SEQ ID NO: 2454416 - protein, 6 aa, Entamoeba dispar
QKPKLE

SEQ ID NO: 2454417 - protein, 11 aa, Entamoeba dispar
QKPKPKTEHEA

SEQ ID NO: 2454418 - protein, 5 aa, Entamoeba dispar
QKPKR

SEQ ID NO: 2454419 - protein, 8 aa, Entamoeba dispar
QKPLKDFN

SEQ ID NO: 2454420 - protein, 6 aa, Entamoeba dispar
QKPLNE

SEQ ID NO: 2454421 - protein, 7 aa, Entamoeba dispar
QKPLNPW

SEQ ID NO: 2454422 - protein, 8 aa, Entamoeba dispar
QKPLTGPV

SEQ ID NO: 2454423 - protein, 8 aa, Entamoeba dispar
QKPNFKGR

SEQ ID NO: 2454424 - protein, 6 aa, Entamoeba dispar
QKPNKK

SEQ ID NO: 2454425 - protein, 8 aa, Entamoeba dispar
QKPNPYPK

SEQ ID NO: 2454426 - protein, 8 aa, Entamoeba dispar
QKPPCSYT

SEQ ID NO: 2454427 - protein, 13 aa, Entamoeba dispar
QKPQPKQLSPNEI

SEQ ID NO: 2454428 - protein, 18 aa, Entamoeba dispar
QKPRKSSELKSKKSSQTL

SEQ ID NO: 2454429 - protein, 5 aa, Entamoeba dispar
QKPSI

SEQ ID NO: 2454430 - protein, 30 aa, Entamoeba dispar
QKPSQSQQLDTSQSVNLNQPPTSQSQFSSC

SEQ ID NO: 2454431 - protein, 6 aa, Entamoeba dispar
QKPSVE

SEQ ID NO: 2454432 - protein, 7 aa, Entamoeba dispar
QKPTDTI

SEQ ID NO: 2454433 - protein, 7 aa, Entamoeba dispar
QKPTEFQ

SEQ ID NO: 2454434 - protein, 7 aa, Entamoeba dispar
QKPTGTV

SEQ ID NO: 2454435 - protein, 7 aa, Entamoeba dispar
QKPTKAR

SEQ ID NO: 2454436 - protein, 8 aa, Entamoeba dispar
QKPTQAIY

SEQ ID NO: 2454437 - protein, 22 aa, Entamoeba dispar
QKPTRKHSTCSNKRESTNKRRK

SEQ ID NO: 2454438 - protein, 30 aa, Entamoeba dispar
QKPVSSSPQTVLSQPSETEPTQSPTPVTRR

SEQ ID NO: 2454439 - protein, 6 aa, Entamoeba dispar
QKPWYS

SEQ ID NO: 2454440 - protein, 9 aa, Entamoeba dispar
QKPYTAKSD

SEQ ID NO: 2454441 - protein, 9 aa, Entamoeba dispar
QKPYTFGDA

SEQ ID NO: 2454442 - protein, 5 aa, Entamoeba dispar
QKQDI

SEQ ID NO: 2454443 - protein, 33 aa, Entamoeba dispar
QKQDTTPLTNSSTVSLPQSSSSTLGNINKPNGL

SEQ ID NO: 2454444 - protein, 37 aa, Entamoeba dispar
QKQEISHEEPTGNTDKGLQKSINSSTPSLREDHSELT

SEQ ID NO: 2454445 - protein, 5 aa, Entamoeba dispar
QKQFD

SEQ ID NO: 2454446 - protein, 9 aa, Entamoeba dispar
QKQGMTQKE

SEQ ID NO: 2454447 - protein, 9 aa, Entamoeba dispar
QKQGRDNKV

SEQ ID NO: 2454448 - protein, 41 aa, Entamoeba dispar
QKQIEKNVTPIADESTKSSNDSKQSPPELSKDRVSESCPTL

SEQ ID NO: 2454449 - protein, 15 aa, Entamoeba dispar
QKQIHEEQMEKQKIE

SEQ ID NO: 2454450 - protein, 9 aa, Entamoeba dispar
QKQKELEKL

SEQ ID NO: 2454451 - protein, 7 aa, Entamoeba dispar
QKQKGYS

SEQ ID NO: 2454452 - protein, 11 aa, Entamoeba dispar
QKQKSEKKTYY

SEQ ID NO: 2454453 - protein, 4 aa, Entamoeba dispar
QKQL

SEQ ID NO: 2454454 - protein, 15 aa, Entamoeba dispar
QKQNKTKSIQKEENK

SEQ ID NO: 2454455 - protein, 6 aa, Entamoeba dispar
QKQNNP

SEQ ID NO: 2454456 - protein, 6 aa, Entamoeba dispar
QKQNYY

SEQ ID NO: 2454457 - protein, 19 aa, Entamoeba dispar
QKQPENITSINTANKQKLD

SEQ ID NO: 2454458 - protein, 6 aa, Entamoeba dispar
QKQPGV

SEQ ID NO: 2454459 - protein, 12 aa, Entamoeba dispar
QKQQGKNPQEVA

SEQ ID NO: 2454460 - protein, 17 aa, Entamoeba dispar
QKQRKINKETFKNNEKE

SEQ ID NO: 2454461 - protein, 29 aa, Entamoeba dispar
QKQSYDDSIEDDENSNTTFGSEEQNEEKI

SEQ ID NO: 2454462 - protein, 18 aa, Entamoeba dispar
QKQTAAYLQTEEEVKGCE

SEQ ID NO: 2454463 - protein, 7 aa, Entamoeba dispar
QKQTIKE

SEQ ID NO: 2454464 - protein, 8 aa, Entamoeba dispar
QKQTTQTD

SEQ ID NO: 2454465 - protein, 7 aa, Entamoeba dispar
QKQVEEL

SEQ ID NO: 2454466 - protein, 122 aa, Entamoeba dispar
QKQVEQKKFDPNPKPTSAHTYSSYHTSHSTQPISYSTSHNVKETTKPRTVTRRENSLELNTSTTQHKDDKINHTSSSTRTYKQPSFTKPKITPSQPNTSSSKSQVSSSNPIKSEPKQSNEVD

SEQ ID NO: 2454467 - protein, 39 aa, Entamoeba dispar
QKQYPKMKDEYYKKPKEPKEIKTITEKQNNENEKKITHS

SEQ ID NO: 2454468 - protein, 8 aa, Entamoeba dispar
QKQYQQAR

SEQ ID NO: 2454469 - protein, 9 aa, Entamoeba dispar
QKRDTPKLN

SEQ ID NO: 2454470 - protein, 14 aa, Entamoeba dispar
QKRENSFETYPQPE

SEQ ID NO: 2454471 - protein, 14 aa, Entamoeba dispar
QKRGGDNETPKEVS

SEQ ID NO: 2454472 - protein, 11 aa, Entamoeba dispar
QKRGINENEID

SEQ ID NO: 2454473 - protein, 6 aa, Entamoeba dispar
QKRGNK

SEQ ID NO: 2454474 - protein, 6 aa, Entamoeba dispar
QKRGPL

SEQ ID NO: 2454475 - protein, 7 aa, Entamoeba dispar
QKRGRNI

SEQ ID NO: 2454476 - protein, 4 aa, Entamoeba dispar
QKRI

SEQ ID NO: 2454477 - protein, 11 aa, Entamoeba dispar
QKRKEKAGKWD

SEQ ID NO: 2454478 - protein, 32 aa, Entamoeba dispar
QKRKQAKPSLEQKSPHKQPTKKKEDEKENKSG

SEQ ID NO: 2454479 - protein, 11 aa, Entamoeba dispar
QKRKTDRKALD

SEQ ID NO: 2454480 - protein, 10 aa, Entamoeba dispar
QKRMPDNYTD

SEQ ID NO: 2454481 - protein, 7 aa, Entamoeba dispar
QKRNGID

SEQ ID NO: 2454482 - protein, 9 aa, Entamoeba dispar
QKRNQGNQK

SEQ ID NO: 2454483 - protein, 5 aa, Entamoeba dispar
QKRPF

SEQ ID NO: 2454484 - protein, 10 aa, Entamoeba dispar
QKRPSIRPND

SEQ ID NO: 2454485 - protein, 14 aa, Entamoeba dispar
QKSEEKKESQFKTI

SEQ ID NO: 2454486 - protein, 6 aa, Entamoeba dispar
QKSGLK

SEQ ID NO: 2454487 - protein, 21 aa, Entamoeba dispar
QKSGLQNSANITDSQNLHQSG

SEQ ID NO: 2454488 - protein, 6 aa, Entamoeba dispar
QKSGRY

SEQ ID NO: 2454489 - protein, 8 aa, Entamoeba dispar
QKSGTPIS

SEQ ID NO: 2454490 - protein, 4 aa, Entamoeba dispar
QKSI

SEQ ID NO: 2454491 - protein, 43 aa, Entamoeba dispar
QKSIGSPRSKSQDLHSINNNNSLSTAQSDNSMSSEPQKDLSEG

SEQ ID NO: 2454492 - protein, 7 aa, Entamoeba dispar
QKSIPLT

SEQ ID NO: 2454493 - protein, 6 aa, Entamoeba dispar
QKSISS

SEQ ID NO: 2454494 - protein, 11 aa, Entamoeba dispar
QKSISTPPNSV

SEQ ID NO: 2454495 - protein, 9 aa, Entamoeba dispar
QKSKDKKGG

SEQ ID NO: 2454496 - protein, 27 aa, Entamoeba dispar
QKSKETQEDEPIKCDDNDLKKPQINNK

SEQ ID NO: 2454497 - protein, 12 aa, Entamoeba dispar
QKSKNNMKAKLT

SEQ ID NO: 2454498 - protein, 8 aa, Entamoeba dispar
QKSKSNKF

SEQ ID NO: 2454499 - protein, 9 aa, Entamoeba dispar
QKSKTKLND

SEQ ID NO: 2454500 - protein, 6 aa, Entamoeba dispar
QKSKYR

SEQ ID NO: 2454501 - protein, 5 aa, Entamoeba dispar
QKSLE

SEQ ID NO: 2454502 - protein, 11 aa, Entamoeba dispar
QKSLTNPFSNS

SEQ ID NO: 2454503 - protein, 5 aa, Entamoeba dispar
QKSMT

SEQ ID NO: 2454504 - protein, 20 aa, Entamoeba dispar
QKSNIKKGEVEMTSNGITSF

SEQ ID NO: 2454505 - protein, 25 aa, Entamoeba dispar
QKSNITSEQIKTEPILTSQTSTNQN

SEQ ID NO: 2454506 - protein, 26 aa, Entamoeba dispar
QKSNSQENDTNVSQSIQEVQTQLENT

SEQ ID NO: 2454507 - protein, 6 aa, Entamoeba dispar
QKSNTR

SEQ ID NO: 2454508 - protein, 8 aa, Entamoeba dispar
QKSPQFRT

SEQ ID NO: 2454509 - protein, 7 aa, Entamoeba dispar
QKSPTDR

SEQ ID NO: 2454510 - protein, 5 aa, Entamoeba dispar
QKSQD

SEQ ID NO: 2454511 - protein, 10 aa, Entamoeba dispar
QKSQQYKVNT

SEQ ID NO: 2454512 - protein, 7 aa, Entamoeba dispar
QKSQTFK

SEQ ID NO: 2454513 - protein, 7 aa, Entamoeba dispar
QKSRNEK

SEQ ID NO: 2454514 - protein, 8 aa, Entamoeba dispar
QKSSDEVP

SEQ ID NO: 2454515 - protein, 8 aa, Entamoeba dispar
QKSSEALN

SEQ ID NO: 2454516 - protein, 6 aa, Entamoeba dispar
QKSSEV

SEQ ID NO: 2454517 - protein, 9 aa, Entamoeba dispar
QKSSKTDCK

SEQ ID NO: 2454518 - protein, 11 aa, Entamoeba dispar
QKSSSSEGVSH

SEQ ID NO: 2454519 - protein, 10 aa, Entamoeba dispar
QKSSSSPSTA

SEQ ID NO: 2454520 - protein, 6 aa, Entamoeba dispar
QKSTRV

SEQ ID NO: 2454521 - protein, 8 aa, Entamoeba dispar
QKSVDASI

SEQ ID NO: 2454522 - protein, 9 aa, Entamoeba dispar
QKSVSENVN

SEQ ID NO: 2454523 - protein, 6 aa, Entamoeba dispar
QKSYLP

SEQ ID NO: 2454524 - protein, 9 aa, Entamoeba dispar
QKTDGSTEI

SEQ ID NO: 2454525 - protein, 8 aa, Entamoeba dispar
QKTDTELY

SEQ ID NO: 2454526 - protein, 24 aa, Entamoeba dispar
QKTEDGNKAIEALNDKEVQELTKT

SEQ ID NO: 2454527 - protein, 18 aa, Entamoeba dispar
QKTEQAKQLQQVCLIFIL

SEQ ID NO: 2454528 - protein, 20 aa, Entamoeba dispar
QKTERKDADIERLEKEARRD

SEQ ID NO: 2454529 - protein, 7 aa, Entamoeba dispar
QKTGEEL

SEQ ID NO: 2454530 - protein, 6 aa, Entamoeba dispar
QKTGIA

SEQ ID NO: 2454531 - protein, 7 aa, Entamoeba dispar
QKTISNN

SEQ ID NO: 2454532 - protein, 8 aa, Entamoeba dispar
QKTISQED

SEQ ID NO: 2454533 - protein, 55 aa, Entamoeba dispar
QKTKDQQYNDEMNAKQKLREKEYAESKRIESEKLTAAAEARNAAMNAAKEQKVNA

SEQ ID NO: 2454534 - protein, 10 aa, Entamoeba dispar
QKTKNQECSI

SEQ ID NO: 2454535 - protein, 12 aa, Entamoeba dispar
QKTKNVHNWFIW

SEQ ID NO: 2454536 - protein, 4 aa, Entamoeba dispar
QKTL

SEQ ID NO: 2454537 - protein, 7 aa, Entamoeba dispar
QKTLESG

SEQ ID NO: 2454538 - protein, 29 aa, Entamoeba dispar
QKTLHKKNLAKKEKLRNETQKLENEKKVV

SEQ ID NO: 2454539 - protein, 6 aa, Entamoeba dispar
QKTLPT

SEQ ID NO: 2454540 - protein, 6 aa, Entamoeba dispar
QKTNDL

SEQ ID NO: 2454541 - protein, 5 aa, Entamoeba dispar
QKTNN

SEQ ID NO: 2454542 - protein, 12 aa, Entamoeba dispar
QKTQERIYEDEQ

SEQ ID NO: 2454543 - protein, 16 aa, Entamoeba dispar
QKTQLPNVEENNDQVQ

SEQ ID NO: 2454544 - protein, 7 aa, Entamoeba dispar
QKTQSDV

SEQ ID NO: 2454545 - protein, 4 aa, Entamoeba dispar
QKTS

SEQ ID NO: 2454546 - protein, 24 aa, Entamoeba dispar
QKTSPITETAKTQIKDEEKQEIEV

SEQ ID NO: 2454547 - protein, 130 aa, Entamoeba dispar
QKTSTSSSIKFGQTPTKQQNDNKTSEKSTITTSKSPEPQQQITPKPTSYGSKTPSSLTTQPKLQTKSNSMFSKKSTKPTTTSSITNSVKPTTTPTNKFSSSSTPTVSTPSSNNESSTQKSQNSSFTPRAF

SEQ ID NO: 2454548 - protein, 11 aa, Entamoeba dispar
QKTYGAKGPAI

SEQ ID NO: 2454549 - protein, 4 aa, Entamoeba dispar
QKVE

SEQ ID NO: 2454550 - protein, 23 aa, Entamoeba dispar
QKVEEESGDKENIENNKKQEILD

SEQ ID NO: 2454551 - protein, 13 aa, Entamoeba dispar
QKVEKEKNELQNN

SEQ ID NO: 2454552 - protein, 7 aa, Entamoeba dispar
QKVENGE

SEQ ID NO: 2454553 - protein, 4 aa, Entamoeba dispar
QKVG

SEQ ID NO: 2454554 - protein, 7 aa, Entamoeba dispar
QKVKEEK

SEQ ID NO: 2454555 - protein, 12 aa, Entamoeba dispar
QKVLQSTPVILN

SEQ ID NO: 2454556 - protein, 8 aa, Entamoeba dispar
QKVNDSTQ

SEQ ID NO: 2454557 - protein, 7 aa, Entamoeba dispar
QKVNKEI

SEQ ID NO: 2454558 - protein, 12 aa, Entamoeba dispar
QKVPTKEEERSD

SEQ ID NO: 2454559 - protein, 5 aa, Entamoeba dispar
QKYDG

SEQ ID NO: 2454560 - protein, 16 aa, Entamoeba dispar
QKYDNPKYKDEKCKEG

SEQ ID NO: 2454561 - protein, 5 aa, Entamoeba dispar
QKYEK

SEQ ID NO: 2454562 - protein, 8 aa, Entamoeba dispar
QKYENTIK

SEQ ID NO: 2454563 - protein, 8 aa, Entamoeba dispar
QKYGKKVS

SEQ ID NO: 2454564 - protein, 15 aa, Entamoeba dispar
QKYGQKKVGVEEGPK

SEQ ID NO: 2454565 - protein, 12 aa, Entamoeba dispar
QKYNALKSDKQN

SEQ ID NO: 2454566 - protein, 9 aa, Entamoeba dispar
QKYNNEEIN

SEQ ID NO: 2454567 - protein, 8 aa, Entamoeba dispar
QKYPPSAN

SEQ ID NO: 2454568 - protein, 18 aa, Entamoeba dispar
QKYQSTSPQQDQSIPNTT

SEQ ID NO: 2454569 - protein, 6 aa, Entamoeba dispar
QKYTDI

SEQ ID NO: 2454570 - protein, 14 aa, Entamoeba dispar
QLADSKYAGARSDP

SEQ ID NO: 2454571 - protein, 5 aa, Entamoeba dispar
QLAEG

SEQ ID NO: 2454572 - protein, 11 aa, Entamoeba dispar
QLAENAKFSTG

SEQ ID NO: 2454573 - protein, 5 aa, Entamoeba dispar
QLAES

SEQ ID NO: 2454574 - protein, 9 aa, Entamoeba dispar
QLAKEERMK

SEQ ID NO: 2454575 - protein, 26 aa, Entamoeba dispar
QLAKSRKSEKRKSIVAPKKPLSPASK

SEQ ID NO: 2454576 - protein, 5 aa, Entamoeba dispar
QLAQE

SEQ ID NO: 2454577 - protein, 10 aa, Entamoeba dispar
QLDENSKSSD

SEQ ID NO: 2454578 - protein, 7 aa, Entamoeba dispar
QLDEQTK

SEQ ID NO: 2454579 - protein, 6 aa, Entamoeba dispar
QLDGCS

SEQ ID NO: 2454580 - protein, 7 aa, Entamoeba dispar
QLDSSTV

SEQ ID NO: 2454581 - protein, 12 aa, Entamoeba dispar
QLDTDCKTNDVN

SEQ ID NO: 2454582 - protein, 12 aa, Entamoeba dispar
QLDTTEDNSKDL

SEQ ID NO: 2454583 - protein, 26 aa, Entamoeba dispar
QLEAKKQEDLEREQRVKSQLRSNPNR

SEQ ID NO: 2454584 - protein, 5 aa, Entamoeba dispar
QLEDS

SEQ ID NO: 2454585 - protein, 76 aa, Entamoeba dispar
QLEECQKKAEESKKSAEAAAEKATASKKSAEAAAARQKEAQAAEDDVTKALNEVKAQEQAKEDKRKALQKKIETAG

SEQ ID NO: 2454586 - protein, 17 aa, Entamoeba dispar
QLEEGKTLSDYNIQKES

SEQ ID NO: 2454587 - protein, 8 aa, Entamoeba dispar
QLEEPSLD

SEQ ID NO: 2454588 - protein, 6 aa, Entamoeba dispar
QLEKAK

SEQ ID NO: 2454589 - protein, 19 aa, Entamoeba dispar
QLEKNSEPEDINKQDEKQL

SEQ ID NO: 2454590 - protein, 10 aa, Entamoeba dispar
QLEKNTPADV

SEQ ID NO: 2454591 - protein, 4 aa, Entamoeba dispar
QLEN

SEQ ID NO: 2454592 - protein, 10 aa, Entamoeba dispar
QLENDSAFSR

SEQ ID NO: 2454593 - protein, 9 aa, Entamoeba dispar
QLENEGEEW

SEQ ID NO: 2454594 - protein, 16 aa, Entamoeba dispar
QLENEGYKTTKYSEEV

SEQ ID NO: 2454595 - protein, 14 aa, Entamoeba dispar
QLENQSTKDKKCFI

SEQ ID NO: 2454596 - protein, 10 aa, Entamoeba dispar
QLENSNGKIN

SEQ ID NO: 2454597 - protein, 8 aa, Entamoeba dispar
QLEPPANP

SEQ ID NO: 2454598 - protein, 5 aa, Entamoeba dispar
QLEPQ

SEQ ID NO: 2454599 - protein, 9 aa, Entamoeba dispar
QLEQDKKNL

SEQ ID NO: 2454600 - protein, 16 aa, Entamoeba dispar
QLEQKQKEKQERKRIK

SEQ ID NO: 2454601 - protein, 14 aa, Entamoeba dispar
QLEREKRKKEKLKE

SEQ ID NO: 2454602 - protein, 10 aa, Entamoeba dispar
QLERNSNSNY

SEQ ID NO: 2454603 - protein, 9 aa, Entamoeba dispar
QLESELTKR

SEQ ID NO: 2454604 - protein, 32 aa, Entamoeba dispar
QLESRKASIYENSTLKSTESINSLTPEQQEQL

SEQ ID NO: 2454605 - protein, 5 aa, Entamoeba dispar
QLETL

SEQ ID NO: 2454606 - protein, 6 aa, Entamoeba dispar
QLGDNG

SEQ ID NO: 2454607 - protein, 6 aa, Entamoeba dispar
QLGEMN

SEQ ID NO: 2454608 - protein, 10 aa, Entamoeba dispar
QLGGENNKSM

SEQ ID NO: 2454609 - protein, 11 aa, Entamoeba dispar
QLGSKGDQTKM

SEQ ID NO: 2454610 - protein, 11 aa, Entamoeba dispar
QLGSSDMSGEF

SEQ ID NO: 2454611 - protein, 5 aa, Entamoeba dispar
QLGTV

SEQ ID NO: 2454612 - protein, 23 aa, Entamoeba dispar
QLKAKGKPIPPPIKEKKSGKCAL

SEQ ID NO: 2454613 - protein, 12 aa, Entamoeba dispar
QLKAQSKNKEEL

SEQ ID NO: 2454614 - protein, 7 aa, Entamoeba dispar
QLKDSLA

SEQ ID NO: 2454615 - protein, 4 aa, Entamoeba dispar
QLKE

SEQ ID NO: 2454616 - protein, 24 aa, Entamoeba dispar
QLKEEEDSINSISEEELEKTQPIS

SEQ ID NO: 2454617 - protein, 19 aa, Entamoeba dispar
QLKEENNKIQEELEQKNQE

SEQ ID NO: 2454618 - protein, 5 aa, Entamoeba dispar
QLKEN

SEQ ID NO: 2454619 - protein, 12 aa, Entamoeba dispar
QLKEQETKASEL

SEQ ID NO: 2454620 - protein, 11 aa, Entamoeba dispar
QLKERDESKEL

SEQ ID NO: 2454621 - protein, 6 aa, Entamoeba dispar
QLKERL

SEQ ID NO: 2454622 - protein, 13 aa, Entamoeba dispar
QLKETKTIQEKDI

SEQ ID NO: 2454623 - protein, 9 aa, Entamoeba dispar
QLKGTDITE

SEQ ID NO: 2454624 - protein, 5 aa, Entamoeba dispar
QLKKD

SEQ ID NO: 2454625 - protein, 16 aa, Entamoeba dispar
QLKPKEKPEKRSLPRP

SEQ ID NO: 2454626 - protein, 6 aa, Entamoeba dispar
QLKQNK

SEQ ID NO: 2454627 - protein, 6 aa, Entamoeba dispar
QLKQQH

SEQ ID NO: 2454628 - protein, 8 aa, Entamoeba dispar
QLKQQISS

SEQ ID NO: 2454629 - protein, 7 aa, Entamoeba dispar
QLKQTNE

SEQ ID NO: 2454630 - protein, 7 aa, Entamoeba dispar
QLKQTNQ

SEQ ID NO: 2454631 - protein, 6 aa, Entamoeba dispar
QLKRRK

SEQ ID NO: 2454632 - protein, 5 aa, Entamoeba dispar
QLKTK

SEQ ID NO: 2454633 - protein, 9 aa, Entamoeba dispar
QLKYPYEGN

SEQ ID NO: 2454634 - protein, 16 aa, Entamoeba dispar
QLMKKSSSDAKIHKSK

SEQ ID NO: 2454635 - protein, 22 aa, Entamoeba dispar
QLNADDLRDLTGNFTANAQDIT

SEQ ID NO: 2454636 - protein, 4 aa, Entamoeba dispar
QLND

SEQ ID NO: 2454637 - protein, 10 aa, Entamoeba dispar
QLNDDQKNKI

SEQ ID NO: 2454638 - protein, 9 aa, Entamoeba dispar
QLNDKSKTV

SEQ ID NO: 2454639 - protein, 8 aa, Entamoeba dispar
QLNDPTPE

SEQ ID NO: 2454640 - protein, 4 aa, Entamoeba dispar
QLNE

SEQ ID NO: 2454641 - protein, 5 aa, Entamoeba dispar
QLNED

SEQ ID NO: 2454642 - protein, 12 aa, Entamoeba dispar
QLNKSKQEEKGC

SEQ ID NO: 2454643 - protein, 18 aa, Entamoeba dispar
QLNKSNSSQKCFSSEKEK

SEQ ID NO: 2454644 - protein, 5 aa, Entamoeba dispar
QLNNA

SEQ ID NO: 2454645 - protein, 106 aa, Entamoeba dispar
QLNNENKKTENEQPSVKQKEVKNKRKHRTYSYSDDSSEDSEQSSKRKRRHHRSHSRHSKRKHYRRSLSNSSDTSDYEDRYRRRKGHKHRKHSASSYDKSSRDLSED

SEQ ID NO: 2454646 - protein, 6 aa, Entamoeba dispar
QLNNQQ

SEQ ID NO: 2454647 - protein, 5 aa, Entamoeba dispar
QLNNS

SEQ ID NO: 2454648 - protein, 13 aa, Entamoeba dispar
QLNQPIQQHNKEL

SEQ ID NO: 2454649 - protein, 6 aa, Entamoeba dispar
QLNQRE

SEQ ID NO: 2454650 - protein, 7 aa, Entamoeba dispar
QLNSNYN

SEQ ID NO: 2454651 - protein, 8 aa, Entamoeba dispar
QLNTPEYE

SEQ ID NO: 2454652 - protein, 5 aa, Entamoeba dispar
QLPDG

SEQ ID NO: 2454653 - protein, 9 aa, Entamoeba dispar
QLPEAINGQ

SEQ ID NO: 2454654 - protein, 5 aa, Entamoeba dispar
QLPEQ

SEQ ID NO: 2454655 - protein, 10 aa, Entamoeba dispar
QLPEQQKETY

SEQ ID NO: 2454656 - protein, 6 aa, Entamoeba dispar
QLPGNK

SEQ ID NO: 2454657 - protein, 54 aa, Entamoeba dispar
QLPITTEKNIETKKEIKDITQNDKDKIKKASKKEKESTEPLKGNNESTTNQKNL

SEQ ID NO: 2454658 - protein, 6 aa, Entamoeba dispar
QLPNKY

SEQ ID NO: 2454659 - protein, 5 aa, Entamoeba dispar
QLPNS

SEQ ID NO: 2454660 - protein, 22 aa, Entamoeba dispar
QLPPPTNSNYYSPFTPSSSLNY

SEQ ID NO: 2454661 - protein, 7 aa, Entamoeba dispar
QLPPQPN

SEQ ID NO: 2454662 - protein, 6 aa, Entamoeba dispar
QLPPSV

SEQ ID NO: 2454663 - protein, 10 aa, Entamoeba dispar
QLPPTSKDVF

SEQ ID NO: 2454664 - protein, 7 aa, Entamoeba dispar
QLPQQPF

SEQ ID NO: 2454665 - protein, 12 aa, Entamoeba dispar
QLPSAKDRETIE

SEQ ID NO: 2454666 - protein, 12 aa, Entamoeba dispar
QLPSAKDRETVE

SEQ ID NO: 2454667 - protein, 5 aa, Entamoeba dispar
QLPSD

SEQ ID NO: 2454668 - protein, 13 aa, Entamoeba dispar
QLPSHLKGGNGKV

SEQ ID NO: 2454669 - protein, 6 aa, Entamoeba dispar
QLPSPK

SEQ ID NO: 2454670 - protein, 5 aa, Entamoeba dispar
QLPSQ

SEQ ID NO: 2454671 - protein, 5 aa, Entamoeba dispar
QLPSS

SEQ ID NO: 2454672 - protein, 18 aa, Entamoeba dispar
QLPSSLSEQTSAYPTTIP

SEQ ID NO: 2454673 - protein, 7 aa, Entamoeba dispar
QLPTEQK

SEQ ID NO: 2454674 - protein, 9 aa, Entamoeba dispar
QLQDERGEI

SEQ ID NO: 2454675 - protein, 5 aa, Entamoeba dispar
QLQED

SEQ ID NO: 2454676 - protein, 5 aa, Entamoeba dispar
QLQES

SEQ ID NO: 2454677 - protein, 4 aa, Entamoeba dispar
QLQG

SEQ ID NO: 2454678 - protein, 10 aa, Entamoeba dispar
QLQNKKKERF

SEQ ID NO: 2454679 - protein, 9 aa, Entamoeba dispar
QLQNNKINE

SEQ ID NO: 2454680 - protein, 9 aa, Entamoeba dispar
QLQPPSLPI

SEQ ID NO: 2454681 - protein, 9 aa, Entamoeba dispar
QLQRQDAAN

SEQ ID NO: 2454682 - protein, 29 aa, Entamoeba dispar
QLQTEKASIEKETTDMEQEFQKNEKSIEE

SEQ ID NO: 2454683 - protein, 10 aa, Entamoeba dispar
QLRAETEKEL

SEQ ID NO: 2454684 - protein, 7 aa, Entamoeba dispar
QLRDEND

SEQ ID NO: 2454685 - protein, 8 aa, Entamoeba dispar
QLRERRSR

SEQ ID NO: 2454686 - protein, 13 aa, Entamoeba dispar
QLRKNKDGSGYDC

SEQ ID NO: 2454687 - protein, 7 aa, Entamoeba dispar
QLRTTQN

SEQ ID NO: 2454688 - protein, 4 aa, Entamoeba dispar
QLSD

SEQ ID NO: 2454689 - protein, 7 aa, Entamoeba dispar
QLSDSTV

SEQ ID NO: 2454690 - protein, 5 aa, Entamoeba dispar
QLSEE

SEQ ID NO: 2454691 - protein, 9 aa, Entamoeba dispar
QLSGGEKTI

SEQ ID NO: 2454692 - protein, 9 aa, Entamoeba dispar
QLSGKAPHH

SEQ ID NO: 2454693 - protein, 11 aa, Entamoeba dispar
QLSIKDEGKTI

SEQ ID NO: 2454694 - protein, 4 aa, Entamoeba dispar
QLSQ

SEQ ID NO: 2454695 - protein, 10 aa, Entamoeba dispar
QLSQSNISLE

SEQ ID NO: 2454696 - protein, 8 aa, Entamoeba dispar
QLSSPNRI

SEQ ID NO: 2454697 - protein, 9 aa, Entamoeba dispar
QLSSQPPDF

SEQ ID NO: 2454698 - protein, 5 aa, Entamoeba dispar
QLSSS

SEQ ID NO: 2454699 - protein, 7 aa, Entamoeba dispar
QLSSSTD

SEQ ID NO: 2454700 - protein, 5 aa, Entamoeba dispar
QLSSY

SEQ ID NO: 2454701 - protein, 11 aa, Entamoeba dispar
QLSSYKEQDKW

SEQ ID NO: 2454702 - protein, 7 aa, Entamoeba dispar
QLSTEDI

SEQ ID NO: 2454703 - protein, 5 aa, Entamoeba dispar
QLTED

SEQ ID NO: 2454704 - protein, 9 aa, Entamoeba dispar
QLTEEEKQE

SEQ ID NO: 2454705 - protein, 7 aa, Entamoeba dispar
QLTETST

SEQ ID NO: 2454706 - protein, 6 aa, Entamoeba dispar
QLTGRI

SEQ ID NO: 2454707 - protein, 8 aa, Entamoeba dispar
QLTNPYSS

SEQ ID NO: 2454708 - protein, 4 aa, Entamoeba dispar
QLTP

SEQ ID NO: 2454709 - protein, 6 aa, Entamoeba dispar
QLTPLS

SEQ ID NO: 2454710 - protein, 10 aa, Entamoeba dispar
QLTSLTEEQF

SEQ ID NO: 2454711 - protein, 14 aa, Entamoeba dispar
QLTSQKSDEPKIEI

SEQ ID NO: 2454712 - protein, 13 aa, Entamoeba dispar
QLTSQRDKRNSIV

SEQ ID NO: 2454713 - protein, 13 aa, Entamoeba dispar
QLTSTDTPMNNSQ

SEQ ID NO: 2454714 - protein, 16 aa, Entamoeba dispar
QMAEEYRTKVDTMKEN

SEQ ID NO: 2454715 - protein, 8 aa, Entamoeba dispar
QMEQAQNK

SEQ ID NO: 2454716 - protein, 7 aa, Entamoeba dispar
QMGDPGL

SEQ ID NO: 2454717 - protein, 14 aa, Entamoeba dispar
QMITGGGKRKVRDE

SEQ ID NO: 2454718 - protein, 4 aa, Entamoeba dispar
QMKE

SEQ ID NO: 2454719 - protein, 15 aa, Entamoeba dispar
QMKEKQSQYNHSPSI

SEQ ID NO: 2454720 - protein, 5 aa, Entamoeba dispar
QMKER

SEQ ID NO: 2454721 - protein, 18 aa, Entamoeba dispar
QMKSTGKKTIKKKKMGVA

SEQ ID NO: 2454722 - protein, 5 aa, Entamoeba dispar
QMNDE

SEQ ID NO: 2454723 - protein, 6 aa, Entamoeba dispar
QMNNKG

SEQ ID NO: 2454724 - protein, 29 aa, Entamoeba dispar
QMNNSTLSNDFTETKGSNILSRTKGDHCE

SEQ ID NO: 2454725 - protein, 23 aa, Entamoeba dispar
QMNSQTKPDVKKAAQLQEQKEEI

SEQ ID NO: 2454726 - protein, 11 aa, Entamoeba dispar
QMPGGQYSNLQ

SEQ ID NO: 2454727 - protein, 4 aa, Entamoeba dispar
QMRP

SEQ ID NO: 2454728 - protein, 8 aa, Entamoeba dispar
QMSEEERK

SEQ ID NO: 2454729 - protein, 8 aa, Entamoeba dispar
QMSGIDAE

SEQ ID NO: 2454730 - protein, 9 aa, Entamoeba dispar
QMSSSEKEH

SEQ ID NO: 2454731 - protein, 11 aa, Entamoeba dispar
QMTPDTKEECS

SEQ ID NO: 2454732 - protein, 10 aa, Entamoeba dispar
QNAAKDASEL

SEQ ID NO: 2454733 - protein, 9 aa, Entamoeba dispar
QNAAQDTTI

SEQ ID NO: 2454734 - protein, 7 aa, Entamoeba dispar
QNAEIEQ

SEQ ID NO: 2454735 - protein, 9 aa, Entamoeba dispar
QNAGEDETF

SEQ ID NO: 2454736 - protein, 9 aa, Entamoeba dispar
QNANNSLEL

SEQ ID NO: 2454737 - protein, 10 aa, Entamoeba dispar
QNAQEEKNEV

SEQ ID NO: 2454738 - protein, 12 aa, Entamoeba dispar
QNAQEKLKRNIV

SEQ ID NO: 2454739 - protein, 10 aa, Entamoeba dispar
QNAQIGSKVY

SEQ ID NO: 2454740 - protein, 8 aa, Entamoeba dispar
QNATEAKG

SEQ ID NO: 2454741 - protein, 4 aa, Entamoeba dispar
QNAY

SEQ ID NO: 2454742 - protein, 10 aa, Entamoeba dispar
QNCSNEERVK

SEQ ID NO: 2454743 - protein, 6 aa, Entamoeba dispar
QNDAYP

SEQ ID NO: 2454744 - protein, 8 aa, Entamoeba dispar
QNDDESIQ

SEQ ID NO: 2454745 - protein, 13 aa, Entamoeba dispar
QNDDFNEKDMKDK

SEQ ID NO: 2454746 - protein, 5 aa, Entamoeba dispar
QNDDK

SEQ ID NO: 2454747 - protein, 14 aa, Entamoeba dispar
QNDDSGDQSNTIED

SEQ ID NO: 2454748 - protein, 6 aa, Entamoeba dispar
QNDEAN

SEQ ID NO: 2454749 - protein, 13 aa, Entamoeba dispar
QNDEEEVAEETNA

SEQ ID NO: 2454750 - protein, 6 aa, Entamoeba dispar
QNDEKI

SEQ ID NO: 2454751 - protein, 25 aa, Entamoeba dispar
QNDFEPPKSHTSFTEPHTPSSTKYV

SEQ ID NO: 2454752 - protein, 4 aa, Entamoeba dispar
QNDG

SEQ ID NO: 2454753 - protein, 7 aa, Entamoeba dispar
QNDISSL

SEQ ID NO: 2454754 - protein, 6 aa, Entamoeba dispar
QNDNGY

SEQ ID NO: 2454755 - protein, 9 aa, Entamoeba dispar
QNDNKDNKF

SEQ ID NO: 2454756 - protein, 12 aa, Entamoeba dispar
QNDNKLSKLLKE

SEQ ID NO: 2454757 - protein, 12 aa, Entamoeba dispar
QNDNTLSMLLKN

SEQ ID NO: 2454758 - protein, 11 aa, Entamoeba dispar
QNDPDPDENIE

SEQ ID NO: 2454759 - protein, 6 aa, Entamoeba dispar
QNDPID

SEQ ID NO: 2454760 - protein, 6 aa, Entamoeba dispar
QNDPRE

SEQ ID NO: 2454761 - protein, 6 aa, Entamoeba dispar
QNDQHS

SEQ ID NO: 2454762 - protein, 5 aa, Entamoeba dispar
QNDVP

SEQ ID NO: 2454763 - protein, 7 aa, Entamoeba dispar
QNEAVTA

SEQ ID NO: 2454764 - protein, 4 aa, Entamoeba dispar
QNED

SEQ ID NO: 2454765 - protein, 7 aa, Entamoeba dispar
QNEDKIE

SEQ ID NO: 2454766 - protein, 6 aa, Entamoeba dispar
QNEDKK

SEQ ID NO: 2454767 - protein, 8 aa, Entamoeba dispar
QNEDTDEG

SEQ ID NO: 2454768 - protein, 8 aa, Entamoeba dispar
QNEECKKK

SEQ ID NO: 2454769 - protein, 7 aa, Entamoeba dispar
QNEEIKQ

SEQ ID NO: 2454770 - protein, 20 aa, Entamoeba dispar
QNEEKWDKCKNQLKKHLIYG

SEQ ID NO: 2454771 - protein, 10 aa, Entamoeba dispar
QNEENEYKKL

SEQ ID NO: 2454772 - protein, 6 aa, Entamoeba dispar
QNEENI

SEQ ID NO: 2454773 - protein, 8 aa, Entamoeba dispar
QNEESNIH

SEQ ID NO: 2454774 - protein, 16 aa, Entamoeba dispar
QNEEYNDTKQPKYTPK

SEQ ID NO: 2454775 - protein, 6 aa, Entamoeba dispar
QNEGKT

SEQ ID NO: 2454776 - protein, 16 aa, Entamoeba dispar
QNEGLKKQVEETQNRM

SEQ ID NO: 2454777 - protein, 6 aa, Entamoeba dispar
QNEIGT

SEQ ID NO: 2454778 - protein, 6 aa, Entamoeba dispar
QNEINN

SEQ ID NO: 2454779 - protein, 7 aa, Entamoeba dispar
QNEIPQL

SEQ ID NO: 2454780 - protein, 5 aa, Entamoeba dispar
QNEIS

SEQ ID NO: 2454781 - protein, 17 aa, Entamoeba dispar
QNEITTKQQQESQEKER

SEQ ID NO: 2454782 - protein, 7 aa, Entamoeba dispar
QNEITTQ

SEQ ID NO: 2454783 - protein, 4 aa, Entamoeba dispar
QNEK

SEQ ID NO: 2454784 - protein, 10 aa, Entamoeba dispar
QNEKKRPEGY

SEQ ID NO: 2454785 - protein, 10 aa, Entamoeba dispar
QNEKKSPIKD

SEQ ID NO: 2454786 - protein, 7 aa, Entamoeba dispar
QNEKQEW

SEQ ID NO: 2454787 - protein, 8 aa, Entamoeba dispar
QNEKTIPL

SEQ ID NO: 2454788 - protein, 9 aa, Entamoeba dispar
QNEKTNREQ

SEQ ID NO: 2454789 - protein, 15 aa, Entamoeba dispar
QNELEKAKKEISEIT

SEQ ID NO: 2454790 - protein, 22 aa, Entamoeba dispar
QNELKGEHKQIKGRASETNLSN

SEQ ID NO: 2454791 - protein, 5 aa, Entamoeba dispar
QNEMT

SEQ ID NO: 2454792 - protein, 15 aa, Entamoeba dispar
QNENAKLKNELQAKE

SEQ ID NO: 2454793 - protein, 7 aa, Entamoeba dispar
QNENDQL

SEQ ID NO: 2454794 - protein, 7 aa, Entamoeba dispar
QNENDTL

SEQ ID NO: 2454795 - protein, 8 aa, Entamoeba dispar
QNENKLQE

SEQ ID NO: 2454796 - protein, 7 aa, Entamoeba dispar
QNENSYH

SEQ ID NO: 2454797 - protein, 7 aa, Entamoeba dispar
QNEPDLN

SEQ ID NO: 2454798 - protein, 9 aa, Entamoeba dispar
QNEPDPEFP

SEQ ID NO: 2454799 - protein, 9 aa, Entamoeba dispar
QNEPPTRYS

SEQ ID NO: 2454800 - protein, 4 aa, Entamoeba dispar
QNEQ

SEQ ID NO: 2454801 - protein, 6 aa, Entamoeba dispar
QNEQKT

SEQ ID NO: 2454802 - protein, 9 aa, Entamoeba dispar
QNEREAARK

SEQ ID NO: 2454803 - protein, 30 aa, Entamoeba dispar
QNERLKKENDEIKETIDSYQKAINNKTTEI

SEQ ID NO: 2454804 - protein, 16 aa, Entamoeba dispar
QNERLRSQILSLKEKF

SEQ ID NO: 2454805 - protein, 5 aa, Entamoeba dispar
QNERN

SEQ ID NO: 2454806 - protein, 11 aa, Entamoeba dispar
QNERNQIQPED

SEQ ID NO: 2454807 - protein, 10 aa, Entamoeba dispar
QNESDSVDYA

SEQ ID NO: 2454808 - protein, 9 aa, Entamoeba dispar
QNESGYIPR

SEQ ID NO: 2454809 - protein, 9 aa, Entamoeba dispar
QNESISTDE

SEQ ID NO: 2454810 - protein, 29 aa, Entamoeba dispar
QNESLKNNKSKEVKSPSSSLSESTEEEKE

SEQ ID NO: 2454811 - protein, 9 aa, Entamoeba dispar
QNESRKEEG

SEQ ID NO: 2454812 - protein, 5 aa, Entamoeba dispar
QNEST

SEQ ID NO: 2454813 - protein, 10 aa, Entamoeba dispar
QNESVEQKGY

SEQ ID NO: 2454814 - protein, 8 aa, Entamoeba dispar
QNETESPE

SEQ ID NO: 2454815 - protein, 8 aa, Entamoeba dispar
QNETETLT

SEQ ID NO: 2454816 - protein, 7 aa, Entamoeba dispar
QNEVKKR

SEQ ID NO: 2454817 - protein, 12 aa, Entamoeba dispar
QNEVNALKSGLG

SEQ ID NO: 2454818 - protein, 4 aa, Entamoeba dispar
QNEW

SEQ ID NO: 2454819 - protein, 9 aa, Entamoeba dispar
QNEYNEDET

SEQ ID NO: 2454820 - protein, 6 aa, Entamoeba dispar
QNEYQK

SEQ ID NO: 2454821 - protein, 4 aa, Entamoeba dispar
QNFE

SEQ ID NO: 2454822 - protein, 6 aa, Entamoeba dispar
QNFNDE

SEQ ID NO: 2454823 - protein, 5 aa, Entamoeba dispar
QNFTA

SEQ ID NO: 2454824 - protein, 5 aa, Entamoeba dispar
QNFTP

SEQ ID NO: 2454825 - protein, 8 aa, Entamoeba dispar
QNGAINPS

SEQ ID NO: 2454826 - protein, 6 aa, Entamoeba dispar
QNGANK

SEQ ID NO: 2454827 - protein, 8 aa, Entamoeba dispar
QNGANSQS

SEQ ID NO: 2454828 - protein, 7 aa, Entamoeba dispar
QNGCKSK

SEQ ID NO: 2454829 - protein, 4 aa, Entamoeba dispar
QNGE

SEQ ID NO: 2454830 - protein, 5 aa, Entamoeba dispar
QNGEN

SEQ ID NO: 2454831 - protein, 6 aa, Entamoeba dispar
QNGGNI

SEQ ID NO: 2454832 - protein, 6 aa, Entamoeba dispar
QNGHYQ

SEQ ID NO: 2454833 - protein, 4 aa, Entamoeba dispar
QNGI

SEQ ID NO: 2454834 - protein, 19 aa, Entamoeba dispar
QNGISFGKRKTKQAKKTIQ

SEQ ID NO: 2454835 - protein, 14 aa, Entamoeba dispar
QNGISSNTLNPQQV

SEQ ID NO: 2454836 - protein, 11 aa, Entamoeba dispar
QNGKSANEYPV

SEQ ID NO: 2454837 - protein, 8 aa, Entamoeba dispar
QNGLSGEE

SEQ ID NO: 2454838 - protein, 5 aa, Entamoeba dispar
QNGNI

SEQ ID NO: 2454839 - protein, 4 aa, Entamoeba dispar
QNGP

SEQ ID NO: 2454840 - protein, 5 aa, Entamoeba dispar
QNGPI

SEQ ID NO: 2454841 - protein, 8 aa, Entamoeba dispar
QNGQQAIA

SEQ ID NO: 2454842 - protein, 13 aa, Entamoeba dispar
QNGQQSFFPEPNH

SEQ ID NO: 2454843 - protein, 4 aa, Entamoeba dispar
QNGR

SEQ ID NO: 2454844 - protein, 7 aa, Entamoeba dispar
QNGTEEL

SEQ ID NO: 2454845 - protein, 8 aa, Entamoeba dispar
QNGTGKTT

SEQ ID NO: 2454846 - protein, 6 aa, Entamoeba dispar
QNGTNQ

SEQ ID NO: 2454847 - protein, 14 aa, Entamoeba dispar
QNGTPSFQVKTDQK

SEQ ID NO: 2454848 - protein, 4 aa, Entamoeba dispar
QNGV

SEQ ID NO: 2454849 - protein, 10 aa, Entamoeba dispar
QNGYTKQDLN

SEQ ID NO: 2454850 - protein, 5 aa, Entamoeba dispar
QNHEA

SEQ ID NO: 2454851 - protein, 13 aa, Entamoeba dispar
QNHPKEAEKELEN

SEQ ID NO: 2454852 - protein, 5 aa, Entamoeba dispar
QNHPT

SEQ ID NO: 2454853 - protein, 12 aa, Entamoeba dispar
QNHTKKGKVSVS

SEQ ID NO: 2454854 - protein, 8 aa, Entamoeba dispar
QNHTNGKN

SEQ ID NO: 2454855 - protein, 5 aa, Entamoeba dispar
QNIEL

SEQ ID NO: 2454856 - protein, 8 aa, Entamoeba dispar
QNIHEEET

SEQ ID NO: 2454857 - protein, 6 aa, Entamoeba dispar
QNINNT

SEQ ID NO: 2454858 - protein, 9 aa, Entamoeba dispar
QNINPTPKS

SEQ ID NO: 2454859 - protein, 6 aa, Entamoeba dispar
QNIPQN

SEQ ID NO: 2454860 - protein, 6 aa, Entamoeba dispar
QNIPSG

SEQ ID NO: 2454861 - protein, 10 aa, Entamoeba dispar
QNIPSKPIQF

SEQ ID NO: 2454862 - protein, 6 aa, Entamoeba dispar
QNIQEI

SEQ ID NO: 2454863 - protein, 83 aa, Entamoeba dispar
QNIQGKTKKQQQQKQQQTKGNKDEKQKQGKTKEEKKEGQQKVDGVPQLSNKELKALKKQQKHDKKVAKLGENIQKSKTGESQI

SEQ ID NO: 2454864 - protein, 14 aa, Entamoeba dispar
QNIQQNKSDIPSNV

SEQ ID NO: 2454865 - protein, 6 aa, Entamoeba dispar
QNISGE

SEQ ID NO: 2454866 - protein, 5 aa, Entamoeba dispar
QNISS

SEQ ID NO: 2454867 - protein, 7 aa, Entamoeba dispar
QNITKDE

SEQ ID NO: 2454868 - protein, 8 aa, Entamoeba dispar
QNKDDEDL

SEQ ID NO: 2454869 - protein, 18 aa, Entamoeba dispar
QNKDGGYRDKPSKKPDLY

SEQ ID NO: 2454870 - protein, 5 aa, Entamoeba dispar
QNKDK

SEQ ID NO: 2454871 - protein, 11 aa, Entamoeba dispar
QNKDRKKEEEK

SEQ ID NO: 2454872 - protein, 6 aa, Entamoeba dispar
QNKEEF

SEQ ID NO: 2454873 - protein, 21 aa, Entamoeba dispar
QNKEHIPYSEDKSLTGTARYA

SEQ ID NO: 2454874 - protein, 8 aa, Entamoeba dispar
QNKGLGID

SEQ ID NO: 2454875 - protein, 5 aa, Entamoeba dispar
QNKGR

SEQ ID NO: 2454876 - protein, 5 aa, Entamoeba dispar
QNKGT

SEQ ID NO: 2454877 - protein, 5 aa, Entamoeba dispar
QNKGV

SEQ ID NO: 2454878 - protein, 11 aa, Entamoeba dispar
QNKHKDYTDTD

SEQ ID NO: 2454879 - protein, 5 aa, Entamoeba dispar
QNKHQ

SEQ ID NO: 2454880 - protein, 12 aa, Entamoeba dispar
QNKKKKKQHCVI

SEQ ID NO: 2454881 - protein, 9 aa, Entamoeba dispar
QNKLKNAPQ

SEQ ID NO: 2454882 - protein, 8 aa, Entamoeba dispar
QNKLTSND

SEQ ID NO: 2454883 - protein, 8 aa, Entamoeba dispar
QNKNDNQC

SEQ ID NO: 2454884 - protein, 9 aa, Entamoeba dispar
QNKPEYQDE

SEQ ID NO: 2454885 - protein, 9 aa, Entamoeba dispar
QNKPSTMYS

SEQ ID NO: 2454886 - protein, 11 aa, Entamoeba dispar
QNKQKLSKTTP

SEQ ID NO: 2454887 - protein, 9 aa, Entamoeba dispar
QNKQKNDSI

SEQ ID NO: 2454888 - protein, 9 aa, Entamoeba dispar
QNKQTGKDM

SEQ ID NO: 2454889 - protein, 10 aa, Entamoeba dispar
QNKRAKNEQL

SEQ ID NO: 2454890 - protein, 14 aa, Entamoeba dispar
QNKRIPEKCFKDVR

SEQ ID NO: 2454891 - protein, 5 aa, Entamoeba dispar
QNKSF

SEQ ID NO: 2454892 - protein, 25 aa, Entamoeba dispar
QNKSYISSNCANGELTQGYEDPTGL

SEQ ID NO: 2454893 - protein, 6 aa, Entamoeba dispar
QNKVDD

SEQ ID NO: 2454894 - protein, 13 aa, Entamoeba dispar
QNKWSSKEYRKRK

SEQ ID NO: 2454895 - protein, 7 aa, Entamoeba dispar
QNLKNEN

SEQ ID NO: 2454896 - protein, 14 aa, Entamoeba dispar
QNLNQQPQHTIPQQ

SEQ ID NO: 2454897 - protein, 4 aa, Entamoeba dispar
QNLP

SEQ ID NO: 2454898 - protein, 9 aa, Entamoeba dispar
QNLPRTGSA

SEQ ID NO: 2454899 - protein, 18 aa, Entamoeba dispar
QNLSGKRGRFDGRRGLSR

SEQ ID NO: 2454900 - protein, 8 aa, Entamoeba dispar
QNLSKEEM

SEQ ID NO: 2454901 - protein, 6 aa, Entamoeba dispar
QNMARR

SEQ ID NO: 2454902 - protein, 13 aa, Entamoeba dispar
QNMEEQGSTALGP

SEQ ID NO: 2454903 - protein, 4 aa, Entamoeba dispar
QNND

SEQ ID NO: 2454904 - protein, 9 aa, Entamoeba dispar
QNNDNNTIL

SEQ ID NO: 2454905 - protein, 7 aa, Entamoeba dispar
QNNEIKN

SEQ ID NO: 2454906 - protein, 8 aa, Entamoeba dispar
QNNEQAKK

SEQ ID NO: 2454907 - protein, 5 aa, Entamoeba dispar
QNNIE

SEQ ID NO: 2454908 - protein, 8 aa, Entamoeba dispar
QNNKEKLQ

SEQ ID NO: 2454909 - protein, 7 aa, Entamoeba dispar
QNNKENA

SEQ ID NO: 2454910 - protein, 6 aa, Entamoeba dispar
QNNKGG

SEQ ID NO: 2454911 - protein, 7 aa, Entamoeba dispar
QNNLSQI

SEQ ID NO: 2454912 - protein, 8 aa, Entamoeba dispar
QNNNAANA

SEQ ID NO: 2454913 - protein, 5 aa, Entamoeba dispar
QNNNF

SEQ ID NO: 2454914 - protein, 8 aa, Entamoeba dispar
QNNNSFNN

SEQ ID NO: 2454915 - protein, 8 aa, Entamoeba dispar
QNNNYSEE

SEQ ID NO: 2454916 - protein, 6 aa, Entamoeba dispar
QNNPNI

SEQ ID NO: 2454917 - protein, 6 aa, Entamoeba dispar
QNNPTL

SEQ ID NO: 2454918 - protein, 4 aa, Entamoeba dispar
QNNQ

SEQ ID NO: 2454919 - protein, 5 aa, Entamoeba dispar
QNNQE

SEQ ID NO: 2454920 - protein, 5 aa, Entamoeba dispar
QNNQG

SEQ ID NO: 2454921 - protein, 5 aa, Entamoeba dispar
QNNQK

SEQ ID NO: 2454922 - protein, 13 aa, Entamoeba dispar
QNNQKGTNYLSPS

SEQ ID NO: 2454923 - protein, 12 aa, Entamoeba dispar
QNNQKTAKEIND

SEQ ID NO: 2454924 - protein, 13 aa, Entamoeba dispar
QNNQQLPQGYTPF

SEQ ID NO: 2454925 - protein, 17 aa, Entamoeba dispar
QNNQQTGFGNNTQQING

SEQ ID NO: 2454926 - protein, 9 aa, Entamoeba dispar
QNNQSATIS

SEQ ID NO: 2454927 - protein, 4 aa, Entamoeba dispar
QNNR

SEQ ID NO: 2454928 - protein, 14 aa, Entamoeba dispar
QNNSHELSSFQENK

SEQ ID NO: 2454929 - protein, 11 aa, Entamoeba dispar
QNNSRKEKGCK

SEQ ID NO: 2454930 - protein, 8 aa, Entamoeba dispar
QNNTDGNV

SEQ ID NO: 2454931 - protein, 18 aa, Entamoeba dispar
QNNTDNNAVYSEPSYEEF

SEQ ID NO: 2454932 - protein, 15 aa, Entamoeba dispar
QNNTELKKNLNQLKD

SEQ ID NO: 2454933 - protein, 11 aa, Entamoeba dispar
QNNTITGEETT

SEQ ID NO: 2454934 - protein, 13 aa, Entamoeba dispar
QNNTKVNSILSLF

SEQ ID NO: 2454935 - protein, 16 aa, Entamoeba dispar
QNNVPSQSQNVQPTQR

SEQ ID NO: 2454936 - protein, 5 aa, Entamoeba dispar
QNNWG

SEQ ID NO: 2454937 - protein, 7 aa, Entamoeba dispar
QNNYEES

SEQ ID NO: 2454938 - protein, 20 aa, Entamoeba dispar
QNPALRQQAEAQLTSFQNTD

SEQ ID NO: 2454939 - protein, 4 aa, Entamoeba dispar
QNPD

SEQ ID NO: 2454940 - protein, 5 aa, Entamoeba dispar
QNPDF

SEQ ID NO: 2454941 - protein, 8 aa, Entamoeba dispar
QNPEFEEK

SEQ ID NO: 2454942 - protein, 7 aa, Entamoeba dispar
QNPELRP

SEQ ID NO: 2454943 - protein, 7 aa, Entamoeba dispar
QNPENSD

SEQ ID NO: 2454944 - protein, 20 aa, Entamoeba dispar
QNPETLPLKDETNETNHPQI

SEQ ID NO: 2454945 - protein, 6 aa, Entamoeba dispar
QNPFDP

SEQ ID NO: 2454946 - protein, 9 aa, Entamoeba dispar
QNPGSQESL

SEQ ID NO: 2454947 - protein, 16 aa, Entamoeba dispar
QNPHRRISQPPYEITE

SEQ ID NO: 2454948 - protein, 4 aa, Entamoeba dispar
QNPK

SEQ ID NO: 2454949 - protein, 6 aa, Entamoeba dispar
QNPKDR

SEQ ID NO: 2454950 - protein, 4 aa, Entamoeba dispar
QNPL

SEQ ID NO: 2454951 - protein, 15 aa, Entamoeba dispar
QNPLGEGSGRKGLPQ

SEQ ID NO: 2454952 - protein, 9 aa, Entamoeba dispar
QNPLNTQKG

SEQ ID NO: 2454953 - protein, 19 aa, Entamoeba dispar
QNPMATQPLPKQLATQPLP

SEQ ID NO: 2454954 - protein, 13 aa, Entamoeba dispar
QNPNTPCPRDSSR

SEQ ID NO: 2454955 - protein, 5 aa, Entamoeba dispar
QNPPI

SEQ ID NO: 2454956 - protein, 11 aa, Entamoeba dispar
QNPPNTYGGRK

SEQ ID NO: 2454957 - protein, 7 aa, Entamoeba dispar
QNPPPVD

SEQ ID NO: 2454958 - protein, 5 aa, Entamoeba dispar
QNPQA

SEQ ID NO: 2454959 - protein, 12 aa, Entamoeba dispar
QNPQAQQPQYHQ

SEQ ID NO: 2454960 - protein, 4 aa, Entamoeba dispar
QNPS

SEQ ID NO: 2454961 - protein, 6 aa, Entamoeba dispar
QNPSEF

SEQ ID NO: 2454962 - protein, 7 aa, Entamoeba dispar
QNPSLHP

SEQ ID NO: 2454963 - protein, 9 aa, Entamoeba dispar
QNPSSNQFE

SEQ ID NO: 2454964 - protein, 23 aa, Entamoeba dispar
QNPSVKVKNPSPPNSSGKKTKKY

SEQ ID NO: 2454965 - protein, 6 aa, Entamoeba dispar
QNPSYN

SEQ ID NO: 2454966 - protein, 7 aa, Entamoeba dispar
QNPTALE

SEQ ID NO: 2454967 - protein, 6 aa, Entamoeba dispar
QNPTPY

SEQ ID NO: 2454968 - protein, 9 aa, Entamoeba dispar
QNPVNSVPN

SEQ ID NO: 2454969 - protein, 7 aa, Entamoeba dispar
QNPYGSN

SEQ ID NO: 2454970 - protein, 25 aa, Entamoeba dispar
QNPYTTKYIPDDDFNDYPKIPSSSI

SEQ ID NO: 2454971 - protein, 10 aa, Entamoeba dispar
QNQDSYNTYK

SEQ ID NO: 2454972 - protein, 7 aa, Entamoeba dispar
QNQEKKY

SEQ ID NO: 2454973 - protein, 10 aa, Entamoeba dispar
QNQEVSQDLN

SEQ ID NO: 2454974 - protein, 16 aa, Entamoeba dispar
QNQEYFTTQSNNNNDI

SEQ ID NO: 2454975 - protein, 10 aa, Entamoeba dispar
QNQGEETREK

SEQ ID NO: 2454976 - protein, 4 aa, Entamoeba dispar
QNQI

SEQ ID NO: 2454977 - protein, 5 aa, Entamoeba dispar
QNQIE

SEQ ID NO: 2454978 - protein, 15 aa, Entamoeba dispar
QNQIGPITTQDGLEK

SEQ ID NO: 2454979 - protein, 14 aa, Entamoeba dispar
QNQIGPVTTQDGLE

SEQ ID NO: 2454980 - protein, 7 aa, Entamoeba dispar
QNQPISN

SEQ ID NO: 2454981 - protein, 8 aa, Entamoeba dispar
QNQPTKAE

SEQ ID NO: 2454982 - protein, 10 aa, Entamoeba dispar
QNQQKEFPTF

SEQ ID NO: 2454983 - protein, 5 aa, Entamoeba dispar
QNQQN

SEQ ID NO: 2454984 - protein, 9 aa, Entamoeba dispar
QNQQSTKSL

SEQ ID NO: 2454985 - protein, 4 aa, Entamoeba dispar
QNQR

SEQ ID NO: 2454986 - protein, 11 aa, Entamoeba dispar
QNQSQSSSLEE

SEQ ID NO: 2454987 - protein, 4 aa, Entamoeba dispar
QNQY

SEQ ID NO: 2454988 - protein, 23 aa, Entamoeba dispar
QNQYKEKKQKYQKRKGSYEALRS

SEQ ID NO: 2454989 - protein, 7 aa, Entamoeba dispar
QNRNKLK

SEQ ID NO: 2454990 - protein, 6 aa, Entamoeba dispar
QNRNPP

SEQ ID NO: 2454991 - protein, 7 aa, Entamoeba dispar
QNRPYNA

SEQ ID NO: 2454992 - protein, 4 aa, Entamoeba dispar
QNRT

SEQ ID NO: 2454993 - protein, 6 aa, Entamoeba dispar
QNSDMT

SEQ ID NO: 2454994 - protein, 18 aa, Entamoeba dispar
QNSDTYDYGISKDGYKIA

SEQ ID NO: 2454995 - protein, 5 aa, Entamoeba dispar
QNSEI

SEQ ID NO: 2454996 - protein, 7 aa, Entamoeba dispar
QNSFQDI

SEQ ID NO: 2454997 - protein, 15 aa, Entamoeba dispar
QNSIEVGNCGDSPAY

SEQ ID NO: 2454998 - protein, 6 aa, Entamoeba dispar
QNSITD

SEQ ID NO: 2454999 - protein, 4 aa, Entamoeba dispar
QNSK

SEQ ID NO: 2455000 - protein, 5 aa, Entamoeba dispar
QNSKE

SEQ ID NO: 2455001 - protein, 16 aa, Entamoeba dispar
QNSKKLKKSHQYSSTN

SEQ ID NO: 2455002 - protein, 11 aa, Entamoeba dispar
QNSKRDPHSLK

SEQ ID NO: 2455003 - protein, 9 aa, Entamoeba dispar
QNSKSNKQC

SEQ ID NO: 2455004 - protein, 5 aa, Entamoeba dispar
QNSLK

SEQ ID NO: 2455005 - protein, 15 aa, Entamoeba dispar
QNSLSEIKKDETHKN

SEQ ID NO: 2455006 - protein, 6 aa, Entamoeba dispar
QNSNRH

SEQ ID NO: 2455007 - protein, 7 aa, Entamoeba dispar
QNSQPSA

SEQ ID NO: 2455008 - protein, 4 aa, Entamoeba dispar
QNSR

SEQ ID NO: 2455009 - protein, 6 aa, Entamoeba dispar
QNSRVK

SEQ ID NO: 2455010 - protein, 6 aa, Entamoeba dispar
QNSSIQ

SEQ ID NO: 2455011 - protein, 19 aa, Entamoeba dispar
QNSSKAQISLEKSNKFPEC

SEQ ID NO: 2455012 - protein, 11 aa, Entamoeba dispar
QNSTNQDKKDY

SEQ ID NO: 2455013 - protein, 6 aa, Entamoeba dispar
QNSTTI

SEQ ID NO: 2455014 - protein, 7 aa, Entamoeba dispar
QNSYTPY

SEQ ID NO: 2455015 - protein, 6 aa, Entamoeba dispar
QNTDTL

SEQ ID NO: 2455016 - protein, 15 aa, Entamoeba dispar
QNTETQDESERLSVS

SEQ ID NO: 2455017 - protein, 4 aa, Entamoeba dispar
QNTG

SEQ ID NO: 2455018 - protein, 7 aa, Entamoeba dispar
QNTGKSI

SEQ ID NO: 2455019 - protein, 5 aa, Entamoeba dispar
QNTNE

SEQ ID NO: 2455020 - protein, 8 aa, Entamoeba dispar
QNTPKNKI

SEQ ID NO: 2455021 - protein, 7 aa, Entamoeba dispar
QNTPPDN

SEQ ID NO: 2455022 - protein, 8 aa, Entamoeba dispar
QNTPQSTL

SEQ ID NO: 2455023 - protein, 17 aa, Entamoeba dispar
QNTQTTQSRNTETSTTI

SEQ ID NO: 2455024 - protein, 8 aa, Entamoeba dispar
QNTRRGER

SEQ ID NO: 2455025 - protein, 6 aa, Entamoeba dispar
QNTRTT

SEQ ID NO: 2455026 - protein, 20 aa, Entamoeba dispar
QNTSGETEKVKEIGKKIQEE

SEQ ID NO: 2455027 - protein, 19 aa, Entamoeba dispar
QNTSLNETLKSQKSKNVKF

SEQ ID NO: 2455028 - protein, 6 aa, Entamoeba dispar
QNTSNI

SEQ ID NO: 2455029 - protein, 9 aa, Entamoeba dispar
QNTSRSETI

SEQ ID NO: 2455030 - protein, 10 aa, Entamoeba dispar
QNTSVNQMTS

SEQ ID NO: 2455031 - protein, 6 aa, Entamoeba dispar
QNTTVD

SEQ ID NO: 2455032 - protein, 18 aa, Entamoeba dispar
QNTVNNNSAEKTNTEPIP

SEQ ID NO: 2455033 - protein, 19 aa, Entamoeba dispar
QNVEKSEEIANTQKSLNQQ

SEQ ID NO: 2455034 - protein, 10 aa, Entamoeba dispar
QNVETQTQIN

SEQ ID NO: 2455035 - protein, 6 aa, Entamoeba dispar
QNVPSI

SEQ ID NO: 2455036 - protein, 6 aa, Entamoeba dispar
QNVPSY

SEQ ID NO: 2455037 - protein, 81 aa, Entamoeba dispar
QNVQGKTKKQQQQQQTKGNKDEKQKQGKTKEEKKEGQQKVDGVPQLSNKELKALKKQQKHDKKVAKLGENIQKSKTGESQI

SEQ ID NO: 2455038 - protein, 27 aa, Entamoeba dispar
QNVQKLEQARHKRNQQAQQVLMAGGKL

SEQ ID NO: 2455039 - protein, 8 aa, Entamoeba dispar
QNVSTTRD

SEQ ID NO: 2455040 - protein, 5 aa, Entamoeba dispar
QNYDS

SEQ ID NO: 2455041 - protein, 11 aa, Entamoeba dispar
QNYELAPTYPS

SEQ ID NO: 2455042 - protein, 6 aa, Entamoeba dispar
QNYGTA

SEQ ID NO: 2455043 - protein, 8 aa, Entamoeba dispar
QNYPKSKP

SEQ ID NO: 2455044 - protein, 6 aa, Entamoeba dispar
QNYQNS

SEQ ID NO: 2455045 - protein, 21 aa, Entamoeba dispar
QNYQQPNYNYPQPPQQNYSYY

SEQ ID NO: 2455046 - protein, 10 aa, Entamoeba dispar
QNYSAPNNRK

SEQ ID NO: 2455047 - protein, 19 aa, Entamoeba dispar
QPAKISAKKIKKTTPSTRL

SEQ ID NO: 2455048 - protein, 9 aa, Entamoeba dispar
QPAKKSITT

SEQ ID NO: 2455049 - protein, 25 aa, Entamoeba dispar
QPALKPKRKRGRSVAEISQEPTNYN

SEQ ID NO: 2455050 - protein, 26 aa, Entamoeba dispar
QPALQSKNISIQENTTTTYTPDSNYY

SEQ ID NO: 2455051 - protein, 27 aa, Entamoeba dispar
QPALTSTRVDPRKSLDSFDDEKQATQL

SEQ ID NO: 2455052 - protein, 9 aa, Entamoeba dispar
QPANGGLGT

SEQ ID NO: 2455053 - protein, 8 aa, Entamoeba dispar
QPANRPSF

SEQ ID NO: 2455054 - protein, 11 aa, Entamoeba dispar
QPAQGDELAKK

SEQ ID NO: 2455055 - protein, 34 aa, Entamoeba dispar
QPCKESSVDEKIPTRKVTKQDESKKKRLSRVFSS

SEQ ID NO: 2455056 - protein, 5 aa, Entamoeba dispar
QPCYK

SEQ ID NO: 2455057 - protein, 5 aa, Entamoeba dispar
QPDDQ

SEQ ID NO: 2455058 - protein, 9 aa, Entamoeba dispar
QPDKQIKEN

SEQ ID NO: 2455059 - protein, 12 aa, Entamoeba dispar
QPDLPNDENGFS

SEQ ID NO: 2455060 - protein, 5 aa, Entamoeba dispar
QPDLS

SEQ ID NO: 2455061 - protein, 5 aa, Entamoeba dispar
QPDLY

SEQ ID NO: 2455062 - protein, 7 aa, Entamoeba dispar
QPDSLSE

SEQ ID NO: 2455063 - protein, 7 aa, Entamoeba dispar
QPDSQDL

SEQ ID NO: 2455064 - protein, 8 aa, Entamoeba dispar
QPDVPAQP

SEQ ID NO: 2455065 - protein, 4 aa, Entamoeba dispar
QPEA

SEQ ID NO: 2455066 - protein, 5 aa, Entamoeba dispar
QPEED

SEQ ID NO: 2455067 - protein, 6 aa, Entamoeba dispar
QPEGMK

SEQ ID NO: 2455068 - protein, 5 aa, Entamoeba dispar
QPEKI

SEQ ID NO: 2455069 - protein, 6 aa, Entamoeba dispar
QPEKKE

SEQ ID NO: 2455070 - protein, 21 aa, Entamoeba dispar
QPEMNSHEKGSEVNEPVTKKL

SEQ ID NO: 2455071 - protein, 4 aa, Entamoeba dispar
QPER

SEQ ID NO: 2455072 - protein, 5 aa, Entamoeba dispar
QPEVN

SEQ ID NO: 2455073 - protein, 15 aa, Entamoeba dispar
QPEYPTQPQTNEKRT

SEQ ID NO: 2455074 - protein, 15 aa, Entamoeba dispar
QPFEGKDNTRSENEI

SEQ ID NO: 2455075 - protein, 5 aa, Entamoeba dispar
QPFKP

SEQ ID NO: 2455076 - protein, 7 aa, Entamoeba dispar
QPFPPFT

SEQ ID NO: 2455077 - protein, 5 aa, Entamoeba dispar
QPFPS

SEQ ID NO: 2455078 - protein, 6 aa, Entamoeba dispar
QPGDGK

SEQ ID NO: 2455079 - protein, 10 aa, Entamoeba dispar
QPGEPQIPTD

SEQ ID NO: 2455080 - protein, 5 aa, Entamoeba dispar
QPGIA

SEQ ID NO: 2455081 - protein, 6 aa, Entamoeba dispar
QPGIER

SEQ ID NO: 2455082 - protein, 5 aa, Entamoeba dispar
QPGII

SEQ ID NO: 2455083 - protein, 8 aa, Entamoeba dispar
QPGKTTLQ

SEQ ID NO: 2455084 - protein, 5 aa, Entamoeba dispar
QPGNC

SEQ ID NO: 2455085 - protein, 7 aa, Entamoeba dispar
QPGQMAT

SEQ ID NO: 2455086 - protein, 9 aa, Entamoeba dispar
QPGTKDKET

SEQ ID NO: 2455087 - protein, 8 aa, Entamoeba dispar
QPGTLGSK

SEQ ID NO: 2455088 - protein, 11 aa, Entamoeba dispar
QPHPSSTSVPL

SEQ ID NO: 2455089 - protein, 12 aa, Entamoeba dispar
QPIALGNSQEVQ

SEQ ID NO: 2455090 - protein, 4 aa, Entamoeba dispar
QPID

SEQ ID NO: 2455091 - protein, 5 aa, Entamoeba dispar
QPIDT

SEQ ID NO: 2455092 - protein, 15 aa, Entamoeba dispar
QPIEGCNNTKSEEEI

SEQ ID NO: 2455093 - protein, 5 aa, Entamoeba dispar
QPIEK

SEQ ID NO: 2455094 - protein, 30 aa, Entamoeba dispar
QPIGTIKETTNEVKEIGRTKNYEDVKTKRR

SEQ ID NO: 2455095 - protein, 4 aa, Entamoeba dispar
QPIK

SEQ ID NO: 2455096 - protein, 6 aa, Entamoeba dispar
QPIKDS

SEQ ID NO: 2455097 - protein, 24 aa, Entamoeba dispar
QPINKTKTKELINEEEKIKNERKS

SEQ ID NO: 2455098 - protein, 6 aa, Entamoeba dispar
QPINPS

SEQ ID NO: 2455099 - protein, 20 aa, Entamoeba dispar
QPINREGMSDKQYNRSKESW

SEQ ID NO: 2455100 - protein, 16 aa, Entamoeba dispar
QPIPLTTTSQELETNP

SEQ ID NO: 2455101 - protein, 5 aa, Entamoeba dispar
QPIQK

SEQ ID NO: 2455102 - protein, 5 aa, Entamoeba dispar
QPIQP

SEQ ID NO: 2455103 - protein, 14 aa, Entamoeba dispar
QPIRPRPTRLSNNP

SEQ ID NO: 2455104 - protein, 9 aa, Entamoeba dispar
QPISNQPIP

SEQ ID NO: 2455105 - protein, 7 aa, Entamoeba dispar
QPISRKS

SEQ ID NO: 2455106 - protein, 9 aa, Entamoeba dispar
QPISRNGIT

SEQ ID NO: 2455107 - protein, 12 aa, Entamoeba dispar
QPISSNQSETYR

SEQ ID NO: 2455108 - protein, 4 aa, Entamoeba dispar
QPIT

SEQ ID NO: 2455109 - protein, 19 aa, Entamoeba dispar
QPITAKPSLMETTPSPHTR

SEQ ID NO: 2455110 - protein, 17 aa, Entamoeba dispar
QPITQEQNECGQRIEEG

SEQ ID NO: 2455111 - protein, 48 aa, Entamoeba dispar
QPKAVEEADEKKRKKEQEEIQKQRRKEEKEREKQAKKQKKEEKKNLKK

SEQ ID NO: 2455112 - protein, 11 aa, Entamoeba dispar
QPKEEQTENQL

SEQ ID NO: 2455113 - protein, 5 aa, Entamoeba dispar
QPKEV

SEQ ID NO: 2455114 - protein, 9 aa, Entamoeba dispar
QPKKEEGFT

SEQ ID NO: 2455115 - protein, 6 aa, Entamoeba dispar
QPKNLK

SEQ ID NO: 2455116 - protein, 6 aa, Entamoeba dispar
QPKPVE

SEQ ID NO: 2455117 - protein, 10 aa, Entamoeba dispar
QPKQKEESVY

SEQ ID NO: 2455118 - protein, 18 aa, Entamoeba dispar
QPKQSLSEEDPFADILNK

SEQ ID NO: 2455119 - protein, 20 aa, Entamoeba dispar
QPKTKLDKDEKSKKKPSLKL

SEQ ID NO: 2455120 - protein, 8 aa, Entamoeba dispar
QPKTSPNF

SEQ ID NO: 2455121 - protein, 11 aa, Entamoeba dispar
QPLKGNPSNSG

SEQ ID NO: 2455122 - protein, 11 aa, Entamoeba dispar
QPLLDKSKESL

SEQ ID NO: 2455123 - protein, 9 aa, Entamoeba dispar
QPLNQNKSV

SEQ ID NO: 2455124 - protein, 9 aa, Entamoeba dispar
QPLNTPTRS

SEQ ID NO: 2455125 - protein, 6 aa, Entamoeba dispar
QPLPDA

SEQ ID NO: 2455126 - protein, 36 aa, Entamoeba dispar
QPLPQQKMNKQQPPSKIQEQQKPDTILKKQSSKRLI

SEQ ID NO: 2455127 - protein, 4 aa, Entamoeba dispar
QPLQ

SEQ ID NO: 2455128 - protein, 7 aa, Entamoeba dispar
QPLRQKR

SEQ ID NO: 2455129 - protein, 8 aa, Entamoeba dispar
QPLSSPIN

SEQ ID NO: 2455130 - protein, 5 aa, Entamoeba dispar
QPLTT

SEQ ID NO: 2455131 - protein, 7 aa, Entamoeba dispar
QPMEKDD

SEQ ID NO: 2455132 - protein, 4 aa, Entamoeba dispar
QPMP

SEQ ID NO: 2455133 - protein, 5 aa, Entamoeba dispar
QPMTD

SEQ ID NO: 2455134 - protein, 11 aa, Entamoeba dispar
QPNEGNINERK

SEQ ID NO: 2455135 - protein, 6 aa, Entamoeba dispar
QPNEKR

SEQ ID NO: 2455136 - protein, 7 aa, Entamoeba dispar
QPNESVE

SEQ ID NO: 2455137 - protein, 5 aa, Entamoeba dispar
QPNGD

SEQ ID NO: 2455138 - protein, 10 aa, Entamoeba dispar
QPNGPTQIPS

SEQ ID NO: 2455139 - protein, 16 aa, Entamoeba dispar
QPNITPTECPIPEAES

SEQ ID NO: 2455140 - protein, 10 aa, Entamoeba dispar
QPNNFGKGKK

SEQ ID NO: 2455141 - protein, 13 aa, Entamoeba dispar
QPNNQTQKPEIEI

SEQ ID NO: 2455142 - protein, 9 aa, Entamoeba dispar
QPNPERDRK

SEQ ID NO: 2455143 - protein, 29 aa, Entamoeba dispar
QPNPKQWKGEKGVKEGKRTRAVKPGKVVI

SEQ ID NO: 2455144 - protein, 7 aa, Entamoeba dispar
QPNPSNY

SEQ ID NO: 2455145 - protein, 5 aa, Entamoeba dispar
QPNQS

SEQ ID NO: 2455146 - protein, 6 aa, Entamoeba dispar
QPNQTQ

SEQ ID NO: 2455147 - protein, 16 aa, Entamoeba dispar
QPNRNQRRSEEKEIKR

SEQ ID NO: 2455148 - protein, 11 aa, Entamoeba dispar
QPNRRKTRGFY

SEQ ID NO: 2455149 - protein, 4 aa, Entamoeba dispar
QPNS

SEQ ID NO: 2455150 - protein, 13 aa, Entamoeba dispar
QPNSKNNDVEGAV

SEQ ID NO: 2455151 - protein, 10 aa, Entamoeba dispar
QPNSTTPQKM

SEQ ID NO: 2455152 - protein, 7 aa, Entamoeba dispar
QPNTTPL

SEQ ID NO: 2455153 - protein, 6 aa, Entamoeba dispar
QPNVES

SEQ ID NO: 2455154 - protein, 4 aa, Entamoeba dispar
QPNY

SEQ ID NO: 2455155 - protein, 4 aa, Entamoeba dispar
QPPF

SEQ ID NO: 2455156 - protein, 4 aa, Entamoeba dispar
QPPG

SEQ ID NO: 2455157 - protein, 4 aa, Entamoeba dispar
QPPI

SEQ ID NO: 2455158 - protein, 7 aa, Entamoeba dispar
QPPIPSI

SEQ ID NO: 2455159 - protein, 6 aa, Entamoeba dispar
QPPKIP

SEQ ID NO: 2455160 - protein, 6 aa, Entamoeba dispar
QPPLRQ

SEQ ID NO: 2455161 - protein, 6 aa, Entamoeba dispar
QPPNTS

SEQ ID NO: 2455162 - protein, 26 aa, Entamoeba dispar
QPPPPPPIDNSKIPNVSTPSTSGRGD

SEQ ID NO: 2455163 - protein, 5 aa, Entamoeba dispar
QPPQE

SEQ ID NO: 2455164 - protein, 6 aa, Entamoeba dispar
QPPSKI

SEQ ID NO: 2455165 - protein, 6 aa, Entamoeba dispar
QPPSLK

SEQ ID NO: 2455166 - protein, 11 aa, Entamoeba dispar
QPPSLQQSQQP

SEQ ID NO: 2455167 - protein, 31 aa, Entamoeba dispar
QPPSTKRKEPKEEKEEKEEKPEIEKEENDYP

SEQ ID NO: 2455168 - protein, 31 aa, Entamoeba dispar
QPPSTKRKEPNEEKEEKEEKPEIEKEENDYP

SEQ ID NO: 2455169 - protein, 31 aa, Entamoeba dispar
QPPSTKRKEPTEEKEQKEEKPEIEKEENDYP

SEQ ID NO: 2455170 - protein, 6 aa, Entamoeba dispar
QPPTAK

SEQ ID NO: 2455171 - protein, 31 aa, Entamoeba dispar
QPPTTKRKEPIEEKEQKEEKPEIEKEENDYP

SEQ ID NO: 2455172 - protein, 6 aa, Entamoeba dispar
QPPTVN

SEQ ID NO: 2455173 - protein, 6 aa, Entamoeba dispar
QPPVYH

SEQ ID NO: 2455174 - protein, 7 aa, Entamoeba dispar
QPPYNHN

SEQ ID NO: 2455175 - protein, 5 aa, Entamoeba dispar
QPQAY

SEQ ID NO: 2455176 - protein, 17 aa, Entamoeba dispar
QPQDKAPAQIILGDTLP

SEQ ID NO: 2455177 - protein, 7 aa, Entamoeba dispar
QPQEATK

SEQ ID NO: 2455178 - protein, 24 aa, Entamoeba dispar
QPQHQYQSNSSYQQPVTNKLPYSQ

SEQ ID NO: 2455179 - protein, 5 aa, Entamoeba dispar
QPQIE

SEQ ID NO: 2455180 - protein, 4 aa, Entamoeba dispar
QPQK

SEQ ID NO: 2455181 - protein, 8 aa, Entamoeba dispar
QPQLPKRI

SEQ ID NO: 2455182 - protein, 17 aa, Entamoeba dispar
QPQLSRGSSQIIGQSST

SEQ ID NO: 2455183 - protein, 18 aa, Entamoeba dispar
QPQNITSASTVSYNTSQS

SEQ ID NO: 2455184 - protein, 5 aa, Entamoeba dispar
QPQPI

SEQ ID NO: 2455185 - protein, 12 aa, Entamoeba dispar
QPQQHPARDAQD

SEQ ID NO: 2455186 - protein, 5 aa, Entamoeba dispar
QPRQI

SEQ ID NO: 2455187 - protein, 4 aa, Entamoeba dispar
QPRR

SEQ ID NO: 2455188 - protein, 6 aa, Entamoeba dispar
QPRYDD

SEQ ID NO: 2455189 - protein, 12 aa, Entamoeba dispar
QPSANKYKNLNE

SEQ ID NO: 2455190 - protein, 9 aa, Entamoeba dispar
QPSEDQSNS

SEQ ID NO: 2455191 - protein, 16 aa, Entamoeba dispar
QPSEEEKKEYVEGDER

SEQ ID NO: 2455192 - protein, 5 aa, Entamoeba dispar
QPSEL

SEQ ID NO: 2455193 - protein, 8 aa, Entamoeba dispar
QPSELPSL

SEQ ID NO: 2455194 - protein, 5 aa, Entamoeba dispar
QPSHS

SEQ ID NO: 2455195 - protein, 4 aa, Entamoeba dispar
QPSI

SEQ ID NO: 2455196 - protein, 14 aa, Entamoeba dispar
QPSINNPPPQYTDT

SEQ ID NO: 2455197 - protein, 15 aa, Entamoeba dispar
QPSKKPNTPTIKKDN

SEQ ID NO: 2455198 - protein, 5 aa, Entamoeba dispar
QPSLN

SEQ ID NO: 2455199 - protein, 5 aa, Entamoeba dispar
QPSMI

SEQ ID NO: 2455200 - protein, 6 aa, Entamoeba dispar
QPSNDW

SEQ ID NO: 2455201 - protein, 14 aa, Entamoeba dispar
QPSNESIPYGSNTK

SEQ ID NO: 2455202 - protein, 10 aa, Entamoeba dispar
QPSSKELKQI

SEQ ID NO: 2455203 - protein, 11 aa, Entamoeba dispar
QPSSKREGFTT

SEQ ID NO: 2455204 - protein, 7 aa, Entamoeba dispar
QPSSNDQ

SEQ ID NO: 2455205 - protein, 14 aa, Entamoeba dispar
QPSSNNIPTPTPVI

SEQ ID NO: 2455206 - protein, 17 aa, Entamoeba dispar
QPSSSNNTQTKSPSSFD

SEQ ID NO: 2455207 - protein, 22 aa, Entamoeba dispar
QPSTLEDKKRTDVSQPISKPLQ

SEQ ID NO: 2455208 - protein, 8 aa, Entamoeba dispar
QPSTQNNE

SEQ ID NO: 2455209 - protein, 11 aa, Entamoeba dispar
QPSTSSLYYPD

SEQ ID NO: 2455210 - protein, 8 aa, Entamoeba dispar
QPSYPSST

SEQ ID NO: 2455211 - protein, 4 aa, Entamoeba dispar
QPTA

SEQ ID NO: 2455212 - protein, 5 aa, Entamoeba dispar
QPTDD

SEQ ID NO: 2455213 - protein, 10 aa, Entamoeba dispar
QPTERTQNEM

SEQ ID NO: 2455214 - protein, 9 aa, Entamoeba dispar
QPTIPGTKN

SEQ ID NO: 2455215 - protein, 6 aa, Entamoeba dispar
QPTNLN

SEQ ID NO: 2455216 - protein, 8 aa, Entamoeba dispar
QPTQPPLI

SEQ ID NO: 2455217 - protein, 10 aa, Entamoeba dispar
QPTQSSHRRK

SEQ ID NO: 2455218 - protein, 6 aa, Entamoeba dispar
QPTQVP

SEQ ID NO: 2455219 - protein, 5 aa, Entamoeba dispar
QPTSF

SEQ ID NO: 2455220 - protein, 5 aa, Entamoeba dispar
QPTSM

SEQ ID NO: 2455221 - protein, 11 aa, Entamoeba dispar
QPTSSTLPIQQ

SEQ ID NO: 2455222 - protein, 6 aa, Entamoeba dispar
QPTSSY

SEQ ID NO: 2455223 - protein, 21 aa, Entamoeba dispar
QPTTTGPRSSQISTSSPNGFL

SEQ ID NO: 2455224 - protein, 4 aa, Entamoeba dispar
QPTY

SEQ ID NO: 2455225 - protein, 9 aa, Entamoeba dispar
QPVLQEDKI

SEQ ID NO: 2455226 - protein, 18 aa, Entamoeba dispar
QPVRGNSPHKKMESLPDI

SEQ ID NO: 2455227 - protein, 31 aa, Entamoeba dispar
QPVSTKPLTSQDNLKTAREKLKEKMSGSQQF

SEQ ID NO: 2455228 - protein, 26 aa, Entamoeba dispar
QPVSTKPLTSQDNLKTAREKLSEKMS

SEQ ID NO: 2455229 - protein, 5 aa, Entamoeba dispar
QPYQK

SEQ ID NO: 2455230 - protein, 5 aa, Entamoeba dispar
QPYQV

SEQ ID NO: 2455231 - protein, 5 aa, Entamoeba dispar
QPYRK

SEQ ID NO: 2455232 - protein, 4 aa, Entamoeba dispar
QPYS

SEQ ID NO: 2455233 - protein, 32 aa, Entamoeba dispar
QPYSSASKPPPRPINRNNQPLSKSSGSTENTP

SEQ ID NO: 2455234 - protein, 4 aa, Entamoeba dispar
QQAD

SEQ ID NO: 2455235 - protein, 7 aa, Entamoeba dispar
QQAEKAK

SEQ ID NO: 2455236 - protein, 22 aa, Entamoeba dispar
QQAEQKAEQQRHEQTQTSKNER

SEQ ID NO: 2455237 - protein, 13 aa, Entamoeba dispar
QQAKNELSKRLED

SEQ ID NO: 2455238 - protein, 10 aa, Entamoeba dispar
QQAKNSEFTS

SEQ ID NO: 2455239 - protein, 9 aa, Entamoeba dispar
QQAKRDRTN

SEQ ID NO: 2455240 - protein, 7 aa, Entamoeba dispar
QQAMDGT

SEQ ID NO: 2455241 - protein, 8 aa, Entamoeba dispar
QQANQNTL

SEQ ID NO: 2455242 - protein, 9 aa, Entamoeba dispar
QQAPQQGIQ

SEQ ID NO: 2455243 - protein, 29 aa, Entamoeba dispar
QQAPSSNIQGPTTNFGLGTSQTNNTNFGN

SEQ ID NO: 2455244 - protein, 6 aa, Entamoeba dispar
QQCQQR

SEQ ID NO: 2455245 - protein, 10 aa, Entamoeba dispar
QQCQQRHSEI

SEQ ID NO: 2455246 - protein, 17 aa, Entamoeba dispar
QQDAKQRENIYEKFSSI

SEQ ID NO: 2455247 - protein, 8 aa, Entamoeba dispar
QQDENENY

SEQ ID NO: 2455248 - protein, 9 aa, Entamoeba dispar
QQDERTTTI

SEQ ID NO: 2455249 - protein, 5 aa, Entamoeba dispar
QQDNS

SEQ ID NO: 2455250 - protein, 9 aa, Entamoeba dispar
QQDPNTIRD

SEQ ID NO: 2455251 - protein, 8 aa, Entamoeba dispar
QQDRIKAA

SEQ ID NO: 2455252 - protein, 4 aa, Entamoeba dispar
QQDS

SEQ ID NO: 2455253 - protein, 8 aa, Entamoeba dispar
QQDTFNSL

SEQ ID NO: 2455254 - protein, 5 aa, Entamoeba dispar
QQEAY

SEQ ID NO: 2455255 - protein, 4 aa, Entamoeba dispar
QQED

SEQ ID NO: 2455256 - protein, 11 aa, Entamoeba dispar
QQEEDEKEENY

SEQ ID NO: 2455257 - protein, 13 aa, Entamoeba dispar
QQEEEKKRIEEEI

SEQ ID NO: 2455258 - protein, 16 aa, Entamoeba dispar
QQEEEKKRRLLEENKG

SEQ ID NO: 2455259 - protein, 10 aa, Entamoeba dispar
QQEEIDERDG

SEQ ID NO: 2455260 - protein, 18 aa, Entamoeba dispar
QQEEIQESPRPKTPEEFN

SEQ ID NO: 2455261 - protein, 6 aa, Entamoeba dispar
QQEEKP

SEQ ID NO: 2455262 - protein, 16 aa, Entamoeba dispar
QQEEKYKKIKQNEKNK

SEQ ID NO: 2455263 - protein, 5 aa, Entamoeba dispar
QQEEL

SEQ ID NO: 2455264 - protein, 17 aa, Entamoeba dispar
QQEESTQSLNQDERDAI

SEQ ID NO: 2455265 - protein, 7 aa, Entamoeba dispar
QQEGKIK

SEQ ID NO: 2455266 - protein, 4 aa, Entamoeba dispar
QQEI

SEQ ID NO: 2455267 - protein, 12 aa, Entamoeba dispar
QQEIKKETQRKE

SEQ ID NO: 2455268 - protein, 10 aa, Entamoeba dispar
QQEINSKNEY

SEQ ID NO: 2455269 - protein, 10 aa, Entamoeba dispar
QQELKNKEEE

SEQ ID NO: 2455270 - protein, 30 aa, Entamoeba dispar
QQENIQKNNLQNLQKERDEIIEKNKKSIEH

SEQ ID NO: 2455271 - protein, 15 aa, Entamoeba dispar
QQENKALQQKTTSRQ

SEQ ID NO: 2455272 - protein, 7 aa, Entamoeba dispar
QQENSQL

SEQ ID NO: 2455273 - protein, 20 aa, Entamoeba dispar
QQENSSSVERCSDEEITDLK

SEQ ID NO: 2455274 - protein, 6 aa, Entamoeba dispar
QQEQSL

SEQ ID NO: 2455275 - protein, 13 aa, Entamoeba dispar
QQEQSYDTQTLPQ

SEQ ID NO: 2455276 - protein, 6 aa, Entamoeba dispar
QQERSL

SEQ ID NO: 2455277 - protein, 6 aa, Entamoeba dispar
QQESCN

SEQ ID NO: 2455278 - protein, 6 aa, Entamoeba dispar
QQESIA

SEQ ID NO: 2455279 - protein, 7 aa, Entamoeba dispar
QQESVKS

SEQ ID NO: 2455280 - protein, 9 aa, Entamoeba dispar
QQESYEKPS

SEQ ID NO: 2455281 - protein, 7 aa, Entamoeba dispar
QQEVERD

SEQ ID NO: 2455282 - protein, 6 aa, Entamoeba dispar
QQFEKE

SEQ ID NO: 2455283 - protein, 6 aa, Entamoeba dispar
QQFKTK

SEQ ID NO: 2455284 - protein, 5 aa, Entamoeba dispar
QQFNQ

SEQ ID NO: 2455285 - protein, 5 aa, Entamoeba dispar
QQFTT

SEQ ID NO: 2455286 - protein, 17 aa, Entamoeba dispar
QQGEDSVDQIESEKKKI

SEQ ID NO: 2455287 - protein, 8 aa, Entamoeba dispar
QQGNNEEA

SEQ ID NO: 2455288 - protein, 7 aa, Entamoeba dispar
QQGNRNK

SEQ ID NO: 2455289 - protein, 9 aa, Entamoeba dispar
QQGTEPKSA

SEQ ID NO: 2455290 - protein, 20 aa, Entamoeba dispar
QQGTYPAQDNVYESKPIKRY

SEQ ID NO: 2455291 - protein, 12 aa, Entamoeba dispar
QQGYNKPSGIQQ

SEQ ID NO: 2455292 - protein, 5 aa, Entamoeba dispar
QQHKE

SEQ ID NO: 2455293 - protein, 4 aa, Entamoeba dispar
QQHN

SEQ ID NO: 2455294 - protein, 10 aa, Entamoeba dispar
QQHQQQKKTE

SEQ ID NO: 2455295 - protein, 13 aa, Entamoeba dispar
QQIDTQKKEETEM

SEQ ID NO: 2455296 - protein, 5 aa, Entamoeba dispar
QQIEF

SEQ ID NO: 2455297 - protein, 5 aa, Entamoeba dispar
QQIGA

SEQ ID NO: 2455298 - protein, 7 aa, Entamoeba dispar
QQIGSRK

SEQ ID NO: 2455299 - protein, 8 aa, Entamoeba dispar
QQIHNEDE

SEQ ID NO: 2455300 - protein, 31 aa, Entamoeba dispar
QQIKEETEKNIRSQVEEEWKNENEELKQKEV

SEQ ID NO: 2455301 - protein, 5 aa, Entamoeba dispar
QQIKR

SEQ ID NO: 2455302 - protein, 12 aa, Entamoeba dispar
QQINKPELEKIP

SEQ ID NO: 2455303 - protein, 5 aa, Entamoeba dispar
QQIPK

SEQ ID NO: 2455304 - protein, 6 aa, Entamoeba dispar
QQIPNE

SEQ ID NO: 2455305 - protein, 7 aa, Entamoeba dispar
QQIPSNG

SEQ ID NO: 2455306 - protein, 12 aa, Entamoeba dispar
QQIPTDTSSTDN

SEQ ID NO: 2455307 - protein, 17 aa, Entamoeba dispar
QQIQNTENKIKEPPEVT

SEQ ID NO: 2455308 - protein, 37 aa, Entamoeba dispar
QQIQTQNKEQEQQKRLETLKANSASNKRNGLNLPSSF

SEQ ID NO: 2455309 - protein, 7 aa, Entamoeba dispar
QQIRETQ

SEQ ID NO: 2455310 - protein, 8 aa, Entamoeba dispar
QQISEEQK

SEQ ID NO: 2455311 - protein, 16 aa, Entamoeba dispar
QQISNEDRTKENKEEN

SEQ ID NO: 2455312 - protein, 7 aa, Entamoeba dispar
QQISPQR

SEQ ID NO: 2455313 - protein, 5 aa, Entamoeba dispar
QQITT

SEQ ID NO: 2455314 - protein, 10 aa, Entamoeba dispar
QQKDEKIKEL

SEQ ID NO: 2455315 - protein, 15 aa, Entamoeba dispar
QQKDEQQNVSDGSEL

SEQ ID NO: 2455316 - protein, 24 aa, Entamoeba dispar
QQKDSIQSKVKEEDKNEKIKKETT

SEQ ID NO: 2455317 - protein, 4 aa, Entamoeba dispar
QQKE

SEQ ID NO: 2455318 - protein, 6 aa, Entamoeba dispar
QQKEIE

SEQ ID NO: 2455319 - protein, 8 aa, Entamoeba dispar
QQKEKPDV

SEQ ID NO: 2455320 - protein, 18 aa, Entamoeba dispar
QQKGESFVSAAEGQELAE

SEQ ID NO: 2455321 - protein, 32 aa, Entamoeba dispar
QQKKRRQRKYSEYSETPRKGTDTIKDDSEEKH

SEQ ID NO: 2455322 - protein, 5 aa, Entamoeba dispar
QQKND

SEQ ID NO: 2455323 - protein, 8 aa, Entamoeba dispar
QQKNRQVR

SEQ ID NO: 2455324 - protein, 6 aa, Entamoeba dispar
QQKPNE

SEQ ID NO: 2455325 - protein, 8 aa, Entamoeba dispar
QQKPVQKI

SEQ ID NO: 2455326 - protein, 10 aa, Entamoeba dispar
QQKQKEVDRT

SEQ ID NO: 2455327 - protein, 8 aa, Entamoeba dispar
QQKRASLE

SEQ ID NO: 2455328 - protein, 5 aa, Entamoeba dispar
QQKSI

SEQ ID NO: 2455329 - protein, 8 aa, Entamoeba dispar
QQKTTNEL

SEQ ID NO: 2455330 - protein, 16 aa, Entamoeba dispar
QQKVDDSGINNEPLQQ

SEQ ID NO: 2455331 - protein, 7 aa, Entamoeba dispar
QQKYTIP

SEQ ID NO: 2455332 - protein, 45 aa, Entamoeba dispar
QQLDETQKEKEEETKKYEEVKGQIDNAHQQVESIKKETEKQINQM

SEQ ID NO: 2455333 - protein, 5 aa, Entamoeba dispar
QQLDG

SEQ ID NO: 2455334 - protein, 11 aa, Entamoeba dispar
QQLKKKQKRHY

SEQ ID NO: 2455335 - protein, 17 aa, Entamoeba dispar
QQLNKQTPSVSKNKRIN

SEQ ID NO: 2455336 - protein, 9 aa, Entamoeba dispar
QQLNNGMGG

SEQ ID NO: 2455337 - protein, 9 aa, Entamoeba dispar
QQLPQNQRI

SEQ ID NO: 2455338 - protein, 9 aa, Entamoeba dispar
QQLPQQQKG

SEQ ID NO: 2455339 - protein, 4 aa, Entamoeba dispar
QQLS

SEQ ID NO: 2455340 - protein, 5 aa, Entamoeba dispar
QQLSK

SEQ ID NO: 2455341 - protein, 6 aa, Entamoeba dispar
QQLVGE

SEQ ID NO: 2455342 - protein, 4 aa, Entamoeba dispar
QQMA

SEQ ID NO: 2455343 - protein, 5 aa, Entamoeba dispar
QQMRT

SEQ ID NO: 2455344 - protein, 20 aa, Entamoeba dispar
QQNASTESNDEKQENETNDF

SEQ ID NO: 2455345 - protein, 5 aa, Entamoeba dispar
QQNAT

SEQ ID NO: 2455346 - protein, 10 aa, Entamoeba dispar
QQNDASVNNI

SEQ ID NO: 2455347 - protein, 5 aa, Entamoeba dispar
QQNDF

SEQ ID NO: 2455348 - protein, 6 aa, Entamoeba dispar
QQNDFI

SEQ ID NO: 2455349 - protein, 29 aa, Entamoeba dispar
QQNEFRSKKGVSPIYDTSKGCVIPVKYVD

SEQ ID NO: 2455350 - protein, 32 aa, Entamoeba dispar
QQNEIEKEKKAKKEEKDIKQPEIQKKRKTVGK

SEQ ID NO: 2455351 - protein, 8 aa, Entamoeba dispar
QQNHPEKL

SEQ ID NO: 2455352 - protein, 5 aa, Entamoeba dispar
QQNID

SEQ ID NO: 2455353 - protein, 9 aa, Entamoeba dispar
QQNKNSSFN

SEQ ID NO: 2455354 - protein, 7 aa, Entamoeba dispar
QQNKRGK

SEQ ID NO: 2455355 - protein, 9 aa, Entamoeba dispar
QQNKRSVDT

SEQ ID NO: 2455356 - protein, 5 aa, Entamoeba dispar
QQNKT

SEQ ID NO: 2455357 - protein, 5 aa, Entamoeba dispar
QQNKY

SEQ ID NO: 2455358 - protein, 18 aa, Entamoeba dispar
QQNNKNSRNGTKTLSRNI

SEQ ID NO: 2455359 - protein, 27 aa, Entamoeba dispar
QQNNTIYNTYSEKNEEEDNDQDSDDEL

SEQ ID NO: 2455360 - protein, 7 aa, Entamoeba dispar
QQNNTYK

SEQ ID NO: 2455361 - protein, 160 aa, Entamoeba dispar
QQNPFGTPNTTTQPQFGTTPSFGGFNTNQTSGTTNPFNSTGNSTSGTNNPFNTTNNTTNSTTNPFNTNTNTTNNPFNTNTNTTTNPFNTTTTGTTTNPFNTNITSTNNPFNTTTSITGTTTTTNNPFSTNNTTTGTTTGTNTTGTTTTNNPFSTTTGTTN

SEQ ID NO: 2455362 - protein, 7 aa, Entamoeba dispar
QQNQFRE

SEQ ID NO: 2455363 - protein, 6 aa, Entamoeba dispar
QQNQQL

SEQ ID NO: 2455364 - protein, 18 aa, Entamoeba dispar
QQNQQTASQINELSNRPL

SEQ ID NO: 2455365 - protein, 9 aa, Entamoeba dispar
QQNSEERGD

SEQ ID NO: 2455366 - protein, 5 aa, Entamoeba dispar
QQNSK

SEQ ID NO: 2455367 - protein, 8 aa, Entamoeba dispar
QQNSYSHD

SEQ ID NO: 2455368 - protein, 8 aa, Entamoeba dispar
QQNTARQF

SEQ ID NO: 2455369 - protein, 6 aa, Entamoeba dispar
QQNTGG

SEQ ID NO: 2455370 - protein, 104 aa, Entamoeba dispar
QQNTNQPNPYRNQQMTSSTLNPPGTYLTSPYSNTYSSAQQRPNQPTYQPPTMPNISQQSSFGIKSTSPYSAQQSTYTAPQNPSYQPQQNYQGVYSTPQQYPSLQ

SEQ ID NO: 2455371 - protein, 19 aa, Entamoeba dispar
QQNTSSTTVSNGNDAAMSN

SEQ ID NO: 2455372 - protein, 16 aa, Entamoeba dispar
QQPAPSQQPQVQQQTP

SEQ ID NO: 2455373 - protein, 20 aa, Entamoeba dispar
QQPATTTPVQQPKPQPKPDV

SEQ ID NO: 2455374 - protein, 7 aa, Entamoeba dispar
QQPDNLN

SEQ ID NO: 2455375 - protein, 8 aa, Entamoeba dispar
QQPEPDFP

SEQ ID NO: 2455376 - protein, 8 aa, Entamoeba dispar
QQPEYDDK

SEQ ID NO: 2455377 - protein, 17 aa, Entamoeba dispar
QQPHTQQNTPQQRPVTN

SEQ ID NO: 2455378 - protein, 25 aa, Entamoeba dispar
QQPIESPIQPSISDKTLSPNSGQIN

SEQ ID NO: 2455379 - protein, 9 aa, Entamoeba dispar
QQPLNRPKI

SEQ ID NO: 2455380 - protein, 6 aa, Entamoeba dispar
QQPLTL

SEQ ID NO: 2455381 - protein, 12 aa, Entamoeba dispar
QQPMKREPEGFN

SEQ ID NO: 2455382 - protein, 10 aa, Entamoeba dispar
QQPNPSQQYP

SEQ ID NO: 2455383 - protein, 6 aa, Entamoeba dispar
QQPNVS

SEQ ID NO: 2455384 - protein, 61 aa, Entamoeba dispar
QQPPASSSIQQQEKKEEQPNEENIPKTTEEKKDSHEIHSNEQAQSQNTRNEEPNPQQPNPL

SEQ ID NO: 2455385 - protein, 25 aa, Entamoeba dispar
QQPPLEPGQTNAQPPHQQCQPMFPH

SEQ ID NO: 2455386 - protein, 31 aa, Entamoeba dispar
QQPQNVQQQNTQPQNVQQPNTQPQNVQQQNP

SEQ ID NO: 2455387 - protein, 14 aa, Entamoeba dispar
QQPQQAENHSASSA

SEQ ID NO: 2455388 - protein, 17 aa, Entamoeba dispar
QQPSPKLKQYSEQTNDK

SEQ ID NO: 2455389 - protein, 7 aa, Entamoeba dispar
QQPSQIN

SEQ ID NO: 2455390 - protein, 6 aa, Entamoeba dispar
QQPTPR

SEQ ID NO: 2455391 - protein, 9 aa, Entamoeba dispar
QQPTQPMGY

SEQ ID NO: 2455392 - protein, 18 aa, Entamoeba dispar
QQPTQPMGYQQSTPSTLM

SEQ ID NO: 2455393 - protein, 12 aa, Entamoeba dispar
QQPVTHSQKDTI

SEQ ID NO: 2455394 - protein, 13 aa, Entamoeba dispar
QQPYERPWKKLLY

SEQ ID NO: 2455395 - protein, 7 aa, Entamoeba dispar
QQPYKDT

SEQ ID NO: 2455396 - protein, 8 aa, Entamoeba dispar
QQQANPAG

SEQ ID NO: 2455397 - protein, 5 aa, Entamoeba dispar
QQQEI

SEQ ID NO: 2455398 - protein, 5 aa, Entamoeba dispar
QQQEN

SEQ ID NO: 2455399 - protein, 4 aa, Entamoeba dispar
QQQF

SEQ ID NO: 2455400 - protein, 6 aa, Entamoeba dispar
QQQFDT

SEQ ID NO: 2455401 - protein, 8 aa, Entamoeba dispar
QQQINQES

SEQ ID NO: 2455402 - protein, 5 aa, Entamoeba dispar
QQQIS

SEQ ID NO: 2455403 - protein, 5 aa, Entamoeba dispar
QQQKE

SEQ ID NO: 2455404 - protein, 67 aa, Entamoeba dispar
QQQKERKEIQAHASETSKKIYEGSSVKKQKRIDEEKKAKEQKKIEKSKIKKEKRAERNKEKKEEEKF

SEQ ID NO: 2455405 - protein, 10 aa, Entamoeba dispar
QQQKPIEDVR

SEQ ID NO: 2455406 - protein, 21 aa, Entamoeba dispar
QQQLDEKEENDNDSINQEKKD

SEQ ID NO: 2455407 - protein, 25 aa, Entamoeba dispar
QQQLNEKEKQLKEEEEKRKEVENEL

SEQ ID NO: 2455408 - protein, 12 aa, Entamoeba dispar
QQQLPQPPAQYQ

SEQ ID NO: 2455409 - protein, 15 aa, Entamoeba dispar
QQQMKASKEFSDPAP

SEQ ID NO: 2455410 - protein, 7 aa, Entamoeba dispar
QQQNNQW

SEQ ID NO: 2455411 - protein, 25 aa, Entamoeba dispar
QQQPQKDTEIPVPGSKTETTFNKER

SEQ ID NO: 2455412 - protein, 13 aa, Entamoeba dispar
QQQPSEEAKEGVR

SEQ ID NO: 2455413 - protein, 37 aa, Entamoeba dispar
QQQQKKERKPKQKAPKVDKEGTKIDTRKRLDKEGNFP

SEQ ID NO: 2455414 - protein, 23 aa, Entamoeba dispar
QQQQSIKPIRKSRKTRSGVVAQD

SEQ ID NO: 2455415 - protein, 8 aa, Entamoeba dispar
QQQSKEAQ

SEQ ID NO: 2455416 - protein, 4 aa, Entamoeba dispar
QQQT

SEQ ID NO: 2455417 - protein, 7 aa, Entamoeba dispar
QQQTKKL

SEQ ID NO: 2455418 - protein, 8 aa, Entamoeba dispar
QQQTLSEK

SEQ ID NO: 2455419 - protein, 11 aa, Entamoeba dispar
QQQTPKPQLVN

SEQ ID NO: 2455420 - protein, 9 aa, Entamoeba dispar
QQQTSISRL

SEQ ID NO: 2455421 - protein, 10 aa, Entamoeba dispar
QQQYYQQPVQ

SEQ ID NO: 2455422 - protein, 28 aa, Entamoeba dispar
QQRAQKESDPSQASPRRPQPPTPKRGVT

SEQ ID NO: 2455423 - protein, 7 aa, Entamoeba dispar
QQRIDNQ

SEQ ID NO: 2455424 - protein, 4 aa, Entamoeba dispar
QQRN

SEQ ID NO: 2455425 - protein, 12 aa, Entamoeba dispar
QQRPHKIGEYPG

SEQ ID NO: 2455426 - protein, 27 aa, Entamoeba dispar
QQRPPQQNPTETTEPPIPINANSKSVH

SEQ ID NO: 2455427 - protein, 7 aa, Entamoeba dispar
QQRPTTM

SEQ ID NO: 2455428 - protein, 4 aa, Entamoeba dispar
QQRQ

SEQ ID NO: 2455429 - protein, 6 aa, Entamoeba dispar
QQRQRP

SEQ ID NO: 2455430 - protein, 8 aa, Entamoeba dispar
QQRRDSSD

SEQ ID NO: 2455431 - protein, 41 aa, Entamoeba dispar
QQRRKESQELEHEEKLRREKNRQLLEEKRKREEIKQRNEEI

SEQ ID NO: 2455432 - protein, 23 aa, Entamoeba dispar
QQRRQTENKLSLTTEKSYERIED

SEQ ID NO: 2455433 - protein, 18 aa, Entamoeba dispar
QQRSKSSSNRINQKTPRL

SEQ ID NO: 2455434 - protein, 8 aa, Entamoeba dispar
QQRYSQRM

SEQ ID NO: 2455435 - protein, 4 aa, Entamoeba dispar
QQSE

SEQ ID NO: 2455436 - protein, 8 aa, Entamoeba dispar
QQSFDNQQ

SEQ ID NO: 2455437 - protein, 9 aa, Entamoeba dispar
QQSGETKGD

SEQ ID NO: 2455438 - protein, 8 aa, Entamoeba dispar
QQSGMKKN

SEQ ID NO: 2455439 - protein, 14 aa, Entamoeba dispar
QQSIPQQQQSTSNS

SEQ ID NO: 2455440 - protein, 9 aa, Entamoeba dispar
QQSKENRKF

SEQ ID NO: 2455441 - protein, 14 aa, Entamoeba dispar
QQSKLENSKIQQYE

SEQ ID NO: 2455442 - protein, 10 aa, Entamoeba dispar
QQSKSTLINE

SEQ ID NO: 2455443 - protein, 10 aa, Entamoeba dispar
QQSLTLPDGF

SEQ ID NO: 2455444 - protein, 6 aa, Entamoeba dispar
QQSNID

SEQ ID NO: 2455445 - protein, 11 aa, Entamoeba dispar
QQSNNTQKDQT

SEQ ID NO: 2455446 - protein, 15 aa, Entamoeba dispar
QQSNQLGNEKLGGGA

SEQ ID NO: 2455447 - protein, 12 aa, Entamoeba dispar
QQSNYMRRCYEI

SEQ ID NO: 2455448 - protein, 11 aa, Entamoeba dispar
QQSPKRKPSNL

SEQ ID NO: 2455449 - protein, 5 aa, Entamoeba dispar
QQSPR

SEQ ID NO: 2455450 - protein, 17 aa, Entamoeba dispar
QQSREKVGPEEITKSDT

SEQ ID NO: 2455451 - protein, 7 aa, Entamoeba dispar
QQSSQIN

SEQ ID NO: 2455452 - protein, 21 aa, Entamoeba dispar
QQSSQTEKPTLPIRRKANPPI

SEQ ID NO: 2455453 - protein, 8 aa, Entamoeba dispar
QQSTENAI

SEQ ID NO: 2455454 - protein, 14 aa, Entamoeba dispar
QQSVNQKKEQPKQN

SEQ ID NO: 2455455 - protein, 7 aa, Entamoeba dispar
QQSVQTM

SEQ ID NO: 2455456 - protein, 4 aa, Entamoeba dispar
QQTE

SEQ ID NO: 2455457 - protein, 9 aa, Entamoeba dispar
QQTESSDLV

SEQ ID NO: 2455458 - protein, 8 aa, Entamoeba dispar
QQTKEETI

SEQ ID NO: 2455459 - protein, 8 aa, Entamoeba dispar
QQTKEETV

SEQ ID NO: 2455460 - protein, 6 aa, Entamoeba dispar
QQTKQE

SEQ ID NO: 2455461 - protein, 4 aa, Entamoeba dispar
QQTL

SEQ ID NO: 2455462 - protein, 7 aa, Entamoeba dispar
QQTNAPI

SEQ ID NO: 2455463 - protein, 17 aa, Entamoeba dispar
QQTNNGMSDQQKQYSSA

SEQ ID NO: 2455464 - protein, 6 aa, Entamoeba dispar
QQTNNL

SEQ ID NO: 2455465 - protein, 16 aa, Entamoeba dispar
QQTNNSFLEQNKDHTI

SEQ ID NO: 2455466 - protein, 17 aa, Entamoeba dispar
QQTNSGMSDQQKQYSSA

SEQ ID NO: 2455467 - protein, 11 aa, Entamoeba dispar
QQTPSITQESL

SEQ ID NO: 2455468 - protein, 7 aa, Entamoeba dispar
QQTQSQI

SEQ ID NO: 2455469 - protein, 12 aa, Entamoeba dispar
QQTQSVQQSDGG

SEQ ID NO: 2455470 - protein, 9 aa, Entamoeba dispar
QQTQTKEEI

SEQ ID NO: 2455471 - protein, 4 aa, Entamoeba dispar
QQTS

SEQ ID NO: 2455472 - protein, 6 aa, Entamoeba dispar
QQTSQG

SEQ ID NO: 2455473 - protein, 8 aa, Entamoeba dispar
QQTSQLTE

SEQ ID NO: 2455474 - protein, 6 aa, Entamoeba dispar
QQTSQY

SEQ ID NO: 2455475 - protein, 11 aa, Entamoeba dispar
QQTTENIVKSE

SEQ ID NO: 2455476 - protein, 10 aa, Entamoeba dispar
QQTVPNGGHA

SEQ ID NO: 2455477 - protein, 15 aa, Entamoeba dispar
QQVNQSVESKEEQDI

SEQ ID NO: 2455478 - protein, 8 aa, Entamoeba dispar
QQVNQYPH

SEQ ID NO: 2455479 - protein, 11 aa, Entamoeba dispar
QQVPGQSFQQQ

SEQ ID NO: 2455480 - protein, 16 aa, Entamoeba dispar
QQVQENEKRRKEVEHK

SEQ ID NO: 2455481 - protein, 19 aa, Entamoeba dispar
QQYENQIQENSQKEQKEQI

SEQ ID NO: 2455482 - protein, 14 aa, Entamoeba dispar
QQYSGTKMTKSAWD

SEQ ID NO: 2455483 - protein, 11 aa, Entamoeba dispar
QQYTPANVGER

SEQ ID NO: 2455484 - protein, 12 aa, Entamoeba dispar
QRAAKKAAKECK

SEQ ID NO: 2455485 - protein, 11 aa, Entamoeba dispar
QRAEEKNISGV

SEQ ID NO: 2455486 - protein, 10 aa, Entamoeba dispar
QRAHSENALS

SEQ ID NO: 2455487 - protein, 5 aa, Entamoeba dispar
QRAIT

SEQ ID NO: 2455488 - protein, 14 aa, Entamoeba dispar
QRARQEKHLTQKEL

SEQ ID NO: 2455489 - protein, 4 aa, Entamoeba dispar
QRAT

SEQ ID NO: 2455490 - protein, 10 aa, Entamoeba dispar
QRCSTRNKQA

SEQ ID NO: 2455491 - protein, 22 aa, Entamoeba dispar
QRCYDSKGSVSDSESSSIDPQE

SEQ ID NO: 2455492 - protein, 4 aa, Entamoeba dispar
QRDA

SEQ ID NO: 2455493 - protein, 6 aa, Entamoeba dispar
QRDKEI

SEQ ID NO: 2455494 - protein, 9 aa, Entamoeba dispar
QRDKNKKEM

SEQ ID NO: 2455495 - protein, 9 aa, Entamoeba dispar
QRDPSKRIT

SEQ ID NO: 2455496 - protein, 13 aa, Entamoeba dispar
QRDQEEQNNNHSK

SEQ ID NO: 2455497 - protein, 7 aa, Entamoeba dispar
QRDSELN

SEQ ID NO: 2455498 - protein, 7 aa, Entamoeba dispar
QRDSYAS

SEQ ID NO: 2455499 - protein, 6 aa, Entamoeba dispar
QREDGS

SEQ ID NO: 2455500 - protein, 5 aa, Entamoeba dispar
QREEA

SEQ ID NO: 2455501 - protein, 17 aa, Entamoeba dispar
QREEQTENKSLSSEGES

SEQ ID NO: 2455502 - protein, 4 aa, Entamoeba dispar
QREG

SEQ ID NO: 2455503 - protein, 7 aa, Entamoeba dispar
QREIGAV

SEQ ID NO: 2455504 - protein, 29 aa, Entamoeba dispar
QREIREEELKDKEKELSKKIQKYSQELDK

SEQ ID NO: 2455505 - protein, 34 aa, Entamoeba dispar
QREKEEDDKKEMIRKQEEERIKQAQQEQEEKEHQ

SEQ ID NO: 2455506 - protein, 4 aa, Entamoeba dispar
QREN

SEQ ID NO: 2455507 - protein, 7 aa, Entamoeba dispar
QREQQTH

SEQ ID NO: 2455508 - protein, 7 aa, Entamoeba dispar
QRESIQN

SEQ ID NO: 2455509 - protein, 5 aa, Entamoeba dispar
QRETK

SEQ ID NO: 2455510 - protein, 7 aa, Entamoeba dispar
QREYSEN

SEQ ID NO: 2455511 - protein, 11 aa, Entamoeba dispar
QRFATNSADVK

SEQ ID NO: 2455512 - protein, 7 aa, Entamoeba dispar
QRFEDEG

SEQ ID NO: 2455513 - protein, 8 aa, Entamoeba dispar
QRFNPNIP

SEQ ID NO: 2455514 - protein, 13 aa, Entamoeba dispar
QRGGRGNAGGQHH

SEQ ID NO: 2455515 - protein, 13 aa, Entamoeba dispar
QRGKERRESGRTT

SEQ ID NO: 2455516 - protein, 9 aa, Entamoeba dispar
QRGKGPIQF

SEQ ID NO: 2455517 - protein, 8 aa, Entamoeba dispar
QRGNDGNL

SEQ ID NO: 2455518 - protein, 8 aa, Entamoeba dispar
QRGNTEIE

SEQ ID NO: 2455519 - protein, 17 aa, Entamoeba dispar
QRGQRNSPLAIPPEQTL

SEQ ID NO: 2455520 - protein, 12 aa, Entamoeba dispar
QRGRDGPLNTPE

SEQ ID NO: 2455521 - protein, 8 aa, Entamoeba dispar
QRGTMNTV

SEQ ID NO: 2455522 - protein, 10 aa, Entamoeba dispar
QRGTRSTKYT

SEQ ID NO: 2455523 - protein, 5 aa, Entamoeba dispar
QRGVA

SEQ ID NO: 2455524 - protein, 12 aa, Entamoeba dispar
QRGVQKDLEEMR

SEQ ID NO: 2455525 - protein, 4 aa, Entamoeba dispar
QRHN

SEQ ID NO: 2455526 - protein, 4 aa, Entamoeba dispar
QRID

SEQ ID NO: 2455527 - protein, 4 aa, Entamoeba dispar
QRIE

SEQ ID NO: 2455528 - protein, 11 aa, Entamoeba dispar
QRIEEDPNNPH

SEQ ID NO: 2455529 - protein, 22 aa, Entamoeba dispar
QRIEKDKQKLKTLQRSQQKKEG

SEQ ID NO: 2455530 - protein, 13 aa, Entamoeba dispar
QRIETKTKNEELK

SEQ ID NO: 2455531 - protein, 6 aa, Entamoeba dispar
QRIGDT

SEQ ID NO: 2455532 - protein, 9 aa, Entamoeba dispar
QRINPSEKV

SEQ ID NO: 2455533 - protein, 15 aa, Entamoeba dispar
QRIPQQQVQQPPNGI

SEQ ID NO: 2455534 - protein, 5 aa, Entamoeba dispar
QRIPR

SEQ ID NO: 2455535 - protein, 5 aa, Entamoeba dispar
QRISN

SEQ ID NO: 2455536 - protein, 5 aa, Entamoeba dispar
QRIYT

SEQ ID NO: 2455537 - protein, 8 aa, Entamoeba dispar
QRKDEEFK

SEQ ID NO: 2455538 - protein, 9 aa, Entamoeba dispar
QRKDNTPEV

SEQ ID NO: 2455539 - protein, 8 aa, Entamoeba dispar
QRKEEEPI

SEQ ID NO: 2455540 - protein, 21 aa, Entamoeba dispar
QRKEKEDYDAKHAGDKKEEVK

SEQ ID NO: 2455541 - protein, 28 aa, Entamoeba dispar
QRKEKEEYDAKHAGDKKEEVKEEKEEEK

SEQ ID NO: 2455542 - protein, 12 aa, Entamoeba dispar
QRKEKGGEEEYY

SEQ ID NO: 2455543 - protein, 8 aa, Entamoeba dispar
QRKEKVDK

SEQ ID NO: 2455544 - protein, 22 aa, Entamoeba dispar
QRKENQKEDTTTITTNTENSQL

SEQ ID NO: 2455545 - protein, 6 aa, Entamoeba dispar
QRKGFG

SEQ ID NO: 2455546 - protein, 9 aa, Entamoeba dispar
QRKGTISTS

SEQ ID NO: 2455547 - protein, 78 aa, Entamoeba dispar
QRKHKDISKSDHEKSHQNTHQKQQQSKTKSGIKRPNNGKYTQPLKQRSNPFGAKVSDELKKEYQEKKQRKESNEDAVN

SEQ ID NO: 2455548 - protein, 14 aa, Entamoeba dispar
QRKIQDGLKEKTSG

SEQ ID NO: 2455549 - protein, 4 aa, Entamoeba dispar
QRKK

SEQ ID NO: 2455550 - protein, 27 aa, Entamoeba dispar
QRKKEENNETSTKLPKQPESLKHNNSL

SEQ ID NO: 2455551 - protein, 16 aa, Entamoeba dispar
QRKKPQSQRKKQNNTT

SEQ ID NO: 2455552 - protein, 10 aa, Entamoeba dispar
QRKKTGNEEQ

SEQ ID NO: 2455553 - protein, 15 aa, Entamoeba dispar
QRKLEEEAANAAAEQ

SEQ ID NO: 2455554 - protein, 19 aa, Entamoeba dispar
QRKQEIPPKNEPKSDEELS

SEQ ID NO: 2455555 - protein, 15 aa, Entamoeba dispar
QRKRNEPLFNPNDPD

SEQ ID NO: 2455556 - protein, 8 aa, Entamoeba dispar
QRKSDGSI

SEQ ID NO: 2455557 - protein, 5 aa, Entamoeba dispar
QRKSS

SEQ ID NO: 2455558 - protein, 10 aa, Entamoeba dispar
QRKSTEKNPI

SEQ ID NO: 2455559 - protein, 10 aa, Entamoeba dispar
QRKTNKIQSQ

SEQ ID NO: 2455560 - protein, 10 aa, Entamoeba dispar
QRLPQPPSFE

SEQ ID NO: 2455561 - protein, 8 aa, Entamoeba dispar
QRLRGSKI

SEQ ID NO: 2455562 - protein, 21 aa, Entamoeba dispar
QRLTEQKQKSLSSIQTPHHKK

SEQ ID NO: 2455563 - protein, 16 aa, Entamoeba dispar
QRMENTTFDSSDPFDY

SEQ ID NO: 2455564 - protein, 10 aa, Entamoeba dispar
QRMTPEQAAQ

SEQ ID NO: 2455565 - protein, 13 aa, Entamoeba dispar
QRMTPKQANRKVE

SEQ ID NO: 2455566 - protein, 8 aa, Entamoeba dispar
QRNDGDVS

SEQ ID NO: 2455567 - protein, 6 aa, Entamoeba dispar
QRNDIN

SEQ ID NO: 2455568 - protein, 11 aa, Entamoeba dispar
QRNEKEGLIPP

SEQ ID NO: 2455569 - protein, 11 aa, Entamoeba dispar
QRNEKGNMKKK

SEQ ID NO: 2455570 - protein, 26 aa, Entamoeba dispar
QRNEKVPSELPTGLTQGRTTEDGPVT

SEQ ID NO: 2455571 - protein, 24 aa, Entamoeba dispar
QRNELNRKMATPDFGKQNNDDDLL

SEQ ID NO: 2455572 - protein, 6 aa, Entamoeba dispar
QRNETI

SEQ ID NO: 2455573 - protein, 8 aa, Entamoeba dispar
QRNGEMKP

SEQ ID NO: 2455574 - protein, 7 aa, Entamoeba dispar
QRNGRKC

SEQ ID NO: 2455575 - protein, 5 aa, Entamoeba dispar
QRNIR

SEQ ID NO: 2455576 - protein, 11 aa, Entamoeba dispar
QRNMKNKEEME

SEQ ID NO: 2455577 - protein, 4 aa, Entamoeba dispar
QRNN

SEQ ID NO: 2455578 - protein, 8 aa, Entamoeba dispar
QRNNKEIN

SEQ ID NO: 2455579 - protein, 10 aa, Entamoeba dispar
QRNNSASEMV

SEQ ID NO: 2455580 - protein, 8 aa, Entamoeba dispar
QRNPDWKY

SEQ ID NO: 2455581 - protein, 10 aa, Entamoeba dispar
QRNQIKRDKE

SEQ ID NO: 2455582 - protein, 47 aa, Entamoeba dispar
QRNQTKTRVPVEADDGSKSEEYLDEKQNNESEELEKEESKSEEEEEE

SEQ ID NO: 2455583 - protein, 7 aa, Entamoeba dispar
QRNSLKS

SEQ ID NO: 2455584 - protein, 6 aa, Entamoeba dispar
QRNSSV

SEQ ID NO: 2455585 - protein, 10 aa, Entamoeba dispar
QRNTESKSSF

SEQ ID NO: 2455586 - protein, 12 aa, Entamoeba dispar
QRNTKLNKQKYS

SEQ ID NO: 2455587 - protein, 7 aa, Entamoeba dispar
QRNTQIN

SEQ ID NO: 2455588 - protein, 4 aa, Entamoeba dispar
QRNY

SEQ ID NO: 2455589 - protein, 30 aa, Entamoeba dispar
QRPAQQPNNNSETKREPRLPLQQSKTTHGF

SEQ ID NO: 2455590 - protein, 13 aa, Entamoeba dispar
QRPASSTGVVPSK

SEQ ID NO: 2455591 - protein, 13 aa, Entamoeba dispar
QRPLSNDKESKTF

SEQ ID NO: 2455592 - protein, 6 aa, Entamoeba dispar
QRPPLR

SEQ ID NO: 2455593 - protein, 5 aa, Entamoeba dispar
QRPPR

SEQ ID NO: 2455594 - protein, 8 aa, Entamoeba dispar
QRPQQKKP

SEQ ID NO: 2455595 - protein, 6 aa, Entamoeba dispar
QRPSAE

SEQ ID NO: 2455596 - protein, 5 aa, Entamoeba dispar
QRPYE

SEQ ID NO: 2455597 - protein, 12 aa, Entamoeba dispar
QRQANPKKFDNA

SEQ ID NO: 2455598 - protein, 15 aa, Entamoeba dispar
QRQETHNNSTLLLSD

SEQ ID NO: 2455599 - protein, 5 aa, Entamoeba dispar
QRQFP

SEQ ID NO: 2455600 - protein, 25 aa, Entamoeba dispar
QRQGDKANLPSVPAPISQPKQSKAV

SEQ ID NO: 2455601 - protein, 9 aa, Entamoeba dispar
QRQGNRTPE

SEQ ID NO: 2455602 - protein, 44 aa, Entamoeba dispar
QRQLARDTESKKKSTAALRDEAALKQQSYKQMQEDAEKAAAERL

SEQ ID NO: 2455603 - protein, 7 aa, Entamoeba dispar
QRQQENQ

SEQ ID NO: 2455604 - protein, 10 aa, Entamoeba dispar
QRQRKEFEQK

SEQ ID NO: 2455605 - protein, 9 aa, Entamoeba dispar
QRQSQSNLG

SEQ ID NO: 2455606 - protein, 28 aa, Entamoeba dispar
QRQSSTHTSVPGTQVSTRVQQTPNRTQM

SEQ ID NO: 2455607 - protein, 4 aa, Entamoeba dispar
QRRE

SEQ ID NO: 2455608 - protein, 5 aa, Entamoeba dispar
QRRGY

SEQ ID NO: 2455609 - protein, 7 aa, Entamoeba dispar
QRRIPNT

SEQ ID NO: 2455610 - protein, 8 aa, Entamoeba dispar
QRRISSNS

SEQ ID NO: 2455611 - protein, 9 aa, Entamoeba dispar
QRRPTEESI

SEQ ID NO: 2455612 - protein, 17 aa, Entamoeba dispar
QRRRRRNKRQQENRERV

SEQ ID NO: 2455613 - protein, 5 aa, Entamoeba dispar
QRRTG

SEQ ID NO: 2455614 - protein, 7 aa, Entamoeba dispar
QRRTVTQ

SEQ ID NO: 2455615 - protein, 55 aa, Entamoeba dispar
QRSDPHQHDRSRSPSPNLRYSRSSRQRISYRERSRSDSRERRKNYHEERRYDSRK

SEQ ID NO: 2455616 - protein, 11 aa, Entamoeba dispar
QRSEDKSVTSL

SEQ ID NO: 2455617 - protein, 9 aa, Entamoeba dispar
QRSEETRQS

SEQ ID NO: 2455618 - protein, 5 aa, Entamoeba dispar
QRSEF

SEQ ID NO: 2455619 - protein, 6 aa, Entamoeba dispar
QRSGLG

SEQ ID NO: 2455620 - protein, 31 aa, Entamoeba dispar
QRSKGSPSSSERSSERSESNRLKRSSQIQEQ

SEQ ID NO: 2455621 - protein, 5 aa, Entamoeba dispar
QRSKI

SEQ ID NO: 2455622 - protein, 6 aa, Entamoeba dispar
QRSQYY

SEQ ID NO: 2455623 - protein, 10 aa, Entamoeba dispar
QRSSASMGNF

SEQ ID NO: 2455624 - protein, 6 aa, Entamoeba dispar
QRSTVR

SEQ ID NO: 2455625 - protein, 11 aa, Entamoeba dispar
QRTAPHKNSLG

SEQ ID NO: 2455626 - protein, 4 aa, Entamoeba dispar
QRTD

SEQ ID NO: 2455627 - protein, 6 aa, Entamoeba dispar
QRTDRD

SEQ ID NO: 2455628 - protein, 6 aa, Entamoeba dispar
QRTEIA

SEQ ID NO: 2455629 - protein, 6 aa, Entamoeba dispar
QRTETM

SEQ ID NO: 2455630 - protein, 5 aa, Entamoeba dispar
QRTHV

SEQ ID NO: 2455631 - protein, 10 aa, Entamoeba dispar
QRTKDGDPMD

SEQ ID NO: 2455632 - protein, 24 aa, Entamoeba dispar
QRTKNSLDLNDENHKNSQKKDTEA

SEQ ID NO: 2455633 - protein, 8 aa, Entamoeba dispar
QRTKTTPF

SEQ ID NO: 2455634 - protein, 9 aa, Entamoeba dispar
QRTNGYDNR

SEQ ID NO: 2455635 - protein, 15 aa, Entamoeba dispar
QRTNPKGINERLDET

SEQ ID NO: 2455636 - protein, 9 aa, Entamoeba dispar
QRTNPTDVV

SEQ ID NO: 2455637 - protein, 8 aa, Entamoeba dispar
QRTNQDDW

SEQ ID NO: 2455638 - protein, 7 aa, Entamoeba dispar
QRTNTAN

SEQ ID NO: 2455639 - protein, 8 aa, Entamoeba dispar
QRTQEMAD

SEQ ID NO: 2455640 - protein, 5 aa, Entamoeba dispar
QRTSK

SEQ ID NO: 2455641 - protein, 9 aa, Entamoeba dispar
QRTSPPPPI

SEQ ID NO: 2455642 - protein, 12 aa, Entamoeba dispar
QRTSSNGDDNRL

SEQ ID NO: 2455643 - protein, 16 aa, Entamoeba dispar
QRVQQRRPSQQRSTTI

SEQ ID NO: 2455644 - protein, 6 aa, Entamoeba dispar
QRVSPM

SEQ ID NO: 2455645 - protein, 10 aa, Entamoeba dispar
QRYGSGNQFT

SEQ ID NO: 2455646 - protein, 12 aa, Entamoeba dispar
QRYNISKTQEIE

SEQ ID NO: 2455647 - protein, 23 aa, Entamoeba dispar
QRYQRESGKIVSDTKNDIPQYTV

SEQ ID NO: 2455648 - protein, 5 aa, Entamoeba dispar
QRYSR

SEQ ID NO: 2455649 - protein, 11 aa, Entamoeba dispar
QRYTDSSLAGD

SEQ ID NO: 2455650 - protein, 11 aa, Entamoeba dispar
QSAADGNIDPN

SEQ ID NO: 2455651 - protein, 10 aa, Entamoeba dispar
QSADSLQQEL

SEQ ID NO: 2455652 - protein, 5 aa, Entamoeba dispar
QSAEL

SEQ ID NO: 2455653 - protein, 9 aa, Entamoeba dispar
QSAPKGNSL

SEQ ID NO: 2455654 - protein, 6 aa, Entamoeba dispar
QSCAKA

SEQ ID NO: 2455655 - protein, 6 aa, Entamoeba dispar
QSCEPP

SEQ ID NO: 2455656 - protein, 6 aa, Entamoeba dispar
QSCGEE

SEQ ID NO: 2455657 - protein, 8 aa, Entamoeba dispar
QSCHPDEK

SEQ ID NO: 2455658 - protein, 5 aa, Entamoeba dispar
QSCSE

SEQ ID NO: 2455659 - protein, 7 aa, Entamoeba dispar
QSDAEMQ

SEQ ID NO: 2455660 - protein, 4 aa, Entamoeba dispar
QSDC

SEQ ID NO: 2455661 - protein, 7 aa, Entamoeba dispar
QSDDDLA

SEQ ID NO: 2455662 - protein, 11 aa, Entamoeba dispar
QSDDIQPQEHQ

SEQ ID NO: 2455663 - protein, 6 aa, Entamoeba dispar
QSDDSY

SEQ ID NO: 2455664 - protein, 6 aa, Entamoeba dispar
QSDEHD

SEQ ID NO: 2455665 - protein, 8 aa, Entamoeba dispar
QSDGKSSF

SEQ ID NO: 2455666 - protein, 7 aa, Entamoeba dispar
QSDIESN

SEQ ID NO: 2455667 - protein, 6 aa, Entamoeba dispar
QSDKGS

SEQ ID NO: 2455668 - protein, 9 aa, Entamoeba dispar
QSDKGVSRE

SEQ ID NO: 2455669 - protein, 7 aa, Entamoeba dispar
QSDKTKN

SEQ ID NO: 2455670 - protein, 4 aa, Entamoeba dispar
QSDN

SEQ ID NO: 2455671 - protein, 9 aa, Entamoeba dispar
QSDNTIPSG

SEQ ID NO: 2455672 - protein, 7 aa, Entamoeba dispar
QSDPGKA

SEQ ID NO: 2455673 - protein, 4 aa, Entamoeba dispar
QSDS

SEQ ID NO: 2455674 - protein, 6 aa, Entamoeba dispar
QSDSIQ

SEQ ID NO: 2455675 - protein, 12 aa, Entamoeba dispar
QSDSKQEEFHDN

SEQ ID NO: 2455676 - protein, 5 aa, Entamoeba dispar
QSEEE

SEQ ID NO: 2455677 - protein, 5 aa, Entamoeba dispar
QSEEI

SEQ ID NO: 2455678 - protein, 9 aa, Entamoeba dispar
QSEEIEHSA

SEQ ID NO: 2455679 - protein, 10 aa, Entamoeba dispar
QSEELNPQIK

SEQ ID NO: 2455680 - protein, 5 aa, Entamoeba dispar
QSEEM

SEQ ID NO: 2455681 - protein, 20 aa, Entamoeba dispar
QSEENKEIFNSGKSFADENR

SEQ ID NO: 2455682 - protein, 9 aa, Entamoeba dispar
QSEGSHSSA

SEQ ID NO: 2455683 - protein, 8 aa, Entamoeba dispar
QSEKHSKQ

SEQ ID NO: 2455684 - protein, 9 aa, Entamoeba dispar
QSEKRKDKF

SEQ ID NO: 2455685 - protein, 21 aa, Entamoeba dispar
QSEKSVNNEIDKPLTKEELER

SEQ ID NO: 2455686 - protein, 4 aa, Entamoeba dispar
QSEL

SEQ ID NO: 2455687 - protein, 5 aa, Entamoeba dispar
QSELH

SEQ ID NO: 2455688 - protein, 51 aa, Entamoeba dispar
QSELNNKTSSTPSPMPPSSPLPPQSSPLPPTATPPVSTSQPHTTSGRRPRY

SEQ ID NO: 2455689 - protein, 8 aa, Entamoeba dispar
QSELPPQS

SEQ ID NO: 2455690 - protein, 6 aa, Entamoeba dispar
QSENDL

SEQ ID NO: 2455691 - protein, 10 aa, Entamoeba dispar
QSEPNSILNG

SEQ ID NO: 2455692 - protein, 10 aa, Entamoeba dispar
QSESASENSR

SEQ ID NO: 2455693 - protein, 6 aa, Entamoeba dispar
QSETSQ

SEQ ID NO: 2455694 - protein, 6 aa, Entamoeba dispar
QSEVEA

SEQ ID NO: 2455695 - protein, 11 aa, Entamoeba dispar
QSEWSEKEECQ

SEQ ID NO: 2455696 - protein, 15 aa, Entamoeba dispar
QSFDDESTDQNDYGM

SEQ ID NO: 2455697 - protein, 9 aa, Entamoeba dispar
QSFENYPQP

SEQ ID NO: 2455698 - protein, 4 aa, Entamoeba dispar
QSFG

SEQ ID NO: 2455699 - protein, 9 aa, Entamoeba dispar
QSFKSTRTI

SEQ ID NO: 2455700 - protein, 7 aa, Entamoeba dispar
QSFNDGK

SEQ ID NO: 2455701 - protein, 6 aa, Entamoeba dispar
QSFQNT

SEQ ID NO: 2455702 - protein, 8 aa, Entamoeba dispar
QSFQQEKK

SEQ ID NO: 2455703 - protein, 8 aa, Entamoeba dispar
QSFSQTEQ

SEQ ID NO: 2455704 - protein, 23 aa, Entamoeba dispar
QSFSSTPIEHPSSPFARFFLEEV

SEQ ID NO: 2455705 - protein, 6 aa, Entamoeba dispar
QSFTDD

SEQ ID NO: 2455706 - protein, 6 aa, Entamoeba dispar
QSFTPF

SEQ ID NO: 2455707 - protein, 8 aa, Entamoeba dispar
QSGEQTIP

SEQ ID NO: 2455708 - protein, 6 aa, Entamoeba dispar
QSGFHS

SEQ ID NO: 2455709 - protein, 24 aa, Entamoeba dispar
QSGKEKTQELKNEIEKETETAKKG

SEQ ID NO: 2455710 - protein, 8 aa, Entamoeba dispar
QSGKTTFS

SEQ ID NO: 2455711 - protein, 5 aa, Entamoeba dispar
QSGLS

SEQ ID NO: 2455712 - protein, 7 aa, Entamoeba dispar
QSGNEKN

SEQ ID NO: 2455713 - protein, 5 aa, Entamoeba dispar
QSGNP

SEQ ID NO: 2455714 - protein, 5 aa, Entamoeba dispar
QSGNR

SEQ ID NO: 2455715 - protein, 8 aa, Entamoeba dispar
QSGPYDGF

SEQ ID NO: 2455716 - protein, 4 aa, Entamoeba dispar
QSGQ

SEQ ID NO: 2455717 - protein, 9 aa, Entamoeba dispar
QSGQSREVV

SEQ ID NO: 2455718 - protein, 14 aa, Entamoeba dispar
QSGRALTKEGRKDM

SEQ ID NO: 2455719 - protein, 5 aa, Entamoeba dispar
QSGRC

SEQ ID NO: 2455720 - protein, 8 aa, Entamoeba dispar
QSGSSSVL

SEQ ID NO: 2455721 - protein, 5 aa, Entamoeba dispar
QSGYE

SEQ ID NO: 2455722 - protein, 7 aa, Entamoeba dispar
QSGYVSP

SEQ ID NO: 2455723 - protein, 6 aa, Entamoeba dispar
QSHEID

SEQ ID NO: 2455724 - protein, 7 aa, Entamoeba dispar
QSHETGK

SEQ ID NO: 2455725 - protein, 4 aa, Entamoeba dispar
QSHP

SEQ ID NO: 2455726 - protein, 6 aa, Entamoeba dispar
QSHPGD

SEQ ID NO: 2455727 - protein, 11 aa, Entamoeba dispar
QSIADKELNEK

SEQ ID NO: 2455728 - protein, 6 aa, Entamoeba dispar
QSIARK

SEQ ID NO: 2455729 - protein, 5 aa, Entamoeba dispar
QSICP

SEQ ID NO: 2455730 - protein, 6 aa, Entamoeba dispar
QSIDGY

SEQ ID NO: 2455731 - protein, 21 aa, Entamoeba dispar
QSIDSSLLGTKTSDYISETYG

SEQ ID NO: 2455732 - protein, 12 aa, Entamoeba dispar
QSIESHPTNQPI

SEQ ID NO: 2455733 - protein, 5 aa, Entamoeba dispar
QSIET

SEQ ID NO: 2455734 - protein, 10 aa, Entamoeba dispar
QSIGEPSTQM

SEQ ID NO: 2455735 - protein, 8 aa, Entamoeba dispar
QSIGSEPL

SEQ ID NO: 2455736 - protein, 4 aa, Entamoeba dispar
QSIH

SEQ ID NO: 2455737 - protein, 5 aa, Entamoeba dispar
QSIHD

SEQ ID NO: 2455738 - protein, 14 aa, Entamoeba dispar
QSIINNSTNKYMKS

SEQ ID NO: 2455739 - protein, 4 aa, Entamoeba dispar
QSIK

SEQ ID NO: 2455740 - protein, 7 aa, Entamoeba dispar
QSIKGKD

SEQ ID NO: 2455741 - protein, 8 aa, Entamoeba dispar
QSIKGQYS

SEQ ID NO: 2455742 - protein, 12 aa, Entamoeba dispar
QSIKNKSINIAS

SEQ ID NO: 2455743 - protein, 10 aa, Entamoeba dispar
QSIKPNRIRD

SEQ ID NO: 2455744 - protein, 26 aa, Entamoeba dispar
QSIKQSLESKFNQSNINTDIIQCLFN

SEQ ID NO: 2455745 - protein, 12 aa, Entamoeba dispar
QSINRQGLQQQI

SEQ ID NO: 2455746 - protein, 14 aa, Entamoeba dispar
QSIPDEATLSHSSQ

SEQ ID NO: 2455747 - protein, 8 aa, Entamoeba dispar
QSIPDTTS

SEQ ID NO: 2455748 - protein, 22 aa, Entamoeba dispar
QSIPQLPKTDQKELEKELESET

SEQ ID NO: 2455749 - protein, 9 aa, Entamoeba dispar
QSIPQQPKQ

SEQ ID NO: 2455750 - protein, 9 aa, Entamoeba dispar
QSIPQTEDT

SEQ ID NO: 2455751 - protein, 19 aa, Entamoeba dispar
QSIPSDSTSPLYPRTGKSV

SEQ ID NO: 2455752 - protein, 6 aa, Entamoeba dispar
QSIQEY

SEQ ID NO: 2455753 - protein, 8 aa, Entamoeba dispar
QSIQKESK

SEQ ID NO: 2455754 - protein, 8 aa, Entamoeba dispar
QSIQNNLQ

SEQ ID NO: 2455755 - protein, 9 aa, Entamoeba dispar
QSIQPSSDL

SEQ ID NO: 2455756 - protein, 11 aa, Entamoeba dispar
QSIQSTLSTSV

SEQ ID NO: 2455757 - protein, 4 aa, Entamoeba dispar
QSIS

SEQ ID NO: 2455758 - protein, 6 aa, Entamoeba dispar
QSISKT

SEQ ID NO: 2455759 - protein, 10 aa, Entamoeba dispar
QSISNGQLPH

SEQ ID NO: 2455760 - protein, 9 aa, Entamoeba dispar
QSISPTNSI

SEQ ID NO: 2455761 - protein, 9 aa, Entamoeba dispar
QSISSDDSI

SEQ ID NO: 2455762 - protein, 4 aa, Entamoeba dispar
QSIV

SEQ ID NO: 2455763 - protein, 28 aa, Entamoeba dispar
QSKAIGSVSTVPRKKSENHSEELNQQKR

SEQ ID NO: 2455764 - protein, 15 aa, Entamoeba dispar
QSKDFDDGYIEKSTN

SEQ ID NO: 2455765 - protein, 8 aa, Entamoeba dispar
QSKEQEIK

SEQ ID NO: 2455766 - protein, 6 aa, Entamoeba dispar
QSKEVQ

SEQ ID NO: 2455767 - protein, 5 aa, Entamoeba dispar
QSKFS

SEQ ID NO: 2455768 - protein, 7 aa, Entamoeba dispar
QSKLNKN

SEQ ID NO: 2455769 - protein, 5 aa, Entamoeba dispar
QSKMD

SEQ ID NO: 2455770 - protein, 9 aa, Entamoeba dispar
QSKNGTLLP

SEQ ID NO: 2455771 - protein, 8 aa, Entamoeba dispar
QSKNNLKE

SEQ ID NO: 2455772 - protein, 9 aa, Entamoeba dispar
QSKNQQIQR

SEQ ID NO: 2455773 - protein, 5 aa, Entamoeba dispar
QSKNY

SEQ ID NO: 2455774 - protein, 19 aa, Entamoeba dispar
QSKPLPPKKNEKKSCCCLI

SEQ ID NO: 2455775 - protein, 12 aa, Entamoeba dispar
QSKPLSDKIPTA

SEQ ID NO: 2455776 - protein, 7 aa, Entamoeba dispar
QSKPQVK

SEQ ID NO: 2455777 - protein, 9 aa, Entamoeba dispar
QSKQKGDEE

SEQ ID NO: 2455778 - protein, 10 aa, Entamoeba dispar
QSKQNCVSSV

SEQ ID NO: 2455779 - protein, 14 aa, Entamoeba dispar
QSKQVNITGNEKCN

SEQ ID NO: 2455780 - protein, 4 aa, Entamoeba dispar
QSKR

SEQ ID NO: 2455781 - protein, 7 aa, Entamoeba dispar
QSKRSAG

SEQ ID NO: 2455782 - protein, 8 aa, Entamoeba dispar
QSKRTELI

SEQ ID NO: 2455783 - protein, 8 aa, Entamoeba dispar
QSKSEGLA

SEQ ID NO: 2455784 - protein, 8 aa, Entamoeba dispar
QSKSLTES

SEQ ID NO: 2455785 - protein, 4 aa, Entamoeba dispar
QSKT

SEQ ID NO: 2455786 - protein, 8 aa, Entamoeba dispar
QSKTRNGI

SEQ ID NO: 2455787 - protein, 6 aa, Entamoeba dispar
QSKTYN

SEQ ID NO: 2455788 - protein, 4 aa, Entamoeba dispar
QSKY

SEQ ID NO: 2455789 - protein, 9 aa, Entamoeba dispar
QSKYSEKAD

SEQ ID NO: 2455790 - protein, 4 aa, Entamoeba dispar
QSLD

SEQ ID NO: 2455791 - protein, 6 aa, Entamoeba dispar
QSLDQQ

SEQ ID NO: 2455792 - protein, 4 aa, Entamoeba dispar
QSLE

SEQ ID NO: 2455793 - protein, 13 aa, Entamoeba dispar
QSLEDEDQTLYNR

SEQ ID NO: 2455794 - protein, 6 aa, Entamoeba dispar
QSLEDN

SEQ ID NO: 2455795 - protein, 5 aa, Entamoeba dispar
QSLER

SEQ ID NO: 2455796 - protein, 22 aa, Entamoeba dispar
QSLESEPKQSTGDGISQTELKD

SEQ ID NO: 2455797 - protein, 19 aa, Entamoeba dispar
QSLGKQSVLSKEKSLLETK

SEQ ID NO: 2455798 - protein, 5 aa, Entamoeba dispar
QSLGT

SEQ ID NO: 2455799 - protein, 19 aa, Entamoeba dispar
QSLKELDSGIQRKEGNDLY

SEQ ID NO: 2455800 - protein, 4 aa, Entamoeba dispar
QSLL

SEQ ID NO: 2455801 - protein, 10 aa, Entamoeba dispar
QSLNDKNEGL

SEQ ID NO: 2455802 - protein, 4 aa, Entamoeba dispar
QSLP

SEQ ID NO: 2455803 - protein, 7 aa, Entamoeba dispar
QSLPDGQ

SEQ ID NO: 2455804 - protein, 11 aa, Entamoeba dispar
QSLPPQPKSID

SEQ ID NO: 2455805 - protein, 5 aa, Entamoeba dispar
QSLQD

SEQ ID NO: 2455806 - protein, 13 aa, Entamoeba dispar
QSLQEKTITYTTR

SEQ ID NO: 2455807 - protein, 29 aa, Entamoeba dispar
QSLQEKTVTYTTRGTQTLIPDTNYDGISK

SEQ ID NO: 2455808 - protein, 29 aa, Entamoeba dispar
QSLQEKTVTYTTRGTQTLLPDTNYDGISK

SEQ ID NO: 2455809 - protein, 67 aa, Entamoeba dispar
QSLQSANPSDNKSTISNINGDTVSYTSASMNTETKSVSQSCANNDTVSVTSLDKTEKETKKESKFRR

SEQ ID NO: 2455810 - protein, 16 aa, Entamoeba dispar
QSLQTSSSDLPPPPTF

SEQ ID NO: 2455811 - protein, 6 aa, Entamoeba dispar
QSLSET

SEQ ID NO: 2455812 - protein, 7 aa, Entamoeba dispar
QSLSNKT

SEQ ID NO: 2455813 - protein, 5 aa, Entamoeba dispar
QSLTN

SEQ ID NO: 2455814 - protein, 13 aa, Entamoeba dispar
QSLTSEDIEDCKV

SEQ ID NO: 2455815 - protein, 16 aa, Entamoeba dispar
QSLYGPNNKLTLKVII

SEQ ID NO: 2455816 - protein, 4 aa, Entamoeba dispar
QSND

SEQ ID NO: 2455817 - protein, 9 aa, Entamoeba dispar
QSNDWKDQF

SEQ ID NO: 2455818 - protein, 6 aa, Entamoeba dispar
QSNEFG

SEQ ID NO: 2455819 - protein, 13 aa, Entamoeba dispar
QSNEKPEARIQPD

SEQ ID NO: 2455820 - protein, 8 aa, Entamoeba dispar
QSNEMAGE

SEQ ID NO: 2455821 - protein, 9 aa, Entamoeba dispar
QSNEYYEKN

SEQ ID NO: 2455822 - protein, 11 aa, Entamoeba dispar
QSNFEKENQLN

SEQ ID NO: 2455823 - protein, 6 aa, Entamoeba dispar
QSNHTG

SEQ ID NO: 2455824 - protein, 18 aa, Entamoeba dispar
QSNIYKSKITKETVTQKD

SEQ ID NO: 2455825 - protein, 10 aa, Entamoeba dispar
QSNKEPNNNH

SEQ ID NO: 2455826 - protein, 7 aa, Entamoeba dispar
QSNKIRR

SEQ ID NO: 2455827 - protein, 8 aa, Entamoeba dispar
QSNKNEVD

SEQ ID NO: 2455828 - protein, 8 aa, Entamoeba dispar
QSNMYQTQ

SEQ ID NO: 2455829 - protein, 9 aa, Entamoeba dispar
QSNNEIKEI

SEQ ID NO: 2455830 - protein, 5 aa, Entamoeba dispar
QSNNH

SEQ ID NO: 2455831 - protein, 49 aa, Entamoeba dispar
QSNNKHDTTNSDLTKTEEETDAEEEEEEEYDEDGDPSEENNSDDSGSCI

SEQ ID NO: 2455832 - protein, 60 aa, Entamoeba dispar
QSNNNYLQSQQKTPRLESETKKKKGEYKTEPQPSVLSSPKDQQHKTKSKNSLLSKPTVPA

SEQ ID NO: 2455833 - protein, 8 aa, Entamoeba dispar
QSNNSSEL

SEQ ID NO: 2455834 - protein, 18 aa, Entamoeba dispar
QSNNWKDSLEKSIPLRYF

SEQ ID NO: 2455835 - protein, 7 aa, Entamoeba dispar
QSNPGKK

SEQ ID NO: 2455836 - protein, 8 aa, Entamoeba dispar
QSNPQSKV

SEQ ID NO: 2455837 - protein, 7 aa, Entamoeba dispar
QSNQDNI

SEQ ID NO: 2455838 - protein, 8 aa, Entamoeba dispar
QSNQKFNG

SEQ ID NO: 2455839 - protein, 10 aa, Entamoeba dispar
QSNQNDTFDP

SEQ ID NO: 2455840 - protein, 17 aa, Entamoeba dispar
QSNQQTINQQLEGTKDT

SEQ ID NO: 2455841 - protein, 30 aa, Entamoeba dispar
QSNSEKSTPRTLSPRQMGENKAKLESTKSG

SEQ ID NO: 2455842 - protein, 5 aa, Entamoeba dispar
QSNSM

SEQ ID NO: 2455843 - protein, 25 aa, Entamoeba dispar
QSNSQPTMTNQNKQISERKDKPKID

SEQ ID NO: 2455844 - protein, 18 aa, Entamoeba dispar
QSNTEKPEVTKPSPMITN

SEQ ID NO: 2455845 - protein, 8 aa, Entamoeba dispar
QSNTIEQP

SEQ ID NO: 2455846 - protein, 10 aa, Entamoeba dispar
QSPEEMKGYT

SEQ ID NO: 2455847 - protein, 8 aa, Entamoeba dispar
QSPFPVND

SEQ ID NO: 2455848 - protein, 8 aa, Entamoeba dispar
QSPGGISY

SEQ ID NO: 2455849 - protein, 4 aa, Entamoeba dispar
QSPH

SEQ ID NO: 2455850 - protein, 5 aa, Entamoeba dispar
QSPID

SEQ ID NO: 2455851 - protein, 7 aa, Entamoeba dispar
QSPIQAA

SEQ ID NO: 2455852 - protein, 12 aa, Entamoeba dispar
QSPITFSNELNF

SEQ ID NO: 2455853 - protein, 6 aa, Entamoeba dispar
QSPLKQ

SEQ ID NO: 2455854 - protein, 7 aa, Entamoeba dispar
QSPNELN

SEQ ID NO: 2455855 - protein, 6 aa, Entamoeba dispar
QSPNES

SEQ ID NO: 2455856 - protein, 6 aa, Entamoeba dispar
QSPNTI

SEQ ID NO: 2455857 - protein, 5 aa, Entamoeba dispar
QSPPH

SEQ ID NO: 2455858 - protein, 6 aa, Entamoeba dispar
QSPPIP

SEQ ID NO: 2455859 - protein, 6 aa, Entamoeba dispar
QSPQEI

SEQ ID NO: 2455860 - protein, 9 aa, Entamoeba dispar
QSPQRKQAE

SEQ ID NO: 2455861 - protein, 5 aa, Entamoeba dispar
QSPRN

SEQ ID NO: 2455862 - protein, 12 aa, Entamoeba dispar
QSPRPSLTPEQA

SEQ ID NO: 2455863 - protein, 8 aa, Entamoeba dispar
QSPSAAIS

SEQ ID NO: 2455864 - protein, 6 aa, Entamoeba dispar
QSPSDL

SEQ ID NO: 2455865 - protein, 18 aa, Entamoeba dispar
QSPSIKNESQKVQEIKKE

SEQ ID NO: 2455866 - protein, 8 aa, Entamoeba dispar
QSPSTVDS

SEQ ID NO: 2455867 - protein, 16 aa, Entamoeba dispar
QSPTAMDMNDGCFDYP

SEQ ID NO: 2455868 - protein, 17 aa, Entamoeba dispar
QSPTPNRRGQNGSRYNV

SEQ ID NO: 2455869 - protein, 16 aa, Entamoeba dispar
QSPTSSMKEYQLKKDY

SEQ ID NO: 2455870 - protein, 18 aa, Entamoeba dispar
QSPTTTTASSSITTTPRK

SEQ ID NO: 2455871 - protein, 8 aa, Entamoeba dispar
QSQDKQIA

SEQ ID NO: 2455872 - protein, 6 aa, Entamoeba dispar
QSQEDI

SEQ ID NO: 2455873 - protein, 8 aa, Entamoeba dispar
QSQEYVPS

SEQ ID NO: 2455874 - protein, 4 aa, Entamoeba dispar
QSQG

SEQ ID NO: 2455875 - protein, 6 aa, Entamoeba dispar
QSQGIN

SEQ ID NO: 2455876 - protein, 4 aa, Entamoeba dispar
QSQI

SEQ ID NO: 2455877 - protein, 34 aa, Entamoeba dispar
QSQIGQPQKDIWGNPAQSQIGQQQPNTQIQPQKD

SEQ ID NO: 2455878 - protein, 34 aa, Entamoeba dispar
QSQIGQPQKDIWGNPTQSQIGQQQPNTQIQPQKD

SEQ ID NO: 2455879 - protein, 4 aa, Entamoeba dispar
QSQN

SEQ ID NO: 2455880 - protein, 9 aa, Entamoeba dispar
QSQNEIQKE

SEQ ID NO: 2455881 - protein, 6 aa, Entamoeba dispar
QSQNGL

SEQ ID NO: 2455882 - protein, 9 aa, Entamoeba dispar
QSQSGSGKT

SEQ ID NO: 2455883 - protein, 6 aa, Entamoeba dispar
QSQSTL

SEQ ID NO: 2455884 - protein, 9 aa, Entamoeba dispar
QSQTGSGKT

SEQ ID NO: 2455885 - protein, 6 aa, Entamoeba dispar
QSQTQR

SEQ ID NO: 2455886 - protein, 7 aa, Entamoeba dispar
QSQTSTQ

SEQ ID NO: 2455887 - protein, 14 aa, Entamoeba dispar
QSQVKEKDRKISID

SEQ ID NO: 2455888 - protein, 22 aa, Entamoeba dispar
QSQVSDDIYQKSIKNKNYGNKL

SEQ ID NO: 2455889 - protein, 5 aa, Entamoeba dispar
QSRGL

SEQ ID NO: 2455890 - protein, 22 aa, Entamoeba dispar
QSRGSLSRKQPLGVSTSSPVLL

SEQ ID NO: 2455891 - protein, 9 aa, Entamoeba dispar
QSRKEKGYN

SEQ ID NO: 2455892 - protein, 9 aa, Entamoeba dispar
QSRKQEKSL

SEQ ID NO: 2455893 - protein, 11 aa, Entamoeba dispar
QSRKQTLMKQN

SEQ ID NO: 2455894 - protein, 13 aa, Entamoeba dispar
QSRKRSKNQPKPI

SEQ ID NO: 2455895 - protein, 4 aa, Entamoeba dispar
QSRS

SEQ ID NO: 2455896 - protein, 5 aa, Entamoeba dispar
QSRSA

SEQ ID NO: 2455897 - protein, 12 aa, Entamoeba dispar
QSSDYTSKSPFA

SEQ ID NO: 2455898 - protein, 4 aa, Entamoeba dispar
QSSE

SEQ ID NO: 2455899 - protein, 39 aa, Entamoeba dispar
QSSEDDGEEYDDEYNSENTEDGTYSNEQNEEDSQSQKEE

SEQ ID NO: 2455900 - protein, 20 aa, Entamoeba dispar
QSSEDDSKMECEEQDEVNGF

SEQ ID NO: 2455901 - protein, 26 aa, Entamoeba dispar
QSSEEKHKIDEFEKQKSEKEERLNEL

SEQ ID NO: 2455902 - protein, 13 aa, Entamoeba dispar
QSSEEPKTNKDIQ

SEQ ID NO: 2455903 - protein, 11 aa, Entamoeba dispar
QSSEHLPTSST

SEQ ID NO: 2455904 - protein, 8 aa, Entamoeba dispar
QSSESVNS

SEQ ID NO: 2455905 - protein, 20 aa, Entamoeba dispar
QSSESVSKCATQPQTPCNPA

SEQ ID NO: 2455906 - protein, 6 aa, Entamoeba dispar
QSSFRA

SEQ ID NO: 2455907 - protein, 7 aa, Entamoeba dispar
QSSGSGL

SEQ ID NO: 2455908 - protein, 11 aa, Entamoeba dispar
QSSIQTHKRSS

SEQ ID NO: 2455909 - protein, 6 aa, Entamoeba dispar
QSSLDN

SEQ ID NO: 2455910 - protein, 6 aa, Entamoeba dispar
QSSLLP

SEQ ID NO: 2455911 - protein, 10 aa, Entamoeba dispar
QSSLPGVQRN

SEQ ID NO: 2455912 - protein, 14 aa, Entamoeba dispar
QSSLQNELNTTSPD

SEQ ID NO: 2455913 - protein, 5 aa, Entamoeba dispar
QSSLR

SEQ ID NO: 2455914 - protein, 10 aa, Entamoeba dispar
QSSNDTINKK

SEQ ID NO: 2455915 - protein, 8 aa, Entamoeba dispar
QSSNPTYS

SEQ ID NO: 2455916 - protein, 18 aa, Entamoeba dispar
QSSNTSVSQSPKPSSSAS

SEQ ID NO: 2455917 - protein, 7 aa, Entamoeba dispar
QSSPIPI

SEQ ID NO: 2455918 - protein, 7 aa, Entamoeba dispar
QSSPNER

SEQ ID NO: 2455919 - protein, 9 aa, Entamoeba dispar
QSSPNNSFS

SEQ ID NO: 2455920 - protein, 18 aa, Entamoeba dispar
QSSPSYQSNHGPLDQQSL

SEQ ID NO: 2455921 - protein, 5 aa, Entamoeba dispar
QSSQF

SEQ ID NO: 2455922 - protein, 12 aa, Entamoeba dispar
QSSQQKIKKEKI

SEQ ID NO: 2455923 - protein, 8 aa, Entamoeba dispar
QSSQSIDD

SEQ ID NO: 2455924 - protein, 7 aa, Entamoeba dispar
QSSRGDI

SEQ ID NO: 2455925 - protein, 9 aa, Entamoeba dispar
QSSSETKEK

SEQ ID NO: 2455926 - protein, 10 aa, Entamoeba dispar
QSSSGNEPNA

SEQ ID NO: 2455927 - protein, 10 aa, Entamoeba dispar
QSSSPSNDLS

SEQ ID NO: 2455928 - protein, 6 aa, Entamoeba dispar
QSSSSL

SEQ ID NO: 2455929 - protein, 7 aa, Entamoeba dispar
QSSSTCT

SEQ ID NO: 2455930 - protein, 6 aa, Entamoeba dispar
QSSTNL

SEQ ID NO: 2455931 - protein, 17 aa, Entamoeba dispar
QSSTQRPLPPTPTPQQL

SEQ ID NO: 2455932 - protein, 8 aa, Entamoeba dispar
QSSVSELG

SEQ ID NO: 2455933 - protein, 6 aa, Entamoeba dispar
QSTAQT

SEQ ID NO: 2455934 - protein, 8 aa, Entamoeba dispar
QSTASPSL

SEQ ID NO: 2455935 - protein, 6 aa, Entamoeba dispar
QSTAVS

SEQ ID NO: 2455936 - protein, 7 aa, Entamoeba dispar
QSTEPPM

SEQ ID NO: 2455937 - protein, 9 aa, Entamoeba dispar
QSTEPSQLD

SEQ ID NO: 2455938 - protein, 30 aa, Entamoeba dispar
QSTEVPPLTGPHSKTPNIEVPSSPSVSSAV

SEQ ID NO: 2455939 - protein, 7 aa, Entamoeba dispar
QSTFENT

SEQ ID NO: 2455940 - protein, 7 aa, Entamoeba dispar
QSTFQSK

SEQ ID NO: 2455941 - protein, 4 aa, Entamoeba dispar
QSTG

SEQ ID NO: 2455942 - protein, 10 aa, Entamoeba dispar
QSTGGITAQL

SEQ ID NO: 2455943 - protein, 6 aa, Entamoeba dispar
QSTHLS

SEQ ID NO: 2455944 - protein, 12 aa, Entamoeba dispar
QSTISKSPIVNR

SEQ ID NO: 2455945 - protein, 8 aa, Entamoeba dispar
QSTKPNDN

SEQ ID NO: 2455946 - protein, 6 aa, Entamoeba dispar
QSTKSA

SEQ ID NO: 2455947 - protein, 8 aa, Entamoeba dispar
QSTKSTVH

SEQ ID NO: 2455948 - protein, 6 aa, Entamoeba dispar
QSTKYG

SEQ ID NO: 2455949 - protein, 8 aa, Entamoeba dispar
QSTMNRQD

SEQ ID NO: 2455950 - protein, 4 aa, Entamoeba dispar
QSTN

SEQ ID NO: 2455951 - protein, 7 aa, Entamoeba dispar
QSTNNEI

SEQ ID NO: 2455952 - protein, 60 aa, Entamoeba dispar
QSTSFTPQSTVPQQPTQSNVTSSTQTTSIPTQKENNTQTKQPTQQNKPSQPKPSVQADDW

SEQ ID NO: 2455953 - protein, 18 aa, Entamoeba dispar
QSTTHIKGSGYYKSTDGE

SEQ ID NO: 2455954 - protein, 68 aa, Entamoeba dispar
QSTTIKESNKKELEKQKAKEEEEKRKQEQLEAEAKRKKEEEDNKKKAEEEKERIKEETRRKREQERQR

SEQ ID NO: 2455955 - protein, 8 aa, Entamoeba dispar
QSTTKPYI

SEQ ID NO: 2455956 - protein, 42 aa, Entamoeba dispar
QSTTNILNEPEKKINNQTKKKNQSHQQEKSFTNKNNNPKINE

SEQ ID NO: 2455957 - protein, 5 aa, Entamoeba dispar
QSTTQ

SEQ ID NO: 2455958 - protein, 18 aa, Entamoeba dispar
QSTTSSASFIRPTEDNGW

SEQ ID NO: 2455959 - protein, 6 aa, Entamoeba dispar
QSTTTS

SEQ ID NO: 2455960 - protein, 7 aa, Entamoeba dispar
QSTTYEE

SEQ ID NO: 2455961 - protein, 26 aa, Entamoeba dispar
QSTVEEQPKQKEPSPQPSVTEPPVPA

SEQ ID NO: 2455962 - protein, 9 aa, Entamoeba dispar
QSVEKTQDV

SEQ ID NO: 2455963 - protein, 19 aa, Entamoeba dispar
QSVEQSSESNSMSSFTDEE

SEQ ID NO: 2455964 - protein, 7 aa, Entamoeba dispar
QSVGKTC

SEQ ID NO: 2455965 - protein, 8 aa, Entamoeba dispar
QSVGKTSL

SEQ ID NO: 2455966 - protein, 7 aa, Entamoeba dispar
QSVGKTT

SEQ ID NO: 2455967 - protein, 9 aa, Entamoeba dispar
QSVKESLKN

SEQ ID NO: 2455968 - protein, 19 aa, Entamoeba dispar
QSVKSSQINECRNREASFS

SEQ ID NO: 2455969 - protein, 9 aa, Entamoeba dispar
QSVSNQQQA

SEQ ID NO: 2455970 - protein, 5 aa, Entamoeba dispar
QSVTS

SEQ ID NO: 2455971 - protein, 6 aa, Entamoeba dispar
QSVTSR

SEQ ID NO: 2455972 - protein, 6 aa, Entamoeba dispar
QSVVGN

SEQ ID NO: 2455973 - protein, 9 aa, Entamoeba dispar
QSWKGTKEV

SEQ ID NO: 2455974 - protein, 8 aa, Entamoeba dispar
QSWQQTSD

SEQ ID NO: 2455975 - protein, 19 aa, Entamoeba dispar
QSWRKSTDQLPSSSISPPV

SEQ ID NO: 2455976 - protein, 12 aa, Entamoeba dispar
QSYEEKFGNGEI

SEQ ID NO: 2455977 - protein, 21 aa, Entamoeba dispar
QSYEKDQKILKEQKDEKENGV

SEQ ID NO: 2455978 - protein, 12 aa, Entamoeba dispar
QSYENKSPKQPF

SEQ ID NO: 2455979 - protein, 25 aa, Entamoeba dispar
QSYGTQQGNTAQERDQNSESNNYDS

SEQ ID NO: 2455980 - protein, 8 aa, Entamoeba dispar
QSYNNKYS

SEQ ID NO: 2455981 - protein, 26 aa, Entamoeba dispar
QSYQGPSQPPQYQSYGQSQYSGAPPM

SEQ ID NO: 2455982 - protein, 6 aa, Entamoeba dispar
QSYSSE

SEQ ID NO: 2455983 - protein, 4 aa, Entamoeba dispar
QSYT

SEQ ID NO: 2455984 - protein, 6 aa, Entamoeba dispar
QSYYRK

SEQ ID NO: 2455985 - protein, 5 aa, Entamoeba dispar
QTAEI

SEQ ID NO: 2455986 - protein, 20 aa, Entamoeba dispar
QTAITTGRIQSKNPNLQQIP

SEQ ID NO: 2455987 - protein, 6 aa, Entamoeba dispar
QTAKTS

SEQ ID NO: 2455988 - protein, 7 aa, Entamoeba dispar
QTAPKQV

SEQ ID NO: 2455989 - protein, 16 aa, Entamoeba dispar
QTAQEENPNSESNDNC

SEQ ID NO: 2455990 - protein, 7 aa, Entamoeba dispar
QTARNNL

SEQ ID NO: 2455991 - protein, 4 aa, Entamoeba dispar
QTAT

SEQ ID NO: 2455992 - protein, 14 aa, Entamoeba dispar
QTATAKSFSPSIGM

SEQ ID NO: 2455993 - protein, 15 aa, Entamoeba dispar
QTATGGLNGRPEKLP

SEQ ID NO: 2455994 - protein, 22 aa, Entamoeba dispar
QTAYGEGNRGYNAAQNYKEGKQ

SEQ ID NO: 2455995 - protein, 27 aa, Entamoeba dispar
QTCGKGDKRIAKPRTRIETSSEVSEQI

SEQ ID NO: 2455996 - protein, 9 aa, Entamoeba dispar
QTCQTDNIE

SEQ ID NO: 2455997 - protein, 11 aa, Entamoeba dispar
QTDDTFGYRPT

SEQ ID NO: 2455998 - protein, 15 aa, Entamoeba dispar
QTDEKYKSYPKDPCE

SEQ ID NO: 2455999 - protein, 5 aa, Entamoeba dispar
QTDER

SEQ ID NO: 2456000 - protein, 4 aa, Entamoeba dispar
QTDI

SEQ ID NO: 2456001 - protein, 12 aa, Entamoeba dispar
QTDIRAANENTD

SEQ ID NO: 2456002 - protein, 11 aa, Entamoeba dispar
QTDKGSVQTVT

SEQ ID NO: 2456003 - protein, 8 aa, Entamoeba dispar
QTDNETRC

SEQ ID NO: 2456004 - protein, 6 aa, Entamoeba dispar
QTDQIS

SEQ ID NO: 2456005 - protein, 9 aa, Entamoeba dispar
QTDSKEVEV

SEQ ID NO: 2456006 - protein, 18 aa, Entamoeba dispar
QTDSKGIETDDKGEVVSG

SEQ ID NO: 2456007 - protein, 21 aa, Entamoeba dispar
QTDSKSKILRRKKSSSKLLSS

SEQ ID NO: 2456008 - protein, 7 aa, Entamoeba dispar
QTDSLKE

SEQ ID NO: 2456009 - protein, 10 aa, Entamoeba dispar
QTDSTEENIE

SEQ ID NO: 2456010 - protein, 17 aa, Entamoeba dispar
QTDTHWPNKINESRQEL

SEQ ID NO: 2456011 - protein, 5 aa, Entamoeba dispar
QTDTL

SEQ ID NO: 2456012 - protein, 8 aa, Entamoeba dispar
QTEEELRR

SEQ ID NO: 2456013 - protein, 13 aa, Entamoeba dispar
QTEGDRSGTDVPR

SEQ ID NO: 2456014 - protein, 8 aa, Entamoeba dispar
QTEGFSGS

SEQ ID NO: 2456015 - protein, 8 aa, Entamoeba dispar
QTEGGQTA

SEQ ID NO: 2456016 - protein, 7 aa, Entamoeba dispar
QTEGKGI

SEQ ID NO: 2456017 - protein, 10 aa, Entamoeba dispar
QTEKLAKGEV

SEQ ID NO: 2456018 - protein, 8 aa, Entamoeba dispar
QTEKSNEC

SEQ ID NO: 2456019 - protein, 17 aa, Entamoeba dispar
QTENDEKKSGYKERIEG

SEQ ID NO: 2456020 - protein, 25 aa, Entamoeba dispar
QTENEEKEKPTIPTRKSKRGNPFRR

SEQ ID NO: 2456021 - protein, 8 aa, Entamoeba dispar
QTENKREK

SEQ ID NO: 2456022 - protein, 9 aa, Entamoeba dispar
QTENKREKL

SEQ ID NO: 2456023 - protein, 4 aa, Entamoeba dispar
QTEP

SEQ ID NO: 2456024 - protein, 5 aa, Entamoeba dispar
QTEPL

SEQ ID NO: 2456025 - protein, 6 aa, Entamoeba dispar
QTEQIP

SEQ ID NO: 2456026 - protein, 9 aa, Entamoeba dispar
QTEQMSKEL

SEQ ID NO: 2456027 - protein, 13 aa, Entamoeba dispar
QTEQQYLQTEQQY

SEQ ID NO: 2456028 - protein, 4 aa, Entamoeba dispar
QTES

SEQ ID NO: 2456029 - protein, 7 aa, Entamoeba dispar
QTESDVR

SEQ ID NO: 2456030 - protein, 11 aa, Entamoeba dispar
QTESEEEEEKL

SEQ ID NO: 2456031 - protein, 6 aa, Entamoeba dispar
QTESGI

SEQ ID NO: 2456032 - protein, 7 aa, Entamoeba dispar
QTESGTR

SEQ ID NO: 2456033 - protein, 15 aa, Entamoeba dispar
QTESNEEKKKIKKAQ

SEQ ID NO: 2456034 - protein, 6 aa, Entamoeba dispar
QTESSI

SEQ ID NO: 2456035 - protein, 36 aa, Entamoeba dispar
QTETEEVQESSKQEITKDIETPSSKINTNNNNPSPA

SEQ ID NO: 2456036 - protein, 12 aa, Entamoeba dispar
QTETGKQALEKG

SEQ ID NO: 2456037 - protein, 18 aa, Entamoeba dispar
QTEYQNNNITQPKRNTQY

SEQ ID NO: 2456038 - protein, 6 aa, Entamoeba dispar
QTFNEN

SEQ ID NO: 2456039 - protein, 5 aa, Entamoeba dispar
QTFPD

SEQ ID NO: 2456040 - protein, 12 aa, Entamoeba dispar
QTFSDKKFNPLN

SEQ ID NO: 2456041 - protein, 12 aa, Entamoeba dispar
QTFSDKNFNPLS

SEQ ID NO: 2456042 - protein, 11 aa, Entamoeba dispar
QTFSDNNFNPL

SEQ ID NO: 2456043 - protein, 8 aa, Entamoeba dispar
QTGEGRIR

SEQ ID NO: 2456044 - protein, 7 aa, Entamoeba dispar
QTGEPAI

SEQ ID NO: 2456045 - protein, 15 aa, Entamoeba dispar
QTGHNPALVQNFTSE

SEQ ID NO: 2456046 - protein, 4 aa, Entamoeba dispar
QTGI

SEQ ID NO: 2456047 - protein, 5 aa, Entamoeba dispar
QTGKI

SEQ ID NO: 2456048 - protein, 14 aa, Entamoeba dispar
QTGKTGKKPVGQDD

SEQ ID NO: 2456049 - protein, 4 aa, Entamoeba dispar
QTGN

SEQ ID NO: 2456050 - protein, 5 aa, Entamoeba dispar
QTGNE

SEQ ID NO: 2456051 - protein, 7 aa, Entamoeba dispar
QTGRKES

SEQ ID NO: 2456052 - protein, 14 aa, Entamoeba dispar
QTGSGKTTLLNSFI

SEQ ID NO: 2456053 - protein, 6 aa, Entamoeba dispar
QTGSLP

SEQ ID NO: 2456054 - protein, 6 aa, Entamoeba dispar
QTGVTL

SEQ ID NO: 2456055 - protein, 5 aa, Entamoeba dispar
QTHDN

SEQ ID NO: 2456056 - protein, 4 aa, Entamoeba dispar
QTHL

SEQ ID NO: 2456057 - protein, 8 aa, Entamoeba dispar
QTHNSQNK

SEQ ID NO: 2456058 - protein, 12 aa, Entamoeba dispar
QTHQELNQSQTQ

SEQ ID NO: 2456059 - protein, 9 aa, Entamoeba dispar
QTHSPYQTR

SEQ ID NO: 2456060 - protein, 5 aa, Entamoeba dispar
QTIDP

SEQ ID NO: 2456061 - protein, 4 aa, Entamoeba dispar
QTIE

SEQ ID NO: 2456062 - protein, 5 aa, Entamoeba dispar
QTIEE

SEQ ID NO: 2456063 - protein, 5 aa, Entamoeba dispar
QTIEN

SEQ ID NO: 2456064 - protein, 26 aa, Entamoeba dispar
QTIEYTEDSEDKIISSSRTNSQIEPN

SEQ ID NO: 2456065 - protein, 14 aa, Entamoeba dispar
QTIGKHDRMQDTSN

SEQ ID NO: 2456066 - protein, 4 aa, Entamoeba dispar
QTIK

SEQ ID NO: 2456067 - protein, 8 aa, Entamoeba dispar
QTIKSAQE

SEQ ID NO: 2456068 - protein, 5 aa, Entamoeba dispar
QTINA

SEQ ID NO: 2456069 - protein, 13 aa, Entamoeba dispar
QTINEKEKIASLE

SEQ ID NO: 2456070 - protein, 12 aa, Entamoeba dispar
QTINGKNIEKKD

SEQ ID NO: 2456071 - protein, 5 aa, Entamoeba dispar
QTINN

SEQ ID NO: 2456072 - protein, 4 aa, Entamoeba dispar
QTIP

SEQ ID NO: 2456073 - protein, 19 aa, Entamoeba dispar
QTIQAEEEEEDLENIPEQT

SEQ ID NO: 2456074 - protein, 5 aa, Entamoeba dispar
QTIQD

SEQ ID NO: 2456075 - protein, 8 aa, Entamoeba dispar
QTIQEQNN

SEQ ID NO: 2456076 - protein, 34 aa, Entamoeba dispar
QTIQQQQNQINELTRKKEETSKEDMEKIPPTLEE

SEQ ID NO: 2456077 - protein, 6 aa, Entamoeba dispar
QTIQRG

SEQ ID NO: 2456078 - protein, 19 aa, Entamoeba dispar
QTIQSQRTGIKEISDTDKF

SEQ ID NO: 2456079 - protein, 8 aa, Entamoeba dispar
QTISGEKF

SEQ ID NO: 2456080 - protein, 10 aa, Entamoeba dispar
QTISQQPKDI

SEQ ID NO: 2456081 - protein, 13 aa, Entamoeba dispar
QTISRESKSKITK

SEQ ID NO: 2456082 - protein, 4 aa, Entamoeba dispar
QTIT

SEQ ID NO: 2456083 - protein, 21 aa, Entamoeba dispar
QTKCNPKNKRLVKRDEKCDKE

SEQ ID NO: 2456084 - protein, 7 aa, Entamoeba dispar
QTKDFGR

SEQ ID NO: 2456085 - protein, 9 aa, Entamoeba dispar
QTKDSYQYS

SEQ ID NO: 2456086 - protein, 7 aa, Entamoeba dispar
QTKDTKY

SEQ ID NO: 2456087 - protein, 36 aa, Entamoeba dispar
QTKEDKSKQSGAFSRTKPSDLESQIDELKREKEYLQ

SEQ ID NO: 2456088 - protein, 11 aa, Entamoeba dispar
QTKEGIGKKPV

SEQ ID NO: 2456089 - protein, 6 aa, Entamoeba dispar
QTKEIT

SEQ ID NO: 2456090 - protein, 8 aa, Entamoeba dispar
QTKEKEPL

SEQ ID NO: 2456091 - protein, 6 aa, Entamoeba dispar
QTKGDS

SEQ ID NO: 2456092 - protein, 8 aa, Entamoeba dispar
QTKHAEKT

SEQ ID NO: 2456093 - protein, 37 aa, Entamoeba dispar
QTKHDSVLDDDPKMKRGLDDESSEDYSSSEDENDPEY

SEQ ID NO: 2456094 - protein, 9 aa, Entamoeba dispar
QTKKAKLTE

SEQ ID NO: 2456095 - protein, 8 aa, Entamoeba dispar
QTKKEIDS

SEQ ID NO: 2456096 - protein, 15 aa, Entamoeba dispar
QTKKKKQNKKITGFR

SEQ ID NO: 2456097 - protein, 6 aa, Entamoeba dispar
QTKKPT

SEQ ID NO: 2456098 - protein, 6 aa, Entamoeba dispar
QTKLQI

SEQ ID NO: 2456099 - protein, 7 aa, Entamoeba dispar
QTKNDEV

SEQ ID NO: 2456100 - protein, 7 aa, Entamoeba dispar
QTKQEEM

SEQ ID NO: 2456101 - protein, 8 aa, Entamoeba dispar
QTKQEGIS

SEQ ID NO: 2456102 - protein, 7 aa, Entamoeba dispar
QTKQSGE

SEQ ID NO: 2456103 - protein, 6 aa, Entamoeba dispar
QTKQTE

SEQ ID NO: 2456104 - protein, 4 aa, Entamoeba dispar
QTKT

SEQ ID NO: 2456105 - protein, 9 aa, Entamoeba dispar
QTKVNSQST

SEQ ID NO: 2456106 - protein, 10 aa, Entamoeba dispar
QTLDSSSNYD

SEQ ID NO: 2456107 - protein, 10 aa, Entamoeba dispar
QTLGEEQSMK

SEQ ID NO: 2456108 - protein, 7 aa, Entamoeba dispar
QTLKQQN

SEQ ID NO: 2456109 - protein, 6 aa, Entamoeba dispar
QTLKSQ

SEQ ID NO: 2456110 - protein, 4 aa, Entamoeba dispar
QTLN

SEQ ID NO: 2456111 - protein, 5 aa, Entamoeba dispar
QTLNE

SEQ ID NO: 2456112 - protein, 12 aa, Entamoeba dispar
QTLNSKDYQKMA

SEQ ID NO: 2456113 - protein, 4 aa, Entamoeba dispar
QTLP

SEQ ID NO: 2456114 - protein, 8 aa, Entamoeba dispar
QTLPSKIN

SEQ ID NO: 2456115 - protein, 29 aa, Entamoeba dispar
QTLQEKTVTYTTRGTQTLIPDTNYDGISK

SEQ ID NO: 2456116 - protein, 6 aa, Entamoeba dispar
QTLQPI

SEQ ID NO: 2456117 - protein, 11 aa, Entamoeba dispar
QTLRDNGGHME

SEQ ID NO: 2456118 - protein, 45 aa, Entamoeba dispar
QTNAPKDLPTQQIKREEEKEEDSTIKKDKKTNEETKEYHKKVTSV

SEQ ID NO: 2456119 - protein, 28 aa, Entamoeba dispar
QTNAQSNGFTGFGNTTGFGQTNTQTNGL

SEQ ID NO: 2456120 - protein, 7 aa, Entamoeba dispar
QTNEGNW

SEQ ID NO: 2456121 - protein, 5 aa, Entamoeba dispar
QTNGG

SEQ ID NO: 2456122 - protein, 11 aa, Entamoeba dispar
QTNGLTSIPAV

SEQ ID NO: 2456123 - protein, 5 aa, Entamoeba dispar
QTNGN

SEQ ID NO: 2456124 - protein, 8 aa, Entamoeba dispar
QTNGQQPF

SEQ ID NO: 2456125 - protein, 6 aa, Entamoeba dispar
QTNGRP

SEQ ID NO: 2456126 - protein, 10 aa, Entamoeba dispar
QTNGSTLPQN

SEQ ID NO: 2456127 - protein, 6 aa, Entamoeba dispar
QTNIEQ

SEQ ID NO: 2456128 - protein, 10 aa, Entamoeba dispar
QTNIKDKGLS

SEQ ID NO: 2456129 - protein, 10 aa, Entamoeba dispar
QTNKIKPPKI

SEQ ID NO: 2456130 - protein, 10 aa, Entamoeba dispar
QTNKITENEV

SEQ ID NO: 2456131 - protein, 5 aa, Entamoeba dispar
QTNKQ

SEQ ID NO: 2456132 - protein, 9 aa, Entamoeba dispar
QTNKTNENI

SEQ ID NO: 2456133 - protein, 5 aa, Entamoeba dispar
QTNKY

SEQ ID NO: 2456134 - protein, 10 aa, Entamoeba dispar
QTNNKLPELQ

SEQ ID NO: 2456135 - protein, 6 aa, Entamoeba dispar
QTNNYT

SEQ ID NO: 2456136 - protein, 6 aa, Entamoeba dispar
QTNPEE

SEQ ID NO: 2456137 - protein, 7 aa, Entamoeba dispar
QTNPKSS

SEQ ID NO: 2456138 - protein, 6 aa, Entamoeba dispar
QTNPNI

SEQ ID NO: 2456139 - protein, 17 aa, Entamoeba dispar
QTNSTKNNKKYKHGGSN

SEQ ID NO: 2456140 - protein, 9 aa, Entamoeba dispar
QTNTDEIRK

SEQ ID NO: 2456141 - protein, 11 aa, Entamoeba dispar
QTNTKKNTRCG

SEQ ID NO: 2456142 - protein, 6 aa, Entamoeba dispar
QTNYES

SEQ ID NO: 2456143 - protein, 10 aa, Entamoeba dispar
QTNYSTPEQT

SEQ ID NO: 2456144 - protein, 6 aa, Entamoeba dispar
QTPADN

SEQ ID NO: 2456145 - protein, 4 aa, Entamoeba dispar
QTPD

SEQ ID NO: 2456146 - protein, 4 aa, Entamoeba dispar
QTPE

SEQ ID NO: 2456147 - protein, 8 aa, Entamoeba dispar
QTPEQPMS

SEQ ID NO: 2456148 - protein, 8 aa, Entamoeba dispar
QTPFEEDD

SEQ ID NO: 2456149 - protein, 4 aa, Entamoeba dispar
QTPG

SEQ ID NO: 2456150 - protein, 5 aa, Entamoeba dispar
QTPHN

SEQ ID NO: 2456151 - protein, 10 aa, Entamoeba dispar
QTPHSHPDYP

SEQ ID NO: 2456152 - protein, 5 aa, Entamoeba dispar
QTPKE

SEQ ID NO: 2456153 - protein, 18 aa, Entamoeba dispar
QTPKGEKKKEKEIEQPSI

SEQ ID NO: 2456154 - protein, 9 aa, Entamoeba dispar
QTPKKIQPY

SEQ ID NO: 2456155 - protein, 4 aa, Entamoeba dispar
QTPN

SEQ ID NO: 2456156 - protein, 17 aa, Entamoeba dispar
QTPNDPPRKSSFVGTPE

SEQ ID NO: 2456157 - protein, 7 aa, Entamoeba dispar
QTPPPFE

SEQ ID NO: 2456158 - protein, 6 aa, Entamoeba dispar
QTPPYL

SEQ ID NO: 2456159 - protein, 9 aa, Entamoeba dispar
QTPQETACD

SEQ ID NO: 2456160 - protein, 5 aa, Entamoeba dispar
QTPQS

SEQ ID NO: 2456161 - protein, 8 aa, Entamoeba dispar
QTPSEDSL

SEQ ID NO: 2456162 - protein, 9 aa, Entamoeba dispar
QTPSLQPGT

SEQ ID NO: 2456163 - protein, 5 aa, Entamoeba dispar
QTPSV

SEQ ID NO: 2456164 - protein, 5 aa, Entamoeba dispar
QTPYQ

SEQ ID NO: 2456165 - protein, 12 aa, Entamoeba dispar
QTQAAKTHIGTT

SEQ ID NO: 2456166 - protein, 6 aa, Entamoeba dispar
QTQEAN

SEQ ID NO: 2456167 - protein, 13 aa, Entamoeba dispar
QTQESEKDENQVI

SEQ ID NO: 2456168 - protein, 6 aa, Entamoeba dispar
QTQGEM

SEQ ID NO: 2456169 - protein, 6 aa, Entamoeba dispar
QTQKES

SEQ ID NO: 2456170 - protein, 13 aa, Entamoeba dispar
QTQKSEKDENQVI

SEQ ID NO: 2456171 - protein, 6 aa, Entamoeba dispar
QTQNSS

SEQ ID NO: 2456172 - protein, 28 aa, Entamoeba dispar
QTQPKTPSERAEANKKAKAALKKDISDL

SEQ ID NO: 2456173 - protein, 6 aa, Entamoeba dispar
QTQPNK

SEQ ID NO: 2456174 - protein, 9 aa, Entamoeba dispar
QTQQASNQK

SEQ ID NO: 2456175 - protein, 9 aa, Entamoeba dispar
QTQQATRQV

SEQ ID NO: 2456176 - protein, 7 aa, Entamoeba dispar
QTQQPFQ

SEQ ID NO: 2456177 - protein, 6 aa, Entamoeba dispar
QTQQQL

SEQ ID NO: 2456178 - protein, 16 aa, Entamoeba dispar
QTQQYYNSRPQTITTS

SEQ ID NO: 2456179 - protein, 13 aa, Entamoeba dispar
QTQTARKPAKTGW

SEQ ID NO: 2456180 - protein, 7 aa, Entamoeba dispar
QTQTEPH

SEQ ID NO: 2456181 - protein, 8 aa, Entamoeba dispar
QTQVEATG

SEQ ID NO: 2456182 - protein, 7 aa, Entamoeba dispar
QTRAPSL

SEQ ID NO: 2456183 - protein, 5 aa, Entamoeba dispar
QTREE

SEQ ID NO: 2456184 - protein, 8 aa, Entamoeba dispar
QTRGIRES

SEQ ID NO: 2456185 - protein, 6 aa, Entamoeba dispar
QTRGPT

SEQ ID NO: 2456186 - protein, 6 aa, Entamoeba dispar
QTRGVY

SEQ ID NO: 2456187 - protein, 15 aa, Entamoeba dispar
QTRIKQENQYPPMQG

SEQ ID NO: 2456188 - protein, 9 aa, Entamoeba dispar
QTRINRRRI

SEQ ID NO: 2456189 - protein, 11 aa, Entamoeba dispar
QTRKNSKTAKD

SEQ ID NO: 2456190 - protein, 7 aa, Entamoeba dispar
QTRNGTG

SEQ ID NO: 2456191 - protein, 11 aa, Entamoeba dispar
QTRQQRSTLNP

SEQ ID NO: 2456192 - protein, 10 aa, Entamoeba dispar
QTRRPIGTPG

SEQ ID NO: 2456193 - protein, 5 aa, Entamoeba dispar
QTRTA

SEQ ID NO: 2456194 - protein, 9 aa, Entamoeba dispar
QTRTLNDKN

SEQ ID NO: 2456195 - protein, 6 aa, Entamoeba dispar
QTRTSL

SEQ ID NO: 2456196 - protein, 8 aa, Entamoeba dispar
QTRYKGWP

SEQ ID NO: 2456197 - protein, 7 aa, Entamoeba dispar
QTSDSQK

SEQ ID NO: 2456198 - protein, 20 aa, Entamoeba dispar
QTSEVQSSTTPQSEKLSTKN

SEQ ID NO: 2456199 - protein, 9 aa, Entamoeba dispar
QTSFSESKS

SEQ ID NO: 2456200 - protein, 4 aa, Entamoeba dispar
QTSK

SEQ ID NO: 2456201 - protein, 5 aa, Entamoeba dispar
QTSKM

SEQ ID NO: 2456202 - protein, 16 aa, Entamoeba dispar
QTSKSSPVTPELPNSY

SEQ ID NO: 2456203 - protein, 15 aa, Entamoeba dispar
QTSLNKSLKGVNNNK

SEQ ID NO: 2456204 - protein, 9 aa, Entamoeba dispar
QTSMNQPDF

SEQ ID NO: 2456205 - protein, 7 aa, Entamoeba dispar
QTSNAKE

SEQ ID NO: 2456206 - protein, 13 aa, Entamoeba dispar
QTSPTFNNPPLVP

SEQ ID NO: 2456207 - protein, 7 aa, Entamoeba dispar
QTSQQKR

SEQ ID NO: 2456208 - protein, 7 aa, Entamoeba dispar
QTSSNWD

SEQ ID NO: 2456209 - protein, 14 aa, Entamoeba dispar
QTSTKEGTNTPSWN

SEQ ID NO: 2456210 - protein, 6 aa, Entamoeba dispar
QTSVDS

SEQ ID NO: 2456211 - protein, 5 aa, Entamoeba dispar
QTSVP

SEQ ID NO: 2456212 - protein, 5 aa, Entamoeba dispar
QTSVY

SEQ ID NO: 2456213 - protein, 13 aa, Entamoeba dispar
QTTAPPPPQQEHQ

SEQ ID NO: 2456214 - protein, 4 aa, Entamoeba dispar
QTTD

SEQ ID NO: 2456215 - protein, 5 aa, Entamoeba dispar
QTTEA

SEQ ID NO: 2456216 - protein, 22 aa, Entamoeba dispar
QTTEQKEKKREEEKPKRNNNFK

SEQ ID NO: 2456217 - protein, 11 aa, Entamoeba dispar
QTTESSPIPDL

SEQ ID NO: 2456218 - protein, 70 aa, Entamoeba dispar
QTTGVGITDEKEKDFPQPKRKVLNEKKGTKKTNISKKTYPVDEEDEKSEREKQRNQEKITEQVKRESEKC

SEQ ID NO: 2456219 - protein, 20 aa, Entamoeba dispar
QTTIGNSNGGATTSVNISGG

SEQ ID NO: 2456220 - protein, 6 aa, Entamoeba dispar
QTTIKT

SEQ ID NO: 2456221 - protein, 20 aa, Entamoeba dispar
QTTISKPKEETQQDKKEEHF

SEQ ID NO: 2456222 - protein, 4 aa, Entamoeba dispar
QTTN

SEQ ID NO: 2456223 - protein, 5 aa, Entamoeba dispar
QTTNG

SEQ ID NO: 2456224 - protein, 7 aa, Entamoeba dispar
QTTPRNP

SEQ ID NO: 2456225 - protein, 7 aa, Entamoeba dispar
QTTQGDI

SEQ ID NO: 2456226 - protein, 7 aa, Entamoeba dispar
QTTQQPL

SEQ ID NO: 2456227 - protein, 7 aa, Entamoeba dispar
QTTQSSV

SEQ ID NO: 2456228 - protein, 6 aa, Entamoeba dispar
QTTSKI

SEQ ID NO: 2456229 - protein, 5 aa, Entamoeba dispar
QTTST

SEQ ID NO: 2456230 - protein, 10 aa, Entamoeba dispar
QTTTNTQKNK

SEQ ID NO: 2456231 - protein, 10 aa, Entamoeba dispar
QTTYSSKSDL

SEQ ID NO: 2456232 - protein, 10 aa, Entamoeba dispar
QTVNGGRVSD

SEQ ID NO: 2456233 - protein, 7 aa, Entamoeba dispar
QTVPQGL

SEQ ID NO: 2456234 - protein, 11 aa, Entamoeba dispar
QTVSGTDNTLE

SEQ ID NO: 2456235 - protein, 18 aa, Entamoeba dispar
QTVSKSIEKETEAEKKNQ

SEQ ID NO: 2456236 - protein, 47 aa, Entamoeba dispar
QTVSSPNLNISTTSLNNRQVTTSFPKTNTVTITNNSTIHTNPNPTTF

SEQ ID NO: 2456237 - protein, 13 aa, Entamoeba dispar
QTWTSTKTKPSKI

SEQ ID NO: 2456238 - protein, 19 aa, Entamoeba dispar
QTYEDSKMKGTLPQSIEEY

SEQ ID NO: 2456239 - protein, 6 aa, Entamoeba dispar
QTYGNY

SEQ ID NO: 2456240 - protein, 5 aa, Entamoeba dispar
QTYSG

SEQ ID NO: 2456241 - protein, 7 aa, Entamoeba dispar
QTYSNDT

SEQ ID NO: 2456242 - protein, 8 aa, Entamoeba dispar
QTYSSSKR

SEQ ID NO: 2456243 - protein, 6 aa, Entamoeba dispar
QTYSTA

SEQ ID NO: 2456244 - protein, 4 aa, Entamoeba dispar
QTYT

SEQ ID NO: 2456245 - protein, 10 aa, Entamoeba dispar
QTYTIDNGNY

SEQ ID NO: 2456246 - protein, 10 aa, Entamoeba dispar
QVASKETIGD

SEQ ID NO: 2456247 - protein, 19 aa, Entamoeba dispar
QVDAERATKAAIENASNYP

SEQ ID NO: 2456248 - protein, 11 aa, Entamoeba dispar
QVDNEKDTTAA

SEQ ID NO: 2456249 - protein, 8 aa, Entamoeba dispar
QVDVPTSI

SEQ ID NO: 2456250 - protein, 9 aa, Entamoeba dispar
QVEASQSVK

SEQ ID NO: 2456251 - protein, 9 aa, Entamoeba dispar
QVEEENNLI

SEQ ID NO: 2456252 - protein, 7 aa, Entamoeba dispar
QVEEGNN

SEQ ID NO: 2456253 - protein, 23 aa, Entamoeba dispar
QVEEHQMEPPQPDEQRHSEEHPL

SEQ ID NO: 2456254 - protein, 6 aa, Entamoeba dispar
QVEENI

SEQ ID NO: 2456255 - protein, 7 aa, Entamoeba dispar
QVENPMT

SEQ ID NO: 2456256 - protein, 9 aa, Entamoeba dispar
QVETNPTEI

SEQ ID NO: 2456257 - protein, 12 aa, Entamoeba dispar
QVGTDEFQNGKD

SEQ ID NO: 2456258 - protein, 18 aa, Entamoeba dispar
QVHTQPKKNEKIEYKQSP

SEQ ID NO: 2456259 - protein, 36 aa, Entamoeba dispar
QVIERKKAKDNQKNKEEKESKPKKFKSNSPPNEDTF

SEQ ID NO: 2456260 - protein, 23 aa, Entamoeba dispar
QVIPPEPKEIKMEETDEETIEEQ

SEQ ID NO: 2456261 - protein, 7 aa, Entamoeba dispar
QVKDDTD

SEQ ID NO: 2456262 - protein, 7 aa, Entamoeba dispar
QVKEQLS

SEQ ID NO: 2456263 - protein, 5 aa, Entamoeba dispar
QVKGG

SEQ ID NO: 2456264 - protein, 22 aa, Entamoeba dispar
QVKKPRRLNTLSKRKKEMASIR

SEQ ID NO: 2456265 - protein, 23 aa, Entamoeba dispar
QVKPKPSSTEQNSSKKSKKEYEE

SEQ ID NO: 2456266 - protein, 6 aa, Entamoeba dispar
QVKPTF

SEQ ID NO: 2456267 - protein, 31 aa, Entamoeba dispar
QVKQQTKKTIQQAREERKEIIKEKKKELEER

SEQ ID NO: 2456268 - protein, 8 aa, Entamoeba dispar
QVKTANDG

SEQ ID NO: 2456269 - protein, 17 aa, Entamoeba dispar
QVLPDTTKGTTINPNVD

SEQ ID NO: 2456270 - protein, 11 aa, Entamoeba dispar
QVMGKSAEYAN

SEQ ID NO: 2456271 - protein, 5 aa, Entamoeba dispar
QVMTQ

SEQ ID NO: 2456272 - protein, 8 aa, Entamoeba dispar
QVNDENKP

SEQ ID NO: 2456273 - protein, 15 aa, Entamoeba dispar
QVNETVKQKNEQYKE

SEQ ID NO: 2456274 - protein, 16 aa, Entamoeba dispar
QVNGPEDVMKIMKEMG

SEQ ID NO: 2456275 - protein, 5 aa, Entamoeba dispar
QVNGR

SEQ ID NO: 2456276 - protein, 11 aa, Entamoeba dispar
QVNITGDERCN

SEQ ID NO: 2456277 - protein, 12 aa, Entamoeba dispar
QVNKQTGTTRSI

SEQ ID NO: 2456278 - protein, 6 aa, Entamoeba dispar
QVNNDH

SEQ ID NO: 2456279 - protein, 7 aa, Entamoeba dispar
QVNPRPH

SEQ ID NO: 2456280 - protein, 13 aa, Entamoeba dispar
QVNPSTITNYTTS

SEQ ID NO: 2456281 - protein, 5 aa, Entamoeba dispar
QVPEA

SEQ ID NO: 2456282 - protein, 6 aa, Entamoeba dispar
QVPGKH

SEQ ID NO: 2456283 - protein, 35 aa, Entamoeba dispar
QVPPEKKKTEIRDDTTTAEDNNETHLKSETVSEKE

SEQ ID NO: 2456284 - protein, 13 aa, Entamoeba dispar
QVPYKDKSPNIEQ

SEQ ID NO: 2456285 - protein, 15 aa, Entamoeba dispar
QVQDPTEGVNRNSLG

SEQ ID NO: 2456286 - protein, 4 aa, Entamoeba dispar
QVQE

SEQ ID NO: 2456287 - protein, 9 aa, Entamoeba dispar
QVQEESAGI

SEQ ID NO: 2456288 - protein, 19 aa, Entamoeba dispar
QVQEITESNEFNGNTSTNE

SEQ ID NO: 2456289 - protein, 24 aa, Entamoeba dispar
QVQKKKAEYLKKEQEKKNKQFEQF

SEQ ID NO: 2456290 - protein, 21 aa, Entamoeba dispar
QVQNAREEAQENNTQQPQTRA

SEQ ID NO: 2456291 - protein, 14 aa, Entamoeba dispar
QVQQETDLPPEIPQ

SEQ ID NO: 2456292 - protein, 17 aa, Entamoeba dispar
QVQQQQRMQGMQGKQPI

SEQ ID NO: 2456293 - protein, 21 aa, Entamoeba dispar
QVQSKQVTSFPSSINKDNQKE

SEQ ID NO: 2456294 - protein, 7 aa, Entamoeba dispar
QVQSPHD

SEQ ID NO: 2456295 - protein, 7 aa, Entamoeba dispar
QVQTKDS

SEQ ID NO: 2456296 - protein, 5 aa, Entamoeba dispar
QVRTI

SEQ ID NO: 2456297 - protein, 17 aa, Entamoeba dispar
QVSDNAQVNTQKYGLRP

SEQ ID NO: 2456298 - protein, 4 aa, Entamoeba dispar
QVSE

SEQ ID NO: 2456299 - protein, 28 aa, Entamoeba dispar
QVSESQTNLNNSSQINGHISTQSSTQTN

SEQ ID NO: 2456300 - protein, 16 aa, Entamoeba dispar
QVSIPKVQQPNPNNSH

SEQ ID NO: 2456301 - protein, 5 aa, Entamoeba dispar
QVSKE

SEQ ID NO: 2456302 - protein, 11 aa, Entamoeba dispar
QVSKKKDEDIY

SEQ ID NO: 2456303 - protein, 8 aa, Entamoeba dispar
QVSKSDLR

SEQ ID NO: 2456304 - protein, 5 aa, Entamoeba dispar
QVSNE

SEQ ID NO: 2456305 - protein, 34 aa, Entamoeba dispar
QVSPEGTIKSELTQQTLTRSKSGINVPRTKQSLP

SEQ ID NO: 2456306 - protein, 4 aa, Entamoeba dispar
QVSY

SEQ ID NO: 2456307 - protein, 20 aa, Entamoeba dispar
QVTDNKTTIKTIKKASGSGI

SEQ ID NO: 2456308 - protein, 20 aa, Entamoeba dispar
QVTKPQLAENEVSIEKDEQI

SEQ ID NO: 2456309 - protein, 8 aa, Entamoeba dispar
QVTNKNSH

SEQ ID NO: 2456310 - protein, 17 aa, Entamoeba dispar
QVTNNPENDGCINAVLL

SEQ ID NO: 2456311 - protein, 6 aa, Entamoeba dispar
QVTPTY

SEQ ID NO: 2456312 - protein, 15 aa, Entamoeba dispar
QVTQKKDVKKEMSDY

SEQ ID NO: 2456313 - protein, 12 aa, Entamoeba dispar
QVTQRKGYKKRN

SEQ ID NO: 2456314 - protein, 12 aa, Entamoeba dispar
QVTQRKGYKRGN

SEQ ID NO: 2456315 - protein, 6 aa, Entamoeba dispar
QVTRSS

SEQ ID NO: 2456316 - protein, 19 aa, Entamoeba dispar
QVVSEQDQLPKPSEVEEKK

SEQ ID NO: 2456317 - protein, 19 aa, Entamoeba dispar
QVYDSSSKAKDEKAKIKPW

SEQ ID NO: 2456318 - protein, 10 aa, Entamoeba dispar
QVYPNPPATL

SEQ ID NO: 2456319 - protein, 33 aa, Entamoeba dispar
QVYSPQQINQPNYPVPGYSPQIASGYPVQPNAY

SEQ ID NO: 2456320 - protein, 13 aa, Entamoeba dispar
QWDRTISNANEQM

SEQ ID NO: 2456321 - protein, 21 aa, Entamoeba dispar
QWETPKDKYMEKPQPGTDSTY

SEQ ID NO: 2456322 - protein, 11 aa, Entamoeba dispar
QWHEGKTCEEW

SEQ ID NO: 2456323 - protein, 6 aa, Entamoeba dispar
QWKDSG

SEQ ID NO: 2456324 - protein, 24 aa, Entamoeba dispar
QWNQQKNSEEQPQPSSNQQGDSNG

SEQ ID NO: 2456325 - protein, 7 aa, Entamoeba dispar
QWNSESS

SEQ ID NO: 2456326 - protein, 5 aa, Entamoeba dispar
QWNSS

SEQ ID NO: 2456327 - protein, 5 aa, Entamoeba dispar
QWSPT

SEQ ID NO: 2456328 - protein, 9 aa, Entamoeba dispar
QYADRNGKR

SEQ ID NO: 2456329 - protein, 16 aa, Entamoeba dispar
QYAHEDCNELNLENPI

SEQ ID NO: 2456330 - protein, 14 aa, Entamoeba dispar
QYANDSVKERERRD

SEQ ID NO: 2456331 - protein, 25 aa, Entamoeba dispar
QYASEIKKDMSSNQIKTIKRRRDLN

SEQ ID NO: 2456332 - protein, 5 aa, Entamoeba dispar
QYCPP

SEQ ID NO: 2456333 - protein, 24 aa, Entamoeba dispar
QYDEYTTSRSSKTTQHKEKGKKIE

SEQ ID NO: 2456334 - protein, 5 aa, Entamoeba dispar
QYDIP

SEQ ID NO: 2456335 - protein, 19 aa, Entamoeba dispar
QYDKASPEVDDEQPDQEGE

SEQ ID NO: 2456336 - protein, 5 aa, Entamoeba dispar
QYDPT

SEQ ID NO: 2456337 - protein, 11 aa, Entamoeba dispar
QYDRNTSVSTI

SEQ ID NO: 2456338 - protein, 5 aa, Entamoeba dispar
QYDSQ

SEQ ID NO: 2456339 - protein, 5 aa, Entamoeba dispar
QYDYK

SEQ ID NO: 2456340 - protein, 4 aa, Entamoeba dispar
QYEA

SEQ ID NO: 2456341 - protein, 7 aa, Entamoeba dispar
QYEEPKV

SEQ ID NO: 2456342 - protein, 7 aa, Entamoeba dispar
QYEGGTT

SEQ ID NO: 2456343 - protein, 8 aa, Entamoeba dispar
QYEKDNNE

SEQ ID NO: 2456344 - protein, 8 aa, Entamoeba dispar
QYEKEIEQ

SEQ ID NO: 2456345 - protein, 6 aa, Entamoeba dispar
QYENYK

SEQ ID NO: 2456346 - protein, 7 aa, Entamoeba dispar
QYENYKA

SEQ ID NO: 2456347 - protein, 6 aa, Entamoeba dispar
QYEQQR

SEQ ID NO: 2456348 - protein, 5 aa, Entamoeba dispar
QYESG

SEQ ID NO: 2456349 - protein, 7 aa, Entamoeba dispar
QYESYNG

SEQ ID NO: 2456350 - protein, 6 aa, Entamoeba dispar
QYFPPG

SEQ ID NO: 2456351 - protein, 5 aa, Entamoeba dispar
QYGEV

SEQ ID NO: 2456352 - protein, 5 aa, Entamoeba dispar
QYGGT

SEQ ID NO: 2456353 - protein, 6 aa, Entamoeba dispar
QYGNEC

SEQ ID NO: 2456354 - protein, 6 aa, Entamoeba dispar
QYGQHQ

SEQ ID NO: 2456355 - protein, 10 aa, Entamoeba dispar
QYGSEQEVKL

SEQ ID NO: 2456356 - protein, 14 aa, Entamoeba dispar
QYGTEYSKSEINNF

SEQ ID NO: 2456357 - protein, 4 aa, Entamoeba dispar
QYHT

SEQ ID NO: 2456358 - protein, 4 aa, Entamoeba dispar
QYIS

SEQ ID NO: 2456359 - protein, 7 aa, Entamoeba dispar
QYMKPQS

SEQ ID NO: 2456360 - protein, 6 aa, Entamoeba dispar
QYMRSG

SEQ ID NO: 2456361 - protein, 4 aa, Entamoeba dispar
QYNQ

SEQ ID NO: 2456362 - protein, 4 aa, Entamoeba dispar
QYPN

SEQ ID NO: 2456363 - protein, 7 aa, Entamoeba dispar
QYPPEVT

SEQ ID NO: 2456364 - protein, 18 aa, Entamoeba dispar
QYPSNVTEFSSPYLSNTP

SEQ ID NO: 2456365 - protein, 6 aa, Entamoeba dispar
QYQCSE

SEQ ID NO: 2456366 - protein, 7 aa, Entamoeba dispar
QYQPPKC

SEQ ID NO: 2456367 - protein, 16 aa, Entamoeba dispar
QYRKVKEEINKISQEE

SEQ ID NO: 2456368 - protein, 12 aa, Entamoeba dispar
QYSEGHGKTVDK

SEQ ID NO: 2456369 - protein, 4 aa, Entamoeba dispar
QYSI

SEQ ID NO: 2456370 - protein, 26 aa, Entamoeba dispar
QYSKKQNTKPEKLKEIKKKKKELKKK

SEQ ID NO: 2456371 - protein, 11 aa, Entamoeba dispar
QYSKNNPEQAE

SEQ ID NO: 2456372 - protein, 9 aa, Entamoeba dispar
QYSNGWSEK

SEQ ID NO: 2456373 - protein, 4 aa, Entamoeba dispar
QYSP

SEQ ID NO: 2456374 - protein, 7 aa, Entamoeba dispar
QYSPEEQ

SEQ ID NO: 2456375 - protein, 10 aa, Entamoeba dispar
QYSPKDTGNC

SEQ ID NO: 2456376 - protein, 10 aa, Entamoeba dispar
QYSQTTPSKQ

SEQ ID NO: 2456377 - protein, 7 aa, Entamoeba dispar
QYSSEKK

SEQ ID NO: 2456378 - protein, 6 aa, Entamoeba dispar
QYSSGD

SEQ ID NO: 2456379 - protein, 9 aa, Entamoeba dispar
QYSSPSNSV

SEQ ID NO: 2456380 - protein, 8 aa, Entamoeba dispar
QYSSTFPK

SEQ ID NO: 2456381 - protein, 10 aa, Entamoeba dispar
QYSTSKPQGW

SEQ ID NO: 2456382 - protein, 5 aa, Entamoeba dispar
QYTKE

SEQ ID NO: 2456383 - protein, 6 aa, Entamoeba dispar
QYTKNN

SEQ ID NO: 2456384 - protein, 13 aa, Entamoeba dispar
QYTNPYRNRTNNR

SEQ ID NO: 2456385 - protein, 7 aa, Entamoeba dispar
QYTPKIK

SEQ ID NO: 2456386 - protein, 22 aa, Entamoeba dispar
QYTPNQYPSLSKPLSSPQSSTF

SEQ ID NO: 2456387 - protein, 7 aa, Entamoeba dispar
QYTQTDH

SEQ ID NO: 2456388 - protein, 7 aa, Entamoeba dispar
QYTQTDN

SEQ ID NO: 2456389 - protein, 5 aa, Entamoeba dispar
QYTSE

SEQ ID NO: 2456390 - protein, 13 aa, Entamoeba dispar
QYTSSSQKKQKPT

SEQ ID NO: 2456391 - protein, 6 aa, Entamoeba dispar
QYVTSA

SEQ ID NO: 2456392 - protein, 8 aa, Entamoeba dispar
QYYPKGEN

SEQ ID NO: 2456393 - protein, 30 aa, Entamoeba dispar
QYYQQQPQQQYYQQQPQQQYYQQQPQQQYQ

SEQ ID NO: 2456394 - protein, 6 aa, Entamoeba dispar
QYYQTA

SEQ ID NO: 2456395 - protein, 11 aa, Entamoeba dispar
RAADNTEKPHI

SEQ ID NO: 2456396 - protein, 20 aa, Entamoeba dispar
RAAEERNKKEKEDQKKRINQ

SEQ ID NO: 2456397 - protein, 72 aa, Entamoeba dispar
RAAEKKKAKKVVKSKKGKKDEESSDEESEEEEKKQPINKETKKAVKKTTKKKNKKGKKREEEDDSDDDKYEL

SEQ ID NO: 2456398 - protein, 9 aa, Entamoeba dispar
RAAKEKSRL

SEQ ID NO: 2456399 - protein, 5 aa, Entamoeba dispar
RADEK

SEQ ID NO: 2456400 - protein, 5 aa, Entamoeba dispar
RADET

SEQ ID NO: 2456401 - protein, 9 aa, Entamoeba dispar
RADGDDPAR

SEQ ID NO: 2456402 - protein, 8 aa, Entamoeba dispar
RADSEEYV

SEQ ID NO: 2456403 - protein, 49 aa, Entamoeba dispar
RAEAEKANKRALEAEERIEENRKAARAAEEKELKERVGREEEARAKETW

SEQ ID NO: 2456404 - protein, 7 aa, Entamoeba dispar
RAEDGTQ

SEQ ID NO: 2456405 - protein, 10 aa, Entamoeba dispar
RAEEADKRDH

SEQ ID NO: 2456406 - protein, 8 aa, Entamoeba dispar
RAEEDYNN

SEQ ID NO: 2456407 - protein, 7 aa, Entamoeba dispar
RAEGTRI

SEQ ID NO: 2456408 - protein, 7 aa, Entamoeba dispar
RAEKSHP

SEQ ID NO: 2456409 - protein, 5 aa, Entamoeba dispar
RAEPI

SEQ ID NO: 2456410 - protein, 10 aa, Entamoeba dispar
RAEQKSDEYQ

SEQ ID NO: 2456411 - protein, 45 aa, Entamoeba dispar
RAEQSKSSNSLPGTPLQQISSPKKQVSSLYSSTQITETSTPTEEV

SEQ ID NO: 2456412 - protein, 8 aa, Entamoeba dispar
RAEQSRTV

SEQ ID NO: 2456413 - protein, 4 aa, Entamoeba dispar
RAER

SEQ ID NO: 2456414 - protein, 8 aa, Entamoeba dispar
RAESAPIS

SEQ ID NO: 2456415 - protein, 14 aa, Entamoeba dispar
RAETGDRDITEFSE

SEQ ID NO: 2456416 - protein, 10 aa, Entamoeba dispar
RAFGDDSTLM

SEQ ID NO: 2456417 - protein, 9 aa, Entamoeba dispar
RAFGTDKHY

SEQ ID NO: 2456418 - protein, 4 aa, Entamoeba dispar
RAGA

SEQ ID NO: 2456419 - protein, 5 aa, Entamoeba dispar
RAGGL

SEQ ID NO: 2456420 - protein, 10 aa, Entamoeba dispar
RAGIGATDLK

SEQ ID NO: 2456421 - protein, 7 aa, Entamoeba dispar
RAGNEKR

SEQ ID NO: 2456422 - protein, 8 aa, Entamoeba dispar
RAGRAQVR

SEQ ID NO: 2456423 - protein, 4 aa, Entamoeba dispar
RAGS

SEQ ID NO: 2456424 - protein, 13 aa, Entamoeba dispar
RAGTRTKGRSHKY

SEQ ID NO: 2456425 - protein, 6 aa, Entamoeba dispar
RAIADT

SEQ ID NO: 2456426 - protein, 6 aa, Entamoeba dispar
RAIDET

SEQ ID NO: 2456427 - protein, 34 aa, Entamoeba dispar
RAIKERSRKTLHSNRESIGDRNDTLYEEDGIDAS

SEQ ID NO: 2456428 - protein, 6 aa, Entamoeba dispar
RAIPTG

SEQ ID NO: 2456429 - protein, 7 aa, Entamoeba dispar
RAISEGK

SEQ ID NO: 2456430 - protein, 6 aa, Entamoeba dispar
RAISSE

SEQ ID NO: 2456431 - protein, 13 aa, Entamoeba dispar
RAKDFADKAKKDI

SEQ ID NO: 2456432 - protein, 10 aa, Entamoeba dispar
RAKDLTPDEK

SEQ ID NO: 2456433 - protein, 5 aa, Entamoeba dispar
RAKEM

SEQ ID NO: 2456434 - protein, 210 aa, Entamoeba dispar
RAKENKKKLEDERKNQQSLQYSKNSYTTIPQQYPSSFNTPLQENNTSKPYLSSYSSYNQNQSTTQYSSSYITSQQQNNLKHYPSSYSPSNQLNNQSPSYPSSYSPSHQTNQPPSYPSSYATSKSNQPLNRYSTTQTPSSSIPVSSYPSSYTTSNPTQPPPYSQIPQYQNTQYNYSNSTAPLGTLQPPIPTLSSPTTTLPPPIPPTTYPLS

SEQ ID NO: 2456435 - protein, 6 aa, Entamoeba dispar
RAKGEL

SEQ ID NO: 2456436 - protein, 7 aa, Entamoeba dispar
RAKISEY

SEQ ID NO: 2456437 - protein, 4 aa, Entamoeba dispar
RAKK

SEQ ID NO: 2456438 - protein, 12 aa, Entamoeba dispar
RAKKAAVKVIEA

SEQ ID NO: 2456439 - protein, 8 aa, Entamoeba dispar
RAKKGVSV

SEQ ID NO: 2456440 - protein, 10 aa, Entamoeba dispar
RAKLKKSDFE

SEQ ID NO: 2456441 - protein, 7 aa, Entamoeba dispar
RAKNNGS

SEQ ID NO: 2456442 - protein, 8 aa, Entamoeba dispar
RAKNPETT

SEQ ID NO: 2456443 - protein, 13 aa, Entamoeba dispar
RAKRSFSCGGNTF

SEQ ID NO: 2456444 - protein, 17 aa, Entamoeba dispar
RALDQQRRLRNERRFRE

SEQ ID NO: 2456445 - protein, 6 aa, Entamoeba dispar
RALNGK

SEQ ID NO: 2456446 - protein, 12 aa, Entamoeba dispar
RALRETSQKHHQ

SEQ ID NO: 2456447 - protein, 9 aa, Entamoeba dispar
RALSSSVEK

SEQ ID NO: 2456448 - protein, 10 aa, Entamoeba dispar
RAMSRDDSYF

SEQ ID NO: 2456449 - protein, 32 aa, Entamoeba dispar
RAMTTRTDDASVSVTENKKHQSTQIDDGEELA

SEQ ID NO: 2456450 - protein, 12 aa, Entamoeba dispar
RANDPNVDKEGQ

SEQ ID NO: 2456451 - protein, 7 aa, Entamoeba dispar
RANNPCT

SEQ ID NO: 2456452 - protein, 12 aa, Entamoeba dispar
RANNRRRQTRKS

SEQ ID NO: 2456453 - protein, 10 aa, Entamoeba dispar
RANSEPLRKR

SEQ ID NO: 2456454 - protein, 19 aa, Entamoeba dispar
RANSNYDVTDNDGDDSEVW

SEQ ID NO: 2456455 - protein, 6 aa, Entamoeba dispar
RANTNT

SEQ ID NO: 2456456 - protein, 13 aa, Entamoeba dispar
RANVEKSKKEAEK

SEQ ID NO: 2456457 - protein, 23 aa, Entamoeba dispar
RANVRERQQRRKQDLEGKKQMEG

SEQ ID NO: 2456458 - protein, 4 aa, Entamoeba dispar
RAPI

SEQ ID NO: 2456459 - protein, 13 aa, Entamoeba dispar
RAPITKKEKYEEF

SEQ ID NO: 2456460 - protein, 4 aa, Entamoeba dispar
RAPL

SEQ ID NO: 2456461 - protein, 9 aa, Entamoeba dispar
RAPNEEIKE

SEQ ID NO: 2456462 - protein, 5 aa, Entamoeba dispar
RAPPK

SEQ ID NO: 2456463 - protein, 13 aa, Entamoeba dispar
RAPPQEAMKEMEN

SEQ ID NO: 2456464 - protein, 6 aa, Entamoeba dispar
RAPVGG

SEQ ID NO: 2456465 - protein, 8 aa, Entamoeba dispar
RAQEEVKR

SEQ ID NO: 2456466 - protein, 16 aa, Entamoeba dispar
RAQLQKQLSSNKTLEY

SEQ ID NO: 2456467 - protein, 5 aa, Entamoeba dispar
RAQPK

SEQ ID NO: 2456468 - protein, 11 aa, Entamoeba dispar
RAQPTSRLSLP

SEQ ID NO: 2456469 - protein, 9 aa, Entamoeba dispar
RAQQKTAIT

SEQ ID NO: 2456470 - protein, 28 aa, Entamoeba dispar
RAQSQSKKRGSNEGPTFARSVSKEGLAV

SEQ ID NO: 2456471 - protein, 6 aa, Entamoeba dispar
RAQTSS

SEQ ID NO: 2456472 - protein, 6 aa, Entamoeba dispar
RAQWAS

SEQ ID NO: 2456473 - protein, 18 aa, Entamoeba dispar
RAQYNKSKLVNAIKKLMP

SEQ ID NO: 2456474 - protein, 9 aa, Entamoeba dispar
RARDTRSRR

SEQ ID NO: 2456475 - protein, 8 aa, Entamoeba dispar
RARGQGMG

SEQ ID NO: 2456476 - protein, 9 aa, Entamoeba dispar
RARKPQHTK

SEQ ID NO: 2456477 - protein, 4 aa, Entamoeba dispar
RARS

SEQ ID NO: 2456478 - protein, 9 aa, Entamoeba dispar
RARSRSPLM

SEQ ID NO: 2456479 - protein, 5 aa, Entamoeba dispar
RARTT

SEQ ID NO: 2456480 - protein, 8 aa, Entamoeba dispar
RASADGQR

SEQ ID NO: 2456481 - protein, 7 aa, Entamoeba dispar
RASEKNK

SEQ ID NO: 2456482 - protein, 7 aa, Entamoeba dispar
RASFGDN

SEQ ID NO: 2456483 - protein, 6 aa, Entamoeba dispar
RASGNP

SEQ ID NO: 2456484 - protein, 10 aa, Entamoeba dispar
RASPENEKTP

SEQ ID NO: 2456485 - protein, 8 aa, Entamoeba dispar
RASPQVPY

SEQ ID NO: 2456486 - protein, 30 aa, Entamoeba dispar
RASPRKAAEAKAKEEAEAKKAQEENEKKVL

SEQ ID NO: 2456487 - protein, 6 aa, Entamoeba dispar
RASPTI

SEQ ID NO: 2456488 - protein, 7 aa, Entamoeba dispar
RASQNAS

SEQ ID NO: 2456489 - protein, 8 aa, Entamoeba dispar
RASSDLDQ

SEQ ID NO: 2456490 - protein, 11 aa, Entamoeba dispar
RASTERDSAQQ

SEQ ID NO: 2456491 - protein, 12 aa, Entamoeba dispar
RATADASQIRSA

SEQ ID NO: 2456492 - protein, 5 aa, Entamoeba dispar
RATDG

SEQ ID NO: 2456493 - protein, 5 aa, Entamoeba dispar
RATGA

SEQ ID NO: 2456494 - protein, 5 aa, Entamoeba dispar
RATNP

SEQ ID NO: 2456495 - protein, 4 aa, Entamoeba dispar
RATQ

SEQ ID NO: 2456496 - protein, 5 aa, Entamoeba dispar
RATSI

SEQ ID NO: 2456497 - protein, 8 aa, Entamoeba dispar
RATTSSRM

SEQ ID NO: 2456498 - protein, 9 aa, Entamoeba dispar
RATTTSKEW

SEQ ID NO: 2456499 - protein, 4 aa, Entamoeba dispar
RAVE

SEQ ID NO: 2456500 - protein, 8 aa, Entamoeba dispar
RAVSKEEA

SEQ ID NO: 2456501 - protein, 12 aa, Entamoeba dispar
RAVVKDQSSIEE

SEQ ID NO: 2456502 - protein, 6 aa, Entamoeba dispar
RAYPDT

SEQ ID NO: 2456503 - protein, 9 aa, Entamoeba dispar
RCDDPSSPI

SEQ ID NO: 2456504 - protein, 11 aa, Entamoeba dispar
RCDNGKKNFPE

SEQ ID NO: 2456505 - protein, 5 aa, Entamoeba dispar
RCEDE

SEQ ID NO: 2456506 - protein, 9 aa, Entamoeba dispar
RCEKNPEND

SEQ ID NO: 2456507 - protein, 5 aa, Entamoeba dispar
RCERD

SEQ ID NO: 2456508 - protein, 6 aa, Entamoeba dispar
RCGDSL

SEQ ID NO: 2456509 - protein, 5 aa, Entamoeba dispar
RCGKD

SEQ ID NO: 2456510 - protein, 10 aa, Entamoeba dispar
RCHSNGKTKY

SEQ ID NO: 2456511 - protein, 4 aa, Entamoeba dispar
RCKE

SEQ ID NO: 2456512 - protein, 9 aa, Entamoeba dispar
RCKGGLNDT

SEQ ID NO: 2456513 - protein, 15 aa, Entamoeba dispar
RCKNPGMCLSLFSFS

SEQ ID NO: 2456514 - protein, 4 aa, Entamoeba dispar
RCKQ

SEQ ID NO: 2456515 - protein, 8 aa, Entamoeba dispar
RCKQREKF

SEQ ID NO: 2456516 - protein, 6 aa, Entamoeba dispar
RCKRAE

SEQ ID NO: 2456517 - protein, 4 aa, Entamoeba dispar
RCND

SEQ ID NO: 2456518 - protein, 10 aa, Entamoeba dispar
RCSDKKERIK

SEQ ID NO: 2456519 - protein, 5 aa, Entamoeba dispar
RCSEF

SEQ ID NO: 2456520 - protein, 5 aa, Entamoeba dispar
RCSKV

SEQ ID NO: 2456521 - protein, 9 aa, Entamoeba dispar
RCTTSEVGE

SEQ ID NO: 2456522 - protein, 5 aa, Entamoeba dispar
RDAED

SEQ ID NO: 2456523 - protein, 6 aa, Entamoeba dispar
RDAISS

SEQ ID NO: 2456524 - protein, 5 aa, Entamoeba dispar
RDATI

SEQ ID NO: 2456525 - protein, 6 aa, Entamoeba dispar
RDCHPQ

SEQ ID NO: 2456526 - protein, 17 aa, Entamoeba dispar
RDCPNNPKGIYPQGGGC

SEQ ID NO: 2456527 - protein, 7 aa, Entamoeba dispar
RDCQKEE

SEQ ID NO: 2456528 - protein, 9 aa, Entamoeba dispar
RDDAASSFK

SEQ ID NO: 2456529 - protein, 6 aa, Entamoeba dispar
RDDCLT

SEQ ID NO: 2456530 - protein, 8 aa, Entamoeba dispar
RDDEAVVP

SEQ ID NO: 2456531 - protein, 7 aa, Entamoeba dispar
RDDEQVR

SEQ ID NO: 2456532 - protein, 15 aa, Entamoeba dispar
RDDFGSSDKDTAYES

SEQ ID NO: 2456533 - protein, 6 aa, Entamoeba dispar
RDDFSE

SEQ ID NO: 2456534 - protein, 6 aa, Entamoeba dispar
RDDGSA

SEQ ID NO: 2456535 - protein, 10 aa, Entamoeba dispar
RDDIRQENNA

SEQ ID NO: 2456536 - protein, 7 aa, Entamoeba dispar
RDDKPST

SEQ ID NO: 2456537 - protein, 7 aa, Entamoeba dispar
RDDPIPE

SEQ ID NO: 2456538 - protein, 33 aa, Entamoeba dispar
RDDSLMKKEKREKLPKNIKELDRGDFNDTPTYN

SEQ ID NO: 2456539 - protein, 5 aa, Entamoeba dispar
RDDTT

SEQ ID NO: 2456540 - protein, 25 aa, Entamoeba dispar
RDEDEKKTKSMEEENKVLENENEVP

SEQ ID NO: 2456541 - protein, 7 aa, Entamoeba dispar
RDEDLPK

SEQ ID NO: 2456542 - protein, 8 aa, Entamoeba dispar
RDEETQRI

SEQ ID NO: 2456543 - protein, 7 aa, Entamoeba dispar
RDEFESE

SEQ ID NO: 2456544 - protein, 12 aa, Entamoeba dispar
RDEGDEMNFYLI

SEQ ID NO: 2456545 - protein, 10 aa, Entamoeba dispar
RDEIEDEKEM

SEQ ID NO: 2456546 - protein, 6 aa, Entamoeba dispar
RDEISS

SEQ ID NO: 2456547 - protein, 9 aa, Entamoeba dispar
RDEKKVGEW

SEQ ID NO: 2456548 - protein, 6 aa, Entamoeba dispar
RDEKVR

SEQ ID NO: 2456549 - protein, 6 aa, Entamoeba dispar
RDELMA

SEQ ID NO: 2456550 - protein, 8 aa, Entamoeba dispar
RDENGAKR

SEQ ID NO: 2456551 - protein, 7 aa, Entamoeba dispar
RDENGIR

SEQ ID NO: 2456552 - protein, 7 aa, Entamoeba dispar
RDENNTI

SEQ ID NO: 2456553 - protein, 5 aa, Entamoeba dispar
RDENV

SEQ ID NO: 2456554 - protein, 12 aa, Entamoeba dispar
RDEQDNGLFHYI

SEQ ID NO: 2456555 - protein, 8 aa, Entamoeba dispar
RDEQPNSE

SEQ ID NO: 2456556 - protein, 9 aa, Entamoeba dispar
RDETKATEP

SEQ ID NO: 2456557 - protein, 4 aa, Entamoeba dispar
RDEY

SEQ ID NO: 2456558 - protein, 6 aa, Entamoeba dispar
RDEYEM

SEQ ID NO: 2456559 - protein, 12 aa, Entamoeba dispar
RDFENASDNYLR

SEQ ID NO: 2456560 - protein, 10 aa, Entamoeba dispar
RDFGKSSFGG

SEQ ID NO: 2456561 - protein, 11 aa, Entamoeba dispar
RDFNEKERLDK

SEQ ID NO: 2456562 - protein, 6 aa, Entamoeba dispar
RDFNKR

SEQ ID NO: 2456563 - protein, 9 aa, Entamoeba dispar
RDFTKTTGF

SEQ ID NO: 2456564 - protein, 4 aa, Entamoeba dispar
RDGA

SEQ ID NO: 2456565 - protein, 6 aa, Entamoeba dispar
RDGDGY

SEQ ID NO: 2456566 - protein, 9 aa, Entamoeba dispar
RDGDPDADV

SEQ ID NO: 2456567 - protein, 15 aa, Entamoeba dispar
RDGKYLASSSEDGTL

SEQ ID NO: 2456568 - protein, 5 aa, Entamoeba dispar
RDGPN

SEQ ID NO: 2456569 - protein, 7 aa, Entamoeba dispar
RDGQKKK

SEQ ID NO: 2456570 - protein, 8 aa, Entamoeba dispar
RDGSSGGI

SEQ ID NO: 2456571 - protein, 4 aa, Entamoeba dispar
RDGT

SEQ ID NO: 2456572 - protein, 10 aa, Entamoeba dispar
RDGTAPSPDE

SEQ ID NO: 2456573 - protein, 15 aa, Entamoeba dispar
RDGTLDKEKYDTKNI

SEQ ID NO: 2456574 - protein, 8 aa, Entamoeba dispar
RDGYEDEE

SEQ ID NO: 2456575 - protein, 9 aa, Entamoeba dispar
RDGYESDRS

SEQ ID NO: 2456576 - protein, 6 aa, Entamoeba dispar
RDHAIR

SEQ ID NO: 2456577 - protein, 4 aa, Entamoeba dispar
RDHL

SEQ ID NO: 2456578 - protein, 4 aa, Entamoeba dispar
RDIE

SEQ ID NO: 2456579 - protein, 11 aa, Entamoeba dispar
RDIEKRKGHSI

SEQ ID NO: 2456580 - protein, 8 aa, Entamoeba dispar
RDIEQSQI

SEQ ID NO: 2456581 - protein, 4 aa, Entamoeba dispar
RDIN

SEQ ID NO: 2456582 - protein, 7 aa, Entamoeba dispar
RDISDED

SEQ ID NO: 2456583 - protein, 45 aa, Entamoeba dispar
RDKDEDWESFDDDSDYEEVQSDNENKNETDNEHNDTEEESESEED

SEQ ID NO: 2456584 - protein, 8 aa, Entamoeba dispar
RDKDIGEE

SEQ ID NO: 2456585 - protein, 7 aa, Entamoeba dispar
RDKEEKV

SEQ ID NO: 2456586 - protein, 10 aa, Entamoeba dispar
RDKEKTQIQI

SEQ ID NO: 2456587 - protein, 7 aa, Entamoeba dispar
RDKETSE

SEQ ID NO: 2456588 - protein, 6 aa, Entamoeba dispar
RDKIKT

SEQ ID NO: 2456589 - protein, 37 aa, Entamoeba dispar
RDKKQQEDEDELKEYEQQRKETMKEEHRPKVETLKKE

SEQ ID NO: 2456590 - protein, 8 aa, Entamoeba dispar
RDKNQINH

SEQ ID NO: 2456591 - protein, 9 aa, Entamoeba dispar
RDKRKNSIY

SEQ ID NO: 2456592 - protein, 12 aa, Entamoeba dispar
RDKSEFGKNRSG

SEQ ID NO: 2456593 - protein, 7 aa, Entamoeba dispar
RDKSLKG

SEQ ID NO: 2456594 - protein, 4 aa, Entamoeba dispar
RDKT

SEQ ID NO: 2456595 - protein, 8 aa, Entamoeba dispar
RDKTRAGL

SEQ ID NO: 2456596 - protein, 16 aa, Entamoeba dispar
RDKTRKERKVQDLEKK

SEQ ID NO: 2456597 - protein, 5 aa, Entamoeba dispar
RDLDT

SEQ ID NO: 2456598 - protein, 4 aa, Entamoeba dispar
RDLE

SEQ ID NO: 2456599 - protein, 6 aa, Entamoeba dispar
RDLGTH

SEQ ID NO: 2456600 - protein, 23 aa, Entamoeba dispar
RDLKEKEENEKKDNENKKQENIE

SEQ ID NO: 2456601 - protein, 8 aa, Entamoeba dispar
RDLNSQDL

SEQ ID NO: 2456602 - protein, 8 aa, Entamoeba dispar
RDLNTGKR

SEQ ID NO: 2456603 - protein, 4 aa, Entamoeba dispar
RDLV

SEQ ID NO: 2456604 - protein, 4 aa, Entamoeba dispar
RDMN

SEQ ID NO: 2456605 - protein, 7 aa, Entamoeba dispar
RDNADKK

SEQ ID NO: 2456606 - protein, 5 aa, Entamoeba dispar
RDNDS

SEQ ID NO: 2456607 - protein, 11 aa, Entamoeba dispar
RDNGTKSESTW

SEQ ID NO: 2456608 - protein, 6 aa, Entamoeba dispar
RDNNDV

SEQ ID NO: 2456609 - protein, 7 aa, Entamoeba dispar
RDNNISK

SEQ ID NO: 2456610 - protein, 10 aa, Entamoeba dispar
RDNPNVKSMR

SEQ ID NO: 2456611 - protein, 7 aa, Entamoeba dispar
RDNPSAT

SEQ ID NO: 2456612 - protein, 7 aa, Entamoeba dispar
RDNPTLP

SEQ ID NO: 2456613 - protein, 7 aa, Entamoeba dispar
RDNQTGQ

SEQ ID NO: 2456614 - protein, 4 aa, Entamoeba dispar
RDNR

SEQ ID NO: 2456615 - protein, 7 aa, Entamoeba dispar
RDNSKRD

SEQ ID NO: 2456616 - protein, 11 aa, Entamoeba dispar
RDNSNEEQGVN

SEQ ID NO: 2456617 - protein, 11 aa, Entamoeba dispar
RDNVKSVSQEK

SEQ ID NO: 2456618 - protein, 7 aa, Entamoeba dispar
RDPASPF

SEQ ID NO: 2456619 - protein, 5 aa, Entamoeba dispar
RDPDS

SEQ ID NO: 2456620 - protein, 7 aa, Entamoeba dispar
RDPFNDE

SEQ ID NO: 2456621 - protein, 8 aa, Entamoeba dispar
RDPGTGEN

SEQ ID NO: 2456622 - protein, 7 aa, Entamoeba dispar
RDPGYQS

SEQ ID NO: 2456623 - protein, 7 aa, Entamoeba dispar
RDPHGNV

SEQ ID NO: 2456624 - protein, 13 aa, Entamoeba dispar
RDPMGTRSKHVEE

SEQ ID NO: 2456625 - protein, 6 aa, Entamoeba dispar
RDPNLE

SEQ ID NO: 2456626 - protein, 4 aa, Entamoeba dispar
RDPR

SEQ ID NO: 2456627 - protein, 21 aa, Entamoeba dispar
RDPRRLQEKEETTIENEEPKR

SEQ ID NO: 2456628 - protein, 6 aa, Entamoeba dispar
RDPSED

SEQ ID NO: 2456629 - protein, 11 aa, Entamoeba dispar
RDPSSPFPQAK

SEQ ID NO: 2456630 - protein, 8 aa, Entamoeba dispar
RDPSSPIP

SEQ ID NO: 2456631 - protein, 7 aa, Entamoeba dispar
RDQENTT

SEQ ID NO: 2456632 - protein, 8 aa, Entamoeba dispar
RDQFEKEN

SEQ ID NO: 2456633 - protein, 9 aa, Entamoeba dispar
RDQGKTQMN

SEQ ID NO: 2456634 - protein, 32 aa, Entamoeba dispar
RDQKKKVEDIQQTIEEKENKLNELKEERIEEK

SEQ ID NO: 2456635 - protein, 8 aa, Entamoeba dispar
RDQPSEEH

SEQ ID NO: 2456636 - protein, 12 aa, Entamoeba dispar
RDQRTQELKDKL

SEQ ID NO: 2456637 - protein, 5 aa, Entamoeba dispar
RDQTG

SEQ ID NO: 2456638 - protein, 4 aa, Entamoeba dispar
RDQV

SEQ ID NO: 2456639 - protein, 6 aa, Entamoeba dispar
RDQYKT

SEQ ID NO: 2456640 - protein, 10 aa, Entamoeba dispar
RDRGYSLDDQ

SEQ ID NO: 2456641 - protein, 10 aa, Entamoeba dispar
RDRGYTQDDQ

SEQ ID NO: 2456642 - protein, 10 aa, Entamoeba dispar
RDRISNQHKG

SEQ ID NO: 2456643 - protein, 17 aa, Entamoeba dispar
RDRKDEKQKQESEYQRK

SEQ ID NO: 2456644 - protein, 13 aa, Entamoeba dispar
RDRKRISRSSEAC

SEQ ID NO: 2456645 - protein, 13 aa, Entamoeba dispar
RDRKRVSRSSEAC

SEQ ID NO: 2456646 - protein, 6 aa, Entamoeba dispar
RDRRKQ

SEQ ID NO: 2456647 - protein, 7 aa, Entamoeba dispar
RDRSGTL

SEQ ID NO: 2456648 - protein, 58 aa, Entamoeba dispar
RDRSKTSLGSDDGHRHHSTRDRSSTLEKPERTPSTPEERRARREAREKERAARRAKGE

SEQ ID NO: 2456649 - protein, 9 aa, Entamoeba dispar
RDRTENDPP

SEQ ID NO: 2456650 - protein, 22 aa, Entamoeba dispar
RDRVSSALEPMKSQNCFIGNMD

SEQ ID NO: 2456651 - protein, 19 aa, Entamoeba dispar
RDRYENDDCYSPRERSPNN

SEQ ID NO: 2456652 - protein, 9 aa, Entamoeba dispar
RDRYSEKYG

SEQ ID NO: 2456653 - protein, 11 aa, Entamoeba dispar
RDSDNNIGDES

SEQ ID NO: 2456654 - protein, 9 aa, Entamoeba dispar
RDSEINGKP

SEQ ID NO: 2456655 - protein, 6 aa, Entamoeba dispar
RDSGTL

SEQ ID NO: 2456656 - protein, 16 aa, Entamoeba dispar
RDSKTNPKGFTKNDPI

SEQ ID NO: 2456657 - protein, 26 aa, Entamoeba dispar
RDSLQKNETNNPRKSQIQETEDSESI

SEQ ID NO: 2456658 - protein, 10 aa, Entamoeba dispar
RDSNDKNIKT

SEQ ID NO: 2456659 - protein, 6 aa, Entamoeba dispar
RDSNHP

SEQ ID NO: 2456660 - protein, 9 aa, Entamoeba dispar
RDSNSDKDI

SEQ ID NO: 2456661 - protein, 4 aa, Entamoeba dispar
RDSP

SEQ ID NO: 2456662 - protein, 5 aa, Entamoeba dispar
RDSPL

SEQ ID NO: 2456663 - protein, 8 aa, Entamoeba dispar
RDSPNKML

SEQ ID NO: 2456664 - protein, 8 aa, Entamoeba dispar
RDTALQSR

SEQ ID NO: 2456665 - protein, 5 aa, Entamoeba dispar
RDTGD

SEQ ID NO: 2456666 - protein, 9 aa, Entamoeba dispar
RDTKFNLNG

SEQ ID NO: 2456667 - protein, 9 aa, Entamoeba dispar
RDTKRSPRE

SEQ ID NO: 2456668 - protein, 7 aa, Entamoeba dispar
RDTPTSV

SEQ ID NO: 2456669 - protein, 4 aa, Entamoeba dispar
RDTQ

SEQ ID NO: 2456670 - protein, 4 aa, Entamoeba dispar
RDTS

SEQ ID NO: 2456671 - protein, 4 aa, Entamoeba dispar
RDTT

SEQ ID NO: 2456672 - protein, 7 aa, Entamoeba dispar
RDTTGAT

SEQ ID NO: 2456673 - protein, 8 aa, Entamoeba dispar
RDTTVTNI

SEQ ID NO: 2456674 - protein, 8 aa, Entamoeba dispar
RDVAPDSG

SEQ ID NO: 2456675 - protein, 4 aa, Entamoeba dispar
RDVM

SEQ ID NO: 2456676 - protein, 5 aa, Entamoeba dispar
RDVNG

SEQ ID NO: 2456677 - protein, 14 aa, Entamoeba dispar
RDVRNKLKAKDPIK

SEQ ID NO: 2456678 - protein, 11 aa, Entamoeba dispar
RDVSSNGSYVN

SEQ ID NO: 2456679 - protein, 13 aa, Entamoeba dispar
RDWTDEERNEFGS

SEQ ID NO: 2456680 - protein, 5 aa, Entamoeba dispar
RDYEG

SEQ ID NO: 2456681 - protein, 18 aa, Entamoeba dispar
RDYNNQENLKNPDCLSGS

SEQ ID NO: 2456682 - protein, 6 aa, Entamoeba dispar
RDYQTC

SEQ ID NO: 2456683 - protein, 8 aa, Entamoeba dispar
REAAALDG

SEQ ID NO: 2456684 - protein, 20 aa, Entamoeba dispar
REAEERRKRENGIKDPEPEF

SEQ ID NO: 2456685 - protein, 15 aa, Entamoeba dispar
REAEINKKRREEESK

SEQ ID NO: 2456686 - protein, 7 aa, Entamoeba dispar
REAKERI

SEQ ID NO: 2456687 - protein, 4 aa, Entamoeba dispar
REAP

SEQ ID NO: 2456688 - protein, 4 aa, Entamoeba dispar
REAQ

SEQ ID NO: 2456689 - protein, 13 aa, Entamoeba dispar
REARSNGMNPRQE

SEQ ID NO: 2456690 - protein, 8 aa, Entamoeba dispar
REATDDQE

SEQ ID NO: 2456691 - protein, 10 aa, Entamoeba dispar
RECPDTVNPS

SEQ ID NO: 2456692 - protein, 7 aa, Entamoeba dispar
RECQEKE

SEQ ID NO: 2456693 - protein, 5 aa, Entamoeba dispar
RECQT

SEQ ID NO: 2456694 - protein, 9 aa, Entamoeba dispar
REDDRSHNP

SEQ ID NO: 2456695 - protein, 8 aa, Entamoeba dispar
REDDTSLE

SEQ ID NO: 2456696 - protein, 18 aa, Entamoeba dispar
REDERDKIYREKQRFGDP

SEQ ID NO: 2456697 - protein, 7 aa, Entamoeba dispar
REDESGM

SEQ ID NO: 2456698 - protein, 6 aa, Entamoeba dispar
REDETM

SEQ ID NO: 2456699 - protein, 6 aa, Entamoeba dispar
REDGWI

SEQ ID NO: 2456700 - protein, 4 aa, Entamoeba dispar
REDI

SEQ ID NO: 2456701 - protein, 12 aa, Entamoeba dispar
REDIEQHKSRLA

SEQ ID NO: 2456702 - protein, 5 aa, Entamoeba dispar
REDKM

SEQ ID NO: 2456703 - protein, 9 aa, Entamoeba dispar
REDKTHSDA

SEQ ID NO: 2456704 - protein, 4 aa, Entamoeba dispar
REDL

SEQ ID NO: 2456705 - protein, 81 aa, Entamoeba dispar
REDTQSHKQEIPEQPPQLPPPRRGTSPANRSLNPSLSTNDSVRRGGFKSNSLSNYEQPTVSGSTPTLNSGLKGRGTFRGGY

SEQ ID NO: 2456706 - protein, 7 aa, Entamoeba dispar
REDVEKD

SEQ ID NO: 2456707 - protein, 17 aa, Entamoeba dispar
REDVGDIPSENLKNKTK

SEQ ID NO: 2456708 - protein, 12 aa, Entamoeba dispar
REDVSDHSDPSL

SEQ ID NO: 2456709 - protein, 21 aa, Entamoeba dispar
REEAEKRKKEEVQEDEEENEL

SEQ ID NO: 2456710 - protein, 6 aa, Entamoeba dispar
REEDVA

SEQ ID NO: 2456711 - protein, 4 aa, Entamoeba dispar
REEE

SEQ ID NO: 2456712 - protein, 30 aa, Entamoeba dispar
REEEEDEQFDEEKEKRDKARDERRREREEF

SEQ ID NO: 2456713 - protein, 35 aa, Entamoeba dispar
  misc_feature (22)..(23): Xaa can be any naturally occurring amino acid
REEEEKKAKRLEELQILQEEKXXSIDKEISKAGNN

SEQ ID NO: 2456714 - protein, 11 aa, Entamoeba dispar
REEEGEEKDEW

SEQ ID NO: 2456715 - protein, 12 aa, Entamoeba dispar
REEEKGNLKEPI

SEQ ID NO: 2456716 - protein, 9 aa, Entamoeba dispar
REEENLPEA

SEQ ID NO: 2456717 - protein, 7 aa, Entamoeba dispar
REEEQRK

SEQ ID NO: 2456718 - protein, 6 aa, Entamoeba dispar
REEEST

SEQ ID NO: 2456719 - protein, 13 aa, Entamoeba dispar
REEFKKEIGKKEK

SEQ ID NO: 2456720 - protein, 7 aa, Entamoeba dispar
REEIDNA

SEQ ID NO: 2456721 - protein, 7 aa, Entamoeba dispar
REEIGKE

SEQ ID NO: 2456722 - protein, 7 aa, Entamoeba dispar
REEIGNN

SEQ ID NO: 2456723 - protein, 11 aa, Entamoeba dispar
REEIKSNKEDA

SEQ ID NO: 2456724 - protein, 10 aa, Entamoeba dispar
REEKRKELDE

SEQ ID NO: 2456725 - protein, 4 aa, Entamoeba dispar
REEL

SEQ ID NO: 2456726 - protein, 13 aa, Entamoeba dispar
REELKQEGVSGNE

SEQ ID NO: 2456727 - protein, 36 aa, Entamoeba dispar
REEMGSIKEENKTNIRMSNSNQMERNNKNDIKRNRI

SEQ ID NO: 2456728 - protein, 16 aa, Entamoeba dispar
REENKQNSNGTEDEGY

SEQ ID NO: 2456729 - protein, 9 aa, Entamoeba dispar
REENVFENG

SEQ ID NO: 2456730 - protein, 10 aa, Entamoeba dispar
REEPQTYSTP

SEQ ID NO: 2456731 - protein, 11 aa, Entamoeba dispar
REEQQNKPKAL

SEQ ID NO: 2456732 - protein, 9 aa, Entamoeba dispar
REEQYNSRR

SEQ ID NO: 2456733 - protein, 24 aa, Entamoeba dispar
REEREKNEKKKEKETKPVRRKTEL

SEQ ID NO: 2456734 - protein, 5 aa, Entamoeba dispar
REESD

SEQ ID NO: 2456735 - protein, 4 aa, Entamoeba dispar
REET

SEQ ID NO: 2456736 - protein, 4 aa, Entamoeba dispar
REEV

SEQ ID NO: 2456737 - protein, 5 aa, Entamoeba dispar
REEYP

SEQ ID NO: 2456738 - protein, 7 aa, Entamoeba dispar
REFTSTE

SEQ ID NO: 2456739 - protein, 9 aa, Entamoeba dispar
REGDDGEAR

SEQ ID NO: 2456740 - protein, 4 aa, Entamoeba dispar
REGE

SEQ ID NO: 2456741 - protein, 5 aa, Entamoeba dispar
REGEE

SEQ ID NO: 2456742 - protein, 17 aa, Entamoeba dispar
REGEKSEEHLPGKKGCT

SEQ ID NO: 2456743 - protein, 6 aa, Entamoeba dispar
REGENI

SEQ ID NO: 2456744 - protein, 10 aa, Entamoeba dispar
REGEPPRREE

SEQ ID NO: 2456745 - protein, 15 aa, Entamoeba dispar
REGERARYQPHTDDL

SEQ ID NO: 2456746 - protein, 14 aa, Entamoeba dispar
REGKDNMSVIVISF

SEQ ID NO: 2456747 - protein, 9 aa, Entamoeba dispar
REGKQNEMK

SEQ ID NO: 2456748 - protein, 6 aa, Entamoeba dispar
REGKSK

SEQ ID NO: 2456749 - protein, 10 aa, Entamoeba dispar
REGLKTQGTI

SEQ ID NO: 2456750 - protein, 5 aa, Entamoeba dispar
REGRD

SEQ ID NO: 2456751 - protein, 7 aa, Entamoeba dispar
REGRVSY

SEQ ID NO: 2456752 - protein, 5 aa, Entamoeba dispar
REGSK

SEQ ID NO: 2456753 - protein, 6 aa, Entamoeba dispar
REGSSY

SEQ ID NO: 2456754 - protein, 7 aa, Entamoeba dispar
REHANEG

SEQ ID NO: 2456755 - protein, 7 aa, Entamoeba dispar
REHKQEH

SEQ ID NO: 2456756 - protein, 7 aa, Entamoeba dispar
REHNSAM

SEQ ID NO: 2456757 - protein, 11 aa, Entamoeba dispar
REHPPSSIQSI

SEQ ID NO: 2456758 - protein, 18 aa, Entamoeba dispar
REHSEEKKVDLEETEELS

SEQ ID NO: 2456759 - protein, 12 aa, Entamoeba dispar
REIDPDQTVARG

SEQ ID NO: 2456760 - protein, 23 aa, Entamoeba dispar
REIEDRTDSLFDKGGSSKEKDSW

SEQ ID NO: 2456761 - protein, 10 aa, Entamoeba dispar
REIEEKKEEN

SEQ ID NO: 2456762 - protein, 10 aa, Entamoeba dispar
REIKEKLKKP

SEQ ID NO: 2456763 - protein, 11 aa, Entamoeba dispar
REINDKFDDNA

SEQ ID NO: 2456764 - protein, 14 aa, Entamoeba dispar
REIPDSPQKHLKYG

SEQ ID NO: 2456765 - protein, 6 aa, Entamoeba dispar
REIPTN

SEQ ID NO: 2456766 - protein, 6 aa, Entamoeba dispar
REIQAG

SEQ ID NO: 2456767 - protein, 9 aa, Entamoeba dispar
REIQPNEDE

SEQ ID NO: 2456768 - protein, 22 aa, Entamoeba dispar
REIREKKTGRSIGTDKAGSSLF

SEQ ID NO: 2456769 - protein, 5 aa, Entamoeba dispar
REISP

SEQ ID NO: 2456770 - protein, 4 aa, Entamoeba dispar
REIT

SEQ ID NO: 2456771 - protein, 14 aa, Entamoeba dispar
REITRESKRLEREE

SEQ ID NO: 2456772 - protein, 10 aa, Entamoeba dispar
REITTGSSDN

SEQ ID NO: 2456773 - protein, 11 aa, Entamoeba dispar
REKAHQKNSKC

SEQ ID NO: 2456774 - protein, 16 aa, Entamoeba dispar
REKEDEKVLSKDQTPL

SEQ ID NO: 2456775 - protein, 8 aa, Entamoeba dispar
REKEENEA

SEQ ID NO: 2456776 - protein, 10 aa, Entamoeba dispar
REKEEQEELE

SEQ ID NO: 2456777 - protein, 8 aa, Entamoeba dispar
REKENTVK

SEQ ID NO: 2456778 - protein, 10 aa, Entamoeba dispar
REKERNNEGL

SEQ ID NO: 2456779 - protein, 9 aa, Entamoeba dispar
REKHQATER

SEQ ID NO: 2456780 - protein, 10 aa, Entamoeba dispar
REKINKNKDY

SEQ ID NO: 2456781 - protein, 21 aa, Entamoeba dispar
REKKKNEKEMKDNKTAAQKMQ

SEQ ID NO: 2456782 - protein, 67 aa, Entamoeba dispar
REKLEEKAKELIESERRSETRKSLVEESKIEREKMKERIKERWSEEEIKSRNERLSEKRKRERKDEI

SEQ ID NO: 2456783 - protein, 11 aa, Entamoeba dispar
REKNDSAVNGT

SEQ ID NO: 2456784 - protein, 7 aa, Entamoeba dispar
REKNPDA

SEQ ID NO: 2456785 - protein, 8 aa, Entamoeba dispar
REKPGKTT

SEQ ID NO: 2456786 - protein, 13 aa, Entamoeba dispar
REKRGIGISDNDH

SEQ ID NO: 2456787 - protein, 13 aa, Entamoeba dispar
REKRINKLEKEKL

SEQ ID NO: 2456788 - protein, 11 aa, Entamoeba dispar
REKRSAKPSLE

SEQ ID NO: 2456789 - protein, 10 aa, Entamoeba dispar
REKRTGFDGE

SEQ ID NO: 2456790 - protein, 7 aa, Entamoeba dispar
REKRTRG

SEQ ID NO: 2456791 - protein, 20 aa, Entamoeba dispar
REKSENERREVEKLTNPNQN

SEQ ID NO: 2456792 - protein, 9 aa, Entamoeba dispar
REKSKSINE

SEQ ID NO: 2456793 - protein, 5 aa, Entamoeba dispar
REKVE

SEQ ID NO: 2456794 - protein, 20 aa, Entamoeba dispar
REKWPSKDIQVDGGISDKTV

SEQ ID NO: 2456795 - protein, 7 aa, Entamoeba dispar
REKYNNA

SEQ ID NO: 2456796 - protein, 4 aa, Entamoeba dispar
RELE

SEQ ID NO: 2456797 - protein, 9 aa, Entamoeba dispar
RELEEDKLN

SEQ ID NO: 2456798 - protein, 58 aa, Entamoeba dispar
RELENDSTPVPQKKQPKRIETQEEREERRRKKFERPLESPKRSNSTFSTSSTPLPPRH

SEQ ID NO: 2456799 - protein, 61 aa, Entamoeba dispar
RELEQEQHKNEENITVNKEEQTNIEQEEPRELNKISDNENTKPNQVTIKESDNEEEQKELE

SEQ ID NO: 2456800 - protein, 9 aa, Entamoeba dispar
RELERSGKL

SEQ ID NO: 2456801 - protein, 9 aa, Entamoeba dispar
RELKRDMER

SEQ ID NO: 2456802 - protein, 10 aa, Entamoeba dispar
RELNENSPEI

SEQ ID NO: 2456803 - protein, 7 aa, Entamoeba dispar
RELQSSV

SEQ ID NO: 2456804 - protein, 4 aa, Entamoeba dispar
RELS

SEQ ID NO: 2456805 - protein, 12 aa, Entamoeba dispar
RELTSSKFSATI

SEQ ID NO: 2456806 - protein, 43 aa, Entamoeba dispar
REMDQSIDDIENSNDYLHDETDGEDINDDNIISEDEGDDNYEY

SEQ ID NO: 2456807 - protein, 9 aa, Entamoeba dispar
REMKNLESY

SEQ ID NO: 2456808 - protein, 5 aa, Entamoeba dispar
REMND

SEQ ID NO: 2456809 - protein, 8 aa, Entamoeba dispar
RENAKNVD

SEQ ID NO: 2456810 - protein, 5 aa, Entamoeba dispar
RENAP

SEQ ID NO: 2456811 - protein, 18 aa, Entamoeba dispar
RENDIEYDGEFDWYLTKQ

SEQ ID NO: 2456812 - protein, 6 aa, Entamoeba dispar
RENEET

SEQ ID NO: 2456813 - protein, 11 aa, Entamoeba dispar
RENEGAQQRNF

SEQ ID NO: 2456814 - protein, 14 aa, Entamoeba dispar
RENGNKKVSDSYLS

SEQ ID NO: 2456815 - protein, 8 aa, Entamoeba dispar
RENKKEYE

SEQ ID NO: 2456816 - protein, 23 aa, Entamoeba dispar
RENNDLKNKTIHSSSSNLSSNES

SEQ ID NO: 2456817 - protein, 7 aa, Entamoeba dispar
RENPTNI

SEQ ID NO: 2456818 - protein, 5 aa, Entamoeba dispar
RENQN

SEQ ID NO: 2456819 - protein, 7 aa, Entamoeba dispar
RENRIGY

SEQ ID NO: 2456820 - protein, 11 aa, Entamoeba dispar
RENSKRETPLT

SEQ ID NO: 2456821 - protein, 13 aa, Entamoeba dispar
RENTRKKQRRPAQ

SEQ ID NO: 2456822 - protein, 11 aa, Entamoeba dispar
RENTSPNITTG

SEQ ID NO: 2456823 - protein, 17 aa, Entamoeba dispar
RENVREKGSRGKGMSTL

SEQ ID NO: 2456824 - protein, 16 aa, Entamoeba dispar
RENVREKGSRGKGMTT

SEQ ID NO: 2456825 - protein, 4 aa, Entamoeba dispar
REPA

SEQ ID NO: 2456826 - protein, 5 aa, Entamoeba dispar
REPFQ

SEQ ID NO: 2456827 - protein, 9 aa, Entamoeba dispar
REPGVGKTA

SEQ ID NO: 2456828 - protein, 10 aa, Entamoeba dispar
REPNEERVKE

SEQ ID NO: 2456829 - protein, 6 aa, Entamoeba dispar
REPPED

SEQ ID NO: 2456830 - protein, 8 aa, Entamoeba dispar
REPPREQQ

SEQ ID NO: 2456831 - protein, 14 aa, Entamoeba dispar
REPQPLKPEEMTKF

SEQ ID NO: 2456832 - protein, 7 aa, Entamoeba dispar
REPSFKE

SEQ ID NO: 2456833 - protein, 7 aa, Entamoeba dispar
REPSTEA

SEQ ID NO: 2456834 - protein, 14 aa, Entamoeba dispar
REQAGSDKYGEEPI

SEQ ID NO: 2456835 - protein, 11 aa, Entamoeba dispar
REQDSNPGIRD

SEQ ID NO: 2456836 - protein, 5 aa, Entamoeba dispar
REQGE

SEQ ID NO: 2456837 - protein, 5 aa, Entamoeba dispar
REQGV

SEQ ID NO: 2456838 - protein, 13 aa, Entamoeba dispar
REQIKKGSKINDY

SEQ ID NO: 2456839 - protein, 7 aa, Entamoeba dispar
REQKDNF

SEQ ID NO: 2456840 - protein, 12 aa, Entamoeba dispar
REQLGTKYNGKE

SEQ ID NO: 2456841 - protein, 6 aa, Entamoeba dispar
REQLTN

SEQ ID NO: 2456842 - protein, 11 aa, Entamoeba dispar
REQPPPQLASR

SEQ ID NO: 2456843 - protein, 9 aa, Entamoeba dispar
REQRELEEA

SEQ ID NO: 2456844 - protein, 4 aa, Entamoeba dispar
REQW

SEQ ID NO: 2456845 - protein, 7 aa, Entamoeba dispar
REQYSKS

SEQ ID NO: 2456846 - protein, 14 aa, Entamoeba dispar
RERDKTATINTGDR

SEQ ID NO: 2456847 - protein, 10 aa, Entamoeba dispar
REREEEKNPI

SEQ ID NO: 2456848 - protein, 26 aa, Entamoeba dispar
REREEGNFDRDGNYTKFKREDGEKDN

SEQ ID NO: 2456849 - protein, 12 aa, Entamoeba dispar
REREESQEQEKI

SEQ ID NO: 2456850 - protein, 9 aa, Entamoeba dispar
RERETEEVM

SEQ ID NO: 2456851 - protein, 5 aa, Entamoeba dispar
RERFG

SEQ ID NO: 2456852 - protein, 11 aa, Entamoeba dispar
RERIENKEDID

SEQ ID NO: 2456853 - protein, 15 aa, Entamoeba dispar
RERKGKIEERRRRGI

SEQ ID NO: 2456854 - protein, 10 aa, Entamoeba dispar
RERKNGKGVG

SEQ ID NO: 2456855 - protein, 5 aa, Entamoeba dispar
RERLD

SEQ ID NO: 2456856 - protein, 6 aa, Entamoeba dispar
RERPSA

SEQ ID NO: 2456857 - protein, 29 aa, Entamoeba dispar
RERQNTKTSKQVKKQYHKSKSTIAISGPV

SEQ ID NO: 2456858 - protein, 15 aa, Entamoeba dispar
RERTKEVRRAKRDEL

SEQ ID NO: 2456859 - protein, 29 aa, Entamoeba dispar
RESCHTPSPVKYESIRDRTKDIPREQQKI

SEQ ID NO: 2456860 - protein, 9 aa, Entamoeba dispar
RESEAVDAS

SEQ ID NO: 2456861 - protein, 7 aa, Entamoeba dispar
RESEMET

SEQ ID NO: 2456862 - protein, 18 aa, Entamoeba dispar
RESFSKRKERASASMIEN

SEQ ID NO: 2456863 - protein, 24 aa, Entamoeba dispar
RESGKNEIMRTKQQDYSSIGNKTG

SEQ ID NO: 2456864 - protein, 18 aa, Entamoeba dispar
RESGTTGIYNKDGSVNKE

SEQ ID NO: 2456865 - protein, 6 aa, Entamoeba dispar
RESKHA

SEQ ID NO: 2456866 - protein, 6 aa, Entamoeba dispar
RESKHS

SEQ ID NO: 2456867 - protein, 10 aa, Entamoeba dispar
RESKPKPGTL

SEQ ID NO: 2456868 - protein, 7 aa, Entamoeba dispar
RESKPKQ

SEQ ID NO: 2456869 - protein, 10 aa, Entamoeba dispar
RESKSGMGRG

SEQ ID NO: 2456870 - protein, 4 aa, Entamoeba dispar
RESL

SEQ ID NO: 2456871 - protein, 5 aa, Entamoeba dispar
RESLT

SEQ ID NO: 2456872 - protein, 4 aa, Entamoeba dispar
RESN

SEQ ID NO: 2456873 - protein, 11 aa, Entamoeba dispar
RESNEEKIEEL

SEQ ID NO: 2456874 - protein, 8 aa, Entamoeba dispar
RESNPQYL

SEQ ID NO: 2456875 - protein, 14 aa, Entamoeba dispar
RESQQDNESIQEEW

SEQ ID NO: 2456876 - protein, 10 aa, Entamoeba dispar
RESSKKITQT

SEQ ID NO: 2456877 - protein, 5 aa, Entamoeba dispar
RESSL

SEQ ID NO: 2456878 - protein, 5 aa, Entamoeba dispar
RESSS

SEQ ID NO: 2456879 - protein, 12 aa, Entamoeba dispar
RESSYQKPLKPA

SEQ ID NO: 2456880 - protein, 8 aa, Entamoeba dispar
RESTATTN

SEQ ID NO: 2456881 - protein, 12 aa, Entamoeba dispar
RESTLSRDEYRE

SEQ ID NO: 2456882 - protein, 5 aa, Entamoeba dispar
RESTQ

SEQ ID NO: 2456883 - protein, 7 aa, Entamoeba dispar
RESTQPK

SEQ ID NO: 2456884 - protein, 4 aa, Entamoeba dispar
RETA

SEQ ID NO: 2456885 - protein, 79 aa, Entamoeba dispar
RETEKSEYFSKPTNGDFSDEFEEEEDDDYFDDSNEEEDDHENGEDFDDQEDDFELSSSSEEEEEEPEEIEEEEIEEEEE

SEQ ID NO: 2456886 - protein, 5 aa, Entamoeba dispar
RETET

SEQ ID NO: 2456887 - protein, 4 aa, Entamoeba dispar
RETF

SEQ ID NO: 2456888 - protein, 6 aa, Entamoeba dispar
RETHQI

SEQ ID NO: 2456889 - protein, 9 aa, Entamoeba dispar
RETKKSKGC

SEQ ID NO: 2456890 - protein, 4 aa, Entamoeba dispar
RETM

SEQ ID NO: 2456891 - protein, 4 aa, Entamoeba dispar
RETN

SEQ ID NO: 2456892 - protein, 6 aa, Entamoeba dispar
RETNEA

SEQ ID NO: 2456893 - protein, 16 aa, Entamoeba dispar
RETNRKKKERAKNSEC

SEQ ID NO: 2456894 - protein, 8 aa, Entamoeba dispar
RETNTTYN

SEQ ID NO: 2456895 - protein, 5 aa, Entamoeba dispar
RETPY

SEQ ID NO: 2456896 - protein, 7 aa, Entamoeba dispar
RETRNST

SEQ ID NO: 2456897 - protein, 6 aa, Entamoeba dispar
RETSEL

SEQ ID NO: 2456898 - protein, 5 aa, Entamoeba dispar
RETSI

SEQ ID NO: 2456899 - protein, 11 aa, Entamoeba dispar
RETTQGIDPEE

SEQ ID NO: 2456900 - protein, 5 aa, Entamoeba dispar
RETVN

SEQ ID NO: 2456901 - protein, 6 aa, Entamoeba dispar
REVCGG

SEQ ID NO: 2456902 - protein, 5 aa, Entamoeba dispar
REVGE

SEQ ID NO: 2456903 - protein, 8 aa, Entamoeba dispar
REVSSEKE

SEQ ID NO: 2456904 - protein, 13 aa, Entamoeba dispar
REVTETKEELIKE

SEQ ID NO: 2456905 - protein, 4 aa, Entamoeba dispar
REWN

SEQ ID NO: 2456906 - protein, 9 aa, Entamoeba dispar
REYDKQTAS

SEQ ID NO: 2456907 - protein, 14 aa, Entamoeba dispar
REYEESKNEIDESI

SEQ ID NO: 2456908 - protein, 6 aa, Entamoeba dispar
REYNRR

SEQ ID NO: 2456909 - protein, 5 aa, Entamoeba dispar
REYPE

SEQ ID NO: 2456910 - protein, 11 aa, Entamoeba dispar
REYPNSLKGGD

SEQ ID NO: 2456911 - protein, 11 aa, Entamoeba dispar
REYPNSLKNGD

SEQ ID NO: 2456912 - protein, 8 aa, Entamoeba dispar
REYSKSRC

SEQ ID NO: 2456913 - protein, 16 aa, Entamoeba dispar
REYSKSRCRLEADNEL

SEQ ID NO: 2456914 - protein, 12 aa, Entamoeba dispar
RFAGAGENEEAL

SEQ ID NO: 2456915 - protein, 13 aa, Entamoeba dispar
RFAGKKEKAPKIS

SEQ ID NO: 2456916 - protein, 10 aa, Entamoeba dispar
RFAPTGRNNQ

SEQ ID NO: 2456917 - protein, 10 aa, Entamoeba dispar
RFDERRAAGY

SEQ ID NO: 2456918 - protein, 9 aa, Entamoeba dispar
RFDNKSDRV

SEQ ID NO: 2456919 - protein, 9 aa, Entamoeba dispar
RFDQTDNRL

SEQ ID NO: 2456920 - protein, 14 aa, Entamoeba dispar
RFDQVEEQTNQKTE

SEQ ID NO: 2456921 - protein, 5 aa, Entamoeba dispar
RFEER

SEQ ID NO: 2456922 - protein, 9 aa, Entamoeba dispar
RFEGTRKEN

SEQ ID NO: 2456923 - protein, 4 aa, Entamoeba dispar
RFEK

SEQ ID NO: 2456924 - protein, 11 aa, Entamoeba dispar
RFENDTMSKFE

SEQ ID NO: 2456925 - protein, 11 aa, Entamoeba dispar
RFEPETENTSL

SEQ ID NO: 2456926 - protein, 4 aa, Entamoeba dispar
RFER

SEQ ID NO: 2456927 - protein, 11 aa, Entamoeba dispar
RFESKSYKDFK

SEQ ID NO: 2456928 - protein, 9 aa, Entamoeba dispar
RFESPRDQE

SEQ ID NO: 2456929 - protein, 6 aa, Entamoeba dispar
RFGEGP

SEQ ID NO: 2456930 - protein, 4 aa, Entamoeba dispar
RFGG

SEQ ID NO: 2456931 - protein, 7 aa, Entamoeba dispar
RFGPNDM

SEQ ID NO: 2456932 - protein, 17 aa, Entamoeba dispar
RFKKDGIKLGGGSYGEV

SEQ ID NO: 2456933 - protein, 10 aa, Entamoeba dispar
RFNDSNEIIE

SEQ ID NO: 2456934 - protein, 9 aa, Entamoeba dispar
RFNNKSDRV

SEQ ID NO: 2456935 - protein, 5 aa, Entamoeba dispar
RFNSS

SEQ ID NO: 2456936 - protein, 10 aa, Entamoeba dispar
RFNTSTEYEK

SEQ ID NO: 2456937 - protein, 10 aa, Entamoeba dispar
RFPKNTPPAI

SEQ ID NO: 2456938 - protein, 4 aa, Entamoeba dispar
RFPP

SEQ ID NO: 2456939 - protein, 6 aa, Entamoeba dispar
RFQQPF

SEQ ID NO: 2456940 - protein, 9 aa, Entamoeba dispar
RFQQPFKGT

SEQ ID NO: 2456941 - protein, 11 aa, Entamoeba dispar
RFSDDKKAKLV

SEQ ID NO: 2456942 - protein, 13 aa, Entamoeba dispar
RFSQEEKKELENL

SEQ ID NO: 2456943 - protein, 6 aa, Entamoeba dispar
RFTGEV

SEQ ID NO: 2456944 - protein, 10 aa, Entamoeba dispar
RFTSQYEPTI

SEQ ID NO: 2456945 - protein, 5 aa, Entamoeba dispar
RFTTT

SEQ ID NO: 2456946 - protein, 6 aa, Entamoeba dispar
RFYTPE

SEQ ID NO: 2456947 - protein, 4 aa, Entamoeba dispar
RGAF

SEQ ID NO: 2456948 - protein, 9 aa, Entamoeba dispar
RGANHTGKY

SEQ ID NO: 2456949 - protein, 9 aa, Entamoeba dispar
RGAPPVGDG

SEQ ID NO: 2456950 - protein, 8 aa, Entamoeba dispar
RGASPYQY

SEQ ID NO: 2456951 - protein, 8 aa, Entamoeba dispar
RGASSPAL

SEQ ID NO: 2456952 - protein, 5 aa, Entamoeba dispar
RGCEA

SEQ ID NO: 2456953 - protein, 9 aa, Entamoeba dispar
RGCREQLKE

SEQ ID NO: 2456954 - protein, 10 aa, Entamoeba dispar
RGCSSHERVG

SEQ ID NO: 2456955 - protein, 16 aa, Entamoeba dispar
RGCTPNTGEEKVDSSI

SEQ ID NO: 2456956 - protein, 6 aa, Entamoeba dispar
RGDDRE

SEQ ID NO: 2456957 - protein, 7 aa, Entamoeba dispar
RGDEKKS

SEQ ID NO: 2456958 - protein, 5 aa, Entamoeba dispar
RGDER

SEQ ID NO: 2456959 - protein, 5 aa, Entamoeba dispar
RGDFS

SEQ ID NO: 2456960 - protein, 4 aa, Entamoeba dispar
RGDG

SEQ ID NO: 2456961 - protein, 12 aa, Entamoeba dispar
RGDITETTQPFE

SEQ ID NO: 2456962 - protein, 12 aa, Entamoeba dispar
RGDKKENKGTIE

SEQ ID NO: 2456963 - protein, 9 aa, Entamoeba dispar
RGDNSTDQL

SEQ ID NO: 2456964 - protein, 22 aa, Entamoeba dispar
RGDRYYSEAEEAREEEREKRIR

SEQ ID NO: 2456965 - protein, 11 aa, Entamoeba dispar
RGDTKTQSPTI

SEQ ID NO: 2456966 - protein, 4 aa, Entamoeba dispar
RGDV

SEQ ID NO: 2456967 - protein, 11 aa, Entamoeba dispar
RGEAKEKFEGD

SEQ ID NO: 2456968 - protein, 6 aa, Entamoeba dispar
RGEALT

SEQ ID NO: 2456969 - protein, 7 aa, Entamoeba dispar
RGEESPF

SEQ ID NO: 2456970 - protein, 7 aa, Entamoeba dispar
RGEGERI

SEQ ID NO: 2456971 - protein, 23 aa, Entamoeba dispar
RGEIKREEEEIESQVREEEETQI

SEQ ID NO: 2456972 - protein, 9 aa, Entamoeba dispar
RGEKDQQDV

SEQ ID NO: 2456973 - protein, 18 aa, Entamoeba dispar
RGEKKENKGSIEKAQVHG

SEQ ID NO: 2456974 - protein, 10 aa, Entamoeba dispar
RGEKPQSGLG

SEQ ID NO: 2456975 - protein, 4 aa, Entamoeba dispar
RGEN

SEQ ID NO: 2456976 - protein, 13 aa, Entamoeba dispar
RGENSLNHDKYGD

SEQ ID NO: 2456977 - protein, 7 aa, Entamoeba dispar
RGEQCRK

SEQ ID NO: 2456978 - protein, 9 aa, Entamoeba dispar
RGEQSPEGK

SEQ ID NO: 2456979 - protein, 16 aa, Entamoeba dispar
RGERIENEKKELKTTI

SEQ ID NO: 2456980 - protein, 11 aa, Entamoeba dispar
RGERNEKLGRT

SEQ ID NO: 2456981 - protein, 8 aa, Entamoeba dispar
RGETTTIQ

SEQ ID NO: 2456982 - protein, 61 aa, Entamoeba dispar
RGEVKENTEGIRDERKKDGEKEKKESDKEEKQEIKGETEGKEDDGKIKVEKEQTKSRWGNS

SEQ ID NO: 2456983 - protein, 61 aa, Entamoeba dispar
RGEVKENTEGIRDKRKKDGEKEKKEGDKEEKQEIKGETEGKEDDGKIKVEKEQTKSRWGNS

SEQ ID NO: 2456984 - protein, 19 aa, Entamoeba dispar
RGFNGQPQEIMSKEERKVK

SEQ ID NO: 2456985 - protein, 12 aa, Entamoeba dispar
RGFSETYSSQHT

SEQ ID NO: 2456986 - protein, 57 aa, Entamoeba dispar
RGGAPRGGRGGSNGRGGFGNDNKGPRNAGRGAPKGGRGAKGGAKGRGGIGSKGGVQI

SEQ ID NO: 2456987 - protein, 5 aa, Entamoeba dispar
RGGDL

SEQ ID NO: 2456988 - protein, 6 aa, Entamoeba dispar
RGGGSE

SEQ ID NO: 2456989 - protein, 15 aa, Entamoeba dispar
RGGKDEESEEEDGIE

SEQ ID NO: 2456990 - protein, 7 aa, Entamoeba dispar
RGGNIGN

SEQ ID NO: 2456991 - protein, 6 aa, Entamoeba dispar
RGGNQH

SEQ ID NO: 2456992 - protein, 9 aa, Entamoeba dispar
RGGQPCNDA

SEQ ID NO: 2456993 - protein, 8 aa, Entamoeba dispar
RGGRDIEG

SEQ ID NO: 2456994 - protein, 10 aa, Entamoeba dispar
RGGRTEEKEF

SEQ ID NO: 2456995 - protein, 29 aa, Entamoeba dispar
RGGTSLKKSTDRVLQPPKEELTAQQKGDL

SEQ ID NO: 2456996 - protein, 5 aa, Entamoeba dispar
RGHPR

SEQ ID NO: 2456997 - protein, 6 aa, Entamoeba dispar
RGHSKG

SEQ ID NO: 2456998 - protein, 4 aa, Entamoeba dispar
RGIN

SEQ ID NO: 2456999 - protein, 5 aa, Entamoeba dispar
RGINE

SEQ ID NO: 2457000 - protein, 12 aa, Entamoeba dispar
RGIRQGKTGKCY

SEQ ID NO: 2457001 - protein, 9 aa, Entamoeba dispar
RGKDKKLDK

SEQ ID NO: 2457002 - protein, 8 aa, Entamoeba dispar
RGKEKKQL

SEQ ID NO: 2457003 - protein, 4 aa, Entamoeba dispar
RGKI

SEQ ID NO: 2457004 - protein, 13 aa, Entamoeba dispar
RGKKDTNKGKFSS

SEQ ID NO: 2457005 - protein, 5 aa, Entamoeba dispar
RGKKK

SEQ ID NO: 2457006 - protein, 9 aa, Entamoeba dispar
RGKKQINKG

SEQ ID NO: 2457007 - protein, 9 aa, Entamoeba dispar
RGKQKEKPL

SEQ ID NO: 2457008 - protein, 9 aa, Entamoeba dispar
RGKQQQTLP

SEQ ID NO: 2457009 - protein, 17 aa, Entamoeba dispar
RGKSTREASKQLKVSPS

SEQ ID NO: 2457010 - protein, 5 aa, Entamoeba dispar
RGKTD

SEQ ID NO: 2457011 - protein, 7 aa, Entamoeba dispar
RGKTDPL

SEQ ID NO: 2457012 - protein, 16 aa, Entamoeba dispar
RGKTFGGYGNEPGKFN

SEQ ID NO: 2457013 - protein, 11 aa, Entamoeba dispar
RGKTPQKPTLE

SEQ ID NO: 2457014 - protein, 4 aa, Entamoeba dispar
RGKV

SEQ ID NO: 2457015 - protein, 7 aa, Entamoeba dispar
RGKWSTE

SEQ ID NO: 2457016 - protein, 4 aa, Entamoeba dispar
RGKY

SEQ ID NO: 2457017 - protein, 5 aa, Entamoeba dispar
RGKYK

SEQ ID NO: 2457018 - protein, 4 aa, Entamoeba dispar
RGLD

SEQ ID NO: 2457019 - protein, 11 aa, Entamoeba dispar
RGLKEETASKR

SEQ ID NO: 2457020 - protein, 10 aa, Entamoeba dispar
RGLPKEYNEF

SEQ ID NO: 2457021 - protein, 8 aa, Entamoeba dispar
RGLSPSDI

SEQ ID NO: 2457022 - protein, 6 aa, Entamoeba dispar
RGLTGK

SEQ ID NO: 2457023 - protein, 4 aa, Entamoeba dispar
RGMS

SEQ ID NO: 2457024 - protein, 37 aa, Entamoeba dispar
RGMTVTSKDENLESDKKRKKRHNTTKETSTPVLPSGS

SEQ ID NO: 2457025 - protein, 6 aa, Entamoeba dispar
RGNETE

SEQ ID NO: 2457026 - protein, 6 aa, Entamoeba dispar
RGNGIK

SEQ ID NO: 2457027 - protein, 10 aa, Entamoeba dispar
RGNGRGQFKN

SEQ ID NO: 2457028 - protein, 4 aa, Entamoeba dispar
RGNM

SEQ ID NO: 2457029 - protein, 13 aa, Entamoeba dispar
RGNSPPLSPPLKN

SEQ ID NO: 2457030 - protein, 8 aa, Entamoeba dispar
RGNSTTEI

SEQ ID NO: 2457031 - protein, 5 aa, Entamoeba dispar
RGNTE

SEQ ID NO: 2457032 - protein, 8 aa, Entamoeba dispar
RGPITEEK

SEQ ID NO: 2457033 - protein, 12 aa, Entamoeba dispar
RGQCQKTSGLSK

SEQ ID NO: 2457034 - protein, 5 aa, Entamoeba dispar
RGQEE

SEQ ID NO: 2457035 - protein, 5 aa, Entamoeba dispar
RGQGL

SEQ ID NO: 2457036 - protein, 7 aa, Entamoeba dispar
RGQKIES

SEQ ID NO: 2457037 - protein, 35 aa, Entamoeba dispar
RGQSEINLTPNSQKHENTSSSKSSSNKRSSTSGFV

SEQ ID NO: 2457038 - protein, 9 aa, Entamoeba dispar
RGQSQSQVQ

SEQ ID NO: 2457039 - protein, 5 aa, Entamoeba dispar
RGQYS

SEQ ID NO: 2457040 - protein, 18 aa, Entamoeba dispar
RGRDPDPSALLKKLHLIN

SEQ ID NO: 2457041 - protein, 38 aa, Entamoeba dispar
RGRDTRSTFSGSTDVSSFSTVGENKIDEQTYNADPRFS

SEQ ID NO: 2457042 - protein, 4 aa, Entamoeba dispar
RGRK

SEQ ID NO: 2457043 - protein, 5 aa, Entamoeba dispar
RGRKC

SEQ ID NO: 2457044 - protein, 10 aa, Entamoeba dispar
RGRKGSYVQT

SEQ ID NO: 2457045 - protein, 33 aa, Entamoeba dispar
RGRKRNNRIIKGKNKKKNKKEKKKRMEEISQGV

SEQ ID NO: 2457046 - protein, 4 aa, Entamoeba dispar
RGRL

SEQ ID NO: 2457047 - protein, 4 aa, Entamoeba dispar
RGRQ

SEQ ID NO: 2457048 - protein, 5 aa, Entamoeba dispar
RGRQV

SEQ ID NO: 2457049 - protein, 4 aa, Entamoeba dispar
RGRR

SEQ ID NO: 2457050 - protein, 4 aa, Entamoeba dispar
RGRS

SEQ ID NO: 2457051 - protein, 10 aa, Entamoeba dispar
RGRSKNAYTT

SEQ ID NO: 2457052 - protein, 11 aa, Entamoeba dispar
RGSADMKSGLA

SEQ ID NO: 2457053 - protein, 6 aa, Entamoeba dispar
RGSDTV

SEQ ID NO: 2457054 - protein, 5 aa, Entamoeba dispar
RGSET

SEQ ID NO: 2457055 - protein, 4 aa, Entamoeba dispar
RGSF

SEQ ID NO: 2457056 - protein, 5 aa, Entamoeba dispar
RGSGI

SEQ ID NO: 2457057 - protein, 7 aa, Entamoeba dispar
RGSKSTI

SEQ ID NO: 2457058 - protein, 8 aa, Entamoeba dispar
RGSNYDNN

SEQ ID NO: 2457059 - protein, 4 aa, Entamoeba dispar
RGSS

SEQ ID NO: 2457060 - protein, 6 aa, Entamoeba dispar
RGSSIV

SEQ ID NO: 2457061 - protein, 5 aa, Entamoeba dispar
RGSSP

SEQ ID NO: 2457062 - protein, 8 aa, Entamoeba dispar
RGSTQPIP

SEQ ID NO: 2457063 - protein, 5 aa, Entamoeba dispar
RGSTR

SEQ ID NO: 2457064 - protein, 5 aa, Entamoeba dispar
RGTAG

SEQ ID NO: 2457065 - protein, 7 aa, Entamoeba dispar
RGTDPMS

SEQ ID NO: 2457066 - protein, 12 aa, Entamoeba dispar
RGTDRKCQGYVE

SEQ ID NO: 2457067 - protein, 9 aa, Entamoeba dispar
RGTETEEQV

SEQ ID NO: 2457068 - protein, 10 aa, Entamoeba dispar
RGTLVSPEEL

SEQ ID NO: 2457069 - protein, 5 aa, Entamoeba dispar
RGTYQ

SEQ ID NO: 2457070 - protein, 6 aa, Entamoeba dispar
RGVDED

SEQ ID NO: 2457071 - protein, 17 aa, Entamoeba dispar
RGVHEPNYYGSYTQSAT

SEQ ID NO: 2457072 - protein, 7 aa, Entamoeba dispar
RGVSAKQ

SEQ ID NO: 2457073 - protein, 9 aa, Entamoeba dispar
RGVSSDGTP

SEQ ID NO: 2457074 - protein, 4 aa, Entamoeba dispar
RGVT

SEQ ID NO: 2457075 - protein, 8 aa, Entamoeba dispar
RGWSGKSF

SEQ ID NO: 2457076 - protein, 8 aa, Entamoeba dispar
RGYPKTAP

SEQ ID NO: 2457077 - protein, 8 aa, Entamoeba dispar
RHAAAKRM

SEQ ID NO: 2457078 - protein, 6 aa, Entamoeba dispar
RHDLEP

SEQ ID NO: 2457079 - protein, 7 aa, Entamoeba dispar
RHDSESP

SEQ ID NO: 2457080 - protein, 10 aa, Entamoeba dispar
RHDTQPRQNL

SEQ ID NO: 2457081 - protein, 8 aa, Entamoeba dispar
RHEDPNET

SEQ ID NO: 2457082 - protein, 10 aa, Entamoeba dispar
RHEEGRSRQE

SEQ ID NO: 2457083 - protein, 6 aa, Entamoeba dispar
RHEEKE

SEQ ID NO: 2457084 - protein, 9 aa, Entamoeba dispar
RHEEKKEEI

SEQ ID NO: 2457085 - protein, 5 aa, Entamoeba dispar
RHEPL

SEQ ID NO: 2457086 - protein, 19 aa, Entamoeba dispar
RHEQRKRFRESGKRTQPMR

SEQ ID NO: 2457087 - protein, 7 aa, Entamoeba dispar
RHESVAT

SEQ ID NO: 2457088 - protein, 12 aa, Entamoeba dispar
RHETEKEYPFDQ

SEQ ID NO: 2457089 - protein, 33 aa, Entamoeba dispar
RHETTTLNRSGSTEINTYSPKSLPRKSVRKTLT

SEQ ID NO: 2457090 - protein, 6 aa, Entamoeba dispar
RHGGEN

SEQ ID NO: 2457091 - protein, 16 aa, Entamoeba dispar
RHGSGNGDSGSKSGSV

SEQ ID NO: 2457092 - protein, 4 aa, Entamoeba dispar
RHHS

SEQ ID NO: 2457093 - protein, 7 aa, Entamoeba dispar
RHKEKLE

SEQ ID NO: 2457094 - protein, 5 aa, Entamoeba dispar
RHKSK

SEQ ID NO: 2457095 - protein, 4 aa, Entamoeba dispar
RHND

SEQ ID NO: 2457096 - protein, 5 aa, Entamoeba dispar
RHNGK

SEQ ID NO: 2457097 - protein, 5 aa, Entamoeba dispar
RHNTP

SEQ ID NO: 2457098 - protein, 34 aa, Entamoeba dispar
RHPLEKQRKNTKTGNSLNDLGDKFDNVSDDELKT

SEQ ID NO: 2457099 - protein, 4 aa, Entamoeba dispar
RHPN

SEQ ID NO: 2457100 - protein, 8 aa, Entamoeba dispar
RHRGQIDA

SEQ ID NO: 2457101 - protein, 6 aa, Entamoeba dispar
RHRRTT

SEQ ID NO: 2457102 - protein, 20 aa, Entamoeba dispar
RHRSSKEIEKSQYRKIGREW

SEQ ID NO: 2457103 - protein, 11 aa, Entamoeba dispar
RHSDKQKLSFN

SEQ ID NO: 2457104 - protein, 12 aa, Entamoeba dispar
RHSDKQKLSFSD

SEQ ID NO: 2457105 - protein, 15 aa, Entamoeba dispar
RHSDKQKLSFSENQF

SEQ ID NO: 2457106 - protein, 19 aa, Entamoeba dispar
RHSSEDPKSYIGKNAPIQF

SEQ ID NO: 2457107 - protein, 12 aa, Entamoeba dispar
RHSSKTEEKKEE

SEQ ID NO: 2457108 - protein, 9 aa, Entamoeba dispar
RHTGERTEF

SEQ ID NO: 2457109 - protein, 6 aa, Entamoeba dispar
RHTGSR

SEQ ID NO: 2457110 - protein, 10 aa, Entamoeba dispar
RHTKNEETLN

SEQ ID NO: 2457111 - protein, 12 aa, Entamoeba dispar
RIASGENVISTT

SEQ ID NO: 2457112 - protein, 6 aa, Entamoeba dispar
RICEGD

SEQ ID NO: 2457113 - protein, 16 aa, Entamoeba dispar
RIDAKEALKHPFISFY

SEQ ID NO: 2457114 - protein, 5 aa, Entamoeba dispar
RIDEF

SEQ ID NO: 2457115 - protein, 11 aa, Entamoeba dispar
RIDSGNSTNIE

SEQ ID NO: 2457116 - protein, 16 aa, Entamoeba dispar
RIDSKEKRKLTKTEKL

SEQ ID NO: 2457117 - protein, 7 aa, Entamoeba dispar
RIDTNKL

SEQ ID NO: 2457118 - protein, 9 aa, Entamoeba dispar
RIEDESPES

SEQ ID NO: 2457119 - protein, 13 aa, Entamoeba dispar
RIEEDPLSEGYNE

SEQ ID NO: 2457120 - protein, 49 aa, Entamoeba dispar
RIEEEERKLQEEEEEENKRKEEEELKVKQEEENKRKAIENKQLKEKKEW

SEQ ID NO: 2457121 - protein, 7 aa, Entamoeba dispar
RIEEITK

SEQ ID NO: 2457122 - protein, 7 aa, Entamoeba dispar
RIEENKE

SEQ ID NO: 2457123 - protein, 11 aa, Entamoeba dispar
RIEKENNEIRK

SEQ ID NO: 2457124 - protein, 7 aa, Entamoeba dispar
RIEKERQ

SEQ ID NO: 2457125 - protein, 13 aa, Entamoeba dispar
RIEKGKNKYPVSG

SEQ ID NO: 2457126 - protein, 20 aa, Entamoeba dispar
RIEKKQVAKKTNEPKQLSET

SEQ ID NO: 2457127 - protein, 16 aa, Entamoeba dispar
RIEKTYPPKYQIEQLE

SEQ ID NO: 2457128 - protein, 7 aa, Entamoeba dispar
RIENRQT

SEQ ID NO: 2457129 - protein, 14 aa, Entamoeba dispar
RIERPREKDYYSGE

SEQ ID NO: 2457130 - protein, 7 aa, Entamoeba dispar
RIERTQD

SEQ ID NO: 2457131 - protein, 6 aa, Entamoeba dispar
RIESNA

SEQ ID NO: 2457132 - protein, 6 aa, Entamoeba dispar
RIESTT

SEQ ID NO: 2457133 - protein, 31 aa, Entamoeba dispar
RIETNENNTNTDSFSLTTTPTVSSTPPTNVY

SEQ ID NO: 2457134 - protein, 9 aa, Entamoeba dispar
RIGEGVGGC

SEQ ID NO: 2457135 - protein, 6 aa, Entamoeba dispar
RIGERP

SEQ ID NO: 2457136 - protein, 5 aa, Entamoeba dispar
RIGET

SEQ ID NO: 2457137 - protein, 6 aa, Entamoeba dispar
RIGGEG

SEQ ID NO: 2457138 - protein, 6 aa, Entamoeba dispar
RIGQKN

SEQ ID NO: 2457139 - protein, 8 aa, Entamoeba dispar
RIGQTKPV

SEQ ID NO: 2457140 - protein, 5 aa, Entamoeba dispar
RIGRS

SEQ ID NO: 2457141 - protein, 4 aa, Entamoeba dispar
RIGS

SEQ ID NO: 2457142 - protein, 16 aa, Entamoeba dispar
RIGSKEDGKPSEEGDE

SEQ ID NO: 2457143 - protein, 8 aa, Entamoeba dispar
RIGYDGEI

SEQ ID NO: 2457144 - protein, 5 aa, Entamoeba dispar
RIKDR

SEQ ID NO: 2457145 - protein, 9 aa, Entamoeba dispar
RIKDSSTTS

SEQ ID NO: 2457146 - protein, 21 aa, Entamoeba dispar
RIKDYPKYRSPGSSPKTIPPY

SEQ ID NO: 2457147 - protein, 259 aa, Entamoeba dispar
RIKEEAEKKAKEEAEAKAKEEAEAKAKEEAEAKAKEEAEAKAKEEAEAKAKEEAEAKAKEEAEKKAKEEAEAKAKEEAEAKAKEEAEAKAKEEAEAKAKEEAEAKAKEEAEAKAKEEAEKKAKEEAEAKAKEEAEAKAKEEAEAKAKEEAEAKAKEEAEAKAKEEAEAKAKEEAEAKAKEEAEAKAKEEAEAKAKEEAEAKAKEEAEAKAKEEAEAKAKEEAEAKAKEEVKEEVKEEVKEENCEECQEQNKAQDTIPTE

SEQ ID NO: 2457148 - protein, 11 aa, Entamoeba dispar
RIKEEKQKIED

SEQ ID NO: 2457149 - protein, 35 aa, Entamoeba dispar
RIKEERQRIREEQEQEYKKALEEAKRQEEREQKIQ

SEQ ID NO: 2457150 - protein, 12 aa, Entamoeba dispar
RIKENKQKALNQ

SEQ ID NO: 2457151 - protein, 13 aa, Entamoeba dispar
RIKQENEAKRKRI

SEQ ID NO: 2457152 - protein, 7 aa, Entamoeba dispar
RIKRQTI

SEQ ID NO: 2457153 - protein, 20 aa, Entamoeba dispar
RIKSHSSSILSSRSSTPREM

SEQ ID NO: 2457154 - protein, 7 aa, Entamoeba dispar
RINDNKI

SEQ ID NO: 2457155 - protein, 5 aa, Entamoeba dispar
RINEP

SEQ ID NO: 2457156 - protein, 7 aa, Entamoeba dispar
RINGKEV

SEQ ID NO: 2457157 - protein, 6 aa, Entamoeba dispar
RINKER

SEQ ID NO: 2457158 - protein, 4 aa, Entamoeba dispar
RINP

SEQ ID NO: 2457159 - protein, 10 aa, Entamoeba dispar
RINQKQEDEE

SEQ ID NO: 2457160 - protein, 18 aa, Entamoeba dispar
RINSHQTVAPVPKTTEEN

SEQ ID NO: 2457161 - protein, 11 aa, Entamoeba dispar
RINTTAPPRLD

SEQ ID NO: 2457162 - protein, 5 aa, Entamoeba dispar
RINYD

SEQ ID NO: 2457163 - protein, 5 aa, Entamoeba dispar
RIPIK

SEQ ID NO: 2457164 - protein, 4 aa, Entamoeba dispar
RIPQ

SEQ ID NO: 2457165 - protein, 4 aa, Entamoeba dispar
RIPS

SEQ ID NO: 2457166 - protein, 11 aa, Entamoeba dispar
RIQAEEGHWDP

SEQ ID NO: 2457167 - protein, 7 aa, Entamoeba dispar
RIQASKK

SEQ ID NO: 2457168 - protein, 5 aa, Entamoeba dispar
RIQKE

SEQ ID NO: 2457169 - protein, 8 aa, Entamoeba dispar
RIQKKNKK

SEQ ID NO: 2457170 - protein, 5 aa, Entamoeba dispar
RIREE

SEQ ID NO: 2457171 - protein, 11 aa, Entamoeba dispar
RIREETQKELQ

SEQ ID NO: 2457172 - protein, 13 aa, Entamoeba dispar
RIRGDPKTPDIHQ

SEQ ID NO: 2457173 - protein, 8 aa, Entamoeba dispar
RIRNEEKF

SEQ ID NO: 2457174 - protein, 5 aa, Entamoeba dispar
RIRNP

SEQ ID NO: 2457175 - protein, 9 aa, Entamoeba dispar
RIRSTNELN

SEQ ID NO: 2457176 - protein, 5 aa, Entamoeba dispar
RISDG

SEQ ID NO: 2457177 - protein, 4 aa, Entamoeba dispar
RISE

SEQ ID NO: 2457178 - protein, 10 aa, Entamoeba dispar
RISEDCQQDE

SEQ ID NO: 2457179 - protein, 7 aa, Entamoeba dispar
RISESTL

SEQ ID NO: 2457180 - protein, 9 aa, Entamoeba dispar
RISGEVEIS

SEQ ID NO: 2457181 - protein, 11 aa, Entamoeba dispar
RISKGAEKQIA

SEQ ID NO: 2457182 - protein, 16 aa, Entamoeba dispar
RISKKRRFNASTKYTN

SEQ ID NO: 2457183 - protein, 10 aa, Entamoeba dispar
RISKSSTIND

SEQ ID NO: 2457184 - protein, 14 aa, Entamoeba dispar
RISNYNKGINYDSD

SEQ ID NO: 2457185 - protein, 5 aa, Entamoeba dispar
RISRN

SEQ ID NO: 2457186 - protein, 8 aa, Entamoeba dispar
RISRSQPN

SEQ ID NO: 2457187 - protein, 5 aa, Entamoeba dispar
RISSE

SEQ ID NO: 2457188 - protein, 7 aa, Entamoeba dispar
RISSESI

SEQ ID NO: 2457189 - protein, 5 aa, Entamoeba dispar
RISSH

SEQ ID NO: 2457190 - protein, 98 aa, Entamoeba dispar
RITAKNQKKDYGGIGNYGGMSSSSYGNYSSNTTSFSSDDFNSFNKPTSTYGGYHDEPQPTTSTTYSNNSQPTYGRPGTYKDNVVEQKQIQRDPSPVSQ

SEQ ID NO: 2457191 - protein, 12 aa, Entamoeba dispar
RITDSKDKSQEN

SEQ ID NO: 2457192 - protein, 4 aa, Entamoeba dispar
RITE

SEQ ID NO: 2457193 - protein, 11 aa, Entamoeba dispar
RITKGDDYKLS

SEQ ID NO: 2457194 - protein, 5 aa, Entamoeba dispar
RITKT

SEQ ID NO: 2457195 - protein, 16 aa, Entamoeba dispar
RITPDKTASDLGLQDG

SEQ ID NO: 2457196 - protein, 6 aa, Entamoeba dispar
RITPKE

SEQ ID NO: 2457197 - protein, 10 aa, Entamoeba dispar
RITQSKSFKE

SEQ ID NO: 2457198 - protein, 5 aa, Entamoeba dispar
RITSL

SEQ ID NO: 2457199 - protein, 5 aa, Entamoeba dispar
RITSN

SEQ ID NO: 2457200 - protein, 5 aa, Entamoeba dispar
RITSQ

SEQ ID NO: 2457201 - protein, 9 aa, Entamoeba dispar
RITTGSREL

SEQ ID NO: 2457202 - protein, 15 aa, Entamoeba dispar
RITTKNVSNRYSTKN

SEQ ID NO: 2457203 - protein, 6 aa, Entamoeba dispar
RITYTG

SEQ ID NO: 2457204 - protein, 25 aa, Entamoeba dispar
RIVEEENDIQKKVEQREQINEEEQN

SEQ ID NO: 2457205 - protein, 9 aa, Entamoeba dispar
RIVQESDEK

SEQ ID NO: 2457206 - protein, 19 aa, Entamoeba dispar
RKAEIEVTGDSAGISDPSY

SEQ ID NO: 2457207 - protein, 10 aa, Entamoeba dispar
RKAIEEASNY

SEQ ID NO: 2457208 - protein, 7 aa, Entamoeba dispar
RKAIKDK

SEQ ID NO: 2457209 - protein, 13 aa, Entamoeba dispar
RKAINDRFNEQNH

SEQ ID NO: 2457210 - protein, 8 aa, Entamoeba dispar
RKAKNITV

SEQ ID NO: 2457211 - protein, 9 aa, Entamoeba dispar
RKAKPIGSN

SEQ ID NO: 2457212 - protein, 5 aa, Entamoeba dispar
RKALQ

SEQ ID NO: 2457213 - protein, 28 aa, Entamoeba dispar
RKANASRGKLKREQVEDEENLTVEREVD

SEQ ID NO: 2457214 - protein, 6 aa, Entamoeba dispar
RKANIK

SEQ ID NO: 2457215 - protein, 6 aa, Entamoeba dispar
RKANKE

SEQ ID NO: 2457216 - protein, 8 aa, Entamoeba dispar
RKANKKNK

SEQ ID NO: 2457217 - protein, 9 aa, Entamoeba dispar
RKAPALEAT

SEQ ID NO: 2457218 - protein, 8 aa, Entamoeba dispar
RKAPQLPK

SEQ ID NO: 2457219 - protein, 10 aa, Entamoeba dispar
RKASAKYPEW

SEQ ID NO: 2457220 - protein, 17 aa, Entamoeba dispar
RKASLDPKEGEDTLSNQ

SEQ ID NO: 2457221 - protein, 11 aa, Entamoeba dispar
RKASNKNPDEF

SEQ ID NO: 2457222 - protein, 6 aa, Entamoeba dispar
RKASPD

SEQ ID NO: 2457223 - protein, 11 aa, Entamoeba dispar
RKATIPAYTQN

SEQ ID NO: 2457224 - protein, 23 aa, Entamoeba dispar
RKATPKPAKVEPTDADTKKKGHS

SEQ ID NO: 2457225 - protein, 7 aa, Entamoeba dispar
RKATVEN

SEQ ID NO: 2457226 - protein, 21 aa, Entamoeba dispar
RKAVPDLDPTPLEEDNAMDRS

SEQ ID NO: 2457227 - protein, 7 aa, Entamoeba dispar
RKAVTTD

SEQ ID NO: 2457228 - protein, 8 aa, Entamoeba dispar
RKAYEKRG

SEQ ID NO: 2457229 - protein, 24 aa, Entamoeba dispar
RKCRERYSRSRSRSDSRERHYRRE

SEQ ID NO: 2457230 - protein, 4 aa, Entamoeba dispar
RKDD

SEQ ID NO: 2457231 - protein, 8 aa, Entamoeba dispar
RKDDGKQV

SEQ ID NO: 2457232 - protein, 9 aa, Entamoeba dispar
RKDDPNSFK

SEQ ID NO: 2457233 - protein, 7 aa, Entamoeba dispar
RKDDSKV

SEQ ID NO: 2457234 - protein, 8 aa, Entamoeba dispar
RKDDTTNK

SEQ ID NO: 2457235 - protein, 6 aa, Entamoeba dispar
RKDEDT

SEQ ID NO: 2457236 - protein, 6 aa, Entamoeba dispar
RKDELE

SEQ ID NO: 2457237 - protein, 8 aa, Entamoeba dispar
RKDENKIE

SEQ ID NO: 2457238 - protein, 10 aa, Entamoeba dispar
RKDERKFNGY

SEQ ID NO: 2457239 - protein, 7 aa, Entamoeba dispar
RKDGVVE

SEQ ID NO: 2457240 - protein, 7 aa, Entamoeba dispar
RKDHPPG

SEQ ID NO: 2457241 - protein, 20 aa, Entamoeba dispar
RKDIADDEYEEDDDSSDEWS

SEQ ID NO: 2457242 - protein, 7 aa, Entamoeba dispar
RKDIDSK

SEQ ID NO: 2457243 - protein, 10 aa, Entamoeba dispar
RKDKETADKL

SEQ ID NO: 2457244 - protein, 7 aa, Entamoeba dispar
RKDKKIR

SEQ ID NO: 2457245 - protein, 8 aa, Entamoeba dispar
RKDKSVTI

SEQ ID NO: 2457246 - protein, 7 aa, Entamoeba dispar
RKDLNRT

SEQ ID NO: 2457247 - protein, 6 aa, Entamoeba dispar
RKDLSY

SEQ ID NO: 2457248 - protein, 13 aa, Entamoeba dispar
RKDNETKDTISDA

SEQ ID NO: 2457249 - protein, 7 aa, Entamoeba dispar
RKDRVSD

SEQ ID NO: 2457250 - protein, 8 aa, Entamoeba dispar
RKDSFDRD

SEQ ID NO: 2457251 - protein, 6 aa, Entamoeba dispar
RKDSTC

SEQ ID NO: 2457252 - protein, 4 aa, Entamoeba dispar
RKDT

SEQ ID NO: 2457253 - protein, 5 aa, Entamoeba dispar
RKDTL

SEQ ID NO: 2457254 - protein, 5 aa, Entamoeba dispar
RKDYA

SEQ ID NO: 2457255 - protein, 19 aa, Entamoeba dispar
RKDYSSNKYEEIPKDKCVI

SEQ ID NO: 2457256 - protein, 6 aa, Entamoeba dispar
RKEAEA

SEQ ID NO: 2457257 - protein, 11 aa, Entamoeba dispar
RKEAGAHGKDT

SEQ ID NO: 2457258 - protein, 4 aa, Entamoeba dispar
RKEC

SEQ ID NO: 2457259 - protein, 7 aa, Entamoeba dispar
RKEDGVN

SEQ ID NO: 2457260 - protein, 6 aa, Entamoeba dispar
RKEDKA

SEQ ID NO: 2457261 - protein, 19 aa, Entamoeba dispar
RKEDMVKEKRNDPETEMRE

SEQ ID NO: 2457262 - protein, 8 aa, Entamoeba dispar
RKEEDQKL

SEQ ID NO: 2457263 - protein, 27 aa, Entamoeba dispar
RKEEEEKNVSHQNLTEPINESTEKKEK

SEQ ID NO: 2457264 - protein, 60 aa, Entamoeba dispar
RKEEENKRKEIEEKERQIKEEQKKKELEEQQRKEEEEKRRLKEEEQRKEEEERERKLEEE

SEQ ID NO: 2457265 - protein, 27 aa, Entamoeba dispar
RKEEENKRKQEELNEIQTKEQTRSVNE

SEQ ID NO: 2457266 - protein, 6 aa, Entamoeba dispar
RKEEIQ

SEQ ID NO: 2457267 - protein, 10 aa, Entamoeba dispar
RKEENKEKEL

SEQ ID NO: 2457268 - protein, 5 aa, Entamoeba dispar
RKEES

SEQ ID NO: 2457269 - protein, 14 aa, Entamoeba dispar
RKEESNTETPTSKK

SEQ ID NO: 2457270 - protein, 17 aa, Entamoeba dispar
RKEETKPIPPSSDDNSL

SEQ ID NO: 2457271 - protein, 18 aa, Entamoeba dispar
RKEFEQGVTKERQNPKRW

SEQ ID NO: 2457272 - protein, 14 aa, Entamoeba dispar
RKEFRTNESLRREK

SEQ ID NO: 2457273 - protein, 8 aa, Entamoeba dispar
RKEGASPF

SEQ ID NO: 2457274 - protein, 9 aa, Entamoeba dispar
RKEGKIETQ

SEQ ID NO: 2457275 - protein, 6 aa, Entamoeba dispar
RKEGNV

SEQ ID NO: 2457276 - protein, 8 aa, Entamoeba dispar
RKEGSEKA

SEQ ID NO: 2457277 - protein, 4 aa, Entamoeba dispar
RKEI

SEQ ID NO: 2457278 - protein, 24 aa, Entamoeba dispar
RKEIDQIKEETRANREAKEDTTMK

SEQ ID NO: 2457279 - protein, 8 aa, Entamoeba dispar
RKEINSQT

SEQ ID NO: 2457280 - protein, 8 aa, Entamoeba dispar
RKEITDYN

SEQ ID NO: 2457281 - protein, 7 aa, Entamoeba dispar
RKEKDKL

SEQ ID NO: 2457282 - protein, 8 aa, Entamoeba dispar
RKEKDLNT

SEQ ID NO: 2457283 - protein, 8 aa, Entamoeba dispar
RKEKDPTL

SEQ ID NO: 2457284 - protein, 22 aa, Entamoeba dispar
RKEKDYQHDTNDNKTEENNELS

SEQ ID NO: 2457285 - protein, 22 aa, Entamoeba dispar
RKEKEEEKAREKEFIGSTKKTF

SEQ ID NO: 2457286 - protein, 13 aa, Entamoeba dispar
RKEKEEKETKEIM

SEQ ID NO: 2457287 - protein, 42 aa, Entamoeba dispar
RKEKEIKKGIEEKAQEMNEIKEGKKENSTKQRPKYQGKFPQN

SEQ ID NO: 2457288 - protein, 42 aa, Entamoeba dispar
RKEKEIKKGIEEKAQEMNETKEGKKENSTKQRPKYQGKFPQN

SEQ ID NO: 2457289 - protein, 5 aa, Entamoeba dispar
RKEKK

SEQ ID NO: 2457290 - protein, 18 aa, Entamoeba dispar
RKEKNQTGIPKSKQDKDM

SEQ ID NO: 2457291 - protein, 6 aa, Entamoeba dispar
RKEKQF

SEQ ID NO: 2457292 - protein, 21 aa, Entamoeba dispar
RKELEECKTEINDAKDRLKIS

SEQ ID NO: 2457293 - protein, 19 aa, Entamoeba dispar
RKELEEKAKQEAEEKARLE

SEQ ID NO: 2457294 - protein, 10 aa, Entamoeba dispar
RKELPSNASS

SEQ ID NO: 2457295 - protein, 8 aa, Entamoeba dispar
RKELTPPW

SEQ ID NO: 2457296 - protein, 13 aa, Entamoeba dispar
RKENAQENALHLN

SEQ ID NO: 2457297 - protein, 6 aa, Entamoeba dispar
RKENDS

SEQ ID NO: 2457298 - protein, 5 aa, Entamoeba dispar
RKENR

SEQ ID NO: 2457299 - protein, 5 aa, Entamoeba dispar
RKENT

SEQ ID NO: 2457300 - protein, 15 aa, Entamoeba dispar
RKENVTKPTLNVGEE

SEQ ID NO: 2457301 - protein, 4 aa, Entamoeba dispar
RKEP

SEQ ID NO: 2457302 - protein, 12 aa, Entamoeba dispar
RKEPIPEQNENE

SEQ ID NO: 2457303 - protein, 10 aa, Entamoeba dispar
RKEPTSCKRP

SEQ ID NO: 2457304 - protein, 8 aa, Entamoeba dispar
RKEQDTKI

SEQ ID NO: 2457305 - protein, 13 aa, Entamoeba dispar
RKEQKRRNEEKEI

SEQ ID NO: 2457306 - protein, 7 aa, Entamoeba dispar
RKEQQRC

SEQ ID NO: 2457307 - protein, 21 aa, Entamoeba dispar
RKEQQTPLQSPKDSNHSSPRY

SEQ ID NO: 2457308 - protein, 9 aa, Entamoeba dispar
RKERFEEER

SEQ ID NO: 2457309 - protein, 11 aa, Entamoeba dispar
RKERKKNEIEK

SEQ ID NO: 2457310 - protein, 7 aa, Entamoeba dispar
RKESAAV

SEQ ID NO: 2457311 - protein, 10 aa, Entamoeba dispar
RKESEPEYNK

SEQ ID NO: 2457312 - protein, 10 aa, Entamoeba dispar
RKESNVELKT

SEQ ID NO: 2457313 - protein, 51 aa, Entamoeba dispar
RKETELEEANENLDIEKKDRMNKEKQVKKLEGELKETKDKLSAAIAEKDSI

SEQ ID NO: 2457314 - protein, 5 aa, Entamoeba dispar
RKETF

SEQ ID NO: 2457315 - protein, 4 aa, Entamoeba dispar
RKEY

SEQ ID NO: 2457316 - protein, 13 aa, Entamoeba dispar
RKEYEDPDDDSSN

SEQ ID NO: 2457317 - protein, 10 aa, Entamoeba dispar
RKEYKKLDEY

SEQ ID NO: 2457318 - protein, 15 aa, Entamoeba dispar
RKEYQKAKTDINKRQ

SEQ ID NO: 2457319 - protein, 4 aa, Entamoeba dispar
RKFG

SEQ ID NO: 2457320 - protein, 11 aa, Entamoeba dispar
RKFIDDDDDVN

SEQ ID NO: 2457321 - protein, 6 aa, Entamoeba dispar
RKFPNY

SEQ ID NO: 2457322 - protein, 11 aa, Entamoeba dispar
RKFTTKTKREK

SEQ ID NO: 2457323 - protein, 8 aa, Entamoeba dispar
RKGASYTP

SEQ ID NO: 2457324 - protein, 5 aa, Entamoeba dispar
RKGDN

SEQ ID NO: 2457325 - protein, 4 aa, Entamoeba dispar
RKGE

SEQ ID NO: 2457326 - protein, 19 aa, Entamoeba dispar
RKGEFETGFDKGGQTREHS

SEQ ID NO: 2457327 - protein, 5 aa, Entamoeba dispar
RKGES

SEQ ID NO: 2457328 - protein, 7 aa, Entamoeba dispar
RKGESVD

SEQ ID NO: 2457329 - protein, 9 aa, Entamoeba dispar
RKGGKFSPL

SEQ ID NO: 2457330 - protein, 9 aa, Entamoeba dispar
RKGGNPPQF

SEQ ID NO: 2457331 - protein, 8 aa, Entamoeba dispar
RKGGRDDI

SEQ ID NO: 2457332 - protein, 7 aa, Entamoeba dispar
RKGGSSK

SEQ ID NO: 2457333 - protein, 9 aa, Entamoeba dispar
RKGHNPQEM

SEQ ID NO: 2457334 - protein, 8 aa, Entamoeba dispar
RKGIGGRS

SEQ ID NO: 2457335 - protein, 9 aa, Entamoeba dispar
RKGISNTKR

SEQ ID NO: 2457336 - protein, 4 aa, Entamoeba dispar
RKGK

SEQ ID NO: 2457337 - protein, 9 aa, Entamoeba dispar
RKGKRAGGF

SEQ ID NO: 2457338 - protein, 4 aa, Entamoeba dispar
RKGL

SEQ ID NO: 2457339 - protein, 6 aa, Entamoeba dispar
RKGLNG

SEQ ID NO: 2457340 - protein, 9 aa, Entamoeba dispar
RKGMSSPAL

SEQ ID NO: 2457341 - protein, 6 aa, Entamoeba dispar
RKGNGI

SEQ ID NO: 2457342 - protein, 8 aa, Entamoeba dispar
RKGNNAES

SEQ ID NO: 2457343 - protein, 24 aa, Entamoeba dispar
RKGNRRPPSKKALQVGSKELKDSD

SEQ ID NO: 2457344 - protein, 6 aa, Entamoeba dispar
RKGQFS

SEQ ID NO: 2457345 - protein, 9 aa, Entamoeba dispar
RKGRENDVD

SEQ ID NO: 2457346 - protein, 9 aa, Entamoeba dispar
RKGRTRQKD

SEQ ID NO: 2457347 - protein, 4 aa, Entamoeba dispar
RKGS

SEQ ID NO: 2457348 - protein, 6 aa, Entamoeba dispar
RKGSDY

SEQ ID NO: 2457349 - protein, 7 aa, Entamoeba dispar
RKGSKFS

SEQ ID NO: 2457350 - protein, 6 aa, Entamoeba dispar
RKGSNI

SEQ ID NO: 2457351 - protein, 7 aa, Entamoeba dispar
RKGSTTL

SEQ ID NO: 2457352 - protein, 6 aa, Entamoeba dispar
RKGSYE

SEQ ID NO: 2457353 - protein, 4 aa, Entamoeba dispar
RKGY

SEQ ID NO: 2457354 - protein, 4 aa, Entamoeba dispar
RKHD

SEQ ID NO: 2457355 - protein, 9 aa, Entamoeba dispar
RKHKNEKNY

SEQ ID NO: 2457356 - protein, 13 aa, Entamoeba dispar
RKHPTNEKKWKYD

SEQ ID NO: 2457357 - protein, 12 aa, Entamoeba dispar
RKIDRTKGTTFT

SEQ ID NO: 2457358 - protein, 4 aa, Entamoeba dispar
RKIE

SEQ ID NO: 2457359 - protein, 15 aa, Entamoeba dispar
RKIEELKEEGEKTRE

SEQ ID NO: 2457360 - protein, 12 aa, Entamoeba dispar
RKIEENNQNEKI

SEQ ID NO: 2457361 - protein, 6 aa, Entamoeba dispar
RKIERR

SEQ ID NO: 2457362 - protein, 6 aa, Entamoeba dispar
RKIGES

SEQ ID NO: 2457363 - protein, 9 aa, Entamoeba dispar
RKIKAQESL

SEQ ID NO: 2457364 - protein, 7 aa, Entamoeba dispar
RKIKEEE

SEQ ID NO: 2457365 - protein, 10 aa, Entamoeba dispar
RKIKNSPIYE

SEQ ID NO: 2457366 - protein, 6 aa, Entamoeba dispar
RKINGR

SEQ ID NO: 2457367 - protein, 8 aa, Entamoeba dispar
RKIPTEMP

SEQ ID NO: 2457368 - protein, 7 aa, Entamoeba dispar
RKIQHGD

SEQ ID NO: 2457369 - protein, 7 aa, Entamoeba dispar
RKISDSA

SEQ ID NO: 2457370 - protein, 13 aa, Entamoeba dispar
RKISSQKKNNLDD

SEQ ID NO: 2457371 - protein, 6 aa, Entamoeba dispar
RKITGT

SEQ ID NO: 2457372 - protein, 6 aa, Entamoeba dispar
RKITQK

SEQ ID NO: 2457373 - protein, 8 aa, Entamoeba dispar
RKKDGEEF

SEQ ID NO: 2457374 - protein, 8 aa, Entamoeba dispar
RKKDGQRD

SEQ ID NO: 2457375 - protein, 9 aa, Entamoeba dispar
RKKDNKNIK

SEQ ID NO: 2457376 - protein, 26 aa, Entamoeba dispar
RKKDRGRTNEKSYDKKRISSEERNEM

SEQ ID NO: 2457377 - protein, 18 aa, Entamoeba dispar
RKKDRQQMKKINEEERIA

SEQ ID NO: 2457378 - protein, 4 aa, Entamoeba dispar
RKKE

SEQ ID NO: 2457379 - protein, 16 aa, Entamoeba dispar
RKKEEEFNTLKEEKED

SEQ ID NO: 2457380 - protein, 11 aa, Entamoeba dispar
RKKEEREKQIE

SEQ ID NO: 2457381 - protein, 10 aa, Entamoeba dispar
RKKEGTKRMS

SEQ ID NO: 2457382 - protein, 13 aa, Entamoeba dispar
RKKEKEKKEKENN

SEQ ID NO: 2457383 - protein, 16 aa, Entamoeba dispar
RKKEQRIREQHPPPEY

SEQ ID NO: 2457384 - protein, 6 aa, Entamoeba dispar
RKKESL

SEQ ID NO: 2457385 - protein, 7 aa, Entamoeba dispar
RKKEVKK

SEQ ID NO: 2457386 - protein, 8 aa, Entamoeba dispar
RKKGSTTI

SEQ ID NO: 2457387 - protein, 6 aa, Entamoeba dispar
RKKISL

SEQ ID NO: 2457388 - protein, 15 aa, Entamoeba dispar
RKKKEEEDDKTNITT

SEQ ID NO: 2457389 - protein, 8 aa, Entamoeba dispar
RKKKEEET

SEQ ID NO: 2457390 - protein, 7 aa, Entamoeba dispar
RKKKGKS

SEQ ID NO: 2457391 - protein, 10 aa, Entamoeba dispar
RKKKNSYKES

SEQ ID NO: 2457392 - protein, 9 aa, Entamoeba dispar
RKKKTKKLR

SEQ ID NO: 2457393 - protein, 7 aa, Entamoeba dispar
RKKNELY

SEQ ID NO: 2457394 - protein, 11 aa, Entamoeba dispar
RKKNKKSGESQ

SEQ ID NO: 2457395 - protein, 16 aa, Entamoeba dispar
RKKNQPHWNGKDNERY

SEQ ID NO: 2457396 - protein, 40 aa, Entamoeba dispar
RKKPRGTNASISSQKMVNSEKDSSGSLQKVPNSTDTLAQE

SEQ ID NO: 2457397 - protein, 19 aa, Entamoeba dispar
RKKPTPHRKKQTGDDTTSL

SEQ ID NO: 2457398 - protein, 20 aa, Entamoeba dispar
RKKREEEEEKARKKEEMRKI

SEQ ID NO: 2457399 - protein, 8 aa, Entamoeba dispar
RKKRTRDI

SEQ ID NO: 2457400 - protein, 10 aa, Entamoeba dispar
RKKSQDEEEI

SEQ ID NO: 2457401 - protein, 9 aa, Entamoeba dispar
RKKTDTGLS

SEQ ID NO: 2457402 - protein, 16 aa, Entamoeba dispar
RKKTNKKGRNQQETKV

SEQ ID NO: 2457403 - protein, 37 aa, Entamoeba dispar
RKKTSQTRSRYSWSSRSATSLYSPTQSVSKESGSISN

SEQ ID NO: 2457404 - protein, 5 aa, Entamoeba dispar
RKKVI

SEQ ID NO: 2457405 - protein, 21 aa, Entamoeba dispar
RKKVKRQRKGNEYKPMKNNSE

SEQ ID NO: 2457406 - protein, 4 aa, Entamoeba dispar
RKKW

SEQ ID NO: 2457407 - protein, 17 aa, Entamoeba dispar
RKLAKKAQEEAESFKEN

SEQ ID NO: 2457408 - protein, 6 aa, Entamoeba dispar
RKLDSF

SEQ ID NO: 2457409 - protein, 7 aa, Entamoeba dispar
RKLETQK

SEQ ID NO: 2457410 - protein, 19 aa, Entamoeba dispar
RKLGRERINTQMNKRANTI

SEQ ID NO: 2457411 - protein, 12 aa, Entamoeba dispar
RKLSDKLKGPWD

SEQ ID NO: 2457412 - protein, 8 aa, Entamoeba dispar
RKLSEDEI

SEQ ID NO: 2457413 - protein, 8 aa, Entamoeba dispar
RKLSENVD

SEQ ID NO: 2457414 - protein, 6 aa, Entamoeba dispar
RKLTKQ

SEQ ID NO: 2457415 - protein, 19 aa, Entamoeba dispar
RKLTSRPANMRTVSDTNIL

SEQ ID NO: 2457416 - protein, 13 aa, Entamoeba dispar
RKMGSDIKEGKKT

SEQ ID NO: 2457417 - protein, 5 aa, Entamoeba dispar
RKMKK

SEQ ID NO: 2457418 - protein, 17 aa, Entamoeba dispar
RKMNKKDSTQVDSVQTD

SEQ ID NO: 2457419 - protein, 8 aa, Entamoeba dispar
RKNEEQRV

SEQ ID NO: 2457420 - protein, 108 aa, Entamoeba dispar
RKNEMVEQAKAKANDAQSQIDSKKDELTKAENSLKDLEEDTKKEKDKVDAAQKQLRKAKEQRKDLLSKEKDAQREIEELKDKEKSEKDKEREQKRAARRAAKKKEREM

SEQ ID NO: 2457421 - protein, 14 aa, Entamoeba dispar
RKNEVQELKEGQCS

SEQ ID NO: 2457422 - protein, 8 aa, Entamoeba dispar
RKNIEPVK

SEQ ID NO: 2457423 - protein, 6 aa, Entamoeba dispar
RKNKDL

SEQ ID NO: 2457424 - protein, 10 aa, Entamoeba dispar
RKNKKKVGRA

SEQ ID NO: 2457425 - protein, 9 aa, Entamoeba dispar
RKNNGSLSI

SEQ ID NO: 2457426 - protein, 10 aa, Entamoeba dispar
RKNNKEEEIE

SEQ ID NO: 2457427 - protein, 6 aa, Entamoeba dispar
RKNPKK

SEQ ID NO: 2457428 - protein, 7 aa, Entamoeba dispar
RKNQELK

SEQ ID NO: 2457429 - protein, 10 aa, Entamoeba dispar
RKNQPYTAKA

SEQ ID NO: 2457430 - protein, 10 aa, Entamoeba dispar
RKNRNRESAF

SEQ ID NO: 2457431 - protein, 10 aa, Entamoeba dispar
RKNRPKPGLA

SEQ ID NO: 2457432 - protein, 21 aa, Entamoeba dispar
RKNRQSCFSPSSITQPIDYNT

SEQ ID NO: 2457433 - protein, 11 aa, Entamoeba dispar
RKNSPPPSELK

SEQ ID NO: 2457434 - protein, 10 aa, Entamoeba dispar
RKNSSEDKKG

SEQ ID NO: 2457435 - protein, 4 aa, Entamoeba dispar
RKNV

SEQ ID NO: 2457436 - protein, 9 aa, Entamoeba dispar
RKPARNWSI

SEQ ID NO: 2457437 - protein, 9 aa, Entamoeba dispar
RKPIINENE

SEQ ID NO: 2457438 - protein, 25 aa, Entamoeba dispar
RKPKKVEESTITTHETNNESKTQLK

SEQ ID NO: 2457439 - protein, 6 aa, Entamoeba dispar
RKPLKG

SEQ ID NO: 2457440 - protein, 8 aa, Entamoeba dispar
RKPLTEAK

SEQ ID NO: 2457441 - protein, 48 aa, Entamoeba dispar
RKPPTRDPPLALKEKGSETYSSDSETIRKSKRKEKNIVDSEHDEKINK

SEQ ID NO: 2457442 - protein, 4 aa, Entamoeba dispar
RKPR

SEQ ID NO: 2457443 - protein, 7 aa, Entamoeba dispar
RKPSDEI

SEQ ID NO: 2457444 - protein, 8 aa, Entamoeba dispar
RKPTNKMD

SEQ ID NO: 2457445 - protein, 4 aa, Entamoeba dispar
RKPV

SEQ ID NO: 2457446 - protein, 14 aa, Entamoeba dispar
RKPVTESLNERPHT

SEQ ID NO: 2457447 - protein, 8 aa, Entamoeba dispar
RKQADGKD

SEQ ID NO: 2457448 - protein, 8 aa, Entamoeba dispar
RKQAEGKD

SEQ ID NO: 2457449 - protein, 7 aa, Entamoeba dispar
RKQDAEF

SEQ ID NO: 2457450 - protein, 4 aa, Entamoeba dispar
RKQE

SEQ ID NO: 2457451 - protein, 8 aa, Entamoeba dispar
RKQEEEMT

SEQ ID NO: 2457452 - protein, 11 aa, Entamoeba dispar
RKQEERPSPLS

SEQ ID NO: 2457453 - protein, 15 aa, Entamoeba dispar
RKQKKQVGAEEGRAK

SEQ ID NO: 2457454 - protein, 12 aa, Entamoeba dispar
RKQLASRDLSME

SEQ ID NO: 2457455 - protein, 28 aa, Entamoeba dispar
RKQLNENGSFTDYTPKLPPKMNQTNSKI

SEQ ID NO: 2457456 - protein, 16 aa, Entamoeba dispar
RKQNKQPSPSAIPPAT

SEQ ID NO: 2457457 - protein, 8 aa, Entamoeba dispar
RKQPGKEQ

SEQ ID NO: 2457458 - protein, 29 aa, Entamoeba dispar
RKQQAVTRVQTAENNYKQAVEKANAFGEE

SEQ ID NO: 2457459 - protein, 8 aa, Entamoeba dispar
RKQQKRDD

SEQ ID NO: 2457460 - protein, 28 aa, Entamoeba dispar
RKQQNSDAPEEAGKGGPKKQKEKKKCYL

SEQ ID NO: 2457461 - protein, 8 aa, Entamoeba dispar
RKQQPQET

SEQ ID NO: 2457462 - protein, 15 aa, Entamoeba dispar
RKQREVRDKKAECNS

SEQ ID NO: 2457463 - protein, 15 aa, Entamoeba dispar
RKQRKRPIKTDTGET

SEQ ID NO: 2457464 - protein, 17 aa, Entamoeba dispar
RKQSDAKKLENQFGDIK

SEQ ID NO: 2457465 - protein, 12 aa, Entamoeba dispar
RKQSISTDKTSI

SEQ ID NO: 2457466 - protein, 6 aa, Entamoeba dispar
RKQTLL

SEQ ID NO: 2457467 - protein, 4 aa, Entamoeba dispar
RKQY

SEQ ID NO: 2457468 - protein, 9 aa, Entamoeba dispar
RKRADDRKE

SEQ ID NO: 2457469 - protein, 12 aa, Entamoeba dispar
RKRDIRHGKKKM

SEQ ID NO: 2457470 - protein, 18 aa, Entamoeba dispar
RKRDKTKTKLSTEPKKSL

SEQ ID NO: 2457471 - protein, 8 aa, Entamoeba dispar
RKREGKKY

SEQ ID NO: 2457472 - protein, 19 aa, Entamoeba dispar
RKREKGNKIKSKSSILENT

SEQ ID NO: 2457473 - protein, 8 aa, Entamoeba dispar
RKRGDCGG

SEQ ID NO: 2457474 - protein, 9 aa, Entamoeba dispar
RKRGGMPKG

SEQ ID NO: 2457475 - protein, 8 aa, Entamoeba dispar
RKRGNSRG

SEQ ID NO: 2457476 - protein, 14 aa, Entamoeba dispar
RKRKPTLSPNSATT

SEQ ID NO: 2457477 - protein, 5 aa, Entamoeba dispar
RKRLR

SEQ ID NO: 2457478 - protein, 9 aa, Entamoeba dispar
RKRPENRPR

SEQ ID NO: 2457479 - protein, 16 aa, Entamoeba dispar
RKRREKISRFLHLTKT

SEQ ID NO: 2457480 - protein, 31 aa, Entamoeba dispar
RKRRSYNRKNNGKRKKDPNKKEIEEVTEENT

SEQ ID NO: 2457481 - protein, 7 aa, Entamoeba dispar
RKRSGAI

SEQ ID NO: 2457482 - protein, 16 aa, Entamoeba dispar
RKRSKQERARLALALL

SEQ ID NO: 2457483 - protein, 13 aa, Entamoeba dispar
RKRTINSYGITDG

SEQ ID NO: 2457484 - protein, 8 aa, Entamoeba dispar
RKRYYQKN

SEQ ID NO: 2457485 - protein, 8 aa, Entamoeba dispar
RKSDGPLS

SEQ ID NO: 2457486 - protein, 8 aa, Entamoeba dispar
RKSDIDDR

SEQ ID NO: 2457487 - protein, 9 aa, Entamoeba dispar
RKSDQIKKM

SEQ ID NO: 2457488 - protein, 13 aa, Entamoeba dispar
RKSEEQLEELKKS

SEQ ID NO: 2457489 - protein, 12 aa, Entamoeba dispar
RKSFSKNIPQEY

SEQ ID NO: 2457490 - protein, 7 aa, Entamoeba dispar
RKSGGDD

SEQ ID NO: 2457491 - protein, 13 aa, Entamoeba dispar
RKSGIRDNSDESI

SEQ ID NO: 2457492 - protein, 9 aa, Entamoeba dispar
RKSGYTQKT

SEQ ID NO: 2457493 - protein, 7 aa, Entamoeba dispar
RKSISKR

SEQ ID NO: 2457494 - protein, 14 aa, Entamoeba dispar
RKSISRPGKRMEDK

SEQ ID NO: 2457495 - protein, 8 aa, Entamoeba dispar
RKSKADHL

SEQ ID NO: 2457496 - protein, 45 aa, Entamoeba dispar
RKSKGLPPLERKKHDTGKRHHHHRDKKKEEKKKNTAPSSTPVTPV

SEQ ID NO: 2457497 - protein, 9 aa, Entamoeba dispar
RKSKKEVEK

SEQ ID NO: 2457498 - protein, 9 aa, Entamoeba dispar
RKSKKLSGL

SEQ ID NO: 2457499 - protein, 18 aa, Entamoeba dispar
RKSKTEEIKKENEEVEER

SEQ ID NO: 2457500 - protein, 11 aa, Entamoeba dispar
RKSLDNSKEVL

SEQ ID NO: 2457501 - protein, 26 aa, Entamoeba dispar
RKSLDSKEEVESKEIKVNSSQNKIQV

SEQ ID NO: 2457502 - protein, 12 aa, Entamoeba dispar
RKSLEKSRENEI

SEQ ID NO: 2457503 - protein, 8 aa, Entamoeba dispar
RKSLKQSR

SEQ ID NO: 2457504 - protein, 10 aa, Entamoeba dispar
RKSLKQSREV

SEQ ID NO: 2457505 - protein, 11 aa, Entamoeba dispar
RKSLKQSREVL

SEQ ID NO: 2457506 - protein, 4 aa, Entamoeba dispar
RKSN

SEQ ID NO: 2457507 - protein, 9 aa, Entamoeba dispar
RKSNDGVSI

SEQ ID NO: 2457508 - protein, 11 aa, Entamoeba dispar
RKSNGEVSQTW

SEQ ID NO: 2457509 - protein, 9 aa, Entamoeba dispar
RKSPVAPDV

SEQ ID NO: 2457510 - protein, 4 aa, Entamoeba dispar
RKSQ

SEQ ID NO: 2457511 - protein, 8 aa, Entamoeba dispar
RKSQEITP

SEQ ID NO: 2457512 - protein, 5 aa, Entamoeba dispar
RKSRI

SEQ ID NO: 2457513 - protein, 7 aa, Entamoeba dispar
RKSSGLC

SEQ ID NO: 2457514 - protein, 36 aa, Entamoeba dispar
RKSSIPQPKQSPSQLPNTSNTNSARVPKHPLPPLPK

SEQ ID NO: 2457515 - protein, 15 aa, Entamoeba dispar
RKSSKEQNLSQSTDC

SEQ ID NO: 2457516 - protein, 8 aa, Entamoeba dispar
RKSSKSTM

SEQ ID NO: 2457517 - protein, 7 aa, Entamoeba dispar
RKSSPFN

SEQ ID NO: 2457518 - protein, 23 aa, Entamoeba dispar
RKSSSLKTKSIDLPQKNNENEEI

SEQ ID NO: 2457519 - protein, 9 aa, Entamoeba dispar
RKSSYERDF

SEQ ID NO: 2457520 - protein, 9 aa, Entamoeba dispar
RKSTDRDCH

SEQ ID NO: 2457521 - protein, 6 aa, Entamoeba dispar
RKSTQE

SEQ ID NO: 2457522 - protein, 9 aa, Entamoeba dispar
RKSTTNEQP

SEQ ID NO: 2457523 - protein, 26 aa, Entamoeba dispar
RKSVTNIPSEEHQQEQPIPPPPPERV

SEQ ID NO: 2457524 - protein, 5 aa, Entamoeba dispar
RKSYQ

SEQ ID NO: 2457525 - protein, 6 aa, Entamoeba dispar
RKTAEG

SEQ ID NO: 2457526 - protein, 8 aa, Entamoeba dispar
RKTDALNQ

SEQ ID NO: 2457527 - protein, 6 aa, Entamoeba dispar
RKTDTF

SEQ ID NO: 2457528 - protein, 10 aa, Entamoeba dispar
RKTDVNGHWS

SEQ ID NO: 2457529 - protein, 15 aa, Entamoeba dispar
RKTEEDQKADEEAVI

SEQ ID NO: 2457530 - protein, 10 aa, Entamoeba dispar
RKTEKEVPID

SEQ ID NO: 2457531 - protein, 21 aa, Entamoeba dispar
RKTENGNGDINTSTLSDQGKT

SEQ ID NO: 2457532 - protein, 12 aa, Entamoeba dispar
RKTHETSREKWH

SEQ ID NO: 2457533 - protein, 6 aa, Entamoeba dispar
RKTIGK

SEQ ID NO: 2457534 - protein, 7 aa, Entamoeba dispar
RKTIKRK

SEQ ID NO: 2457535 - protein, 12 aa, Entamoeba dispar
RKTKDLKKTLQE

SEQ ID NO: 2457536 - protein, 10 aa, Entamoeba dispar
RKTKRSKQTV

SEQ ID NO: 2457537 - protein, 18 aa, Entamoeba dispar
RKTKVEDKEEEKKPTNIS

SEQ ID NO: 2457538 - protein, 17 aa, Entamoeba dispar
RKTKVGGKSKKKGGCDL

SEQ ID NO: 2457539 - protein, 7 aa, Entamoeba dispar
RKTLGKR

SEQ ID NO: 2457540 - protein, 4 aa, Entamoeba dispar
RKTM

SEQ ID NO: 2457541 - protein, 20 aa, Entamoeba dispar
RKTNEDSSMEEEEEDYSDEL

SEQ ID NO: 2457542 - protein, 17 aa, Entamoeba dispar
RKTNTKKKRSRAGMNDL

SEQ ID NO: 2457543 - protein, 4 aa, Entamoeba dispar
RKTQ

SEQ ID NO: 2457544 - protein, 14 aa, Entamoeba dispar
RKTQNKEEKTAKDE

SEQ ID NO: 2457545 - protein, 8 aa, Entamoeba dispar
RKTRERKK

SEQ ID NO: 2457546 - protein, 11 aa, Entamoeba dispar
RKTRKGTKEDY

SEQ ID NO: 2457547 - protein, 15 aa, Entamoeba dispar
RKTSSTKMNSQSSRS

SEQ ID NO: 2457548 - protein, 4 aa, Entamoeba dispar
RKTT

SEQ ID NO: 2457549 - protein, 41 aa, Entamoeba dispar
RKTVISTKTEVPITRTTTTENQTINIPKPQKKISDDTIEDD

SEQ ID NO: 2457550 - protein, 6 aa, Entamoeba dispar
RKTYQL

SEQ ID NO: 2457551 - protein, 9 aa, Entamoeba dispar
RKVAKQSVS

SEQ ID NO: 2457552 - protein, 16 aa, Entamoeba dispar
RKVDEKEERIEKPSAL

SEQ ID NO: 2457553 - protein, 36 aa, Entamoeba dispar
RKVEPQTTPKPEDKQPDATPPHPSGEAPVPEHRERK

SEQ ID NO: 2457554 - protein, 6 aa, Entamoeba dispar
RKVNEK

SEQ ID NO: 2457555 - protein, 4 aa, Entamoeba dispar
RKVR

SEQ ID NO: 2457556 - protein, 8 aa, Entamoeba dispar
RKVREECE

SEQ ID NO: 2457557 - protein, 9 aa, Entamoeba dispar
RKVSDSDIE

SEQ ID NO: 2457558 - protein, 11 aa, Entamoeba dispar
RKVTDIPPSVT

SEQ ID NO: 2457559 - protein, 7 aa, Entamoeba dispar
RKVTPSI

SEQ ID NO: 2457560 - protein, 7 aa, Entamoeba dispar
RKWGYSN

SEQ ID NO: 2457561 - protein, 6 aa, Entamoeba dispar
RKYEDA

SEQ ID NO: 2457562 - protein, 22 aa, Entamoeba dispar
RKYGDESKQEHVRDIAKSFVSR

SEQ ID NO: 2457563 - protein, 11 aa, Entamoeba dispar
RKYGSCPHGGY

SEQ ID NO: 2457564 - protein, 7 aa, Entamoeba dispar
RKYGTSN

SEQ ID NO: 2457565 - protein, 13 aa, Entamoeba dispar
RKYKEQINNKQNG

SEQ ID NO: 2457566 - protein, 12 aa, Entamoeba dispar
RKYKSEPKYSEY

SEQ ID NO: 2457567 - protein, 10 aa, Entamoeba dispar
RKYNEGKIRD

SEQ ID NO: 2457568 - protein, 6 aa, Entamoeba dispar
RKYNRN

SEQ ID NO: 2457569 - protein, 10 aa, Entamoeba dispar
RKYQKKNEDI

SEQ ID NO: 2457570 - protein, 6 aa, Entamoeba dispar
RKYQSN

SEQ ID NO: 2457571 - protein, 4 aa, Entamoeba dispar
RKYR

SEQ ID NO: 2457572 - protein, 10 aa, Entamoeba dispar
RKYSPTSSKH

SEQ ID NO: 2457573 - protein, 14 aa, Entamoeba dispar
RLALSASSEDDPER

SEQ ID NO: 2457574 - protein, 35 aa, Entamoeba dispar
RLDPSTNTRIATTKGSKKSKSSKGYRRSSKMTGLS

SEQ ID NO: 2457575 - protein, 7 aa, Entamoeba dispar
RLDQRSV

SEQ ID NO: 2457576 - protein, 8 aa, Entamoeba dispar
RLDSEGNV

SEQ ID NO: 2457577 - protein, 36 aa, Entamoeba dispar
RLEEERKKREQERIKREQERKKIEEERKRKEEELER

SEQ ID NO: 2457578 - protein, 5 aa, Entamoeba dispar
RLEEI

SEQ ID NO: 2457579 - protein, 5 aa, Entamoeba dispar
RLEEN

SEQ ID NO: 2457580 - protein, 5 aa, Entamoeba dispar
RLEEP

SEQ ID NO: 2457581 - protein, 4 aa, Entamoeba dispar
RLEI

SEQ ID NO: 2457582 - protein, 9 aa, Entamoeba dispar
RLEKEAAEV

SEQ ID NO: 2457583 - protein, 16 aa, Entamoeba dispar
RLEKEENERKEENKIS

SEQ ID NO: 2457584 - protein, 36 aa, Entamoeba dispar
RLENESSKANTPTASPRSSTRDSNSDAALREHSSED

SEQ ID NO: 2457585 - protein, 6 aa, Entamoeba dispar
RLEPKK

SEQ ID NO: 2457586 - protein, 8 aa, Entamoeba dispar
RLERKDNM

SEQ ID NO: 2457587 - protein, 4 aa, Entamoeba dispar
RLGK

SEQ ID NO: 2457588 - protein, 11 aa, Entamoeba dispar
RLGNRSEHQDE

SEQ ID NO: 2457589 - protein, 14 aa, Entamoeba dispar
RLGQNSKEKQKDKI

SEQ ID NO: 2457590 - protein, 4 aa, Entamoeba dispar
RLGS

SEQ ID NO: 2457591 - protein, 7 aa, Entamoeba dispar
RLKDEKV

SEQ ID NO: 2457592 - protein, 8 aa, Entamoeba dispar
RLKDNPST

SEQ ID NO: 2457593 - protein, 19 aa, Entamoeba dispar
RLKKTRAELPVSAQKTLDK

SEQ ID NO: 2457594 - protein, 8 aa, Entamoeba dispar
RLKNNEGQ

SEQ ID NO: 2457595 - protein, 7 aa, Entamoeba dispar
RLKPSHL

SEQ ID NO: 2457596 - protein, 7 aa, Entamoeba dispar
RLKTNGI

SEQ ID NO: 2457597 - protein, 4 aa, Entamoeba dispar
RLND

SEQ ID NO: 2457598 - protein, 6 aa, Entamoeba dispar
RLNDEA

SEQ ID NO: 2457599 - protein, 14 aa, Entamoeba dispar
RLNEVSSRKPQGDF

SEQ ID NO: 2457600 - protein, 4 aa, Entamoeba dispar
RLPA

SEQ ID NO: 2457601 - protein, 8 aa, Entamoeba dispar
RLPDPQGL

SEQ ID NO: 2457602 - protein, 5 aa, Entamoeba dispar
RLPES

SEQ ID NO: 2457603 - protein, 16 aa, Entamoeba dispar
RLPHPNGYLYELIINT

SEQ ID NO: 2457604 - protein, 4 aa, Entamoeba dispar
RLPK

SEQ ID NO: 2457605 - protein, 7 aa, Entamoeba dispar
RLPKKED

SEQ ID NO: 2457606 - protein, 13 aa, Entamoeba dispar
RLPKKGKEQENEW

SEQ ID NO: 2457607 - protein, 9 aa, Entamoeba dispar
RLPKPKECN

SEQ ID NO: 2457608 - protein, 10 aa, Entamoeba dispar
RLPNPRRVKT

SEQ ID NO: 2457609 - protein, 10 aa, Entamoeba dispar
RLPPPPPSAY

SEQ ID NO: 2457610 - protein, 7 aa, Entamoeba dispar
RLPPTDK

SEQ ID NO: 2457611 - protein, 14 aa, Entamoeba dispar
RLPQPGDNIDSPTI

SEQ ID NO: 2457612 - protein, 16 aa, Entamoeba dispar
RLQDESDEQDACDDGC

SEQ ID NO: 2457613 - protein, 8 aa, Entamoeba dispar
RLQEKHPE

SEQ ID NO: 2457614 - protein, 12 aa, Entamoeba dispar
RLQKGSKPKIER

SEQ ID NO: 2457615 - protein, 10 aa, Entamoeba dispar
RLQNGKGVKG

SEQ ID NO: 2457616 - protein, 5 aa, Entamoeba dispar
RLQSE

SEQ ID NO: 2457617 - protein, 11 aa, Entamoeba dispar
RLRNQTKENSP

SEQ ID NO: 2457618 - protein, 4 aa, Entamoeba dispar
RLRP

SEQ ID NO: 2457619 - protein, 6 aa, Entamoeba dispar
RLSADE

SEQ ID NO: 2457620 - protein, 17 aa, Entamoeba dispar
RLSAKEAMNHPLFQCLS

SEQ ID NO: 2457621 - protein, 11 aa, Entamoeba dispar
RLSEESLKSRK

SEQ ID NO: 2457622 - protein, 5 aa, Entamoeba dispar
RLSEG

SEQ ID NO: 2457623 - protein, 18 aa, Entamoeba dispar
RLSEKNPNKCSLKKDENI

SEQ ID NO: 2457624 - protein, 6 aa, Entamoeba dispar
RLSEQP

SEQ ID NO: 2457625 - protein, 4 aa, Entamoeba dispar
RLSG

SEQ ID NO: 2457626 - protein, 6 aa, Entamoeba dispar
RLSGDQ

SEQ ID NO: 2457627 - protein, 8 aa, Entamoeba dispar
RLSGQEEK

SEQ ID NO: 2457628 - protein, 21 aa, Entamoeba dispar
RLSIEESKRLYGSKNLAREDF

SEQ ID NO: 2457629 - protein, 9 aa, Entamoeba dispar
RLSKEQKKI

SEQ ID NO: 2457630 - protein, 6 aa, Entamoeba dispar
RLSKNN

SEQ ID NO: 2457631 - protein, 6 aa, Entamoeba dispar
RLSNVQ

SEQ ID NO: 2457632 - protein, 16 aa, Entamoeba dispar
RLSQKYPDQFNSENKL

SEQ ID NO: 2457633 - protein, 10 aa, Entamoeba dispar
RLSSGINSRE

SEQ ID NO: 2457634 - protein, 10 aa, Entamoeba dispar
RLSTGRVETS

SEQ ID NO: 2457635 - protein, 9 aa, Entamoeba dispar
RLSTPEKIK

SEQ ID NO: 2457636 - protein, 15 aa, Entamoeba dispar
RLSTPEKPKRKARKS

SEQ ID NO: 2457637 - protein, 6 aa, Entamoeba dispar
RLSVTK

SEQ ID NO: 2457638 - protein, 11 aa, Entamoeba dispar
RLTDEETQKIA

SEQ ID NO: 2457639 - protein, 9 aa, Entamoeba dispar
RLTDPTTGM

SEQ ID NO: 2457640 - protein, 14 aa, Entamoeba dispar
RLTEENNKFKNDNL

SEQ ID NO: 2457641 - protein, 13 aa, Entamoeba dispar
RLTEGKKDTSKLE

SEQ ID NO: 2457642 - protein, 4 aa, Entamoeba dispar
RLTK

SEQ ID NO: 2457643 - protein, 8 aa, Entamoeba dispar
RLTNPQTL

SEQ ID NO: 2457644 - protein, 11 aa, Entamoeba dispar
RLTNRNPQNPI

SEQ ID NO: 2457645 - protein, 4 aa, Entamoeba dispar
RLTS

SEQ ID NO: 2457646 - protein, 10 aa, Entamoeba dispar
RLTSGIKNKP

SEQ ID NO: 2457647 - protein, 7 aa, Entamoeba dispar
RLTTYSQ

SEQ ID NO: 2457648 - protein, 4 aa, Entamoeba dispar
RMAG

SEQ ID NO: 2457649 - protein, 23 aa, Entamoeba dispar
RMDSLNSKVNNNSYISNNPHNSI

SEQ ID NO: 2457650 - protein, 24 aa, Entamoeba dispar
RMKEETEKKIKEEVNQKEKRINEL

SEQ ID NO: 2457651 - protein, 6 aa, Entamoeba dispar
RMKEGA

SEQ ID NO: 2457652 - protein, 9 aa, Entamoeba dispar
RMKENKSID

SEQ ID NO: 2457653 - protein, 4 aa, Entamoeba dispar
RMKK

SEQ ID NO: 2457654 - protein, 8 aa, Entamoeba dispar
RMKTSRYE

SEQ ID NO: 2457655 - protein, 6 aa, Entamoeba dispar
RMNEEL

SEQ ID NO: 2457656 - protein, 5 aa, Entamoeba dispar
RMNEK

SEQ ID NO: 2457657 - protein, 6 aa, Entamoeba dispar
RMNSSK

SEQ ID NO: 2457658 - protein, 4 aa, Entamoeba dispar
RMPN

SEQ ID NO: 2457659 - protein, 7 aa, Entamoeba dispar
RMQESTE

SEQ ID NO: 2457660 - protein, 4 aa, Entamoeba dispar
RMRN

SEQ ID NO: 2457661 - protein, 5 aa, Entamoeba dispar
RMRNS

SEQ ID NO: 2457662 - protein, 9 aa, Entamoeba dispar
RMTTGREMT

SEQ ID NO: 2457663 - protein, 4 aa, Entamoeba dispar
RNAF

SEQ ID NO: 2457664 - protein, 10 aa, Entamoeba dispar
RNAGENKSKW

SEQ ID NO: 2457665 - protein, 5 aa, Entamoeba dispar
RNAND

SEQ ID NO: 2457666 - protein, 8 aa, Entamoeba dispar
RNANPEDV

SEQ ID NO: 2457667 - protein, 12 aa, Entamoeba dispar
RNANPEKFTSRF

SEQ ID NO: 2457668 - protein, 23 aa, Entamoeba dispar
RNAPDRLDTSEASRKTIETIKDA

SEQ ID NO: 2457669 - protein, 7 aa, Entamoeba dispar
RNATDRE

SEQ ID NO: 2457670 - protein, 5 aa, Entamoeba dispar
RNCKH

SEQ ID NO: 2457671 - protein, 17 aa, Entamoeba dispar
RNCKTSGINKGDKNKLT

SEQ ID NO: 2457672 - protein, 107 aa, Entamoeba dispar
RNCPKQSGRRYERNRSRRRRSRSRSPSSRSRSPSSRSRSRSPRSRSRSSSRRRYRKSTSYKRRYSSRSRSRSNSRRRSYSRSRSNSRSKSRSRSYSHRSQHNDQSPR

SEQ ID NO: 2457673 - protein, 9 aa, Entamoeba dispar
RNCSQEERE

SEQ ID NO: 2457674 - protein, 12 aa, Entamoeba dispar
RNDAIKSRHSTS

SEQ ID NO: 2457675 - protein, 7 aa, Entamoeba dispar
RNDDEKI

SEQ ID NO: 2457676 - protein, 8 aa, Entamoeba dispar
RNDDKKKY

SEQ ID NO: 2457677 - protein, 4 aa, Entamoeba dispar
RNDE

SEQ ID NO: 2457678 - protein, 7 aa, Entamoeba dispar
RNDEEIK

SEQ ID NO: 2457679 - protein, 7 aa, Entamoeba dispar
RNDEVTG

SEQ ID NO: 2457680 - protein, 6 aa, Entamoeba dispar
RNDFED

SEQ ID NO: 2457681 - protein, 6 aa, Entamoeba dispar
RNDIDS

SEQ ID NO: 2457682 - protein, 5 aa, Entamoeba dispar
RNDKV

SEQ ID NO: 2457683 - protein, 11 aa, Entamoeba dispar
RNDMRRSRRRE

SEQ ID NO: 2457684 - protein, 7 aa, Entamoeba dispar
RNDNDMK

SEQ ID NO: 2457685 - protein, 6 aa, Entamoeba dispar
RNDNNK

SEQ ID NO: 2457686 - protein, 7 aa, Entamoeba dispar
RNDPITR

SEQ ID NO: 2457687 - protein, 19 aa, Entamoeba dispar
RNDSITKQFKRKNKDQTIY

SEQ ID NO: 2457688 - protein, 11 aa, Entamoeba dispar
RNDSKHKNKLG

SEQ ID NO: 2457689 - protein, 4 aa, Entamoeba dispar
RNDT

SEQ ID NO: 2457690 - protein, 10 aa, Entamoeba dispar
RNDTEGTGEL

SEQ ID NO: 2457691 - protein, 7 aa, Entamoeba dispar
RNDYKQL

SEQ ID NO: 2457692 - protein, 6 aa, Entamoeba dispar
RNEAGT

SEQ ID NO: 2457693 - protein, 7 aa, Entamoeba dispar
RNEAKGC

SEQ ID NO: 2457694 - protein, 9 aa, Entamoeba dispar
RNEDGEQFS

SEQ ID NO: 2457695 - protein, 10 aa, Entamoeba dispar
RNEEEPNGIK

SEQ ID NO: 2457696 - protein, 9 aa, Entamoeba dispar
RNEEKSTYF

SEQ ID NO: 2457697 - protein, 15 aa, Entamoeba dispar
RNEEKYGSKYRKTRP

SEQ ID NO: 2457698 - protein, 38 aa, Entamoeba dispar
RNEEQERKRKEIEELKKRTEDLEKENAKVKESLGSNGI

SEQ ID NO: 2457699 - protein, 8 aa, Entamoeba dispar
RNEETKEI

SEQ ID NO: 2457700 - protein, 12 aa, Entamoeba dispar
RNEEVENDSKRA

SEQ ID NO: 2457701 - protein, 4 aa, Entamoeba dispar
RNEG

SEQ ID NO: 2457702 - protein, 4 aa, Entamoeba dispar
RNEK

SEQ ID NO: 2457703 - protein, 7 aa, Entamoeba dispar
RNEKELS

SEQ ID NO: 2457704 - protein, 6 aa, Entamoeba dispar
RNEKNQ

SEQ ID NO: 2457705 - protein, 10 aa, Entamoeba dispar
RNEKSDNYEM

SEQ ID NO: 2457706 - protein, 9 aa, Entamoeba dispar
RNELSKKKK

SEQ ID NO: 2457707 - protein, 7 aa, Entamoeba dispar
RNENEKT

SEQ ID NO: 2457708 - protein, 6 aa, Entamoeba dispar
RNENEL

SEQ ID NO: 2457709 - protein, 6 aa, Entamoeba dispar
RNENQK

SEQ ID NO: 2457710 - protein, 21 aa, Entamoeba dispar
RNEPEQEIGTTEYAPVFIFDD

SEQ ID NO: 2457711 - protein, 21 aa, Entamoeba dispar
RNEPIENTQGKEETNTNQKPF

SEQ ID NO: 2457712 - protein, 4 aa, Entamoeba dispar
RNEQ

SEQ ID NO: 2457713 - protein, 6 aa, Entamoeba dispar
RNEQGT

SEQ ID NO: 2457714 - protein, 20 aa, Entamoeba dispar
RNEQRKKGQLERKKAEFEEM

SEQ ID NO: 2457715 - protein, 7 aa, Entamoeba dispar
RNEQTPI

SEQ ID NO: 2457716 - protein, 7 aa, Entamoeba dispar
RNERSNT

SEQ ID NO: 2457717 - protein, 8 aa, Entamoeba dispar
RNERYGKL

SEQ ID NO: 2457718 - protein, 21 aa, Entamoeba dispar
  misc_feature (16)..(17): Xaa can be any naturally occurring amino acid
RNERYGKLNEGILIQXXIIIY

SEQ ID NO: 2457719 - protein, 4 aa, Entamoeba dispar
RNES

SEQ ID NO: 2457720 - protein, 7 aa, Entamoeba dispar
RNETARY

SEQ ID NO: 2457721 - protein, 8 aa, Entamoeba dispar
RNETNHPE

SEQ ID NO: 2457722 - protein, 11 aa, Entamoeba dispar
RNETVSGKTIE

SEQ ID NO: 2457723 - protein, 5 aa, Entamoeba dispar
RNEYE

SEQ ID NO: 2457724 - protein, 5 aa, Entamoeba dispar
RNGAK

SEQ ID NO: 2457725 - protein, 7 aa, Entamoeba dispar
RNGCGKS

SEQ ID NO: 2457726 - protein, 10 aa, Entamoeba dispar
RNGDDNPFEQ

SEQ ID NO: 2457727 - protein, 9 aa, Entamoeba dispar
RNGEENERI

SEQ ID NO: 2457728 - protein, 21 aa, Entamoeba dispar
RNGEIKRLKTGQSFDENEEDQ

SEQ ID NO: 2457729 - protein, 7 aa, Entamoeba dispar
RNGGEDI

SEQ ID NO: 2457730 - protein, 22 aa, Entamoeba dispar
RNGIDKATANVITNPEGGQNLT

SEQ ID NO: 2457731 - protein, 5 aa, Entamoeba dispar
RNGIQ

SEQ ID NO: 2457732 - protein, 18 aa, Entamoeba dispar
RNGISGTNIIETISILRF

SEQ ID NO: 2457733 - protein, 8 aa, Entamoeba dispar
RNGKSEII

SEQ ID NO: 2457734 - protein, 4 aa, Entamoeba dispar
RNGL

SEQ ID NO: 2457735 - protein, 4 aa, Entamoeba dispar
RNGM

SEQ ID NO: 2457736 - protein, 8 aa, Entamoeba dispar
RNGNKVYD

SEQ ID NO: 2457737 - protein, 10 aa, Entamoeba dispar
RNGNSQQKDV

SEQ ID NO: 2457738 - protein, 6 aa, Entamoeba dispar
RNGSIV

SEQ ID NO: 2457739 - protein, 6 aa, Entamoeba dispar
RNGSLE

SEQ ID NO: 2457740 - protein, 9 aa, Entamoeba dispar
RNGTGKSNF

SEQ ID NO: 2457741 - protein, 6 aa, Entamoeba dispar
RNGTHI

SEQ ID NO: 2457742 - protein, 6 aa, Entamoeba dispar
RNGVRD

SEQ ID NO: 2457743 - protein, 5 aa, Entamoeba dispar
RNGYK

SEQ ID NO: 2457744 - protein, 15 aa, Entamoeba dispar
RNGYRTVEHQRTEKI

SEQ ID NO: 2457745 - protein, 11 aa, Entamoeba dispar
RNHGSNDGRQN

SEQ ID NO: 2457746 - protein, 7 aa, Entamoeba dispar
RNHPSTP

SEQ ID NO: 2457747 - protein, 13 aa, Entamoeba dispar
RNIDVPSNRDWRT

SEQ ID NO: 2457748 - protein, 37 aa, Entamoeba dispar
RNIENSRLRNNKQKIPTSQISQFKSNGTILPPFNSDN

SEQ ID NO: 2457749 - protein, 36 aa, Entamoeba dispar
RNIENSRNRINKQKVQPQVPQPHSNASMLPPFNSDN

SEQ ID NO: 2457750 - protein, 8 aa, Entamoeba dispar
RNIGEEKP

SEQ ID NO: 2457751 - protein, 10 aa, Entamoeba dispar
RNIGSNSLSK

SEQ ID NO: 2457752 - protein, 5 aa, Entamoeba dispar
RNINT

SEQ ID NO: 2457753 - protein, 4 aa, Entamoeba dispar
RNIP

SEQ ID NO: 2457754 - protein, 9 aa, Entamoeba dispar
RNIQNNQQA

SEQ ID NO: 2457755 - protein, 7 aa, Entamoeba dispar
RNIRTSE

SEQ ID NO: 2457756 - protein, 5 aa, Entamoeba dispar
RNITD

SEQ ID NO: 2457757 - protein, 8 aa, Entamoeba dispar
RNITSKKQ

SEQ ID NO: 2457758 - protein, 7 aa, Entamoeba dispar
RNKDYKK

SEQ ID NO: 2457759 - protein, 5 aa, Entamoeba dispar
RNKEC

SEQ ID NO: 2457760 - protein, 50 aa, Entamoeba dispar
RNKEEKEKEEKEQLEKELKESGTIPMEEEQKSAGYIPSVPKKRSLFDDTS

SEQ ID NO: 2457761 - protein, 10 aa, Entamoeba dispar
RNKEVSENDL

SEQ ID NO: 2457762 - protein, 6 aa, Entamoeba dispar
RNKGDV

SEQ ID NO: 2457763 - protein, 6 aa, Entamoeba dispar
RNKGSS

SEQ ID NO: 2457764 - protein, 10 aa, Entamoeba dispar
RNKGSSCSGF

SEQ ID NO: 2457765 - protein, 12 aa, Entamoeba dispar
RNKKGNSHKDSI

SEQ ID NO: 2457766 - protein, 19 aa, Entamoeba dispar
RNKKRDQLLQTKREPHSLP

SEQ ID NO: 2457767 - protein, 13 aa, Entamoeba dispar
RNKNNNESQPNEI

SEQ ID NO: 2457768 - protein, 7 aa, Entamoeba dispar
RNKNVPS

SEQ ID NO: 2457769 - protein, 7 aa, Entamoeba dispar
RNKQEFE

SEQ ID NO: 2457770 - protein, 16 aa, Entamoeba dispar
RNKQETDATLATLSNE

SEQ ID NO: 2457771 - protein, 7 aa, Entamoeba dispar
RNKRAPE

SEQ ID NO: 2457772 - protein, 16 aa, Entamoeba dispar
RNKRETDATLATLSNE

SEQ ID NO: 2457773 - protein, 8 aa, Entamoeba dispar
RNKSETSY

SEQ ID NO: 2457774 - protein, 10 aa, Entamoeba dispar
RNKTAEQQFP

SEQ ID NO: 2457775 - protein, 9 aa, Entamoeba dispar
RNLDGKEKS

SEQ ID NO: 2457776 - protein, 11 aa, Entamoeba dispar
RNLGGGPDIIP

SEQ ID NO: 2457777 - protein, 8 aa, Entamoeba dispar
RNLPQNKG

SEQ ID NO: 2457778 - protein, 10 aa, Entamoeba dispar
RNLQEKQDDC

SEQ ID NO: 2457779 - protein, 9 aa, Entamoeba dispar
RNLTRDLSN

SEQ ID NO: 2457780 - protein, 5 aa, Entamoeba dispar
RNMNK

SEQ ID NO: 2457781 - protein, 6 aa, Entamoeba dispar
RNMNKG

SEQ ID NO: 2457782 - protein, 9 aa, Entamoeba dispar
RNNAKLSSR

SEQ ID NO: 2457783 - protein, 10 aa, Entamoeba dispar
RNNAPDEYKN

SEQ ID NO: 2457784 - protein, 8 aa, Entamoeba dispar
RNNEEPSV

SEQ ID NO: 2457785 - protein, 5 aa, Entamoeba dispar
RNNEN

SEQ ID NO: 2457786 - protein, 6 aa, Entamoeba dispar
RNNENW

SEQ ID NO: 2457787 - protein, 5 aa, Entamoeba dispar
RNNFD

SEQ ID NO: 2457788 - protein, 5 aa, Entamoeba dispar
RNNGQ

SEQ ID NO: 2457789 - protein, 11 aa, Entamoeba dispar
RNNKQKSNEPI

SEQ ID NO: 2457790 - protein, 4 aa, Entamoeba dispar
RNNN

SEQ ID NO: 2457791 - protein, 6 aa, Entamoeba dispar
RNNNFS

SEQ ID NO: 2457792 - protein, 7 aa, Entamoeba dispar
RNNNGGN

SEQ ID NO: 2457793 - protein, 6 aa, Entamoeba dispar
RNNPIR

SEQ ID NO: 2457794 - protein, 15 aa, Entamoeba dispar
RNNPSVAALQGEKTV

SEQ ID NO: 2457795 - protein, 14 aa, Entamoeba dispar
RNNQIEVNGYNSLK

SEQ ID NO: 2457796 - protein, 7 aa, Entamoeba dispar
RNNQQYQ

SEQ ID NO: 2457797 - protein, 13 aa, Entamoeba dispar
RNNSERTQEHIEP

SEQ ID NO: 2457798 - protein, 6 aa, Entamoeba dispar
RNNSIG

SEQ ID NO: 2457799 - protein, 7 aa, Entamoeba dispar
RNNSISS

SEQ ID NO: 2457800 - protein, 5 aa, Entamoeba dispar
RNNSK

SEQ ID NO: 2457801 - protein, 5 aa, Entamoeba dispar
RNNSP

SEQ ID NO: 2457802 - protein, 18 aa, Entamoeba dispar
RNPDGPGVDGGEELDDCN

SEQ ID NO: 2457803 - protein, 9 aa, Entamoeba dispar
RNPDTNKYR

SEQ ID NO: 2457804 - protein, 4 aa, Entamoeba dispar
RNPF

SEQ ID NO: 2457805 - protein, 5 aa, Entamoeba dispar
RNPKI

SEQ ID NO: 2457806 - protein, 8 aa, Entamoeba dispar
RNPKLSQK

SEQ ID NO: 2457807 - protein, 9 aa, Entamoeba dispar
RNPLKTTTF

SEQ ID NO: 2457808 - protein, 11 aa, Entamoeba dispar
RNPNQRASSRE

SEQ ID NO: 2457809 - protein, 11 aa, Entamoeba dispar
RNPREKEDADS

SEQ ID NO: 2457810 - protein, 29 aa, Entamoeba dispar
RNPSSNFDKPKKDKKKSHKKSKKVNQKKT

SEQ ID NO: 2457811 - protein, 7 aa, Entamoeba dispar
RNPSWNK

SEQ ID NO: 2457812 - protein, 26 aa, Entamoeba dispar
RNPTKELSVPPTPRTKTTKNNDFESI

SEQ ID NO: 2457813 - protein, 9 aa, Entamoeba dispar
RNPTKVSKD

SEQ ID NO: 2457814 - protein, 8 aa, Entamoeba dispar
RNPTQPAL

SEQ ID NO: 2457815 - protein, 56 aa, Entamoeba dispar
RNPTYQTSLSQYPQPQSQPPYKPTDQPKFKTVSEVNKRPDNIQDDNIQIGPKKPPE

SEQ ID NO: 2457816 - protein, 6 aa, Entamoeba dispar
RNPYEM

SEQ ID NO: 2457817 - protein, 12 aa, Entamoeba dispar
RNPYTGSSHEPY

SEQ ID NO: 2457818 - protein, 4 aa, Entamoeba dispar
RNQE

SEQ ID NO: 2457819 - protein, 6 aa, Entamoeba dispar
RNQETK

SEQ ID NO: 2457820 - protein, 5 aa, Entamoeba dispar
RNQGK

SEQ ID NO: 2457821 - protein, 6 aa, Entamoeba dispar
RNQQVT

SEQ ID NO: 2457822 - protein, 26 aa, Entamoeba dispar
RNQSPKKSSIQVHSPSYSEDKFFELT

SEQ ID NO: 2457823 - protein, 5 aa, Entamoeba dispar
RNQST

SEQ ID NO: 2457824 - protein, 11 aa, Entamoeba dispar
RNQTELANTEV

SEQ ID NO: 2457825 - protein, 9 aa, Entamoeba dispar
RNQTGETAL

SEQ ID NO: 2457826 - protein, 8 aa, Entamoeba dispar
RNQTLSSH

SEQ ID NO: 2457827 - protein, 5 aa, Entamoeba dispar
RNQTM

SEQ ID NO: 2457828 - protein, 8 aa, Entamoeba dispar
RNQTPKTL

SEQ ID NO: 2457829 - protein, 5 aa, Entamoeba dispar
RNQWS

SEQ ID NO: 2457830 - protein, 12 aa, Entamoeba dispar
RNRCDNSLDPFF

SEQ ID NO: 2457831 - protein, 4 aa, Entamoeba dispar
RNRD

SEQ ID NO: 2457832 - protein, 18 aa, Entamoeba dispar
RNRDEDDDFGSVDGRTAS

SEQ ID NO: 2457833 - protein, 18 aa, Entamoeba dispar
RNRDRTMIDSTDANKILD

SEQ ID NO: 2457834 - protein, 6 aa, Entamoeba dispar
RNREED

SEQ ID NO: 2457835 - protein, 9 aa, Entamoeba dispar
RNRISQDVE

SEQ ID NO: 2457836 - protein, 8 aa, Entamoeba dispar
RNRKISEK

SEQ ID NO: 2457837 - protein, 6 aa, Entamoeba dispar
RNRKQC

SEQ ID NO: 2457838 - protein, 7 aa, Entamoeba dispar
RNRLAGP

SEQ ID NO: 2457839 - protein, 7 aa, Entamoeba dispar
RNRMEEG

SEQ ID NO: 2457840 - protein, 10 aa, Entamoeba dispar
RNRMNGEEKK

SEQ ID NO: 2457841 - protein, 19 aa, Entamoeba dispar
RNRPSEYIQQEKGDDDTID

SEQ ID NO: 2457842 - protein, 11 aa, Entamoeba dispar
RNRQSETSRYK

SEQ ID NO: 2457843 - protein, 8 aa, Entamoeba dispar
RNRSGEKM

SEQ ID NO: 2457844 - protein, 9 aa, Entamoeba dispar
RNRSGTLEP

SEQ ID NO: 2457845 - protein, 10 aa, Entamoeba dispar
RNRYSSPPIY

SEQ ID NO: 2457846 - protein, 6 aa, Entamoeba dispar
RNRYVS

SEQ ID NO: 2457847 - protein, 5 aa, Entamoeba dispar
RNSFI

SEQ ID NO: 2457848 - protein, 6 aa, Entamoeba dispar
RNSHLS

SEQ ID NO: 2457849 - protein, 18 aa, Entamoeba dispar
RNSIPKELDSFLKKNEII

SEQ ID NO: 2457850 - protein, 5 aa, Entamoeba dispar
RNSKI

SEQ ID NO: 2457851 - protein, 6 aa, Entamoeba dispar
RNSLSG

SEQ ID NO: 2457852 - protein, 4 aa, Entamoeba dispar
RNSN

SEQ ID NO: 2457853 - protein, 6 aa, Entamoeba dispar
RNSNFR

SEQ ID NO: 2457854 - protein, 6 aa, Entamoeba dispar
RNSPEL

SEQ ID NO: 2457855 - protein, 10 aa, Entamoeba dispar
RNSPGPQSLK

SEQ ID NO: 2457856 - protein, 8 aa, Entamoeba dispar
RNSPVAPD

SEQ ID NO: 2457857 - protein, 13 aa, Entamoeba dispar
RNSTIPAKKSQVF

SEQ ID NO: 2457858 - protein, 9 aa, Entamoeba dispar
RNSTRSKHL

SEQ ID NO: 2457859 - protein, 7 aa, Entamoeba dispar
RNSTTKQ

SEQ ID NO: 2457860 - protein, 9 aa, Entamoeba dispar
RNSTTPQTA

SEQ ID NO: 2457861 - protein, 14 aa, Entamoeba dispar
RNSVRQQKKIPEGM

SEQ ID NO: 2457862 - protein, 12 aa, Entamoeba dispar
RNTAKSSEKEKW

SEQ ID NO: 2457863 - protein, 8 aa, Entamoeba dispar
RNTEQDNI

SEQ ID NO: 2457864 - protein, 9 aa, Entamoeba dispar
RNTFQGDKN

SEQ ID NO: 2457865 - protein, 10 aa, Entamoeba dispar
RNTISGGLSG

SEQ ID NO: 2457866 - protein, 5 aa, Entamoeba dispar
RNTKN

SEQ ID NO: 2457867 - protein, 15 aa, Entamoeba dispar
RNTLGSSRVTIDQQQ

SEQ ID NO: 2457868 - protein, 7 aa, Entamoeba dispar
RNTPEGH

SEQ ID NO: 2457869 - protein, 7 aa, Entamoeba dispar
RNTPTPL

SEQ ID NO: 2457870 - protein, 6 aa, Entamoeba dispar
RNTPYY

SEQ ID NO: 2457871 - protein, 8 aa, Entamoeba dispar
RNTQRDYQ

SEQ ID NO: 2457872 - protein, 7 aa, Entamoeba dispar
RNTSESY

SEQ ID NO: 2457873 - protein, 6 aa, Entamoeba dispar
RNTSKI

SEQ ID NO: 2457874 - protein, 6 aa, Entamoeba dispar
RNTTSN

SEQ ID NO: 2457875 - protein, 14 aa, Entamoeba dispar
RNTVASVGGSGSAS

SEQ ID NO: 2457876 - protein, 8 aa, Entamoeba dispar
RNTYPSLS

SEQ ID NO: 2457877 - protein, 29 aa, Entamoeba dispar
RNYQEEKTHNNEEYEKKIEDLEERIKEKN

SEQ ID NO: 2457878 - protein, 7 aa, Entamoeba dispar
RNYQSQQ

SEQ ID NO: 2457879 - protein, 6 aa, Entamoeba dispar
RNYQVS

SEQ ID NO: 2457880 - protein, 16 aa, Entamoeba dispar
RPADLSSASKTDGVET

SEQ ID NO: 2457881 - protein, 25 aa, Entamoeba dispar
RPATKNAAKAPKYPRSLKANRNKMD

SEQ ID NO: 2457882 - protein, 46 aa, Entamoeba dispar
RPATSKQPRKYYAPKSASKKAAVSSKKAVASVSQKKPVARHSHPGI

SEQ ID NO: 2457883 - protein, 14 aa, Entamoeba dispar
RPCQSDDENKNGGR

SEQ ID NO: 2457884 - protein, 7 aa, Entamoeba dispar
RPDDEDF

SEQ ID NO: 2457885 - protein, 7 aa, Entamoeba dispar
RPDFEGE

SEQ ID NO: 2457886 - protein, 9 aa, Entamoeba dispar
RPDNPATTC

SEQ ID NO: 2457887 - protein, 13 aa, Entamoeba dispar
RPDRQNDREEAKR

SEQ ID NO: 2457888 - protein, 4 aa, Entamoeba dispar
RPDV

SEQ ID NO: 2457889 - protein, 4 aa, Entamoeba dispar
RPED

SEQ ID NO: 2457890 - protein, 18 aa, Entamoeba dispar
RPEDESEKKAREAKEDAM

SEQ ID NO: 2457891 - protein, 30 aa, Entamoeba dispar
RPEDPIANELTNEENDNGSNDSEQNEEEQK

SEQ ID NO: 2457892 - protein, 5 aa, Entamoeba dispar
RPEFV

SEQ ID NO: 2457893 - protein, 7 aa, Entamoeba dispar
RPEGPIA

SEQ ID NO: 2457894 - protein, 4 aa, Entamoeba dispar
RPEI

SEQ ID NO: 2457895 - protein, 9 aa, Entamoeba dispar
RPEQIQNNS

SEQ ID NO: 2457896 - protein, 7 aa, Entamoeba dispar
RPERGNI

SEQ ID NO: 2457897 - protein, 6 aa, Entamoeba dispar
RPETAQ

SEQ ID NO: 2457898 - protein, 6 aa, Entamoeba dispar
RPETMY

SEQ ID NO: 2457899 - protein, 4 aa, Entamoeba dispar
RPEY

SEQ ID NO: 2457900 - protein, 14 aa, Entamoeba dispar
RPFDTSDKSKPPVK

SEQ ID NO: 2457901 - protein, 9 aa, Entamoeba dispar
RPFGNDGKV

SEQ ID NO: 2457902 - protein, 5 aa, Entamoeba dispar
RPFGS

SEQ ID NO: 2457903 - protein, 7 aa, Entamoeba dispar
RPFPPYD

SEQ ID NO: 2457904 - protein, 10 aa, Entamoeba dispar
RPFPSNRNGV

SEQ ID NO: 2457905 - protein, 12 aa, Entamoeba dispar
RPFSSNYAGTKK

SEQ ID NO: 2457906 - protein, 15 aa, Entamoeba dispar
RPGAVDAEKAVAPHG

SEQ ID NO: 2457907 - protein, 7 aa, Entamoeba dispar
RPGPSNM

SEQ ID NO: 2457908 - protein, 5 aa, Entamoeba dispar
RPGRI

SEQ ID NO: 2457909 - protein, 26 aa, Entamoeba dispar
RPGRRKDKKDENIQSNISSDNNSSNI

SEQ ID NO: 2457910 - protein, 5 aa, Entamoeba dispar
RPHQE

SEQ ID NO: 2457911 - protein, 11 aa, Entamoeba dispar
RPIETQRGGRC

SEQ ID NO: 2457912 - protein, 17 aa, Entamoeba dispar
RPIGGKPANESDKNCLD

SEQ ID NO: 2457913 - protein, 5 aa, Entamoeba dispar
RPINY

SEQ ID NO: 2457914 - protein, 4 aa, Entamoeba dispar
RPIP

SEQ ID NO: 2457915 - protein, 11 aa, Entamoeba dispar
RPIPHPPSTGH

SEQ ID NO: 2457916 - protein, 7 aa, Entamoeba dispar
RPIPPKN

SEQ ID NO: 2457917 - protein, 9 aa, Entamoeba dispar
RPIQTPSIA

SEQ ID NO: 2457918 - protein, 7 aa, Entamoeba dispar
RPISGPD

SEQ ID NO: 2457919 - protein, 8 aa, Entamoeba dispar
RPISPDPY

SEQ ID NO: 2457920 - protein, 24 aa, Entamoeba dispar
RPKDGLRRQCDSKTIEQFLLKFIK

SEQ ID NO: 2457921 - protein, 6 aa, Entamoeba dispar
RPKEGI

SEQ ID NO: 2457922 - protein, 11 aa, Entamoeba dispar
RPKEGQSAQEL

SEQ ID NO: 2457923 - protein, 9 aa, Entamoeba dispar
RPKKDEGAV

SEQ ID NO: 2457924 - protein, 13 aa, Entamoeba dispar
RPKKEWLKPQMIK

SEQ ID NO: 2457925 - protein, 9 aa, Entamoeba dispar
RPKKRSSLT

SEQ ID NO: 2457926 - protein, 22 aa, Entamoeba dispar
RPKLNAYTNKAAGGGYEDETTY

SEQ ID NO: 2457927 - protein, 16 aa, Entamoeba dispar
RPKLNTKATRFQGGGM

SEQ ID NO: 2457928 - protein, 16 aa, Entamoeba dispar
RPKPMQHNNNSVKQLS

SEQ ID NO: 2457929 - protein, 8 aa, Entamoeba dispar
RPKSFKAR

SEQ ID NO: 2457930 - protein, 4 aa, Entamoeba dispar
RPKT

SEQ ID NO: 2457931 - protein, 13 aa, Entamoeba dispar
RPKTLDDVQGQEE

SEQ ID NO: 2457932 - protein, 12 aa, Entamoeba dispar
RPLPNVKTPYSQ

SEQ ID NO: 2457933 - protein, 9 aa, Entamoeba dispar
RPLPPDIDP

SEQ ID NO: 2457934 - protein, 10 aa, Entamoeba dispar
RPLSKGEGPI

SEQ ID NO: 2457935 - protein, 14 aa, Entamoeba dispar
RPLTGSLDSNPERL

SEQ ID NO: 2457936 - protein, 11 aa, Entamoeba dispar
RPLTQTKIPSE

SEQ ID NO: 2457937 - protein, 7 aa, Entamoeba dispar
RPNEDPV

SEQ ID NO: 2457938 - protein, 7 aa, Entamoeba dispar
RPNETTA

SEQ ID NO: 2457939 - protein, 4 aa, Entamoeba dispar
RPNF

SEQ ID NO: 2457940 - protein, 4 aa, Entamoeba dispar
RPNG

SEQ ID NO: 2457941 - protein, 6 aa, Entamoeba dispar
RPNIDE

SEQ ID NO: 2457942 - protein, 6 aa, Entamoeba dispar
RPNKFK

SEQ ID NO: 2457943 - protein, 12 aa, Entamoeba dispar
RPNKSCVSKTAN

SEQ ID NO: 2457944 - protein, 48 aa, Entamoeba dispar
RPNKSKKSTPTTPAKPVVTSTPSSQPQPKPVTTPAKVTEPQSKPVTGA

SEQ ID NO: 2457945 - protein, 8 aa, Entamoeba dispar
RPNQHETK

SEQ ID NO: 2457946 - protein, 6 aa, Entamoeba dispar
RPPAAF

SEQ ID NO: 2457947 - protein, 6 aa, Entamoeba dispar
RPPEDQ

SEQ ID NO: 2457948 - protein, 5 aa, Entamoeba dispar
RPPFS

SEQ ID NO: 2457949 - protein, 4 aa, Entamoeba dispar
RPPI

SEQ ID NO: 2457950 - protein, 8 aa, Entamoeba dispar
RPPKKAWK

SEQ ID NO: 2457951 - protein, 20 aa, Entamoeba dispar
RPPLNAQANRLQGGGVESNT

SEQ ID NO: 2457952 - protein, 8 aa, Entamoeba dispar
RPPPPFPS

SEQ ID NO: 2457953 - protein, 16 aa, Entamoeba dispar
RPPPRSFKAKPTSPSR

SEQ ID NO: 2457954 - protein, 28 aa, Entamoeba dispar
RPPQPSNSSKEEQEPIKKTTQNNEKDFT

SEQ ID NO: 2457955 - protein, 5 aa, Entamoeba dispar
RPQCE

SEQ ID NO: 2457956 - protein, 5 aa, Entamoeba dispar
RPQIK

SEQ ID NO: 2457957 - protein, 8 aa, Entamoeba dispar
RPQKQIKK

SEQ ID NO: 2457958 - protein, 6 aa, Entamoeba dispar
RPQSKE

SEQ ID NO: 2457959 - protein, 13 aa, Entamoeba dispar
RPQSRTNGHTQDC

SEQ ID NO: 2457960 - protein, 6 aa, Entamoeba dispar
RPQTND

SEQ ID NO: 2457961 - protein, 5 aa, Entamoeba dispar
RPRID

SEQ ID NO: 2457962 - protein, 8 aa, Entamoeba dispar
RPRIQSSK

SEQ ID NO: 2457963 - protein, 8 aa, Entamoeba dispar
RPRLSAEF

SEQ ID NO: 2457964 - protein, 6 aa, Entamoeba dispar
RPRSFN

SEQ ID NO: 2457965 - protein, 19 aa, Entamoeba dispar
RPRSSSTSLDQRKKIDQDA

SEQ ID NO: 2457966 - protein, 12 aa, Entamoeba dispar
RPRTTKEGTPDL

SEQ ID NO: 2457967 - protein, 15 aa, Entamoeba dispar
RPSDTKGISPLTDRE

SEQ ID NO: 2457968 - protein, 4 aa, Entamoeba dispar
RPSF

SEQ ID NO: 2457969 - protein, 9 aa, Entamoeba dispar
RPSKRTTTT

SEQ ID NO: 2457970 - protein, 8 aa, Entamoeba dispar
RPTDIPEE

SEQ ID NO: 2457971 - protein, 4 aa, Entamoeba dispar
RPTE

SEQ ID NO: 2457972 - protein, 14 aa, Entamoeba dispar
RPTETYNDIGGLDK

SEQ ID NO: 2457973 - protein, 5 aa, Entamoeba dispar
RPTID

SEQ ID NO: 2457974 - protein, 6 aa, Entamoeba dispar
RPTTNY

SEQ ID NO: 2457975 - protein, 12 aa, Entamoeba dispar
RPTYTNEDSNGF

SEQ ID NO: 2457976 - protein, 6 aa, Entamoeba dispar
RPVAEG

SEQ ID NO: 2457977 - protein, 6 aa, Entamoeba dispar
RPVGYG

SEQ ID NO: 2457978 - protein, 4 aa, Entamoeba dispar
RPVP

SEQ ID NO: 2457979 - protein, 15 aa, Entamoeba dispar
RPVPNSGNVFSSKKK

SEQ ID NO: 2457980 - protein, 5 aa, Entamoeba dispar
RPYPI

SEQ ID NO: 2457981 - protein, 5 aa, Entamoeba dispar
RPYQK

SEQ ID NO: 2457982 - protein, 11 aa, Entamoeba dispar
RPYTLNENNAQ

SEQ ID NO: 2457983 - protein, 16 aa, Entamoeba dispar
RQAPKRVGAKDEKVIE

SEQ ID NO: 2457984 - protein, 37 aa, Entamoeba dispar
RQARYQSVYSKKDKIKEEEDDDENTSRSINSESEEID

SEQ ID NO: 2457985 - protein, 15 aa, Entamoeba dispar
RQDEQLAETDQEIDN

SEQ ID NO: 2457986 - protein, 18 aa, Entamoeba dispar
RQDGMSEFQESAAEIGDD

SEQ ID NO: 2457987 - protein, 17 aa, Entamoeba dispar
RQDKPNILTKPSNHLTE

SEQ ID NO: 2457988 - protein, 5 aa, Entamoeba dispar
RQEEI

SEQ ID NO: 2457989 - protein, 12 aa, Entamoeba dispar
RQEISNKESIEG

SEQ ID NO: 2457990 - protein, 5 aa, Entamoeba dispar
RQEKQ

SEQ ID NO: 2457991 - protein, 4 aa, Entamoeba dispar
RQEL

SEQ ID NO: 2457992 - protein, 13 aa, Entamoeba dispar
RQEQYKQDEIERE

SEQ ID NO: 2457993 - protein, 13 aa, Entamoeba dispar
RQERIQDQKQGKI

SEQ ID NO: 2457994 - protein, 6 aa, Entamoeba dispar
RQESFE

SEQ ID NO: 2457995 - protein, 12 aa, Entamoeba dispar
RQETSSKKPEEY

SEQ ID NO: 2457996 - protein, 4 aa, Entamoeba dispar
RQEY

SEQ ID NO: 2457997 - protein, 8 aa, Entamoeba dispar
RQFNKQRN

SEQ ID NO: 2457998 - protein, 4 aa, Entamoeba dispar
RQGK

SEQ ID NO: 2457999 - protein, 36 aa, Entamoeba dispar
RQGKKLKKVETVDKSSPKVGNSSDPKKSTTSTGGND

SEQ ID NO: 2458000 - protein, 6 aa, Entamoeba dispar
RQGKWK

SEQ ID NO: 2458001 - protein, 4 aa, Entamoeba dispar
RQGM

SEQ ID NO: 2458002 - protein, 5 aa, Entamoeba dispar
RQGRS

SEQ ID NO: 2458003 - protein, 9 aa, Entamoeba dispar
RQGSQKERL

SEQ ID NO: 2458004 - protein, 15 aa, Entamoeba dispar
RQGYPEGFKWISQYM

SEQ ID NO: 2458005 - protein, 13 aa, Entamoeba dispar
RQHSKKADAENTE

SEQ ID NO: 2458006 - protein, 7 aa, Entamoeba dispar
RQHTNSE

SEQ ID NO: 2458007 - protein, 4 aa, Entamoeba dispar
RQIF

SEQ ID NO: 2458008 - protein, 5 aa, Entamoeba dispar
RQIGD

SEQ ID NO: 2458009 - protein, 6 aa, Entamoeba dispar
RQIQQG

SEQ ID NO: 2458010 - protein, 5 aa, Entamoeba dispar
RQISG

SEQ ID NO: 2458011 - protein, 14 aa, Entamoeba dispar
RQISSEDAKGFAKN

SEQ ID NO: 2458012 - protein, 4 aa, Entamoeba dispar
RQKC

SEQ ID NO: 2458013 - protein, 7 aa, Entamoeba dispar
RQKDPVG

SEQ ID NO: 2458014 - protein, 9 aa, Entamoeba dispar
RQKEQTVRA

SEQ ID NO: 2458015 - protein, 20 aa, Entamoeba dispar
RQKKMRTETNEKDEKNNTFK

SEQ ID NO: 2458016 - protein, 7 aa, Entamoeba dispar
RQKNKKE

SEQ ID NO: 2458017 - protein, 10 aa, Entamoeba dispar
RQKQETGQSF

SEQ ID NO: 2458018 - protein, 8 aa, Entamoeba dispar
RQKSERHY

SEQ ID NO: 2458019 - protein, 8 aa, Entamoeba dispar
RQKVPEFD

SEQ ID NO: 2458020 - protein, 6 aa, Entamoeba dispar
RQLADN

SEQ ID NO: 2458021 - protein, 31 aa, Entamoeba dispar
RQLEEERKKKEEERKKREEEERKKEEEEERL

SEQ ID NO: 2458022 - protein, 7 aa, Entamoeba dispar
RQLQEKE

SEQ ID NO: 2458023 - protein, 19 aa, Entamoeba dispar
RQMEEQQKEEEQKIRDQQE

SEQ ID NO: 2458024 - protein, 5 aa, Entamoeba dispar
RQNDQ

SEQ ID NO: 2458025 - protein, 6 aa, Entamoeba dispar
RQNGDT

SEQ ID NO: 2458026 - protein, 10 aa, Entamoeba dispar
RQNGLKKEWE

SEQ ID NO: 2458027 - protein, 7 aa, Entamoeba dispar
RQNNGEW

SEQ ID NO: 2458028 - protein, 10 aa, Entamoeba dispar
RQNQTPKTTE

SEQ ID NO: 2458029 - protein, 7 aa, Entamoeba dispar
RQNSNGN

SEQ ID NO: 2458030 - protein, 11 aa, Entamoeba dispar
RQNTEPPESQL

SEQ ID NO: 2458031 - protein, 6 aa, Entamoeba dispar
RQPCDE

SEQ ID NO: 2458032 - protein, 4 aa, Entamoeba dispar
RQPE

SEQ ID NO: 2458033 - protein, 8 aa, Entamoeba dispar
RQPESSKF

SEQ ID NO: 2458034 - protein, 8 aa, Entamoeba dispar
RQPKRSTL

SEQ ID NO: 2458035 - protein, 10 aa, Entamoeba dispar
RQPYNGPKAD

SEQ ID NO: 2458036 - protein, 4 aa, Entamoeba dispar
RQQD

SEQ ID NO: 2458037 - protein, 6 aa, Entamoeba dispar
RQQDDR

SEQ ID NO: 2458038 - protein, 12 aa, Entamoeba dispar
RQQEMEKEHQRY

SEQ ID NO: 2458039 - protein, 28 aa, Entamoeba dispar
RQQEQQQETKKQNKTKENGIEGKKELME

SEQ ID NO: 2458040 - protein, 20 aa, Entamoeba dispar
RQQFEEGFGSNTTLKTAQTR

SEQ ID NO: 2458041 - protein, 11 aa, Entamoeba dispar
RQQGKKIEDIT

SEQ ID NO: 2458042 - protein, 6 aa, Entamoeba dispar
RQQIQN

SEQ ID NO: 2458043 - protein, 6 aa, Entamoeba dispar
RQQKTL

SEQ ID NO: 2458044 - protein, 6 aa, Entamoeba dispar
RQQQEE

SEQ ID NO: 2458045 - protein, 9 aa, Entamoeba dispar
RQQRKRHES

SEQ ID NO: 2458046 - protein, 19 aa, Entamoeba dispar
RQQRLKELEDRKKNAKVIS

SEQ ID NO: 2458047 - protein, 6 aa, Entamoeba dispar
RQQTRN

SEQ ID NO: 2458048 - protein, 7 aa, Entamoeba dispar
RQRAQTS

SEQ ID NO: 2458049 - protein, 9 aa, Entamoeba dispar
RQRGEGGRF

SEQ ID NO: 2458050 - protein, 5 aa, Entamoeba dispar
RQRKG

SEQ ID NO: 2458051 - protein, 6 aa, Entamoeba dispar
RQRSRG

SEQ ID NO: 2458052 - protein, 7 aa, Entamoeba dispar
RQRTRAA

SEQ ID NO: 2458053 - protein, 4 aa, Entamoeba dispar
RQSE

SEQ ID NO: 2458054 - protein, 6 aa, Entamoeba dispar
RQSFEG

SEQ ID NO: 2458055 - protein, 11 aa, Entamoeba dispar
RQSGDDNFGDE

SEQ ID NO: 2458056 - protein, 8 aa, Entamoeba dispar
RQSKSWEA

SEQ ID NO: 2458057 - protein, 18 aa, Entamoeba dispar
RQSQNSRNEQLSTFTKEK

SEQ ID NO: 2458058 - protein, 6 aa, Entamoeba dispar
RQSRRE

SEQ ID NO: 2458059 - protein, 16 aa, Entamoeba dispar
RQSRTGESDRKHDIER

SEQ ID NO: 2458060 - protein, 9 aa, Entamoeba dispar
RQSSDYPTQ

SEQ ID NO: 2458061 - protein, 5 aa, Entamoeba dispar
RQSTK

SEQ ID NO: 2458062 - protein, 11 aa, Entamoeba dispar
RQTANAATLPG

SEQ ID NO: 2458063 - protein, 10 aa, Entamoeba dispar
RQTKKSIDHK

SEQ ID NO: 2458064 - protein, 6 aa, Entamoeba dispar
RQTNPT

SEQ ID NO: 2458065 - protein, 6 aa, Entamoeba dispar
RQTNSL

SEQ ID NO: 2458066 - protein, 12 aa, Entamoeba dispar
RQTQKQSSTVSS

SEQ ID NO: 2458067 - protein, 11 aa, Entamoeba dispar
RQTSLTPDMNN

SEQ ID NO: 2458068 - protein, 4 aa, Entamoeba dispar
RQVE

SEQ ID NO: 2458069 - protein, 19 aa, Entamoeba dispar
RQYGRGDGGEQKQTQRKRK

SEQ ID NO: 2458070 - protein, 14 aa, Entamoeba dispar
RQYLTEDEKRKKEI

SEQ ID NO: 2458071 - protein, 10 aa, Entamoeba dispar
RQYRNKPREF

SEQ ID NO: 2458072 - protein, 18 aa, Entamoeba dispar
RRAAQTTDMNERRKLAEE

SEQ ID NO: 2458073 - protein, 13 aa, Entamoeba dispar
RRAKTLEEGYDET

SEQ ID NO: 2458074 - protein, 9 aa, Entamoeba dispar
RRARKNDNL

SEQ ID NO: 2458075 - protein, 9 aa, Entamoeba dispar
RRASDPREM

SEQ ID NO: 2458076 - protein, 6 aa, Entamoeba dispar
RRASQE

SEQ ID NO: 2458077 - protein, 5 aa, Entamoeba dispar
RRATA

SEQ ID NO: 2458078 - protein, 7 aa, Entamoeba dispar
RRATEKD

SEQ ID NO: 2458079 - protein, 98 aa, Entamoeba dispar
RRDDDYRKAGYRTSRYERKVDRKDYRNDHFERRDDYKLSDHKDDYRLSDHRDDYRASDRRDDYRQSDHKDDYRSSDRRDDYRSSDRRDDYRQSDRRDD

SEQ ID NO: 2458080 - protein, 6 aa, Entamoeba dispar
RRDDEE

SEQ ID NO: 2458081 - protein, 6 aa, Entamoeba dispar
RRDDLE

SEQ ID NO: 2458082 - protein, 7 aa, Entamoeba dispar
RRDEAKE

SEQ ID NO: 2458083 - protein, 9 aa, Entamoeba dispar
RRDGVPKKA

SEQ ID NO: 2458084 - protein, 13 aa, Entamoeba dispar
RRDQPYMTRGRQR

SEQ ID NO: 2458085 - protein, 19 aa, Entamoeba dispar
RRDRRQSVYSEETSHKPVT

SEQ ID NO: 2458086 - protein, 8 aa, Entamoeba dispar
RRDSLASH

SEQ ID NO: 2458087 - protein, 11 aa, Entamoeba dispar
RREDDAKMKER

SEQ ID NO: 2458088 - protein, 6 aa, Entamoeba dispar
RREDDF

SEQ ID NO: 2458089 - protein, 31 aa, Entamoeba dispar
RREDSRSRSKSHSLSNSKSVSRSASPSFNKE

SEQ ID NO: 2458090 - protein, 13 aa, Entamoeba dispar
RREEARDKTPGRY

SEQ ID NO: 2458091 - protein, 8 aa, Entamoeba dispar
RREEEETK

SEQ ID NO: 2458092 - protein, 5 aa, Entamoeba dispar
RREGD

SEQ ID NO: 2458093 - protein, 20 aa, Entamoeba dispar
RRENKNIKEQIKAGGLQRQE

SEQ ID NO: 2458094 - protein, 6 aa, Entamoeba dispar
RREQER

SEQ ID NO: 2458095 - protein, 12 aa, Entamoeba dispar
RREQIKTEIEGL

SEQ ID NO: 2458096 - protein, 7 aa, Entamoeba dispar
RRERSKT

SEQ ID NO: 2458097 - protein, 7 aa, Entamoeba dispar
RRERYDQ

SEQ ID NO: 2458098 - protein, 6 aa, Entamoeba dispar
RRESIG

SEQ ID NO: 2458099 - protein, 9 aa, Entamoeba dispar
RRFEGNEGL

SEQ ID NO: 2458100 - protein, 5 aa, Entamoeba dispar
RRFHS

SEQ ID NO: 2458101 - protein, 13 aa, Entamoeba dispar
RRGDYVDKNDPRD

SEQ ID NO: 2458102 - protein, 5 aa, Entamoeba dispar
RRGGC

SEQ ID NO: 2458103 - protein, 17 aa, Entamoeba dispar
RRGGKRGGRGRPAAAVR

SEQ ID NO: 2458104 - protein, 7 aa, Entamoeba dispar
RRGGPEY

SEQ ID NO: 2458105 - protein, 8 aa, Entamoeba dispar
RRGNPVSQ

SEQ ID NO: 2458106 - protein, 8 aa, Entamoeba dispar
RRGPSDQI

SEQ ID NO: 2458107 - protein, 9 aa, Entamoeba dispar
RRGRRSTLR

SEQ ID NO: 2458108 - protein, 4 aa, Entamoeba dispar
RRGS

SEQ ID NO: 2458109 - protein, 7 aa, Entamoeba dispar
RRGYKAK

SEQ ID NO: 2458110 - protein, 13 aa, Entamoeba dispar
RRGYKKRSTLKRQ

SEQ ID NO: 2458111 - protein, 6 aa, Entamoeba dispar
RRHENS

SEQ ID NO: 2458112 - protein, 10 aa, Entamoeba dispar
RRIDNPSKCR

SEQ ID NO: 2458113 - protein, 11 aa, Entamoeba dispar
RRIKDKNSMEE

SEQ ID NO: 2458114 - protein, 4 aa, Entamoeba dispar
RRIT

SEQ ID NO: 2458115 - protein, 10 aa, Entamoeba dispar
RRKDKGGRIS

SEQ ID NO: 2458116 - protein, 10 aa, Entamoeba dispar
RRKDNPNRRR

SEQ ID NO: 2458117 - protein, 9 aa, Entamoeba dispar
RRKDRSTAC

SEQ ID NO: 2458118 - protein, 10 aa, Entamoeba dispar
RRKEKEEGVV

SEQ ID NO: 2458119 - protein, 58 aa, Entamoeba dispar
RRKGGDEKEGDERGDKEEFSPKVKEEKKEKKKEEKKEKEREKKERKEEKKKKGSEENI

SEQ ID NO: 2458120 - protein, 6 aa, Entamoeba dispar
RRKGNN

SEQ ID NO: 2458121 - protein, 49 aa, Entamoeba dispar
RRKMEEKTQKTKESTIKQEQLNDLKKKNKELKKRIEKGGLDIEAREREI

SEQ ID NO: 2458122 - protein, 15 aa, Entamoeba dispar
RRKPSDGNSMLPPPI

SEQ ID NO: 2458123 - protein, 6 aa, Entamoeba dispar
RRKTDE

SEQ ID NO: 2458124 - protein, 9 aa, Entamoeba dispar
RRKTTRFSA

SEQ ID NO: 2458125 - protein, 4 aa, Entamoeba dispar
RRKV

SEQ ID NO: 2458126 - protein, 5 aa, Entamoeba dispar
RRKWN

SEQ ID NO: 2458127 - protein, 4 aa, Entamoeba dispar
RRLG

SEQ ID NO: 2458128 - protein, 6 aa, Entamoeba dispar
RRLKEK

SEQ ID NO: 2458129 - protein, 4 aa, Entamoeba dispar
RRLS

SEQ ID NO: 2458130 - protein, 9 aa, Entamoeba dispar
RRLSSQKSN

SEQ ID NO: 2458131 - protein, 8 aa, Entamoeba dispar
RRNELENE

SEQ ID NO: 2458132 - protein, 12 aa, Entamoeba dispar
RRNENIEKEGNE

SEQ ID NO: 2458133 - protein, 4 aa, Entamoeba dispar
RRNF

SEQ ID NO: 2458134 - protein, 10 aa, Entamoeba dispar
RRNGTKSTLS

SEQ ID NO: 2458135 - protein, 9 aa, Entamoeba dispar
RRNKKENSF

SEQ ID NO: 2458136 - protein, 10 aa, Entamoeba dispar
RRNNNTDNII

SEQ ID NO: 2458137 - protein, 9 aa, Entamoeba dispar
RRNPKTNKS

SEQ ID NO: 2458138 - protein, 4 aa, Entamoeba dispar
RRNQ

SEQ ID NO: 2458139 - protein, 7 aa, Entamoeba dispar
RRNQIGS

SEQ ID NO: 2458140 - protein, 10 aa, Entamoeba dispar
RRNQVPPANN

SEQ ID NO: 2458141 - protein, 11 aa, Entamoeba dispar
RRNRLPNDEMA

SEQ ID NO: 2458142 - protein, 6 aa, Entamoeba dispar
RRNTAP

SEQ ID NO: 2458143 - protein, 5 aa, Entamoeba dispar
RRNTH

SEQ ID NO: 2458144 - protein, 12 aa, Entamoeba dispar
RRNTKGKKGTLK

SEQ ID NO: 2458145 - protein, 13 aa, Entamoeba dispar
RRNTSENEIRTRQ

SEQ ID NO: 2458146 - protein, 6 aa, Entamoeba dispar
RRPDLL

SEQ ID NO: 2458147 - protein, 69 aa, Entamoeba dispar
RRPNEMEPTKEKKDKDEEKQRKKEEKEKKKLEKEQEKLKKKEEKEKKKKKESKTKEEKYAPKKDRSKRR

SEQ ID NO: 2458148 - protein, 21 aa, Entamoeba dispar
RRPSFREKKKEGMENEKSSQT

SEQ ID NO: 2458149 - protein, 6 aa, Entamoeba dispar
RRPSGI

SEQ ID NO: 2458150 - protein, 11 aa, Entamoeba dispar
RRPSQAPTEEM

SEQ ID NO: 2458151 - protein, 7 aa, Entamoeba dispar
RRPSTRA

SEQ ID NO: 2458152 - protein, 45 aa, Entamoeba dispar
RRQAERQAEREKARKEREEKKKEEMAKKAAQRAAMRKQADEELKQ

SEQ ID NO: 2458153 - protein, 20 aa, Entamoeba dispar
RRQDTNISSSEEEDDDDDWS

SEQ ID NO: 2458154 - protein, 11 aa, Entamoeba dispar
RRQEDTEETFI

SEQ ID NO: 2458155 - protein, 10 aa, Entamoeba dispar
RRQGANPLLS

SEQ ID NO: 2458156 - protein, 8 aa, Entamoeba dispar
RRQGRLEN

SEQ ID NO: 2458157 - protein, 7 aa, Entamoeba dispar
RRQKKEI

SEQ ID NO: 2458158 - protein, 7 aa, Entamoeba dispar
RRQLTGD

SEQ ID NO: 2458159 - protein, 8 aa, Entamoeba dispar
RRQPNNES

SEQ ID NO: 2458160 - protein, 14 aa, Entamoeba dispar
RRQQPKRAEAENAE

SEQ ID NO: 2458161 - protein, 11 aa, Entamoeba dispar
RRQSNIKTENF

SEQ ID NO: 2458162 - protein, 8 aa, Entamoeba dispar
RRQTRLTA

SEQ ID NO: 2458163 - protein, 15 aa, Entamoeba dispar
RRRADRSPSLSPLGD

SEQ ID NO: 2458164 - protein, 8 aa, Entamoeba dispar
RRRDLPPI

SEQ ID NO: 2458165 - protein, 9 aa, Entamoeba dispar
RRRDQRHHS

SEQ ID NO: 2458166 - protein, 9 aa, Entamoeba dispar
RRRGGGGDC

SEQ ID NO: 2458167 - protein, 9 aa, Entamoeba dispar
RRRKGDYSL

SEQ ID NO: 2458168 - protein, 14 aa, Entamoeba dispar
RRRNRQKETFNSEE

SEQ ID NO: 2458169 - protein, 14 aa, Entamoeba dispar
RRRTAPLSADMGGT

SEQ ID NO: 2458170 - protein, 30 aa, Entamoeba dispar
RRRTERSRSRERYRPSYYSPRRSRSISPRD

SEQ ID NO: 2458171 - protein, 12 aa, Entamoeba dispar
RRRYKKRATLKR

SEQ ID NO: 2458172 - protein, 9 aa, Entamoeba dispar
RRSEDRRTV

SEQ ID NO: 2458173 - protein, 8 aa, Entamoeba dispar
RRSFKNQN

SEQ ID NO: 2458174 - protein, 12 aa, Entamoeba dispar
RRSKKKRGVTAP

SEQ ID NO: 2458175 - protein, 6 aa, Entamoeba dispar
RRSNEV

SEQ ID NO: 2458176 - protein, 24 aa, Entamoeba dispar
RRSQDNPDAIEDERAFKAEYKQSV

SEQ ID NO: 2458177 - protein, 24 aa, Entamoeba dispar
RRSSELKRESLTNELKGNSLPPAV

SEQ ID NO: 2458178 - protein, 58 aa, Entamoeba dispar
RRSSSISSEEHSFGQGYEKTNEEQYPNTEGAIQQEVPEQFQEEQPAEQNQQPQRQGRI

SEQ ID NO: 2458179 - protein, 9 aa, Entamoeba dispar
RRSTEPMRS

SEQ ID NO: 2458180 - protein, 4 aa, Entamoeba dispar
RRSV

SEQ ID NO: 2458181 - protein, 10 aa, Entamoeba dispar
RRSVSKEDEL

SEQ ID NO: 2458182 - protein, 5 aa, Entamoeba dispar
RRSVV

SEQ ID NO: 2458183 - protein, 8 aa, Entamoeba dispar
RRTCDPKF

SEQ ID NO: 2458184 - protein, 27 aa, Entamoeba dispar
RRTESLPIPVSEKKRLEEVSKESVATT

SEQ ID NO: 2458185 - protein, 11 aa, Entamoeba dispar
RRTGGTSNSKE

SEQ ID NO: 2458186 - protein, 9 aa, Entamoeba dispar
RRTHTPQKV

SEQ ID NO: 2458187 - protein, 8 aa, Entamoeba dispar
RRTNRRQT

SEQ ID NO: 2458188 - protein, 19 aa, Entamoeba dispar
RRTQRKRLRRQRRVAGKTV

SEQ ID NO: 2458189 - protein, 8 aa, Entamoeba dispar
RRTQRRQS

SEQ ID NO: 2458190 - protein, 6 aa, Entamoeba dispar
RRTRGL

SEQ ID NO: 2458191 - protein, 7 aa, Entamoeba dispar
RRTSDLA

SEQ ID NO: 2458192 - protein, 18 aa, Entamoeba dispar
RRTSVAKGAALEASKNTQ

SEQ ID NO: 2458193 - protein, 18 aa, Entamoeba dispar
RRTSVSEESEEEVIQGGQ

SEQ ID NO: 2458194 - protein, 15 aa, Entamoeba dispar
RRTTQPKSKKQATFQ

SEQ ID NO: 2458195 - protein, 35 aa, Entamoeba dispar
RRVEPSKEEVKINSTTETNHLEKQSNNKKQEVDDL

SEQ ID NO: 2458196 - protein, 10 aa, Entamoeba dispar
RRVNERSKQI

SEQ ID NO: 2458197 - protein, 8 aa, Entamoeba dispar
RRVSEAQL

SEQ ID NO: 2458198 - protein, 12 aa, Entamoeba dispar
RRWEKSEDGELK

SEQ ID NO: 2458199 - protein, 9 aa, Entamoeba dispar
RRYQNNKKI

SEQ ID NO: 2458200 - protein, 24 aa, Entamoeba dispar
RRYQPTQYPNSAAQALPDFTQKGN

SEQ ID NO: 2458201 - protein, 7 aa, Entamoeba dispar
RRYSDNE

SEQ ID NO: 2458202 - protein, 8 aa, Entamoeba dispar
RRYTKSSF

SEQ ID NO: 2458203 - protein, 11 aa, Entamoeba dispar
RSAAANRDDDR

SEQ ID NO: 2458204 - protein, 24 aa, Entamoeba dispar
RSAADRKLDTAAPVVSDAGKQDLT

SEQ ID NO: 2458205 - protein, 18 aa, Entamoeba dispar
RSAEKALKTMNKTELNGK

SEQ ID NO: 2458206 - protein, 12 aa, Entamoeba dispar
RSAEKELYKKSQ

SEQ ID NO: 2458207 - protein, 15 aa, Entamoeba dispar
RSAKAKTKQKGGKHQ

SEQ ID NO: 2458208 - protein, 15 aa, Entamoeba dispar
RSAKTQPKKEVRKTL

SEQ ID NO: 2458209 - protein, 8 aa, Entamoeba dispar
RSAQELGP

SEQ ID NO: 2458210 - protein, 10 aa, Entamoeba dispar
RSAQPLPGTF

SEQ ID NO: 2458211 - protein, 6 aa, Entamoeba dispar
RSASIA

SEQ ID NO: 2458212 - protein, 21 aa, Entamoeba dispar
RSASPLGESEAEEKKKKKINL

SEQ ID NO: 2458213 - protein, 5 aa, Entamoeba dispar
RSAST

SEQ ID NO: 2458214 - protein, 6 aa, Entamoeba dispar
RSASVA

SEQ ID NO: 2458215 - protein, 6 aa, Entamoeba dispar
RSATKR

SEQ ID NO: 2458216 - protein, 5 aa, Entamoeba dispar
RSDAP

SEQ ID NO: 2458217 - protein, 10 aa, Entamoeba dispar
RSDEEDEKLK

SEQ ID NO: 2458218 - protein, 5 aa, Entamoeba dispar
RSDES

SEQ ID NO: 2458219 - protein, 5 aa, Entamoeba dispar
RSDFG

SEQ ID NO: 2458220 - protein, 4 aa, Entamoeba dispar
RSDG

SEQ ID NO: 2458221 - protein, 4 aa, Entamoeba dispar
RSDI

SEQ ID NO: 2458222 - protein, 19 aa, Entamoeba dispar
RSDIADDEDDDDDDDDEWS

SEQ ID NO: 2458223 - protein, 9 aa, Entamoeba dispar
RSDINSDVT

SEQ ID NO: 2458224 - protein, 10 aa, Entamoeba dispar
RSDRENRTIE

SEQ ID NO: 2458225 - protein, 6 aa, Entamoeba dispar
RSDVDI

SEQ ID NO: 2458226 - protein, 5 aa, Entamoeba dispar
RSEAH

SEQ ID NO: 2458227 - protein, 27 aa, Entamoeba dispar
RSEDKKDKELEKSVKEETKPKRRKTQL

SEQ ID NO: 2458228 - protein, 5 aa, Entamoeba dispar
RSEDL

SEQ ID NO: 2458229 - protein, 15 aa, Entamoeba dispar
RSEEEAKKKAAEIKG

SEQ ID NO: 2458230 - protein, 8 aa, Entamoeba dispar
RSEEENKE

SEQ ID NO: 2458231 - protein, 27 aa, Entamoeba dispar
RSEESKEKELEKRVKEETKPKRRKTEL

SEQ ID NO: 2458232 - protein, 13 aa, Entamoeba dispar
RSELTNNIEEGEP

SEQ ID NO: 2458233 - protein, 5 aa, Entamoeba dispar
RSEME

SEQ ID NO: 2458234 - protein, 15 aa, Entamoeba dispar
RSENEIEDGKGGNRE

SEQ ID NO: 2458235 - protein, 9 aa, Entamoeba dispar
RSENKQINS

SEQ ID NO: 2458236 - protein, 12 aa, Entamoeba dispar
RSEQISLEEPNK

SEQ ID NO: 2458237 - protein, 25 aa, Entamoeba dispar
RSERHNLESQKSISSPSNKQKFKYE

SEQ ID NO: 2458238 - protein, 9 aa, Entamoeba dispar
RSESDSGEF

SEQ ID NO: 2458239 - protein, 6 aa, Entamoeba dispar
RSESHS

SEQ ID NO: 2458240 - protein, 14 aa, Entamoeba dispar
RSESKTRRHYTNLT

SEQ ID NO: 2458241 - protein, 9 aa, Entamoeba dispar
RSESNFSSR

SEQ ID NO: 2458242 - protein, 24 aa, Entamoeba dispar
RSESPITRTQLSPRTITTKKESDL

SEQ ID NO: 2458243 - protein, 30 aa, Entamoeba dispar
RSESQSDYSKTETNYESYPAQRESSSRISP

SEQ ID NO: 2458244 - protein, 9 aa, Entamoeba dispar
RSESVNNQL

SEQ ID NO: 2458245 - protein, 7 aa, Entamoeba dispar
RSETDDI

SEQ ID NO: 2458246 - protein, 8 aa, Entamoeba dispar
RSETNGEF

SEQ ID NO: 2458247 - protein, 10 aa, Entamoeba dispar
RSFDGNDERC

SEQ ID NO: 2458248 - protein, 14 aa, Entamoeba dispar
RSFDSSISGNFRRE

SEQ ID NO: 2458249 - protein, 5 aa, Entamoeba dispar
RSFED

SEQ ID NO: 2458250 - protein, 13 aa, Entamoeba dispar
RSFEPAKNTLDLP

SEQ ID NO: 2458251 - protein, 5 aa, Entamoeba dispar
RSFHP

SEQ ID NO: 2458252 - protein, 16 aa, Entamoeba dispar
RSFPPSQIKTQPIPNI

SEQ ID NO: 2458253 - protein, 8 aa, Entamoeba dispar
RSGAAPFT

SEQ ID NO: 2458254 - protein, 6 aa, Entamoeba dispar
RSGDTF

SEQ ID NO: 2458255 - protein, 6 aa, Entamoeba dispar
RSGGLG

SEQ ID NO: 2458256 - protein, 12 aa, Entamoeba dispar
RSGGTGGDSVRD

SEQ ID NO: 2458257 - protein, 7 aa, Entamoeba dispar
RSGHPMK

SEQ ID NO: 2458258 - protein, 7 aa, Entamoeba dispar
RSGKDVV

SEQ ID NO: 2458259 - protein, 13 aa, Entamoeba dispar
RSGLTPKPTAKNF

SEQ ID NO: 2458260 - protein, 10 aa, Entamoeba dispar
RSGNLTEKDN

SEQ ID NO: 2458261 - protein, 5 aa, Entamoeba dispar
RSGQF

SEQ ID NO: 2458262 - protein, 8 aa, Entamoeba dispar
RSGRFGRT

SEQ ID NO: 2458263 - protein, 10 aa, Entamoeba dispar
RSGSAESLNG

SEQ ID NO: 2458264 - protein, 9 aa, Entamoeba dispar
RSGSGKTSM

SEQ ID NO: 2458265 - protein, 4 aa, Entamoeba dispar
RSGT

SEQ ID NO: 2458266 - protein, 6 aa, Entamoeba dispar
RSGVEG

SEQ ID NO: 2458267 - protein, 5 aa, Entamoeba dispar
RSGWN

SEQ ID NO: 2458268 - protein, 4 aa, Entamoeba dispar
RSGY

SEQ ID NO: 2458269 - protein, 10 aa, Entamoeba dispar
RSGYMTEKSG

SEQ ID NO: 2458270 - protein, 16 aa, Entamoeba dispar
RSGYYKELEKDLILIQ

SEQ ID NO: 2458271 - protein, 10 aa, Entamoeba dispar
RSHEDRTNKL

SEQ ID NO: 2458272 - protein, 8 aa, Entamoeba dispar
RSHNKPEE

SEQ ID NO: 2458273 - protein, 10 aa, Entamoeba dispar
RSHTTKQNVQ

SEQ ID NO: 2458274 - protein, 5 aa, Entamoeba dispar
RSHTV

SEQ ID NO: 2458275 - protein, 12 aa, Entamoeba dispar
RSIDDISKDIEN

SEQ ID NO: 2458276 - protein, 8 aa, Entamoeba dispar
RSIGDEPL

SEQ ID NO: 2458277 - protein, 8 aa, Entamoeba dispar
RSIGDESM

SEQ ID NO: 2458278 - protein, 5 aa, Entamoeba dispar
RSIHE

SEQ ID NO: 2458279 - protein, 10 aa, Entamoeba dispar
RSIKGYDKHP

SEQ ID NO: 2458280 - protein, 7 aa, Entamoeba dispar
RSKAEDY

SEQ ID NO: 2458281 - protein, 7 aa, Entamoeba dispar
RSKELSN

SEQ ID NO: 2458282 - protein, 6 aa, Entamoeba dispar
RSKEYD

SEQ ID NO: 2458283 - protein, 6 aa, Entamoeba dispar
RSKEYL

SEQ ID NO: 2458284 - protein, 7 aa, Entamoeba dispar
RSKEYSE

SEQ ID NO: 2458285 - protein, 10 aa, Entamoeba dispar
RSKFSKTVTT

SEQ ID NO: 2458286 - protein, 8 aa, Entamoeba dispar
RSKGLNDS

SEQ ID NO: 2458287 - protein, 14 aa, Entamoeba dispar
RSKINKGSTSPPQV

SEQ ID NO: 2458288 - protein, 9 aa, Entamoeba dispar
RSKKAEKAL

SEQ ID NO: 2458289 - protein, 8 aa, Entamoeba dispar
RSKKEVSQ

SEQ ID NO: 2458290 - protein, 8 aa, Entamoeba dispar
RSKKTSKT

SEQ ID NO: 2458291 - protein, 5 aa, Entamoeba dispar
RSKLQ

SEQ ID NO: 2458292 - protein, 11 aa, Entamoeba dispar
RSKNSSEERRD

SEQ ID NO: 2458293 - protein, 5 aa, Entamoeba dispar
RSKPK

SEQ ID NO: 2458294 - protein, 9 aa, Entamoeba dispar
RSKPSEELQ

SEQ ID NO: 2458295 - protein, 13 aa, Entamoeba dispar
RSKPYIDQVYELT

SEQ ID NO: 2458296 - protein, 8 aa, Entamoeba dispar
RSKQEYPE

SEQ ID NO: 2458297 - protein, 10 aa, Entamoeba dispar
RSKSNKGNSS

SEQ ID NO: 2458298 - protein, 9 aa, Entamoeba dispar
RSKSPDKVK

SEQ ID NO: 2458299 - protein, 7 aa, Entamoeba dispar
RSKTDAM

SEQ ID NO: 2458300 - protein, 7 aa, Entamoeba dispar
RSLDKRQ

SEQ ID NO: 2458301 - protein, 8 aa, Entamoeba dispar
RSLGDRAL

SEQ ID NO: 2458302 - protein, 10 aa, Entamoeba dispar
RSLGDSVNQP

SEQ ID NO: 2458303 - protein, 4 aa, Entamoeba dispar
RSLK

SEQ ID NO: 2458304 - protein, 11 aa, Entamoeba dispar
RSLKTKSEELK

SEQ ID NO: 2458305 - protein, 8 aa, Entamoeba dispar
RSLPKGES

SEQ ID NO: 2458306 - protein, 7 aa, Entamoeba dispar
RSLPKKE

SEQ ID NO: 2458307 - protein, 11 aa, Entamoeba dispar
RSLPKQDEYFT

SEQ ID NO: 2458308 - protein, 7 aa, Entamoeba dispar
RSLPPAI

SEQ ID NO: 2458309 - protein, 77 aa, Entamoeba dispar
RSLPPKPVRSSAINSPLTTPITTNANSQTLPKPSPLVSSQQKMPTKPSPQQHGCKQSQSQPVLNKTTQQNSARPSTL

SEQ ID NO: 2458310 - protein, 5 aa, Entamoeba dispar
RSLPS

SEQ ID NO: 2458311 - protein, 9 aa, Entamoeba dispar
RSLSINSTT

SEQ ID NO: 2458312 - protein, 46 aa, Entamoeba dispar
RSLSRSRKRSSRSFSRRQISPRRYNRSERRHSYSDRRRSLSKRRSL

SEQ ID NO: 2458313 - protein, 11 aa, Entamoeba dispar
RSLSSKEGIIT

SEQ ID NO: 2458314 - protein, 9 aa, Entamoeba dispar
RSLTTTDNQ

SEQ ID NO: 2458315 - protein, 5 aa, Entamoeba dispar
RSMEK

SEQ ID NO: 2458316 - protein, 10 aa, Entamoeba dispar
RSMRDGVADM

SEQ ID NO: 2458317 - protein, 35 aa, Entamoeba dispar
RSMTTQSGSPMSSPFHSPRENLTGTSVGSPRQPNC

SEQ ID NO: 2458318 - protein, 12 aa, Entamoeba dispar
RSNCSSSRNHHK

SEQ ID NO: 2458319 - protein, 4 aa, Entamoeba dispar
RSND

SEQ ID NO: 2458320 - protein, 5 aa, Entamoeba dispar
RSNDL

SEQ ID NO: 2458321 - protein, 19 aa, Entamoeba dispar
RSNEIQKENETIKQTPQYV

SEQ ID NO: 2458322 - protein, 7 aa, Entamoeba dispar
RSNEYRF

SEQ ID NO: 2458323 - protein, 6 aa, Entamoeba dispar
RSNHPK

SEQ ID NO: 2458324 - protein, 14 aa, Entamoeba dispar
RSNKEQRYDEVGDE

SEQ ID NO: 2458325 - protein, 18 aa, Entamoeba dispar
RSNLTEKEQDIILQASMH

SEQ ID NO: 2458326 - protein, 8 aa, Entamoeba dispar
RSNNEFNK

SEQ ID NO: 2458327 - protein, 16 aa, Entamoeba dispar
RSNNSIDVEEELDNTP

SEQ ID NO: 2458328 - protein, 6 aa, Entamoeba dispar
RSNPEL

SEQ ID NO: 2458329 - protein, 7 aa, Entamoeba dispar
RSNPSTA

SEQ ID NO: 2458330 - protein, 26 aa, Entamoeba dispar
RSNPTTPSHKKSRKSSIVDAFKKFSK

SEQ ID NO: 2458331 - protein, 12 aa, Entamoeba dispar
RSNQNGQPTTRT

SEQ ID NO: 2458332 - protein, 10 aa, Entamoeba dispar
RSNRRKENPN

SEQ ID NO: 2458333 - protein, 5 aa, Entamoeba dispar
RSNRV

SEQ ID NO: 2458334 - protein, 13 aa, Entamoeba dispar
RSNSGEKKTTRRN

SEQ ID NO: 2458335 - protein, 18 aa, Entamoeba dispar
RSNSIGKNKSSSLSGDLS

SEQ ID NO: 2458336 - protein, 9 aa, Entamoeba dispar
RSNVTDPEG

SEQ ID NO: 2458337 - protein, 7 aa, Entamoeba dispar
RSNYNKG

SEQ ID NO: 2458338 - protein, 13 aa, Entamoeba dispar
RSNYTQLAQQTNQ

SEQ ID NO: 2458339 - protein, 5 aa, Entamoeba dispar
RSPCE

SEQ ID NO: 2458340 - protein, 15 aa, Entamoeba dispar
RSPDKNDSPNKFDER

SEQ ID NO: 2458341 - protein, 17 aa, Entamoeba dispar
RSPDNDMTREMTDTPKL

SEQ ID NO: 2458342 - protein, 4 aa, Entamoeba dispar
RSPE

SEQ ID NO: 2458343 - protein, 9 aa, Entamoeba dispar
RSPGERPTI

SEQ ID NO: 2458344 - protein, 9 aa, Entamoeba dispar
RSPGGDMGI

SEQ ID NO: 2458345 - protein, 6 aa, Entamoeba dispar
RSPKQE

SEQ ID NO: 2458346 - protein, 7 aa, Entamoeba dispar
RSPLNSY

SEQ ID NO: 2458347 - protein, 5 aa, Entamoeba dispar
RSPNV

SEQ ID NO: 2458348 - protein, 5 aa, Entamoeba dispar
RSPPG

SEQ ID NO: 2458349 - protein, 7 aa, Entamoeba dispar
RSPQIKT

SEQ ID NO: 2458350 - protein, 6 aa, Entamoeba dispar
RSPRNC

SEQ ID NO: 2458351 - protein, 20 aa, Entamoeba dispar
RSPSPSSSRSSHIRRTSGSH

SEQ ID NO: 2458352 - protein, 9 aa, Entamoeba dispar
RSPSSTRLT

SEQ ID NO: 2458353 - protein, 9 aa, Entamoeba dispar
RSPTTENIS

SEQ ID NO: 2458354 - protein, 6 aa, Entamoeba dispar
RSPTVS

SEQ ID NO: 2458355 - protein, 11 aa, Entamoeba dispar
RSQAEKYESVG

SEQ ID NO: 2458356 - protein, 8 aa, Entamoeba dispar
RSQEEEFS

SEQ ID NO: 2458357 - protein, 7 aa, Entamoeba dispar
RSQEYPS

SEQ ID NO: 2458358 - protein, 10 aa, Entamoeba dispar
RSQEYSDRAP

SEQ ID NO: 2458359 - protein, 19 aa, Entamoeba dispar
RSQLQKRKDPFKENPDSID

SEQ ID NO: 2458360 - protein, 9 aa, Entamoeba dispar
RSQQDINNR

SEQ ID NO: 2458361 - protein, 10 aa, Entamoeba dispar
RSQQKRGDEK

SEQ ID NO: 2458362 - protein, 6 aa, Entamoeba dispar
RSQRYC

SEQ ID NO: 2458363 - protein, 8 aa, Entamoeba dispar
RSQVSNTI

SEQ ID NO: 2458364 - protein, 5 aa, Entamoeba dispar
RSRFK

SEQ ID NO: 2458365 - protein, 12 aa, Entamoeba dispar
RSRGGLGNEKRP

SEQ ID NO: 2458366 - protein, 18 aa, Entamoeba dispar
RSRHNKGRKDKEINKDNI

SEQ ID NO: 2458367 - protein, 6 aa, Entamoeba dispar
RSRKAA

SEQ ID NO: 2458368 - protein, 13 aa, Entamoeba dispar
RSRKRNPINCLVI

SEQ ID NO: 2458369 - protein, 11 aa, Entamoeba dispar
RSRKVSGKAEG

SEQ ID NO: 2458370 - protein, 4 aa, Entamoeba dispar
RSRN

SEQ ID NO: 2458371 - protein, 7 aa, Entamoeba dispar
RSRNDDS

SEQ ID NO: 2458372 - protein, 6 aa, Entamoeba dispar
RSRPQM

SEQ ID NO: 2458373 - protein, 11 aa, Entamoeba dispar
RSRQKVKDSKK

SEQ ID NO: 2458374 - protein, 14 aa, Entamoeba dispar
RSRRRFPINAMIAI

SEQ ID NO: 2458375 - protein, 8 aa, Entamoeba dispar
RSRRTVNP

SEQ ID NO: 2458376 - protein, 8 aa, Entamoeba dispar
RSRSDYNK

SEQ ID NO: 2458377 - protein, 16 aa, Entamoeba dispar
RSRTKKKFINHEIPFQ

SEQ ID NO: 2458378 - protein, 9 aa, Entamoeba dispar
RSSAEDSID

SEQ ID NO: 2458379 - protein, 25 aa, Entamoeba dispar
RSSAGSKTAIKPEVQSDQQPNTSPF

SEQ ID NO: 2458380 - protein, 5 aa, Entamoeba dispar
RSSAL

SEQ ID NO: 2458381 - protein, 5 aa, Entamoeba dispar
RSSDG

SEQ ID NO: 2458382 - protein, 7 aa, Entamoeba dispar
RSSDGKD

SEQ ID NO: 2458383 - protein, 8 aa, Entamoeba dispar
RSSDNNYL

SEQ ID NO: 2458384 - protein, 5 aa, Entamoeba dispar
RSSDP

SEQ ID NO: 2458385 - protein, 8 aa, Entamoeba dispar
RSSEMKNT

SEQ ID NO: 2458386 - protein, 31 aa, Entamoeba dispar
RSSGGKPSNVTEPPPKEEESELQKKLKSRRA

SEQ ID NO: 2458387 - protein, 12 aa, Entamoeba dispar
RSSGTTSTESEW

SEQ ID NO: 2458388 - protein, 5 aa, Entamoeba dispar
RSSID

SEQ ID NO: 2458389 - protein, 7 aa, Entamoeba dispar
RSSKDED

SEQ ID NO: 2458390 - protein, 5 aa, Entamoeba dispar
RSSKP

SEQ ID NO: 2458391 - protein, 9 aa, Entamoeba dispar
RSSKTFEAC

SEQ ID NO: 2458392 - protein, 18 aa, Entamoeba dispar
RSSLHSNNINSSSNLSTI

SEQ ID NO: 2458393 - protein, 6 aa, Entamoeba dispar
RSSLKF

SEQ ID NO: 2458394 - protein, 8 aa, Entamoeba dispar
RSSNTKLL

SEQ ID NO: 2458395 - protein, 15 aa, Entamoeba dispar
RSSPSQDDSPTPNIA

SEQ ID NO: 2458396 - protein, 10 aa, Entamoeba dispar
RSSQQELTAT

SEQ ID NO: 2458397 - protein, 39 aa, Entamoeba dispar
RSSRESPRLEQPKSELGTPREGIKSPRVIGKEKRRLSGS

SEQ ID NO: 2458398 - protein, 5 aa, Entamoeba dispar
RSSRG

SEQ ID NO: 2458399 - protein, 47 aa, Entamoeba dispar
RSSRSYSRSPSSRNSNSFRSPYQSPTRRSSPPLPEYRNSYRSPINKN

SEQ ID NO: 2458400 - protein, 15 aa, Entamoeba dispar
RSSSAERKSNDKKES

SEQ ID NO: 2458401 - protein, 21 aa, Entamoeba dispar
RSSSSTLPTKSNLHERGGRVG

SEQ ID NO: 2458402 - protein, 9 aa, Entamoeba dispar
RSSSTEQNL

SEQ ID NO: 2458403 - protein, 10 aa, Entamoeba dispar
RSSSTQSNCY

SEQ ID NO: 2458404 - protein, 6 aa, Entamoeba dispar
RSSTDI

SEQ ID NO: 2458405 - protein, 7 aa, Entamoeba dispar
RSSTNTL

SEQ ID NO: 2458406 - protein, 10 aa, Entamoeba dispar
RSSVAQKDEV

SEQ ID NO: 2458407 - protein, 15 aa, Entamoeba dispar
RSSYSNTYLQNEGET

SEQ ID NO: 2458408 - protein, 5 aa, Entamoeba dispar
RSTGD

SEQ ID NO: 2458409 - protein, 11 aa, Entamoeba dispar
RSTHTMTGHSN

SEQ ID NO: 2458410 - protein, 5 aa, Entamoeba dispar
RSTKK

SEQ ID NO: 2458411 - protein, 5 aa, Entamoeba dispar
RSTKM

SEQ ID NO: 2458412 - protein, 8 aa, Entamoeba dispar
RSTKNKWN

SEQ ID NO: 2458413 - protein, 6 aa, Entamoeba dispar
RSTKVD

SEQ ID NO: 2458414 - protein, 14 aa, Entamoeba dispar
RSTLAKKKDKQVVG

SEQ ID NO: 2458415 - protein, 9 aa, Entamoeba dispar
RSTLKSNDH

SEQ ID NO: 2458416 - protein, 12 aa, Entamoeba dispar
RSTMPENQYKTR

SEQ ID NO: 2458417 - protein, 12 aa, Entamoeba dispar
RSTNDSSTVSEW

SEQ ID NO: 2458418 - protein, 14 aa, Entamoeba dispar
RSTNYNTTKKHNEN

SEQ ID NO: 2458419 - protein, 6 aa, Entamoeba dispar
RSTPYE

SEQ ID NO: 2458420 - protein, 9 aa, Entamoeba dispar
RSTQDFNGA

SEQ ID NO: 2458421 - protein, 7 aa, Entamoeba dispar
RSTRKEY

SEQ ID NO: 2458422 - protein, 4 aa, Entamoeba dispar
RSTS

SEQ ID NO: 2458423 - protein, 15 aa, Entamoeba dispar
RSTSRRSSPEHQNFS

SEQ ID NO: 2458424 - protein, 8 aa, Entamoeba dispar
RSTSVPDE

SEQ ID NO: 2458425 - protein, 9 aa, Entamoeba dispar
RSTTGKVDE

SEQ ID NO: 2458426 - protein, 6 aa, Entamoeba dispar
RSTVKS

SEQ ID NO: 2458427 - protein, 13 aa, Entamoeba dispar
RSVADNSSKIQEK

SEQ ID NO: 2458428 - protein, 14 aa, Entamoeba dispar
RSVKHIQSDIRMEE

SEQ ID NO: 2458429 - protein, 15 aa, Entamoeba dispar
RSVNSGRVDDNDDSL

SEQ ID NO: 2458430 - protein, 15 aa, Entamoeba dispar
RSVQNRLSTSYFDLK

SEQ ID NO: 2458431 - protein, 9 aa, Entamoeba dispar
RSVSGEANQ

SEQ ID NO: 2458432 - protein, 7 aa, Entamoeba dispar
RSYERIK

SEQ ID NO: 2458433 - protein, 6 aa, Entamoeba dispar
RSYNDL

SEQ ID NO: 2458434 - protein, 10 aa, Entamoeba dispar
RSYNRAPKLK

SEQ ID NO: 2458435 - protein, 8 aa, Entamoeba dispar
RSYPENAA

SEQ ID NO: 2458436 - protein, 16 aa, Entamoeba dispar
RSYSNSPKRRSSPRQL

SEQ ID NO: 2458437 - protein, 5 aa, Entamoeba dispar
RTAAI

SEQ ID NO: 2458438 - protein, 6 aa, Entamoeba dispar
RTAEPV

SEQ ID NO: 2458439 - protein, 4 aa, Entamoeba dispar
RTAI

SEQ ID NO: 2458440 - protein, 11 aa, Entamoeba dispar
RTAKTVSPEER

SEQ ID NO: 2458441 - protein, 14 aa, Entamoeba dispar
RTAQDLNKQIEQEL

SEQ ID NO: 2458442 - protein, 4 aa, Entamoeba dispar
RTAR

SEQ ID NO: 2458443 - protein, 10 aa, Entamoeba dispar
RTARADTKGR

SEQ ID NO: 2458444 - protein, 9 aa, Entamoeba dispar
RTARANRKG

SEQ ID NO: 2458445 - protein, 7 aa, Entamoeba dispar
RTASHKE

SEQ ID NO: 2458446 - protein, 7 aa, Entamoeba dispar
RTATSEI

SEQ ID NO: 2458447 - protein, 8 aa, Entamoeba dispar
RTCGTGIE

SEQ ID NO: 2458448 - protein, 5 aa, Entamoeba dispar
RTCSK

SEQ ID NO: 2458449 - protein, 5 aa, Entamoeba dispar
RTCTP

SEQ ID NO: 2458450 - protein, 5 aa, Entamoeba dispar
RTDAL

SEQ ID NO: 2458451 - protein, 8 aa, Entamoeba dispar
RTDANSKI

SEQ ID NO: 2458452 - protein, 8 aa, Entamoeba dispar
RTDGVSTT

SEQ ID NO: 2458453 - protein, 5 aa, Entamoeba dispar
RTDME

SEQ ID NO: 2458454 - protein, 26 aa, Entamoeba dispar
RTDSPKKRSNTILNGTENSFTKQKYN

SEQ ID NO: 2458455 - protein, 5 aa, Entamoeba dispar
RTDTL

SEQ ID NO: 2458456 - protein, 17 aa, Entamoeba dispar
RTDTNKTRSSTTSFSDN

SEQ ID NO: 2458457 - protein, 10 aa, Entamoeba dispar
RTEEKKKNIK

SEQ ID NO: 2458458 - protein, 8 aa, Entamoeba dispar
RTEGVSTT

SEQ ID NO: 2458459 - protein, 11 aa, Entamoeba dispar
RTEISKSQTPL

SEQ ID NO: 2458460 - protein, 11 aa, Entamoeba dispar
RTEISNTKKVL

SEQ ID NO: 2458461 - protein, 4 aa, Entamoeba dispar
RTEM

SEQ ID NO: 2458462 - protein, 4 aa, Entamoeba dispar
RTEN

SEQ ID NO: 2458463 - protein, 7 aa, Entamoeba dispar
RTENLEY

SEQ ID NO: 2458464 - protein, 5 aa, Entamoeba dispar
RTEPN

SEQ ID NO: 2458465 - protein, 7 aa, Entamoeba dispar
RTERNIN

SEQ ID NO: 2458466 - protein, 25 aa, Entamoeba dispar
RTESNPTAFANGHPSTDGAQIGFIN

SEQ ID NO: 2458467 - protein, 6 aa, Entamoeba dispar
RTESQI

SEQ ID NO: 2458468 - protein, 8 aa, Entamoeba dispar
RTEVAESA

SEQ ID NO: 2458469 - protein, 5 aa, Entamoeba dispar
RTFAD

SEQ ID NO: 2458470 - protein, 16 aa, Entamoeba dispar
RTFKSRGGKDVQETFN

SEQ ID NO: 2458471 - protein, 13 aa, Entamoeba dispar
RTGGTAEEEGNVN

SEQ ID NO: 2458472 - protein, 6 aa, Entamoeba dispar
RTGKPI

SEQ ID NO: 2458473 - protein, 5 aa, Entamoeba dispar
RTGKS

SEQ ID NO: 2458474 - protein, 16 aa, Entamoeba dispar
RTGLNPGNNASESLAS

SEQ ID NO: 2458475 - protein, 4 aa, Entamoeba dispar
RTGN

SEQ ID NO: 2458476 - protein, 7 aa, Entamoeba dispar
RTGRIGY

SEQ ID NO: 2458477 - protein, 12 aa, Entamoeba dispar
RTGRMGRSVEGE

SEQ ID NO: 2458478 - protein, 9 aa, Entamoeba dispar
RTGSGKTAA

SEQ ID NO: 2458479 - protein, 6 aa, Entamoeba dispar
RTGTIE

SEQ ID NO: 2458480 - protein, 7 aa, Entamoeba dispar
RTGTNSS

SEQ ID NO: 2458481 - protein, 9 aa, Entamoeba dispar
RTHKEYKGL

SEQ ID NO: 2458482 - protein, 8 aa, Entamoeba dispar
RTHKFREA

SEQ ID NO: 2458483 - protein, 7 aa, Entamoeba dispar
RTHPSAS

SEQ ID NO: 2458484 - protein, 6 aa, Entamoeba dispar
RTHPVG

SEQ ID NO: 2458485 - protein, 5 aa, Entamoeba dispar
RTHSQ

SEQ ID NO: 2458486 - protein, 6 aa, Entamoeba dispar
RTIKGT

SEQ ID NO: 2458487 - protein, 10 aa, Entamoeba dispar
RTINEKQSMN

SEQ ID NO: 2458488 - protein, 6 aa, Entamoeba dispar
RTISSQ

SEQ ID NO: 2458489 - protein, 5 aa, Entamoeba dispar
RTITK

SEQ ID NO: 2458490 - protein, 5 aa, Entamoeba dispar
RTIYE

SEQ ID NO: 2458491 - protein, 6 aa, Entamoeba dispar
RTIYGG

SEQ ID NO: 2458492 - protein, 4 aa, Entamoeba dispar
RTKA

SEQ ID NO: 2458493 - protein, 5 aa, Entamoeba dispar
RTKDE

SEQ ID NO: 2458494 - protein, 12 aa, Entamoeba dispar
RTKDMENPEQTA

SEQ ID NO: 2458495 - protein, 9 aa, Entamoeba dispar
RTKDVRDQL

SEQ ID NO: 2458496 - protein, 10 aa, Entamoeba dispar
RTKEAGSFGE

SEQ ID NO: 2458497 - protein, 7 aa, Entamoeba dispar
RTKEDDH

SEQ ID NO: 2458498 - protein, 9 aa, Entamoeba dispar
RTKENERMN

SEQ ID NO: 2458499 - protein, 6 aa, Entamoeba dispar
RTKGDI

SEQ ID NO: 2458500 - protein, 12 aa, Entamoeba dispar
RTKGMLEGNGDI

SEQ ID NO: 2458501 - protein, 6 aa, Entamoeba dispar
RTKKQC

SEQ ID NO: 2458502 - protein, 9 aa, Entamoeba dispar
RTKKTKNTV

SEQ ID NO: 2458503 - protein, 8 aa, Entamoeba dispar
RTKNERPV

SEQ ID NO: 2458504 - protein, 8 aa, Entamoeba dispar
RTKNSLPN

SEQ ID NO: 2458505 - protein, 6 aa, Entamoeba dispar
RTKQIN

SEQ ID NO: 2458506 - protein, 9 aa, Entamoeba dispar
RTKSEINKN

SEQ ID NO: 2458507 - protein, 12 aa, Entamoeba dispar
RTKSKGYSTELP

SEQ ID NO: 2458508 - protein, 11 aa, Entamoeba dispar
RTKTAKERIER

SEQ ID NO: 2458509 - protein, 18 aa, Entamoeba dispar
RTLADSIPKEEKNLTQTL

SEQ ID NO: 2458510 - protein, 4 aa, Entamoeba dispar
RTLP

SEQ ID NO: 2458511 - protein, 24 aa, Entamoeba dispar
RTLREEEEHSISLSNSASSSDGIP

SEQ ID NO: 2458512 - protein, 6 aa, Entamoeba dispar
RTLSEP

SEQ ID NO: 2458513 - protein, 6 aa, Entamoeba dispar
RTMDQL

SEQ ID NO: 2458514 - protein, 6 aa, Entamoeba dispar
RTMGEE

SEQ ID NO: 2458515 - protein, 9 aa, Entamoeba dispar
RTMSETGMT

SEQ ID NO: 2458516 - protein, 10 aa, Entamoeba dispar
RTNAGTPAYM

SEQ ID NO: 2458517 - protein, 4 aa, Entamoeba dispar
RTND

SEQ ID NO: 2458518 - protein, 5 aa, Entamoeba dispar
RTNDD

SEQ ID NO: 2458519 - protein, 11 aa, Entamoeba dispar
RTNDVKKQEEI

SEQ ID NO: 2458520 - protein, 6 aa, Entamoeba dispar
RTNDVT

SEQ ID NO: 2458521 - protein, 10 aa, Entamoeba dispar
RTNKSKKENY

SEQ ID NO: 2458522 - protein, 6 aa, Entamoeba dispar
RTNNDL

SEQ ID NO: 2458523 - protein, 5 aa, Entamoeba dispar
RTNNE

SEQ ID NO: 2458524 - protein, 6 aa, Entamoeba dispar
RTNNNS

SEQ ID NO: 2458525 - protein, 10 aa, Entamoeba dispar
RTNNREISDT

SEQ ID NO: 2458526 - protein, 27 aa, Entamoeba dispar
RTNNTTEENKEINRITTEEKRRERNNN

SEQ ID NO: 2458527 - protein, 6 aa, Entamoeba dispar
RTNPDL

SEQ ID NO: 2458528 - protein, 7 aa, Entamoeba dispar
RTNPNKW

SEQ ID NO: 2458529 - protein, 7 aa, Entamoeba dispar
RTNPRGN

SEQ ID NO: 2458530 - protein, 4 aa, Entamoeba dispar
RTNS

SEQ ID NO: 2458531 - protein, 8 aa, Entamoeba dispar
RTNTDYKS

SEQ ID NO: 2458532 - protein, 6 aa, Entamoeba dispar
RTNTIE

SEQ ID NO: 2458533 - protein, 7 aa, Entamoeba dispar
RTPEDYA

SEQ ID NO: 2458534 - protein, 8 aa, Entamoeba dispar
RTPEGYNR

SEQ ID NO: 2458535 - protein, 13 aa, Entamoeba dispar
RTPIRDKPSTDPI

SEQ ID NO: 2458536 - protein, 22 aa, Entamoeba dispar
RTPKEKYKITQSFDKKKEEWNT

SEQ ID NO: 2458537 - protein, 9 aa, Entamoeba dispar
RTPNATQEA

SEQ ID NO: 2458538 - protein, 9 aa, Entamoeba dispar
RTPNSRNVD

SEQ ID NO: 2458539 - protein, 7 aa, Entamoeba dispar
RTPNTYV

SEQ ID NO: 2458540 - protein, 6 aa, Entamoeba dispar
RTPNVE

SEQ ID NO: 2458541 - protein, 5 aa, Entamoeba dispar
RTPPG

SEQ ID NO: 2458542 - protein, 10 aa, Entamoeba dispar
RTPPIPSKRI

SEQ ID NO: 2458543 - protein, 7 aa, Entamoeba dispar
RTPQGVS

SEQ ID NO: 2458544 - protein, 5 aa, Entamoeba dispar
RTPRY

SEQ ID NO: 2458545 - protein, 7 aa, Entamoeba dispar
RTPSADL

SEQ ID NO: 2458546 - protein, 44 aa, Entamoeba dispar
RTPVGTAQGLESVTPNEKAYQNESPAPLQTSVSHSSLQQPTNSV

SEQ ID NO: 2458547 - protein, 5 aa, Entamoeba dispar
RTPVV

SEQ ID NO: 2458548 - protein, 6 aa, Entamoeba dispar
RTQAEH

SEQ ID NO: 2458549 - protein, 13 aa, Entamoeba dispar
RTQDETVGDGTTS

SEQ ID NO: 2458550 - protein, 15 aa, Entamoeba dispar
RTQEINADTVEDAKS

SEQ ID NO: 2458551 - protein, 7 aa, Entamoeba dispar
RTQEKVD

SEQ ID NO: 2458552 - protein, 7 aa, Entamoeba dispar
RTQIAPN

SEQ ID NO: 2458553 - protein, 22 aa, Entamoeba dispar
RTQQEESATEGSDNESKTALGD

SEQ ID NO: 2458554 - protein, 5 aa, Entamoeba dispar
RTQQP

SEQ ID NO: 2458555 - protein, 4 aa, Entamoeba dispar
RTQS

SEQ ID NO: 2458556 - protein, 9 aa, Entamoeba dispar
RTQTMNEED

SEQ ID NO: 2458557 - protein, 8 aa, Entamoeba dispar
RTQTRNTT

SEQ ID NO: 2458558 - protein, 10 aa, Entamoeba dispar
RTRERNPRHV

SEQ ID NO: 2458559 - protein, 7 aa, Entamoeba dispar
RTRKQIK

SEQ ID NO: 2458560 - protein, 56 aa, Entamoeba dispar
RTRPTPKPEEPKQEEIASRSTPLKPQSSNSSVQDKPRAGALKATPSTDKPAVPQRN

SEQ ID NO: 2458561 - protein, 7 aa, Entamoeba dispar
RTRPTTN

SEQ ID NO: 2458562 - protein, 5 aa, Entamoeba dispar
RTSDP

SEQ ID NO: 2458563 - protein, 7 aa, Entamoeba dispar
RTSEYQY

SEQ ID NO: 2458564 - protein, 11 aa, Entamoeba dispar
RTSHKRSKLEN

SEQ ID NO: 2458565 - protein, 19 aa, Entamoeba dispar
RTSKIDKSEIKKGCTSETP

SEQ ID NO: 2458566 - protein, 10 aa, Entamoeba dispar
RTSKISSIQQ

SEQ ID NO: 2458567 - protein, 5 aa, Entamoeba dispar
RTSPH

SEQ ID NO: 2458568 - protein, 8 aa, Entamoeba dispar
RTSQESFD

SEQ ID NO: 2458569 - protein, 22 aa, Entamoeba dispar
RTSRRPELGDKFSSRHGQKGVT

SEQ ID NO: 2458570 - protein, 28 aa, Entamoeba dispar
RTSTPAPSFSTVKQNENVRRKGIRKRGK

SEQ ID NO: 2458571 - protein, 15 aa, Entamoeba dispar
RTSTPSESEQSESSE

SEQ ID NO: 2458572 - protein, 9 aa, Entamoeba dispar
RTTAGVDGS

SEQ ID NO: 2458573 - protein, 5 aa, Entamoeba dispar
RTTAP

SEQ ID NO: 2458574 - protein, 7 aa, Entamoeba dispar
RTTDEVK

SEQ ID NO: 2458575 - protein, 5 aa, Entamoeba dispar
RTTEE

SEQ ID NO: 2458576 - protein, 7 aa, Entamoeba dispar
RTTEWDK

SEQ ID NO: 2458577 - protein, 13 aa, Entamoeba dispar
RTTEYEQKRVEEI

SEQ ID NO: 2458578 - protein, 29 aa, Entamoeba dispar
RTTKEDRIKRRKALAKKRISRQKEKAQQS

SEQ ID NO: 2458579 - protein, 9 aa, Entamoeba dispar
RTTKNEIAE

SEQ ID NO: 2458580 - protein, 11 aa, Entamoeba dispar
RTTKPAKMTKK

SEQ ID NO: 2458581 - protein, 6 aa, Entamoeba dispar
RTTKPQ

SEQ ID NO: 2458582 - protein, 5 aa, Entamoeba dispar
RTTNT

SEQ ID NO: 2458583 - protein, 7 aa, Entamoeba dispar
RTTNTNV

SEQ ID NO: 2458584 - protein, 7 aa, Entamoeba dispar
RTTPEKA

SEQ ID NO: 2458585 - protein, 15 aa, Entamoeba dispar
RTTPRKLEGHSQRDY

SEQ ID NO: 2458586 - protein, 7 aa, Entamoeba dispar
RTTQRNS

SEQ ID NO: 2458587 - protein, 4 aa, Entamoeba dispar
RTTR

SEQ ID NO: 2458588 - protein, 7 aa, Entamoeba dispar
RTTRNEV

SEQ ID NO: 2458589 - protein, 10 aa, Entamoeba dispar
RTTRNKKATV

SEQ ID NO: 2458590 - protein, 8 aa, Entamoeba dispar
RTTTGKKG

SEQ ID NO: 2458591 - protein, 8 aa, Entamoeba dispar
RTTTISSQ

SEQ ID NO: 2458592 - protein, 9 aa, Entamoeba dispar
RTVEGTKSF

SEQ ID NO: 2458593 - protein, 10 aa, Entamoeba dispar
RTVEKDGTKY

SEQ ID NO: 2458594 - protein, 8 aa, Entamoeba dispar
RTVNETCQ

SEQ ID NO: 2458595 - protein, 9 aa, Entamoeba dispar
RTVPGNKFG

SEQ ID NO: 2458596 - protein, 9 aa, Entamoeba dispar
RTVRRSSGD

SEQ ID NO: 2458597 - protein, 4 aa, Entamoeba dispar
RTYQ

SEQ ID NO: 2458598 - protein, 10 aa, Entamoeba dispar
RVAAPGKSGI

SEQ ID NO: 2458599 - protein, 5 aa, Entamoeba dispar
RVAPV

SEQ ID NO: 2458600 - protein, 5 aa, Entamoeba dispar
RVAQK

SEQ ID NO: 2458601 - protein, 19 aa, Entamoeba dispar
RVATPPTRSGENDDGTEDL

SEQ ID NO: 2458602 - protein, 24 aa, Entamoeba dispar
RVDEELKKDEERIKKDEERAKDRR

SEQ ID NO: 2458603 - protein, 6 aa, Entamoeba dispar
RVDGKS

SEQ ID NO: 2458604 - protein, 6 aa, Entamoeba dispar
RVDGRT

SEQ ID NO: 2458605 - protein, 10 aa, Entamoeba dispar
RVDKNSGVIR

SEQ ID NO: 2458606 - protein, 8 aa, Entamoeba dispar
RVDSEGLD

SEQ ID NO: 2458607 - protein, 8 aa, Entamoeba dispar
RVDSPDFS

SEQ ID NO: 2458608 - protein, 11 aa, Entamoeba dispar
RVDSPKDEYGN

SEQ ID NO: 2458609 - protein, 11 aa, Entamoeba dispar
RVEDKTFDGKS

SEQ ID NO: 2458610 - protein, 11 aa, Entamoeba dispar
RVEEEYPSGKI

SEQ ID NO: 2458611 - protein, 99 aa, Entamoeba dispar
RVEEIEKQKQAMEEEKKKEEEEKRKEEEEKKKAEEEKEKAIEELKKKKEEEMKRKSGIGKQQNQRYVRPKKTQSEREEENKEEEEKAIELEKKSNSERI

SEQ ID NO: 2458612 - protein, 44 aa, Entamoeba dispar
RVEEIEKQKQAMEEEKKKEEEEKRKEEEEKKKAEEEKERAIEEL

SEQ ID NO: 2458613 - protein, 99 aa, Entamoeba dispar
RVEEIEKQKQTMEEEKRKEEEEKRKEEEEKKKAEEEKEKAIEELKKKKEEEMKRKSGIGKQQNQRYVRPKKTQSEKEEESKEEEEKAIELEKKSNSERI

SEQ ID NO: 2458614 - protein, 6 aa, Entamoeba dispar
RVEEKE

SEQ ID NO: 2458615 - protein, 13 aa, Entamoeba dispar
RVEGWDDETEEIR

SEQ ID NO: 2458616 - protein, 13 aa, Entamoeba dispar
RVENTKKAKKLRY

SEQ ID NO: 2458617 - protein, 14 aa, Entamoeba dispar
RVEPNKVKIGDSES

SEQ ID NO: 2458618 - protein, 5 aa, Entamoeba dispar
RVGED

SEQ ID NO: 2458619 - protein, 5 aa, Entamoeba dispar
RVGGT

SEQ ID NO: 2458620 - protein, 6 aa, Entamoeba dispar
RVGSVT

SEQ ID NO: 2458621 - protein, 8 aa, Entamoeba dispar
RVHGDIKP

SEQ ID NO: 2458622 - protein, 7 aa, Entamoeba dispar
RVHGKPT

SEQ ID NO: 2458623 - protein, 15 aa, Entamoeba dispar
RVKELTDSQTVSSYL

SEQ ID NO: 2458624 - protein, 15 aa, Entamoeba dispar
RVKEMKKKKNRKGLD

SEQ ID NO: 2458625 - protein, 9 aa, Entamoeba dispar
RVKKDEDIQ

SEQ ID NO: 2458626 - protein, 11 aa, Entamoeba dispar
RVKKSKLATEF

SEQ ID NO: 2458627 - protein, 8 aa, Entamoeba dispar
RVKQTLSP

SEQ ID NO: 2458628 - protein, 9 aa, Entamoeba dispar
RVNASKRNN

SEQ ID NO: 2458629 - protein, 8 aa, Entamoeba dispar
RVNETETV

SEQ ID NO: 2458630 - protein, 7 aa, Entamoeba dispar
RVNFGDK

SEQ ID NO: 2458631 - protein, 11 aa, Entamoeba dispar
RVNGDGKGYIS

SEQ ID NO: 2458632 - protein, 9 aa, Entamoeba dispar
RVNKTDSHQ

SEQ ID NO: 2458633 - protein, 20 aa, Entamoeba dispar
RVNNTQTRPLSQQQNQPIQT

SEQ ID NO: 2458634 - protein, 34 aa, Entamoeba dispar
RVNPEETKTSAKDDLTIAKTKNEIKHERRKTCSA

SEQ ID NO: 2458635 - protein, 13 aa, Entamoeba dispar
RVNQQSLTKTYPH

SEQ ID NO: 2458636 - protein, 7 aa, Entamoeba dispar
RVNSNGQ

SEQ ID NO: 2458637 - protein, 7 aa, Entamoeba dispar
RVPDSKN

SEQ ID NO: 2458638 - protein, 43 aa, Entamoeba dispar
RVPGKGGSKSKSNSQPSQKATYNQQPTQSFNAPPPPPPSYGGH

SEQ ID NO: 2458639 - protein, 6 aa, Entamoeba dispar
RVPNSL

SEQ ID NO: 2458640 - protein, 7 aa, Entamoeba dispar
RVQEEVN

SEQ ID NO: 2458641 - protein, 8 aa, Entamoeba dispar
RVQESLRD

SEQ ID NO: 2458642 - protein, 20 aa, Entamoeba dispar
RVQQTQLPTQPQEGPSVEEE

SEQ ID NO: 2458643 - protein, 18 aa, Entamoeba dispar
RVRQRREAKISSRREEAI

SEQ ID NO: 2458644 - protein, 12 aa, Entamoeba dispar
RVRQRREASENR

SEQ ID NO: 2458645 - protein, 18 aa, Entamoeba dispar
RVSDSGSDQEQSSEEEQT

SEQ ID NO: 2458646 - protein, 7 aa, Entamoeba dispar
RVSDSKE

SEQ ID NO: 2458647 - protein, 13 aa, Entamoeba dispar
RVSEEVGSKLGEE

SEQ ID NO: 2458648 - protein, 13 aa, Entamoeba dispar
RVSQGKRSKNKEL

SEQ ID NO: 2458649 - protein, 23 aa, Entamoeba dispar
RVSRHSYSAYSNNQSSKEDSYLT

SEQ ID NO: 2458650 - protein, 8 aa, Entamoeba dispar
RVSTDDGV

SEQ ID NO: 2458651 - protein, 14 aa, Entamoeba dispar
RVSTDDGVNYTPYN

SEQ ID NO: 2458652 - protein, 8 aa, Entamoeba dispar
RVTDEDLD

SEQ ID NO: 2458653 - protein, 55 aa, Entamoeba dispar
RVTEENKKLQAQREKEAKKAEAAAAKKAGKKKASLAPIPGEEGNMVKGRKQNPLA

SEQ ID NO: 2458654 - protein, 8 aa, Entamoeba dispar
RVTGTTSV

SEQ ID NO: 2458655 - protein, 7 aa, Entamoeba dispar
RVTSREK

SEQ ID NO: 2458656 - protein, 9 aa, Entamoeba dispar
RVTTGKPTI

SEQ ID NO: 2458657 - protein, 9 aa, Entamoeba dispar
RVYEPAPPR

SEQ ID NO: 2458658 - protein, 7 aa, Entamoeba dispar
RWEEEER

SEQ ID NO: 2458659 - protein, 8 aa, Entamoeba dispar
RWKEQSTK

SEQ ID NO: 2458660 - protein, 20 aa, Entamoeba dispar
RWNGKQPEEMDEQTKNRYKR

SEQ ID NO: 2458661 - protein, 7 aa, Entamoeba dispar
RWPSGAK

SEQ ID NO: 2458662 - protein, 8 aa, Entamoeba dispar
RYADGEIK

SEQ ID NO: 2458663 - protein, 13 aa, Entamoeba dispar
RYDEDEEIKDSDL

SEQ ID NO: 2458664 - protein, 4 aa, Entamoeba dispar
RYDG

SEQ ID NO: 2458665 - protein, 11 aa, Entamoeba dispar
RYDGEERVEEL

SEQ ID NO: 2458666 - protein, 4 aa, Entamoeba dispar
RYDP

SEQ ID NO: 2458667 - protein, 5 aa, Entamoeba dispar
RYDRI

SEQ ID NO: 2458668 - protein, 4 aa, Entamoeba dispar
RYEA

SEQ ID NO: 2458669 - protein, 17 aa, Entamoeba dispar
RYEEEIERQKQKKAYGK

SEQ ID NO: 2458670 - protein, 13 aa, Entamoeba dispar
RYEGERSAAPNIK

SEQ ID NO: 2458671 - protein, 5 aa, Entamoeba dispar
RYEIK

SEQ ID NO: 2458672 - protein, 19 aa, Entamoeba dispar
RYEKTSEKILDSSNTSSKT

SEQ ID NO: 2458673 - protein, 9 aa, Entamoeba dispar
RYENGESVN

SEQ ID NO: 2458674 - protein, 16 aa, Entamoeba dispar
RYENNGPFEFEKDDDD

SEQ ID NO: 2458675 - protein, 5 aa, Entamoeba dispar
RYEPD

SEQ ID NO: 2458676 - protein, 6 aa, Entamoeba dispar
RYEQEP

SEQ ID NO: 2458677 - protein, 14 aa, Entamoeba dispar
RYESNKKYIEPSLS

SEQ ID NO: 2458678 - protein, 8 aa, Entamoeba dispar
RYESSQNA

SEQ ID NO: 2458679 - protein, 11 aa, Entamoeba dispar
RYFSNEEKYNE

SEQ ID NO: 2458680 - protein, 6 aa, Entamoeba dispar
RYGDVN

SEQ ID NO: 2458681 - protein, 8 aa, Entamoeba dispar
RYGEGEAT

SEQ ID NO: 2458682 - protein, 12 aa, Entamoeba dispar
RYGLGSKEFTPA

SEQ ID NO: 2458683 - protein, 10 aa, Entamoeba dispar
RYGPDKGNVP

SEQ ID NO: 2458684 - protein, 9 aa, Entamoeba dispar
RYGPPPSYR

SEQ ID NO: 2458685 - protein, 10 aa, Entamoeba dispar
RYHPTKTANV

SEQ ID NO: 2458686 - protein, 10 aa, Entamoeba dispar
RYHSKTNQYE

SEQ ID NO: 2458687 - protein, 12 aa, Entamoeba dispar
RYKDEEQPNWEN

SEQ ID NO: 2458688 - protein, 6 aa, Entamoeba dispar
RYKEDD

SEQ ID NO: 2458689 - protein, 7 aa, Entamoeba dispar
RYKGKTI

SEQ ID NO: 2458690 - protein, 9 aa, Entamoeba dispar
RYKTANPSM

SEQ ID NO: 2458691 - protein, 13 aa, Entamoeba dispar
RYNEGKEGMASAE

SEQ ID NO: 2458692 - protein, 14 aa, Entamoeba dispar
RYNEGKEGMASAEA

SEQ ID NO: 2458693 - protein, 13 aa, Entamoeba dispar
RYNEGKKGIANAE

SEQ ID NO: 2458694 - protein, 13 aa, Entamoeba dispar
RYNEGKKGMANAE

SEQ ID NO: 2458695 - protein, 13 aa, Entamoeba dispar
RYNEGKKGVASAE

SEQ ID NO: 2458696 - protein, 9 aa, Entamoeba dispar
RYNKEGNNI

SEQ ID NO: 2458697 - protein, 13 aa, Entamoeba dispar
RYNQGKKGMASAE

SEQ ID NO: 2458698 - protein, 4 aa, Entamoeba dispar
RYNS

SEQ ID NO: 2458699 - protein, 16 aa, Entamoeba dispar
RYNTENQMKEHELSKK

SEQ ID NO: 2458700 - protein, 9 aa, Entamoeba dispar
RYNTSSNNH

SEQ ID NO: 2458701 - protein, 4 aa, Entamoeba dispar
RYQQ

SEQ ID NO: 2458702 - protein, 5 aa, Entamoeba dispar
RYRGE

SEQ ID NO: 2458703 - protein, 13 aa, Entamoeba dispar
RYRGEDTKEITSR

SEQ ID NO: 2458704 - protein, 9 aa, Entamoeba dispar
RYSGPTAGY

SEQ ID NO: 2458705 - protein, 5 aa, Entamoeba dispar
RYSKA

SEQ ID NO: 2458706 - protein, 11 aa, Entamoeba dispar
RYSKTGKKTND

SEQ ID NO: 2458707 - protein, 6 aa, Entamoeba dispar
RYSPER

SEQ ID NO: 2458708 - protein, 8 aa, Entamoeba dispar
RYSPKEQE

SEQ ID NO: 2458709 - protein, 8 aa, Entamoeba dispar
RYSQNAPL

SEQ ID NO: 2458710 - protein, 6 aa, Entamoeba dispar
RYSRNK

SEQ ID NO: 2458711 - protein, 4 aa, Entamoeba dispar
RYST

SEQ ID NO: 2458712 - protein, 8 aa, Entamoeba dispar
RYSTNPVK

SEQ ID NO: 2458713 - protein, 16 aa, Entamoeba dispar
RYSTSKISEIEQESLN

SEQ ID NO: 2458714 - protein, 11 aa, Entamoeba dispar
RYSTTKLNQTS

SEQ ID NO: 2458715 - protein, 9 aa, Entamoeba dispar
RYTDLSADQ

SEQ ID NO: 2458716 - protein, 11 aa, Entamoeba dispar
RYTKEKETGSI

SEQ ID NO: 2458717 - protein, 9 aa, Entamoeba dispar
RYTNNKIAE

SEQ ID NO: 2458718 - protein, 8 aa, Entamoeba dispar
RYTSPPLS

SEQ ID NO: 2458719 - protein, 8 aa, Entamoeba dispar
RYTTQSDV

SEQ ID NO: 2458720 - protein, 6 aa, Entamoeba dispar
RYVTGD

SEQ ID NO: 2458721 - protein, 7 aa, Entamoeba dispar
SAAAGAN

SEQ ID NO: 2458722 - protein, 7 aa, Entamoeba dispar
SAADAST

SEQ ID NO: 2458723 - protein, 10 aa, Entamoeba dispar
SAADKTTMDD

SEQ ID NO: 2458724 - protein, 7 aa, Entamoeba dispar
SAADSST

SEQ ID NO: 2458725 - protein, 10 aa, Entamoeba dispar
SAAKGEGQQL

SEQ ID NO: 2458726 - protein, 9 aa, Entamoeba dispar
SAAKGENIQ

SEQ ID NO: 2458727 - protein, 36 aa, Entamoeba dispar
SAAPTERSENGYRQTQMSDDDDDDDNDQQGNVQCHQ

SEQ ID NO: 2458728 - protein, 8 aa, Entamoeba dispar
SAAPTLKS

SEQ ID NO: 2458729 - protein, 14 aa, Entamoeba dispar
SAARSKDFEVTDAK

SEQ ID NO: 2458730 - protein, 8 aa, Entamoeba dispar
SAASNSNV

SEQ ID NO: 2458731 - protein, 6 aa, Entamoeba dispar
SAATEN

SEQ ID NO: 2458732 - protein, 35 aa, Entamoeba dispar
SACEEEVSEDDGYGETQEELSKSTKIEESDDEIGN

SEQ ID NO: 2458733 - protein, 8 aa, Entamoeba dispar
SACIDSSD

SEQ ID NO: 2458734 - protein, 4 aa, Entamoeba dispar
SACN

SEQ ID NO: 2458735 - protein, 4 aa, Entamoeba dispar
SADE

SEQ ID NO: 2458736 - protein, 7 aa, Entamoeba dispar
SADEDKM

SEQ ID NO: 2458737 - protein, 7 aa, Entamoeba dispar
SADEPMT

SEQ ID NO: 2458738 - protein, 12 aa, Entamoeba dispar
SADESTEKKGKL

SEQ ID NO: 2458739 - protein, 14 aa, Entamoeba dispar
SADFATSHKYDKEL

SEQ ID NO: 2458740 - protein, 8 aa, Entamoeba dispar
SADFDRNR

SEQ ID NO: 2458741 - protein, 14 aa, Entamoeba dispar
SADGTTLGSDDGAG

SEQ ID NO: 2458742 - protein, 4 aa, Entamoeba dispar
SADH

SEQ ID NO: 2458743 - protein, 10 aa, Entamoeba dispar
SADNDTKKSI

SEQ ID NO: 2458744 - protein, 8 aa, Entamoeba dispar
SADNKQSR

SEQ ID NO: 2458745 - protein, 6 aa, Entamoeba dispar
SADNKY

SEQ ID NO: 2458746 - protein, 16 aa, Entamoeba dispar
SADNSDFSTITPASAQ

SEQ ID NO: 2458747 - protein, 7 aa, Entamoeba dispar
SADPNAQ

SEQ ID NO: 2458748 - protein, 10 aa, Entamoeba dispar
SADPQKKMDS

SEQ ID NO: 2458749 - protein, 13 aa, Entamoeba dispar
SADRNIKGKITKD

SEQ ID NO: 2458750 - protein, 5 aa, Entamoeba dispar
SADRT

SEQ ID NO: 2458751 - protein, 9 aa, Entamoeba dispar
SADSGLPKP

SEQ ID NO: 2458752 - protein, 23 aa, Entamoeba dispar
SADTKQNCLTTEEGESSSVPQTR

SEQ ID NO: 2458753 - protein, 18 aa, Entamoeba dispar
SADTNVSIDPKNPPKERQ

SEQ ID NO: 2458754 - protein, 9 aa, Entamoeba dispar
SADVNNARL

SEQ ID NO: 2458755 - protein, 7 aa, Entamoeba dispar
SADYNAK

SEQ ID NO: 2458756 - protein, 9 aa, Entamoeba dispar
SAEARERER

SEQ ID NO: 2458757 - protein, 5 aa, Entamoeba dispar
SAEDQ

SEQ ID NO: 2458758 - protein, 8 aa, Entamoeba dispar
SAEEMQNI

SEQ ID NO: 2458759 - protein, 12 aa, Entamoeba dispar
SAEETGNSSKPL

SEQ ID NO: 2458760 - protein, 9 aa, Entamoeba dispar
SAEGNKEQL

SEQ ID NO: 2458761 - protein, 5 aa, Entamoeba dispar
SAELA

SEQ ID NO: 2458762 - protein, 8 aa, Entamoeba dispar
SAEMETTK

SEQ ID NO: 2458763 - protein, 4 aa, Entamoeba dispar
SAEN

SEQ ID NO: 2458764 - protein, 9 aa, Entamoeba dispar
SAEQDKTDF

SEQ ID NO: 2458765 - protein, 8 aa, Entamoeba dispar
SAEQRSDV

SEQ ID NO: 2458766 - protein, 6 aa, Entamoeba dispar
SAEREM

SEQ ID NO: 2458767 - protein, 19 aa, Entamoeba dispar
SAERKKEIQEKRQASQLKR

SEQ ID NO: 2458768 - protein, 13 aa, Entamoeba dispar
SAERKKPATIVSR

SEQ ID NO: 2458769 - protein, 15 aa, Entamoeba dispar
SAESDIEKGKANNLI

SEQ ID NO: 2458770 - protein, 10 aa, Entamoeba dispar
SAESKRDEII

SEQ ID NO: 2458771 - protein, 7 aa, Entamoeba dispar
SAESSRH

SEQ ID NO: 2458772 - protein, 9 aa, Entamoeba dispar
SAETLKQEA

SEQ ID NO: 2458773 - protein, 6 aa, Entamoeba dispar
SAETQG

SEQ ID NO: 2458774 - protein, 8 aa, Entamoeba dispar
SAFEKDYS

SEQ ID NO: 2458775 - protein, 5 aa, Entamoeba dispar
SAFSQ

SEQ ID NO: 2458776 - protein, 9 aa, Entamoeba dispar
SAFVSDTNS

SEQ ID NO: 2458777 - protein, 5 aa, Entamoeba dispar
SAGAY

SEQ ID NO: 2458778 - protein, 6 aa, Entamoeba dispar
SAGETP

SEQ ID NO: 2458779 - protein, 11 aa, Entamoeba dispar
SAGGMKLGQKP

SEQ ID NO: 2458780 - protein, 6 aa, Entamoeba dispar
SAGGVD

SEQ ID NO: 2458781 - protein, 5 aa, Entamoeba dispar
SAGKG

SEQ ID NO: 2458782 - protein, 7 aa, Entamoeba dispar
SAGLESS

SEQ ID NO: 2458783 - protein, 4 aa, Entamoeba dispar
SAGN

SEQ ID NO: 2458784 - protein, 5 aa, Entamoeba dispar
SAGND

SEQ ID NO: 2458785 - protein, 7 aa, Entamoeba dispar
SAGQQKM

SEQ ID NO: 2458786 - protein, 7 aa, Entamoeba dispar
SAGRHRE

SEQ ID NO: 2458787 - protein, 8 aa, Entamoeba dispar
SAGRVESN

SEQ ID NO: 2458788 - protein, 11 aa, Entamoeba dispar
SAGSNSTIRTN

SEQ ID NO: 2458789 - protein, 5 aa, Entamoeba dispar
SAGVD

SEQ ID NO: 2458790 - protein, 4 aa, Entamoeba dispar
SAHE

SEQ ID NO: 2458791 - protein, 6 aa, Entamoeba dispar
SAHKRI

SEQ ID NO: 2458792 - protein, 9 aa, Entamoeba dispar
SAHPNRNSI

SEQ ID NO: 2458793 - protein, 12 aa, Entamoeba dispar
SAHPSGRTLGGT

SEQ ID NO: 2458794 - protein, 6 aa, Entamoeba dispar
SAHQQT

SEQ ID NO: 2458795 - protein, 4 aa, Entamoeba dispar
SAHR

SEQ ID NO: 2458796 - protein, 5 aa, Entamoeba dispar
SAIDS

SEQ ID NO: 2458797 - protein, 5 aa, Entamoeba dispar
SAIGE

SEQ ID NO: 2458798 - protein, 13 aa, Entamoeba dispar
SAIGIPEDQIREA

SEQ ID NO: 2458799 - protein, 5 aa, Entamoeba dispar
SAINP

SEQ ID NO: 2458800 - protein, 4 aa, Entamoeba dispar
SAIP

SEQ ID NO: 2458801 - protein, 6 aa, Entamoeba dispar
SAIPGV

SEQ ID NO: 2458802 - protein, 8 aa, Entamoeba dispar
SAIPTSTY

SEQ ID NO: 2458803 - protein, 15 aa, Entamoeba dispar
SAIQKESDKKFSKNI

SEQ ID NO: 2458804 - protein, 6 aa, Entamoeba dispar
SAISPD

SEQ ID NO: 2458805 - protein, 6 aa, Entamoeba dispar
SAITNQ

SEQ ID NO: 2458806 - protein, 13 aa, Entamoeba dispar
SAITQPQGATASQ

SEQ ID NO: 2458807 - protein, 8 aa, Entamoeba dispar
SAKARKGL

SEQ ID NO: 2458808 - protein, 9 aa, Entamoeba dispar
SAKDGSGID

SEQ ID NO: 2458809 - protein, 41 aa, Entamoeba dispar
SAKDQLPKEDSNEEQKFDEMEEEKNEDDQNSVSISSATAVT

SEQ ID NO: 2458810 - protein, 4 aa, Entamoeba dispar
SAKE

SEQ ID NO: 2458811 - protein, 8 aa, Entamoeba dispar
SAKEGCGK

SEQ ID NO: 2458812 - protein, 9 aa, Entamoeba dispar
SAKEGTGVN

SEQ ID NO: 2458813 - protein, 9 aa, Entamoeba dispar
SAKERKERA

SEQ ID NO: 2458814 - protein, 8 aa, Entamoeba dispar
SAKFPGGL

SEQ ID NO: 2458815 - protein, 7 aa, Entamoeba dispar
SAKHNKN

SEQ ID NO: 2458816 - protein, 9 aa, Entamoeba dispar
SAKKGVVSG

SEQ ID NO: 2458817 - protein, 8 aa, Entamoeba dispar
SAKKSLNV

SEQ ID NO: 2458818 - protein, 10 aa, Entamoeba dispar
SAKNPVNNKV

SEQ ID NO: 2458819 - protein, 7 aa, Entamoeba dispar
SAKNSLK

SEQ ID NO: 2458820 - protein, 13 aa, Entamoeba dispar
SAKPQTDTKQNSF

SEQ ID NO: 2458821 - protein, 12 aa, Entamoeba dispar
SAKQIKKKTEGW

SEQ ID NO: 2458822 - protein, 12 aa, Entamoeba dispar
SAKQLDPKGSSI

SEQ ID NO: 2458823 - protein, 7 aa, Entamoeba dispar
SAKRNIK

SEQ ID NO: 2458824 - protein, 6 aa, Entamoeba dispar
SAKRSK

SEQ ID NO: 2458825 - protein, 11 aa, Entamoeba dispar
SAKTAAEEREI

SEQ ID NO: 2458826 - protein, 9 aa, Entamoeba dispar
SAKTGDGLE

SEQ ID NO: 2458827 - protein, 9 aa, Entamoeba dispar
SAKTGENVE

SEQ ID NO: 2458828 - protein, 9 aa, Entamoeba dispar
SAKTGTGVK

SEQ ID NO: 2458829 - protein, 13 aa, Entamoeba dispar
SAKTLQDNQKLRG

SEQ ID NO: 2458830 - protein, 7 aa, Entamoeba dispar
SAKTNKN

SEQ ID NO: 2458831 - protein, 8 aa, Entamoeba dispar
SAKTNTNV

SEQ ID NO: 2458832 - protein, 8 aa, Entamoeba dispar
SAKTQKNI

SEQ ID NO: 2458833 - protein, 9 aa, Entamoeba dispar
SAKTSENLK

SEQ ID NO: 2458834 - protein, 9 aa, Entamoeba dispar
SAKTYTETA

SEQ ID NO: 2458835 - protein, 16 aa, Entamoeba dispar
SAKYSDFKAPQGYEKW

SEQ ID NO: 2458836 - protein, 10 aa, Entamoeba dispar
SAKYSTDDWC

SEQ ID NO: 2458837 - protein, 7 aa, Entamoeba dispar
SALGDDS

SEQ ID NO: 2458838 - protein, 17 aa, Entamoeba dispar
SALGNASIDEEIKKELD

SEQ ID NO: 2458839 - protein, 9 aa, Entamoeba dispar
SALKDRGIN

SEQ ID NO: 2458840 - protein, 6 aa, Entamoeba dispar
SALPDT

SEQ ID NO: 2458841 - protein, 15 aa, Entamoeba dispar
SALPNTSLKSDGGWG

SEQ ID NO: 2458842 - protein, 10 aa, Entamoeba dispar
SALPPQRSID

SEQ ID NO: 2458843 - protein, 11 aa, Entamoeba dispar
SALQDSSHAAD

SEQ ID NO: 2458844 - protein, 5 aa, Entamoeba dispar
SALQQ

SEQ ID NO: 2458845 - protein, 49 aa, Entamoeba dispar
SALSFSDKKENDKEKKDSNTRQTVSGKPNDGTPREGDKKPRFSLFKKTK

SEQ ID NO: 2458846 - protein, 6 aa, Entamoeba dispar
SALSSA

SEQ ID NO: 2458847 - protein, 4 aa, Entamoeba dispar
SALT

SEQ ID NO: 2458848 - protein, 7 aa, Entamoeba dispar
SALTGDN

SEQ ID NO: 2458849 - protein, 9 aa, Entamoeba dispar
SALTSTSAE

SEQ ID NO: 2458850 - protein, 4 aa, Entamoeba dispar
SAME

SEQ ID NO: 2458851 - protein, 8 aa, Entamoeba dispar
SAMSNPAQ

SEQ ID NO: 2458852 - protein, 6 aa, Entamoeba dispar
SAMSRR

SEQ ID NO: 2458853 - protein, 8 aa, Entamoeba dispar
SANDEEEH

SEQ ID NO: 2458854 - protein, 8 aa, Entamoeba dispar
SANGSEAD

SEQ ID NO: 2458855 - protein, 4 aa, Entamoeba dispar
SANL

SEQ ID NO: 2458856 - protein, 10 aa, Entamoeba dispar
SANLKDNKTA

SEQ ID NO: 2458857 - protein, 15 aa, Entamoeba dispar
SANMNAKNKIGETPL

SEQ ID NO: 2458858 - protein, 15 aa, Entamoeba dispar
SANPNYVQDSTTTKI

SEQ ID NO: 2458859 - protein, 7 aa, Entamoeba dispar
SANQTTK

SEQ ID NO: 2458860 - protein, 4 aa, Entamoeba dispar
SANR

SEQ ID NO: 2458861 - protein, 10 aa, Entamoeba dispar
SANRERLKAS

SEQ ID NO: 2458862 - protein, 5 aa, Entamoeba dispar
SANTR

SEQ ID NO: 2458863 - protein, 17 aa, Entamoeba dispar
SAPDSFSSVNSKKEENP

SEQ ID NO: 2458864 - protein, 13 aa, Entamoeba dispar
SAPDYSNSPSQSK

SEQ ID NO: 2458865 - protein, 5 aa, Entamoeba dispar
SAPED

SEQ ID NO: 2458866 - protein, 10 aa, Entamoeba dispar
SAPEEEQAKK

SEQ ID NO: 2458867 - protein, 4 aa, Entamoeba dispar
SAPF

SEQ ID NO: 2458868 - protein, 6 aa, Entamoeba dispar
SAPGTI

SEQ ID NO: 2458869 - protein, 4 aa, Entamoeba dispar
SAPI

SEQ ID NO: 2458870 - protein, 34 aa, Entamoeba dispar
SAPKINEEEFKKEEKQEEKEIKRNENKKEEINEN

SEQ ID NO: 2458871 - protein, 6 aa, Entamoeba dispar
SAPKLQ

SEQ ID NO: 2458872 - protein, 7 aa, Entamoeba dispar
SAPLTPE

SEQ ID NO: 2458873 - protein, 6 aa, Entamoeba dispar
SAPLTQ

SEQ ID NO: 2458874 - protein, 12 aa, Entamoeba dispar
SAPNQPNQQQNS

SEQ ID NO: 2458875 - protein, 12 aa, Entamoeba dispar
SAPPKKRTDEAF

SEQ ID NO: 2458876 - protein, 6 aa, Entamoeba dispar
SAPPVP

SEQ ID NO: 2458877 - protein, 6 aa, Entamoeba dispar
SAPSCD

SEQ ID NO: 2458878 - protein, 7 aa, Entamoeba dispar
SAPSEEI

SEQ ID NO: 2458879 - protein, 9 aa, Entamoeba dispar
SAPSGHDMS

SEQ ID NO: 2458880 - protein, 6 aa, Entamoeba dispar
SAPTHE

SEQ ID NO: 2458881 - protein, 7 aa, Entamoeba dispar
SAPTISV

SEQ ID NO: 2458882 - protein, 9 aa, Entamoeba dispar
SAPTKPVVT

SEQ ID NO: 2458883 - protein, 9 aa, Entamoeba dispar
SAPTSRPVT

SEQ ID NO: 2458884 - protein, 10 aa, Entamoeba dispar
SAPTSSGKTL

SEQ ID NO: 2458885 - protein, 4 aa, Entamoeba dispar
SAPY

SEQ ID NO: 2458886 - protein, 5 aa, Entamoeba dispar
SAQAA

SEQ ID NO: 2458887 - protein, 8 aa, Entamoeba dispar
SAQENTLP

SEQ ID NO: 2458888 - protein, 16 aa, Entamoeba dispar
SAQGTTLGGDDGTGVA

SEQ ID NO: 2458889 - protein, 12 aa, Entamoeba dispar
SAQKYTETARDE

SEQ ID NO: 2458890 - protein, 7 aa, Entamoeba dispar
SAQNNIN

SEQ ID NO: 2458891 - protein, 9 aa, Entamoeba dispar
SAQPSTEEK

SEQ ID NO: 2458892 - protein, 44 aa, Entamoeba dispar
SAQQEQIPIQPQQPITQQYPKDVYSDYNGGSYISGPYGGDQSVG

SEQ ID NO: 2458893 - protein, 6 aa, Entamoeba dispar
SAQQQL

SEQ ID NO: 2458894 - protein, 11 aa, Entamoeba dispar
SAQTSQNGVEQ

SEQ ID NO: 2458895 - protein, 13 aa, Entamoeba dispar
SAQVQEKKQSDWR

SEQ ID NO: 2458896 - protein, 10 aa, Entamoeba dispar
SARDESRKLE

SEQ ID NO: 2458897 - protein, 6 aa, Entamoeba dispar
SARGID

SEQ ID NO: 2458898 - protein, 9 aa, Entamoeba dispar
SARISDGYQ

SEQ ID NO: 2458899 - protein, 13 aa, Entamoeba dispar
SARKEEDLDESTI

SEQ ID NO: 2458900 - protein, 10 aa, Entamoeba dispar
SARLEPQPIE

SEQ ID NO: 2458901 - protein, 4 aa, Entamoeba dispar
SARP

SEQ ID NO: 2458902 - protein, 8 aa, Entamoeba dispar
SARQGISI

SEQ ID NO: 2458903 - protein, 22 aa, Entamoeba dispar
SARQVQQGKETNQYKTSAKRIK

SEQ ID NO: 2458904 - protein, 14 aa, Entamoeba dispar
SARSESEHESSRRL

SEQ ID NO: 2458905 - protein, 8 aa, Entamoeba dispar
SARSGKNI

SEQ ID NO: 2458906 - protein, 19 aa, Entamoeba dispar
SARTGSDNLSGMSQPEEEA

SEQ ID NO: 2458907 - protein, 7 aa, Entamoeba dispar
SASCSEE

SEQ ID NO: 2458908 - protein, 7 aa, Entamoeba dispar
SASDGID

SEQ ID NO: 2458909 - protein, 10 aa, Entamoeba dispar
SASDKKKEID

SEQ ID NO: 2458910 - protein, 8 aa, Entamoeba dispar
SASDLDYS

SEQ ID NO: 2458911 - protein, 12 aa, Entamoeba dispar
SASDNKKEPIRE

SEQ ID NO: 2458912 - protein, 7 aa, Entamoeba dispar
SASEDST

SEQ ID NO: 2458913 - protein, 18 aa, Entamoeba dispar
SASEGYCKSESVHANQTK

SEQ ID NO: 2458914 - protein, 12 aa, Entamoeba dispar
SASEITSDASYI

SEQ ID NO: 2458915 - protein, 17 aa, Entamoeba dispar
SASETQRVGRAGRLSSG

SEQ ID NO: 2458916 - protein, 9 aa, Entamoeba dispar
SASGDQHLG

SEQ ID NO: 2458917 - protein, 18 aa, Entamoeba dispar
SASGRTGDSDPMKQQPTS

SEQ ID NO: 2458918 - protein, 10 aa, Entamoeba dispar
SASLNDGAIK

SEQ ID NO: 2458919 - protein, 22 aa, Entamoeba dispar
SASPNNPSTTSPIKQSPTPNKI

SEQ ID NO: 2458920 - protein, 12 aa, Entamoeba dispar
SASPQDQEDNFG

SEQ ID NO: 2458921 - protein, 5 aa, Entamoeba dispar
SASQI

SEQ ID NO: 2458922 - protein, 7 aa, Entamoeba dispar
SASQRAP

SEQ ID NO: 2458923 - protein, 6 aa, Entamoeba dispar
SASRRY

SEQ ID NO: 2458924 - protein, 6 aa, Entamoeba dispar
SASSHI

SEQ ID NO: 2458925 - protein, 5 aa, Entamoeba dispar
SASSL

SEQ ID NO: 2458926 - protein, 10 aa, Entamoeba dispar
SASSSKERDE

SEQ ID NO: 2458927 - protein, 7 aa, Entamoeba dispar
SASVTEN

SEQ ID NO: 2458928 - protein, 4 aa, Entamoeba dispar
SATA

SEQ ID NO: 2458929 - protein, 7 aa, Entamoeba dispar
SATDASG

SEQ ID NO: 2458930 - protein, 7 aa, Entamoeba dispar
SATDAST

SEQ ID NO: 2458931 - protein, 7 aa, Entamoeba dispar
SATDPIE

SEQ ID NO: 2458932 - protein, 8 aa, Entamoeba dispar
SATDPRAN

SEQ ID NO: 2458933 - protein, 6 aa, Entamoeba dispar
SATEQC

SEQ ID NO: 2458934 - protein, 12 aa, Entamoeba dispar
SATLSNDRSSRS

SEQ ID NO: 2458935 - protein, 7 aa, Entamoeba dispar
SATPEQL

SEQ ID NO: 2458936 - protein, 5 aa, Entamoeba dispar
SATTF

SEQ ID NO: 2458937 - protein, 5 aa, Entamoeba dispar
SATVL

SEQ ID NO: 2458938 - protein, 5 aa, Entamoeba dispar
SATVR

SEQ ID NO: 2458939 - protein, 6 aa, Entamoeba dispar
SAVAGM

SEQ ID NO: 2458940 - protein, 42 aa, Entamoeba dispar
SAVKEEKNKIEEEKNKITNENKEIKEENIKSIEEKTQEINSL

SEQ ID NO: 2458941 - protein, 8 aa, Entamoeba dispar
SAVKSPEF

SEQ ID NO: 2458942 - protein, 6 aa, Entamoeba dispar
SAVKVN

SEQ ID NO: 2458943 - protein, 16 aa, Entamoeba dispar
SAVNITEPEDVNRYPA

SEQ ID NO: 2458944 - protein, 14 aa, Entamoeba dispar
SAVNNTNSSEQALR

SEQ ID NO: 2458945 - protein, 40 aa, Entamoeba dispar
SAVPAPKPAPVTQPENHPTEPVPQVTTQPITTNQPSTQPV

SEQ ID NO: 2458946 - protein, 6 aa, Entamoeba dispar
SAVPQH

SEQ ID NO: 2458947 - protein, 10 aa, Entamoeba dispar
SAVQTRDIEE

SEQ ID NO: 2458948 - protein, 15 aa, Entamoeba dispar
SAVRQKEKHKKRRDD

SEQ ID NO: 2458949 - protein, 20 aa, Entamoeba dispar
SAVSKLKESNAAIKRSGWGR

SEQ ID NO: 2458950 - protein, 7 aa, Entamoeba dispar
SAVSSKT

SEQ ID NO: 2458951 - protein, 6 aa, Entamoeba dispar
SAYEKD

SEQ ID NO: 2458952 - protein, 11 aa, Entamoeba dispar
SAYENKEEFSS

SEQ ID NO: 2458953 - protein, 18 aa, Entamoeba dispar
SAYSKEGNSCAFNKNSTY

SEQ ID NO: 2458954 - protein, 6 aa, Entamoeba dispar
SAYSYN

SEQ ID NO: 2458955 - protein, 10 aa, Entamoeba dispar
SAYTKNLGST

SEQ ID NO: 2458956 - protein, 11 aa, Entamoeba dispar
SCAVSPGKLDH

SEQ ID NO: 2458957 - protein, 18 aa, Entamoeba dispar
SCDETTQNISQQEQQPTV

SEQ ID NO: 2458958 - protein, 16 aa, Entamoeba dispar
SCDSSYCDQTKGTFCS

SEQ ID NO: 2458959 - protein, 6 aa, Entamoeba dispar
SCDYGD

SEQ ID NO: 2458960 - protein, 7 aa, Entamoeba dispar
SCEDGVQ

SEQ ID NO: 2458961 - protein, 17 aa, Entamoeba dispar
SCEDTSEEKTNLGDKNQ

SEQ ID NO: 2458962 - protein, 4 aa, Entamoeba dispar
SCEE

SEQ ID NO: 2458963 - protein, 8 aa, Entamoeba dispar
SCEGGEPL

SEQ ID NO: 2458964 - protein, 6 aa, Entamoeba dispar
SCESSL

SEQ ID NO: 2458965 - protein, 24 aa, Entamoeba dispar
SCETDQSLNKVRSQDSPSGEMIPP

SEQ ID NO: 2458966 - protein, 8 aa, Entamoeba dispar
SCETKQSV

SEQ ID NO: 2458967 - protein, 15 aa, Entamoeba dispar
SCGISSNEPIKNEQV

SEQ ID NO: 2458968 - protein, 5 aa, Entamoeba dispar
SCGPN

SEQ ID NO: 2458969 - protein, 8 aa, Entamoeba dispar
SCGPRGFY

SEQ ID NO: 2458970 - protein, 4 aa, Entamoeba dispar
SCGT

SEQ ID NO: 2458971 - protein, 5 aa, Entamoeba dispar
SCGYT

SEQ ID NO: 2458972 - protein, 5 aa, Entamoeba dispar
SCKNE

SEQ ID NO: 2458973 - protein, 19 aa, Entamoeba dispar
SCKTPDPYSTTPSQGTFRY

SEQ ID NO: 2458974 - protein, 5 aa, Entamoeba dispar
SCLGS

SEQ ID NO: 2458975 - protein, 18 aa, Entamoeba dispar
SCNEEVNEDNTSPKQEVR

SEQ ID NO: 2458976 - protein, 15 aa, Entamoeba dispar
SCNGKKGFSLTPNDM

SEQ ID NO: 2458977 - protein, 10 aa, Entamoeba dispar
SCNKGKCKGC

SEQ ID NO: 2458978 - protein, 6 aa, Entamoeba dispar
SCNKNG

SEQ ID NO: 2458979 - protein, 8 aa, Entamoeba dispar
SCNNEQTG

SEQ ID NO: 2458980 - protein, 6 aa, Entamoeba dispar
SCNPRN

SEQ ID NO: 2458981 - protein, 11 aa, Entamoeba dispar
SCNSRDQNGSG

SEQ ID NO: 2458982 - protein, 5 aa, Entamoeba dispar
SCPKD

SEQ ID NO: 2458983 - protein, 5 aa, Entamoeba dispar
SCPNG

SEQ ID NO: 2458984 - protein, 5 aa, Entamoeba dispar
SCPNP

SEQ ID NO: 2458985 - protein, 8 aa, Entamoeba dispar
SCPPNAFN

SEQ ID NO: 2458986 - protein, 9 aa, Entamoeba dispar
SCPSEKSIS

SEQ ID NO: 2458987 - protein, 9 aa, Entamoeba dispar
SCPTGSAVS

SEQ ID NO: 2458988 - protein, 5 aa, Entamoeba dispar
SCRHG

SEQ ID NO: 2458989 - protein, 11 aa, Entamoeba dispar
SCRQNSEDEDL

SEQ ID NO: 2458990 - protein, 9 aa, Entamoeba dispar
SCSEAPTAR

SEQ ID NO: 2458991 - protein, 7 aa, Entamoeba dispar
SCSGGSP

SEQ ID NO: 2458992 - protein, 8 aa, Entamoeba dispar
SCSGPDSC

SEQ ID NO: 2458993 - protein, 6 aa, Entamoeba dispar
SCSISN

SEQ ID NO: 2458994 - protein, 10 aa, Entamoeba dispar
SCSKRSWDGQ

SEQ ID NO: 2458995 - protein, 6 aa, Entamoeba dispar
SCSNPF

SEQ ID NO: 2458996 - protein, 8 aa, Entamoeba dispar
SCSNPPAI

SEQ ID NO: 2458997 - protein, 6 aa, Entamoeba dispar
SCSQES

SEQ ID NO: 2458998 - protein, 4 aa, Entamoeba dispar
SCSS

SEQ ID NO: 2458999 - protein, 17 aa, Entamoeba dispar
SCSSTISSKTSSRKSIC

SEQ ID NO: 2459000 - protein, 4 aa, Entamoeba dispar
SCSV

SEQ ID NO: 2459001 - protein, 10 aa, Entamoeba dispar
SCTEKRTEEI

SEQ ID NO: 2459002 - protein, 12 aa, Entamoeba dispar
SCTKGKKGTVKY

SEQ ID NO: 2459003 - protein, 4 aa, Entamoeba dispar
SCTV

SEQ ID NO: 2459004 - protein, 11 aa, Entamoeba dispar
SCVNQSSTPFQ

SEQ ID NO: 2459005 - protein, 6 aa, Entamoeba dispar
SCWSEG

SEQ ID NO: 2459006 - protein, 9 aa, Entamoeba dispar
SDAATKEFA

SEQ ID NO: 2459007 - protein, 7 aa, Entamoeba dispar
SDAMGRD

SEQ ID NO: 2459008 - protein, 11 aa, Entamoeba dispar
SDAMNKKHDKS

SEQ ID NO: 2459009 - protein, 8 aa, Entamoeba dispar
SDANEMAR

SEQ ID NO: 2459010 - protein, 8 aa, Entamoeba dispar
SDAQTNPN

SEQ ID NO: 2459011 - protein, 11 aa, Entamoeba dispar
SDARSKTDIEE

SEQ ID NO: 2459012 - protein, 12 aa, Entamoeba dispar
SDARSKTDIQTI

SEQ ID NO: 2459013 - protein, 8 aa, Entamoeba dispar
SDATLIDK

SEQ ID NO: 2459014 - protein, 17 aa, Entamoeba dispar
SDATSKSTEIHKASTNQ

SEQ ID NO: 2459015 - protein, 5 aa, Entamoeba dispar
SDCQN

SEQ ID NO: 2459016 - protein, 22 aa, Entamoeba dispar
SDDDSEEKKETSNTMEEIDLSE

SEQ ID NO: 2459017 - protein, 7 aa, Entamoeba dispar
SDDEDIE

SEQ ID NO: 2459018 - protein, 71 aa, Entamoeba dispar
SDDEEIEEEVPEEDAYEEDEEEKERRRIEREKRKLEKQRKKEEAKKKKRKLIKEDDDDEMEIENEQEMDEE

SEQ ID NO: 2459019 - protein, 13 aa, Entamoeba dispar
SDDESTNSSKESI

SEQ ID NO: 2459020 - protein, 4 aa, Entamoeba dispar
SDDG

SEQ ID NO: 2459021 - protein, 7 aa, Entamoeba dispar
SDDINEE

SEQ ID NO: 2459022 - protein, 10 aa, Entamoeba dispar
SDDKDFDGQV

SEQ ID NO: 2459023 - protein, 6 aa, Entamoeba dispar
SDDKKA

SEQ ID NO: 2459024 - protein, 6 aa, Entamoeba dispar
SDDKNI

SEQ ID NO: 2459025 - protein, 9 aa, Entamoeba dispar
SDDKNYGFA

SEQ ID NO: 2459026 - protein, 42 aa, Entamoeba dispar
SDDKQNPNTNVSINKNNDQQKTTQNNLSETTPSTTDKSGSNM

SEQ ID NO: 2459027 - protein, 17 aa, Entamoeba dispar
SDDKTKKIEIKNEKERT

SEQ ID NO: 2459028 - protein, 7 aa, Entamoeba dispar
SDDKTRK

SEQ ID NO: 2459029 - protein, 6 aa, Entamoeba dispar
SDDKTT

SEQ ID NO: 2459030 - protein, 6 aa, Entamoeba dispar
SDDLEE

SEQ ID NO: 2459031 - protein, 8 aa, Entamoeba dispar
SDDMRADN

SEQ ID NO: 2459032 - protein, 7 aa, Entamoeba dispar
SDDNEIK

SEQ ID NO: 2459033 - protein, 9 aa, Entamoeba dispar
SDDNSKNNI

SEQ ID NO: 2459034 - protein, 6 aa, Entamoeba dispar
SDDPEF

SEQ ID NO: 2459035 - protein, 8 aa, Entamoeba dispar
SDDQNKSF

SEQ ID NO: 2459036 - protein, 7 aa, Entamoeba dispar
SDDSDVR

SEQ ID NO: 2459037 - protein, 7 aa, Entamoeba dispar
SDDSKKY

SEQ ID NO: 2459038 - protein, 10 aa, Entamoeba dispar
SDDSRNSLTG

SEQ ID NO: 2459039 - protein, 8 aa, Entamoeba dispar
SDDTEQDL

SEQ ID NO: 2459040 - protein, 10 aa, Entamoeba dispar
SDDTNNSTTQ

SEQ ID NO: 2459041 - protein, 8 aa, Entamoeba dispar
SDDTPSVG

SEQ ID NO: 2459042 - protein, 20 aa, Entamoeba dispar
SDDTQVKDVEEKYSKGELLS

SEQ ID NO: 2459043 - protein, 10 aa, Entamoeba dispar
SDDTVEKQSE

SEQ ID NO: 2459044 - protein, 6 aa, Entamoeba dispar
SDDVAA

SEQ ID NO: 2459045 - protein, 8 aa, Entamoeba dispar
SDDYSEVG

SEQ ID NO: 2459046 - protein, 17 aa, Entamoeba dispar
SDECKNDVCCKQPLIEK

SEQ ID NO: 2459047 - protein, 8 aa, Entamoeba dispar
SDEDGNGF

SEQ ID NO: 2459048 - protein, 15 aa, Entamoeba dispar
SDEDKIADLDSKSIV

SEQ ID NO: 2459049 - protein, 6 aa, Entamoeba dispar
SDEDLN

SEQ ID NO: 2459050 - protein, 10 aa, Entamoeba dispar
SDEDNQRKEK

SEQ ID NO: 2459051 - protein, 16 aa, Entamoeba dispar
SDEDRPIPKRVVASMF

SEQ ID NO: 2459052 - protein, 20 aa, Entamoeba dispar
SDEDVDEEVFTEKNKEQPVE

SEQ ID NO: 2459053 - protein, 4 aa, Entamoeba dispar
SDEE

SEQ ID NO: 2459054 - protein, 8 aa, Entamoeba dispar
SDEEDGCP

SEQ ID NO: 2459055 - protein, 8 aa, Entamoeba dispar
SDEEFNDG

SEQ ID NO: 2459056 - protein, 8 aa, Entamoeba dispar
SDEEKKQL

SEQ ID NO: 2459057 - protein, 16 aa, Entamoeba dispar
SDEEKPIPKRVVASMF

SEQ ID NO: 2459058 - protein, 15 aa, Entamoeba dispar
SDEENNDVDMTEYSL

SEQ ID NO: 2459059 - protein, 9 aa, Entamoeba dispar
SDEENTRRY

SEQ ID NO: 2459060 - protein, 9 aa, Entamoeba dispar
SDEERKKKL

SEQ ID NO: 2459061 - protein, 6 aa, Entamoeba dispar
SDEERR

SEQ ID NO: 2459062 - protein, 8 aa, Entamoeba dispar
SDEETKKQ

SEQ ID NO: 2459063 - protein, 5 aa, Entamoeba dispar
SDEFA

SEQ ID NO: 2459064 - protein, 7 aa, Entamoeba dispar
SDEFATK

SEQ ID NO: 2459065 - protein, 4 aa, Entamoeba dispar
SDEG

SEQ ID NO: 2459066 - protein, 14 aa, Entamoeba dispar
SDEGCDNTKSENEI

SEQ ID NO: 2459067 - protein, 25 aa, Entamoeba dispar
SDEKEQERKQTIYEQQQKQKVNNED

SEQ ID NO: 2459068 - protein, 6 aa, Entamoeba dispar
SDELTP

SEQ ID NO: 2459069 - protein, 6 aa, Entamoeba dispar
SDENEC

SEQ ID NO: 2459070 - protein, 8 aa, Entamoeba dispar
SDENQPTV

SEQ ID NO: 2459071 - protein, 4 aa, Entamoeba dispar
SDEQ

SEQ ID NO: 2459072 - protein, 15 aa, Entamoeba dispar
SDEQETEIEEDNASL

SEQ ID NO: 2459073 - protein, 15 aa, Entamoeba dispar
SDEQTQIEPRKSQPV

SEQ ID NO: 2459074 - protein, 14 aa, Entamoeba dispar
SDEQTTEEKKPKFF

SEQ ID NO: 2459075 - protein, 8 aa, Entamoeba dispar
SDESDMKC

SEQ ID NO: 2459076 - protein, 7 aa, Entamoeba dispar
SDESGDL

SEQ ID NO: 2459077 - protein, 7 aa, Entamoeba dispar
SDETIQP

SEQ ID NO: 2459078 - protein, 5 aa, Entamoeba dispar
SDEYI

SEQ ID NO: 2459079 - protein, 8 aa, Entamoeba dispar
SDEYPNEL

SEQ ID NO: 2459080 - protein, 7 aa, Entamoeba dispar
SDFEKKS

SEQ ID NO: 2459081 - protein, 9 aa, Entamoeba dispar
SDFGGDEEF

SEQ ID NO: 2459082 - protein, 30 aa, Entamoeba dispar
SDFGSFSSTTLQQPSQQNNGTSTLNGDDWD

SEQ ID NO: 2459083 - protein, 7 aa, Entamoeba dispar
SDFKAEE

SEQ ID NO: 2459084 - protein, 4 aa, Entamoeba dispar
SDFN

SEQ ID NO: 2459085 - protein, 6 aa, Entamoeba dispar
SDFQQY

SEQ ID NO: 2459086 - protein, 13 aa, Entamoeba dispar
SDFYPANGLPDKE

SEQ ID NO: 2459087 - protein, 11 aa, Entamoeba dispar
SDGADTVDEKE

SEQ ID NO: 2459088 - protein, 7 aa, Entamoeba dispar
SDGAEFN

SEQ ID NO: 2459089 - protein, 19 aa, Entamoeba dispar
SDGAEFNYKGYGKPVNGRK

SEQ ID NO: 2459090 - protein, 4 aa, Entamoeba dispar
SDGD

SEQ ID NO: 2459091 - protein, 10 aa, Entamoeba dispar
SDGDARNALN

SEQ ID NO: 2459092 - protein, 4 aa, Entamoeba dispar
SDGE

SEQ ID NO: 2459093 - protein, 9 aa, Entamoeba dispar
SDGEFYSES

SEQ ID NO: 2459094 - protein, 9 aa, Entamoeba dispar
SDGEKKKAC

SEQ ID NO: 2459095 - protein, 7 aa, Entamoeba dispar
SDGETPK

SEQ ID NO: 2459096 - protein, 40 aa, Entamoeba dispar
SDGEYSPKEQNNYTTEKKPIVKPINERKSKQKTERTNEMN

SEQ ID NO: 2459097 - protein, 7 aa, Entamoeba dispar
SDGGELR

SEQ ID NO: 2459098 - protein, 7 aa, Entamoeba dispar
SDGGKIN

SEQ ID NO: 2459099 - protein, 8 aa, Entamoeba dispar
SDGIKKSE

SEQ ID NO: 2459100 - protein, 6 aa, Entamoeba dispar
SDGIKS

SEQ ID NO: 2459101 - protein, 5 aa, Entamoeba dispar
SDGIV

SEQ ID NO: 2459102 - protein, 8 aa, Entamoeba dispar
SDGKDYTL

SEQ ID NO: 2459103 - protein, 9 aa, Entamoeba dispar
SDGKTSVKR

SEQ ID NO: 2459104 - protein, 5 aa, Entamoeba dispar
SDGKY

SEQ ID NO: 2459105 - protein, 4 aa, Entamoeba dispar
SDGL

SEQ ID NO: 2459106 - protein, 5 aa, Entamoeba dispar
SDGMG

SEQ ID NO: 2459107 - protein, 9 aa, Entamoeba dispar
SDGNKQGDK

SEQ ID NO: 2459108 - protein, 6 aa, Entamoeba dispar
SDGRKE

SEQ ID NO: 2459109 - protein, 9 aa, Entamoeba dispar
SDGSTYKSR

SEQ ID NO: 2459110 - protein, 7 aa, Entamoeba dispar
SDGSVKI

SEQ ID NO: 2459111 - protein, 10 aa, Entamoeba dispar
SDGSYEMGQK

SEQ ID NO: 2459112 - protein, 15 aa, Entamoeba dispar
SDGTASLLNKFTQPQ

SEQ ID NO: 2459113 - protein, 24 aa, Entamoeba dispar
SDGTTNYNEQIPLTGKGHYTTQNG

SEQ ID NO: 2459114 - protein, 9 aa, Entamoeba dispar
SDGTVGANH

SEQ ID NO: 2459115 - protein, 7 aa, Entamoeba dispar
SDGYDDK

SEQ ID NO: 2459116 - protein, 5 aa, Entamoeba dispar
SDHDD

SEQ ID NO: 2459117 - protein, 7 aa, Entamoeba dispar
SDHEAYK

SEQ ID NO: 2459118 - protein, 4 aa, Entamoeba dispar
SDHF

SEQ ID NO: 2459119 - protein, 30 aa, Entamoeba dispar
SDHSRDNTRKSIIGSNRTHLPSVAQSTPIM

SEQ ID NO: 2459120 - protein, 10 aa, Entamoeba dispar
SDHYTTKEPF

SEQ ID NO: 2459121 - protein, 22 aa, Entamoeba dispar
SDIDRTTKKAKEWYRNGEKENA

SEQ ID NO: 2459122 - protein, 5 aa, Entamoeba dispar
SDIEK

SEQ ID NO: 2459123 - protein, 5 aa, Entamoeba dispar
SDIET

SEQ ID NO: 2459124 - protein, 13 aa, Entamoeba dispar
SDIGGGNSGVPSF

SEQ ID NO: 2459125 - protein, 16 aa, Entamoeba dispar
SDIGNTVDDQFNETKN

SEQ ID NO: 2459126 - protein, 7 aa, Entamoeba dispar
SDIKIKR

SEQ ID NO: 2459127 - protein, 4 aa, Entamoeba dispar
SDIN

SEQ ID NO: 2459128 - protein, 7 aa, Entamoeba dispar
SDINARA

SEQ ID NO: 2459129 - protein, 6 aa, Entamoeba dispar
SDINEF

SEQ ID NO: 2459130 - protein, 19 aa, Entamoeba dispar
SDINENLSRGIKERDEKIK

SEQ ID NO: 2459131 - protein, 7 aa, Entamoeba dispar
SDIPKDR

SEQ ID NO: 2459132 - protein, 10 aa, Entamoeba dispar
SDIPKLTSNL

SEQ ID NO: 2459133 - protein, 8 aa, Entamoeba dispar
SDIPQELH

SEQ ID NO: 2459134 - protein, 8 aa, Entamoeba dispar
SDIPSIGK

SEQ ID NO: 2459135 - protein, 11 aa, Entamoeba dispar
SDIPTISMDGN

SEQ ID NO: 2459136 - protein, 4 aa, Entamoeba dispar
SDIQ

SEQ ID NO: 2459137 - protein, 7 aa, Entamoeba dispar
SDIQTQT

SEQ ID NO: 2459138 - protein, 6 aa, Entamoeba dispar
SDISAD

SEQ ID NO: 2459139 - protein, 12 aa, Entamoeba dispar
SDISDTNNIEST

SEQ ID NO: 2459140 - protein, 16 aa, Entamoeba dispar
SDISRRKSSSSESLSP

SEQ ID NO: 2459141 - protein, 26 aa, Entamoeba dispar
SDITNTPSLIPSTSTEKINNETETSV

SEQ ID NO: 2459142 - protein, 6 aa, Entamoeba dispar
SDITSK

SEQ ID NO: 2459143 - protein, 5 aa, Entamoeba dispar
SDKAL

SEQ ID NO: 2459144 - protein, 8 aa, Entamoeba dispar
SDKCSPND

SEQ ID NO: 2459145 - protein, 9 aa, Entamoeba dispar
SDKDHEVKE

SEQ ID NO: 2459146 - protein, 6 aa, Entamoeba dispar
SDKDKR

SEQ ID NO: 2459147 - protein, 9 aa, Entamoeba dispar
SDKEKDPSF

SEQ ID NO: 2459148 - protein, 7 aa, Entamoeba dispar
SDKENKK

SEQ ID NO: 2459149 - protein, 11 aa, Entamoeba dispar
SDKERIEESGD

SEQ ID NO: 2459150 - protein, 6 aa, Entamoeba dispar
SDKETI

SEQ ID NO: 2459151 - protein, 9 aa, Entamoeba dispar
SDKETQING

SEQ ID NO: 2459152 - protein, 8 aa, Entamoeba dispar
SDKEVNDY

SEQ ID NO: 2459153 - protein, 11 aa, Entamoeba dispar
SDKFGQDQSTK

SEQ ID NO: 2459154 - protein, 5 aa, Entamoeba dispar
SDKFQ

SEQ ID NO: 2459155 - protein, 8 aa, Entamoeba dispar
SDKGGCDA

SEQ ID NO: 2459156 - protein, 8 aa, Entamoeba dispar
SDKGKTSY

SEQ ID NO: 2459157 - protein, 25 aa, Entamoeba dispar
SDKGNVLRKGTKRVKVEPCKKSNCS

SEQ ID NO: 2459158 - protein, 9 aa, Entamoeba dispar
SDKHKTNLI

SEQ ID NO: 2459159 - protein, 4 aa, Entamoeba dispar
SDKI

SEQ ID NO: 2459160 - protein, 8 aa, Entamoeba dispar
SDKKGYSS

SEQ ID NO: 2459161 - protein, 9 aa, Entamoeba dispar
SDKKIKPNI

SEQ ID NO: 2459162 - protein, 10 aa, Entamoeba dispar
SDKKIKQETA

SEQ ID NO: 2459163 - protein, 7 aa, Entamoeba dispar
SDKLETI

SEQ ID NO: 2459164 - protein, 15 aa, Entamoeba dispar
SDKLTGANTDKFAYN

SEQ ID NO: 2459165 - protein, 13 aa, Entamoeba dispar
SDKLTKDAQNALR

SEQ ID NO: 2459166 - protein, 15 aa, Entamoeba dispar
SDKMREETKPSKGGL

SEQ ID NO: 2459167 - protein, 8 aa, Entamoeba dispar
SDKNDTEL

SEQ ID NO: 2459168 - protein, 9 aa, Entamoeba dispar
SDKNKMNAA

SEQ ID NO: 2459169 - protein, 8 aa, Entamoeba dispar
SDKNTQRA

SEQ ID NO: 2459170 - protein, 17 aa, Entamoeba dispar
SDKNTRSLGLSSEEEQF

SEQ ID NO: 2459171 - protein, 18 aa, Entamoeba dispar
SDKPANDPRETSDQDLTE

SEQ ID NO: 2459172 - protein, 8 aa, Entamoeba dispar
SDKQHPLT

SEQ ID NO: 2459173 - protein, 13 aa, Entamoeba dispar
SDKQLKEKGPSLQ

SEQ ID NO: 2459174 - protein, 37 aa, Entamoeba dispar
SDKQTAEKIKNEVKLSKERISSEQIGQTKRDNEESQL

SEQ ID NO: 2459175 - protein, 14 aa, Entamoeba dispar
SDKRPNKWTDNQDI

SEQ ID NO: 2459176 - protein, 18 aa, Entamoeba dispar
SDKRYFNSKSKKEININD

SEQ ID NO: 2459177 - protein, 4 aa, Entamoeba dispar
SDKS

SEQ ID NO: 2459178 - protein, 5 aa, Entamoeba dispar
SDKSD

SEQ ID NO: 2459179 - protein, 14 aa, Entamoeba dispar
SDKSGLLERDETTK

SEQ ID NO: 2459180 - protein, 7 aa, Entamoeba dispar
SDKTDDK

SEQ ID NO: 2459181 - protein, 6 aa, Entamoeba dispar
SDKTDI

SEQ ID NO: 2459182 - protein, 20 aa, Entamoeba dispar
SDKYLTQKSKGEKTEISEEQ

SEQ ID NO: 2459183 - protein, 6 aa, Entamoeba dispar
SDKYSI

SEQ ID NO: 2459184 - protein, 9 aa, Entamoeba dispar
SDLDNDSEQ

SEQ ID NO: 2459185 - protein, 8 aa, Entamoeba dispar
SDLDPSDF

SEQ ID NO: 2459186 - protein, 21 aa, Entamoeba dispar
SDLEGNRQITTSEAEQFAQEN

SEQ ID NO: 2459187 - protein, 17 aa, Entamoeba dispar
SDLEREVTKEEAEEVAK

SEQ ID NO: 2459188 - protein, 7 aa, Entamoeba dispar
SDLNEET

SEQ ID NO: 2459189 - protein, 11 aa, Entamoeba dispar
SDLNLGGNNFD

SEQ ID NO: 2459190 - protein, 4 aa, Entamoeba dispar
SDLP

SEQ ID NO: 2459191 - protein, 12 aa, Entamoeba dispar
SDLPDDDDVEEQ

SEQ ID NO: 2459192 - protein, 5 aa, Entamoeba dispar
SDLPN

SEQ ID NO: 2459193 - protein, 8 aa, Entamoeba dispar
SDLPNSGI

SEQ ID NO: 2459194 - protein, 6 aa, Entamoeba dispar
SDLQRS

SEQ ID NO: 2459195 - protein, 19 aa, Entamoeba dispar
SDLRQSQSTIEKLRNEGKA

SEQ ID NO: 2459196 - protein, 30 aa, Entamoeba dispar
SDLSSGSDGLSKLNEEIETINKEKEGIQNE

SEQ ID NO: 2459197 - protein, 8 aa, Entamoeba dispar
SDLTNNKH

SEQ ID NO: 2459198 - protein, 12 aa, Entamoeba dispar
SDMDEEDDVEDI

SEQ ID NO: 2459199 - protein, 8 aa, Entamoeba dispar
SDMNGTVS

SEQ ID NO: 2459200 - protein, 13 aa, Entamoeba dispar
SDMQKKELENAYK

SEQ ID NO: 2459201 - protein, 6 aa, Entamoeba dispar
SDNCNK

SEQ ID NO: 2459202 - protein, 12 aa, Entamoeba dispar
SDNDDAENDNMQ

SEQ ID NO: 2459203 - protein, 17 aa, Entamoeba dispar
SDNDFERYKGKTLPELK

SEQ ID NO: 2459204 - protein, 8 aa, Entamoeba dispar
SDNDMDNP

SEQ ID NO: 2459205 - protein, 9 aa, Entamoeba dispar
SDNEENNEI

SEQ ID NO: 2459206 - protein, 18 aa, Entamoeba dispar
SDNESVGSCHHDNEDSEV

SEQ ID NO: 2459207 - protein, 4 aa, Entamoeba dispar
SDNF

SEQ ID NO: 2459208 - protein, 7 aa, Entamoeba dispar
SDNFSGR

SEQ ID NO: 2459209 - protein, 9 aa, Entamoeba dispar
SDNGLDARK

SEQ ID NO: 2459210 - protein, 10 aa, Entamoeba dispar
SDNGSQLSSA

SEQ ID NO: 2459211 - protein, 19 aa, Entamoeba dispar
SDNGTYEYTPNPSTDGISK

SEQ ID NO: 2459212 - protein, 9 aa, Entamoeba dispar
SDNHESSNS

SEQ ID NO: 2459213 - protein, 7 aa, Entamoeba dispar
SDNHVPP

SEQ ID NO: 2459214 - protein, 16 aa, Entamoeba dispar
SDNIIPNDKITRGTTR

SEQ ID NO: 2459215 - protein, 12 aa, Entamoeba dispar
SDNISDDEPFYF

SEQ ID NO: 2459216 - protein, 5 aa, Entamoeba dispar
SDNIY

SEQ ID NO: 2459217 - protein, 4 aa, Entamoeba dispar
SDNK

SEQ ID NO: 2459218 - protein, 5 aa, Entamoeba dispar
SDNKG

SEQ ID NO: 2459219 - protein, 5 aa, Entamoeba dispar
SDNKK

SEQ ID NO: 2459220 - protein, 8 aa, Entamoeba dispar
SDNKTLKK

SEQ ID NO: 2459221 - protein, 21 aa, Entamoeba dispar
SDNKYNGPTIDPDHKSDEGRS

SEQ ID NO: 2459222 - protein, 15 aa, Entamoeba dispar
SDNLAKQLGNSIQQR

SEQ ID NO: 2459223 - protein, 8 aa, Entamoeba dispar
SDNNEVST

SEQ ID NO: 2459224 - protein, 7 aa, Entamoeba dispar
SDNNPDK

SEQ ID NO: 2459225 - protein, 6 aa, Entamoeba dispar
SDNPLL

SEQ ID NO: 2459226 - protein, 7 aa, Entamoeba dispar
SDNQIEG

SEQ ID NO: 2459227 - protein, 8 aa, Entamoeba dispar
SDNQIEGD

SEQ ID NO: 2459228 - protein, 8 aa, Entamoeba dispar
SDNSNEIV

SEQ ID NO: 2459229 - protein, 11 aa, Entamoeba dispar
SDNSPTTPAPF

SEQ ID NO: 2459230 - protein, 11 aa, Entamoeba dispar
SDNTETPEEAK

SEQ ID NO: 2459231 - protein, 25 aa, Entamoeba dispar
SDNTQNTSKIKTSTSIKKPVRNTFD

SEQ ID NO: 2459232 - protein, 9 aa, Entamoeba dispar
SDPAERSKV

SEQ ID NO: 2459233 - protein, 8 aa, Entamoeba dispar
SDPAGSVA

SEQ ID NO: 2459234 - protein, 7 aa, Entamoeba dispar
SDPASLE

SEQ ID NO: 2459235 - protein, 4 aa, Entamoeba dispar
SDPD

SEQ ID NO: 2459236 - protein, 9 aa, Entamoeba dispar
SDPDDSLRR

SEQ ID NO: 2459237 - protein, 9 aa, Entamoeba dispar
SDPDGIKSV

SEQ ID NO: 2459238 - protein, 6 aa, Entamoeba dispar
SDPEGW

SEQ ID NO: 2459239 - protein, 6 aa, Entamoeba dispar
SDPFRP

SEQ ID NO: 2459240 - protein, 23 aa, Entamoeba dispar
SDPGFRKEFEKNGKKGGEGRYRD

SEQ ID NO: 2459241 - protein, 5 aa, Entamoeba dispar
SDPHD

SEQ ID NO: 2459242 - protein, 5 aa, Entamoeba dispar
SDPHM

SEQ ID NO: 2459243 - protein, 27 aa, Entamoeba dispar
SDPIPSRSRKRVLPKSKMERRKESIEL

SEQ ID NO: 2459244 - protein, 5 aa, Entamoeba dispar
SDPIS

SEQ ID NO: 2459245 - protein, 4 aa, Entamoeba dispar
SDPK

SEQ ID NO: 2459246 - protein, 4 aa, Entamoeba dispar
SDPN

SEQ ID NO: 2459247 - protein, 6 aa, Entamoeba dispar
SDPNLS

SEQ ID NO: 2459248 - protein, 5 aa, Entamoeba dispar
SDPNN

SEQ ID NO: 2459249 - protein, 15 aa, Entamoeba dispar
SDPNNLELSNNVSKE

SEQ ID NO: 2459250 - protein, 14 aa, Entamoeba dispar
SDPQLRRDDKGEYT

SEQ ID NO: 2459251 - protein, 9 aa, Entamoeba dispar
SDPQTVPLP

SEQ ID NO: 2459252 - protein, 9 aa, Entamoeba dispar
SDPRGKGFR

SEQ ID NO: 2459253 - protein, 9 aa, Entamoeba dispar
SDPRNEMNY

SEQ ID NO: 2459254 - protein, 5 aa, Entamoeba dispar
SDPSF

SEQ ID NO: 2459255 - protein, 8 aa, Entamoeba dispar
SDPSSNKI

SEQ ID NO: 2459256 - protein, 4 aa, Entamoeba dispar
SDPT

SEQ ID NO: 2459257 - protein, 7 aa, Entamoeba dispar
SDPTIQK

SEQ ID NO: 2459258 - protein, 5 aa, Entamoeba dispar
SDPTQ

SEQ ID NO: 2459259 - protein, 4 aa, Entamoeba dispar
SDPV

SEQ ID NO: 2459260 - protein, 11 aa, Entamoeba dispar
SDQDGGEGKTG

SEQ ID NO: 2459261 - protein, 8 aa, Entamoeba dispar
SDQEGDYN

SEQ ID NO: 2459262 - protein, 8 aa, Entamoeba dispar
SDQISELS

SEQ ID NO: 2459263 - protein, 7 aa, Entamoeba dispar
SDQNDSI

SEQ ID NO: 2459264 - protein, 10 aa, Entamoeba dispar
SDQNLDSNER

SEQ ID NO: 2459265 - protein, 25 aa, Entamoeba dispar
SDQQIETQKKENSFPKIQDNQNSIQ

SEQ ID NO: 2459266 - protein, 12 aa, Entamoeba dispar
SDQQINVDETKV

SEQ ID NO: 2459267 - protein, 7 aa, Entamoeba dispar
SDQSFKD

SEQ ID NO: 2459268 - protein, 8 aa, Entamoeba dispar
SDQSVKKS

SEQ ID NO: 2459269 - protein, 4 aa, Entamoeba dispar
SDQY

SEQ ID NO: 2459270 - protein, 9 aa, Entamoeba dispar
SDRCPPGGL

SEQ ID NO: 2459271 - protein, 4 aa, Entamoeba dispar
SDRE

SEQ ID NO: 2459272 - protein, 11 aa, Entamoeba dispar
SDREEFGPDIS

SEQ ID NO: 2459273 - protein, 7 aa, Entamoeba dispar
SDRISRI

SEQ ID NO: 2459274 - protein, 6 aa, Entamoeba dispar
SDRKYD

SEQ ID NO: 2459275 - protein, 6 aa, Entamoeba dispar
SDRLST

SEQ ID NO: 2459276 - protein, 5 aa, Entamoeba dispar
SDRPY

SEQ ID NO: 2459277 - protein, 23 aa, Entamoeba dispar
SDRRKDMNMEDNEDDSGDDWSDD

SEQ ID NO: 2459278 - protein, 4 aa, Entamoeba dispar
SDRY

SEQ ID NO: 2459279 - protein, 4 aa, Entamoeba dispar
SDSC

SEQ ID NO: 2459280 - protein, 23 aa, Entamoeba dispar
SDSDEDYSQISELETNKEEPIKL

SEQ ID NO: 2459281 - protein, 8 aa, Entamoeba dispar
SDSDKDDV

SEQ ID NO: 2459282 - protein, 6 aa, Entamoeba dispar
SDSEAY

SEQ ID NO: 2459283 - protein, 8 aa, Entamoeba dispar
SDSEEKPV

SEQ ID NO: 2459284 - protein, 7 aa, Entamoeba dispar
SDSEWDK

SEQ ID NO: 2459285 - protein, 4 aa, Entamoeba dispar
SDSF

SEQ ID NO: 2459286 - protein, 7 aa, Entamoeba dispar
SDSGNNR

SEQ ID NO: 2459287 - protein, 6 aa, Entamoeba dispar
SDSGSI

SEQ ID NO: 2459288 - protein, 10 aa, Entamoeba dispar
SDSGSSAMTD

SEQ ID NO: 2459289 - protein, 7 aa, Entamoeba dispar
SDSHNSQ

SEQ ID NO: 2459290 - protein, 8 aa, Entamoeba dispar
SDSIEEGC

SEQ ID NO: 2459291 - protein, 5 aa, Entamoeba dispar
SDSLE

SEQ ID NO: 2459292 - protein, 10 aa, Entamoeba dispar
SDSLNHQSID

SEQ ID NO: 2459293 - protein, 5 aa, Entamoeba dispar
SDSLP

SEQ ID NO: 2459294 - protein, 9 aa, Entamoeba dispar
SDSLREGGY

SEQ ID NO: 2459295 - protein, 16 aa, Entamoeba dispar
SDSLTQKKAKKQRRYK

SEQ ID NO: 2459296 - protein, 16 aa, Entamoeba dispar
SDSLVGGERNKGEDEI

SEQ ID NO: 2459297 - protein, 4 aa, Entamoeba dispar
SDSM

SEQ ID NO: 2459298 - protein, 5 aa, Entamoeba dispar
SDSNE

SEQ ID NO: 2459299 - protein, 5 aa, Entamoeba dispar
SDSNI

SEQ ID NO: 2459300 - protein, 28 aa, Entamoeba dispar
SDSNITQTYYSNDDGESIEVTKEQLKES

SEQ ID NO: 2459301 - protein, 11 aa, Entamoeba dispar
SDSNSNRDLVE

SEQ ID NO: 2459302 - protein, 8 aa, Entamoeba dispar
SDSNTKEV

SEQ ID NO: 2459303 - protein, 6 aa, Entamoeba dispar
SDSPKL

SEQ ID NO: 2459304 - protein, 17 aa, Entamoeba dispar
SDSQKQKSIPIKQEKIK

SEQ ID NO: 2459305 - protein, 8 aa, Entamoeba dispar
SDSRESQV

SEQ ID NO: 2459306 - protein, 6 aa, Entamoeba dispar
SDSRPS

SEQ ID NO: 2459307 - protein, 7 aa, Entamoeba dispar
SDSRQVL

SEQ ID NO: 2459308 - protein, 4 aa, Entamoeba dispar
SDSS

SEQ ID NO: 2459309 - protein, 8 aa, Entamoeba dispar
SDSSFTQA

SEQ ID NO: 2459310 - protein, 6 aa, Entamoeba dispar
SDSSRF

SEQ ID NO: 2459311 - protein, 15 aa, Entamoeba dispar
SDSTQLERKGIDDDC

SEQ ID NO: 2459312 - protein, 4 aa, Entamoeba dispar
SDSV

SEQ ID NO: 2459313 - protein, 34 aa, Entamoeba dispar
SDSVTEEEKPEHIEEPVTKRTTRRQANHENQRQE

SEQ ID NO: 2459314 - protein, 26 aa, Entamoeba dispar
SDSVTRHGTQSSYPNKERIQKIISEI

SEQ ID NO: 2459315 - protein, 8 aa, Entamoeba dispar
SDTATEQF

SEQ ID NO: 2459316 - protein, 9 aa, Entamoeba dispar
SDTDGEDQD

SEQ ID NO: 2459317 - protein, 8 aa, Entamoeba dispar
SDTDVKRQ

SEQ ID NO: 2459318 - protein, 6 aa, Entamoeba dispar
SDTEEY

SEQ ID NO: 2459319 - protein, 7 aa, Entamoeba dispar
SDTERLN

SEQ ID NO: 2459320 - protein, 135 aa, Entamoeba dispar
SDTESDSESSNEKHEITKPEIKEEKKEEHKHSKKDKKEHKHSKKDKKEKKEHKHSKKDKKEKKKDKSDDKDEDQKEKSTTEVTRMEEDTKEEIIKDEEEQEKNEKEEQGNDKKEELINEKKEELINEKKEEEEVV

SEQ ID NO: 2459321 - protein, 7 aa, Entamoeba dispar
SDTGEYS

SEQ ID NO: 2459322 - protein, 10 aa, Entamoeba dispar
SDTHSEPNEV

SEQ ID NO: 2459323 - protein, 6 aa, Entamoeba dispar
SDTISE

SEQ ID NO: 2459324 - protein, 9 aa, Entamoeba dispar
SDTKPTRSF

SEQ ID NO: 2459325 - protein, 7 aa, Entamoeba dispar
SDTKRDD

SEQ ID NO: 2459326 - protein, 17 aa, Entamoeba dispar
SDTNAGCVSPIKEGKCQ

SEQ ID NO: 2459327 - protein, 6 aa, Entamoeba dispar
SDTNIS

SEQ ID NO: 2459328 - protein, 6 aa, Entamoeba dispar
SDTNQM

SEQ ID NO: 2459329 - protein, 6 aa, Entamoeba dispar
SDTNTR

SEQ ID NO: 2459330 - protein, 9 aa, Entamoeba dispar
SDTPEGESC

SEQ ID NO: 2459331 - protein, 10 aa, Entamoeba dispar
SDTPGNLVTS

SEQ ID NO: 2459332 - protein, 7 aa, Entamoeba dispar
SDTPPWA

SEQ ID NO: 2459333 - protein, 7 aa, Entamoeba dispar
SDTQHVV

SEQ ID NO: 2459334 - protein, 9 aa, Entamoeba dispar
SDTSLNDTT

SEQ ID NO: 2459335 - protein, 7 aa, Entamoeba dispar
SDTTCKQ

SEQ ID NO: 2459336 - protein, 5 aa, Entamoeba dispar
SDTVD

SEQ ID NO: 2459337 - protein, 6 aa, Entamoeba dispar
SDTVRR

SEQ ID NO: 2459338 - protein, 6 aa, Entamoeba dispar
SDTYGE

SEQ ID NO: 2459339 - protein, 11 aa, Entamoeba dispar
SDTYKGVPAGE

SEQ ID NO: 2459340 - protein, 5 aa, Entamoeba dispar
SDVDV

SEQ ID NO: 2459341 - protein, 7 aa, Entamoeba dispar
SDVEADI

SEQ ID NO: 2459342 - protein, 10 aa, Entamoeba dispar
SDVESSLDPT

SEQ ID NO: 2459343 - protein, 7 aa, Entamoeba dispar
SDVGKSS

SEQ ID NO: 2459344 - protein, 31 aa, Entamoeba dispar
  misc_feature (15)..(16): Xaa can be any naturally occurring amino acid
SDVHPSCYATSSKNXXPMISSFTSVKTDQLY

SEQ ID NO: 2459345 - protein, 8 aa, Entamoeba dispar
SDVKKETT

SEQ ID NO: 2459346 - protein, 38 aa, Entamoeba dispar
SDVPSDAATEAGYSLNEESKSEKKEDNDHSFEEQKEEL

SEQ ID NO: 2459347 - protein, 13 aa, Entamoeba dispar
SDVPSEDGKSHEK

SEQ ID NO: 2459348 - protein, 39 aa, Entamoeba dispar
SDVSPKPRNSTSLNTPTAPVGSPNNNAKPCRKSNQNISE

SEQ ID NO: 2459349 - protein, 6 aa, Entamoeba dispar
SDVVST

SEQ ID NO: 2459350 - protein, 19 aa, Entamoeba dispar
SDYDYTSDETIENNPDKVN

SEQ ID NO: 2459351 - protein, 6 aa, Entamoeba dispar
SDYETM

SEQ ID NO: 2459352 - protein, 11 aa, Entamoeba dispar
SDYNTLHSSST

SEQ ID NO: 2459353 - protein, 4 aa, Entamoeba dispar
SDYP

SEQ ID NO: 2459354 - protein, 9 aa, Entamoeba dispar
SDYPNQQRD

SEQ ID NO: 2459355 - protein, 14 aa, Entamoeba dispar
SDYSNGIPNIGPIS

SEQ ID NO: 2459356 - protein, 13 aa, Entamoeba dispar
SDYSQSSELGEEY

SEQ ID NO: 2459357 - protein, 14 aa, Entamoeba dispar
SEAAEERRLRGQYP

SEQ ID NO: 2459358 - protein, 7 aa, Entamoeba dispar
SEADSDL

SEQ ID NO: 2459359 - protein, 6 aa, Entamoeba dispar
SEAEEL

SEQ ID NO: 2459360 - protein, 13 aa, Entamoeba dispar
SEAERALRSKLNT

SEQ ID NO: 2459361 - protein, 4 aa, Entamoeba dispar
SEAF

SEQ ID NO: 2459362 - protein, 8 aa, Entamoeba dispar
SEAGEVGE

SEQ ID NO: 2459363 - protein, 4 aa, Entamoeba dispar
SEAI

SEQ ID NO: 2459364 - protein, 4 aa, Entamoeba dispar
SEAK

SEQ ID NO: 2459365 - protein, 8 aa, Entamoeba dispar
SEANKRDI

SEQ ID NO: 2459366 - protein, 5 aa, Entamoeba dispar
SEANV

SEQ ID NO: 2459367 - protein, 6 aa, Entamoeba dispar
SEANVR

SEQ ID NO: 2459368 - protein, 13 aa, Entamoeba dispar
SEAPQAKEKKKGM

SEQ ID NO: 2459369 - protein, 8 aa, Entamoeba dispar
SEAQPNDN

SEQ ID NO: 2459370 - protein, 4 aa, Entamoeba dispar
SEAR

SEQ ID NO: 2459371 - protein, 6 aa, Entamoeba dispar
SEAVPK

SEQ ID NO: 2459372 - protein, 4 aa, Entamoeba dispar
SECI

SEQ ID NO: 2459373 - protein, 7 aa, Entamoeba dispar
SECTGCG

SEQ ID NO: 2459374 - protein, 9 aa, Entamoeba dispar
SEDATPRTL

SEQ ID NO: 2459375 - protein, 4 aa, Entamoeba dispar
SEDD

SEQ ID NO: 2459376 - protein, 9 aa, Entamoeba dispar
SEDDDKTMK

SEQ ID NO: 2459377 - protein, 16 aa, Entamoeba dispar
SEDDNDNESPQCEEEP

SEQ ID NO: 2459378 - protein, 12 aa, Entamoeba dispar
SEDDQKKVEDLK

SEQ ID NO: 2459379 - protein, 4 aa, Entamoeba dispar
SEDE

SEQ ID NO: 2459380 - protein, 20 aa, Entamoeba dispar
SEDERKKYKDLAQHNKDSVK

SEQ ID NO: 2459381 - protein, 28 aa, Entamoeba dispar
SEDGESDEYEETEDSNKDSKSSEEDDEI

SEQ ID NO: 2459382 - protein, 7 aa, Entamoeba dispar
SEDGNFT

SEQ ID NO: 2459383 - protein, 5 aa, Entamoeba dispar
SEDIG

SEQ ID NO: 2459384 - protein, 10 aa, Entamoeba dispar
SEDIQQKKEL

SEQ ID NO: 2459385 - protein, 8 aa, Entamoeba dispar
SEDKIPNA

SEQ ID NO: 2459386 - protein, 20 aa, Entamoeba dispar
SEDKQSVKRKTPLPTEEEIN

SEQ ID NO: 2459387 - protein, 10 aa, Entamoeba dispar
SEDLDGEKRI

SEQ ID NO: 2459388 - protein, 7 aa, Entamoeba dispar
SEDLTEY

SEQ ID NO: 2459389 - protein, 4 aa, Entamoeba dispar
SEDN

SEQ ID NO: 2459390 - protein, 14 aa, Entamoeba dispar
SEDNPNNKCSKSLD

SEQ ID NO: 2459391 - protein, 8 aa, Entamoeba dispar
SEDPFQPN

SEQ ID NO: 2459392 - protein, 10 aa, Entamoeba dispar
SEDPNDITTG

SEQ ID NO: 2459393 - protein, 10 aa, Entamoeba dispar
SEDPNQPLKT

SEQ ID NO: 2459394 - protein, 7 aa, Entamoeba dispar
SEDPQYK

SEQ ID NO: 2459395 - protein, 33 aa, Entamoeba dispar
SEDRNESEESQISKKSESDNKKIRRKNNVNEET

SEQ ID NO: 2459396 - protein, 12 aa, Entamoeba dispar
SEDSIPQNFIQN

SEQ ID NO: 2459397 - protein, 37 aa, Entamoeba dispar
SEDSLDKEDEDEGEYSADDYNDHQPFGGRDNNMDIIY

SEQ ID NO: 2459398 - protein, 15 aa, Entamoeba dispar
SEDSLEDMKESTDYD

SEQ ID NO: 2459399 - protein, 26 aa, Entamoeba dispar
SEDTPTSELAKTARALSSNQNPELTY

SEQ ID NO: 2459400 - protein, 24 aa, Entamoeba dispar
SEDTRTKRKKIKKRNTLRKEIETA

SEQ ID NO: 2459401 - protein, 4 aa, Entamoeba dispar
SEDW

SEQ ID NO: 2459402 - protein, 6 aa, Entamoeba dispar
SEDWGE

SEQ ID NO: 2459403 - protein, 4 aa, Entamoeba dispar
SEEA

SEQ ID NO: 2459404 - protein, 8 aa, Entamoeba dispar
SEEAGADA

SEQ ID NO: 2459405 - protein, 7 aa, Entamoeba dispar
SEEDCEK

SEQ ID NO: 2459406 - protein, 33 aa, Entamoeba dispar
SEEDINSKLPKTPETIKCSEDRIKKPSRRVETN

SEQ ID NO: 2459407 - protein, 5 aa, Entamoeba dispar
SEEDK

SEQ ID NO: 2459408 - protein, 5 aa, Entamoeba dispar
SEEDL

SEQ ID NO: 2459409 - protein, 6 aa, Entamoeba dispar
SEEDTV

SEQ ID NO: 2459410 - protein, 4 aa, Entamoeba dispar
SEEE

SEQ ID NO: 2459411 - protein, 5 aa, Entamoeba dispar
SEEED

SEQ ID NO: 2459412 - protein, 11 aa, Entamoeba dispar
SEEEDGTLGAK

SEQ ID NO: 2459413 - protein, 9 aa, Entamoeba dispar
SEEEEEKMA

SEQ ID NO: 2459414 - protein, 7 aa, Entamoeba dispar
SEEEEEV

SEQ ID NO: 2459415 - protein, 5 aa, Entamoeba dispar
SEEEF

SEQ ID NO: 2459416 - protein, 9 aa, Entamoeba dispar
SEEEGEEPI

SEQ ID NO: 2459417 - protein, 61 aa, Entamoeba dispar
SEEEHKKRGDEEKSETKKIKQKQERKGKKQRNTERKEEKQEKRFDRKGLSREEKEELHKED

SEQ ID NO: 2459418 - protein, 61 aa, Entamoeba dispar
SEEEHTKRGDEEKSETKKIKQKQERKGKKQRNTERKEEKQEKRFDRKGLSREEKEELHKED

SEQ ID NO: 2459419 - protein, 6 aa, Entamoeba dispar
SEEEKK

SEQ ID NO: 2459420 - protein, 7 aa, Entamoeba dispar
SEEEKKL

SEQ ID NO: 2459421 - protein, 6 aa, Entamoeba dispar
SEEEME

SEQ ID NO: 2459422 - protein, 7 aa, Entamoeba dispar
SEEENDE

SEQ ID NO: 2459423 - protein, 9 aa, Entamoeba dispar
SEEEQGNEV

SEQ ID NO: 2459424 - protein, 8 aa, Entamoeba dispar
SEEEQSLL

SEQ ID NO: 2459425 - protein, 9 aa, Entamoeba dispar
SEEESKLRQ

SEQ ID NO: 2459426 - protein, 6 aa, Entamoeba dispar
SEEETD

SEQ ID NO: 2459427 - protein, 9 aa, Entamoeba dispar
SEEETEIEE

SEQ ID NO: 2459428 - protein, 14 aa, Entamoeba dispar
SEEETNKVEEEIKE

SEQ ID NO: 2459429 - protein, 7 aa, Entamoeba dispar
SEEETSN

SEQ ID NO: 2459430 - protein, 9 aa, Entamoeba dispar
SEEGDSPMN

SEQ ID NO: 2459431 - protein, 5 aa, Entamoeba dispar
SEEGE

SEQ ID NO: 2459432 - protein, 24 aa, Entamoeba dispar
SEEGFGQEDPKLKTLNEPKEGDYK

SEQ ID NO: 2459433 - protein, 7 aa, Entamoeba dispar
SEEGPGK

SEQ ID NO: 2459434 - protein, 9 aa, Entamoeba dispar
SEEGVQQAE

SEQ ID NO: 2459435 - protein, 7 aa, Entamoeba dispar
SEEGYSK

SEQ ID NO: 2459436 - protein, 13 aa, Entamoeba dispar
SEEIEDSHENYQK

SEQ ID NO: 2459437 - protein, 7 aa, Entamoeba dispar
SEEIGTR

SEQ ID NO: 2459438 - protein, 5 aa, Entamoeba dispar
SEEIK

SEQ ID NO: 2459439 - protein, 5 aa, Entamoeba dispar
SEEIN

SEQ ID NO: 2459440 - protein, 9 aa, Entamoeba dispar
SEEIRKKEK

SEQ ID NO: 2459441 - protein, 6 aa, Entamoeba dispar
SEEISN

SEQ ID NO: 2459442 - protein, 15 aa, Entamoeba dispar
SEEKEDTVNERLQEE

SEQ ID NO: 2459443 - protein, 10 aa, Entamoeba dispar
SEEKENEIQT

SEQ ID NO: 2459444 - protein, 8 aa, Entamoeba dispar
SEEKIGEV

SEQ ID NO: 2459445 - protein, 15 aa, Entamoeba dispar
SEEKIKKEKKPRNNQ

SEQ ID NO: 2459446 - protein, 5 aa, Entamoeba dispar
SEEKN

SEQ ID NO: 2459447 - protein, 11 aa, Entamoeba dispar
SEELEQPLNTG

SEQ ID NO: 2459448 - protein, 29 aa, Entamoeba dispar
SEELNEKRKEEITRLQKENEDLENKQQQL

SEQ ID NO: 2459449 - protein, 6 aa, Entamoeba dispar
SEEMAN

SEQ ID NO: 2459450 - protein, 11 aa, Entamoeba dispar
SEENGKEYKSL

SEQ ID NO: 2459451 - protein, 23 aa, Entamoeba dispar
SEENINPNISNSTNSKNSTTGIN

SEQ ID NO: 2459452 - protein, 6 aa, Entamoeba dispar
SEENSI

SEQ ID NO: 2459453 - protein, 7 aa, Entamoeba dispar
SEEPDRA

SEQ ID NO: 2459454 - protein, 6 aa, Entamoeba dispar
SEEPKL

SEQ ID NO: 2459455 - protein, 7 aa, Entamoeba dispar
SEEPPGI

SEQ ID NO: 2459456 - protein, 4 aa, Entamoeba dispar
SEEQ

SEQ ID NO: 2459457 - protein, 14 aa, Entamoeba dispar
SEEQIKEKNISQEI

SEQ ID NO: 2459458 - protein, 21 aa, Entamoeba dispar
SEERVSTTKEIKRAIESNDLE

SEQ ID NO: 2459459 - protein, 11 aa, Entamoeba dispar
SEESKRISSPL

SEQ ID NO: 2459460 - protein, 6 aa, Entamoeba dispar
SEETRI

SEQ ID NO: 2459461 - protein, 11 aa, Entamoeba dispar
SEEVNSSRQPL

SEQ ID NO: 2459462 - protein, 9 aa, Entamoeba dispar
SEEVPPPIY

SEQ ID NO: 2459463 - protein, 5 aa, Entamoeba dispar
SEEYR

SEQ ID NO: 2459464 - protein, 8 aa, Entamoeba dispar
SEFAPGTY

SEQ ID NO: 2459465 - protein, 5 aa, Entamoeba dispar
SEFAT

SEQ ID NO: 2459466 - protein, 6 aa, Entamoeba dispar
SEFDNE

SEQ ID NO: 2459467 - protein, 16 aa, Entamoeba dispar
SEFDPSTCEFANIFLI

SEQ ID NO: 2459468 - protein, 6 aa, Entamoeba dispar
SEFEAY

SEQ ID NO: 2459469 - protein, 13 aa, Entamoeba dispar
SEFKEKNTIICLM

SEQ ID NO: 2459470 - protein, 5 aa, Entamoeba dispar
SEFPE

SEQ ID NO: 2459471 - protein, 8 aa, Entamoeba dispar
SEFRTNGR

SEQ ID NO: 2459472 - protein, 9 aa, Entamoeba dispar
SEFSPDQYS

SEQ ID NO: 2459473 - protein, 15 aa, Entamoeba dispar
SEFTTQVDGITDKQQ

SEQ ID NO: 2459474 - protein, 4 aa, Entamoeba dispar
SEGD

SEQ ID NO: 2459475 - protein, 7 aa, Entamoeba dispar
SEGDESV

SEQ ID NO: 2459476 - protein, 8 aa, Entamoeba dispar
SEGDNAFS

SEQ ID NO: 2459477 - protein, 13 aa, Entamoeba dispar
SEGDSAQENYSVS

SEQ ID NO: 2459478 - protein, 11 aa, Entamoeba dispar
SEGEEEKMNQI

SEQ ID NO: 2459479 - protein, 4 aa, Entamoeba dispar
SEGF

SEQ ID NO: 2459480 - protein, 15 aa, Entamoeba dispar
SEGFEQYDSSKTEQV

SEQ ID NO: 2459481 - protein, 19 aa, Entamoeba dispar
SEGGISSLNELNDEQLNNT

SEQ ID NO: 2459482 - protein, 7 aa, Entamoeba dispar
SEGGNEL

SEQ ID NO: 2459483 - protein, 5 aa, Entamoeba dispar
SEGGP

SEQ ID NO: 2459484 - protein, 6 aa, Entamoeba dispar
SEGIDF

SEQ ID NO: 2459485 - protein, 5 aa, Entamoeba dispar
SEGIT

SEQ ID NO: 2459486 - protein, 14 aa, Entamoeba dispar
SEGKGAGKFEQGIE

SEQ ID NO: 2459487 - protein, 8 aa, Entamoeba dispar
SEGKKEKT

SEQ ID NO: 2459488 - protein, 15 aa, Entamoeba dispar
SEGKQNSTQSTGRFG

SEQ ID NO: 2459489 - protein, 8 aa, Entamoeba dispar
SEGKSGAD

SEQ ID NO: 2459490 - protein, 19 aa, Entamoeba dispar
SEGLTGQVDVTKDEFEAQC

SEQ ID NO: 2459491 - protein, 9 aa, Entamoeba dispar
SEGNKEPEL

SEQ ID NO: 2459492 - protein, 4 aa, Entamoeba dispar
SEGP

SEQ ID NO: 2459493 - protein, 8 aa, Entamoeba dispar
SEGPVQSS

SEQ ID NO: 2459494 - protein, 10 aa, Entamoeba dispar
SEGRNLSNNM

SEQ ID NO: 2459495 - protein, 6 aa, Entamoeba dispar
SEGSEA

SEQ ID NO: 2459496 - protein, 5 aa, Entamoeba dispar
SEGTV

SEQ ID NO: 2459497 - protein, 4 aa, Entamoeba dispar
SEGV

SEQ ID NO: 2459498 - protein, 5 aa, Entamoeba dispar
SEGVN

SEQ ID NO: 2459499 - protein, 11 aa, Entamoeba dispar
SEHEKRENALK

SEQ ID NO: 2459500 - protein, 6 aa, Entamoeba dispar
SEHPGV

SEQ ID NO: 2459501 - protein, 12 aa, Entamoeba dispar
SEHSKQKEDEGE

SEQ ID NO: 2459502 - protein, 5 aa, Entamoeba dispar
SEHSN

SEQ ID NO: 2459503 - protein, 6 aa, Entamoeba dispar
SEIANE

SEQ ID NO: 2459504 - protein, 6 aa, Entamoeba dispar
SEICQT

SEQ ID NO: 2459505 - protein, 16 aa, Entamoeba dispar
SEIDENIPQNQNGKLA

SEQ ID NO: 2459506 - protein, 4 aa, Entamoeba dispar
SEIE

SEQ ID NO: 2459507 - protein, 12 aa, Entamoeba dispar
SEIEEESKEEIP

SEQ ID NO: 2459508 - protein, 6 aa, Entamoeba dispar
SEIEER

SEQ ID NO: 2459509 - protein, 6 aa, Entamoeba dispar
SEIEET

SEQ ID NO: 2459510 - protein, 10 aa, Entamoeba dispar
SEIEGQPEAI

SEQ ID NO: 2459511 - protein, 6 aa, Entamoeba dispar
SEIEQM

SEQ ID NO: 2459512 - protein, 6 aa, Entamoeba dispar
SEIEQT

SEQ ID NO: 2459513 - protein, 4 aa, Entamoeba dispar
SEIG

SEQ ID NO: 2459514 - protein, 12 aa, Entamoeba dispar
SEIGNNSQVSIN

SEQ ID NO: 2459515 - protein, 13 aa, Entamoeba dispar
SEIHPQDIETAQV

SEQ ID NO: 2459516 - protein, 10 aa, Entamoeba dispar
SEIKGNKEVL

SEQ ID NO: 2459517 - protein, 13 aa, Entamoeba dispar
SEIKKQGNTYPTT

SEQ ID NO: 2459518 - protein, 9 aa, Entamoeba dispar
SEIKKRKKY

SEQ ID NO: 2459519 - protein, 8 aa, Entamoeba dispar
SEIKPNSI

SEQ ID NO: 2459520 - protein, 9 aa, Entamoeba dispar
SEIKTNKNV

SEQ ID NO: 2459521 - protein, 4 aa, Entamoeba dispar
SEIN

SEQ ID NO: 2459522 - protein, 12 aa, Entamoeba dispar
SEINGKDEITQL

SEQ ID NO: 2459523 - protein, 12 aa, Entamoeba dispar
SEINKNEKNNIK

SEQ ID NO: 2459524 - protein, 4 aa, Entamoeba dispar
SEIP

SEQ ID NO: 2459525 - protein, 10 aa, Entamoeba dispar
SEIPGISRSD

SEQ ID NO: 2459526 - protein, 6 aa, Entamoeba dispar
SEIPID

SEQ ID NO: 2459527 - protein, 6 aa, Entamoeba dispar
SEIPQE

SEQ ID NO: 2459528 - protein, 6 aa, Entamoeba dispar
SEIPVD

SEQ ID NO: 2459529 - protein, 11 aa, Entamoeba dispar
SEIQPRNMTTN

SEQ ID NO: 2459530 - protein, 11 aa, Entamoeba dispar
SEIRDSADKPN

SEQ ID NO: 2459531 - protein, 8 aa, Entamoeba dispar
SEIREDEY

SEQ ID NO: 2459532 - protein, 9 aa, Entamoeba dispar
SEISEEDLE

SEQ ID NO: 2459533 - protein, 17 aa, Entamoeba dispar
SEISKVRKTSKKPSLVT

SEQ ID NO: 2459534 - protein, 5 aa, Entamoeba dispar
SEITA

SEQ ID NO: 2459535 - protein, 5 aa, Entamoeba dispar
SEITD

SEQ ID NO: 2459536 - protein, 12 aa, Entamoeba dispar
SEITSAEEQSTF

SEQ ID NO: 2459537 - protein, 13 aa, Entamoeba dispar
SEITSTSKSIDTQ

SEQ ID NO: 2459538 - protein, 14 aa, Entamoeba dispar
SEITTSTKDRGTYA

SEQ ID NO: 2459539 - protein, 18 aa, Entamoeba dispar
SEKAQEKIKAVGGACELT

SEQ ID NO: 2459540 - protein, 5 aa, Entamoeba dispar
SEKDI

SEQ ID NO: 2459541 - protein, 8 aa, Entamoeba dispar
SEKDPTNA

SEQ ID NO: 2459542 - protein, 6 aa, Entamoeba dispar
SEKDYN

SEQ ID NO: 2459543 - protein, 10 aa, Entamoeba dispar
SEKEAETQIS

SEQ ID NO: 2459544 - protein, 8 aa, Entamoeba dispar
SEKEEDDI

SEQ ID NO: 2459545 - protein, 6 aa, Entamoeba dispar
SEKEGY

SEQ ID NO: 2459546 - protein, 12 aa, Entamoeba dispar
SEKEIDEKEQEV

SEQ ID NO: 2459547 - protein, 5 aa, Entamoeba dispar
SEKEK

SEQ ID NO: 2459548 - protein, 15 aa, Entamoeba dispar
SEKELKEIVKIQMGE

SEQ ID NO: 2459549 - protein, 10 aa, Entamoeba dispar
SEKELQKRSE

SEQ ID NO: 2459550 - protein, 10 aa, Entamoeba dispar
SEKEPQYQTQ

SEQ ID NO: 2459551 - protein, 30 aa, Entamoeba dispar
SEKEREKYSALAKENKKKDLEKEANEEKAL

SEQ ID NO: 2459552 - protein, 19 aa, Entamoeba dispar
SEKERKEKKEGGDLTGKIT

SEQ ID NO: 2459553 - protein, 34 aa, Entamoeba dispar
SEKESLSNELTQLKSDNEQKETELNQVKQEKEEV

SEQ ID NO: 2459554 - protein, 10 aa, Entamoeba dispar
SEKGKRQPGN

SEQ ID NO: 2459555 - protein, 9 aa, Entamoeba dispar
SEKGKVGEE

SEQ ID NO: 2459556 - protein, 8 aa, Entamoeba dispar
SEKGVSSI

SEQ ID NO: 2459557 - protein, 21 aa, Entamoeba dispar
SEKHNPSVDKEKARIESSGGK

SEQ ID NO: 2459558 - protein, 4 aa, Entamoeba dispar
SEKI

SEQ ID NO: 2459559 - protein, 5 aa, Entamoeba dispar
SEKIK

SEQ ID NO: 2459560 - protein, 7 aa, Entamoeba dispar
SEKIPST

SEQ ID NO: 2459561 - protein, 9 aa, Entamoeba dispar
SEKKEELAT

SEQ ID NO: 2459562 - protein, 13 aa, Entamoeba dispar
SEKKIDDYNGTGI

SEQ ID NO: 2459563 - protein, 23 aa, Entamoeba dispar
SEKKKDLDKHQNNEEEEQNPCNG

SEQ ID NO: 2459564 - protein, 14 aa, Entamoeba dispar
SEKKPDSRFKKDAR

SEQ ID NO: 2459565 - protein, 16 aa, Entamoeba dispar
SEKKQEKIPKKPQLTD

SEQ ID NO: 2459566 - protein, 6 aa, Entamoeba dispar
SEKKTK

SEQ ID NO: 2459567 - protein, 11 aa, Entamoeba dispar
SEKKTTDETKL

SEQ ID NO: 2459568 - protein, 6 aa, Entamoeba dispar
SEKKYN

SEQ ID NO: 2459569 - protein, 9 aa, Entamoeba dispar
SEKLKSENK

SEQ ID NO: 2459570 - protein, 5 aa, Entamoeba dispar
SEKLS

SEQ ID NO: 2459571 - protein, 4 aa, Entamoeba dispar
SEKN

SEQ ID NO: 2459572 - protein, 8 aa, Entamoeba dispar
SEKNEYKV

SEQ ID NO: 2459573 - protein, 8 aa, Entamoeba dispar
SEKPRPPF

SEQ ID NO: 2459574 - protein, 13 aa, Entamoeba dispar
SEKPTKRTENDPL

SEQ ID NO: 2459575 - protein, 7 aa, Entamoeba dispar
SEKPTLY

SEQ ID NO: 2459576 - protein, 6 aa, Entamoeba dispar
SEKQDW

SEQ ID NO: 2459577 - protein, 9 aa, Entamoeba dispar
SEKQTKSFP

SEQ ID NO: 2459578 - protein, 12 aa, Entamoeba dispar
SEKRIQYPNRWF

SEQ ID NO: 2459579 - protein, 9 aa, Entamoeba dispar
SEKRKGRRE

SEQ ID NO: 2459580 - protein, 29 aa, Entamoeba dispar
SEKRNEVKTVQNQPRKIPNDDKDNTLDEW

SEQ ID NO: 2459581 - protein, 19 aa, Entamoeba dispar
SEKRQESFNERDDQDDIKS

SEQ ID NO: 2459582 - protein, 6 aa, Entamoeba dispar
SEKRQI

SEQ ID NO: 2459583 - protein, 8 aa, Entamoeba dispar
SEKRQNQR

SEQ ID NO: 2459584 - protein, 13 aa, Entamoeba dispar
SEKSFIPEKRYKH

SEQ ID NO: 2459585 - protein, 11 aa, Entamoeba dispar
SEKSKFERPWN

SEQ ID NO: 2459586 - protein, 5 aa, Entamoeba dispar
SEKTD

SEQ ID NO: 2459587 - protein, 7 aa, Entamoeba dispar
SEKTDGL

SEQ ID NO: 2459588 - protein, 7 aa, Entamoeba dispar
SEKTDGV

SEQ ID NO: 2459589 - protein, 9 aa, Entamoeba dispar
SEKTEKTIN

SEQ ID NO: 2459590 - protein, 5 aa, Entamoeba dispar
SEKVK

SEQ ID NO: 2459591 - protein, 5 aa, Entamoeba dispar
SEKYE

SEQ ID NO: 2459592 - protein, 6 aa, Entamoeba dispar
SEKYGK

SEQ ID NO: 2459593 - protein, 7 aa, Entamoeba dispar
SEKYKKM

SEQ ID NO: 2459594 - protein, 15 aa, Entamoeba dispar
SEKYTSKVDENYKLS

SEQ ID NO: 2459595 - protein, 6 aa, Entamoeba dispar
SELEEK

SEQ ID NO: 2459596 - protein, 11 aa, Entamoeba dispar
SELEPKSSLLP

SEQ ID NO: 2459597 - protein, 15 aa, Entamoeba dispar
SELERQTSFKPNEPL

SEQ ID NO: 2459598 - protein, 8 aa, Entamoeba dispar
SELGNDYA

SEQ ID NO: 2459599 - protein, 10 aa, Entamoeba dispar
SELGSRYYRP

SEQ ID NO: 2459600 - protein, 6 aa, Entamoeba dispar
SELKPV

SEQ ID NO: 2459601 - protein, 5 aa, Entamoeba dispar
SELLE

SEQ ID NO: 2459602 - protein, 8 aa, Entamoeba dispar
SELNENNS

SEQ ID NO: 2459603 - protein, 8 aa, Entamoeba dispar
SELPDKER

SEQ ID NO: 2459604 - protein, 8 aa, Entamoeba dispar
SELPSSNL

SEQ ID NO: 2459605 - protein, 13 aa, Entamoeba dispar
SELQPYGLTQQNA

SEQ ID NO: 2459606 - protein, 11 aa, Entamoeba dispar
SELSSQYGNPI

SEQ ID NO: 2459607 - protein, 20 aa, Entamoeba dispar
SELSTTRKVKQYTPSEGINE

SEQ ID NO: 2459608 - protein, 13 aa, Entamoeba dispar
SELTKETEEERQK

SEQ ID NO: 2459609 - protein, 12 aa, Entamoeba dispar
SELTKPPRVKKV

SEQ ID NO: 2459610 - protein, 8 aa, Entamoeba dispar
SELTPQEE

SEQ ID NO: 2459611 - protein, 4 aa, Entamoeba dispar
SELY

SEQ ID NO: 2459612 - protein, 6 aa, Entamoeba dispar
SELYSE

SEQ ID NO: 2459613 - protein, 10 aa, Entamoeba dispar
SEMEEQKKEL

SEQ ID NO: 2459614 - protein, 6 aa, Entamoeba dispar
SEMENQ

SEQ ID NO: 2459615 - protein, 6 aa, Entamoeba dispar
SEMIES

SEQ ID NO: 2459616 - protein, 13 aa, Entamoeba dispar
SEMKKITEEWSNE

SEQ ID NO: 2459617 - protein, 7 aa, Entamoeba dispar
SEMPKKG

SEQ ID NO: 2459618 - protein, 8 aa, Entamoeba dispar
SEMRESDV

SEQ ID NO: 2459619 - protein, 71 aa, Entamoeba dispar
SEMSEIPSSNQQVIQPQELPSNPHLNQTSPTKQVKTSPLTQPNTPHSNTEHQTTEETTSTQSKRGRRAQSI

SEQ ID NO: 2459620 - protein, 25 aa, Entamoeba dispar
SEMSSKYSAQIKEKQELIDKERTEK

SEQ ID NO: 2459621 - protein, 5 aa, Entamoeba dispar
SEMYT

SEQ ID NO: 2459622 - protein, 4 aa, Entamoeba dispar
SENA

SEQ ID NO: 2459623 - protein, 5 aa, Entamoeba dispar
SENAP

SEQ ID NO: 2459624 - protein, 19 aa, Entamoeba dispar
SENASLKDEIKSLSEQLDR

SEQ ID NO: 2459625 - protein, 5 aa, Entamoeba dispar
SENAV

SEQ ID NO: 2459626 - protein, 19 aa, Entamoeba dispar
SENDEKKPGYKERVEGYKK

SEQ ID NO: 2459627 - protein, 11 aa, Entamoeba dispar
SENDKKKLRDI

SEQ ID NO: 2459628 - protein, 6 aa, Entamoeba dispar
SENECS

SEQ ID NO: 2459629 - protein, 10 aa, Entamoeba dispar
SENEDKNDPI

SEQ ID NO: 2459630 - protein, 17 aa, Entamoeba dispar
SENEEKKTGYKERIEGY

SEQ ID NO: 2459631 - protein, 28 aa, Entamoeba dispar
SENEEKKTGYKERVEGYKELKKANETIE

SEQ ID NO: 2459632 - protein, 20 aa, Entamoeba dispar
SENEMPAAPSEVEEAKEEGV

SEQ ID NO: 2459633 - protein, 10 aa, Entamoeba dispar
SENENKNDPI

SEQ ID NO: 2459634 - protein, 17 aa, Entamoeba dispar
SENEQKKSGYKERIEGY

SEQ ID NO: 2459635 - protein, 14 aa, Entamoeba dispar
SENEQLNNEMTNDS

SEQ ID NO: 2459636 - protein, 9 aa, Entamoeba dispar
SENESDDQL

SEQ ID NO: 2459637 - protein, 9 aa, Entamoeba dispar
SENETDYNV

SEQ ID NO: 2459638 - protein, 5 aa, Entamoeba dispar
SENGN

SEQ ID NO: 2459639 - protein, 17 aa, Entamoeba dispar
SENGTYNYTPSPLTDGI

SEQ ID NO: 2459640 - protein, 17 aa, Entamoeba dispar
SENHTKSFGKSMSRSGS

SEQ ID NO: 2459641 - protein, 4 aa, Entamoeba dispar
SENI

SEQ ID NO: 2459642 - protein, 6 aa, Entamoeba dispar
SENISL

SEQ ID NO: 2459643 - protein, 19 aa, Entamoeba dispar
SENKSTEEQEKLSGGNTPE

SEQ ID NO: 2459644 - protein, 14 aa, Entamoeba dispar
SENLPKQSQFEVST

SEQ ID NO: 2459645 - protein, 9 aa, Entamoeba dispar
SENNDVTEN

SEQ ID NO: 2459646 - protein, 8 aa, Entamoeba dispar
SENNNNQV

SEQ ID NO: 2459647 - protein, 27 aa, Entamoeba dispar
SENNSPKMSSSPMNEEHSTTFFHPIYT

SEQ ID NO: 2459648 - protein, 7 aa, Entamoeba dispar
SENPVCE

SEQ ID NO: 2459649 - protein, 10 aa, Entamoeba dispar
SENPYEAPGF

SEQ ID NO: 2459650 - protein, 11 aa, Entamoeba dispar
SENQEKDSSDL

SEQ ID NO: 2459651 - protein, 8 aa, Entamoeba dispar
SENQPTSP

SEQ ID NO: 2459652 - protein, 11 aa, Entamoeba dispar
SENSDNRKVTQ

SEQ ID NO: 2459653 - protein, 6 aa, Entamoeba dispar
SENSEY

SEQ ID NO: 2459654 - protein, 6 aa, Entamoeba dispar
SENSIK

SEQ ID NO: 2459655 - protein, 9 aa, Entamoeba dispar
SENSQLESD

SEQ ID NO: 2459656 - protein, 6 aa, Entamoeba dispar
SENSSL

SEQ ID NO: 2459657 - protein, 7 aa, Entamoeba dispar
SENSTCS

SEQ ID NO: 2459658 - protein, 9 aa, Entamoeba dispar
SENSTTAKG

SEQ ID NO: 2459659 - protein, 7 aa, Entamoeba dispar
SENSYYR

SEQ ID NO: 2459660 - protein, 4 aa, Entamoeba dispar
SENT

SEQ ID NO: 2459661 - protein, 6 aa, Entamoeba dispar
SENTQQ

SEQ ID NO: 2459662 - protein, 5 aa, Entamoeba dispar
SENVE

SEQ ID NO: 2459663 - protein, 10 aa, Entamoeba dispar
SEPDHSGSLS

SEQ ID NO: 2459664 - protein, 5 aa, Entamoeba dispar
SEPEV

SEQ ID NO: 2459665 - protein, 4 aa, Entamoeba dispar
SEPF

SEQ ID NO: 2459666 - protein, 5 aa, Entamoeba dispar
SEPHV

SEQ ID NO: 2459667 - protein, 6 aa, Entamoeba dispar
SEPIPQ

SEQ ID NO: 2459668 - protein, 13 aa, Entamoeba dispar
SEPLQEVKREKDA

SEQ ID NO: 2459669 - protein, 6 aa, Entamoeba dispar
SEPNEI

SEQ ID NO: 2459670 - protein, 9 aa, Entamoeba dispar
SEPNGNGFE

SEQ ID NO: 2459671 - protein, 5 aa, Entamoeba dispar
SEPNK

SEQ ID NO: 2459672 - protein, 7 aa, Entamoeba dispar
SEPPIPT

SEQ ID NO: 2459673 - protein, 8 aa, Entamoeba dispar
SEPPPSNC

SEQ ID NO: 2459674 - protein, 24 aa, Entamoeba dispar
SEPPQVSPSNIKYGYSQSHPMSRM

SEQ ID NO: 2459675 - protein, 8 aa, Entamoeba dispar
SEPPSNPQ

SEQ ID NO: 2459676 - protein, 7 aa, Entamoeba dispar
SEPPSNR

SEQ ID NO: 2459677 - protein, 6 aa, Entamoeba dispar
SEPPTD

SEQ ID NO: 2459678 - protein, 6 aa, Entamoeba dispar
SEPQIQ

SEQ ID NO: 2459679 - protein, 8 aa, Entamoeba dispar
SEPQTTAR

SEQ ID NO: 2459680 - protein, 7 aa, Entamoeba dispar
SEPSIQK

SEQ ID NO: 2459681 - protein, 65 aa, Entamoeba dispar
SEPSQIKKTEIPPTPTKEATPELITSERKERREKKRQQIEKEKEKLRKMEESRKERTMKKEELKR

SEQ ID NO: 2459682 - protein, 27 aa, Entamoeba dispar
SEPSVTEDVTKKHTDIEKKETDNKQPK

SEQ ID NO: 2459683 - protein, 17 aa, Entamoeba dispar
SEPTDKKRKSVSNEIKE

SEQ ID NO: 2459684 - protein, 7 aa, Entamoeba dispar
SEPTKIS

SEQ ID NO: 2459685 - protein, 7 aa, Entamoeba dispar
SEPTRTV

SEQ ID NO: 2459686 - protein, 14 aa, Entamoeba dispar
SEPTSTVISRSGDE

SEQ ID NO: 2459687 - protein, 6 aa, Entamoeba dispar
SEPVSK

SEQ ID NO: 2459688 - protein, 14 aa, Entamoeba dispar
SEQAEKENDVETQL

SEQ ID NO: 2459689 - protein, 6 aa, Entamoeba dispar
SEQAKS

SEQ ID NO: 2459690 - protein, 5 aa, Entamoeba dispar
SEQED

SEQ ID NO: 2459691 - protein, 13 aa, Entamoeba dispar
SEQGVSENQITPS

SEQ ID NO: 2459692 - protein, 4 aa, Entamoeba dispar
SEQI

SEQ ID NO: 2459693 - protein, 7 aa, Entamoeba dispar
SEQIEEL

SEQ ID NO: 2459694 - protein, 8 aa, Entamoeba dispar
SEQISTYK

SEQ ID NO: 2459695 - protein, 5 aa, Entamoeba dispar
SEQKE

SEQ ID NO: 2459696 - protein, 6 aa, Entamoeba dispar
SEQKNI

SEQ ID NO: 2459697 - protein, 13 aa, Entamoeba dispar
SEQKRKKASQKKV

SEQ ID NO: 2459698 - protein, 5 aa, Entamoeba dispar
SEQKY

SEQ ID NO: 2459699 - protein, 11 aa, Entamoeba dispar
SEQLKKRSSRI

SEQ ID NO: 2459700 - protein, 17 aa, Entamoeba dispar
SEQMPESDIEDADKSTT

SEQ ID NO: 2459701 - protein, 4 aa, Entamoeba dispar
SEQN

SEQ ID NO: 2459702 - protein, 15 aa, Entamoeba dispar
SEQNQIPKTEQQKKV

SEQ ID NO: 2459703 - protein, 16 aa, Entamoeba dispar
SEQNTEKPTTDDQQTN

SEQ ID NO: 2459704 - protein, 7 aa, Entamoeba dispar
SEQPQKL

SEQ ID NO: 2459705 - protein, 4 aa, Entamoeba dispar
SEQQ

SEQ ID NO: 2459706 - protein, 22 aa, Entamoeba dispar
SEQQASSPSTKSPEQQQKAKIN

SEQ ID NO: 2459707 - protein, 7 aa, Entamoeba dispar
SEQQEKA

SEQ ID NO: 2459708 - protein, 8 aa, Entamoeba dispar
SEQRGDDE

SEQ ID NO: 2459709 - protein, 11 aa, Entamoeba dispar
SEQRSEEIISK

SEQ ID NO: 2459710 - protein, 27 aa, Entamoeba dispar
SEQSSQLKKYSQTTSGSSALSSNGSWS

SEQ ID NO: 2459711 - protein, 5 aa, Entamoeba dispar
SEQTE

SEQ ID NO: 2459712 - protein, 4 aa, Entamoeba dispar
SEQV

SEQ ID NO: 2459713 - protein, 6 aa, Entamoeba dispar
SERAQE

SEQ ID NO: 2459714 - protein, 6 aa, Entamoeba dispar
SERASD

SEQ ID NO: 2459715 - protein, 7 aa, Entamoeba dispar
SERDPIE

SEQ ID NO: 2459716 - protein, 26 aa, Entamoeba dispar
SERENLQNEIKTKDNVISSSKAELDN

SEQ ID NO: 2459717 - protein, 5 aa, Entamoeba dispar
SERGL

SEQ ID NO: 2459718 - protein, 11 aa, Entamoeba dispar
SERKKAALSLE

SEQ ID NO: 2459719 - protein, 6 aa, Entamoeba dispar
SERLDD

SEQ ID NO: 2459720 - protein, 6 aa, Entamoeba dispar
SERLTE

SEQ ID NO: 2459721 - protein, 5 aa, Entamoeba dispar
SERMK

SEQ ID NO: 2459722 - protein, 7 aa, Entamoeba dispar
SERMKEK

SEQ ID NO: 2459723 - protein, 9 aa, Entamoeba dispar
SERNEWEKE

SEQ ID NO: 2459724 - protein, 6 aa, Entamoeba dispar
SERNNK

SEQ ID NO: 2459725 - protein, 18 aa, Entamoeba dispar
SERPSQRLSASTETNKPF

SEQ ID NO: 2459726 - protein, 11 aa, Entamoeba dispar
SERREQTSIDE

SEQ ID NO: 2459727 - protein, 4 aa, Entamoeba dispar
SERS

SEQ ID NO: 2459728 - protein, 15 aa, Entamoeba dispar
SERSKNDEDKIINED

SEQ ID NO: 2459729 - protein, 7 aa, Entamoeba dispar
SERSSPK

SEQ ID NO: 2459730 - protein, 6 aa, Entamoeba dispar
SERYST

SEQ ID NO: 2459731 - protein, 18 aa, Entamoeba dispar
SESCQKMSSSQQFIGKND

SEQ ID NO: 2459732 - protein, 4 aa, Entamoeba dispar
SESD

SEQ ID NO: 2459733 - protein, 6 aa, Entamoeba dispar
SESECA

SEQ ID NO: 2459734 - protein, 14 aa, Entamoeba dispar
SESEEKKNGYQKRI

SEQ ID NO: 2459735 - protein, 9 aa, Entamoeba dispar
SESEQPSRR

SEQ ID NO: 2459736 - protein, 9 aa, Entamoeba dispar
SESGEANEI

SEQ ID NO: 2459737 - protein, 7 aa, Entamoeba dispar
SESGGDE

SEQ ID NO: 2459738 - protein, 8 aa, Entamoeba dispar
SESGRRPF

SEQ ID NO: 2459739 - protein, 9 aa, Entamoeba dispar
SESGTDGEV

SEQ ID NO: 2459740 - protein, 8 aa, Entamoeba dispar
SESHKPQF

SEQ ID NO: 2459741 - protein, 5 aa, Entamoeba dispar
SESIG

SEQ ID NO: 2459742 - protein, 22 aa, Entamoeba dispar
SESIKGARVTHGTNKPPKEKME

SEQ ID NO: 2459743 - protein, 13 aa, Entamoeba dispar
SESIKSGRITAST

SEQ ID NO: 2459744 - protein, 13 aa, Entamoeba dispar
SESKQSYKENQTK

SEQ ID NO: 2459745 - protein, 10 aa, Entamoeba dispar
SESKSSLPLT

SEQ ID NO: 2459746 - protein, 8 aa, Entamoeba dispar
SESNYDSF

SEQ ID NO: 2459747 - protein, 7 aa, Entamoeba dispar
SESPGEC

SEQ ID NO: 2459748 - protein, 16 aa, Entamoeba dispar
SESPVEDLVGDKDKLC

SEQ ID NO: 2459749 - protein, 5 aa, Entamoeba dispar
SESQP

SEQ ID NO: 2459750 - protein, 11 aa, Entamoeba dispar
SESSAKRSQID

SEQ ID NO: 2459751 - protein, 8 aa, Entamoeba dispar
SESSDGNE

SEQ ID NO: 2459752 - protein, 9 aa, Entamoeba dispar
SESSEDNEM

SEQ ID NO: 2459753 - protein, 12 aa, Entamoeba dispar
SESSESLKDINE

SEQ ID NO: 2459754 - protein, 52 aa, Entamoeba dispar
SESSSSSSSASSSYSEERHSRDKKEKKKSEKKPKKEGARELKRRKKEEIATL

SEQ ID NO: 2459755 - protein, 10 aa, Entamoeba dispar
SESSTKRYVP

SEQ ID NO: 2459756 - protein, 6 aa, Entamoeba dispar
SESTKN

SEQ ID NO: 2459757 - protein, 7 aa, Entamoeba dispar
SESTMTE

SEQ ID NO: 2459758 - protein, 7 aa, Entamoeba dispar
SESTNEI

SEQ ID NO: 2459759 - protein, 10 aa, Entamoeba dispar
SESVDQKTDL

SEQ ID NO: 2459760 - protein, 7 aa, Entamoeba dispar
SESVIDN

SEQ ID NO: 2459761 - protein, 6 aa, Entamoeba dispar
SESYDE

SEQ ID NO: 2459762 - protein, 11 aa, Entamoeba dispar
SETCQGDEQET

SEQ ID NO: 2459763 - protein, 7 aa, Entamoeba dispar
SETEEDI

SEQ ID NO: 2459764 - protein, 15 aa, Entamoeba dispar
SETEIGESQDKADIQ

SEQ ID NO: 2459765 - protein, 17 aa, Entamoeba dispar
SETEKIAKQKNNETALK

SEQ ID NO: 2459766 - protein, 6 aa, Entamoeba dispar
SETEKL

SEQ ID NO: 2459767 - protein, 8 aa, Entamoeba dispar
SETFDKDI

SEQ ID NO: 2459768 - protein, 22 aa, Entamoeba dispar
SETGPHPKQEEEEEKGTPSIQI

SEQ ID NO: 2459769 - protein, 6 aa, Entamoeba dispar
SETIEY

SEQ ID NO: 2459770 - protein, 7 aa, Entamoeba dispar
SETIITE

SEQ ID NO: 2459771 - protein, 4 aa, Entamoeba dispar
SETK

SEQ ID NO: 2459772 - protein, 22 aa, Entamoeba dispar
SETKATTVAADVSKDPTYPKTT

SEQ ID NO: 2459773 - protein, 9 aa, Entamoeba dispar
SETKMSEQE

SEQ ID NO: 2459774 - protein, 26 aa, Entamoeba dispar
SETKQYSKLKESLNTIKQTTEKNDNM

SEQ ID NO: 2459775 - protein, 5 aa, Entamoeba dispar
SETLP

SEQ ID NO: 2459776 - protein, 4 aa, Entamoeba dispar
SETN

SEQ ID NO: 2459777 - protein, 10 aa, Entamoeba dispar
SETPSSIATS

SEQ ID NO: 2459778 - protein, 4 aa, Entamoeba dispar
SETQ

SEQ ID NO: 2459779 - protein, 9 aa, Entamoeba dispar
SETQQSNVV

SEQ ID NO: 2459780 - protein, 19 aa, Entamoeba dispar
SETQSIKISTNNHLSTRSS

SEQ ID NO: 2459781 - protein, 7 aa, Entamoeba dispar
SETSITN

SEQ ID NO: 2459782 - protein, 5 aa, Entamoeba dispar
SETSL

SEQ ID NO: 2459783 - protein, 11 aa, Entamoeba dispar
SETSSKKKEGY

SEQ ID NO: 2459784 - protein, 4 aa, Entamoeba dispar
SETT

SEQ ID NO: 2459785 - protein, 14 aa, Entamoeba dispar
SETTDNGDKERFNE

SEQ ID NO: 2459786 - protein, 9 aa, Entamoeba dispar
SETTGYNKD

SEQ ID NO: 2459787 - protein, 13 aa, Entamoeba dispar
SETTYSNASRRQG

SEQ ID NO: 2459788 - protein, 6 aa, Entamoeba dispar
SETVDT

SEQ ID NO: 2459789 - protein, 6 aa, Entamoeba dispar
SETVET

SEQ ID NO: 2459790 - protein, 5 aa, Entamoeba dispar
SEVDE

SEQ ID NO: 2459791 - protein, 25 aa, Entamoeba dispar
SEVDEEQKKLQEAQEAQRKKEWEEI

SEQ ID NO: 2459792 - protein, 64 aa, Entamoeba dispar
SEVDEEQKKLQEAQEAQRKKEWEEIKKKQKEEEKKKEEAKKMEEEKPKEESKKENIPMEEEKKE

SEQ ID NO: 2459793 - protein, 8 aa, Entamoeba dispar
SEVENKQD

SEQ ID NO: 2459794 - protein, 52 aa, Entamoeba dispar
SEVERERNKREERAERRREQRKENNKINVQEEENNITENIAEKENIKEKTPL

SEQ ID NO: 2459795 - protein, 6 aa, Entamoeba dispar
SEVETK

SEQ ID NO: 2459796 - protein, 21 aa, Entamoeba dispar
SEVKTEEPKEEKKQTKIKTSK

SEQ ID NO: 2459797 - protein, 10 aa, Entamoeba dispar
SEVKTRKESQ

SEQ ID NO: 2459798 - protein, 7 aa, Entamoeba dispar
SEVLSDK

SEQ ID NO: 2459799 - protein, 5 aa, Entamoeba dispar
SEVND

SEQ ID NO: 2459800 - protein, 10 aa, Entamoeba dispar
SEVPNVTPRV

SEQ ID NO: 2459801 - protein, 4 aa, Entamoeba dispar
SEVQ

SEQ ID NO: 2459802 - protein, 10 aa, Entamoeba dispar
SEVRTATRRI

SEQ ID NO: 2459803 - protein, 5 aa, Entamoeba dispar
SEVTS

SEQ ID NO: 2459804 - protein, 20 aa, Entamoeba dispar
SEVTSNAPKDVFNEAKKATE

SEQ ID NO: 2459805 - protein, 26 aa, Entamoeba dispar
SEVYPKQAEALANPLDNPELFVLPEQ

SEQ ID NO: 2459806 - protein, 9 aa, Entamoeba dispar
SEWDPDSPE

SEQ ID NO: 2459807 - protein, 9 aa, Entamoeba dispar
SEWEGQKRI

SEQ ID NO: 2459808 - protein, 20 aa, Entamoeba dispar
SEYEKDRTYKDMDKFLSDYL

SEQ ID NO: 2459809 - protein, 5 aa, Entamoeba dispar
SEYEY

SEQ ID NO: 2459810 - protein, 4 aa, Entamoeba dispar
SEYN

SEQ ID NO: 2459811 - protein, 6 aa, Entamoeba dispar
SEYPEI

SEQ ID NO: 2459812 - protein, 5 aa, Entamoeba dispar
SEYPT

SEQ ID NO: 2459813 - protein, 9 aa, Entamoeba dispar
SEYQKKTPF

SEQ ID NO: 2459814 - protein, 5 aa, Entamoeba dispar
SEYQN

SEQ ID NO: 2459815 - protein, 6 aa, Entamoeba dispar
SEYSDY

SEQ ID NO: 2459816 - protein, 7 aa, Entamoeba dispar
SEYSQKQ

SEQ ID NO: 2459817 - protein, 6 aa, Entamoeba dispar
SEYTNN

SEQ ID NO: 2459818 - protein, 34 aa, Entamoeba dispar
SEYTTEAGGSRGSSYRTPTLGSAPESPRKTHTDK

SEQ ID NO: 2459819 - protein, 6 aa, Entamoeba dispar
SFADSN

SEQ ID NO: 2459820 - protein, 4 aa, Entamoeba dispar
SFAK

SEQ ID NO: 2459821 - protein, 19 aa, Entamoeba dispar
SFAKQPQWKQKNAKARVGL

SEQ ID NO: 2459822 - protein, 9 aa, Entamoeba dispar
SFAPPPKRE

SEQ ID NO: 2459823 - protein, 18 aa, Entamoeba dispar
SFAPPPVKPFINYTNPFL

SEQ ID NO: 2459824 - protein, 7 aa, Entamoeba dispar
SFASTRT

SEQ ID NO: 2459825 - protein, 5 aa, Entamoeba dispar
SFDKN

SEQ ID NO: 2459826 - protein, 5 aa, Entamoeba dispar
SFDKS

SEQ ID NO: 2459827 - protein, 18 aa, Entamoeba dispar
SFDPNKVPTLQSLQESKL

SEQ ID NO: 2459828 - protein, 7 aa, Entamoeba dispar
SFDPPEL

SEQ ID NO: 2459829 - protein, 6 aa, Entamoeba dispar
SFDPTG

SEQ ID NO: 2459830 - protein, 11 aa, Entamoeba dispar
SFDSPKIKVTP

SEQ ID NO: 2459831 - protein, 18 aa, Entamoeba dispar
SFDSQQYPGYNVPQGMQQ

SEQ ID NO: 2459832 - protein, 10 aa, Entamoeba dispar
SFDSQRRTEL

SEQ ID NO: 2459833 - protein, 5 aa, Entamoeba dispar
SFDTD

SEQ ID NO: 2459834 - protein, 7 aa, Entamoeba dispar
SFEDQHN

SEQ ID NO: 2459835 - protein, 5 aa, Entamoeba dispar
SFEEC

SEQ ID NO: 2459836 - protein, 21 aa, Entamoeba dispar
SFEEEGLKEFKDKTIQLPFIL

SEQ ID NO: 2459837 - protein, 23 aa, Entamoeba dispar
SFEEETNETRDSTDSKQDAKSDN

SEQ ID NO: 2459838 - protein, 34 aa, Entamoeba dispar
SFEENGSELKEEDDELKEEDDELKEEQENTENIK

SEQ ID NO: 2459839 - protein, 5 aa, Entamoeba dispar
SFEER

SEQ ID NO: 2459840 - protein, 11 aa, Entamoeba dispar
SFEKSKEGGVL

SEQ ID NO: 2459841 - protein, 4 aa, Entamoeba dispar
SFEN

SEQ ID NO: 2459842 - protein, 6 aa, Entamoeba dispar
SFENTD

SEQ ID NO: 2459843 - protein, 5 aa, Entamoeba dispar
SFEST

SEQ ID NO: 2459844 - protein, 4 aa, Entamoeba dispar
SFET

SEQ ID NO: 2459845 - protein, 10 aa, Entamoeba dispar
SFETNNTSAV

SEQ ID NO: 2459846 - protein, 6 aa, Entamoeba dispar
SFEVPT

SEQ ID NO: 2459847 - protein, 7 aa, Entamoeba dispar
SFGDEES

SEQ ID NO: 2459848 - protein, 8 aa, Entamoeba dispar
SFGEDDED

SEQ ID NO: 2459849 - protein, 10 aa, Entamoeba dispar
SFGGEDAPEP

SEQ ID NO: 2459850 - protein, 27 aa, Entamoeba dispar
SFGGNVNNKVNGKYNNEPNQSKSSGGL

SEQ ID NO: 2459851 - protein, 5 aa, Entamoeba dispar
SFGIK

SEQ ID NO: 2459852 - protein, 5 aa, Entamoeba dispar
SFGPV

SEQ ID NO: 2459853 - protein, 96 aa, Entamoeba dispar
SFGQTNTQQNRLSGLGSFGNTTGFGQNNTQQNPFGGFGQTNNQQSNGFGSFGQTNTQTSGFGSTTGFGQTSQQQNGFGGFGNTTGFGQTNNQQGGF

SEQ ID NO: 2459854 - protein, 7 aa, Entamoeba dispar
SFGSYTR

SEQ ID NO: 2459855 - protein, 34 aa, Entamoeba dispar
SFGTIPPVRQTQNNLVTNTQRYPITTSTNSIQPN

SEQ ID NO: 2459856 - protein, 15 aa, Entamoeba dispar
SFHDSESKKRQYAKD

SEQ ID NO: 2459857 - protein, 4 aa, Entamoeba dispar
SFHP

SEQ ID NO: 2459858 - protein, 16 aa, Entamoeba dispar
SFHSTSNSASLSPSSG

SEQ ID NO: 2459859 - protein, 4 aa, Entamoeba dispar
SFIS

SEQ ID NO: 2459860 - protein, 11 aa, Entamoeba dispar
SFKDKKPNGDI

SEQ ID NO: 2459861 - protein, 9 aa, Entamoeba dispar
SFKEKYKEH

SEQ ID NO: 2459862 - protein, 4 aa, Entamoeba dispar
SFKG

SEQ ID NO: 2459863 - protein, 22 aa, Entamoeba dispar
SFKNRASEPPKDTSSSKEFEEL

SEQ ID NO: 2459864 - protein, 8 aa, Entamoeba dispar
SFKPPSQA

SEQ ID NO: 2459865 - protein, 6 aa, Entamoeba dispar
SFKPTK

SEQ ID NO: 2459866 - protein, 6 aa, Entamoeba dispar
SFKRYQ

SEQ ID NO: 2459867 - protein, 6 aa, Entamoeba dispar
SFKSTF

SEQ ID NO: 2459868 - protein, 4 aa, Entamoeba dispar
SFKT

SEQ ID NO: 2459869 - protein, 20 aa, Entamoeba dispar
SFNAPSKKAMTFTKPTQRGN

SEQ ID NO: 2459870 - protein, 12 aa, Entamoeba dispar
SFNEQNKKINEI

SEQ ID NO: 2459871 - protein, 9 aa, Entamoeba dispar
SFNESTSSF

SEQ ID NO: 2459872 - protein, 5 aa, Entamoeba dispar
SFNGQ

SEQ ID NO: 2459873 - protein, 6 aa, Entamoeba dispar
SFNNNN

SEQ ID NO: 2459874 - protein, 5 aa, Entamoeba dispar
SFNPY

SEQ ID NO: 2459875 - protein, 13 aa, Entamoeba dispar
SFNQTNRNTQTEI

SEQ ID NO: 2459876 - protein, 11 aa, Entamoeba dispar
SFNSFRKRTEL

SEQ ID NO: 2459877 - protein, 5 aa, Entamoeba dispar
SFNSK

SEQ ID NO: 2459878 - protein, 7 aa, Entamoeba dispar
SFNSYSS

SEQ ID NO: 2459879 - protein, 7 aa, Entamoeba dispar
SFNTKQH

SEQ ID NO: 2459880 - protein, 10 aa, Entamoeba dispar
SFNVEDDNQK

SEQ ID NO: 2459881 - protein, 5 aa, Entamoeba dispar
SFPDD

SEQ ID NO: 2459882 - protein, 6 aa, Entamoeba dispar
SFPEET

SEQ ID NO: 2459883 - protein, 14 aa, Entamoeba dispar
SFPELSKQGAFNQE

SEQ ID NO: 2459884 - protein, 7 aa, Entamoeba dispar
SFPGDTK

SEQ ID NO: 2459885 - protein, 7 aa, Entamoeba dispar
SFPPTDP

SEQ ID NO: 2459886 - protein, 6 aa, Entamoeba dispar
SFPRDT

SEQ ID NO: 2459887 - protein, 4 aa, Entamoeba dispar
SFPT

SEQ ID NO: 2459888 - protein, 4 aa, Entamoeba dispar
SFQE

SEQ ID NO: 2459889 - protein, 6 aa, Entamoeba dispar
SFQGRE

SEQ ID NO: 2459890 - protein, 7 aa, Entamoeba dispar
SFQKEED

SEQ ID NO: 2459891 - protein, 15 aa, Entamoeba dispar
SFQSPKHSYGSHDTD

SEQ ID NO: 2459892 - protein, 32 aa, Entamoeba dispar
SFRDRKKSAKIVEEEQLDEYESESEKKKSTTI

SEQ ID NO: 2459893 - protein, 7 aa, Entamoeba dispar
SFRDSKQ

SEQ ID NO: 2459894 - protein, 11 aa, Entamoeba dispar
SFRGKDEKKDK

SEQ ID NO: 2459895 - protein, 13 aa, Entamoeba dispar
SFRKTRNVQANQQ

SEQ ID NO: 2459896 - protein, 23 aa, Entamoeba dispar
SFRNESQIRNESGLKEKRASDRK

SEQ ID NO: 2459897 - protein, 4 aa, Entamoeba dispar
SFRT

SEQ ID NO: 2459898 - protein, 11 aa, Entamoeba dispar
SFSDNSQSNNF

SEQ ID NO: 2459899 - protein, 20 aa, Entamoeba dispar
SFSEDTSTNKSYDKEEQTVC

SEQ ID NO: 2459900 - protein, 6 aa, Entamoeba dispar
SFSKKD

SEQ ID NO: 2459901 - protein, 16 aa, Entamoeba dispar
SFSKKDKKKDKKEIDD

SEQ ID NO: 2459902 - protein, 37 aa, Entamoeba dispar
SFSKRSSTENTGHSSSEHSGTSSLASETTAEEVNRSV

SEQ ID NO: 2459903 - protein, 30 aa, Entamoeba dispar
SFSKTTDANSLKSAVQSFQQAAGAFQKAED

SEQ ID NO: 2459904 - protein, 12 aa, Entamoeba dispar
SFSMGPDDYGVQ

SEQ ID NO: 2459905 - protein, 13 aa, Entamoeba dispar
SFSNDGKQLATAS

SEQ ID NO: 2459906 - protein, 6 aa, Entamoeba dispar
SFSNEY

SEQ ID NO: 2459907 - protein, 7 aa, Entamoeba dispar
SFSPKDP

SEQ ID NO: 2459908 - protein, 10 aa, Entamoeba dispar
SFSPKRKYLD

SEQ ID NO: 2459909 - protein, 13 aa, Entamoeba dispar
SFSPSRRAFTPKV

SEQ ID NO: 2459910 - protein, 11 aa, Entamoeba dispar
SFSSETKPIDI

SEQ ID NO: 2459911 - protein, 41 aa, Entamoeba dispar
SFSTDNVNDGSDLKSPKPSSNNGSLVGTDESPRLLSPRDPT

SEQ ID NO: 2459912 - protein, 42 aa, Entamoeba dispar
SFSTDNVNDVSDLKSPKPSSNNGSLVGTDESPRLLSPRDPTH

SEQ ID NO: 2459913 - protein, 15 aa, Entamoeba dispar
SFSTPFTSTSFSLPF

SEQ ID NO: 2459914 - protein, 20 aa, Entamoeba dispar
SFTDKNGSFYSGASLNEKEN

SEQ ID NO: 2459915 - protein, 11 aa, Entamoeba dispar
SFTEEDYQETT

SEQ ID NO: 2459916 - protein, 10 aa, Entamoeba dispar
SFTEGTGIEN

SEQ ID NO: 2459917 - protein, 14 aa, Entamoeba dispar
SFTEKRSKSFNPMT

SEQ ID NO: 2459918 - protein, 4 aa, Entamoeba dispar
SFTG

SEQ ID NO: 2459919 - protein, 7 aa, Entamoeba dispar
SFTGKTS

SEQ ID NO: 2459920 - protein, 9 aa, Entamoeba dispar
SFTKEEKTI

SEQ ID NO: 2459921 - protein, 7 aa, Entamoeba dispar
SFTPARD

SEQ ID NO: 2459922 - protein, 8 aa, Entamoeba dispar
SFTPSPKL

SEQ ID NO: 2459923 - protein, 22 aa, Entamoeba dispar
SFTPSTPRAESPQLPEQKDDFK

SEQ ID NO: 2459924 - protein, 5 aa, Entamoeba dispar
SFTSG

SEQ ID NO: 2459925 - protein, 8 aa, Entamoeba dispar
SFTSGNNH

SEQ ID NO: 2459926 - protein, 4 aa, Entamoeba dispar
SFTT

SEQ ID NO: 2459927 - protein, 4 aa, Entamoeba dispar
SFVG

SEQ ID NO: 2459928 - protein, 6 aa, Entamoeba dispar
SFVPRN

SEQ ID NO: 2459929 - protein, 4 aa, Entamoeba dispar
SGAA

SEQ ID NO: 2459930 - protein, 10 aa, Entamoeba dispar
SGADHASELK

SEQ ID NO: 2459931 - protein, 11 aa, Entamoeba dispar
SGAKKIKELTG

SEQ ID NO: 2459932 - protein, 8 aa, Entamoeba dispar
SGAKLTTA

SEQ ID NO: 2459933 - protein, 7 aa, Entamoeba dispar
SGAQSNF

SEQ ID NO: 2459934 - protein, 11 aa, Entamoeba dispar
SGARKGGNVGG

SEQ ID NO: 2459935 - protein, 4 aa, Entamoeba dispar
SGAT

SEQ ID NO: 2459936 - protein, 8 aa, Entamoeba dispar
SGATSLTS

SEQ ID NO: 2459937 - protein, 13 aa, Entamoeba dispar
SGATTINGFKGTK

SEQ ID NO: 2459938 - protein, 9 aa, Entamoeba dispar
SGCADELKR

SEQ ID NO: 2459939 - protein, 54 aa, Entamoeba dispar
SGCDNKEESTHGDSNDKGDDKTKKVTEDPNKCNNQESRDGAEKDKQKEEQEIKE

SEQ ID NO: 2459940 - protein, 8 aa, Entamoeba dispar
SGCGKTSL

SEQ ID NO: 2459941 - protein, 17 aa, Entamoeba dispar
SGCGNEESLKKDPPDIV

SEQ ID NO: 2459942 - protein, 4 aa, Entamoeba dispar
SGCS

SEQ ID NO: 2459943 - protein, 4 aa, Entamoeba dispar
SGCT

SEQ ID NO: 2459944 - protein, 8 aa, Entamoeba dispar
SGCTLSPK

SEQ ID NO: 2459945 - protein, 12 aa, Entamoeba dispar
SGCYRDKDRASL

SEQ ID NO: 2459946 - protein, 8 aa, Entamoeba dispar
SGDALSGD

SEQ ID NO: 2459947 - protein, 6 aa, Entamoeba dispar
SGDANG

SEQ ID NO: 2459948 - protein, 16 aa, Entamoeba dispar
SGDDDKRKRKNDLSNE

SEQ ID NO: 2459949 - protein, 5 aa, Entamoeba dispar
SGDDK

SEQ ID NO: 2459950 - protein, 22 aa, Entamoeba dispar
SGDEGVKDVKSLEGNSTEHREK

SEQ ID NO: 2459951 - protein, 10 aa, Entamoeba dispar
SGDEKGNTQF

SEQ ID NO: 2459952 - protein, 13 aa, Entamoeba dispar
SGDKKKINEHSQY

SEQ ID NO: 2459953 - protein, 8 aa, Entamoeba dispar
SGDKTELN

SEQ ID NO: 2459954 - protein, 10 aa, Entamoeba dispar
SGDNEEDSRS

SEQ ID NO: 2459955 - protein, 7 aa, Entamoeba dispar
SGDNHRF

SEQ ID NO: 2459956 - protein, 6 aa, Entamoeba dispar
SGDQEV

SEQ ID NO: 2459957 - protein, 9 aa, Entamoeba dispar
SGDQRKAAS

SEQ ID NO: 2459958 - protein, 7 aa, Entamoeba dispar
SGDQTTE

SEQ ID NO: 2459959 - protein, 6 aa, Entamoeba dispar
SGDRYR

SEQ ID NO: 2459960 - protein, 9 aa, Entamoeba dispar
SGDSDTVQV

SEQ ID NO: 2459961 - protein, 9 aa, Entamoeba dispar
SGDSSEMEE

SEQ ID NO: 2459962 - protein, 6 aa, Entamoeba dispar
SGDSTW

SEQ ID NO: 2459963 - protein, 6 aa, Entamoeba dispar
SGDTAG

SEQ ID NO: 2459964 - protein, 9 aa, Entamoeba dispar
SGDYLKEGS

SEQ ID NO: 2459965 - protein, 9 aa, Entamoeba dispar
SGDYNPHTI

SEQ ID NO: 2459966 - protein, 6 aa, Entamoeba dispar
SGEAGR

SEQ ID NO: 2459967 - protein, 9 aa, Entamoeba dispar
SGECDNNEY

SEQ ID NO: 2459968 - protein, 7 aa, Entamoeba dispar
SGEDADL

SEQ ID NO: 2459969 - protein, 9 aa, Entamoeba dispar
SGEEEISVP

SEQ ID NO: 2459970 - protein, 7 aa, Entamoeba dispar
SGEEMNG

SEQ ID NO: 2459971 - protein, 4 aa, Entamoeba dispar
SGEF

SEQ ID NO: 2459972 - protein, 10 aa, Entamoeba dispar
SGEGGNPTVK

SEQ ID NO: 2459973 - protein, 10 aa, Entamoeba dispar
SGEGSNPTVK

SEQ ID NO: 2459974 - protein, 7 aa, Entamoeba dispar
SGEGSVD

SEQ ID NO: 2459975 - protein, 4 aa, Entamoeba dispar
SGEH

SEQ ID NO: 2459976 - protein, 7 aa, Entamoeba dispar
SGEISRQ

SEQ ID NO: 2459977 - protein, 5 aa, Entamoeba dispar
SGEKK

SEQ ID NO: 2459978 - protein, 13 aa, Entamoeba dispar
SGEKSIAKEESEK

SEQ ID NO: 2459979 - protein, 4 aa, Entamoeba dispar
SGEL

SEQ ID NO: 2459980 - protein, 5 aa, Entamoeba dispar
SGELK

SEQ ID NO: 2459981 - protein, 7 aa, Entamoeba dispar
SGELTNV

SEQ ID NO: 2459982 - protein, 6 aa, Entamoeba dispar
SGENDI

SEQ ID NO: 2459983 - protein, 7 aa, Entamoeba dispar
SGENNSV

SEQ ID NO: 2459984 - protein, 6 aa, Entamoeba dispar
SGEPKL

SEQ ID NO: 2459985 - protein, 15 aa, Entamoeba dispar
SGEPSVNQKKINAQG

SEQ ID NO: 2459986 - protein, 8 aa, Entamoeba dispar
SGEQRQNR

SEQ ID NO: 2459987 - protein, 5 aa, Entamoeba dispar
SGERF

SEQ ID NO: 2459988 - protein, 9 aa, Entamoeba dispar
SGERGPSLA

SEQ ID NO: 2459989 - protein, 5 aa, Entamoeba dispar
SGERL

SEQ ID NO: 2459990 - protein, 8 aa, Entamoeba dispar
SGESAVGN

SEQ ID NO: 2459991 - protein, 10 aa, Entamoeba dispar
SGESCDTDNG

SEQ ID NO: 2459992 - protein, 8 aa, Entamoeba dispar
SGESEEQF

SEQ ID NO: 2459993 - protein, 10 aa, Entamoeba dispar
SGESGKSTIA

SEQ ID NO: 2459994 - protein, 19 aa, Entamoeba dispar
SGESLKDAEKRYKESEPSF

SEQ ID NO: 2459995 - protein, 5 aa, Entamoeba dispar
SGESY

SEQ ID NO: 2459996 - protein, 9 aa, Entamoeba dispar
SGETCGSIA

SEQ ID NO: 2459997 - protein, 5 aa, Entamoeba dispar
SGETI

SEQ ID NO: 2459998 - protein, 7 aa, Entamoeba dispar
SGETKQQ

SEQ ID NO: 2459999 - protein, 27 aa, Entamoeba dispar
SGETRDDLKLPEGEMGQKIQADYDDGK

SEQ ID NO: 2460000 - protein, 6 aa, Entamoeba dispar
SGETVP

SEQ ID NO: 2460001 - protein, 7 aa, Entamoeba dispar
SGEVSSA

SEQ ID NO: 2460002 - protein, 13 aa, Entamoeba dispar
SGFAEETTADESV

SEQ ID NO: 2460003 - protein, 4 aa, Entamoeba dispar
SGFE

SEQ ID NO: 2460004 - protein, 15 aa, Entamoeba dispar
SGFGSNQTQNTGFGQ

SEQ ID NO: 2460005 - protein, 6 aa, Entamoeba dispar
SGFGTS

SEQ ID NO: 2460006 - protein, 6 aa, Entamoeba dispar
SGFNNK

SEQ ID NO: 2460007 - protein, 5 aa, Entamoeba dispar
SGFPK

SEQ ID NO: 2460008 - protein, 8 aa, Entamoeba dispar
SGFPTGAL

SEQ ID NO: 2460009 - protein, 11 aa, Entamoeba dispar
SGFPTKSIQQI

SEQ ID NO: 2460010 - protein, 4 aa, Entamoeba dispar
SGFS

SEQ ID NO: 2460011 - protein, 9 aa, Entamoeba dispar
SGGARMQEG

SEQ ID NO: 2460012 - protein, 5 aa, Entamoeba dispar
SGGDD

SEQ ID NO: 2460013 - protein, 8 aa, Entamoeba dispar
SGGDDGTA

SEQ ID NO: 2460014 - protein, 8 aa, Entamoeba dispar
SGGDGKLT

SEQ ID NO: 2460015 - protein, 15 aa, Entamoeba dispar
SGGDINDSQQNDDWQ

SEQ ID NO: 2460016 - protein, 5 aa, Entamoeba dispar
SGGDM

SEQ ID NO: 2460017 - protein, 5 aa, Entamoeba dispar
SGGDQ

SEQ ID NO: 2460018 - protein, 6 aa, Entamoeba dispar
SGGFQS

SEQ ID NO: 2460019 - protein, 9 aa, Entamoeba dispar
SGGIPPQLE

SEQ ID NO: 2460020 - protein, 7 aa, Entamoeba dispar
SGGKDKQ

SEQ ID NO: 2460021 - protein, 9 aa, Entamoeba dispar
SGGKDSTAL

SEQ ID NO: 2460022 - protein, 9 aa, Entamoeba dispar
SGGKRSKEV

SEQ ID NO: 2460023 - protein, 6 aa, Entamoeba dispar
SGGLAT

SEQ ID NO: 2460024 - protein, 11 aa, Entamoeba dispar
SGGNPSDPESF

SEQ ID NO: 2460025 - protein, 5 aa, Entamoeba dispar
SGGNV

SEQ ID NO: 2460026 - protein, 4 aa, Entamoeba dispar
SGGP

SEQ ID NO: 2460027 - protein, 6 aa, Entamoeba dispar
SGGRDG

SEQ ID NO: 2460028 - protein, 8 aa, Entamoeba dispar
SGGSDEVH

SEQ ID NO: 2460029 - protein, 13 aa, Entamoeba dispar
SGGSNIFGKTGGV

SEQ ID NO: 2460030 - protein, 5 aa, Entamoeba dispar
SGGSV

SEQ ID NO: 2460031 - protein, 5 aa, Entamoeba dispar
SGGTN

SEQ ID NO: 2460032 - protein, 5 aa, Entamoeba dispar
SGGTW

SEQ ID NO: 2460033 - protein, 7 aa, Entamoeba dispar
SGGTYKS

SEQ ID NO: 2460034 - protein, 7 aa, Entamoeba dispar
SGGVGKT

SEQ ID NO: 2460035 - protein, 6 aa, Entamoeba dispar
SGGVPS

SEQ ID NO: 2460036 - protein, 5 aa, Entamoeba dispar
SGGYR

SEQ ID NO: 2460037 - protein, 7 aa, Entamoeba dispar
SGHGKEY

SEQ ID NO: 2460038 - protein, 8 aa, Entamoeba dispar
SGHNEKAD

SEQ ID NO: 2460039 - protein, 6 aa, Entamoeba dispar
SGHSAA

SEQ ID NO: 2460040 - protein, 6 aa, Entamoeba dispar
SGHTAK

SEQ ID NO: 2460041 - protein, 12 aa, Entamoeba dispar
SGHTNPSGRLPT

SEQ ID NO: 2460042 - protein, 4 aa, Entamoeba dispar
SGID

SEQ ID NO: 2460043 - protein, 6 aa, Entamoeba dispar
SGIDTD

SEQ ID NO: 2460044 - protein, 4 aa, Entamoeba dispar
SGIE

SEQ ID NO: 2460045 - protein, 5 aa, Entamoeba dispar
SGIEE

SEQ ID NO: 2460046 - protein, 5 aa, Entamoeba dispar
SGIEG

SEQ ID NO: 2460047 - protein, 18 aa, Entamoeba dispar
SGIEKTESSQSKNQSTEV

SEQ ID NO: 2460048 - protein, 5 aa, Entamoeba dispar
SGIEL

SEQ ID NO: 2460049 - protein, 7 aa, Entamoeba dispar
SGIGEPI

SEQ ID NO: 2460050 - protein, 6 aa, Entamoeba dispar
SGIGNE

SEQ ID NO: 2460051 - protein, 6 aa, Entamoeba dispar
SGIGSI

SEQ ID NO: 2460052 - protein, 4 aa, Entamoeba dispar
SGIK

SEQ ID NO: 2460053 - protein, 10 aa, Entamoeba dispar
SGIKRSKQTF

SEQ ID NO: 2460054 - protein, 8 aa, Entamoeba dispar
SGINDPNR

SEQ ID NO: 2460055 - protein, 14 aa, Entamoeba dispar
SGINTKKRNEMKSP

SEQ ID NO: 2460056 - protein, 6 aa, Entamoeba dispar
SGIPNS

SEQ ID NO: 2460057 - protein, 7 aa, Entamoeba dispar
SGIPPEH

SEQ ID NO: 2460058 - protein, 16 aa, Entamoeba dispar
SGIPTTTGRVTPDGKQ

SEQ ID NO: 2460059 - protein, 7 aa, Entamoeba dispar
SGIREEY

SEQ ID NO: 2460060 - protein, 6 aa, Entamoeba dispar
SGITDY

SEQ ID NO: 2460061 - protein, 5 aa, Entamoeba dispar
SGITH

SEQ ID NO: 2460062 - protein, 5 aa, Entamoeba dispar
SGITP

SEQ ID NO: 2460063 - protein, 5 aa, Entamoeba dispar
SGITV

SEQ ID NO: 2460064 - protein, 5 aa, Entamoeba dispar
SGIVK

SEQ ID NO: 2460065 - protein, 10 aa, Entamoeba dispar
SGIYDDSTGD

SEQ ID NO: 2460066 - protein, 4 aa, Entamoeba dispar
SGKA

SEQ ID NO: 2460067 - protein, 6 aa, Entamoeba dispar
SGKAEV

SEQ ID NO: 2460068 - protein, 12 aa, Entamoeba dispar
SGKALPDGTHLR

SEQ ID NO: 2460069 - protein, 15 aa, Entamoeba dispar
SGKANRVNVTGTTKP

SEQ ID NO: 2460070 - protein, 11 aa, Entamoeba dispar
SGKASSAAGLT

SEQ ID NO: 2460071 - protein, 4 aa, Entamoeba dispar
SGKE

SEQ ID NO: 2460072 - protein, 5 aa, Entamoeba dispar
SGKEA

SEQ ID NO: 2460073 - protein, 26 aa, Entamoeba dispar
SGKEDPIDFPEPTFSKKNLKNGQHSF

SEQ ID NO: 2460074 - protein, 6 aa, Entamoeba dispar
SGKEEQ

SEQ ID NO: 2460075 - protein, 7 aa, Entamoeba dispar
SGKEGGI

SEQ ID NO: 2460076 - protein, 8 aa, Entamoeba dispar
SGKEHLNE

SEQ ID NO: 2460077 - protein, 10 aa, Entamoeba dispar
SGKGEINEIS

SEQ ID NO: 2460078 - protein, 7 aa, Entamoeba dispar
SGKGNIY

SEQ ID NO: 2460079 - protein, 10 aa, Entamoeba dispar
SGKGPKENCG

SEQ ID NO: 2460080 - protein, 4 aa, Entamoeba dispar
SGKH

SEQ ID NO: 2460081 - protein, 11 aa, Entamoeba dispar
SGKIEDDTEKS

SEQ ID NO: 2460082 - protein, 6 aa, Entamoeba dispar
SGKIEN

SEQ ID NO: 2460083 - protein, 7 aa, Entamoeba dispar
SGKIKKD

SEQ ID NO: 2460084 - protein, 9 aa, Entamoeba dispar
SGKKAYPHK

SEQ ID NO: 2460085 - protein, 11 aa, Entamoeba dispar
SGKKEESHELK

SEQ ID NO: 2460086 - protein, 8 aa, Entamoeba dispar
SGKKGSVM

SEQ ID NO: 2460087 - protein, 24 aa, Entamoeba dispar
SGKKIRIADEDSTEEESEDDPDAL

SEQ ID NO: 2460088 - protein, 33 aa, Entamoeba dispar
SGKKIRIADEDSTEEESEDDPDALVNNWNTGNF

SEQ ID NO: 2460089 - protein, 11 aa, Entamoeba dispar
SGKKKKQKPEY

SEQ ID NO: 2460090 - protein, 8 aa, Entamoeba dispar
SGKKPFPS

SEQ ID NO: 2460091 - protein, 4 aa, Entamoeba dispar
SGKL

SEQ ID NO: 2460092 - protein, 6 aa, Entamoeba dispar
SGKLAN

SEQ ID NO: 2460093 - protein, 10 aa, Entamoeba dispar
SGKLGYPHRG

SEQ ID NO: 2460094 - protein, 7 aa, Entamoeba dispar
SGKLTIP

SEQ ID NO: 2460095 - protein, 11 aa, Entamoeba dispar
SGKMKEIKNEV

SEQ ID NO: 2460096 - protein, 7 aa, Entamoeba dispar
SGKNNTK

SEQ ID NO: 2460097 - protein, 5 aa, Entamoeba dispar
SGKNV

SEQ ID NO: 2460098 - protein, 4 aa, Entamoeba dispar
SGKP

SEQ ID NO: 2460099 - protein, 7 aa, Entamoeba dispar
SGKPGNE

SEQ ID NO: 2460100 - protein, 17 aa, Entamoeba dispar
SGKPRDEVVSMWIKLLP

SEQ ID NO: 2460101 - protein, 9 aa, Entamoeba dispar
SGKPYNGSK

SEQ ID NO: 2460102 - protein, 9 aa, Entamoeba dispar
SGKQRNSMV

SEQ ID NO: 2460103 - protein, 9 aa, Entamoeba dispar
SGKQTSDIK

SEQ ID NO: 2460104 - protein, 4 aa, Entamoeba dispar
SGKR

SEQ ID NO: 2460105 - protein, 7 aa, Entamoeba dispar
SGKRDDC

SEQ ID NO: 2460106 - protein, 4 aa, Entamoeba dispar
SGKS

SEQ ID NO: 2460107 - protein, 10 aa, Entamoeba dispar
SGKSAVSPKI

SEQ ID NO: 2460108 - protein, 9 aa, Entamoeba dispar
SGKSTLSKT

SEQ ID NO: 2460109 - protein, 14 aa, Entamoeba dispar
SGKSTVKKNEKISK

SEQ ID NO: 2460110 - protein, 10 aa, Entamoeba dispar
SGKSTVNKTG

SEQ ID NO: 2460111 - protein, 9 aa, Entamoeba dispar
SGKSVDESK

SEQ ID NO: 2460112 - protein, 4 aa, Entamoeba dispar
SGKT

SEQ ID NO: 2460113 - protein, 12 aa, Entamoeba dispar
SGKTATEPAIGK

SEQ ID NO: 2460114 - protein, 12 aa, Entamoeba dispar
SGKTKAVDPIAD

SEQ ID NO: 2460115 - protein, 7 aa, Entamoeba dispar
SGKTTFA

SEQ ID NO: 2460116 - protein, 5 aa, Entamoeba dispar
SGKVK

SEQ ID NO: 2460117 - protein, 6 aa, Entamoeba dispar
SGKVKR

SEQ ID NO: 2460118 - protein, 13 aa, Entamoeba dispar
SGKVNDDAERASI

SEQ ID NO: 2460119 - protein, 8 aa, Entamoeba dispar
SGKVNQYR

SEQ ID NO: 2460120 - protein, 13 aa, Entamoeba dispar
SGKVSDDAERGTI

SEQ ID NO: 2460121 - protein, 5 aa, Entamoeba dispar
SGKYH

SEQ ID NO: 2460122 - protein, 10 aa, Entamoeba dispar
SGLDEEQNKQ

SEQ ID NO: 2460123 - protein, 8 aa, Entamoeba dispar
SGLDLEEQ

SEQ ID NO: 2460124 - protein, 5 aa, Entamoeba dispar
SGLEG

SEQ ID NO: 2460125 - protein, 11 aa, Entamoeba dispar
SGLEKSQVSDD

SEQ ID NO: 2460126 - protein, 22 aa, Entamoeba dispar
SGLGSSTGLSSGLGSSTNSGFG

SEQ ID NO: 2460127 - protein, 4 aa, Entamoeba dispar
SGLI

SEQ ID NO: 2460128 - protein, 4 aa, Entamoeba dispar
SGLS

SEQ ID NO: 2460129 - protein, 22 aa, Entamoeba dispar
SGLSEEEAEKKVDKRWKKAGHE

SEQ ID NO: 2460130 - protein, 7 aa, Entamoeba dispar
SGLSRES

SEQ ID NO: 2460131 - protein, 8 aa, Entamoeba dispar
SGLTADAR

SEQ ID NO: 2460132 - protein, 9 aa, Entamoeba dispar
SGLTADART

SEQ ID NO: 2460133 - protein, 11 aa, Entamoeba dispar
SGMDKQTDALR

SEQ ID NO: 2460134 - protein, 7 aa, Entamoeba dispar
SGMESKK

SEQ ID NO: 2460135 - protein, 7 aa, Entamoeba dispar
SGMGPDA

SEQ ID NO: 2460136 - protein, 8 aa, Entamoeba dispar
SGMKPQTI

SEQ ID NO: 2460137 - protein, 6 aa, Entamoeba dispar
SGMNDN

SEQ ID NO: 2460138 - protein, 18 aa, Entamoeba dispar
SGMTASQFKQDPLTRRAL

SEQ ID NO: 2460139 - protein, 6 aa, Entamoeba dispar
SGNCEQ

SEQ ID NO: 2460140 - protein, 5 aa, Entamoeba dispar
SGNDI

SEQ ID NO: 2460141 - protein, 10 aa, Entamoeba dispar
SGNDIATTSI

SEQ ID NO: 2460142 - protein, 9 aa, Entamoeba dispar
SGNDPNWNK

SEQ ID NO: 2460143 - protein, 4 aa, Entamoeba dispar
SGNE

SEQ ID NO: 2460144 - protein, 18 aa, Entamoeba dispar
SGNEGKIDEQKYNPDPRY

SEQ ID NO: 2460145 - protein, 7 aa, Entamoeba dispar
SGNEKQI

SEQ ID NO: 2460146 - protein, 6 aa, Entamoeba dispar
SGNELK

SEQ ID NO: 2460147 - protein, 12 aa, Entamoeba dispar
SGNFENISEQKK

SEQ ID NO: 2460148 - protein, 5 aa, Entamoeba dispar
SGNGE

SEQ ID NO: 2460149 - protein, 8 aa, Entamoeba dispar
SGNGNTSD

SEQ ID NO: 2460150 - protein, 5 aa, Entamoeba dispar
SGNGR

SEQ ID NO: 2460151 - protein, 10 aa, Entamoeba dispar
SGNHSQDAQN

SEQ ID NO: 2460152 - protein, 9 aa, Entamoeba dispar
SGNISKMPV

SEQ ID NO: 2460153 - protein, 10 aa, Entamoeba dispar
SGNISTSSSF

SEQ ID NO: 2460154 - protein, 8 aa, Entamoeba dispar
SGNKGATM

SEQ ID NO: 2460155 - protein, 19 aa, Entamoeba dispar
SGNKKPGVLTHSGGNPVLN

SEQ ID NO: 2460156 - protein, 5 aa, Entamoeba dispar
SGNKN

SEQ ID NO: 2460157 - protein, 5 aa, Entamoeba dispar
SGNLE

SEQ ID NO: 2460158 - protein, 5 aa, Entamoeba dispar
SGNLL

SEQ ID NO: 2460159 - protein, 11 aa, Entamoeba dispar
SGNLSTNSLEN

SEQ ID NO: 2460160 - protein, 8 aa, Entamoeba dispar
SGNNKNYK

SEQ ID NO: 2460161 - protein, 7 aa, Entamoeba dispar
SGNPAAE

SEQ ID NO: 2460162 - protein, 8 aa, Entamoeba dispar
SGNPFKGT

SEQ ID NO: 2460163 - protein, 9 aa, Entamoeba dispar
SGNPNGSSF

SEQ ID NO: 2460164 - protein, 7 aa, Entamoeba dispar
SGNQQWP

SEQ ID NO: 2460165 - protein, 4 aa, Entamoeba dispar
SGNT

SEQ ID NO: 2460166 - protein, 6 aa, Entamoeba dispar
SGNTHE

SEQ ID NO: 2460167 - protein, 9 aa, Entamoeba dispar
SGNTPNNGQ

SEQ ID NO: 2460168 - protein, 8 aa, Entamoeba dispar
SGNVGDST

SEQ ID NO: 2460169 - protein, 9 aa, Entamoeba dispar
SGNVKKENQ

SEQ ID NO: 2460170 - protein, 5 aa, Entamoeba dispar
SGNYI

SEQ ID NO: 2460171 - protein, 7 aa, Entamoeba dispar
SGPAAHT

SEQ ID NO: 2460172 - protein, 7 aa, Entamoeba dispar
SGPAKTF

SEQ ID NO: 2460173 - protein, 8 aa, Entamoeba dispar
SGPEEATG

SEQ ID NO: 2460174 - protein, 4 aa, Entamoeba dispar
SGPF

SEQ ID NO: 2460175 - protein, 6 aa, Entamoeba dispar
SGPFNT

SEQ ID NO: 2460176 - protein, 15 aa, Entamoeba dispar
SGPGVDGGEELDDCN

SEQ ID NO: 2460177 - protein, 14 aa, Entamoeba dispar
SGPKGQVITTGNGP

SEQ ID NO: 2460178 - protein, 5 aa, Entamoeba dispar
SGPQL

SEQ ID NO: 2460179 - protein, 6 aa, Entamoeba dispar
SGPRCG

SEQ ID NO: 2460180 - protein, 7 aa, Entamoeba dispar
SGPSDPW

SEQ ID NO: 2460181 - protein, 15 aa, Entamoeba dispar
SGPSNNYENPLSLSP

SEQ ID NO: 2460182 - protein, 5 aa, Entamoeba dispar
SGPTG

SEQ ID NO: 2460183 - protein, 7 aa, Entamoeba dispar
SGPTNIS

SEQ ID NO: 2460184 - protein, 5 aa, Entamoeba dispar
SGQCA

SEQ ID NO: 2460185 - protein, 13 aa, Entamoeba dispar
SGQFESGPSKKRI

SEQ ID NO: 2460186 - protein, 7 aa, Entamoeba dispar
SGQFTSI

SEQ ID NO: 2460187 - protein, 4 aa, Entamoeba dispar
SGQL

SEQ ID NO: 2460188 - protein, 9 aa, Entamoeba dispar
SGQNNEDQM

SEQ ID NO: 2460189 - protein, 8 aa, Entamoeba dispar
SGQPSLAD

SEQ ID NO: 2460190 - protein, 7 aa, Entamoeba dispar
SGQQQQK

SEQ ID NO: 2460191 - protein, 10 aa, Entamoeba dispar
SGRDSTSPTY

SEQ ID NO: 2460192 - protein, 7 aa, Entamoeba dispar
SGRDYSD

SEQ ID NO: 2460193 - protein, 5 aa, Entamoeba dispar
SGRER

SEQ ID NO: 2460194 - protein, 6 aa, Entamoeba dispar
SGRETM

SEQ ID NO: 2460195 - protein, 7 aa, Entamoeba dispar
SGRFQPN

SEQ ID NO: 2460196 - protein, 14 aa, Entamoeba dispar
SGRGELSERQQKLG

SEQ ID NO: 2460197 - protein, 9 aa, Entamoeba dispar
SGRHKQDKE

SEQ ID NO: 2460198 - protein, 4 aa, Entamoeba dispar
SGRK

SEQ ID NO: 2460199 - protein, 7 aa, Entamoeba dispar
SGRKEHI

SEQ ID NO: 2460200 - protein, 5 aa, Entamoeba dispar
SGRMN

SEQ ID NO: 2460201 - protein, 10 aa, Entamoeba dispar
SGRTARAGRS

SEQ ID NO: 2460202 - protein, 5 aa, Entamoeba dispar
SGRTH

SEQ ID NO: 2460203 - protein, 5 aa, Entamoeba dispar
SGSAF

SEQ ID NO: 2460204 - protein, 5 aa, Entamoeba dispar
SGSDC

SEQ ID NO: 2460205 - protein, 8 aa, Entamoeba dispar
SGSDDGTI

SEQ ID NO: 2460206 - protein, 16 aa, Entamoeba dispar
SGSDLPKLKEQLGDDV

SEQ ID NO: 2460207 - protein, 11 aa, Entamoeba dispar
SGSEKESKEKG

SEQ ID NO: 2460208 - protein, 4 aa, Entamoeba dispar
SGSF

SEQ ID NO: 2460209 - protein, 11 aa, Entamoeba dispar
SGSFSSSELNA

SEQ ID NO: 2460210 - protein, 8 aa, Entamoeba dispar
SGSGTEVT

SEQ ID NO: 2460211 - protein, 5 aa, Entamoeba dispar
SGSHA

SEQ ID NO: 2460212 - protein, 7 aa, Entamoeba dispar
SGSHPDV

SEQ ID NO: 2460213 - protein, 4 aa, Entamoeba dispar
SGSI

SEQ ID NO: 2460214 - protein, 6 aa, Entamoeba dispar
SGSIIG

SEQ ID NO: 2460215 - protein, 6 aa, Entamoeba dispar
SGSIRE

SEQ ID NO: 2460216 - protein, 7 aa, Entamoeba dispar
SGSKDAS

SEQ ID NO: 2460217 - protein, 8 aa, Entamoeba dispar
SGSKDNIQ

SEQ ID NO: 2460218 - protein, 9 aa, Entamoeba dispar
SGSKGSTTN

SEQ ID NO: 2460219 - protein, 7 aa, Entamoeba dispar
SGSKGSV

SEQ ID NO: 2460220 - protein, 12 aa, Entamoeba dispar
SGSLDAQKPTNQ

SEQ ID NO: 2460221 - protein, 7 aa, Entamoeba dispar
SGSLDGT

SEQ ID NO: 2460222 - protein, 5 aa, Entamoeba dispar
SGSNI

SEQ ID NO: 2460223 - protein, 14 aa, Entamoeba dispar
SGSNSYNMANKTKA

SEQ ID NO: 2460224 - protein, 8 aa, Entamoeba dispar
SGSNVERH

SEQ ID NO: 2460225 - protein, 36 aa, Entamoeba dispar
SGSPEDSVYSGYSSPNPIRQENSFSTGTSQYPTYPS

SEQ ID NO: 2460226 - protein, 6 aa, Entamoeba dispar
SGSRDK

SEQ ID NO: 2460227 - protein, 15 aa, Entamoeba dispar
SGSRQSKYMNEKGDI

SEQ ID NO: 2460228 - protein, 19 aa, Entamoeba dispar
SGSSDNERDELKKKIKKDI

SEQ ID NO: 2460229 - protein, 11 aa, Entamoeba dispar
SGSSSEEAKQF

SEQ ID NO: 2460230 - protein, 10 aa, Entamoeba dispar
SGSSTTKTGL

SEQ ID NO: 2460231 - protein, 14 aa, Entamoeba dispar
SGSTDNICVLVCKL

SEQ ID NO: 2460232 - protein, 15 aa, Entamoeba dispar
SGSTDSTGATFSIRE

SEQ ID NO: 2460233 - protein, 14 aa, Entamoeba dispar
SGSTLQTTEKRSRL

SEQ ID NO: 2460234 - protein, 11 aa, Entamoeba dispar
SGSVGKSAIAT

SEQ ID NO: 2460235 - protein, 6 aa, Entamoeba dispar
SGSYDD

SEQ ID NO: 2460236 - protein, 6 aa, Entamoeba dispar
SGSYGK

SEQ ID NO: 2460237 - protein, 13 aa, Entamoeba dispar
SGTDGNCGPSPAN

SEQ ID NO: 2460238 - protein, 10 aa, Entamoeba dispar
SGTEIGLPEE

SEQ ID NO: 2460239 - protein, 11 aa, Entamoeba dispar
SGTGAAKPIRI

SEQ ID NO: 2460240 - protein, 10 aa, Entamoeba dispar
SGTIGSNSQD

SEQ ID NO: 2460241 - protein, 10 aa, Entamoeba dispar
SGTINKEVKQ

SEQ ID NO: 2460242 - protein, 6 aa, Entamoeba dispar
SGTIYK

SEQ ID NO: 2460243 - protein, 6 aa, Entamoeba dispar
SGTKCP

SEQ ID NO: 2460244 - protein, 19 aa, Entamoeba dispar
SGTKNVELANEPTAAIAGY

SEQ ID NO: 2460245 - protein, 5 aa, Entamoeba dispar
SGTLQ

SEQ ID NO: 2460246 - protein, 5 aa, Entamoeba dispar
SGTNA

SEQ ID NO: 2460247 - protein, 16 aa, Entamoeba dispar
SGTNAANGTGAYKQKS

SEQ ID NO: 2460248 - protein, 6 aa, Entamoeba dispar
SGTNEF

SEQ ID NO: 2460249 - protein, 29 aa, Entamoeba dispar
SGTNSSIPSLSTNAFPSLTSNGGLGNSTN

SEQ ID NO: 2460250 - protein, 9 aa, Entamoeba dispar
SGTPELPPC

SEQ ID NO: 2460251 - protein, 5 aa, Entamoeba dispar
SGTPL

SEQ ID NO: 2460252 - protein, 13 aa, Entamoeba dispar
SGTPNSSLSINPT

SEQ ID NO: 2460253 - protein, 27 aa, Entamoeba dispar
SGTQREDNKNQNQINEAKQAGIKAFNK

SEQ ID NO: 2460254 - protein, 9 aa, Entamoeba dispar
SGTSGLPKG

SEQ ID NO: 2460255 - protein, 10 aa, Entamoeba dispar
SGTSGTPKGA

SEQ ID NO: 2460256 - protein, 12 aa, Entamoeba dispar
SGTSLSSKEESG

SEQ ID NO: 2460257 - protein, 9 aa, Entamoeba dispar
SGTSSISTK

SEQ ID NO: 2460258 - protein, 14 aa, Entamoeba dispar
SGTSYQNSSINPGY

SEQ ID NO: 2460259 - protein, 9 aa, Entamoeba dispar
SGTTGFPKG

SEQ ID NO: 2460260 - protein, 6 aa, Entamoeba dispar
SGTTKG

SEQ ID NO: 2460261 - protein, 9 aa, Entamoeba dispar
SGTTNSQKK

SEQ ID NO: 2460262 - protein, 4 aa, Entamoeba dispar
SGTY

SEQ ID NO: 2460263 - protein, 5 aa, Entamoeba dispar
SGVDE

SEQ ID NO: 2460264 - protein, 19 aa, Entamoeba dispar
SGVDSSSISQSGVSELNQA

SEQ ID NO: 2460265 - protein, 11 aa, Entamoeba dispar
SGVPPKQPPYR

SEQ ID NO: 2460266 - protein, 6 aa, Entamoeba dispar
SGVPSL

SEQ ID NO: 2460267 - protein, 8 aa, Entamoeba dispar
SGVQPKTV

SEQ ID NO: 2460268 - protein, 23 aa, Entamoeba dispar
SGVSPKSRNSTSLNNTISPGISP

SEQ ID NO: 2460269 - protein, 26 aa, Entamoeba dispar
SGVSPYSMGKDCDSPRIKESDYCAST

SEQ ID NO: 2460270 - protein, 8 aa, Entamoeba dispar
SGVSSTDQ

SEQ ID NO: 2460271 - protein, 5 aa, Entamoeba dispar
SGVTE

SEQ ID NO: 2460272 - protein, 15 aa, Entamoeba dispar
SGWDPSCRPQGKKQK

SEQ ID NO: 2460273 - protein, 9 aa, Entamoeba dispar
SGWGEQPIS

SEQ ID NO: 2460274 - protein, 10 aa, Entamoeba dispar
SGYDKSIEPM

SEQ ID NO: 2460275 - protein, 6 aa, Entamoeba dispar
SGYEDA

SEQ ID NO: 2460276 - protein, 19 aa, Entamoeba dispar
SGYEQHTYSQKEIEELNNE

SEQ ID NO: 2460277 - protein, 10 aa, Entamoeba dispar
SGYEVEEKPV

SEQ ID NO: 2460278 - protein, 7 aa, Entamoeba dispar
SGYGMTE

SEQ ID NO: 2460279 - protein, 6 aa, Entamoeba dispar
SGYGTR

SEQ ID NO: 2460280 - protein, 4 aa, Entamoeba dispar
SGYI

SEQ ID NO: 2460281 - protein, 7 aa, Entamoeba dispar
SGYISSS

SEQ ID NO: 2460282 - protein, 5 aa, Entamoeba dispar
SGYPL

SEQ ID NO: 2460283 - protein, 8 aa, Entamoeba dispar
SGYPNETP

SEQ ID NO: 2460284 - protein, 7 aa, Entamoeba dispar
SGYPNTI

SEQ ID NO: 2460285 - protein, 5 aa, Entamoeba dispar
SGYPS

SEQ ID NO: 2460286 - protein, 6 aa, Entamoeba dispar
SGYPTV

SEQ ID NO: 2460287 - protein, 7 aa, Entamoeba dispar
SGYQNEA

SEQ ID NO: 2460288 - protein, 9 aa, Entamoeba dispar
SGYQQHDSQ

SEQ ID NO: 2460289 - protein, 16 aa, Entamoeba dispar
SGYRGGLDVKTGTTGV

SEQ ID NO: 2460290 - protein, 4 aa, Entamoeba dispar
SGYV

SEQ ID NO: 2460291 - protein, 5 aa, Entamoeba dispar
SGYVE

SEQ ID NO: 2460292 - protein, 4 aa, Entamoeba dispar
SHAR

SEQ ID NO: 2460293 - protein, 7 aa, Entamoeba dispar
SHCGKTS

SEQ ID NO: 2460294 - protein, 10 aa, Entamoeba dispar
SHCTSSRDHH

SEQ ID NO: 2460295 - protein, 7 aa, Entamoeba dispar
SHDEKTR

SEQ ID NO: 2460296 - protein, 9 aa, Entamoeba dispar
SHDETKTLR

SEQ ID NO: 2460297 - protein, 8 aa, Entamoeba dispar
SHDNKKTI

SEQ ID NO: 2460298 - protein, 4 aa, Entamoeba dispar
SHDQ

SEQ ID NO: 2460299 - protein, 6 aa, Entamoeba dispar
SHEEKR

SEQ ID NO: 2460300 - protein, 114 aa, Entamoeba dispar
SHEEYRHENNERQHKGFKEREAPQPSEADTADSWRRKDDDGFVPKKTYERRYENTEKPHREFGERRTDDRGKRTYGPKDGQHQNTKKSTQHIKQGKKTPKQSSKPVVDEEGWMT

SEQ ID NO: 2460301 - protein, 5 aa, Entamoeba dispar
SHEGD

SEQ ID NO: 2460302 - protein, 4 aa, Entamoeba dispar
SHEI

SEQ ID NO: 2460303 - protein, 7 aa, Entamoeba dispar
SHEKNCS

SEQ ID NO: 2460304 - protein, 8 aa, Entamoeba dispar
SHEKSDEM

SEQ ID NO: 2460305 - protein, 7 aa, Entamoeba dispar
SHENGLQ

SEQ ID NO: 2460306 - protein, 4 aa, Entamoeba dispar
SHEQ

SEQ ID NO: 2460307 - protein, 4 aa, Entamoeba dispar
SHEV

SEQ ID NO: 2460308 - protein, 12 aa, Entamoeba dispar
SHFSDNQYTQID

SEQ ID NO: 2460309 - protein, 10 aa, Entamoeba dispar
SHGKSNDSYM

SEQ ID NO: 2460310 - protein, 5 aa, Entamoeba dispar
SHGNY

SEQ ID NO: 2460311 - protein, 5 aa, Entamoeba dispar
SHGYN

SEQ ID NO: 2460312 - protein, 5 aa, Entamoeba dispar
SHHPP

SEQ ID NO: 2460313 - protein, 7 aa, Entamoeba dispar
SHIGDTD

SEQ ID NO: 2460314 - protein, 11 aa, Entamoeba dispar
SHINKQRREID

SEQ ID NO: 2460315 - protein, 10 aa, Entamoeba dispar
SHISTGGGAS

SEQ ID NO: 2460316 - protein, 10 aa, Entamoeba dispar
SHKARQFTTK

SEQ ID NO: 2460317 - protein, 7 aa, Entamoeba dispar
SHKGGCG

SEQ ID NO: 2460318 - protein, 6 aa, Entamoeba dispar
SHKNSG

SEQ ID NO: 2460319 - protein, 8 aa, Entamoeba dispar
SHKPKEEI

SEQ ID NO: 2460320 - protein, 4 aa, Entamoeba dispar
SHKT

SEQ ID NO: 2460321 - protein, 8 aa, Entamoeba dispar
SHLDDENK

SEQ ID NO: 2460322 - protein, 16 aa, Entamoeba dispar
SHLPSNNYSFPDPISS

SEQ ID NO: 2460323 - protein, 4 aa, Entamoeba dispar
SHLS

SEQ ID NO: 2460324 - protein, 5 aa, Entamoeba dispar
SHNET

SEQ ID NO: 2460325 - protein, 12 aa, Entamoeba dispar
SHNPAGKDHGDF

SEQ ID NO: 2460326 - protein, 10 aa, Entamoeba dispar
SHNPKADNGY

SEQ ID NO: 2460327 - protein, 7 aa, Entamoeba dispar
SHNQQRV

SEQ ID NO: 2460328 - protein, 18 aa, Entamoeba dispar
SHNSAQNVLQTSSTTLPE

SEQ ID NO: 2460329 - protein, 7 aa, Entamoeba dispar
SHNSHEQ

SEQ ID NO: 2460330 - protein, 5 aa, Entamoeba dispar
SHNSK

SEQ ID NO: 2460331 - protein, 11 aa, Entamoeba dispar
SHPEKKRKVER

SEQ ID NO: 2460332 - protein, 15 aa, Entamoeba dispar
SHPFPSHPKSLSRSV

SEQ ID NO: 2460333 - protein, 6 aa, Entamoeba dispar
SHPKEL

SEQ ID NO: 2460334 - protein, 13 aa, Entamoeba dispar
SHPKPKLKIGSET

SEQ ID NO: 2460335 - protein, 9 aa, Entamoeba dispar
SHPNNNAQT

SEQ ID NO: 2460336 - protein, 23 aa, Entamoeba dispar
SHPQPNQSFKKDEPKKDEPKKDD

SEQ ID NO: 2460337 - protein, 4 aa, Entamoeba dispar
SHQE

SEQ ID NO: 2460338 - protein, 4 aa, Entamoeba dispar
SHQH

SEQ ID NO: 2460339 - protein, 6 aa, Entamoeba dispar
SHQMTS

SEQ ID NO: 2460340 - protein, 8 aa, Entamoeba dispar
SHQPVGEK

SEQ ID NO: 2460341 - protein, 15 aa, Entamoeba dispar
SHQQNTPIPPSKPSN

SEQ ID NO: 2460342 - protein, 7 aa, Entamoeba dispar
SHQQPNK

SEQ ID NO: 2460343 - protein, 8 aa, Entamoeba dispar
SHRDEDTA

SEQ ID NO: 2460344 - protein, 8 aa, Entamoeba dispar
SHRPKELS

SEQ ID NO: 2460345 - protein, 6 aa, Entamoeba dispar
SHRSAN

SEQ ID NO: 2460346 - protein, 6 aa, Entamoeba dispar
SHSATA

SEQ ID NO: 2460347 - protein, 4 aa, Entamoeba dispar
SHSE

SEQ ID NO: 2460348 - protein, 9 aa, Entamoeba dispar
SHSEPKPQL

SEQ ID NO: 2460349 - protein, 9 aa, Entamoeba dispar
SHSETQTPR

SEQ ID NO: 2460350 - protein, 4 aa, Entamoeba dispar
SHSF

SEQ ID NO: 2460351 - protein, 9 aa, Entamoeba dispar
SHSGSGKTV

SEQ ID NO: 2460352 - protein, 17 aa, Entamoeba dispar
SHSGSSENILSTDNIDS

SEQ ID NO: 2460353 - protein, 4 aa, Entamoeba dispar
SHSK

SEQ ID NO: 2460354 - protein, 8 aa, Entamoeba dispar
SHSKIQPK

SEQ ID NO: 2460355 - protein, 13 aa, Entamoeba dispar
SHSKQKLKLQNDT

SEQ ID NO: 2460356 - protein, 9 aa, Entamoeba dispar
SHSNEKTDQ

SEQ ID NO: 2460357 - protein, 8 aa, Entamoeba dispar
SHSRPSWE

SEQ ID NO: 2460358 - protein, 24 aa, Entamoeba dispar
SHSSLEPKKHSPPSLDLPLEKKKL

SEQ ID NO: 2460359 - protein, 7 aa, Entamoeba dispar
SHSSRKI

SEQ ID NO: 2460360 - protein, 9 aa, Entamoeba dispar
SHSSVDKTS

SEQ ID NO: 2460361 - protein, 21 aa, Entamoeba dispar
SHSTTPDELNKEVDDENEHQS

SEQ ID NO: 2460362 - protein, 13 aa, Entamoeba dispar
SHTDQSRSKTITE

SEQ ID NO: 2460363 - protein, 6 aa, Entamoeba dispar
SHTEMN

SEQ ID NO: 2460364 - protein, 12 aa, Entamoeba dispar
SHTETGPRKCNE

SEQ ID NO: 2460365 - protein, 8 aa, Entamoeba dispar
SHTMSKQA

SEQ ID NO: 2460366 - protein, 4 aa, Entamoeba dispar
SHTN

SEQ ID NO: 2460367 - protein, 9 aa, Entamoeba dispar
SHTNEQGEL

SEQ ID NO: 2460368 - protein, 48 aa, Entamoeba dispar
SHTPVTSTYTPTHSKQSSSKYRPNRTSEQMSRPKEQISRPKATKIFPM

SEQ ID NO: 2460369 - protein, 14 aa, Entamoeba dispar
SHTPYGDSSEQSIV

SEQ ID NO: 2460370 - protein, 9 aa, Entamoeba dispar
SHVNDTEQD

SEQ ID NO: 2460371 - protein, 8 aa, Entamoeba dispar
SHVQEEET

SEQ ID NO: 2460372 - protein, 4 aa, Entamoeba dispar
SHVR

SEQ ID NO: 2460373 - protein, 6 aa, Entamoeba dispar
SHVTST

SEQ ID NO: 2460374 - protein, 14 aa, Entamoeba dispar
SHWKRKGKENDSSL

SEQ ID NO: 2460375 - protein, 7 aa, Entamoeba dispar
SHYNNTR

SEQ ID NO: 2460376 - protein, 7 aa, Entamoeba dispar
SHYNSSF

SEQ ID NO: 2460377 - protein, 9 aa, Entamoeba dispar
SIADEERRR

SEQ ID NO: 2460378 - protein, 6 aa, Entamoeba dispar
SIADTQ

SEQ ID NO: 2460379 - protein, 8 aa, Entamoeba dispar
SIAEGDEK

SEQ ID NO: 2460380 - protein, 6 aa, Entamoeba dispar
SIAENA

SEQ ID NO: 2460381 - protein, 7 aa, Entamoeba dispar
SIAENNE

SEQ ID NO: 2460382 - protein, 5 aa, Entamoeba dispar
SIANG

SEQ ID NO: 2460383 - protein, 14 aa, Entamoeba dispar
SIANTTAPSGFSSP

SEQ ID NO: 2460384 - protein, 15 aa, Entamoeba dispar
SIAPKRDKAQGEVER

SEQ ID NO: 2460385 - protein, 15 aa, Entamoeba dispar
SIAPKRDKSGGEVER

SEQ ID NO: 2460386 - protein, 6 aa, Entamoeba dispar
SIAPSL

SEQ ID NO: 2460387 - protein, 7 aa, Entamoeba dispar
SIAPTPK

SEQ ID NO: 2460388 - protein, 13 aa, Entamoeba dispar
SIAQTKRNRRNAG

SEQ ID NO: 2460389 - protein, 24 aa, Entamoeba dispar
SIAQTQPSDENTTSQNGNEENKMQ

SEQ ID NO: 2460390 - protein, 4 aa, Entamoeba dispar
SIAS

SEQ ID NO: 2460391 - protein, 10 aa, Entamoeba dispar
SIASSDEDTM

SEQ ID NO: 2460392 - protein, 8 aa, Entamoeba dispar
SIATQSSC

SEQ ID NO: 2460393 - protein, 4 aa, Entamoeba dispar
SIDD

SEQ ID NO: 2460394 - protein, 7 aa, Entamoeba dispar
SIDDEDD

SEQ ID NO: 2460395 - protein, 5 aa, Entamoeba dispar
SIDDF

SEQ ID NO: 2460396 - protein, 7 aa, Entamoeba dispar
SIDDKTT

SEQ ID NO: 2460397 - protein, 22 aa, Entamoeba dispar
SIDDLSGIGKTKKATKEKIQKE

SEQ ID NO: 2460398 - protein, 11 aa, Entamoeba dispar
SIDDQSLGNSL

SEQ ID NO: 2460399 - protein, 4 aa, Entamoeba dispar
SIDE

SEQ ID NO: 2460400 - protein, 14 aa, Entamoeba dispar
SIDEDIDKSSIDGI

SEQ ID NO: 2460401 - protein, 5 aa, Entamoeba dispar
SIDEG

SEQ ID NO: 2460402 - protein, 9 aa, Entamoeba dispar
SIDEKYGKD

SEQ ID NO: 2460403 - protein, 5 aa, Entamoeba dispar
SIDEN

SEQ ID NO: 2460404 - protein, 10 aa, Entamoeba dispar
SIDERTTDEE

SEQ ID NO: 2460405 - protein, 7 aa, Entamoeba dispar
SIDETKR

SEQ ID NO: 2460406 - protein, 8 aa, Entamoeba dispar
SIDEVGDY

SEQ ID NO: 2460407 - protein, 14 aa, Entamoeba dispar
SIDGKQFSKPDIER

SEQ ID NO: 2460408 - protein, 10 aa, Entamoeba dispar
SIDGSKNKKP

SEQ ID NO: 2460409 - protein, 6 aa, Entamoeba dispar
SIDGTI

SEQ ID NO: 2460410 - protein, 9 aa, Entamoeba dispar
SIDKENEEI

SEQ ID NO: 2460411 - protein, 8 aa, Entamoeba dispar
SIDKNSLN

SEQ ID NO: 2460412 - protein, 5 aa, Entamoeba dispar
SIDKQ

SEQ ID NO: 2460413 - protein, 6 aa, Entamoeba dispar
SIDKTA

SEQ ID NO: 2460414 - protein, 40 aa, Entamoeba dispar
SIDNKPNNADQKIVQKDEIKEVGNNKPELFTNTEDNIPQQ

SEQ ID NO: 2460415 - protein, 23 aa, Entamoeba dispar
SIDNKPNNADQKIVQKDERRIPQ

SEQ ID NO: 2460416 - protein, 5 aa, Entamoeba dispar
SIDPQ

SEQ ID NO: 2460417 - protein, 9 aa, Entamoeba dispar
SIDPSSTDC

SEQ ID NO: 2460418 - protein, 6 aa, Entamoeba dispar
SIDPVS

SEQ ID NO: 2460419 - protein, 6 aa, Entamoeba dispar
SIDRGY

SEQ ID NO: 2460420 - protein, 9 aa, Entamoeba dispar
SIDRTTQNL

SEQ ID NO: 2460421 - protein, 4 aa, Entamoeba dispar
SIDS

SEQ ID NO: 2460422 - protein, 10 aa, Entamoeba dispar
SIDSDWEKQE

SEQ ID NO: 2460423 - protein, 10 aa, Entamoeba dispar
SIDSETPDQM

SEQ ID NO: 2460424 - protein, 14 aa, Entamoeba dispar
SIDSFSEKRDNSIK

SEQ ID NO: 2460425 - protein, 35 aa, Entamoeba dispar
  misc_feature (20)..(21): Xaa can be any naturally occurring amino acid
SIDSHTKEISVDGKKFKLRXXNHTKIYWCSRFSLQ

SEQ ID NO: 2460426 - protein, 4 aa, Entamoeba dispar
SIDT

SEQ ID NO: 2460427 - protein, 7 aa, Entamoeba dispar
SIDTNGL

SEQ ID NO: 2460428 - protein, 21 aa, Entamoeba dispar
SIDTTEDEEEEEEEMDSEEYK

SEQ ID NO: 2460429 - protein, 20 aa, Entamoeba dispar
SIDTTEDEEEEEEMDSEEYK

SEQ ID NO: 2460430 - protein, 4 aa, Entamoeba dispar
SIED

SEQ ID NO: 2460431 - protein, 6 aa, Entamoeba dispar
SIEDDQ

SEQ ID NO: 2460432 - protein, 11 aa, Entamoeba dispar
SIEDENDGYDE

SEQ ID NO: 2460433 - protein, 6 aa, Entamoeba dispar
SIEDEP

SEQ ID NO: 2460434 - protein, 27 aa, Entamoeba dispar
SIEDERKKREEKKSLQPIKKPLSKPTY

SEQ ID NO: 2460435 - protein, 9 aa, Entamoeba dispar
SIEDTDDAI

SEQ ID NO: 2460436 - protein, 5 aa, Entamoeba dispar
SIEEA

SEQ ID NO: 2460437 - protein, 32 aa, Entamoeba dispar
SIEEKDDKIADLQSQLSSNSNDAVANDKLGDA

SEQ ID NO: 2460438 - protein, 6 aa, Entamoeba dispar
SIEEKP

SEQ ID NO: 2460439 - protein, 10 aa, Entamoeba dispar
SIEEKSEKTR

SEQ ID NO: 2460440 - protein, 8 aa, Entamoeba dispar
SIEEKSNK

SEQ ID NO: 2460441 - protein, 5 aa, Entamoeba dispar
SIEEL

SEQ ID NO: 2460442 - protein, 9 aa, Entamoeba dispar
SIEELSDEV

SEQ ID NO: 2460443 - protein, 11 aa, Entamoeba dispar
SIEEQKQRVQE

SEQ ID NO: 2460444 - protein, 9 aa, Entamoeba dispar
SIEERQKNL

SEQ ID NO: 2460445 - protein, 40 aa, Entamoeba dispar
SIEESKNHDQKDTEIAKQQKEEKIKTINKEIESLKRKEEL

SEQ ID NO: 2460446 - protein, 6 aa, Entamoeba dispar
SIEGAQ

SEQ ID NO: 2460447 - protein, 5 aa, Entamoeba dispar
SIEGD

SEQ ID NO: 2460448 - protein, 6 aa, Entamoeba dispar
SIEGRT

SEQ ID NO: 2460449 - protein, 5 aa, Entamoeba dispar
SIEGT

SEQ ID NO: 2460450 - protein, 6 aa, Entamoeba dispar
SIEKEE

SEQ ID NO: 2460451 - protein, 6 aa, Entamoeba dispar
SIEKTK

SEQ ID NO: 2460452 - protein, 12 aa, Entamoeba dispar
SIENEPTAAITE

SEQ ID NO: 2460453 - protein, 7 aa, Entamoeba dispar
SIENKNK

SEQ ID NO: 2460454 - protein, 16 aa, Entamoeba dispar
SIENSYNNKPNPTTRA

SEQ ID NO: 2460455 - protein, 4 aa, Entamoeba dispar
SIEP

SEQ ID NO: 2460456 - protein, 10 aa, Entamoeba dispar
SIEPENPNYL

SEQ ID NO: 2460457 - protein, 4 aa, Entamoeba dispar
SIEQ

SEQ ID NO: 2460458 - protein, 8 aa, Entamoeba dispar
SIEQKPNI

SEQ ID NO: 2460459 - protein, 32 aa, Entamoeba dispar
SIEQNETTWKENESNDSDWTETQINSKIEDDW

SEQ ID NO: 2460460 - protein, 9 aa, Entamoeba dispar
SIERTGNGY

SEQ ID NO: 2460461 - protein, 5 aa, Entamoeba dispar
SIESD

SEQ ID NO: 2460462 - protein, 12 aa, Entamoeba dispar
SIESDSESNSEE

SEQ ID NO: 2460463 - protein, 8 aa, Entamoeba dispar
SIESECNE

SEQ ID NO: 2460464 - protein, 6 aa, Entamoeba dispar
SIESNE

SEQ ID NO: 2460465 - protein, 5 aa, Entamoeba dispar
SIESP

SEQ ID NO: 2460466 - protein, 5 aa, Entamoeba dispar
SIESQ

SEQ ID NO: 2460467 - protein, 12 aa, Entamoeba dispar
SIETEEKEVTEV

SEQ ID NO: 2460468 - protein, 7 aa, Entamoeba dispar
SIETEYG

SEQ ID NO: 2460469 - protein, 5 aa, Entamoeba dispar
SIETI

SEQ ID NO: 2460470 - protein, 10 aa, Entamoeba dispar
SIETKPVSET

SEQ ID NO: 2460471 - protein, 12 aa, Entamoeba dispar
SIETNPPNYTTI

SEQ ID NO: 2460472 - protein, 9 aa, Entamoeba dispar
SIETQDPQL

SEQ ID NO: 2460473 - protein, 8 aa, Entamoeba dispar
SIETQGLQ

SEQ ID NO: 2460474 - protein, 7 aa, Entamoeba dispar
SIETQIE

SEQ ID NO: 2460475 - protein, 9 aa, Entamoeba dispar
SIETQRNSF

SEQ ID NO: 2460476 - protein, 6 aa, Entamoeba dispar
SIEYNS

SEQ ID NO: 2460477 - protein, 6 aa, Entamoeba dispar
SIFEGR

SEQ ID NO: 2460478 - protein, 12 aa, Entamoeba dispar
SIFPPTHGGAQQ

SEQ ID NO: 2460479 - protein, 13 aa, Entamoeba dispar
SIGATGKSTFYGE

SEQ ID NO: 2460480 - protein, 13 aa, Entamoeba dispar
SIGDDDKPKEIED

SEQ ID NO: 2460481 - protein, 9 aa, Entamoeba dispar
SIGDDKMKD

SEQ ID NO: 2460482 - protein, 10 aa, Entamoeba dispar
SIGDETPSTI

SEQ ID NO: 2460483 - protein, 6 aa, Entamoeba dispar
SIGEDG

SEQ ID NO: 2460484 - protein, 5 aa, Entamoeba dispar
SIGEN

SEQ ID NO: 2460485 - protein, 6 aa, Entamoeba dispar
SIGEQT

SEQ ID NO: 2460486 - protein, 16 aa, Entamoeba dispar
SIGESKHDKIKSIENS

SEQ ID NO: 2460487 - protein, 5 aa, Entamoeba dispar
SIGGD

SEQ ID NO: 2460488 - protein, 6 aa, Entamoeba dispar
SIGIQT

SEQ ID NO: 2460489 - protein, 19 aa, Entamoeba dispar
SIGKARGGGVGDAGGSADR

SEQ ID NO: 2460490 - protein, 10 aa, Entamoeba dispar
SIGKERKRSG

SEQ ID NO: 2460491 - protein, 7 aa, Entamoeba dispar
SIGKGGF

SEQ ID NO: 2460492 - protein, 10 aa, Entamoeba dispar
SIGKKTETGL

SEQ ID NO: 2460493 - protein, 15 aa, Entamoeba dispar
SIGKNAGDKGNGNSA

SEQ ID NO: 2460494 - protein, 6 aa, Entamoeba dispar
SIGKNN

SEQ ID NO: 2460495 - protein, 6 aa, Entamoeba dispar
SIGKPL

SEQ ID NO: 2460496 - protein, 4 aa, Entamoeba dispar
SIGM

SEQ ID NO: 2460497 - protein, 8 aa, Entamoeba dispar
SIGNKNKL

SEQ ID NO: 2460498 - protein, 6 aa, Entamoeba dispar
SIGPQA

SEQ ID NO: 2460499 - protein, 5 aa, Entamoeba dispar
SIGPT

SEQ ID NO: 2460500 - protein, 4 aa, Entamoeba dispar
SIGQ

SEQ ID NO: 2460501 - protein, 7 aa, Entamoeba dispar
SIGRGAY

SEQ ID NO: 2460502 - protein, 5 aa, Entamoeba dispar
SIGRQ

SEQ ID NO: 2460503 - protein, 12 aa, Entamoeba dispar
SIGSDYSTNISD

SEQ ID NO: 2460504 - protein, 16 aa, Entamoeba dispar
SIGSKLESTLSKTDIT

SEQ ID NO: 2460505 - protein, 13 aa, Entamoeba dispar
SIGSTSSPLSISP

SEQ ID NO: 2460506 - protein, 16 aa, Entamoeba dispar
SIGTDPYPYKCMKHKT

SEQ ID NO: 2460507 - protein, 12 aa, Entamoeba dispar
SIHGDRSQADRD

SEQ ID NO: 2460508 - protein, 13 aa, Entamoeba dispar
SIHPESAKKSYID

SEQ ID NO: 2460509 - protein, 4 aa, Entamoeba dispar
SIHS

SEQ ID NO: 2460510 - protein, 6 aa, Entamoeba dispar
SIIENK

SEQ ID NO: 2460511 - protein, 16 aa, Entamoeba dispar
SIIGTKKKVEENGKEE

SEQ ID NO: 2460512 - protein, 14 aa, Entamoeba dispar
SIIKAQNKAKEPFM

SEQ ID NO: 2460513 - protein, 11 aa, Entamoeba dispar
SIINSKDDELK

SEQ ID NO: 2460514 - protein, 11 aa, Entamoeba dispar
SIITQTKTLSS

SEQ ID NO: 2460515 - protein, 5 aa, Entamoeba dispar
SIKAD

SEQ ID NO: 2460516 - protein, 13 aa, Entamoeba dispar
SIKAGTAEDEAPS

SEQ ID NO: 2460517 - protein, 8 aa, Entamoeba dispar
SIKDGKES

SEQ ID NO: 2460518 - protein, 4 aa, Entamoeba dispar
SIKE

SEQ ID NO: 2460519 - protein, 12 aa, Entamoeba dispar
SIKEEHPDAKVT

SEQ ID NO: 2460520 - protein, 6 aa, Entamoeba dispar
SIKEEK

SEQ ID NO: 2460521 - protein, 5 aa, Entamoeba dispar
SIKEK

SEQ ID NO: 2460522 - protein, 10 aa, Entamoeba dispar
SIKEKNSEYF

SEQ ID NO: 2460523 - protein, 7 aa, Entamoeba dispar
SIKEQPE

SEQ ID NO: 2460524 - protein, 4 aa, Entamoeba dispar
SIKI

SEQ ID NO: 2460525 - protein, 33 aa, Entamoeba dispar
SIKKDSDLPQATPQVRTKAKLSKCNSETNLTPA

SEQ ID NO: 2460526 - protein, 29 aa, Entamoeba dispar
SIKKESIKENSGSSISNEEGKEDKFTGDE

SEQ ID NO: 2460527 - protein, 5 aa, Entamoeba dispar
SIKKG

SEQ ID NO: 2460528 - protein, 9 aa, Entamoeba dispar
SIKKNGGVV

SEQ ID NO: 2460529 - protein, 6 aa, Entamoeba dispar
SIKKTL

SEQ ID NO: 2460530 - protein, 8 aa, Entamoeba dispar
SIKNDQGI

SEQ ID NO: 2460531 - protein, 5 aa, Entamoeba dispar
SIKNE

SEQ ID NO: 2460532 - protein, 10 aa, Entamoeba dispar
SIKNNKENEL

SEQ ID NO: 2460533 - protein, 14 aa, Entamoeba dispar
SIKNQNNNSKEDIQ

SEQ ID NO: 2460534 - protein, 5 aa, Entamoeba dispar
SIKNS

SEQ ID NO: 2460535 - protein, 31 aa, Entamoeba dispar
SIKNSSLTEDGSINEENSLSVDEKSNLNKID

SEQ ID NO: 2460536 - protein, 7 aa, Entamoeba dispar
SIKPKSC

SEQ ID NO: 2460537 - protein, 5 aa, Entamoeba dispar
SIKPN

SEQ ID NO: 2460538 - protein, 9 aa, Entamoeba dispar
SIKQKSDPM

SEQ ID NO: 2460539 - protein, 7 aa, Entamoeba dispar
SIKQQTN

SEQ ID NO: 2460540 - protein, 7 aa, Entamoeba dispar
SIKQSGF

SEQ ID NO: 2460541 - protein, 8 aa, Entamoeba dispar
SIKQYPKY

SEQ ID NO: 2460542 - protein, 4 aa, Entamoeba dispar
SIKR

SEQ ID NO: 2460543 - protein, 7 aa, Entamoeba dispar
SIKSNGT

SEQ ID NO: 2460544 - protein, 10 aa, Entamoeba dispar
SIKSTDEYGV

SEQ ID NO: 2460545 - protein, 11 aa, Entamoeba dispar
SIKTNGRTASI

SEQ ID NO: 2460546 - protein, 17 aa, Entamoeba dispar
SIKTRSIQNNITRKPTN

SEQ ID NO: 2460547 - protein, 6 aa, Entamoeba dispar
SILPEN

SEQ ID NO: 2460548 - protein, 5 aa, Entamoeba dispar
SILSS

SEQ ID NO: 2460549 - protein, 8 aa, Entamoeba dispar
SILTGSEK

SEQ ID NO: 2460550 - protein, 4 aa, Entamoeba dispar
SIND

SEQ ID NO: 2460551 - protein, 5 aa, Entamoeba dispar
SINDK

SEQ ID NO: 2460552 - protein, 5 aa, Entamoeba dispar
SINEL

SEQ ID NO: 2460553 - protein, 13 aa, Entamoeba dispar
SINENSQPLFGQN

SEQ ID NO: 2460554 - protein, 24 aa, Entamoeba dispar
SINETSSEEPSQEELPPPVPEKTY

SEQ ID NO: 2460555 - protein, 5 aa, Entamoeba dispar
SINEY

SEQ ID NO: 2460556 - protein, 11 aa, Entamoeba dispar
SINGENDKDIS

SEQ ID NO: 2460557 - protein, 13 aa, Entamoeba dispar
SINIPSSVSEIGN

SEQ ID NO: 2460558 - protein, 4 aa, Entamoeba dispar
SINK

SEQ ID NO: 2460559 - protein, 5 aa, Entamoeba dispar
SINKI

SEQ ID NO: 2460560 - protein, 4 aa, Entamoeba dispar
SINL

SEQ ID NO: 2460561 - protein, 7 aa, Entamoeba dispar
SINLPKG

SEQ ID NO: 2460562 - protein, 14 aa, Entamoeba dispar
SINNEGVISDPSGV

SEQ ID NO: 2460563 - protein, 9 aa, Entamoeba dispar
SINNPTDIE

SEQ ID NO: 2460564 - protein, 5 aa, Entamoeba dispar
SINNY

SEQ ID NO: 2460565 - protein, 8 aa, Entamoeba dispar
SINPDKPV

SEQ ID NO: 2460566 - protein, 8 aa, Entamoeba dispar
SINPEPYH

SEQ ID NO: 2460567 - protein, 9 aa, Entamoeba dispar
SINPNKPQI

SEQ ID NO: 2460568 - protein, 5 aa, Entamoeba dispar
SINPS

SEQ ID NO: 2460569 - protein, 4 aa, Entamoeba dispar
SINQ

SEQ ID NO: 2460570 - protein, 12 aa, Entamoeba dispar
SINQKDDLGNTA

SEQ ID NO: 2460571 - protein, 13 aa, Entamoeba dispar
SINQQREMIENFE

SEQ ID NO: 2460572 - protein, 5 aa, Entamoeba dispar
SINQS

SEQ ID NO: 2460573 - protein, 8 aa, Entamoeba dispar
SINRGQNT

SEQ ID NO: 2460574 - protein, 5 aa, Entamoeba dispar
SINSE

SEQ ID NO: 2460575 - protein, 46 aa, Entamoeba dispar
SINSKGGNGGINGGRGSGEQTRIISGSEEEKENNKNEEKKKENYRK

SEQ ID NO: 2460576 - protein, 9 aa, Entamoeba dispar
SINSNGDIN

SEQ ID NO: 2460577 - protein, 43 aa, Entamoeba dispar
SINSSTSSPFLKSKKSPIEDEEDEWDTWQSRQQKAKTPTLATD

SEQ ID NO: 2460578 - protein, 7 aa, Entamoeba dispar
SINSTPI

SEQ ID NO: 2460579 - protein, 13 aa, Entamoeba dispar
SINTNDQTTPKPI

SEQ ID NO: 2460580 - protein, 6 aa, Entamoeba dispar
SINTSE

SEQ ID NO: 2460581 - protein, 5 aa, Entamoeba dispar
SINTT

SEQ ID NO: 2460582 - protein, 28 aa, Entamoeba dispar
SINTTEDKKEDKKNEKKEDEKSEIKDNK

SEQ ID NO: 2460583 - protein, 5 aa, Entamoeba dispar
SIPDG

SEQ ID NO: 2460584 - protein, 7 aa, Entamoeba dispar
SIPDGDE

SEQ ID NO: 2460585 - protein, 9 aa, Entamoeba dispar
SIPDNVSSI

SEQ ID NO: 2460586 - protein, 5 aa, Entamoeba dispar
SIPED

SEQ ID NO: 2460587 - protein, 13 aa, Entamoeba dispar
SIPEDAKKPPVEE

SEQ ID NO: 2460588 - protein, 8 aa, Entamoeba dispar
SIPEGTLG

SEQ ID NO: 2460589 - protein, 5 aa, Entamoeba dispar
SIPEP

SEQ ID NO: 2460590 - protein, 11 aa, Entamoeba dispar
SIPESYRYSTG

SEQ ID NO: 2460591 - protein, 12 aa, Entamoeba dispar
SIPGASNGSDYT

SEQ ID NO: 2460592 - protein, 5 aa, Entamoeba dispar
SIPGL

SEQ ID NO: 2460593 - protein, 6 aa, Entamoeba dispar
SIPGND

SEQ ID NO: 2460594 - protein, 6 aa, Entamoeba dispar
SIPKDL

SEQ ID NO: 2460595 - protein, 8 aa, Entamoeba dispar
SIPKEDSF

SEQ ID NO: 2460596 - protein, 7 aa, Entamoeba dispar
SIPKQSI

SEQ ID NO: 2460597 - protein, 6 aa, Entamoeba dispar
SIPKQY

SEQ ID NO: 2460598 - protein, 9 aa, Entamoeba dispar
SIPKSSDLS

SEQ ID NO: 2460599 - protein, 4 aa, Entamoeba dispar
SIPL

SEQ ID NO: 2460600 - protein, 6 aa, Entamoeba dispar
SIPLAG

SEQ ID NO: 2460601 - protein, 5 aa, Entamoeba dispar
SIPLQ

SEQ ID NO: 2460602 - protein, 12 aa, Entamoeba dispar
SIPLSDSSIPPF

SEQ ID NO: 2460603 - protein, 10 aa, Entamoeba dispar
SIPNDEPEQC

SEQ ID NO: 2460604 - protein, 8 aa, Entamoeba dispar
SIPNNSSL

SEQ ID NO: 2460605 - protein, 8 aa, Entamoeba dispar
SIPNQRTP

SEQ ID NO: 2460606 - protein, 8 aa, Entamoeba dispar
SIPNRSQC

SEQ ID NO: 2460607 - protein, 5 aa, Entamoeba dispar
SIPPC

SEQ ID NO: 2460608 - protein, 6 aa, Entamoeba dispar
SIPPEI

SEQ ID NO: 2460609 - protein, 6 aa, Entamoeba dispar
SIPPRC

SEQ ID NO: 2460610 - protein, 13 aa, Entamoeba dispar
SIPPSVNKIGKGS

SEQ ID NO: 2460611 - protein, 5 aa, Entamoeba dispar
SIPPT

SEQ ID NO: 2460612 - protein, 15 aa, Entamoeba dispar
SIPQQSQEGIGPMPS

SEQ ID NO: 2460613 - protein, 5 aa, Entamoeba dispar
SIPQS

SEQ ID NO: 2460614 - protein, 13 aa, Entamoeba dispar
SIPRHNSNYDNEN

SEQ ID NO: 2460615 - protein, 5 aa, Entamoeba dispar
SIPRN

SEQ ID NO: 2460616 - protein, 6 aa, Entamoeba dispar
SIPRTV

SEQ ID NO: 2460617 - protein, 4 aa, Entamoeba dispar
SIPS

SEQ ID NO: 2460618 - protein, 5 aa, Entamoeba dispar
SIPSK

SEQ ID NO: 2460619 - protein, 7 aa, Entamoeba dispar
SIPSLNG

SEQ ID NO: 2460620 - protein, 26 aa, Entamoeba dispar
SIPSRASPGSLSSQRLSRNTSNQQLS

SEQ ID NO: 2460621 - protein, 10 aa, Entamoeba dispar
SIPSSETTDK

SEQ ID NO: 2460622 - protein, 6 aa, Entamoeba dispar
SIPSSI

SEQ ID NO: 2460623 - protein, 5 aa, Entamoeba dispar
SIPST

SEQ ID NO: 2460624 - protein, 5 aa, Entamoeba dispar
SIPTP

SEQ ID NO: 2460625 - protein, 11 aa, Entamoeba dispar
SIPVDGTVSQL

SEQ ID NO: 2460626 - protein, 5 aa, Entamoeba dispar
SIPVE

SEQ ID NO: 2460627 - protein, 21 aa, Entamoeba dispar
SIQDTRKQQPASQQKQTLGQF

SEQ ID NO: 2460628 - protein, 4 aa, Entamoeba dispar
SIQE

SEQ ID NO: 2460629 - protein, 5 aa, Entamoeba dispar
SIQES

SEQ ID NO: 2460630 - protein, 9 aa, Entamoeba dispar
SIQGDEAIE

SEQ ID NO: 2460631 - protein, 14 aa, Entamoeba dispar
SIQGETSEDVSPRI

SEQ ID NO: 2460632 - protein, 8 aa, Entamoeba dispar
SIQGPDTM

SEQ ID NO: 2460633 - protein, 6 aa, Entamoeba dispar
SIQHEG

SEQ ID NO: 2460634 - protein, 9 aa, Entamoeba dispar
SIQNEIGNA

SEQ ID NO: 2460635 - protein, 7 aa, Entamoeba dispar
SIQPIEQ

SEQ ID NO: 2460636 - protein, 20 aa, Entamoeba dispar
SIQPQNGQQQNTQVQPQNNM

SEQ ID NO: 2460637 - protein, 5 aa, Entamoeba dispar
SIQPS

SEQ ID NO: 2460638 - protein, 7 aa, Entamoeba dispar
SIQPYEQ

SEQ ID NO: 2460639 - protein, 12 aa, Entamoeba dispar
SIQSEEELKSNE

SEQ ID NO: 2460640 - protein, 11 aa, Entamoeba dispar
SIQSERNSNEI

SEQ ID NO: 2460641 - protein, 12 aa, Entamoeba dispar
SIRDTTNNYGED

SEQ ID NO: 2460642 - protein, 16 aa, Entamoeba dispar
SIREEQKQKESLEKNL

SEQ ID NO: 2460643 - protein, 10 aa, Entamoeba dispar
SIRGSDEDAS

SEQ ID NO: 2460644 - protein, 12 aa, Entamoeba dispar
SIRIDKDKAVTK

SEQ ID NO: 2460645 - protein, 8 aa, Entamoeba dispar
SIRIPSKK

SEQ ID NO: 2460646 - protein, 10 aa, Entamoeba dispar
SIRKDIESHR

SEQ ID NO: 2460647 - protein, 5 aa, Entamoeba dispar
SIRKT

SEQ ID NO: 2460648 - protein, 13 aa, Entamoeba dispar
SIRNEAACTRSKK

SEQ ID NO: 2460649 - protein, 10 aa, Entamoeba dispar
SIRNKKKEEL

SEQ ID NO: 2460650 - protein, 5 aa, Entamoeba dispar
SIRPE

SEQ ID NO: 2460651 - protein, 7 aa, Entamoeba dispar
SIRPTTL

SEQ ID NO: 2460652 - protein, 6 aa, Entamoeba dispar
SIRSNK

SEQ ID NO: 2460653 - protein, 9 aa, Entamoeba dispar
SIRSPKEIE

SEQ ID NO: 2460654 - protein, 6 aa, Entamoeba dispar
SIRTRA

SEQ ID NO: 2460655 - protein, 6 aa, Entamoeba dispar
SIRTVR

SEQ ID NO: 2460656 - protein, 15 aa, Entamoeba dispar
SIRTYGDKYPTTEQV

SEQ ID NO: 2460657 - protein, 5 aa, Entamoeba dispar
SIRYN

SEQ ID NO: 2460658 - protein, 7 aa, Entamoeba dispar
SISDCSN

SEQ ID NO: 2460659 - protein, 6 aa, Entamoeba dispar
SISDHP

SEQ ID NO: 2460660 - protein, 8 aa, Entamoeba dispar
SISDPKKT

SEQ ID NO: 2460661 - protein, 7 aa, Entamoeba dispar
SISEDET

SEQ ID NO: 2460662 - protein, 5 aa, Entamoeba dispar
SISEL

SEQ ID NO: 2460663 - protein, 6 aa, Entamoeba dispar
SISELG

SEQ ID NO: 2460664 - protein, 8 aa, Entamoeba dispar
SISESDEL

SEQ ID NO: 2460665 - protein, 13 aa, Entamoeba dispar
SISESTQSSSIDL

SEQ ID NO: 2460666 - protein, 13 aa, Entamoeba dispar
SISEYTNSEVEQI

SEQ ID NO: 2460667 - protein, 7 aa, Entamoeba dispar
SISGTEF

SEQ ID NO: 2460668 - protein, 7 aa, Entamoeba dispar
SISHSST

SEQ ID NO: 2460669 - protein, 8 aa, Entamoeba dispar
SISINDKE

SEQ ID NO: 2460670 - protein, 11 aa, Entamoeba dispar
SISKIGNEPFE

SEQ ID NO: 2460671 - protein, 10 aa, Entamoeba dispar
SISKNGKTLK

SEQ ID NO: 2460672 - protein, 10 aa, Entamoeba dispar
SISLKEQNKK

SEQ ID NO: 2460673 - protein, 15 aa, Entamoeba dispar
SISLTDKSKYYYPQN

SEQ ID NO: 2460674 - protein, 14 aa, Entamoeba dispar
SISNEKPSTGTYNI

SEQ ID NO: 2460675 - protein, 35 aa, Entamoeba dispar
SISNKEIKTDDNHQQKTKIQKEISNSIEENENEPK

SEQ ID NO: 2460676 - protein, 7 aa, Entamoeba dispar
SISNNPH

SEQ ID NO: 2460677 - protein, 9 aa, Entamoeba dispar
SISNPRISK

SEQ ID NO: 2460678 - protein, 5 aa, Entamoeba dispar
SISNR

SEQ ID NO: 2460679 - protein, 8 aa, Entamoeba dispar
SISNRKRC

SEQ ID NO: 2460680 - protein, 14 aa, Entamoeba dispar
SISNSKVQETPKKK

SEQ ID NO: 2460681 - protein, 13 aa, Entamoeba dispar
SISPSKPSKHDLQ

SEQ ID NO: 2460682 - protein, 5 aa, Entamoeba dispar
SISPT

SEQ ID NO: 2460683 - protein, 10 aa, Entamoeba dispar
SISQDEHRRG

SEQ ID NO: 2460684 - protein, 20 aa, Entamoeba dispar
SISQQTENNSLELSPKEIEK

SEQ ID NO: 2460685 - protein, 5 aa, Entamoeba dispar
SISQR

SEQ ID NO: 2460686 - protein, 8 aa, Entamoeba dispar
SISQTEIP

SEQ ID NO: 2460687 - protein, 9 aa, Entamoeba dispar
SISQTNELT

SEQ ID NO: 2460688 - protein, 7 aa, Entamoeba dispar
SISSDAQ

SEQ ID NO: 2460689 - protein, 5 aa, Entamoeba dispar
SISSF

SEQ ID NO: 2460690 - protein, 18 aa, Entamoeba dispar
SISSGLGTTTGLGNTNSL

SEQ ID NO: 2460691 - protein, 11 aa, Entamoeba dispar
SISSKANEDLH

SEQ ID NO: 2460692 - protein, 20 aa, Entamoeba dispar
SISSNAPPTPLVSNPPPVLQ

SEQ ID NO: 2460693 - protein, 15 aa, Entamoeba dispar
SISSNESSTTVTPRS

SEQ ID NO: 2460694 - protein, 11 aa, Entamoeba dispar
SISSQSDKTIS

SEQ ID NO: 2460695 - protein, 12 aa, Entamoeba dispar
SISSSGSKSKSV

SEQ ID NO: 2460696 - protein, 23 aa, Entamoeba dispar
SISSSTNNSLIKSSGSTPSPKTL

SEQ ID NO: 2460697 - protein, 5 aa, Entamoeba dispar
SISTN

SEQ ID NO: 2460698 - protein, 6 aa, Entamoeba dispar
SISTTS

SEQ ID NO: 2460699 - protein, 6 aa, Entamoeba dispar
SISYGA

SEQ ID NO: 2460700 - protein, 12 aa, Entamoeba dispar
SITDDFDEQTKI

SEQ ID NO: 2460701 - protein, 13 aa, Entamoeba dispar
SITDNNINTNSIQ

SEQ ID NO: 2460702 - protein, 5 aa, Entamoeba dispar
SITEY

SEQ ID NO: 2460703 - protein, 12 aa, Entamoeba dispar
SITGCQSGKKIN

SEQ ID NO: 2460704 - protein, 5 aa, Entamoeba dispar
SITGK

SEQ ID NO: 2460705 - protein, 45 aa, Entamoeba dispar
SITGKEVSDTSLNNTTTPVDSLNSATISDNLPNNTAAPVGSPNNT

SEQ ID NO: 2460706 - protein, 9 aa, Entamoeba dispar
SITHSDEEA

SEQ ID NO: 2460707 - protein, 5 aa, Entamoeba dispar
SITIP

SEQ ID NO: 2460708 - protein, 10 aa, Entamoeba dispar
SITIPSSISE

SEQ ID NO: 2460709 - protein, 4 aa, Entamoeba dispar
SITK

SEQ ID NO: 2460710 - protein, 9 aa, Entamoeba dispar
SITKGRVSS

SEQ ID NO: 2460711 - protein, 5 aa, Entamoeba dispar
SITKI

SEQ ID NO: 2460712 - protein, 9 aa, Entamoeba dispar
SITKIGNEH

SEQ ID NO: 2460713 - protein, 12 aa, Entamoeba dispar
SITKKSKQEIRA

SEQ ID NO: 2460714 - protein, 5 aa, Entamoeba dispar
SITKL

SEQ ID NO: 2460715 - protein, 6 aa, Entamoeba dispar
SITNRE

SEQ ID NO: 2460716 - protein, 4 aa, Entamoeba dispar
SITP

SEQ ID NO: 2460717 - protein, 9 aa, Entamoeba dispar
SITPLGSGS

SEQ ID NO: 2460718 - protein, 8 aa, Entamoeba dispar
SITPPDPV

SEQ ID NO: 2460719 - protein, 6 aa, Entamoeba dispar
SITPRQ

SEQ ID NO: 2460720 - protein, 5 aa, Entamoeba dispar
SITPS

SEQ ID NO: 2460721 - protein, 11 aa, Entamoeba dispar
SITQKSKQEIK

SEQ ID NO: 2460722 - protein, 14 aa, Entamoeba dispar
SITQTIQDQSNDDL

SEQ ID NO: 2460723 - protein, 9 aa, Entamoeba dispar
SITRGEEQQ

SEQ ID NO: 2460724 - protein, 5 aa, Entamoeba dispar
SITSG

SEQ ID NO: 2460725 - protein, 11 aa, Entamoeba dispar
SITSGKRPPII

SEQ ID NO: 2460726 - protein, 14 aa, Entamoeba dispar
SITSGRLRKNPENH

SEQ ID NO: 2460727 - protein, 5 aa, Entamoeba dispar
SITSN

SEQ ID NO: 2460728 - protein, 6 aa, Entamoeba dispar
SITSPL

SEQ ID NO: 2460729 - protein, 16 aa, Entamoeba dispar
SITSQTPDTSGTEVKQ

SEQ ID NO: 2460730 - protein, 33 aa, Entamoeba dispar
SITSTQSMSKKDVTETSSIGSVETTKSTKEELK

SEQ ID NO: 2460731 - protein, 23 aa, Entamoeba dispar
SITSTSDLISEDKKTLKQKELPN

SEQ ID NO: 2460732 - protein, 4 aa, Entamoeba dispar
SITT

SEQ ID NO: 2460733 - protein, 5 aa, Entamoeba dispar
SITTN

SEQ ID NO: 2460734 - protein, 11 aa, Entamoeba dispar
SITTNNNNSYK

SEQ ID NO: 2460735 - protein, 8 aa, Entamoeba dispar
SITTPNQS

SEQ ID NO: 2460736 - protein, 12 aa, Entamoeba dispar
SITVPKGVTKLG

SEQ ID NO: 2460737 - protein, 21 aa, Entamoeba dispar
SIVSDEKKENTQISNNESDDF

SEQ ID NO: 2460738 - protein, 7 aa, Entamoeba dispar
SIYDGPN

SEQ ID NO: 2460739 - protein, 4 aa, Entamoeba dispar
SIYK

SEQ ID NO: 2460740 - protein, 9 aa, Entamoeba dispar
SIYPSNPEH

SEQ ID NO: 2460741 - protein, 12 aa, Entamoeba dispar
SIYSNDGNSIIQ

SEQ ID NO: 2460742 - protein, 6 aa, Entamoeba dispar
SKAANQ

SEQ ID NO: 2460743 - protein, 7 aa, Entamoeba dispar
SKADKDD

SEQ ID NO: 2460744 - protein, 14 aa, Entamoeba dispar
SKADLTTATKSTED

SEQ ID NO: 2460745 - protein, 219 aa, Entamoeba dispar
SKAEYNDKLKEYDAQTLNTDDKKEKKTKKTTKKEDEKDTEEKKPKKVEIKKEDEKPKKVESKKEEKPKKVEVKKEEDKSKKVEVKKEEEKKEEKKEKKHSKKEDKKKEKKEETKKNEGKKESDKKDDTKKDKKVKKSEKKDETKKEDEKKHEKTEEKKPKKLESEKEESKKEKKHSKKDDEKLKKTDDKKKDEEKSKKVEDKKAKKQKKDESSSSDEDM

SEQ ID NO: 2460746 - protein, 7 aa, Entamoeba dispar
SKAFSQL

SEQ ID NO: 2460747 - protein, 18 aa, Entamoeba dispar
SKAGEPSWESQWGPGRPG

SEQ ID NO: 2460748 - protein, 4 aa, Entamoeba dispar
SKAK

SEQ ID NO: 2460749 - protein, 15 aa, Entamoeba dispar
SKALSNELQSSPTMQ

SEQ ID NO: 2460750 - protein, 18 aa, Entamoeba dispar
SKANAQQRTGRVGRVSAG

SEQ ID NO: 2460751 - protein, 9 aa, Entamoeba dispar
SKANETKAS

SEQ ID NO: 2460752 - protein, 22 aa, Entamoeba dispar
SKANSKELKRLEKETGVDSNGL

SEQ ID NO: 2460753 - protein, 19 aa, Entamoeba dispar
SKANSSVDEESFKEAKDKM

SEQ ID NO: 2460754 - protein, 9 aa, Entamoeba dispar
SKAPDNSID

SEQ ID NO: 2460755 - protein, 10 aa, Entamoeba dispar
SKAPTSGEGY

SEQ ID NO: 2460756 - protein, 9 aa, Entamoeba dispar
SKARESDGM

SEQ ID NO: 2460757 - protein, 5 aa, Entamoeba dispar
SKARG

SEQ ID NO: 2460758 - protein, 15 aa, Entamoeba dispar
SKARKALYTANASQR

SEQ ID NO: 2460759 - protein, 15 aa, Entamoeba dispar
SKARKALYTAPASQR

SEQ ID NO: 2460760 - protein, 19 aa, Entamoeba dispar
SKASADQRAGRAGRVSPGK

SEQ ID NO: 2460761 - protein, 10 aa, Entamoeba dispar
SKASDGNPYA

SEQ ID NO: 2460762 - protein, 9 aa, Entamoeba dispar
SKASEIDPK

SEQ ID NO: 2460763 - protein, 10 aa, Entamoeba dispar
SKASTSNSSL

SEQ ID NO: 2460764 - protein, 9 aa, Entamoeba dispar
SKATHIPAG

SEQ ID NO: 2460765 - protein, 13 aa, Entamoeba dispar
SKATKDQQKDLNN

SEQ ID NO: 2460766 - protein, 12 aa, Entamoeba dispar
SKAYLKSIITII

SEQ ID NO: 2460767 - protein, 8 aa, Entamoeba dispar
SKAYSQQL

SEQ ID NO: 2460768 - protein, 9 aa, Entamoeba dispar
SKCESCSPH

SEQ ID NO: 2460769 - protein, 22 aa, Entamoeba dispar
SKCGSRKIQETLAQTRSADEPM

SEQ ID NO: 2460770 - protein, 6 aa, Entamoeba dispar
SKCKEG

SEQ ID NO: 2460771 - protein, 5 aa, Entamoeba dispar
SKCKG

SEQ ID NO: 2460772 - protein, 12 aa, Entamoeba dispar
SKCKIETKPEKN

SEQ ID NO: 2460773 - protein, 5 aa, Entamoeba dispar
SKCNY

SEQ ID NO: 2460774 - protein, 11 aa, Entamoeba dispar
SKDATSTYDFQ

SEQ ID NO: 2460775 - protein, 13 aa, Entamoeba dispar
SKDDVQKAYDNIN

SEQ ID NO: 2460776 - protein, 4 aa, Entamoeba dispar
SKDE

SEQ ID NO: 2460777 - protein, 7 aa, Entamoeba dispar
SKDEEFN

SEQ ID NO: 2460778 - protein, 16 aa, Entamoeba dispar
SKDEKLTKAALAEPEI

SEQ ID NO: 2460779 - protein, 11 aa, Entamoeba dispar
SKDENDPSNTN

SEQ ID NO: 2460780 - protein, 9 aa, Entamoeba dispar
SKDESVLSG

SEQ ID NO: 2460781 - protein, 7 aa, Entamoeba dispar
SKDEVSR

SEQ ID NO: 2460782 - protein, 11 aa, Entamoeba dispar
SKDEWSPYEDN

SEQ ID NO: 2460783 - protein, 4 aa, Entamoeba dispar
SKDG

SEQ ID NO: 2460784 - protein, 7 aa, Entamoeba dispar
SKDGKII

SEQ ID NO: 2460785 - protein, 6 aa, Entamoeba dispar
SKDGLL

SEQ ID NO: 2460786 - protein, 9 aa, Entamoeba dispar
SKDGNENDL

SEQ ID NO: 2460787 - protein, 9 aa, Entamoeba dispar
SKDGSTGSI

SEQ ID NO: 2460788 - protein, 6 aa, Entamoeba dispar
SKDHSV

SEQ ID NO: 2460789 - protein, 9 aa, Entamoeba dispar
SKDIAGDEE

SEQ ID NO: 2460790 - protein, 7 aa, Entamoeba dispar
SKDIDID

SEQ ID NO: 2460791 - protein, 9 aa, Entamoeba dispar
SKDKKGDRR

SEQ ID NO: 2460792 - protein, 8 aa, Entamoeba dispar
SKDKLEEA

SEQ ID NO: 2460793 - protein, 13 aa, Entamoeba dispar
SKDKVPYLFLANS

SEQ ID NO: 2460794 - protein, 4 aa, Entamoeba dispar
SKDL

SEQ ID NO: 2460795 - protein, 7 aa, Entamoeba dispar
SKDLRGR

SEQ ID NO: 2460796 - protein, 8 aa, Entamoeba dispar
SKDLSDKI

SEQ ID NO: 2460797 - protein, 5 aa, Entamoeba dispar
SKDMQ

SEQ ID NO: 2460798 - protein, 6 aa, Entamoeba dispar
SKDNPN

SEQ ID NO: 2460799 - protein, 7 aa, Entamoeba dispar
SKDPKEV

SEQ ID NO: 2460800 - protein, 8 aa, Entamoeba dispar
SKDPNIRA

SEQ ID NO: 2460801 - protein, 8 aa, Entamoeba dispar
SKDPQLNQ

SEQ ID NO: 2460802 - protein, 7 aa, Entamoeba dispar
SKDPVNL

SEQ ID NO: 2460803 - protein, 5 aa, Entamoeba dispar
SKDQK

SEQ ID NO: 2460804 - protein, 16 aa, Entamoeba dispar
SKDQQEKSSISTIGTK

SEQ ID NO: 2460805 - protein, 7 aa, Entamoeba dispar
SKDQYGN

SEQ ID NO: 2460806 - protein, 14 aa, Entamoeba dispar
SKDSEMTEKQKEVQ

SEQ ID NO: 2460807 - protein, 6 aa, Entamoeba dispar
SKDSFD

SEQ ID NO: 2460808 - protein, 9 aa, Entamoeba dispar
SKDSKMTAQ

SEQ ID NO: 2460809 - protein, 9 aa, Entamoeba dispar
SKDSQLEPV

SEQ ID NO: 2460810 - protein, 6 aa, Entamoeba dispar
SKDSRF

SEQ ID NO: 2460811 - protein, 6 aa, Entamoeba dispar
SKDTRE

SEQ ID NO: 2460812 - protein, 7 aa, Entamoeba dispar
SKDTTSV

SEQ ID NO: 2460813 - protein, 18 aa, Entamoeba dispar
SKDTTWNIESDTKEKKNV

SEQ ID NO: 2460814 - protein, 18 aa, Entamoeba dispar
SKDVEEDKKQKQNINTMN

SEQ ID NO: 2460815 - protein, 6 aa, Entamoeba dispar
SKDVKD

SEQ ID NO: 2460816 - protein, 10 aa, Entamoeba dispar
SKDYKADQNK

SEQ ID NO: 2460817 - protein, 4 aa, Entamoeba dispar
SKEC

SEQ ID NO: 2460818 - protein, 6 aa, Entamoeba dispar
SKEDDF

SEQ ID NO: 2460819 - protein, 7 aa, Entamoeba dispar
SKEDENK

SEQ ID NO: 2460820 - protein, 7 aa, Entamoeba dispar
SKEDFGI

SEQ ID NO: 2460821 - protein, 6 aa, Entamoeba dispar
SKEDIN

SEQ ID NO: 2460822 - protein, 4 aa, Entamoeba dispar
SKEE

SEQ ID NO: 2460823 - protein, 12 aa, Entamoeba dispar
SKEEAEEKAKEL

SEQ ID NO: 2460824 - protein, 11 aa, Entamoeba dispar
SKEEAEFNTTA

SEQ ID NO: 2460825 - protein, 6 aa, Entamoeba dispar
SKEEAL

SEQ ID NO: 2460826 - protein, 8 aa, Entamoeba dispar
SKEEAYTT

SEQ ID NO: 2460827 - protein, 6 aa, Entamoeba dispar
SKEEKE

SEQ ID NO: 2460828 - protein, 8 aa, Entamoeba dispar
SKEEKEGF

SEQ ID NO: 2460829 - protein, 9 aa, Entamoeba dispar
SKEEKQPFF

SEQ ID NO: 2460830 - protein, 7 aa, Entamoeba dispar
SKEEMWN

SEQ ID NO: 2460831 - protein, 8 aa, Entamoeba dispar
SKEETRNA

SEQ ID NO: 2460832 - protein, 5 aa, Entamoeba dispar
SKEEV

SEQ ID NO: 2460833 - protein, 7 aa, Entamoeba dispar
SKEEVST

SEQ ID NO: 2460834 - protein, 7 aa, Entamoeba dispar
SKEGAEK

SEQ ID NO: 2460835 - protein, 17 aa, Entamoeba dispar
SKEGKYGTNEDDCLLPA

SEQ ID NO: 2460836 - protein, 7 aa, Entamoeba dispar
SKEGSPD

SEQ ID NO: 2460837 - protein, 8 aa, Entamoeba dispar
SKEGTRQL

SEQ ID NO: 2460838 - protein, 6 aa, Entamoeba dispar
SKEGVY

SEQ ID NO: 2460839 - protein, 6 aa, Entamoeba dispar
SKEGYE

SEQ ID NO: 2460840 - protein, 5 aa, Entamoeba dispar
SKEHD

SEQ ID NO: 2460841 - protein, 23 aa, Entamoeba dispar
SKEHNGSRTVQQSIEKGNETERQ

SEQ ID NO: 2460842 - protein, 24 aa, Entamoeba dispar
SKEHNGSRTVQQSIEKGSEDERQK

SEQ ID NO: 2460843 - protein, 9 aa, Entamoeba dispar
SKEIDDREG

SEQ ID NO: 2460844 - protein, 30 aa, Entamoeba dispar
SKEIDKEKEKKPKLKEDNKEKGKKKGILER

SEQ ID NO: 2460845 - protein, 27 aa, Entamoeba dispar
SKEIKKKKKKKRNRRITRKTKNKQRMS

SEQ ID NO: 2460846 - protein, 16 aa, Entamoeba dispar
SKEIKQRLTKEATVKI

SEQ ID NO: 2460847 - protein, 5 aa, Entamoeba dispar
SKEIN

SEQ ID NO: 2460848 - protein, 27 aa, Entamoeba dispar
SKEKELSNNSEMDYTSKITTQNTQNDI

SEQ ID NO: 2460849 - protein, 7 aa, Entamoeba dispar
SKEKPPF

SEQ ID NO: 2460850 - protein, 11 aa, Entamoeba dispar
SKELKEDYTNA

SEQ ID NO: 2460851 - protein, 7 aa, Entamoeba dispar
SKELPNK

SEQ ID NO: 2460852 - protein, 11 aa, Entamoeba dispar
SKELPVTTDIN

SEQ ID NO: 2460853 - protein, 6 aa, Entamoeba dispar
SKELQN

SEQ ID NO: 2460854 - protein, 6 aa, Entamoeba dispar
SKELRE

SEQ ID NO: 2460855 - protein, 6 aa, Entamoeba dispar
SKELSS

SEQ ID NO: 2460856 - protein, 6 aa, Entamoeba dispar
SKELTD

SEQ ID NO: 2460857 - protein, 13 aa, Entamoeba dispar
SKELVKNKSIEPV

SEQ ID NO: 2460858 - protein, 4 aa, Entamoeba dispar
SKEM

SEQ ID NO: 2460859 - protein, 17 aa, Entamoeba dispar
SKENDEITKLIKHFQTF

SEQ ID NO: 2460860 - protein, 11 aa, Entamoeba dispar
SKENDKEENEL

SEQ ID NO: 2460861 - protein, 9 aa, Entamoeba dispar
SKENIEESQ

SEQ ID NO: 2460862 - protein, 8 aa, Entamoeba dispar
SKENKVIP

SEQ ID NO: 2460863 - protein, 24 aa, Entamoeba dispar
SKENNIKENDTEHKEQIKSGDTTI

SEQ ID NO: 2460864 - protein, 9 aa, Entamoeba dispar
SKENNKKIY

SEQ ID NO: 2460865 - protein, 15 aa, Entamoeba dispar
SKENNSSQSTGSSNL

SEQ ID NO: 2460866 - protein, 8 aa, Entamoeba dispar
SKENPDFN

SEQ ID NO: 2460867 - protein, 20 aa, Entamoeba dispar
SKENTSDDKLNGWNTLSSEK

SEQ ID NO: 2460868 - protein, 13 aa, Entamoeba dispar
SKENVSGNETTAT

SEQ ID NO: 2460869 - protein, 14 aa, Entamoeba dispar
SKENVTKENTTNTF

SEQ ID NO: 2460870 - protein, 15 aa, Entamoeba dispar
SKENVTKENTTSTFC

SEQ ID NO: 2460871 - protein, 5 aa, Entamoeba dispar
SKEPI

SEQ ID NO: 2460872 - protein, 9 aa, Entamoeba dispar
SKEPKEIED

SEQ ID NO: 2460873 - protein, 12 aa, Entamoeba dispar
SKEPKGTTEEIR

SEQ ID NO: 2460874 - protein, 7 aa, Entamoeba dispar
SKEPNGQ

SEQ ID NO: 2460875 - protein, 9 aa, Entamoeba dispar
SKEPNKQNM

SEQ ID NO: 2460876 - protein, 11 aa, Entamoeba dispar
SKEPYSKPGWD

SEQ ID NO: 2460877 - protein, 14 aa, Entamoeba dispar
SKEQEKEKLNNIEK

SEQ ID NO: 2460878 - protein, 8 aa, Entamoeba dispar
SKEQKIAR

SEQ ID NO: 2460879 - protein, 12 aa, Entamoeba dispar
SKEQKKNKNKID

SEQ ID NO: 2460880 - protein, 14 aa, Entamoeba dispar
SKEQRPSDRKYEEY

SEQ ID NO: 2460881 - protein, 14 aa, Entamoeba dispar
SKEQTTKPKTTQLK

SEQ ID NO: 2460882 - protein, 5 aa, Entamoeba dispar
SKERL

SEQ ID NO: 2460883 - protein, 9 aa, Entamoeba dispar
SKERYGPEA

SEQ ID NO: 2460884 - protein, 9 aa, Entamoeba dispar
SKESEDTYL

SEQ ID NO: 2460885 - protein, 8 aa, Entamoeba dispar
SKESEEEQ

SEQ ID NO: 2460886 - protein, 16 aa, Entamoeba dispar
SKESEFINTEWYYHFL

SEQ ID NO: 2460887 - protein, 5 aa, Entamoeba dispar
SKESG

SEQ ID NO: 2460888 - protein, 9 aa, Entamoeba dispar
SKESGDGMF

SEQ ID NO: 2460889 - protein, 13 aa, Entamoeba dispar
SKESKINKTSIEC

SEQ ID NO: 2460890 - protein, 9 aa, Entamoeba dispar
SKESKQAGF

SEQ ID NO: 2460891 - protein, 5 aa, Entamoeba dispar
SKESV

SEQ ID NO: 2460892 - protein, 13 aa, Entamoeba dispar
SKESVHKKEKELK

SEQ ID NO: 2460893 - protein, 6 aa, Entamoeba dispar
SKETPL

SEQ ID NO: 2460894 - protein, 11 aa, Entamoeba dispar
SKETRESLSEE

SEQ ID NO: 2460895 - protein, 7 aa, Entamoeba dispar
SKETRIK

SEQ ID NO: 2460896 - protein, 9 aa, Entamoeba dispar
SKETTAGCT

SEQ ID NO: 2460897 - protein, 12 aa, Entamoeba dispar
SKETYLAAIQKM

SEQ ID NO: 2460898 - protein, 30 aa, Entamoeba dispar
SKEVAEATRIQYGGSVNPANCNELAKKADI

SEQ ID NO: 2460899 - protein, 5 aa, Entamoeba dispar
SKEVE

SEQ ID NO: 2460900 - protein, 15 aa, Entamoeba dispar
SKEVNGIEENEDDVY

SEQ ID NO: 2460901 - protein, 4 aa, Entamoeba dispar
SKEY

SEQ ID NO: 2460902 - protein, 5 aa, Entamoeba dispar
SKEYD

SEQ ID NO: 2460903 - protein, 6 aa, Entamoeba dispar
SKEYQS

SEQ ID NO: 2460904 - protein, 7 aa, Entamoeba dispar
SKFEDQK

SEQ ID NO: 2460905 - protein, 7 aa, Entamoeba dispar
SKFEGED

SEQ ID NO: 2460906 - protein, 14 aa, Entamoeba dispar
SKFKSQNGSTKDIS

SEQ ID NO: 2460907 - protein, 6 aa, Entamoeba dispar
SKFQGR

SEQ ID NO: 2460908 - protein, 13 aa, Entamoeba dispar
SKFSESTTQNDKV

SEQ ID NO: 2460909 - protein, 6 aa, Entamoeba dispar
SKFTDG

SEQ ID NO: 2460910 - protein, 5 aa, Entamoeba dispar
SKFTS

SEQ ID NO: 2460911 - protein, 8 aa, Entamoeba dispar
SKGAQGEV

SEQ ID NO: 2460912 - protein, 8 aa, Entamoeba dispar
SKGDARSI

SEQ ID NO: 2460913 - protein, 6 aa, Entamoeba dispar
SKGEPM

SEQ ID NO: 2460914 - protein, 20 aa, Entamoeba dispar
SKGERIEVEKERDRATSELN

SEQ ID NO: 2460915 - protein, 9 aa, Entamoeba dispar
SKGEYDNTN

SEQ ID NO: 2460916 - protein, 9 aa, Entamoeba dispar
SKGFEDKPS

SEQ ID NO: 2460917 - protein, 21 aa, Entamoeba dispar
SKGFKTSLSHTYPNSIKTNAS

SEQ ID NO: 2460918 - protein, 5 aa, Entamoeba dispar
SKGFQ

SEQ ID NO: 2460919 - protein, 7 aa, Entamoeba dispar
SKGGDSH

SEQ ID NO: 2460920 - protein, 17 aa, Entamoeba dispar
SKGGTKKITKQELTQVD

SEQ ID NO: 2460921 - protein, 4 aa, Entamoeba dispar
SKGI

SEQ ID NO: 2460922 - protein, 11 aa, Entamoeba dispar
SKGKALSDEEQ

SEQ ID NO: 2460923 - protein, 8 aa, Entamoeba dispar
SKGKEVEG

SEQ ID NO: 2460924 - protein, 17 aa, Entamoeba dispar
SKGKIVDSDNDESEEKE

SEQ ID NO: 2460925 - protein, 16 aa, Entamoeba dispar
SKGKKKENKKKDDGFG

SEQ ID NO: 2460926 - protein, 6 aa, Entamoeba dispar
SKGKKL

SEQ ID NO: 2460927 - protein, 8 aa, Entamoeba dispar
SKGNHIGG

SEQ ID NO: 2460928 - protein, 10 aa, Entamoeba dispar
SKGNNARESL

SEQ ID NO: 2460929 - protein, 19 aa, Entamoeba dispar
SKGNRPDPNKLSGGDLDGD

SEQ ID NO: 2460930 - protein, 7 aa, Entamoeba dispar
SKGNRQL

SEQ ID NO: 2460931 - protein, 7 aa, Entamoeba dispar
SKGNYKG

SEQ ID NO: 2460932 - protein, 6 aa, Entamoeba dispar
SKGPFS

SEQ ID NO: 2460933 - protein, 10 aa, Entamoeba dispar
SKGPTTITNQ

SEQ ID NO: 2460934 - protein, 5 aa, Entamoeba dispar
SKGRI

SEQ ID NO: 2460935 - protein, 15 aa, Entamoeba dispar
SKGSRSSSRKREDII

SEQ ID NO: 2460936 - protein, 5 aa, Entamoeba dispar
SKGSV

SEQ ID NO: 2460937 - protein, 5 aa, Entamoeba dispar
SKGTI

SEQ ID NO: 2460938 - protein, 6 aa, Entamoeba dispar
SKGYTC

SEQ ID NO: 2460939 - protein, 6 aa, Entamoeba dispar
SKHFTP

SEQ ID NO: 2460940 - protein, 10 aa, Entamoeba dispar
SKHGGNNDLT

SEQ ID NO: 2460941 - protein, 4 aa, Entamoeba dispar
SKHK

SEQ ID NO: 2460942 - protein, 6 aa, Entamoeba dispar
SKHQKT

SEQ ID NO: 2460943 - protein, 8 aa, Entamoeba dispar
SKHSKTNY

SEQ ID NO: 2460944 - protein, 10 aa, Entamoeba dispar
SKIAKQEEVD

SEQ ID NO: 2460945 - protein, 8 aa, Entamoeba dispar
SKIDDNDP

SEQ ID NO: 2460946 - protein, 8 aa, Entamoeba dispar
SKIDGSTA

SEQ ID NO: 2460947 - protein, 12 aa, Entamoeba dispar
SKIDGTKKSRQI

SEQ ID NO: 2460948 - protein, 7 aa, Entamoeba dispar
SKIDHST

SEQ ID NO: 2460949 - protein, 6 aa, Entamoeba dispar
SKIDPV

SEQ ID NO: 2460950 - protein, 16 aa, Entamoeba dispar
SKIDTSAKSGSINNPT

SEQ ID NO: 2460951 - protein, 19 aa, Entamoeba dispar
SKIEANYAKRLKSQTTTPL

SEQ ID NO: 2460952 - protein, 7 aa, Entamoeba dispar
SKIEDGS

SEQ ID NO: 2460953 - protein, 12 aa, Entamoeba dispar
SKIEEDQSSYQV

SEQ ID NO: 2460954 - protein, 8 aa, Entamoeba dispar
SKIEEKED

SEQ ID NO: 2460955 - protein, 21 aa, Entamoeba dispar
SKIEEPLKEKEDKKESSQDLI

SEQ ID NO: 2460956 - protein, 9 aa, Entamoeba dispar
SKIEESARN

SEQ ID NO: 2460957 - protein, 6 aa, Entamoeba dispar
SKIEKE

SEQ ID NO: 2460958 - protein, 6 aa, Entamoeba dispar
SKIENK

SEQ ID NO: 2460959 - protein, 8 aa, Entamoeba dispar
SKIESSTA

SEQ ID NO: 2460960 - protein, 6 aa, Entamoeba dispar
SKIGDE

SEQ ID NO: 2460961 - protein, 8 aa, Entamoeba dispar
SKIGPKEI

SEQ ID NO: 2460962 - protein, 14 aa, Entamoeba dispar
SKIGPNPLTNEKLY

SEQ ID NO: 2460963 - protein, 6 aa, Entamoeba dispar
SKIGTF

SEQ ID NO: 2460964 - protein, 10 aa, Entamoeba dispar
SKIKGEDEKQ

SEQ ID NO: 2460965 - protein, 14 aa, Entamoeba dispar
SKIKLQGSKLVPDG

SEQ ID NO: 2460966 - protein, 13 aa, Entamoeba dispar
SKIKNEEQEYKGE

SEQ ID NO: 2460967 - protein, 13 aa, Entamoeba dispar
SKIMKGATSPPQI

SEQ ID NO: 2460968 - protein, 6 aa, Entamoeba dispar
SKININ

SEQ ID NO: 2460969 - protein, 8 aa, Entamoeba dispar
SKINSSNK

SEQ ID NO: 2460970 - protein, 4 aa, Entamoeba dispar
SKIP

SEQ ID NO: 2460971 - protein, 5 aa, Entamoeba dispar
SKIPE

SEQ ID NO: 2460972 - protein, 8 aa, Entamoeba dispar
SKIPEDEI

SEQ ID NO: 2460973 - protein, 6 aa, Entamoeba dispar
SKIPSK

SEQ ID NO: 2460974 - protein, 12 aa, Entamoeba dispar
SKIPSSKTSLDL

SEQ ID NO: 2460975 - protein, 8 aa, Entamoeba dispar
SKIQENKF

SEQ ID NO: 2460976 - protein, 5 aa, Entamoeba dispar
SKISP

SEQ ID NO: 2460977 - protein, 5 aa, Entamoeba dispar
SKIYP

SEQ ID NO: 2460978 - protein, 18 aa, Entamoeba dispar
SKKAMEEDEKGNSKEALE

SEQ ID NO: 2460979 - protein, 10 aa, Entamoeba dispar
SKKASNNAVS

SEQ ID NO: 2460980 - protein, 11 aa, Entamoeba dispar
SKKCKDGADVE

SEQ ID NO: 2460981 - protein, 8 aa, Entamoeba dispar
SKKCKQTQ

SEQ ID NO: 2460982 - protein, 25 aa, Entamoeba dispar
SKKCNTPVSKQLQTSSKRGFGSTPS

SEQ ID NO: 2460983 - protein, 20 aa, Entamoeba dispar
SKKCQDGDIEKIGDGSDEVD

SEQ ID NO: 2460984 - protein, 9 aa, Entamoeba dispar
SKKDPQFPF

SEQ ID NO: 2460985 - protein, 13 aa, Entamoeba dispar
SKKDRGRPDQQHK

SEQ ID NO: 2460986 - protein, 6 aa, Entamoeba dispar
SKKDYA

SEQ ID NO: 2460987 - protein, 13 aa, Entamoeba dispar
SKKDYKSEKNKIY

SEQ ID NO: 2460988 - protein, 17 aa, Entamoeba dispar
SKKEEGEIAKLIKHFEL

SEQ ID NO: 2460989 - protein, 18 aa, Entamoeba dispar
SKKEEGEIAKLMEHFQTF

SEQ ID NO: 2460990 - protein, 9 aa, Entamoeba dispar
SKKEGIEKQ

SEQ ID NO: 2460991 - protein, 9 aa, Entamoeba dispar
SKKEGKKEK

SEQ ID NO: 2460992 - protein, 6 aa, Entamoeba dispar
SKKEIT

SEQ ID NO: 2460993 - protein, 8 aa, Entamoeba dispar
SKKEKKEL

SEQ ID NO: 2460994 - protein, 7 aa, Entamoeba dispar
SKKEPQE

SEQ ID NO: 2460995 - protein, 8 aa, Entamoeba dispar
SKKEQLGD

SEQ ID NO: 2460996 - protein, 14 aa, Entamoeba dispar
SKKESVKKHGSDKA

SEQ ID NO: 2460997 - protein, 6 aa, Entamoeba dispar
SKKFQE

SEQ ID NO: 2460998 - protein, 8 aa, Entamoeba dispar
SKKGCVND

SEQ ID NO: 2460999 - protein, 7 aa, Entamoeba dispar
SKKGDEI

SEQ ID NO: 2461000 - protein, 8 aa, Entamoeba dispar
SKKGERTI

SEQ ID NO: 2461001 - protein, 5 aa, Entamoeba dispar
SKKGI

SEQ ID NO: 2461002 - protein, 8 aa, Entamoeba dispar
SKKGKNPY

SEQ ID NO: 2461003 - protein, 8 aa, Entamoeba dispar
SKKGRVER

SEQ ID NO: 2461004 - protein, 10 aa, Entamoeba dispar
SKKGYLDKDD

SEQ ID NO: 2461005 - protein, 9 aa, Entamoeba dispar
SKKHERRMQ

SEQ ID NO: 2461006 - protein, 8 aa, Entamoeba dispar
SKKHLTDG

SEQ ID NO: 2461007 - protein, 20 aa, Entamoeba dispar
SKKIKSSKISPSPKLPESKI

SEQ ID NO: 2461008 - protein, 8 aa, Entamoeba dispar
SKKIQTPI

SEQ ID NO: 2461009 - protein, 5 aa, Entamoeba dispar
SKKKG

SEQ ID NO: 2461010 - protein, 5 aa, Entamoeba dispar
SKKKN

SEQ ID NO: 2461011 - protein, 37 aa, Entamoeba dispar
SKKKRDDFDDDEKERGALLGNGKNSDEEKKPKKPESE

SEQ ID NO: 2461012 - protein, 16 aa, Entamoeba dispar
SKKKSLSDMTNESRTV

SEQ ID NO: 2461013 - protein, 9 aa, Entamoeba dispar
SKKKYSERI

SEQ ID NO: 2461014 - protein, 9 aa, Entamoeba dispar
SKKLADATK

SEQ ID NO: 2461015 - protein, 6 aa, Entamoeba dispar
SKKLET

SEQ ID NO: 2461016 - protein, 12 aa, Entamoeba dispar
SKKLNTDRSKGY

SEQ ID NO: 2461017 - protein, 10 aa, Entamoeba dispar
SKKMEPEKQK

SEQ ID NO: 2461018 - protein, 12 aa, Entamoeba dispar
SKKNDADDDNAC

SEQ ID NO: 2461019 - protein, 9 aa, Entamoeba dispar
SKKNDVDDD

SEQ ID NO: 2461020 - protein, 37 aa, Entamoeba dispar
SKKNMDDLDEDDKERSALLGDSKKGDEEKKPKKPEND

SEQ ID NO: 2461021 - protein, 9 aa, Entamoeba dispar
SKKNQLQSL

SEQ ID NO: 2461022 - protein, 8 aa, Entamoeba dispar
SKKPGKDY

SEQ ID NO: 2461023 - protein, 6 aa, Entamoeba dispar
SKKPTS

SEQ ID NO: 2461024 - protein, 7 aa, Entamoeba dispar
SKKPVPV

SEQ ID NO: 2461025 - protein, 9 aa, Entamoeba dispar
SKKQANQKI

SEQ ID NO: 2461026 - protein, 5 aa, Entamoeba dispar
SKKQE

SEQ ID NO: 2461027 - protein, 44 aa, Entamoeba dispar
SKKQEEDEKEEELEEKQRKQKEIAEREEAERQKRLQEQQQQIKE

SEQ ID NO: 2461028 - protein, 7 aa, Entamoeba dispar
SKKQESI

SEQ ID NO: 2461029 - protein, 5 aa, Entamoeba dispar
SKKQL

SEQ ID NO: 2461030 - protein, 12 aa, Entamoeba dispar
SKKQRNVQERKY

SEQ ID NO: 2461031 - protein, 8 aa, Entamoeba dispar
SKKRGNKK

SEQ ID NO: 2461032 - protein, 7 aa, Entamoeba dispar
SKKSDKI

SEQ ID NO: 2461033 - protein, 5 aa, Entamoeba dispar
SKKSF

SEQ ID NO: 2461034 - protein, 7 aa, Entamoeba dispar
SKKSGSL

SEQ ID NO: 2461035 - protein, 12 aa, Entamoeba dispar
SKKSHNNYGILD

SEQ ID NO: 2461036 - protein, 16 aa, Entamoeba dispar
SKKSKNIKPSKLTPNM

SEQ ID NO: 2461037 - protein, 9 aa, Entamoeba dispar
SKKSPKTFQ

SEQ ID NO: 2461038 - protein, 53 aa, Entamoeba dispar
SKKSSDVMDGTYEPSEFENSGSSTTTSTTSVKTTVSTSSGKRPPPPPPTRKEQ

SEQ ID NO: 2461039 - protein, 54 aa, Entamoeba dispar
SKKSSDVMDGTYEPSEFENSGSSTTTSTTTSVKTTVSTSSGKRPPPPPPTRKEQ

SEQ ID NO: 2461040 - protein, 18 aa, Entamoeba dispar
SKKSSTSSSMTRSSKQRK

SEQ ID NO: 2461041 - protein, 8 aa, Entamoeba dispar
SKKSTKVF

SEQ ID NO: 2461042 - protein, 8 aa, Entamoeba dispar
SKKTANKK

SEQ ID NO: 2461043 - protein, 26 aa, Entamoeba dispar
SKKTKKGLKKLKDKEPNLNEHESHDK

SEQ ID NO: 2461044 - protein, 20 aa, Entamoeba dispar
SKKTKRKRKLSTSEKIKSLF

SEQ ID NO: 2461045 - protein, 10 aa, Entamoeba dispar
SKKTLSEEEV

SEQ ID NO: 2461046 - protein, 12 aa, Entamoeba dispar
SKKTQQGIPGIG

SEQ ID NO: 2461047 - protein, 5 aa, Entamoeba dispar
SKKTT

SEQ ID NO: 2461048 - protein, 8 aa, Entamoeba dispar
SKKVHRTK

SEQ ID NO: 2461049 - protein, 22 aa, Entamoeba dispar
SKKVSKPNKIVKKNVTKSKKSK

SEQ ID NO: 2461050 - protein, 5 aa, Entamoeba dispar
SKKWE

SEQ ID NO: 2461051 - protein, 9 aa, Entamoeba dispar
SKKWSTDMT

SEQ ID NO: 2461052 - protein, 5 aa, Entamoeba dispar
SKKYA

SEQ ID NO: 2461053 - protein, 8 aa, Entamoeba dispar
SKKYGNKI

SEQ ID NO: 2461054 - protein, 12 aa, Entamoeba dispar
SKLDNETKSKYD

SEQ ID NO: 2461055 - protein, 14 aa, Entamoeba dispar
SKLEGNIKIDPNNK

SEQ ID NO: 2461056 - protein, 9 aa, Entamoeba dispar
SKLESEKEK

SEQ ID NO: 2461057 - protein, 11 aa, Entamoeba dispar
SKLKDKSLVTK

SEQ ID NO: 2461058 - protein, 11 aa, Entamoeba dispar
SKLKGMGTRIK

SEQ ID NO: 2461059 - protein, 11 aa, Entamoeba dispar
SKLKQPKNKLK

SEQ ID NO: 2461060 - protein, 5 aa, Entamoeba dispar
SKLKT

SEQ ID NO: 2461061 - protein, 8 aa, Entamoeba dispar
SKLNDEIN

SEQ ID NO: 2461062 - protein, 6 aa, Entamoeba dispar
SKLNLS

SEQ ID NO: 2461063 - protein, 6 aa, Entamoeba dispar
SKLPDS

SEQ ID NO: 2461064 - protein, 5 aa, Entamoeba dispar
SKLPE

SEQ ID NO: 2461065 - protein, 10 aa, Entamoeba dispar
SKLPKDNQNV

SEQ ID NO: 2461066 - protein, 8 aa, Entamoeba dispar
SKLRGIPS

SEQ ID NO: 2461067 - protein, 15 aa, Entamoeba dispar
SKLSDQFDNLSSGPD

SEQ ID NO: 2461068 - protein, 8 aa, Entamoeba dispar
SKLSEEHL

SEQ ID NO: 2461069 - protein, 8 aa, Entamoeba dispar
SKLSEQDL

SEQ ID NO: 2461070 - protein, 5 aa, Entamoeba dispar
SKLSN

SEQ ID NO: 2461071 - protein, 11 aa, Entamoeba dispar
SKLSNNKNTKI

SEQ ID NO: 2461072 - protein, 8 aa, Entamoeba dispar
SKLSSTFG

SEQ ID NO: 2461073 - protein, 7 aa, Entamoeba dispar
SKLSTNE

SEQ ID NO: 2461074 - protein, 8 aa, Entamoeba dispar
SKLSYEKG

SEQ ID NO: 2461075 - protein, 11 aa, Entamoeba dispar
SKLTKPSPSSL

SEQ ID NO: 2461076 - protein, 14 aa, Entamoeba dispar
SKLTNGKSTTVKNE

SEQ ID NO: 2461077 - protein, 19 aa, Entamoeba dispar
SKLTPENFKEDEKEEGCNI

SEQ ID NO: 2461078 - protein, 7 aa, Entamoeba dispar
SKLTQQQ

SEQ ID NO: 2461079 - protein, 8 aa, Entamoeba dispar
SKLYQPTS

SEQ ID NO: 2461080 - protein, 7 aa, Entamoeba dispar
SKLYSKE

SEQ ID NO: 2461081 - protein, 10 aa, Entamoeba dispar
SKMGGEISTF

SEQ ID NO: 2461082 - protein, 37 aa, Entamoeba dispar
SKMKEVEKSAKAVRQDAENKIKDVEKCKDATKKERDK

SEQ ID NO: 2461083 - protein, 9 aa, Entamoeba dispar
SKMKSDKKL

SEQ ID NO: 2461084 - protein, 9 aa, Entamoeba dispar
SKMPKKGYP

SEQ ID NO: 2461085 - protein, 6 aa, Entamoeba dispar
SKMSEI

SEQ ID NO: 2461086 - protein, 6 aa, Entamoeba dispar
SKMSNG

SEQ ID NO: 2461087 - protein, 9 aa, Entamoeba dispar
SKMSNQPGK

SEQ ID NO: 2461088 - protein, 8 aa, Entamoeba dispar
SKMTADPR

SEQ ID NO: 2461089 - protein, 5 aa, Entamoeba dispar
SKMTE

SEQ ID NO: 2461090 - protein, 4 aa, Entamoeba dispar
SKND

SEQ ID NO: 2461091 - protein, 8 aa, Entamoeba dispar
SKNDELGK

SEQ ID NO: 2461092 - protein, 8 aa, Entamoeba dispar
SKNDKSTL

SEQ ID NO: 2461093 - protein, 9 aa, Entamoeba dispar
SKNDNKGII

SEQ ID NO: 2461094 - protein, 8 aa, Entamoeba dispar
SKNEEELK

SEQ ID NO: 2461095 - protein, 8 aa, Entamoeba dispar
SKNEEQTT

SEQ ID NO: 2461096 - protein, 10 aa, Entamoeba dispar
SKNEGGKRYN

SEQ ID NO: 2461097 - protein, 9 aa, Entamoeba dispar
SKNEMRPKR

SEQ ID NO: 2461098 - protein, 5 aa, Entamoeba dispar
SKNER

SEQ ID NO: 2461099 - protein, 4 aa, Entamoeba dispar
SKNG

SEQ ID NO: 2461100 - protein, 8 aa, Entamoeba dispar
SKNGATIR

SEQ ID NO: 2461101 - protein, 5 aa, Entamoeba dispar
SKNGF

SEQ ID NO: 2461102 - protein, 6 aa, Entamoeba dispar
SKNGGC

SEQ ID NO: 2461103 - protein, 12 aa, Entamoeba dispar
SKNGISKITDNM

SEQ ID NO: 2461104 - protein, 8 aa, Entamoeba dispar
SKNGKASY

SEQ ID NO: 2461105 - protein, 8 aa, Entamoeba dispar
SKNGKPKV

SEQ ID NO: 2461106 - protein, 5 aa, Entamoeba dispar
SKNGL

SEQ ID NO: 2461107 - protein, 11 aa, Entamoeba dispar
SKNGQNDPERD

SEQ ID NO: 2461108 - protein, 4 aa, Entamoeba dispar
SKNI

SEQ ID NO: 2461109 - protein, 24 aa, Entamoeba dispar
SKNINSRESEQCFTDKKQKNKCMV

SEQ ID NO: 2461110 - protein, 4 aa, Entamoeba dispar
SKNK

SEQ ID NO: 2461111 - protein, 7 aa, Entamoeba dispar
SKNKEDI

SEQ ID NO: 2461112 - protein, 12 aa, Entamoeba dispar
SKNKEGKNDPDA

SEQ ID NO: 2461113 - protein, 8 aa, Entamoeba dispar
SKNKIETV

SEQ ID NO: 2461114 - protein, 5 aa, Entamoeba dispar
SKNKR

SEQ ID NO: 2461115 - protein, 6 aa, Entamoeba dispar
SKNKSI

SEQ ID NO: 2461116 - protein, 5 aa, Entamoeba dispar
SKNKY

SEQ ID NO: 2461117 - protein, 14 aa, Entamoeba dispar
SKNLKVKRSDASKY

SEQ ID NO: 2461118 - protein, 7 aa, Entamoeba dispar
SKNLPTE

SEQ ID NO: 2461119 - protein, 8 aa, Entamoeba dispar
SKNLTGEK

SEQ ID NO: 2461120 - protein, 35 aa, Entamoeba dispar
SKNNEKKDELKREEEKVKEMKEKRREQSRNHEKEE

SEQ ID NO: 2461121 - protein, 17 aa, Entamoeba dispar
SKNNISPSLAQEKVNQL

SEQ ID NO: 2461122 - protein, 7 aa, Entamoeba dispar
SKNNQWI

SEQ ID NO: 2461123 - protein, 9 aa, Entamoeba dispar
SKNNTGIKE

SEQ ID NO: 2461124 - protein, 7 aa, Entamoeba dispar
SKNNTHN

SEQ ID NO: 2461125 - protein, 8 aa, Entamoeba dispar
SKNNTTTV

SEQ ID NO: 2461126 - protein, 13 aa, Entamoeba dispar
SKNPKSKMTPSTI

SEQ ID NO: 2461127 - protein, 5 aa, Entamoeba dispar
SKNPL

SEQ ID NO: 2461128 - protein, 17 aa, Entamoeba dispar
SKNPLKNSVKYPQPPPI

SEQ ID NO: 2461129 - protein, 8 aa, Entamoeba dispar
SKNPQNNE

SEQ ID NO: 2461130 - protein, 19 aa, Entamoeba dispar
SKNPSKSPNFESPMKKRVL

SEQ ID NO: 2461131 - protein, 8 aa, Entamoeba dispar
SKNPSTCC

SEQ ID NO: 2461132 - protein, 6 aa, Entamoeba dispar
SKNPTD

SEQ ID NO: 2461133 - protein, 4 aa, Entamoeba dispar
SKNQ

SEQ ID NO: 2461134 - protein, 5 aa, Entamoeba dispar
SKNQI

SEQ ID NO: 2461135 - protein, 7 aa, Entamoeba dispar
SKNQTSA

SEQ ID NO: 2461136 - protein, 15 aa, Entamoeba dispar
SKNRIQKKSSNANTF

SEQ ID NO: 2461137 - protein, 9 aa, Entamoeba dispar
SKNRRVKDQ

SEQ ID NO: 2461138 - protein, 4 aa, Entamoeba dispar
SKNS

SEQ ID NO: 2461139 - protein, 18 aa, Entamoeba dispar
SKNSLNEQATSLEKGIEN

SEQ ID NO: 2461140 - protein, 18 aa, Entamoeba dispar
SKNSLNERATSLEKGIEN

SEQ ID NO: 2461141 - protein, 8 aa, Entamoeba dispar
SKNSNEKF

SEQ ID NO: 2461142 - protein, 6 aa, Entamoeba dispar
SKNSNL

SEQ ID NO: 2461143 - protein, 6 aa, Entamoeba dispar
SKNSYA

SEQ ID NO: 2461144 - protein, 13 aa, Entamoeba dispar
SKNTSRNETKDVR

SEQ ID NO: 2461145 - protein, 5 aa, Entamoeba dispar
SKNYK

SEQ ID NO: 2461146 - protein, 7 aa, Entamoeba dispar
SKPAYNA

SEQ ID NO: 2461147 - protein, 9 aa, Entamoeba dispar
SKPDSNSRG

SEQ ID NO: 2461148 - protein, 5 aa, Entamoeba dispar
SKPED

SEQ ID NO: 2461149 - protein, 11 aa, Entamoeba dispar
SKPENKPLTPN

SEQ ID NO: 2461150 - protein, 12 aa, Entamoeba dispar
SKPENKPLTPNI

SEQ ID NO: 2461151 - protein, 8 aa, Entamoeba dispar
SKPESVSQ

SEQ ID NO: 2461152 - protein, 5 aa, Entamoeba dispar
SKPFI

SEQ ID NO: 2461153 - protein, 20 aa, Entamoeba dispar
SKPFLNKQDSEIMAELQQLL

SEQ ID NO: 2461154 - protein, 8 aa, Entamoeba dispar
SKPFPTPS

SEQ ID NO: 2461155 - protein, 5 aa, Entamoeba dispar
SKPIE

SEQ ID NO: 2461156 - protein, 36 aa, Entamoeba dispar
SKPIEEKKENKPTLPPKKTVVKPKVPEKKEESTSDF

SEQ ID NO: 2461157 - protein, 7 aa, Entamoeba dispar
SKPIEQA

SEQ ID NO: 2461158 - protein, 8 aa, Entamoeba dispar
SKPIGALN

SEQ ID NO: 2461159 - protein, 7 aa, Entamoeba dispar
SKPKEFK

SEQ ID NO: 2461160 - protein, 7 aa, Entamoeba dispar
SKPKIEP

SEQ ID NO: 2461161 - protein, 12 aa, Entamoeba dispar
SKPLASGEGISK

SEQ ID NO: 2461162 - protein, 5 aa, Entamoeba dispar
SKPLR

SEQ ID NO: 2461163 - protein, 8 aa, Entamoeba dispar
SKPLSPKD

SEQ ID NO: 2461164 - protein, 7 aa, Entamoeba dispar
SKPLTNL

SEQ ID NO: 2461165 - protein, 16 aa, Entamoeba dispar
SKPMNSQDNLKTVREK

SEQ ID NO: 2461166 - protein, 17 aa, Entamoeba dispar
SKPMNSQDNLKTVREKL

SEQ ID NO: 2461167 - protein, 9 aa, Entamoeba dispar
SKPPESLAP

SEQ ID NO: 2461168 - protein, 5 aa, Entamoeba dispar
SKPQQ

SEQ ID NO: 2461169 - protein, 9 aa, Entamoeba dispar
SKPSEKKNT

SEQ ID NO: 2461170 - protein, 13 aa, Entamoeba dispar
SKPSHPNDSFEYP

SEQ ID NO: 2461171 - protein, 7 aa, Entamoeba dispar
SKPSNQF

SEQ ID NO: 2461172 - protein, 14 aa, Entamoeba dispar
SKPSRKSKKSHQME

SEQ ID NO: 2461173 - protein, 9 aa, Entamoeba dispar
SKPSSPRRL

SEQ ID NO: 2461174 - protein, 7 aa, Entamoeba dispar
SKPSTIN

SEQ ID NO: 2461175 - protein, 6 aa, Entamoeba dispar
SKPTFS

SEQ ID NO: 2461176 - protein, 5 aa, Entamoeba dispar
SKPTQ

SEQ ID NO: 2461177 - protein, 8 aa, Entamoeba dispar
SKPVRTAS

SEQ ID NO: 2461178 - protein, 9 aa, Entamoeba dispar
SKPVTEKIP

SEQ ID NO: 2461179 - protein, 11 aa, Entamoeba dispar
SKQEEKKINEI

SEQ ID NO: 2461180 - protein, 18 aa, Entamoeba dispar
SKQEEPKKEEKSNKKKEI

SEQ ID NO: 2461181 - protein, 14 aa, Entamoeba dispar
SKQEMKRAEHERKV

SEQ ID NO: 2461182 - protein, 9 aa, Entamoeba dispar
SKQEQKIDK

SEQ ID NO: 2461183 - protein, 7 aa, Entamoeba dispar
SKQETAA

SEQ ID NO: 2461184 - protein, 4 aa, Entamoeba dispar
SKQF

SEQ ID NO: 2461185 - protein, 7 aa, Entamoeba dispar
SKQGSVS

SEQ ID NO: 2461186 - protein, 4 aa, Entamoeba dispar
SKQI

SEQ ID NO: 2461187 - protein, 4 aa, Entamoeba dispar
SKQK

SEQ ID NO: 2461188 - protein, 21 aa, Entamoeba dispar
SKQKSKIDSGWNSDEAFRVYQ

SEQ ID NO: 2461189 - protein, 8 aa, Entamoeba dispar
SKQKYYEH

SEQ ID NO: 2461190 - protein, 5 aa, Entamoeba dispar
SKQLE

SEQ ID NO: 2461191 - protein, 6 aa, Entamoeba dispar
SKQNEV

SEQ ID NO: 2461192 - protein, 11 aa, Entamoeba dispar
SKQNKEKFENE

SEQ ID NO: 2461193 - protein, 10 aa, Entamoeba dispar
SKQNQYEKSE

SEQ ID NO: 2461194 - protein, 6 aa, Entamoeba dispar
SKQPHG

SEQ ID NO: 2461195 - protein, 7 aa, Entamoeba dispar
SKQPQRL

SEQ ID NO: 2461196 - protein, 10 aa, Entamoeba dispar
SKQPSPPVQP

SEQ ID NO: 2461197 - protein, 7 aa, Entamoeba dispar
SKQQDIG

SEQ ID NO: 2461198 - protein, 8 aa, Entamoeba dispar
SKQQDSMM

SEQ ID NO: 2461199 - protein, 6 aa, Entamoeba dispar
SKQQEI

SEQ ID NO: 2461200 - protein, 6 aa, Entamoeba dispar
SKQRIE

SEQ ID NO: 2461201 - protein, 7 aa, Entamoeba dispar
SKQRPRK

SEQ ID NO: 2461202 - protein, 5 aa, Entamoeba dispar
SKQRS

SEQ ID NO: 2461203 - protein, 6 aa, Entamoeba dispar
SKQSDI

SEQ ID NO: 2461204 - protein, 9 aa, Entamoeba dispar
SKQSGNETS

SEQ ID NO: 2461205 - protein, 6 aa, Entamoeba dispar
SKQSKM

SEQ ID NO: 2461206 - protein, 18 aa, Entamoeba dispar
SKQSKSSHKSSSKMDSSV

SEQ ID NO: 2461207 - protein, 5 aa, Entamoeba dispar
SKQTE

SEQ ID NO: 2461208 - protein, 7 aa, Entamoeba dispar
SKQTESP

SEQ ID NO: 2461209 - protein, 6 aa, Entamoeba dispar
SKQTKH

SEQ ID NO: 2461210 - protein, 7 aa, Entamoeba dispar
SKQTRIK

SEQ ID NO: 2461211 - protein, 15 aa, Entamoeba dispar
SKRAGSIKISSESNF

SEQ ID NO: 2461212 - protein, 8 aa, Entamoeba dispar
SKRAKNIN

SEQ ID NO: 2461213 - protein, 7 aa, Entamoeba dispar
SKRDEQK

SEQ ID NO: 2461214 - protein, 11 aa, Entamoeba dispar
SKRDGSNYNSK

SEQ ID NO: 2461215 - protein, 9 aa, Entamoeba dispar
SKRDKGINT

SEQ ID NO: 2461216 - protein, 7 aa, Entamoeba dispar
SKREPLE

SEQ ID NO: 2461217 - protein, 10 aa, Entamoeba dispar
SKRETKDGFN

SEQ ID NO: 2461218 - protein, 4 aa, Entamoeba dispar
SKRF

SEQ ID NO: 2461219 - protein, 21 aa, Entamoeba dispar
SKRFNEEYKRRKINEEDNKII

SEQ ID NO: 2461220 - protein, 18 aa, Entamoeba dispar
SKRFNEEYKRRKINEEED

SEQ ID NO: 2461221 - protein, 7 aa, Entamoeba dispar
SKRFNEK

SEQ ID NO: 2461222 - protein, 5 aa, Entamoeba dispar
SKRGC

SEQ ID NO: 2461223 - protein, 8 aa, Entamoeba dispar
SKRGFGEE

SEQ ID NO: 2461224 - protein, 7 aa, Entamoeba dispar
SKRIRSL

SEQ ID NO: 2461225 - protein, 9 aa, Entamoeba dispar
SKRITPDNQ

SEQ ID NO: 2461226 - protein, 6 aa, Entamoeba dispar
SKRKYN

SEQ ID NO: 2461227 - protein, 7 aa, Entamoeba dispar
SKRLADQ

SEQ ID NO: 2461228 - protein, 7 aa, Entamoeba dispar
SKRMTAQ

SEQ ID NO: 2461229 - protein, 5 aa, Entamoeba dispar
SKRNL

SEQ ID NO: 2461230 - protein, 8 aa, Entamoeba dispar
SKRNRSNA

SEQ ID NO: 2461231 - protein, 6 aa, Entamoeba dispar
SKRNSS

SEQ ID NO: 2461232 - protein, 4 aa, Entamoeba dispar
SKRP

SEQ ID NO: 2461233 - protein, 12 aa, Entamoeba dispar
SKRPETTKEDEG

SEQ ID NO: 2461234 - protein, 6 aa, Entamoeba dispar
SKRPKI

SEQ ID NO: 2461235 - protein, 7 aa, Entamoeba dispar
SKRPPFK

SEQ ID NO: 2461236 - protein, 7 aa, Entamoeba dispar
SKRPPIF

SEQ ID NO: 2461237 - protein, 8 aa, Entamoeba dispar
SKRQLSVE

SEQ ID NO: 2461238 - protein, 6 aa, Entamoeba dispar
SKRRID

SEQ ID NO: 2461239 - protein, 7 aa, Entamoeba dispar
SKRSDNN

SEQ ID NO: 2461240 - protein, 8 aa, Entamoeba dispar
SKRSERSL

SEQ ID NO: 2461241 - protein, 7 aa, Entamoeba dispar
SKRSGRD

SEQ ID NO: 2461242 - protein, 7 aa, Entamoeba dispar
SKRSSSA

SEQ ID NO: 2461243 - protein, 5 aa, Entamoeba dispar
SKRTD

SEQ ID NO: 2461244 - protein, 6 aa, Entamoeba dispar
SKRTEY

SEQ ID NO: 2461245 - protein, 10 aa, Entamoeba dispar
SKRTKELDKK

SEQ ID NO: 2461246 - protein, 8 aa, Entamoeba dispar
SKRTLENQ

SEQ ID NO: 2461247 - protein, 6 aa, Entamoeba dispar
SKRYSV

SEQ ID NO: 2461248 - protein, 8 aa, Entamoeba dispar
SKSAPGCP

SEQ ID NO: 2461249 - protein, 7 aa, Entamoeba dispar
SKSAVED

SEQ ID NO: 2461250 - protein, 23 aa, Entamoeba dispar
SKSCSSPADSLKKVKTDSTTLNP

SEQ ID NO: 2461251 - protein, 8 aa, Entamoeba dispar
SKSDDVGI

SEQ ID NO: 2461252 - protein, 4 aa, Entamoeba dispar
SKSE

SEQ ID NO: 2461253 - protein, 10 aa, Entamoeba dispar
SKSEDETELD

SEQ ID NO: 2461254 - protein, 7 aa, Entamoeba dispar
SKSEIRP

SEQ ID NO: 2461255 - protein, 7 aa, Entamoeba dispar
SKSEKYE

SEQ ID NO: 2461256 - protein, 8 aa, Entamoeba dispar
SKSENGTM

SEQ ID NO: 2461257 - protein, 5 aa, Entamoeba dispar
SKSFD

SEQ ID NO: 2461258 - protein, 7 aa, Entamoeba dispar
SKSFKGR

SEQ ID NO: 2461259 - protein, 11 aa, Entamoeba dispar
SKSFTNSEQAN

SEQ ID NO: 2461260 - protein, 9 aa, Entamoeba dispar
SKSGEDMTS

SEQ ID NO: 2461261 - protein, 9 aa, Entamoeba dispar
SKSGKTLYN

SEQ ID NO: 2461262 - protein, 8 aa, Entamoeba dispar
SKSGSNAS

SEQ ID NO: 2461263 - protein, 7 aa, Entamoeba dispar
SKSGYNV

SEQ ID NO: 2461264 - protein, 9 aa, Entamoeba dispar
SKSINNSIN

SEQ ID NO: 2461265 - protein, 9 aa, Entamoeba dispar
SKSISTNER

SEQ ID NO: 2461266 - protein, 8 aa, Entamoeba dispar
SKSITNID

SEQ ID NO: 2461267 - protein, 11 aa, Entamoeba dispar
SKSKAGQLTKH

SEQ ID NO: 2461268 - protein, 6 aa, Entamoeba dispar
SKSKDL

SEQ ID NO: 2461269 - protein, 7 aa, Entamoeba dispar
SKSKEMF

SEQ ID NO: 2461270 - protein, 15 aa, Entamoeba dispar
SKSKIKEEDVERTEK

SEQ ID NO: 2461271 - protein, 14 aa, Entamoeba dispar
SKSKLKETIKERGE

SEQ ID NO: 2461272 - protein, 10 aa, Entamoeba dispar
SKSKNQSFQN

SEQ ID NO: 2461273 - protein, 10 aa, Entamoeba dispar
SKSKSNIPRE

SEQ ID NO: 2461274 - protein, 7 aa, Entamoeba dispar
SKSKTNI

SEQ ID NO: 2461275 - protein, 7 aa, Entamoeba dispar
SKSKVAD

SEQ ID NO: 2461276 - protein, 9 aa, Entamoeba dispar
SKSLKGVSY

SEQ ID NO: 2461277 - protein, 7 aa, Entamoeba dispar
SKSLNKI

SEQ ID NO: 2461278 - protein, 10 aa, Entamoeba dispar
SKSLNNGLSK

SEQ ID NO: 2461279 - protein, 7 aa, Entamoeba dispar
SKSLREI

SEQ ID NO: 2461280 - protein, 7 aa, Entamoeba dispar
SKSLSIG

SEQ ID NO: 2461281 - protein, 14 aa, Entamoeba dispar
SKSLSQPDAKSKIT

SEQ ID NO: 2461282 - protein, 45 aa, Entamoeba dispar
SKSNGQDKSDNQITNQSLKSNKSNSSTNTENSTFSEPIQYNQKNE

SEQ ID NO: 2461283 - protein, 8 aa, Entamoeba dispar
SKSNKQRK

SEQ ID NO: 2461284 - protein, 8 aa, Entamoeba dispar
SKSPELKT

SEQ ID NO: 2461285 - protein, 61 aa, Entamoeba dispar
SKSPQSDSSLVPSTSNSPLSQNNDSSELKTRLTPQRRSPLSPSTSFNQPKKSSNAVTSKLF

SEQ ID NO: 2461286 - protein, 8 aa, Entamoeba dispar
SKSQESNI

SEQ ID NO: 2461287 - protein, 9 aa, Entamoeba dispar
SKSQKEMDE

SEQ ID NO: 2461288 - protein, 7 aa, Entamoeba dispar
SKSQKFT

SEQ ID NO: 2461289 - protein, 11 aa, Entamoeba dispar
SKSQKIATKTE

SEQ ID NO: 2461290 - protein, 10 aa, Entamoeba dispar
SKSQQYIPTK

SEQ ID NO: 2461291 - protein, 10 aa, Entamoeba dispar
SKSREENKSI

SEQ ID NO: 2461292 - protein, 10 aa, Entamoeba dispar
SKSRLGDDEK

SEQ ID NO: 2461293 - protein, 11 aa, Entamoeba dispar
SKSRSPNTNNV

SEQ ID NO: 2461294 - protein, 7 aa, Entamoeba dispar
SKSRVLE

SEQ ID NO: 2461295 - protein, 8 aa, Entamoeba dispar
SKSSAARS

SEQ ID NO: 2461296 - protein, 6 aa, Entamoeba dispar
SKSSAL

SEQ ID NO: 2461297 - protein, 17 aa, Entamoeba dispar
SKSSDTKATKKKKSKIM

SEQ ID NO: 2461298 - protein, 8 aa, Entamoeba dispar
SKSSNTNK

SEQ ID NO: 2461299 - protein, 7 aa, Entamoeba dispar
SKSSPSL

SEQ ID NO: 2461300 - protein, 6 aa, Entamoeba dispar
SKSSSM

SEQ ID NO: 2461301 - protein, 10 aa, Entamoeba dispar
SKSSTIKKST

SEQ ID NO: 2461302 - protein, 10 aa, Entamoeba dispar
SKSSYPNTSP

SEQ ID NO: 2461303 - protein, 5 aa, Entamoeba dispar
SKSTA

SEQ ID NO: 2461304 - protein, 28 aa, Entamoeba dispar
SKSTAGDKQPPLTRPRVSTNSSKNKSAF

SEQ ID NO: 2461305 - protein, 7 aa, Entamoeba dispar
SKSTFSS

SEQ ID NO: 2461306 - protein, 8 aa, Entamoeba dispar
SKSTINDS

SEQ ID NO: 2461307 - protein, 9 aa, Entamoeba dispar
SKSTNPVKP

SEQ ID NO: 2461308 - protein, 5 aa, Entamoeba dispar
SKSVN

SEQ ID NO: 2461309 - protein, 5 aa, Entamoeba dispar
SKTAN

SEQ ID NO: 2461310 - protein, 19 aa, Entamoeba dispar
SKTANDNKSESSESGAKTV

SEQ ID NO: 2461311 - protein, 8 aa, Entamoeba dispar
SKTDITGA

SEQ ID NO: 2461312 - protein, 6 aa, Entamoeba dispar
SKTDKL

SEQ ID NO: 2461313 - protein, 7 aa, Entamoeba dispar
SKTDPNI

SEQ ID NO: 2461314 - protein, 7 aa, Entamoeba dispar
SKTEAGC

SEQ ID NO: 2461315 - protein, 17 aa, Entamoeba dispar
SKTEEEVEQLFEHFQMF

SEQ ID NO: 2461316 - protein, 13 aa, Entamoeba dispar
SKTEICNKQSEEL

SEQ ID NO: 2461317 - protein, 9 aa, Entamoeba dispar
SKTEKFKEI

SEQ ID NO: 2461318 - protein, 10 aa, Entamoeba dispar
SKTEPRLNNQ

SEQ ID NO: 2461319 - protein, 7 aa, Entamoeba dispar
SKTESKF

SEQ ID NO: 2461320 - protein, 6 aa, Entamoeba dispar
SKTFQA

SEQ ID NO: 2461321 - protein, 9 aa, Entamoeba dispar
SKTGKSQLK

SEQ ID NO: 2461322 - protein, 12 aa, Entamoeba dispar
SKTGPSKGSTMS

SEQ ID NO: 2461323 - protein, 5 aa, Entamoeba dispar
SKTHE

SEQ ID NO: 2461324 - protein, 6 aa, Entamoeba dispar
SKTIDD

SEQ ID NO: 2461325 - protein, 14 aa, Entamoeba dispar
SKTIEKDKEEIEKL

SEQ ID NO: 2461326 - protein, 7 aa, Entamoeba dispar
SKTISTI

SEQ ID NO: 2461327 - protein, 7 aa, Entamoeba dispar
SKTKCHQ

SEQ ID NO: 2461328 - protein, 14 aa, Entamoeba dispar
SKTKDKKVEKNSGF

SEQ ID NO: 2461329 - protein, 7 aa, Entamoeba dispar
SKTKEDM

SEQ ID NO: 2461330 - protein, 7 aa, Entamoeba dispar
SKTKKCG

SEQ ID NO: 2461331 - protein, 12 aa, Entamoeba dispar
SKTKNSLTISKG

SEQ ID NO: 2461332 - protein, 6 aa, Entamoeba dispar
SKTKQE

SEQ ID NO: 2461333 - protein, 11 aa, Entamoeba dispar
SKTKQKQITTL

SEQ ID NO: 2461334 - protein, 6 aa, Entamoeba dispar
SKTKYF

SEQ ID NO: 2461335 - protein, 18 aa, Entamoeba dispar
SKTLDGKPLELEPGLSTY

SEQ ID NO: 2461336 - protein, 7 aa, Entamoeba dispar
SKTLDNT

SEQ ID NO: 2461337 - protein, 8 aa, Entamoeba dispar
SKTLPDKL

SEQ ID NO: 2461338 - protein, 7 aa, Entamoeba dispar
SKTLPWK

SEQ ID NO: 2461339 - protein, 9 aa, Entamoeba dispar
SKTMNREAR

SEQ ID NO: 2461340 - protein, 4 aa, Entamoeba dispar
SKTN

SEQ ID NO: 2461341 - protein, 19 aa, Entamoeba dispar
SKTNDNQRVEDKEKTCKRF

SEQ ID NO: 2461342 - protein, 6 aa, Entamoeba dispar
SKTNIQ

SEQ ID NO: 2461343 - protein, 7 aa, Entamoeba dispar
SKTNSNF

SEQ ID NO: 2461344 - protein, 12 aa, Entamoeba dispar
SKTNSSLKALGA

SEQ ID NO: 2461345 - protein, 16 aa, Entamoeba dispar
SKTPKTPKLNKTIPYT

SEQ ID NO: 2461346 - protein, 7 aa, Entamoeba dispar
SKTPPEK

SEQ ID NO: 2461347 - protein, 7 aa, Entamoeba dispar
SKTPRKQ

SEQ ID NO: 2461348 - protein, 17 aa, Entamoeba dispar
SKTQLNSNQKINEPTFD

SEQ ID NO: 2461349 - protein, 7 aa, Entamoeba dispar
SKTRDPQ

SEQ ID NO: 2461350 - protein, 9 aa, Entamoeba dispar
SKTRTPEEI

SEQ ID NO: 2461351 - protein, 7 aa, Entamoeba dispar
SKTSEDI

SEQ ID NO: 2461352 - protein, 7 aa, Entamoeba dispar
SKTSQNR

SEQ ID NO: 2461353 - protein, 11 aa, Entamoeba dispar
SKTSRGKCKTC

SEQ ID NO: 2461354 - protein, 4 aa, Entamoeba dispar
SKTT

SEQ ID NO: 2461355 - protein, 15 aa, Entamoeba dispar
SKTTDEEVGDGTTSV

SEQ ID NO: 2461356 - protein, 9 aa, Entamoeba dispar
SKTTKGNNR

SEQ ID NO: 2461357 - protein, 7 aa, Entamoeba dispar
SKTTNEQ

SEQ ID NO: 2461358 - protein, 9 aa, Entamoeba dispar
SKTTQGSKK

SEQ ID NO: 2461359 - protein, 8 aa, Entamoeba dispar
SKTYNIPG

SEQ ID NO: 2461360 - protein, 9 aa, Entamoeba dispar
SKVDKTVEL

SEQ ID NO: 2461361 - protein, 32 aa, Entamoeba dispar
SKVENSIKGKIKDNLKNGYSKVEKAGVAGGKM

SEQ ID NO: 2461362 - protein, 16 aa, Entamoeba dispar
SKVGALKGEYQDATPF

SEQ ID NO: 2461363 - protein, 9 aa, Entamoeba dispar
SKVGDEQSE

SEQ ID NO: 2461364 - protein, 7 aa, Entamoeba dispar
SKVGGPN

SEQ ID NO: 2461365 - protein, 6 aa, Entamoeba dispar
SKVGKT

SEQ ID NO: 2461366 - protein, 7 aa, Entamoeba dispar
SKVISQS

SEQ ID NO: 2461367 - protein, 12 aa, Entamoeba dispar
SKVKDEKNDPRK

SEQ ID NO: 2461368 - protein, 22 aa, Entamoeba dispar
SKVKGKKKQSQTIQNQINEEMN

SEQ ID NO: 2461369 - protein, 8 aa, Entamoeba dispar
SKVKSEIN

SEQ ID NO: 2461370 - protein, 9 aa, Entamoeba dispar
SKVNDKENI

SEQ ID NO: 2461371 - protein, 11 aa, Entamoeba dispar
SKVNQKYLPPK

SEQ ID NO: 2461372 - protein, 15 aa, Entamoeba dispar
SKVPGAQFESEIGGL

SEQ ID NO: 2461373 - protein, 7 aa, Entamoeba dispar
SKVQEKK

SEQ ID NO: 2461374 - protein, 9 aa, Entamoeba dispar
SKVSPKARR

SEQ ID NO: 2461375 - protein, 20 aa, Entamoeba dispar
SKVSSGEKVDLSGKKIKEGF

SEQ ID NO: 2461376 - protein, 7 aa, Entamoeba dispar
SKWTPEE

SEQ ID NO: 2461377 - protein, 8 aa, Entamoeba dispar
SKYAEPQN

SEQ ID NO: 2461378 - protein, 48 aa, Entamoeba dispar
SKYAPKKSNPVKPTPTRGAHRIEREKKEYDSSTPTQMRTPIPQTPTYT

SEQ ID NO: 2461379 - protein, 12 aa, Entamoeba dispar
SKYDGESQKDFT

SEQ ID NO: 2461380 - protein, 7 aa, Entamoeba dispar
SKYDGGD

SEQ ID NO: 2461381 - protein, 8 aa, Entamoeba dispar
SKYDQLKS

SEQ ID NO: 2461382 - protein, 4 aa, Entamoeba dispar
SKYE

SEQ ID NO: 2461383 - protein, 11 aa, Entamoeba dispar
SKYEENKPSQL

SEQ ID NO: 2461384 - protein, 7 aa, Entamoeba dispar
SKYENKE

SEQ ID NO: 2461385 - protein, 9 aa, Entamoeba dispar
SKYGEEGGK

SEQ ID NO: 2461386 - protein, 9 aa, Entamoeba dispar
SKYKDVSKY

SEQ ID NO: 2461387 - protein, 5 aa, Entamoeba dispar
SKYKN

SEQ ID NO: 2461388 - protein, 11 aa, Entamoeba dispar
SKYPVDTQPHP

SEQ ID NO: 2461389 - protein, 8 aa, Entamoeba dispar
SKYQDERQ

SEQ ID NO: 2461390 - protein, 10 aa, Entamoeba dispar
SKYQKEGKEW

SEQ ID NO: 2461391 - protein, 22 aa, Entamoeba dispar
SKYQPLNHQNQTDSTQSDPLTQ

SEQ ID NO: 2461392 - protein, 9 aa, Entamoeba dispar
SKYSGLSSN

SEQ ID NO: 2461393 - protein, 9 aa, Entamoeba dispar
SKYSIDSNN

SEQ ID NO: 2461394 - protein, 11 aa, Entamoeba dispar
SKYSKPTSKTL

SEQ ID NO: 2461395 - protein, 5 aa, Entamoeba dispar
SKYSN

SEQ ID NO: 2461396 - protein, 6 aa, Entamoeba dispar
SKYSNS

SEQ ID NO: 2461397 - protein, 7 aa, Entamoeba dispar
SKYSNTN

SEQ ID NO: 2461398 - protein, 8 aa, Entamoeba dispar
SKYSPYST

SEQ ID NO: 2461399 - protein, 6 aa, Entamoeba dispar
SKYSRG

SEQ ID NO: 2461400 - protein, 13 aa, Entamoeba dispar
SLADQPKEELEKK

SEQ ID NO: 2461401 - protein, 11 aa, Entamoeba dispar
SLAEMKKTKTF

SEQ ID NO: 2461402 - protein, 10 aa, Entamoeba dispar
SLAKAKQFAA

SEQ ID NO: 2461403 - protein, 4 aa, Entamoeba dispar
SLAN

SEQ ID NO: 2461404 - protein, 9 aa, Entamoeba dispar
SLASPDDDK

SEQ ID NO: 2461405 - protein, 9 aa, Entamoeba dispar
SLDATRDDA

SEQ ID NO: 2461406 - protein, 20 aa, Entamoeba dispar
SLDDDEQPKKETTVNNSSNM

SEQ ID NO: 2461407 - protein, 10 aa, Entamoeba dispar
SLDDNASLSQ

SEQ ID NO: 2461408 - protein, 12 aa, Entamoeba dispar
SLDDQVLKKKQL

SEQ ID NO: 2461409 - protein, 13 aa, Entamoeba dispar
SLDDTLGSSAPEV

SEQ ID NO: 2461410 - protein, 6 aa, Entamoeba dispar
SLDEDG

SEQ ID NO: 2461411 - protein, 5 aa, Entamoeba dispar
SLDEE

SEQ ID NO: 2461412 - protein, 23 aa, Entamoeba dispar
SLDEIKKSHEIERESNDKEIKLQ

SEQ ID NO: 2461413 - protein, 16 aa, Entamoeba dispar
SLDETARKYLSSDTHS

SEQ ID NO: 2461414 - protein, 5 aa, Entamoeba dispar
SLDGK

SEQ ID NO: 2461415 - protein, 13 aa, Entamoeba dispar
SLDGKSRSKNNTF

SEQ ID NO: 2461416 - protein, 15 aa, Entamoeba dispar
SLDGSKVAVSSPSGN

SEQ ID NO: 2461417 - protein, 5 aa, Entamoeba dispar
SLDGT

SEQ ID NO: 2461418 - protein, 5 aa, Entamoeba dispar
SLDGY

SEQ ID NO: 2461419 - protein, 11 aa, Entamoeba dispar
SLDKAKEISQL

SEQ ID NO: 2461420 - protein, 7 aa, Entamoeba dispar
SLDPKER

SEQ ID NO: 2461421 - protein, 16 aa, Entamoeba dispar
SLDPKEYEEQINTLSL

SEQ ID NO: 2461422 - protein, 6 aa, Entamoeba dispar
SLDQPI

SEQ ID NO: 2461423 - protein, 6 aa, Entamoeba dispar
SLDSGL

SEQ ID NO: 2461424 - protein, 12 aa, Entamoeba dispar
SLDSSLDTFEGS

SEQ ID NO: 2461425 - protein, 25 aa, Entamoeba dispar
SLDTKKETKTNTTQHQDEKKKTSED

SEQ ID NO: 2461426 - protein, 5 aa, Entamoeba dispar
SLDTN

SEQ ID NO: 2461427 - protein, 8 aa, Entamoeba dispar
SLDTNNGA

SEQ ID NO: 2461428 - protein, 22 aa, Entamoeba dispar
SLEDKNKKEIKDNKFKQQDEKK

SEQ ID NO: 2461429 - protein, 21 aa, Entamoeba dispar
SLEDKSQTPELPEDDENTLNQ

SEQ ID NO: 2461430 - protein, 7 aa, Entamoeba dispar
SLEEKIN

SEQ ID NO: 2461431 - protein, 13 aa, Entamoeba dispar
SLEENKQSITSDD

SEQ ID NO: 2461432 - protein, 10 aa, Entamoeba dispar
SLEEQEKKKN

SEQ ID NO: 2461433 - protein, 4 aa, Entamoeba dispar
SLEI

SEQ ID NO: 2461434 - protein, 5 aa, Entamoeba dispar
SLEKE

SEQ ID NO: 2461435 - protein, 8 aa, Entamoeba dispar
SLEKEGYP

SEQ ID NO: 2461436 - protein, 36 aa, Entamoeba dispar
SLEKGSESSSLISPRGISQTALTNGRHSSHEDPPEH

SEQ ID NO: 2461437 - protein, 10 aa, Entamoeba dispar
SLENSQNEEL

SEQ ID NO: 2461438 - protein, 14 aa, Entamoeba dispar
SLEPEKNGLVPPKA

SEQ ID NO: 2461439 - protein, 8 aa, Entamoeba dispar
SLEPKEVS

SEQ ID NO: 2461440 - protein, 6 aa, Entamoeba dispar
SLEPSF

SEQ ID NO: 2461441 - protein, 11 aa, Entamoeba dispar
SLEPTRNKEIR

SEQ ID NO: 2461442 - protein, 5 aa, Entamoeba dispar
SLERQ

SEQ ID NO: 2461443 - protein, 6 aa, Entamoeba dispar
SLERSA

SEQ ID NO: 2461444 - protein, 7 aa, Entamoeba dispar
SLERSIS

SEQ ID NO: 2461445 - protein, 7 aa, Entamoeba dispar
SLESQEI

SEQ ID NO: 2461446 - protein, 6 aa, Entamoeba dispar
SLETVT

SEQ ID NO: 2461447 - protein, 11 aa, Entamoeba dispar
SLFNRNDKGKF

SEQ ID NO: 2461448 - protein, 23 aa, Entamoeba dispar
SLFPSEEEKESVTTNSYFKMEQK

SEQ ID NO: 2461449 - protein, 5 aa, Entamoeba dispar
SLFSG

SEQ ID NO: 2461450 - protein, 6 aa, Entamoeba dispar
SLGATI

SEQ ID NO: 2461451 - protein, 10 aa, Entamoeba dispar
SLGDKELHPP

SEQ ID NO: 2461452 - protein, 11 aa, Entamoeba dispar
SLGDKTYKGKG

SEQ ID NO: 2461453 - protein, 7 aa, Entamoeba dispar
SLGDTSI

SEQ ID NO: 2461454 - protein, 5 aa, Entamoeba dispar
SLGEL

SEQ ID NO: 2461455 - protein, 14 aa, Entamoeba dispar
SLGESSIEKETSCN

SEQ ID NO: 2461456 - protein, 14 aa, Entamoeba dispar
SLGGPEEGSELPKL

SEQ ID NO: 2461457 - protein, 6 aa, Entamoeba dispar
SLGKMK

SEQ ID NO: 2461458 - protein, 4 aa, Entamoeba dispar
SLGN

SEQ ID NO: 2461459 - protein, 20 aa, Entamoeba dispar
SLGNNDKIITKKQRKKESLF

SEQ ID NO: 2461460 - protein, 8 aa, Entamoeba dispar
SLGNNGDI

SEQ ID NO: 2461461 - protein, 7 aa, Entamoeba dispar
SLGPKGM

SEQ ID NO: 2461462 - protein, 14 aa, Entamoeba dispar
SLGPMTPKKKPGSL

SEQ ID NO: 2461463 - protein, 8 aa, Entamoeba dispar
SLGPSFGS

SEQ ID NO: 2461464 - protein, 7 aa, Entamoeba dispar
SLGQSGL

SEQ ID NO: 2461465 - protein, 5 aa, Entamoeba dispar
SLGSL

SEQ ID NO: 2461466 - protein, 5 aa, Entamoeba dispar
SLGTN

SEQ ID NO: 2461467 - protein, 22 aa, Entamoeba dispar
SLGTTDKKKEEKSKEENSSTSI

SEQ ID NO: 2461468 - protein, 20 aa, Entamoeba dispar
SLGTVRGGKGRENKNKREAD

SEQ ID NO: 2461469 - protein, 4 aa, Entamoeba dispar
SLGW

SEQ ID NO: 2461470 - protein, 11 aa, Entamoeba dispar
SLHPSRATSGV

SEQ ID NO: 2461471 - protein, 6 aa, Entamoeba dispar
SLHTSH

SEQ ID NO: 2461472 - protein, 12 aa, Entamoeba dispar
SLIENSANRFGS

SEQ ID NO: 2461473 - protein, 5 aa, Entamoeba dispar
SLIKT

SEQ ID NO: 2461474 - protein, 6 aa, Entamoeba dispar
SLISKE

SEQ ID NO: 2461475 - protein, 12 aa, Entamoeba dispar
SLKADTEKGSIH

SEQ ID NO: 2461476 - protein, 7 aa, Entamoeba dispar
SLKDTFG

SEQ ID NO: 2461477 - protein, 4 aa, Entamoeba dispar
SLKE

SEQ ID NO: 2461478 - protein, 15 aa, Entamoeba dispar
SLKEEDGSMKASEHE

SEQ ID NO: 2461479 - protein, 9 aa, Entamoeba dispar
SLKEENEIK

SEQ ID NO: 2461480 - protein, 8 aa, Entamoeba dispar
SLKEGDSI

SEQ ID NO: 2461481 - protein, 6 aa, Entamoeba dispar
SLKERE

SEQ ID NO: 2461482 - protein, 12 aa, Entamoeba dispar
SLKGEDGKELNP

SEQ ID NO: 2461483 - protein, 6 aa, Entamoeba dispar
SLKGKE

SEQ ID NO: 2461484 - protein, 8 aa, Entamoeba dispar
SLKGNLDD

SEQ ID NO: 2461485 - protein, 9 aa, Entamoeba dispar
SLKGRASLP

SEQ ID NO: 2461486 - protein, 10 aa, Entamoeba dispar
SLKHDNNQDL

SEQ ID NO: 2461487 - protein, 4 aa, Entamoeba dispar
SLKK

SEQ ID NO: 2461488 - protein, 12 aa, Entamoeba dispar
SLKKKSGREKYG

SEQ ID NO: 2461489 - protein, 7 aa, Entamoeba dispar
SLKKSNT

SEQ ID NO: 2461490 - protein, 5 aa, Entamoeba dispar
SLKKV

SEQ ID NO: 2461491 - protein, 9 aa, Entamoeba dispar
SLKNKEVKS

SEQ ID NO: 2461492 - protein, 7 aa, Entamoeba dispar
SLKNNKD

SEQ ID NO: 2461493 - protein, 5 aa, Entamoeba dispar
SLKQA

SEQ ID NO: 2461494 - protein, 8 aa, Entamoeba dispar
SLKQGQNP

SEQ ID NO: 2461495 - protein, 19 aa, Entamoeba dispar
SLKRMTETLKKDKTLTPIG

SEQ ID NO: 2461496 - protein, 13 aa, Entamoeba dispar
SLKSETDQDEESI

SEQ ID NO: 2461497 - protein, 12 aa, Entamoeba dispar
SLKSIKNSTFSN

SEQ ID NO: 2461498 - protein, 11 aa, Entamoeba dispar
SLKSKTSDGIE

SEQ ID NO: 2461499 - protein, 8 aa, Entamoeba dispar
SLKSNKPL

SEQ ID NO: 2461500 - protein, 6 aa, Entamoeba dispar
SLKSRE

SEQ ID NO: 2461501 - protein, 9 aa, Entamoeba dispar
SLKSRRINK

SEQ ID NO: 2461502 - protein, 8 aa, Entamoeba dispar
SLKSTKKE

SEQ ID NO: 2461503 - protein, 12 aa, Entamoeba dispar
SLKSTQTKVTTI

SEQ ID NO: 2461504 - protein, 10 aa, Entamoeba dispar
SLKSTTDEEF

SEQ ID NO: 2461505 - protein, 11 aa, Entamoeba dispar
SLKSTYDNRTY

SEQ ID NO: 2461506 - protein, 7 aa, Entamoeba dispar
SLKTNSF

SEQ ID NO: 2461507 - protein, 12 aa, Entamoeba dispar
SLLASGSAVGGS

SEQ ID NO: 2461508 - protein, 5 aa, Entamoeba dispar
SLLGN

SEQ ID NO: 2461509 - protein, 13 aa, Entamoeba dispar
SLLNSEKGLPKVN

SEQ ID NO: 2461510 - protein, 6 aa, Entamoeba dispar
SLLPPK

SEQ ID NO: 2461511 - protein, 7 aa, Entamoeba dispar
SLNDGDI

SEQ ID NO: 2461512 - protein, 9 aa, Entamoeba dispar
SLNDNDLEK

SEQ ID NO: 2461513 - protein, 12 aa, Entamoeba dispar
SLNDNSFSSPPE

SEQ ID NO: 2461514 - protein, 12 aa, Entamoeba dispar
SLNDPPNSDLPP

SEQ ID NO: 2461515 - protein, 13 aa, Entamoeba dispar
SLNDYTGSLTLIS

SEQ ID NO: 2461516 - protein, 11 aa, Entamoeba dispar
SLNEDHKPNVP

SEQ ID NO: 2461517 - protein, 9 aa, Entamoeba dispar
SLNENDENC

SEQ ID NO: 2461518 - protein, 10 aa, Entamoeba dispar
SLNENQTSIS

SEQ ID NO: 2461519 - protein, 10 aa, Entamoeba dispar
SLNENSQVDL

SEQ ID NO: 2461520 - protein, 6 aa, Entamoeba dispar
SLNEQV

SEQ ID NO: 2461521 - protein, 11 aa, Entamoeba dispar
SLNESSFPEGI

SEQ ID NO: 2461522 - protein, 4 aa, Entamoeba dispar
SLNG

SEQ ID NO: 2461523 - protein, 4 aa, Entamoeba dispar
SLNK

SEQ ID NO: 2461524 - protein, 29 aa, Entamoeba dispar
SLNKQELKSVEEKEVESKEEREKLEKKRK

SEQ ID NO: 2461525 - protein, 11 aa, Entamoeba dispar
SLNKSYYNGGS

SEQ ID NO: 2461526 - protein, 11 aa, Entamoeba dispar
SLNNPSFCQQN

SEQ ID NO: 2461527 - protein, 8 aa, Entamoeba dispar
SLNPSELA

SEQ ID NO: 2461528 - protein, 9 aa, Entamoeba dispar
SLNPTNETS

SEQ ID NO: 2461529 - protein, 17 aa, Entamoeba dispar
SLNQEEITQINEDPEEY

SEQ ID NO: 2461530 - protein, 11 aa, Entamoeba dispar
SLNQEIKNKTL

SEQ ID NO: 2461531 - protein, 8 aa, Entamoeba dispar
SLNQGYAA

SEQ ID NO: 2461532 - protein, 11 aa, Entamoeba dispar
SLNQNCSDKPI

SEQ ID NO: 2461533 - protein, 20 aa, Entamoeba dispar
SLNQPITQRNTNQPINIPSS

SEQ ID NO: 2461534 - protein, 7 aa, Entamoeba dispar
SLNQTKR

SEQ ID NO: 2461535 - protein, 4 aa, Entamoeba dispar
SLNS

SEQ ID NO: 2461536 - protein, 12 aa, Entamoeba dispar
SLNSDQCKQYRS

SEQ ID NO: 2461537 - protein, 17 aa, Entamoeba dispar
SLNSENNDMTSKIPQLR

SEQ ID NO: 2461538 - protein, 10 aa, Entamoeba dispar
SLNSETKDAV

SEQ ID NO: 2461539 - protein, 12 aa, Entamoeba dispar
SLNSETKEGVGY

SEQ ID NO: 2461540 - protein, 5 aa, Entamoeba dispar
SLNSG

SEQ ID NO: 2461541 - protein, 6 aa, Entamoeba dispar
SLNSTS

SEQ ID NO: 2461542 - protein, 33 aa, Entamoeba dispar
SLNTQRDADKKAADEEKKKKEEQRRAERKARLL

SEQ ID NO: 2461543 - protein, 16 aa, Entamoeba dispar
SLNTTAEQQNNENVNN

SEQ ID NO: 2461544 - protein, 8 aa, Entamoeba dispar
SLPDEDLT

SEQ ID NO: 2461545 - protein, 7 aa, Entamoeba dispar
SLPDTNK

SEQ ID NO: 2461546 - protein, 4 aa, Entamoeba dispar
SLPE

SEQ ID NO: 2461547 - protein, 7 aa, Entamoeba dispar
SLPEETK

SEQ ID NO: 2461548 - protein, 7 aa, Entamoeba dispar
SLPEQTT

SEQ ID NO: 2461549 - protein, 4 aa, Entamoeba dispar
SLPF

SEQ ID NO: 2461550 - protein, 12 aa, Entamoeba dispar
SLPFTNSATQLC

SEQ ID NO: 2461551 - protein, 6 aa, Entamoeba dispar
SLPGSS

SEQ ID NO: 2461552 - protein, 6 aa, Entamoeba dispar
SLPKDY

SEQ ID NO: 2461553 - protein, 5 aa, Entamoeba dispar
SLPKE

SEQ ID NO: 2461554 - protein, 6 aa, Entamoeba dispar
SLPKET

SEQ ID NO: 2461555 - protein, 9 aa, Entamoeba dispar
SLPKKEYPK

SEQ ID NO: 2461556 - protein, 7 aa, Entamoeba dispar
SLPKKLP

SEQ ID NO: 2461557 - protein, 7 aa, Entamoeba dispar
SLPKKNY

SEQ ID NO: 2461558 - protein, 7 aa, Entamoeba dispar
SLPKKSY

SEQ ID NO: 2461559 - protein, 9 aa, Entamoeba dispar
SLPKNNGSV

SEQ ID NO: 2461560 - protein, 6 aa, Entamoeba dispar
SLPKTA

SEQ ID NO: 2461561 - protein, 15 aa, Entamoeba dispar
SLPNDLTESHPEMKA

SEQ ID NO: 2461562 - protein, 6 aa, Entamoeba dispar
SLPNEM

SEQ ID NO: 2461563 - protein, 11 aa, Entamoeba dispar
SLPNGNSNETF

SEQ ID NO: 2461564 - protein, 9 aa, Entamoeba dispar
SLPNNSLTL

SEQ ID NO: 2461565 - protein, 5 aa, Entamoeba dispar
SLPPI

SEQ ID NO: 2461566 - protein, 8 aa, Entamoeba dispar
SLPPPLKR

SEQ ID NO: 2461567 - protein, 9 aa, Entamoeba dispar
SLPPQKPKR

SEQ ID NO: 2461568 - protein, 26 aa, Entamoeba dispar
SLPPSTNGETEKKEIKKSEEDSQREI

SEQ ID NO: 2461569 - protein, 5 aa, Entamoeba dispar
SLPQF

SEQ ID NO: 2461570 - protein, 8 aa, Entamoeba dispar
SLPQNEDF

SEQ ID NO: 2461571 - protein, 20 aa, Entamoeba dispar
SLPQPYQSSLSIPSQNTLSS

SEQ ID NO: 2461572 - protein, 9 aa, Entamoeba dispar
SLPQTLQPQ

SEQ ID NO: 2461573 - protein, 17 aa, Entamoeba dispar
SLPRSGSLSPKPGSRKI

SEQ ID NO: 2461574 - protein, 25 aa, Entamoeba dispar
SLPSAKVKHSQHKKPNEQKSQPQNI

SEQ ID NO: 2461575 - protein, 18 aa, Entamoeba dispar
SLPSEPIKTSLKKSQDVI

SEQ ID NO: 2461576 - protein, 9 aa, Entamoeba dispar
SLPSEVNVE

SEQ ID NO: 2461577 - protein, 6 aa, Entamoeba dispar
SLPSGR

SEQ ID NO: 2461578 - protein, 9 aa, Entamoeba dispar
SLPSPQSVK

SEQ ID NO: 2461579 - protein, 6 aa, Entamoeba dispar
SLPSPT

SEQ ID NO: 2461580 - protein, 6 aa, Entamoeba dispar
SLPSST

SEQ ID NO: 2461581 - protein, 9 aa, Entamoeba dispar
SLPSTIEQR

SEQ ID NO: 2461582 - protein, 10 aa, Entamoeba dispar
SLPSTIRHRS

SEQ ID NO: 2461583 - protein, 5 aa, Entamoeba dispar
SLPSY

SEQ ID NO: 2461584 - protein, 12 aa, Entamoeba dispar
SLPTNTDMEAGE

SEQ ID NO: 2461585 - protein, 42 aa, Entamoeba dispar
SLPTSNEESTVKVESHEESTEVSSEESSVKKRTPVGARGIPG

SEQ ID NO: 2461586 - protein, 20 aa, Entamoeba dispar
SLPTTKKNEPFKLKLQHFIH

SEQ ID NO: 2461587 - protein, 6 aa, Entamoeba dispar
SLQGDE

SEQ ID NO: 2461588 - protein, 4 aa, Entamoeba dispar
SLQK

SEQ ID NO: 2461589 - protein, 7 aa, Entamoeba dispar
SLQKGAE

SEQ ID NO: 2461590 - protein, 4 aa, Entamoeba dispar
SLQL

SEQ ID NO: 2461591 - protein, 13 aa, Entamoeba dispar
SLQNEREDQSTVK

SEQ ID NO: 2461592 - protein, 8 aa, Entamoeba dispar
SLQNHPRS

SEQ ID NO: 2461593 - protein, 11 aa, Entamoeba dispar
SLQPEVKNQTI

SEQ ID NO: 2461594 - protein, 5 aa, Entamoeba dispar
SLQPS

SEQ ID NO: 2461595 - protein, 11 aa, Entamoeba dispar
SLQQKPTITPS

SEQ ID NO: 2461596 - protein, 4 aa, Entamoeba dispar
SLQR

SEQ ID NO: 2461597 - protein, 8 aa, Entamoeba dispar
SLQRDKTN

SEQ ID NO: 2461598 - protein, 15 aa, Entamoeba dispar
SLQRDNEEESNSENE

SEQ ID NO: 2461599 - protein, 29 aa, Entamoeba dispar
SLQREKDRNIKNKSELHEETSDEYQQING

SEQ ID NO: 2461600 - protein, 5 aa, Entamoeba dispar
SLQRR

SEQ ID NO: 2461601 - protein, 15 aa, Entamoeba dispar
SLQSKDQVEIPVPQT

SEQ ID NO: 2461602 - protein, 7 aa, Entamoeba dispar
SLQSPFG

SEQ ID NO: 2461603 - protein, 23 aa, Entamoeba dispar
SLQSTSYESRMDEQIQTNERLSK

SEQ ID NO: 2461604 - protein, 8 aa, Entamoeba dispar
SLQSTVDA

SEQ ID NO: 2461605 - protein, 9 aa, Entamoeba dispar
SLQTKNPGK

SEQ ID NO: 2461606 - protein, 14 aa, Entamoeba dispar
SLQTQKGTKDYPEQ

SEQ ID NO: 2461607 - protein, 26 aa, Entamoeba dispar
SLRENTKDQQPSSTISKKVVPSISIQ

SEQ ID NO: 2461608 - protein, 6 aa, Entamoeba dispar
SLRETS

SEQ ID NO: 2461609 - protein, 9 aa, Entamoeba dispar
SLRGPSSLI

SEQ ID NO: 2461610 - protein, 11 aa, Entamoeba dispar
SLRKERKEEYN

SEQ ID NO: 2461611 - protein, 7 aa, Entamoeba dispar
SLRSDGY

SEQ ID NO: 2461612 - protein, 5 aa, Entamoeba dispar
SLRSG

SEQ ID NO: 2461613 - protein, 9 aa, Entamoeba dispar
SLRTSEADA

SEQ ID NO: 2461614 - protein, 10 aa, Entamoeba dispar
SLRVGKKSKA

SEQ ID NO: 2461615 - protein, 6 aa, Entamoeba dispar
SLSDDT

SEQ ID NO: 2461616 - protein, 9 aa, Entamoeba dispar
SLSDELKKT

SEQ ID NO: 2461617 - protein, 9 aa, Entamoeba dispar
SLSDTTQIT

SEQ ID NO: 2461618 - protein, 5 aa, Entamoeba dispar
SLSEG

SEQ ID NO: 2461619 - protein, 5 aa, Entamoeba dispar
SLSEI

SEQ ID NO: 2461620 - protein, 6 aa, Entamoeba dispar
SLSEME

SEQ ID NO: 2461621 - protein, 6 aa, Entamoeba dispar
SLSETV

SEQ ID NO: 2461622 - protein, 15 aa, Entamoeba dispar
SLSGEELPKVVKKLR

SEQ ID NO: 2461623 - protein, 6 aa, Entamoeba dispar
SLSGEI

SEQ ID NO: 2461624 - protein, 10 aa, Entamoeba dispar
SLSGGRSCQN

SEQ ID NO: 2461625 - protein, 6 aa, Entamoeba dispar
SLSGQA

SEQ ID NO: 2461626 - protein, 5 aa, Entamoeba dispar
SLSHD

SEQ ID NO: 2461627 - protein, 8 aa, Entamoeba dispar
SLSKEQRK

SEQ ID NO: 2461628 - protein, 19 aa, Entamoeba dispar
SLSKQTPSNINQPKFSSVE

SEQ ID NO: 2461629 - protein, 16 aa, Entamoeba dispar
SLSNSPFENRIQTDPQ

SEQ ID NO: 2461630 - protein, 13 aa, Entamoeba dispar
SLSPDMFDTSILN

SEQ ID NO: 2461631 - protein, 7 aa, Entamoeba dispar
SLSPEIT

SEQ ID NO: 2461632 - protein, 7 aa, Entamoeba dispar
SLSPGSF

SEQ ID NO: 2461633 - protein, 16 aa, Entamoeba dispar
SLSPISSSSNNNNNQT

SEQ ID NO: 2461634 - protein, 7 aa, Entamoeba dispar
SLSPKDL

SEQ ID NO: 2461635 - protein, 7 aa, Entamoeba dispar
SLSPQQI

SEQ ID NO: 2461636 - protein, 24 aa, Entamoeba dispar
SLSPRLDPSHNSHTPRMKKERSWR

SEQ ID NO: 2461637 - protein, 19 aa, Entamoeba dispar
SLSPTSGSPFSRSPRGSRI

SEQ ID NO: 2461638 - protein, 16 aa, Entamoeba dispar
SLSPYNPSVNNTPVQS

SEQ ID NO: 2461639 - protein, 4 aa, Entamoeba dispar
SLSQ

SEQ ID NO: 2461640 - protein, 6 aa, Entamoeba dispar
SLSQKT

SEQ ID NO: 2461641 - protein, 5 aa, Entamoeba dispar
SLSQL

SEQ ID NO: 2461642 - protein, 4 aa, Entamoeba dispar
SLSS

SEQ ID NO: 2461643 - protein, 5 aa, Entamoeba dispar
SLSSE

SEQ ID NO: 2461644 - protein, 9 aa, Entamoeba dispar
SLSSNSSYT

SEQ ID NO: 2461645 - protein, 8 aa, Entamoeba dispar
SLSSSLNK

SEQ ID NO: 2461646 - protein, 7 aa, Entamoeba dispar
SLSSSNL

SEQ ID NO: 2461647 - protein, 11 aa, Entamoeba dispar
SLSTDKDKLKE

SEQ ID NO: 2461648 - protein, 38 aa, Entamoeba dispar
SLSTDNDSKILSKNNTHSGIKRSVPEGVKPKPSKKYIV

SEQ ID NO: 2461649 - protein, 5 aa, Entamoeba dispar
SLSTP

SEQ ID NO: 2461650 - protein, 7 aa, Entamoeba dispar
SLSTPLK

SEQ ID NO: 2461651 - protein, 40 aa, Entamoeba dispar
SLSTRDSQNTHYQNQNHNSHIQPSITQTQTKPQQENSASI

SEQ ID NO: 2461652 - protein, 13 aa, Entamoeba dispar
SLSTSKSPKINNY

SEQ ID NO: 2461653 - protein, 23 aa, Entamoeba dispar
SLSTTNGPTNGNSMRQTQQMNQS

SEQ ID NO: 2461654 - protein, 5 aa, Entamoeba dispar
SLTAT

SEQ ID NO: 2461655 - protein, 5 aa, Entamoeba dispar
SLTDG

SEQ ID NO: 2461656 - protein, 9 aa, Entamoeba dispar
SLTDQAQTI

SEQ ID NO: 2461657 - protein, 22 aa, Entamoeba dispar
SLTDSGNNIEITGQTKESPELT

SEQ ID NO: 2461658 - protein, 4 aa, Entamoeba dispar
SLTE

SEQ ID NO: 2461659 - protein, 5 aa, Entamoeba dispar
SLTGQ

SEQ ID NO: 2461660 - protein, 5 aa, Entamoeba dispar
SLTGR

SEQ ID NO: 2461661 - protein, 12 aa, Entamoeba dispar
SLTKQQSSSDFI

SEQ ID NO: 2461662 - protein, 4 aa, Entamoeba dispar
SLTN

SEQ ID NO: 2461663 - protein, 6 aa, Entamoeba dispar
SLTNER

SEQ ID NO: 2461664 - protein, 12 aa, Entamoeba dispar
SLTNNRKLTFKP

SEQ ID NO: 2461665 - protein, 7 aa, Entamoeba dispar
SLTPPKG

SEQ ID NO: 2461666 - protein, 8 aa, Entamoeba dispar
SLTPTSSD

SEQ ID NO: 2461667 - protein, 5 aa, Entamoeba dispar
SLTQK

SEQ ID NO: 2461668 - protein, 18 aa, Entamoeba dispar
SLTQQPITTHEKTIETNP

SEQ ID NO: 2461669 - protein, 5 aa, Entamoeba dispar
SLTSI

SEQ ID NO: 2461670 - protein, 13 aa, Entamoeba dispar
SLTSITIPSSTRE

SEQ ID NO: 2461671 - protein, 7 aa, Entamoeba dispar
SLTSSKQ

SEQ ID NO: 2461672 - protein, 21 aa, Entamoeba dispar
SLTTEGKEEEEEDSNDNFPNT

SEQ ID NO: 2461673 - protein, 5 aa, Entamoeba dispar
SLTTF

SEQ ID NO: 2461674 - protein, 12 aa, Entamoeba dispar
SLTTGPRVEEAM

SEQ ID NO: 2461675 - protein, 6 aa, Entamoeba dispar
SLTTPK

SEQ ID NO: 2461676 - protein, 19 aa, Entamoeba dispar
SLTTQEKHDDAPKKKRKRK

SEQ ID NO: 2461677 - protein, 8 aa, Entamoeba dispar
SLTTTNDK

SEQ ID NO: 2461678 - protein, 52 aa, Entamoeba dispar
SLVPDNKKPVTKTEKEEKKKDKKVSKKEDEKKVSEKSTPKKDENKPKKPKNA

SEQ ID NO: 2461679 - protein, 12 aa, Entamoeba dispar
SLVPNLGENVTD

SEQ ID NO: 2461680 - protein, 63 aa, Entamoeba dispar
SLYEDDKKPRFNKHSNHSSSTKKFEKKSEKKFNKKENKFSNKQTRKGDKISKKMIKENKKVRK

SEQ ID NO: 2461681 - protein, 4 aa, Entamoeba dispar
SLYG

SEQ ID NO: 2461682 - protein, 10 aa, Entamoeba dispar
SLYKPQPTSL

SEQ ID NO: 2461683 - protein, 6 aa, Entamoeba dispar
SLYSSP

SEQ ID NO: 2461684 - protein, 6 aa, Entamoeba dispar
SMADDV

SEQ ID NO: 2461685 - protein, 8 aa, Entamoeba dispar
SMAEEEKE

SEQ ID NO: 2461686 - protein, 8 aa, Entamoeba dispar
SMAPIRGE

SEQ ID NO: 2461687 - protein, 8 aa, Entamoeba dispar
SMARRTKK

SEQ ID NO: 2461688 - protein, 5 aa, Entamoeba dispar
SMDEG

SEQ ID NO: 2461689 - protein, 40 aa, Entamoeba dispar
SMDNENNEEYQEKRDIKESQNNSTIEQSTPFNNKSESYQI

SEQ ID NO: 2461690 - protein, 5 aa, Entamoeba dispar
SMDPS

SEQ ID NO: 2461691 - protein, 14 aa, Entamoeba dispar
SMDSEKKPKKAETD

SEQ ID NO: 2461692 - protein, 6 aa, Entamoeba dispar
SMEARS

SEQ ID NO: 2461693 - protein, 4 aa, Entamoeba dispar
SMED

SEQ ID NO: 2461694 - protein, 9 aa, Entamoeba dispar
SMEDKSKYI

SEQ ID NO: 2461695 - protein, 8 aa, Entamoeba dispar
SMEDQSPL

SEQ ID NO: 2461696 - protein, 6 aa, Entamoeba dispar
SMEGYY

SEQ ID NO: 2461697 - protein, 11 aa, Entamoeba dispar
SMEKRLPPSTF

SEQ ID NO: 2461698 - protein, 13 aa, Entamoeba dispar
SMGKMSASNPNSA

SEQ ID NO: 2461699 - protein, 18 aa, Entamoeba dispar
SMGKSEYGSLDITPRGEY

SEQ ID NO: 2461700 - protein, 9 aa, Entamoeba dispar
SMINKKDGL

SEQ ID NO: 2461701 - protein, 7 aa, Entamoeba dispar
SMKKSNQ

SEQ ID NO: 2461702 - protein, 5 aa, Entamoeba dispar
SMKKT

SEQ ID NO: 2461703 - protein, 5 aa, Entamoeba dispar
SMKTN

SEQ ID NO: 2461704 - protein, 21 aa, Entamoeba dispar
SMLKPVKKSDIEKKPKKPDVK

SEQ ID NO: 2461705 - protein, 4 aa, Entamoeba dispar
SMNA

SEQ ID NO: 2461706 - protein, 8 aa, Entamoeba dispar
SMNEGVTP

SEQ ID NO: 2461707 - protein, 10 aa, Entamoeba dispar
SMNKQTTPQL

SEQ ID NO: 2461708 - protein, 7 aa, Entamoeba dispar
SMNPKRS

SEQ ID NO: 2461709 - protein, 6 aa, Entamoeba dispar
SMNSGD

SEQ ID NO: 2461710 - protein, 10 aa, Entamoeba dispar
SMPKTTPRNR

SEQ ID NO: 2461711 - protein, 21 aa, Entamoeba dispar
SMPNLPTTFSKTTRSSMPPQM

SEQ ID NO: 2461712 - protein, 12 aa, Entamoeba dispar
SMQKNYTKKTTP

SEQ ID NO: 2461713 - protein, 4 aa, Entamoeba dispar
SMQQ

SEQ ID NO: 2461714 - protein, 9 aa, Entamoeba dispar
SMRGGDENA

SEQ ID NO: 2461715 - protein, 14 aa, Entamoeba dispar
SMRKENKNIPENAS

SEQ ID NO: 2461716 - protein, 7 aa, Entamoeba dispar
SMRPNND

SEQ ID NO: 2461717 - protein, 23 aa, Entamoeba dispar
SMSKQNKSESFTYQNEVTKKCEG

SEQ ID NO: 2461718 - protein, 47 aa, Entamoeba dispar
SMSNPYGIDNPYATVTTPTEPSPYSGDPTNNTKNYSQSYSSTNQVDS

SEQ ID NO: 2461719 - protein, 17 aa, Entamoeba dispar
SMSPKGTPRQPTNITVM

SEQ ID NO: 2461720 - protein, 13 aa, Entamoeba dispar
SMSRDQMGEKYDG

SEQ ID NO: 2461721 - protein, 16 aa, Entamoeba dispar
SMSTSTTNLRDNSSEI

SEQ ID NO: 2461722 - protein, 4 aa, Entamoeba dispar
SMTE

SEQ ID NO: 2461723 - protein, 15 aa, Entamoeba dispar
SMTNQMQRQAEEVTH

SEQ ID NO: 2461724 - protein, 11 aa, Entamoeba dispar
SMTPHQKTKKV

SEQ ID NO: 2461725 - protein, 5 aa, Entamoeba dispar
SMTPR

SEQ ID NO: 2461726 - protein, 7 aa, Entamoeba dispar
SMTSEEL

SEQ ID NO: 2461727 - protein, 11 aa, Entamoeba dispar
SMTSKKSVEEK

SEQ ID NO: 2461728 - protein, 16 aa, Entamoeba dispar
SMTTNENWQLFDDLLN

SEQ ID NO: 2461729 - protein, 6 aa, Entamoeba dispar
SMYRNK

SEQ ID NO: 2461730 - protein, 7 aa, Entamoeba dispar
SMYSSDE

SEQ ID NO: 2461731 - protein, 5 aa, Entamoeba dispar
SNAAV

SEQ ID NO: 2461732 - protein, 4 aa, Entamoeba dispar
SNAE

SEQ ID NO: 2461733 - protein, 4 aa, Entamoeba dispar
SNAI

SEQ ID NO: 2461734 - protein, 10 aa, Entamoeba dispar
SNAKGTDLEK

SEQ ID NO: 2461735 - protein, 16 aa, Entamoeba dispar
SNANQESEKEKNTIIE

SEQ ID NO: 2461736 - protein, 16 aa, Entamoeba dispar
SNAPHKLESSQYNERV

SEQ ID NO: 2461737 - protein, 7 aa, Entamoeba dispar
SNAPLGP

SEQ ID NO: 2461738 - protein, 8 aa, Entamoeba dispar
SNAPSDQF

SEQ ID NO: 2461739 - protein, 6 aa, Entamoeba dispar
SNAQIQ

SEQ ID NO: 2461740 - protein, 4 aa, Entamoeba dispar
SNAT

SEQ ID NO: 2461741 - protein, 8 aa, Entamoeba dispar
SNATESDK

SEQ ID NO: 2461742 - protein, 12 aa, Entamoeba dispar
SNATTNSPIRRD

SEQ ID NO: 2461743 - protein, 13 aa, Entamoeba dispar
SNCDNTKKLHSIS

SEQ ID NO: 2461744 - protein, 12 aa, Entamoeba dispar
SNCHPESKTRNE

SEQ ID NO: 2461745 - protein, 10 aa, Entamoeba dispar
SNCNTHEHTP

SEQ ID NO: 2461746 - protein, 7 aa, Entamoeba dispar
SNDAPIL

SEQ ID NO: 2461747 - protein, 16 aa, Entamoeba dispar
SNDDNNDNNDDTNINE

SEQ ID NO: 2461748 - protein, 10 aa, Entamoeba dispar
SNDDSERLEE

SEQ ID NO: 2461749 - protein, 17 aa, Entamoeba dispar
SNDDSNNDDDTNSNEKI

SEQ ID NO: 2461750 - protein, 5 aa, Entamoeba dispar
SNDED

SEQ ID NO: 2461751 - protein, 7 aa, Entamoeba dispar
SNDEEQH

SEQ ID NO: 2461752 - protein, 13 aa, Entamoeba dispar
SNDEKNVKIRKEN

SEQ ID NO: 2461753 - protein, 10 aa, Entamoeba dispar
SNDERDKKAT

SEQ ID NO: 2461754 - protein, 9 aa, Entamoeba dispar
SNDERTTTR

SEQ ID NO: 2461755 - protein, 6 aa, Entamoeba dispar
SNDESK

SEQ ID NO: 2461756 - protein, 5 aa, Entamoeba dispar
SNDFI

SEQ ID NO: 2461757 - protein, 9 aa, Entamoeba dispar
SNDGEETSL

SEQ ID NO: 2461758 - protein, 5 aa, Entamoeba dispar
SNDGI

SEQ ID NO: 2461759 - protein, 8 aa, Entamoeba dispar
SNDGNEIP

SEQ ID NO: 2461760 - protein, 8 aa, Entamoeba dispar
SNDITKPL

SEQ ID NO: 2461761 - protein, 9 aa, Entamoeba dispar
SNDKNVIRK

SEQ ID NO: 2461762 - protein, 5 aa, Entamoeba dispar
SNDKT

SEQ ID NO: 2461763 - protein, 33 aa, Entamoeba dispar
SNDLNKRTEQGDHLDHEKQERTRQKQEEEQKRI

SEQ ID NO: 2461764 - protein, 7 aa, Entamoeba dispar
SNDLTDD

SEQ ID NO: 2461765 - protein, 5 aa, Entamoeba dispar
SNDND

SEQ ID NO: 2461766 - protein, 8 aa, Entamoeba dispar
SNDNDAMK

SEQ ID NO: 2461767 - protein, 7 aa, Entamoeba dispar
SNDNDSV

SEQ ID NO: 2461768 - protein, 9 aa, Entamoeba dispar
SNDNEHEKI

SEQ ID NO: 2461769 - protein, 7 aa, Entamoeba dispar
SNDNEIK

SEQ ID NO: 2461770 - protein, 6 aa, Entamoeba dispar
SNDNLQ

SEQ ID NO: 2461771 - protein, 42 aa, Entamoeba dispar
SNDNNSKEKEKENINNKENINFNDNNNNDKENDDEKKEEIKN

SEQ ID NO: 2461772 - protein, 7 aa, Entamoeba dispar
SNDNYEE

SEQ ID NO: 2461773 - protein, 7 aa, Entamoeba dispar
SNDPVPY

SEQ ID NO: 2461774 - protein, 6 aa, Entamoeba dispar
SNDQPF

SEQ ID NO: 2461775 - protein, 7 aa, Entamoeba dispar
SNDSQTL

SEQ ID NO: 2461776 - protein, 8 aa, Entamoeba dispar
SNDSSNYY

SEQ ID NO: 2461777 - protein, 5 aa, Entamoeba dispar
SNDTD

SEQ ID NO: 2461778 - protein, 5 aa, Entamoeba dispar
SNDTV

SEQ ID NO: 2461779 - protein, 7 aa, Entamoeba dispar
SNDVGSP

SEQ ID NO: 2461780 - protein, 7 aa, Entamoeba dispar
SNDWGNE

SEQ ID NO: 2461781 - protein, 15 aa, Entamoeba dispar
SNDYTKKNEYHLESE

SEQ ID NO: 2461782 - protein, 9 aa, Entamoeba dispar
SNEAKNSIH

SEQ ID NO: 2461783 - protein, 6 aa, Entamoeba dispar
SNEAPQ

SEQ ID NO: 2461784 - protein, 12 aa, Entamoeba dispar
SNECEKGKYEID

SEQ ID NO: 2461785 - protein, 4 aa, Entamoeba dispar
SNED

SEQ ID NO: 2461786 - protein, 5 aa, Entamoeba dispar
SNEDI

SEQ ID NO: 2461787 - protein, 8 aa, Entamoeba dispar
SNEDKEER

SEQ ID NO: 2461788 - protein, 5 aa, Entamoeba dispar
SNEDP

SEQ ID NO: 2461789 - protein, 8 aa, Entamoeba dispar
SNEECTSK

SEQ ID NO: 2461790 - protein, 10 aa, Entamoeba dispar
SNEEDNVRTI

SEQ ID NO: 2461791 - protein, 13 aa, Entamoeba dispar
SNEEEGLHSPNKK

SEQ ID NO: 2461792 - protein, 7 aa, Entamoeba dispar
SNEEEGV

SEQ ID NO: 2461793 - protein, 9 aa, Entamoeba dispar
SNEEEINTN

SEQ ID NO: 2461794 - protein, 24 aa, Entamoeba dispar
SNEEEPKAESNLTITKEEPEQDNG

SEQ ID NO: 2461795 - protein, 13 aa, Entamoeba dispar
SNEEEPKTDDEKI

SEQ ID NO: 2461796 - protein, 7 aa, Entamoeba dispar
SNEEEPL

SEQ ID NO: 2461797 - protein, 8 aa, Entamoeba dispar
SNEEGYKQ

SEQ ID NO: 2461798 - protein, 5 aa, Entamoeba dispar
SNEEI

SEQ ID NO: 2461799 - protein, 7 aa, Entamoeba dispar
SNEEIQR

SEQ ID NO: 2461800 - protein, 8 aa, Entamoeba dispar
SNEELKGE

SEQ ID NO: 2461801 - protein, 12 aa, Entamoeba dispar
SNEELKRKLKEK

SEQ ID NO: 2461802 - protein, 53 aa, Entamoeba dispar
SNEELSTSHSQSSPSIVPPIKTNPTHKSEPTSVQDSQADSLLSPSSKTQSSQT

SEQ ID NO: 2461803 - protein, 7 aa, Entamoeba dispar
SNEENEE

SEQ ID NO: 2461804 - protein, 8 aa, Entamoeba dispar
SNEENGID

SEQ ID NO: 2461805 - protein, 57 aa, Entamoeba dispar
SNEENINEEQEDEEDESEEDEEDDSDESDVVEEKKEKKPEVKEKKPIQSKEAYGFSD

SEQ ID NO: 2461806 - protein, 7 aa, Entamoeba dispar
SNEETVG

SEQ ID NO: 2461807 - protein, 6 aa, Entamoeba dispar
SNEEVT

SEQ ID NO: 2461808 - protein, 7 aa, Entamoeba dispar
SNEFEEI

SEQ ID NO: 2461809 - protein, 7 aa, Entamoeba dispar
SNEGNYP

SEQ ID NO: 2461810 - protein, 5 aa, Entamoeba dispar
SNEIN

SEQ ID NO: 2461811 - protein, 11 aa, Entamoeba dispar
SNEINEQSKVS

SEQ ID NO: 2461812 - protein, 18 aa, Entamoeba dispar
SNEIPDKEDKQQNEEGLN

SEQ ID NO: 2461813 - protein, 5 aa, Entamoeba dispar
SNEIR

SEQ ID NO: 2461814 - protein, 5 aa, Entamoeba dispar
SNEIS

SEQ ID NO: 2461815 - protein, 6 aa, Entamoeba dispar
SNEIVN

SEQ ID NO: 2461816 - protein, 11 aa, Entamoeba dispar
SNEKDHTYQMS

SEQ ID NO: 2461817 - protein, 7 aa, Entamoeba dispar
SNEKELS

SEQ ID NO: 2461818 - protein, 20 aa, Entamoeba dispar
SNEKNENKKVECVEEEKNNI

SEQ ID NO: 2461819 - protein, 5 aa, Entamoeba dispar
SNEKQ

SEQ ID NO: 2461820 - protein, 14 aa, Entamoeba dispar
SNEKTEVHKGSPLI

SEQ ID NO: 2461821 - protein, 4 aa, Entamoeba dispar
SNEL

SEQ ID NO: 2461822 - protein, 10 aa, Entamoeba dispar
SNELPSSQYY

SEQ ID NO: 2461823 - protein, 5 aa, Entamoeba dispar
SNENC

SEQ ID NO: 2461824 - protein, 5 aa, Entamoeba dispar
SNEND

SEQ ID NO: 2461825 - protein, 6 aa, Entamoeba dispar
SNENKL

SEQ ID NO: 2461826 - protein, 7 aa, Entamoeba dispar
SNENLEL

SEQ ID NO: 2461827 - protein, 70 aa, Entamoeba dispar
SNENNKPKVEKKTTTEMKQADNKPKDQKVDTKTTNNNKPAEGTHVPKPKGDAPVIEDRPNGKKEVVSGDK

SEQ ID NO: 2461828 - protein, 13 aa, Entamoeba dispar
SNENYTNINNKRN

SEQ ID NO: 2461829 - protein, 21 aa, Entamoeba dispar
SNENYTNINNKRNEYGDKYDN

SEQ ID NO: 2461830 - protein, 5 aa, Entamoeba dispar
SNEPE

SEQ ID NO: 2461831 - protein, 10 aa, Entamoeba dispar
SNEPENFSPI

SEQ ID NO: 2461832 - protein, 7 aa, Entamoeba dispar
SNEQVAE

SEQ ID NO: 2461833 - protein, 7 aa, Entamoeba dispar
SNEQYSI

SEQ ID NO: 2461834 - protein, 5 aa, Entamoeba dispar
SNERK

SEQ ID NO: 2461835 - protein, 17 aa, Entamoeba dispar
SNERLQSKKRKKRLEDG

SEQ ID NO: 2461836 - protein, 15 aa, Entamoeba dispar
SNERRYNDHYPNNPP

SEQ ID NO: 2461837 - protein, 4 aa, Entamoeba dispar
SNES

SEQ ID NO: 2461838 - protein, 6 aa, Entamoeba dispar
SNESLE

SEQ ID NO: 2461839 - protein, 7 aa, Entamoeba dispar
SNESLGS

SEQ ID NO: 2461840 - protein, 6 aa, Entamoeba dispar
SNESLQ

SEQ ID NO: 2461841 - protein, 4 aa, Entamoeba dispar
SNET

SEQ ID NO: 2461842 - protein, 5 aa, Entamoeba dispar
SNETE

SEQ ID NO: 2461843 - protein, 10 aa, Entamoeba dispar
SNETKIDDKE

SEQ ID NO: 2461844 - protein, 5 aa, Entamoeba dispar
SNETL

SEQ ID NO: 2461845 - protein, 6 aa, Entamoeba dispar
SNETMT

SEQ ID NO: 2461846 - protein, 7 aa, Entamoeba dispar
SNETNNT

SEQ ID NO: 2461847 - protein, 10 aa, Entamoeba dispar
SNETQPHKSD

SEQ ID NO: 2461848 - protein, 17 aa, Entamoeba dispar
SNEVGKKIEEVTEKDLG

SEQ ID NO: 2461849 - protein, 14 aa, Entamoeba dispar
SNEVNKKEFNDGTT

SEQ ID NO: 2461850 - protein, 17 aa, Entamoeba dispar
SNEVPKENNIKNNDKVQ

SEQ ID NO: 2461851 - protein, 7 aa, Entamoeba dispar
SNEVTCS

SEQ ID NO: 2461852 - protein, 6 aa, Entamoeba dispar
SNEYPN

SEQ ID NO: 2461853 - protein, 7 aa, Entamoeba dispar
SNEYRDS

SEQ ID NO: 2461854 - protein, 4 aa, Entamoeba dispar
SNFD

SEQ ID NO: 2461855 - protein, 11 aa, Entamoeba dispar
SNFKGNSKQRN

SEQ ID NO: 2461856 - protein, 5 aa, Entamoeba dispar
SNFKS

SEQ ID NO: 2461857 - protein, 28 aa, Entamoeba dispar
SNGDINTQPVYTPNDQSMINESNQRINE

SEQ ID NO: 2461858 - protein, 8 aa, Entamoeba dispar
SNGDYQYD

SEQ ID NO: 2461859 - protein, 10 aa, Entamoeba dispar
SNGEIENSDG

SEQ ID NO: 2461860 - protein, 15 aa, Entamoeba dispar
SNGEIESSTIRGGLK

SEQ ID NO: 2461861 - protein, 8 aa, Entamoeba dispar
SNGENVDS

SEQ ID NO: 2461862 - protein, 6 aa, Entamoeba dispar
SNGEQV

SEQ ID NO: 2461863 - protein, 5 aa, Entamoeba dispar
SNGFE

SEQ ID NO: 2461864 - protein, 12 aa, Entamoeba dispar
SNGFQMKNEGEV

SEQ ID NO: 2461865 - protein, 13 aa, Entamoeba dispar
SNGGNQNLGGNDF

SEQ ID NO: 2461866 - protein, 19 aa, Entamoeba dispar
SNGIPEKTARRRYDTNKIT

SEQ ID NO: 2461867 - protein, 8 aa, Entamoeba dispar
SNGISNDH

SEQ ID NO: 2461868 - protein, 15 aa, Entamoeba dispar
SNGISSKTASRRWEN

SEQ ID NO: 2461869 - protein, 11 aa, Entamoeba dispar
SNGKESTGIPI

SEQ ID NO: 2461870 - protein, 6 aa, Entamoeba dispar
SNGKKR

SEQ ID NO: 2461871 - protein, 9 aa, Entamoeba dispar
SNGKTYTAK

SEQ ID NO: 2461872 - protein, 5 aa, Entamoeba dispar
SNGKW

SEQ ID NO: 2461873 - protein, 4 aa, Entamoeba dispar
SNGL

SEQ ID NO: 2461874 - protein, 12 aa, Entamoeba dispar
SNGLYSSRRSYK

SEQ ID NO: 2461875 - protein, 4 aa, Entamoeba dispar
SNGN

SEQ ID NO: 2461876 - protein, 6 aa, Entamoeba dispar
SNGNID

SEQ ID NO: 2461877 - protein, 8 aa, Entamoeba dispar
SNGNQKIY

SEQ ID NO: 2461878 - protein, 5 aa, Entamoeba dispar
SNGNY

SEQ ID NO: 2461879 - protein, 7 aa, Entamoeba dispar
SNGNYNK

SEQ ID NO: 2461880 - protein, 5 aa, Entamoeba dispar
SNGRI

SEQ ID NO: 2461881 - protein, 6 aa, Entamoeba dispar
SNGRID

SEQ ID NO: 2461882 - protein, 5 aa, Entamoeba dispar
SNGTF

SEQ ID NO: 2461883 - protein, 14 aa, Entamoeba dispar
SNGTINKDIETGAK

SEQ ID NO: 2461884 - protein, 8 aa, Entamoeba dispar
SNGTKSGL

SEQ ID NO: 2461885 - protein, 8 aa, Entamoeba dispar
SNGTLHDE

SEQ ID NO: 2461886 - protein, 15 aa, Entamoeba dispar
SNGTVLASASADKTV

SEQ ID NO: 2461887 - protein, 6 aa, Entamoeba dispar
SNGVGE

SEQ ID NO: 2461888 - protein, 19 aa, Entamoeba dispar
SNGVSSKTAIRRGQNNRKI

SEQ ID NO: 2461889 - protein, 8 aa, Entamoeba dispar
SNGYEEEE

SEQ ID NO: 2461890 - protein, 8 aa, Entamoeba dispar
SNGYHSGM

SEQ ID NO: 2461891 - protein, 20 aa, Entamoeba dispar
SNGYQAKESTGYISTTSEYH

SEQ ID NO: 2461892 - protein, 7 aa, Entamoeba dispar
SNHKAQL

SEQ ID NO: 2461893 - protein, 7 aa, Entamoeba dispar
SNHKGSL

SEQ ID NO: 2461894 - protein, 5 aa, Entamoeba dispar
SNHPN

SEQ ID NO: 2461895 - protein, 10 aa, Entamoeba dispar
SNHPRRTNQT

SEQ ID NO: 2461896 - protein, 8 aa, Entamoeba dispar
SNHQYPDD

SEQ ID NO: 2461897 - protein, 16 aa, Entamoeba dispar
SNHTDTQFPLNSQNTT

SEQ ID NO: 2461898 - protein, 8 aa, Entamoeba dispar
SNHTTEDI

SEQ ID NO: 2461899 - protein, 4 aa, Entamoeba dispar
SNHV

SEQ ID NO: 2461900 - protein, 5 aa, Entamoeba dispar
SNIAN

SEQ ID NO: 2461901 - protein, 10 aa, Entamoeba dispar
SNIDTGEAIN

SEQ ID NO: 2461902 - protein, 18 aa, Entamoeba dispar
SNIENELKKKQEEGKEYI

SEQ ID NO: 2461903 - protein, 4 aa, Entamoeba dispar
SNIG

SEQ ID NO: 2461904 - protein, 15 aa, Entamoeba dispar
SNIGSEGIAQDVASE

SEQ ID NO: 2461905 - protein, 6 aa, Entamoeba dispar
SNIKEN

SEQ ID NO: 2461906 - protein, 7 aa, Entamoeba dispar
SNINDPD

SEQ ID NO: 2461907 - protein, 13 aa, Entamoeba dispar
SNINETKIQSSKD

SEQ ID NO: 2461908 - protein, 7 aa, Entamoeba dispar
SNINSDV

SEQ ID NO: 2461909 - protein, 14 aa, Entamoeba dispar
SNIPDIAKKTQPLI

SEQ ID NO: 2461910 - protein, 9 aa, Entamoeba dispar
SNIPSNIPR

SEQ ID NO: 2461911 - protein, 7 aa, Entamoeba dispar
SNIQQTQ

SEQ ID NO: 2461912 - protein, 8 aa, Entamoeba dispar
SNIQTEYD

SEQ ID NO: 2461913 - protein, 5 aa, Entamoeba dispar
SNIQY

SEQ ID NO: 2461914 - protein, 14 aa, Entamoeba dispar
SNIRKVEQEDGGSL

SEQ ID NO: 2461915 - protein, 9 aa, Entamoeba dispar
SNISDVPES

SEQ ID NO: 2461916 - protein, 22 aa, Entamoeba dispar
SNISEQSATVSSRQSLSYDDEI

SEQ ID NO: 2461917 - protein, 10 aa, Entamoeba dispar
SNISQELKDE

SEQ ID NO: 2461918 - protein, 10 aa, Entamoeba dispar
SNISRSGSLN

SEQ ID NO: 2461919 - protein, 27 aa, Entamoeba dispar
SNISSGSTDSSIGPATPSEQTSKKKGR

SEQ ID NO: 2461920 - protein, 9 aa, Entamoeba dispar
SNISSRYSG

SEQ ID NO: 2461921 - protein, 8 aa, Entamoeba dispar
SNISSSLN

SEQ ID NO: 2461922 - protein, 4 aa, Entamoeba dispar
SNIT

SEQ ID NO: 2461923 - protein, 10 aa, Entamoeba dispar
SNITKSENDS

SEQ ID NO: 2461924 - protein, 8 aa, Entamoeba dispar
SNKAKYKC

SEQ ID NO: 2461925 - protein, 10 aa, Entamoeba dispar
SNKANIINST

SEQ ID NO: 2461926 - protein, 6 aa, Entamoeba dispar
SNKAPL

SEQ ID NO: 2461927 - protein, 7 aa, Entamoeba dispar
SNKDESI

SEQ ID NO: 2461928 - protein, 5 aa, Entamoeba dispar
SNKDP

SEQ ID NO: 2461929 - protein, 7 aa, Entamoeba dispar
SNKDSVI

SEQ ID NO: 2461930 - protein, 5 aa, Entamoeba dispar
SNKEF

SEQ ID NO: 2461931 - protein, 7 aa, Entamoeba dispar
SNKEHEQ

SEQ ID NO: 2461932 - protein, 5 aa, Entamoeba dispar
SNKEQ

SEQ ID NO: 2461933 - protein, 8 aa, Entamoeba dispar
SNKEQQNA

SEQ ID NO: 2461934 - protein, 13 aa, Entamoeba dispar
SNKESYNDMKPPI

SEQ ID NO: 2461935 - protein, 8 aa, Entamoeba dispar
SNKETAKA

SEQ ID NO: 2461936 - protein, 18 aa, Entamoeba dispar
SNKETGFNNQDNRSTIGY

SEQ ID NO: 2461937 - protein, 6 aa, Entamoeba dispar
SNKETK

SEQ ID NO: 2461938 - protein, 16 aa, Entamoeba dispar
SNKETLFNNQDNRSKI

SEQ ID NO: 2461939 - protein, 17 aa, Entamoeba dispar
SNKETRFNNQDNRSTIG

SEQ ID NO: 2461940 - protein, 5 aa, Entamoeba dispar
SNKEV

SEQ ID NO: 2461941 - protein, 7 aa, Entamoeba dispar
SNKGFTG

SEQ ID NO: 2461942 - protein, 13 aa, Entamoeba dispar
SNKGMETLSPRTE

SEQ ID NO: 2461943 - protein, 5 aa, Entamoeba dispar
SNKGS

SEQ ID NO: 2461944 - protein, 5 aa, Entamoeba dispar
SNKGW

SEQ ID NO: 2461945 - protein, 8 aa, Entamoeba dispar
SNKHSIQS

SEQ ID NO: 2461946 - protein, 5 aa, Entamoeba dispar
SNKIG

SEQ ID NO: 2461947 - protein, 16 aa, Entamoeba dispar
SNKIKREKKKQEVATP

SEQ ID NO: 2461948 - protein, 5 aa, Entamoeba dispar
SNKIL

SEQ ID NO: 2461949 - protein, 6 aa, Entamoeba dispar
SNKINS

SEQ ID NO: 2461950 - protein, 5 aa, Entamoeba dispar
SNKIP

SEQ ID NO: 2461951 - protein, 9 aa, Entamoeba dispar
SNKKEEDTI

SEQ ID NO: 2461952 - protein, 8 aa, Entamoeba dispar
SNKKPTNI

SEQ ID NO: 2461953 - protein, 11 aa, Entamoeba dispar
SNKKPTTENVE

SEQ ID NO: 2461954 - protein, 16 aa, Entamoeba dispar
SNKKTTKRIEEENDIP

SEQ ID NO: 2461955 - protein, 7 aa, Entamoeba dispar
SNKNKGS

SEQ ID NO: 2461956 - protein, 11 aa, Entamoeba dispar
SNKNKRDQTKE

SEQ ID NO: 2461957 - protein, 8 aa, Entamoeba dispar
SNKNNGMG

SEQ ID NO: 2461958 - protein, 7 aa, Entamoeba dispar
SNKNQEL

SEQ ID NO: 2461959 - protein, 9 aa, Entamoeba dispar
SNKPAESQY

SEQ ID NO: 2461960 - protein, 7 aa, Entamoeba dispar
SNKPISK

SEQ ID NO: 2461961 - protein, 9 aa, Entamoeba dispar
SNKPMQENI

SEQ ID NO: 2461962 - protein, 8 aa, Entamoeba dispar
SNKPNIEN

SEQ ID NO: 2461963 - protein, 8 aa, Entamoeba dispar
SNKPTLTE

SEQ ID NO: 2461964 - protein, 7 aa, Entamoeba dispar
SNKQETL

SEQ ID NO: 2461965 - protein, 20 aa, Entamoeba dispar
SNKRPDVFEDETTELEEENV

SEQ ID NO: 2461966 - protein, 7 aa, Entamoeba dispar
SNKRPGL

SEQ ID NO: 2461967 - protein, 4 aa, Entamoeba dispar
SNKS

SEQ ID NO: 2461968 - protein, 9 aa, Entamoeba dispar
SNKSAKAVK

SEQ ID NO: 2461969 - protein, 8 aa, Entamoeba dispar
SNKSASAM

SEQ ID NO: 2461970 - protein, 11 aa, Entamoeba dispar
SNKSDAQLEQD

SEQ ID NO: 2461971 - protein, 6 aa, Entamoeba dispar
SNKSEM

SEQ ID NO: 2461972 - protein, 10 aa, Entamoeba dispar
SNKSIDSTKD

SEQ ID NO: 2461973 - protein, 7 aa, Entamoeba dispar
SNKSNGK

SEQ ID NO: 2461974 - protein, 6 aa, Entamoeba dispar
SNKSSC

SEQ ID NO: 2461975 - protein, 10 aa, Entamoeba dispar
SNKSTETYGS

SEQ ID NO: 2461976 - protein, 12 aa, Entamoeba dispar
SNKTETNNYFDN

SEQ ID NO: 2461977 - protein, 9 aa, Entamoeba dispar
SNKTGEGCT

SEQ ID NO: 2461978 - protein, 5 aa, Entamoeba dispar
SNKTM

SEQ ID NO: 2461979 - protein, 9 aa, Entamoeba dispar
SNKTNDAER

SEQ ID NO: 2461980 - protein, 5 aa, Entamoeba dispar
SNKTQ

SEQ ID NO: 2461981 - protein, 9 aa, Entamoeba dispar
SNKTSDDVQ

SEQ ID NO: 2461982 - protein, 14 aa, Entamoeba dispar
SNKTSGFKNPISTK

SEQ ID NO: 2461983 - protein, 8 aa, Entamoeba dispar
SNKTSINP

SEQ ID NO: 2461984 - protein, 7 aa, Entamoeba dispar
SNKTVTE

SEQ ID NO: 2461985 - protein, 6 aa, Entamoeba dispar
SNKTYT

SEQ ID NO: 2461986 - protein, 8 aa, Entamoeba dispar
SNKVEPDE

SEQ ID NO: 2461987 - protein, 7 aa, Entamoeba dispar
SNKWPDE

SEQ ID NO: 2461988 - protein, 5 aa, Entamoeba dispar
SNKYN

SEQ ID NO: 2461989 - protein, 8 aa, Entamoeba dispar
SNKYRSDT

SEQ ID NO: 2461990 - protein, 4 aa, Entamoeba dispar
SNLG

SEQ ID NO: 2461991 - protein, 9 aa, Entamoeba dispar
SNLIGTTSK

SEQ ID NO: 2461992 - protein, 5 aa, Entamoeba dispar
SNLMD

SEQ ID NO: 2461993 - protein, 11 aa, Entamoeba dispar
SNLNKNGLNDK

SEQ ID NO: 2461994 - protein, 10 aa, Entamoeba dispar
SNLNNSPKYK

SEQ ID NO: 2461995 - protein, 8 aa, Entamoeba dispar
SNLNTDDK

SEQ ID NO: 2461996 - protein, 4 aa, Entamoeba dispar
SNLP

SEQ ID NO: 2461997 - protein, 8 aa, Entamoeba dispar
SNLPKPQI

SEQ ID NO: 2461998 - protein, 10 aa, Entamoeba dispar
SNLPSSNEQI

SEQ ID NO: 2461999 - protein, 5 aa, Entamoeba dispar
SNLQG

SEQ ID NO: 2462000 - protein, 7 aa, Entamoeba dispar
SNLQKPG

SEQ ID NO: 2462001 - protein, 44 aa, Entamoeba dispar
SNLQSPNETSEDSLNTQTEGALSMTSSNPELSPRTKPQRTLSEY

SEQ ID NO: 2462002 - protein, 6 aa, Entamoeba dispar
SNLRPE

SEQ ID NO: 2462003 - protein, 9 aa, Entamoeba dispar
SNLSEKEKT

SEQ ID NO: 2462004 - protein, 17 aa, Entamoeba dispar
SNLSSSNDDVDQALTTK

SEQ ID NO: 2462005 - protein, 9 aa, Entamoeba dispar
SNLTKEENE

SEQ ID NO: 2462006 - protein, 13 aa, Entamoeba dispar
SNMCGKRDSMQDT

SEQ ID NO: 2462007 - protein, 7 aa, Entamoeba dispar
SNNDDAL

SEQ ID NO: 2462008 - protein, 6 aa, Entamoeba dispar
SNNDGN

SEQ ID NO: 2462009 - protein, 6 aa, Entamoeba dispar
SNNDPL

SEQ ID NO: 2462010 - protein, 9 aa, Entamoeba dispar
SNNEKAEEV

SEQ ID NO: 2462011 - protein, 5 aa, Entamoeba dispar
SNNEL

SEQ ID NO: 2462012 - protein, 8 aa, Entamoeba dispar
SNNENVKN

SEQ ID NO: 2462013 - protein, 6 aa, Entamoeba dispar
SNNERN

SEQ ID NO: 2462014 - protein, 15 aa, Entamoeba dispar
SNNETTINTSQTEDV

SEQ ID NO: 2462015 - protein, 17 aa, Entamoeba dispar
SNNEYNKGKEKTSKVGC

SEQ ID NO: 2462016 - protein, 6 aa, Entamoeba dispar
SNNGEK

SEQ ID NO: 2462017 - protein, 5 aa, Entamoeba dispar
SNNGM

SEQ ID NO: 2462018 - protein, 6 aa, Entamoeba dispar
SNNIIS

SEQ ID NO: 2462019 - protein, 7 aa, Entamoeba dispar
SNNKATL

SEQ ID NO: 2462020 - protein, 7 aa, Entamoeba dispar
SNNKEFE

SEQ ID NO: 2462021 - protein, 6 aa, Entamoeba dispar
SNNLNN

SEQ ID NO: 2462022 - protein, 5 aa, Entamoeba dispar
SNNLT

SEQ ID NO: 2462023 - protein, 4 aa, Entamoeba dispar
SNNN

SEQ ID NO: 2462024 - protein, 15 aa, Entamoeba dispar
SNNNEPKPPEPFEWN

SEQ ID NO: 2462025 - protein, 7 aa, Entamoeba dispar
SNNNKQI

SEQ ID NO: 2462026 - protein, 9 aa, Entamoeba dispar
SNNNSAGRF

SEQ ID NO: 2462027 - protein, 6 aa, Entamoeba dispar
SNNNYQ

SEQ ID NO: 2462028 - protein, 121 aa, Entamoeba dispar
SNNPFKDSSSTMADSTNPFGDSSTLDNPATEVTQTQESHSSKKTSFANTQFEDEPPKMTSSTTRLSSNNPFGEPESTYSNPFKSSEVPVKSKTPNPSSTNPFGDEPPRLTSSTSKQSSTNL

SEQ ID NO: 2462029 - protein, 47 aa, Entamoeba dispar
SNNPFSENSSDSSEHQPTTISQTNPFDDDVSDEATKVDHQATTTLDK

SEQ ID NO: 2462030 - protein, 9 aa, Entamoeba dispar
SNNPNATDI

SEQ ID NO: 2462031 - protein, 8 aa, Entamoeba dispar
SNNPSDTF

SEQ ID NO: 2462032 - protein, 6 aa, Entamoeba dispar
SNNPSI

SEQ ID NO: 2462033 - protein, 9 aa, Entamoeba dispar
SNNPTEEKI

SEQ ID NO: 2462034 - protein, 8 aa, Entamoeba dispar
SNNPTIRK

SEQ ID NO: 2462035 - protein, 6 aa, Entamoeba dispar
SNNPVG

SEQ ID NO: 2462036 - protein, 7 aa, Entamoeba dispar
SNNQENQ

SEQ ID NO: 2462037 - protein, 6 aa, Entamoeba dispar
SNNQIH

SEQ ID NO: 2462038 - protein, 6 aa, Entamoeba dispar
SNNQIS

SEQ ID NO: 2462039 - protein, 6 aa, Entamoeba dispar
SNNQLL

SEQ ID NO: 2462040 - protein, 9 aa, Entamoeba dispar
SNNQSIKQS

SEQ ID NO: 2462041 - protein, 6 aa, Entamoeba dispar
SNNQTD

SEQ ID NO: 2462042 - protein, 23 aa, Entamoeba dispar
SNNSFEEKQRELETKKKKEDEYL

SEQ ID NO: 2462043 - protein, 8 aa, Entamoeba dispar
SNNSGNKS

SEQ ID NO: 2462044 - protein, 8 aa, Entamoeba dispar
SNNSNKYC

SEQ ID NO: 2462045 - protein, 8 aa, Entamoeba dispar
SNNSSDRF

SEQ ID NO: 2462046 - protein, 8 aa, Entamoeba dispar
SNNSTEIK

SEQ ID NO: 2462047 - protein, 149 aa, Entamoeba dispar
SNNSTSSTTTGTTATTGSNPFGNFNTTNNTTSSTTSTGNNTTTGSNPFGNFTTTNSTTPSTTTGTTTTTTGSNPFGNFNTTNNTSNSSTTSTTTGSNPFGNFTNNTTSNSTTPNTTGTNTSNPFGSFTSNTTNTTTTSTTGAGNPFSTT

SEQ ID NO: 2462048 - protein, 9 aa, Entamoeba dispar
SNNTGKPLN

SEQ ID NO: 2462049 - protein, 5 aa, Entamoeba dispar
SNNTR

SEQ ID NO: 2462050 - protein, 8 aa, Entamoeba dispar
SNNTTNNN

SEQ ID NO: 2462051 - protein, 8 aa, Entamoeba dispar
SNNTYRNN

SEQ ID NO: 2462052 - protein, 6 aa, Entamoeba dispar
SNNYPS

SEQ ID NO: 2462053 - protein, 5 aa, Entamoeba dispar
SNPAV

SEQ ID NO: 2462054 - protein, 6 aa, Entamoeba dispar
SNPDVQ

SEQ ID NO: 2462055 - protein, 4 aa, Entamoeba dispar
SNPE

SEQ ID NO: 2462056 - protein, 28 aa, Entamoeba dispar
SNPEKRKQYDSSDNTDDKLPQDRQYEEK

SEQ ID NO: 2462057 - protein, 9 aa, Entamoeba dispar
SNPEKYNSP

SEQ ID NO: 2462058 - protein, 7 aa, Entamoeba dispar
SNPGINI

SEQ ID NO: 2462059 - protein, 4 aa, Entamoeba dispar
SNPI

SEQ ID NO: 2462060 - protein, 7 aa, Entamoeba dispar
SNPIKTL

SEQ ID NO: 2462061 - protein, 11 aa, Entamoeba dispar
SNPINKSSNEI

SEQ ID NO: 2462062 - protein, 7 aa, Entamoeba dispar
SNPIPQP

SEQ ID NO: 2462063 - protein, 7 aa, Entamoeba dispar
SNPITSN

SEQ ID NO: 2462064 - protein, 8 aa, Entamoeba dispar
SNPKEPTI

SEQ ID NO: 2462065 - protein, 28 aa, Entamoeba dispar
SNPKIEKKEETLNNKIHESEKKEEQIDD

SEQ ID NO: 2462066 - protein, 7 aa, Entamoeba dispar
SNPKKEF

SEQ ID NO: 2462067 - protein, 7 aa, Entamoeba dispar
SNPKYNQ

SEQ ID NO: 2462068 - protein, 4 aa, Entamoeba dispar
SNPL

SEQ ID NO: 2462069 - protein, 11 aa, Entamoeba dispar
SNPLESYSNEA

SEQ ID NO: 2462070 - protein, 10 aa, Entamoeba dispar
SNPNATDNSL

SEQ ID NO: 2462071 - protein, 6 aa, Entamoeba dispar
SNPNCQ

SEQ ID NO: 2462072 - protein, 18 aa, Entamoeba dispar
SNPNDEHHSKESDNQTYT

SEQ ID NO: 2462073 - protein, 12 aa, Entamoeba dispar
SNPNKQKQVDEA

SEQ ID NO: 2462074 - protein, 7 aa, Entamoeba dispar
SNPNPFY

SEQ ID NO: 2462075 - protein, 7 aa, Entamoeba dispar
SNPPESV

SEQ ID NO: 2462076 - protein, 7 aa, Entamoeba dispar
SNPPPHT

SEQ ID NO: 2462077 - protein, 7 aa, Entamoeba dispar
SNPPQQG

SEQ ID NO: 2462078 - protein, 4 aa, Entamoeba dispar
SNPQ

SEQ ID NO: 2462079 - protein, 94 aa, Entamoeba dispar
SNPQPQPVTKKSFTTPSSSTLKQTTQPNSSSVNSFNKPSVVKQTTTSSVNTSKPLTPKSPTSSLNENKLSTSSHINSTIPSPIKQTQSKISQPL

SEQ ID NO: 2462080 - protein, 8 aa, Entamoeba dispar
SNPRNEMN

SEQ ID NO: 2462081 - protein, 4 aa, Entamoeba dispar
SNPS

SEQ ID NO: 2462082 - protein, 9 aa, Entamoeba dispar
SNPSQLSAP

SEQ ID NO: 2462083 - protein, 8 aa, Entamoeba dispar
SNPSRGEV

SEQ ID NO: 2462084 - protein, 7 aa, Entamoeba dispar
SNPSSIR

SEQ ID NO: 2462085 - protein, 7 aa, Entamoeba dispar
SNPSYGH

SEQ ID NO: 2462086 - protein, 7 aa, Entamoeba dispar
SNPTERK

SEQ ID NO: 2462087 - protein, 15 aa, Entamoeba dispar
SNPTLCSNENEELTK

SEQ ID NO: 2462088 - protein, 6 aa, Entamoeba dispar
SNPVRQ

SEQ ID NO: 2462089 - protein, 9 aa, Entamoeba dispar
SNPVTEELA

SEQ ID NO: 2462090 - protein, 9 aa, Entamoeba dispar
SNQDGLDNR

SEQ ID NO: 2462091 - protein, 30 aa, Entamoeba dispar
SNQEPLPMQETERKPIQNLETGKCSKKQRS

SEQ ID NO: 2462092 - protein, 11 aa, Entamoeba dispar
SNQFKKEKSPI

SEQ ID NO: 2462093 - protein, 8 aa, Entamoeba dispar
SNQIGENT

SEQ ID NO: 2462094 - protein, 4 aa, Entamoeba dispar
SNQK

SEQ ID NO: 2462095 - protein, 5 aa, Entamoeba dispar
SNQKE

SEQ ID NO: 2462096 - protein, 8 aa, Entamoeba dispar
SNQKSSVI

SEQ ID NO: 2462097 - protein, 7 aa, Entamoeba dispar
SNQKTVI

SEQ ID NO: 2462098 - protein, 4 aa, Entamoeba dispar
SNQL

SEQ ID NO: 2462099 - protein, 6 aa, Entamoeba dispar
SNQLRE

SEQ ID NO: 2462100 - protein, 8 aa, Entamoeba dispar
SNQNRSIS

SEQ ID NO: 2462101 - protein, 15 aa, Entamoeba dispar
SNQPIPSVNSQGPSC

SEQ ID NO: 2462102 - protein, 14 aa, Entamoeba dispar
SNQQEFEAAGEAAK

SEQ ID NO: 2462103 - protein, 29 aa, Entamoeba dispar
SNQQLNETTKQEEQPKQEIPQRDEEKVQE

SEQ ID NO: 2462104 - protein, 8 aa, Entamoeba dispar
SNQQNQYR

SEQ ID NO: 2462105 - protein, 4 aa, Entamoeba dispar
SNQR

SEQ ID NO: 2462106 - protein, 16 aa, Entamoeba dispar
SNQREKHNTSPPKVTD

SEQ ID NO: 2462107 - protein, 4 aa, Entamoeba dispar
SNQS

SEQ ID NO: 2462108 - protein, 5 aa, Entamoeba dispar
SNQSL

SEQ ID NO: 2462109 - protein, 7 aa, Entamoeba dispar
SNQSPSP

SEQ ID NO: 2462110 - protein, 10 aa, Entamoeba dispar
SNQSSPKTFG

SEQ ID NO: 2462111 - protein, 6 aa, Entamoeba dispar
SNQTDL

SEQ ID NO: 2462112 - protein, 8 aa, Entamoeba dispar
SNQTESPL

SEQ ID NO: 2462113 - protein, 6 aa, Entamoeba dispar
SNQVTR

SEQ ID NO: 2462114 - protein, 4 aa, Entamoeba dispar
SNRA

SEQ ID NO: 2462115 - protein, 15 aa, Entamoeba dispar
SNRAAAYQKLGEHPY

SEQ ID NO: 2462116 - protein, 4 aa, Entamoeba dispar
SNRC

SEQ ID NO: 2462117 - protein, 4 aa, Entamoeba dispar
SNRE

SEQ ID NO: 2462118 - protein, 4 aa, Entamoeba dispar
SNRF

SEQ ID NO: 2462119 - protein, 9 aa, Entamoeba dispar
SNRGEQQAI

SEQ ID NO: 2462120 - protein, 10 aa, Entamoeba dispar
SNRKDKPLRI

SEQ ID NO: 2462121 - protein, 6 aa, Entamoeba dispar
SNRMSV

SEQ ID NO: 2462122 - protein, 9 aa, Entamoeba dispar
SNRNDKPRR

SEQ ID NO: 2462123 - protein, 7 aa, Entamoeba dispar
SNRRDAF

SEQ ID NO: 2462124 - protein, 6 aa, Entamoeba dispar
SNRSTF

SEQ ID NO: 2462125 - protein, 4 aa, Entamoeba dispar
SNRT

SEQ ID NO: 2462126 - protein, 6 aa, Entamoeba dispar
SNSADD

SEQ ID NO: 2462127 - protein, 9 aa, Entamoeba dispar
SNSAQLRGR

SEQ ID NO: 2462128 - protein, 10 aa, Entamoeba dispar
SNSASTNELP

SEQ ID NO: 2462129 - protein, 15 aa, Entamoeba dispar
SNSCPPSPQFQDRSV

SEQ ID NO: 2462130 - protein, 7 aa, Entamoeba dispar
SNSDGLT

SEQ ID NO: 2462131 - protein, 4 aa, Entamoeba dispar
SNSE

SEQ ID NO: 2462132 - protein, 12 aa, Entamoeba dispar
SNSEEGNNHSSV

SEQ ID NO: 2462133 - protein, 15 aa, Entamoeba dispar
SNSESESISDFVLSP

SEQ ID NO: 2462134 - protein, 7 aa, Entamoeba dispar
SNSFNDC

SEQ ID NO: 2462135 - protein, 7 aa, Entamoeba dispar
SNSGATH

SEQ ID NO: 2462136 - protein, 17 aa, Entamoeba dispar
SNSGSSTPSRSVSRSDL

SEQ ID NO: 2462137 - protein, 5 aa, Entamoeba dispar
SNSHN

SEQ ID NO: 2462138 - protein, 4 aa, Entamoeba dispar
SNSI

SEQ ID NO: 2462139 - protein, 5 aa, Entamoeba dispar
SNSIK

SEQ ID NO: 2462140 - protein, 5 aa, Entamoeba dispar
SNSIM

SEQ ID NO: 2462141 - protein, 5 aa, Entamoeba dispar
SNSIS

SEQ ID NO: 2462142 - protein, 6 aa, Entamoeba dispar
SNSITT

SEQ ID NO: 2462143 - protein, 13 aa, Entamoeba dispar
SNSKEAGGKYKVE

SEQ ID NO: 2462144 - protein, 7 aa, Entamoeba dispar
SNSKKDQ

SEQ ID NO: 2462145 - protein, 7 aa, Entamoeba dispar
SNSKLNE

SEQ ID NO: 2462146 - protein, 14 aa, Entamoeba dispar
SNSKQIAEKGEPHG

SEQ ID NO: 2462147 - protein, 5 aa, Entamoeba dispar
SNSLA

SEQ ID NO: 2462148 - protein, 14 aa, Entamoeba dispar
SNSLSFDQDNAKSV

SEQ ID NO: 2462149 - protein, 16 aa, Entamoeba dispar
SNSMEKSYSLQSSSQI

SEQ ID NO: 2462150 - protein, 7 aa, Entamoeba dispar
SNSNEKM

SEQ ID NO: 2462151 - protein, 7 aa, Entamoeba dispar
SNSNEWG

SEQ ID NO: 2462152 - protein, 25 aa, Entamoeba dispar
SNSNPTSTPSENENSSQKTTSDCNQ

SEQ ID NO: 2462153 - protein, 7 aa, Entamoeba dispar
SNSNTID

SEQ ID NO: 2462154 - protein, 4 aa, Entamoeba dispar
SNSP

SEQ ID NO: 2462155 - protein, 7 aa, Entamoeba dispar
SNSPAQR

SEQ ID NO: 2462156 - protein, 6 aa, Entamoeba dispar
SNSPDL

SEQ ID NO: 2462157 - protein, 10 aa, Entamoeba dispar
SNSPQKEVDN

SEQ ID NO: 2462158 - protein, 7 aa, Entamoeba dispar
SNSQCIN

SEQ ID NO: 2462159 - protein, 6 aa, Entamoeba dispar
SNSQFQ

SEQ ID NO: 2462160 - protein, 6 aa, Entamoeba dispar
SNSQNG

SEQ ID NO: 2462161 - protein, 5 aa, Entamoeba dispar
SNSQQ

SEQ ID NO: 2462162 - protein, 6 aa, Entamoeba dispar
SNSQYK

SEQ ID NO: 2462163 - protein, 34 aa, Entamoeba dispar
SNSRRYRNNNQRINGDSMPPRRDKNDRETPAPQY

SEQ ID NO: 2462164 - protein, 6 aa, Entamoeba dispar
SNSRYK

SEQ ID NO: 2462165 - protein, 13 aa, Entamoeba dispar
SNSSAKEFIYLSL

SEQ ID NO: 2462166 - protein, 8 aa, Entamoeba dispar
SNSSFETD

SEQ ID NO: 2462167 - protein, 6 aa, Entamoeba dispar
SNSSGV

SEQ ID NO: 2462168 - protein, 5 aa, Entamoeba dispar
SNSSI

SEQ ID NO: 2462169 - protein, 18 aa, Entamoeba dispar
SNSSKPKPVVTKKETLAD

SEQ ID NO: 2462170 - protein, 5 aa, Entamoeba dispar
SNSSL

SEQ ID NO: 2462171 - protein, 7 aa, Entamoeba dispar
SNSSNNQ

SEQ ID NO: 2462172 - protein, 5 aa, Entamoeba dispar
SNSSR

SEQ ID NO: 2462173 - protein, 6 aa, Entamoeba dispar
SNSTAI

SEQ ID NO: 2462174 - protein, 10 aa, Entamoeba dispar
SNSTHTNQTL

SEQ ID NO: 2462175 - protein, 5 aa, Entamoeba dispar
SNSTI

SEQ ID NO: 2462176 - protein, 7 aa, Entamoeba dispar
SNSTLPE

SEQ ID NO: 2462177 - protein, 29 aa, Entamoeba dispar
SNSTPISGLQSKATSPKRKNIQPTTISSL

SEQ ID NO: 2462178 - protein, 8 aa, Entamoeba dispar
SNSTYDEK

SEQ ID NO: 2462179 - protein, 4 aa, Entamoeba dispar
SNSV

SEQ ID NO: 2462180 - protein, 6 aa, Entamoeba dispar
SNSYRN

SEQ ID NO: 2462181 - protein, 10 aa, Entamoeba dispar
SNTAAVREPR

SEQ ID NO: 2462182 - protein, 7 aa, Entamoeba dispar
SNTAQSL

SEQ ID NO: 2462183 - protein, 7 aa, Entamoeba dispar
SNTDATF

SEQ ID NO: 2462184 - protein, 9 aa, Entamoeba dispar
SNTDEIESK

SEQ ID NO: 2462185 - protein, 8 aa, Entamoeba dispar
SNTDSDTI

SEQ ID NO: 2462186 - protein, 9 aa, Entamoeba dispar
SNTELQNAD

SEQ ID NO: 2462187 - protein, 5 aa, Entamoeba dispar
SNTEP

SEQ ID NO: 2462188 - protein, 5 aa, Entamoeba dispar
SNTEQ

SEQ ID NO: 2462189 - protein, 5 aa, Entamoeba dispar
SNTFT

SEQ ID NO: 2462190 - protein, 14 aa, Entamoeba dispar
SNTFTGNDAALDLS

SEQ ID NO: 2462191 - protein, 12 aa, Entamoeba dispar
SNTGINDLDQGV

SEQ ID NO: 2462192 - protein, 5 aa, Entamoeba dispar
SNTGN

SEQ ID NO: 2462193 - protein, 13 aa, Entamoeba dispar
SNTGTIGPYQTDE

SEQ ID NO: 2462194 - protein, 13 aa, Entamoeba dispar
SNTINSPQKDQKL

SEQ ID NO: 2462195 - protein, 4 aa, Entamoeba dispar
SNTK

SEQ ID NO: 2462196 - protein, 7 aa, Entamoeba dispar
SNTKESV

SEQ ID NO: 2462197 - protein, 74 aa, Entamoeba dispar
SNTKKEEIKKEDQQPTSQNQNITNEEIKQTPPTQVENKEQLTSNNEEVNENMKDENNTNTEENIDDNSEEDDNY

SEQ ID NO: 2462198 - protein, 6 aa, Entamoeba dispar
SNTKVL

SEQ ID NO: 2462199 - protein, 5 aa, Entamoeba dispar
SNTLE

SEQ ID NO: 2462200 - protein, 8 aa, Entamoeba dispar
SNTLPQEQ

SEQ ID NO: 2462201 - protein, 7 aa, Entamoeba dispar
SNTMQPD

SEQ ID NO: 2462202 - protein, 5 aa, Entamoeba dispar
SNTNA

SEQ ID NO: 2462203 - protein, 5 aa, Entamoeba dispar
SNTNI

SEQ ID NO: 2462204 - protein, 9 aa, Entamoeba dispar
SNTNITQSL

SEQ ID NO: 2462205 - protein, 6 aa, Entamoeba dispar
SNTNLS

SEQ ID NO: 2462206 - protein, 6 aa, Entamoeba dispar
SNTNQF

SEQ ID NO: 2462207 - protein, 9 aa, Entamoeba dispar
SNTNTFTET

SEQ ID NO: 2462208 - protein, 4 aa, Entamoeba dispar
SNTP

SEQ ID NO: 2462209 - protein, 24 aa, Entamoeba dispar
SNTPGTISPIEEGSSSNSQGKSIT

SEQ ID NO: 2462210 - protein, 6 aa, Entamoeba dispar
SNTPIS

SEQ ID NO: 2462211 - protein, 7 aa, Entamoeba dispar
SNTQISQ

SEQ ID NO: 2462212 - protein, 6 aa, Entamoeba dispar
SNTQSN

SEQ ID NO: 2462213 - protein, 5 aa, Entamoeba dispar
SNTQV

SEQ ID NO: 2462214 - protein, 7 aa, Entamoeba dispar
SNTRIEK

SEQ ID NO: 2462215 - protein, 6 aa, Entamoeba dispar
SNTRKL

SEQ ID NO: 2462216 - protein, 9 aa, Entamoeba dispar
SNTRSETKR

SEQ ID NO: 2462217 - protein, 8 aa, Entamoeba dispar
SNTRSNGE

SEQ ID NO: 2462218 - protein, 10 aa, Entamoeba dispar
SNTSNSSSRE

SEQ ID NO: 2462219 - protein, 6 aa, Entamoeba dispar
SNTSSH

SEQ ID NO: 2462220 - protein, 21 aa, Entamoeba dispar
SNTSSNDLTDLSEPNAPIEGS

SEQ ID NO: 2462221 - protein, 7 aa, Entamoeba dispar
SNTTNIQ

SEQ ID NO: 2462222 - protein, 7 aa, Entamoeba dispar
SNTTSGF

SEQ ID NO: 2462223 - protein, 8 aa, Entamoeba dispar
SNTTTSPL

SEQ ID NO: 2462224 - protein, 19 aa, Entamoeba dispar
SNTVQPETTPIQQVPQQQF

SEQ ID NO: 2462225 - protein, 9 aa, Entamoeba dispar
SNTYSPNLN

SEQ ID NO: 2462226 - protein, 13 aa, Entamoeba dispar
SNTYYSEPSYDEF

SEQ ID NO: 2462227 - protein, 7 aa, Entamoeba dispar
SNVEQEK

SEQ ID NO: 2462228 - protein, 5 aa, Entamoeba dispar
SNVES

SEQ ID NO: 2462229 - protein, 8 aa, Entamoeba dispar
SNVKSGDI

SEQ ID NO: 2462230 - protein, 5 aa, Entamoeba dispar
SNVNF

SEQ ID NO: 2462231 - protein, 10 aa, Entamoeba dispar
SNVNNGENIQ

SEQ ID NO: 2462232 - protein, 35 aa, Entamoeba dispar
SNVNTSENNEELLPTKSNNTLTERKQQSLNSQQII

SEQ ID NO: 2462233 - protein, 30 aa, Entamoeba dispar
SNVPKANDSVKEEIKEEKKEVNKEEDGRKE

SEQ ID NO: 2462234 - protein, 5 aa, Entamoeba dispar
SNVQD

SEQ ID NO: 2462235 - protein, 6 aa, Entamoeba dispar
SNVSPS

SEQ ID NO: 2462236 - protein, 4 aa, Entamoeba dispar
SNVT

SEQ ID NO: 2462237 - protein, 10 aa, Entamoeba dispar
SNVTFSNQPK

SEQ ID NO: 2462238 - protein, 8 aa, Entamoeba dispar
SNVTNKQI

SEQ ID NO: 2462239 - protein, 7 aa, Entamoeba dispar
SNWNPAE

SEQ ID NO: 2462240 - protein, 6 aa, Entamoeba dispar
SNYEEI

SEQ ID NO: 2462241 - protein, 13 aa, Entamoeba dispar
SNYEEIEKISLEE

SEQ ID NO: 2462242 - protein, 7 aa, Entamoeba dispar
SNYENNY

SEQ ID NO: 2462243 - protein, 7 aa, Entamoeba dispar
SNYEPTI

SEQ ID NO: 2462244 - protein, 6 aa, Entamoeba dispar
SNYESA

SEQ ID NO: 2462245 - protein, 9 aa, Entamoeba dispar
SNYKGGSTT

SEQ ID NO: 2462246 - protein, 6 aa, Entamoeba dispar
SNYKNE

SEQ ID NO: 2462247 - protein, 6 aa, Entamoeba dispar
SNYKNG

SEQ ID NO: 2462248 - protein, 6 aa, Entamoeba dispar
SNYKTV

SEQ ID NO: 2462249 - protein, 4 aa, Entamoeba dispar
SNYN

SEQ ID NO: 2462250 - protein, 6 aa, Entamoeba dispar
SNYPGT

SEQ ID NO: 2462251 - protein, 16 aa, Entamoeba dispar
SNYPPLKKKKENLSEI

SEQ ID NO: 2462252 - protein, 6 aa, Entamoeba dispar
SNYSFQ

SEQ ID NO: 2462253 - protein, 5 aa, Entamoeba dispar
SNYSL

SEQ ID NO: 2462254 - protein, 18 aa, Entamoeba dispar
SNYSSNISSPRSDNEEET

SEQ ID NO: 2462255 - protein, 7 aa, Entamoeba dispar
SNYSTLQ

SEQ ID NO: 2462256 - protein, 7 aa, Entamoeba dispar
SPAESES

SEQ ID NO: 2462257 - protein, 4 aa, Entamoeba dispar
SPAN

SEQ ID NO: 2462258 - protein, 5 aa, Entamoeba dispar
SPAND

SEQ ID NO: 2462259 - protein, 7 aa, Entamoeba dispar
SPARYDP

SEQ ID NO: 2462260 - protein, 9 aa, Entamoeba dispar
SPASGKTSF

SEQ ID NO: 2462261 - protein, 5 aa, Entamoeba dispar
SPASI

SEQ ID NO: 2462262 - protein, 6 aa, Entamoeba dispar
SPASPR

SEQ ID NO: 2462263 - protein, 16 aa, Entamoeba dispar
SPATQHDIEKNKPQKY

SEQ ID NO: 2462264 - protein, 28 aa, Entamoeba dispar
SPCESPRYKKPINQRAKLSNPTTPLNSC

SEQ ID NO: 2462265 - protein, 10 aa, Entamoeba dispar
SPCNTTVPVG

SEQ ID NO: 2462266 - protein, 7 aa, Entamoeba dispar
SPCTEEK

SEQ ID NO: 2462267 - protein, 4 aa, Entamoeba dispar
SPDA

SEQ ID NO: 2462268 - protein, 10 aa, Entamoeba dispar
SPDAKRLSDF

SEQ ID NO: 2462269 - protein, 8 aa, Entamoeba dispar
SPDAQPLD

SEQ ID NO: 2462270 - protein, 12 aa, Entamoeba dispar
SPDDMADETVKE

SEQ ID NO: 2462271 - protein, 17 aa, Entamoeba dispar
SPDESIRKQAESTFEQM

SEQ ID NO: 2462272 - protein, 8 aa, Entamoeba dispar
SPDESNFE

SEQ ID NO: 2462273 - protein, 8 aa, Entamoeba dispar
SPDETRTF

SEQ ID NO: 2462274 - protein, 9 aa, Entamoeba dispar
SPDFDPEEL

SEQ ID NO: 2462275 - protein, 5 aa, Entamoeba dispar
SPDGS

SEQ ID NO: 2462276 - protein, 10 aa, Entamoeba dispar
SPDKCPHRKE

SEQ ID NO: 2462277 - protein, 7 aa, Entamoeba dispar
SPDLKSI

SEQ ID NO: 2462278 - protein, 4 aa, Entamoeba dispar
SPDN

SEQ ID NO: 2462279 - protein, 10 aa, Entamoeba dispar
SPDQKIAPSD

SEQ ID NO: 2462280 - protein, 7 aa, Entamoeba dispar
SPDQNTF

SEQ ID NO: 2462281 - protein, 15 aa, Entamoeba dispar
SPDQPKKIFNQKEED

SEQ ID NO: 2462282 - protein, 10 aa, Entamoeba dispar
SPDQYNHEQD

SEQ ID NO: 2462283 - protein, 10 aa, Entamoeba dispar
SPDQYNHERD

SEQ ID NO: 2462284 - protein, 12 aa, Entamoeba dispar
SPDRIEEEMPLS

SEQ ID NO: 2462285 - protein, 8 aa, Entamoeba dispar
SPDSSNLK

SEQ ID NO: 2462286 - protein, 9 aa, Entamoeba dispar
SPDTTKKEK

SEQ ID NO: 2462287 - protein, 5 aa, Entamoeba dispar
SPECS

SEQ ID NO: 2462288 - protein, 8 aa, Entamoeba dispar
SPEDITYS

SEQ ID NO: 2462289 - protein, 11 aa, Entamoeba dispar
SPEEEIDDKYS

SEQ ID NO: 2462290 - protein, 7 aa, Entamoeba dispar
SPEEKQL

SEQ ID NO: 2462291 - protein, 6 aa, Entamoeba dispar
SPEEKR

SEQ ID NO: 2462292 - protein, 5 aa, Entamoeba dispar
SPEEP

SEQ ID NO: 2462293 - protein, 4 aa, Entamoeba dispar
SPEF

SEQ ID NO: 2462294 - protein, 13 aa, Entamoeba dispar
SPEFKGTRSARKT

SEQ ID NO: 2462295 - protein, 5 aa, Entamoeba dispar
SPEGN

SEQ ID NO: 2462296 - protein, 4 aa, Entamoeba dispar
SPEI

SEQ ID NO: 2462297 - protein, 5 aa, Entamoeba dispar
SPEIA

SEQ ID NO: 2462298 - protein, 5 aa, Entamoeba dispar
SPEIR

SEQ ID NO: 2462299 - protein, 4 aa, Entamoeba dispar
SPEK

SEQ ID NO: 2462300 - protein, 10 aa, Entamoeba dispar
SPEKGQQMAT

SEQ ID NO: 2462301 - protein, 5 aa, Entamoeba dispar
SPEKI

SEQ ID NO: 2462302 - protein, 7 aa, Entamoeba dispar
SPEKSYI

SEQ ID NO: 2462303 - protein, 5 aa, Entamoeba dispar
SPELK

SEQ ID NO: 2462304 - protein, 4 aa, Entamoeba dispar
SPEN

SEQ ID NO: 2462305 - protein, 5 aa, Entamoeba dispar
SPENI

SEQ ID NO: 2462306 - protein, 5 aa, Entamoeba dispar
SPENK

SEQ ID NO: 2462307 - protein, 5 aa, Entamoeba dispar
SPENN

SEQ ID NO: 2462308 - protein, 5 aa, Entamoeba dispar
SPEQG

SEQ ID NO: 2462309 - protein, 30 aa, Entamoeba dispar
SPEQNKLEKTPKQPEDSIPTSDYPDELNDN

SEQ ID NO: 2462310 - protein, 6 aa, Entamoeba dispar
SPETFQ

SEQ ID NO: 2462311 - protein, 9 aa, Entamoeba dispar
SPETSCEEA

SEQ ID NO: 2462312 - protein, 6 aa, Entamoeba dispar
SPETVS

SEQ ID NO: 2462313 - protein, 7 aa, Entamoeba dispar
SPEYPQR

SEQ ID NO: 2462314 - protein, 6 aa, Entamoeba dispar
SPEYRE

SEQ ID NO: 2462315 - protein, 7 aa, Entamoeba dispar
SPFDTSN

SEQ ID NO: 2462316 - protein, 5 aa, Entamoeba dispar
SPFED

SEQ ID NO: 2462317 - protein, 5 aa, Entamoeba dispar
SPFEE

SEQ ID NO: 2462318 - protein, 13 aa, Entamoeba dispar
SPFGQQNQANNEY

SEQ ID NO: 2462319 - protein, 19 aa, Entamoeba dispar
SPFKKQKTLNSNSEIDTSP

SEQ ID NO: 2462320 - protein, 4 aa, Entamoeba dispar
SPFN

SEQ ID NO: 2462321 - protein, 7 aa, Entamoeba dispar
SPFNSPI

SEQ ID NO: 2462322 - protein, 6 aa, Entamoeba dispar
SPFQST

SEQ ID NO: 2462323 - protein, 13 aa, Entamoeba dispar
SPFSSVSSSSSLS

SEQ ID NO: 2462324 - protein, 4 aa, Entamoeba dispar
SPFT

SEQ ID NO: 2462325 - protein, 6 aa, Entamoeba dispar
SPFTTS

SEQ ID NO: 2462326 - protein, 13 aa, Entamoeba dispar
SPFVPNKTDEMKN

SEQ ID NO: 2462327 - protein, 5 aa, Entamoeba dispar
SPGAY

SEQ ID NO: 2462328 - protein, 15 aa, Entamoeba dispar
SPGGKTMIDPSRRAF

SEQ ID NO: 2462329 - protein, 9 aa, Entamoeba dispar
SPGHKTMTY

SEQ ID NO: 2462330 - protein, 5 aa, Entamoeba dispar
SPGHV

SEQ ID NO: 2462331 - protein, 5 aa, Entamoeba dispar
SPGTM

SEQ ID NO: 2462332 - protein, 9 aa, Entamoeba dispar
SPGTSHKGK

SEQ ID NO: 2462333 - protein, 8 aa, Entamoeba dispar
SPGVGSQL

SEQ ID NO: 2462334 - protein, 10 aa, Entamoeba dispar
SPGYDGANRG

SEQ ID NO: 2462335 - protein, 14 aa, Entamoeba dispar
SPHAGVKKSQTGFK

SEQ ID NO: 2462336 - protein, 6 aa, Entamoeba dispar
SPHDIT

SEQ ID NO: 2462337 - protein, 7 aa, Entamoeba dispar
SPHEAEE

SEQ ID NO: 2462338 - protein, 18 aa, Entamoeba dispar
SPHIGTTENITSSSVNDQ

SEQ ID NO: 2462339 - protein, 4 aa, Entamoeba dispar
SPHP

SEQ ID NO: 2462340 - protein, 5 aa, Entamoeba dispar
SPHPE

SEQ ID NO: 2462341 - protein, 4 aa, Entamoeba dispar
SPHQ

SEQ ID NO: 2462342 - protein, 5 aa, Entamoeba dispar
SPHQP

SEQ ID NO: 2462343 - protein, 8 aa, Entamoeba dispar
SPHSTHPK

SEQ ID NO: 2462344 - protein, 8 aa, Entamoeba dispar
SPHYTAPE

SEQ ID NO: 2462345 - protein, 6 aa, Entamoeba dispar
SPIEEN

SEQ ID NO: 2462346 - protein, 15 aa, Entamoeba dispar
SPIERKKKAAKKRKV

SEQ ID NO: 2462347 - protein, 9 aa, Entamoeba dispar
SPIGANHQP

SEQ ID NO: 2462348 - protein, 7 aa, Entamoeba dispar
SPIGKHS

SEQ ID NO: 2462349 - protein, 9 aa, Entamoeba dispar
SPIKNGTIE

SEQ ID NO: 2462350 - protein, 43 aa, Entamoeba dispar
SPIKPESKKTSPQKIEHKEKKDQKEKRDAKEQTEGSKFKVLKK

SEQ ID NO: 2462351 - protein, 5 aa, Entamoeba dispar
SPIND

SEQ ID NO: 2462352 - protein, 33 aa, Entamoeba dispar
SPINEKDINKKDESFQEKVNTEDNQEITEETSS

SEQ ID NO: 2462353 - protein, 14 aa, Entamoeba dispar
SPIPEKSKNGCCTV

SEQ ID NO: 2462354 - protein, 8 aa, Entamoeba dispar
SPIPGSGA

SEQ ID NO: 2462355 - protein, 12 aa, Entamoeba dispar
SPIQQSPKSVRK

SEQ ID NO: 2462356 - protein, 5 aa, Entamoeba dispar
SPIRN

SEQ ID NO: 2462357 - protein, 5 aa, Entamoeba dispar
SPIRS

SEQ ID NO: 2462358 - protein, 4 aa, Entamoeba dispar
SPIS

SEQ ID NO: 2462359 - protein, 5 aa, Entamoeba dispar
SPISI

SEQ ID NO: 2462360 - protein, 8 aa, Entamoeba dispar
SPISRLQN

SEQ ID NO: 2462361 - protein, 10 aa, Entamoeba dispar
SPITEEENLN

SEQ ID NO: 2462362 - protein, 13 aa, Entamoeba dispar
SPITEVKESAARE

SEQ ID NO: 2462363 - protein, 5 aa, Entamoeba dispar
SPIVT

SEQ ID NO: 2462364 - protein, 8 aa, Entamoeba dispar
SPKCERGK

SEQ ID NO: 2462365 - protein, 4 aa, Entamoeba dispar
SPKE

SEQ ID NO: 2462366 - protein, 5 aa, Entamoeba dispar
SPKEE

SEQ ID NO: 2462367 - protein, 7 aa, Entamoeba dispar
SPKEEFT

SEQ ID NO: 2462368 - protein, 5 aa, Entamoeba dispar
SPKEI

SEQ ID NO: 2462369 - protein, 13 aa, Entamoeba dispar
SPKEIDTSKIESE

SEQ ID NO: 2462370 - protein, 9 aa, Entamoeba dispar
SPKETKLGE

SEQ ID NO: 2462371 - protein, 5 aa, Entamoeba dispar
SPKGH

SEQ ID NO: 2462372 - protein, 10 aa, Entamoeba dispar
SPKGSSIARC

SEQ ID NO: 2462373 - protein, 15 aa, Entamoeba dispar
SPKHRAPPPPLSPRI

SEQ ID NO: 2462374 - protein, 4 aa, Entamoeba dispar
SPKI

SEQ ID NO: 2462375 - protein, 6 aa, Entamoeba dispar
SPKISS

SEQ ID NO: 2462376 - protein, 4 aa, Entamoeba dispar
SPKK

SEQ ID NO: 2462377 - protein, 7 aa, Entamoeba dispar
SPKKQNI

SEQ ID NO: 2462378 - protein, 10 aa, Entamoeba dispar
SPKLSSGVVE

SEQ ID NO: 2462379 - protein, 5 aa, Entamoeba dispar
SPKNL

SEQ ID NO: 2462380 - protein, 7 aa, Entamoeba dispar
SPKNLSK

SEQ ID NO: 2462381 - protein, 4 aa, Entamoeba dispar
SPKQ

SEQ ID NO: 2462382 - protein, 18 aa, Entamoeba dispar
SPKQNYQSINQQSRKNTY

SEQ ID NO: 2462383 - protein, 14 aa, Entamoeba dispar
SPKQPGLSSSRVTS

SEQ ID NO: 2462384 - protein, 4 aa, Entamoeba dispar
SPKV

SEQ ID NO: 2462385 - protein, 5 aa, Entamoeba dispar
SPKYP

SEQ ID NO: 2462386 - protein, 8 aa, Entamoeba dispar
SPLDAKDR

SEQ ID NO: 2462387 - protein, 9 aa, Entamoeba dispar
SPLDRPQIT

SEQ ID NO: 2462388 - protein, 10 aa, Entamoeba dispar
SPLEAQPKRI

SEQ ID NO: 2462389 - protein, 17 aa, Entamoeba dispar
SPLGNPGYGSTVPAPFE

SEQ ID NO: 2462390 - protein, 13 aa, Entamoeba dispar
SPLHTKSVQPEVV

SEQ ID NO: 2462391 - protein, 5 aa, Entamoeba dispar
SPLNT

SEQ ID NO: 2462392 - protein, 11 aa, Entamoeba dispar
SPLPKTRESLD

SEQ ID NO: 2462393 - protein, 6 aa, Entamoeba dispar
SPLPPL

SEQ ID NO: 2462394 - protein, 8 aa, Entamoeba dispar
SPLPSKES

SEQ ID NO: 2462395 - protein, 5 aa, Entamoeba dispar
SPLQG

SEQ ID NO: 2462396 - protein, 5 aa, Entamoeba dispar
SPLRE

SEQ ID NO: 2462397 - protein, 5 aa, Entamoeba dispar
SPLRK

SEQ ID NO: 2462398 - protein, 8 aa, Entamoeba dispar
SPLSDDIQ

SEQ ID NO: 2462399 - protein, 8 aa, Entamoeba dispar
SPLSEENK

SEQ ID NO: 2462400 - protein, 13 aa, Entamoeba dispar
SPLSKNSTPPLDS

SEQ ID NO: 2462401 - protein, 21 aa, Entamoeba dispar
SPMESSTPFDESDNSQPYHED

SEQ ID NO: 2462402 - protein, 9 aa, Entamoeba dispar
SPMNQKTSV

SEQ ID NO: 2462403 - protein, 4 aa, Entamoeba dispar
SPMS

SEQ ID NO: 2462404 - protein, 13 aa, Entamoeba dispar
SPMSSVSGSIHIS

SEQ ID NO: 2462405 - protein, 9 aa, Entamoeba dispar
SPNANEDAL

SEQ ID NO: 2462406 - protein, 11 aa, Entamoeba dispar
SPNDFKTKQTK

SEQ ID NO: 2462407 - protein, 5 aa, Entamoeba dispar
SPNDK

SEQ ID NO: 2462408 - protein, 6 aa, Entamoeba dispar
SPNEDD

SEQ ID NO: 2462409 - protein, 9 aa, Entamoeba dispar
SPNEDNSIE

SEQ ID NO: 2462410 - protein, 8 aa, Entamoeba dispar
SPNEEKWN

SEQ ID NO: 2462411 - protein, 10 aa, Entamoeba dispar
SPNEGQEMAQ

SEQ ID NO: 2462412 - protein, 7 aa, Entamoeba dispar
SPNEKYT

SEQ ID NO: 2462413 - protein, 10 aa, Entamoeba dispar
SPNESSELSY

SEQ ID NO: 2462414 - protein, 5 aa, Entamoeba dispar
SPNGT

SEQ ID NO: 2462415 - protein, 5 aa, Entamoeba dispar
SPNHG

SEQ ID NO: 2462416 - protein, 12 aa, Entamoeba dispar
SPNHGQLEVIGK

SEQ ID NO: 2462417 - protein, 4 aa, Entamoeba dispar
SPNI

SEQ ID NO: 2462418 - protein, 5 aa, Entamoeba dispar
SPNIA

SEQ ID NO: 2462419 - protein, 4 aa, Entamoeba dispar
SPNK

SEQ ID NO: 2462420 - protein, 9 aa, Entamoeba dispar
SPNKAIRPN

SEQ ID NO: 2462421 - protein, 9 aa, Entamoeba dispar
SPNLPEAEA

SEQ ID NO: 2462422 - protein, 5 aa, Entamoeba dispar
SPNME

SEQ ID NO: 2462423 - protein, 5 aa, Entamoeba dispar
SPNNE

SEQ ID NO: 2462424 - protein, 14 aa, Entamoeba dispar
SPNNEVRKQAEQVY

SEQ ID NO: 2462425 - protein, 14 aa, Entamoeba dispar
SPNNPTGVSYTQES

SEQ ID NO: 2462426 - protein, 5 aa, Entamoeba dispar
SPNNR

SEQ ID NO: 2462427 - protein, 6 aa, Entamoeba dispar
SPNPDE

SEQ ID NO: 2462428 - protein, 5 aa, Entamoeba dispar
SPNQK

SEQ ID NO: 2462429 - protein, 8 aa, Entamoeba dispar
SPNQPFPG

SEQ ID NO: 2462430 - protein, 22 aa, Entamoeba dispar
SPNQQTTGNSTNSLQNKIPQLP

SEQ ID NO: 2462431 - protein, 7 aa, Entamoeba dispar
SPNQTLS

SEQ ID NO: 2462432 - protein, 5 aa, Entamoeba dispar
SPNSI

SEQ ID NO: 2462433 - protein, 14 aa, Entamoeba dispar
SPNSISSENNTTTI

SEQ ID NO: 2462434 - protein, 8 aa, Entamoeba dispar
SPNSTTPL

SEQ ID NO: 2462435 - protein, 5 aa, Entamoeba dispar
SPNTP

SEQ ID NO: 2462436 - protein, 15 aa, Entamoeba dispar
SPNTTSENSTTLYSP

SEQ ID NO: 2462437 - protein, 10 aa, Entamoeba dispar
SPNYRECEEK

SEQ ID NO: 2462438 - protein, 8 aa, Entamoeba dispar
SPPDRRAA

SEQ ID NO: 2462439 - protein, 5 aa, Entamoeba dispar
SPPIE

SEQ ID NO: 2462440 - protein, 6 aa, Entamoeba dispar
SPPLPS

SEQ ID NO: 2462441 - protein, 5 aa, Entamoeba dispar
SPPNV

SEQ ID NO: 2462442 - protein, 5 aa, Entamoeba dispar
SPPPK

SEQ ID NO: 2462443 - protein, 11 aa, Entamoeba dispar
SPPPKRKQQNF

SEQ ID NO: 2462444 - protein, 6 aa, Entamoeba dispar
SPPPLE

SEQ ID NO: 2462445 - protein, 6 aa, Entamoeba dispar
SPPQQC

SEQ ID NO: 2462446 - protein, 5 aa, Entamoeba dispar
SPPRV

SEQ ID NO: 2462447 - protein, 8 aa, Entamoeba dispar
SPPSSLKN

SEQ ID NO: 2462448 - protein, 6 aa, Entamoeba dispar
SPPSTC

SEQ ID NO: 2462449 - protein, 9 aa, Entamoeba dispar
SPPTGELER

SEQ ID NO: 2462450 - protein, 15 aa, Entamoeba dispar
SPPVIPTNPPIATPS

SEQ ID NO: 2462451 - protein, 11 aa, Entamoeba dispar
SPQANHSSGIG

SEQ ID NO: 2462452 - protein, 4 aa, Entamoeba dispar
SPQE

SEQ ID NO: 2462453 - protein, 22 aa, Entamoeba dispar
SPQEAIKKQSGVFSEKVNVFEK

SEQ ID NO: 2462454 - protein, 7 aa, Entamoeba dispar
SPQEREV

SEQ ID NO: 2462455 - protein, 8 aa, Entamoeba dispar
SPQKDDIK

SEQ ID NO: 2462456 - protein, 5 aa, Entamoeba dispar
SPQKI

SEQ ID NO: 2462457 - protein, 5 aa, Entamoeba dispar
SPQLN

SEQ ID NO: 2462458 - protein, 6 aa, Entamoeba dispar
SPQLPF

SEQ ID NO: 2462459 - protein, 9 aa, Entamoeba dispar
SPQNRKRRY

SEQ ID NO: 2462460 - protein, 5 aa, Entamoeba dispar
SPQNS

SEQ ID NO: 2462461 - protein, 5 aa, Entamoeba dispar
SPQNT

SEQ ID NO: 2462462 - protein, 4 aa, Entamoeba dispar
SPQQ

SEQ ID NO: 2462463 - protein, 12 aa, Entamoeba dispar
SPQQAKARGLTS

SEQ ID NO: 2462464 - protein, 14 aa, Entamoeba dispar
SPQQLEREQKKGGK

SEQ ID NO: 2462465 - protein, 16 aa, Entamoeba dispar
SPQRNSAVTQQQNSEN

SEQ ID NO: 2462466 - protein, 7 aa, Entamoeba dispar
SPQSAPV

SEQ ID NO: 2462467 - protein, 12 aa, Entamoeba dispar
SPQSKTKHSVDL

SEQ ID NO: 2462468 - protein, 6 aa, Entamoeba dispar
SPQSNS

SEQ ID NO: 2462469 - protein, 5 aa, Entamoeba dispar
SPQTG

SEQ ID NO: 2462470 - protein, 21 aa, Entamoeba dispar
SPQTMDNQYQQQYQQYPQYQN

SEQ ID NO: 2462471 - protein, 6 aa, Entamoeba dispar
SPQTNQ

SEQ ID NO: 2462472 - protein, 6 aa, Entamoeba dispar
SPQTPS

SEQ ID NO: 2462473 - protein, 13 aa, Entamoeba dispar
SPQTRSRSRSSSF

SEQ ID NO: 2462474 - protein, 4 aa, Entamoeba dispar
SPRD

SEQ ID NO: 2462475 - protein, 11 aa, Entamoeba dispar
SPREEEQTEVE

SEQ ID NO: 2462476 - protein, 32 aa, Entamoeba dispar
SPRFEDAKTKDAENEKRPAELEDLKKQWGIDD

SEQ ID NO: 2462477 - protein, 9 aa, Entamoeba dispar
SPRKHEQQK

SEQ ID NO: 2462478 - protein, 9 aa, Entamoeba dispar
SPRKSSDTC

SEQ ID NO: 2462479 - protein, 10 aa, Entamoeba dispar
SPRKTEEGRI

SEQ ID NO: 2462480 - protein, 6 aa, Entamoeba dispar
SPRLNG

SEQ ID NO: 2462481 - protein, 15 aa, Entamoeba dispar
SPRLPSKGLNTLTQK

SEQ ID NO: 2462482 - protein, 6 aa, Entamoeba dispar
SPRNYN

SEQ ID NO: 2462483 - protein, 9 aa, Entamoeba dispar
SPRPELGTD

SEQ ID NO: 2462484 - protein, 4 aa, Entamoeba dispar
SPRS

SEQ ID NO: 2462485 - protein, 18 aa, Entamoeba dispar
SPRSSSTSPRNNSPQFKK

SEQ ID NO: 2462486 - protein, 5 aa, Entamoeba dispar
SPRTI

SEQ ID NO: 2462487 - protein, 14 aa, Entamoeba dispar
SPRYDTKQKKEEAF

SEQ ID NO: 2462488 - protein, 6 aa, Entamoeba dispar
SPRYSP

SEQ ID NO: 2462489 - protein, 9 aa, Entamoeba dispar
SPSAVKDGY

SEQ ID NO: 2462490 - protein, 10 aa, Entamoeba dispar
SPSAVKSGYD

SEQ ID NO: 2462491 - protein, 4 aa, Entamoeba dispar
SPSD

SEQ ID NO: 2462492 - protein, 8 aa, Entamoeba dispar
SPSDDTRT

SEQ ID NO: 2462493 - protein, 14 aa, Entamoeba dispar
SPSDNQLSSSRATD

SEQ ID NO: 2462494 - protein, 9 aa, Entamoeba dispar
SPSDQQPKC

SEQ ID NO: 2462495 - protein, 29 aa, Entamoeba dispar
SPSDSSSSSQSSDQISPSIQSSLTNSPYS

SEQ ID NO: 2462496 - protein, 10 aa, Entamoeba dispar
SPSEEKTPEE

SEQ ID NO: 2462497 - protein, 9 aa, Entamoeba dispar
SPSEKDIKD

SEQ ID NO: 2462498 - protein, 7 aa, Entamoeba dispar
SPSENEL

SEQ ID NO: 2462499 - protein, 5 aa, Entamoeba dispar
SPSFE

SEQ ID NO: 2462500 - protein, 13 aa, Entamoeba dispar
SPSFYADKPQIST

SEQ ID NO: 2462501 - protein, 6 aa, Entamoeba dispar
SPSIAK

SEQ ID NO: 2462502 - protein, 8 aa, Entamoeba dispar
SPSIPPPS

SEQ ID NO: 2462503 - protein, 6 aa, Entamoeba dispar
SPSISR

SEQ ID NO: 2462504 - protein, 7 aa, Entamoeba dispar
SPSKDEM

SEQ ID NO: 2462505 - protein, 29 aa, Entamoeba dispar
SPSLETTDHPRSSRFSISGSSSRSKTIQV

SEQ ID NO: 2462506 - protein, 16 aa, Entamoeba dispar
SPSLLQRKGTKQPQYI

SEQ ID NO: 2462507 - protein, 18 aa, Entamoeba dispar
SPSLLTPPKVSPPDPNLP

SEQ ID NO: 2462508 - protein, 12 aa, Entamoeba dispar
SPSLNSTKRSNC

SEQ ID NO: 2462509 - protein, 13 aa, Entamoeba dispar
SPSLSSIKETSST

SEQ ID NO: 2462510 - protein, 22 aa, Entamoeba dispar
SPSMIGTSPKPRQTFTNSRKAT

SEQ ID NO: 2462511 - protein, 8 aa, Entamoeba dispar
SPSMKTVS

SEQ ID NO: 2462512 - protein, 4 aa, Entamoeba dispar
SPSN

SEQ ID NO: 2462513 - protein, 11 aa, Entamoeba dispar
SPSNKEEKGYI

SEQ ID NO: 2462514 - protein, 15 aa, Entamoeba dispar
SPSPADSISPKSSPL

SEQ ID NO: 2462515 - protein, 7 aa, Entamoeba dispar
SPSPCTS

SEQ ID NO: 2462516 - protein, 7 aa, Entamoeba dispar
SPSPESL

SEQ ID NO: 2462517 - protein, 8 aa, Entamoeba dispar
SPSPISFK

SEQ ID NO: 2462518 - protein, 7 aa, Entamoeba dispar
SPSPSLK

SEQ ID NO: 2462519 - protein, 15 aa, Entamoeba dispar
SPSPTFSRSPSPHSF

SEQ ID NO: 2462520 - protein, 9 aa, Entamoeba dispar
SPSQDDPDS

SEQ ID NO: 2462521 - protein, 7 aa, Entamoeba dispar
SPSQKQT

SEQ ID NO: 2462522 - protein, 6 aa, Entamoeba dispar
SPSQNG

SEQ ID NO: 2462523 - protein, 8 aa, Entamoeba dispar
SPSQNRTF

SEQ ID NO: 2462524 - protein, 15 aa, Entamoeba dispar
SPSQTPKLEEENKEN

SEQ ID NO: 2462525 - protein, 5 aa, Entamoeba dispar
SPSQY

SEQ ID NO: 2462526 - protein, 5 aa, Entamoeba dispar
SPSRI

SEQ ID NO: 2462527 - protein, 4 aa, Entamoeba dispar
SPSS

SEQ ID NO: 2462528 - protein, 6 aa, Entamoeba dispar
SPSSIQ

SEQ ID NO: 2462529 - protein, 5 aa, Entamoeba dispar
SPSSK

SEQ ID NO: 2462530 - protein, 14 aa, Entamoeba dispar
SPSSKSPAHAPETV

SEQ ID NO: 2462531 - protein, 9 aa, Entamoeba dispar
SPSSLEQAE

SEQ ID NO: 2462532 - protein, 4 aa, Entamoeba dispar
SPST

SEQ ID NO: 2462533 - protein, 4 aa, Entamoeba dispar
SPSV

SEQ ID NO: 2462534 - protein, 9 aa, Entamoeba dispar
SPTDDNVDN

SEQ ID NO: 2462535 - protein, 7 aa, Entamoeba dispar
SPTDENI

SEQ ID NO: 2462536 - protein, 7 aa, Entamoeba dispar
SPTDPDS

SEQ ID NO: 2462537 - protein, 5 aa, Entamoeba dispar
SPTDV

SEQ ID NO: 2462538 - protein, 4 aa, Entamoeba dispar
SPTE

SEQ ID NO: 2462539 - protein, 12 aa, Entamoeba dispar
SPTEFDDKKRNA

SEQ ID NO: 2462540 - protein, 13 aa, Entamoeba dispar
SPTEHDEINPRPH

SEQ ID NO: 2462541 - protein, 8 aa, Entamoeba dispar
SPTENTSI

SEQ ID NO: 2462542 - protein, 4 aa, Entamoeba dispar
SPTF

SEQ ID NO: 2462543 - protein, 7 aa, Entamoeba dispar
SPTGINP

SEQ ID NO: 2462544 - protein, 7 aa, Entamoeba dispar
SPTGTGK

SEQ ID NO: 2462545 - protein, 5 aa, Entamoeba dispar
SPTGY

SEQ ID NO: 2462546 - protein, 11 aa, Entamoeba dispar
SPTIEDTYNKT

SEQ ID NO: 2462547 - protein, 6 aa, Entamoeba dispar
SPTKVL

SEQ ID NO: 2462548 - protein, 40 aa, Entamoeba dispar
SPTLGNVEELSKERIQSLPTPIKTNQRLGEPKRKRSSTPI

SEQ ID NO: 2462549 - protein, 9 aa, Entamoeba dispar
SPTLNANRN

SEQ ID NO: 2462550 - protein, 9 aa, Entamoeba dispar
SPTLSSSMK

SEQ ID NO: 2462551 - protein, 10 aa, Entamoeba dispar
SPTNKSKKLD

SEQ ID NO: 2462552 - protein, 7 aa, Entamoeba dispar
SPTNQNI

SEQ ID NO: 2462553 - protein, 6 aa, Entamoeba dispar
SPTNQR

SEQ ID NO: 2462554 - protein, 43 aa, Entamoeba dispar
SPTNTNKPKPMGFSPSPVSPRKTHPQFATPSPFITSSSPRSSP

SEQ ID NO: 2462555 - protein, 5 aa, Entamoeba dispar
SPTPE

SEQ ID NO: 2462556 - protein, 8 aa, Entamoeba dispar
SPTPPTTY

SEQ ID NO: 2462557 - protein, 4 aa, Entamoeba dispar
SPTQ

SEQ ID NO: 2462558 - protein, 7 aa, Entamoeba dispar
SPTQTQI

SEQ ID NO: 2462559 - protein, 4 aa, Entamoeba dispar
SPTS

SEQ ID NO: 2462560 - protein, 5 aa, Entamoeba dispar
SPTSG

SEQ ID NO: 2462561 - protein, 4 aa, Entamoeba dispar
SPTT

SEQ ID NO: 2462562 - protein, 9 aa, Entamoeba dispar
SPTTKENRL

SEQ ID NO: 2462563 - protein, 5 aa, Entamoeba dispar
SPTTN

SEQ ID NO: 2462564 - protein, 8 aa, Entamoeba dispar
SPTTPNRD

SEQ ID NO: 2462565 - protein, 7 aa, Entamoeba dispar
SPTTPVK

SEQ ID NO: 2462566 - protein, 6 aa, Entamoeba dispar
SPTTTL

SEQ ID NO: 2462567 - protein, 6 aa, Entamoeba dispar
SPTTTV

SEQ ID NO: 2462568 - protein, 6 aa, Entamoeba dispar
SPTVDE

SEQ ID NO: 2462569 - protein, 6 aa, Entamoeba dispar
SPTVVT

SEQ ID NO: 2462570 - protein, 6 aa, Entamoeba dispar
SPVDAT

SEQ ID NO: 2462571 - protein, 13 aa, Entamoeba dispar
SPVEKDSQTESPH

SEQ ID NO: 2462572 - protein, 8 aa, Entamoeba dispar
SPVEYDDE

SEQ ID NO: 2462573 - protein, 8 aa, Entamoeba dispar
SPVGRTGM

SEQ ID NO: 2462574 - protein, 7 aa, Entamoeba dispar
SPVPDDE

SEQ ID NO: 2462575 - protein, 5 aa, Entamoeba dispar
SPVQL

SEQ ID NO: 2462576 - protein, 4 aa, Entamoeba dispar
SPVR

SEQ ID NO: 2462577 - protein, 32 aa, Entamoeba dispar
SPVSDRPSSPNNQPFKQHRPTAISRSETYNPE

SEQ ID NO: 2462578 - protein, 8 aa, Entamoeba dispar
SPYDDTNY

SEQ ID NO: 2462579 - protein, 6 aa, Entamoeba dispar
SPYDEE

SEQ ID NO: 2462580 - protein, 9 aa, Entamoeba dispar
SPYDTEIET

SEQ ID NO: 2462581 - protein, 5 aa, Entamoeba dispar
SPYFQ

SEQ ID NO: 2462582 - protein, 5 aa, Entamoeba dispar
SPYKR

SEQ ID NO: 2462583 - protein, 6 aa, Entamoeba dispar
SPYKYH

SEQ ID NO: 2462584 - protein, 6 aa, Entamoeba dispar
SPYLPS

SEQ ID NO: 2462585 - protein, 6 aa, Entamoeba dispar
SPYPQE

SEQ ID NO: 2462586 - protein, 21 aa, Entamoeba dispar
SPYQTTPQMQQQNMYSSQKYY

SEQ ID NO: 2462587 - protein, 4 aa, Entamoeba dispar
SPYS

SEQ ID NO: 2462588 - protein, 14 aa, Entamoeba dispar
SPYSEQAPSSPVKV

SEQ ID NO: 2462589 - protein, 13 aa, Entamoeba dispar
SPYSPRSTRPGFL

SEQ ID NO: 2462590 - protein, 6 aa, Entamoeba dispar
SPYTEN

SEQ ID NO: 2462591 - protein, 13 aa, Entamoeba dispar
SPYYNPNYAAKNY

SEQ ID NO: 2462592 - protein, 5 aa, Entamoeba dispar
SPYYQ

SEQ ID NO: 2462593 - protein, 19 aa, Entamoeba dispar
SQAAAQQRAGRAGRTRPGQ

SEQ ID NO: 2462594 - protein, 9 aa, Entamoeba dispar
SQANSLTIP

SEQ ID NO: 2462595 - protein, 9 aa, Entamoeba dispar
SQAPSLEPQ

SEQ ID NO: 2462596 - protein, 8 aa, Entamoeba dispar
SQAPTIET

SEQ ID NO: 2462597 - protein, 9 aa, Entamoeba dispar
SQAQQSYKT

SEQ ID NO: 2462598 - protein, 7 aa, Entamoeba dispar
SQASTST

SEQ ID NO: 2462599 - protein, 12 aa, Entamoeba dispar
SQCSDSDGEDII

SEQ ID NO: 2462600 - protein, 7 aa, Entamoeba dispar
SQDDRLR

SEQ ID NO: 2462601 - protein, 6 aa, Entamoeba dispar
SQDENI

SEQ ID NO: 2462602 - protein, 7 aa, Entamoeba dispar
SQDKPSC

SEQ ID NO: 2462603 - protein, 4 aa, Entamoeba dispar
SQDL

SEQ ID NO: 2462604 - protein, 8 aa, Entamoeba dispar
SQDNNIRS

SEQ ID NO: 2462605 - protein, 8 aa, Entamoeba dispar
SQDNSYKN

SEQ ID NO: 2462606 - protein, 8 aa, Entamoeba dispar
SQDNVTKK

SEQ ID NO: 2462607 - protein, 6 aa, Entamoeba dispar
SQDPQT

SEQ ID NO: 2462608 - protein, 11 aa, Entamoeba dispar
SQDQTGSRTVQ

SEQ ID NO: 2462609 - protein, 4 aa, Entamoeba dispar
SQDS

SEQ ID NO: 2462610 - protein, 6 aa, Entamoeba dispar
SQDVSV

SEQ ID NO: 2462611 - protein, 6 aa, Entamoeba dispar
SQEDSI

SEQ ID NO: 2462612 - protein, 4 aa, Entamoeba dispar
SQEE

SEQ ID NO: 2462613 - protein, 5 aa, Entamoeba dispar
SQEEA

SEQ ID NO: 2462614 - protein, 5 aa, Entamoeba dispar
SQEEE

SEQ ID NO: 2462615 - protein, 22 aa, Entamoeba dispar
SQEEENEKDKTSKENDSLQKSS

SEQ ID NO: 2462616 - protein, 8 aa, Entamoeba dispar
SQEEINET

SEQ ID NO: 2462617 - protein, 8 aa, Entamoeba dispar
SQEEINSM

SEQ ID NO: 2462618 - protein, 18 aa, Entamoeba dispar
SQEEKRINEDSSKDLDKI

SEQ ID NO: 2462619 - protein, 5 aa, Entamoeba dispar
SQEEV

SEQ ID NO: 2462620 - protein, 8 aa, Entamoeba dispar
SQEEVDEI

SEQ ID NO: 2462621 - protein, 5 aa, Entamoeba dispar
SQEGR

SEQ ID NO: 2462622 - protein, 13 aa, Entamoeba dispar
SQEIDEFNKNHIL

SEQ ID NO: 2462623 - protein, 12 aa, Entamoeba dispar
SQELTTTKEELK

SEQ ID NO: 2462624 - protein, 8 aa, Entamoeba dispar
SQENINKY

SEQ ID NO: 2462625 - protein, 10 aa, Entamoeba dispar
SQEPQIRSSV

SEQ ID NO: 2462626 - protein, 8 aa, Entamoeba dispar
SQEPSRSL

SEQ ID NO: 2462627 - protein, 4 aa, Entamoeba dispar
SQEQ

SEQ ID NO: 2462628 - protein, 5 aa, Entamoeba dispar
SQEQE

SEQ ID NO: 2462629 - protein, 6 aa, Entamoeba dispar
SQEQIE

SEQ ID NO: 2462630 - protein, 6 aa, Entamoeba dispar
SQERKN

SEQ ID NO: 2462631 - protein, 8 aa, Entamoeba dispar
SQERTNES

SEQ ID NO: 2462632 - protein, 4 aa, Entamoeba dispar
SQES

SEQ ID NO: 2462633 - protein, 8 aa, Entamoeba dispar
SQETAGKT

SEQ ID NO: 2462634 - protein, 10 aa, Entamoeba dispar
SQETEAQSEL

SEQ ID NO: 2462635 - protein, 8 aa, Entamoeba dispar
SQETTQTG

SEQ ID NO: 2462636 - protein, 13 aa, Entamoeba dispar
SQEVYKQESDQVT

SEQ ID NO: 2462637 - protein, 15 aa, Entamoeba dispar
SQEYSNSSLKSLQEE

SEQ ID NO: 2462638 - protein, 8 aa, Entamoeba dispar
SQEYWKQS

SEQ ID NO: 2462639 - protein, 23 aa, Entamoeba dispar
SQFNQQPTNSFRDKKSDYSQSPL

SEQ ID NO: 2462640 - protein, 11 aa, Entamoeba dispar
SQFPENKINKT

SEQ ID NO: 2462641 - protein, 6 aa, Entamoeba dispar
SQGAKK

SEQ ID NO: 2462642 - protein, 8 aa, Entamoeba dispar
SQGDPTKV

SEQ ID NO: 2462643 - protein, 5 aa, Entamoeba dispar
SQGIN

SEQ ID NO: 2462644 - protein, 4 aa, Entamoeba dispar
SQGL

SEQ ID NO: 2462645 - protein, 6 aa, Entamoeba dispar
SQGLTL

SEQ ID NO: 2462646 - protein, 9 aa, Entamoeba dispar
SQGMGNKGA

SEQ ID NO: 2462647 - protein, 12 aa, Entamoeba dispar
SQGMKTSEAARQ

SEQ ID NO: 2462648 - protein, 5 aa, Entamoeba dispar
SQGMT

SEQ ID NO: 2462649 - protein, 5 aa, Entamoeba dispar
SQGNI

SEQ ID NO: 2462650 - protein, 9 aa, Entamoeba dispar
SQGNIYESQ

SEQ ID NO: 2462651 - protein, 6 aa, Entamoeba dispar
SQGNKR

SEQ ID NO: 2462652 - protein, 40 aa, Entamoeba dispar
SQGNYEGYDEKKFEEAKRKRLEEEKKEEEEAAKRKQDAID

SEQ ID NO: 2462653 - protein, 5 aa, Entamoeba dispar
SQGQF

SEQ ID NO: 2462654 - protein, 10 aa, Entamoeba dispar
SQGRNETLKR

SEQ ID NO: 2462655 - protein, 6 aa, Entamoeba dispar
SQGRRE

SEQ ID NO: 2462656 - protein, 4 aa, Entamoeba dispar
SQGT

SEQ ID NO: 2462657 - protein, 8 aa, Entamoeba dispar
SQHDIDTN

SEQ ID NO: 2462658 - protein, 6 aa, Entamoeba dispar
SQHPNI

SEQ ID NO: 2462659 - protein, 4 aa, Entamoeba dispar
SQID

SEQ ID NO: 2462660 - protein, 11 aa, Entamoeba dispar
SQIDPEKITGY

SEQ ID NO: 2462661 - protein, 26 aa, Entamoeba dispar
SQIEDLNREKEPQKKKKQSQQKKNQI

SEQ ID NO: 2462662 - protein, 12 aa, Entamoeba dispar
SQIERENEQLKE

SEQ ID NO: 2462663 - protein, 5 aa, Entamoeba dispar
SQIEY

SEQ ID NO: 2462664 - protein, 9 aa, Entamoeba dispar
SQIGPKGMT

SEQ ID NO: 2462665 - protein, 5 aa, Entamoeba dispar
SQIKN

SEQ ID NO: 2462666 - protein, 6 aa, Entamoeba dispar
SQIKPS

SEQ ID NO: 2462667 - protein, 15 aa, Entamoeba dispar
SQIKQEGKTTLPQQI

SEQ ID NO: 2462668 - protein, 6 aa, Entamoeba dispar
SQIPGR

SEQ ID NO: 2462669 - protein, 20 aa, Entamoeba dispar
SQIRGLEETGQEKDQTITNL

SEQ ID NO: 2462670 - protein, 12 aa, Entamoeba dispar
SQIRSDKREEMT

SEQ ID NO: 2462671 - protein, 13 aa, Entamoeba dispar
SQISDLESQISDL

SEQ ID NO: 2462672 - protein, 6 aa, Entamoeba dispar
SQISSS

SEQ ID NO: 2462673 - protein, 5 aa, Entamoeba dispar
SQITN

SEQ ID NO: 2462674 - protein, 6 aa, Entamoeba dispar
SQKDGD

SEQ ID NO: 2462675 - protein, 7 aa, Entamoeba dispar
SQKEEYE

SEQ ID NO: 2462676 - protein, 6 aa, Entamoeba dispar
SQKEGI

SEQ ID NO: 2462677 - protein, 10 aa, Entamoeba dispar
SQKEGTYKEK

SEQ ID NO: 2462678 - protein, 9 aa, Entamoeba dispar
SQKEIDTRA

SEQ ID NO: 2462679 - protein, 7 aa, Entamoeba dispar
SQKEIKE

SEQ ID NO: 2462680 - protein, 8 aa, Entamoeba dispar
SQKEMNPK

SEQ ID NO: 2462681 - protein, 9 aa, Entamoeba dispar
SQKEMPSKN

SEQ ID NO: 2462682 - protein, 14 aa, Entamoeba dispar
SQKENEKKVKEKKA

SEQ ID NO: 2462683 - protein, 9 aa, Entamoeba dispar
SQKERDNTE

SEQ ID NO: 2462684 - protein, 9 aa, Entamoeba dispar
SQKESWESA

SEQ ID NO: 2462685 - protein, 13 aa, Entamoeba dispar
SQKFQTNEREEIK

SEQ ID NO: 2462686 - protein, 6 aa, Entamoeba dispar
SQKGDL

SEQ ID NO: 2462687 - protein, 10 aa, Entamoeba dispar
SQKGQSKNLT

SEQ ID NO: 2462688 - protein, 10 aa, Entamoeba dispar
SQKHKENETI

SEQ ID NO: 2462689 - protein, 20 aa, Entamoeba dispar
SQKIRTASQKLQIVNNKIIE

SEQ ID NO: 2462690 - protein, 11 aa, Entamoeba dispar
SQKKKEFNKNN

SEQ ID NO: 2462691 - protein, 16 aa, Entamoeba dispar
SQKKQIESEEHVEGNI

SEQ ID NO: 2462692 - protein, 19 aa, Entamoeba dispar
SQKKSPVSHNIGSDETEKA

SEQ ID NO: 2462693 - protein, 4 aa, Entamoeba dispar
SQKL

SEQ ID NO: 2462694 - protein, 11 aa, Entamoeba dispar
SQKLKEETRTV

SEQ ID NO: 2462695 - protein, 4 aa, Entamoeba dispar
SQKP

SEQ ID NO: 2462696 - protein, 8 aa, Entamoeba dispar
SQKPELTV

SEQ ID NO: 2462697 - protein, 9 aa, Entamoeba dispar
SQKPLSNGL

SEQ ID NO: 2462698 - protein, 8 aa, Entamoeba dispar
SQKPMTNV

SEQ ID NO: 2462699 - protein, 19 aa, Entamoeba dispar
SQKPVVSKEAPKSEGPEFS

SEQ ID NO: 2462700 - protein, 18 aa, Entamoeba dispar
SQKQGIQKIEEEKKIQRT

SEQ ID NO: 2462701 - protein, 5 aa, Entamoeba dispar
SQKRF

SEQ ID NO: 2462702 - protein, 13 aa, Entamoeba dispar
SQKRKGTKEQEAA

SEQ ID NO: 2462703 - protein, 11 aa, Entamoeba dispar
SQKSEGTTLSE

SEQ ID NO: 2462704 - protein, 14 aa, Entamoeba dispar
SQKSHNEYPEEESE

SEQ ID NO: 2462705 - protein, 7 aa, Entamoeba dispar
SQKSPEI

SEQ ID NO: 2462706 - protein, 9 aa, Entamoeba dispar
SQKTAGEKN

SEQ ID NO: 2462707 - protein, 7 aa, Entamoeba dispar
SQKTEDI

SEQ ID NO: 2462708 - protein, 8 aa, Entamoeba dispar
SQKVTSKT

SEQ ID NO: 2462709 - protein, 4 aa, Entamoeba dispar
SQLD

SEQ ID NO: 2462710 - protein, 8 aa, Entamoeba dispar
SQLEPQVN

SEQ ID NO: 2462711 - protein, 9 aa, Entamoeba dispar
SQLGNDNDL

SEQ ID NO: 2462712 - protein, 10 aa, Entamoeba dispar
SQLKPEERKR

SEQ ID NO: 2462713 - protein, 12 aa, Entamoeba dispar
SQLNEEENDSFP

SEQ ID NO: 2462714 - protein, 6 aa, Entamoeba dispar
SQLNEI

SEQ ID NO: 2462715 - protein, 12 aa, Entamoeba dispar
SQLPPKTSSTNQ

SEQ ID NO: 2462716 - protein, 6 aa, Entamoeba dispar
SQLRDT

SEQ ID NO: 2462717 - protein, 27 aa, Entamoeba dispar
SQLRGDGIKRRRSKKQIENDLPPIGYP

SEQ ID NO: 2462718 - protein, 4 aa, Entamoeba dispar
SQLS

SEQ ID NO: 2462719 - protein, 10 aa, Entamoeba dispar
SQLSKKPKDK

SEQ ID NO: 2462720 - protein, 10 aa, Entamoeba dispar
SQLSSKKKQQ

SEQ ID NO: 2462721 - protein, 4 aa, Entamoeba dispar
SQLT

SEQ ID NO: 2462722 - protein, 18 aa, Entamoeba dispar
SQLTQTTPLTLSPSFFNN

SEQ ID NO: 2462723 - protein, 13 aa, Entamoeba dispar
SQNDNADQTPDIV

SEQ ID NO: 2462724 - protein, 6 aa, Entamoeba dispar
SQNDQL

SEQ ID NO: 2462725 - protein, 7 aa, Entamoeba dispar
SQNEEIT

SEQ ID NO: 2462726 - protein, 5 aa, Entamoeba dispar
SQNEH

SEQ ID NO: 2462727 - protein, 16 aa, Entamoeba dispar
SQNEIKPTSSDNLDNQ

SEQ ID NO: 2462728 - protein, 9 aa, Entamoeba dispar
SQNEKTEIG

SEQ ID NO: 2462729 - protein, 13 aa, Entamoeba dispar
SQNESNDCASKTV

SEQ ID NO: 2462730 - protein, 8 aa, Entamoeba dispar
SQNEYGDI

SEQ ID NO: 2462731 - protein, 4 aa, Entamoeba dispar
SQNG

SEQ ID NO: 2462732 - protein, 11 aa, Entamoeba dispar
SQNGFKESTKK

SEQ ID NO: 2462733 - protein, 9 aa, Entamoeba dispar
SQNHKNQLN

SEQ ID NO: 2462734 - protein, 6 aa, Entamoeba dispar
SQNIGT

SEQ ID NO: 2462735 - protein, 4 aa, Entamoeba dispar
SQNK

SEQ ID NO: 2462736 - protein, 10 aa, Entamoeba dispar
SQNKKEFNKE

SEQ ID NO: 2462737 - protein, 5 aa, Entamoeba dispar
SQNKL

SEQ ID NO: 2462738 - protein, 8 aa, Entamoeba dispar
SQNKNEKE

SEQ ID NO: 2462739 - protein, 8 aa, Entamoeba dispar
SQNLSRTQ

SEQ ID NO: 2462740 - protein, 16 aa, Entamoeba dispar
SQNNCTISKGLNLLMI

SEQ ID NO: 2462741 - protein, 6 aa, Entamoeba dispar
SQNPDK

SEQ ID NO: 2462742 - protein, 12 aa, Entamoeba dispar
SQNPEYSTNPTL

SEQ ID NO: 2462743 - protein, 7 aa, Entamoeba dispar
SQNQENI

SEQ ID NO: 2462744 - protein, 9 aa, Entamoeba dispar
SQNQNVSEG

SEQ ID NO: 2462745 - protein, 7 aa, Entamoeba dispar
SQNQSMK

SEQ ID NO: 2462746 - protein, 6 aa, Entamoeba dispar
SQNQTI

SEQ ID NO: 2462747 - protein, 7 aa, Entamoeba dispar
SQNRGPN

SEQ ID NO: 2462748 - protein, 37 aa, Entamoeba dispar
SQNRNLRNRTSTSSRSRSRDRNRYSGISESDSQFQND

SEQ ID NO: 2462749 - protein, 7 aa, Entamoeba dispar
SQNSKLT

SEQ ID NO: 2462750 - protein, 10 aa, Entamoeba dispar
SQNSLNLPTT

SEQ ID NO: 2462751 - protein, 6 aa, Entamoeba dispar
SQNSLR

SEQ ID NO: 2462752 - protein, 11 aa, Entamoeba dispar
SQNSNSKLIES

SEQ ID NO: 2462753 - protein, 6 aa, Entamoeba dispar
SQNSQI

SEQ ID NO: 2462754 - protein, 9 aa, Entamoeba dispar
SQNTEENLT

SEQ ID NO: 2462755 - protein, 8 aa, Entamoeba dispar
SQNTSPVS

SEQ ID NO: 2462756 - protein, 15 aa, Entamoeba dispar
SQNTSSQNTTQITAT

SEQ ID NO: 2462757 - protein, 12 aa, Entamoeba dispar
SQNTTKSLPEGI

SEQ ID NO: 2462758 - protein, 7 aa, Entamoeba dispar
SQNYDTK

SEQ ID NO: 2462759 - protein, 22 aa, Entamoeba dispar
SQPATIPLEGYSSTNKEDNKGV

SEQ ID NO: 2462760 - protein, 16 aa, Entamoeba dispar
SQPDDEDYDNTRSEEE

SEQ ID NO: 2462761 - protein, 16 aa, Entamoeba dispar
SQPDEDDDNIRSEKEI

SEQ ID NO: 2462762 - protein, 15 aa, Entamoeba dispar
SQPDEDDDNTISEEE

SEQ ID NO: 2462763 - protein, 16 aa, Entamoeba dispar
SQPDEDEDNSRTDKEV

SEQ ID NO: 2462764 - protein, 17 aa, Entamoeba dispar
SQPDEDYYDNTRSEEEI

SEQ ID NO: 2462765 - protein, 16 aa, Entamoeba dispar
SQPDEESDNIRSDNEI

SEQ ID NO: 2462766 - protein, 15 aa, Entamoeba dispar
SQPEEDNDNTRSEEE

SEQ ID NO: 2462767 - protein, 15 aa, Entamoeba dispar
SQPEEDYDNTRTEEE

SEQ ID NO: 2462768 - protein, 25 aa, Entamoeba dispar
SQPEEEDYNTKSEEDDDNTRSEKEI

SEQ ID NO: 2462769 - protein, 17 aa, Entamoeba dispar
SQPEEGEDNSRSEKGIE

SEQ ID NO: 2462770 - protein, 15 aa, Entamoeba dispar
SQPEEGEDNTRSEAE

SEQ ID NO: 2462771 - protein, 19 aa, Entamoeba dispar
SQPEEGEDNTRSEAEIKKF

SEQ ID NO: 2462772 - protein, 11 aa, Entamoeba dispar
SQPEEKQTQPI

SEQ ID NO: 2462773 - protein, 16 aa, Entamoeba dispar
SQPEGEDNSRSKEEIE

SEQ ID NO: 2462774 - protein, 15 aa, Entamoeba dispar
SQPEGGEDNTRSEAE

SEQ ID NO: 2462775 - protein, 23 aa, Entamoeba dispar
SQPENSNPNEKKYDQTREDEWDD

SEQ ID NO: 2462776 - protein, 6 aa, Entamoeba dispar
SQPHFP

SEQ ID NO: 2462777 - protein, 4 aa, Entamoeba dispar
SQPI

SEQ ID NO: 2462778 - protein, 21 aa, Entamoeba dispar
SQPKVKDEDHKERKEIEEHKV

SEQ ID NO: 2462779 - protein, 7 aa, Entamoeba dispar
SQPLSSS

SEQ ID NO: 2462780 - protein, 21 aa, Entamoeba dispar
SQPMTSIPSPIPKQRISSTFV

SEQ ID NO: 2462781 - protein, 30 aa, Entamoeba dispar
SQPNKEEKGQCITTSQHNVPQRKDKTEQKK

SEQ ID NO: 2462782 - protein, 7 aa, Entamoeba dispar
SQPPEGL

SEQ ID NO: 2462783 - protein, 28 aa, Entamoeba dispar
SQPPPPPPPPAPDKSMQQVANPHEDKKT

SEQ ID NO: 2462784 - protein, 16 aa, Entamoeba dispar
SQPPSTRTPFLKRRKQ

SEQ ID NO: 2462785 - protein, 7 aa, Entamoeba dispar
SQPQQTM

SEQ ID NO: 2462786 - protein, 6 aa, Entamoeba dispar
SQPQYL

SEQ ID NO: 2462787 - protein, 6 aa, Entamoeba dispar
SQPRLP

SEQ ID NO: 2462788 - protein, 7 aa, Entamoeba dispar
SQPSEKD

SEQ ID NO: 2462789 - protein, 5 aa, Entamoeba dispar
SQPSS

SEQ ID NO: 2462790 - protein, 7 aa, Entamoeba dispar
SQPTHDG

SEQ ID NO: 2462791 - protein, 6 aa, Entamoeba dispar
SQPTKE

SEQ ID NO: 2462792 - protein, 4 aa, Entamoeba dispar
SQPV

SEQ ID NO: 2462793 - protein, 16 aa, Entamoeba dispar
SQPVNKQNKGDEKKDI

SEQ ID NO: 2462794 - protein, 5 aa, Entamoeba dispar
SQQCP

SEQ ID NO: 2462795 - protein, 23 aa, Entamoeba dispar
SQQEDLTNTDPYYDNETNNEVYP

SEQ ID NO: 2462796 - protein, 8 aa, Entamoeba dispar
SQQEHYEE

SEQ ID NO: 2462797 - protein, 7 aa, Entamoeba dispar
SQQGGMD

SEQ ID NO: 2462798 - protein, 9 aa, Entamoeba dispar
SQQGQTVKS

SEQ ID NO: 2462799 - protein, 8 aa, Entamoeba dispar
SQQKIPEQ

SEQ ID NO: 2462800 - protein, 6 aa, Entamoeba dispar
SQQKNR

SEQ ID NO: 2462801 - protein, 10 aa, Entamoeba dispar
SQQKYDEEQV

SEQ ID NO: 2462802 - protein, 5 aa, Entamoeba dispar
SQQLN

SEQ ID NO: 2462803 - protein, 7 aa, Entamoeba dispar
SQQNDQQ

SEQ ID NO: 2462804 - protein, 6 aa, Entamoeba dispar
SQQNSA

SEQ ID NO: 2462805 - protein, 6 aa, Entamoeba dispar
SQQPIR

SEQ ID NO: 2462806 - protein, 33 aa, Entamoeba dispar
SQQPNQKEKNESDKEGADSTTEDITQSYDYSSI

SEQ ID NO: 2462807 - protein, 10 aa, Entamoeba dispar
SQQPQNYNEE

SEQ ID NO: 2462808 - protein, 15 aa, Entamoeba dispar
SQQPSTLGEEIESTS

SEQ ID NO: 2462809 - protein, 4 aa, Entamoeba dispar
SQQQ

SEQ ID NO: 2462810 - protein, 8 aa, Entamoeba dispar
SQQQNMGL

SEQ ID NO: 2462811 - protein, 7 aa, Entamoeba dispar
SQQQQLP

SEQ ID NO: 2462812 - protein, 6 aa, Entamoeba dispar
SQQQQP

SEQ ID NO: 2462813 - protein, 7 aa, Entamoeba dispar
SQQQYHQ

SEQ ID NO: 2462814 - protein, 4 aa, Entamoeba dispar
SQQR

SEQ ID NO: 2462815 - protein, 10 aa, Entamoeba dispar
SQQRGPKCAR

SEQ ID NO: 2462816 - protein, 6 aa, Entamoeba dispar
SQQRPI

SEQ ID NO: 2462817 - protein, 7 aa, Entamoeba dispar
SQQRSPK

SEQ ID NO: 2462818 - protein, 4 aa, Entamoeba dispar
SQQS

SEQ ID NO: 2462819 - protein, 6 aa, Entamoeba dispar
SQQSNG

SEQ ID NO: 2462820 - protein, 9 aa, Entamoeba dispar
SQQSQGNAQ

SEQ ID NO: 2462821 - protein, 5 aa, Entamoeba dispar
SQQSR

SEQ ID NO: 2462822 - protein, 9 aa, Entamoeba dispar
SQQSSINPL

SEQ ID NO: 2462823 - protein, 11 aa, Entamoeba dispar
SQQTQKLKQEI

SEQ ID NO: 2462824 - protein, 8 aa, Entamoeba dispar
SQQTTKEK

SEQ ID NO: 2462825 - protein, 4 aa, Entamoeba dispar
SQQY

SEQ ID NO: 2462826 - protein, 18 aa, Entamoeba dispar
SQQYEPTPYKKVEAEPVA

SEQ ID NO: 2462827 - protein, 19 aa, Entamoeba dispar
SQQYQNDTKLSTKISNTNI

SEQ ID NO: 2462828 - protein, 9 aa, Entamoeba dispar
SQREEKYSD

SEQ ID NO: 2462829 - protein, 10 aa, Entamoeba dispar
SQRGDINGEY

SEQ ID NO: 2462830 - protein, 20 aa, Entamoeba dispar
SQRKQSSTAKRQEMSQNDGL

SEQ ID NO: 2462831 - protein, 8 aa, Entamoeba dispar
SQRLAERY

SEQ ID NO: 2462832 - protein, 8 aa, Entamoeba dispar
SQRLNNPS

SEQ ID NO: 2462833 - protein, 7 aa, Entamoeba dispar
SQRPDSK

SEQ ID NO: 2462834 - protein, 5 aa, Entamoeba dispar
SQRPF

SEQ ID NO: 2462835 - protein, 7 aa, Entamoeba dispar
SQRVGSS

SEQ ID NO: 2462836 - protein, 6 aa, Entamoeba dispar
SQRYDE

SEQ ID NO: 2462837 - protein, 9 aa, Entamoeba dispar
SQSAGKSSV

SEQ ID NO: 2462838 - protein, 4 aa, Entamoeba dispar
SQSD

SEQ ID NO: 2462839 - protein, 11 aa, Entamoeba dispar
SQSDGTIPKEE

SEQ ID NO: 2462840 - protein, 6 aa, Entamoeba dispar
SQSDIK

SEQ ID NO: 2462841 - protein, 16 aa, Entamoeba dispar
SQSDYSYSAPQKYIDE

SEQ ID NO: 2462842 - protein, 8 aa, Entamoeba dispar
SQSEESLK

SEQ ID NO: 2462843 - protein, 6 aa, Entamoeba dispar
SQSKEE

SEQ ID NO: 2462844 - protein, 7 aa, Entamoeba dispar
SQSKMQN

SEQ ID NO: 2462845 - protein, 6 aa, Entamoeba dispar
SQSMET

SEQ ID NO: 2462846 - protein, 4 aa, Entamoeba dispar
SQSN

SEQ ID NO: 2462847 - protein, 11 aa, Entamoeba dispar
SQSNPGDEEGI

SEQ ID NO: 2462848 - protein, 11 aa, Entamoeba dispar
SQSNPSKDKDN

SEQ ID NO: 2462849 - protein, 5 aa, Entamoeba dispar
SQSPD

SEQ ID NO: 2462850 - protein, 5 aa, Entamoeba dispar
SQSPL

SEQ ID NO: 2462851 - protein, 6 aa, Entamoeba dispar
SQSPRR

SEQ ID NO: 2462852 - protein, 13 aa, Entamoeba dispar
SQSQDSEIGDGTT

SEQ ID NO: 2462853 - protein, 6 aa, Entamoeba dispar
SQSQGS

SEQ ID NO: 2462854 - protein, 31 aa, Entamoeba dispar
SQSRDSSKSIASRRLSPQHSPCYSPPQKRLT

SEQ ID NO: 2462855 - protein, 8 aa, Entamoeba dispar
SQSSEPFQ

SEQ ID NO: 2462856 - protein, 11 aa, Entamoeba dispar
SQSSPERKKRI

SEQ ID NO: 2462857 - protein, 5 aa, Entamoeba dispar
SQSTI

SEQ ID NO: 2462858 - protein, 13 aa, Entamoeba dispar
SQSTISTSSKLEQ

SEQ ID NO: 2462859 - protein, 39 aa, Entamoeba dispar
SQSTKSTMSSSSSVRSNEKEKLQQVETPVSQEPTPSPRP

SEQ ID NO: 2462860 - protein, 5 aa, Entamoeba dispar
SQSTS

SEQ ID NO: 2462861 - protein, 8 aa, Entamoeba dispar
SQSTSESQ

SEQ ID NO: 2462862 - protein, 4 aa, Entamoeba dispar
SQSY

SEQ ID NO: 2462863 - protein, 20 aa, Entamoeba dispar
SQTAGKHPGIPQGKPTMNQI

SEQ ID NO: 2462864 - protein, 4 aa, Entamoeba dispar
SQTE

SEQ ID NO: 2462865 - protein, 10 aa, Entamoeba dispar
SQTGKPCSKN

SEQ ID NO: 2462866 - protein, 7 aa, Entamoeba dispar
SQTGVGV

SEQ ID NO: 2462867 - protein, 5 aa, Entamoeba dispar
SQTIN

SEQ ID NO: 2462868 - protein, 7 aa, Entamoeba dispar
SQTISSP

SEQ ID NO: 2462869 - protein, 6 aa, Entamoeba dispar
SQTIYG

SEQ ID NO: 2462870 - protein, 12 aa, Entamoeba dispar
SQTKEDKWDTNV

SEQ ID NO: 2462871 - protein, 19 aa, Entamoeba dispar
SQTKKRYATVTEKRQLQQK

SEQ ID NO: 2462872 - protein, 10 aa, Entamoeba dispar
SQTKNKSNKI

SEQ ID NO: 2462873 - protein, 10 aa, Entamoeba dispar
SQTKQNQSHD

SEQ ID NO: 2462874 - protein, 7 aa, Entamoeba dispar
SQTKRLE

SEQ ID NO: 2462875 - protein, 7 aa, Entamoeba dispar
SQTNGDN

SEQ ID NO: 2462876 - protein, 7 aa, Entamoeba dispar
SQTNQSW

SEQ ID NO: 2462877 - protein, 10 aa, Entamoeba dispar
SQTPEEKYQE

SEQ ID NO: 2462878 - protein, 8 aa, Entamoeba dispar
SQTPGRYN

SEQ ID NO: 2462879 - protein, 15 aa, Entamoeba dispar
SQTQLGSSLKKSNPY

SEQ ID NO: 2462880 - protein, 15 aa, Entamoeba dispar
SQTQNDDQIEDIDQY

SEQ ID NO: 2462881 - protein, 7 aa, Entamoeba dispar
SQTQNID

SEQ ID NO: 2462882 - protein, 25 aa, Entamoeba dispar
SQTQYQNMENNSFSGDNQETKQTPF

SEQ ID NO: 2462883 - protein, 14 aa, Entamoeba dispar
SQTSDPVQRTRDSF

SEQ ID NO: 2462884 - protein, 8 aa, Entamoeba dispar
SQTTARKY

SEQ ID NO: 2462885 - protein, 24 aa, Entamoeba dispar
SQTTESEQSYNDNNKIKNEIKQED

SEQ ID NO: 2462886 - protein, 4 aa, Entamoeba dispar
SQVN

SEQ ID NO: 2462887 - protein, 7 aa, Entamoeba dispar
SQVNQNQ

SEQ ID NO: 2462888 - protein, 9 aa, Entamoeba dispar
SQVPPDERK

SEQ ID NO: 2462889 - protein, 4 aa, Entamoeba dispar
SQVQ

SEQ ID NO: 2462890 - protein, 6 aa, Entamoeba dispar
SQVSKH

SEQ ID NO: 2462891 - protein, 10 aa, Entamoeba dispar
SQVSPENEEE

SEQ ID NO: 2462892 - protein, 5 aa, Entamoeba dispar
SQVTK

SEQ ID NO: 2462893 - protein, 27 aa, Entamoeba dispar
SQVTSTSSPIDKMKSQTLKRSSRLSLI

SEQ ID NO: 2462894 - protein, 6 aa, Entamoeba dispar
SQYDKK

SEQ ID NO: 2462895 - protein, 4 aa, Entamoeba dispar
SQYE

SEQ ID NO: 2462896 - protein, 5 aa, Entamoeba dispar
SQYGA

SEQ ID NO: 2462897 - protein, 14 aa, Entamoeba dispar
SQYGTTSCGTTQYA

SEQ ID NO: 2462898 - protein, 12 aa, Entamoeba dispar
SQYKEGCTTDVT

SEQ ID NO: 2462899 - protein, 5 aa, Entamoeba dispar
SQYNQ

SEQ ID NO: 2462900 - protein, 5 aa, Entamoeba dispar
SQYNS

SEQ ID NO: 2462901 - protein, 6 aa, Entamoeba dispar
SQYPFN

SEQ ID NO: 2462902 - protein, 15 aa, Entamoeba dispar
SQYSNYNPKKATVTE

SEQ ID NO: 2462903 - protein, 8 aa, Entamoeba dispar
SQYYRETQ

SEQ ID NO: 2462904 - protein, 10 aa, Entamoeba dispar
SRAALSNYST

SEQ ID NO: 2462905 - protein, 4 aa, Entamoeba dispar
SRAD

SEQ ID NO: 2462906 - protein, 6 aa, Entamoeba dispar
SRASRY

SEQ ID NO: 2462907 - protein, 7 aa, Entamoeba dispar
SRATRGA

SEQ ID NO: 2462908 - protein, 7 aa, Entamoeba dispar
SRATVGP

SEQ ID NO: 2462909 - protein, 6 aa, Entamoeba dispar
SRCKQH

SEQ ID NO: 2462910 - protein, 4 aa, Entamoeba dispar
SRCS

SEQ ID NO: 2462911 - protein, 16 aa, Entamoeba dispar
SRCSATESRQIFIPVF

SEQ ID NO: 2462912 - protein, 14 aa, Entamoeba dispar
SRDCKRSGQGETDV

SEQ ID NO: 2462913 - protein, 5 aa, Entamoeba dispar
SRDEE

SEQ ID NO: 2462914 - protein, 12 aa, Entamoeba dispar
SRDELSSGVPTR

SEQ ID NO: 2462915 - protein, 5 aa, Entamoeba dispar
SRDGL

SEQ ID NO: 2462916 - protein, 11 aa, Entamoeba dispar
SRDGRAKSNKI

SEQ ID NO: 2462917 - protein, 10 aa, Entamoeba dispar
SRDKKSVYSV

SEQ ID NO: 2462918 - protein, 9 aa, Entamoeba dispar
SRDMKSDDL

SEQ ID NO: 2462919 - protein, 6 aa, Entamoeba dispar
SRDNGC

SEQ ID NO: 2462920 - protein, 33 aa, Entamoeba dispar
SRDPKKQIKHKENKTPKSSVLNNSPTPRRSSSV

SEQ ID NO: 2462921 - protein, 6 aa, Entamoeba dispar
SRDPQN

SEQ ID NO: 2462922 - protein, 6 aa, Entamoeba dispar
SRDPSL

SEQ ID NO: 2462923 - protein, 5 aa, Entamoeba dispar
SRDSN

SEQ ID NO: 2462924 - protein, 7 aa, Entamoeba dispar
SRDTYKN

SEQ ID NO: 2462925 - protein, 17 aa, Entamoeba dispar
SREDDEITKLIKHFQTF

SEQ ID NO: 2462926 - protein, 17 aa, Entamoeba dispar
SREDEKELIGEKPRKAR

SEQ ID NO: 2462927 - protein, 6 aa, Entamoeba dispar
SREDEL

SEQ ID NO: 2462928 - protein, 6 aa, Entamoeba dispar
SREDKL

SEQ ID NO: 2462929 - protein, 5 aa, Entamoeba dispar
SREED

SEQ ID NO: 2462930 - protein, 11 aa, Entamoeba dispar
SREFRNAQTIQ

SEQ ID NO: 2462931 - protein, 6 aa, Entamoeba dispar
SREGTL

SEQ ID NO: 2462932 - protein, 5 aa, Entamoeba dispar
SREIE

SEQ ID NO: 2462933 - protein, 6 aa, Entamoeba dispar
SRENEQ

SEQ ID NO: 2462934 - protein, 17 aa, Entamoeba dispar
SRENGETAKLIKHFQSF

SEQ ID NO: 2462935 - protein, 23 aa, Entamoeba dispar
SRENKINISDDNESTNKKRKCLL

SEQ ID NO: 2462936 - protein, 12 aa, Entamoeba dispar
SRENPKNERANI

SEQ ID NO: 2462937 - protein, 19 aa, Entamoeba dispar
SRENSSKSFLTKQQQSSSL

SEQ ID NO: 2462938 - protein, 12 aa, Entamoeba dispar
SRERDSYDDDSD

SEQ ID NO: 2462939 - protein, 5 aa, Entamoeba dispar
SRESF

SEQ ID NO: 2462940 - protein, 6 aa, Entamoeba dispar
SRESRL

SEQ ID NO: 2462941 - protein, 8 aa, Entamoeba dispar
SRESSTGS

SEQ ID NO: 2462942 - protein, 4 aa, Entamoeba dispar
SRET

SEQ ID NO: 2462943 - protein, 10 aa, Entamoeba dispar
SRETPKDDED

SEQ ID NO: 2462944 - protein, 7 aa, Entamoeba dispar
SRETRNF

SEQ ID NO: 2462945 - protein, 6 aa, Entamoeba dispar
SREVNP

SEQ ID NO: 2462946 - protein, 8 aa, Entamoeba dispar
SRFDEDNE

SEQ ID NO: 2462947 - protein, 7 aa, Entamoeba dispar
SRFGTPD

SEQ ID NO: 2462948 - protein, 18 aa, Entamoeba dispar
SRGFSGEMKGETTKTEMA

SEQ ID NO: 2462949 - protein, 9 aa, Entamoeba dispar
SRGKKEVDI

SEQ ID NO: 2462950 - protein, 7 aa, Entamoeba dispar
SRGKLPS

SEQ ID NO: 2462951 - protein, 5 aa, Entamoeba dispar
SRGKV

SEQ ID NO: 2462952 - protein, 4 aa, Entamoeba dispar
SRGN

SEQ ID NO: 2462953 - protein, 8 aa, Entamoeba dispar
SRGNEKYM

SEQ ID NO: 2462954 - protein, 7 aa, Entamoeba dispar
SRGRAGV

SEQ ID NO: 2462955 - protein, 5 aa, Entamoeba dispar
SRGRW

SEQ ID NO: 2462956 - protein, 8 aa, Entamoeba dispar
SRGSTKNL

SEQ ID NO: 2462957 - protein, 6 aa, Entamoeba dispar
SRGVKG

SEQ ID NO: 2462958 - protein, 7 aa, Entamoeba dispar
SRGVKGE

SEQ ID NO: 2462959 - protein, 6 aa, Entamoeba dispar
SRGWLD

SEQ ID NO: 2462960 - protein, 6 aa, Entamoeba dispar
SRHKRD

SEQ ID NO: 2462961 - protein, 21 aa, Entamoeba dispar
SRHNSKSRGSSKDREADPEAY

SEQ ID NO: 2462962 - protein, 11 aa, Entamoeba dispar
SRIDGLEGGNV

SEQ ID NO: 2462963 - protein, 7 aa, Entamoeba dispar
SRIEQYN

SEQ ID NO: 2462964 - protein, 6 aa, Entamoeba dispar
SRIGNS

SEQ ID NO: 2462965 - protein, 7 aa, Entamoeba dispar
SRIGSSI

SEQ ID NO: 2462966 - protein, 12 aa, Entamoeba dispar
SRINRKSTSLPR

SEQ ID NO: 2462967 - protein, 8 aa, Entamoeba dispar
SRIQSSAN

SEQ ID NO: 2462968 - protein, 14 aa, Entamoeba dispar
SRIRSDIEKHREEK

SEQ ID NO: 2462969 - protein, 5 aa, Entamoeba dispar
SRISG

SEQ ID NO: 2462970 - protein, 5 aa, Entamoeba dispar
SRIST

SEQ ID NO: 2462971 - protein, 4 aa, Entamoeba dispar
SRIT

SEQ ID NO: 2462972 - protein, 6 aa, Entamoeba dispar
SRKALS

SEQ ID NO: 2462973 - protein, 13 aa, Entamoeba dispar
SRKDNNPANARLT

SEQ ID NO: 2462974 - protein, 6 aa, Entamoeba dispar
SRKEVE

SEQ ID NO: 2462975 - protein, 7 aa, Entamoeba dispar
SRKEYAD

SEQ ID NO: 2462976 - protein, 22 aa, Entamoeba dispar
SRKGNGNHNRSHSRLSDRQTQY

SEQ ID NO: 2462977 - protein, 8 aa, Entamoeba dispar
SRKKASER

SEQ ID NO: 2462978 - protein, 8 aa, Entamoeba dispar
SRKKPLNQ

SEQ ID NO: 2462979 - protein, 6 aa, Entamoeba dispar
SRKKRK

SEQ ID NO: 2462980 - protein, 9 aa, Entamoeba dispar
SRKNEQQQE

SEQ ID NO: 2462981 - protein, 11 aa, Entamoeba dispar
SRKPPSSKISD

SEQ ID NO: 2462982 - protein, 12 aa, Entamoeba dispar
SRKQKSSFKIDP

SEQ ID NO: 2462983 - protein, 8 aa, Entamoeba dispar
SRKQKTSK

SEQ ID NO: 2462984 - protein, 18 aa, Entamoeba dispar
SRKRYKQTRLTRVGKEEV

SEQ ID NO: 2462985 - protein, 7 aa, Entamoeba dispar
SRKSIAE

SEQ ID NO: 2462986 - protein, 8 aa, Entamoeba dispar
SRKSIEQI

SEQ ID NO: 2462987 - protein, 8 aa, Entamoeba dispar
SRKSIPST

SEQ ID NO: 2462988 - protein, 11 aa, Entamoeba dispar
SRKSKSQTSVE

SEQ ID NO: 2462989 - protein, 9 aa, Entamoeba dispar
SRKSNEEDL

SEQ ID NO: 2462990 - protein, 6 aa, Entamoeba dispar
SRKSNF

SEQ ID NO: 2462991 - protein, 5 aa, Entamoeba dispar
SRKTA

SEQ ID NO: 2462992 - protein, 6 aa, Entamoeba dispar
SRKTIE

SEQ ID NO: 2462993 - protein, 6 aa, Entamoeba dispar
SRKTVN

SEQ ID NO: 2462994 - protein, 9 aa, Entamoeba dispar
SRKYYTNTR

SEQ ID NO: 2462995 - protein, 21 aa, Entamoeba dispar
SRLKKNNKMSSNDSKLEPSNL

SEQ ID NO: 2462996 - protein, 10 aa, Entamoeba dispar
SRLNDANETI

SEQ ID NO: 2462997 - protein, 10 aa, Entamoeba dispar
SRLNDQQKID

SEQ ID NO: 2462998 - protein, 7 aa, Entamoeba dispar
SRLNEKS

SEQ ID NO: 2462999 - protein, 34 aa, Entamoeba dispar
SRLPPTTIQPPLQPSLQPSIPRTIAPPAPSSSMS

SEQ ID NO: 2463000 - protein, 30 aa, Entamoeba dispar
SRLSENNRLSYKSRPLPQLPVKPDTSKPEI

SEQ ID NO: 2463001 - protein, 19 aa, Entamoeba dispar
SRLSTDSNNSEGSETSETY

SEQ ID NO: 2463002 - protein, 6 aa, Entamoeba dispar
SRNAER

SEQ ID NO: 2463003 - protein, 10 aa, Entamoeba dispar
SRNASDKKAI

SEQ ID NO: 2463004 - protein, 14 aa, Entamoeba dispar
SRNDNHLESSGDLS

SEQ ID NO: 2463005 - protein, 4 aa, Entamoeba dispar
SRNE

SEQ ID NO: 2463006 - protein, 12 aa, Entamoeba dispar
SRNEAKKEAKKV

SEQ ID NO: 2463007 - protein, 19 aa, Entamoeba dispar
SRNEEKNNNNNNNNNNNNN

SEQ ID NO: 2463008 - protein, 9 aa, Entamoeba dispar
SRNEKGEID

SEQ ID NO: 2463009 - protein, 8 aa, Entamoeba dispar
SRNELNQK

SEQ ID NO: 2463010 - protein, 9 aa, Entamoeba dispar
SRNENADNV

SEQ ID NO: 2463011 - protein, 7 aa, Entamoeba dispar
SRNGNSE

SEQ ID NO: 2463012 - protein, 7 aa, Entamoeba dispar
SRNGTYI

SEQ ID NO: 2463013 - protein, 11 aa, Entamoeba dispar
SRNHQTDEHLN

SEQ ID NO: 2463014 - protein, 12 aa, Entamoeba dispar
SRNKKTAWNKQK

SEQ ID NO: 2463015 - protein, 15 aa, Entamoeba dispar
SRNKVKNGNSYERTC

SEQ ID NO: 2463016 - protein, 4 aa, Entamoeba dispar
SRNL

SEQ ID NO: 2463017 - protein, 5 aa, Entamoeba dispar
SRNNR

SEQ ID NO: 2463018 - protein, 8 aa, Entamoeba dispar
SRNQKGTR

SEQ ID NO: 2463019 - protein, 8 aa, Entamoeba dispar
SRNREGSC

SEQ ID NO: 2463020 - protein, 10 aa, Entamoeba dispar
SRNRPLEYGP

SEQ ID NO: 2463021 - protein, 7 aa, Entamoeba dispar
SRNSGSL

SEQ ID NO: 2463022 - protein, 4 aa, Entamoeba dispar
SRNY

SEQ ID NO: 2463023 - protein, 5 aa, Entamoeba dispar
SRNYY

SEQ ID NO: 2463024 - protein, 15 aa, Entamoeba dispar
SRPDDDEIDNTRSED

SEQ ID NO: 2463025 - protein, 8 aa, Entamoeba dispar
SRPKTNAV

SEQ ID NO: 2463026 - protein, 16 aa, Entamoeba dispar
SRPQDRKRRDHYRSSY

SEQ ID NO: 2463027 - protein, 9 aa, Entamoeba dispar
SRPSPPPIS

SEQ ID NO: 2463028 - protein, 4 aa, Entamoeba dispar
SRPT

SEQ ID NO: 2463029 - protein, 9 aa, Entamoeba dispar
SRPTTCQNS

SEQ ID NO: 2463030 - protein, 7 aa, Entamoeba dispar
SRQDEFT

SEQ ID NO: 2463031 - protein, 17 aa, Entamoeba dispar
SRQEEQSSILITKVLDK

SEQ ID NO: 2463032 - protein, 4 aa, Entamoeba dispar
SRQI

SEQ ID NO: 2463033 - protein, 6 aa, Entamoeba dispar
SRQNGG

SEQ ID NO: 2463034 - protein, 9 aa, Entamoeba dispar
SRQNNSSKE

SEQ ID NO: 2463035 - protein, 6 aa, Entamoeba dispar
SRQNSI

SEQ ID NO: 2463036 - protein, 8 aa, Entamoeba dispar
SRQRATIN

SEQ ID NO: 2463037 - protein, 7 aa, Entamoeba dispar
SRQSLTT

SEQ ID NO: 2463038 - protein, 4 aa, Entamoeba dispar
SRQT

SEQ ID NO: 2463039 - protein, 6 aa, Entamoeba dispar
SRQTDV

SEQ ID NO: 2463040 - protein, 17 aa, Entamoeba dispar
SRQVDQLKQRSKPSLTL

SEQ ID NO: 2463041 - protein, 7 aa, Entamoeba dispar
SRQYDDL

SEQ ID NO: 2463042 - protein, 5 aa, Entamoeba dispar
SRQYP

SEQ ID NO: 2463043 - protein, 9 aa, Entamoeba dispar
SRRDENTLE

SEQ ID NO: 2463044 - protein, 6 aa, Entamoeba dispar
SRRERI

SEQ ID NO: 2463045 - protein, 5 aa, Entamoeba dispar
SRRGI

SEQ ID NO: 2463046 - protein, 7 aa, Entamoeba dispar
SRRNNKI

SEQ ID NO: 2463047 - protein, 48 aa, Entamoeba dispar
SRRSETQNQTNEHGSTTSHEVSGDETKNEQKQSSSQTSEPTEKETHKK

SEQ ID NO: 2463048 - protein, 13 aa, Entamoeba dispar
SRRSNHCCSCCVI

SEQ ID NO: 2463049 - protein, 14 aa, Entamoeba dispar
SRRSPSSVLPPRQL

SEQ ID NO: 2463050 - protein, 5 aa, Entamoeba dispar
SRRSV

SEQ ID NO: 2463051 - protein, 6 aa, Entamoeba dispar
SRRTKR

SEQ ID NO: 2463052 - protein, 5 aa, Entamoeba dispar
SRRTT

SEQ ID NO: 2463053 - protein, 15 aa, Entamoeba dispar
SRRYEGFSSSLGEQM

SEQ ID NO: 2463054 - protein, 4 aa, Entamoeba dispar
SRSA

SEQ ID NO: 2463055 - protein, 5 aa, Entamoeba dispar
SRSAE

SEQ ID NO: 2463056 - protein, 5 aa, Entamoeba dispar
SRSAS

SEQ ID NO: 2463057 - protein, 5 aa, Entamoeba dispar
SRSAT

SEQ ID NO: 2463058 - protein, 13 aa, Entamoeba dispar
SRSDIRKDEYIYI

SEQ ID NO: 2463059 - protein, 28 aa, Entamoeba dispar
SRSDSPSLSSSNGNSSATDTISDNEDTF

SEQ ID NO: 2463060 - protein, 9 aa, Entamoeba dispar
SRSERKIPT

SEQ ID NO: 2463061 - protein, 5 aa, Entamoeba dispar
SRSFQ

SEQ ID NO: 2463062 - protein, 6 aa, Entamoeba dispar
SRSFQR

SEQ ID NO: 2463063 - protein, 16 aa, Entamoeba dispar
SRSIGSIHNDSKIPGV

SEQ ID NO: 2463064 - protein, 11 aa, Entamoeba dispar
SRSKQNGIGEY

SEQ ID NO: 2463065 - protein, 4 aa, Entamoeba dispar
SRSL

SEQ ID NO: 2463066 - protein, 17 aa, Entamoeba dispar
SRSLGDKQYKGGRGAVI

SEQ ID NO: 2463067 - protein, 4 aa, Entamoeba dispar
SRSN

SEQ ID NO: 2463068 - protein, 13 aa, Entamoeba dispar
SRSNDIDQINTSQ

SEQ ID NO: 2463069 - protein, 5 aa, Entamoeba dispar
SRSPN

SEQ ID NO: 2463070 - protein, 34 aa, Entamoeba dispar
SRSPTSAPSQPTPSSQPTQPTPQPNEQNTFQQPQ

SEQ ID NO: 2463071 - protein, 7 aa, Entamoeba dispar
SRSQPER

SEQ ID NO: 2463072 - protein, 7 aa, Entamoeba dispar
SRSRVEQ

SEQ ID NO: 2463073 - protein, 7 aa, Entamoeba dispar
SRSSFES

SEQ ID NO: 2463074 - protein, 7 aa, Entamoeba dispar
SRSSFGN

SEQ ID NO: 2463075 - protein, 6 aa, Entamoeba dispar
SRSSFV

SEQ ID NO: 2463076 - protein, 11 aa, Entamoeba dispar
SRSSQKEKVPC

SEQ ID NO: 2463077 - protein, 13 aa, Entamoeba dispar
SRSSTYKEEEGKV

SEQ ID NO: 2463078 - protein, 7 aa, Entamoeba dispar
SRSTNDN

SEQ ID NO: 2463079 - protein, 18 aa, Entamoeba dispar
SRSYEPYSKESQNFDKER

SEQ ID NO: 2463080 - protein, 9 aa, Entamoeba dispar
SRTFEEEKK

SEQ ID NO: 2463081 - protein, 8 aa, Entamoeba dispar
SRTGANIR

SEQ ID NO: 2463082 - protein, 5 aa, Entamoeba dispar
SRTGH

SEQ ID NO: 2463083 - protein, 6 aa, Entamoeba dispar
SRTGYG

SEQ ID NO: 2463084 - protein, 5 aa, Entamoeba dispar
SRTIS

SEQ ID NO: 2463085 - protein, 9 aa, Entamoeba dispar
SRTKGATKT

SEQ ID NO: 2463086 - protein, 14 aa, Entamoeba dispar
SRTLSANLRSKKIS

SEQ ID NO: 2463087 - protein, 4 aa, Entamoeba dispar
SRTM

SEQ ID NO: 2463088 - protein, 11 aa, Entamoeba dispar
SRTMTDENKKH

SEQ ID NO: 2463089 - protein, 6 aa, Entamoeba dispar
SRTPDE

SEQ ID NO: 2463090 - protein, 7 aa, Entamoeba dispar
SRTPEQL

SEQ ID NO: 2463091 - protein, 20 aa, Entamoeba dispar
SRTPIDNPKPEQGDYEPDDK

SEQ ID NO: 2463092 - protein, 8 aa, Entamoeba dispar
SRTPQAKG

SEQ ID NO: 2463093 - protein, 24 aa, Entamoeba dispar
SRTPQPSRSSSTIYRSDTPTFTRR

SEQ ID NO: 2463094 - protein, 7 aa, Entamoeba dispar
SRTPSEA

SEQ ID NO: 2463095 - protein, 10 aa, Entamoeba dispar
SRTQNYNDGD

SEQ ID NO: 2463096 - protein, 10 aa, Entamoeba dispar
SRTRSTDTCE

SEQ ID NO: 2463097 - protein, 9 aa, Entamoeba dispar
SRTSTKSGS

SEQ ID NO: 2463098 - protein, 8 aa, Entamoeba dispar
SRTTPSES

SEQ ID NO: 2463099 - protein, 8 aa, Entamoeba dispar
SRTTSAPN

SEQ ID NO: 2463100 - protein, 25 aa, Entamoeba dispar
SRVADTSNWNEDEFNEQEKEIPIES

SEQ ID NO: 2463101 - protein, 5 aa, Entamoeba dispar
SRVPT

SEQ ID NO: 2463102 - protein, 22 aa, Entamoeba dispar
SRVQEEKKQQKLAKEGIKQKKN

SEQ ID NO: 2463103 - protein, 39 aa, Entamoeba dispar
SRVSSEITTPKKGFFGSRSNSRTRENSSLSSSPQHSSPL

SEQ ID NO: 2463104 - protein, 13 aa, Entamoeba dispar
SRWDEQPKAIDSV

SEQ ID NO: 2463105 - protein, 9 aa, Entamoeba dispar
SRWSEDQRF

SEQ ID NO: 2463106 - protein, 12 aa, Entamoeba dispar
SRYKVNKEQIEN

SEQ ID NO: 2463107 - protein, 8 aa, Entamoeba dispar
SRYPENDY

SEQ ID NO: 2463108 - protein, 15 aa, Entamoeba dispar
SRYSKEKEQGNECKN

SEQ ID NO: 2463109 - protein, 4 aa, Entamoeba dispar
SSAA

SEQ ID NO: 2463110 - protein, 6 aa, Entamoeba dispar
SSAASQ

SEQ ID NO: 2463111 - protein, 7 aa, Entamoeba dispar
SSAATEQ

SEQ ID NO: 2463112 - protein, 4 aa, Entamoeba dispar
SSAD

SEQ ID NO: 2463113 - protein, 4 aa, Entamoeba dispar
SSAE

SEQ ID NO: 2463114 - protein, 13 aa, Entamoeba dispar
SSAESCSAGRITS

SEQ ID NO: 2463115 - protein, 8 aa, Entamoeba dispar
SSAGGEYT

SEQ ID NO: 2463116 - protein, 7 aa, Entamoeba dispar
SSAGVEI

SEQ ID NO: 2463117 - protein, 10 aa, Entamoeba dispar
SSAKTGQNVE

SEQ ID NO: 2463118 - protein, 5 aa, Entamoeba dispar
SSALP

SEQ ID NO: 2463119 - protein, 7 aa, Entamoeba dispar
SSAMTPK

SEQ ID NO: 2463120 - protein, 4 aa, Entamoeba dispar
SSAN

SEQ ID NO: 2463121 - protein, 8 aa, Entamoeba dispar
SSANKCGV

SEQ ID NO: 2463122 - protein, 9 aa, Entamoeba dispar
SSANTNPYI

SEQ ID NO: 2463123 - protein, 9 aa, Entamoeba dispar
SSAPDSSLS

SEQ ID NO: 2463124 - protein, 8 aa, Entamoeba dispar
SSAPESTP

SEQ ID NO: 2463125 - protein, 8 aa, Entamoeba dispar
SSAPPTPD

SEQ ID NO: 2463126 - protein, 15 aa, Entamoeba dispar
SSAPSESSKNSYRQP

SEQ ID NO: 2463127 - protein, 9 aa, Entamoeba dispar
SSAPVSGTY

SEQ ID NO: 2463128 - protein, 9 aa, Entamoeba dispar
SSAQGLPAT

SEQ ID NO: 2463129 - protein, 8 aa, Entamoeba dispar
SSAQKNNA

SEQ ID NO: 2463130 - protein, 10 aa, Entamoeba dispar
SSASVTEGVP

SEQ ID NO: 2463131 - protein, 9 aa, Entamoeba dispar
SSCDSFEGI

SEQ ID NO: 2463132 - protein, 10 aa, Entamoeba dispar
SSCEQPDLTT

SEQ ID NO: 2463133 - protein, 32 aa, Entamoeba dispar
SSCIDKDETSNTKIDDALSKNGTKEGKSINEK

SEQ ID NO: 2463134 - protein, 4 aa, Entamoeba dispar
SSCK

SEQ ID NO: 2463135 - protein, 14 aa, Entamoeba dispar
SSCKETLESISASR

SEQ ID NO: 2463136 - protein, 10 aa, Entamoeba dispar
SSCSRERSNA

SEQ ID NO: 2463137 - protein, 10 aa, Entamoeba dispar
SSCTNTPSFD

SEQ ID NO: 2463138 - protein, 7 aa, Entamoeba dispar
SSCTPST

SEQ ID NO: 2463139 - protein, 6 aa, Entamoeba dispar
SSCTSA

SEQ ID NO: 2463140 - protein, 13 aa, Entamoeba dispar
SSDAWTQQDEENI

SEQ ID NO: 2463141 - protein, 8 aa, Entamoeba dispar
SSDAYKAM

SEQ ID NO: 2463142 - protein, 13 aa, Entamoeba dispar
SSDCSAPVTPPSF

SEQ ID NO: 2463143 - protein, 5 aa, Entamoeba dispar
SSDDL

SEQ ID NO: 2463144 - protein, 17 aa, Entamoeba dispar
SSDDNIQTKQETKEEKT

SEQ ID NO: 2463145 - protein, 6 aa, Entamoeba dispar
SSDDRT

SEQ ID NO: 2463146 - protein, 9 aa, Entamoeba dispar
SSDEDKANR

SEQ ID NO: 2463147 - protein, 8 aa, Entamoeba dispar
SSDEFENI

SEQ ID NO: 2463148 - protein, 5 aa, Entamoeba dispar
SSDEH

SEQ ID NO: 2463149 - protein, 9 aa, Entamoeba dispar
SSDEHGYNN

SEQ ID NO: 2463150 - protein, 5 aa, Entamoeba dispar
SSDEI

SEQ ID NO: 2463151 - protein, 6 aa, Entamoeba dispar
SSDEIA

SEQ ID NO: 2463152 - protein, 8 aa, Entamoeba dispar
SSDENPIE

SEQ ID NO: 2463153 - protein, 14 aa, Entamoeba dispar
SSDESISQDEYDSC

SEQ ID NO: 2463154 - protein, 7 aa, Entamoeba dispar
SSDFNNS

SEQ ID NO: 2463155 - protein, 12 aa, Entamoeba dispar
SSDFSVEEKRIN

SEQ ID NO: 2463156 - protein, 7 aa, Entamoeba dispar
SSDGEVN

SEQ ID NO: 2463157 - protein, 13 aa, Entamoeba dispar
SSDIEDESEVDEI

SEQ ID NO: 2463158 - protein, 6 aa, Entamoeba dispar
SSDIGK

SEQ ID NO: 2463159 - protein, 8 aa, Entamoeba dispar
SSDKQKLK

SEQ ID NO: 2463160 - protein, 15 aa, Entamoeba dispar
SSDKQYNNRDGKKGI

SEQ ID NO: 2463161 - protein, 7 aa, Entamoeba dispar
SSDKTPL

SEQ ID NO: 2463162 - protein, 10 aa, Entamoeba dispar
SSDLQTKYSA

SEQ ID NO: 2463163 - protein, 4 aa, Entamoeba dispar
SSDN

SEQ ID NO: 2463164 - protein, 7 aa, Entamoeba dispar
SSDNSDV

SEQ ID NO: 2463165 - protein, 8 aa, Entamoeba dispar
SSDNVEEY

SEQ ID NO: 2463166 - protein, 4 aa, Entamoeba dispar
SSDP

SEQ ID NO: 2463167 - protein, 6 aa, Entamoeba dispar
SSDPDL

SEQ ID NO: 2463168 - protein, 6 aa, Entamoeba dispar
SSDPLD

SEQ ID NO: 2463169 - protein, 5 aa, Entamoeba dispar
SSDQH

SEQ ID NO: 2463170 - protein, 8 aa, Entamoeba dispar
SSDQPTKI

SEQ ID NO: 2463171 - protein, 12 aa, Entamoeba dispar
SSDQSNEESQNI

SEQ ID NO: 2463172 - protein, 4 aa, Entamoeba dispar
SSDR

SEQ ID NO: 2463173 - protein, 13 aa, Entamoeba dispar
SSDSAESGARETK

SEQ ID NO: 2463174 - protein, 6 aa, Entamoeba dispar
SSDSDL

SEQ ID NO: 2463175 - protein, 10 aa, Entamoeba dispar
SSDSENEYDF

SEQ ID NO: 2463176 - protein, 8 aa, Entamoeba dispar
SSDSHETI

SEQ ID NO: 2463177 - protein, 37 aa, Entamoeba dispar
SSDSSPNEFSKSDTEIEEEINKNKTKKEKLVSPSKLG

SEQ ID NO: 2463178 - protein, 10 aa, Entamoeba dispar
SSDTKKSAKE

SEQ ID NO: 2463179 - protein, 10 aa, Entamoeba dispar
SSDTKSQDNN

SEQ ID NO: 2463180 - protein, 4 aa, Entamoeba dispar
SSDV

SEQ ID NO: 2463181 - protein, 5 aa, Entamoeba dispar
SSDVG

SEQ ID NO: 2463182 - protein, 5 aa, Entamoeba dispar
SSDWG

SEQ ID NO: 2463183 - protein, 6 aa, Entamoeba dispar
SSDWKD

SEQ ID NO: 2463184 - protein, 19 aa, Entamoeba dispar
SSDYEDEEHPKEESDKIRQ

SEQ ID NO: 2463185 - protein, 21 aa, Entamoeba dispar
SSDYERPTDYPHFTGLRQFCH

SEQ ID NO: 2463186 - protein, 8 aa, Entamoeba dispar
SSECSTTH

SEQ ID NO: 2463187 - protein, 12 aa, Entamoeba dispar
SSEDRRKYGNKI

SEQ ID NO: 2463188 - protein, 6 aa, Entamoeba dispar
SSEDRV

SEQ ID NO: 2463189 - protein, 13 aa, Entamoeba dispar
SSEEDFSKHHSSN

SEQ ID NO: 2463190 - protein, 7 aa, Entamoeba dispar
SSEEGKI

SEQ ID NO: 2463191 - protein, 24 aa, Entamoeba dispar
SSEEIKKEEVKEITSEDNQINPEQ

SEQ ID NO: 2463192 - protein, 9 aa, Entamoeba dispar
SSEEQQVSQ

SEQ ID NO: 2463193 - protein, 8 aa, Entamoeba dispar
SSEEVPKF

SEQ ID NO: 2463194 - protein, 4 aa, Entamoeba dispar
SSEF

SEQ ID NO: 2463195 - protein, 5 aa, Entamoeba dispar
SSEFG

SEQ ID NO: 2463196 - protein, 7 aa, Entamoeba dispar
SSEGKIK

SEQ ID NO: 2463197 - protein, 7 aa, Entamoeba dispar
SSEGLNR

SEQ ID NO: 2463198 - protein, 5 aa, Entamoeba dispar
SSEGN

SEQ ID NO: 2463199 - protein, 9 aa, Entamoeba dispar
SSEHENHEI

SEQ ID NO: 2463200 - protein, 7 aa, Entamoeba dispar
SSEIKTN

SEQ ID NO: 2463201 - protein, 8 aa, Entamoeba dispar
SSEIQSSL

SEQ ID NO: 2463202 - protein, 19 aa, Entamoeba dispar
SSEIRTEKKYNKEPSDCVV

SEQ ID NO: 2463203 - protein, 12 aa, Entamoeba dispar
SSEKEQKQLTPR

SEQ ID NO: 2463204 - protein, 19 aa, Entamoeba dispar
SSEKEQLPENLEFPDIVLN

SEQ ID NO: 2463205 - protein, 10 aa, Entamoeba dispar
SSEKKPLQNE

SEQ ID NO: 2463206 - protein, 9 aa, Entamoeba dispar
SSEKNKFNN

SEQ ID NO: 2463207 - protein, 9 aa, Entamoeba dispar
SSEKPKIKT

SEQ ID NO: 2463208 - protein, 15 aa, Entamoeba dispar
SSELKEKYEKKMNDA

SEQ ID NO: 2463209 - protein, 8 aa, Entamoeba dispar
SSELQNQR

SEQ ID NO: 2463210 - protein, 5 aa, Entamoeba dispar
SSEMG

SEQ ID NO: 2463211 - protein, 6 aa, Entamoeba dispar
SSENDR

SEQ ID NO: 2463212 - protein, 8 aa, Entamoeba dispar
SSENNKST

SEQ ID NO: 2463213 - protein, 14 aa, Entamoeba dispar
SSENPHKTATSQTC

SEQ ID NO: 2463214 - protein, 11 aa, Entamoeba dispar
SSENPITSSVT

SEQ ID NO: 2463215 - protein, 17 aa, Entamoeba dispar
SSENQSLETKENSNQFL

SEQ ID NO: 2463216 - protein, 7 aa, Entamoeba dispar
SSEPIPK

SEQ ID NO: 2463217 - protein, 11 aa, Entamoeba dispar
SSEPTNPSLSI

SEQ ID NO: 2463218 - protein, 26 aa, Entamoeba dispar
SSEQQSKLFSEQNTRVQRKKTSKLTD

SEQ ID NO: 2463219 - protein, 34 aa, Entamoeba dispar
SSEQTKSSEETTNSYDTIGSNTLSTKKVYKEKEI

SEQ ID NO: 2463220 - protein, 4 aa, Entamoeba dispar
SSES

SEQ ID NO: 2463221 - protein, 9 aa, Entamoeba dispar
SSESDDGSC

SEQ ID NO: 2463222 - protein, 14 aa, Entamoeba dispar
SSESEEDNETIVRT

SEQ ID NO: 2463223 - protein, 7 aa, Entamoeba dispar
SSESEKL

SEQ ID NO: 2463224 - protein, 6 aa, Entamoeba dispar
SSESFD

SEQ ID NO: 2463225 - protein, 8 aa, Entamoeba dispar
SSESMQHG

SEQ ID NO: 2463226 - protein, 32 aa, Entamoeba dispar
SSESNDENTVNEKKEESTEDEESSEEDNGDEE

SEQ ID NO: 2463227 - protein, 9 aa, Entamoeba dispar
SSESSAISS

SEQ ID NO: 2463228 - protein, 11 aa, Entamoeba dispar
SSESSEDNNRI

SEQ ID NO: 2463229 - protein, 22 aa, Entamoeba dispar
SSESSIDPQIDKSNNIQYRSPN

SEQ ID NO: 2463230 - protein, 30 aa, Entamoeba dispar
SSETDESEESSTDSYSKEEFEEGKENAEII

SEQ ID NO: 2463231 - protein, 9 aa, Entamoeba dispar
SSETIYENE

SEQ ID NO: 2463232 - protein, 11 aa, Entamoeba dispar
SSETMARKTTV

SEQ ID NO: 2463233 - protein, 6 aa, Entamoeba dispar
SSETNK

SEQ ID NO: 2463234 - protein, 7 aa, Entamoeba dispar
SSETTYV

SEQ ID NO: 2463235 - protein, 4 aa, Entamoeba dispar
SSEV

SEQ ID NO: 2463236 - protein, 5 aa, Entamoeba dispar
SSEVG

SEQ ID NO: 2463237 - protein, 7 aa, Entamoeba dispar
SSEVTAS

SEQ ID NO: 2463238 - protein, 5 aa, Entamoeba dispar
SSEYE

SEQ ID NO: 2463239 - protein, 5 aa, Entamoeba dispar
SSEYG

SEQ ID NO: 2463240 - protein, 8 aa, Entamoeba dispar
SSEYKEKG

SEQ ID NO: 2463241 - protein, 4 aa, Entamoeba dispar
SSFA

SEQ ID NO: 2463242 - protein, 12 aa, Entamoeba dispar
SSFDDKLTAKEQ

SEQ ID NO: 2463243 - protein, 8 aa, Entamoeba dispar
SSFDESTH

SEQ ID NO: 2463244 - protein, 7 aa, Entamoeba dispar
SSFDKEE

SEQ ID NO: 2463245 - protein, 5 aa, Entamoeba dispar
SSFED

SEQ ID NO: 2463246 - protein, 18 aa, Entamoeba dispar
SSFEGKDCGKNSYYKRES

SEQ ID NO: 2463247 - protein, 8 aa, Entamoeba dispar
SSFEYENN

SEQ ID NO: 2463248 - protein, 25 aa, Entamoeba dispar
SSFGDTHPSNLVSSKPNFDESKNSF

SEQ ID NO: 2463249 - protein, 6 aa, Entamoeba dispar
SSFGKR

SEQ ID NO: 2463250 - protein, 19 aa, Entamoeba dispar
SSFGSETNQNQSNPFASGT

SEQ ID NO: 2463251 - protein, 6 aa, Entamoeba dispar
SSFKSR

SEQ ID NO: 2463252 - protein, 5 aa, Entamoeba dispar
SSFKT

SEQ ID NO: 2463253 - protein, 4 aa, Entamoeba dispar
SSFN

SEQ ID NO: 2463254 - protein, 11 aa, Entamoeba dispar
SSFNENDGVTL

SEQ ID NO: 2463255 - protein, 13 aa, Entamoeba dispar
SSFNSNSQKKDDI

SEQ ID NO: 2463256 - protein, 6 aa, Entamoeba dispar
SSFPEE

SEQ ID NO: 2463257 - protein, 5 aa, Entamoeba dispar
SSFPI

SEQ ID NO: 2463258 - protein, 7 aa, Entamoeba dispar
SSFPKDK

SEQ ID NO: 2463259 - protein, 6 aa, Entamoeba dispar
SSFPRS

SEQ ID NO: 2463260 - protein, 5 aa, Entamoeba dispar
SSFQE

SEQ ID NO: 2463261 - protein, 4 aa, Entamoeba dispar
SSFR

SEQ ID NO: 2463262 - protein, 7 aa, Entamoeba dispar
SSFRSRQ

SEQ ID NO: 2463263 - protein, 8 aa, Entamoeba dispar
SSFSPMST

SEQ ID NO: 2463264 - protein, 17 aa, Entamoeba dispar
SSFTKDDIQDVSDQGLT

SEQ ID NO: 2463265 - protein, 5 aa, Entamoeba dispar
SSGAY

SEQ ID NO: 2463266 - protein, 11 aa, Entamoeba dispar
SSGCKRPKKDL

SEQ ID NO: 2463267 - protein, 4 aa, Entamoeba dispar
SSGD

SEQ ID NO: 2463268 - protein, 5 aa, Entamoeba dispar
SSGDG

SEQ ID NO: 2463269 - protein, 10 aa, Entamoeba dispar
SSGDGKSSLG

SEQ ID NO: 2463270 - protein, 7 aa, Entamoeba dispar
SSGFEES

SEQ ID NO: 2463271 - protein, 6 aa, Entamoeba dispar
SSGFTP

SEQ ID NO: 2463272 - protein, 31 aa, Entamoeba dispar
SSGIINDEEINEEERLEENNINTINKSTKDE

SEQ ID NO: 2463273 - protein, 7 aa, Entamoeba dispar
SSGKEET

SEQ ID NO: 2463274 - protein, 7 aa, Entamoeba dispar
SSGKGYV

SEQ ID NO: 2463275 - protein, 11 aa, Entamoeba dispar
SSGKYQMKYDT

SEQ ID NO: 2463276 - protein, 7 aa, Entamoeba dispar
SSGLEQD

SEQ ID NO: 2463277 - protein, 11 aa, Entamoeba dispar
SSGLNSKSQWT

SEQ ID NO: 2463278 - protein, 7 aa, Entamoeba dispar
SSGNEVM

SEQ ID NO: 2463279 - protein, 7 aa, Entamoeba dispar
SSGNTQQ

SEQ ID NO: 2463280 - protein, 20 aa, Entamoeba dispar
SSGPQQNTTIPERSVQGQPL

SEQ ID NO: 2463281 - protein, 8 aa, Entamoeba dispar
SSGPVKTR

SEQ ID NO: 2463282 - protein, 7 aa, Entamoeba dispar
SSGQQRV

SEQ ID NO: 2463283 - protein, 16 aa, Entamoeba dispar
SSGSETRSRRKSYNPI

SEQ ID NO: 2463284 - protein, 14 aa, Entamoeba dispar
SSGSSEIDGPEEEK

SEQ ID NO: 2463285 - protein, 8 aa, Entamoeba dispar
SSGSYQSL

SEQ ID NO: 2463286 - protein, 6 aa, Entamoeba dispar
SSGTTQ

SEQ ID NO: 2463287 - protein, 7 aa, Entamoeba dispar
SSGVGKT

SEQ ID NO: 2463288 - protein, 4 aa, Entamoeba dispar
SSGY

SEQ ID NO: 2463289 - protein, 7 aa, Entamoeba dispar
SSGYSVY

SEQ ID NO: 2463290 - protein, 7 aa, Entamoeba dispar
SSHDKTI

SEQ ID NO: 2463291 - protein, 16 aa, Entamoeba dispar
SSHEGITRINKNKKKV

SEQ ID NO: 2463292 - protein, 6 aa, Entamoeba dispar
SSHEKY

SEQ ID NO: 2463293 - protein, 12 aa, Entamoeba dispar
SSHFKNGKCKQY

SEQ ID NO: 2463294 - protein, 20 aa, Entamoeba dispar
SSHFPNSLTETSPNSSNSPI

SEQ ID NO: 2463295 - protein, 5 aa, Entamoeba dispar
SSHGR

SEQ ID NO: 2463296 - protein, 7 aa, Entamoeba dispar
SSHGTPL

SEQ ID NO: 2463297 - protein, 4 aa, Entamoeba dispar
SSHI

SEQ ID NO: 2463298 - protein, 5 aa, Entamoeba dispar
SSHIG

SEQ ID NO: 2463299 - protein, 10 aa, Entamoeba dispar
SSHKQQIDTE

SEQ ID NO: 2463300 - protein, 13 aa, Entamoeba dispar
SSHPCQPLQSSSG

SEQ ID NO: 2463301 - protein, 17 aa, Entamoeba dispar
SSHPSQSFSSTNETSIN

SEQ ID NO: 2463302 - protein, 7 aa, Entamoeba dispar
SSHQPKR

SEQ ID NO: 2463303 - protein, 6 aa, Entamoeba dispar
SSHTNH

SEQ ID NO: 2463304 - protein, 5 aa, Entamoeba dispar
SSIDR

SEQ ID NO: 2463305 - protein, 7 aa, Entamoeba dispar
SSIDTDY

SEQ ID NO: 2463306 - protein, 9 aa, Entamoeba dispar
SSIDTSASN

SEQ ID NO: 2463307 - protein, 4 aa, Entamoeba dispar
SSIE

SEQ ID NO: 2463308 - protein, 7 aa, Entamoeba dispar
SSIEDSS

SEQ ID NO: 2463309 - protein, 6 aa, Entamoeba dispar
SSIEEY

SEQ ID NO: 2463310 - protein, 7 aa, Entamoeba dispar
SSIENNS

SEQ ID NO: 2463311 - protein, 7 aa, Entamoeba dispar
SSIESGK

SEQ ID NO: 2463312 - protein, 25 aa, Entamoeba dispar
SSIFKSQKSYPTQPVNKQTSNAQKK

SEQ ID NO: 2463313 - protein, 13 aa, Entamoeba dispar
SSIGEKRMNGGRK

SEQ ID NO: 2463314 - protein, 6 aa, Entamoeba dispar
SSIGEL

SEQ ID NO: 2463315 - protein, 10 aa, Entamoeba dispar
SSIGSHNTCQ

SEQ ID NO: 2463316 - protein, 11 aa, Entamoeba dispar
SSIGSPSLESQ

SEQ ID NO: 2463317 - protein, 6 aa, Entamoeba dispar
SSIHSE

SEQ ID NO: 2463318 - protein, 6 aa, Entamoeba dispar
SSIIKE

SEQ ID NO: 2463319 - protein, 4 aa, Entamoeba dispar
SSIK

SEQ ID NO: 2463320 - protein, 5 aa, Entamoeba dispar
SSIKE

SEQ ID NO: 2463321 - protein, 7 aa, Entamoeba dispar
SSIKEMG

SEQ ID NO: 2463322 - protein, 6 aa, Entamoeba dispar
SSIKGS

SEQ ID NO: 2463323 - protein, 10 aa, Entamoeba dispar
SSIKKDKINL

SEQ ID NO: 2463324 - protein, 5 aa, Entamoeba dispar
SSIKR

SEQ ID NO: 2463325 - protein, 13 aa, Entamoeba dispar
SSIKSNEEYEKYK

SEQ ID NO: 2463326 - protein, 5 aa, Entamoeba dispar
SSINE

SEQ ID NO: 2463327 - protein, 16 aa, Entamoeba dispar
SSINEEKENKRLSISS

SEQ ID NO: 2463328 - protein, 36 aa, Entamoeba dispar
SSINKNQLNKEVVETTNEPIKPKPETKSLSKEDYRE

SEQ ID NO: 2463329 - protein, 12 aa, Entamoeba dispar
SSIPDMKDEPLM

SEQ ID NO: 2463330 - protein, 9 aa, Entamoeba dispar
SSIPEDTRN

SEQ ID NO: 2463331 - protein, 8 aa, Entamoeba dispar
SSIPNSTK

SEQ ID NO: 2463332 - protein, 16 aa, Entamoeba dispar
SSIPPPEHSFISSYDN

SEQ ID NO: 2463333 - protein, 6 aa, Entamoeba dispar
SSIPSD

SEQ ID NO: 2463334 - protein, 14 aa, Entamoeba dispar
SSIQETYSKIQKGE

SEQ ID NO: 2463335 - protein, 42 aa, Entamoeba dispar
SSIQKSKEEIQTITTNKKEETNQNINTKDQYKNEKINEQTKM

SEQ ID NO: 2463336 - protein, 19 aa, Entamoeba dispar
SSIQNNTQLNTNSNNYFQN

SEQ ID NO: 2463337 - protein, 8 aa, Entamoeba dispar
SSIQNTTS

SEQ ID NO: 2463338 - protein, 6 aa, Entamoeba dispar
SSIQPT

SEQ ID NO: 2463339 - protein, 6 aa, Entamoeba dispar
SSISDN

SEQ ID NO: 2463340 - protein, 6 aa, Entamoeba dispar
SSISDQ

SEQ ID NO: 2463341 - protein, 7 aa, Entamoeba dispar
SSISEIG

SEQ ID NO: 2463342 - protein, 8 aa, Entamoeba dispar
SSISEIGD

SEQ ID NO: 2463343 - protein, 9 aa, Entamoeba dispar
SSISEKRLR

SEQ ID NO: 2463344 - protein, 6 aa, Entamoeba dispar
SSISKF

SEQ ID NO: 2463345 - protein, 8 aa, Entamoeba dispar
SSISKLGG

SEQ ID NO: 2463346 - protein, 8 aa, Entamoeba dispar
SSISNAVE

SEQ ID NO: 2463347 - protein, 17 aa, Entamoeba dispar
SSISSKEFEQNIKSQKQ

SEQ ID NO: 2463348 - protein, 8 aa, Entamoeba dispar
SSISSSIG

SEQ ID NO: 2463349 - protein, 11 aa, Entamoeba dispar
SSISTHEKNCK

SEQ ID NO: 2463350 - protein, 6 aa, Entamoeba dispar
SSITKL

SEQ ID NO: 2463351 - protein, 26 aa, Entamoeba dispar
SSITQAPTISYETNNIPVQFKDLNIH

SEQ ID NO: 2463352 - protein, 26 aa, Entamoeba dispar
SSITSAIASPPKDCITTPKKNDRSIR

SEQ ID NO: 2463353 - protein, 6 aa, Entamoeba dispar
SSIYTD

SEQ ID NO: 2463354 - protein, 6 aa, Entamoeba dispar
SSKADH

SEQ ID NO: 2463355 - protein, 9 aa, Entamoeba dispar
SSKAEEMEG

SEQ ID NO: 2463356 - protein, 5 aa, Entamoeba dispar
SSKAI

SEQ ID NO: 2463357 - protein, 7 aa, Entamoeba dispar
SSKANGL

SEQ ID NO: 2463358 - protein, 6 aa, Entamoeba dispar
SSKCNE

SEQ ID NO: 2463359 - protein, 13 aa, Entamoeba dispar
SSKCSREKKKDKF

SEQ ID NO: 2463360 - protein, 12 aa, Entamoeba dispar
SSKCSVAVKKAS

SEQ ID NO: 2463361 - protein, 8 aa, Entamoeba dispar
SSKDELTA

SEQ ID NO: 2463362 - protein, 10 aa, Entamoeba dispar
SSKDGLSARS

SEQ ID NO: 2463363 - protein, 10 aa, Entamoeba dispar
SSKDRWTLPG

SEQ ID NO: 2463364 - protein, 9 aa, Entamoeba dispar
SSKDYSTQY

SEQ ID NO: 2463365 - protein, 4 aa, Entamoeba dispar
SSKE

SEQ ID NO: 2463366 - protein, 5 aa, Entamoeba dispar
SSKEF

SEQ ID NO: 2463367 - protein, 9 aa, Entamoeba dispar
SSKELGNWT

SEQ ID NO: 2463368 - protein, 15 aa, Entamoeba dispar
SSKEPLEKADKGGRV

SEQ ID NO: 2463369 - protein, 16 aa, Entamoeba dispar
SSKFGKEKEEFYQPNG

SEQ ID NO: 2463370 - protein, 7 aa, Entamoeba dispar
SSKGELG

SEQ ID NO: 2463371 - protein, 6 aa, Entamoeba dispar
SSKGHY

SEQ ID NO: 2463372 - protein, 6 aa, Entamoeba dispar
SSKGIE

SEQ ID NO: 2463373 - protein, 8 aa, Entamoeba dispar
SSKGKTHV

SEQ ID NO: 2463374 - protein, 8 aa, Entamoeba dispar
SSKGNKQE

SEQ ID NO: 2463375 - protein, 6 aa, Entamoeba dispar
SSKGYL

SEQ ID NO: 2463376 - protein, 13 aa, Entamoeba dispar
SSKHNTQTKPQKN

SEQ ID NO: 2463377 - protein, 6 aa, Entamoeba dispar
SSKHSP

SEQ ID NO: 2463378 - protein, 29 aa, Entamoeba dispar
SSKIEEEKSNSQTPSLTVSEGKDKNESIE

SEQ ID NO: 2463379 - protein, 6 aa, Entamoeba dispar
SSKIEN

SEQ ID NO: 2463380 - protein, 8 aa, Entamoeba dispar
SSKIPTSK

SEQ ID NO: 2463381 - protein, 6 aa, Entamoeba dispar
SSKKEL

SEQ ID NO: 2463382 - protein, 23 aa, Entamoeba dispar
SSKKERQNEKKSQDSDGKVLEEN

SEQ ID NO: 2463383 - protein, 21 aa, Entamoeba dispar
SSKKESSAIDISSTGTNIDDW

SEQ ID NO: 2463384 - protein, 8 aa, Entamoeba dispar
SSKKETII

SEQ ID NO: 2463385 - protein, 5 aa, Entamoeba dispar
SSKKF

SEQ ID NO: 2463386 - protein, 10 aa, Entamoeba dispar
SSKKKKKEVP

SEQ ID NO: 2463387 - protein, 17 aa, Entamoeba dispar
SSKKQQLEEELKETQNI

SEQ ID NO: 2463388 - protein, 9 aa, Entamoeba dispar
SSKLGSSQP

SEQ ID NO: 2463389 - protein, 11 aa, Entamoeba dispar
SSKLKESQRIN

SEQ ID NO: 2463390 - protein, 13 aa, Entamoeba dispar
SSKLRNETKPQKN

SEQ ID NO: 2463391 - protein, 35 aa, Entamoeba dispar
SSKLSGDSVSINGGNGTEAITETLKKAKEKGLNKE

SEQ ID NO: 2463392 - protein, 7 aa, Entamoeba dispar
SSKNCTI

SEQ ID NO: 2463393 - protein, 8 aa, Entamoeba dispar
SSKNENEA

SEQ ID NO: 2463394 - protein, 6 aa, Entamoeba dispar
SSKNKQ

SEQ ID NO: 2463395 - protein, 11 aa, Entamoeba dispar
SSKNSETLTST

SEQ ID NO: 2463396 - protein, 6 aa, Entamoeba dispar
SSKPIL

SEQ ID NO: 2463397 - protein, 6 aa, Entamoeba dispar
SSKPKN

SEQ ID NO: 2463398 - protein, 8 aa, Entamoeba dispar
SSKPLTDL

SEQ ID NO: 2463399 - protein, 9 aa, Entamoeba dispar
SSKPNVSSH

SEQ ID NO: 2463400 - protein, 9 aa, Entamoeba dispar
SSKPSESSL

SEQ ID NO: 2463401 - protein, 8 aa, Entamoeba dispar
SSKPVTVE

SEQ ID NO: 2463402 - protein, 13 aa, Entamoeba dispar
SSKPVVQENTDGH

SEQ ID NO: 2463403 - protein, 8 aa, Entamoeba dispar
SSKPYYKR

SEQ ID NO: 2463404 - protein, 14 aa, Entamoeba dispar
SSKQFNEAEASFTK

SEQ ID NO: 2463405 - protein, 5 aa, Entamoeba dispar
SSKQT

SEQ ID NO: 2463406 - protein, 7 aa, Entamoeba dispar
SSKRKGI

SEQ ID NO: 2463407 - protein, 9 aa, Entamoeba dispar
SSKRPIKNE

SEQ ID NO: 2463408 - protein, 4 aa, Entamoeba dispar
SSKS

SEQ ID NO: 2463409 - protein, 5 aa, Entamoeba dispar
SSKSA

SEQ ID NO: 2463410 - protein, 8 aa, Entamoeba dispar
SSKSEDKD

SEQ ID NO: 2463411 - protein, 17 aa, Entamoeba dispar
SSKSEECQIKTDSPIIT

SEQ ID NO: 2463412 - protein, 11 aa, Entamoeba dispar
SSKSFPSNSTF

SEQ ID NO: 2463413 - protein, 6 aa, Entamoeba dispar
SSKSIT

SEQ ID NO: 2463414 - protein, 7 aa, Entamoeba dispar
SSKSKMF

SEQ ID NO: 2463415 - protein, 17 aa, Entamoeba dispar
SSKSLQKLSPNDKTKQQ

SEQ ID NO: 2463416 - protein, 5 aa, Entamoeba dispar
SSKSP

SEQ ID NO: 2463417 - protein, 13 aa, Entamoeba dispar
SSKSPIQSPNPDL

SEQ ID NO: 2463418 - protein, 4 aa, Entamoeba dispar
SSKT

SEQ ID NO: 2463419 - protein, 9 aa, Entamoeba dispar
SSKTGDNVN

SEQ ID NO: 2463420 - protein, 8 aa, Entamoeba dispar
SSKTGEGI

SEQ ID NO: 2463421 - protein, 12 aa, Entamoeba dispar
SSKTGEGVKETM

SEQ ID NO: 2463422 - protein, 12 aa, Entamoeba dispar
SSKTGGNTTYNT

SEQ ID NO: 2463423 - protein, 14 aa, Entamoeba dispar
SSKTGKTVGGSSGR

SEQ ID NO: 2463424 - protein, 7 aa, Entamoeba dispar
SSKTNAI

SEQ ID NO: 2463425 - protein, 10 aa, Entamoeba dispar
SSKTQIESKT

SEQ ID NO: 2463426 - protein, 8 aa, Entamoeba dispar
SSKTRSSN

SEQ ID NO: 2463427 - protein, 6 aa, Entamoeba dispar
SSKTSH

SEQ ID NO: 2463428 - protein, 11 aa, Entamoeba dispar
SSKVNSFNGSD

SEQ ID NO: 2463429 - protein, 12 aa, Entamoeba dispar
SSKVQKDERIGQ

SEQ ID NO: 2463430 - protein, 15 aa, Entamoeba dispar
SSKYEDDDLSSKETI

SEQ ID NO: 2463431 - protein, 7 aa, Entamoeba dispar
SSKYSYS

SEQ ID NO: 2463432 - protein, 23 aa, Entamoeba dispar
SSLASYSSKVDSLSGKTVPLLYV

SEQ ID NO: 2463433 - protein, 4 aa, Entamoeba dispar
SSLD

SEQ ID NO: 2463434 - protein, 19 aa, Entamoeba dispar
SSLDEKNKDADPPKQQELS

SEQ ID NO: 2463435 - protein, 4 aa, Entamoeba dispar
SSLE

SEQ ID NO: 2463436 - protein, 8 aa, Entamoeba dispar
SSLEGLTT

SEQ ID NO: 2463437 - protein, 7 aa, Entamoeba dispar
SSLEGQM

SEQ ID NO: 2463438 - protein, 9 aa, Entamoeba dispar
SSLEKITKE

SEQ ID NO: 2463439 - protein, 6 aa, Entamoeba dispar
SSLEST

SEQ ID NO: 2463440 - protein, 4 aa, Entamoeba dispar
SSLG

SEQ ID NO: 2463441 - protein, 9 aa, Entamoeba dispar
SSLIETGTT

SEQ ID NO: 2463442 - protein, 8 aa, Entamoeba dispar
SSLKDQID

SEQ ID NO: 2463443 - protein, 12 aa, Entamoeba dispar
SSLNEKKSWKTG

SEQ ID NO: 2463444 - protein, 5 aa, Entamoeba dispar
SSLNP

SEQ ID NO: 2463445 - protein, 16 aa, Entamoeba dispar
SSLNQSSSLINNSEPK

SEQ ID NO: 2463446 - protein, 8 aa, Entamoeba dispar
SSLNSKKI

SEQ ID NO: 2463447 - protein, 8 aa, Entamoeba dispar
SSLNTSIQ

SEQ ID NO: 2463448 - protein, 8 aa, Entamoeba dispar
SSLPKKPL

SEQ ID NO: 2463449 - protein, 6 aa, Entamoeba dispar
SSLPNV

SEQ ID NO: 2463450 - protein, 8 aa, Entamoeba dispar
SSLPVPAK

SEQ ID NO: 2463451 - protein, 7 aa, Entamoeba dispar
SSLQDQS

SEQ ID NO: 2463452 - protein, 14 aa, Entamoeba dispar
SSLQFSSSQTTVTK

SEQ ID NO: 2463453 - protein, 24 aa, Entamoeba dispar
SSLQTSPPSDPRRIDERPALTRST

SEQ ID NO: 2463454 - protein, 4 aa, Entamoeba dispar
SSLS

SEQ ID NO: 2463455 - protein, 6 aa, Entamoeba dispar
SSLSDK

SEQ ID NO: 2463456 - protein, 7 aa, Entamoeba dispar
SSLSEES

SEQ ID NO: 2463457 - protein, 27 aa, Entamoeba dispar
SSLSERAKEINDSQREKTKAKTAPRRG

SEQ ID NO: 2463458 - protein, 8 aa, Entamoeba dispar
SSLSIDST

SEQ ID NO: 2463459 - protein, 32 aa, Entamoeba dispar
SSLSLKEKAAKFKPIKDEIKNKSIHQTPSKEN

SEQ ID NO: 2463460 - protein, 15 aa, Entamoeba dispar
SSLSLSSSLEVPQST

SEQ ID NO: 2463461 - protein, 8 aa, Entamoeba dispar
SSLSPNKG

SEQ ID NO: 2463462 - protein, 9 aa, Entamoeba dispar
SSLSPSTQR

SEQ ID NO: 2463463 - protein, 7 aa, Entamoeba dispar
SSLSPTT

SEQ ID NO: 2463464 - protein, 14 aa, Entamoeba dispar
SSLSQKKTDQANQL

SEQ ID NO: 2463465 - protein, 12 aa, Entamoeba dispar
SSLSQSQEPLPL

SEQ ID NO: 2463466 - protein, 8 aa, Entamoeba dispar
SSLSSLGR

SEQ ID NO: 2463467 - protein, 10 aa, Entamoeba dispar
SSLSSPQQQY

SEQ ID NO: 2463468 - protein, 6 aa, Entamoeba dispar
SSLSSQ

SEQ ID NO: 2463469 - protein, 18 aa, Entamoeba dispar
SSLSTTPATEKLPVDSKN

SEQ ID NO: 2463470 - protein, 12 aa, Entamoeba dispar
SSLTDDEGQPFK

SEQ ID NO: 2463471 - protein, 9 aa, Entamoeba dispar
SSLTKEGYH

SEQ ID NO: 2463472 - protein, 14 aa, Entamoeba dispar
SSLTTNENDKEAKE

SEQ ID NO: 2463473 - protein, 16 aa, Entamoeba dispar
SSMDGKGSLYTRSGTA

SEQ ID NO: 2463474 - protein, 5 aa, Entamoeba dispar
SSMEG

SEQ ID NO: 2463475 - protein, 4 aa, Entamoeba dispar
SSMN

SEQ ID NO: 2463476 - protein, 10 aa, Entamoeba dispar
SSMNDQEKEE

SEQ ID NO: 2463477 - protein, 16 aa, Entamoeba dispar
SSMNGSEKKNGAEVSR

SEQ ID NO: 2463478 - protein, 8 aa, Entamoeba dispar
SSMSQKSP

SEQ ID NO: 2463479 - protein, 9 aa, Entamoeba dispar
SSMSSSPVN

SEQ ID NO: 2463480 - protein, 20 aa, Entamoeba dispar
SSMTNTDELPVSSSFVGKYQ

SEQ ID NO: 2463481 - protein, 12 aa, Entamoeba dispar
SSMTQKQFKQEC

SEQ ID NO: 2463482 - protein, 7 aa, Entamoeba dispar
SSNAKDI

SEQ ID NO: 2463483 - protein, 9 aa, Entamoeba dispar
SSNARLTAS

SEQ ID NO: 2463484 - protein, 7 aa, Entamoeba dispar
SSNASHP

SEQ ID NO: 2463485 - protein, 8 aa, Entamoeba dispar
SSNATSDK

SEQ ID NO: 2463486 - protein, 5 aa, Entamoeba dispar
SSNCI

SEQ ID NO: 2463487 - protein, 4 aa, Entamoeba dispar
SSND

SEQ ID NO: 2463488 - protein, 7 aa, Entamoeba dispar
SSNDDIK

SEQ ID NO: 2463489 - protein, 5 aa, Entamoeba dispar
SSNDE

SEQ ID NO: 2463490 - protein, 6 aa, Entamoeba dispar
SSNDFP

SEQ ID NO: 2463491 - protein, 5 aa, Entamoeba dispar
SSNDI

SEQ ID NO: 2463492 - protein, 13 aa, Entamoeba dispar
SSNDQQTKKKPLF

SEQ ID NO: 2463493 - protein, 11 aa, Entamoeba dispar
SSNDSSIRSSL

SEQ ID NO: 2463494 - protein, 4 aa, Entamoeba dispar
SSNE

SEQ ID NO: 2463495 - protein, 7 aa, Entamoeba dispar
SSNEHNT

SEQ ID NO: 2463496 - protein, 6 aa, Entamoeba dispar
SSNEHV

SEQ ID NO: 2463497 - protein, 5 aa, Entamoeba dispar
SSNEI

SEQ ID NO: 2463498 - protein, 10 aa, Entamoeba dispar
SSNEKNKNLQ

SEQ ID NO: 2463499 - protein, 9 aa, Entamoeba dispar
SSNEQRLNE

SEQ ID NO: 2463500 - protein, 8 aa, Entamoeba dispar
SSNESSPI

SEQ ID NO: 2463501 - protein, 72 aa, Entamoeba dispar
SSNETQETNEQTNEQTNEQTNEQTNEQTNEQTQEQTQEQTQEQTEEIHQNQQTQEQNEEAQQNEQAQEQNER

SEQ ID NO: 2463502 - protein, 30 aa, Entamoeba dispar
SSNETSEYFNTSDSYGSVSFESEASEIYRD

SEQ ID NO: 2463503 - protein, 4 aa, Entamoeba dispar
SSNG

SEQ ID NO: 2463504 - protein, 5 aa, Entamoeba dispar
SSNGF

SEQ ID NO: 2463505 - protein, 11 aa, Entamoeba dispar
SSNGGKELADK

SEQ ID NO: 2463506 - protein, 11 aa, Entamoeba dispar
SSNGPNESQYK

SEQ ID NO: 2463507 - protein, 7 aa, Entamoeba dispar
SSNGSID

SEQ ID NO: 2463508 - protein, 6 aa, Entamoeba dispar
SSNGTW

SEQ ID NO: 2463509 - protein, 10 aa, Entamoeba dispar
SSNHKGHDYS

SEQ ID NO: 2463510 - protein, 75 aa, Entamoeba dispar
SSNHPDDRRLSKVSSSKKLVKEKEKKSENSEIHEAKDGSKEEFKNESINDVTRDNEETKAEGAKLEETKSIEENG

SEQ ID NO: 2463511 - protein, 16 aa, Entamoeba dispar
SSNIPKGESDDGKDYI

SEQ ID NO: 2463512 - protein, 18 aa, Entamoeba dispar
SSNISGAAWGKPTNSTLE

SEQ ID NO: 2463513 - protein, 9 aa, Entamoeba dispar
SSNITKEDI

SEQ ID NO: 2463514 - protein, 9 aa, Entamoeba dispar
SSNITSTTD

SEQ ID NO: 2463515 - protein, 7 aa, Entamoeba dispar
SSNKFYS

SEQ ID NO: 2463516 - protein, 18 aa, Entamoeba dispar
SSNKKKKETEEDSSQLRK

SEQ ID NO: 2463517 - protein, 11 aa, Entamoeba dispar
SSNKMEKGKAI

SEQ ID NO: 2463518 - protein, 9 aa, Entamoeba dispar
SSNKRPEYI

SEQ ID NO: 2463519 - protein, 9 aa, Entamoeba dispar
SSNKSPPYL

SEQ ID NO: 2463520 - protein, 6 aa, Entamoeba dispar
SSNKYN

SEQ ID NO: 2463521 - protein, 8 aa, Entamoeba dispar
SSNKYSYA

SEQ ID NO: 2463522 - protein, 5 aa, Entamoeba dispar
SSNLK

SEQ ID NO: 2463523 - protein, 32 aa, Entamoeba dispar
SSNLNSNTHNQYSEPITQPVTQEEKKDSGNSN

SEQ ID NO: 2463524 - protein, 6 aa, Entamoeba dispar
SSNLPR

SEQ ID NO: 2463525 - protein, 9 aa, Entamoeba dispar
SSNNDINGL

SEQ ID NO: 2463526 - protein, 10 aa, Entamoeba dispar
SSNNESAYDM

SEQ ID NO: 2463527 - protein, 7 aa, Entamoeba dispar
SSNNKSY

SEQ ID NO: 2463528 - protein, 5 aa, Entamoeba dispar
SSNNS

SEQ ID NO: 2463529 - protein, 9 aa, Entamoeba dispar
SSNNSPTYL

SEQ ID NO: 2463530 - protein, 6 aa, Entamoeba dispar
SSNPFS

SEQ ID NO: 2463531 - protein, 13 aa, Entamoeba dispar
SSNPPSIPSTPTK

SEQ ID NO: 2463532 - protein, 6 aa, Entamoeba dispar
SSNPRI

SEQ ID NO: 2463533 - protein, 7 aa, Entamoeba dispar
SSNPRLT

SEQ ID NO: 2463534 - protein, 9 aa, Entamoeba dispar
SSNPRLTAN

SEQ ID NO: 2463535 - protein, 9 aa, Entamoeba dispar
SSNPRLTEN

SEQ ID NO: 2463536 - protein, 9 aa, Entamoeba dispar
SSNPRLTTS

SEQ ID NO: 2463537 - protein, 4 aa, Entamoeba dispar
SSNQ

SEQ ID NO: 2463538 - protein, 15 aa, Entamoeba dispar
SSNQIPSKEQLQSAS

SEQ ID NO: 2463539 - protein, 6 aa, Entamoeba dispar
SSNQKF

SEQ ID NO: 2463540 - protein, 10 aa, Entamoeba dispar
SSNQMDSKGI

SEQ ID NO: 2463541 - protein, 6 aa, Entamoeba dispar
SSNRST

SEQ ID NO: 2463542 - protein, 5 aa, Entamoeba dispar
SSNSF

SEQ ID NO: 2463543 - protein, 7 aa, Entamoeba dispar
SSNSFSL

SEQ ID NO: 2463544 - protein, 10 aa, Entamoeba dispar
SSNSSSEDNS

SEQ ID NO: 2463545 - protein, 5 aa, Entamoeba dispar
SSNSW

SEQ ID NO: 2463546 - protein, 4 aa, Entamoeba dispar
SSNT

SEQ ID NO: 2463547 - protein, 15 aa, Entamoeba dispar
SSNTLKVRREGTRID

SEQ ID NO: 2463548 - protein, 7 aa, Entamoeba dispar
SSNTPYL

SEQ ID NO: 2463549 - protein, 6 aa, Entamoeba dispar
SSNVAT

SEQ ID NO: 2463550 - protein, 7 aa, Entamoeba dispar
SSNVGKT

SEQ ID NO: 2463551 - protein, 5 aa, Entamoeba dispar
SSNVN

SEQ ID NO: 2463552 - protein, 16 aa, Entamoeba dispar
SSNVTQDTSTKTPLPQ

SEQ ID NO: 2463553 - protein, 8 aa, Entamoeba dispar
SSNYKATV

SEQ ID NO: 2463554 - protein, 20 aa, Entamoeba dispar
SSNYKDDDKKVTGGRNGYGA

SEQ ID NO: 2463555 - protein, 10 aa, Entamoeba dispar
SSNYKSTTDP

SEQ ID NO: 2463556 - protein, 17 aa, Entamoeba dispar
SSNYNRAVNGINDDQLG

SEQ ID NO: 2463557 - protein, 4 aa, Entamoeba dispar
SSPA

SEQ ID NO: 2463558 - protein, 7 aa, Entamoeba dispar
SSPCERD

SEQ ID NO: 2463559 - protein, 15 aa, Entamoeba dispar
SSPDEGVDNTRSENE

SEQ ID NO: 2463560 - protein, 23 aa, Entamoeba dispar
SSPDLTASYNSLTKSTQLSVNTK

SEQ ID NO: 2463561 - protein, 8 aa, Entamoeba dispar
SSPDPMTH

SEQ ID NO: 2463562 - protein, 7 aa, Entamoeba dispar
SSPDTIQ

SEQ ID NO: 2463563 - protein, 8 aa, Entamoeba dispar
SSPENSRN

SEQ ID NO: 2463564 - protein, 14 aa, Entamoeba dispar
SSPHYSKSKEEIIK

SEQ ID NO: 2463565 - protein, 9 aa, Entamoeba dispar
SSPKASDQL

SEQ ID NO: 2463566 - protein, 40 aa, Entamoeba dispar
SSPKHFSQLSSSTSSSISKPIEIQSDSKEKNDPELPKPRK

SEQ ID NO: 2463567 - protein, 15 aa, Entamoeba dispar
SSPKMRDLPTTEEIT

SEQ ID NO: 2463568 - protein, 7 aa, Entamoeba dispar
SSPKNSI

SEQ ID NO: 2463569 - protein, 21 aa, Entamoeba dispar
SSPKQTKEVVKKNKKPNQTRN

SEQ ID NO: 2463570 - protein, 5 aa, Entamoeba dispar
SSPLD

SEQ ID NO: 2463571 - protein, 27 aa, Entamoeba dispar
SSPLESHSARARSISPKTIYSPTIPTE

SEQ ID NO: 2463572 - protein, 15 aa, Entamoeba dispar
SSPLIPDDHQPQKKI

SEQ ID NO: 2463573 - protein, 6 aa, Entamoeba dispar
SSPLLQ

SEQ ID NO: 2463574 - protein, 5 aa, Entamoeba dispar
SSPLY

SEQ ID NO: 2463575 - protein, 8 aa, Entamoeba dispar
SSPNESQI

SEQ ID NO: 2463576 - protein, 7 aa, Entamoeba dispar
SSPNGIE

SEQ ID NO: 2463577 - protein, 7 aa, Entamoeba dispar
SSPPLET

SEQ ID NO: 2463578 - protein, 20 aa, Entamoeba dispar
SSPPVQTKSEQSWKSDTNPY

SEQ ID NO: 2463579 - protein, 10 aa, Entamoeba dispar
SSPQKRSESI

SEQ ID NO: 2463580 - protein, 13 aa, Entamoeba dispar
SSPSDDETTPKTA

SEQ ID NO: 2463581 - protein, 11 aa, Entamoeba dispar
SSPSESEEEEI

SEQ ID NO: 2463582 - protein, 9 aa, Entamoeba dispar
SSPSGKTKF

SEQ ID NO: 2463583 - protein, 8 aa, Entamoeba dispar
SSPSNNEQ

SEQ ID NO: 2463584 - protein, 8 aa, Entamoeba dispar
SSPSNTIV

SEQ ID NO: 2463585 - protein, 16 aa, Entamoeba dispar
SSPSPREKDVKACEDS

SEQ ID NO: 2463586 - protein, 20 aa, Entamoeba dispar
SSPSTQNKLSTQNALDILLF

SEQ ID NO: 2463587 - protein, 7 aa, Entamoeba dispar
SSPSVVK

SEQ ID NO: 2463588 - protein, 31 aa, Entamoeba dispar
SSPTDSDGDQSPSDVFTSNAQNIKRSKPMKL

SEQ ID NO: 2463589 - protein, 6 aa, Entamoeba dispar
SSPTLE

SEQ ID NO: 2463590 - protein, 5 aa, Entamoeba dispar
SSPTQ

SEQ ID NO: 2463591 - protein, 12 aa, Entamoeba dispar
SSPTQCSSCSKG

SEQ ID NO: 2463592 - protein, 6 aa, Entamoeba dispar
SSPTSL

SEQ ID NO: 2463593 - protein, 7 aa, Entamoeba dispar
SSPTSLI

SEQ ID NO: 2463594 - protein, 18 aa, Entamoeba dispar
SSPVEGKRKTQKPRQLHN

SEQ ID NO: 2463595 - protein, 10 aa, Entamoeba dispar
SSPVSSSKTA

SEQ ID NO: 2463596 - protein, 4 aa, Entamoeba dispar
SSPY

SEQ ID NO: 2463597 - protein, 9 aa, Entamoeba dispar
SSPYKSSHE

SEQ ID NO: 2463598 - protein, 5 aa, Entamoeba dispar
SSPYR

SEQ ID NO: 2463599 - protein, 8 aa, Entamoeba dispar
SSQAALDG

SEQ ID NO: 2463600 - protein, 8 aa, Entamoeba dispar
SSQCPQGF

SEQ ID NO: 2463601 - protein, 7 aa, Entamoeba dispar
SSQDDAM

SEQ ID NO: 2463602 - protein, 8 aa, Entamoeba dispar
SSQDITKT

SEQ ID NO: 2463603 - protein, 9 aa, Entamoeba dispar
SSQEDKEKY

SEQ ID NO: 2463604 - protein, 16 aa, Entamoeba dispar
SSQELKEREEVQPVKG

SEQ ID NO: 2463605 - protein, 12 aa, Entamoeba dispar
SSQEQIKASQCR

SEQ ID NO: 2463606 - protein, 6 aa, Entamoeba dispar
SSQFDY

SEQ ID NO: 2463607 - protein, 5 aa, Entamoeba dispar
SSQGY

SEQ ID NO: 2463608 - protein, 4 aa, Entamoeba dispar
SSQH

SEQ ID NO: 2463609 - protein, 12 aa, Entamoeba dispar
SSQIKESDLDKT

SEQ ID NO: 2463610 - protein, 5 aa, Entamoeba dispar
SSQIT

SEQ ID NO: 2463611 - protein, 16 aa, Entamoeba dispar
SSQKQQYNWCDAFSNL

SEQ ID NO: 2463612 - protein, 6 aa, Entamoeba dispar
SSQLKS

SEQ ID NO: 2463613 - protein, 7 aa, Entamoeba dispar
SSQNNLA

SEQ ID NO: 2463614 - protein, 18 aa, Entamoeba dispar
SSQPATGITSSRSKIDEQ

SEQ ID NO: 2463615 - protein, 7 aa, Entamoeba dispar
SSQPGFI

SEQ ID NO: 2463616 - protein, 7 aa, Entamoeba dispar
SSQPGVQ

SEQ ID NO: 2463617 - protein, 16 aa, Entamoeba dispar
SSQPKTGFTGKSDEDV

SEQ ID NO: 2463618 - protein, 16 aa, Entamoeba dispar
SSQPTPSTQQEKKGDF

SEQ ID NO: 2463619 - protein, 4 aa, Entamoeba dispar
SSQQ

SEQ ID NO: 2463620 - protein, 11 aa, Entamoeba dispar
SSQQPYSQQSS

SEQ ID NO: 2463621 - protein, 8 aa, Entamoeba dispar
SSQQTKIK

SEQ ID NO: 2463622 - protein, 8 aa, Entamoeba dispar
SSQQTPVP

SEQ ID NO: 2463623 - protein, 10 aa, Entamoeba dispar
SSQRLTDKSI

SEQ ID NO: 2463624 - protein, 8 aa, Entamoeba dispar
SSQRYRTK

SEQ ID NO: 2463625 - protein, 10 aa, Entamoeba dispar
SSQSEKQEKL

SEQ ID NO: 2463626 - protein, 28 aa, Entamoeba dispar
SSQSFDSRNSRNRSRERSYSRSSSRDKD

SEQ ID NO: 2463627 - protein, 8 aa, Entamoeba dispar
SSQSGFDK

SEQ ID NO: 2463628 - protein, 12 aa, Entamoeba dispar
SSQSLEKKEGII

SEQ ID NO: 2463629 - protein, 8 aa, Entamoeba dispar
SSQSLNES

SEQ ID NO: 2463630 - protein, 15 aa, Entamoeba dispar
SSQSPSDSITTTYSS

SEQ ID NO: 2463631 - protein, 6 aa, Entamoeba dispar
SSQSTM

SEQ ID NO: 2463632 - protein, 4 aa, Entamoeba dispar
SSQT

SEQ ID NO: 2463633 - protein, 8 aa, Entamoeba dispar
SSQTSSGH

SEQ ID NO: 2463634 - protein, 4 aa, Entamoeba dispar
SSQV

SEQ ID NO: 2463635 - protein, 5 aa, Entamoeba dispar
SSQYS

SEQ ID NO: 2463636 - protein, 8 aa, Entamoeba dispar
SSRCNSFN

SEQ ID NO: 2463637 - protein, 20 aa, Entamoeba dispar
SSRDGLSKKGVQNSIKNKSN

SEQ ID NO: 2463638 - protein, 12 aa, Entamoeba dispar
SSREITAASDET

SEQ ID NO: 2463639 - protein, 31 aa, Entamoeba dispar
SSRESLSDVSNSQGRIGNGKEGAPDLGNASL

SEQ ID NO: 2463640 - protein, 8 aa, Entamoeba dispar
SSREVAKA

SEQ ID NO: 2463641 - protein, 14 aa, Entamoeba dispar
SSREVQRESIPQEK

SEQ ID NO: 2463642 - protein, 13 aa, Entamoeba dispar
SSRGADSSGNVSN

SEQ ID NO: 2463643 - protein, 20 aa, Entamoeba dispar
SSRISRDNYELKPELDFEKR

SEQ ID NO: 2463644 - protein, 11 aa, Entamoeba dispar
SSRITTGSLNE

SEQ ID NO: 2463645 - protein, 5 aa, Entamoeba dispar
SSRKT

SEQ ID NO: 2463646 - protein, 5 aa, Entamoeba dispar
SSRLV

SEQ ID NO: 2463647 - protein, 4 aa, Entamoeba dispar
SSRN

SEQ ID NO: 2463648 - protein, 24 aa, Entamoeba dispar
SSRNEHIEEESEEEDNEKIQPDGP

SEQ ID NO: 2463649 - protein, 7 aa, Entamoeba dispar
SSRNHFS

SEQ ID NO: 2463650 - protein, 4 aa, Entamoeba dispar
SSRQ

SEQ ID NO: 2463651 - protein, 4 aa, Entamoeba dispar
SSRR

SEQ ID NO: 2463652 - protein, 10 aa, Entamoeba dispar
SSRRKELSEK

SEQ ID NO: 2463653 - protein, 9 aa, Entamoeba dispar
SSRRREGLG

SEQ ID NO: 2463654 - protein, 43 aa, Entamoeba dispar
SSRSTSRDDRHHSHRYSDSRKSSSKRDESIREKSPEKNEEEHS

SEQ ID NO: 2463655 - protein, 4 aa, Entamoeba dispar
SSRV

SEQ ID NO: 2463656 - protein, 6 aa, Entamoeba dispar
SSRVGN

SEQ ID NO: 2463657 - protein, 20 aa, Entamoeba dispar
SSSAPSGRYNPTRDSFFVVK

SEQ ID NO: 2463658 - protein, 8 aa, Entamoeba dispar
SSSAPTYF

SEQ ID NO: 2463659 - protein, 4 aa, Entamoeba dispar
SSSC

SEQ ID NO: 2463660 - protein, 7 aa, Entamoeba dispar
SSSCETE

SEQ ID NO: 2463661 - protein, 4 aa, Entamoeba dispar
SSSD

SEQ ID NO: 2463662 - protein, 9 aa, Entamoeba dispar
SSSDDYKSA

SEQ ID NO: 2463663 - protein, 10 aa, Entamoeba dispar
SSSDNFPREE

SEQ ID NO: 2463664 - protein, 9 aa, Entamoeba dispar
SSSDNTRKV

SEQ ID NO: 2463665 - protein, 9 aa, Entamoeba dispar
SSSDPNRIA

SEQ ID NO: 2463666 - protein, 11 aa, Entamoeba dispar
SSSDSSLSSLS

SEQ ID NO: 2463667 - protein, 6 aa, Entamoeba dispar
SSSEEI

SEQ ID NO: 2463668 - protein, 10 aa, Entamoeba dispar
SSSEERTTHF

SEQ ID NO: 2463669 - protein, 8 aa, Entamoeba dispar
SSSEGNGL

SEQ ID NO: 2463670 - protein, 9 aa, Entamoeba dispar
SSSEHEAIK

SEQ ID NO: 2463671 - protein, 8 aa, Entamoeba dispar
SSSELTKR

SEQ ID NO: 2463672 - protein, 6 aa, Entamoeba dispar
SSSEPF

SEQ ID NO: 2463673 - protein, 9 aa, Entamoeba dispar
SSSEPTIST

SEQ ID NO: 2463674 - protein, 10 aa, Entamoeba dispar
SSSEQKSYIK

SEQ ID NO: 2463675 - protein, 5 aa, Entamoeba dispar
SSSEV

SEQ ID NO: 2463676 - protein, 5 aa, Entamoeba dispar
SSSFG

SEQ ID NO: 2463677 - protein, 17 aa, Entamoeba dispar
SSSFSESLPSNKNKFNS

SEQ ID NO: 2463678 - protein, 9 aa, Entamoeba dispar
SSSGKTKFT

SEQ ID NO: 2463679 - protein, 14 aa, Entamoeba dispar
SSSGSIDEQGNEKY

SEQ ID NO: 2463680 - protein, 9 aa, Entamoeba dispar
SSSHEDETK

SEQ ID NO: 2463681 - protein, 8 aa, Entamoeba dispar
SSSHHTPH

SEQ ID NO: 2463682 - protein, 16 aa, Entamoeba dispar
SSSIDSEISSTSNRGI

SEQ ID NO: 2463683 - protein, 9 aa, Entamoeba dispar
SSSIGDGSR

SEQ ID NO: 2463684 - protein, 10 aa, Entamoeba dispar
SSSIGPKKRM

SEQ ID NO: 2463685 - protein, 9 aa, Entamoeba dispar
SSSIKGNPI

SEQ ID NO: 2463686 - protein, 9 aa, Entamoeba dispar
SSSIKPTVQ

SEQ ID NO: 2463687 - protein, 7 aa, Entamoeba dispar
SSSIVTS

SEQ ID NO: 2463688 - protein, 7 aa, Entamoeba dispar
SSSKGKV

SEQ ID NO: 2463689 - protein, 5 aa, Entamoeba dispar
SSSKL

SEQ ID NO: 2463690 - protein, 8 aa, Entamoeba dispar
SSSKTDGV

SEQ ID NO: 2463691 - protein, 7 aa, Entamoeba dispar
SSSLDGT

SEQ ID NO: 2463692 - protein, 7 aa, Entamoeba dispar
SSSLSQE

SEQ ID NO: 2463693 - protein, 15 aa, Entamoeba dispar
SSSLTPTKGLPELKK

SEQ ID NO: 2463694 - protein, 9 aa, Entamoeba dispar
SSSLTRDSK

SEQ ID NO: 2463695 - protein, 5 aa, Entamoeba dispar
SSSNA

SEQ ID NO: 2463696 - protein, 7 aa, Entamoeba dispar
SSSNDIN

SEQ ID NO: 2463697 - protein, 16 aa, Entamoeba dispar
SSSNDTIGCGYNTKTK

SEQ ID NO: 2463698 - protein, 7 aa, Entamoeba dispar
SSSNDVK

SEQ ID NO: 2463699 - protein, 8 aa, Entamoeba dispar
SSSNEPIE

SEQ ID NO: 2463700 - protein, 6 aa, Entamoeba dispar
SSSNEQ

SEQ ID NO: 2463701 - protein, 8 aa, Entamoeba dispar
SSSNGFEG

SEQ ID NO: 2463702 - protein, 8 aa, Entamoeba dispar
SSSNNNYQ

SEQ ID NO: 2463703 - protein, 8 aa, Entamoeba dispar
SSSNNTCA

SEQ ID NO: 2463704 - protein, 8 aa, Entamoeba dispar
SSSNPFQL

SEQ ID NO: 2463705 - protein, 8 aa, Entamoeba dispar
SSSNSSVS

SEQ ID NO: 2463706 - protein, 11 aa, Entamoeba dispar
SSSNTSAATNV

SEQ ID NO: 2463707 - protein, 4 aa, Entamoeba dispar
SSSP

SEQ ID NO: 2463708 - protein, 6 aa, Entamoeba dispar
SSSPDI

SEQ ID NO: 2463709 - protein, 5 aa, Entamoeba dispar
SSSPE

SEQ ID NO: 2463710 - protein, 14 aa, Entamoeba dispar
SSSPENHEPSITNT

SEQ ID NO: 2463711 - protein, 6 aa, Entamoeba dispar
SSSPID

SEQ ID NO: 2463712 - protein, 6 aa, Entamoeba dispar
SSSPII

SEQ ID NO: 2463713 - protein, 7 aa, Entamoeba dispar
SSSPIQQ

SEQ ID NO: 2463714 - protein, 18 aa, Entamoeba dispar
SSSPLSSPGLSKHGKEDY

SEQ ID NO: 2463715 - protein, 6 aa, Entamoeba dispar
SSSPMV

SEQ ID NO: 2463716 - protein, 8 aa, Entamoeba dispar
SSSPNEAI

SEQ ID NO: 2463717 - protein, 6 aa, Entamoeba dispar
SSSPPT

SEQ ID NO: 2463718 - protein, 28 aa, Entamoeba dispar
SSSPRMAYSASPRSRKPAIYRGTPPTFT

SEQ ID NO: 2463719 - protein, 9 aa, Entamoeba dispar
SSSPSKYSS

SEQ ID NO: 2463720 - protein, 15 aa, Entamoeba dispar
SSSPSQDDSPTPNIA

SEQ ID NO: 2463721 - protein, 6 aa, Entamoeba dispar
SSSPSY

SEQ ID NO: 2463722 - protein, 21 aa, Entamoeba dispar
SSSPVKSSPSSSSSQQQQSTN

SEQ ID NO: 2463723 - protein, 8 aa, Entamoeba dispar
SSSQEITP

SEQ ID NO: 2463724 - protein, 23 aa, Entamoeba dispar
SSSQLESKTKNIDELKTKELTTE

SEQ ID NO: 2463725 - protein, 9 aa, Entamoeba dispar
SSSQLSLSP

SEQ ID NO: 2463726 - protein, 9 aa, Entamoeba dispar
SSSQTQPLR

SEQ ID NO: 2463727 - protein, 9 aa, Entamoeba dispar
SSSSEEEEL

SEQ ID NO: 2463728 - protein, 17 aa, Entamoeba dispar
SSSSGNTSETTPTNQDN

SEQ ID NO: 2463729 - protein, 7 aa, Entamoeba dispar
SSSSIPP

SEQ ID NO: 2463730 - protein, 9 aa, Entamoeba dispar
SSSSKEKEV

SEQ ID NO: 2463731 - protein, 7 aa, Entamoeba dispar
SSSSKYP

SEQ ID NO: 2463732 - protein, 5 aa, Entamoeba dispar
SSSSN

SEQ ID NO: 2463733 - protein, 15 aa, Entamoeba dispar
SSSSNEKKKKKDKKK

SEQ ID NO: 2463734 - protein, 8 aa, Entamoeba dispar
SSSSPSFI

SEQ ID NO: 2463735 - protein, 224 aa, Entamoeba dispar
SSSSSAKTSQQSSAKPAQQYPGPQQGAQQGYGAYPGYPQQQYPGYPPQGQQQYPGYPPQQPGAPVQQQYPGYPQQAPQGQQQYPGYPQQGYGAYPGYPQQAPQSQQQYPGYPPQQPRAPTQQQPQGSSGKPATQPGAPAQQQYPGYPQQGGYPQQGGYPQQAPQGQQYSAPQQPGAPAQQQYPGYPQQGYGAYPGYPQQGVQGQQPGYPQQGYGAYPGYPQQPP

SEQ ID NO: 2463736 - protein, 52 aa, Entamoeba dispar
SSSSSEQSEGEEEFDEEDEDEDEYEQECPTTGMKHPPQVNSYGDALKPGKDA

SEQ ID NO: 2463737 - protein, 11 aa, Entamoeba dispar
SSSSSVVTPSS

SEQ ID NO: 2463738 - protein, 21 aa, Entamoeba dispar
SSSTFNSSTPTKTQSGSELKQ

SEQ ID NO: 2463739 - protein, 11 aa, Entamoeba dispar
SSSTGLKVGGY

SEQ ID NO: 2463740 - protein, 7 aa, Entamoeba dispar
SSSTNQF

SEQ ID NO: 2463741 - protein, 6 aa, Entamoeba dispar
SSSTTK

SEQ ID NO: 2463742 - protein, 8 aa, Entamoeba dispar
SSSTVPTI

SEQ ID NO: 2463743 - protein, 14 aa, Entamoeba dispar
SSSVGATRNDKKTA

SEQ ID NO: 2463744 - protein, 10 aa, Entamoeba dispar
SSSVIQTKNY

SEQ ID NO: 2463745 - protein, 6 aa, Entamoeba dispar
SSSVPQ

SEQ ID NO: 2463746 - protein, 7 aa, Entamoeba dispar
SSSVSKL

SEQ ID NO: 2463747 - protein, 37 aa, Entamoeba dispar
SSSVTRDISRSTSKQRNTSTLSEGRDDTQSNSIKEGM

SEQ ID NO: 2463748 - protein, 7 aa, Entamoeba dispar
SSSYEIT

SEQ ID NO: 2463749 - protein, 4 aa, Entamoeba dispar
SSTA

SEQ ID NO: 2463750 - protein, 11 aa, Entamoeba dispar
SSTAASISNTF

SEQ ID NO: 2463751 - protein, 8 aa, Entamoeba dispar
SSTADGLD

SEQ ID NO: 2463752 - protein, 9 aa, Entamoeba dispar
SSTDGLTAH

SEQ ID NO: 2463753 - protein, 17 aa, Entamoeba dispar
SSTDGVSTNQRYNLTES

SEQ ID NO: 2463754 - protein, 8 aa, Entamoeba dispar
SSTDPIIN

SEQ ID NO: 2463755 - protein, 6 aa, Entamoeba dispar
SSTEGL

SEQ ID NO: 2463756 - protein, 10 aa, Entamoeba dispar
SSTESQPKVI

SEQ ID NO: 2463757 - protein, 6 aa, Entamoeba dispar
SSTGTV

SEQ ID NO: 2463758 - protein, 4 aa, Entamoeba dispar
SSTI

SEQ ID NO: 2463759 - protein, 14 aa, Entamoeba dispar
SSTIQESMGNIDSS

SEQ ID NO: 2463760 - protein, 7 aa, Entamoeba dispar
SSTISDL

SEQ ID NO: 2463761 - protein, 5 aa, Entamoeba dispar
SSTKE

SEQ ID NO: 2463762 - protein, 7 aa, Entamoeba dispar
SSTKGIG

SEQ ID NO: 2463763 - protein, 6 aa, Entamoeba dispar
SSTKLG

SEQ ID NO: 2463764 - protein, 6 aa, Entamoeba dispar
SSTKTM

SEQ ID NO: 2463765 - protein, 5 aa, Entamoeba dispar
SSTLN

SEQ ID NO: 2463766 - protein, 12 aa, Entamoeba dispar
SSTLQNNNSSLN

SEQ ID NO: 2463767 - protein, 20 aa, Entamoeba dispar
SSTLSESTSLSRKHSRRGSI

SEQ ID NO: 2463768 - protein, 6 aa, Entamoeba dispar
SSTNFK

SEQ ID NO: 2463769 - protein, 5 aa, Entamoeba dispar
SSTNM

SEQ ID NO: 2463770 - protein, 7 aa, Entamoeba dispar
SSTNSTI

SEQ ID NO: 2463771 - protein, 11 aa, Entamoeba dispar
SSTNTTPLNPN

SEQ ID NO: 2463772 - protein, 7 aa, Entamoeba dispar
SSTNTYK

SEQ ID NO: 2463773 - protein, 8 aa, Entamoeba dispar
SSTPDENR

SEQ ID NO: 2463774 - protein, 7 aa, Entamoeba dispar
SSTPLKD

SEQ ID NO: 2463775 - protein, 13 aa, Entamoeba dispar
SSTPRSPTSPIIP

SEQ ID NO: 2463776 - protein, 8 aa, Entamoeba dispar
SSTPSPLV

SEQ ID NO: 2463777 - protein, 9 aa, Entamoeba dispar
SSTPSPYEP

SEQ ID NO: 2463778 - protein, 10 aa, Entamoeba dispar
SSTPTDGDSI

SEQ ID NO: 2463779 - protein, 7 aa, Entamoeba dispar
SSTPTKI

SEQ ID NO: 2463780 - protein, 10 aa, Entamoeba dispar
SSTQNETPFS

SEQ ID NO: 2463781 - protein, 8 aa, Entamoeba dispar
SSTSFTEK

SEQ ID NO: 2463782 - protein, 6 aa, Entamoeba dispar
SSTSLQ

SEQ ID NO: 2463783 - protein, 10 aa, Entamoeba dispar
SSTSNCNGKY

SEQ ID NO: 2463784 - protein, 5 aa, Entamoeba dispar
SSTSR

SEQ ID NO: 2463785 - protein, 6 aa, Entamoeba dispar
SSTSSF

SEQ ID NO: 2463786 - protein, 34 aa, Entamoeba dispar
SSTSSSSLSEEKLKKLSKKKKKLSKKKKKQSCII

SEQ ID NO: 2463787 - protein, 9 aa, Entamoeba dispar
SSTSVDTRV

SEQ ID NO: 2463788 - protein, 36 aa, Entamoeba dispar
SSTSYSTNGRTMTTSEITETTEIQQNETIVFNGFWL

SEQ ID NO: 2463789 - protein, 9 aa, Entamoeba dispar
SSTTAEPYE

SEQ ID NO: 2463790 - protein, 7 aa, Entamoeba dispar
SSTTELS

SEQ ID NO: 2463791 - protein, 5 aa, Entamoeba dispar
SSTTH

SEQ ID NO: 2463792 - protein, 5 aa, Entamoeba dispar
SSTTK

SEQ ID NO: 2463793 - protein, 8 aa, Entamoeba dispar
SSTTLQTR

SEQ ID NO: 2463794 - protein, 22 aa, Entamoeba dispar
SSTTQGIAETINGDEAEERKRD

SEQ ID NO: 2463795 - protein, 6 aa, Entamoeba dispar
SSTTQI

SEQ ID NO: 2463796 - protein, 5 aa, Entamoeba dispar
SSTTT

SEQ ID NO: 2463797 - protein, 7 aa, Entamoeba dispar
SSTTTRW

SEQ ID NO: 2463798 - protein, 6 aa, Entamoeba dispar
SSTVSP

SEQ ID NO: 2463799 - protein, 5 aa, Entamoeba dispar
SSVDL

SEQ ID NO: 2463800 - protein, 5 aa, Entamoeba dispar
SSVEY

SEQ ID NO: 2463801 - protein, 6 aa, Entamoeba dispar
SSVEYH

SEQ ID NO: 2463802 - protein, 10 aa, Entamoeba dispar
SSVFSSPSSL

SEQ ID NO: 2463803 - protein, 10 aa, Entamoeba dispar
SSVGKTSITQ

SEQ ID NO: 2463804 - protein, 8 aa, Entamoeba dispar
SSVKTSSD

SEQ ID NO: 2463805 - protein, 6 aa, Entamoeba dispar
SSVLKE

SEQ ID NO: 2463806 - protein, 6 aa, Entamoeba dispar
SSVNDR

SEQ ID NO: 2463807 - protein, 5 aa, Entamoeba dispar
SSVNE

SEQ ID NO: 2463808 - protein, 9 aa, Entamoeba dispar
SSVPGEGEH

SEQ ID NO: 2463809 - protein, 5 aa, Entamoeba dispar
SSVPT

SEQ ID NO: 2463810 - protein, 13 aa, Entamoeba dispar
SSVRDMKEKIEPK

SEQ ID NO: 2463811 - protein, 6 aa, Entamoeba dispar
SSVRQA

SEQ ID NO: 2463812 - protein, 6 aa, Entamoeba dispar
SSVRTI

SEQ ID NO: 2463813 - protein, 4 aa, Entamoeba dispar
SSVS

SEQ ID NO: 2463814 - protein, 10 aa, Entamoeba dispar
SSVSASDIAG

SEQ ID NO: 2463815 - protein, 7 aa, Entamoeba dispar
SSVSELG

SEQ ID NO: 2463816 - protein, 9 aa, Entamoeba dispar
SSVSESSPY

SEQ ID NO: 2463817 - protein, 6 aa, Entamoeba dispar
SSVSKF

SEQ ID NO: 2463818 - protein, 7 aa, Entamoeba dispar
SSVSNND

SEQ ID NO: 2463819 - protein, 6 aa, Entamoeba dispar
SSVSTL

SEQ ID NO: 2463820 - protein, 11 aa, Entamoeba dispar
SSVVEKKGLHT

SEQ ID NO: 2463821 - protein, 9 aa, Entamoeba dispar
SSWKTKEDV

SEQ ID NO: 2463822 - protein, 9 aa, Entamoeba dispar
SSWSENDDS

SEQ ID NO: 2463823 - protein, 5 aa, Entamoeba dispar
SSYAG

SEQ ID NO: 2463824 - protein, 8 aa, Entamoeba dispar
SSYDVPKM

SEQ ID NO: 2463825 - protein, 4 aa, Entamoeba dispar
SSYE

SEQ ID NO: 2463826 - protein, 7 aa, Entamoeba dispar
SSYEGGI

SEQ ID NO: 2463827 - protein, 5 aa, Entamoeba dispar
SSYEI

SEQ ID NO: 2463828 - protein, 7 aa, Entamoeba dispar
SSYENNY

SEQ ID NO: 2463829 - protein, 4 aa, Entamoeba dispar
SSYG

SEQ ID NO: 2463830 - protein, 7 aa, Entamoeba dispar
SSYGKRK

SEQ ID NO: 2463831 - protein, 10 aa, Entamoeba dispar
SSYGKTIQKP

SEQ ID NO: 2463832 - protein, 5 aa, Entamoeba dispar
SSYIP

SEQ ID NO: 2463833 - protein, 4 aa, Entamoeba dispar
SSYK

SEQ ID NO: 2463834 - protein, 11 aa, Entamoeba dispar
SSYKNLKSDSF

SEQ ID NO: 2463835 - protein, 7 aa, Entamoeba dispar
SSYNETP

SEQ ID NO: 2463836 - protein, 6 aa, Entamoeba dispar
SSYNNF

SEQ ID NO: 2463837 - protein, 9 aa, Entamoeba dispar
SSYPPTKGW

SEQ ID NO: 2463838 - protein, 9 aa, Entamoeba dispar
SSYPSSAAK

SEQ ID NO: 2463839 - protein, 9 aa, Entamoeba dispar
SSYRAEADT

SEQ ID NO: 2463840 - protein, 15 aa, Entamoeba dispar
SSYSNKNILNSSKED

SEQ ID NO: 2463841 - protein, 49 aa, Entamoeba dispar
SSYSNQPQEELTKGETTEIDGNIQENKKPVVEEEGLPKQEETKEKAQVE

SEQ ID NO: 2463842 - protein, 11 aa, Entamoeba dispar
SSYSNSPYCQP

SEQ ID NO: 2463843 - protein, 11 aa, Entamoeba dispar
SSYSPKPIDKN

SEQ ID NO: 2463844 - protein, 5 aa, Entamoeba dispar
SSYSQ

SEQ ID NO: 2463845 - protein, 15 aa, Entamoeba dispar
SSYTSNYQQHSFESN

SEQ ID NO: 2463846 - protein, 8 aa, Entamoeba dispar
SSYTYPSP

SEQ ID NO: 2463847 - protein, 6 aa, Entamoeba dispar
SSYVES

SEQ ID NO: 2463848 - protein, 8 aa, Entamoeba dispar
SSYYKGTQ

SEQ ID NO: 2463849 - protein, 6 aa, Entamoeba dispar
STADDI

SEQ ID NO: 2463850 - protein, 9 aa, Entamoeba dispar
STAGPEITS

SEQ ID NO: 2463851 - protein, 8 aa, Entamoeba dispar
STAIDPSM

SEQ ID NO: 2463852 - protein, 5 aa, Entamoeba dispar
STALK

SEQ ID NO: 2463853 - protein, 5 aa, Entamoeba dispar
STAPI

SEQ ID NO: 2463854 - protein, 4 aa, Entamoeba dispar
STAQ

SEQ ID NO: 2463855 - protein, 6 aa, Entamoeba dispar
STARSP

SEQ ID NO: 2463856 - protein, 12 aa, Entamoeba dispar
STATEPELCSDT

SEQ ID NO: 2463857 - protein, 9 aa, Entamoeba dispar
STATTAQAE

SEQ ID NO: 2463858 - protein, 4 aa, Entamoeba dispar
STCK

SEQ ID NO: 2463859 - protein, 17 aa, Entamoeba dispar
STCKSDEQLKSQPPSSQ

SEQ ID NO: 2463860 - protein, 22 aa, Entamoeba dispar
STDAINEHEEKLRKTNKQFDSA

SEQ ID NO: 2463861 - protein, 20 aa, Entamoeba dispar
STDAITEHENKLRKSNKQFE

SEQ ID NO: 2463862 - protein, 7 aa, Entamoeba dispar
STDDSSS

SEQ ID NO: 2463863 - protein, 4 aa, Entamoeba dispar
STDE

SEQ ID NO: 2463864 - protein, 8 aa, Entamoeba dispar
STDENGKR

SEQ ID NO: 2463865 - protein, 8 aa, Entamoeba dispar
STDGPSRT

SEQ ID NO: 2463866 - protein, 5 aa, Entamoeba dispar
STDHE

SEQ ID NO: 2463867 - protein, 14 aa, Entamoeba dispar
STDKHKEDVKPAFE

SEQ ID NO: 2463868 - protein, 14 aa, Entamoeba dispar
STDKTGRGKIEING

SEQ ID NO: 2463869 - protein, 4 aa, Entamoeba dispar
STDN

SEQ ID NO: 2463870 - protein, 6 aa, Entamoeba dispar
STDPGV

SEQ ID NO: 2463871 - protein, 12 aa, Entamoeba dispar
STDSDKYPVSEG

SEQ ID NO: 2463872 - protein, 8 aa, Entamoeba dispar
STDSKENP

SEQ ID NO: 2463873 - protein, 7 aa, Entamoeba dispar
STDSQWS

SEQ ID NO: 2463874 - protein, 10 aa, Entamoeba dispar
STDSSINKYK

SEQ ID NO: 2463875 - protein, 6 aa, Entamoeba dispar
STEDDS

SEQ ID NO: 2463876 - protein, 10 aa, Entamoeba dispar
STEDEQLEDK

SEQ ID NO: 2463877 - protein, 5 aa, Entamoeba dispar
STEDI

SEQ ID NO: 2463878 - protein, 36 aa, Entamoeba dispar
STEEARKKSIDLKDKKEKKQNEENGEKKSSHTKKPI

SEQ ID NO: 2463879 - protein, 8 aa, Entamoeba dispar
STEEDPSF

SEQ ID NO: 2463880 - protein, 8 aa, Entamoeba dispar
STEEDPSV

SEQ ID NO: 2463881 - protein, 14 aa, Entamoeba dispar
STEEGFVGDEERRE

SEQ ID NO: 2463882 - protein, 15 aa, Entamoeba dispar
STEEGFVGDEERREI

SEQ ID NO: 2463883 - protein, 13 aa, Entamoeba dispar
STEEGQKFSNEGN

SEQ ID NO: 2463884 - protein, 6 aa, Entamoeba dispar
STEEHT

SEQ ID NO: 2463885 - protein, 7 aa, Entamoeba dispar
STEELDR

SEQ ID NO: 2463886 - protein, 10 aa, Entamoeba dispar
STEELQSNAT

SEQ ID NO: 2463887 - protein, 9 aa, Entamoeba dispar
STEESNVNK

SEQ ID NO: 2463888 - protein, 8 aa, Entamoeba dispar
STEESYAR

SEQ ID NO: 2463889 - protein, 5 aa, Entamoeba dispar
STEFI

SEQ ID NO: 2463890 - protein, 6 aa, Entamoeba dispar
STEFKP

SEQ ID NO: 2463891 - protein, 6 aa, Entamoeba dispar
STEFTQ

SEQ ID NO: 2463892 - protein, 5 aa, Entamoeba dispar
STEGI

SEQ ID NO: 2463893 - protein, 15 aa, Entamoeba dispar
STEGIVTGQSENTEN

SEQ ID NO: 2463894 - protein, 6 aa, Entamoeba dispar
STEGNA

SEQ ID NO: 2463895 - protein, 9 aa, Entamoeba dispar
STEGSEDYA

SEQ ID NO: 2463896 - protein, 7 aa, Entamoeba dispar
STEIPSI

SEQ ID NO: 2463897 - protein, 4 aa, Entamoeba dispar
STEK

SEQ ID NO: 2463898 - protein, 7 aa, Entamoeba dispar
STEKWEE

SEQ ID NO: 2463899 - protein, 5 aa, Entamoeba dispar
STENG

SEQ ID NO: 2463900 - protein, 8 aa, Entamoeba dispar
STENSSNT

SEQ ID NO: 2463901 - protein, 7 aa, Entamoeba dispar
STENVQT

SEQ ID NO: 2463902 - protein, 10 aa, Entamoeba dispar
STEPSESYKA

SEQ ID NO: 2463903 - protein, 19 aa, Entamoeba dispar
STEPTTNENQHHKKNYYEQ

SEQ ID NO: 2463904 - protein, 4 aa, Entamoeba dispar
STEQ

SEQ ID NO: 2463905 - protein, 23 aa, Entamoeba dispar
STEQKGKTTSSAPLVDNKGSEEM

SEQ ID NO: 2463906 - protein, 10 aa, Entamoeba dispar
STEQNIPPAQ

SEQ ID NO: 2463907 - protein, 10 aa, Entamoeba dispar
STERKSDVAQ

SEQ ID NO: 2463908 - protein, 5 aa, Entamoeba dispar
STERL

SEQ ID NO: 2463909 - protein, 8 aa, Entamoeba dispar
STESARQW

SEQ ID NO: 2463910 - protein, 8 aa, Entamoeba dispar
STESGTTA

SEQ ID NO: 2463911 - protein, 5 aa, Entamoeba dispar
STESH

SEQ ID NO: 2463912 - protein, 7 aa, Entamoeba dispar
STESYAN

SEQ ID NO: 2463913 - protein, 8 aa, Entamoeba dispar
STETPVNE

SEQ ID NO: 2463914 - protein, 5 aa, Entamoeba dispar
STETT

SEQ ID NO: 2463915 - protein, 6 aa, Entamoeba dispar
STFEAQ

SEQ ID NO: 2463916 - protein, 16 aa, Entamoeba dispar
STFEKYTKTHKATSLA

SEQ ID NO: 2463917 - protein, 5 aa, Entamoeba dispar
STFER

SEQ ID NO: 2463918 - protein, 13 aa, Entamoeba dispar
STFESTLNQYGEQ

SEQ ID NO: 2463919 - protein, 12 aa, Entamoeba dispar
STFGSSTSSTFL

SEQ ID NO: 2463920 - protein, 5 aa, Entamoeba dispar
STFKP

SEQ ID NO: 2463921 - protein, 6 aa, Entamoeba dispar
STFQDG

SEQ ID NO: 2463922 - protein, 7 aa, Entamoeba dispar
STFQGKK

SEQ ID NO: 2463923 - protein, 13 aa, Entamoeba dispar
STFRDLPSKTLSV

SEQ ID NO: 2463924 - protein, 4 aa, Entamoeba dispar
STFS

SEQ ID NO: 2463925 - protein, 10 aa, Entamoeba dispar
STFTQEEKEA

SEQ ID NO: 2463926 - protein, 19 aa, Entamoeba dispar
STFTSQQQDMLPPPTGNFS

SEQ ID NO: 2463927 - protein, 12 aa, Entamoeba dispar
STFTTTGNARQA

SEQ ID NO: 2463928 - protein, 6 aa, Entamoeba dispar
STGALV

SEQ ID NO: 2463929 - protein, 13 aa, Entamoeba dispar
STGDEDMRNSRDA

SEQ ID NO: 2463930 - protein, 14 aa, Entamoeba dispar
STGDSTCMKTKAGE

SEQ ID NO: 2463931 - protein, 6 aa, Entamoeba dispar
STGEDG

SEQ ID NO: 2463932 - protein, 13 aa, Entamoeba dispar
STGELAAQHPLSS

SEQ ID NO: 2463933 - protein, 10 aa, Entamoeba dispar
STGHGQEKEV

SEQ ID NO: 2463934 - protein, 4 aa, Entamoeba dispar
STGI

SEQ ID NO: 2463935 - protein, 20 aa, Entamoeba dispar
STGIEKKVRENENNKRKIYT

SEQ ID NO: 2463936 - protein, 5 aa, Entamoeba dispar
STGIN

SEQ ID NO: 2463937 - protein, 5 aa, Entamoeba dispar
STGIR

SEQ ID NO: 2463938 - protein, 7 aa, Entamoeba dispar
STGISSS

SEQ ID NO: 2463939 - protein, 4 aa, Entamoeba dispar
STGK

SEQ ID NO: 2463940 - protein, 6 aa, Entamoeba dispar
STGKIA

SEQ ID NO: 2463941 - protein, 9 aa, Entamoeba dispar
STGKRPPII

SEQ ID NO: 2463942 - protein, 6 aa, Entamoeba dispar
STGKTQ

SEQ ID NO: 2463943 - protein, 9 aa, Entamoeba dispar
STGKVNDGV

SEQ ID NO: 2463944 - protein, 8 aa, Entamoeba dispar
STGLGDVP

SEQ ID NO: 2463945 - protein, 22 aa, Entamoeba dispar
STGNPILSSSPRINSEKQEQEI

SEQ ID NO: 2463946 - protein, 7 aa, Entamoeba dispar
STGRNST

SEQ ID NO: 2463947 - protein, 7 aa, Entamoeba dispar
STGRVES

SEQ ID NO: 2463948 - protein, 11 aa, Entamoeba dispar
STGRVESNINS

SEQ ID NO: 2463949 - protein, 7 aa, Entamoeba dispar
STGTGTV

SEQ ID NO: 2463950 - protein, 5 aa, Entamoeba dispar
STGTI

SEQ ID NO: 2463951 - protein, 9 aa, Entamoeba dispar
STGTKRYGE

SEQ ID NO: 2463952 - protein, 5 aa, Entamoeba dispar
STGTM

SEQ ID NO: 2463953 - protein, 4 aa, Entamoeba dispar
STGY

SEQ ID NO: 2463954 - protein, 4 aa, Entamoeba dispar
STHC

SEQ ID NO: 2463955 - protein, 7 aa, Entamoeba dispar
STHCPDC

SEQ ID NO: 2463956 - protein, 5 aa, Entamoeba dispar
STHDK

SEQ ID NO: 2463957 - protein, 6 aa, Entamoeba dispar
STHKHL

SEQ ID NO: 2463958 - protein, 5 aa, Entamoeba dispar
STHPD

SEQ ID NO: 2463959 - protein, 6 aa, Entamoeba dispar
STHQPS

SEQ ID NO: 2463960 - protein, 5 aa, Entamoeba dispar
STHTG

SEQ ID NO: 2463961 - protein, 7 aa, Entamoeba dispar
STIDNDF

SEQ ID NO: 2463962 - protein, 12 aa, Entamoeba dispar
STIDPGSVDGQT

SEQ ID NO: 2463963 - protein, 13 aa, Entamoeba dispar
STIEDDIKTHEKY

SEQ ID NO: 2463964 - protein, 7 aa, Entamoeba dispar
STIEDPS

SEQ ID NO: 2463965 - protein, 6 aa, Entamoeba dispar
STIEEG

SEQ ID NO: 2463966 - protein, 18 aa, Entamoeba dispar
STIGGKKKTQKKSQSQKK

SEQ ID NO: 2463967 - protein, 4 aa, Entamoeba dispar
STIN

SEQ ID NO: 2463968 - protein, 6 aa, Entamoeba dispar
STINEE

SEQ ID NO: 2463969 - protein, 7 aa, Entamoeba dispar
STINTTH

SEQ ID NO: 2463970 - protein, 5 aa, Entamoeba dispar
STINY

SEQ ID NO: 2463971 - protein, 10 aa, Entamoeba dispar
STIPLDEPEW

SEQ ID NO: 2463972 - protein, 21 aa, Entamoeba dispar
STIPNSFESSDGIKNRNTREW

SEQ ID NO: 2463973 - protein, 14 aa, Entamoeba dispar
STIQPPKSVNPKEV

SEQ ID NO: 2463974 - protein, 10 aa, Entamoeba dispar
STISNNKEEI

SEQ ID NO: 2463975 - protein, 35 aa, Entamoeba dispar
STISSLQKPLTKSGSIDSNISEHSISENSLNPPFP

SEQ ID NO: 2463976 - protein, 8 aa, Entamoeba dispar
STITAPSD

SEQ ID NO: 2463977 - protein, 6 aa, Entamoeba dispar
STITPR

SEQ ID NO: 2463978 - protein, 6 aa, Entamoeba dispar
STITQL

SEQ ID NO: 2463979 - protein, 7 aa, Entamoeba dispar
STITRDD

SEQ ID NO: 2463980 - protein, 5 aa, Entamoeba dispar
STITS

SEQ ID NO: 2463981 - protein, 6 aa, Entamoeba dispar
STITSL

SEQ ID NO: 2463982 - protein, 14 aa, Entamoeba dispar
STITTIKRNDNKSK

SEQ ID NO: 2463983 - protein, 10 aa, Entamoeba dispar
STKAISSARS

SEQ ID NO: 2463984 - protein, 7 aa, Entamoeba dispar
STKDITP

SEQ ID NO: 2463985 - protein, 10 aa, Entamoeba dispar
STKEDIEGAK

SEQ ID NO: 2463986 - protein, 30 aa, Entamoeba dispar
STKEEPKKKLVSDNETKTEKMTKTQTKTKL

SEQ ID NO: 2463987 - protein, 7 aa, Entamoeba dispar
STKEEQN

SEQ ID NO: 2463988 - protein, 10 aa, Entamoeba dispar
STKEKDTDIE

SEQ ID NO: 2463989 - protein, 21 aa, Entamoeba dispar
STKGKHVKGNIEGYSKIKATS

SEQ ID NO: 2463990 - protein, 6 aa, Entamoeba dispar
STKGKI

SEQ ID NO: 2463991 - protein, 10 aa, Entamoeba dispar
STKIKGIGST

SEQ ID NO: 2463992 - protein, 7 aa, Entamoeba dispar
STKIPKP

SEQ ID NO: 2463993 - protein, 7 aa, Entamoeba dispar
STKKIID

SEQ ID NO: 2463994 - protein, 9 aa, Entamoeba dispar
STKKSYMKT

SEQ ID NO: 2463995 - protein, 8 aa, Entamoeba dispar
STKLPNPY

SEQ ID NO: 2463996 - protein, 10 aa, Entamoeba dispar
STKMGGTNKL

SEQ ID NO: 2463997 - protein, 4 aa, Entamoeba dispar
STKN

SEQ ID NO: 2463998 - protein, 9 aa, Entamoeba dispar
STKNKEAKI

SEQ ID NO: 2463999 - protein, 8 aa, Entamoeba dispar
STKNNDIT

SEQ ID NO: 2464000 - protein, 6 aa, Entamoeba dispar
STKNQI

SEQ ID NO: 2464001 - protein, 8 aa, Entamoeba dispar
STKPEVST

SEQ ID NO: 2464002 - protein, 6 aa, Entamoeba dispar
STKPKK

SEQ ID NO: 2464003 - protein, 6 aa, Entamoeba dispar
STKPKV

SEQ ID NO: 2464004 - protein, 32 aa, Entamoeba dispar
STKPMNSQDNLKTAREKLGEKISDSQQFLSEE

SEQ ID NO: 2464005 - protein, 28 aa, Entamoeba dispar
STKPMNSQDNLKTAREKLKEKISDSQQF

SEQ ID NO: 2464006 - protein, 28 aa, Entamoeba dispar
STKPMNSQDNLKTAREKLKEKMSGSQQF

SEQ ID NO: 2464007 - protein, 17 aa, Entamoeba dispar
STKPMNSQDNLKTVREK

SEQ ID NO: 2464008 - protein, 9 aa, Entamoeba dispar
STKPQKENN

SEQ ID NO: 2464009 - protein, 6 aa, Entamoeba dispar
STKPTL

SEQ ID NO: 2464010 - protein, 5 aa, Entamoeba dispar
STKQG

SEQ ID NO: 2464011 - protein, 6 aa, Entamoeba dispar
STKSER

SEQ ID NO: 2464012 - protein, 7 aa, Entamoeba dispar
STKSKRA

SEQ ID NO: 2464013 - protein, 30 aa, Entamoeba dispar
STKSSPFSSSTEPPRDKDTMSSTGEAARDV

SEQ ID NO: 2464014 - protein, 6 aa, Entamoeba dispar
STKSYL

SEQ ID NO: 2464015 - protein, 9 aa, Entamoeba dispar
STKTGKTEF

SEQ ID NO: 2464016 - protein, 8 aa, Entamoeba dispar
STKTKEKY

SEQ ID NO: 2464017 - protein, 10 aa, Entamoeba dispar
STKTRTAEKE

SEQ ID NO: 2464018 - protein, 8 aa, Entamoeba dispar
STKTSLLS

SEQ ID NO: 2464019 - protein, 8 aa, Entamoeba dispar
STKTWKTS

SEQ ID NO: 2464020 - protein, 5 aa, Entamoeba dispar
STKVK

SEQ ID NO: 2464021 - protein, 8 aa, Entamoeba dispar
STLEKRTQ

SEQ ID NO: 2464022 - protein, 5 aa, Entamoeba dispar
STLEQ

SEQ ID NO: 2464023 - protein, 5 aa, Entamoeba dispar
STLHQ

SEQ ID NO: 2464024 - protein, 22 aa, Entamoeba dispar
STLKATQRLGRSAAEKASSISN

SEQ ID NO: 2464025 - protein, 6 aa, Entamoeba dispar
STLKSI

SEQ ID NO: 2464026 - protein, 12 aa, Entamoeba dispar
STLNKTQTENGI

SEQ ID NO: 2464027 - protein, 6 aa, Entamoeba dispar
STLPHK

SEQ ID NO: 2464028 - protein, 12 aa, Entamoeba dispar
STLPTEDKSVEF

SEQ ID NO: 2464029 - protein, 5 aa, Entamoeba dispar
STLPV

SEQ ID NO: 2464030 - protein, 4 aa, Entamoeba dispar
STLR

SEQ ID NO: 2464031 - protein, 5 aa, Entamoeba dispar
STLSI

SEQ ID NO: 2464032 - protein, 8 aa, Entamoeba dispar
STLSNGKI

SEQ ID NO: 2464033 - protein, 12 aa, Entamoeba dispar
STLSQEQRAVAK

SEQ ID NO: 2464034 - protein, 14 aa, Entamoeba dispar
STLTESKQESPCGS

SEQ ID NO: 2464035 - protein, 9 aa, Entamoeba dispar
STLTNPRTK

SEQ ID NO: 2464036 - protein, 15 aa, Entamoeba dispar
STLTNTQNVTSQELK

SEQ ID NO: 2464037 - protein, 14 aa, Entamoeba dispar
STLVNSDGKPVLGG

SEQ ID NO: 2464038 - protein, 6 aa, Entamoeba dispar
STNDGA

SEQ ID NO: 2464039 - protein, 8 aa, Entamoeba dispar
STNDNDEL

SEQ ID NO: 2464040 - protein, 198 aa, Entamoeba dispar
STNDTNGTPRTHVSNSETTNESETSEENKTSEGSEDNKISEGSETTKESKTSENSETTKENEIIEGSKTTKENETSEESETNKESETNKESETNEESETTKESETNKESETTKESETNEENEISKESETTKESETNEDNKTNKESETNKESETNKESETTKENKTTKENEISKERKKNKTIKENKVDEQCKQPVNTQN

SEQ ID NO: 2464041 - protein, 4 aa, Entamoeba dispar
STNE

SEQ ID NO: 2464042 - protein, 8 aa, Entamoeba dispar
STNEKYRP

SEQ ID NO: 2464043 - protein, 7 aa, Entamoeba dispar
STNGEKI

SEQ ID NO: 2464044 - protein, 6 aa, Entamoeba dispar
STNGGW

SEQ ID NO: 2464045 - protein, 16 aa, Entamoeba dispar
STNGIGMSSNGLGGIG

SEQ ID NO: 2464046 - protein, 9 aa, Entamoeba dispar
STNGKIEND

SEQ ID NO: 2464047 - protein, 6 aa, Entamoeba dispar
STNGSI

SEQ ID NO: 2464048 - protein, 6 aa, Entamoeba dispar
STNGYP

SEQ ID NO: 2464049 - protein, 6 aa, Entamoeba dispar
STNHPN

SEQ ID NO: 2464050 - protein, 11 aa, Entamoeba dispar
STNIPSSINEI

SEQ ID NO: 2464051 - protein, 8 aa, Entamoeba dispar
STNITGTD

SEQ ID NO: 2464052 - protein, 5 aa, Entamoeba dispar
STNKD

SEQ ID NO: 2464053 - protein, 5 aa, Entamoeba dispar
STNKE

SEQ ID NO: 2464054 - protein, 5 aa, Entamoeba dispar
STNKI

SEQ ID NO: 2464055 - protein, 11 aa, Entamoeba dispar
STNKINPKDPI

SEQ ID NO: 2464056 - protein, 7 aa, Entamoeba dispar
STNKKIL

SEQ ID NO: 2464057 - protein, 10 aa, Entamoeba dispar
STNKKSIEPI

SEQ ID NO: 2464058 - protein, 8 aa, Entamoeba dispar
STNKSTDI

SEQ ID NO: 2464059 - protein, 8 aa, Entamoeba dispar
STNLSSRV

SEQ ID NO: 2464060 - protein, 4 aa, Entamoeba dispar
STNN

SEQ ID NO: 2464061 - protein, 8 aa, Entamoeba dispar
STNNEEVK

SEQ ID NO: 2464062 - protein, 17 aa, Entamoeba dispar
STNNPNYQQSIPSTTQY

SEQ ID NO: 2464063 - protein, 10 aa, Entamoeba dispar
STNNSLHKED

SEQ ID NO: 2464064 - protein, 8 aa, Entamoeba dispar
STNNYNET

SEQ ID NO: 2464065 - protein, 9 aa, Entamoeba dispar
STNPETPDT

SEQ ID NO: 2464066 - protein, 10 aa, Entamoeba dispar
STNPNCQIDP

SEQ ID NO: 2464067 - protein, 14 aa, Entamoeba dispar
STNQENNRSPQSVK

SEQ ID NO: 2464068 - protein, 7 aa, Entamoeba dispar
STNQITE

SEQ ID NO: 2464069 - protein, 8 aa, Entamoeba dispar
STNQLQTD

SEQ ID NO: 2464070 - protein, 16 aa, Entamoeba dispar
STNQPILPSQSTTSFP

SEQ ID NO: 2464071 - protein, 4 aa, Entamoeba dispar
STNS

SEQ ID NO: 2464072 - protein, 5 aa, Entamoeba dispar
STNSE

SEQ ID NO: 2464073 - protein, 10 aa, Entamoeba dispar
STNSFDSSQY

SEQ ID NO: 2464074 - protein, 8 aa, Entamoeba dispar
STNTEDQL

SEQ ID NO: 2464075 - protein, 6 aa, Entamoeba dispar
STNTQM

SEQ ID NO: 2464076 - protein, 5 aa, Entamoeba dispar
STNTS

SEQ ID NO: 2464077 - protein, 6 aa, Entamoeba dispar
STNVAD

SEQ ID NO: 2464078 - protein, 7 aa, Entamoeba dispar
STNYSYP

SEQ ID NO: 2464079 - protein, 7 aa, Entamoeba dispar
STPAQQD

SEQ ID NO: 2464080 - protein, 14 aa, Entamoeba dispar
STPEDLFDLLIQSL

SEQ ID NO: 2464081 - protein, 16 aa, Entamoeba dispar
STPEEAEKAAKEINGK

SEQ ID NO: 2464082 - protein, 7 aa, Entamoeba dispar
STPEEAI

SEQ ID NO: 2464083 - protein, 6 aa, Entamoeba dispar
STPEIV

SEQ ID NO: 2464084 - protein, 6 aa, Entamoeba dispar
STPESH

SEQ ID NO: 2464085 - protein, 4 aa, Entamoeba dispar
STPF

SEQ ID NO: 2464086 - protein, 7 aa, Entamoeba dispar
STPFNLS

SEQ ID NO: 2464087 - protein, 43 aa, Entamoeba dispar
STPFTSPSLPLPDSKTAIPNHPSLAGSKISEDGLGVSLFSDPS

SEQ ID NO: 2464088 - protein, 7 aa, Entamoeba dispar
STPGPGV

SEQ ID NO: 2464089 - protein, 25 aa, Entamoeba dispar
STPIARGYQPNPYEQQNPPSYPSVY

SEQ ID NO: 2464090 - protein, 10 aa, Entamoeba dispar
STPIENSSEY

SEQ ID NO: 2464091 - protein, 5 aa, Entamoeba dispar
STPIM

SEQ ID NO: 2464092 - protein, 14 aa, Entamoeba dispar
STPKKNGKQNQSEI

SEQ ID NO: 2464093 - protein, 7 aa, Entamoeba dispar
STPKRQI

SEQ ID NO: 2464094 - protein, 7 aa, Entamoeba dispar
STPLKIS

SEQ ID NO: 2464095 - protein, 6 aa, Entamoeba dispar
STPLNI

SEQ ID NO: 2464096 - protein, 23 aa, Entamoeba dispar
STPMPQTPSLTSSATPLGNPNDS

SEQ ID NO: 2464097 - protein, 5 aa, Entamoeba dispar
STPMY

SEQ ID NO: 2464098 - protein, 9 aa, Entamoeba dispar
STPNDFEND

SEQ ID NO: 2464099 - protein, 8 aa, Entamoeba dispar
STPNEDEL

SEQ ID NO: 2464100 - protein, 6 aa, Entamoeba dispar
STPPFN

SEQ ID NO: 2464101 - protein, 12 aa, Entamoeba dispar
STPPSINNNNNV

SEQ ID NO: 2464102 - protein, 6 aa, Entamoeba dispar
STPQFK

SEQ ID NO: 2464103 - protein, 11 aa, Entamoeba dispar
STPQQTVEQME

SEQ ID NO: 2464104 - protein, 4 aa, Entamoeba dispar
STPS

SEQ ID NO: 2464105 - protein, 7 aa, Entamoeba dispar
STPSETM

SEQ ID NO: 2464106 - protein, 8 aa, Entamoeba dispar
STPSPDEC

SEQ ID NO: 2464107 - protein, 7 aa, Entamoeba dispar
STPSQLA

SEQ ID NO: 2464108 - protein, 6 aa, Entamoeba dispar
STPSRV

SEQ ID NO: 2464109 - protein, 9 aa, Entamoeba dispar
STPSTIANP

SEQ ID NO: 2464110 - protein, 11 aa, Entamoeba dispar
STPSTSISERR

SEQ ID NO: 2464111 - protein, 5 aa, Entamoeba dispar
STPTE

SEQ ID NO: 2464112 - protein, 6 aa, Entamoeba dispar
STPTEQ

SEQ ID NO: 2464113 - protein, 35 aa, Entamoeba dispar
STPTRKGRHYNTSKSRGGYTSHDKNKFYKHTSRTG

SEQ ID NO: 2464114 - protein, 11 aa, Entamoeba dispar
STPVLEDNEPY

SEQ ID NO: 2464115 - protein, 10 aa, Entamoeba dispar
STPVPTTGTA

SEQ ID NO: 2464116 - protein, 4 aa, Entamoeba dispar
STPY

SEQ ID NO: 2464117 - protein, 5 aa, Entamoeba dispar
STPYC

SEQ ID NO: 2464118 - protein, 10 aa, Entamoeba dispar
STQASTSITG

SEQ ID NO: 2464119 - protein, 22 aa, Entamoeba dispar
STQASTSITGTTCRKSSRIINL

SEQ ID NO: 2464120 - protein, 4 aa, Entamoeba dispar
STQE

SEQ ID NO: 2464121 - protein, 17 aa, Entamoeba dispar
STQEDFTIKSSSEIKEM

SEQ ID NO: 2464122 - protein, 5 aa, Entamoeba dispar
STQEP

SEQ ID NO: 2464123 - protein, 15 aa, Entamoeba dispar
STQFQGYPQQPYPQQ

SEQ ID NO: 2464124 - protein, 14 aa, Entamoeba dispar
STQGVSTGNSENTE

SEQ ID NO: 2464125 - protein, 9 aa, Entamoeba dispar
STQIEMQEK

SEQ ID NO: 2464126 - protein, 12 aa, Entamoeba dispar
STQIRDSDLDKK

SEQ ID NO: 2464127 - protein, 5 aa, Entamoeba dispar
STQKD

SEQ ID NO: 2464128 - protein, 10 aa, Entamoeba dispar
STQKIRRSTF

SEQ ID NO: 2464129 - protein, 34 aa, Entamoeba dispar
STQKLSKQPSLSQQLSKSNEEYQRLDSEINSVFG

SEQ ID NO: 2464130 - protein, 24 aa, Entamoeba dispar
STQLQHKQKEEKTEKKDKKIERTI

SEQ ID NO: 2464131 - protein, 13 aa, Entamoeba dispar
STQLQKKQTFCSL

SEQ ID NO: 2464132 - protein, 14 aa, Entamoeba dispar
STQLTQEQANTLAE

SEQ ID NO: 2464133 - protein, 24 aa, Entamoeba dispar
STQNKTDKLQLPKEEYYKPKQQNI

SEQ ID NO: 2464134 - protein, 8 aa, Entamoeba dispar
STQNPDSV

SEQ ID NO: 2464135 - protein, 9 aa, Entamoeba dispar
STQPPFSSQ

SEQ ID NO: 2464136 - protein, 7 aa, Entamoeba dispar
STQPPKV

SEQ ID NO: 2464137 - protein, 5 aa, Entamoeba dispar
STQPY

SEQ ID NO: 2464138 - protein, 5 aa, Entamoeba dispar
STQQA

SEQ ID NO: 2464139 - protein, 6 aa, Entamoeba dispar
STQQLE

SEQ ID NO: 2464140 - protein, 21 aa, Entamoeba dispar
STQQPNPVISTNNTSWISSKE

SEQ ID NO: 2464141 - protein, 7 aa, Entamoeba dispar
STQQVQG

SEQ ID NO: 2464142 - protein, 4 aa, Entamoeba dispar
STQT

SEQ ID NO: 2464143 - protein, 7 aa, Entamoeba dispar
STQYKSP

SEQ ID NO: 2464144 - protein, 31 aa, Entamoeba dispar
STRAPQKPLPVEESNGPSNELAALLAKRRQK

SEQ ID NO: 2464145 - protein, 9 aa, Entamoeba dispar
STREERAKS

SEQ ID NO: 2464146 - protein, 6 aa, Entamoeba dispar
STRGES

SEQ ID NO: 2464147 - protein, 6 aa, Entamoeba dispar
STRGYD

SEQ ID NO: 2464148 - protein, 16 aa, Entamoeba dispar
STRIKDRSDRATNDQV

SEQ ID NO: 2464149 - protein, 7 aa, Entamoeba dispar
STRIPSQ

SEQ ID NO: 2464150 - protein, 7 aa, Entamoeba dispar
STRKVGD

SEQ ID NO: 2464151 - protein, 4 aa, Entamoeba dispar
STRL

SEQ ID NO: 2464152 - protein, 5 aa, Entamoeba dispar
STRLR

SEQ ID NO: 2464153 - protein, 6 aa, Entamoeba dispar
STRPTL

SEQ ID NO: 2464154 - protein, 4 aa, Entamoeba dispar
STRR

SEQ ID NO: 2464155 - protein, 22 aa, Entamoeba dispar
STRRNTVANTINENQPRSTVNN

SEQ ID NO: 2464156 - protein, 8 aa, Entamoeba dispar
STRSAEET

SEQ ID NO: 2464157 - protein, 6 aa, Entamoeba dispar
STRSSD

SEQ ID NO: 2464158 - protein, 20 aa, Entamoeba dispar
STSAAPDTLRDGSSYNPTQI

SEQ ID NO: 2464159 - protein, 6 aa, Entamoeba dispar
STSAQN

SEQ ID NO: 2464160 - protein, 6 aa, Entamoeba dispar
STSCDK

SEQ ID NO: 2464161 - protein, 10 aa, Entamoeba dispar
STSEESSCEF

SEQ ID NO: 2464162 - protein, 8 aa, Entamoeba dispar
STSEGKAI

SEQ ID NO: 2464163 - protein, 9 aa, Entamoeba dispar
STSERRVEG

SEQ ID NO: 2464164 - protein, 7 aa, Entamoeba dispar
STSFGSE

SEQ ID NO: 2464165 - protein, 11 aa, Entamoeba dispar
STSFGSEETDV

SEQ ID NO: 2464166 - protein, 7 aa, Entamoeba dispar
STSFPSA

SEQ ID NO: 2464167 - protein, 51 aa, Entamoeba dispar
STSFPSRKSSGDPSDDDYDESESDCHNETDEEYPDLSSDDEKTIEDNGEID

SEQ ID NO: 2464168 - protein, 22 aa, Entamoeba dispar
STSFSSINPPFSPSFSDSQQPI

SEQ ID NO: 2464169 - protein, 15 aa, Entamoeba dispar
STSGDLDGQDNSSKF

SEQ ID NO: 2464170 - protein, 21 aa, Entamoeba dispar
STSGGRSNLCSSKSQKQVHYS

SEQ ID NO: 2464171 - protein, 13 aa, Entamoeba dispar
STSGINSNHVNPA

SEQ ID NO: 2464172 - protein, 8 aa, Entamoeba dispar
STSGKKIC

SEQ ID NO: 2464173 - protein, 20 aa, Entamoeba dispar
STSGSKISRAFNGSSQNYSI

SEQ ID NO: 2464174 - protein, 13 aa, Entamoeba dispar
STSHEEEAYGMES

SEQ ID NO: 2464175 - protein, 8 aa, Entamoeba dispar
STSHKGGV

SEQ ID NO: 2464176 - protein, 9 aa, Entamoeba dispar
STSINIPTS

SEQ ID NO: 2464177 - protein, 13 aa, Entamoeba dispar
STSINQNARIVII

SEQ ID NO: 2464178 - protein, 6 aa, Entamoeba dispar
STSIPY

SEQ ID NO: 2464179 - protein, 14 aa, Entamoeba dispar
STSIQSPDEMTTTY

SEQ ID NO: 2464180 - protein, 26 aa, Entamoeba dispar
STSISPKSRQTKTKSRQGLKKTQEIS

SEQ ID NO: 2464181 - protein, 21 aa, Entamoeba dispar
STSISRKPPPSSISEQQQQKE

SEQ ID NO: 2464182 - protein, 9 aa, Entamoeba dispar
STSKGAVES

SEQ ID NO: 2464183 - protein, 8 aa, Entamoeba dispar
STSKGFVQ

SEQ ID NO: 2464184 - protein, 5 aa, Entamoeba dispar
STSKI

SEQ ID NO: 2464185 - protein, 17 aa, Entamoeba dispar
STSKKDSKKQENNSQTV

SEQ ID NO: 2464186 - protein, 7 aa, Entamoeba dispar
STSKKNS

SEQ ID NO: 2464187 - protein, 5 aa, Entamoeba dispar
STSKN

SEQ ID NO: 2464188 - protein, 11 aa, Entamoeba dispar
STSKTGKHGHA

SEQ ID NO: 2464189 - protein, 12 aa, Entamoeba dispar
STSKTGKHGHAK

SEQ ID NO: 2464190 - protein, 6 aa, Entamoeba dispar
STSLGS

SEQ ID NO: 2464191 - protein, 6 aa, Entamoeba dispar
STSLKG

SEQ ID NO: 2464192 - protein, 20 aa, Entamoeba dispar
STSLTDQSKTITSTTPAPTF

SEQ ID NO: 2464193 - protein, 17 aa, Entamoeba dispar
STSMDYSKTIDKSSTEI

SEQ ID NO: 2464194 - protein, 6 aa, Entamoeba dispar
STSNDV

SEQ ID NO: 2464195 - protein, 34 aa, Entamoeba dispar
STSNEPLTCSDSKMPSISSPTEKPKKKRKASVGS

SEQ ID NO: 2464196 - protein, 8 aa, Entamoeba dispar
STSNFDTE

SEQ ID NO: 2464197 - protein, 9 aa, Entamoeba dispar
STSNNDEAI

SEQ ID NO: 2464198 - protein, 49 aa, Entamoeba dispar
STSNRSSRDSSRTRSSIPRPMSSLQDTSPTLTPRLSNSSSQKSSPKQSK

SEQ ID NO: 2464199 - protein, 17 aa, Entamoeba dispar
STSNVSLEERKKNIDSK

SEQ ID NO: 2464200 - protein, 7 aa, Entamoeba dispar
STSPNLR

SEQ ID NO: 2464201 - protein, 30 aa, Entamoeba dispar
STSPSKIIQQSSINQKDILSPSSSLPSQNK

SEQ ID NO: 2464202 - protein, 6 aa, Entamoeba dispar
STSPTI

SEQ ID NO: 2464203 - protein, 9 aa, Entamoeba dispar
STSQEARKN

SEQ ID NO: 2464204 - protein, 5 aa, Entamoeba dispar
STSQI

SEQ ID NO: 2464205 - protein, 10 aa, Entamoeba dispar
STSQPKHIDN

SEQ ID NO: 2464206 - protein, 33 aa, Entamoeba dispar
STSQQLPQQQKIEKDQRLNNGINTPPLESEESI

SEQ ID NO: 2464207 - protein, 10 aa, Entamoeba dispar
STSQSKLEMA

SEQ ID NO: 2464208 - protein, 6 aa, Entamoeba dispar
STSQYG

SEQ ID NO: 2464209 - protein, 11 aa, Entamoeba dispar
STSRARAESTT

SEQ ID NO: 2464210 - protein, 7 aa, Entamoeba dispar
STSSAII

SEQ ID NO: 2464211 - protein, 6 aa, Entamoeba dispar
STSSAN

SEQ ID NO: 2464212 - protein, 9 aa, Entamoeba dispar
STSSDKTVN

SEQ ID NO: 2464213 - protein, 11 aa, Entamoeba dispar
STSSDLNKDIK

SEQ ID NO: 2464214 - protein, 7 aa, Entamoeba dispar
STSSDRS

SEQ ID NO: 2464215 - protein, 12 aa, Entamoeba dispar
STSSEHPTETNQ

SEQ ID NO: 2464216 - protein, 6 aa, Entamoeba dispar
STSSIR

SEQ ID NO: 2464217 - protein, 18 aa, Entamoeba dispar
STSSNDKEIETTKEQKYE

SEQ ID NO: 2464218 - protein, 8 aa, Entamoeba dispar
STSSPLSN

SEQ ID NO: 2464219 - protein, 10 aa, Entamoeba dispar
STSSSLKQLP

SEQ ID NO: 2464220 - protein, 10 aa, Entamoeba dispar
STSSSLTGKN

SEQ ID NO: 2464221 - protein, 44 aa, Entamoeba dispar
STSTEQDQQLTTSSSNDDNKKTESKSIQQEESSSEQSTSVDRDN

SEQ ID NO: 2464222 - protein, 5 aa, Entamoeba dispar
STSTI

SEQ ID NO: 2464223 - protein, 6 aa, Entamoeba dispar
STSTIE

SEQ ID NO: 2464224 - protein, 5 aa, Entamoeba dispar
STSTT

SEQ ID NO: 2464225 - protein, 6 aa, Entamoeba dispar
STSTTS

SEQ ID NO: 2464226 - protein, 7 aa, Entamoeba dispar
STSTTTM

SEQ ID NO: 2464227 - protein, 5 aa, Entamoeba dispar
STSVP

SEQ ID NO: 2464228 - protein, 8 aa, Entamoeba dispar
STSVSAAT

SEQ ID NO: 2464229 - protein, 13 aa, Entamoeba dispar
STSVSVNAKNDTF

SEQ ID NO: 2464230 - protein, 8 aa, Entamoeba dispar
STSYEDET

SEQ ID NO: 2464231 - protein, 7 aa, Entamoeba dispar
STSYIGN

SEQ ID NO: 2464232 - protein, 4 aa, Entamoeba dispar
STTA

SEQ ID NO: 2464233 - protein, 5 aa, Entamoeba dispar
STTCA

SEQ ID NO: 2464234 - protein, 4 aa, Entamoeba dispar
STTD

SEQ ID NO: 2464235 - protein, 8 aa, Entamoeba dispar
STTDAERL

SEQ ID NO: 2464236 - protein, 8 aa, Entamoeba dispar
STTDELTA

SEQ ID NO: 2464237 - protein, 5 aa, Entamoeba dispar
STTDG

SEQ ID NO: 2464238 - protein, 22 aa, Entamoeba dispar
STTDMDSDATDAQTIKTNSNNY

SEQ ID NO: 2464239 - protein, 6 aa, Entamoeba dispar
STTDVA

SEQ ID NO: 2464240 - protein, 7 aa, Entamoeba dispar
STTEKTK

SEQ ID NO: 2464241 - protein, 8 aa, Entamoeba dispar
STTELGPQ

SEQ ID NO: 2464242 - protein, 11 aa, Entamoeba dispar
STTEWANSVSR

SEQ ID NO: 2464243 - protein, 11 aa, Entamoeba dispar
STTGAEPQEIK

SEQ ID NO: 2464244 - protein, 6 aa, Entamoeba dispar
STTGFY

SEQ ID NO: 2464245 - protein, 10 aa, Entamoeba dispar
STTGSQISDY

SEQ ID NO: 2464246 - protein, 7 aa, Entamoeba dispar
STTIETS

SEQ ID NO: 2464247 - protein, 5 aa, Entamoeba dispar
STTIK

SEQ ID NO: 2464248 - protein, 6 aa, Entamoeba dispar
STTIKD

SEQ ID NO: 2464249 - protein, 12 aa, Entamoeba dispar
STTIPPPSQSDR

SEQ ID NO: 2464250 - protein, 5 aa, Entamoeba dispar
STTIQ

SEQ ID NO: 2464251 - protein, 27 aa, Entamoeba dispar
STTISSQTKSLKKKKISSSNSEVFTNE

SEQ ID NO: 2464252 - protein, 9 aa, Entamoeba dispar
STTKEFREA

SEQ ID NO: 2464253 - protein, 9 aa, Entamoeba dispar
STTKEPEMK

SEQ ID NO: 2464254 - protein, 11 aa, Entamoeba dispar
STTKIEEESNG

SEQ ID NO: 2464255 - protein, 12 aa, Entamoeba dispar
STTKKRYATMTE

SEQ ID NO: 2464256 - protein, 10 aa, Entamoeba dispar
STTKKSKRQI

SEQ ID NO: 2464257 - protein, 22 aa, Entamoeba dispar
STTKLKKNKRIPEESFQSSEDV

SEQ ID NO: 2464258 - protein, 8 aa, Entamoeba dispar
STTKNGIR

SEQ ID NO: 2464259 - protein, 8 aa, Entamoeba dispar
STTKSKEI

SEQ ID NO: 2464260 - protein, 6 aa, Entamoeba dispar
STTKTF

SEQ ID NO: 2464261 - protein, 11 aa, Entamoeba dispar
STTLSSYNNNN

SEQ ID NO: 2464262 - protein, 7 aa, Entamoeba dispar
STTNALD

SEQ ID NO: 2464263 - protein, 6 aa, Entamoeba dispar
STTNDN

SEQ ID NO: 2464264 - protein, 5 aa, Entamoeba dispar
STTNK

SEQ ID NO: 2464265 - protein, 6 aa, Entamoeba dispar
STTPIV

SEQ ID NO: 2464266 - protein, 10 aa, Entamoeba dispar
STTPKSVAEL

SEQ ID NO: 2464267 - protein, 8 aa, Entamoeba dispar
STTPKTRQ

SEQ ID NO: 2464268 - protein, 5 aa, Entamoeba dispar
STTPN

SEQ ID NO: 2464269 - protein, 8 aa, Entamoeba dispar
STTPSYIP

SEQ ID NO: 2464270 - protein, 6 aa, Entamoeba dispar
STTQLP

SEQ ID NO: 2464271 - protein, 8 aa, Entamoeba dispar
STTQSEKI

SEQ ID NO: 2464272 - protein, 35 aa, Entamoeba dispar
STTSAPSTPGLSHSPRRSTLSTSTTCEGGPNTNGI

SEQ ID NO: 2464273 - protein, 7 aa, Entamoeba dispar
STTSGAL

SEQ ID NO: 2464274 - protein, 10 aa, Entamoeba dispar
STTSKNDDKL

SEQ ID NO: 2464275 - protein, 9 aa, Entamoeba dispar
STTSLPNGN

SEQ ID NO: 2464276 - protein, 10 aa, Entamoeba dispar
STTSPTNPIT

SEQ ID NO: 2464277 - protein, 7 aa, Entamoeba dispar
STTSQKV

SEQ ID NO: 2464278 - protein, 9 aa, Entamoeba dispar
STTSSSLAR

SEQ ID NO: 2464279 - protein, 7 aa, Entamoeba dispar
STTSTIP

SEQ ID NO: 2464280 - protein, 5 aa, Entamoeba dispar
STTSV

SEQ ID NO: 2464281 - protein, 33 aa, Entamoeba dispar
STTTAIEEEIDEEKTQDEEELKPVDHNQKIKER

SEQ ID NO: 2464282 - protein, 6 aa, Entamoeba dispar
STTTND

SEQ ID NO: 2464283 - protein, 6 aa, Entamoeba dispar
STTTSL

SEQ ID NO: 2464284 - protein, 6 aa, Entamoeba dispar
STTVTL

SEQ ID NO: 2464285 - protein, 8 aa, Entamoeba dispar
STTYNSIQ

SEQ ID NO: 2464286 - protein, 9 aa, Entamoeba dispar
STVDGEKLA

SEQ ID NO: 2464287 - protein, 18 aa, Entamoeba dispar
STVDPKLKKNEDGTTGVD

SEQ ID NO: 2464288 - protein, 11 aa, Entamoeba dispar
STVDQQSEPFI

SEQ ID NO: 2464289 - protein, 5 aa, Entamoeba dispar
STVDW

SEQ ID NO: 2464290 - protein, 10 aa, Entamoeba dispar
STVEKSESNE

SEQ ID NO: 2464291 - protein, 10 aa, Entamoeba dispar
STVGKTSLAN

SEQ ID NO: 2464292 - protein, 7 aa, Entamoeba dispar
STVGKTT

SEQ ID NO: 2464293 - protein, 5 aa, Entamoeba dispar
STVHS

SEQ ID NO: 2464294 - protein, 13 aa, Entamoeba dispar
STVIGTTRYPEDT

SEQ ID NO: 2464295 - protein, 8 aa, Entamoeba dispar
STVNGKPY

SEQ ID NO: 2464296 - protein, 7 aa, Entamoeba dispar
STVNTSK

SEQ ID NO: 2464297 - protein, 6 aa, Entamoeba dispar
STVPES

SEQ ID NO: 2464298 - protein, 8 aa, Entamoeba dispar
STVPVPLP

SEQ ID NO: 2464299 - protein, 19 aa, Entamoeba dispar
STVSNDDSDRSLLQGEPGV

SEQ ID NO: 2464300 - protein, 6 aa, Entamoeba dispar
STVSTI

SEQ ID NO: 2464301 - protein, 4 aa, Entamoeba dispar
STYE

SEQ ID NO: 2464302 - protein, 5 aa, Entamoeba dispar
STYEE

SEQ ID NO: 2464303 - protein, 8 aa, Entamoeba dispar
STYEGGST

SEQ ID NO: 2464304 - protein, 6 aa, Entamoeba dispar
STYENN

SEQ ID NO: 2464305 - protein, 4 aa, Entamoeba dispar
STYI

SEQ ID NO: 2464306 - protein, 6 aa, Entamoeba dispar
STYKQF

SEQ ID NO: 2464307 - protein, 8 aa, Entamoeba dispar
STYLTEDP

SEQ ID NO: 2464308 - protein, 6 aa, Entamoeba dispar
STYNEK

SEQ ID NO: 2464309 - protein, 8 aa, Entamoeba dispar
STYNESIG

SEQ ID NO: 2464310 - protein, 5 aa, Entamoeba dispar
STYPF

SEQ ID NO: 2464311 - protein, 5 aa, Entamoeba dispar
STYPT

SEQ ID NO: 2464312 - protein, 19 aa, Entamoeba dispar
STYQADDNSNIFEQPDSPE

SEQ ID NO: 2464313 - protein, 18 aa, Entamoeba dispar
STYQPPYTSTYPSQYQSP

SEQ ID NO: 2464314 - protein, 9 aa, Entamoeba dispar
STYQSNRLK

SEQ ID NO: 2464315 - protein, 10 aa, Entamoeba dispar
STYRDTSGKG

SEQ ID NO: 2464316 - protein, 11 aa, Entamoeba dispar
STYSPENTSPR

SEQ ID NO: 2464317 - protein, 9 aa, Entamoeba dispar
STYSPSKEE

SEQ ID NO: 2464318 - protein, 9 aa, Entamoeba dispar
SVAATKRTQ

SEQ ID NO: 2464319 - protein, 12 aa, Entamoeba dispar
SVAKNGNSSLYG

SEQ ID NO: 2464320 - protein, 4 aa, Entamoeba dispar
SVAN

SEQ ID NO: 2464321 - protein, 13 aa, Entamoeba dispar
SVAPMGQGYPPMG

SEQ ID NO: 2464322 - protein, 10 aa, Entamoeba dispar
SVATSLTNGT

SEQ ID NO: 2464323 - protein, 11 aa, Entamoeba dispar
SVCSSTPCKSI

SEQ ID NO: 2464324 - protein, 12 aa, Entamoeba dispar
SVDAKSKVSEKP

SEQ ID NO: 2464325 - protein, 9 aa, Entamoeba dispar
SVDDNGVQE

SEQ ID NO: 2464326 - protein, 4 aa, Entamoeba dispar
SVDG

SEQ ID NO: 2464327 - protein, 11 aa, Entamoeba dispar
SVDGSVTSKQG

SEQ ID NO: 2464328 - protein, 7 aa, Entamoeba dispar
SVDGTDY

SEQ ID NO: 2464329 - protein, 21 aa, Entamoeba dispar
SVDKELETELKDDEKEGGPNA

SEQ ID NO: 2464330 - protein, 12 aa, Entamoeba dispar
SVDSGRSDDNEV

SEQ ID NO: 2464331 - protein, 19 aa, Entamoeba dispar
SVDTQKEIRRTIKQNKYQE

SEQ ID NO: 2464332 - protein, 15 aa, Entamoeba dispar
SVDTSIQCTTDFKVF

SEQ ID NO: 2464333 - protein, 7 aa, Entamoeba dispar
SVEDEGY

SEQ ID NO: 2464334 - protein, 8 aa, Entamoeba dispar
SVEDPPPT

SEQ ID NO: 2464335 - protein, 10 aa, Entamoeba dispar
SVEERSEKMG

SEQ ID NO: 2464336 - protein, 4 aa, Entamoeba dispar
SVEG

SEQ ID NO: 2464337 - protein, 9 aa, Entamoeba dispar
SVEGDSVDK

SEQ ID NO: 2464338 - protein, 6 aa, Entamoeba dispar
SVEGGE

SEQ ID NO: 2464339 - protein, 9 aa, Entamoeba dispar
SVEGYDKKR

SEQ ID NO: 2464340 - protein, 5 aa, Entamoeba dispar
SVEIN

SEQ ID NO: 2464341 - protein, 44 aa, Entamoeba dispar
SVEKERKELKDLETSKIKEELGWESQQETTQNSYPNESAEQTMV

SEQ ID NO: 2464342 - protein, 43 aa, Entamoeba dispar
SVEKKPVEKKSQEKKPKKVTEKKAKSHDDEGRKNTLSKKSGLQ

SEQ ID NO: 2464343 - protein, 6 aa, Entamoeba dispar
SVEKPY

SEQ ID NO: 2464344 - protein, 12 aa, Entamoeba dispar
SVELDEKEEYDK

SEQ ID NO: 2464345 - protein, 6 aa, Entamoeba dispar
SVENDI

SEQ ID NO: 2464346 - protein, 15 aa, Entamoeba dispar
SVENDQKNQQQQSVT

SEQ ID NO: 2464347 - protein, 6 aa, Entamoeba dispar
SVENQK

SEQ ID NO: 2464348 - protein, 5 aa, Entamoeba dispar
SVEPG

SEQ ID NO: 2464349 - protein, 5 aa, Entamoeba dispar
SVEQK

SEQ ID NO: 2464350 - protein, 5 aa, Entamoeba dispar
SVEQS

SEQ ID NO: 2464351 - protein, 12 aa, Entamoeba dispar
SVESQSSTDQQE

SEQ ID NO: 2464352 - protein, 10 aa, Entamoeba dispar
SVESSNNQAW

SEQ ID NO: 2464353 - protein, 10 aa, Entamoeba dispar
SVETKKQELP

SEQ ID NO: 2464354 - protein, 6 aa, Entamoeba dispar
SVETND

SEQ ID NO: 2464355 - protein, 5 aa, Entamoeba dispar
SVFQE

SEQ ID NO: 2464356 - protein, 4 aa, Entamoeba dispar
SVGA

SEQ ID NO: 2464357 - protein, 6 aa, Entamoeba dispar
SVGDED

SEQ ID NO: 2464358 - protein, 8 aa, Entamoeba dispar
SVGDNTFD

SEQ ID NO: 2464359 - protein, 10 aa, Entamoeba dispar
SVGDTSIDIP

SEQ ID NO: 2464360 - protein, 14 aa, Entamoeba dispar
SVGEIQEPNDSKPI

SEQ ID NO: 2464361 - protein, 6 aa, Entamoeba dispar
SVGEST

SEQ ID NO: 2464362 - protein, 12 aa, Entamoeba dispar
SVGINKSTEYNY

SEQ ID NO: 2464363 - protein, 5 aa, Entamoeba dispar
SVGKS

SEQ ID NO: 2464364 - protein, 14 aa, Entamoeba dispar
SVGPKTSSPFVFAL

SEQ ID NO: 2464365 - protein, 8 aa, Entamoeba dispar
SVGQNSNF

SEQ ID NO: 2464366 - protein, 6 aa, Entamoeba dispar
SVGSNL

SEQ ID NO: 2464367 - protein, 11 aa, Entamoeba dispar
SVGSNYKENKQ

SEQ ID NO: 2464368 - protein, 25 aa, Entamoeba dispar
SVGSPCNTTTHNTSSNNTTTDENDA

SEQ ID NO: 2464369 - protein, 12 aa, Entamoeba dispar
SVGSQEKDISNQ

SEQ ID NO: 2464370 - protein, 4 aa, Entamoeba dispar
SVGT

SEQ ID NO: 2464371 - protein, 4 aa, Entamoeba dispar
SVGY

SEQ ID NO: 2464372 - protein, 7 aa, Entamoeba dispar
SVGYGPK

SEQ ID NO: 2464373 - protein, 7 aa, Entamoeba dispar
SVHSGAV

SEQ ID NO: 2464374 - protein, 9 aa, Entamoeba dispar
SVHSNGSQR

SEQ ID NO: 2464375 - protein, 8 aa, Entamoeba dispar
SVHTEQEE

SEQ ID NO: 2464376 - protein, 12 aa, Entamoeba dispar
SVINQDSHLPPK

SEQ ID NO: 2464377 - protein, 14 aa, Entamoeba dispar
SVISNSGKFTMNGG

SEQ ID NO: 2464378 - protein, 9 aa, Entamoeba dispar
SVISRRSKT

SEQ ID NO: 2464379 - protein, 9 aa, Entamoeba dispar
SVISTDKGQ

SEQ ID NO: 2464380 - protein, 18 aa, Entamoeba dispar
SVKDGSVSRKRAFTTRKD

SEQ ID NO: 2464381 - protein, 8 aa, Entamoeba dispar
SVKEHSEC

SEQ ID NO: 2464382 - protein, 11 aa, Entamoeba dispar
SVKKENKTDDI

SEQ ID NO: 2464383 - protein, 21 aa, Entamoeba dispar
SVKKQMKTSGSQKGKIARKTI

SEQ ID NO: 2464384 - protein, 8 aa, Entamoeba dispar
SVKLPGEF

SEQ ID NO: 2464385 - protein, 8 aa, Entamoeba dispar
SVKNGTVE

SEQ ID NO: 2464386 - protein, 5 aa, Entamoeba dispar
SVKPD

SEQ ID NO: 2464387 - protein, 14 aa, Entamoeba dispar
SVKPELKKIESKSK

SEQ ID NO: 2464388 - protein, 26 aa, Entamoeba dispar
SVKPLNSQDNLKTAREKLKEKMSGSH

SEQ ID NO: 2464389 - protein, 28 aa, Entamoeba dispar
SVKPLNSQDNLKTAREKLKQKISGSQQF

SEQ ID NO: 2464390 - protein, 28 aa, Entamoeba dispar
SVKPMTSQDNLKTAREKLKEKISDSQQF

SEQ ID NO: 2464391 - protein, 22 aa, Entamoeba dispar
SVKQETKIDEEQPIQPKQMKHE

SEQ ID NO: 2464392 - protein, 18 aa, Entamoeba dispar
SVKRQSTTNKMAYAPRQS

SEQ ID NO: 2464393 - protein, 26 aa, Entamoeba dispar
SVKSESYSPTRDRSTSKTSSSSQSQL

SEQ ID NO: 2464394 - protein, 10 aa, Entamoeba dispar
SVKSNDPNIK

SEQ ID NO: 2464395 - protein, 11 aa, Entamoeba dispar
SVKSNKERALS

SEQ ID NO: 2464396 - protein, 25 aa, Entamoeba dispar
SVKTPEITPTKGRSTSKLTTDSQSL

SEQ ID NO: 2464397 - protein, 6 aa, Entamoeba dispar
SVKTPF

SEQ ID NO: 2464398 - protein, 5 aa, Entamoeba dispar
SVKTT

SEQ ID NO: 2464399 - protein, 6 aa, Entamoeba dispar
SVLEAE

SEQ ID NO: 2464400 - protein, 22 aa, Entamoeba dispar
SVLKGRNQLDEFTGTNGKSLNE

SEQ ID NO: 2464401 - protein, 7 aa, Entamoeba dispar
SVLQPDE

SEQ ID NO: 2464402 - protein, 12 aa, Entamoeba dispar
SVLSTNEDNDTN

SEQ ID NO: 2464403 - protein, 10 aa, Entamoeba dispar
SVMDDTTGSY

SEQ ID NO: 2464404 - protein, 10 aa, Entamoeba dispar
SVMQTGSTAL

SEQ ID NO: 2464405 - protein, 5 aa, Entamoeba dispar
SVNDA

SEQ ID NO: 2464406 - protein, 4 aa, Entamoeba dispar
SVNE

SEQ ID NO: 2464407 - protein, 6 aa, Entamoeba dispar
SVNEIG

SEQ ID NO: 2464408 - protein, 7 aa, Entamoeba dispar
SVNELGD

SEQ ID NO: 2464409 - protein, 7 aa, Entamoeba dispar
SVNERTI

SEQ ID NO: 2464410 - protein, 5 aa, Entamoeba dispar
SVNGQ

SEQ ID NO: 2464411 - protein, 19 aa, Entamoeba dispar
SVNKESKVNQKISNNDHVG

SEQ ID NO: 2464412 - protein, 7 aa, Entamoeba dispar
SVNKGEH

SEQ ID NO: 2464413 - protein, 5 aa, Entamoeba dispar
SVNPK

SEQ ID NO: 2464414 - protein, 11 aa, Entamoeba dispar
SVNPKSKTGGY

SEQ ID NO: 2464415 - protein, 11 aa, Entamoeba dispar
SVNPSKYPSNN

SEQ ID NO: 2464416 - protein, 9 aa, Entamoeba dispar
SVNQSSQII

SEQ ID NO: 2464417 - protein, 9 aa, Entamoeba dispar
SVNTAERET

SEQ ID NO: 2464418 - protein, 4 aa, Entamoeba dispar
SVPE

SEQ ID NO: 2464419 - protein, 7 aa, Entamoeba dispar
SVPEEEW

SEQ ID NO: 2464420 - protein, 6 aa, Entamoeba dispar
SVPEKT

SEQ ID NO: 2464421 - protein, 9 aa, Entamoeba dispar
SVPGHEIST

SEQ ID NO: 2464422 - protein, 12 aa, Entamoeba dispar
SVPIRTNKEENS

SEQ ID NO: 2464423 - protein, 8 aa, Entamoeba dispar
SVPKESTV

SEQ ID NO: 2464424 - protein, 17 aa, Entamoeba dispar
SVPPPPVSSDTAYIEKD

SEQ ID NO: 2464425 - protein, 5 aa, Entamoeba dispar
SVPPT

SEQ ID NO: 2464426 - protein, 9 aa, Entamoeba dispar
SVPPYPSPN

SEQ ID NO: 2464427 - protein, 5 aa, Entamoeba dispar
SVPQL

SEQ ID NO: 2464428 - protein, 6 aa, Entamoeba dispar
SVPQQG

SEQ ID NO: 2464429 - protein, 9 aa, Entamoeba dispar
SVPSASPHF

SEQ ID NO: 2464430 - protein, 10 aa, Entamoeba dispar
SVPSDSPDDY

SEQ ID NO: 2464431 - protein, 6 aa, Entamoeba dispar
SVPSEN

SEQ ID NO: 2464432 - protein, 5 aa, Entamoeba dispar
SVPSG

SEQ ID NO: 2464433 - protein, 20 aa, Entamoeba dispar
SVPSQTLQSQPLSSPSLPFQ

SEQ ID NO: 2464434 - protein, 10 aa, Entamoeba dispar
SVPTKRGTPS

SEQ ID NO: 2464435 - protein, 4 aa, Entamoeba dispar
SVPV

SEQ ID NO: 2464436 - protein, 8 aa, Entamoeba dispar
SVPVTQKD

SEQ ID NO: 2464437 - protein, 6 aa, Entamoeba dispar
SVQCDE

SEQ ID NO: 2464438 - protein, 5 aa, Entamoeba dispar
SVQDV

SEQ ID NO: 2464439 - protein, 4 aa, Entamoeba dispar
SVQE

SEQ ID NO: 2464440 - protein, 11 aa, Entamoeba dispar
SVQKTQNDKNK

SEQ ID NO: 2464441 - protein, 5 aa, Entamoeba dispar
SVQNI

SEQ ID NO: 2464442 - protein, 4 aa, Entamoeba dispar
SVQP

SEQ ID NO: 2464443 - protein, 6 aa, Entamoeba dispar
SVQPQC

SEQ ID NO: 2464444 - protein, 6 aa, Entamoeba dispar
SVQPTR

SEQ ID NO: 2464445 - protein, 16 aa, Entamoeba dispar
SVQQSIRTNNSSITLQ

SEQ ID NO: 2464446 - protein, 13 aa, Entamoeba dispar
SVQQTTSSEEGFV

SEQ ID NO: 2464447 - protein, 4 aa, Entamoeba dispar
SVQS

SEQ ID NO: 2464448 - protein, 7 aa, Entamoeba dispar
SVQSPDW

SEQ ID NO: 2464449 - protein, 9 aa, Entamoeba dispar
SVQTNPQQQ

SEQ ID NO: 2464450 - protein, 7 aa, Entamoeba dispar
SVQTTLN

SEQ ID NO: 2464451 - protein, 6 aa, Entamoeba dispar
SVRDPI

SEQ ID NO: 2464452 - protein, 17 aa, Entamoeba dispar
SVRGSTFDTGSSRTLNG

SEQ ID NO: 2464453 - protein, 7 aa, Entamoeba dispar
SVRKQAA

SEQ ID NO: 2464454 - protein, 7 aa, Entamoeba dispar
SVRNSSY

SEQ ID NO: 2464455 - protein, 6 aa, Entamoeba dispar
SVRRAG

SEQ ID NO: 2464456 - protein, 7 aa, Entamoeba dispar
SVRTAQD

SEQ ID NO: 2464457 - protein, 11 aa, Entamoeba dispar
SVRTNVGAHSG

SEQ ID NO: 2464458 - protein, 9 aa, Entamoeba dispar
SVSADPEDM

SEQ ID NO: 2464459 - protein, 9 aa, Entamoeba dispar
SVSDLEQSF

SEQ ID NO: 2464460 - protein, 6 aa, Entamoeba dispar
SVSEIG

SEQ ID NO: 2464461 - protein, 8 aa, Entamoeba dispar
SVSEIGSG

SEQ ID NO: 2464462 - protein, 14 aa, Entamoeba dispar
SVSETIAPNDPNFT

SEQ ID NO: 2464463 - protein, 8 aa, Entamoeba dispar
SVSIPTSI

SEQ ID NO: 2464464 - protein, 9 aa, Entamoeba dispar
SVSIPTSIN

SEQ ID NO: 2464465 - protein, 9 aa, Entamoeba dispar
SVSKEDQEF

SEQ ID NO: 2464466 - protein, 8 aa, Entamoeba dispar
SVSKIGGS

SEQ ID NO: 2464467 - protein, 8 aa, Entamoeba dispar
SVSKTDLD

SEQ ID NO: 2464468 - protein, 9 aa, Entamoeba dispar
SVSLKGSET

SEQ ID NO: 2464469 - protein, 4 aa, Entamoeba dispar
SVSP

SEQ ID NO: 2464470 - protein, 6 aa, Entamoeba dispar
SVSQET

SEQ ID NO: 2464471 - protein, 6 aa, Entamoeba dispar
SVSSDE

SEQ ID NO: 2464472 - protein, 6 aa, Entamoeba dispar
SVSSLG

SEQ ID NO: 2464473 - protein, 22 aa, Entamoeba dispar
SVSSLGNKNLSHPRRPTAGSFD

SEQ ID NO: 2464474 - protein, 9 aa, Entamoeba dispar
SVSSSNEQL

SEQ ID NO: 2464475 - protein, 8 aa, Entamoeba dispar
SVSSVGKG

SEQ ID NO: 2464476 - protein, 16 aa, Entamoeba dispar
SVSTPNKGLSPRSKGL

SEQ ID NO: 2464477 - protein, 9 aa, Entamoeba dispar
SVSTPVKGN

SEQ ID NO: 2464478 - protein, 4 aa, Entamoeba dispar
SVSV

SEQ ID NO: 2464479 - protein, 7 aa, Entamoeba dispar
SVSVPSS

SEQ ID NO: 2464480 - protein, 6 aa, Entamoeba dispar
SVSVSS

SEQ ID NO: 2464481 - protein, 8 aa, Entamoeba dispar
SVTEKGER

SEQ ID NO: 2464482 - protein, 6 aa, Entamoeba dispar
SVTGKK

SEQ ID NO: 2464483 - protein, 7 aa, Entamoeba dispar
SVTHTGD

SEQ ID NO: 2464484 - protein, 8 aa, Entamoeba dispar
SVTIPSSI

SEQ ID NO: 2464485 - protein, 12 aa, Entamoeba dispar
SVTIPTSITKIC

SEQ ID NO: 2464486 - protein, 10 aa, Entamoeba dispar
SVTKEKTKIK

SEQ ID NO: 2464487 - protein, 18 aa, Entamoeba dispar
SVTKTNQTESLNNNWKNE

SEQ ID NO: 2464488 - protein, 11 aa, Entamoeba dispar
SVTKVESGEVV

SEQ ID NO: 2464489 - protein, 8 aa, Entamoeba dispar
SVTNNQKL

SEQ ID NO: 2464490 - protein, 8 aa, Entamoeba dispar
SVTNQNVE

SEQ ID NO: 2464491 - protein, 4 aa, Entamoeba dispar
SVTP

SEQ ID NO: 2464492 - protein, 16 aa, Entamoeba dispar
SVTPGYVSGDVRGKKG

SEQ ID NO: 2464493 - protein, 14 aa, Entamoeba dispar
SVTSRDKKSDLIEK

SEQ ID NO: 2464494 - protein, 6 aa, Entamoeba dispar
SVTSYG

SEQ ID NO: 2464495 - protein, 7 aa, Entamoeba dispar
SVTTPEA

SEQ ID NO: 2464496 - protein, 6 aa, Entamoeba dispar
SVTVPS

SEQ ID NO: 2464497 - protein, 6 aa, Entamoeba dispar
SVVKKE

SEQ ID NO: 2464498 - protein, 11 aa, Entamoeba dispar
SVVKPENTNRY

SEQ ID NO: 2464499 - protein, 5 aa, Entamoeba dispar
SVYQQ

SEQ ID NO: 2464500 - protein, 12 aa, Entamoeba dispar
SWGTKEGGGYKN

SEQ ID NO: 2464501 - protein, 9 aa, Entamoeba dispar
SWKNKSNCP

SEQ ID NO: 2464502 - protein, 5 aa, Entamoeba dispar
SWNRL

SEQ ID NO: 2464503 - protein, 5 aa, Entamoeba dispar
SWPAC

SEQ ID NO: 2464504 - protein, 7 aa, Entamoeba dispar
SWSKKNA

SEQ ID NO: 2464505 - protein, 6 aa, Entamoeba dispar
SWSPDG

SEQ ID NO: 2464506 - protein, 7 aa, Entamoeba dispar
SWSPDGK

SEQ ID NO: 2464507 - protein, 9 aa, Entamoeba dispar
SWTNKGAHF

SEQ ID NO: 2464508 - protein, 14 aa, Entamoeba dispar
SWTSTKSNRGESNS

SEQ ID NO: 2464509 - protein, 6 aa, Entamoeba dispar
SYAAEM

SEQ ID NO: 2464510 - protein, 6 aa, Entamoeba dispar
SYAQKD

SEQ ID NO: 2464511 - protein, 13 aa, Entamoeba dispar
SYASANSSSTTYV

SEQ ID NO: 2464512 - protein, 6 aa, Entamoeba dispar
SYAYDG

SEQ ID NO: 2464513 - protein, 21 aa, Entamoeba dispar
SYCNGDGTPFSAERILIVQMG

SEQ ID NO: 2464514 - protein, 10 aa, Entamoeba dispar
SYCSSSRSHH

SEQ ID NO: 2464515 - protein, 15 aa, Entamoeba dispar
SYCSSSRSHHHSRLC

SEQ ID NO: 2464516 - protein, 10 aa, Entamoeba dispar
SYCSSTKELP

SEQ ID NO: 2464517 - protein, 6 aa, Entamoeba dispar
SYDENH

SEQ ID NO: 2464518 - protein, 9 aa, Entamoeba dispar
SYDERYGEV

SEQ ID NO: 2464519 - protein, 7 aa, Entamoeba dispar
SYDETKA

SEQ ID NO: 2464520 - protein, 5 aa, Entamoeba dispar
SYDGK

SEQ ID NO: 2464521 - protein, 5 aa, Entamoeba dispar
SYDNT

SEQ ID NO: 2464522 - protein, 4 aa, Entamoeba dispar
SYDR

SEQ ID NO: 2464523 - protein, 6 aa, Entamoeba dispar
SYDRTA

SEQ ID NO: 2464524 - protein, 16 aa, Entamoeba dispar
SYDRTARLWTSKQNKS

SEQ ID NO: 2464525 - protein, 8 aa, Entamoeba dispar
SYDTNDEI

SEQ ID NO: 2464526 - protein, 7 aa, Entamoeba dispar
SYDTTND

SEQ ID NO: 2464527 - protein, 12 aa, Entamoeba dispar
SYDYSLDSKEVS

SEQ ID NO: 2464528 - protein, 7 aa, Entamoeba dispar
SYEDPLT

SEQ ID NO: 2464529 - protein, 5 aa, Entamoeba dispar
SYEKK

SEQ ID NO: 2464530 - protein, 22 aa, Entamoeba dispar
SYENSTKMKTQQQESIQGLTEE

SEQ ID NO: 2464531 - protein, 7 aa, Entamoeba dispar
SYEQNGG

SEQ ID NO: 2464532 - protein, 21 aa, Entamoeba dispar
SYEQTRKKSYIPSPTDVHEQE

SEQ ID NO: 2464533 - protein, 5 aa, Entamoeba dispar
SYERE

SEQ ID NO: 2464534 - protein, 5 aa, Entamoeba dispar
SYERK

SEQ ID NO: 2464535 - protein, 10 aa, Entamoeba dispar
SYERKTTSPL

SEQ ID NO: 2464536 - protein, 5 aa, Entamoeba dispar
SYERP

SEQ ID NO: 2464537 - protein, 4 aa, Entamoeba dispar
SYES

SEQ ID NO: 2464538 - protein, 5 aa, Entamoeba dispar
SYESV

SEQ ID NO: 2464539 - protein, 9 aa, Entamoeba dispar
SYESVNGKL

SEQ ID NO: 2464540 - protein, 4 aa, Entamoeba dispar
SYET

SEQ ID NO: 2464541 - protein, 23 aa, Entamoeba dispar
SYETGKKKTESKQATSTTPIRGK

SEQ ID NO: 2464542 - protein, 22 aa, Entamoeba dispar
SYETTESGTSSENEEKKSSSLK

SEQ ID NO: 2464543 - protein, 15 aa, Entamoeba dispar
SYETTSFDSDSDIEE

SEQ ID NO: 2464544 - protein, 5 aa, Entamoeba dispar
SYETV

SEQ ID NO: 2464545 - protein, 17 aa, Entamoeba dispar
SYEYPIESDTVTPKLPH

SEQ ID NO: 2464546 - protein, 41 aa, Entamoeba dispar
SYFDPDNEPERANKPDIIDEEYNKTEESLFDDPDYEEYNNE

SEQ ID NO: 2464547 - protein, 4 aa, Entamoeba dispar
SYFK

SEQ ID NO: 2464548 - protein, 7 aa, Entamoeba dispar
SYGEHGH

SEQ ID NO: 2464549 - protein, 6 aa, Entamoeba dispar
SYGEIE

SEQ ID NO: 2464550 - protein, 16 aa, Entamoeba dispar
SYGIEMSSTNNNRNTF

SEQ ID NO: 2464551 - protein, 5 aa, Entamoeba dispar
SYGIN

SEQ ID NO: 2464552 - protein, 9 aa, Entamoeba dispar
SYGLKSDTF

SEQ ID NO: 2464553 - protein, 6 aa, Entamoeba dispar
SYGNKC

SEQ ID NO: 2464554 - protein, 10 aa, Entamoeba dispar
SYGNTIPSEV

SEQ ID NO: 2464555 - protein, 6 aa, Entamoeba dispar
SYGPKG

SEQ ID NO: 2464556 - protein, 8 aa, Entamoeba dispar
SYGPRTLT

SEQ ID NO: 2464557 - protein, 13 aa, Entamoeba dispar
SYGRAGAKIDYTG

SEQ ID NO: 2464558 - protein, 6 aa, Entamoeba dispar
SYGSSY

SEQ ID NO: 2464559 - protein, 7 aa, Entamoeba dispar
SYGYPST

SEQ ID NO: 2464560 - protein, 5 aa, Entamoeba dispar
SYHKK

SEQ ID NO: 2464561 - protein, 27 aa, Entamoeba dispar
SYHPKAKTTQPEPQAVPAPSGSDVFDF

SEQ ID NO: 2464562 - protein, 7 aa, Entamoeba dispar
SYHPSTT

SEQ ID NO: 2464563 - protein, 7 aa, Entamoeba dispar
SYHSNPF

SEQ ID NO: 2464564 - protein, 4 aa, Entamoeba dispar
SYIE

SEQ ID NO: 2464565 - protein, 7 aa, Entamoeba dispar
SYITGDI

SEQ ID NO: 2464566 - protein, 7 aa, Entamoeba dispar
SYKDNKK

SEQ ID NO: 2464567 - protein, 14 aa, Entamoeba dispar
SYKEDDDTPVTTRQ

SEQ ID NO: 2464568 - protein, 7 aa, Entamoeba dispar
SYKGNLS

SEQ ID NO: 2464569 - protein, 13 aa, Entamoeba dispar
SYKKKRKNNNMET

SEQ ID NO: 2464570 - protein, 10 aa, Entamoeba dispar
SYKKQNDNLE

SEQ ID NO: 2464571 - protein, 6 aa, Entamoeba dispar
SYKKRN

SEQ ID NO: 2464572 - protein, 10 aa, Entamoeba dispar
SYKKSTTVKV

SEQ ID NO: 2464573 - protein, 27 aa, Entamoeba dispar
SYKLTTKDLQTKNNEFAQQLNEKKEIS

SEQ ID NO: 2464574 - protein, 14 aa, Entamoeba dispar
SYKNGTKIKTTPLN

SEQ ID NO: 2464575 - protein, 7 aa, Entamoeba dispar
SYKNPHQ

SEQ ID NO: 2464576 - protein, 16 aa, Entamoeba dispar
SYKNTSRIEENEKKPF

SEQ ID NO: 2464577 - protein, 19 aa, Entamoeba dispar
SYKQAEELRKKAKQTEEAK

SEQ ID NO: 2464578 - protein, 26 aa, Entamoeba dispar
SYKQAEHSCSKAKKTKQDKKEQIPQM

SEQ ID NO: 2464579 - protein, 9 aa, Entamoeba dispar
SYKQEDLTH

SEQ ID NO: 2464580 - protein, 11 aa, Entamoeba dispar
SYKQGNGSTIT

SEQ ID NO: 2464581 - protein, 6 aa, Entamoeba dispar
SYKQPD

SEQ ID NO: 2464582 - protein, 9 aa, Entamoeba dispar
SYKQQAQDI

SEQ ID NO: 2464583 - protein, 6 aa, Entamoeba dispar
SYKRTP

SEQ ID NO: 2464584 - protein, 8 aa, Entamoeba dispar
SYKSATTP

SEQ ID NO: 2464585 - protein, 16 aa, Entamoeba dispar
SYKTESLEIKTKKKKL

SEQ ID NO: 2464586 - protein, 4 aa, Entamoeba dispar
SYLP

SEQ ID NO: 2464587 - protein, 12 aa, Entamoeba dispar
SYLPSRDKPPKM

SEQ ID NO: 2464588 - protein, 13 aa, Entamoeba dispar
SYLRGGAGVDGAI

SEQ ID NO: 2464589 - protein, 14 aa, Entamoeba dispar
SYLTEKNRVDGPPV

SEQ ID NO: 2464590 - protein, 13 aa, Entamoeba dispar
SYNAKEELKYGEQ

SEQ ID NO: 2464591 - protein, 4 aa, Entamoeba dispar
SYNE

SEQ ID NO: 2464592 - protein, 17 aa, Entamoeba dispar
SYNEKKSKQFKKQPKKI

SEQ ID NO: 2464593 - protein, 26 aa, Entamoeba dispar
SYNGISNKREYSEFPIDPDKQYEEEE

SEQ ID NO: 2464594 - protein, 13 aa, Entamoeba dispar
SYNGTNKNTNYPK

SEQ ID NO: 2464595 - protein, 4 aa, Entamoeba dispar
SYNK

SEQ ID NO: 2464596 - protein, 12 aa, Entamoeba dispar
SYNKKDKTFNDG

SEQ ID NO: 2464597 - protein, 13 aa, Entamoeba dispar
SYNKSEKTKEETL

SEQ ID NO: 2464598 - protein, 15 aa, Entamoeba dispar
SYNLPTQPLRSMPSS

SEQ ID NO: 2464599 - protein, 26 aa, Entamoeba dispar
SYNTNSSSNQLPAVPPINSGRRALSQ

SEQ ID NO: 2464600 - protein, 5 aa, Entamoeba dispar
SYNTS

SEQ ID NO: 2464601 - protein, 4 aa, Entamoeba dispar
SYPD

SEQ ID NO: 2464602 - protein, 7 aa, Entamoeba dispar
SYPIEQE

SEQ ID NO: 2464603 - protein, 7 aa, Entamoeba dispar
SYPKGLQ

SEQ ID NO: 2464604 - protein, 16 aa, Entamoeba dispar
SYPKTTLRNKTGKKTV

SEQ ID NO: 2464605 - protein, 4 aa, Entamoeba dispar
SYPM

SEQ ID NO: 2464606 - protein, 9 aa, Entamoeba dispar
SYPNEETQR

SEQ ID NO: 2464607 - protein, 4 aa, Entamoeba dispar
SYPP

SEQ ID NO: 2464608 - protein, 6 aa, Entamoeba dispar
SYPPLE

SEQ ID NO: 2464609 - protein, 6 aa, Entamoeba dispar
SYPPTL

SEQ ID NO: 2464610 - protein, 4 aa, Entamoeba dispar
SYPQ

SEQ ID NO: 2464611 - protein, 9 aa, Entamoeba dispar
SYPQDDGTY

SEQ ID NO: 2464612 - protein, 7 aa, Entamoeba dispar
SYPQEKI

SEQ ID NO: 2464613 - protein, 6 aa, Entamoeba dispar
SYPTAP

SEQ ID NO: 2464614 - protein, 5 aa, Entamoeba dispar
SYPTC

SEQ ID NO: 2464615 - protein, 12 aa, Entamoeba dispar
SYQDYERKYKDI

SEQ ID NO: 2464616 - protein, 17 aa, Entamoeba dispar
SYQEGAKRFSPVYMNRM

SEQ ID NO: 2464617 - protein, 6 aa, Entamoeba dispar
SYQEGS

SEQ ID NO: 2464618 - protein, 5 aa, Entamoeba dispar
SYQFR

SEQ ID NO: 2464619 - protein, 7 aa, Entamoeba dispar
SYQHTSA

SEQ ID NO: 2464620 - protein, 15 aa, Entamoeba dispar
SYQKEGKSALKAPSS

SEQ ID NO: 2464621 - protein, 14 aa, Entamoeba dispar
SYQKFNDPQIKEEN

SEQ ID NO: 2464622 - protein, 30 aa, Entamoeba dispar
SYQPQTIYQPPQTSQGNLTQPTQYNYNPYK

SEQ ID NO: 2464623 - protein, 10 aa, Entamoeba dispar
SYQPSQPSYS

SEQ ID NO: 2464624 - protein, 10 aa, Entamoeba dispar
SYQPTQNPRV

SEQ ID NO: 2464625 - protein, 30 aa, Entamoeba dispar
SYQQSYQQPNQPIQQTQQTQSINNQIKPNE

SEQ ID NO: 2464626 - protein, 4 aa, Entamoeba dispar
SYRD

SEQ ID NO: 2464627 - protein, 24 aa, Entamoeba dispar
SYREPTLDKSMNKKRVNNENKTLQ

SEQ ID NO: 2464628 - protein, 16 aa, Entamoeba dispar
SYREVTPQRKPSEEKS

SEQ ID NO: 2464629 - protein, 5 aa, Entamoeba dispar
SYRGD

SEQ ID NO: 2464630 - protein, 7 aa, Entamoeba dispar
SYRGQKV

SEQ ID NO: 2464631 - protein, 4 aa, Entamoeba dispar
SYRK

SEQ ID NO: 2464632 - protein, 7 aa, Entamoeba dispar
SYRNGKI

SEQ ID NO: 2464633 - protein, 8 aa, Entamoeba dispar
SYRPYQAK

SEQ ID NO: 2464634 - protein, 17 aa, Entamoeba dispar
SYRQKGYSSDEESEEQI

SEQ ID NO: 2464635 - protein, 38 aa, Entamoeba dispar
SYSAPKKQHNSNSQPLTNTHPTPSNTSTLSNSTTPING

SEQ ID NO: 2464636 - protein, 4 aa, Entamoeba dispar
SYSD

SEQ ID NO: 2464637 - protein, 6 aa, Entamoeba dispar
SYSEKS

SEQ ID NO: 2464638 - protein, 4 aa, Entamoeba dispar
SYSP

SEQ ID NO: 2464639 - protein, 12 aa, Entamoeba dispar
SYSQLKETNVGG

SEQ ID NO: 2464640 - protein, 10 aa, Entamoeba dispar
SYSRENQRST

SEQ ID NO: 2464641 - protein, 5 aa, Entamoeba dispar
SYSRN

SEQ ID NO: 2464642 - protein, 9 aa, Entamoeba dispar
SYSSANEKT

SEQ ID NO: 2464643 - protein, 12 aa, Entamoeba dispar
SYSSGKNNSKKM

SEQ ID NO: 2464644 - protein, 6 aa, Entamoeba dispar
SYSSNY

SEQ ID NO: 2464645 - protein, 9 aa, Entamoeba dispar
SYSSTINST

SEQ ID NO: 2464646 - protein, 9 aa, Entamoeba dispar
SYSTDTAVK

SEQ ID NO: 2464647 - protein, 9 aa, Entamoeba dispar
SYSTGNGKF

SEQ ID NO: 2464648 - protein, 35 aa, Entamoeba dispar
SYSTSEENDRTRSRSRSHHRRNERLSGNRRDQERF

SEQ ID NO: 2464649 - protein, 6 aa, Entamoeba dispar
SYSTSN

SEQ ID NO: 2464650 - protein, 8 aa, Entamoeba dispar
SYSTSVSG

SEQ ID NO: 2464651 - protein, 5 aa, Entamoeba dispar
SYSTT

SEQ ID NO: 2464652 - protein, 5 aa, Entamoeba dispar
SYTDI

SEQ ID NO: 2464653 - protein, 4 aa, Entamoeba dispar
SYTE

SEQ ID NO: 2464654 - protein, 6 aa, Entamoeba dispar
SYTEPL

SEQ ID NO: 2464655 - protein, 10 aa, Entamoeba dispar
SYTESKPFQQ

SEQ ID NO: 2464656 - protein, 4 aa, Entamoeba dispar
SYTI

SEQ ID NO: 2464657 - protein, 11 aa, Entamoeba dispar
SYTLGKKSASA

SEQ ID NO: 2464658 - protein, 10 aa, Entamoeba dispar
SYTNQPEISH

SEQ ID NO: 2464659 - protein, 6 aa, Entamoeba dispar
SYTPHQ

SEQ ID NO: 2464660 - protein, 7 aa, Entamoeba dispar
SYTPNEH

SEQ ID NO: 2464661 - protein, 5 aa, Entamoeba dispar
SYTPS

SEQ ID NO: 2464662 - protein, 11 aa, Entamoeba dispar
SYTPSSYKAEN

SEQ ID NO: 2464663 - protein, 39 aa, Entamoeba dispar
SYTQSTESSISKISPQGLQRKRLPKKKRKWSLQDKKRAV

SEQ ID NO: 2464664 - protein, 12 aa, Entamoeba dispar
SYTRNTNEFRQP

SEQ ID NO: 2464665 - protein, 9 aa, Entamoeba dispar
SYTSRTGDV

SEQ ID NO: 2464666 - protein, 5 aa, Entamoeba dispar
SYTTQ

SEQ ID NO: 2464667 - protein, 12 aa, Entamoeba dispar
SYVNKQNMNGET

SEQ ID NO: 2464668 - protein, 10 aa, Entamoeba dispar
SYVRTDKKKF

SEQ ID NO: 2464669 - protein, 4 aa, Entamoeba dispar
SYVS

SEQ ID NO: 2464670 - protein, 10 aa, Entamoeba dispar
SYYAPSGQGF

SEQ ID NO: 2464671 - protein, 4 aa, Entamoeba dispar
SYYP

SEQ ID NO: 2464672 - protein, 6 aa, Entamoeba dispar
SYYRGA

SEQ ID NO: 2464673 - protein, 6 aa, Entamoeba dispar
SYYRGS

SEQ ID NO: 2464674 - protein, 12 aa, Entamoeba dispar
SYYTTDPSYRNK

SEQ ID NO: 2464675 - protein, 33 aa, Entamoeba dispar
TAAAAKSSESGYRAGSNAAGPMASKGTWEATTD

SEQ ID NO: 2464676 - protein, 64 aa, Entamoeba dispar
TAAAKKRKAQKAVENGDDSKAREKALKEENARLEAEKKKKEEEEKRKREESRRRLAERAAKFNQ

SEQ ID NO: 2464677 - protein, 7 aa, Entamoeba dispar
TAAEKSI

SEQ ID NO: 2464678 - protein, 10 aa, Entamoeba dispar
TAAGKSQPAN

SEQ ID NO: 2464679 - protein, 8 aa, Entamoeba dispar
TAANTSGF

SEQ ID NO: 2464680 - protein, 13 aa, Entamoeba dispar
TAAPQQSQNTNPF

SEQ ID NO: 2464681 - protein, 8 aa, Entamoeba dispar
TAASSDDL

SEQ ID NO: 2464682 - protein, 13 aa, Entamoeba dispar
TAAYGSKHDSTYT

SEQ ID NO: 2464683 - protein, 12 aa, Entamoeba dispar
TAAYTKDLENGE

SEQ ID NO: 2464684 - protein, 24 aa, Entamoeba dispar
TADDKEKEEIKEEIKKKRPKSESM

SEQ ID NO: 2464685 - protein, 5 aa, Entamoeba dispar
TADPL

SEQ ID NO: 2464686 - protein, 7 aa, Entamoeba dispar
TADTPNK

SEQ ID NO: 2464687 - protein, 8 aa, Entamoeba dispar
TAEDDEIK

SEQ ID NO: 2464688 - protein, 5 aa, Entamoeba dispar
TAEDI

SEQ ID NO: 2464689 - protein, 9 aa, Entamoeba dispar
TAEEEKKVK

SEQ ID NO: 2464690 - protein, 83 aa, Entamoeba dispar
TAEEIEKKKRREEMKKAKNAAKNEKFKKKQEAQQQQKNNLGKTKKENKKQIKEKEEIKFNKTNKGEKKKVIEPMPNTYSPKYV

SEQ ID NO: 2464691 - protein, 12 aa, Entamoeba dispar
TAEENTEKKGKL

SEQ ID NO: 2464692 - protein, 6 aa, Entamoeba dispar
TAEGKD

SEQ ID NO: 2464693 - protein, 7 aa, Entamoeba dispar
TAEISNE

SEQ ID NO: 2464694 - protein, 8 aa, Entamoeba dispar
TAEKEKTL

SEQ ID NO: 2464695 - protein, 6 aa, Entamoeba dispar
TAEKID

SEQ ID NO: 2464696 - protein, 5 aa, Entamoeba dispar
TAESS

SEQ ID NO: 2464697 - protein, 8 aa, Entamoeba dispar
TAETGKGI

SEQ ID NO: 2464698 - protein, 8 aa, Entamoeba dispar
TAEYSTNK

SEQ ID NO: 2464699 - protein, 5 aa, Entamoeba dispar
TAFDG

SEQ ID NO: 2464700 - protein, 6 aa, Entamoeba dispar
TAGAKR

SEQ ID NO: 2464701 - protein, 9 aa, Entamoeba dispar
TAGEEKYRS

SEQ ID NO: 2464702 - protein, 6 aa, Entamoeba dispar
TAGGED

SEQ ID NO: 2464703 - protein, 8 aa, Entamoeba dispar
TAGGKDYH

SEQ ID NO: 2464704 - protein, 7 aa, Entamoeba dispar
TAGIPSP

SEQ ID NO: 2464705 - protein, 7 aa, Entamoeba dispar
TAGKTLP

SEQ ID NO: 2464706 - protein, 8 aa, Entamoeba dispar
TAGKTNRK

SEQ ID NO: 2464707 - protein, 4 aa, Entamoeba dispar
TAGL

SEQ ID NO: 2464708 - protein, 8 aa, Entamoeba dispar
TAGNTHRL

SEQ ID NO: 2464709 - protein, 11 aa, Entamoeba dispar
TAGPDRHSGVS

SEQ ID NO: 2464710 - protein, 14 aa, Entamoeba dispar
TAGPKTIEEPNNYK

SEQ ID NO: 2464711 - protein, 20 aa, Entamoeba dispar
TAGPQANPSLVAPTRGVGIP

SEQ ID NO: 2464712 - protein, 7 aa, Entamoeba dispar
TAGQDEF

SEQ ID NO: 2464713 - protein, 8 aa, Entamoeba dispar
TAGQEDFD

SEQ ID NO: 2464714 - protein, 8 aa, Entamoeba dispar
TAGQEEFD

SEQ ID NO: 2464715 - protein, 8 aa, Entamoeba dispar
TAGQEEYA

SEQ ID NO: 2464716 - protein, 9 aa, Entamoeba dispar
TAGQEEYES

SEQ ID NO: 2464717 - protein, 9 aa, Entamoeba dispar
TAGQEEYNS

SEQ ID NO: 2464718 - protein, 10 aa, Entamoeba dispar
TAGQEEYNSL

SEQ ID NO: 2464719 - protein, 10 aa, Entamoeba dispar
TAGQEEYSSL

SEQ ID NO: 2464720 - protein, 8 aa, Entamoeba dispar
TAGQEKFR

SEQ ID NO: 2464721 - protein, 14 aa, Entamoeba dispar
TAGQEKFRSTTKSY

SEQ ID NO: 2464722 - protein, 7 aa, Entamoeba dispar
TAGQEKY

SEQ ID NO: 2464723 - protein, 9 aa, Entamoeba dispar
TAGQEKYRA

SEQ ID NO: 2464724 - protein, 6 aa, Entamoeba dispar
TAGQER

SEQ ID NO: 2464725 - protein, 7 aa, Entamoeba dispar
TAGQERF

SEQ ID NO: 2464726 - protein, 8 aa, Entamoeba dispar
TAGREEYQ

SEQ ID NO: 2464727 - protein, 12 aa, Entamoeba dispar
TAGRGRGKSAAL

SEQ ID NO: 2464728 - protein, 6 aa, Entamoeba dispar
TAGSEK

SEQ ID NO: 2464729 - protein, 7 aa, Entamoeba dispar
TAGSEQF

SEQ ID NO: 2464730 - protein, 6 aa, Entamoeba dispar
TAGSER

SEQ ID NO: 2464731 - protein, 6 aa, Entamoeba dispar
TAHESM

SEQ ID NO: 2464732 - protein, 4 aa, Entamoeba dispar
TAHH

SEQ ID NO: 2464733 - protein, 7 aa, Entamoeba dispar
TAHTRKK

SEQ ID NO: 2464734 - protein, 9 aa, Entamoeba dispar
TAIPSSSEY

SEQ ID NO: 2464735 - protein, 8 aa, Entamoeba dispar
TAISDGSE

SEQ ID NO: 2464736 - protein, 15 aa, Entamoeba dispar
TAKDESEKQRMKSKG

SEQ ID NO: 2464737 - protein, 10 aa, Entamoeba dispar
TAKDGSQSRT

SEQ ID NO: 2464738 - protein, 14 aa, Entamoeba dispar
TAKDKKSMEYGTER

SEQ ID NO: 2464739 - protein, 15 aa, Entamoeba dispar
TAKDPEKASNKKAQW

SEQ ID NO: 2464740 - protein, 5 aa, Entamoeba dispar
TAKEE

SEQ ID NO: 2464741 - protein, 6 aa, Entamoeba dispar
TAKEYN

SEQ ID NO: 2464742 - protein, 7 aa, Entamoeba dispar
TAKGANI

SEQ ID NO: 2464743 - protein, 10 aa, Entamoeba dispar
TAKGEELKNR

SEQ ID NO: 2464744 - protein, 7 aa, Entamoeba dispar
TAKGTGC

SEQ ID NO: 2464745 - protein, 7 aa, Entamoeba dispar
TAKKEGL

SEQ ID NO: 2464746 - protein, 23 aa, Entamoeba dispar
TAKKKSRIRQDMSSKSGDDDDSK

SEQ ID NO: 2464747 - protein, 13 aa, Entamoeba dispar
TAKKQSDADLEEL

SEQ ID NO: 2464748 - protein, 9 aa, Entamoeba dispar
TAKKTGEWE

SEQ ID NO: 2464749 - protein, 7 aa, Entamoeba dispar
TAKMGSD

SEQ ID NO: 2464750 - protein, 5 aa, Entamoeba dispar
TAKRE

SEQ ID NO: 2464751 - protein, 8 aa, Entamoeba dispar
TAKREELH

SEQ ID NO: 2464752 - protein, 14 aa, Entamoeba dispar
TAKRRYQTNKKTDG

SEQ ID NO: 2464753 - protein, 6 aa, Entamoeba dispar
TAKTIA

SEQ ID NO: 2464754 - protein, 29 aa, Entamoeba dispar
  misc_feature (15)..(16): Xaa can be any naturally occurring amino acid
TAKTIAKNLIGKTVXXKLITKYNKVIIFG

SEQ ID NO: 2464755 - protein, 11 aa, Entamoeba dispar
TALGNTDSRGI

SEQ ID NO: 2464756 - protein, 4 aa, Entamoeba dispar
TALN

SEQ ID NO: 2464757 - protein, 10 aa, Entamoeba dispar
TALSRTNKQL

SEQ ID NO: 2464758 - protein, 12 aa, Entamoeba dispar
TAMTEKNINDMK

SEQ ID NO: 2464759 - protein, 9 aa, Entamoeba dispar
TANDPFEEF

SEQ ID NO: 2464760 - protein, 8 aa, Entamoeba dispar
TANEEGDK

SEQ ID NO: 2464761 - protein, 9 aa, Entamoeba dispar
TANEQELNT

SEQ ID NO: 2464762 - protein, 5 aa, Entamoeba dispar
TANES

SEQ ID NO: 2464763 - protein, 8 aa, Entamoeba dispar
TANHGNFS

SEQ ID NO: 2464764 - protein, 8 aa, Entamoeba dispar
TANKSGSW

SEQ ID NO: 2464765 - protein, 5 aa, Entamoeba dispar
TANNT

SEQ ID NO: 2464766 - protein, 8 aa, Entamoeba dispar
TANPQVER

SEQ ID NO: 2464767 - protein, 13 aa, Entamoeba dispar
TANPSVPMNEKYE

SEQ ID NO: 2464768 - protein, 7 aa, Entamoeba dispar
TANPTWA

SEQ ID NO: 2464769 - protein, 7 aa, Entamoeba dispar
TANQNVE

SEQ ID NO: 2464770 - protein, 12 aa, Entamoeba dispar
TANSGQSDDIRK

SEQ ID NO: 2464771 - protein, 8 aa, Entamoeba dispar
TANSPKFS

SEQ ID NO: 2464772 - protein, 7 aa, Entamoeba dispar
TANTTLN

SEQ ID NO: 2464773 - protein, 4 aa, Entamoeba dispar
TANV

SEQ ID NO: 2464774 - protein, 7 aa, Entamoeba dispar
TAPDNTR

SEQ ID NO: 2464775 - protein, 13 aa, Entamoeba dispar
TAPEAGDPNSPTY

SEQ ID NO: 2464776 - protein, 9 aa, Entamoeba dispar
TAPGGSSSY

SEQ ID NO: 2464777 - protein, 9 aa, Entamoeba dispar
TAPISVDKK

SEQ ID NO: 2464778 - protein, 16 aa, Entamoeba dispar
TAPKVAAQKERPFKFL

SEQ ID NO: 2464779 - protein, 16 aa, Entamoeba dispar
TAPKVASQKERPFKFL

SEQ ID NO: 2464780 - protein, 16 aa, Entamoeba dispar
TAPKVTNQKERPFKFL

SEQ ID NO: 2464781 - protein, 7 aa, Entamoeba dispar
TAPPKLG

SEQ ID NO: 2464782 - protein, 8 aa, Entamoeba dispar
TAPPPDGL

SEQ ID NO: 2464783 - protein, 8 aa, Entamoeba dispar
TAPPTCDN

SEQ ID NO: 2464784 - protein, 8 aa, Entamoeba dispar
TAPQNELD

SEQ ID NO: 2464785 - protein, 7 aa, Entamoeba dispar
TAPSTEG

SEQ ID NO: 2464786 - protein, 7 aa, Entamoeba dispar
TAPTTEL

SEQ ID NO: 2464787 - protein, 14 aa, Entamoeba dispar
TAPTTSAADGDDIK

SEQ ID NO: 2464788 - protein, 35 aa, Entamoeba dispar
TAPVGPDAYEAGYRGAGSNAAGPMASKGTWEATTD

SEQ ID NO: 2464789 - protein, 35 aa, Entamoeba dispar
TAPVGPDAYEAGYRGVSSDAAGPMASKGTWEATTD

SEQ ID NO: 2464790 - protein, 4 aa, Entamoeba dispar
TAQE

SEQ ID NO: 2464791 - protein, 10 aa, Entamoeba dispar
TAQEKLGNHP

SEQ ID NO: 2464792 - protein, 8 aa, Entamoeba dispar
TAQEQAGD

SEQ ID NO: 2464793 - protein, 5 aa, Entamoeba dispar
TAQET

SEQ ID NO: 2464794 - protein, 8 aa, Entamoeba dispar
TAQKSGYY

SEQ ID NO: 2464795 - protein, 7 aa, Entamoeba dispar
TAQLSDF

SEQ ID NO: 2464796 - protein, 11 aa, Entamoeba dispar
TAQNSLKTEIE

SEQ ID NO: 2464797 - protein, 11 aa, Entamoeba dispar
TAQPAPNKTLI

SEQ ID NO: 2464798 - protein, 10 aa, Entamoeba dispar
TAQQENQGSY

SEQ ID NO: 2464799 - protein, 8 aa, Entamoeba dispar
TAQQSAIN

SEQ ID NO: 2464800 - protein, 5 aa, Entamoeba dispar
TAQST

SEQ ID NO: 2464801 - protein, 6 aa, Entamoeba dispar
TAQTIG

SEQ ID NO: 2464802 - protein, 12 aa, Entamoeba dispar
TAQYKGIFEHNY

SEQ ID NO: 2464803 - protein, 4 aa, Entamoeba dispar
TARG

SEQ ID NO: 2464804 - protein, 8 aa, Entamoeba dispar
TARIGRNG

SEQ ID NO: 2464805 - protein, 8 aa, Entamoeba dispar
TARKNKPS

SEQ ID NO: 2464806 - protein, 6 aa, Entamoeba dispar
TARMGS

SEQ ID NO: 2464807 - protein, 6 aa, Entamoeba dispar
TARMTA

SEQ ID NO: 2464808 - protein, 6 aa, Entamoeba dispar
TARQTL

SEQ ID NO: 2464809 - protein, 10 aa, Entamoeba dispar
TARSDQIPYV

SEQ ID NO: 2464810 - protein, 45 aa, Entamoeba dispar
TASCIGSNDSSASNTESSKRISDASSVSTNSSSGTSIIGTTKVNS

SEQ ID NO: 2464811 - protein, 6 aa, Entamoeba dispar
TASDEA

SEQ ID NO: 2464812 - protein, 16 aa, Entamoeba dispar
TASEKECTVQKGDENI

SEQ ID NO: 2464813 - protein, 9 aa, Entamoeba dispar
TASGKSTVA

SEQ ID NO: 2464814 - protein, 5 aa, Entamoeba dispar
TASGN

SEQ ID NO: 2464815 - protein, 7 aa, Entamoeba dispar
TASGTTA

SEQ ID NO: 2464816 - protein, 9 aa, Entamoeba dispar
TASKFGIEA

SEQ ID NO: 2464817 - protein, 6 aa, Entamoeba dispar
TASPEL

SEQ ID NO: 2464818 - protein, 8 aa, Entamoeba dispar
TASQERYR

SEQ ID NO: 2464819 - protein, 15 aa, Entamoeba dispar
TASSCGSRKEANELE

SEQ ID NO: 2464820 - protein, 17 aa, Entamoeba dispar
TASSDRSARISTAESGK

SEQ ID NO: 2464821 - protein, 4 aa, Entamoeba dispar
TAST

SEQ ID NO: 2464822 - protein, 9 aa, Entamoeba dispar
TASTSSQVN

SEQ ID NO: 2464823 - protein, 4 aa, Entamoeba dispar
TATC

SEQ ID NO: 2464824 - protein, 4 aa, Entamoeba dispar
TATD

SEQ ID NO: 2464825 - protein, 6 aa, Entamoeba dispar
TATDGS

SEQ ID NO: 2464826 - protein, 7 aa, Entamoeba dispar
TATDRLS

SEQ ID NO: 2464827 - protein, 29 aa, Entamoeba dispar
TATETLGEKSKSSRRSIKRTGSCADLQPS

SEQ ID NO: 2464828 - protein, 24 aa, Entamoeba dispar
TATKVETTKRNEEVEKERKNSQEL

SEQ ID NO: 2464829 - protein, 17 aa, Entamoeba dispar
TATNTEEIQKYSELESN

SEQ ID NO: 2464830 - protein, 10 aa, Entamoeba dispar
TATPGSENSL

SEQ ID NO: 2464831 - protein, 6 aa, Entamoeba dispar
TATPMN

SEQ ID NO: 2464832 - protein, 5 aa, Entamoeba dispar
TATPV

SEQ ID NO: 2464833 - protein, 7 aa, Entamoeba dispar
TATPWDD

SEQ ID NO: 2464834 - protein, 5 aa, Entamoeba dispar
TATQE

SEQ ID NO: 2464835 - protein, 4 aa, Entamoeba dispar
TATS

SEQ ID NO: 2464836 - protein, 14 aa, Entamoeba dispar
TATSHKNYGPTPEH

SEQ ID NO: 2464837 - protein, 8 aa, Entamoeba dispar
TATSSSTL

SEQ ID NO: 2464838 - protein, 17 aa, Entamoeba dispar
TATTRVKTCGDSNCEGK

SEQ ID NO: 2464839 - protein, 4 aa, Entamoeba dispar
TATY

SEQ ID NO: 2464840 - protein, 21 aa, Entamoeba dispar
TAVEESKPKATGKTKEIAKAE

SEQ ID NO: 2464841 - protein, 12 aa, Entamoeba dispar
TAVGTGLNAEPK

SEQ ID NO: 2464842 - protein, 8 aa, Entamoeba dispar
TAVKSSGE

SEQ ID NO: 2464843 - protein, 7 aa, Entamoeba dispar
TAVPVTG

SEQ ID NO: 2464844 - protein, 18 aa, Entamoeba dispar
TAVQEKEKKRPGELEQGI

SEQ ID NO: 2464845 - protein, 5 aa, Entamoeba dispar
TAVSA

SEQ ID NO: 2464846 - protein, 6 aa, Entamoeba dispar
TAYARK

SEQ ID NO: 2464847 - protein, 18 aa, Entamoeba dispar
TAYKATTTTTEITKGYNL

SEQ ID NO: 2464848 - protein, 16 aa, Entamoeba dispar
TAYPSFQPKLANQSAV

SEQ ID NO: 2464849 - protein, 7 aa, Entamoeba dispar
TAYSGEC

SEQ ID NO: 2464850 - protein, 8 aa, Entamoeba dispar
TAYTSLPD

SEQ ID NO: 2464851 - protein, 15 aa, Entamoeba dispar
TCDMDKKKEKEEEIT

SEQ ID NO: 2464852 - protein, 45 aa, Entamoeba dispar
TCEAAKKKSEKARVEAETAAEEMKKKMEEAEEYLNQQKAAAAAGQ

SEQ ID NO: 2464853 - protein, 14 aa, Entamoeba dispar
TCENKRGVDPEIDE

SEQ ID NO: 2464854 - protein, 5 aa, Entamoeba dispar
TCESR

SEQ ID NO: 2464855 - protein, 8 aa, Entamoeba dispar
TCGGEQMA

SEQ ID NO: 2464856 - protein, 11 aa, Entamoeba dispar
TCGQEQYKSLA

SEQ ID NO: 2464857 - protein, 8 aa, Entamoeba dispar
TCGQEQYR

SEQ ID NO: 2464858 - protein, 4 aa, Entamoeba dispar
TCGR

SEQ ID NO: 2464859 - protein, 4 aa, Entamoeba dispar
TCHP

SEQ ID NO: 2464860 - protein, 5 aa, Entamoeba dispar
TCKEA

SEQ ID NO: 2464861 - protein, 8 aa, Entamoeba dispar
TCKNENRK

SEQ ID NO: 2464862 - protein, 7 aa, Entamoeba dispar
TCKTGDQ

SEQ ID NO: 2464863 - protein, 4 aa, Entamoeba dispar
TCND

SEQ ID NO: 2464864 - protein, 8 aa, Entamoeba dispar
TCNETKIP

SEQ ID NO: 2464865 - protein, 8 aa, Entamoeba dispar
TCNNGRSL

SEQ ID NO: 2464866 - protein, 5 aa, Entamoeba dispar
TCNQT

SEQ ID NO: 2464867 - protein, 6 aa, Entamoeba dispar
TCPNQS

SEQ ID NO: 2464868 - protein, 6 aa, Entamoeba dispar
TCPQNE

SEQ ID NO: 2464869 - protein, 6 aa, Entamoeba dispar
TCQFEP

SEQ ID NO: 2464870 - protein, 6 aa, Entamoeba dispar
TCQKCS

SEQ ID NO: 2464871 - protein, 12 aa, Entamoeba dispar
TCRSKKEEGYSY

SEQ ID NO: 2464872 - protein, 5 aa, Entamoeba dispar
TCRTP

SEQ ID NO: 2464873 - protein, 13 aa, Entamoeba dispar
TCRVGNAGESMPT

SEQ ID NO: 2464874 - protein, 9 aa, Entamoeba dispar
TCSDKPTTH

SEQ ID NO: 2464875 - protein, 6 aa, Entamoeba dispar
TCSETE

SEQ ID NO: 2464876 - protein, 9 aa, Entamoeba dispar
TCSKKRNEI

SEQ ID NO: 2464877 - protein, 5 aa, Entamoeba dispar
TCTTA

SEQ ID NO: 2464878 - protein, 12 aa, Entamoeba dispar
TDADDEGNSIEE

SEQ ID NO: 2464879 - protein, 12 aa, Entamoeba dispar
TDAFGTSKFIEE

SEQ ID NO: 2464880 - protein, 4 aa, Entamoeba dispar
TDAG

SEQ ID NO: 2464881 - protein, 13 aa, Entamoeba dispar
TDAGTTKSKENSP

SEQ ID NO: 2464882 - protein, 7 aa, Entamoeba dispar
TDAKSIS

SEQ ID NO: 2464883 - protein, 4 aa, Entamoeba dispar
TDAL

SEQ ID NO: 2464884 - protein, 4 aa, Entamoeba dispar
TDAN

SEQ ID NO: 2464885 - protein, 6 aa, Entamoeba dispar
TDASGT

SEQ ID NO: 2464886 - protein, 11 aa, Entamoeba dispar
TDATKPLTTQY

SEQ ID NO: 2464887 - protein, 5 aa, Entamoeba dispar
TDDAM

SEQ ID NO: 2464888 - protein, 10 aa, Entamoeba dispar
TDDDTTSSSR

SEQ ID NO: 2464889 - protein, 10 aa, Entamoeba dispar
TDDEERNRGI

SEQ ID NO: 2464890 - protein, 10 aa, Entamoeba dispar
TDDEQNRMKS

SEQ ID NO: 2464891 - protein, 7 aa, Entamoeba dispar
TDDGFVD

SEQ ID NO: 2464892 - protein, 11 aa, Entamoeba dispar
TDDGNKSNEGK

SEQ ID NO: 2464893 - protein, 6 aa, Entamoeba dispar
TDDGQN

SEQ ID NO: 2464894 - protein, 17 aa, Entamoeba dispar
TDDLTKDYTVNYSDGDN

SEQ ID NO: 2464895 - protein, 14 aa, Entamoeba dispar
TDDLTKQRGKQYKM

SEQ ID NO: 2464896 - protein, 12 aa, Entamoeba dispar
TDDPRVSKRIPE

SEQ ID NO: 2464897 - protein, 15 aa, Entamoeba dispar
TDDYSTANGLNYHNG

SEQ ID NO: 2464898 - protein, 15 aa, Entamoeba dispar
TDEADTNQIERSPDD

SEQ ID NO: 2464899 - protein, 25 aa, Entamoeba dispar
TDEDDKKENGSSSTSDYDDGEDTTL

SEQ ID NO: 2464900 - protein, 8 aa, Entamoeba dispar
TDEDGKKC

SEQ ID NO: 2464901 - protein, 11 aa, Entamoeba dispar
TDEDRFDESKN

SEQ ID NO: 2464902 - protein, 5 aa, Entamoeba dispar
TDEDV

SEQ ID NO: 2464903 - protein, 6 aa, Entamoeba dispar
TDEEAG

SEQ ID NO: 2464904 - protein, 22 aa, Entamoeba dispar
TDEEEEKNETETQKDNRKRTGQ

SEQ ID NO: 2464905 - protein, 6 aa, Entamoeba dispar
TDEEQA

SEQ ID NO: 2464906 - protein, 10 aa, Entamoeba dispar
TDEERELPKY

SEQ ID NO: 2464907 - protein, 8 aa, Entamoeba dispar
TDEETAEE

SEQ ID NO: 2464908 - protein, 9 aa, Entamoeba dispar
TDEETKEGL

SEQ ID NO: 2464909 - protein, 7 aa, Entamoeba dispar
TDEGELK

SEQ ID NO: 2464910 - protein, 9 aa, Entamoeba dispar
TDEKECENK

SEQ ID NO: 2464911 - protein, 16 aa, Entamoeba dispar
TDEKEQNQLKTEAIND

SEQ ID NO: 2464912 - protein, 6 aa, Entamoeba dispar
TDEKPI

SEQ ID NO: 2464913 - protein, 5 aa, Entamoeba dispar
TDEKS

SEQ ID NO: 2464914 - protein, 4 aa, Entamoeba dispar
TDEN

SEQ ID NO: 2464915 - protein, 9 aa, Entamoeba dispar
TDENDEVKS

SEQ ID NO: 2464916 - protein, 22 aa, Entamoeba dispar
TDEPERKKHTEEHSSIKQSEEI

SEQ ID NO: 2464917 - protein, 5 aa, Entamoeba dispar
TDEPY

SEQ ID NO: 2464918 - protein, 5 aa, Entamoeba dispar
TDEQF

SEQ ID NO: 2464919 - protein, 7 aa, Entamoeba dispar
TDESKEM

SEQ ID NO: 2464920 - protein, 11 aa, Entamoeba dispar
TDESSEAPLEE

SEQ ID NO: 2464921 - protein, 6 aa, Entamoeba dispar
TDETDI

SEQ ID NO: 2464922 - protein, 6 aa, Entamoeba dispar
TDETSH

SEQ ID NO: 2464923 - protein, 17 aa, Entamoeba dispar
TDEVPIEKQYNEEKPYI

SEQ ID NO: 2464924 - protein, 5 aa, Entamoeba dispar
TDEVT

SEQ ID NO: 2464925 - protein, 17 aa, Entamoeba dispar
TDEYDEPPKYDLKDKTF

SEQ ID NO: 2464926 - protein, 6 aa, Entamoeba dispar
TDFGIS

SEQ ID NO: 2464927 - protein, 8 aa, Entamoeba dispar
TDFGSSRN

SEQ ID NO: 2464928 - protein, 18 aa, Entamoeba dispar
TDFGSSTLKDENHMTGGV

SEQ ID NO: 2464929 - protein, 6 aa, Entamoeba dispar
TDFNPK

SEQ ID NO: 2464930 - protein, 4 aa, Entamoeba dispar
TDFS

SEQ ID NO: 2464931 - protein, 17 aa, Entamoeba dispar
TDFSSRSPSPSPLQTPR

SEQ ID NO: 2464932 - protein, 6 aa, Entamoeba dispar
TDGDVF

SEQ ID NO: 2464933 - protein, 12 aa, Entamoeba dispar
TDGEICPGEYAN

SEQ ID NO: 2464934 - protein, 5 aa, Entamoeba dispar
TDGEP

SEQ ID NO: 2464935 - protein, 7 aa, Entamoeba dispar
TDGGSKI

SEQ ID NO: 2464936 - protein, 4 aa, Entamoeba dispar
TDGI

SEQ ID NO: 2464937 - protein, 10 aa, Entamoeba dispar
TDGKEKTKSL

SEQ ID NO: 2464938 - protein, 5 aa, Entamoeba dispar
TDGMP

SEQ ID NO: 2464939 - protein, 9 aa, Entamoeba dispar
TDGRGRTVD

SEQ ID NO: 2464940 - protein, 11 aa, Entamoeba dispar
TDGSESSVVTE

SEQ ID NO: 2464941 - protein, 8 aa, Entamoeba dispar
TDGSLGAA

SEQ ID NO: 2464942 - protein, 17 aa, Entamoeba dispar
TDGTIPSKGILTKIPLA

SEQ ID NO: 2464943 - protein, 8 aa, Entamoeba dispar
TDGTQEIH

SEQ ID NO: 2464944 - protein, 7 aa, Entamoeba dispar
TDGTTSI

SEQ ID NO: 2464945 - protein, 8 aa, Entamoeba dispar
TDGVTNKK

SEQ ID NO: 2464946 - protein, 7 aa, Entamoeba dispar
TDGYDGN

SEQ ID NO: 2464947 - protein, 14 aa, Entamoeba dispar
TDGYTTKSVNEHIT

SEQ ID NO: 2464948 - protein, 6 aa, Entamoeba dispar
TDHQKE

SEQ ID NO: 2464949 - protein, 8 aa, Entamoeba dispar
TDHRDTIE

SEQ ID NO: 2464950 - protein, 4 aa, Entamoeba dispar
TDID

SEQ ID NO: 2464951 - protein, 19 aa, Entamoeba dispar
TDIEEIKDKEEPGKESIEI

SEQ ID NO: 2464952 - protein, 9 aa, Entamoeba dispar
TDIEQYDEA

SEQ ID NO: 2464953 - protein, 6 aa, Entamoeba dispar
TDIGDE

SEQ ID NO: 2464954 - protein, 13 aa, Entamoeba dispar
TDIKKEGGKNGRN

SEQ ID NO: 2464955 - protein, 6 aa, Entamoeba dispar
TDINNQ

SEQ ID NO: 2464956 - protein, 5 aa, Entamoeba dispar
TDIPE

SEQ ID NO: 2464957 - protein, 10 aa, Entamoeba dispar
TDIPKKRGRL

SEQ ID NO: 2464958 - protein, 15 aa, Entamoeba dispar
TDIPPQLPPKPKRMT

SEQ ID NO: 2464959 - protein, 11 aa, Entamoeba dispar
TDISEPNVPIE

SEQ ID NO: 2464960 - protein, 4 aa, Entamoeba dispar
TDIT

SEQ ID NO: 2464961 - protein, 9 aa, Entamoeba dispar
TDKAEESTK

SEQ ID NO: 2464962 - protein, 4 aa, Entamoeba dispar
TDKD

SEQ ID NO: 2464963 - protein, 7 aa, Entamoeba dispar
TDKDEVN

SEQ ID NO: 2464964 - protein, 8 aa, Entamoeba dispar
TDKDKAMS

SEQ ID NO: 2464965 - protein, 12 aa, Entamoeba dispar
TDKDKSGSLELG

SEQ ID NO: 2464966 - protein, 6 aa, Entamoeba dispar
TDKEAD

SEQ ID NO: 2464967 - protein, 8 aa, Entamoeba dispar
TDKESFDN

SEQ ID NO: 2464968 - protein, 11 aa, Entamoeba dispar
TDKKQFDQTTF

SEQ ID NO: 2464969 - protein, 6 aa, Entamoeba dispar
TDKKSF

SEQ ID NO: 2464970 - protein, 18 aa, Entamoeba dispar
TDKKTSNNIDSKTKEALE

SEQ ID NO: 2464971 - protein, 5 aa, Entamoeba dispar
TDKLE

SEQ ID NO: 2464972 - protein, 8 aa, Entamoeba dispar
TDKPGTLN

SEQ ID NO: 2464973 - protein, 4 aa, Entamoeba dispar
TDKQ

SEQ ID NO: 2464974 - protein, 11 aa, Entamoeba dispar
TDKSNKALAAQ

SEQ ID NO: 2464975 - protein, 10 aa, Entamoeba dispar
TDKSSSTNSL

SEQ ID NO: 2464976 - protein, 14 aa, Entamoeba dispar
TDKSTRRKKFGGSL

SEQ ID NO: 2464977 - protein, 8 aa, Entamoeba dispar
TDKTDSSI

SEQ ID NO: 2464978 - protein, 9 aa, Entamoeba dispar
TDLDSGANS

SEQ ID NO: 2464979 - protein, 7 aa, Entamoeba dispar
TDLEQGV

SEQ ID NO: 2464980 - protein, 8 aa, Entamoeba dispar
TDLETGQS

SEQ ID NO: 2464981 - protein, 6 aa, Entamoeba dispar
TDLFKP

SEQ ID NO: 2464982 - protein, 7 aa, Entamoeba dispar
TDLGRPK

SEQ ID NO: 2464983 - protein, 7 aa, Entamoeba dispar
TDLIQDE

SEQ ID NO: 2464984 - protein, 7 aa, Entamoeba dispar
TDLKIES

SEQ ID NO: 2464985 - protein, 16 aa, Entamoeba dispar
TDLPSDVNLQQPGRIY

SEQ ID NO: 2464986 - protein, 19 aa, Entamoeba dispar
TDLQKIKEEVNKRIDDGNH

SEQ ID NO: 2464987 - protein, 9 aa, Entamoeba dispar
TDLSKAPKE

SEQ ID NO: 2464988 - protein, 7 aa, Entamoeba dispar
TDLTETQ

SEQ ID NO: 2464989 - protein, 8 aa, Entamoeba dispar
TDLYSGSD

SEQ ID NO: 2464990 - protein, 7 aa, Entamoeba dispar
TDMEEKI

SEQ ID NO: 2464991 - protein, 8 aa, Entamoeba dispar
TDNDETHF

SEQ ID NO: 2464992 - protein, 7 aa, Entamoeba dispar
TDNDTIE

SEQ ID NO: 2464993 - protein, 5 aa, Entamoeba dispar
TDNEN

SEQ ID NO: 2464994 - protein, 9 aa, Entamoeba dispar
TDNESEQSL

SEQ ID NO: 2464995 - protein, 7 aa, Entamoeba dispar
TDNFESK

SEQ ID NO: 2464996 - protein, 8 aa, Entamoeba dispar
TDNHPSYK

SEQ ID NO: 2464997 - protein, 6 aa, Entamoeba dispar
TDNKDK

SEQ ID NO: 2464998 - protein, 10 aa, Entamoeba dispar
TDNKEVEEQL

SEQ ID NO: 2464999 - protein, 14 aa, Entamoeba dispar
TDNKKHDKVTGKNY

SEQ ID NO: 2465000 - protein, 11 aa, Entamoeba dispar
TDNKPAPMKTN

SEQ ID NO: 2465001 - protein, 9 aa, Entamoeba dispar
TDNKPSPMY

SEQ ID NO: 2465002 - protein, 5 aa, Entamoeba dispar
TDNPI

SEQ ID NO: 2465003 - protein, 9 aa, Entamoeba dispar
TDNPTQSIT

SEQ ID NO: 2465004 - protein, 10 aa, Entamoeba dispar
TDNQRKRCEE

SEQ ID NO: 2465005 - protein, 7 aa, Entamoeba dispar
TDNSNKI

SEQ ID NO: 2465006 - protein, 7 aa, Entamoeba dispar
TDNSTGI

SEQ ID NO: 2465007 - protein, 33 aa, Entamoeba dispar
TDPDDEELETKIEKKDDGTYHAEYKPTKPGKYN

SEQ ID NO: 2465008 - protein, 17 aa, Entamoeba dispar
TDPERRLGTKKGAEEIK

SEQ ID NO: 2465009 - protein, 7 aa, Entamoeba dispar
TDPETGY

SEQ ID NO: 2465010 - protein, 7 aa, Entamoeba dispar
TDPFESE

SEQ ID NO: 2465011 - protein, 19 aa, Entamoeba dispar
TDPKKTNKIEKLEKSIRDK

SEQ ID NO: 2465012 - protein, 10 aa, Entamoeba dispar
TDPKPESPDW

SEQ ID NO: 2465013 - protein, 4 aa, Entamoeba dispar
TDPN

SEQ ID NO: 2465014 - protein, 6 aa, Entamoeba dispar
TDPNDL

SEQ ID NO: 2465015 - protein, 25 aa, Entamoeba dispar
TDPNPNSPANPQASALYTSNRKEYN

SEQ ID NO: 2465016 - protein, 6 aa, Entamoeba dispar
TDPPHA

SEQ ID NO: 2465017 - protein, 15 aa, Entamoeba dispar
TDPPVGISSGPIDES

SEQ ID NO: 2465018 - protein, 4 aa, Entamoeba dispar
TDPQ

SEQ ID NO: 2465019 - protein, 7 aa, Entamoeba dispar
TDPRASG

SEQ ID NO: 2465020 - protein, 6 aa, Entamoeba dispar
TDPTMK

SEQ ID NO: 2465021 - protein, 6 aa, Entamoeba dispar
TDPTQN

SEQ ID NO: 2465022 - protein, 5 aa, Entamoeba dispar
TDPYT

SEQ ID NO: 2465023 - protein, 9 aa, Entamoeba dispar
TDQDRRPSY

SEQ ID NO: 2465024 - protein, 7 aa, Entamoeba dispar
TDQEELS

SEQ ID NO: 2465025 - protein, 6 aa, Entamoeba dispar
TDQGIE

SEQ ID NO: 2465026 - protein, 8 aa, Entamoeba dispar
TDQKDEQI

SEQ ID NO: 2465027 - protein, 8 aa, Entamoeba dispar
TDQKRHGR

SEQ ID NO: 2465028 - protein, 9 aa, Entamoeba dispar
TDQNEETLQ

SEQ ID NO: 2465029 - protein, 9 aa, Entamoeba dispar
TDQPPNAIT

SEQ ID NO: 2465030 - protein, 7 aa, Entamoeba dispar
TDQQIER

SEQ ID NO: 2465031 - protein, 11 aa, Entamoeba dispar
TDQRPNVKSEV

SEQ ID NO: 2465032 - protein, 10 aa, Entamoeba dispar
TDQYKKPQET

SEQ ID NO: 2465033 - protein, 13 aa, Entamoeba dispar
TDRDPTKRQTKKL

SEQ ID NO: 2465034 - protein, 10 aa, Entamoeba dispar
TDRESQRSKG

SEQ ID NO: 2465035 - protein, 6 aa, Entamoeba dispar
TDRKGE

SEQ ID NO: 2465036 - protein, 12 aa, Entamoeba dispar
TDRKVEEEAEEI

SEQ ID NO: 2465037 - protein, 7 aa, Entamoeba dispar
TDRSGTI

SEQ ID NO: 2465038 - protein, 6 aa, Entamoeba dispar
TDRTKR

SEQ ID NO: 2465039 - protein, 5 aa, Entamoeba dispar
TDRTS

SEQ ID NO: 2465040 - protein, 5 aa, Entamoeba dispar
TDSDI

SEQ ID NO: 2465041 - protein, 10 aa, Entamoeba dispar
TDSETVTKRM

SEQ ID NO: 2465042 - protein, 6 aa, Entamoeba dispar
TDSFEN

SEQ ID NO: 2465043 - protein, 8 aa, Entamoeba dispar
TDSFSKEI

SEQ ID NO: 2465044 - protein, 4 aa, Entamoeba dispar
TDSG

SEQ ID NO: 2465045 - protein, 6 aa, Entamoeba dispar
TDSGAL

SEQ ID NO: 2465046 - protein, 9 aa, Entamoeba dispar
TDSGYRSNY

SEQ ID NO: 2465047 - protein, 5 aa, Entamoeba dispar
TDSID

SEQ ID NO: 2465048 - protein, 5 aa, Entamoeba dispar
TDSIE

SEQ ID NO: 2465049 - protein, 7 aa, Entamoeba dispar
TDSKEGA

SEQ ID NO: 2465050 - protein, 6 aa, Entamoeba dispar
TDSKSE

SEQ ID NO: 2465051 - protein, 18 aa, Entamoeba dispar
TDSLDSAIKENRETKEEF

SEQ ID NO: 2465052 - protein, 8 aa, Entamoeba dispar
TDSLSNAL

SEQ ID NO: 2465053 - protein, 9 aa, Entamoeba dispar
TDSNLRRSA

SEQ ID NO: 2465054 - protein, 6 aa, Entamoeba dispar
TDSNTK

SEQ ID NO: 2465055 - protein, 18 aa, Entamoeba dispar
TDSPLDIKESTNYREETD

SEQ ID NO: 2465056 - protein, 15 aa, Entamoeba dispar
TDSPMHTHTTKEPLV

SEQ ID NO: 2465057 - protein, 5 aa, Entamoeba dispar
TDSPR

SEQ ID NO: 2465058 - protein, 5 aa, Entamoeba dispar
TDSPT

SEQ ID NO: 2465059 - protein, 6 aa, Entamoeba dispar
TDSSDV

SEQ ID NO: 2465060 - protein, 16 aa, Entamoeba dispar
TDSSKNMSLPQPDGPV

SEQ ID NO: 2465061 - protein, 12 aa, Entamoeba dispar
TDSSKRSKETLD

SEQ ID NO: 2465062 - protein, 9 aa, Entamoeba dispar
TDSSSIEKI

SEQ ID NO: 2465063 - protein, 10 aa, Entamoeba dispar
TDSSVTSETI

SEQ ID NO: 2465064 - protein, 6 aa, Entamoeba dispar
TDSTFD

SEQ ID NO: 2465065 - protein, 8 aa, Entamoeba dispar
TDSTIDKT

SEQ ID NO: 2465066 - protein, 9 aa, Entamoeba dispar
TDSTSTLYN

SEQ ID NO: 2465067 - protein, 8 aa, Entamoeba dispar
TDTDSKSQ

SEQ ID NO: 2465068 - protein, 6 aa, Entamoeba dispar
TDTENY

SEQ ID NO: 2465069 - protein, 7 aa, Entamoeba dispar
TDTESES

SEQ ID NO: 2465070 - protein, 4 aa, Entamoeba dispar
TDTF

SEQ ID NO: 2465071 - protein, 7 aa, Entamoeba dispar
TDTFDSS

SEQ ID NO: 2465072 - protein, 7 aa, Entamoeba dispar
TDTPLQT

SEQ ID NO: 2465073 - protein, 5 aa, Entamoeba dispar
TDTPN

SEQ ID NO: 2465074 - protein, 8 aa, Entamoeba dispar
TDTQKNNH

SEQ ID NO: 2465075 - protein, 11 aa, Entamoeba dispar
TDTQNKELSKK

SEQ ID NO: 2465076 - protein, 24 aa, Entamoeba dispar
TDTRSVSRKTVDGSPYDPSQSSSM

SEQ ID NO: 2465077 - protein, 37 aa, Entamoeba dispar
TDTRTVSHKTVDGSPYDPSQSSSIESIKEIKKRKKKF

SEQ ID NO: 2465078 - protein, 6 aa, Entamoeba dispar
TDTSMV

SEQ ID NO: 2465079 - protein, 8 aa, Entamoeba dispar
TDTSPIPM

SEQ ID NO: 2465080 - protein, 8 aa, Entamoeba dispar
TDTTAEAA

SEQ ID NO: 2465081 - protein, 19 aa, Entamoeba dispar
TDTVPIENKKQQKKSKCYL

SEQ ID NO: 2465082 - protein, 7 aa, Entamoeba dispar
TDTWGDE

SEQ ID NO: 2465083 - protein, 6 aa, Entamoeba dispar
TDTYTL

SEQ ID NO: 2465084 - protein, 12 aa, Entamoeba dispar
TDVNGESKELTD

SEQ ID NO: 2465085 - protein, 23 aa, Entamoeba dispar
TDVPEQNVPIKGSKRLKNHEKGK

SEQ ID NO: 2465086 - protein, 5 aa, Entamoeba dispar
TDVPR

SEQ ID NO: 2465087 - protein, 10 aa, Entamoeba dispar
TDVSEQNIPI

SEQ ID NO: 2465088 - protein, 9 aa, Entamoeba dispar
TDVSSGKSL

SEQ ID NO: 2465089 - protein, 14 aa, Entamoeba dispar
TDYEPPKKPTKYSR

SEQ ID NO: 2465090 - protein, 5 aa, Entamoeba dispar
TDYPE

SEQ ID NO: 2465091 - protein, 8 aa, Entamoeba dispar
TDYQSGDR

SEQ ID NO: 2465092 - protein, 4 aa, Entamoeba dispar
TDYS

SEQ ID NO: 2465093 - protein, 11 aa, Entamoeba dispar
TDYSDTSKTEF

SEQ ID NO: 2465094 - protein, 11 aa, Entamoeba dispar
TDYSGRGELAS

SEQ ID NO: 2465095 - protein, 6 aa, Entamoeba dispar
TDYSNG

SEQ ID NO: 2465096 - protein, 21 aa, Entamoeba dispar
TEAKIQADKEKEKRLAQKMFG

SEQ ID NO: 2465097 - protein, 12 aa, Entamoeba dispar
TEAKKKNSNILT

SEQ ID NO: 2465098 - protein, 5 aa, Entamoeba dispar
TEAKR

SEQ ID NO: 2465099 - protein, 4 aa, Entamoeba dispar
TEAL

SEQ ID NO: 2465100 - protein, 5 aa, Entamoeba dispar
TEANE

SEQ ID NO: 2465101 - protein, 8 aa, Entamoeba dispar
TEAPKKKV

SEQ ID NO: 2465102 - protein, 13 aa, Entamoeba dispar
TEAPNSTDEKPPY

SEQ ID NO: 2465103 - protein, 8 aa, Entamoeba dispar
TEARSSKV

SEQ ID NO: 2465104 - protein, 6 aa, Entamoeba dispar
TEASKL

SEQ ID NO: 2465105 - protein, 10 aa, Entamoeba dispar
TEATKEQEKY

SEQ ID NO: 2465106 - protein, 8 aa, Entamoeba dispar
TECAGSRI

SEQ ID NO: 2465107 - protein, 12 aa, Entamoeba dispar
TECAKKSTYNEI

SEQ ID NO: 2465108 - protein, 6 aa, Entamoeba dispar
TECPKS

SEQ ID NO: 2465109 - protein, 5 aa, Entamoeba dispar
TECPR

SEQ ID NO: 2465110 - protein, 11 aa, Entamoeba dispar
TECSDDETCQI

SEQ ID NO: 2465111 - protein, 8 aa, Entamoeba dispar
TEDDEIEQ

SEQ ID NO: 2465112 - protein, 4 aa, Entamoeba dispar
TEDE

SEQ ID NO: 2465113 - protein, 14 aa, Entamoeba dispar
TEDENKKEKHTNLR

SEQ ID NO: 2465114 - protein, 5 aa, Entamoeba dispar
TEDEV

SEQ ID NO: 2465115 - protein, 12 aa, Entamoeba dispar
TEDFTKQPFPVD

SEQ ID NO: 2465116 - protein, 6 aa, Entamoeba dispar
TEDGKI

SEQ ID NO: 2465117 - protein, 11 aa, Entamoeba dispar
TEDGKTPEEFE

SEQ ID NO: 2465118 - protein, 5 aa, Entamoeba dispar
TEDGS

SEQ ID NO: 2465119 - protein, 12 aa, Entamoeba dispar
TEDIDAKTTVKQ

SEQ ID NO: 2465120 - protein, 7 aa, Entamoeba dispar
TEDIDNP

SEQ ID NO: 2465121 - protein, 9 aa, Entamoeba dispar
TEDKGSMVH

SEQ ID NO: 2465122 - protein, 31 aa, Entamoeba dispar
TEDKKKSIKPKKVSKKEFKQPKDEKKEKEIT

SEQ ID NO: 2465123 - protein, 9 aa, Entamoeba dispar
TEDLSGHPH

SEQ ID NO: 2465124 - protein, 15 aa, Entamoeba dispar
TEDLTPETIYKESSK

SEQ ID NO: 2465125 - protein, 4 aa, Entamoeba dispar
TEDN

SEQ ID NO: 2465126 - protein, 10 aa, Entamoeba dispar
TEDNNGINPF

SEQ ID NO: 2465127 - protein, 11 aa, Entamoeba dispar
TEDNNHSDGFG

SEQ ID NO: 2465128 - protein, 5 aa, Entamoeba dispar
TEDNP

SEQ ID NO: 2465129 - protein, 11 aa, Entamoeba dispar
TEDNTKKAYEW

SEQ ID NO: 2465130 - protein, 11 aa, Entamoeba dispar
TEDNTKKEYEW

SEQ ID NO: 2465131 - protein, 6 aa, Entamoeba dispar
TEDQMN

SEQ ID NO: 2465132 - protein, 5 aa, Entamoeba dispar
TEDQS

SEQ ID NO: 2465133 - protein, 5 aa, Entamoeba dispar
TEDTS

SEQ ID NO: 2465134 - protein, 12 aa, Entamoeba dispar
TEDWNEREPWEG

SEQ ID NO: 2465135 - protein, 6 aa, Entamoeba dispar
TEDYDA

SEQ ID NO: 2465136 - protein, 4 aa, Entamoeba dispar
TEEA

SEQ ID NO: 2465137 - protein, 6 aa, Entamoeba dispar
TEEDAK

SEQ ID NO: 2465138 - protein, 8 aa, Entamoeba dispar
TEEDANKI

SEQ ID NO: 2465139 - protein, 8 aa, Entamoeba dispar
TEEDEKVL

SEQ ID NO: 2465140 - protein, 8 aa, Entamoeba dispar
TEEDERST

SEQ ID NO: 2465141 - protein, 15 aa, Entamoeba dispar
TEEDREKYGNTIPSE

SEQ ID NO: 2465142 - protein, 5 aa, Entamoeba dispar
TEEDY

SEQ ID NO: 2465143 - protein, 10 aa, Entamoeba dispar
TEEEAIKNGQ

SEQ ID NO: 2465144 - protein, 12 aa, Entamoeba dispar
TEEEEKKYGYQK

SEQ ID NO: 2465145 - protein, 15 aa, Entamoeba dispar
TEEELEEYGEKADIK

SEQ ID NO: 2465146 - protein, 6 aa, Entamoeba dispar
TEEEPT

SEQ ID NO: 2465147 - protein, 18 aa, Entamoeba dispar
TEEEQEAIKQSSKTITEN

SEQ ID NO: 2465148 - protein, 27 aa, Entamoeba dispar
TEEESSNGMSEDEKKEEIESSDESMSV

SEQ ID NO: 2465149 - protein, 8 aa, Entamoeba dispar
TEEEYSKD

SEQ ID NO: 2465150 - protein, 12 aa, Entamoeba dispar
TEEFTKQPFPVD

SEQ ID NO: 2465151 - protein, 6 aa, Entamoeba dispar
TEEGCP

SEQ ID NO: 2465152 - protein, 9 aa, Entamoeba dispar
TEEGQKRIA

SEQ ID NO: 2465153 - protein, 26 aa, Entamoeba dispar
TEEGSSKTFKTSVQKNTSEPKWDQSV

SEQ ID NO: 2465154 - protein, 6 aa, Entamoeba dispar
TEEIEG

SEQ ID NO: 2465155 - protein, 5 aa, Entamoeba dispar
TEEIN

SEQ ID NO: 2465156 - protein, 24 aa, Entamoeba dispar
TEEKAYEKKQRKHKHQGKRKEKYS

SEQ ID NO: 2465157 - protein, 28 aa, Entamoeba dispar
TEEKELNESIKSEEEMYYPDDDKEDDTV

SEQ ID NO: 2465158 - protein, 9 aa, Entamoeba dispar
TEEKGTEGI

SEQ ID NO: 2465159 - protein, 18 aa, Entamoeba dispar
TEEKQRREDVKENEINTV

SEQ ID NO: 2465160 - protein, 20 aa, Entamoeba dispar
TEEKSRREELGGNETNRVPQ

SEQ ID NO: 2465161 - protein, 22 aa, Entamoeba dispar
TEELDSTATVKQRKRNDEAKFA

SEQ ID NO: 2465162 - protein, 18 aa, Entamoeba dispar
TEELKKNKTIPRGSFAYM

SEQ ID NO: 2465163 - protein, 18 aa, Entamoeba dispar
TEELKKNKTIPRGSFEHI

SEQ ID NO: 2465164 - protein, 18 aa, Entamoeba dispar
TEELKKNKTIPRGSFEHT

SEQ ID NO: 2465165 - protein, 18 aa, Entamoeba dispar
TEELKKNKTIPRRSFEHI

SEQ ID NO: 2465166 - protein, 6 aa, Entamoeba dispar
TEELRQ

SEQ ID NO: 2465167 - protein, 8 aa, Entamoeba dispar
TEENDINS

SEQ ID NO: 2465168 - protein, 15 aa, Entamoeba dispar
TEENEARKKQKGCCA

SEQ ID NO: 2465169 - protein, 9 aa, Entamoeba dispar
TEENEHRKS

SEQ ID NO: 2465170 - protein, 5 aa, Entamoeba dispar
TEENP

SEQ ID NO: 2465171 - protein, 8 aa, Entamoeba dispar
TEENQGME

SEQ ID NO: 2465172 - protein, 9 aa, Entamoeba dispar
TEENQPKYQ

SEQ ID NO: 2465173 - protein, 6 aa, Entamoeba dispar
TEEPIP

SEQ ID NO: 2465174 - protein, 6 aa, Entamoeba dispar
TEEPSF

SEQ ID NO: 2465175 - protein, 7 aa, Entamoeba dispar
TEEQERK

SEQ ID NO: 2465176 - protein, 11 aa, Entamoeba dispar
TEEQGKSFANQ

SEQ ID NO: 2465177 - protein, 9 aa, Entamoeba dispar
TEEQSDDIK

SEQ ID NO: 2465178 - protein, 8 aa, Entamoeba dispar
TEESGSYL

SEQ ID NO: 2465179 - protein, 14 aa, Entamoeba dispar
TEESLSLGGEDVPN

SEQ ID NO: 2465180 - protein, 6 aa, Entamoeba dispar
TEESYV

SEQ ID NO: 2465181 - protein, 13 aa, Entamoeba dispar
TEETINPEPQQDE

SEQ ID NO: 2465182 - protein, 16 aa, Entamoeba dispar
TEETTLSEPRKMEEEK

SEQ ID NO: 2465183 - protein, 26 aa, Entamoeba dispar
TEETVQEEEQNEQQDDQAITETKQPE

SEQ ID NO: 2465184 - protein, 4 aa, Entamoeba dispar
TEFE

SEQ ID NO: 2465185 - protein, 21 aa, Entamoeba dispar
TEFNSITSDGLKTLDNKTDVK

SEQ ID NO: 2465186 - protein, 5 aa, Entamoeba dispar
TEFPD

SEQ ID NO: 2465187 - protein, 16 aa, Entamoeba dispar
TEFPHGTKVDADNPAH

SEQ ID NO: 2465188 - protein, 4 aa, Entamoeba dispar
TEFS

SEQ ID NO: 2465189 - protein, 6 aa, Entamoeba dispar
TEFSNR

SEQ ID NO: 2465190 - protein, 6 aa, Entamoeba dispar
TEFSSF

SEQ ID NO: 2465191 - protein, 5 aa, Entamoeba dispar
TEGDN

SEQ ID NO: 2465192 - protein, 12 aa, Entamoeba dispar
TEGEDGDDETDL

SEQ ID NO: 2465193 - protein, 14 aa, Entamoeba dispar
TEGEGWEGESKGKI

SEQ ID NO: 2465194 - protein, 9 aa, Entamoeba dispar
TEGFDGNDY

SEQ ID NO: 2465195 - protein, 7 aa, Entamoeba dispar
TEGFNGA

SEQ ID NO: 2465196 - protein, 4 aa, Entamoeba dispar
TEGH

SEQ ID NO: 2465197 - protein, 14 aa, Entamoeba dispar
TEGITEIEKEDLNT

SEQ ID NO: 2465198 - protein, 4 aa, Entamoeba dispar
TEGK

SEQ ID NO: 2465199 - protein, 5 aa, Entamoeba dispar
TEGKD

SEQ ID NO: 2465200 - protein, 13 aa, Entamoeba dispar
TEGKRNEKPLTEE

SEQ ID NO: 2465201 - protein, 7 aa, Entamoeba dispar
TEGLENK

SEQ ID NO: 2465202 - protein, 13 aa, Entamoeba dispar
TEGNEPKIKNEDG

SEQ ID NO: 2465203 - protein, 9 aa, Entamoeba dispar
TEGPKTSVD

SEQ ID NO: 2465204 - protein, 9 aa, Entamoeba dispar
TEGRSTPVK

SEQ ID NO: 2465205 - protein, 9 aa, Entamoeba dispar
TEGSKESYP

SEQ ID NO: 2465206 - protein, 6 aa, Entamoeba dispar
TEGSKK

SEQ ID NO: 2465207 - protein, 8 aa, Entamoeba dispar
TEGSYLPD

SEQ ID NO: 2465208 - protein, 9 aa, Entamoeba dispar
TEGTFRPER

SEQ ID NO: 2465209 - protein, 6 aa, Entamoeba dispar
TEGTIE

SEQ ID NO: 2465210 - protein, 7 aa, Entamoeba dispar
TEGVNDI

SEQ ID NO: 2465211 - protein, 14 aa, Entamoeba dispar
TEGYISSYSTDSAG

SEQ ID NO: 2465212 - protein, 4 aa, Entamoeba dispar
TEHG

SEQ ID NO: 2465213 - protein, 10 aa, Entamoeba dispar
TEHGPLAAKT

SEQ ID NO: 2465214 - protein, 10 aa, Entamoeba dispar
TEHPTIKKNT

SEQ ID NO: 2465215 - protein, 11 aa, Entamoeba dispar
TEIDLPTPAYL

SEQ ID NO: 2465216 - protein, 14 aa, Entamoeba dispar
TEIDTKSYSPISTN

SEQ ID NO: 2465217 - protein, 15 aa, Entamoeba dispar
TEIEQKEKLEKKKAM

SEQ ID NO: 2465218 - protein, 4 aa, Entamoeba dispar
TEIG

SEQ ID NO: 2465219 - protein, 6 aa, Entamoeba dispar
TEIGIK

SEQ ID NO: 2465220 - protein, 13 aa, Entamoeba dispar
TEIHEEENGKMDI

SEQ ID NO: 2465221 - protein, 21 aa, Entamoeba dispar
TEIKTSATTPILPNDEKNNNI

SEQ ID NO: 2465222 - protein, 4 aa, Entamoeba dispar
TEIN

SEQ ID NO: 2465223 - protein, 13 aa, Entamoeba dispar
TEINNPFEEDKNE

SEQ ID NO: 2465224 - protein, 11 aa, Entamoeba dispar
TEIPDNLTNPE

SEQ ID NO: 2465225 - protein, 5 aa, Entamoeba dispar
TEIPK

SEQ ID NO: 2465226 - protein, 7 aa, Entamoeba dispar
TEIQQNE

SEQ ID NO: 2465227 - protein, 15 aa, Entamoeba dispar
TEIQQQQQQKQQPEL

SEQ ID NO: 2465228 - protein, 6 aa, Entamoeba dispar
TEISKK

SEQ ID NO: 2465229 - protein, 15 aa, Entamoeba dispar
TEITISKEKAPPIKL

SEQ ID NO: 2465230 - protein, 13 aa, Entamoeba dispar
TEKASLNVLKSLN

SEQ ID NO: 2465231 - protein, 5 aa, Entamoeba dispar
TEKDD

SEQ ID NO: 2465232 - protein, 6 aa, Entamoeba dispar
TEKDDL

SEQ ID NO: 2465233 - protein, 8 aa, Entamoeba dispar
TEKDFMES

SEQ ID NO: 2465234 - protein, 4 aa, Entamoeba dispar
TEKE

SEQ ID NO: 2465235 - protein, 10 aa, Entamoeba dispar
TEKEAETQIS

SEQ ID NO: 2465236 - protein, 5 aa, Entamoeba dispar
TEKEC

SEQ ID NO: 2465237 - protein, 8 aa, Entamoeba dispar
TEKEDQIL

SEQ ID NO: 2465238 - protein, 13 aa, Entamoeba dispar
TEKEEKKTGYQER

SEQ ID NO: 2465239 - protein, 29 aa, Entamoeba dispar
TEKEKEKEKQEKKETKEKDKKDKKEKKEK

SEQ ID NO: 2465240 - protein, 5 aa, Entamoeba dispar
TEKEL

SEQ ID NO: 2465241 - protein, 10 aa, Entamoeba dispar
TEKELEDVPS

SEQ ID NO: 2465242 - protein, 11 aa, Entamoeba dispar
TEKENNDSALN

SEQ ID NO: 2465243 - protein, 7 aa, Entamoeba dispar
TEKEWND

SEQ ID NO: 2465244 - protein, 4 aa, Entamoeba dispar
TEKF

SEQ ID NO: 2465245 - protein, 16 aa, Entamoeba dispar
TEKGKFEFDEDAEEAM

SEQ ID NO: 2465246 - protein, 17 aa, Entamoeba dispar
TEKGKKLLNGVTNGTIR

SEQ ID NO: 2465247 - protein, 11 aa, Entamoeba dispar
TEKGKKSTNKL

SEQ ID NO: 2465248 - protein, 10 aa, Entamoeba dispar
TEKKEQRGNF

SEQ ID NO: 2465249 - protein, 17 aa, Entamoeba dispar
TEKKKEEKKGKEQADPQ

SEQ ID NO: 2465250 - protein, 10 aa, Entamoeba dispar
TEKKKESQHE

SEQ ID NO: 2465251 - protein, 9 aa, Entamoeba dispar
TEKKPKTLT

SEQ ID NO: 2465252 - protein, 14 aa, Entamoeba dispar
TEKKSNKESSDCVV

SEQ ID NO: 2465253 - protein, 8 aa, Entamoeba dispar
TEKNESCE

SEQ ID NO: 2465254 - protein, 5 aa, Entamoeba dispar
TEKNI

SEQ ID NO: 2465255 - protein, 6 aa, Entamoeba dispar
TEKNPF

SEQ ID NO: 2465256 - protein, 10 aa, Entamoeba dispar
TEKPAISSSN

SEQ ID NO: 2465257 - protein, 12 aa, Entamoeba dispar
TEKPLDAPPPFS

SEQ ID NO: 2465258 - protein, 5 aa, Entamoeba dispar
TEKQA

SEQ ID NO: 2465259 - protein, 5 aa, Entamoeba dispar
TEKQK

SEQ ID NO: 2465260 - protein, 11 aa, Entamoeba dispar
TEKRDRNKPQT

SEQ ID NO: 2465261 - protein, 8 aa, Entamoeba dispar
TEKRNSRM

SEQ ID NO: 2465262 - protein, 4 aa, Entamoeba dispar
TEKS

SEQ ID NO: 2465263 - protein, 12 aa, Entamoeba dispar
TEKSDIQEENNE

SEQ ID NO: 2465264 - protein, 18 aa, Entamoeba dispar
TEKSDSQRQKEESEKMRK

SEQ ID NO: 2465265 - protein, 4 aa, Entamoeba dispar
TEKT

SEQ ID NO: 2465266 - protein, 5 aa, Entamoeba dispar
TEKTI

SEQ ID NO: 2465267 - protein, 13 aa, Entamoeba dispar
TEKTIQQKTEEHY

SEQ ID NO: 2465268 - protein, 14 aa, Entamoeba dispar
TEKTKTKGKINYEN

SEQ ID NO: 2465269 - protein, 5 aa, Entamoeba dispar
TEKTY

SEQ ID NO: 2465270 - protein, 8 aa, Entamoeba dispar
TEKTYDDD

SEQ ID NO: 2465271 - protein, 6 aa, Entamoeba dispar
TEKTYV

SEQ ID NO: 2465272 - protein, 9 aa, Entamoeba dispar
TEKVAKSTA

SEQ ID NO: 2465273 - protein, 4 aa, Entamoeba dispar
TEKW

SEQ ID NO: 2465274 - protein, 24 aa, Entamoeba dispar
TEKYISKDLKTKTENTLQEKQNEI

SEQ ID NO: 2465275 - protein, 13 aa, Entamoeba dispar
TEKYNNSNQETFS

SEQ ID NO: 2465276 - protein, 8 aa, Entamoeba dispar
TEKYRNER

SEQ ID NO: 2465277 - protein, 10 aa, Entamoeba dispar
TELDDGPKVE

SEQ ID NO: 2465278 - protein, 7 aa, Entamoeba dispar
TELDGSI

SEQ ID NO: 2465279 - protein, 54 aa, Entamoeba dispar
TELEEKKKQVIDKEKKNGLDEIGDEIKEIEDKIKKEKEKKSAIKEDKDKEVESV

SEQ ID NO: 2465280 - protein, 9 aa, Entamoeba dispar
TELGTNRNY

SEQ ID NO: 2465281 - protein, 11 aa, Entamoeba dispar
TELKEKKKTLK

SEQ ID NO: 2465282 - protein, 8 aa, Entamoeba dispar
TELKPEET

SEQ ID NO: 2465283 - protein, 5 aa, Entamoeba dispar
TELPA

SEQ ID NO: 2465284 - protein, 11 aa, Entamoeba dispar
TELPDKEPDAI

SEQ ID NO: 2465285 - protein, 11 aa, Entamoeba dispar
TELPKRDSDEL

SEQ ID NO: 2465286 - protein, 7 aa, Entamoeba dispar
TELPTER

SEQ ID NO: 2465287 - protein, 24 aa, Entamoeba dispar
TELQEEQEELNRYEELDKKRRGIE

SEQ ID NO: 2465288 - protein, 9 aa, Entamoeba dispar
TELQNPKYS

SEQ ID NO: 2465289 - protein, 4 aa, Entamoeba dispar
TELS

SEQ ID NO: 2465290 - protein, 17 aa, Entamoeba dispar
TELSKPQNEEPEDDDLP

SEQ ID NO: 2465291 - protein, 7 aa, Entamoeba dispar
TELTSDT

SEQ ID NO: 2465292 - protein, 12 aa, Entamoeba dispar
TELTSSTPATLS

SEQ ID NO: 2465293 - protein, 4 aa, Entamoeba dispar
TEME

SEQ ID NO: 2465294 - protein, 6 aa, Entamoeba dispar
TEMEEN

SEQ ID NO: 2465295 - protein, 17 aa, Entamoeba dispar
TEMEGIENEKEENEKEI

SEQ ID NO: 2465296 - protein, 5 aa, Entamoeba dispar
TEMKD

SEQ ID NO: 2465297 - protein, 9 aa, Entamoeba dispar
TEMNTTTAI

SEQ ID NO: 2465298 - protein, 10 aa, Entamoeba dispar
TEMPKELNDC

SEQ ID NO: 2465299 - protein, 5 aa, Entamoeba dispar
TEMQS

SEQ ID NO: 2465300 - protein, 10 aa, Entamoeba dispar
TEMREQQSKL

SEQ ID NO: 2465301 - protein, 7 aa, Entamoeba dispar
TENAAAL

SEQ ID NO: 2465302 - protein, 9 aa, Entamoeba dispar
TENAGEKTT

SEQ ID NO: 2465303 - protein, 9 aa, Entamoeba dispar
TENANYDGS

SEQ ID NO: 2465304 - protein, 9 aa, Entamoeba dispar
TENAPECKE

SEQ ID NO: 2465305 - protein, 7 aa, Entamoeba dispar
TENASSF

SEQ ID NO: 2465306 - protein, 5 aa, Entamoeba dispar
TENDE

SEQ ID NO: 2465307 - protein, 5 aa, Entamoeba dispar
TENDF

SEQ ID NO: 2465308 - protein, 11 aa, Entamoeba dispar
TENDKKKLREI

SEQ ID NO: 2465309 - protein, 5 aa, Entamoeba dispar
TENEC

SEQ ID NO: 2465310 - protein, 24 aa, Entamoeba dispar
TENEEKKSGYKERVERYKQLKQSN

SEQ ID NO: 2465311 - protein, 11 aa, Entamoeba dispar
TENEEKKTGYK

SEQ ID NO: 2465312 - protein, 25 aa, Entamoeba dispar
TENEEMKSGYQKRVEGYKQLKQSNE

SEQ ID NO: 2465313 - protein, 6 aa, Entamoeba dispar
TENEEQ

SEQ ID NO: 2465314 - protein, 11 aa, Entamoeba dispar
TENELKNSKDS

SEQ ID NO: 2465315 - protein, 8 aa, Entamoeba dispar
TENESLIQ

SEQ ID NO: 2465316 - protein, 10 aa, Entamoeba dispar
TENETITPEA

SEQ ID NO: 2465317 - protein, 7 aa, Entamoeba dispar
TENFSGA

SEQ ID NO: 2465318 - protein, 9 aa, Entamoeba dispar
TENFSSTRQ

SEQ ID NO: 2465319 - protein, 4 aa, Entamoeba dispar
TENG

SEQ ID NO: 2465320 - protein, 9 aa, Entamoeba dispar
TENGEITTL

SEQ ID NO: 2465321 - protein, 8 aa, Entamoeba dispar
TENGKITS

SEQ ID NO: 2465322 - protein, 9 aa, Entamoeba dispar
TENGQQKRR

SEQ ID NO: 2465323 - protein, 5 aa, Entamoeba dispar
TENGR

SEQ ID NO: 2465324 - protein, 13 aa, Entamoeba dispar
TENIEKKPGYKSR

SEQ ID NO: 2465325 - protein, 9 aa, Entamoeba dispar
TENKHYDGS

SEQ ID NO: 2465326 - protein, 10 aa, Entamoeba dispar
TENKNKMRPI

SEQ ID NO: 2465327 - protein, 9 aa, Entamoeba dispar
TENKNYDGS

SEQ ID NO: 2465328 - protein, 11 aa, Entamoeba dispar
TENKNYDGSYK

SEQ ID NO: 2465329 - protein, 5 aa, Entamoeba dispar
TENKR

SEQ ID NO: 2465330 - protein, 14 aa, Entamoeba dispar
TENKSKKESSDCVM

SEQ ID NO: 2465331 - protein, 14 aa, Entamoeba dispar
TENKSKKESSDCVV

SEQ ID NO: 2465332 - protein, 9 aa, Entamoeba dispar
TENKSYDGS

SEQ ID NO: 2465333 - protein, 16 aa, Entamoeba dispar
TENKTNESESPKQSSV

SEQ ID NO: 2465334 - protein, 14 aa, Entamoeba dispar
TENKTNKETSECVV

SEQ ID NO: 2465335 - protein, 9 aa, Entamoeba dispar
TENNELKKA

SEQ ID NO: 2465336 - protein, 8 aa, Entamoeba dispar
TENNKGSF

SEQ ID NO: 2465337 - protein, 11 aa, Entamoeba dispar
TENNQNNQVGQ

SEQ ID NO: 2465338 - protein, 22 aa, Entamoeba dispar
TENNQNNQVGQEELSMTEEEKE

SEQ ID NO: 2465339 - protein, 7 aa, Entamoeba dispar
TENPDQP

SEQ ID NO: 2465340 - protein, 8 aa, Entamoeba dispar
TENPIPKK

SEQ ID NO: 2465341 - protein, 8 aa, Entamoeba dispar
TENPKSLS

SEQ ID NO: 2465342 - protein, 15 aa, Entamoeba dispar
TENPKSLSTHFNQTQ

SEQ ID NO: 2465343 - protein, 6 aa, Entamoeba dispar
TENPNN

SEQ ID NO: 2465344 - protein, 25 aa, Entamoeba dispar
TENPSKFETQTIQSENQHSSNKCVV

SEQ ID NO: 2465345 - protein, 10 aa, Entamoeba dispar
TENPYDPTPF

SEQ ID NO: 2465346 - protein, 8 aa, Entamoeba dispar
TENQTLRE

SEQ ID NO: 2465347 - protein, 10 aa, Entamoeba dispar
TENQTSTESL

SEQ ID NO: 2465348 - protein, 5 aa, Entamoeba dispar
TENRS

SEQ ID NO: 2465349 - protein, 4 aa, Entamoeba dispar
TENS

SEQ ID NO: 2465350 - protein, 11 aa, Entamoeba dispar
TENSLSNDTLP

SEQ ID NO: 2465351 - protein, 4 aa, Entamoeba dispar
TENT

SEQ ID NO: 2465352 - protein, 16 aa, Entamoeba dispar
TENTFGATRVDEEDAF

SEQ ID NO: 2465353 - protein, 6 aa, Entamoeba dispar
TENTHV

SEQ ID NO: 2465354 - protein, 6 aa, Entamoeba dispar
TENTPI

SEQ ID NO: 2465355 - protein, 8 aa, Entamoeba dispar
TENTTNQQ

SEQ ID NO: 2465356 - protein, 13 aa, Entamoeba dispar
TENTTNSGFDNEE

SEQ ID NO: 2465357 - protein, 6 aa, Entamoeba dispar
TENYDN

SEQ ID NO: 2465358 - protein, 13 aa, Entamoeba dispar
TENYEQQIPSTNQ

SEQ ID NO: 2465359 - protein, 7 aa, Entamoeba dispar
TENYKNS

SEQ ID NO: 2465360 - protein, 5 aa, Entamoeba dispar
TENYS

SEQ ID NO: 2465361 - protein, 12 aa, Entamoeba dispar
TEPAKGSDPTFV

SEQ ID NO: 2465362 - protein, 8 aa, Entamoeba dispar
TEPDHSGS

SEQ ID NO: 2465363 - protein, 5 aa, Entamoeba dispar
TEPEF

SEQ ID NO: 2465364 - protein, 8 aa, Entamoeba dispar
TEPEPDPL

SEQ ID NO: 2465365 - protein, 26 aa, Entamoeba dispar
TEPIQETKNEQQEDSKEEEEDSEEEL

SEQ ID NO: 2465366 - protein, 8 aa, Entamoeba dispar
TEPKTEST

SEQ ID NO: 2465367 - protein, 4 aa, Entamoeba dispar
TEPN

SEQ ID NO: 2465368 - protein, 6 aa, Entamoeba dispar
TEPPHS

SEQ ID NO: 2465369 - protein, 4 aa, Entamoeba dispar
TEPQ

SEQ ID NO: 2465370 - protein, 8 aa, Entamoeba dispar
TEPQNSFT

SEQ ID NO: 2465371 - protein, 13 aa, Entamoeba dispar
TEPSLKQNKNQII

SEQ ID NO: 2465372 - protein, 4 aa, Entamoeba dispar
TEPT

SEQ ID NO: 2465373 - protein, 6 aa, Entamoeba dispar
TEPTSE

SEQ ID NO: 2465374 - protein, 61 aa, Entamoeba dispar
TEQEELQKELEREEEEEREEEIAKNKKTAKQKRAEEKKKRKEQRIKEGGMDIANSSGYDEV

SEQ ID NO: 2465375 - protein, 7 aa, Entamoeba dispar
TEQEEYI

SEQ ID NO: 2465376 - protein, 7 aa, Entamoeba dispar
TEQHGAY

SEQ ID NO: 2465377 - protein, 21 aa, Entamoeba dispar
TEQHYRKRSQNKDDYLDKRGL

SEQ ID NO: 2465378 - protein, 11 aa, Entamoeba dispar
TEQKKETQKFQ

SEQ ID NO: 2465379 - protein, 22 aa, Entamoeba dispar
TEQLTGSIRTSLNDVSDCGGRI

SEQ ID NO: 2465380 - protein, 39 aa, Entamoeba dispar
TEQNMKPIHEDKRHSEEKKPIQKKESNKDSKKEAKKPIM

SEQ ID NO: 2465381 - protein, 9 aa, Entamoeba dispar
TEQPQLPND

SEQ ID NO: 2465382 - protein, 11 aa, Entamoeba dispar
TEQQEAKETIE

SEQ ID NO: 2465383 - protein, 32 aa, Entamoeba dispar
TEQQEQQRIEKRNERLKEKNEELKAINKEQQI

SEQ ID NO: 2465384 - protein, 15 aa, Entamoeba dispar
TEQRNATLRQQPTKQ

SEQ ID NO: 2465385 - protein, 10 aa, Entamoeba dispar
TEQSSSSTLP

SEQ ID NO: 2465386 - protein, 8 aa, Entamoeba dispar
TEQTEGLI

SEQ ID NO: 2465387 - protein, 5 aa, Entamoeba dispar
TEQTY

SEQ ID NO: 2465388 - protein, 12 aa, Entamoeba dispar
TEQYNEENENRD

SEQ ID NO: 2465389 - protein, 14 aa, Entamoeba dispar
TERDPRTIKSNEKT

SEQ ID NO: 2465390 - protein, 11 aa, Entamoeba dispar
TERENISSEAM

SEQ ID NO: 2465391 - protein, 4 aa, Entamoeba dispar
TERF

SEQ ID NO: 2465392 - protein, 8 aa, Entamoeba dispar
TERGELKM

SEQ ID NO: 2465393 - protein, 12 aa, Entamoeba dispar
TERGKNKFGRHT

SEQ ID NO: 2465394 - protein, 11 aa, Entamoeba dispar
TERIPSEDIQN

SEQ ID NO: 2465395 - protein, 22 aa, Entamoeba dispar
TERKQHGHKERSRSRERNQHTF

SEQ ID NO: 2465396 - protein, 5 aa, Entamoeba dispar
TERLG

SEQ ID NO: 2465397 - protein, 6 aa, Entamoeba dispar
TERPER

SEQ ID NO: 2465398 - protein, 9 aa, Entamoeba dispar
TERRGTSEL

SEQ ID NO: 2465399 - protein, 4 aa, Entamoeba dispar
TERS

SEQ ID NO: 2465400 - protein, 4 aa, Entamoeba dispar
TESC

SEQ ID NO: 2465401 - protein, 6 aa, Entamoeba dispar
TESCGG

SEQ ID NO: 2465402 - protein, 5 aa, Entamoeba dispar
TESCS

SEQ ID NO: 2465403 - protein, 16 aa, Entamoeba dispar
TESEALRSRIDKRKLG

SEQ ID NO: 2465404 - protein, 6 aa, Entamoeba dispar
TESEEA

SEQ ID NO: 2465405 - protein, 12 aa, Entamoeba dispar
TESESSLDMESA

SEQ ID NO: 2465406 - protein, 9 aa, Entamoeba dispar
TESGQHQMD

SEQ ID NO: 2465407 - protein, 6 aa, Entamoeba dispar
TESGYS

SEQ ID NO: 2465408 - protein, 5 aa, Entamoeba dispar
TESKI

SEQ ID NO: 2465409 - protein, 9 aa, Entamoeba dispar
TESKKDGLI

SEQ ID NO: 2465410 - protein, 12 aa, Entamoeba dispar
TESLKHDNNQDL

SEQ ID NO: 2465411 - protein, 8 aa, Entamoeba dispar
TESLQSER

SEQ ID NO: 2465412 - protein, 10 aa, Entamoeba dispar
TESNNKKQFT

SEQ ID NO: 2465413 - protein, 8 aa, Entamoeba dispar
TESNNTQS

SEQ ID NO: 2465414 - protein, 6 aa, Entamoeba dispar
TESPCS

SEQ ID NO: 2465415 - protein, 17 aa, Entamoeba dispar
TESQNSICEDGVEAKSS

SEQ ID NO: 2465416 - protein, 9 aa, Entamoeba dispar
TESQSDPVV

SEQ ID NO: 2465417 - protein, 10 aa, Entamoeba dispar
TESQSEPGIN

SEQ ID NO: 2465418 - protein, 10 aa, Entamoeba dispar
TESQTEPGIN

SEQ ID NO: 2465419 - protein, 10 aa, Entamoeba dispar
TESQVDPNVN

SEQ ID NO: 2465420 - protein, 6 aa, Entamoeba dispar
TESRCK

SEQ ID NO: 2465421 - protein, 5 aa, Entamoeba dispar
TESRQ

SEQ ID NO: 2465422 - protein, 14 aa, Entamoeba dispar
TESSALIKSSAARA

SEQ ID NO: 2465423 - protein, 22 aa, Entamoeba dispar
TESSFKENGGKPYCFTCYGKLF

SEQ ID NO: 2465424 - protein, 9 aa, Entamoeba dispar
TESSKDRNN

SEQ ID NO: 2465425 - protein, 7 aa, Entamoeba dispar
TESTEQH

SEQ ID NO: 2465426 - protein, 8 aa, Entamoeba dispar
TESVGTKA

SEQ ID NO: 2465427 - protein, 5 aa, Entamoeba dispar
TESVS

SEQ ID NO: 2465428 - protein, 8 aa, Entamoeba dispar
TESYPTAT

SEQ ID NO: 2465429 - protein, 4 aa, Entamoeba dispar
TETA

SEQ ID NO: 2465430 - protein, 6 aa, Entamoeba dispar
TETAPI

SEQ ID NO: 2465431 - protein, 10 aa, Entamoeba dispar
TETEPDGVYT

SEQ ID NO: 2465432 - protein, 5 aa, Entamoeba dispar
TETFN

SEQ ID NO: 2465433 - protein, 4 aa, Entamoeba dispar
TETG

SEQ ID NO: 2465434 - protein, 7 aa, Entamoeba dispar
TETGPKY

SEQ ID NO: 2465435 - protein, 6 aa, Entamoeba dispar
TETHSN

SEQ ID NO: 2465436 - protein, 10 aa, Entamoeba dispar
TETKEQTAKE

SEQ ID NO: 2465437 - protein, 13 aa, Entamoeba dispar
TETKKSDKKEALA

SEQ ID NO: 2465438 - protein, 7 aa, Entamoeba dispar
TETKTTI

SEQ ID NO: 2465439 - protein, 9 aa, Entamoeba dispar
TETLRAENA

SEQ ID NO: 2465440 - protein, 10 aa, Entamoeba dispar
TETNKNACNS

SEQ ID NO: 2465441 - protein, 8 aa, Entamoeba dispar
TETNLTDN

SEQ ID NO: 2465442 - protein, 7 aa, Entamoeba dispar
TETNYTN

SEQ ID NO: 2465443 - protein, 8 aa, Entamoeba dispar
TETPFPNG

SEQ ID NO: 2465444 - protein, 24 aa, Entamoeba dispar
TETPKGEYKEKAVTQYPPEKRESI

SEQ ID NO: 2465445 - protein, 18 aa, Entamoeba dispar
TETPKNVISKSKQTTVAD

SEQ ID NO: 2465446 - protein, 10 aa, Entamoeba dispar
TETRQQTAQD

SEQ ID NO: 2465447 - protein, 7 aa, Entamoeba dispar
TETSKAE

SEQ ID NO: 2465448 - protein, 14 aa, Entamoeba dispar
TETSKKNSSKTVND

SEQ ID NO: 2465449 - protein, 8 aa, Entamoeba dispar
TETTDYQK

SEQ ID NO: 2465450 - protein, 15 aa, Entamoeba dispar
TETTEYSSSSDDLEL

SEQ ID NO: 2465451 - protein, 6 aa, Entamoeba dispar
TETTGM

SEQ ID NO: 2465452 - protein, 5 aa, Entamoeba dispar
TETTH

SEQ ID NO: 2465453 - protein, 8 aa, Entamoeba dispar
TETTKARL

SEQ ID NO: 2465454 - protein, 10 aa, Entamoeba dispar
TETTKKRLES

SEQ ID NO: 2465455 - protein, 6 aa, Entamoeba dispar
TETTKR

SEQ ID NO: 2465456 - protein, 8 aa, Entamoeba dispar
TETTPSAD

SEQ ID NO: 2465457 - protein, 4 aa, Entamoeba dispar
TETV

SEQ ID NO: 2465458 - protein, 8 aa, Entamoeba dispar
TETVHDPS

SEQ ID NO: 2465459 - protein, 13 aa, Entamoeba dispar
TETYETHSYGEKE

SEQ ID NO: 2465460 - protein, 5 aa, Entamoeba dispar
TETYS

SEQ ID NO: 2465461 - protein, 6 aa, Entamoeba dispar
TEVDGP

SEQ ID NO: 2465462 - protein, 9 aa, Entamoeba dispar
TEVEKRKPI

SEQ ID NO: 2465463 - protein, 19 aa, Entamoeba dispar
TEVGIKTKQETQKLYQCIV

SEQ ID NO: 2465464 - protein, 6 aa, Entamoeba dispar
TEVGNI

SEQ ID NO: 2465465 - protein, 10 aa, Entamoeba dispar
TEVKERKKEM

SEQ ID NO: 2465466 - protein, 13 aa, Entamoeba dispar
TEVNEKSQEKEEI

SEQ ID NO: 2465467 - protein, 8 aa, Entamoeba dispar
TEVPQKDN

SEQ ID NO: 2465468 - protein, 14 aa, Entamoeba dispar
TEVRGKQLGPPKIG

SEQ ID NO: 2465469 - protein, 4 aa, Entamoeba dispar
TEVT

SEQ ID NO: 2465470 - protein, 11 aa, Entamoeba dispar
TEVYAQSTHAD

SEQ ID NO: 2465471 - protein, 4 aa, Entamoeba dispar
TEWK

SEQ ID NO: 2465472 - protein, 9 aa, Entamoeba dispar
TEYDKNGPI

SEQ ID NO: 2465473 - protein, 9 aa, Entamoeba dispar
TEYDRNKYG

SEQ ID NO: 2465474 - protein, 14 aa, Entamoeba dispar
TEYKEKKVPEFSSE

SEQ ID NO: 2465475 - protein, 6 aa, Entamoeba dispar
TEYNAG

SEQ ID NO: 2465476 - protein, 11 aa, Entamoeba dispar
TEYNQSIGYSQ

SEQ ID NO: 2465477 - protein, 4 aa, Entamoeba dispar
TEYQ

SEQ ID NO: 2465478 - protein, 23 aa, Entamoeba dispar
TEYRKATIKKGSAIKKKGDVTNS

SEQ ID NO: 2465479 - protein, 5 aa, Entamoeba dispar
TEYTP

SEQ ID NO: 2465480 - protein, 4 aa, Entamoeba dispar
TEYY

SEQ ID NO: 2465481 - protein, 9 aa, Entamoeba dispar
TEYYKNKGI

SEQ ID NO: 2465482 - protein, 11 aa, Entamoeba dispar
TFDKNEEDSAY

SEQ ID NO: 2465483 - protein, 19 aa, Entamoeba dispar
TFDKRRNDRTSFSWLFKNL

SEQ ID NO: 2465484 - protein, 6 aa, Entamoeba dispar
TFDNNN

SEQ ID NO: 2465485 - protein, 9 aa, Entamoeba dispar
TFDTSDKVS

SEQ ID NO: 2465486 - protein, 5 aa, Entamoeba dispar
TFEEE

SEQ ID NO: 2465487 - protein, 12 aa, Entamoeba dispar
TFEETKNQNDGF

SEQ ID NO: 2465488 - protein, 5 aa, Entamoeba dispar
TFEGY

SEQ ID NO: 2465489 - protein, 17 aa, Entamoeba dispar
TFEKDKKNRLKRKPSEH

SEQ ID NO: 2465490 - protein, 5 aa, Entamoeba dispar
TFEKT

SEQ ID NO: 2465491 - protein, 5 aa, Entamoeba dispar
TFEPN

SEQ ID NO: 2465492 - protein, 7 aa, Entamoeba dispar
TFEPREI

SEQ ID NO: 2465493 - protein, 5 aa, Entamoeba dispar
TFEQS

SEQ ID NO: 2465494 - protein, 8 aa, Entamoeba dispar
TFGHTSEV

SEQ ID NO: 2465495 - protein, 12 aa, Entamoeba dispar
TFGKNDSLGSTH

SEQ ID NO: 2465496 - protein, 11 aa, Entamoeba dispar
TFGKNEENTVG

SEQ ID NO: 2465497 - protein, 12 aa, Entamoeba dispar
TFGNEFSNEAAQ

SEQ ID NO: 2465498 - protein, 32 aa, Entamoeba dispar
TFGQQQNNSIGGFGQQQSNPLGGFGQPQTGSS

SEQ ID NO: 2465499 - protein, 30 aa, Entamoeba dispar
TFGQQQNSGMGGFGQQQSNPLGGFGQPQSN

SEQ ID NO: 2465500 - protein, 14 aa, Entamoeba dispar
TFGSDKKEEEEEDD

SEQ ID NO: 2465501 - protein, 5 aa, Entamoeba dispar
TFGTG

SEQ ID NO: 2465502 - protein, 8 aa, Entamoeba dispar
TFKASGPM

SEQ ID NO: 2465503 - protein, 4 aa, Entamoeba dispar
TFKG

SEQ ID NO: 2465504 - protein, 10 aa, Entamoeba dispar
TFKPQYSESE

SEQ ID NO: 2465505 - protein, 22 aa, Entamoeba dispar
TFKRSQSIQPTPQKRLNPSRNP

SEQ ID NO: 2465506 - protein, 14 aa, Entamoeba dispar
TFNASDNSKQRTIG

SEQ ID NO: 2465507 - protein, 6 aa, Entamoeba dispar
TFNDGK

SEQ ID NO: 2465508 - protein, 7 aa, Entamoeba dispar
TFNEKKA

SEQ ID NO: 2465509 - protein, 13 aa, Entamoeba dispar
TFNGSGKVLKDPG

SEQ ID NO: 2465510 - protein, 4 aa, Entamoeba dispar
TFNQ

SEQ ID NO: 2465511 - protein, 19 aa, Entamoeba dispar
TFNQNSPKIDDSSQDEKKE

SEQ ID NO: 2465512 - protein, 13 aa, Entamoeba dispar
TFNQPERQENKIE

SEQ ID NO: 2465513 - protein, 21 aa, Entamoeba dispar
TFNSSTGYIPQQNQQYSYNPY

SEQ ID NO: 2465514 - protein, 10 aa, Entamoeba dispar
TFNTPQPPQA

SEQ ID NO: 2465515 - protein, 5 aa, Entamoeba dispar
TFNTQ

SEQ ID NO: 2465516 - protein, 15 aa, Entamoeba dispar
TFNTSQYSTLWQNYS

SEQ ID NO: 2465517 - protein, 11 aa, Entamoeba dispar
TFNVPSDSNRL

SEQ ID NO: 2465518 - protein, 7 aa, Entamoeba dispar
TFPESPV

SEQ ID NO: 2465519 - protein, 6 aa, Entamoeba dispar
TFPKEG

SEQ ID NO: 2465520 - protein, 20 aa, Entamoeba dispar
TFPKEIDAKEKEYKSQRKRS

SEQ ID NO: 2465521 - protein, 10 aa, Entamoeba dispar
TFPKKPKKAF

SEQ ID NO: 2465522 - protein, 5 aa, Entamoeba dispar
TFPLE

SEQ ID NO: 2465523 - protein, 29 aa, Entamoeba dispar
TFPSFGQPTQQNTNKFPSFNQTQEQPQQF

SEQ ID NO: 2465524 - protein, 31 aa, Entamoeba dispar
TFQENKRPTSAPLEPNNQGIEKSQNQSPFED

SEQ ID NO: 2465525 - protein, 4 aa, Entamoeba dispar
TFQG

SEQ ID NO: 2465526 - protein, 4 aa, Entamoeba dispar
TFQR

SEQ ID NO: 2465527 - protein, 8 aa, Entamoeba dispar
TFQRKPFG

SEQ ID NO: 2465528 - protein, 9 aa, Entamoeba dispar
TFRASKTMQ

SEQ ID NO: 2465529 - protein, 9 aa, Entamoeba dispar
TFREEYEST

SEQ ID NO: 2465530 - protein, 12 aa, Entamoeba dispar
TFSDGLPKVPKE

SEQ ID NO: 2465531 - protein, 5 aa, Entamoeba dispar
TFSNE

SEQ ID NO: 2465532 - protein, 13 aa, Entamoeba dispar
TFSNEVDGMNTSM

SEQ ID NO: 2465533 - protein, 7 aa, Entamoeba dispar
TFSPSGK

SEQ ID NO: 2465534 - protein, 7 aa, Entamoeba dispar
TFSPTTQ

SEQ ID NO: 2465535 - protein, 13 aa, Entamoeba dispar
TFSSGKHNSTKLE

SEQ ID NO: 2465536 - protein, 6 aa, Entamoeba dispar
TFTPNT

SEQ ID NO: 2465537 - protein, 12 aa, Entamoeba dispar
TFTSDDSLGDAK

SEQ ID NO: 2465538 - protein, 13 aa, Entamoeba dispar
TFTTDRGSEVNGT

SEQ ID NO: 2465539 - protein, 13 aa, Entamoeba dispar
TGADGTIQWYSDW

SEQ ID NO: 2465540 - protein, 8 aa, Entamoeba dispar
TGADKKAL

SEQ ID NO: 2465541 - protein, 6 aa, Entamoeba dispar
TGAGFG

SEQ ID NO: 2465542 - protein, 8 aa, Entamoeba dispar
TGAGLSGR

SEQ ID NO: 2465543 - protein, 7 aa, Entamoeba dispar
TGAPNMP

SEQ ID NO: 2465544 - protein, 6 aa, Entamoeba dispar
TGATAK

SEQ ID NO: 2465545 - protein, 5 aa, Entamoeba dispar
TGATL

SEQ ID NO: 2465546 - protein, 7 aa, Entamoeba dispar
TGCADGK

SEQ ID NO: 2465547 - protein, 16 aa, Entamoeba dispar
TGCDGTTGAYSPSKGL

SEQ ID NO: 2465548 - protein, 10 aa, Entamoeba dispar
TGCGKTTQLT

SEQ ID NO: 2465549 - protein, 12 aa, Entamoeba dispar
TGCSNIDESSLK

SEQ ID NO: 2465550 - protein, 7 aa, Entamoeba dispar
TGDAYTA

SEQ ID NO: 2465551 - protein, 21 aa, Entamoeba dispar
TGDDDFKDLPPVKPWQDTTVT

SEQ ID NO: 2465552 - protein, 8 aa, Entamoeba dispar
TGDESGRI

SEQ ID NO: 2465553 - protein, 8 aa, Entamoeba dispar
TGDETGKI

SEQ ID NO: 2465554 - protein, 5 aa, Entamoeba dispar
TGDFV

SEQ ID NO: 2465555 - protein, 9 aa, Entamoeba dispar
TGDGESRAI

SEQ ID NO: 2465556 - protein, 6 aa, Entamoeba dispar
TGDGIS

SEQ ID NO: 2465557 - protein, 7 aa, Entamoeba dispar
TGDGKSA

SEQ ID NO: 2465558 - protein, 9 aa, Entamoeba dispar
TGDGKSSLG

SEQ ID NO: 2465559 - protein, 14 aa, Entamoeba dispar
TGDGTIRKNVDART

SEQ ID NO: 2465560 - protein, 5 aa, Entamoeba dispar
TGDIG

SEQ ID NO: 2465561 - protein, 9 aa, Entamoeba dispar
TGDNCPSIT

SEQ ID NO: 2465562 - protein, 4 aa, Entamoeba dispar
TGDQ

SEQ ID NO: 2465563 - protein, 8 aa, Entamoeba dispar
TGDTTISS

SEQ ID NO: 2465564 - protein, 6 aa, Entamoeba dispar
TGEEAK

SEQ ID NO: 2465565 - protein, 7 aa, Entamoeba dispar
TGEEESL

SEQ ID NO: 2465566 - protein, 7 aa, Entamoeba dispar
TGEETPY

SEQ ID NO: 2465567 - protein, 6 aa, Entamoeba dispar
TGEKPY

SEQ ID NO: 2465568 - protein, 15 aa, Entamoeba dispar
TGELTESIQEDEYPL

SEQ ID NO: 2465569 - protein, 11 aa, Entamoeba dispar
TGENTQTLDVS

SEQ ID NO: 2465570 - protein, 4 aa, Entamoeba dispar
TGER

SEQ ID NO: 2465571 - protein, 6 aa, Entamoeba dispar
TGEREN

SEQ ID NO: 2465572 - protein, 12 aa, Entamoeba dispar
TGESGTKATGIP

SEQ ID NO: 2465573 - protein, 5 aa, Entamoeba dispar
TGETL

SEQ ID NO: 2465574 - protein, 8 aa, Entamoeba dispar
TGETPQQL

SEQ ID NO: 2465575 - protein, 6 aa, Entamoeba dispar
TGETTI

SEQ ID NO: 2465576 - protein, 27 aa, Entamoeba dispar
TGFEEQPKEEIIRKEDKQEKQNEKEDC

SEQ ID NO: 2465577 - protein, 5 aa, Entamoeba dispar
TGFGD

SEQ ID NO: 2465578 - protein, 10 aa, Entamoeba dispar
TGFGGKGANQ

SEQ ID NO: 2465579 - protein, 54 aa, Entamoeba dispar
TGFGNSNTTGFGNGNTTGFGSGFGSTTGGFGNNNSGLTNGFGNNNNTKAGVGFG

SEQ ID NO: 2465580 - protein, 5 aa, Entamoeba dispar
TGFQP

SEQ ID NO: 2465581 - protein, 4 aa, Entamoeba dispar
TGGD

SEQ ID NO: 2465582 - protein, 4 aa, Entamoeba dispar
TGGE

SEQ ID NO: 2465583 - protein, 5 aa, Entamoeba dispar
TGGEI

SEQ ID NO: 2465584 - protein, 6 aa, Entamoeba dispar
TGGGAY

SEQ ID NO: 2465585 - protein, 8 aa, Entamoeba dispar
TGGIAGET

SEQ ID NO: 2465586 - protein, 11 aa, Entamoeba dispar
TGGKDTKEEAK

SEQ ID NO: 2465587 - protein, 15 aa, Entamoeba dispar
TGGKTVDDSRLAGRK

SEQ ID NO: 2465588 - protein, 4 aa, Entamoeba dispar
TGGM

SEQ ID NO: 2465589 - protein, 5 aa, Entamoeba dispar
TGGNK

SEQ ID NO: 2465590 - protein, 29 aa, Entamoeba dispar
TGGSDNTSIAKDTNKMKKAYDFGEKIAQK

SEQ ID NO: 2465591 - protein, 7 aa, Entamoeba dispar
TGGSNDV

SEQ ID NO: 2465592 - protein, 5 aa, Entamoeba dispar
TGHEK

SEQ ID NO: 2465593 - protein, 6 aa, Entamoeba dispar
TGHENR

SEQ ID NO: 2465594 - protein, 9 aa, Entamoeba dispar
TGHGKSSLG

SEQ ID NO: 2465595 - protein, 24 aa, Entamoeba dispar
TGHITDKTEDKHTKIRSSQAPLDP

SEQ ID NO: 2465596 - protein, 11 aa, Entamoeba dispar
TGHKSHEKIPI

SEQ ID NO: 2465597 - protein, 5 aa, Entamoeba dispar
TGHND

SEQ ID NO: 2465598 - protein, 4 aa, Entamoeba dispar
TGHP

SEQ ID NO: 2465599 - protein, 6 aa, Entamoeba dispar
TGHQTQ

SEQ ID NO: 2465600 - protein, 8 aa, Entamoeba dispar
TGHSQAVS

SEQ ID NO: 2465601 - protein, 5 aa, Entamoeba dispar
TGHSY

SEQ ID NO: 2465602 - protein, 8 aa, Entamoeba dispar
TGHVESEQ

SEQ ID NO: 2465603 - protein, 18 aa, Entamoeba dispar
TGHYTPASAGNSPINRPI

SEQ ID NO: 2465604 - protein, 13 aa, Entamoeba dispar
TGIEESLSQCESG

SEQ ID NO: 2465605 - protein, 15 aa, Entamoeba dispar
TGIEGDIKEISKGSN

SEQ ID NO: 2465606 - protein, 99 aa, Entamoeba dispar
TGIEKEKTYDRGRVEDQRDSSRYSRSHSRRRYSRSRSKGHYSRSRSRGRYPRNRSRSHYSRSRSRSHYSRSRSRSSDKYYSRTRRSRSRRRSDSRRRRR

SEQ ID NO: 2465607 - protein, 4 aa, Entamoeba dispar
TGIK

SEQ ID NO: 2465608 - protein, 9 aa, Entamoeba dispar
TGIKEGNNY

SEQ ID NO: 2465609 - protein, 11 aa, Entamoeba dispar
TGIKNSGNTCY

SEQ ID NO: 2465610 - protein, 7 aa, Entamoeba dispar
TGIQSKL

SEQ ID NO: 2465611 - protein, 5 aa, Entamoeba dispar
TGIRK

SEQ ID NO: 2465612 - protein, 4 aa, Entamoeba dispar
TGIT

SEQ ID NO: 2465613 - protein, 7 aa, Entamoeba dispar
TGITKED

SEQ ID NO: 2465614 - protein, 12 aa, Entamoeba dispar
TGITKGRKFSYS

SEQ ID NO: 2465615 - protein, 5 aa, Entamoeba dispar
TGIYP

SEQ ID NO: 2465616 - protein, 4 aa, Entamoeba dispar
TGKC

SEQ ID NO: 2465617 - protein, 9 aa, Entamoeba dispar
TGKDFGNDE

SEQ ID NO: 2465618 - protein, 9 aa, Entamoeba dispar
TGKDFGNEE

SEQ ID NO: 2465619 - protein, 6 aa, Entamoeba dispar
TGKDGE

SEQ ID NO: 2465620 - protein, 10 aa, Entamoeba dispar
TGKDLPKDTI

SEQ ID NO: 2465621 - protein, 12 aa, Entamoeba dispar
TGKDNTKRTSKA

SEQ ID NO: 2465622 - protein, 22 aa, Entamoeba dispar
TGKDTIEPTPEGIKKYLTTHKI

SEQ ID NO: 2465623 - protein, 21 aa, Entamoeba dispar
TGKDTIEPTPERNQEIFNNTL

SEQ ID NO: 2465624 - protein, 19 aa, Entamoeba dispar
TGKDTIEQTPEGIKKYLTT

SEQ ID NO: 2465625 - protein, 9 aa, Entamoeba dispar
TGKDVELDD

SEQ ID NO: 2465626 - protein, 9 aa, Entamoeba dispar
TGKGEYGEG

SEQ ID NO: 2465627 - protein, 4 aa, Entamoeba dispar
TGKI

SEQ ID NO: 2465628 - protein, 15 aa, Entamoeba dispar
TGKIETIKDENSEQF

SEQ ID NO: 2465629 - protein, 10 aa, Entamoeba dispar
TGKIKSSVGG

SEQ ID NO: 2465630 - protein, 15 aa, Entamoeba dispar
TGKISQTKPVGHKTK

SEQ ID NO: 2465631 - protein, 9 aa, Entamoeba dispar
TGKKEKAEE

SEQ ID NO: 2465632 - protein, 7 aa, Entamoeba dispar
TGKNEAV

SEQ ID NO: 2465633 - protein, 5 aa, Entamoeba dispar
TGKNG

SEQ ID NO: 2465634 - protein, 8 aa, Entamoeba dispar
TGKNKKGI

SEQ ID NO: 2465635 - protein, 15 aa, Entamoeba dispar
TGKNKQHPDPLEQND

SEQ ID NO: 2465636 - protein, 10 aa, Entamoeba dispar
TGKQKEENFG

SEQ ID NO: 2465637 - protein, 5 aa, Entamoeba dispar
TGKSL

SEQ ID NO: 2465638 - protein, 13 aa, Entamoeba dispar
TGKTATPDQAQEV

SEQ ID NO: 2465639 - protein, 17 aa, Entamoeba dispar
TGKTLDKKYDKNPKDVI

SEQ ID NO: 2465640 - protein, 4 aa, Entamoeba dispar
TGKW

SEQ ID NO: 2465641 - protein, 12 aa, Entamoeba dispar
TGKYTRKQEDIL

SEQ ID NO: 2465642 - protein, 13 aa, Entamoeba dispar
TGLEKEEEQEMDQ

SEQ ID NO: 2465643 - protein, 4 aa, Entamoeba dispar
TGLN

SEQ ID NO: 2465644 - protein, 11 aa, Entamoeba dispar
TGLPQQTSQPI

SEQ ID NO: 2465645 - protein, 6 aa, Entamoeba dispar
TGLYDT

SEQ ID NO: 2465646 - protein, 13 aa, Entamoeba dispar
TGMKTKDGKNPST

SEQ ID NO: 2465647 - protein, 6 aa, Entamoeba dispar
TGMNNK

SEQ ID NO: 2465648 - protein, 15 aa, Entamoeba dispar
TGNAKPVEKETRTTV

SEQ ID NO: 2465649 - protein, 10 aa, Entamoeba dispar
TGNALKGSRP

SEQ ID NO: 2465650 - protein, 31 aa, Entamoeba dispar
TGNDITEQAKAKSKARGIAARARGGKRTNLS

SEQ ID NO: 2465651 - protein, 5 aa, Entamoeba dispar
TGNDL

SEQ ID NO: 2465652 - protein, 20 aa, Entamoeba dispar
TGNDMSISTGWGGGYNGEDI

SEQ ID NO: 2465653 - protein, 5 aa, Entamoeba dispar
TGNDN

SEQ ID NO: 2465654 - protein, 7 aa, Entamoeba dispar
TGNEEAI

SEQ ID NO: 2465655 - protein, 6 aa, Entamoeba dispar
TGNETG

SEQ ID NO: 2465656 - protein, 12 aa, Entamoeba dispar
TGNGDLSKGIPI

SEQ ID NO: 2465657 - protein, 5 aa, Entamoeba dispar
TGNGF

SEQ ID NO: 2465658 - protein, 6 aa, Entamoeba dispar
TGNGKS

SEQ ID NO: 2465659 - protein, 8 aa, Entamoeba dispar
TGNIPDNY

SEQ ID NO: 2465660 - protein, 5 aa, Entamoeba dispar
TGNNR

SEQ ID NO: 2465661 - protein, 5 aa, Entamoeba dispar
TGNPI

SEQ ID NO: 2465662 - protein, 13 aa, Entamoeba dispar
TGNPSDANKMTTE

SEQ ID NO: 2465663 - protein, 10 aa, Entamoeba dispar
TGNQLEEQKR

SEQ ID NO: 2465664 - protein, 8 aa, Entamoeba dispar
TGNQQSAI

SEQ ID NO: 2465665 - protein, 8 aa, Entamoeba dispar
TGNQWNKQ

SEQ ID NO: 2465666 - protein, 6 aa, Entamoeba dispar
TGNSLQ

SEQ ID NO: 2465667 - protein, 6 aa, Entamoeba dispar
TGNSTK

SEQ ID NO: 2465668 - protein, 6 aa, Entamoeba dispar
TGNTAG

SEQ ID NO: 2465669 - protein, 7 aa, Entamoeba dispar
TGNTKNR

SEQ ID NO: 2465670 - protein, 32 aa, Entamoeba dispar
TGNTKTEETEEKKIDYKPRQAIRTSKNQDNSF

SEQ ID NO: 2465671 - protein, 9 aa, Entamoeba dispar
TGNTSESAL

SEQ ID NO: 2465672 - protein, 7 aa, Entamoeba dispar
TGNVEAA

SEQ ID NO: 2465673 - protein, 5 aa, Entamoeba dispar
TGPAT

SEQ ID NO: 2465674 - protein, 6 aa, Entamoeba dispar
TGPHGV

SEQ ID NO: 2465675 - protein, 6 aa, Entamoeba dispar
TGPMRN

SEQ ID NO: 2465676 - protein, 11 aa, Entamoeba dispar
TGPNGAGKTTI

SEQ ID NO: 2465677 - protein, 6 aa, Entamoeba dispar
TGPNNT

SEQ ID NO: 2465678 - protein, 10 aa, Entamoeba dispar
TGPNSSGKTI

SEQ ID NO: 2465679 - protein, 4 aa, Entamoeba dispar
TGPS

SEQ ID NO: 2465680 - protein, 10 aa, Entamoeba dispar
TGPSPITGEI

SEQ ID NO: 2465681 - protein, 6 aa, Entamoeba dispar
TGPTIG

SEQ ID NO: 2465682 - protein, 5 aa, Entamoeba dispar
TGPTL

SEQ ID NO: 2465683 - protein, 11 aa, Entamoeba dispar
TGPVAEQREIG

SEQ ID NO: 2465684 - protein, 17 aa, Entamoeba dispar
TGQKGYISKRPKIEEAR

SEQ ID NO: 2465685 - protein, 8 aa, Entamoeba dispar
TGQKYTLE

SEQ ID NO: 2465686 - protein, 7 aa, Entamoeba dispar
TGQPSSL

SEQ ID NO: 2465687 - protein, 8 aa, Entamoeba dispar
TGQTVSHD

SEQ ID NO: 2465688 - protein, 8 aa, Entamoeba dispar
TGQYQKPQ

SEQ ID NO: 2465689 - protein, 9 aa, Entamoeba dispar
TGRDQALQE

SEQ ID NO: 2465690 - protein, 58 aa, Entamoeba dispar
TGRPASPSAAPAPRCCSPPAAAGLSTGGASCRRAGGRAVRGGLAGERRHAARAPDPLA

SEQ ID NO: 2465691 - protein, 4 aa, Entamoeba dispar
TGRT

SEQ ID NO: 2465692 - protein, 8 aa, Entamoeba dispar
TGSEKRVT

SEQ ID NO: 2465693 - protein, 11 aa, Entamoeba dispar
TGSFGENGSQA

SEQ ID NO: 2465694 - protein, 7 aa, Entamoeba dispar
TGSGKNA

SEQ ID NO: 2465695 - protein, 7 aa, Entamoeba dispar
TGSGKSA

SEQ ID NO: 2465696 - protein, 7 aa, Entamoeba dispar
TGSHEPS

SEQ ID NO: 2465697 - protein, 8 aa, Entamoeba dispar
TGSHQPDT

SEQ ID NO: 2465698 - protein, 7 aa, Entamoeba dispar
TGSIGGN

SEQ ID NO: 2465699 - protein, 15 aa, Entamoeba dispar
TGSKCVTSKQHNTNI

SEQ ID NO: 2465700 - protein, 8 aa, Entamoeba dispar
TGSKDKKL

SEQ ID NO: 2465701 - protein, 9 aa, Entamoeba dispar
TGSLPNAKD

SEQ ID NO: 2465702 - protein, 4 aa, Entamoeba dispar
TGSN

SEQ ID NO: 2465703 - protein, 14 aa, Entamoeba dispar
TGSNASSGKRTYGR

SEQ ID NO: 2465704 - protein, 8 aa, Entamoeba dispar
TGSNCGDV

SEQ ID NO: 2465705 - protein, 8 aa, Entamoeba dispar
TGSRFNGK

SEQ ID NO: 2465706 - protein, 9 aa, Entamoeba dispar
TGSRNPHSW

SEQ ID NO: 2465707 - protein, 11 aa, Entamoeba dispar
TGSSLTSSGDK

SEQ ID NO: 2465708 - protein, 5 aa, Entamoeba dispar
TGSSP

SEQ ID NO: 2465709 - protein, 7 aa, Entamoeba dispar
TGSTDGI

SEQ ID NO: 2465710 - protein, 7 aa, Entamoeba dispar
TGSTLKE

SEQ ID NO: 2465711 - protein, 5 aa, Entamoeba dispar
TGSVT

SEQ ID NO: 2465712 - protein, 6 aa, Entamoeba dispar
TGTAVS

SEQ ID NO: 2465713 - protein, 19 aa, Entamoeba dispar
TGTDVNNDSEITQLTNSSF

SEQ ID NO: 2465714 - protein, 4 aa, Entamoeba dispar
TGTE

SEQ ID NO: 2465715 - protein, 4 aa, Entamoeba dispar
TGTF

SEQ ID NO: 2465716 - protein, 13 aa, Entamoeba dispar
TGTFGNSTNTGFG

SEQ ID NO: 2465717 - protein, 7 aa, Entamoeba dispar
TGTGSTL

SEQ ID NO: 2465718 - protein, 7 aa, Entamoeba dispar
TGTIEAE

SEQ ID NO: 2465719 - protein, 4 aa, Entamoeba dispar
TGTK

SEQ ID NO: 2465720 - protein, 21 aa, Entamoeba dispar
TGTKAMKTDYTRNGKRGFSGV

SEQ ID NO: 2465721 - protein, 13 aa, Entamoeba dispar
TGTKMYETKRAEA

SEQ ID NO: 2465722 - protein, 4 aa, Entamoeba dispar
TGTL

SEQ ID NO: 2465723 - protein, 9 aa, Entamoeba dispar
TGTPGTGKS

SEQ ID NO: 2465724 - protein, 10 aa, Entamoeba dispar
TGTPVPKGIS

SEQ ID NO: 2465725 - protein, 7 aa, Entamoeba dispar
TGTYNDK

SEQ ID NO: 2465726 - protein, 11 aa, Entamoeba dispar
TGVDPTQTTGK

SEQ ID NO: 2465727 - protein, 7 aa, Entamoeba dispar
TGVGKSS

SEQ ID NO: 2465728 - protein, 8 aa, Entamoeba dispar
TGVGKSSL

SEQ ID NO: 2465729 - protein, 14 aa, Entamoeba dispar
TGVISNSGKFTVNA

SEQ ID NO: 2465730 - protein, 6 aa, Entamoeba dispar
TGVNEE

SEQ ID NO: 2465731 - protein, 10 aa, Entamoeba dispar
TGVQEEDIQM

SEQ ID NO: 2465732 - protein, 12 aa, Entamoeba dispar
TGVSRRGYVIID

SEQ ID NO: 2465733 - protein, 4 aa, Entamoeba dispar
TGVY

SEQ ID NO: 2465734 - protein, 7 aa, Entamoeba dispar
TGVYPPK

SEQ ID NO: 2465735 - protein, 13 aa, Entamoeba dispar
TGWGTKQGGSWKS

SEQ ID NO: 2465736 - protein, 14 aa, Entamoeba dispar
TGWPAGKRIKPTER

SEQ ID NO: 2465737 - protein, 4 aa, Entamoeba dispar
TGYE

SEQ ID NO: 2465738 - protein, 7 aa, Entamoeba dispar
TGYEEAA

SEQ ID NO: 2465739 - protein, 5 aa, Entamoeba dispar
TGYEN

SEQ ID NO: 2465740 - protein, 8 aa, Entamoeba dispar
TGYGKSSL

SEQ ID NO: 2465741 - protein, 17 aa, Entamoeba dispar
TGYGSNIGDPSENNCNQ

SEQ ID NO: 2465742 - protein, 10 aa, Entamoeba dispar
TGYPASPPRC

SEQ ID NO: 2465743 - protein, 6 aa, Entamoeba dispar
TGYPVV

SEQ ID NO: 2465744 - protein, 5 aa, Entamoeba dispar
TGYTQ

SEQ ID NO: 2465745 - protein, 6 aa, Entamoeba dispar
THAGFT

SEQ ID NO: 2465746 - protein, 74 aa, Entamoeba dispar
THANTEQTIKEITESEIPPKRKQLGGKKKKVDEISDIPKRKALNPKKSSKLKNCTSSSKEDTTTKEKQSQTKIP

SEQ ID NO: 2465747 - protein, 14 aa, Entamoeba dispar
THCESDSELSIERK

SEQ ID NO: 2465748 - protein, 6 aa, Entamoeba dispar
THDDPD

SEQ ID NO: 2465749 - protein, 12 aa, Entamoeba dispar
THDGRSPDYDDW

SEQ ID NO: 2465750 - protein, 5 aa, Entamoeba dispar
THDHQ

SEQ ID NO: 2465751 - protein, 4 aa, Entamoeba dispar
THDK

SEQ ID NO: 2465752 - protein, 5 aa, Entamoeba dispar
THDNE

SEQ ID NO: 2465753 - protein, 21 aa, Entamoeba dispar
THDSIHPEEPTFSSTMSELEK

SEQ ID NO: 2465754 - protein, 7 aa, Entamoeba dispar
THDSQGL

SEQ ID NO: 2465755 - protein, 36 aa, Entamoeba dispar
THEDVNGNSKELQQGNEEDQCIKPSSMGLKSSAAQI

SEQ ID NO: 2465756 - protein, 12 aa, Entamoeba dispar
THEIKQQPQVKS

SEQ ID NO: 2465757 - protein, 8 aa, Entamoeba dispar
THEPKIPD

SEQ ID NO: 2465758 - protein, 11 aa, Entamoeba dispar
THESEKPFNGT

SEQ ID NO: 2465759 - protein, 8 aa, Entamoeba dispar
THETDTKS

SEQ ID NO: 2465760 - protein, 14 aa, Entamoeba dispar
THFNDDEDSETKME

SEQ ID NO: 2465761 - protein, 9 aa, Entamoeba dispar
THGSYPKPE

SEQ ID NO: 2465762 - protein, 8 aa, Entamoeba dispar
THKDTVAE

SEQ ID NO: 2465763 - protein, 7 aa, Entamoeba dispar
THKEDTS

SEQ ID NO: 2465764 - protein, 4 aa, Entamoeba dispar
THKG

SEQ ID NO: 2465765 - protein, 10 aa, Entamoeba dispar
THKKKQNVNL

SEQ ID NO: 2465766 - protein, 9 aa, Entamoeba dispar
THKKSTGEW

SEQ ID NO: 2465767 - protein, 11 aa, Entamoeba dispar
THLKEKEQGNI

SEQ ID NO: 2465768 - protein, 11 aa, Entamoeba dispar
THLKEKGTGNI

SEQ ID NO: 2465769 - protein, 6 aa, Entamoeba dispar
THLPDS

SEQ ID NO: 2465770 - protein, 14 aa, Entamoeba dispar
THLPPQKPLQQPQV

SEQ ID NO: 2465771 - protein, 39 aa, Entamoeba dispar
THMSQENSFSGHTNTVSSSSQTPTTLSSTQSSNNTSSIE

SEQ ID NO: 2465772 - protein, 17 aa, Entamoeba dispar
THMTYDEKAGITGYPPQ

SEQ ID NO: 2465773 - protein, 5 aa, Entamoeba dispar
THNGK

SEQ ID NO: 2465774 - protein, 9 aa, Entamoeba dispar
THNGKSREQ

SEQ ID NO: 2465775 - protein, 4 aa, Entamoeba dispar
THNK

SEQ ID NO: 2465776 - protein, 6 aa, Entamoeba dispar
THNNGN

SEQ ID NO: 2465777 - protein, 6 aa, Entamoeba dispar
THNNPT

SEQ ID NO: 2465778 - protein, 6 aa, Entamoeba dispar
THNSSF

SEQ ID NO: 2465779 - protein, 7 aa, Entamoeba dispar
THPDNKE

SEQ ID NO: 2465780 - protein, 4 aa, Entamoeba dispar
THPE

SEQ ID NO: 2465781 - protein, 30 aa, Entamoeba dispar
THPETSLHSKKDSKEKVGKTTKVKEGQLDK

SEQ ID NO: 2465782 - protein, 5 aa, Entamoeba dispar
THPEV

SEQ ID NO: 2465783 - protein, 5 aa, Entamoeba dispar
THPGQ

SEQ ID NO: 2465784 - protein, 4 aa, Entamoeba dispar
THPI

SEQ ID NO: 2465785 - protein, 5 aa, Entamoeba dispar
THPTT

SEQ ID NO: 2465786 - protein, 5 aa, Entamoeba dispar
THQPI

SEQ ID NO: 2465787 - protein, 23 aa, Entamoeba dispar
THQQNTTQYRSMEEENTNNIKTR

SEQ ID NO: 2465788 - protein, 12 aa, Entamoeba dispar
THQSNSKWKPQE

SEQ ID NO: 2465789 - protein, 6 aa, Entamoeba dispar
THSDGT

SEQ ID NO: 2465790 - protein, 16 aa, Entamoeba dispar
THSEHKIKNSKGKEIS

SEQ ID NO: 2465791 - protein, 10 aa, Entamoeba dispar
THSESDAVVT

SEQ ID NO: 2465792 - protein, 8 aa, Entamoeba dispar
THSGKKPF

SEQ ID NO: 2465793 - protein, 7 aa, Entamoeba dispar
THSGRVS

SEQ ID NO: 2465794 - protein, 15 aa, Entamoeba dispar
THSIQNSTTRKPTNV

SEQ ID NO: 2465795 - protein, 5 aa, Entamoeba dispar
THSIT

SEQ ID NO: 2465796 - protein, 5 aa, Entamoeba dispar
THSKS

SEQ ID NO: 2465797 - protein, 4 aa, Entamoeba dispar
THSL

SEQ ID NO: 2465798 - protein, 11 aa, Entamoeba dispar
THSNNPTPIHE

SEQ ID NO: 2465799 - protein, 20 aa, Entamoeba dispar
THSQIEKNKRECGEKGKKSF

SEQ ID NO: 2465800 - protein, 5 aa, Entamoeba dispar
THSQV

SEQ ID NO: 2465801 - protein, 8 aa, Entamoeba dispar
THSSFNPS

SEQ ID NO: 2465802 - protein, 7 aa, Entamoeba dispar
THSTEGV

SEQ ID NO: 2465803 - protein, 38 aa, Entamoeba dispar
THSTSSLSTLPQHYSNEPIISPRSTRREIRATNSSATL

SEQ ID NO: 2465804 - protein, 4 aa, Entamoeba dispar
THTK

SEQ ID NO: 2465805 - protein, 11 aa, Entamoeba dispar
THTKKPMYKHT

SEQ ID NO: 2465806 - protein, 8 aa, Entamoeba dispar
THTSAIQK

SEQ ID NO: 2465807 - protein, 7 aa, Entamoeba dispar
THTSPHS

SEQ ID NO: 2465808 - protein, 12 aa, Entamoeba dispar
THTTGKGNVSCE

SEQ ID NO: 2465809 - protein, 6 aa, Entamoeba dispar
THTTQI

SEQ ID NO: 2465810 - protein, 16 aa, Entamoeba dispar
TIAEEEEDEDEDEQMN

SEQ ID NO: 2465811 - protein, 9 aa, Entamoeba dispar
TIARSSTQS

SEQ ID NO: 2465812 - protein, 5 aa, Entamoeba dispar
TIASG

SEQ ID NO: 2465813 - protein, 5 aa, Entamoeba dispar
TIASS

SEQ ID NO: 2465814 - protein, 10 aa, Entamoeba dispar
TIATKEEIDK

SEQ ID NO: 2465815 - protein, 14 aa, Entamoeba dispar
TIATSKPTKNSDRI

SEQ ID NO: 2465816 - protein, 12 aa, Entamoeba dispar
TICNTSKQIEDD

SEQ ID NO: 2465817 - protein, 10 aa, Entamoeba dispar
TIDESNPNPY

SEQ ID NO: 2465818 - protein, 15 aa, Entamoeba dispar
TIDGKEMTQLDEKGK

SEQ ID NO: 2465819 - protein, 11 aa, Entamoeba dispar
TIDGKKVNERV

SEQ ID NO: 2465820 - protein, 10 aa, Entamoeba dispar
TIDGNTNLTF

SEQ ID NO: 2465821 - protein, 6 aa, Entamoeba dispar
TIDKKG

SEQ ID NO: 2465822 - protein, 9 aa, Entamoeba dispar
TIDNHGDKE

SEQ ID NO: 2465823 - protein, 8 aa, Entamoeba dispar
TIDNTYTS

SEQ ID NO: 2465824 - protein, 5 aa, Entamoeba dispar
TIDPL

SEQ ID NO: 2465825 - protein, 20 aa, Entamoeba dispar
TIDPRTPYQYPPYPRRYDQD

SEQ ID NO: 2465826 - protein, 9 aa, Entamoeba dispar
TIDPSEDEL

SEQ ID NO: 2465827 - protein, 8 aa, Entamoeba dispar
TIDSHKEG

SEQ ID NO: 2465828 - protein, 10 aa, Entamoeba dispar
TIDSPQQQPI

SEQ ID NO: 2465829 - protein, 4 aa, Entamoeba dispar
TIDT

SEQ ID NO: 2465830 - protein, 6 aa, Entamoeba dispar
TIDYEE

SEQ ID NO: 2465831 - protein, 6 aa, Entamoeba dispar
TIEDRK

SEQ ID NO: 2465832 - protein, 9 aa, Entamoeba dispar
TIEDSFNTT

SEQ ID NO: 2465833 - protein, 8 aa, Entamoeba dispar
TIEEKDKA

SEQ ID NO: 2465834 - protein, 8 aa, Entamoeba dispar
TIEEKDTA

SEQ ID NO: 2465835 - protein, 10 aa, Entamoeba dispar
TIEENKREEL

SEQ ID NO: 2465836 - protein, 5 aa, Entamoeba dispar
TIEET

SEQ ID NO: 2465837 - protein, 8 aa, Entamoeba dispar
TIEGGEKV

SEQ ID NO: 2465838 - protein, 14 aa, Entamoeba dispar
TIEKATENEQRSRE

SEQ ID NO: 2465839 - protein, 43 aa, Entamoeba dispar
TIEKEVSSIDQENSDVNKELNDKKEKIQEIDTESKKINDEIEE

SEQ ID NO: 2465840 - protein, 12 aa, Entamoeba dispar
TIEKKDKESIKQ

SEQ ID NO: 2465841 - protein, 10 aa, Entamoeba dispar
TIEKRSGDVI

SEQ ID NO: 2465842 - protein, 4 aa, Entamoeba dispar
TIEN

SEQ ID NO: 2465843 - protein, 6 aa, Entamoeba dispar
TIENNN

SEQ ID NO: 2465844 - protein, 11 aa, Entamoeba dispar
TIENSENITLE

SEQ ID NO: 2465845 - protein, 14 aa, Entamoeba dispar
TIEPKELKSKVVYH

SEQ ID NO: 2465846 - protein, 16 aa, Entamoeba dispar
TIEPNNQKEETKPKKI

SEQ ID NO: 2465847 - protein, 4 aa, Entamoeba dispar
TIEQ

SEQ ID NO: 2465848 - protein, 15 aa, Entamoeba dispar
TIEQAKETKDYLNER

SEQ ID NO: 2465849 - protein, 9 aa, Entamoeba dispar
TIEQDPREF

SEQ ID NO: 2465850 - protein, 6 aa, Entamoeba dispar
TIEQET

SEQ ID NO: 2465851 - protein, 38 aa, Entamoeba dispar
TIEQKDTTILPEQPLTTKEISEENSNQNISSELPQQVD

SEQ ID NO: 2465852 - protein, 14 aa, Entamoeba dispar
TIERSDKSYEAKTK

SEQ ID NO: 2465853 - protein, 9 aa, Entamoeba dispar
TIESNGQVN

SEQ ID NO: 2465854 - protein, 4 aa, Entamoeba dispar
TIET

SEQ ID NO: 2465855 - protein, 19 aa, Entamoeba dispar
TIETKEQSVEGKKKQLEID

SEQ ID NO: 2465856 - protein, 12 aa, Entamoeba dispar
TIETPSKDIEKI

SEQ ID NO: 2465857 - protein, 6 aa, Entamoeba dispar
TIFTGA

SEQ ID NO: 2465858 - protein, 9 aa, Entamoeba dispar
TIGANYSSK

SEQ ID NO: 2465859 - protein, 22 aa, Entamoeba dispar
TIGDESVELSDEERNKKIKSVV

SEQ ID NO: 2465860 - protein, 12 aa, Entamoeba dispar
TIGEKFKEQGLK

SEQ ID NO: 2465861 - protein, 8 aa, Entamoeba dispar
TIGENTSK

SEQ ID NO: 2465862 - protein, 13 aa, Entamoeba dispar
TIGGGVKKNAVTH

SEQ ID NO: 2465863 - protein, 5 aa, Entamoeba dispar
TIGIN

SEQ ID NO: 2465864 - protein, 7 aa, Entamoeba dispar
TIGKNDS

SEQ ID NO: 2465865 - protein, 11 aa, Entamoeba dispar
TIGKNGTPTVE

SEQ ID NO: 2465866 - protein, 11 aa, Entamoeba dispar
TIGKQISGEPY

SEQ ID NO: 2465867 - protein, 7 aa, Entamoeba dispar
TIGNENA

SEQ ID NO: 2465868 - protein, 7 aa, Entamoeba dispar
TIGNQAV

SEQ ID NO: 2465869 - protein, 5 aa, Entamoeba dispar
TIGPN

SEQ ID NO: 2465870 - protein, 9 aa, Entamoeba dispar
TIGPTTNYG

SEQ ID NO: 2465871 - protein, 7 aa, Entamoeba dispar
TIGSNDL

SEQ ID NO: 2465872 - protein, 10 aa, Entamoeba dispar
TIGTKSKQYK

SEQ ID NO: 2465873 - protein, 5 aa, Entamoeba dispar
TIGTR

SEQ ID NO: 2465874 - protein, 7 aa, Entamoeba dispar
TIHEGDS

SEQ ID NO: 2465875 - protein, 4 aa, Entamoeba dispar
TIIN

SEQ ID NO: 2465876 - protein, 9 aa, Entamoeba dispar
TIITGSSDG

SEQ ID NO: 2465877 - protein, 6 aa, Entamoeba dispar
TIITSE

SEQ ID NO: 2465878 - protein, 12 aa, Entamoeba dispar
TIKEEENSKEIL

SEQ ID NO: 2465879 - protein, 6 aa, Entamoeba dispar
TIKEEI

SEQ ID NO: 2465880 - protein, 8 aa, Entamoeba dispar
TIKEPKNI

SEQ ID NO: 2465881 - protein, 8 aa, Entamoeba dispar
TIKGGSSK

SEQ ID NO: 2465882 - protein, 8 aa, Entamoeba dispar
TIKGQGKL

SEQ ID NO: 2465883 - protein, 10 aa, Entamoeba dispar
TIKKDRSEEL

SEQ ID NO: 2465884 - protein, 8 aa, Entamoeba dispar
TIKKQAKG

SEQ ID NO: 2465885 - protein, 11 aa, Entamoeba dispar
TIKKSSKGTND

SEQ ID NO: 2465886 - protein, 9 aa, Entamoeba dispar
TIKNNEECS

SEQ ID NO: 2465887 - protein, 6 aa, Entamoeba dispar
TIKNST

SEQ ID NO: 2465888 - protein, 8 aa, Entamoeba dispar
TIKPMSSN

SEQ ID NO: 2465889 - protein, 20 aa, Entamoeba dispar
TIKQQNQTDVIGTYPDNTLV

SEQ ID NO: 2465890 - protein, 14 aa, Entamoeba dispar
TIKREECDGFEVLE

SEQ ID NO: 2465891 - protein, 7 aa, Entamoeba dispar
TIKSQQV

SEQ ID NO: 2465892 - protein, 11 aa, Entamoeba dispar
TIKTKGEVRSN

SEQ ID NO: 2465893 - protein, 6 aa, Entamoeba dispar
TIKTNL

SEQ ID NO: 2465894 - protein, 4 aa, Entamoeba dispar
TIMT

SEQ ID NO: 2465895 - protein, 9 aa, Entamoeba dispar
TINDAQGQR

SEQ ID NO: 2465896 - protein, 5 aa, Entamoeba dispar
TINDY

SEQ ID NO: 2465897 - protein, 5 aa, Entamoeba dispar
TINEA

SEQ ID NO: 2465898 - protein, 7 aa, Entamoeba dispar
TINEESE

SEQ ID NO: 2465899 - protein, 5 aa, Entamoeba dispar
TINEK

SEQ ID NO: 2465900 - protein, 5 aa, Entamoeba dispar
TINEL

SEQ ID NO: 2465901 - protein, 12 aa, Entamoeba dispar
TINEQNPEDSLV

SEQ ID NO: 2465902 - protein, 9 aa, Entamoeba dispar
TINESTSKE

SEQ ID NO: 2465903 - protein, 8 aa, Entamoeba dispar
TINETEVK

SEQ ID NO: 2465904 - protein, 7 aa, Entamoeba dispar
TINGEDP

SEQ ID NO: 2465905 - protein, 6 aa, Entamoeba dispar
TINGNT

SEQ ID NO: 2465906 - protein, 5 aa, Entamoeba dispar
TINGP

SEQ ID NO: 2465907 - protein, 4 aa, Entamoeba dispar
TINI

SEQ ID NO: 2465908 - protein, 6 aa, Entamoeba dispar
TINING

SEQ ID NO: 2465909 - protein, 5 aa, Entamoeba dispar
TINIP

SEQ ID NO: 2465910 - protein, 10 aa, Entamoeba dispar
TINKENEALK

SEQ ID NO: 2465911 - protein, 5 aa, Entamoeba dispar
TINND

SEQ ID NO: 2465912 - protein, 6 aa, Entamoeba dispar
TINNPS

SEQ ID NO: 2465913 - protein, 14 aa, Entamoeba dispar
TINPRAKRIESEHA

SEQ ID NO: 2465914 - protein, 4 aa, Entamoeba dispar
TINQ

SEQ ID NO: 2465915 - protein, 8 aa, Entamoeba dispar
TINRQQSI

SEQ ID NO: 2465916 - protein, 4 aa, Entamoeba dispar
TINS

SEQ ID NO: 2465917 - protein, 8 aa, Entamoeba dispar
TINSGKTP

SEQ ID NO: 2465918 - protein, 7 aa, Entamoeba dispar
TINSNKR

SEQ ID NO: 2465919 - protein, 5 aa, Entamoeba dispar
TINSQ

SEQ ID NO: 2465920 - protein, 10 aa, Entamoeba dispar
TINSTETQFK

SEQ ID NO: 2465921 - protein, 7 aa, Entamoeba dispar
TINSTKG

SEQ ID NO: 2465922 - protein, 13 aa, Entamoeba dispar
TINTIQEGTFAPE

SEQ ID NO: 2465923 - protein, 8 aa, Entamoeba dispar
TIPEGPGR

SEQ ID NO: 2465924 - protein, 10 aa, Entamoeba dispar
TIPGESIEDA

SEQ ID NO: 2465925 - protein, 5 aa, Entamoeba dispar
TIPGG

SEQ ID NO: 2465926 - protein, 19 aa, Entamoeba dispar
TIPITQQPTPNKKEDDEDV

SEQ ID NO: 2465927 - protein, 6 aa, Entamoeba dispar
TIPKKD

SEQ ID NO: 2465928 - protein, 6 aa, Entamoeba dispar
TIPKKK

SEQ ID NO: 2465929 - protein, 5 aa, Entamoeba dispar
TIPNE

SEQ ID NO: 2465930 - protein, 15 aa, Entamoeba dispar
TIPNTEDLNPLTPET

SEQ ID NO: 2465931 - protein, 5 aa, Entamoeba dispar
TIPNY

SEQ ID NO: 2465932 - protein, 6 aa, Entamoeba dispar
TIPPPM

SEQ ID NO: 2465933 - protein, 10 aa, Entamoeba dispar
TIPPSQTTNL

SEQ ID NO: 2465934 - protein, 13 aa, Entamoeba dispar
TIPQQPSAGPAYL

SEQ ID NO: 2465935 - protein, 7 aa, Entamoeba dispar
TIPQRGE

SEQ ID NO: 2465936 - protein, 4 aa, Entamoeba dispar
TIPS

SEQ ID NO: 2465937 - protein, 9 aa, Entamoeba dispar
TIPSEVKSL

SEQ ID NO: 2465938 - protein, 5 aa, Entamoeba dispar
TIPSS

SEQ ID NO: 2465939 - protein, 9 aa, Entamoeba dispar
TIPSSSTEL

SEQ ID NO: 2465940 - protein, 6 aa, Entamoeba dispar
TIPSSV

SEQ ID NO: 2465941 - protein, 9 aa, Entamoeba dispar
TIPSSVTKL

SEQ ID NO: 2465942 - protein, 6 aa, Entamoeba dispar
TIPSTI

SEQ ID NO: 2465943 - protein, 7 aa, Entamoeba dispar
TIPSTIS

SEQ ID NO: 2465944 - protein, 6 aa, Entamoeba dispar
TIPSTV

SEQ ID NO: 2465945 - protein, 8 aa, Entamoeba dispar
TIPSTVSK

SEQ ID NO: 2465946 - protein, 10 aa, Entamoeba dispar
TIPTKNNPNK

SEQ ID NO: 2465947 - protein, 7 aa, Entamoeba dispar
TIPTSVS

SEQ ID NO: 2465948 - protein, 9 aa, Entamoeba dispar
TIPTSVSKQ

SEQ ID NO: 2465949 - protein, 6 aa, Entamoeba dispar
TIPTTI

SEQ ID NO: 2465950 - protein, 19 aa, Entamoeba dispar
TIQDQHQEEKNNKAYPSSK

SEQ ID NO: 2465951 - protein, 5 aa, Entamoeba dispar
TIQEE

SEQ ID NO: 2465952 - protein, 9 aa, Entamoeba dispar
TIQENNNKI

SEQ ID NO: 2465953 - protein, 7 aa, Entamoeba dispar
TIQNTEE

SEQ ID NO: 2465954 - protein, 6 aa, Entamoeba dispar
TIQNTF

SEQ ID NO: 2465955 - protein, 6 aa, Entamoeba dispar
TIQSSG

SEQ ID NO: 2465956 - protein, 13 aa, Entamoeba dispar
TIQTNELKKNDEI

SEQ ID NO: 2465957 - protein, 6 aa, Entamoeba dispar
TIQTPP

SEQ ID NO: 2465958 - protein, 25 aa, Entamoeba dispar
TIRDDTTKEGHNEKREDISRREINQ

SEQ ID NO: 2465959 - protein, 7 aa, Entamoeba dispar
TIRNSGS

SEQ ID NO: 2465960 - protein, 6 aa, Entamoeba dispar
TIRPKD

SEQ ID NO: 2465961 - protein, 28 aa, Entamoeba dispar
TIRSDKKDLSKIKSKDSSLNTQKTLEDR

SEQ ID NO: 2465962 - protein, 25 aa, Entamoeba dispar
TIRSPTPKNITKRKEIDKEKELKRR

SEQ ID NO: 2465963 - protein, 10 aa, Entamoeba dispar
TISADDYEYG

SEQ ID NO: 2465964 - protein, 4 aa, Entamoeba dispar
TISD

SEQ ID NO: 2465965 - protein, 15 aa, Entamoeba dispar
TISDDDNNDTDQLKT

SEQ ID NO: 2465966 - protein, 12 aa, Entamoeba dispar
TISDEGGNSQIP

SEQ ID NO: 2465967 - protein, 10 aa, Entamoeba dispar
TISEGSKEIN

SEQ ID NO: 2465968 - protein, 10 aa, Entamoeba dispar
TISEQTTSLT

SEQ ID NO: 2465969 - protein, 5 aa, Entamoeba dispar
TISET

SEQ ID NO: 2465970 - protein, 7 aa, Entamoeba dispar
TISETQV

SEQ ID NO: 2465971 - protein, 4 aa, Entamoeba dispar
TISH

SEQ ID NO: 2465972 - protein, 4 aa, Entamoeba dispar
TISK

SEQ ID NO: 2465973 - protein, 9 aa, Entamoeba dispar
TISKENRTL

SEQ ID NO: 2465974 - protein, 5 aa, Entamoeba dispar
TISLP

SEQ ID NO: 2465975 - protein, 7 aa, Entamoeba dispar
TISNQSD

SEQ ID NO: 2465976 - protein, 17 aa, Entamoeba dispar
TISPKEYGETMEEERAQ

SEQ ID NO: 2465977 - protein, 17 aa, Entamoeba dispar
TISPNGQYIATGDGQGN

SEQ ID NO: 2465978 - protein, 14 aa, Entamoeba dispar
TISPTSSKPNRSTI

SEQ ID NO: 2465979 - protein, 14 aa, Entamoeba dispar
TISQEIQSTSIELN

SEQ ID NO: 2465980 - protein, 9 aa, Entamoeba dispar
TISQNKEIN

SEQ ID NO: 2465981 - protein, 4 aa, Entamoeba dispar
TISR

SEQ ID NO: 2465982 - protein, 11 aa, Entamoeba dispar
TISSDGTADIY

SEQ ID NO: 2465983 - protein, 10 aa, Entamoeba dispar
TISSDSNKFG

SEQ ID NO: 2465984 - protein, 9 aa, Entamoeba dispar
TISSEKSNE

SEQ ID NO: 2465985 - protein, 26 aa, Entamoeba dispar
TISSETSDKDDKKDINEDSPVEEDEL

SEQ ID NO: 2465986 - protein, 10 aa, Entamoeba dispar
TISSFPPEYK

SEQ ID NO: 2465987 - protein, 64 aa, Entamoeba dispar
TISSSALPEPSKQFNNPTSSINNTINQEPTPSIVKSSTNDIQINKQTSHLPPLPTPSHHKTESC

SEQ ID NO: 2465988 - protein, 24 aa, Entamoeba dispar
TISSVEENQIKNETEIKEIKEEKN

SEQ ID NO: 2465989 - protein, 11 aa, Entamoeba dispar
TISTGKRPPII

SEQ ID NO: 2465990 - protein, 5 aa, Entamoeba dispar
TISTL

SEQ ID NO: 2465991 - protein, 24 aa, Entamoeba dispar
TISTPAPRPIQPPPITTSITQSQQ

SEQ ID NO: 2465992 - protein, 5 aa, Entamoeba dispar
TISTR

SEQ ID NO: 2465993 - protein, 13 aa, Entamoeba dispar
TISTTSKEEYEEE

SEQ ID NO: 2465994 - protein, 8 aa, Entamoeba dispar
TISVNGQS

SEQ ID NO: 2465995 - protein, 14 aa, Entamoeba dispar
TITDESLNAKPNVD

SEQ ID NO: 2465996 - protein, 5 aa, Entamoeba dispar
TITEE

SEQ ID NO: 2465997 - protein, 19 aa, Entamoeba dispar
TITEEKSKENELNENEKVE

SEQ ID NO: 2465998 - protein, 10 aa, Entamoeba dispar
TITEEPKNYE

SEQ ID NO: 2465999 - protein, 6 aa, Entamoeba dispar
TITEEV

SEQ ID NO: 2466000 - protein, 6 aa, Entamoeba dispar
TITEPS

SEQ ID NO: 2466001 - protein, 9 aa, Entamoeba dispar
TITIEKDST

SEQ ID NO: 2466002 - protein, 5 aa, Entamoeba dispar
TITKK

SEQ ID NO: 2466003 - protein, 7 aa, Entamoeba dispar
TITNDGA

SEQ ID NO: 2466004 - protein, 6 aa, Entamoeba dispar
TITNEN

SEQ ID NO: 2466005 - protein, 10 aa, Entamoeba dispar
TITPPDQSCV

SEQ ID NO: 2466006 - protein, 16 aa, Entamoeba dispar
TITPPTLIPNKIETPP

SEQ ID NO: 2466007 - protein, 6 aa, Entamoeba dispar
TITPQD

SEQ ID NO: 2466008 - protein, 11 aa, Entamoeba dispar
TITPQLTQEAK

SEQ ID NO: 2466009 - protein, 5 aa, Entamoeba dispar
TITSL

SEQ ID NO: 2466010 - protein, 23 aa, Entamoeba dispar
TITSQEPESTKKTYKRDTSWKED

SEQ ID NO: 2466011 - protein, 17 aa, Entamoeba dispar
TITTDGTCQQAENNKEN

SEQ ID NO: 2466012 - protein, 23 aa, Entamoeba dispar
TITTTETDKNGRQFQTTREVETP

SEQ ID NO: 2466013 - protein, 10 aa, Entamoeba dispar
TIVGDATPPF

SEQ ID NO: 2466014 - protein, 5 aa, Entamoeba dispar
TIVST

SEQ ID NO: 2466015 - protein, 6 aa, Entamoeba dispar
TIYEGS

SEQ ID NO: 2466016 - protein, 11 aa, Entamoeba dispar
TIYETKSLSTL

SEQ ID NO: 2466017 - protein, 19 aa, Entamoeba dispar
TIYGDEDEYMATRKSDGME

SEQ ID NO: 2466018 - protein, 15 aa, Entamoeba dispar
TIYSDTYDNNSENIR

SEQ ID NO: 2466019 - protein, 8 aa, Entamoeba dispar
TKADSGLN

SEQ ID NO: 2466020 - protein, 11 aa, Entamoeba dispar
TKAEDSTKKRY

SEQ ID NO: 2466021 - protein, 5 aa, Entamoeba dispar
TKAFA

SEQ ID NO: 2466022 - protein, 8 aa, Entamoeba dispar
TKAGLESS

SEQ ID NO: 2466023 - protein, 6 aa, Entamoeba dispar
TKAGLY

SEQ ID NO: 2466024 - protein, 8 aa, Entamoeba dispar
TKAKEIRK

SEQ ID NO: 2466025 - protein, 9 aa, Entamoeba dispar
TKAKTNAVP

SEQ ID NO: 2466026 - protein, 5 aa, Entamoeba dispar
TKAMS

SEQ ID NO: 2466027 - protein, 6 aa, Entamoeba dispar
TKANFS

SEQ ID NO: 2466028 - protein, 6 aa, Entamoeba dispar
TKAPNT

SEQ ID NO: 2466029 - protein, 6 aa, Entamoeba dispar
TKARIE

SEQ ID NO: 2466030 - protein, 10 aa, Entamoeba dispar
TKARRDENGK

SEQ ID NO: 2466031 - protein, 6 aa, Entamoeba dispar
TKASRA

SEQ ID NO: 2466032 - protein, 9 aa, Entamoeba dispar
TKASVKSLT

SEQ ID NO: 2466033 - protein, 6 aa, Entamoeba dispar
TKATIK

SEQ ID NO: 2466034 - protein, 5 aa, Entamoeba dispar
TKAYD

SEQ ID NO: 2466035 - protein, 13 aa, Entamoeba dispar
TKCGTSNYTSPQI

SEQ ID NO: 2466036 - protein, 4 aa, Entamoeba dispar
TKCH

SEQ ID NO: 2466037 - protein, 9 aa, Entamoeba dispar
TKCNPKNKR

SEQ ID NO: 2466038 - protein, 13 aa, Entamoeba dispar
TKDAKAYEKAEDP

SEQ ID NO: 2466039 - protein, 5 aa, Entamoeba dispar
TKDDI

SEQ ID NO: 2466040 - protein, 6 aa, Entamoeba dispar
TKDEDL

SEQ ID NO: 2466041 - protein, 16 aa, Entamoeba dispar
TKDEEIKKLNDEYEKI

SEQ ID NO: 2466042 - protein, 9 aa, Entamoeba dispar
TKDEEKVNY

SEQ ID NO: 2466043 - protein, 17 aa, Entamoeba dispar
TKDEQRLVNDASGGNHF

SEQ ID NO: 2466044 - protein, 4 aa, Entamoeba dispar
TKDF

SEQ ID NO: 2466045 - protein, 16 aa, Entamoeba dispar
TKDGLNKRTLMKKMFR

SEQ ID NO: 2466046 - protein, 5 aa, Entamoeba dispar
TKDGN

SEQ ID NO: 2466047 - protein, 29 aa, Entamoeba dispar
TKDINDTPLTDSLQQDTTATTSTLFSNSV

SEQ ID NO: 2466048 - protein, 7 aa, Entamoeba dispar
TKDINEA

SEQ ID NO: 2466049 - protein, 36 aa, Entamoeba dispar
TKDISKEREIKKEQRTSINNKSSLFKRKKDDEIITK

SEQ ID NO: 2466050 - protein, 8 aa, Entamoeba dispar
TKDKEIMK

SEQ ID NO: 2466051 - protein, 9 aa, Entamoeba dispar
TKDKIEKPT

SEQ ID NO: 2466052 - protein, 6 aa, Entamoeba dispar
TKDKTV

SEQ ID NO: 2466053 - protein, 9 aa, Entamoeba dispar
TKDMTNTGI

SEQ ID NO: 2466054 - protein, 7 aa, Entamoeba dispar
TKDNAHV

SEQ ID NO: 2466055 - protein, 5 aa, Entamoeba dispar
TKDND

SEQ ID NO: 2466056 - protein, 14 aa, Entamoeba dispar
TKDNLKKKDILEQQ

SEQ ID NO: 2466057 - protein, 7 aa, Entamoeba dispar
TKDNTLK

SEQ ID NO: 2466058 - protein, 4 aa, Entamoeba dispar
TKDP

SEQ ID NO: 2466059 - protein, 9 aa, Entamoeba dispar
TKDQHYKDL

SEQ ID NO: 2466060 - protein, 14 aa, Entamoeba dispar
TKDRTKAGETKPRK

SEQ ID NO: 2466061 - protein, 19 aa, Entamoeba dispar
TKDSGGRIGSADGNHPDLK

SEQ ID NO: 2466062 - protein, 7 aa, Entamoeba dispar
TKDTFPL

SEQ ID NO: 2466063 - protein, 22 aa, Entamoeba dispar
TKDTPDDSVKEKLKHKNDTIET

SEQ ID NO: 2466064 - protein, 7 aa, Entamoeba dispar
TKDTVSV

SEQ ID NO: 2466065 - protein, 13 aa, Entamoeba dispar
TKDVNESIKESER

SEQ ID NO: 2466066 - protein, 29 aa, Entamoeba dispar
TKDVRDKKQKKSKIDELTKPKKNEPQITK

SEQ ID NO: 2466067 - protein, 6 aa, Entamoeba dispar
TKEADR

SEQ ID NO: 2466068 - protein, 10 aa, Entamoeba dispar
TKEASDMKEQ

SEQ ID NO: 2466069 - protein, 7 aa, Entamoeba dispar
TKECQYN

SEQ ID NO: 2466070 - protein, 4 aa, Entamoeba dispar
TKED

SEQ ID NO: 2466071 - protein, 9 aa, Entamoeba dispar
TKEDETKCR

SEQ ID NO: 2466072 - protein, 5 aa, Entamoeba dispar
TKEDI

SEQ ID NO: 2466073 - protein, 13 aa, Entamoeba dispar
TKEDKKKDTTISE

SEQ ID NO: 2466074 - protein, 6 aa, Entamoeba dispar
TKEDLW

SEQ ID NO: 2466075 - protein, 6 aa, Entamoeba dispar
TKEDNE

SEQ ID NO: 2466076 - protein, 11 aa, Entamoeba dispar
TKEDTKTEASR

SEQ ID NO: 2466077 - protein, 4 aa, Entamoeba dispar
TKEE

SEQ ID NO: 2466078 - protein, 6 aa, Entamoeba dispar
TKEEEL

SEQ ID NO: 2466079 - protein, 11 aa, Entamoeba dispar
TKEEGEARAKE

SEQ ID NO: 2466080 - protein, 10 aa, Entamoeba dispar
TKEEGKLENS

SEQ ID NO: 2466081 - protein, 5 aa, Entamoeba dispar
TKEEI

SEQ ID NO: 2466082 - protein, 10 aa, Entamoeba dispar
TKEEIDERKK

SEQ ID NO: 2466083 - protein, 7 aa, Entamoeba dispar
TKEEIEN

SEQ ID NO: 2466084 - protein, 23 aa, Entamoeba dispar
TKEEKEENNLSNDIEPKKDIKCS

SEQ ID NO: 2466085 - protein, 9 aa, Entamoeba dispar
TKEEKEIEY

SEQ ID NO: 2466086 - protein, 7 aa, Entamoeba dispar
TKEEKKL

SEQ ID NO: 2466087 - protein, 17 aa, Entamoeba dispar
TKEELEQRRPKKPKINI

SEQ ID NO: 2466088 - protein, 26 aa, Entamoeba dispar
TKEELTNKKDSKNNTELEPNEKQESK

SEQ ID NO: 2466089 - protein, 6 aa, Entamoeba dispar
TKEEQS

SEQ ID NO: 2466090 - protein, 13 aa, Entamoeba dispar
TKEERASTSETLK

SEQ ID NO: 2466091 - protein, 9 aa, Entamoeba dispar
TKEESEDSE

SEQ ID NO: 2466092 - protein, 18 aa, Entamoeba dispar
TKEETKPKEDIETNTVDK

SEQ ID NO: 2466093 - protein, 7 aa, Entamoeba dispar
TKEGGQF

SEQ ID NO: 2466094 - protein, 8 aa, Entamoeba dispar
TKEGKSGI

SEQ ID NO: 2466095 - protein, 10 aa, Entamoeba dispar
TKEGKTPRII

SEQ ID NO: 2466096 - protein, 6 aa, Entamoeba dispar
TKEGQN

SEQ ID NO: 2466097 - protein, 5 aa, Entamoeba dispar
TKEHE

SEQ ID NO: 2466098 - protein, 8 aa, Entamoeba dispar
TKEIIDEN

SEQ ID NO: 2466099 - protein, 6 aa, Entamoeba dispar
TKEIKQ

SEQ ID NO: 2466100 - protein, 9 aa, Entamoeba dispar
TKEKESPDH

SEQ ID NO: 2466101 - protein, 7 aa, Entamoeba dispar
TKEKLEK

SEQ ID NO: 2466102 - protein, 7 aa, Entamoeba dispar
TKEKNTN

SEQ ID NO: 2466103 - protein, 13 aa, Entamoeba dispar
TKEKTQRESQREI

SEQ ID NO: 2466104 - protein, 7 aa, Entamoeba dispar
TKELITE

SEQ ID NO: 2466105 - protein, 6 aa, Entamoeba dispar
TKELSQ

SEQ ID NO: 2466106 - protein, 21 aa, Entamoeba dispar
TKEMSYGPELKDEKEQPKGHK

SEQ ID NO: 2466107 - protein, 8 aa, Entamoeba dispar
TKENDELR

SEQ ID NO: 2466108 - protein, 11 aa, Entamoeba dispar
TKENETKEISI

SEQ ID NO: 2466109 - protein, 6 aa, Entamoeba dispar
TKENIE

SEQ ID NO: 2466110 - protein, 7 aa, Entamoeba dispar
TKENNEF

SEQ ID NO: 2466111 - protein, 6 aa, Entamoeba dispar
TKENRQ

SEQ ID NO: 2466112 - protein, 4 aa, Entamoeba dispar
TKEP

SEQ ID NO: 2466113 - protein, 8 aa, Entamoeba dispar
TKEPSENQ

SEQ ID NO: 2466114 - protein, 6 aa, Entamoeba dispar
TKEPYQ

SEQ ID NO: 2466115 - protein, 7 aa, Entamoeba dispar
TKEQKGL

SEQ ID NO: 2466116 - protein, 6 aa, Entamoeba dispar
TKEQNN

SEQ ID NO: 2466117 - protein, 5 aa, Entamoeba dispar
TKEQR

SEQ ID NO: 2466118 - protein, 6 aa, Entamoeba dispar
TKERAY

SEQ ID NO: 2466119 - protein, 11 aa, Entamoeba dispar
TKESGGKRGTI

SEQ ID NO: 2466120 - protein, 9 aa, Entamoeba dispar
TKESGSNAK

SEQ ID NO: 2466121 - protein, 19 aa, Entamoeba dispar
TKESREKYGDTIPPEVTSI

SEQ ID NO: 2466122 - protein, 9 aa, Entamoeba dispar
TKESRLTKE

SEQ ID NO: 2466123 - protein, 5 aa, Entamoeba dispar
TKESY

SEQ ID NO: 2466124 - protein, 9 aa, Entamoeba dispar
TKETKGRIG

SEQ ID NO: 2466125 - protein, 8 aa, Entamoeba dispar
TKETRHEK

SEQ ID NO: 2466126 - protein, 34 aa, Entamoeba dispar
TKEVTKDSTETKQGNQNTLNNEQQTDEIRSGKQS

SEQ ID NO: 2466127 - protein, 20 aa, Entamoeba dispar
TKFENKDFEGVDDNSEHVNA

SEQ ID NO: 2466128 - protein, 4 aa, Entamoeba dispar
TKFG

SEQ ID NO: 2466129 - protein, 7 aa, Entamoeba dispar
TKFQQYN

SEQ ID NO: 2466130 - protein, 5 aa, Entamoeba dispar
TKFSG

SEQ ID NO: 2466131 - protein, 6 aa, Entamoeba dispar
TKFTGS

SEQ ID NO: 2466132 - protein, 11 aa, Entamoeba dispar
TKGAQGSQRIE

SEQ ID NO: 2466133 - protein, 5 aa, Entamoeba dispar
TKGDV

SEQ ID NO: 2466134 - protein, 10 aa, Entamoeba dispar
TKGELTDKSF

SEQ ID NO: 2466135 - protein, 4 aa, Entamoeba dispar
TKGG

SEQ ID NO: 2466136 - protein, 6 aa, Entamoeba dispar
TKGGSK

SEQ ID NO: 2466137 - protein, 14 aa, Entamoeba dispar
TKGIEGVKNNKTLQ

SEQ ID NO: 2466138 - protein, 9 aa, Entamoeba dispar
TKGIPPVQY

SEQ ID NO: 2466139 - protein, 4 aa, Entamoeba dispar
TKGN

SEQ ID NO: 2466140 - protein, 59 aa, Entamoeba dispar
TKGNEVSDTESQVDSYNGEYSNDESYSDSYSDSKSVDSQKSEESRTDDDDDTDDDDTRE

SEQ ID NO: 2466141 - protein, 7 aa, Entamoeba dispar
TKGPGIA

SEQ ID NO: 2466142 - protein, 9 aa, Entamoeba dispar
TKGQVNGNI

SEQ ID NO: 2466143 - protein, 21 aa, Entamoeba dispar
TKGQYQELPENEPTEEESKKD

SEQ ID NO: 2466144 - protein, 4 aa, Entamoeba dispar
TKGR

SEQ ID NO: 2466145 - protein, 13 aa, Entamoeba dispar
TKGSDEITKESEI

SEQ ID NO: 2466146 - protein, 8 aa, Entamoeba dispar
TKGSERKQ

SEQ ID NO: 2466147 - protein, 8 aa, Entamoeba dispar
TKGSGSLR

SEQ ID NO: 2466148 - protein, 12 aa, Entamoeba dispar
TKGSREKYGTTI

SEQ ID NO: 2466149 - protein, 7 aa, Entamoeba dispar
TKGTEEV

SEQ ID NO: 2466150 - protein, 5 aa, Entamoeba dispar
TKGTI

SEQ ID NO: 2466151 - protein, 9 aa, Entamoeba dispar
TKGTKLSRK

SEQ ID NO: 2466152 - protein, 5 aa, Entamoeba dispar
TKGTL

SEQ ID NO: 2466153 - protein, 10 aa, Entamoeba dispar
TKGTTTGFSG

SEQ ID NO: 2466154 - protein, 22 aa, Entamoeba dispar
TKGVEIEKRKKQQIKDTPFVEN

SEQ ID NO: 2466155 - protein, 5 aa, Entamoeba dispar
TKHEN

SEQ ID NO: 2466156 - protein, 14 aa, Entamoeba dispar
TKHESSSPLPLGGL

SEQ ID NO: 2466157 - protein, 9 aa, Entamoeba dispar
TKHPKKASV

SEQ ID NO: 2466158 - protein, 4 aa, Entamoeba dispar
TKHQ

SEQ ID NO: 2466159 - protein, 7 aa, Entamoeba dispar
TKHSTGF

SEQ ID NO: 2466160 - protein, 5 aa, Entamoeba dispar
TKIDQ

SEQ ID NO: 2466161 - protein, 8 aa, Entamoeba dispar
TKIEDKNP

SEQ ID NO: 2466162 - protein, 7 aa, Entamoeba dispar
TKIEEVE

SEQ ID NO: 2466163 - protein, 6 aa, Entamoeba dispar
TKIEGP

SEQ ID NO: 2466164 - protein, 4 aa, Entamoeba dispar
TKIG

SEQ ID NO: 2466165 - protein, 9 aa, Entamoeba dispar
TKIGGSSDF

SEQ ID NO: 2466166 - protein, 22 aa, Entamoeba dispar
TKIKNYNDEEFKEDVEKKEEEY

SEQ ID NO: 2466167 - protein, 11 aa, Entamoeba dispar
TKILAQSENGG

SEQ ID NO: 2466168 - protein, 11 aa, Entamoeba dispar
TKINENTKTVT

SEQ ID NO: 2466169 - protein, 18 aa, Entamoeba dispar
TKIPETSKQEEIKLGENS

SEQ ID NO: 2466170 - protein, 8 aa, Entamoeba dispar
TKIPKNKE

SEQ ID NO: 2466171 - protein, 9 aa, Entamoeba dispar
TKIPNGCSG

SEQ ID NO: 2466172 - protein, 5 aa, Entamoeba dispar
TKIQN

SEQ ID NO: 2466173 - protein, 9 aa, Entamoeba dispar
TKISQNETY

SEQ ID NO: 2466174 - protein, 13 aa, Entamoeba dispar
TKITALDKDSERY

SEQ ID NO: 2466175 - protein, 18 aa, Entamoeba dispar
TKITESKLKTNEKEKEFQ

SEQ ID NO: 2466176 - protein, 6 aa, Entamoeba dispar
TKITKQ

SEQ ID NO: 2466177 - protein, 7 aa, Entamoeba dispar
TKITQRN

SEQ ID NO: 2466178 - protein, 6 aa, Entamoeba dispar
TKKDDT

SEQ ID NO: 2466179 - protein, 6 aa, Entamoeba dispar
TKKDEE

SEQ ID NO: 2466180 - protein, 8 aa, Entamoeba dispar
TKKDEEWN

SEQ ID NO: 2466181 - protein, 7 aa, Entamoeba dispar
TKKDEEY

SEQ ID NO: 2466182 - protein, 8 aa, Entamoeba dispar
TKKDGEEY

SEQ ID NO: 2466183 - protein, 9 aa, Entamoeba dispar
TKKDIPEDQ

SEQ ID NO: 2466184 - protein, 7 aa, Entamoeba dispar
TKKDITE

SEQ ID NO: 2466185 - protein, 8 aa, Entamoeba dispar
TKKDKEME

SEQ ID NO: 2466186 - protein, 8 aa, Entamoeba dispar
TKKDLSPI

SEQ ID NO: 2466187 - protein, 8 aa, Entamoeba dispar
TKKDQTYN

SEQ ID NO: 2466188 - protein, 8 aa, Entamoeba dispar
TKKDTKMS

SEQ ID NO: 2466189 - protein, 7 aa, Entamoeba dispar
TKKDYSG

SEQ ID NO: 2466190 - protein, 5 aa, Entamoeba dispar
TKKEC

SEQ ID NO: 2466191 - protein, 8 aa, Entamoeba dispar
TKKEDQPT

SEQ ID NO: 2466192 - protein, 10 aa, Entamoeba dispar
TKKEEEIIKE

SEQ ID NO: 2466193 - protein, 9 aa, Entamoeba dispar
TKKEEEKNP

SEQ ID NO: 2466194 - protein, 10 aa, Entamoeba dispar
TKKEKISRTV

SEQ ID NO: 2466195 - protein, 7 aa, Entamoeba dispar
TKKEKLL

SEQ ID NO: 2466196 - protein, 26 aa, Entamoeba dispar
TKKERKQEFKQHASEVKMNATGKYKE

SEQ ID NO: 2466197 - protein, 10 aa, Entamoeba dispar
TKKEVPPPIQ

SEQ ID NO: 2466198 - protein, 8 aa, Entamoeba dispar
TKKEYKAG

SEQ ID NO: 2466199 - protein, 6 aa, Entamoeba dispar
TKKEYN

SEQ ID NO: 2466200 - protein, 15 aa, Entamoeba dispar
TKKGDESRMVMERPL

SEQ ID NO: 2466201 - protein, 10 aa, Entamoeba dispar
TKKGEEEEQQ

SEQ ID NO: 2466202 - protein, 8 aa, Entamoeba dispar
TKKGEYRS

SEQ ID NO: 2466203 - protein, 25 aa, Entamoeba dispar
TKKGGKDICGQKDNAMTTPKEVGEY

SEQ ID NO: 2466204 - protein, 8 aa, Entamoeba dispar
TKKGKWVS

SEQ ID NO: 2466205 - protein, 10 aa, Entamoeba dispar
TKKKASKTLK

SEQ ID NO: 2466206 - protein, 5 aa, Entamoeba dispar
TKKKE

SEQ ID NO: 2466207 - protein, 9 aa, Entamoeba dispar
TKKKEDIKP

SEQ ID NO: 2466208 - protein, 6 aa, Entamoeba dispar
TKKKEL

SEQ ID NO: 2466209 - protein, 8 aa, Entamoeba dispar
TKKKELKE

SEQ ID NO: 2466210 - protein, 7 aa, Entamoeba dispar
TKKKRAH

SEQ ID NO: 2466211 - protein, 9 aa, Entamoeba dispar
TKKKRPTFI

SEQ ID NO: 2466212 - protein, 9 aa, Entamoeba dispar
TKKKRTELE

SEQ ID NO: 2466213 - protein, 10 aa, Entamoeba dispar
TKKKRTGGKI

SEQ ID NO: 2466214 - protein, 6 aa, Entamoeba dispar
TKKKTG

SEQ ID NO: 2466215 - protein, 8 aa, Entamoeba dispar
TKKKTPKY

SEQ ID NO: 2466216 - protein, 19 aa, Entamoeba dispar
TKKLKQTITQSTVEKTQQL

SEQ ID NO: 2466217 - protein, 7 aa, Entamoeba dispar
TKKNHFV

SEQ ID NO: 2466218 - protein, 5 aa, Entamoeba dispar
TKKNI

SEQ ID NO: 2466219 - protein, 16 aa, Entamoeba dispar
TKKNNKITKKQEIEEE

SEQ ID NO: 2466220 - protein, 11 aa, Entamoeba dispar
TKKNRDESELA

SEQ ID NO: 2466221 - protein, 9 aa, Entamoeba dispar
TKKNTRTVR

SEQ ID NO: 2466222 - protein, 14 aa, Entamoeba dispar
TKKPAQSQTVSSDE

SEQ ID NO: 2466223 - protein, 4 aa, Entamoeba dispar
TKKQ

SEQ ID NO: 2466224 - protein, 17 aa, Entamoeba dispar
TKKQAEKTLSEKERNEE

SEQ ID NO: 2466225 - protein, 6 aa, Entamoeba dispar
TKKQID

SEQ ID NO: 2466226 - protein, 21 aa, Entamoeba dispar
TKKQNIKTKEEKEKENNAADK

SEQ ID NO: 2466227 - protein, 8 aa, Entamoeba dispar
TKKQPTYS

SEQ ID NO: 2466228 - protein, 9 aa, Entamoeba dispar
TKKQTHTSF

SEQ ID NO: 2466229 - protein, 9 aa, Entamoeba dispar
TKKQTIQTK

SEQ ID NO: 2466230 - protein, 7 aa, Entamoeba dispar
TKKRNEM

SEQ ID NO: 2466231 - protein, 6 aa, Entamoeba dispar
TKKSII

SEQ ID NO: 2466232 - protein, 11 aa, Entamoeba dispar
TKKSKKATTKD

SEQ ID NO: 2466233 - protein, 13 aa, Entamoeba dispar
TKKSKKVLTSQQY

SEQ ID NO: 2466234 - protein, 8 aa, Entamoeba dispar
TKKSKRAI

SEQ ID NO: 2466235 - protein, 6 aa, Entamoeba dispar
TKKSNK

SEQ ID NO: 2466236 - protein, 6 aa, Entamoeba dispar
TKKSTL

SEQ ID NO: 2466237 - protein, 4 aa, Entamoeba dispar
TKKV

SEQ ID NO: 2466238 - protein, 8 aa, Entamoeba dispar
TKKVGAKM

SEQ ID NO: 2466239 - protein, 22 aa, Entamoeba dispar
TKKVGQSGKTDYKPRSRTSKAV

SEQ ID NO: 2466240 - protein, 19 aa, Entamoeba dispar
TKKVSKKQVNKAPHGEKIN

SEQ ID NO: 2466241 - protein, 10 aa, Entamoeba dispar
TKLDAKEFSE

SEQ ID NO: 2466242 - protein, 15 aa, Entamoeba dispar
TKLDEDTKKDGITQL

SEQ ID NO: 2466243 - protein, 4 aa, Entamoeba dispar
TKLG

SEQ ID NO: 2466244 - protein, 6 aa, Entamoeba dispar
TKLGDA

SEQ ID NO: 2466245 - protein, 8 aa, Entamoeba dispar
TKLGESSF

SEQ ID NO: 2466246 - protein, 5 aa, Entamoeba dispar
TKLGR

SEQ ID NO: 2466247 - protein, 8 aa, Entamoeba dispar
TKLNTTLE

SEQ ID NO: 2466248 - protein, 4 aa, Entamoeba dispar
TKLP

SEQ ID NO: 2466249 - protein, 10 aa, Entamoeba dispar
TKLPSEEPLS

SEQ ID NO: 2466250 - protein, 10 aa, Entamoeba dispar
TKLPSGYTEV

SEQ ID NO: 2466251 - protein, 8 aa, Entamoeba dispar
TKLSDDLD

SEQ ID NO: 2466252 - protein, 7 aa, Entamoeba dispar
TKLSDNG

SEQ ID NO: 2466253 - protein, 12 aa, Entamoeba dispar
TKLSDNKYKTAN

SEQ ID NO: 2466254 - protein, 7 aa, Entamoeba dispar
TKLSESL

SEQ ID NO: 2466255 - protein, 7 aa, Entamoeba dispar
TKLSPLK

SEQ ID NO: 2466256 - protein, 8 aa, Entamoeba dispar
TKLTKDSP

SEQ ID NO: 2466257 - protein, 9 aa, Entamoeba dispar
TKLTPSSRR

SEQ ID NO: 2466258 - protein, 12 aa, Entamoeba dispar
TKMERRQEIPHE

SEQ ID NO: 2466259 - protein, 6 aa, Entamoeba dispar
TKMGEN

SEQ ID NO: 2466260 - protein, 24 aa, Entamoeba dispar
TKMGGSNTKNKERKRSLSPSQSSI

SEQ ID NO: 2466261 - protein, 9 aa, Entamoeba dispar
TKMPEYSKS

SEQ ID NO: 2466262 - protein, 10 aa, Entamoeba dispar
TKNAEPRKEE

SEQ ID NO: 2466263 - protein, 4 aa, Entamoeba dispar
TKNC

SEQ ID NO: 2466264 - protein, 9 aa, Entamoeba dispar
TKNCNTDLN

SEQ ID NO: 2466265 - protein, 6 aa, Entamoeba dispar
TKNDDV

SEQ ID NO: 2466266 - protein, 4 aa, Entamoeba dispar
TKNE

SEQ ID NO: 2466267 - protein, 28 aa, Entamoeba dispar
TKNEEYEKSVNELSTQTEELNHTTSSLQ

SEQ ID NO: 2466268 - protein, 7 aa, Entamoeba dispar
TKNENQV

SEQ ID NO: 2466269 - protein, 48 aa, Entamoeba dispar
TKNEQQKDEQQKEEIKEETNKGEVKVEQQKDENKNEQDKDETNQKSLK

SEQ ID NO: 2466270 - protein, 7 aa, Entamoeba dispar
TKNGEDF

SEQ ID NO: 2466271 - protein, 9 aa, Entamoeba dispar
TKNGEINPN

SEQ ID NO: 2466272 - protein, 5 aa, Entamoeba dispar
TKNGF

SEQ ID NO: 2466273 - protein, 12 aa, Entamoeba dispar
TKNGYKQKQEEW

SEQ ID NO: 2466274 - protein, 9 aa, Entamoeba dispar
TKNIKEKEN

SEQ ID NO: 2466275 - protein, 10 aa, Entamoeba dispar
TKNIKLNDDQ

SEQ ID NO: 2466276 - protein, 13 aa, Entamoeba dispar
TKNIQPGQEQAQI

SEQ ID NO: 2466277 - protein, 6 aa, Entamoeba dispar
TKNKEA

SEQ ID NO: 2466278 - protein, 6 aa, Entamoeba dispar
TKNKSG

SEQ ID NO: 2466279 - protein, 6 aa, Entamoeba dispar
TKNKSK

SEQ ID NO: 2466280 - protein, 11 aa, Entamoeba dispar
TKNKSKRNTIV

SEQ ID NO: 2466281 - protein, 8 aa, Entamoeba dispar
TKNNGKDI

SEQ ID NO: 2466282 - protein, 23 aa, Entamoeba dispar
TKNNNEKSNKKKVESGDNEEERI

SEQ ID NO: 2466283 - protein, 7 aa, Entamoeba dispar
TKNNNEQ

SEQ ID NO: 2466284 - protein, 20 aa, Entamoeba dispar
TKNNSLVAGSRNGNLFYVTG

SEQ ID NO: 2466285 - protein, 5 aa, Entamoeba dispar
TKNQG

SEQ ID NO: 2466286 - protein, 6 aa, Entamoeba dispar
TKNQLK

SEQ ID NO: 2466287 - protein, 4 aa, Entamoeba dispar
TKNR

SEQ ID NO: 2466288 - protein, 39 aa, Entamoeba dispar
TKNSEEASTQKQSKEAQKKKNKKSCKPPVNKKETLNEQE

SEQ ID NO: 2466289 - protein, 8 aa, Entamoeba dispar
TKNSLKEP

SEQ ID NO: 2466290 - protein, 8 aa, Entamoeba dispar
TKNTTKEY

SEQ ID NO: 2466291 - protein, 7 aa, Entamoeba dispar
TKNTVNR

SEQ ID NO: 2466292 - protein, 7 aa, Entamoeba dispar
TKNVPGY

SEQ ID NO: 2466293 - protein, 7 aa, Entamoeba dispar
TKNYFTN

SEQ ID NO: 2466294 - protein, 12 aa, Entamoeba dispar
TKNYGQNTESFA

SEQ ID NO: 2466295 - protein, 9 aa, Entamoeba dispar
TKPDIPSNI

SEQ ID NO: 2466296 - protein, 4 aa, Entamoeba dispar
TKPF

SEQ ID NO: 2466297 - protein, 6 aa, Entamoeba dispar
TKPIDD

SEQ ID NO: 2466298 - protein, 31 aa, Entamoeba dispar
TKPIEKNNTEKEKGEENEEGKIKEKISKRER

SEQ ID NO: 2466299 - protein, 7 aa, Entamoeba dispar
TKPIGDC

SEQ ID NO: 2466300 - protein, 12 aa, Entamoeba dispar
TKPISPNSSHQV

SEQ ID NO: 2466301 - protein, 12 aa, Entamoeba dispar
TKPIYSNQGENF

SEQ ID NO: 2466302 - protein, 4 aa, Entamoeba dispar
TKPK

SEQ ID NO: 2466303 - protein, 8 aa, Entamoeba dispar
TKPKETVK

SEQ ID NO: 2466304 - protein, 8 aa, Entamoeba dispar
TKPKETVQ

SEQ ID NO: 2466305 - protein, 9 aa, Entamoeba dispar
TKPKKNNFI

SEQ ID NO: 2466306 - protein, 9 aa, Entamoeba dispar
TKPKTIKYG

SEQ ID NO: 2466307 - protein, 10 aa, Entamoeba dispar
TKPKTNNRNG

SEQ ID NO: 2466308 - protein, 4 aa, Entamoeba dispar
TKPL

SEQ ID NO: 2466309 - protein, 8 aa, Entamoeba dispar
TKPLYTSK

SEQ ID NO: 2466310 - protein, 4 aa, Entamoeba dispar
TKPN

SEQ ID NO: 2466311 - protein, 6 aa, Entamoeba dispar
TKPNQF

SEQ ID NO: 2466312 - protein, 7 aa, Entamoeba dispar
TKPNSIE

SEQ ID NO: 2466313 - protein, 8 aa, Entamoeba dispar
TKPNYLSK

SEQ ID NO: 2466314 - protein, 7 aa, Entamoeba dispar
TKPPKKA

SEQ ID NO: 2466315 - protein, 10 aa, Entamoeba dispar
TKPPKPKDQI

SEQ ID NO: 2466316 - protein, 29 aa, Entamoeba dispar
TKPPTKTGHTKMNQTKLSYGNKQTGQSLN

SEQ ID NO: 2466317 - protein, 7 aa, Entamoeba dispar
TKPPVRM

SEQ ID NO: 2466318 - protein, 4 aa, Entamoeba dispar
TKPQ

SEQ ID NO: 2466319 - protein, 5 aa, Entamoeba dispar
TKPQR

SEQ ID NO: 2466320 - protein, 8 aa, Entamoeba dispar
TKPSINPF

SEQ ID NO: 2466321 - protein, 12 aa, Entamoeba dispar
TKPSKIIEDNPV

SEQ ID NO: 2466322 - protein, 24 aa, Entamoeba dispar
TKPSKITRNSFKPKTIPIHPQSQD

SEQ ID NO: 2466323 - protein, 9 aa, Entamoeba dispar
TKPSLPTNI

SEQ ID NO: 2466324 - protein, 23 aa, Entamoeba dispar
TKPSPSSNTSSIPTAQSTTPINV

SEQ ID NO: 2466325 - protein, 9 aa, Entamoeba dispar
TKPSRNLEW

SEQ ID NO: 2466326 - protein, 6 aa, Entamoeba dispar
TKPSSV

SEQ ID NO: 2466327 - protein, 6 aa, Entamoeba dispar
TKPTCR

SEQ ID NO: 2466328 - protein, 9 aa, Entamoeba dispar
TKPTRSRNE

SEQ ID NO: 2466329 - protein, 7 aa, Entamoeba dispar
TKQAREC

SEQ ID NO: 2466330 - protein, 8 aa, Entamoeba dispar
TKQAREEI

SEQ ID NO: 2466331 - protein, 8 aa, Entamoeba dispar
TKQDELNE

SEQ ID NO: 2466332 - protein, 7 aa, Entamoeba dispar
TKQDGNF

SEQ ID NO: 2466333 - protein, 4 aa, Entamoeba dispar
TKQE

SEQ ID NO: 2466334 - protein, 9 aa, Entamoeba dispar
TKQEAANAM

SEQ ID NO: 2466335 - protein, 7 aa, Entamoeba dispar
TKQELEQ

SEQ ID NO: 2466336 - protein, 10 aa, Entamoeba dispar
TKQENKTPLE

SEQ ID NO: 2466337 - protein, 32 aa, Entamoeba dispar
TKQEREDDTPTIRQAPRRPTRSSKNRKPATKK

SEQ ID NO: 2466338 - protein, 10 aa, Entamoeba dispar
TKQGGSHKSW

SEQ ID NO: 2466339 - protein, 17 aa, Entamoeba dispar
TKQGVSQQTAKRRMQEA

SEQ ID NO: 2466340 - protein, 9 aa, Entamoeba dispar
TKQKLCNDG

SEQ ID NO: 2466341 - protein, 4 aa, Entamoeba dispar
TKQL

SEQ ID NO: 2466342 - protein, 5 aa, Entamoeba dispar
TKQLE

SEQ ID NO: 2466343 - protein, 14 aa, Entamoeba dispar
TKQMDKQLAEQPPE

SEQ ID NO: 2466344 - protein, 5 aa, Entamoeba dispar
TKQMK

SEQ ID NO: 2466345 - protein, 9 aa, Entamoeba dispar
TKQNDEGDT

SEQ ID NO: 2466346 - protein, 7 aa, Entamoeba dispar
TKQNIPK

SEQ ID NO: 2466347 - protein, 8 aa, Entamoeba dispar
TKQNPDFQ

SEQ ID NO: 2466348 - protein, 7 aa, Entamoeba dispar
TKQNTLN

SEQ ID NO: 2466349 - protein, 8 aa, Entamoeba dispar
TKQPKTGI

SEQ ID NO: 2466350 - protein, 8 aa, Entamoeba dispar
TKQPLPEE

SEQ ID NO: 2466351 - protein, 20 aa, Entamoeba dispar
TKQPTEFSESIHGTPNYLPP

SEQ ID NO: 2466352 - protein, 6 aa, Entamoeba dispar
TKQQAI

SEQ ID NO: 2466353 - protein, 16 aa, Entamoeba dispar
TKQQEANKKPKQKKEP

SEQ ID NO: 2466354 - protein, 5 aa, Entamoeba dispar
TKQQI

SEQ ID NO: 2466355 - protein, 23 aa, Entamoeba dispar
TKQQNQINKSKDEDFNKKQQVLK

SEQ ID NO: 2466356 - protein, 8 aa, Entamoeba dispar
TKQQTQPI

SEQ ID NO: 2466357 - protein, 13 aa, Entamoeba dispar
TKQREELDQKRRK

SEQ ID NO: 2466358 - protein, 4 aa, Entamoeba dispar
TKQS

SEQ ID NO: 2466359 - protein, 10 aa, Entamoeba dispar
TKQSKPTLKE

SEQ ID NO: 2466360 - protein, 10 aa, Entamoeba dispar
TKQSSIYQQT

SEQ ID NO: 2466361 - protein, 10 aa, Entamoeba dispar
TKRENGRKAQ

SEQ ID NO: 2466362 - protein, 8 aa, Entamoeba dispar
TKRIDGEI

SEQ ID NO: 2466363 - protein, 5 aa, Entamoeba dispar
TKRKE

SEQ ID NO: 2466364 - protein, 9 aa, Entamoeba dispar
TKRKEESLF

SEQ ID NO: 2466365 - protein, 5 aa, Entamoeba dispar
TKRKN

SEQ ID NO: 2466366 - protein, 11 aa, Entamoeba dispar
TKRKSKRNTVV

SEQ ID NO: 2466367 - protein, 7 aa, Entamoeba dispar
TKRLQSP

SEQ ID NO: 2466368 - protein, 6 aa, Entamoeba dispar
TKRLSA

SEQ ID NO: 2466369 - protein, 10 aa, Entamoeba dispar
TKRPEIDDSV

SEQ ID NO: 2466370 - protein, 13 aa, Entamoeba dispar
TKRPKPQGYDTSK

SEQ ID NO: 2466371 - protein, 8 aa, Entamoeba dispar
TKRQQNKV

SEQ ID NO: 2466372 - protein, 4 aa, Entamoeba dispar
TKRS

SEQ ID NO: 2466373 - protein, 12 aa, Entamoeba dispar
TKRSAGTSCNYN

SEQ ID NO: 2466374 - protein, 17 aa, Entamoeba dispar
TKRSDTRKIYEGKTDHQ

SEQ ID NO: 2466375 - protein, 37 aa, Entamoeba dispar
TKRSKIPTISSNGTSQDNVNVSNPVNPQPSKRRYCLI

SEQ ID NO: 2466376 - protein, 11 aa, Entamoeba dispar
TKRSQNPAKNL

SEQ ID NO: 2466377 - protein, 7 aa, Entamoeba dispar
TKRTPPI

SEQ ID NO: 2466378 - protein, 12 aa, Entamoeba dispar
TKSDGSVEIEES

SEQ ID NO: 2466379 - protein, 9 aa, Entamoeba dispar
TKSDLSTQR

SEQ ID NO: 2466380 - protein, 5 aa, Entamoeba dispar
TKSDV

SEQ ID NO: 2466381 - protein, 5 aa, Entamoeba dispar
TKSEE

SEQ ID NO: 2466382 - protein, 5 aa, Entamoeba dispar
TKSEI

SEQ ID NO: 2466383 - protein, 6 aa, Entamoeba dispar
TKSERY

SEQ ID NO: 2466384 - protein, 6 aa, Entamoeba dispar
TKSEVN

SEQ ID NO: 2466385 - protein, 10 aa, Entamoeba dispar
TKSFNKDEIK

SEQ ID NO: 2466386 - protein, 9 aa, Entamoeba dispar
TKSFPNAKS

SEQ ID NO: 2466387 - protein, 7 aa, Entamoeba dispar
TKSGRTP

SEQ ID NO: 2466388 - protein, 8 aa, Entamoeba dispar
TKSGVSKR

SEQ ID NO: 2466389 - protein, 9 aa, Entamoeba dispar
TKSIDRDEI

SEQ ID NO: 2466390 - protein, 7 aa, Entamoeba dispar
TKSIKNT

SEQ ID NO: 2466391 - protein, 7 aa, Entamoeba dispar
TKSKDKY

SEQ ID NO: 2466392 - protein, 6 aa, Entamoeba dispar
TKSKDT

SEQ ID NO: 2466393 - protein, 6 aa, Entamoeba dispar
TKSKEF

SEQ ID NO: 2466394 - protein, 8 aa, Entamoeba dispar
TKSKGGNA

SEQ ID NO: 2466395 - protein, 46 aa, Entamoeba dispar
TKSKKSGSKANKKPTTSSVKPTTPTTPVDPSVIPPEIKEPTETLST

SEQ ID NO: 2466396 - protein, 11 aa, Entamoeba dispar
TKSKQVPPPRV

SEQ ID NO: 2466397 - protein, 8 aa, Entamoeba dispar
TKSKSRKV

SEQ ID NO: 2466398 - protein, 9 aa, Entamoeba dispar
TKSKYYQEE

SEQ ID NO: 2466399 - protein, 4 aa, Entamoeba dispar
TKSL

SEQ ID NO: 2466400 - protein, 5 aa, Entamoeba dispar
TKSLH

SEQ ID NO: 2466401 - protein, 10 aa, Entamoeba dispar
TKSLYKKDNG

SEQ ID NO: 2466402 - protein, 4 aa, Entamoeba dispar
TKSN

SEQ ID NO: 2466403 - protein, 5 aa, Entamoeba dispar
TKSND

SEQ ID NO: 2466404 - protein, 6 aa, Entamoeba dispar
TKSNQI

SEQ ID NO: 2466405 - protein, 15 aa, Entamoeba dispar
TKSNTWTGTKSFNGY

SEQ ID NO: 2466406 - protein, 5 aa, Entamoeba dispar
TKSPI

SEQ ID NO: 2466407 - protein, 49 aa, Entamoeba dispar
TKSPKTFSSKTTSPNLTHDNTQSNKKAIESEGSSPASVPNKTNSPSTRV

SEQ ID NO: 2466408 - protein, 7 aa, Entamoeba dispar
TKSQEYK

SEQ ID NO: 2466409 - protein, 15 aa, Entamoeba dispar
TKSQGKNGIAKSETI

SEQ ID NO: 2466410 - protein, 8 aa, Entamoeba dispar
TKSQPEEV

SEQ ID NO: 2466411 - protein, 16 aa, Entamoeba dispar
TKSRINSTSKETEELK

SEQ ID NO: 2466412 - protein, 5 aa, Entamoeba dispar
TKSSD

SEQ ID NO: 2466413 - protein, 14 aa, Entamoeba dispar
TKSSKDGVSSQQYQ

SEQ ID NO: 2466414 - protein, 14 aa, Entamoeba dispar
TKSSKNGVSSQQYQ

SEQ ID NO: 2466415 - protein, 23 aa, Entamoeba dispar
TKSSPSSNTSSIPTAQSTTPINV

SEQ ID NO: 2466416 - protein, 21 aa, Entamoeba dispar
TKSSTCTGDKEENTVDINSEE

SEQ ID NO: 2466417 - protein, 22 aa, Entamoeba dispar
TKSSTQTKIKKTKQNDRTIDDK

SEQ ID NO: 2466418 - protein, 7 aa, Entamoeba dispar
TKSSVQP

SEQ ID NO: 2466419 - protein, 13 aa, Entamoeba dispar
TKSTQGNNLSNET

SEQ ID NO: 2466420 - protein, 5 aa, Entamoeba dispar
TKSTR

SEQ ID NO: 2466421 - protein, 7 aa, Entamoeba dispar
TKSVEEQ

SEQ ID NO: 2466422 - protein, 8 aa, Entamoeba dispar
TKSVGLNE

SEQ ID NO: 2466423 - protein, 16 aa, Entamoeba dispar
TKSWKTTSFNAHPAGV

SEQ ID NO: 2466424 - protein, 8 aa, Entamoeba dispar
TKSYPDRV

SEQ ID NO: 2466425 - protein, 9 aa, Entamoeba dispar
TKTAKECRS

SEQ ID NO: 2466426 - protein, 20 aa, Entamoeba dispar
TKTAPTSPPTTSSPIQSKPS

SEQ ID NO: 2466427 - protein, 20 aa, Entamoeba dispar
TKTASELDKFDKTTSLSTKR

SEQ ID NO: 2466428 - protein, 4 aa, Entamoeba dispar
TKTC

SEQ ID NO: 2466429 - protein, 6 aa, Entamoeba dispar
TKTCSS

SEQ ID NO: 2466430 - protein, 19 aa, Entamoeba dispar
TKTDFSDFKKESEDKIKKL

SEQ ID NO: 2466431 - protein, 14 aa, Entamoeba dispar
TKTEIPTTEKINEN

SEQ ID NO: 2466432 - protein, 22 aa, Entamoeba dispar
TKTEKVEKKEKKKEKKVTKRKK

SEQ ID NO: 2466433 - protein, 12 aa, Entamoeba dispar
TKTETDNQHQEQ

SEQ ID NO: 2466434 - protein, 7 aa, Entamoeba dispar
TKTEVMK

SEQ ID NO: 2466435 - protein, 7 aa, Entamoeba dispar
TKTEVYN

SEQ ID NO: 2466436 - protein, 13 aa, Entamoeba dispar
TKTFEKKKKGDLV

SEQ ID NO: 2466437 - protein, 8 aa, Entamoeba dispar
TKTGAGLN

SEQ ID NO: 2466438 - protein, 7 aa, Entamoeba dispar
TKTGELQ

SEQ ID NO: 2466439 - protein, 4 aa, Entamoeba dispar
TKTI

SEQ ID NO: 2466440 - protein, 13 aa, Entamoeba dispar
TKTIEEKDSQIKK

SEQ ID NO: 2466441 - protein, 6 aa, Entamoeba dispar
TKTINL

SEQ ID NO: 2466442 - protein, 15 aa, Entamoeba dispar
TKTITEIKPTNINDE

SEQ ID NO: 2466443 - protein, 8 aa, Entamoeba dispar
TKTKEFKS

SEQ ID NO: 2466444 - protein, 10 aa, Entamoeba dispar
TKTKKEEVVE

SEQ ID NO: 2466445 - protein, 35 aa, Entamoeba dispar
TKTKLKDECPKIAQKDKDKEKKDKDKKDKDKAVAK

SEQ ID NO: 2466446 - protein, 6 aa, Entamoeba dispar
TKTKRI

SEQ ID NO: 2466447 - protein, 11 aa, Entamoeba dispar
TKTLPSSPFTN

SEQ ID NO: 2466448 - protein, 7 aa, Entamoeba dispar
TKTNAIP

SEQ ID NO: 2466449 - protein, 8 aa, Entamoeba dispar
TKTNECNR

SEQ ID NO: 2466450 - protein, 19 aa, Entamoeba dispar
TKTNELAIDEDKEEEEYRE

SEQ ID NO: 2466451 - protein, 9 aa, Entamoeba dispar
TKTNGDKYV

SEQ ID NO: 2466452 - protein, 5 aa, Entamoeba dispar
TKTNL

SEQ ID NO: 2466453 - protein, 10 aa, Entamoeba dispar
TKTNQEKISD

SEQ ID NO: 2466454 - protein, 8 aa, Entamoeba dispar
TKTNTNEL

SEQ ID NO: 2466455 - protein, 6 aa, Entamoeba dispar
TKTNVA

SEQ ID NO: 2466456 - protein, 6 aa, Entamoeba dispar
TKTPDG

SEQ ID NO: 2466457 - protein, 7 aa, Entamoeba dispar
TKTPKIH

SEQ ID NO: 2466458 - protein, 14 aa, Entamoeba dispar
TKTPKKETIPGRAN

SEQ ID NO: 2466459 - protein, 7 aa, Entamoeba dispar
TKTPLLR

SEQ ID NO: 2466460 - protein, 6 aa, Entamoeba dispar
TKTPYQ

SEQ ID NO: 2466461 - protein, 4 aa, Entamoeba dispar
TKTQ

SEQ ID NO: 2466462 - protein, 5 aa, Entamoeba dispar
TKTQG

SEQ ID NO: 2466463 - protein, 13 aa, Entamoeba dispar
TKTQIKAAEPYDS

SEQ ID NO: 2466464 - protein, 5 aa, Entamoeba dispar
TKTQL

SEQ ID NO: 2466465 - protein, 7 aa, Entamoeba dispar
TKTQSDN

SEQ ID NO: 2466466 - protein, 10 aa, Entamoeba dispar
TKTQSPLPLN

SEQ ID NO: 2466467 - protein, 14 aa, Entamoeba dispar
TKTSEWRTGESPNT

SEQ ID NO: 2466468 - protein, 5 aa, Entamoeba dispar
TKTSL

SEQ ID NO: 2466469 - protein, 5 aa, Entamoeba dispar
TKTSN

SEQ ID NO: 2466470 - protein, 7 aa, Entamoeba dispar
TKTTEYI

SEQ ID NO: 2466471 - protein, 5 aa, Entamoeba dispar
TKTTI

SEQ ID NO: 2466472 - protein, 6 aa, Entamoeba dispar
TKTTPS

SEQ ID NO: 2466473 - protein, 5 aa, Entamoeba dispar
TKTTS

SEQ ID NO: 2466474 - protein, 7 aa, Entamoeba dispar
TKTTTTI

SEQ ID NO: 2466475 - protein, 9 aa, Entamoeba dispar
TKVDENKGF

SEQ ID NO: 2466476 - protein, 11 aa, Entamoeba dispar
TKVDGRSPSIV

SEQ ID NO: 2466477 - protein, 5 aa, Entamoeba dispar
TKVEV

SEQ ID NO: 2466478 - protein, 4 aa, Entamoeba dispar
TKVG

SEQ ID NO: 2466479 - protein, 17 aa, Entamoeba dispar
TKVHQKEEKTENSPLQG

SEQ ID NO: 2466480 - protein, 5 aa, Entamoeba dispar
TKVKA

SEQ ID NO: 2466481 - protein, 7 aa, Entamoeba dispar
TKVNPIN

SEQ ID NO: 2466482 - protein, 13 aa, Entamoeba dispar
TKVPKEKHKKRGK

SEQ ID NO: 2466483 - protein, 6 aa, Entamoeba dispar
TKVQEF

SEQ ID NO: 2466484 - protein, 16 aa, Entamoeba dispar
TKVQNNKSVQIEKEQQ

SEQ ID NO: 2466485 - protein, 7 aa, Entamoeba dispar
TKVSNDL

SEQ ID NO: 2466486 - protein, 14 aa, Entamoeba dispar
TKVTDGKNGTIKTE

SEQ ID NO: 2466487 - protein, 8 aa, Entamoeba dispar
TKVYEASS

SEQ ID NO: 2466488 - protein, 14 aa, Entamoeba dispar
TKYDNTNKGGIKER

SEQ ID NO: 2466489 - protein, 16 aa, Entamoeba dispar
TKYDRKSYGNTIPSEV

SEQ ID NO: 2466490 - protein, 17 aa, Entamoeba dispar
TKYDRNKYGNTIPSEVK

SEQ ID NO: 2466491 - protein, 22 aa, Entamoeba dispar
TKYDSYKYGNTIPSEVKSLGDE

SEQ ID NO: 2466492 - protein, 25 aa, Entamoeba dispar
TKYDSYKYGNTIPTEVKLLGYGYFN

SEQ ID NO: 2466493 - protein, 15 aa, Entamoeba dispar
TKYGGGAFTCTSDGS

SEQ ID NO: 2466494 - protein, 11 aa, Entamoeba dispar
TKYKKNNGSFA

SEQ ID NO: 2466495 - protein, 16 aa, Entamoeba dispar
TKYNHGNGKGNEGSNE

SEQ ID NO: 2466496 - protein, 8 aa, Entamoeba dispar
TKYPPRPY

SEQ ID NO: 2466497 - protein, 4 aa, Entamoeba dispar
TKYR

SEQ ID NO: 2466498 - protein, 6 aa, Entamoeba dispar
TKYSDI

SEQ ID NO: 2466499 - protein, 8 aa, Entamoeba dispar
TLAPKPVA

SEQ ID NO: 2466500 - protein, 10 aa, Entamoeba dispar
TLAQSSKQHW

SEQ ID NO: 2466501 - protein, 11 aa, Entamoeba dispar
TLASSDYDAAY

SEQ ID NO: 2466502 - protein, 13 aa, Entamoeba dispar
TLASSKRDAVNEI

SEQ ID NO: 2466503 - protein, 4 aa, Entamoeba dispar
TLAY

SEQ ID NO: 2466504 - protein, 4 aa, Entamoeba dispar
TLDA

SEQ ID NO: 2466505 - protein, 18 aa, Entamoeba dispar
TLDDDEGWTLDQDKNDTK

SEQ ID NO: 2466506 - protein, 9 aa, Entamoeba dispar
TLDDPNAKA

SEQ ID NO: 2466507 - protein, 4 aa, Entamoeba dispar
TLDE

SEQ ID NO: 2466508 - protein, 9 aa, Entamoeba dispar
TLDKTKQKL

SEQ ID NO: 2466509 - protein, 4 aa, Entamoeba dispar
TLED

SEQ ID NO: 2466510 - protein, 5 aa, Entamoeba dispar
TLEDK

SEQ ID NO: 2466511 - protein, 11 aa, Entamoeba dispar
TLEEQSSSSIN

SEQ ID NO: 2466512 - protein, 6 aa, Entamoeba dispar
TLEERE

SEQ ID NO: 2466513 - protein, 31 aa, Entamoeba dispar
TLEESKSHDARDNELAKQDKADKIKSAENEI

SEQ ID NO: 2466514 - protein, 11 aa, Entamoeba dispar
TLEGGEQSLTE

SEQ ID NO: 2466515 - protein, 9 aa, Entamoeba dispar
TLEGYSGNI

SEQ ID NO: 2466516 - protein, 10 aa, Entamoeba dispar
TLEKGRIQNE

SEQ ID NO: 2466517 - protein, 10 aa, Entamoeba dispar
TLEKSQRLKT

SEQ ID NO: 2466518 - protein, 8 aa, Entamoeba dispar
TLENHQDY

SEQ ID NO: 2466519 - protein, 4 aa, Entamoeba dispar
TLEQ

SEQ ID NO: 2466520 - protein, 9 aa, Entamoeba dispar
TLEQTEEYG

SEQ ID NO: 2466521 - protein, 7 aa, Entamoeba dispar
TLEQTQK

SEQ ID NO: 2466522 - protein, 9 aa, Entamoeba dispar
TLERRKSPI

SEQ ID NO: 2466523 - protein, 5 aa, Entamoeba dispar
TLESR

SEQ ID NO: 2466524 - protein, 6 aa, Entamoeba dispar
TLESTT

SEQ ID NO: 2466525 - protein, 6 aa, Entamoeba dispar
TLETQK

SEQ ID NO: 2466526 - protein, 7 aa, Entamoeba dispar
TLETSKS

SEQ ID NO: 2466527 - protein, 4 aa, Entamoeba dispar
TLGE

SEQ ID NO: 2466528 - protein, 21 aa, Entamoeba dispar
TLGGEDDDCSRKGGRKNVNQQ

SEQ ID NO: 2466529 - protein, 8 aa, Entamoeba dispar
TLGGSSIN

SEQ ID NO: 2466530 - protein, 20 aa, Entamoeba dispar
TLGKNYKQTVIRTDKHFEDI

SEQ ID NO: 2466531 - protein, 8 aa, Entamoeba dispar
TLGNTEEL

SEQ ID NO: 2466532 - protein, 7 aa, Entamoeba dispar
TLGPKGR

SEQ ID NO: 2466533 - protein, 5 aa, Entamoeba dispar
TLGPM

SEQ ID NO: 2466534 - protein, 39 aa, Entamoeba dispar
TLGPQTTPQSSSQPQTQIQQPVNSAPVQMSTESESASVP

SEQ ID NO: 2466535 - protein, 12 aa, Entamoeba dispar
TLGRQGNQKVTD

SEQ ID NO: 2466536 - protein, 7 aa, Entamoeba dispar
TLGRQSK

SEQ ID NO: 2466537 - protein, 7 aa, Entamoeba dispar
TLGRSGP

SEQ ID NO: 2466538 - protein, 10 aa, Entamoeba dispar
TLGSGSSNIY

SEQ ID NO: 2466539 - protein, 14 aa, Entamoeba dispar
TLGSKRMTNYTSDL

SEQ ID NO: 2466540 - protein, 13 aa, Entamoeba dispar
TLHSDKSYDQTIN

SEQ ID NO: 2466541 - protein, 20 aa, Entamoeba dispar
TLHSKTKKSKKSIKLDSCIV

SEQ ID NO: 2466542 - protein, 17 aa, Entamoeba dispar
TLHTPKKENKPSFTSTN

SEQ ID NO: 2466543 - protein, 7 aa, Entamoeba dispar
TLKDEKS

SEQ ID NO: 2466544 - protein, 9 aa, Entamoeba dispar
TLKDSTDCA

SEQ ID NO: 2466545 - protein, 8 aa, Entamoeba dispar
TLKDSTTD

SEQ ID NO: 2466546 - protein, 5 aa, Entamoeba dispar
TLKGG

SEQ ID NO: 2466547 - protein, 8 aa, Entamoeba dispar
TLKGKQTK

SEQ ID NO: 2466548 - protein, 6 aa, Entamoeba dispar
TLKGSM

SEQ ID NO: 2466549 - protein, 13 aa, Entamoeba dispar
TLKKEEDELNGFT

SEQ ID NO: 2466550 - protein, 15 aa, Entamoeba dispar
TLKKEKENTPENDTI

SEQ ID NO: 2466551 - protein, 10 aa, Entamoeba dispar
TLKKEQNNKG

SEQ ID NO: 2466552 - protein, 9 aa, Entamoeba dispar
TLKKQKELQ

SEQ ID NO: 2466553 - protein, 10 aa, Entamoeba dispar
TLKNENIKHS

SEQ ID NO: 2466554 - protein, 8 aa, Entamoeba dispar
TLKQPPTI

SEQ ID NO: 2466555 - protein, 13 aa, Entamoeba dispar
TLKSFKENEYPFD

SEQ ID NO: 2466556 - protein, 10 aa, Entamoeba dispar
TLKTNDNEPM

SEQ ID NO: 2466557 - protein, 6 aa, Entamoeba dispar
TLLPGQ

SEQ ID NO: 2466558 - protein, 15 aa, Entamoeba dispar
TLLQTDNKKPNDIKT

SEQ ID NO: 2466559 - protein, 10 aa, Entamoeba dispar
TLLSGSDDTY

SEQ ID NO: 2466560 - protein, 4 aa, Entamoeba dispar
TLLT

SEQ ID NO: 2466561 - protein, 9 aa, Entamoeba dispar
TLNAMTSPT

SEQ ID NO: 2466562 - protein, 10 aa, Entamoeba dispar
TLNEEEKEHK

SEQ ID NO: 2466563 - protein, 16 aa, Entamoeba dispar
TLNEKTAKEKEEIEQK

SEQ ID NO: 2466564 - protein, 8 aa, Entamoeba dispar
TLNEPSKG

SEQ ID NO: 2466565 - protein, 9 aa, Entamoeba dispar
TLNETPEDN

SEQ ID NO: 2466566 - protein, 12 aa, Entamoeba dispar
TLNEYTKSKFSE

SEQ ID NO: 2466567 - protein, 9 aa, Entamoeba dispar
TLNGHNGAV

SEQ ID NO: 2466568 - protein, 9 aa, Entamoeba dispar
TLNHTSSTG

SEQ ID NO: 2466569 - protein, 4 aa, Entamoeba dispar
TLNI

SEQ ID NO: 2466570 - protein, 10 aa, Entamoeba dispar
TLNKKENEDF

SEQ ID NO: 2466571 - protein, 30 aa, Entamoeba dispar
TLNKSSSDEIQIEEQNKDNKEEVNKSSLEQ

SEQ ID NO: 2466572 - protein, 36 aa, Entamoeba dispar
TLNKTTKESIIKEQSERKRRGSDPSNSSSDKSKQEL

SEQ ID NO: 2466573 - protein, 4 aa, Entamoeba dispar
TLNN

SEQ ID NO: 2466574 - protein, 6 aa, Entamoeba dispar
TLNNQT

SEQ ID NO: 2466575 - protein, 10 aa, Entamoeba dispar
TLNPNDSRKT

SEQ ID NO: 2466576 - protein, 4 aa, Entamoeba dispar
TLNQ

SEQ ID NO: 2466577 - protein, 13 aa, Entamoeba dispar
TLNQKGDSKENDL

SEQ ID NO: 2466578 - protein, 9 aa, Entamoeba dispar
TLNRDGSPM

SEQ ID NO: 2466579 - protein, 29 aa, Entamoeba dispar
TLNSPTNKGNKVLGNNRNNKFNPKESQEV

SEQ ID NO: 2466580 - protein, 6 aa, Entamoeba dispar
TLNTSS

SEQ ID NO: 2466581 - protein, 6 aa, Entamoeba dispar
TLNVGG

SEQ ID NO: 2466582 - protein, 5 aa, Entamoeba dispar
TLPAK

SEQ ID NO: 2466583 - protein, 5 aa, Entamoeba dispar
TLPAT

SEQ ID NO: 2466584 - protein, 4 aa, Entamoeba dispar
TLPD

SEQ ID NO: 2466585 - protein, 5 aa, Entamoeba dispar
TLPDA

SEQ ID NO: 2466586 - protein, 15 aa, Entamoeba dispar
TLPDERRRTSTEYDY

SEQ ID NO: 2466587 - protein, 4 aa, Entamoeba dispar
TLPE

SEQ ID NO: 2466588 - protein, 8 aa, Entamoeba dispar
TLPEPQVA

SEQ ID NO: 2466589 - protein, 6 aa, Entamoeba dispar
TLPETV

SEQ ID NO: 2466590 - protein, 5 aa, Entamoeba dispar
TLPFT

SEQ ID NO: 2466591 - protein, 7 aa, Entamoeba dispar
TLPGKEV

SEQ ID NO: 2466592 - protein, 8 aa, Entamoeba dispar
TLPKGEAD

SEQ ID NO: 2466593 - protein, 9 aa, Entamoeba dispar
TLPKPKSKV

SEQ ID NO: 2466594 - protein, 8 aa, Entamoeba dispar
TLPLNPHE

SEQ ID NO: 2466595 - protein, 4 aa, Entamoeba dispar
TLPN

SEQ ID NO: 2466596 - protein, 5 aa, Entamoeba dispar
TLPNC

SEQ ID NO: 2466597 - protein, 5 aa, Entamoeba dispar
TLPNK

SEQ ID NO: 2466598 - protein, 9 aa, Entamoeba dispar
TLPNNSSLK

SEQ ID NO: 2466599 - protein, 6 aa, Entamoeba dispar
TLPNYQ

SEQ ID NO: 2466600 - protein, 13 aa, Entamoeba dispar
TLPPNYSRSSENA

SEQ ID NO: 2466601 - protein, 12 aa, Entamoeba dispar
TLPRTDEDEYYN

SEQ ID NO: 2466602 - protein, 4 aa, Entamoeba dispar
TLPS

SEQ ID NO: 2466603 - protein, 6 aa, Entamoeba dispar
TLPSDI

SEQ ID NO: 2466604 - protein, 8 aa, Entamoeba dispar
TLPSDKQQ

SEQ ID NO: 2466605 - protein, 14 aa, Entamoeba dispar
TLPSDYTASVTGPK

SEQ ID NO: 2466606 - protein, 10 aa, Entamoeba dispar
TLPSKPDYNK

SEQ ID NO: 2466607 - protein, 19 aa, Entamoeba dispar
TLPSNDSEYEQSSDVNDFE

SEQ ID NO: 2466608 - protein, 5 aa, Entamoeba dispar
TLPSS

SEQ ID NO: 2466609 - protein, 8 aa, Entamoeba dispar
TLPSSKEM

SEQ ID NO: 2466610 - protein, 8 aa, Entamoeba dispar
TLPSSVSE

SEQ ID NO: 2466611 - protein, 7 aa, Entamoeba dispar
TLPTEQF

SEQ ID NO: 2466612 - protein, 8 aa, Entamoeba dispar
TLPTNIRQ

SEQ ID NO: 2466613 - protein, 9 aa, Entamoeba dispar
TLPTPADVN

SEQ ID NO: 2466614 - protein, 15 aa, Entamoeba dispar
TLQDEEQCTKDYYDN

SEQ ID NO: 2466615 - protein, 11 aa, Entamoeba dispar
TLQDELQTPNF

SEQ ID NO: 2466616 - protein, 7 aa, Entamoeba dispar
TLQKHER

SEQ ID NO: 2466617 - protein, 10 aa, Entamoeba dispar
TLQNGTTTAS

SEQ ID NO: 2466618 - protein, 17 aa, Entamoeba dispar
TLQPPSREPPELPQYES

SEQ ID NO: 2466619 - protein, 16 aa, Entamoeba dispar
TLQPSTQNLSKQEVNS

SEQ ID NO: 2466620 - protein, 5 aa, Entamoeba dispar
TLQQV

SEQ ID NO: 2466621 - protein, 15 aa, Entamoeba dispar
TLQRLDSKDNSIYTR

SEQ ID NO: 2466622 - protein, 7 aa, Entamoeba dispar
TLREKDH

SEQ ID NO: 2466623 - protein, 5 aa, Entamoeba dispar
TLRES

SEQ ID NO: 2466624 - protein, 8 aa, Entamoeba dispar
TLRPSNEE

SEQ ID NO: 2466625 - protein, 7 aa, Entamoeba dispar
TLRPTAE

SEQ ID NO: 2466626 - protein, 11 aa, Entamoeba dispar
TLRPVSNNSSL

SEQ ID NO: 2466627 - protein, 7 aa, Entamoeba dispar
TLRQKKP

SEQ ID NO: 2466628 - protein, 9 aa, Entamoeba dispar
TLRQNKRKE

SEQ ID NO: 2466629 - protein, 10 aa, Entamoeba dispar
TLRQSKVKNE

SEQ ID NO: 2466630 - protein, 4 aa, Entamoeba dispar
TLRR

SEQ ID NO: 2466631 - protein, 41 aa, Entamoeba dispar
TLRSPSLSSETVNTTFPSGDTKNSSPKRKRWDKTSREKAVK

SEQ ID NO: 2466632 - protein, 11 aa, Entamoeba dispar
TLSDKGSQEAK

SEQ ID NO: 2466633 - protein, 4 aa, Entamoeba dispar
TLSE

SEQ ID NO: 2466634 - protein, 6 aa, Entamoeba dispar
TLSECP

SEQ ID NO: 2466635 - protein, 5 aa, Entamoeba dispar
TLSEQ

SEQ ID NO: 2466636 - protein, 10 aa, Entamoeba dispar
TLSEQRTTRL

SEQ ID NO: 2466637 - protein, 19 aa, Entamoeba dispar
TLSETIESIGESPGKLDHS

SEQ ID NO: 2466638 - protein, 6 aa, Entamoeba dispar
TLSGNK

SEQ ID NO: 2466639 - protein, 13 aa, Entamoeba dispar
TLSGRLPARNQQF

SEQ ID NO: 2466640 - protein, 8 aa, Entamoeba dispar
TLSKGQTY

SEQ ID NO: 2466641 - protein, 9 aa, Entamoeba dispar
TLSKSASAL

SEQ ID NO: 2466642 - protein, 9 aa, Entamoeba dispar
TLSKSEATK

SEQ ID NO: 2466643 - protein, 9 aa, Entamoeba dispar
TLSNKRKAN

SEQ ID NO: 2466644 - protein, 15 aa, Entamoeba dispar
TLSPDQNIRNQGEQV

SEQ ID NO: 2466645 - protein, 5 aa, Entamoeba dispar
TLSPM

SEQ ID NO: 2466646 - protein, 33 aa, Entamoeba dispar
TLSPRPKTERCRRESPTHSVKNSPRSPRSARDL

SEQ ID NO: 2466647 - protein, 15 aa, Entamoeba dispar
TLSPSKNASARLTEK

SEQ ID NO: 2466648 - protein, 4 aa, Entamoeba dispar
TLSQ

SEQ ID NO: 2466649 - protein, 7 aa, Entamoeba dispar
TLSQDEQ

SEQ ID NO: 2466650 - protein, 14 aa, Entamoeba dispar
TLSSETSCKHIQKG

SEQ ID NO: 2466651 - protein, 9 aa, Entamoeba dispar
TLSSPNKSD

SEQ ID NO: 2466652 - protein, 7 aa, Entamoeba dispar
TLSSQDQ

SEQ ID NO: 2466653 - protein, 13 aa, Entamoeba dispar
TLSSQEENKGIQK

SEQ ID NO: 2466654 - protein, 16 aa, Entamoeba dispar
TLSTGSEDGVLICSQF

SEQ ID NO: 2466655 - protein, 5 aa, Entamoeba dispar
TLSYS

SEQ ID NO: 2466656 - protein, 9 aa, Entamoeba dispar
TLTAPNRHM

SEQ ID NO: 2466657 - protein, 7 aa, Entamoeba dispar
TLTEEAR

SEQ ID NO: 2466658 - protein, 8 aa, Entamoeba dispar
TLTEEQAN

SEQ ID NO: 2466659 - protein, 12 aa, Entamoeba dispar
TLTGHSNRITGG

SEQ ID NO: 2466660 - protein, 10 aa, Entamoeba dispar
TLTHSSQASV

SEQ ID NO: 2466661 - protein, 4 aa, Entamoeba dispar
TLTK

SEQ ID NO: 2466662 - protein, 10 aa, Entamoeba dispar
TLTKDENKLA

SEQ ID NO: 2466663 - protein, 11 aa, Entamoeba dispar
TLTKPRNKITQ

SEQ ID NO: 2466664 - protein, 5 aa, Entamoeba dispar
TLTLE

SEQ ID NO: 2466665 - protein, 9 aa, Entamoeba dispar
TLTNNGRKT

SEQ ID NO: 2466666 - protein, 11 aa, Entamoeba dispar
TLTNNKYPRLP

SEQ ID NO: 2466667 - protein, 16 aa, Entamoeba dispar
TLTNTKSKDNKDNTFA

SEQ ID NO: 2466668 - protein, 6 aa, Entamoeba dispar
TLTPQE

SEQ ID NO: 2466669 - protein, 15 aa, Entamoeba dispar
TLTSDDLTQPKKEVY

SEQ ID NO: 2466670 - protein, 11 aa, Entamoeba dispar
TLTSIRTGGIG

SEQ ID NO: 2466671 - protein, 5 aa, Entamoeba dispar
TLTSN

SEQ ID NO: 2466672 - protein, 8 aa, Entamoeba dispar
TLTSPNNT

SEQ ID NO: 2466673 - protein, 13 aa, Entamoeba dispar
TLTTKERKKSRFG

SEQ ID NO: 2466674 - protein, 12 aa, Entamoeba dispar
TLYDSEEDGLTA

SEQ ID NO: 2466675 - protein, 10 aa, Entamoeba dispar
TMKETNKNFN

SEQ ID NO: 2466676 - protein, 11 aa, Entamoeba dispar
TMKGGNDYEMA

SEQ ID NO: 2466677 - protein, 5 aa, Entamoeba dispar
TMKGR

SEQ ID NO: 2466678 - protein, 16 aa, Entamoeba dispar
TMKKETEKMVESPKNP

SEQ ID NO: 2466679 - protein, 8 aa, Entamoeba dispar
TMKNNSDI

SEQ ID NO: 2466680 - protein, 8 aa, Entamoeba dispar
TMKQSEME

SEQ ID NO: 2466681 - protein, 10 aa, Entamoeba dispar
TMKRTTETKR

SEQ ID NO: 2466682 - protein, 4 aa, Entamoeba dispar
TMKV

SEQ ID NO: 2466683 - protein, 12 aa, Entamoeba dispar
TMLSPSSQLTSP

SEQ ID NO: 2466684 - protein, 65 aa, Entamoeba dispar
TMMKTDNHHDKVKEYDSYYNERKKSRSRSRSRGRSNHNDTYRDRYSRSERDYYRDRNYDDKRRLR

SEQ ID NO: 2466685 - protein, 4 aa, Entamoeba dispar
TMNE

SEQ ID NO: 2466686 - protein, 6 aa, Entamoeba dispar
TMNGGY

SEQ ID NO: 2466687 - protein, 8 aa, Entamoeba dispar
TMNKYERE

SEQ ID NO: 2466688 - protein, 6 aa, Entamoeba dispar
TMPAYS

SEQ ID NO: 2466689 - protein, 85 aa, Entamoeba dispar
TMPDENTEIKKKTIKKVTTTRKRKDEDLSLSGDEKTKRKRTTKKTTTKKVTKKRTTKVSKEEEGIDKEENDTPAKTSRKKKTKKV

SEQ ID NO: 2466690 - protein, 4 aa, Entamoeba dispar
TMPK

SEQ ID NO: 2466691 - protein, 10 aa, Entamoeba dispar
TMPSSVKNIG

SEQ ID NO: 2466692 - protein, 8 aa, Entamoeba dispar
TMQNVNSS

SEQ ID NO: 2466693 - protein, 7 aa, Entamoeba dispar
TMRDAQQ

SEQ ID NO: 2466694 - protein, 6 aa, Entamoeba dispar
TMRTPP

SEQ ID NO: 2466695 - protein, 6 aa, Entamoeba dispar
TMSLQG

SEQ ID NO: 2466696 - protein, 13 aa, Entamoeba dispar
TMSPSKLATKISR

SEQ ID NO: 2466697 - protein, 12 aa, Entamoeba dispar
TMSSASNPSISL

SEQ ID NO: 2466698 - protein, 9 aa, Entamoeba dispar
TMTDQKYQL

SEQ ID NO: 2466699 - protein, 28 aa, Entamoeba dispar
TMTNKEKDIVKAQNKAKEQYMKEHPDVK

SEQ ID NO: 2466700 - protein, 5 aa, Entamoeba dispar
TMTPE

SEQ ID NO: 2466701 - protein, 57 aa, Entamoeba dispar
TMTTYEKQRSKYFNNTPNNNTMEEEDYDDDDDDDDYSDGPLEHAPFGGKNDDMDIIY

SEQ ID NO: 2466702 - protein, 5 aa, Entamoeba dispar
TMTVN

SEQ ID NO: 2466703 - protein, 15 aa, Entamoeba dispar
TNAAKVSKTTTKSGA

SEQ ID NO: 2466704 - protein, 4 aa, Entamoeba dispar
TNAD

SEQ ID NO: 2466705 - protein, 10 aa, Entamoeba dispar
TNADPNDETN

SEQ ID NO: 2466706 - protein, 7 aa, Entamoeba dispar
TNAEEYR

SEQ ID NO: 2466707 - protein, 9 aa, Entamoeba dispar
TNAKNETEK

SEQ ID NO: 2466708 - protein, 7 aa, Entamoeba dispar
TNAPISL

SEQ ID NO: 2466709 - protein, 19 aa, Entamoeba dispar
TNARSSVAATFGDEPILGT

SEQ ID NO: 2466710 - protein, 4 aa, Entamoeba dispar
TNAS

SEQ ID NO: 2466711 - protein, 7 aa, Entamoeba dispar
TNATEVS

SEQ ID NO: 2466712 - protein, 5 aa, Entamoeba dispar
TNCDE

SEQ ID NO: 2466713 - protein, 6 aa, Entamoeba dispar
TNDCNN

SEQ ID NO: 2466714 - protein, 8 aa, Entamoeba dispar
TNDEEPMP

SEQ ID NO: 2466715 - protein, 5 aa, Entamoeba dispar
TNDEL

SEQ ID NO: 2466716 - protein, 9 aa, Entamoeba dispar
TNDEPDQTW

SEQ ID NO: 2466717 - protein, 8 aa, Entamoeba dispar
TNDEPSGY

SEQ ID NO: 2466718 - protein, 6 aa, Entamoeba dispar
TNDEQI

SEQ ID NO: 2466719 - protein, 11 aa, Entamoeba dispar
TNDEVEEYNSI

SEQ ID NO: 2466720 - protein, 4 aa, Entamoeba dispar
TNDF

SEQ ID NO: 2466721 - protein, 9 aa, Entamoeba dispar
TNDGKDMNK

SEQ ID NO: 2466722 - protein, 6 aa, Entamoeba dispar
TNDGTI

SEQ ID NO: 2466723 - protein, 6 aa, Entamoeba dispar
TNDKIT

SEQ ID NO: 2466724 - protein, 15 aa, Entamoeba dispar
TNDKPEKEDEVSSGA

SEQ ID NO: 2466725 - protein, 14 aa, Entamoeba dispar
TNDKPTVSKSPRTI

SEQ ID NO: 2466726 - protein, 5 aa, Entamoeba dispar
TNDKV

SEQ ID NO: 2466727 - protein, 7 aa, Entamoeba dispar
TNDMTEQ

SEQ ID NO: 2466728 - protein, 12 aa, Entamoeba dispar
TNDNDDSTDTED

SEQ ID NO: 2466729 - protein, 31 aa, Entamoeba dispar
TNDNPTVSKNPKVTSTNPFGESTTTDNTNPF

SEQ ID NO: 2466730 - protein, 4 aa, Entamoeba dispar
TNDP

SEQ ID NO: 2466731 - protein, 8 aa, Entamoeba dispar
TNDPNESV

SEQ ID NO: 2466732 - protein, 17 aa, Entamoeba dispar
TNDPQLDKKRHIGNDVC

SEQ ID NO: 2466733 - protein, 8 aa, Entamoeba dispar
TNDQTDKQ

SEQ ID NO: 2466734 - protein, 8 aa, Entamoeba dispar
TNDRKKKA

SEQ ID NO: 2466735 - protein, 16 aa, Entamoeba dispar
TNDRPKKLQIERNSKM

SEQ ID NO: 2466736 - protein, 6 aa, Entamoeba dispar
TNDSES

SEQ ID NO: 2466737 - protein, 5 aa, Entamoeba dispar
TNDSS

SEQ ID NO: 2466738 - protein, 4 aa, Entamoeba dispar
TNDT

SEQ ID NO: 2466739 - protein, 6 aa, Entamoeba dispar
TNDTIT

SEQ ID NO: 2466740 - protein, 42 aa, Entamoeba dispar
TNDTPVPAKSPKTVSHSQTNTVSTNPFGEPTTPQVDNTNPFL

SEQ ID NO: 2466741 - protein, 6 aa, Entamoeba dispar
TNDVEK

SEQ ID NO: 2466742 - protein, 8 aa, Entamoeba dispar
TNEAKETL

SEQ ID NO: 2466743 - protein, 4 aa, Entamoeba dispar
TNED

SEQ ID NO: 2466744 - protein, 5 aa, Entamoeba dispar
TNEDH

SEQ ID NO: 2466745 - protein, 5 aa, Entamoeba dispar
TNEDK

SEQ ID NO: 2466746 - protein, 19 aa, Entamoeba dispar
TNEDMESGKATGIRDAKET

SEQ ID NO: 2466747 - protein, 16 aa, Entamoeba dispar
TNEDVTEVQNIDNDYE

SEQ ID NO: 2466748 - protein, 7 aa, Entamoeba dispar
TNEEDID

SEQ ID NO: 2466749 - protein, 6 aa, Entamoeba dispar
TNEEEL

SEQ ID NO: 2466750 - protein, 5 aa, Entamoeba dispar
TNEEF

SEQ ID NO: 2466751 - protein, 7 aa, Entamoeba dispar
TNEEGNS

SEQ ID NO: 2466752 - protein, 5 aa, Entamoeba dispar
TNEEI

SEQ ID NO: 2466753 - protein, 9 aa, Entamoeba dispar
TNEEPVHKS

SEQ ID NO: 2466754 - protein, 11 aa, Entamoeba dispar
TNEEVVKPGEQ

SEQ ID NO: 2466755 - protein, 6 aa, Entamoeba dispar
TNEEYE

SEQ ID NO: 2466756 - protein, 10 aa, Entamoeba dispar
TNEGDCDKSW

SEQ ID NO: 2466757 - protein, 6 aa, Entamoeba dispar
TNEGKC

SEQ ID NO: 2466758 - protein, 8 aa, Entamoeba dispar
TNEGNEEY

SEQ ID NO: 2466759 - protein, 11 aa, Entamoeba dispar
TNEHNSIKTGT

SEQ ID NO: 2466760 - protein, 4 aa, Entamoeba dispar
TNEI

SEQ ID NO: 2466761 - protein, 17 aa, Entamoeba dispar
TNEIGKESTKINQNKEI

SEQ ID NO: 2466762 - protein, 9 aa, Entamoeba dispar
TNEIKESYQ

SEQ ID NO: 2466763 - protein, 7 aa, Entamoeba dispar
TNEKGDE

SEQ ID NO: 2466764 - protein, 5 aa, Entamoeba dispar
TNEKM

SEQ ID NO: 2466765 - protein, 11 aa, Entamoeba dispar
TNEKTKEFEKY

SEQ ID NO: 2466766 - protein, 4 aa, Entamoeba dispar
TNEL

SEQ ID NO: 2466767 - protein, 6 aa, Entamoeba dispar
TNELSE

SEQ ID NO: 2466768 - protein, 4 aa, Entamoeba dispar
TNEN

SEQ ID NO: 2466769 - protein, 8 aa, Entamoeba dispar
TNENDKPI

SEQ ID NO: 2466770 - protein, 11 aa, Entamoeba dispar
TNENEDNGNLN

SEQ ID NO: 2466771 - protein, 9 aa, Entamoeba dispar
TNENNNDYQ

SEQ ID NO: 2466772 - protein, 11 aa, Entamoeba dispar
TNENNTKSSLI

SEQ ID NO: 2466773 - protein, 12 aa, Entamoeba dispar
TNENSYNQGSWE

SEQ ID NO: 2466774 - protein, 7 aa, Entamoeba dispar
TNEPIQQ

SEQ ID NO: 2466775 - protein, 7 aa, Entamoeba dispar
TNEPNEN

SEQ ID NO: 2466776 - protein, 19 aa, Entamoeba dispar
TNEQFRQEEVSQSDDKKFA

SEQ ID NO: 2466777 - protein, 19 aa, Entamoeba dispar
TNEQIEEDRKKLFEQCLEM

SEQ ID NO: 2466778 - protein, 8 aa, Entamoeba dispar
TNEQQDSS

SEQ ID NO: 2466779 - protein, 6 aa, Entamoeba dispar
TNEQSI

SEQ ID NO: 2466780 - protein, 4 aa, Entamoeba dispar
TNER

SEQ ID NO: 2466781 - protein, 7 aa, Entamoeba dispar
TNERDEN

SEQ ID NO: 2466782 - protein, 7 aa, Entamoeba dispar
TNERNIA

SEQ ID NO: 2466783 - protein, 5 aa, Entamoeba dispar
TNESC

SEQ ID NO: 2466784 - protein, 9 aa, Entamoeba dispar
TNESKTPAL

SEQ ID NO: 2466785 - protein, 9 aa, Entamoeba dispar
TNESKTPSL

SEQ ID NO: 2466786 - protein, 8 aa, Entamoeba dispar
TNESNNMV

SEQ ID NO: 2466787 - protein, 10 aa, Entamoeba dispar
TNESVISSTQ

SEQ ID NO: 2466788 - protein, 7 aa, Entamoeba dispar
TNETDPA

SEQ ID NO: 2466789 - protein, 9 aa, Entamoeba dispar
TNETGDLES

SEQ ID NO: 2466790 - protein, 12 aa, Entamoeba dispar
TNEVHPSPSIKA

SEQ ID NO: 2466791 - protein, 12 aa, Entamoeba dispar
TNEVNPSPNIKS

SEQ ID NO: 2466792 - protein, 6 aa, Entamoeba dispar
TNEVRG

SEQ ID NO: 2466793 - protein, 13 aa, Entamoeba dispar
TNEVSFKKENESF

SEQ ID NO: 2466794 - protein, 6 aa, Entamoeba dispar
TNEYEQ

SEQ ID NO: 2466795 - protein, 6 aa, Entamoeba dispar
TNFEKE

SEQ ID NO: 2466796 - protein, 4 aa, Entamoeba dispar
TNFQ

SEQ ID NO: 2466797 - protein, 4 aa, Entamoeba dispar
TNFT

SEQ ID NO: 2466798 - protein, 5 aa, Entamoeba dispar
TNFTV

SEQ ID NO: 2466799 - protein, 4 aa, Entamoeba dispar
TNGA

SEQ ID NO: 2466800 - protein, 5 aa, Entamoeba dispar
TNGDS

SEQ ID NO: 2466801 - protein, 8 aa, Entamoeba dispar
TNGDSVRT

SEQ ID NO: 2466802 - protein, 7 aa, Entamoeba dispar
TNGDTTM

SEQ ID NO: 2466803 - protein, 9 aa, Entamoeba dispar
TNGEFNQGN

SEQ ID NO: 2466804 - protein, 13 aa, Entamoeba dispar
TNGETKIKELEDE

SEQ ID NO: 2466805 - protein, 4 aa, Entamoeba dispar
TNGI

SEQ ID NO: 2466806 - protein, 7 aa, Entamoeba dispar
TNGITGT

SEQ ID NO: 2466807 - protein, 14 aa, Entamoeba dispar
TNGKFITNDRKKES

SEQ ID NO: 2466808 - protein, 8 aa, Entamoeba dispar
TNGNKFGG

SEQ ID NO: 2466809 - protein, 9 aa, Entamoeba dispar
TNGNKFGGY

SEQ ID NO: 2466810 - protein, 4 aa, Entamoeba dispar
TNGP

SEQ ID NO: 2466811 - protein, 23 aa, Entamoeba dispar
TNGPKLDSIRTTGSSTSPKLSQA

SEQ ID NO: 2466812 - protein, 13 aa, Entamoeba dispar
TNGRSVQAATSHH

SEQ ID NO: 2466813 - protein, 19 aa, Entamoeba dispar
TNGSEKYGRVTSRANKGDG

SEQ ID NO: 2466814 - protein, 7 aa, Entamoeba dispar
TNGSGRY

SEQ ID NO: 2466815 - protein, 16 aa, Entamoeba dispar
TNGTEEIDISQDKNRE

SEQ ID NO: 2466816 - protein, 9 aa, Entamoeba dispar
TNGTSNPNQ

SEQ ID NO: 2466817 - protein, 5 aa, Entamoeba dispar
TNHPN

SEQ ID NO: 2466818 - protein, 6 aa, Entamoeba dispar
TNHSDL

SEQ ID NO: 2466819 - protein, 14 aa, Entamoeba dispar
TNHSTKPRTRPMSP

SEQ ID NO: 2466820 - protein, 10 aa, Entamoeba dispar
TNHSYSAPVV

SEQ ID NO: 2466821 - protein, 12 aa, Entamoeba dispar
TNIDSTGQSYYG

SEQ ID NO: 2466822 - protein, 4 aa, Entamoeba dispar
TNIE

SEQ ID NO: 2466823 - protein, 9 aa, Entamoeba dispar
TNIETTPRR

SEQ ID NO: 2466824 - protein, 4 aa, Entamoeba dispar
TNIK

SEQ ID NO: 2466825 - protein, 15 aa, Entamoeba dispar
TNIKDYNKRNDPTTK

SEQ ID NO: 2466826 - protein, 6 aa, Entamoeba dispar
TNIKGR

SEQ ID NO: 2466827 - protein, 8 aa, Entamoeba dispar
TNINQPDV

SEQ ID NO: 2466828 - protein, 27 aa, Entamoeba dispar
TNINTQNKINTSSQEKTTKSGKENKNI

SEQ ID NO: 2466829 - protein, 4 aa, Entamoeba dispar
TNIP

SEQ ID NO: 2466830 - protein, 12 aa, Entamoeba dispar
TNIPENDPENQF

SEQ ID NO: 2466831 - protein, 21 aa, Entamoeba dispar
TNIQDNSNTNTISLNGASGVT

SEQ ID NO: 2466832 - protein, 5 aa, Entamoeba dispar
TNIQN

SEQ ID NO: 2466833 - protein, 9 aa, Entamoeba dispar
TNISNDPTF

SEQ ID NO: 2466834 - protein, 12 aa, Entamoeba dispar
TNISNEQNEKAP

SEQ ID NO: 2466835 - protein, 5 aa, Entamoeba dispar
TNITN

SEQ ID NO: 2466836 - protein, 17 aa, Entamoeba dispar
TNKDNSVPQVDTTKPSW

SEQ ID NO: 2466837 - protein, 4 aa, Entamoeba dispar
TNKE

SEQ ID NO: 2466838 - protein, 10 aa, Entamoeba dispar
TNKEEAVPND

SEQ ID NO: 2466839 - protein, 8 aa, Entamoeba dispar
TNKEGKIT

SEQ ID NO: 2466840 - protein, 6 aa, Entamoeba dispar
TNKEIK

SEQ ID NO: 2466841 - protein, 8 aa, Entamoeba dispar
TNKEQSEK

SEQ ID NO: 2466842 - protein, 11 aa, Entamoeba dispar
TNKETGKSRGF

SEQ ID NO: 2466843 - protein, 13 aa, Entamoeba dispar
TNKGSGLYTTPSS

SEQ ID NO: 2466844 - protein, 8 aa, Entamoeba dispar
TNKGSTNY

SEQ ID NO: 2466845 - protein, 8 aa, Entamoeba dispar
TNKIDIES

SEQ ID NO: 2466846 - protein, 16 aa, Entamoeba dispar
TNKILSSQLSNEELEK

SEQ ID NO: 2466847 - protein, 7 aa, Entamoeba dispar
TNKINEN

SEQ ID NO: 2466848 - protein, 7 aa, Entamoeba dispar
TNKINKN

SEQ ID NO: 2466849 - protein, 11 aa, Entamoeba dispar
TNKITKSFTGC

SEQ ID NO: 2466850 - protein, 8 aa, Entamoeba dispar
TNKKHPTK

SEQ ID NO: 2466851 - protein, 6 aa, Entamoeba dispar
TNKKSY

SEQ ID NO: 2466852 - protein, 4 aa, Entamoeba dispar
TNKL

SEQ ID NO: 2466853 - protein, 4 aa, Entamoeba dispar
TNKN

SEQ ID NO: 2466854 - protein, 7 aa, Entamoeba dispar
TNKNDPK

SEQ ID NO: 2466855 - protein, 5 aa, Entamoeba dispar
TNKNG

SEQ ID NO: 2466856 - protein, 5 aa, Entamoeba dispar
TNKNI

SEQ ID NO: 2466857 - protein, 7 aa, Entamoeba dispar
TNKNKFG

SEQ ID NO: 2466858 - protein, 8 aa, Entamoeba dispar
TNKNKGMG

SEQ ID NO: 2466859 - protein, 6 aa, Entamoeba dispar
TNKPID

SEQ ID NO: 2466860 - protein, 15 aa, Entamoeba dispar
TNKPKTQQSDEPSVS

SEQ ID NO: 2466861 - protein, 13 aa, Entamoeba dispar
TNKPSITNNYEEK

SEQ ID NO: 2466862 - protein, 7 aa, Entamoeba dispar
TNKQPNY

SEQ ID NO: 2466863 - protein, 6 aa, Entamoeba dispar
TNKRRG

SEQ ID NO: 2466864 - protein, 5 aa, Entamoeba dispar
TNKRS

SEQ ID NO: 2466865 - protein, 7 aa, Entamoeba dispar
TNKSLRR

SEQ ID NO: 2466866 - protein, 7 aa, Entamoeba dispar
TNKSNYI

SEQ ID NO: 2466867 - protein, 10 aa, Entamoeba dispar
TNKTDSRIKN

SEQ ID NO: 2466868 - protein, 15 aa, Entamoeba dispar
TNKTIKLGQSGYKER

SEQ ID NO: 2466869 - protein, 7 aa, Entamoeba dispar
TNKTPFS

SEQ ID NO: 2466870 - protein, 6 aa, Entamoeba dispar
TNKYLR

SEQ ID NO: 2466871 - protein, 5 aa, Entamoeba dispar
TNKYR

SEQ ID NO: 2466872 - protein, 7 aa, Entamoeba dispar
TNLDREG

SEQ ID NO: 2466873 - protein, 6 aa, Entamoeba dispar
TNLERI

SEQ ID NO: 2466874 - protein, 5 aa, Entamoeba dispar
TNLGK

SEQ ID NO: 2466875 - protein, 40 aa, Entamoeba dispar
TNLKQSKESYSDIKRQLEKEKTMGQRQSDTIEDLNENDKE

SEQ ID NO: 2466876 - protein, 10 aa, Entamoeba dispar
TNLQGQQKEF

SEQ ID NO: 2466877 - protein, 11 aa, Entamoeba dispar
TNLSGGEKTLS

SEQ ID NO: 2466878 - protein, 11 aa, Entamoeba dispar
TNLTNEMENNI

SEQ ID NO: 2466879 - protein, 6 aa, Entamoeba dispar
TNLTVP

SEQ ID NO: 2466880 - protein, 6 aa, Entamoeba dispar
TNMRPN

SEQ ID NO: 2466881 - protein, 4 aa, Entamoeba dispar
TNMS

SEQ ID NO: 2466882 - protein, 13 aa, Entamoeba dispar
TNNDGTLEKNQST

SEQ ID NO: 2466883 - protein, 7 aa, Entamoeba dispar
TNNDPIK

SEQ ID NO: 2466884 - protein, 21 aa, Entamoeba dispar
TNNDPQKKHGRKEKKDEEFTV

SEQ ID NO: 2466885 - protein, 10 aa, Entamoeba dispar
TNNEERKKTC

SEQ ID NO: 2466886 - protein, 7 aa, Entamoeba dispar
TNNERGK

SEQ ID NO: 2466887 - protein, 37 aa, Entamoeba dispar
TNNERTITHQEDKRCQKIDKNKNLTTSIKKNSNRECS

SEQ ID NO: 2466888 - protein, 7 aa, Entamoeba dispar
TNNESVV

SEQ ID NO: 2466889 - protein, 12 aa, Entamoeba dispar
TNNETMEKTANA

SEQ ID NO: 2466890 - protein, 5 aa, Entamoeba dispar
TNNFD

SEQ ID NO: 2466891 - protein, 4 aa, Entamoeba dispar
TNNG

SEQ ID NO: 2466892 - protein, 19 aa, Entamoeba dispar
TNNGAGNSWANGYYTTEKM

SEQ ID NO: 2466893 - protein, 11 aa, Entamoeba dispar
TNNGSRKQQLQ

SEQ ID NO: 2466894 - protein, 6 aa, Entamoeba dispar
TNNIEN

SEQ ID NO: 2466895 - protein, 8 aa, Entamoeba dispar
TNNIGESP

SEQ ID NO: 2466896 - protein, 5 aa, Entamoeba dispar
TNNKE

SEQ ID NO: 2466897 - protein, 9 aa, Entamoeba dispar
TNNKEKIDE

SEQ ID NO: 2466898 - protein, 10 aa, Entamoeba dispar
TNNKKDDEID

SEQ ID NO: 2466899 - protein, 16 aa, Entamoeba dispar
TNNKNMNNTPQNTVES

SEQ ID NO: 2466900 - protein, 5 aa, Entamoeba dispar
TNNKR

SEQ ID NO: 2466901 - protein, 10 aa, Entamoeba dispar
TNNKRTKTKP

SEQ ID NO: 2466902 - protein, 6 aa, Entamoeba dispar
TNNKTR

SEQ ID NO: 2466903 - protein, 7 aa, Entamoeba dispar
TNNNKGK

SEQ ID NO: 2466904 - protein, 5 aa, Entamoeba dispar
TNNNP

SEQ ID NO: 2466905 - protein, 6 aa, Entamoeba dispar
TNNNTN

SEQ ID NO: 2466906 - protein, 10 aa, Entamoeba dispar
TNNPKYPVPS

SEQ ID NO: 2466907 - protein, 7 aa, Entamoeba dispar
TNNPTAV

SEQ ID NO: 2466908 - protein, 5 aa, Entamoeba dispar
TNNPY

SEQ ID NO: 2466909 - protein, 4 aa, Entamoeba dispar
TNNQ

SEQ ID NO: 2466910 - protein, 12 aa, Entamoeba dispar
TNNQETNSWRKT

SEQ ID NO: 2466911 - protein, 9 aa, Entamoeba dispar
TNNQRLQTT

SEQ ID NO: 2466912 - protein, 5 aa, Entamoeba dispar
TNNQY

SEQ ID NO: 2466913 - protein, 22 aa, Entamoeba dispar
TNNRIEENKEINRITTEEKEEN

SEQ ID NO: 2466914 - protein, 23 aa, Entamoeba dispar
TNNRIEGNKEINRITTEEKEEKG

SEQ ID NO: 2466915 - protein, 10 aa, Entamoeba dispar
TNNRSGTKKI

SEQ ID NO: 2466916 - protein, 11 aa, Entamoeba dispar
TNNRTEENKEI

SEQ ID NO: 2466917 - protein, 23 aa, Entamoeba dispar
TNNRTEENKEINRITTEEKEEKG

SEQ ID NO: 2466918 - protein, 5 aa, Entamoeba dispar
TNNSD

SEQ ID NO: 2466919 - protein, 7 aa, Entamoeba dispar
TNNSITS

SEQ ID NO: 2466920 - protein, 7 aa, Entamoeba dispar
TNNSNKK

SEQ ID NO: 2466921 - protein, 10 aa, Entamoeba dispar
TNNSPEEITK

SEQ ID NO: 2466922 - protein, 7 aa, Entamoeba dispar
TNNSQDQ

SEQ ID NO: 2466923 - protein, 9 aa, Entamoeba dispar
TNNSTETIY

SEQ ID NO: 2466924 - protein, 7 aa, Entamoeba dispar
TNNTTDI

SEQ ID NO: 2466925 - protein, 12 aa, Entamoeba dispar
TNNYRPKGNAYL

SEQ ID NO: 2466926 - protein, 7 aa, Entamoeba dispar
TNPAISR

SEQ ID NO: 2466927 - protein, 10 aa, Entamoeba dispar
TNPASEKTKH

SEQ ID NO: 2466928 - protein, 10 aa, Entamoeba dispar
TNPDQAYTNA

SEQ ID NO: 2466929 - protein, 9 aa, Entamoeba dispar
TNPEDDSIN

SEQ ID NO: 2466930 - protein, 7 aa, Entamoeba dispar
TNPEQST

SEQ ID NO: 2466931 - protein, 10 aa, Entamoeba dispar
TNPFDNGPTM

SEQ ID NO: 2466932 - protein, 7 aa, Entamoeba dispar
TNPFNQP

SEQ ID NO: 2466933 - protein, 13 aa, Entamoeba dispar
TNPFPVPNSQVTQ

SEQ ID NO: 2466934 - protein, 41 aa, Entamoeba dispar
TNPFSQTNTSIINQTNTSIINQTNTNGNNQNKDRNRKEVNG

SEQ ID NO: 2466935 - protein, 7 aa, Entamoeba dispar
TNPIGES

SEQ ID NO: 2466936 - protein, 11 aa, Entamoeba dispar
TNPIPPIENNP

SEQ ID NO: 2466937 - protein, 9 aa, Entamoeba dispar
TNPKTTETV

SEQ ID NO: 2466938 - protein, 6 aa, Entamoeba dispar
TNPMQN

SEQ ID NO: 2466939 - protein, 4 aa, Entamoeba dispar
TNPN

SEQ ID NO: 2466940 - protein, 23 aa, Entamoeba dispar
TNPNCPKPGCYKSYGSAKEDNPI

SEQ ID NO: 2466941 - protein, 7 aa, Entamoeba dispar
TNPNDGG

SEQ ID NO: 2466942 - protein, 5 aa, Entamoeba dispar
TNPNL

SEQ ID NO: 2466943 - protein, 6 aa, Entamoeba dispar
TNPNNE

SEQ ID NO: 2466944 - protein, 6 aa, Entamoeba dispar
TNPPKV

SEQ ID NO: 2466945 - protein, 15 aa, Entamoeba dispar
TNPPPPPQKPSQQFQ

SEQ ID NO: 2466946 - protein, 13 aa, Entamoeba dispar
TNPPPQKPSQQFQ

SEQ ID NO: 2466947 - protein, 9 aa, Entamoeba dispar
TNPQNGVSS

SEQ ID NO: 2466948 - protein, 12 aa, Entamoeba dispar
TNPQTINDLAIK

SEQ ID NO: 2466949 - protein, 12 aa, Entamoeba dispar
TNPQTVTELTNK

SEQ ID NO: 2466950 - protein, 9 aa, Entamoeba dispar
TNPQYKSVE

SEQ ID NO: 2466951 - protein, 11 aa, Entamoeba dispar
TNPRRAETMKR

SEQ ID NO: 2466952 - protein, 9 aa, Entamoeba dispar
TNPSYGTMD

SEQ ID NO: 2466953 - protein, 5 aa, Entamoeba dispar
TNPTD

SEQ ID NO: 2466954 - protein, 5 aa, Entamoeba dispar
TNPTT

SEQ ID NO: 2466955 - protein, 4 aa, Entamoeba dispar
TNPY

SEQ ID NO: 2466956 - protein, 4 aa, Entamoeba dispar
TNQG

SEQ ID NO: 2466957 - protein, 16 aa, Entamoeba dispar
TNQGENETVAKAREHH

SEQ ID NO: 2466958 - protein, 6 aa, Entamoeba dispar
TNQITE

SEQ ID NO: 2466959 - protein, 13 aa, Entamoeba dispar
TNQKDIQKTIDNI

SEQ ID NO: 2466960 - protein, 8 aa, Entamoeba dispar
TNQKKKKE

SEQ ID NO: 2466961 - protein, 7 aa, Entamoeba dispar
TNQLNTI

SEQ ID NO: 2466962 - protein, 4 aa, Entamoeba dispar
TNQN

SEQ ID NO: 2466963 - protein, 9 aa, Entamoeba dispar
TNQNKTNDI

SEQ ID NO: 2466964 - protein, 8 aa, Entamoeba dispar
TNQNSTFK

SEQ ID NO: 2466965 - protein, 7 aa, Entamoeba dispar
TNQPEIN

SEQ ID NO: 2466966 - protein, 6 aa, Entamoeba dispar
TNQPND

SEQ ID NO: 2466967 - protein, 8 aa, Entamoeba dispar
TNQQMKKE

SEQ ID NO: 2466968 - protein, 12 aa, Entamoeba dispar
TNQQNSEQPLLD

SEQ ID NO: 2466969 - protein, 33 aa, Entamoeba dispar
TNQQVNPNTNNSQFNSFTPSQPFGLQQKTNTVA

SEQ ID NO: 2466970 - protein, 6 aa, Entamoeba dispar
TNQREM

SEQ ID NO: 2466971 - protein, 7 aa, Entamoeba dispar
TNQRETT

SEQ ID NO: 2466972 - protein, 5 aa, Entamoeba dispar
TNQRL

SEQ ID NO: 2466973 - protein, 11 aa, Entamoeba dispar
TNQSKRPGSFV

SEQ ID NO: 2466974 - protein, 17 aa, Entamoeba dispar
TNQSNQQLQSTEGSLSI

SEQ ID NO: 2466975 - protein, 5 aa, Entamoeba dispar
TNQSQ

SEQ ID NO: 2466976 - protein, 9 aa, Entamoeba dispar
TNQSTLSVN

SEQ ID NO: 2466977 - protein, 17 aa, Entamoeba dispar
TNQSTQQQPIQQPSNSA

SEQ ID NO: 2466978 - protein, 15 aa, Entamoeba dispar
TNQTEECCSLITELS

SEQ ID NO: 2466979 - protein, 6 aa, Entamoeba dispar
TNQTRY

SEQ ID NO: 2466980 - protein, 5 aa, Entamoeba dispar
TNQTS

SEQ ID NO: 2466981 - protein, 10 aa, Entamoeba dispar
TNQYTGTNGI

SEQ ID NO: 2466982 - protein, 4 aa, Entamoeba dispar
TNRA

SEQ ID NO: 2466983 - protein, 6 aa, Entamoeba dispar
TNRDGF

SEQ ID NO: 2466984 - protein, 8 aa, Entamoeba dispar
TNREEGKL

SEQ ID NO: 2466985 - protein, 12 aa, Entamoeba dispar
TNREQTEHLQTA

SEQ ID NO: 2466986 - protein, 11 aa, Entamoeba dispar
TNRGNKDNLKS

SEQ ID NO: 2466987 - protein, 14 aa, Entamoeba dispar
TNRGVSKTDEENFE

SEQ ID NO: 2466988 - protein, 6 aa, Entamoeba dispar
TNRINE

SEQ ID NO: 2466989 - protein, 7 aa, Entamoeba dispar
TNRISNV

SEQ ID NO: 2466990 - protein, 15 aa, Entamoeba dispar
TNRNEQDVTSKNNGM

SEQ ID NO: 2466991 - protein, 23 aa, Entamoeba dispar
TNRPARKQSDGYVPYTPTRSGDY

SEQ ID NO: 2466992 - protein, 6 aa, Entamoeba dispar
TNRPDC

SEQ ID NO: 2466993 - protein, 6 aa, Entamoeba dispar
TNRPDL

SEQ ID NO: 2466994 - protein, 11 aa, Entamoeba dispar
TNRPDSLDPAL

SEQ ID NO: 2466995 - protein, 5 aa, Entamoeba dispar
TNRPF

SEQ ID NO: 2466996 - protein, 8 aa, Entamoeba dispar
TNRPNAID

SEQ ID NO: 2466997 - protein, 7 aa, Entamoeba dispar
TNRPNTI

SEQ ID NO: 2466998 - protein, 13 aa, Entamoeba dispar
TNRPQEIDEAARR

SEQ ID NO: 2466999 - protein, 13 aa, Entamoeba dispar
TNRQETCKKGEVD

SEQ ID NO: 2467000 - protein, 9 aa, Entamoeba dispar
TNRSGTMEP

SEQ ID NO: 2467001 - protein, 7 aa, Entamoeba dispar
TNRSTGE

SEQ ID NO: 2467002 - protein, 4 aa, Entamoeba dispar
TNRT

SEQ ID NO: 2467003 - protein, 5 aa, Entamoeba dispar
TNRYY

SEQ ID NO: 2467004 - protein, 10 aa, Entamoeba dispar
TNSEAQPEII

SEQ ID NO: 2467005 - protein, 5 aa, Entamoeba dispar
TNSEL

SEQ ID NO: 2467006 - protein, 8 aa, Entamoeba dispar
TNSEVQLP

SEQ ID NO: 2467007 - protein, 8 aa, Entamoeba dispar
TNSFPDSY

SEQ ID NO: 2467008 - protein, 9 aa, Entamoeba dispar
TNSGDLHPR

SEQ ID NO: 2467009 - protein, 7 aa, Entamoeba dispar
TNSIDSN

SEQ ID NO: 2467010 - protein, 18 aa, Entamoeba dispar
TNSIPEAEKQSAFVMSSL

SEQ ID NO: 2467011 - protein, 8 aa, Entamoeba dispar
TNSIPPKF

SEQ ID NO: 2467012 - protein, 7 aa, Entamoeba dispar
TNSIQKD

SEQ ID NO: 2467013 - protein, 9 aa, Entamoeba dispar
TNSIQQNAE

SEQ ID NO: 2467014 - protein, 9 aa, Entamoeba dispar
TNSKGKERY

SEQ ID NO: 2467015 - protein, 27 aa, Entamoeba dispar
TNSKTPQTQTPQENSQKASSPIQPPKR

SEQ ID NO: 2467016 - protein, 4 aa, Entamoeba dispar
TNSL

SEQ ID NO: 2467017 - protein, 25 aa, Entamoeba dispar
TNSLPRNDPRKKAYSSVKGQLSKLK

SEQ ID NO: 2467018 - protein, 18 aa, Entamoeba dispar
TNSLSQRELKQESKSWEA

SEQ ID NO: 2467019 - protein, 19 aa, Entamoeba dispar
TNSNETDEIDENTENQNQI

SEQ ID NO: 2467020 - protein, 15 aa, Entamoeba dispar
TNSNVRSQMDAVKKS

SEQ ID NO: 2467021 - protein, 44 aa, Entamoeba dispar
TNSPDQTSNGAREIEMSSPNQSNEVSVPSPSRITNNHEQISESN

SEQ ID NO: 2467022 - protein, 5 aa, Entamoeba dispar
TNSPV

SEQ ID NO: 2467023 - protein, 17 aa, Entamoeba dispar
TNSPYRHDEKTEIEEQT

SEQ ID NO: 2467024 - protein, 9 aa, Entamoeba dispar
TNSQQSLEQ

SEQ ID NO: 2467025 - protein, 14 aa, Entamoeba dispar
TNSRQSEIESSIET

SEQ ID NO: 2467026 - protein, 9 aa, Entamoeba dispar
TNSSHTHAG

SEQ ID NO: 2467027 - protein, 5 aa, Entamoeba dispar
TNSSI

SEQ ID NO: 2467028 - protein, 10 aa, Entamoeba dispar
TNSSQTMKEG

SEQ ID NO: 2467029 - protein, 8 aa, Entamoeba dispar
TNSTGDTA

SEQ ID NO: 2467030 - protein, 8 aa, Entamoeba dispar
TNSTGETP

SEQ ID NO: 2467031 - protein, 19 aa, Entamoeba dispar
TNSTQTIFSGQTSTTTTHS

SEQ ID NO: 2467032 - protein, 10 aa, Entamoeba dispar
TNSVETTNKR

SEQ ID NO: 2467033 - protein, 6 aa, Entamoeba dispar
TNSVGG

SEQ ID NO: 2467034 - protein, 5 aa, Entamoeba dispar
TNSVK

SEQ ID NO: 2467035 - protein, 7 aa, Entamoeba dispar
TNSVPEV

SEQ ID NO: 2467036 - protein, 9 aa, Entamoeba dispar
TNSVTDLSP

SEQ ID NO: 2467037 - protein, 5 aa, Entamoeba dispar
TNSYP

SEQ ID NO: 2467038 - protein, 11 aa, Entamoeba dispar
TNTDDEKKEDI

SEQ ID NO: 2467039 - protein, 8 aa, Entamoeba dispar
TNTDGMEV

SEQ ID NO: 2467040 - protein, 17 aa, Entamoeba dispar
TNTDGYSTIKSLTAIEW

SEQ ID NO: 2467041 - protein, 5 aa, Entamoeba dispar
TNTDS

SEQ ID NO: 2467042 - protein, 7 aa, Entamoeba dispar
TNTEIPN

SEQ ID NO: 2467043 - protein, 19 aa, Entamoeba dispar
TNTEPTTMSATLTNKSPIN

SEQ ID NO: 2467044 - protein, 7 aa, Entamoeba dispar
TNTHQSK

SEQ ID NO: 2467045 - protein, 6 aa, Entamoeba dispar
TNTIDK

SEQ ID NO: 2467046 - protein, 4 aa, Entamoeba dispar
TNTK

SEQ ID NO: 2467047 - protein, 7 aa, Entamoeba dispar
TNTKKIK

SEQ ID NO: 2467048 - protein, 9 aa, Entamoeba dispar
TNTKRNTYC

SEQ ID NO: 2467049 - protein, 7 aa, Entamoeba dispar
TNTKYSL

SEQ ID NO: 2467050 - protein, 4 aa, Entamoeba dispar
TNTL

SEQ ID NO: 2467051 - protein, 18 aa, Entamoeba dispar
TNTLPDRYLTSSGEVSVV

SEQ ID NO: 2467052 - protein, 8 aa, Entamoeba dispar
TNTNNNEI

SEQ ID NO: 2467053 - protein, 9 aa, Entamoeba dispar
TNTPDGSSY

SEQ ID NO: 2467054 - protein, 12 aa, Entamoeba dispar
TNTPITYEYFDT

SEQ ID NO: 2467055 - protein, 6 aa, Entamoeba dispar
TNTPQL

SEQ ID NO: 2467056 - protein, 7 aa, Entamoeba dispar
TNTRRKI

SEQ ID NO: 2467057 - protein, 13 aa, Entamoeba dispar
TNTRTVVTDRPKE

SEQ ID NO: 2467058 - protein, 17 aa, Entamoeba dispar
TNTSAGVKKAGRANKIE

SEQ ID NO: 2467059 - protein, 10 aa, Entamoeba dispar
TNTSNSQLTN

SEQ ID NO: 2467060 - protein, 11 aa, Entamoeba dispar
TNTSTSGPITV

SEQ ID NO: 2467061 - protein, 8 aa, Entamoeba dispar
TNTTGTQS

SEQ ID NO: 2467062 - protein, 5 aa, Entamoeba dispar
TNTTI

SEQ ID NO: 2467063 - protein, 5 aa, Entamoeba dispar
TNTTL

SEQ ID NO: 2467064 - protein, 7 aa, Entamoeba dispar
TNTTLGS

SEQ ID NO: 2467065 - protein, 10 aa, Entamoeba dispar
TNTTNDRRNT

SEQ ID NO: 2467066 - protein, 14 aa, Entamoeba dispar
TNTVAEEKKSKSVN

SEQ ID NO: 2467067 - protein, 8 aa, Entamoeba dispar
TNTVQGQQ

SEQ ID NO: 2467068 - protein, 17 aa, Entamoeba dispar
TNTWNDKRASRFKKFSK

SEQ ID NO: 2467069 - protein, 10 aa, Entamoeba dispar
TNVDPSKPLA

SEQ ID NO: 2467070 - protein, 7 aa, Entamoeba dispar
TNVETEK

SEQ ID NO: 2467071 - protein, 18 aa, Entamoeba dispar
TNVGRNKSLGLKSEKISS

SEQ ID NO: 2467072 - protein, 4 aa, Entamoeba dispar
TNVK

SEQ ID NO: 2467073 - protein, 9 aa, Entamoeba dispar
TNVKGITNN

SEQ ID NO: 2467074 - protein, 8 aa, Entamoeba dispar
TNVPPPVP

SEQ ID NO: 2467075 - protein, 14 aa, Entamoeba dispar
TNVPTSSTTSNSKF

SEQ ID NO: 2467076 - protein, 14 aa, Entamoeba dispar
TNVQRGEAGGITQQ

SEQ ID NO: 2467077 - protein, 6 aa, Entamoeba dispar
TNVSNA

SEQ ID NO: 2467078 - protein, 5 aa, Entamoeba dispar
TNVSS

SEQ ID NO: 2467079 - protein, 6 aa, Entamoeba dispar
TNWSER

SEQ ID NO: 2467080 - protein, 7 aa, Entamoeba dispar
TNYDDKI

SEQ ID NO: 2467081 - protein, 33 aa, Entamoeba dispar
TNYESEDDQLISDDDDDCSTISMNDDSSTSISE

SEQ ID NO: 2467082 - protein, 5 aa, Entamoeba dispar
TNYET

SEQ ID NO: 2467083 - protein, 9 aa, Entamoeba dispar
TNYFNSTKE

SEQ ID NO: 2467084 - protein, 5 aa, Entamoeba dispar
TNYGR

SEQ ID NO: 2467085 - protein, 12 aa, Entamoeba dispar
TNYKSSKSIENA

SEQ ID NO: 2467086 - protein, 4 aa, Entamoeba dispar
TNYN

SEQ ID NO: 2467087 - protein, 5 aa, Entamoeba dispar
TNYPG

SEQ ID NO: 2467088 - protein, 12 aa, Entamoeba dispar
TNYQNQRQPQMS

SEQ ID NO: 2467089 - protein, 5 aa, Entamoeba dispar
TNYQS

SEQ ID NO: 2467090 - protein, 8 aa, Entamoeba dispar
TNYRTPLD

SEQ ID NO: 2467091 - protein, 7 aa, Entamoeba dispar
TNYSQKT

SEQ ID NO: 2467092 - protein, 6 aa, Entamoeba dispar
TNYTQQ

SEQ ID NO: 2467093 - protein, 6 aa, Entamoeba dispar
TPAAQL

SEQ ID NO: 2467094 - protein, 10 aa, Entamoeba dispar
TPAGENPVKC

SEQ ID NO: 2467095 - protein, 9 aa, Entamoeba dispar
TPAHDPNDY

SEQ ID NO: 2467096 - protein, 6 aa, Entamoeba dispar
TPALSR

SEQ ID NO: 2467097 - protein, 12 aa, Entamoeba dispar
TPANSVNSQVKE

SEQ ID NO: 2467098 - protein, 5 aa, Entamoeba dispar
TPAPY

SEQ ID NO: 2467099 - protein, 4 aa, Entamoeba dispar
TPAQ

SEQ ID NO: 2467100 - protein, 6 aa, Entamoeba dispar
TPAQLQ

SEQ ID NO: 2467101 - protein, 20 aa, Entamoeba dispar
TPAQNAVKKTRRGHAQDGGA

SEQ ID NO: 2467102 - protein, 4 aa, Entamoeba dispar
TPAS

SEQ ID NO: 2467103 - protein, 8 aa, Entamoeba dispar
TPATLTKG

SEQ ID NO: 2467104 - protein, 4 aa, Entamoeba dispar
TPCG

SEQ ID NO: 2467105 - protein, 6 aa, Entamoeba dispar
TPCGSG

SEQ ID NO: 2467106 - protein, 14 aa, Entamoeba dispar
TPCPKTPNMPSSPF

SEQ ID NO: 2467107 - protein, 14 aa, Entamoeba dispar
TPCRPISSPQDEKD

SEQ ID NO: 2467108 - protein, 4 aa, Entamoeba dispar
TPCT

SEQ ID NO: 2467109 - protein, 6 aa, Entamoeba dispar
TPCTPK

SEQ ID NO: 2467110 - protein, 21 aa, Entamoeba dispar
TPDCPPQLPHSSNNQQEEPPV

SEQ ID NO: 2467111 - protein, 4 aa, Entamoeba dispar
TPDE

SEQ ID NO: 2467112 - protein, 10 aa, Entamoeba dispar
TPDEKTYYSN

SEQ ID NO: 2467113 - protein, 6 aa, Entamoeba dispar
TPDETS

SEQ ID NO: 2467114 - protein, 35 aa, Entamoeba dispar
TPDFTKASKLNSKINELEKKNNNAIHKKEELENEI

SEQ ID NO: 2467115 - protein, 4 aa, Entamoeba dispar
TPDG

SEQ ID NO: 2467116 - protein, 6 aa, Entamoeba dispar
TPDGAP

SEQ ID NO: 2467117 - protein, 15 aa, Entamoeba dispar
TPDGKDINQTETIKH

SEQ ID NO: 2467118 - protein, 8 aa, Entamoeba dispar
TPDGNQDM

SEQ ID NO: 2467119 - protein, 4 aa, Entamoeba dispar
TPDL

SEQ ID NO: 2467120 - protein, 5 aa, Entamoeba dispar
TPDNK

SEQ ID NO: 2467121 - protein, 10 aa, Entamoeba dispar
TPDNPKVSKN

SEQ ID NO: 2467122 - protein, 25 aa, Entamoeba dispar
TPDQIAASRENKQPSPWRDRSVEEN

SEQ ID NO: 2467123 - protein, 13 aa, Entamoeba dispar
TPDSSASLLTPAD

SEQ ID NO: 2467124 - protein, 4 aa, Entamoeba dispar
TPDT

SEQ ID NO: 2467125 - protein, 7 aa, Entamoeba dispar
TPDTIPV

SEQ ID NO: 2467126 - protein, 7 aa, Entamoeba dispar
TPDTPEL

SEQ ID NO: 2467127 - protein, 19 aa, Entamoeba dispar
TPDWGSSAAQDGFSQHSNG

SEQ ID NO: 2467128 - protein, 6 aa, Entamoeba dispar
TPEAEK

SEQ ID NO: 2467129 - protein, 7 aa, Entamoeba dispar
TPEAEKQ

SEQ ID NO: 2467130 - protein, 16 aa, Entamoeba dispar
TPEALSFGGGTGHPSL

SEQ ID NO: 2467131 - protein, 16 aa, Entamoeba dispar
TPEAPNKKDEQKRQYY

SEQ ID NO: 2467132 - protein, 15 aa, Entamoeba dispar
TPEDAKKINEDEEGI

SEQ ID NO: 2467133 - protein, 10 aa, Entamoeba dispar
TPEDSNTYST

SEQ ID NO: 2467134 - protein, 14 aa, Entamoeba dispar
TPEEGPRTTQASYV

SEQ ID NO: 2467135 - protein, 8 aa, Entamoeba dispar
TPEERKPV

SEQ ID NO: 2467136 - protein, 6 aa, Entamoeba dispar
TPEEVS

SEQ ID NO: 2467137 - protein, 5 aa, Entamoeba dispar
TPEGA

SEQ ID NO: 2467138 - protein, 15 aa, Entamoeba dispar
TPEHWSNNTTGCKQF

SEQ ID NO: 2467139 - protein, 4 aa, Entamoeba dispar
TPEI

SEQ ID NO: 2467140 - protein, 5 aa, Entamoeba dispar
TPEIM

SEQ ID NO: 2467141 - protein, 4 aa, Entamoeba dispar
TPEK

SEQ ID NO: 2467142 - protein, 21 aa, Entamoeba dispar
TPEKAKAKATAKWSKLDEDKM

SEQ ID NO: 2467143 - protein, 8 aa, Entamoeba dispar
TPEKFPDY

SEQ ID NO: 2467144 - protein, 9 aa, Entamoeba dispar
TPEKRPTAQ

SEQ ID NO: 2467145 - protein, 8 aa, Entamoeba dispar
TPEKVPNE

SEQ ID NO: 2467146 - protein, 5 aa, Entamoeba dispar
TPEKW

SEQ ID NO: 2467147 - protein, 4 aa, Entamoeba dispar
TPEL

SEQ ID NO: 2467148 - protein, 4 aa, Entamoeba dispar
TPEM

SEQ ID NO: 2467149 - protein, 4 aa, Entamoeba dispar
TPEN

SEQ ID NO: 2467150 - protein, 5 aa, Entamoeba dispar
TPENM

SEQ ID NO: 2467151 - protein, 6 aa, Entamoeba dispar
TPENPQ

SEQ ID NO: 2467152 - protein, 4 aa, Entamoeba dispar
TPEP

SEQ ID NO: 2467153 - protein, 4 aa, Entamoeba dispar
TPES

SEQ ID NO: 2467154 - protein, 5 aa, Entamoeba dispar
TPETF

SEQ ID NO: 2467155 - protein, 6 aa, Entamoeba dispar
TPEVNT

SEQ ID NO: 2467156 - protein, 5 aa, Entamoeba dispar
TPEYL

SEQ ID NO: 2467157 - protein, 16 aa, Entamoeba dispar
TPFAADDDGNQNETYQ

SEQ ID NO: 2467158 - protein, 20 aa, Entamoeba dispar
TPFDKTYSSQPSVKTSSTTI

SEQ ID NO: 2467159 - protein, 12 aa, Entamoeba dispar
TPFDVWNDDEIK

SEQ ID NO: 2467160 - protein, 6 aa, Entamoeba dispar
TPFEKN

SEQ ID NO: 2467161 - protein, 14 aa, Entamoeba dispar
TPFGDNSPLPIDGD

SEQ ID NO: 2467162 - protein, 13 aa, Entamoeba dispar
TPFIGEETTTRIG

SEQ ID NO: 2467163 - protein, 11 aa, Entamoeba dispar
TPFKTGPIRNS

SEQ ID NO: 2467164 - protein, 6 aa, Entamoeba dispar
TPFPSL

SEQ ID NO: 2467165 - protein, 7 aa, Entamoeba dispar
TPFPSNS

SEQ ID NO: 2467166 - protein, 8 aa, Entamoeba dispar
TPFQPKTR

SEQ ID NO: 2467167 - protein, 11 aa, Entamoeba dispar
TPFTDNVTSGR

SEQ ID NO: 2467168 - protein, 6 aa, Entamoeba dispar
TPFTGT

SEQ ID NO: 2467169 - protein, 8 aa, Entamoeba dispar
TPGAEAPS

SEQ ID NO: 2467170 - protein, 5 aa, Entamoeba dispar
TPGAP

SEQ ID NO: 2467171 - protein, 9 aa, Entamoeba dispar
TPGAYPSFE

SEQ ID NO: 2467172 - protein, 4 aa, Entamoeba dispar
TPGE

SEQ ID NO: 2467173 - protein, 6 aa, Entamoeba dispar
TPGEIS

SEQ ID NO: 2467174 - protein, 9 aa, Entamoeba dispar
TPGFGDSRG

SEQ ID NO: 2467175 - protein, 9 aa, Entamoeba dispar
TPGFGDTRG

SEQ ID NO: 2467176 - protein, 11 aa, Entamoeba dispar
TPGFGDTRGIA

SEQ ID NO: 2467177 - protein, 11 aa, Entamoeba dispar
TPGFGDTRGIE

SEQ ID NO: 2467178 - protein, 13 aa, Entamoeba dispar
TPGFGDTRGIEHD

SEQ ID NO: 2467179 - protein, 19 aa, Entamoeba dispar
TPGFGDTRGIEHDKEITRQ

SEQ ID NO: 2467180 - protein, 12 aa, Entamoeba dispar
TPGFGDTRGIEY

SEQ ID NO: 2467181 - protein, 19 aa, Entamoeba dispar
TPGFGDTRGKGYDKEITNQ

SEQ ID NO: 2467182 - protein, 6 aa, Entamoeba dispar
TPGHEA

SEQ ID NO: 2467183 - protein, 6 aa, Entamoeba dispar
TPGHSD

SEQ ID NO: 2467184 - protein, 7 aa, Entamoeba dispar
TPGHSPG

SEQ ID NO: 2467185 - protein, 9 aa, Entamoeba dispar
TPGHSPGSC

SEQ ID NO: 2467186 - protein, 4 aa, Entamoeba dispar
TPGI

SEQ ID NO: 2467187 - protein, 10 aa, Entamoeba dispar
TPGKFGDISN

SEQ ID NO: 2467188 - protein, 22 aa, Entamoeba dispar
TPGKYDIETYDSQPIGDLAQGG

SEQ ID NO: 2467189 - protein, 15 aa, Entamoeba dispar
TPGLDSSSQHISSKE

SEQ ID NO: 2467190 - protein, 14 aa, Entamoeba dispar
TPGLNDSKNFDNKN

SEQ ID NO: 2467191 - protein, 6 aa, Entamoeba dispar
TPGNRQ

SEQ ID NO: 2467192 - protein, 11 aa, Entamoeba dispar
TPGNTKAGKAI

SEQ ID NO: 2467193 - protein, 5 aa, Entamoeba dispar
TPGQE

SEQ ID NO: 2467194 - protein, 7 aa, Entamoeba dispar
TPGQNKP

SEQ ID NO: 2467195 - protein, 9 aa, Entamoeba dispar
TPGQNSNGV

SEQ ID NO: 2467196 - protein, 9 aa, Entamoeba dispar
TPGQVSENE

SEQ ID NO: 2467197 - protein, 15 aa, Entamoeba dispar
TPGRLASLNNSGALD

SEQ ID NO: 2467198 - protein, 6 aa, Entamoeba dispar
TPGRTM

SEQ ID NO: 2467199 - protein, 11 aa, Entamoeba dispar
TPGSVEERKKD

SEQ ID NO: 2467200 - protein, 17 aa, Entamoeba dispar
TPGTEVKDLTQPGQKKK

SEQ ID NO: 2467201 - protein, 26 aa, Entamoeba dispar
TPHDSRDYRIKSTTTAWSNTNRNQLR

SEQ ID NO: 2467202 - protein, 6 aa, Entamoeba dispar
TPHFNT

SEQ ID NO: 2467203 - protein, 4 aa, Entamoeba dispar
TPHH

SEQ ID NO: 2467204 - protein, 4 aa, Entamoeba dispar
TPHP

SEQ ID NO: 2467205 - protein, 5 aa, Entamoeba dispar
TPIDE

SEQ ID NO: 2467206 - protein, 5 aa, Entamoeba dispar
TPIDG

SEQ ID NO: 2467207 - protein, 4 aa, Entamoeba dispar
TPIE

SEQ ID NO: 2467208 - protein, 8 aa, Entamoeba dispar
TPIEEIET

SEQ ID NO: 2467209 - protein, 10 aa, Entamoeba dispar
TPIEPSEQIR

SEQ ID NO: 2467210 - protein, 7 aa, Entamoeba dispar
TPIEQGK

SEQ ID NO: 2467211 - protein, 8 aa, Entamoeba dispar
TPIGEDQI

SEQ ID NO: 2467212 - protein, 5 aa, Entamoeba dispar
TPIIP

SEQ ID NO: 2467213 - protein, 32 aa, Entamoeba dispar
TPIKDVNEKPINNDYGKQKEETKPKKKNGKKW

SEQ ID NO: 2467214 - protein, 12 aa, Entamoeba dispar
TPIKIGKRKATI

SEQ ID NO: 2467215 - protein, 13 aa, Entamoeba dispar
TPIKTEQNEITEI

SEQ ID NO: 2467216 - protein, 66 aa, Entamoeba dispar
TPINTETPITTESTTSTEKKEEEKPVEEEKKVETEKPVEEEKKVETEKPTEEEKKEEEKPVEEESK

SEQ ID NO: 2467217 - protein, 11 aa, Entamoeba dispar
TPINTNGKKAC

SEQ ID NO: 2467218 - protein, 37 aa, Entamoeba dispar
TPIPQPTVSPQGIQPIPRVPQGGVVPPQPGFQPPPFR

SEQ ID NO: 2467219 - protein, 5 aa, Entamoeba dispar
TPIPR

SEQ ID NO: 2467220 - protein, 18 aa, Entamoeba dispar
TPIPTDCTKRKGGRRGRR

SEQ ID NO: 2467221 - protein, 4 aa, Entamoeba dispar
TPIQ

SEQ ID NO: 2467222 - protein, 6 aa, Entamoeba dispar
TPIQNE

SEQ ID NO: 2467223 - protein, 6 aa, Entamoeba dispar
TPIQNN

SEQ ID NO: 2467224 - protein, 4 aa, Entamoeba dispar
TPIS

SEQ ID NO: 2467225 - protein, 11 aa, Entamoeba dispar
TPISNNQFGQS

SEQ ID NO: 2467226 - protein, 16 aa, Entamoeba dispar
TPISPKETLHDDPARA

SEQ ID NO: 2467227 - protein, 5 aa, Entamoeba dispar
TPKCP

SEQ ID NO: 2467228 - protein, 10 aa, Entamoeba dispar
TPKDVEANKP

SEQ ID NO: 2467229 - protein, 5 aa, Entamoeba dispar
TPKEC

SEQ ID NO: 2467230 - protein, 5 aa, Entamoeba dispar
TPKEE

SEQ ID NO: 2467231 - protein, 10 aa, Entamoeba dispar
TPKEGTYDEN

SEQ ID NO: 2467232 - protein, 8 aa, Entamoeba dispar
TPKEHETI

SEQ ID NO: 2467233 - protein, 8 aa, Entamoeba dispar
TPKEHPDY

SEQ ID NO: 2467234 - protein, 5 aa, Entamoeba dispar
TPKEI

SEQ ID NO: 2467235 - protein, 26 aa, Entamoeba dispar
TPKEPAKDPVKDEPTKTTEKPVNNEQ

SEQ ID NO: 2467236 - protein, 10 aa, Entamoeba dispar
TPKEQKRLRK

SEQ ID NO: 2467237 - protein, 5 aa, Entamoeba dispar
TPKGD

SEQ ID NO: 2467238 - protein, 9 aa, Entamoeba dispar
TPKGTRDYF

SEQ ID NO: 2467239 - protein, 5 aa, Entamoeba dispar
TPKIR

SEQ ID NO: 2467240 - protein, 34 aa, Entamoeba dispar
TPKISKQKTRIMGSPNTSSSKIPTSSSCNTPKRK

SEQ ID NO: 2467241 - protein, 18 aa, Entamoeba dispar
TPKITKIEEEKESFTQKI

SEQ ID NO: 2467242 - protein, 7 aa, Entamoeba dispar
TPKKEKK

SEQ ID NO: 2467243 - protein, 12 aa, Entamoeba dispar
TPKKRKGEMNSN

SEQ ID NO: 2467244 - protein, 20 aa, Entamoeba dispar
TPKLTSNSLLTSSGTISNDL

SEQ ID NO: 2467245 - protein, 8 aa, Entamoeba dispar
TPKPIDYP

SEQ ID NO: 2467246 - protein, 18 aa, Entamoeba dispar
TPKPTISTETTPFKRQRT

SEQ ID NO: 2467247 - protein, 8 aa, Entamoeba dispar
TPKQKEEL

SEQ ID NO: 2467248 - protein, 8 aa, Entamoeba dispar
TPKQKKDW

SEQ ID NO: 2467249 - protein, 5 aa, Entamoeba dispar
TPKTD

SEQ ID NO: 2467250 - protein, 12 aa, Entamoeba dispar
TPKTEIYPIPCY

SEQ ID NO: 2467251 - protein, 8 aa, Entamoeba dispar
TPKTTTQL

SEQ ID NO: 2467252 - protein, 4 aa, Entamoeba dispar
TPKY

SEQ ID NO: 2467253 - protein, 8 aa, Entamoeba dispar
TPKYLGSS

SEQ ID NO: 2467254 - protein, 9 aa, Entamoeba dispar
TPLDKTTSS

SEQ ID NO: 2467255 - protein, 12 aa, Entamoeba dispar
TPLDSNASISAD

SEQ ID NO: 2467256 - protein, 5 aa, Entamoeba dispar
TPLEA

SEQ ID NO: 2467257 - protein, 6 aa, Entamoeba dispar
TPLEKT

SEQ ID NO: 2467258 - protein, 5 aa, Entamoeba dispar
TPLGK

SEQ ID NO: 2467259 - protein, 5 aa, Entamoeba dispar
TPLHP

SEQ ID NO: 2467260 - protein, 4 aa, Entamoeba dispar
TPLI

SEQ ID NO: 2467261 - protein, 6 aa, Entamoeba dispar
TPLKEA

SEQ ID NO: 2467262 - protein, 5 aa, Entamoeba dispar
TPLNK

SEQ ID NO: 2467263 - protein, 21 aa, Entamoeba dispar
TPLNNQPVAPPPENQETPKRQ

SEQ ID NO: 2467264 - protein, 21 aa, Entamoeba dispar
TPLNNQPVPPPPENQETPKHQ

SEQ ID NO: 2467265 - protein, 5 aa, Entamoeba dispar
TPLNT

SEQ ID NO: 2467266 - protein, 11 aa, Entamoeba dispar
TPLNYKQKEIE

SEQ ID NO: 2467267 - protein, 8 aa, Entamoeba dispar
TPLPRDVD

SEQ ID NO: 2467268 - protein, 5 aa, Entamoeba dispar
TPLPT

SEQ ID NO: 2467269 - protein, 6 aa, Entamoeba dispar
TPLQNT

SEQ ID NO: 2467270 - protein, 6 aa, Entamoeba dispar
TPLSPY

SEQ ID NO: 2467271 - protein, 4 aa, Entamoeba dispar
TPLT

SEQ ID NO: 2467272 - protein, 14 aa, Entamoeba dispar
TPMGTTSTSNGEFI

SEQ ID NO: 2467273 - protein, 56 aa, Entamoeba dispar
TPMKTDKIKTINKPTTISSIPTHSIPSKAERALSKQFSPKPTTESKNFSEKQKPRH

SEQ ID NO: 2467274 - protein, 5 aa, Entamoeba dispar
TPNAE

SEQ ID NO: 2467275 - protein, 5 aa, Entamoeba dispar
TPNAT

SEQ ID NO: 2467276 - protein, 13 aa, Entamoeba dispar
TPNCNKNEEISGI

SEQ ID NO: 2467277 - protein, 9 aa, Entamoeba dispar
TPNCPTERS

SEQ ID NO: 2467278 - protein, 5 aa, Entamoeba dispar
TPNDE

SEQ ID NO: 2467279 - protein, 5 aa, Entamoeba dispar
TPNDQ

SEQ ID NO: 2467280 - protein, 7 aa, Entamoeba dispar
TPNECGQ

SEQ ID NO: 2467281 - protein, 5 aa, Entamoeba dispar
TPNEE

SEQ ID NO: 2467282 - protein, 16 aa, Entamoeba dispar
TPNESIGGLKDSNFGD

SEQ ID NO: 2467283 - protein, 6 aa, Entamoeba dispar
TPNGTE

SEQ ID NO: 2467284 - protein, 8 aa, Entamoeba dispar
TPNGTGIG

SEQ ID NO: 2467285 - protein, 4 aa, Entamoeba dispar
TPNH

SEQ ID NO: 2467286 - protein, 4 aa, Entamoeba dispar
TPNK

SEQ ID NO: 2467287 - protein, 10 aa, Entamoeba dispar
TPNKQTNYKD

SEQ ID NO: 2467288 - protein, 7 aa, Entamoeba dispar
TPNKSPN

SEQ ID NO: 2467289 - protein, 9 aa, Entamoeba dispar
TPNLQPGNL

SEQ ID NO: 2467290 - protein, 6 aa, Entamoeba dispar
TPNLSQ

SEQ ID NO: 2467291 - protein, 5 aa, Entamoeba dispar
TPNNF

SEQ ID NO: 2467292 - protein, 15 aa, Entamoeba dispar
TPNNLKGEEADEELE

SEQ ID NO: 2467293 - protein, 15 aa, Entamoeba dispar
TPNNTTTLDDPEAEA

SEQ ID NO: 2467294 - protein, 6 aa, Entamoeba dispar
TPNPLY

SEQ ID NO: 2467295 - protein, 6 aa, Entamoeba dispar
TPNPVS

SEQ ID NO: 2467296 - protein, 22 aa, Entamoeba dispar
TPNQEINQSKPIQPIQSKPIQP

SEQ ID NO: 2467297 - protein, 13 aa, Entamoeba dispar
TPNSGPSSEWPGV

SEQ ID NO: 2467298 - protein, 4 aa, Entamoeba dispar
TPNT

SEQ ID NO: 2467299 - protein, 8 aa, Entamoeba dispar
TPNTEAPA

SEQ ID NO: 2467300 - protein, 7 aa, Entamoeba dispar
TPNTKEY

SEQ ID NO: 2467301 - protein, 11 aa, Entamoeba dispar
TPNTSTKQQSV

SEQ ID NO: 2467302 - protein, 12 aa, Entamoeba dispar
TPNTTSYEKGGK

SEQ ID NO: 2467303 - protein, 4 aa, Entamoeba dispar
TPPA

SEQ ID NO: 2467304 - protein, 9 aa, Entamoeba dispar
TPPGTSDEH

SEQ ID NO: 2467305 - protein, 6 aa, Entamoeba dispar
TPPIKP

SEQ ID NO: 2467306 - protein, 7 aa, Entamoeba dispar
TPPISPE

SEQ ID NO: 2467307 - protein, 38 aa, Entamoeba dispar
TPPLEEKQKLSKGKKSIETHSEPYLNTSKEPEPKRKQL

SEQ ID NO: 2467308 - protein, 39 aa, Entamoeba dispar
TPPLNIPQDRRSYIPDEEEIKELEGYDPNITVDEAKRRN

SEQ ID NO: 2467309 - protein, 8 aa, Entamoeba dispar
TPPNNEIH

SEQ ID NO: 2467310 - protein, 6 aa, Entamoeba dispar
TPPNSL

SEQ ID NO: 2467311 - protein, 8 aa, Entamoeba dispar
TPPNTQQQ

SEQ ID NO: 2467312 - protein, 4 aa, Entamoeba dispar
TPPP

SEQ ID NO: 2467313 - protein, 15 aa, Entamoeba dispar
TPPPPSKSQSGPQMD

SEQ ID NO: 2467314 - protein, 7 aa, Entamoeba dispar
TPPPPSY

SEQ ID NO: 2467315 - protein, 13 aa, Entamoeba dispar
TPPQWEPVNYSYY

SEQ ID NO: 2467316 - protein, 6 aa, Entamoeba dispar
TPPSIY

SEQ ID NO: 2467317 - protein, 6 aa, Entamoeba dispar
TPPTKE

SEQ ID NO: 2467318 - protein, 6 aa, Entamoeba dispar
TPQGTK

SEQ ID NO: 2467319 - protein, 7 aa, Entamoeba dispar
TPQHNGP

SEQ ID NO: 2467320 - protein, 5 aa, Entamoeba dispar
TPQKD

SEQ ID NO: 2467321 - protein, 10 aa, Entamoeba dispar
TPQKEAEKTP

SEQ ID NO: 2467322 - protein, 11 aa, Entamoeba dispar
TPQKINGEKEG

SEQ ID NO: 2467323 - protein, 5 aa, Entamoeba dispar
TPQKN

SEQ ID NO: 2467324 - protein, 5 aa, Entamoeba dispar
TPQLA

SEQ ID NO: 2467325 - protein, 5 aa, Entamoeba dispar
TPQNL

SEQ ID NO: 2467326 - protein, 22 aa, Entamoeba dispar
TPQNSSSRLTTIPQSLTAPPLQ

SEQ ID NO: 2467327 - protein, 4 aa, Entamoeba dispar
TPQP

SEQ ID NO: 2467328 - protein, 9 aa, Entamoeba dispar
TPQQGGEIT

SEQ ID NO: 2467329 - protein, 6 aa, Entamoeba dispar
TPQSIT

SEQ ID NO: 2467330 - protein, 4 aa, Entamoeba dispar
TPQT

SEQ ID NO: 2467331 - protein, 7 aa, Entamoeba dispar
TPQTITD

SEQ ID NO: 2467332 - protein, 11 aa, Entamoeba dispar
TPQVIDNTNST

SEQ ID NO: 2467333 - protein, 8 aa, Entamoeba dispar
TPQVTNPL

SEQ ID NO: 2467334 - protein, 7 aa, Entamoeba dispar
TPQYAGS

SEQ ID NO: 2467335 - protein, 11 aa, Entamoeba dispar
TPREDNQENNQ

SEQ ID NO: 2467336 - protein, 10 aa, Entamoeba dispar
TPRGAKVRNG

SEQ ID NO: 2467337 - protein, 18 aa, Entamoeba dispar
TPRGSIRKSEKKKDKREL

SEQ ID NO: 2467338 - protein, 10 aa, Entamoeba dispar
TPRIEKENTE

SEQ ID NO: 2467339 - protein, 26 aa, Entamoeba dispar
TPRKIGKGKGDEQLESKNEMRDEARK

SEQ ID NO: 2467340 - protein, 5 aa, Entamoeba dispar
TPRNC

SEQ ID NO: 2467341 - protein, 10 aa, Entamoeba dispar
TPRQKKETIQ

SEQ ID NO: 2467342 - protein, 12 aa, Entamoeba dispar
TPRQRGGPQTPL

SEQ ID NO: 2467343 - protein, 4 aa, Entamoeba dispar
TPRR

SEQ ID NO: 2467344 - protein, 7 aa, Entamoeba dispar
TPRRKAT

SEQ ID NO: 2467345 - protein, 14 aa, Entamoeba dispar
TPRSARRHNEIREE

SEQ ID NO: 2467346 - protein, 8 aa, Entamoeba dispar
TPRTNKKR

SEQ ID NO: 2467347 - protein, 7 aa, Entamoeba dispar
TPRTSSL

SEQ ID NO: 2467348 - protein, 9 aa, Entamoeba dispar
TPRYAGPSI

SEQ ID NO: 2467349 - protein, 7 aa, Entamoeba dispar
TPSAERQ

SEQ ID NO: 2467350 - protein, 14 aa, Entamoeba dispar
TPSAVADELIKLYG

SEQ ID NO: 2467351 - protein, 5 aa, Entamoeba dispar
TPSDK

SEQ ID NO: 2467352 - protein, 6 aa, Entamoeba dispar
TPSEES

SEQ ID NO: 2467353 - protein, 7 aa, Entamoeba dispar
TPSETFT

SEQ ID NO: 2467354 - protein, 5 aa, Entamoeba dispar
TPSFL

SEQ ID NO: 2467355 - protein, 13 aa, Entamoeba dispar
TPSFSDSSKMNEE

SEQ ID NO: 2467356 - protein, 5 aa, Entamoeba dispar
TPSGH

SEQ ID NO: 2467357 - protein, 9 aa, Entamoeba dispar
TPSGTQYGH

SEQ ID NO: 2467358 - protein, 48 aa, Entamoeba dispar
TPSHSPRVSPRFSPKISPRSSFNSSHGSSSNGSNSPNSTSTDDRSQQL

SEQ ID NO: 2467359 - protein, 6 aa, Entamoeba dispar
TPSIAE

SEQ ID NO: 2467360 - protein, 6 aa, Entamoeba dispar
TPSKPY

SEQ ID NO: 2467361 - protein, 16 aa, Entamoeba dispar
TPSLKERESLLKWFIS

SEQ ID NO: 2467362 - protein, 14 aa, Entamoeba dispar
TPSNEKEETINSVS

SEQ ID NO: 2467363 - protein, 8 aa, Entamoeba dispar
TPSNNNSI

SEQ ID NO: 2467364 - protein, 4 aa, Entamoeba dispar
TPSP

SEQ ID NO: 2467365 - protein, 7 aa, Entamoeba dispar
TPSPLDQ

SEQ ID NO: 2467366 - protein, 9 aa, Entamoeba dispar
TPSPTGVSY

SEQ ID NO: 2467367 - protein, 7 aa, Entamoeba dispar
TPSQRTE

SEQ ID NO: 2467368 - protein, 5 aa, Entamoeba dispar
TPSSM

SEQ ID NO: 2467369 - protein, 5 aa, Entamoeba dispar
TPSTI

SEQ ID NO: 2467370 - protein, 9 aa, Entamoeba dispar
TPSTRKSHR

SEQ ID NO: 2467371 - protein, 6 aa, Entamoeba dispar
TPSVNG

SEQ ID NO: 2467372 - protein, 7 aa, Entamoeba dispar
TPSYRPP

SEQ ID NO: 2467373 - protein, 8 aa, Entamoeba dispar
TPSYYYNS

SEQ ID NO: 2467374 - protein, 7 aa, Entamoeba dispar
TPTANTG

SEQ ID NO: 2467375 - protein, 8 aa, Entamoeba dispar
TPTAQSQV

SEQ ID NO: 2467376 - protein, 6 aa, Entamoeba dispar
TPTDQN

SEQ ID NO: 2467377 - protein, 6 aa, Entamoeba dispar
TPTDSL

SEQ ID NO: 2467378 - protein, 4 aa, Entamoeba dispar
TPTE

SEQ ID NO: 2467379 - protein, 9 aa, Entamoeba dispar
TPTEESWPG

SEQ ID NO: 2467380 - protein, 12 aa, Entamoeba dispar
TPTEFDDKKRNA

SEQ ID NO: 2467381 - protein, 11 aa, Entamoeba dispar
TPTEKVKQALQ

SEQ ID NO: 2467382 - protein, 11 aa, Entamoeba dispar
TPTENTKTLPV

SEQ ID NO: 2467383 - protein, 14 aa, Entamoeba dispar
TPTETKHNESHELP

SEQ ID NO: 2467384 - protein, 28 aa, Entamoeba dispar
TPTFKNSTTKDPMTEAKTEEYQAKRKLD

SEQ ID NO: 2467385 - protein, 11 aa, Entamoeba dispar
TPTHPLPSSNQ

SEQ ID NO: 2467386 - protein, 20 aa, Entamoeba dispar
TPTIEPTIKREEKERTFDGM

SEQ ID NO: 2467387 - protein, 4 aa, Entamoeba dispar
TPTN

SEQ ID NO: 2467388 - protein, 24 aa, Entamoeba dispar
TPTNTTPEKSPSPNGDGQQSGISK

SEQ ID NO: 2467389 - protein, 4 aa, Entamoeba dispar
TPTP

SEQ ID NO: 2467390 - protein, 5 aa, Entamoeba dispar
TPTPE

SEQ ID NO: 2467391 - protein, 6 aa, Entamoeba dispar
TPTPKE

SEQ ID NO: 2467392 - protein, 7 aa, Entamoeba dispar
TPTPRIG

SEQ ID NO: 2467393 - protein, 9 aa, Entamoeba dispar
TPTPSPTPD

SEQ ID NO: 2467394 - protein, 8 aa, Entamoeba dispar
TPTQISQK

SEQ ID NO: 2467395 - protein, 6 aa, Entamoeba dispar
TPTQSY

SEQ ID NO: 2467396 - protein, 48 aa, Entamoeba dispar
TPTQTPLTNADYPRFSRKRKGAKAGEEEDDTDEEDEKIKVEQQPNQIP

SEQ ID NO: 2467397 - protein, 4 aa, Entamoeba dispar
TPTR

SEQ ID NO: 2467398 - protein, 9 aa, Entamoeba dispar
TPTRPETGY

SEQ ID NO: 2467399 - protein, 10 aa, Entamoeba dispar
TPTRSDAEKL

SEQ ID NO: 2467400 - protein, 6 aa, Entamoeba dispar
TPTSMA

SEQ ID NO: 2467401 - protein, 26 aa, Entamoeba dispar
TPTSQQPQFPNTSQSQFSDQAYTPLH

SEQ ID NO: 2467402 - protein, 20 aa, Entamoeba dispar
TPTSSNSFDNNHKRRKWYII

SEQ ID NO: 2467403 - protein, 5 aa, Entamoeba dispar
TPTSV

SEQ ID NO: 2467404 - protein, 26 aa, Entamoeba dispar
TPTTEKKVKKVKKVKKTKKALKELPD

SEQ ID NO: 2467405 - protein, 5 aa, Entamoeba dispar
TPTTF

SEQ ID NO: 2467406 - protein, 13 aa, Entamoeba dispar
TPTVEQSGNGISN

SEQ ID NO: 2467407 - protein, 10 aa, Entamoeba dispar
TPTVNNATKI

SEQ ID NO: 2467408 - protein, 12 aa, Entamoeba dispar
TPTYKEEEENTI

SEQ ID NO: 2467409 - protein, 12 aa, Entamoeba dispar
TPTYKVSNETNE

SEQ ID NO: 2467410 - protein, 5 aa, Entamoeba dispar
TPVES

SEQ ID NO: 2467411 - protein, 4 aa, Entamoeba dispar
TPVK

SEQ ID NO: 2467412 - protein, 10 aa, Entamoeba dispar
TPVKKPVSKS

SEQ ID NO: 2467413 - protein, 7 aa, Entamoeba dispar
TPVQNGL

SEQ ID NO: 2467414 - protein, 10 aa, Entamoeba dispar
TPVQPSAKVD

SEQ ID NO: 2467415 - protein, 6 aa, Entamoeba dispar
TPVSNY

SEQ ID NO: 2467416 - protein, 19 aa, Entamoeba dispar
TPVTPSEGEKINPDNKERK

SEQ ID NO: 2467417 - protein, 9 aa, Entamoeba dispar
TPVTSGKGI

SEQ ID NO: 2467418 - protein, 4 aa, Entamoeba dispar
TPVY

SEQ ID NO: 2467419 - protein, 5 aa, Entamoeba dispar
TPWSD

SEQ ID NO: 2467420 - protein, 12 aa, Entamoeba dispar
TPYLSYQPFSLI

SEQ ID NO: 2467421 - protein, 17 aa, Entamoeba dispar
TPYLTEDNKTTKNKSFE

SEQ ID NO: 2467422 - protein, 5 aa, Entamoeba dispar
TPYNP

SEQ ID NO: 2467423 - protein, 15 aa, Entamoeba dispar
TPYRGNSKKSQEEEM

SEQ ID NO: 2467424 - protein, 18 aa, Entamoeba dispar
TPYSTSDQMSIEDDELND

SEQ ID NO: 2467425 - protein, 13 aa, Entamoeba dispar
TPYYNTNTNSSLK

SEQ ID NO: 2467426 - protein, 5 aa, Entamoeba dispar
TPYYR

SEQ ID NO: 2467427 - protein, 18 aa, Entamoeba dispar
TQADYTLDPEKAKPSRDV

SEQ ID NO: 2467428 - protein, 18 aa, Entamoeba dispar
TQADYTLDPEKARPSRDR

SEQ ID NO: 2467429 - protein, 9 aa, Entamoeba dispar
TQAEDETDR

SEQ ID NO: 2467430 - protein, 6 aa, Entamoeba dispar
TQAGTY

SEQ ID NO: 2467431 - protein, 6 aa, Entamoeba dispar
TQAQRT

SEQ ID NO: 2467432 - protein, 21 aa, Entamoeba dispar
TQARADGNEKEIEDITQEQNG

SEQ ID NO: 2467433 - protein, 4 aa, Entamoeba dispar
TQAT

SEQ ID NO: 2467434 - protein, 5 aa, Entamoeba dispar
TQATV

SEQ ID NO: 2467435 - protein, 9 aa, Entamoeba dispar
TQCKTPGKS

SEQ ID NO: 2467436 - protein, 6 aa, Entamoeba dispar
TQDECV

SEQ ID NO: 2467437 - protein, 5 aa, Entamoeba dispar
TQDHA

SEQ ID NO: 2467438 - protein, 16 aa, Entamoeba dispar
TQDIQNRIKTGKSIDS

SEQ ID NO: 2467439 - protein, 7 aa, Entamoeba dispar
TQDLEGV

SEQ ID NO: 2467440 - protein, 4 aa, Entamoeba dispar
TQDQ

SEQ ID NO: 2467441 - protein, 5 aa, Entamoeba dispar
TQDST

SEQ ID NO: 2467442 - protein, 10 aa, Entamoeba dispar
TQDTEEEYPY

SEQ ID NO: 2467443 - protein, 8 aa, Entamoeba dispar
TQDTEKKV

SEQ ID NO: 2467444 - protein, 8 aa, Entamoeba dispar
TQDTQQIE

SEQ ID NO: 2467445 - protein, 4 aa, Entamoeba dispar
TQED

SEQ ID NO: 2467446 - protein, 4 aa, Entamoeba dispar
TQEE

SEQ ID NO: 2467447 - protein, 4 aa, Entamoeba dispar
TQEG

SEQ ID NO: 2467448 - protein, 22 aa, Entamoeba dispar
TQEGMKKSFGSTCHGAGRKMSR

SEQ ID NO: 2467449 - protein, 22 aa, Entamoeba dispar
TQEGMKKTFGSTCHGAGRKISR

SEQ ID NO: 2467450 - protein, 18 aa, Entamoeba dispar
TQEIQEKQKEQEIEEEED

SEQ ID NO: 2467451 - protein, 7 aa, Entamoeba dispar
TQEKTSH

SEQ ID NO: 2467452 - protein, 5 aa, Entamoeba dispar
TQEKY

SEQ ID NO: 2467453 - protein, 5 aa, Entamoeba dispar
TQELQ

SEQ ID NO: 2467454 - protein, 5 aa, Entamoeba dispar
TQENI

SEQ ID NO: 2467455 - protein, 5 aa, Entamoeba dispar
TQENL

SEQ ID NO: 2467456 - protein, 14 aa, Entamoeba dispar
TQENNELDNNIPNY

SEQ ID NO: 2467457 - protein, 9 aa, Entamoeba dispar
TQEQNSKLT

SEQ ID NO: 2467458 - protein, 6 aa, Entamoeba dispar
TQEQTE

SEQ ID NO: 2467459 - protein, 7 aa, Entamoeba dispar
TQEQTEH

SEQ ID NO: 2467460 - protein, 5 aa, Entamoeba dispar
TQERE

SEQ ID NO: 2467461 - protein, 5 aa, Entamoeba dispar
TQEST

SEQ ID NO: 2467462 - protein, 9 aa, Entamoeba dispar
TQESTQQIK

SEQ ID NO: 2467463 - protein, 6 aa, Entamoeba dispar
TQFENT

SEQ ID NO: 2467464 - protein, 13 aa, Entamoeba dispar
TQFGETEKKRYDI

SEQ ID NO: 2467465 - protein, 9 aa, Entamoeba dispar
TQFQQSQPT

SEQ ID NO: 2467466 - protein, 15 aa, Entamoeba dispar
TQFRRRREGKTDYYA

SEQ ID NO: 2467467 - protein, 5 aa, Entamoeba dispar
TQFSD

SEQ ID NO: 2467468 - protein, 4 aa, Entamoeba dispar
TQGA

SEQ ID NO: 2467469 - protein, 5 aa, Entamoeba dispar
TQGAK

SEQ ID NO: 2467470 - protein, 29 aa, Entamoeba dispar
TQGDLPPPPPPRGSHGAPAAPPAPAAPSL

SEQ ID NO: 2467471 - protein, 6 aa, Entamoeba dispar
TQGEFD

SEQ ID NO: 2467472 - protein, 8 aa, Entamoeba dispar
TQGKPFRP

SEQ ID NO: 2467473 - protein, 7 aa, Entamoeba dispar
TQGMLSQ

SEQ ID NO: 2467474 - protein, 5 aa, Entamoeba dispar
TQGMS

SEQ ID NO: 2467475 - protein, 6 aa, Entamoeba dispar
TQGNNG

SEQ ID NO: 2467476 - protein, 41 aa, Entamoeba dispar
TQGPHKSKVKRVQKEKPWTVEDAKGRIDNGPKLGRKPWDND

SEQ ID NO: 2467477 - protein, 7 aa, Entamoeba dispar
TQGQKLE

SEQ ID NO: 2467478 - protein, 6 aa, Entamoeba dispar
TQGRRS

SEQ ID NO: 2467479 - protein, 9 aa, Entamoeba dispar
TQGSGKSEL

SEQ ID NO: 2467480 - protein, 6 aa, Entamoeba dispar
TQGSSI

SEQ ID NO: 2467481 - protein, 22 aa, Entamoeba dispar
TQGSTSAPPVPPLSPRRQAEQK

SEQ ID NO: 2467482 - protein, 8 aa, Entamoeba dispar
TQGYTNPK

SEQ ID NO: 2467483 - protein, 10 aa, Entamoeba dispar
TQHQNSNLQK

SEQ ID NO: 2467484 - protein, 11 aa, Entamoeba dispar
TQIADNDKELT

SEQ ID NO: 2467485 - protein, 4 aa, Entamoeba dispar
TQID

SEQ ID NO: 2467486 - protein, 14 aa, Entamoeba dispar
TQIDKYGRNIEQED

SEQ ID NO: 2467487 - protein, 6 aa, Entamoeba dispar
TQIEEP

SEQ ID NO: 2467488 - protein, 27 aa, Entamoeba dispar
TQINENKNVEEKKPKQQKKKKVEIKKG

SEQ ID NO: 2467489 - protein, 6 aa, Entamoeba dispar
TQIPKM

SEQ ID NO: 2467490 - protein, 6 aa, Entamoeba dispar
TQIPKY

SEQ ID NO: 2467491 - protein, 5 aa, Entamoeba dispar
TQIPN

SEQ ID NO: 2467492 - protein, 8 aa, Entamoeba dispar
TQIPTTTN

SEQ ID NO: 2467493 - protein, 10 aa, Entamoeba dispar
TQIRDDTESV

SEQ ID NO: 2467494 - protein, 9 aa, Entamoeba dispar
TQIRDEDTY

SEQ ID NO: 2467495 - protein, 4 aa, Entamoeba dispar
TQIS

SEQ ID NO: 2467496 - protein, 6 aa, Entamoeba dispar
TQISAE

SEQ ID NO: 2467497 - protein, 9 aa, Entamoeba dispar
TQISQTQEQ

SEQ ID NO: 2467498 - protein, 5 aa, Entamoeba dispar
TQISS

SEQ ID NO: 2467499 - protein, 8 aa, Entamoeba dispar
TQKCPNSD

SEQ ID NO: 2467500 - protein, 11 aa, Entamoeba dispar
TQKDIKEYKSK

SEQ ID NO: 2467501 - protein, 6 aa, Entamoeba dispar
TQKDRI

SEQ ID NO: 2467502 - protein, 4 aa, Entamoeba dispar
TQKE

SEQ ID NO: 2467503 - protein, 16 aa, Entamoeba dispar
TQKEEKFNSISPGQQI

SEQ ID NO: 2467504 - protein, 15 aa, Entamoeba dispar
TQKEEVKNQIEQELS

SEQ ID NO: 2467505 - protein, 5 aa, Entamoeba dispar
TQKEI

SEQ ID NO: 2467506 - protein, 33 aa, Entamoeba dispar
TQKEKLEQELSNKKKEVELAKKRKEEKNRNINE

SEQ ID NO: 2467507 - protein, 7 aa, Entamoeba dispar
TQKELSN

SEQ ID NO: 2467508 - protein, 12 aa, Entamoeba dispar
TQKENPLSNNGN

SEQ ID NO: 2467509 - protein, 4 aa, Entamoeba dispar
TQKG

SEQ ID NO: 2467510 - protein, 8 aa, Entamoeba dispar
TQKGELEM

SEQ ID NO: 2467511 - protein, 8 aa, Entamoeba dispar
TQKGGVRP

SEQ ID NO: 2467512 - protein, 6 aa, Entamoeba dispar
TQKINS

SEQ ID NO: 2467513 - protein, 4 aa, Entamoeba dispar
TQKK

SEQ ID NO: 2467514 - protein, 10 aa, Entamoeba dispar
TQKKKEVTEV

SEQ ID NO: 2467515 - protein, 9 aa, Entamoeba dispar
TQKNENDMV

SEQ ID NO: 2467516 - protein, 5 aa, Entamoeba dispar
TQKNK

SEQ ID NO: 2467517 - protein, 18 aa, Entamoeba dispar
TQKNSDQPKSVSKSSSQV

SEQ ID NO: 2467518 - protein, 7 aa, Entamoeba dispar
TQKQKEM

SEQ ID NO: 2467519 - protein, 9 aa, Entamoeba dispar
TQKRNEKIT

SEQ ID NO: 2467520 - protein, 4 aa, Entamoeba dispar
TQKS

SEQ ID NO: 2467521 - protein, 8 aa, Entamoeba dispar
TQKSSDLI

SEQ ID NO: 2467522 - protein, 14 aa, Entamoeba dispar
TQKTDKTDKTDEII

SEQ ID NO: 2467523 - protein, 8 aa, Entamoeba dispar
TQKTLSVT

SEQ ID NO: 2467524 - protein, 9 aa, Entamoeba dispar
TQKTNQITT

SEQ ID NO: 2467525 - protein, 9 aa, Entamoeba dispar
TQKYDEKKK

SEQ ID NO: 2467526 - protein, 4 aa, Entamoeba dispar
TQLC

SEQ ID NO: 2467527 - protein, 4 aa, Entamoeba dispar
TQLD

SEQ ID NO: 2467528 - protein, 5 aa, Entamoeba dispar
TQLET

SEQ ID NO: 2467529 - protein, 7 aa, Entamoeba dispar
TQLKPKN

SEQ ID NO: 2467530 - protein, 5 aa, Entamoeba dispar
TQLNT

SEQ ID NO: 2467531 - protein, 19 aa, Entamoeba dispar
TQLQQKNIKIDENKHFVVL

SEQ ID NO: 2467532 - protein, 8 aa, Entamoeba dispar
TQLSNNST

SEQ ID NO: 2467533 - protein, 4 aa, Entamoeba dispar
TQLT

SEQ ID NO: 2467534 - protein, 16 aa, Entamoeba dispar
TQMAGRAGRRGKDAAG

SEQ ID NO: 2467535 - protein, 7 aa, Entamoeba dispar
TQMDTGS

SEQ ID NO: 2467536 - protein, 5 aa, Entamoeba dispar
TQMLS

SEQ ID NO: 2467537 - protein, 6 aa, Entamoeba dispar
TQNDTE

SEQ ID NO: 2467538 - protein, 5 aa, Entamoeba dispar
TQNEE

SEQ ID NO: 2467539 - protein, 6 aa, Entamoeba dispar
TQNERK

SEQ ID NO: 2467540 - protein, 36 aa, Entamoeba dispar
TQNESSINTTNSQQSQTNNETNNVTRTQETEEQPTF

SEQ ID NO: 2467541 - protein, 6 aa, Entamoeba dispar
TQNGEN

SEQ ID NO: 2467542 - protein, 7 aa, Entamoeba dispar
TQNGQLR

SEQ ID NO: 2467543 - protein, 7 aa, Entamoeba dispar
TQNHKGS

SEQ ID NO: 2467544 - protein, 6 aa, Entamoeba dispar
TQNHQI

SEQ ID NO: 2467545 - protein, 5 aa, Entamoeba dispar
TQNKE

SEQ ID NO: 2467546 - protein, 5 aa, Entamoeba dispar
TQNKL

SEQ ID NO: 2467547 - protein, 13 aa, Entamoeba dispar
TQNKRIPRKCLNE

SEQ ID NO: 2467548 - protein, 5 aa, Entamoeba dispar
TQNPI

SEQ ID NO: 2467549 - protein, 9 aa, Entamoeba dispar
TQNSYQKVN

SEQ ID NO: 2467550 - protein, 7 aa, Entamoeba dispar
TQNTANG

SEQ ID NO: 2467551 - protein, 34 aa, Entamoeba dispar
TQNTVQQPSNQQTVHSQTSPQNNNLQTPTQTQQL

SEQ ID NO: 2467552 - protein, 9 aa, Entamoeba dispar
TQPDHSTKK

SEQ ID NO: 2467553 - protein, 5 aa, Entamoeba dispar
TQPEI

SEQ ID NO: 2467554 - protein, 7 aa, Entamoeba dispar
TQPEPKI

SEQ ID NO: 2467555 - protein, 4 aa, Entamoeba dispar
TQPF

SEQ ID NO: 2467556 - protein, 5 aa, Entamoeba dispar
TQPFG

SEQ ID NO: 2467557 - protein, 4 aa, Entamoeba dispar
TQPI

SEQ ID NO: 2467558 - protein, 13 aa, Entamoeba dispar
TQPIKGAQTNGVS

SEQ ID NO: 2467559 - protein, 6 aa, Entamoeba dispar
TQPIPT

SEQ ID NO: 2467560 - protein, 10 aa, Entamoeba dispar
TQPKDKSPIP

SEQ ID NO: 2467561 - protein, 6 aa, Entamoeba dispar
TQPKRS

SEQ ID NO: 2467562 - protein, 12 aa, Entamoeba dispar
TQPKTTTPSSDD

SEQ ID NO: 2467563 - protein, 5 aa, Entamoeba dispar
TQPNS

SEQ ID NO: 2467564 - protein, 5 aa, Entamoeba dispar
TQPPG

SEQ ID NO: 2467565 - protein, 8 aa, Entamoeba dispar
TQPPQMEE

SEQ ID NO: 2467566 - protein, 9 aa, Entamoeba dispar
TQPPTPYQI

SEQ ID NO: 2467567 - protein, 8 aa, Entamoeba dispar
TQPPYKEH

SEQ ID NO: 2467568 - protein, 13 aa, Entamoeba dispar
TQPQMEEENSGII

SEQ ID NO: 2467569 - protein, 4 aa, Entamoeba dispar
TQPR

SEQ ID NO: 2467570 - protein, 5 aa, Entamoeba dispar
TQPRL

SEQ ID NO: 2467571 - protein, 6 aa, Entamoeba dispar
TQPRRI

SEQ ID NO: 2467572 - protein, 4 aa, Entamoeba dispar
TQPS

SEQ ID NO: 2467573 - protein, 6 aa, Entamoeba dispar
TQPSDA

SEQ ID NO: 2467574 - protein, 11 aa, Entamoeba dispar
TQPSEKEDYSD

SEQ ID NO: 2467575 - protein, 6 aa, Entamoeba dispar
TQPSFQ

SEQ ID NO: 2467576 - protein, 5 aa, Entamoeba dispar
TQPSK

SEQ ID NO: 2467577 - protein, 6 aa, Entamoeba dispar
TQPTPV

SEQ ID NO: 2467578 - protein, 6 aa, Entamoeba dispar
TQPTTS

SEQ ID NO: 2467579 - protein, 6 aa, Entamoeba dispar
TQPVEN

SEQ ID NO: 2467580 - protein, 8 aa, Entamoeba dispar
TQPYDPSR

SEQ ID NO: 2467581 - protein, 12 aa, Entamoeba dispar
TQQDKEEARKLD

SEQ ID NO: 2467582 - protein, 9 aa, Entamoeba dispar
TQQDKKELL

SEQ ID NO: 2467583 - protein, 17 aa, Entamoeba dispar
TQQEESQESKTTEEPIP

SEQ ID NO: 2467584 - protein, 5 aa, Entamoeba dispar
TQQFT

SEQ ID NO: 2467585 - protein, 7 aa, Entamoeba dispar
TQQGPNS

SEQ ID NO: 2467586 - protein, 11 aa, Entamoeba dispar
TQQIGIPSNGI

SEQ ID NO: 2467587 - protein, 17 aa, Entamoeba dispar
TQQINTRGYPRPVSATG

SEQ ID NO: 2467588 - protein, 15 aa, Entamoeba dispar
TQQKKNKDIPEGGSK

SEQ ID NO: 2467589 - protein, 15 aa, Entamoeba dispar
TQQKLRQSETIPIKD

SEQ ID NO: 2467590 - protein, 16 aa, Entamoeba dispar
TQQKLSQMKKKNEPFN

SEQ ID NO: 2467591 - protein, 4 aa, Entamoeba dispar
TQQL

SEQ ID NO: 2467592 - protein, 10 aa, Entamoeba dispar
TQQNAPEDYE

SEQ ID NO: 2467593 - protein, 9 aa, Entamoeba dispar
TQQNVGESL

SEQ ID NO: 2467594 - protein, 20 aa, Entamoeba dispar
TQQNWKSNDSSIDENFCSSF

SEQ ID NO: 2467595 - protein, 6 aa, Entamoeba dispar
TQQPIQ

SEQ ID NO: 2467596 - protein, 7 aa, Entamoeba dispar
TQQPLSR

SEQ ID NO: 2467597 - protein, 4 aa, Entamoeba dispar
TQQQ

SEQ ID NO: 2467598 - protein, 6 aa, Entamoeba dispar
TQQQKD

SEQ ID NO: 2467599 - protein, 11 aa, Entamoeba dispar
TQQQQPKSNNE

SEQ ID NO: 2467600 - protein, 33 aa, Entamoeba dispar
TQQQSQNTNPFIDNSSQKSDPLNKTQKKETNPF

SEQ ID NO: 2467601 - protein, 6 aa, Entamoeba dispar
TQQRGF

SEQ ID NO: 2467602 - protein, 5 aa, Entamoeba dispar
TQQRK

SEQ ID NO: 2467603 - protein, 7 aa, Entamoeba dispar
TQQSENL

SEQ ID NO: 2467604 - protein, 8 aa, Entamoeba dispar
TQQSSQLL

SEQ ID NO: 2467605 - protein, 14 aa, Entamoeba dispar
TQQTEDVLKVLSSL

SEQ ID NO: 2467606 - protein, 11 aa, Entamoeba dispar
TQQTNANPLSA

SEQ ID NO: 2467607 - protein, 11 aa, Entamoeba dispar
TQRAPLPNPFI

SEQ ID NO: 2467608 - protein, 8 aa, Entamoeba dispar
TQREPDVN

SEQ ID NO: 2467609 - protein, 15 aa, Entamoeba dispar
TQREQDYDKSSFDQK

SEQ ID NO: 2467610 - protein, 4 aa, Entamoeba dispar
TQRI

SEQ ID NO: 2467611 - protein, 5 aa, Entamoeba dispar
TQRIN

SEQ ID NO: 2467612 - protein, 14 aa, Entamoeba dispar
TQRKEDITNGGYNM

SEQ ID NO: 2467613 - protein, 9 aa, Entamoeba dispar
TQRKINPEM

SEQ ID NO: 2467614 - protein, 4 aa, Entamoeba dispar
TQRR

SEQ ID NO: 2467615 - protein, 9 aa, Entamoeba dispar
TQRSTVDST

SEQ ID NO: 2467616 - protein, 17 aa, Entamoeba dispar
TQRYSNLQSNHYFIVDA

SEQ ID NO: 2467617 - protein, 32 aa, Entamoeba dispar
TQSAARIKKSMEEEEKAKAAKGKEEEKEKEQQ

SEQ ID NO: 2467618 - protein, 5 aa, Entamoeba dispar
TQSAS

SEQ ID NO: 2467619 - protein, 6 aa, Entamoeba dispar
TQSDPR

SEQ ID NO: 2467620 - protein, 11 aa, Entamoeba dispar
TQSDSNQKQYE

SEQ ID NO: 2467621 - protein, 35 aa, Entamoeba dispar
TQSEEVFNENEQRKRKKETSELSPKRSLEEMTQNE

SEQ ID NO: 2467622 - protein, 8 aa, Entamoeba dispar
TQSEKQKD

SEQ ID NO: 2467623 - protein, 8 aa, Entamoeba dispar
TQSEKVDD

SEQ ID NO: 2467624 - protein, 9 aa, Entamoeba dispar
TQSEKYGTT

SEQ ID NO: 2467625 - protein, 7 aa, Entamoeba dispar
TQSFNRD

SEQ ID NO: 2467626 - protein, 15 aa, Entamoeba dispar
TQSHSSFQEKLPENL

SEQ ID NO: 2467627 - protein, 9 aa, Entamoeba dispar
TQSKLKAED

SEQ ID NO: 2467628 - protein, 5 aa, Entamoeba dispar
TQSKM

SEQ ID NO: 2467629 - protein, 5 aa, Entamoeba dispar
TQSLA

SEQ ID NO: 2467630 - protein, 11 aa, Entamoeba dispar
TQSLGGAAENL

SEQ ID NO: 2467631 - protein, 10 aa, Entamoeba dispar
TQSLNENQLA

SEQ ID NO: 2467632 - protein, 5 aa, Entamoeba dispar
TQSMK

SEQ ID NO: 2467633 - protein, 4 aa, Entamoeba dispar
TQSN

SEQ ID NO: 2467634 - protein, 11 aa, Entamoeba dispar
TQSNNPDGKKH

SEQ ID NO: 2467635 - protein, 8 aa, Entamoeba dispar
TQSNTKDE

SEQ ID NO: 2467636 - protein, 8 aa, Entamoeba dispar
TQSPAGVT

SEQ ID NO: 2467637 - protein, 5 aa, Entamoeba dispar
TQSQC

SEQ ID NO: 2467638 - protein, 11 aa, Entamoeba dispar
TQSQDTSNQNI

SEQ ID NO: 2467639 - protein, 8 aa, Entamoeba dispar
TQSQSENN

SEQ ID NO: 2467640 - protein, 8 aa, Entamoeba dispar
TQSRTTTL

SEQ ID NO: 2467641 - protein, 6 aa, Entamoeba dispar
TQSSFG

SEQ ID NO: 2467642 - protein, 5 aa, Entamoeba dispar
TQSSN

SEQ ID NO: 2467643 - protein, 8 aa, Entamoeba dispar
TQSSQTNN

SEQ ID NO: 2467644 - protein, 5 aa, Entamoeba dispar
TQSSY

SEQ ID NO: 2467645 - protein, 4 aa, Entamoeba dispar
TQST

SEQ ID NO: 2467646 - protein, 17 aa, Entamoeba dispar
TQSYKNYLTSNNLSYSY

SEQ ID NO: 2467647 - protein, 5 aa, Entamoeba dispar
TQTAQ

SEQ ID NO: 2467648 - protein, 20 aa, Entamoeba dispar
TQTDAMKTDFTRKGKREIKG

SEQ ID NO: 2467649 - protein, 7 aa, Entamoeba dispar
TQTELEH

SEQ ID NO: 2467650 - protein, 14 aa, Entamoeba dispar
TQTETTHKKIEETN

SEQ ID NO: 2467651 - protein, 4 aa, Entamoeba dispar
TQTG

SEQ ID NO: 2467652 - protein, 9 aa, Entamoeba dispar
TQTGKSKGY

SEQ ID NO: 2467653 - protein, 6 aa, Entamoeba dispar
TQTHNQ

SEQ ID NO: 2467654 - protein, 5 aa, Entamoeba dispar
TQTHS

SEQ ID NO: 2467655 - protein, 4 aa, Entamoeba dispar
TQTI

SEQ ID NO: 2467656 - protein, 4 aa, Entamoeba dispar
TQTK

SEQ ID NO: 2467657 - protein, 7 aa, Entamoeba dispar
TQTKSVQ

SEQ ID NO: 2467658 - protein, 4 aa, Entamoeba dispar
TQTL

SEQ ID NO: 2467659 - protein, 7 aa, Entamoeba dispar
TQTNPSA

SEQ ID NO: 2467660 - protein, 7 aa, Entamoeba dispar
TQTPGRY

SEQ ID NO: 2467661 - protein, 11 aa, Entamoeba dispar
TQTPNLNDSSL

SEQ ID NO: 2467662 - protein, 17 aa, Entamoeba dispar
TQTSAKKCFADKKDQLQ

SEQ ID NO: 2467663 - protein, 5 aa, Entamoeba dispar
TQTSS

SEQ ID NO: 2467664 - protein, 6 aa, Entamoeba dispar
TQTTKI

SEQ ID NO: 2467665 - protein, 5 aa, Entamoeba dispar
TQTVS

SEQ ID NO: 2467666 - protein, 14 aa, Entamoeba dispar
TQTWDPETASSKMK

SEQ ID NO: 2467667 - protein, 14 aa, Entamoeba dispar
TQTWDPETSSKKMK

SEQ ID NO: 2467668 - protein, 9 aa, Entamoeba dispar
TQTYRSPRN

SEQ ID NO: 2467669 - protein, 5 aa, Entamoeba dispar
TQVNN

SEQ ID NO: 2467670 - protein, 6 aa, Entamoeba dispar
TQVSKA

SEQ ID NO: 2467671 - protein, 162 aa, Entamoeba dispar
TQYAQKDQEEVPKVQPTGKKWTPKVAPAPEVPQPTYQRPTVPKPTYRPPQQTIPEPVQEEQPQEQCQEEQQPQEQYQEEQQPEQQYQEEQPQEQYQEEQPQEQYQEEQQSEQQYQEEQQSEQQYQEEPVQEEPQQYEEAPQEEVSSVPPLPPKPRQQQGETY

SEQ ID NO: 2467672 - protein, 9 aa, Entamoeba dispar
TQYATNQDN

SEQ ID NO: 2467673 - protein, 8 aa, Entamoeba dispar
TQYEGENQ

SEQ ID NO: 2467674 - protein, 5 aa, Entamoeba dispar
TQYGG

SEQ ID NO: 2467675 - protein, 4 aa, Entamoeba dispar
TQYN

SEQ ID NO: 2467676 - protein, 5 aa, Entamoeba dispar
TQYQY

SEQ ID NO: 2467677 - protein, 8 aa, Entamoeba dispar
TRAEMEKA

SEQ ID NO: 2467678 - protein, 16 aa, Entamoeba dispar
TRAGYLTSEGKRKVIK

SEQ ID NO: 2467679 - protein, 6 aa, Entamoeba dispar
TRAHTE

SEQ ID NO: 2467680 - protein, 17 aa, Entamoeba dispar
TRANKQLKTKIAASTVN

SEQ ID NO: 2467681 - protein, 6 aa, Entamoeba dispar
TRAPSL

SEQ ID NO: 2467682 - protein, 15 aa, Entamoeba dispar
TRASEMVSSETRNGI

SEQ ID NO: 2467683 - protein, 4 aa, Entamoeba dispar
TRCS

SEQ ID NO: 2467684 - protein, 14 aa, Entamoeba dispar
TRDDKEVNDITTNK

SEQ ID NO: 2467685 - protein, 5 aa, Entamoeba dispar
TRDEI

SEQ ID NO: 2467686 - protein, 7 aa, Entamoeba dispar
TRDGKSY

SEQ ID NO: 2467687 - protein, 6 aa, Entamoeba dispar
TRDKND

SEQ ID NO: 2467688 - protein, 5 aa, Entamoeba dispar
TRDNG

SEQ ID NO: 2467689 - protein, 12 aa, Entamoeba dispar
TRDQSDRNRTSP

SEQ ID NO: 2467690 - protein, 10 aa, Entamoeba dispar
TRDTENKSEI

SEQ ID NO: 2467691 - protein, 37 aa, Entamoeba dispar
TREEEKEEEKEEEKEVEKEVEKEVEKEVEKDNRSGKY

SEQ ID NO: 2467692 - protein, 8 aa, Entamoeba dispar
TREELKEA

SEQ ID NO: 2467693 - protein, 4 aa, Entamoeba dispar
TREG

SEQ ID NO: 2467694 - protein, 5 aa, Entamoeba dispar
TREGQ

SEQ ID NO: 2467695 - protein, 5 aa, Entamoeba dispar
TREIE

SEQ ID NO: 2467696 - protein, 4 aa, Entamoeba dispar
TREL

SEQ ID NO: 2467697 - protein, 5 aa, Entamoeba dispar
TRELG

SEQ ID NO: 2467698 - protein, 6 aa, Entamoeba dispar
TRELTQ

SEQ ID NO: 2467699 - protein, 4 aa, Entamoeba dispar
TREN

SEQ ID NO: 2467700 - protein, 6 aa, Entamoeba dispar
TREPNV

SEQ ID NO: 2467701 - protein, 4 aa, Entamoeba dispar
TRER

SEQ ID NO: 2467702 - protein, 13 aa, Entamoeba dispar
TRETKAVKPYSQM

SEQ ID NO: 2467703 - protein, 10 aa, Entamoeba dispar
TRETNPKKRM

SEQ ID NO: 2467704 - protein, 7 aa, Entamoeba dispar
TREYDQQ

SEQ ID NO: 2467705 - protein, 17 aa, Entamoeba dispar
TREYKQTALKSTQNDFS

SEQ ID NO: 2467706 - protein, 5 aa, Entamoeba dispar
TRFQQ

SEQ ID NO: 2467707 - protein, 8 aa, Entamoeba dispar
TRGDTFTN

SEQ ID NO: 2467708 - protein, 5 aa, Entamoeba dispar
TRGFD

SEQ ID NO: 2467709 - protein, 5 aa, Entamoeba dispar
TRGGD

SEQ ID NO: 2467710 - protein, 8 aa, Entamoeba dispar
TRGGKNAC

SEQ ID NO: 2467711 - protein, 7 aa, Entamoeba dispar
TRGGKVV

SEQ ID NO: 2467712 - protein, 12 aa, Entamoeba dispar
TRGLEKKQRFTR

SEQ ID NO: 2467713 - protein, 16 aa, Entamoeba dispar
TRGMRGGYRGNNRGNL

SEQ ID NO: 2467714 - protein, 8 aa, Entamoeba dispar
TRGNTPKY

SEQ ID NO: 2467715 - protein, 5 aa, Entamoeba dispar
TRGPV

SEQ ID NO: 2467716 - protein, 4 aa, Entamoeba dispar
TRGV

SEQ ID NO: 2467717 - protein, 6 aa, Entamoeba dispar
TRHDIG

SEQ ID NO: 2467718 - protein, 13 aa, Entamoeba dispar
TRHNGTGGKSIYG

SEQ ID NO: 2467719 - protein, 4 aa, Entamoeba dispar
TRHP

SEQ ID NO: 2467720 - protein, 7 aa, Entamoeba dispar
TRIDDSK

SEQ ID NO: 2467721 - protein, 6 aa, Entamoeba dispar
TRIENK

SEQ ID NO: 2467722 - protein, 6 aa, Entamoeba dispar
TRIGKS

SEQ ID NO: 2467723 - protein, 5 aa, Entamoeba dispar
TRIGR

SEQ ID NO: 2467724 - protein, 9 aa, Entamoeba dispar
TRINQKGKK

SEQ ID NO: 2467725 - protein, 6 aa, Entamoeba dispar
TRIQEE

SEQ ID NO: 2467726 - protein, 10 aa, Entamoeba dispar
TRIQGNSKNI

SEQ ID NO: 2467727 - protein, 4 aa, Entamoeba dispar
TRKA

SEQ ID NO: 2467728 - protein, 16 aa, Entamoeba dispar
TRKACNTSNCPPKPKH

SEQ ID NO: 2467729 - protein, 9 aa, Entamoeba dispar
TRKDTKVGV

SEQ ID NO: 2467730 - protein, 8 aa, Entamoeba dispar
TRKEDDEV

SEQ ID NO: 2467731 - protein, 26 aa, Entamoeba dispar
TRKEELDSNENRKKENEQKKGNELDS

SEQ ID NO: 2467732 - protein, 9 aa, Entamoeba dispar
TRKEIEENN

SEQ ID NO: 2467733 - protein, 8 aa, Entamoeba dispar
TRKENEVG

SEQ ID NO: 2467734 - protein, 23 aa, Entamoeba dispar
TRKENNETKDIPEEIENNKSNLN

SEQ ID NO: 2467735 - protein, 11 aa, Entamoeba dispar
TRKETNEVPMS

SEQ ID NO: 2467736 - protein, 4 aa, Entamoeba dispar
TRKG

SEQ ID NO: 2467737 - protein, 5 aa, Entamoeba dispar
TRKHD

SEQ ID NO: 2467738 - protein, 15 aa, Entamoeba dispar
TRKKEEKEPKNTQTV

SEQ ID NO: 2467739 - protein, 6 aa, Entamoeba dispar
TRKMDN

SEQ ID NO: 2467740 - protein, 7 aa, Entamoeba dispar
TRKNTTT

SEQ ID NO: 2467741 - protein, 8 aa, Entamoeba dispar
TRKPPKYE

SEQ ID NO: 2467742 - protein, 6 aa, Entamoeba dispar
TRKQCR

SEQ ID NO: 2467743 - protein, 25 aa, Entamoeba dispar
TRKQGDASEVEEDIEKYTTPEYRSP

SEQ ID NO: 2467744 - protein, 11 aa, Entamoeba dispar
TRKQNQSQLKE

SEQ ID NO: 2467745 - protein, 9 aa, Entamoeba dispar
TRKSNEGQI

SEQ ID NO: 2467746 - protein, 13 aa, Entamoeba dispar
TRKTPCGEGSKTW

SEQ ID NO: 2467747 - protein, 6 aa, Entamoeba dispar
TRKTTY

SEQ ID NO: 2467748 - protein, 10 aa, Entamoeba dispar
TRLDQSSYED

SEQ ID NO: 2467749 - protein, 5 aa, Entamoeba dispar
TRLSE

SEQ ID NO: 2467750 - protein, 5 aa, Entamoeba dispar
TRLVQ

SEQ ID NO: 2467751 - protein, 6 aa, Entamoeba dispar
TRNAAS

SEQ ID NO: 2467752 - protein, 17 aa, Entamoeba dispar
TRNEANKEREKNLNNKI

SEQ ID NO: 2467753 - protein, 8 aa, Entamoeba dispar
TRNEECDE

SEQ ID NO: 2467754 - protein, 5 aa, Entamoeba dispar
TRNEL

SEQ ID NO: 2467755 - protein, 5 aa, Entamoeba dispar
TRNGI

SEQ ID NO: 2467756 - protein, 5 aa, Entamoeba dispar
TRNKL

SEQ ID NO: 2467757 - protein, 6 aa, Entamoeba dispar
TRNKQA

SEQ ID NO: 2467758 - protein, 7 aa, Entamoeba dispar
TRNLDGT

SEQ ID NO: 2467759 - protein, 10 aa, Entamoeba dispar
TRNNPNGREF

SEQ ID NO: 2467760 - protein, 6 aa, Entamoeba dispar
TRNNRA

SEQ ID NO: 2467761 - protein, 6 aa, Entamoeba dispar
TRNPQF

SEQ ID NO: 2467762 - protein, 8 aa, Entamoeba dispar
TRNQLNDD

SEQ ID NO: 2467763 - protein, 9 aa, Entamoeba dispar
TRNTEPHYP

SEQ ID NO: 2467764 - protein, 6 aa, Entamoeba dispar
TRPDCC

SEQ ID NO: 2467765 - protein, 6 aa, Entamoeba dispar
TRPDTY

SEQ ID NO: 2467766 - protein, 8 aa, Entamoeba dispar
TRPELGPT

SEQ ID NO: 2467767 - protein, 4 aa, Entamoeba dispar
TRPI

SEQ ID NO: 2467768 - protein, 9 aa, Entamoeba dispar
TRPKNKTYH

SEQ ID NO: 2467769 - protein, 4 aa, Entamoeba dispar
TRPL

SEQ ID NO: 2467770 - protein, 4 aa, Entamoeba dispar
TRPQ

SEQ ID NO: 2467771 - protein, 11 aa, Entamoeba dispar
TRPSVQENPNI

SEQ ID NO: 2467772 - protein, 10 aa, Entamoeba dispar
TRPTKKSLVT

SEQ ID NO: 2467773 - protein, 11 aa, Entamoeba dispar
TRPTKSSKKTL

SEQ ID NO: 2467774 - protein, 5 aa, Entamoeba dispar
TRPYC

SEQ ID NO: 2467775 - protein, 6 aa, Entamoeba dispar
TRQDAG

SEQ ID NO: 2467776 - protein, 6 aa, Entamoeba dispar
TRQIEG

SEQ ID NO: 2467777 - protein, 11 aa, Entamoeba dispar
TRQIQKQNEEI

SEQ ID NO: 2467778 - protein, 8 aa, Entamoeba dispar
TRQKTSYP

SEQ ID NO: 2467779 - protein, 4 aa, Entamoeba dispar
TRQN

SEQ ID NO: 2467780 - protein, 15 aa, Entamoeba dispar
TRQPLEGRSRDGGLR

SEQ ID NO: 2467781 - protein, 10 aa, Entamoeba dispar
TRQQPTPTIN

SEQ ID NO: 2467782 - protein, 10 aa, Entamoeba dispar
TRRDPKGTHS

SEQ ID NO: 2467783 - protein, 6 aa, Entamoeba dispar
TRRKGI

SEQ ID NO: 2467784 - protein, 5 aa, Entamoeba dispar
TRRKP

SEQ ID NO: 2467785 - protein, 15 aa, Entamoeba dispar
TRRKRRKGIENNQGS

SEQ ID NO: 2467786 - protein, 9 aa, Entamoeba dispar
TRRNTIQRK

SEQ ID NO: 2467787 - protein, 14 aa, Entamoeba dispar
TRRNTRQKERRIQE

SEQ ID NO: 2467788 - protein, 6 aa, Entamoeba dispar
TRRPRN

SEQ ID NO: 2467789 - protein, 9 aa, Entamoeba dispar
TRRQATSNI

SEQ ID NO: 2467790 - protein, 32 aa, Entamoeba dispar
TRRSNYSPQSTPSPNSDDTPTPVSSARIRGRR

SEQ ID NO: 2467791 - protein, 6 aa, Entamoeba dispar
TRRSVR

SEQ ID NO: 2467792 - protein, 16 aa, Entamoeba dispar
TRRTKKMKTKIAPPTI

SEQ ID NO: 2467793 - protein, 6 aa, Entamoeba dispar
TRSAGS

SEQ ID NO: 2467794 - protein, 17 aa, Entamoeba dispar
TRSATLGGKRIPLVIPK

SEQ ID NO: 2467795 - protein, 14 aa, Entamoeba dispar
TRSDEQLPSQEEAT

SEQ ID NO: 2467796 - protein, 5 aa, Entamoeba dispar
TRSEN

SEQ ID NO: 2467797 - protein, 14 aa, Entamoeba dispar
TRSGITHDTTGTSP

SEQ ID NO: 2467798 - protein, 4 aa, Entamoeba dispar
TRSI

SEQ ID NO: 2467799 - protein, 9 aa, Entamoeba dispar
TRSKEQAQY

SEQ ID NO: 2467800 - protein, 8 aa, Entamoeba dispar
TRSKKAQV

SEQ ID NO: 2467801 - protein, 7 aa, Entamoeba dispar
TRSKNSI

SEQ ID NO: 2467802 - protein, 33 aa, Entamoeba dispar
TRSLDITSSNDSEYEFDTTSDPKKINSNESITE

SEQ ID NO: 2467803 - protein, 13 aa, Entamoeba dispar
TRSLEDKHAHARE

SEQ ID NO: 2467804 - protein, 7 aa, Entamoeba dispar
TRSLRQS

SEQ ID NO: 2467805 - protein, 9 aa, Entamoeba dispar
TRSPEMKKQ

SEQ ID NO: 2467806 - protein, 7 aa, Entamoeba dispar
TRSPPDY

SEQ ID NO: 2467807 - protein, 6 aa, Entamoeba dispar
TRSPSV

SEQ ID NO: 2467808 - protein, 6 aa, Entamoeba dispar
TRSQIE

SEQ ID NO: 2467809 - protein, 5 aa, Entamoeba dispar
TRSQL

SEQ ID NO: 2467810 - protein, 5 aa, Entamoeba dispar
TRSSD

SEQ ID NO: 2467811 - protein, 8 aa, Entamoeba dispar
TRSSEVRP

SEQ ID NO: 2467812 - protein, 9 aa, Entamoeba dispar
TRSSGPDSP

SEQ ID NO: 2467813 - protein, 10 aa, Entamoeba dispar
TRSSSTEQVI

SEQ ID NO: 2467814 - protein, 6 aa, Entamoeba dispar
TRSTEQ

SEQ ID NO: 2467815 - protein, 11 aa, Entamoeba dispar
TRSTKHPLGGT

SEQ ID NO: 2467816 - protein, 16 aa, Entamoeba dispar
TRSVTDSLEKQRMGSN

SEQ ID NO: 2467817 - protein, 14 aa, Entamoeba dispar
TRTAEKSSTPKYNE

SEQ ID NO: 2467818 - protein, 6 aa, Entamoeba dispar
TRTARF

SEQ ID NO: 2467819 - protein, 13 aa, Entamoeba dispar
TRTFNKKGVTIPS

SEQ ID NO: 2467820 - protein, 4 aa, Entamoeba dispar
TRTG

SEQ ID NO: 2467821 - protein, 7 aa, Entamoeba dispar
TRTHTYE

SEQ ID NO: 2467822 - protein, 5 aa, Entamoeba dispar
TRTIG

SEQ ID NO: 2467823 - protein, 13 aa, Entamoeba dispar
TRTINEKDQCKKK

SEQ ID NO: 2467824 - protein, 17 aa, Entamoeba dispar
TRTKGSAEESGRRESEV

SEQ ID NO: 2467825 - protein, 10 aa, Entamoeba dispar
TRTKQDSPEV

SEQ ID NO: 2467826 - protein, 7 aa, Entamoeba dispar
TRTMGEL

SEQ ID NO: 2467827 - protein, 7 aa, Entamoeba dispar
TRTPEQC

SEQ ID NO: 2467828 - protein, 8 aa, Entamoeba dispar
TRTPVQVR

SEQ ID NO: 2467829 - protein, 8 aa, Entamoeba dispar
TRTQERKQ

SEQ ID NO: 2467830 - protein, 6 aa, Entamoeba dispar
TRTRSV

SEQ ID NO: 2467831 - protein, 13 aa, Entamoeba dispar
TRTSASKRTISPR

SEQ ID NO: 2467832 - protein, 7 aa, Entamoeba dispar
TRTTSDI

SEQ ID NO: 2467833 - protein, 32 aa, Entamoeba dispar
TRTVNPKSMKSERSWQSKNATRAIYSNSNNSI

SEQ ID NO: 2467834 - protein, 7 aa, Entamoeba dispar
TRVEKKD

SEQ ID NO: 2467835 - protein, 4 aa, Entamoeba dispar
TRVN

SEQ ID NO: 2467836 - protein, 6 aa, Entamoeba dispar
TRYKGE

SEQ ID NO: 2467837 - protein, 10 aa, Entamoeba dispar
TRYKPGSDMS

SEQ ID NO: 2467838 - protein, 4 aa, Entamoeba dispar
TRYL

SEQ ID NO: 2467839 - protein, 6 aa, Entamoeba dispar
TRYPRT

SEQ ID NO: 2467840 - protein, 8 aa, Entamoeba dispar
TSAANSQT

SEQ ID NO: 2467841 - protein, 6 aa, Entamoeba dispar
TSADEA

SEQ ID NO: 2467842 - protein, 9 aa, Entamoeba dispar
TSADGSITI

SEQ ID NO: 2467843 - protein, 8 aa, Entamoeba dispar
TSAEDKTT

SEQ ID NO: 2467844 - protein, 10 aa, Entamoeba dispar
TSAGKTATAE

SEQ ID NO: 2467845 - protein, 9 aa, Entamoeba dispar
TSAGPLCDE

SEQ ID NO: 2467846 - protein, 8 aa, Entamoeba dispar
TSAHSETI

SEQ ID NO: 2467847 - protein, 11 aa, Entamoeba dispar
TSAIGGKPLRD

SEQ ID NO: 2467848 - protein, 10 aa, Entamoeba dispar
TSAITGEGIP

SEQ ID NO: 2467849 - protein, 9 aa, Entamoeba dispar
TSAKEGSNV

SEQ ID NO: 2467850 - protein, 6 aa, Entamoeba dispar
TSAKER

SEQ ID NO: 2467851 - protein, 10 aa, Entamoeba dispar
TSAKKKSNIN

SEQ ID NO: 2467852 - protein, 8 aa, Entamoeba dispar
TSAKSNIN

SEQ ID NO: 2467853 - protein, 9 aa, Entamoeba dispar
TSAKTNNNV

SEQ ID NO: 2467854 - protein, 8 aa, Entamoeba dispar
TSALSSNK

SEQ ID NO: 2467855 - protein, 11 aa, Entamoeba dispar
TSAMSNGDISQ

SEQ ID NO: 2467856 - protein, 4 aa, Entamoeba dispar
TSAP

SEQ ID NO: 2467857 - protein, 21 aa, Entamoeba dispar
TSAPAQTSQKENTKQEETKVQ

SEQ ID NO: 2467858 - protein, 6 aa, Entamoeba dispar
TSAPHY

SEQ ID NO: 2467859 - protein, 7 aa, Entamoeba dispar
TSAPTAH

SEQ ID NO: 2467860 - protein, 8 aa, Entamoeba dispar
TSASLNLK

SEQ ID NO: 2467861 - protein, 5 aa, Entamoeba dispar
TSAST

SEQ ID NO: 2467862 - protein, 10 aa, Entamoeba dispar
TSASTKSKPF

SEQ ID NO: 2467863 - protein, 8 aa, Entamoeba dispar
TSATDDRK

SEQ ID NO: 2467864 - protein, 15 aa, Entamoeba dispar
TSATFRKTKRSKQTV

SEQ ID NO: 2467865 - protein, 4 aa, Entamoeba dispar
TSCK

SEQ ID NO: 2467866 - protein, 10 aa, Entamoeba dispar
TSCVGSKDTF

SEQ ID NO: 2467867 - protein, 14 aa, Entamoeba dispar
TSDDAETVNKQNYP

SEQ ID NO: 2467868 - protein, 8 aa, Entamoeba dispar
TSDEFESQ

SEQ ID NO: 2467869 - protein, 13 aa, Entamoeba dispar
TSDFDTRDAALSA

SEQ ID NO: 2467870 - protein, 13 aa, Entamoeba dispar
TSDGNKASTNNKY

SEQ ID NO: 2467871 - protein, 9 aa, Entamoeba dispar
TSDGSARVR

SEQ ID NO: 2467872 - protein, 5 aa, Entamoeba dispar
TSDHK

SEQ ID NO: 2467873 - protein, 10 aa, Entamoeba dispar
TSDIRKSKTF

SEQ ID NO: 2467874 - protein, 7 aa, Entamoeba dispar
TSDITKK

SEQ ID NO: 2467875 - protein, 8 aa, Entamoeba dispar
TSDKENYV

SEQ ID NO: 2467876 - protein, 7 aa, Entamoeba dispar
TSDKEVS

SEQ ID NO: 2467877 - protein, 20 aa, Entamoeba dispar
TSDKRQENDRNEITKVPTTH

SEQ ID NO: 2467878 - protein, 5 aa, Entamoeba dispar
TSDNN

SEQ ID NO: 2467879 - protein, 12 aa, Entamoeba dispar
TSDPKSETDNCT

SEQ ID NO: 2467880 - protein, 5 aa, Entamoeba dispar
TSDRI

SEQ ID NO: 2467881 - protein, 19 aa, Entamoeba dispar
TSDRLNATSKLNDQMQNTP

SEQ ID NO: 2467882 - protein, 10 aa, Entamoeba dispar
TSDSIEEIDS

SEQ ID NO: 2467883 - protein, 10 aa, Entamoeba dispar
TSEAKREMRL

SEQ ID NO: 2467884 - protein, 5 aa, Entamoeba dispar
TSEDV

SEQ ID NO: 2467885 - protein, 5 aa, Entamoeba dispar
TSEEE

SEQ ID NO: 2467886 - protein, 5 aa, Entamoeba dispar
TSEEQ

SEQ ID NO: 2467887 - protein, 17 aa, Entamoeba dispar
TSEESTPINLDCFVSCH

SEQ ID NO: 2467888 - protein, 12 aa, Entamoeba dispar
TSEEVAEDMAEN

SEQ ID NO: 2467889 - protein, 5 aa, Entamoeba dispar
TSEFI

SEQ ID NO: 2467890 - protein, 8 aa, Entamoeba dispar
TSEGVQSE

SEQ ID NO: 2467891 - protein, 7 aa, Entamoeba dispar
TSEIEQK

SEQ ID NO: 2467892 - protein, 8 aa, Entamoeba dispar
TSEIPEIN

SEQ ID NO: 2467893 - protein, 13 aa, Entamoeba dispar
TSEIQAKDKFSDD

SEQ ID NO: 2467894 - protein, 13 aa, Entamoeba dispar
TSEKEEEKVDSDF

SEQ ID NO: 2467895 - protein, 5 aa, Entamoeba dispar
TSEKI

SEQ ID NO: 2467896 - protein, 9 aa, Entamoeba dispar
TSELKKNDD

SEQ ID NO: 2467897 - protein, 6 aa, Entamoeba dispar
TSELPK

SEQ ID NO: 2467898 - protein, 11 aa, Entamoeba dispar
TSELQKENGQI

SEQ ID NO: 2467899 - protein, 6 aa, Entamoeba dispar
TSEMNN

SEQ ID NO: 2467900 - protein, 22 aa, Entamoeba dispar
TSENQTKKQTLIKRESTNREHL

SEQ ID NO: 2467901 - protein, 13 aa, Entamoeba dispar
TSEPITPSISTPR

SEQ ID NO: 2467902 - protein, 7 aa, Entamoeba dispar
TSEQPLT

SEQ ID NO: 2467903 - protein, 8 aa, Entamoeba dispar
TSERKTYV

SEQ ID NO: 2467904 - protein, 7 aa, Entamoeba dispar
TSERYVE

SEQ ID NO: 2467905 - protein, 10 aa, Entamoeba dispar
TSESEEDRKM

SEQ ID NO: 2467906 - protein, 8 aa, Entamoeba dispar
TSESNNIH

SEQ ID NO: 2467907 - protein, 8 aa, Entamoeba dispar
TSETGYHG

SEQ ID NO: 2467908 - protein, 5 aa, Entamoeba dispar
TSETK

SEQ ID NO: 2467909 - protein, 8 aa, Entamoeba dispar
TSETNEGW

SEQ ID NO: 2467910 - protein, 7 aa, Entamoeba dispar
TSETTKE

SEQ ID NO: 2467911 - protein, 10 aa, Entamoeba dispar
TSEVPKEKTI

SEQ ID NO: 2467912 - protein, 5 aa, Entamoeba dispar
TSEVQ

SEQ ID NO: 2467913 - protein, 5 aa, Entamoeba dispar
TSFEK

SEQ ID NO: 2467914 - protein, 7 aa, Entamoeba dispar
TSFGPGD

SEQ ID NO: 2467915 - protein, 6 aa, Entamoeba dispar
TSFGVN

SEQ ID NO: 2467916 - protein, 7 aa, Entamoeba dispar
TSFKPNK

SEQ ID NO: 2467917 - protein, 7 aa, Entamoeba dispar
TSFPLTD

SEQ ID NO: 2467918 - protein, 8 aa, Entamoeba dispar
TSFPPSRS

SEQ ID NO: 2467919 - protein, 4 aa, Entamoeba dispar
TSFQ

SEQ ID NO: 2467920 - protein, 18 aa, Entamoeba dispar
TSFSSKKEPQKSEQENYD

SEQ ID NO: 2467921 - protein, 13 aa, Entamoeba dispar
TSFSSSNKDKVKD

SEQ ID NO: 2467922 - protein, 12 aa, Entamoeba dispar
TSFSYRDKTYNE

SEQ ID NO: 2467923 - protein, 13 aa, Entamoeba dispar
TSGAISKNTPIGT

SEQ ID NO: 2467924 - protein, 14 aa, Entamoeba dispar
TSGALQSSTKLGTT

SEQ ID NO: 2467925 - protein, 7 aa, Entamoeba dispar
TSGDERF

SEQ ID NO: 2467926 - protein, 7 aa, Entamoeba dispar
TSGDPTM

SEQ ID NO: 2467927 - protein, 7 aa, Entamoeba dispar
TSGDSQF

SEQ ID NO: 2467928 - protein, 9 aa, Entamoeba dispar
TSGEERYHS

SEQ ID NO: 2467929 - protein, 7 aa, Entamoeba dispar
TSGEFIT

SEQ ID NO: 2467930 - protein, 6 aa, Entamoeba dispar
TSGFSD

SEQ ID NO: 2467931 - protein, 9 aa, Entamoeba dispar
TSGGDNTYR

SEQ ID NO: 2467932 - protein, 8 aa, Entamoeba dispar
TSGGGKTT

SEQ ID NO: 2467933 - protein, 6 aa, Entamoeba dispar
TSGITG

SEQ ID NO: 2467934 - protein, 4 aa, Entamoeba dispar
TSGK

SEQ ID NO: 2467935 - protein, 16 aa, Entamoeba dispar
TSGKTVPKYLNKKQKH

SEQ ID NO: 2467936 - protein, 4 aa, Entamoeba dispar
TSGL

SEQ ID NO: 2467937 - protein, 5 aa, Entamoeba dispar
TSGMT

SEQ ID NO: 2467938 - protein, 17 aa, Entamoeba dispar
TSGNGVDSLRDELKDDE

SEQ ID NO: 2467939 - protein, 5 aa, Entamoeba dispar
TSGNV

SEQ ID NO: 2467940 - protein, 6 aa, Entamoeba dispar
TSGNYG

SEQ ID NO: 2467941 - protein, 7 aa, Entamoeba dispar
TSGRLQY

SEQ ID NO: 2467942 - protein, 9 aa, Entamoeba dispar
TSGRNKSLK

SEQ ID NO: 2467943 - protein, 5 aa, Entamoeba dispar
TSGSD

SEQ ID NO: 2467944 - protein, 13 aa, Entamoeba dispar
TSGSENITRENSY

SEQ ID NO: 2467945 - protein, 9 aa, Entamoeba dispar
TSGSTGEPK

SEQ ID NO: 2467946 - protein, 10 aa, Entamoeba dispar
TSGSTGEPKI

SEQ ID NO: 2467947 - protein, 9 aa, Entamoeba dispar
TSGSTGNPK

SEQ ID NO: 2467948 - protein, 8 aa, Entamoeba dispar
TSGSTGVP

SEQ ID NO: 2467949 - protein, 6 aa, Entamoeba dispar
TSGTEL

SEQ ID NO: 2467950 - protein, 9 aa, Entamoeba dispar
TSGTGKGEL

SEQ ID NO: 2467951 - protein, 5 aa, Entamoeba dispar
TSGTI

SEQ ID NO: 2467952 - protein, 13 aa, Entamoeba dispar
TSGVTDNKKPPHK

SEQ ID NO: 2467953 - protein, 13 aa, Entamoeba dispar
TSGVTNNKKPPHK

SEQ ID NO: 2467954 - protein, 9 aa, Entamoeba dispar
TSHDSQFKN

SEQ ID NO: 2467955 - protein, 11 aa, Entamoeba dispar
TSHGNGTKITN

SEQ ID NO: 2467956 - protein, 4 aa, Entamoeba dispar
TSHI

SEQ ID NO: 2467957 - protein, 6 aa, Entamoeba dispar
TSHNRT

SEQ ID NO: 2467958 - protein, 5 aa, Entamoeba dispar
TSHRN

SEQ ID NO: 2467959 - protein, 6 aa, Entamoeba dispar
TSHSSV

SEQ ID NO: 2467960 - protein, 9 aa, Entamoeba dispar
TSIASSPSH

SEQ ID NO: 2467961 - protein, 9 aa, Entamoeba dispar
TSIDQANNI

SEQ ID NO: 2467962 - protein, 4 aa, Entamoeba dispar
TSIE

SEQ ID NO: 2467963 - protein, 5 aa, Entamoeba dispar
TSIEN

SEQ ID NO: 2467964 - protein, 6 aa, Entamoeba dispar
TSIGSY

SEQ ID NO: 2467965 - protein, 4 aa, Entamoeba dispar
TSIK

SEQ ID NO: 2467966 - protein, 7 aa, Entamoeba dispar
TSIKEGL

SEQ ID NO: 2467967 - protein, 9 aa, Entamoeba dispar
TSIKERGKD

SEQ ID NO: 2467968 - protein, 8 aa, Entamoeba dispar
TSIKNNRL

SEQ ID NO: 2467969 - protein, 14 aa, Entamoeba dispar
TSINENNEKKMEEE

SEQ ID NO: 2467970 - protein, 10 aa, Entamoeba dispar
TSINGSKRTR

SEQ ID NO: 2467971 - protein, 6 aa, Entamoeba dispar
TSINNN

SEQ ID NO: 2467972 - protein, 6 aa, Entamoeba dispar
TSINSN

SEQ ID NO: 2467973 - protein, 34 aa, Entamoeba dispar
TSIPEDLSEQRAVGATTPGINDTSVIQKDQTVMT

SEQ ID NO: 2467974 - protein, 16 aa, Entamoeba dispar
TSIPKPAAPPPPSTLL

SEQ ID NO: 2467975 - protein, 26 aa, Entamoeba dispar
TSIPVQRPKGRKKTNFSEEEEVPTES

SEQ ID NO: 2467976 - protein, 5 aa, Entamoeba dispar
TSIQK

SEQ ID NO: 2467977 - protein, 18 aa, Entamoeba dispar
TSIQKDGETFTSSQLERI

SEQ ID NO: 2467978 - protein, 5 aa, Entamoeba dispar
TSIQQ

SEQ ID NO: 2467979 - protein, 5 aa, Entamoeba dispar
TSIQT

SEQ ID NO: 2467980 - protein, 6 aa, Entamoeba dispar
TSIQTA

SEQ ID NO: 2467981 - protein, 4 aa, Entamoeba dispar
TSIR

SEQ ID NO: 2467982 - protein, 8 aa, Entamoeba dispar
TSISGKTV

SEQ ID NO: 2467983 - protein, 5 aa, Entamoeba dispar
TSISK

SEQ ID NO: 2467984 - protein, 8 aa, Entamoeba dispar
TSISNNEN

SEQ ID NO: 2467985 - protein, 8 aa, Entamoeba dispar
TSISPTGR

SEQ ID NO: 2467986 - protein, 5 aa, Entamoeba dispar
TSITS

SEQ ID NO: 2467987 - protein, 5 aa, Entamoeba dispar
TSITT

SEQ ID NO: 2467988 - protein, 10 aa, Entamoeba dispar
TSKDLLSETS

SEQ ID NO: 2467989 - protein, 6 aa, Entamoeba dispar
TSKDTI

SEQ ID NO: 2467990 - protein, 8 aa, Entamoeba dispar
TSKEFKGK

SEQ ID NO: 2467991 - protein, 9 aa, Entamoeba dispar
TSKEPFSKI

SEQ ID NO: 2467992 - protein, 9 aa, Entamoeba dispar
TSKEREKVD

SEQ ID NO: 2467993 - protein, 6 aa, Entamoeba dispar
TSKFSN

SEQ ID NO: 2467994 - protein, 5 aa, Entamoeba dispar
TSKGI

SEQ ID NO: 2467995 - protein, 15 aa, Entamoeba dispar
TSKIDKEKPFTFPQH

SEQ ID NO: 2467996 - protein, 12 aa, Entamoeba dispar
TSKIGRKRIDDK

SEQ ID NO: 2467997 - protein, 10 aa, Entamoeba dispar
TSKIKEKYTD

SEQ ID NO: 2467998 - protein, 5 aa, Entamoeba dispar
TSKIN

SEQ ID NO: 2467999 - protein, 6 aa, Entamoeba dispar
TSKIPK

SEQ ID NO: 2468000 - protein, 9 aa, Entamoeba dispar
TSKIPKIRE

SEQ ID NO: 2468001 - protein, 7 aa, Entamoeba dispar
TSKIRND

SEQ ID NO: 2468002 - protein, 12 aa, Entamoeba dispar
TSKKEAIESDHK

SEQ ID NO: 2468003 - protein, 7 aa, Entamoeba dispar
TSKKEIQ

SEQ ID NO: 2468004 - protein, 8 aa, Entamoeba dispar
TSKKKSTL

SEQ ID NO: 2468005 - protein, 10 aa, Entamoeba dispar
TSKKSSVETM

SEQ ID NO: 2468006 - protein, 13 aa, Entamoeba dispar
TSKLESKKKPKFD

SEQ ID NO: 2468007 - protein, 5 aa, Entamoeba dispar
TSKLK

SEQ ID NO: 2468008 - protein, 8 aa, Entamoeba dispar
TSKLSKND

SEQ ID NO: 2468009 - protein, 8 aa, Entamoeba dispar
TSKNEKSL

SEQ ID NO: 2468010 - protein, 12 aa, Entamoeba dispar
TSKNKSTEKPKV

SEQ ID NO: 2468011 - protein, 8 aa, Entamoeba dispar
TSKNYSSD

SEQ ID NO: 2468012 - protein, 4 aa, Entamoeba dispar
TSKP

SEQ ID NO: 2468013 - protein, 6 aa, Entamoeba dispar
TSKPLS

SEQ ID NO: 2468014 - protein, 10 aa, Entamoeba dispar
TSKPPKQFAE

SEQ ID NO: 2468015 - protein, 5 aa, Entamoeba dispar
TSKPQ

SEQ ID NO: 2468016 - protein, 7 aa, Entamoeba dispar
TSKPYNL

SEQ ID NO: 2468017 - protein, 8 aa, Entamoeba dispar
TSKQNKSV

SEQ ID NO: 2468018 - protein, 13 aa, Entamoeba dispar
TSKQSQCDEKEDL

SEQ ID NO: 2468019 - protein, 14 aa, Entamoeba dispar
TSKRASTNRDAAQQ

SEQ ID NO: 2468020 - protein, 8 aa, Entamoeba dispar
TSKRNPKY

SEQ ID NO: 2468021 - protein, 7 aa, Entamoeba dispar
TSKRSKL

SEQ ID NO: 2468022 - protein, 4 aa, Entamoeba dispar
TSKS

SEQ ID NO: 2468023 - protein, 7 aa, Entamoeba dispar
TSKSFTS

SEQ ID NO: 2468024 - protein, 7 aa, Entamoeba dispar
TSKSPQL

SEQ ID NO: 2468025 - protein, 9 aa, Entamoeba dispar
TSKTAKQQS

SEQ ID NO: 2468026 - protein, 9 aa, Entamoeba dispar
TSKTDDTKG

SEQ ID NO: 2468027 - protein, 7 aa, Entamoeba dispar
TSKTEPS

SEQ ID NO: 2468028 - protein, 14 aa, Entamoeba dispar
TSKTTGKNKSAIAE

SEQ ID NO: 2468029 - protein, 5 aa, Entamoeba dispar
TSKYA

SEQ ID NO: 2468030 - protein, 12 aa, Entamoeba dispar
TSLASSIPTVPD

SEQ ID NO: 2468031 - protein, 5 aa, Entamoeba dispar
TSLDE

SEQ ID NO: 2468032 - protein, 4 aa, Entamoeba dispar
TSLE

SEQ ID NO: 2468033 - protein, 8 aa, Entamoeba dispar
TSLEKEKE

SEQ ID NO: 2468034 - protein, 4 aa, Entamoeba dispar
TSLG

SEQ ID NO: 2468035 - protein, 4 aa, Entamoeba dispar
TSLK

SEQ ID NO: 2468036 - protein, 5 aa, Entamoeba dispar
TSLKE

SEQ ID NO: 2468037 - protein, 16 aa, Entamoeba dispar
TSLKENIQNTVTSLSD

SEQ ID NO: 2468038 - protein, 13 aa, Entamoeba dispar
TSLKGKKKNKGIN

SEQ ID NO: 2468039 - protein, 12 aa, Entamoeba dispar
TSLKSVSDSEKL

SEQ ID NO: 2468040 - protein, 24 aa, Entamoeba dispar
TSLNDSEEKIEKIKRNKETSQGIY

SEQ ID NO: 2468041 - protein, 8 aa, Entamoeba dispar
TSLNENKD

SEQ ID NO: 2468042 - protein, 8 aa, Entamoeba dispar
TSLNPDVQ

SEQ ID NO: 2468043 - protein, 12 aa, Entamoeba dispar
TSLPNGGQRNVD

SEQ ID NO: 2468044 - protein, 5 aa, Entamoeba dispar
TSLPP

SEQ ID NO: 2468045 - protein, 5 aa, Entamoeba dispar
TSLPQ

SEQ ID NO: 2468046 - protein, 7 aa, Entamoeba dispar
TSLPSHD

SEQ ID NO: 2468047 - protein, 5 aa, Entamoeba dispar
TSLQE

SEQ ID NO: 2468048 - protein, 8 aa, Entamoeba dispar
TSLQTKSN

SEQ ID NO: 2468049 - protein, 4 aa, Entamoeba dispar
TSLR

SEQ ID NO: 2468050 - protein, 10 aa, Entamoeba dispar
TSLRSNGVSP

SEQ ID NO: 2468051 - protein, 19 aa, Entamoeba dispar
TSLSDNTVTLRDRDTTKQI

SEQ ID NO: 2468052 - protein, 7 aa, Entamoeba dispar
TSLSSIS

SEQ ID NO: 2468053 - protein, 7 aa, Entamoeba dispar
TSLSSLT

SEQ ID NO: 2468054 - protein, 4 aa, Entamoeba dispar
TSLT

SEQ ID NO: 2468055 - protein, 8 aa, Entamoeba dispar
TSLTAGTE

SEQ ID NO: 2468056 - protein, 5 aa, Entamoeba dispar
TSLTT

SEQ ID NO: 2468057 - protein, 10 aa, Entamoeba dispar
TSLTYTPNQK

SEQ ID NO: 2468058 - protein, 4 aa, Entamoeba dispar
TSLV

SEQ ID NO: 2468059 - protein, 4 aa, Entamoeba dispar
TSLY

SEQ ID NO: 2468060 - protein, 6 aa, Entamoeba dispar
TSLYEG

SEQ ID NO: 2468061 - protein, 5 aa, Entamoeba dispar
TSMGY

SEQ ID NO: 2468062 - protein, 5 aa, Entamoeba dispar
TSMKE

SEQ ID NO: 2468063 - protein, 4 aa, Entamoeba dispar
TSML

SEQ ID NO: 2468064 - protein, 6 aa, Entamoeba dispar
TSMPPL

SEQ ID NO: 2468065 - protein, 4 aa, Entamoeba dispar
TSMQ

SEQ ID NO: 2468066 - protein, 5 aa, Entamoeba dispar
TSMTL

SEQ ID NO: 2468067 - protein, 5 aa, Entamoeba dispar
TSMTY

SEQ ID NO: 2468068 - protein, 14 aa, Entamoeba dispar
TSNDKRKEEIDKTV

SEQ ID NO: 2468069 - protein, 11 aa, Entamoeba dispar
TSNDPPQGELE

SEQ ID NO: 2468070 - protein, 7 aa, Entamoeba dispar
TSNDSTA

SEQ ID NO: 2468071 - protein, 8 aa, Entamoeba dispar
TSNDSTSE

SEQ ID NO: 2468072 - protein, 10 aa, Entamoeba dispar
TSNDTLSDSI

SEQ ID NO: 2468073 - protein, 8 aa, Entamoeba dispar
TSNFASSK

SEQ ID NO: 2468074 - protein, 13 aa, Entamoeba dispar
TSNFASSKLKSVY

SEQ ID NO: 2468075 - protein, 12 aa, Entamoeba dispar
TSNFNDESSTFN

SEQ ID NO: 2468076 - protein, 6 aa, Entamoeba dispar
TSNGEV

SEQ ID NO: 2468077 - protein, 16 aa, Entamoeba dispar
TSNGIQQANEVAQQIN

SEQ ID NO: 2468078 - protein, 12 aa, Entamoeba dispar
TSNGKQPKQSME

SEQ ID NO: 2468079 - protein, 5 aa, Entamoeba dispar
TSNID

SEQ ID NO: 2468080 - protein, 19 aa, Entamoeba dispar
TSNIETKSKGTSFERPASV

SEQ ID NO: 2468081 - protein, 9 aa, Entamoeba dispar
TSNKEDLID

SEQ ID NO: 2468082 - protein, 5 aa, Entamoeba dispar
TSNKK

SEQ ID NO: 2468083 - protein, 12 aa, Entamoeba dispar
TSNKTLSHEINS

SEQ ID NO: 2468084 - protein, 5 aa, Entamoeba dispar
TSNLD

SEQ ID NO: 2468085 - protein, 7 aa, Entamoeba dispar
TSNLPYP

SEQ ID NO: 2468086 - protein, 7 aa, Entamoeba dispar
TSNLSVS

SEQ ID NO: 2468087 - protein, 4 aa, Entamoeba dispar
TSNN

SEQ ID NO: 2468088 - protein, 6 aa, Entamoeba dispar
TSNNNY

SEQ ID NO: 2468089 - protein, 8 aa, Entamoeba dispar
TSNNPIDL

SEQ ID NO: 2468090 - protein, 10 aa, Entamoeba dispar
TSNPFGTTQS

SEQ ID NO: 2468091 - protein, 8 aa, Entamoeba dispar
TSNPFSGT

SEQ ID NO: 2468092 - protein, 8 aa, Entamoeba dispar
TSNPKENI

SEQ ID NO: 2468093 - protein, 9 aa, Entamoeba dispar
TSNPQIPSE

SEQ ID NO: 2468094 - protein, 5 aa, Entamoeba dispar
TSNPV

SEQ ID NO: 2468095 - protein, 9 aa, Entamoeba dispar
TSNQEEEDL

SEQ ID NO: 2468096 - protein, 6 aa, Entamoeba dispar
TSNQPI

SEQ ID NO: 2468097 - protein, 11 aa, Entamoeba dispar
TSNQQSDEGQK

SEQ ID NO: 2468098 - protein, 9 aa, Entamoeba dispar
TSNSGQGIP

SEQ ID NO: 2468099 - protein, 8 aa, Entamoeba dispar
TSNSIQKV

SEQ ID NO: 2468100 - protein, 7 aa, Entamoeba dispar
TSNSITQ

SEQ ID NO: 2468101 - protein, 8 aa, Entamoeba dispar
TSNSLERI

SEQ ID NO: 2468102 - protein, 8 aa, Entamoeba dispar
TSNSRNVG

SEQ ID NO: 2468103 - protein, 7 aa, Entamoeba dispar
TSNTISE

SEQ ID NO: 2468104 - protein, 12 aa, Entamoeba dispar
TSNTKRAEEKYN

SEQ ID NO: 2468105 - protein, 8 aa, Entamoeba dispar
TSNTKTLK

SEQ ID NO: 2468106 - protein, 10 aa, Entamoeba dispar
TSPAPNTTIK

SEQ ID NO: 2468107 - protein, 5 aa, Entamoeba dispar
TSPDF

SEQ ID NO: 2468108 - protein, 12 aa, Entamoeba dispar
TSPDFSKKTEQY

SEQ ID NO: 2468109 - protein, 9 aa, Entamoeba dispar
TSPDINPTL

SEQ ID NO: 2468110 - protein, 10 aa, Entamoeba dispar
TSPEASGEGV

SEQ ID NO: 2468111 - protein, 7 aa, Entamoeba dispar
TSPEIKN

SEQ ID NO: 2468112 - protein, 11 aa, Entamoeba dispar
TSPFRDKNYTC

SEQ ID NO: 2468113 - protein, 5 aa, Entamoeba dispar
TSPFS

SEQ ID NO: 2468114 - protein, 4 aa, Entamoeba dispar
TSPI

SEQ ID NO: 2468115 - protein, 13 aa, Entamoeba dispar
TSPINKKKTACSD

SEQ ID NO: 2468116 - protein, 10 aa, Entamoeba dispar
TSPKQERLTK

SEQ ID NO: 2468117 - protein, 7 aa, Entamoeba dispar
TSPKSLT

SEQ ID NO: 2468118 - protein, 9 aa, Entamoeba dispar
TSPLNYNPQ

SEQ ID NO: 2468119 - protein, 5 aa, Entamoeba dispar
TSPLT

SEQ ID NO: 2468120 - protein, 9 aa, Entamoeba dispar
TSPMKRRRS

SEQ ID NO: 2468121 - protein, 6 aa, Entamoeba dispar
TSPNDL

SEQ ID NO: 2468122 - protein, 8 aa, Entamoeba dispar
TSPNSLTG

SEQ ID NO: 2468123 - protein, 5 aa, Entamoeba dispar
TSPPV

SEQ ID NO: 2468124 - protein, 5 aa, Entamoeba dispar
TSPQN

SEQ ID NO: 2468125 - protein, 10 aa, Entamoeba dispar
TSPQPLLPGG

SEQ ID NO: 2468126 - protein, 5 aa, Entamoeba dispar
TSPRL

SEQ ID NO: 2468127 - protein, 23 aa, Entamoeba dispar
TSPTIQTSKPNYLPPKPNRLQYK

SEQ ID NO: 2468128 - protein, 7 aa, Entamoeba dispar
TSPTPAI

SEQ ID NO: 2468129 - protein, 25 aa, Entamoeba dispar
TSPTQIESNDFSEEFSEDNNTFNYR

SEQ ID NO: 2468130 - protein, 8 aa, Entamoeba dispar
TSPTYTSK

SEQ ID NO: 2468131 - protein, 5 aa, Entamoeba dispar
TSPVD

SEQ ID NO: 2468132 - protein, 14 aa, Entamoeba dispar
TSPYNPDYTTLQSA

SEQ ID NO: 2468133 - protein, 9 aa, Entamoeba dispar
TSQAPGSAI

SEQ ID NO: 2468134 - protein, 5 aa, Entamoeba dispar
TSQAY

SEQ ID NO: 2468135 - protein, 8 aa, Entamoeba dispar
TSQEVEVN

SEQ ID NO: 2468136 - protein, 13 aa, Entamoeba dispar
TSQFDSSNDYAEE

SEQ ID NO: 2468137 - protein, 11 aa, Entamoeba dispar
TSQGSFEADEN

SEQ ID NO: 2468138 - protein, 12 aa, Entamoeba dispar
TSQIEEKADAIS

SEQ ID NO: 2468139 - protein, 4 aa, Entamoeba dispar
TSQK

SEQ ID NO: 2468140 - protein, 7 aa, Entamoeba dispar
TSQKDNE

SEQ ID NO: 2468141 - protein, 8 aa, Entamoeba dispar
TSQKQGKD

SEQ ID NO: 2468142 - protein, 4 aa, Entamoeba dispar
TSQL

SEQ ID NO: 2468143 - protein, 9 aa, Entamoeba dispar
TSQNEIGSE

SEQ ID NO: 2468144 - protein, 4 aa, Entamoeba dispar
TSQP

SEQ ID NO: 2468145 - protein, 16 aa, Entamoeba dispar
TSQPKKEVKKKKVEGC

SEQ ID NO: 2468146 - protein, 4 aa, Entamoeba dispar
TSQQ

SEQ ID NO: 2468147 - protein, 7 aa, Entamoeba dispar
TSQQEVE

SEQ ID NO: 2468148 - protein, 5 aa, Entamoeba dispar
TSQSE

SEQ ID NO: 2468149 - protein, 12 aa, Entamoeba dispar
TSQSNASMSGNV

SEQ ID NO: 2468150 - protein, 10 aa, Entamoeba dispar
TSQTIREKGR

SEQ ID NO: 2468151 - protein, 9 aa, Entamoeba dispar
TSQTSFPQS

SEQ ID NO: 2468152 - protein, 16 aa, Entamoeba dispar
TSQTYKGTVTENKANY

SEQ ID NO: 2468153 - protein, 12 aa, Entamoeba dispar
TSQVNEKYLPDK

SEQ ID NO: 2468154 - protein, 6 aa, Entamoeba dispar
TSQVRP

SEQ ID NO: 2468155 - protein, 5 aa, Entamoeba dispar
TSQYS

SEQ ID NO: 2468156 - protein, 22 aa, Entamoeba dispar
TSRAGIGSSHSSVPLPNPSTMI

SEQ ID NO: 2468157 - protein, 8 aa, Entamoeba dispar
TSRDPTSI

SEQ ID NO: 2468158 - protein, 19 aa, Entamoeba dispar
TSRDQYECQNTVEKEKAYT

SEQ ID NO: 2468159 - protein, 7 aa, Entamoeba dispar
TSRDSLS

SEQ ID NO: 2468160 - protein, 4 aa, Entamoeba dispar
TSRE

SEQ ID NO: 2468161 - protein, 14 aa, Entamoeba dispar
TSREDKRQSQRKRM

SEQ ID NO: 2468162 - protein, 5 aa, Entamoeba dispar
TSRET

SEQ ID NO: 2468163 - protein, 7 aa, Entamoeba dispar
TSRGKEK

SEQ ID NO: 2468164 - protein, 6 aa, Entamoeba dispar
TSRIST

SEQ ID NO: 2468165 - protein, 10 aa, Entamoeba dispar
TSRISTELNE

SEQ ID NO: 2468166 - protein, 6 aa, Entamoeba dispar
TSRNGT

SEQ ID NO: 2468167 - protein, 11 aa, Entamoeba dispar
TSRQEYVDKES

SEQ ID NO: 2468168 - protein, 6 aa, Entamoeba dispar
TSRRSL

SEQ ID NO: 2468169 - protein, 4 aa, Entamoeba dispar
TSRS

SEQ ID NO: 2468170 - protein, 8 aa, Entamoeba dispar
TSRSCSEE

SEQ ID NO: 2468171 - protein, 9 aa, Entamoeba dispar
TSRTVVKEN

SEQ ID NO: 2468172 - protein, 4 aa, Entamoeba dispar
TSSA

SEQ ID NO: 2468173 - protein, 13 aa, Entamoeba dispar
TSSALKNYKDIYL

SEQ ID NO: 2468174 - protein, 7 aa, Entamoeba dispar
TSSDDTF

SEQ ID NO: 2468175 - protein, 10 aa, Entamoeba dispar
TSSDTTSNAI

SEQ ID NO: 2468176 - protein, 9 aa, Entamoeba dispar
TSSDYQQEI

SEQ ID NO: 2468177 - protein, 16 aa, Entamoeba dispar
TSSEADRKRSQTITRQ

SEQ ID NO: 2468178 - protein, 23 aa, Entamoeba dispar
TSSEDTQDKEQTDSTEELSDDEI

SEQ ID NO: 2468179 - protein, 8 aa, Entamoeba dispar
TSSEEGCQ

SEQ ID NO: 2468180 - protein, 10 aa, Entamoeba dispar
TSSEQPDVKK

SEQ ID NO: 2468181 - protein, 7 aa, Entamoeba dispar
TSSEQTN

SEQ ID NO: 2468182 - protein, 8 aa, Entamoeba dispar
TSSESDPL

SEQ ID NO: 2468183 - protein, 16 aa, Entamoeba dispar
TSSEYLTKGYNEEGYD

SEQ ID NO: 2468184 - protein, 4 aa, Entamoeba dispar
TSSF

SEQ ID NO: 2468185 - protein, 5 aa, Entamoeba dispar
TSSGE

SEQ ID NO: 2468186 - protein, 7 aa, Entamoeba dispar
TSSGIED

SEQ ID NO: 2468187 - protein, 17 aa, Entamoeba dispar
TSSGKLCDSAVSPQFAA

SEQ ID NO: 2468188 - protein, 18 aa, Entamoeba dispar
TSSGSNLSIREENEKRVI

SEQ ID NO: 2468189 - protein, 5 aa, Entamoeba dispar
TSSIP

SEQ ID NO: 2468190 - protein, 7 aa, Entamoeba dispar
TSSIPGV

SEQ ID NO: 2468191 - protein, 9 aa, Entamoeba dispar
TSSIQNKRD

SEQ ID NO: 2468192 - protein, 5 aa, Entamoeba dispar
TSSIS

SEQ ID NO: 2468193 - protein, 4 aa, Entamoeba dispar
TSSK

SEQ ID NO: 2468194 - protein, 16 aa, Entamoeba dispar
TSSKTQDNTSIKDVPR

SEQ ID NO: 2468195 - protein, 5 aa, Entamoeba dispar
TSSLK

SEQ ID NO: 2468196 - protein, 6 aa, Entamoeba dispar
TSSLPS

SEQ ID NO: 2468197 - protein, 8 aa, Entamoeba dispar
TSSLQQDK

SEQ ID NO: 2468198 - protein, 17 aa, Entamoeba dispar
TSSNGTQYKDEDIGKGN

SEQ ID NO: 2468199 - protein, 8 aa, Entamoeba dispar
TSSNPIKS

SEQ ID NO: 2468200 - protein, 9 aa, Entamoeba dispar
TSSNQEELT

SEQ ID NO: 2468201 - protein, 16 aa, Entamoeba dispar
TSSNRSIPSPLNENKN

SEQ ID NO: 2468202 - protein, 5 aa, Entamoeba dispar
TSSNS

SEQ ID NO: 2468203 - protein, 4 aa, Entamoeba dispar
TSSP

SEQ ID NO: 2468204 - protein, 53 aa, Entamoeba dispar
TSSQENKLNNEKDETRKSETESSNKTESSNKTETENNNETETENNNETEQKEV

SEQ ID NO: 2468205 - protein, 10 aa, Entamoeba dispar
TSSQKETISA

SEQ ID NO: 2468206 - protein, 9 aa, Entamoeba dispar
TSSQPKEPT

SEQ ID NO: 2468207 - protein, 9 aa, Entamoeba dispar
TSSQQNNIP

SEQ ID NO: 2468208 - protein, 7 aa, Entamoeba dispar
TSSQSIP

SEQ ID NO: 2468209 - protein, 5 aa, Entamoeba dispar
TSSQY

SEQ ID NO: 2468210 - protein, 8 aa, Entamoeba dispar
TSSQYRDA

SEQ ID NO: 2468211 - protein, 9 aa, Entamoeba dispar
TSSRRSNTK

SEQ ID NO: 2468212 - protein, 4 aa, Entamoeba dispar
TSSS

SEQ ID NO: 2468213 - protein, 20 aa, Entamoeba dispar
TSSSDDELVDTQYDPSDVTQ

SEQ ID NO: 2468214 - protein, 7 aa, Entamoeba dispar
TSSSEII

SEQ ID NO: 2468215 - protein, 7 aa, Entamoeba dispar
TSSSFNK

SEQ ID NO: 2468216 - protein, 7 aa, Entamoeba dispar
TSSSFNS

SEQ ID NO: 2468217 - protein, 7 aa, Entamoeba dispar
TSSSIKP

SEQ ID NO: 2468218 - protein, 9 aa, Entamoeba dispar
TSSSITKKQ

SEQ ID NO: 2468219 - protein, 15 aa, Entamoeba dispar
TSSSVIKKREEMTGI

SEQ ID NO: 2468220 - protein, 4 aa, Entamoeba dispar
TSST

SEQ ID NO: 2468221 - protein, 30 aa, Entamoeba dispar
TSSTEYDNSSSVKQVKKNKTSREIRNSQTI

SEQ ID NO: 2468222 - protein, 21 aa, Entamoeba dispar
TSSTPSRSKGTSTPNAPVNPN

SEQ ID NO: 2468223 - protein, 5 aa, Entamoeba dispar
TSSTV

SEQ ID NO: 2468224 - protein, 5 aa, Entamoeba dispar
TSSVK

SEQ ID NO: 2468225 - protein, 6 aa, Entamoeba dispar
TSSYRS

SEQ ID NO: 2468226 - protein, 6 aa, Entamoeba dispar
TSTAFR

SEQ ID NO: 2468227 - protein, 10 aa, Entamoeba dispar
TSTAPRSKSV

SEQ ID NO: 2468228 - protein, 7 aa, Entamoeba dispar
TSTDEIN

SEQ ID NO: 2468229 - protein, 13 aa, Entamoeba dispar
TSTDFDETGHNYY

SEQ ID NO: 2468230 - protein, 6 aa, Entamoeba dispar
TSTEQS

SEQ ID NO: 2468231 - protein, 5 aa, Entamoeba dispar
TSTEV

SEQ ID NO: 2468232 - protein, 5 aa, Entamoeba dispar
TSTGR

SEQ ID NO: 2468233 - protein, 12 aa, Entamoeba dispar
TSTIGGGDKVRT

SEQ ID NO: 2468234 - protein, 12 aa, Entamoeba dispar
TSTINKKTTVNV

SEQ ID NO: 2468235 - protein, 14 aa, Entamoeba dispar
TSTIQTKLDAMINT

SEQ ID NO: 2468236 - protein, 6 aa, Entamoeba dispar
TSTISR

SEQ ID NO: 2468237 - protein, 7 aa, Entamoeba dispar
TSTKAVH

SEQ ID NO: 2468238 - protein, 5 aa, Entamoeba dispar
TSTKE

SEQ ID NO: 2468239 - protein, 8 aa, Entamoeba dispar
TSTKESDL

SEQ ID NO: 2468240 - protein, 7 aa, Entamoeba dispar
TSTKSQV

SEQ ID NO: 2468241 - protein, 14 aa, Entamoeba dispar
TSTKTKKEKKGNYK

SEQ ID NO: 2468242 - protein, 5 aa, Entamoeba dispar
TSTKY

SEQ ID NO: 2468243 - protein, 7 aa, Entamoeba dispar
TSTKYGI

SEQ ID NO: 2468244 - protein, 6 aa, Entamoeba dispar
TSTKYK

SEQ ID NO: 2468245 - protein, 7 aa, Entamoeba dispar
TSTKYKT

SEQ ID NO: 2468246 - protein, 8 aa, Entamoeba dispar
TSTLTQPL

SEQ ID NO: 2468247 - protein, 25 aa, Entamoeba dispar
TSTMGKKFGETSKGFKSAKGKTEQV

SEQ ID NO: 2468248 - protein, 14 aa, Entamoeba dispar
TSTNEIKEKLPEKK

SEQ ID NO: 2468249 - protein, 8 aa, Entamoeba dispar
TSTNGSYI

SEQ ID NO: 2468250 - protein, 19 aa, Entamoeba dispar
TSTNGTYVNGEKIGRGKTV

SEQ ID NO: 2468251 - protein, 7 aa, Entamoeba dispar
TSTNKEV

SEQ ID NO: 2468252 - protein, 16 aa, Entamoeba dispar
TSTPKTSSQQKPTQYS

SEQ ID NO: 2468253 - protein, 10 aa, Entamoeba dispar
TSTPNSGTLA

SEQ ID NO: 2468254 - protein, 15 aa, Entamoeba dispar
TSTPVPNKGTKVKLE

SEQ ID NO: 2468255 - protein, 4 aa, Entamoeba dispar
TSTQ

SEQ ID NO: 2468256 - protein, 6 aa, Entamoeba dispar
TSTQIQ

SEQ ID NO: 2468257 - protein, 9 aa, Entamoeba dispar
TSTRRASEA

SEQ ID NO: 2468258 - protein, 7 aa, Entamoeba dispar
TSTSLKT

SEQ ID NO: 2468259 - protein, 7 aa, Entamoeba dispar
TSTSMTA

SEQ ID NO: 2468260 - protein, 12 aa, Entamoeba dispar
TSTSYRSEFDRS

SEQ ID NO: 2468261 - protein, 5 aa, Entamoeba dispar
TSTTE

SEQ ID NO: 2468262 - protein, 5 aa, Entamoeba dispar
TSTTH

SEQ ID NO: 2468263 - protein, 6 aa, Entamoeba dispar
TSTTKS

SEQ ID NO: 2468264 - protein, 7 aa, Entamoeba dispar
TSTTKSV

SEQ ID NO: 2468265 - protein, 7 aa, Entamoeba dispar
TSTTQYP

SEQ ID NO: 2468266 - protein, 6 aa, Entamoeba dispar
TSTTSG

SEQ ID NO: 2468267 - protein, 10 aa, Entamoeba dispar
TSTTTEDTSN

SEQ ID NO: 2468268 - protein, 6 aa, Entamoeba dispar
TSTTTK

SEQ ID NO: 2468269 - protein, 12 aa, Entamoeba dispar
TSTVGGEEKIRT

SEQ ID NO: 2468270 - protein, 4 aa, Entamoeba dispar
TSVD

SEQ ID NO: 2468271 - protein, 10 aa, Entamoeba dispar
TSVENTKNQL

SEQ ID NO: 2468272 - protein, 5 aa, Entamoeba dispar
TSVEQ

SEQ ID NO: 2468273 - protein, 4 aa, Entamoeba dispar
TSVG

SEQ ID NO: 2468274 - protein, 8 aa, Entamoeba dispar
TSVGGETL

SEQ ID NO: 2468275 - protein, 13 aa, Entamoeba dispar
TSVGSIAGGGRYD

SEQ ID NO: 2468276 - protein, 6 aa, Entamoeba dispar
TSVKEI

SEQ ID NO: 2468277 - protein, 10 aa, Entamoeba dispar
TSVKEKESIE

SEQ ID NO: 2468278 - protein, 10 aa, Entamoeba dispar
TSVKELGNKA

SEQ ID NO: 2468279 - protein, 8 aa, Entamoeba dispar
TSVKNGGL

SEQ ID NO: 2468280 - protein, 6 aa, Entamoeba dispar
TSVKTI

SEQ ID NO: 2468281 - protein, 21 aa, Entamoeba dispar
TSVNDTKTSVCNEYSEVGEKY

SEQ ID NO: 2468282 - protein, 6 aa, Entamoeba dispar
TSVNEI

SEQ ID NO: 2468283 - protein, 7 aa, Entamoeba dispar
TSVNQTE

SEQ ID NO: 2468284 - protein, 7 aa, Entamoeba dispar
TSVNSPE

SEQ ID NO: 2468285 - protein, 24 aa, Entamoeba dispar
TSVPNNSNKSFSKRTLDNSSTSSI

SEQ ID NO: 2468286 - protein, 9 aa, Entamoeba dispar
TSVPSPSER

SEQ ID NO: 2468287 - protein, 4 aa, Entamoeba dispar
TSVQ

SEQ ID NO: 2468288 - protein, 6 aa, Entamoeba dispar
TSVRET

SEQ ID NO: 2468289 - protein, 6 aa, Entamoeba dispar
TSVSAP

SEQ ID NO: 2468290 - protein, 6 aa, Entamoeba dispar
TSVSEL

SEQ ID NO: 2468291 - protein, 7 aa, Entamoeba dispar
TSVSELG

SEQ ID NO: 2468292 - protein, 5 aa, Entamoeba dispar
TSVSG

SEQ ID NO: 2468293 - protein, 5 aa, Entamoeba dispar
TSVSI

SEQ ID NO: 2468294 - protein, 6 aa, Entamoeba dispar
TSVSNI

SEQ ID NO: 2468295 - protein, 4 aa, Entamoeba dispar
TSVT

SEQ ID NO: 2468296 - protein, 6 aa, Entamoeba dispar
TSVTNT

SEQ ID NO: 2468297 - protein, 8 aa, Entamoeba dispar
TSVTSIGN

SEQ ID NO: 2468298 - protein, 4 aa, Entamoeba dispar
TSYD

SEQ ID NO: 2468299 - protein, 8 aa, Entamoeba dispar
TSYDKTKP

SEQ ID NO: 2468300 - protein, 21 aa, Entamoeba dispar
TSYIGSPISSVPISQSTTPTS

SEQ ID NO: 2468301 - protein, 5 aa, Entamoeba dispar
TSYIS

SEQ ID NO: 2468302 - protein, 9 aa, Entamoeba dispar
TSYPDGSPL

SEQ ID NO: 2468303 - protein, 4 aa, Entamoeba dispar
TSYS

SEQ ID NO: 2468304 - protein, 6 aa, Entamoeba dispar
TSYTTQ

SEQ ID NO: 2468305 - protein, 5 aa, Entamoeba dispar
TTADW

SEQ ID NO: 2468306 - protein, 13 aa, Entamoeba dispar
TTAERKETTSNPI

SEQ ID NO: 2468307 - protein, 7 aa, Entamoeba dispar
TTAGDIP

SEQ ID NO: 2468308 - protein, 7 aa, Entamoeba dispar
TTANEPY

SEQ ID NO: 2468309 - protein, 19 aa, Entamoeba dispar
TTAPKEKIEEKTIDPHENK

SEQ ID NO: 2468310 - protein, 15 aa, Entamoeba dispar
TTAPTQPNNNSTKDV

SEQ ID NO: 2468311 - protein, 4 aa, Entamoeba dispar
TTAQ

SEQ ID NO: 2468312 - protein, 6 aa, Entamoeba dispar
TTAQIG

SEQ ID NO: 2468313 - protein, 12 aa, Entamoeba dispar
TTARFAKDNMDG

SEQ ID NO: 2468314 - protein, 5 aa, Entamoeba dispar
TTARS

SEQ ID NO: 2468315 - protein, 5 aa, Entamoeba dispar
TTATE

SEQ ID NO: 2468316 - protein, 9 aa, Entamoeba dispar
TTATIARNE

SEQ ID NO: 2468317 - protein, 4 aa, Entamoeba dispar
TTAV

SEQ ID NO: 2468318 - protein, 9 aa, Entamoeba dispar
TTAVSSRTL

SEQ ID NO: 2468319 - protein, 5 aa, Entamoeba dispar
TTAVT

SEQ ID NO: 2468320 - protein, 7 aa, Entamoeba dispar
TTCAEPS

SEQ ID NO: 2468321 - protein, 7 aa, Entamoeba dispar
TTCDPGN

SEQ ID NO: 2468322 - protein, 5 aa, Entamoeba dispar
TTDAG

SEQ ID NO: 2468323 - protein, 4 aa, Entamoeba dispar
TTDE

SEQ ID NO: 2468324 - protein, 11 aa, Entamoeba dispar
TTDEKNEPSIH

SEQ ID NO: 2468325 - protein, 12 aa, Entamoeba dispar
TTDEKNTKVDIR

SEQ ID NO: 2468326 - protein, 6 aa, Entamoeba dispar
TTDEPF

SEQ ID NO: 2468327 - protein, 9 aa, Entamoeba dispar
TTDLDEDDA

SEQ ID NO: 2468328 - protein, 5 aa, Entamoeba dispar
TTDNN

SEQ ID NO: 2468329 - protein, 7 aa, Entamoeba dispar
TTDNNSV

SEQ ID NO: 2468330 - protein, 8 aa, Entamoeba dispar
TTDPKYPF

SEQ ID NO: 2468331 - protein, 15 aa, Entamoeba dispar
TTDPNNKNDAMSATE

SEQ ID NO: 2468332 - protein, 6 aa, Entamoeba dispar
TTDPVG

SEQ ID NO: 2468333 - protein, 6 aa, Entamoeba dispar
TTDSQA

SEQ ID NO: 2468334 - protein, 9 aa, Entamoeba dispar
TTDSSFKSD

SEQ ID NO: 2468335 - protein, 11 aa, Entamoeba dispar
TTDYEYKDAEI

SEQ ID NO: 2468336 - protein, 5 aa, Entamoeba dispar
TTEAE

SEQ ID NO: 2468337 - protein, 9 aa, Entamoeba dispar
TTEASNEEI

SEQ ID NO: 2468338 - protein, 6 aa, Entamoeba dispar
TTEDKQ

SEQ ID NO: 2468339 - protein, 9 aa, Entamoeba dispar
TTEDVENDV

SEQ ID NO: 2468340 - protein, 7 aa, Entamoeba dispar
TTEDVNI

SEQ ID NO: 2468341 - protein, 4 aa, Entamoeba dispar
TTEE

SEQ ID NO: 2468342 - protein, 6 aa, Entamoeba dispar
TTEEEE

SEQ ID NO: 2468343 - protein, 11 aa, Entamoeba dispar
TTEEEKLEPKT

SEQ ID NO: 2468344 - protein, 6 aa, Entamoeba dispar
TTEESY

SEQ ID NO: 2468345 - protein, 6 aa, Entamoeba dispar
TTEEYN

SEQ ID NO: 2468346 - protein, 8 aa, Entamoeba dispar
TTEGHGTT

SEQ ID NO: 2468347 - protein, 5 aa, Entamoeba dispar
TTEGN

SEQ ID NO: 2468348 - protein, 11 aa, Entamoeba dispar
TTEGQKKAIEE

SEQ ID NO: 2468349 - protein, 7 aa, Entamoeba dispar
TTEGYAG

SEQ ID NO: 2468350 - protein, 8 aa, Entamoeba dispar
TTEGYPGV

SEQ ID NO: 2468351 - protein, 7 aa, Entamoeba dispar
TTEHNGV

SEQ ID NO: 2468352 - protein, 4 aa, Entamoeba dispar
TTEI

SEQ ID NO: 2468353 - protein, 6 aa, Entamoeba dispar
TTEKPP

SEQ ID NO: 2468354 - protein, 11 aa, Entamoeba dispar
TTEKSAARGTF

SEQ ID NO: 2468355 - protein, 6 aa, Entamoeba dispar
TTEKTY

SEQ ID NO: 2468356 - protein, 22 aa, Entamoeba dispar
TTEMSDTSSNNTTTSVSSPCNT

SEQ ID NO: 2468357 - protein, 5 aa, Entamoeba dispar
TTENE

SEQ ID NO: 2468358 - protein, 6 aa, Entamoeba dispar
TTENGT

SEQ ID NO: 2468359 - protein, 8 aa, Entamoeba dispar
TTENPSFE

SEQ ID NO: 2468360 - protein, 8 aa, Entamoeba dispar
TTENPSFQ

SEQ ID NO: 2468361 - protein, 19 aa, Entamoeba dispar
TTENQSPKTLKPQSKRKLK

SEQ ID NO: 2468362 - protein, 5 aa, Entamoeba dispar
TTEPI

SEQ ID NO: 2468363 - protein, 6 aa, Entamoeba dispar
TTEPNN

SEQ ID NO: 2468364 - protein, 4 aa, Entamoeba dispar
TTET

SEQ ID NO: 2468365 - protein, 9 aa, Entamoeba dispar
TTEYIDSDG

SEQ ID NO: 2468366 - protein, 8 aa, Entamoeba dispar
TTFDEKDN

SEQ ID NO: 2468367 - protein, 5 aa, Entamoeba dispar
TTFNN

SEQ ID NO: 2468368 - protein, 4 aa, Entamoeba dispar
TTFP

SEQ ID NO: 2468369 - protein, 9 aa, Entamoeba dispar
TTFPTPLST

SEQ ID NO: 2468370 - protein, 5 aa, Entamoeba dispar
TTFSP

SEQ ID NO: 2468371 - protein, 4 aa, Entamoeba dispar
TTFT

SEQ ID NO: 2468372 - protein, 14 aa, Entamoeba dispar
TTFVPTPEGELQQK

SEQ ID NO: 2468373 - protein, 14 aa, Entamoeba dispar
TTGFEGQKEGYENK

SEQ ID NO: 2468374 - protein, 25 aa, Entamoeba dispar
TTGGIKQNRKRRETWTDEERSKFEE

SEQ ID NO: 2468375 - protein, 4 aa, Entamoeba dispar
TTGH

SEQ ID NO: 2468376 - protein, 16 aa, Entamoeba dispar
TTGHSGVDNSTTITEV

SEQ ID NO: 2468377 - protein, 11 aa, Entamoeba dispar
TTGIQSSNVGR

SEQ ID NO: 2468378 - protein, 9 aa, Entamoeba dispar
TTGKKTKEL

SEQ ID NO: 2468379 - protein, 8 aa, Entamoeba dispar
TTGNGESI

SEQ ID NO: 2468380 - protein, 9 aa, Entamoeba dispar
TTGNKQQID

SEQ ID NO: 2468381 - protein, 5 aa, Entamoeba dispar
TTGPI

SEQ ID NO: 2468382 - protein, 10 aa, Entamoeba dispar
TTGRGSTAVG

SEQ ID NO: 2468383 - protein, 7 aa, Entamoeba dispar
TTGSSQF

SEQ ID NO: 2468384 - protein, 11 aa, Entamoeba dispar
TTGTHVKSKEE

SEQ ID NO: 2468385 - protein, 6 aa, Entamoeba dispar
TTGTTG

SEQ ID NO: 2468386 - protein, 6 aa, Entamoeba dispar
TTGVGA

SEQ ID NO: 2468387 - protein, 4 aa, Entamoeba dispar
TTHL

SEQ ID NO: 2468388 - protein, 7 aa, Entamoeba dispar
TTHNGKN

SEQ ID NO: 2468389 - protein, 5 aa, Entamoeba dispar
TTHPE

SEQ ID NO: 2468390 - protein, 21 aa, Entamoeba dispar
TTHQEQKQDEYSLSSATELSQ

SEQ ID NO: 2468391 - protein, 8 aa, Entamoeba dispar
TTHQNKEG

SEQ ID NO: 2468392 - protein, 6 aa, Entamoeba dispar
TTHRGE

SEQ ID NO: 2468393 - protein, 10 aa, Entamoeba dispar
TTIDDSTKQK

SEQ ID NO: 2468394 - protein, 7 aa, Entamoeba dispar
TTIDNET

SEQ ID NO: 2468395 - protein, 5 aa, Entamoeba dispar
TTIDQ

SEQ ID NO: 2468396 - protein, 9 aa, Entamoeba dispar
TTIEEKVNN

SEQ ID NO: 2468397 - protein, 4 aa, Entamoeba dispar
TTIG

SEQ ID NO: 2468398 - protein, 6 aa, Entamoeba dispar
TTIGKD

SEQ ID NO: 2468399 - protein, 9 aa, Entamoeba dispar
TTIKERGKN

SEQ ID NO: 2468400 - protein, 20 aa, Entamoeba dispar
TTIKQTKQQEEKKDQSKKKI

SEQ ID NO: 2468401 - protein, 4 aa, Entamoeba dispar
TTIP

SEQ ID NO: 2468402 - protein, 7 aa, Entamoeba dispar
TTIPKSE

SEQ ID NO: 2468403 - protein, 6 aa, Entamoeba dispar
TTIPNG

SEQ ID NO: 2468404 - protein, 7 aa, Entamoeba dispar
TTIPPDT

SEQ ID NO: 2468405 - protein, 60 aa, Entamoeba dispar
TTIPTEEKKEETPIEEEKKEETPIKEEKKEETPIEEEKKEETTPIEEEKKEETPVEEQKT

SEQ ID NO: 2468406 - protein, 8 aa, Entamoeba dispar
TTIQQPPL

SEQ ID NO: 2468407 - protein, 5 aa, Entamoeba dispar
TTIQS

SEQ ID NO: 2468408 - protein, 4 aa, Entamoeba dispar
TTIS

SEQ ID NO: 2468409 - protein, 5 aa, Entamoeba dispar
TTISK

SEQ ID NO: 2468410 - protein, 11 aa, Entamoeba dispar
TTITRTKEQAI

SEQ ID NO: 2468411 - protein, 5 aa, Entamoeba dispar
TTITS

SEQ ID NO: 2468412 - protein, 9 aa, Entamoeba dispar
TTKADETGL

SEQ ID NO: 2468413 - protein, 4 aa, Entamoeba dispar
TTKD

SEQ ID NO: 2468414 - protein, 9 aa, Entamoeba dispar
TTKDLRNED

SEQ ID NO: 2468415 - protein, 12 aa, Entamoeba dispar
TTKDRRRYGNEI

SEQ ID NO: 2468416 - protein, 16 aa, Entamoeba dispar
TTKDYKNNISLTPNIT

SEQ ID NO: 2468417 - protein, 12 aa, Entamoeba dispar
TTKDYNSLKGNR

SEQ ID NO: 2468418 - protein, 4 aa, Entamoeba dispar
TTKE

SEQ ID NO: 2468419 - protein, 6 aa, Entamoeba dispar
TTKETS

SEQ ID NO: 2468420 - protein, 6 aa, Entamoeba dispar
TTKETY

SEQ ID NO: 2468421 - protein, 9 aa, Entamoeba dispar
TTKFSNDKY

SEQ ID NO: 2468422 - protein, 6 aa, Entamoeba dispar
TTKGKG

SEQ ID NO: 2468423 - protein, 10 aa, Entamoeba dispar
TTKGKKGTMK

SEQ ID NO: 2468424 - protein, 13 aa, Entamoeba dispar
TTKGYREQSVIEE

SEQ ID NO: 2468425 - protein, 6 aa, Entamoeba dispar
TTKINK

SEQ ID NO: 2468426 - protein, 33 aa, Entamoeba dispar
TTKINNNTTTDQPNQEKEQNKDTVYKTNQNIEK

SEQ ID NO: 2468427 - protein, 5 aa, Entamoeba dispar
TTKIQ

SEQ ID NO: 2468428 - protein, 9 aa, Entamoeba dispar
TTKKAFNDN

SEQ ID NO: 2468429 - protein, 7 aa, Entamoeba dispar
TTKKTGV

SEQ ID NO: 2468430 - protein, 4 aa, Entamoeba dispar
TTKM

SEQ ID NO: 2468431 - protein, 11 aa, Entamoeba dispar
TTKPRNTDGFE

SEQ ID NO: 2468432 - protein, 7 aa, Entamoeba dispar
TTKPSKS

SEQ ID NO: 2468433 - protein, 14 aa, Entamoeba dispar
TTKPTETGDKTKTM

SEQ ID NO: 2468434 - protein, 5 aa, Entamoeba dispar
TTKQE

SEQ ID NO: 2468435 - protein, 5 aa, Entamoeba dispar
TTKQH

SEQ ID NO: 2468436 - protein, 5 aa, Entamoeba dispar
TTKQQ

SEQ ID NO: 2468437 - protein, 8 aa, Entamoeba dispar
TTKQYEKC

SEQ ID NO: 2468438 - protein, 6 aa, Entamoeba dispar
TTKSDL

SEQ ID NO: 2468439 - protein, 9 aa, Entamoeba dispar
TTKSEYGKA

SEQ ID NO: 2468440 - protein, 15 aa, Entamoeba dispar
TTKSPNDTSLIGRSK

SEQ ID NO: 2468441 - protein, 8 aa, Entamoeba dispar
TTKSQNKR

SEQ ID NO: 2468442 - protein, 5 aa, Entamoeba dispar
TTKTE

SEQ ID NO: 2468443 - protein, 7 aa, Entamoeba dispar
TTKTEVI

SEQ ID NO: 2468444 - protein, 9 aa, Entamoeba dispar
TTKTQTDKR

SEQ ID NO: 2468445 - protein, 7 aa, Entamoeba dispar
TTKTSQM

SEQ ID NO: 2468446 - protein, 14 aa, Entamoeba dispar
TTKTTGKNKSAIAE

SEQ ID NO: 2468447 - protein, 16 aa, Entamoeba dispar
TTKVNESISTNKQQQK

SEQ ID NO: 2468448 - protein, 10 aa, Entamoeba dispar
TTKYEKRGIA

SEQ ID NO: 2468449 - protein, 15 aa, Entamoeba dispar
TTKYPVTRLLVLLQN

SEQ ID NO: 2468450 - protein, 9 aa, Entamoeba dispar
TTKYQPTQF

SEQ ID NO: 2468451 - protein, 7 aa, Entamoeba dispar
TTKYSSK

SEQ ID NO: 2468452 - protein, 5 aa, Entamoeba dispar
TTKYT

SEQ ID NO: 2468453 - protein, 4 aa, Entamoeba dispar
TTLE

SEQ ID NO: 2468454 - protein, 5 aa, Entamoeba dispar
TTLEE

SEQ ID NO: 2468455 - protein, 8 aa, Entamoeba dispar
TTLEGREQ

SEQ ID NO: 2468456 - protein, 4 aa, Entamoeba dispar
TTLG

SEQ ID NO: 2468457 - protein, 34 aa, Entamoeba dispar
TTLIKPSKKQSKINQEDEEIKTTSSLHKEIENKR

SEQ ID NO: 2468458 - protein, 13 aa, Entamoeba dispar
TTLKAKKLTEAGC

SEQ ID NO: 2468459 - protein, 5 aa, Entamoeba dispar
TTLKS

SEQ ID NO: 2468460 - protein, 4 aa, Entamoeba dispar
TTLN

SEQ ID NO: 2468461 - protein, 10 aa, Entamoeba dispar
TTLNATAKTV

SEQ ID NO: 2468462 - protein, 5 aa, Entamoeba dispar
TTLNG

SEQ ID NO: 2468463 - protein, 5 aa, Entamoeba dispar
TTLPQ

SEQ ID NO: 2468464 - protein, 7 aa, Entamoeba dispar
TTLPQPI

SEQ ID NO: 2468465 - protein, 6 aa, Entamoeba dispar
TTLPRL

SEQ ID NO: 2468466 - protein, 4 aa, Entamoeba dispar
TTLS

SEQ ID NO: 2468467 - protein, 13 aa, Entamoeba dispar
TTLSDGSSQMSTQ

SEQ ID NO: 2468468 - protein, 7 aa, Entamoeba dispar
TTLSQSG

SEQ ID NO: 2468469 - protein, 6 aa, Entamoeba dispar
TTLTPS

SEQ ID NO: 2468470 - protein, 10 aa, Entamoeba dispar
TTLTSYTTGS

SEQ ID NO: 2468471 - protein, 11 aa, Entamoeba dispar
TTMDQTSNQHS

SEQ ID NO: 2468472 - protein, 9 aa, Entamoeba dispar
TTMTTKNTN

SEQ ID NO: 2468473 - protein, 4 aa, Entamoeba dispar
TTNA

SEQ ID NO: 2468474 - protein, 6 aa, Entamoeba dispar
TTNCKP

SEQ ID NO: 2468475 - protein, 4 aa, Entamoeba dispar
TTND

SEQ ID NO: 2468476 - protein, 8 aa, Entamoeba dispar
TTNDNITC

SEQ ID NO: 2468477 - protein, 5 aa, Entamoeba dispar
TTNDP

SEQ ID NO: 2468478 - protein, 7 aa, Entamoeba dispar
TTNEEIN

SEQ ID NO: 2468479 - protein, 7 aa, Entamoeba dispar
TTNEGDS

SEQ ID NO: 2468480 - protein, 12 aa, Entamoeba dispar
TTNEKAKRERAK

SEQ ID NO: 2468481 - protein, 7 aa, Entamoeba dispar
TTNEQSR

SEQ ID NO: 2468482 - protein, 13 aa, Entamoeba dispar
TTNESATESSTQI

SEQ ID NO: 2468483 - protein, 7 aa, Entamoeba dispar
TTNEVDY

SEQ ID NO: 2468484 - protein, 7 aa, Entamoeba dispar
TTNGDLS

SEQ ID NO: 2468485 - protein, 5 aa, Entamoeba dispar
TTNGM

SEQ ID NO: 2468486 - protein, 4 aa, Entamoeba dispar
TTNI

SEQ ID NO: 2468487 - protein, 10 aa, Entamoeba dispar
TTNINRKKDR

SEQ ID NO: 2468488 - protein, 4 aa, Entamoeba dispar
TTNK

SEQ ID NO: 2468489 - protein, 5 aa, Entamoeba dispar
TTNKD

SEQ ID NO: 2468490 - protein, 5 aa, Entamoeba dispar
TTNKN

SEQ ID NO: 2468491 - protein, 5 aa, Entamoeba dispar
TTNKT

SEQ ID NO: 2468492 - protein, 12 aa, Entamoeba dispar
TTNKTNEGEENQ

SEQ ID NO: 2468493 - protein, 11 aa, Entamoeba dispar
TTNKTNIGEED

SEQ ID NO: 2468494 - protein, 12 aa, Entamoeba dispar
TTNKTNNGEENQ

SEQ ID NO: 2468495 - protein, 17 aa, Entamoeba dispar
TTNLKPEEREKIQKQTE

SEQ ID NO: 2468496 - protein, 4 aa, Entamoeba dispar
TTNN

SEQ ID NO: 2468497 - protein, 5 aa, Entamoeba dispar
TTNND

SEQ ID NO: 2468498 - protein, 6 aa, Entamoeba dispar
TTNNTM

SEQ ID NO: 2468499 - protein, 7 aa, Entamoeba dispar
TTNNVEE

SEQ ID NO: 2468500 - protein, 4 aa, Entamoeba dispar
TTNP

SEQ ID NO: 2468501 - protein, 6 aa, Entamoeba dispar
TTNPEL

SEQ ID NO: 2468502 - protein, 6 aa, Entamoeba dispar
TTNPNR

SEQ ID NO: 2468503 - protein, 4 aa, Entamoeba dispar
TTNQ

SEQ ID NO: 2468504 - protein, 5 aa, Entamoeba dispar
TTNQL

SEQ ID NO: 2468505 - protein, 54 aa, Entamoeba dispar
TTNQQYPGYPIQQSPTSQQPVSTGTTPATGAQSYPACNTQQPIPQFPNNGQYYG

SEQ ID NO: 2468506 - protein, 6 aa, Entamoeba dispar
TTNSDT

SEQ ID NO: 2468507 - protein, 7 aa, Entamoeba dispar
TTNSISV

SEQ ID NO: 2468508 - protein, 7 aa, Entamoeba dispar
TTNSPTF

SEQ ID NO: 2468509 - protein, 59 aa, Entamoeba dispar
TTNTIEHKEQTQNQSNETKNNLEKNTPSITDKEEQQDQTKVSPLSTEANNTLTNQPQAI

SEQ ID NO: 2468510 - protein, 6 aa, Entamoeba dispar
TTNTMS

SEQ ID NO: 2468511 - protein, 6 aa, Entamoeba dispar
TTNTNI

SEQ ID NO: 2468512 - protein, 8 aa, Entamoeba dispar
TTNTPVER

SEQ ID NO: 2468513 - protein, 5 aa, Entamoeba dispar
TTNTT

SEQ ID NO: 2468514 - protein, 10 aa, Entamoeba dispar
TTNTTKGHSI

SEQ ID NO: 2468515 - protein, 5 aa, Entamoeba dispar
TTNVD

SEQ ID NO: 2468516 - protein, 7 aa, Entamoeba dispar
TTNVSTE

SEQ ID NO: 2468517 - protein, 5 aa, Entamoeba dispar
TTNYE

SEQ ID NO: 2468518 - protein, 8 aa, Entamoeba dispar
TTPDKKKG

SEQ ID NO: 2468519 - protein, 7 aa, Entamoeba dispar
TTPEDKM

SEQ ID NO: 2468520 - protein, 21 aa, Entamoeba dispar
TTPERKPLLSSSKRSSLPANV

SEQ ID NO: 2468521 - protein, 4 aa, Entamoeba dispar
TTPF

SEQ ID NO: 2468522 - protein, 12 aa, Entamoeba dispar
TTPFGGDADEIN

SEQ ID NO: 2468523 - protein, 13 aa, Entamoeba dispar
TTPFYKEKDVKKE

SEQ ID NO: 2468524 - protein, 4 aa, Entamoeba dispar
TTPG

SEQ ID NO: 2468525 - protein, 6 aa, Entamoeba dispar
TTPGYS

SEQ ID NO: 2468526 - protein, 13 aa, Entamoeba dispar
TTPGYSYYNKLLF

SEQ ID NO: 2468527 - protein, 35 aa, Entamoeba dispar
TTPIYSTPTIQPYSTPTIQPYSTPTIQPYSTPTIN

SEQ ID NO: 2468528 - protein, 15 aa, Entamoeba dispar
TTPLASRSYLQKTTI

SEQ ID NO: 2468529 - protein, 9 aa, Entamoeba dispar
TTPLPSQKN

SEQ ID NO: 2468530 - protein, 8 aa, Entamoeba dispar
TTPNENSS

SEQ ID NO: 2468531 - protein, 4 aa, Entamoeba dispar
TTPP

SEQ ID NO: 2468532 - protein, 7 aa, Entamoeba dispar
TTPPPMT

SEQ ID NO: 2468533 - protein, 116 aa, Entamoeba dispar
TTPPQGVVPPQGVVPPQGVVPPQGVVPPQGVVPPQGVVPPQGVVPPQGVVPPQGVVPPQGVVPSQGVVPPQGVVPPQGVVPPQQEPYYAQPQQPYNAPPQQPYNAPPQQPYNPPPQ

SEQ ID NO: 2468534 - protein, 6 aa, Entamoeba dispar
TTPQDA

SEQ ID NO: 2468535 - protein, 9 aa, Entamoeba dispar
TTPQTPIST

SEQ ID NO: 2468536 - protein, 32 aa, Entamoeba dispar
TTPRQQGQTPYQSKVTSSLRERGERRTNRMSE

SEQ ID NO: 2468537 - protein, 9 aa, Entamoeba dispar
TTPRTSLRR

SEQ ID NO: 2468538 - protein, 44 aa, Entamoeba dispar
TTPSFSNNKSSNSFLNSSSSALPQTSKQTKINSSISDPLGNSSS

SEQ ID NO: 2468539 - protein, 7 aa, Entamoeba dispar
TTPSGSI

SEQ ID NO: 2468540 - protein, 9 aa, Entamoeba dispar
TTPSKEITP

SEQ ID NO: 2468541 - protein, 6 aa, Entamoeba dispar
TTPSRE

SEQ ID NO: 2468542 - protein, 6 aa, Entamoeba dispar
TTPSSK

SEQ ID NO: 2468543 - protein, 6 aa, Entamoeba dispar
TTPSTL

SEQ ID NO: 2468544 - protein, 9 aa, Entamoeba dispar
TTPTPLNAQ

SEQ ID NO: 2468545 - protein, 12 aa, Entamoeba dispar
TTPYNADFDGDE

SEQ ID NO: 2468546 - protein, 6 aa, Entamoeba dispar
TTPYST

SEQ ID NO: 2468547 - protein, 10 aa, Entamoeba dispar
TTQDMEEVPA

SEQ ID NO: 2468548 - protein, 4 aa, Entamoeba dispar
TTQE

SEQ ID NO: 2468549 - protein, 8 aa, Entamoeba dispar
TTQINEEK

SEQ ID NO: 2468550 - protein, 27 aa, Entamoeba dispar
TTQIPQTLTTSQPIPQTLTTSQPIPQT

SEQ ID NO: 2468551 - protein, 10 aa, Entamoeba dispar
TTQIQEATKN

SEQ ID NO: 2468552 - protein, 13 aa, Entamoeba dispar
TTQKEEKRKLEKG

SEQ ID NO: 2468553 - protein, 6 aa, Entamoeba dispar
TTQKLQ

SEQ ID NO: 2468554 - protein, 14 aa, Entamoeba dispar
TTQLPGVSSEGNFR

SEQ ID NO: 2468555 - protein, 7 aa, Entamoeba dispar
TTQNPPS

SEQ ID NO: 2468556 - protein, 10 aa, Entamoeba dispar
TTQNRPVRYE

SEQ ID NO: 2468557 - protein, 4 aa, Entamoeba dispar
TTQP

SEQ ID NO: 2468558 - protein, 7 aa, Entamoeba dispar
TTQQGEI

SEQ ID NO: 2468559 - protein, 9 aa, Entamoeba dispar
TTQSGNAAG

SEQ ID NO: 2468560 - protein, 29 aa, Entamoeba dispar
TTQSNGREMEKSQTWKEQIESNKTAQKEM

SEQ ID NO: 2468561 - protein, 10 aa, Entamoeba dispar
TTQTKQQPNT

SEQ ID NO: 2468562 - protein, 7 aa, Entamoeba dispar
TTQTTDY

SEQ ID NO: 2468563 - protein, 4 aa, Entamoeba dispar
TTQV

SEQ ID NO: 2468564 - protein, 9 aa, Entamoeba dispar
TTQVNKQTN

SEQ ID NO: 2468565 - protein, 4 aa, Entamoeba dispar
TTRA

SEQ ID NO: 2468566 - protein, 27 aa, Entamoeba dispar
TTRARREIKSEEYTQNLDRSTRKEKEY

SEQ ID NO: 2468567 - protein, 10 aa, Entamoeba dispar
TTRGSYIGEG

SEQ ID NO: 2468568 - protein, 7 aa, Entamoeba dispar
TTRKEQK

SEQ ID NO: 2468569 - protein, 14 aa, Entamoeba dispar
TTRKTPCGEGSKTW

SEQ ID NO: 2468570 - protein, 6 aa, Entamoeba dispar
TTRKTW

SEQ ID NO: 2468571 - protein, 4 aa, Entamoeba dispar
TTRN

SEQ ID NO: 2468572 - protein, 12 aa, Entamoeba dispar
TTRNKDKDGSMR

SEQ ID NO: 2468573 - protein, 7 aa, Entamoeba dispar
TTRPNSN

SEQ ID NO: 2468574 - protein, 13 aa, Entamoeba dispar
TTRPQSNPNPIAS

SEQ ID NO: 2468575 - protein, 6 aa, Entamoeba dispar
TTRRQK

SEQ ID NO: 2468576 - protein, 7 aa, Entamoeba dispar
TTRYPEA

SEQ ID NO: 2468577 - protein, 6 aa, Entamoeba dispar
TTSDQL

SEQ ID NO: 2468578 - protein, 5 aa, Entamoeba dispar
TTSEI

SEQ ID NO: 2468579 - protein, 10 aa, Entamoeba dispar
TTSEKYCKGE

SEQ ID NO: 2468580 - protein, 7 aa, Entamoeba dispar
TTSFGNE

SEQ ID NO: 2468581 - protein, 7 aa, Entamoeba dispar
TTSGSFT

SEQ ID NO: 2468582 - protein, 5 aa, Entamoeba dispar
TTSGT

SEQ ID NO: 2468583 - protein, 8 aa, Entamoeba dispar
TTSGTGCE

SEQ ID NO: 2468584 - protein, 10 aa, Entamoeba dispar
TTSGTGSEVT

SEQ ID NO: 2468585 - protein, 7 aa, Entamoeba dispar
TTSHVNE

SEQ ID NO: 2468586 - protein, 6 aa, Entamoeba dispar
TTSIDT

SEQ ID NO: 2468587 - protein, 5 aa, Entamoeba dispar
TTSIE

SEQ ID NO: 2468588 - protein, 6 aa, Entamoeba dispar
TTSKFD

SEQ ID NO: 2468589 - protein, 8 aa, Entamoeba dispar
TTSKGDLS

SEQ ID NO: 2468590 - protein, 7 aa, Entamoeba dispar
TTSLERR

SEQ ID NO: 2468591 - protein, 9 aa, Entamoeba dispar
TTSLKSNPL

SEQ ID NO: 2468592 - protein, 4 aa, Entamoeba dispar
TTSN

SEQ ID NO: 2468593 - protein, 8 aa, Entamoeba dispar
TTSNPNMK

SEQ ID NO: 2468594 - protein, 5 aa, Entamoeba dispar
TTSNV

SEQ ID NO: 2468595 - protein, 5 aa, Entamoeba dispar
TTSPI

SEQ ID NO: 2468596 - protein, 6 aa, Entamoeba dispar
TTSPVS

SEQ ID NO: 2468597 - protein, 8 aa, Entamoeba dispar
TTSPWERM

SEQ ID NO: 2468598 - protein, 7 aa, Entamoeba dispar
TTSQLNN

SEQ ID NO: 2468599 - protein, 6 aa, Entamoeba dispar
TTSRFD

SEQ ID NO: 2468600 - protein, 12 aa, Entamoeba dispar
TTSRIDRKETQE

SEQ ID NO: 2468601 - protein, 6 aa, Entamoeba dispar
TTSRIG

SEQ ID NO: 2468602 - protein, 11 aa, Entamoeba dispar
TTSRPSSGNTI

SEQ ID NO: 2468603 - protein, 8 aa, Entamoeba dispar
TTSSDSVR

SEQ ID NO: 2468604 - protein, 7 aa, Entamoeba dispar
TTSSGKS

SEQ ID NO: 2468605 - protein, 11 aa, Entamoeba dispar
TTSSKLPNKQK

SEQ ID NO: 2468606 - protein, 10 aa, Entamoeba dispar
TTSSSSIVDQ

SEQ ID NO: 2468607 - protein, 4 aa, Entamoeba dispar
TTST

SEQ ID NO: 2468608 - protein, 5 aa, Entamoeba dispar
TTSTD

SEQ ID NO: 2468609 - protein, 6 aa, Entamoeba dispar
TTSTEP

SEQ ID NO: 2468610 - protein, 15 aa, Entamoeba dispar
TTSTESNSGQVGQTK

SEQ ID NO: 2468611 - protein, 8 aa, Entamoeba dispar
TTSTPYEQ

SEQ ID NO: 2468612 - protein, 8 aa, Entamoeba dispar
TTSTVSST

SEQ ID NO: 2468613 - protein, 9 aa, Entamoeba dispar
TTSWKDPRD

SEQ ID NO: 2468614 - protein, 7 aa, Entamoeba dispar
TTSYNGK

SEQ ID NO: 2468615 - protein, 7 aa, Entamoeba dispar
TTTADQA

SEQ ID NO: 2468616 - protein, 57 aa, Entamoeba dispar
TTTDCDETEEENINETEVSHKVDDPQTANEERRNKRRVNKRRELTKPYHSTTHNDPI

SEQ ID NO: 2468617 - protein, 5 aa, Entamoeba dispar
TTTDI

SEQ ID NO: 2468618 - protein, 7 aa, Entamoeba dispar
TTTDKPC

SEQ ID NO: 2468619 - protein, 4 aa, Entamoeba dispar
TTTE

SEQ ID NO: 2468620 - protein, 10 aa, Entamoeba dispar
TTTEASSASL

SEQ ID NO: 2468621 - protein, 7 aa, Entamoeba dispar
TTTEDND

SEQ ID NO: 2468622 - protein, 10 aa, Entamoeba dispar
TTTEKNVDSQ

SEQ ID NO: 2468623 - protein, 5 aa, Entamoeba dispar
TTTEN

SEQ ID NO: 2468624 - protein, 7 aa, Entamoeba dispar
TTTEQPI

SEQ ID NO: 2468625 - protein, 4 aa, Entamoeba dispar
TTTF

SEQ ID NO: 2468626 - protein, 6 aa, Entamoeba dispar
TTTFEE

SEQ ID NO: 2468627 - protein, 5 aa, Entamoeba dispar
TTTFG

SEQ ID NO: 2468628 - protein, 13 aa, Entamoeba dispar
TTTGAKGSKVNHS

SEQ ID NO: 2468629 - protein, 6 aa, Entamoeba dispar
TTTGNT

SEQ ID NO: 2468630 - protein, 4 aa, Entamoeba dispar
TTTH

SEQ ID NO: 2468631 - protein, 6 aa, Entamoeba dispar
TTTHPE

SEQ ID NO: 2468632 - protein, 18 aa, Entamoeba dispar
TTTIDETKTKADSERIKP

SEQ ID NO: 2468633 - protein, 5 aa, Entamoeba dispar
TTTIT

SEQ ID NO: 2468634 - protein, 4 aa, Entamoeba dispar
TTTK

SEQ ID NO: 2468635 - protein, 8 aa, Entamoeba dispar
TTTKGPNK

SEQ ID NO: 2468636 - protein, 14 aa, Entamoeba dispar
TTTKKKSDPTEDDF

SEQ ID NO: 2468637 - protein, 5 aa, Entamoeba dispar
TTTNE

SEQ ID NO: 2468638 - protein, 13 aa, Entamoeba dispar
TTTNFSTNTIEDS

SEQ ID NO: 2468639 - protein, 13 aa, Entamoeba dispar
TTTNGYEGTGRSL

SEQ ID NO: 2468640 - protein, 15 aa, Entamoeba dispar
TTTNQAAFAATEKAE

SEQ ID NO: 2468641 - protein, 4 aa, Entamoeba dispar
TTTP

SEQ ID NO: 2468642 - protein, 10 aa, Entamoeba dispar
TTTPKVNDDT

SEQ ID NO: 2468643 - protein, 11 aa, Entamoeba dispar
TTTPMNSPDER

SEQ ID NO: 2468644 - protein, 4 aa, Entamoeba dispar
TTTQ

SEQ ID NO: 2468645 - protein, 5 aa, Entamoeba dispar
TTTQL

SEQ ID NO: 2468646 - protein, 13 aa, Entamoeba dispar
TTTQNDDALPTVT

SEQ ID NO: 2468647 - protein, 5 aa, Entamoeba dispar
TTTRV

SEQ ID NO: 2468648 - protein, 5 aa, Entamoeba dispar
TTTSL

SEQ ID NO: 2468649 - protein, 5 aa, Entamoeba dispar
TTTSM

SEQ ID NO: 2468650 - protein, 11 aa, Entamoeba dispar
TTTSNNTPPAI

SEQ ID NO: 2468651 - protein, 5 aa, Entamoeba dispar
TTTSS

SEQ ID NO: 2468652 - protein, 6 aa, Entamoeba dispar
TTTSSK

SEQ ID NO: 2468653 - protein, 7 aa, Entamoeba dispar
TTTSSVP

SEQ ID NO: 2468654 - protein, 5 aa, Entamoeba dispar
TTTTP

SEQ ID NO: 2468655 - protein, 21 aa, Entamoeba dispar
TTTTSEGKNGAMKNESIKSVY

SEQ ID NO: 2468656 - protein, 4 aa, Entamoeba dispar
TTVE

SEQ ID NO: 2468657 - protein, 15 aa, Entamoeba dispar
TTVEEKYSKKNGFPW

SEQ ID NO: 2468658 - protein, 26 aa, Entamoeba dispar
TTVPDTETTTSNSSSKPEKKKKGCFI

SEQ ID NO: 2468659 - protein, 15 aa, Entamoeba dispar
TTVQVNPSSSVPYGS

SEQ ID NO: 2468660 - protein, 4 aa, Entamoeba dispar
TTVS

SEQ ID NO: 2468661 - protein, 6 aa, Entamoeba dispar
TTVSEI

SEQ ID NO: 2468662 - protein, 9 aa, Entamoeba dispar
TTVSEIPSF

SEQ ID NO: 2468663 - protein, 5 aa, Entamoeba dispar
TTVTK

SEQ ID NO: 2468664 - protein, 4 aa, Entamoeba dispar
TTVY

SEQ ID NO: 2468665 - protein, 4 aa, Entamoeba dispar
TTYA

SEQ ID NO: 2468666 - protein, 8 aa, Entamoeba dispar
TTYDNQTT

SEQ ID NO: 2468667 - protein, 6 aa, Entamoeba dispar
TTYENN

SEQ ID NO: 2468668 - protein, 6 aa, Entamoeba dispar
TTYPPK

SEQ ID NO: 2468669 - protein, 5 aa, Entamoeba dispar
TTYRE

SEQ ID NO: 2468670 - protein, 10 aa, Entamoeba dispar
TTYTNDKNIN

SEQ ID NO: 2468671 - protein, 10 aa, Entamoeba dispar
TTYTNDKNIT

SEQ ID NO: 2468672 - protein, 8 aa, Entamoeba dispar
TVAASNRQ

SEQ ID NO: 2468673 - protein, 5 aa, Entamoeba dispar
TVAEI

SEQ ID NO: 2468674 - protein, 10 aa, Entamoeba dispar
TVAENQEGQI

SEQ ID NO: 2468675 - protein, 5 aa, Entamoeba dispar
TVAGF

SEQ ID NO: 2468676 - protein, 6 aa, Entamoeba dispar
TVAGTG

SEQ ID NO: 2468677 - protein, 13 aa, Entamoeba dispar
TVANKKVSKAVKS

SEQ ID NO: 2468678 - protein, 9 aa, Entamoeba dispar
TVAQQDDLT

SEQ ID NO: 2468679 - protein, 6 aa, Entamoeba dispar
TVDGEQ

SEQ ID NO: 2468680 - protein, 5 aa, Entamoeba dispar
TVDGP

SEQ ID NO: 2468681 - protein, 8 aa, Entamoeba dispar
TVDITKEL

SEQ ID NO: 2468682 - protein, 11 aa, Entamoeba dispar
TVDSERPITDP

SEQ ID NO: 2468683 - protein, 9 aa, Entamoeba dispar
TVDTTENKM

SEQ ID NO: 2468684 - protein, 16 aa, Entamoeba dispar
TVEDKKKRRQRKRNMD

SEQ ID NO: 2468685 - protein, 5 aa, Entamoeba dispar
TVEET

SEQ ID NO: 2468686 - protein, 7 aa, Entamoeba dispar
TVEGEAE

SEQ ID NO: 2468687 - protein, 6 aa, Entamoeba dispar
TVEGKE

SEQ ID NO: 2468688 - protein, 6 aa, Entamoeba dispar
TVENEN

SEQ ID NO: 2468689 - protein, 6 aa, Entamoeba dispar
TVEQGD

SEQ ID NO: 2468690 - protein, 4 aa, Entamoeba dispar
TVER

SEQ ID NO: 2468691 - protein, 6 aa, Entamoeba dispar
TVERHD

SEQ ID NO: 2468692 - protein, 5 aa, Entamoeba dispar
TVERP

SEQ ID NO: 2468693 - protein, 8 aa, Entamoeba dispar
TVETSNSN

SEQ ID NO: 2468694 - protein, 8 aa, Entamoeba dispar
TVEVEEDT

SEQ ID NO: 2468695 - protein, 7 aa, Entamoeba dispar
TVGGGLS

SEQ ID NO: 2468696 - protein, 12 aa, Entamoeba dispar
TVGIRKENDARL

SEQ ID NO: 2468697 - protein, 9 aa, Entamoeba dispar
TVGKSNIGK

SEQ ID NO: 2468698 - protein, 6 aa, Entamoeba dispar
TVGKTS

SEQ ID NO: 2468699 - protein, 11 aa, Entamoeba dispar
TVGSDDPLGKA

SEQ ID NO: 2468700 - protein, 12 aa, Entamoeba dispar
TVGSENSLIGEK

SEQ ID NO: 2468701 - protein, 12 aa, Entamoeba dispar
TVGSKIEQTIED

SEQ ID NO: 2468702 - protein, 14 aa, Entamoeba dispar
TVGSPAVEKPTEHI

SEQ ID NO: 2468703 - protein, 7 aa, Entamoeba dispar
TVGTNRN

SEQ ID NO: 2468704 - protein, 4 aa, Entamoeba dispar
TVGY

SEQ ID NO: 2468705 - protein, 48 aa, Entamoeba dispar
TVHPPTIPSSQTTNHSRKLESQTKLENESLTQQSPNPPFKPSQNQQPD

SEQ ID NO: 2468706 - protein, 4 aa, Entamoeba dispar
TVHR

SEQ ID NO: 2468707 - protein, 36 aa, Entamoeba dispar
TVKDKKAKKKEKRSKKEEDNGDQKDSKTSHKINTPT

SEQ ID NO: 2468708 - protein, 9 aa, Entamoeba dispar
TVKDRDQET

SEQ ID NO: 2468709 - protein, 30 aa, Entamoeba dispar
TVKDSLRKEHNKRKEQRERRKAKKEEEKRK

SEQ ID NO: 2468710 - protein, 53 aa, Entamoeba dispar
TVKDSSDVKDVKDIQQESIKTETKEVIQPKQETTQVQKEEKRVEGNKEESDYY

SEQ ID NO: 2468711 - protein, 12 aa, Entamoeba dispar
TVKEGKSNSHEK

SEQ ID NO: 2468712 - protein, 16 aa, Entamoeba dispar
TVKEPEKVEKSGDKHL

SEQ ID NO: 2468713 - protein, 16 aa, Entamoeba dispar
TVKEPEKVEKTGDKHL

SEQ ID NO: 2468714 - protein, 7 aa, Entamoeba dispar
TVKNSEH

SEQ ID NO: 2468715 - protein, 5 aa, Entamoeba dispar
TVKQK

SEQ ID NO: 2468716 - protein, 9 aa, Entamoeba dispar
TVKQTKDVD

SEQ ID NO: 2468717 - protein, 9 aa, Entamoeba dispar
TVKSDNQVT

SEQ ID NO: 2468718 - protein, 17 aa, Entamoeba dispar
TVKSEEDKTITKKRQEE

SEQ ID NO: 2468719 - protein, 6 aa, Entamoeba dispar
TVKSES

SEQ ID NO: 2468720 - protein, 7 aa, Entamoeba dispar
TVKTKEE

SEQ ID NO: 2468721 - protein, 9 aa, Entamoeba dispar
TVKTKTQNK

SEQ ID NO: 2468722 - protein, 7 aa, Entamoeba dispar
TVLPSTV

SEQ ID NO: 2468723 - protein, 5 aa, Entamoeba dispar
TVNDS

SEQ ID NO: 2468724 - protein, 4 aa, Entamoeba dispar
TVNE

SEQ ID NO: 2468725 - protein, 5 aa, Entamoeba dispar
TVNEK

SEQ ID NO: 2468726 - protein, 28 aa, Entamoeba dispar
TVNEKTEKFKRTSIPRTSFSSRGSVDDF

SEQ ID NO: 2468727 - protein, 14 aa, Entamoeba dispar
TVNKNSSKLTKQSL

SEQ ID NO: 2468728 - protein, 8 aa, Entamoeba dispar
TVNQQAYR

SEQ ID NO: 2468729 - protein, 8 aa, Entamoeba dispar
TVNRGSNL

SEQ ID NO: 2468730 - protein, 6 aa, Entamoeba dispar
TVNRSG

SEQ ID NO: 2468731 - protein, 14 aa, Entamoeba dispar
TVNTDEYVVIDLLY

SEQ ID NO: 2468732 - protein, 6 aa, Entamoeba dispar
TVNTNT

SEQ ID NO: 2468733 - protein, 17 aa, Entamoeba dispar
TVPCRNSSTRAEIDSDQ

SEQ ID NO: 2468734 - protein, 10 aa, Entamoeba dispar
TVPDNCETTY

SEQ ID NO: 2468735 - protein, 5 aa, Entamoeba dispar
TVPEI

SEQ ID NO: 2468736 - protein, 9 aa, Entamoeba dispar
TVPNDDQQI

SEQ ID NO: 2468737 - protein, 10 aa, Entamoeba dispar
TVPNKQDSYL

SEQ ID NO: 2468738 - protein, 5 aa, Entamoeba dispar
TVPPA

SEQ ID NO: 2468739 - protein, 5 aa, Entamoeba dispar
TVPPQ

SEQ ID NO: 2468740 - protein, 9 aa, Entamoeba dispar
TVPSSISKL

SEQ ID NO: 2468741 - protein, 9 aa, Entamoeba dispar
TVPSTPKNC

SEQ ID NO: 2468742 - protein, 7 aa, Entamoeba dispar
TVPTREN

SEQ ID NO: 2468743 - protein, 7 aa, Entamoeba dispar
TVQEDGV

SEQ ID NO: 2468744 - protein, 7 aa, Entamoeba dispar
TVQESSL

SEQ ID NO: 2468745 - protein, 12 aa, Entamoeba dispar
TVQGENLGATTQ

SEQ ID NO: 2468746 - protein, 4 aa, Entamoeba dispar
TVQK

SEQ ID NO: 2468747 - protein, 5 aa, Entamoeba dispar
TVQKQ

SEQ ID NO: 2468748 - protein, 22 aa, Entamoeba dispar
TVQTAQDDCDEDKKDLEKAGEL

SEQ ID NO: 2468749 - protein, 9 aa, Entamoeba dispar
TVREKKNID

SEQ ID NO: 2468750 - protein, 6 aa, Entamoeba dispar
TVREKQ

SEQ ID NO: 2468751 - protein, 5 aa, Entamoeba dispar
TVRGG

SEQ ID NO: 2468752 - protein, 6 aa, Entamoeba dispar
TVRKGD

SEQ ID NO: 2468753 - protein, 17 aa, Entamoeba dispar
TVRKGTPISKPEDHSDL

SEQ ID NO: 2468754 - protein, 14 aa, Entamoeba dispar
TVSGGGKSEISKSI

SEQ ID NO: 2468755 - protein, 8 aa, Entamoeba dispar
TVSGIRGQ

SEQ ID NO: 2468756 - protein, 12 aa, Entamoeba dispar
TVSGNGSNSSQC

SEQ ID NO: 2468757 - protein, 5 aa, Entamoeba dispar
TVSGP

SEQ ID NO: 2468758 - protein, 9 aa, Entamoeba dispar
TVSKKAANC

SEQ ID NO: 2468759 - protein, 10 aa, Entamoeba dispar
TVSLRDTNNL

SEQ ID NO: 2468760 - protein, 6 aa, Entamoeba dispar
TVSNEE

SEQ ID NO: 2468761 - protein, 7 aa, Entamoeba dispar
TVSNVDK

SEQ ID NO: 2468762 - protein, 4 aa, Entamoeba dispar
TVSP

SEQ ID NO: 2468763 - protein, 8 aa, Entamoeba dispar
TVSPANEK

SEQ ID NO: 2468764 - protein, 9 aa, Entamoeba dispar
TVSRESTVA

SEQ ID NO: 2468765 - protein, 26 aa, Entamoeba dispar
TVSSERISNTQKDEEKRTIKKKKPLL

SEQ ID NO: 2468766 - protein, 5 aa, Entamoeba dispar
TVSSP

SEQ ID NO: 2468767 - protein, 39 aa, Entamoeba dispar
TVSSVAQKTVDTATDFSKGYQKGGLKEGIKQGGKTLANN

SEQ ID NO: 2468768 - protein, 13 aa, Entamoeba dispar
TVSSYSSETFGNP

SEQ ID NO: 2468769 - protein, 10 aa, Entamoeba dispar
TVTESTTSQV

SEQ ID NO: 2468770 - protein, 5 aa, Entamoeba dispar
TVTGK

SEQ ID NO: 2468771 - protein, 13 aa, Entamoeba dispar
TVTGKNARYNNEP

SEQ ID NO: 2468772 - protein, 4 aa, Entamoeba dispar
TVTK

SEQ ID NO: 2468773 - protein, 9 aa, Entamoeba dispar
TVTKGDNKH

SEQ ID NO: 2468774 - protein, 5 aa, Entamoeba dispar
TVTNL

SEQ ID NO: 2468775 - protein, 13 aa, Entamoeba dispar
TVTQEEIDKQKAA

SEQ ID NO: 2468776 - protein, 6 aa, Entamoeba dispar
TVTRPG

SEQ ID NO: 2468777 - protein, 5 aa, Entamoeba dispar
TVTSE

SEQ ID NO: 2468778 - protein, 5 aa, Entamoeba dispar
TVTSI

SEQ ID NO: 2468779 - protein, 6 aa, Entamoeba dispar
TVTSLN

SEQ ID NO: 2468780 - protein, 6 aa, Entamoeba dispar
TVTSMK

SEQ ID NO: 2468781 - protein, 7 aa, Entamoeba dispar
TVTSRKE

SEQ ID NO: 2468782 - protein, 11 aa, Entamoeba dispar
TVVDRPKNIGF

SEQ ID NO: 2468783 - protein, 4 aa, Entamoeba dispar
TWEE

SEQ ID NO: 2468784 - protein, 4 aa, Entamoeba dispar
TWKN

SEQ ID NO: 2468785 - protein, 10 aa, Entamoeba dispar
TWNDHPDAKN

SEQ ID NO: 2468786 - protein, 5 aa, Entamoeba dispar
TWPEI

SEQ ID NO: 2468787 - protein, 6 aa, Entamoeba dispar
TWRDST

SEQ ID NO: 2468788 - protein, 7 aa, Entamoeba dispar
TWSGNQC

SEQ ID NO: 2468789 - protein, 5 aa, Entamoeba dispar
TWSPQ

SEQ ID NO: 2468790 - protein, 11 aa, Entamoeba dispar
TWSTENNVEDE

SEQ ID NO: 2468791 - protein, 6 aa, Entamoeba dispar
TYASQT

SEQ ID NO: 2468792 - protein, 9 aa, Entamoeba dispar
TYDDDLTGR

SEQ ID NO: 2468793 - protein, 4 aa, Entamoeba dispar
TYDE

SEQ ID NO: 2468794 - protein, 6 aa, Entamoeba dispar
TYDENH

SEQ ID NO: 2468795 - protein, 11 aa, Entamoeba dispar
TYDETGKKELN

SEQ ID NO: 2468796 - protein, 9 aa, Entamoeba dispar
TYDKQEEQN

SEQ ID NO: 2468797 - protein, 5 aa, Entamoeba dispar
TYDPE

SEQ ID NO: 2468798 - protein, 19 aa, Entamoeba dispar
TYDQEDDNEDSDLPNPEYH

SEQ ID NO: 2468799 - protein, 10 aa, Entamoeba dispar
TYEEDKNALK

SEQ ID NO: 2468800 - protein, 18 aa, Entamoeba dispar
TYEGGFSGCPGGEAHGGY

SEQ ID NO: 2468801 - protein, 7 aa, Entamoeba dispar
TYEGSDE

SEQ ID NO: 2468802 - protein, 6 aa, Entamoeba dispar
TYEISE

SEQ ID NO: 2468803 - protein, 8 aa, Entamoeba dispar
TYENSPKL

SEQ ID NO: 2468804 - protein, 6 aa, Entamoeba dispar
TYERDY

SEQ ID NO: 2468805 - protein, 5 aa, Entamoeba dispar
TYERL

SEQ ID NO: 2468806 - protein, 8 aa, Entamoeba dispar
TYETPTPI

SEQ ID NO: 2468807 - protein, 8 aa, Entamoeba dispar
TYFESGTG

SEQ ID NO: 2468808 - protein, 6 aa, Entamoeba dispar
TYGDKS

SEQ ID NO: 2468809 - protein, 6 aa, Entamoeba dispar
TYGEIG

SEQ ID NO: 2468810 - protein, 10 aa, Entamoeba dispar
TYGEKKLSDI

SEQ ID NO: 2468811 - protein, 4 aa, Entamoeba dispar
TYGG

SEQ ID NO: 2468812 - protein, 6 aa, Entamoeba dispar
TYGSET

SEQ ID NO: 2468813 - protein, 16 aa, Entamoeba dispar
TYGTTIPSEVKSLGDK

SEQ ID NO: 2468814 - protein, 10 aa, Entamoeba dispar
TYHNSTRETL

SEQ ID NO: 2468815 - protein, 7 aa, Entamoeba dispar
TYHQNLP

SEQ ID NO: 2468816 - protein, 6 aa, Entamoeba dispar
TYIDDT

SEQ ID NO: 2468817 - protein, 6 aa, Entamoeba dispar
TYIEEN

SEQ ID NO: 2468818 - protein, 6 aa, Entamoeba dispar
TYIRSG

SEQ ID NO: 2468819 - protein, 7 aa, Entamoeba dispar
TYKEEEG

SEQ ID NO: 2468820 - protein, 5 aa, Entamoeba dispar
TYKES

SEQ ID NO: 2468821 - protein, 6 aa, Entamoeba dispar
TYKETN

SEQ ID NO: 2468822 - protein, 11 aa, Entamoeba dispar
TYKGPSGVSSI

SEQ ID NO: 2468823 - protein, 5 aa, Entamoeba dispar
TYKGQ

SEQ ID NO: 2468824 - protein, 5 aa, Entamoeba dispar
TYKIN

SEQ ID NO: 2468825 - protein, 4 aa, Entamoeba dispar
TYKL

SEQ ID NO: 2468826 - protein, 13 aa, Entamoeba dispar
TYKNAKDNNSSLT

SEQ ID NO: 2468827 - protein, 5 aa, Entamoeba dispar
TYKPE

SEQ ID NO: 2468828 - protein, 13 aa, Entamoeba dispar
TYKQEIESAFVSK

SEQ ID NO: 2468829 - protein, 19 aa, Entamoeba dispar
TYKRGLSKSDIAKPHSPHL

SEQ ID NO: 2468830 - protein, 5 aa, Entamoeba dispar
TYKSR

SEQ ID NO: 2468831 - protein, 4 aa, Entamoeba dispar
TYLE

SEQ ID NO: 2468832 - protein, 5 aa, Entamoeba dispar
TYLST

SEQ ID NO: 2468833 - protein, 7 aa, Entamoeba dispar
TYLSTGK

SEQ ID NO: 2468834 - protein, 10 aa, Entamoeba dispar
TYNGPNSPIG

SEQ ID NO: 2468835 - protein, 8 aa, Entamoeba dispar
TYNKQGTL

SEQ ID NO: 2468836 - protein, 10 aa, Entamoeba dispar
TYNLPKQSKL

SEQ ID NO: 2468837 - protein, 8 aa, Entamoeba dispar
TYNPEYQP

SEQ ID NO: 2468838 - protein, 4 aa, Entamoeba dispar
TYPD

SEQ ID NO: 2468839 - protein, 6 aa, Entamoeba dispar
TYPDEI

SEQ ID NO: 2468840 - protein, 7 aa, Entamoeba dispar
TYPDQMS

SEQ ID NO: 2468841 - protein, 21 aa, Entamoeba dispar
TYPFRDGKKIGNPICDKGKGA

SEQ ID NO: 2468842 - protein, 12 aa, Entamoeba dispar
TYPIQSDTKFPQ

SEQ ID NO: 2468843 - protein, 5 aa, Entamoeba dispar
TYPKD

SEQ ID NO: 2468844 - protein, 8 aa, Entamoeba dispar
TYPNPIKE

SEQ ID NO: 2468845 - protein, 16 aa, Entamoeba dispar
TYPPPNVPTYTDIYKM

SEQ ID NO: 2468846 - protein, 6 aa, Entamoeba dispar
TYPQEN

SEQ ID NO: 2468847 - protein, 5 aa, Entamoeba dispar
TYPQN

SEQ ID NO: 2468848 - protein, 12 aa, Entamoeba dispar
TYQDRNTYGTTI

SEQ ID NO: 2468849 - protein, 5 aa, Entamoeba dispar
TYQEE

SEQ ID NO: 2468850 - protein, 13 aa, Entamoeba dispar
TYQPSGDATYQKT

SEQ ID NO: 2468851 - protein, 6 aa, Entamoeba dispar
TYQQNE

SEQ ID NO: 2468852 - protein, 8 aa, Entamoeba dispar
TYQSGTIE

SEQ ID NO: 2468853 - protein, 20 aa, Entamoeba dispar
TYRRGNKVKYNGEVEEGEWQ

SEQ ID NO: 2468854 - protein, 12 aa, Entamoeba dispar
TYRSDQRKETKI

SEQ ID NO: 2468855 - protein, 4 aa, Entamoeba dispar
TYSA

SEQ ID NO: 2468856 - protein, 10 aa, Entamoeba dispar
TYSDTNKIER

SEQ ID NO: 2468857 - protein, 11 aa, Entamoeba dispar
TYSDTNKMNAQ

SEQ ID NO: 2468858 - protein, 4 aa, Entamoeba dispar
TYSE

SEQ ID NO: 2468859 - protein, 9 aa, Entamoeba dispar
TYSEPKSFG

SEQ ID NO: 2468860 - protein, 5 aa, Entamoeba dispar
TYSER

SEQ ID NO: 2468861 - protein, 9 aa, Entamoeba dispar
TYSESNEEY

SEQ ID NO: 2468862 - protein, 45 aa, Entamoeba dispar
TYSHSSSHSLSRSTSHSAASSCQRSRSHSKPSSTSNSRKNSLSLQ

SEQ ID NO: 2468863 - protein, 7 aa, Entamoeba dispar
TYSNKLS

SEQ ID NO: 2468864 - protein, 4 aa, Entamoeba dispar
TYSP

SEQ ID NO: 2468865 - protein, 8 aa, Entamoeba dispar
TYSQDAYN

SEQ ID NO: 2468866 - protein, 14 aa, Entamoeba dispar
TYSRETSPSKEYYS

SEQ ID NO: 2468867 - protein, 12 aa, Entamoeba dispar
TYSSNNTQYIQK

SEQ ID NO: 2468868 - protein, 5 aa, Entamoeba dispar
TYTEK

SEQ ID NO: 2468869 - protein, 13 aa, Entamoeba dispar
TYTPKESKEAENI

SEQ ID NO: 2468870 - protein, 10 aa, Entamoeba dispar
TYTQTDHNAS

SEQ ID NO: 2468871 - protein, 9 aa, Entamoeba dispar
TYTQTEHNA

SEQ ID NO: 2468872 - protein, 6 aa, Entamoeba dispar
TYTSEG

SEQ ID NO: 2468873 - protein, 11 aa, Entamoeba dispar
TYTVGDPSNTF

SEQ ID NO: 2468874 - protein, 10 aa, Entamoeba dispar
TYYERNNKEI

SEQ ID NO: 2468875 - protein, 5 aa, Entamoeba dispar
TYYQS

SEQ ID NO: 2468876 - protein, 17 aa, Entamoeba dispar
VAAGGADQVSSVSPSHY

SEQ ID NO: 2468877 - protein, 10 aa, Entamoeba dispar
VAAGGQLTTT

SEQ ID NO: 2468878 - protein, 4 aa, Entamoeba dispar
VAAN

SEQ ID NO: 2468879 - protein, 13 aa, Entamoeba dispar
VAANEAAAVPRKR

SEQ ID NO: 2468880 - protein, 6 aa, Entamoeba dispar
VADNEI

SEQ ID NO: 2468881 - protein, 11 aa, Entamoeba dispar
VADNKKMTKTL

SEQ ID NO: 2468882 - protein, 5 aa, Entamoeba dispar
VADPK

SEQ ID NO: 2468883 - protein, 4 aa, Entamoeba dispar
VADS

SEQ ID NO: 2468884 - protein, 8 aa, Entamoeba dispar
VAEAVKDD

SEQ ID NO: 2468885 - protein, 11 aa, Entamoeba dispar
VAEEDTKTIPD

SEQ ID NO: 2468886 - protein, 22 aa, Entamoeba dispar
VAEEHTISTATTEAPKQSFTEN

SEQ ID NO: 2468887 - protein, 16 aa, Entamoeba dispar
VAEHSNNELDLEDNSK

SEQ ID NO: 2468888 - protein, 7 aa, Entamoeba dispar
VAEPADG

SEQ ID NO: 2468889 - protein, 11 aa, Entamoeba dispar
VAEQSDNIGQI

SEQ ID NO: 2468890 - protein, 14 aa, Entamoeba dispar
VAERGQKINKQKEE

SEQ ID NO: 2468891 - protein, 9 aa, Entamoeba dispar
VAETKGHIT

SEQ ID NO: 2468892 - protein, 8 aa, Entamoeba dispar
VAEVGGAN

SEQ ID NO: 2468893 - protein, 5 aa, Entamoeba dispar
VAGDE

SEQ ID NO: 2468894 - protein, 8 aa, Entamoeba dispar
VAGDQQAS

SEQ ID NO: 2468895 - protein, 9 aa, Entamoeba dispar
VAGETKSGF

SEQ ID NO: 2468896 - protein, 18 aa, Entamoeba dispar
VAGGVSQTTSTRRYEKNK

SEQ ID NO: 2468897 - protein, 6 aa, Entamoeba dispar
VAGIPN

SEQ ID NO: 2468898 - protein, 11 aa, Entamoeba dispar
VAGKTGIEQDE

SEQ ID NO: 2468899 - protein, 6 aa, Entamoeba dispar
VAGRGG

SEQ ID NO: 2468900 - protein, 7 aa, Entamoeba dispar
VAGSDIT

SEQ ID NO: 2468901 - protein, 9 aa, Entamoeba dispar
VAGSTNKRV

SEQ ID NO: 2468902 - protein, 13 aa, Entamoeba dispar
VAHTSGRRNYNED

SEQ ID NO: 2468903 - protein, 14 aa, Entamoeba dispar
VAISTEPSKENKKC

SEQ ID NO: 2468904 - protein, 8 aa, Entamoeba dispar
VAKEQNVS

SEQ ID NO: 2468905 - protein, 9 aa, Entamoeba dispar
VAKESKANF

SEQ ID NO: 2468906 - protein, 4 aa, Entamoeba dispar
VAKG

SEQ ID NO: 2468907 - protein, 13 aa, Entamoeba dispar
VAKGKRPNFDPDF

SEQ ID NO: 2468908 - protein, 24 aa, Entamoeba dispar
VAKKQQEQLQAAYEENEKIDSTTY

SEQ ID NO: 2468909 - protein, 24 aa, Entamoeba dispar
VAKPQRSKATSSLMRTGDETGQPV

SEQ ID NO: 2468910 - protein, 6 aa, Entamoeba dispar
VAKQPI

SEQ ID NO: 2468911 - protein, 6 aa, Entamoeba dispar
VAKTGV

SEQ ID NO: 2468912 - protein, 4 aa, Entamoeba dispar
VALG

SEQ ID NO: 2468913 - protein, 5 aa, Entamoeba dispar
VALSG

SEQ ID NO: 2468914 - protein, 13 aa, Entamoeba dispar
VANAAKKAGSTVE

SEQ ID NO: 2468915 - protein, 8 aa, Entamoeba dispar
VANATDAQ

SEQ ID NO: 2468916 - protein, 7 aa, Entamoeba dispar
VANETSA

SEQ ID NO: 2468917 - protein, 5 aa, Entamoeba dispar
VANPE

SEQ ID NO: 2468918 - protein, 6 aa, Entamoeba dispar
VANQTQ

SEQ ID NO: 2468919 - protein, 11 aa, Entamoeba dispar
VANSNSTVTVN

SEQ ID NO: 2468920 - protein, 12 aa, Entamoeba dispar
VANSSDEASQEF

SEQ ID NO: 2468921 - protein, 7 aa, Entamoeba dispar
VANTNDT

SEQ ID NO: 2468922 - protein, 5 aa, Entamoeba dispar
VAPGK

SEQ ID NO: 2468923 - protein, 5 aa, Entamoeba dispar
VAPNE

SEQ ID NO: 2468924 - protein, 6 aa, Entamoeba dispar
VAPNPM

SEQ ID NO: 2468925 - protein, 15 aa, Entamoeba dispar
VAPRAKMNQQRSRRF

SEQ ID NO: 2468926 - protein, 42 aa, Entamoeba dispar
VAPRAKMNQQRSRRFKSAKDAENAELKQAEENRNRAKNGLPE

SEQ ID NO: 2468927 - protein, 35 aa, Entamoeba dispar
VAPRAKMNQQRSRRFKSAKEVDDNERKQAEENRNR

SEQ ID NO: 2468928 - protein, 8 aa, Entamoeba dispar
VAPRQVTE

SEQ ID NO: 2468929 - protein, 19 aa, Entamoeba dispar
VAPRSVYTTGKGSSGAGLT

SEQ ID NO: 2468930 - protein, 5 aa, Entamoeba dispar
VAPSG

SEQ ID NO: 2468931 - protein, 8 aa, Entamoeba dispar
VAPSITEM

SEQ ID NO: 2468932 - protein, 16 aa, Entamoeba dispar
VAQDYGQFEHTGDRKF

SEQ ID NO: 2468933 - protein, 12 aa, Entamoeba dispar
VAQESNRRKTLS

SEQ ID NO: 2468934 - protein, 9 aa, Entamoeba dispar
VAQRTQEEN

SEQ ID NO: 2468935 - protein, 9 aa, Entamoeba dispar
VASDSSDFD

SEQ ID NO: 2468936 - protein, 5 aa, Entamoeba dispar
VASEQ

SEQ ID NO: 2468937 - protein, 9 aa, Entamoeba dispar
VASGSDENF

SEQ ID NO: 2468938 - protein, 5 aa, Entamoeba dispar
VASHS

SEQ ID NO: 2468939 - protein, 17 aa, Entamoeba dispar
VASKKEQKTGEVQGNNM

SEQ ID NO: 2468940 - protein, 14 aa, Entamoeba dispar
VASKTDRRKQSLQT

SEQ ID NO: 2468941 - protein, 4 aa, Entamoeba dispar
VASN

SEQ ID NO: 2468942 - protein, 12 aa, Entamoeba dispar
VASQKEEAQKHL

SEQ ID NO: 2468943 - protein, 6 aa, Entamoeba dispar
VASQQN

SEQ ID NO: 2468944 - protein, 7 aa, Entamoeba dispar
VASSKER

SEQ ID NO: 2468945 - protein, 10 aa, Entamoeba dispar
VASTNENMQD

SEQ ID NO: 2468946 - protein, 26 aa, Entamoeba dispar
VASYEKEQRKTEKENEKIEDMTPEEI

SEQ ID NO: 2468947 - protein, 15 aa, Entamoeba dispar
VASYKGCSSVILNIT

SEQ ID NO: 2468948 - protein, 4 aa, Entamoeba dispar
VATE

SEQ ID NO: 2468949 - protein, 9 aa, Entamoeba dispar
VATEADSTF

SEQ ID NO: 2468950 - protein, 8 aa, Entamoeba dispar
VATESKSN

SEQ ID NO: 2468951 - protein, 7 aa, Entamoeba dispar
VATGKTA

SEQ ID NO: 2468952 - protein, 6 aa, Entamoeba dispar
VATSGA

SEQ ID NO: 2468953 - protein, 5 aa, Entamoeba dispar
VATSI

SEQ ID NO: 2468954 - protein, 10 aa, Entamoeba dispar
VATSISGKTG

SEQ ID NO: 2468955 - protein, 7 aa, Entamoeba dispar
VCPNAQD

SEQ ID NO: 2468956 - protein, 12 aa, Entamoeba dispar
VCQSQSDLPQNV

SEQ ID NO: 2468957 - protein, 6 aa, Entamoeba dispar
VCSNGN

SEQ ID NO: 2468958 - protein, 9 aa, Entamoeba dispar
VCTKTSDGK

SEQ ID NO: 2468959 - protein, 14 aa, Entamoeba dispar
VDAPADGEKHNKND

SEQ ID NO: 2468960 - protein, 5 aa, Entamoeba dispar
VDAPG

SEQ ID NO: 2468961 - protein, 14 aa, Entamoeba dispar
VDARDEIAKEIGDE

SEQ ID NO: 2468962 - protein, 8 aa, Entamoeba dispar
VDASGKAL

SEQ ID NO: 2468963 - protein, 4 aa, Entamoeba dispar
VDDA

SEQ ID NO: 2468964 - protein, 15 aa, Entamoeba dispar
VDDDEPIETANEEDI

SEQ ID NO: 2468965 - protein, 6 aa, Entamoeba dispar
VDDDQR

SEQ ID NO: 2468966 - protein, 10 aa, Entamoeba dispar
VDDEKEYEEL

SEQ ID NO: 2468967 - protein, 7 aa, Entamoeba dispar
VDDITTL

SEQ ID NO: 2468968 - protein, 16 aa, Entamoeba dispar
VDDKNKTTMTFTENEN

SEQ ID NO: 2468969 - protein, 6 aa, Entamoeba dispar
VDDKTI

SEQ ID NO: 2468970 - protein, 6 aa, Entamoeba dispar
VDDNKK

SEQ ID NO: 2468971 - protein, 9 aa, Entamoeba dispar
VDDPNFTNS

SEQ ID NO: 2468972 - protein, 15 aa, Entamoeba dispar
VDDSELNNNEVNSSS

SEQ ID NO: 2468973 - protein, 8 aa, Entamoeba dispar
VDDSKSPI

SEQ ID NO: 2468974 - protein, 10 aa, Entamoeba dispar
VDDSSSDNEI

SEQ ID NO: 2468975 - protein, 9 aa, Entamoeba dispar
VDDSTGSLT

SEQ ID NO: 2468976 - protein, 10 aa, Entamoeba dispar
VDDTAKTNIY

SEQ ID NO: 2468977 - protein, 5 aa, Entamoeba dispar
VDDYT

SEQ ID NO: 2468978 - protein, 26 aa, Entamoeba dispar
VDEDIDNSTQITDSSTQNQIDQKQTH

SEQ ID NO: 2468979 - protein, 8 aa, Entamoeba dispar
VDEDPQRF

SEQ ID NO: 2468980 - protein, 15 aa, Entamoeba dispar
VDEEDQLPSRRGDRR

SEQ ID NO: 2468981 - protein, 15 aa, Entamoeba dispar
VDEEKESVTMNSPNE

SEQ ID NO: 2468982 - protein, 4 aa, Entamoeba dispar
VDEF

SEQ ID NO: 2468983 - protein, 10 aa, Entamoeba dispar
VDEGEGRIPR

SEQ ID NO: 2468984 - protein, 7 aa, Entamoeba dispar
VDEIGSE

SEQ ID NO: 2468985 - protein, 10 aa, Entamoeba dispar
VDEKGKGTGI

SEQ ID NO: 2468986 - protein, 10 aa, Entamoeba dispar
VDEKNKGIYE

SEQ ID NO: 2468987 - protein, 5 aa, Entamoeba dispar
VDEKP

SEQ ID NO: 2468988 - protein, 5 aa, Entamoeba dispar
VDEKQ

SEQ ID NO: 2468989 - protein, 5 aa, Entamoeba dispar
VDEKV

SEQ ID NO: 2468990 - protein, 5 aa, Entamoeba dispar
VDELK

SEQ ID NO: 2468991 - protein, 11 aa, Entamoeba dispar
VDENGEQLNTT

SEQ ID NO: 2468992 - protein, 18 aa, Entamoeba dispar
VDEPPKVKSEIKNDRDTA

SEQ ID NO: 2468993 - protein, 7 aa, Entamoeba dispar
VDEQEAE

SEQ ID NO: 2468994 - protein, 11 aa, Entamoeba dispar
VDEQGAQLPEK

SEQ ID NO: 2468995 - protein, 7 aa, Entamoeba dispar
VDEQGKL

SEQ ID NO: 2468996 - protein, 9 aa, Entamoeba dispar
VDEQNINDT

SEQ ID NO: 2468997 - protein, 15 aa, Entamoeba dispar
VDEQQEEILTNLNSL

SEQ ID NO: 2468998 - protein, 7 aa, Entamoeba dispar
VDEQQTA

SEQ ID NO: 2468999 - protein, 5 aa, Entamoeba dispar
VDERD

SEQ ID NO: 2469000 - protein, 11 aa, Entamoeba dispar
VDESDDEQIED

SEQ ID NO: 2469001 - protein, 9 aa, Entamoeba dispar
VDETHRADT

SEQ ID NO: 2469002 - protein, 7 aa, Entamoeba dispar
VDETKST

SEQ ID NO: 2469003 - protein, 10 aa, Entamoeba dispar
VDETTKNELK

SEQ ID NO: 2469004 - protein, 8 aa, Entamoeba dispar
VDGDCPSI

SEQ ID NO: 2469005 - protein, 8 aa, Entamoeba dispar
VDGGVSRS

SEQ ID NO: 2469006 - protein, 4 aa, Entamoeba dispar
VDGK

SEQ ID NO: 2469007 - protein, 8 aa, Entamoeba dispar
VDGKYNSN

SEQ ID NO: 2469008 - protein, 7 aa, Entamoeba dispar
VDGLSST

SEQ ID NO: 2469009 - protein, 5 aa, Entamoeba dispar
VDGNG

SEQ ID NO: 2469010 - protein, 7 aa, Entamoeba dispar
VDGPQGA

SEQ ID NO: 2469011 - protein, 19 aa, Entamoeba dispar
VDGQASMFGGDTKKPVGGN

SEQ ID NO: 2469012 - protein, 11 aa, Entamoeba dispar
VDGRNKGKESF

SEQ ID NO: 2469013 - protein, 4 aa, Entamoeba dispar
VDGS

SEQ ID NO: 2469014 - protein, 8 aa, Entamoeba dispar
VDGTQNSD

SEQ ID NO: 2469015 - protein, 14 aa, Entamoeba dispar
VDHRKKKKIDEENS

SEQ ID NO: 2469016 - protein, 211 aa, Entamoeba dispar
VDIEAQKKKEEEEKRKGTEEEEKKAKETEEIKRKEEEKRLKEEEEKKRKEEERKQKAEEEERRHKEEEERRHKEEEERRHKEEEERKQKAEEERKQKAEEERRRKAEEERKRKEEEERRHKEEEEKKQKAEEERRRKAEEERKRKAEEERKRKEEERRRKEEERRRKEEEERRHKEEEEKKQKAEEERKRKEEEERKRKEEEEKKRAKEVA

SEQ ID NO: 2469017 - protein, 10 aa, Entamoeba dispar
VDIPSSISKL

SEQ ID NO: 2469018 - protein, 9 aa, Entamoeba dispar
VDKANTTRE

SEQ ID NO: 2469019 - protein, 13 aa, Entamoeba dispar
VDKETSKKGKGGC

SEQ ID NO: 2469020 - protein, 8 aa, Entamoeba dispar
VDKETYDN

SEQ ID NO: 2469021 - protein, 4 aa, Entamoeba dispar
VDKG

SEQ ID NO: 2469022 - protein, 9 aa, Entamoeba dispar
VDKKEPNNI

SEQ ID NO: 2469023 - protein, 9 aa, Entamoeba dispar
VDKKKKSDV

SEQ ID NO: 2469024 - protein, 7 aa, Entamoeba dispar
VDKNHAF

SEQ ID NO: 2469025 - protein, 8 aa, Entamoeba dispar
VDKNTNSI

SEQ ID NO: 2469026 - protein, 10 aa, Entamoeba dispar
VDKSGRLNGE

SEQ ID NO: 2469027 - protein, 17 aa, Entamoeba dispar
VDKSWASMKGGKPIDQP

SEQ ID NO: 2469028 - protein, 8 aa, Entamoeba dispar
VDKTKNRQ

SEQ ID NO: 2469029 - protein, 9 aa, Entamoeba dispar
VDKTPNVSV

SEQ ID NO: 2469030 - protein, 10 aa, Entamoeba dispar
VDKYDKIPQD

SEQ ID NO: 2469031 - protein, 8 aa, Entamoeba dispar
VDLATSDA

SEQ ID NO: 2469032 - protein, 30 aa, Entamoeba dispar
VDLGNSNENIPKRNNTNPKTNLQKNEPKYS

SEQ ID NO: 2469033 - protein, 5 aa, Entamoeba dispar
VDLNP

SEQ ID NO: 2469034 - protein, 4 aa, Entamoeba dispar
VDMS

SEQ ID NO: 2469035 - protein, 4 aa, Entamoeba dispar
VDNE

SEQ ID NO: 2469036 - protein, 7 aa, Entamoeba dispar
VDNENKD

SEQ ID NO: 2469037 - protein, 13 aa, Entamoeba dispar
VDNENKGKEIEQI

SEQ ID NO: 2469038 - protein, 6 aa, Entamoeba dispar
VDNESI

SEQ ID NO: 2469039 - protein, 4 aa, Entamoeba dispar
VDNG

SEQ ID NO: 2469040 - protein, 10 aa, Entamoeba dispar
VDNGDNNAFV

SEQ ID NO: 2469041 - protein, 12 aa, Entamoeba dispar
VDNHENNSQRKF

SEQ ID NO: 2469042 - protein, 11 aa, Entamoeba dispar
VDNKLDNLQES

SEQ ID NO: 2469043 - protein, 7 aa, Entamoeba dispar
VDNKTQE

SEQ ID NO: 2469044 - protein, 7 aa, Entamoeba dispar
VDNLDTR

SEQ ID NO: 2469045 - protein, 6 aa, Entamoeba dispar
VDNPND

SEQ ID NO: 2469046 - protein, 8 aa, Entamoeba dispar
VDNPNEVG

SEQ ID NO: 2469047 - protein, 12 aa, Entamoeba dispar
VDNPTKRVEEKI

SEQ ID NO: 2469048 - protein, 5 aa, Entamoeba dispar
VDNQS

SEQ ID NO: 2469049 - protein, 8 aa, Entamoeba dispar
VDNRTKEI

SEQ ID NO: 2469050 - protein, 7 aa, Entamoeba dispar
VDNVEKQ

SEQ ID NO: 2469051 - protein, 7 aa, Entamoeba dispar
VDNYPDT

SEQ ID NO: 2469052 - protein, 8 aa, Entamoeba dispar
VDPDNKYH

SEQ ID NO: 2469053 - protein, 10 aa, Entamoeba dispar
VDPEEAQKNF

SEQ ID NO: 2469054 - protein, 17 aa, Entamoeba dispar
VDPISGLKEENGDEAFT

SEQ ID NO: 2469055 - protein, 6 aa, Entamoeba dispar
VDPKGS

SEQ ID NO: 2469056 - protein, 12 aa, Entamoeba dispar
VDPKTEKSYKTL

SEQ ID NO: 2469057 - protein, 7 aa, Entamoeba dispar
VDPKTKI

SEQ ID NO: 2469058 - protein, 5 aa, Entamoeba dispar
VDPLD

SEQ ID NO: 2469059 - protein, 10 aa, Entamoeba dispar
VDPNETDEIE

SEQ ID NO: 2469060 - protein, 8 aa, Entamoeba dispar
VDPNSEMD

SEQ ID NO: 2469061 - protein, 10 aa, Entamoeba dispar
VDPPDSKKNR

SEQ ID NO: 2469062 - protein, 7 aa, Entamoeba dispar
VDPRSMS

SEQ ID NO: 2469063 - protein, 25 aa, Entamoeba dispar
VDPSEDTNIKSVKYPDQHLDGQHAD

SEQ ID NO: 2469064 - protein, 6 aa, Entamoeba dispar
VDPSQI

SEQ ID NO: 2469065 - protein, 9 aa, Entamoeba dispar
VDPSSFGGS

SEQ ID NO: 2469066 - protein, 13 aa, Entamoeba dispar
VDPTEGMTEEEKS

SEQ ID NO: 2469067 - protein, 14 aa, Entamoeba dispar
VDPTKKDSAVISSP

SEQ ID NO: 2469068 - protein, 12 aa, Entamoeba dispar
VDPTQTKNENLE

SEQ ID NO: 2469069 - protein, 7 aa, Entamoeba dispar
VDQGGVS

SEQ ID NO: 2469070 - protein, 10 aa, Entamoeba dispar
VDQNKRWNSQ

SEQ ID NO: 2469071 - protein, 14 aa, Entamoeba dispar
VDQRGELTDLQKEQ

SEQ ID NO: 2469072 - protein, 10 aa, Entamoeba dispar
VDQRKTKWIN

SEQ ID NO: 2469073 - protein, 6 aa, Entamoeba dispar
VDRERL

SEQ ID NO: 2469074 - protein, 10 aa, Entamoeba dispar
VDRETQQNIF

SEQ ID NO: 2469075 - protein, 7 aa, Entamoeba dispar
VDRGSRG

SEQ ID NO: 2469076 - protein, 13 aa, Entamoeba dispar
VDRNESQIKRRPK

SEQ ID NO: 2469077 - protein, 15 aa, Entamoeba dispar
VDRRNLQKDEINERH

SEQ ID NO: 2469078 - protein, 9 aa, Entamoeba dispar
VDSDDDDIT

SEQ ID NO: 2469079 - protein, 10 aa, Entamoeba dispar
VDSDKTKIRD

SEQ ID NO: 2469080 - protein, 27 aa, Entamoeba dispar
VDSDNINEELTHKKPLKKPKELKKEDK

SEQ ID NO: 2469081 - protein, 7 aa, Entamoeba dispar
VDSDSDI

SEQ ID NO: 2469082 - protein, 11 aa, Entamoeba dispar
VDSEKNLPQIS

SEQ ID NO: 2469083 - protein, 16 aa, Entamoeba dispar
VDSERGVTKEEGMQKS

SEQ ID NO: 2469084 - protein, 4 aa, Entamoeba dispar
VDSI

SEQ ID NO: 2469085 - protein, 18 aa, Entamoeba dispar
VDSIQGISKEGFKLPDDV

SEQ ID NO: 2469086 - protein, 17 aa, Entamoeba dispar
VDSKENNSNNIIPPRKT

SEQ ID NO: 2469087 - protein, 6 aa, Entamoeba dispar
VDSKSN

SEQ ID NO: 2469088 - protein, 8 aa, Entamoeba dispar
VDSLETQY

SEQ ID NO: 2469089 - protein, 6 aa, Entamoeba dispar
VDSNNK

SEQ ID NO: 2469090 - protein, 5 aa, Entamoeba dispar
VDSPN

SEQ ID NO: 2469091 - protein, 7 aa, Entamoeba dispar
VDSPVKR

SEQ ID NO: 2469092 - protein, 9 aa, Entamoeba dispar
VDSQESQLI

SEQ ID NO: 2469093 - protein, 8 aa, Entamoeba dispar
VDSREASV

SEQ ID NO: 2469094 - protein, 14 aa, Entamoeba dispar
VDSSDTDDNNQIND

SEQ ID NO: 2469095 - protein, 7 aa, Entamoeba dispar
VDSSQLS

SEQ ID NO: 2469096 - protein, 8 aa, Entamoeba dispar
VDSTEGLS

SEQ ID NO: 2469097 - protein, 29 aa, Entamoeba dispar
VDTAANSIRDTAFKKQSLDNITAIVVKIP

SEQ ID NO: 2469098 - protein, 4 aa, Entamoeba dispar
VDTD

SEQ ID NO: 2469099 - protein, 22 aa, Entamoeba dispar
VDTDAKEEKKPKLPTNDEPKVV

SEQ ID NO: 2469100 - protein, 11 aa, Entamoeba dispar
VDTDKDGKISF

SEQ ID NO: 2469101 - protein, 9 aa, Entamoeba dispar
VDTEKEDLR

SEQ ID NO: 2469102 - protein, 11 aa, Entamoeba dispar
VDTETTNKDGI

SEQ ID NO: 2469103 - protein, 5 aa, Entamoeba dispar
VDTIS

SEQ ID NO: 2469104 - protein, 11 aa, Entamoeba dispar
VDTKTKISDIR

SEQ ID NO: 2469105 - protein, 20 aa, Entamoeba dispar
VDTKTKISDIRKSNQNIPET

SEQ ID NO: 2469106 - protein, 9 aa, Entamoeba dispar
VDTKTKLSD

SEQ ID NO: 2469107 - protein, 4 aa, Entamoeba dispar
VDTP

SEQ ID NO: 2469108 - protein, 5 aa, Entamoeba dispar
VDTQE

SEQ ID NO: 2469109 - protein, 11 aa, Entamoeba dispar
VDTSNPSYSSL

SEQ ID NO: 2469110 - protein, 8 aa, Entamoeba dispar
VDTSPEIA

SEQ ID NO: 2469111 - protein, 16 aa, Entamoeba dispar
VDTTNNRYGYCDDSGN

SEQ ID NO: 2469112 - protein, 14 aa, Entamoeba dispar
VEAKEKKPTKKNKK

SEQ ID NO: 2469113 - protein, 18 aa, Entamoeba dispar
VEALKEEKELEKINNPIK

SEQ ID NO: 2469114 - protein, 13 aa, Entamoeba dispar
VEAPKSDKEIREE

SEQ ID NO: 2469115 - protein, 10 aa, Entamoeba dispar
VEAQNNNEEV

SEQ ID NO: 2469116 - protein, 21 aa, Entamoeba dispar
VEARERAVTNLNGTKLGENEI

SEQ ID NO: 2469117 - protein, 8 aa, Entamoeba dispar
VEASEDEL

SEQ ID NO: 2469118 - protein, 4 aa, Entamoeba dispar
VECG

SEQ ID NO: 2469119 - protein, 16 aa, Entamoeba dispar
VEDDEEDPRGGVQCAA

SEQ ID NO: 2469120 - protein, 15 aa, Entamoeba dispar
VEDDGKTAWKLGNPE

SEQ ID NO: 2469121 - protein, 18 aa, Entamoeba dispar
VEDEPVSEVSLSNIARSM

SEQ ID NO: 2469122 - protein, 4 aa, Entamoeba dispar
VEDF

SEQ ID NO: 2469123 - protein, 7 aa, Entamoeba dispar
VEDGKPV

SEQ ID NO: 2469124 - protein, 8 aa, Entamoeba dispar
VEDGTGFS

SEQ ID NO: 2469125 - protein, 7 aa, Entamoeba dispar
VEDGTNK

SEQ ID NO: 2469126 - protein, 18 aa, Entamoeba dispar
VEDKIEEKKQDSDIRYKG

SEQ ID NO: 2469127 - protein, 8 aa, Entamoeba dispar
VEDKIRPK

SEQ ID NO: 2469128 - protein, 23 aa, Entamoeba dispar
VEDKNEKKVDDDTITEVASETEE

SEQ ID NO: 2469129 - protein, 6 aa, Entamoeba dispar
VEDKVS

SEQ ID NO: 2469130 - protein, 8 aa, Entamoeba dispar
VEDPKKTL

SEQ ID NO: 2469131 - protein, 19 aa, Entamoeba dispar
VEDPPEEDYIDENQQYEEM

SEQ ID NO: 2469132 - protein, 25 aa, Entamoeba dispar
VEDPSNPSKPKKNFSLETPKSKYQL

SEQ ID NO: 2469133 - protein, 5 aa, Entamoeba dispar
VEDQM

SEQ ID NO: 2469134 - protein, 8 aa, Entamoeba dispar
VEDSRQND

SEQ ID NO: 2469135 - protein, 9 aa, Entamoeba dispar
VEDTNTTFE

SEQ ID NO: 2469136 - protein, 6 aa, Entamoeba dispar
VEDTTP

SEQ ID NO: 2469137 - protein, 6 aa, Entamoeba dispar
VEDYQT

SEQ ID NO: 2469138 - protein, 4 aa, Entamoeba dispar
VEEA

SEQ ID NO: 2469139 - protein, 6 aa, Entamoeba dispar
VEEAQK

SEQ ID NO: 2469140 - protein, 11 aa, Entamoeba dispar
VEEAQRQKEYI

SEQ ID NO: 2469141 - protein, 10 aa, Entamoeba dispar
VEEASNGSVS

SEQ ID NO: 2469142 - protein, 14 aa, Entamoeba dispar
VEEDDKQNGGPQYD

SEQ ID NO: 2469143 - protein, 13 aa, Entamoeba dispar
VEEDDNEEEWEDG

SEQ ID NO: 2469144 - protein, 5 aa, Entamoeba dispar
VEEDV

SEQ ID NO: 2469145 - protein, 4 aa, Entamoeba dispar
VEEE

SEQ ID NO: 2469146 - protein, 25 aa, Entamoeba dispar
VEEEASFARNREEKEQPSDQIQRHY

SEQ ID NO: 2469147 - protein, 17 aa, Entamoeba dispar
VEEEDPELAEQMREDPE

SEQ ID NO: 2469148 - protein, 8 aa, Entamoeba dispar
VEEEKQKK

SEQ ID NO: 2469149 - protein, 11 aa, Entamoeba dispar
VEEEKRESLLQ

SEQ ID NO: 2469150 - protein, 7 aa, Entamoeba dispar
VEEEKRM

SEQ ID NO: 2469151 - protein, 10 aa, Entamoeba dispar
VEEEKTKPED

SEQ ID NO: 2469152 - protein, 8 aa, Entamoeba dispar
VEEFTKKG

SEQ ID NO: 2469153 - protein, 6 aa, Entamoeba dispar
VEEGKR

SEQ ID NO: 2469154 - protein, 12 aa, Entamoeba dispar
VEEGNSLTSSVN

SEQ ID NO: 2469155 - protein, 14 aa, Entamoeba dispar
VEEIPESKESQIGF

SEQ ID NO: 2469156 - protein, 16 aa, Entamoeba dispar
VEEKDTAQFPEGSPDY

SEQ ID NO: 2469157 - protein, 11 aa, Entamoeba dispar
VEEKEKELNSL

SEQ ID NO: 2469158 - protein, 6 aa, Entamoeba dispar
VEEKMR

SEQ ID NO: 2469159 - protein, 9 aa, Entamoeba dispar
VEEKPERAH

SEQ ID NO: 2469160 - protein, 20 aa, Entamoeba dispar
VEELENEKNDIKQKNEEQES

SEQ ID NO: 2469161 - protein, 15 aa, Entamoeba dispar
VEELTEVKKEKEEND

SEQ ID NO: 2469162 - protein, 4 aa, Entamoeba dispar
VEEN

SEQ ID NO: 2469163 - protein, 5 aa, Entamoeba dispar
VEEND

SEQ ID NO: 2469164 - protein, 6 aa, Entamoeba dispar
VEENED

SEQ ID NO: 2469165 - protein, 19 aa, Entamoeba dispar
VEENKRSVELGDKKSDLVE

SEQ ID NO: 2469166 - protein, 69 aa, Entamoeba dispar
VEENTGMKSNAKIDSTQQKEGEGSGNNEENNTKVGEGEGHVNGNSKKEQQELRKVQQEKKGNGDSQNHI

SEQ ID NO: 2469167 - protein, 27 aa, Entamoeba dispar
VEEPDHTSADDDSNDDDEKLKEKREWD

SEQ ID NO: 2469168 - protein, 10 aa, Entamoeba dispar
VEEPKIDEDG

SEQ ID NO: 2469169 - protein, 16 aa, Entamoeba dispar
VEERKDIEGLYQAKEL

SEQ ID NO: 2469170 - protein, 14 aa, Entamoeba dispar
VEESEVNHTTAPID

SEQ ID NO: 2469171 - protein, 17 aa, Entamoeba dispar
VEESRSPNLSIQSDNDE

SEQ ID NO: 2469172 - protein, 24 aa, Entamoeba dispar
VEESSSSSDSLSNSMNSSSSDEYV

SEQ ID NO: 2469173 - protein, 18 aa, Entamoeba dispar
VEETIEEKMKRSASEINE

SEQ ID NO: 2469174 - protein, 14 aa, Entamoeba dispar
VEETKRIIGNIDTN

SEQ ID NO: 2469175 - protein, 11 aa, Entamoeba dispar
VEETQKPQEMT

SEQ ID NO: 2469176 - protein, 7 aa, Entamoeba dispar
VEETYKR

SEQ ID NO: 2469177 - protein, 4 aa, Entamoeba dispar
VEEV

SEQ ID NO: 2469178 - protein, 7 aa, Entamoeba dispar
VEEVREV

SEQ ID NO: 2469179 - protein, 13 aa, Entamoeba dispar
VEEYQKAGHNPWP

SEQ ID NO: 2469180 - protein, 8 aa, Entamoeba dispar
VEFDESRR

SEQ ID NO: 2469181 - protein, 6 aa, Entamoeba dispar
VEGEKE

SEQ ID NO: 2469182 - protein, 8 aa, Entamoeba dispar
VEGEKKRV

SEQ ID NO: 2469183 - protein, 17 aa, Entamoeba dispar
VEGESKLSQLSSKTKGI

SEQ ID NO: 2469184 - protein, 5 aa, Entamoeba dispar
VEGGA

SEQ ID NO: 2469185 - protein, 8 aa, Entamoeba dispar
VEGGNDSF

SEQ ID NO: 2469186 - protein, 4 aa, Entamoeba dispar
VEGI

SEQ ID NO: 2469187 - protein, 8 aa, Entamoeba dispar
VEGIKSNY

SEQ ID NO: 2469188 - protein, 5 aa, Entamoeba dispar
VEGIT

SEQ ID NO: 2469189 - protein, 9 aa, Entamoeba dispar
VEGKKRKEV

SEQ ID NO: 2469190 - protein, 9 aa, Entamoeba dispar
VEGKPTGKI

SEQ ID NO: 2469191 - protein, 5 aa, Entamoeba dispar
VEGKS

SEQ ID NO: 2469192 - protein, 8 aa, Entamoeba dispar
VEGKTHVE

SEQ ID NO: 2469193 - protein, 7 aa, Entamoeba dispar
VEGKTSE

SEQ ID NO: 2469194 - protein, 5 aa, Entamoeba dispar
VEGLA

SEQ ID NO: 2469195 - protein, 12 aa, Entamoeba dispar
VEGNKKETNTRD

SEQ ID NO: 2469196 - protein, 6 aa, Entamoeba dispar
VEGNKS

SEQ ID NO: 2469197 - protein, 8 aa, Entamoeba dispar
VEGQNKTV

SEQ ID NO: 2469198 - protein, 12 aa, Entamoeba dispar
VEGQNLKGQEEF

SEQ ID NO: 2469199 - protein, 10 aa, Entamoeba dispar
VEGRDDENTV

SEQ ID NO: 2469200 - protein, 7 aa, Entamoeba dispar
VEGSDEI

SEQ ID NO: 2469201 - protein, 11 aa, Entamoeba dispar
VEGSKAEAHTH

SEQ ID NO: 2469202 - protein, 9 aa, Entamoeba dispar
VEGTPDANG

SEQ ID NO: 2469203 - protein, 15 aa, Entamoeba dispar
VEGTPSLKLTSTTKI

SEQ ID NO: 2469204 - protein, 178 aa, Entamoeba dispar
VEGTRKSSRGGNGGFQRGGRGFGGGNGRGRGAERREDRRRDDRDRHDYDRRDDRDRRDYYDRRDDRDRRDYYDRRDDRDRHEYESSRRDDRDRHGYSSSRRDDRYDYESSRRDDRDRHGYSSSRRDDRDRYEESSRRDDRDRHGYSSSRRDDRGDRYDDRSPRRDDRSSNRREDRDHH

SEQ ID NO: 2469205 - protein, 8 aa, Entamoeba dispar
VEGVTDEE

SEQ ID NO: 2469206 - protein, 6 aa, Entamoeba dispar
VEHDSK

SEQ ID NO: 2469207 - protein, 24 aa, Entamoeba dispar
VEHIDNEKHEQTSSSVKPIAKENV

SEQ ID NO: 2469208 - protein, 6 aa, Entamoeba dispar
VEHPGL

SEQ ID NO: 2469209 - protein, 4 aa, Entamoeba dispar
VEIE

SEQ ID NO: 2469210 - protein, 5 aa, Entamoeba dispar
VEIEN

SEQ ID NO: 2469211 - protein, 10 aa, Entamoeba dispar
VEIPPPSSTQ

SEQ ID NO: 2469212 - protein, 7 aa, Entamoeba dispar
VEISQDK

SEQ ID NO: 2469213 - protein, 8 aa, Entamoeba dispar
VEITKNNK

SEQ ID NO: 2469214 - protein, 10 aa, Entamoeba dispar
VEKDEINPHP

SEQ ID NO: 2469215 - protein, 11 aa, Entamoeba dispar
VEKDEINPRPH

SEQ ID NO: 2469216 - protein, 5 aa, Entamoeba dispar
VEKEE

SEQ ID NO: 2469217 - protein, 15 aa, Entamoeba dispar
VEKENSQASSERTKR

SEQ ID NO: 2469218 - protein, 12 aa, Entamoeba dispar
VEKETTPPLTEK

SEQ ID NO: 2469219 - protein, 7 aa, Entamoeba dispar
VEKGDLK

SEQ ID NO: 2469220 - protein, 23 aa, Entamoeba dispar
VEKGEVAKKKDLKEAFGKTNEDD

SEQ ID NO: 2469221 - protein, 9 aa, Entamoeba dispar
VEKGQKEFT

SEQ ID NO: 2469222 - protein, 7 aa, Entamoeba dispar
VEKGSIV

SEQ ID NO: 2469223 - protein, 7 aa, Entamoeba dispar
VEKGTSF

SEQ ID NO: 2469224 - protein, 9 aa, Entamoeba dispar
VEKKDIAEE

SEQ ID NO: 2469225 - protein, 10 aa, Entamoeba dispar
VEKKEQSSSV

SEQ ID NO: 2469226 - protein, 12 aa, Entamoeba dispar
VEKKRLSEGYSP

SEQ ID NO: 2469227 - protein, 8 aa, Entamoeba dispar
VEKNNEPF

SEQ ID NO: 2469228 - protein, 5 aa, Entamoeba dispar
VEKPL

SEQ ID NO: 2469229 - protein, 10 aa, Entamoeba dispar
VEKSPKVSNI

SEQ ID NO: 2469230 - protein, 5 aa, Entamoeba dispar
VEKSQ

SEQ ID NO: 2469231 - protein, 5 aa, Entamoeba dispar
VEKSV

SEQ ID NO: 2469232 - protein, 9 aa, Entamoeba dispar
VEKTQMNAN

SEQ ID NO: 2469233 - protein, 19 aa, Entamoeba dispar
VEKVGENEWQTTIEDEHHS

SEQ ID NO: 2469234 - protein, 7 aa, Entamoeba dispar
VEKYPEE

SEQ ID NO: 2469235 - protein, 66 aa, Entamoeba dispar
VELENEKQKEDRITQEEEPIQQEIENERLKEENTITQKDPGVIQEKTKPNQENTEIENTKPTEEIE

SEQ ID NO: 2469236 - protein, 11 aa, Entamoeba dispar
VELSDDPDTKL

SEQ ID NO: 2469237 - protein, 5 aa, Entamoeba dispar
VENDS

SEQ ID NO: 2469238 - protein, 5 aa, Entamoeba dispar
VENEM

SEQ ID NO: 2469239 - protein, 12 aa, Entamoeba dispar
VENGANGSKLDE

SEQ ID NO: 2469240 - protein, 8 aa, Entamoeba dispar
VENKENDC

SEQ ID NO: 2469241 - protein, 15 aa, Entamoeba dispar
VENKKEEAKNHNSNS

SEQ ID NO: 2469242 - protein, 6 aa, Entamoeba dispar
VENKKM

SEQ ID NO: 2469243 - protein, 6 aa, Entamoeba dispar
VENKPA

SEQ ID NO: 2469244 - protein, 17 aa, Entamoeba dispar
VENKRRNSLSSNQPQQI

SEQ ID NO: 2469245 - protein, 4 aa, Entamoeba dispar
VENL

SEQ ID NO: 2469246 - protein, 5 aa, Entamoeba dispar
VENNA

SEQ ID NO: 2469247 - protein, 8 aa, Entamoeba dispar
VENNDKSI

SEQ ID NO: 2469248 - protein, 5 aa, Entamoeba dispar
VENPN

SEQ ID NO: 2469249 - protein, 7 aa, Entamoeba dispar
VENPQKQ

SEQ ID NO: 2469250 - protein, 7 aa, Entamoeba dispar
VENSATA

SEQ ID NO: 2469251 - protein, 4 aa, Entamoeba dispar
VENT

SEQ ID NO: 2469252 - protein, 6 aa, Entamoeba dispar
VENTPF

SEQ ID NO: 2469253 - protein, 10 aa, Entamoeba dispar
VENVGRERID

SEQ ID NO: 2469254 - protein, 20 aa, Entamoeba dispar
VEPEESAVLSGKPKGPHGIQ

SEQ ID NO: 2469255 - protein, 7 aa, Entamoeba dispar
VEPEESV

SEQ ID NO: 2469256 - protein, 17 aa, Entamoeba dispar
VEPINADKQTSILSKEK

SEQ ID NO: 2469257 - protein, 7 aa, Entamoeba dispar
VEPITEK

SEQ ID NO: 2469258 - protein, 15 aa, Entamoeba dispar
VEPITEKKPIRIPSK

SEQ ID NO: 2469259 - protein, 4 aa, Entamoeba dispar
VEPK

SEQ ID NO: 2469260 - protein, 5 aa, Entamoeba dispar
VEPKV

SEQ ID NO: 2469261 - protein, 4 aa, Entamoeba dispar
VEPM

SEQ ID NO: 2469262 - protein, 8 aa, Entamoeba dispar
VEPNDSID

SEQ ID NO: 2469263 - protein, 10 aa, Entamoeba dispar
VEPNKEKSLQ

SEQ ID NO: 2469264 - protein, 7 aa, Entamoeba dispar
VEPPDNN

SEQ ID NO: 2469265 - protein, 6 aa, Entamoeba dispar
VEPPHS

SEQ ID NO: 2469266 - protein, 10 aa, Entamoeba dispar
VEPPNEDDLI

SEQ ID NO: 2469267 - protein, 10 aa, Entamoeba dispar
VEPPPKAELI

SEQ ID NO: 2469268 - protein, 7 aa, Entamoeba dispar
VEPPPKV

SEQ ID NO: 2469269 - protein, 9 aa, Entamoeba dispar
VEPRGSNGF

SEQ ID NO: 2469270 - protein, 11 aa, Entamoeba dispar
VEPSNKDTYVG

SEQ ID NO: 2469271 - protein, 9 aa, Entamoeba dispar
VEPTNERAF

SEQ ID NO: 2469272 - protein, 12 aa, Entamoeba dispar
VEQAEATKNAIA

SEQ ID NO: 2469273 - protein, 9 aa, Entamoeba dispar
VEQALNDNN

SEQ ID NO: 2469274 - protein, 12 aa, Entamoeba dispar
VEQARGDRSREN

SEQ ID NO: 2469275 - protein, 7 aa, Entamoeba dispar
VEQDEGL

SEQ ID NO: 2469276 - protein, 7 aa, Entamoeba dispar
VEQGAEE

SEQ ID NO: 2469277 - protein, 15 aa, Entamoeba dispar
VEQGGEKKKRKRQKK

SEQ ID NO: 2469278 - protein, 11 aa, Entamoeba dispar
VEQGTNQNGEF

SEQ ID NO: 2469279 - protein, 5 aa, Entamoeba dispar
VEQKD

SEQ ID NO: 2469280 - protein, 4 aa, Entamoeba dispar
VEQL

SEQ ID NO: 2469281 - protein, 14 aa, Entamoeba dispar
VEQLEQESLPPPLQ

SEQ ID NO: 2469282 - protein, 9 aa, Entamoeba dispar
VEQLSTGSL

SEQ ID NO: 2469283 - protein, 5 aa, Entamoeba dispar
VEQNG

SEQ ID NO: 2469284 - protein, 5 aa, Entamoeba dispar
VEQNQ

SEQ ID NO: 2469285 - protein, 7 aa, Entamoeba dispar
VEQPNTQ

SEQ ID NO: 2469286 - protein, 9 aa, Entamoeba dispar
VEQPSKDGI

SEQ ID NO: 2469287 - protein, 36 aa, Entamoeba dispar
VEQQMADSSDFKPFEGEGSRLGRSRDMEQNDYTDTE

SEQ ID NO: 2469288 - protein, 5 aa, Entamoeba dispar
VEQQP

SEQ ID NO: 2469289 - protein, 9 aa, Entamoeba dispar
VEQRKTKTI

SEQ ID NO: 2469290 - protein, 20 aa, Entamoeba dispar
VEQSNGSSTLGNQPKTIKPC

SEQ ID NO: 2469291 - protein, 4 aa, Entamoeba dispar
VEQT

SEQ ID NO: 2469292 - protein, 7 aa, Entamoeba dispar
VEQTRAE

SEQ ID NO: 2469293 - protein, 9 aa, Entamoeba dispar
VEQVRPGQT

SEQ ID NO: 2469294 - protein, 9 aa, Entamoeba dispar
VERDDESYS

SEQ ID NO: 2469295 - protein, 9 aa, Entamoeba dispar
VERDDPTYT

SEQ ID NO: 2469296 - protein, 9 aa, Entamoeba dispar
VERDGSLNT

SEQ ID NO: 2469297 - protein, 12 aa, Entamoeba dispar
VERESKEKVLEK

SEQ ID NO: 2469298 - protein, 54 aa, Entamoeba dispar
VERKKDKRQPPQEEKPKNSPIKSNGIVERKKEKKNLSQDSNPPKRVSLFKQRMG

SEQ ID NO: 2469299 - protein, 16 aa, Entamoeba dispar
VERKRASGQQIARAEG

SEQ ID NO: 2469300 - protein, 9 aa, Entamoeba dispar
VERKSNEKA

SEQ ID NO: 2469301 - protein, 5 aa, Entamoeba dispar
VERSD

SEQ ID NO: 2469302 - protein, 21 aa, Entamoeba dispar
VERSKRKAKKKEIKKNPKNFK

SEQ ID NO: 2469303 - protein, 12 aa, Entamoeba dispar
VERTFSKEGVSN

SEQ ID NO: 2469304 - protein, 8 aa, Entamoeba dispar
VESAGDSG

SEQ ID NO: 2469305 - protein, 14 aa, Entamoeba dispar
VESASRKSGVLPET

SEQ ID NO: 2469306 - protein, 13 aa, Entamoeba dispar
VESASRKSRVLPE

SEQ ID NO: 2469307 - protein, 15 aa, Entamoeba dispar
VESASRNSKVLPESR

SEQ ID NO: 2469308 - protein, 14 aa, Entamoeba dispar
VESASRNSKVLPET

SEQ ID NO: 2469309 - protein, 4 aa, Entamoeba dispar
VESD

SEQ ID NO: 2469310 - protein, 8 aa, Entamoeba dispar
VESDDTLF

SEQ ID NO: 2469311 - protein, 11 aa, Entamoeba dispar
VESDTVKIRKS

SEQ ID NO: 2469312 - protein, 43 aa, Entamoeba dispar
VESEEEEEISKPSPRKPRQTKDKSKITHQKKINEKKEIDESED

SEQ ID NO: 2469313 - protein, 20 aa, Entamoeba dispar
VESEETKKELKKKKEEEIKL

SEQ ID NO: 2469314 - protein, 5 aa, Entamoeba dispar
VESEH

SEQ ID NO: 2469315 - protein, 6 aa, Entamoeba dispar
VESGIT

SEQ ID NO: 2469316 - protein, 6 aa, Entamoeba dispar
VESGPV

SEQ ID NO: 2469317 - protein, 26 aa, Entamoeba dispar
VESIQKKPEINLKDENDNLIGTSQEL

SEQ ID NO: 2469318 - protein, 8 aa, Entamoeba dispar
VESISKGN

SEQ ID NO: 2469319 - protein, 4 aa, Entamoeba dispar
VESK

SEQ ID NO: 2469320 - protein, 5 aa, Entamoeba dispar
VESNK

SEQ ID NO: 2469321 - protein, 7 aa, Entamoeba dispar
VESNKRE

SEQ ID NO: 2469322 - protein, 14 aa, Entamoeba dispar
VESPGKVKYEDIGG

SEQ ID NO: 2469323 - protein, 10 aa, Entamoeba dispar
VESQRPNLHQ

SEQ ID NO: 2469324 - protein, 5 aa, Entamoeba dispar
VESRT

SEQ ID NO: 2469325 - protein, 4 aa, Entamoeba dispar
VESS

SEQ ID NO: 2469326 - protein, 5 aa, Entamoeba dispar
VESSD

SEQ ID NO: 2469327 - protein, 8 aa, Entamoeba dispar
VESSDGEA

SEQ ID NO: 2469328 - protein, 15 aa, Entamoeba dispar
VESSGGNQDLGGNEF

SEQ ID NO: 2469329 - protein, 7 aa, Entamoeba dispar
VESTTKP

SEQ ID NO: 2469330 - protein, 14 aa, Entamoeba dispar
VETARSTKSFATGN

SEQ ID NO: 2469331 - protein, 4 aa, Entamoeba dispar
VETE

SEQ ID NO: 2469332 - protein, 5 aa, Entamoeba dispar
VETEA

SEQ ID NO: 2469333 - protein, 7 aa, Entamoeba dispar
VETEGKP

SEQ ID NO: 2469334 - protein, 14 aa, Entamoeba dispar
VETEKAGQSQKSIE

SEQ ID NO: 2469335 - protein, 25 aa, Entamoeba dispar
VETEQPKETIDDGIESKEYPKELSK

SEQ ID NO: 2469336 - protein, 7 aa, Entamoeba dispar
VETERQS

SEQ ID NO: 2469337 - protein, 5 aa, Entamoeba dispar
VETEV

SEQ ID NO: 2469338 - protein, 12 aa, Entamoeba dispar
VETGNDSGRPMS

SEQ ID NO: 2469339 - protein, 7 aa, Entamoeba dispar
VETKEKS

SEQ ID NO: 2469340 - protein, 7 aa, Entamoeba dispar
VETKQNL

SEQ ID NO: 2469341 - protein, 10 aa, Entamoeba dispar
VETKTKELEE

SEQ ID NO: 2469342 - protein, 7 aa, Entamoeba dispar
VETKYGF

SEQ ID NO: 2469343 - protein, 6 aa, Entamoeba dispar
VETNGK

SEQ ID NO: 2469344 - protein, 14 aa, Entamoeba dispar
VETNYSNEEKFQGN

SEQ ID NO: 2469345 - protein, 5 aa, Entamoeba dispar
VETPE

SEQ ID NO: 2469346 - protein, 8 aa, Entamoeba dispar
VETQPSNE

SEQ ID NO: 2469347 - protein, 9 aa, Entamoeba dispar
VETQTEADQ

SEQ ID NO: 2469348 - protein, 7 aa, Entamoeba dispar
VETTEKY

SEQ ID NO: 2469349 - protein, 6 aa, Entamoeba dispar
VEVNQE

SEQ ID NO: 2469350 - protein, 7 aa, Entamoeba dispar
VEYTGAP

SEQ ID NO: 2469351 - protein, 4 aa, Entamoeba dispar
VFEE

SEQ ID NO: 2469352 - protein, 26 aa, Entamoeba dispar
VFEKDSKKENKVNPFNTKRPRSDSTL

SEQ ID NO: 2469353 - protein, 87 aa, Entamoeba dispar
VFENGKDSTLGKEEKVEEEDDDKEKKVKEASHTSSSSTSSSTSSSSESSSSEESTSSMSSESSSNESEEEEEKKRIKKGKEGGEKKK

SEQ ID NO: 2469354 - protein, 9 aa, Entamoeba dispar
VFGGEQSDF

SEQ ID NO: 2469355 - protein, 7 aa, Entamoeba dispar
VFGGTQG

SEQ ID NO: 2469356 - protein, 7 aa, Entamoeba dispar
VFGKSSD

SEQ ID NO: 2469357 - protein, 7 aa, Entamoeba dispar
VFGSDDD

SEQ ID NO: 2469358 - protein, 16 aa, Entamoeba dispar
VFNNNKGETDKNDGMI

SEQ ID NO: 2469359 - protein, 22 aa, Entamoeba dispar
VFSNSPDDTDCDHSKKYTSRHT

SEQ ID NO: 2469360 - protein, 26 aa, Entamoeba dispar
VFTGSSDLTQAANNLKTSNLKDGYQQ

SEQ ID NO: 2469361 - protein, 6 aa, Entamoeba dispar
VGAGDS

SEQ ID NO: 2469362 - protein, 4 aa, Entamoeba dispar
VGAN

SEQ ID NO: 2469363 - protein, 7 aa, Entamoeba dispar
VGAQRGH

SEQ ID NO: 2469364 - protein, 18 aa, Entamoeba dispar
VGASETKLQGLKTEIGDR

SEQ ID NO: 2469365 - protein, 15 aa, Entamoeba dispar
VGDGEEIIYDEDDEI

SEQ ID NO: 2469366 - protein, 9 aa, Entamoeba dispar
VGDGKSSLG

SEQ ID NO: 2469367 - protein, 9 aa, Entamoeba dispar
VGDKEESIM

SEQ ID NO: 2469368 - protein, 10 aa, Entamoeba dispar
VGDKMTKEEV

SEQ ID NO: 2469369 - protein, 19 aa, Entamoeba dispar
VGDKSGKMRVSRKTTNNYF

SEQ ID NO: 2469370 - protein, 4 aa, Entamoeba dispar
VGDL

SEQ ID NO: 2469371 - protein, 39 aa, Entamoeba dispar
VGDLDKEPVYTPTEQSMVGEPNVQARREKEIANGTYVKV

SEQ ID NO: 2469372 - protein, 4 aa, Entamoeba dispar
VGDN

SEQ ID NO: 2469373 - protein, 5 aa, Entamoeba dispar
VGDQT

SEQ ID NO: 2469374 - protein, 31 aa, Entamoeba dispar
VGDRKTTKKEEEELTRRPPPPPQVPLQEDDL

SEQ ID NO: 2469375 - protein, 35 aa, Entamoeba dispar
VGDSNPTNKPRANTLNEEYKKAAAEDEEAAEKGII

SEQ ID NO: 2469376 - protein, 9 aa, Entamoeba dispar
VGDSTTDLP

SEQ ID NO: 2469377 - protein, 8 aa, Entamoeba dispar
VGDVKNKP

SEQ ID NO: 2469378 - protein, 31 aa, Entamoeba dispar
VGDYPSYSLPPNAANNGKESGKKNGKRRERM

SEQ ID NO: 2469379 - protein, 31 aa, Entamoeba dispar
VGDYPSYSLPPNTANNGKESGKKNGKRRERM

SEQ ID NO: 2469380 - protein, 13 aa, Entamoeba dispar
VGEAAECRTDAER

SEQ ID NO: 2469381 - protein, 4 aa, Entamoeba dispar
VGEE

SEQ ID NO: 2469382 - protein, 6 aa, Entamoeba dispar
VGEGAK

SEQ ID NO: 2469383 - protein, 6 aa, Entamoeba dispar
VGEGAM

SEQ ID NO: 2469384 - protein, 6 aa, Entamoeba dispar
VGEGTF

SEQ ID NO: 2469385 - protein, 6 aa, Entamoeba dispar
VGEGTY

SEQ ID NO: 2469386 - protein, 17 aa, Entamoeba dispar
VGEKAPKIRGKSYYKGE

SEQ ID NO: 2469387 - protein, 15 aa, Entamoeba dispar
VGEKPKLDEKVQKTL

SEQ ID NO: 2469388 - protein, 14 aa, Entamoeba dispar
VGELNDSITQKEKN

SEQ ID NO: 2469389 - protein, 5 aa, Entamoeba dispar
VGENM

SEQ ID NO: 2469390 - protein, 21 aa, Entamoeba dispar
VGERKQEKKHEVTSQELTAGK

SEQ ID NO: 2469391 - protein, 8 aa, Entamoeba dispar
VGESERNI

SEQ ID NO: 2469392 - protein, 6 aa, Entamoeba dispar
VGESVD

SEQ ID NO: 2469393 - protein, 10 aa, Entamoeba dispar
VGESVSKPIE

SEQ ID NO: 2469394 - protein, 7 aa, Entamoeba dispar
VGETEGK

SEQ ID NO: 2469395 - protein, 7 aa, Entamoeba dispar
VGETEKN

SEQ ID NO: 2469396 - protein, 6 aa, Entamoeba dispar
VGETNL

SEQ ID NO: 2469397 - protein, 7 aa, Entamoeba dispar
VGETNQK

SEQ ID NO: 2469398 - protein, 8 aa, Entamoeba dispar
VGETTKGL

SEQ ID NO: 2469399 - protein, 4 aa, Entamoeba dispar
VGGA

SEQ ID NO: 2469400 - protein, 6 aa, Entamoeba dispar
VGGATA

SEQ ID NO: 2469401 - protein, 9 aa, Entamoeba dispar
VGGDADRVI

SEQ ID NO: 2469402 - protein, 31 aa, Entamoeba dispar
VGGFQGSDAADVEAAYKQELANHTSVDSDGS

SEQ ID NO: 2469403 - protein, 10 aa, Entamoeba dispar
VGGGHEEYYP

SEQ ID NO: 2469404 - protein, 7 aa, Entamoeba dispar
VGGGNTL

SEQ ID NO: 2469405 - protein, 7 aa, Entamoeba dispar
VGGGQDK

SEQ ID NO: 2469406 - protein, 5 aa, Entamoeba dispar
VGGNG

SEQ ID NO: 2469407 - protein, 5 aa, Entamoeba dispar
VGGNN

SEQ ID NO: 2469408 - protein, 6 aa, Entamoeba dispar
VGGREG

SEQ ID NO: 2469409 - protein, 6 aa, Entamoeba dispar
VGGSDD

SEQ ID NO: 2469410 - protein, 8 aa, Entamoeba dispar
VGGSDGSI

SEQ ID NO: 2469411 - protein, 7 aa, Entamoeba dispar
VGGSGST

SEQ ID NO: 2469412 - protein, 6 aa, Entamoeba dispar
VGGSIR

SEQ ID NO: 2469413 - protein, 18 aa, Entamoeba dispar
VGGSSEAEVGERKDRIED

SEQ ID NO: 2469414 - protein, 6 aa, Entamoeba dispar
VGHGPG

SEQ ID NO: 2469415 - protein, 26 aa, Entamoeba dispar
VGHQPSQETPMEEEKQEEIKKEEEED

SEQ ID NO: 2469416 - protein, 7 aa, Entamoeba dispar
VGIERGV

SEQ ID NO: 2469417 - protein, 7 aa, Entamoeba dispar
VGKAKEI

SEQ ID NO: 2469418 - protein, 8 aa, Entamoeba dispar
VGKEEPAI

SEQ ID NO: 2469419 - protein, 8 aa, Entamoeba dispar
VGKEKNKR

SEQ ID NO: 2469420 - protein, 17 aa, Entamoeba dispar
VGKGPNETKRNEEEIKK

SEQ ID NO: 2469421 - protein, 4 aa, Entamoeba dispar
VGKH

SEQ ID NO: 2469422 - protein, 13 aa, Entamoeba dispar
VGKIEEVTKEKRI

SEQ ID NO: 2469423 - protein, 17 aa, Entamoeba dispar
VGKIEPNEQSLKPIRGH

SEQ ID NO: 2469424 - protein, 20 aa, Entamoeba dispar
VGKKKEKTKIAKPSLNPDWN

SEQ ID NO: 2469425 - protein, 21 aa, Entamoeba dispar
VGKKKVEGSAPEGAIMKKWGE

SEQ ID NO: 2469426 - protein, 7 aa, Entamoeba dispar
VGKPTIV

SEQ ID NO: 2469427 - protein, 7 aa, Entamoeba dispar
VGKSNSK

SEQ ID NO: 2469428 - protein, 6 aa, Entamoeba dispar
VGKSQV

SEQ ID NO: 2469429 - protein, 14 aa, Entamoeba dispar
VGKSSIAKSFGEGN

SEQ ID NO: 2469430 - protein, 8 aa, Entamoeba dispar
VGKSSTIN

SEQ ID NO: 2469431 - protein, 8 aa, Entamoeba dispar
VGKSTSLS

SEQ ID NO: 2469432 - protein, 7 aa, Entamoeba dispar
VGKTEFT

SEQ ID NO: 2469433 - protein, 5 aa, Entamoeba dispar
VGKTS

SEQ ID NO: 2469434 - protein, 4 aa, Entamoeba dispar
VGLD

SEQ ID NO: 2469435 - protein, 7 aa, Entamoeba dispar
VGLKEGD

SEQ ID NO: 2469436 - protein, 12 aa, Entamoeba dispar
VGLKGNAFSDGQ

SEQ ID NO: 2469437 - protein, 38 aa, Entamoeba dispar
VGLKKETAEEKKAKEEEIEKEKTKEEMEKKERERLTKS

SEQ ID NO: 2469438 - protein, 12 aa, Entamoeba dispar
VGLPSDGIPCNG

SEQ ID NO: 2469439 - protein, 5 aa, Entamoeba dispar
VGNEK

SEQ ID NO: 2469440 - protein, 17 aa, Entamoeba dispar
VGNGTQVKINQPGNAQP

SEQ ID NO: 2469441 - protein, 5 aa, Entamoeba dispar
VGNKT

SEQ ID NO: 2469442 - protein, 9 aa, Entamoeba dispar
VGNNPKIGM

SEQ ID NO: 2469443 - protein, 11 aa, Entamoeba dispar
VGNNQENNYPV

SEQ ID NO: 2469444 - protein, 5 aa, Entamoeba dispar
VGNSM

SEQ ID NO: 2469445 - protein, 7 aa, Entamoeba dispar
VGNSNEL

SEQ ID NO: 2469446 - protein, 7 aa, Entamoeba dispar
VGNTEAQ

SEQ ID NO: 2469447 - protein, 12 aa, Entamoeba dispar
VGNTPDAAIQVG

SEQ ID NO: 2469448 - protein, 4 aa, Entamoeba dispar
VGPE

SEQ ID NO: 2469449 - protein, 9 aa, Entamoeba dispar
VGPGAVEPV

SEQ ID NO: 2469450 - protein, 6 aa, Entamoeba dispar
VGPGPT

SEQ ID NO: 2469451 - protein, 11 aa, Entamoeba dispar
VGPNEPLTREK

SEQ ID NO: 2469452 - protein, 10 aa, Entamoeba dispar
VGPNGTGKST

SEQ ID NO: 2469453 - protein, 5 aa, Entamoeba dispar
VGPNK

SEQ ID NO: 2469454 - protein, 6 aa, Entamoeba dispar
VGPNTN

SEQ ID NO: 2469455 - protein, 5 aa, Entamoeba dispar
VGPRT

SEQ ID NO: 2469456 - protein, 7 aa, Entamoeba dispar
VGPSDDI

SEQ ID NO: 2469457 - protein, 4 aa, Entamoeba dispar
VGPV

SEQ ID NO: 2469458 - protein, 7 aa, Entamoeba dispar
VGQDGDI

SEQ ID NO: 2469459 - protein, 9 aa, Entamoeba dispar
VGQENAREA

SEQ ID NO: 2469460 - protein, 12 aa, Entamoeba dispar
VGQPKEIKKNTS

SEQ ID NO: 2469461 - protein, 9 aa, Entamoeba dispar
VGQSPGSNA

SEQ ID NO: 2469462 - protein, 8 aa, Entamoeba dispar
VGQSPSNR

SEQ ID NO: 2469463 - protein, 10 aa, Entamoeba dispar
VGRDDPLGSV

SEQ ID NO: 2469464 - protein, 12 aa, Entamoeba dispar
VGREEQKRGIES

SEQ ID NO: 2469465 - protein, 10 aa, Entamoeba dispar
VGRETKSRFH

SEQ ID NO: 2469466 - protein, 10 aa, Entamoeba dispar
VGRMRKDSDT

SEQ ID NO: 2469467 - protein, 13 aa, Entamoeba dispar
VGRTGRAGKGGNA

SEQ ID NO: 2469468 - protein, 14 aa, Entamoeba dispar
VGSASRNSKVLPET

SEQ ID NO: 2469469 - protein, 5 aa, Entamoeba dispar
VGSDG

SEQ ID NO: 2469470 - protein, 5 aa, Entamoeba dispar
VGSDI

SEQ ID NO: 2469471 - protein, 11 aa, Entamoeba dispar
VGSDSDKFTAN

SEQ ID NO: 2469472 - protein, 8 aa, Entamoeba dispar
VGSEERIN

SEQ ID NO: 2469473 - protein, 10 aa, Entamoeba dispar
VGSENTIKQS

SEQ ID NO: 2469474 - protein, 8 aa, Entamoeba dispar
VGSEQNAA

SEQ ID NO: 2469475 - protein, 6 aa, Entamoeba dispar
VGSFDP

SEQ ID NO: 2469476 - protein, 7 aa, Entamoeba dispar
VGSGDNA

SEQ ID NO: 2469477 - protein, 9 aa, Entamoeba dispar
VGSGGTGTV

SEQ ID NO: 2469478 - protein, 7 aa, Entamoeba dispar
VGSGKSS

SEQ ID NO: 2469479 - protein, 8 aa, Entamoeba dispar
VGSGPAGL

SEQ ID NO: 2469480 - protein, 13 aa, Entamoeba dispar
VGSGTERENARKE

SEQ ID NO: 2469481 - protein, 5 aa, Entamoeba dispar
VGSIK

SEQ ID NO: 2469482 - protein, 15 aa, Entamoeba dispar
VGSKSGKLYVFDEMY

SEQ ID NO: 2469483 - protein, 6 aa, Entamoeba dispar
VGSKTI

SEQ ID NO: 2469484 - protein, 14 aa, Entamoeba dispar
VGSPRTQKINSPRS

SEQ ID NO: 2469485 - protein, 5 aa, Entamoeba dispar
VGSQD

SEQ ID NO: 2469486 - protein, 10 aa, Entamoeba dispar
VGSQGSGKSS

SEQ ID NO: 2469487 - protein, 14 aa, Entamoeba dispar
VGSQRSGLESHDEE

SEQ ID NO: 2469488 - protein, 6 aa, Entamoeba dispar
VGSRRA

SEQ ID NO: 2469489 - protein, 10 aa, Entamoeba dispar
VGSRSDVEEC

SEQ ID NO: 2469490 - protein, 7 aa, Entamoeba dispar
VGSSETD

SEQ ID NO: 2469491 - protein, 22 aa, Entamoeba dispar
VGSSKNSPRHLSANYKKGSISV

SEQ ID NO: 2469492 - protein, 9 aa, Entamoeba dispar
VGSSQNPAW

SEQ ID NO: 2469493 - protein, 12 aa, Entamoeba dispar
VGSSTRVSKESI

SEQ ID NO: 2469494 - protein, 10 aa, Entamoeba dispar
VGSTTTKSPA

SEQ ID NO: 2469495 - protein, 9 aa, Entamoeba dispar
VGSTTTNSP

SEQ ID NO: 2469496 - protein, 5 aa, Entamoeba dispar
VGSYT

SEQ ID NO: 2469497 - protein, 15 aa, Entamoeba dispar
VGSYYGRGTAQEKQE

SEQ ID NO: 2469498 - protein, 6 aa, Entamoeba dispar
VGTAPI

SEQ ID NO: 2469499 - protein, 4 aa, Entamoeba dispar
VGTD

SEQ ID NO: 2469500 - protein, 5 aa, Entamoeba dispar
VGTDG

SEQ ID NO: 2469501 - protein, 9 aa, Entamoeba dispar
VGTDVKTNL

SEQ ID NO: 2469502 - protein, 8 aa, Entamoeba dispar
VGTGFSDE

SEQ ID NO: 2469503 - protein, 11 aa, Entamoeba dispar
VGTGKEESEFE

SEQ ID NO: 2469504 - protein, 7 aa, Entamoeba dispar
VGTGSNE

SEQ ID NO: 2469505 - protein, 17 aa, Entamoeba dispar
VGTKRYDAHSGGEKEIQ

SEQ ID NO: 2469506 - protein, 24 aa, Entamoeba dispar
VGTPSLSRESSAPSLNSRTRNSVC

SEQ ID NO: 2469507 - protein, 13 aa, Entamoeba dispar
VGTQIKAGQVEKT

SEQ ID NO: 2469508 - protein, 7 aa, Entamoeba dispar
VGTSAAD

SEQ ID NO: 2469509 - protein, 7 aa, Entamoeba dispar
VGTSFSK

SEQ ID NO: 2469510 - protein, 7 aa, Entamoeba dispar
VGTSGTV

SEQ ID NO: 2469511 - protein, 6 aa, Entamoeba dispar
VGTSIS

SEQ ID NO: 2469512 - protein, 8 aa, Entamoeba dispar
VGTSNGNV

SEQ ID NO: 2469513 - protein, 16 aa, Entamoeba dispar
VGTTQKGFDEFKKNAG

SEQ ID NO: 2469514 - protein, 6 aa, Entamoeba dispar
VGVGKS

SEQ ID NO: 2469515 - protein, 6 aa, Entamoeba dispar
VGVGSN

SEQ ID NO: 2469516 - protein, 7 aa, Entamoeba dispar
VGVRESN

SEQ ID NO: 2469517 - protein, 5 aa, Entamoeba dispar
VGYGQ

SEQ ID NO: 2469518 - protein, 4 aa, Entamoeba dispar
VGYL

SEQ ID NO: 2469519 - protein, 8 aa, Entamoeba dispar
VGYTNYPD

SEQ ID NO: 2469520 - protein, 4 aa, Entamoeba dispar
VHDE

SEQ ID NO: 2469521 - protein, 10 aa, Entamoeba dispar
VHDKNDYKNY

SEQ ID NO: 2469522 - protein, 4 aa, Entamoeba dispar
VHDP

SEQ ID NO: 2469523 - protein, 16 aa, Entamoeba dispar
VHGGRNMTSENKKHYI

SEQ ID NO: 2469524 - protein, 12 aa, Entamoeba dispar
VHGRATGPYATL

SEQ ID NO: 2469525 - protein, 4 aa, Entamoeba dispar
VHHQ

SEQ ID NO: 2469526 - protein, 7 aa, Entamoeba dispar
VHKEGNL

SEQ ID NO: 2469527 - protein, 27 aa, Entamoeba dispar
VHKKKEKEVNNQLPSKAKERVSRSSMY

SEQ ID NO: 2469528 - protein, 13 aa, Entamoeba dispar
VHKTESPQKRLSE

SEQ ID NO: 2469529 - protein, 8 aa, Entamoeba dispar
VHLPRKSS

SEQ ID NO: 2469530 - protein, 6 aa, Entamoeba dispar
VHNPTH

SEQ ID NO: 2469531 - protein, 5 aa, Entamoeba dispar
VHPGE

SEQ ID NO: 2469532 - protein, 5 aa, Entamoeba dispar
VHPSG

SEQ ID NO: 2469533 - protein, 17 aa, Entamoeba dispar
VHPSSETKTVNITENGT

SEQ ID NO: 2469534 - protein, 26 aa, Entamoeba dispar
VHQPNGKIKTQKWKGGSNKEKKSKGK

SEQ ID NO: 2469535 - protein, 9 aa, Entamoeba dispar
VHQQNTVSV

SEQ ID NO: 2469536 - protein, 5 aa, Entamoeba dispar
VHRQS

SEQ ID NO: 2469537 - protein, 6 aa, Entamoeba dispar
VHSDQV

SEQ ID NO: 2469538 - protein, 5 aa, Entamoeba dispar
VHSNT

SEQ ID NO: 2469539 - protein, 14 aa, Entamoeba dispar
VHTPDETIDIESGN

SEQ ID NO: 2469540 - protein, 5 aa, Entamoeba dispar
VHTPK

SEQ ID NO: 2469541 - protein, 8 aa, Entamoeba dispar
VHTSDSKV

SEQ ID NO: 2469542 - protein, 8 aa, Entamoeba dispar
VHTSSLSA

SEQ ID NO: 2469543 - protein, 7 aa, Entamoeba dispar
VHTTGDF

SEQ ID NO: 2469544 - protein, 11 aa, Entamoeba dispar
VHTTNSPQSTI

SEQ ID NO: 2469545 - protein, 19 aa, Entamoeba dispar
VIDDTKKISPAATKTGNDY

SEQ ID NO: 2469546 - protein, 7 aa, Entamoeba dispar
VIDGPKK

SEQ ID NO: 2469547 - protein, 11 aa, Entamoeba dispar
VIDNTTDNPPL

SEQ ID NO: 2469548 - protein, 13 aa, Entamoeba dispar
VIDPRTEVSEMRN

SEQ ID NO: 2469549 - protein, 12 aa, Entamoeba dispar
VIDQPPQHQGER

SEQ ID NO: 2469550 - protein, 4 aa, Entamoeba dispar
VIDS

SEQ ID NO: 2469551 - protein, 16 aa, Entamoeba dispar
VIEKEDEESFCVEESI

SEQ ID NO: 2469552 - protein, 8 aa, Entamoeba dispar
VIETKNEF

SEQ ID NO: 2469553 - protein, 10 aa, Entamoeba dispar
VIGEETTSNH

SEQ ID NO: 2469554 - protein, 5 aa, Entamoeba dispar
VIGEK

SEQ ID NO: 2469555 - protein, 8 aa, Entamoeba dispar
VIGGEEGE

SEQ ID NO: 2469556 - protein, 8 aa, Entamoeba dispar
VIGSPSGI

SEQ ID NO: 2469557 - protein, 23 aa, Entamoeba dispar
VIKEDTEITEMDNRNKDIEIETD

SEQ ID NO: 2469558 - protein, 10 aa, Entamoeba dispar
VIKPDEEKGL

SEQ ID NO: 2469559 - protein, 9 aa, Entamoeba dispar
VIKSPENIT

SEQ ID NO: 2469560 - protein, 11 aa, Entamoeba dispar
VINAQNELGET

SEQ ID NO: 2469561 - protein, 12 aa, Entamoeba dispar
VINEKKKNKSLK

SEQ ID NO: 2469562 - protein, 16 aa, Entamoeba dispar
VINNNKGETDKNDGMI

SEQ ID NO: 2469563 - protein, 7 aa, Entamoeba dispar
VINQQSE

SEQ ID NO: 2469564 - protein, 4 aa, Entamoeba dispar
VIPD

SEQ ID NO: 2469565 - protein, 13 aa, Entamoeba dispar
VIPNNQTNSREIR

SEQ ID NO: 2469566 - protein, 10 aa, Entamoeba dispar
VIPPPTPPRL

SEQ ID NO: 2469567 - protein, 5 aa, Entamoeba dispar
VIQPD

SEQ ID NO: 2469568 - protein, 5 aa, Entamoeba dispar
VIQPK

SEQ ID NO: 2469569 - protein, 5 aa, Entamoeba dispar
VIQQP

SEQ ID NO: 2469570 - protein, 13 aa, Entamoeba dispar
VIRESQKKRGAPV

SEQ ID NO: 2469571 - protein, 21 aa, Entamoeba dispar
VISEEGPKKVKKSKPQPPPTA

SEQ ID NO: 2469572 - protein, 5 aa, Entamoeba dispar
VISRQ

SEQ ID NO: 2469573 - protein, 21 aa, Entamoeba dispar
VISSARSSARSTAGDQASRVS

SEQ ID NO: 2469574 - protein, 18 aa, Entamoeba dispar
VISSNTTSQTPMKPSGLM

SEQ ID NO: 2469575 - protein, 12 aa, Entamoeba dispar
VITQPEINKKEK

SEQ ID NO: 2469576 - protein, 7 aa, Entamoeba dispar
VITTSNN

SEQ ID NO: 2469577 - protein, 14 aa, Entamoeba dispar
VKADQEEEGVPSTA

SEQ ID NO: 2469578 - protein, 7 aa, Entamoeba dispar
VKAESTD

SEQ ID NO: 2469579 - protein, 11 aa, Entamoeba dispar
VKAKGKKPEVI

SEQ ID NO: 2469580 - protein, 29 aa, Entamoeba dispar
VKAKREKRKAAKFSTEKQDLTASKKEDVI

SEQ ID NO: 2469581 - protein, 4 aa, Entamoeba dispar
VKAN

SEQ ID NO: 2469582 - protein, 7 aa, Entamoeba dispar
VKANPEI

SEQ ID NO: 2469583 - protein, 6 aa, Entamoeba dispar
VKAPKG

SEQ ID NO: 2469584 - protein, 20 aa, Entamoeba dispar
VKASQTKHIKQSISTQYPGL

SEQ ID NO: 2469585 - protein, 8 aa, Entamoeba dispar
VKDDESKS

SEQ ID NO: 2469586 - protein, 8 aa, Entamoeba dispar
VKDEVSRH

SEQ ID NO: 2469587 - protein, 5 aa, Entamoeba dispar
VKDFD

SEQ ID NO: 2469588 - protein, 7 aa, Entamoeba dispar
VKDGRKI

SEQ ID NO: 2469589 - protein, 23 aa, Entamoeba dispar
VKDHMDNPQHRGEITEEEGKEHG

SEQ ID NO: 2469590 - protein, 7 aa, Entamoeba dispar
VKDKEEI

SEQ ID NO: 2469591 - protein, 10 aa, Entamoeba dispar
VKDKKESDIN

SEQ ID NO: 2469592 - protein, 16 aa, Entamoeba dispar
VKDKKKETKKYNTEDR

SEQ ID NO: 2469593 - protein, 13 aa, Entamoeba dispar
VKDNEAKIEQQES

SEQ ID NO: 2469594 - protein, 10 aa, Entamoeba dispar
VKDNNGTSNL

SEQ ID NO: 2469595 - protein, 6 aa, Entamoeba dispar
VKDNPE

SEQ ID NO: 2469596 - protein, 7 aa, Entamoeba dispar
VKDNTVD

SEQ ID NO: 2469597 - protein, 6 aa, Entamoeba dispar
VKDPKI

SEQ ID NO: 2469598 - protein, 10 aa, Entamoeba dispar
VKDPKQKKRL

SEQ ID NO: 2469599 - protein, 23 aa, Entamoeba dispar
VKDQLDKAQDDLADKEDELATLD

SEQ ID NO: 2469600 - protein, 8 aa, Entamoeba dispar
VKDREEHE

SEQ ID NO: 2469601 - protein, 5 aa, Entamoeba dispar
VKDSD

SEQ ID NO: 2469602 - protein, 16 aa, Entamoeba dispar
VKDSEIKEESKKIEER

SEQ ID NO: 2469603 - protein, 11 aa, Entamoeba dispar
VKDTTRDDEDI

SEQ ID NO: 2469604 - protein, 8 aa, Entamoeba dispar
VKDVSRGY

SEQ ID NO: 2469605 - protein, 6 aa, Entamoeba dispar
VKEAGA

SEQ ID NO: 2469606 - protein, 7 aa, Entamoeba dispar
VKEANEA

SEQ ID NO: 2469607 - protein, 11 aa, Entamoeba dispar
VKEDEENNEEL

SEQ ID NO: 2469608 - protein, 40 aa, Entamoeba dispar
VKEDHKSKNSSPLEEEIKEKNENQEKKEKDSTSKTDYRKY

SEQ ID NO: 2469609 - protein, 9 aa, Entamoeba dispar
VKEDKEKEQ

SEQ ID NO: 2469610 - protein, 5 aa, Entamoeba dispar
VKEDN

SEQ ID NO: 2469611 - protein, 7 aa, Entamoeba dispar
VKEDREQ

SEQ ID NO: 2469612 - protein, 6 aa, Entamoeba dispar
VKEEEE

SEQ ID NO: 2469613 - protein, 12 aa, Entamoeba dispar
VKEEEKPKEDIK

SEQ ID NO: 2469614 - protein, 17 aa, Entamoeba dispar
VKEEEMPKTKEVTAETT

SEQ ID NO: 2469615 - protein, 12 aa, Entamoeba dispar
VKEEENDDDDDL

SEQ ID NO: 2469616 - protein, 6 aa, Entamoeba dispar
VKEEEV

SEQ ID NO: 2469617 - protein, 5 aa, Entamoeba dispar
VKEEI

SEQ ID NO: 2469618 - protein, 8 aa, Entamoeba dispar
VKEERKKN

SEQ ID NO: 2469619 - protein, 7 aa, Entamoeba dispar
VKEESPF

SEQ ID NO: 2469620 - protein, 14 aa, Entamoeba dispar
VKEETKPQRRKTEL

SEQ ID NO: 2469621 - protein, 8 aa, Entamoeba dispar
VKEGDIDE

SEQ ID NO: 2469622 - protein, 25 aa, Entamoeba dispar
VKEGDMKQSKANKKLEEEVTELEEE

SEQ ID NO: 2469623 - protein, 7 aa, Entamoeba dispar
VKEGNEL

SEQ ID NO: 2469624 - protein, 9 aa, Entamoeba dispar
VKEGNQPSF

SEQ ID NO: 2469625 - protein, 6 aa, Entamoeba dispar
VKEGTF

SEQ ID NO: 2469626 - protein, 26 aa, Entamoeba dispar
VKEIEETSNEQYSKNGWGNDSSSTIV

SEQ ID NO: 2469627 - protein, 6 aa, Entamoeba dispar
VKEIPT

SEQ ID NO: 2469628 - protein, 12 aa, Entamoeba dispar
VKEKEKDLKDND

SEQ ID NO: 2469629 - protein, 7 aa, Entamoeba dispar
VKEKIGQ

SEQ ID NO: 2469630 - protein, 16 aa, Entamoeba dispar
VKEKIGQEVIEQIETT

SEQ ID NO: 2469631 - protein, 9 aa, Entamoeba dispar
VKEKKPEAR

SEQ ID NO: 2469632 - protein, 19 aa, Entamoeba dispar
VKEKREVGEQKLKEREVQN

SEQ ID NO: 2469633 - protein, 10 aa, Entamoeba dispar
VKEKRKTEDL

SEQ ID NO: 2469634 - protein, 9 aa, Entamoeba dispar
VKEKTKTQL

SEQ ID NO: 2469635 - protein, 31 aa, Entamoeba dispar
VKELNDRIKEKNQQIDDYEKTIEENKEDFEA

SEQ ID NO: 2469636 - protein, 14 aa, Entamoeba dispar
VKENGKKKGVQVKG

SEQ ID NO: 2469637 - protein, 18 aa, Entamoeba dispar
VKENGKKKGVQVKGPVRI

SEQ ID NO: 2469638 - protein, 9 aa, Entamoeba dispar
VKENKNENI

SEQ ID NO: 2469639 - protein, 7 aa, Entamoeba dispar
VKENLEE

SEQ ID NO: 2469640 - protein, 6 aa, Entamoeba dispar
VKENNE

SEQ ID NO: 2469641 - protein, 7 aa, Entamoeba dispar
VKENSEI

SEQ ID NO: 2469642 - protein, 9 aa, Entamoeba dispar
VKEPQEQNR

SEQ ID NO: 2469643 - protein, 11 aa, Entamoeba dispar
VKEQDLSDEKV

SEQ ID NO: 2469644 - protein, 5 aa, Entamoeba dispar
VKEQE

SEQ ID NO: 2469645 - protein, 21 aa, Entamoeba dispar
VKEQGKMKLAESKGQYGVFWL

SEQ ID NO: 2469646 - protein, 5 aa, Entamoeba dispar
VKEQP

SEQ ID NO: 2469647 - protein, 9 aa, Entamoeba dispar
VKEQTRENG

SEQ ID NO: 2469648 - protein, 4 aa, Entamoeba dispar
VKER

SEQ ID NO: 2469649 - protein, 7 aa, Entamoeba dispar
VKERTHQ

SEQ ID NO: 2469650 - protein, 8 aa, Entamoeba dispar
VKESAGKQ

SEQ ID NO: 2469651 - protein, 8 aa, Entamoeba dispar
VKESNQRW

SEQ ID NO: 2469652 - protein, 7 aa, Entamoeba dispar
VKESQLP

SEQ ID NO: 2469653 - protein, 6 aa, Entamoeba dispar
VKETDQ

SEQ ID NO: 2469654 - protein, 126 aa, Entamoeba dispar
VKETNNKQESVNDKEDETKRKEVQMEEESEEESMNKEEVSTKEEISEDDISNEGDEESSKDDISNEDNDMSNEDNDISNEDNDISSEGDDISNEDNDISSEDDEEGEEQDSKLKEGGDDSEEDVDA

SEQ ID NO: 2469655 - protein, 9 aa, Entamoeba dispar
VKETPSPIL

SEQ ID NO: 2469656 - protein, 5 aa, Entamoeba dispar
VKEVE

SEQ ID NO: 2469657 - protein, 8 aa, Entamoeba dispar
VKFSPDGQ

SEQ ID NO: 2469658 - protein, 4 aa, Entamoeba dispar
VKGE

SEQ ID NO: 2469659 - protein, 8 aa, Entamoeba dispar
VKGERDKL

SEQ ID NO: 2469660 - protein, 32 aa, Entamoeba dispar
VKGGKAVGHALSKDEKDKKKEKTKEDSCSEGE

SEQ ID NO: 2469661 - protein, 7 aa, Entamoeba dispar
VKGKEGR

SEQ ID NO: 2469662 - protein, 10 aa, Entamoeba dispar
VKGKNQQVIT

SEQ ID NO: 2469663 - protein, 6 aa, Entamoeba dispar
VKGNGA

SEQ ID NO: 2469664 - protein, 4 aa, Entamoeba dispar
VKGP

SEQ ID NO: 2469665 - protein, 10 aa, Entamoeba dispar
VKGPNGIEED

SEQ ID NO: 2469666 - protein, 6 aa, Entamoeba dispar
VKGRAR

SEQ ID NO: 2469667 - protein, 8 aa, Entamoeba dispar
VKGRDNGI

SEQ ID NO: 2469668 - protein, 11 aa, Entamoeba dispar
VKGTEQEHKTL

SEQ ID NO: 2469669 - protein, 17 aa, Entamoeba dispar
VKGTLQTDYTVKDTDPR

SEQ ID NO: 2469670 - protein, 7 aa, Entamoeba dispar
VKGVEKE

SEQ ID NO: 2469671 - protein, 4 aa, Entamoeba dispar
VKHH

SEQ ID NO: 2469672 - protein, 12 aa, Entamoeba dispar
VKHSDVDDPLGR

SEQ ID NO: 2469673 - protein, 11 aa, Entamoeba dispar
VKHSNAIDDEI

SEQ ID NO: 2469674 - protein, 4 aa, Entamoeba dispar
VKIK

SEQ ID NO: 2469675 - protein, 11 aa, Entamoeba dispar
VKIKKNNIYKG

SEQ ID NO: 2469676 - protein, 10 aa, Entamoeba dispar
VKIPSSPRQR

SEQ ID NO: 2469677 - protein, 4 aa, Entamoeba dispar
VKKA

SEQ ID NO: 2469678 - protein, 8 aa, Entamoeba dispar
VKKASDIE

SEQ ID NO: 2469679 - protein, 9 aa, Entamoeba dispar
VKKASVTQQ

SEQ ID NO: 2469680 - protein, 4 aa, Entamoeba dispar
VKKD

SEQ ID NO: 2469681 - protein, 9 aa, Entamoeba dispar
VKKDGKTVG

SEQ ID NO: 2469682 - protein, 6 aa, Entamoeba dispar
VKKDNK

SEQ ID NO: 2469683 - protein, 5 aa, Entamoeba dispar
VKKDQ

SEQ ID NO: 2469684 - protein, 15 aa, Entamoeba dispar
VKKEEKKEEKKKMNK

SEQ ID NO: 2469685 - protein, 9 aa, Entamoeba dispar
VKKEEKVIE

SEQ ID NO: 2469686 - protein, 13 aa, Entamoeba dispar
VKKEENINQRNCE

SEQ ID NO: 2469687 - protein, 9 aa, Entamoeba dispar
VKKETGKHL

SEQ ID NO: 2469688 - protein, 12 aa, Entamoeba dispar
VKKETKRKTSKL

SEQ ID NO: 2469689 - protein, 7 aa, Entamoeba dispar
VKKGERC

SEQ ID NO: 2469690 - protein, 13 aa, Entamoeba dispar
VKKGKTSSKSYQM

SEQ ID NO: 2469691 - protein, 6 aa, Entamoeba dispar
VKKGNL

SEQ ID NO: 2469692 - protein, 6 aa, Entamoeba dispar
VKKGSK

SEQ ID NO: 2469693 - protein, 6 aa, Entamoeba dispar
VKKGVS

SEQ ID NO: 2469694 - protein, 8 aa, Entamoeba dispar
VKKGYKYS

SEQ ID NO: 2469695 - protein, 5 aa, Entamoeba dispar
VKKNE

SEQ ID NO: 2469696 - protein, 6 aa, Entamoeba dispar
VKKNKT

SEQ ID NO: 2469697 - protein, 8 aa, Entamoeba dispar
VKKSDEKD

SEQ ID NO: 2469698 - protein, 8 aa, Entamoeba dispar
VKKTYSEM

SEQ ID NO: 2469699 - protein, 11 aa, Entamoeba dispar
VKKYEAGYHQA

SEQ ID NO: 2469700 - protein, 5 aa, Entamoeba dispar
VKLPN

SEQ ID NO: 2469701 - protein, 13 aa, Entamoeba dispar
VKMEEDEEEWEVS

SEQ ID NO: 2469702 - protein, 10 aa, Entamoeba dispar
VKNDDFKRED

SEQ ID NO: 2469703 - protein, 10 aa, Entamoeba dispar
VKNDIKEKGF

SEQ ID NO: 2469704 - protein, 21 aa, Entamoeba dispar
VKNDKTVTISSAVPNNSGHRK

SEQ ID NO: 2469705 - protein, 7 aa, Entamoeba dispar
VKNEEAY

SEQ ID NO: 2469706 - protein, 8 aa, Entamoeba dispar
VKNEENEI

SEQ ID NO: 2469707 - protein, 18 aa, Entamoeba dispar
VKNEIKPINTNEIGTKLG

SEQ ID NO: 2469708 - protein, 12 aa, Entamoeba dispar
VKNENDIAAPHP

SEQ ID NO: 2469709 - protein, 8 aa, Entamoeba dispar
VKNERPAF

SEQ ID NO: 2469710 - protein, 10 aa, Entamoeba dispar
VKNGSNAGYS

SEQ ID NO: 2469711 - protein, 10 aa, Entamoeba dispar
VKNKDGEDTL

SEQ ID NO: 2469712 - protein, 9 aa, Entamoeba dispar
VKNNKAAEK

SEQ ID NO: 2469713 - protein, 15 aa, Entamoeba dispar
VKNNKLAKKAKKTLK

SEQ ID NO: 2469714 - protein, 6 aa, Entamoeba dispar
VKNPSK

SEQ ID NO: 2469715 - protein, 9 aa, Entamoeba dispar
VKNPSQQAI

SEQ ID NO: 2469716 - protein, 11 aa, Entamoeba dispar
VKNQKTKTNEL

SEQ ID NO: 2469717 - protein, 17 aa, Entamoeba dispar
VKNSSTDDDFMKRFTRK

SEQ ID NO: 2469718 - protein, 8 aa, Entamoeba dispar
VKNSTIEQ

SEQ ID NO: 2469719 - protein, 6 aa, Entamoeba dispar
VKNSTV

SEQ ID NO: 2469720 - protein, 8 aa, Entamoeba dispar
VKNTKTGV

SEQ ID NO: 2469721 - protein, 7 aa, Entamoeba dispar
VKNTPKR

SEQ ID NO: 2469722 - protein, 7 aa, Entamoeba dispar
VKNTTIN

SEQ ID NO: 2469723 - protein, 4 aa, Entamoeba dispar
VKPA

SEQ ID NO: 2469724 - protein, 4 aa, Entamoeba dispar
VKPE

SEQ ID NO: 2469725 - protein, 5 aa, Entamoeba dispar
VKPED

SEQ ID NO: 2469726 - protein, 6 aa, Entamoeba dispar
VKPEDD

SEQ ID NO: 2469727 - protein, 6 aa, Entamoeba dispar
VKPEET

SEQ ID NO: 2469728 - protein, 8 aa, Entamoeba dispar
VKPEYQSP

SEQ ID NO: 2469729 - protein, 5 aa, Entamoeba dispar
VKPFP

SEQ ID NO: 2469730 - protein, 16 aa, Entamoeba dispar
VKPMNSQDNLKTVREK

SEQ ID NO: 2469731 - protein, 8 aa, Entamoeba dispar
VKPNSPET

SEQ ID NO: 2469732 - protein, 10 aa, Entamoeba dispar
VKPPGSNLPK

SEQ ID NO: 2469733 - protein, 9 aa, Entamoeba dispar
VKPRTSSMS

SEQ ID NO: 2469734 - protein, 9 aa, Entamoeba dispar
VKPSEQLTA

SEQ ID NO: 2469735 - protein, 12 aa, Entamoeba dispar
VKPSGENGHIAT

SEQ ID NO: 2469736 - protein, 5 aa, Entamoeba dispar
VKPSL

SEQ ID NO: 2469737 - protein, 18 aa, Entamoeba dispar
VKPSNKTWDEINSNINKQ

SEQ ID NO: 2469738 - protein, 6 aa, Entamoeba dispar
VKPSPF

SEQ ID NO: 2469739 - protein, 14 aa, Entamoeba dispar
VKPSPSQQQQQQQY

SEQ ID NO: 2469740 - protein, 5 aa, Entamoeba dispar
VKPSQ

SEQ ID NO: 2469741 - protein, 17 aa, Entamoeba dispar
VKPSSETKTVNITENGT

SEQ ID NO: 2469742 - protein, 9 aa, Entamoeba dispar
VKPTTTLKK

SEQ ID NO: 2469743 - protein, 6 aa, Entamoeba dispar
VKPVET

SEQ ID NO: 2469744 - protein, 10 aa, Entamoeba dispar
VKPVPQQPTI

SEQ ID NO: 2469745 - protein, 5 aa, Entamoeba dispar
VKQAI

SEQ ID NO: 2469746 - protein, 22 aa, Entamoeba dispar
VKQAINESKKPNPEGKYTVPPT

SEQ ID NO: 2469747 - protein, 9 aa, Entamoeba dispar
VKQDLKSKR

SEQ ID NO: 2469748 - protein, 12 aa, Entamoeba dispar
VKQEEGWKGTPY

SEQ ID NO: 2469749 - protein, 20 aa, Entamoeba dispar
VKQEEKQPKEEENQQSDIEN

SEQ ID NO: 2469750 - protein, 7 aa, Entamoeba dispar
VKQEKGR

SEQ ID NO: 2469751 - protein, 8 aa, Entamoeba dispar
VKQERGVD

SEQ ID NO: 2469752 - protein, 8 aa, Entamoeba dispar
VKQGEPNC

SEQ ID NO: 2469753 - protein, 10 aa, Entamoeba dispar
VKQGEPNCDR

SEQ ID NO: 2469754 - protein, 22 aa, Entamoeba dispar
VKQGPIEDLPPSPLPTQSPSVI

SEQ ID NO: 2469755 - protein, 5 aa, Entamoeba dispar
VKQGY

SEQ ID NO: 2469756 - protein, 6 aa, Entamoeba dispar
VKQKDS

SEQ ID NO: 2469757 - protein, 17 aa, Entamoeba dispar
VKQKTRTDNNIIDETSK

SEQ ID NO: 2469758 - protein, 38 aa, Entamoeba dispar
VKQLQDDKELNEQDIRDAGFENKKLTNQINDAKEAMDK

SEQ ID NO: 2469759 - protein, 92 aa, Entamoeba dispar
VKQNETKEQPPSEQLPKQNTLPPKPAAPAALPPKHHQSLNSKTNSQTQHQTTPATPMEQPPIPPKPAHLTSKEEKKKKKEEKKKEKEKKKSK

SEQ ID NO: 2469760 - protein, 13 aa, Entamoeba dispar
VKQNKDSEEIKKQ

SEQ ID NO: 2469761 - protein, 12 aa, Entamoeba dispar
VKQTKDSVVPLG

SEQ ID NO: 2469762 - protein, 12 aa, Entamoeba dispar
VKQTKENAILVE

SEQ ID NO: 2469763 - protein, 18 aa, Entamoeba dispar
VKQTNSSEFSESSHGEDY

SEQ ID NO: 2469764 - protein, 9 aa, Entamoeba dispar
VKRDEKSKI

SEQ ID NO: 2469765 - protein, 4 aa, Entamoeba dispar
VKRE

SEQ ID NO: 2469766 - protein, 10 aa, Entamoeba dispar
VKREDKEKNK

SEQ ID NO: 2469767 - protein, 8 aa, Entamoeba dispar
VKREETDL

SEQ ID NO: 2469768 - protein, 10 aa, Entamoeba dispar
VKREGSQNGQ

SEQ ID NO: 2469769 - protein, 14 aa, Entamoeba dispar
VKRGESAKETFKGY

SEQ ID NO: 2469770 - protein, 7 aa, Entamoeba dispar
VKRGTDW

SEQ ID NO: 2469771 - protein, 7 aa, Entamoeba dispar
VKRKAAA

SEQ ID NO: 2469772 - protein, 21 aa, Entamoeba dispar
VKRQEKGGGGSTIGPKIASHT

SEQ ID NO: 2469773 - protein, 5 aa, Entamoeba dispar
VKRTE

SEQ ID NO: 2469774 - protein, 6 aa, Entamoeba dispar
VKRTEY

SEQ ID NO: 2469775 - protein, 21 aa, Entamoeba dispar
VKRVKGEKNTKKSKSLQKEGI

SEQ ID NO: 2469776 - protein, 7 aa, Entamoeba dispar
VKRVQRK

SEQ ID NO: 2469777 - protein, 8 aa, Entamoeba dispar
VKSDNKYM

SEQ ID NO: 2469778 - protein, 9 aa, Entamoeba dispar
VKSGNGWRQ

SEQ ID NO: 2469779 - protein, 6 aa, Entamoeba dispar
VKSKEE

SEQ ID NO: 2469780 - protein, 8 aa, Entamoeba dispar
VKSKEGEY

SEQ ID NO: 2469781 - protein, 19 aa, Entamoeba dispar
VKSKEQKQTQPQVRKTLGQ

SEQ ID NO: 2469782 - protein, 19 aa, Entamoeba dispar
VKSKPKSKNTENEKNEGLY

SEQ ID NO: 2469783 - protein, 14 aa, Entamoeba dispar
VKSKTVHTRIERKD

SEQ ID NO: 2469784 - protein, 6 aa, Entamoeba dispar
VKSLGN

SEQ ID NO: 2469785 - protein, 8 aa, Entamoeba dispar
VKSNPENL

SEQ ID NO: 2469786 - protein, 9 aa, Entamoeba dispar
VKSNTDEFG

SEQ ID NO: 2469787 - protein, 77 aa, Entamoeba dispar
VKSPEPALKDTPQNVSKSTEPAKTTTTVKGIQKHSTNPVKEVESSTVQESIKSPKVQQPNIEKPITSKYQSTASQPK

SEQ ID NO: 2469788 - protein, 16 aa, Entamoeba dispar
VKSQPQRKSIKRQRDI

SEQ ID NO: 2469789 - protein, 10 aa, Entamoeba dispar
VKSQQDAGKE

SEQ ID NO: 2469790 - protein, 12 aa, Entamoeba dispar
VKSQTETSQIDD

SEQ ID NO: 2469791 - protein, 5 aa, Entamoeba dispar
VKSRE

SEQ ID NO: 2469792 - protein, 9 aa, Entamoeba dispar
VKSRNERIE

SEQ ID NO: 2469793 - protein, 10 aa, Entamoeba dispar
VKSSDIKTIK

SEQ ID NO: 2469794 - protein, 7 aa, Entamoeba dispar
VKSSTSC

SEQ ID NO: 2469795 - protein, 8 aa, Entamoeba dispar
VKSSYPDS

SEQ ID NO: 2469796 - protein, 10 aa, Entamoeba dispar
VKSTIDDSTK

SEQ ID NO: 2469797 - protein, 8 aa, Entamoeba dispar
VKSTTLDN

SEQ ID NO: 2469798 - protein, 4 aa, Entamoeba dispar
VKSY

SEQ ID NO: 2469799 - protein, 8 aa, Entamoeba dispar
VKTASPGI

SEQ ID NO: 2469800 - protein, 8 aa, Entamoeba dispar
VKTASSGY

SEQ ID NO: 2469801 - protein, 8 aa, Entamoeba dispar
VKTGSTVL

SEQ ID NO: 2469802 - protein, 7 aa, Entamoeba dispar
VKTKYNE

SEQ ID NO: 2469803 - protein, 28 aa, Entamoeba dispar
VKTNDDFDDEDEEIDKNINTELPVLPPS

SEQ ID NO: 2469804 - protein, 7 aa, Entamoeba dispar
VKTPTGP

SEQ ID NO: 2469805 - protein, 8 aa, Entamoeba dispar
VKTQNKER

SEQ ID NO: 2469806 - protein, 5 aa, Entamoeba dispar
VKTQS

SEQ ID NO: 2469807 - protein, 9 aa, Entamoeba dispar
VKTREGAET

SEQ ID NO: 2469808 - protein, 8 aa, Entamoeba dispar
VKTRTSVQ

SEQ ID NO: 2469809 - protein, 4 aa, Entamoeba dispar
VKTS

SEQ ID NO: 2469810 - protein, 9 aa, Entamoeba dispar
VKTSDTGYI

SEQ ID NO: 2469811 - protein, 10 aa, Entamoeba dispar
VKTSKSSKEM

SEQ ID NO: 2469812 - protein, 8 aa, Entamoeba dispar
VKTTKTKS

SEQ ID NO: 2469813 - protein, 8 aa, Entamoeba dispar
VKVDTDNK

SEQ ID NO: 2469814 - protein, 8 aa, Entamoeba dispar
VKVGGGVN

SEQ ID NO: 2469815 - protein, 8 aa, Entamoeba dispar
VKVNEQSR

SEQ ID NO: 2469816 - protein, 10 aa, Entamoeba dispar
VKVRRPKDYN

SEQ ID NO: 2469817 - protein, 4 aa, Entamoeba dispar
VKYA

SEQ ID NO: 2469818 - protein, 11 aa, Entamoeba dispar
VKYEESSAASL

SEQ ID NO: 2469819 - protein, 9 aa, Entamoeba dispar
VKYKTTRNK

SEQ ID NO: 2469820 - protein, 9 aa, Entamoeba dispar
VKYSQSDLK

SEQ ID NO: 2469821 - protein, 4 aa, Entamoeba dispar
VLDD

SEQ ID NO: 2469822 - protein, 10 aa, Entamoeba dispar
VLDDEEYEKI

SEQ ID NO: 2469823 - protein, 11 aa, Entamoeba dispar
VLEKTQERELL

SEQ ID NO: 2469824 - protein, 6 aa, Entamoeba dispar
VLEQGK

SEQ ID NO: 2469825 - protein, 8 aa, Entamoeba dispar
VLESEDEL

SEQ ID NO: 2469826 - protein, 4 aa, Entamoeba dispar
VLGN

SEQ ID NO: 2469827 - protein, 6 aa, Entamoeba dispar
VLGSEK

SEQ ID NO: 2469828 - protein, 13 aa, Entamoeba dispar
VLGTDSTNENTEQ

SEQ ID NO: 2469829 - protein, 6 aa, Entamoeba dispar
VLKDDE

SEQ ID NO: 2469830 - protein, 10 aa, Entamoeba dispar
VLKGKAKSKL

SEQ ID NO: 2469831 - protein, 17 aa, Entamoeba dispar
VLKKRGRKKSENTDLQE

SEQ ID NO: 2469832 - protein, 12 aa, Entamoeba dispar
VLNGNRATLNGM

SEQ ID NO: 2469833 - protein, 9 aa, Entamoeba dispar
VLNKKPEES

SEQ ID NO: 2469834 - protein, 4 aa, Entamoeba dispar
VLPA

SEQ ID NO: 2469835 - protein, 5 aa, Entamoeba dispar
VLPKK

SEQ ID NO: 2469836 - protein, 12 aa, Entamoeba dispar
VLREYTPKYTLK

SEQ ID NO: 2469837 - protein, 9 aa, Entamoeba dispar
VLSDQEKKA

SEQ ID NO: 2469838 - protein, 9 aa, Entamoeba dispar
VLSKEDKEF

SEQ ID NO: 2469839 - protein, 8 aa, Entamoeba dispar
VLSKSKNP

SEQ ID NO: 2469840 - protein, 6 aa, Entamoeba dispar
VLSNEP

SEQ ID NO: 2469841 - protein, 12 aa, Entamoeba dispar
VLTEEKPDIFKT

SEQ ID NO: 2469842 - protein, 9 aa, Entamoeba dispar
VLTGNGKEV

SEQ ID NO: 2469843 - protein, 25 aa, Entamoeba dispar
VLTKEKKKKKKVAENAQVKETISND

SEQ ID NO: 2469844 - protein, 9 aa, Entamoeba dispar
VMASSSAEG

SEQ ID NO: 2469845 - protein, 5 aa, Entamoeba dispar
VMQSG

SEQ ID NO: 2469846 - protein, 11 aa, Entamoeba dispar
VMRTKGEGLAN

SEQ ID NO: 2469847 - protein, 10 aa, Entamoeba dispar
VNAKDKQQHF

SEQ ID NO: 2469848 - protein, 11 aa, Entamoeba dispar
VNALGNEKNEI

SEQ ID NO: 2469849 - protein, 4 aa, Entamoeba dispar
VNAN

SEQ ID NO: 2469850 - protein, 4 aa, Entamoeba dispar
VNAQ

SEQ ID NO: 2469851 - protein, 10 aa, Entamoeba dispar
VNASDGSHFS

SEQ ID NO: 2469852 - protein, 12 aa, Entamoeba dispar
VNASDKEQLLVF

SEQ ID NO: 2469853 - protein, 6 aa, Entamoeba dispar
VNATKE

SEQ ID NO: 2469854 - protein, 10 aa, Entamoeba dispar
VNCQCDGEPV

SEQ ID NO: 2469855 - protein, 12 aa, Entamoeba dispar
VNCTSPTQKQVI

SEQ ID NO: 2469856 - protein, 7 aa, Entamoeba dispar
VNDDNRK

SEQ ID NO: 2469857 - protein, 4 aa, Entamoeba dispar
VNDE

SEQ ID NO: 2469858 - protein, 10 aa, Entamoeba dispar
VNDGKTKIEQ

SEQ ID NO: 2469859 - protein, 5 aa, Entamoeba dispar
VNDGY

SEQ ID NO: 2469860 - protein, 4 aa, Entamoeba dispar
VNDK

SEQ ID NO: 2469861 - protein, 9 aa, Entamoeba dispar
VNDKQEKIE

SEQ ID NO: 2469862 - protein, 7 aa, Entamoeba dispar
VNDKQGI

SEQ ID NO: 2469863 - protein, 17 aa, Entamoeba dispar
VNDNSVKEIKNEVNEIE

SEQ ID NO: 2469864 - protein, 6 aa, Entamoeba dispar
VNDPDE

SEQ ID NO: 2469865 - protein, 12 aa, Entamoeba dispar
VNDPDTNQRTLE

SEQ ID NO: 2469866 - protein, 8 aa, Entamoeba dispar
VNDPQTSY

SEQ ID NO: 2469867 - protein, 9 aa, Entamoeba dispar
VNDSTLEER

SEQ ID NO: 2469868 - protein, 6 aa, Entamoeba dispar
VNDSTV

SEQ ID NO: 2469869 - protein, 6 aa, Entamoeba dispar
VNDTEQ

SEQ ID NO: 2469870 - protein, 9 aa, Entamoeba dispar
VNEATKLPA

SEQ ID NO: 2469871 - protein, 33 aa, Entamoeba dispar
VNEDEFNNKMKESRNQGIKELQEKEKLKEKGNK

SEQ ID NO: 2469872 - protein, 8 aa, Entamoeba dispar
VNEDGEKV

SEQ ID NO: 2469873 - protein, 10 aa, Entamoeba dispar
VNEDKVREAM

SEQ ID NO: 2469874 - protein, 8 aa, Entamoeba dispar
VNEDNEKI

SEQ ID NO: 2469875 - protein, 7 aa, Entamoeba dispar
VNEEDRP

SEQ ID NO: 2469876 - protein, 15 aa, Entamoeba dispar
VNEEGNHKGFSSQID

SEQ ID NO: 2469877 - protein, 10 aa, Entamoeba dispar
VNEEKEQETH

SEQ ID NO: 2469878 - protein, 23 aa, Entamoeba dispar
VNEENKIKEDVVGASGEDTKNFE

SEQ ID NO: 2469879 - protein, 12 aa, Entamoeba dispar
VNEKDINKESFE

SEQ ID NO: 2469880 - protein, 6 aa, Entamoeba dispar
VNEKER

SEQ ID NO: 2469881 - protein, 9 aa, Entamoeba dispar
VNEKIDKNG

SEQ ID NO: 2469882 - protein, 6 aa, Entamoeba dispar
VNEKKF

SEQ ID NO: 2469883 - protein, 5 aa, Entamoeba dispar
VNEKN

SEQ ID NO: 2469884 - protein, 20 aa, Entamoeba dispar
VNELESRPVGTGNADENEIK

SEQ ID NO: 2469885 - protein, 4 aa, Entamoeba dispar
VNEN

SEQ ID NO: 2469886 - protein, 16 aa, Entamoeba dispar
VNENDSYGAYTQAKPD

SEQ ID NO: 2469887 - protein, 12 aa, Entamoeba dispar
VNENECGKAQTE

SEQ ID NO: 2469888 - protein, 12 aa, Entamoeba dispar
VNENGSPVHTQI

SEQ ID NO: 2469889 - protein, 15 aa, Entamoeba dispar
VNENPQLNHSKHQSV

SEQ ID NO: 2469890 - protein, 8 aa, Entamoeba dispar
VNEPKKSI

SEQ ID NO: 2469891 - protein, 9 aa, Entamoeba dispar
VNEQNRQSL

SEQ ID NO: 2469892 - protein, 16 aa, Entamoeba dispar
VNEQTKHRQSRSKDGY

SEQ ID NO: 2469893 - protein, 6 aa, Entamoeba dispar
VNERTP

SEQ ID NO: 2469894 - protein, 8 aa, Entamoeba dispar
VNESEKIE

SEQ ID NO: 2469895 - protein, 5 aa, Entamoeba dispar
VNESQ

SEQ ID NO: 2469896 - protein, 15 aa, Entamoeba dispar
VNESSDNLTFIVIKI

SEQ ID NO: 2469897 - protein, 50 aa, Entamoeba dispar
VNETGRKINTKSETGDSERTVIEPTEEKEDKKPKQFPEKKRQKKSNTVDP

SEQ ID NO: 2469898 - protein, 7 aa, Entamoeba dispar
VNETSSQ

SEQ ID NO: 2469899 - protein, 6 aa, Entamoeba dispar
VNEYND

SEQ ID NO: 2469900 - protein, 7 aa, Entamoeba dispar
VNFDNSE

SEQ ID NO: 2469901 - protein, 4 aa, Entamoeba dispar
VNGA

SEQ ID NO: 2469902 - protein, 8 aa, Entamoeba dispar
VNGDGVLD

SEQ ID NO: 2469903 - protein, 9 aa, Entamoeba dispar
VNGDSKKNL

SEQ ID NO: 2469904 - protein, 19 aa, Entamoeba dispar
VNGDSKKNLRFVSNLYQIV

SEQ ID NO: 2469905 - protein, 30 aa, Entamoeba dispar
VNGEFESELKEKEQAKIEQSDATTNGYSSS

SEQ ID NO: 2469906 - protein, 8 aa, Entamoeba dispar
VNGENGSI

SEQ ID NO: 2469907 - protein, 5 aa, Entamoeba dispar
VNGER

SEQ ID NO: 2469908 - protein, 9 aa, Entamoeba dispar
VNGESVDSI

SEQ ID NO: 2469909 - protein, 6 aa, Entamoeba dispar
VNGESY

SEQ ID NO: 2469910 - protein, 11 aa, Entamoeba dispar
VNGETLNESIE

SEQ ID NO: 2469911 - protein, 5 aa, Entamoeba dispar
VNGEV

SEQ ID NO: 2469912 - protein, 7 aa, Entamoeba dispar
VNGEVKR

SEQ ID NO: 2469913 - protein, 4 aa, Entamoeba dispar
VNGG

SEQ ID NO: 2469914 - protein, 10 aa, Entamoeba dispar
VNGIPSSDGR

SEQ ID NO: 2469915 - protein, 12 aa, Entamoeba dispar
VNGISSCSSVGE

SEQ ID NO: 2469916 - protein, 4 aa, Entamoeba dispar
VNGK

SEQ ID NO: 2469917 - protein, 5 aa, Entamoeba dispar
VNGKE

SEQ ID NO: 2469918 - protein, 7 aa, Entamoeba dispar
VNGKPKV

SEQ ID NO: 2469919 - protein, 8 aa, Entamoeba dispar
VNGKTLTS

SEQ ID NO: 2469920 - protein, 8 aa, Entamoeba dispar
VNGPEDTH

SEQ ID NO: 2469921 - protein, 8 aa, Entamoeba dispar
VNGQDNAM

SEQ ID NO: 2469922 - protein, 5 aa, Entamoeba dispar
VNGRK

SEQ ID NO: 2469923 - protein, 12 aa, Entamoeba dispar
VNGSDSGDSDDI

SEQ ID NO: 2469924 - protein, 7 aa, Entamoeba dispar
VNGSGKH

SEQ ID NO: 2469925 - protein, 13 aa, Entamoeba dispar
VNGSNKVSEDIVS

SEQ ID NO: 2469926 - protein, 10 aa, Entamoeba dispar
VNGSPTEHDL

SEQ ID NO: 2469927 - protein, 4 aa, Entamoeba dispar
VNGT

SEQ ID NO: 2469928 - protein, 6 aa, Entamoeba dispar
VNGTVK

SEQ ID NO: 2469929 - protein, 11 aa, Entamoeba dispar
VNHPGLESFPG

SEQ ID NO: 2469930 - protein, 13 aa, Entamoeba dispar
VNHPNGMTTSQSS

SEQ ID NO: 2469931 - protein, 7 aa, Entamoeba dispar
VNHPNKQ

SEQ ID NO: 2469932 - protein, 7 aa, Entamoeba dispar
VNHQTNN

SEQ ID NO: 2469933 - protein, 7 aa, Entamoeba dispar
VNHSSSQ

SEQ ID NO: 2469934 - protein, 9 aa, Entamoeba dispar
VNIEPKKQQ

SEQ ID NO: 2469935 - protein, 4 aa, Entamoeba dispar
VNIN

SEQ ID NO: 2469936 - protein, 9 aa, Entamoeba dispar
VNIPSSVSK

SEQ ID NO: 2469937 - protein, 7 aa, Entamoeba dispar
VNIPTSI

SEQ ID NO: 2469938 - protein, 7 aa, Entamoeba dispar
VNIPTSV

SEQ ID NO: 2469939 - protein, 9 aa, Entamoeba dispar
VNIQEEKRI

SEQ ID NO: 2469940 - protein, 10 aa, Entamoeba dispar
VNITGNEKCN

SEQ ID NO: 2469941 - protein, 9 aa, Entamoeba dispar
VNKDQQRYE

SEQ ID NO: 2469942 - protein, 10 aa, Entamoeba dispar
VNKEEKEGKY

SEQ ID NO: 2469943 - protein, 8 aa, Entamoeba dispar
VNKEGVTV

SEQ ID NO: 2469944 - protein, 9 aa, Entamoeba dispar
VNKEKEKEE

SEQ ID NO: 2469945 - protein, 8 aa, Entamoeba dispar
VNKEKNEY

SEQ ID NO: 2469946 - protein, 7 aa, Entamoeba dispar
VNKENAQ

SEQ ID NO: 2469947 - protein, 8 aa, Entamoeba dispar
VNKENIGP

SEQ ID NO: 2469948 - protein, 12 aa, Entamoeba dispar
VNKFGSKPTLSD

SEQ ID NO: 2469949 - protein, 6 aa, Entamoeba dispar
VNKKNR

SEQ ID NO: 2469950 - protein, 6 aa, Entamoeba dispar
VNKKRK

SEQ ID NO: 2469951 - protein, 4 aa, Entamoeba dispar
VNKN

SEQ ID NO: 2469952 - protein, 11 aa, Entamoeba dispar
VNKPPPAKAPV

SEQ ID NO: 2469953 - protein, 8 aa, Entamoeba dispar
VNKRNQSL

SEQ ID NO: 2469954 - protein, 6 aa, Entamoeba dispar
VNKTDK

SEQ ID NO: 2469955 - protein, 9 aa, Entamoeba dispar
VNKTSNAGD

SEQ ID NO: 2469956 - protein, 10 aa, Entamoeba dispar
VNKTSQSSDQ

SEQ ID NO: 2469957 - protein, 4 aa, Entamoeba dispar
VNKY

SEQ ID NO: 2469958 - protein, 10 aa, Entamoeba dispar
VNLNEEKPVF

SEQ ID NO: 2469959 - protein, 23 aa, Entamoeba dispar
VNLNGGKTKKKKRDIANEDVEEM

SEQ ID NO: 2469960 - protein, 10 aa, Entamoeba dispar
VNLPKSNKIS

SEQ ID NO: 2469961 - protein, 16 aa, Entamoeba dispar
VNNATAVVTDDNGPVF

SEQ ID NO: 2469962 - protein, 13 aa, Entamoeba dispar
VNNCKPPDFPCST

SEQ ID NO: 2469963 - protein, 10 aa, Entamoeba dispar
VNNDHEEEKD

SEQ ID NO: 2469964 - protein, 5 aa, Entamoeba dispar
VNNDS

SEQ ID NO: 2469965 - protein, 6 aa, Entamoeba dispar
VNNEKE

SEQ ID NO: 2469966 - protein, 21 aa, Entamoeba dispar
VNNEQKKKSFTKRISQESDIS

SEQ ID NO: 2469967 - protein, 28 aa, Entamoeba dispar
VNNERKSLQKKEIKEQNEEDIRKKSDNV

SEQ ID NO: 2469968 - protein, 7 aa, Entamoeba dispar
VNNETES

SEQ ID NO: 2469969 - protein, 18 aa, Entamoeba dispar
VNNGKGDTSKRDRRSSCA

SEQ ID NO: 2469970 - protein, 4 aa, Entamoeba dispar
VNNH

SEQ ID NO: 2469971 - protein, 13 aa, Entamoeba dispar
VNNLTKNKDFNDR

SEQ ID NO: 2469972 - protein, 10 aa, Entamoeba dispar
VNNNTKKREM

SEQ ID NO: 2469973 - protein, 9 aa, Entamoeba dispar
VNNPGPTAL

SEQ ID NO: 2469974 - protein, 4 aa, Entamoeba dispar
VNNQ

SEQ ID NO: 2469975 - protein, 7 aa, Entamoeba dispar
VNNQTEQ

SEQ ID NO: 2469976 - protein, 10 aa, Entamoeba dispar
VNNSMERSEP

SEQ ID NO: 2469977 - protein, 6 aa, Entamoeba dispar
VNNTRI

SEQ ID NO: 2469978 - protein, 12 aa, Entamoeba dispar
VNNTVSGFAQNV

SEQ ID NO: 2469979 - protein, 7 aa, Entamoeba dispar
VNNYRRD

SEQ ID NO: 2469980 - protein, 4 aa, Entamoeba dispar
VNPD

SEQ ID NO: 2469981 - protein, 16 aa, Entamoeba dispar
VNPDQRPSTESSIKNP

SEQ ID NO: 2469982 - protein, 6 aa, Entamoeba dispar
VNPDTV

SEQ ID NO: 2469983 - protein, 5 aa, Entamoeba dispar
VNPFP

SEQ ID NO: 2469984 - protein, 14 aa, Entamoeba dispar
VNPKIKQELRDADE

SEQ ID NO: 2469985 - protein, 25 aa, Entamoeba dispar
VNPKPDANNVDISKQGQQTQKEGGC

SEQ ID NO: 2469986 - protein, 12 aa, Entamoeba dispar
VNPKTSIKTSIT

SEQ ID NO: 2469987 - protein, 7 aa, Entamoeba dispar
VNPLENK

SEQ ID NO: 2469988 - protein, 20 aa, Entamoeba dispar
VNPNSETNETKGYSGTGDRS

SEQ ID NO: 2469989 - protein, 7 aa, Entamoeba dispar
VNPPFND

SEQ ID NO: 2469990 - protein, 6 aa, Entamoeba dispar
VNPQFG

SEQ ID NO: 2469991 - protein, 6 aa, Entamoeba dispar
VNPQPL

SEQ ID NO: 2469992 - protein, 7 aa, Entamoeba dispar
VNPSKTA

SEQ ID NO: 2469993 - protein, 49 aa, Entamoeba dispar
VNPSTNELKPLTNEPKPLTSELNPTLSTQKTQEISNTNSIKQNTSKDVS

SEQ ID NO: 2469994 - protein, 19 aa, Entamoeba dispar
VNQEKKETITRHQSNEPQN

SEQ ID NO: 2469995 - protein, 10 aa, Entamoeba dispar
VNQFKTSTDT

SEQ ID NO: 2469996 - protein, 4 aa, Entamoeba dispar
VNQG

SEQ ID NO: 2469997 - protein, 8 aa, Entamoeba dispar
VNQKNNAI

SEQ ID NO: 2469998 - protein, 10 aa, Entamoeba dispar
VNQKTNNTSY

SEQ ID NO: 2469999 - protein, 7 aa, Entamoeba dispar
VNQMGAS

SEQ ID NO: 2470000 - protein, 33 aa, Entamoeba dispar
VNQNEQSTEESQVSNSQEQPNQDETSQQSTQED

SEQ ID NO: 2470001 - protein, 15 aa, Entamoeba dispar
VNQPKPTSNEKRVDP

SEQ ID NO: 2470002 - protein, 5 aa, Entamoeba dispar
VNQQN

SEQ ID NO: 2470003 - protein, 15 aa, Entamoeba dispar
VNQSEKEDIVSPKDD

SEQ ID NO: 2470004 - protein, 33 aa, Entamoeba dispar
VNQSTDEDIKTTPKSAPKRLTRKRCNSASKIDR

SEQ ID NO: 2470005 - protein, 50 aa, Entamoeba dispar
VNQTAQLNQNQINPQQPTQITQPQQGITTPIQPNFKQRTQQEFQTSQNIS

SEQ ID NO: 2470006 - protein, 7 aa, Entamoeba dispar
VNQTREK

SEQ ID NO: 2470007 - protein, 9 aa, Entamoeba dispar
VNRDNVEKE

SEQ ID NO: 2470008 - protein, 11 aa, Entamoeba dispar
VNRKKIKKNDI

SEQ ID NO: 2470009 - protein, 6 aa, Entamoeba dispar
VNRKPQ

SEQ ID NO: 2470010 - protein, 8 aa, Entamoeba dispar
VNRNNTPM

SEQ ID NO: 2470011 - protein, 8 aa, Entamoeba dispar
VNRNSGCG

SEQ ID NO: 2470012 - protein, 11 aa, Entamoeba dispar
VNRTTIQSEGF

SEQ ID NO: 2470013 - protein, 12 aa, Entamoeba dispar
VNSDIPPVKGSI

SEQ ID NO: 2470014 - protein, 9 aa, Entamoeba dispar
VNSDKDELS

SEQ ID NO: 2470015 - protein, 7 aa, Entamoeba dispar
VNSDTLQ

SEQ ID NO: 2470016 - protein, 6 aa, Entamoeba dispar
VNSEIA

SEQ ID NO: 2470017 - protein, 11 aa, Entamoeba dispar
VNSEKQNTYNE

SEQ ID NO: 2470018 - protein, 12 aa, Entamoeba dispar
VNSIEKPDVSET

SEQ ID NO: 2470019 - protein, 13 aa, Entamoeba dispar
VNSIQTKGRGITG

SEQ ID NO: 2470020 - protein, 7 aa, Entamoeba dispar
VNSKSPL

SEQ ID NO: 2470021 - protein, 12 aa, Entamoeba dispar
VNSNDGQVVLAN

SEQ ID NO: 2470022 - protein, 10 aa, Entamoeba dispar
VNSNENETSL

SEQ ID NO: 2470023 - protein, 7 aa, Entamoeba dispar
VNSNNPE

SEQ ID NO: 2470024 - protein, 25 aa, Entamoeba dispar
VNSNPNSIAQETKECYGESNRKKEI

SEQ ID NO: 2470025 - protein, 9 aa, Entamoeba dispar
VNSNTTGIK

SEQ ID NO: 2470026 - protein, 5 aa, Entamoeba dispar
VNSPE

SEQ ID NO: 2470027 - protein, 6 aa, Entamoeba dispar
VNSPEM

SEQ ID NO: 2470028 - protein, 7 aa, Entamoeba dispar
VNSPRSP

SEQ ID NO: 2470029 - protein, 7 aa, Entamoeba dispar
VNSPTRT

SEQ ID NO: 2470030 - protein, 6 aa, Entamoeba dispar
VNSSDP

SEQ ID NO: 2470031 - protein, 9 aa, Entamoeba dispar
VNSSGETAL

SEQ ID NO: 2470032 - protein, 5 aa, Entamoeba dispar
VNSTH

SEQ ID NO: 2470033 - protein, 7 aa, Entamoeba dispar
VNSTSRD

SEQ ID NO: 2470034 - protein, 6 aa, Entamoeba dispar
VNSTYD

SEQ ID NO: 2470035 - protein, 7 aa, Entamoeba dispar
VNTDTIR

SEQ ID NO: 2470036 - protein, 17 aa, Entamoeba dispar
VNTDTNEEEKEQWLPPR

SEQ ID NO: 2470037 - protein, 17 aa, Entamoeba dispar
VNTGQGLQRMQSAPNVS

SEQ ID NO: 2470038 - protein, 14 aa, Entamoeba dispar
VNTKKSKKKEETEM

SEQ ID NO: 2470039 - protein, 22 aa, Entamoeba dispar
VNTNPFDDDNDFVDNNSKTSVV

SEQ ID NO: 2470040 - protein, 8 aa, Entamoeba dispar
VNTNVNPI

SEQ ID NO: 2470041 - protein, 17 aa, Entamoeba dispar
VNTPTVNQVAPTPRPIS

SEQ ID NO: 2470042 - protein, 12 aa, Entamoeba dispar
VNTQDEQGNTPL

SEQ ID NO: 2470043 - protein, 6 aa, Entamoeba dispar
VNTQSK

SEQ ID NO: 2470044 - protein, 12 aa, Entamoeba dispar
VNTQSKKQENME

SEQ ID NO: 2470045 - protein, 19 aa, Entamoeba dispar
VNTQSKKQESLVSLKSSYL

SEQ ID NO: 2470046 - protein, 7 aa, Entamoeba dispar
VNTRDSL

SEQ ID NO: 2470047 - protein, 40 aa, Entamoeba dispar
VNTSDENENENSMEQIDSNESGSEEQSQMENDDTKPTTQL

SEQ ID NO: 2470048 - protein, 10 aa, Entamoeba dispar
VNTSENSGLI

SEQ ID NO: 2470049 - protein, 15 aa, Entamoeba dispar
VNTSNTTKPSDQSVH

SEQ ID NO: 2470050 - protein, 12 aa, Entamoeba dispar
VNTSPKDSKWNK

SEQ ID NO: 2470051 - protein, 10 aa, Entamoeba dispar
VNTSSVPAFS

SEQ ID NO: 2470052 - protein, 9 aa, Entamoeba dispar
VNTVPRKTT

SEQ ID NO: 2470053 - protein, 6 aa, Entamoeba dispar
VNVENT

SEQ ID NO: 2470054 - protein, 14 aa, Entamoeba dispar
VNVPQSSRSPSSFN

SEQ ID NO: 2470055 - protein, 18 aa, Entamoeba dispar
VNVQSDVSTSKRNIITET

SEQ ID NO: 2470056 - protein, 14 aa, Entamoeba dispar
VNVRTRKSKVEGKV

SEQ ID NO: 2470057 - protein, 11 aa, Entamoeba dispar
VNYNEARTSNT

SEQ ID NO: 2470058 - protein, 7 aa, Entamoeba dispar
VPAGLSV

SEQ ID NO: 2470059 - protein, 8 aa, Entamoeba dispar
VPAKGSAG

SEQ ID NO: 2470060 - protein, 9 aa, Entamoeba dispar
VPASEVPDV

SEQ ID NO: 2470061 - protein, 14 aa, Entamoeba dispar
VPCGEAKNHYSEAD

SEQ ID NO: 2470062 - protein, 10 aa, Entamoeba dispar
VPDDGYDGIS

SEQ ID NO: 2470063 - protein, 7 aa, Entamoeba dispar
VPDETGR

SEQ ID NO: 2470064 - protein, 37 aa, Entamoeba dispar
VPDKETSEEEYIESEDEDLENEEEKLENEKGDITTKQ

SEQ ID NO: 2470065 - protein, 5 aa, Entamoeba dispar
VPDPI

SEQ ID NO: 2470066 - protein, 6 aa, Entamoeba dispar
VPDQDA

SEQ ID NO: 2470067 - protein, 7 aa, Entamoeba dispar
VPDRAQG

SEQ ID NO: 2470068 - protein, 7 aa, Entamoeba dispar
VPDSITN

SEQ ID NO: 2470069 - protein, 11 aa, Entamoeba dispar
VPDSQKKGVSR

SEQ ID NO: 2470070 - protein, 8 aa, Entamoeba dispar
VPDTALDE

SEQ ID NO: 2470071 - protein, 4 aa, Entamoeba dispar
VPED

SEQ ID NO: 2470072 - protein, 6 aa, Entamoeba dispar
VPEGDG

SEQ ID NO: 2470073 - protein, 8 aa, Entamoeba dispar
VPEGQNEY

SEQ ID NO: 2470074 - protein, 11 aa, Entamoeba dispar
VPEIPAEIPQE

SEQ ID NO: 2470075 - protein, 6 aa, Entamoeba dispar
VPEPVG

SEQ ID NO: 2470076 - protein, 6 aa, Entamoeba dispar
VPEQPS

SEQ ID NO: 2470077 - protein, 18 aa, Entamoeba dispar
VPERAKPTEVKETKKQGP

SEQ ID NO: 2470078 - protein, 20 aa, Entamoeba dispar
VPERSTLGKRSANNIKKGDN

SEQ ID NO: 2470079 - protein, 14 aa, Entamoeba dispar
VPETKKTKLNQQIN

SEQ ID NO: 2470080 - protein, 9 aa, Entamoeba dispar
VPGAQFESD

SEQ ID NO: 2470081 - protein, 7 aa, Entamoeba dispar
VPGASRA

SEQ ID NO: 2470082 - protein, 6 aa, Entamoeba dispar
VPGEGE

SEQ ID NO: 2470083 - protein, 31 aa, Entamoeba dispar
VPGEKGEKKDLLNPKDFPDIPPFDPATTEVS

SEQ ID NO: 2470084 - protein, 22 aa, Entamoeba dispar
VPGESVYGEKRIAKEDAEGNKI

SEQ ID NO: 2470085 - protein, 9 aa, Entamoeba dispar
VPGNENTSK

SEQ ID NO: 2470086 - protein, 12 aa, Entamoeba dispar
VPGRTKKQCKDR

SEQ ID NO: 2470087 - protein, 6 aa, Entamoeba dispar
VPGSGF

SEQ ID NO: 2470088 - protein, 5 aa, Entamoeba dispar
VPHEG

SEQ ID NO: 2470089 - protein, 10 aa, Entamoeba dispar
VPHKNTPNNA

SEQ ID NO: 2470090 - protein, 9 aa, Entamoeba dispar
VPIGATPEY

SEQ ID NO: 2470091 - protein, 15 aa, Entamoeba dispar
VPIGQEKESIGFNSN

SEQ ID NO: 2470092 - protein, 35 aa, Entamoeba dispar
VPITQKPLDQEQEELKQETQLQDECKNGNTNLESY

SEQ ID NO: 2470093 - protein, 9 aa, Entamoeba dispar
VPKASDDAL

SEQ ID NO: 2470094 - protein, 11 aa, Entamoeba dispar
VPKATATAVTD

SEQ ID NO: 2470095 - protein, 181 aa, Entamoeba dispar
VPKEEEIHEEKSADDLREEPRKESSSSSNSEEESKETEEKPKEEEEKKTEEEEKKTEEEEKSNETQEKPKETEEKITEEEPKETEEKPKETEEEPKEVEEKPKETEEKPKETEEKPKEVEEKPKEVEEKPKEVEEEPKETEEKLEENKKSEDSSTKSDSSSTLSSSSSKSDTSDKKSRDLS

SEQ ID NO: 2470096 - protein, 13 aa, Entamoeba dispar
VPKEKRPKQPQTL

SEQ ID NO: 2470097 - protein, 11 aa, Entamoeba dispar
VPKESQKKWGF

SEQ ID NO: 2470098 - protein, 5 aa, Entamoeba dispar
VPKET

SEQ ID NO: 2470099 - protein, 9 aa, Entamoeba dispar
VPKGGKDKG

SEQ ID NO: 2470100 - protein, 8 aa, Entamoeba dispar
VPKGVSAI

SEQ ID NO: 2470101 - protein, 5 aa, Entamoeba dispar
VPKGY

SEQ ID NO: 2470102 - protein, 6 aa, Entamoeba dispar
VPKISN

SEQ ID NO: 2470103 - protein, 8 aa, Entamoeba dispar
VPKISSPL

SEQ ID NO: 2470104 - protein, 13 aa, Entamoeba dispar
VPKKDSQINLLLY

SEQ ID NO: 2470105 - protein, 5 aa, Entamoeba dispar
VPKNL

SEQ ID NO: 2470106 - protein, 21 aa, Entamoeba dispar
VPKNTTAIEPSQSDLSIGSGR

SEQ ID NO: 2470107 - protein, 23 aa, Entamoeba dispar
VPKQTTNQKQQTTNVDKSTNVIN

SEQ ID NO: 2470108 - protein, 11 aa, Entamoeba dispar
VPKSSRTGYRG

SEQ ID NO: 2470109 - protein, 7 aa, Entamoeba dispar
VPKTGRD

SEQ ID NO: 2470110 - protein, 5 aa, Entamoeba dispar
VPKTS

SEQ ID NO: 2470111 - protein, 33 aa, Entamoeba dispar
VPKTSVTEQPRLPITQTQKIEDKSNSSNSLECQ

SEQ ID NO: 2470112 - protein, 11 aa, Entamoeba dispar
VPKTTKENKDL

SEQ ID NO: 2470113 - protein, 6 aa, Entamoeba dispar
VPKWTG

SEQ ID NO: 2470114 - protein, 5 aa, Entamoeba dispar
VPLAD

SEQ ID NO: 2470115 - protein, 25 aa, Entamoeba dispar
VPLKKRKGNGDEYEAAEDKKLTEEI

SEQ ID NO: 2470116 - protein, 7 aa, Entamoeba dispar
VPLNNGY

SEQ ID NO: 2470117 - protein, 10 aa, Entamoeba dispar
VPLNPDDKPI

SEQ ID NO: 2470118 - protein, 4 aa, Entamoeba dispar
VPLP

SEQ ID NO: 2470119 - protein, 86 aa, Entamoeba dispar
VPLPPSPHGEAPPPVPPPRGGAPALPPPRRGTKNVPPPPPLDPNAVTPTSTTLSGPSLAEQLQAKKNDLNSVPVEDNTLAQQEDDI

SEQ ID NO: 2470120 - protein, 5 aa, Entamoeba dispar
VPLPT

SEQ ID NO: 2470121 - protein, 11 aa, Entamoeba dispar
VPLQSDSSEAW

SEQ ID NO: 2470122 - protein, 31 aa, Entamoeba dispar
VPLSSSSGQPNRNYFDGSNDANDKEQEGGDL

SEQ ID NO: 2470123 - protein, 5 aa, Entamoeba dispar
VPLTT

SEQ ID NO: 2470124 - protein, 14 aa, Entamoeba dispar
VPNFGDETSSDEDV

SEQ ID NO: 2470125 - protein, 7 aa, Entamoeba dispar
VPNKNEK

SEQ ID NO: 2470126 - protein, 4 aa, Entamoeba dispar
VPNN

SEQ ID NO: 2470127 - protein, 11 aa, Entamoeba dispar
VPNNMQNIERE

SEQ ID NO: 2470128 - protein, 8 aa, Entamoeba dispar
VPNPESIS

SEQ ID NO: 2470129 - protein, 8 aa, Entamoeba dispar
VPNRNTMD

SEQ ID NO: 2470130 - protein, 5 aa, Entamoeba dispar
VPPEG

SEQ ID NO: 2470131 - protein, 14 aa, Entamoeba dispar
VPPENGRYISTEES

SEQ ID NO: 2470132 - protein, 12 aa, Entamoeba dispar
VPPKFSKKPTKV

SEQ ID NO: 2470133 - protein, 7 aa, Entamoeba dispar
VPPKGLN

SEQ ID NO: 2470134 - protein, 6 aa, Entamoeba dispar
VPPKKP

SEQ ID NO: 2470135 - protein, 38 aa, Entamoeba dispar
VPPKNENNDSENEIKEVDSVKEEHKNEELEITNNENEK

SEQ ID NO: 2470136 - protein, 7 aa, Entamoeba dispar
VPPKTED

SEQ ID NO: 2470137 - protein, 4 aa, Entamoeba dispar
VPPL

SEQ ID NO: 2470138 - protein, 18 aa, Entamoeba dispar
VPPPPPTLSMPPPPPTLN

SEQ ID NO: 2470139 - protein, 10 aa, Entamoeba dispar
VPPPSSNKPH

SEQ ID NO: 2470140 - protein, 5 aa, Entamoeba dispar
VPPPY

SEQ ID NO: 2470141 - protein, 5 aa, Entamoeba dispar
VPPQV

SEQ ID NO: 2470142 - protein, 121 aa, Entamoeba dispar
VPPRDDSQKNSFNKPRRDGREPKEDGNEQRRRGRGNREGGSYRERKENQERKERGDGEERSHRGRGGYRNNYRNGEKRDYKPKYHYGNEQQKESTKEEVKSLGTSSQETPIDSKPIEHKTD

SEQ ID NO: 2470143 - protein, 11 aa, Entamoeba dispar
VPPRSRSRSIS

SEQ ID NO: 2470144 - protein, 20 aa, Entamoeba dispar
VPPRTDAPKNSFNKGQHQGM

SEQ ID NO: 2470145 - protein, 12 aa, Entamoeba dispar
VPPSLTDENWKR

SEQ ID NO: 2470146 - protein, 6 aa, Entamoeba dispar
VPPSPD

SEQ ID NO: 2470147 - protein, 6 aa, Entamoeba dispar
VPPTAR

SEQ ID NO: 2470148 - protein, 16 aa, Entamoeba dispar
VPPVRKNSQLSPFPYS

SEQ ID NO: 2470149 - protein, 14 aa, Entamoeba dispar
VPQDRIKSTIVYQT

SEQ ID NO: 2470150 - protein, 6 aa, Entamoeba dispar
VPQGKG

SEQ ID NO: 2470151 - protein, 7 aa, Entamoeba dispar
VPQGRYD

SEQ ID NO: 2470152 - protein, 29 aa, Entamoeba dispar
VPQKESDKEESSEEDEKPKYKSKKERKEL

SEQ ID NO: 2470153 - protein, 10 aa, Entamoeba dispar
VPQKKTQSKV

SEQ ID NO: 2470154 - protein, 8 aa, Entamoeba dispar
VPQNRPSF

SEQ ID NO: 2470155 - protein, 8 aa, Entamoeba dispar
VPQPMSRG

SEQ ID NO: 2470156 - protein, 8 aa, Entamoeba dispar
VPQQHNEY

SEQ ID NO: 2470157 - protein, 5 aa, Entamoeba dispar
VPQQL

SEQ ID NO: 2470158 - protein, 8 aa, Entamoeba dispar
VPQQSNGV

SEQ ID NO: 2470159 - protein, 4 aa, Entamoeba dispar
VPQR

SEQ ID NO: 2470160 - protein, 12 aa, Entamoeba dispar
VPQREYNPEKDD

SEQ ID NO: 2470161 - protein, 14 aa, Entamoeba dispar
VPQRRPQNEIKKNL

SEQ ID NO: 2470162 - protein, 13 aa, Entamoeba dispar
VPQSIGDVIDVDD

SEQ ID NO: 2470163 - protein, 19 aa, Entamoeba dispar
VPQSKIHTRSSTRHKASQN

SEQ ID NO: 2470164 - protein, 7 aa, Entamoeba dispar
VPQSLPK

SEQ ID NO: 2470165 - protein, 6 aa, Entamoeba dispar
VPQSST

SEQ ID NO: 2470166 - protein, 14 aa, Entamoeba dispar
VPQTERPKRATGAA

SEQ ID NO: 2470167 - protein, 12 aa, Entamoeba dispar
VPQTTEGAVLVV

SEQ ID NO: 2470168 - protein, 15 aa, Entamoeba dispar
VPQYPQRYQQLTEDF

SEQ ID NO: 2470169 - protein, 11 aa, Entamoeba dispar
VPRDPNGDYPF

SEQ ID NO: 2470170 - protein, 4 aa, Entamoeba dispar
VPRR

SEQ ID NO: 2470171 - protein, 5 aa, Entamoeba dispar
VPRTL

SEQ ID NO: 2470172 - protein, 13 aa, Entamoeba dispar
VPRTVEEIEAFMK

SEQ ID NO: 2470173 - protein, 7 aa, Entamoeba dispar
VPRTVNS

SEQ ID NO: 2470174 - protein, 16 aa, Entamoeba dispar
VPRTVNSIKSQGGFDT

SEQ ID NO: 2470175 - protein, 13 aa, Entamoeba dispar
VPSAPPPKVPPRQ

SEQ ID NO: 2470176 - protein, 8 aa, Entamoeba dispar
VPSENDYS

SEQ ID NO: 2470177 - protein, 8 aa, Entamoeba dispar
VPSGKLSI

SEQ ID NO: 2470178 - protein, 6 aa, Entamoeba dispar
VPSHST

SEQ ID NO: 2470179 - protein, 4 aa, Entamoeba dispar
VPSI

SEQ ID NO: 2470180 - protein, 6 aa, Entamoeba dispar
VPSKEI

SEQ ID NO: 2470181 - protein, 13 aa, Entamoeba dispar
VPSKKDKEDYDAR

SEQ ID NO: 2470182 - protein, 7 aa, Entamoeba dispar
VPSKNGG

SEQ ID NO: 2470183 - protein, 6 aa, Entamoeba dispar
VPSKRV

SEQ ID NO: 2470184 - protein, 8 aa, Entamoeba dispar
VPSNPKDA

SEQ ID NO: 2470185 - protein, 8 aa, Entamoeba dispar
VPSPAPIE

SEQ ID NO: 2470186 - protein, 10 aa, Entamoeba dispar
VPSPEEQELY

SEQ ID NO: 2470187 - protein, 8 aa, Entamoeba dispar
VPSPISEL

SEQ ID NO: 2470188 - protein, 11 aa, Entamoeba dispar
VPSPSFTPNSS

SEQ ID NO: 2470189 - protein, 7 aa, Entamoeba dispar
VPSPSNL

SEQ ID NO: 2470190 - protein, 9 aa, Entamoeba dispar
VPSPTVSET

SEQ ID NO: 2470191 - protein, 12 aa, Entamoeba dispar
VPSQPKQQLPQQ

SEQ ID NO: 2470192 - protein, 9 aa, Entamoeba dispar
VPSQPNVQS

SEQ ID NO: 2470193 - protein, 15 aa, Entamoeba dispar
VPSQQITENQTKQLP

SEQ ID NO: 2470194 - protein, 6 aa, Entamoeba dispar
VPSQSI

SEQ ID NO: 2470195 - protein, 24 aa, Entamoeba dispar
VPSRESPSSTPRRARRGNEDDRMK

SEQ ID NO: 2470196 - protein, 5 aa, Entamoeba dispar
VPSSD

SEQ ID NO: 2470197 - protein, 5 aa, Entamoeba dispar
VPSSI

SEQ ID NO: 2470198 - protein, 7 aa, Entamoeba dispar
VPSSISE

SEQ ID NO: 2470199 - protein, 8 aa, Entamoeba dispar
VPSSISEI

SEQ ID NO: 2470200 - protein, 5 aa, Entamoeba dispar
VPSTL

SEQ ID NO: 2470201 - protein, 6 aa, Entamoeba dispar
VPSTSV

SEQ ID NO: 2470202 - protein, 4 aa, Entamoeba dispar
VPSY

SEQ ID NO: 2470203 - protein, 4 aa, Entamoeba dispar
VPTA

SEQ ID NO: 2470204 - protein, 5 aa, Entamoeba dispar
VPTEE

SEQ ID NO: 2470205 - protein, 7 aa, Entamoeba dispar
VPTEKKV

SEQ ID NO: 2470206 - protein, 15 aa, Entamoeba dispar
VPTERKNRCSEIPTD

SEQ ID NO: 2470207 - protein, 8 aa, Entamoeba dispar
VPTESTSK

SEQ ID NO: 2470208 - protein, 8 aa, Entamoeba dispar
VPTGPREG

SEQ ID NO: 2470209 - protein, 12 aa, Entamoeba dispar
VPTKKPSNLGGI

SEQ ID NO: 2470210 - protein, 13 aa, Entamoeba dispar
VPTKRTAEDDHEI

SEQ ID NO: 2470211 - protein, 6 aa, Entamoeba dispar
VPTLGT

SEQ ID NO: 2470212 - protein, 7 aa, Entamoeba dispar
VPTNEIE

SEQ ID NO: 2470213 - protein, 6 aa, Entamoeba dispar
VPTNPN

SEQ ID NO: 2470214 - protein, 6 aa, Entamoeba dispar
VPTPIE

SEQ ID NO: 2470215 - protein, 7 aa, Entamoeba dispar
VPTSNEL

SEQ ID NO: 2470216 - protein, 30 aa, Entamoeba dispar
VPTTANYNTGESQRKVSSGIIPSKNSINGL

SEQ ID NO: 2470217 - protein, 54 aa, Entamoeba dispar
VPTTNPFSDDSEDEKQKTQNVTEVNQSNPFVDESDEKLEEQVEEHRNPFGDESE

SEQ ID NO: 2470218 - protein, 6 aa, Entamoeba dispar
VPTTTN

SEQ ID NO: 2470219 - protein, 8 aa, Entamoeba dispar
VPTTVSEL

SEQ ID NO: 2470220 - protein, 5 aa, Entamoeba dispar
VPTTY

SEQ ID NO: 2470221 - protein, 13 aa, Entamoeba dispar
VPVDSSKDGIKAY

SEQ ID NO: 2470222 - protein, 6 aa, Entamoeba dispar
VPVEGG

SEQ ID NO: 2470223 - protein, 9 aa, Entamoeba dispar
VPVGAGSYT

SEQ ID NO: 2470224 - protein, 20 aa, Entamoeba dispar
VPVSHQQAAPADLSKGKVTP

SEQ ID NO: 2470225 - protein, 4 aa, Entamoeba dispar
VPWK

SEQ ID NO: 2470226 - protein, 13 aa, Entamoeba dispar
VPYAEEKMSNAIE

SEQ ID NO: 2470227 - protein, 34 aa, Entamoeba dispar
VPYQQKKTNRSRRKNISIAEGKTKNNKEKKEKMV

SEQ ID NO: 2470228 - protein, 12 aa, Entamoeba dispar
VQAEENANVYIC

SEQ ID NO: 2470229 - protein, 21 aa, Entamoeba dispar
VQAKKAYSLDGNELGTYSTEN

SEQ ID NO: 2470230 - protein, 11 aa, Entamoeba dispar
VQASTKRSEAM

SEQ ID NO: 2470231 - protein, 8 aa, Entamoeba dispar
VQATPSPF

SEQ ID NO: 2470232 - protein, 4 aa, Entamoeba dispar
VQCT

SEQ ID NO: 2470233 - protein, 5 aa, Entamoeba dispar
VQDEG

SEQ ID NO: 2470234 - protein, 21 aa, Entamoeba dispar
VQDEKKRFDRLRQDSDEFLKE

SEQ ID NO: 2470235 - protein, 7 aa, Entamoeba dispar
VQDNGFK

SEQ ID NO: 2470236 - protein, 13 aa, Entamoeba dispar
VQDQPDDIKEEEI

SEQ ID NO: 2470237 - protein, 14 aa, Entamoeba dispar
VQDSKDEKEASKNL

SEQ ID NO: 2470238 - protein, 13 aa, Entamoeba dispar
VQEDDDEGEDQNS

SEQ ID NO: 2470239 - protein, 30 aa, Entamoeba dispar
VQEDRSIVEQQQEQEKVEQQKKKEEVETNE

SEQ ID NO: 2470240 - protein, 17 aa, Entamoeba dispar
VQEEEKKRLNETDKNTL

SEQ ID NO: 2470241 - protein, 10 aa, Entamoeba dispar
VQEKGGIEQA

SEQ ID NO: 2470242 - protein, 6 aa, Entamoeba dispar
VQEMRT

SEQ ID NO: 2470243 - protein, 9 aa, Entamoeba dispar
VQENKNKIE

SEQ ID NO: 2470244 - protein, 12 aa, Entamoeba dispar
VQEPAQPAVQSR

SEQ ID NO: 2470245 - protein, 9 aa, Entamoeba dispar
VQEPPSRGP

SEQ ID NO: 2470246 - protein, 7 aa, Entamoeba dispar
VQEPSNV

SEQ ID NO: 2470247 - protein, 8 aa, Entamoeba dispar
VQESDESM

SEQ ID NO: 2470248 - protein, 7 aa, Entamoeba dispar
VQETGTL

SEQ ID NO: 2470249 - protein, 9 aa, Entamoeba dispar
VQGESKELN

SEQ ID NO: 2470250 - protein, 12 aa, Entamoeba dispar
VQGRAGNTKGIE

SEQ ID NO: 2470251 - protein, 4 aa, Entamoeba dispar
VQGS

SEQ ID NO: 2470252 - protein, 6 aa, Entamoeba dispar
VQGTYA

SEQ ID NO: 2470253 - protein, 6 aa, Entamoeba dispar
VQHNNP

SEQ ID NO: 2470254 - protein, 18 aa, Entamoeba dispar
VQHPEQQQSSEQTDENPI

SEQ ID NO: 2470255 - protein, 6 aa, Entamoeba dispar
VQHPTK

SEQ ID NO: 2470256 - protein, 9 aa, Entamoeba dispar
VQIDEPDGD

SEQ ID NO: 2470257 - protein, 10 aa, Entamoeba dispar
VQIEGNDEER

SEQ ID NO: 2470258 - protein, 4 aa, Entamoeba dispar
VQIP

SEQ ID NO: 2470259 - protein, 18 aa, Entamoeba dispar
VQKEFEEQEQIPCGDATK

SEQ ID NO: 2470260 - protein, 5 aa, Entamoeba dispar
VQKEG

SEQ ID NO: 2470261 - protein, 13 aa, Entamoeba dispar
VQKELKEFNAIKV

SEQ ID NO: 2470262 - protein, 11 aa, Entamoeba dispar
VQKENLPEDEA

SEQ ID NO: 2470263 - protein, 6 aa, Entamoeba dispar
VQKGNG

SEQ ID NO: 2470264 - protein, 7 aa, Entamoeba dispar
VQKSEGM

SEQ ID NO: 2470265 - protein, 8 aa, Entamoeba dispar
VQKSENAY

SEQ ID NO: 2470266 - protein, 6 aa, Entamoeba dispar
VQKTHE

SEQ ID NO: 2470267 - protein, 10 aa, Entamoeba dispar
VQKTQEQLNQ

SEQ ID NO: 2470268 - protein, 13 aa, Entamoeba dispar
VQLSGGKLQPKPI

SEQ ID NO: 2470269 - protein, 13 aa, Entamoeba dispar
VQLSQQDTTDFDQ

SEQ ID NO: 2470270 - protein, 17 aa, Entamoeba dispar
VQLTKQEKASKELEGKA

SEQ ID NO: 2470271 - protein, 7 aa, Entamoeba dispar
VQNEERV

SEQ ID NO: 2470272 - protein, 6 aa, Entamoeba dispar
VQNEIQ

SEQ ID NO: 2470273 - protein, 16 aa, Entamoeba dispar
VQNEKGSSAYLSKKHH

SEQ ID NO: 2470274 - protein, 6 aa, Entamoeba dispar
VQNENL

SEQ ID NO: 2470275 - protein, 16 aa, Entamoeba dispar
VQNEPGLEPQKQVTPP

SEQ ID NO: 2470276 - protein, 8 aa, Entamoeba dispar
VQNGEELP

SEQ ID NO: 2470277 - protein, 8 aa, Entamoeba dispar
VQNGEGID

SEQ ID NO: 2470278 - protein, 7 aa, Entamoeba dispar
VQNGGCN

SEQ ID NO: 2470279 - protein, 12 aa, Entamoeba dispar
VQNGNTSTAEEG

SEQ ID NO: 2470280 - protein, 7 aa, Entamoeba dispar
VQNKNIR

SEQ ID NO: 2470281 - protein, 5 aa, Entamoeba dispar
VQNKT

SEQ ID NO: 2470282 - protein, 5 aa, Entamoeba dispar
VQNNN

SEQ ID NO: 2470283 - protein, 7 aa, Entamoeba dispar
VQNTEQG

SEQ ID NO: 2470284 - protein, 5 aa, Entamoeba dispar
VQNYG

SEQ ID NO: 2470285 - protein, 18 aa, Entamoeba dispar
VQPDGSSQTLNTEKSDTI

SEQ ID NO: 2470286 - protein, 9 aa, Entamoeba dispar
VQPEERYQA

SEQ ID NO: 2470287 - protein, 200 aa, Entamoeba dispar
VQPEEVSDIPPPVPSKPPRLEQNELPKEPEEDKKAIKEEDKKAIKEEDKKAIKEEEKRQKEEEKRQKEEEKRQKEEEKRQKEEEKRLREEEKRQKEEEEKRQKEEEKRLREEEKLKKKLEEDERKKMKEEMKKAQKEEERLKKEEKKQEKKNKKTEDTNNNESEEEVIPGVPSQNFPTPAAVANPVDGEFSSKGIVTPKE

SEQ ID NO: 2470288 - protein, 5 aa, Entamoeba dispar
VQPEN

SEQ ID NO: 2470289 - protein, 4 aa, Entamoeba dispar
VQPG

SEQ ID NO: 2470290 - protein, 9 aa, Entamoeba dispar
VQPGNPTEL

SEQ ID NO: 2470291 - protein, 7 aa, Entamoeba dispar
VQPKETY

SEQ ID NO: 2470292 - protein, 11 aa, Entamoeba dispar
VQPKNNIPSEL

SEQ ID NO: 2470293 - protein, 6 aa, Entamoeba dispar
VQPKPV

SEQ ID NO: 2470294 - protein, 14 aa, Entamoeba dispar
VQPKQNEKKPNDNP

SEQ ID NO: 2470295 - protein, 5 aa, Entamoeba dispar
VQPNV

SEQ ID NO: 2470296 - protein, 6 aa, Entamoeba dispar
VQPPQR

SEQ ID NO: 2470297 - protein, 6 aa, Entamoeba dispar
VQPQND

SEQ ID NO: 2470298 - protein, 12 aa, Entamoeba dispar
VQPQTNQPPSID

SEQ ID NO: 2470299 - protein, 10 aa, Entamoeba dispar
VQPSDGDKIN

SEQ ID NO: 2470300 - protein, 12 aa, Entamoeba dispar
VQPSQPKNNEIN

SEQ ID NO: 2470301 - protein, 15 aa, Entamoeba dispar
VQPTKIPSEKDYASN

SEQ ID NO: 2470302 - protein, 10 aa, Entamoeba dispar
VQPTKYNGNE

SEQ ID NO: 2470303 - protein, 40 aa, Entamoeba dispar
VQQADGKQNTPQQYPGSNSQQPYGQMGGYNAQQQYPGYGI

SEQ ID NO: 2470304 - protein, 18 aa, Entamoeba dispar
VQQEDNYQQPSCDTNSYV

SEQ ID NO: 2470305 - protein, 11 aa, Entamoeba dispar
VQQIEAQKEEE

SEQ ID NO: 2470306 - protein, 37 aa, Entamoeba dispar
VQQKPSSSTQPISISPSHSPNTTQTLGPLPSKPPLPV

SEQ ID NO: 2470307 - protein, 11 aa, Entamoeba dispar
VQQLSTSTVTN

SEQ ID NO: 2470308 - protein, 7 aa, Entamoeba dispar
VQQNHSE

SEQ ID NO: 2470309 - protein, 18 aa, Entamoeba dispar
VQQNNTYNNYPSGARYGA

SEQ ID NO: 2470310 - protein, 6 aa, Entamoeba dispar
VQQPMN

SEQ ID NO: 2470311 - protein, 10 aa, Entamoeba dispar
VQQPQKQTMN

SEQ ID NO: 2470312 - protein, 7 aa, Entamoeba dispar
VQQPTTP

SEQ ID NO: 2470313 - protein, 6 aa, Entamoeba dispar
VQQQEN

SEQ ID NO: 2470314 - protein, 22 aa, Entamoeba dispar
VQQQTETKKPRKNDLPIPSSIT

SEQ ID NO: 2470315 - protein, 5 aa, Entamoeba dispar
VQQRA

SEQ ID NO: 2470316 - protein, 5 aa, Entamoeba dispar
VQRNG

SEQ ID NO: 2470317 - protein, 32 aa, Entamoeba dispar
VQRQERNNDFQPIAKRENLKDVNKEKEEEIDL

SEQ ID NO: 2470318 - protein, 9 aa, Entamoeba dispar
VQRSGMKKD

SEQ ID NO: 2470319 - protein, 7 aa, Entamoeba dispar
VQSDPSL

SEQ ID NO: 2470320 - protein, 8 aa, Entamoeba dispar
VQSEPKEY

SEQ ID NO: 2470321 - protein, 5 aa, Entamoeba dispar
VQSGE

SEQ ID NO: 2470322 - protein, 9 aa, Entamoeba dispar
VQSGTPFQK

SEQ ID NO: 2470323 - protein, 12 aa, Entamoeba dispar
VQSKKKKSLTYF

SEQ ID NO: 2470324 - protein, 4 aa, Entamoeba dispar
VQSP

SEQ ID NO: 2470325 - protein, 9 aa, Entamoeba dispar
VQSPNKEKV

SEQ ID NO: 2470326 - protein, 14 aa, Entamoeba dispar
VQSQQQNTTDSYSR

SEQ ID NO: 2470327 - protein, 8 aa, Entamoeba dispar
VQSRGTEI

SEQ ID NO: 2470328 - protein, 9 aa, Entamoeba dispar
VQSRPDEKY

SEQ ID NO: 2470329 - protein, 8 aa, Entamoeba dispar
VQSSPNQS

SEQ ID NO: 2470330 - protein, 63 aa, Entamoeba dispar
VQSSTPPMSPQHSHSITPSASPKENKVSTPLSPDREDGGVTTPTPSKKEEETKPKKSSNESVT

SEQ ID NO: 2470331 - protein, 5 aa, Entamoeba dispar
VQSWN

SEQ ID NO: 2470332 - protein, 5 aa, Entamoeba dispar
VQTDE

SEQ ID NO: 2470333 - protein, 18 aa, Entamoeba dispar
VQTDRKKAKTILSENPSL

SEQ ID NO: 2470334 - protein, 10 aa, Entamoeba dispar
VQTESQHYPI

SEQ ID NO: 2470335 - protein, 6 aa, Entamoeba dispar
VQTGDG

SEQ ID NO: 2470336 - protein, 13 aa, Entamoeba dispar
VQTGSSDSSMKEK

SEQ ID NO: 2470337 - protein, 4 aa, Entamoeba dispar
VQTI

SEQ ID NO: 2470338 - protein, 10 aa, Entamoeba dispar
VQTNTTGTHS

SEQ ID NO: 2470339 - protein, 7 aa, Entamoeba dispar
VQTPKYE

SEQ ID NO: 2470340 - protein, 12 aa, Entamoeba dispar
VQTPQQPQETVE

SEQ ID NO: 2470341 - protein, 33 aa, Entamoeba dispar
VQTQKDEIITKTDTLTDIENTNLENKKKEKKMM

SEQ ID NO: 2470342 - protein, 7 aa, Entamoeba dispar
VQTSNYQ

SEQ ID NO: 2470343 - protein, 12 aa, Entamoeba dispar
VQTTEGQSFADQ

SEQ ID NO: 2470344 - protein, 11 aa, Entamoeba dispar
VRAPTGSGKTL

SEQ ID NO: 2470345 - protein, 12 aa, Entamoeba dispar
VRDDYVKEASNL

SEQ ID NO: 2470346 - protein, 7 aa, Entamoeba dispar
VRDNTSF

SEQ ID NO: 2470347 - protein, 17 aa, Entamoeba dispar
VRDQQRNISCLDVPMEK

SEQ ID NO: 2470348 - protein, 9 aa, Entamoeba dispar
VRDTKKEGI

SEQ ID NO: 2470349 - protein, 8 aa, Entamoeba dispar
VREEEEGK

SEQ ID NO: 2470350 - protein, 11 aa, Entamoeba dispar
VREGEQQDQKY

SEQ ID NO: 2470351 - protein, 4 aa, Entamoeba dispar
VREI

SEQ ID NO: 2470352 - protein, 6 aa, Entamoeba dispar
VREIEK

SEQ ID NO: 2470353 - protein, 4 aa, Entamoeba dispar
VREK

SEQ ID NO: 2470354 - protein, 22 aa, Entamoeba dispar
VREKERNRVKEEMKETNRYGDA

SEQ ID NO: 2470355 - protein, 13 aa, Entamoeba dispar
VREKSDNRETNKY

SEQ ID NO: 2470356 - protein, 22 aa, Entamoeba dispar
VRENDNIEQLTETSKRKTSKLL

SEQ ID NO: 2470357 - protein, 16 aa, Entamoeba dispar
VRENKLENDNDEGVPI

SEQ ID NO: 2470358 - protein, 11 aa, Entamoeba dispar
VRENKVGKRKK

SEQ ID NO: 2470359 - protein, 4 aa, Entamoeba dispar
VREP

SEQ ID NO: 2470360 - protein, 12 aa, Entamoeba dispar
VREQLSRATDET

SEQ ID NO: 2470361 - protein, 14 aa, Entamoeba dispar
VREQLSRATDETSE

SEQ ID NO: 2470362 - protein, 8 aa, Entamoeba dispar
VRERSKAI

SEQ ID NO: 2470363 - protein, 7 aa, Entamoeba dispar
VRESDGS

SEQ ID NO: 2470364 - protein, 7 aa, Entamoeba dispar
VRETNRK

SEQ ID NO: 2470365 - protein, 41 aa, Entamoeba dispar
VREVPEVEESFSNEIDSSSDNEEDIRKTPSRHKSSPIKATS

SEQ ID NO: 2470366 - protein, 13 aa, Entamoeba dispar
VRGAGRNCQTTES

SEQ ID NO: 2470367 - protein, 15 aa, Entamoeba dispar
VRGGSMNDTNPITPD

SEQ ID NO: 2470368 - protein, 7 aa, Entamoeba dispar
VRGTSQL

SEQ ID NO: 2470369 - protein, 4 aa, Entamoeba dispar
VRIN

SEQ ID NO: 2470370 - protein, 7 aa, Entamoeba dispar
VRKEKPK

SEQ ID NO: 2470371 - protein, 20 aa, Entamoeba dispar
VRKREVDDAKKPDEEEETDH

SEQ ID NO: 2470372 - protein, 24 aa, Entamoeba dispar
VRKSEGKFTQGEKEIKKNESQKEG

SEQ ID NO: 2470373 - protein, 4 aa, Entamoeba dispar
VRNN

SEQ ID NO: 2470374 - protein, 6 aa, Entamoeba dispar
VRNNGT

SEQ ID NO: 2470375 - protein, 23 aa, Entamoeba dispar
VRNNQNSLENDGIIENEPNKIED

SEQ ID NO: 2470376 - protein, 26 aa, Entamoeba dispar
VRNSEVQKSQNENDTLVNEAKQKDAI

SEQ ID NO: 2470377 - protein, 13 aa, Entamoeba dispar
VRPDPLKSLFPTK

SEQ ID NO: 2470378 - protein, 6 aa, Entamoeba dispar
VRPPIP

SEQ ID NO: 2470379 - protein, 6 aa, Entamoeba dispar
VRPTAA

SEQ ID NO: 2470380 - protein, 12 aa, Entamoeba dispar
VRQQYKSADELA

SEQ ID NO: 2470381 - protein, 4 aa, Entamoeba dispar
VRQT

SEQ ID NO: 2470382 - protein, 9 aa, Entamoeba dispar
VRQTNGEFS

SEQ ID NO: 2470383 - protein, 6 aa, Entamoeba dispar
VRRATE

SEQ ID NO: 2470384 - protein, 24 aa, Entamoeba dispar
VRRDGDGRRCRGARRSRRRVRPEP

SEQ ID NO: 2470385 - protein, 20 aa, Entamoeba dispar
VRRGTTASKKLGSSFSGRLF

SEQ ID NO: 2470386 - protein, 6 aa, Entamoeba dispar
VRRPEE

SEQ ID NO: 2470387 - protein, 10 aa, Entamoeba dispar
VRRSNEPIES

SEQ ID NO: 2470388 - protein, 19 aa, Entamoeba dispar
VRRSSRLSSRKSLGLESVP

SEQ ID NO: 2470389 - protein, 6 aa, Entamoeba dispar
VRSAET

SEQ ID NO: 2470390 - protein, 6 aa, Entamoeba dispar
VRSEGD

SEQ ID NO: 2470391 - protein, 9 aa, Entamoeba dispar
VRSEPGTYL

SEQ ID NO: 2470392 - protein, 8 aa, Entamoeba dispar
VRSKATTL

SEQ ID NO: 2470393 - protein, 9 aa, Entamoeba dispar
VRSNANVAP

SEQ ID NO: 2470394 - protein, 6 aa, Entamoeba dispar
VRSPSE

SEQ ID NO: 2470395 - protein, 11 aa, Entamoeba dispar
VRSREQEESIY

SEQ ID NO: 2470396 - protein, 23 aa, Entamoeba dispar
VRSSEYAVNSVGKRRTKNKEAAF

SEQ ID NO: 2470397 - protein, 8 aa, Entamoeba dispar
VRSSHPCS

SEQ ID NO: 2470398 - protein, 14 aa, Entamoeba dispar
VRSYTGEKISEEDI

SEQ ID NO: 2470399 - protein, 8 aa, Entamoeba dispar
VRTASSIQ

SEQ ID NO: 2470400 - protein, 18 aa, Entamoeba dispar
VRTDREDTKFEKDGCQNL

SEQ ID NO: 2470401 - protein, 8 aa, Entamoeba dispar
VRTDSGLQ

SEQ ID NO: 2470402 - protein, 12 aa, Entamoeba dispar
VRTESVGTLGKK

SEQ ID NO: 2470403 - protein, 12 aa, Entamoeba dispar
VRTETGDEKNET

SEQ ID NO: 2470404 - protein, 11 aa, Entamoeba dispar
VRTGKSSNTIQ

SEQ ID NO: 2470405 - protein, 6 aa, Entamoeba dispar
VRTPAR

SEQ ID NO: 2470406 - protein, 7 aa, Entamoeba dispar
VRTSGDP

SEQ ID NO: 2470407 - protein, 11 aa, Entamoeba dispar
VRTTKSNKKPE

SEQ ID NO: 2470408 - protein, 10 aa, Entamoeba dispar
VRTYNGSDLI

SEQ ID NO: 2470409 - protein, 7 aa, Entamoeba dispar
VSAETSA

SEQ ID NO: 2470410 - protein, 4 aa, Entamoeba dispar
VSAI

SEQ ID NO: 2470411 - protein, 11 aa, Entamoeba dispar
VSANNDEKIGE

SEQ ID NO: 2470412 - protein, 7 aa, Entamoeba dispar
VSAPGLD

SEQ ID NO: 2470413 - protein, 6 aa, Entamoeba dispar
VSAQNR

SEQ ID NO: 2470414 - protein, 15 aa, Entamoeba dispar
VSAQTPLSQLSPSDG

SEQ ID NO: 2470415 - protein, 8 aa, Entamoeba dispar
VSARPSSF

SEQ ID NO: 2470416 - protein, 14 aa, Entamoeba dispar
VSASEESRTTEEIN

SEQ ID NO: 2470417 - protein, 6 aa, Entamoeba dispar
VSASSV

SEQ ID NO: 2470418 - protein, 9 aa, Entamoeba dispar
VSATNNEGL

SEQ ID NO: 2470419 - protein, 11 aa, Entamoeba dispar
VSDAQPKKQKL

SEQ ID NO: 2470420 - protein, 10 aa, Entamoeba dispar
VSDASESFSE

SEQ ID NO: 2470421 - protein, 7 aa, Entamoeba dispar
VSDDDVE

SEQ ID NO: 2470422 - protein, 10 aa, Entamoeba dispar
VSDDETTSFY

SEQ ID NO: 2470423 - protein, 15 aa, Entamoeba dispar
VSDESNNKFKTGNKI

SEQ ID NO: 2470424 - protein, 9 aa, Entamoeba dispar
VSDETNSEV

SEQ ID NO: 2470425 - protein, 7 aa, Entamoeba dispar
VSDHNSI

SEQ ID NO: 2470426 - protein, 7 aa, Entamoeba dispar
VSDMQKD

SEQ ID NO: 2470427 - protein, 7 aa, Entamoeba dispar
VSDNELK

SEQ ID NO: 2470428 - protein, 7 aa, Entamoeba dispar
VSDNFKE

SEQ ID NO: 2470429 - protein, 6 aa, Entamoeba dispar
VSDNQP

SEQ ID NO: 2470430 - protein, 8 aa, Entamoeba dispar
VSDNSISK

SEQ ID NO: 2470431 - protein, 6 aa, Entamoeba dispar
VSDPEH

SEQ ID NO: 2470432 - protein, 12 aa, Entamoeba dispar
VSDQNKQRLSED

SEQ ID NO: 2470433 - protein, 22 aa, Entamoeba dispar
VSDSNKTVTKYTGGYFGEGDRS

SEQ ID NO: 2470434 - protein, 10 aa, Entamoeba dispar
VSDSRKLPKI

SEQ ID NO: 2470435 - protein, 8 aa, Entamoeba dispar
VSDSWEGK

SEQ ID NO: 2470436 - protein, 9 aa, Entamoeba dispar
VSDTPNSVT

SEQ ID NO: 2470437 - protein, 26 aa, Entamoeba dispar
VSEDEEEEINEQEIEIEKKKAQERIK

SEQ ID NO: 2470438 - protein, 8 aa, Entamoeba dispar
VSEDELGG

SEQ ID NO: 2470439 - protein, 6 aa, Entamoeba dispar
VSEDNI

SEQ ID NO: 2470440 - protein, 4 aa, Entamoeba dispar
VSEE

SEQ ID NO: 2470441 - protein, 34 aa, Entamoeba dispar
VSEEKPVKKRLEKSVATSTNNTSTNGVTSDGTHN

SEQ ID NO: 2470442 - protein, 12 aa, Entamoeba dispar
VSEGAKESKDDL

SEQ ID NO: 2470443 - protein, 9 aa, Entamoeba dispar
VSEGHRPLR

SEQ ID NO: 2470444 - protein, 6 aa, Entamoeba dispar
VSEGYK

SEQ ID NO: 2470445 - protein, 6 aa, Entamoeba dispar
VSEKEG

SEQ ID NO: 2470446 - protein, 8 aa, Entamoeba dispar
VSEKETLI

SEQ ID NO: 2470447 - protein, 10 aa, Entamoeba dispar
VSEKSSYHHG

SEQ ID NO: 2470448 - protein, 30 aa, Entamoeba dispar
VSELKSSTSRQRTEFPYSHQKSKIEAPKGY

SEQ ID NO: 2470449 - protein, 13 aa, Entamoeba dispar
VSELTQEKEEAEA

SEQ ID NO: 2470450 - protein, 42 aa, Entamoeba dispar
VSEMPKKIKDTKENVKNDRKKNEDTKEKATKRAKNLKKGDNL

SEQ ID NO: 2470451 - protein, 13 aa, Entamoeba dispar
VSENKEGSESKTR

SEQ ID NO: 2470452 - protein, 12 aa, Entamoeba dispar
VSEQGEKTSVVT

SEQ ID NO: 2470453 - protein, 7 aa, Entamoeba dispar
VSEQNFG

SEQ ID NO: 2470454 - protein, 7 aa, Entamoeba dispar
VSERPQI

SEQ ID NO: 2470455 - protein, 10 aa, Entamoeba dispar
VSESDKSNYK

SEQ ID NO: 2470456 - protein, 8 aa, Entamoeba dispar
VSESRYQT

SEQ ID NO: 2470457 - protein, 9 aa, Entamoeba dispar
VSESTYGLK

SEQ ID NO: 2470458 - protein, 8 aa, Entamoeba dispar
VSESYDSS

SEQ ID NO: 2470459 - protein, 5 aa, Entamoeba dispar
VSETG

SEQ ID NO: 2470460 - protein, 11 aa, Entamoeba dispar
VSETPTLLTGS

SEQ ID NO: 2470461 - protein, 18 aa, Entamoeba dispar
VSEYRSSVESQKNKQIEI

SEQ ID NO: 2470462 - protein, 7 aa, Entamoeba dispar
VSEYTDN

SEQ ID NO: 2470463 - protein, 7 aa, Entamoeba dispar
VSEYTNN

SEQ ID NO: 2470464 - protein, 10 aa, Entamoeba dispar
VSGAKLKGDM

SEQ ID NO: 2470465 - protein, 6 aa, Entamoeba dispar
VSGDSR

SEQ ID NO: 2470466 - protein, 15 aa, Entamoeba dispar
VSGDVANYTRIRSII

SEQ ID NO: 2470467 - protein, 8 aa, Entamoeba dispar
VSGEGSVE

SEQ ID NO: 2470468 - protein, 6 aa, Entamoeba dispar
VSGEKI

SEQ ID NO: 2470469 - protein, 6 aa, Entamoeba dispar
VSGGDE

SEQ ID NO: 2470470 - protein, 8 aa, Entamoeba dispar
VSGGHPDK

SEQ ID NO: 2470471 - protein, 7 aa, Entamoeba dispar
VSGGNEK

SEQ ID NO: 2470472 - protein, 7 aa, Entamoeba dispar
VSGGSLE

SEQ ID NO: 2470473 - protein, 7 aa, Entamoeba dispar
VSGGTDK

SEQ ID NO: 2470474 - protein, 9 aa, Entamoeba dispar
VSGKCNSNS

SEQ ID NO: 2470475 - protein, 10 aa, Entamoeba dispar
VSGKEEEINK

SEQ ID NO: 2470476 - protein, 7 aa, Entamoeba dispar
VSGKGKL

SEQ ID NO: 2470477 - protein, 6 aa, Entamoeba dispar
VSGKKY

SEQ ID NO: 2470478 - protein, 14 aa, Entamoeba dispar
VSGNDTEETEYANS

SEQ ID NO: 2470479 - protein, 49 aa, Entamoeba dispar
VSGNNQNAMTMDETSTEKAPKINAPKSVPKFNGRYPQPTEEQRERDNRS

SEQ ID NO: 2470480 - protein, 5 aa, Entamoeba dispar
VSGNT

SEQ ID NO: 2470481 - protein, 10 aa, Entamoeba dispar
VSGPNDSTKL

SEQ ID NO: 2470482 - protein, 15 aa, Entamoeba dispar
VSGQKDNLKSPSGSV

SEQ ID NO: 2470483 - protein, 4 aa, Entamoeba dispar
VSGR

SEQ ID NO: 2470484 - protein, 6 aa, Entamoeba dispar
VSGRIG

SEQ ID NO: 2470485 - protein, 7 aa, Entamoeba dispar
VSGSRDK

SEQ ID NO: 2470486 - protein, 21 aa, Entamoeba dispar
VSGTKAVGHGVVSGTKAVGHG

SEQ ID NO: 2470487 - protein, 32 aa, Entamoeba dispar
VSHKTVDGSPYDPSQSSSIENVKEIKKKKKKF

SEQ ID NO: 2470488 - protein, 7 aa, Entamoeba dispar
VSHNNTT

SEQ ID NO: 2470489 - protein, 8 aa, Entamoeba dispar
VSHPVEQQ

SEQ ID NO: 2470490 - protein, 24 aa, Entamoeba dispar
VSHRRGKSSIDQSTRKNEAKSEFK

SEQ ID NO: 2470491 - protein, 7 aa, Entamoeba dispar
VSHTPTP

SEQ ID NO: 2470492 - protein, 9 aa, Entamoeba dispar
VSIEKQKEL

SEQ ID NO: 2470493 - protein, 11 aa, Entamoeba dispar
VSINKRTKQQI

SEQ ID NO: 2470494 - protein, 32 aa, Entamoeba dispar
VSIPPQKVPPAPPPSTQTKSEINHHAQEQNSF

SEQ ID NO: 2470495 - protein, 5 aa, Entamoeba dispar
VSIRG

SEQ ID NO: 2470496 - protein, 11 aa, Entamoeba dispar
VSKADGEALAK

SEQ ID NO: 2470497 - protein, 6 aa, Entamoeba dispar
VSKAEK

SEQ ID NO: 2470498 - protein, 26 aa, Entamoeba dispar
VSKAKKGNENNRIENMTRGRSRNELQ

SEQ ID NO: 2470499 - protein, 4 aa, Entamoeba dispar
VSKD

SEQ ID NO: 2470500 - protein, 8 aa, Entamoeba dispar
VSKDAKDL

SEQ ID NO: 2470501 - protein, 6 aa, Entamoeba dispar
VSKDAL

SEQ ID NO: 2470502 - protein, 4 aa, Entamoeba dispar
VSKE

SEQ ID NO: 2470503 - protein, 25 aa, Entamoeba dispar
VSKEEKKGQKKEREKKESKIEEGLS

SEQ ID NO: 2470504 - protein, 6 aa, Entamoeba dispar
VSKEQA

SEQ ID NO: 2470505 - protein, 25 aa, Entamoeba dispar
VSKEQNQFNSSKLPKPELKTESPLS

SEQ ID NO: 2470506 - protein, 4 aa, Entamoeba dispar
VSKG

SEQ ID NO: 2470507 - protein, 10 aa, Entamoeba dispar
VSKGEKAEAV

SEQ ID NO: 2470508 - protein, 8 aa, Entamoeba dispar
VSKGKNAK

SEQ ID NO: 2470509 - protein, 22 aa, Entamoeba dispar
VSKGLGSKESIYKDNPNSVSTF

SEQ ID NO: 2470510 - protein, 23 aa, Entamoeba dispar
VSKIPEDDKTITEEEESTTLEDD

SEQ ID NO: 2470511 - protein, 5 aa, Entamoeba dispar
VSKKR

SEQ ID NO: 2470512 - protein, 11 aa, Entamoeba dispar
VSKKTEDNEVN

SEQ ID NO: 2470513 - protein, 10 aa, Entamoeba dispar
VSKLKQDIST

SEQ ID NO: 2470514 - protein, 9 aa, Entamoeba dispar
VSKLTSKNL

SEQ ID NO: 2470515 - protein, 11 aa, Entamoeba dispar
VSKNDKFKYAK

SEQ ID NO: 2470516 - protein, 10 aa, Entamoeba dispar
VSKNDQSISD

SEQ ID NO: 2470517 - protein, 11 aa, Entamoeba dispar
VSKNEVNPQHP

SEQ ID NO: 2470518 - protein, 6 aa, Entamoeba dispar
VSKNTG

SEQ ID NO: 2470519 - protein, 9 aa, Entamoeba dispar
VSKPPAPEE

SEQ ID NO: 2470520 - protein, 33 aa, Entamoeba dispar
VSKPREEGRRRDYRHDDRDSRRDYRSRDDHYRR

SEQ ID NO: 2470521 - protein, 15 aa, Entamoeba dispar
VSKSNESSQEGQSGC

SEQ ID NO: 2470522 - protein, 12 aa, Entamoeba dispar
VSKTAPSGEYLT

SEQ ID NO: 2470523 - protein, 8 aa, Entamoeba dispar
VSKTAREE

SEQ ID NO: 2470524 - protein, 11 aa, Entamoeba dispar
VSKTKTELKQR

SEQ ID NO: 2470525 - protein, 8 aa, Entamoeba dispar
VSKTNEAC

SEQ ID NO: 2470526 - protein, 13 aa, Entamoeba dispar
VSLENSSRKEYTE

SEQ ID NO: 2470527 - protein, 8 aa, Entamoeba dispar
VSLESNNG

SEQ ID NO: 2470528 - protein, 6 aa, Entamoeba dispar
VSLNGK

SEQ ID NO: 2470529 - protein, 4 aa, Entamoeba dispar
VSLP

SEQ ID NO: 2470530 - protein, 6 aa, Entamoeba dispar
VSLSQN

SEQ ID NO: 2470531 - protein, 8 aa, Entamoeba dispar
VSMDNDGN

SEQ ID NO: 2470532 - protein, 19 aa, Entamoeba dispar
VSMPNGSAVRISKDAQEYM

SEQ ID NO: 2470533 - protein, 10 aa, Entamoeba dispar
VSNAQQKIDQ

SEQ ID NO: 2470534 - protein, 11 aa, Entamoeba dispar
VSNDLKGKPKD

SEQ ID NO: 2470535 - protein, 18 aa, Entamoeba dispar
VSNDNNQGYAKPRIYESE

SEQ ID NO: 2470536 - protein, 14 aa, Entamoeba dispar
VSNEEPSHEISEKG

SEQ ID NO: 2470537 - protein, 10 aa, Entamoeba dispar
VSNEKWKQTP

SEQ ID NO: 2470538 - protein, 5 aa, Entamoeba dispar
VSNEL

SEQ ID NO: 2470539 - protein, 9 aa, Entamoeba dispar
VSNKNETDI

SEQ ID NO: 2470540 - protein, 8 aa, Entamoeba dispar
VSNKTTEN

SEQ ID NO: 2470541 - protein, 9 aa, Entamoeba dispar
VSNNASLTI

SEQ ID NO: 2470542 - protein, 6 aa, Entamoeba dispar
VSNNQR

SEQ ID NO: 2470543 - protein, 7 aa, Entamoeba dispar
VSNPSFK

SEQ ID NO: 2470544 - protein, 10 aa, Entamoeba dispar
VSNQERELTP

SEQ ID NO: 2470545 - protein, 8 aa, Entamoeba dispar
VSNRQTPT

SEQ ID NO: 2470546 - protein, 11 aa, Entamoeba dispar
VSNSPNSVTKE

SEQ ID NO: 2470547 - protein, 15 aa, Entamoeba dispar
VSNSSDTEGMDTPNI

SEQ ID NO: 2470548 - protein, 9 aa, Entamoeba dispar
VSNSTESDL

SEQ ID NO: 2470549 - protein, 17 aa, Entamoeba dispar
VSNTTNDIYESPSENEM

SEQ ID NO: 2470550 - protein, 7 aa, Entamoeba dispar
VSNTTQK

SEQ ID NO: 2470551 - protein, 4 aa, Entamoeba dispar
VSNV

SEQ ID NO: 2470552 - protein, 6 aa, Entamoeba dispar
VSNYNP

SEQ ID NO: 2470553 - protein, 8 aa, Entamoeba dispar
VSPAGKTL

SEQ ID NO: 2470554 - protein, 7 aa, Entamoeba dispar
VSPASLP

SEQ ID NO: 2470555 - protein, 5 aa, Entamoeba dispar
VSPDG

SEQ ID NO: 2470556 - protein, 11 aa, Entamoeba dispar
VSPGRSRPDQG

SEQ ID NO: 2470557 - protein, 4 aa, Entamoeba dispar
VSPK

SEQ ID NO: 2470558 - protein, 6 aa, Entamoeba dispar
VSPLTS

SEQ ID NO: 2470559 - protein, 7 aa, Entamoeba dispar
VSPNKGI

SEQ ID NO: 2470560 - protein, 10 aa, Entamoeba dispar
VSPNQQELSD

SEQ ID NO: 2470561 - protein, 10 aa, Entamoeba dispar
VSPNSPLKSS

SEQ ID NO: 2470562 - protein, 16 aa, Entamoeba dispar
VSPPDSSRSSLRSSLE

SEQ ID NO: 2470563 - protein, 16 aa, Entamoeba dispar
VSPPGGDFSDPVTTST

SEQ ID NO: 2470564 - protein, 8 aa, Entamoeba dispar
VSPPGTYL

SEQ ID NO: 2470565 - protein, 8 aa, Entamoeba dispar
VSPPPRSQ

SEQ ID NO: 2470566 - protein, 14 aa, Entamoeba dispar
VSPQIGSRNAFEES

SEQ ID NO: 2470567 - protein, 31 aa, Entamoeba dispar
VSPRSASSDRSTPEPKGQIQLTNEKSGSESF

SEQ ID NO: 2470568 - protein, 6 aa, Entamoeba dispar
VSPSDS

SEQ ID NO: 2470569 - protein, 7 aa, Entamoeba dispar
VSPSEAE

SEQ ID NO: 2470570 - protein, 6 aa, Entamoeba dispar
VSPSGR

SEQ ID NO: 2470571 - protein, 7 aa, Entamoeba dispar
VSPSKDK

SEQ ID NO: 2470572 - protein, 10 aa, Entamoeba dispar
VSPSNKTVNQ

SEQ ID NO: 2470573 - protein, 6 aa, Entamoeba dispar
VSPSQM

SEQ ID NO: 2470574 - protein, 6 aa, Entamoeba dispar
VSPSSL

SEQ ID NO: 2470575 - protein, 10 aa, Entamoeba dispar
VSPSTINPFT

SEQ ID NO: 2470576 - protein, 6 aa, Entamoeba dispar
VSPSTK

SEQ ID NO: 2470577 - protein, 5 aa, Entamoeba dispar
VSPTE

SEQ ID NO: 2470578 - protein, 9 aa, Entamoeba dispar
VSQAENKQY

SEQ ID NO: 2470579 - protein, 8 aa, Entamoeba dispar
VSQDTRLD

SEQ ID NO: 2470580 - protein, 20 aa, Entamoeba dispar
VSQGADARSEVAPPKARNAQ

SEQ ID NO: 2470581 - protein, 7 aa, Entamoeba dispar
VSQGNSF

SEQ ID NO: 2470582 - protein, 15 aa, Entamoeba dispar
VSQKLEKESIKEEIS

SEQ ID NO: 2470583 - protein, 9 aa, Entamoeba dispar
VSQNDSERK

SEQ ID NO: 2470584 - protein, 15 aa, Entamoeba dispar
VSQPKSYGGEYTSTY

SEQ ID NO: 2470585 - protein, 12 aa, Entamoeba dispar
VSQPKTSQPDSF

SEQ ID NO: 2470586 - protein, 10 aa, Entamoeba dispar
VSQPNQKQTS

SEQ ID NO: 2470587 - protein, 9 aa, Entamoeba dispar
VSQPSKTID

SEQ ID NO: 2470588 - protein, 12 aa, Entamoeba dispar
VSQPSTPVTRNQ

SEQ ID NO: 2470589 - protein, 7 aa, Entamoeba dispar
VSQQKAI

SEQ ID NO: 2470590 - protein, 4 aa, Entamoeba dispar
VSQR

SEQ ID NO: 2470591 - protein, 5 aa, Entamoeba dispar
VSQRY

SEQ ID NO: 2470592 - protein, 10 aa, Entamoeba dispar
VSQSDTQEQV

SEQ ID NO: 2470593 - protein, 7 aa, Entamoeba dispar
VSQSFKN

SEQ ID NO: 2470594 - protein, 9 aa, Entamoeba dispar
VSQSKESNV

SEQ ID NO: 2470595 - protein, 5 aa, Entamoeba dispar
VSQSN

SEQ ID NO: 2470596 - protein, 6 aa, Entamoeba dispar
VSQTNS

SEQ ID NO: 2470597 - protein, 10 aa, Entamoeba dispar
VSQTQSGTTA

SEQ ID NO: 2470598 - protein, 9 aa, Entamoeba dispar
VSQTSRRNT

SEQ ID NO: 2470599 - protein, 8 aa, Entamoeba dispar
VSQYPGSQ

SEQ ID NO: 2470600 - protein, 6 aa, Entamoeba dispar
VSRGEM

SEQ ID NO: 2470601 - protein, 15 aa, Entamoeba dispar
VSRGKKYSPNQTVGT

SEQ ID NO: 2470602 - protein, 8 aa, Entamoeba dispar
VSRGQSNG

SEQ ID NO: 2470603 - protein, 5 aa, Entamoeba dispar
VSRIG

SEQ ID NO: 2470604 - protein, 15 aa, Entamoeba dispar
VSRKGDPMTYQMLED

SEQ ID NO: 2470605 - protein, 7 aa, Entamoeba dispar
VSRKRYS

SEQ ID NO: 2470606 - protein, 4 aa, Entamoeba dispar
VSRL

SEQ ID NO: 2470607 - protein, 8 aa, Entamoeba dispar
VSRNGNNL

SEQ ID NO: 2470608 - protein, 4 aa, Entamoeba dispar
VSRP

SEQ ID NO: 2470609 - protein, 7 aa, Entamoeba dispar
VSRPGYG

SEQ ID NO: 2470610 - protein, 7 aa, Entamoeba dispar
VSRSATY

SEQ ID NO: 2470611 - protein, 10 aa, Entamoeba dispar
VSRSTPDNYT

SEQ ID NO: 2470612 - protein, 10 aa, Entamoeba dispar
VSRSTSRGEF

SEQ ID NO: 2470613 - protein, 5 aa, Entamoeba dispar
VSRTS

SEQ ID NO: 2470614 - protein, 5 aa, Entamoeba dispar
VSRWT

SEQ ID NO: 2470615 - protein, 5 aa, Entamoeba dispar
VSSDE

SEQ ID NO: 2470616 - protein, 11 aa, Entamoeba dispar
VSSDGSAINAG

SEQ ID NO: 2470617 - protein, 6 aa, Entamoeba dispar
VSSDIL

SEQ ID NO: 2470618 - protein, 6 aa, Entamoeba dispar
VSSDIN

SEQ ID NO: 2470619 - protein, 12 aa, Entamoeba dispar
VSSDTPSLDQSG

SEQ ID NO: 2470620 - protein, 6 aa, Entamoeba dispar
VSSEEL

SEQ ID NO: 2470621 - protein, 4 aa, Entamoeba dispar
VSSG

SEQ ID NO: 2470622 - protein, 8 aa, Entamoeba dispar
VSSGAKPV

SEQ ID NO: 2470623 - protein, 5 aa, Entamoeba dispar
VSSHQ

SEQ ID NO: 2470624 - protein, 16 aa, Entamoeba dispar
VSSHQPRMEEVSNFQE

SEQ ID NO: 2470625 - protein, 10 aa, Entamoeba dispar
VSSIKEESKS

SEQ ID NO: 2470626 - protein, 5 aa, Entamoeba dispar
VSSIP

SEQ ID NO: 2470627 - protein, 4 aa, Entamoeba dispar
VSSK

SEQ ID NO: 2470628 - protein, 11 aa, Entamoeba dispar
VSSKEEDNERI

SEQ ID NO: 2470629 - protein, 23 aa, Entamoeba dispar
VSSKPKSETKNTIGYYGEDDKSD

SEQ ID NO: 2470630 - protein, 9 aa, Entamoeba dispar
VSSKSMTSK

SEQ ID NO: 2470631 - protein, 11 aa, Entamoeba dispar
VSSKTGDGIPK

SEQ ID NO: 2470632 - protein, 6 aa, Entamoeba dispar
VSSKVQ

SEQ ID NO: 2470633 - protein, 7 aa, Entamoeba dispar
VSSLGRS

SEQ ID NO: 2470634 - protein, 10 aa, Entamoeba dispar
VSSLKSSTIH

SEQ ID NO: 2470635 - protein, 7 aa, Entamoeba dispar
VSSNDGK

SEQ ID NO: 2470636 - protein, 50 aa, Entamoeba dispar
VSSNGPDSSSLPPPPPPPTTTSQPLSSSLPPPPPPPGIPGVPPPPPTVPG

SEQ ID NO: 2470637 - protein, 13 aa, Entamoeba dispar
VSSNPKTLKETGY

SEQ ID NO: 2470638 - protein, 13 aa, Entamoeba dispar
VSSNTPSLRSNVH

SEQ ID NO: 2470639 - protein, 5 aa, Entamoeba dispar
VSSPI

SEQ ID NO: 2470640 - protein, 16 aa, Entamoeba dispar
VSSPPTYKKSNSTSIT

SEQ ID NO: 2470641 - protein, 6 aa, Entamoeba dispar
VSSPRS

SEQ ID NO: 2470642 - protein, 18 aa, Entamoeba dispar
VSSPSQLSRSTRARPKTM

SEQ ID NO: 2470643 - protein, 6 aa, Entamoeba dispar
VSSPSY

SEQ ID NO: 2470644 - protein, 6 aa, Entamoeba dispar
VSSQKL

SEQ ID NO: 2470645 - protein, 6 aa, Entamoeba dispar
VSSQSK

SEQ ID NO: 2470646 - protein, 9 aa, Entamoeba dispar
VSSQTSPNI

SEQ ID NO: 2470647 - protein, 4 aa, Entamoeba dispar
VSSS

SEQ ID NO: 2470648 - protein, 6 aa, Entamoeba dispar
VSSSAH

SEQ ID NO: 2470649 - protein, 6 aa, Entamoeba dispar
VSSSFD

SEQ ID NO: 2470650 - protein, 13 aa, Entamoeba dispar
VSSSQVEKVDNQI

SEQ ID NO: 2470651 - protein, 22 aa, Entamoeba dispar
VSSSSAPKTQETVGYNGEGDRR

SEQ ID NO: 2470652 - protein, 4 aa, Entamoeba dispar
VSSV

SEQ ID NO: 2470653 - protein, 10 aa, Entamoeba dispar
VSSVSPNRKV

SEQ ID NO: 2470654 - protein, 58 aa, Entamoeba dispar
VSTANKTKFTKELKQATTPVIKETKGSSKKTKKESEDNLEEMSESIEEDNEQIFDEDM

SEQ ID NO: 2470655 - protein, 8 aa, Entamoeba dispar
VSTARSPI

SEQ ID NO: 2470656 - protein, 7 aa, Entamoeba dispar
VSTDNNE

SEQ ID NO: 2470657 - protein, 11 aa, Entamoeba dispar
VSTGSKASASL

SEQ ID NO: 2470658 - protein, 6 aa, Entamoeba dispar
VSTISV

SEQ ID NO: 2470659 - protein, 8 aa, Entamoeba dispar
VSTKEENN

SEQ ID NO: 2470660 - protein, 9 aa, Entamoeba dispar
VSTKPSTTI

SEQ ID NO: 2470661 - protein, 6 aa, Entamoeba dispar
VSTNEL

SEQ ID NO: 2470662 - protein, 12 aa, Entamoeba dispar
VSTNGRGATGVG

SEQ ID NO: 2470663 - protein, 22 aa, Entamoeba dispar
VSTNKCCKSTQVQNGNYCNSSK

SEQ ID NO: 2470664 - protein, 8 aa, Entamoeba dispar
VSTNKDKP

SEQ ID NO: 2470665 - protein, 12 aa, Entamoeba dispar
VSTNKNFKRTIK

SEQ ID NO: 2470666 - protein, 28 aa, Entamoeba dispar
VSTNQQITSSSSLNQSIQQQQLSNQPND

SEQ ID NO: 2470667 - protein, 8 aa, Entamoeba dispar
VSTNTDSK

SEQ ID NO: 2470668 - protein, 13 aa, Entamoeba dispar
VSTNTSNPSNSIK

SEQ ID NO: 2470669 - protein, 14 aa, Entamoeba dispar
VSTPRDSKKGSKKM

SEQ ID NO: 2470670 - protein, 9 aa, Entamoeba dispar
VSTPSKPNV

SEQ ID NO: 2470671 - protein, 11 aa, Entamoeba dispar
VSTSESKERYS

SEQ ID NO: 2470672 - protein, 13 aa, Entamoeba dispar
VSTSGESKTTTEM

SEQ ID NO: 2470673 - protein, 13 aa, Entamoeba dispar
VSTSKEKFTDKGD

SEQ ID NO: 2470674 - protein, 7 aa, Entamoeba dispar
VSTSQAM

SEQ ID NO: 2470675 - protein, 10 aa, Entamoeba dispar
VSTTLSSNAW

SEQ ID NO: 2470676 - protein, 9 aa, Entamoeba dispar
VSTTPKTSD

SEQ ID NO: 2470677 - protein, 15 aa, Entamoeba dispar
VSTTPNKSHSDLSSE

SEQ ID NO: 2470678 - protein, 31 aa, Entamoeba dispar
VSVNNQKPQPSPNNNDKPEPNQNNDKPQYNP

SEQ ID NO: 2470679 - protein, 17 aa, Entamoeba dispar
VSVNSQKLQKPQTTPSV

SEQ ID NO: 2470680 - protein, 7 aa, Entamoeba dispar
VSVPTTI

SEQ ID NO: 2470681 - protein, 11 aa, Entamoeba dispar
VSYGCDAEKKL

SEQ ID NO: 2470682 - protein, 7 aa, Entamoeba dispar
VSYSSNI

SEQ ID NO: 2470683 - protein, 10 aa, Entamoeba dispar
VTADSKAEQI

SEQ ID NO: 2470684 - protein, 8 aa, Entamoeba dispar
VTANSVQM

SEQ ID NO: 2470685 - protein, 9 aa, Entamoeba dispar
VTAPDSPIN

SEQ ID NO: 2470686 - protein, 6 aa, Entamoeba dispar
VTAPQE

SEQ ID NO: 2470687 - protein, 9 aa, Entamoeba dispar
VTAPSSEDK

SEQ ID NO: 2470688 - protein, 7 aa, Entamoeba dispar
VTATSKQ

SEQ ID NO: 2470689 - protein, 4 aa, Entamoeba dispar
VTDA

SEQ ID NO: 2470690 - protein, 12 aa, Entamoeba dispar
VTDDKKLDKVTR

SEQ ID NO: 2470691 - protein, 11 aa, Entamoeba dispar
VTDDKKLKVTR

SEQ ID NO: 2470692 - protein, 10 aa, Entamoeba dispar
VTDEATKRSC

SEQ ID NO: 2470693 - protein, 5 aa, Entamoeba dispar
VTDEF

SEQ ID NO: 2470694 - protein, 6 aa, Entamoeba dispar
VTDESL

SEQ ID NO: 2470695 - protein, 7 aa, Entamoeba dispar
VTDFGTS

SEQ ID NO: 2470696 - protein, 19 aa, Entamoeba dispar
VTDKQSLSFASRQHSKRQC

SEQ ID NO: 2470697 - protein, 6 aa, Entamoeba dispar
VTDKSI

SEQ ID NO: 2470698 - protein, 46 aa, Entamoeba dispar
VTDKSLKESKEISDERFNENEEKKQPSSENVQKSNHPKKTKEEWDD

SEQ ID NO: 2470699 - protein, 5 aa, Entamoeba dispar
VTDNG

SEQ ID NO: 2470700 - protein, 13 aa, Entamoeba dispar
VTDPEGKKQTAKV

SEQ ID NO: 2470701 - protein, 9 aa, Entamoeba dispar
VTDPQTGKK

SEQ ID NO: 2470702 - protein, 4 aa, Entamoeba dispar
VTDQ

SEQ ID NO: 2470703 - protein, 11 aa, Entamoeba dispar
VTDQTPRKSIT

SEQ ID NO: 2470704 - protein, 10 aa, Entamoeba dispar
VTDRNAPNGA

SEQ ID NO: 2470705 - protein, 7 aa, Entamoeba dispar
VTDSIDN

SEQ ID NO: 2470706 - protein, 11 aa, Entamoeba dispar
VTDSLSDSEIE

SEQ ID NO: 2470707 - protein, 7 aa, Entamoeba dispar
VTDTEKK

SEQ ID NO: 2470708 - protein, 19 aa, Entamoeba dispar
VTDTPNNLRPFDETKVPSI

SEQ ID NO: 2470709 - protein, 12 aa, Entamoeba dispar
VTDYAQNGDKEA

SEQ ID NO: 2470710 - protein, 9 aa, Entamoeba dispar
VTEEDKERL

SEQ ID NO: 2470711 - protein, 11 aa, Entamoeba dispar
VTEEEESNNKG

SEQ ID NO: 2470712 - protein, 6 aa, Entamoeba dispar
VTEEEG

SEQ ID NO: 2470713 - protein, 10 aa, Entamoeba dispar
VTEEFSRSGV

SEQ ID NO: 2470714 - protein, 12 aa, Entamoeba dispar
VTEEGKSLSMTN

SEQ ID NO: 2470715 - protein, 7 aa, Entamoeba dispar
VTEEPTR

SEQ ID NO: 2470716 - protein, 7 aa, Entamoeba dispar
VTEEQSL

SEQ ID NO: 2470717 - protein, 7 aa, Entamoeba dispar
VTEERDE

SEQ ID NO: 2470718 - protein, 10 aa, Entamoeba dispar
VTEESSLQQI

SEQ ID NO: 2470719 - protein, 4 aa, Entamoeba dispar
VTEK

SEQ ID NO: 2470720 - protein, 18 aa, Entamoeba dispar
VTEKEGTKEEINAEKERL

SEQ ID NO: 2470721 - protein, 11 aa, Entamoeba dispar
VTEKNHISSTG

SEQ ID NO: 2470722 - protein, 5 aa, Entamoeba dispar
VTELT

SEQ ID NO: 2470723 - protein, 10 aa, Entamoeba dispar
VTENKNYDGS

SEQ ID NO: 2470724 - protein, 11 aa, Entamoeba dispar
VTENKNYDGSF

SEQ ID NO: 2470725 - protein, 44 aa, Entamoeba dispar
VTENKVKSPVGSPRLSGPVQQKIDEKDNLINPSTGNHSIQPRRR

SEQ ID NO: 2470726 - protein, 5 aa, Entamoeba dispar
VTEPI

SEQ ID NO: 2470727 - protein, 6 aa, Entamoeba dispar
VTEPNE

SEQ ID NO: 2470728 - protein, 8 aa, Entamoeba dispar
VTEPNPKL

SEQ ID NO: 2470729 - protein, 5 aa, Entamoeba dispar
VTERP

SEQ ID NO: 2470730 - protein, 4 aa, Entamoeba dispar
VTES

SEQ ID NO: 2470731 - protein, 32 aa, Entamoeba dispar
VTESEKKKKKEGEKSSSSSSSEEEDDDAEDEE

SEQ ID NO: 2470732 - protein, 4 aa, Entamoeba dispar
VTET

SEQ ID NO: 2470733 - protein, 6 aa, Entamoeba dispar
VTETKD

SEQ ID NO: 2470734 - protein, 10 aa, Entamoeba dispar
VTETTQTSRK

SEQ ID NO: 2470735 - protein, 10 aa, Entamoeba dispar
VTETTTPKFQ

SEQ ID NO: 2470736 - protein, 7 aa, Entamoeba dispar
VTEVEEP

SEQ ID NO: 2470737 - protein, 4 aa, Entamoeba dispar
VTFE

SEQ ID NO: 2470738 - protein, 5 aa, Entamoeba dispar
VTGDQ

SEQ ID NO: 2470739 - protein, 8 aa, Entamoeba dispar
VTGGYRGE

SEQ ID NO: 2470740 - protein, 5 aa, Entamoeba dispar
VTGIG

SEQ ID NO: 2470741 - protein, 40 aa, Entamoeba dispar
VTGIQDDEQEAIQSLDKKENVSIDGQKNVNTTEEKSVHVE

SEQ ID NO: 2470742 - protein, 5 aa, Entamoeba dispar
VTGKE

SEQ ID NO: 2470743 - protein, 9 aa, Entamoeba dispar
VTGKNISGD

SEQ ID NO: 2470744 - protein, 9 aa, Entamoeba dispar
VTGKPNEKC

SEQ ID NO: 2470745 - protein, 5 aa, Entamoeba dispar
VTGKR

SEQ ID NO: 2470746 - protein, 7 aa, Entamoeba dispar
VTGNYDN

SEQ ID NO: 2470747 - protein, 22 aa, Entamoeba dispar
VTGQTTRKVTQTAKTGSTVTNK

SEQ ID NO: 2470748 - protein, 13 aa, Entamoeba dispar
VTGSEDNTMGLFV

SEQ ID NO: 2470749 - protein, 8 aa, Entamoeba dispar
VTGSGKTE

SEQ ID NO: 2470750 - protein, 8 aa, Entamoeba dispar
VTGSTDRT

SEQ ID NO: 2470751 - protein, 13 aa, Entamoeba dispar
VTGSTPKSGEGKL

SEQ ID NO: 2470752 - protein, 8 aa, Entamoeba dispar
VTGTSSGL

SEQ ID NO: 2470753 - protein, 5 aa, Entamoeba dispar
VTHSD

SEQ ID NO: 2470754 - protein, 11 aa, Entamoeba dispar
VTIGNTNTIQN

SEQ ID NO: 2470755 - protein, 5 aa, Entamoeba dispar
VTINR

SEQ ID NO: 2470756 - protein, 11 aa, Entamoeba dispar
VTIPSSVSEIG

SEQ ID NO: 2470757 - protein, 9 aa, Entamoeba dispar
VTISKDKKA

SEQ ID NO: 2470758 - protein, 4 aa, Entamoeba dispar
VTKE

SEQ ID NO: 2470759 - protein, 17 aa, Entamoeba dispar
VTKEKEDLEKEYSSGNN

SEQ ID NO: 2470760 - protein, 19 aa, Entamoeba dispar
VTKKKSKPFIPPKNNEERI

SEQ ID NO: 2470761 - protein, 14 aa, Entamoeba dispar
VTKKLNKKNSKKIS

SEQ ID NO: 2470762 - protein, 30 aa, Entamoeba dispar
VTKNACNDARIKDYKKEVGNVEELKKSVGK

SEQ ID NO: 2470763 - protein, 26 aa, Entamoeba dispar
VTKQKTAQETLARYNEGKKGKANAEN

SEQ ID NO: 2470764 - protein, 20 aa, Entamoeba dispar
VTKQTVSANAEDVLKNGSEE

SEQ ID NO: 2470765 - protein, 19 aa, Entamoeba dispar
VTKSQNEPITLSEGSVSPA

SEQ ID NO: 2470766 - protein, 8 aa, Entamoeba dispar
VTKTIQQE

SEQ ID NO: 2470767 - protein, 6 aa, Entamoeba dispar
VTNEEK

SEQ ID NO: 2470768 - protein, 7 aa, Entamoeba dispar
VTNEGIS

SEQ ID NO: 2470769 - protein, 10 aa, Entamoeba dispar
VTNETKQHLD

SEQ ID NO: 2470770 - protein, 5 aa, Entamoeba dispar
VTNHT

SEQ ID NO: 2470771 - protein, 4 aa, Entamoeba dispar
VTNI

SEQ ID NO: 2470772 - protein, 59 aa, Entamoeba dispar
VTNNYTNEEHQSTTAPIKTLKGKTSILKNPSLARTNTGILPKETTKKLRASCSPKRKRL

SEQ ID NO: 2470773 - protein, 8 aa, Entamoeba dispar
VTNPYTEE

SEQ ID NO: 2470774 - protein, 6 aa, Entamoeba dispar
VTNQPS

SEQ ID NO: 2470775 - protein, 7 aa, Entamoeba dispar
VTNSGGI

SEQ ID NO: 2470776 - protein, 7 aa, Entamoeba dispar
VTNSPQF

SEQ ID NO: 2470777 - protein, 10 aa, Entamoeba dispar
VTPDLPSSIT

SEQ ID NO: 2470778 - protein, 15 aa, Entamoeba dispar
VTPEGKKCTKGGDEF

SEQ ID NO: 2470779 - protein, 8 aa, Entamoeba dispar
VTPGNKQF

SEQ ID NO: 2470780 - protein, 22 aa, Entamoeba dispar
VTPISSKNVSEQENTSSVYEND

SEQ ID NO: 2470781 - protein, 4 aa, Entamoeba dispar
VTPK

SEQ ID NO: 2470782 - protein, 6 aa, Entamoeba dispar
VTPKQL

SEQ ID NO: 2470783 - protein, 6 aa, Entamoeba dispar
VTPKTD

SEQ ID NO: 2470784 - protein, 5 aa, Entamoeba dispar
VTPNR

SEQ ID NO: 2470785 - protein, 11 aa, Entamoeba dispar
VTPNYRPPEGD

SEQ ID NO: 2470786 - protein, 7 aa, Entamoeba dispar
VTPPQCP

SEQ ID NO: 2470787 - protein, 9 aa, Entamoeba dispar
VTPPRQTEY

SEQ ID NO: 2470788 - protein, 14 aa, Entamoeba dispar
VTPQNELEKTYDGS

SEQ ID NO: 2470789 - protein, 7 aa, Entamoeba dispar
VTPQNQQ

SEQ ID NO: 2470790 - protein, 4 aa, Entamoeba dispar
VTPR

SEQ ID NO: 2470791 - protein, 8 aa, Entamoeba dispar
VTPSSKVV

SEQ ID NO: 2470792 - protein, 9 aa, Entamoeba dispar
VTPTNAAGK

SEQ ID NO: 2470793 - protein, 9 aa, Entamoeba dispar
VTPVPGGDE

SEQ ID NO: 2470794 - protein, 5 aa, Entamoeba dispar
VTQAI

SEQ ID NO: 2470795 - protein, 12 aa, Entamoeba dispar
VTQDRFSGKKGE

SEQ ID NO: 2470796 - protein, 4 aa, Entamoeba dispar
VTQE

SEQ ID NO: 2470797 - protein, 12 aa, Entamoeba dispar
VTQGNSVSYPPN

SEQ ID NO: 2470798 - protein, 10 aa, Entamoeba dispar
VTQKAVDDEK

SEQ ID NO: 2470799 - protein, 14 aa, Entamoeba dispar
VTQNKQRHIESEKG

SEQ ID NO: 2470800 - protein, 28 aa, Entamoeba dispar
VTQPEEVKETSPTIKEDDSSSDEEKEVL

SEQ ID NO: 2470801 - protein, 15 aa, Entamoeba dispar
VTQTISNKAQEVDEA

SEQ ID NO: 2470802 - protein, 5 aa, Entamoeba dispar
VTQTK

SEQ ID NO: 2470803 - protein, 10 aa, Entamoeba dispar
VTRKYNSNKL

SEQ ID NO: 2470804 - protein, 5 aa, Entamoeba dispar
VTRMT

SEQ ID NO: 2470805 - protein, 8 aa, Entamoeba dispar
VTRNDKIG

SEQ ID NO: 2470806 - protein, 11 aa, Entamoeba dispar
VTRSLGDKKFH

SEQ ID NO: 2470807 - protein, 6 aa, Entamoeba dispar
VTSANK

SEQ ID NO: 2470808 - protein, 10 aa, Entamoeba dispar
VTSATHEVKS

SEQ ID NO: 2470809 - protein, 5 aa, Entamoeba dispar
VTSDR

SEQ ID NO: 2470810 - protein, 6 aa, Entamoeba dispar
VTSDSD

SEQ ID NO: 2470811 - protein, 10 aa, Entamoeba dispar
VTSEGKDLNK

SEQ ID NO: 2470812 - protein, 7 aa, Entamoeba dispar
VTSEKGF

SEQ ID NO: 2470813 - protein, 5 aa, Entamoeba dispar
VTSES

SEQ ID NO: 2470814 - protein, 33 aa, Entamoeba dispar
VTSETPSSSEEESKGVMDKTATSLSEETKEENV

SEQ ID NO: 2470815 - protein, 16 aa, Entamoeba dispar
VTSGAQIDINKDGTSI

SEQ ID NO: 2470816 - protein, 17 aa, Entamoeba dispar
VTSGNDEVPKYKFPSSV

SEQ ID NO: 2470817 - protein, 17 aa, Entamoeba dispar
VTSLESDSQDKDEQIAK

SEQ ID NO: 2470818 - protein, 5 aa, Entamoeba dispar
VTSLG

SEQ ID NO: 2470819 - protein, 14 aa, Entamoeba dispar
VTSNPHPQSKTRDE

SEQ ID NO: 2470820 - protein, 22 aa, Entamoeba dispar
VTSNPLSSSVGNREQSTHASSV

SEQ ID NO: 2470821 - protein, 7 aa, Entamoeba dispar
VTSPKKI

SEQ ID NO: 2470822 - protein, 9 aa, Entamoeba dispar
VTSPKNADL

SEQ ID NO: 2470823 - protein, 5 aa, Entamoeba dispar
VTSPQ

SEQ ID NO: 2470824 - protein, 8 aa, Entamoeba dispar
VTSRFESD

SEQ ID NO: 2470825 - protein, 6 aa, Entamoeba dispar
VTSRNC

SEQ ID NO: 2470826 - protein, 14 aa, Entamoeba dispar
VTSRQTRIQNMLDE

SEQ ID NO: 2470827 - protein, 9 aa, Entamoeba dispar
VTSSEFKAT

SEQ ID NO: 2470828 - protein, 12 aa, Entamoeba dispar
VTSSIERSTFNQ

SEQ ID NO: 2470829 - protein, 7 aa, Entamoeba dispar
VTSSNGK

SEQ ID NO: 2470830 - protein, 10 aa, Entamoeba dispar
VTSVEGQQMA

SEQ ID NO: 2470831 - protein, 12 aa, Entamoeba dispar
VTSVSSHPGRTK

SEQ ID NO: 2470832 - protein, 13 aa, Entamoeba dispar
VTTDELNGDYDLQ

SEQ ID NO: 2470833 - protein, 9 aa, Entamoeba dispar
VTTDSDDQA

SEQ ID NO: 2470834 - protein, 13 aa, Entamoeba dispar
VTTEIDQEKKKMV

SEQ ID NO: 2470835 - protein, 5 aa, Entamoeba dispar
VTTEP

SEQ ID NO: 2470836 - protein, 5 aa, Entamoeba dispar
VTTLP

SEQ ID NO: 2470837 - protein, 4 aa, Entamoeba dispar
VTTN

SEQ ID NO: 2470838 - protein, 5 aa, Entamoeba dispar
VTTNT

SEQ ID NO: 2470839 - protein, 7 aa, Entamoeba dispar
VTTPEKA

SEQ ID NO: 2470840 - protein, 5 aa, Entamoeba dispar
VTTQF

SEQ ID NO: 2470841 - protein, 8 aa, Entamoeba dispar
VTTQPTFN

SEQ ID NO: 2470842 - protein, 4 aa, Entamoeba dispar
VTTS

SEQ ID NO: 2470843 - protein, 5 aa, Entamoeba dispar
VTTSK

SEQ ID NO: 2470844 - protein, 8 aa, Entamoeba dispar
VTTSKEEL

SEQ ID NO: 2470845 - protein, 5 aa, Entamoeba dispar
VTTSN

SEQ ID NO: 2470846 - protein, 7 aa, Entamoeba dispar
VTTSPLD

SEQ ID NO: 2470847 - protein, 10 aa, Entamoeba dispar
VTTSTNGKIE

SEQ ID NO: 2470848 - protein, 4 aa, Entamoeba dispar
VTTV

SEQ ID NO: 2470849 - protein, 11 aa, Entamoeba dispar
VTVGSEGKIST

SEQ ID NO: 2470850 - protein, 11 aa, Entamoeba dispar
VTYPSSSITSP

SEQ ID NO: 2470851 - protein, 6 aa, Entamoeba dispar
VTYTPT

SEQ ID NO: 2470852 - protein, 17 aa, Entamoeba dispar
VVEGGDDNDESTFDDKQ

SEQ ID NO: 2470853 - protein, 9 aa, Entamoeba dispar
VVEKPSNVN

SEQ ID NO: 2470854 - protein, 11 aa, Entamoeba dispar
VVEQQKKVNNI

SEQ ID NO: 2470855 - protein, 4 aa, Entamoeba dispar
VVES

SEQ ID NO: 2470856 - protein, 7 aa, Entamoeba dispar
VVESQES

SEQ ID NO: 2470857 - protein, 8 aa, Entamoeba dispar
VVGDGNEN

SEQ ID NO: 2470858 - protein, 8 aa, Entamoeba dispar
VVGEGGEF

SEQ ID NO: 2470859 - protein, 9 aa, Entamoeba dispar
VVGTSFNSY

SEQ ID NO: 2470860 - protein, 9 aa, Entamoeba dispar
VVKKSPLER

SEQ ID NO: 2470861 - protein, 29 aa, Entamoeba dispar
VVKTNTNEFSIKEDSQKSDISSNSQTTIK

SEQ ID NO: 2470862 - protein, 8 aa, Entamoeba dispar
VVNGTSRK

SEQ ID NO: 2470863 - protein, 10 aa, Entamoeba dispar
VVNKEKPLST

SEQ ID NO: 2470864 - protein, 28 aa, Entamoeba dispar
VVNKPKKDEESDSDNELSSSSSLDSEEA

SEQ ID NO: 2470865 - protein, 17 aa, Entamoeba dispar
VVNPGTSSERKTNYKKY

SEQ ID NO: 2470866 - protein, 8 aa, Entamoeba dispar
VVPKGSPV

SEQ ID NO: 2470867 - protein, 6 aa, Entamoeba dispar
VVPSSI

SEQ ID NO: 2470868 - protein, 37 aa, Entamoeba dispar
VVPTTTPLSQVNDKSLNEKHKVEKKINVEQNNSTFDR

SEQ ID NO: 2470869 - protein, 8 aa, Entamoeba dispar
VVQPTPTY

SEQ ID NO: 2470870 - protein, 13 aa, Entamoeba dispar
VVQQAAEKISPQT

SEQ ID NO: 2470871 - protein, 9 aa, Entamoeba dispar
VVRNTSSSP

SEQ ID NO: 2470872 - protein, 5 aa, Entamoeba dispar
VVSEE

SEQ ID NO: 2470873 - protein, 10 aa, Entamoeba dispar
VVSQDDRRMK

SEQ ID NO: 2470874 - protein, 8 aa, Entamoeba dispar
VVSQSKKI

SEQ ID NO: 2470875 - protein, 9 aa, Entamoeba dispar
VVTERNDKT

SEQ ID NO: 2470876 - protein, 47 aa, Entamoeba dispar
VVTKNESKKVTQDEKKAEKKRKAEQKKIEKEEKKRKREEEKKLKKDA

SEQ ID NO: 2470877 - protein, 17 aa, Entamoeba dispar
VYDDPNIPLSNPPKKKY

SEQ ID NO: 2470878 - protein, 10 aa, Entamoeba dispar
VYESSISNGI

SEQ ID NO: 2470879 - protein, 12 aa, Entamoeba dispar
VYGNNDEKKNNF

SEQ ID NO: 2470880 - protein, 12 aa, Entamoeba dispar
VYGSKKKWPDYQ

SEQ ID NO: 2470881 - protein, 8 aa, Entamoeba dispar
VYGSKTPM

SEQ ID NO: 2470882 - protein, 5 aa, Entamoeba dispar
VYNDD

SEQ ID NO: 2470883 - protein, 10 aa, Entamoeba dispar
VYNEKSATGW

SEQ ID NO: 2470884 - protein, 14 aa, Entamoeba dispar
VYNQNQKNKLTIGS

SEQ ID NO: 2470885 - protein, 10 aa, Entamoeba dispar
VYPEDKYSEL

SEQ ID NO: 2470886 - protein, 8 aa, Entamoeba dispar
VYPQSEDT

SEQ ID NO: 2470887 - protein, 20 aa, Entamoeba dispar
VYQSQNPPFTRGYLYLYKSI

SEQ ID NO: 2470888 - protein, 10 aa, Entamoeba dispar
VYSDDDDDIV

SEQ ID NO: 2470889 - protein, 7 aa, Entamoeba dispar
VYSEPEK

SEQ ID NO: 2470890 - protein, 7 aa, Entamoeba dispar
VYSPYKK

SEQ ID NO: 2470891 - protein, 12 aa, Entamoeba dispar
VYTGTPDEMKEE

SEQ ID NO: 2470892 - protein, 5 aa, Entamoeba dispar
VYTSN

SEQ ID NO: 2470893 - protein, 7 aa, Entamoeba dispar
VYTTEKE

SEQ ID NO: 2470894 - protein, 7 aa, Entamoeba dispar
WAANPND

SEQ ID NO: 2470895 - protein, 11 aa, Entamoeba dispar
WAESQRKNLEM

SEQ ID NO: 2470896 - protein, 8 aa, Entamoeba dispar
WAKNDGKL

SEQ ID NO: 2470897 - protein, 16 aa, Entamoeba dispar
WAPNANDRTFTLKVNV

SEQ ID NO: 2470898 - protein, 9 aa, Entamoeba dispar
WASQGRKNV

SEQ ID NO: 2470899 - protein, 61 aa, Entamoeba dispar
WDDTTKEEEKENHENNSMEEEIEEGEEESMKEEDEEHMEEDEENKEEDEEHMEEDEESEEV

SEQ ID NO: 2470900 - protein, 10 aa, Entamoeba dispar
WDEIDTEEDT

SEQ ID NO: 2470901 - protein, 16 aa, Entamoeba dispar
WDEKRIESRQQYLPKR

SEQ ID NO: 2470902 - protein, 6 aa, Entamoeba dispar
WDKPKE

SEQ ID NO: 2470903 - protein, 4 aa, Entamoeba dispar
WDPT

SEQ ID NO: 2470904 - protein, 15 aa, Entamoeba dispar
WDPTHNLKATDNPNR

SEQ ID NO: 2470905 - protein, 10 aa, Entamoeba dispar
WDTNPRGRGY

SEQ ID NO: 2470906 - protein, 13 aa, Entamoeba dispar
WDYTEKEYKSSRN

SEQ ID NO: 2470907 - protein, 14 aa, Entamoeba dispar
WEAEARKKKKLQTR

SEQ ID NO: 2470908 - protein, 4 aa, Entamoeba dispar
WEEA

SEQ ID NO: 2470909 - protein, 47 aa, Entamoeba dispar
WEECSGSSSSDEREEDMSEEEDSKAEDFNEDDEDEMSEEEDNIPQYD

SEQ ID NO: 2470910 - protein, 12 aa, Entamoeba dispar
WEEEQQKRIKTR

SEQ ID NO: 2470911 - protein, 14 aa, Entamoeba dispar
WEEHRKNHSNQITK

SEQ ID NO: 2470912 - protein, 4 aa, Entamoeba dispar
WEEP

SEQ ID NO: 2470913 - protein, 8 aa, Entamoeba dispar
WEESKKSF

SEQ ID NO: 2470914 - protein, 15 aa, Entamoeba dispar
WEKESDLKEENDLKE

SEQ ID NO: 2470915 - protein, 7 aa, Entamoeba dispar
WEKNEEL

SEQ ID NO: 2470916 - protein, 9 aa, Entamoeba dispar
WEKSEKESK

SEQ ID NO: 2470917 - protein, 4 aa, Entamoeba dispar
WENE

SEQ ID NO: 2470918 - protein, 8 aa, Entamoeba dispar
WENEDGFS

SEQ ID NO: 2470919 - protein, 12 aa, Entamoeba dispar
WENEYNNKLDGT

SEQ ID NO: 2470920 - protein, 22 aa, Entamoeba dispar
WEREQQDKRAEQTTAKSHGYEA

SEQ ID NO: 2470921 - protein, 4 aa, Entamoeba dispar
WGDD

SEQ ID NO: 2470922 - protein, 4 aa, Entamoeba dispar
WGDG

SEQ ID NO: 2470923 - protein, 4 aa, Entamoeba dispar
WGDL

SEQ ID NO: 2470924 - protein, 10 aa, Entamoeba dispar
WGEDTNLDEM

SEQ ID NO: 2470925 - protein, 10 aa, Entamoeba dispar
WGEDTNLEEM

SEQ ID NO: 2470926 - protein, 6 aa, Entamoeba dispar
WGESDN

SEQ ID NO: 2470927 - protein, 10 aa, Entamoeba dispar
WGGGYNGENI

SEQ ID NO: 2470928 - protein, 9 aa, Entamoeba dispar
WGKPSDPSI

SEQ ID NO: 2470929 - protein, 6 aa, Entamoeba dispar
WGNDSK

SEQ ID NO: 2470930 - protein, 6 aa, Entamoeba dispar
WGNEDV

SEQ ID NO: 2470931 - protein, 23 aa, Entamoeba dispar
WGNPVQSQNKTSQIGQPQPQKDV

SEQ ID NO: 2470932 - protein, 7 aa, Entamoeba dispar
WGSPQPY

SEQ ID NO: 2470933 - protein, 8 aa, Entamoeba dispar
WGSQDPYQ

SEQ ID NO: 2470934 - protein, 7 aa, Entamoeba dispar
WGSQPDQ

SEQ ID NO: 2470935 - protein, 5 aa, Entamoeba dispar
WGTES

SEQ ID NO: 2470936 - protein, 5 aa, Entamoeba dispar
WHGED

SEQ ID NO: 2470937 - protein, 5 aa, Entamoeba dispar
WIEDP

SEQ ID NO: 2470938 - protein, 9 aa, Entamoeba dispar
WITDESGKL

SEQ ID NO: 2470939 - protein, 8 aa, Entamoeba dispar
WKAPDTNR

SEQ ID NO: 2470940 - protein, 6 aa, Entamoeba dispar
WKDGTK

SEQ ID NO: 2470941 - protein, 20 aa, Entamoeba dispar
WKDGTKLRYEGYGDEEPGVI

SEQ ID NO: 2470942 - protein, 6 aa, Entamoeba dispar
WKDSGK

SEQ ID NO: 2470943 - protein, 6 aa, Entamoeba dispar
WKDTDV

SEQ ID NO: 2470944 - protein, 17 aa, Entamoeba dispar
WKEDESISLNGKSMKGE

SEQ ID NO: 2470945 - protein, 9 aa, Entamoeba dispar
WKEDNPVVK

SEQ ID NO: 2470946 - protein, 9 aa, Entamoeba dispar
WKEDNSLVK

SEQ ID NO: 2470947 - protein, 14 aa, Entamoeba dispar
WKEEKSKIKMQEVP

SEQ ID NO: 2470948 - protein, 12 aa, Entamoeba dispar
WKEESNKVPIKE

SEQ ID NO: 2470949 - protein, 16 aa, Entamoeba dispar
WKERNNKARRFIKEKD

SEQ ID NO: 2470950 - protein, 6 aa, Entamoeba dispar
WKESEQ

SEQ ID NO: 2470951 - protein, 9 aa, Entamoeba dispar
WKESGKGDI

SEQ ID NO: 2470952 - protein, 9 aa, Entamoeba dispar
WKESSSEEV

SEQ ID NO: 2470953 - protein, 6 aa, Entamoeba dispar
WKGMTG

SEQ ID NO: 2470954 - protein, 9 aa, Entamoeba dispar
WKGNNASQL

SEQ ID NO: 2470955 - protein, 18 aa, Entamoeba dispar
WKKEGFTLDQTRKELGKI

SEQ ID NO: 2470956 - protein, 8 aa, Entamoeba dispar
WKKYGETK

SEQ ID NO: 2470957 - protein, 5 aa, Entamoeba dispar
WKPNT

SEQ ID NO: 2470958 - protein, 16 aa, Entamoeba dispar
WKQEAKERIRIEEVVK

SEQ ID NO: 2470959 - protein, 8 aa, Entamoeba dispar
WKQEPKER

SEQ ID NO: 2470960 - protein, 13 aa, Entamoeba dispar
WKQEPKERIRIEE

SEQ ID NO: 2470961 - protein, 12 aa, Entamoeba dispar
WKQEPKERITIE

SEQ ID NO: 2470962 - protein, 6 aa, Entamoeba dispar
WKQPGC

SEQ ID NO: 2470963 - protein, 12 aa, Entamoeba dispar
WKQQTEKQKAGL

SEQ ID NO: 2470964 - protein, 12 aa, Entamoeba dispar
WKSCQAKNGELT

SEQ ID NO: 2470965 - protein, 4 aa, Entamoeba dispar
WKSG

SEQ ID NO: 2470966 - protein, 9 aa, Entamoeba dispar
WKSPSHGDQ

SEQ ID NO: 2470967 - protein, 11 aa, Entamoeba dispar
WKTDAKTLDTM

SEQ ID NO: 2470968 - protein, 8 aa, Entamoeba dispar
WKTTPKRF

SEQ ID NO: 2470969 - protein, 12 aa, Entamoeba dispar
WNDPRPKNERLP

SEQ ID NO: 2470970 - protein, 12 aa, Entamoeba dispar
WNESTSKKVEFE

SEQ ID NO: 2470971 - protein, 5 aa, Entamoeba dispar
WNETD

SEQ ID NO: 2470972 - protein, 11 aa, Entamoeba dispar
WNETKQQSEEV

SEQ ID NO: 2470973 - protein, 13 aa, Entamoeba dispar
WNGNQNTTKTVTE

SEQ ID NO: 2470974 - protein, 9 aa, Entamoeba dispar
WNGNTEKSI

SEQ ID NO: 2470975 - protein, 10 aa, Entamoeba dispar
WNGSNEIESE

SEQ ID NO: 2470976 - protein, 4 aa, Entamoeba dispar
WNKY

SEQ ID NO: 2470977 - protein, 13 aa, Entamoeba dispar
WNNETPKWEESKI

SEQ ID NO: 2470978 - protein, 8 aa, Entamoeba dispar
WNNGRAQG

SEQ ID NO: 2470979 - protein, 9 aa, Entamoeba dispar
WNPAKDKQA

SEQ ID NO: 2470980 - protein, 10 aa, Entamoeba dispar
WNPANDEQAM

SEQ ID NO: 2470981 - protein, 13 aa, Entamoeba dispar
WNPAPLQDHYRPD

SEQ ID NO: 2470982 - protein, 29 aa, Entamoeba dispar
WNPKGGIASAQTTPVVPKAEAPKEESKPV

SEQ ID NO: 2470983 - protein, 9 aa, Entamoeba dispar
WNPSPKTKY

SEQ ID NO: 2470984 - protein, 18 aa, Entamoeba dispar
WNPTVDSQAKERTLRIGQ

SEQ ID NO: 2470985 - protein, 7 aa, Entamoeba dispar
WNSESKI

SEQ ID NO: 2470986 - protein, 21 aa, Entamoeba dispar
WNSQETYNSNVRGKKGFNSTT

SEQ ID NO: 2470987 - protein, 12 aa, Entamoeba dispar
WNTASSVKQTNT

SEQ ID NO: 2470988 - protein, 14 aa, Entamoeba dispar
WNTGDEDYTEEDDV

SEQ ID NO: 2470989 - protein, 8 aa, Entamoeba dispar
WNVPQTQK

SEQ ID NO: 2470990 - protein, 13 aa, Entamoeba dispar
WNYPSYEQLWNSH

SEQ ID NO: 2470991 - protein, 11 aa, Entamoeba dispar
WPCRDTRTREV

SEQ ID NO: 2470992 - protein, 6 aa, Entamoeba dispar
WPEGKY

SEQ ID NO: 2470993 - protein, 5 aa, Entamoeba dispar
WPEKS

SEQ ID NO: 2470994 - protein, 6 aa, Entamoeba dispar
WPGVGS

SEQ ID NO: 2470995 - protein, 5 aa, Entamoeba dispar
WPSNE

SEQ ID NO: 2470996 - protein, 13 aa, Entamoeba dispar
WPYPSYETLWNAH

SEQ ID NO: 2470997 - protein, 13 aa, Entamoeba dispar
WPYPSYETLWNTH

SEQ ID NO: 2470998 - protein, 8 aa, Entamoeba dispar
WQQYSTQK

SEQ ID NO: 2470999 - protein, 10 aa, Entamoeba dispar
WQRKSNENLE

SEQ ID NO: 2471000 - protein, 6 aa, Entamoeba dispar
WRDKTN

SEQ ID NO: 2471001 - protein, 6 aa, Entamoeba dispar
WRDPPL

SEQ ID NO: 2471002 - protein, 5 aa, Entamoeba dispar
WRNSI

SEQ ID NO: 2471003 - protein, 8 aa, Entamoeba dispar
WRNSRNDV

SEQ ID NO: 2471004 - protein, 10 aa, Entamoeba dispar
WRSTNALPSP

SEQ ID NO: 2471005 - protein, 9 aa, Entamoeba dispar
WSDDESIKQ

SEQ ID NO: 2471006 - protein, 13 aa, Entamoeba dispar
WSDEKPANQSKGV

SEQ ID NO: 2471007 - protein, 9 aa, Entamoeba dispar
WSDSEREQI

SEQ ID NO: 2471008 - protein, 18 aa, Entamoeba dispar
WSEAHDKKLSGKDSLDEM

SEQ ID NO: 2471009 - protein, 18 aa, Entamoeba dispar
WSEISKKLSGRTARAVRN

SEQ ID NO: 2471010 - protein, 4 aa, Entamoeba dispar
WSER

SEQ ID NO: 2471011 - protein, 6 aa, Entamoeba dispar
WSETQT

SEQ ID NO: 2471012 - protein, 6 aa, Entamoeba dispar
WSGEGV

SEQ ID NO: 2471013 - protein, 11 aa, Entamoeba dispar
WSGQTDEDEIG

SEQ ID NO: 2471014 - protein, 7 aa, Entamoeba dispar
WSKEEDQ

SEQ ID NO: 2471015 - protein, 9 aa, Entamoeba dispar
WSLSDQTTF

SEQ ID NO: 2471016 - protein, 5 aa, Entamoeba dispar
WSNEV

SEQ ID NO: 2471017 - protein, 7 aa, Entamoeba dispar
WSNKRAE

SEQ ID NO: 2471018 - protein, 6 aa, Entamoeba dispar
WSPEGT

SEQ ID NO: 2471019 - protein, 7 aa, Entamoeba dispar
WSPKGER

SEQ ID NO: 2471020 - protein, 6 aa, Entamoeba dispar
WSPNEA

SEQ ID NO: 2471021 - protein, 5 aa, Entamoeba dispar
WSQTI

SEQ ID NO: 2471022 - protein, 5 aa, Entamoeba dispar
WSSKD

SEQ ID NO: 2471023 - protein, 4 aa, Entamoeba dispar
WSTE

SEQ ID NO: 2471024 - protein, 8 aa, Entamoeba dispar
WTEEEQNI

SEQ ID NO: 2471025 - protein, 8 aa, Entamoeba dispar
WTGDAKEG

SEQ ID NO: 2471026 - protein, 12 aa, Entamoeba dispar
WTGKKQCKEIYN

SEQ ID NO: 2471027 - protein, 6 aa, Entamoeba dispar
WTGKSQ

SEQ ID NO: 2471028 - protein, 10 aa, Entamoeba dispar
WTKKDKYERC

SEQ ID NO: 2471029 - protein, 12 aa, Entamoeba dispar
WTKPKPNDTEKD

SEQ ID NO: 2471030 - protein, 12 aa, Entamoeba dispar
WTKSDKTERSPN

SEQ ID NO: 2471031 - protein, 7 aa, Entamoeba dispar
WTKTKEA

SEQ ID NO: 2471032 - protein, 10 aa, Entamoeba dispar
WTNPSQEGFE

SEQ ID NO: 2471033 - protein, 5 aa, Entamoeba dispar
WTNST

SEQ ID NO: 2471034 - protein, 8 aa, Entamoeba dispar
WTQPSQLN

SEQ ID NO: 2471035 - protein, 8 aa, Entamoeba dispar
WTRSTTDN

SEQ ID NO: 2471036 - protein, 11 aa, Entamoeba dispar
WTSGKKGAQIV

SEQ ID NO: 2471037 - protein, 5 aa, Entamoeba dispar
WTSKQ

SEQ ID NO: 2471038 - protein, 8 aa, Entamoeba dispar
WTSKQESF

SEQ ID NO: 2471039 - protein, 12 aa, Entamoeba dispar
WTTSEKGKVGEE

SEQ ID NO: 2471040 - protein, 7 aa, Entamoeba dispar
YAAGSLK

SEQ ID NO: 2471041 - protein, 6 aa, Entamoeba dispar
YADDSQ

SEQ ID NO: 2471042 - protein, 9 aa, Entamoeba dispar
YADGDARNG

SEQ ID NO: 2471043 - protein, 7 aa, Entamoeba dispar
YADNQEG

SEQ ID NO: 2471044 - protein, 7 aa, Entamoeba dispar
YADNQPG

SEQ ID NO: 2471045 - protein, 6 aa, Entamoeba dispar
YAEADP

SEQ ID NO: 2471046 - protein, 8 aa, Entamoeba dispar
YAEAESVA

SEQ ID NO: 2471047 - protein, 10 aa, Entamoeba dispar
YAEGRQPPIG

SEQ ID NO: 2471048 - protein, 18 aa, Entamoeba dispar
YAEPYRPSRSVNASPILS

SEQ ID NO: 2471049 - protein, 9 aa, Entamoeba dispar
YAESKGSKN

SEQ ID NO: 2471050 - protein, 15 aa, Entamoeba dispar
YAESSYCPSETDIDQ

SEQ ID NO: 2471051 - protein, 17 aa, Entamoeba dispar
YAGAVEAAKKANSTRTW

SEQ ID NO: 2471052 - protein, 7 aa, Entamoeba dispar
YAGDSPL

SEQ ID NO: 2471053 - protein, 7 aa, Entamoeba dispar
YAGKGNL

SEQ ID NO: 2471054 - protein, 9 aa, Entamoeba dispar
YAKEQKGHK

SEQ ID NO: 2471055 - protein, 9 aa, Entamoeba dispar
YAKKNEDVA

SEQ ID NO: 2471056 - protein, 10 aa, Entamoeba dispar
YANNSDEKKV

SEQ ID NO: 2471057 - protein, 9 aa, Entamoeba dispar
YANPDECNS

SEQ ID NO: 2471058 - protein, 18 aa, Entamoeba dispar
YANRVNGGGYENTSVYKK

SEQ ID NO: 2471059 - protein, 11 aa, Entamoeba dispar
YANSLGKYGTS

SEQ ID NO: 2471060 - protein, 11 aa, Entamoeba dispar
YANSPYKKRAE

SEQ ID NO: 2471061 - protein, 15 aa, Entamoeba dispar
YAPKSMKEGKIDQYS

SEQ ID NO: 2471062 - protein, 8 aa, Entamoeba dispar
YAQDEPKN

SEQ ID NO: 2471063 - protein, 10 aa, Entamoeba dispar
YAQDEPKNTI

SEQ ID NO: 2471064 - protein, 15 aa, Entamoeba dispar
YAQRDETDKNTLIYM

SEQ ID NO: 2471065 - protein, 16 aa, Entamoeba dispar
YAQSKQKKNKNKNGEN

SEQ ID NO: 2471066 - protein, 9 aa, Entamoeba dispar
YARDLSRSI

SEQ ID NO: 2471067 - protein, 10 aa, Entamoeba dispar
YARKTTIGKF

SEQ ID NO: 2471068 - protein, 9 aa, Entamoeba dispar
YARNEEKTD

SEQ ID NO: 2471069 - protein, 9 aa, Entamoeba dispar
YARPTTTGM

SEQ ID NO: 2471070 - protein, 7 aa, Entamoeba dispar
YARRRKN

SEQ ID NO: 2471071 - protein, 32 aa, Entamoeba dispar
YASATGGSNVSVKKQPKKVQNSYTSTSSNVDW

SEQ ID NO: 2471072 - protein, 4 aa, Entamoeba dispar
YASE

SEQ ID NO: 2471073 - protein, 26 aa, Entamoeba dispar
YASETGIKLTKKNKKEKSSKKQGCKN

SEQ ID NO: 2471074 - protein, 7 aa, Entamoeba dispar
YASHGIG

SEQ ID NO: 2471075 - protein, 17 aa, Entamoeba dispar
YASNEEKRYYQNNKEEV

SEQ ID NO: 2471076 - protein, 6 aa, Entamoeba dispar
YASNPI

SEQ ID NO: 2471077 - protein, 8 aa, Entamoeba dispar
YASNRVKN

SEQ ID NO: 2471078 - protein, 5 aa, Entamoeba dispar
YASPC

SEQ ID NO: 2471079 - protein, 9 aa, Entamoeba dispar
YASQPDPRM

SEQ ID NO: 2471080 - protein, 6 aa, Entamoeba dispar
YASSEG

SEQ ID NO: 2471081 - protein, 9 aa, Entamoeba dispar
YASTDDQQA

SEQ ID NO: 2471082 - protein, 18 aa, Entamoeba dispar
YASTPRSSLDLNRNDIKK

SEQ ID NO: 2471083 - protein, 4 aa, Entamoeba dispar
YASV

SEQ ID NO: 2471084 - protein, 26 aa, Entamoeba dispar
YATESQPSIPPPQIPPQNQQLPSFQG

SEQ ID NO: 2471085 - protein, 32 aa, Entamoeba dispar
YATESQPSIPPPQIPPQNQQLPSFQGNIDTLS

SEQ ID NO: 2471086 - protein, 8 aa, Entamoeba dispar
YATNCKNC

SEQ ID NO: 2471087 - protein, 6 aa, Entamoeba dispar
YAVSGE

SEQ ID NO: 2471088 - protein, 10 aa, Entamoeba dispar
YAYKNEPNKI

SEQ ID NO: 2471089 - protein, 21 aa, Entamoeba dispar
YCDNDEEKIGTPLEDAQRRDF

SEQ ID NO: 2471090 - protein, 9 aa, Entamoeba dispar
YCEENNKNI

SEQ ID NO: 2471091 - protein, 9 aa, Entamoeba dispar
YCESDLSNS

SEQ ID NO: 2471092 - protein, 8 aa, Entamoeba dispar
YCQTTESN

SEQ ID NO: 2471093 - protein, 6 aa, Entamoeba dispar
YCSKGG

SEQ ID NO: 2471094 - protein, 10 aa, Entamoeba dispar
YCSSEDSIRK

SEQ ID NO: 2471095 - protein, 11 aa, Entamoeba dispar
YCTTRDNQTSA

SEQ ID NO: 2471096 - protein, 13 aa, Entamoeba dispar
YDASTDTELSIKR

SEQ ID NO: 2471097 - protein, 10 aa, Entamoeba dispar
YDATAEGDLT

SEQ ID NO: 2471098 - protein, 7 aa, Entamoeba dispar
YDATESL

SEQ ID NO: 2471099 - protein, 4 aa, Entamoeba dispar
YDDD

SEQ ID NO: 2471100 - protein, 12 aa, Entamoeba dispar
YDDEDNPPIPPG

SEQ ID NO: 2471101 - protein, 6 aa, Entamoeba dispar
YDDEQP

SEQ ID NO: 2471102 - protein, 4 aa, Entamoeba dispar
YDDF

SEQ ID NO: 2471103 - protein, 9 aa, Entamoeba dispar
YDDHPDASQ

SEQ ID NO: 2471104 - protein, 4 aa, Entamoeba dispar
YDDI

SEQ ID NO: 2471105 - protein, 7 aa, Entamoeba dispar
YDDKPHK

SEQ ID NO: 2471106 - protein, 7 aa, Entamoeba dispar
YDDMDEE

SEQ ID NO: 2471107 - protein, 5 aa, Entamoeba dispar
YDDNK

SEQ ID NO: 2471108 - protein, 10 aa, Entamoeba dispar
YDDPTGLGDD

SEQ ID NO: 2471109 - protein, 7 aa, Entamoeba dispar
YDDQEAT

SEQ ID NO: 2471110 - protein, 9 aa, Entamoeba dispar
YDDQPFDKE

SEQ ID NO: 2471111 - protein, 4 aa, Entamoeba dispar
YDDS

SEQ ID NO: 2471112 - protein, 39 aa, Entamoeba dispar
YDDSSKSVDGEQSSNNEIKPATEPIDLGSQNNKPEEKKC

SEQ ID NO: 2471113 - protein, 44 aa, Entamoeba dispar
YDDYNDCDDYDDEKIKHDDYDDEKRRKENRRNENTRREDGTDEI

SEQ ID NO: 2471114 - protein, 9 aa, Entamoeba dispar
YDEDDFPEF

SEQ ID NO: 2471115 - protein, 8 aa, Entamoeba dispar
YDEEFDDG

SEQ ID NO: 2471116 - protein, 8 aa, Entamoeba dispar
YDEELTGR

SEQ ID NO: 2471117 - protein, 6 aa, Entamoeba dispar
YDEEQN

SEQ ID NO: 2471118 - protein, 7 aa, Entamoeba dispar
YDEGKSV

SEQ ID NO: 2471119 - protein, 4 aa, Entamoeba dispar
YDEI

SEQ ID NO: 2471120 - protein, 4 aa, Entamoeba dispar
YDEK

SEQ ID NO: 2471121 - protein, 8 aa, Entamoeba dispar
YDEKSSYI

SEQ ID NO: 2471122 - protein, 4 aa, Entamoeba dispar
YDEQ

SEQ ID NO: 2471123 - protein, 33 aa, Entamoeba dispar
YDEQLDQENKQLKEPPLLPPKPKRLQKEEQLRQ

SEQ ID NO: 2471124 - protein, 26 aa, Entamoeba dispar
YDERKKLREEEEDRIEKRKLGKEELV

SEQ ID NO: 2471125 - protein, 8 aa, Entamoeba dispar
YDERREES

SEQ ID NO: 2471126 - protein, 6 aa, Entamoeba dispar
YDETAT

SEQ ID NO: 2471127 - protein, 8 aa, Entamoeba dispar
YDETGTVG

SEQ ID NO: 2471128 - protein, 5 aa, Entamoeba dispar
YDETP

SEQ ID NO: 2471129 - protein, 15 aa, Entamoeba dispar
YDEVEDANLLDNDET

SEQ ID NO: 2471130 - protein, 18 aa, Entamoeba dispar
YDEVENELERKQHQLDGL

SEQ ID NO: 2471131 - protein, 4 aa, Entamoeba dispar
YDEW

SEQ ID NO: 2471132 - protein, 9 aa, Entamoeba dispar
YDGASSDEV

SEQ ID NO: 2471133 - protein, 11 aa, Entamoeba dispar
YDGEPYMQSKT

SEQ ID NO: 2471134 - protein, 5 aa, Entamoeba dispar
YDGIR

SEQ ID NO: 2471135 - protein, 10 aa, Entamoeba dispar
YDGKGEGSSL

SEQ ID NO: 2471136 - protein, 8 aa, Entamoeba dispar
YDGNEISG

SEQ ID NO: 2471137 - protein, 10 aa, Entamoeba dispar
YDGSFKASEK

SEQ ID NO: 2471138 - protein, 5 aa, Entamoeba dispar
YDGSI

SEQ ID NO: 2471139 - protein, 8 aa, Entamoeba dispar
YDGSSKGF

SEQ ID NO: 2471140 - protein, 6 aa, Entamoeba dispar
YDGTED

SEQ ID NO: 2471141 - protein, 12 aa, Entamoeba dispar
YDGTYEDGRSTI

SEQ ID NO: 2471142 - protein, 40 aa, Entamoeba dispar
YDHSKEKTLTNPTKLQKQQNNTFTKYKQTKEECTTSNESY

SEQ ID NO: 2471143 - protein, 4 aa, Entamoeba dispar
YDIG

SEQ ID NO: 2471144 - protein, 6 aa, Entamoeba dispar
YDIKES

SEQ ID NO: 2471145 - protein, 5 aa, Entamoeba dispar
YDISS

SEQ ID NO: 2471146 - protein, 10 aa, Entamoeba dispar
YDKDEDVKDP

SEQ ID NO: 2471147 - protein, 10 aa, Entamoeba dispar
YDKDGTKNTV

SEQ ID NO: 2471148 - protein, 7 aa, Entamoeba dispar
YDKDGVR

SEQ ID NO: 2471149 - protein, 11 aa, Entamoeba dispar
YDKDTNKSKGY

SEQ ID NO: 2471150 - protein, 9 aa, Entamoeba dispar
YDKKKDKDA

SEQ ID NO: 2471151 - protein, 13 aa, Entamoeba dispar
YDKSGNQRFIINC

SEQ ID NO: 2471152 - protein, 9 aa, Entamoeba dispar
YDKSNSLSY

SEQ ID NO: 2471153 - protein, 9 aa, Entamoeba dispar
YDKSQTLIN

SEQ ID NO: 2471154 - protein, 7 aa, Entamoeba dispar
YDKTKKY

SEQ ID NO: 2471155 - protein, 13 aa, Entamoeba dispar
YDKTKSKNIPEKP

SEQ ID NO: 2471156 - protein, 11 aa, Entamoeba dispar
YDLKNKEHRQE

SEQ ID NO: 2471157 - protein, 14 aa, Entamoeba dispar
YDNARTTTENELKE

SEQ ID NO: 2471158 - protein, 6 aa, Entamoeba dispar
YDNDQG

SEQ ID NO: 2471159 - protein, 7 aa, Entamoeba dispar
YDNENEI

SEQ ID NO: 2471160 - protein, 6 aa, Entamoeba dispar
YDNGHC

SEQ ID NO: 2471161 - protein, 4 aa, Entamoeba dispar
YDNK

SEQ ID NO: 2471162 - protein, 9 aa, Entamoeba dispar
YDNKYQQEF

SEQ ID NO: 2471163 - protein, 11 aa, Entamoeba dispar
YDNNSDDIKRI

SEQ ID NO: 2471164 - protein, 7 aa, Entamoeba dispar
YDPAGDD

SEQ ID NO: 2471165 - protein, 7 aa, Entamoeba dispar
YDPDERI

SEQ ID NO: 2471166 - protein, 4 aa, Entamoeba dispar
YDPE

SEQ ID NO: 2471167 - protein, 8 aa, Entamoeba dispar
YDPGKGTK

SEQ ID NO: 2471168 - protein, 5 aa, Entamoeba dispar
YDPKE

SEQ ID NO: 2471169 - protein, 7 aa, Entamoeba dispar
YDPKEKA

SEQ ID NO: 2471170 - protein, 10 aa, Entamoeba dispar
YDPKISTSNI

SEQ ID NO: 2471171 - protein, 7 aa, Entamoeba dispar
YDPKNLY

SEQ ID NO: 2471172 - protein, 6 aa, Entamoeba dispar
YDPKTL

SEQ ID NO: 2471173 - protein, 4 aa, Entamoeba dispar
YDPM

SEQ ID NO: 2471174 - protein, 21 aa, Entamoeba dispar
YDPNETRNSTIESPDGSATHT

SEQ ID NO: 2471175 - protein, 8 aa, Entamoeba dispar
YDPNTYLD

SEQ ID NO: 2471176 - protein, 7 aa, Entamoeba dispar
YDPSKRM

SEQ ID NO: 2471177 - protein, 5 aa, Entamoeba dispar
YDPTV

SEQ ID NO: 2471178 - protein, 7 aa, Entamoeba dispar
YDQDELA

SEQ ID NO: 2471179 - protein, 9 aa, Entamoeba dispar
YDQDSKQRT

SEQ ID NO: 2471180 - protein, 8 aa, Entamoeba dispar
YDQENAQH

SEQ ID NO: 2471181 - protein, 7 aa, Entamoeba dispar
YDQKTDT

SEQ ID NO: 2471182 - protein, 4 aa, Entamoeba dispar
YDQN

SEQ ID NO: 2471183 - protein, 8 aa, Entamoeba dispar
YDQNAKKI

SEQ ID NO: 2471184 - protein, 8 aa, Entamoeba dispar
YDQNTSSD

SEQ ID NO: 2471185 - protein, 15 aa, Entamoeba dispar
YDQPLGDSYTNSTLQ

SEQ ID NO: 2471186 - protein, 8 aa, Entamoeba dispar
YDQSQQHD

SEQ ID NO: 2471187 - protein, 13 aa, Entamoeba dispar
YDQTGFAGTYDKN

SEQ ID NO: 2471188 - protein, 35 aa, Entamoeba dispar
YDRCNQRHSQSQKRQSSIQIKPNKSLPSSKKTEKI

SEQ ID NO: 2471189 - protein, 13 aa, Entamoeba dispar
YDRFSKRNGDQIT

SEQ ID NO: 2471190 - protein, 16 aa, Entamoeba dispar
YDRKSYGNTIPSEVKS

SEQ ID NO: 2471191 - protein, 13 aa, Entamoeba dispar
YDRRNDRDQRYSR

SEQ ID NO: 2471192 - protein, 12 aa, Entamoeba dispar
YDSDDEKEDDLD

SEQ ID NO: 2471193 - protein, 30 aa, Entamoeba dispar
YDSEEEYEKMSEDYDERNSEEEDVPRTREG

SEQ ID NO: 2471194 - protein, 5 aa, Entamoeba dispar
YDSEH

SEQ ID NO: 2471195 - protein, 4 aa, Entamoeba dispar
YDSG

SEQ ID NO: 2471196 - protein, 10 aa, Entamoeba dispar
YDSGKNLREE

SEQ ID NO: 2471197 - protein, 6 aa, Entamoeba dispar
YDSIKA

SEQ ID NO: 2471198 - protein, 8 aa, Entamoeba dispar
YDSKGEEY

SEQ ID NO: 2471199 - protein, 8 aa, Entamoeba dispar
YDSKLTRT

SEQ ID NO: 2471200 - protein, 6 aa, Entamoeba dispar
YDSNTQ

SEQ ID NO: 2471201 - protein, 8 aa, Entamoeba dispar
YDSPDSMM

SEQ ID NO: 2471202 - protein, 20 aa, Entamoeba dispar
YDSPKGKAFAKPYGQGDTVG

SEQ ID NO: 2471203 - protein, 7 aa, Entamoeba dispar
YDSSEQN

SEQ ID NO: 2471204 - protein, 6 aa, Entamoeba dispar
YDSSQN

SEQ ID NO: 2471205 - protein, 8 aa, Entamoeba dispar
YDSTKDKS

SEQ ID NO: 2471206 - protein, 7 aa, Entamoeba dispar
YDSVNGA

SEQ ID NO: 2471207 - protein, 12 aa, Entamoeba dispar
YDTENKHEKEYE

SEQ ID NO: 2471208 - protein, 10 aa, Entamoeba dispar
YDTKVRKTQN

SEQ ID NO: 2471209 - protein, 8 aa, Entamoeba dispar
YDTNRDID

SEQ ID NO: 2471210 - protein, 10 aa, Entamoeba dispar
YDTNRQIQNS

SEQ ID NO: 2471211 - protein, 7 aa, Entamoeba dispar
YDTPEGL

SEQ ID NO: 2471212 - protein, 5 aa, Entamoeba dispar
YDTPL

SEQ ID NO: 2471213 - protein, 4 aa, Entamoeba dispar
YDVS

SEQ ID NO: 2471214 - protein, 12 aa, Entamoeba dispar
YDVSTPKTFNAP

SEQ ID NO: 2471215 - protein, 9 aa, Entamoeba dispar
YDYESTRSE

SEQ ID NO: 2471216 - protein, 4 aa, Entamoeba dispar
YDYG

SEQ ID NO: 2471217 - protein, 4 aa, Entamoeba dispar
YDYQ

SEQ ID NO: 2471218 - protein, 6 aa, Entamoeba dispar
YEAKEE

SEQ ID NO: 2471219 - protein, 5 aa, Entamoeba dispar
YEAPK

SEQ ID NO: 2471220 - protein, 9 aa, Entamoeba dispar
YEAPPTVLS

SEQ ID NO: 2471221 - protein, 48 aa, Entamoeba dispar
YEDAGEYEEGGDDEYEKEEDDEYEYEEESDDESEEYESGEEDEDQLEY

SEQ ID NO: 2471222 - protein, 137 aa, Entamoeba dispar
YEDAKKEDKKEELKKEEDKKEEDKKEEDKKEEDKKEEDKKEEDKKEEDKKEEANEQNKEESNEDKKEEEKESSESSSSLTPTSESEKKEVTEEPKQEEPKQEEPKQEEQATEGNESDKKESSSSSSIKEDQKQQPLV

SEQ ID NO: 2471223 - protein, 8 aa, Entamoeba dispar
YEDDLEDV

SEQ ID NO: 2471224 - protein, 4 aa, Entamoeba dispar
YEDE

SEQ ID NO: 2471225 - protein, 9 aa, Entamoeba dispar
YEDEKNTLQ

SEQ ID NO: 2471226 - protein, 11 aa, Entamoeba dispar
YEDEQITETRS

SEQ ID NO: 2471227 - protein, 11 aa, Entamoeba dispar
YEDGDDDMKRT

SEQ ID NO: 2471228 - protein, 10 aa, Entamoeba dispar
YEDKQLKQSP

SEQ ID NO: 2471229 - protein, 7 aa, Entamoeba dispar
YEDRTKS

SEQ ID NO: 2471230 - protein, 5 aa, Entamoeba dispar
YEDSS

SEQ ID NO: 2471231 - protein, 9 aa, Entamoeba dispar
YEDTDTLEN

SEQ ID NO: 2471232 - protein, 33 aa, Entamoeba dispar
YEDTTHETKMEEEEEEKHKEHIDEGLEEAQENQ

SEQ ID NO: 2471233 - protein, 11 aa, Entamoeba dispar
YEEDNEEDIPN

SEQ ID NO: 2471234 - protein, 9 aa, Entamoeba dispar
YEEDPDYGP

SEQ ID NO: 2471235 - protein, 10 aa, Entamoeba dispar
YEEDRDYGSI

SEQ ID NO: 2471236 - protein, 14 aa, Entamoeba dispar
YEEEDKEEYGEKIE

SEQ ID NO: 2471237 - protein, 9 aa, Entamoeba dispar
YEEENQNAV

SEQ ID NO: 2471238 - protein, 13 aa, Entamoeba dispar
YEEEQRSHTKTIE

SEQ ID NO: 2471239 - protein, 9 aa, Entamoeba dispar
YEEGARKGY

SEQ ID NO: 2471240 - protein, 8 aa, Entamoeba dispar
YEEGEELA

SEQ ID NO: 2471241 - protein, 20 aa, Entamoeba dispar
YEEGIQKEEEEKRKEEEEAE

SEQ ID NO: 2471242 - protein, 6 aa, Entamoeba dispar
YEEGTN

SEQ ID NO: 2471243 - protein, 9 aa, Entamoeba dispar
YEEKNNKEF

SEQ ID NO: 2471244 - protein, 8 aa, Entamoeba dispar
YEEKTKMG

SEQ ID NO: 2471245 - protein, 16 aa, Entamoeba dispar
YEEKTNKLIISIGKDK

SEQ ID NO: 2471246 - protein, 8 aa, Entamoeba dispar
YEENEDKL

SEQ ID NO: 2471247 - protein, 17 aa, Entamoeba dispar
YEENEIVEPSSIQRESE

SEQ ID NO: 2471248 - protein, 18 aa, Entamoeba dispar
YEENKRLKQQVNKIKQTQ

SEQ ID NO: 2471249 - protein, 6 aa, Entamoeba dispar
YEENQN

SEQ ID NO: 2471250 - protein, 11 aa, Entamoeba dispar
YEEPSQGEQVI

SEQ ID NO: 2471251 - protein, 8 aa, Entamoeba dispar
YEEQISRL

SEQ ID NO: 2471252 - protein, 10 aa, Entamoeba dispar
YEEQQSTIQQ

SEQ ID NO: 2471253 - protein, 9 aa, Entamoeba dispar
YEEQRKEAE

SEQ ID NO: 2471254 - protein, 11 aa, Entamoeba dispar
YEEQRKEDGMK

SEQ ID NO: 2471255 - protein, 10 aa, Entamoeba dispar
YEEQRNNNIQ

SEQ ID NO: 2471256 - protein, 8 aa, Entamoeba dispar
YEERANWD

SEQ ID NO: 2471257 - protein, 6 aa, Entamoeba dispar
YEERDD

SEQ ID NO: 2471258 - protein, 9 aa, Entamoeba dispar
YEESTKDLV

SEQ ID NO: 2471259 - protein, 10 aa, Entamoeba dispar
YEETHEKVKP

SEQ ID NO: 2471260 - protein, 7 aa, Entamoeba dispar
YEEYSND

SEQ ID NO: 2471261 - protein, 13 aa, Entamoeba dispar
YEFGGKGHKEQYE

SEQ ID NO: 2471262 - protein, 8 aa, Entamoeba dispar
YEGAKQPI

SEQ ID NO: 2471263 - protein, 7 aa, Entamoeba dispar
YEGDPCD

SEQ ID NO: 2471264 - protein, 7 aa, Entamoeba dispar
YEGGDVE

SEQ ID NO: 2471265 - protein, 12 aa, Entamoeba dispar
YEGGNEDNEVET

SEQ ID NO: 2471266 - protein, 13 aa, Entamoeba dispar
YEGKNEKGGSTRY

SEQ ID NO: 2471267 - protein, 7 aa, Entamoeba dispar
YEGKSEL

SEQ ID NO: 2471268 - protein, 23 aa, Entamoeba dispar
YEGNASQKQNQLLSSSSTVQQQV

SEQ ID NO: 2471269 - protein, 11 aa, Entamoeba dispar
YEGNATATPSF

SEQ ID NO: 2471270 - protein, 10 aa, Entamoeba dispar
YEGNEEEMKN

SEQ ID NO: 2471271 - protein, 5 aa, Entamoeba dispar
YEGNN

SEQ ID NO: 2471272 - protein, 14 aa, Entamoeba dispar
YEGPEEDDDMKDST

SEQ ID NO: 2471273 - protein, 18 aa, Entamoeba dispar
YEGTPDEQATNFREQGNE

SEQ ID NO: 2471274 - protein, 20 aa, Entamoeba dispar
YEHNEENETNPEQKETDVTK

SEQ ID NO: 2471275 - protein, 4 aa, Entamoeba dispar
YEHS

SEQ ID NO: 2471276 - protein, 4 aa, Entamoeba dispar
YEHT

SEQ ID NO: 2471277 - protein, 8 aa, Entamoeba dispar
YEIDGKTK

SEQ ID NO: 2471278 - protein, 19 aa, Entamoeba dispar
YEIKEDDKKRSTEIKDIED

SEQ ID NO: 2471279 - protein, 6 aa, Entamoeba dispar
YEKAQK

SEQ ID NO: 2471280 - protein, 4 aa, Entamoeba dispar
YEKD

SEQ ID NO: 2471281 - protein, 15 aa, Entamoeba dispar
YEKDAEEIKKTNELI

SEQ ID NO: 2471282 - protein, 5 aa, Entamoeba dispar
YEKEG

SEQ ID NO: 2471283 - protein, 9 aa, Entamoeba dispar
YEKEGSLNE

SEQ ID NO: 2471284 - protein, 12 aa, Entamoeba dispar
YEKEKGGSEEMK

SEQ ID NO: 2471285 - protein, 6 aa, Entamoeba dispar
YEKEKT

SEQ ID NO: 2471286 - protein, 5 aa, Entamoeba dispar
YEKEQ

SEQ ID NO: 2471287 - protein, 10 aa, Entamoeba dispar
YEKKEIKEEN

SEQ ID NO: 2471288 - protein, 10 aa, Entamoeba dispar
YEKNKQSPPL

SEQ ID NO: 2471289 - protein, 13 aa, Entamoeba dispar
YEKNNEKIKQNDD

SEQ ID NO: 2471290 - protein, 9 aa, Entamoeba dispar
YEKNSPDNI

SEQ ID NO: 2471291 - protein, 7 aa, Entamoeba dispar
YEKPKRR

SEQ ID NO: 2471292 - protein, 10 aa, Entamoeba dispar
YEKPSPVQRQ

SEQ ID NO: 2471293 - protein, 12 aa, Entamoeba dispar
YEKQKTEEPPKT

SEQ ID NO: 2471294 - protein, 9 aa, Entamoeba dispar
YEKQQSIKS

SEQ ID NO: 2471295 - protein, 9 aa, Entamoeba dispar
YEKTKKDCD

SEQ ID NO: 2471296 - protein, 7 aa, Entamoeba dispar
YEKTKRP

SEQ ID NO: 2471297 - protein, 11 aa, Entamoeba dispar
YELKDQESPFK

SEQ ID NO: 2471298 - protein, 8 aa, Entamoeba dispar
YELPTNPV

SEQ ID NO: 2471299 - protein, 5 aa, Entamoeba dispar
YEMGG

SEQ ID NO: 2471300 - protein, 11 aa, Entamoeba dispar
YEMKNTGQGYH

SEQ ID NO: 2471301 - protein, 5 aa, Entamoeba dispar
YEMSK

SEQ ID NO: 2471302 - protein, 9 aa, Entamoeba dispar
YENDQHNTI

SEQ ID NO: 2471303 - protein, 4 aa, Entamoeba dispar
YENE

SEQ ID NO: 2471304 - protein, 13 aa, Entamoeba dispar
YENEPRGDGAVDL

SEQ ID NO: 2471305 - protein, 5 aa, Entamoeba dispar
YENEQ

SEQ ID NO: 2471306 - protein, 9 aa, Entamoeba dispar
YENETLPNS

SEQ ID NO: 2471307 - protein, 8 aa, Entamoeba dispar
YENNARNE

SEQ ID NO: 2471308 - protein, 13 aa, Entamoeba dispar
YENNDRKKQEDAR

SEQ ID NO: 2471309 - protein, 12 aa, Entamoeba dispar
YENNQEDNGFSM

SEQ ID NO: 2471310 - protein, 6 aa, Entamoeba dispar
YENSNL

SEQ ID NO: 2471311 - protein, 14 aa, Entamoeba dispar
YENSRLKDDLEQVQ

SEQ ID NO: 2471312 - protein, 12 aa, Entamoeba dispar
YENTKENEESVK

SEQ ID NO: 2471313 - protein, 11 aa, Entamoeba dispar
YENTYASPEPF

SEQ ID NO: 2471314 - protein, 15 aa, Entamoeba dispar
YENYSNDSHKSNSIE

SEQ ID NO: 2471315 - protein, 10 aa, Entamoeba dispar
YEPESTDPME

SEQ ID NO: 2471316 - protein, 5 aa, Entamoeba dispar
YEPKE

SEQ ID NO: 2471317 - protein, 8 aa, Entamoeba dispar
YEPKNRPL

SEQ ID NO: 2471318 - protein, 13 aa, Entamoeba dispar
YEPLGNKTKQRYR

SEQ ID NO: 2471319 - protein, 10 aa, Entamoeba dispar
YEPNSSYFKT

SEQ ID NO: 2471320 - protein, 9 aa, Entamoeba dispar
YEPQQASDL

SEQ ID NO: 2471321 - protein, 7 aa, Entamoeba dispar
YEPSERI

SEQ ID NO: 2471322 - protein, 9 aa, Entamoeba dispar
YEPSTDSLE

SEQ ID NO: 2471323 - protein, 11 aa, Entamoeba dispar
YEQDHNPKLEK

SEQ ID NO: 2471324 - protein, 5 aa, Entamoeba dispar
YEQEE

SEQ ID NO: 2471325 - protein, 5 aa, Entamoeba dispar
YEQEL

SEQ ID NO: 2471326 - protein, 5 aa, Entamoeba dispar
YEQEP

SEQ ID NO: 2471327 - protein, 8 aa, Entamoeba dispar
YEQGSNSQ

SEQ ID NO: 2471328 - protein, 6 aa, Entamoeba dispar
YEQKEH

SEQ ID NO: 2471329 - protein, 11 aa, Entamoeba dispar
YEQKELESNTQ

SEQ ID NO: 2471330 - protein, 16 aa, Entamoeba dispar
YEQKRLSSKEHEQITR

SEQ ID NO: 2471331 - protein, 4 aa, Entamoeba dispar
YEQM

SEQ ID NO: 2471332 - protein, 10 aa, Entamoeba dispar
YEQNSKQTKD

SEQ ID NO: 2471333 - protein, 12 aa, Entamoeba dispar
YEQTNQQGEKIT

SEQ ID NO: 2471334 - protein, 6 aa, Entamoeba dispar
YEQTSE

SEQ ID NO: 2471335 - protein, 9 aa, Entamoeba dispar
YERAQTVED

SEQ ID NO: 2471336 - protein, 7 aa, Entamoeba dispar
YERNPKF

SEQ ID NO: 2471337 - protein, 7 aa, Entamoeba dispar
YERRNTM

SEQ ID NO: 2471338 - protein, 4 aa, Entamoeba dispar
YERT

SEQ ID NO: 2471339 - protein, 10 aa, Entamoeba dispar
YESDDKEVSA

SEQ ID NO: 2471340 - protein, 10 aa, Entamoeba dispar
YESDRIQSIE

SEQ ID NO: 2471341 - protein, 31 aa, Entamoeba dispar
YESIENKKEDKIKEIEESEDNDKTEKEEGEW

SEQ ID NO: 2471342 - protein, 12 aa, Entamoeba dispar
YESISTKQLQPV

SEQ ID NO: 2471343 - protein, 9 aa, Entamoeba dispar
YESNQYSLD

SEQ ID NO: 2471344 - protein, 8 aa, Entamoeba dispar
YESNYYSR

SEQ ID NO: 2471345 - protein, 12 aa, Entamoeba dispar
YESQKSYKESEI

SEQ ID NO: 2471346 - protein, 4 aa, Entamoeba dispar
YESR

SEQ ID NO: 2471347 - protein, 10 aa, Entamoeba dispar
YESSENTDMD

SEQ ID NO: 2471348 - protein, 7 aa, Entamoeba dispar
YESSKET

SEQ ID NO: 2471349 - protein, 10 aa, Entamoeba dispar
YESTSSDPME

SEQ ID NO: 2471350 - protein, 6 aa, Entamoeba dispar
YESYRS

SEQ ID NO: 2471351 - protein, 20 aa, Entamoeba dispar
YESYTNDTAAFRSSRNYPPK

SEQ ID NO: 2471352 - protein, 16 aa, Entamoeba dispar
YETDFGEDDTGSFSDD

SEQ ID NO: 2471353 - protein, 10 aa, Entamoeba dispar
YETDTEDDQV

SEQ ID NO: 2471354 - protein, 11 aa, Entamoeba dispar
YETEDTSYHSL

SEQ ID NO: 2471355 - protein, 6 aa, Entamoeba dispar
YETEKK

SEQ ID NO: 2471356 - protein, 10 aa, Entamoeba dispar
YETGDKANDV

SEQ ID NO: 2471357 - protein, 6 aa, Entamoeba dispar
YETGPL

SEQ ID NO: 2471358 - protein, 9 aa, Entamoeba dispar
YETKEELEK

SEQ ID NO: 2471359 - protein, 5 aa, Entamoeba dispar
YETKT

SEQ ID NO: 2471360 - protein, 7 aa, Entamoeba dispar
YETKTPI

SEQ ID NO: 2471361 - protein, 14 aa, Entamoeba dispar
YETNESGSKVTITT

SEQ ID NO: 2471362 - protein, 18 aa, Entamoeba dispar
YETNGKTLTEISEGKKIK

SEQ ID NO: 2471363 - protein, 6 aa, Entamoeba dispar
YETPSF

SEQ ID NO: 2471364 - protein, 16 aa, Entamoeba dispar
YETQEMEEEDDDETIE

SEQ ID NO: 2471365 - protein, 25 aa, Entamoeba dispar
YETQHAMDREKKNAMSEESSSEAEL

SEQ ID NO: 2471366 - protein, 10 aa, Entamoeba dispar
YETSTQYTSA

SEQ ID NO: 2471367 - protein, 5 aa, Entamoeba dispar
YETTH

SEQ ID NO: 2471368 - protein, 5 aa, Entamoeba dispar
YETTI

SEQ ID NO: 2471369 - protein, 15 aa, Entamoeba dispar
YEVKGDLAKTAKRQR

SEQ ID NO: 2471370 - protein, 4 aa, Entamoeba dispar
YEVQ

SEQ ID NO: 2471371 - protein, 21 aa, Entamoeba dispar
YEYEDEEYEDEVEEEEEEEYE

SEQ ID NO: 2471372 - protein, 13 aa, Entamoeba dispar
YEYEEGKKRVEES

SEQ ID NO: 2471373 - protein, 6 aa, Entamoeba dispar
YEYEKS

SEQ ID NO: 2471374 - protein, 5 aa, Entamoeba dispar
YEYPE

SEQ ID NO: 2471375 - protein, 15 aa, Entamoeba dispar
YFATPTRTVSFVTRQ

SEQ ID NO: 2471376 - protein, 5 aa, Entamoeba dispar
YFDGS

SEQ ID NO: 2471377 - protein, 8 aa, Entamoeba dispar
YFEKQDTL

SEQ ID NO: 2471378 - protein, 14 aa, Entamoeba dispar
YFESDGQPSLNNGN

SEQ ID NO: 2471379 - protein, 7 aa, Entamoeba dispar
YFNPQPG

SEQ ID NO: 2471380 - protein, 18 aa, Entamoeba dispar
YFPDKKKRSSEGEEPEIK

SEQ ID NO: 2471381 - protein, 12 aa, Entamoeba dispar
YFPDQQELTPKQ

SEQ ID NO: 2471382 - protein, 5 aa, Entamoeba dispar
YFTDK

SEQ ID NO: 2471383 - protein, 5 aa, Entamoeba dispar
YGAKY

SEQ ID NO: 2471384 - protein, 21 aa, Entamoeba dispar
YGAPIKQKPQLPNKASKLNAT

SEQ ID NO: 2471385 - protein, 9 aa, Entamoeba dispar
YGCTEDNKC

SEQ ID NO: 2471386 - protein, 7 aa, Entamoeba dispar
YGDASQL

SEQ ID NO: 2471387 - protein, 15 aa, Entamoeba dispar
YGDEKSLPDDPYDGR

SEQ ID NO: 2471388 - protein, 25 aa, Entamoeba dispar
YGDEKSLPDDPYDGRRVMVISDHAT

SEQ ID NO: 2471389 - protein, 20 aa, Entamoeba dispar
YGDESKQENVRDIAKSFVSR

SEQ ID NO: 2471390 - protein, 7 aa, Entamoeba dispar
YGDETRM

SEQ ID NO: 2471391 - protein, 12 aa, Entamoeba dispar
YGDSPSKTFSDT

SEQ ID NO: 2471392 - protein, 5 aa, Entamoeba dispar
YGDTD

SEQ ID NO: 2471393 - protein, 9 aa, Entamoeba dispar
YGECGKRGG

SEQ ID NO: 2471394 - protein, 10 aa, Entamoeba dispar
YGECGKRGGY

SEQ ID NO: 2471395 - protein, 4 aa, Entamoeba dispar
YGEG

SEQ ID NO: 2471396 - protein, 15 aa, Entamoeba dispar
YGEGASTASTSLKYF

SEQ ID NO: 2471397 - protein, 5 aa, Entamoeba dispar
YGEHP

SEQ ID NO: 2471398 - protein, 6 aa, Entamoeba dispar
YGEIEG

SEQ ID NO: 2471399 - protein, 5 aa, Entamoeba dispar
YGENG

SEQ ID NO: 2471400 - protein, 9 aa, Entamoeba dispar
YGENRTSED

SEQ ID NO: 2471401 - protein, 4 aa, Entamoeba dispar
YGEQ

SEQ ID NO: 2471402 - protein, 9 aa, Entamoeba dispar
YGEQQGKKI

SEQ ID NO: 2471403 - protein, 6 aa, Entamoeba dispar
YGERGM

SEQ ID NO: 2471404 - protein, 11 aa, Entamoeba dispar
YGESIPPESSV

SEQ ID NO: 2471405 - protein, 7 aa, Entamoeba dispar
YGETDDP

SEQ ID NO: 2471406 - protein, 5 aa, Entamoeba dispar
YGETS

SEQ ID NO: 2471407 - protein, 13 aa, Entamoeba dispar
YGETSPPKPLTEP

SEQ ID NO: 2471408 - protein, 8 aa, Entamoeba dispar
YGEYNEDI

SEQ ID NO: 2471409 - protein, 10 aa, Entamoeba dispar
YGEYYQGRGT

SEQ ID NO: 2471410 - protein, 8 aa, Entamoeba dispar
YGGADGRA

SEQ ID NO: 2471411 - protein, 7 aa, Entamoeba dispar
YGGAKGF

SEQ ID NO: 2471412 - protein, 10 aa, Entamoeba dispar
YGGAKGLVNR

SEQ ID NO: 2471413 - protein, 4 aa, Entamoeba dispar
YGGF

SEQ ID NO: 2471414 - protein, 10 aa, Entamoeba dispar
YGGGEKEKHI

SEQ ID NO: 2471415 - protein, 5 aa, Entamoeba dispar
YGGKL

SEQ ID NO: 2471416 - protein, 8 aa, Entamoeba dispar
YGGRKTEE

SEQ ID NO: 2471417 - protein, 15 aa, Entamoeba dispar
YGGRNMTSENKKHYI

SEQ ID NO: 2471418 - protein, 13 aa, Entamoeba dispar
YGIKNNSKIEEIK

SEQ ID NO: 2471419 - protein, 4 aa, Entamoeba dispar
YGIN

SEQ ID NO: 2471420 - protein, 7 aa, Entamoeba dispar
YGKCAKK

SEQ ID NO: 2471421 - protein, 10 aa, Entamoeba dispar
YGKDATNEKI

SEQ ID NO: 2471422 - protein, 9 aa, Entamoeba dispar
YGKEDEPFT

SEQ ID NO: 2471423 - protein, 6 aa, Entamoeba dispar
YGKEDH

SEQ ID NO: 2471424 - protein, 13 aa, Entamoeba dispar
YGKEGLEKGGMGG

SEQ ID NO: 2471425 - protein, 6 aa, Entamoeba dispar
YGKEVP

SEQ ID NO: 2471426 - protein, 8 aa, Entamoeba dispar
YGKGVAGL

SEQ ID NO: 2471427 - protein, 10 aa, Entamoeba dispar
YGKKDKALGC

SEQ ID NO: 2471428 - protein, 9 aa, Entamoeba dispar
YGKKQGTRY

SEQ ID NO: 2471429 - protein, 8 aa, Entamoeba dispar
YGKKYEEN

SEQ ID NO: 2471430 - protein, 4 aa, Entamoeba dispar
YGKN

SEQ ID NO: 2471431 - protein, 7 aa, Entamoeba dispar
YGKNGKY

SEQ ID NO: 2471432 - protein, 13 aa, Entamoeba dispar
YGKPGKKVQKEYT

SEQ ID NO: 2471433 - protein, 7 aa, Entamoeba dispar
YGKPIDD

SEQ ID NO: 2471434 - protein, 11 aa, Entamoeba dispar
YGKPNKPSKGI

SEQ ID NO: 2471435 - protein, 4 aa, Entamoeba dispar
YGKR

SEQ ID NO: 2471436 - protein, 6 aa, Entamoeba dispar
YGKRNN

SEQ ID NO: 2471437 - protein, 5 aa, Entamoeba dispar
YGKRT

SEQ ID NO: 2471438 - protein, 10 aa, Entamoeba dispar
YGKSSKETKL

SEQ ID NO: 2471439 - protein, 8 aa, Entamoeba dispar
YGKSSQCQ

SEQ ID NO: 2471440 - protein, 4 aa, Entamoeba dispar
YGKT

SEQ ID NO: 2471441 - protein, 6 aa, Entamoeba dispar
YGKTAR

SEQ ID NO: 2471442 - protein, 6 aa, Entamoeba dispar
YGKTID

SEQ ID NO: 2471443 - protein, 6 aa, Entamoeba dispar
YGKTPV

SEQ ID NO: 2471444 - protein, 4 aa, Entamoeba dispar
YGLF

SEQ ID NO: 2471445 - protein, 6 aa, Entamoeba dispar
YGLNDD

SEQ ID NO: 2471446 - protein, 10 aa, Entamoeba dispar
YGLNSEEALN

SEQ ID NO: 2471447 - protein, 8 aa, Entamoeba dispar
YGLPPKYD

SEQ ID NO: 2471448 - protein, 9 aa, Entamoeba dispar
YGMGTSDEL

SEQ ID NO: 2471449 - protein, 8 aa, Entamoeba dispar
YGNEIKTG

SEQ ID NO: 2471450 - protein, 20 aa, Entamoeba dispar
YGNEKEVGDGIKSAIEKGYV

SEQ ID NO: 2471451 - protein, 5 aa, Entamoeba dispar
YGNGC

SEQ ID NO: 2471452 - protein, 9 aa, Entamoeba dispar
YGNKVGQTN

SEQ ID NO: 2471453 - protein, 4 aa, Entamoeba dispar
YGNT

SEQ ID NO: 2471454 - protein, 5 aa, Entamoeba dispar
YGPDP

SEQ ID NO: 2471455 - protein, 12 aa, Entamoeba dispar
YGPNDSDENGKT

SEQ ID NO: 2471456 - protein, 5 aa, Entamoeba dispar
YGPNG

SEQ ID NO: 2471457 - protein, 6 aa, Entamoeba dispar
YGPPKA

SEQ ID NO: 2471458 - protein, 9 aa, Entamoeba dispar
YGQDRTFQI

SEQ ID NO: 2471459 - protein, 7 aa, Entamoeba dispar
YGQPPSR

SEQ ID NO: 2471460 - protein, 8 aa, Entamoeba dispar
YGQTSHQI

SEQ ID NO: 2471461 - protein, 5 aa, Entamoeba dispar
YGREL

SEQ ID NO: 2471462 - protein, 7 aa, Entamoeba dispar
YGRESQI

SEQ ID NO: 2471463 - protein, 12 aa, Entamoeba dispar
YGRGTSDMKGGN

SEQ ID NO: 2471464 - protein, 15 aa, Entamoeba dispar
YGRITSSSANGNSKV

SEQ ID NO: 2471465 - protein, 10 aa, Entamoeba dispar
YGRQDPKQQL

SEQ ID NO: 2471466 - protein, 10 aa, Entamoeba dispar
YGRSDENTRS

SEQ ID NO: 2471467 - protein, 13 aa, Entamoeba dispar
YGRSVRTSKYPSL

SEQ ID NO: 2471468 - protein, 11 aa, Entamoeba dispar
YGRTDKKEEKG

SEQ ID NO: 2471469 - protein, 32 aa, Entamoeba dispar
YGRTSSTEKSSTTHLHSNENVKYQQKERTLNK

SEQ ID NO: 2471470 - protein, 4 aa, Entamoeba dispar
YGSC

SEQ ID NO: 2471471 - protein, 8 aa, Entamoeba dispar
YGSEEGSY

SEQ ID NO: 2471472 - protein, 8 aa, Entamoeba dispar
YGSEIQSG

SEQ ID NO: 2471473 - protein, 4 aa, Entamoeba dispar
YGSG

SEQ ID NO: 2471474 - protein, 5 aa, Entamoeba dispar
YGSHD

SEQ ID NO: 2471475 - protein, 4 aa, Entamoeba dispar
YGSI

SEQ ID NO: 2471476 - protein, 5 aa, Entamoeba dispar
YGSPI

SEQ ID NO: 2471477 - protein, 14 aa, Entamoeba dispar
YGSPQVEYKKRREY

SEQ ID NO: 2471478 - protein, 4 aa, Entamoeba dispar
YGSQ

SEQ ID NO: 2471479 - protein, 7 aa, Entamoeba dispar
YGSTETF

SEQ ID NO: 2471480 - protein, 4 aa, Entamoeba dispar
YGSY

SEQ ID NO: 2471481 - protein, 6 aa, Entamoeba dispar
YGTANS

SEQ ID NO: 2471482 - protein, 7 aa, Entamoeba dispar
YGTEPEH

SEQ ID NO: 2471483 - protein, 5 aa, Entamoeba dispar
YGTEQ

SEQ ID NO: 2471484 - protein, 6 aa, Entamoeba dispar
YGTGKG

SEQ ID NO: 2471485 - protein, 6 aa, Entamoeba dispar
YGTKGY

SEQ ID NO: 2471486 - protein, 11 aa, Entamoeba dispar
YGTMGTDGVEL

SEQ ID NO: 2471487 - protein, 8 aa, Entamoeba dispar
YGTPLESL

SEQ ID NO: 2471488 - protein, 8 aa, Entamoeba dispar
YGTPPKGV

SEQ ID NO: 2471489 - protein, 7 aa, Entamoeba dispar
YGTRYGA

SEQ ID NO: 2471490 - protein, 7 aa, Entamoeba dispar
YGVRGDS

SEQ ID NO: 2471491 - protein, 4 aa, Entamoeba dispar
YGVT

SEQ ID NO: 2471492 - protein, 10 aa, Entamoeba dispar
YGYEGETVQP

SEQ ID NO: 2471493 - protein, 11 aa, Entamoeba dispar
YGYGEESHQWK

SEQ ID NO: 2471494 - protein, 9 aa, Entamoeba dispar
YGYKGANAL

SEQ ID NO: 2471495 - protein, 12 aa, Entamoeba dispar
YGYLPKETKRLG

SEQ ID NO: 2471496 - protein, 7 aa, Entamoeba dispar
YGYTPNE

SEQ ID NO: 2471497 - protein, 5 aa, Entamoeba dispar
YHFPG

SEQ ID NO: 2471498 - protein, 7 aa, Entamoeba dispar
YHGKNQD

SEQ ID NO: 2471499 - protein, 4 aa, Entamoeba dispar
YHGT

SEQ ID NO: 2471500 - protein, 6 aa, Entamoeba dispar
YHGTNK

SEQ ID NO: 2471501 - protein, 12 aa, Entamoeba dispar
YHNNDEYYGESS

SEQ ID NO: 2471502 - protein, 4 aa, Entamoeba dispar
YHPS

SEQ ID NO: 2471503 - protein, 12 aa, Entamoeba dispar
YHPSGKYNTSYQ

SEQ ID NO: 2471504 - protein, 6 aa, Entamoeba dispar
YHPSNS

SEQ ID NO: 2471505 - protein, 13 aa, Entamoeba dispar
YHQNASEEDEKYL

SEQ ID NO: 2471506 - protein, 6 aa, Entamoeba dispar
YHRPTK

SEQ ID NO: 2471507 - protein, 8 aa, Entamoeba dispar
YHSNKPKI

SEQ ID NO: 2471508 - protein, 6 aa, Entamoeba dispar
YHSSSS

SEQ ID NO: 2471509 - protein, 9 aa, Entamoeba dispar
YHSTETPQQ

SEQ ID NO: 2471510 - protein, 4 aa, Entamoeba dispar
YHVP

SEQ ID NO: 2471511 - protein, 13 aa, Entamoeba dispar
YIAKKPKKPQSFL

SEQ ID NO: 2471512 - protein, 8 aa, Entamoeba dispar
YIDGETSA

SEQ ID NO: 2471513 - protein, 5 aa, Entamoeba dispar
YIDRT

SEQ ID NO: 2471514 - protein, 8 aa, Entamoeba dispar
YIEDGKEI

SEQ ID NO: 2471515 - protein, 5 aa, Entamoeba dispar
YIENG

SEQ ID NO: 2471516 - protein, 13 aa, Entamoeba dispar
YIEPNDAKLPTES

SEQ ID NO: 2471517 - protein, 17 aa, Entamoeba dispar
YIEPPQSAAAITTETIT

SEQ ID NO: 2471518 - protein, 10 aa, Entamoeba dispar
YIEQRNYQSK

SEQ ID NO: 2471519 - protein, 14 aa, Entamoeba dispar
YIETPDYNNEPDNE

SEQ ID NO: 2471520 - protein, 4 aa, Entamoeba dispar
YIKD

SEQ ID NO: 2471521 - protein, 21 aa, Entamoeba dispar
YIKEKGECKEKDNECNKSERN

SEQ ID NO: 2471522 - protein, 21 aa, Entamoeba dispar
YIKENGECKEIDNKCNKSERN

SEQ ID NO: 2471523 - protein, 21 aa, Entamoeba dispar
YIKENGECKEKDNKCNKSERN

SEQ ID NO: 2471524 - protein, 9 aa, Entamoeba dispar
YIPAPTQNH

SEQ ID NO: 2471525 - protein, 13 aa, Entamoeba dispar
YIPEDIETNQTNI

SEQ ID NO: 2471526 - protein, 34 aa, Entamoeba dispar
YIPEEQSHKEQDLKSKQTSTRTNQRRPRVQQGQM

SEQ ID NO: 2471527 - protein, 12 aa, Entamoeba dispar
YIPGGKRGDYEY

SEQ ID NO: 2471528 - protein, 8 aa, Entamoeba dispar
YIPPQQTY

SEQ ID NO: 2471529 - protein, 6 aa, Entamoeba dispar
YIPPSP

SEQ ID NO: 2471530 - protein, 19 aa, Entamoeba dispar
YIPQQQSFNQSQQNTMPNQ

SEQ ID NO: 2471531 - protein, 6 aa, Entamoeba dispar
YIPSPY

SEQ ID NO: 2471532 - protein, 9 aa, Entamoeba dispar
YIPTPQQPS

SEQ ID NO: 2471533 - protein, 10 aa, Entamoeba dispar
YIQGNSTVTP

SEQ ID NO: 2471534 - protein, 16 aa, Entamoeba dispar
YIQPPPEQYIQPPPDQ

SEQ ID NO: 2471535 - protein, 11 aa, Entamoeba dispar
YISDSTEEINP

SEQ ID NO: 2471536 - protein, 10 aa, Entamoeba dispar
YISEGKNELK

SEQ ID NO: 2471537 - protein, 11 aa, Entamoeba dispar
YISEGKSELKE

SEQ ID NO: 2471538 - protein, 8 aa, Entamoeba dispar
YISETPTK

SEQ ID NO: 2471539 - protein, 6 aa, Entamoeba dispar
YISSTT

SEQ ID NO: 2471540 - protein, 13 aa, Entamoeba dispar
YITSEEDHNTTLE

SEQ ID NO: 2471541 - protein, 9 aa, Entamoeba dispar
YKAANPSMM

SEQ ID NO: 2471542 - protein, 11 aa, Entamoeba dispar
YKAETEDSREA

SEQ ID NO: 2471543 - protein, 7 aa, Entamoeba dispar
YKAPNGV

SEQ ID NO: 2471544 - protein, 8 aa, Entamoeba dispar
YKAPSGGV

SEQ ID NO: 2471545 - protein, 7 aa, Entamoeba dispar
YKAQKKI

SEQ ID NO: 2471546 - protein, 4 aa, Entamoeba dispar
YKAS

SEQ ID NO: 2471547 - protein, 4 aa, Entamoeba dispar
YKAT

SEQ ID NO: 2471548 - protein, 4 aa, Entamoeba dispar
YKDC

SEQ ID NO: 2471549 - protein, 14 aa, Entamoeba dispar
YKDDEAEKEIQAKQ

SEQ ID NO: 2471550 - protein, 9 aa, Entamoeba dispar
YKDDPDSLD

SEQ ID NO: 2471551 - protein, 15 aa, Entamoeba dispar
YKDEDIEEGGFEMNI

SEQ ID NO: 2471552 - protein, 59 aa, Entamoeba dispar
YKDEKSTRKKKDKNKEKRKEKEPYIRRTTKKDNKEDIKREKRIKQKYQEQKERIKKTQI

SEQ ID NO: 2471553 - protein, 8 aa, Entamoeba dispar
YKDENKND

SEQ ID NO: 2471554 - protein, 12 aa, Entamoeba dispar
YKDETNESFNST

SEQ ID NO: 2471555 - protein, 13 aa, Entamoeba dispar
YKDGEERKTLKQI

SEQ ID NO: 2471556 - protein, 9 aa, Entamoeba dispar
YKDGETERL

SEQ ID NO: 2471557 - protein, 4 aa, Entamoeba dispar
YKDK

SEQ ID NO: 2471558 - protein, 16 aa, Entamoeba dispar
YKDPEDMEKQEENYNA

SEQ ID NO: 2471559 - protein, 23 aa, Entamoeba dispar
YKDPEESEKDSEDMEKQEENYNA

SEQ ID NO: 2471560 - protein, 23 aa, Entamoeba dispar
YKDPEESENDSEDMEKQEENYDA

SEQ ID NO: 2471561 - protein, 24 aa, Entamoeba dispar
YKDPNESEKSEEDMERKEDNYDAV

SEQ ID NO: 2471562 - protein, 44 aa, Entamoeba dispar
YKDPNESENNSKDMSQEEKDYDPQKDLDEKYEEVKDDNSEDYQS

SEQ ID NO: 2471563 - protein, 50 aa, Entamoeba dispar
YKDPNESQNEIEDMSQEEKEYDPQKELDDKYEEVKDLPEEDDTSMNEIPS

SEQ ID NO: 2471564 - protein, 50 aa, Entamoeba dispar
YKDPNESQNEIEDMSQEEKEYDPQKELDNKYEEVKDLPEEDDTSMNEIPS

SEQ ID NO: 2471565 - protein, 30 aa, Entamoeba dispar
YKDPQESDNPSEDMQEQETNYDPQKDLEEK

SEQ ID NO: 2471566 - protein, 50 aa, Entamoeba dispar
YKDPQESDNPSEDMQEQETNYDPQKDLEEKYNALEEQDEDATMQEDYTPE

SEQ ID NO: 2471567 - protein, 49 aa, Entamoeba dispar
YKDPQESENSSENMQEQETNYDPQKDLEEKYNALEEKDEDTTIQEEYAP

SEQ ID NO: 2471568 - protein, 23 aa, Entamoeba dispar
YKDPTESEKDSEDMEQQEENYNA

SEQ ID NO: 2471569 - protein, 9 aa, Entamoeba dispar
YKDQRQNLQ

SEQ ID NO: 2471570 - protein, 10 aa, Entamoeba dispar
YKDRKQEKRI

SEQ ID NO: 2471571 - protein, 10 aa, Entamoeba dispar
YKDRNKYGNI

SEQ ID NO: 2471572 - protein, 5 aa, Entamoeba dispar
YKDSE

SEQ ID NO: 2471573 - protein, 18 aa, Entamoeba dispar
YKDSKTEIYKATERSGLR

SEQ ID NO: 2471574 - protein, 12 aa, Entamoeba dispar
YKDTKDITQIVN

SEQ ID NO: 2471575 - protein, 7 aa, Entamoeba dispar
YKDTTED

SEQ ID NO: 2471576 - protein, 12 aa, Entamoeba dispar
YKEAREHAEQRL

SEQ ID NO: 2471577 - protein, 12 aa, Entamoeba dispar
YKEDKVKAPQTS

SEQ ID NO: 2471578 - protein, 7 aa, Entamoeba dispar
YKEDNEK

SEQ ID NO: 2471579 - protein, 12 aa, Entamoeba dispar
YKEEGKKEEEKR

SEQ ID NO: 2471580 - protein, 10 aa, Entamoeba dispar
YKEENNDINE

SEQ ID NO: 2471581 - protein, 6 aa, Entamoeba dispar
YKEEVK

SEQ ID NO: 2471582 - protein, 7 aa, Entamoeba dispar
YKEFKDP

SEQ ID NO: 2471583 - protein, 8 aa, Entamoeba dispar
YKEFQENT

SEQ ID NO: 2471584 - protein, 11 aa, Entamoeba dispar
YKEIKEEKKQE

SEQ ID NO: 2471585 - protein, 4 aa, Entamoeba dispar
YKEK

SEQ ID NO: 2471586 - protein, 12 aa, Entamoeba dispar
YKEKGTKGSNIT

SEQ ID NO: 2471587 - protein, 56 aa, Entamoeba dispar
YKEKRKEVEEKEREYKLKRKEKEELIKRKEEDQPEIERKEKIKEEEKKKREEIEEE

SEQ ID NO: 2471588 - protein, 8 aa, Entamoeba dispar
YKEKSKQY

SEQ ID NO: 2471589 - protein, 7 aa, Entamoeba dispar
YKENKEY

SEQ ID NO: 2471590 - protein, 10 aa, Entamoeba dispar
YKENNKEIEG

SEQ ID NO: 2471591 - protein, 6 aa, Entamoeba dispar
YKENTL

SEQ ID NO: 2471592 - protein, 6 aa, Entamoeba dispar
YKEPKL

SEQ ID NO: 2471593 - protein, 7 aa, Entamoeba dispar
YKEQEAT

SEQ ID NO: 2471594 - protein, 6 aa, Entamoeba dispar
YKESWN

SEQ ID NO: 2471595 - protein, 7 aa, Entamoeba dispar
YKETGSQ

SEQ ID NO: 2471596 - protein, 31 aa, Entamoeba dispar
YKETIETKPKKLNPEEKTDKKLIEDEKKFPK

SEQ ID NO: 2471597 - protein, 28 aa, Entamoeba dispar
YKETQQTNTEQEDELNEVPPVPAPRNGL

SEQ ID NO: 2471598 - protein, 13 aa, Entamoeba dispar
YKGEGRKTNDKGM

SEQ ID NO: 2471599 - protein, 13 aa, Entamoeba dispar
YKGEGRKTNEEGM

SEQ ID NO: 2471600 - protein, 11 aa, Entamoeba dispar
YKGEPIHTTQC

SEQ ID NO: 2471601 - protein, 13 aa, Entamoeba dispar
YKGEWSKKSIDSR

SEQ ID NO: 2471602 - protein, 7 aa, Entamoeba dispar
YKGFPKK

SEQ ID NO: 2471603 - protein, 10 aa, Entamoeba dispar
YKGGEGVDHK

SEQ ID NO: 2471604 - protein, 6 aa, Entamoeba dispar
YKGGNY

SEQ ID NO: 2471605 - protein, 8 aa, Entamoeba dispar
YKGGSGAK

SEQ ID NO: 2471606 - protein, 7 aa, Entamoeba dispar
YKGNCSK

SEQ ID NO: 2471607 - protein, 10 aa, Entamoeba dispar
YKGNDIETTV

SEQ ID NO: 2471608 - protein, 5 aa, Entamoeba dispar
YKGTK

SEQ ID NO: 2471609 - protein, 12 aa, Entamoeba dispar
YKGYGTPVNGRK

SEQ ID NO: 2471610 - protein, 12 aa, Entamoeba dispar
YKHKQQKENNID

SEQ ID NO: 2471611 - protein, 8 aa, Entamoeba dispar
YKIEGNTS

SEQ ID NO: 2471612 - protein, 6 aa, Entamoeba dispar
YKIPDG

SEQ ID NO: 2471613 - protein, 13 aa, Entamoeba dispar
YKIQRNSLDDEYD

SEQ ID NO: 2471614 - protein, 9 aa, Entamoeba dispar
YKKAQTKQI

SEQ ID NO: 2471615 - protein, 9 aa, Entamoeba dispar
YKKDCDNKK

SEQ ID NO: 2471616 - protein, 16 aa, Entamoeba dispar
YKKDGQPRAKEGDYQF

SEQ ID NO: 2471617 - protein, 17 aa, Entamoeba dispar
YKKDINKTNKMGHEGKY

SEQ ID NO: 2471618 - protein, 8 aa, Entamoeba dispar
YKKDQYGI

SEQ ID NO: 2471619 - protein, 7 aa, Entamoeba dispar
YKKEEKE

SEQ ID NO: 2471620 - protein, 7 aa, Entamoeba dispar
YKKEFDY

SEQ ID NO: 2471621 - protein, 6 aa, Entamoeba dispar
YKKFGG

SEQ ID NO: 2471622 - protein, 4 aa, Entamoeba dispar
YKKH

SEQ ID NO: 2471623 - protein, 5 aa, Entamoeba dispar
YKKKE

SEQ ID NO: 2471624 - protein, 34 aa, Entamoeba dispar
YKKNDEEEEKEKVKPRQPLSEYERNKLKQEMRDE

SEQ ID NO: 2471625 - protein, 7 aa, Entamoeba dispar
YKKNNQK

SEQ ID NO: 2471626 - protein, 11 aa, Entamoeba dispar
YKKNPTSGSIN

SEQ ID NO: 2471627 - protein, 16 aa, Entamoeba dispar
YKKQKDKKELRKDSID

SEQ ID NO: 2471628 - protein, 5 aa, Entamoeba dispar
YKKRK

SEQ ID NO: 2471629 - protein, 9 aa, Entamoeba dispar
YKKTGNDGR

SEQ ID NO: 2471630 - protein, 14 aa, Entamoeba dispar
YKKTRGSSKTVKRE

SEQ ID NO: 2471631 - protein, 16 aa, Entamoeba dispar
YKKTRGSSKTVKRERI

SEQ ID NO: 2471632 - protein, 12 aa, Entamoeba dispar
YKKTYNYKAGSR

SEQ ID NO: 2471633 - protein, 8 aa, Entamoeba dispar
YKKYKGPS

SEQ ID NO: 2471634 - protein, 12 aa, Entamoeba dispar
YKLNDRNVKASM

SEQ ID NO: 2471635 - protein, 14 aa, Entamoeba dispar
YKLNKDHSNKTSNL

SEQ ID NO: 2471636 - protein, 5 aa, Entamoeba dispar
YKLPK

SEQ ID NO: 2471637 - protein, 34 aa, Entamoeba dispar
YKNDEEEEEKDKVKPKQPLSEYERNKLKQEMRDE

SEQ ID NO: 2471638 - protein, 27 aa, Entamoeba dispar
YKNDRQSECSRKDSVGGTDSPSSFKPK

SEQ ID NO: 2471639 - protein, 34 aa, Entamoeba dispar
YKNEEEEKEKDKVKPKQPLSEYERNKLKQEMRDE

SEQ ID NO: 2471640 - protein, 6 aa, Entamoeba dispar
YKNEES

SEQ ID NO: 2471641 - protein, 14 aa, Entamoeba dispar
YKNEGDKEEELAEE

SEQ ID NO: 2471642 - protein, 6 aa, Entamoeba dispar
YKNENQ

SEQ ID NO: 2471643 - protein, 27 aa, Entamoeba dispar
YKNGEGIEKIKNKEEIIKRNKEEDIDR

SEQ ID NO: 2471644 - protein, 5 aa, Entamoeba dispar
YKNIG

SEQ ID NO: 2471645 - protein, 17 aa, Entamoeba dispar
YKNKPIPKQYSKKPKKS

SEQ ID NO: 2471646 - protein, 7 aa, Entamoeba dispar
YKNMTND

SEQ ID NO: 2471647 - protein, 7 aa, Entamoeba dispar
YKNTPND

SEQ ID NO: 2471648 - protein, 10 aa, Entamoeba dispar
YKNYSNPTNL

SEQ ID NO: 2471649 - protein, 6 aa, Entamoeba dispar
YKPDDL

SEQ ID NO: 2471650 - protein, 6 aa, Entamoeba dispar
YKPEEL

SEQ ID NO: 2471651 - protein, 38 aa, Entamoeba dispar
YKPEHNKYKQEIPKTISYGGNTTKKPNTLTSPSKPKII

SEQ ID NO: 2471652 - protein, 4 aa, Entamoeba dispar
YKPG

SEQ ID NO: 2471653 - protein, 7 aa, Entamoeba dispar
YKPIGQP

SEQ ID NO: 2471654 - protein, 4 aa, Entamoeba dispar
YKPM

SEQ ID NO: 2471655 - protein, 7 aa, Entamoeba dispar
YKPQNDL

SEQ ID NO: 2471656 - protein, 13 aa, Entamoeba dispar
YKPQSFPEIPDTS

SEQ ID NO: 2471657 - protein, 8 aa, Entamoeba dispar
YKPRENGV

SEQ ID NO: 2471658 - protein, 6 aa, Entamoeba dispar
YKPRID

SEQ ID NO: 2471659 - protein, 8 aa, Entamoeba dispar
YKPTTPTL

SEQ ID NO: 2471660 - protein, 20 aa, Entamoeba dispar
YKPVEAKKQLEDTLKGNGSV

SEQ ID NO: 2471661 - protein, 7 aa, Entamoeba dispar
YKQERTQ

SEQ ID NO: 2471662 - protein, 20 aa, Entamoeba dispar
YKQKDRNKYGNTIPSEVKSL

SEQ ID NO: 2471663 - protein, 8 aa, Entamoeba dispar
YKQPEQIE

SEQ ID NO: 2471664 - protein, 31 aa, Entamoeba dispar
YKQPKQYNYNSPLTTPRRTPKKQSKPNSPIN

SEQ ID NO: 2471665 - protein, 5 aa, Entamoeba dispar
YKQRN

SEQ ID NO: 2471666 - protein, 8 aa, Entamoeba dispar
YKQRNDSI

SEQ ID NO: 2471667 - protein, 11 aa, Entamoeba dispar
YKQSPYSKSSI

SEQ ID NO: 2471668 - protein, 13 aa, Entamoeba dispar
YKREHPNSLKNGD

SEQ ID NO: 2471669 - protein, 14 aa, Entamoeba dispar
YKREYSNSLKNGNK

SEQ ID NO: 2471670 - protein, 8 aa, Entamoeba dispar
YKRGKTTK

SEQ ID NO: 2471671 - protein, 5 aa, Entamoeba dispar
YKRGV

SEQ ID NO: 2471672 - protein, 10 aa, Entamoeba dispar
YKRKQVNANT

SEQ ID NO: 2471673 - protein, 8 aa, Entamoeba dispar
YKRNRNYQ

SEQ ID NO: 2471674 - protein, 12 aa, Entamoeba dispar
YKRQERIKSIHN

SEQ ID NO: 2471675 - protein, 10 aa, Entamoeba dispar
YKSDDNDREH

SEQ ID NO: 2471676 - protein, 16 aa, Entamoeba dispar
YKSDGSEVTQVDTQSQ

SEQ ID NO: 2471677 - protein, 8 aa, Entamoeba dispar
YKSDKSLQ

SEQ ID NO: 2471678 - protein, 9 aa, Entamoeba dispar
YKSEGGKKV

SEQ ID NO: 2471679 - protein, 10 aa, Entamoeba dispar
YKSFAQSTEL

SEQ ID NO: 2471680 - protein, 8 aa, Entamoeba dispar
YKSFEQPE

SEQ ID NO: 2471681 - protein, 18 aa, Entamoeba dispar
YKSGKQEVQAGSTPEQTL

SEQ ID NO: 2471682 - protein, 10 aa, Entamoeba dispar
YKSKDHQKRE

SEQ ID NO: 2471683 - protein, 7 aa, Entamoeba dispar
YKSKDSM

SEQ ID NO: 2471684 - protein, 9 aa, Entamoeba dispar
YKSKLNEWE

SEQ ID NO: 2471685 - protein, 10 aa, Entamoeba dispar
YKSNKQQNYP

SEQ ID NO: 2471686 - protein, 7 aa, Entamoeba dispar
YKSQQYY

SEQ ID NO: 2471687 - protein, 8 aa, Entamoeba dispar
YKSQSGGF

SEQ ID NO: 2471688 - protein, 9 aa, Entamoeba dispar
YKSQTEDGE

SEQ ID NO: 2471689 - protein, 10 aa, Entamoeba dispar
YKTKDPKEID

SEQ ID NO: 2471690 - protein, 11 aa, Entamoeba dispar
YKTMQTEDRMR

SEQ ID NO: 2471691 - protein, 8 aa, Entamoeba dispar
YKTNSELD

SEQ ID NO: 2471692 - protein, 15 aa, Entamoeba dispar
YKTPKEKYLPKRSRL

SEQ ID NO: 2471693 - protein, 7 aa, Entamoeba dispar
YKTQEEK

SEQ ID NO: 2471694 - protein, 11 aa, Entamoeba dispar
YKTQSSLPSGL

SEQ ID NO: 2471695 - protein, 9 aa, Entamoeba dispar
YKTRGKSKY

SEQ ID NO: 2471696 - protein, 22 aa, Entamoeba dispar
YKTRTNKTFESGKEFRKQHENC

SEQ ID NO: 2471697 - protein, 10 aa, Entamoeba dispar
YKTSNEASIA

SEQ ID NO: 2471698 - protein, 9 aa, Entamoeba dispar
YKTTQNKKL

SEQ ID NO: 2471699 - protein, 4 aa, Entamoeba dispar
YKVG

SEQ ID NO: 2471700 - protein, 10 aa, Entamoeba dispar
YKWTQTPEDV

SEQ ID NO: 2471701 - protein, 8 aa, Entamoeba dispar
YKYGQQPV

SEQ ID NO: 2471702 - protein, 16 aa, Entamoeba dispar
YLDNSSLKDLLSQCEC

SEQ ID NO: 2471703 - protein, 10 aa, Entamoeba dispar
YLEEKQKGNI

SEQ ID NO: 2471704 - protein, 9 aa, Entamoeba dispar
YLGQPNSLY

SEQ ID NO: 2471705 - protein, 8 aa, Entamoeba dispar
YLKESNRN

SEQ ID NO: 2471706 - protein, 10 aa, Entamoeba dispar
YLKNSSNDDQ

SEQ ID NO: 2471707 - protein, 9 aa, Entamoeba dispar
YLKTKEKQN

SEQ ID NO: 2471708 - protein, 11 aa, Entamoeba dispar
YLNERNKRMKE

SEQ ID NO: 2471709 - protein, 12 aa, Entamoeba dispar
YLNGRKEREPYR

SEQ ID NO: 2471710 - protein, 11 aa, Entamoeba dispar
YLNKNKYGNII

SEQ ID NO: 2471711 - protein, 9 aa, Entamoeba dispar
YLPGNPEGW

SEQ ID NO: 2471712 - protein, 8 aa, Entamoeba dispar
YLPTTAEK

SEQ ID NO: 2471713 - protein, 4 aa, Entamoeba dispar
YLPY

SEQ ID NO: 2471714 - protein, 9 aa, Entamoeba dispar
YLQEKEQGI

SEQ ID NO: 2471715 - protein, 21 aa, Entamoeba dispar
YLQKRKDEIEKNSDGNKFGGY

SEQ ID NO: 2471716 - protein, 29 aa, Entamoeba dispar
YLQKRKDEIEKSKNENINKTKDAPTKQTD

SEQ ID NO: 2471717 - protein, 16 aa, Entamoeba dispar
YLQKRKEKNERREGLA

SEQ ID NO: 2471718 - protein, 10 aa, Entamoeba dispar
YLQRSGRTEA

SEQ ID NO: 2471719 - protein, 10 aa, Entamoeba dispar
YLSEKEQGNI

SEQ ID NO: 2471720 - protein, 9 aa, Entamoeba dispar
YLSNSSSIN

SEQ ID NO: 2471721 - protein, 10 aa, Entamoeba dispar
YLSSSDTSSV

SEQ ID NO: 2471722 - protein, 8 aa, Entamoeba dispar
YLSSTSST

SEQ ID NO: 2471723 - protein, 11 aa, Entamoeba dispar
YLSTESDFTSP

SEQ ID NO: 2471724 - protein, 7 aa, Entamoeba dispar
YLTPTSL

SEQ ID NO: 2471725 - protein, 12 aa, Entamoeba dispar
YMEDHPDSAVPN

SEQ ID NO: 2471726 - protein, 20 aa, Entamoeba dispar
YMPRPRSRESISQRERSESR

SEQ ID NO: 2471727 - protein, 9 aa, Entamoeba dispar
YMSQTDKGV

SEQ ID NO: 2471728 - protein, 6 aa, Entamoeba dispar
YMSSDD

SEQ ID NO: 2471729 - protein, 8 aa, Entamoeba dispar
YNADGEKY

SEQ ID NO: 2471730 - protein, 7 aa, Entamoeba dispar
YNAPNSE

SEQ ID NO: 2471731 - protein, 8 aa, Entamoeba dispar
YNASKEKE

SEQ ID NO: 2471732 - protein, 11 aa, Entamoeba dispar
YNASLKSTRAT

SEQ ID NO: 2471733 - protein, 4 aa, Entamoeba dispar
YNCP

SEQ ID NO: 2471734 - protein, 11 aa, Entamoeba dispar
YNDDYNNTKED

SEQ ID NO: 2471735 - protein, 15 aa, Entamoeba dispar
YNDESWLSDCENFSN

SEQ ID NO: 2471736 - protein, 5 aa, Entamoeba dispar
YNDKY

SEQ ID NO: 2471737 - protein, 7 aa, Entamoeba dispar
YNDKYAT

SEQ ID NO: 2471738 - protein, 8 aa, Entamoeba dispar
YNDNGDGY

SEQ ID NO: 2471739 - protein, 5 aa, Entamoeba dispar
YNDPE

SEQ ID NO: 2471740 - protein, 8 aa, Entamoeba dispar
YNDQLKEE

SEQ ID NO: 2471741 - protein, 7 aa, Entamoeba dispar
YNDSSAK

SEQ ID NO: 2471742 - protein, 8 aa, Entamoeba dispar
YNDTTQVG

SEQ ID NO: 2471743 - protein, 12 aa, Entamoeba dispar
YNDYETKNSSIT

SEQ ID NO: 2471744 - protein, 5 aa, Entamoeba dispar
YNEAK

SEQ ID NO: 2471745 - protein, 5 aa, Entamoeba dispar
YNEAY

SEQ ID NO: 2471746 - protein, 13 aa, Entamoeba dispar
YNEDEDEVRFEST

SEQ ID NO: 2471747 - protein, 12 aa, Entamoeba dispar
YNEDGTNKNPEI

SEQ ID NO: 2471748 - protein, 6 aa, Entamoeba dispar
YNEDTK

SEQ ID NO: 2471749 - protein, 21 aa, Entamoeba dispar
YNEELSSSYLKGKKGVSTKGI

SEQ ID NO: 2471750 - protein, 9 aa, Entamoeba dispar
YNEEQLEEL

SEQ ID NO: 2471751 - protein, 5 aa, Entamoeba dispar
YNEEY

SEQ ID NO: 2471752 - protein, 12 aa, Entamoeba dispar
YNEGKKGIASAE

SEQ ID NO: 2471753 - protein, 6 aa, Entamoeba dispar
YNEGSN

SEQ ID NO: 2471754 - protein, 5 aa, Entamoeba dispar
YNEIN

SEQ ID NO: 2471755 - protein, 18 aa, Entamoeba dispar
YNEISNNNNTNDQNNIKL

SEQ ID NO: 2471756 - protein, 6 aa, Entamoeba dispar
YNEKEE

SEQ ID NO: 2471757 - protein, 8 aa, Entamoeba dispar
YNEKPNRD

SEQ ID NO: 2471758 - protein, 6 aa, Entamoeba dispar
YNENIP

SEQ ID NO: 2471759 - protein, 5 aa, Entamoeba dispar
YNENS

SEQ ID NO: 2471760 - protein, 8 aa, Entamoeba dispar
YNEPSSYF

SEQ ID NO: 2471761 - protein, 75 aa, Entamoeba dispar
YNEPTDDDYDGIEKSVRRKQLNPRKPLKGKKKVKKLKETHKNLEEKVQDEIQKQEVKDNSQKVTEESLPKEGVNE

SEQ ID NO: 2471762 - protein, 6 aa, Entamoeba dispar
YNEQTH

SEQ ID NO: 2471763 - protein, 12 aa, Entamoeba dispar
YNESKQKLTRGT

SEQ ID NO: 2471764 - protein, 5 aa, Entamoeba dispar
YNESN

SEQ ID NO: 2471765 - protein, 8 aa, Entamoeba dispar
YNFDNEKK

SEQ ID NO: 2471766 - protein, 10 aa, Entamoeba dispar
YNGDKHPLTS

SEQ ID NO: 2471767 - protein, 11 aa, Entamoeba dispar
YNGDLEAREKM

SEQ ID NO: 2471768 - protein, 7 aa, Entamoeba dispar
YNGDSKK

SEQ ID NO: 2471769 - protein, 10 aa, Entamoeba dispar
YNGDYSNTEN

SEQ ID NO: 2471770 - protein, 9 aa, Entamoeba dispar
YNGGIDDEM

SEQ ID NO: 2471771 - protein, 11 aa, Entamoeba dispar
YNGKKPSDEEV

SEQ ID NO: 2471772 - protein, 10 aa, Entamoeba dispar
YNGKSTTNTL

SEQ ID NO: 2471773 - protein, 7 aa, Entamoeba dispar
YNGNKYQ

SEQ ID NO: 2471774 - protein, 5 aa, Entamoeba dispar
YNGPT

SEQ ID NO: 2471775 - protein, 8 aa, Entamoeba dispar
YNGSGPEI

SEQ ID NO: 2471776 - protein, 8 aa, Entamoeba dispar
YNGSGSEI

SEQ ID NO: 2471777 - protein, 4 aa, Entamoeba dispar
YNGT

SEQ ID NO: 2471778 - protein, 17 aa, Entamoeba dispar
YNGTGLKEGLKWLKKKL

SEQ ID NO: 2471779 - protein, 7 aa, Entamoeba dispar
YNGTTYP

SEQ ID NO: 2471780 - protein, 10 aa, Entamoeba dispar
YNGVEARENM

SEQ ID NO: 2471781 - protein, 10 aa, Entamoeba dispar
YNHTKGKGNI

SEQ ID NO: 2471782 - protein, 9 aa, Entamoeba dispar
YNIDEEKYK

SEQ ID NO: 2471783 - protein, 6 aa, Entamoeba dispar
YNIQPG

SEQ ID NO: 2471784 - protein, 8 aa, Entamoeba dispar
YNITEEDI

SEQ ID NO: 2471785 - protein, 11 aa, Entamoeba dispar
YNKAKKPNAAI

SEQ ID NO: 2471786 - protein, 6 aa, Entamoeba dispar
YNKEEC

SEQ ID NO: 2471787 - protein, 9 aa, Entamoeba dispar
YNKGDDRKN

SEQ ID NO: 2471788 - protein, 8 aa, Entamoeba dispar
YNKGIEYR

SEQ ID NO: 2471789 - protein, 10 aa, Entamoeba dispar
YNKINTKTSN

SEQ ID NO: 2471790 - protein, 7 aa, Entamoeba dispar
YNKNNYN

SEQ ID NO: 2471791 - protein, 20 aa, Entamoeba dispar
YNKPEEVKSDEKQNKEDLKE

SEQ ID NO: 2471792 - protein, 5 aa, Entamoeba dispar
YNKQH

SEQ ID NO: 2471793 - protein, 9 aa, Entamoeba dispar
YNKRKEQYK

SEQ ID NO: 2471794 - protein, 22 aa, Entamoeba dispar
YNKSENEVEEQIKTKKDKINPE

SEQ ID NO: 2471795 - protein, 8 aa, Entamoeba dispar
YNKTTRTI

SEQ ID NO: 2471796 - protein, 4 aa, Entamoeba dispar
YNLA

SEQ ID NO: 2471797 - protein, 9 aa, Entamoeba dispar
YNLTQGKKI

SEQ ID NO: 2471798 - protein, 7 aa, Entamoeba dispar
YNNDGEF

SEQ ID NO: 2471799 - protein, 7 aa, Entamoeba dispar
YNNDGEL

SEQ ID NO: 2471800 - protein, 5 aa, Entamoeba dispar
YNNEA

SEQ ID NO: 2471801 - protein, 6 aa, Entamoeba dispar
YNNENR

SEQ ID NO: 2471802 - protein, 5 aa, Entamoeba dispar
YNNEQ

SEQ ID NO: 2471803 - protein, 10 aa, Entamoeba dispar
YNNETKPNLY

SEQ ID NO: 2471804 - protein, 9 aa, Entamoeba dispar
YNNETNSLQ

SEQ ID NO: 2471805 - protein, 18 aa, Entamoeba dispar
YNNEVSTKESTNSSEGSL

SEQ ID NO: 2471806 - protein, 10 aa, Entamoeba dispar
YNNGKNKEVN

SEQ ID NO: 2471807 - protein, 9 aa, Entamoeba dispar
YNNGQTPID

SEQ ID NO: 2471808 - protein, 8 aa, Entamoeba dispar
YNNKTEQL

SEQ ID NO: 2471809 - protein, 8 aa, Entamoeba dispar
YNNKYDNN

SEQ ID NO: 2471810 - protein, 15 aa, Entamoeba dispar
YNNNKTQWKNNDEIS

SEQ ID NO: 2471811 - protein, 6 aa, Entamoeba dispar
YNNNRK

SEQ ID NO: 2471812 - protein, 4 aa, Entamoeba dispar
YNNP

SEQ ID NO: 2471813 - protein, 5 aa, Entamoeba dispar
YNNPD

SEQ ID NO: 2471814 - protein, 8 aa, Entamoeba dispar
YNNPIQPD

SEQ ID NO: 2471815 - protein, 11 aa, Entamoeba dispar
YNNSSPSLKSD

SEQ ID NO: 2471816 - protein, 7 aa, Entamoeba dispar
YNNSTSL

SEQ ID NO: 2471817 - protein, 9 aa, Entamoeba dispar
YNNSTTPDQ

SEQ ID NO: 2471818 - protein, 8 aa, Entamoeba dispar
YNNVPSCS

SEQ ID NO: 2471819 - protein, 4 aa, Entamoeba dispar
YNPE

SEQ ID NO: 2471820 - protein, 21 aa, Entamoeba dispar
YNPEDNILGPQKTETKINQTI

SEQ ID NO: 2471821 - protein, 11 aa, Entamoeba dispar
YNPEEEEHKEK

SEQ ID NO: 2471822 - protein, 6 aa, Entamoeba dispar
YNPERK

SEQ ID NO: 2471823 - protein, 4 aa, Entamoeba dispar
YNPH

SEQ ID NO: 2471824 - protein, 5 aa, Entamoeba dispar
YNPIG

SEQ ID NO: 2471825 - protein, 5 aa, Entamoeba dispar
YNPIS

SEQ ID NO: 2471826 - protein, 11 aa, Entamoeba dispar
YNPKDNMSSTM

SEQ ID NO: 2471827 - protein, 6 aa, Entamoeba dispar
YNPKEF

SEQ ID NO: 2471828 - protein, 13 aa, Entamoeba dispar
YNPKNNKPKEENN

SEQ ID NO: 2471829 - protein, 20 aa, Entamoeba dispar
YNPKSKPVQLSSSMTQTDSP

SEQ ID NO: 2471830 - protein, 23 aa, Entamoeba dispar
YNPKTKTELFGDSAKQALSKKGI

SEQ ID NO: 2471831 - protein, 4 aa, Entamoeba dispar
YNPL

SEQ ID NO: 2471832 - protein, 5 aa, Entamoeba dispar
YNPNS

SEQ ID NO: 2471833 - protein, 7 aa, Entamoeba dispar
YNPPQNT

SEQ ID NO: 2471834 - protein, 6 aa, Entamoeba dispar
YNPPVE

SEQ ID NO: 2471835 - protein, 5 aa, Entamoeba dispar
YNPQD

SEQ ID NO: 2471836 - protein, 8 aa, Entamoeba dispar
YNPQQEDV

SEQ ID NO: 2471837 - protein, 6 aa, Entamoeba dispar
YNPQTV

SEQ ID NO: 2471838 - protein, 7 aa, Entamoeba dispar
YNPSTQQ

SEQ ID NO: 2471839 - protein, 7 aa, Entamoeba dispar
YNPSTTL

SEQ ID NO: 2471840 - protein, 8 aa, Entamoeba dispar
YNPTIEDS

SEQ ID NO: 2471841 - protein, 5 aa, Entamoeba dispar
YNPTP

SEQ ID NO: 2471842 - protein, 5 aa, Entamoeba dispar
YNQED

SEQ ID NO: 2471843 - protein, 7 aa, Entamoeba dispar
YNQENDM

SEQ ID NO: 2471844 - protein, 11 aa, Entamoeba dispar
YNQGKEGMANA

SEQ ID NO: 2471845 - protein, 10 aa, Entamoeba dispar
YNQKAPDVAR

SEQ ID NO: 2471846 - protein, 8 aa, Entamoeba dispar
YNQLKQAN

SEQ ID NO: 2471847 - protein, 11 aa, Entamoeba dispar
YNQLKQSNEIT

SEQ ID NO: 2471848 - protein, 9 aa, Entamoeba dispar
YNQNKEIKS

SEQ ID NO: 2471849 - protein, 5 aa, Entamoeba dispar
YNQNP

SEQ ID NO: 2471850 - protein, 4 aa, Entamoeba dispar
YNQP

SEQ ID NO: 2471851 - protein, 10 aa, Entamoeba dispar
YNQPNTQPLS

SEQ ID NO: 2471852 - protein, 6 aa, Entamoeba dispar
YNQQTS

SEQ ID NO: 2471853 - protein, 4 aa, Entamoeba dispar
YNQT

SEQ ID NO: 2471854 - protein, 24 aa, Entamoeba dispar
YNQTQEIKQKADIVNAKDEDYHKH

SEQ ID NO: 2471855 - protein, 13 aa, Entamoeba dispar
YNREKSDFPNNFT

SEQ ID NO: 2471856 - protein, 25 aa, Entamoeba dispar
YNRGGLTQEKRNEIKKVNEELRKRH

SEQ ID NO: 2471857 - protein, 9 aa, Entamoeba dispar
YNRIRENGG

SEQ ID NO: 2471858 - protein, 6 aa, Entamoeba dispar
YNRNGT

SEQ ID NO: 2471859 - protein, 6 aa, Entamoeba dispar
YNRPLQ

SEQ ID NO: 2471860 - protein, 6 aa, Entamoeba dispar
YNRSEG

SEQ ID NO: 2471861 - protein, 9 aa, Entamoeba dispar
YNSANKDAL

SEQ ID NO: 2471862 - protein, 6 aa, Entamoeba dispar
YNSANR

SEQ ID NO: 2471863 - protein, 15 aa, Entamoeba dispar
YNSDEDARSRNRTAK

SEQ ID NO: 2471864 - protein, 5 aa, Entamoeba dispar
YNSED

SEQ ID NO: 2471865 - protein, 5 aa, Entamoeba dispar
YNSES

SEQ ID NO: 2471866 - protein, 8 aa, Entamoeba dispar
YNSESGKM

SEQ ID NO: 2471867 - protein, 7 aa, Entamoeba dispar
YNSGSST

SEQ ID NO: 2471868 - protein, 15 aa, Entamoeba dispar
YNSKTMKGVSSSLNY

SEQ ID NO: 2471869 - protein, 9 aa, Entamoeba dispar
YNSNQTTTL

SEQ ID NO: 2471870 - protein, 7 aa, Entamoeba dispar
YNSNYTD

SEQ ID NO: 2471871 - protein, 8 aa, Entamoeba dispar
YNSQKGYV

SEQ ID NO: 2471872 - protein, 6 aa, Entamoeba dispar
YNSRGT

SEQ ID NO: 2471873 - protein, 9 aa, Entamoeba dispar
YNSSISPKK

SEQ ID NO: 2471874 - protein, 15 aa, Entamoeba dispar
YNSSRAQKKQTINVS

SEQ ID NO: 2471875 - protein, 4 aa, Entamoeba dispar
YNSY

SEQ ID NO: 2471876 - protein, 8 aa, Entamoeba dispar
YNTKDTPV

SEQ ID NO: 2471877 - protein, 11 aa, Entamoeba dispar
YNTKSNSSIEV

SEQ ID NO: 2471878 - protein, 6 aa, Entamoeba dispar
YNTNGI

SEQ ID NO: 2471879 - protein, 5 aa, Entamoeba dispar
YNTPC

SEQ ID NO: 2471880 - protein, 8 aa, Entamoeba dispar
YNTQSSNM

SEQ ID NO: 2471881 - protein, 8 aa, Entamoeba dispar
YNTSSFNP

SEQ ID NO: 2471882 - protein, 5 aa, Entamoeba dispar
YNVEK

SEQ ID NO: 2471883 - protein, 17 aa, Entamoeba dispar
YNYNEKSITELASETYN

SEQ ID NO: 2471884 - protein, 9 aa, Entamoeba dispar
YNYNENIPS

SEQ ID NO: 2471885 - protein, 7 aa, Entamoeba dispar
YNYPDNK

SEQ ID NO: 2471886 - protein, 16 aa, Entamoeba dispar
YNYSSENGHITNTSLQ

SEQ ID NO: 2471887 - protein, 6 aa, Entamoeba dispar
YPAEDE

SEQ ID NO: 2471888 - protein, 11 aa, Entamoeba dispar
YPAEKVNSDGK

SEQ ID NO: 2471889 - protein, 11 aa, Entamoeba dispar
YPALDNKYRQS

SEQ ID NO: 2471890 - protein, 11 aa, Entamoeba dispar
YPALSAKSLSK

SEQ ID NO: 2471891 - protein, 6 aa, Entamoeba dispar
YPAPTL

SEQ ID NO: 2471892 - protein, 12 aa, Entamoeba dispar
YPCPDANPNTIQ

SEQ ID NO: 2471893 - protein, 8 aa, Entamoeba dispar
YPDALRPS

SEQ ID NO: 2471894 - protein, 4 aa, Entamoeba dispar
YPDE

SEQ ID NO: 2471895 - protein, 12 aa, Entamoeba dispar
YPDGTKITAKRA

SEQ ID NO: 2471896 - protein, 15 aa, Entamoeba dispar
YPDNHVQTSRVTRNN

SEQ ID NO: 2471897 - protein, 8 aa, Entamoeba dispar
YPDNQQAS

SEQ ID NO: 2471898 - protein, 7 aa, Entamoeba dispar
YPDNTPL

SEQ ID NO: 2471899 - protein, 14 aa, Entamoeba dispar
YPDQSPRKERHSDN

SEQ ID NO: 2471900 - protein, 11 aa, Entamoeba dispar
YPDTGFDENEN

SEQ ID NO: 2471901 - protein, 4 aa, Entamoeba dispar
YPDY

SEQ ID NO: 2471902 - protein, 18 aa, Entamoeba dispar
YPDYTNSGSIDAREKSNV

SEQ ID NO: 2471903 - protein, 4 aa, Entamoeba dispar
YPED

SEQ ID NO: 2471904 - protein, 7 aa, Entamoeba dispar
YPEEGDQ

SEQ ID NO: 2471905 - protein, 6 aa, Entamoeba dispar
YPEKID

SEQ ID NO: 2471906 - protein, 5 aa, Entamoeba dispar
YPERV

SEQ ID NO: 2471907 - protein, 6 aa, Entamoeba dispar
YPESLE

SEQ ID NO: 2471908 - protein, 6 aa, Entamoeba dispar
YPETLQ

SEQ ID NO: 2471909 - protein, 7 aa, Entamoeba dispar
YPETNEN

SEQ ID NO: 2471910 - protein, 9 aa, Entamoeba dispar
YPETRKNEA

SEQ ID NO: 2471911 - protein, 6 aa, Entamoeba dispar
YPGEYG

SEQ ID NO: 2471912 - protein, 10 aa, Entamoeba dispar
YPGSTNKKTL

SEQ ID NO: 2471913 - protein, 5 aa, Entamoeba dispar
YPGTL

SEQ ID NO: 2471914 - protein, 4 aa, Entamoeba dispar
YPGY

SEQ ID NO: 2471915 - protein, 10 aa, Entamoeba dispar
YPIENRPQED

SEQ ID NO: 2471916 - protein, 11 aa, Entamoeba dispar
YPIEQKGNRDK

SEQ ID NO: 2471917 - protein, 6 aa, Entamoeba dispar
YPINPK

SEQ ID NO: 2471918 - protein, 10 aa, Entamoeba dispar
YPIPNNEDTL

SEQ ID NO: 2471919 - protein, 8 aa, Entamoeba dispar
YPKDDNEL

SEQ ID NO: 2471920 - protein, 10 aa, Entamoeba dispar
YPKDLSTGKP

SEQ ID NO: 2471921 - protein, 10 aa, Entamoeba dispar
YPKDQLTASN

SEQ ID NO: 2471922 - protein, 6 aa, Entamoeba dispar
YPKDTK

SEQ ID NO: 2471923 - protein, 7 aa, Entamoeba dispar
YPKEQIP

SEQ ID NO: 2471924 - protein, 5 aa, Entamoeba dispar
YPKEV

SEQ ID NO: 2471925 - protein, 10 aa, Entamoeba dispar
YPKGGSRHQL

SEQ ID NO: 2471926 - protein, 4 aa, Entamoeba dispar
YPKK

SEQ ID NO: 2471927 - protein, 5 aa, Entamoeba dispar
YPKKR

SEQ ID NO: 2471928 - protein, 12 aa, Entamoeba dispar
YPKKSYTPMTTS

SEQ ID NO: 2471929 - protein, 8 aa, Entamoeba dispar
YPKNPKIK

SEQ ID NO: 2471930 - protein, 13 aa, Entamoeba dispar
YPKNSLKGHPESI

SEQ ID NO: 2471931 - protein, 5 aa, Entamoeba dispar
YPKNT

SEQ ID NO: 2471932 - protein, 9 aa, Entamoeba dispar
YPKPPSNTI

SEQ ID NO: 2471933 - protein, 5 aa, Entamoeba dispar
YPKPR

SEQ ID NO: 2471934 - protein, 5 aa, Entamoeba dispar
YPKQI

SEQ ID NO: 2471935 - protein, 11 aa, Entamoeba dispar
YPLEKDIQKNN

SEQ ID NO: 2471936 - protein, 14 aa, Entamoeba dispar
YPLPPDSRTYSSTT

SEQ ID NO: 2471937 - protein, 6 aa, Entamoeba dispar
YPLSAN

SEQ ID NO: 2471938 - protein, 7 aa, Entamoeba dispar
YPMNPPK

SEQ ID NO: 2471939 - protein, 7 aa, Entamoeba dispar
YPNDDTM

SEQ ID NO: 2471940 - protein, 4 aa, Entamoeba dispar
YPNE

SEQ ID NO: 2471941 - protein, 15 aa, Entamoeba dispar
YPNESVGFKRTKPRL

SEQ ID NO: 2471942 - protein, 23 aa, Entamoeba dispar
YPNFPKGDYENSPFITKYLEDNF

SEQ ID NO: 2471943 - protein, 4 aa, Entamoeba dispar
YPNQ

SEQ ID NO: 2471944 - protein, 11 aa, Entamoeba dispar
YPNSGKSSVIN

SEQ ID NO: 2471945 - protein, 5 aa, Entamoeba dispar
YPNTR

SEQ ID NO: 2471946 - protein, 15 aa, Entamoeba dispar
YPNYPQPNYGYSPYG

SEQ ID NO: 2471947 - protein, 4 aa, Entamoeba dispar
YPPA

SEQ ID NO: 2471948 - protein, 6 aa, Entamoeba dispar
YPPEDI

SEQ ID NO: 2471949 - protein, 9 aa, Entamoeba dispar
YPPLAEQSN

SEQ ID NO: 2471950 - protein, 12 aa, Entamoeba dispar
YPPLEATEEIEL

SEQ ID NO: 2471951 - protein, 6 aa, Entamoeba dispar
YPPNIT

SEQ ID NO: 2471952 - protein, 6 aa, Entamoeba dispar
YPPNYN

SEQ ID NO: 2471953 - protein, 13 aa, Entamoeba dispar
YPPPKAPQEPYSN

SEQ ID NO: 2471954 - protein, 30 aa, Entamoeba dispar
YPPPPMGGCPPPMPGPGGYPMSGPGGYPMG

SEQ ID NO: 2471955 - protein, 5 aa, Entamoeba dispar
YPPQY

SEQ ID NO: 2471956 - protein, 6 aa, Entamoeba dispar
YPPSDK

SEQ ID NO: 2471957 - protein, 9 aa, Entamoeba dispar
YPPSSGPID

SEQ ID NO: 2471958 - protein, 7 aa, Entamoeba dispar
YPPTKIK

SEQ ID NO: 2471959 - protein, 5 aa, Entamoeba dispar
YPPTS

SEQ ID NO: 2471960 - protein, 4 aa, Entamoeba dispar
YPQE

SEQ ID NO: 2471961 - protein, 8 aa, Entamoeba dispar
YPQPGETI

SEQ ID NO: 2471962 - protein, 4 aa, Entamoeba dispar
YPQS

SEQ ID NO: 2471963 - protein, 7 aa, Entamoeba dispar
YPQTSDI

SEQ ID NO: 2471964 - protein, 5 aa, Entamoeba dispar
YPRDP

SEQ ID NO: 2471965 - protein, 5 aa, Entamoeba dispar
YPRLN

SEQ ID NO: 2471966 - protein, 6 aa, Entamoeba dispar
YPRNEI

SEQ ID NO: 2471967 - protein, 11 aa, Entamoeba dispar
YPRTESTKYSS

SEQ ID NO: 2471968 - protein, 8 aa, Entamoeba dispar
YPRTETNI

SEQ ID NO: 2471969 - protein, 9 aa, Entamoeba dispar
YPSGDTESE

SEQ ID NO: 2471970 - protein, 4 aa, Entamoeba dispar
YPSI

SEQ ID NO: 2471971 - protein, 4 aa, Entamoeba dispar
YPSQ

SEQ ID NO: 2471972 - protein, 5 aa, Entamoeba dispar
YPSSL

SEQ ID NO: 2471973 - protein, 8 aa, Entamoeba dispar
YPSSPIAH

SEQ ID NO: 2471974 - protein, 5 aa, Entamoeba dispar
YPTAD

SEQ ID NO: 2471975 - protein, 6 aa, Entamoeba dispar
YPTEPA

SEQ ID NO: 2471976 - protein, 5 aa, Entamoeba dispar
YPTET

SEQ ID NO: 2471977 - protein, 4 aa, Entamoeba dispar
YPTK

SEQ ID NO: 2471978 - protein, 6 aa, Entamoeba dispar
YPTKKL

SEQ ID NO: 2471979 - protein, 11 aa, Entamoeba dispar
YPTNEKKWKYD

SEQ ID NO: 2471980 - protein, 7 aa, Entamoeba dispar
YPTTTQQ

SEQ ID NO: 2471981 - protein, 5 aa, Entamoeba dispar
YPTVT

SEQ ID NO: 2471982 - protein, 14 aa, Entamoeba dispar
YPVPKGQRKTEPKI

SEQ ID NO: 2471983 - protein, 9 aa, Entamoeba dispar
YPVSSSARD

SEQ ID NO: 2471984 - protein, 4 aa, Entamoeba dispar
YPYE

SEQ ID NO: 2471985 - protein, 9 aa, Entamoeba dispar
YPYETDEQY

SEQ ID NO: 2471986 - protein, 8 aa, Entamoeba dispar
YPYNPNSV

SEQ ID NO: 2471987 - protein, 21 aa, Entamoeba dispar
YPYSINSSSLSSSSQPSYYNQ

SEQ ID NO: 2471988 - protein, 7 aa, Entamoeba dispar
YQAPPLP

SEQ ID NO: 2471989 - protein, 11 aa, Entamoeba dispar
YQDKKTNDTIT

SEQ ID NO: 2471990 - protein, 9 aa, Entamoeba dispar
YQDKPNFPK

SEQ ID NO: 2471991 - protein, 17 aa, Entamoeba dispar
YQDREEYGNTIPPEVKS

SEQ ID NO: 2471992 - protein, 9 aa, Entamoeba dispar
YQDTETYKT

SEQ ID NO: 2471993 - protein, 5 aa, Entamoeba dispar
YQEAR

SEQ ID NO: 2471994 - protein, 8 aa, Entamoeba dispar
YQEDSESM

SEQ ID NO: 2471995 - protein, 4 aa, Entamoeba dispar
YQEE

SEQ ID NO: 2471996 - protein, 18 aa, Entamoeba dispar
YQEENQVEIEEQNNGNIS

SEQ ID NO: 2471997 - protein, 19 aa, Entamoeba dispar
YQEENQVEIEEQNNGNISS

SEQ ID NO: 2471998 - protein, 18 aa, Entamoeba dispar
YQEESREFRSIKEENTRL

SEQ ID NO: 2471999 - protein, 8 aa, Entamoeba dispar
YQEGEEAR

SEQ ID NO: 2472000 - protein, 4 aa, Entamoeba dispar
YQEK

SEQ ID NO: 2472001 - protein, 16 aa, Entamoeba dispar
YQEKTYIDSPRKRGIS

SEQ ID NO: 2472002 - protein, 4 aa, Entamoeba dispar
YQEL

SEQ ID NO: 2472003 - protein, 4 aa, Entamoeba dispar
YQEP

SEQ ID NO: 2472004 - protein, 16 aa, Entamoeba dispar
YQEYGTGYEEGYYEGH

SEQ ID NO: 2472005 - protein, 4 aa, Entamoeba dispar
YQGE

SEQ ID NO: 2472006 - protein, 6 aa, Entamoeba dispar
YQGKSI

SEQ ID NO: 2472007 - protein, 29 aa, Entamoeba dispar
YQGRGSNEFAGGRNTEKENNNKGPTIEEV

SEQ ID NO: 2472008 - protein, 41 aa, Entamoeba dispar
YQGTSLEQTQPVIEQQKKPQTEPTNPNGKKQRGRPKLDHNR

SEQ ID NO: 2472009 - protein, 10 aa, Entamoeba dispar
YQGYDPNSQM

SEQ ID NO: 2472010 - protein, 8 aa, Entamoeba dispar
YQHQSTQG

SEQ ID NO: 2472011 - protein, 9 aa, Entamoeba dispar
YQIEGRNEP

SEQ ID NO: 2472012 - protein, 10 aa, Entamoeba dispar
YQIPSNDYIP

SEQ ID NO: 2472013 - protein, 6 aa, Entamoeba dispar
YQKESK

SEQ ID NO: 2472014 - protein, 26 aa, Entamoeba dispar
YQKINGKLNDEKDDKKQKIIQQTRDD

SEQ ID NO: 2472015 - protein, 8 aa, Entamoeba dispar
YQKISQAR

SEQ ID NO: 2472016 - protein, 33 aa, Entamoeba dispar
YQKKTEPLEEIGEKKRKKLLSENKQDLTKYDDS

SEQ ID NO: 2472017 - protein, 16 aa, Entamoeba dispar
YQKSDGSQINERMKKE

SEQ ID NO: 2472018 - protein, 4 aa, Entamoeba dispar
YQKY

SEQ ID NO: 2472019 - protein, 5 aa, Entamoeba dispar
YQLGD

SEQ ID NO: 2472020 - protein, 10 aa, Entamoeba dispar
YQNDQVAKKL

SEQ ID NO: 2472021 - protein, 4 aa, Entamoeba dispar
YQNE

SEQ ID NO: 2472022 - protein, 6 aa, Entamoeba dispar
YQNEGI

SEQ ID NO: 2472023 - protein, 8 aa, Entamoeba dispar
YQNEKAPN

SEQ ID NO: 2472024 - protein, 19 aa, Entamoeba dispar
YQNEKQQCDELQKSYDNQL

SEQ ID NO: 2472025 - protein, 12 aa, Entamoeba dispar
YQNETSQLFIKK

SEQ ID NO: 2472026 - protein, 5 aa, Entamoeba dispar
YQNKD

SEQ ID NO: 2472027 - protein, 14 aa, Entamoeba dispar
YQNLRNDRKSDRRQ

SEQ ID NO: 2472028 - protein, 6 aa, Entamoeba dispar
YQNNKM

SEQ ID NO: 2472029 - protein, 9 aa, Entamoeba dispar
YQNNPEFEN

SEQ ID NO: 2472030 - protein, 4 aa, Entamoeba dispar
YQNS

SEQ ID NO: 2472031 - protein, 5 aa, Entamoeba dispar
YQNSE

SEQ ID NO: 2472032 - protein, 7 aa, Entamoeba dispar
YQPHSDK

SEQ ID NO: 2472033 - protein, 6 aa, Entamoeba dispar
YQPIEG

SEQ ID NO: 2472034 - protein, 39 aa, Entamoeba dispar
YQPIKRKPEEPQNNDIRGGKITSEEIEQKFKERQVETEP

SEQ ID NO: 2472035 - protein, 9 aa, Entamoeba dispar
YQPKENKVQ

SEQ ID NO: 2472036 - protein, 15 aa, Entamoeba dispar
YQPKRSLEPSRGKNK

SEQ ID NO: 2472037 - protein, 13 aa, Entamoeba dispar
YQPKSKEFTTEDP

SEQ ID NO: 2472038 - protein, 5 aa, Entamoeba dispar
YQPNP

SEQ ID NO: 2472039 - protein, 4 aa, Entamoeba dispar
YQPP

SEQ ID NO: 2472040 - protein, 23 aa, Entamoeba dispar
YQPQSGTCPVTPTSQSKRNITSL

SEQ ID NO: 2472041 - protein, 12 aa, Entamoeba dispar
YQPSIDKQKRNF

SEQ ID NO: 2472042 - protein, 5 aa, Entamoeba dispar
YQPSQ

SEQ ID NO: 2472043 - protein, 9 aa, Entamoeba dispar
YQPSSQPCA

SEQ ID NO: 2472044 - protein, 33 aa, Entamoeba dispar
YQQASSPVLSPIGKPQIKTSGSTQIKPSAITSI

SEQ ID NO: 2472045 - protein, 11 aa, Entamoeba dispar
YQQEDSDKANE

SEQ ID NO: 2472046 - protein, 6 aa, Entamoeba dispar
YQQEYH

SEQ ID NO: 2472047 - protein, 5 aa, Entamoeba dispar
YQQGY

SEQ ID NO: 2472048 - protein, 16 aa, Entamoeba dispar
YQQKENSGGDDYIDEE

SEQ ID NO: 2472049 - protein, 18 aa, Entamoeba dispar
YQQNENQINDNKQCQEAL

SEQ ID NO: 2472050 - protein, 8 aa, Entamoeba dispar
YQQPQARH

SEQ ID NO: 2472051 - protein, 16 aa, Entamoeba dispar
YQQPTEITKDNIPQQI

SEQ ID NO: 2472052 - protein, 14 aa, Entamoeba dispar
YQQQSSNEQIKRRP

SEQ ID NO: 2472053 - protein, 7 aa, Entamoeba dispar
YQQQTID

SEQ ID NO: 2472054 - protein, 6 aa, Entamoeba dispar
YQQYTP

SEQ ID NO: 2472055 - protein, 24 aa, Entamoeba dispar
YQREKKRLEEEARRREEEEDARLE

SEQ ID NO: 2472056 - protein, 20 aa, Entamoeba dispar
YQRKERKEGKEKKRNDEKRA

SEQ ID NO: 2472057 - protein, 8 aa, Entamoeba dispar
YQRKVEGK

SEQ ID NO: 2472058 - protein, 10 aa, Entamoeba dispar
YQRPIKPPIE

SEQ ID NO: 2472059 - protein, 7 aa, Entamoeba dispar
YQRPYQE

SEQ ID NO: 2472060 - protein, 5 aa, Entamoeba dispar
YQSDI

SEQ ID NO: 2472061 - protein, 18 aa, Entamoeba dispar
YQSDRTTEVIPTKEKQLK

SEQ ID NO: 2472062 - protein, 18 aa, Entamoeba dispar
YQSDTTFQSTKKVPKNVS

SEQ ID NO: 2472063 - protein, 10 aa, Entamoeba dispar
YQSEDKDVDA

SEQ ID NO: 2472064 - protein, 10 aa, Entamoeba dispar
YQSEHQNIKR

SEQ ID NO: 2472065 - protein, 5 aa, Entamoeba dispar
YQSGR

SEQ ID NO: 2472066 - protein, 6 aa, Entamoeba dispar
YQSIND

SEQ ID NO: 2472067 - protein, 10 aa, Entamoeba dispar
YQSKGRNSKD

SEQ ID NO: 2472068 - protein, 7 aa, Entamoeba dispar
YQSRENA

SEQ ID NO: 2472069 - protein, 7 aa, Entamoeba dispar
YQSSSER

SEQ ID NO: 2472070 - protein, 7 aa, Entamoeba dispar
YQSSSPI

SEQ ID NO: 2472071 - protein, 7 aa, Entamoeba dispar
YQTASSI

SEQ ID NO: 2472072 - protein, 5 aa, Entamoeba dispar
YQTIE

SEQ ID NO: 2472073 - protein, 7 aa, Entamoeba dispar
YQTKEKF

SEQ ID NO: 2472074 - protein, 4 aa, Entamoeba dispar
YQTN

SEQ ID NO: 2472075 - protein, 17 aa, Entamoeba dispar
YQTPKECDLSGQEWSDD

SEQ ID NO: 2472076 - protein, 6 aa, Entamoeba dispar
YQTQQQ

SEQ ID NO: 2472077 - protein, 4 aa, Entamoeba dispar
YQTS

SEQ ID NO: 2472078 - protein, 4 aa, Entamoeba dispar
YQTY

SEQ ID NO: 2472079 - protein, 8 aa, Entamoeba dispar
YQTYETNS

SEQ ID NO: 2472080 - protein, 11 aa, Entamoeba dispar
YQVCPNKKEHP

SEQ ID NO: 2472081 - protein, 9 aa, Entamoeba dispar
YQVRSTGPI

SEQ ID NO: 2472082 - protein, 5 aa, Entamoeba dispar
YQYEQ

SEQ ID NO: 2472083 - protein, 9 aa, Entamoeba dispar
YQYQPSSPL

SEQ ID NO: 2472084 - protein, 4 aa, Entamoeba dispar
YRAP

SEQ ID NO: 2472085 - protein, 10 aa, Entamoeba dispar
YRDEYTPAGD

SEQ ID NO: 2472086 - protein, 14 aa, Entamoeba dispar
YRDSREDPKRLEKR

SEQ ID NO: 2472087 - protein, 7 aa, Entamoeba dispar
YREERRC

SEQ ID NO: 2472088 - protein, 11 aa, Entamoeba dispar
YRENSSSSRYA

SEQ ID NO: 2472089 - protein, 18 aa, Entamoeba dispar
YREQQENEIKKINEEDPQ

SEQ ID NO: 2472090 - protein, 4 aa, Entamoeba dispar
YRET

SEQ ID NO: 2472091 - protein, 8 aa, Entamoeba dispar
YRETNNDT

SEQ ID NO: 2472092 - protein, 4 aa, Entamoeba dispar
YREY

SEQ ID NO: 2472093 - protein, 4 aa, Entamoeba dispar
YRFN

SEQ ID NO: 2472094 - protein, 5 aa, Entamoeba dispar
YRFPG

SEQ ID NO: 2472095 - protein, 5 aa, Entamoeba dispar
YRGAE

SEQ ID NO: 2472096 - protein, 4 aa, Entamoeba dispar
YRGD

SEQ ID NO: 2472097 - protein, 8 aa, Entamoeba dispar
YRGESEYD

SEQ ID NO: 2472098 - protein, 16 aa, Entamoeba dispar
YRGGLDVASGSTGTYS

SEQ ID NO: 2472099 - protein, 15 aa, Entamoeba dispar
YRGGLDVKSGSTGTW

SEQ ID NO: 2472100 - protein, 4 aa, Entamoeba dispar
YRGK

SEQ ID NO: 2472101 - protein, 17 aa, Entamoeba dispar
YRGNNKESNTVIKPSEK

SEQ ID NO: 2472102 - protein, 5 aa, Entamoeba dispar
YRGSD

SEQ ID NO: 2472103 - protein, 4 aa, Entamoeba dispar
YRGT

SEQ ID NO: 2472104 - protein, 6 aa, Entamoeba dispar
YRIGQK

SEQ ID NO: 2472105 - protein, 18 aa, Entamoeba dispar
YRKEDRYKYGNTIPSEVK

SEQ ID NO: 2472106 - protein, 8 aa, Entamoeba dispar
YRKEGDLR

SEQ ID NO: 2472107 - protein, 8 aa, Entamoeba dispar
YRKEYTEG

SEQ ID NO: 2472108 - protein, 16 aa, Entamoeba dispar
YRKGKSSYKKKEKESN

SEQ ID NO: 2472109 - protein, 9 aa, Entamoeba dispar
YRKKKRDVK

SEQ ID NO: 2472110 - protein, 27 aa, Entamoeba dispar
YRKQRDQIKNELEKYKKENEKLELENQ

SEQ ID NO: 2472111 - protein, 16 aa, Entamoeba dispar
YRKSEKNNTEKEEPEE

SEQ ID NO: 2472112 - protein, 7 aa, Entamoeba dispar
YRNGSSI

SEQ ID NO: 2472113 - protein, 10 aa, Entamoeba dispar
YRNKNGKEIG

SEQ ID NO: 2472114 - protein, 10 aa, Entamoeba dispar
YRNKNKSNTL

SEQ ID NO: 2472115 - protein, 11 aa, Entamoeba dispar
YRNNKNVQVDT

SEQ ID NO: 2472116 - protein, 23 aa, Entamoeba dispar
YRNRPPPPNLQQPTHPLEPIPFL

SEQ ID NO: 2472117 - protein, 4 aa, Entamoeba dispar
YRPE

SEQ ID NO: 2472118 - protein, 6 aa, Entamoeba dispar
YRPGES

SEQ ID NO: 2472119 - protein, 7 aa, Entamoeba dispar
YRPHKSG

SEQ ID NO: 2472120 - protein, 14 aa, Entamoeba dispar
YRPQNSQVKKEPKK

SEQ ID NO: 2472121 - protein, 15 aa, Entamoeba dispar
YRPQTKSDLIGNKNQ

SEQ ID NO: 2472122 - protein, 4 aa, Entamoeba dispar
YRPT

SEQ ID NO: 2472123 - protein, 5 aa, Entamoeba dispar
YRPTD

SEQ ID NO: 2472124 - protein, 9 aa, Entamoeba dispar
YRQEGKVNE

SEQ ID NO: 2472125 - protein, 8 aa, Entamoeba dispar
YRQQDGDF

SEQ ID NO: 2472126 - protein, 6 aa, Entamoeba dispar
YRRERD

SEQ ID NO: 2472127 - protein, 21 aa, Entamoeba dispar
YRRESEKYRASLKQAKSIDDN

SEQ ID NO: 2472128 - protein, 10 aa, Entamoeba dispar
YRSEDDSESC

SEQ ID NO: 2472129 - protein, 18 aa, Entamoeba dispar
YRSFSRDRSRSRSPTPLY

SEQ ID NO: 2472130 - protein, 8 aa, Entamoeba dispar
YRSPSPIK

SEQ ID NO: 2472131 - protein, 15 aa, Entamoeba dispar
YRSRVNNDNHSQRLG

SEQ ID NO: 2472132 - protein, 5 aa, Entamoeba dispar
YRTIY

SEQ ID NO: 2472133 - protein, 10 aa, Entamoeba dispar
YRTKGNTINP

SEQ ID NO: 2472134 - protein, 14 aa, Entamoeba dispar
YRTSTKEQREQELR

SEQ ID NO: 2472135 - protein, 4 aa, Entamoeba dispar
YRTT

SEQ ID NO: 2472136 - protein, 6 aa, Entamoeba dispar
YRTTEE

SEQ ID NO: 2472137 - protein, 8 aa, Entamoeba dispar
YRVPTPIQ

SEQ ID NO: 2472138 - protein, 14 aa, Entamoeba dispar
YSAKQEVLDKGKKT

SEQ ID NO: 2472139 - protein, 13 aa, Entamoeba dispar
YSAQETNELSIKT

SEQ ID NO: 2472140 - protein, 18 aa, Entamoeba dispar
YSASKSVKEKRNEEVKEV

SEQ ID NO: 2472141 - protein, 7 aa, Entamoeba dispar
YSASKTL

SEQ ID NO: 2472142 - protein, 8 aa, Entamoeba dispar
YSATPLGS

SEQ ID NO: 2472143 - protein, 17 aa, Entamoeba dispar
YSDDPDMKQSKKAFENT

SEQ ID NO: 2472144 - protein, 11 aa, Entamoeba dispar
YSDDYKTEMQR

SEQ ID NO: 2472145 - protein, 9 aa, Entamoeba dispar
YSDFGTRRR

SEQ ID NO: 2472146 - protein, 12 aa, Entamoeba dispar
YSDNFGKNTKMD

SEQ ID NO: 2472147 - protein, 12 aa, Entamoeba dispar
YSDNGEISGALS

SEQ ID NO: 2472148 - protein, 10 aa, Entamoeba dispar
YSDNNERNTA

SEQ ID NO: 2472149 - protein, 9 aa, Entamoeba dispar
YSDNSNKMS

SEQ ID NO: 2472150 - protein, 7 aa, Entamoeba dispar
YSDNSVK

SEQ ID NO: 2472151 - protein, 4 aa, Entamoeba dispar
YSDP

SEQ ID NO: 2472152 - protein, 14 aa, Entamoeba dispar
YSDPSASSNDRRQA

SEQ ID NO: 2472153 - protein, 14 aa, Entamoeba dispar
YSDPSPFEKNAFDL

SEQ ID NO: 2472154 - protein, 4 aa, Entamoeba dispar
YSDS

SEQ ID NO: 2472155 - protein, 6 aa, Entamoeba dispar
YSDSCF

SEQ ID NO: 2472156 - protein, 10 aa, Entamoeba dispar
YSDTTEKPFN

SEQ ID NO: 2472157 - protein, 4 aa, Entamoeba dispar
YSED

SEQ ID NO: 2472158 - protein, 13 aa, Entamoeba dispar
YSEDKDHGFVIVE

SEQ ID NO: 2472159 - protein, 8 aa, Entamoeba dispar
YSEDPTDL

SEQ ID NO: 2472160 - protein, 9 aa, Entamoeba dispar
YSEENPRKA

SEQ ID NO: 2472161 - protein, 4 aa, Entamoeba dispar
YSEF

SEQ ID NO: 2472162 - protein, 6 aa, Entamoeba dispar
YSEKES

SEQ ID NO: 2472163 - protein, 23 aa, Entamoeba dispar
YSELQRKNSAIEDTTQPKTTPIL

SEQ ID NO: 2472164 - protein, 6 aa, Entamoeba dispar
YSEQDI

SEQ ID NO: 2472165 - protein, 6 aa, Entamoeba dispar
YSESGF

SEQ ID NO: 2472166 - protein, 24 aa, Entamoeba dispar
YSESQESATPRAEKHQRMRSTRSK

SEQ ID NO: 2472167 - protein, 5 aa, Entamoeba dispar
YSETP

SEQ ID NO: 2472168 - protein, 6 aa, Entamoeba dispar
YSFKGN

SEQ ID NO: 2472169 - protein, 6 aa, Entamoeba dispar
YSFNPN

SEQ ID NO: 2472170 - protein, 20 aa, Entamoeba dispar
YSFSSRKNYLNDSKIPQKDS

SEQ ID NO: 2472171 - protein, 5 aa, Entamoeba dispar
YSGDD

SEQ ID NO: 2472172 - protein, 11 aa, Entamoeba dispar
YSGDDSRSIRN

SEQ ID NO: 2472173 - protein, 7 aa, Entamoeba dispar
YSGENIT

SEQ ID NO: 2472174 - protein, 8 aa, Entamoeba dispar
YSGEQDDY

SEQ ID NO: 2472175 - protein, 7 aa, Entamoeba dispar
YSGEQYS

SEQ ID NO: 2472176 - protein, 8 aa, Entamoeba dispar
YSGEVKEL

SEQ ID NO: 2472177 - protein, 14 aa, Entamoeba dispar
YSGGLDITTTTIDG

SEQ ID NO: 2472178 - protein, 6 aa, Entamoeba dispar
YSGGQK

SEQ ID NO: 2472179 - protein, 9 aa, Entamoeba dispar
YSGGSDQGT

SEQ ID NO: 2472180 - protein, 5 aa, Entamoeba dispar
YSGKL

SEQ ID NO: 2472181 - protein, 6 aa, Entamoeba dispar
YSGKTS

SEQ ID NO: 2472182 - protein, 23 aa, Entamoeba dispar
YSGNNTEIGQNKKDIQDDQIEEE

SEQ ID NO: 2472183 - protein, 5 aa, Entamoeba dispar
YSGNQ

SEQ ID NO: 2472184 - protein, 15 aa, Entamoeba dispar
YSGRGYVQQPQFQQN

SEQ ID NO: 2472185 - protein, 24 aa, Entamoeba dispar
YSGRVDVKTTGGRLGPVEGDYPEL

SEQ ID NO: 2472186 - protein, 8 aa, Entamoeba dispar
YSGSNEGH

SEQ ID NO: 2472187 - protein, 17 aa, Entamoeba dispar
YSGTTSPFSSASTESSV

SEQ ID NO: 2472188 - protein, 6 aa, Entamoeba dispar
YSHEDP

SEQ ID NO: 2472189 - protein, 19 aa, Entamoeba dispar
YSHSSQDKQPLSQHPYTNT

SEQ ID NO: 2472190 - protein, 26 aa, Entamoeba dispar
YSHTTNQSSGSTINIGTRNSPPSPIR

SEQ ID NO: 2472191 - protein, 9 aa, Entamoeba dispar
YSIEPSNEN

SEQ ID NO: 2472192 - protein, 6 aa, Entamoeba dispar
YSIKTN

SEQ ID NO: 2472193 - protein, 25 aa, Entamoeba dispar
YSIPNSDFNPLDGPIDENDAGEEQV

SEQ ID NO: 2472194 - protein, 5 aa, Entamoeba dispar
YSIQP

SEQ ID NO: 2472195 - protein, 10 aa, Entamoeba dispar
YSISSNESIT

SEQ ID NO: 2472196 - protein, 32 aa, Entamoeba dispar
YSITDSENEYSREDKEEESDDETEEVEKGFIE

SEQ ID NO: 2472197 - protein, 10 aa, Entamoeba dispar
YSKDISNIST

SEQ ID NO: 2472198 - protein, 9 aa, Entamoeba dispar
YSKDPEETI

SEQ ID NO: 2472199 - protein, 8 aa, Entamoeba dispar
YSKDQKTK

SEQ ID NO: 2472200 - protein, 15 aa, Entamoeba dispar
YSKEDFDELMKTVDV

SEQ ID NO: 2472201 - protein, 10 aa, Entamoeba dispar
YSKEKNNFKS

SEQ ID NO: 2472202 - protein, 10 aa, Entamoeba dispar
YSKEQDNVRE

SEQ ID NO: 2472203 - protein, 15 aa, Entamoeba dispar
YSKEQNEIKKKKGNE

SEQ ID NO: 2472204 - protein, 7 aa, Entamoeba dispar
YSKERRH

SEQ ID NO: 2472205 - protein, 7 aa, Entamoeba dispar
YSKETEV

SEQ ID NO: 2472206 - protein, 9 aa, Entamoeba dispar
YSKGPKKVN

SEQ ID NO: 2472207 - protein, 5 aa, Entamoeba dispar
YSKHP

SEQ ID NO: 2472208 - protein, 6 aa, Entamoeba dispar
YSKIDS

SEQ ID NO: 2472209 - protein, 9 aa, Entamoeba dispar
YSKKNANEK

SEQ ID NO: 2472210 - protein, 4 aa, Entamoeba dispar
YSKN

SEQ ID NO: 2472211 - protein, 9 aa, Entamoeba dispar
YSKNNIPER

SEQ ID NO: 2472212 - protein, 8 aa, Entamoeba dispar
YSKNPHKH

SEQ ID NO: 2472213 - protein, 8 aa, Entamoeba dispar
YSKNTTGT

SEQ ID NO: 2472214 - protein, 23 aa, Entamoeba dispar
YSKNYLPDNVKSQIRQAGEKKQN

SEQ ID NO: 2472215 - protein, 15 aa, Entamoeba dispar
YSKPDKQKESITKLT

SEQ ID NO: 2472216 - protein, 15 aa, Entamoeba dispar
YSKSDREKTKGKIPQ

SEQ ID NO: 2472217 - protein, 6 aa, Entamoeba dispar
YSKSSF

SEQ ID NO: 2472218 - protein, 15 aa, Entamoeba dispar
YSKTPVKRKPSKKIE

SEQ ID NO: 2472219 - protein, 9 aa, Entamoeba dispar
YSKTSSPSR

SEQ ID NO: 2472220 - protein, 11 aa, Entamoeba dispar
YSLKENKEINS

SEQ ID NO: 2472221 - protein, 9 aa, Entamoeba dispar
YSLKRGSGY

SEQ ID NO: 2472222 - protein, 8 aa, Entamoeba dispar
YSLNPKDK

SEQ ID NO: 2472223 - protein, 4 aa, Entamoeba dispar
YSLT

SEQ ID NO: 2472224 - protein, 6 aa, Entamoeba dispar
YSNDMK

SEQ ID NO: 2472225 - protein, 5 aa, Entamoeba dispar
YSNEE

SEQ ID NO: 2472226 - protein, 10 aa, Entamoeba dispar
YSNELSEENA

SEQ ID NO: 2472227 - protein, 15 aa, Entamoeba dispar
YSNENSKKIPSQYKG

SEQ ID NO: 2472228 - protein, 8 aa, Entamoeba dispar
YSNENYDS

SEQ ID NO: 2472229 - protein, 8 aa, Entamoeba dispar
YSNESGNH

SEQ ID NO: 2472230 - protein, 4 aa, Entamoeba dispar
YSNG

SEQ ID NO: 2472231 - protein, 7 aa, Entamoeba dispar
YSNKKGD

SEQ ID NO: 2472232 - protein, 8 aa, Entamoeba dispar
YSNLNSKR

SEQ ID NO: 2472233 - protein, 9 aa, Entamoeba dispar
YSNMDGCSN

SEQ ID NO: 2472234 - protein, 19 aa, Entamoeba dispar
YSNNTPFKKVNQNEFEVIS

SEQ ID NO: 2472235 - protein, 7 aa, Entamoeba dispar
YSNPIHP

SEQ ID NO: 2472236 - protein, 8 aa, Entamoeba dispar
YSNPSQWD

SEQ ID NO: 2472237 - protein, 5 aa, Entamoeba dispar
YSNRS

SEQ ID NO: 2472238 - protein, 11 aa, Entamoeba dispar
YSNRSTQTSGI

SEQ ID NO: 2472239 - protein, 15 aa, Entamoeba dispar
YSNTGGQKSKATNLG

SEQ ID NO: 2472240 - protein, 6 aa, Entamoeba dispar
YSNTTE

SEQ ID NO: 2472241 - protein, 8 aa, Entamoeba dispar
YSPANTDA

SEQ ID NO: 2472242 - protein, 4 aa, Entamoeba dispar
YSPD

SEQ ID NO: 2472243 - protein, 6 aa, Entamoeba dispar
YSPDPL

SEQ ID NO: 2472244 - protein, 8 aa, Entamoeba dispar
YSPEATGI

SEQ ID NO: 2472245 - protein, 10 aa, Entamoeba dispar
YSPEKRLSAS

SEQ ID NO: 2472246 - protein, 14 aa, Entamoeba dispar
YSPHSALDSVNGGI

SEQ ID NO: 2472247 - protein, 21 aa, Entamoeba dispar
YSPIKQAQTPVLPESNIPKSR

SEQ ID NO: 2472248 - protein, 17 aa, Entamoeba dispar
YSPIPQLSEDLSDDGLS

SEQ ID NO: 2472249 - protein, 4 aa, Entamoeba dispar
YSPK

SEQ ID NO: 2472250 - protein, 18 aa, Entamoeba dispar
YSPKEKTTTWSTGRPSYC

SEQ ID NO: 2472251 - protein, 6 aa, Entamoeba dispar
YSPKTN

SEQ ID NO: 2472252 - protein, 24 aa, Entamoeba dispar
YSPKVNRSKAEELARRISEKERDK

SEQ ID NO: 2472253 - protein, 12 aa, Entamoeba dispar
YSPNNSLGNGTE

SEQ ID NO: 2472254 - protein, 11 aa, Entamoeba dispar
YSPNVLSDKEL

SEQ ID NO: 2472255 - protein, 12 aa, Entamoeba dispar
YSPRTAPLEITT

SEQ ID NO: 2472256 - protein, 6 aa, Entamoeba dispar
YSPSGE

SEQ ID NO: 2472257 - protein, 7 aa, Entamoeba dispar
YSPSNPD

SEQ ID NO: 2472258 - protein, 6 aa, Entamoeba dispar
YSPSPD

SEQ ID NO: 2472259 - protein, 6 aa, Entamoeba dispar
YSPSYK

SEQ ID NO: 2472260 - protein, 4 aa, Entamoeba dispar
YSPV

SEQ ID NO: 2472261 - protein, 14 aa, Entamoeba dispar
YSQGINPIEPNASR

SEQ ID NO: 2472262 - protein, 7 aa, Entamoeba dispar
YSQKGKI

SEQ ID NO: 2472263 - protein, 16 aa, Entamoeba dispar
YSQPDEDDDNTRTEEE

SEQ ID NO: 2472264 - protein, 4 aa, Entamoeba dispar
YSQQ

SEQ ID NO: 2472265 - protein, 7 aa, Entamoeba dispar
YSQQKEI

SEQ ID NO: 2472266 - protein, 15 aa, Entamoeba dispar
YSQQPSIQNNNLKKS

SEQ ID NO: 2472267 - protein, 8 aa, Entamoeba dispar
YSQRIEEI

SEQ ID NO: 2472268 - protein, 4 aa, Entamoeba dispar
YSQT

SEQ ID NO: 2472269 - protein, 15 aa, Entamoeba dispar
YSRKSESMDITPGMT

SEQ ID NO: 2472270 - protein, 5 aa, Entamoeba dispar
YSRKV

SEQ ID NO: 2472271 - protein, 6 aa, Entamoeba dispar
YSRRGN

SEQ ID NO: 2472272 - protein, 5 aa, Entamoeba dispar
YSSDD

SEQ ID NO: 2472273 - protein, 5 aa, Entamoeba dispar
YSSDE

SEQ ID NO: 2472274 - protein, 14 aa, Entamoeba dispar
YSSDYITIQVIEQI

SEQ ID NO: 2472275 - protein, 10 aa, Entamoeba dispar
YSSDYKGPVN

SEQ ID NO: 2472276 - protein, 6 aa, Entamoeba dispar
YSSEDA

SEQ ID NO: 2472277 - protein, 7 aa, Entamoeba dispar
YSSEKDV

SEQ ID NO: 2472278 - protein, 10 aa, Entamoeba dispar
YSSELQQKDF

SEQ ID NO: 2472279 - protein, 15 aa, Entamoeba dispar
YSSFNQRKSQFNQQP

SEQ ID NO: 2472280 - protein, 14 aa, Entamoeba dispar
YSSGKNHSNKTETF

SEQ ID NO: 2472281 - protein, 13 aa, Entamoeba dispar
YSSGKNNSNRTET

SEQ ID NO: 2472282 - protein, 9 aa, Entamoeba dispar
YSSGNSIIQ

SEQ ID NO: 2472283 - protein, 11 aa, Entamoeba dispar
YSSGNYSVNAS

SEQ ID NO: 2472284 - protein, 5 aa, Entamoeba dispar
YSSIN

SEQ ID NO: 2472285 - protein, 14 aa, Entamoeba dispar
YSSISKEDRIAAKN

SEQ ID NO: 2472286 - protein, 5 aa, Entamoeba dispar
YSSLK

SEQ ID NO: 2472287 - protein, 4 aa, Entamoeba dispar
YSSN

SEQ ID NO: 2472288 - protein, 9 aa, Entamoeba dispar
YSSNPSDSL

SEQ ID NO: 2472289 - protein, 8 aa, Entamoeba dispar
YSSNSTFS

SEQ ID NO: 2472290 - protein, 4 aa, Entamoeba dispar
YSSP

SEQ ID NO: 2472291 - protein, 16 aa, Entamoeba dispar
YSSPDNPNPSPTFGIS

SEQ ID NO: 2472292 - protein, 11 aa, Entamoeba dispar
YSSPETLRPEE

SEQ ID NO: 2472293 - protein, 6 aa, Entamoeba dispar
YSSPSP

SEQ ID NO: 2472294 - protein, 7 aa, Entamoeba dispar
YSSQELD

SEQ ID NO: 2472295 - protein, 8 aa, Entamoeba dispar
YSSQPLET

SEQ ID NO: 2472296 - protein, 32 aa, Entamoeba dispar
YSSRSRSPSRDRHYRKHSTSHEHSSSRRRYYD

SEQ ID NO: 2472297 - protein, 41 aa, Entamoeba dispar
YSSSPTRLNSPHITPTLPDSVPSSPHTTPALRERSGSATAK

SEQ ID NO: 2472298 - protein, 22 aa, Entamoeba dispar
YSSSSEPQNSDDNSKDNTTEDY

SEQ ID NO: 2472299 - protein, 8 aa, Entamoeba dispar
YSSSSIDL

SEQ ID NO: 2472300 - protein, 6 aa, Entamoeba dispar
YSSSSY

SEQ ID NO: 2472301 - protein, 11 aa, Entamoeba dispar
YSSTNGDFEAR

SEQ ID NO: 2472302 - protein, 12 aa, Entamoeba dispar
YSSTPDKETDIN

SEQ ID NO: 2472303 - protein, 7 aa, Entamoeba dispar
YSSVPDP

SEQ ID NO: 2472304 - protein, 8 aa, Entamoeba dispar
YSSVTPLR

SEQ ID NO: 2472305 - protein, 5 aa, Entamoeba dispar
YSTDE

SEQ ID NO: 2472306 - protein, 11 aa, Entamoeba dispar
YSTDKATVTNA

SEQ ID NO: 2472307 - protein, 7 aa, Entamoeba dispar
YSTDPLK

SEQ ID NO: 2472308 - protein, 9 aa, Entamoeba dispar
YSTDSEGVL

SEQ ID NO: 2472309 - protein, 4 aa, Entamoeba dispar
YSTE

SEQ ID NO: 2472310 - protein, 14 aa, Entamoeba dispar
YSTECSKEYSKAEG

SEQ ID NO: 2472311 - protein, 6 aa, Entamoeba dispar
YSTEGN

SEQ ID NO: 2472312 - protein, 10 aa, Entamoeba dispar
YSTESTTMTV

SEQ ID NO: 2472313 - protein, 5 aa, Entamoeba dispar
YSTGA

SEQ ID NO: 2472314 - protein, 7 aa, Entamoeba dispar
YSTGFSP

SEQ ID NO: 2472315 - protein, 9 aa, Entamoeba dispar
YSTGISSES

SEQ ID NO: 2472316 - protein, 7 aa, Entamoeba dispar
YSTGRDA

SEQ ID NO: 2472317 - protein, 19 aa, Entamoeba dispar
YSTKHFNDEDTPKNIKVLL

SEQ ID NO: 2472318 - protein, 20 aa, Entamoeba dispar
YSTKTSPQMSNRMGEASKGV

SEQ ID NO: 2472319 - protein, 8 aa, Entamoeba dispar
YSTNTEAL

SEQ ID NO: 2472320 - protein, 4 aa, Entamoeba dispar
YSTP

SEQ ID NO: 2472321 - protein, 12 aa, Entamoeba dispar
YSTPKTSQTQIN

SEQ ID NO: 2472322 - protein, 22 aa, Entamoeba dispar
YSTPYDPYSTRGSERPISNSSI

SEQ ID NO: 2472323 - protein, 9 aa, Entamoeba dispar
YSTQNQQSI

SEQ ID NO: 2472324 - protein, 4 aa, Entamoeba dispar
YSTR

SEQ ID NO: 2472325 - protein, 7 aa, Entamoeba dispar
YSTSHSF

SEQ ID NO: 2472326 - protein, 22 aa, Entamoeba dispar
YSTTKVKKPTSYPPALPKTKQL

SEQ ID NO: 2472327 - protein, 13 aa, Entamoeba dispar
YSTTSEKDIHNQS

SEQ ID NO: 2472328 - protein, 10 aa, Entamoeba dispar
YSTTVNNQTY

SEQ ID NO: 2472329 - protein, 5 aa, Entamoeba dispar
YSTYY

SEQ ID NO: 2472330 - protein, 8 aa, Entamoeba dispar
YSTYYKTE

SEQ ID NO: 2472331 - protein, 37 aa, Entamoeba dispar
YSVGSSSFSNDKKRKIIPTKHETPTIKKKKVSSSLDE

SEQ ID NO: 2472332 - protein, 4 aa, Entamoeba dispar
YSVH

SEQ ID NO: 2472333 - protein, 13 aa, Entamoeba dispar
YSVKCKKRGQTAW

SEQ ID NO: 2472334 - protein, 4 aa, Entamoeba dispar
YSVS

SEQ ID NO: 2472335 - protein, 17 aa, Entamoeba dispar
YSYDGKEELYSGITGKA

SEQ ID NO: 2472336 - protein, 9 aa, Entamoeba dispar
YSYDPRNQT

SEQ ID NO: 2472337 - protein, 6 aa, Entamoeba dispar
YSYENK

SEQ ID NO: 2472338 - protein, 17 aa, Entamoeba dispar
YSYGKAINKPSDEQGSI

SEQ ID NO: 2472339 - protein, 17 aa, Entamoeba dispar
YSYGKTINKPSDEQGSI

SEQ ID NO: 2472340 - protein, 9 aa, Entamoeba dispar
YTAANDEEL

SEQ ID NO: 2472341 - protein, 5 aa, Entamoeba dispar
YTADK

SEQ ID NO: 2472342 - protein, 14 aa, Entamoeba dispar
YTAEAESELTITEG

SEQ ID NO: 2472343 - protein, 5 aa, Entamoeba dispar
YTAGE

SEQ ID NO: 2472344 - protein, 16 aa, Entamoeba dispar
YTANGTGGKSVYAQSG

SEQ ID NO: 2472345 - protein, 4 aa, Entamoeba dispar
YTAP

SEQ ID NO: 2472346 - protein, 10 aa, Entamoeba dispar
YTAPTDEALK

SEQ ID NO: 2472347 - protein, 5 aa, Entamoeba dispar
YTASH

SEQ ID NO: 2472348 - protein, 14 aa, Entamoeba dispar
YTDPSANSNDRRQA

SEQ ID NO: 2472349 - protein, 15 aa, Entamoeba dispar
YTDPSANSNDRRQAY

SEQ ID NO: 2472350 - protein, 14 aa, Entamoeba dispar
YTDPSASSNDRRQA

SEQ ID NO: 2472351 - protein, 78 aa, Entamoeba dispar
YTDRSRSRSREHSHRYEDYKRNDDYSRRDDYKRRDDYDRRDDYDRRDNYDRRDDYKRRDDYSRRNDHGRSYRSSGNVV

SEQ ID NO: 2472352 - protein, 18 aa, Entamoeba dispar
YTEAKAAYTEAEKNNNNI

SEQ ID NO: 2472353 - protein, 16 aa, Entamoeba dispar
YTEEDRDKYGNTIPSE

SEQ ID NO: 2472354 - protein, 7 aa, Entamoeba dispar
YTEEDRK

SEQ ID NO: 2472355 - protein, 18 aa, Entamoeba dispar
YTEEDRKKYGNTIPSEVK

SEQ ID NO: 2472356 - protein, 7 aa, Entamoeba dispar
YTEEESR

SEQ ID NO: 2472357 - protein, 10 aa, Entamoeba dispar
YTEEIKDNNY

SEQ ID NO: 2472358 - protein, 9 aa, Entamoeba dispar
YTEENATDE

SEQ ID NO: 2472359 - protein, 4 aa, Entamoeba dispar
YTEI

SEQ ID NO: 2472360 - protein, 9 aa, Entamoeba dispar
YTEIEGKQG

SEQ ID NO: 2472361 - protein, 6 aa, Entamoeba dispar
YTEKGE

SEQ ID NO: 2472362 - protein, 21 aa, Entamoeba dispar
YTENSKSSDSKQLKEDLETNT

SEQ ID NO: 2472363 - protein, 9 aa, Entamoeba dispar
YTEQKKPTI

SEQ ID NO: 2472364 - protein, 11 aa, Entamoeba dispar
YTEQPTSNNNI

SEQ ID NO: 2472365 - protein, 9 aa, Entamoeba dispar
YTESDREKY

SEQ ID NO: 2472366 - protein, 13 aa, Entamoeba dispar
YTESDREKYGCPI

SEQ ID NO: 2472367 - protein, 13 aa, Entamoeba dispar
YTEYDREKYGTTI

SEQ ID NO: 2472368 - protein, 9 aa, Entamoeba dispar
YTEYDRNKY

SEQ ID NO: 2472369 - protein, 5 aa, Entamoeba dispar
YTGDG

SEQ ID NO: 2472370 - protein, 6 aa, Entamoeba dispar
YTGEGL

SEQ ID NO: 2472371 - protein, 11 aa, Entamoeba dispar
YTGEKNKAKIA

SEQ ID NO: 2472372 - protein, 7 aa, Entamoeba dispar
YTGKSSY

SEQ ID NO: 2472373 - protein, 5 aa, Entamoeba dispar
YTGRP

SEQ ID NO: 2472374 - protein, 6 aa, Entamoeba dispar
YTGTTQ

SEQ ID NO: 2472375 - protein, 18 aa, Entamoeba dispar
YTGYGGGKGEVDNSTVVG

SEQ ID NO: 2472376 - protein, 18 aa, Entamoeba dispar
YTGYGRNEGESSEINSVE

SEQ ID NO: 2472377 - protein, 5 aa, Entamoeba dispar
YTGYY

SEQ ID NO: 2472378 - protein, 4 aa, Entamoeba dispar
YTHP

SEQ ID NO: 2472379 - protein, 12 aa, Entamoeba dispar
YTHPKHPDYSAL

SEQ ID NO: 2472380 - protein, 9 aa, Entamoeba dispar
YTINDSTGS

SEQ ID NO: 2472381 - protein, 11 aa, Entamoeba dispar
YTISKEKSSNV

SEQ ID NO: 2472382 - protein, 11 aa, Entamoeba dispar
YTKAGNNAVYD

SEQ ID NO: 2472383 - protein, 8 aa, Entamoeba dispar
YTKDEQPI

SEQ ID NO: 2472384 - protein, 4 aa, Entamoeba dispar
YTKE

SEQ ID NO: 2472385 - protein, 17 aa, Entamoeba dispar
YTKEDRDTYGNTIPSEV

SEQ ID NO: 2472386 - protein, 16 aa, Entamoeba dispar
YTKEDRHKHGTTIPPE

SEQ ID NO: 2472387 - protein, 16 aa, Entamoeba dispar
YTKEDRNGYGTTIPPE

SEQ ID NO: 2472388 - protein, 17 aa, Entamoeba dispar
YTKEDRNKYGNTIPSEV

SEQ ID NO: 2472389 - protein, 21 aa, Entamoeba dispar
YTKEDRNKYGNTIPSEVKSLG

SEQ ID NO: 2472390 - protein, 9 aa, Entamoeba dispar
YTKEDRWKY

SEQ ID NO: 2472391 - protein, 10 aa, Entamoeba dispar
YTKEGGKKKS

SEQ ID NO: 2472392 - protein, 17 aa, Entamoeba dispar
YTKGESQTDVEVTTATD

SEQ ID NO: 2472393 - protein, 20 aa, Entamoeba dispar
YTKQDRKKYGNTIPPEVKSL

SEQ ID NO: 2472394 - protein, 12 aa, Entamoeba dispar
YTKQNLKDVNGP

SEQ ID NO: 2472395 - protein, 9 aa, Entamoeba dispar
YTKREDEKY

SEQ ID NO: 2472396 - protein, 10 aa, Entamoeba dispar
YTKRQDDRNY

SEQ ID NO: 2472397 - protein, 16 aa, Entamoeba dispar
YTKSDRMKYGNKIPSE

SEQ ID NO: 2472398 - protein, 10 aa, Entamoeba dispar
YTKSDRVEYG

SEQ ID NO: 2472399 - protein, 5 aa, Entamoeba dispar
YTKSS

SEQ ID NO: 2472400 - protein, 4 aa, Entamoeba dispar
YTKT

SEQ ID NO: 2472401 - protein, 7 aa, Entamoeba dispar
YTKTNPD

SEQ ID NO: 2472402 - protein, 9 aa, Entamoeba dispar
YTKTTFTEK

SEQ ID NO: 2472403 - protein, 4 aa, Entamoeba dispar
YTLE

SEQ ID NO: 2472404 - protein, 6 aa, Entamoeba dispar
YTLPDG

SEQ ID NO: 2472405 - protein, 21 aa, Entamoeba dispar
YTNDETDNYTENNKEELKKNS

SEQ ID NO: 2472406 - protein, 15 aa, Entamoeba dispar
YTNDTTDVSEQNIPI

SEQ ID NO: 2472407 - protein, 6 aa, Entamoeba dispar
YTNEAR

SEQ ID NO: 2472408 - protein, 13 aa, Entamoeba dispar
YTNEDRKKCGGMI

SEQ ID NO: 2472409 - protein, 19 aa, Entamoeba dispar
YTNEEEKKESEKETEPKEI

SEQ ID NO: 2472410 - protein, 10 aa, Entamoeba dispar
YTNGKKINDE

SEQ ID NO: 2472411 - protein, 5 aa, Entamoeba dispar
YTNIS

SEQ ID NO: 2472412 - protein, 9 aa, Entamoeba dispar
YTNKCKEAA

SEQ ID NO: 2472413 - protein, 10 aa, Entamoeba dispar
YTNKENVQNN

SEQ ID NO: 2472414 - protein, 7 aa, Entamoeba dispar
YTNNPIY

SEQ ID NO: 2472415 - protein, 4 aa, Entamoeba dispar
YTNP

SEQ ID NO: 2472416 - protein, 8 aa, Entamoeba dispar
YTNPPKDV

SEQ ID NO: 2472417 - protein, 5 aa, Entamoeba dispar
YTNSL

SEQ ID NO: 2472418 - protein, 8 aa, Entamoeba dispar
YTNSQVTP

SEQ ID NO: 2472419 - protein, 4 aa, Entamoeba dispar
YTNY

SEQ ID NO: 2472420 - protein, 23 aa, Entamoeba dispar
YTPDERSPCENSSSPDVFAFDEE

SEQ ID NO: 2472421 - protein, 4 aa, Entamoeba dispar
YTPE

SEQ ID NO: 2472422 - protein, 5 aa, Entamoeba dispar
YTPEE

SEQ ID NO: 2472423 - protein, 10 aa, Entamoeba dispar
YTPEKRPTAV

SEQ ID NO: 2472424 - protein, 10 aa, Entamoeba dispar
YTPESIPQNI

SEQ ID NO: 2472425 - protein, 5 aa, Entamoeba dispar
YTPIP

SEQ ID NO: 2472426 - protein, 5 aa, Entamoeba dispar
YTPKK

SEQ ID NO: 2472427 - protein, 4 aa, Entamoeba dispar
YTPN

SEQ ID NO: 2472428 - protein, 4 aa, Entamoeba dispar
YTPP

SEQ ID NO: 2472429 - protein, 10 aa, Entamoeba dispar
YTPPKQRFIP

SEQ ID NO: 2472430 - protein, 7 aa, Entamoeba dispar
YTPQTVK

SEQ ID NO: 2472431 - protein, 7 aa, Entamoeba dispar
YTPSDGI

SEQ ID NO: 2472432 - protein, 6 aa, Entamoeba dispar
YTPSPK

SEQ ID NO: 2472433 - protein, 6 aa, Entamoeba dispar
YTPSSL

SEQ ID NO: 2472434 - protein, 8 aa, Entamoeba dispar
YTPSSNVN

SEQ ID NO: 2472435 - protein, 10 aa, Entamoeba dispar
YTPVDSPNYR

SEQ ID NO: 2472436 - protein, 6 aa, Entamoeba dispar
YTQPDI

SEQ ID NO: 2472437 - protein, 8 aa, Entamoeba dispar
YTQQQPNL

SEQ ID NO: 2472438 - protein, 5 aa, Entamoeba dispar
YTQRR

SEQ ID NO: 2472439 - protein, 12 aa, Entamoeba dispar
YTQSDRKSYGNI

SEQ ID NO: 2472440 - protein, 19 aa, Entamoeba dispar
YTQSDRNKYGNTITPEVTS

SEQ ID NO: 2472441 - protein, 26 aa, Entamoeba dispar
YTQSSPDTILESTRKRVSSSKSITNS

SEQ ID NO: 2472442 - protein, 19 aa, Entamoeba dispar
YTQYEKKKKVTKKKISKKK

SEQ ID NO: 2472443 - protein, 16 aa, Entamoeba dispar
YTRDDSVKEVTIEVDH

SEQ ID NO: 2472444 - protein, 14 aa, Entamoeba dispar
YTREDRNKYGNTIP

SEQ ID NO: 2472445 - protein, 23 aa, Entamoeba dispar
YTRERTKRGCTADKTVSKKNLGR

SEQ ID NO: 2472446 - protein, 7 aa, Entamoeba dispar
YTRPDGR

SEQ ID NO: 2472447 - protein, 13 aa, Entamoeba dispar
YTRSDRNKYGNTI

SEQ ID NO: 2472448 - protein, 10 aa, Entamoeba dispar
YTSDSNASTA

SEQ ID NO: 2472449 - protein, 4 aa, Entamoeba dispar
YTSE

SEQ ID NO: 2472450 - protein, 7 aa, Entamoeba dispar
YTSEKEP

SEQ ID NO: 2472451 - protein, 25 aa, Entamoeba dispar
YTSGKGSSAAGLTAAVNKDSSTGEF

SEQ ID NO: 2472452 - protein, 6 aa, Entamoeba dispar
YTSNAN

SEQ ID NO: 2472453 - protein, 7 aa, Entamoeba dispar
YTSNEPQ

SEQ ID NO: 2472454 - protein, 7 aa, Entamoeba dispar
YTSNGIH

SEQ ID NO: 2472455 - protein, 6 aa, Entamoeba dispar
YTSPKG

SEQ ID NO: 2472456 - protein, 11 aa, Entamoeba dispar
YTSPNNTIDIP

SEQ ID NO: 2472457 - protein, 11 aa, Entamoeba dispar
YTSPSSAKLTQ

SEQ ID NO: 2472458 - protein, 9 aa, Entamoeba dispar
YTSQNNQEQ

SEQ ID NO: 2472459 - protein, 8 aa, Entamoeba dispar
YTSQQPNL

SEQ ID NO: 2472460 - protein, 15 aa, Entamoeba dispar
YTSSPRQNKEVPSQT

SEQ ID NO: 2472461 - protein, 10 aa, Entamoeba dispar
YTSSQDRGKY

SEQ ID NO: 2472462 - protein, 8 aa, Entamoeba dispar
YTSSSKHN

SEQ ID NO: 2472463 - protein, 7 aa, Entamoeba dispar
YTSSYSE

SEQ ID NO: 2472464 - protein, 13 aa, Entamoeba dispar
YTSTDLVSKGKQY

SEQ ID NO: 2472465 - protein, 10 aa, Entamoeba dispar
YTSTDNESLP

SEQ ID NO: 2472466 - protein, 5 aa, Entamoeba dispar
YTSTN

SEQ ID NO: 2472467 - protein, 8 aa, Entamoeba dispar
YTSTPEPF

SEQ ID NO: 2472468 - protein, 15 aa, Entamoeba dispar
YTSTPERTGDDARSI

SEQ ID NO: 2472469 - protein, 13 aa, Entamoeba dispar
YTTASPTVPTTFS

SEQ ID NO: 2472470 - protein, 6 aa, Entamoeba dispar
YTTDET

SEQ ID NO: 2472471 - protein, 5 aa, Entamoeba dispar
YTTDN

SEQ ID NO: 2472472 - protein, 8 aa, Entamoeba dispar
YTTEETGM

SEQ ID NO: 2472473 - protein, 6 aa, Entamoeba dispar
YTTEPI

SEQ ID NO: 2472474 - protein, 14 aa, Entamoeba dispar
YTTFGNRTHSSDKD

SEQ ID NO: 2472475 - protein, 9 aa, Entamoeba dispar
YTTKGESVK

SEQ ID NO: 2472476 - protein, 10 aa, Entamoeba dispar
YTTKRTSISP

SEQ ID NO: 2472477 - protein, 5 aa, Entamoeba dispar
YTTND

SEQ ID NO: 2472478 - protein, 10 aa, Entamoeba dispar
YTTQREAESY

SEQ ID NO: 2472479 - protein, 16 aa, Entamoeba dispar
YTTQSDENVKIDGVSS

SEQ ID NO: 2472480 - protein, 4 aa, Entamoeba dispar
YTTR

SEQ ID NO: 2472481 - protein, 4 aa, Entamoeba dispar
YTTS

SEQ ID NO: 2472482 - protein, 5 aa, Entamoeba dispar
YTTSN

SEQ ID NO: 2472483 - protein, 10 aa, Entamoeba dispar
YTTSRTDTRV

SEQ ID NO: 2472484 - protein, 7 aa, Entamoeba dispar
YTTTPER

SEQ ID NO: 2472485 - protein, 5 aa, Entamoeba dispar
YTTWS

SEQ ID NO: 2472486 - protein, 8 aa, Entamoeba dispar
YTVDPRTT

SEQ ID NO: 2472487 - protein, 10 aa, Entamoeba dispar
YTYDQPGIRN

SEQ ID NO: 2472488 - protein, 18 aa, Entamoeba dispar
YTYEDRNKYGNTIPSEVK

SEQ ID NO: 2472489 - protein, 12 aa, Entamoeba dispar
YTYGNTIPPEVK

SEQ ID NO: 2472490 - protein, 13 aa, Entamoeba dispar
YTYNQEKAVASGN

SEQ ID NO: 2472491 - protein, 15 aa, Entamoeba dispar
YTYQATVKQDPTNYT

SEQ ID NO: 2472492 - protein, 10 aa, Entamoeba dispar
YTYQDRNKYG

SEQ ID NO: 2472493 - protein, 4 aa, Entamoeba dispar
YTYR

SEQ ID NO: 2472494 - protein, 4 aa, Entamoeba dispar
YVDG

SEQ ID NO: 2472495 - protein, 8 aa, Entamoeba dispar
YVEDDDAT

SEQ ID NO: 2472496 - protein, 5 aa, Entamoeba dispar
YVEDG

SEQ ID NO: 2472497 - protein, 7 aa, Entamoeba dispar
YVEGKKG

SEQ ID NO: 2472498 - protein, 12 aa, Entamoeba dispar
YVEKEKKEQQDL

SEQ ID NO: 2472499 - protein, 9 aa, Entamoeba dispar
YVGTDRPNQ

SEQ ID NO: 2472500 - protein, 4 aa, Entamoeba dispar
YVNA

SEQ ID NO: 2472501 - protein, 6 aa, Entamoeba dispar
YVNGPT

SEQ ID NO: 2472502 - protein, 4 aa, Entamoeba dispar
YVNP

SEQ ID NO: 2472503 - protein, 5 aa, Entamoeba dispar
YVPED

SEQ ID NO: 2472504 - protein, 6 aa, Entamoeba dispar
YVPGSS

SEQ ID NO: 2472505 - protein, 24 aa, Entamoeba dispar
YVPPALRKQQGDNSIPSQYTIPPK

SEQ ID NO: 2472506 - protein, 4 aa, Entamoeba dispar
YVPQ

SEQ ID NO: 2472507 - protein, 7 aa, Entamoeba dispar
YVQKQNP

SEQ ID NO: 2472508 - protein, 7 aa, Entamoeba dispar
YVSSTSK

SEQ ID NO: 2472509 - protein, 12 aa, Entamoeba dispar
YVTSSGYPLPGA

SEQ ID NO: 2472510 - protein, 12 aa, Entamoeba dispar
YYADSNGKRNEL

SEQ ID NO: 2472511 - protein, 13 aa, Entamoeba dispar
YYAQGKTKEKIEQ

SEQ ID NO: 2472512 - protein, 5 aa, Entamoeba dispar
YYDGS

SEQ ID NO: 2472513 - protein, 16 aa, Entamoeba dispar
YYDPNPDERIDDKEGT

SEQ ID NO: 2472514 - protein, 10 aa, Entamoeba dispar
YYDTQDPSFD

SEQ ID NO: 2472515 - protein, 4 aa, Entamoeba dispar
YYEE

SEQ ID NO: 2472516 - protein, 10 aa, Entamoeba dispar
YYENDKPFEV

SEQ ID NO: 2472517 - protein, 8 aa, Entamoeba dispar
YYGEESKI

SEQ ID NO: 2472518 - protein, 6 aa, Entamoeba dispar
YYGSRS

SEQ ID NO: 2472519 - protein, 30 aa, Entamoeba dispar
YYHQEENNNNEEEEDIKEEINNNKEGEVEE

SEQ ID NO: 2472520 - protein, 6 aa, Entamoeba dispar
YYKETA

SEQ ID NO: 2472521 - protein, 6 aa, Entamoeba dispar
YYKGPE

SEQ ID NO: 2472522 - protein, 16 aa, Entamoeba dispar
YYNEISNNNNTNYQNN

SEQ ID NO: 2472523 - protein, 18 aa, Entamoeba dispar
YYNEISNTNINDQNNIKL

SEQ ID NO: 2472524 - protein, 5 aa, Entamoeba dispar
YYNER

SEQ ID NO: 2472525 - protein, 9 aa, Entamoeba dispar
YYNGSDGKN

SEQ ID NO: 2472526 - protein, 14 aa, Entamoeba dispar
YYNNEGNENTTKIR

SEQ ID NO: 2472527 - protein, 10 aa, Entamoeba dispar
YYNSNGTFGE

SEQ ID NO: 2472528 - protein, 4 aa, Entamoeba dispar
YYPP

SEQ ID NO: 2472529 - protein, 19 aa, Entamoeba dispar
YYPSGDSGLLASGSDSPND

SEQ ID NO: 2472530 - protein, 7 aa, Entamoeba dispar
YYQQDDH

SEQ ID NO: 2472531 - protein, 4 aa, Entamoeba dispar
YYRG

SEQ ID NO: 2472532 - protein, 6 aa, Entamoeba dispar
YYRGAS

SEQ ID NO: 2472533 - protein, 6 aa, Entamoeba dispar
YYRGAT

SEQ ID NO: 2472534 - protein, 5 aa, Entamoeba dispar
YYRGT

SEQ ID NO: 2472535 - protein, 4 aa, Entamoeba dispar
YYRS

SEQ ID NO: 2472536 - protein, 9 aa, Entamoeba dispar
YYSGTPDGG

SEQ ID NO: 2472537 - protein, 6 aa, Entamoeba dispar
YYSQRD

SEQ ID NO: 2472538 - protein, 8 aa, Entamoeba dispar
YYSQTKTE

SEQ ID NO: 2472539 - protein, 25 aa, Entamoeba dispar
YYSRTQKDYYNQVNRDEQAKQNGQV

SEQ ID NO: 2472540 - protein, 7 aa, Entamoeba dispar
YYSTNEE

SEQ ID NO: 2472541 - protein, 40 aa, Entamoeba dispar
YYTRTQKDYYNQVKQDEQTKQSGQVTKVDNTVKTNEDYAK

SEQ ID NO: 2472542 - protein, 38 aa, Entamoeba dispar
YYTRTQKDYYNQVNRDEQAKQNGQVTKVDNTVKSNDDY

SEQ ID NO: 2472543 - protein, 19 aa, Entamoeba dispar
GRLTDGRGRTVDFKNTIVI

SEQ ID NO: 2472544 - protein, 20 aa, Entamoeba dispar
DVPSNLQCRVIGLDMGALIA

SEQ ID NO: 2472545 - protein, 23 aa, Entamoeba dispar
IRRKPYSVILFDEIEKAHPQVFN

SEQ ID NO: 2472546 - protein, 27 aa, Entamoeba dispar
GGLGNEKRPTGSFMFLGPSGVGKTELA

SEQ ID NO: 2472547 - protein, 19 aa, Entamoeba dispar
KLCIDECENCQFIINKNQI

SEQ ID NO: 2472548 - protein, 19 aa, Entamoeba dispar
RYINGRFLPDKAIDLVDEA

SEQ ID NO: 2472549 - protein, 24 aa, Entamoeba dispar
KGTMKRKGKEIISKMAKEGKDCWE

SEQ ID NO: 2472550 - protein, 19 aa, Entamoeba dispar
NAYIMPIHMMEAIVEEESN

SEQ ID NO: 2472551 - protein, 18 aa, Entamoeba dispar
RMIGRRFSEPSIQKDMKH

SEQ ID NO: 2472552 - protein, 23 aa, Entamoeba dispar
VKESKIPIILFIDEIHTVLGAGA

SEQ ID NO: 2472553 - protein, 18 aa, Entamoeba dispar
GRTVDFKNTIVIMTSNLG

SEQ ID NO: 2472554 - protein, 17 aa, Entamoeba dispar
ICIERKGTMKRKGKEII

SEQ ID NO: 2472555 - protein, 26 aa, Entamoeba dispar
KEGKDCWEYAKELECVDTLIESTPDE

SEQ ID NO: 2472556 - protein, 28 aa, Entamoeba dispar
KELKEIVKLQMGEVIKMIKKRYPLSEVE

SEQ ID NO: 2472557 - protein, 24 aa, Entamoeba dispar
CKINIKSDCIERLKLERNKQTQIK

SEQ ID NO: 2472558 - protein, 18 aa, Entamoeba dispar
CRVIGLDMGALIAGAQYR

SEQ ID NO: 2472559 - protein, 25 aa, Entamoeba dispar
ERFRCPEALFQPSFLGMECNGIHET

SEQ ID NO: 2472560 - protein, 18 aa, Entamoeba dispar
FKLFTIERIKTVDQEYQM

SEQ ID NO: 2472561 - protein, 22 aa, Entamoeba dispar
INVKSKCPINKLIVSQSKQVNI

SEQ ID NO: 2472562 - protein, 25 aa, Entamoeba dispar
ITTGKWKVNLPWEFITSENYPKTIE

SEQ ID NO: 2472563 - protein, 17 aa, Entamoeba dispar
LLDEGRLTDGRGRTVDF

SEQ ID NO: 2472564 - protein, 23 aa, Entamoeba dispar
NEEVKFESVVPFTNFNHHFYYDD

SEQ ID NO: 2472565 - protein, 19 aa, Entamoeba dispar
PNSYCDVSKYFPCVENQNS

SEQ ID NO: 2472566 - protein, 18 aa, Entamoeba dispar
RPRHVSVMAGMGQKDAYV

SEQ ID NO: 2472567 - protein, 19 aa, Entamoeba dispar
YKGKYVVLLFYPLDWTFVC

SEQ ID NO: 2472568 - protein, 27 aa, Entamoeba dispar
AVSRAYYPGARWGITRRLIASSLQEKS

SEQ ID NO: 2472569 - protein, 21 aa, Entamoeba dispar
DIKEKLCYVAEDFNEEMQKAA

SEQ ID NO: 2472570 - protein, 18 aa, Entamoeba dispar
DVDIRKDLYGNIVLSGGT

SEQ ID NO: 2472571 - protein, 24 aa, Entamoeba dispar
EYCKKECCCPRIKAFKKFMNTFEK

SEQ ID NO: 2472572 - protein, 18 aa, Entamoeba dispar
FETKVLDLNAICFVAQSS

SEQ ID NO: 2472573 - protein, 27 aa, Entamoeba dispar
FEVIIPIDDLLPFAAMKMFPNALFGNL

SEQ ID NO: 2472574 - protein, 21 aa, Entamoeba dispar
GESKGKIGIFPSHYVERDVKI

SEQ ID NO: 2472575 - protein, 19 aa, Entamoeba dispar
GSGMCKAGFAGDDAPRAVF

SEQ ID NO: 2472576 - protein, 17 aa, Entamoeba dispar
IKLKNILHEAALLQVEI

SEQ ID NO: 2472577 - protein, 19 aa, Entamoeba dispar
IKMIKKRYPLSEVEMTESA

SEQ ID NO: 2472578 - protein, 17 aa, Entamoeba dispar
KNIFKKDINEFIIPSSI

SEQ ID NO: 2472579 - protein, 24 aa, Entamoeba dispar
KVKSPISIICCDTIILTQYNNQIK

SEQ ID NO: 2472580 - protein, 23 aa, Entamoeba dispar
LLCGTEFFQHYAGMYDQFKIDGV

SEQ ID NO: 2472581 - protein, 17 aa, Entamoeba dispar
LYGNIVLSGGTSMYPGI

SEQ ID NO: 2472582 - protein, 26 aa, Entamoeba dispar
NKLKSIEVINCRECKINIKSDCIERL

SEQ ID NO: 2472583 - protein, 17 aa, Entamoeba dispar
PSIVGRPRHVSVMAGMG

SEQ ID NO: 2472584 - protein, 26 aa, Entamoeba dispar
RKSIDCSAIMKYCCNSNSSDEYVYTY

SEQ ID NO: 2472585 - protein, 24 aa, Entamoeba dispar
VLKEAKPVPDFIPLESVDIPNEVE

SEQ ID NO: 2472586 - protein, 23 aa, Entamoeba dispar
YNLKQNNLFISFGRKSIDCSAIM

SEQ ID NO: 2472587 - protein, 19 aa, Entamoeba dispar
AAWNPDFLLSVLLGNQTAT

SEQ ID NO: 2472588 - protein, 23 aa, Entamoeba dispar
AQGNKYRMGNLFIVGPTKTGKTE

SEQ ID NO: 2472589 - protein, 18 aa, Entamoeba dispar
DRFSNIVIEQLKKEFTKV

SEQ ID NO: 2472590 - protein, 23 aa, Entamoeba dispar
EDNSFKPYIGFIGYARNNNGLVV

SEQ ID NO: 2472591 - protein, 20 aa, Entamoeba dispar
EVKNAVITCPAYFNDSQRQA

SEQ ID NO: 2472592 - protein, 17 aa, Entamoeba dispar
FLGPSGVGKTELAKALA

SEQ ID NO: 2472593 - protein, 24 aa, Entamoeba dispar
FQEKKELYGSLIVENQTDVHQLLK

SEQ ID NO: 2472594 - protein, 18 aa, Entamoeba dispar
FQGNIERFHFNPIPLNEY

SEQ ID NO: 2472595 - protein, 20 aa, Entamoeba dispar
GEASMTSHCNLLGKFELTGI

SEQ ID NO: 2472596 - protein, 19 aa, Entamoeba dispar
GNGMGRVGVIVKREVHPGS

SEQ ID NO: 2472597 - protein, 18 aa, Entamoeba dispar
IDTTHIFYDLFKNTNFNS

SEQ ID NO: 2472598 - protein, 22 aa, Entamoeba dispar
IEYPDTSILGFGQRGHVDVLSN

SEQ ID NO: 2472599 - protein, 19 aa, Entamoeba dispar
IKMIKKRYPLSEVEMTEAA

SEQ ID NO: 2472600 - protein, 31 aa, Entamoeba dispar
KESNDRCPIMLVCQDCFWRCTLQGGCEYICN

SEQ ID NO: 2472601 - protein, 21 aa, Entamoeba dispar
KEVKNAVITCPAYFNDSQRQA

SEQ ID NO: 2472602 - protein, 24 aa, Entamoeba dispar
KIKKYLKRHPLLIEEEIPEELIER

SEQ ID NO: 2472603 - protein, 25 aa, Entamoeba dispar
KINELRMEFGDFIPRNIRTQIKDLD

SEQ ID NO: 2472604 - protein, 32 aa, Entamoeba dispar
KNTNFNSFCKCFKRVKIDKALAVLSISDIKMK

SEQ ID NO: 2472605 - protein, 17 aa, Entamoeba dispar
LDDIIVFSPLSEKELKE

SEQ ID NO: 2472606 - protein, 20 aa, Entamoeba dispar
LKDLIKTPIYGMNYEKFMPA

SEQ ID NO: 2472607 - protein, 17 aa, Entamoeba dispar
LNLHKKRYGSYGSIHGW

SEQ ID NO: 2472608 - protein, 22 aa, Entamoeba dispar
MKGKEVKMVRCHDIKIVDTSNS

SEQ ID NO: 2472609 - protein, 25 aa, Entamoeba dispar
NDSYILKVMGYITVRFKQLRTTKNE

SEQ ID NO: 2472610 - protein, 17 aa, Entamoeba dispar
NEYKGKYVVLLFYPLDW

SEQ ID NO: 2472611 - protein, 34 aa, Entamoeba dispar
PEIAESIGKGFIREGWGCLLMNSRIWERVSQGLW

SEQ ID NO: 2472612 - protein, 19 aa, Entamoeba dispar
PMLSRGELRCIGATTLEEY

SEQ ID NO: 2472613 - protein, 18 aa, Entamoeba dispar
PNVITAWDRNGIDKATAN

SEQ ID NO: 2472614 - protein, 26 aa, Entamoeba dispar
PYKIVKGRNGEGWIHINGKTYSPTEI

SEQ ID NO: 2472615 - protein, 26 aa, Entamoeba dispar
SKEKRIAGKLDHFFPIQKIWNQNGVI

SEQ ID NO: 2472616 - protein, 18 aa, Entamoeba dispar
TACERAKRTLSSASVANI

SEQ ID NO: 2472617 - protein, 21 aa, Entamoeba dispar
TIEAFRIVSHNILKHGITPTS

SEQ ID NO: 2472618 - protein, 19 aa, Entamoeba dispar
TTYSCVGIWENDRVEIIAN

SEQ ID NO: 2472619 - protein, 18 aa, Entamoeba dispar
YKGKYVVLLFYPLDWTFV

SEQ ID NO: 2472620 - protein, 21 aa, Entamoeba dispar
YKGNIIMPLGIWDEYFILELN

SEQ ID NO: 2472621 - protein, 18 aa, Entamoeba dispar
AGAYFASSFIEFNKDIPN

SEQ ID NO: 2472622 - protein, 17 aa, Entamoeba dispar
ALYGIKITDDFRYIIIN

SEQ ID NO: 2472623 - protein, 17 aa, Entamoeba dispar
CRVIGLDMGALIAGAQY

SEQ ID NO: 2472624 - protein, 24 aa, Entamoeba dispar
CTLTIHWQFDVTLRGLRKVLVSED

SEQ ID NO: 2472625 - protein, 18 aa, Entamoeba dispar
DAELKLVGQFGLKNKKEI

SEQ ID NO: 2472626 - protein, 22 aa, Entamoeba dispar
DEGKFSIEIIKEIKVKSPISII

SEQ ID NO: 2472627 - protein, 23 aa, Entamoeba dispar
EEHGTVCPINWKTGKDTIEPTPE

SEQ ID NO: 2472628 - protein, 27 aa, Entamoeba dispar
EELLPHIKGNVGFIFTKGDLYQLKAKL

SEQ ID NO: 2472629 - protein, 20 aa, Entamoeba dispar
EGKFSIEIIQEIKVKSPISI

SEQ ID NO: 2472630 - protein, 22 aa, Entamoeba dispar
EKNKKIHFILGGGFGNRELLIN

SEQ ID NO: 2472631 - protein, 24 aa, Entamoeba dispar
ENAEGKRTTPSCVSFTPTGILVGE

SEQ ID NO: 2472632 - protein, 26 aa, Entamoeba dispar
ENIKKMIPCIVNIFIVGDNLQKEFVA

SEQ ID NO: 2472633 - protein, 26 aa, Entamoeba dispar
EQQNEMMGGFGMMRGFIPNNMPMGGF

SEQ ID NO: 2472634 - protein, 23 aa, Entamoeba dispar
ETGVLRPGTIVQFAPSGVSSECK

SEQ ID NO: 2472635 - protein, 17 aa, Entamoeba dispar
ETYRVFYRQVISGATKG

SEQ ID NO: 2472636 - protein, 21 aa, Entamoeba dispar
FKEGLKKLAAALAVGAKLGGN

SEQ ID NO: 2472637 - protein, 17 aa, Entamoeba dispar
FLLSVLLGNQTATCQTL

SEQ ID NO: 2472638 - protein, 26 aa, Entamoeba dispar
FSSQTSFRLLFKMIKIVEYIHSKQII

SEQ ID NO: 2472639 - protein, 26 aa, Entamoeba dispar
FTMKCSGCTKLVMMLRQLGYAAIPLH

SEQ ID NO: 2472640 - protein, 18 aa, Entamoeba dispar
FVALEFVWEITRKHERIF

SEQ ID NO: 2472641 - protein, 20 aa, Entamoeba dispar
GEIKECFRNLQSRSITCLNE

SEQ ID NO: 2472642 - protein, 18 aa, Entamoeba dispar
GIGTVPCGRVETGVLRPG

SEQ ID NO: 2472643 - protein, 21 aa, Entamoeba dispar
GKDCLMIFHGLKLTTDKLRSI

SEQ ID NO: 2472644 - protein, 20 aa, Entamoeba dispar
GKTEELTRVISLVNSIQNDM

SEQ ID NO: 2472645 - protein, 25 aa, Entamoeba dispar
GKTEFAIQEIFLKYNTFMLRGDSLF

SEQ ID NO: 2472646 - protein, 19 aa, Entamoeba dispar
GMPPPPPGMPGMPPPPPGM

SEQ ID NO: 2472647 - protein, 20 aa, Entamoeba dispar
GQLDIGVSCHGSFNYDSPEN

SEQ ID NO: 2472648 - protein, 19 aa, Entamoeba dispar
GSYIMKIMGYITVRFKQLR

SEQ ID NO: 2472649 - protein, 24 aa, Entamoeba dispar
HVKFPMVHCKPVIASKRFNLPIKA

SEQ ID NO: 2472650 - protein, 17 aa, Entamoeba dispar
IDYLKIKIFSFPLIRNI

SEQ ID NO: 2472651 - protein, 24 aa, Entamoeba dispar
IENCKKFRFEGEYEEYGNIKLINC

SEQ ID NO: 2472652 - protein, 24 aa, Entamoeba dispar
IEVNKEIRELICIGNEKKEKKKIQ

SEQ ID NO: 2472653 - protein, 17 aa, Entamoeba dispar
IKVPLKEAEEIYIVSMK

SEQ ID NO: 2472654 - protein, 17 aa, Entamoeba dispar
IKYSKAIVTARPCIHLL

SEQ ID NO: 2472655 - protein, 24 aa, Entamoeba dispar
ILSGCYYLITKGWSFLFSKEKRIA

SEQ ID NO: 2472656 - protein, 21 aa, Entamoeba dispar
INKKNAWEIFVMGLKNKDSTI

SEQ ID NO: 2472657 - protein, 17 aa, Entamoeba dispar
IPIKEGIEFCCKITEGV

SEQ ID NO: 2472658 - protein, 24 aa, Entamoeba dispar
ITLKDIPSLLVINKIKLTGINPDN

SEQ ID NO: 2472659 - protein, 23 aa, Entamoeba dispar
ITSFGRGCFEECGCEDELMKNKT

SEQ ID NO: 2472660 - protein, 25 aa, Entamoeba dispar
KINPFKYGAVIDVVYDNGIVYDAKA

SEQ ID NO: 2472661 - protein, 18 aa, Entamoeba dispar
KISGIGTVPCGRVETGVL

SEQ ID NO: 2472662 - protein, 21 aa, Entamoeba dispar
KKLLEEYKQVVVVKCDNVGSS

SEQ ID NO: 2472663 - protein, 33 aa, Entamoeba dispar
KPSHGPHGMKECLPLILILRNRLNYALNGREVT

SEQ ID NO: 2472664 - protein, 21 aa, Entamoeba dispar
KSEEWKNVFDVVNRLPEHMKI

SEQ ID NO: 2472665 - protein, 25 aa, Entamoeba dispar
KSIDCSAIMKYCCNSNSSDEYVYTY

SEQ ID NO: 2472666 - protein, 24 aa, Entamoeba dispar
KSIKRKRKPLLFANRLNNEEVNDN

SEQ ID NO: 2472667 - protein, 18 aa, Entamoeba dispar
LAERNGINLNEFVEYAQN

SEQ ID NO: 2472668 - protein, 19 aa, Entamoeba dispar
LLEGAALLRRLHNLGILPR

SEQ ID NO: 2472669 - protein, 19 aa, Entamoeba dispar
LLRLRQINNAVFIKANAST

SEQ ID NO: 2472670 - protein, 20 aa, Entamoeba dispar
LRLPLQDVYKISGIGTVPCG

SEQ ID NO: 2472671 - protein, 17 aa, Entamoeba dispar
LVGQFGLKNKKEIQRVH

SEQ ID NO: 2472672 - protein, 17 aa, Entamoeba dispar
MAGNLKAAFQQRDSTQV

SEQ ID NO: 2472673 - protein, 20 aa, Entamoeba dispar
MGDSYLAIDVIVMSLMEEKE

SEQ ID NO: 2472674 - protein, 25 aa, Entamoeba dispar
NDIIWPEFKSLISTRGEQITINVKY

SEQ ID NO: 2472675 - protein, 25 aa, Entamoeba dispar
NEIKEKSFIIGCVIRCGISLELERK

SEQ ID NO: 2472676 - protein, 25 aa, Entamoeba dispar
NFYGPTRVEGFWTYDENNISWNPYT

SEQ ID NO: 2472677 - protein, 17 aa, Entamoeba dispar
NGIIVKQIINYGNEEVK

SEQ ID NO: 2472678 - protein, 18 aa, Entamoeba dispar
NKNFGIDTTHIFYDLFKN

SEQ ID NO: 2472679 - protein, 20 aa, Entamoeba dispar
NLNTRPSLTTTFTPKSINNS

SEQ ID NO: 2472680 - protein, 24 aa, Entamoeba dispar
NWIPSECIKYGMYRDFTTNRVEGF

SEQ ID NO: 2472681 - protein, 20 aa, Entamoeba dispar
PEFLNRLDDIIVFSPLSEKE

SEQ ID NO: 2472682 - protein, 20 aa, Entamoeba dispar
PKEIVAKCSKVFSMDNVYIR

SEQ ID NO: 2472683 - protein, 18 aa, Entamoeba dispar
PKLIVAIRIRGINGVSPK

SEQ ID NO: 2472684 - protein, 33 aa, Entamoeba dispar
PLEMVVYLPYLCKKLQVPYCIVKGKARLGQLIH

SEQ ID NO: 2472685 - protein, 17 aa, Entamoeba dispar
PPPPPGMPGMPPPPPGM

SEQ ID NO: 2472686 - protein, 17 aa, Entamoeba dispar
QGNMERFHFNPIPLNEY

SEQ ID NO: 2472687 - protein, 23 aa, Entamoeba dispar
QHDLIPLVEFVFGGRQRRFIINL

SEQ ID NO: 2472688 - protein, 17 aa, Entamoeba dispar
RRFCLVPLTAEQAKFKL

SEQ ID NO: 2472689 - protein, 17 aa, Entamoeba dispar
RTIPNGFYQNVIGSNTY

SEQ ID NO: 2472690 - protein, 18 aa, Entamoeba dispar
RTPPIKIIDTPGFGDTRG

SEQ ID NO: 2472691 - protein, 17 aa, Entamoeba dispar
RYVKYPLYVRIQKEKRL

SEQ ID NO: 2472692 - protein, 25 aa, Entamoeba dispar
SKTVKRKRISTFNGIRQEEIYEIGE

SEQ ID NO: 2472693 - protein, 17 aa, Entamoeba dispar
SMYPSEMIIYGRINNNW

SEQ ID NO: 2472694 - protein, 23 aa, Entamoeba dispar
SNIELPKSYSLIGNVVVNKMKHN

SEQ ID NO: 2472695 - protein, 18 aa, Entamoeba dispar
TAPRARRNLKSTMAGNLK

SEQ ID NO: 2472696 - protein, 22 aa, Entamoeba dispar
TDHTCKLWPLSISTEEDSKPAK

SEQ ID NO: 2472697 - protein, 18 aa, Entamoeba dispar
TEYYLYKKIQSISSTPIL

SEQ ID NO: 2472698 - protein, 25 aa, Entamoeba dispar
TIRKELRGTCEFVMGKNTLIRKAIK

SEQ ID NO: 2472699 - protein, 23 aa, Entamoeba dispar
TKKCGWSVGSDLTIISMIKKYGI

SEQ ID NO: 2472700 - protein, 27 aa, Entamoeba dispar
TQEITFPCIYGMAARRTIPNGFYQNVI

SEQ ID NO: 2472701 - protein, 24 aa, Entamoeba dispar
VFRRRWGSYGSIKNNWYSNNYSLN

SEQ ID NO: 2472702 - protein, 17 aa, Entamoeba dispar
VKYQAKRPFEEKLTSTF

SEQ ID NO: 2472703 - protein, 18 aa, Entamoeba dispar
VLMDLDGFVGLNEENRKK

SEQ ID NO: 2472704 - protein, 19 aa, Entamoeba dispar
VSVSWFPTYIKTENETTTP

SEQ ID NO: 2472705 - protein, 19 aa, Entamoeba dispar
VVCVAGVSLWGLWTNKKQK

SEQ ID NO: 2472706 - protein, 26 aa, Entamoeba dispar
VVFLKQCIKSGALIVTGPFKINGVPL

SEQ ID NO: 2472707 - protein, 19 aa, Entamoeba dispar
WWKDVKDSIGDRVKDISER

SEQ ID NO: 2472708 - protein, 22 aa, Entamoeba dispar
WYKEARAAINERVKKYYDNPEN

SEQ ID NO: 2472709 - protein, 27 aa, Entamoeba dispar
YCIVKGKARLGQLIHRPTAAVVAVTET

SEQ ID NO: 2472710 - protein, 19 aa, Entamoeba dispar
YGYENLPVDTFMTIGSLAE

SEQ ID NO: 2472711 - protein, 25 aa, Entamoeba dispar
YIYRSELRIGEAITQMTKSLGVTLN

SEQ ID NO: 2472712 - protein, 18 aa, Entamoeba dispar
YNPFSIKSKKIFPKLTNQ

SEQ ID NO: 2472713 - protein, 17 aa, Entamoeba dispar
ADPKLIVAIRIRGINGV

SEQ ID NO: 2472714 - protein, 24 aa, Entamoeba dispar
AEKPHLTGFLGFKAGMTHVIREVK

SEQ ID NO: 2472715 - protein, 26 aa, Entamoeba dispar
AEMGKGSFKYAWVLDNLKAERERGIT

SEQ ID NO: 2472716 - protein, 21 aa, Entamoeba dispar
AKRTTWPRVRGVAMNPVDHPH

SEQ ID NO: 2472717 - protein, 20 aa, Entamoeba dispar
ALDPLGWTGHSGMAILAPHL

SEQ ID NO: 2472718 - protein, 28 aa, Entamoeba dispar
ALKKMRAHRGLRHYWGLRVRGQHTKTTG

SEQ ID NO: 2472719 - protein, 17 aa, Entamoeba dispar
AMANCDEKGPLMMYVSK

SEQ ID NO: 2472720 - protein, 24 aa, Entamoeba dispar
ANLLPSRHFGALVLTTSYGILDNT

SEQ ID NO: 2472721 - protein, 27 aa, Entamoeba dispar
AQCKGLNCAFGRWPVKSAQFILKLLKN

SEQ ID NO: 2472722 - protein, 22 aa, Entamoeba dispar
ASKGRTTIIIAHRLSTIQNADK

SEQ ID NO: 2472723 - protein, 33 aa, Entamoeba dispar
CQTLVFNLTWSWVVSLRGLRKSTLDVIPIPNAN

SEQ ID NO: 2472724 - protein, 21 aa, Entamoeba dispar
CRYGIIKRRALRLENGNFSWA

SEQ ID NO: 2472725 - protein, 20 aa, Entamoeba dispar
CVIRCGISLELERKTKNDEE

SEQ ID NO: 2472726 - protein, 26 aa, Entamoeba dispar
DANETRVAWKIAIERNNGPTLLILAR

SEQ ID NO: 2472727 - protein, 25 aa, Entamoeba dispar
DDSYLLKVMGYITVRFKQLRTTRNE

SEQ ID NO: 2472728 - protein, 25 aa, Entamoeba dispar
DGIELIKSFVFNGGKFLGICAGAYF

SEQ ID NO: 2472729 - protein, 27 aa, Entamoeba dispar
DIAKIAMKYCNGRFGTFSQLYEIPEDI

SEQ ID NO: 2472730 - protein, 25 aa, Entamoeba dispar
DIRMERCGYTIPAHNTIVTSVKLNH

SEQ ID NO: 2472731 - protein, 25 aa, Entamoeba dispar
DNVKIKVRVGRGIVVGGFQGSDAAD

SEQ ID NO: 2472732 - protein, 25 aa, Entamoeba dispar
DPAQIGWGELGVDYVVESTGVFTTI

SEQ ID NO: 2472733 - protein, 19 aa, Entamoeba dispar
DRNGVKIKVVEVNGTKYFG

SEQ ID NO: 2472734 - protein, 20 aa, Entamoeba dispar
EAETSFLYGNHLVKNGISKI

SEQ ID NO: 2472735 - protein, 20 aa, Entamoeba dispar
EAGFQKSMFERFMANTQIKR

SEQ ID NO: 2472736 - protein, 26 aa, Entamoeba dispar
EEFAKFPPLGRFAVRDMKQTVAVGVV

SEQ ID NO: 2472737 - protein, 17 aa, Entamoeba dispar
EENTLYILRGIREKYEN

SEQ ID NO: 2472738 - protein, 24 aa, Entamoeba dispar
EESSWSELNIPYSEKTTLVRSKYT

SEQ ID NO: 2472739 - protein, 28 aa, Entamoeba dispar
EFKPELQNGRFIPCILYGAKAQLPGMTG

SEQ ID NO: 2472740 - protein, 30 aa, Entamoeba dispar
EGKELLKTVMKLWLPAGVTLLEMIVLHLPS

SEQ ID NO: 2472741 - protein, 30 aa, Entamoeba dispar
EGLPFDRLPAFTARDVFRFLGVSRNQFTEI

SEQ ID NO: 2472742 - protein, 20 aa, Entamoeba dispar
EGTGILYAVMTFDLKDHTIH

SEQ ID NO: 2472743 - protein, 19 aa, Entamoeba dispar
EKFIGDCGVAVGMHSFGAS

SEQ ID NO: 2472744 - protein, 17 aa, Entamoeba dispar
EKGFIHRDIKLENFLLV

SEQ ID NO: 2472745 - protein, 23 aa, Entamoeba dispar
EKTLYYGSRWGVVRQLDAASMME

SEQ ID NO: 2472746 - protein, 19 aa, Entamoeba dispar
ELFIKPNLSILKKVTYTKH

SEQ ID NO: 2472747 - protein, 18 aa, Entamoeba dispar
ELYQRIETMIEKKLNEYK

SEQ ID NO: 2472748 - protein, 21 aa, Entamoeba dispar
ERRLQTLVYRKGFAKSIHHAR

SEQ ID NO: 2472749 - protein, 20 aa, Entamoeba dispar
EVMKHIKPIIEFGGIEPNPS

SEQ ID NO: 2472750 - protein, 17 aa, Entamoeba dispar
FAVRDMKQTVAVGVVKA

SEQ ID NO: 2472751 - protein, 24 aa, Entamoeba dispar
FDLKDHTIHFGAYKNQWFNITPQK

SEQ ID NO: 2472752 - protein, 19 aa, Entamoeba dispar
FETEVSGWVHSIAYTPSGT

SEQ ID NO: 2472753 - protein, 24 aa, Entamoeba dispar
FKDGRIFKYVIWYLVNYSEYLQEK

SEQ ID NO: 2472754 - protein, 20 aa, Entamoeba dispar
FKEECECSTIFSVLKTNSQI

SEQ ID NO: 2472755 - protein, 22 aa, Entamoeba dispar
FKEGLKKLAAALAVGAKLGGNM

SEQ ID NO: 2472756 - protein, 20 aa, Entamoeba dispar
FKLNAVRASMEMTFIGNQLL

SEQ ID NO: 2472757 - protein, 23 aa, Entamoeba dispar
FKMYCRDASGIICTIIADNYFGY

SEQ ID NO: 2472758 - protein, 17 aa, Entamoeba dispar
FLKKFYYTMKEPSYIDW

SEQ ID NO: 2472759 - protein, 18 aa, Entamoeba dispar
FQPELEKPFQEKKELYGS

SEQ ID NO: 2472760 - protein, 19 aa, Entamoeba dispar
FTTRLNNVFVIGKGTETLV

SEQ ID NO: 2472761 - protein, 17 aa, Entamoeba dispar
FYIGKRVAYVYKVNVKK

SEQ ID NO: 2472762 - protein, 22 aa, Entamoeba dispar
GACPPLKALIYIMANGEYNGMT

SEQ ID NO: 2472763 - protein, 18 aa, Entamoeba dispar
GDSYLAIDVIVMSLMEEK

SEQ ID NO: 2472764 - protein, 25 aa, Entamoeba dispar
GEHPSRIIFVSGICRNEYENIKNKI

SEQ ID NO: 2472765 - protein, 17 aa, Entamoeba dispar
GEMKGILGYTEDLVVSS

SEQ ID NO: 2472766 - protein, 25 aa, Entamoeba dispar
GFGRIGRLVARVVLERKDFELVAIN

SEQ ID NO: 2472767 - protein, 19 aa, Entamoeba dispar
GGNDCIVHLFDIRNGKQIG

SEQ ID NO: 2472768 - protein, 23 aa, Entamoeba dispar
GIGNHVIQIFIERSEEIKEVIEK

SEQ ID NO: 2472769 - protein, 19 aa, Entamoeba dispar
GKFKLHITALPYLAQYCSC

SEQ ID NO: 2472770 - protein, 20 aa, Entamoeba dispar
GKKLLAMRVVEEAFEIIHLL

SEQ ID NO: 2472771 - protein, 17 aa, Entamoeba dispar
GKVKYQAKRPFEEKLTS

SEQ ID NO: 2472772 - protein, 26 aa, Entamoeba dispar
GLGVRVVSLPSWELFNQQPVEYRESV

SEQ ID NO: 2472773 - protein, 19 aa, Entamoeba dispar
GNQPFVFDYIEFCNDFNTN

SEQ ID NO: 2472774 - protein, 25 aa, Entamoeba dispar
GPSGKDWRAGRCACANIIPASTGAA

SEQ ID NO: 2472775 - protein, 18 aa, Entamoeba dispar
GRSYDFNEVVRWFAERAD

SEQ ID NO: 2472776 - protein, 17 aa, Entamoeba dispar
GSFGIVYIGEFRGNQVA

SEQ ID NO: 2472777 - protein, 17 aa, Entamoeba dispar
GTGAIPYIVTHDGRTIR

SEQ ID NO: 2472778 - protein, 23 aa, Entamoeba dispar
GTINVCVYYSMKMLHSQYQEARI

SEQ ID NO: 2472779 - protein, 23 aa, Entamoeba dispar
GTSEGLDLWTFNRNEIVQHYDTE

SEQ ID NO: 2472780 - protein, 19 aa, Entamoeba dispar
GVPLMRINQRYVIATSQKV

SEQ ID NO: 2472781 - protein, 24 aa, Entamoeba dispar
GYTHLIPKLFRNYDSLKRYDAFVL

SEQ ID NO: 2472782 - protein, 28 aa, Entamoeba dispar
HENSVFQLPSIITHLSYFRIPLPDILHW

SEQ ID NO: 2472783 - protein, 19 aa, Entamoeba dispar
HERIFEGTEGVVLANKLLH

SEQ ID NO: 2472784 - protein, 22 aa, Entamoeba dispar
HKKRYGSYGSIHGWYGNYKFVN

SEQ ID NO: 2472785 - protein, 17 aa, Entamoeba dispar
HNTIQLFHHFFPCANVF

SEQ ID NO: 2472786 - protein, 19 aa, Entamoeba dispar
HSAISWGTGRAVARIPRIS

SEQ ID NO: 2472787 - protein, 24 aa, Entamoeba dispar
IDHAAAYRYAKLLNIQLPRELLTG

SEQ ID NO: 2472788 - protein, 22 aa, Entamoeba dispar
IGDDCFYGCLSLTTINIPSTIS

SEQ ID NO: 2472789 - protein, 18 aa, Entamoeba dispar
IGYWCFYECSSLTSMNID

SEQ ID NO: 2472790 - protein, 19 aa, Entamoeba dispar
IHINKGLMCIIDLIEHKEN

SEQ ID NO: 2472791 - protein, 18 aa, Entamoeba dispar
IHVDFSQSIGKYGIQYDF

SEQ ID NO: 2472792 - protein, 18 aa, Entamoeba dispar
IKIEPSRPGGIRQQLILR

SEQ ID NO: 2472793 - protein, 23 aa, Entamoeba dispar
IKMLRLVDPYVTYGYPTLETVQK

SEQ ID NO: 2472794 - protein, 23 aa, Entamoeba dispar
IKPEMLGHYLGEFSITYKPVTHG

SEQ ID NO: 2472795 - protein, 19 aa, Entamoeba dispar
IKYSKAIVTARPCIHLLNQ

SEQ ID NO: 2472796 - protein, 33 aa, Entamoeba dispar
ILDIASVISICIEYSRYSTIFTMYRSLGKKTIE

SEQ ID NO: 2472797 - protein, 25 aa, Entamoeba dispar
ILRRVNHPCILGCLNVYLTSHRAVM

SEQ ID NO: 2472798 - protein, 19 aa, Entamoeba dispar
INETMSFDLTILKHKDGGL

SEQ ID NO: 2472799 - protein, 18 aa, Entamoeba dispar
INKKCGIAINSLKVNPWF

SEQ ID NO: 2472800 - protein, 28 aa, Entamoeba dispar
IPLPTVIRDELHFVPARVLKKDGERYYA

SEQ ID NO: 2472801 - protein, 18 aa, Entamoeba dispar
IPSAAALILKALKEPPKD

SEQ ID NO: 2472802 - protein, 23 aa, Entamoeba dispar
IREKCYKYYKRILEIDYKYHKTL

SEQ ID NO: 2472803 - protein, 24 aa, Entamoeba dispar
IREKCYKYYKRILEIDYKYHKTLS

SEQ ID NO: 2472804 - protein, 24 aa, Entamoeba dispar
IRKEGKRVICISSDIKTTTEKEDE

SEQ ID NO: 2472805 - protein, 19 aa, Entamoeba dispar
IRNGLLEQRLEFMEFDNFE

SEQ ID NO: 2472806 - protein, 17 aa, Entamoeba dispar
ISPRFNVTLSEFDKWEA

SEQ ID NO: 2472807 - protein, 21 aa, Entamoeba dispar
IVLECCKHPYGCRVVQRVIES

SEQ ID NO: 2472808 - protein, 22 aa, Entamoeba dispar
KDISDVVLVGGMTRMPLIQNTV

SEQ ID NO: 2472809 - protein, 26 aa, Entamoeba dispar
KEHKKKWRMCHSFKDYKKKEMKKASR

SEQ ID NO: 2472810 - protein, 21 aa, Entamoeba dispar
KEKYIDIMVNLLFYIPMRNDY

SEQ ID NO: 2472811 - protein, 29 aa, Entamoeba dispar
KEWMKGKREFIEYGYCMILEILIEQRKKE

SEQ ID NO: 2472812 - protein, 20 aa, Entamoeba dispar
KFVMNGGLIVGTWDGANVEI

SEQ ID NO: 2472813 - protein, 22 aa, Entamoeba dispar
KGEEYKGVINLSTISCNKEERI

SEQ ID NO: 2472814 - protein, 19 aa, Entamoeba dispar
KGRFYAFGRVFSGTIRTGG

SEQ ID NO: 2472815 - protein, 32 aa, Entamoeba dispar
KIIGVSWKLDFFVRPEHKEISPVFLVTLKTKV

SEQ ID NO: 2472816 - protein, 24 aa, Entamoeba dispar
KIKIFSFPLIRNIIKMMNDKEKTI

SEQ ID NO: 2472817 - protein, 21 aa, Entamoeba dispar
KIYRLGCGDLKNAKTEFDITE

SEQ ID NO: 2472818 - protein, 20 aa, Entamoeba dispar
KKFKSTVTKVAWSPDSLTVA

SEQ ID NO: 2472819 - protein, 18 aa, Entamoeba dispar
KKIEGIKKIKQGRIEIES

SEQ ID NO: 2472820 - protein, 20 aa, Entamoeba dispar
KKLRTRKGAKITALDKPAWN

SEQ ID NO: 2472821 - protein, 20 aa, Entamoeba dispar
KNAYIMPIHMMEAIVEEESN

SEQ ID NO: 2472822 - protein, 19 aa, Entamoeba dispar
KQRVKEVFNNDIIQFSDIQ

SEQ ID NO: 2472823 - protein, 18 aa, Entamoeba dispar
KRISSPIINKSSHTTNVK

SEQ ID NO: 2472824 - protein, 25 aa, Entamoeba dispar
KRLLMKRLKTPPAVNIFANHTLDKT

SEQ ID NO: 2472825 - protein, 19 aa, Entamoeba dispar
KRTPPIKIIDTPGFGDTRG

SEQ ID NO: 2472826 - protein, 18 aa, Entamoeba dispar
KTFTVNCELFIFEIKMSG

SEQ ID NO: 2472827 - protein, 17 aa, Entamoeba dispar
KTLPFLDVLCITDNKVV

SEQ ID NO: 2472828 - protein, 21 aa, Entamoeba dispar
KTNNEIIKFLANHPHIQIPLR

SEQ ID NO: 2472829 - protein, 18 aa, Entamoeba dispar
KTVCPCKARCQAFRAEVI

SEQ ID NO: 2472830 - protein, 20 aa, Entamoeba dispar
KVDEFRGRFMMDGHNESLKY

SEQ ID NO: 2472831 - protein, 26 aa, Entamoeba dispar
LAMLKEAKRYAAILNRYKVLKAHGMK

SEQ ID NO: 2472832 - protein, 20 aa, Entamoeba dispar
LCDEIQYCISCQIRSVNHKV

SEQ ID NO: 2472833 - protein, 25 aa, Entamoeba dispar
LEGFQSGRILACISSRPGQTGSVEG

SEQ ID NO: 2472834 - protein, 20 aa, Entamoeba dispar
LEMIVLHLPSPVVAQKYRTS

SEQ ID NO: 2472835 - protein, 18 aa, Entamoeba dispar
LENITGIYISNKIIPFDN

SEQ ID NO: 2472836 - protein, 18 aa, Entamoeba dispar
LFDSISITSKYLEEFILK

SEQ ID NO: 2472837 - protein, 27 aa, Entamoeba dispar
LIHCNSFRLTPMWTYLTQIQIKEQFEQ

SEQ ID NO: 2472838 - protein, 26 aa, Entamoeba dispar
LINPPVLRIKVFEPLFIVGKENYAKL

SEQ ID NO: 2472839 - protein, 17 aa, Entamoeba dispar
LKEAEEIYIVSMKDYIF

SEQ ID NO: 2472840 - protein, 26 aa, Entamoeba dispar
LKEIVKLQMGEVIKMIKKRYPLSEVE

SEQ ID NO: 2472841 - protein, 19 aa, Entamoeba dispar
LKIKLNDKLFKTIELDKKT

SEQ ID NO: 2472842 - protein, 17 aa, Entamoeba dispar
LKLVGQFGLKNKKEIQR

SEQ ID NO: 2472843 - protein, 20 aa, Entamoeba dispar
LKRLNAPHHWMLSKLGGTFA

SEQ ID NO: 2472844 - protein, 19 aa, Entamoeba dispar
LKVNPWFTSERDINKFCNI

SEQ ID NO: 2472845 - protein, 25 aa, Entamoeba dispar
LNLAPGCHMGRFIIWTESAFKKLNT

SEQ ID NO: 2472846 - protein, 26 aa, Entamoeba dispar
LNSATFPSICTAWDRNGVKIKVVEVN

SEQ ID NO: 2472847 - protein, 20 aa, Entamoeba dispar
LPEHMKIPLNDLLKDLLEEQ

SEQ ID NO: 2472848 - protein, 17 aa, Entamoeba dispar
LQGIVLECCKHPYGCRV

SEQ ID NO: 2472849 - protein, 33 aa, Entamoeba dispar
LQIEEIKAGNIYQFEPEKSYFYIMRNCNMLRFL

SEQ ID NO: 2472850 - protein, 23 aa, Entamoeba dispar
LQNFPKRHDHIFEDWQINNIYLI

SEQ ID NO: 2472851 - protein, 28 aa, Entamoeba dispar
LRHLKTTIIVNMHIWKSLNASFKTQVAT

SEQ ID NO: 2472852 - protein, 17 aa, Entamoeba dispar
LSYQKCHENSVFQLPSI

SEQ ID NO: 2472853 - protein, 26 aa, Entamoeba dispar
MDVNGIWKKFYGINCASKFIEYIQTI

SEQ ID NO: 2472854 - protein, 17 aa, Entamoeba dispar
MKGILGYTEDLVVSSDF

SEQ ID NO: 2472855 - protein, 21 aa, Entamoeba dispar
MKITCSLAKILLKDLEKKELI

SEQ ID NO: 2472856 - protein, 18 aa, Entamoeba dispar
MLSRGELRCIGATTLEEY

SEQ ID NO: 2472857 - protein, 18 aa, Entamoeba dispar
NAHLPPSLFSNRWKALNN

SEQ ID NO: 2472858 - protein, 24 aa, Entamoeba dispar
NDGLPEHNFYQFGGRPYNPPIPDE

SEQ ID NO: 2472859 - protein, 24 aa, Entamoeba dispar
NDQVYALICLIELLKTQPCAKDSR

SEQ ID NO: 2472860 - protein, 26 aa, Entamoeba dispar
NEKTLYYGSRWGVIRQLDAASMMEKS

SEQ ID NO: 2472861 - protein, 17 aa, Entamoeba dispar
NELFDSISITSKYLEEF

SEQ ID NO: 2472862 - protein, 29 aa, Entamoeba dispar
NEVVRWFAERADMIVLVFDAHKLDISDEF

SEQ ID NO: 2472863 - protein, 19 aa, Entamoeba dispar
NGVIKRFGVRHLPRKTHRG

SEQ ID NO: 2472864 - protein, 25 aa, Entamoeba dispar
NPSFKTQIATIIIFKGYSKENFGYI

SEQ ID NO: 2472865 - protein, 19 aa, Entamoeba dispar
NRIMICLLGASSGVEGIGK

SEQ ID NO: 2472866 - protein, 19 aa, Entamoeba dispar
NSYKLFLHQLHNILNYGPE

SEQ ID NO: 2472867 - protein, 25 aa, Entamoeba dispar
NVRAYLPVCESFGFTADLRSHTSGQ

SEQ ID NO: 2472868 - protein, 22 aa, Entamoeba dispar
NYEKFMPALMQYYKQPQEKHLL

SEQ ID NO: 2472869 - protein, 20 aa, Entamoeba dispar
PEFIPYIPTLSKFLSYQKCH

SEQ ID NO: 2472870 - protein, 23 aa, Entamoeba dispar
PEFLNRLDDIIVFSPLSEKELKE

SEQ ID NO: 2472871 - protein, 20 aa, Entamoeba dispar
PIGQCPEGTVVCNVESKPGD

SEQ ID NO: 2472872 - protein, 29 aa, Entamoeba dispar
PKTYMKLEYCVSCGIHGRVVRVRSRTDRR

SEQ ID NO: 2472873 - protein, 18 aa, Entamoeba dispar
PLQYCTFESWKSTVNPVI

SEQ ID NO: 2472874 - protein, 29 aa, Entamoeba dispar
PRKTHRGLRKVACVGAWHPARVSWTVARA

SEQ ID NO: 2472875 - protein, 19 aa, Entamoeba dispar
PTEYYLYKKIQSISSTPIL

SEQ ID NO: 2472876 - protein, 23 aa, Entamoeba dispar
PTMMAGKLYKFIPENQNGRFYPF

SEQ ID NO: 2472877 - protein, 18 aa, Entamoeba dispar
PTRRSCVTEQFFRINSIE

SEQ ID NO: 2472878 - protein, 17 aa, Entamoeba dispar
QGNIERFHFNPIPLNEY

SEQ ID NO: 2472879 - protein, 24 aa, Entamoeba dispar
QKKGEIMKAISYLVRLNRLNKVEI

SEQ ID NO: 2472880 - protein, 18 aa, Entamoeba dispar
QLDIGVSCHGSFNYDSPE

SEQ ID NO: 2472881 - protein, 24 aa, Entamoeba dispar
QQLILRCVNALKLPNDLIGLPPPH

SEQ ID NO: 2472882 - protein, 23 aa, Entamoeba dispar
QQLMRVYGALMWSLGKVMQTPEC

SEQ ID NO: 2472883 - protein, 20 aa, Entamoeba dispar
QVNLTINIPQILKIDYIQDS

SEQ ID NO: 2472884 - protein, 18 aa, Entamoeba dispar
QYAAKVEKILAAKKEALN

SEQ ID NO: 2472885 - protein, 19 aa, Entamoeba dispar
RAEVLEMIGDLPFAEIKPP

SEQ ID NO: 2472886 - protein, 18 aa, Entamoeba dispar
RALRLENGNFSWASQSIT

SEQ ID NO: 2472887 - protein, 18 aa, Entamoeba dispar
RARFEEINIDLFKSTIGP

SEQ ID NO: 2472888 - protein, 22 aa, Entamoeba dispar
RCGDCGCVLAGIRHIRPHQYGW

SEQ ID NO: 2472889 - protein, 17 aa, Entamoeba dispar
RDPKRLLEGAALLRRLH

SEQ ID NO: 2472890 - protein, 18 aa, Entamoeba dispar
RFEKGYVLMEGFVDTNFI

SEQ ID NO: 2472891 - protein, 24 aa, Entamoeba dispar
RGRLESCGIILQKEMNGINIHTRR

SEQ ID NO: 2472892 - protein, 28 aa, Entamoeba dispar
RHLKTTIIVNLHIWKALNPSFKTQIATI

SEQ ID NO: 2472893 - protein, 21 aa, Entamoeba dispar
RIKNHLCGRGNIFEEGRKEWM

SEQ ID NO: 2472894 - protein, 19 aa, Entamoeba dispar
RKIKERKGPLVVYGNDDLQ

SEQ ID NO: 2472895 - protein, 19 aa, Entamoeba dispar
RKLPFQHLVREIAQQSKSD

SEQ ID NO: 2472896 - protein, 19 aa, Entamoeba dispar
RKYGKIRSVEIIRDRKTKK

SEQ ID NO: 2472897 - protein, 21 aa, Entamoeba dispar
RLAALSHYPSIFVFTHDSIGV

SEQ ID NO: 2472898 - protein, 24 aa, Entamoeba dispar
RLNQQIKKRVCFIVDEAVVSTLMT

SEQ ID NO: 2472899 - protein, 18 aa, Entamoeba dispar
RNGLLEQRLEFMEFDNFE

SEQ ID NO: 2472900 - protein, 19 aa, Entamoeba dispar
RNKIAGFITHLMRRIQKGP

SEQ ID NO: 2472901 - protein, 28 aa, Entamoeba dispar
RQEYCFIPFKYRDGYLLSILKETEGKSI

SEQ ID NO: 2472902 - protein, 24 aa, Entamoeba dispar
RQLPLKSKFEIISFGSKYDFMFKE

SEQ ID NO: 2472903 - protein, 24 aa, Entamoeba dispar
RRLGYKPKDGFVIYSVRIHRGNRK

SEQ ID NO: 2472904 - protein, 17 aa, Entamoeba dispar
RRRDFGLEYTAQVWGGM

SEQ ID NO: 2472905 - protein, 24 aa, Entamoeba dispar
RSDKLYDCVCLVFLEGAKNDIGKE

SEQ ID NO: 2472906 - protein, 26 aa, Entamoeba dispar
RSSPLEIVEAYNFVRCQSSWKDTQTG

SEQ ID NO: 2472907 - protein, 19 aa, Entamoeba dispar
RVVYAHFPVTLVIADDGKS

SEQ ID NO: 2472908 - protein, 22 aa, Entamoeba dispar
SATFPSICTAWDRNGVRINTAV

SEQ ID NO: 2472909 - protein, 26 aa, Entamoeba dispar
SDFPLVKGKPSWSIKSIFLGKKSYLD

SEQ ID NO: 2472910 - protein, 22 aa, Entamoeba dispar
SECYLKMGELYKMKNDKSLMYI

SEQ ID NO: 2472911 - protein, 17 aa, Entamoeba dispar
SEGEMKGILGYTEDLVV

SEQ ID NO: 2472912 - protein, 19 aa, Entamoeba dispar
SEMIIYGRINNNWIKAREN

SEQ ID NO: 2472913 - protein, 17 aa, Entamoeba dispar
SENRLINDFLRERETGR

SEQ ID NO: 2472914 - protein, 18 aa, Entamoeba dispar
SFGTSCFFNCGCDEELKY

SEQ ID NO: 2472915 - protein, 25 aa, Entamoeba dispar
SGQAFPQCVFDHWQLLNGDVTDATS

SEQ ID NO: 2472916 - protein, 21 aa, Entamoeba dispar
SIDNLSCLLQLQGIRKEGKRV

SEQ ID NO: 2472917 - protein, 22 aa, Entamoeba dispar
SIIFRELCDCFDQFKIMDVHIC

SEQ ID NO: 2472918 - protein, 20 aa, Entamoeba dispar
SKIKEGYLNLVKKLNGLVIE

SEQ ID NO: 2472919 - protein, 17 aa, Entamoeba dispar
SKYFPCVENQNSITLKR

SEQ ID NO: 2472920 - protein, 23 aa, Entamoeba dispar
SMACSCLSSLFSCFESTQDLSKD

SEQ ID NO: 2472921 - protein, 20 aa, Entamoeba dispar
SWTVARAGQMGFFKRTEVNK

SEQ ID NO: 2472922 - protein, 17 aa, Entamoeba dispar
SYLKRIHEEPSYTLMTY

SEQ ID NO: 2472923 - protein, 24 aa, Entamoeba dispar
SYYIMPCCTTRFVLDAKYSDFKNG

SEQ ID NO: 2472924 - protein, 24 aa, Entamoeba dispar
TAKEVKHGYELMGRHEIEPKYNVT

SEQ ID NO: 2472925 - protein, 18 aa, Entamoeba dispar
TAPRARRNLKSSMAGNLK

SEQ ID NO: 2472926 - protein, 29 aa, Entamoeba dispar
TASITLSSSWPFLIMWKGSDNEAYIQLQR

SEQ ID NO: 2472927 - protein, 17 aa, Entamoeba dispar
TCEEFKNGCKIGNETYC

SEQ ID NO: 2472928 - protein, 24 aa, Entamoeba dispar
TDGTEKRKGVIVVADPNERFVNIF

SEQ ID NO: 2472929 - protein, 19 aa, Entamoeba dispar
TELLLRKLPFQHLVREIAQ

SEQ ID NO: 2472930 - protein, 26 aa, Entamoeba dispar
TILLNPHFVKLVSWYDNEWGYSNRLV

SEQ ID NO: 2472931 - protein, 19 aa, Entamoeba dispar
TKEVPSMKVITPAVVADRM

SEQ ID NO: 2472932 - protein, 23 aa, Entamoeba dispar
TKLRASWNSNRMAGAKIIATKLA

SEQ ID NO: 2472933 - protein, 18 aa, Entamoeba dispar
TKLSEWGKGKEEFENIAR

SEQ ID NO: 2472934 - protein, 17 aa, Entamoeba dispar
TVTKVAWSPDSLTVAAA

SEQ ID NO: 2472935 - protein, 17 aa, Entamoeba dispar
TYEVIPSAAALILKALK

SEQ ID NO: 2472936 - protein, 23 aa, Entamoeba dispar
TYLKGICMPNDWLDLDNKKWLEE

SEQ ID NO: 2472937 - protein, 19 aa, Entamoeba dispar
VDEFRGRFMMDGHNESLKY

SEQ ID NO: 2472938 - protein, 25 aa, Entamoeba dispar
VGHHFNPCLFERGADGWKFVKELDQ

SEQ ID NO: 2472939 - protein, 19 aa, Entamoeba dispar
VGNLLKVVFIPNYSVSLAE

SEQ ID NO: 2472940 - protein, 17 aa, Entamoeba dispar
VKGDVPSNLQCRVIGLD

SEQ ID NO: 2472941 - protein, 19 aa, Entamoeba dispar
VKILKEFINNGGKYLGICA

SEQ ID NO: 2472942 - protein, 22 aa, Entamoeba dispar
VLGKCCFYKCSSLTSINIPSTI

SEQ ID NO: 2472943 - protein, 22 aa, Entamoeba dispar
VMIRPASKVICEFLNVMMKHQY

SEQ ID NO: 2472944 - protein, 20 aa, Entamoeba dispar
VRRCPERLYKISANDIPLIE

SEQ ID NO: 2472945 - protein, 20 aa, Entamoeba dispar
VYSFLKKRCNEMYLFDIQRG

SEQ ID NO: 2472946 - protein, 18 aa, Entamoeba dispar
WGTGRAVARIPRISGSGS

SEQ ID NO: 2472947 - protein, 17 aa, Entamoeba dispar
WHPARVSWTVARAGQMG

SEQ ID NO: 2472948 - protein, 18 aa, Entamoeba dispar
WKFETSKYYFTIIDAPGH

SEQ ID NO: 2472949 - protein, 19 aa, Entamoeba dispar
WKKGKLVTRYKCNPLGTAS

SEQ ID NO: 2472950 - protein, 24 aa, Entamoeba dispar
WQCYKNYYHCLSLFNQNKLKESYT

SEQ ID NO: 2472951 - protein, 18 aa, Entamoeba dispar
WQRKTPKQMRRFAVASCI

SEQ ID NO: 2472952 - protein, 22 aa, Entamoeba dispar
WSDALKRYGYENLPVDTFMTIG

SEQ ID NO: 2472953 - protein, 18 aa, Entamoeba dispar
WTGHSGMAILAPHLTRMT

SEQ ID NO: 2472954 - protein, 23 aa, Entamoeba dispar
YAKKLEVLKNMKFDEALLEGFQS

SEQ ID NO: 2472955 - protein, 18 aa, Entamoeba dispar
YFGKHGMRVFHLKANKYY

SEQ ID NO: 2472956 - protein, 22 aa, Entamoeba dispar
YIKVPLKEAEEIYIVSMKDYIF

SEQ ID NO: 2472957 - protein, 20 aa, Entamoeba dispar
YLAKMKKLLEEYKQVVVVKC

SEQ ID NO: 2472958 - protein, 18 aa, Entamoeba dispar
YLYAIAFGNVNNAIRVYS

SEQ ID NO: 2472959 - protein, 17 aa, Entamoeba dispar
YSKAIVTARPCIHLLNQ

SEQ ID NO: 2472960 - protein, 17 aa, Entamoeba dispar
YYPLLTLDFHTNKRVVD

SEQ ID NO: 2472961 - protein, 18 aa, Entamoeba dispar
AAKAYKINDFRKFFIDIQ

SEQ ID NO: 2472962 - protein, 18 aa, Entamoeba dispar
AAMSMPGMMDTILNLGLN

SEQ ID NO: 2472963 - protein, 22 aa, Entamoeba dispar
ADGFKKNDFRGVGIVWGSKQSN

SEQ ID NO: 2472964 - protein, 20 aa, Entamoeba dispar
ADGTFWPIPITMSVSEEEAK

SEQ ID NO: 2472965 - protein, 21 aa, Entamoeba dispar
ADQFRPLGIQVFHIQENSTMF

SEQ ID NO: 2472966 - protein, 22 aa, Entamoeba dispar
AEADIYFKPIIELKEIEQEKME

SEQ ID NO: 2472967 - protein, 17 aa, Entamoeba dispar
AEADPKLIVAIRIRGIN

SEQ ID NO: 2472968 - protein, 21 aa, Entamoeba dispar
AEDFIGSPLFMSPEVIKKSFY

SEQ ID NO: 2472969 - protein, 19 aa, Entamoeba dispar
AEEDFKMLGLDKVITVVLR

SEQ ID NO: 2472970 - protein, 19 aa, Entamoeba dispar
AEKMKNWLCVLAGDVTPLD

SEQ ID NO: 2472971 - protein, 23 aa, Entamoeba dispar
AEPISRLKSIKGFINGIEQLGFV

SEQ ID NO: 2472972 - protein, 20 aa, Entamoeba dispar
AESRKSYKELVAKRNEEVAK

SEQ ID NO: 2472973 - protein, 24 aa, Entamoeba dispar
AFTKTSACMSICLSATKDVIFTGH

SEQ ID NO: 2472974 - protein, 27 aa, Entamoeba dispar
AGCYNNCNFDVFLLCFSVTQRSSFRNI

SEQ ID NO: 2472975 - protein, 25 aa, Entamoeba dispar
AGDLPRLLKHLSIVRKTNENEISCL

SEQ ID NO: 2472976 - protein, 19 aa, Entamoeba dispar
AHAKEGFDVAMTRMDAEDD

SEQ ID NO: 2472977 - protein, 39 aa, Entamoeba dispar
AHKTEFSRQTFFRLGLFSLLLHEVMLEFNMSWNNSHEEE

SEQ ID NO: 2472978 - protein, 17 aa, Entamoeba dispar
AHMINAKVIPNCIGNIW

SEQ ID NO: 2472979 - protein, 18 aa, Entamoeba dispar
AIEGLHLFGDKKEMTLFK

SEQ ID NO: 2472980 - protein, 24 aa, Entamoeba dispar
AILNRYKVLKAHGMKVVSFADTDA

SEQ ID NO: 2472981 - protein, 20 aa, Entamoeba dispar
AINLKCILDKINEMYQIIRD

SEQ ID NO: 2472982 - protein, 20 aa, Entamoeba dispar
AISDLSLRFGEGSRKKKVMS

SEQ ID NO: 2472983 - protein, 26 aa, Entamoeba dispar
AKIVVKRLISAIGYLHSMNIVHRDLK

SEQ ID NO: 2472984 - protein, 18 aa, Entamoeba dispar
AKLQRIRAAAKELAEKTQ

SEQ ID NO: 2472985 - protein, 23 aa, Entamoeba dispar
AKLWDLKSGEPIQTYAVHEKGVV

SEQ ID NO: 2472986 - protein, 19 aa, Entamoeba dispar
ALETWPVDLFGQLLPRHLQ

SEQ ID NO: 2472987 - protein, 17 aa, Entamoeba dispar
ALKKGRYGEHINKMASV

SEQ ID NO: 2472988 - protein, 21 aa, Entamoeba dispar
ALLECKIKEMMKKNSEKDSTY

SEQ ID NO: 2472989 - protein, 24 aa, Entamoeba dispar
ALNALLKKNLRSIDYKYCMFEESR

SEQ ID NO: 2472990 - protein, 24 aa, Entamoeba dispar
ANEVCKRVGQPLPYNKSTSKLWRN

SEQ ID NO: 2472991 - protein, 21 aa, Entamoeba dispar
ANKKCGVACFLAQHKDRLTCG

SEQ ID NO: 2472992 - protein, 19 aa, Entamoeba dispar
ANLNTLLLLMLNDDDDITQ

SEQ ID NO: 2472993 - protein, 18 aa, Entamoeba dispar
ANQPFKCVPVKNLTEEEL

SEQ ID NO: 2472994 - protein, 23 aa, Entamoeba dispar
APCDDFPCCVHIVGLERENISSE

SEQ ID NO: 2472995 - protein, 24 aa, Entamoeba dispar
APGDKTAPVLLKYVDEIVTVDEES

SEQ ID NO: 2472996 - protein, 21 aa, Entamoeba dispar
APNYCSRCGNIASIMKVNENL

SEQ ID NO: 2472997 - protein, 25 aa, Entamoeba dispar
APSRFAIKSLQLFSINEIYFNSIAM

SEQ ID NO: 2472998 - protein, 18 aa, Entamoeba dispar
APTGMLARGEYKSNVKFY

SEQ ID NO: 2472999 - protein, 22 aa, Entamoeba dispar
APYCLPLIPKTVEWLNSELPPN

SEQ ID NO: 2473000 - protein, 41 aa, Entamoeba dispar
AQHIKTMIKIIRNVFPITDFWRHVCIVWTKCYCYIPKEVIE

SEQ ID NO: 2473001 - protein, 23 aa, Entamoeba dispar
AQPKFYLTGVFYFTLMYSGSNLK

SEQ ID NO: 2473002 - protein, 25 aa, Entamoeba dispar
AQSSRSHSIFMMDLCGRNIGSNEQR

SEQ ID NO: 2473003 - protein, 27 aa, Entamoeba dispar
ARFGIKELCKKVGLKAGSVFDTISVDI

SEQ ID NO: 2473004 - protein, 23 aa, Entamoeba dispar
ARRFCNKENVFAYVIGIFPNEES

SEQ ID NO: 2473005 - protein, 25 aa, Entamoeba dispar
ASAPQPPVIICREMLDTFIERTKAN

SEQ ID NO: 2473006 - protein, 23 aa, Entamoeba dispar
ASGDKYRMGNLFIVGPTKTGKTE

SEQ ID NO: 2473007 - protein, 33 aa, Entamoeba dispar
ASGKYTPYCQYMFYDCLEILPDKYLELPKEEFI

SEQ ID NO: 2473008 - protein, 19 aa, Entamoeba dispar
ASIKGHFFIDHGVGVVIGE

SEQ ID NO: 2473009 - protein, 26 aa, Entamoeba dispar
ASQNAEFKRLTLLMTNLPNKRLRDVS

SEQ ID NO: 2473010 - protein, 26 aa, Entamoeba dispar
ATFVPPAQIMFKWFNTIYKVGGDGCV

SEQ ID NO: 2473011 - protein, 17 aa, Entamoeba dispar
ATIIASILHKVSIPSKH

SEQ ID NO: 2473012 - protein, 17 aa, Entamoeba dispar
ATKVYHPNISFFGKICL

SEQ ID NO: 2473013 - protein, 19 aa, Entamoeba dispar
ATLLACKLAGIKNVELANE

SEQ ID NO: 2473014 - protein, 21 aa, Entamoeba dispar
AVGSRKHCCDIAMEYGATDII

SEQ ID NO: 2473015 - protein, 24 aa, Entamoeba dispar
AYDSYRRFVSLFGKIALNVDDEVY

SEQ ID NO: 2473016 - protein, 25 aa, Entamoeba dispar
AYHSLNLWLEYLLLCRNSNDFKLSQ

SEQ ID NO: 2473017 - protein, 17 aa, Entamoeba dispar
AYITPGGTYCMLIHNNS

SEQ ID NO: 2473018 - protein, 18 aa, Entamoeba dispar
AYSPCSKEIIVASFDGNK

SEQ ID NO: 2473019 - protein, 20 aa, Entamoeba dispar
CACKINYPHRFFLLRGNHES

SEQ ID NO: 2473020 - protein, 17 aa, Entamoeba dispar
CDIELIRNIGRIGNGIS

SEQ ID NO: 2473021 - protein, 25 aa, Entamoeba dispar
CFQVEYRLLCEVFTDSILRNSNVVL

SEQ ID NO: 2473022 - protein, 20 aa, Entamoeba dispar
CGDLTPTLMRFFKAIPQIKT

SEQ ID NO: 2473023 - protein, 30 aa, Entamoeba dispar
CGETRYPSYPLSRWSYCGVGEFQCNDGKSK

SEQ ID NO: 2473024 - protein, 20 aa, Entamoeba dispar
CGGLCPGLNNVIRGLVMNLQ

SEQ ID NO: 2473025 - protein, 19 aa, Entamoeba dispar
CGPHYKVAHDISLLIPEIW

SEQ ID NO: 2473026 - protein, 20 aa, Entamoeba dispar
CGYPSDIDTIKWMKCQYDPL

SEQ ID NO: 2473027 - protein, 24 aa, Entamoeba dispar
CGYTRRYGKGKILITGFHFEFDEQ

SEQ ID NO: 2473028 - protein, 25 aa, Entamoeba dispar
CHCKTDFKSVVLLAQSFLNLFNNEK

SEQ ID NO: 2473029 - protein, 17 aa, Entamoeba dispar
CIHPNKFYDDPFVMLNY

SEQ ID NO: 2473030 - protein, 20 aa, Entamoeba dispar
CIQCMKDAKLRKKDISDVVL

SEQ ID NO: 2473031 - protein, 19 aa, Entamoeba dispar
CISCGLTNCCFKNQYHRKM

SEQ ID NO: 2473032 - protein, 21 aa, Entamoeba dispar
CKASIDISKCYLKELTLREYQ

SEQ ID NO: 2473033 - protein, 17 aa, Entamoeba dispar
CKCGMKYCNFKCQQLDY

SEQ ID NO: 2473034 - protein, 22 aa, Entamoeba dispar
CKKECCCPRIKAFKKFMNTFEK

SEQ ID NO: 2473035 - protein, 20 aa, Entamoeba dispar
CKLGTFLFETEVSGWVHSIA

SEQ ID NO: 2473036 - protein, 17 aa, Entamoeba dispar
CKSLIKINIEYVTYIGD

SEQ ID NO: 2473037 - protein, 18 aa, Entamoeba dispar
CLDKEIYLSNVFIIIRIE

SEQ ID NO: 2473038 - protein, 18 aa, Entamoeba dispar
CLLLQFQDKRFQPIHDLT

SEQ ID NO: 2473039 - protein, 18 aa, Entamoeba dispar
CLLSKWCRITIKKPTRRS

SEQ ID NO: 2473040 - protein, 23 aa, Entamoeba dispar
CNGKEPYIKHGILGANILRELGL

SEQ ID NO: 2473041 - protein, 19 aa, Entamoeba dispar
CNHKEMFEHAIKGGFAVPG

SEQ ID NO: 2473042 - protein, 23 aa, Entamoeba dispar
CNRFIQCFGSFGWSGEGVKNLSA

SEQ ID NO: 2473043 - protein, 21 aa, Entamoeba dispar
CPKIAFLRMLKAAFYGAPADH

SEQ ID NO: 2473044 - protein, 20 aa, Entamoeba dispar
CPKTPCLLVGTKLDMREDKE

SEQ ID NO: 2473045 - protein, 24 aa, Entamoeba dispar
CQINIKSDCIERLKLEGNKQTQFK

SEQ ID NO: 2473046 - protein, 34 aa, Entamoeba dispar
CQTLVFNLTWSWVVSLRGLRKSTLDVVPIPNANS

SEQ ID NO: 2473047 - protein, 29 aa, Entamoeba dispar
CQYKYNGYEIILFFLKQILIRNDVININK

SEQ ID NO: 2473048 - protein, 19 aa, Entamoeba dispar
CRPTIRLAALSHYPSIFVF

SEQ ID NO: 2473049 - protein, 20 aa, Entamoeba dispar
CSAGPVGDDIFHWTATITGP

SEQ ID NO: 2473050 - protein, 31 aa, Entamoeba dispar
CSECIRRWLSVKEMCPICKRRTKQQEIEANI

SEQ ID NO: 2473051 - protein, 21 aa, Entamoeba dispar
CSLNPTIHCNRFIQCFGSFGW

SEQ ID NO: 2473052 - protein, 28 aa, Entamoeba dispar
CSYEPQNDCALWFIKVFPGNREFMMRAS

SEQ ID NO: 2473053 - protein, 18 aa, Entamoeba dispar
CTIHGGKIIDGKKNNVQE

SEQ ID NO: 2473054 - protein, 25 aa, Entamoeba dispar
CTLTIHWQFDVTLRGLRKVLTPNAE

SEQ ID NO: 2473055 - protein, 20 aa, Entamoeba dispar
CVIEHLWDILSPRGIGYIVI

SEQ ID NO: 2473056 - protein, 19 aa, Entamoeba dispar
CVIRCGISLELERKTKNDE

SEQ ID NO: 2473057 - protein, 29 aa, Entamoeba dispar
CYCESLLCYGQLILRKEMTRLNIGELLEF

SEQ ID NO: 2473058 - protein, 18 aa, Entamoeba dispar
DAKLRKKDISDVVLVGGM

SEQ ID NO: 2473059 - protein, 25 aa, Entamoeba dispar
DALKSIHADSSFSYRERIAQVNNIQ

SEQ ID NO: 2473060 - protein, 21 aa, Entamoeba dispar
DAQFAAVARGFRLYNQNPNAD

SEQ ID NO: 2473061 - protein, 20 aa, Entamoeba dispar
DASFIMALLQFPGINVNAKN

SEQ ID NO: 2473062 - protein, 19 aa, Entamoeba dispar
DCGKLKSLRVRNTVVNSQL

SEQ ID NO: 2473063 - protein, 24 aa, Entamoeba dispar
DDDMSFRHVYNWLSEARRFCNKEN

SEQ ID NO: 2473064 - protein, 24 aa, Entamoeba dispar
DDGRIFKTIIWYTVDYSTYLFEKE

SEQ ID NO: 2473065 - protein, 25 aa, Entamoeba dispar
DDTINCWDISTGVPSKRITFEQTMN

SEQ ID NO: 2473066 - protein, 24 aa, Entamoeba dispar
DECFKGCSSLTYIDIPTSITSFGN

SEQ ID NO: 2473067 - protein, 24 aa, Entamoeba dispar
DEFYVPNIIGVLILSMSKRIMNEL

SEQ ID NO: 2473068 - protein, 26 aa, Entamoeba dispar
DELKAICCSHGPVLRTNIKENIERYR

SEQ ID NO: 2473069 - protein, 21 aa, Entamoeba dispar
DEQHYRFILLDDINYDKNTVR

SEQ ID NO: 2473070 - protein, 21 aa, Entamoeba dispar
DEQNYRFILFDDINYDKNLLR

SEQ ID NO: 2473071 - protein, 18 aa, Entamoeba dispar
DEWVTVGKGVSWKKIKQN

SEQ ID NO: 2473072 - protein, 20 aa, Entamoeba dispar
DEWYSLYYERNFVLNDQYVN

SEQ ID NO: 2473073 - protein, 27 aa, Entamoeba dispar
DFKELAQSEVHLFEQASAIFLTASNNI

SEQ ID NO: 2473074 - protein, 25 aa, Entamoeba dispar
DFPPVNGKESWAIKSIFLGKKSYLD

SEQ ID NO: 2473075 - protein, 26 aa, Entamoeba dispar
DFPPVNGKESWAIKSIFLGKKSYLDV

SEQ ID NO: 2473076 - protein, 25 aa, Entamoeba dispar
DFSCMPPLRMKTSMISPYAYYPPER

SEQ ID NO: 2473077 - protein, 26 aa, Entamoeba dispar
DFTTNRVEGFFGHLKKIIKHSQVPFY

SEQ ID NO: 2473078 - protein, 20 aa, Entamoeba dispar
DGACTQFGFTDCKIDTLTCD

SEQ ID NO: 2473079 - protein, 26 aa, Entamoeba dispar
DGAKKRLNKIIGCGGGERLVSASDDG

SEQ ID NO: 2473080 - protein, 26 aa, Entamoeba dispar
DGAVGKTCLLLAFSKGEIPTAYVPTV

SEQ ID NO: 2473081 - protein, 21 aa, Entamoeba dispar
DGESRLECLHRGVIKNYQFQK

SEQ ID NO: 2473082 - protein, 17 aa, Entamoeba dispar
DGISKLNEELMQIKKEK

SEQ ID NO: 2473083 - protein, 17 aa, Entamoeba dispar
DGLEILVTMSILKLTEP

SEQ ID NO: 2473084 - protein, 20 aa, Entamoeba dispar
DGRIVKTIIWYTVDYSTYLK

SEQ ID NO: 2473085 - protein, 26 aa, Entamoeba dispar
DGVLDKLEFRSCLSSMGLIDIDFTGG

SEQ ID NO: 2473086 - protein, 23 aa, Entamoeba dispar
DHAAAYRYAKLLNIQLPRELLTG

SEQ ID NO: 2473087 - protein, 18 aa, Entamoeba dispar
DIEFKYPYNKSMKDFVSP

SEQ ID NO: 2473088 - protein, 23 aa, Entamoeba dispar
DIIWPEFKSLISTRGEQITINVK

SEQ ID NO: 2473089 - protein, 22 aa, Entamoeba dispar
DIKAICYMECSALTRSGLNQVF

SEQ ID NO: 2473090 - protein, 19 aa, Entamoeba dispar
DIKPKRIIFKLIEEYIKVS

SEQ ID NO: 2473091 - protein, 20 aa, Entamoeba dispar
DILSPRGIGYIVIIQDNDPK

SEQ ID NO: 2473092 - protein, 24 aa, Entamoeba dispar
DIRKKLEIVTCITKGFVFEDQERN

SEQ ID NO: 2473093 - protein, 24 aa, Entamoeba dispar
DIVRPRKLLYLAVDGVAPRAKMNQ

SEQ ID NO: 2473094 - protein, 29 aa, Entamoeba dispar
DIYSLGIVFWEIFRRVVFGSYTKPWFKEY

SEQ ID NO: 2473095 - protein, 23 aa, Entamoeba dispar
DKIKRKYIAFKKVFEEHGEDVEY

SEQ ID NO: 2473096 - protein, 18 aa, Entamoeba dispar
DLAIGCLVICEYPSGKEL

SEQ ID NO: 2473097 - protein, 28 aa, Entamoeba dispar
DLISLKKLWIILGWYYFYENIKESELEK

SEQ ID NO: 2473098 - protein, 26 aa, Entamoeba dispar
DLRRLHVETILTLWVFLQESKKNPRV

SEQ ID NO: 2473099 - protein, 23 aa, Entamoeba dispar
DLSIACLMPSTDVVLENNTSSKN

SEQ ID NO: 2473100 - protein, 17 aa, Entamoeba dispar
DNLYFDVAVGFKEGQPL

SEQ ID NO: 2473101 - protein, 25 aa, Entamoeba dispar
DNTKKAYEWKGTYCSDGVSNCVIEI

SEQ ID NO: 2473102 - protein, 22 aa, Entamoeba dispar
DPCNPNHPITLPLRDPEEEIKG

SEQ ID NO: 2473103 - protein, 19 aa, Entamoeba dispar
DPFVFKRKGDGKIINKIIP

SEQ ID NO: 2473104 - protein, 19 aa, Entamoeba dispar
DPIFSIGMVLSTLNKRFDN

SEQ ID NO: 2473105 - protein, 29 aa, Entamoeba dispar
DQIIDFNLQWYITCSFDRYICTPTEDEDI

SEQ ID NO: 2473106 - protein, 23 aa, Entamoeba dispar
DRERYGLKIPKGFNGIGDECFEG

SEQ ID NO: 2473107 - protein, 20 aa, Entamoeba dispar
DRKKIMLHMIHIYKEKKEEE

SEQ ID NO: 2473108 - protein, 20 aa, Entamoeba dispar
DSDVVLLCFAVNNRTSFDNI

SEQ ID NO: 2473109 - protein, 25 aa, Entamoeba dispar
DSKIKEILPTGAIVYEKCPNCGNET

SEQ ID NO: 2473110 - protein, 28 aa, Entamoeba dispar
DSKVIIKIICFICSFITEKEEIQEIVSS

SEQ ID NO: 2473111 - protein, 24 aa, Entamoeba dispar
DSSVGKTCIIGRFMTGDFSTGYEA

SEQ ID NO: 2473112 - protein, 20 aa, Entamoeba dispar
DSTIIFNCPSAFSVDDQLNC

SEQ ID NO: 2473113 - protein, 23 aa, Entamoeba dispar
DVDEYKSVIVINNIPMTFSSNEL

SEQ ID NO: 2473114 - protein, 20 aa, Entamoeba dispar
DVLVKLTMSGFFGVREVALK

SEQ ID NO: 2473115 - protein, 20 aa, Entamoeba dispar
DVNKFCRIFNPPTCNCNLLN

SEQ ID NO: 2473116 - protein, 18 aa, Entamoeba dispar
DVNPEFIPYIPTLSKFLS

SEQ ID NO: 2473117 - protein, 25 aa, Entamoeba dispar
DVSPKRIDNVFALPYGRYNVDVTQL

SEQ ID NO: 2473118 - protein, 25 aa, Entamoeba dispar
DWTFYCHKCDGMASLRTCPHTKKDR

SEQ ID NO: 2473119 - protein, 18 aa, Entamoeba dispar
DYFLKVSIIGDRGSGKTC

SEQ ID NO: 2473120 - protein, 25 aa, Entamoeba dispar
DYLRIIFDISHSFQREELVIVPRTK

SEQ ID NO: 2473121 - protein, 20 aa, Entamoeba dispar
DYSEEFKIAMNFQSKEITTS

SEQ ID NO: 2473122 - protein, 17 aa, Entamoeba dispar
EAILLLCDALKKNSTNS

SEQ ID NO: 2473123 - protein, 23 aa, Entamoeba dispar
EANHFSEYLLLKEVKIPTTVTSI

SEQ ID NO: 2473124 - protein, 27 aa, Entamoeba dispar
EATLEELHFWPSFYLHAVLFNKTDPSY

SEQ ID NO: 2473125 - protein, 17 aa, Entamoeba dispar
ECFYLCYSLQSINIPST

SEQ ID NO: 2473126 - protein, 24 aa, Entamoeba dispar
ECPITPDIYTAVFFGWQNSPTTCV

SEQ ID NO: 2473127 - protein, 26 aa, Entamoeba dispar
ECVECLEAGGIKEVDSIFFIEITDIE

SEQ ID NO: 2473128 - protein, 23 aa, Entamoeba dispar
EDCRLLWKYRYLVEKTKPGSLAR

SEQ ID NO: 2473129 - protein, 19 aa, Entamoeba dispar
EDEIIKLTAQYTARNGSNF

SEQ ID NO: 2473130 - protein, 23 aa, Entamoeba dispar
EDEIVKMLTWVRSLTSINVEEVK

SEQ ID NO: 2473131 - protein, 22 aa, Entamoeba dispar
EDGARIVKEFQFNQNNTDMVKL

SEQ ID NO: 2473132 - protein, 23 aa, Entamoeba dispar
EDGKRYFKQCEFKLWRKQPQPIK

SEQ ID NO: 2473133 - protein, 25 aa, Entamoeba dispar
EDHLLRYKFLLAFEREMLHLEDQYP

SEQ ID NO: 2473134 - protein, 24 aa, Entamoeba dispar
EDKIYKLSPVWLATISSNSITGRK

SEQ ID NO: 2473135 - protein, 19 aa, Entamoeba dispar
EDKTWGEIITRLRHLKTTI

SEQ ID NO: 2473136 - protein, 22 aa, Entamoeba dispar
EDLAKREGFEYIETSAKSNNNV

SEQ ID NO: 2473137 - protein, 26 aa, Entamoeba dispar
EDRQIDLWPNFQFFLNEQAKEKYGDA

SEQ ID NO: 2473138 - protein, 19 aa, Entamoeba dispar
EDSIFCNKKGSFLVEEFVG

SEQ ID NO: 2473139 - protein, 27 aa, Entamoeba dispar
EDYYNCCGFCLKTLCSKEPKNKYNQIF

SEQ ID NO: 2473140 - protein, 19 aa, Entamoeba dispar
EECYLKIIHYFISQEEIEK

SEQ ID NO: 2473141 - protein, 23 aa, Entamoeba dispar
EEFKERGRGEVEILKHPNTQLSR

SEQ ID NO: 2473142 - protein, 23 aa, Entamoeba dispar
EEHGTVCPINWKAGKDTIEPTPE

SEQ ID NO: 2473143 - protein, 29 aa, Entamoeba dispar
EEHSKRLKIKLTIEKEVFKNTVIQQDFNV

SEQ ID NO: 2473144 - protein, 18 aa, Entamoeba dispar
EEIFRKCLVQVPDVEIAK

SEQ ID NO: 2473145 - protein, 21 aa, Entamoeba dispar
EEIKKLIKWARGLPSIDKEEI

SEQ ID NO: 2473146 - protein, 17 aa, Entamoeba dispar
EELRKIRNGEIIINKEV

SEQ ID NO: 2473147 - protein, 28 aa, Entamoeba dispar
EERGCARSLKWLCQCIYYNELIIPDEEG

SEQ ID NO: 2473148 - protein, 23 aa, Entamoeba dispar
EESEFKGMIGITQPRRIAATAMA

SEQ ID NO: 2473149 - protein, 24 aa, Entamoeba dispar
EESRLNFAKKGWKTIAALQLRNPM

SEQ ID NO: 2473150 - protein, 17 aa, Entamoeba dispar
EEVKFESVVPFTNFNHH

SEQ ID NO: 2473151 - protein, 23 aa, Entamoeba dispar
EEWEHIIFYCCFLMMIQNNKIMM

SEQ ID NO: 2473152 - protein, 20 aa, Entamoeba dispar
EEYKYIVLGCDGLWDTLNGI

SEQ ID NO: 2473153 - protein, 20 aa, Entamoeba dispar
EFEDCNQKEFDRCMKCVDDI

SEQ ID NO: 2473154 - protein, 24 aa, Entamoeba dispar
EFLFKMKRINMVTAQNVIDNLIDS

SEQ ID NO: 2473155 - protein, 24 aa, Entamoeba dispar
EGHKANVCGIGISREGQYIYTCSE

SEQ ID NO: 2473156 - protein, 20 aa, Entamoeba dispar
EGNELWNFVVRKQCDITKQS

SEQ ID NO: 2473157 - protein, 20 aa, Entamoeba dispar
EGRNKLGYQECVECLEAGGI

SEQ ID NO: 2473158 - protein, 21 aa, Entamoeba dispar
EHAAILWRISRFNGKTQQTIT

SEQ ID NO: 2473159 - protein, 25 aa, Entamoeba dispar
EHAIKGGFAVPGFNFNNLEQMQAII

SEQ ID NO: 2473160 - protein, 20 aa, Entamoeba dispar
EHAPSIIFMDEIDSIGSSRI

SEQ ID NO: 2473161 - protein, 18 aa, Entamoeba dispar
EHICEFCGKAFLRKSECE

SEQ ID NO: 2473162 - protein, 19 aa, Entamoeba dispar
EHQGIKIDFIGSIEYSYDR

SEQ ID NO: 2473163 - protein, 18 aa, Entamoeba dispar
EIAAQICRQAGLVKHKGL

SEQ ID NO: 2473164 - protein, 19 aa, Entamoeba dispar
EIGHWCFNECYSLKSINVE

SEQ ID NO: 2473165 - protein, 18 aa, Entamoeba dispar
EIHLPCLNGLPPIPTSIL

SEQ ID NO: 2473166 - protein, 24 aa, Entamoeba dispar
EIKACCTEAGMFALRERRSHVTQE

SEQ ID NO: 2473167 - protein, 21 aa, Entamoeba dispar
EILLYLCACKINYPHRFFLLR

SEQ ID NO: 2473168 - protein, 33 aa, Entamoeba dispar
EILNNCPLYQLLPLQTFCDLLSISVNPQLINGI

SEQ ID NO: 2473169 - protein, 19 aa, Entamoeba dispar
EINRFCEPPSKGIICDLLW

SEQ ID NO: 2473170 - protein, 21 aa, Entamoeba dispar
EIPNALIAADIIKIYLRNLPE

SEQ ID NO: 2473171 - protein, 27 aa, Entamoeba dispar
EKEDCVIQWKIPTAGFTEKLSKSIDEI

SEQ ID NO: 2473172 - protein, 21 aa, Entamoeba dispar
EKEEFCCHLELNDAIDIGATY

SEQ ID NO: 2473173 - protein, 18 aa, Entamoeba dispar
EKFMPALIQYYKQPQEKH

SEQ ID NO: 2473174 - protein, 22 aa, Entamoeba dispar
EKGEIFLFLVGNKLDLGHREVT

SEQ ID NO: 2473175 - protein, 23 aa, Entamoeba dispar
EKGEWVPVLVLLRIDFAATDIKW

SEQ ID NO: 2473176 - protein, 22 aa, Entamoeba dispar
EKGISRGTGFVCFRKRGVADKI

SEQ ID NO: 2473177 - protein, 21 aa, Entamoeba dispar
EKGYEYLIKQVELIEDAHYNI

SEQ ID NO: 2473178 - protein, 17 aa, Entamoeba dispar
EKIDCVIEHLWDILSPR

SEQ ID NO: 2473179 - protein, 28 aa, Entamoeba dispar
EKIFNELFFTYTICQNVNDPFLMMYDDE

SEQ ID NO: 2473180 - protein, 17 aa, Entamoeba dispar
EKKERRKSLSINVNDEV

SEQ ID NO: 2473181 - protein, 20 aa, Entamoeba dispar
EKKPVLKMTISLNHSQKAKE

SEQ ID NO: 2473182 - protein, 22 aa, Entamoeba dispar
EKQDIWSLGMILYFIITGDHVF

SEQ ID NO: 2473183 - protein, 21 aa, Entamoeba dispar
EKRIKMIDSITEFNEESEAKS

SEQ ID NO: 2473184 - protein, 19 aa, Entamoeba dispar
EKVRVCAKQASIIKEMGFS

SEQ ID NO: 2473185 - protein, 22 aa, Entamoeba dispar
EKYKQIFGRLVFNLVNKKQEEK

SEQ ID NO: 2473186 - protein, 22 aa, Entamoeba dispar
ELCKRARLAKTNAYITSYLREQ

SEQ ID NO: 2473187 - protein, 23 aa, Entamoeba dispar
ELDKRLGDDGGFFKNIGKQQKRI

SEQ ID NO: 2473188 - protein, 26 aa, Entamoeba dispar
ELKGNVRVFCRVRPPLKNEGISVDVT

SEQ ID NO: 2473189 - protein, 23 aa, Entamoeba dispar
ELMKATETITGFKQANIEESAWM

SEQ ID NO: 2473190 - protein, 20 aa, Entamoeba dispar
ELNLSINWNDFVVVETIDFD

SEQ ID NO: 2473191 - protein, 18 aa, Entamoeba dispar
ELSSDLFANYVIQKALEF

SEQ ID NO: 2473192 - protein, 25 aa, Entamoeba dispar
ELYSRGYKRVGIMVGGYKMYHKYFI

SEQ ID NO: 2473193 - protein, 18 aa, Entamoeba dispar
EMIGDLPFAEIKPPENVL

SEQ ID NO: 2473194 - protein, 24 aa, Entamoeba dispar
EMMIKPESKLSMIFNNIKKEVEKK

SEQ ID NO: 2473195 - protein, 24 aa, Entamoeba dispar
EMMIKPESKLTMIFNNIKKEVEKK

SEQ ID NO: 2473196 - protein, 20 aa, Entamoeba dispar
EMPTSYSLMGSVIVNKMRHN

SEQ ID NO: 2473197 - protein, 23 aa, Entamoeba dispar
ENAHMYREFGGRINGFKHNEKQK

SEQ ID NO: 2473198 - protein, 23 aa, Entamoeba dispar
ENKPFVCVAIAGWIFSAKIPETI

SEQ ID NO: 2473199 - protein, 24 aa, Entamoeba dispar
ENLFKHKLIDFIIEFMQEIDKEIS

SEQ ID NO: 2473200 - protein, 17 aa, Entamoeba dispar
ENLKLIVENGISKVPHN

SEQ ID NO: 2473201 - protein, 20 aa, Entamoeba dispar
ENLVKYCCHQFGGYTVQKIA

SEQ ID NO: 2473202 - protein, 20 aa, Entamoeba dispar
ENRDYLAFDLNIFVVLNDWY

SEQ ID NO: 2473203 - protein, 17 aa, Entamoeba dispar
EPIRLADLISRNLLRNE

SEQ ID NO: 2473204 - protein, 20 aa, Entamoeba dispar
EPYDGIEVFVEKNIVNVDDP

SEQ ID NO: 2473205 - protein, 17 aa, Entamoeba dispar
EQEPKYLIEHGYLEPCP

SEQ ID NO: 2473206 - protein, 25 aa, Entamoeba dispar
EQIICFDYLQSQGWSMLMEADGGAF

SEQ ID NO: 2473207 - protein, 28 aa, Entamoeba dispar
EQQLRYVLNETLKGLVYLHSIKIIHHDI

SEQ ID NO: 2473208 - protein, 25 aa, Entamoeba dispar
EQQNEMMGGFGMMRGFIPNNMPMGG

SEQ ID NO: 2473209 - protein, 25 aa, Entamoeba dispar
EQTKRASFMNYLWRGYSVDGLPQNV

SEQ ID NO: 2473210 - protein, 23 aa, Entamoeba dispar
EQYEVIKSTSLREYSFDEEYLID

SEQ ID NO: 2473211 - protein, 18 aa, Entamoeba dispar
EREIAIKMTEELKKIKAR

SEQ ID NO: 2473212 - protein, 20 aa, Entamoeba dispar
ERIFGCSKYLSNQCLWVNNS

SEQ ID NO: 2473213 - protein, 17 aa, Entamoeba dispar
ERIPKWYETNGKALTEI

SEQ ID NO: 2473214 - protein, 22 aa, Entamoeba dispar
ERKDFKDPFFFKKNKIKKSKKI

SEQ ID NO: 2473215 - protein, 19 aa, Entamoeba dispar
ERPTRILINGIYERINEEW

SEQ ID NO: 2473216 - protein, 21 aa, Entamoeba dispar
ERTGKEWFKKVREIMEISRCN

SEQ ID NO: 2473217 - protein, 30 aa, Entamoeba dispar
ESFKKRAPKAIKIIRFLAIKTMKTHVVKFD

SEQ ID NO: 2473218 - protein, 27 aa, Entamoeba dispar
ESLDIPKFIKRRGKEYFEIHKNKRAIV

SEQ ID NO: 2473219 - protein, 17 aa, Entamoeba dispar
ESVRRFVGHEGDVMSVA

SEQ ID NO: 2473220 - protein, 23 aa, Entamoeba dispar
ETDKIPITFCVLRNELFVPCNYR

SEQ ID NO: 2473221 - protein, 25 aa, Entamoeba dispar
ETKVFRLAFDSEITRDEWTTIFQKF

SEQ ID NO: 2473222 - protein, 25 aa, Entamoeba dispar
ETPEYWLEAGNPWEIVRKDVNHEVR

SEQ ID NO: 2473223 - protein, 25 aa, Entamoeba dispar
ETTMNKWSSVITEIQSPSRQNNFPS

SEQ ID NO: 2473224 - protein, 26 aa, Entamoeba dispar
ETYKTNFAGLLWRPQPTNIIKPEMAK

SEQ ID NO: 2473225 - protein, 18 aa, Entamoeba dispar
EVALKIIRKNERMVKLSQ

SEQ ID NO: 2473226 - protein, 24 aa, Entamoeba dispar
EVCGIDINLGCGMWFSTKGEMGQA

SEQ ID NO: 2473227 - protein, 23 aa, Entamoeba dispar
EVKRINLEYGKGVFSKKRYQKEE

SEQ ID NO: 2473228 - protein, 26 aa, Entamoeba dispar
EVKTLLNTRMHLWLEYYTINQAMSSN

SEQ ID NO: 2473229 - protein, 22 aa, Entamoeba dispar
EVTFPCIYGMAAKRTIPSGFYQ

SEQ ID NO: 2473230 - protein, 17 aa, Entamoeba dispar
EVYPHLIFDNLTTPLGK

SEQ ID NO: 2473231 - protein, 27 aa, Entamoeba dispar
EVYYNGLPLRFGYSIEDFCERKYQMEQ

SEQ ID NO: 2473232 - protein, 17 aa, Entamoeba dispar
EWSILYEKLENIVKSGA

SEQ ID NO: 2473233 - protein, 23 aa, Entamoeba dispar
EYCKKECCCPRIKAFKKFMNTFE

SEQ ID NO: 2473234 - protein, 18 aa, Entamoeba dispar
EYDIKQILNELGYDVSEG

SEQ ID NO: 2473235 - protein, 20 aa, Entamoeba dispar
EYLKNCAKTSMQSKLIAMQR

SEQ ID NO: 2473236 - protein, 24 aa, Entamoeba dispar
EYNPKRFAGAIMRISSPKSTALIF

SEQ ID NO: 2473237 - protein, 26 aa, Entamoeba dispar
EYRWKEGKELFSLPANEYINKCLDYV

SEQ ID NO: 2473238 - protein, 21 aa, Entamoeba dispar
EYRYPKVYLEKVIYEKRNIEE

SEQ ID NO: 2473239 - protein, 21 aa, Entamoeba dispar
FAIQEIFLKYNTFMLRGDSLF

SEQ ID NO: 2473240 - protein, 20 aa, Entamoeba dispar
FAYTCDMHVLVILTDMSSYA

SEQ ID NO: 2473241 - protein, 23 aa, Entamoeba dispar
FDDECYRNEILLGDFTLDLRRLH

SEQ ID NO: 2473242 - protein, 25 aa, Entamoeba dispar
FDKCKKLYIDECENCQFIINKNQIK

SEQ ID NO: 2473243 - protein, 17 aa, Entamoeba dispar
FDMKNALLLIRKNVLHQ

SEQ ID NO: 2473244 - protein, 24 aa, Entamoeba dispar
FDSRIINFFPDYTNPIMFINCDGR

SEQ ID NO: 2473245 - protein, 24 aa, Entamoeba dispar
FEGLKELEVLGAKIGELQMEKRIV

SEQ ID NO: 2473246 - protein, 18 aa, Entamoeba dispar
FEKNRFKNFLTYLQNYDE

SEQ ID NO: 2473247 - protein, 18 aa, Entamoeba dispar
FENTRQLLISQFRDVNKY

SEQ ID NO: 2473248 - protein, 19 aa, Entamoeba dispar
FENTRQLLISQFRDVNKYI

SEQ ID NO: 2473249 - protein, 19 aa, Entamoeba dispar
FETKVLDLNAICFVAQSSN

SEQ ID NO: 2473250 - protein, 21 aa, Entamoeba dispar
FFERYRWIMHDVILIEKDGQK

SEQ ID NO: 2473251 - protein, 29 aa, Entamoeba dispar
FFGKICLDTLKPQGWVCAMQISSVLQTIQ

SEQ ID NO: 2473252 - protein, 19 aa, Entamoeba dispar
FFKTEIEPIKNYKEQGESY

SEQ ID NO: 2473253 - protein, 20 aa, Entamoeba dispar
FFYYNSFNIIIGKQGAGKTT

SEQ ID NO: 2473254 - protein, 18 aa, Entamoeba dispar
FGAKEHFVNAIICQIAND

SEQ ID NO: 2473255 - protein, 21 aa, Entamoeba dispar
FGEAIMASGLVLNENTHWLTF

SEQ ID NO: 2473256 - protein, 24 aa, Entamoeba dispar
FGSLHNCGVVIPKGINTLKGIISG

SEQ ID NO: 2473257 - protein, 27 aa, Entamoeba dispar
FHLFLKEGFRILKPNGLMIIAEPISRL

SEQ ID NO: 2473258 - protein, 22 aa, Entamoeba dispar
FIDKLNCYYLNVSHIQNLRELS

SEQ ID NO: 2473259 - protein, 23 aa, Entamoeba dispar
FIKKLRIFFPNIIDLKYVTNQIS

SEQ ID NO: 2473260 - protein, 18 aa, Entamoeba dispar
FIPNALKSYGDFDLDLYM

SEQ ID NO: 2473261 - protein, 21 aa, Entamoeba dispar
FIPTILYGARASIPGVKNNTE

SEQ ID NO: 2473262 - protein, 17 aa, Entamoeba dispar
FIRKRIEYDSRIKQGDF

SEQ ID NO: 2473263 - protein, 17 aa, Entamoeba dispar
FISFGRKSIDCSAIMKY

SEQ ID NO: 2473264 - protein, 23 aa, Entamoeba dispar
FKDGRIFKYVIWYLVNYSEYLQE

SEQ ID NO: 2473265 - protein, 24 aa, Entamoeba dispar
FKDVECAILVAGMPRKVGMERKEL

SEQ ID NO: 2473266 - protein, 20 aa, Entamoeba dispar
FKDYCIKYYCFRNVSYQFGR

SEQ ID NO: 2473267 - protein, 21 aa, Entamoeba dispar
FKFKSIFIDNVIVKCQIYDTA

SEQ ID NO: 2473268 - protein, 17 aa, Entamoeba dispar
FKIAMNFQSKEITTSED

SEQ ID NO: 2473269 - protein, 20 aa, Entamoeba dispar
FKKDINEFIIPSSITKLGDH

SEQ ID NO: 2473270 - protein, 19 aa, Entamoeba dispar
FKNGQPINLYWSHGNQNQH

SEQ ID NO: 2473271 - protein, 24 aa, Entamoeba dispar
FKPEIQNGRFIPTILYGARASIPG

SEQ ID NO: 2473272 - protein, 22 aa, Entamoeba dispar
FKPTWKISCELIVKTIVVTPNV

SEQ ID NO: 2473273 - protein, 27 aa, Entamoeba dispar
FKTLKELIMRIPLKLGGGMKEQITNLT

SEQ ID NO: 2473274 - protein, 20 aa, Entamoeba dispar
FKTQVATIIIFKGYSKENFN

SEQ ID NO: 2473275 - protein, 21 aa, Entamoeba dispar
FKTQVATIIIFKGYSKENFNY

SEQ ID NO: 2473276 - protein, 21 aa, Entamoeba dispar
FKYFIHELVKITFYDYPLQHC

SEQ ID NO: 2473277 - protein, 19 aa, Entamoeba dispar
FLAASCPKLIAPAMNTTML

SEQ ID NO: 2473278 - protein, 20 aa, Entamoeba dispar
FLKNVIIKKEIVPFRKHNGG

SEQ ID NO: 2473279 - protein, 25 aa, Entamoeba dispar
FLSKADLLGGYGFNVRLEDIINGNV

SEQ ID NO: 2473280 - protein, 17 aa, Entamoeba dispar
FLTFTEAEDAYQFVEKV

SEQ ID NO: 2473281 - protein, 17 aa, Entamoeba dispar
FMELITWAIDIDFLSTD

SEQ ID NO: 2473282 - protein, 17 aa, Entamoeba dispar
FNCPSAFSVDDQLNCSF

SEQ ID NO: 2473283 - protein, 20 aa, Entamoeba dispar
FNSIAMKFGITINVSCELGY

SEQ ID NO: 2473284 - protein, 25 aa, Entamoeba dispar
FPGNREFMMRASFELPSIRDEETDK

SEQ ID NO: 2473285 - protein, 20 aa, Entamoeba dispar
FPKKHRSFMKRWSKTQQLGI

SEQ ID NO: 2473286 - protein, 17 aa, Entamoeba dispar
FPTVYGLASRRTVPPGF

SEQ ID NO: 2473287 - protein, 20 aa, Entamoeba dispar
FQICKECVDNGFSNVMIDGS

SEQ ID NO: 2473288 - protein, 21 aa, Entamoeba dispar
FRDAKLYYERQFHHSIPAILS

SEQ ID NO: 2473289 - protein, 22 aa, Entamoeba dispar
FRIPLPDILHWMNIDISSSSGK

SEQ ID NO: 2473290 - protein, 25 aa, Entamoeba dispar
FSDKHGAVCPINWKAGKDTIEPTPE

SEQ ID NO: 2473291 - protein, 17 aa, Entamoeba dispar
FSECPSLTSIDIGNVQF

SEQ ID NO: 2473292 - protein, 28 aa, Entamoeba dispar
FSKEKRIAGKLDHFFPIQKIWNQSGVIM

SEQ ID NO: 2473293 - protein, 19 aa, Entamoeba dispar
FTSPCFLKPLELGADVALH

SEQ ID NO: 2473294 - protein, 19 aa, Entamoeba dispar
FTTIFNCPSAFSVDDQLNC

SEQ ID NO: 2473295 - protein, 24 aa, Entamoeba dispar
FVEYCYLNPGYGYEVYKEGADVLV

SEQ ID NO: 2473296 - protein, 24 aa, Entamoeba dispar
FVVYSEPFAVYGINLPNQSGATAE

SEQ ID NO: 2473297 - protein, 24 aa, Entamoeba dispar
FWPDDNGLCSLKCNQEIEGCHVIG

SEQ ID NO: 2473298 - protein, 18 aa, Entamoeba dispar
FWYSCVNSYTSRTGDFSA

SEQ ID NO: 2473299 - protein, 18 aa, Entamoeba dispar
FYDIFDYLSSSQLQTTKE

SEQ ID NO: 2473300 - protein, 21 aa, Entamoeba dispar
FYKQQCAYLASSISLPQITVA

SEQ ID NO: 2473301 - protein, 23 aa, Entamoeba dispar
GAFELQCWKELKEFAKNVKGKAK

SEQ ID NO: 2473302 - protein, 30 aa, Entamoeba dispar
GAITHKEPHMWLRRGLFFCHRDINPILDDV

SEQ ID NO: 2473303 - protein, 22 aa, Entamoeba dispar
GAKRRFDAKFGAIASNIRKYNE

SEQ ID NO: 2473304 - protein, 18 aa, Entamoeba dispar
GAVGKTCLLICYTTNEFP

SEQ ID NO: 2473305 - protein, 20 aa, Entamoeba dispar
GAVGKTCLLISYTTNAFPNE

SEQ ID NO: 2473306 - protein, 17 aa, Entamoeba dispar
GAYSYAIKIVGLDLNAI

SEQ ID NO: 2473307 - protein, 19 aa, Entamoeba dispar
GCGICNGEEGIIMSPHSSS

SEQ ID NO: 2473308 - protein, 22 aa, Entamoeba dispar
GCVIRCGISLELERKTKNDEGL

SEQ ID NO: 2473309 - protein, 18 aa, Entamoeba dispar
GDGSLRMFDLRSLEHSTI

SEQ ID NO: 2473310 - protein, 27 aa, Entamoeba dispar
GDMTSTFCGTAAYLAPEILLGEKYDSA

SEQ ID NO: 2473311 - protein, 19 aa, Entamoeba dispar
GDSLPVFGDKFIKNLQFLK

SEQ ID NO: 2473312 - protein, 17 aa, Entamoeba dispar
GDYCFYECTSLESINIP

SEQ ID NO: 2473313 - protein, 18 aa, Entamoeba dispar
GEAARFLFSPTQCKEFLS

SEQ ID NO: 2473314 - protein, 17 aa, Entamoeba dispar
GEARLSLECKDRIVESF

SEQ ID NO: 2473315 - protein, 27 aa, Entamoeba dispar
GEDNYPCWFEGPPFKFKKSMKDIHTRF

SEQ ID NO: 2473316 - protein, 18 aa, Entamoeba dispar
GELFDRISDKTFYPEDKA

SEQ ID NO: 2473317 - protein, 22 aa, Entamoeba dispar
GELSFKEGDIITVLKKEGDWWL

SEQ ID NO: 2473318 - protein, 23 aa, Entamoeba dispar
GEMKQECPLCHRLIPLSEMDKHM

SEQ ID NO: 2473319 - protein, 25 aa, Entamoeba dispar
GERIQIKITLVFRHYATMGLTGQVQ

SEQ ID NO: 2473320 - protein, 21 aa, Entamoeba dispar
GEVFVPRKAPTEFREHEQREP

SEQ ID NO: 2473321 - protein, 22 aa, Entamoeba dispar
GEVGVIRRIFERIVKQKLSTKT

SEQ ID NO: 2473322 - protein, 24 aa, Entamoeba dispar
GFPIKGVWKHVCIVWTKCYNCYSQ

SEQ ID NO: 2473323 - protein, 21 aa, Entamoeba dispar
GFQTKDLWKTGGIKQSPMDKY

SEQ ID NO: 2473324 - protein, 18 aa, Entamoeba dispar
GGCFRECTSLTSINIPSS

SEQ ID NO: 2473325 - protein, 21 aa, Entamoeba dispar
GGIDGFVRFWDLRKPNQELCH

SEQ ID NO: 2473326 - protein, 17 aa, Entamoeba dispar
GGKCLRFDELALKAPTG

SEQ ID NO: 2473327 - protein, 22 aa, Entamoeba dispar
GGSRPFGISTLIGGFDPDGTPR

SEQ ID NO: 2473328 - protein, 23 aa, Entamoeba dispar
GGVGPLMVCTQVAGTLHLVDVLK

SEQ ID NO: 2473329 - protein, 21 aa, Entamoeba dispar
GGYACEFEIFITIKCTTKIKE

SEQ ID NO: 2473330 - protein, 28 aa, Entamoeba dispar
GIEFCCKITEGVLLRMVLSDLIKQSQSK

SEQ ID NO: 2473331 - protein, 19 aa, Entamoeba dispar
GIEKLKCQEIHIFYYRGQE

SEQ ID NO: 2473332 - protein, 23 aa, Entamoeba dispar
GIEYSGCCGLLCIIEIKEKKRII

SEQ ID NO: 2473333 - protein, 17 aa, Entamoeba dispar
GIIGWVISYFLPCKETL

SEQ ID NO: 2473334 - protein, 17 aa, Entamoeba dispar
GKDCFKSSSIRLMTIPN

SEQ ID NO: 2473335 - protein, 21 aa, Entamoeba dispar
GKEKLGNVFMWDAGSTVGEIS

SEQ ID NO: 2473336 - protein, 18 aa, Entamoeba dispar
GKELLPLPAKRLPKQPRP

SEQ ID NO: 2473337 - protein, 17 aa, Entamoeba dispar
GKEYFEIHKNKRAIVKT

SEQ ID NO: 2473338 - protein, 25 aa, Entamoeba dispar
GKIKARWMRKNARRLDIEHYTRTDL

SEQ ID NO: 2473339 - protein, 23 aa, Entamoeba dispar
GKIKARWMRKNARRLDIENYTRT

SEQ ID NO: 2473340 - protein, 23 aa, Entamoeba dispar
GKIMNAGICQLLYHMRVNSHFSI

SEQ ID NO: 2473341 - protein, 25 aa, Entamoeba dispar
GKKEKIKFGFDRAFDSDSTQQDIFE

SEQ ID NO: 2473342 - protein, 20 aa, Entamoeba dispar
GKKTFGFGFVNEKMEVVDKD

SEQ ID NO: 2473343 - protein, 18 aa, Entamoeba dispar
GKLLAGCRILGCNEIIVD

SEQ ID NO: 2473344 - protein, 23 aa, Entamoeba dispar
GKMIYKMTIEINGKKIVFKDTLA

SEQ ID NO: 2473345 - protein, 17 aa, Entamoeba dispar
GKNAGVFVYENGKGLFA

SEQ ID NO: 2473346 - protein, 18 aa, Entamoeba dispar
GKPKKLREYISIEKMIES

SEQ ID NO: 2473347 - protein, 30 aa, Entamoeba dispar
GKSAKIYSCKSCGFIMFAIPKKGLEKKFST

SEQ ID NO: 2473348 - protein, 19 aa, Entamoeba dispar
GKTEFAIQEIFLKYNTFML

SEQ ID NO: 2473349 - protein, 22 aa, Entamoeba dispar
GKTEFAIQEIFMKYNTFMLRGD

SEQ ID NO: 2473350 - protein, 20 aa, Entamoeba dispar
GKTRKGCRRIIRETDSNIII

SEQ ID NO: 2473351 - protein, 20 aa, Entamoeba dispar
GKYEEAIELFKKCHKKEQRA

SEQ ID NO: 2473352 - protein, 19 aa, Entamoeba dispar
GMEDWKILKDITVLKWTLL

SEQ ID NO: 2473353 - protein, 17 aa, Entamoeba dispar
GNECFKNCYNLKKINIP

SEQ ID NO: 2473354 - protein, 18 aa, Entamoeba dispar
GNENIKLIGVLATGYNNV

SEQ ID NO: 2473355 - protein, 17 aa, Entamoeba dispar
GNGGLGISNLTMTAGED

SEQ ID NO: 2473356 - protein, 17 aa, Entamoeba dispar
GNGWVKVQWESSRNENR

SEQ ID NO: 2473357 - protein, 23 aa, Entamoeba dispar
GNIIPPPSINPILKIRKSDSRMK

SEQ ID NO: 2473358 - protein, 19 aa, Entamoeba dispar
GNMVSCLDFVESVFGNAGN

SEQ ID NO: 2473359 - protein, 26 aa, Entamoeba dispar
GNNQLNFPLCFTIFGATHYSFKNKAA

SEQ ID NO: 2473360 - protein, 23 aa, Entamoeba dispar
GNNYPINFGYIYPINENVALDYV

SEQ ID NO: 2473361 - protein, 20 aa, Entamoeba dispar
GNTEKLSWRVFGPQGALIQN

SEQ ID NO: 2473362 - protein, 26 aa, Entamoeba dispar
GNYHLKFLIQPFLHWPDTMMTVIEEL

SEQ ID NO: 2473363 - protein, 20 aa, Entamoeba dispar
GPDSILYRSSEPFLKNIDNR

SEQ ID NO: 2473364 - protein, 18 aa, Entamoeba dispar
GQGSRLGFEHPKGMFVLP

SEQ ID NO: 2473365 - protein, 25 aa, Entamoeba dispar
GQIGYNLLFLIAHGLMFGPNQTVYL

SEQ ID NO: 2473366 - protein, 27 aa, Entamoeba dispar
GRAGRNFEGYCYRLYSSSIYENIFEEF

SEQ ID NO: 2473367 - protein, 24 aa, Entamoeba dispar
GRFFQEWYFDLLLSHTDKVLSAAR

SEQ ID NO: 2473368 - protein, 24 aa, Entamoeba dispar
GRIFKKVIWYKVDYSTHLKEKILY

SEQ ID NO: 2473369 - protein, 17 aa, Entamoeba dispar
GRLAACFLDSLATMNLP

SEQ ID NO: 2473370 - protein, 24 aa, Entamoeba dispar
GRQTRPELLVGICGEHGGEPSSIE

SEQ ID NO: 2473371 - protein, 17 aa, Entamoeba dispar
GSDGGSCIDGRLTSAWN

SEQ ID NO: 2473372 - protein, 17 aa, Entamoeba dispar
GSDNEAYIQLQRSTSIP

SEQ ID NO: 2473373 - protein, 19 aa, Entamoeba dispar
GSDVIKFDHYVHVIFLRCD

SEQ ID NO: 2473374 - protein, 17 aa, Entamoeba dispar
GSDYYLVCRDFDGYVKV

SEQ ID NO: 2473375 - protein, 23 aa, Entamoeba dispar
GSHKGYCLSEFVEIMSSCLSIAN

SEQ ID NO: 2473376 - protein, 22 aa, Entamoeba dispar
GSRYLRTLMRAVAQLTGGQYAA

SEQ ID NO: 2473377 - protein, 19 aa, Entamoeba dispar
GSSKFSFKGILSGEEEINV

SEQ ID NO: 2473378 - protein, 25 aa, Entamoeba dispar
GSTTQLSCVMIAFGTAMTMGNGVTG

SEQ ID NO: 2473379 - protein, 22 aa, Entamoeba dispar
GTGSGFTAALCEKLADKYTKKT

SEQ ID NO: 2473380 - protein, 19 aa, Entamoeba dispar
GTKYIALAMEWTATEDPFD

SEQ ID NO: 2473381 - protein, 21 aa, Entamoeba dispar
GTLDVSCCKIVNDNIIVESSG

SEQ ID NO: 2473382 - protein, 24 aa, Entamoeba dispar
GTPVYNFLCSYLLKTNTPQSKGLF

SEQ ID NO: 2473383 - protein, 27 aa, Entamoeba dispar
GTVAFGSGLHGWAFTLEKFAKMWSAKF

SEQ ID NO: 2473384 - protein, 19 aa, Entamoeba dispar
GWDRYFGYQLYMCDPSGNY

SEQ ID NO: 2473385 - protein, 21 aa, Entamoeba dispar
GYCKKEVKTQISYSANLYGFA

SEQ ID NO: 2473386 - protein, 29 aa, Entamoeba dispar
GYDSLKMVIPSSVTKIGMKCFSTSQVEDI

SEQ ID NO: 2473387 - protein, 21 aa, Entamoeba dispar
GYGCFCKCTSLTTINIPTSIT

SEQ ID NO: 2473388 - protein, 21 aa, Entamoeba dispar
GYITLFLMESFIKKRKDDEIT

SEQ ID NO: 2473389 - protein, 20 aa, Entamoeba dispar
HAAVVARGMGKPCVSGAEGI

SEQ ID NO: 2473390 - protein, 17 aa, Entamoeba dispar
HDGPVWDVQYCPLEYYM

SEQ ID NO: 2473391 - protein, 19 aa, Entamoeba dispar
HEECLYCCYLYDILSKTNK

SEQ ID NO: 2473392 - protein, 26 aa, Entamoeba dispar
HEETLEFIQWLYSLGISIISLHGRHH

SEQ ID NO: 2473393 - protein, 24 aa, Entamoeba dispar
HFKDFKLTYYPGDYDTFEATMQKK

SEQ ID NO: 2473394 - protein, 18 aa, Entamoeba dispar
HFTNIVVQSVMHLDDKLD

SEQ ID NO: 2473395 - protein, 23 aa, Entamoeba dispar
HGILLRPIPRAKRILSSPRNLPH

SEQ ID NO: 2473396 - protein, 18 aa, Entamoeba dispar
HGSINSFSSSPCHIELIL

SEQ ID NO: 2473397 - protein, 17 aa, Entamoeba dispar
HIEYCKILNSSMNTYKQ

SEQ ID NO: 2473398 - protein, 19 aa, Entamoeba dispar
HIGDFAFRLTCNPLAVYSH

SEQ ID NO: 2473399 - protein, 22 aa, Entamoeba dispar
HIKLTDFGLCTGFHRIDTSITL

SEQ ID NO: 2473400 - protein, 17 aa, Entamoeba dispar
HIQIPLRKFRQIQREED

SEQ ID NO: 2473401 - protein, 22 aa, Entamoeba dispar
HKAEAKNTWQSVVQLRQHAEHK

SEQ ID NO: 2473402 - protein, 19 aa, Entamoeba dispar
HKDFVCLHPVFGIPNLQVF

SEQ ID NO: 2473403 - protein, 21 aa, Entamoeba dispar
HKHIHGGLTPGGRVRMEKLAS

SEQ ID NO: 2473404 - protein, 28 aa, Entamoeba dispar
HKLIKRFWPGALTIIFPRNETVPNEVTA

SEQ ID NO: 2473405 - protein, 23 aa, Entamoeba dispar
HKNHPNYPYFAQLCESYNQCLHP

SEQ ID NO: 2473406 - protein, 17 aa, Entamoeba dispar
HKQEFFCETMKSYKIKQ

SEQ ID NO: 2473407 - protein, 24 aa, Entamoeba dispar
HLKEKEIIQLIGKLLNYNLYYSKI

SEQ ID NO: 2473408 - protein, 19 aa, Entamoeba dispar
HLLLNIYKEVLRVCQVLNQ

SEQ ID NO: 2473409 - protein, 17 aa, Entamoeba dispar
HLNAICLLRPTKENMEL

SEQ ID NO: 2473410 - protein, 26 aa, Entamoeba dispar
HLNRTFKDLFHRTTELCETIDKQWGV

SEQ ID NO: 2473411 - protein, 26 aa, Entamoeba dispar
HLTERLIRITSIFKDGKIFGRDELIE

SEQ ID NO: 2473412 - protein, 30 aa, Entamoeba dispar
HNTYTFPLSTLMSWGTDSSKTFKNTSTDHK

SEQ ID NO: 2473413 - protein, 18 aa, Entamoeba dispar
HNVRCRYGIIKRRALRLE

SEQ ID NO: 2473414 - protein, 17 aa, Entamoeba dispar
HPEHAAILWRISRFNGK

SEQ ID NO: 2473415 - protein, 18 aa, Entamoeba dispar
HPNISFFGKICLDTLKPQ

SEQ ID NO: 2473416 - protein, 19 aa, Entamoeba dispar
HPQNCFWSIISSIKSMGSV

SEQ ID NO: 2473417 - protein, 20 aa, Entamoeba dispar
HPVFGIPNLQVFMLMKGLAT

SEQ ID NO: 2473418 - protein, 24 aa, Entamoeba dispar
HQITESYGLLSIIGVSNRATIIID

SEQ ID NO: 2473419 - protein, 17 aa, Entamoeba dispar
HQKPLHFTSRYAYLTLW

SEQ ID NO: 2473420 - protein, 18 aa, Entamoeba dispar
HSVYCWDIDDGFAVCVLM

SEQ ID NO: 2473421 - protein, 17 aa, Entamoeba dispar
HTAGNILRVMLLRNPHV

SEQ ID NO: 2473422 - protein, 24 aa, Entamoeba dispar
HVDSESSAHVYLRMKEGDTIETLP

SEQ ID NO: 2473423 - protein, 17 aa, Entamoeba dispar
HWMLSKLGGTFAPKPSH

SEQ ID NO: 2473424 - protein, 18 aa, Entamoeba dispar
HYFDCIFGPFKNYVIKGI

SEQ ID NO: 2473425 - protein, 17 aa, Entamoeba dispar
HYLHFEKGFIHRDIKLE

SEQ ID NO: 2473426 - protein, 23 aa, Entamoeba dispar
HYLSPNVIISGRILDGIEDLMKA

SEQ ID NO: 2473427 - protein, 31 aa, Entamoeba dispar
IAESIGKGFIREGWGCLLMNSRIWERVSQGL

SEQ ID NO: 2473428 - protein, 32 aa, Entamoeba dispar
IAMAELKAGKIPFIIRRRLPNGSFEDWKVSEL

SEQ ID NO: 2473429 - protein, 21 aa, Entamoeba dispar
IAVCLCKEGKGMIRVNGVPLD

SEQ ID NO: 2473430 - protein, 19 aa, Entamoeba dispar
ICFQEVFKELNWRREKLLK

SEQ ID NO: 2473431 - protein, 27 aa, Entamoeba dispar
ICISHKWDFVSLYPKYTKLIFTLFCNI

SEQ ID NO: 2473432 - protein, 29 aa, Entamoeba dispar
IDAIPPNKRWGALLPVGLIPPEITTPVSS

SEQ ID NO: 2473433 - protein, 17 aa, Entamoeba dispar
IDCVIEHLWDILSPRGI

SEQ ID NO: 2473434 - protein, 25 aa, Entamoeba dispar
IDDGEKLFLHGLHLYFKKLGDNDKK

SEQ ID NO: 2473435 - protein, 26 aa, Entamoeba dispar
IDDIKESFTAFKTEMDKMADIEETWR

SEQ ID NO: 2473436 - protein, 17 aa, Entamoeba dispar
IDKHMYHDFYLKVKGNQ

SEQ ID NO: 2473437 - protein, 19 aa, Entamoeba dispar
IDKIIEIHPSYLLIDCPGQ

SEQ ID NO: 2473438 - protein, 22 aa, Entamoeba dispar
IDLKLMRMGFETITEKSKISPE

SEQ ID NO: 2473439 - protein, 25 aa, Entamoeba dispar
IDPRLIAATCVFFSSKVEGCLISPH

SEQ ID NO: 2473440 - protein, 17 aa, Entamoeba dispar
IDRMEMERYFNILHTPF

SEQ ID NO: 2473441 - protein, 25 aa, Entamoeba dispar
IEDECLRKLFECLPGESMKGTGIIV

SEQ ID NO: 2473442 - protein, 28 aa, Entamoeba dispar
IEDICECIMAFISMTLLSPVAVSQLSDI

SEQ ID NO: 2473443 - protein, 27 aa, Entamoeba dispar
IEFCCKITEGVLLRMVLSDLIKQSQSK

SEQ ID NO: 2473444 - protein, 24 aa, Entamoeba dispar
IELIPEFFFLPQFLINFNTIDFGK

SEQ ID NO: 2473445 - protein, 30 aa, Entamoeba dispar
IENLKSLLFPFEWCNICIDSLPYSLIDYVS

SEQ ID NO: 2473446 - protein, 22 aa, Entamoeba dispar
IEPAFAHRGFQMGVRKPHAVQQ

SEQ ID NO: 2473447 - protein, 27 aa, Entamoeba dispar
IERKRCGKYLFTLGMISSWNNGEIETA

SEQ ID NO: 2473448 - protein, 23 aa, Entamoeba dispar
IESIYKRYLMIIGTMKEKEIEES

SEQ ID NO: 2473449 - protein, 20 aa, Entamoeba dispar
IESNLSLSQIRQFSMKNYLP

SEQ ID NO: 2473450 - protein, 19 aa, Entamoeba dispar
IETLISILIRKRSTTINIS

SEQ ID NO: 2473451 - protein, 20 aa, Entamoeba dispar
IETWKSIIMKNIKNIKEDND

SEQ ID NO: 2473452 - protein, 22 aa, Entamoeba dispar
IFFYYNSFNIIIGKQGAGKTTF

SEQ ID NO: 2473453 - protein, 18 aa, Entamoeba dispar
IFGPFKNYVIKGINMIET

SEQ ID NO: 2473454 - protein, 21 aa, Entamoeba dispar
IFPKLTNQFLYSRNDNKIKGV

SEQ ID NO: 2473455 - protein, 18 aa, Entamoeba dispar
IGAHMAMPLLRKEWKDHM

SEQ ID NO: 2473456 - protein, 18 aa, Entamoeba dispar
IGDECFYLCYSLQSINIP

SEQ ID NO: 2473457 - protein, 20 aa, Entamoeba dispar
IGDKCFLYCISLTSISLPQH

SEQ ID NO: 2473458 - protein, 18 aa, Entamoeba dispar
IGDNCFYLCYSLTSITIP

SEQ ID NO: 2473459 - protein, 19 aa, Entamoeba dispar
IGEGCFNLCYSLTSIDIPS

SEQ ID NO: 2473460 - protein, 18 aa, Entamoeba dispar
IGHWKLILNNFKFDDRSC

SEQ ID NO: 2473461 - protein, 26 aa, Entamoeba dispar
IGIELNQLWETLPFYLDEDKPLHGTN

SEQ ID NO: 2473462 - protein, 23 aa, Entamoeba dispar
IGKRLRQLAIEWLNSEKRWDDIE

SEQ ID NO: 2473463 - protein, 18 aa, Entamoeba dispar
IGNNCFYGCYSLTSINIP

SEQ ID NO: 2473464 - protein, 19 aa, Entamoeba dispar
IGNYCFYKCSSITTINIPS

SEQ ID NO: 2473465 - protein, 23 aa, Entamoeba dispar
IHASDFCRRRLAIVVKAKKMVTD

SEQ ID NO: 2473466 - protein, 17 aa, Entamoeba dispar
IHEYKRQLLNLFGTIHT

SEQ ID NO: 2473467 - protein, 24 aa, Entamoeba dispar
IIAKLAAGIADDFLTTTFLAASCP

SEQ ID NO: 2473468 - protein, 25 aa, Entamoeba dispar
IIEKEIYSIISIIWERGINDCLNKN

SEQ ID NO: 2473469 - protein, 18 aa, Entamoeba dispar
IIILRGNHETRMMTERMG

SEQ ID NO: 2473470 - protein, 17 aa, Entamoeba dispar
IIITPLFSNFKVYCSES

SEQ ID NO: 2473471 - protein, 17 aa, Entamoeba dispar
IILDHLITVGSFTIKCT

SEQ ID NO: 2473472 - protein, 17 aa, Entamoeba dispar
IILEEKTMYPFSFSGID

SEQ ID NO: 2473473 - protein, 22 aa, Entamoeba dispar
IILMCYKVLYPTKIIMLRGQNE

SEQ ID NO: 2473474 - protein, 25 aa, Entamoeba dispar
IIPSSITKLGDWCFDECSSLKSINI

SEQ ID NO: 2473475 - protein, 22 aa, Entamoeba dispar
IIQLLDGIKFQNEKIFEMQEEQ

SEQ ID NO: 2473476 - protein, 23 aa, Entamoeba dispar
IIQRCKEELVLKRMNDIRIKLSE

SEQ ID NO: 2473477 - protein, 17 aa, Entamoeba dispar
IISGGGVFYNLTTQILK

SEQ ID NO: 2473478 - protein, 18 aa, Entamoeba dispar
IKDMKFSVSPVVRVAVET

SEQ ID NO: 2473479 - protein, 26 aa, Entamoeba dispar
IKEIGSWCFCRCYSLSNIIIPSSISK

SEQ ID NO: 2473480 - protein, 21 aa, Entamoeba dispar
IKEISVFGILHFNNQPINFTR

SEQ ID NO: 2473481 - protein, 23 aa, Entamoeba dispar
IKEMGFSESIGYHQILYPKTTDV

SEQ ID NO: 2473482 - protein, 18 aa, Entamoeba dispar
IKFDHYVHVIFLRCDFDL

SEQ ID NO: 2473483 - protein, 28 aa, Entamoeba dispar
IKGEIIPKEINNFYGMITCYIQCKEEIK

SEQ ID NO: 2473484 - protein, 27 aa, Entamoeba dispar
IKGTLHLPRKSAFLLGKYEDIIFEQST

SEQ ID NO: 2473485 - protein, 27 aa, Entamoeba dispar
IKINCKLSGMPELRLGLNEKINIGDRM

SEQ ID NO: 2473486 - protein, 18 aa, Entamoeba dispar
IKITDDFRYIIINEDNLE

SEQ ID NO: 2473487 - protein, 22 aa, Entamoeba dispar
IKKEKIINLIVDYVKTFPNEFE

SEQ ID NO: 2473488 - protein, 19 aa, Entamoeba dispar
IKLASIVGVTCASSTNPLL

SEQ ID NO: 2473489 - protein, 24 aa, Entamoeba dispar
IKLFSRIIEVLREFVVSKRAVYIC

SEQ ID NO: 2473490 - protein, 18 aa, Entamoeba dispar
IKLNDEVISTVQIDKKTK

SEQ ID NO: 2473491 - protein, 25 aa, Entamoeba dispar
IKLPEDVRNRFNLIYHETVERIENS

SEQ ID NO: 2473492 - protein, 25 aa, Entamoeba dispar
IKLSKEEFLEYPIFDEYQFNCINDH

SEQ ID NO: 2473493 - protein, 20 aa, Entamoeba dispar
IKMIKKRYPLSEVEMTESAI

SEQ ID NO: 2473494 - protein, 21 aa, Entamoeba dispar
IKNEELAIMPDLEKLIKGINK

SEQ ID NO: 2473495 - protein, 30 aa, Entamoeba dispar
IKNKELLKRITFCYKECYKKGFNNEILIQY

SEQ ID NO: 2473496 - protein, 17 aa, Entamoeba dispar
IKNRKWYCQTSCATNGD

SEQ ID NO: 2473497 - protein, 17 aa, Entamoeba dispar
IKPESKLSIIFNNIKKE

SEQ ID NO: 2473498 - protein, 22 aa, Entamoeba dispar
IKPPEMLKMDLAGGMPVNASCD

SEQ ID NO: 2473499 - protein, 22 aa, Entamoeba dispar
IKRKVEEPCFVFHYKTKETVII

SEQ ID NO: 2473500 - protein, 18 aa, Entamoeba dispar
IKRLLKKKYVTTISSINM

SEQ ID NO: 2473501 - protein, 23 aa, Entamoeba dispar
IKRTKRAPPIKIIDTPGFGDTRG

SEQ ID NO: 2473502 - protein, 23 aa, Entamoeba dispar
IKSCQIALWDVCCQCERKGSLDS

SEQ ID NO: 2473503 - protein, 20 aa, Entamoeba dispar
IKTLSSYCCVAGITHYPLHT

SEQ ID NO: 2473504 - protein, 21 aa, Entamoeba dispar
IKVRVGRGIVVGGFQGSDAAD

SEQ ID NO: 2473505 - protein, 17 aa, Entamoeba dispar
IKYICLSGNKIKSIQII

SEQ ID NO: 2473506 - protein, 31 aa, Entamoeba dispar
ILDIASVISICIEYSRYSTIFTMYRSLGKKT

SEQ ID NO: 2473507 - protein, 20 aa, Entamoeba dispar
ILPPFRCDYGKYISVGHDTF

SEQ ID NO: 2473508 - protein, 24 aa, Entamoeba dispar
ILPTKSLHGHSHFISDLVLSNDGQ

SEQ ID NO: 2473509 - protein, 20 aa, Entamoeba dispar
ILQRGFVQFCFDPITKLFNA

SEQ ID NO: 2473510 - protein, 17 aa, Entamoeba dispar
ILSDYCFYLEELYGTAD

SEQ ID NO: 2473511 - protein, 18 aa, Entamoeba dispar
ILTYEMMVGIPPFYSEDE

SEQ ID NO: 2473512 - protein, 17 aa, Entamoeba dispar
INAKIQVRKEIIKKEDS

SEQ ID NO: 2473513 - protein, 31 aa, Entamoeba dispar
INAKVIPNCIGNIWVYVRDWPEEKGRSGKFN

SEQ ID NO: 2473514 - protein, 26 aa, Entamoeba dispar
INAKVIPNCIGNIWVYVYDCPENEGR

SEQ ID NO: 2473515 - protein, 26 aa, Entamoeba dispar
INKKSEEGYLCYFKIELNYIHKLKQS

SEQ ID NO: 2473516 - protein, 17 aa, Entamoeba dispar
INLKCILDKINEMYQII

SEQ ID NO: 2473517 - protein, 17 aa, Entamoeba dispar
INPLDGIIEYIKKNNQI

SEQ ID NO: 2473518 - protein, 22 aa, Entamoeba dispar
INRCVGFNVGIEEFWRRYDDEE

SEQ ID NO: 2473519 - protein, 25 aa, Entamoeba dispar
INVKSKCPINKLIIVESYEVNITGN

SEQ ID NO: 2473520 - protein, 25 aa, Entamoeba dispar
INVKSKCPINKLIIVESYEVSIRGN

SEQ ID NO: 2473521 - protein, 19 aa, Entamoeba dispar
INYKLAEIGKTFYTIVDTQ

SEQ ID NO: 2473522 - protein, 24 aa, Entamoeba dispar
IPCARRCCFACVLTGAPSLLEPMY

SEQ ID NO: 2473523 - protein, 19 aa, Entamoeba dispar
IPHDKAWIIRREFVRSMEY

SEQ ID NO: 2473524 - protein, 26 aa, Entamoeba dispar
IPILRFNPKCIVCVGDPMQLDPVLQS

SEQ ID NO: 2473525 - protein, 19 aa, Entamoeba dispar
IPLFPNLQTFYVRRCPERL

SEQ ID NO: 2473526 - protein, 19 aa, Entamoeba dispar
IPNKIRIKFMIDGAKGISY

SEQ ID NO: 2473527 - protein, 18 aa, Entamoeba dispar
IPNLQVFMLMKGLATKKC

SEQ ID NO: 2473528 - protein, 24 aa, Entamoeba dispar
IPRYELLIRDMLKDVGRDFPDLEQ

SEQ ID NO: 2473529 - protein, 20 aa, Entamoeba dispar
IPSSITKLGEYCFSGCSTLT

SEQ ID NO: 2473530 - protein, 27 aa, Entamoeba dispar
IPTTISIIGYRFFCKCISLKSVNMPSV

SEQ ID NO: 2473531 - protein, 18 aa, Entamoeba dispar
IPYRRTAPSWLKTSTLEV

SEQ ID NO: 2473532 - protein, 19 aa, Entamoeba dispar
IQCITKIFDEKHCERVEKE

SEQ ID NO: 2473533 - protein, 19 aa, Entamoeba dispar
IQCMKDAKLRKKDISDVVL

SEQ ID NO: 2473534 - protein, 18 aa, Entamoeba dispar
IQFAPNIRAAGFKPEANN

SEQ ID NO: 2473535 - protein, 25 aa, Entamoeba dispar
IQIINLRALQGFFPIIESVIMNCGV

SEQ ID NO: 2473536 - protein, 27 aa, Entamoeba dispar
IQNEYLICYNGAMICHGNETIFESEIN

SEQ ID NO: 2473537 - protein, 31 aa, Entamoeba dispar
IQQKIRDALKFILQYYGINGIIIDNFTDEQI

SEQ ID NO: 2473538 - protein, 26 aa, Entamoeba dispar
IQSDVLLRKYSCIIIDEAHERNLNTD

SEQ ID NO: 2473539 - protein, 27 aa, Entamoeba dispar
IRDQIFKLACNHYILPYIKIKEFPNNQ

SEQ ID NO: 2473540 - protein, 21 aa, Entamoeba dispar
IREACGFSAYERHMMDLLRRG

SEQ ID NO: 2473541 - protein, 25 aa, Entamoeba dispar
IRFFECGYELYGYCLVFELHIINLN

SEQ ID NO: 2473542 - protein, 18 aa, Entamoeba dispar
IRLESELDDIVKERQEVE

SEQ ID NO: 2473543 - protein, 18 aa, Entamoeba dispar
IRMFEVGDTVSLKEGSLT

SEQ ID NO: 2473544 - protein, 17 aa, Entamoeba dispar
IRMILPLVCTIKELSQT

SEQ ID NO: 2473545 - protein, 17 aa, Entamoeba dispar
IRNAVTIIVKNRVAYYL

SEQ ID NO: 2473546 - protein, 28 aa, Entamoeba dispar
IRTAFWEFCYSNRYCPIGDELKGSTLLL

SEQ ID NO: 2473547 - protein, 23 aa, Entamoeba dispar
ISAELPLGFDNYVLWVKGEDADL

SEQ ID NO: 2473548 - protein, 22 aa, Entamoeba dispar
ISDDCKDFILGLLTVKASSRLS

SEQ ID NO: 2473549 - protein, 28 aa, Entamoeba dispar
ISGLPRMKKGLVKFKVTFNVDINGMLSV

SEQ ID NO: 2473550 - protein, 23 aa, Entamoeba dispar
ISHFPYGPTAYFGLYNVVSRHET

SEQ ID NO: 2473551 - protein, 17 aa, Entamoeba dispar
ISICISHKWDFVSLYPK

SEQ ID NO: 2473552 - protein, 24 aa, Entamoeba dispar
ISIKTRNPIVFSFHPSALKCSIMA

SEQ ID NO: 2473553 - protein, 17 aa, Entamoeba dispar
ISKCYLKELTLREYQGK

SEQ ID NO: 2473554 - protein, 17 aa, Entamoeba dispar
ISLCLQRPQTECYLDSQ

SEQ ID NO: 2473555 - protein, 24 aa, Entamoeba dispar
ISLFKILSSMIIKLNRQMMENEKT

SEQ ID NO: 2473556 - protein, 17 aa, Entamoeba dispar
ISLKDYEFEEFVKNIEK

SEQ ID NO: 2473557 - protein, 25 aa, Entamoeba dispar
ISRKESFEKIPIWLEECRKYSNPNT

SEQ ID NO: 2473558 - protein, 26 aa, Entamoeba dispar
ISTDFKTGIVLINFFEIISKKILRER

SEQ ID NO: 2473559 - protein, 23 aa, Entamoeba dispar
ISTRETLESFGIGKEIEEVKEWI

SEQ ID NO: 2473560 - protein, 23 aa, Entamoeba dispar
ITEKGITPMGGFPHYGVVKNDFL

SEQ ID NO: 2473561 - protein, 17 aa, Entamoeba dispar
ITFLLLHKVKYPDRIHL

SEQ ID NO: 2473562 - protein, 20 aa, Entamoeba dispar
ITGLPELPAGAVRFEVECEI

SEQ ID NO: 2473563 - protein, 23 aa, Entamoeba dispar
ITQPRRIAATAMAKRVGEEMGEE

SEQ ID NO: 2473564 - protein, 17 aa, Entamoeba dispar
ITRDEWTTIFQKFIDEK

SEQ ID NO: 2473565 - protein, 25 aa, Entamoeba dispar
ITSFGRSCFYGCGCVEELTQNKRIP

SEQ ID NO: 2473566 - protein, 22 aa, Entamoeba dispar
ITVLKKEGDWWLGELKGQQGYF

SEQ ID NO: 2473567 - protein, 19 aa, Entamoeba dispar
IVETFKYLPIAAVVQGTYL

SEQ ID NO: 2473568 - protein, 17 aa, Entamoeba dispar
IVFKDTLALIPTSISKF

SEQ ID NO: 2473569 - protein, 23 aa, Entamoeba dispar
IVGSHWCSIALYLNNRTARSIRN

SEQ ID NO: 2473570 - protein, 19 aa, Entamoeba dispar
IVQRFCFHKYKDLYESTIG

SEQ ID NO: 2473571 - protein, 18 aa, Entamoeba dispar
IVSAIVLKAIKIEIQRRL

SEQ ID NO: 2473572 - protein, 20 aa, Entamoeba dispar
IVSLCNFKPTSIDQAKMLIK

SEQ ID NO: 2473573 - protein, 23 aa, Entamoeba dispar
IWEPSHFNLLQVMGLQVQSTEQK

SEQ ID NO: 2473574 - protein, 19 aa, Entamoeba dispar
IWLEECRKYSNPNTTIMLV

SEQ ID NO: 2473575 - protein, 23 aa, Entamoeba dispar
IYEQKYAKEIYGFNSKDEELNQQ

SEQ ID NO: 2473576 - protein, 18 aa, Entamoeba dispar
IYYKDTWTDDDIRVLIGA

SEQ ID NO: 2473577 - protein, 18 aa, Entamoeba dispar
KAAWKPNTKMVYLESPAN

SEQ ID NO: 2473578 - protein, 18 aa, Entamoeba dispar
KAEEIIEKNLRWIDNNQN

SEQ ID NO: 2473579 - protein, 22 aa, Entamoeba dispar
KAGKRAGNFLDFLRATEGMVHD

SEQ ID NO: 2473580 - protein, 19 aa, Entamoeba dispar
KAKFLEYDRTLLVADPRRC

SEQ ID NO: 2473581 - protein, 19 aa, Entamoeba dispar
KAKPLISIASDFIPGGEII

SEQ ID NO: 2473582 - protein, 23 aa, Entamoeba dispar
KALPGLMSCLLVGGMDVMKQSVQ

SEQ ID NO: 2473583 - protein, 21 aa, Entamoeba dispar
KAVEGKNLFLWGKTGTGKTLT

SEQ ID NO: 2473584 - protein, 18 aa, Entamoeba dispar
KDPDNFIIPPKQYKEIKP

SEQ ID NO: 2473585 - protein, 25 aa, Entamoeba dispar
KDQWKSKMCNIIEMFSKKKLDYKPF

SEQ ID NO: 2473586 - protein, 18 aa, Entamoeba dispar
KDVYCVSTHFGIVFDSIS

SEQ ID NO: 2473587 - protein, 28 aa, Entamoeba dispar
KDYSEPVDWWGFGILIYEMIHGHAPFTS

SEQ ID NO: 2473588 - protein, 25 aa, Entamoeba dispar
KECILSGLLSVDGKKVFHLDKNDYY

SEQ ID NO: 2473589 - protein, 25 aa, Entamoeba dispar
KEGAEFKMRVTFRVQHQPVLGLRIL

SEQ ID NO: 2473590 - protein, 39 aa, Entamoeba dispar
KEGASALAHLIKAKVIPDCVSSIWVCCVDKRYENGRNGK

SEQ ID NO: 2473591 - protein, 23 aa, Entamoeba dispar
KEIKRLINRWDIDKTQRESIQKK

SEQ ID NO: 2473592 - protein, 21 aa, Entamoeba dispar
KEIVHLISPQCVIVSPQWLFL

SEQ ID NO: 2473593 - protein, 22 aa, Entamoeba dispar
KEKEEFCCHLELNDAIDIGATY

SEQ ID NO: 2473594 - protein, 17 aa, Entamoeba dispar
KEKGCKPVPLSTKHNPT

SEQ ID NO: 2473595 - protein, 22 aa, Entamoeba dispar
KEKYIDIMVNLLFYIPMRNEYL

SEQ ID NO: 2473596 - protein, 18 aa, Entamoeba dispar
KELAPLNPDWIYIRAAAI

SEQ ID NO: 2473597 - protein, 17 aa, Entamoeba dispar
KELEVMKIAGLNEITLT

SEQ ID NO: 2473598 - protein, 20 aa, Entamoeba dispar
KENLILLTQRLKEMIDNAHN

SEQ ID NO: 2473599 - protein, 20 aa, Entamoeba dispar
KEPTKSWVSLYMRPVVVPGV

SEQ ID NO: 2473600 - protein, 19 aa, Entamoeba dispar
KERCKNCGSSEHTTKDCLE

SEQ ID NO: 2473601 - protein, 22 aa, Entamoeba dispar
KERKNKRIIAVNIKRKEEIEKR

SEQ ID NO: 2473602 - protein, 18 aa, Entamoeba dispar
KERNISIIYLVIGNCTQK

SEQ ID NO: 2473603 - protein, 20 aa, Entamoeba dispar
KEVEVGLKLLQPIEQQFISI

SEQ ID NO: 2473604 - protein, 20 aa, Entamoeba dispar
KEVLKIIYFDDECYRNEILL

SEQ ID NO: 2473605 - protein, 18 aa, Entamoeba dispar
KEVLRVCQVLNQRIIHFD

SEQ ID NO: 2473606 - protein, 19 aa, Entamoeba dispar
KEYEWKGTYCSDGVSNCVI

SEQ ID NO: 2473607 - protein, 17 aa, Entamoeba dispar
KFEIRPRNDIDDIKESF

SEQ ID NO: 2473608 - protein, 26 aa, Entamoeba dispar
KFKVRCAKYLYTYICADKAKAEELKK

SEQ ID NO: 2473609 - protein, 20 aa, Entamoeba dispar
KFPSLQFIHPINNGFLCFEI

SEQ ID NO: 2473610 - protein, 26 aa, Entamoeba dispar
KGERGKAIGYCFLTFTEAEDAYQFVE

SEQ ID NO: 2473611 - protein, 28 aa, Entamoeba dispar
KGFFIKDGFKYGCDFVVYKKHPQCCHSY

SEQ ID NO: 2473612 - protein, 17 aa, Entamoeba dispar
KGGIESLAITLYGKLTS

SEQ ID NO: 2473613 - protein, 22 aa, Entamoeba dispar
KGICRKYLKNQLEVFIDDGEKL

SEQ ID NO: 2473614 - protein, 18 aa, Entamoeba dispar
KGKDCIIFGVEKKSIAKL

SEQ ID NO: 2473615 - protein, 20 aa, Entamoeba dispar
KGKYHVIAFYCRDFSRICPK

SEQ ID NO: 2473616 - protein, 22 aa, Entamoeba dispar
KGLTKYLIIYLCAKDNDYMIKK

SEQ ID NO: 2473617 - protein, 22 aa, Entamoeba dispar
KGNETFKIIVQIGRNNDKQRVM

SEQ ID NO: 2473618 - protein, 21 aa, Entamoeba dispar
KGRKYVRLDLKSFTFINKKSL

SEQ ID NO: 2473619 - protein, 24 aa, Entamoeba dispar
KGYKRGNVQLVILNGGTCKMPRIR

SEQ ID NO: 2473620 - protein, 18 aa, Entamoeba dispar
KGYPSILIIGNKCDVSNR

SEQ ID NO: 2473621 - protein, 19 aa, Entamoeba dispar
KHDELFKWWREMKREQRMT

SEQ ID NO: 2473622 - protein, 17 aa, Entamoeba dispar
KHSEVNIISQMVQQTKE

SEQ ID NO: 2473623 - protein, 23 aa, Entamoeba dispar
KHYEPKCKMMVVGTKTDCRNDEA

SEQ ID NO: 2473624 - protein, 23 aa, Entamoeba dispar
KIFEELGTFLSHYHVGKLPRVFK

SEQ ID NO: 2473625 - protein, 22 aa, Entamoeba dispar
KIFKKVVWYLVDYSKYLKEKEE

SEQ ID NO: 2473626 - protein, 24 aa, Entamoeba dispar
KIFRTRTKMLSYWRRNLEDILSGE

SEQ ID NO: 2473627 - protein, 19 aa, Entamoeba dispar
KIISWPLLLEEFRETRRKQ

SEQ ID NO: 2473628 - protein, 21 aa, Entamoeba dispar
KIKSRWMRKNSRRIDMENYTK

SEQ ID NO: 2473629 - protein, 23 aa, Entamoeba dispar
KINKRLELVEGFYENSEIRLKIK

SEQ ID NO: 2473630 - protein, 18 aa, Entamoeba dispar
KINSVVLKGAIKCAAAQT

SEQ ID NO: 2473631 - protein, 22 aa, Entamoeba dispar
KINYGMRTHQRIGSGRRWFEAS

SEQ ID NO: 2473632 - protein, 23 aa, Entamoeba dispar
KIQFKEIIDRIVGPTNNLQYAHI

SEQ ID NO: 2473633 - protein, 21 aa, Entamoeba dispar
KITPSLCKLTKLSVLDVSANP

SEQ ID NO: 2473634 - protein, 19 aa, Entamoeba dispar
KIVSRRKMLDVSRLEQDIV

SEQ ID NO: 2473635 - protein, 21 aa, Entamoeba dispar
KIVVELWKKQGIIDGFVDLDG

SEQ ID NO: 2473636 - protein, 20 aa, Entamoeba dispar
KIYIKGRFPYSGRKYQVTFG

SEQ ID NO: 2473637 - protein, 18 aa, Entamoeba dispar
KIYLKIPHDKAWIIRREF

SEQ ID NO: 2473638 - protein, 18 aa, Entamoeba dispar
KKARMGPMKKDLERQRAE

SEQ ID NO: 2473639 - protein, 19 aa, Entamoeba dispar
KKDINEFIIPSSITKLGDC

SEQ ID NO: 2473640 - protein, 23 aa, Entamoeba dispar
KKDISDVVLVGGMTRMPLIQNTV

SEQ ID NO: 2473641 - protein, 27 aa, Entamoeba dispar
KKIAGIGGKVYKWIGNAMYKVSPVAKP

SEQ ID NO: 2473642 - protein, 18 aa, Entamoeba dispar
KKIKSLLAEKNRLLHQLK

SEQ ID NO: 2473643 - protein, 28 aa, Entamoeba dispar
KKITPEKIKGGLVFFHLFRSFMKHTRLT

SEQ ID NO: 2473644 - protein, 32 aa, Entamoeba dispar
KKKQIFSTLMFLRYLFVPFLKHPYILKSLQKC

SEQ ID NO: 2473645 - protein, 26 aa, Entamoeba dispar
KKKTSLWIVCELFRIIVSSNLQEFDL

SEQ ID NO: 2473646 - protein, 22 aa, Entamoeba dispar
KKLHFQEYLALKKAVYRPQAFF

SEQ ID NO: 2473647 - protein, 22 aa, Entamoeba dispar
KKLPGGGILVFLTGHKEIEEVC

SEQ ID NO: 2473648 - protein, 20 aa, Entamoeba dispar
KKLREHFMKGGGIKEKSIHE

SEQ ID NO: 2473649 - protein, 24 aa, Entamoeba dispar
KKPLEAYHCSFLNLAIGYMDATEP

SEQ ID NO: 2473650 - protein, 20 aa, Entamoeba dispar
KKRISSPIINKSSHTTNVKN

SEQ ID NO: 2473651 - protein, 17 aa, Entamoeba dispar
KKSFLICDYCRDGDSYR

SEQ ID NO: 2473652 - protein, 19 aa, Entamoeba dispar
KKSLGYGFIEFETKEGCEN

SEQ ID NO: 2473653 - protein, 29 aa, Entamoeba dispar
KKTMLKKNFESYALYISRVLKSVFQDIGI

SEQ ID NO: 2473654 - protein, 17 aa, Entamoeba dispar
KKVREIMEISRCNDEIG

SEQ ID NO: 2473655 - protein, 20 aa, Entamoeba dispar
KKVYREIVEIEISNIPIKEG

SEQ ID NO: 2473656 - protein, 23 aa, Entamoeba dispar
KKYSSLLKKLWENEKLLDKYNLS

SEQ ID NO: 2473657 - protein, 18 aa, Entamoeba dispar
KLDSSTIICGDFLDDLIY

SEQ ID NO: 2473658 - protein, 18 aa, Entamoeba dispar
KLQIKYNGPLVILPEANV

SEQ ID NO: 2473659 - protein, 17 aa, Entamoeba dispar
KLQRIRAAAKELAEKTQ

SEQ ID NO: 2473660 - protein, 20 aa, Entamoeba dispar
KLTRKVCIPSYLTDTGKDDP

SEQ ID NO: 2473661 - protein, 24 aa, Entamoeba dispar
KLWEELPKSWKILVVDKEALKVIS

SEQ ID NO: 2473662 - protein, 23 aa, Entamoeba dispar
KMELADCCFPLVKGVIASNKTEV

SEQ ID NO: 2473663 - protein, 35 aa, Entamoeba dispar
KMNLANIFICLGPALRGCPFCYNYATVHHSEIFGS

SEQ ID NO: 2473664 - protein, 21 aa, Entamoeba dispar
KMPGAPMHLSLDIQGVSSSEK

SEQ ID NO: 2473665 - protein, 30 aa, Entamoeba dispar
KNAQYLPDFVRMFFNRFFTLLREGDIEDVV

SEQ ID NO: 2473666 - protein, 25 aa, Entamoeba dispar
KNDIWKRKTICTMERREKEKRRSSE

SEQ ID NO: 2473667 - protein, 30 aa, Entamoeba dispar
KNDLPSLLLLPIKFLPQFYSLIKEYHKSLP

SEQ ID NO: 2473668 - protein, 32 aa, Entamoeba dispar
KNFSEKIFYIKALRMFTIFQVKSLLEPISGVS

SEQ ID NO: 2473669 - protein, 18 aa, Entamoeba dispar
KNGAEKFFKKVPEYIKKD

SEQ ID NO: 2473670 - protein, 30 aa, Entamoeba dispar
KNGVELCALLEIIGETTIKCVTNPKMRIQM

SEQ ID NO: 2473671 - protein, 23 aa, Entamoeba dispar
KNSDFFYRGLKDCVVDISKTKIG

SEQ ID NO: 2473672 - protein, 20 aa, Entamoeba dispar
KNYRFFEGKNNAVAIAHMIN

SEQ ID NO: 2473673 - protein, 28 aa, Entamoeba dispar
KPADPRLPKPLFAWNLPKGYETVLKKAF

SEQ ID NO: 2473674 - protein, 22 aa, Entamoeba dispar
KPERSVGILLGIENEEEVIVRT

SEQ ID NO: 2473675 - protein, 26 aa, Entamoeba dispar
KPLHFTSRYAYLTLWGDEVQNKIQFK

SEQ ID NO: 2473676 - protein, 19 aa, Entamoeba dispar
KQFLEQVIRDSVTYTEHAK

SEQ ID NO: 2473677 - protein, 22 aa, Entamoeba dispar
KQIDWNLQWACHIEIGKYIRKL

SEQ ID NO: 2473678 - protein, 36 aa, Entamoeba dispar
KQLFGQKDFGIFCVTKYGNVFGIFFHSVKILRNQTF

SEQ ID NO: 2473679 - protein, 28 aa, Entamoeba dispar
KQNGCRGFGLNVSRTFLSQILESLNILY

SEQ ID NO: 2473680 - protein, 17 aa, Entamoeba dispar
KQVTALCTIQYSDVIFS

SEQ ID NO: 2473681 - protein, 18 aa, Entamoeba dispar
KRIIFKLIEEYIKVSLKE

SEQ ID NO: 2473682 - protein, 20 aa, Entamoeba dispar
KRIKTLVIVSDTKMGKTEFV

SEQ ID NO: 2473683 - protein, 20 aa, Entamoeba dispar
KRISSPLMLGSSIEKIIEID

SEQ ID NO: 2473684 - protein, 22 aa, Entamoeba dispar
KRISWDELFVHPFITQKLQCVF

SEQ ID NO: 2473685 - protein, 17 aa, Entamoeba dispar
KRITIKGSIKVDNNDIP

SEQ ID NO: 2473686 - protein, 19 aa, Entamoeba dispar
KRLLHDLPNLDREIVGKWK

SEQ ID NO: 2473687 - protein, 21 aa, Entamoeba dispar
KRLNIYKPWRATNEQMEMFHS

SEQ ID NO: 2473688 - protein, 25 aa, Entamoeba dispar
KRLNMKQCKVCFVNNGVRLKEIRGS

SEQ ID NO: 2473689 - protein, 24 aa, Entamoeba dispar
KRPRSFKARPIIKHSDGTQQTFWY

SEQ ID NO: 2473690 - protein, 18 aa, Entamoeba dispar
KRRIQARQYREEKKRKED

SEQ ID NO: 2473691 - protein, 17 aa, Entamoeba dispar
KRTKRTPPIKIIDTPGF

SEQ ID NO: 2473692 - protein, 25 aa, Entamoeba dispar
KRTSVFSGKTFKLLGFSTEQRDPIR

SEQ ID NO: 2473693 - protein, 18 aa, Entamoeba dispar
KRTTVGVFHICQSDVPVP

SEQ ID NO: 2473694 - protein, 21 aa, Entamoeba dispar
KSDTRLLSVLQYFDDSQLEWN

SEQ ID NO: 2473695 - protein, 22 aa, Entamoeba dispar
KSETVKNYILYFGSVKSNEQLE

SEQ ID NO: 2473696 - protein, 24 aa, Entamoeba dispar
KSIFEILNTPPLYDSLTILQKFDM

SEQ ID NO: 2473697 - protein, 21 aa, Entamoeba dispar
KSIRSSVIGNINWEEVGDDKI

SEQ ID NO: 2473698 - protein, 18 aa, Entamoeba dispar
KSIYFLRGNHESLAMNSL

SEQ ID NO: 2473699 - protein, 25 aa, Entamoeba dispar
KSLPNIFSSFTIYFGRDIDQQIRTE

SEQ ID NO: 2473700 - protein, 23 aa, Entamoeba dispar
KSLVFRELCDCFDQFKIMDVHIC

SEQ ID NO: 2473701 - protein, 19 aa, Entamoeba dispar
KSSIFTWGDYYNFEAQISS

SEQ ID NO: 2473702 - protein, 24 aa, Entamoeba dispar
KTFKVPPKCMVCGMSKNNNIYKLP

SEQ ID NO: 2473703 - protein, 18 aa, Entamoeba dispar
KTGMCKELAPLNPDWIYI

SEQ ID NO: 2473704 - protein, 18 aa, Entamoeba dispar
KTLGWQFKINVKYVEIYN

SEQ ID NO: 2473705 - protein, 20 aa, Entamoeba dispar
KTNNEIIKFLVNHPHIQIPL

SEQ ID NO: 2473706 - protein, 22 aa, Entamoeba dispar
KTPKIESIQEPKPLPHTETIPI

SEQ ID NO: 2473707 - protein, 24 aa, Entamoeba dispar
KTPLTQQKTIVWGNSVQPQTNLQQ

SEQ ID NO: 2473708 - protein, 19 aa, Entamoeba dispar
KTQKFMCMFFGTIKQIQHS

SEQ ID NO: 2473709 - protein, 25 aa, Entamoeba dispar
KTQRKFSFHSFFILGMTKNQIIQQT

SEQ ID NO: 2473710 - protein, 19 aa, Entamoeba dispar
KTRKGCRRIIREIDSNIII

SEQ ID NO: 2473711 - protein, 25 aa, Entamoeba dispar
KTSLEELDHPLSHQNRFIAFFSPRR

SEQ ID NO: 2473712 - protein, 19 aa, Entamoeba dispar
KTTLKGFKLLRLASQTDNV

SEQ ID NO: 2473713 - protein, 17 aa, Entamoeba dispar
KTWDDRMIEGFLIEQID

SEQ ID NO: 2473714 - protein, 19 aa, Entamoeba dispar
KTYTYKKQHIFISGSISVG

SEQ ID NO: 2473715 - protein, 21 aa, Entamoeba dispar
KVDTPLLWHQGLLVFVQRYSK

SEQ ID NO: 2473716 - protein, 20 aa, Entamoeba dispar
KVESMTCLFYASEEVIGIII

SEQ ID NO: 2473717 - protein, 25 aa, Entamoeba dispar
KVLKEVQSRFAVQMDELPSSLKDIP

SEQ ID NO: 2473718 - protein, 17 aa, Entamoeba dispar
KVPYLKEYMASYFTLKN

SEQ ID NO: 2473719 - protein, 25 aa, Entamoeba dispar
KVVKDCPYDLILNGDICKQEDITKL

SEQ ID NO: 2473720 - protein, 21 aa, Entamoeba dispar
KVVRLNRIVKVVESIHQSHQN

SEQ ID NO: 2473721 - protein, 29 aa, Entamoeba dispar
KWFCSKIRKLRMEGYYCKKVIEKHPEYFT

SEQ ID NO: 2473722 - protein, 18 aa, Entamoeba dispar
KWMKCQYDPLFGYPNLVR

SEQ ID NO: 2473723 - protein, 20 aa, Entamoeba dispar
KYECFRECTSLVYIKFPTSI

SEQ ID NO: 2473724 - protein, 24 aa, Entamoeba dispar
KYFASCGLYCLVQPNTPYEIIYEY

SEQ ID NO: 2473725 - protein, 24 aa, Entamoeba dispar
KYHILCKETAFIAIDKTTKKEVEF

SEQ ID NO: 2473726 - protein, 17 aa, Entamoeba dispar
KYIDIREFYERDGELKP

SEQ ID NO: 2473727 - protein, 26 aa, Entamoeba dispar
KYLGLKCPHAQFTLVKSKIILGSLNE

SEQ ID NO: 2473728 - protein, 23 aa, Entamoeba dispar
KYLRSYEELVKFSMINKKTNEGL

SEQ ID NO: 2473729 - protein, 20 aa, Entamoeba dispar
KYLSNQCLWVNNSIGTYERL

SEQ ID NO: 2473730 - protein, 22 aa, Entamoeba dispar
KYPRLYYTWIDKVVQTQEKSGN

SEQ ID NO: 2473731 - protein, 17 aa, Entamoeba dispar
KYSPSGYYICSGDVQGN

SEQ ID NO: 2473732 - protein, 24 aa, Entamoeba dispar
KYVKELFPRITTFCSDINPYALEC

SEQ ID NO: 2473733 - protein, 18 aa, Entamoeba dispar
KYVVKVEAGIDIKSLKPN

SEQ ID NO: 2473734 - protein, 19 aa, Entamoeba dispar
KYYYKRISHQFLLPPPIFC

SEQ ID NO: 2473735 - protein, 19 aa, Entamoeba dispar
LAHLINAKVIPNCIGNIWV

SEQ ID NO: 2473736 - protein, 24 aa, Entamoeba dispar
LAKKRAERAKKFAISDSDDDDDIK

SEQ ID NO: 2473737 - protein, 29 aa, Entamoeba dispar
LAKSTLAWKGLRVTVKITVVNRVATYEVI

SEQ ID NO: 2473738 - protein, 18 aa, Entamoeba dispar
LARGEYKSNVKFYDDDKV

SEQ ID NO: 2473739 - protein, 27 aa, Entamoeba dispar
LATKKCVKETCNWRCLYWTLNDEGIAY

SEQ ID NO: 2473740 - protein, 18 aa, Entamoeba dispar
LCLSLKKNPAIRYQQNSE

SEQ ID NO: 2473741 - protein, 18 aa, Entamoeba dispar
LCPFTRHVFLSGGVAVGK

SEQ ID NO: 2473742 - protein, 19 aa, Entamoeba dispar
LCQKLGCVAYIEASSVAKI

SEQ ID NO: 2473743 - protein, 37 aa, Entamoeba dispar
LDIEHYTRTDLFPWREEMPEVQTIRKWLKCAQGNKYR

SEQ ID NO: 2473744 - protein, 23 aa, Entamoeba dispar
LDLNANCFTEFPTQISTLTNLEE

SEQ ID NO: 2473745 - protein, 17 aa, Entamoeba dispar
LDLSSNHLKRFCKSIKL

SEQ ID NO: 2473746 - protein, 21 aa, Entamoeba dispar
LDPKLVEMLLENEVEEDIELD

SEQ ID NO: 2473747 - protein, 18 aa, Entamoeba dispar
LDPRINYDTRYDRLERGI

SEQ ID NO: 2473748 - protein, 19 aa, Entamoeba dispar
LDSSINIFEIKARIEDLDN

SEQ ID NO: 2473749 - protein, 18 aa, Entamoeba dispar
LEIHIARLEYKYGSVDKG

SEQ ID NO: 2473750 - protein, 17 aa, Entamoeba dispar
LEIKTPVTVCGDIHGQF

SEQ ID NO: 2473751 - protein, 23 aa, Entamoeba dispar
LELCSIDGIITLKYIPTLNLQTN

SEQ ID NO: 2473752 - protein, 17 aa, Entamoeba dispar
LEQKEVIENKQKTPKIE

SEQ ID NO: 2473753 - protein, 22 aa, Entamoeba dispar
LETSRLFPISVEYLHEHTLTGN

SEQ ID NO: 2473754 - protein, 18 aa, Entamoeba dispar
LEVNNLWLSNPEQAKSNA

SEQ ID NO: 2473755 - protein, 18 aa, Entamoeba dispar
LFANYVIQKALEFIPESR

SEQ ID NO: 2473756 - protein, 19 aa, Entamoeba dispar
LFEQKEMFYVDGLNDVTST

SEQ ID NO: 2473757 - protein, 21 aa, Entamoeba dispar
LGDYCFDCCFSGCSSLTSVII

SEQ ID NO: 2473758 - protein, 20 aa, Entamoeba dispar
LGDYCFYKCTSLTTINIPSS

SEQ ID NO: 2473759 - protein, 28 aa, Entamoeba dispar
LGEKYDSAVDWWSFGILTYEMMVGIPPF

SEQ ID NO: 2473760 - protein, 19 aa, Entamoeba dispar
LGEWCRIYQSVTLGAMHFQ

SEQ ID NO: 2473761 - protein, 25 aa, Entamoeba dispar
LGLSERVLMPISLCLQRPQTECYLD

SEQ ID NO: 2473762 - protein, 22 aa, Entamoeba dispar
LGNGCFYKCSSLEYINIPTTIN

SEQ ID NO: 2473763 - protein, 20 aa, Entamoeba dispar
LGNSCFKECYSLSSINIPTT

SEQ ID NO: 2473764 - protein, 19 aa, Entamoeba dispar
LGNYCFCQCTSLKSINIPS

SEQ ID NO: 2473765 - protein, 18 aa, Entamoeba dispar
LGNYCFSYCSSITTINIP

SEQ ID NO: 2473766 - protein, 19 aa, Entamoeba dispar
LGTAVGWKYADVVAKNEAE

SEQ ID NO: 2473767 - protein, 19 aa, Entamoeba dispar
LGTAVGWKYADVVAKNETE

SEQ ID NO: 2473768 - protein, 29 aa, Entamoeba dispar
LGVIIKRKIGKFFCCHGGISPEINKIEEI

SEQ ID NO: 2473769 - protein, 24 aa, Entamoeba dispar
LGYDGRFFAKYGINDIIEKGKMIY

SEQ ID NO: 2473770 - protein, 18 aa, Entamoeba dispar
LGYECFYDCISLTNIDIL

SEQ ID NO: 2473771 - protein, 26 aa, Entamoeba dispar
LHCIIYRVIKDYAIQFGDITMGKGGN

SEQ ID NO: 2473772 - protein, 17 aa, Entamoeba dispar
LIEIFGFETDIRTFSRG

SEQ ID NO: 2473773 - protein, 24 aa, Entamoeba dispar
LIERRCKEMMKLDLSNGLREKTAI

SEQ ID NO: 2473774 - protein, 26 aa, Entamoeba dispar
LIFERHPREALKVFCEIDKTLTEKEK

SEQ ID NO: 2473775 - protein, 19 aa, Entamoeba dispar
LILNNFKFDDRSCVDLKDK

SEQ ID NO: 2473776 - protein, 25 aa, Entamoeba dispar
LINQYWKGCVIDIGSGKGYLMEELQ

SEQ ID NO: 2473777 - protein, 22 aa, Entamoeba dispar
LIRRRIKEQSWDDVVRKTLVQK

SEQ ID NO: 2473778 - protein, 18 aa, Entamoeba dispar
LISLILLIDTFRIAEAKK

SEQ ID NO: 2473779 - protein, 20 aa, Entamoeba dispar
LKAPQAVVAMNACTLTIHWQ

SEQ ID NO: 2473780 - protein, 18 aa, Entamoeba dispar
LKDITVLKWTLLKKDTGI

SEQ ID NO: 2473781 - protein, 17 aa, Entamoeba dispar
LKDSIELISPEPIDKIE

SEQ ID NO: 2473782 - protein, 28 aa, Entamoeba dispar
LKEERAYTLKLCRAIQKSGCNVLLIQKS

SEQ ID NO: 2473783 - protein, 22 aa, Entamoeba dispar
LKEFLIGCIQLKQKVNATKEVV

SEQ ID NO: 2473784 - protein, 25 aa, Entamoeba dispar
LKEKEIKAGLTFSFAVEQIAIDKGI

SEQ ID NO: 2473785 - protein, 18 aa, Entamoeba dispar
LKEVEDFLSKRSEAGETV

SEQ ID NO: 2473786 - protein, 21 aa, Entamoeba dispar
LKFMKYTGCTAVAGRFTPGSF

SEQ ID NO: 2473787 - protein, 24 aa, Entamoeba dispar
LKIASDYKTIKWVRYITKAGAIQY

SEQ ID NO: 2473788 - protein, 25 aa, Entamoeba dispar
LKIKIFSFPLIRNIIKMMNDKEKTI

SEQ ID NO: 2473789 - protein, 21 aa, Entamoeba dispar
LKILEKEAWLVEDIALTAINF

SEQ ID NO: 2473790 - protein, 24 aa, Entamoeba dispar
LKKKVSKVSGWKRRWVVLCRGFLF

SEQ ID NO: 2473791 - protein, 17 aa, Entamoeba dispar
LKLGGGMKEQITNLTEI

SEQ ID NO: 2473792 - protein, 17 aa, Entamoeba dispar
LKMPDLEEAHAFLKNIS

SEQ ID NO: 2473793 - protein, 23 aa, Entamoeba dispar
LKQIGYPCGILYGRMDQEIREKE

SEQ ID NO: 2473794 - protein, 18 aa, Entamoeba dispar
LKRGYPVHTMKTAKRHYG

SEQ ID NO: 2473795 - protein, 17 aa, Entamoeba dispar
LKTNEILNGKQQWRDVC

SEQ ID NO: 2473796 - protein, 20 aa, Entamoeba dispar
LKTVKYYKIYYSLRPIFKRL

SEQ ID NO: 2473797 - protein, 23 aa, Entamoeba dispar
LLCGVQLCGGAHAIGHEITNYYG

SEQ ID NO: 2473798 - protein, 21 aa, Entamoeba dispar
LLDKFPFCRGSSANGREFIIY

SEQ ID NO: 2473799 - protein, 23 aa, Entamoeba dispar
LLGMICCGYSGFVSSASYCGPHY

SEQ ID NO: 2473800 - protein, 20 aa, Entamoeba dispar
LLIEKCCSKHLVLNDYNKFI

SEQ ID NO: 2473801 - protein, 19 aa, Entamoeba dispar
LLLQYYLHTILPIKKLDSS

SEQ ID NO: 2473802 - protein, 25 aa, Entamoeba dispar
LLMKVYREFLPHGGYITESGSLNVT

SEQ ID NO: 2473803 - protein, 18 aa, Entamoeba dispar
LLNDLNIVTPGNKQFGVT

SEQ ID NO: 2473804 - protein, 22 aa, Entamoeba dispar
LLRIIFLKERITIHELYNQFKI

SEQ ID NO: 2473805 - protein, 17 aa, Entamoeba dispar
LLRKEWKDHMSREEAEH

SEQ ID NO: 2473806 - protein, 21 aa, Entamoeba dispar
LLRLDYCSNLNISLISNKLKS

SEQ ID NO: 2473807 - protein, 23 aa, Entamoeba dispar
LLSEPSCSVGEVIKAVGKDKVLV

SEQ ID NO: 2473808 - protein, 17 aa, Entamoeba dispar
LLSPIPCRGTIKTYSRE

SEQ ID NO: 2473809 - protein, 18 aa, Entamoeba dispar
LMNVWIIQCNCMKYVDNY

SEQ ID NO: 2473810 - protein, 25 aa, Entamoeba dispar
LMYKLIELLSRYVIILLDEENPIHI

SEQ ID NO: 2473811 - protein, 17 aa, Entamoeba dispar
LNAICFVAQSSNARLTA

SEQ ID NO: 2473812 - protein, 21 aa, Entamoeba dispar
LNDSLEFVHYLTIPSYPTPIE

SEQ ID NO: 2473813 - protein, 22 aa, Entamoeba dispar
LNEFFLDMFMLRDLCDDFVEMF

SEQ ID NO: 2473814 - protein, 25 aa, Entamoeba dispar
LNGISYGHLRSGNIFINLEGKVKCF

SEQ ID NO: 2473815 - protein, 29 aa, Entamoeba dispar
LNGRCYRGHQLHIVFGIPIDINEGPNHGT

SEQ ID NO: 2473816 - protein, 22 aa, Entamoeba dispar
LNSCKGRNVIISSLRITEDCLS

SEQ ID NO: 2473817 - protein, 21 aa, Entamoeba dispar
LNSSFKHFILFATEFNLLDKK

SEQ ID NO: 2473818 - protein, 25 aa, Entamoeba dispar
LNVALTRAKCGLIVIGNIQTLIGSK

SEQ ID NO: 2473819 - protein, 25 aa, Entamoeba dispar
LNVCSEFYKSLPLAAVVANSAFCAH

SEQ ID NO: 2473820 - protein, 41 aa, Entamoeba dispar
LNYKEYEAVLNLMKFNGGYSWWRRNSMTIFLDQKIYKDPNE

SEQ ID NO: 2473821 - protein, 28 aa, Entamoeba dispar
LPERKAEMLCCVCGALIEVNPSSMCANC

SEQ ID NO: 2473822 - protein, 17 aa, Entamoeba dispar
LPIVVKMILSNTLEERK

SEQ ID NO: 2473823 - protein, 22 aa, Entamoeba dispar
LPKKSVYRLGNISQHVIMIPEL

SEQ ID NO: 2473824 - protein, 18 aa, Entamoeba dispar
LPKNNYRGKLALKNLKCF

SEQ ID NO: 2473825 - protein, 17 aa, Entamoeba dispar
LPLTIIIISLNNVFGKQ

SEQ ID NO: 2473826 - protein, 25 aa, Entamoeba dispar
LQEKGSCNVKLIGLYVKTMGNKILV

SEQ ID NO: 2473827 - protein, 18 aa, Entamoeba dispar
LQHPCALMMSELSKSQDI

SEQ ID NO: 2473828 - protein, 19 aa, Entamoeba dispar
LQKAGINFGKFKNAGISAE

SEQ ID NO: 2473829 - protein, 19 aa, Entamoeba dispar
LQLSLPLTIIIISLNNVFG

SEQ ID NO: 2473830 - protein, 19 aa, Entamoeba dispar
LQQLICNEEIFGLCDGIEI

SEQ ID NO: 2473831 - protein, 22 aa, Entamoeba dispar
LQVCGTLKMRLVQWELYQRKRV

SEQ ID NO: 2473832 - protein, 21 aa, Entamoeba dispar
LQYFCVASGVSIDIKIDQTIE

SEQ ID NO: 2473833 - protein, 24 aa, Entamoeba dispar
LRERFKRNFNGGVGIIELLYKSNL

SEQ ID NO: 2473834 - protein, 18 aa, Entamoeba dispar
LRGLEILNEVYLKPIVMS

SEQ ID NO: 2473835 - protein, 21 aa, Entamoeba dispar
LRKIRNGEIIINKEVIISEEV

SEQ ID NO: 2473836 - protein, 18 aa, Entamoeba dispar
LRLFKESRGIKMFSGSKE

SEQ ID NO: 2473837 - protein, 20 aa, Entamoeba dispar
LRLNYCSNLNVSLISNKLKS

SEQ ID NO: 2473838 - protein, 21 aa, Entamoeba dispar
LRSEILGTIKINCKLSGMPEL

SEQ ID NO: 2473839 - protein, 21 aa, Entamoeba dispar
LRSYNIIFPHIEYCKILNSSM

SEQ ID NO: 2473840 - protein, 35 aa, Entamoeba dispar
LRTTKNEIVESFSFLHWYISDGSSVLNEMIPLTGE

SEQ ID NO: 2473841 - protein, 24 aa, Entamoeba dispar
LRYVEYKGDIKIMIDETGIGKREI

SEQ ID NO: 2473842 - protein, 18 aa, Entamoeba dispar
LSAKQGLLLWCQKKCEPY

SEQ ID NO: 2473843 - protein, 20 aa, Entamoeba dispar
LSGNKIKSIQIINNINKIYP

SEQ ID NO: 2473844 - protein, 21 aa, Entamoeba dispar
LSHSFLPPIISSQFNPTQNLI

SEQ ID NO: 2473845 - protein, 18 aa, Entamoeba dispar
LSIQHPFEAEEIVKAMKK

SEQ ID NO: 2473846 - protein, 25 aa, Entamoeba dispar
LSISTESPANCGVFYNNRIYVGTNK

SEQ ID NO: 2473847 - protein, 18 aa, Entamoeba dispar
LSLPRNISNIGMKVLKGC

SEQ ID NO: 2473848 - protein, 19 aa, Entamoeba dispar
LSNGRKCECKAQIEKKSNN

SEQ ID NO: 2473849 - protein, 21 aa, Entamoeba dispar
LTANQKYIFGNIIDLFGNDVK

SEQ ID NO: 2473850 - protein, 23 aa, Entamoeba dispar
LTDKTKGLFNYKVFQEMKKSVII

SEQ ID NO: 2473851 - protein, 23 aa, Entamoeba dispar
LTEIRLSLIHFIEGMLNYDPMKR

SEQ ID NO: 2473852 - protein, 22 aa, Entamoeba dispar
LTLEGIKQFYIDVVKDEYKIDT

SEQ ID NO: 2473853 - protein, 28 aa, Entamoeba dispar
LTNLPPVYTYFYLCVIVSSEGFVKISVL

SEQ ID NO: 2473854 - protein, 27 aa, Entamoeba dispar
LTPKNIKSCFTITDGSLRYCRTNINGF

SEQ ID NO: 2473855 - protein, 19 aa, Entamoeba dispar
LVDCGFKVVAEKVEGTVAK

SEQ ID NO: 2473856 - protein, 19 aa, Entamoeba dispar
LVEQCFRIISNILACSTVL

SEQ ID NO: 2473857 - protein, 20 aa, Entamoeba dispar
LVLQEIGPRFDLRPYQIKLG

SEQ ID NO: 2473858 - protein, 23 aa, Entamoeba dispar
LVPFPRDHFAMMSYAPIVTPEKA

SEQ ID NO: 2473859 - protein, 22 aa, Entamoeba dispar
LWNPEIPYVIGTSGDGRDIQFW

SEQ ID NO: 2473860 - protein, 20 aa, Entamoeba dispar
LYAPYAVGVTSDFPLHTFMR

SEQ ID NO: 2473861 - protein, 20 aa, Entamoeba dispar
LYFDVAVGFKEGQPLVYRLI

SEQ ID NO: 2473862 - protein, 25 aa, Entamoeba dispar
MAKELKAKRYVECTSKDYETTHNVV

SEQ ID NO: 2473863 - protein, 18 aa, Entamoeba dispar
MAVASKFKESLIEIKKNN

SEQ ID NO: 2473864 - protein, 19 aa, Entamoeba dispar
MCYSMKNRIKEMGDKISSE

SEQ ID NO: 2473865 - protein, 19 aa, Entamoeba dispar
MDDVFYVSRAFCIKTKGSF

SEQ ID NO: 2473866 - protein, 27 aa, Entamoeba dispar
MDFFVVLARPGFRVSRRKRMQDKIGRD

SEQ ID NO: 2473867 - protein, 20 aa, Entamoeba dispar
MDIFYGDHLCTIVRQTIQMT

SEQ ID NO: 2473868 - protein, 18 aa, Entamoeba dispar
MEGVKMELADCCFPLVKG

SEQ ID NO: 2473869 - protein, 18 aa, Entamoeba dispar
MERLRGYQGLYHGLMIFM

SEQ ID NO: 2473870 - protein, 17 aa, Entamoeba dispar
MESRIALVGRNGCGKTT

SEQ ID NO: 2473871 - protein, 20 aa, Entamoeba dispar
MGVGKTCIVQRFCFHKYKDL

SEQ ID NO: 2473872 - protein, 22 aa, Entamoeba dispar
MIKPESKLSIIFNNIKKEVEKK

SEQ ID NO: 2473873 - protein, 17 aa, Entamoeba dispar
MILEYQRVFKKCVEGTL

SEQ ID NO: 2473874 - protein, 34 aa, Entamoeba dispar
MILTCGKIKVFISLRPLSNIGLIYSLLPSIQSSL

SEQ ID NO: 2473875 - protein, 21 aa, Entamoeba dispar
MKAQCTDIRNAVTIIVKNRVA

SEQ ID NO: 2473876 - protein, 18 aa, Entamoeba dispar
MKNALLLIRKNVLHQNHP

SEQ ID NO: 2473877 - protein, 18 aa, Entamoeba dispar
MKNYLPKISQIAEIMQHN

SEQ ID NO: 2473878 - protein, 25 aa, Entamoeba dispar
MKPIPRYPAPYPFGYDKDNRDQRYS

SEQ ID NO: 2473879 - protein, 17 aa, Entamoeba dispar
MKSMMFVNDLKVNDCGL

SEQ ID NO: 2473880 - protein, 17 aa, Entamoeba dispar
MKTLPMRMKIHMENGLK

SEQ ID NO: 2473881 - protein, 18 aa, Entamoeba dispar
MKTTRLVLLILKSLKVLK

SEQ ID NO: 2473882 - protein, 24 aa, Entamoeba dispar
MLDIGCGWGGLVREVGIIQEKNVL

SEQ ID NO: 2473883 - protein, 19 aa, Entamoeba dispar
MLPKNNYRGKLALKNLKCF

SEQ ID NO: 2473884 - protein, 17 aa, Entamoeba dispar
MLSRGELRCIGATTIEE

SEQ ID NO: 2473885 - protein, 23 aa, Entamoeba dispar
MMIKAESKLSMIFNNIKKEVEKK

SEQ ID NO: 2473886 - protein, 18 aa, Entamoeba dispar
MNGFKCILNHPIKKDIFP

SEQ ID NO: 2473887 - protein, 17 aa, Entamoeba dispar
MNVCKSINWYEQVKLRI

SEQ ID NO: 2473888 - protein, 23 aa, Entamoeba dispar
MNYEKFMPALMQYYKQPQEKHLL

SEQ ID NO: 2473889 - protein, 26 aa, Entamoeba dispar
MPSRGGPRGAPPRGMPPRGGPRGAPR

SEQ ID NO: 2473890 - protein, 17 aa, Entamoeba dispar
MPSSLPYPYHIPVNVPT

SEQ ID NO: 2473891 - protein, 17 aa, Entamoeba dispar
MRNAILLVFANKHDLPQ

SEQ ID NO: 2473892 - protein, 24 aa, Entamoeba dispar
MSKLEGLKQKWTLYEDEMKKEVQE

SEQ ID NO: 2473893 - protein, 17 aa, Entamoeba dispar
MSLIPILRFNPKCIVCV

SEQ ID NO: 2473894 - protein, 20 aa, Entamoeba dispar
MSSTIKKIVRFQCSDKPASR

SEQ ID NO: 2473895 - protein, 22 aa, Entamoeba dispar
MSYEFRNARIVIWERHLSEALS

SEQ ID NO: 2473896 - protein, 22 aa, Entamoeba dispar
MYLNIKAGRSFNDLSQYPIFPW

SEQ ID NO: 2473897 - protein, 34 aa, Entamoeba dispar
NAESISFLVPFDLRRFLPFESDCIGLLSETIYPT

SEQ ID NO: 2473898 - protein, 19 aa, Entamoeba dispar
NAFLFREITSQTGVVIVTN

SEQ ID NO: 2473899 - protein, 20 aa, Entamoeba dispar
NCDEKGPLMMYVSKMIPTND

SEQ ID NO: 2473900 - protein, 17 aa, Entamoeba dispar
NCFYGCYSLTSINIPSS

SEQ ID NO: 2473901 - protein, 20 aa, Entamoeba dispar
NCFYKCSLLTLINIPPSITA

SEQ ID NO: 2473902 - protein, 21 aa, Entamoeba dispar
NCTGLQGFFIYNSVGGGTGSG

SEQ ID NO: 2473903 - protein, 29 aa, Entamoeba dispar
NCWNKEVPHWSSDMIYQFKENINKTHCKI

SEQ ID NO: 2473904 - protein, 25 aa, Entamoeba dispar
NDGRIIKLLIWYTVNYSTYLKEKKK

SEQ ID NO: 2473905 - protein, 17 aa, Entamoeba dispar
NDKKGIVGFVTHGKNTI

SEQ ID NO: 2473906 - protein, 24 aa, Entamoeba dispar
NDKKRYAKMFSVLGSLSEVDEEQK

SEQ ID NO: 2473907 - protein, 17 aa, Entamoeba dispar
NDLKNYRFFEGKNNAVA

SEQ ID NO: 2473908 - protein, 20 aa, Entamoeba dispar
NECNWIGRYYDREIREIRIE

SEQ ID NO: 2473909 - protein, 17 aa, Entamoeba dispar
NEDEMRNAILLVFANKH

SEQ ID NO: 2473910 - protein, 24 aa, Entamoeba dispar
NEFETEALISLTIVIYEFMIMTGN

SEQ ID NO: 2473911 - protein, 22 aa, Entamoeba dispar
NEFGNSCFYKCISLQSINIPSS

SEQ ID NO: 2473912 - protein, 24 aa, Entamoeba dispar
NEIKEKSFIIGCVIRCGISLELER

SEQ ID NO: 2473913 - protein, 23 aa, Entamoeba dispar
NELKRSLRLLEEMKMIQTNEIEK

SEQ ID NO: 2473914 - protein, 26 aa, Entamoeba dispar
NERRFSIARAKFYAAEILLALEHLHL

SEQ ID NO: 2473915 - protein, 18 aa, Entamoeba dispar
NEVMELKGNVRVFCRVRP

SEQ ID NO: 2473916 - protein, 26 aa, Entamoeba dispar
NEVTRTVSVKGYFAAGLVEKAMYTYY

SEQ ID NO: 2473917 - protein, 18 aa, Entamoeba dispar
NGIIVKQLINYGNEEVKF

SEQ ID NO: 2473918 - protein, 23 aa, Entamoeba dispar
NGVEFKSKFIPIIYHEENGQELK

SEQ ID NO: 2473919 - protein, 20 aa, Entamoeba dispar
NGYCKVCGCHYTQHANGKYR

SEQ ID NO: 2473920 - protein, 27 aa, Entamoeba dispar
NIDIPRSEWGVGMGHKHIHGGLTPGGR

SEQ ID NO: 2473921 - protein, 24 aa, Entamoeba dispar
NIKKMIPCIVNIFIVGDNLQKEFV

SEQ ID NO: 2473922 - protein, 20 aa, Entamoeba dispar
NILRGKVRFPNDIKISDDCK

SEQ ID NO: 2473923 - protein, 17 aa, Entamoeba dispar
NIPSSFKSSETLSLELL

SEQ ID NO: 2473924 - protein, 18 aa, Entamoeba dispar
NISRKCSHNTFIRYLQNS

SEQ ID NO: 2473925 - protein, 17 aa, Entamoeba dispar
NIVIRIVEMMGGDVNKL

SEQ ID NO: 2473926 - protein, 22 aa, Entamoeba dispar
NKDRLKRLVFRLTDSKVVLDRN

SEQ ID NO: 2473927 - protein, 24 aa, Entamoeba dispar
NKFDPNFIATFAMDSDKVIIIDVR

SEQ ID NO: 2473928 - protein, 23 aa, Entamoeba dispar
NKGKFMSCCMMYRGDVSSREVNL

SEQ ID NO: 2473929 - protein, 23 aa, Entamoeba dispar
NKPMAMARLSRVVPHEKDYHQIY

SEQ ID NO: 2473930 - protein, 18 aa, Entamoeba dispar
NKYRVCVRNIPKNSNKKM

SEQ ID NO: 2473931 - protein, 22 aa, Entamoeba dispar
NLEGKVKCFGIFPKGFEKAAGP

SEQ ID NO: 2473932 - protein, 21 aa, Entamoeba dispar
NLKQNNLFISFGRKSIDCSAI

SEQ ID NO: 2473933 - protein, 17 aa, Entamoeba dispar
NLLNLRLRMPISDDLNP

SEQ ID NO: 2473934 - protein, 18 aa, Entamoeba dispar
NLLTAGTIIGEWYYVEIN

SEQ ID NO: 2473935 - protein, 21 aa, Entamoeba dispar
NLPNKRLRDVSLRVKYMKAKE

SEQ ID NO: 2473936 - protein, 18 aa, Entamoeba dispar
NLVRFGWETSKRIIEEKV

SEQ ID NO: 2473937 - protein, 18 aa, Entamoeba dispar
NMIEKAKPLISIASDFIP

SEQ ID NO: 2473938 - protein, 29 aa, Entamoeba dispar
NNSWTVDALKMYLNEVMYNIGVGKVDAIL

SEQ ID NO: 2473939 - protein, 17 aa, Entamoeba dispar
NPATCYGCLQCRNKDDF

SEQ ID NO: 2473940 - protein, 22 aa, Entamoeba dispar
NPEPYIIGIGFFINMISLVLEQ

SEQ ID NO: 2473941 - protein, 23 aa, Entamoeba dispar
NPIYEYLRYVIVPYLQKVTLCGK

SEQ ID NO: 2473942 - protein, 18 aa, Entamoeba dispar
NPRKVFWTAIYRQLNKKG

SEQ ID NO: 2473943 - protein, 24 aa, Entamoeba dispar
NQEFKFDISKGILSRVERNPHLKW

SEQ ID NO: 2473944 - protein, 23 aa, Entamoeba dispar
NQGLCLGDYVSALVICHTRELAL

SEQ ID NO: 2473945 - protein, 23 aa, Entamoeba dispar
NQKDIKGVTVFIGIDYTSSNVES

SEQ ID NO: 2473946 - protein, 20 aa, Entamoeba dispar
NQLFKIIDMLGLPPKNILEQ

SEQ ID NO: 2473947 - protein, 29 aa, Entamoeba dispar
NQLIDFNLQWYITCSFDRYICTPTEDEDN

SEQ ID NO: 2473948 - protein, 19 aa, Entamoeba dispar
NQRLPLSDIRPSLNDPRDL

SEQ ID NO: 2473949 - protein, 21 aa, Entamoeba dispar
NQVCPKGKYIAIVGTTVETSN

SEQ ID NO: 2473950 - protein, 26 aa, Entamoeba dispar
NQVLKQKALCLFYERYPEAVSEVMFP

SEQ ID NO: 2473951 - protein, 25 aa, Entamoeba dispar
NQVYFRFGDWDTIRILRVIIKVQPI

SEQ ID NO: 2473952 - protein, 18 aa, Entamoeba dispar
NQYGEMKQECPLCHRLIP

SEQ ID NO: 2473953 - protein, 17 aa, Entamoeba dispar
NRFKNFLTYLQNYDENK

SEQ ID NO: 2473954 - protein, 18 aa, Entamoeba dispar
NRHVTSFDQLLTVIENKP

SEQ ID NO: 2473955 - protein, 19 aa, Entamoeba dispar
NRIASQAFTGFKQQRFLEY

SEQ ID NO: 2473956 - protein, 20 aa, Entamoeba dispar
NRTSPFAFIGNRFEFRAVGS

SEQ ID NO: 2473957 - protein, 21 aa, Entamoeba dispar
NRYKVLKAHGMKVVSFADTDA

SEQ ID NO: 2473958 - protein, 25 aa, Entamoeba dispar
NSEIKESWDVWGLGVIIIEMMNGTA

SEQ ID NO: 2473959 - protein, 18 aa, Entamoeba dispar
NSGALRFGAKEHFVNAII

SEQ ID NO: 2473960 - protein, 23 aa, Entamoeba dispar
NSLHGVGLGRSCDIELIRNIGRI

SEQ ID NO: 2473961 - protein, 18 aa, Entamoeba dispar
NTQLSRVILIRDQIFKLA

SEQ ID NO: 2473962 - protein, 18 aa, Entamoeba dispar
NTQMNFSRIDPAARAAGI

SEQ ID NO: 2473963 - protein, 19 aa, Entamoeba dispar
NVDIIPKFIMSSGEMVNLL

SEQ ID NO: 2473964 - protein, 21 aa, Entamoeba dispar
NVIEKCFKFATPNERQQILEE

SEQ ID NO: 2473965 - protein, 28 aa, Entamoeba dispar
NVIGIAICTYCLPVIKKEKIINLIVDYV

SEQ ID NO: 2473966 - protein, 19 aa, Entamoeba dispar
NVNSFLKKFYYTMKEPSYI

SEQ ID NO: 2473967 - protein, 21 aa, Entamoeba dispar
NVYLTSHRAVMEMEYMNGGDL

SEQ ID NO: 2473968 - protein, 17 aa, Entamoeba dispar
NWIGRYYDREIREIRIE

SEQ ID NO: 2473969 - protein, 21 aa, Entamoeba dispar
NYKLISFIRKRIEYDSRIKQG

SEQ ID NO: 2473970 - protein, 19 aa, Entamoeba dispar
NYLGYLIHRILSYDPTLEE

SEQ ID NO: 2473971 - protein, 21 aa, Entamoeba dispar
NYLKERIASLSLKNPKFSFDL

SEQ ID NO: 2473972 - protein, 27 aa, Entamoeba dispar
NYLKVLIIKNCQGIYLKTIVKLNHLLT

SEQ ID NO: 2473973 - protein, 17 aa, Entamoeba dispar
NYYSVVGSNSMKNEQKT

SEQ ID NO: 2473974 - protein, 21 aa, Entamoeba dispar
PAIYIKWNYKAEEFSLPITFT

SEQ ID NO: 2473975 - protein, 19 aa, Entamoeba dispar
PCCGGTKIYIKGRFPYSGR

SEQ ID NO: 2473976 - protein, 17 aa, Entamoeba dispar
PCSCISIGSCCFAQCHS

SEQ ID NO: 2473977 - protein, 18 aa, Entamoeba dispar
PDESCIFHTDRIIKNPTL

SEQ ID NO: 2473978 - protein, 19 aa, Entamoeba dispar
PDNGIPYLDSVIINTNVQP

SEQ ID NO: 2473979 - protein, 17 aa, Entamoeba dispar
PDSICFEQFDAVDHPTY

SEQ ID NO: 2473980 - protein, 22 aa, Entamoeba dispar
PDWIYIRAAAIARKVYLNNGIG

SEQ ID NO: 2473981 - protein, 24 aa, Entamoeba dispar
PEARCIRVRYRLGGMQDGYVQDHC

SEQ ID NO: 2473982 - protein, 20 aa, Entamoeba dispar
PEATFKTMIHISMGVETNMS

SEQ ID NO: 2473983 - protein, 24 aa, Entamoeba dispar
PEFLNRLDDIIIFSPLSEKELKEI

SEQ ID NO: 2473984 - protein, 21 aa, Entamoeba dispar
PEFLNRLDDIIVFSPLSEKEL

SEQ ID NO: 2473985 - protein, 19 aa, Entamoeba dispar
PEMTEFIIFNFSHKHPLVP

SEQ ID NO: 2473986 - protein, 24 aa, Entamoeba dispar
PEPIRLADLISRNLLRNEGLLPHM

SEQ ID NO: 2473987 - protein, 21 aa, Entamoeba dispar
PEPSLMLIGSMCYSLEASFAP

SEQ ID NO: 2473988 - protein, 20 aa, Entamoeba dispar
PEQSDIILLNILVLIQPEIK

SEQ ID NO: 2473989 - protein, 18 aa, Entamoeba dispar
PERVPKAAAVVLDQTKPI

SEQ ID NO: 2473990 - protein, 17 aa, Entamoeba dispar
PESKLSMIFNNIKKEVE

SEQ ID NO: 2473991 - protein, 17 aa, Entamoeba dispar
PESKLTMIFNNIKKEVE

SEQ ID NO: 2473992 - protein, 34 aa, Entamoeba dispar
PFFLNIFGSLLLKFNIYGGWTFIYQILYSVLKYN

SEQ ID NO: 2473993 - protein, 25 aa, Entamoeba dispar
PFGLQRIFGDLTFSNVLSIVSYDYN

SEQ ID NO: 2473994 - protein, 19 aa, Entamoeba dispar
PFGSWRRGKTTLKLNQMNQ

SEQ ID NO: 2473995 - protein, 17 aa, Entamoeba dispar
PGASIKGHFFIDHGVGV

SEQ ID NO: 2473996 - protein, 23 aa, Entamoeba dispar
PGESMKGTGIIVFRQIMKNRCEV

SEQ ID NO: 2473997 - protein, 17 aa, Entamoeba dispar
PGIKYRKNEVFVDVIEK

SEQ ID NO: 2473998 - protein, 24 aa, Entamoeba dispar
PHTETIPITNSNPFNQIQNPTLIQ

SEQ ID NO: 2473999 - protein, 20 aa, Entamoeba dispar
PICSRSSFKISNLYLLHLHH

SEQ ID NO: 2474000 - protein, 24 aa, Entamoeba dispar
PIGDELKGSTLLLLIFDMSNSDSF

SEQ ID NO: 2474001 - protein, 17 aa, Entamoeba dispar
PKKRLLHDLPNLDREIV

SEQ ID NO: 2474002 - protein, 19 aa, Entamoeba dispar
PKLEDFETLKLIGKGTYGK

SEQ ID NO: 2474003 - protein, 26 aa, Entamoeba dispar
PKLFYKPKILCLNIELELKKEKDNAE

SEQ ID NO: 2474004 - protein, 24 aa, Entamoeba dispar
PLHTFMRKWLKSLYEINVENDMKF

SEQ ID NO: 2474005 - protein, 21 aa, Entamoeba dispar
PLNYKIPVWFLNRQKDNKDGK

SEQ ID NO: 2474006 - protein, 17 aa, Entamoeba dispar
PLRDLLEQLSIEYRSVG

SEQ ID NO: 2474007 - protein, 19 aa, Entamoeba dispar
PMRMKIHMENGLKVAKFLE

SEQ ID NO: 2474008 - protein, 21 aa, Entamoeba dispar
PNAQPPYILVGAIDNGSAPSI

SEQ ID NO: 2474009 - protein, 32 aa, Entamoeba dispar
PNEIDHTIQWARDRFEGFFKTEIEPIKNYKEQ

SEQ ID NO: 2474010 - protein, 38 aa, Entamoeba dispar
PNISKLIFLQCVSNLLGIPREVPVIIPPSELIELIQHY

SEQ ID NO: 2474011 - protein, 17 aa, Entamoeba dispar
PNQELCHLFGPQDGINC

SEQ ID NO: 2474012 - protein, 17 aa, Entamoeba dispar
PPKNEFNALELPKNDWN

SEQ ID NO: 2474013 - protein, 24 aa, Entamoeba dispar
PPNGFLFRFLRDETVLFGVDAKVT

SEQ ID NO: 2474014 - protein, 19 aa, Entamoeba dispar
PQIKVDDFLHEFNQQTKMN

SEQ ID NO: 2474015 - protein, 18 aa, Entamoeba dispar
PQQLDCLTQLIKPKTLTF

SEQ ID NO: 2474016 - protein, 18 aa, Entamoeba dispar
PRDYNVDIIPKFIMSSGE

SEQ ID NO: 2474017 - protein, 20 aa, Entamoeba dispar
PRNISNIGMKVLKGCSSLKS

SEQ ID NO: 2474018 - protein, 18 aa, Entamoeba dispar
PRYELLIRDMLKDTGKDY

SEQ ID NO: 2474019 - protein, 25 aa, Entamoeba dispar
PSALKCSIMAAKIVRDAAIAAGAPE

SEQ ID NO: 2474020 - protein, 27 aa, Entamoeba dispar
PSDESYRFYQLLLFNFSQFIADEDFNR

SEQ ID NO: 2474021 - protein, 17 aa, Entamoeba dispar
PSLAELIAMQKAGTLPK

SEQ ID NO: 2474022 - protein, 26 aa, Entamoeba dispar
PSMAVSKAEHKICCVKTAKTMADGIA

SEQ ID NO: 2474023 - protein, 28 aa, Entamoeba dispar
PSSDALHLGHLIPFIFTKYLQDAFDCQL

SEQ ID NO: 2474024 - protein, 20 aa, Entamoeba dispar
PSSFCPRCGAYLILSDSGDI

SEQ ID NO: 2474025 - protein, 19 aa, Entamoeba dispar
PSSIIKLGDYCFYECTSLE

SEQ ID NO: 2474026 - protein, 27 aa, Entamoeba dispar
PSSISKLGYKCFKECYSLKSINIPSSI

SEQ ID NO: 2474027 - protein, 25 aa, Entamoeba dispar
PSSITKLGICCFRRCKSLQSINIPS

SEQ ID NO: 2474028 - protein, 22 aa, Entamoeba dispar
PSSMCANCLHKTIDITEGIPKQ

SEQ ID NO: 2474029 - protein, 22 aa, Entamoeba dispar
PSSVSKIGNWCFYGCSSLKEVD

SEQ ID NO: 2474030 - protein, 23 aa, Entamoeba dispar
PTILRPGGVTLEMLREVIPSTQV

SEQ ID NO: 2474031 - protein, 21 aa, Entamoeba dispar
PTIVMMCLWIMMLKQKNIGSS

SEQ ID NO: 2474032 - protein, 20 aa, Entamoeba dispar
PYSTTFDWGNIVERNNDIAK

SEQ ID NO: 2474033 - protein, 20 aa, Entamoeba dispar
QAFTGFKQQRFLEYNAERGL

SEQ ID NO: 2474034 - protein, 18 aa, Entamoeba dispar
QAMLLMLERCKIVSEGSG

SEQ ID NO: 2474035 - protein, 17 aa, Entamoeba dispar
QASAIFLTASNNIKLKK

SEQ ID NO: 2474036 - protein, 18 aa, Entamoeba dispar
QATQIGGKQYIRLAGLRD

SEQ ID NO: 2474037 - protein, 22 aa, Entamoeba dispar
QCIETIKLKTNEILNGKQQWRD

SEQ ID NO: 2474038 - protein, 22 aa, Entamoeba dispar
QEELDYKPGIYTQWESAYNMED

SEQ ID NO: 2474039 - protein, 22 aa, Entamoeba dispar
QEELDYKPGIYTQWETAYNMED

SEQ ID NO: 2474040 - protein, 20 aa, Entamoeba dispar
QELLRLLSQQFFDMSKYSII

SEQ ID NO: 2474041 - protein, 20 aa, Entamoeba dispar
QGFHCVYSGMVLSYYLPIHC

SEQ ID NO: 2474042 - protein, 18 aa, Entamoeba dispar
QGLLLWCQKKCEPYPVKV

SEQ ID NO: 2474043 - protein, 20 aa, Entamoeba dispar
QGLVPLLRLQWNKFDPNFIA

SEQ ID NO: 2474044 - protein, 18 aa, Entamoeba dispar
QGQDELRVFWNSKVIVYK

SEQ ID NO: 2474045 - protein, 27 aa, Entamoeba dispar
QHHLRICLEEINKLISDIISIRRKQEQ

SEQ ID NO: 2474046 - protein, 18 aa, Entamoeba dispar
QHSIKLNGYDRFSDENLR

SEQ ID NO: 2474047 - protein, 19 aa, Entamoeba dispar
QIEGLRISLNNGISKMSEI

SEQ ID NO: 2474048 - protein, 18 aa, Entamoeba dispar
QIFAPIAVDSVMKVIDIN

SEQ ID NO: 2474049 - protein, 26 aa, Entamoeba dispar
QIILFTFKSHLLKSVRILTTPSTDHS

SEQ ID NO: 2474050 - protein, 19 aa, Entamoeba dispar
QKCMLCGISKNNNIYQLQY

SEQ ID NO: 2474051 - protein, 19 aa, Entamoeba dispar
QKEFDRCMKCVDDILAKTK

SEQ ID NO: 2474052 - protein, 20 aa, Entamoeba dispar
QKIGNISFHLSIYNKTLYKQ

SEQ ID NO: 2474053 - protein, 22 aa, Entamoeba dispar
QKKEIMKTFEYVMKELDKLTSA

SEQ ID NO: 2474054 - protein, 19 aa, Entamoeba dispar
QKLSTFILVASKKVNDKEL

SEQ ID NO: 2474055 - protein, 23 aa, Entamoeba dispar
QKPIFKISMFLFQQRDSKADKAI

SEQ ID NO: 2474056 - protein, 25 aa, Entamoeba dispar
QKTLWIIRMRVLRRLLLKYRTTGKI

SEQ ID NO: 2474057 - protein, 23 aa, Entamoeba dispar
QKYPRLYYTWIDKVVQTQEKSGN

SEQ ID NO: 2474058 - protein, 24 aa, Entamoeba dispar
QLIYPCMQCADIFELGADVCQLGL

SEQ ID NO: 2474059 - protein, 19 aa, Entamoeba dispar
QLLDGIKFQNEKIFEMQEE

SEQ ID NO: 2474060 - protein, 20 aa, Entamoeba dispar
QLVSCSNLNISLMSNKLKSV

SEQ ID NO: 2474061 - protein, 18 aa, Entamoeba dispar
QNELKMFSEIGGFQSECF

SEQ ID NO: 2474062 - protein, 18 aa, Entamoeba dispar
QNFSWVRVGCICMVVANR

SEQ ID NO: 2474063 - protein, 18 aa, Entamoeba dispar
QNNFPSFEQEEKRLLNAQ

SEQ ID NO: 2474064 - protein, 30 aa, Entamoeba dispar
QNTVPFVGWCPCSFKCGINSQPATAVPGSS

SEQ ID NO: 2474065 - protein, 26 aa, Entamoeba dispar
QPAKHYRCSISMTELLPYNTNHVKEL

SEQ ID NO: 2474066 - protein, 24 aa, Entamoeba dispar
QPANTRLGAIRVHNVRCRYGIIKR

SEQ ID NO: 2474067 - protein, 31 aa, Entamoeba dispar
QPCKRTPGGGFGICWSNLLLGTFTVCEEGNL

SEQ ID NO: 2474068 - protein, 18 aa, Entamoeba dispar
QPHFKKSLEEFNFTDDCP

SEQ ID NO: 2474069 - protein, 20 aa, Entamoeba dispar
QPKGKNFMFIHFSKEESAKE

SEQ ID NO: 2474070 - protein, 23 aa, Entamoeba dispar
QPTGQPQKNVWGNPVQSQIGQPQ

SEQ ID NO: 2474071 - protein, 23 aa, Entamoeba dispar
QQFIDRFKCSAVRGPQVQSRIKM

SEQ ID NO: 2474072 - protein, 24 aa, Entamoeba dispar
QRLFVGKSKKGFGYITDDPFIDDT

SEQ ID NO: 2474073 - protein, 22 aa, Entamoeba dispar
QRMKLVPRVKIFAGKAAIGYDM

SEQ ID NO: 2474074 - protein, 26 aa, Entamoeba dispar
QRNRKARIGVFAQHFVDQLNFKVNAI

SEQ ID NO: 2474075 - protein, 22 aa, Entamoeba dispar
QRTEIRNVFMFKAISGGGDGPI

SEQ ID NO: 2474076 - protein, 25 aa, Entamoeba dispar
QRYFIAYGGNVSFSFNSKVTHYITN

SEQ ID NO: 2474077 - protein, 22 aa, Entamoeba dispar
QSEMRELACLLVEKYQVENDFT

SEQ ID NO: 2474078 - protein, 18 aa, Entamoeba dispar
QSIGKYGIQYDFIHKHNK

SEQ ID NO: 2474079 - protein, 25 aa, Entamoeba dispar
QSIQVCPEQSFFIYFFPTSQFTLTK

SEQ ID NO: 2474080 - protein, 24 aa, Entamoeba dispar
QSKTWFPDMPSHFITKENEPIKPL

SEQ ID NO: 2474081 - protein, 24 aa, Entamoeba dispar
QSNLKLKNLMGVTRSMLNHRIDLW

SEQ ID NO: 2474082 - protein, 24 aa, Entamoeba dispar
QTDPAGTWTEWKAHVVGRNSKTVD

SEQ ID NO: 2474083 - protein, 24 aa, Entamoeba dispar
QTQFKEVIDRIAGPTNNLQYAHIS

SEQ ID NO: 2474084 - protein, 21 aa, Entamoeba dispar
QVCGTLKMRLVQWELYQRKRV

SEQ ID NO: 2474085 - protein, 17 aa, Entamoeba dispar
QVSDRGNNVIVYGTIAG

SEQ ID NO: 2474086 - protein, 22 aa, Entamoeba dispar
QYIKQGDGFVLIYSITSKESFE

SEQ ID NO: 2474087 - protein, 21 aa, Entamoeba dispar
RACGVSRDVIAVAIINDKGKS

SEQ ID NO: 2474088 - protein, 17 aa, Entamoeba dispar
RAIVKTIRRRERSRRRM

SEQ ID NO: 2474089 - protein, 18 aa, Entamoeba dispar
RATLKRQAFGNFASAMQQ

SEQ ID NO: 2474090 - protein, 21 aa, Entamoeba dispar
RCHKCVQKKILRAFLINEHNL

SEQ ID NO: 2474091 - protein, 25 aa, Entamoeba dispar
RDIIFKFNEAFGVAKTKGTNELHLH

SEQ ID NO: 2474092 - protein, 26 aa, Entamoeba dispar
RDKLGIKSMEVYGGVLSVEAFNHFLW

SEQ ID NO: 2474093 - protein, 37 aa, Entamoeba dispar
RDKLGIKSMEVYGGVLSVEAFNHFLWCQSSESVSDLV

SEQ ID NO: 2474094 - protein, 22 aa, Entamoeba dispar
RDKTLIKWMIKDILQRKKHSNL

SEQ ID NO: 2474095 - protein, 22 aa, Entamoeba dispar
RDLRDPRIIDSRFDPRYDNRYL

SEQ ID NO: 2474096 - protein, 23 aa, Entamoeba dispar
RDLYMKTGQGFVLVYSIIAQSTY

SEQ ID NO: 2474097 - protein, 23 aa, Entamoeba dispar
REINDFIVYWIAKLNKNYYKVTI

SEQ ID NO: 2474098 - protein, 18 aa, Entamoeba dispar
RELIGIKLPTSLKEINHT

SEQ ID NO: 2474099 - protein, 21 aa, Entamoeba dispar
RENYNTFAISYNCRHNSNYSR

SEQ ID NO: 2474100 - protein, 17 aa, Entamoeba dispar
RESIIWNSVEGIKGEED

SEQ ID NO: 2474101 - protein, 21 aa, Entamoeba dispar
RETDARKSIRLFKKHQIAQLR

SEQ ID NO: 2474102 - protein, 19 aa, Entamoeba dispar
REVTTLGDECFKYCSTITT

SEQ ID NO: 2474103 - protein, 25 aa, Entamoeba dispar
REYETWKSNAIYLYSFLTTYETSFP

SEQ ID NO: 2474104 - protein, 26 aa, Entamoeba dispar
RFDPRYSSSRFDPRFDPRYDPRFERF

SEQ ID NO: 2474105 - protein, 19 aa, Entamoeba dispar
RFGFPKDKIELYVEKVLAR

SEQ ID NO: 2474106 - protein, 25 aa, Entamoeba dispar
RFLFSPTQCKEFLSKLVKEIEKEET

SEQ ID NO: 2474107 - protein, 27 aa, Entamoeba dispar
RFNNEPTLKEFIRYVFASDDDFLVEQC

SEQ ID NO: 2474108 - protein, 19 aa, Entamoeba dispar
RGCIIDCTISLNKKPGILT

SEQ ID NO: 2474109 - protein, 25 aa, Entamoeba dispar
RGRIPHDIALSVLRSVNFDMKNALL

SEQ ID NO: 2474110 - protein, 24 aa, Entamoeba dispar
RGSPVPRGRGGMMPPAQVPEHEEQ

SEQ ID NO: 2474111 - protein, 24 aa, Entamoeba dispar
RGSPVPRGRGGMMPPAQVSEHEEQ

SEQ ID NO: 2474112 - protein, 24 aa, Entamoeba dispar
RHVNPAAAWPCCHLMKERRRMSLK

SEQ ID NO: 2474113 - protein, 26 aa, Entamoeba dispar
RILTTSVYIPLDFTTIFNCPSAFSVD

SEQ ID NO: 2474114 - protein, 21 aa, Entamoeba dispar
RIRPPRYCPEQIICFDYLQSQ

SEQ ID NO: 2474115 - protein, 20 aa, Entamoeba dispar
RKAVRGMLPKNNYRGKLALK

SEQ ID NO: 2474116 - protein, 21 aa, Entamoeba dispar
RKEFEEECYKRGIYEEFINKI

SEQ ID NO: 2474117 - protein, 21 aa, Entamoeba dispar
RKGGFNRRGAGRFGGRDRRYE

SEQ ID NO: 2474118 - protein, 23 aa, Entamoeba dispar
RKKHAEGGLWYGVNVNEEGILDM

SEQ ID NO: 2474119 - protein, 20 aa, Entamoeba dispar
RKLLSRKFPLNFEVKQPNCQ

SEQ ID NO: 2474120 - protein, 25 aa, Entamoeba dispar
RKLQKRALRCYLRALDYLDNDYRIP

SEQ ID NO: 2474121 - protein, 17 aa, Entamoeba dispar
RKNDKKGIVGFVTHGKN

SEQ ID NO: 2474122 - protein, 17 aa, Entamoeba dispar
RKNEVFVDVIEKVNVLV

SEQ ID NO: 2474123 - protein, 19 aa, Entamoeba dispar
RKVGMERKELIGINTRIMK

SEQ ID NO: 2474124 - protein, 18 aa, Entamoeba dispar
RKYHLVTICDSKFDKEVA

SEQ ID NO: 2474125 - protein, 21 aa, Entamoeba dispar
RLAASVLKCGNRKVWLDPNET

SEQ ID NO: 2474126 - protein, 19 aa, Entamoeba dispar
RLKEIRMNKDIGYVGKCSF

SEQ ID NO: 2474127 - protein, 22 aa, Entamoeba dispar
RLLTQPMKIDWTFYCHKCDGMA

SEQ ID NO: 2474128 - protein, 24 aa, Entamoeba dispar
RLPMPRPGQILGLVGTNGIGKSTA

SEQ ID NO: 2474129 - protein, 19 aa, Entamoeba dispar
RLSCGKLLAGCRILGCNEI

SEQ ID NO: 2474130 - protein, 17 aa, Entamoeba dispar
RMKQLKFNIQQPNINTV

SEQ ID NO: 2474131 - protein, 22 aa, Entamoeba dispar
RMPSHPIAYEFIKQCKTPIAAP

SEQ ID NO: 2474132 - protein, 21 aa, Entamoeba dispar
RMTANLPLFYFSPININPPKF

SEQ ID NO: 2474133 - protein, 22 aa, Entamoeba dispar
RNENRYRWGVDKAYDVKVVEIV

SEQ ID NO: 2474134 - protein, 20 aa, Entamoeba dispar
RNGMKEYIPIVSKRESDIYI

SEQ ID NO: 2474135 - protein, 21 aa, Entamoeba dispar
RNIKNKWIIELRKYAPTVPVI

SEQ ID NO: 2474136 - protein, 20 aa, Entamoeba dispar
RNIQILKSFGVKFINSSYGK

SEQ ID NO: 2474137 - protein, 23 aa, Entamoeba dispar
RNKRGEAMRLIIMSATLRVSEFT

SEQ ID NO: 2474138 - protein, 24 aa, Entamoeba dispar
RNMLPCGLYKFPVRNTTDLEMIMM

SEQ ID NO: 2474139 - protein, 21 aa, Entamoeba dispar
RNPHLKWKDVNDFVHKETHNK

SEQ ID NO: 2474140 - protein, 19 aa, Entamoeba dispar
RNQIQLIDVVLRYAGSSKR

SEQ ID NO: 2474141 - protein, 28 aa, Entamoeba dispar
RPFYIKPPNSMGYLTLKFSNSGKIIPQY

SEQ ID NO: 2474142 - protein, 19 aa, Entamoeba dispar
RPLSYPNTDLFLLCFSVIS

SEQ ID NO: 2474143 - protein, 19 aa, Entamoeba dispar
RPQAFFKGLIFPLCQEKDV

SEQ ID NO: 2474144 - protein, 21 aa, Entamoeba dispar
RPRSFKARPIINHSDGTKQSF

SEQ ID NO: 2474145 - protein, 23 aa, Entamoeba dispar
RPYGVSFLYAGWDRYFGYQLYMC

SEQ ID NO: 2474146 - protein, 17 aa, Entamoeba dispar
RQLPISRQKINWANWKG

SEQ ID NO: 2474147 - protein, 17 aa, Entamoeba dispar
RQRPTGKYVIEWGGIIA

SEQ ID NO: 2474148 - protein, 26 aa, Entamoeba dispar
RRTRKLFKRPFRGHGISNTSTILHTY

SEQ ID NO: 2474149 - protein, 18 aa, Entamoeba dispar
RSIRMVFDDETFYRVNNA

SEQ ID NO: 2474150 - protein, 26 aa, Entamoeba dispar
RSSPLEIVEAYNFVRCQSSWKDTRTG

SEQ ID NO: 2474151 - protein, 21 aa, Entamoeba dispar
RTDRHLGLEMQFDYIQLDFQS

SEQ ID NO: 2474152 - protein, 28 aa, Entamoeba dispar
RTMLKTQYRMHPAIVEFSNKMFYSSKLE

SEQ ID NO: 2474153 - protein, 26 aa, Entamoeba dispar
RTMRRRGRRGTLRRQAFGNFASAMQQ

SEQ ID NO: 2474154 - protein, 17 aa, Entamoeba dispar
RTPPIKIIDTPGFGDTR

SEQ ID NO: 2474155 - protein, 22 aa, Entamoeba dispar
RTVHCCQCLICKKETFFQTKNP

SEQ ID NO: 2474156 - protein, 23 aa, Entamoeba dispar
RVDNEVLKGISFKAEQGKTIALV

SEQ ID NO: 2474157 - protein, 19 aa, Entamoeba dispar
RYANGEVKPIRILDPNVTL

SEQ ID NO: 2474158 - protein, 19 aa, Entamoeba dispar
RYILRAMAVASKFKESLIE

SEQ ID NO: 2474159 - protein, 19 aa, Entamoeba dispar
RYMELAQMIGLKCNTPAEG

SEQ ID NO: 2474160 - protein, 24 aa, Entamoeba dispar
SAFFFARDFCHFVNLWDMRYQRCL

SEQ ID NO: 2474161 - protein, 24 aa, Entamoeba dispar
SAGCKATIVMPEFASTAKVTATRG

SEQ ID NO: 2474162 - protein, 20 aa, Entamoeba dispar
SAKNGIGIVKLMGRDAGFIA

SEQ ID NO: 2474163 - protein, 24 aa, Entamoeba dispar
SARFGRKGVAIDFITTEEMDTINR

SEQ ID NO: 2474164 - protein, 24 aa, Entamoeba dispar
SCMKFCMNGGLIIGTWDGANVEIA

SEQ ID NO: 2474165 - protein, 24 aa, Entamoeba dispar
SDCSYYALSCGKYVQYYGPLPSAP

SEQ ID NO: 2474166 - protein, 21 aa, Entamoeba dispar
SDSNAWTALLVPLMNDIPEAT

SEQ ID NO: 2474167 - protein, 26 aa, Entamoeba dispar
SDVLRFLRRIRCWELRHLPRIHRVAR

SEQ ID NO: 2474168 - protein, 23 aa, Entamoeba dispar
SEAEIKKFLEWVRSIPPMNVKNI

SEQ ID NO: 2474169 - protein, 21 aa, Entamoeba dispar
SECYLKMGELYKMKNDKSLMY

SEQ ID NO: 2474170 - protein, 24 aa, Entamoeba dispar
SEEHGAVCPINWKAGKDTIEPTPE

SEQ ID NO: 2474171 - protein, 24 aa, Entamoeba dispar
SEEHGAVCPINWKTGKDTIEPTPE

SEQ ID NO: 2474172 - protein, 17 aa, Entamoeba dispar
SEESKIIFRDIVDDANA

SEQ ID NO: 2474173 - protein, 26 aa, Entamoeba dispar
SEEYFRFLWELRLVFNKEMTQLQELK

SEQ ID NO: 2474174 - protein, 24 aa, Entamoeba dispar
SEGFKLFVNLCCDTFLILRKNYHG

SEQ ID NO: 2474175 - protein, 20 aa, Entamoeba dispar
SEGFVKISVLVPAPKQDVVD

SEQ ID NO: 2474176 - protein, 23 aa, Entamoeba dispar
SEHPTHFVKPCANKGVKSDCEII

SEQ ID NO: 2474177 - protein, 24 aa, Entamoeba dispar
SELGYDCFKGCYSLTSINLPSSIN

SEQ ID NO: 2474178 - protein, 19 aa, Entamoeba dispar
SESDYALTQGRLSLQPLSK

SEQ ID NO: 2474179 - protein, 26 aa, Entamoeba dispar
SFEQEEKRLLNAQTKVEDMKRIVNAL

SEQ ID NO: 2474180 - protein, 27 aa, Entamoeba dispar
SGFSLDEPAAFAGRIYRMVKLGLSLDD

SEQ ID NO: 2474181 - protein, 25 aa, Entamoeba dispar
SGIATMRIGGITYKLTKGTKPHFLE

SEQ ID NO: 2474182 - protein, 24 aa, Entamoeba dispar
SGKNVRLRYYLRVSVNKKYSSGLS

SEQ ID NO: 2474183 - protein, 19 aa, Entamoeba dispar
SGMFIEFYAKATGAGTEAA

SEQ ID NO: 2474184 - protein, 22 aa, Entamoeba dispar
SGSRDKTLMVWKVDTNSEAQAE

SEQ ID NO: 2474185 - protein, 19 aa, Entamoeba dispar
SHQFLLPPPIFCIGTKSDL

SEQ ID NO: 2474186 - protein, 18 aa, Entamoeba dispar
SIEIGRKRIDEMDKADEE

SEQ ID NO: 2474187 - protein, 22 aa, Entamoeba dispar
SIGGDCFYECLSLKSINIDNLQ

SEQ ID NO: 2474188 - protein, 19 aa, Entamoeba dispar
SIGSCCFAQCHSLKSITIH

SEQ ID NO: 2474189 - protein, 17 aa, Entamoeba dispar
SIISRSYLELGMNEEAM

SEQ ID NO: 2474190 - protein, 24 aa, Entamoeba dispar
SIMDELGKFLSVFMSISNKIPKDE

SEQ ID NO: 2474191 - protein, 18 aa, Entamoeba dispar
SIPKSRYVILNKLHSARF

SEQ ID NO: 2474192 - protein, 20 aa, Entamoeba dispar
SIQLEQQYYLSIISILQQQK

SEQ ID NO: 2474193 - protein, 28 aa, Entamoeba dispar
SISELKKACFSWCETLRTITIPPSVIEL

SEQ ID NO: 2474194 - protein, 17 aa, Entamoeba dispar
SKEIYFFSDPKKRLLHD

SEQ ID NO: 2474195 - protein, 18 aa, Entamoeba dispar
SKEVFFNEIAPFQMKKYV

SEQ ID NO: 2474196 - protein, 20 aa, Entamoeba dispar
SKFAKTILHRLCLSRVNRPI

SEQ ID NO: 2474197 - protein, 21 aa, Entamoeba dispar
SKKRISSPIINKSSHTTNVKN

SEQ ID NO: 2474198 - protein, 24 aa, Entamoeba dispar
SKLGPGCFKNCLSLRTITLPSSIS

SEQ ID NO: 2474199 - protein, 25 aa, Entamoeba dispar
SKLKEFVKEIKLIIPNSTRINRGNI

SEQ ID NO: 2474200 - protein, 19 aa, Entamoeba dispar
SKQKPKCTIVTQRDLEGYE

SEQ ID NO: 2474201 - protein, 22 aa, Entamoeba dispar
SKQNITWSGGKLKPDIDDEKGL

SEQ ID NO: 2474202 - protein, 24 aa, Entamoeba dispar
SKSSFKVCIDFGRMIESHRRKYCE

SEQ ID NO: 2474203 - protein, 23 aa, Entamoeba dispar
SKTLKRKITWDLAAQLVEYATAT

SEQ ID NO: 2474204 - protein, 24 aa, Entamoeba dispar
SKVKNWKKRWFVFHNNGMLDYFTD

SEQ ID NO: 2474205 - protein, 18 aa, Entamoeba dispar
SKYFPCVENQNSIPLKRI

SEQ ID NO: 2474206 - protein, 21 aa, Entamoeba dispar
SLFPFVVFHSSPLIPFNSEIV

SEQ ID NO: 2474207 - protein, 17 aa, Entamoeba dispar
SLGKVMQTPECLRVYVS

SEQ ID NO: 2474208 - protein, 20 aa, Entamoeba dispar
SLGNACFSFCTNLKKIQLPE

SEQ ID NO: 2474209 - protein, 19 aa, Entamoeba dispar
SLITGGLYFKLKEKHPEFD

SEQ ID NO: 2474210 - protein, 28 aa, Entamoeba dispar
SLKSHGYELLKISIKVIKDIKILRKCLI

SEQ ID NO: 2474211 - protein, 26 aa, Entamoeba dispar
SLMAPMDAFLCARGMKTLPMRMKIHM

SEQ ID NO: 2474212 - protein, 21 aa, Entamoeba dispar
SLPYEQKFLMGFDKSGASVVI

SEQ ID NO: 2474213 - protein, 17 aa, Entamoeba dispar
SLSECKLPISLSSIQNN

SEQ ID NO: 2474214 - protein, 18 aa, Entamoeba dispar
SMAGNLKAAFQQRDSTQV

SEQ ID NO: 2474215 - protein, 22 aa, Entamoeba dispar
SMPLPRIKISNFVHSISPFQPY

SEQ ID NO: 2474216 - protein, 18 aa, Entamoeba dispar
SNIVIRIVEMMGGDVNKL

SEQ ID NO: 2474217 - protein, 26 aa, Entamoeba dispar
SNKLKSVEVINCRECQINIKSDCIER

SEQ ID NO: 2474218 - protein, 18 aa, Entamoeba dispar
SPDFKWLVSGSEDCSVRL

SEQ ID NO: 2474219 - protein, 28 aa, Entamoeba dispar
SPILLNLQYRCCPPISNIVNRLYYNGLL

SEQ ID NO: 2474220 - protein, 25 aa, Entamoeba dispar
SQGAARYAFEFSTGMIKSITEVTAH

SEQ ID NO: 2474221 - protein, 26 aa, Entamoeba dispar
SQTEEVKRLQEQIIKEKQENEKHLKQ

SEQ ID NO: 2474222 - protein, 18 aa, Entamoeba dispar
SQTEGPCCGGTKIYIKGR

SEQ ID NO: 2474223 - protein, 28 aa, Entamoeba dispar
SQYDLLIEVGRCFKIFNNKCLNETHSVH

SEQ ID NO: 2474224 - protein, 26 aa, Entamoeba dispar
SRAFCIKTKGSFVLPGISQEYEIEDS

SEQ ID NO: 2474225 - protein, 18 aa, Entamoeba dispar
SREIKLASIVGVTCASST

SEQ ID NO: 2474226 - protein, 21 aa, Entamoeba dispar
SRIPEFEKLLGQYGNDINNVY

SEQ ID NO: 2474227 - protein, 19 aa, Entamoeba dispar
SRNPLLASLQLQIDNKPYP

SEQ ID NO: 2474228 - protein, 17 aa, Entamoeba dispar
SRRFFPNIETFHIYNKN

SEQ ID NO: 2474229 - protein, 21 aa, Entamoeba dispar
SRSIKGCKLRSVNIVYTPASN

SEQ ID NO: 2474230 - protein, 25 aa, Entamoeba dispar
SRVLVSTDLCGRGIDVAKVNLVVNF

SEQ ID NO: 2474231 - protein, 25 aa, Entamoeba dispar
SRYMKEYKDQLVIVQWIARDQKIGN

SEQ ID NO: 2474232 - protein, 17 aa, Entamoeba dispar
SSAIGILATDGILLAAK

SEQ ID NO: 2474233 - protein, 20 aa, Entamoeba dispar
SSEEFAARFVGEVATPEIRW

SEQ ID NO: 2474234 - protein, 17 aa, Entamoeba dispar
SSITKLGNYCFCQCTSL

SEQ ID NO: 2474235 - protein, 24 aa, Entamoeba dispar
SSNFRICALDPAPIITPGESSMVI

SEQ ID NO: 2474236 - protein, 23 aa, Entamoeba dispar
SSTEIPCNLNFDKIQHHHITSQH

SEQ ID NO: 2474237 - protein, 17 aa, Entamoeba dispar
SSVISIGYWCFYECSSL

SEQ ID NO: 2474238 - protein, 18 aa, Entamoeba dispar
STDFKARIFNAFNKTIDP

SEQ ID NO: 2474239 - protein, 19 aa, Entamoeba dispar
STISKLGNYCFSYCSSITT

SEQ ID NO: 2474240 - protein, 20 aa, Entamoeba dispar
STLESLKFEDCVVSDLEDSS

SEQ ID NO: 2474241 - protein, 17 aa, Entamoeba dispar
STQMCSFSGAPELPPCP

SEQ ID NO: 2474242 - protein, 17 aa, Entamoeba dispar
STTSYLFVQDIRTNGII

SEQ ID NO: 2474243 - protein, 18 aa, Entamoeba dispar
STVSDLLLLQPPSYITNN

SEQ ID NO: 2474244 - protein, 25 aa, Entamoeba dispar
SVCKCDVSTNKCCKSTQVQNGNYCN

SEQ ID NO: 2474245 - protein, 22 aa, Entamoeba dispar
SVMPEDFLKPELQDLAIYADSY

SEQ ID NO: 2474246 - protein, 24 aa, Entamoeba dispar
SVPPRYEQRIELIKSCQIALWDVC

SEQ ID NO: 2474247 - protein, 25 aa, Entamoeba dispar
SVVELWKKQEIIDGFVDLDGMSVGE

SEQ ID NO: 2474248 - protein, 19 aa, Entamoeba dispar
SWKDTRTGQTVSHDSVISL

SEQ ID NO: 2474249 - protein, 26 aa, Entamoeba dispar
SYFYIMRNCNMLRFLDSNNTAMFAST

SEQ ID NO: 2474250 - protein, 17 aa, Entamoeba dispar
SYLGLSPRISRLSRSNS

SEQ ID NO: 2474251 - protein, 23 aa, Entamoeba dispar
SYSMWKSNITVFSTSLKEQRSYQ

SEQ ID NO: 2474252 - protein, 18 aa, Entamoeba dispar
SYTQECLVWKYSYETAAL

SEQ ID NO: 2474253 - protein, 17 aa, Entamoeba dispar
TAIAVCLCKEGKGMIRV

SEQ ID NO: 2474254 - protein, 24 aa, Entamoeba dispar
TCEVLGIQCSFAMLGKLEHIEKQW

SEQ ID NO: 2474255 - protein, 34 aa, Entamoeba dispar
TCQTLVFNLTWSWVVSLRGLRKSTLDVIPIPNAN

SEQ ID NO: 2474256 - protein, 21 aa, Entamoeba dispar
TDDALLCYCESLLCYGQLILR

SEQ ID NO: 2474257 - protein, 23 aa, Entamoeba dispar
TDHKMYIFQFMFIPNTDSYSTKK

SEQ ID NO: 2474258 - protein, 21 aa, Entamoeba dispar
TEIPNKIRIKFMLDGAKGISY

SEQ ID NO: 2474259 - protein, 24 aa, Entamoeba dispar
TEQFFKVFLYPIIRHSIHQNKKLH

SEQ ID NO: 2474260 - protein, 17 aa, Entamoeba dispar
TETILFSQIAQHRYFVD

SEQ ID NO: 2474261 - protein, 22 aa, Entamoeba dispar
TEYCTYLKRMEEMNNEQNENIK

SEQ ID NO: 2474262 - protein, 23 aa, Entamoeba dispar
TEYCTYLKRMEEMNNKQNENIKK

SEQ ID NO: 2474263 - protein, 23 aa, Entamoeba dispar
TFAPKLFNKWSYDVTVSDISLKE

SEQ ID NO: 2474264 - protein, 19 aa, Entamoeba dispar
TFDSCISLSSIHFPNKLER

SEQ ID NO: 2474265 - protein, 23 aa, Entamoeba dispar
TFMGNEFGHPEWLDFPREGNGDS

SEQ ID NO: 2474266 - protein, 17 aa, Entamoeba dispar
TFSLNGCTLRIQDITKL

SEQ ID NO: 2474267 - protein, 25 aa, Entamoeba dispar
TFYRVNNAFYLRPYLYEKKGKTWDD

SEQ ID NO: 2474268 - protein, 17 aa, Entamoeba dispar
TGDLLLKEFEDISKRET

SEQ ID NO: 2474269 - protein, 25 aa, Entamoeba dispar
TGQIPWRSPDIFYKKNQLFLDVIES

SEQ ID NO: 2474270 - protein, 23 aa, Entamoeba dispar
TGSGCLSAAFGSRLQFGNEHGKG

SEQ ID NO: 2474271 - protein, 30 aa, Entamoeba dispar; identical to SEQ ID NO: 2379832

SEQ ID NO: 2474272 - protein, 29 aa, Entamoeba dispar
TIDQCKRCKKFLAGTTWFYCEPESRELMT

SEQ ID NO: 2474273 - protein, 19 aa, Entamoeba dispar
TIEAFRIVSHNILKHGITP

SEQ ID NO: 2474274 - protein, 24 aa, Entamoeba dispar
TIEEVIKYAKFISGTVAQQPPYPK

SEQ ID NO: 2474275 - protein, 23 aa, Entamoeba dispar
TIMKDPYIIYAILDLIHSHYQIL

SEQ ID NO: 2474276 - protein, 22 aa, Entamoeba dispar
TIPVSEDMLGRVFNGSGKPVDK

SEQ ID NO: 2474277 - protein, 28 aa, Entamoeba dispar
TKDELEVIRRACDVLGSGIEESSINQEE

SEQ ID NO: 2474278 - protein, 18 aa, Entamoeba dispar
TKHIQEFKTSTEYSTTAC

SEQ ID NO: 2474279 - protein, 24 aa, Entamoeba dispar
TKIEIWKKQMFVISISNKQNTLTN

SEQ ID NO: 2474280 - protein, 20 aa, Entamoeba dispar
TKKYECINYLNGSSTIPSTV

SEQ ID NO: 2474281 - protein, 19 aa, Entamoeba dispar
TKLCVLILRSLKMLHPEME

SEQ ID NO: 2474282 - protein, 30 aa, Entamoeba dispar
TKNEFNSFALWCRSRHLSIQATLLAIELKA

SEQ ID NO: 2474283 - protein, 21 aa, Entamoeba dispar
TKQSFWYSRVNSYTSRTGDIS

SEQ ID NO: 2474284 - protein, 21 aa, Entamoeba dispar
TKQTFWYSRVNSYTSRTGDIS

SEQ ID NO: 2474285 - protein, 24 aa, Entamoeba dispar
TLAKILAPNLCWSKDEGITGNIYT

SEQ ID NO: 2474286 - protein, 23 aa, Entamoeba dispar
TLSPNCPIINQFIHNINRNHLKE

SEQ ID NO: 2474287 - protein, 18 aa, Entamoeba dispar
TMKLLIKLCEAVHLKEKI

SEQ ID NO: 2474288 - protein, 25 aa, Entamoeba dispar
TMTKIGLPVPQGFVITTEMCKQFIA

SEQ ID NO: 2474289 - protein, 18 aa, Entamoeba dispar
TNQCKIRDGVAVNIAKCS

SEQ ID NO: 2474290 - protein, 17 aa, Entamoeba dispar
TPAFKYFIHELVKITFY

SEQ ID NO: 2474291 - protein, 20 aa, Entamoeba dispar
TPEIRWNSSMRNYLIDNISQ

SEQ ID NO: 2474292 - protein, 24 aa, Entamoeba dispar
TPKRLRMANLAIICSHTVNGVAAI

SEQ ID NO: 2474293 - protein, 25 aa, Entamoeba dispar
TPLGKRFEMILKYLFPVPKSDSKRV

SEQ ID NO: 2474294 - protein, 31 aa, Entamoeba dispar
TQLKVELHLEWKRLACEVVNIPTGSFFSKSR

SEQ ID NO: 2474295 - protein, 17 aa, Entamoeba dispar
TQQPCYCYLCQKSKMFE

SEQ ID NO: 2474296 - protein, 26 aa, Entamoeba dispar
TREGLEWKGSERKDVAYGIKKLTIIC

SEQ ID NO: 2474297 - protein, 19 aa, Entamoeba dispar
TRNVLKQFLEQVIRDSVTY

SEQ ID NO: 2474298 - protein, 20 aa, Entamoeba dispar
TRPAIETVKKIVLYFESLSR

SEQ ID NO: 2474299 - protein, 20 aa, Entamoeba dispar
TRQTFWYSRVNSYTSRTGDI

SEQ ID NO: 2474300 - protein, 35 aa, Entamoeba dispar; identical to SEQ ID NO: 2391332

SEQ ID NO: 2474301 - protein, 23 aa, Entamoeba dispar
TSENYISLIRLIRENTKYKEETK

SEQ ID NO: 2474302 - protein, 17 aa, Entamoeba dispar
TSFPYSTTFDWGNIVER

SEQ ID NO: 2474303 - protein, 24 aa, Entamoeba dispar
TSILYKLKLGEIVTTIPTIGFNVE

SEQ ID NO: 2474304 - protein, 26 aa, Entamoeba dispar
TTRNEIVETYSFLRWSISDGTTNYSE

SEQ ID NO: 2474305 - protein, 25 aa, Entamoeba dispar
TYGIKCLKSGMSMICKRNEVDGVRL

SEQ ID NO: 2474306 - protein, 25 aa, Entamoeba dispar
TYGKRRVNLFLLRWKNNNHYIIDDV

SEQ ID NO: 2474307 - protein, 21 aa, Entamoeba dispar
TYIDRTICMTKFLKKQDKELE

SEQ ID NO: 2474308 - protein, 24 aa, Entamoeba dispar
VAEFFRYFLDECYSYLQNILSTTS

SEQ ID NO: 2474309 - protein, 18 aa, Entamoeba dispar
VCAKQASIIKEMGFSESI

SEQ ID NO: 2474310 - protein, 17 aa, Entamoeba dispar
VDATFTSPCFLKPLELG

SEQ ID NO: 2474311 - protein, 24 aa, Entamoeba dispar
VDIDLCVSRGFVGFNGLAEKKQNQ

SEQ ID NO: 2474312 - protein, 18 aa, Entamoeba dispar
VDSIFFIEITDIENQGEI

SEQ ID NO: 2474313 - protein, 21 aa, Entamoeba dispar
VDYPFKAPRVTFMTKVYHPNI

SEQ ID NO: 2474314 - protein, 25 aa, Entamoeba dispar
VEASLECITCFSIDEEIRIDMYNRN

SEQ ID NO: 2474315 - protein, 23 aa, Entamoeba dispar
VECEGCRLYYPMCYKEEHQKECL

SEQ ID NO: 2474316 - protein, 17 aa, Entamoeba dispar
VEHWPINPLDGIIEYIK

SEQ ID NO: 2474317 - protein, 22 aa, Entamoeba dispar
VEINIPTSIEWIGDNCFKECTR

SEQ ID NO: 2474318 - protein, 25 aa, Entamoeba dispar
VEKAKIGVCQFCISPPKTNMDGNVV

SEQ ID NO: 2474319 - protein, 18 aa, Entamoeba dispar
VENAARFGIKELCKKVGL

SEQ ID NO: 2474320 - protein, 24 aa, Entamoeba dispar
VESLRPALFEGWGKKQGGSVKTWK

SEQ ID NO: 2474321 - protein, 21 aa, Entamoeba dispar
VEYGLPIVIKDGAWIGAGATI

SEQ ID NO: 2474322 - protein, 19 aa, Entamoeba dispar
VFKELNWRREKLLKKAKKA

SEQ ID NO: 2474323 - protein, 18 aa, Entamoeba dispar
VFLVKDIASSACKMLQKY

SEQ ID NO: 2474324 - protein, 17 aa, Entamoeba dispar
VGEVMRIAVTKGRQTRP

SEQ ID NO: 2474325 - protein, 17 aa, Entamoeba dispar
VGKLGFPLVSDIKRCIS

SEQ ID NO: 2474326 - protein, 29 aa, Entamoeba dispar
VGKLPRVFKLLPSFEEWIPLLQMTNPSQW

SEQ ID NO: 2474327 - protein, 18 aa, Entamoeba dispar
VGMKEIETLISILIRKRS

SEQ ID NO: 2474328 - protein, 23 aa, Entamoeba dispar
VGRNGCGKTTFLKLLIDALTPVE

SEQ ID NO: 2474329 - protein, 18 aa, Entamoeba dispar
VGVTSDFPLHTFMRKWLK

SEQ ID NO: 2474330 - protein, 22 aa, Entamoeba dispar
VIEAKKALFCFIAEDCDNDKYT

SEQ ID NO: 2474331 - protein, 25 aa, Entamoeba dispar
VIEMGKSCFYGCGCEEELRQMEGIP

SEQ ID NO: 2474332 - protein, 23 aa, Entamoeba dispar
VIFSGGVEGIVKMWKINIPSSFK

SEQ ID NO: 2474333 - protein, 24 aa, Entamoeba dispar
VIWERHLSEALSIFCDGDESLTIE

SEQ ID NO: 2474334 - protein, 24 aa, Entamoeba dispar
VIWERHLSEALSIFCENDESLTDE

SEQ ID NO: 2474335 - protein, 23 aa, Entamoeba dispar
VIYSRWVPHNSKVLKIKFNKDNT

SEQ ID NO: 2474336 - protein, 19 aa, Entamoeba dispar
VKEFLKKEMDIRSEKIKEI

SEQ ID NO: 2474337 - protein, 24 aa, Entamoeba dispar
VKESKIPIILFIDEIHTVLGAGAT

SEQ ID NO: 2474338 - protein, 17 aa, Entamoeba dispar
VKSAQFILKLLKNAVDN

SEQ ID NO: 2474339 - protein, 23 aa, Entamoeba dispar
VKSPISIICCDTIILTQYNNQIK

SEQ ID NO: 2474340 - protein, 21 aa, Entamoeba dispar
VKSPISIIWCDTIILTQYNNQ

SEQ ID NO: 2474341 - protein, 23 aa, Entamoeba dispar
VKYCLALNHLFDFSKGGEITKDH

SEQ ID NO: 2474342 - protein, 25 aa, Entamoeba dispar
VKYFASCGLYCLVQPNTPYEIIYEY

SEQ ID NO: 2474343 - protein, 28 aa, Entamoeba dispar
VLGYYYKGCQSWDWYYPYLYAPFAEDMG

SEQ ID NO: 2474344 - protein, 18 aa, Entamoeba dispar
VLKKERCKNCGSSEHTTK

SEQ ID NO: 2474345 - protein, 17 aa, Entamoeba dispar
VLQYFIDKLNCYYLNVS

SEQ ID NO: 2474346 - protein, 19 aa, Entamoeba dispar
VLTHNKCIIDSFDRPNEYD

SEQ ID NO: 2474347 - protein, 19 aa, Entamoeba dispar
VMEIIKTSLDYAIERIEKT

SEQ ID NO: 2474348 - protein, 26 aa, Entamoeba dispar
VMQTPECLRVYVSSFWDQPFKESLFT

SEQ ID NO: 2474349 - protein, 18 aa, Entamoeba dispar
VMSRRRGKIISEEQRPGT

SEQ ID NO: 2474350 - protein, 18 aa, Entamoeba dispar
VMVDLFLHRELDAKKDAP

SEQ ID NO: 2474351 - protein, 26 aa, Entamoeba dispar
VNATKEVVNQIALKSSYTNTTLKTKH

SEQ ID NO: 2474352 - protein, 26 aa, Entamoeba dispar
VNEYIRFAFKLFIKIYYKDTWTDDDI

SEQ ID NO: 2474353 - protein, 17 aa, Entamoeba dispar
VNFDMKNALLLIRKNVL

SEQ ID NO: 2474354 - protein, 24 aa, Entamoeba dispar
VNLWDMRYQRCLMMKKEEVREVAL

SEQ ID NO: 2474355 - protein, 23 aa, Entamoeba dispar
VPEDAKYWHNFKHNSEKKKINYP

SEQ ID NO: 2474356 - protein, 18 aa, Entamoeba dispar
VPEDAKYWQNFKHNSEKK

SEQ ID NO: 2474357 - protein, 22 aa, Entamoeba dispar
VPEPYYLFNRFVLFNRELIGIK

SEQ ID NO: 2474358 - protein, 23 aa, Entamoeba dispar
VPHEGSFCDLMWSDPEENEKGMR

SEQ ID NO: 2474359 - protein, 19 aa, Entamoeba dispar
VPKNAALCKTRCTAGSAKY

SEQ ID NO: 2474360 - protein, 17 aa, Entamoeba dispar
VPLKEAEEIYIVSMKDY

SEQ ID NO: 2474361 - protein, 19 aa, Entamoeba dispar
VPLKEAEEIYIVSMKDYIF

SEQ ID NO: 2474362 - protein, 18 aa, Entamoeba dispar
VPSNLQCRVIGLDMGALI

SEQ ID NO: 2474363 - protein, 19 aa, Entamoeba dispar
VPYQYLRFFLNDDQQLEKI

SEQ ID NO: 2474364 - protein, 20 aa, Entamoeba dispar
VQFYRYGVRPYVPYDRYYKN

SEQ ID NO: 2474365 - protein, 22 aa, Entamoeba dispar
VQKTFLMRVLKSVYVDEGSNEV

SEQ ID NO: 2474366 - protein, 21 aa, Entamoeba dispar
VRRCPERLYKISANDIPLIEI

SEQ ID NO: 2474367 - protein, 21 aa, Entamoeba dispar
VSDYKRLNVALTRAKCGLIVI

SEQ ID NO: 2474368 - protein, 19 aa, Entamoeba dispar
VSKYFPCVENQNSITLKRI

SEQ ID NO: 2474369 - protein, 17 aa, Entamoeba dispar
VSNILRGKVRFPNDIKI

SEQ ID NO: 2474370 - protein, 25 aa, Entamoeba dispar
VSQHLNEWIDLIFGYKQRGKNAEEA

SEQ ID NO: 2474371 - protein, 19 aa, Entamoeba dispar
VSVLVRGANRLVLDEAERS

SEQ ID NO: 2474372 - protein, 19 aa, Entamoeba dispar
VSYCKICMDKEKGISRGTG

SEQ ID NO: 2474373 - protein, 17 aa, Entamoeba dispar
VTALCTIQYSDVIFSGG

SEQ ID NO: 2474374 - protein, 19 aa, Entamoeba dispar
VTFNQVKGIFGFQPHDNLG

SEQ ID NO: 2474375 - protein, 25 aa, Entamoeba dispar
VTRSMLNHRIDLWKQEANKDAFIPY

SEQ ID NO: 2474376 - protein, 24 aa, Entamoeba dispar
VTSSYYRSCHGVFLVYAQDDKTSF

SEQ ID NO: 2474377 - protein, 18 aa, Entamoeba dispar
VVANVFKKFLREMKEKVF

SEQ ID NO: 2474378 - protein, 24 aa, Entamoeba dispar
VVCPSINGGLIYCIGVLPKPIKCK

SEQ ID NO: 2474379 - protein, 33 aa, Entamoeba dispar
VVDLMKYNGGYNWWKRNSLTVFIDKKLYKDPEE

SEQ ID NO: 2474380 - protein, 18 aa, Entamoeba dispar
VVEFWKYWMDSTPQSDAL

SEQ ID NO: 2474381 - protein, 24 aa, Entamoeba dispar
VVEKTGYQSYPWVRYMTFAGDYCF

SEQ ID NO: 2474382 - protein, 27 aa, Entamoeba dispar
VVQMIFKRLFRVYAHIYLHHLNQITQL

SEQ ID NO: 2474383 - protein, 18 aa, Entamoeba dispar
VVVPGVKGVKGFEHEKAT

SEQ ID NO: 2474384 - protein, 18 aa, Entamoeba dispar
VYLSIIFLLLKQAIENGC

SEQ ID NO: 2474385 - protein, 18 aa, Entamoeba dispar
VYSGMVLSYYLPIHCGIK

SEQ ID NO: 2474386 - protein, 19 aa, Entamoeba dispar
VYYMSIEYLIGRSLMNSIC

SEQ ID NO: 2474387 - protein, 23 aa, Entamoeba dispar
WDVDEARKIWCFGPDNCGPNLFV

SEQ ID NO: 2474388 - protein, 22 aa, Entamoeba dispar
WEPRTCSTFRDISFGSPCNCIA

SEQ ID NO: 2474389 - protein, 23 aa, Entamoeba dispar
WFKEYNIPSANDFAILNLITAGK

SEQ ID NO: 2474390 - protein, 29 aa, Entamoeba dispar
WFYCEPESRELMTYLIKRIKGLNKLKLIN

SEQ ID NO: 2474391 - protein, 25 aa, Entamoeba dispar
WHAPKRFPHIYPFNIDNQYAKEFII

SEQ ID NO: 2474392 - protein, 18 aa, Entamoeba dispar
WIMHDVILIEKDGQKKMH

SEQ ID NO: 2474393 - protein, 17 aa, Entamoeba dispar
WKDVNDFVHKETHNKDV

SEQ ID NO: 2474394 - protein, 20 aa, Entamoeba dispar
WKGPAVKRMVMVKANQFVQQ

SEQ ID NO: 2474395 - protein, 19 aa, Entamoeba dispar
WKKKLYITTEHPLPSELIR

SEQ ID NO: 2474396 - protein, 23 aa, Entamoeba dispar
WKRRWVVLCRGFLFYYNNPKDEI

SEQ ID NO: 2474397 - protein, 18 aa, Entamoeba dispar
WMKEYLMMKGNKKEHNSE

SEQ ID NO: 2474398 - protein, 20 aa, Entamoeba dispar
WRKMKSQTEEVKRLQEQIIK

SEQ ID NO: 2474399 - protein, 18 aa, Entamoeba dispar
WRNYKKQKVVLLDDIDKD

SEQ ID NO: 2474400 - protein, 21 aa, Entamoeba dispar
WTTKCIRCVARMGKFSSDRSI

SEQ ID NO: 2474401 - protein, 18 aa, Entamoeba dispar
WVIGKSVVRGRDWKWKDQ

SEQ ID NO: 2474402 - protein, 20 aa, Entamoeba dispar
WVRVGCICMVVANRRLNTFV

SEQ ID NO: 2474403 - protein, 24 aa, Entamoeba dispar
YAKEFYPKGAAIVMPKDNNTYTII

SEQ ID NO: 2474404 - protein, 17 aa, Entamoeba dispar
YASEEVIGIIIQNMKKG

SEQ ID NO: 2474405 - protein, 24 aa, Entamoeba dispar
YCDAQCVKYGLAMIEGGTTGTKGN

SEQ ID NO: 2474406 - protein, 17 aa, Entamoeba dispar
YCFYECTSLESINIPSS

SEQ ID NO: 2474407 - protein, 22 aa, Entamoeba dispar
YCKKECCCPRIKAFKKFMNTFE

SEQ ID NO: 2474408 - protein, 17 aa, Entamoeba dispar
YCRDFSRICPKEIKEIS

SEQ ID NO: 2474409 - protein, 22 aa, Entamoeba dispar
YDDASCGMGLIFGTGTNGCYIE

SEQ ID NO: 2474410 - protein, 19 aa, Entamoeba dispar
YDKCIRIYNEWCGYARDCY

SEQ ID NO: 2474411 - protein, 24 aa, Entamoeba dispar
YDPMKRWTPSQALCHPFLTGQQFT

SEQ ID NO: 2474412 - protein, 25 aa, Entamoeba dispar
YDTKSGISSFVIKWISKASAAQRAG

SEQ ID NO: 2474413 - protein, 19 aa, Entamoeba dispar
YEKDYPFGSWRRGKTTLKL

SEQ ID NO: 2474414 - protein, 26 aa, Entamoeba dispar
YEMDNRPASALPFKISAAKLDALSGQ

SEQ ID NO: 2474415 - protein, 18 aa, Entamoeba dispar
YEVNRVLWVGGLNNNEMK

SEQ ID NO: 2474416 - protein, 22 aa, Entamoeba dispar
YFADRKIFCAGRVEEDDMKRVC

SEQ ID NO: 2474417 - protein, 18 aa, Entamoeba dispar
YFIFQCIHPNKFYDDPFV

SEQ ID NO: 2474418 - protein, 23 aa, Entamoeba dispar
YFIFQCIHPNKFYDDPFVMLNYN

SEQ ID NO: 2474419 - protein, 17 aa, Entamoeba dispar
YFLTEHWAPLKNILRRY

SEQ ID NO: 2474420 - protein, 29 aa, Entamoeba dispar
YGCTVSLFTHWLPRFGIEVDLVDTSDVEK

SEQ ID NO: 2474421 - protein, 18 aa, Entamoeba dispar
YGDNPVTETILFSQIAQH

SEQ ID NO: 2474422 - protein, 26 aa, Entamoeba dispar
YGGVLSVEAFNHFLWCQSSESVSDLV

SEQ ID NO: 2474423 - protein, 23 aa, Entamoeba dispar
YGNKLILGLLYTLYRIYRMNPVD

SEQ ID NO: 2474424 - protein, 18 aa, Entamoeba dispar
YGYENLPVDTFMTLGSLA

SEQ ID NO: 2474425 - protein, 19 aa, Entamoeba dispar
YHRLFYPIIDRIMEVFQPS

SEQ ID NO: 2474426 - protein, 35 aa, Entamoeba dispar
YILSEFWMCGLIQYETPILCFWNNDKTLAIHLFSS

SEQ ID NO: 2474427 - protein, 24 aa, Entamoeba dispar
YINKVELIKVFGKVIVDSLLDYKE

SEQ ID NO: 2474428 - protein, 28 aa, Entamoeba dispar
YIQQEGRIKARWMRKNARRIDMEQYTKT

SEQ ID NO: 2474429 - protein, 17 aa, Entamoeba dispar
YIRCKKVKNGGEVIYGE

SEQ ID NO: 2474430 - protein, 29 aa, Entamoeba dispar
YISSILSRSIMNWDLKGMFYLINNNDYEY

SEQ ID NO: 2474431 - protein, 31 aa, Entamoeba dispar
YISSILSRSIMNWDLKGMFYLINNNDYEYIN

SEQ ID NO: 2474432 - protein, 22 aa, Entamoeba dispar
YKGNIIMPLGIWDEYFILELNL

SEQ ID NO: 2474433 - protein, 17 aa, Entamoeba dispar
YKIAEGLPVRRAVGSVM

SEQ ID NO: 2474434 - protein, 24 aa, Entamoeba dispar
YKIVKGRNGEGWIHINGKTYSPTE

SEQ ID NO: 2474435 - protein, 18 aa, Entamoeba dispar
YKKQHIFISGSISVGKTM

SEQ ID NO: 2474436 - protein, 20 aa, Entamoeba dispar
YKNREIFGAIIPLEAKSLGH

SEQ ID NO: 2474437 - protein, 18 aa, Entamoeba dispar
YKSNVKFYDDDKVTHLQF

SEQ ID NO: 2474438 - protein, 24 aa, Entamoeba dispar
YKVFQEMKKSVIIINMARGPIVVN

SEQ ID NO: 2474439 - protein, 26 aa, Entamoeba dispar
YLIMKRKRIEINKVLHEVASRYMKEY

SEQ ID NO: 2474440 - protein, 19 aa, Entamoeba dispar
YLNLVKKLNGLVIEYNKKT

SEQ ID NO: 2474441 - protein, 19 aa, Entamoeba dispar
YLPPIGIDYKTKFYIIDNK

SEQ ID NO: 2474442 - protein, 21 aa, Entamoeba dispar
YLQFRAIHGSYVFTKGKVYKI

SEQ ID NO: 2474443 - protein, 17 aa, Entamoeba dispar
YLYKKIQSISSTPILQI

SEQ ID NO: 2474444 - protein, 38 aa, Entamoeba dispar
YMAPELYRRLPYGNKIDCWSCGVVIYSLLYGTFPFAGE

SEQ ID NO: 2474445 - protein, 18 aa, Entamoeba dispar
YMIKKKYYDSFLFTPENI

SEQ ID NO: 2474446 - protein, 18 aa, Entamoeba dispar
YMNNVSKFDSVWAQEHSR

SEQ ID NO: 2474447 - protein, 17 aa, Entamoeba dispar
YMYLTLWGDEISNQTQF

SEQ ID NO: 2474448 - protein, 18 aa, Entamoeba dispar
YNEHIPIIIVCNKNDLED

SEQ ID NO: 2474449 - protein, 26 aa, Entamoeba dispar
YNFIKLCKIEYYLHCIIYRVIKDYAI

SEQ ID NO: 2474450 - protein, 17 aa, Entamoeba dispar
YNGPLVILPEANVIEVF

SEQ ID NO: 2474451 - protein, 25 aa, Entamoeba dispar
YNHKLKNFYLLHGLYCQLLETALQD

SEQ ID NO: 2474452 - protein, 28 aa, Entamoeba dispar
YNVLRVGGKICCFCPCIEQIQKSSQELR

SEQ ID NO: 2474453 - protein, 24 aa, Entamoeba dispar
YNYEHNSVFWAIKFYHTDTKTSRK

SEQ ID NO: 2474454 - protein, 29 aa, Entamoeba dispar
YPCQCSALRKGGYVVIKGRPCKVFEMSTS

SEQ ID NO: 2474455 - protein, 23 aa, Entamoeba dispar
YPLHPRLGKILYLTQKKGIEEIG

SEQ ID NO: 2474456 - protein, 26 aa, Entamoeba dispar
YPLQMLTSLWIKRMKSLDLLLLNEMK

SEQ ID NO: 2474457 - protein, 28 aa, Entamoeba dispar
YQIKPFRKIQCPIVERLVCCMMQHGKNS

SEQ ID NO: 2474458 - protein, 18 aa, Entamoeba dispar
YQNLCASTLYYWIRADER

SEQ ID NO: 2474459 - protein, 17 aa, Entamoeba dispar
YRAGCYNNCNFDVFLLC

SEQ ID NO: 2474460 - protein, 17 aa, Entamoeba dispar
YRFGGRPYVPYTPLAGS

SEQ ID NO: 2474461 - protein, 24 aa, Entamoeba dispar
YRSPFSNKYFPAFPEGGLPSDELR

SEQ ID NO: 2474462 - protein, 18 aa, Entamoeba dispar
YRSSEPFLKNIDNRQPSD

SEQ ID NO: 2474463 - protein, 19 aa, Entamoeba dispar
YSESVQCHFIESSAKRNEN

SEQ ID NO: 2474464 - protein, 17 aa, Entamoeba dispar
YSHARVTSIPTILVLNP

SEQ ID NO: 2474465 - protein, 21 aa, Entamoeba dispar
YSHARVTSIPTILVLNPGSWK

SEQ ID NO: 2474466 - protein, 23 aa, Entamoeba dispar
YTKEVSIAYGIEPNRCSSMFDTL

SEQ ID NO: 2474467 - protein, 24 aa, Entamoeba dispar
YTSDEIKILLSIAKCYLAKSPASF

SEQ ID NO: 2474468 - protein, 20 aa, Entamoeba dispar
YTSITRARFEEINIDLFKST

SEQ ID NO: 2474469 - protein, 20 aa, Entamoeba dispar
YVIVGEVAVGKSCLLLQFQD

SEQ ID NO: 2474470 - protein, 23 aa, Entamoeba dispar
YVLLCGYPPFFGDTLGEILSAVC

SEQ ID NO: 2474471 - protein, 19 aa, Entamoeba dispar
YVSCSSYRIPVARIAAAQA

SEQ ID NO: 2474472 - protein, 24 aa, Entamoeba dispar
YYCFRNVSYQFGRLINKINTIINE

SEQ ID NO: 2474473 - protein, 17 aa, Entamoeba dispar
YYNSAGRYVSRQYDKQP

SEQ ID NO: 2474474 - protein, 25 aa, Entamoeba dispar
AAAAFDYKCCLCVGLHSDKTITTQK

SEQ ID NO: 2474475 - protein, 18 aa, Entamoeba dispar
AAAFEYRLTGKIENLYWR

SEQ ID NO: 2474476 - protein, 18 aa, Entamoeba dispar
AAAIPLPLVKGLLGNYNV

SEQ ID NO: 2474477 - protein, 22 aa, Entamoeba dispar
AAAMCRRLTEDLLVEYINPLLE

SEQ ID NO: 2474478 - protein, 29 aa, Entamoeba dispar
AACERAEKENKWILAYVFKENDLECLTFI

SEQ ID NO: 2474479 - protein, 24 aa, Entamoeba dispar
AACSEDALCFGSLVLVNKDDNSFS

SEQ ID NO: 2474480 - protein, 20 aa, Entamoeba dispar
AADAHFCLCLANAAVHVAMA

SEQ ID NO: 2474481 - protein, 25 aa, Entamoeba dispar
AADFAISSLSLWILFMRDKKEWDIF

SEQ ID NO: 2474482 - protein, 37 aa, Entamoeba dispar
AADFKVAQFSNGKWRSEWTITVGSKVTCEGRIRVQVH

SEQ ID NO: 2474483 - protein, 18 aa, Entamoeba dispar
AADICVNWSGGLHHAKKS

SEQ ID NO: 2474484 - protein, 25 aa, Entamoeba dispar
AADKPFNIKNFYGMMKRKENTDLYS

SEQ ID NO: 2474485 - protein, 37 aa, Entamoeba dispar
AADLKVAQFSNGKWRSEWTISVGSKVTCEGRIRVQVH

SEQ ID NO: 2474486 - protein, 21 aa, Entamoeba dispar
AADNRYGLKYQFASANFHKVF

SEQ ID NO: 2474487 - protein, 27 aa, Entamoeba dispar
AADWQQSDFLWSGRCLVTRSPEHCIVK

SEQ ID NO: 2474488 - protein, 23 aa, Entamoeba dispar
AAEEFSSLISLMIDEFDIIKEWS

SEQ ID NO: 2474489 - protein, 18 aa, Entamoeba dispar
AAELFGVDAESLRKAIIQ

SEQ ID NO: 2474490 - protein, 24 aa, Entamoeba dispar
AAFCCPYEGCTKAFEYPSHLFKHC

SEQ ID NO: 2474491 - protein, 23 aa, Entamoeba dispar
AAFFHEPITFFALLPYAEELECS

SEQ ID NO: 2474492 - protein, 19 aa, Entamoeba dispar
AAFTESFLDGFSVNDSTVT

SEQ ID NO: 2474493 - protein, 24 aa, Entamoeba dispar
AAGCGKSYVLSAIVEKLKHDKEVY

SEQ ID NO: 2474494 - protein, 18 aa, Entamoeba dispar
AAGIADDFLTTTFLAASC

SEQ ID NO: 2474495 - protein, 18 aa, Entamoeba dispar
AAGIYCFQPYCVTGQLEP

SEQ ID NO: 2474496 - protein, 20 aa, Entamoeba dispar
AAGQGLMWWMQRELEEKKKF

SEQ ID NO: 2474497 - protein, 18 aa, Entamoeba dispar
AAHVSMVIIERNLFDLNM

SEQ ID NO: 2474498 - protein, 18 aa, Entamoeba dispar
AAIDLELINGSAISRIAD

SEQ ID NO: 2474499 - protein, 24 aa, Entamoeba dispar
AAIFRMKRTWEVVNQDPNKAEFDR

SEQ ID NO: 2474500 - protein, 17 aa, Entamoeba dispar
AAIKRSGWGRKLKAIQS

SEQ ID NO: 2474501 - protein, 20 aa, Entamoeba dispar
AAIKTLKGQHIGGIDECEMI

SEQ ID NO: 2474502 - protein, 18 aa, Entamoeba dispar
AAIPHALAGRDIIGAART

SEQ ID NO: 2474503 - protein, 18 aa, Entamoeba dispar
AAITFCFDNEALYKIASD

SEQ ID NO: 2474504 - protein, 17 aa, Entamoeba dispar
AAKAFKRLVSLDRTNFG

SEQ ID NO: 2474505 - protein, 24 aa, Entamoeba dispar
AAKALFGLCELHLINANEIDTLGN

SEQ ID NO: 2474506 - protein, 25 aa, Entamoeba dispar
AAKEKSRLGKIFKINNYAFIMNVCM

SEQ ID NO: 2474507 - protein, 23 aa, Entamoeba dispar
AAKIAGISCLRLMNEHTATALAY

SEQ ID NO: 2474508 - protein, 18 aa, Entamoeba dispar
AAKLAVTSSLEFVISSIT

SEQ ID NO: 2474509 - protein, 18 aa, Entamoeba dispar
AAKLPQPILVPLQNEPDP

SEQ ID NO: 2474510 - protein, 18 aa, Entamoeba dispar
AAKSLIYYLRSEEDIKIF

SEQ ID NO: 2474511 - protein, 17 aa, Entamoeba dispar
AALKKGKKTSFFGKKDE

SEQ ID NO: 2474512 - protein, 17 aa, Entamoeba dispar
AALKNLKASSLTITTLK

SEQ ID NO: 2474513 - protein, 22 aa, Entamoeba dispar
AALLCSSQEGFSYVPDVVKIDK

SEQ ID NO: 2474514 - protein, 19 aa, Entamoeba dispar
AALLPSLKTSPIVIKQQTL

SEQ ID NO: 2474515 - protein, 17 aa, Entamoeba dispar
AALRGILVYPEIDIPGH

SEQ ID NO: 2474516 - protein, 17 aa, Entamoeba dispar
AAMNEIPEQYAIMKQLG

SEQ ID NO: 2474517 - protein, 23 aa, Entamoeba dispar
AANINRSLVVFGRVIHGLVQAST

SEQ ID NO: 2474518 - protein, 25 aa, Entamoeba dispar
AAPGKSGICNAMYIGFTYATPDTIP

SEQ ID NO: 2474519 - protein, 24 aa, Entamoeba dispar
AAPICTLALRSLRYLSSLELSAPL

SEQ ID NO: 2474520 - protein, 18 aa, Entamoeba dispar
AAPIKCLIITQEEDGEDE

SEQ ID NO: 2474521 - protein, 17 aa, Entamoeba dispar
AAQATHVNLVIAINYQS

SEQ ID NO: 2474522 - protein, 18 aa, Entamoeba dispar
AARARGGKRTNLSNLVKG

SEQ ID NO: 2474523 - protein, 22 aa, Entamoeba dispar
AARIDCFGEIATNRFGEVMKEQ

SEQ ID NO: 2474524 - protein, 19 aa, Entamoeba dispar
AASNFFLAEGILLPENIKI

SEQ ID NO: 2474525 - protein, 19 aa, Entamoeba dispar
AATFKKFFMDMSEPLFSSE

SEQ ID NO: 2474526 - protein, 22 aa, Entamoeba dispar
AATLCRNKLKQVYGSCHGNITD

SEQ ID NO: 2474527 - protein, 17 aa, Entamoeba dispar
AAVEWRNNREEFKKKVR

SEQ ID NO: 2474528 - protein, 27 aa, Entamoeba dispar
AAVNCPLLKLYQSFCLMIQGNIEKALS

SEQ ID NO: 2474529 - protein, 24 aa, Entamoeba dispar
AAVPRKRTALVLDQTDISVAILEE

SEQ ID NO: 2474530 - protein, 17 aa, Entamoeba dispar
AAVYWLGRMIFSGENPK

SEQ ID NO: 2474531 - protein, 18 aa, Entamoeba dispar
AAWNPDFLLSVLLGNQTA

SEQ ID NO: 2474532 - protein, 18 aa, Entamoeba dispar
AAYLAYLRQIECVSHKVI

SEQ ID NO: 2474533 - protein, 19 aa, Entamoeba dispar
ACAELQPYFKVRDYVVEDL

SEQ ID NO: 2474534 - protein, 17 aa, Entamoeba dispar
ACAKRYLIDYEKETSNY

SEQ ID NO: 2474535 - protein, 23 aa, Entamoeba dispar
ACCLGYAPSCLGFYDPEKVILNR

SEQ ID NO: 2474536 - protein, 20 aa, Entamoeba dispar
ACDCRLRYTQKLSLYNPIDI

SEQ ID NO: 2474537 - protein, 24 aa, Entamoeba dispar
ACEKSYRGLVEMLINKGANVNCCD

SEQ ID NO: 2474538 - protein, 17 aa, Entamoeba dispar
ACFYECGCEEMLKQNKT

SEQ ID NO: 2474539 - protein, 18 aa, Entamoeba dispar
ACIGDNGYCKVCGCHYTQ

SEQ ID NO: 2474540 - protein, 21 aa, Entamoeba dispar
ACIGESYAFGPGVEGGVTIDK

SEQ ID NO: 2474541 - protein, 27 aa, Entamoeba dispar
ACKESLTLECFMHWNYYESKENGIVII

SEQ ID NO: 2474542 - protein, 18 aa, Entamoeba dispar
ACLALGMNRSCLKSAKLG

SEQ ID NO: 2474543 - protein, 25 aa, Entamoeba dispar
ACLCNCGRCQCKIKECKHETCIHKK

SEQ ID NO: 2474544 - protein, 20 aa, Entamoeba dispar
ACLLSLGAHRFVDFLREIAY

SEQ ID NO: 2474545 - protein, 17 aa, Entamoeba dispar
ACLPIMTTMTALYSAIQ

SEQ ID NO: 2474546 - protein, 17 aa, Entamoeba dispar
ACLSSDFIIPFVKCEES

SEQ ID NO: 2474547 - protein, 32 aa, Entamoeba dispar
ACNIKGKIVLDVGCGLGILSLFAARAGAKHVY

SEQ ID NO: 2474548 - protein, 18 aa, Entamoeba dispar
ACNKEFSSHLAFICPYCK

SEQ ID NO: 2474549 - protein, 18 aa, Entamoeba dispar
ACNQCTLLTSIIFSTSLK

SEQ ID NO: 2474550 - protein, 23 aa, Entamoeba dispar
ACPKEFSSMIIKTNLKDCLVQSK

SEQ ID NO: 2474551 - protein, 22 aa, Entamoeba dispar
ACQMSKKMAIGDGIKRAFRLFG

SEQ ID NO: 2474552 - protein, 26 aa, Entamoeba dispar
ACSILYKTKLPLIIVFTKTDVTPCTK

SEQ ID NO: 2474553 - protein, 25 aa, Entamoeba dispar
ACSIRKFSTIYLFNFPETDLSPFIH

SEQ ID NO: 2474554 - protein, 33 aa, Entamoeba dispar
ACSLYPSAIHRLRLPTGYPFLMTKPINWYWERL

SEQ ID NO: 2474555 - protein, 30 aa, Entamoeba dispar
ACSLYPSAVARLFLPSGVPRVMNKPIEWYL

SEQ ID NO: 2474556 - protein, 26 aa, Entamoeba dispar
ACSSFNLPVIISKGILKTLEVEVPWK

SEQ ID NO: 2474557 - protein, 17 aa, Entamoeba dispar
ACSYNLSSHLYNSVVKS

SEQ ID NO: 2474558 - protein, 22 aa, Entamoeba dispar
ACTTKTFNLGWIPELDRFKRSQ

SEQ ID NO: 2474559 - protein, 25 aa, Entamoeba dispar
ACWGKEVWMKNYIIREDGVVEIPVK

SEQ ID NO: 2474560 - protein, 25 aa, Entamoeba dispar
ADAESGRDAMRWLDRALLRTCNKFG

SEQ ID NO: 2474561 - protein, 19 aa, Entamoeba dispar
ADAHFCLCLANAAVHVAMA

SEQ ID NO: 2474562 - protein, 25 aa, Entamoeba dispar
ADALLSILQFLLIRSKIQHPFSIIN

SEQ ID NO: 2474563 - protein, 24 aa, Entamoeba dispar
ADALQFLVTCIRSKYLKIKELSLE

SEQ ID NO: 2474564 - protein, 17 aa, Entamoeba dispar
ADALVGVARDLDKKTSV

SEQ ID NO: 2474565 - protein, 20 aa, Entamoeba dispar
ADCCGLVFDVSNPKSFEQLT

SEQ ID NO: 2474566 - protein, 20 aa, Entamoeba dispar
ADCFYECSLLPFINIPTSIG

SEQ ID NO: 2474567 - protein, 26 aa, Entamoeba dispar
ADDAVLVFDCGSSFIKVGVAGEEQPR

SEQ ID NO: 2474568 - protein, 25 aa, Entamoeba dispar
ADDITKCFCCIPALQCNCDNTLLYA

SEQ ID NO: 2474569 - protein, 26 aa, Entamoeba dispar
ADEELWGVFQECHKVWAKTKEVALAW

SEQ ID NO: 2474570 - protein, 18 aa, Entamoeba dispar
ADEGVCLIDEFDKMDDQD

SEQ ID NO: 2474571 - protein, 24 aa, Entamoeba dispar
ADEIRRYGEFFGMIEENIKKEHDT

SEQ ID NO: 2474572 - protein, 24 aa, Entamoeba dispar
ADEKILKQQFEKFGGITDCKVMRT

SEQ ID NO: 2474573 - protein, 17 aa, Entamoeba dispar
ADEKLAFVKTLLTNFTP

SEQ ID NO: 2474574 - protein, 17 aa, Entamoeba dispar
ADELFKQIPSGVGTKAQ

SEQ ID NO: 2474575 - protein, 19 aa, Entamoeba dispar
ADFIIYRGFGRYVTSIGME

SEQ ID NO: 2474576 - protein, 22 aa, Entamoeba dispar
ADGKKGILPFYVLDQLNQMVQI

SEQ ID NO: 2474577 - protein, 34 aa, Entamoeba dispar
ADGKTYRFYPEKSYCYLIKNADTIRLMDQNNTHM

SEQ ID NO: 2474578 - protein, 21 aa, Entamoeba dispar
ADGTCRYAMFLVSYEKMNESE

SEQ ID NO: 2474579 - protein, 25 aa, Entamoeba dispar
ADIFSLGCVLAYLFLENSLFDVSNI

SEQ ID NO: 2474580 - protein, 18 aa, Entamoeba dispar
ADIIVPWGEIEKAQTPGV

SEQ ID NO: 2474581 - protein, 19 aa, Entamoeba dispar
ADIIVPWGEIEKAQTPGVL

SEQ ID NO: 2474582 - protein, 24 aa, Entamoeba dispar
ADIKAICTEAGLLALRERRMKVNQ

SEQ ID NO: 2474583 - protein, 21 aa, Entamoeba dispar
ADIKLFAKIFRFDLNEEYNEL

SEQ ID NO: 2474584 - protein, 22 aa, Entamoeba dispar
ADILPLKLCVYLFSSISRLIAL

SEQ ID NO: 2474585 - protein, 17 aa, Entamoeba dispar
ADITLFGMNEWETGKPS

SEQ ID NO: 2474586 - protein, 17 aa, Entamoeba dispar
ADITSKVLLKFVKEGPY

SEQ ID NO: 2474587 - protein, 20 aa, Entamoeba dispar
ADIWSIGVILVRMLTGKYPF

SEQ ID NO: 2474588 - protein, 22 aa, Entamoeba dispar
ADIWSLGVVFYVMIFGFMPFPG

SEQ ID NO: 2474589 - protein, 17 aa, Entamoeba dispar
ADKLLVYLIFYIQSLLL

SEQ ID NO: 2474590 - protein, 24 aa, Entamoeba dispar
ADKNNRGFSLFLIDGRKREMYLSG

SEQ ID NO: 2474591 - protein, 24 aa, Entamoeba dispar
ADKRIGIITPRSFKKPTLSKPPEC

SEQ ID NO: 2474592 - protein, 17 aa, Entamoeba dispar
ADKSIQETIRFIESFKG

SEQ ID NO: 2474593 - protein, 19 aa, Entamoeba dispar
ADKVLRPFIQRGKAIHDLI

SEQ ID NO: 2474594 - protein, 28 aa, Entamoeba dispar
ADLAPTHPIRLGLALNFSVFYYEIMNDA

SEQ ID NO: 2474595 - protein, 19 aa, Entamoeba dispar
ADLDHLRLIDGYIHEEQQA

SEQ ID NO: 2474596 - protein, 25 aa, Entamoeba dispar
ADLLFPLCLFLTIKAQLPYFDSTIY

SEQ ID NO: 2474597 - protein, 21 aa, Entamoeba dispar
ADLPDVFVCEKIEKMIQGGVK

SEQ ID NO: 2474598 - protein, 17 aa, Entamoeba dispar
ADLSLKCLNLETAFDAC

SEQ ID NO: 2474599 - protein, 20 aa, Entamoeba dispar
ADLYSLGVILYYMATKEFPF

SEQ ID NO: 2474600 - protein, 17 aa, Entamoeba dispar
ADMTFKILIIGESAVGK

SEQ ID NO: 2474601 - protein, 20 aa, Entamoeba dispar
ADNIKEERIPSILEQLKEQP

SEQ ID NO: 2474602 - protein, 21 aa, Entamoeba dispar
ADNQPGVLIQVFEGEASMTAH

SEQ ID NO: 2474603 - protein, 22 aa, Entamoeba dispar
ADNSGSIGFFEFIALYNWVKLC

SEQ ID NO: 2474604 - protein, 19 aa, Entamoeba dispar
ADNVLPFVYDVFRELNNDK

SEQ ID NO: 2474605 - protein, 20 aa, Entamoeba dispar
ADPEGLICKSFRQFQTNNKL

SEQ ID NO: 2474606 - protein, 22 aa, Entamoeba dispar
ADPKRITFYKADLLNIDEIDQI

SEQ ID NO: 2474607 - protein, 25 aa, Entamoeba dispar
ADPQLGYLCKIGYVDAIICEDSDLI

SEQ ID NO: 2474608 - protein, 21 aa, Entamoeba dispar
ADPVIKIPLMKPVITKMINKI

SEQ ID NO: 2474609 - protein, 22 aa, Entamoeba dispar
ADRRRKIMSISIKRNEYDFLQH

SEQ ID NO: 2474610 - protein, 22 aa, Entamoeba dispar
ADRYPSFLPKFIESSETIYENE

SEQ ID NO: 2474611 - protein, 20 aa, Entamoeba dispar
ADSCFYECMSLTNIMLPSLV

SEQ ID NO: 2474612 - protein, 38 aa, Entamoeba dispar
ADSESGYKFILGMMFSLYRKYCICRSVSDESNNKFKTG

SEQ ID NO: 2474613 - protein, 20 aa, Entamoeba dispar
ADSFSKLALSVHWKNRKCIA

SEQ ID NO: 2474614 - protein, 23 aa, Entamoeba dispar
ADSKKPVPVFSYDPVNSIEKPDV

SEQ ID NO: 2474615 - protein, 23 aa, Entamoeba dispar
ADSKYNIIQGFPINGQPKIIVQK

SEQ ID NO: 2474616 - protein, 20 aa, Entamoeba dispar
ADSVIIWDAIFAYGSSLKLC

SEQ ID NO: 2474617 - protein, 18 aa, Entamoeba dispar
ADSYWGLDSIMSRIQDNY

SEQ ID NO: 2474618 - protein, 23 aa, Entamoeba dispar
ADTFRPLFQYNVDSPQLIIDFFK

SEQ ID NO: 2474619 - protein, 24 aa, Entamoeba dispar
ADVCLRSAAAPSYYRPYQNYVDGG

SEQ ID NO: 2474620 - protein, 18 aa, Entamoeba dispar
ADVGEFYFRVLKSEELLT

SEQ ID NO: 2474621 - protein, 19 aa, Entamoeba dispar
ADVGEFYFRVLKSEELLTE

SEQ ID NO: 2474622 - protein, 17 aa, Entamoeba dispar
ADVIAFGMKEWAEELGA

SEQ ID NO: 2474623 - protein, 17 aa, Entamoeba dispar
ADVMSEFLFALFDCQTD

SEQ ID NO: 2474624 - protein, 25 aa, Entamoeba dispar
ADVPFGVGSVRIAFHGFDMDKKEII

SEQ ID NO: 2474625 - protein, 23 aa, Entamoeba dispar
ADVTRLFYKAAIMENTMLGDEES

SEQ ID NO: 2474626 - protein, 18 aa, Entamoeba dispar
ADVVAFGMKEWAEELGAV

SEQ ID NO: 2474627 - protein, 25 aa, Entamoeba dispar
ADVYLRLPRNLSYQEKIWDHAAGYL

SEQ ID NO: 2474628 - protein, 23 aa, Entamoeba dispar
ADYDSFKAFALNLECRNNSKLNY

SEQ ID NO: 2474629 - protein, 35 aa, Entamoeba dispar
ADYIRNCTLFGGKTRACVLAHLITAGITPKFLGSI

SEQ ID NO: 2474630 - protein, 31 aa, Entamoeba dispar
ADYLHILMFKMCDILAMKAHIIFTILKSKDI

SEQ ID NO: 2474631 - protein, 18 aa, Entamoeba dispar
ADYPAICHSTSIPEDLSE

SEQ ID NO: 2474632 - protein, 21 aa, Entamoeba dispar
AEAAMLLRNCEIMEYSDVEHI

SEQ ID NO: 2474633 - protein, 27 aa, Entamoeba dispar
AEADINWTNRWGRFIGYSDTASITLSS

SEQ ID NO: 2474634 - protein, 27 aa, Entamoeba dispar
AEADISWTNRWGRFIGYSDTASITLSS

SEQ ID NO: 2474635 - protein, 23 aa, Entamoeba dispar
AEAIFTKTIQGFVDFSLKVVSRQ

SEQ ID NO: 2474636 - protein, 20 aa, Entamoeba dispar
AEAIIQYKDINQMGIGNIAI

SEQ ID NO: 2474637 - protein, 25 aa, Entamoeba dispar
AEAKEKIRLQRIFKEENVMWLYSNV

SEQ ID NO: 2474638 - protein, 20 aa, Entamoeba dispar
AEALIFCINHKVQLSNHDIT

SEQ ID NO: 2474639 - protein, 18 aa, Entamoeba dispar
AEALRINTVLKEFKFPIS

SEQ ID NO: 2474640 - protein, 21 aa, Entamoeba dispar
AEALYQLKSWKELHALAMKSG

SEQ ID NO: 2474641 - protein, 21 aa, Entamoeba dispar
AEAMIKLLIVYFKSLYSQKEI

SEQ ID NO: 2474642 - protein, 29 aa, Entamoeba dispar
AEANAAYVRFLMKLFRILGRSEVMGVFEY

SEQ ID NO: 2474643 - protein, 21 aa, Entamoeba dispar
AEANIAWKAFYDLMKPQVSFE

SEQ ID NO: 2474644 - protein, 28 aa, Entamoeba dispar
AEAPSEFVFYIPSMKAFCASEEINHIMH

SEQ ID NO: 2474645 - protein, 17 aa, Entamoeba dispar
AECFTCERCGLRFNERR

SEQ ID NO: 2474646 - protein, 19 aa, Entamoeba dispar
AECGKLEPEWISLNLGIVI

SEQ ID NO: 2474647 - protein, 40 aa, Entamoeba dispar
AECRIFKALAKLMIKRYCNNFIYMYQWFKSFVNESEHQGD

SEQ ID NO: 2474648 - protein, 24 aa, Entamoeba dispar
AEDHFRILIIDSVTSLFRVDFSGR

SEQ ID NO: 2474649 - protein, 19 aa, Entamoeba dispar
AEDKYKFFLEATQLDMIKE

SEQ ID NO: 2474650 - protein, 18 aa, Entamoeba dispar
AEDLFKYILEGYYETGDK

SEQ ID NO: 2474651 - protein, 20 aa, Entamoeba dispar
AEDTRAFFLELYDSLLKDEK

SEQ ID NO: 2474652 - protein, 22 aa, Entamoeba dispar
AEEELRKAFTLSKKKGTKKGSS

SEQ ID NO: 2474653 - protein, 18 aa, Entamoeba dispar
AEEFNRCVGSYKNILFVI

SEQ ID NO: 2474654 - protein, 19 aa, Entamoeba dispar
AEEGPTHFIALGKIGYKNA

SEQ ID NO: 2474655 - protein, 24 aa, Entamoeba dispar
AEEHKDDIVALLIGPVADDLVDDD

SEQ ID NO: 2474656 - protein, 24 aa, Entamoeba dispar
AEEKITEIPLFFTQEILPESTQQR

SEQ ID NO: 2474657 - protein, 25 aa, Entamoeba dispar
AEELHCLFCEVSALDGTNITHAFTE

SEQ ID NO: 2474658 - protein, 24 aa, Entamoeba dispar
AEELIKVYEWCLGVDEIKTYEMGG

SEQ ID NO: 2474659 - protein, 17 aa, Entamoeba dispar
AEEMGVKLGEEVGYSIR

SEQ ID NO: 2474660 - protein, 29 aa, Entamoeba dispar
AEERRLRGQYPYQWKRKASEMAAYNYRRE

SEQ ID NO: 2474661 - protein, 21 aa, Entamoeba dispar
AEFAEDAWLKLMLSCIGETIA

SEQ ID NO: 2474662 - protein, 25 aa, Entamoeba dispar
AEFRSKRRIPICTYFNQITHGAIYR

SEQ ID NO: 2474663 - protein, 23 aa, Entamoeba dispar
AEGTCAALVKAGKCYATATEDMD

SEQ ID NO: 2474664 - protein, 17 aa, Entamoeba dispar
AEGTGNVVFSVKFEAIV

SEQ ID NO: 2474665 - protein, 17 aa, Entamoeba dispar
AEHALKMDEEIIAVLTR

SEQ ID NO: 2474666 - protein, 26 aa, Entamoeba dispar
AEHPAFKCLYSFREIRNYQSEQESVL

SEQ ID NO: 2474667 - protein, 17 aa, Entamoeba dispar
AEIAGIEVIEFVNEPTA

SEQ ID NO: 2474668 - protein, 28 aa, Entamoeba dispar
AEIASGLWYLHFCKHIIHRDLKLENFLL

SEQ ID NO: 2474669 - protein, 31 aa, Entamoeba dispar
AEIEEGKKVYKRWVVLKSKTMMLFKEKGQAK

SEQ ID NO: 2474670 - protein, 25 aa, Entamoeba dispar
AEIFIQTLLNAFAFVPSEKGNDKYL

SEQ ID NO: 2474671 - protein, 23 aa, Entamoeba dispar
AEINISYQIACLFEENSLSSGSF

SEQ ID NO: 2474672 - protein, 20 aa, Entamoeba dispar
AEINPFFIGSWIDMSQQGGM

SEQ ID NO: 2474673 - protein, 18 aa, Entamoeba dispar
AEIPEWAELNFDARRSLK

SEQ ID NO: 2474674 - protein, 18 aa, Entamoeba dispar
AEISRVIATFILSKLFSE

SEQ ID NO: 2474675 - protein, 20 aa, Entamoeba dispar
AEITFYIKCQIAAFCELLRD

SEQ ID NO: 2474676 - protein, 20 aa, Entamoeba dispar
AEIVIPLLECFVTETMKGTV

SEQ ID NO: 2474677 - protein, 26 aa, Entamoeba dispar
AEKALEFGKSLGLKYHSVEAIHIVSH

SEQ ID NO: 2474678 - protein, 33 aa, Entamoeba dispar
AEKEVRLKKELAICNFYRNFLFMSRKTGFEQME

SEQ ID NO: 2474679 - protein, 24 aa, Entamoeba dispar
AEKGEYHINCKLNRRHIAGSPFKQ

SEQ ID NO: 2474680 - protein, 20 aa, Entamoeba dispar
AEKIGAVGYCECSALTQEGL

SEQ ID NO: 2474681 - protein, 25 aa, Entamoeba dispar
AEKIIKEKSDEIIMVQKELEETNST

SEQ ID NO: 2474682 - protein, 17 aa, Entamoeba dispar
AEKMAIDPFCILHLVHI

SEQ ID NO: 2474683 - protein, 29 aa, Entamoeba dispar
AEKRSPGSYIKILLRSAISSSPYKALEIY

SEQ ID NO: 2474684 - protein, 20 aa, Entamoeba dispar
AEKRYGFSLYQGGVVAGNEV

SEQ ID NO: 2474685 - protein, 21 aa, Entamoeba dispar
AEKTLKEKPLISFDDQKEIDK

SEQ ID NO: 2474686 - protein, 17 aa, Entamoeba dispar
AEKTNPLVLKWLQTSST

SEQ ID NO: 2474687 - protein, 22 aa, Entamoeba dispar
AEKTNPLVLKWLQTSSTFVNIL

SEQ ID NO: 2474688 - protein, 26 aa, Entamoeba dispar
AEKYTEFKRLALLLTNLPTKRLRDIS

SEQ ID NO: 2474689 - protein, 17 aa, Entamoeba dispar
AEKYVNGSIFLQKPPTE

SEQ ID NO: 2474690 - protein, 18 aa, Entamoeba dispar
AELAMKFNDREMVCVENE

SEQ ID NO: 2474691 - protein, 23 aa, Entamoeba dispar
AELGDLPLSVFLMEKPEDIKKVE

SEQ ID NO: 2474692 - protein, 18 aa, Entamoeba dispar
AELGESINWISNITSSSI

SEQ ID NO: 2474693 - protein, 17 aa, Entamoeba dispar
AELHAPFEEHERRRYVM

SEQ ID NO: 2474694 - protein, 21 aa, Entamoeba dispar
AELHFKMAMIYKQHAQYEECF

SEQ ID NO: 2474695 - protein, 24 aa, Entamoeba dispar
AELHSTLKRRSCAVSPGKLDHSTL

SEQ ID NO: 2474696 - protein, 20 aa, Entamoeba dispar
AELIPGVLFIDEIHMLDAEC

SEQ ID NO: 2474697 - protein, 23 aa, Entamoeba dispar
AELKARLAKRKELAESVKITQEE

SEQ ID NO: 2474698 - protein, 26 aa, Entamoeba dispar
AELKKAYKKLALKWHPDRNINNQQEA

SEQ ID NO: 2474699 - protein, 18 aa, Entamoeba dispar
AELLLFFLHCKVDKEVVE

SEQ ID NO: 2474700 - protein, 24 aa, Entamoeba dispar
AELPWEKGSAIVIIRTKYGKTARH

SEQ ID NO: 2474701 - protein, 22 aa, Entamoeba dispar
AELRKSRRERRLEVKRIQGTNS

SEQ ID NO: 2474702 - protein, 19 aa, Entamoeba dispar
AELSHTFGTLAERRRPQKI

SEQ ID NO: 2474703 - protein, 17 aa, Entamoeba dispar
AELTRLQGTYMFNKHRI

SEQ ID NO: 2474704 - protein, 21 aa, Entamoeba dispar
AELVLGIPLFPGNSEFNQLFK

SEQ ID NO: 2474705 - protein, 24 aa, Entamoeba dispar
AEMIGLLDMIICFVTYSSTNSTIC

SEQ ID NO: 2474706 - protein, 17 aa, Entamoeba dispar
AEMKLAPIGVVAKAQMH

SEQ ID NO: 2474707 - protein, 18 aa, Entamoeba dispar
AEMKNKDDVWAFKSKREF

SEQ ID NO: 2474708 - protein, 20 aa, Entamoeba dispar
AEMLNNFIVLYEFKKQQEDN

SEQ ID NO: 2474709 - protein, 21 aa, Entamoeba dispar
AEMNRPVCVVGMMKLFSLSPF

SEQ ID NO: 2474710 - protein, 26 aa, Entamoeba dispar
AEMYCYTCQCVICSVCQRDIHRKHSI

SEQ ID NO: 2474711 - protein, 19 aa, Entamoeba dispar
AENAFELFLSTTEIKYVYY

SEQ ID NO: 2474712 - protein, 21 aa, Entamoeba dispar
AENIATWFELYSWWKDNEDAQ

SEQ ID NO: 2474713 - protein, 20 aa, Entamoeba dispar
AENIWRLYFLVTELDVENGA

SEQ ID NO: 2474714 - protein, 17 aa, Entamoeba dispar
AENLMKLVSIMEEVHQK

SEQ ID NO: 2474715 - protein, 23 aa, Entamoeba dispar
AENLRVCGLLVARSVGDVKNKPI

SEQ ID NO: 2474716 - protein, 23 aa, Entamoeba dispar
AEPYLMKYFPGISLTDVRIEHEH

SEQ ID NO: 2474717 - protein, 19 aa, Entamoeba dispar
AEQTILHYVCNTFTSDASF

SEQ ID NO: 2474718 - protein, 29 aa, Entamoeba dispar
AERFYEQRNFFGLCAIIFALHKIQDFDYL

SEQ ID NO: 2474719 - protein, 22 aa, Entamoeba dispar
AERLKGTCGLCFTNKKKEEILA

SEQ ID NO: 2474720 - protein, 19 aa, Entamoeba dispar
AERVLLVFIDPHYTVENLE

SEQ ID NO: 2474721 - protein, 18 aa, Entamoeba dispar
AESKGSKNLWSFISVLSS

SEQ ID NO: 2474722 - protein, 23 aa, Entamoeba dispar
AESLKTVSVVLSWFAEPIEEEIS

SEQ ID NO: 2474723 - protein, 19 aa, Entamoeba dispar
AESVEMVLQQTKLVFNIII

SEQ ID NO: 2474724 - protein, 23 aa, Entamoeba dispar
AETDIFGFFAFEVDPLFLVAQYL

SEQ ID NO: 2474725 - protein, 17 aa, Entamoeba dispar
AETKGHITPKVVWGTEY

SEQ ID NO: 2474726 - protein, 30 aa, Entamoeba dispar
AEVCDGNIVLKIYGDFLFQTMVINREKYDD

SEQ ID NO: 2474727 - protein, 21 aa, Entamoeba dispar
AEVELSLYILHESWMLSEEMN

SEQ ID NO: 2474728 - protein, 23 aa, Entamoeba dispar
AEVICKRAFQVFLLEQISKEQYI

SEQ ID NO: 2474729 - protein, 27 aa, Entamoeba dispar
AEVILVLKANYEWSYPQYVCEYICEEL

SEQ ID NO: 2474730 - protein, 24 aa, Entamoeba dispar
AEVLRDFPALSIKVGDKEESIMTR

SEQ ID NO: 2474731 - protein, 24 aa, Entamoeba dispar
AEWAKNCLDGQIIDEMNIVVEYSL

SEQ ID NO: 2474732 - protein, 19 aa, Entamoeba dispar
AEYANPIIIKAHHISKTKE

SEQ ID NO: 2474733 - protein, 21 aa, Entamoeba dispar
AEYLAKIVYKFRSSVESYCHP

SEQ ID NO: 2474734 - protein, 25 aa, Entamoeba dispar
AEYNPKRFGALIIRITNPKTTALVF

SEQ ID NO: 2474735 - protein, 20 aa, Entamoeba dispar
AEYPCKIGGQGYDISVKNFK

SEQ ID NO: 2474736 - protein, 19 aa, Entamoeba dispar
AFAKRASQLYDVYKRRCAH

SEQ ID NO: 2474737 - protein, 19 aa, Entamoeba dispar
AFALTYFRDIVVARFSDES

SEQ ID NO: 2474738 - protein, 24 aa, Entamoeba dispar
AFARALRQLPMIIADNAGYDSADL

SEQ ID NO: 2474739 - protein, 18 aa, Entamoeba dispar
AFCSVKFATELAQNHQRD

SEQ ID NO: 2474740 - protein, 25 aa, Entamoeba dispar
AFEKGEFQWAITLLNHLIFANPKNV

SEQ ID NO: 2474741 - protein, 27 aa, Entamoeba dispar
AFEQEIRNTLPYGFSFSFNKENNKEEY

SEQ ID NO: 2474742 - protein, 23 aa, Entamoeba dispar
AFESNCWNRVIPYCYYLTTVHRQ

SEQ ID NO: 2474743 - protein, 17 aa, Entamoeba dispar
AFFHPKPNIPLIVSASL

SEQ ID NO: 2474744 - protein, 19 aa, Entamoeba dispar
AFFKKFGYEKVVDQIMKAD

SEQ ID NO: 2474745 - protein, 21 aa, Entamoeba dispar
AFFLQPELPMLMIIRTSHCQT

SEQ ID NO: 2474746 - protein, 23 aa, Entamoeba dispar
AFGTACFYKCGCEEMLKQNKTIP

SEQ ID NO: 2474747 - protein, 18 aa, Entamoeba dispar
AFHLPKISIVQQINETNK

SEQ ID NO: 2474748 - protein, 22 aa, Entamoeba dispar
AFHSSSLFKYSFDYFEPKYSKR

SEQ ID NO: 2474749 - protein, 23 aa, Entamoeba dispar
AFIELPSRLEVIGNKAFEYCDLI

SEQ ID NO: 2474750 - protein, 18 aa, Entamoeba dispar
AFINLPYKTFPNYQSNLF

SEQ ID NO: 2474751 - protein, 23 aa, Entamoeba dispar
AFIRSLKCGYVMNILHTNPFHFK

SEQ ID NO: 2474752 - protein, 19 aa, Entamoeba dispar
AFKAIFIETVTNFAQQVGQ

SEQ ID NO: 2474753 - protein, 20 aa, Entamoeba dispar
AFKAIFIETVTNFAQQVGQA

SEQ ID NO: 2474754 - protein, 18 aa, Entamoeba dispar
AFKELKFYDWIKQFADNK

SEQ ID NO: 2474755 - protein, 21 aa, Entamoeba dispar
AFKGIHPNAQFTFSGDICYAN

SEQ ID NO: 2474756 - protein, 19 aa, Entamoeba dispar
AFKSKKGFVQKGVDDLVML

SEQ ID NO: 2474757 - protein, 17 aa, Entamoeba dispar
AFLAKLLAFLRKHKEKI

SEQ ID NO: 2474758 - protein, 25 aa, Entamoeba dispar
AFLARAIEVYSIYHSIVKNIFKSSV

SEQ ID NO: 2474759 - protein, 17 aa, Entamoeba dispar
AFLNCSSLVHLIIPHGV

SEQ ID NO: 2474760 - protein, 17 aa, Entamoeba dispar
AFLNVLQPFMWQHILIP

SEQ ID NO: 2474761 - protein, 35 aa, Entamoeba dispar
AFLRPETAQGIFTMFKRNLEFNGGKVPFGVTQIGN

SEQ ID NO: 2474762 - protein, 17 aa, Entamoeba dispar
AFLSRRMMEQPNNFGKG

SEQ ID NO: 2474763 - protein, 25 aa, Entamoeba dispar
AFMLRCPGCLQMYYCEGCNENEHTL

SEQ ID NO: 2474764 - protein, 19 aa, Entamoeba dispar
AFNELKIIIKFLTRMLLCC

SEQ ID NO: 2474765 - protein, 24 aa, Entamoeba dispar
AFNKFIYCPIVLPYFLRLLTHCLS

SEQ ID NO: 2474766 - protein, 19 aa, Entamoeba dispar
AFNKLPSTLKFVLKESEPY

SEQ ID NO: 2474767 - protein, 20 aa, Entamoeba dispar
AFNLCINMCDSINLISKMWD

SEQ ID NO: 2474768 - protein, 22 aa, Entamoeba dispar
AFNMVKTKAWTLELSMVLVSEL

SEQ ID NO: 2474769 - protein, 18 aa, Entamoeba dispar
AFPATGFSQQWRNSRNDV

SEQ ID NO: 2474770 - protein, 22 aa, Entamoeba dispar
AFPDFKTPIVLPARKATVENVS

SEQ ID NO: 2474771 - protein, 19 aa, Entamoeba dispar
AFPHPIEWDKFFDTSQYTS

SEQ ID NO: 2474772 - protein, 25 aa, Entamoeba dispar
AFPTAFHIAGLWKIDRLIEEMKLCY

SEQ ID NO: 2474773 - protein, 17 aa, Entamoeba dispar
AFQFFKQIYKLFEKCPY

SEQ ID NO: 2474774 - protein, 19 aa, Entamoeba dispar
AFRDWLLQKLVNGERASLL

SEQ ID NO: 2474775 - protein, 24 aa, Entamoeba dispar
AFRMIEMYWTCYDLHSQEIYSKLH

SEQ ID NO: 2474776 - protein, 19 aa, Entamoeba dispar
AFSGFKIPVAKGRKYVRLD

SEQ ID NO: 2474777 - protein, 23 aa, Entamoeba dispar
AFSKIKLYEFFKWTNDKNACKSI

SEQ ID NO: 2474778 - protein, 17 aa, Entamoeba dispar
AFSRRPSYHQNFLKQND

SEQ ID NO: 2474779 - protein, 27 aa, Entamoeba dispar
AFTICNNNIWLAMPMFNQIGIVSFNYQ

SEQ ID NO: 2474780 - protein, 18 aa, Entamoeba dispar
AFTLEKFAKMWSAKFGID

SEQ ID NO: 2474781 - protein, 19 aa, Entamoeba dispar
AFTLEKFAKMWSAKFGIDR

SEQ ID NO: 2474782 - protein, 25 aa, Entamoeba dispar
AFTMFDQLFRYFGLKKAEFLQAGFK

SEQ ID NO: 2474783 - protein, 17 aa, Entamoeba dispar
AFTQGVVNYDGRYYFMC

SEQ ID NO: 2474784 - protein, 20 aa, Entamoeba dispar
AFVECWPDDAFIQYPKQFVK

SEQ ID NO: 2474785 - protein, 18 aa, Entamoeba dispar
AFVGCAFNKVILPNNLEI

SEQ ID NO: 2474786 - protein, 17 aa, Entamoeba dispar
AFVILLKQMIELRIHHL

SEQ ID NO: 2474787 - protein, 25 aa, Entamoeba dispar
AFVMKEIIMGLAYLHGNNMIHRDIK

SEQ ID NO: 2474788 - protein, 18 aa, Entamoeba dispar
AFVPWIPNNMQLAVCDIP

SEQ ID NO: 2474789 - protein, 18 aa, Entamoeba dispar
AFYERRLHRMEARAMKAF

SEQ ID NO: 2474790 - protein, 19 aa, Entamoeba dispar
AFYGQERPVFVNGKIIKSS

SEQ ID NO: 2474791 - protein, 19 aa, Entamoeba dispar
AFYLCLEKVVPFIEELERY

SEQ ID NO: 2474792 - protein, 17 aa, Entamoeba dispar
AGAHGKDTWGIFRVHQF

SEQ ID NO: 2474793 - protein, 24 aa, Entamoeba dispar
AGAHGKDTWGIFRVHQFEKIEQFC

SEQ ID NO: 2474794 - protein, 17 aa, Entamoeba dispar
AGAMVLADRGIVCVDEF

SEQ ID NO: 2474795 - protein, 20 aa, Entamoeba dispar
AGANIEWLEEVGINYIINCT

SEQ ID NO: 2474796 - protein, 18 aa, Entamoeba dispar
AGAYFSSSYIKFFLTSQL

SEQ ID NO: 2474797 - protein, 18 aa, Entamoeba dispar
AGAYFSSSYVKFFLTSQL

SEQ ID NO: 2474798 - protein, 26 aa, Entamoeba dispar
AGCCLKTGIIYTNWLKTGIVIIKCRF

SEQ ID NO: 2474799 - protein, 20 aa, Entamoeba dispar
AGCEVMRLGGIVAILRYELN

SEQ ID NO: 2474800 - protein, 26 aa, Entamoeba dispar
AGCICAELILGIPLFPGSSEYNELYK

SEQ ID NO: 2474801 - protein, 39 aa, Entamoeba dispar
AGDAFVGSYARCWAIGLDPKRSAEISVRIASDSVTRHGT

SEQ ID NO: 2474802 - protein, 21 aa, Entamoeba dispar
AGDLIPWTLTQQFLDDEFAGL

SEQ ID NO: 2474803 - protein, 25 aa, Entamoeba dispar
AGDLPRLLKHLNVYEIHNGEFYSVF

SEQ ID NO: 2474804 - protein, 25 aa, Entamoeba dispar
AGDLPRLLKHLSIVREISEGNYDTL

SEQ ID NO: 2474805 - protein, 23 aa, Entamoeba dispar
AGDRKGILSFMYQILNKYRLGNC

SEQ ID NO: 2474806 - protein, 23 aa, Entamoeba dispar
AGDVRTADQLYCLRKLEEKTTET

SEQ ID NO: 2474807 - protein, 20 aa, Entamoeba dispar
AGEFKMIYKTTVNRSGLVEV

SEQ ID NO: 2474808 - protein, 25 aa, Entamoeba dispar
AGELEIKSPFILKEYLNNPGANKQA

SEQ ID NO: 2474809 - protein, 24 aa, Entamoeba dispar
AGETKPRKIIPFNSQIEKKLEEII

SEQ ID NO: 2474810 - protein, 27 aa, Entamoeba dispar
AGEYQFARVAKDCRLVNEIMDVPLYIS

SEQ ID NO: 2474811 - protein, 18 aa, Entamoeba dispar
AGFANFFISLEDLKACNF

SEQ ID NO: 2474812 - protein, 18 aa, Entamoeba dispar
AGFANFFISLEDLKTCNF

SEQ ID NO: 2474813 - protein, 21 aa, Entamoeba dispar
AGFFVCQGRFIFKELPTTISS

SEQ ID NO: 2474814 - protein, 35 aa, Entamoeba dispar
AGFHCCWCSVNVHAKCLSLLPSHCSYGKLASILTK

SEQ ID NO: 2474815 - protein, 17 aa, Entamoeba dispar
AGGKGRYWVLDPIDGTL

SEQ ID NO: 2474816 - protein, 20 aa, Entamoeba dispar
AGGKSIEIGTIFKQPSSSFN

SEQ ID NO: 2474817 - protein, 26 aa, Entamoeba dispar
AGHHQKRFKVFIAHDGIFNTEEQYIE

SEQ ID NO: 2474818 - protein, 17 aa, Entamoeba dispar
AGIHVSETLKSYNDKFE

SEQ ID NO: 2474819 - protein, 24 aa, Entamoeba dispar
AGILANKHHICWTDRRGVHEPNYY

SEQ ID NO: 2474820 - protein, 19 aa, Entamoeba dispar
AGISEEYALHGWGNDSSST

SEQ ID NO: 2474821 - protein, 26 aa, Entamoeba dispar
AGIVVWPCIAEILPQYVFNDRNPIIC

SEQ ID NO: 2474822 - protein, 23 aa, Entamoeba dispar
AGIYKLKGGCVIVSDECVDALRY

SEQ ID NO: 2474823 - protein, 24 aa, Entamoeba dispar
AGKGRTGLMCACLLVYFRDCLHSY

SEQ ID NO: 2474824 - protein, 25 aa, Entamoeba dispar
AGKGRTGLMSACFLVYMLDSLNAHE

SEQ ID NO: 2474825 - protein, 22 aa, Entamoeba dispar
AGKRRYSDFLKLFESLCERYDE

SEQ ID NO: 2474826 - protein, 21 aa, Entamoeba dispar
AGKSDGWCRDNFLQARALNKA

SEQ ID NO: 2474827 - protein, 17 aa, Entamoeba dispar
AGLDILQTAGLVNFIGK

SEQ ID NO: 2474828 - protein, 27 aa, Entamoeba dispar
AGLDPFKVLRLHTAAVRAVDVHKILPL

SEQ ID NO: 2474829 - protein, 23 aa, Entamoeba dispar
AGLDPKLVEMLLENEIEEDVELD

SEQ ID NO: 2474830 - protein, 22 aa, Entamoeba dispar
AGLFKPQMAKPFMNAMKEVTDL

SEQ ID NO: 2474831 - protein, 20 aa, Entamoeba dispar
AGLGRSGTFIILLRIYEHHF

SEQ ID NO: 2474832 - protein, 19 aa, Entamoeba dispar
AGLKVPIITVMVGEGGSGG

SEQ ID NO: 2474833 - protein, 24 aa, Entamoeba dispar
AGLRGKMCAGFNCMNNLIVQQASQ

SEQ ID NO: 2474834 - protein, 17 aa, Entamoeba dispar
AGMKDKRGVTCQYITIP

SEQ ID NO: 2474835 - protein, 18 aa, Entamoeba dispar
AGMSRVYYNGALGAIVMC

SEQ ID NO: 2474836 - protein, 18 aa, Entamoeba dispar
AGMSRVYYNGALGGLVMC

SEQ ID NO: 2474837 - protein, 22 aa, Entamoeba dispar
AGNEKRYYGVIIEPLDNGSMVY

SEQ ID NO: 2474838 - protein, 20 aa, Entamoeba dispar
AGNPFSTTNLLNSSTTGTQT

SEQ ID NO: 2474839 - protein, 25 aa, Entamoeba dispar
AGNVKEGIDLIGIFDGHNGSDAAKL

SEQ ID NO: 2474840 - protein, 26 aa, Entamoeba dispar
AGPPVTCIGLKFIAGSLIITSARIIF

SEQ ID NO: 2474841 - protein, 18 aa, Entamoeba dispar
AGQGTMWFMQRELDEKKK

SEQ ID NO: 2474842 - protein, 27 aa, Entamoeba dispar
AGREVGRSCFILKYMGHNIMLDCGVHP

SEQ ID NO: 2474843 - protein, 18 aa, Entamoeba dispar
AGSERFRSMVSMYYRGVS

SEQ ID NO: 2474844 - protein, 21 aa, Entamoeba dispar
AGSLAFFSTTLNNVWANKCTK

SEQ ID NO: 2474845 - protein, 21 aa, Entamoeba dispar
AGSTVEAWAEAFTDYYERPAG

SEQ ID NO: 2474846 - protein, 23 aa, Entamoeba dispar
AGVIKTWIDSFAISYDVTVKKGL

SEQ ID NO: 2474847 - protein, 20 aa, Entamoeba dispar
AGVKFMYDCVMGLKQGFRGN

SEQ ID NO: 2474848 - protein, 19 aa, Entamoeba dispar
AGYCVATYILGIGDRHSDN

SEQ ID NO: 2474849 - protein, 19 aa, Entamoeba dispar
AGYCVATYILGVGDRHSDN

SEQ ID NO: 2474850 - protein, 26 aa, Entamoeba dispar
AHAFLKSISLKGYMNNVAKFDTMWNQ

SEQ ID NO: 2474851 - protein, 19 aa, Entamoeba dispar
AHAIPSLVHLFRTKNDEFG

SEQ ID NO: 2474852 - protein, 20 aa, Entamoeba dispar
AHALIDYIFYHSSYIYFNTN

SEQ ID NO: 2474853 - protein, 23 aa, Entamoeba dispar
AHAVKCILLIFTIADHHILQQYD

SEQ ID NO: 2474854 - protein, 18 aa, Entamoeba dispar
AHEYVVWNKYYLRETKVI

SEQ ID NO: 2474855 - protein, 25 aa, Entamoeba dispar
AHFGEKWPGYEFEVHGLVCKNGKYY

SEQ ID NO: 2474856 - protein, 24 aa, Entamoeba dispar
AHFKVCPTYPSVLVVPIEMNERMM

SEQ ID NO: 2474857 - protein, 21 aa, Entamoeba dispar
AHFQCPYCHYENTEVEQTSPI

SEQ ID NO: 2474858 - protein, 26 aa, Entamoeba dispar
AHGDVRYGINMLQSFVKCGVTLGEKN

SEQ ID NO: 2474859 - protein, 19 aa, Entamoeba dispar
AHGGSLVMIAKGNRSEMLT

SEQ ID NO: 2474860 - protein, 21 aa, Entamoeba dispar
AHGKDTWGIFRVHQFEKIEQF

SEQ ID NO: 2474861 - protein, 23 aa, Entamoeba dispar
AHGPQARQFFMQKIINAERTALK

SEQ ID NO: 2474862 - protein, 21 aa, Entamoeba dispar
AHGRLEELIIWAFNKQIITKD

SEQ ID NO: 2474863 - protein, 18 aa, Entamoeba dispar
AHGYYRKPTFSLKAPYVV

SEQ ID NO: 2474864 - protein, 26 aa, Entamoeba dispar
AHILIDLCAAPGGWCQVATKEMPVES

SEQ ID NO: 2474865 - protein, 26 aa, Entamoeba dispar
AHKKRSTKFVKILSHLAIPNYPDKLL

SEQ ID NO: 2474866 - protein, 24 aa, Entamoeba dispar
AHKNFRINRCLDNYFDVFNKCIKS

SEQ ID NO: 2474867 - protein, 18 aa, Entamoeba dispar
AHLISFQIPLLVHQLTDY

SEQ ID NO: 2474868 - protein, 17 aa, Entamoeba dispar
AHLPVLHKIVVECFGSN

SEQ ID NO: 2474869 - protein, 25 aa, Entamoeba dispar
AHMHSAVSFLMRFSQRSLTISPNDY

SEQ ID NO: 2474870 - protein, 24 aa, Entamoeba dispar
AHNKALHFTSRFMYLTLWGDEISN

SEQ ID NO: 2474871 - protein, 21 aa, Entamoeba dispar
AHPGCSRAFHLQCHDPPLFAI

SEQ ID NO: 2474872 - protein, 18 aa, Entamoeba dispar
AHRIASPVLRELWSCEPE

SEQ ID NO: 2474873 - protein, 20 aa, Entamoeba dispar
AHRIGHEITAYYGLAHGETL

SEQ ID NO: 2474874 - protein, 18 aa, Entamoeba dispar
AHSNIDVPVIKRVEYPLQ

SEQ ID NO: 2474875 - protein, 19 aa, Entamoeba dispar
AHSNIDVPVIKRVEYPLQD

SEQ ID NO: 2474876 - protein, 18 aa, Entamoeba dispar
AIAERKAQLAQRLELDEQ

SEQ ID NO: 2474877 - protein, 24 aa, Entamoeba dispar
AIASFDIGLAVSFKTHIKCFDIRN

SEQ ID NO: 2474878 - protein, 18 aa, Entamoeba dispar
AICEGRNAGVFVYDNGKG

SEQ ID NO: 2474879 - protein, 18 aa, Entamoeba dispar
AICLKTLCKGIICKTCNK

SEQ ID NO: 2474880 - protein, 24 aa, Entamoeba dispar
AICNTVCTFLKIFNPIDINHEKNI

SEQ ID NO: 2474881 - protein, 24 aa, Entamoeba dispar
AIDDRPVWKFFKNVIEKMSLTGII

SEQ ID NO: 2474882 - protein, 20 aa, Entamoeba dispar
AIDICCLRAADYCDNDEEKI

SEQ ID NO: 2474883 - protein, 19 aa, Entamoeba dispar
AIDILIKIYLKFLPENGYI

SEQ ID NO: 2474884 - protein, 19 aa, Entamoeba dispar
AIDIPRLVSKLTVIEENNT

SEQ ID NO: 2474885 - protein, 26 aa, Entamoeba dispar
AIDIYEVHGLLPLFTKVYQFVGKEKL

SEQ ID NO: 2474886 - protein, 25 aa, Entamoeba dispar
AIDQYFTKCFEFMDSIIKGGGSILI

SEQ ID NO: 2474887 - protein, 17 aa, Entamoeba dispar
AIEAFKRGGKIFGVRKN

SEQ ID NO: 2474888 - protein, 17 aa, Entamoeba dispar
AIEFLKHKTIQYLEKKE

SEQ ID NO: 2474889 - protein, 26 aa, Entamoeba dispar
AIEGCNYCSIELKFSPIESVILQDVE

SEQ ID NO: 2474890 - protein, 18 aa, Entamoeba dispar
AIEGMCSLIQWIKKDLPL

SEQ ID NO: 2474891 - protein, 25 aa, Entamoeba dispar
AIEHAFPPTGGWGLGIDRLSMLLAD

SEQ ID NO: 2474892 - protein, 25 aa, Entamoeba dispar
AIEKLKFHFELGVIDKSDIVSDDAR

SEQ ID NO: 2474893 - protein, 18 aa, Entamoeba dispar
AIEVILKIIEPMNLKEIG

SEQ ID NO: 2474894 - protein, 17 aa, Entamoeba dispar
AIEYNLFEFQDKVDTIS

SEQ ID NO: 2474895 - protein, 23 aa, Entamoeba dispar
AIGDGIKRAFRLFGNNLGNNLER

SEQ ID NO: 2474896 - protein, 28 aa, Entamoeba dispar
AIGNEIRFILRILKGVFRIGFTDRSLPP

SEQ ID NO: 2474897 - protein, 22 aa, Entamoeba dispar
AIHGLLAWRDWQISELTATSVT

SEQ ID NO: 2474898 - protein, 20 aa, Entamoeba dispar
AIHHPHLVKRLSLHHKGSYL

SEQ ID NO: 2474899 - protein, 17 aa, Entamoeba dispar
AIHKATIAFTLRKAGTS

SEQ ID NO: 2474900 - protein, 18 aa, Entamoeba dispar
AIIGCVIVDGKIYDFVSQ

SEQ ID NO: 2474901 - protein, 21 aa, Entamoeba dispar
AIIGSKGFKKCILRLGTAGPD

SEQ ID NO: 2474902 - protein, 24 aa, Entamoeba dispar
AIIKRLRRKPIGLIRGKTDILNIF

SEQ ID NO: 2474903 - protein, 18 aa, Entamoeba dispar
AIILWKKQNEWYLSYLKR

SEQ ID NO: 2474904 - protein, 20 aa, Entamoeba dispar
AIIPKAFNIIPLFTKQTLQK

SEQ ID NO: 2474905 - protein, 23 aa, Entamoeba dispar
AIISKYRFGVVYAGPGQSSENEI

SEQ ID NO: 2474906 - protein, 21 aa, Entamoeba dispar
AIKAIEMSGMFFKENSPIYVS

SEQ ID NO: 2474907 - protein, 24 aa, Entamoeba dispar
AIKDGRLKPGMEIIEATSGNTGIG

SEQ ID NO: 2474908 - protein, 26 aa, Entamoeba dispar
AIKKSQWRVPLPIFRAMQYLEEHKGD

SEQ ID NO: 2474909 - protein, 27 aa, Entamoeba dispar
AIKKSQWRVPLPIFRAMQYLEEHKGDE

SEQ ID NO: 2474910 - protein, 27 aa, Entamoeba dispar
AIKLNPRVANFFACRAQYYNKAKKPNA

SEQ ID NO: 2474911 - protein, 23 aa, Entamoeba dispar
AIKNGRLKPGMEIIEATSGNTGI

SEQ ID NO: 2474912 - protein, 24 aa, Entamoeba dispar
AIKTFQIVSSLGYPEADTALYECA

SEQ ID NO: 2474913 - protein, 23 aa, Entamoeba dispar
AIKVPGRIWPLMINPTTVIISSY

SEQ ID NO: 2474914 - protein, 17 aa, Entamoeba dispar
AIKYSFGSKSFVPRNKV

SEQ ID NO: 2474915 - protein, 19 aa, Entamoeba dispar
AILLYKPSPLYILDEVDAA

SEQ ID NO: 2474916 - protein, 22 aa, Entamoeba dispar
AILLYKYMLQYLIFRKVSNDTI

SEQ ID NO: 2474917 - protein, 17 aa, Entamoeba dispar
AILNRYKVLKAHGMKVV

SEQ ID NO: 2474918 - protein, 20 aa, Entamoeba dispar
AILRRFSRRILVDLPTKEDR

SEQ ID NO: 2474919 - protein, 26 aa, Entamoeba dispar
AINAGDCLKILQTVCMIFESDELAQH

SEQ ID NO: 2474920 - protein, 17 aa, Entamoeba dispar
AINEMKLEIASLAQSQT

SEQ ID NO: 2474921 - protein, 22 aa, Entamoeba dispar
AINLMKIGGFIDAIRILLKGNY

SEQ ID NO: 2474922 - protein, 17 aa, Entamoeba dispar
AINSLKVNPWFTSERDI

SEQ ID NO: 2474923 - protein, 25 aa, Entamoeba dispar
AIPLVALNCLVEYGSYDERYGEVDL

SEQ ID NO: 2474924 - protein, 20 aa, Entamoeba dispar
AIPVLPSLFNLVTTFNEPTD

SEQ ID NO: 2474925 - protein, 18 aa, Entamoeba dispar
AIQEIFMKYPTFMLRGDS

SEQ ID NO: 2474926 - protein, 20 aa, Entamoeba dispar
AIRHKLKIINILNDDGTMNQ

SEQ ID NO: 2474927 - protein, 18 aa, Entamoeba dispar
AIRPETLGQLTLVALSLV

SEQ ID NO: 2474928 - protein, 24 aa, Entamoeba dispar
AIRRKPYSVILFDEIEKAHPQVFN

SEQ ID NO: 2474929 - protein, 20 aa, Entamoeba dispar
AISKEAWKNIILAYEPVWAI

SEQ ID NO: 2474930 - protein, 19 aa, Entamoeba dispar
AISKRSGRDILTLMQKIIN

SEQ ID NO: 2474931 - protein, 20 aa, Entamoeba dispar
AISLLTKWAEECGVVLRKGS

SEQ ID NO: 2474932 - protein, 26 aa, Entamoeba dispar
AISPFSIPVARNFFKQLLSGVKYCHD

SEQ ID NO: 2474933 - protein, 18 aa, Entamoeba dispar
AITAKVFLSKGFKTYLFS

SEQ ID NO: 2474934 - protein, 19 aa, Entamoeba dispar
AITATVMRKQGDFGDCISV

SEQ ID NO: 2474935 - protein, 19 aa, Entamoeba dispar
AITATVMRKQGDFGDYISV

SEQ ID NO: 2474936 - protein, 28 aa, Entamoeba dispar
AITMIKRLVPLFQMIGCSVCSLYSGMEM

SEQ ID NO: 2474937 - protein, 18 aa, Entamoeba dispar
AITQCLSHSFYLTLSEAT

SEQ ID NO: 2474938 - protein, 17 aa, Entamoeba dispar
AITQLRNSLALYSKNMT

SEQ ID NO: 2474939 - protein, 24 aa, Entamoeba dispar
AIVECPYWLAPEVISGEPFTQKSD

SEQ ID NO: 2474940 - protein, 18 aa, Entamoeba dispar
AIVFKTIDFGKCYYTGSV

SEQ ID NO: 2474941 - protein, 18 aa, Entamoeba dispar
AIVIRFNQNFKVNERFGF

SEQ ID NO: 2474942 - protein, 31 aa, Entamoeba dispar
AIVKSVPVQFGWKVVIEWIKNNNQLYSQSHD

SEQ ID NO: 2474943 - protein, 20 aa, Entamoeba dispar
AIVLKFRNIHFASFRSPLRK

SEQ ID NO: 2474944 - protein, 24 aa, Entamoeba dispar
AIVRLLYSMCLYQNDLLIEIIKQL

SEQ ID NO: 2474945 - protein, 43 aa, Entamoeba dispar
AIYCVPRTNSCLIRAFFYWSGCYFLRLNLMKKAEFMFRNCCEI

SEQ ID NO: 2474946 - protein, 19 aa, Entamoeba dispar
AIYRCSQPLVANSSYFIGV

SEQ ID NO: 2474947 - protein, 21 aa, Entamoeba dispar
AIYRNRLKIIPPTEPRIVVFS

SEQ ID NO: 2474948 - protein, 25 aa, Entamoeba dispar
AKAECIWKNLILMCIGENFENSEFL

SEQ ID NO: 2474949 - protein, 17 aa, Entamoeba dispar
AKAGTPLFRGNTPFIRF

SEQ ID NO: 2474950 - protein, 23 aa, Entamoeba dispar
AKAKEVVDLLITRYLVPDNIPKE

SEQ ID NO: 2474951 - protein, 18 aa, Entamoeba dispar
AKASLAMLTLCLCSSNII

SEQ ID NO: 2474952 - protein, 18 aa, Entamoeba dispar
AKASMIWIIGEYNQLITN

SEQ ID NO: 2474953 - protein, 18 aa, Entamoeba dispar
AKCGNPITRNMVIVKTFE

SEQ ID NO: 2474954 - protein, 21 aa, Entamoeba dispar
AKCPHCKKTGTLQLIHTLSYY

SEQ ID NO: 2474955 - protein, 18 aa, Entamoeba dispar
AKCVVSLFDSLKEKTLNT

SEQ ID NO: 2474956 - protein, 18 aa, Entamoeba dispar
AKDAITLIARYSSPIMIE

SEQ ID NO: 2474957 - protein, 18 aa, Entamoeba dispar
AKDAVSLGRSCRQLHGII

SEQ ID NO: 2474958 - protein, 25 aa, Entamoeba dispar
AKDEMGCSIGLYNNGCKLNIRLSLK

SEQ ID NO: 2474959 - protein, 37 aa, Entamoeba dispar
AKDKHGWTLLHYAAWFNKSHICSMLMRYNANDESSDN

SEQ ID NO: 2474960 - protein, 17 aa, Entamoeba dispar
AKDLHTIFHTDERAVDL

SEQ ID NO: 2474961 - protein, 32 aa, Entamoeba dispar
AKDLIKKLVCLKEKRLADIKLIQQHPFFKGFN

SEQ ID NO: 2474962 - protein, 19 aa, Entamoeba dispar
AKDNMDGRVVYGRELKVNW

SEQ ID NO: 2474963 - protein, 27 aa, Entamoeba dispar
AKDNVKCGILLREEDDILSWLGNSDFG

SEQ ID NO: 2474964 - protein, 18 aa, Entamoeba dispar
AKDSVAIERDALFEKTIQ

SEQ ID NO: 2474965 - protein, 19 aa, Entamoeba dispar
AKDVERFSSFHSNEIYQHL

SEQ ID NO: 2474966 - protein, 19 aa, Entamoeba dispar
AKEAMEFFAKRRSKINKGS

SEQ ID NO: 2474967 - protein, 18 aa, Entamoeba dispar
AKEAYHFLSKMSCGSIIG

SEQ ID NO: 2474968 - protein, 25 aa, Entamoeba dispar
AKEDSVYLLRCQIINTCISFMEEYS

SEQ ID NO: 2474969 - protein, 25 aa, Entamoeba dispar
AKEFKELFEPILILTKKIVEELDRA

SEQ ID NO: 2474970 - protein, 35 aa, Entamoeba dispar
AKEICKEIVWTPSMRRLFCLIIECIKHKEPVLLIG

SEQ ID NO: 2474971 - protein, 19 aa, Entamoeba dispar
AKELLPCKIIDSRKNEQQQ

SEQ ID NO: 2474972 - protein, 17 aa, Entamoeba dispar
AKERIRIEEVVRMLERI

SEQ ID NO: 2474973 - protein, 28 aa, Entamoeba dispar
AKESIYITDWRIDPEIILIRRGTHRLKG

SEQ ID NO: 2474974 - protein, 22 aa, Entamoeba dispar
AKEVKFLLYDTFYAMNNLMNEK

SEQ ID NO: 2474975 - protein, 22 aa, Entamoeba dispar
AKEVKHGYELMGRHEIEPKYNV

SEQ ID NO: 2474976 - protein, 28 aa, Entamoeba dispar
AKEYSPMAFAIVRRFFGLTPESMIESIC

SEQ ID NO: 2474977 - protein, 32 aa, Entamoeba dispar
AKFANGVLALLKRRGYTFCEKKTRPCHITTRL

SEQ ID NO: 2474978 - protein, 23 aa, Entamoeba dispar
AKFEKEIKMYGGISHQGYPNIDC

SEQ ID NO: 2474979 - protein, 19 aa, Entamoeba dispar
AKFGDARVGMVGFPSVGES

SEQ ID NO: 2474980 - protein, 18 aa, Entamoeba dispar
AKFGDARVGMVGFPSVGK

SEQ ID NO: 2474981 - protein, 24 aa, Entamoeba dispar
AKFLSNCGAFDCASEELLHEEEIE

SEQ ID NO: 2474982 - protein, 25 aa, Entamoeba dispar
AKFQLPDCAKYLFENVKRIAMEDYV

SEQ ID NO: 2474983 - protein, 24 aa, Entamoeba dispar
AKGFLGERYMRFDPILPNNLDLDC

SEQ ID NO: 2474984 - protein, 20 aa, Entamoeba dispar
AKGIPIFISNPINDRKSKFI

SEQ ID NO: 2474985 - protein, 18 aa, Entamoeba dispar
AKGKRPNFDPDFNEQITS

SEQ ID NO: 2474986 - protein, 18 aa, Entamoeba dispar
AKGLKYLHELKIIHRDLK

SEQ ID NO: 2474987 - protein, 27 aa, Entamoeba dispar
AKGLRDMIAPFFLRRIKKEVLPSLPTR

SEQ ID NO: 2474988 - protein, 22 aa, Entamoeba dispar
AKGLSLDFLEKVFPLIEKYTRI

SEQ ID NO: 2474989 - protein, 17 aa, Entamoeba dispar
AKGMCLVKMPKIQEIKK

SEQ ID NO: 2474990 - protein, 18 aa, Entamoeba dispar
AKGSCLIQKENSKVISSV

SEQ ID NO: 2474991 - protein, 17 aa, Entamoeba dispar
AKGTVLILGKEKHFLLK

SEQ ID NO: 2474992 - protein, 20 aa, Entamoeba dispar
AKHHALRMAAFFHEPITFFA

SEQ ID NO: 2474993 - protein, 25 aa, Entamoeba dispar
AKHRKRLGMNTILFLDEIHSLNRLQ

SEQ ID NO: 2474994 - protein, 24 aa, Entamoeba dispar
AKHTFYCKMCFELCSNEPSCKLRL

SEQ ID NO: 2474995 - protein, 17 aa, Entamoeba dispar
AKIAIRIQLTNKIKSYC

SEQ ID NO: 2474996 - protein, 23 aa, Entamoeba dispar
AKICARCGKPITTNCVSALGKTY

SEQ ID NO: 2474997 - protein, 20 aa, Entamoeba dispar
AKICSDVFVITDIISEFCNF

SEQ ID NO: 2474998 - protein, 18 aa, Entamoeba dispar
AKIFDIFENVYRPIIDKL

SEQ ID NO: 2474999 - protein, 17 aa, Entamoeba dispar
AKIGKLVRVKGIVTRAT

SEQ ID NO: 2475000 - protein, 17 aa, Entamoeba dispar
AKIHRKRKNEDVSQEEE

SEQ ID NO: 2475001 - protein, 18 aa, Entamoeba dispar
AKIIFFIVKVLFRCDAVD

SEQ ID NO: 2475002 - protein, 25 aa, Entamoeba dispar
AKILKCNIALFVLRERIRKALQLYS

SEQ ID NO: 2475003 - protein, 18 aa, Entamoeba dispar
AKINRPRGIVSFVKSKDP

SEQ ID NO: 2475004 - protein, 18 aa, Entamoeba dispar
AKISEYGFKQIFERHKEN

SEQ ID NO: 2475005 - protein, 19 aa, Entamoeba dispar
AKISIPICSTPQLLTSLSF

SEQ ID NO: 2475006 - protein, 20 aa, Entamoeba dispar
AKKAKEELIKLAEQQKEYER

SEQ ID NO: 2475007 - protein, 17 aa, Entamoeba dispar
AKKAWKEGFWGSCRNQN

SEQ ID NO: 2475008 - protein, 17 aa, Entamoeba dispar
AKKDKDCIFLEDDPSHF

SEQ ID NO: 2475009 - protein, 19 aa, Entamoeba dispar
AKKECKLKIIKHYQNEKLI

SEQ ID NO: 2475010 - protein, 17 aa, Entamoeba dispar
AKKGLIIVGNYNTLRYE

SEQ ID NO: 2475011 - protein, 31 aa, Entamoeba dispar
AKKKCICRYFMGASLVCYGIPVLKKNINESI

SEQ ID NO: 2475012 - protein, 18 aa, Entamoeba dispar
AKKKLVLDHLIIQTMEKK

SEQ ID NO: 2475013 - protein, 19 aa, Entamoeba dispar
AKKLGNILCCGGDLSDGLK

SEQ ID NO: 2475014 - protein, 26 aa, Entamoeba dispar
AKKLISMNCWLSFGRVVLNNNNIKIN

SEQ ID NO: 2475015 - protein, 22 aa, Entamoeba dispar
AKKLMWMSMEYMDGGCLTDILE

SEQ ID NO: 2475016 - protein, 26 aa, Entamoeba dispar
AKKLRLLSIEIMKRFLDDICLQPIPL

SEQ ID NO: 2475017 - protein, 21 aa, Entamoeba dispar
AKKPLSAYILFTQAKREEIAA

SEQ ID NO: 2475018 - protein, 17 aa, Entamoeba dispar
AKKQMKAEEKAIKKQMK

SEQ ID NO: 2475019 - protein, 23 aa, Entamoeba dispar
AKKSETTELMFFKPSENNSEITE

SEQ ID NO: 2475020 - protein, 24 aa, Entamoeba dispar
AKKVEVIVGVPFIYIPKVQQILAG

SEQ ID NO: 2475021 - protein, 19 aa, Entamoeba dispar
AKKWFTEVLSNGWTETTKG

SEQ ID NO: 2475022 - protein, 20 aa, Entamoeba dispar
AKKYIQFVIENNIRYEIDRT

SEQ ID NO: 2475023 - protein, 23 aa, Entamoeba dispar
AKLDAALIRAMFDKGIKVGGSLL

SEQ ID NO: 2475024 - protein, 18 aa, Entamoeba dispar
AKLEHYVLAFKLSLYCGI

SEQ ID NO: 2475025 - protein, 17 aa, Entamoeba dispar
AKLKLLVKHPELVEFHD

SEQ ID NO: 2475026 - protein, 25 aa, Entamoeba dispar
AKLKREEYVCALKVLAKLQIYKYNM

SEQ ID NO: 2475027 - protein, 19 aa, Entamoeba dispar
AKLLRELLTENGIIYGEKI

SEQ ID NO: 2475028 - protein, 19 aa, Entamoeba dispar
AKLRASRPKKLFVKLHNRQ

SEQ ID NO: 2475029 - protein, 20 aa, Entamoeba dispar
AKLSPYAFIPHKGYDDIEEL

SEQ ID NO: 2475030 - protein, 29 aa, Entamoeba dispar
AKMIFATEFAYNWYVRKFFFEEGLKDAEL

SEQ ID NO: 2475031 - protein, 19 aa, Entamoeba dispar
AKNGFMLYDCFGNLQFETY

SEQ ID NO: 2475032 - protein, 18 aa, Entamoeba dispar
AKNIIAILGEDNHGECQS

SEQ ID NO: 2475033 - protein, 21 aa, Entamoeba dispar
AKNNGSICLHDSKRLIGETVK

SEQ ID NO: 2475034 - protein, 18 aa, Entamoeba dispar
AKNSLKVDDCFISLARDV

SEQ ID NO: 2475035 - protein, 20 aa, Entamoeba dispar
AKNTALHFVVVLNRVDLINL

SEQ ID NO: 2475036 - protein, 22 aa, Entamoeba dispar
AKPARLPFLSLALNLPPELADI

SEQ ID NO: 2475037 - protein, 28 aa, Entamoeba dispar
AKPEICIPLSQFHCFLGFVDEELLRFQM

SEQ ID NO: 2475038 - protein, 22 aa, Entamoeba dispar
AKPEICKTLKYVVLYDNTGLSL

SEQ ID NO: 2475039 - protein, 25 aa, Entamoeba dispar
AKPHPQIFLRAGHLLGCTDMKQAIV

SEQ ID NO: 2475040 - protein, 23 aa, Entamoeba dispar
AKPMTRLRCAGFTKEERASTSET

SEQ ID NO: 2475041 - protein, 20 aa, Entamoeba dispar
AKPTFCEFYPDYIDFGGKCL

SEQ ID NO: 2475042 - protein, 18 aa, Entamoeba dispar
AKQIAFGMNEIHSYKMPL

SEQ ID NO: 2475043 - protein, 18 aa, Entamoeba dispar
AKQVPEILILQEPSYPLI

SEQ ID NO: 2475044 - protein, 23 aa, Entamoeba dispar
AKRGEQKFEFTIQINQNGMMEIS

SEQ ID NO: 2475045 - protein, 25 aa, Entamoeba dispar
AKRNSSGIWSWMGYSNVINSQLTED

SEQ ID NO: 2475046 - protein, 21 aa, Entamoeba dispar
AKRRFDAKFGAIASNIRKYNE

SEQ ID NO: 2475047 - protein, 26 aa, Entamoeba dispar
AKRSQIPLQLAWAISIHKSQGMTLER

SEQ ID NO: 2475048 - protein, 21 aa, Entamoeba dispar
AKSCISSLIDIRSLKNKIEQD

SEQ ID NO: 2475049 - protein, 20 aa, Entamoeba dispar
AKSDAVWKIVTEVINSTTEL

SEQ ID NO: 2475050 - protein, 23 aa, Entamoeba dispar
AKSDIVMSLSFIKRRITIDPVIV

SEQ ID NO: 2475051 - protein, 17 aa, Entamoeba dispar
AKSFLKEKKIEIKGETS

SEQ ID NO: 2475052 - protein, 18 aa, Entamoeba dispar
AKSIKQFINNCVDSLTSL

SEQ ID NO: 2475053 - protein, 22 aa, Entamoeba dispar
AKSILKKDCQMMVTLKSIMIID

SEQ ID NO: 2475054 - protein, 19 aa, Entamoeba dispar
AKSLMCIDVAVKQASVMII

SEQ ID NO: 2475055 - protein, 20 aa, Entamoeba dispar
AKSVIFPSVEKFDGKENRFL

SEQ ID NO: 2475056 - protein, 24 aa, Entamoeba dispar
AKTGFPQKFKYLAFDMSDDTEQDL

SEQ ID NO: 2475057 - protein, 18 aa, Entamoeba dispar
AKTIIAWLDKFIKKQKKE

SEQ ID NO: 2475058 - protein, 18 aa, Entamoeba dispar
AKTIMWNGPCGVFEIDKF

SEQ ID NO: 2475059 - protein, 19 aa, Entamoeba dispar
AKTLCGTPTYFSPELLRGW

SEQ ID NO: 2475060 - protein, 20 aa, Entamoeba dispar
AKTQMTLFFAKMGSSMTQKQ

SEQ ID NO: 2475061 - protein, 23 aa, Entamoeba dispar
AKTRLSEWGFGKEHFKEISDKFD

SEQ ID NO: 2475062 - protein, 19 aa, Entamoeba dispar
AKTSFGLEVMNCVIRTYQF

SEQ ID NO: 2475063 - protein, 25 aa, Entamoeba dispar
AKTSRSSFIDGIKILKDHLLPITKF

SEQ ID NO: 2475064 - protein, 17 aa, Entamoeba dispar
AKVCIPGLGDYRIKEIE

SEQ ID NO: 2475065 - protein, 19 aa, Entamoeba dispar
AKVDLCAKPVPYNFAGING

SEQ ID NO: 2475066 - protein, 20 aa, Entamoeba dispar
AKVFSCIRTTFEHEYEYCYY

SEQ ID NO: 2475067 - protein, 25 aa, Entamoeba dispar
AKVHLPRKSSTILIEKGKTAQLLAD

SEQ ID NO: 2475068 - protein, 23 aa, Entamoeba dispar
AKVKVKAMEFFLRLDEKQAAMDD

SEQ ID NO: 2475069 - protein, 22 aa, Entamoeba dispar
AKVRSGKLWSQYIDDIIVKYGK

SEQ ID NO: 2475070 - protein, 17 aa, Entamoeba dispar
AKVSVFNAFKEVGIQQS

SEQ ID NO: 2475071 - protein, 21 aa, Entamoeba dispar
AKWKIEPLFNNQWKKFKLQID

SEQ ID NO: 2475072 - protein, 25 aa, Entamoeba dispar
AKYKISPRNTFKSCMEEASNRLKKQ

SEQ ID NO: 2475073 - protein, 19 aa, Entamoeba dispar
ALAASGLRSVRYAKELPQD

SEQ ID NO: 2475074 - protein, 34 aa, Entamoeba dispar
ALAHLIKAKVIPDCVSSIWVCCVDKRYENGRNGK

SEQ ID NO: 2475075 - protein, 18 aa, Entamoeba dispar
ALANACICNEVLSLPLAR

SEQ ID NO: 2475076 - protein, 18 aa, Entamoeba dispar
ALANECKANFIAVKGPQL

SEQ ID NO: 2475077 - protein, 27 aa, Entamoeba dispar
ALANELHCSWCLVSAKTGEGVSNAFES

SEQ ID NO: 2475078 - protein, 19 aa, Entamoeba dispar
ALANLHIILFDVLKNPVHF

SEQ ID NO: 2475079 - protein, 18 aa, Entamoeba dispar
ALCEMSGYMVKKNEKGEN

SEQ ID NO: 2475080 - protein, 17 aa, Entamoeba dispar
ALCKGFFMQSAHQVKGG

SEQ ID NO: 2475081 - protein, 19 aa, Entamoeba dispar
ALCKNWEIEFPICSKCYQV

SEQ ID NO: 2475082 - protein, 31 aa, Entamoeba dispar
ALCQLFRLLPATSICTCKYLFLGDYVDRGTH

SEQ ID NO: 2475083 - protein, 18 aa, Entamoeba dispar
ALCQNLKIELPKNELHED

SEQ ID NO: 2475084 - protein, 21 aa, Entamoeba dispar
ALCRKYLKNPFEVFIDDGEKL

SEQ ID NO: 2475085 - protein, 23 aa, Entamoeba dispar
ALCVESFSDLPARVLPESIKHAS

SEQ ID NO: 2475086 - protein, 23 aa, Entamoeba dispar
ALCVKKCPFEAIKIINLPKNLEQ

SEQ ID NO: 2475087 - protein, 23 aa, Entamoeba dispar
ALDAECFTITSGVTLEKSQRLKT

SEQ ID NO: 2475088 - protein, 18 aa, Entamoeba dispar
ALDCIDKQQLLSAIEEVK

SEQ ID NO: 2475089 - protein, 25 aa, Entamoeba dispar
ALDETLRLVVFLNNISAEYKKYLEN

SEQ ID NO: 2475090 - protein, 32 aa, Entamoeba dispar
ALDILGLGCALDLLKRIDIDFKLNGCRFEGPF

SEQ ID NO: 2475091 - protein, 22 aa, Entamoeba dispar
ALDMYKPVVWEFNRLNITYTVM

SEQ ID NO: 2475092 - protein, 25 aa, Entamoeba dispar
ALDSFPIYRLEHLFLQLNDNDKENF

SEQ ID NO: 2475093 - protein, 20 aa, Entamoeba dispar
ALDSICYLPTVPSISHSSTL

SEQ ID NO: 2475094 - protein, 27 aa, Entamoeba dispar
ALDSTGKICLCIGKKYMKVVDLYRGKV

SEQ ID NO: 2475095 - protein, 21 aa, Entamoeba dispar
ALEGFKRKKYPVMVATNVLSR

SEQ ID NO: 2475096 - protein, 18 aa, Entamoeba dispar
ALELPKIDVNMCDKEEKN

SEQ ID NO: 2475097 - protein, 28 aa, Entamoeba dispar
ALEQPKKWWKFAFIATRDYLREREEEKN

SEQ ID NO: 2475098 - protein, 17 aa, Entamoeba dispar
ALESEDYLRVLLLSNKV

SEQ ID NO: 2475099 - protein, 19 aa, Entamoeba dispar
ALESYQIVINGFAKINNYW

SEQ ID NO: 2475100 - protein, 17 aa, Entamoeba dispar
ALEVLKRMPGITTNQLF

SEQ ID NO: 2475101 - protein, 17 aa, Entamoeba dispar
ALEYAAKLLLEDIKVNV

SEQ ID NO: 2475102 - protein, 20 aa, Entamoeba dispar
ALFMKPNVVLLPFCPYNFQV

SEQ ID NO: 2475103 - protein, 18 aa, Entamoeba dispar
ALFQMCPKIHSLEVPSCL

SEQ ID NO: 2475104 - protein, 21 aa, Entamoeba dispar
ALGCMLYEFVVGYPPFNASTP

SEQ ID NO: 2475105 - protein, 19 aa, Entamoeba dispar
ALGDELKKLLLLSLSAGKA

SEQ ID NO: 2475106 - protein, 18 aa, Entamoeba dispar
ALGKSYHPDHFVCKNCKK

SEQ ID NO: 2475107 - protein, 18 aa, Entamoeba dispar
ALGNCIACNDYVALVHPE

SEQ ID NO: 2475108 - protein, 17 aa, Entamoeba dispar
ALHFSLSLIQPFSIQSQ

SEQ ID NO: 2475109 - protein, 25 aa, Entamoeba dispar
ALHICNFSIPMVYVKTIGVDFLMVD

SEQ ID NO: 2475110 - protein, 18 aa, Entamoeba dispar
ALHTKRIFSRLNWISYEY

SEQ ID NO: 2475111 - protein, 25 aa, Entamoeba dispar
ALIEGKWVVSKNWIINGMKKDEFKY

SEQ ID NO: 2475112 - protein, 25 aa, Entamoeba dispar
ALIKELPSYCFFKCTSLQQLFFYPK

SEQ ID NO: 2475113 - protein, 18 aa, Entamoeba dispar
ALILITLSLMKKCLHSKE

SEQ ID NO: 2475114 - protein, 19 aa, Entamoeba dispar
ALILNDMFKVLNISFYEEI

SEQ ID NO: 2475115 - protein, 18 aa, Entamoeba dispar
ALISELVSLIVGINTSVQ

SEQ ID NO: 2475116 - protein, 17 aa, Entamoeba dispar
ALKALRYLSKRRHENSF

SEQ ID NO: 2475117 - protein, 18 aa, Entamoeba dispar
ALKDIPIDQSFDFELLAQ

SEQ ID NO: 2475118 - protein, 23 aa, Entamoeba dispar
ALKDSRYSQTYGVILRHHSTEEG

SEQ ID NO: 2475119 - protein, 18 aa, Entamoeba dispar
ALKFPAVVRPMFENLSLL

SEQ ID NO: 2475120 - protein, 18 aa, Entamoeba dispar
ALKGDEFAGFTFQDDAAL

SEQ ID NO: 2475121 - protein, 17 aa, Entamoeba dispar
ALKGSRPIISFGAEFEA

SEQ ID NO: 2475122 - protein, 25 aa, Entamoeba dispar
ALKKLIVVDSCVRLEELLGINNVML

SEQ ID NO: 2475123 - protein, 19 aa, Entamoeba dispar
ALKKPYWSLVYRIANKKGL

SEQ ID NO: 2475124 - protein, 21 aa, Entamoeba dispar
ALKKRNVKVVPIALQDGVGED

SEQ ID NO: 2475125 - protein, 32 aa, Entamoeba dispar
ALKNLCLLHCNLHFGKFYDFFDHIARLIPSMK

SEQ ID NO: 2475126 - protein, 18 aa, Entamoeba dispar
ALKNRGDMGQLFYWLLVG

SEQ ID NO: 2475127 - protein, 26 aa, Entamoeba dispar
ALKTVGFKMGIDLAFNTNFHLLCVEK

SEQ ID NO: 2475128 - protein, 25 aa, Entamoeba dispar
ALLDGSLMCYHRLLLKGNNETEKSQ

SEQ ID NO: 2475129 - protein, 17 aa, Entamoeba dispar
ALLDSVRIKFGDISYSS

SEQ ID NO: 2475130 - protein, 35 aa, Entamoeba dispar
ALLGAPLPIEFKWKIPITKKKTGLFSIIETTEVTL

SEQ ID NO: 2475131 - protein, 22 aa, Entamoeba dispar
ALLKTELIGGVDISEKEEKSDE

SEQ ID NO: 2475132 - protein, 25 aa, Entamoeba dispar
ALLNRLMKLCYRISLNHDDTQMDSL

SEQ ID NO: 2475133 - protein, 25 aa, Entamoeba dispar
ALLPLQLRFIQIFVICEPTLSLESP

SEQ ID NO: 2475134 - protein, 24 aa, Entamoeba dispar
ALLPYPECSLKFWDCSCDIELLQL

SEQ ID NO: 2475135 - protein, 17 aa, Entamoeba dispar
ALMSRFDLFFVVLDEPN

SEQ ID NO: 2475136 - protein, 19 aa, Entamoeba dispar
ALNIFSWIIPCKKISTETV

SEQ ID NO: 2475137 - protein, 24 aa, Entamoeba dispar
ALNKKRFLAQKMWNVMVEYSQLTM

SEQ ID NO: 2475138 - protein, 26 aa, Entamoeba dispar
ALNPFSTLLHKWYGIDFDDYEILFPK

SEQ ID NO: 2475139 - protein, 33 aa, Entamoeba dispar
ALNRNDLNMAYHILRNSYQIIYEVIQSTTPKSV

SEQ ID NO: 2475140 - protein, 22 aa, Entamoeba dispar
ALNWLIRRHHLGVNSILADEMG

SEQ ID NO: 2475141 - protein, 26 aa, Entamoeba dispar
ALPEDNVCFCLISLRMTYEGVPNIAR

SEQ ID NO: 2475142 - protein, 17 aa, Entamoeba dispar
ALPELACQCISSLKKIT

SEQ ID NO: 2475143 - protein, 24 aa, Entamoeba dispar
ALPETIMKLGERCFIGCTSLSEIN

SEQ ID NO: 2475144 - protein, 22 aa, Entamoeba dispar
ALPGLMSCLLVGGMDVMKQSVQ

SEQ ID NO: 2475145 - protein, 24 aa, Entamoeba dispar
ALPQACCMYEVLMNRRIYLMEGVI

SEQ ID NO: 2475146 - protein, 17 aa, Entamoeba dispar
ALPQMYIILAHLNPIIH

SEQ ID NO: 2475147 - protein, 20 aa, Entamoeba dispar
ALQEKTCCICGKKSSDWKKG

SEQ ID NO: 2475148 - protein, 20 aa, Entamoeba dispar
ALQENCLHSFLQNRRASQEV

SEQ ID NO: 2475149 - protein, 19 aa, Entamoeba dispar
ALQVPTYFSVIKRPMDLGT

SEQ ID NO: 2475150 - protein, 18 aa, Entamoeba dispar
ALQYKRLFTQEEFLKYLR

SEQ ID NO: 2475151 - protein, 26 aa, Entamoeba dispar
ALRAIRFSGKMGFVLDEELEQEMKTK

SEQ ID NO: 2475152 - protein, 20 aa, Entamoeba dispar
ALRFNDDLLHQFVLNNRQYF

SEQ ID NO: 2475153 - protein, 26 aa, Entamoeba dispar
ALRNNLRSATIWHLYGIVCRSEKRYS

SEQ ID NO: 2475154 - protein, 19 aa, Entamoeba dispar
ALRQVKVRRGVLYLNNSNI

SEQ ID NO: 2475155 - protein, 17 aa, Entamoeba dispar
ALRSSSLLKKRNERRNK

SEQ ID NO: 2475156 - protein, 20 aa, Entamoeba dispar
ALSDFKSGAVNYLIATDLAS

SEQ ID NO: 2475157 - protein, 18 aa, Entamoeba dispar
ALSDLIPYIMKIATKKLC

SEQ ID NO: 2475158 - protein, 17 aa, Entamoeba dispar
ALSEIGIDTTYILPSGL

SEQ ID NO: 2475159 - protein, 17 aa, Entamoeba dispar
ALSIFAPTIYLYIVDTA

SEQ ID NO: 2475160 - protein, 27 aa, Entamoeba dispar
ALSKKGITVAYEFKRFIGKSFDDKIIE

SEQ ID NO: 2475161 - protein, 18 aa, Entamoeba dispar
ALSLCKSADETIERYGLD

SEQ ID NO: 2475162 - protein, 18 aa, Entamoeba dispar
ALSPFRTKIYQKRYDSAI

SEQ ID NO: 2475163 - protein, 19 aa, Entamoeba dispar
ALSQFLVKFGYHPQQITVD

SEQ ID NO: 2475164 - protein, 25 aa, Entamoeba dispar
ALSREYGVVVPLVLMNSFSTNVETE

SEQ ID NO: 2475165 - protein, 29 aa, Entamoeba dispar
ALSSEKARCALRWGVPVLNFQWLFDCLKE

SEQ ID NO: 2475166 - protein, 18 aa, Entamoeba dispar
ALSTKPVLPPNWKQTPKG

SEQ ID NO: 2475167 - protein, 26 aa, Entamoeba dispar
ALSYLDDFDPHFALLSINNKYVFLSH

SEQ ID NO: 2475168 - protein, 18 aa, Entamoeba dispar
ALTIGFCIESVLVNSIKN

SEQ ID NO: 2475169 - protein, 20 aa, Entamoeba dispar
ALTIRCVETLYQDTKDMTPL

SEQ ID NO: 2475170 - protein, 29 aa, Entamoeba dispar
ALTPEIVSLIPLRLHLLIKALGDEYGGRQ

SEQ ID NO: 2475171 - protein, 19 aa, Entamoeba dispar
ALTSFCNRVEQLFPSLENT

SEQ ID NO: 2475172 - protein, 19 aa, Entamoeba dispar
ALVDCEEWGQIPIMTVLMH

SEQ ID NO: 2475173 - protein, 19 aa, Entamoeba dispar
ALVELVQSYSLVGFSPLNI

SEQ ID NO: 2475174 - protein, 24 aa, Entamoeba dispar
ALWIKTLSSYCCVAGITHYPLHTI

SEQ ID NO: 2475175 - protein, 18 aa, Entamoeba dispar
ALWSMGRINGYDLFGDTL

SEQ ID NO: 2475176 - protein, 24 aa, Entamoeba dispar
ALYDILRFWGIYSLYSSIDPSSTD

SEQ ID NO: 2475177 - protein, 28 aa, Entamoeba dispar
ALYLARAPKSCAVFETMKYTEEIIKQTG

SEQ ID NO: 2475178 - protein, 24 aa, Entamoeba dispar
AMDILKRRLEGGWNSIGEETKKGI

SEQ ID NO: 2475179 - protein, 31 aa, Entamoeba dispar
AMEIYYIIASCVIKRKLYLLFTKGEITKIDS

SEQ ID NO: 2475180 - protein, 20 aa, Entamoeba dispar
AMEKAEHAYHDMLKKPENKQ

SEQ ID NO: 2475181 - protein, 19 aa, Entamoeba dispar
AMEKMKVGVNKFLERYPNI

SEQ ID NO: 2475182 - protein, 18 aa, Entamoeba dispar
AMEVSPECIIEWESQGAK

SEQ ID NO: 2475183 - protein, 17 aa, Entamoeba dispar
AMGPRAVYHLLVPAMKS

SEQ ID NO: 2475184 - protein, 23 aa, Entamoeba dispar
AMIPEIVSAYTIKVVAPGSSGIG

SEQ ID NO: 2475185 - protein, 19 aa, Entamoeba dispar
AMKAFTLDEQFLFKQINEE

SEQ ID NO: 2475186 - protein, 24 aa, Entamoeba dispar
AMKLYGLIHARFILSPNGMKKMKN

SEQ ID NO: 2475187 - protein, 19 aa, Entamoeba dispar
AMLEFLRNIELSFQKVSPV

SEQ ID NO: 2475188 - protein, 17 aa, Entamoeba dispar
AMLKCIKYVNDLHNSFS

SEQ ID NO: 2475189 - protein, 18 aa, Entamoeba dispar
AMMLLMERCKVIIEGAGA

SEQ ID NO: 2475190 - protein, 19 aa, Entamoeba dispar
AMNCCANFAFANRGMITYR

SEQ ID NO: 2475191 - protein, 18 aa, Entamoeba dispar
AMNKGCIMACNNLAVLQM

SEQ ID NO: 2475192 - protein, 18 aa, Entamoeba dispar
AMNSICKFHGRFNSTKEI

SEQ ID NO: 2475193 - protein, 17 aa, Entamoeba dispar
AMRKILKFLNSIDKAKY

SEQ ID NO: 2475194 - protein, 18 aa, Entamoeba dispar
AMRKLWGEKRIRSTNELN

SEQ ID NO: 2475195 - protein, 27 aa, Entamoeba dispar
AMVTYKKKHCYAFLFSDELVFAKEQAV

SEQ ID NO: 2475196 - protein, 23 aa, Entamoeba dispar
AMYTVKCQIIISDIGINYPINSE

SEQ ID NO: 2475197 - protein, 23 aa, Entamoeba dispar
ANAKQIGVLACTWNVNQTVFTRH

SEQ ID NO: 2475198 - protein, 17 aa, Entamoeba dispar
ANATLLRNLAKGAVEYS

SEQ ID NO: 2475199 - protein, 21 aa, Entamoeba dispar
ANCDEKGPLMMYVSKMIPTND

SEQ ID NO: 2475200 - protein, 25 aa, Entamoeba dispar
ANDIFKKGDIVVCQNEIPLEATYEA

SEQ ID NO: 2475201 - protein, 22 aa, Entamoeba dispar
ANDLIPLFEFLLMFIENNISGT

SEQ ID NO: 2475202 - protein, 25 aa, Entamoeba dispar
ANDMKWKTEMFDLKESLQIEQKKEI

SEQ ID NO: 2475203 - protein, 21 aa, Entamoeba dispar
ANEDRAVFLFLNEFFRETYVI

SEQ ID NO: 2475204 - protein, 22 aa, Entamoeba dispar
ANEILPSLPWGKVFEKDVFESP

SEQ ID NO: 2475205 - protein, 25 aa, Entamoeba dispar
ANEKFKGDVIALYEYLYAGNPIPLI

SEQ ID NO: 2475206 - protein, 24 aa, Entamoeba dispar
ANEKFKGDVIALYEYLYAGNPITF

SEQ ID NO: 2475207 - protein, 19 aa, Entamoeba dispar
ANEKINFYFKQIITGIQYI

SEQ ID NO: 2475208 - protein, 20 aa, Entamoeba dispar
ANEMLIILNYSIEWLNKEES

SEQ ID NO: 2475209 - protein, 28 aa, Entamoeba dispar
ANETIRLALWQLYLTWTNVFPAQTLNQI

SEQ ID NO: 2475210 - protein, 18 aa, Entamoeba dispar
ANEYPVYSPIISFNQKIT

SEQ ID NO: 2475211 - protein, 24 aa, Entamoeba dispar
ANEYRGGQCIYAIVDYLQSEEFLQ

SEQ ID NO: 2475212 - protein, 18 aa, Entamoeba dispar
ANFAFANRGMITYRIRQA

SEQ ID NO: 2475213 - protein, 18 aa, Entamoeba dispar
ANFDEWAFCISNVSNANI

SEQ ID NO: 2475214 - protein, 18 aa, Entamoeba dispar
ANFIRSMSAYAIVSYILQ

SEQ ID NO: 2475215 - protein, 17 aa, Entamoeba dispar
ANGSVLDEAYCIECIPS

SEQ ID NO: 2475216 - protein, 20 aa, Entamoeba dispar
ANGYCKICGCHYTQHANSRY

SEQ ID NO: 2475217 - protein, 20 aa, Entamoeba dispar
ANGYCKVCGCHYTQHANVEY

SEQ ID NO: 2475218 - protein, 21 aa, Entamoeba dispar
ANGYCNVCGCHYIQHTNSPYR

SEQ ID NO: 2475219 - protein, 23 aa, Entamoeba dispar
ANGYCNVCGCYYTHHANAEYRWE

SEQ ID NO: 2475220 - protein, 23 aa, Entamoeba dispar
ANGYCNVCGCYYTHHANSKYRWD

SEQ ID NO: 2475221 - protein, 19 aa, Entamoeba dispar
ANHKACTFQCSCCKDKTHI

SEQ ID NO: 2475222 - protein, 25 aa, Entamoeba dispar
ANHPEMIKQLSVIFLERISKGICVD

SEQ ID NO: 2475223 - protein, 26 aa, Entamoeba dispar
ANHRPATCKMWKNWQELMQRDGLNLK

SEQ ID NO: 2475224 - protein, 17 aa, Entamoeba dispar
ANIFKIELDDMNFEKDL

SEQ ID NO: 2475225 - protein, 19 aa, Entamoeba dispar
ANIFQKCIVNWKYDSCFGK

SEQ ID NO: 2475226 - protein, 20 aa, Entamoeba dispar
ANIFSISWKTPISLDLSLPL

SEQ ID NO: 2475227 - protein, 27 aa, Entamoeba dispar
ANIGESCRRWCFLRIDIASTVPESFYQ

SEQ ID NO: 2475228 - protein, 18 aa, Entamoeba dispar
ANIIASLLTELNSETVGE

SEQ ID NO: 2475229 - protein, 25 aa, Entamoeba dispar
ANIKAMIKLLCTIFPISDFWEHVCI

SEQ ID NO: 2475230 - protein, 24 aa, Entamoeba dispar
ANILFKGRSKLVIGGALVAGGYSD

SEQ ID NO: 2475231 - protein, 18 aa, Entamoeba dispar
ANIYKDFAVFCIADGCGM

SEQ ID NO: 2475232 - protein, 22 aa, Entamoeba dispar
ANKCLPLGRSRDWHNALMDYGA

SEQ ID NO: 2475233 - protein, 18 aa, Entamoeba dispar
ANKCTKQILCIVLQMVYN

SEQ ID NO: 2475234 - protein, 22 aa, Entamoeba dispar
ANKGRPILPNTFEKGVIKKGEE

SEQ ID NO: 2475235 - protein, 18 aa, Entamoeba dispar
ANKIKIGLLGDMGVGKTC

SEQ ID NO: 2475236 - protein, 24 aa, Entamoeba dispar
ANKIKIGLLGDMGVGKTCIVQRFC

SEQ ID NO: 2475237 - protein, 23 aa, Entamoeba dispar
ANKRPEILVKIAVITERDRRDRE

SEQ ID NO: 2475238 - protein, 18 aa, Entamoeba dispar
ANLAVCFTPVLTRLSDTT

SEQ ID NO: 2475239 - protein, 17 aa, Entamoeba dispar
ANLKKAYTPEYWVCDAS

SEQ ID NO: 2475240 - protein, 17 aa, Entamoeba dispar
ANLNTLLLLMLNDDDDI

SEQ ID NO: 2475241 - protein, 18 aa, Entamoeba dispar
ANLYGRLMMELEQKIEEE

SEQ ID NO: 2475242 - protein, 19 aa, Entamoeba dispar
ANNLIELLLIFSSKKKMSK

SEQ ID NO: 2475243 - protein, 17 aa, Entamoeba dispar
ANPGGKIKYSFDRDTFV

SEQ ID NO: 2475244 - protein, 27 aa, Entamoeba dispar
ANPNIQICCRFWYKAIDPKMVIVWKPN

SEQ ID NO: 2475245 - protein, 23 aa, Entamoeba dispar
ANRRRTVQCIAHLSKYADDSQLQ

SEQ ID NO: 2475246 - protein, 19 aa, Entamoeba dispar
ANRYLAGKVTLAARADSCR

SEQ ID NO: 2475247 - protein, 17 aa, Entamoeba dispar
ANSFISRIIFIVRDSLE

SEQ ID NO: 2475248 - protein, 17 aa, Entamoeba dispar
ANSLFFVSINQPDKNSQ

SEQ ID NO: 2475249 - protein, 18 aa, Entamoeba dispar
ANSLLASLSHAFKSQLQS

SEQ ID NO: 2475250 - protein, 26 aa, Entamoeba dispar
ANSNGFKGMLLVSAKTGFHVEETMEN

SEQ ID NO: 2475251 - protein, 25 aa, Entamoeba dispar
ANSVLISLCSLFVVTRKVFTMKDFV

SEQ ID NO: 2475252 - protein, 22 aa, Entamoeba dispar
ANTCDECTFNFVLNKQSVICFI

SEQ ID NO: 2475253 - protein, 24 aa, Entamoeba dispar
ANTFLKHYTNFMVGYVPYGALFCI

SEQ ID NO: 2475254 - protein, 22 aa, Entamoeba dispar
ANTQKIRDCFNFYDRDYDGKID

SEQ ID NO: 2475255 - protein, 20 aa, Entamoeba dispar
ANVLINFCNQLGIGFGGSAE

SEQ ID NO: 2475256 - protein, 25 aa, Entamoeba dispar
ANVLKCIDTGAVIICGKNKLKPITE

SEQ ID NO: 2475257 - protein, 19 aa, Entamoeba dispar
ANVPLVIAGCVPQADPKAC

SEQ ID NO: 2475258 - protein, 18 aa, Entamoeba dispar
ANVRKDYAKSMLRMVQEF

SEQ ID NO: 2475259 - protein, 21 aa, Entamoeba dispar
ANYKCMCELQMLRNEKGFDYE

SEQ ID NO: 2475260 - protein, 22 aa, Entamoeba dispar
ANYKIEMAKVIPSLQYGMDCYL

SEQ ID NO: 2475261 - protein, 26 aa, Entamoeba dispar
APAIALEVFIRFFPIIPLKNTKTQRD

SEQ ID NO: 2475262 - protein, 28 aa, Entamoeba dispar
APALKILVRLCSLFPLIKKYVLACELFR

SEQ ID NO: 2475263 - protein, 17 aa, Entamoeba dispar
APALLFIDEIDAITPKR

SEQ ID NO: 2475264 - protein, 21 aa, Entamoeba dispar
APCNGFGHVLQRYNEITPSVQ

SEQ ID NO: 2475265 - protein, 17 aa, Entamoeba dispar
APCTGLGIISRDAAVKL

SEQ ID NO: 2475266 - protein, 18 aa, Entamoeba dispar
APDFVFYNDPCCFRTTEE

SEQ ID NO: 2475267 - protein, 29 aa, Entamoeba dispar
APDNLKTKFVYYSRDWEDFLKSNNHSISV

SEQ ID NO: 2475268 - protein, 23 aa, Entamoeba dispar
APEARYGKKLCFYINGHVFAAPD

SEQ ID NO: 2475269 - protein, 23 aa, Entamoeba dispar
APECPTACILFHSMSRLLTMFSQ

SEQ ID NO: 2475270 - protein, 24 aa, Entamoeba dispar
APEKCKPYAFPVLDVLEKYHLEKK

SEQ ID NO: 2475271 - protein, 24 aa, Entamoeba dispar
APENSIFCSAVFHFIDQDSFDKFC

SEQ ID NO: 2475272 - protein, 19 aa, Entamoeba dispar
APEPIKLMIDPTRYVIIPR

SEQ ID NO: 2475273 - protein, 19 aa, Entamoeba dispar
APEPLRFILSVYDSNSREK

SEQ ID NO: 2475274 - protein, 28 aa, Entamoeba dispar
APEVVPICSFLIKPGYVISGSISDNSFY

SEQ ID NO: 2475275 - protein, 17 aa, Entamoeba dispar
APFNLLICKQTLGEIED

SEQ ID NO: 2475276 - protein, 17 aa, Entamoeba dispar
APFVLTESMIYVFAGER

SEQ ID NO: 2475277 - protein, 17 aa, Entamoeba dispar
APGPVSVFIKLNQNGRF

SEQ ID NO: 2475278 - protein, 26 aa, Entamoeba dispar
APHSIAHSFALYIGWVKTESIPSTIY

SEQ ID NO: 2475279 - protein, 17 aa, Entamoeba dispar
APIFKGVLTQMQYQEFL

SEQ ID NO: 2475280 - protein, 22 aa, Entamoeba dispar
APIIPICAQLKYNMDVVCEYIC

SEQ ID NO: 2475281 - protein, 29 aa, Entamoeba dispar
APIMGRRADYMWGLGYRKALMIEKLKMEG

SEQ ID NO: 2475282 - protein, 22 aa, Entamoeba dispar
APITCVNWSLTNNFLFCSGDEK

SEQ ID NO: 2475283 - protein, 19 aa, Entamoeba dispar
APKHYTWHYVVRSYDSGKN

SEQ ID NO: 2475284 - protein, 17 aa, Entamoeba dispar
APLFRAILMNLQKTVIE

SEQ ID NO: 2475285 - protein, 17 aa, Entamoeba dispar
APLGLSEQSMLLMKKYK

SEQ ID NO: 2475286 - protein, 23 aa, Entamoeba dispar
APLIPGIIEKVVHSFQCEDDYVD

SEQ ID NO: 2475287 - protein, 23 aa, Entamoeba dispar
APLPEQAIACIIKGVVNGLEALH

SEQ ID NO: 2475288 - protein, 17 aa, Entamoeba dispar
APLQAMLFGLQLQPLPT

SEQ ID NO: 2475289 - protein, 18 aa, Entamoeba dispar
APLRCLYTTFTDTITSHL

SEQ ID NO: 2475290 - protein, 20 aa, Entamoeba dispar
APLTYGLYEWLRVCTGAYIM

SEQ ID NO: 2475291 - protein, 21 aa, Entamoeba dispar
APNFKEMYLFGDFNKWDRATA

SEQ ID NO: 2475292 - protein, 18 aa, Entamoeba dispar
APNHMIFILTGPVQNGEE

SEQ ID NO: 2475293 - protein, 21 aa, Entamoeba dispar
APNIIKLCIGFNEDSIKKRGI

SEQ ID NO: 2475294 - protein, 23 aa, Entamoeba dispar
APNNRKFLRDSIITVKAKSKLVA

SEQ ID NO: 2475295 - protein, 42 aa, Entamoeba dispar
APNRRGLPGFGMEWLEEISLNYGGLCMKDLLTSVDIMKKESY

SEQ ID NO: 2475296 - protein, 18 aa, Entamoeba dispar
APNSEVWNLAKTMSDAYE

SEQ ID NO: 2475297 - protein, 23 aa, Entamoeba dispar
APNYCYKCNNLAAIMELSDTGEY

SEQ ID NO: 2475298 - protein, 22 aa, Entamoeba dispar
APNYCYRCTNDAAIFVIKGENK

SEQ ID NO: 2475299 - protein, 17 aa, Entamoeba dispar
APPEETEEFQLKKFNEM

SEQ ID NO: 2475300 - protein, 23 aa, Entamoeba dispar
APPFTRKCIIATNIAETSITIDG

SEQ ID NO: 2475301 - protein, 18 aa, Entamoeba dispar
APPHIFHHFKLYSEGLTF

SEQ ID NO: 2475302 - protein, 17 aa, Entamoeba dispar
APPKLRYNTSLNNAILP

SEQ ID NO: 2475303 - protein, 17 aa, Entamoeba dispar
APPLWLSQNSIRPEDIL

SEQ ID NO: 2475304 - protein, 25 aa, Entamoeba dispar
APPVPAPRRGLMLGRRSINETSSEE

SEQ ID NO: 2475305 - protein, 25 aa, Entamoeba dispar
APPVPAPRRGLMLGRRSVQQTTSSE

SEQ ID NO: 2475306 - protein, 20 aa, Entamoeba dispar
APQQKGCQQPEYNTQQPIPQ

SEQ ID NO: 2475307 - protein, 18 aa, Entamoeba dispar
APQYLLLQLNRFSIASDH

SEQ ID NO: 2475308 - protein, 23 aa, Entamoeba dispar
APRFPDRCVNGFEKIRLEDGKIV

SEQ ID NO: 2475309 - protein, 18 aa, Entamoeba dispar
APSGILALIHHPSFSTEK

SEQ ID NO: 2475310 - protein, 28 aa, Entamoeba dispar
APSLKLKFIKNFHETIGMYPRSDQLSVI

SEQ ID NO: 2475311 - protein, 17 aa, Entamoeba dispar
APSNWLIEVAKKSGLEY

SEQ ID NO: 2475312 - protein, 25 aa, Entamoeba dispar
APTFAPKLFNKWSYDVTVSDISLKE

SEQ ID NO: 2475313 - protein, 26 aa, Entamoeba dispar
APTGCGKTLTALLCMLREVKMHQHDM

SEQ ID NO: 2475314 - protein, 18 aa, Entamoeba dispar
APTKSLHGHSHFISDLVL

SEQ ID NO: 2475315 - protein, 17 aa, Entamoeba dispar
APVKILMITPKVGIPQL

SEQ ID NO: 2475316 - protein, 19 aa, Entamoeba dispar
APVPIDFNSHFSRIGKEGT

SEQ ID NO: 2475317 - protein, 23 aa, Entamoeba dispar
AQADAFMKIALSIVQERKEELEL

SEQ ID NO: 2475318 - protein, 22 aa, Entamoeba dispar
AQCHPACKAKEISIQIVVDQGN

SEQ ID NO: 2475319 - protein, 25 aa, Entamoeba dispar
AQDEPKNIITFGICFNKEEIKEKFI

SEQ ID NO: 2475320 - protein, 24 aa, Entamoeba dispar
AQDSLLKTKMKSEIEAKKKLEILE

SEQ ID NO: 2475321 - protein, 23 aa, Entamoeba dispar
AQEELDYKPGIYTQWESAYNHED

SEQ ID NO: 2475322 - protein, 22 aa, Entamoeba dispar
AQEYRKPFGSKRGRKGGFNRRG

SEQ ID NO: 2475323 - protein, 17 aa, Entamoeba dispar
AQGLPATSIVELLSMIV

SEQ ID NO: 2475324 - protein, 22 aa, Entamoeba dispar
AQGRLDSFFSVKKVPLSKSEAA

SEQ ID NO: 2475325 - protein, 26 aa, Entamoeba dispar
AQINLALCYLWGCGVKKSIDDAKKCY

SEQ ID NO: 2475326 - protein, 18 aa, Entamoeba dispar
AQINNGLLYLLRTLGYSF

SEQ ID NO: 2475327 - protein, 19 aa, Entamoeba dispar
AQINNGLLYLLRTLGYSFS

SEQ ID NO: 2475328 - protein, 25 aa, Entamoeba dispar
AQIVKDLKIVFGIEDDLKCFLRKES

SEQ ID NO: 2475329 - protein, 27 aa, Entamoeba dispar
AQKFPTPRLGLIEVIKGEVSKPNVNTV

SEQ ID NO: 2475330 - protein, 22 aa, Entamoeba dispar
AQKIPLFIAAGCESTFKIVAYT

SEQ ID NO: 2475331 - protein, 21 aa, Entamoeba dispar
AQKQKKCIFVKGFPNSWKIKD

SEQ ID NO: 2475332 - protein, 18 aa, Entamoeba dispar
AQLARIDAVLAMKEPELY

SEQ ID NO: 2475333 - protein, 20 aa, Entamoeba dispar
AQLNISREIYLPDEMEANEI

SEQ ID NO: 2475334 - protein, 24 aa, Entamoeba dispar
AQLSSPNRITCDVRILVLSSQHED

SEQ ID NO: 2475335 - protein, 20 aa, Entamoeba dispar
AQLVHCLRLVGFDYVFDINS

SEQ ID NO: 2475336 - protein, 19 aa, Entamoeba dispar
AQNMLRLYMEPDLVSGKGK

SEQ ID NO: 2475337 - protein, 23 aa, Entamoeba dispar
AQQLCKLNHAISLPLVKLNLSNL

SEQ ID NO: 2475338 - protein, 20 aa, Entamoeba dispar
AQQLRVMLMLSKKLKQKRID

SEQ ID NO: 2475339 - protein, 17 aa, Entamoeba dispar
AQQWIKPGMSDLFVAEN

SEQ ID NO: 2475340 - protein, 17 aa, Entamoeba dispar
AQRAGRAGRNFEGYCYR

SEQ ID NO: 2475341 - protein, 24 aa, Entamoeba dispar
AQSGRLYALGLIFGGHGKEILTII

SEQ ID NO: 2475342 - protein, 20 aa, Entamoeba dispar
AQSIAIPFELWYLEANYTCI

SEQ ID NO: 2475343 - protein, 20 aa, Entamoeba dispar
AQSIIRGFLYHKRYITYKAF

SEQ ID NO: 2475344 - protein, 25 aa, Entamoeba dispar
AQSLKTIMIPPGITIVQAVSVSLEN

SEQ ID NO: 2475345 - protein, 18 aa, Entamoeba dispar
AQVLGIRETDRWYYGGGL

SEQ ID NO: 2475346 - protein, 24 aa, Entamoeba dispar
AQVLSGTFTHTWPPVTSEGCLKDT

SEQ ID NO: 2475347 - protein, 25 aa, Entamoeba dispar
AQVLSRLTFTSALAYLRKISSPVEG

SEQ ID NO: 2475348 - protein, 18 aa, Entamoeba dispar
AQVNIVRKVIEILIDQNF

SEQ ID NO: 2475349 - protein, 18 aa, Entamoeba dispar
AQVRLCLQTEDFSFIKTF

SEQ ID NO: 2475350 - protein, 26 aa, Entamoeba dispar
AQWKYWPYSLHCHRLMIYANTIGKGN

SEQ ID NO: 2475351 - protein, 19 aa, Entamoeba dispar
AQYFLEKYFSILYYRNNDK

SEQ ID NO: 2475352 - protein, 18 aa, Entamoeba dispar
AQYKIVFSHHCPTTSLSK

SEQ ID NO: 2475353 - protein, 23 aa, Entamoeba dispar
ARAAEEKELKERVGREEEARAKE

SEQ ID NO: 2475354 - protein, 19 aa, Entamoeba dispar
ARAATPCIIFIDEIDTVVG

SEQ ID NO: 2475355 - protein, 17 aa, Entamoeba dispar
ARAECLMLMHSAKNLQT

SEQ ID NO: 2475356 - protein, 17 aa, Entamoeba dispar
ARAGIHVSETLKSYNDK

SEQ ID NO: 2475357 - protein, 18 aa, Entamoeba dispar
ARALQSCKMHGMKNNIQL

SEQ ID NO: 2475358 - protein, 21 aa, Entamoeba dispar
ARANMKIGRIEDVTPIPTDCT

SEQ ID NO: 2475359 - protein, 22 aa, Entamoeba dispar
ARATFCYAATVALNYSLACGVD

SEQ ID NO: 2475360 - protein, 17 aa, Entamoeba dispar
ARCWCYETAAACDLNIP

SEQ ID NO: 2475361 - protein, 17 aa, Entamoeba dispar
ARDAHLIKISTWNEFMD

SEQ ID NO: 2475362 - protein, 17 aa, Entamoeba dispar
ARDAYRRFIQNYNTLKF

SEQ ID NO: 2475363 - protein, 24 aa, Entamoeba dispar
ARDGCGRTPLHVAVVMNDAVSVKK

SEQ ID NO: 2475364 - protein, 18 aa, Entamoeba dispar
ARDIKRLIHIKGKKNPFA

SEQ ID NO: 2475365 - protein, 18 aa, Entamoeba dispar
ARDPRLEQNYSLVCIELI

SEQ ID NO: 2475366 - protein, 17 aa, Entamoeba dispar
AREALGLIVEMVKAKRM

SEQ ID NO: 2475367 - protein, 23 aa, Entamoeba dispar
AREFLKKPIEIICGGRSQVSNTI

SEQ ID NO: 2475368 - protein, 25 aa, Entamoeba dispar
AREGKKCQPGWVCDRSGKVLSEPGP

SEQ ID NO: 2475369 - protein, 22 aa, Entamoeba dispar
AREMSNAVLYSSLTNCKTETVT

SEQ ID NO: 2475370 - protein, 24 aa, Entamoeba dispar
ARFQLPQSILLSGISIKNEPYSNA

SEQ ID NO: 2475371 - protein, 24 aa, Entamoeba dispar
ARGIYKVRFYAMVRNSSGEIKSEI

SEQ ID NO: 2475372 - protein, 21 aa, Entamoeba dispar
ARGQALLARHGILGCIFKDKF

SEQ ID NO: 2475373 - protein, 18 aa, Entamoeba dispar
ARHAKRWGVPVLNHQWLF

SEQ ID NO: 2475374 - protein, 17 aa, Entamoeba dispar
ARHIISLYWGHEIITDA

SEQ ID NO: 2475375 - protein, 20 aa, Entamoeba dispar
ARIDYMKSRALLGSTELREM

SEQ ID NO: 2475376 - protein, 43 aa, Entamoeba dispar
ARIFRALFELLLIKRWARPALKALELCKSVTRRLFNSQCPLRQ

SEQ ID NO: 2475377 - protein, 18 aa, Entamoeba dispar
ARIFVWKLVLGYYQFDMT

SEQ ID NO: 2475378 - protein, 17 aa, Entamoeba dispar
ARITFLMMLSKTLEGRK

SEQ ID NO: 2475379 - protein, 18 aa, Entamoeba dispar
ARITIWIKTNEYITLTNF

SEQ ID NO: 2475380 - protein, 19 aa, Entamoeba dispar
ARKAFPCFDEPNYKATFDI

SEQ ID NO: 2475381 - protein, 23 aa, Entamoeba dispar
ARKERLKQLALERIDLSKDPYFY

SEQ ID NO: 2475382 - protein, 19 aa, Entamoeba dispar
ARKQGIRYTIGEKMKVGIM

SEQ ID NO: 2475383 - protein, 20 aa, Entamoeba dispar
ARLCSYKFVDYFLNRVSNKP

SEQ ID NO: 2475384 - protein, 19 aa, Entamoeba dispar
ARLKPSHLANKEIVTQLYI

SEQ ID NO: 2475385 - protein, 21 aa, Entamoeba dispar
ARLKSIIPPLTFDSHKGGCGK

SEQ ID NO: 2475386 - protein, 17 aa, Entamoeba dispar
ARLLIKYLKNGKIQSLH

SEQ ID NO: 2475387 - protein, 22 aa, Entamoeba dispar
ARLPIEQHIECIGRKVLTVNQV

SEQ ID NO: 2475388 - protein, 17 aa, Entamoeba dispar
ARLQKMKKLESDAAKGG

SEQ ID NO: 2475389 - protein, 19 aa, Entamoeba dispar
ARMQCVIDALLVPENRVSW

SEQ ID NO: 2475390 - protein, 17 aa, Entamoeba dispar
ARNGLTVLISMYDILLT

SEQ ID NO: 2475391 - protein, 19 aa, Entamoeba dispar
ARNIHCIDSTFIITKDYFS

SEQ ID NO: 2475392 - protein, 21 aa, Entamoeba dispar
ARNILPYVSIFLVDDHKDVRN

SEQ ID NO: 2475393 - protein, 22 aa, Entamoeba dispar
ARNKPFLMKSFSKKQMKKEEDR

SEQ ID NO: 2475394 - protein, 29 aa, Entamoeba dispar
ARNTFLTLFFLRYCFRPFSKVPSILKILH

SEQ ID NO: 2475395 - protein, 20 aa, Entamoeba dispar
ARNVFGNTLALAGKISGVHW

SEQ ID NO: 2475396 - protein, 17 aa, Entamoeba dispar
ARNVVCLDPNSYEEGVE

SEQ ID NO: 2475397 - protein, 25 aa, Entamoeba dispar
ARPIMSSLLVCYTKYLKSVSKEWKQ

SEQ ID NO: 2475398 - protein, 19 aa, Entamoeba dispar
ARPIPQQQIYFDNLSSSSS

SEQ ID NO: 2475399 - protein, 22 aa, Entamoeba dispar
ARPKNGRTLNIFQRRTNCTVLV

SEQ ID NO: 2475400 - protein, 20 aa, Entamoeba dispar
ARQFTTKKGIPFFETSALQR

SEQ ID NO: 2475401 - protein, 25 aa, Entamoeba dispar
ARQYQKICIRDCVYIPEKKYIDVKD

SEQ ID NO: 2475402 - protein, 25 aa, Entamoeba dispar
ARRKAGKKILKIQCGMGHHNTVGYS

SEQ ID NO: 2475403 - protein, 19 aa, Entamoeba dispar
ARRLAIGLLNGFDQPIKNI

SEQ ID NO: 2475404 - protein, 19 aa, Entamoeba dispar
ARSLVQYEPFFGEFAIYEV

SEQ ID NO: 2475405 - protein, 21 aa, Entamoeba dispar
ARSVFSLPAQLRSAAANRDDD

SEQ ID NO: 2475406 - protein, 24 aa, Entamoeba dispar
ARTKKQCVKSIIGHNCDVNVVNWN

SEQ ID NO: 2475407 - protein, 20 aa, Entamoeba dispar
ARVIGLKLNLSFENGEVKEN

SEQ ID NO: 2475408 - protein, 26 aa, Entamoeba dispar
ARVILFFFDLTRVMTLNNIKDWYKEA

SEQ ID NO: 2475409 - protein, 17 aa, Entamoeba dispar
ARVKGEIPEDGIPYSKD

SEQ ID NO: 2475410 - protein, 19 aa, Entamoeba dispar
ARVLEPYSSIELSHISKLV

SEQ ID NO: 2475411 - protein, 19 aa, Entamoeba dispar
ARVMRMCKHPNLVDYYDYF

SEQ ID NO: 2475412 - protein, 18 aa, Entamoeba dispar
ARVSAGSVIGIFVDYNCL

SEQ ID NO: 2475413 - protein, 17 aa, Entamoeba dispar
ARVVRICTHPDVTSMGY

SEQ ID NO: 2475414 - protein, 21 aa, Entamoeba dispar
ARWYYHCDTIGIIVWQDMPSR

SEQ ID NO: 2475415 - protein, 17 aa, Entamoeba dispar
ARYLIDIALKRHSFDNI

SEQ ID NO: 2475416 - protein, 20 aa, Entamoeba dispar
ARYLVDLALFKQSLDNVTVS

SEQ ID NO: 2475417 - protein, 17 aa, Entamoeba dispar
ARYRLSHFKCIRKALKH

SEQ ID NO: 2475418 - protein, 21 aa, Entamoeba dispar
ARYRYLKEITALILDTLDGDN

SEQ ID NO: 2475419 - protein, 23 aa, Entamoeba dispar
ASAAGFFGCQGRVLFEENHPTID

SEQ ID NO: 2475420 - protein, 21 aa, Entamoeba dispar
ASAAGFFGCQGRVVFEENHPT

SEQ ID NO: 2475421 - protein, 18 aa, Entamoeba dispar
ASAEVSRPNVLLESLEKR

SEQ ID NO: 2475422 - protein, 27 aa, Entamoeba dispar
ASAEWWKEAICLCCAIHAPCDGVLVSP

SEQ ID NO: 2475423 - protein, 25 aa, Entamoeba dispar
ASAKTCGVVFGMLKQLERFRDQENT

SEQ ID NO: 2475424 - protein, 20 aa, Entamoeba dispar
ASALKQLYKKFGYSNNNPKV

SEQ ID NO: 2475425 - protein, 25 aa, Entamoeba dispar
ASDEFKGKCVLAINSKDKKGDRRYL

SEQ ID NO: 2475426 - protein, 34 aa, Entamoeba dispar
ASDIWSCGVMLYNMLFLFPFKKPKNMYELQLTDD

SEQ ID NO: 2475427 - protein, 18 aa, Entamoeba dispar
ASEHAFKNSFCFEQGVLL

SEQ ID NO: 2475428 - protein, 29 aa, Entamoeba dispar
ASEKQKLCWELCKIRCQLAMEDQFYKYAQ

SEQ ID NO: 2475429 - protein, 28 aa, Entamoeba dispar
ASEKQKLCWELCKIRCQLAMEDQFYTYA

SEQ ID NO: 2475430 - protein, 41 aa, Entamoeba dispar
ASELPMDVTIKMWDKMFCEIRGMRYLFAFLASMILEIECLI

SEQ ID NO: 2475431 - protein, 21 aa, Entamoeba dispar
ASENRLINDFLRERETGRLDL

SEQ ID NO: 2475432 - protein, 22 aa, Entamoeba dispar
ASENRLINDFLRERETGRLDLE

SEQ ID NO: 2475433 - protein, 21 aa, Entamoeba dispar
ASERICFKINQLLNERRNGFI

SEQ ID NO: 2475434 - protein, 24 aa, Entamoeba dispar
ASFGCIRVGSWINKYNSLVSTITP

SEQ ID NO: 2475435 - protein, 20 aa, Entamoeba dispar
ASFGGLLLMLYGKPEKLSAY

SEQ ID NO: 2475436 - protein, 21 aa, Entamoeba dispar
ASFLERHVDKFIKGERKFVIK

SEQ ID NO: 2475437 - protein, 17 aa, Entamoeba dispar
ASFNGLINGCLNNTPQF

SEQ ID NO: 2475438 - protein, 18 aa, Entamoeba dispar
ASFTSFITSYSWASSNIT

SEQ ID NO: 2475439 - protein, 18 aa, Entamoeba dispar
ASFYERAGMVECLGSPKR

SEQ ID NO: 2475440 - protein, 23 aa, Entamoeba dispar
ASGDEKGSVILWDIKYGEHVKKI

SEQ ID NO: 2475441 - protein, 24 aa, Entamoeba dispar
ASGLMAKERYGLLIIDSATALYRT

SEQ ID NO: 2475442 - protein, 19 aa, Entamoeba dispar
ASGNKLVAICRFNEESNWW

SEQ ID NO: 2475443 - protein, 19 aa, Entamoeba dispar
ASGNYAWNAGIFLWTAKTI

SEQ ID NO: 2475444 - protein, 27 aa, Entamoeba dispar
ASGRYKGDFPINIAFQNQRSCGILLET

SEQ ID NO: 2475445 - protein, 17 aa, Entamoeba dispar
ASGSFALAECLTGIDSN

SEQ ID NO: 2475446 - protein, 24 aa, Entamoeba dispar
ASGTRPCLYVPQSAFENLISKQVR

SEQ ID NO: 2475447 - protein, 19 aa, Entamoeba dispar
ASHALRWGVPVLSHQWLFD

SEQ ID NO: 2475448 - protein, 21 aa, Entamoeba dispar
ASHGKVVFLFIKLGEKEISST

SEQ ID NO: 2475449 - protein, 19 aa, Entamoeba dispar
ASHPNICLFNQPKTNTLQN

SEQ ID NO: 2475450 - protein, 27 aa, Entamoeba dispar
ASHQIRRLTYQLIKFILQICYISDIST

SEQ ID NO: 2475451 - protein, 28 aa, Entamoeba dispar
ASHTFCQFCIFHGFKIILVSRRSIEIGG

SEQ ID NO: 2475452 - protein, 19 aa, Entamoeba dispar
ASHVSELFSSVLDSLDMKF

SEQ ID NO: 2475453 - protein, 23 aa, Entamoeba dispar
ASIFPKVKLSNFGLCDQIENSVI

SEQ ID NO: 2475454 - protein, 18 aa, Entamoeba dispar
ASIKGHFFIDHGVGVVIG

SEQ ID NO: 2475455 - protein, 22 aa, Entamoeba dispar
ASIKMCIEILIEYCDKLIPPQL

SEQ ID NO: 2475456 - protein, 19 aa, Entamoeba dispar
ASILLACKLSGTKNVELAN

SEQ ID NO: 2475457 - protein, 24 aa, Entamoeba dispar
ASIPSMLKSDVCRLKRCVTQPSMI

SEQ ID NO: 2475458 - protein, 22 aa, Entamoeba dispar
ASKDLRGRVSICGCGVLGNGKD

SEQ ID NO: 2475459 - protein, 24 aa, Entamoeba dispar
ASKFFASCVIGCWQIEHNTQNLVN

SEQ ID NO: 2475460 - protein, 19 aa, Entamoeba dispar
ASKHCKTVEHHAMSVYADA

SEQ ID NO: 2475461 - protein, 28 aa, Entamoeba dispar
ASKPCILPMIFRLFLRKDYTYEVFGLIC

SEQ ID NO: 2475462 - protein, 20 aa, Entamoeba dispar
ASKPFSCIVFKKSTPDQIIP

SEQ ID NO: 2475463 - protein, 23 aa, Entamoeba dispar
ASLARKLGAFFIETSCLNGSNVD

SEQ ID NO: 2475464 - protein, 17 aa, Entamoeba dispar
ASLERRTLTSFKLLLSS

SEQ ID NO: 2475465 - protein, 23 aa, Entamoeba dispar
ASLEVVESLAALTKGKKKEETKR

SEQ ID NO: 2475466 - protein, 18 aa, Entamoeba dispar
ASLFAFCVALLSKYFRIE

SEQ ID NO: 2475467 - protein, 18 aa, Entamoeba dispar
ASLLLLELFDKFYSIFNK

SEQ ID NO: 2475468 - protein, 19 aa, Entamoeba dispar
ASLLVKWDNVKEVSEMFKK

SEQ ID NO: 2475469 - protein, 23 aa, Entamoeba dispar
ASLMIYSYRVDDIYQAFANFAEL

SEQ ID NO: 2475470 - protein, 24 aa, Entamoeba dispar
ASLNYKVLICASTNVAVDRVLESL

SEQ ID NO: 2475471 - protein, 25 aa, Entamoeba dispar
ASLNYKVLICASTNVAVDRVLESLL

SEQ ID NO: 2475472 - protein, 24 aa, Entamoeba dispar
ASLPVLDALLCYSFIDRSILNSLC

SEQ ID NO: 2475473 - protein, 18 aa, Entamoeba dispar
ASLPYLILERQFKGKVLM

SEQ ID NO: 2475474 - protein, 17 aa, Entamoeba dispar
ASLSLKTLFGISSSDVI

SEQ ID NO: 2475475 - protein, 19 aa, Entamoeba dispar
ASLVYRLMNDLEFTIYIGT

SEQ ID NO: 2475476 - protein, 18 aa, Entamoeba dispar
ASLYAGKGNLEFNDPIPK

SEQ ID NO: 2475477 - protein, 17 aa, Entamoeba dispar
ASMKLGLDQAVLANITT

SEQ ID NO: 2475478 - protein, 17 aa, Entamoeba dispar
ASMKLYQPILIPRTLWL

SEQ ID NO: 2475479 - protein, 20 aa, Entamoeba dispar
ASPAGYRTATRLMLLAEQFA

SEQ ID NO: 2475480 - protein, 17 aa, Entamoeba dispar
ASPKYFAQLDKFKESET

SEQ ID NO: 2475481 - protein, 19 aa, Entamoeba dispar
ASPTIGLSLIKLHDFSCGI

SEQ ID NO: 2475482 - protein, 25 aa, Entamoeba dispar
ASQARKGDCQIAIIGDEDSVTGFLL

SEQ ID NO: 2475483 - protein, 18 aa, Entamoeba dispar
ASQCRESLIHTERLMATV

SEQ ID NO: 2475484 - protein, 24 aa, Entamoeba dispar
ASQIECYGEFPIYYTKTSVPICID

SEQ ID NO: 2475485 - protein, 19 aa, Entamoeba dispar
ASQKYIFDNIIDLFGKDVK

SEQ ID NO: 2475486 - protein, 26 aa, Entamoeba dispar
ASQMLELELGLLILKIGLNGTKTLIL

SEQ ID NO: 2475487 - protein, 24 aa, Entamoeba dispar
ASQQFAGLFFKCYETQFSSITSVT

SEQ ID NO: 2475488 - protein, 25 aa, Entamoeba dispar
ASRGWLDSKRPCMLTIENPFDETSN

SEQ ID NO: 2475489 - protein, 23 aa, Entamoeba dispar
ASRLCKKNTALLLDCKTHQTVNE

SEQ ID NO: 2475490 - protein, 25 aa, Entamoeba dispar
ASRLIKRSMDAIAFSKLLEVAEKAS

SEQ ID NO: 2475491 - protein, 21 aa, Entamoeba dispar
ASRRVKTEFLVQMNGVGNSME

SEQ ID NO: 2475492 - protein, 17 aa, Entamoeba dispar
ASSCQRSRSHSKPSSTS

SEQ ID NO: 2475493 - protein, 26 aa, Entamoeba dispar
ASSFINKRIENMLECFNKMLFFVDLL

SEQ ID NO: 2475494 - protein, 23 aa, Entamoeba dispar
ASSIKPHLVSMVFCCSTCKANKE

SEQ ID NO: 2475495 - protein, 19 aa, Entamoeba dispar
ASSLTSIYHELLIISHTNE

SEQ ID NO: 2475496 - protein, 25 aa, Entamoeba dispar
ASSRRYKKWLPFILAVLDAEKKTFV

SEQ ID NO: 2475497 - protein, 26 aa, Entamoeba dispar
ASTDERAKALSLLKILVTVTYEADND

SEQ ID NO: 2475498 - protein, 22 aa, Entamoeba dispar
ASTTRLYLRKGKGEQRIVKIYD

SEQ ID NO: 2475499 - protein, 18 aa, Entamoeba dispar
ASVIEFDREFHLKEKSKI

SEQ ID NO: 2475500 - protein, 19 aa, Entamoeba dispar
ASVMPEAGGVAFISQSGAL

SEQ ID NO: 2475501 - protein, 20 aa, Entamoeba dispar
ASVNAHLGKPVSRTDDLVSA

SEQ ID NO: 2475502 - protein, 19 aa, Entamoeba dispar
ASVPLPWAQVQQRIQAEEG

SEQ ID NO: 2475503 - protein, 20 aa, Entamoeba dispar
ASVSEIGNWCFGECSSLTSV

SEQ ID NO: 2475504 - protein, 27 aa, Entamoeba dispar
ASYFGPKGLRARYVIDAILYTSEGPVQ

SEQ ID NO: 2475505 - protein, 21 aa, Entamoeba dispar
ASYFLNCLCQGMVNKKTVTSL

SEQ ID NO: 2475506 - protein, 29 aa, Entamoeba dispar
ASYMCPRDGYKYSYIDAMDYYDTTTHRMF

SEQ ID NO: 2475507 - protein, 29 aa, Entamoeba dispar
ATAICVLHPSKFIIDRLVEELKVPKYKQY

SEQ ID NO: 2475508 - protein, 19 aa, Entamoeba dispar
ATCDLRPTIPPSTPQKMAT

SEQ ID NO: 2475509 - protein, 21 aa, Entamoeba dispar
ATCGYIPPLLYDVAVECVLSS

SEQ ID NO: 2475510 - protein, 29 aa, Entamoeba dispar
ATCSSIDVIVPWTHLYSKPIILRLGEVIV

SEQ ID NO: 2475511 - protein, 20 aa, Entamoeba dispar
ATDICYIYEWFVEKKQSIPF

SEQ ID NO: 2475512 - protein, 22 aa, Entamoeba dispar
ATDIHSLFDFPKPRQIDFLPYH

SEQ ID NO: 2475513 - protein, 17 aa, Entamoeba dispar
ATDLKHGCFDRCEQLSK

SEQ ID NO: 2475514 - protein, 18 aa, Entamoeba dispar
ATEGIDFDKRMMDLLEMK

SEQ ID NO: 2475515 - protein, 21 aa, Entamoeba dispar
ATELSFLTGLEVNSVSEALEA

SEQ ID NO: 2475516 - protein, 25 aa, Entamoeba dispar
ATFGSIIGSFALFFKSTGSSLTSSG

SEQ ID NO: 2475517 - protein, 25 aa, Entamoeba dispar
ATFIALADGCGWGDKPSFAAKLAVT

SEQ ID NO: 2475518 - protein, 24 aa, Entamoeba dispar
ATFQYGKTISLGWYNPSIPKEITM

SEQ ID NO: 2475519 - protein, 20 aa, Entamoeba dispar
ATGCGDGIVRLFKIGVTIDE

SEQ ID NO: 2475520 - protein, 18 aa, Entamoeba dispar
ATGGRRKSFSQQFKEKVQ

SEQ ID NO: 2475521 - protein, 31 aa, Entamoeba dispar
ATHPEYRLKITTLLPAFDFGMDIFIDKLPLT

SEQ ID NO: 2475522 - protein, 23 aa, Entamoeba dispar
ATHYSFKNKAAVMLITDTNIDIS

SEQ ID NO: 2475523 - protein, 19 aa, Entamoeba dispar
ATIPHLRLSDIDKKGRDFS

SEQ ID NO: 2475524 - protein, 25 aa, Entamoeba dispar
ATIPNAFEFASWISNIHKQVCHVVY

SEQ ID NO: 2475525 - protein, 17 aa, Entamoeba dispar
ATIWIPCLFEIPQENPV

SEQ ID NO: 2475526 - protein, 25 aa, Entamoeba dispar
ATKALPFLQIRSINFGNGDVFNFNQ

SEQ ID NO: 2475527 - protein, 19 aa, Entamoeba dispar
ATKFGCLFAEVTSVEGDSV

SEQ ID NO: 2475528 - protein, 29 aa, Entamoeba dispar
ATKRIRIGKFPKYLLIKLERQIILNYQDI

SEQ ID NO: 2475529 - protein, 24 aa, Entamoeba dispar
ATKYYLQKSCDFFISTYWPSYILN

SEQ ID NO: 2475530 - protein, 25 aa, Entamoeba dispar
ATLKFLRPCEIEALKYTCEIPFVHP

SEQ ID NO: 2475531 - protein, 18 aa, Entamoeba dispar
ATLLACKLAGIKNVSLAN

SEQ ID NO: 2475532 - protein, 23 aa, Entamoeba dispar
ATLPQIMILLLFNTHKVLKISEI

SEQ ID NO: 2475533 - protein, 25 aa, Entamoeba dispar
ATLRKSLCSKTKFKYSTRRKSADMT

SEQ ID NO: 2475534 - protein, 22 aa, Entamoeba dispar
ATLVPTVKCLINISDAPYKVIE

SEQ ID NO: 2475535 - protein, 19 aa, Entamoeba dispar
ATLVWKKVIINAGRALSDL

SEQ ID NO: 2475536 - protein, 43 aa, Entamoeba dispar
ATNCKKCHQTCHYPCHYLSLVSKFTMKYCHCIENGYCNVCGCH

SEQ ID NO: 2475537 - protein, 25 aa, Entamoeba dispar
ATNIEGADLFAVFDGHNGHEAATLC

SEQ ID NO: 2475538 - protein, 31 aa, Entamoeba dispar
ATNRPDCIDPAMLRPGRLDRLISVDLPNSDA

SEQ ID NO: 2475539 - protein, 28 aa, Entamoeba dispar
ATQAIYSFWLYDFCDVYLEASKVIFKGP

SEQ ID NO: 2475540 - protein, 24 aa, Entamoeba dispar
ATQLLKHPFIEWAPTSYFYKKYHH

SEQ ID NO: 2475541 - protein, 19 aa, Entamoeba dispar
ATQTSLRFTLQMLTPTSIV

SEQ ID NO: 2475542 - protein, 20 aa, Entamoeba dispar
ATQVCIKFTIANGSSVIPKS

SEQ ID NO: 2475543 - protein, 23 aa, Entamoeba dispar
ATRHPQMFPGFLEMLIEYKKQGG

SEQ ID NO: 2475544 - protein, 19 aa, Entamoeba dispar
ATRIRLLLNELNKQMSVYG

SEQ ID NO: 2475545 - protein, 25 aa, Entamoeba dispar
ATRVAKSFLAKVGRKYLLDIYKPFV

SEQ ID NO: 2475546 - protein, 20 aa, Entamoeba dispar
ATSITSCFAQMELIRIALKL

SEQ ID NO: 2475547 - protein, 18 aa, Entamoeba dispar
ATSLLKAYLRSMVEPLIP

SEQ ID NO: 2475548 - protein, 25 aa, Entamoeba dispar
ATSYFPFSGVHGVFLVYRNDDDMSF

SEQ ID NO: 2475549 - protein, 17 aa, Entamoeba dispar
ATTCLAPDVLRNLDVWE

SEQ ID NO: 2475550 - protein, 29 aa, Entamoeba dispar
ATTSMPPLYQARALFDFESKNAECLNVKT

SEQ ID NO: 2475551 - protein, 18 aa, Entamoeba dispar
ATVGCNIKFTDEVKRLNA

SEQ ID NO: 2475552 - protein, 19 aa, Entamoeba dispar
ATVITRAARQFEFRKMNKL

SEQ ID NO: 2475553 - protein, 19 aa, Entamoeba dispar
ATVLFPKDEAGAFYNPVQE

SEQ ID NO: 2475554 - protein, 23 aa, Entamoeba dispar
ATVLRIVKEYVDNGSILSSNQIS

SEQ ID NO: 2475555 - protein, 23 aa, Entamoeba dispar
ATVLYLGCEIVKIAYVGDCSVYL

SEQ ID NO: 2475556 - protein, 26 aa, Entamoeba dispar
ATYCRGKLVFKDGVFVGEKGYGKRVK

SEQ ID NO: 2475557 - protein, 17 aa, Entamoeba dispar
ATYDGYIVFIIKESLED

SEQ ID NO: 2475558 - protein, 18 aa, Entamoeba dispar
ATYFKMPSIFKLSISSFN

SEQ ID NO: 2475559 - protein, 22 aa, Entamoeba dispar
ATYFLCGSAEQFIRSYNSESGK

SEQ ID NO: 2475560 - protein, 27 aa, Entamoeba dispar
AVAHSCTKLGIRFIVIRSLSDVPSEDG

SEQ ID NO: 2475561 - protein, 24 aa, Entamoeba dispar
AVASYYKKEVSLFVSGEEAKVVVE

SEQ ID NO: 2475562 - protein, 17 aa, Entamoeba dispar
AVAYYKSKLDELLRTVV

SEQ ID NO: 2475563 - protein, 18 aa, Entamoeba dispar
AVCFAAMALEYAEQGITL

SEQ ID NO: 2475564 - protein, 17 aa, Entamoeba dispar
AVDGFVIDNAITKIKGN

SEQ ID NO: 2475565 - protein, 24 aa, Entamoeba dispar
AVDKFKYYWGESCELRRFRDGRLL

SEQ ID NO: 2475566 - protein, 18 aa, Entamoeba dispar
AVDLLMKVYREFLPHGGY

SEQ ID NO: 2475567 - protein, 19 aa, Entamoeba dispar
AVDLPPELAPLPPLPPKVH

SEQ ID NO: 2475568 - protein, 24 aa, Entamoeba dispar
AVDRCCSQGLPPVIPEQIFEMMDL

SEQ ID NO: 2475569 - protein, 23 aa, Entamoeba dispar
AVECCSKAGIIHCDVKPENILMT

SEQ ID NO: 2475570 - protein, 21 aa, Entamoeba dispar
AVECPCSLGNGNSNTICVYNI

SEQ ID NO: 2475571 - protein, 20 aa, Entamoeba dispar
AVEFFGEYEDAIPLISDMKN

SEQ ID NO: 2475572 - protein, 17 aa, Entamoeba dispar
AVELEYENSCIRLEHEN

SEQ ID NO: 2475573 - protein, 31 aa, Entamoeba dispar
AVELSNALFGFDGWSCCITNLNVDYVDVEKG

SEQ ID NO: 2475574 - protein, 18 aa, Entamoeba dispar
AVENCIKKSTLASFVVRT

SEQ ID NO: 2475575 - protein, 17 aa, Entamoeba dispar
AVENGLFTTNLVKKLMD

SEQ ID NO: 2475576 - protein, 21 aa, Entamoeba dispar
AVESIYNYLYDKGFTVPGIFR

SEQ ID NO: 2475577 - protein, 18 aa, Entamoeba dispar
AVFNKEYAYRVSTDSGTS

SEQ ID NO: 2475578 - protein, 24 aa, Entamoeba dispar
AVFPDRKGIVYGGADGRANVLHFE

SEQ ID NO: 2475579 - protein, 25 aa, Entamoeba dispar
AVFVSCSLIKFGVSIENALEYGIKH

SEQ ID NO: 2475580 - protein, 27 aa, Entamoeba dispar
AVHFKQIGLCKLVIPHWLSLEELKETL

SEQ ID NO: 2475581 - protein, 19 aa, Entamoeba dispar
AVKEASCGISKFKEEVEIK

SEQ ID NO: 2475582 - protein, 18 aa, Entamoeba dispar
AVKEGKCDQSVLEQLTAT

SEQ ID NO: 2475583 - protein, 17 aa, Entamoeba dispar
AVKESREKLFLLGASDA

SEQ ID NO: 2475584 - protein, 29 aa, Entamoeba dispar
AVKKSSWRFPIPVFRSLQYLLTHEGKELE

SEQ ID NO: 2475585 - protein, 18 aa, Entamoeba dispar
AVKMIRINPPKVLLYAPF

SEQ ID NO: 2475586 - protein, 20 aa, Entamoeba dispar
AVKQNCCEESLPLLNYILED

SEQ ID NO: 2475587 - protein, 23 aa, Entamoeba dispar
AVKREYLIYSWIFINTLDEKPFE

SEQ ID NO: 2475588 - protein, 19 aa, Entamoeba dispar
AVKSAVCKVNIDSDGRLAM

SEQ ID NO: 2475589 - protein, 33 aa, Entamoeba dispar
AVLEKMKSKGFDLLNNRFLILQGEVERIALMPA

SEQ ID NO: 2475590 - protein, 21 aa, Entamoeba dispar
AVLFKKELTAMKLSNTQVKSF

SEQ ID NO: 2475591 - protein, 17 aa, Entamoeba dispar
AVLKAVVTVPAYFDDSQ

SEQ ID NO: 2475592 - protein, 28 aa, Entamoeba dispar
AVLKFYNIAVEWLRQSLFSERILPDSEK

SEQ ID NO: 2475593 - protein, 25 aa, Entamoeba dispar
AVLQKRLHEELAQLVIQEGNCVCAD

SEQ ID NO: 2475594 - protein, 25 aa, Entamoeba dispar
AVLRMFYQICHAVAFMHSQNPPLCH

SEQ ID NO: 2475595 - protein, 17 aa, Entamoeba dispar
AVPQHSCEIPITGETVK

SEQ ID NO: 2475596 - protein, 18 aa, Entamoeba dispar
AVQAFKELIEEYLKPQVE

SEQ ID NO: 2475597 - protein, 27 aa, Entamoeba dispar
AVREPRGYIIDGVFPFLIDKEEEESQY

SEQ ID NO: 2475598 - protein, 22 aa, Entamoeba dispar
AVRGLCFHPNRPLVVSGGDDCV

SEQ ID NO: 2475599 - protein, 25 aa, Entamoeba dispar
AVRRDSCGVVRGMMSSVMNYLLNKD

SEQ ID NO: 2475600 - protein, 17 aa, Entamoeba dispar
AVRSCQWVDEVVDGIPY

SEQ ID NO: 2475601 - protein, 24 aa, Entamoeba dispar
AVSELRTAAFYVYSTIYQNYVIDD

SEQ ID NO: 2475602 - protein, 27 aa, Entamoeba dispar
AVSGRIGKMSLSFPWNKLDSQPVVVKI

SEQ ID NO: 2475603 - protein, 24 aa, Entamoeba dispar
AVSKKCATAIIFATINPFFSSETL

SEQ ID NO: 2475604 - protein, 18 aa, Entamoeba dispar
AVSLLLYYLVFNLSIEKR

SEQ ID NO: 2475605 - protein, 17 aa, Entamoeba dispar
AVSPLGILNDKERKVQV

SEQ ID NO: 2475606 - protein, 26 aa, Entamoeba dispar
AVSRAYYPGARWGITRRLIASSLQEK

SEQ ID NO: 2475607 - protein, 24 aa, Entamoeba dispar
AVTGKVLLKVCYKVGQSNEIPTVI

SEQ ID NO: 2475608 - protein, 24 aa, Entamoeba dispar
AVTPLLIKMFLKYQLKCSSIQEAI

SEQ ID NO: 2475609 - protein, 18 aa, Entamoeba dispar
AVVKRAAYLAYLKQENRI

SEQ ID NO: 2475610 - protein, 19 aa, Entamoeba dispar
AVVLIRFKCDYTITNKKNE

SEQ ID NO: 2475611 - protein, 18 aa, Entamoeba dispar
AVVQDIMLGNAMGKKRRQ

SEQ ID NO: 2475612 - protein, 18 aa, Entamoeba dispar
AVVSLLFELLDRLEKMQQ

SEQ ID NO: 2475613 - protein, 25 aa, Entamoeba dispar
AVVTRCALSLIVAGLKYGKPNKPSK

SEQ ID NO: 2475614 - protein, 17 aa, Entamoeba dispar
AVWPSYRTFVVHLIDSL

SEQ ID NO: 2475615 - protein, 18 aa, Entamoeba dispar
AVYCLKKYQKGIVAFINR

SEQ ID NO: 2475616 - protein, 23 aa, Entamoeba dispar
AVYKLLENIPMPWEEVKMVDVMY

SEQ ID NO: 2475617 - protein, 23 aa, Entamoeba dispar
AWENWPPHVVTFFKKMSADWDAE

SEQ ID NO: 2475618 - protein, 18 aa, Entamoeba dispar
AWGEAAGFNVPIFDFRNE

SEQ ID NO: 2475619 - protein, 18 aa, Entamoeba dispar
AWGTEFGRLKKKVFVFEL

SEQ ID NO: 2475620 - protein, 21 aa, Entamoeba dispar
AWIGCGAKILPGVRIGKNAVV

SEQ ID NO: 2475621 - protein, 18 aa, Entamoeba dispar
AWIKAICAHNMLRFEKVF

SEQ ID NO: 2475622 - protein, 18 aa, Entamoeba dispar
AWNYRGNVIDAYLSEKLP

SEQ ID NO: 2475623 - protein, 18 aa, Entamoeba dispar
AYACPLPPPPPVVGACPL

SEQ ID NO: 2475624 - protein, 17 aa, Entamoeba dispar
AYCARWIAKSLVHAGLC

SEQ ID NO: 2475625 - protein, 19 aa, Entamoeba dispar
AYCCKDCRNNSFIHCSLSN

SEQ ID NO: 2475626 - protein, 17 aa, Entamoeba dispar
AYCFDGKTRQCHIRGQM

SEQ ID NO: 2475627 - protein, 17 aa, Entamoeba dispar
AYCKMQVTIAGSDDHLF

SEQ ID NO: 2475628 - protein, 36 aa, Entamoeba dispar
AYCNGFLPKKEMYYCLCLVDYLVLNCPQFRPQVLNP

SEQ ID NO: 2475629 - protein, 20 aa, Entamoeba dispar
AYCRQLKCSINEDFQDIVTD

SEQ ID NO: 2475630 - protein, 18 aa, Entamoeba dispar
AYDKGWRIRTEFKRYQIQ

SEQ ID NO: 2475631 - protein, 24 aa, Entamoeba dispar
AYDLDFRKKLFLKLEEITGIKYPL

SEQ ID NO: 2475632 - protein, 20 aa, Entamoeba dispar
AYEKIPHIILHFNEITPKEK

SEQ ID NO: 2475633 - protein, 24 aa, Entamoeba dispar
AYERGEIPWSEYMKEREKYILDND

SEQ ID NO: 2475634 - protein, 24 aa, Entamoeba dispar
AYESCNACACFSAIVNESLARDLA

SEQ ID NO: 2475635 - protein, 17 aa, Entamoeba dispar
AYEYSNKMIKGITEVTA

SEQ ID NO: 2475636 - protein, 24 aa, Entamoeba dispar
AYHFKRYPITPTFITIEHNDLQEI

SEQ ID NO: 2475637 - protein, 30 aa, Entamoeba dispar
AYHNKFLPSLEMYYCLCFMDYAVKRNSNFR

SEQ ID NO: 2475638 - protein, 20 aa, Entamoeba dispar
AYHPLCFEGVTGLEKEVTYT

SEQ ID NO: 2475639 - protein, 17 aa, Entamoeba dispar
AYIGLYISGLGTEGALL

SEQ ID NO: 2475640 - protein, 18 aa, Entamoeba dispar
AYILFKYMIPEILMETKF

SEQ ID NO: 2475641 - protein, 17 aa, Entamoeba dispar
AYIMPIHMMEAIVEEES

SEQ ID NO: 2475642 - protein, 18 aa, Entamoeba dispar
AYKAMQAMNNKVFDGQPI

SEQ ID NO: 2475643 - protein, 19 aa, Entamoeba dispar
AYKIEVVYIADRKTAEGIM

SEQ ID NO: 2475644 - protein, 22 aa, Entamoeba dispar
AYKKNGFEVFGNVKYKKIDIIT

SEQ ID NO: 2475645 - protein, 39 aa, Entamoeba dispar
AYKKTSPISLYLTQCLSVIFEPPTSFSIINYCDDNKVKT

SEQ ID NO: 2475646 - protein, 28 aa, Entamoeba dispar
AYKMLHELSLEWSCLSFDIIPDTLGALR

SEQ ID NO: 2475647 - protein, 22 aa, Entamoeba dispar
AYKRRGQVKLALGQTQSALEDF

SEQ ID NO: 2475648 - protein, 26 aa, Entamoeba dispar
AYKVIKRIDAFEIINSIIPSYSSGLF

SEQ ID NO: 2475649 - protein, 24 aa, Entamoeba dispar
AYLDGCTYVEFRLLQFKVQIKDYH

SEQ ID NO: 2475650 - protein, 20 aa, Entamoeba dispar
AYLHECFDFEKLKQFVSKYH

SEQ ID NO: 2475651 - protein, 20 aa, Entamoeba dispar
AYLQMDWTKKGNLTPLINRA

SEQ ID NO: 2475652 - protein, 23 aa, Entamoeba dispar
AYLSRTGYVDVVICEDSDMIPYG

SEQ ID NO: 2475653 - protein, 19 aa, Entamoeba dispar
AYNICYSTCLGYVDDINIE

SEQ ID NO: 2475654 - protein, 29 aa, Entamoeba dispar
AYNRLEAFILMIYRMIDLYSNQKNYSSLC

SEQ ID NO: 2475655 - protein, 27 aa, Entamoeba dispar
AYPERKLYYFICSAIILKNGDQIVEKQ

SEQ ID NO: 2475656 - protein, 24 aa, Entamoeba dispar
AYPFCLPASLSLPKKSYNKMFERQ

SEQ ID NO: 2475657 - protein, 23 aa, Entamoeba dispar
AYPHKKCMTKSRIVKLDNVGKAV

SEQ ID NO: 2475658 - protein, 21 aa, Entamoeba dispar
AYQGTIDWMKEYLMMKGNKKE

SEQ ID NO: 2475659 - protein, 19 aa, Entamoeba dispar
AYQQFKIPILMDVKDLICE

SEQ ID NO: 2475660 - protein, 19 aa, Entamoeba dispar
AYQTLPFVRVDSIYFSNED

SEQ ID NO: 2475661 - protein, 17 aa, Entamoeba dispar
AYRKLAIKYHPDKNPGD

SEQ ID NO: 2475662 - protein, 20 aa, Entamoeba dispar
AYRMKVYDSTICFVVSHLAA

SEQ ID NO: 2475663 - protein, 17 aa, Entamoeba dispar
AYSQLFGVVSSMIDNNT

SEQ ID NO: 2475664 - protein, 18 aa, Entamoeba dispar
AYTLPRLDLDSIKSKKIS

SEQ ID NO: 2475665 - protein, 17 aa, Entamoeba dispar
AYVTAALFLGPRQLGKM

SEQ ID NO: 2475666 - protein, 31 aa, Entamoeba dispar
AYYDLVELPELFKSNFIEICNILKTNSLTSV

SEQ ID NO: 2475667 - protein, 22 aa, Entamoeba dispar
AYYTLFVKPVFEIYQKTSKSRD

SEQ ID NO: 2475668 - protein, 20 aa, Entamoeba dispar
CAASLKELMVLSSNLITIKK

SEQ ID NO: 2475669 - protein, 19 aa, Entamoeba dispar
CACKAFIAQKGYDLETIKL

SEQ ID NO: 2475670 - protein, 19 aa, Entamoeba dispar
CADCIFYFNRIKLPTEFLP

SEQ ID NO: 2475671 - protein, 51 aa, Entamoeba dispar
CADCRTTPIHYVDMDFGCFLCLKCGMVHKNFSKKLGICKIEDIQKHSIKDI

SEQ ID NO: 2475672 - protein, 20 aa, Entamoeba dispar
CADETRIREEFGKYGKIEIV

SEQ ID NO: 2475673 - protein, 29 aa, Entamoeba dispar
CAECYKTCCYPCRVPFFISNFTARGCSCI

SEQ ID NO: 2475674 - protein, 17 aa, Entamoeba dispar
CAFDCAVNLGYRGYAAK

SEQ ID NO: 2475675 - protein, 20 aa, Entamoeba dispar
CAGLIKIVIPSSVIYLGENC

SEQ ID NO: 2475676 - protein, 21 aa, Entamoeba dispar
CAIELIKRGKAYVCHQTPDQI

SEQ ID NO: 2475677 - protein, 17 aa, Entamoeba dispar
CAIHPDEHIFISLKKTM

SEQ ID NO: 2475678 - protein, 18 aa, Entamoeba dispar
CAIHRAILEGDWVSAFER

SEQ ID NO: 2475679 - protein, 20 aa, Entamoeba dispar
CAIKRINGSLELIEKELQII

SEQ ID NO: 2475680 - protein, 18 aa, Entamoeba dispar
CAILELLKVHSRVLYIDI

SEQ ID NO: 2475681 - protein, 18 aa, Entamoeba dispar
CAILQRILDKFPNFFEKI

SEQ ID NO: 2475682 - protein, 18 aa, Entamoeba dispar
CAILSLREAFKMKEKGID

SEQ ID NO: 2475683 - protein, 20 aa, Entamoeba dispar
CAILSLREAFKMKEKGIDKT

SEQ ID NO: 2475684 - protein, 23 aa, Entamoeba dispar
CAINFKNLSCFNRDYKLNNIFIK

SEQ ID NO: 2475685 - protein, 20 aa, Entamoeba dispar
CAIYIACRRNNLKLLEKLIK

SEQ ID NO: 2475686 - protein, 19 aa, Entamoeba dispar
CAKCNKKVCNTCATTKIAL

SEQ ID NO: 2475687 - protein, 23 aa, Entamoeba dispar
CAKLRVINIPSLVNEIGNNCFND

SEQ ID NO: 2475688 - protein, 19 aa, Entamoeba dispar
CAKRIIKLKLVTSRSDFEI

SEQ ID NO: 2475689 - protein, 19 aa, Entamoeba dispar
CAKVLKEIVTIVGDVPTFP

SEQ ID NO: 2475690 - protein, 21 aa, Entamoeba dispar
CALETLNVIALRDDTLNILSN

SEQ ID NO: 2475691 - protein, 18 aa, Entamoeba dispar
CALIDHFNSITNWVISTI

SEQ ID NO: 2475692 - protein, 30 aa, Entamoeba dispar
CAPECAEVFLQTLLNAFGFVPSEKGSDKFF

SEQ ID NO: 2475693 - protein, 27 aa, Entamoeba dispar
CAPYLQIKLLRLLRVMNPSTKYYQQSM

SEQ ID NO: 2475694 - protein, 25 aa, Entamoeba dispar
CAQGDRYRMGNLFIVGPTKTGKTEF

SEQ ID NO: 2475695 - protein, 17 aa, Entamoeba dispar
CASELAASCPEQRYKAI

SEQ ID NO: 2475696 - protein, 25 aa, Entamoeba dispar
CASGDRYRMGNLFIVGSTKTGKTEF

SEQ ID NO: 2475697 - protein, 24 aa, Entamoeba dispar
CASGNKYRMGNLFIVGPTKTGKTE

SEQ ID NO: 2475698 - protein, 17 aa, Entamoeba dispar
CASLRNITIPISITKIG

SEQ ID NO: 2475699 - protein, 19 aa, Entamoeba dispar
CASYGRSVIIAALDGTFQR

SEQ ID NO: 2475700 - protein, 21 aa, Entamoeba dispar
CATCFKRIIEHSIYPYEYFHQ

SEQ ID NO: 2475701 - protein, 25 aa, Entamoeba dispar
CAVARLYLMCIVGSAAVKSKKVGIV

SEQ ID NO: 2475702 - protein, 25 aa, Entamoeba dispar
CAVNRPNTFCLFGDNFAQIITVEGN

SEQ ID NO: 2475703 - protein, 17 aa, Entamoeba dispar
CAVPRVLQRIYDVFHQK

SEQ ID NO: 2475704 - protein, 22 aa, Entamoeba dispar
CAVSQFWSYRWNFLLMASEGYI

SEQ ID NO: 2475705 - protein, 19 aa, Entamoeba dispar
CCCPIEIIQQLKLLFPEEH

SEQ ID NO: 2475706 - protein, 24 aa, Entamoeba dispar
CCCSGDGFMLTPIFAITGNNYSKI

SEQ ID NO: 2475707 - protein, 20 aa, Entamoeba dispar
CCDLSRGWFENVLMMYMHPS

SEQ ID NO: 2475708 - protein, 23 aa, Entamoeba dispar
CCECSCYKPELYGELKTKACGLL

SEQ ID NO: 2475709 - protein, 19 aa, Entamoeba dispar
CCEESLPLLNYILEDAIQG

SEQ ID NO: 2475710 - protein, 18 aa, Entamoeba dispar
CCEGLKEVFIPTTVTKIG

SEQ ID NO: 2475711 - protein, 20 aa, Entamoeba dispar
CCEVEKRLHKANSITICETQ

SEQ ID NO: 2475712 - protein, 19 aa, Entamoeba dispar
CCFCVCPSLTSINIPTTIK

SEQ ID NO: 2475713 - protein, 22 aa, Entamoeba dispar
CCFDGCSKLTLIDMAPSIHTLG

SEQ ID NO: 2475714 - protein, 18 aa, Entamoeba dispar
CCFGECKSLTLINIPSSI

SEQ ID NO: 2475715 - protein, 27 aa, Entamoeba dispar
CCFGIPRKIRGFVWYALLLRPKTTQEI

SEQ ID NO: 2475716 - protein, 20 aa, Entamoeba dispar
CCFKNCRLMNSIIIPTSVIE

SEQ ID NO: 2475717 - protein, 19 aa, Entamoeba dispar
CCFSCCKSLSSVTIPTSIT

SEQ ID NO: 2475718 - protein, 17 aa, Entamoeba dispar
CCFVGAYGVGKSSIAKS

SEQ ID NO: 2475719 - protein, 17 aa, Entamoeba dispar
CCFYECLSLTSINIPSS

SEQ ID NO: 2475720 - protein, 19 aa, Entamoeba dispar
CCFYGCSSLKSINLPSSIN

SEQ ID NO: 2475721 - protein, 18 aa, Entamoeba dispar
CCFYGCSSLTSINIPSSI

SEQ ID NO: 2475722 - protein, 18 aa, Entamoeba dispar
CCFYKCKSLKSINIPSPI

SEQ ID NO: 2475723 - protein, 17 aa, Entamoeba dispar
CCFYKCSSITTINIPTS

SEQ ID NO: 2475724 - protein, 20 aa, Entamoeba dispar
CCHSCGKCSTTLLDKAPTKI

SEQ ID NO: 2475725 - protein, 17 aa, Entamoeba dispar
CCIEMLIYISTLLYDIP

SEQ ID NO: 2475726 - protein, 27 aa, Entamoeba dispar
CCIFQRCFLDYHFLMFFIDNNGLSLLK

SEQ ID NO: 2475727 - protein, 18 aa, Entamoeba dispar
CCIICQKKSMFLVQNPKI

SEQ ID NO: 2475728 - protein, 20 aa, Entamoeba dispar
CCKCIQKMILSEVNFCEGEK

SEQ ID NO: 2475729 - protein, 29 aa, Entamoeba dispar
CCKGKRFICTLCLLFHPKFNLERCELYCD

SEQ ID NO: 2475730 - protein, 19 aa, Entamoeba dispar
CCKQSSFEYKGISNVLCGR

SEQ ID NO: 2475731 - protein, 22 aa, Entamoeba dispar
CCQEKLCFRFINKIKLYKEVTP

SEQ ID NO: 2475732 - protein, 23 aa, Entamoeba dispar
CCSGFGMTELCGLMYKMPSKATH

SEQ ID NO: 2475733 - protein, 21 aa, Entamoeba dispar
CCSLKRINISTAIKEIGSLSF

SEQ ID NO: 2475734 - protein, 25 aa, Entamoeba dispar
CCTINKLLIIYPCGVDIIQLPPKFV

SEQ ID NO: 2475735 - protein, 23 aa, Entamoeba dispar
CCTQPRRVAAISVAQRVAEEMDV

SEQ ID NO: 2475736 - protein, 18 aa, Entamoeba dispar
CCYPCDIKGDIKDGCCCI

SEQ ID NO: 2475737 - protein, 31 aa, Entamoeba dispar
CDAEKKLGHDFCLKHLLNLPGNFTATKLAWI

SEQ ID NO: 2475738 - protein, 27 aa, Entamoeba dispar
CDAVEILRINPLFSIKPLIGPKDFIYF

SEQ ID NO: 2475739 - protein, 19 aa, Entamoeba dispar
CDDSSRIAIAKEVIDSDIL

SEQ ID NO: 2475740 - protein, 23 aa, Entamoeba dispar
CDEDCGFGESKPAVLSLVVGDFN

SEQ ID NO: 2475741 - protein, 18 aa, Entamoeba dispar
CDEPDCIHIPSLSSKEQV

SEQ ID NO: 2475742 - protein, 17 aa, Entamoeba dispar
CDFFISTYWPSYILNEL

SEQ ID NO: 2475743 - protein, 21 aa, Entamoeba dispar
CDFGHSVVVISDWDFVESAVV

SEQ ID NO: 2475744 - protein, 17 aa, Entamoeba dispar
CDFRGTRPFRLITTGED

SEQ ID NO: 2475745 - protein, 19 aa, Entamoeba dispar
CDFRGTRPFRLITTGEDNY

SEQ ID NO: 2475746 - protein, 18 aa, Entamoeba dispar
CDFTFGKYADQWVVLARY

SEQ ID NO: 2475747 - protein, 24 aa, Entamoeba dispar
CDHSFICCFCSFKRRFFDKDMACP

SEQ ID NO: 2475748 - protein, 21 aa, Entamoeba dispar
CDIDVRRCLFGNILCAGGNTL

SEQ ID NO: 2475749 - protein, 17 aa, Entamoeba dispar
CDIHIVVNFARQIDNVI

SEQ ID NO: 2475750 - protein, 19 aa, Entamoeba dispar
CDILIKKITKKGCEIKQQK

SEQ ID NO: 2475751 - protein, 19 aa, Entamoeba dispar
CDIPVAWKTQGDVLNYIEH

SEQ ID NO: 2475752 - protein, 17 aa, Entamoeba dispar
CDITLPIITARPVIESH

SEQ ID NO: 2475753 - protein, 26 aa, Entamoeba dispar
CDKDWGRCVCNLSDLAPVLVNGVKVE

SEQ ID NO: 2475754 - protein, 24 aa, Entamoeba dispar
CDKNELKIIFLFTSSHPLIVLNRL

SEQ ID NO: 2475755 - protein, 18 aa, Entamoeba dispar
CDKSILDVVDYVRNEIIV

SEQ ID NO: 2475756 - protein, 19 aa, Entamoeba dispar
CDKSILDVVDYVRNEIIVK

SEQ ID NO: 2475757 - protein, 23 aa, Entamoeba dispar
CDLDECFECPNGYGLSMKKDNCI

SEQ ID NO: 2475758 - protein, 19 aa, Entamoeba dispar
CDLEGLRVILGSYKFTEPH

SEQ ID NO: 2475759 - protein, 17 aa, Entamoeba dispar
CDLETKLEMVLTKNKTI

SEQ ID NO: 2475760 - protein, 17 aa, Entamoeba dispar
CDLETNLEMVLTKNKTI

SEQ ID NO: 2475761 - protein, 17 aa, Entamoeba dispar
CDLLMRYDKENKVDLMN

SEQ ID NO: 2475762 - protein, 17 aa, Entamoeba dispar
CDLLWSDPVSEWDPDSP

SEQ ID NO: 2475763 - protein, 17 aa, Entamoeba dispar
CDLNCWIALCAFAAQTR

SEQ ID NO: 2475764 - protein, 34 aa, Entamoeba dispar
CDLRKEMYNNIVLCGGSSMFPGMKQRFIKEITIL

SEQ ID NO: 2475765 - protein, 19 aa, Entamoeba dispar
CDLSKLLVIPVQYLSIPKN

SEQ ID NO: 2475766 - protein, 18 aa, Entamoeba dispar
CDNFDLCLECFSQGKEIG

SEQ ID NO: 2475767 - protein, 17 aa, Entamoeba dispar
CDNPKFIITSTHPTSLF

SEQ ID NO: 2475768 - protein, 18 aa, Entamoeba dispar
CDPMSAFKPCNNGIVDND

SEQ ID NO: 2475769 - protein, 25 aa, Entamoeba dispar
CDPQTGVNCNLFLNGDAVTSIIRTF

SEQ ID NO: 2475770 - protein, 21 aa, Entamoeba dispar
CDRKKIMLHMIHIYKEKKEEE

SEQ ID NO: 2475771 - protein, 25 aa, Entamoeba dispar
CDRRFPHDYIPIMFDGIAVVRTYRG

SEQ ID NO: 2475772 - protein, 24 aa, Entamoeba dispar
CDRVKLRLTSVPELEYFVEDKIPC

SEQ ID NO: 2475773 - protein, 23 aa, Entamoeba dispar
CDTIECLSCQRSDITTINANEIK

SEQ ID NO: 2475774 - protein, 17 aa, Entamoeba dispar
CDVFELCGGRCMYANES

SEQ ID NO: 2475775 - protein, 20 aa, Entamoeba dispar
CDVSCKKLNIEGEAYNLQLW

SEQ ID NO: 2475776 - protein, 20 aa, Entamoeba dispar
CDVYSFGILVFHVLTQLVNT

SEQ ID NO: 2475777 - protein, 24 aa, Entamoeba dispar
CDYGDPCPCTEVGFKKVVDCKQSN

SEQ ID NO: 2475778 - protein, 17 aa, Entamoeba dispar
CDYGICFEQIHGNSISV

SEQ ID NO: 2475779 - protein, 20 aa, Entamoeba dispar
CDYLKQAIEFSTHISHEVKR

SEQ ID NO: 2475780 - protein, 17 aa, Entamoeba dispar
CDYPFVYENPYLSDKQL

SEQ ID NO: 2475781 - protein, 22 aa, Entamoeba dispar
CEAAMKPGVKWYDIHELSNKLM

SEQ ID NO: 2475782 - protein, 17 aa, Entamoeba dispar
CEADKLLVYLIFYIQSL

SEQ ID NO: 2475783 - protein, 25 aa, Entamoeba dispar
CEAYECFKSLCGIISILSNNSDISI

SEQ ID NO: 2475784 - protein, 22 aa, Entamoeba dispar
CEDCFAFIICKHCYLEHHPCAV

SEQ ID NO: 2475785 - protein, 25 aa, Entamoeba dispar
CEEHGLKLIGFWDFHQFYREWTKSQ

SEQ ID NO: 2475786 - protein, 20 aa, Entamoeba dispar
CEEKIIKGTEEWNITFKTVE

SEQ ID NO: 2475787 - protein, 19 aa, Entamoeba dispar
CEEKWAIVRDEINKVKQLE

SEQ ID NO: 2475788 - protein, 30 aa, Entamoeba dispar
CEELKLSKYPVLARWCSRKIQFVGFTDNLE

SEQ ID NO: 2475789 - protein, 17 aa, Entamoeba dispar
CEGFALDWSPVVEGRLI

SEQ ID NO: 2475790 - protein, 23 aa, Entamoeba dispar
CEGKGWRGLSVVHLGDRDVPNCL

SEQ ID NO: 2475791 - protein, 24 aa, Entamoeba dispar
CEGKGWRGLSVVHLGDRDVPNCLF

SEQ ID NO: 2475792 - protein, 18 aa, Entamoeba dispar
CEGLKTIGLIGRHCKDRT

SEQ ID NO: 2475793 - protein, 20 aa, Entamoeba dispar
CEGYKKWKQELVVYDINEQM

SEQ ID NO: 2475794 - protein, 19 aa, Entamoeba dispar
CEICQQFGKMTHVFHSIIP

SEQ ID NO: 2475795 - protein, 19 aa, Entamoeba dispar
CEIGEKWLVERGLCERCLE

SEQ ID NO: 2475796 - protein, 21 aa, Entamoeba dispar
CEIHPALVMGVLGSIIPFPDH

SEQ ID NO: 2475797 - protein, 17 aa, Entamoeba dispar
CEIKQQKECEHAGERYE

SEQ ID NO: 2475798 - protein, 21 aa, Entamoeba dispar
CEILKRLDHPNIIKLKEVYQT

SEQ ID NO: 2475799 - protein, 24 aa, Entamoeba dispar
CEIPFVHPELIKFTKSITSLYRTL

SEQ ID NO: 2475800 - protein, 24 aa, Entamoeba dispar
CEKSKIMYGFGLSESCMDIYFAHK

SEQ ID NO: 2475801 - protein, 17 aa, Entamoeba dispar
CEKVMKIITIESTSSSL

SEQ ID NO: 2475802 - protein, 19 aa, Entamoeba dispar
CELCGRNAFQKMKADGWVP

SEQ ID NO: 2475803 - protein, 17 aa, Entamoeba dispar
CELCTSIINGNSVLVHC

SEQ ID NO: 2475804 - protein, 18 aa, Entamoeba dispar
CELERLKISLELLQSTVK

SEQ ID NO: 2475805 - protein, 44 aa, Entamoeba dispar
CELFCDICLVPLCKELGCFDWCCDCCCDCCDCGDCCSDKKSDKK

SEQ ID NO: 2475806 - protein, 20 aa, Entamoeba dispar
CELFIKDLTTRAGYLTSEGK

SEQ ID NO: 2475807 - protein, 18 aa, Entamoeba dispar
CEMGLQFIQILKKHKESG

SEQ ID NO: 2475808 - protein, 23 aa, Entamoeba dispar
CEMYCQLITGMFVFLEDEQNSSS

SEQ ID NO: 2475809 - protein, 24 aa, Entamoeba dispar
CEMYTFAALICKIFTNKLPYNPSL

SEQ ID NO: 2475810 - protein, 17 aa, Entamoeba dispar
CENCKFAVNSEEERDVW

SEQ ID NO: 2475811 - protein, 17 aa, Entamoeba dispar
CENCVPLTVNTSRAGIG

SEQ ID NO: 2475812 - protein, 25 aa, Entamoeba dispar
CENDVSLIWNCLGTLITSFTSTSNG

SEQ ID NO: 2475813 - protein, 20 aa, Entamoeba dispar
CENSWRIKKLAQVCNRQLIP

SEQ ID NO: 2475814 - protein, 25 aa, Entamoeba dispar
CEPITKCVRDLLVLDGKEDQGDLNR

SEQ ID NO: 2475815 - protein, 25 aa, Entamoeba dispar
CEPPSKGIICDLLWSDPITEEFLNE

SEQ ID NO: 2475816 - protein, 17 aa, Entamoeba dispar
CEPRFVKIKADLVIVLF

SEQ ID NO: 2475817 - protein, 20 aa, Entamoeba dispar
CEQFIPLIMNILMEPLNTQD

SEQ ID NO: 2475818 - protein, 22 aa, Entamoeba dispar
CEQNGYLGFHLLKQFYKTNYYE

SEQ ID NO: 2475819 - protein, 28 aa, Entamoeba dispar
CERERIIRMGGHVFAGRVNGELAISRSF

SEQ ID NO: 2475820 - protein, 17 aa, Entamoeba dispar
CERISKYLDENGIGLNS

SEQ ID NO: 2475821 - protein, 17 aa, Entamoeba dispar
CERISKYLDEQNISLNS

SEQ ID NO: 2475822 - protein, 17 aa, Entamoeba dispar
CERISLFLDESGIGLNS

SEQ ID NO: 2475823 - protein, 18 aa, Entamoeba dispar
CERLSRFLDESGIGMNSF

SEQ ID NO: 2475824 - protein, 28 aa, Entamoeba dispar
CESDIKLLKILFYFPMIQTIQVQYCDLT

SEQ ID NO: 2475825 - protein, 20 aa, Entamoeba dispar
CESIKKFGYINYFGLQRFGS

SEQ ID NO: 2475826 - protein, 20 aa, Entamoeba dispar
CESSHKIKLLTLLQTIFATA

SEQ ID NO: 2475827 - protein, 17 aa, Entamoeba dispar
CETSIGFFPVLFISQTM

SEQ ID NO: 2475828 - protein, 18 aa, Entamoeba dispar
CEVCHLYSRVEIIESTKL

SEQ ID NO: 2475829 - protein, 18 aa, Entamoeba dispar
CEVIKLAAYEHLYKENKS

SEQ ID NO: 2475830 - protein, 23 aa, Entamoeba dispar
CEVLKNILLIGFKHLEVIDLDVI

SEQ ID NO: 2475831 - protein, 25 aa, Entamoeba dispar
CEVNELPLHLILSWYEQKAVAVLLA

SEQ ID NO: 2475832 - protein, 20 aa, Entamoeba dispar
CEWYKRGFCKHGKKCKHGHV

SEQ ID NO: 2475833 - protein, 21 aa, Entamoeba dispar
CEYDETPNCFNLIKCSLLKEL

SEQ ID NO: 2475834 - protein, 18 aa, Entamoeba dispar
CFCECSSLTKVECPNELQ

SEQ ID NO: 2475835 - protein, 18 aa, Entamoeba dispar
CFCGCSSLTSINIPSSIS

SEQ ID NO: 2475836 - protein, 19 aa, Entamoeba dispar
CFCRGKIVVDVGCGTGILS

SEQ ID NO: 2475837 - protein, 18 aa, Entamoeba dispar
CFDACKSLTSITIPTTIS

SEQ ID NO: 2475838 - protein, 25 aa, Entamoeba dispar
CFDCRKNYCKHCFKEAHKDQYHSIR

SEQ ID NO: 2475839 - protein, 19 aa, Entamoeba dispar
CFDFCLGLEEFNFEEHCQI

SEQ ID NO: 2475840 - protein, 17 aa, Entamoeba dispar
CFDGCKSLTSFTVPTTV

SEQ ID NO: 2475841 - protein, 23 aa, Entamoeba dispar
CFDLCILCNKAILINSTEIYSII

SEQ ID NO: 2475842 - protein, 17 aa, Entamoeba dispar
CFDQLLIQQYKDFQTFP

SEQ ID NO: 2475843 - protein, 28 aa, Entamoeba dispar
CFDSQRIKFIFDCIGDLISYYSLNNTPM

SEQ ID NO: 2475844 - protein, 20 aa, Entamoeba dispar
CFEFYSRPLWYHVQPTVLVK

SEQ ID NO: 2475845 - protein, 19 aa, Entamoeba dispar
CFEGCKLLTSITIPSTITE

SEQ ID NO: 2475846 - protein, 18 aa, Entamoeba dispar
CFEGCRMLTSINIPTSVI

SEQ ID NO: 2475847 - protein, 17 aa, Entamoeba dispar
CFEGCRMLTTITISSTI

SEQ ID NO: 2475848 - protein, 18 aa, Entamoeba dispar
CFEGCRSLTSINIPSSIT

SEQ ID NO: 2475849 - protein, 17 aa, Entamoeba dispar
CFEIMYHVVPLLTERSA

SEQ ID NO: 2475850 - protein, 24 aa, Entamoeba dispar
CFELLRKFIERWGYSQPLNTPTRS

SEQ ID NO: 2475851 - protein, 19 aa, Entamoeba dispar
CFFNVKFSNGIIVTPESLW

SEQ ID NO: 2475852 - protein, 25 aa, Entamoeba dispar
CFGLLSLLHPLSWQGVFLPMVPQSH

SEQ ID NO: 2475853 - protein, 30 aa, Entamoeba dispar
CFGNYLYLVLCKRCLEHCLLFSMNKEIGMV

SEQ ID NO: 2475854 - protein, 19 aa, Entamoeba dispar
CFIGFRYYFDRDELISMDE

SEQ ID NO: 2475855 - protein, 23 aa, Entamoeba dispar
CFIISSAMPRFEQFRVNQFKRDY

SEQ ID NO: 2475856 - protein, 25 aa, Entamoeba dispar
CFISCYDSICLFSGSSIPIEHTTSL

SEQ ID NO: 2475857 - protein, 17 aa, Entamoeba dispar
CFKNFAEYARMYVGDEP

SEQ ID NO: 2475858 - protein, 19 aa, Entamoeba dispar
CFKSGRFIEDIDKLPAILT

SEQ ID NO: 2475859 - protein, 20 aa, Entamoeba dispar
CFKSKFILTNSSVFTPVKKS

SEQ ID NO: 2475860 - protein, 18 aa, Entamoeba dispar
CFLNCKSLTSLTLSSSLK

SEQ ID NO: 2475861 - protein, 17 aa, Entamoeba dispar
CFMGCSSIKLINIPTTI

SEQ ID NO: 2475862 - protein, 17 aa, Entamoeba dispar
CFMNCTKLTSIQFNSQL

SEQ ID NO: 2475863 - protein, 19 aa, Entamoeba dispar
CFNFGSLLLDNQFYKHTIL

SEQ ID NO: 2475864 - protein, 17 aa, Entamoeba dispar
CFNGCLSLTSINIPSSI

SEQ ID NO: 2475865 - protein, 35 aa, Entamoeba dispar
CFQFAFRWFNCFLLREMSLEKGLRFWDTYLSDEDG

SEQ ID NO: 2475866 - protein, 18 aa, Entamoeba dispar
CFSGCSKLSFIKVEDESK

SEQ ID NO: 2475867 - protein, 18 aa, Entamoeba dispar
CFSGCSLLKSINIPTTIT

SEQ ID NO: 2475868 - protein, 19 aa, Entamoeba dispar
CFSNCPSLKSINISSSIIE

SEQ ID NO: 2475869 - protein, 19 aa, Entamoeba dispar
CFTQGMLPVVDFNSKPLYE

SEQ ID NO: 2475870 - protein, 19 aa, Entamoeba dispar
CFVGPEGNCLLRVIATLKR

SEQ ID NO: 2475871 - protein, 18 aa, Entamoeba dispar
CFVHESFDPTDFSCIKTI

SEQ ID NO: 2475872 - protein, 17 aa, Entamoeba dispar
CFYGCSLLKSINIPSTI

SEQ ID NO: 2475873 - protein, 17 aa, Entamoeba dispar
CFYGCSSLTGITIPILV

SEQ ID NO: 2475874 - protein, 17 aa, Entamoeba dispar
CFYGCSSLTSINLPSSV

SEQ ID NO: 2475875 - protein, 17 aa, Entamoeba dispar
CFYLCKSLKSINIPSSV

SEQ ID NO: 2475876 - protein, 19 aa, Entamoeba dispar
CFYLCPSLTSINIPSSITS

SEQ ID NO: 2475877 - protein, 18 aa, Entamoeba dispar
CFYSNRFLTSIQLSTNLT

SEQ ID NO: 2475878 - protein, 22 aa, Entamoeba dispar
CGAGSRQSINWAKNDGKLEVLR

SEQ ID NO: 2475879 - protein, 21 aa, Entamoeba dispar
CGAHVSFKKKQCFISSQVKHY

SEQ ID NO: 2475880 - protein, 20 aa, Entamoeba dispar
CGANIYPGHGMMFVRNDAKV

SEQ ID NO: 2475881 - protein, 19 aa, Entamoeba dispar
CGDISSLLNGISMSIEDKA

SEQ ID NO: 2475882 - protein, 26 aa, Entamoeba dispar
CGEAFVPIVICLSFRRGVQCIENLAT

SEQ ID NO: 2475883 - protein, 17 aa, Entamoeba dispar
CGECSKGRIPITPQSTV

SEQ ID NO: 2475884 - protein, 17 aa, Entamoeba dispar
CGECSKWKMPIPPNNTL

SEQ ID NO: 2475885 - protein, 17 aa, Entamoeba dispar
CGEEIFEGDSIVRLPCL

SEQ ID NO: 2475886 - protein, 32 aa, Entamoeba dispar
CGEICNYFLKTFCPSGLQVLRDFIFDNKSQNE

SEQ ID NO: 2475887 - protein, 21 aa, Entamoeba dispar
CGEKARTVALFQQFFPGTKTM

SEQ ID NO: 2475888 - protein, 18 aa, Entamoeba dispar
CGEKNVMFIIITKTGYAF

SEQ ID NO: 2475889 - protein, 17 aa, Entamoeba dispar
CGETTGIIQCQCGKYFC

SEQ ID NO: 2475890 - protein, 24 aa, Entamoeba dispar
CGGLNCNGFPFGTEMIVSTFSNGQ

SEQ ID NO: 2475891 - protein, 21 aa, Entamoeba dispar
CGGLYKIYIADWFAQLNHKMG

SEQ ID NO: 2475892 - protein, 21 aa, Entamoeba dispar
CGGQSGINRKFVCYIEDGISI

SEQ ID NO: 2475893 - protein, 17 aa, Entamoeba dispar
CGGYHTLALNIWGEVFS

SEQ ID NO: 2475894 - protein, 24 aa, Entamoeba dispar
CGHLYCSDCLNIIFDTPGVHYCPI

SEQ ID NO: 2475895 - protein, 22 aa, Entamoeba dispar
CGIDQCWGAHRIGHEITAYYGL

SEQ ID NO: 2475896 - protein, 21 aa, Entamoeba dispar
CGIDVPEVYVIHSLKHIPKEV

SEQ ID NO: 2475897 - protein, 17 aa, Entamoeba dispar
CGIILSGIHSLQYLDIS

SEQ ID NO: 2475898 - protein, 18 aa, Entamoeba dispar
CGIISLILPSLLSSIQPY

SEQ ID NO: 2475899 - protein, 17 aa, Entamoeba dispar
CGIKHWGEKTMFVTTSH

SEQ ID NO: 2475900 - protein, 33 aa, Entamoeba dispar
CGIKLKYRILEMIKKFICLFPNDFFVSENNGTM

SEQ ID NO: 2475901 - protein, 24 aa, Entamoeba dispar
CGINPEIFSGLSPSTLQYWISQSE

SEQ ID NO: 2475902 - protein, 18 aa, Entamoeba dispar
CGIPGAKGTEWEGGIYPL

SEQ ID NO: 2475903 - protein, 22 aa, Entamoeba dispar
CGKNRRRALLEYAKEHGYTSIA

SEQ ID NO: 2475904 - protein, 21 aa, Entamoeba dispar
CGKPIGMSFLEVFGKKWHEGC

SEQ ID NO: 2475905 - protein, 20 aa, Entamoeba dispar
CGKSAYPLERITAGGKDYHN

SEQ ID NO: 2475906 - protein, 26 aa, Entamoeba dispar
CGKSGCGKTSLAQRFFSNKLQVGEIS

SEQ ID NO: 2475907 - protein, 19 aa, Entamoeba dispar
CGLANSWKLFGEALKKNTE

SEQ ID NO: 2475908 - protein, 19 aa, Entamoeba dispar
CGLARLPYELQKRGNKCYA

SEQ ID NO: 2475909 - protein, 17 aa, Entamoeba dispar
CGLELKQNMTIPRDFIY

SEQ ID NO: 2475910 - protein, 18 aa, Entamoeba dispar
CGLIKESVSFIKSIDSVY

SEQ ID NO: 2475911 - protein, 22 aa, Entamoeba dispar
CGLNALIRFKNRLHEWPTYCYL

SEQ ID NO: 2475912 - protein, 17 aa, Entamoeba dispar
CGLVKNFSLLTEVTTDS

SEQ ID NO: 2475913 - protein, 19 aa, Entamoeba dispar
CGNHIGWKFTTHNDLLKPK

SEQ ID NO: 2475914 - protein, 26 aa, Entamoeba dispar
CGNISCWCSVVFSGYVLENSITQLNC

SEQ ID NO: 2475915 - protein, 23 aa, Entamoeba dispar
CGPPGCGKTTFIQALVKTYTKQN

SEQ ID NO: 2475916 - protein, 25 aa, Entamoeba dispar
CGQIICSDCVDSLLLGGSEMECPLC

SEQ ID NO: 2475917 - protein, 19 aa, Entamoeba dispar
CGQRFCFKCLGEYHAPATC

SEQ ID NO: 2475918 - protein, 18 aa, Entamoeba dispar
CGRIEKLFIVGFNKMSQR

SEQ ID NO: 2475919 - protein, 26 aa, Entamoeba dispar
CGRITFIDLPCCWEQSNHKGSLLNGL

SEQ ID NO: 2475920 - protein, 28 aa, Entamoeba dispar
CGSATDMALRMAISLTKTKRLRGIGIAL

SEQ ID NO: 2475921 - protein, 21 aa, Entamoeba dispar
CGSCGPRGFYGGTLEHLKIEN

SEQ ID NO: 2475922 - protein, 20 aa, Entamoeba dispar
CGTNGFEYCGAKNALCGNYN

SEQ ID NO: 2475923 - protein, 21 aa, Entamoeba dispar
CGTPEYLAPEVVVGKDYSEPV

SEQ ID NO: 2475924 - protein, 17 aa, Entamoeba dispar
CGTPEYLSPEVVLAEPY

SEQ ID NO: 2475925 - protein, 29 aa, Entamoeba dispar
CGTPTYFSPELLRGWNEYRKTLISNEQSK

SEQ ID NO: 2475926 - protein, 19 aa, Entamoeba dispar
CGTYYRIGTVNTCACSLKD

SEQ ID NO: 2475927 - protein, 20 aa, Entamoeba dispar
CGVDQCWGAHMIGHEITAYY

SEQ ID NO: 2475928 - protein, 18 aa, Entamoeba dispar
CGVNLKVKLADFGFGRII

SEQ ID NO: 2475929 - protein, 19 aa, Entamoeba dispar
CGYPPTVKYLFLGDYIDRG

SEQ ID NO: 2475930 - protein, 22 aa, Entamoeba dispar
CGYTRRYGKGKILITGFHFEFD

SEQ ID NO: 2475931 - protein, 18 aa, Entamoeba dispar
CGYYQDWIDPLREYIVQW

SEQ ID NO: 2475932 - protein, 21 aa, Entamoeba dispar
CHAYTRLTGENGFEYEEIANK

SEQ ID NO: 2475933 - protein, 23 aa, Entamoeba dispar
CHAYTRLTGENGFEYEEIANKTA

SEQ ID NO: 2475934 - protein, 17 aa, Entamoeba dispar
CHCGGEKKPGCDGHGGC

SEQ ID NO: 2475935 - protein, 34 aa, Entamoeba dispar
CHEHGIFGKLCECCKEKTCFKCLNEISIETQKEE

SEQ ID NO: 2475936 - protein, 17 aa, Entamoeba dispar
CHHPNVVLFIGISIDSG

SEQ ID NO: 2475937 - protein, 18 aa, Entamoeba dispar
CHKYKVGIQSIINTCQTR

SEQ ID NO: 2475938 - protein, 20 aa, Entamoeba dispar
CHLKDLKLFDCENIPLSLIP

SEQ ID NO: 2475939 - protein, 25 aa, Entamoeba dispar
CHLLECVEYLSPYMIYVIDNENSIK

SEQ ID NO: 2475940 - protein, 24 aa, Entamoeba dispar
CHLREELKFYYSLYQTCIPMINKL

SEQ ID NO: 2475941 - protein, 25 aa, Entamoeba dispar
CHNELVCRVVLLLLSYVIEERYDEI

SEQ ID NO: 2475942 - protein, 18 aa, Entamoeba dispar
CHQLCVTCQLGIENGGTE

SEQ ID NO: 2475943 - protein, 17 aa, Entamoeba dispar
CHQRIKSNCFSCIHCNL

SEQ ID NO: 2475944 - protein, 24 aa, Entamoeba dispar
CHSEHILEAISFIGSGFDILKQEM

SEQ ID NO: 2475945 - protein, 17 aa, Entamoeba dispar
CHSPKAIQLISLIFSLY

SEQ ID NO: 2475946 - protein, 21 aa, Entamoeba dispar
CIAGIRYFDFRVVYNHKLKNF

SEQ ID NO: 2475947 - protein, 18 aa, Entamoeba dispar
CICTYKFKQFNHEHVMVN

SEQ ID NO: 2475948 - protein, 17 aa, Entamoeba dispar
CIDDLNTLKCLRSTKTI

SEQ ID NO: 2475949 - protein, 24 aa, Entamoeba dispar
CIDQIRRFGYFKGLFGELDEITTT

SEQ ID NO: 2475950 - protein, 20 aa, Entamoeba dispar
CIDVLISTQFLLAGKSDKLV

SEQ ID NO: 2475951 - protein, 20 aa, Entamoeba dispar
CIEEITFKPIFKQINDVKNH

SEQ ID NO: 2475952 - protein, 25 aa, Entamoeba dispar
CIEIDCPDKVIIKGLDLRNTESKVV

SEQ ID NO: 2475953 - protein, 26 aa, Entamoeba dispar
CIEIIPMKLPNTFGLIKGNEFCVFNK

SEQ ID NO: 2475954 - protein, 19 aa, Entamoeba dispar
CIEIKDMIKPLVLLDVGAS

SEQ ID NO: 2475955 - protein, 19 aa, Entamoeba dispar
CIEKLPSTCFLGRLRKFIL

SEQ ID NO: 2475956 - protein, 28 aa, Entamoeba dispar
CIEKMNLICLDISCNLISLFPKNLPITL

SEQ ID NO: 2475957 - protein, 18 aa, Entamoeba dispar
CIELNLGNLHIKSNVNNG

SEQ ID NO: 2475958 - protein, 28 aa, Entamoeba dispar
CIENFYRSCVGYCVASYVLGLADRHNDN

SEQ ID NO: 2475959 - protein, 20 aa, Entamoeba dispar
CIETIKLKTNEILNGKQQWR

SEQ ID NO: 2475960 - protein, 17 aa, Entamoeba dispar
CIGLLPPSIHKISTTSK

SEQ ID NO: 2475961 - protein, 19 aa, Entamoeba dispar
CIHGKKMIELLGGYDVLLI

SEQ ID NO: 2475962 - protein, 17 aa, Entamoeba dispar
CIHKIYISKKEEIRNEI

SEQ ID NO: 2475963 - protein, 17 aa, Entamoeba dispar
CIIDFCPENSIPEQTMD

SEQ ID NO: 2475964 - protein, 18 aa, Entamoeba dispar
CIIIVSFLVLQSTTIDQS

SEQ ID NO: 2475965 - protein, 25 aa, Entamoeba dispar
CIIKCIKHYPKMFDDFLKIHASNIF

SEQ ID NO: 2475966 - protein, 24 aa, Entamoeba dispar
CIISCPCYCTCYYFTESIANLYPC

SEQ ID NO: 2475967 - protein, 25 aa, Entamoeba dispar
CIISFKLEKGVVMKIQYQEEVEENS

SEQ ID NO: 2475968 - protein, 18 aa, Entamoeba dispar
CIITANFDRSERFKNNFL

SEQ ID NO: 2475969 - protein, 18 aa, Entamoeba dispar
CIKECKKFTLEIESDNEQ

SEQ ID NO: 2475970 - protein, 23 aa, Entamoeba dispar
CIKHIKTWVLHDVFEYKNELRLR

SEQ ID NO: 2475971 - protein, 20 aa, Entamoeba dispar
CIKTAIEAACTLLRVDDVVS

SEQ ID NO: 2475972 - protein, 17 aa, Entamoeba dispar
CILADEMGLGKTVQVVA

SEQ ID NO: 2475973 - protein, 31 aa, Entamoeba dispar
CINCGGCMRACPFGTILPRSNLIDVLKILPT

SEQ ID NO: 2475974 - protein, 25 aa, Entamoeba dispar
CINIFKSYYFCESWNNPVFEGYLSK

SEQ ID NO: 2475975 - protein, 26 aa, Entamoeba dispar
CINSSEIQNHFPLFQIRDIFILPIQE

SEQ ID NO: 2475976 - protein, 28 aa, Entamoeba dispar
CINYNSSSARRPYSFLKHHPHSQTQNSQ

SEQ ID NO: 2475977 - protein, 19 aa, Entamoeba dispar
CIPEATIAGIPVDKSPIDD

SEQ ID NO: 2475978 - protein, 23 aa, Entamoeba dispar
CIPIELFSIVSIQLLKALHYIHS

SEQ ID NO: 2475979 - protein, 32 aa, Entamoeba dispar
CIPKAIPSLVCQFNLRCLEFLNNYISRKEMYF

SEQ ID NO: 2475980 - protein, 19 aa, Entamoeba dispar
CIPRTHYFFSVSRDKSLRY

SEQ ID NO: 2475981 - protein, 19 aa, Entamoeba dispar
CIPWHISAFHPDYLMDTTP

SEQ ID NO: 2475982 - protein, 19 aa, Entamoeba dispar
CIQDITWLPGGLRMMACSV

SEQ ID NO: 2475983 - protein, 26 aa, Entamoeba dispar
CIRQYELFPHFGLILIHGGSGVGKTT

SEQ ID NO: 2475984 - protein, 19 aa, Entamoeba dispar
CIRTMEIIGIIFINNKKQP

SEQ ID NO: 2475985 - protein, 30 aa, Entamoeba dispar
CISDVPLPLCKEINQIFSLIDHYCKKVIIP

SEQ ID NO: 2475986 - protein, 18 aa, Entamoeba dispar
CISEKYAPPEIVDLLRLL

SEQ ID NO: 2475987 - protein, 20 aa, Entamoeba dispar
CISFNFKVIQELSLQPNILC

SEQ ID NO: 2475988 - protein, 22 aa, Entamoeba dispar
CISKDCPFQHSYSFKLEDYQPP

SEQ ID NO: 2475989 - protein, 24 aa, Entamoeba dispar
CISLSFELDTFFSLKELSIQMSES

SEQ ID NO: 2475990 - protein, 30 aa, Entamoeba dispar
CISRDFLQCDIKIRMLIVGDQSVGKTTFIK

SEQ ID NO: 2475991 - protein, 25 aa, Entamoeba dispar
CISTFRGIPDWDWFYQFNAPPEITD

SEQ ID NO: 2475992 - protein, 26 aa, Entamoeba dispar
CITHGYEMPKCKKLDFEKIRNIVLEK

SEQ ID NO: 2475993 - protein, 17 aa, Entamoeba dispar
CITLPFFQIKRLHFNNK

SEQ ID NO: 2475994 - protein, 27 aa, Entamoeba dispar
CITPAVMFCDSIGFLSANFYSKNLFDE

SEQ ID NO: 2475995 - protein, 18 aa, Entamoeba dispar
CITPTLLLAPEFIKRLLD

SEQ ID NO: 2475996 - protein, 19 aa, Entamoeba dispar
CITTPISESVNFVKKEESF

SEQ ID NO: 2475997 - protein, 24 aa, Entamoeba dispar
CIVEEVKAGIVLYKEIPPIIEIFN

SEQ ID NO: 2475998 - protein, 22 aa, Entamoeba dispar
CIVVCYCPYIPKSFDRVVEVIK

SEQ ID NO: 2475999 - protein, 17 aa, Entamoeba dispar
CIWCSGETSSFHSYESV

SEQ ID NO: 2476000 - protein, 24 aa, Entamoeba dispar
CIYCGKRYTSLWSLENDCGGHDHS

SEQ ID NO: 2476001 - protein, 24 aa, Entamoeba dispar
CIYISSSYKESWNGFGAIESINGI

SEQ ID NO: 2476002 - protein, 19 aa, Entamoeba dispar
CIYVLMNIYVDFKEIHSKE

SEQ ID NO: 2476003 - protein, 21 aa, Entamoeba dispar
CKAFNRYLFNLIDTKKCGKID

SEQ ID NO: 2476004 - protein, 20 aa, Entamoeba dispar
CKAMMLCGKIDGPIKNGEIY

SEQ ID NO: 2476005 - protein, 26 aa, Entamoeba dispar
CKAQGLCPLELILTATSQIDFSNKPF

SEQ ID NO: 2476006 - protein, 19 aa, Entamoeba dispar
CKARCQAFRAEVIKRTIKN

SEQ ID NO: 2476007 - protein, 19 aa, Entamoeba dispar
CKARCQAFRAEVIKRTIQN

SEQ ID NO: 2476008 - protein, 18 aa, Entamoeba dispar
CKCASLAGCTSKIRNDKH

SEQ ID NO: 2476009 - protein, 17 aa, Entamoeba dispar
CKCKIIPEEVYMDDADE

SEQ ID NO: 2476010 - protein, 18 aa, Entamoeba dispar
CKCKMYFDEHNGVSEKTA

SEQ ID NO: 2476011 - protein, 26 aa, Entamoeba dispar
CKCPKCKDTKRKVCYKTNALLYETQE

SEQ ID NO: 2476012 - protein, 18 aa, Entamoeba dispar
CKDFHSVNMMTYKEELTN

SEQ ID NO: 2476013 - protein, 18 aa, Entamoeba dispar
CKDGISNKKVLRIGMRPL

SEQ ID NO: 2476014 - protein, 31 aa, Entamoeba dispar
CKDNKPFGGICFRPFPTQGFVEIVFCAVDST

SEQ ID NO: 2476015 - protein, 31 aa, Entamoeba dispar
CKDVKAKKNRLIWDKEIERLKNDLYIKQILS

SEQ ID NO: 2476016 - protein, 19 aa, Entamoeba dispar
CKDVLELFSTSLIDFNTNR

SEQ ID NO: 2476017 - protein, 29 aa, Entamoeba dispar
CKEDFKVRIPSHFKRNGAFYIGTIQIYDD

SEQ ID NO: 2476018 - protein, 17 aa, Entamoeba dispar
CKEDKVIVTNALSQILK

SEQ ID NO: 2476019 - protein, 17 aa, Entamoeba dispar
CKEFFNKNIKVFFNKIK

SEQ ID NO: 2476020 - protein, 20 aa, Entamoeba dispar
CKEHKIGVVNVAGYSTESVT

SEQ ID NO: 2476021 - protein, 19 aa, Entamoeba dispar
CKELFKHAKDILLSDKPTP

SEQ ID NO: 2476022 - protein, 18 aa, Entamoeba dispar
CKELMSINIPSTIEEIGN

SEQ ID NO: 2476023 - protein, 21 aa, Entamoeba dispar
CKEMKVCGALGPLTSGNKKTS

SEQ ID NO: 2476024 - protein, 25 aa, Entamoeba dispar
CKENFVLGNWFYWYLTVECGCTNGD

SEQ ID NO: 2476025 - protein, 17 aa, Entamoeba dispar
CKERPRWNAPKIEELKK

SEQ ID NO: 2476026 - protein, 27 aa, Entamoeba dispar
CKGIICKTCNKTLCNNCFNSSEHENHE

SEQ ID NO: 2476027 - protein, 19 aa, Entamoeba dispar
CKGLPVLKISKYVKTRTSV

SEQ ID NO: 2476028 - protein, 19 aa, Entamoeba dispar
CKHPNIVSFFGSYLEEGYV

SEQ ID NO: 2476029 - protein, 27 aa, Entamoeba dispar
CKIADACLRSSAAVGYYPPYQGYADGG

SEQ ID NO: 2476030 - protein, 22 aa, Entamoeba dispar
CKIELMSFYLITPIQRIPRYEL

SEQ ID NO: 2476031 - protein, 19 aa, Entamoeba dispar
CKIERLPIILPLIQEDVLS

SEQ ID NO: 2476032 - protein, 19 aa, Entamoeba dispar
CKIILQKINSLFCNSQINF

SEQ ID NO: 2476033 - protein, 17 aa, Entamoeba dispar
CKILKIIETCLLSPALI

SEQ ID NO: 2476034 - protein, 24 aa, Entamoeba dispar
CKINIKSDCIERLKLEGNIQTQIK

SEQ ID NO: 2476035 - protein, 29 aa, Entamoeba dispar
CKINIKSDCIERLRLERAIHTQFKLSTNK

SEQ ID NO: 2476036 - protein, 21 aa, Entamoeba dispar
CKIVSDWYCIYRWASTVEAVS

SEQ ID NO: 2476037 - protein, 20 aa, Entamoeba dispar
CKKDINEFIIPSSITKLGDW

SEQ ID NO: 2476038 - protein, 21 aa, Entamoeba dispar
CKKDMMRWAEFDCGFASQNML

SEQ ID NO: 2476039 - protein, 21 aa, Entamoeba dispar
CKKECCCPRIKAFKKFMNTFE

SEQ ID NO: 2476040 - protein, 19 aa, Entamoeba dispar
CKKENVFVFGSEYRPVPLQ

SEQ ID NO: 2476041 - protein, 17 aa, Entamoeba dispar
CKKISSLRKKLWMEHLG

SEQ ID NO: 2476042 - protein, 17 aa, Entamoeba dispar
CKKKFKNPFIIAIIITK

SEQ ID NO: 2476043 - protein, 20 aa, Entamoeba dispar
CKKKVIKKTICLDDEETNDL

SEQ ID NO: 2476044 - protein, 21 aa, Entamoeba dispar
CKKLCIDECENCQFIINKNQI

SEQ ID NO: 2476045 - protein, 18 aa, Entamoeba dispar
CKLAEKLAKEPNERLAKE

SEQ ID NO: 2476046 - protein, 19 aa, Entamoeba dispar
CKLCDRPFDVYKWRMEETN

SEQ ID NO: 2476047 - protein, 17 aa, Entamoeba dispar
CKLESYFDLVSSIISLT

SEQ ID NO: 2476048 - protein, 21 aa, Entamoeba dispar
CKLGNICCCERVSEYGIDATV

SEQ ID NO: 2476049 - protein, 17 aa, Entamoeba dispar
CKLHQKMFDEFRQLILS

SEQ ID NO: 2476050 - protein, 26 aa, Entamoeba dispar
CKLNIRLSLKVLKQLYSMVKSCSTEN

SEQ ID NO: 2476051 - protein, 22 aa, Entamoeba dispar
CKLRYCVIEFDKPIKMDTFIGT

SEQ ID NO: 2476052 - protein, 19 aa, Entamoeba dispar
CKLSDYKYIRALRSAVFVL

SEQ ID NO: 2476053 - protein, 20 aa, Entamoeba dispar
CKLSEIWINSQTFQWVASKF

SEQ ID NO: 2476054 - protein, 20 aa, Entamoeba dispar
CKLTNPLHFKRYYHGNDTVI

SEQ ID NO: 2476055 - protein, 22 aa, Entamoeba dispar
CKNCGSINHWTYQCTVEMEEKS

SEQ ID NO: 2476056 - protein, 29 aa, Entamoeba dispar
CKNFKGCSKCTVTKCLECSNGKDVFNDKC

SEQ ID NO: 2476057 - protein, 18 aa, Entamoeba dispar
CKNKEALIDLVKSSVEND

SEQ ID NO: 2476058 - protein, 29 aa, Entamoeba dispar
CKNLHKHIWRCTGPCRNKPPFYGYVKRSM

SEQ ID NO: 2476059 - protein, 20 aa, Entamoeba dispar
CKNLRQNILFNYQKILINEN

SEQ ID NO: 2476060 - protein, 18 aa, Entamoeba dispar
CKPISYPILPDASNHYLW

SEQ ID NO: 2476061 - protein, 17 aa, Entamoeba dispar
CKPKRSISSEPFTRQRL

SEQ ID NO: 2476062 - protein, 19 aa, Entamoeba dispar
CKPSNFVIINGIKEGIDYN

SEQ ID NO: 2476063 - protein, 21 aa, Entamoeba dispar
CKQHGLTAFTYLRMTRGLLDD

SEQ ID NO: 2476064 - protein, 18 aa, Entamoeba dispar
CKQIKFDLQKIIEAIGSR

SEQ ID NO: 2476065 - protein, 22 aa, Entamoeba dispar
CKQLDSPLMWKSLGNAAMISGH

SEQ ID NO: 2476066 - protein, 28 aa, Entamoeba dispar
CKQQRLNKVQLLNGLKVYLSSFPKKEVI

SEQ ID NO: 2476067 - protein, 20 aa, Entamoeba dispar
CKRAVIYQEDIVKFIGSYKA

SEQ ID NO: 2476068 - protein, 22 aa, Entamoeba dispar
CKSKNQLNSLAFNFQENEERIV

SEQ ID NO: 2476069 - protein, 18 aa, Entamoeba dispar
CKSLKSIIIPSTISTIGF

SEQ ID NO: 2476070 - protein, 17 aa, Entamoeba dispar
CKSTICIPICIKNNLPS

SEQ ID NO: 2476071 - protein, 22 aa, Entamoeba dispar
CKTEKGLTPWDYCQFSDKICID

SEQ ID NO: 2476072 - protein, 17 aa, Entamoeba dispar
CKTLLPVIPSTCLSWDI

SEQ ID NO: 2476073 - protein, 21 aa, Entamoeba dispar
CKTLTSLCIHKEGNFLVCSGN

SEQ ID NO: 2476074 - protein, 17 aa, Entamoeba dispar
CKVCVNLAEFILRQARN

SEQ ID NO: 2476075 - protein, 18 aa, Entamoeba dispar
CKVDGNGIVEIEIYHDGK

SEQ ID NO: 2476076 - protein, 25 aa, Entamoeba dispar
CKVLDSLRKPLFLTFKNEDPEGDPI

SEQ ID NO: 2476077 - protein, 21 aa, Entamoeba dispar
CKVQREMGELITIEEYLTKFE

SEQ ID NO: 2476078 - protein, 23 aa, Entamoeba dispar
CKYAPEFPGDYTVDIKLNGDKVG

SEQ ID NO: 2476079 - protein, 17 aa, Entamoeba dispar
CKYEDSWHYKYKNNNEI

SEQ ID NO: 2476080 - protein, 24 aa, Entamoeba dispar
CKYEKSYYALLSFIPRSPLNSYNS

SEQ ID NO: 2476081 - protein, 17 aa, Entamoeba dispar
CKYPQKWVQTGDGSFII

SEQ ID NO: 2476082 - protein, 19 aa, Entamoeba dispar
CKYQRVAIKVLKQQNLSKE

SEQ ID NO: 2476083 - protein, 30 aa, Entamoeba dispar
CKYYMRYGKVEKGLEIFKLFDRSPDKNDSP

SEQ ID NO: 2476084 - protein, 17 aa, Entamoeba dispar
CKYYVAIQTLFTGNEEL

SEQ ID NO: 2476085 - protein, 22 aa, Entamoeba dispar
CLAWKYIYATGAFELRRKQNKQ

SEQ ID NO: 2476086 - protein, 32 aa, Entamoeba dispar
CLDDKELNQMLSIKRLAPYDERKITQAEKERI

SEQ ID NO: 2476087 - protein, 18 aa, Entamoeba dispar
CLEALQLIFKNLVNGYNG

SEQ ID NO: 2476088 - protein, 18 aa, Entamoeba dispar
CLEHPFLHLLDVETDIDI

SEQ ID NO: 2476089 - protein, 18 aa, Entamoeba dispar
CLGDAVLVVPAMANGEYW

SEQ ID NO: 2476090 - protein, 19 aa, Entamoeba dispar
CLGGFCEAWGEAAGFNVPI

SEQ ID NO: 2476091 - protein, 18 aa, Entamoeba dispar
CLGICPRYQPSSQPCAQG

SEQ ID NO: 2476092 - protein, 17 aa, Entamoeba dispar
CLGKCKCTEELKKNKTI

SEQ ID NO: 2476093 - protein, 25 aa, Entamoeba dispar
CLGQEWKYYEILKRITETYELVIKK

SEQ ID NO: 2476094 - protein, 26 aa, Entamoeba dispar
CLGQEWKYYEVLKRITETYELVIKKR

SEQ ID NO: 2476095 - protein, 24 aa, Entamoeba dispar
CLGTNKEKIVCMGVYSEGQYGIPK

SEQ ID NO: 2476096 - protein, 18 aa, Entamoeba dispar
CLHCLHIGCSRYCNGHAQ

SEQ ID NO: 2476097 - protein, 24 aa, Entamoeba dispar
CLHDSKRLIGETVKHYNEQKNLLP

SEQ ID NO: 2476098 - protein, 24 aa, Entamoeba dispar
CLHDSKRLIGETVKRYRQQKGLLP

SEQ ID NO: 2476099 - protein, 20 aa, Entamoeba dispar
CLIDELGPRFILKLRSIQRG

SEQ ID NO: 2476100 - protein, 26 aa, Entamoeba dispar
CLIFYCNNCIFGSFHSIIPFNRGIWS

SEQ ID NO: 2476101 - protein, 19 aa, Entamoeba dispar
CLISGVYHISIWQYKKLGI

SEQ ID NO: 2476102 - protein, 17 aa, Entamoeba dispar
CLIYEYFPKEYRIQVTH

SEQ ID NO: 2476103 - protein, 28 aa, Entamoeba dispar
CLKCNKTCHYPCHIKGDIKKGCACIGAK

SEQ ID NO: 2476104 - protein, 18 aa, Entamoeba dispar
CLKEIAINIGKYYSLLPT

SEQ ID NO: 2476105 - protein, 25 aa, Entamoeba dispar
CLKNKVPIICGGTSYYIDALLFRHQ

SEQ ID NO: 2476106 - protein, 21 aa, Entamoeba dispar
CLLENRKVIGISFHNQPSILN

SEQ ID NO: 2476107 - protein, 18 aa, Entamoeba dispar
CLLFILLKITKLLIEIVE

SEQ ID NO: 2476108 - protein, 19 aa, Entamoeba dispar
CLLLFPRIQIDYQTFYNQS

SEQ ID NO: 2476109 - protein, 19 aa, Entamoeba dispar
CLLLHGGIDQIDRQNTIQE

SEQ ID NO: 2476110 - protein, 24 aa, Entamoeba dispar
CLLLKKRFVPKMKDILETEDQVSH

SEQ ID NO: 2476111 - protein, 19 aa, Entamoeba dispar
CLLLKTVVIPTTIGKLGYK

SEQ ID NO: 2476112 - protein, 19 aa, Entamoeba dispar
CLLLLRQGIFSVLQDTIVL

SEQ ID NO: 2476113 - protein, 20 aa, Entamoeba dispar
CLLMTDILHRGLKKFWWKAM

SEQ ID NO: 2476114 - protein, 19 aa, Entamoeba dispar
CLLSKWCRITIKKPTRRSC

SEQ ID NO: 2476115 - protein, 19 aa, Entamoeba dispar
CLLYALKIKYPEHIYLIRG

SEQ ID NO: 2476116 - protein, 20 aa, Entamoeba dispar
CLLYELYTSKMLFAIADVGE

SEQ ID NO: 2476117 - protein, 18 aa, Entamoeba dispar
CLMINGDCSIAWNKRFEL

SEQ ID NO: 2476118 - protein, 21 aa, Entamoeba dispar
CLMKPLPSYKDRVFTTNEVGF

SEQ ID NO: 2476119 - protein, 18 aa, Entamoeba dispar
CLNGLPPIPTSILPLFEM

SEQ ID NO: 2476120 - protein, 17 aa, Entamoeba dispar
CLNRFYGFYDECLRKYG

SEQ ID NO: 2476121 - protein, 38 aa, Entamoeba dispar
CLNSTLLNTLLYEWYELRKLKTVDCRKIKSLVNQFTHK

SEQ ID NO: 2476122 - protein, 18 aa, Entamoeba dispar
CLNTWVGGKLYLTNYRLI

SEQ ID NO: 2476123 - protein, 29 aa, Entamoeba dispar
CLPIDFSPVCGFMGMILMDQRPELKIIDL

SEQ ID NO: 2476124 - protein, 26 aa, Entamoeba dispar
CLPIFELYGIFLLQLFCSNDFLIQTL

SEQ ID NO: 2476125 - protein, 18 aa, Entamoeba dispar
CLPLCIMYPYDYPFTPPL

SEQ ID NO: 2476126 - protein, 18 aa, Entamoeba dispar
CLPLCIMYPYDYSFTPPL

SEQ ID NO: 2476127 - protein, 21 aa, Entamoeba dispar
CLQPHVIWLVKALKIIIEFDF

SEQ ID NO: 2476128 - protein, 24 aa, Entamoeba dispar
CLRCNRTCHYPCDIKGDIKDGCYC

SEQ ID NO: 2476129 - protein, 25 aa, Entamoeba dispar
CLRCNRTCHYPCWIEGDVKDGCACI

SEQ ID NO: 2476130 - protein, 25 aa, Entamoeba dispar
CLRCNRTCHYPCYISGDVKDGCYCI

SEQ ID NO: 2476131 - protein, 19 aa, Entamoeba dispar
CLRDVMVLREGFLKYREMV

SEQ ID NO: 2476132 - protein, 19 aa, Entamoeba dispar
CLRSIYWNLNTSLIPKNVS

SEQ ID NO: 2476133 - protein, 21 aa, Entamoeba dispar
CLSGSEWYSIQALRAVNQAVG

SEQ ID NO: 2476134 - protein, 32 aa, Entamoeba dispar
CLSHLLDRNPPCLVELSLFLYQCDQINIHLRN

SEQ ID NO: 2476135 - protein, 26 aa, Entamoeba dispar
CLSLFREFHCSCGRTLNVELKPLNSP

SEQ ID NO: 2476136 - protein, 19 aa, Entamoeba dispar
CLSLIKKYIEGYRSIDKLE

SEQ ID NO: 2476137 - protein, 18 aa, Entamoeba dispar
CLSLIKVKIEDDIITFEN

SEQ ID NO: 2476138 - protein, 25 aa, Entamoeba dispar
CLSLLRGDLKLVIKHLPEICITFGK

SEQ ID NO: 2476139 - protein, 22 aa, Entamoeba dispar
CLSNFFKPEFFKGDNRLRTDDG

SEQ ID NO: 2476140 - protein, 21 aa, Entamoeba dispar
CLSTLRLDKDWSPVSTLNHVV

SEQ ID NO: 2476141 - protein, 22 aa, Entamoeba dispar
CLTELLKMIDMKAIEIDDALRL

SEQ ID NO: 2476142 - protein, 24 aa, Entamoeba dispar
CLTIGEYNISYIISCTLKNKSTTY

SEQ ID NO: 2476143 - protein, 17 aa, Entamoeba dispar
CLTKCCIPLQGICRQTI

SEQ ID NO: 2476144 - protein, 19 aa, Entamoeba dispar
CLVDLHFLMIQEILNVEKL

SEQ ID NO: 2476145 - protein, 18 aa, Entamoeba dispar
CLVLPSLYLGLMKNIEIP

SEQ ID NO: 2476146 - protein, 20 aa, Entamoeba dispar
CLVQLKIRIEELCKVVENYY

SEQ ID NO: 2476147 - protein, 18 aa, Entamoeba dispar
CLVTRSPEHCIVKFVENN

SEQ ID NO: 2476148 - protein, 19 aa, Entamoeba dispar
CLYLTRAKKSTAIYKATLT

SEQ ID NO: 2476149 - protein, 18 aa, Entamoeba dispar
CLYNQRLLSINPYLLNAK

SEQ ID NO: 2476150 - protein, 18 aa, Entamoeba dispar
CLYPEFIGDTLAYMNSII

SEQ ID NO: 2476151 - protein, 23 aa, Entamoeba dispar
CLYPSQTGVIIAFDLAYNTYSAY

SEQ ID NO: 2476152 - protein, 25 aa, Entamoeba dispar
CLYVKDTRTYIGFKTGDFTCIDFEN

SEQ ID NO: 2476153 - protein, 24 aa, Entamoeba dispar
CMCAWEREEYPIISSTFSMLIPHE

SEQ ID NO: 2476154 - protein, 18 aa, Entamoeba dispar
CMCDQCLEKLTAKGANIE

SEQ ID NO: 2476155 - protein, 18 aa, Entamoeba dispar
CMDKSRLDYIFQLKRPNE

SEQ ID NO: 2476156 - protein, 19 aa, Entamoeba dispar
CMFHVAPLIPCNNNDEQSL

SEQ ID NO: 2476157 - protein, 25 aa, Entamoeba dispar
CMIEECLEFEGCLECTRRECTKCNK

SEQ ID NO: 2476158 - protein, 17 aa, Entamoeba dispar
CMLGELGVGKTSIVLRY

SEQ ID NO: 2476159 - protein, 20 aa, Entamoeba dispar
CMRLCKHPNLVEYKDFFEWN

SEQ ID NO: 2476160 - protein, 21 aa, Entamoeba dispar
CMSDSLKIRVKVEWEKMKLKL

SEQ ID NO: 2476161 - protein, 19 aa, Entamoeba dispar
CMTNLKWVEIKKMIEKGIN

SEQ ID NO: 2476162 - protein, 28 aa, Entamoeba dispar
CNAICFYPFLNSDLIRFIRNIPEEFLVK

SEQ ID NO: 2476163 - protein, 34 aa, Entamoeba dispar
CNAKEWTNEFIWWCYDYDFEFGYDVQFDNIFLSV

SEQ ID NO: 2476164 - protein, 30 aa, Entamoeba dispar
CNCFNVAKVLLRWHIDLEKTNKYGFIPLGT

SEQ ID NO: 2476165 - protein, 21 aa, Entamoeba dispar
CNDDLFNLLTFEMIKDISNNY

SEQ ID NO: 2476166 - protein, 18 aa, Entamoeba dispar
CNDFKKAKAKSVASLLSQ

SEQ ID NO: 2476167 - protein, 27 aa, Entamoeba dispar
CNDRIKEMIKRGASPYQYYDSWDQLTI

SEQ ID NO: 2476168 - protein, 19 aa, Entamoeba dispar
CNECIKKIDQTIIFQTNTN

SEQ ID NO: 2476169 - protein, 18 aa, Entamoeba dispar
CNENEWFYFHEIKPLIKQ

SEQ ID NO: 2476170 - protein, 30 aa, Entamoeba dispar
CNEPVKTRFNCYAHVWDAHLRQYYTQNYPD

SEQ ID NO: 2476171 - protein, 19 aa, Entamoeba dispar
CNEQLKILLNTSSMDIIDF

SEQ ID NO: 2476172 - protein, 23 aa, Entamoeba dispar
CNETLKALTYLHSFHCVHRDIKS

SEQ ID NO: 2476173 - protein, 18 aa, Entamoeba dispar
CNEYFWKIITGCWCNEPS

SEQ ID NO: 2476174 - protein, 22 aa, Entamoeba dispar
CNFKREEIRTTPLIQNVENLKY

SEQ ID NO: 2476175 - protein, 18 aa, Entamoeba dispar
CNFKRIEYGPSLLSITNT

SEQ ID NO: 2476176 - protein, 20 aa, Entamoeba dispar
CNGKNVLKCKDCNKYCHEFC

SEQ ID NO: 2476177 - protein, 21 aa, Entamoeba dispar
CNGYLKILMERKFVPEFKQTK

SEQ ID NO: 2476178 - protein, 32 aa, Entamoeba dispar
CNHMTCPRCHGEWCWMCRGDWKTHGTKTGGFY

SEQ ID NO: 2476179 - protein, 17 aa, Entamoeba dispar
CNHRFCLCCLIEHVKQK

SEQ ID NO: 2476180 - protein, 18 aa, Entamoeba dispar
CNHYGDNIIFISLKSILK

SEQ ID NO: 2476181 - protein, 18 aa, Entamoeba dispar
CNICSSPLVGGCTGGLKC

SEQ ID NO: 2476182 - protein, 27 aa, Entamoeba dispar
CNIDDYRVEICKNLPPFMFEEDEDDFG

SEQ ID NO: 2476183 - protein, 18 aa, Entamoeba dispar
CNIELIFLNHSETKKLNP

SEQ ID NO: 2476184 - protein, 23 aa, Entamoeba dispar
CNIIKTRVKTCFIKEYIDLDFMG

SEQ ID NO: 2476185 - protein, 28 aa, Entamoeba dispar
CNILPIKRMLSPLIRVELSKALSLSGCS

SEQ ID NO: 2476186 - protein, 21 aa, Entamoeba dispar
CNINGTFYHKSCMKCKECHCN

SEQ ID NO: 2476187 - protein, 18 aa, Entamoeba dispar
CNISIEPSQLVLTVGNRE

SEQ ID NO: 2476188 - protein, 23 aa, Entamoeba dispar
CNISIKQLNTWFANYRSRTKKKF

SEQ ID NO: 2476189 - protein, 20 aa, Entamoeba dispar
CNISKELKEYCQINKIIITT

SEQ ID NO: 2476190 - protein, 18 aa, Entamoeba dispar
CNKCHQILEVSSWDLNDK

SEQ ID NO: 2476191 - protein, 20 aa, Entamoeba dispar
CNKIPELIDFCVERDYYWKL

SEQ ID NO: 2476192 - protein, 20 aa, Entamoeba dispar
CNKKIKLPLPVMSLDDGCNK

SEQ ID NO: 2476193 - protein, 19 aa, Entamoeba dispar
CNLKSLVIERSTCPFPFSL

SEQ ID NO: 2476194 - protein, 17 aa, Entamoeba dispar
CNLPTGVAMITVDETAQ

SEQ ID NO: 2476195 - protein, 17 aa, Entamoeba dispar
CNLSTNEGFLFPMSDSF

SEQ ID NO: 2476196 - protein, 24 aa, Entamoeba dispar
CNMKIKLLPYHSLPFAWNNPIKER

SEQ ID NO: 2476197 - protein, 17 aa, Entamoeba dispar
CNMNDIIEEVMKLKQKK

SEQ ID NO: 2476198 - protein, 24 aa, Entamoeba dispar
CNNPIKGNCVVVGNKNYHPECAPS

SEQ ID NO: 2476199 - protein, 17 aa, Entamoeba dispar
CNQCGYYEMSIRCDINC

SEQ ID NO: 2476200 - protein, 19 aa, Entamoeba dispar
CNQLRRLGSSLDWSREVFT

SEQ ID NO: 2476201 - protein, 25 aa, Entamoeba dispar
CNQLTELPSFFSLLSNLNSLDIDHN

SEQ ID NO: 2476202 - protein, 18 aa, Entamoeba dispar
CNQPYQVRKGVKFTTYGG

SEQ ID NO: 2476203 - protein, 19 aa, Entamoeba dispar
CNQSVRWAIENAKEHDKES

SEQ ID NO: 2476204 - protein, 24 aa, Entamoeba dispar
CNRTIEFVEQLGFTIEQRGTRSTK

SEQ ID NO: 2476205 - protein, 17 aa, Entamoeba dispar
CNSGEYNGKIGIKSQIQ

SEQ ID NO: 2476206 - protein, 26 aa, Entamoeba dispar
CNSIESFWRAFGCLPSLELLQDQKIS

SEQ ID NO: 2476207 - protein, 26 aa, Entamoeba dispar
CNSNFSFYWDLLKICQMKIKEKQLPF

SEQ ID NO: 2476208 - protein, 32 aa, Entamoeba dispar
CNSVKKLSDRIGCSVSFSFRDQTKIAIGTETV

SEQ ID NO: 2476209 - protein, 24 aa, Entamoeba dispar
CNTMTYFFSCLMVDEFTDTNCVEI

SEQ ID NO: 2476210 - protein, 18 aa, Entamoeba dispar
CNTYFCTNCLCEYHEGST

SEQ ID NO: 2476211 - protein, 17 aa, Entamoeba dispar
CNVFDSFDNLNEGMVSV

SEQ ID NO: 2476212 - protein, 18 aa, Entamoeba dispar
CNVNSYLCKLVESTSIVT

SEQ ID NO: 2476213 - protein, 36 aa, Entamoeba dispar
CNVYRLVCYIYKGLNLWYYPKLKGGTMMIITLYEKF

SEQ ID NO: 2476214 - protein, 17 aa, Entamoeba dispar
CNYQAFIRAEITIEYTR

SEQ ID NO: 2476215 - protein, 28 aa, Entamoeba dispar
CPAPHKCPVCNALIYSPFTICDIVIQPS

SEQ ID NO: 2476216 - protein, 19 aa, Entamoeba dispar
CPAVIAALFSICNEQNLPS

SEQ ID NO: 2476217 - protein, 17 aa, Entamoeba dispar
CPCCNDIYIVPQQFASR

SEQ ID NO: 2476218 - protein, 25 aa, Entamoeba dispar
CPCKARCQAFRKEVILRTIKNHKDI

SEQ ID NO: 2476219 - protein, 21 aa, Entamoeba dispar
CPDCTTPYCCSLHCLYDREEH

SEQ ID NO: 2476220 - protein, 20 aa, Entamoeba dispar
CPDNCKECLSSTSCNECMNG

SEQ ID NO: 2476221 - protein, 17 aa, Entamoeba dispar
CPEALFKPEKVGIDTAG

SEQ ID NO: 2476222 - protein, 19 aa, Entamoeba dispar
CPECKSLDTELIKENRINF

SEQ ID NO: 2476223 - protein, 18 aa, Entamoeba dispar
CPEEDRKLLKQSNEKIDK

SEQ ID NO: 2476224 - protein, 17 aa, Entamoeba dispar
CPELKQLIIKRSHGHIT

SEQ ID NO: 2476225 - protein, 20 aa, Entamoeba dispar
CPFVSQCFIYGESTDTFITA

SEQ ID NO: 2476226 - protein, 17 aa, Entamoeba dispar
CPHCQKPMLFMLQLYAP

SEQ ID NO: 2476227 - protein, 20 aa, Entamoeba dispar
CPIDCRRDLYKNIILSGGST

SEQ ID NO: 2476228 - protein, 18 aa, Entamoeba dispar
CPIIEYFGKINKLLRVSG

SEQ ID NO: 2476229 - protein, 17 aa, Entamoeba dispar
CPIRKSFNEESQEEKKY

SEQ ID NO: 2476230 - protein, 18 aa, Entamoeba dispar
CPISSILKIPNTDNSITT

SEQ ID NO: 2476231 - protein, 19 aa, Entamoeba dispar
CPITCVFDLLFVNKKIKKA

SEQ ID NO: 2476232 - protein, 19 aa, Entamoeba dispar
CPIVKNIINSVMLQLGEMK

SEQ ID NO: 2476233 - protein, 28 aa, Entamoeba dispar
CPKCGKRKCRHCDEYGISVGHIKTVLDS

SEQ ID NO: 2476234 - protein, 19 aa, Entamoeba dispar
CPKKHKFTIRSLKQKAKIT

SEQ ID NO: 2476235 - protein, 24 aa, Entamoeba dispar
CPKNELRFGYFKNEDIAISVYGNK

SEQ ID NO: 2476236 - protein, 23 aa, Entamoeba dispar
CPLKVEIDDCVFIHNDPPIYFIN

SEQ ID NO: 2476237 - protein, 17 aa, Entamoeba dispar
CPLLGKTTLPYSLTTLN

SEQ ID NO: 2476238 - protein, 19 aa, Entamoeba dispar
CPMDPGGYFIVKGVERVIL

SEQ ID NO: 2476239 - protein, 17 aa, Entamoeba dispar
CPNDLNGMLDCAKIADV

SEQ ID NO: 2476240 - protein, 20 aa, Entamoeba dispar
CPNEAALIITLRIIPSICLS

SEQ ID NO: 2476241 - protein, 25 aa, Entamoeba dispar
CPNKRCVVTLPFLRILEIQRGLDDC

SEQ ID NO: 2476242 - protein, 21 aa, Entamoeba dispar
CPNPLPFDMFILLFKSAVDDH

SEQ ID NO: 2476243 - protein, 17 aa, Entamoeba dispar
CPPECKLCEEHRSRRRT

SEQ ID NO: 2476244 - protein, 24 aa, Entamoeba dispar
CPPHFRNDFPFQVGMTTSIEPGIY

SEQ ID NO: 2476245 - protein, 19 aa, Entamoeba dispar
CPQFKSIELINHLEGNNFI

SEQ ID NO: 2476246 - protein, 26 aa, Entamoeba dispar
CPSIKTLKIHMCIKLMSIQFPSSIQS

SEQ ID NO: 2476247 - protein, 19 aa, Entamoeba dispar
CPSPSEFGVSIKDKRLKEF

SEQ ID NO: 2476248 - protein, 19 aa, Entamoeba dispar
CPTTGTFLYNCEKERRRYD

SEQ ID NO: 2476249 - protein, 21 aa, Entamoeba dispar
CPTVRSLLVVLIFKIILNGYN

SEQ ID NO: 2476250 - protein, 21 aa, Entamoeba dispar
CPVCSKKFPINQIESHVNKHF

SEQ ID NO: 2476251 - protein, 20 aa, Entamoeba dispar
CPVDTCGRAIHYFDTSRKEV

SEQ ID NO: 2476252 - protein, 18 aa, Entamoeba dispar
CQEFPDAHSIYALATSQS

SEQ ID NO: 2476253 - protein, 18 aa, Entamoeba dispar
CQFAVSFQGGVVMLIEPR

SEQ ID NO: 2476254 - protein, 18 aa, Entamoeba dispar
CQFSYSMLLMKLSLQTTE

SEQ ID NO: 2476255 - protein, 28 aa, Entamoeba dispar
CQGTNICKKCWTLLVAAVQVLNYILHEQ

SEQ ID NO: 2476256 - protein, 23 aa, Entamoeba dispar
CQHKLPKEERIEADGTTKEVHVV

SEQ ID NO: 2476257 - protein, 19 aa, Entamoeba dispar
CQIAICVKGSVSISVATKF

SEQ ID NO: 2476258 - protein, 19 aa, Entamoeba dispar
CQIEWNIKGEIIPKEINNF

SEQ ID NO: 2476259 - protein, 23 aa, Entamoeba dispar
CQINIKSDCIERVKLERNKQTQF

SEQ ID NO: 2476260 - protein, 25 aa, Entamoeba dispar
CQINKCKYTIWKILRSYKPFLNSWI

SEQ ID NO: 2476261 - protein, 34 aa, Entamoeba dispar
CQKRYLERRKEVWIAPLYFEFPGYEQAMFKERFC

SEQ ID NO: 2476262 - protein, 22 aa, Entamoeba dispar
CQLHSLRLISTWLDTFSPTLRS

SEQ ID NO: 2476263 - protein, 18 aa, Entamoeba dispar
CQMYLPKTIHVRPFTIST

SEQ ID NO: 2476264 - protein, 34 aa, Entamoeba dispar
CQNIQDCLNLLVSSWKNTESMIINNVNMEIEKEM

SEQ ID NO: 2476265 - protein, 18 aa, Entamoeba dispar
CQNKCQCASCKRKELKRL

SEQ ID NO: 2476266 - protein, 17 aa, Entamoeba dispar
CQNTIKFIKIMKDNTAF

SEQ ID NO: 2476267 - protein, 19 aa, Entamoeba dispar
CQNYLFKIIETCLQDNSTE

SEQ ID NO: 2476268 - protein, 28 aa, Entamoeba dispar
CQPGKAGFVRYNWIYPFLTKESFYKFGR

SEQ ID NO: 2476269 - protein, 21 aa, Entamoeba dispar
CQRCKQMLYSHIDLSKTMNEV

SEQ ID NO: 2476270 - protein, 24 aa, Entamoeba dispar
CQRLRKFAKPEMKVLIEEFEKIII

SEQ ID NO: 2476271 - protein, 19 aa, Entamoeba dispar
CQRVFGVIRDSFWRNARSK

SEQ ID NO: 2476272 - protein, 25 aa, Entamoeba dispar
CQSFRGCSGLESINIPSSVSKIGGY

SEQ ID NO: 2476273 - protein, 20 aa, Entamoeba dispar
CQSLPLNLFLFVNKKPIIDM

SEQ ID NO: 2476274 - protein, 21 aa, Entamoeba dispar
CQSNYICLHHWRENRREYLEH

SEQ ID NO: 2476275 - protein, 24 aa, Entamoeba dispar
CQSRSRNIIFIWKSFSKNGISKIT

SEQ ID NO: 2476276 - protein, 19 aa, Entamoeba dispar
CQTFYHLLCLKRLGRENHI

SEQ ID NO: 2476277 - protein, 18 aa, Entamoeba dispar
CQVLVLWLDCDREGENIS

SEQ ID NO: 2476278 - protein, 26 aa, Entamoeba dispar
CQYCNSNECILCYNGYQLQNKKCILY

SEQ ID NO: 2476279 - protein, 31 aa, Entamoeba dispar
CQYEPEVFPGLVYRMASPKVTLLVFSTGKVV

SEQ ID NO: 2476280 - protein, 32 aa, Entamoeba dispar
CQYEPEVFPGLVYRMASPKVTLLVFSTGKVVL

SEQ ID NO: 2476281 - protein, 17 aa, Entamoeba dispar
CRAVRELKRKDFTKPKK

SEQ ID NO: 2476282 - protein, 24 aa, Entamoeba dispar
CRCDIWKKCLGYSFEEEKYSKLTK

SEQ ID NO: 2476283 - protein, 17 aa, Entamoeba dispar
CRCKGVCDKNCVCVKHG

SEQ ID NO: 2476284 - protein, 29 aa, Entamoeba dispar
CRCLDYLTVRICLWVLYQLLCQIKTIIEM

SEQ ID NO: 2476285 - protein, 33 aa, Entamoeba dispar
CRDEMKWAEFEYCILFPFNVLKMKSIKIMIKYP

SEQ ID NO: 2476286 - protein, 17 aa, Entamoeba dispar
CRDGYLYLYGCDDKSMI

SEQ ID NO: 2476287 - protein, 18 aa, Entamoeba dispar
CRDLYGALNHNIKSQYQL

SEQ ID NO: 2476288 - protein, 17 aa, Entamoeba dispar
CRFELKQLFLQAPMVGL

SEQ ID NO: 2476289 - protein, 27 aa, Entamoeba dispar
CRKAPKPRYFVLCTDILFYTLPKKREV

SEQ ID NO: 2476290 - protein, 17 aa, Entamoeba dispar
CRKDIPISSSIIKRTIL

SEQ ID NO: 2476291 - protein, 18 aa, Entamoeba dispar
CRKEMYSIIYGKSTNLNL

SEQ ID NO: 2476292 - protein, 33 aa, Entamoeba dispar
CRKIIPPQFKCCLCSICGIKLHEECISLIRCGC

SEQ ID NO: 2476293 - protein, 19 aa, Entamoeba dispar
CRKTIYLDEMPSVISSALS

SEQ ID NO: 2476294 - protein, 24 aa, Entamoeba dispar
CRKTPKPRYFILFNDQLIYGTETM

SEQ ID NO: 2476295 - protein, 17 aa, Entamoeba dispar
CRLKIDKIYCGKGIKKV

SEQ ID NO: 2476296 - protein, 17 aa, Entamoeba dispar
CRLMNSIIIPTSVIELG

SEQ ID NO: 2476297 - protein, 19 aa, Entamoeba dispar
CRLVNEIMDVPLYISADKT

SEQ ID NO: 2476298 - protein, 18 aa, Entamoeba dispar
CRMRKRLIHDTDFFERYK

SEQ ID NO: 2476299 - protein, 24 aa, Entamoeba dispar
CRNQNCKGYHLLPYGKSYIVNQYP

SEQ ID NO: 2476300 - protein, 17 aa, Entamoeba dispar
CRNVPTDDCEVMLKWKR

SEQ ID NO: 2476301 - protein, 17 aa, Entamoeba dispar
CRQLAHYIVDWVQCQKY

SEQ ID NO: 2476302 - protein, 17 aa, Entamoeba dispar
CRQLHGIIFGIEGEKYW

SEQ ID NO: 2476303 - protein, 17 aa, Entamoeba dispar
CRQRIRQVQQPPLEPGQ

SEQ ID NO: 2476304 - protein, 17 aa, Entamoeba dispar
CRSLKSIKIPKYVQFIG

SEQ ID NO: 2476305 - protein, 17 aa, Entamoeba dispar
CRSLKSVNLPPTISEIG

SEQ ID NO: 2476306 - protein, 17 aa, Entamoeba dispar
CRTIYQLTFDTHMDQLD

SEQ ID NO: 2476307 - protein, 18 aa, Entamoeba dispar
CRTLKTFSSHGILMAYYQ

SEQ ID NO: 2476308 - protein, 25 aa, Entamoeba dispar
CRTMKQRPGIVGLWGEDGNVYIYDM

SEQ ID NO: 2476309 - protein, 17 aa, Entamoeba dispar
CRVEMNLIRVESIGRPL

SEQ ID NO: 2476310 - protein, 18 aa, Entamoeba dispar
CRVRIIDLEFERNVDEQQ

SEQ ID NO: 2476311 - protein, 18 aa, Entamoeba dispar
CRYFSKESGDGMFSKSYH

SEQ ID NO: 2476312 - protein, 17 aa, Entamoeba dispar
CRYQNRLDVNIQKTKGF

SEQ ID NO: 2476313 - protein, 29 aa, Entamoeba dispar
CRYWDVLHLSTFFPIIFRCSALSPDSLYI

SEQ ID NO: 2476314 - protein, 24 aa, Entamoeba dispar
CSAADAHFCMCLANAAVHVAMAGK

SEQ ID NO: 2476315 - protein, 21 aa, Entamoeba dispar
CSAKFTTLFRKHHCRKCGLCI

SEQ ID NO: 2476316 - protein, 21 aa, Entamoeba dispar
CSATYMKIVISKILNGLENTF

SEQ ID NO: 2476317 - protein, 17 aa, Entamoeba dispar
CSCDITLLQLIIENGLN

SEQ ID NO: 2476318 - protein, 22 aa, Entamoeba dispar
CSCEYEDLFSALLCISYAAEII

SEQ ID NO: 2476319 - protein, 17 aa, Entamoeba dispar
CSCGGIIYPEPEGYKCH

SEQ ID NO: 2476320 - protein, 26 aa, Entamoeba dispar
CSCGKFKVICVYGGVDIQGQINKLQS

SEQ ID NO: 2476321 - protein, 17 aa, Entamoeba dispar
CSCQEGFSYVPDVVKMD

SEQ ID NO: 2476322 - protein, 25 aa, Entamoeba dispar
CSDEFEKKFDCVFNRFETNSLFYKF

SEQ ID NO: 2476323 - protein, 17 aa, Entamoeba dispar
CSDFFPIIIKIFQNTHD

SEQ ID NO: 2476324 - protein, 22 aa, Entamoeba dispar
CSDKGDQLMAVFQSFDSDCSLS

SEQ ID NO: 2476325 - protein, 19 aa, Entamoeba dispar
CSDLLSIISQEVFVKPTIA

SEQ ID NO: 2476326 - protein, 20 aa, Entamoeba dispar
CSDTSDMFCMAIVSNGCDVG

SEQ ID NO: 2476327 - protein, 26 aa, Entamoeba dispar
CSDYSPSLNVDLCWDDPYPKEFTDLI

SEQ ID NO: 2476328 - protein, 27 aa, Entamoeba dispar
CSEADISICDKIMCRIGAGDNIVEGMS

SEQ ID NO: 2476329 - protein, 19 aa, Entamoeba dispar
CSECEDGLHTVCPSCYPYA

SEQ ID NO: 2476330 - protein, 24 aa, Entamoeba dispar
CSEEIATICAMLQISGELFYRPKE

SEQ ID NO: 2476331 - protein, 26 aa, Entamoeba dispar
CSEFMGELYLKCFDQFNEQIRSTEGF

SEQ ID NO: 2476332 - protein, 19 aa, Entamoeba dispar
CSEHKRVSYRIDDVIETKE

SEQ ID NO: 2476333 - protein, 17 aa, Entamoeba dispar
CSEMIKTGISSSFYLNP

SEQ ID NO: 2476334 - protein, 22 aa, Entamoeba dispar
CSENFCGLIANCAKDQSIHDEL

SEQ ID NO: 2476335 - protein, 27 aa, Entamoeba dispar
CSEVDISICDKIMCRIGAGDNIVEGMS

SEQ ID NO: 2476336 - protein, 20 aa, Entamoeba dispar
CSEYAYSYCLTKLSYLSGYT

SEQ ID NO: 2476337 - protein, 20 aa, Entamoeba dispar
CSEYPDGIEIPAAMSTNQLI

SEQ ID NO: 2476338 - protein, 19 aa, Entamoeba dispar
CSFFLRSNFVKTWENYFYK

SEQ ID NO: 2476339 - protein, 25 aa, Entamoeba dispar
CSFLCALHGNDFFWVHGYNKGVPKD

SEQ ID NO: 2476340 - protein, 17 aa, Entamoeba dispar
CSFVERPFIFTSFHDNE

SEQ ID NO: 2476341 - protein, 20 aa, Entamoeba dispar
CSFVNEKEKFIAIITKKSVI

SEQ ID NO: 2476342 - protein, 19 aa, Entamoeba dispar
CSGEPKLTVYDAIINSLIQ

SEQ ID NO: 2476343 - protein, 17 aa, Entamoeba dispar
CSGIENMFPYMLSEANK

SEQ ID NO: 2476344 - protein, 19 aa, Entamoeba dispar
CSGIHREFGHRVKSISMAT

SEQ ID NO: 2476345 - protein, 19 aa, Entamoeba dispar
CSGKTTFANQLVKYINENY

SEQ ID NO: 2476346 - protein, 18 aa, Entamoeba dispar
CSGVPLIVTEPVVSFRET

SEQ ID NO: 2476347 - protein, 18 aa, Entamoeba dispar
CSHLKTSQFYVLFDSDTT

SEQ ID NO: 2476348 - protein, 26 aa, Entamoeba dispar
CSIGIIADGCGWGFRSKKASNNAVSG

SEQ ID NO: 2476349 - protein, 20 aa, Entamoeba dispar
CSIKRQEILNQIKITPKECI

SEQ ID NO: 2476350 - protein, 20 aa, Entamoeba dispar
CSIRYKLGKIRSFIEEKEQQ

SEQ ID NO: 2476351 - protein, 22 aa, Entamoeba dispar
CSIVQYGWSDFIVCSTYQGDIV

SEQ ID NO: 2476352 - protein, 27 aa, Entamoeba dispar
CSKIRKLRININFSIKFELKHPEYFTQ

SEQ ID NO: 2476353 - protein, 25 aa, Entamoeba dispar
CSKMIEHISKLIGIVQFSSNKKKKE

SEQ ID NO: 2476354 - protein, 19 aa, Entamoeba dispar
CSKSFEAIQQAFILSLLNN

SEQ ID NO: 2476355 - protein, 18 aa, Entamoeba dispar
CSLCGITCHSKCLKYVNA

SEQ ID NO: 2476356 - protein, 17 aa, Entamoeba dispar
CSLFESLWPPSYEDNPK

SEQ ID NO: 2476357 - protein, 18 aa, Entamoeba dispar
CSLKDIKIPLGLTSIGVS

SEQ ID NO: 2476358 - protein, 17 aa, Entamoeba dispar
CSLNIPIREGGLCLGTW

SEQ ID NO: 2476359 - protein, 24 aa, Entamoeba dispar
CSLNKTEGVMFLFSDTLMFTKSNK

SEQ ID NO: 2476360 - protein, 20 aa, Entamoeba dispar
CSLPEIRELYELLFSLLTRN

SEQ ID NO: 2476361 - protein, 25 aa, Entamoeba dispar
CSLPHLCFYDCPLLQHVVLPTTLTL

SEQ ID NO: 2476362 - protein, 29 aa, Entamoeba dispar
CSLYPSAIARLYLPMGAPNQMFHPIEWYL

SEQ ID NO: 2476363 - protein, 27 aa, Entamoeba dispar
CSLYPSAIVRLYLPMGAPNQMFHPIEW

SEQ ID NO: 2476364 - protein, 28 aa, Entamoeba dispar
CSLYPSAMKRLLIPTGYPKMITQPIQFI

SEQ ID NO: 2476365 - protein, 28 aa, Entamoeba dispar
CSLYPSAVARLFLPSGVPRVMNKPIEWY

SEQ ID NO: 2476366 - protein, 27 aa, Entamoeba dispar
CSNEIPSGCLPRSIDVILRGENVEQVR

SEQ ID NO: 2476367 - protein, 20 aa, Entamoeba dispar
CSNLTIIDTPGFRLGGDEAL

SEQ ID NO: 2476368 - protein, 19 aa, Entamoeba dispar
CSNLTLIDFGYGWNTIKEG

SEQ ID NO: 2476369 - protein, 17 aa, Entamoeba dispar
CSNVLFKIVNRAYNIFT

SEQ ID NO: 2476370 - protein, 20 aa, Entamoeba dispar
CSPNTPMALCHYFDHYFVPR

SEQ ID NO: 2476371 - protein, 25 aa, Entamoeba dispar
CSPPCDLKHISICVIDEEIFLGCSN

SEQ ID NO: 2476372 - protein, 21 aa, Entamoeba dispar
CSQCAHAAVGCFQKAMEVSPE

SEQ ID NO: 2476373 - protein, 24 aa, Entamoeba dispar
CSQESMGVIIGFVIENIIREGGEW

SEQ ID NO: 2476374 - protein, 17 aa, Entamoeba dispar
CSQILTYLCDIRDATHG

SEQ ID NO: 2476375 - protein, 23 aa, Entamoeba dispar
CSRHYRAPELVFRTNKYNSSIDI

SEQ ID NO: 2476376 - protein, 26 aa, Entamoeba dispar
CSRKDMFKKLVICILVTIKDGVCKQK

SEQ ID NO: 2476377 - protein, 17 aa, Entamoeba dispar
CSSCNKGKCKGCVDGYY

SEQ ID NO: 2476378 - protein, 18 aa, Entamoeba dispar
CSSCSSVEELELFLKSTC

SEQ ID NO: 2476379 - protein, 18 aa, Entamoeba dispar
CSSIMSINIPSPVSKIGN

SEQ ID NO: 2476380 - protein, 18 aa, Entamoeba dispar
CSSLEKIVLPSLITSIGD

SEQ ID NO: 2476381 - protein, 27 aa, Entamoeba dispar
CSSLFQFPKRLICLTKMVMTNSSFNSY

SEQ ID NO: 2476382 - protein, 22 aa, Entamoeba dispar
CSSLKSIIILTSITSFGYGCFY

SEQ ID NO: 2476383 - protein, 19 aa, Entamoeba dispar
CSSLTHIDIPSSVITTSNN

SEQ ID NO: 2476384 - protein, 19 aa, Entamoeba dispar
CSSNFWIPGTRYLQKKSHS

SEQ ID NO: 2476385 - protein, 19 aa, Entamoeba dispar
CSSPLMYVENLIKDCTSKN

SEQ ID NO: 2476386 - protein, 19 aa, Entamoeba dispar
CSTFGFPPISNTLEEIICN

SEQ ID NO: 2476387 - protein, 20 aa, Entamoeba dispar
CSTHKVSFLPLFEPKMFSSK

SEQ ID NO: 2476388 - protein, 22 aa, Entamoeba dispar
CSTKSKRALIKYIAIGKTTKGP

SEQ ID NO: 2476389 - protein, 19 aa, Entamoeba dispar
CSTLTICTRSTILKQKFFA

SEQ ID NO: 2476390 - protein, 19 aa, Entamoeba dispar
CSTPGRIISCTPIDEHSYI

SEQ ID NO: 2476391 - protein, 20 aa, Entamoeba dispar
CSTSLKGKELIHCTYCSIVD

SEQ ID NO: 2476392 - protein, 17 aa, Entamoeba dispar
CSTWNPLSSQLISGYGR

SEQ ID NO: 2476393 - protein, 18 aa, Entamoeba dispar
CSVDCSLVYDNDGLTEVH

SEQ ID NO: 2476394 - protein, 19 aa, Entamoeba dispar
CSVDCTLLYDNSDMSAVHF

SEQ ID NO: 2476395 - protein, 17 aa, Entamoeba dispar
CSVELFGNRFKDMGVDV

SEQ ID NO: 2476396 - protein, 18 aa, Entamoeba dispar
CSVNCPKKCISFGEDGRA

SEQ ID NO: 2476397 - protein, 20 aa, Entamoeba dispar
CSWEGLKEKIKNNILHSGDD

SEQ ID NO: 2476398 - protein, 19 aa, Entamoeba dispar
CSYCKKPIQQFELVECPFC

SEQ ID NO: 2476399 - protein, 17 aa, Entamoeba dispar
CSYFKKSDPFLLSSINI

SEQ ID NO: 2476400 - protein, 30 aa, Entamoeba dispar
CSYFRNPNCSEAFNMFLKRGADVNALNRLH

SEQ ID NO: 2476401 - protein, 17 aa, Entamoeba dispar
CSYRLGITKLDIPENDP

SEQ ID NO: 2476402 - protein, 26 aa, Entamoeba dispar
CTAILDWAANQHVGFSYFVSIGSSID

SEQ ID NO: 2476403 - protein, 21 aa, Entamoeba dispar
CTCLTYLCFAHNQIIEIPPTI

SEQ ID NO: 2476404 - protein, 18 aa, Entamoeba dispar
CTCTNPLYSFSVCAQCKK

SEQ ID NO: 2476405 - protein, 27 aa, Entamoeba dispar
CTDKMILPILKFIHGIVSIELVDEIEN

SEQ ID NO: 2476406 - protein, 19 aa, Entamoeba dispar
CTEAGMFAIRARRKVVTER

SEQ ID NO: 2476407 - protein, 28 aa, Entamoeba dispar
CTEFDCLFPVVLSPRLVLLGDIQQLKPV

SEQ ID NO: 2476408 - protein, 19 aa, Entamoeba dispar
CTFGPGMIVSDDLKEQMRT

SEQ ID NO: 2476409 - protein, 27 aa, Entamoeba dispar
CTFIKNEKKIKCEFTYNSIVASTAYLK

SEQ ID NO: 2476410 - protein, 20 aa, Entamoeba dispar
CTGHSLGGAIAEVITLLYRS

SEQ ID NO: 2476411 - protein, 19 aa, Entamoeba dispar
CTGKVFIDCDYEEFMEEKD

SEQ ID NO: 2476412 - protein, 24 aa, Entamoeba dispar
CTGLKRVDIPIGISKIEDGSFYGC

SEQ ID NO: 2476413 - protein, 25 aa, Entamoeba dispar
CTIEIKEIPDYVGYLTDGIDDDMCT

SEQ ID NO: 2476414 - protein, 17 aa, Entamoeba dispar
CTIEYPTQILHLYDLVV

SEQ ID NO: 2476415 - protein, 25 aa, Entamoeba dispar
CTIIKPEYGEYYWVAKVEDEETENE

SEQ ID NO: 2476416 - protein, 20 aa, Entamoeba dispar
CTINENLDIFSFLLKDFRLI

SEQ ID NO: 2476417 - protein, 21 aa, Entamoeba dispar
CTIQLGDYCILKRDEIMTIVE

SEQ ID NO: 2476418 - protein, 24 aa, Entamoeba dispar
CTKEKMLSIKLHWLQNTLNESEQN

SEQ ID NO: 2476419 - protein, 26 aa, Entamoeba dispar
CTKGFSYCYECNVIYCESHLEQHIKT

SEQ ID NO: 2476420 - protein, 20 aa, Entamoeba dispar
CTKILLDWKDLVLSELEGCN

SEQ ID NO: 2476421 - protein, 21 aa, Entamoeba dispar
CTKQILCIVLQMVYNNVQVIG

SEQ ID NO: 2476422 - protein, 20 aa, Entamoeba dispar
CTKRQCGINSFPLKITAEKV

SEQ ID NO: 2476423 - protein, 20 aa, Entamoeba dispar
CTKYKLPINKTRVLMFGKSN

SEQ ID NO: 2476424 - protein, 18 aa, Entamoeba dispar
CTLLEMYVGYQIFTGKSE

SEQ ID NO: 2476425 - protein, 25 aa, Entamoeba dispar
CTLTIHWQFDVTLRGLRKVLTPNTE

SEQ ID NO: 2476426 - protein, 21 aa, Entamoeba dispar
CTLTIHWQFDVTLRGLRKVLV

SEQ ID NO: 2476427 - protein, 24 aa, Entamoeba dispar
CTLTIHWQFDVTLRGLRKVLVPNA

SEQ ID NO: 2476428 - protein, 18 aa, Entamoeba dispar
CTLTRAFCGSNVADVIRK

SEQ ID NO: 2476429 - protein, 17 aa, Entamoeba dispar
CTMESDVFTLVFFHCPQ

SEQ ID NO: 2476430 - protein, 25 aa, Entamoeba dispar
CTNALRYFFDICGLVSQTNFEDIES

SEQ ID NO: 2476431 - protein, 28 aa, Entamoeba dispar
CTNGDIIFYKWVRDMFGYKRNPEHKKET

SEQ ID NO: 2476432 - protein, 26 aa, Entamoeba dispar
CTNKTWKQYIEWLKEKDLIIEINESV

SEQ ID NO: 2476433 - protein, 18 aa, Entamoeba dispar
CTNLGVFVIPNLPKRKEG

SEQ ID NO: 2476434 - protein, 21 aa, Entamoeba dispar
CTNYSQKTCVGKVFLEFTPFL

SEQ ID NO: 2476435 - protein, 17 aa, Entamoeba dispar
CTQAAQFMAGVMKEAFS

SEQ ID NO: 2476436 - protein, 19 aa, Entamoeba dispar
CTQLILADCESLKNLIFPK

SEQ ID NO: 2476437 - protein, 17 aa, Entamoeba dispar
CTRLRIINIPTSVSEIG

SEQ ID NO: 2476438 - protein, 19 aa, Entamoeba dispar
CTSDKGLLTYEQKEINEFF

SEQ ID NO: 2476439 - protein, 35 aa, Entamoeba dispar
CTSNVIKECIPYGQLRAFPWNSLALMTTTGAKGSK

SEQ ID NO: 2476440 - protein, 19 aa, Entamoeba dispar
CTSSIKKRIFILLRLLVLS

SEQ ID NO: 2476441 - protein, 18 aa, Entamoeba dispar
CTSVCPVGAIIFNGISPQ

SEQ ID NO: 2476442 - protein, 21 aa, Entamoeba dispar
CTTLLKRIDLINVTVTINDHP

SEQ ID NO: 2476443 - protein, 20 aa, Entamoeba dispar
CTTPDEWKKVIDDWKRMPSS

SEQ ID NO: 2476444 - protein, 17 aa, Entamoeba dispar
CTVCGVCTKEPIVSNTM

SEQ ID NO: 2476445 - protein, 20 aa, Entamoeba dispar
CTVEALDLLEKVLVFDHQKR

SEQ ID NO: 2476446 - protein, 19 aa, Entamoeba dispar
CTWMAKPRNQFKVTVTQNI

SEQ ID NO: 2476447 - protein, 19 aa, Entamoeba dispar
CTYLNIFIQQLYSWLQDLL

SEQ ID NO: 2476448 - protein, 18 aa, Entamoeba dispar
CTYYLKALVPSTSYELQY

SEQ ID NO: 2476449 - protein, 24 aa, Entamoeba dispar
CVAGRSRSGTIAISYFMKKKHLSL

SEQ ID NO: 2476450 - protein, 29 aa, Entamoeba dispar
CVAPRAAEIIWLLCFMNYVSKQNVSTTRD

SEQ ID NO: 2476451 - protein, 23 aa, Entamoeba dispar
CVASEFMKSIVLPGIGFIGIADK

SEQ ID NO: 2476452 - protein, 18 aa, Entamoeba dispar
CVCCQKVVHSTCLNKMLP

SEQ ID NO: 2476453 - protein, 18 aa, Entamoeba dispar
CVCEFKIIEGHKKFVGGA

SEQ ID NO: 2476454 - protein, 19 aa, Entamoeba dispar
CVCYASLSSMAYAFFVNNC

SEQ ID NO: 2476455 - protein, 20 aa, Entamoeba dispar
CVDLKRLGVIDEIIDEVDKE

SEQ ID NO: 2476456 - protein, 17 aa, Entamoeba dispar
CVDNIDLIEGFEMKELI

SEQ ID NO: 2476457 - protein, 19 aa, Entamoeba dispar
CVFKVIKALILTIDSKLAS

SEQ ID NO: 2476458 - protein, 28 aa, Entamoeba dispar
CVFQYNCYGLYFAHCMALPQYKDVVCNL

SEQ ID NO: 2476459 - protein, 25 aa, Entamoeba dispar
CVFSSDLFIGKSFKCEVFDDNDEEH

SEQ ID NO: 2476460 - protein, 19 aa, Entamoeba dispar
CVGFSVGLERIMIILEEKL

SEQ ID NO: 2476461 - protein, 17 aa, Entamoeba dispar
CVGMYVCGGSKDLTEQQ

SEQ ID NO: 2476462 - protein, 18 aa, Entamoeba dispar
CVGMYVCGGSKDLTEQQL

SEQ ID NO: 2476463 - protein, 27 aa, Entamoeba dispar
CVGSTIRALRFIECIIQTIKASKLTQS

SEQ ID NO: 2476464 - protein, 21 aa, Entamoeba dispar
CVIAKGAALVAVQVGTKLRLL

SEQ ID NO: 2476465 - protein, 18 aa, Entamoeba dispar
CVIFYSFTDSDLVLNDQT

SEQ ID NO: 2476466 - protein, 27 aa, Entamoeba dispar
CVKLIECYPLRVGHGIFLNKKAIELMH

SEQ ID NO: 2476467 - protein, 18 aa, Entamoeba dispar
CVLKEAELGIGVRDIVDE

SEQ ID NO: 2476468 - protein, 21 aa, Entamoeba dispar
CVLLHYPFILDYMIIKIIHNT

SEQ ID NO: 2476469 - protein, 21 aa, Entamoeba dispar
CVLYKICYFDTPFEESPMRIQ

SEQ ID NO: 2476470 - protein, 26 aa, Entamoeba dispar
CVMNNIRLKSVIKRMIITRLYPYLWQ

SEQ ID NO: 2476471 - protein, 19 aa, Entamoeba dispar
CVMVSRWFGGILLGPDRFK

SEQ ID NO: 2476472 - protein, 20 aa, Entamoeba dispar
CVNTLPSLLIEKSKEEMWNA

SEQ ID NO: 2476473 - protein, 18 aa, Entamoeba dispar
CVPTPYKTIENIKNEEVF

SEQ ID NO: 2476474 - protein, 30 aa, Entamoeba dispar
CVPTRWRPINEFCTYILFFLKAIPSVPEVA

SEQ ID NO: 2476475 - protein, 19 aa, Entamoeba dispar
CVQHPSKGLFLRSYLLYVI

SEQ ID NO: 2476476 - protein, 18 aa, Entamoeba dispar
CVQKGTFSDFGFINEVLY

SEQ ID NO: 2476477 - protein, 20 aa, Entamoeba dispar
CVQNELYLANALMKDKQFQD

SEQ ID NO: 2476478 - protein, 18 aa, Entamoeba dispar
CVSCGCCTSVCPVGAIIF

SEQ ID NO: 2476479 - protein, 24 aa, Entamoeba dispar
CVSHGAWIKTSILGLLELEPTMYH

SEQ ID NO: 2476480 - protein, 25 aa, Entamoeba dispar
CVSKLPFKFTLSFRSENSIKIGAVV

SEQ ID NO: 2476481 - protein, 17 aa, Entamoeba dispar
CVSKRCEQIVCLMKRCP

SEQ ID NO: 2476482 - protein, 18 aa, Entamoeba dispar
CVSNYGLGVTELYLNDFV

SEQ ID NO: 2476483 - protein, 19 aa, Entamoeba dispar
CVSPELKLCKSKDEQIKFF

SEQ ID NO: 2476484 - protein, 32 aa, Entamoeba dispar
CVSPRRRPVYGGSPMPCMMIAEELNKRNKRES

SEQ ID NO: 2476485 - protein, 20 aa, Entamoeba dispar
CVSSMCFANCISLTSIHLQD

SEQ ID NO: 2476486 - protein, 21 aa, Entamoeba dispar
CVTAFKYIVCEPYSYTTEFNM

SEQ ID NO: 2476487 - protein, 18 aa, Entamoeba dispar
CVTLKYLMEHIVQLEVPL

SEQ ID NO: 2476488 - protein, 23 aa, Entamoeba dispar
CVTSYYPHCHHYPFDLTGVDPSR

SEQ ID NO: 2476489 - protein, 30 aa, Entamoeba dispar
CVVKQGHIIWNWYNRWLVLTKEQLYYYDES

SEQ ID NO: 2476490 - protein, 24 aa, Entamoeba dispar
CVVKRIFDIAFYFKSNALRLNTTT

SEQ ID NO: 2476491 - protein, 20 aa, Entamoeba dispar
CVVSGPGVDGGEELDDCNDA

SEQ ID NO: 2476492 - protein, 19 aa, Entamoeba dispar
CVYGFNAFYSKKPCKDYFK

SEQ ID NO: 2476493 - protein, 19 aa, Entamoeba dispar
CWIALCAFAAQTRTAYQLI

SEQ ID NO: 2476494 - protein, 22 aa, Entamoeba dispar
CWPAEAQNGLTLSMSYEATQEL

SEQ ID NO: 2476495 - protein, 18 aa, Entamoeba dispar
CYALCKPSQFPVGGCCYC

SEQ ID NO: 2476496 - protein, 19 aa, Entamoeba dispar
CYAYDFPLLCGGAVGGWKK

SEQ ID NO: 2476497 - protein, 19 aa, Entamoeba dispar
CYCSMKRFPNDVINSVGTP

SEQ ID NO: 2476498 - protein, 28 aa, Entamoeba dispar
CYDEKKKECWGFRRHPTYMAHKLIANCL

SEQ ID NO: 2476499 - protein, 28 aa, Entamoeba dispar
CYDKEVEIIKCINILSSIALNDKITSSN

SEQ ID NO: 2476500 - protein, 17 aa, Entamoeba dispar
CYDMFHWGHANVIRQAC

SEQ ID NO: 2476501 - protein, 19 aa, Entamoeba dispar
CYEAVFFIKTNPLILPTKE

SEQ ID NO: 2476502 - protein, 17 aa, Entamoeba dispar
CYEETCVPRCFKCGKPL

SEQ ID NO: 2476503 - protein, 28 aa, Entamoeba dispar
CYEILKTLQCYDLSPAVMTTTLYQEIIS

SEQ ID NO: 2476504 - protein, 17 aa, Entamoeba dispar
CYESFQMMHTNPNYSFK

SEQ ID NO: 2476505 - protein, 18 aa, Entamoeba dispar
CYFELRLGINGKDENEWN

SEQ ID NO: 2476506 - protein, 22 aa, Entamoeba dispar
CYFFKRDILKQMEDTWPEQYKE

SEQ ID NO: 2476507 - protein, 24 aa, Entamoeba dispar
CYFGNFLFNCVEPINPRPESLWDV

SEQ ID NO: 2476508 - protein, 24 aa, Entamoeba dispar
CYFKEVKSDIVSFFTNRYSLYSDV

SEQ ID NO: 2476509 - protein, 22 aa, Entamoeba dispar
CYGDCKMYVYGGWIDSEKKYNN

SEQ ID NO: 2476510 - protein, 17 aa, Entamoeba dispar
CYHLMKERKNMSLKYLI

SEQ ID NO: 2476511 - protein, 18 aa, Entamoeba dispar
CYIGSKGVINLTKFVGSN

SEQ ID NO: 2476512 - protein, 34 aa, Entamoeba dispar
CYINPWCSRDTSIWVCPICNSRYPLPPDSRTYSS

SEQ ID NO: 2476513 - protein, 24 aa, Entamoeba dispar
CYLHKNSTALVWNRYAIIPDQNGN

SEQ ID NO: 2476514 - protein, 26 aa, Entamoeba dispar
CYLILLSDFYRSVVLLLFKPYDYTVI

SEQ ID NO: 2476515 - protein, 21 aa, Entamoeba dispar
CYNFIPRKKIEKYKIEKEKFK

SEQ ID NO: 2476516 - protein, 26 aa, Entamoeba dispar
CYNYHKYKKIYIVEWARSPIHRASQA

SEQ ID NO: 2476517 - protein, 23 aa, Entamoeba dispar
CYQDELYYKKIIQFVNKESLTSA

SEQ ID NO: 2476518 - protein, 19 aa, Entamoeba dispar
CYQIGFMIYLMVKNKREVV

SEQ ID NO: 2476519 - protein, 21 aa, Entamoeba dispar
CYQLPSYFIKGITVVVSPLVS

SEQ ID NO: 2476520 - protein, 25 aa, Entamoeba dispar
CYQRERLPLPAARDFENASDNYLRA

SEQ ID NO: 2476521 - protein, 18 aa, Entamoeba dispar
CYSACSVFTKGLKECGSA

SEQ ID NO: 2476522 - protein, 19 aa, Entamoeba dispar
CYSACSVFTKGLKEWGSAI

SEQ ID NO: 2476523 - protein, 32 aa, Entamoeba dispar; identical to SEQ ID NO: 2380706

SEQ ID NO: 2476524 - protein, 18 aa, Entamoeba dispar
CYSKIPAKIQKQMTEIFT

SEQ ID NO: 2476525 - protein, 24 aa, Entamoeba dispar
CYSLPTKVHLNLNCDMKEDPDVYI

SEQ ID NO: 2476526 - protein, 26 aa, Entamoeba dispar
CYSQIPSLLGNYAIKVPGRIWPLMIN

SEQ ID NO: 2476527 - protein, 20 aa, Entamoeba dispar
CYVCHQQGHIARNCPKQSGR

SEQ ID NO: 2476528 - protein, 19 aa, Entamoeba dispar
CYYCRRGLIPELPQVNLPI

SEQ ID NO: 2476529 - protein, 17 aa, Entamoeba dispar
CYYRMATAKLRLHKYDD

SEQ ID NO: 2476530 - protein, 18 aa, Entamoeba dispar
DAAEFLLLLLDVMDNDLR

SEQ ID NO: 2476531 - protein, 22 aa, Entamoeba dispar
DAAPPAYLLAGLYLIDSLIRYL

SEQ ID NO: 2476532 - protein, 23 aa, Entamoeba dispar
DAELWKRLADMFKEDGDMEQYYY

SEQ ID NO: 2476533 - protein, 24 aa, Entamoeba dispar
DAFIKAAPFFLYMREFIGNNSHAL

SEQ ID NO: 2476534 - protein, 23 aa, Entamoeba dispar
DAFKRIRMIDYFVTKYTSVAFIP

SEQ ID NO: 2476535 - protein, 17 aa, Entamoeba dispar
DAFKVYIKKNTKLCPQC

SEQ ID NO: 2476536 - protein, 23 aa, Entamoeba dispar
DAFYCVMEFVIKAQCCGHFYSSQ

SEQ ID NO: 2476537 - protein, 17 aa, Entamoeba dispar
DAGKGPVNFTIHCVNKV

SEQ ID NO: 2476538 - protein, 20 aa, Entamoeba dispar
DAIAAFWWDDFCDGDLEDLE

SEQ ID NO: 2476539 - protein, 18 aa, Entamoeba dispar
DAIEGIVVYQSFRDKTLF

SEQ ID NO: 2476540 - protein, 17 aa, Entamoeba dispar
DAIKCSKIAKVFTDAHR

SEQ ID NO: 2476541 - protein, 21 aa, Entamoeba dispar
DAITNCFKNLLKVFTSTKSQV

SEQ ID NO: 2476542 - protein, 17 aa, Entamoeba dispar
DAKCIAYMLLLKKIFSN

SEQ ID NO: 2476543 - protein, 23 aa, Entamoeba dispar
DAKETLTCLTLEWIDELTDRKGE

SEQ ID NO: 2476544 - protein, 34 aa, Entamoeba dispar
DAKKAIELDPNYAKAYARLGIALTKKHKYAEAQK

SEQ ID NO: 2476545 - protein, 27 aa, Entamoeba dispar
DAKTDIFLCIVLKYIYDNCWPKAIEML

SEQ ID NO: 2476546 - protein, 17 aa, Entamoeba dispar
DALDEYLPFLSYLSDSY

SEQ ID NO: 2476547 - protein, 17 aa, Entamoeba dispar
DALKIVRKYLLGPLGMK

SEQ ID NO: 2476548 - protein, 26 aa, Entamoeba dispar
DALKPGKDALHWGVLRPFDSSYPGID

SEQ ID NO: 2476549 - protein, 19 aa, Entamoeba dispar
DALLDRKAFKEAMDSTTKK

SEQ ID NO: 2476550 - protein, 20 aa, Entamoeba dispar
DALNCTAEGEGLENAETKTP

SEQ ID NO: 2476551 - protein, 21 aa, Entamoeba dispar
DALNFCFWPTEGFEYDDLTKG

SEQ ID NO: 2476552 - protein, 17 aa, Entamoeba dispar
DALVCIDLGLNLKKNDP

SEQ ID NO: 2476553 - protein, 24 aa, Entamoeba dispar
DALVKIKLSFRPGAVDAEKAVAPH

SEQ ID NO: 2476554 - protein, 17 aa, Entamoeba dispar
DAQEFLKSLEIPKPADF

SEQ ID NO: 2476555 - protein, 20 aa, Entamoeba dispar
DAQGIIICYDVTSPKSLTSI

SEQ ID NO: 2476556 - protein, 18 aa, Entamoeba dispar
DAQIAVQLIFYAHFDENW

SEQ ID NO: 2476557 - protein, 18 aa, Entamoeba dispar
DARIQEGQLKKWEIKYYK

SEQ ID NO: 2476558 - protein, 24 aa, Entamoeba dispar
DARKHILYLAGIVKGEIVMIRVRL

SEQ ID NO: 2476559 - protein, 18 aa, Entamoeba dispar
DARLSKKKKQVIQQRAPS

SEQ ID NO: 2476560 - protein, 27 aa, Entamoeba dispar
DARQSSLRILHCLNSNFEESLLQEFIN

SEQ ID NO: 2476561 - protein, 21 aa, Entamoeba dispar
DARSLFLLLREVFFVHSPPKL

SEQ ID NO: 2476562 - protein, 24 aa, Entamoeba dispar
DATKRIAIVNCDWENTSARDLFAL

SEQ ID NO: 2476563 - protein, 30 aa, Entamoeba dispar
DATWKKPQEWNHKCVMCVSKMGKFSSDRSM

SEQ ID NO: 2476564 - protein, 19 aa, Entamoeba dispar
DAVCKLCRMNFMETDNFQR

SEQ ID NO: 2476565 - protein, 18 aa, Entamoeba dispar
DAYLYTKERREIICPNPG

SEQ ID NO: 2476566 - protein, 17 aa, Entamoeba dispar
DAYRVYSRNKKTAWNKQ

SEQ ID NO: 2476567 - protein, 21 aa, Entamoeba dispar
DAYRYFAYCRQLKCSINEDFQ

SEQ ID NO: 2476568 - protein, 17 aa, Entamoeba dispar
DCCFCRCSSLTSINIPS

SEQ ID NO: 2476569 - protein, 17 aa, Entamoeba dispar
DCCPAHSNIDVPVIKRV

SEQ ID NO: 2476570 - protein, 35 aa, Entamoeba dispar
DCDLRKEMYNNIVLCGGSSMFPGMKQRFIKEITIL

SEQ ID NO: 2476571 - protein, 24 aa, Entamoeba dispar
DCEYKLIVTLGFDKVNSVLEINEH

SEQ ID NO: 2476572 - protein, 23 aa, Entamoeba dispar
DCEYKLIVTLGFDNVNRVLEINE

SEQ ID NO: 2476573 - protein, 23 aa, Entamoeba dispar
DCEYKLIVTLGFDNVNSVTEMNQ

SEQ ID NO: 2476574 - protein, 20 aa, Entamoeba dispar
DCFGDIKKQGGAPCNFAMHM

SEQ ID NO: 2476575 - protein, 17 aa, Entamoeba dispar
DCFKGCSSLTSINIPSS

SEQ ID NO: 2476576 - protein, 17 aa, Entamoeba dispar
DCFSGCLSLTSMNIDNI

SEQ ID NO: 2476577 - protein, 19 aa, Entamoeba dispar
DCFTCKFDDIISSLDKNVP

SEQ ID NO: 2476578 - protein, 17 aa, Entamoeba dispar
DCFYGCSSLTNMSIDKV

SEQ ID NO: 2476579 - protein, 17 aa, Entamoeba dispar
DCFYGCTSLISINIDNL

SEQ ID NO: 2476580 - protein, 17 aa, Entamoeba dispar
DCFYGCYLLKSINIPSS

SEQ ID NO: 2476581 - protein, 21 aa, Entamoeba dispar
DCGDYFFNWFNTVLKDTNKTK

SEQ ID NO: 2476582 - protein, 21 aa, Entamoeba dispar
DCGHKFCIDCCYEHIHEKIFN

SEQ ID NO: 2476583 - protein, 24 aa, Entamoeba dispar
DCGKLGRYLIHPCEVIFKNRYILK

SEQ ID NO: 2476584 - protein, 29 aa, Entamoeba dispar
DCGKNKVVCLLFPWIIRPQQNIMFIHSTM

SEQ ID NO: 2476585 - protein, 17 aa, Entamoeba dispar
DCGLMSYLINIIKKPPS

SEQ ID NO: 2476586 - protein, 19 aa, Entamoeba dispar
DCGNYCFNHCIGLTSIPLI

SEQ ID NO: 2476587 - protein, 23 aa, Entamoeba dispar
DCHSLKVLIDFKGCESDSFTIDI

SEQ ID NO: 2476588 - protein, 17 aa, Entamoeba dispar
DCHTVWDGVLGQRKNIT

SEQ ID NO: 2476589 - protein, 20 aa, Entamoeba dispar
DCIAEIFAKAVREEIMDQCQ

SEQ ID NO: 2476590 - protein, 21 aa, Entamoeba dispar
DCIEYKCGCIQRDHRKEDIQC

SEQ ID NO: 2476591 - protein, 19 aa, Entamoeba dispar
DCIIDFYAEWCGPCRFISP

SEQ ID NO: 2476592 - protein, 18 aa, Entamoeba dispar
DCIQEFLAPLNLFDTSNK

SEQ ID NO: 2476593 - protein, 26 aa, Entamoeba dispar
DCKAIFEVLKVYPFITDKQKSMVEYL

SEQ ID NO: 2476594 - protein, 29 aa, Entamoeba dispar
DCKISDACLRSAAAVGYYPPYQGYADGGI

SEQ ID NO: 2476595 - protein, 19 aa, Entamoeba dispar
DCKNFYYKGTEIIISEEEK

SEQ ID NO: 2476596 - protein, 18 aa, Entamoeba dispar
DCLCCKKGNGLTKSALHF

SEQ ID NO: 2476597 - protein, 23 aa, Entamoeba dispar
DCLKGNEPMCVSFERLTPNKLTV

SEQ ID NO: 2476598 - protein, 19 aa, Entamoeba dispar
DCLSMVFMFASYRVSKGEK

SEQ ID NO: 2476599 - protein, 23 aa, Entamoeba dispar
DCMFKGCTSLSVIKSKNPKNLQI

SEQ ID NO: 2476600 - protein, 20 aa, Entamoeba dispar
DCNCAGRIITWCKKYAQSKQ

SEQ ID NO: 2476601 - protein, 19 aa, Entamoeba dispar
DCPLGKYGIDITIQQLRRI

SEQ ID NO: 2476602 - protein, 17 aa, Entamoeba dispar
DCQPRLVSTESARQWCE

SEQ ID NO: 2476603 - protein, 20 aa, Entamoeba dispar
DCSDAGIAVQCMDNSHVSLV

SEQ ID NO: 2476604 - protein, 20 aa, Entamoeba dispar
DCSEFGFSMFNLQIGVKTII

SEQ ID NO: 2476605 - protein, 18 aa, Entamoeba dispar
DCSIPLTTFDQIRSYDKI

SEQ ID NO: 2476606 - protein, 21 aa, Entamoeba dispar
DCSPAFWKFLDLIGNKIELNG

SEQ ID NO: 2476607 - protein, 26 aa, Entamoeba dispar
DCSSLSKLVLCSSLIHLGISSFENCK

SEQ ID NO: 2476608 - protein, 22 aa, Entamoeba dispar
DCSVGKTCIIGRFTSKIFDMSY

SEQ ID NO: 2476609 - protein, 27 aa, Entamoeba dispar
DCTEVTKAIVIKGVIQIEINGMFFAID

SEQ ID NO: 2476610 - protein, 26 aa, Entamoeba dispar
DCTFKVIEGMIPFNMNQAIPLVALNC

SEQ ID NO: 2476611 - protein, 20 aa, Entamoeba dispar
DCTHYSTAVDIWAFGCVVAE

SEQ ID NO: 2476612 - protein, 21 aa, Entamoeba dispar
DCTIFKLSKPPFLLFPNKQPT

SEQ ID NO: 2476613 - protein, 25 aa, Entamoeba dispar
DCYIKLDICLIYGVMVLCKKRGNYY

SEQ ID NO: 2476614 - protein, 22 aa, Entamoeba dispar
DCYPVGWDKTYSLNYIKDKYSH

SEQ ID NO: 2476615 - protein, 21 aa, Entamoeba dispar
DDALLRPGRLEVQIEIGLPDE

SEQ ID NO: 2476616 - protein, 18 aa, Entamoeba dispar
DDCCFYKCSSLTSIKIPS

SEQ ID NO: 2476617 - protein, 25 aa, Entamoeba dispar
DDCDRRGHFSFPRSLAIDHTKNYIY

SEQ ID NO: 2476618 - protein, 38 aa, Entamoeba dispar
DDCFIAASFMKLYLREMLEPLIPFNLYEQFIQLPKGGS

SEQ ID NO: 2476619 - protein, 21 aa, Entamoeba dispar
DDCIYLFKTAGYLVTKKFLKG

SEQ ID NO: 2476620 - protein, 21 aa, Entamoeba dispar
DDCQKVKLFFESLQSQVDTFQ

SEQ ID NO: 2476621 - protein, 26 aa, Entamoeba dispar
DDDCFYKCLLLTTLHIPRTVTKIGDE

SEQ ID NO: 2476622 - protein, 27 aa, Entamoeba dispar
DDEAAIKFKTRFVELKFDNKNTLKFYT

SEQ ID NO: 2476623 - protein, 23 aa, Entamoeba dispar
DDEFKGVFRMERSEFNMLPRWKK

SEQ ID NO: 2476624 - protein, 18 aa, Entamoeba dispar
DDEIFKDGIIFKHVIWYP

SEQ ID NO: 2476625 - protein, 17 aa, Entamoeba dispar
DDEKYLWKPVTIAETEK

SEQ ID NO: 2476626 - protein, 20 aa, Entamoeba dispar
DDESIKRFGNKHSINKLILL

SEQ ID NO: 2476627 - protein, 25 aa, Entamoeba dispar
DDEYVPRSPIYFSHLSLTPTVNNAT

SEQ ID NO: 2476628 - protein, 25 aa, Entamoeba dispar
DDFIVCPFCSYSGIMVDPIVYKKST

SEQ ID NO: 2476629 - protein, 29 aa, Entamoeba dispar
DDFQFTKQFLWKWFNEQFIKKVNQTREKL

SEQ ID NO: 2476630 - protein, 17 aa, Entamoeba dispar
DDFWRMVDISAQGLPEN

SEQ ID NO: 2476631 - protein, 26 aa, Entamoeba dispar
DDFYVPDIIGALILSMSKRIMNELIY

SEQ ID NO: 2476632 - protein, 24 aa, Entamoeba dispar
DDGAGLACLLALMELHQKFEHAPI

SEQ ID NO: 2476633 - protein, 24 aa, Entamoeba dispar
DDGDFLLKWSFSSMKGVIENLKCS

SEQ ID NO: 2476634 - protein, 17 aa, Entamoeba dispar
DDGIVLVFDELQRKLDY

SEQ ID NO: 2476635 - protein, 24 aa, Entamoeba dispar
DDGRIFKTIIWYKVDYSTYFQEKG

SEQ ID NO: 2476636 - protein, 25 aa, Entamoeba dispar
DDGRIFKTIIWYTVDYSTYLFEKEQ

SEQ ID NO: 2476637 - protein, 27 aa, Entamoeba dispar
DDGTGVACGLAYMELRDKFQHPALELL

SEQ ID NO: 2476638 - protein, 26 aa, Entamoeba dispar
DDGWVCPHCQAICSATSVISLYSMPV

SEQ ID NO: 2476639 - protein, 17 aa, Entamoeba dispar
DDGYCQIVLDYPDKEEE

SEQ ID NO: 2476640 - protein, 21 aa, Entamoeba dispar
DDGYLWVAMEYMDGGCLTDLL

SEQ ID NO: 2476641 - protein, 17 aa, Entamoeba dispar
DDHMKPKVKVERKNGVI

SEQ ID NO: 2476642 - protein, 17 aa, Entamoeba dispar
DDICALLMDICHEESTL

SEQ ID NO: 2476643 - protein, 27 aa, Entamoeba dispar
DDIFTRISRRAELTLSGFDEKCNGEKS

SEQ ID NO: 2476644 - protein, 17 aa, Entamoeba dispar
DDIIISFSLHDNNCSLF

SEQ ID NO: 2476645 - protein, 17 aa, Entamoeba dispar
DDIKKSSLVQFVIELLK

SEQ ID NO: 2476646 - protein, 23 aa, Entamoeba dispar
DDIKRMCEDYMIKLIDKYPPTKI

SEQ ID NO: 2476647 - protein, 24 aa, Entamoeba dispar
DDIPEFLQGFVMKKRRGDDLEMFV

SEQ ID NO: 2476648 - protein, 17 aa, Entamoeba dispar
DDIPLPILKALYSLYFS

SEQ ID NO: 2476649 - protein, 21 aa, Entamoeba dispar
DDIQKLLIIREHCWQKNFEFI

SEQ ID NO: 2476650 - protein, 35 aa, Entamoeba dispar
DDKELPSQIVGGFLFLRLFCPAIASPENFGLLGVE

SEQ ID NO: 2476651 - protein, 20 aa, Entamoeba dispar
DDKHTICTLIPSSAPSESSK

SEQ ID NO: 2476652 - protein, 22 aa, Entamoeba dispar
DDKKADGFILVYSKQIEKSLEY

SEQ ID NO: 2476653 - protein, 21 aa, Entamoeba dispar
DDKKVSISLERIMKDLHIDKL

SEQ ID NO: 2476654 - protein, 20 aa, Entamoeba dispar
DDKLGKCKLVVPGDLKEGEV

SEQ ID NO: 2476655 - protein, 21 aa, Entamoeba dispar
DDLFEVITFCNDKTCSFVVVY

SEQ ID NO: 2476656 - protein, 20 aa, Entamoeba dispar
DDLKCIINVITRISIIPETF

SEQ ID NO: 2476657 - protein, 20 aa, Entamoeba dispar
DDLKGKVLITLRDPSKQIQH

SEQ ID NO: 2476658 - protein, 17 aa, Entamoeba dispar
DDLKKKFGLISDITKTE

SEQ ID NO: 2476659 - protein, 17 aa, Entamoeba dispar
DDLKLLVRLLIHFISIM

SEQ ID NO: 2476660 - protein, 29 aa, Entamoeba dispar
DDLLWTRHFPIAFLMRQHMLLLGRSEEIN

SEQ ID NO: 2476661 - protein, 19 aa, Entamoeba dispar
DDLPGFGTNELRVFDEKKG

SEQ ID NO: 2476662 - protein, 17 aa, Entamoeba dispar
DDLRRLVTMGINEQYFK

SEQ ID NO: 2476663 - protein, 19 aa, Entamoeba dispar
DDLTLKLSRINEEIKEMSY

SEQ ID NO: 2476664 - protein, 17 aa, Entamoeba dispar
DDMELLWNYTFKEKLHV

SEQ ID NO: 2476665 - protein, 18 aa, Entamoeba dispar
DDMERFREQFAYIMKNNL

SEQ ID NO: 2476666 - protein, 17 aa, Entamoeba dispar
DDMFQVQCVFMVTEDAI

SEQ ID NO: 2476667 - protein, 26 aa, Entamoeba dispar
DDMVKELSDFLFAPKLLKRDFKLNYI

SEQ ID NO: 2476668 - protein, 18 aa, Entamoeba dispar
DDNGFNFITFSSNLKTFL

SEQ ID NO: 2476669 - protein, 26 aa, Entamoeba dispar
DDNIKWIFELAMKFIELEDIQNAVIQ

SEQ ID NO: 2476670 - protein, 25 aa, Entamoeba dispar
DDNYLLKVMGYITVRFKQLRTTRNE

SEQ ID NO: 2476671 - protein, 24 aa, Entamoeba dispar
DDPEFKFDLAVSLHKIDLAREMAD

SEQ ID NO: 2476672 - protein, 17 aa, Entamoeba dispar
DDPKTIIVFKCNENALK

SEQ ID NO: 2476673 - protein, 17 aa, Entamoeba dispar
DDPKWLHESIIKMHNIA

SEQ ID NO: 2476674 - protein, 22 aa, Entamoeba dispar
DDPRIILVGTKCDIRDNQKLID

SEQ ID NO: 2476675 - protein, 18 aa, Entamoeba dispar
DDPVPNVRIHLCHAIYLI

SEQ ID NO: 2476676 - protein, 23 aa, Entamoeba dispar
DDQRLETCIACNKRIEGEFVSAL

SEQ ID NO: 2476677 - protein, 25 aa, Entamoeba dispar
DDRESDMWKKLGIEATKFNLDNNNL

SEQ ID NO: 2476678 - protein, 19 aa, Entamoeba dispar
DDRIKDRKQILLMNNDEKV

SEQ ID NO: 2476679 - protein, 21 aa, Entamoeba dispar
DDRIPAWCDRVLCRTQNAYPY

SEQ ID NO: 2476680 - protein, 20 aa, Entamoeba dispar
DDRYDPDLGKIVDKKIKEIE

SEQ ID NO: 2476681 - protein, 21 aa, Entamoeba dispar
DDSIPLFGFVGRICEQKGVFL

SEQ ID NO: 2476682 - protein, 29 aa, Entamoeba dispar
DDSTCRKLTWMPGHIWMGTVTVVRPRSIR

SEQ ID NO: 2476683 - protein, 22 aa, Entamoeba dispar
DDSVCTRAILDVGYYHTSIVIF

SEQ ID NO: 2476684 - protein, 24 aa, Entamoeba dispar
DDSVFKICLMCIIDSDGFTGAMKW

SEQ ID NO: 2476685 - protein, 23 aa, Entamoeba dispar
DDTRVRFSILLNLPIIHSFPIPL

SEQ ID NO: 2476686 - protein, 22 aa, Entamoeba dispar
DDTSRFCLINGPNMGGKSTYIR

SEQ ID NO: 2476687 - protein, 17 aa, Entamoeba dispar
DDTTFFFLLLLQQYEQA

SEQ ID NO: 2476688 - protein, 23 aa, Entamoeba dispar
DDTVEFIFDYAFEQCTELKNINF

SEQ ID NO: 2476689 - protein, 20 aa, Entamoeba dispar
DDTVVKCMICNKPFSFFIRR

SEQ ID NO: 2476690 - protein, 31 aa, Entamoeba dispar
DDTWKKQIDMEWKRKISQKFQTNEREEIKKD

SEQ ID NO: 2476691 - protein, 22 aa, Entamoeba dispar
DDVDYCRTLFESPMWSADDVKL

SEQ ID NO: 2476692 - protein, 25 aa, Entamoeba dispar
DDVLKEVISFRCAMARVKVEFKESE

SEQ ID NO: 2476693 - protein, 18 aa, Entamoeba dispar
DDWLETVSSYTAFHRAVL

SEQ ID NO: 2476694 - protein, 27 aa, Entamoeba dispar
DDYAWWKGRLSQMSQYFNAYRIDHILG

SEQ ID NO: 2476695 - protein, 17 aa, Entamoeba dispar
DDYHFIFTLQTSLSNVP

SEQ ID NO: 2476696 - protein, 23 aa, Entamoeba dispar
DDYLKPYLRRTTLIKDIIDKNKG

SEQ ID NO: 2476697 - protein, 23 aa, Entamoeba dispar
DEAAIKFKTRFVELKFDNKNTLK

SEQ ID NO: 2476698 - protein, 17 aa, Entamoeba dispar
DEAEIREKFKWYYEKFG

SEQ ID NO: 2476699 - protein, 17 aa, Entamoeba dispar
DEAIRCYVTALNHNPSN

SEQ ID NO: 2476700 - protein, 22 aa, Entamoeba dispar
DEAISFFKSEMDKIYPKKTPFE

SEQ ID NO: 2476701 - protein, 20 aa, Entamoeba dispar
DEAIVYFFKGLCGAATKELE

SEQ ID NO: 2476702 - protein, 20 aa, Entamoeba dispar
DEALFKINLLKRMDEIKRRN

SEQ ID NO: 2476703 - protein, 22 aa, Entamoeba dispar
DEARVSILAFQFFKQIYKLFEK

SEQ ID NO: 2476704 - protein, 21 aa, Entamoeba dispar
DEAYVLLVCMNRYRKNCKSEL

SEQ ID NO: 2476705 - protein, 25 aa, Entamoeba dispar
DECFEGCSMLTFVYIPSSVKKIGSY

SEQ ID NO: 2476706 - protein, 17 aa, Entamoeba dispar
DECGLWMAAISIVLNKY

SEQ ID NO: 2476707 - protein, 17 aa, Entamoeba dispar
DECKIPSNYLIEPVQRF

SEQ ID NO: 2476708 - protein, 21 aa, Entamoeba dispar
DECRDFRATLARILQEKIVLF

SEQ ID NO: 2476709 - protein, 25 aa, Entamoeba dispar
DEDIRLRLCPHISLDDIKTFLYLNI

SEQ ID NO: 2476710 - protein, 18 aa, Entamoeba dispar
DEDLPLWPQDKDIKNYTS

SEQ ID NO: 2476711 - protein, 26 aa, Entamoeba dispar
DEDPDFFWKYLFKCYDAYDQITNSFV

SEQ ID NO: 2476712 - protein, 28 aa, Entamoeba dispar
DEEALKIVGAFVFLRLINPVLLTPLKFS

SEQ ID NO: 2476713 - protein, 35 aa, Entamoeba dispar
DEEERFRRALSFIRIGMPIPFYVLKRNIAAYPRYH

SEQ ID NO: 2476714 - protein, 23 aa, Entamoeba dispar
DEEGWKLFGDIFSCEEFKKTRSV

SEQ ID NO: 2476715 - protein, 18 aa, Entamoeba dispar
DEEHALFLEGLSLYHRDW

SEQ ID NO: 2476716 - protein, 17 aa, Entamoeba dispar
DEEIKFLQIDVISVSSP

SEQ ID NO: 2476717 - protein, 22 aa, Entamoeba dispar
DEEILKCFLFNIERLLNMIIQT

SEQ ID NO: 2476718 - protein, 21 aa, Entamoeba dispar
DEEKIRIVGISLKDVVDELKE

SEQ ID NO: 2476719 - protein, 19 aa, Entamoeba dispar
DEEKMVFILKLLKDEWNKS

SEQ ID NO: 2476720 - protein, 26 aa, Entamoeba dispar
DEELIRLALICVINISSSDNVEEYID

SEQ ID NO: 2476721 - protein, 20 aa, Entamoeba dispar
DEERRAVLMLSVHALLDDGM

SEQ ID NO: 2476722 - protein, 24 aa, Entamoeba dispar
DEEYRYVVMNNLFPNDNFPLQYKF

SEQ ID NO: 2476723 - protein, 23 aa, Entamoeba dispar
DEFDYLLRNSILFRKETFDSAID

SEQ ID NO: 2476724 - protein, 18 aa, Entamoeba dispar
DEFFAHYNVNAFENEFEG

SEQ ID NO: 2476725 - protein, 19 aa, Entamoeba dispar
DEFFWRRRPSPKIVQHENG

SEQ ID NO: 2476726 - protein, 19 aa, Entamoeba dispar
DEFHTNWSGYATEFKSARQ

SEQ ID NO: 2476727 - protein, 23 aa, Entamoeba dispar
DEFIIRKMIRKFIKGEEIDNIKF

SEQ ID NO: 2476728 - protein, 25 aa, Entamoeba dispar
DEFKYGFQKFNLFKGKKVFATELFT

SEQ ID NO: 2476729 - protein, 22 aa, Entamoeba dispar
DEFLKKYILEKKWEEIEDGKED

SEQ ID NO: 2476730 - protein, 22 aa, Entamoeba dispar
DEFMTLCLNSFILEKDLQKENG

SEQ ID NO: 2476731 - protein, 21 aa, Entamoeba dispar
DEFNIPPCISNWKNNRGYTIS

SEQ ID NO: 2476732 - protein, 25 aa, Entamoeba dispar
DEFNQRLISIFSFNLFAGMVGGCKQ

SEQ ID NO: 2476733 - protein, 20 aa, Entamoeba dispar
DEFNRFCCSHPQFIENEKFY

SEQ ID NO: 2476734 - protein, 23 aa, Entamoeba dispar
DEFNTRCECCGLKNKQIHFEKMY

SEQ ID NO: 2476735 - protein, 25 aa, Entamoeba dispar
DEFTQIFWKLGMKNFDDFIEKLKKL

SEQ ID NO: 2476736 - protein, 25 aa, Entamoeba dispar
DEFTQMFWQLGMKNFDEFIKKLKKL

SEQ ID NO: 2476737 - protein, 35 aa, Entamoeba dispar
DEFYHLPDCINVIPVQRISSTLVFVKSTNQQVNPN

SEQ ID NO: 2476738 - protein, 19 aa, Entamoeba dispar
DEGDFCFTEILYGQFRREV

SEQ ID NO: 2476739 - protein, 23 aa, Entamoeba dispar
DEGISLLRWSLLRPSDTKGISPL

SEQ ID NO: 2476740 - protein, 21 aa, Entamoeba dispar
DEGYVGMFVDVCIQNLCQMIE

SEQ ID NO: 2476741 - protein, 17 aa, Entamoeba dispar
DEHKVFIIDGFPRNAEN

SEQ ID NO: 2476742 - protein, 24 aa, Entamoeba dispar
DEHTRFMICLCFLNATACKGLPVL

SEQ ID NO: 2476743 - protein, 23 aa, Entamoeba dispar
DEIAQSMSYHAFILSKITTLQND

SEQ ID NO: 2476744 - protein, 24 aa, Entamoeba dispar
DEIDCLHPTLDIGIFNKPTLLSVS

SEQ ID NO: 2476745 - protein, 37 aa, Entamoeba dispar
DEIESCPSIPSNIDCGFRPKFGKLQLVNGKIIEELPQ

SEQ ID NO: 2476746 - protein, 28 aa, Entamoeba dispar
DEIFKDGRLFKYVIWYDISYSLYLKEKE

SEQ ID NO: 2476747 - protein, 25 aa, Entamoeba dispar
DEIIFCKPPALPPRRSVSTTQAIPT

SEQ ID NO: 2476748 - protein, 17 aa, Entamoeba dispar
DEIIFRMIENVVNKKGK

SEQ ID NO: 2476749 - protein, 22 aa, Entamoeba dispar
DEIIKLWRVSLLQHQIVLNDEC

SEQ ID NO: 2476750 - protein, 22 aa, Entamoeba dispar
DEILKKILDGVGIENDDETIQI

SEQ ID NO: 2476751 - protein, 20 aa, Entamoeba dispar
DEILKKMGLANGFCSTKGKH

SEQ ID NO: 2476752 - protein, 21 aa, Entamoeba dispar
DEILRLSLTRLTFKTIIKSSL

SEQ ID NO: 2476753 - protein, 24 aa, Entamoeba dispar
DEIPKRFYELMFLIAEKIKLEGFG

SEQ ID NO: 2476754 - protein, 19 aa, Entamoeba dispar
DEIPRFKARQIEAMNYQAD

SEQ ID NO: 2476755 - protein, 23 aa, Entamoeba dispar
DEIQRIRKLNGFIDHSKVNGEIV

SEQ ID NO: 2476756 - protein, 18 aa, Entamoeba dispar
DEIREWYRVYKVAEGKKL

SEQ ID NO: 2476757 - protein, 19 aa, Entamoeba dispar
DEISSPAIRVEYVDFFEDE

SEQ ID NO: 2476758 - protein, 25 aa, Entamoeba dispar
DEITMKLQIALIYYKKEEIEKYRFN

SEQ ID NO: 2476759 - protein, 22 aa, Entamoeba dispar
DEITVYMDIDFDDITKFEDDDD

SEQ ID NO: 2476760 - protein, 23 aa, Entamoeba dispar
DEKCIGCALCSSVCPVNAIEYVK

SEQ ID NO: 2476761 - protein, 23 aa, Entamoeba dispar
DEKENKSGLFGMLKDKKEDKKKK

SEQ ID NO: 2476762 - protein, 30 aa, Entamoeba dispar
DEKIRWQRVHVAKFNKCIVALEKQRKKDGL

SEQ ID NO: 2476763 - protein, 21 aa, Entamoeba dispar
DEKKKLFVFEDCSSESNDENT

SEQ ID NO: 2476764 - protein, 25 aa, Entamoeba dispar
DEKKLGWFEGFKIKGEVLEKIHTAG

SEQ ID NO: 2476765 - protein, 19 aa, Entamoeba dispar
DEKLKALIMNKINELDDDD

SEQ ID NO: 2476766 - protein, 26 aa, Entamoeba dispar
DEKLVSNEIWEWILLPKEKFQKRKKT

SEQ ID NO: 2476767 - protein, 17 aa, Entamoeba dispar
DEKMMLAFFTIVAQKYL

SEQ ID NO: 2476768 - protein, 25 aa, Entamoeba dispar
DEKPSGGFFSSFGSFLAGAVNYVLP

SEQ ID NO: 2476769 - protein, 31 aa, Entamoeba dispar
DEKPSGGFFSSFGSFLAGAVNYVLPSVDEQS

SEQ ID NO: 2476770 - protein, 24 aa, Entamoeba dispar
DEKRRLKVLELKLHREAEERRKRE

SEQ ID NO: 2476771 - protein, 28 aa, Entamoeba dispar
DEKRTQLVPVLYKLEFVALVIQNLYTNT

SEQ ID NO: 2476772 - protein, 29 aa, Entamoeba dispar
DEKRTQLVPVLYKLEFVALVIQNLYTNTS

SEQ ID NO: 2476773 - protein, 23 aa, Entamoeba dispar
DEKSKDLICWSREQNRPGFVVLE

SEQ ID NO: 2476774 - protein, 24 aa, Entamoeba dispar
DEKYRIYSVFKNCEFHLQEWKRKE

SEQ ID NO: 2476775 - protein, 17 aa, Entamoeba dispar
DELCEMYNIPSLNNINV

SEQ ID NO: 2476776 - protein, 18 aa, Entamoeba dispar
DELCEMYNIPSLNNINVK

SEQ ID NO: 2476777 - protein, 26 aa, Entamoeba dispar
DELEADVYWSFCWILQSIQSHYTYDQ

SEQ ID NO: 2476778 - protein, 22 aa, Entamoeba dispar
DELIIYCGLKTMRIISDRNPVL

SEQ ID NO: 2476779 - protein, 24 aa, Entamoeba dispar
DELIPIFLERLVAFPLDKLTINYK

SEQ ID NO: 2476780 - protein, 30 aa, Entamoeba dispar
DELISDIWFSRIIKSICKIQMKEEIRSKIL

SEQ ID NO: 2476781 - protein, 26 aa, Entamoeba dispar
DELKAICCSHGPVLRTNIKENIERYK

SEQ ID NO: 2476782 - protein, 23 aa, Entamoeba dispar
DELKEKLHPLGLFKNIESLSITK

SEQ ID NO: 2476783 - protein, 20 aa, Entamoeba dispar
DELKIKKGELVCVLGSVGSG

SEQ ID NO: 2476784 - protein, 34 aa, Entamoeba dispar
DELKKPPKKDYLALFDLEDIKPFTSQQLPLNVQE

SEQ ID NO: 2476785 - protein, 35 aa, Entamoeba dispar
DELKRELKTIVGRMFILDEEWEYWINVLYECLVMD

SEQ ID NO: 2476786 - protein, 25 aa, Entamoeba dispar
DELKRVAKKKIVMCTSALSSTKSPL

SEQ ID NO: 2476787 - protein, 25 aa, Entamoeba dispar
DELKSTILEIGYFYTITLEEICSLN

SEQ ID NO: 2476788 - protein, 20 aa, Entamoeba dispar
DELLKARWPKDMKMNNDTIK

SEQ ID NO: 2476789 - protein, 19 aa, Entamoeba dispar
DELPIKIIIIGDLGVGKTS

SEQ ID NO: 2476790 - protein, 25 aa, Entamoeba dispar
DELRRHIKTDFTIDHAAAYRYAKLL

SEQ ID NO: 2476791 - protein, 19 aa, Entamoeba dispar
DELYCIYIKTLVELCQTVI

SEQ ID NO: 2476792 - protein, 21 aa, Entamoeba dispar
DELYSLPTLYSDFLIFMNKEN

SEQ ID NO: 2476793 - protein, 21 aa, Entamoeba dispar
DELYVRVLVDYSIHLKNKYPY

SEQ ID NO: 2476794 - protein, 18 aa, Entamoeba dispar
DEMFKEFLKTHGECPECH

SEQ ID NO: 2476795 - protein, 26 aa, Entamoeba dispar
DEMIFKIRFDAGVTDLIWRNQTNFLA

SEQ ID NO: 2476796 - protein, 18 aa, Entamoeba dispar
DEMIKMKINKEGNDKEII

SEQ ID NO: 2476797 - protein, 23 aa, Entamoeba dispar
DEMKDVFVYAWKINNCDPELQFA

SEQ ID NO: 2476798 - protein, 21 aa, Entamoeba dispar
DEMKLIWKLRYTVKKTKPKNL

SEQ ID NO: 2476799 - protein, 19 aa, Entamoeba dispar
DEMKSCLLDSFVKYAKEKK

SEQ ID NO: 2476800 - protein, 17 aa, Entamoeba dispar
DEMMKYIADHDVILIKN

SEQ ID NO: 2476801 - protein, 20 aa, Entamoeba dispar
DENCIFCNECTVYARDIGQR

SEQ ID NO: 2476802 - protein, 19 aa, Entamoeba dispar
DENGIGLNSFNAWNRKFNI

SEQ ID NO: 2476803 - protein, 25 aa, Entamoeba dispar
DENIKRKRVVLVHCECGVSRSASIV

SEQ ID NO: 2476804 - protein, 26 aa, Entamoeba dispar
DENIKSFFYRRPVFKPSPIFNANNMS

SEQ ID NO: 2476805 - protein, 23 aa, Entamoeba dispar
DENKRWVLSMLLSYDEKQRKQGD

SEQ ID NO: 2476806 - protein, 17 aa, Entamoeba dispar
DENYGWLSIQKTTIPKS

SEQ ID NO: 2476807 - protein, 24 aa, Entamoeba dispar
DENYHITEYLALGATLAVSYVENI

SEQ ID NO: 2476808 - protein, 20 aa, Entamoeba dispar
DENYISLIFVREGINPFRKA

SEQ ID NO: 2476809 - protein, 17 aa, Entamoeba dispar
DENYPFWNPYTNENVTI

SEQ ID NO: 2476810 - protein, 24 aa, Entamoeba dispar
DEPESVCCGMHCASNLKYRESAAK

SEQ ID NO: 2476811 - protein, 24 aa, Entamoeba dispar
DEPEWKKKIGYSLFEQVKILETEI

SEQ ID NO: 2476812 - protein, 17 aa, Entamoeba dispar
DEPKQRCQTQKLQPLTE

SEQ ID NO: 2476813 - protein, 17 aa, Entamoeba dispar
DEPSYLIYFMRPGYSSD

SEQ ID NO: 2476814 - protein, 20 aa, Entamoeba dispar
DEPWYLKFNNSAIFANKTTD

SEQ ID NO: 2476815 - protein, 20 aa, Entamoeba dispar
DEPWYLKFNNSAIYDDDIKD

SEQ ID NO: 2476816 - protein, 20 aa, Entamoeba dispar
DEPWYLKFNNSAIYDDNTED

SEQ ID NO: 2476817 - protein, 17 aa, Entamoeba dispar
DEQEKLLKERKREAKKL

SEQ ID NO: 2476818 - protein, 23 aa, Entamoeba dispar
DEQKRFTIQQCLNHEFISLKHQK

SEQ ID NO: 2476819 - protein, 31 aa, Entamoeba dispar
DEQMLKQQTWRWFVCLFSREFTVEKVIVIWD

SEQ ID NO: 2476820 - protein, 21 aa, Entamoeba dispar
DEQNGIEIFKGCNVLVDCSDN

SEQ ID NO: 2476821 - protein, 21 aa, Entamoeba dispar
DEQNYRFILFDDINYDRNLIR

SEQ ID NO: 2476822 - protein, 22 aa, Entamoeba dispar
DEQRLLCLLQLVNICDDDIHLH

SEQ ID NO: 2476823 - protein, 18 aa, Entamoeba dispar
DEQRLSVMEKWHSKTTMM

SEQ ID NO: 2476824 - protein, 27 aa, Entamoeba dispar
DEQVEILFYLCEFCDDFKYFEPTFIYI

SEQ ID NO: 2476825 - protein, 29 aa, Entamoeba dispar
DEREPRYVISIKEFARFVVGKSNRVEKNA

SEQ ID NO: 2476826 - protein, 23 aa, Entamoeba dispar
DERHQCTIFRQIVYDIINTIVQR

SEQ ID NO: 2476827 - protein, 21 aa, Entamoeba dispar
DERIVMHLLWLMANIASDGIV

SEQ ID NO: 2476828 - protein, 24 aa, Entamoeba dispar
DERKHLFNQWSFIGGDENTTGLVR

SEQ ID NO: 2476829 - protein, 23 aa, Entamoeba dispar
DERLKLGYERNFDFLRTNASMLL

SEQ ID NO: 2476830 - protein, 22 aa, Entamoeba dispar
DERLKRCTIYLGFTSEMMTSGL

SEQ ID NO: 2476831 - protein, 18 aa, Entamoeba dispar
DESFIKNKMEPYGLVQKI

SEQ ID NO: 2476832 - protein, 19 aa, Entamoeba dispar
DESFYPSEMIVVGSTNGKC

SEQ ID NO: 2476833 - protein, 26 aa, Entamoeba dispar
DESILPCSIDKGFGPVVFYDACGGLE

SEQ ID NO: 2476834 - protein, 26 aa, Entamoeba dispar
DESKSLWLIALRNAFVRFNIATAVSK

SEQ ID NO: 2476835 - protein, 17 aa, Entamoeba dispar
DESLLTFDLLSLINSFK

SEQ ID NO: 2476836 - protein, 26 aa, Entamoeba dispar
DESVWKRFNATFAYLPILALINKKIL

SEQ ID NO: 2476837 - protein, 25 aa, Entamoeba dispar
DETIERYGLDMLKRIGDYKTLIECL

SEQ ID NO: 2476838 - protein, 21 aa, Entamoeba dispar
DETKKYISVCVQGIPKQWNTR

SEQ ID NO: 2476839 - protein, 21 aa, Entamoeba dispar
DETRWIKKCFSDISILINSIE

SEQ ID NO: 2476840 - protein, 25 aa, Entamoeba dispar
DETSKRKIIYCTKQPLPSVLRRQQI

SEQ ID NO: 2476841 - protein, 20 aa, Entamoeba dispar
DETTKLLKSMGFNEKKIAKW

SEQ ID NO: 2476842 - protein, 17 aa, Entamoeba dispar
DEVDLMIAYGYENDIKE

SEQ ID NO: 2476843 - protein, 18 aa, Entamoeba dispar
DEVFPAIKYSSAPPTPDF

SEQ ID NO: 2476844 - protein, 22 aa, Entamoeba dispar
DEVINMFKRLIVELPNKEETFI

SEQ ID NO: 2476845 - protein, 17 aa, Entamoeba dispar
DEVITALRNILSDRRKD

SEQ ID NO: 2476846 - protein, 26 aa, Entamoeba dispar
DEVKAKEYYLPFVFVDGKAEQEQIDF

SEQ ID NO: 2476847 - protein, 23 aa, Entamoeba dispar
DEVKEIDAALVLAKASDKPTLIC

SEQ ID NO: 2476848 - protein, 24 aa, Entamoeba dispar
DEVKRIVADLCDFDPTELIKETMN

SEQ ID NO: 2476849 - protein, 22 aa, Entamoeba dispar
DEVKSCRICQSDRRIIEIDHCD

SEQ ID NO: 2476850 - protein, 17 aa, Entamoeba dispar
DEVPMISSIVPIADLVE

SEQ ID NO: 2476851 - protein, 19 aa, Entamoeba dispar
DEVSIVLILRYKHMNSETT

SEQ ID NO: 2476852 - protein, 18 aa, Entamoeba dispar
DEVVDFLVCYFVISRLYH

SEQ ID NO: 2476853 - protein, 20 aa, Entamoeba dispar
DEVVKSLNMAGGDKKVISRL

SEQ ID NO: 2476854 - protein, 18 aa, Entamoeba dispar
DEYLIIWNPLFLPKPEIN

SEQ ID NO: 2476855 - protein, 24 aa, Entamoeba dispar
DEYPPDFIINLALASCMWFEQPLI

SEQ ID NO: 2476856 - protein, 35 aa, Entamoeba dispar
DEYRKRAHLYNEKWRKTDVNGHWSGKRFDTNRDNF

SEQ ID NO: 2476857 - protein, 19 aa, Entamoeba dispar
DEYSESGSPFYGEVNKQFI

SEQ ID NO: 2476858 - protein, 21 aa, Entamoeba dispar
DEYYCTPCSLNFTKKGDESRM

SEQ ID NO: 2476859 - protein, 17 aa, Entamoeba dispar
DEYYHKINWGMRTHERF

SEQ ID NO: 2476860 - protein, 20 aa, Entamoeba dispar
DFAFESCITLTCVSYKGTKE

SEQ ID NO: 2476861 - protein, 25 aa, Entamoeba dispar
DFCKDMFRELMKRDGIGEWTNYNVD

SEQ ID NO: 2476862 - protein, 22 aa, Entamoeba dispar
DFCPSEGTFLLFQAAKCGNENA

SEQ ID NO: 2476863 - protein, 23 aa, Entamoeba dispar
DFDFLWKKINSFIKSNMSKYSDS

SEQ ID NO: 2476864 - protein, 19 aa, Entamoeba dispar
DFDGVCSPGSILNPGSIYL

SEQ ID NO: 2476865 - protein, 25 aa, Entamoeba dispar
DFDKAVAIQKAWKGYRNRKRALSQR

SEQ ID NO: 2476866 - protein, 24 aa, Entamoeba dispar
DFDKESKCSFSIALFSMVIGLTHF

SEQ ID NO: 2476867 - protein, 26 aa, Entamoeba dispar
DFDLLVCKGCAFLAQSIATEDISNIL

SEQ ID NO: 2476868 - protein, 21 aa, Entamoeba dispar
DFDVLKLLGFTELKLNKINET

SEQ ID NO: 2476869 - protein, 19 aa, Entamoeba dispar
DFEDFKWIVREINENSNNL

SEQ ID NO: 2476870 - protein, 27 aa, Entamoeba dispar
DFEGVQKWYKKAVILIHPDKNQFRSAD

SEQ ID NO: 2476871 - protein, 25 aa, Entamoeba dispar
DFERCLDDFIFFCFLVGNDFLPRIP

SEQ ID NO: 2476872 - protein, 24 aa, Entamoeba dispar
DFFKEAYNYYKMVANHFFKTDNIL

SEQ ID NO: 2476873 - protein, 19 aa, Entamoeba dispar
DFFSEFFKHFEKWFSESEW

SEQ ID NO: 2476874 - protein, 22 aa, Entamoeba dispar
DFFSNIKFALIRNMTPPIIPRL

SEQ ID NO: 2476875 - protein, 33 aa, Entamoeba dispar
DFGLFPCRCQTSACLESNCSCFQGRNFCSPLCT

SEQ ID NO: 2476876 - protein, 17 aa, Entamoeba dispar
DFHIVRISGKLMYIPHN

SEQ ID NO: 2476877 - protein, 19 aa, Entamoeba dispar
DFHLLVFCLDYGVFSSLHS

SEQ ID NO: 2476878 - protein, 24 aa, Entamoeba dispar
DFHPKEPWVLAALHTGTIYILNYQ

SEQ ID NO: 2476879 - protein, 24 aa, Entamoeba dispar
DFIDEVIIGLSLADNVIITIDCAE

SEQ ID NO: 2476880 - protein, 25 aa, Entamoeba dispar
DFIDIPILIPIPVVKNRSCYSILYY

SEQ ID NO: 2476881 - protein, 19 aa, Entamoeba dispar
DFIEKCFVFDFKKRPQCEE

SEQ ID NO: 2476882 - protein, 22 aa, Entamoeba dispar
DFIELCCLILGEYGEYCEDILS

SEQ ID NO: 2476883 - protein, 19 aa, Entamoeba dispar
DFIIEPSVVGAFKTRVYDM

SEQ ID NO: 2476884 - protein, 19 aa, Entamoeba dispar
DFIKSMLTANGFEEMSDEM

SEQ ID NO: 2476885 - protein, 25 aa, Entamoeba dispar
DFILDCINIDISIYYNFIYSLYLLF

SEQ ID NO: 2476886 - protein, 20 aa, Entamoeba dispar
DFILFGRTKLLGKIKICKYI

SEQ ID NO: 2476887 - protein, 19 aa, Entamoeba dispar
DFINRVEWEKGIIWDSDTN

SEQ ID NO: 2476888 - protein, 18 aa, Entamoeba dispar
DFISFCFFENEGYEYSNY

SEQ ID NO: 2476889 - protein, 23 aa, Entamoeba dispar
DFKMYYQSIDFIPNIERNCSYKY

SEQ ID NO: 2476890 - protein, 20 aa, Entamoeba dispar
DFKNGQPINLYWSHGNQNQH

SEQ ID NO: 2476891 - protein, 19 aa, Entamoeba dispar
DFKRRIDLLELKLKTLPSN

SEQ ID NO: 2476892 - protein, 23 aa, Entamoeba dispar
DFKSIVFLVESFLNYSVQTESQH

SEQ ID NO: 2476893 - protein, 25 aa, Entamoeba dispar
DFLKIHASNIFSMFKDCPIVKKAVS

SEQ ID NO: 2476894 - protein, 22 aa, Entamoeba dispar
DFLNNPKIIIHLSGISKETRES

SEQ ID NO: 2476895 - protein, 23 aa, Entamoeba dispar
DFLPRIPSLDIRDGGVDLLMKVY

SEQ ID NO: 2476896 - protein, 21 aa, Entamoeba dispar
DFLQDYCHLVKMVSCKKHGKT

SEQ ID NO: 2476897 - protein, 23 aa, Entamoeba dispar
DFLQSLCFEKCCNTMTYFFSCLM

SEQ ID NO: 2476898 - protein, 17 aa, Entamoeba dispar
DFMIQGGDFTRHNGTGG

SEQ ID NO: 2476899 - protein, 18 aa, Entamoeba dispar
DFMLKKLINAERMTMYNT

SEQ ID NO: 2476900 - protein, 24 aa, Entamoeba dispar
DFNDYLLPIFPLSSIQKGKLLHGY

SEQ ID NO: 2476901 - protein, 18 aa, Entamoeba dispar
DFNQRKALVVSFNDGVLF

SEQ ID NO: 2476902 - protein, 21 aa, Entamoeba dispar
DFPEFYKPRDKFIAEVVDMLN

SEQ ID NO: 2476903 - protein, 26 aa, Entamoeba dispar
DFPNFLFCVVTWYSLCSQYPKVHQPP

SEQ ID NO: 2476904 - protein, 26 aa, Entamoeba dispar
DFPQIIIPRRYYIGGDIMAYNKKKCE

SEQ ID NO: 2476905 - protein, 18 aa, Entamoeba dispar
DFPSNGHVYLLDFSTNGT

SEQ ID NO: 2476906 - protein, 26 aa, Entamoeba dispar
DFPTVKGKESWAIKSIFLGKKCYLDV

SEQ ID NO: 2476907 - protein, 18 aa, Entamoeba dispar
DFRGHLRLLLNKQDNSHA

SEQ ID NO: 2476908 - protein, 19 aa, Entamoeba dispar
DFRGWSVVHHAIYEDKVEF

SEQ ID NO: 2476909 - protein, 24 aa, Entamoeba dispar
DFRIFLDTFFEGVRSPSFIIYTTS

SEQ ID NO: 2476910 - protein, 19 aa, Entamoeba dispar
DFRSRNGMWKRYEPKIYGS

SEQ ID NO: 2476911 - protein, 18 aa, Entamoeba dispar
DFSDFLIRKLINGDRTAI

SEQ ID NO: 2476912 - protein, 23 aa, Entamoeba dispar
DFSKFPKLDLRVVNAVDDALGTQ

SEQ ID NO: 2476913 - protein, 24 aa, Entamoeba dispar
DFSSIIELLGNINLHLINKDYSSI

SEQ ID NO: 2476914 - protein, 23 aa, Entamoeba dispar
DFSSMKTFVVFIVLDNPSNESIL

SEQ ID NO: 2476915 - protein, 18 aa, Entamoeba dispar
DFSTILWIKCNNKHTEQW

SEQ ID NO: 2476916 - protein, 21 aa, Entamoeba dispar
DFSYLSGLIRILADRYPSFLP

SEQ ID NO: 2476917 - protein, 23 aa, Entamoeba dispar
DFTEEEKRLLGLSQETTQTGLFS

SEQ ID NO: 2476918 - protein, 18 aa, Entamoeba dispar
DFTGCIIFSSKDPYYYVN

SEQ ID NO: 2476919 - protein, 18 aa, Entamoeba dispar
DFTKSRFPTESIKNRESI

SEQ ID NO: 2476920 - protein, 19 aa, Entamoeba dispar
DFTNHLARAVLIIGAPYLQ

SEQ ID NO: 2476921 - protein, 20 aa, Entamoeba dispar
DFTQWCDFLEFSPVSSVSDL

SEQ ID NO: 2476922 - protein, 18 aa, Entamoeba dispar
DFTTEGFLSLSYSIEKNS

SEQ ID NO: 2476923 - protein, 19 aa, Entamoeba dispar
DFTTEGFLSLSYSIEKNST

SEQ ID NO: 2476924 - protein, 24 aa, Entamoeba dispar
DFVTIKGIVKVRWISYNNEEIPEL

SEQ ID NO: 2476925 - protein, 23 aa, Entamoeba dispar
DFVYCLFSAKSIRNKKKEELYLS

SEQ ID NO: 2476926 - protein, 26 aa, Entamoeba dispar
DFYAEWCGPCRFISPIFEQYSRQYPN

SEQ ID NO: 2476927 - protein, 23 aa, Entamoeba dispar
DGAEVALRIQIEHKMSDYIKKKI

SEQ ID NO: 2476928 - protein, 31 aa, Entamoeba dispar
DGALWSFAINSVFYFRLLSPFCVSIGNIDSC

SEQ ID NO: 2476929 - protein, 23 aa, Entamoeba dispar
DGAPCGLLNHFAVSCRINARKHP

SEQ ID NO: 2476930 - protein, 20 aa, Entamoeba dispar
DGAVGKTCMLISYTTNAFPN

SEQ ID NO: 2476931 - protein, 26 aa, Entamoeba dispar
DGAVYVWNLTTSKFACCVYPEVNVHQ

SEQ ID NO: 2476932 - protein, 21 aa, Entamoeba dispar
DGCFIKCLLEKGEITLNEPRE

SEQ ID NO: 2476933 - protein, 21 aa, Entamoeba dispar
DGCFIKCLLEKGEITLSEPRE

SEQ ID NO: 2476934 - protein, 17 aa, Entamoeba dispar
DGCFKGCSSLKSINIPS

SEQ ID NO: 2476935 - protein, 17 aa, Entamoeba dispar
DGCFKGCSSLVTINIPT

SEQ ID NO: 2476936 - protein, 18 aa, Entamoeba dispar
DGCFSRCYSLKSINIPSS

SEQ ID NO: 2476937 - protein, 19 aa, Entamoeba dispar
DGCFYDCGCEKELKKNERI

SEQ ID NO: 2476938 - protein, 17 aa, Entamoeba dispar
DGCFYECGCKEELMKNE

SEQ ID NO: 2476939 - protein, 18 aa, Entamoeba dispar
DGCFYGCGCEEELKKNKR

SEQ ID NO: 2476940 - protein, 19 aa, Entamoeba dispar
DGCFYGCGCEKELMKNKRI

SEQ ID NO: 2476941 - protein, 21 aa, Entamoeba dispar
DGCFYRCRCEKELKKNKRIPR

SEQ ID NO: 2476942 - protein, 26 aa, Entamoeba dispar
DGCKADVWSAGVVFFVMATKEYPFMH

SEQ ID NO: 2476943 - protein, 20 aa, Entamoeba dispar
DGCPCGIDFQEVVLKAIKND

SEQ ID NO: 2476944 - protein, 17 aa, Entamoeba dispar
DGCSGLVYVFYNKMLYF

SEQ ID NO: 2476945 - protein, 27 aa, Entamoeba dispar
DGDARNGLNCLEFIFNYFNHLSEEELK

SEQ ID NO: 2476946 - protein, 17 aa, Entamoeba dispar
DGDEYLIIWNPLFLPKP

SEQ ID NO: 2476947 - protein, 19 aa, Entamoeba dispar
DGDGLGAFGDNLSPEEIEE

SEQ ID NO: 2476948 - protein, 22 aa, Entamoeba dispar
DGDKINVLFSFIRTHTNSKMIV

SEQ ID NO: 2476949 - protein, 23 aa, Entamoeba dispar
DGDKRISIIIKCLNKIIREKNEI

SEQ ID NO: 2476950 - protein, 26 aa, Entamoeba dispar
DGDRALELWYNFYYLFEGIFNHSLNE

SEQ ID NO: 2476951 - protein, 21 aa, Entamoeba dispar
DGELVLIPSRFMQPSLNQMEV

SEQ ID NO: 2476952 - protein, 22 aa, Entamoeba dispar
DGEMLNCLILANYVVQNSPNFR

SEQ ID NO: 2476953 - protein, 20 aa, Entamoeba dispar
DGESPIIMFLKAINQKIIGP

SEQ ID NO: 2476954 - protein, 17 aa, Entamoeba dispar
DGFCDNINFTNCKINSM

SEQ ID NO: 2476955 - protein, 18 aa, Entamoeba dispar
DGFNIEFLLKLKDVKDNN

SEQ ID NO: 2476956 - protein, 29 aa, Entamoeba dispar
DGFPIKGVWKHICIVWTKCYNCYSQNQIE

SEQ ID NO: 2476957 - protein, 19 aa, Entamoeba dispar
DGFRACNSLEYLNLSNNSE

SEQ ID NO: 2476958 - protein, 21 aa, Entamoeba dispar
DGFTGAMKWIRGEWSNKRAEF

SEQ ID NO: 2476959 - protein, 25 aa, Entamoeba dispar
DGFTQMFWKLGMKNFDDFIEKLIKL

SEQ ID NO: 2476960 - protein, 20 aa, Entamoeba dispar
DGGHLIWCIVFEKLTNSQFR

SEQ ID NO: 2476961 - protein, 20 aa, Entamoeba dispar
DGGIELYKILPSFKSVKKLD

SEQ ID NO: 2476962 - protein, 17 aa, Entamoeba dispar
DGGRVCRPLIVVENCKS

SEQ ID NO: 2476963 - protein, 20 aa, Entamoeba dispar
DGHLLWRINEVLANRYQLIK

SEQ ID NO: 2476964 - protein, 36 aa, Entamoeba dispar
DGHSASVDWWTLGVLMYEFLYGCNPFAASSIQETYS

SEQ ID NO: 2476965 - protein, 20 aa, Entamoeba dispar
DGHVKLADFGYAAQLNQKQK

SEQ ID NO: 2476966 - protein, 32 aa, Entamoeba dispar
DGIECKKCTVEYGLKIGRLGCMKCFDLDSKCL

SEQ ID NO: 2476967 - protein, 20 aa, Entamoeba dispar
DGIECVGVRERLCYETLIEV

SEQ ID NO: 2476968 - protein, 24 aa, Entamoeba dispar
DGIELIKSFVFNGGKVLRDVCWSI

SEQ ID NO: 2476969 - protein, 19 aa, Entamoeba dispar
DGIIFKHVIWYPVSYSTYL

SEQ ID NO: 2476970 - protein, 20 aa, Entamoeba dispar
DGIPCNGKPFVMCLINSDPS

SEQ ID NO: 2476971 - protein, 23 aa, Entamoeba dispar
DGIQKPRFGEKLNKEATIVLENV

SEQ ID NO: 2476972 - protein, 23 aa, Entamoeba dispar
DGITFLKMVLVIDPNFSKFMEGN

SEQ ID NO: 2476973 - protein, 18 aa, Entamoeba dispar
DGKALKKGMYCLRLHVKQ

SEQ ID NO: 2476974 - protein, 21 aa, Entamoeba dispar
DGKECCSEFNPLFYDEKTNTT

SEQ ID NO: 2476975 - protein, 25 aa, Entamoeba dispar
DGKELMKLGAKFIYLSNGSFMQKSG

SEQ ID NO: 2476976 - protein, 20 aa, Entamoeba dispar
DGKFCLGGIVEPLKATEKEV

SEQ ID NO: 2476977 - protein, 20 aa, Entamoeba dispar
DGKIKIWNVRSLYEDNVEDV

SEQ ID NO: 2476978 - protein, 17 aa, Entamoeba dispar
DGKIMVWEIVDGLVKKE

SEQ ID NO: 2476979 - protein, 25 aa, Entamoeba dispar
DGKKCIECGKGYYLTEDFKCSKCDS

SEQ ID NO: 2476980 - protein, 18 aa, Entamoeba dispar
DGKLFALRNLCILRDQII

SEQ ID NO: 2476981 - protein, 25 aa, Entamoeba dispar
DGKPIVHVCYIPKTSNILLIDCDGS

SEQ ID NO: 2476982 - protein, 23 aa, Entamoeba dispar
DGKPKLTERLSFTSLSTVDQQSE

SEQ ID NO: 2476983 - protein, 26 aa, Entamoeba dispar
DGKRFHLTEGFLFYPNSKYIPFTNNY

SEQ ID NO: 2476984 - protein, 18 aa, Entamoeba dispar
DGKSSLGNFILKKNVFKV

SEQ ID NO: 2476985 - protein, 18 aa, Entamoeba dispar
DGKSSLGNFILNKKNAFK

SEQ ID NO: 2476986 - protein, 18 aa, Entamoeba dispar
DGKYLLKPCLSHRERDFY

SEQ ID NO: 2476987 - protein, 23 aa, Entamoeba dispar
DGLISDIWSCGVILYVMTFGLMP

SEQ ID NO: 2476988 - protein, 26 aa, Entamoeba dispar
DGLKSGMGANGFSREGGFPGGTYTFT

SEQ ID NO: 2476989 - protein, 19 aa, Entamoeba dispar
DGLNISFSFIKHRCPRFQF

SEQ ID NO: 2476990 - protein, 22 aa, Entamoeba dispar
DGLTKLSSLIFLNLSENKITSI

SEQ ID NO: 2476991 - protein, 28 aa, Entamoeba dispar
DGLVIIRGKLVWKITVCVHIINDCGNLM

SEQ ID NO: 2476992 - protein, 18 aa, Entamoeba dispar
DGLYELALQLYIISNDET

SEQ ID NO: 2476993 - protein, 18 aa, Entamoeba dispar
DGNCSIWNPNGTNLGSID

SEQ ID NO: 2476994 - protein, 23 aa, Entamoeba dispar
DGNEIGFYFSETYLFKFHYCDGT

SEQ ID NO: 2476995 - protein, 17 aa, Entamoeba dispar
DGNSVLMYLPLSLVHSI

SEQ ID NO: 2476996 - protein, 20 aa, Entamoeba dispar
DGPCLVELLDSIKLVMGNPN

SEQ ID NO: 2476997 - protein, 24 aa, Entamoeba dispar
DGPMIIEMVRLLQITPVEEFIPDD

SEQ ID NO: 2476998 - protein, 20 aa, Entamoeba dispar
DGPSGLRIGSKLFIKNSTSF

SEQ ID NO: 2476999 - protein, 28 aa, Entamoeba dispar
DGQFLGATGMYPPRIRMFELDQLSQKFE

SEQ ID NO: 2477000 - protein, 18 aa, Entamoeba dispar
DGQPSLNNGNNWYQIISI

SEQ ID NO: 2477001 - protein, 22 aa, Entamoeba dispar
DGQYKITNWKSPKIMCTSEGGV

SEQ ID NO: 2477002 - protein, 18 aa, Entamoeba dispar
DGRFFHIDFGHFLGHFKS

SEQ ID NO: 2477003 - protein, 19 aa, Entamoeba dispar
DGRIFAMKILRKDIVKERK

SEQ ID NO: 2477004 - protein, 25 aa, Entamoeba dispar
DGRIFKEIIWYKVDYSTHLKEKGTG

SEQ ID NO: 2477005 - protein, 23 aa, Entamoeba dispar
DGRIFKKVIWYKVDYSTYLKKKE

SEQ ID NO: 2477006 - protein, 24 aa, Entamoeba dispar
DGRIFKYIIWYLIDYSTYLKEKEQ

SEQ ID NO: 2477007 - protein, 23 aa, Entamoeba dispar
DGRIFKYVIWYKVDYLTYLEEKG

SEQ ID NO: 2477008 - protein, 24 aa, Entamoeba dispar
DGRIFKYVIWYTIDYSTYLFEKEQ

SEQ ID NO: 2477009 - protein, 24 aa, Entamoeba dispar
DGRIFKYVIWYTVEYSKYLQEKEQ

SEQ ID NO: 2477010 - protein, 22 aa, Entamoeba dispar
DGRIFKYVIWYTVSYSTYLQEK

SEQ ID NO: 2477011 - protein, 21 aa, Entamoeba dispar
DGRINFFKQLVRCMLNYYELN

SEQ ID NO: 2477012 - protein, 21 aa, Entamoeba dispar
DGRITYPLVLIYSSPTGINPQ

SEQ ID NO: 2477013 - protein, 21 aa, Entamoeba dispar
DGRPRNVYPIELLKVRNPEAL

SEQ ID NO: 2477014 - protein, 21 aa, Entamoeba dispar
DGSFKAIIEYLKRQAKKHPES

SEQ ID NO: 2477015 - protein, 20 aa, Entamoeba dispar
DGSFKASEKIQIRRINEHEL

SEQ ID NO: 2477016 - protein, 18 aa, Entamoeba dispar
DGSFKYGTAFGGDKLDDM

SEQ ID NO: 2477017 - protein, 22 aa, Entamoeba dispar
DGSFRPIIEYLKKQGERHPESE

SEQ ID NO: 2477018 - protein, 24 aa, Entamoeba dispar
DGSGCGICKNGYYRNGKGCSKCEK

SEQ ID NO: 2477019 - protein, 26 aa, Entamoeba dispar
DGSRLLWRYLTSWELFAMKNPMSEMF

SEQ ID NO: 2477020 - protein, 22 aa, Entamoeba dispar
DGSRLMFSSGFDGSVNVFNCID

SEQ ID NO: 2477021 - protein, 27 aa, Entamoeba dispar
DGSVMAVSFKTAITIWDVLSNKLLFSL

SEQ ID NO: 2477022 - protein, 23 aa, Entamoeba dispar
DGSYLLRRLEIENLQFISKERIF

SEQ ID NO: 2477023 - protein, 25 aa, Entamoeba dispar
DGTIPVFRIDVSKWVEQTYFDKQIL

SEQ ID NO: 2477024 - protein, 22 aa, Entamoeba dispar
DGTKKKVVLVCQCSGKYRSCSG

SEQ ID NO: 2477025 - protein, 30 aa, Entamoeba dispar
DGTKLSFFSWNAWNGWIPHWCVNKATKTMV

SEQ ID NO: 2477026 - protein, 20 aa, Entamoeba dispar
DGTLRFTDLRMMVEDTHMTM

SEQ ID NO: 2477027 - protein, 26 aa, Entamoeba dispar
DGTRFSYKLNDHTLCITAHRQDGMSE

SEQ ID NO: 2477028 - protein, 21 aa, Entamoeba dispar
DGTVGKTCMLISYTTNAFPNE

SEQ ID NO: 2477029 - protein, 20 aa, Entamoeba dispar
DGVCIGKLSFKEHVGQERYN

SEQ ID NO: 2477030 - protein, 25 aa, Entamoeba dispar
DGVCLIWDIGMLMCLHVIEVGECVI

SEQ ID NO: 2477031 - protein, 20 aa, Entamoeba dispar
DGVGRIGYPLAKKVLNEYKR

SEQ ID NO: 2477032 - protein, 19 aa, Entamoeba dispar
DGVSFDFSDMFINRCYNVE

SEQ ID NO: 2477033 - protein, 18 aa, Entamoeba dispar
DGWSNYITSFSIDSIEYE

SEQ ID NO: 2477034 - protein, 27 aa, Entamoeba dispar
DGWWIGKKGGIPGIFPSNFVQELLEKF

SEQ ID NO: 2477035 - protein, 20 aa, Entamoeba dispar
DGYCNVCGCHHSDHANFKFR

SEQ ID NO: 2477036 - protein, 26 aa, Entamoeba dispar
DGYHPYRVILCRVVLGREGRDYVVKY

SEQ ID NO: 2477037 - protein, 19 aa, Entamoeba dispar
DGYISYWRLFRNGRWKPVK

SEQ ID NO: 2477038 - protein, 19 aa, Entamoeba dispar
DGYLYILIREFGFCAKLKQ

SEQ ID NO: 2477039 - protein, 18 aa, Entamoeba dispar
DGYNLSCLMVLPHYQRKG

SEQ ID NO: 2477040 - protein, 22 aa, Entamoeba dispar
DGYTGWKICLTIEPQEIIIKHI

SEQ ID NO: 2477041 - protein, 23 aa, Entamoeba dispar
DGYYSKILCCNMFQTLKTNDTIT

SEQ ID NO: 2477042 - protein, 18 aa, Entamoeba dispar
DHFVCIYQSGTLLRCCPV

SEQ ID NO: 2477043 - protein, 21 aa, Entamoeba dispar
DHHPPRFNHLLKIVGDVVDYI

SEQ ID NO: 2477044 - protein, 20 aa, Entamoeba dispar
DHIKKWLNKCEIKSYETVQS

SEQ ID NO: 2477045 - protein, 24 aa, Entamoeba dispar
DHLKRCFQAGFGFALTKTYPLEKD

SEQ ID NO: 2477046 - protein, 17 aa, Entamoeba dispar
DHLPEFKESCWRVAFNG

SEQ ID NO: 2477047 - protein, 28 aa, Entamoeba dispar
DHLPGTVIRFIWDLADPTTLPIKGGDEE

SEQ ID NO: 2477048 - protein, 19 aa, Entamoeba dispar
DHLSSCFERGTMIETQEEF

SEQ ID NO: 2477049 - protein, 19 aa, Entamoeba dispar
DHLVYKITPKILKDQNIPK

SEQ ID NO: 2477050 - protein, 22 aa, Entamoeba dispar
DHLWYYTPLERIFRNITNDIII

SEQ ID NO: 2477051 - protein, 22 aa, Entamoeba dispar
DHMAYCQLVCKIGMRENAKNVD

SEQ ID NO: 2477052 - protein, 23 aa, Entamoeba dispar
DHPIIGDLLRWLIDIRNYSVRCI

SEQ ID NO: 2477053 - protein, 26 aa, Entamoeba dispar
DHPLFKYLTDPGWRQVLEPVFKKYVK

SEQ ID NO: 2477054 - protein, 22 aa, Entamoeba dispar
DHPNLIKTIGCFLYDHKVYIGM

SEQ ID NO: 2477055 - protein, 25 aa, Entamoeba dispar
DHPRKRSKITLPFFNVIRISTEKEV

SEQ ID NO: 2477056 - protein, 19 aa, Entamoeba dispar
DHPYIIKLYDVFDGNDGKL

SEQ ID NO: 2477057 - protein, 20 aa, Entamoeba dispar
DHPYIIKLYDVFDGNDGKLY

SEQ ID NO: 2477058 - protein, 20 aa, Entamoeba dispar
DHQIDVVFCVFKEIDYNIYT

SEQ ID NO: 2477059 - protein, 26 aa, Entamoeba dispar
DHRFVMRRFASIFVIVGFDDEENELA

SEQ ID NO: 2477060 - protein, 17 aa, Entamoeba dispar
DHSDLSFSYGVITDESL

SEQ ID NO: 2477061 - protein, 18 aa, Entamoeba dispar
DHSIFKIQIIIDVDPVFT

SEQ ID NO: 2477062 - protein, 19 aa, Entamoeba dispar
DHSMLCLHAGISPDLKSID

SEQ ID NO: 2477063 - protein, 18 aa, Entamoeba dispar
DHSSIFEHFILRSKEKEI

SEQ ID NO: 2477064 - protein, 25 aa, Entamoeba dispar
DHVSGIIALLFNWVLNDCDVYLPEG

SEQ ID NO: 2477065 - protein, 18 aa, Entamoeba dispar
DHWFLFGKLYQFRTNPNK

SEQ ID NO: 2477066 - protein, 20 aa, Entamoeba dispar
DHYFVPRPVDVFFDSPTSGV

SEQ ID NO: 2477067 - protein, 23 aa, Entamoeba dispar
DHYLYKTLYGFIPLIYPIPKNYR

SEQ ID NO: 2477068 - protein, 25 aa, Entamoeba dispar
DIACGLRKCATCNQTNLPLIGKTQY

SEQ ID NO: 2477069 - protein, 21 aa, Entamoeba dispar
DIAEASLFCFRSLARVLSEYK

SEQ ID NO: 2477070 - protein, 24 aa, Entamoeba dispar
DIAEGFIKCGIMQKVIQCYYSISN

SEQ ID NO: 2477071 - protein, 24 aa, Entamoeba dispar
DIAGLRKQYDYVFVGCGRQKPYTF

SEQ ID NO: 2477072 - protein, 26 aa, Entamoeba dispar
DIALSLIGGFVFLRLFCPALAAPEGS

SEQ ID NO: 2477073 - protein, 19 aa, Entamoeba dispar
DIANGIPLKTAQRRLEVNK

SEQ ID NO: 2477074 - protein, 17 aa, Entamoeba dispar
DIARYLVDLALFKQSLD

SEQ ID NO: 2477075 - protein, 24 aa, Entamoeba dispar
DIASCIRYLFFFIGPSIVDFTQTI

SEQ ID NO: 2477076 - protein, 30 aa, Entamoeba dispar
DIDEQWKLNEIKGIEFIKESNGMIISNKHK

SEQ ID NO: 2477077 - protein, 26 aa, Entamoeba dispar
DIDLLLKKCQSEGGLESFMSDYEQTM

SEQ ID NO: 2477078 - protein, 23 aa, Entamoeba dispar
DIDRIPIRFNKHIISNKRFTTTA

SEQ ID NO: 2477079 - protein, 21 aa, Entamoeba dispar
DIDRKVGEIVMKKWKEIDKEK

SEQ ID NO: 2477080 - protein, 22 aa, Entamoeba dispar
DIDRKVGEIVMKKWKEIDKEKA

SEQ ID NO: 2477081 - protein, 23 aa, Entamoeba dispar
DIDSEIMNVYGLKKEQVKMKECG

SEQ ID NO: 2477082 - protein, 19 aa, Entamoeba dispar
DIDVSFQLLNIFSSDDTQV

SEQ ID NO: 2477083 - protein, 41 aa, Entamoeba dispar
DIDYYVIRTNWYWRHQIRIMRFGKEHFYRLDETYHVKESFR

SEQ ID NO: 2477084 - protein, 24 aa, Entamoeba dispar
DIEACNKARIVVMNTPGQNSNGVA

SEQ ID NO: 2477085 - protein, 18 aa, Entamoeba dispar
DIEFKKIKSLLAEKNRLL

SEQ ID NO: 2477086 - protein, 24 aa, Entamoeba dispar
DIEFVRKSIQAFGKCALKLEKVAD

SEQ ID NO: 2477087 - protein, 24 aa, Entamoeba dispar
DIEKIKIALELSRYNHLHDLRKYI

SEQ ID NO: 2477088 - protein, 19 aa, Entamoeba dispar
DIEKRCIEEEGTVQYYINQ

SEQ ID NO: 2477089 - protein, 18 aa, Entamoeba dispar
DIEMKRVNGATFKKQPFV

SEQ ID NO: 2477090 - protein, 21 aa, Entamoeba dispar
DIENGDLWVLVKHYKSADNDI

SEQ ID NO: 2477091 - protein, 18 aa, Entamoeba dispar
DIETGLGYSMKIPQRPSQ

SEQ ID NO: 2477092 - protein, 18 aa, Entamoeba dispar
DIEVQRYLIEKIMKKKMD

SEQ ID NO: 2477093 - protein, 28 aa, Entamoeba dispar
DIEWSLPAFLPKRIKSISKEEEEIIKLD

SEQ ID NO: 2477094 - protein, 19 aa, Entamoeba dispar
DIEYCKEHKIGVVNVAGYS

SEQ ID NO: 2477095 - protein, 23 aa, Entamoeba dispar
DIEYEIGKIIGVIGAISPSRIHQ

SEQ ID NO: 2477096 - protein, 29 aa, Entamoeba dispar
DIEYLCGVLQMIVSFAMPSFLYHIENVES

SEQ ID NO: 2477097 - protein, 25 aa, Entamoeba dispar
DIEYSVIFSSEFKKSFFKLSKLLKK

SEQ ID NO: 2477098 - protein, 20 aa, Entamoeba dispar
DIFCRCIRLIETIQKASCRL

SEQ ID NO: 2477099 - protein, 28 aa, Entamoeba dispar
DIFHCVYKLCSIPFQFKFITPNCFISLE

SEQ ID NO: 2477100 - protein, 19 aa, Entamoeba dispar
DIFIGQKFFIYDSLTILEW

SEQ ID NO: 2477101 - protein, 20 aa, Entamoeba dispar
DIFKKKGWSIKFYVEEIMHY

SEQ ID NO: 2477102 - protein, 18 aa, Entamoeba dispar
DIFLRELISNCSDALDKI

SEQ ID NO: 2477103 - protein, 27 aa, Entamoeba dispar
DIFPLKDIWKHVCIVWTKCYNYSQPDE

SEQ ID NO: 2477104 - protein, 23 aa, Entamoeba dispar
DIFQKKWMGYEWENKIIVETDIT

SEQ ID NO: 2477105 - protein, 17 aa, Entamoeba dispar
DIFRELFNNKALQPEYL

SEQ ID NO: 2477106 - protein, 18 aa, Entamoeba dispar
DIFRMYKALNIQKFHSKK

SEQ ID NO: 2477107 - protein, 25 aa, Entamoeba dispar
DIFSVNYYLSFDFIDEEGMKYNCAT

SEQ ID NO: 2477108 - protein, 20 aa, Entamoeba dispar
DIGCTCTLIYIWEENNKIYI

SEQ ID NO: 2477109 - protein, 19 aa, Entamoeba dispar
DIGDFFCCHGGISPDMTSI

SEQ ID NO: 2477110 - protein, 19 aa, Entamoeba dispar
DIGGTASFRNVWKRYLNES

SEQ ID NO: 2477111 - protein, 17 aa, Entamoeba dispar
DIGKALKMPDLEEAHAF

SEQ ID NO: 2477112 - protein, 27 aa, Entamoeba dispar
DIGSIKALWVAWKLGAKDYKINENGFR

SEQ ID NO: 2477113 - protein, 26 aa, Entamoeba dispar
DIGTKCLGCGLIDFLPIKCSYCHNPF

SEQ ID NO: 2477114 - protein, 18 aa, Entamoeba dispar
DIHFLVSVVYTLPRLDLD

SEQ ID NO: 2477115 - protein, 18 aa, Entamoeba dispar
DIHHPAILGMAGIVLSSS

SEQ ID NO: 2477116 - protein, 19 aa, Entamoeba dispar
DIHIFDIINSYPLNITSYE

SEQ ID NO: 2477117 - protein, 21 aa, Entamoeba dispar
DIIAKDIKIVISIYPSNSPTE

SEQ ID NO: 2477118 - protein, 18 aa, Entamoeba dispar
DIICILKRRYLLQNNAIE

SEQ ID NO: 2477119 - protein, 25 aa, Entamoeba dispar
DIICLFKKKCKSYVSQIFQAIKQSF

SEQ ID NO: 2477120 - protein, 17 aa, Entamoeba dispar
DIICSPIDIGIPNSRTR

SEQ ID NO: 2477121 - protein, 22 aa, Entamoeba dispar
DIIEFTNAITFGLCGSSTIDID

SEQ ID NO: 2477122 - protein, 24 aa, Entamoeba dispar
DIIFDPKKDWTFDSLSTCFSKSER

SEQ ID NO: 2477123 - protein, 20 aa, Entamoeba dispar
DIIHCIRPNNSFTLKLTHLE

SEQ ID NO: 2477124 - protein, 19 aa, Entamoeba dispar
DIIIAFGGYKLKSDDKPLQ

SEQ ID NO: 2477125 - protein, 20 aa, Entamoeba dispar
DIIICDWMGINLYYDSLLNE

SEQ ID NO: 2477126 - protein, 18 aa, Entamoeba dispar
DIIIPCFSFVRDIIHAPI

SEQ ID NO: 2477127 - protein, 23 aa, Entamoeba dispar
DIIISGGFGKRTSVLAFISEQIC

SEQ ID NO: 2477128 - protein, 22 aa, Entamoeba dispar
DIIKKRIEKVIPGYYKQKQVMT

SEQ ID NO: 2477129 - protein, 19 aa, Entamoeba dispar
DIIKMCMIEIFKKIHSTWL

SEQ ID NO: 2477130 - protein, 17 aa, Entamoeba dispar
DIIKSIIDYCSITGTII

SEQ ID NO: 2477131 - protein, 19 aa, Entamoeba dispar
DIINIYFTRIHVITIQSFY

SEQ ID NO: 2477132 - protein, 22 aa, Entamoeba dispar
DIIPVVFRYYEKVIIKKPNKYI

SEQ ID NO: 2477133 - protein, 22 aa, Entamoeba dispar
DIIQLPPKFVDFALTPFGCITI

SEQ ID NO: 2477134 - protein, 23 aa, Entamoeba dispar
DIIRFRSDLKLIIASATLETQKF

SEQ ID NO: 2477135 - protein, 20 aa, Entamoeba dispar
DIIRLKKVVEEFSNKLPVNK

SEQ ID NO: 2477136 - protein, 19 aa, Entamoeba dispar
DIIRNILIIFKLIDEQEDI

SEQ ID NO: 2477137 - protein, 25 aa, Entamoeba dispar
DIISRLPSLPLYRIELLCDDINYSI

SEQ ID NO: 2477138 - protein, 24 aa, Entamoeba dispar
DIIWPEFKSLISTRGEQITVNVKY

SEQ ID NO: 2477139 - protein, 20 aa, Entamoeba dispar
DIIYHIKSLIPINEKIDDLI

SEQ ID NO: 2477140 - protein, 23 aa, Entamoeba dispar
DIKDIWIGIYFWYWHSDGRDYQE

SEQ ID NO: 2477141 - protein, 25 aa, Entamoeba dispar
DIKHLYKFKNIRKLIVVELKSFDKM

SEQ ID NO: 2477142 - protein, 23 aa, Entamoeba dispar
DIKKAYKKMCLIYHPDKNNGDDS

SEQ ID NO: 2477143 - protein, 19 aa, Entamoeba dispar
DIKKGCSCIGANGYCNVCG

SEQ ID NO: 2477144 - protein, 25 aa, Entamoeba dispar
DIKLKTEFASFIMSRYGINITDVLN

SEQ ID NO: 2477145 - protein, 26 aa, Entamoeba dispar
DIKNTTCLRKKCKLGIRCKTEKVLAD

SEQ ID NO: 2477146 - protein, 23 aa, Entamoeba dispar
DIKPKRIIFKLIEEYIKVPLKEA

SEQ ID NO: 2477147 - protein, 20 aa, Entamoeba dispar
DIKPKRIIFKLIKEYIKVPL

SEQ ID NO: 2477148 - protein, 17 aa, Entamoeba dispar
DIKPKRIIFKSIEEYIK

SEQ ID NO: 2477149 - protein, 17 aa, Entamoeba dispar
DIKPKRVVFKSIEEYIK

SEQ ID NO: 2477150 - protein, 21 aa, Entamoeba dispar
DIKRFCLLVEFLSKTNERNIC

SEQ ID NO: 2477151 - protein, 23 aa, Entamoeba dispar
DIKRRLDCLELKIDKNNSLTTPR

SEQ ID NO: 2477152 - protein, 25 aa, Entamoeba dispar
DIKSFMGSSLLTFKERLHDSDANDN

SEQ ID NO: 2477153 - protein, 29 aa, Entamoeba dispar
DIKTCKSCWGCMKTGKCWQEDPVMDELIE

SEQ ID NO: 2477154 - protein, 20 aa, Entamoeba dispar
DILDRIKLSLRIDSTNQTIK

SEQ ID NO: 2477155 - protein, 28 aa, Entamoeba dispar
DILDRLIEIVAFPRLYYKTIPLPFDYQT

SEQ ID NO: 2477156 - protein, 25 aa, Entamoeba dispar
DILGRLKKGLIYNFGSNTCWHLYGI

SEQ ID NO: 2477157 - protein, 29 aa, Entamoeba dispar
DILIISCYCYGKLIPKYSKCFLSIRTTFW

SEQ ID NO: 2477158 - protein, 23 aa, Entamoeba dispar
DILKDLQDGIILSRYLQIETGKV

SEQ ID NO: 2477159 - protein, 23 aa, Entamoeba dispar
DILPCFYDSIELLHYLYSLTTTH

SEQ ID NO: 2477160 - protein, 24 aa, Entamoeba dispar
DILRCKEKLLSLCSFAVEEGASGE

SEQ ID NO: 2477161 - protein, 23 aa, Entamoeba dispar
DILRNKLEAIKRCERMSLFLDEH

SEQ ID NO: 2477162 - protein, 39 aa, Entamoeba dispar
DILRRAFMSRMFPPETIKKLGIKHVKGILLYGPPGCGKT

SEQ ID NO: 2477163 - protein, 17 aa, Entamoeba dispar
DILSHGVSMSFGEKPLY

SEQ ID NO: 2477164 - protein, 23 aa, Entamoeba dispar
DILSYRLDKLTSILSSYQDLKLA

SEQ ID NO: 2477165 - protein, 22 aa, Entamoeba dispar
DILTEYGYYFTAHPMKGKSETK

SEQ ID NO: 2477166 - protein, 17 aa, Entamoeba dispar
DIMRKVLAYQVSKKLLT

SEQ ID NO: 2477167 - protein, 19 aa, Entamoeba dispar
DIMRMWRKMCECKDNDDII

SEQ ID NO: 2477168 - protein, 22 aa, Entamoeba dispar
DINARANLISKFIDVAKIMYEQ

SEQ ID NO: 2477169 - protein, 27 aa, Entamoeba dispar
DINEYKVDFCFRDCIGIKYKQTRKSSL

SEQ ID NO: 2477170 - protein, 23 aa, Entamoeba dispar
DINKLIIRRIIRTEYKVAYPNLY

SEQ ID NO: 2477171 - protein, 23 aa, Entamoeba dispar
DIPEDRKRYFTSFYAIVNDPSVA

SEQ ID NO: 2477172 - protein, 18 aa, Entamoeba dispar
DIPFIPFAPFIEQVENLC

SEQ ID NO: 2477173 - protein, 17 aa, Entamoeba dispar
DIPKEILRQNSLADQPK

SEQ ID NO: 2477174 - protein, 19 aa, Entamoeba dispar
DIPRRCSVDASFNKISEIT

SEQ ID NO: 2477175 - protein, 18 aa, Entamoeba dispar
DIPYWIWDEHLEKKEEPI

SEQ ID NO: 2477176 - protein, 18 aa, Entamoeba dispar
DIQELISHIFVIDPEQRY

SEQ ID NO: 2477177 - protein, 41 aa, Entamoeba dispar
DIQFKQDVVIKICWLIDKFGPDIKWKFDSMLETITLAGDIV

SEQ ID NO: 2477178 - protein, 18 aa, Entamoeba dispar
DIQHYFEIFNQYDSEACK

SEQ ID NO: 2477179 - protein, 18 aa, Entamoeba dispar
DIQIEVIRLITLNVTQRI

SEQ ID NO: 2477180 - protein, 22 aa, Entamoeba dispar
DIQKRFNISFVGQVFLTLTKNK

SEQ ID NO: 2477181 - protein, 19 aa, Entamoeba dispar
DIQNLISLGNAFGNIERIE

SEQ ID NO: 2477182 - protein, 26 aa, Entamoeba dispar
DIQNSWIFGVGYGFHIRGEDKSYIGS

SEQ ID NO: 2477183 - protein, 24 aa, Entamoeba dispar
DIQQGCLGDCYFLAALASLSEFPE

SEQ ID NO: 2477184 - protein, 19 aa, Entamoeba dispar
DIQYFWKNYILQLTNIKDE

SEQ ID NO: 2477185 - protein, 25 aa, Entamoeba dispar
DIQYWLKPYHALRFLMYQPSFCSAQ

SEQ ID NO: 2477186 - protein, 24 aa, Entamoeba dispar
DIRKKLEIVTCITKGFIFEDEERN

SEQ ID NO: 2477187 - protein, 22 aa, Entamoeba dispar
DIRQFARLIAILNRGFGKDIKS

SEQ ID NO: 2477188 - protein, 17 aa, Entamoeba dispar
DISFYKCVWQCIINSRL

SEQ ID NO: 2477189 - protein, 30 aa, Entamoeba dispar
DISKAFKIGELISQLKGFTIEKCTTQVNKQ

SEQ ID NO: 2477190 - protein, 19 aa, Entamoeba dispar
DISKYEWICNQQRDSYASY

SEQ ID NO: 2477191 - protein, 26 aa, Entamoeba dispar
DISLEPFRTGYICRGCFEILHYKKFK

SEQ ID NO: 2477192 - protein, 21 aa, Entamoeba dispar
DISLLKKYYCKVEYICDTSKL

SEQ ID NO: 2477193 - protein, 24 aa, Entamoeba dispar
DISSFNCIDFWEGVKREIIPNYII

SEQ ID NO: 2477194 - protein, 18 aa, Entamoeba dispar
DISSFPWETLASTLKRFV

SEQ ID NO: 2477195 - protein, 23 aa, Entamoeba dispar
DITELMIELPIIKHYAEKSIDAY

SEQ ID NO: 2477196 - protein, 21 aa, Entamoeba dispar
DITGILEAYVSFKTNRTEKQT

SEQ ID NO: 2477197 - protein, 20 aa, Entamoeba dispar
DITLCMLCSECFERMQQTNW

SEQ ID NO: 2477198 - protein, 25 aa, Entamoeba dispar
DITLRLPIKQAKVFEQILVVDSISR

SEQ ID NO: 2477199 - protein, 19 aa, Entamoeba dispar
DITQVKVWCFEYHNHKDTI

SEQ ID NO: 2477200 - protein, 17 aa, Entamoeba dispar
DITTCTTISSIIFNDCH

SEQ ID NO: 2477201 - protein, 26 aa, Entamoeba dispar
DITTWEICDSFSLRVLGPLIKKSDEF

SEQ ID NO: 2477202 - protein, 20 aa, Entamoeba dispar
DITVIAWGFGLERPTMISYG

SEQ ID NO: 2477203 - protein, 26 aa, Entamoeba dispar
DIVERKSRILFVRNISFNANEESIRK

SEQ ID NO: 2477204 - protein, 27 aa, Entamoeba dispar
DIVEYSMRLLCRIIKGDEVLITNIIDK

SEQ ID NO: 2477205 - protein, 30 aa, Entamoeba dispar
DIVEYSMRLLCRIIKGDGVLITNIVDKQIW

SEQ ID NO: 2477206 - protein, 25 aa, Entamoeba dispar
DIVGKDDKRTCCFTKSYTKIVEGTG

SEQ ID NO: 2477207 - protein, 24 aa, Entamoeba dispar
DIVHSYFEGMNWVLGYYYKGCQSW

SEQ ID NO: 2477208 - protein, 18 aa, Entamoeba dispar
DIVIPIMLKRSQFKVQLF

SEQ ID NO: 2477209 - protein, 18 aa, Entamoeba dispar
DIVIWMGDLNYRIEMSDI

SEQ ID NO: 2477210 - protein, 19 aa, Entamoeba dispar
DIVKCFPDENGSVSITSGT

SEQ ID NO: 2477211 - protein, 23 aa, Entamoeba dispar
DIVLEKYFPVYLLIRQYLLISQK

SEQ ID NO: 2477212 - protein, 20 aa, Entamoeba dispar
DIVMGMKWFIEKELRLNRFA

SEQ ID NO: 2477213 - protein, 23 aa, Entamoeba dispar
DIVPRASHRAMQELLERIDNIIN

SEQ ID NO: 2477214 - protein, 27 aa, Entamoeba dispar
DIVPRLSLGSFEYFKGMIKCVKDIIGI

SEQ ID NO: 2477215 - protein, 24 aa, Entamoeba dispar
DIVRPRKLLYIAIDGVAPRAKMNQ

SEQ ID NO: 2477216 - protein, 24 aa, Entamoeba dispar
DIVTPFKLKLFFYSKQTQEANMGI

SEQ ID NO: 2477217 - protein, 27 aa, Entamoeba dispar
DIWQLGCVYIQMILRAPPFKGHSVNSI

SEQ ID NO: 2477218 - protein, 25 aa, Entamoeba dispar
DIWSYGCILAEMFLGKPLFPGSSTS

SEQ ID NO: 2477219 - protein, 25 aa, Entamoeba dispar
DIYCKLPLYFERPFTDWTLSLLQKS

SEQ ID NO: 2477220 - protein, 23 aa, Entamoeba dispar
DIYIEFLKLIILTKQWSMLKNII

SEQ ID NO: 2477221 - protein, 18 aa, Entamoeba dispar
DIYIRKPNEKWSDVIADA

SEQ ID NO: 2477222 - protein, 18 aa, Entamoeba dispar
DIYPEWEDEITITPQDVN

SEQ ID NO: 2477223 - protein, 17 aa, Entamoeba dispar
DIYSCSLCSTKYKKYLI

SEQ ID NO: 2477224 - protein, 22 aa, Entamoeba dispar
DIYSFGIILWQLVYKCIYNVYS

SEQ ID NO: 2477225 - protein, 20 aa, Entamoeba dispar
DIYSGIKYSQYRFLTPDKAF

SEQ ID NO: 2477226 - protein, 18 aa, Entamoeba dispar
DIYSLGMCLLEIFQQHEI

SEQ ID NO: 2477227 - protein, 20 aa, Entamoeba dispar
DKAGLRVAICRMCEREIEFD

SEQ ID NO: 2477228 - protein, 18 aa, Entamoeba dispar
DKAICQYIEKEFERKYKR

SEQ ID NO: 2477229 - protein, 37 aa, Entamoeba dispar
DKAMSTCQYFFPEMNTDFFPRVWALRDNGVLSAVTSK

SEQ ID NO: 2477230 - protein, 26 aa, Entamoeba dispar
DKARGAAPCVLFFDELDSIAQSRGAN

SEQ ID NO: 2477231 - protein, 26 aa, Entamoeba dispar
DKARQAAPCVLFFDELDSIGKARGGG

SEQ ID NO: 2477232 - protein, 27 aa, Entamoeba dispar
DKCKERVLKMVLVWCKKCDSLWLSMNS

SEQ ID NO: 2477233 - protein, 29 aa, Entamoeba dispar
DKCKERVLKMVLVWCKKCNSLWLSMNSFV

SEQ ID NO: 2477234 - protein, 29 aa, Entamoeba dispar
DKCKKLCIDECKNCQFIINKNQIKEMKIT

SEQ ID NO: 2477235 - protein, 20 aa, Entamoeba dispar
DKCLDFLTELYQHFKEVHAK

SEQ ID NO: 2477236 - protein, 17 aa, Entamoeba dispar
DKCYICGDYHSPDHCKN

SEQ ID NO: 2477237 - protein, 18 aa, Entamoeba dispar
DKDIDYRVILPKHDQKDA

SEQ ID NO: 2477238 - protein, 27 aa, Entamoeba dispar
DKDLFICGSSQKLVICDFTENVKILYL

SEQ ID NO: 2477239 - protein, 20 aa, Entamoeba dispar
DKDLKGRIITTLQLLELLLD

SEQ ID NO: 2477240 - protein, 26 aa, Entamoeba dispar
DKDLRSLLLTDLRFSPDGSYLNVADD

SEQ ID NO: 2477241 - protein, 19 aa, Entamoeba dispar
DKDWCKHIIEDLDKFKKPI

SEQ ID NO: 2477242 - protein, 25 aa, Entamoeba dispar
DKDWVCNLVMTWPAFANKAQFPDPL

SEQ ID NO: 2477243 - protein, 24 aa, Entamoeba dispar
DKEALKVISSFCGMDDLLNADILD

SEQ ID NO: 2477244 - protein, 18 aa, Entamoeba dispar
DKECIKNAEILMKYFHAH

SEQ ID NO: 2477245 - protein, 27 aa, Entamoeba dispar
DKEEILKLYTGIMKYGADFGLIELMFD

SEQ ID NO: 2477246 - protein, 17 aa, Entamoeba dispar
DKEFIVSLQESFKEKYK

SEQ ID NO: 2477247 - protein, 21 aa, Entamoeba dispar
DKEHLKKIVWQGDVGDNDQYL

SEQ ID NO: 2477248 - protein, 17 aa, Entamoeba dispar
DKEIAILRKEMEELRKI

SEQ ID NO: 2477249 - protein, 20 aa, Entamoeba dispar
DKEIQRFATNSADVKRLQEF

SEQ ID NO: 2477250 - protein, 27 aa, Entamoeba dispar
DKELKIIKCINILSSIALNGKITSSNE

SEQ ID NO: 2477251 - protein, 26 aa, Entamoeba dispar
DKELKIIKCINRLSSIALNDKVTSSN

SEQ ID NO: 2477252 - protein, 25 aa, Entamoeba dispar
DKEMKEMIEAIVLPMTQKEKFEKIG

SEQ ID NO: 2477253 - protein, 19 aa, Entamoeba dispar
DKEPDAIITKRTHPVGKMA

SEQ ID NO: 2477254 - protein, 18 aa, Entamoeba dispar
DKERVGCSQVLIEEGKEP

SEQ ID NO: 2477255 - protein, 25 aa, Entamoeba dispar
DKESIKQKVVDIIGECIKRKEEEEK

SEQ ID NO: 2477256 - protein, 22 aa, Entamoeba dispar
DKESLTLFNTIVNWCGDESINL

SEQ ID NO: 2477257 - protein, 18 aa, Entamoeba dispar
DKESSLTLRCLKTKEQNN

SEQ ID NO: 2477258 - protein, 26 aa, Entamoeba dispar
DKEVEIIECINRLSSIALNDKITSSN

SEQ ID NO: 2477259 - protein, 18 aa, Entamoeba dispar
DKEVEIINCINRLSEIAL

SEQ ID NO: 2477260 - protein, 22 aa, Entamoeba dispar
DKEVSAEIAFYVCAQVSDDMIH

SEQ ID NO: 2477261 - protein, 24 aa, Entamoeba dispar
DKFECSDILMNVHKEILFFAKAKE

SEQ ID NO: 2477262 - protein, 24 aa, Entamoeba dispar
DKFIFLRKPRFVVQSLLRPYIQKC

SEQ ID NO: 2477263 - protein, 19 aa, Entamoeba dispar
DKFKVVITVPATFTDQQKD

SEQ ID NO: 2477264 - protein, 23 aa, Entamoeba dispar
DKFKYAKGNLFSFVLQDKDGAEI

SEQ ID NO: 2477265 - protein, 22 aa, Entamoeba dispar
DKFMFTLSVFGACFYDGIRSDS

SEQ ID NO: 2477266 - protein, 23 aa, Entamoeba dispar
DKFRSEYIIHFYGVFIPNKICMI

SEQ ID NO: 2477267 - protein, 28 aa, Entamoeba dispar
DKFTQMFWELSMKSFDEFIKKLIKLPRK

SEQ ID NO: 2477268 - protein, 34 aa, Entamoeba dispar
DKFVKECLKELWKRIQKKSVKRKLLIVVQNDEGL

SEQ ID NO: 2477269 - protein, 28 aa, Entamoeba dispar
DKGCYYYCKELFLRTMFSFFYEGDSIKI

SEQ ID NO: 2477270 - protein, 24 aa, Entamoeba dispar
DKGELRPELILAINGLLQDLNHPN

SEQ ID NO: 2477271 - protein, 23 aa, Entamoeba dispar
DKGEYKWAVELLNHLIFTNPNNE

SEQ ID NO: 2477272 - protein, 21 aa, Entamoeba dispar
DKHVLFCLGGPGAGKGTQCQK

SEQ ID NO: 2477273 - protein, 17 aa, Entamoeba dispar
DKHVRKLICSCSTEQYC

SEQ ID NO: 2477274 - protein, 22 aa, Entamoeba dispar
DKIDSWKALDFYNEEFEEGEIK

SEQ ID NO: 2477275 - protein, 17 aa, Entamoeba dispar
DKIIALDAIILFDNVLN

SEQ ID NO: 2477276 - protein, 25 aa, Entamoeba dispar
DKIISRGCGFLQNISDFEEGRKLIL

SEQ ID NO: 2477277 - protein, 32 aa, Entamoeba dispar
DKIKIECHGKLIKMVECINVLSSNALNGKITS

SEQ ID NO: 2477278 - protein, 19 aa, Entamoeba dispar
DKIKILNKKGDWWQGECQG

SEQ ID NO: 2477279 - protein, 17 aa, Entamoeba dispar
DKIKIRIINNIRTNNII

SEQ ID NO: 2477280 - protein, 17 aa, Entamoeba dispar
DKIKIRIINNIRTNNTT

SEQ ID NO: 2477281 - protein, 17 aa, Entamoeba dispar
DKIKIRIINTIRTNNRI

SEQ ID NO: 2477282 - protein, 24 aa, Entamoeba dispar
DKIKKCREMFKEVLNIVMDDNPPA

SEQ ID NO: 2477283 - protein, 17 aa, Entamoeba dispar
DKIKLNSAMAYSYATLY

SEQ ID NO: 2477284 - protein, 28 aa, Entamoeba dispar
DKILKFHSFIYFPRELKLSIIGNKTTYN

SEQ ID NO: 2477285 - protein, 24 aa, Entamoeba dispar
DKIMADALWGFSFIVSNPQNICKF

SEQ ID NO: 2477286 - protein, 21 aa, Entamoeba dispar
DKIQKSICLLKIYSGIKTSIL

SEQ ID NO: 2477287 - protein, 18 aa, Entamoeba dispar
DKIVQRVKEESLPKRYCI

SEQ ID NO: 2477288 - protein, 23 aa, Entamoeba dispar
DKKERMDFLLVQFRIALESEDYL

SEQ ID NO: 2477289 - protein, 26 aa, Entamoeba dispar
DKKFICPIENCRRCFTTKSYLDKHIE

SEQ ID NO: 2477290 - protein, 19 aa, Entamoeba dispar
DKKIIRIIFEKMRKYKSGI

SEQ ID NO: 2477291 - protein, 23 aa, Entamoeba dispar
DKKKILSCWVFPDDYPTESFCES

SEQ ID NO: 2477292 - protein, 23 aa, Entamoeba dispar
DKKKRFVTRSVYGRTSSTEKSST

SEQ ID NO: 2477293 - protein, 22 aa, Entamoeba dispar
DKKPTFKGCVCVASDKESHQPT

SEQ ID NO: 2477294 - protein, 24 aa, Entamoeba dispar
DKKRIKIKLNDEIISTVQVDTKTK

SEQ ID NO: 2477295 - protein, 25 aa, Entamoeba dispar
DKKRIKLKLNDEVISTIEINKKRKL

SEQ ID NO: 2477296 - protein, 17 aa, Entamoeba dispar
DKKSIMEGINFEEFNQQ

SEQ ID NO: 2477297 - protein, 20 aa, Entamoeba dispar
DKKYIMPYCYIKVLEDYDQK

SEQ ID NO: 2477298 - protein, 22 aa, Entamoeba dispar
DKKYKVIFERSLNEINCQVPEW

SEQ ID NO: 2477299 - protein, 25 aa, Entamoeba dispar
DKLAIGFRLSPHFLDQIPEFDRTTK

SEQ ID NO: 2477300 - protein, 18 aa, Entamoeba dispar
DKLIQIYPINKFQCSLQK

SEQ ID NO: 2477301 - protein, 25 aa, Entamoeba dispar
DKLLKCISYFLPFISDKNILKEKQN

SEQ ID NO: 2477302 - protein, 21 aa, Entamoeba dispar
DKLNKWLGLESNYLLYRNHLS

SEQ ID NO: 2477303 - protein, 31 aa, Entamoeba dispar
DKLNWRKMLQECFKVLWEFEDYQKKMIEIFE

SEQ ID NO: 2477304 - protein, 17 aa, Entamoeba dispar
DKLPDWVDRSCLEEYLK

SEQ ID NO: 2477305 - protein, 42 aa, Entamoeba dispar
DKLPERPQGEFILWQPTRHTLFLPSQILAAAGYDSTETLDIR

SEQ ID NO: 2477306 - protein, 22 aa, Entamoeba dispar
DKLQVLKSFDFNDVVFIIECGN

SEQ ID NO: 2477307 - protein, 23 aa, Entamoeba dispar
DKLRHFHCLCGIVDIVLTQPIDE

SEQ ID NO: 2477308 - protein, 22 aa, Entamoeba dispar
DKLRLYIKTMVEYLKANSGRQI

SEQ ID NO: 2477309 - protein, 24 aa, Entamoeba dispar
DKLWKESIANIILKGGFDNQPIDD

SEQ ID NO: 2477310 - protein, 31 aa, Entamoeba dispar
DKLYPKLHHVYRYKVDYSFYLKHREDNCDFR

SEQ ID NO: 2477311 - protein, 22 aa, Entamoeba dispar
DKMKEYCDFIAYKVNDIADFIG

SEQ ID NO: 2477312 - protein, 24 aa, Entamoeba dispar
DKNAEYFFVPLIKRKCIVKQDYLV

SEQ ID NO: 2477313 - protein, 18 aa, Entamoeba dispar
DKNEVCNEFALKIIIITF

SEQ ID NO: 2477314 - protein, 18 aa, Entamoeba dispar
DKNFKSPYINYLSAIGEA

SEQ ID NO: 2477315 - protein, 25 aa, Entamoeba dispar
DKNGLKVMLFSGINKYSTYLIYSQE

SEQ ID NO: 2477316 - protein, 19 aa, Entamoeba dispar
DKNIYGDGFAKQFLQFTMF

SEQ ID NO: 2477317 - protein, 20 aa, Entamoeba dispar
DKNLIVEIILDMIKQEYKIE

SEQ ID NO: 2477318 - protein, 22 aa, Entamoeba dispar
DKNQISFRIAEFDKEIIQENKE

SEQ ID NO: 2477319 - protein, 18 aa, Entamoeba dispar
DKNSLVIGKKERLSDKTE

SEQ ID NO: 2477320 - protein, 26 aa, Entamoeba dispar
DKNVKGIITWFSLHNCQTRFEGTRKE

SEQ ID NO: 2477321 - protein, 26 aa, Entamoeba dispar
DKNVLGTVCWALFFVVTRAAKQNPTF

SEQ ID NO: 2477322 - protein, 24 aa, Entamoeba dispar
DKNWSCSELKSFIFKLGEINDQNL

SEQ ID NO: 2477323 - protein, 22 aa, Entamoeba dispar
DKPDVRFVIHHSLPKSLEGYYQ

SEQ ID NO: 2477324 - protein, 24 aa, Entamoeba dispar
DKPIPVELFNKLLLVKSQTNVALI

SEQ ID NO: 2477325 - protein, 23 aa, Entamoeba dispar
DKPISYFKLRFETSRTVVKENSQ

SEQ ID NO: 2477326 - protein, 17 aa, Entamoeba dispar
DKPKKKKARNWITDEDI

SEQ ID NO: 2477327 - protein, 27 aa, Entamoeba dispar
DKPVEIEFFKPLTLITGPNGAGKTTII

SEQ ID NO: 2477328 - protein, 20 aa, Entamoeba dispar
DKPWYLKFNNSAIYADNTED

SEQ ID NO: 2477329 - protein, 19 aa, Entamoeba dispar
DKPWYLKFNNSAIYSDNTE

SEQ ID NO: 2477330 - protein, 18 aa, Entamoeba dispar
DKQCEFWVKPEIKHPQHI

SEQ ID NO: 2477331 - protein, 20 aa, Entamoeba dispar
DKQIGWIISVFSRKALTVKE

SEQ ID NO: 2477332 - protein, 18 aa, Entamoeba dispar
DKQKEEWQHITFTENKVR

SEQ ID NO: 2477333 - protein, 21 aa, Entamoeba dispar
DKQKRIVECVNRLSEIALNGK

SEQ ID NO: 2477334 - protein, 25 aa, Entamoeba dispar
DKQLEIIKCINRLSSIALNDKINSS

SEQ ID NO: 2477335 - protein, 27 aa, Entamoeba dispar
DKRFVFTCFSAFWVLSDGIAYIHQGFK

SEQ ID NO: 2477336 - protein, 19 aa, Entamoeba dispar
DKRLKEFSRNIGSISDVLD

SEQ ID NO: 2477337 - protein, 18 aa, Entamoeba dispar
DKRNFKLTVGNDLHGKEK

SEQ ID NO: 2477338 - protein, 18 aa, Entamoeba dispar
DKRTDTWYKLKKDYLNGL

SEQ ID NO: 2477339 - protein, 22 aa, Entamoeba dispar
DKRWKIRVKGYKELDQLIQTKD

SEQ ID NO: 2477340 - protein, 21 aa, Entamoeba dispar
DKRYSVWAVLLFENNLVLKKI

SEQ ID NO: 2477341 - protein, 20 aa, Entamoeba dispar
DKSFRCLRTQTYLDSIRSKD

SEQ ID NO: 2477342 - protein, 20 aa, Entamoeba dispar
DKSNRFELVVANPKKMKTIL

SEQ ID NO: 2477343 - protein, 28 aa, Entamoeba dispar
DKSPIPIRLPYSMAIKLFPLPTELHNEQ

SEQ ID NO: 2477344 - protein, 23 aa, Entamoeba dispar
DKSYKSYFICSAKTGDGCKEALK

SEQ ID NO: 2477345 - protein, 17 aa, Entamoeba dispar
DKTCFYCRQPGHCLKNC

SEQ ID NO: 2477346 - protein, 27 aa, Entamoeba dispar
DKTFGDLWVEFLLRESGSLDAQKPTNQ

SEQ ID NO: 2477347 - protein, 19 aa, Entamoeba dispar
DKTFLEVFIDTVASTDERA

SEQ ID NO: 2477348 - protein, 24 aa, Entamoeba dispar
DKTIECLSKAIAHCLTKDKKKIFK

SEQ ID NO: 2477349 - protein, 22 aa, Entamoeba dispar
DKTIKAWDLRTRMNNPIQVMKG

SEQ ID NO: 2477350 - protein, 19 aa, Entamoeba dispar
DKTIKRLMRIFDIDLSGSI

SEQ ID NO: 2477351 - protein, 21 aa, Entamoeba dispar
DKTKGLFNYKVFQEMKKSVII

SEQ ID NO: 2477352 - protein, 18 aa, Entamoeba dispar
DKTLKEVFMQDCFEVGRR

SEQ ID NO: 2477353 - protein, 19 aa, Entamoeba dispar
DKTRICWFNAGSQQLNDYK

SEQ ID NO: 2477354 - protein, 28 aa, Entamoeba dispar
DKTRPETFFKLASCYFQGILVEKNEKLA

SEQ ID NO: 2477355 - protein, 22 aa, Entamoeba dispar
DKTSVDPFAAFNSSTATNNQPL

SEQ ID NO: 2477356 - protein, 21 aa, Entamoeba dispar
DKTTIKWIEYLSMIETNDDTK

SEQ ID NO: 2477357 - protein, 19 aa, Entamoeba dispar
DKTVRCVNFLNDLQTEVID

SEQ ID NO: 2477358 - protein, 17 aa, Entamoeba dispar
DKTWGEIITRLRHLKTT

SEQ ID NO: 2477359 - protein, 19 aa, Entamoeba dispar
DKVKFKWALNLKETIDIEE

SEQ ID NO: 2477360 - protein, 25 aa, Entamoeba dispar
DKVKIRYEKDLNFQSKTWFPDMPSH

SEQ ID NO: 2477361 - protein, 24 aa, Entamoeba dispar
DKVLQCFNELEIKPINTLIIDDKE

SEQ ID NO: 2477362 - protein, 23 aa, Entamoeba dispar
DKWSIKISLDYIDQIYKSMINAV

SEQ ID NO: 2477363 - protein, 25 aa, Entamoeba dispar
DKYCAVCRKCFFKDAAMLKTQKSAD

SEQ ID NO: 2477364 - protein, 26 aa, Entamoeba dispar
DKYDSVFRFVLNNTLLVDTLDNARKI

SEQ ID NO: 2477365 - protein, 21 aa, Entamoeba dispar
DKYFFKIDEIFLNKCEPQKRL

SEQ ID NO: 2477366 - protein, 23 aa, Entamoeba dispar
DKYGIIIKTLFRKEGSLQQLNAH

SEQ ID NO: 2477367 - protein, 19 aa, Entamoeba dispar
DKYNESDWVLMFYNPSVPL

SEQ ID NO: 2477368 - protein, 24 aa, Entamoeba dispar
DKYPLEFSESVLQQRFIPWSLNVL

SEQ ID NO: 2477369 - protein, 25 aa, Entamoeba dispar
DKYQLKFVGAIPIEPKICLAGETGV

SEQ ID NO: 2477370 - protein, 17 aa, Entamoeba dispar
DKYVCSSPILPETKDFV

SEQ ID NO: 2477371 - protein, 28 aa, Entamoeba dispar
DKYYLSSRLHHISLWKTIFSDFLSEKVE

SEQ ID NO: 2477372 - protein, 20 aa, Entamoeba dispar
DLAKREGFEYIETSAKSNNN

SEQ ID NO: 2477373 - protein, 30 aa, Entamoeba dispar
DLAKSTLAWKGLRVTVKITVVNRVATYEVI

SEQ ID NO: 2477374 - protein, 23 aa, Entamoeba dispar
DLAKTCIHYQLTHETMLYGYSRT

SEQ ID NO: 2477375 - protein, 24 aa, Entamoeba dispar
DLAKYFKQVYVWQGGDDINTVVFA

SEQ ID NO: 2477376 - protein, 18 aa, Entamoeba dispar
DLAMKEEIFISSCSNDYH

SEQ ID NO: 2477377 - protein, 23 aa, Entamoeba dispar
DLANWPFKVKDRENGSVYIESYN

SEQ ID NO: 2477378 - protein, 20 aa, Entamoeba dispar
DLAYKVRCALGVQLCGIDFI

SEQ ID NO: 2477379 - protein, 17 aa, Entamoeba dispar
DLCLKLLKINPLERITC

SEQ ID NO: 2477380 - protein, 25 aa, Entamoeba dispar
DLCYKTCMPSTHFLSLTSITTNPTI

SEQ ID NO: 2477381 - protein, 20 aa, Entamoeba dispar
DLDITIKLIKEFKENIESIS

SEQ ID NO: 2477382 - protein, 28 aa, Entamoeba dispar
DLDKLRISFRLKIIVSDVNSFLRTKDIW

SEQ ID NO: 2477383 - protein, 23 aa, Entamoeba dispar
DLDRQIRQNIEMSHKTTGAESQR

SEQ ID NO: 2477384 - protein, 20 aa, Entamoeba dispar
DLDRRIGLEPVLPSEFHMMR

SEQ ID NO: 2477385 - protein, 25 aa, Entamoeba dispar
DLDRWEYAKSAILVLFKPLDYAMAN

SEQ ID NO: 2477386 - protein, 23 aa, Entamoeba dispar
DLDSRIRYSIMSNFDERFDYYLS

SEQ ID NO: 2477387 - protein, 21 aa, Entamoeba dispar
DLDVPGSRVPKAFNEGEEDGD

SEQ ID NO: 2477388 - protein, 18 aa, Entamoeba dispar
DLDWRILALQFIQFKDLE

SEQ ID NO: 2477389 - protein, 19 aa, Entamoeba dispar
DLEIFRKSLDLSREPNQQE

SEQ ID NO: 2477390 - protein, 23 aa, Entamoeba dispar
DLEIIVTTLMEWYYIVSTHYQFQ

SEQ ID NO: 2477391 - protein, 19 aa, Entamoeba dispar
DLEIQQCRQTIVGHRAAIK

SEQ ID NO: 2477392 - protein, 21 aa, Entamoeba dispar
DLESLGYLFVYLLKGTLPWQD

SEQ ID NO: 2477393 - protein, 20 aa, Entamoeba dispar
DLEYKLWLEYTATRHPQMFP

SEQ ID NO: 2477394 - protein, 20 aa, Entamoeba dispar
DLEYSCKYEDSWHYKYKNNN

SEQ ID NO: 2477395 - protein, 25 aa, Entamoeba dispar
DLFEEMKQYHGFDLLNLFIYRKPSL

SEQ ID NO: 2477396 - protein, 32 aa, Entamoeba dispar
DLFHSSLACIILFDVLNELKFNSAPHSNTEMI

SEQ ID NO: 2477397 - protein, 20 aa, Entamoeba dispar
DLFIPWIPNNMQLAVCDVPP

SEQ ID NO: 2477398 - protein, 24 aa, Entamoeba dispar
DLFMKIHISELYSWNNSNRENTAS

SEQ ID NO: 2477399 - protein, 19 aa, Entamoeba dispar
DLFNCTFYSVYIAQDQKQR

SEQ ID NO: 2477400 - protein, 17 aa, Entamoeba dispar
DLFNEKLLISFTCPTLS

SEQ ID NO: 2477401 - protein, 27 aa, Entamoeba dispar
DLFRKYPKKYLPVIAKLCDNLNTLDDP

SEQ ID NO: 2477402 - protein, 18 aa, Entamoeba dispar
DLFSKKDYATAICEYSRA

SEQ ID NO: 2477403 - protein, 24 aa, Entamoeba dispar
DLFTQMFWQLGMKNFDDFIKKLTK

SEQ ID NO: 2477404 - protein, 21 aa, Entamoeba dispar
DLGNRVFKVLCNRHDYVKNKI

SEQ ID NO: 2477405 - protein, 20 aa, Entamoeba dispar
DLHFKLLNEFSKKILKSQYN

SEQ ID NO: 2477406 - protein, 22 aa, Entamoeba dispar
DLHFKLLTEFSKKILKSQYNLL

SEQ ID NO: 2477407 - protein, 19 aa, Entamoeba dispar
DLHPWDVKFCDDLEKDMLF

SEQ ID NO: 2477408 - protein, 23 aa, Entamoeba dispar
DLHPWDVKFCDDLEKDMLFEMLK

SEQ ID NO: 2477409 - protein, 17 aa, Entamoeba dispar
DLICLVRAHQVMEDGFK

SEQ ID NO: 2477410 - protein, 18 aa, Entamoeba dispar
DLICPLVYKDSVLIACYE

SEQ ID NO: 2477411 - protein, 26 aa, Entamoeba dispar
DLIFKLCILTEKYLKGKEYVDIMMSI

SEQ ID NO: 2477412 - protein, 19 aa, Entamoeba dispar
DLIGYLLVERKFLFVSQSI

SEQ ID NO: 2477413 - protein, 17 aa, Entamoeba dispar
DLIKELLDVDSEDRLGS

SEQ ID NO: 2477414 - protein, 25 aa, Entamoeba dispar
DLIKEYIWRCDKLKYKINIINDNEI

SEQ ID NO: 2477415 - protein, 17 aa, Entamoeba dispar
DLIKLRSLFSLTSNYKR

SEQ ID NO: 2477416 - protein, 17 aa, Entamoeba dispar
DLIKVEKAFCIKKNGEG

SEQ ID NO: 2477417 - protein, 21 aa, Entamoeba dispar
DLILEPKFEGCILPRIPQVYY

SEQ ID NO: 2477418 - protein, 17 aa, Entamoeba dispar
DLILKKGMLFDIVGKDD

SEQ ID NO: 2477419 - protein, 17 aa, Entamoeba dispar
DLIRIFGINKKTIPWSI

SEQ ID NO: 2477420 - protein, 31 aa, Entamoeba dispar
DLIRSRIKLFRFTKNKKWRKGAVLNLLGIEL

SEQ ID NO: 2477421 - protein, 18 aa, Entamoeba dispar
DLIRYKLESIRRCERLSR

SEQ ID NO: 2477422 - protein, 20 aa, Entamoeba dispar
DLITCGRTLIGKRPSRTQQM

SEQ ID NO: 2477423 - protein, 20 aa, Entamoeba dispar
DLKDGIRVINFFELLSGKTL

SEQ ID NO: 2477424 - protein, 19 aa, Entamoeba dispar
DLKEWKYPPLEATEEIELK

SEQ ID NO: 2477425 - protein, 26 aa, Entamoeba dispar
DLKIAFNCLPNIYKINVKLIQELNER

SEQ ID NO: 2477426 - protein, 30 aa, Entamoeba dispar
DLKKEGYILKRWVTRYVLVKRNYLIYFVSD

SEQ ID NO: 2477427 - protein, 19 aa, Entamoeba dispar
DLKKLFPTKVIHFVEIDIQ

SEQ ID NO: 2477428 - protein, 23 aa, Entamoeba dispar
DLKKTLLPWSCFVKVAHDMKLKT

SEQ ID NO: 2477429 - protein, 17 aa, Entamoeba dispar
DLKKVGWSRCARTDKGV

SEQ ID NO: 2477430 - protein, 22 aa, Entamoeba dispar
DLKLFYCREMHSFGHTNEGKEI

SEQ ID NO: 2477431 - protein, 27 aa, Entamoeba dispar
DLKMACSQFVAFCRPKAITSIAEVIVY

SEQ ID NO: 2477432 - protein, 20 aa, Entamoeba dispar
DLKNGMIGNEEWRKSVIEDC

SEQ ID NO: 2477433 - protein, 29 aa, Entamoeba dispar
DLKPISIWTSEMWFRNRYEALVQHYCEVL

SEQ ID NO: 2477434 - protein, 26 aa, Entamoeba dispar
DLKTLIEIMCNIFSFYEFWEHVCIVW

SEQ ID NO: 2477435 - protein, 30 aa, Entamoeba dispar
DLKYIPFYADLCVSLSIFISSNFTQTLLNL

SEQ ID NO: 2477436 - protein, 27 aa, Entamoeba dispar
DLKYKLIDWKSYFIITINELQSEAFKI

SEQ ID NO: 2477437 - protein, 22 aa, Entamoeba dispar
DLLCSSPELKNCKSKNEQIEFI

SEQ ID NO: 2477438 - protein, 25 aa, Entamoeba dispar
DLLDLPWNRCWIDGNLVEGKKRKEV

SEQ ID NO: 2477439 - protein, 20 aa, Entamoeba dispar
DLLFCSTSTKLQCTILSLLM

SEQ ID NO: 2477440 - protein, 26 aa, Entamoeba dispar
DLLFEPKVKRKLLVIQSELIYESYKY

SEQ ID NO: 2477441 - protein, 25 aa, Entamoeba dispar
DLLFNLIIRDSWQFLFSHSPIDLKQ

SEQ ID NO: 2477442 - protein, 20 aa, Entamoeba dispar
DLLFVLRFMVDAGLVGCSWV

SEQ ID NO: 2477443 - protein, 30 aa, Entamoeba dispar
DLLHWDDDFPLKCCQLKFELPKFTPPNLSK

SEQ ID NO: 2477444 - protein, 17 aa, Entamoeba dispar
DLLIFMLQKLFALVHGE

SEQ ID NO: 2477445 - protein, 19 aa, Entamoeba dispar
DLLKLKIQYFHSYEDQKNQ

SEQ ID NO: 2477446 - protein, 22 aa, Entamoeba dispar
DLLKTFKSIDMFLDKYKEMVEK

SEQ ID NO: 2477447 - protein, 18 aa, Entamoeba dispar
DLLLKRKKRHQLKSLMKQ

SEQ ID NO: 2477448 - protein, 22 aa, Entamoeba dispar
DLLNCLKTIYRASSDLDQSCLV

SEQ ID NO: 2477449 - protein, 19 aa, Entamoeba dispar
DLLPFLRKPMLLIIDSDKQ

SEQ ID NO: 2477450 - protein, 18 aa, Entamoeba dispar
DLLPWREDMEEIKTIRKW

SEQ ID NO: 2477451 - protein, 19 aa, Entamoeba dispar
DLLQCDCFNGGYKTEEDTL

SEQ ID NO: 2477452 - protein, 18 aa, Entamoeba dispar
DLLRYKLESIRRCERISK

SEQ ID NO: 2477453 - protein, 19 aa, Entamoeba dispar
DLLSEFGYFVYSTQTPGRY

SEQ ID NO: 2477454 - protein, 33 aa, Entamoeba dispar
DLLSRVIARREVICLPFYSFIVRYLYVRHENIT

SEQ ID NO: 2477455 - protein, 19 aa, Entamoeba dispar
DLLTEFGYSFVSKWTSGKK

SEQ ID NO: 2477456 - protein, 25 aa, Entamoeba dispar
DLMRMFLELRASMIKKKLIPTLAIS

SEQ ID NO: 2477457 - protein, 17 aa, Entamoeba dispar
DLMSLSFTSFDSLVSCR

SEQ ID NO: 2477458 - protein, 33 aa, Entamoeba dispar
DLNAYCYMECSALKRVGLKQIFEQAIRYTLKDR

SEQ ID NO: 2477459 - protein, 17 aa, Entamoeba dispar
DLNEAFVEIEISALNCS

SEQ ID NO: 2477460 - protein, 18 aa, Entamoeba dispar
DLNGFFIDMFMLKDMCDD

SEQ ID NO: 2477461 - protein, 18 aa, Entamoeba dispar
DLNGLVYLYLAINKTNPK

SEQ ID NO: 2477462 - protein, 24 aa, Entamoeba dispar
DLNGVPLKFCDDFEYHDSVDGSVT

SEQ ID NO: 2477463 - protein, 21 aa, Entamoeba dispar
DLNKPWGRVTIVSYEIAAKHA

SEQ ID NO: 2477464 - protein, 23 aa, Entamoeba dispar
DLNKRLWAGIFVVMRQFNNQYCQ

SEQ ID NO: 2477465 - protein, 19 aa, Entamoeba dispar
DLNLRAGINPPNYPAVVPH

SEQ ID NO: 2477466 - protein, 25 aa, Entamoeba dispar
DLNLWKIDFTQFIPLTKVQLQYIVD

SEQ ID NO: 2477467 - protein, 19 aa, Entamoeba dispar
DLNNGFVIEGSKIMKFNRP

SEQ ID NO: 2477468 - protein, 24 aa, Entamoeba dispar
DLNRLTHDIPFLFHKKIQELMKRL

SEQ ID NO: 2477469 - protein, 25 aa, Entamoeba dispar
DLNSFKSVCSFGCIKTFEIIAICLK

SEQ ID NO: 2477470 - protein, 19 aa, Entamoeba dispar
DLPDAFKIWDEDNYREYLQ

SEQ ID NO: 2477471 - protein, 21 aa, Entamoeba dispar
DLPIENEIYSYVVYVNPQTNK

SEQ ID NO: 2477472 - protein, 39 aa, Entamoeba dispar
DLPLEGNSGGFGWCDGLLLRAMKSGSWVLLDELNLASQS

SEQ ID NO: 2477473 - protein, 19 aa, Entamoeba dispar
DLPLFPGADPREFWQRAEE

SEQ ID NO: 2477474 - protein, 19 aa, Entamoeba dispar
DLPSFAFKSKQTRINWTDK

SEQ ID NO: 2477475 - protein, 19 aa, Entamoeba dispar
DLPSPRYIESLEFQPTDPK

SEQ ID NO: 2477476 - protein, 22 aa, Entamoeba dispar
DLPTILGGMRFICLDVKPEQIV

SEQ ID NO: 2477477 - protein, 19 aa, Entamoeba dispar
DLQALIKRRVYGLEETDIK

SEQ ID NO: 2477478 - protein, 17 aa, Entamoeba dispar
DLQKIWGDAAQKLKVFS

SEQ ID NO: 2477479 - protein, 27 aa, Entamoeba dispar
DLRALAAKCVFRLLKVLDSGKMKEIKN

SEQ ID NO: 2477480 - protein, 28 aa, Entamoeba dispar
DLRGIITTLRFILCSAAQYDISSERLLE

SEQ ID NO: 2477481 - protein, 24 aa, Entamoeba dispar
DLRIGKKLIRYGFAPRISFLTSRT

SEQ ID NO: 2477482 - protein, 20 aa, Entamoeba dispar
DLRKRIVIDGADVAYYNSHG

SEQ ID NO: 2477483 - protein, 20 aa, Entamoeba dispar
DLRQIWKNGMTYNRVGTLYY

SEQ ID NO: 2477484 - protein, 17 aa, Entamoeba dispar
DLRVTSYDGKNCFDCPW

SEQ ID NO: 2477485 - protein, 17 aa, Entamoeba dispar
DLSANFFTTLNFSSTRL

SEQ ID NO: 2477486 - protein, 18 aa, Entamoeba dispar
DLSIPKEHLMIIKTPNTS

SEQ ID NO: 2477487 - protein, 23 aa, Entamoeba dispar
DLSKCVPLKMDVLLNHSNNSITF

SEQ ID NO: 2477488 - protein, 22 aa, Entamoeba dispar
DLSKINQCYINFYVKLITEKTS

SEQ ID NO: 2477489 - protein, 18 aa, Entamoeba dispar
DLSKISWLVTVVDEAHRL

SEQ ID NO: 2477490 - protein, 22 aa, Entamoeba dispar
DLSKLNQCYIDFYVKLITEKTS

SEQ ID NO: 2477491 - protein, 20 aa, Entamoeba dispar
DLSKMSFVQRQRWEREQQDK

SEQ ID NO: 2477492 - protein, 22 aa, Entamoeba dispar
DLSPYKYLSFIVSWEQEGVNLG

SEQ ID NO: 2477493 - protein, 23 aa, Entamoeba dispar
DLSSKETIAYSCHRLNNKYDSTG

SEQ ID NO: 2477494 - protein, 19 aa, Entamoeba dispar
DLSTKMHRVLEETLYQNVK

SEQ ID NO: 2477495 - protein, 26 aa, Entamoeba dispar
DLTSMLRKAMEVRRSDIADDEDDDDD

SEQ ID NO: 2477496 - protein, 23 aa, Entamoeba dispar
DLVCGCSVGSILVSMLAIGITPR

SEQ ID NO: 2477497 - protein, 28 aa, Entamoeba dispar
DLVCTWYLNNTCCVWSIESSRVIVSFSD

SEQ ID NO: 2477498 - protein, 24 aa, Entamoeba dispar
DLVESIRFILERLIPFNQQLNPRR

SEQ ID NO: 2477499 - protein, 19 aa, Entamoeba dispar
DLVIVLFIEIFRAIDSDMN

SEQ ID NO: 2477500 - protein, 21 aa, Entamoeba dispar
DLVLEGCNLIYFPDPLLDQQN

SEQ ID NO: 2477501 - protein, 18 aa, Entamoeba dispar
DLVTMKWWNDLWLNEGFA

SEQ ID NO: 2477502 - protein, 28 aa, Entamoeba dispar
DLVVGLNCKQIKTGAPCRSERLCKYNQL

SEQ ID NO: 2477503 - protein, 27 aa, Entamoeba dispar
DLVYRPFLRLTYKEAIEMLRAAGETIG

SEQ ID NO: 2477504 - protein, 17 aa, Entamoeba dispar
DLVYSFFCEHYWDDKGL

SEQ ID NO: 2477505 - protein, 18 aa, Entamoeba dispar
DLVYWYCLLNEPLDRLHY

SEQ ID NO: 2477506 - protein, 24 aa, Entamoeba dispar
DLWNNNIIWEFAKGLSPGVDLTRI

SEQ ID NO: 2477507 - protein, 24 aa, Entamoeba dispar
DLYNRILANFVEFVHMLGEEVNPL

SEQ ID NO: 2477508 - protein, 20 aa, Entamoeba dispar
DLYQRLKRLNAIELLTDLAQ

SEQ ID NO: 2477509 - protein, 30 aa, Entamoeba dispar
DLYSIGVCLYRLATCQYPFSTTKKEFYSQM

SEQ ID NO: 2477510 - protein, 24 aa, Entamoeba dispar
  misc_feature (21)..(22): Xaa can be any naturally occurring amino acid
DLYSIGVCLYRLATCQYPFSXXFV

SEQ ID NO: 2477511 - protein, 18 aa, Entamoeba dispar
DLYSLGVVLYRLATNEYP

SEQ ID NO: 2477512 - protein, 22 aa, Entamoeba dispar
DMAKYRTITSFTKMTYTLNDLF

SEQ ID NO: 2477513 - protein, 21 aa, Entamoeba dispar
DMCQLSKKFICTKETEQYIER

SEQ ID NO: 2477514 - protein, 24 aa, Entamoeba dispar
DMDEWKYSELEIMKQGGNAKFTAY

SEQ ID NO: 2477515 - protein, 24 aa, Entamoeba dispar
DMHPEIIKAMIISFENEDIFIKKY

SEQ ID NO: 2477516 - protein, 18 aa, Entamoeba dispar
DMIIRGGHNVFPSEIVDT

SEQ ID NO: 2477517 - protein, 18 aa, Entamoeba dispar
DMINKLLEGIRYKIEDGK

SEQ ID NO: 2477518 - protein, 25 aa, Entamoeba dispar
DMKHWSFKKSEIFSTYADNQEGVLI

SEQ ID NO: 2477519 - protein, 23 aa, Entamoeba dispar
DMKVNCCICNIRLGQKEESQKCI

SEQ ID NO: 2477520 - protein, 25 aa, Entamoeba dispar
DMLCKAIKLSPNLSHIIQLESLLFQ

SEQ ID NO: 2477521 - protein, 26 aa, Entamoeba dispar
DMLCKAIKLSPNLSHIIQLESLLFQL

SEQ ID NO: 2477522 - protein, 21 aa, Entamoeba dispar
DMLDPIILLYMKLVVNLTGEK

SEQ ID NO: 2477523 - protein, 25 aa, Entamoeba dispar
DMLFEMLKAATFMNIDMLVEATAKT

SEQ ID NO: 2477524 - protein, 23 aa, Entamoeba dispar
DMLKEKDIRIIASHGGGPILGIK

SEQ ID NO: 2477525 - protein, 18 aa, Entamoeba dispar
DMMNCQYLSTINEEKPIK

SEQ ID NO: 2477526 - protein, 20 aa, Entamoeba dispar
DMMQWACWFHNAGTEIDLPT

SEQ ID NO: 2477527 - protein, 19 aa, Entamoeba dispar
DMNLLLRYIFGLIGYVPTV

SEQ ID NO: 2477528 - protein, 17 aa, Entamoeba dispar
DMPEVLQTIVLDKNNLG

SEQ ID NO: 2477529 - protein, 17 aa, Entamoeba dispar
DMSKIFEILLAYEKTNL

SEQ ID NO: 2477530 - protein, 20 aa, Entamoeba dispar
DMVYIKNLIEQYLQYYYTYQ

SEQ ID NO: 2477531 - protein, 28 aa, Entamoeba dispar
DMWMKYPLMEFLSTYVIIMIDESNDTVL

SEQ ID NO: 2477532 - protein, 30 aa, Entamoeba dispar
DMWSFGCVVAELFLGIPLFAGSSEHNQLSK

SEQ ID NO: 2477533 - protein, 22 aa, Entamoeba dispar
DMYDETKFTGSVTTIIPPQFAQ

SEQ ID NO: 2477534 - protein, 23 aa, Entamoeba dispar
DNAELRETIKLMKQQIEANNELM

SEQ ID NO: 2477535 - protein, 18 aa, Entamoeba dispar
DNCCFDRCTSLTSIKIPS

SEQ ID NO: 2477536 - protein, 19 aa, Entamoeba dispar
DNCFDECKELMSINIPSTI

SEQ ID NO: 2477537 - protein, 19 aa, Entamoeba dispar
DNCFKECYQLSSINIPSTV

SEQ ID NO: 2477538 - protein, 18 aa, Entamoeba dispar
DNCFLGCSSLKSINIPSS

SEQ ID NO: 2477539 - protein, 18 aa, Entamoeba dispar
DNCIINFNCTVLEGGPVT

SEQ ID NO: 2477540 - protein, 22 aa, Entamoeba dispar
DNCPSIVRRVLRKVYDELNNKF

SEQ ID NO: 2477541 - protein, 25 aa, Entamoeba dispar
DNCTEFKERVLLTFINTNGFNIDNQ

SEQ ID NO: 2477542 - protein, 22 aa, Entamoeba dispar
DNDCRCSLWSKCLGNSIDKNIF

SEQ ID NO: 2477543 - protein, 21 aa, Entamoeba dispar
DNDDIVFWNAFIMDTTKSVKQ

SEQ ID NO: 2477544 - protein, 22 aa, Entamoeba dispar
DNDEWIYYLFILIKNILKKYPS

SEQ ID NO: 2477545 - protein, 23 aa, Entamoeba dispar
DNDGKIPLVYAVQLQLPLLVRLI

SEQ ID NO: 2477546 - protein, 25 aa, Entamoeba dispar
DNDTRLARRILRDMNYRGRTLDSVL

SEQ ID NO: 2477547 - protein, 34 aa, Entamoeba dispar
DNELRKCCIICESHGIRVWDCDDITKNEEVFSYP

SEQ ID NO: 2477548 - protein, 26 aa, Entamoeba dispar
DNELSCLKEQFFLKEKRYRHYLTKVR

SEQ ID NO: 2477549 - protein, 24 aa, Entamoeba dispar
DNETKFNLFFSYHYYVDLLCESMA

SEQ ID NO: 2477550 - protein, 25 aa, Entamoeba dispar
DNFKCGIKFCSAGSVIALMTDGVCD

SEQ ID NO: 2477551 - protein, 23 aa, Entamoeba dispar
DNFKINLPFKQEIIRENEELTER

SEQ ID NO: 2477552 - protein, 17 aa, Entamoeba dispar
DNFPLLYPPKLRKGNNF

SEQ ID NO: 2477553 - protein, 22 aa, Entamoeba dispar
DNGFFLPLRHYHDIVSQLKNMG

SEQ ID NO: 2477554 - protein, 17 aa, Entamoeba dispar
DNGFRINYQIDVLNNIL

SEQ ID NO: 2477555 - protein, 17 aa, Entamoeba dispar
DNGIKKKAFWSIEEDRI

SEQ ID NO: 2477556 - protein, 19 aa, Entamoeba dispar
DNGKLLFPQNPVNSVPNYV

SEQ ID NO: 2477557 - protein, 19 aa, Entamoeba dispar
DNGQWLERHGRIERELAQL

SEQ ID NO: 2477558 - protein, 29 aa, Entamoeba dispar
DNGYALELFKLFVKYKCFIKVTYRSELPN

SEQ ID NO: 2477559 - protein, 24 aa, Entamoeba dispar
DNHKKTLLSICEYLIDSGINSDLF

SEQ ID NO: 2477560 - protein, 25 aa, Entamoeba dispar
DNIEIVYHIAPYLPFMETNDPQLDK

SEQ ID NO: 2477561 - protein, 21 aa, Entamoeba dispar
DNIFCLCGQRFCFKCLGEYHA

SEQ ID NO: 2477562 - protein, 23 aa, Entamoeba dispar
DNIKEVILFPTMRPEDESEKKAR

SEQ ID NO: 2477563 - protein, 24 aa, Entamoeba dispar
DNKENFCRYEVLPSLIKQLNELLS

SEQ ID NO: 2477564 - protein, 26 aa, Entamoeba dispar
DNKKRILMELLWPIIKYRSSNELIEA

SEQ ID NO: 2477565 - protein, 24 aa, Entamoeba dispar
DNKNIKIGFSYILLEINKIAEMIG

SEQ ID NO: 2477566 - protein, 20 aa, Entamoeba dispar
DNKSHFVHRFVQLMRDYTDS

SEQ ID NO: 2477567 - protein, 18 aa, Entamoeba dispar
DNLEHWEKRKEVFYSSFL

SEQ ID NO: 2477568 - protein, 18 aa, Entamoeba dispar
DNLIKEFVFQAAKNGMDV

SEQ ID NO: 2477569 - protein, 20 aa, Entamoeba dispar
DNLKFIFDKFYAIDSSPSTI

SEQ ID NO: 2477570 - protein, 24 aa, Entamoeba dispar
DNLVYRKSRVLKRTTKIMRSTDTD

SEQ ID NO: 2477571 - protein, 20 aa, Entamoeba dispar
DNMTICPGAKVLYIGAASGT

SEQ ID NO: 2477572 - protein, 26 aa, Entamoeba dispar
DNNCSLFTLGNRIGFIHITKTNNKRC

SEQ ID NO: 2477573 - protein, 17 aa, Entamoeba dispar
DNNRLAVYIYIKDSNSI

SEQ ID NO: 2477574 - protein, 27 aa, Entamoeba dispar
DNPWYFDARIRRCYHLWDEKQYNLASQ

SEQ ID NO: 2477575 - protein, 18 aa, Entamoeba dispar
DNQFMRKLADLFSADPQK

SEQ ID NO: 2477576 - protein, 19 aa, Entamoeba dispar
DNQPGVLIQVFEGEASMTS

SEQ ID NO: 2477577 - protein, 25 aa, Entamoeba dispar
DNQPNNIFGGFSFNSLGTTDKKKEE

SEQ ID NO: 2477578 - protein, 17 aa, Entamoeba dispar
DNSAWKTSITVVKICDF

SEQ ID NO: 2477579 - protein, 25 aa, Entamoeba dispar
DNSFVLPCFDHIFFGNKSLSISFAH

SEQ ID NO: 2477580 - protein, 24 aa, Entamoeba dispar
DNSIKIWDIRSITPLCTIPFSTKM

SEQ ID NO: 2477581 - protein, 23 aa, Entamoeba dispar
DNSIKRLIPVYGENFDALVSDGF

SEQ ID NO: 2477582 - protein, 23 aa, Entamoeba dispar
DNSLVLYLSYFIIKDNRFGPNDM

SEQ ID NO: 2477583 - protein, 24 aa, Entamoeba dispar
DNSVEFWKIMTFITMQYIQIYSSD

SEQ ID NO: 2477584 - protein, 19 aa, Entamoeba dispar
DNTCYLCGEEIFEGDSIVR

SEQ ID NO: 2477585 - protein, 24 aa, Entamoeba dispar
DNTKKAYEWKGTYCSDGVSNCVIE

SEQ ID NO: 2477586 - protein, 23 aa, Entamoeba dispar
DNTRKRKGLVLDEKIVEFVDKQS

SEQ ID NO: 2477587 - protein, 23 aa, Entamoeba dispar
DNVIKELKIFGGMTNYQGTNIIS

SEQ ID NO: 2477588 - protein, 24 aa, Entamoeba dispar
DNVIKELKIFGGMTNYQGTNIISS

SEQ ID NO: 2477589 - protein, 19 aa, Entamoeba dispar
DNVKIKVRVGRGIVVGGFQ

SEQ ID NO: 2477590 - protein, 21 aa, Entamoeba dispar
DNVWKRKTYQIVLIHLLSQKN

SEQ ID NO: 2477591 - protein, 18 aa, Entamoeba dispar
DNYDCMFHVAPLIPCNNN

SEQ ID NO: 2477592 - protein, 18 aa, Entamoeba dispar
DNYLKHQLIQQIVEIPLN

SEQ ID NO: 2477593 - protein, 23 aa, Entamoeba dispar
DNYPLKRPSVFPHLEVSVEELIR

SEQ ID NO: 2477594 - protein, 21 aa, Entamoeba dispar
DPDFKWEFPKELEIPAELKPK

SEQ ID NO: 2477595 - protein, 24 aa, Entamoeba dispar
DPDLFRSLRVNWIITKVREGLNNH

SEQ ID NO: 2477596 - protein, 17 aa, Entamoeba dispar
DPDNFIIPPKQYKEIKP

SEQ ID NO: 2477597 - protein, 22 aa, Entamoeba dispar
DPEEMSVYIGVCLDHIDDEEII

SEQ ID NO: 2477598 - protein, 24 aa, Entamoeba dispar
DPETFKVMMMLKYNKSLINPGEPV

SEQ ID NO: 2477599 - protein, 22 aa, Entamoeba dispar
DPEVLNSMLPYFSEIYGNPNSL

SEQ ID NO: 2477600 - protein, 19 aa, Entamoeba dispar
DPFANYVLQRMFTMMNNDQ

SEQ ID NO: 2477601 - protein, 24 aa, Entamoeba dispar
DPFDRTPLELSMVIPMNDLKQQIM

SEQ ID NO: 2477602 - protein, 19 aa, Entamoeba dispar
DPFGPIIGVDIVYKPQTNE

SEQ ID NO: 2477603 - protein, 18 aa, Entamoeba dispar
DPFPKEIYNFPWDIADSI

SEQ ID NO: 2477604 - protein, 25 aa, Entamoeba dispar
DPGKGTKVIYHWQGKKSNRMEKGKA

SEQ ID NO: 2477605 - protein, 19 aa, Entamoeba dispar
DPHIYQMFSTLGVEPQLFL

SEQ ID NO: 2477606 - protein, 25 aa, Entamoeba dispar
DPIIKNDFFILVRVYGIYCSCYNLD

SEQ ID NO: 2477607 - protein, 17 aa, Entamoeba dispar
DPISGLKEENGDEAFTR

SEQ ID NO: 2477608 - protein, 28 aa, Entamoeba dispar
DPIVQRFRWSILILFRVITNLYDCLDKN

SEQ ID NO: 2477609 - protein, 18 aa, Entamoeba dispar
DPKFPGTKPIFISRQHYK

SEQ ID NO: 2477610 - protein, 19 aa, Entamoeba dispar
DPKIPVLALLLGENIRSDM

SEQ ID NO: 2477611 - protein, 20 aa, Entamoeba dispar
DPKLVEMLLENEVEEDIELD

SEQ ID NO: 2477612 - protein, 20 aa, Entamoeba dispar
DPKLVEMLLENEVEEDVELD

SEQ ID NO: 2477613 - protein, 21 aa, Entamoeba dispar
DPKLVEMLLENEVEEYIELDD

SEQ ID NO: 2477614 - protein, 19 aa, Entamoeba dispar
DPKLVEMLMENEIEEVSED

SEQ ID NO: 2477615 - protein, 18 aa, Entamoeba dispar
DPKQRVYQLLSIGRNGTH

SEQ ID NO: 2477616 - protein, 23 aa, Entamoeba dispar
DPKTLDPERWLPLYQRKKKQKKG

SEQ ID NO: 2477617 - protein, 19 aa, Entamoeba dispar
DPKTVICLNNTIEIDEELL

SEQ ID NO: 2477618 - protein, 21 aa, Entamoeba dispar
DPLHWLQYFPPLGVEDLKLMG

SEQ ID NO: 2477619 - protein, 18 aa, Entamoeba dispar
DPLPLLRERIIKLKNRIE

SEQ ID NO: 2477620 - protein, 22 aa, Entamoeba dispar
DPMRRTGQFYGRGEYFGKTADI

SEQ ID NO: 2477621 - protein, 24 aa, Entamoeba dispar
DPNNPHCRYCLKPYQPFLNDCEKG

SEQ ID NO: 2477622 - protein, 25 aa, Entamoeba dispar
DPNSFKLSPNFSIYPQFMFHLRRSH

SEQ ID NO: 2477623 - protein, 18 aa, Entamoeba dispar
DPNYCIVTGLIGESNSGM

SEQ ID NO: 2477624 - protein, 34 aa, Entamoeba dispar
DPPEHTCVAPSRAAPRPVKHLVQQTATAKSFSPS

SEQ ID NO: 2477625 - protein, 18 aa, Entamoeba dispar
DPQAFLFTIQINNKIEFN

SEQ ID NO: 2477626 - protein, 19 aa, Entamoeba dispar
DPQTYRKSFRYSKLYEFKK

SEQ ID NO: 2477627 - protein, 18 aa, Entamoeba dispar
DPRCAKRLEELRINIKTT

SEQ ID NO: 2477628 - protein, 18 aa, Entamoeba dispar
DPRHLIEYYRRYIPKQVG

SEQ ID NO: 2477629 - protein, 20 aa, Entamoeba dispar
DPRILTSHFNNVFFIIQPKT

SEQ ID NO: 2477630 - protein, 20 aa, Entamoeba dispar
DPRLFTSHFNHIFVIVQPIS

SEQ ID NO: 2477631 - protein, 22 aa, Entamoeba dispar
DPRYRKVSVGFVVYKTKEAATQ

SEQ ID NO: 2477632 - protein, 25 aa, Entamoeba dispar
DPSKCVMSGPGLKTGEVLVPQEFTV

SEQ ID NO: 2477633 - protein, 17 aa, Entamoeba dispar
DPSMALPPSLRVNRNEL

SEQ ID NO: 2477634 - protein, 19 aa, Entamoeba dispar
DPSSFKFKLLEEPGGKRRI

SEQ ID NO: 2477635 - protein, 23 aa, Entamoeba dispar
DPSSNLLAFHFIKVRPKNLLLID

SEQ ID NO: 2477636 - protein, 22 aa, Entamoeba dispar
DPSYYLFRWLTLLGASELPMDV

SEQ ID NO: 2477637 - protein, 18 aa, Entamoeba dispar
DPTEKWVAILALLQKNNE

SEQ ID NO: 2477638 - protein, 26 aa, Entamoeba dispar
DPTGDFICCLCVSMLVEIKRQLLNGD

SEQ ID NO: 2477639 - protein, 19 aa, Entamoeba dispar
DPTIPVSCTLYINNLDQSI

SEQ ID NO: 2477640 - protein, 21 aa, Entamoeba dispar
DPTLCSQLFIKEIDNALIESI

SEQ ID NO: 2477641 - protein, 26 aa, Entamoeba dispar
DPTLIKLFLQNGMFKEFFEKHPEMED

SEQ ID NO: 2477642 - protein, 19 aa, Entamoeba dispar
DPVCGWTAYNVVLSKTDLD

SEQ ID NO: 2477643 - protein, 17 aa, Entamoeba dispar
DPVNVKALYRIGVVLNK

SEQ ID NO: 2477644 - protein, 19 aa, Entamoeba dispar
DPVSLPAIDYFLRVGNIEN

SEQ ID NO: 2477645 - protein, 19 aa, Entamoeba dispar
DPVYVARLINCISQTESDV

SEQ ID NO: 2477646 - protein, 21 aa, Entamoeba dispar
DPYFAECLVFGYPTVMTKEEL

SEQ ID NO: 2477647 - protein, 23 aa, Entamoeba dispar
DPYFVFTACSAFWILQDGTVSFH

SEQ ID NO: 2477648 - protein, 19 aa, Entamoeba dispar
DPYIKLSVNGQMHKTAIAR

SEQ ID NO: 2477649 - protein, 17 aa, Entamoeba dispar
DQAIFFLNAFWAEAGKD

SEQ ID NO: 2477650 - protein, 25 aa, Entamoeba dispar
DQCYKIIQYYSLKCVLIDKSEAVPK

SEQ ID NO: 2477651 - protein, 27 aa, Entamoeba dispar
DQDGVCLIWDIGMLMCLHVIEVGECVI

SEQ ID NO: 2477652 - protein, 29 aa, Entamoeba dispar
DQECSKRVHLEWEELLGLLEEFAAFQQNC

SEQ ID NO: 2477653 - protein, 32 aa, Entamoeba dispar
DQEFDLSRYIPFIKEIVLRMANNDVPDYCILN

SEQ ID NO: 2477654 - protein, 24 aa, Entamoeba dispar
DQELRIEIMPTYTLENKLPYEMNI

SEQ ID NO: 2477655 - protein, 18 aa, Entamoeba dispar
DQERLFRRSQQLRGTKIY

SEQ ID NO: 2477656 - protein, 25 aa, Entamoeba dispar
DQFLCLRPAKHFPGIPTPLKKCEID

SEQ ID NO: 2477657 - protein, 18 aa, Entamoeba dispar
DQFPLYLHFNPEYSISLS

SEQ ID NO: 2477658 - protein, 19 aa, Entamoeba dispar
DQINICVLTLVITFTSIRR

SEQ ID NO: 2477659 - protein, 17 aa, Entamoeba dispar
DQIQRWLDVDPNDIAIY

SEQ ID NO: 2477660 - protein, 23 aa, Entamoeba dispar
DQKEILRLAFAEDDVMNEIEEID

SEQ ID NO: 2477661 - protein, 25 aa, Entamoeba dispar
DQKYKGKMLFMSPFFLNKLQSYFSL

SEQ ID NO: 2477662 - protein, 26 aa, Entamoeba dispar
DQKYQLPSCGFDWCNQNPDLLCTWYL

SEQ ID NO: 2477663 - protein, 20 aa, Entamoeba dispar
DQLCFICCSNPADTIMLPCK

SEQ ID NO: 2477664 - protein, 21 aa, Entamoeba dispar
DQLECIIHIYSVLELFFNSNL

SEQ ID NO: 2477665 - protein, 20 aa, Entamoeba dispar
DQLFFDRWFRKKLISKETYL

SEQ ID NO: 2477666 - protein, 20 aa, Entamoeba dispar
DQLKSAINYIHLKRQNEIEL

SEQ ID NO: 2477667 - protein, 26 aa, Entamoeba dispar
DQLLIRLKKRFYFRDRNVNDTDQQQL

SEQ ID NO: 2477668 - protein, 22 aa, Entamoeba dispar
DQLLKGYFGISVLNVANENGVI

SEQ ID NO: 2477669 - protein, 26 aa, Entamoeba dispar
DQLMCFPAALPAIFSFSNGNSIRYAK

SEQ ID NO: 2477670 - protein, 37 aa, Entamoeba dispar
DQLPKALVIIFECMYNKGCFCKGIFRESSNASIRQIE

SEQ ID NO: 2477671 - protein, 19 aa, Entamoeba dispar
DQLTYTGIISYDLASFYWS

SEQ ID NO: 2477672 - protein, 23 aa, Entamoeba dispar
DQMKRKSHRGGRRVRRIREMYGM

SEQ ID NO: 2477673 - protein, 24 aa, Entamoeba dispar
DQMLHFYVLISHVILLKDVLLKAP

SEQ ID NO: 2477674 - protein, 20 aa, Entamoeba dispar
DQNYRFIIFDDINYDKNLVR

SEQ ID NO: 2477675 - protein, 17 aa, Entamoeba dispar
DQPFKKDFIYISDIPIE

SEQ ID NO: 2477676 - protein, 17 aa, Entamoeba dispar
DQPNFFKKENKASKKGF

SEQ ID NO: 2477677 - protein, 28 aa, Entamoeba dispar
DQQPPFPYPNWRSVVLPQGYVMYYYRNK

SEQ ID NO: 2477678 - protein, 18 aa, Entamoeba dispar
DQRKEGIISKSIIDNQPT

SEQ ID NO: 2477679 - protein, 17 aa, Entamoeba dispar
DQRKQRELENLRLQEQL

SEQ ID NO: 2477680 - protein, 22 aa, Entamoeba dispar
DQRRRFCFFLAAVIQGVDNHAD

SEQ ID NO: 2477681 - protein, 21 aa, Entamoeba dispar
DQRSLLLLSRLEWILKDISND

SEQ ID NO: 2477682 - protein, 25 aa, Entamoeba dispar
DQSISYRIGDSFGITSFQTEPKQCQ

SEQ ID NO: 2477683 - protein, 19 aa, Entamoeba dispar
DQVLVRMRCTPGIKPNESI

SEQ ID NO: 2477684 - protein, 17 aa, Entamoeba dispar
DQVRLIFMHWKGPAVKR

SEQ ID NO: 2477685 - protein, 23 aa, Entamoeba dispar
DRARSSCFRGIFVDVSSVFQDYG

SEQ ID NO: 2477686 - protein, 19 aa, Entamoeba dispar
DRDELKIPIQNSLISVLLN

SEQ ID NO: 2477687 - protein, 24 aa, Entamoeba dispar
DREKEFQIGTLVSMIETTRKEIEE

SEQ ID NO: 2477688 - protein, 21 aa, Entamoeba dispar
DREMVIVPLILGEGNDWDKID

SEQ ID NO: 2477689 - protein, 20 aa, Entamoeba dispar
DRERCGLNIPEEFNAIDYEC

SEQ ID NO: 2477690 - protein, 19 aa, Entamoeba dispar
DRERCGLNIPEEFNGIGDE

SEQ ID NO: 2477691 - protein, 20 aa, Entamoeba dispar
DRFGECYHLTKGQKKRFGYS

SEQ ID NO: 2477692 - protein, 38 aa, Entamoeba dispar
DRFQRSYFYYRFDFKRCSEPLVIILVDHFVCIYQSGTL

SEQ ID NO: 2477693 - protein, 19 aa, Entamoeba dispar
DRFVSMIINHVSFQVIKNL

SEQ ID NO: 2477694 - protein, 27 aa, Entamoeba dispar
DRGFTYTIRLIFCGDEITQTQARRLAI

SEQ ID NO: 2477695 - protein, 28 aa, Entamoeba dispar
DRGKFGIEVLCLLYALKVKYPGSIFICR

SEQ ID NO: 2477696 - protein, 26 aa, Entamoeba dispar
DRIEEIGIEHKLCFGPYKTGIKNSGN

SEQ ID NO: 2477697 - protein, 17 aa, Entamoeba dispar
DRIKERRDEYSIRKDVN

SEQ ID NO: 2477698 - protein, 21 aa, Entamoeba dispar
DRIKRLGIEFRTNAKVDDITT

SEQ ID NO: 2477699 - protein, 25 aa, Entamoeba dispar
DRKAFCFKTPQGCFVTPTVIENKLS

SEQ ID NO: 2477700 - protein, 24 aa, Entamoeba dispar
DRKEIKANLYSASIWDDVINMTEF

SEQ ID NO: 2477701 - protein, 20 aa, Entamoeba dispar
DRKFYGVMYFYKMAEQDIED

SEQ ID NO: 2477702 - protein, 18 aa, Entamoeba dispar
DRKIFVGALDILKLLVKQ

SEQ ID NO: 2477703 - protein, 27 aa, Entamoeba dispar
DRKIVCADITYGVFLCRDCSNCHKNQL

SEQ ID NO: 2477704 - protein, 19 aa, Entamoeba dispar
DRKQYGLNIPEGFNVIGDE

SEQ ID NO: 2477705 - protein, 22 aa, Entamoeba dispar
DRKRYGLKIPKGFNAIGDECFE

SEQ ID NO: 2477706 - protein, 20 aa, Entamoeba dispar
DRKRYGLKIPKRFDKIGDSC

SEQ ID NO: 2477707 - protein, 20 aa, Entamoeba dispar
DRKSVNLSIHDLIEVGSITY

SEQ ID NO: 2477708 - protein, 22 aa, Entamoeba dispar
DRKTAEGIMVHFKKGFEGKDNR

SEQ ID NO: 2477709 - protein, 24 aa, Entamoeba dispar
DRLCCYPSYDFVHCLVDSFEDITH

SEQ ID NO: 2477710 - protein, 20 aa, Entamoeba dispar
DRLCNFLINIVEKYGSSEDI

SEQ ID NO: 2477711 - protein, 19 aa, Entamoeba dispar
DRLGTCSLDTTVTVWSVET

SEQ ID NO: 2477712 - protein, 20 aa, Entamoeba dispar
DRLICDLLYEDALEHINSAT

SEQ ID NO: 2477713 - protein, 26 aa, Entamoeba dispar
DRLKRLRPLLEISVKKVDSNICIVEK

SEQ ID NO: 2477714 - protein, 20 aa, Entamoeba dispar
DRLLWLTSIICHSQQSNIYK

SEQ ID NO: 2477715 - protein, 34 aa, Entamoeba dispar
DRLQLSIKILECLSLNCHHGVILKTSIDKENEEI

SEQ ID NO: 2477716 - protein, 32 aa, Entamoeba dispar
DRLSEPFFECKFCIYCNSYGYWPTFTLVKVEQ

SEQ ID NO: 2477717 - protein, 19 aa, Entamoeba dispar
DRLTIKYKAKEVGSLVTCS

SEQ ID NO: 2477718 - protein, 19 aa, Entamoeba dispar
DRMFEMIEFVELYNFNPIL

SEQ ID NO: 2477719 - protein, 18 aa, Entamoeba dispar
DRMKISYRQPNVINLSGT

SEQ ID NO: 2477720 - protein, 17 aa, Entamoeba dispar
DRMKKDVLKKVIQKRME

SEQ ID NO: 2477721 - protein, 17 aa, Entamoeba dispar
DRNPVLCKNHLDTIMKF

SEQ ID NO: 2477722 - protein, 21 aa, Entamoeba dispar
DRNRVKGLIVTLFTPKENKYS

SEQ ID NO: 2477723 - protein, 26 aa, Entamoeba dispar
DRNYHAICGIVFAFVRIPEIEQLKSQ

SEQ ID NO: 2477724 - protein, 17 aa, Entamoeba dispar
DRPFDVYKWRMEETNLI

SEQ ID NO: 2477725 - protein, 26 aa, Entamoeba dispar
DRRHIVCPNPAFIMQLYEWQRKYHSC

SEQ ID NO: 2477726 - protein, 21 aa, Entamoeba dispar
DRRIFKQVIWYDISYSQYLKE

SEQ ID NO: 2477727 - protein, 22 aa, Entamoeba dispar
DRRIFKQVIWYDISYSQYLKEK

SEQ ID NO: 2477728 - protein, 19 aa, Entamoeba dispar
DRSGTLKITVIDFNNCFEQ

SEQ ID NO: 2477729 - protein, 25 aa, Entamoeba dispar
DRSLFERLYKCGVSVDMLKIQYRMH

SEQ ID NO: 2477730 - protein, 21 aa, Entamoeba dispar
DRSLIKMCQRFGDFRKDDPNS

SEQ ID NO: 2477731 - protein, 19 aa, Entamoeba dispar
DRSLVSIVVTVIYELDQQI

SEQ ID NO: 2477732 - protein, 23 aa, Entamoeba dispar
DRSTLKERIADLESRIDGLEGGN

SEQ ID NO: 2477733 - protein, 17 aa, Entamoeba dispar
DRTLRWWDMAHSRCKLS

SEQ ID NO: 2477734 - protein, 22 aa, Entamoeba dispar
DRVCFHCGKPGHIGKNCPEQGV

SEQ ID NO: 2477735 - protein, 24 aa, Entamoeba dispar
DRVNMGTIFGPYIFWKEYSMKSIS

SEQ ID NO: 2477736 - protein, 19 aa, Entamoeba dispar
DRVSDDMMRIIKNMRRRGY

SEQ ID NO: 2477737 - protein, 18 aa, Entamoeba dispar
DRVSESCPTLTSLENNLS

SEQ ID NO: 2477738 - protein, 20 aa, Entamoeba dispar
DRVSMKMCLECSKQNINAKT

SEQ ID NO: 2477739 - protein, 21 aa, Entamoeba dispar
DRVYNSWATKIFAGLDNVACV

SEQ ID NO: 2477740 - protein, 22 aa, Entamoeba dispar
DRYEGYYNYLLFESYKKLHPSI

SEQ ID NO: 2477741 - protein, 18 aa, Entamoeba dispar
DRYERRLCELQKKVNEMD

SEQ ID NO: 2477742 - protein, 19 aa, Entamoeba dispar
DRYSTSIYLGDYVDRGTMS

SEQ ID NO: 2477743 - protein, 19 aa, Entamoeba dispar
DRYTIFIGNLSKKQANQKI

SEQ ID NO: 2477744 - protein, 23 aa, Entamoeba dispar
DRYVEHIGLKKVIERIYDEYLPK

SEQ ID NO: 2477745 - protein, 26 aa, Entamoeba dispar
DSAKYVSAVLCCLSVMTSLEIPHLNV

SEQ ID NO: 2477746 - protein, 17 aa, Entamoeba dispar
DSCFPPFDKELNIKAGH

SEQ ID NO: 2477747 - protein, 20 aa, Entamoeba dispar
DSCIPKCPKCGKEMTQNLRS

SEQ ID NO: 2477748 - protein, 28 aa, Entamoeba dispar
DSCSIYRLKESWVLLSTEEVNLFKQLDS

SEQ ID NO: 2477749 - protein, 18 aa, Entamoeba dispar
DSDPWISQILSLQQINNQ

SEQ ID NO: 2477750 - protein, 24 aa, Entamoeba dispar
DSELWDLRMLKLKKTTDLLSGCYS

SEQ ID NO: 2477751 - protein, 26 aa, Entamoeba dispar
DSENILCFAGAFLISGNCGENEESRL

SEQ ID NO: 2477752 - protein, 19 aa, Entamoeba dispar
DSEQICALLPETTSRLLRI

SEQ ID NO: 2477753 - protein, 24 aa, Entamoeba dispar
DSERLDDILLFSGFKDIKQREAAI

SEQ ID NO: 2477754 - protein, 20 aa, Entamoeba dispar
DSESFSFLIEFGEIKNDGNI

SEQ ID NO: 2477755 - protein, 20 aa, Entamoeba dispar
DSESIIFPFLYENEIIQWLT

SEQ ID NO: 2477756 - protein, 22 aa, Entamoeba dispar
DSFDDLKLLGIFNIPKEGCYYA

SEQ ID NO: 2477757 - protein, 29 aa, Entamoeba dispar
DSFDVEPKAKCKRTERVLDKCKEAVLCKD

SEQ ID NO: 2477758 - protein, 24 aa, Entamoeba dispar
DSFEYAKLLQLFSENDFVLISNEN

SEQ ID NO: 2477759 - protein, 24 aa, Entamoeba dispar
DSFLHKISGLSILNYGTINICVPP

SEQ ID NO: 2477760 - protein, 24 aa, Entamoeba dispar
DSFLHLPLYLNRIYELRKDHSKSI

SEQ ID NO: 2477761 - protein, 22 aa, Entamoeba dispar
DSFRKVKLIGMGNVGRVYLVQL

SEQ ID NO: 2477762 - protein, 23 aa, Entamoeba dispar
DSFSTAFLPMILNLAFDSTSNVR

SEQ ID NO: 2477763 - protein, 25 aa, Entamoeba dispar
DSFVDGKAFLALLCSLDKDQKTFDK

SEQ ID NO: 2477764 - protein, 19 aa, Entamoeba dispar
DSFYYFMKKVRSIDERTTD

SEQ ID NO: 2477765 - protein, 17 aa, Entamoeba dispar
DSGCILLKHISYNNFDA

SEQ ID NO: 2477766 - protein, 23 aa, Entamoeba dispar
DSGDSIFTYFGYRKFSKGNYKGF

SEQ ID NO: 2477767 - protein, 25 aa, Entamoeba dispar
DSGLMAKMHLIDYSMLVGVHNLTDE

SEQ ID NO: 2477768 - protein, 23 aa, Entamoeba dispar
DSGQCARALKLQHFSLKYLLQKY

SEQ ID NO: 2477769 - protein, 23 aa, Entamoeba dispar
DSGRVRYAICEMALTLKNFPPQD

SEQ ID NO: 2477770 - protein, 18 aa, Entamoeba dispar
DSGVGKTGIFKRYITGQY

SEQ ID NO: 2477771 - protein, 18 aa, Entamoeba dispar
DSHKRTTTSISFEKNGNR

SEQ ID NO: 2477772 - protein, 23 aa, Entamoeba dispar
DSHKVFIKNGSIYFNELTYINPF

SEQ ID NO: 2477773 - protein, 28 aa, Entamoeba dispar
DSIERKMYWHRIVRKLKECLTVYNLCDK

SEQ ID NO: 2477774 - protein, 17 aa, Entamoeba dispar
DSIFCNKKGSFLVEEFV

SEQ ID NO: 2477775 - protein, 18 aa, Entamoeba dispar
DSIFCNKKGSFLVEEFVG

SEQ ID NO: 2477776 - protein, 32 aa, Entamoeba dispar
DSIICIPNFTAPDFFLFAAIDGHLGSVVSNTF

SEQ ID NO: 2477777 - protein, 25 aa, Entamoeba dispar
DSIIDIKIEFGWFYLNVLSTSPIHQ

SEQ ID NO: 2477778 - protein, 24 aa, Entamoeba dispar
DSIKIPKFYFLIDLIDRLIPKKTQ

SEQ ID NO: 2477779 - protein, 31 aa, Entamoeba dispar
DSIKKIKLRFTVRYDLLLTIFCDKLEKREDV

SEQ ID NO: 2477780 - protein, 17 aa, Entamoeba dispar
DSIKPLHFVIVSKIPIA

SEQ ID NO: 2477781 - protein, 26 aa, Entamoeba dispar
DSIRFVSKRIFYCFIYQSPKCDLEIL

SEQ ID NO: 2477782 - protein, 19 aa, Entamoeba dispar
DSKSFLFSIESKGRIQGMN

SEQ ID NO: 2477783 - protein, 23 aa, Entamoeba dispar
DSKTFLGKRLQGIQKEQKFIEKG

SEQ ID NO: 2477784 - protein, 20 aa, Entamoeba dispar
DSKTLASLCEQGNINQFIPR

SEQ ID NO: 2477785 - protein, 22 aa, Entamoeba dispar
DSKVFEVVKCITIDVQRETMKK

SEQ ID NO: 2477786 - protein, 27 aa, Entamoeba dispar
DSKVKAPMILKCFLTFAERLNIDDSLY

SEQ ID NO: 2477787 - protein, 18 aa, Entamoeba dispar
DSLEGFFFCHSICGGTGS

SEQ ID NO: 2477788 - protein, 24 aa, Entamoeba dispar
DSLGGNCKTVIIGTVSPSLSSIKE

SEQ ID NO: 2477789 - protein, 23 aa, Entamoeba dispar
DSLKIRKGIHLFLLKKMGKCQDP

SEQ ID NO: 2477790 - protein, 17 aa, Entamoeba dispar
DSLKLGLTPSHIKKILI

SEQ ID NO: 2477791 - protein, 24 aa, Entamoeba dispar
DSLLDYSLTMKMHFSTIEEKRRFL

SEQ ID NO: 2477792 - protein, 17 aa, Entamoeba dispar
DSLLYYLKMEHSIISSF

SEQ ID NO: 2477793 - protein, 21 aa, Entamoeba dispar
DSLMKGCPFDLVNKIVVTFCA

SEQ ID NO: 2477794 - protein, 20 aa, Entamoeba dispar
DSLNSLFKKCCMHPNDIVSM

SEQ ID NO: 2477795 - protein, 20 aa, Entamoeba dispar
DSLNSLLLKNERVIDHLIEY

SEQ ID NO: 2477796 - protein, 17 aa, Entamoeba dispar
DSLTRYFVDNSREGTLT

SEQ ID NO: 2477797 - protein, 20 aa, Entamoeba dispar
DSMMSRSYYEGCNVVIVVFD

SEQ ID NO: 2477798 - protein, 24 aa, Entamoeba dispar
DSNAHPILLCFQSSPIFSQQETRF

SEQ ID NO: 2477799 - protein, 24 aa, Entamoeba dispar
DSNEKLQQYHVFITKEAQRIVQES

SEQ ID NO: 2477800 - protein, 25 aa, Entamoeba dispar
DSNHPSIFIIKARIKIIKTNDLTYY

SEQ ID NO: 2477801 - protein, 17 aa, Entamoeba dispar
DSNIALSQKKLKAQPTE

SEQ ID NO: 2477802 - protein, 20 aa, Entamoeba dispar
DSNKWIPVYIQLYNSECLNH

SEQ ID NO: 2477803 - protein, 20 aa, Entamoeba dispar
DSNLTFLIECVDSLKKRVIE

SEQ ID NO: 2477804 - protein, 20 aa, Entamoeba dispar
DSNPIPFGSVDFSNFHADFT

SEQ ID NO: 2477805 - protein, 25 aa, Entamoeba dispar
DSPECALCKVKFTFVNRRHHCRKCG

SEQ ID NO: 2477806 - protein, 24 aa, Entamoeba dispar
DSPLANNVLDDFCIDQIRTQTHNQ

SEQ ID NO: 2477807 - protein, 21 aa, Entamoeba dispar
DSPLEAFSIFIGSSNKSIDST

SEQ ID NO: 2477808 - protein, 22 aa, Entamoeba dispar
DSPRFKWRGLMVDLARNAISKL

SEQ ID NO: 2477809 - protein, 17 aa, Entamoeba dispar
DSQKRFTVKQCLSHEFF

SEQ ID NO: 2477810 - protein, 24 aa, Entamoeba dispar
DSQLRKSTILDLAKYFKQVYVWQG

SEQ ID NO: 2477811 - protein, 31 aa, Entamoeba dispar
DSQLSIIEFFIAMACLNHYVLFKKLPIKIPI

SEQ ID NO: 2477812 - protein, 19 aa, Entamoeba dispar
DSQPMFWEVACILQQKTYL

SEQ ID NO: 2477813 - protein, 25 aa, Entamoeba dispar
DSQRKSEMTGIIFPSQRMRGGPLKK

SEQ ID NO: 2477814 - protein, 18 aa, Entamoeba dispar
DSRDCKRSGQGETDVPIL

SEQ ID NO: 2477815 - protein, 18 aa, Entamoeba dispar
DSRLTLMEIELSKKTIAY

SEQ ID NO: 2477816 - protein, 21 aa, Entamoeba dispar
DSRMSGPWAEKIVIKALEECG

SEQ ID NO: 2477817 - protein, 24 aa, Entamoeba dispar
DSRSLESYAKLIGVIDVQATDVVN

SEQ ID NO: 2477818 - protein, 21 aa, Entamoeba dispar
DSSDVKLCYDFSNNSVVKPEN

SEQ ID NO: 2477819 - protein, 20 aa, Entamoeba dispar
DSSFISFKILTLLYPQPIWN

SEQ ID NO: 2477820 - protein, 23 aa, Entamoeba dispar
DSSILKHQKDFFVLIKSQLEQQQ

SEQ ID NO: 2477821 - protein, 23 aa, Entamoeba dispar
DSSKAFVKREFHALKINPKGKAQ

SEQ ID NO: 2477822 - protein, 24 aa, Entamoeba dispar
DSSSFYFRGCMSALKILNQNSEAS

SEQ ID NO: 2477823 - protein, 17 aa, Entamoeba dispar
DSSSLLVLIQLQSCQSY

SEQ ID NO: 2477824 - protein, 18 aa, Entamoeba dispar
DSTCNSNFSFYWDLLKIC

SEQ ID NO: 2477825 - protein, 20 aa, Entamoeba dispar
DSTCYQIDFSNILLNNYQEI

SEQ ID NO: 2477826 - protein, 18 aa, Entamoeba dispar
DSTIIFNCPSAFSVDNQL

SEQ ID NO: 2477827 - protein, 24 aa, Entamoeba dispar
DSTIKGEILIALTKLSTRIPSQFN

SEQ ID NO: 2477828 - protein, 23 aa, Entamoeba dispar
DSTKKRYGFQFKYGKHTQKLLTD

SEQ ID NO: 2477829 - protein, 17 aa, Entamoeba dispar
DSTKLQCSNLIKEMDKQ

SEQ ID NO: 2477830 - protein, 22 aa, Entamoeba dispar
DSTKWTIVPALSFNPSQADFMT

SEQ ID NO: 2477831 - protein, 26 aa, Entamoeba dispar
DSTLCIVNSCRRGIGFNLKIKVDNQE

SEQ ID NO: 2477832 - protein, 18 aa, Entamoeba dispar
DSTTFIELCEPLFKRIQK

SEQ ID NO: 2477833 - protein, 25 aa, Entamoeba dispar
DSTVKWQVPDTFIFKYKELENELYI

SEQ ID NO: 2477834 - protein, 18 aa, Entamoeba dispar
DSVARKVAIQALMESTQS

SEQ ID NO: 2477835 - protein, 27 aa, Entamoeba dispar
DSVKNAWCSLCPKQVLDFKLSYHYLNT

SEQ ID NO: 2477836 - protein, 24 aa, Entamoeba dispar
DSWIEIENGFKLYQEKSGTVFTIP

SEQ ID NO: 2477837 - protein, 21 aa, Entamoeba dispar
DSYFTQCFVYSFKLITTTTKL

SEQ ID NO: 2477838 - protein, 22 aa, Entamoeba dispar
DSYINFSPFWKKKDGTKIPEGT

SEQ ID NO: 2477839 - protein, 21 aa, Entamoeba dispar
DSYLLRIWDSIFAFPTSKFYY

SEQ ID NO: 2477840 - protein, 31 aa, Entamoeba dispar
DTASITLSSSWPFLIMWKGSDNEAYIQLQRS

SEQ ID NO: 2477841 - protein, 19 aa, Entamoeba dispar
DTCVICYNLYLNEEDIEKK

SEQ ID NO: 2477842 - protein, 19 aa, Entamoeba dispar
DTCVICYNLYLNEENIEKK

SEQ ID NO: 2477843 - protein, 18 aa, Entamoeba dispar
DTEDCIKPLYSMEKTIGM

SEQ ID NO: 2477844 - protein, 34 aa, Entamoeba dispar
DTEFKGEILDFIGVKKWKTVRVVVYNKSPKSGSD

SEQ ID NO: 2477845 - protein, 21 aa, Entamoeba dispar
DTEGIFRISVSVKDLEETMTK

SEQ ID NO: 2477846 - protein, 19 aa, Entamoeba dispar
DTEIVLCRKGMKPEVLSTR

SEQ ID NO: 2477847 - protein, 25 aa, Entamoeba dispar
DTELCPYCNGHIKKANFKIHELRCR

SEQ ID NO: 2477848 - protein, 17 aa, Entamoeba dispar
DTFGYRPTLDKLPELSL

SEQ ID NO: 2477849 - protein, 22 aa, Entamoeba dispar
DTFLRRQSRSFQRAITPKHFGK

SEQ ID NO: 2477850 - protein, 22 aa, Entamoeba dispar
DTFLRRQSRSFQRAITPRKIGK

SEQ ID NO: 2477851 - protein, 17 aa, Entamoeba dispar
DTGVLVFVWCGKETSPT

SEQ ID NO: 2477852 - protein, 19 aa, Entamoeba dispar
DTHLSTVVSSCFQKTIHLS

SEQ ID NO: 2477853 - protein, 17 aa, Entamoeba dispar
DTHSFSSLQHLFKENHL

SEQ ID NO: 2477854 - protein, 18 aa, Entamoeba dispar
DTIFPKAVQLRWAITDCT

SEQ ID NO: 2477855 - protein, 23 aa, Entamoeba dispar
DTIKGVGPITAFELIQQYKSIEN

SEQ ID NO: 2477856 - protein, 17 aa, Entamoeba dispar
DTINHWFGINGMITIGS

SEQ ID NO: 2477857 - protein, 21 aa, Entamoeba dispar
DTISKIFCKLNDEFIKNAQYL

SEQ ID NO: 2477858 - protein, 28 aa, Entamoeba dispar
DTIVFYKIHQVFGGKLKYILNGGAPLTE

SEQ ID NO: 2477859 - protein, 18 aa, Entamoeba dispar
DTIVNCFNECPKGDKVQF

SEQ ID NO: 2477860 - protein, 19 aa, Entamoeba dispar
DTIVSLPFICQNQESFKKI

SEQ ID NO: 2477861 - protein, 26 aa, Entamoeba dispar
DTKGDGEGCWWGCVIKGDHVIDVKRM

SEQ ID NO: 2477862 - protein, 21 aa, Entamoeba dispar
DTKKVISFMELFKRAIRSMAM

SEQ ID NO: 2477863 - protein, 28 aa, Entamoeba dispar
DTKMICGGGCVEMELSLAVEEAAKKTEG

SEQ ID NO: 2477864 - protein, 17 aa, Entamoeba dispar
DTKMMKVPKAMYKISYP

SEQ ID NO: 2477865 - protein, 17 aa, Entamoeba dispar
DTKPGMVQLKCEGQTIS

SEQ ID NO: 2477866 - protein, 19 aa, Entamoeba dispar
DTKTIISIMLLIQSMTENH

SEQ ID NO: 2477867 - protein, 23 aa, Entamoeba dispar
DTKTQFPVVFGRGKEGTHDGSFI

SEQ ID NO: 2477868 - protein, 17 aa, Entamoeba dispar
DTLALIPTSISKFKQFF

SEQ ID NO: 2477869 - protein, 19 aa, Entamoeba dispar
DTLCNFGYSLTQVQYPQYC

SEQ ID NO: 2477870 - protein, 19 aa, Entamoeba dispar
DTLDRIAVINDRCKPGKCR

SEQ ID NO: 2477871 - protein, 23 aa, Entamoeba dispar
DTLEFDGGIIIFRLYSLIIRILF

SEQ ID NO: 2477872 - protein, 25 aa, Entamoeba dispar
DTLERLIEIYFRFKDVKHWKYWNLM

SEQ ID NO: 2477873 - protein, 18 aa, Entamoeba dispar
DTLHFILLMRSLIITPFN

SEQ ID NO: 2477874 - protein, 22 aa, Entamoeba dispar
DTLHPFQNPFVFPTKSSSIISS

SEQ ID NO: 2477875 - protein, 23 aa, Entamoeba dispar
DTLKKLNGILAISRANYNSKSIQ

SEQ ID NO: 2477876 - protein, 17 aa, Entamoeba dispar
DTLKQLYSIIAEELLDS

SEQ ID NO: 2477877 - protein, 17 aa, Entamoeba dispar
DTLLTTGTWCVPDLLDG

SEQ ID NO: 2477878 - protein, 19 aa, Entamoeba dispar
DTLRELLIFSLDIFDKKEI

SEQ ID NO: 2477879 - protein, 21 aa, Entamoeba dispar
DTLRFILMNKIKDWKCELESP

SEQ ID NO: 2477880 - protein, 18 aa, Entamoeba dispar
DTLYKVSFNLPRKEGNSI

SEQ ID NO: 2477881 - protein, 18 aa, Entamoeba dispar
DTMKCLDISLSLKVTEVK

SEQ ID NO: 2477882 - protein, 19 aa, Entamoeba dispar
DTNICYLSLVSPHHESTPE

SEQ ID NO: 2477883 - protein, 23 aa, Entamoeba dispar
DTNKLRKAIGLVQVLHSSFPELQ

SEQ ID NO: 2477884 - protein, 29 aa, Entamoeba dispar
DTNKLSWRVDGPQGALIQKMVDFFWNVGA

SEQ ID NO: 2477885 - protein, 26 aa, Entamoeba dispar
DTNKYTLWYLCDFLVDVLNHQSVNQM

SEQ ID NO: 2477886 - protein, 23 aa, Entamoeba dispar
DTPCVSPPLPVISFSNSNYINEE

SEQ ID NO: 2477887 - protein, 19 aa, Entamoeba dispar
DTPFTFDLLEEIKHVDPEN

SEQ ID NO: 2477888 - protein, 18 aa, Entamoeba dispar
DTPGFRLGGDEALKENID

SEQ ID NO: 2477889 - protein, 17 aa, Entamoeba dispar
DTPLLWLALNLSNSDLF

SEQ ID NO: 2477890 - protein, 20 aa, Entamoeba dispar
DTQKSLGISDIWELTFKDQS

SEQ ID NO: 2477891 - protein, 18 aa, Entamoeba dispar
DTQVEIPLLLPVDENIKD

SEQ ID NO: 2477892 - protein, 18 aa, Entamoeba dispar
DTRKAILKGNYQSMDELQ

SEQ ID NO: 2477893 - protein, 17 aa, Entamoeba dispar
DTSELFAEIAMNVGSQE

SEQ ID NO: 2477894 - protein, 17 aa, Entamoeba dispar
DTSHKFITLSYVPGTIQ

SEQ ID NO: 2477895 - protein, 18 aa, Entamoeba dispar
DTSIVGFGQRGHVDVLSN

SEQ ID NO: 2477896 - protein, 25 aa, Entamoeba dispar
DTSKGKLIISRKLGVSINLGKPKFS

SEQ ID NO: 2477897 - protein, 17 aa, Entamoeba dispar
DTSKRKGYLMVEQTMKY

SEQ ID NO: 2477898 - protein, 18 aa, Entamoeba dispar
DTSLALKEFIEAKKANKN

SEQ ID NO: 2477899 - protein, 35 aa, Entamoeba dispar
DTSVIYDIFNTISFMIKYLHSVIMEHSEIFMQHYI

SEQ ID NO: 2477900 - protein, 19 aa, Entamoeba dispar
DTTKRYGWSAIHKHPYIKT

SEQ ID NO: 2477901 - protein, 22 aa, Entamoeba dispar
DTTMKLTVIDFLSSAIVLLETT

SEQ ID NO: 2477902 - protein, 17 aa, Entamoeba dispar
DTWCKKKNIPSFFVSAK

SEQ ID NO: 2477903 - protein, 18 aa, Entamoeba dispar
DTYIPFRSSPLTRILQDA

SEQ ID NO: 2477904 - protein, 20 aa, Entamoeba dispar
DTYLACVRCCKDYANSPYKK

SEQ ID NO: 2477905 - protein, 21 aa, Entamoeba dispar
DTYRYLKLMSIYNKYKNRLDC

SEQ ID NO: 2477906 - protein, 24 aa, Entamoeba dispar
DVACVINFDCPISIVSYTHRIGRT

SEQ ID NO: 2477907 - protein, 24 aa, Entamoeba dispar
DVAPKKIMYCLSIFIESTKHLTSG

SEQ ID NO: 2477908 - protein, 17 aa, Entamoeba dispar
DVARYLIDIALKRHSFD

SEQ ID NO: 2477909 - protein, 25 aa, Entamoeba dispar
DVDLCATDKGILIWSLYDLIEVNIE

SEQ ID NO: 2477910 - protein, 18 aa, Entamoeba dispar
DVDLCLKAVEVLDFGKPI

SEQ ID NO: 2477911 - protein, 26 aa, Entamoeba dispar
DVDLGRALKMPDLEEAHAFLKNISLK

SEQ ID NO: 2477912 - protein, 28 aa, Entamoeba dispar
DVDMLFKKYQHALSFLAEMKFISKDRNP

SEQ ID NO: 2477913 - protein, 21 aa, Entamoeba dispar
DVDRTVALYGYVRGTNMRPNA

SEQ ID NO: 2477914 - protein, 21 aa, Entamoeba dispar
DVDTWTSIVCEGKFVNEVCPQ

SEQ ID NO: 2477915 - protein, 17 aa, Entamoeba dispar
DVDWPFYVVVTYGHGYQ

SEQ ID NO: 2477916 - protein, 25 aa, Entamoeba dispar
DVEGFACGFLKQTHKAVIISMANSE

SEQ ID NO: 2477917 - protein, 21 aa, Entamoeba dispar
DVELGKKLYEFARYWNERNVS

SEQ ID NO: 2477918 - protein, 23 aa, Entamoeba dispar
DVEPFYFYILCEFNYNEQWKSDD

SEQ ID NO: 2477919 - protein, 25 aa, Entamoeba dispar
DVEQYTRTDLFPWKEDMEEIQTIRK

SEQ ID NO: 2477920 - protein, 26 aa, Entamoeba dispar
DVEVKQRRNVKCITLPFFQIKRLHFN

SEQ ID NO: 2477921 - protein, 24 aa, Entamoeba dispar
DVEYNTAMAFVQSWLNVTSQNLSR

SEQ ID NO: 2477922 - protein, 27 aa, Entamoeba dispar
DVFCTECKSIRTCPHAFLCCIKNLNDG

SEQ ID NO: 2477923 - protein, 25 aa, Entamoeba dispar
DVFDWAMKRISAFTHNIVYHDPVEG

SEQ ID NO: 2477924 - protein, 19 aa, Entamoeba dispar
DVFFPSLVYVLIKANIPFF

SEQ ID NO: 2477925 - protein, 25 aa, Entamoeba dispar
DVFGMPSALSFPFDVIFREPKPSSF

SEQ ID NO: 2477926 - protein, 28 aa, Entamoeba dispar
DVFQFKDFWKHICIVWTKCYNYTPKNKL

SEQ ID NO: 2477927 - protein, 17 aa, Entamoeba dispar
DVFSFAIVMYETFIWGA

SEQ ID NO: 2477928 - protein, 24 aa, Entamoeba dispar
DVFSIGCVLFEMISGELFLQVNNN

SEQ ID NO: 2477929 - protein, 25 aa, Entamoeba dispar
DVHAKFAIALQCGNFKAALDAAKQL

SEQ ID NO: 2477930 - protein, 28 aa, Entamoeba dispar
DVHKLVPLKTDFIFTVNYKKVCEILSLM

SEQ ID NO: 2477931 - protein, 23 aa, Entamoeba dispar
DVHKVLSCMTLFYYISKDKLFKD

SEQ ID NO: 2477932 - protein, 22 aa, Entamoeba dispar
DVICPECIVRPSYVSDVKKGDE

SEQ ID NO: 2477933 - protein, 25 aa, Entamoeba dispar
DVIEFKNIIKFICECYNMKIFEEEF

SEQ ID NO: 2477934 - protein, 18 aa, Entamoeba dispar
DVIFCYIGDSPIYIKSNK

SEQ ID NO: 2477935 - protein, 23 aa, Entamoeba dispar
DVIKKEKRYTFSLDKSIMNCKYV

SEQ ID NO: 2477936 - protein, 24 aa, Entamoeba dispar
DVILKDELRGMRRVLKRLGYVSED

SEQ ID NO: 2477937 - protein, 24 aa, Entamoeba dispar
DVINGCFNFQVPEYNLINFNMEHS

SEQ ID NO: 2477938 - protein, 17 aa, Entamoeba dispar
DVIPEIVDGMNIADYVD

SEQ ID NO: 2477939 - protein, 18 aa, Entamoeba dispar
DVIPIVVICSQFIKEDHR

SEQ ID NO: 2477940 - protein, 24 aa, Entamoeba dispar
DVITPEFTNAIALGDIVIVEIPNI

SEQ ID NO: 2477941 - protein, 24 aa, Entamoeba dispar
DVKELKPGDLVGVNKDTYLILEKL

SEQ ID NO: 2477942 - protein, 24 aa, Entamoeba dispar
DVKIWTPELIQLFINFGNKRVNSL

SEQ ID NO: 2477943 - protein, 18 aa, Entamoeba dispar
DVKKLFKTNGIRVTDEDL

SEQ ID NO: 2477944 - protein, 18 aa, Entamoeba dispar
DVKKNFIAMLTFSDGETP

SEQ ID NO: 2477945 - protein, 18 aa, Entamoeba dispar
DVKLGDFGIATTLNDKTR

SEQ ID NO: 2477946 - protein, 18 aa, Entamoeba dispar
DVKPKRIIFKSIEEYIKV

SEQ ID NO: 2477947 - protein, 22 aa, Entamoeba dispar
DVKYNIGETVVFELFDHDTVGS

SEQ ID NO: 2477948 - protein, 25 aa, Entamoeba dispar
DVLCPHCLTKLVSVDSCYCISMDEI

SEQ ID NO: 2477949 - protein, 17 aa, Entamoeba dispar
DVLDHCYKNISDVINSM

SEQ ID NO: 2477950 - protein, 26 aa, Entamoeba dispar
DVLFGRLCTCLALIKAQRVNETETVE

SEQ ID NO: 2477951 - protein, 23 aa, Entamoeba dispar
DVLFRDPIDSVRIGFSKCLPYLC

SEQ ID NO: 2477952 - protein, 18 aa, Entamoeba dispar
DVLHNCTPFISKLYSLVN

SEQ ID NO: 2477953 - protein, 34 aa, Entamoeba dispar
DVLKEDWTTIKLYKFLIPLIFHYQELYWFERMGM

SEQ ID NO: 2477954 - protein, 18 aa, Entamoeba dispar
DVLKHLSQFTYFYESNAP

SEQ ID NO: 2477955 - protein, 25 aa, Entamoeba dispar
DVLKTCSITKSFKLYYDIVSQSTIR

SEQ ID NO: 2477956 - protein, 30 aa, Entamoeba dispar
DVLLESLGYHIFPIFYSLGINDRYESIIKK

SEQ ID NO: 2477957 - protein, 18 aa, Entamoeba dispar
DVLLPQFIDFIFNSQDDF

SEQ ID NO: 2477958 - protein, 18 aa, Entamoeba dispar
DVLNIVRKSPLFKYDKNK

SEQ ID NO: 2477959 - protein, 19 aa, Entamoeba dispar
DVLPTRNLIGVTILYGPDS

SEQ ID NO: 2477960 - protein, 17 aa, Entamoeba dispar
DVLYTIKIVFVGDPCTL

SEQ ID NO: 2477961 - protein, 25 aa, Entamoeba dispar
DVMLEKTLMEFSRRSVVDCIQGSIV

SEQ ID NO: 2477962 - protein, 41 aa, Entamoeba dispar
DVNDFTFFLPFFLKDDIKEYMLWFNRIYDIKSFMGSSLLTF

SEQ ID NO: 2477963 - protein, 25 aa, Entamoeba dispar
DVNELRMKATSFKAVNIEEITSALS

SEQ ID NO: 2477964 - protein, 17 aa, Entamoeba dispar
DVNGCGINKLGEMMRGM

SEQ ID NO: 2477965 - protein, 23 aa, Entamoeba dispar
DVNGIWKKFYGINCASKFIEYIQ

SEQ ID NO: 2477966 - protein, 21 aa, Entamoeba dispar
DVNKFCRIFNPPTCNCNLLNV

SEQ ID NO: 2477967 - protein, 23 aa, Entamoeba dispar
DVNPEFIPYIQLYLNFFHIKNVM

SEQ ID NO: 2477968 - protein, 25 aa, Entamoeba dispar
DVNVFKILIISSIKLGKDVTQFEET

SEQ ID NO: 2477969 - protein, 23 aa, Entamoeba dispar
DVNWSVNSLGHWDDDIIENDSSY

SEQ ID NO: 2477970 - protein, 20 aa, Entamoeba dispar
DVPFSSAIIECYKNQHENLI

SEQ ID NO: 2477971 - protein, 25 aa, Entamoeba dispar
DVPLKEGLPLPVYDSLKYFKENPTL

SEQ ID NO: 2477972 - protein, 18 aa, Entamoeba dispar
DVQIKELLSIIAKSVVNN

SEQ ID NO: 2477973 - protein, 20 aa, Entamoeba dispar
DVQLPLLMSLVRTFTNRSTG

SEQ ID NO: 2477974 - protein, 26 aa, Entamoeba dispar
DVRVAYEATRILCNLIILNSDYANTI

SEQ ID NO: 2477975 - protein, 19 aa, Entamoeba dispar
DVRVQRMIIHLLANIAGDS

SEQ ID NO: 2477976 - protein, 18 aa, Entamoeba dispar
DVSCCKIVNDNVIIESCG

SEQ ID NO: 2477977 - protein, 24 aa, Entamoeba dispar
DVSGAAKFRGLWKSYYPNVKCIAY

SEQ ID NO: 2477978 - protein, 26 aa, Entamoeba dispar
DVSIREAICAWDWKMREQAGSDKYGE

SEQ ID NO: 2477979 - protein, 23 aa, Entamoeba dispar
DVSKWNINFNIFKPLSSKMIQDI

SEQ ID NO: 2477980 - protein, 20 aa, Entamoeba dispar
DVSLLSRFDFLYTLLESPLM

SEQ ID NO: 2477981 - protein, 21 aa, Entamoeba dispar
DVSYCKICMDKEKGISRGTGF

SEQ ID NO: 2477982 - protein, 25 aa, Entamoeba dispar
DVTCYSFRWVSMLFIDDFSIKDVIK

SEQ ID NO: 2477983 - protein, 28 aa, Entamoeba dispar
DVTTLDEFARRLTVRKVDTDAKEEKKPK

SEQ ID NO: 2477984 - protein, 26 aa, Entamoeba dispar
DVTVMIEIFYRGFGVSFVEREVMKKY

SEQ ID NO: 2477985 - protein, 21 aa, Entamoeba dispar
DVVDPIVLSLMYDYGLNRTKL

SEQ ID NO: 2477986 - protein, 18 aa, Entamoeba dispar
DVVDSCFEYSKVMGDGYI

SEQ ID NO: 2477987 - protein, 19 aa, Entamoeba dispar
DVVEKCGISNIPIVSEQWL

SEQ ID NO: 2477988 - protein, 20 aa, Entamoeba dispar
DVVILWDAIFAFGHQLKLVD

SEQ ID NO: 2477989 - protein, 22 aa, Entamoeba dispar
DVVKPRVGGTLLKNEIMFITSF

SEQ ID NO: 2477990 - protein, 22 aa, Entamoeba dispar
DVVLCKYCDFIYTAVTEDIVFT

SEQ ID NO: 2477991 - protein, 18 aa, Entamoeba dispar
DVVPSLSLSSCKRLIKRM

SEQ ID NO: 2477992 - protein, 21 aa, Entamoeba dispar
DVVQVEGGFTFIIIDYFSLGQ

SEQ ID NO: 2477993 - protein, 22 aa, Entamoeba dispar
DVVSILGFRVNRVVICLNNNVY

SEQ ID NO: 2477994 - protein, 24 aa, Entamoeba dispar
DVVTSVSVNEIWKGITDNINEYTF

SEQ ID NO: 2477995 - protein, 19 aa, Entamoeba dispar
DVYCNLSKILIHSNKEKEP

SEQ ID NO: 2477996 - protein, 27 aa, Entamoeba dispar
DVYFDRWKPIISICNKVGGNLKIDKDE

SEQ ID NO: 2477997 - protein, 25 aa, Entamoeba dispar
DVYFDRWSPIISICNKVGGNLKIDK

SEQ ID NO: 2477998 - protein, 26 aa, Entamoeba dispar
DVYFERWKPIISICNKVGGNLKIDKD

SEQ ID NO: 2477999 - protein, 25 aa, Entamoeba dispar
DVYISFKGSIPFLRKTSPMHLTHDQ

SEQ ID NO: 2478000 - protein, 36 aa, Entamoeba dispar
DVYLASILICLPLLPPHRRVILRIAKNIFIKENIQL

SEQ ID NO: 2478001 - protein, 25 aa, Entamoeba dispar
DVYSCGELLHVMLYGSHPCFSDGIE

SEQ ID NO: 2478002 - protein, 26 aa, Entamoeba dispar
DVYSFAICMLEVWISKDPYNSIKFPD

SEQ ID NO: 2478003 - protein, 24 aa, Entamoeba dispar
DVYYVYNCIDLIFVHLQGSEEVVF

SEQ ID NO: 2478004 - protein, 30 aa, Entamoeba dispar
DWAKLFKPRHLFCGYYIFIEFIVTSSSLEG

SEQ ID NO: 2478005 - protein, 27 aa, Entamoeba dispar
DWCISRQLWWGHRIPAYLIKNKKEKET

SEQ ID NO: 2478006 - protein, 19 aa, Entamoeba dispar
DWCQNKFVRLCIGNQLTEA

SEQ ID NO: 2478007 - protein, 22 aa, Entamoeba dispar
DWENSIHCYYVFEQAIFSIIEL

SEQ ID NO: 2478008 - protein, 19 aa, Entamoeba dispar
DWIDFLFTKFSSVPQLNQQ

SEQ ID NO: 2478009 - protein, 19 aa, Entamoeba dispar
DWIDVEAFVNKRCQDRISF

SEQ ID NO: 2478010 - protein, 17 aa, Entamoeba dispar
DWIRRCSAKMAEDDEDL

SEQ ID NO: 2478011 - protein, 20 aa, Entamoeba dispar
DWKGKKLIHFGAVDYEATVY

SEQ ID NO: 2478012 - protein, 26 aa, Entamoeba dispar
DWSKCMGCGMCAMRCNYGVLHKSGPK

SEQ ID NO: 2478013 - protein, 22 aa, Entamoeba dispar
DWSYSYCLPLFIVSYGNHSEVD

SEQ ID NO: 2478014 - protein, 24 aa, Entamoeba dispar
DWYACKDTVRMVLGGNNLIEPGKP

SEQ ID NO: 2478015 - protein, 28 aa, Entamoeba dispar
DYAKEIKMLKLLSSKVLKNLKNEEEELP

SEQ ID NO: 2478016 - protein, 37 aa, Entamoeba dispar
DYAKSMLRMVQEFRQKRICGQSTLYYGTVKDALETYL

SEQ ID NO: 2478017 - protein, 30 aa, Entamoeba dispar
DYAYSLPRCTVRPEIRIENAEKVQRLTAKR

SEQ ID NO: 2478018 - protein, 22 aa, Entamoeba dispar
DYCFEGCSMLKSINIPTSVREI

SEQ ID NO: 2478019 - protein, 19 aa, Entamoeba dispar
DYCIFALNNICLKYQDYEL

SEQ ID NO: 2478020 - protein, 19 aa, Entamoeba dispar
DYCQTCVQRVFQGKGKKGK

SEQ ID NO: 2478021 - protein, 21 aa, Entamoeba dispar
DYCRPTIRLAALSHYPSIFVF

SEQ ID NO: 2478022 - protein, 21 aa, Entamoeba dispar
DYDKLPWILRCRIQHTKCKYK

SEQ ID NO: 2478023 - protein, 23 aa, Entamoeba dispar
DYDYRLLMLESEVIIIQQPPSTK

SEQ ID NO: 2478024 - protein, 23 aa, Entamoeba dispar
DYDYRLLMLESEVIIVQQPPSTK

SEQ ID NO: 2478025 - protein, 22 aa, Entamoeba dispar
DYEGKVSWLMERSMYEEAFKFL

SEQ ID NO: 2478026 - protein, 26 aa, Entamoeba dispar
DYEIPSGKFNNEWAVTLYNATDKDID

SEQ ID NO: 2478027 - protein, 21 aa, Entamoeba dispar
DYEMIEPFLSPNSIKEFNEIT

SEQ ID NO: 2478028 - protein, 17 aa, Entamoeba dispar
DYHIIRYIIEMSGLDDL

SEQ ID NO: 2478029 - protein, 18 aa, Entamoeba dispar
DYICNVNYSLTYPILKIR

SEQ ID NO: 2478030 - protein, 19 aa, Entamoeba dispar
DYIESFRFGSWPHAGCGIG

SEQ ID NO: 2478031 - protein, 19 aa, Entamoeba dispar
DYILYSISMLFDFKSNPDV

SEQ ID NO: 2478032 - protein, 26 aa, Entamoeba dispar
DYIMNPELFQTCPLHIRNQIYSYTAL

SEQ ID NO: 2478033 - protein, 19 aa, Entamoeba dispar
DYINIPIKWEESSFEGCSK

SEQ ID NO: 2478034 - protein, 25 aa, Entamoeba dispar
DYIRCAKMPLLLAMPQYQINEIQTT

SEQ ID NO: 2478035 - protein, 17 aa, Entamoeba dispar
DYIRTSGGYGITKSYAE

SEQ ID NO: 2478036 - protein, 18 aa, Entamoeba dispar
DYKAIAVLNFIDQEKLLH

SEQ ID NO: 2478037 - protein, 24 aa, Entamoeba dispar
DYKDPKEEIKFFYWQGKHTSIKSK

SEQ ID NO: 2478038 - protein, 21 aa, Entamoeba dispar
DYKGEPIVPIANRKDLKEELK

SEQ ID NO: 2478039 - protein, 26 aa, Entamoeba dispar
DYKITFPFREIIAFSYVQTKTTTTIT

SEQ ID NO: 2478040 - protein, 17 aa, Entamoeba dispar
DYKPGIYTQWESAYNME

SEQ ID NO: 2478041 - protein, 18 aa, Entamoeba dispar
DYKPGIYTQWESAYNMED

SEQ ID NO: 2478042 - protein, 19 aa, Entamoeba dispar
DYLIARRIGMNFGAMVKGK

SEQ ID NO: 2478043 - protein, 34 aa, Entamoeba dispar
DYLIIRSKFLRRRFCTFVIMKLGGLCTVEDMKEL

SEQ ID NO: 2478044 - protein, 24 aa, Entamoeba dispar
DYLNDAMCLPLIELTNRLGTATQN

SEQ ID NO: 2478045 - protein, 17 aa, Entamoeba dispar
DYLRVLLLSNKVNRTTI

SEQ ID NO: 2478046 - protein, 19 aa, Entamoeba dispar
DYLTILQRLLPLGATGQKM

SEQ ID NO: 2478047 - protein, 25 aa, Entamoeba dispar
DYMTKTCKIYRALFSSITKKDITEA

SEQ ID NO: 2478048 - protein, 22 aa, Entamoeba dispar
DYNDLPLASGMIFEDLNYRHWD

SEQ ID NO: 2478049 - protein, 25 aa, Entamoeba dispar
DYNEYIDWWGLGILIYEMLFTQSPF

SEQ ID NO: 2478050 - protein, 24 aa, Entamoeba dispar
DYNFEFNHLASLYFIDKKKEGYFN

SEQ ID NO: 2478051 - protein, 17 aa, Entamoeba dispar
DYNKQWKFFEDSKKWTQ

SEQ ID NO: 2478052 - protein, 23 aa, Entamoeba dispar
DYQKLLDWRAHFPVLNDADYCEL

SEQ ID NO: 2478053 - protein, 38 aa, Entamoeba dispar
DYQSGDRIGLWIKFQLEPSAYATMLFRELLKMPTDLDC

SEQ ID NO: 2478054 - protein, 19 aa, Entamoeba dispar
DYQTCSVLSCVEQQSQDIA

SEQ ID NO: 2478055 - protein, 25 aa, Entamoeba dispar
DYRDWRLVSELVIKTMSYFNHGNIK

SEQ ID NO: 2478056 - protein, 23 aa, Entamoeba dispar
DYRFGPESTFCGKSFKEIFKEKG

SEQ ID NO: 2478057 - protein, 24 aa, Entamoeba dispar
DYRILYWKRILGIEEISQELKEEF

SEQ ID NO: 2478058 - protein, 17 aa, Entamoeba dispar
DYSILECSWVERSKLEG

SEQ ID NO: 2478059 - protein, 18 aa, Entamoeba dispar
DYSKLSVIAFTFELTERY

SEQ ID NO: 2478060 - protein, 20 aa, Entamoeba dispar
DYSTIDGWLLLSIPGIHKGN

SEQ ID NO: 2478061 - protein, 27 aa, Entamoeba dispar
DYTATRVCTYFFNIFLIKEFKEDCELN

SEQ ID NO: 2478062 - protein, 17 aa, Entamoeba dispar
DYTCKFVFFLFKPFYFR

SEQ ID NO: 2478063 - protein, 23 aa, Entamoeba dispar
DYTEPMVQISFMLEKYIVERYFN

SEQ ID NO: 2478064 - protein, 25 aa, Entamoeba dispar
DYTIEFKHIKGLDIGDNIEVVLKWR

SEQ ID NO: 2478065 - protein, 19 aa, Entamoeba dispar
DYTVIPITVTNNFKDINEM

SEQ ID NO: 2478066 - protein, 24 aa, Entamoeba dispar
DYVCLKCYDELQVENKRRNSLSSN

SEQ ID NO: 2478067 - protein, 22 aa, Entamoeba dispar
DYVIKKLALKIAIITEENNGNY

SEQ ID NO: 2478068 - protein, 19 aa, Entamoeba dispar
DYVLPIGGSCCIPLVRKTI

SEQ ID NO: 2478069 - protein, 19 aa, Entamoeba dispar
DYVNGWKRMPAIGEVTEFG

SEQ ID NO: 2478070 - protein, 30 aa, Entamoeba dispar
DYVVIRKIMIPFPICSLKNWDCSCDITLLQ

SEQ ID NO: 2478071 - protein, 17 aa, Entamoeba dispar
DYYAILFVFEKFFKSVI

SEQ ID NO: 2478072 - protein, 23 aa, Entamoeba dispar
DYYFILLRKVHLYAHSVGPNTNF

SEQ ID NO: 2478073 - protein, 17 aa, Entamoeba dispar
DYYLMPIVMDYLQILTL

SEQ ID NO: 2478074 - protein, 25 aa, Entamoeba dispar
DYYNCCGFCLKTLCSKEPKNKYNQI

SEQ ID NO: 2478075 - protein, 33 aa, Entamoeba dispar
DYYRLKPKCCLKEELCIVPLRKQLNWKALNNPQ

SEQ ID NO: 2478076 - protein, 17 aa, Entamoeba dispar
DYYYLKTMVRYSLVTDR

SEQ ID NO: 2478077 - protein, 20 aa, Entamoeba dispar
EAAAFEYRLTGKIENLYWRE

SEQ ID NO: 2478078 - protein, 20 aa, Entamoeba dispar
EAAEAIEFVKIWQKIDVEDA

SEQ ID NO: 2478079 - protein, 26 aa, Entamoeba dispar
EAAFTKLTWLLAQGMTPDEVRNNIKS

SEQ ID NO: 2478080 - protein, 18 aa, Entamoeba dispar
EAAGLPMEMYEDAPDDDP

SEQ ID NO: 2478081 - protein, 20 aa, Entamoeba dispar
EAAIRIAQRVSEDNIKPLCK

SEQ ID NO: 2478082 - protein, 17 aa, Entamoeba dispar
EAAIYIASFLERHVDKF

SEQ ID NO: 2478083 - protein, 22 aa, Entamoeba dispar
EAARKVAIEKVQIMNELTDKIK

SEQ ID NO: 2478084 - protein, 19 aa, Entamoeba dispar
EACECLQGFQVTHSLGGGT

SEQ ID NO: 2478085 - protein, 31 aa, Entamoeba dispar
EADALARIFSTLCSFKPYPIVTANNTIQFTG

SEQ ID NO: 2478086 - protein, 18 aa, Entamoeba dispar
EADALRANARLEALEPLL

SEQ ID NO: 2478087 - protein, 26 aa, Entamoeba dispar
EADISWTNRWGRFIGYSDTASITLSS

SEQ ID NO: 2478088 - protein, 17 aa, Entamoeba dispar
EAEEWQTTFEILQENAE

SEQ ID NO: 2478089 - protein, 17 aa, Entamoeba dispar
EAEKEKRLGEAERLARE

SEQ ID NO: 2478090 - protein, 23 aa, Entamoeba dispar
EAEKKRFGERLIFDQEGNPHIKL

SEQ ID NO: 2478091 - protein, 28 aa, Entamoeba dispar
EAELLSYTGYFMFYRFVGNYIASSSNET

SEQ ID NO: 2478092 - protein, 22 aa, Entamoeba dispar
EAEMKLAPIGVVAKAQMHPHVD

SEQ ID NO: 2478093 - protein, 20 aa, Entamoeba dispar
EAEPWISGGTLIIDTDKSIQ

SEQ ID NO: 2478094 - protein, 25 aa, Entamoeba dispar
EAEQECALICLLIYEGFNMQFSVPR

SEQ ID NO: 2478095 - protein, 20 aa, Entamoeba dispar
EAEQTILHYVCNTFTSDASF

SEQ ID NO: 2478096 - protein, 26 aa, Entamoeba dispar
EAESCFKLASEKGVSSISKYFSQEYN

SEQ ID NO: 2478097 - protein, 32 aa, Entamoeba dispar
EAFDILILARCWLKFSYVYSFYSSEEGKITDL

SEQ ID NO: 2478098 - protein, 18 aa, Entamoeba dispar
EAFFIHHGLFLLVESLKL

SEQ ID NO: 2478099 - protein, 19 aa, Entamoeba dispar
EAFIYKSAIGRTFSVNKKW

SEQ ID NO: 2478100 - protein, 18 aa, Entamoeba dispar
EAFIYTFRCYADQNMVLN

SEQ ID NO: 2478101 - protein, 19 aa, Entamoeba dispar
EAFKYATGCANNLDNYLVY

SEQ ID NO: 2478102 - protein, 18 aa, Entamoeba dispar
EAFNECYDIFLTQDETVS

SEQ ID NO: 2478103 - protein, 19 aa, Entamoeba dispar
EAFNHCPYLTSIVLPSSVK

SEQ ID NO: 2478104 - protein, 18 aa, Entamoeba dispar
EAFNYVRQGIKICKSMKL

SEQ ID NO: 2478105 - protein, 19 aa, Entamoeba dispar
EAFPQYPDILSIGFCSQND

SEQ ID NO: 2478106 - protein, 22 aa, Entamoeba dispar
EAFRQLIYKCLDAWSQTVNDLI

SEQ ID NO: 2478107 - protein, 20 aa, Entamoeba dispar
EAFSQFIPLLNVYKTYVGNT

SEQ ID NO: 2478108 - protein, 19 aa, Entamoeba dispar
EAFTRRLNPRKVDDNAIEE

SEQ ID NO: 2478109 - protein, 22 aa, Entamoeba dispar
EAGHAIASLWSEWFEIPQKAIS

SEQ ID NO: 2478110 - protein, 18 aa, Entamoeba dispar
EAHARIRGSNTIDEIDAQ

SEQ ID NO: 2478111 - protein, 24 aa, Entamoeba dispar
EAHYCSRKQCRVCNKDLMVVNEYL

SEQ ID NO: 2478112 - protein, 18 aa, Entamoeba dispar
EAHYHSALVRDYEVINDI

SEQ ID NO: 2478113 - protein, 20 aa, Entamoeba dispar
EAIACIFTSLIDWAFSPSCI

SEQ ID NO: 2478114 - protein, 23 aa, Entamoeba dispar
EAIEYLVGLIFPLKYSGEIRPYF

SEQ ID NO: 2478115 - protein, 20 aa, Entamoeba dispar
EAIFKRIRMNDYHWPTETSD

SEQ ID NO: 2478116 - protein, 21 aa, Entamoeba dispar
EAIFPNMDIVDAMFYNKNIVL

SEQ ID NO: 2478117 - protein, 24 aa, Entamoeba dispar
EAIGKRLTDSLIILKKRISEKGCK

SEQ ID NO: 2478118 - protein, 17 aa, Entamoeba dispar
EAIHSGVSFGIGINPLT

SEQ ID NO: 2478119 - protein, 23 aa, Entamoeba dispar
EAIKRGEGIFDRMDETERRRKLV

SEQ ID NO: 2478120 - protein, 32 aa, Entamoeba dispar
EAIMKSCSLPFLFKPYCNCISGMIIQPNPSNY

SEQ ID NO: 2478121 - protein, 19 aa, Entamoeba dispar
EAINFGSYNYLGFGGRHPI

SEQ ID NO: 2478122 - protein, 23 aa, Entamoeba dispar
EAIPIKLRIKFMIDAANGIQYLH

SEQ ID NO: 2478123 - protein, 18 aa, Entamoeba dispar
EAIPNFKSVQNFLVGSSI

SEQ ID NO: 2478124 - protein, 21 aa, Entamoeba dispar
EAIQRLIALRIQQGNNEEAIS

SEQ ID NO: 2478125 - protein, 23 aa, Entamoeba dispar
EAIRLGKEAAVFVTTKFPRPINL

SEQ ID NO: 2478126 - protein, 26 aa, Entamoeba dispar
EAISNKPSLWCCFYYSTNKISGSPIP

SEQ ID NO: 2478127 - protein, 20 aa, Entamoeba dispar
EAKEFKIKFDEFSKLVSCQN

SEQ ID NO: 2478128 - protein, 19 aa, Entamoeba dispar
EAKELFKEIILSSTADDIT

SEQ ID NO: 2478129 - protein, 30 aa, Entamoeba dispar
EAKESIYITDWRIDPEIILIRRGTHRLKGK

SEQ ID NO: 2478130 - protein, 18 aa, Entamoeba dispar
EAKGCIQISPSTIIKERE

SEQ ID NO: 2478131 - protein, 32 aa, Entamoeba dispar
EAKGININKGLIVEGFFGYLKKIINHSNLPLY

SEQ ID NO: 2478132 - protein, 20 aa, Entamoeba dispar
EAKINYMIMSMTTRGPNKHI

SEQ ID NO: 2478133 - protein, 24 aa, Entamoeba dispar
EAKKIAECCICFTGNFMSPDEHIY

SEQ ID NO: 2478134 - protein, 26 aa, Entamoeba dispar
EAKKKWLINRNPSLPLPKPNDIENIR

SEQ ID NO: 2478135 - protein, 25 aa, Entamoeba dispar
EAKKVEILLPFDFVACDKFGEDANT

SEQ ID NO: 2478136 - protein, 23 aa, Entamoeba dispar
EAKLMVFRGYSRGFAFVEYETEE

SEQ ID NO: 2478137 - protein, 27 aa, Entamoeba dispar
EAKRNAKMVFSSDVLKQKLGERALPGD

SEQ ID NO: 2478138 - protein, 20 aa, Entamoeba dispar
EALCVFRIAQAVLLCCDGQV

SEQ ID NO: 2478139 - protein, 18 aa, Entamoeba dispar
EALEFARRHSLIYTETSA

SEQ ID NO: 2478140 - protein, 21 aa, Entamoeba dispar
EALETWPVPMFENLLPRHLQI

SEQ ID NO: 2478141 - protein, 24 aa, Entamoeba dispar
EALFKHASEFISIFENVLSVQVLS

SEQ ID NO: 2478142 - protein, 31 aa, Entamoeba dispar
EALFSLDDTEYWLKEQAVISLNRLMKTHRVD

SEQ ID NO: 2478143 - protein, 20 aa, Entamoeba dispar
EALILWDYYFAKGCFNVVYI

SEQ ID NO: 2478144 - protein, 20 aa, Entamoeba dispar
EALKRLDVINTQILEQQTLA

SEQ ID NO: 2478145 - protein, 22 aa, Entamoeba dispar
EALNCCSSCNVSEAIEEWDVEL

SEQ ID NO: 2478146 - protein, 29 aa, Entamoeba dispar
EALQEAVILPIKFPQLFTDKRKPWTGILL

SEQ ID NO: 2478147 - protein, 17 aa, Entamoeba dispar
EALRTKEIVNVIVKSIN

SEQ ID NO: 2478148 - protein, 19 aa, Entamoeba dispar
EALTKAKSVVEAKNKDNEN

SEQ ID NO: 2478149 - protein, 22 aa, Entamoeba dispar
EALVRKECFLFIFYSVQQHYIP

SEQ ID NO: 2478150 - protein, 20 aa, Entamoeba dispar
EAMKFLLARYYAGRMIQPSY

SEQ ID NO: 2478151 - protein, 20 aa, Entamoeba dispar
EAMNSAFKKLQVEYTTTGSE

SEQ ID NO: 2478152 - protein, 26 aa, Entamoeba dispar
EAMRFLQDILNEFGYFVEVEIETIDG

SEQ ID NO: 2478153 - protein, 28 aa, Entamoeba dispar
EAMRMRVDWFFKECIFKRVNISGKEALI

SEQ ID NO: 2478154 - protein, 18 aa, Entamoeba dispar
EAMSCYTKAAGFFCNGEE

SEQ ID NO: 2478155 - protein, 21 aa, Entamoeba dispar
EANCYYVDLFVRKSNETAIGM

SEQ ID NO: 2478156 - protein, 19 aa, Entamoeba dispar
EANDLAIPFLHGAFTAETG

SEQ ID NO: 2478157 - protein, 51 aa, Entamoeba dispar
EANECMRCGTPFTLFFRKHHCRNCGYIICANCRTRCKVPKLGRVDYVCLKC

SEQ ID NO: 2478158 - protein, 24 aa, Entamoeba dispar
EANELWKKYFFEQQIYKIKEMENV

SEQ ID NO: 2478159 - protein, 23 aa, Entamoeba dispar
EANHFSEYLLLKEVKIPTTVTSL

SEQ ID NO: 2478160 - protein, 19 aa, Entamoeba dispar
EANMGILFFEYNKVFFELM

SEQ ID NO: 2478161 - protein, 23 aa, Entamoeba dispar
EANPFLVIVLLKYFFLSLPQSFF

SEQ ID NO: 2478162 - protein, 19 aa, Entamoeba dispar
EANYTCIIFIGERKKRIKF

SEQ ID NO: 2478163 - protein, 19 aa, Entamoeba dispar
EAPFNLRIDEQRVVGLYCL

SEQ ID NO: 2478164 - protein, 20 aa, Entamoeba dispar
EAPKLLVLQLNRFIYDRVKL

SEQ ID NO: 2478165 - protein, 20 aa, Entamoeba dispar
EAPVEIFKPEMKQFHENCQI

SEQ ID NO: 2478166 - protein, 18 aa, Entamoeba dispar
EAQFKRVVKRGRQVELET

SEQ ID NO: 2478167 - protein, 23 aa, Entamoeba dispar
EAQRWWVRDQKPSVEFNVGFIET

SEQ ID NO: 2478168 - protein, 17 aa, Entamoeba dispar
EARCKQYECGECDRHGF

SEQ ID NO: 2478169 - protein, 19 aa, Entamoeba dispar
EARNQYLMLKKQCSERHII

SEQ ID NO: 2478170 - protein, 31 aa, Entamoeba dispar
EARRCLYCAEPNCMRCCPTQLDAKRMVHAAG

SEQ ID NO: 2478171 - protein, 24 aa, Entamoeba dispar
EARTNICPHLSLAKITSILENLIV

SEQ ID NO: 2478172 - protein, 23 aa, Entamoeba dispar
EARVVAVEGFGRIIANQPLSCKS

SEQ ID NO: 2478173 - protein, 21 aa, Entamoeba dispar
EARYISQMELGLFKYKQPMEK

SEQ ID NO: 2478174 - protein, 20 aa, Entamoeba dispar
EASFHCLSLIKVKIEDDIIT

SEQ ID NO: 2478175 - protein, 21 aa, Entamoeba dispar
EASQCSLPIIASGGIRNGFDI

SEQ ID NO: 2478176 - protein, 23 aa, Entamoeba dispar
EASRLSWREFFAHQFVYRAMQHH

SEQ ID NO: 2478177 - protein, 21 aa, Entamoeba dispar
EATELLVKAVNAISGLKEEKD

SEQ ID NO: 2478178 - protein, 18 aa, Entamoeba dispar
EATIKIIMELGRSELLNT

SEQ ID NO: 2478179 - protein, 20 aa, Entamoeba dispar
EATIYWLQRLIEMGENPKYI

SEQ ID NO: 2478180 - protein, 27 aa, Entamoeba dispar
EATLRYQVIFKFLFDIEYHRYLLSRAF

SEQ ID NO: 2478181 - protein, 20 aa, Entamoeba dispar
EAVIRILIRHGADVNAQTIN

SEQ ID NO: 2478182 - protein, 17 aa, Entamoeba dispar
EAVKFLTFTYYFRRLLK

SEQ ID NO: 2478183 - protein, 19 aa, Entamoeba dispar
EAVNRGCSSHERVGEVEMN

SEQ ID NO: 2478184 - protein, 19 aa, Entamoeba dispar
EAVRMCIVKSIKITLTGYV

SEQ ID NO: 2478185 - protein, 17 aa, Entamoeba dispar
EAVVPIILQSFDKNNLI

SEQ ID NO: 2478186 - protein, 23 aa, Entamoeba dispar
EAVWKIKVEDLLAFVLVDDKGND

SEQ ID NO: 2478187 - protein, 23 aa, Entamoeba dispar
EAYKEINLQGAVIMTTVFYEKEN

SEQ ID NO: 2478188 - protein, 20 aa, Entamoeba dispar
ECAIKEGICAKCREKKQIVN

SEQ ID NO: 2478189 - protein, 21 aa, Entamoeba dispar
ECCTVCKCYYTQHANSSYRFD

SEQ ID NO: 2478190 - protein, 20 aa, Entamoeba dispar
ECDIYSFGMMLYEVISQREL

SEQ ID NO: 2478191 - protein, 17 aa, Entamoeba dispar
ECDQCLIGKSVLSYDEL

SEQ ID NO: 2478192 - protein, 23 aa, Entamoeba dispar
ECEFRNLLCSTIHLNHNKEASSI

SEQ ID NO: 2478193 - protein, 19 aa, Entamoeba dispar
ECENEIQIGVGVNQKNNAI

SEQ ID NO: 2478194 - protein, 19 aa, Entamoeba dispar
ECFCECSSLTSVSVDNLQF

SEQ ID NO: 2478195 - protein, 17 aa, Entamoeba dispar
ECFDRHWSLTSINIENL

SEQ ID NO: 2478196 - protein, 19 aa, Entamoeba dispar
ECFEACFSLSDVIIENLHF

SEQ ID NO: 2478197 - protein, 18 aa, Entamoeba dispar
ECFEGCVSLKYMNIEKVK

SEQ ID NO: 2478198 - protein, 19 aa, Entamoeba dispar
ECFYECGIRSISIPITISR

SEQ ID NO: 2478199 - protein, 18 aa, Entamoeba dispar
ECFYGCKSLTTINIPSSV

SEQ ID NO: 2478200 - protein, 19 aa, Entamoeba dispar
ECFYGCPSLTLINKIGDEC

SEQ ID NO: 2478201 - protein, 18 aa, Entamoeba dispar
ECFYGCSSITTINIPTNV

SEQ ID NO: 2478202 - protein, 18 aa, Entamoeba dispar
ECFYGCSSLQTINIPTSI

SEQ ID NO: 2478203 - protein, 18 aa, Entamoeba dispar
ECFYKCPPLTTINIPSSI

SEQ ID NO: 2478204 - protein, 18 aa, Entamoeba dispar
ECFYNCRLLTTINIPSSI

SEQ ID NO: 2478205 - protein, 17 aa, Entamoeba dispar
ECFYNCYELASINIPTT

SEQ ID NO: 2478206 - protein, 20 aa, Entamoeba dispar
ECGFNPYLVELLKTLFESFP

SEQ ID NO: 2478207 - protein, 21 aa, Entamoeba dispar
ECGPLDALVRPLALAPCTSDT

SEQ ID NO: 2478208 - protein, 20 aa, Entamoeba dispar
ECGTALILFKANDQSKETQA

SEQ ID NO: 2478209 - protein, 23 aa, Entamoeba dispar
ECGTPNPSWASVPYGIFICIQCS

SEQ ID NO: 2478210 - protein, 22 aa, Entamoeba dispar
ECHQILELYASVYEDLLAVPVI

SEQ ID NO: 2478211 - protein, 20 aa, Entamoeba dispar
ECIEFPMYFVDSLPDEGSDN

SEQ ID NO: 2478212 - protein, 18 aa, Entamoeba dispar
ECIRRCERISRYLDENGI

SEQ ID NO: 2478213 - protein, 17 aa, Entamoeba dispar
ECISEQALTLFLNCISN

SEQ ID NO: 2478214 - protein, 23 aa, Entamoeba dispar
ECISLKGICDYLINFITGNKSKG

SEQ ID NO: 2478215 - protein, 24 aa, Entamoeba dispar
ECISLKGICDYLINFITGNKSKGP

SEQ ID NO: 2478216 - protein, 20 aa, Entamoeba dispar
ECKCYLCLNKEKVIGKKRVA

SEQ ID NO: 2478217 - protein, 18 aa, Entamoeba dispar
ECKDIIILLSQFIGVSGK

SEQ ID NO: 2478218 - protein, 28 aa, Entamoeba dispar
ECKLNELIELVQLFPNCEIISQTTLLSP

SEQ ID NO: 2478219 - protein, 21 aa, Entamoeba dispar
ECKRKSCSKFAKCEFCNNEEC

SEQ ID NO: 2478220 - protein, 21 aa, Entamoeba dispar
ECKVKRIETFVGGKMDHSTFA

SEQ ID NO: 2478221 - protein, 24 aa, Entamoeba dispar
ECKVQREMGELITIEEYLTKFELS

SEQ ID NO: 2478222 - protein, 25 aa, Entamoeba dispar
ECLEHFDELCEVLKYIGKKKYATKQ

SEQ ID NO: 2478223 - protein, 20 aa, Entamoeba dispar
ECLLNKLWFNKLLDIDIKNT

SEQ ID NO: 2478224 - protein, 21 aa, Entamoeba dispar
ECLNSPNIIWFFKFSLQTICP

SEQ ID NO: 2478225 - protein, 26 aa, Entamoeba dispar
ECLSSFLRFLSSFTRGLPKEYNEFTN

SEQ ID NO: 2478226 - protein, 17 aa, Entamoeba dispar
ECLVWKYSYETAALELR

SEQ ID NO: 2478227 - protein, 24 aa, Entamoeba dispar
ECMTFPFFCLLKIKTTEHNGVSYT

SEQ ID NO: 2478228 - protein, 19 aa, Entamoeba dispar
ECNELKNSLKELQNKIEEI

SEQ ID NO: 2478229 - protein, 25 aa, Entamoeba dispar
ECNNKEFIEFIPLLIEGAGNLYNKS

SEQ ID NO: 2478230 - protein, 21 aa, Entamoeba dispar
ECPEGYRVINNIGEYAGQTVK

SEQ ID NO: 2478231 - protein, 21 aa, Entamoeba dispar
ECPELIDLYSTSAWQDCFITI

SEQ ID NO: 2478232 - protein, 21 aa, Entamoeba dispar
ECPELIDLYSTSAWQDCFITT

SEQ ID NO: 2478233 - protein, 20 aa, Entamoeba dispar
ECPQCHKHMKYYCYNCRKQL

SEQ ID NO: 2478234 - protein, 19 aa, Entamoeba dispar
ECQICKKVSPLIYHEPSDE

SEQ ID NO: 2478235 - protein, 26 aa, Entamoeba dispar
ECQSTELFNGPSIFLFIFDENKNAFG

SEQ ID NO: 2478236 - protein, 23 aa, Entamoeba dispar
ECRQWIYQQIQSINFLKQTQDIQ

SEQ ID NO: 2478237 - protein, 18 aa, Entamoeba dispar
ECRSHLSALPPSEQSMNL

SEQ ID NO: 2478238 - protein, 21 aa, Entamoeba dispar
ECSIKGNILLAEEEYKKFFIK

SEQ ID NO: 2478239 - protein, 23 aa, Entamoeba dispar
ECSIKNHVLFILVYDYCFRHLQE

SEQ ID NO: 2478240 - protein, 23 aa, Entamoeba dispar
ECSYLFNRINAVIQRSSLLTTKF

SEQ ID NO: 2478241 - protein, 18 aa, Entamoeba dispar
ECVDMFRANHKNERIRSE

SEQ ID NO: 2478242 - protein, 28 aa, Entamoeba dispar
ECVKEDFKVMIPFLMKFKTTKTEVIKTA

SEQ ID NO: 2478243 - protein, 20 aa, Entamoeba dispar
ECVSILLLDLHKFIQKKTTI

SEQ ID NO: 2478244 - protein, 21 aa, Entamoeba dispar
ECVSVAFNIIQYVFYSPETKS

SEQ ID NO: 2478245 - protein, 24 aa, Entamoeba dispar
ECYKHLCLTLGTPQQFISNKARWK

SEQ ID NO: 2478246 - protein, 17 aa, Entamoeba dispar
ECYTLKAPIKIVSEQKR

SEQ ID NO: 2478247 - protein, 27 aa, Entamoeba dispar
EDADPAQCWAEGPGVEGGCKTCDMAEF

SEQ ID NO: 2478248 - protein, 24 aa, Entamoeba dispar
EDAIKYVCSPPMKTEESRQALWNA

SEQ ID NO: 2478249 - protein, 18 aa, Entamoeba dispar
EDARRWLGEHSKKTNKEG

SEQ ID NO: 2478250 - protein, 26 aa, Entamoeba dispar
EDCEKENPQMIALRVRKRGKISSQMM

SEQ ID NO: 2478251 - protein, 24 aa, Entamoeba dispar
EDCSCRLLRLGFFLFDCTNALRYF

SEQ ID NO: 2478252 - protein, 25 aa, Entamoeba dispar
EDDARRLLIRRAYDIAGCNPGKRIW

SEQ ID NO: 2478253 - protein, 30 aa, Entamoeba dispar
EDDEMKAFLSWKFVRLERLVLSWLDIMATM

SEQ ID NO: 2478254 - protein, 25 aa, Entamoeba dispar
EDDFPEFPGKLIVHSEEGLAERRYD

SEQ ID NO: 2478255 - protein, 24 aa, Entamoeba dispar
EDDIMKWTCVIFGPDDTIWESGIF

SEQ ID NO: 2478256 - protein, 24 aa, Entamoeba dispar
EDDRKSLFISIALAIKLALNTKVS

SEQ ID NO: 2478257 - protein, 17 aa, Entamoeba dispar
EDDSCYPLFAIVDPCHS

SEQ ID NO: 2478258 - protein, 18 aa, Entamoeba dispar
EDDWDAWNKFTVEHGNFQ

SEQ ID NO: 2478259 - protein, 22 aa, Entamoeba dispar
EDEGIKLFALHISAQLAQHGSQ

SEQ ID NO: 2478260 - protein, 26 aa, Entamoeba dispar
EDEGMIFRNGERFFYGKNVDDDEPIE

SEQ ID NO: 2478261 - protein, 25 aa, Entamoeba dispar
EDEIIKWLAENDIELAIEIGINPIQ

SEQ ID NO: 2478262 - protein, 25 aa, Entamoeba dispar
EDEIQCLIFEKGIFAVGGREGKVFI

SEQ ID NO: 2478263 - protein, 36 aa, Entamoeba dispar
EDEKAKAFAIAVEWYRALRSICWSSIQSPRPSLTPE

SEQ ID NO: 2478264 - protein, 23 aa, Entamoeba dispar
EDEKICRMYGFFNECSRFKDYQN

SEQ ID NO: 2478265 - protein, 17 aa, Entamoeba dispar
EDELVNWLGEGLEEEDK

SEQ ID NO: 2478266 - protein, 28 aa, Entamoeba dispar
EDEMKEICSMYSNLERRQRELAEKFEKV

SEQ ID NO: 2478267 - protein, 25 aa, Entamoeba dispar
EDEPIREFNILKSFLDKYVVFLHKH

SEQ ID NO: 2478268 - protein, 23 aa, Entamoeba dispar
EDFKKICLPLFTQAVDELKRVID

SEQ ID NO: 2478269 - protein, 19 aa, Entamoeba dispar
EDFSRSPFVLEIREIAKIQ

SEQ ID NO: 2478270 - protein, 17 aa, Entamoeba dispar
EDFTKNTRFCLICNYIS

SEQ ID NO: 2478271 - protein, 22 aa, Entamoeba dispar
EDGCLVSILSNGFWDTVVLHIK

SEQ ID NO: 2478272 - protein, 18 aa, Entamoeba dispar
EDGDFCFTEILYGQFRRE

SEQ ID NO: 2478273 - protein, 27 aa, Entamoeba dispar
EDGEGYSDFFLSDWFSSKEFQNFEGQI

SEQ ID NO: 2478274 - protein, 26 aa, Entamoeba dispar
EDGELFCIDCFIEGRSMSYHFNLKDI

SEQ ID NO: 2478275 - protein, 26 aa, Entamoeba dispar
EDGELWVSGWCILSFQNKATNKSYCV

SEQ ID NO: 2478276 - protein, 25 aa, Entamoeba dispar
EDGFGELQGGWAFSVPQSMCRRIMS

SEQ ID NO: 2478277 - protein, 17 aa, Entamoeba dispar
EDGKLIFQEGILVEAVR

SEQ ID NO: 2478278 - protein, 25 aa, Entamoeba dispar
EDHEWKDRVEVCVHSFSRLKPTSLN

SEQ ID NO: 2478279 - protein, 26 aa, Entamoeba dispar
EDHFIKIPVGYGCPKHISIGSTSIKI

SEQ ID NO: 2478280 - protein, 18 aa, Entamoeba dispar
EDHLRIVNKTIRSDKKDL

SEQ ID NO: 2478281 - protein, 30 aa, Entamoeba dispar
EDIAKIAMKYCNGRFGTFSQLYEIPEDIDI

SEQ ID NO: 2478282 - protein, 17 aa, Entamoeba dispar
EDIEFPMFFVDLQSDEG

SEQ ID NO: 2478283 - protein, 24 aa, Entamoeba dispar
EDIEFPMYFVDSVPFEGSNNSRTE

SEQ ID NO: 2478284 - protein, 26 aa, Entamoeba dispar
EDIEKRYECITTFFQLLIKLIQKKNF

SEQ ID NO: 2478285 - protein, 20 aa, Entamoeba dispar
EDIIFIKEYIDYNADGEKYL

SEQ ID NO: 2478286 - protein, 18 aa, Entamoeba dispar
EDIIKSFMIIGAPVSNNF

SEQ ID NO: 2478287 - protein, 26 aa, Entamoeba dispar
EDIIPESFIKFVIKRGLIEAFIRRKG

SEQ ID NO: 2478288 - protein, 17 aa, Entamoeba dispar
EDIKGKVVITLKDKKYE

SEQ ID NO: 2478289 - protein, 17 aa, Entamoeba dispar
EDIKRIYEALEIISNVL

SEQ ID NO: 2478290 - protein, 30 aa, Entamoeba dispar
EDILKQRDGVLFYKKFKSIEHSSQVDSDFK

SEQ ID NO: 2478291 - protein, 20 aa, Entamoeba dispar
EDIMIPTVCHSPVMMFLYDS

SEQ ID NO: 2478292 - protein, 18 aa, Entamoeba dispar
EDIPHNFIISSHKTLTNK

SEQ ID NO: 2478293 - protein, 19 aa, Entamoeba dispar
EDIPILIHLLKQFNEENIE

SEQ ID NO: 2478294 - protein, 19 aa, Entamoeba dispar
EDIQFILGFIENILNEKES

SEQ ID NO: 2478295 - protein, 18 aa, Entamoeba dispar
EDIQRIEILTGKTAGEVI

SEQ ID NO: 2478296 - protein, 21 aa, Entamoeba dispar
EDISIPMGYFSRVFLDNDTDF

SEQ ID NO: 2478297 - protein, 29 aa, Entamoeba dispar
EDIVDVTLCKYCDFIYIAITEDEKYKRHI

SEQ ID NO: 2478298 - protein, 18 aa, Entamoeba dispar
EDIVKALTLSGGNISKEL

SEQ ID NO: 2478299 - protein, 19 aa, Entamoeba dispar
EDIYTVGIMPCIAKKVESQ

SEQ ID NO: 2478300 - protein, 19 aa, Entamoeba dispar
EDKDIFGIHYKIPKVNVES

SEQ ID NO: 2478301 - protein, 27 aa, Entamoeba dispar
EDKEHIIFAFNFFKGIGLVELAKPLQQ

SEQ ID NO: 2478302 - protein, 18 aa, Entamoeba dispar
EDKFLYLVFEFCDEDLYQ

SEQ ID NO: 2478303 - protein, 20 aa, Entamoeba dispar
EDKNALKLASSLISNNLKTS

SEQ ID NO: 2478304 - protein, 30 aa, Entamoeba dispar
EDKPIFIDLSWRLDIVLSYKNVYKLIQPQF

SEQ ID NO: 2478305 - protein, 18 aa, Entamoeba dispar
EDKTWGEIITRLRHLKTT

SEQ ID NO: 2478306 - protein, 29 aa, Entamoeba dispar
EDKVFSWFSLTVIDHWVCMKPQQIPLEQM

SEQ ID NO: 2478307 - protein, 22 aa, Entamoeba dispar
EDKYLIHIGNYFDREKHQATER

SEQ ID NO: 2478308 - protein, 19 aa, Entamoeba dispar
EDLDILFSAVEYFKFSPIE

SEQ ID NO: 2478309 - protein, 18 aa, Entamoeba dispar
EDLIRIYIIHLMISGITD

SEQ ID NO: 2478310 - protein, 23 aa, Entamoeba dispar
EDLKEIFKEFNVINAKVVTYNHR

SEQ ID NO: 2478311 - protein, 20 aa, Entamoeba dispar
EDLKRGYYMYTYKIPDTQVE

SEQ ID NO: 2478312 - protein, 17 aa, Entamoeba dispar
EDLLFRALLNGGRLEDI

SEQ ID NO: 2478313 - protein, 19 aa, Entamoeba dispar
EDLLFRALLNGGRLEDILN

SEQ ID NO: 2478314 - protein, 17 aa, Entamoeba dispar
EDLLFRVHVKLLLGDSV

SEQ ID NO: 2478315 - protein, 18 aa, Entamoeba dispar
EDLLIKIAEEATCPTTIT

SEQ ID NO: 2478316 - protein, 26 aa, Entamoeba dispar
EDLLRYESRLEKICYTDLYESDNLAK

SEQ ID NO: 2478317 - protein, 17 aa, Entamoeba dispar
EDLMSLRCTCNRFKKLI

SEQ ID NO: 2478318 - protein, 19 aa, Entamoeba dispar
EDLNKIILINQFKEEINIR

SEQ ID NO: 2478319 - protein, 23 aa, Entamoeba dispar
EDLSRLLFNSCIWTETHNYEPTK

SEQ ID NO: 2478320 - protein, 23 aa, Entamoeba dispar
EDLSRVMLFPNISTFGIQIKGIK

SEQ ID NO: 2478321 - protein, 25 aa, Entamoeba dispar
EDLSSCLWTCRKLRSFILSDDLIWQ

SEQ ID NO: 2478322 - protein, 22 aa, Entamoeba dispar
EDMKELLPFAIKKLTNDEEPMP

SEQ ID NO: 2478323 - protein, 23 aa, Entamoeba dispar
EDMKIELNDVWNLDIILTTGNAK

SEQ ID NO: 2478324 - protein, 22 aa, Entamoeba dispar
EDMKTGVSLILLVEKLTNKHCS

SEQ ID NO: 2478325 - protein, 18 aa, Entamoeba dispar
EDMTTIALSVEYIDGEEH

SEQ ID NO: 2478326 - protein, 19 aa, Entamoeba dispar
EDPELAMNYVLQNLQIGED

SEQ ID NO: 2478327 - protein, 22 aa, Entamoeba dispar
EDPLCIKNAIIVLNYFSSYGKI

SEQ ID NO: 2478328 - protein, 19 aa, Entamoeba dispar
EDPLHRIIDELGDVEQYNS

SEQ ID NO: 2478329 - protein, 20 aa, Entamoeba dispar
  misc_feature (16)..(17): Xaa can be any naturally occurring amino acid
EDPMAVLIAKIKAGGXXNKF

SEQ ID NO: 2478330 - protein, 17 aa, Entamoeba dispar
EDPRYTSIVSVGNQVFL

SEQ ID NO: 2478331 - protein, 24 aa, Entamoeba dispar
EDPSCKISVLLQVYIGRLTLPGFV

SEQ ID NO: 2478332 - protein, 22 aa, Entamoeba dispar
EDPSLIKIKAMIDTNTKLVEQL

SEQ ID NO: 2478333 - protein, 21 aa, Entamoeba dispar
EDPVMKRARERQERLKQIQAA

SEQ ID NO: 2478334 - protein, 25 aa, Entamoeba dispar
EDQHVSRIIVIFNMVYPEDLIDQQR

SEQ ID NO: 2478335 - protein, 24 aa, Entamoeba dispar
EDQKSIPGWGNWVGEGIQKKTKKN

SEQ ID NO: 2478336 - protein, 31 aa, Entamoeba dispar
EDQLIDFNLQWYITCSFDRYICTPTEDEDNE

SEQ ID NO: 2478337 - protein, 17 aa, Entamoeba dispar
EDQYGFCEYYFKAKYSD

SEQ ID NO: 2478338 - protein, 24 aa, Entamoeba dispar
EDQYHCTCCLCKRVVLLRNGLKKI

SEQ ID NO: 2478339 - protein, 21 aa, Entamoeba dispar
EDRIKRIEGICDRKEEIIRRN

SEQ ID NO: 2478340 - protein, 24 aa, Entamoeba dispar
EDRIKRIEGVYDRKEELVRRNEIV

SEQ ID NO: 2478341 - protein, 22 aa, Entamoeba dispar
EDRIRFPWYVAGGVYNEKSATG

SEQ ID NO: 2478342 - protein, 21 aa, Entamoeba dispar
EDRYLPMNMLFSGKNHLPNLP

SEQ ID NO: 2478343 - protein, 24 aa, Entamoeba dispar
EDSEAYLYLLHHLNNSCSLEALNS

SEQ ID NO: 2478344 - protein, 28 aa, Entamoeba dispar
EDSICIWNSRFRKSYIWEPMKVYEMKEN

SEQ ID NO: 2478345 - protein, 26 aa, Entamoeba dispar
EDSIGELFLNFSPFFIVYRNFLINHN

SEQ ID NO: 2478346 - protein, 21 aa, Entamoeba dispar
EDSLEMKECLNYVVERIVDAT

SEQ ID NO: 2478347 - protein, 24 aa, Entamoeba dispar
EDSYINFSPFWKKKDGTKIPEGTK

SEQ ID NO: 2478348 - protein, 19 aa, Entamoeba dispar
EDTCQFLLIYNGLKESRNL

SEQ ID NO: 2478349 - protein, 22 aa, Entamoeba dispar
EDTEVRFPLTLIEIHTNGMIIG

SEQ ID NO: 2478350 - protein, 25 aa, Entamoeba dispar
EDTLEMKLYRLSETVMPSLNYGSMA

SEQ ID NO: 2478351 - protein, 24 aa, Entamoeba dispar
EDTLPCLRYLFDPDPPKYHIPLNT

SEQ ID NO: 2478352 - protein, 18 aa, Entamoeba dispar
EDVIKAVMSATCHKESII

SEQ ID NO: 2478353 - protein, 20 aa, Entamoeba dispar
EDVILKYGWCHSELEMLVNE

SEQ ID NO: 2478354 - protein, 22 aa, Entamoeba dispar
EDVKARCDLVNWIYAITERYKL

SEQ ID NO: 2478355 - protein, 23 aa, Entamoeba dispar
EDVKGSFKLSVRRERSKTAVIRL

SEQ ID NO: 2478356 - protein, 18 aa, Entamoeba dispar
EDVKRVGMKEVIEAINKK

SEQ ID NO: 2478357 - protein, 25 aa, Entamoeba dispar
EDVLSTVCSMTWREFSLKTKDWTMG

SEQ ID NO: 2478358 - protein, 18 aa, Entamoeba dispar
EDVPKLQAVITLAHNVNC

SEQ ID NO: 2478359 - protein, 22 aa, Entamoeba dispar
EDVVEIWDAIFAYGENLKLVDG

SEQ ID NO: 2478360 - protein, 20 aa, Entamoeba dispar
EDVVKCLHKFMPKNQRILSL

SEQ ID NO: 2478361 - protein, 17 aa, Entamoeba dispar
EDVYKFMKYFKEKYIIP

SEQ ID NO: 2478362 - protein, 19 aa, Entamoeba dispar
EDWIHLTLEVGKWSLETMK

SEQ ID NO: 2478363 - protein, 17 aa, Entamoeba dispar
EDWKWLNEKVVSTLQQE

SEQ ID NO: 2478364 - protein, 24 aa, Entamoeba dispar
EDYAKYFAEAHLELYSSDDVLFMI

SEQ ID NO: 2478365 - protein, 24 aa, Entamoeba dispar
EDYFPNRRSHIIELIHEILKTNYF

SEQ ID NO: 2478366 - protein, 17 aa, Entamoeba dispar
EDYLEEILEEFNEKVEI

SEQ ID NO: 2478367 - protein, 19 aa, Entamoeba dispar
EDYTNAGIHTMTFIDFIEQ

SEQ ID NO: 2478368 - protein, 20 aa, Entamoeba dispar
EDYWRVVGANVKGVEKEFEE

SEQ ID NO: 2478369 - protein, 17 aa, Entamoeba dispar
EEAEKRYGFSLYQGGVV

SEQ ID NO: 2478370 - protein, 21 aa, Entamoeba dispar
EEAFKFLKNLCMNKRDKDIGE

SEQ ID NO: 2478371 - protein, 18 aa, Entamoeba dispar
EEAIKCILKLCVEDIYLI

SEQ ID NO: 2478372 - protein, 20 aa, Entamoeba dispar
EEAKIAWILQRKGLGDFVIY

SEQ ID NO: 2478373 - protein, 25 aa, Entamoeba dispar
EEAKRFASLCFEASILSQKVGDYTK

SEQ ID NO: 2478374 - protein, 25 aa, Entamoeba dispar
EEALKGNQIFDCFTCKFDDIISSLD

SEQ ID NO: 2478375 - protein, 17 aa, Entamoeba dispar
EEALKKGASIVVATPGR

SEQ ID NO: 2478376 - protein, 25 aa, Entamoeba dispar
EEARAKETWKVRALEAENASTKANE

SEQ ID NO: 2478377 - protein, 20 aa, Entamoeba dispar
EEASKCVFCKKAVKQKDSFQ

SEQ ID NO: 2478378 - protein, 25 aa, Entamoeba dispar
EEASNRLKKQFGFELKEIKSGNSGK

SEQ ID NO: 2478379 - protein, 25 aa, Entamoeba dispar
EEAVKCLKVNPCFINDNSFKWFLNH

SEQ ID NO: 2478380 - protein, 20 aa, Entamoeba dispar
EEAVSVVLTLLDLVKKALSQ

SEQ ID NO: 2478381 - protein, 18 aa, Entamoeba dispar
EEAWKVISSQADIINEFY

SEQ ID NO: 2478382 - protein, 18 aa, Entamoeba dispar
EEAYEVYTKFDLQEEAMD

SEQ ID NO: 2478383 - protein, 18 aa, Entamoeba dispar
EEAYKEFMEHSSDYEDEE

SEQ ID NO: 2478384 - protein, 19 aa, Entamoeba dispar
EECKECFNKIINNCITKQK

SEQ ID NO: 2478385 - protein, 23 aa, Entamoeba dispar
EECRAETVGLFLTYNPIVKEILK

SEQ ID NO: 2478386 - protein, 25 aa, Entamoeba dispar
EECSSEWYVELFVDYVRNGKMPLVI

SEQ ID NO: 2478387 - protein, 34 aa, Entamoeba dispar
EEDDILSWLGNSDFGFACYKPGKDESFFRKLSLV

SEQ ID NO: 2478388 - protein, 24 aa, Entamoeba dispar
EEDIKLAFKFGCHAVDQLLNKGTF

SEQ ID NO: 2478389 - protein, 24 aa, Entamoeba dispar
EEDKKWDIAGCVLRVYELLSQVYQ

SEQ ID NO: 2478390 - protein, 24 aa, Entamoeba dispar
EEDMKCLFCNLEELLDGANQLTKQ

SEQ ID NO: 2478391 - protein, 26 aa, Entamoeba dispar
EEDQKSIPGWGNWVGEGIQKKTKKNK

SEQ ID NO: 2478392 - protein, 27 aa, Entamoeba dispar
EEDQKSIPGWGNWVGEGIQKKTKKNKE

SEQ ID NO: 2478393 - protein, 30 aa, Entamoeba dispar
EEDRFGRFCLWFSYVCDFLMIYENYIYNLP

SEQ ID NO: 2478394 - protein, 18 aa, Entamoeba dispar
EEDTLYILRGIREKYENH

SEQ ID NO: 2478395 - protein, 23 aa, Entamoeba dispar
EEDVEKIVGWAFVHEIEKRPDKN

SEQ ID NO: 2478396 - protein, 26 aa, Entamoeba dispar
EEDYSEFKRLTLLLTKLPRKRLRDVS

SEQ ID NO: 2478397 - protein, 18 aa, Entamoeba dispar
EEEAEIIKVRLNEKTENI

SEQ ID NO: 2478398 - protein, 18 aa, Entamoeba dispar
EEEAHYILHQWNKGREME

SEQ ID NO: 2478399 - protein, 25 aa, Entamoeba dispar
EEECIRKEVSCKYCQVTEHCSLICE

SEQ ID NO: 2478400 - protein, 18 aa, Entamoeba dispar
EEECKKRYLQKRKEKNER

SEQ ID NO: 2478401 - protein, 28 aa, Entamoeba dispar
EEECWKALIPRVDILYEFYEFSNQLKDR

SEQ ID NO: 2478402 - protein, 20 aa, Entamoeba dispar
EEEDDWLSLILDITSYICKS

SEQ ID NO: 2478403 - protein, 23 aa, Entamoeba dispar
EEEDLWLRRLNELADGKKEEKNI

SEQ ID NO: 2478404 - protein, 24 aa, Entamoeba dispar
EEEEPFEQWAIIFDECARKLFNMS

SEQ ID NO: 2478405 - protein, 24 aa, Entamoeba dispar
EEEERKRKEEEAKRKIKEERQRKI

SEQ ID NO: 2478406 - protein, 19 aa, Entamoeba dispar
EEEERKRLFQINPYSQQGL

SEQ ID NO: 2478407 - protein, 25 aa, Entamoeba dispar
EEEFCIISTKLFHFFSKKEISYEDK

SEQ ID NO: 2478408 - protein, 28 aa, Entamoeba dispar
EEEGKVNMCALNIKMGYENLYEFVLGKQ

SEQ ID NO: 2478409 - protein, 17 aa, Entamoeba dispar
EEEIGVRGCQDFMVSHK

SEQ ID NO: 2478410 - protein, 22 aa, Entamoeba dispar
EEEIIKLIKWARGLPSIDKEEI

SEQ ID NO: 2478411 - protein, 25 aa, Entamoeba dispar
EEEIKKLKEEIGILKSLKSSDNNNE

SEQ ID NO: 2478412 - protein, 18 aa, Entamoeba dispar
EEEKGFDVVMGKETRDQK

SEQ ID NO: 2478413 - protein, 21 aa, Entamoeba dispar
EEEKGKEIIKLIGENKKKLVE

SEQ ID NO: 2478414 - protein, 17 aa, Entamoeba dispar
EEEKSKLITELSNGNDG

SEQ ID NO: 2478415 - protein, 17 aa, Entamoeba dispar
EEEKTKLITELSNGNDG

SEQ ID NO: 2478416 - protein, 27 aa, Entamoeba dispar
EEELKKRFCKRIEFGTAGLRGKMCAGF

SEQ ID NO: 2478417 - protein, 26 aa, Entamoeba dispar
EEELKYFKECIIKVGLSYDDIKDLEI

SEQ ID NO: 2478418 - protein, 18 aa, Entamoeba dispar
EEEMICVLLKQAINKNKR

SEQ ID NO: 2478419 - protein, 17 aa, Entamoeba dispar
EEENLRVLQRVGGNVNA

SEQ ID NO: 2478420 - protein, 21 aa, Entamoeba dispar
EEERLSFYSGLLLEKSSAVTL

SEQ ID NO: 2478421 - protein, 36 aa, Entamoeba dispar
EEERTAAVLACEWVDEVVDGIVWWCTPYNFVKSFNI

SEQ ID NO: 2478422 - protein, 22 aa, Entamoeba dispar
EEESGLSYMNWIFEEGDKKILI

SEQ ID NO: 2478423 - protein, 24 aa, Entamoeba dispar
EEESRKFIISKYIENIGKDITPLI

SEQ ID NO: 2478424 - protein, 18 aa, Entamoeba dispar
EEEVIALICQYLKEQKLQ

SEQ ID NO: 2478425 - protein, 23 aa, Entamoeba dispar
EEEYKKLLILFTELVIKQSGIKE

SEQ ID NO: 2478426 - protein, 25 aa, Entamoeba dispar
EEFAKFPPLGRFAVRDMKQTVAVGV

SEQ ID NO: 2478427 - protein, 27 aa, Entamoeba dispar
EEFEEWKIIFVDGFIRSTKFEYGINYI

SEQ ID NO: 2478428 - protein, 18 aa, Entamoeba dispar
EEFEKIIIKEGGEDEINE

SEQ ID NO: 2478429 - protein, 17 aa, Entamoeba dispar
EEFFAARANFIRSMSAY

SEQ ID NO: 2478430 - protein, 19 aa, Entamoeba dispar
EEFFRLKLIQNKKKKAIAI

SEQ ID NO: 2478431 - protein, 21 aa, Entamoeba dispar
EEFHSSKLLSVFIPVTDSKRY

SEQ ID NO: 2478432 - protein, 21 aa, Entamoeba dispar
EEFIGVGIVSYIRKILQRYPE

SEQ ID NO: 2478433 - protein, 25 aa, Entamoeba dispar
EEFIIRRLKEINIRDISNGISSKTA

SEQ ID NO: 2478434 - protein, 17 aa, Entamoeba dispar
EEFKGIICGIGKIEHVP

SEQ ID NO: 2478435 - protein, 21 aa, Entamoeba dispar
EEFKKFCFNRDICTIEIKEIP

SEQ ID NO: 2478436 - protein, 17 aa, Entamoeba dispar
EEFKNKVPHDFSKKGVD

SEQ ID NO: 2478437 - protein, 17 aa, Entamoeba dispar
EEFKQKLFILKPNAENR

SEQ ID NO: 2478438 - protein, 28 aa, Entamoeba dispar
EEFNCSVRIILFKFINIMLNEYRDYIGY

SEQ ID NO: 2478439 - protein, 33 aa, Entamoeba dispar
EEFPKKGPRLCFLMSDMLLITVIKKVNDIPVDD

SEQ ID NO: 2478440 - protein, 25 aa, Entamoeba dispar
EEFPLKGEDGFLCLKAVNHFATMVP

SEQ ID NO: 2478441 - protein, 19 aa, Entamoeba dispar
EEFQKCVEEFVSILSSSSG

SEQ ID NO: 2478442 - protein, 22 aa, Entamoeba dispar
EEFSSLLLKFTNWEQWENYNFM

SEQ ID NO: 2478443 - protein, 19 aa, Entamoeba dispar
EEFVKCYDELMGSSYPPTK

SEQ ID NO: 2478444 - protein, 24 aa, Entamoeba dispar
EEFYPKLCEWVGLSNYEVLYNSLE

SEQ ID NO: 2478445 - protein, 26 aa, Entamoeba dispar
EEGDEFKWELQIADPSLFECSSKYFI

SEQ ID NO: 2478446 - protein, 21 aa, Entamoeba dispar
EEGEIAWNYREFIIEYHSLDN

SEQ ID NO: 2478447 - protein, 22 aa, Entamoeba dispar
EEGEVAWNYREFIVEYHSLDNE

SEQ ID NO: 2478448 - protein, 17 aa, Entamoeba dispar
EEGFCPLHGKSFTGNLV

SEQ ID NO: 2478449 - protein, 19 aa, Entamoeba dispar
EEGRFIIAVIRKERINNNK

SEQ ID NO: 2478450 - protein, 32 aa, Entamoeba dispar
EEGVFKGKLLLVWKWTPSVILNVECKEESERY

SEQ ID NO: 2478451 - protein, 17 aa, Entamoeba dispar
EEGYRIYTLEELGLDKN

SEQ ID NO: 2478452 - protein, 24 aa, Entamoeba dispar
EEHLKRLFEITRYTIGIYGVMGLK

SEQ ID NO: 2478453 - protein, 28 aa, Entamoeba dispar
EEHTKFIKAITWLGCTSTRRLPVKLISK

SEQ ID NO: 2478454 - protein, 19 aa, Entamoeba dispar
EEIAISALYDYYSDLVDLQ

SEQ ID NO: 2478455 - protein, 20 aa, Entamoeba dispar
EEICEAPPVPAPRRGLTLGR

SEQ ID NO: 2478456 - protein, 22 aa, Entamoeba dispar
EEIDCISRIIASYSEENPRKAL

SEQ ID NO: 2478457 - protein, 18 aa, Entamoeba dispar
EEIDKLNLIKSIKANPNI

SEQ ID NO: 2478458 - protein, 18 aa, Entamoeba dispar
EEIEECMNQIIKLTKEIK

SEQ ID NO: 2478459 - protein, 25 aa, Entamoeba dispar
EEIELPLQPQVCGALVMALNGEMTD

SEQ ID NO: 2478460 - protein, 18 aa, Entamoeba dispar
EEIEMKYFPSLGNNDKII

SEQ ID NO: 2478461 - protein, 17 aa, Entamoeba dispar
EEIGLLHGGRKGEIIVA

SEQ ID NO: 2478462 - protein, 19 aa, Entamoeba dispar
EEIIDCIYNTANIDIIAFI

SEQ ID NO: 2478463 - protein, 21 aa, Entamoeba dispar
EEIIKLIKWARRLKPIDKEEI

SEQ ID NO: 2478464 - protein, 23 aa, Entamoeba dispar
EEIKFEPLKCDHEMTGNEVIEHF

SEQ ID NO: 2478465 - protein, 24 aa, Entamoeba dispar
EEIKKAYRKLALKLHPDKLVDVDP

SEQ ID NO: 2478466 - protein, 20 aa, Entamoeba dispar
EEIKKLIKWARGLKPIDKEE

SEQ ID NO: 2478467 - protein, 17 aa, Entamoeba dispar
EEILKKVCNQYGEVDEV

SEQ ID NO: 2478468 - protein, 18 aa, Entamoeba dispar
EEILKNRIEKRIDEEENK

SEQ ID NO: 2478469 - protein, 33 aa, Entamoeba dispar
EEILRRHFGEWGELEYIRVLPIRNIAFIRYKLR

SEQ ID NO: 2478470 - protein, 18 aa, Entamoeba dispar
EEINEEFSFVSTFQYSKG

SEQ ID NO: 2478471 - protein, 23 aa, Entamoeba dispar
EEINRISLYLMVGLVSRLDLDTN

SEQ ID NO: 2478472 - protein, 17 aa, Entamoeba dispar
EEIPSLCCLPKTEIEEL

SEQ ID NO: 2478473 - protein, 25 aa, Entamoeba dispar
EEIQTIRKWLRCAQGDKYRMGNLFI

SEQ ID NO: 2478474 - protein, 38 aa, Entamoeba dispar
EEIRLLFIKKERDMIIMGFNYLDILAIYHPMYYNNGFL

SEQ ID NO: 2478475 - protein, 20 aa, Entamoeba dispar
EEISGMILKYLSFMAKSKLK

SEQ ID NO: 2478476 - protein, 18 aa, Entamoeba dispar
EEISHSKCNYPYPKVIKI

SEQ ID NO: 2478477 - protein, 18 aa, Entamoeba dispar
EEITGIKLVPNRKEEYKT

SEQ ID NO: 2478478 - protein, 19 aa, Entamoeba dispar
EEITRLALTGLDVSENYIS

SEQ ID NO: 2478479 - protein, 25 aa, Entamoeba dispar
EEIVISFIYCCLNKIKGTNKEYYEL

SEQ ID NO: 2478480 - protein, 21 aa, Entamoeba dispar
EEIYNLYPLFDILLGAPEINI

SEQ ID NO: 2478481 - protein, 43 aa, Entamoeba dispar
EEIYQTLGKKCCVFCHKANISTKCPVCNKTVCDECKNDKSCYS

SEQ ID NO: 2478482 - protein, 24 aa, Entamoeba dispar
EEKCSAEGKICCFKLPELAEEAKI

SEQ ID NO: 2478483 - protein, 18 aa, Entamoeba dispar
EEKEAIALEAERKKELEK

SEQ ID NO: 2478484 - protein, 24 aa, Entamoeba dispar
EEKEAWKSIIYDQFRYVDEIIENK

SEQ ID NO: 2478485 - protein, 20 aa, Entamoeba dispar
EEKEIKRDDIIFFDKLKEEL

SEQ ID NO: 2478486 - protein, 19 aa, Entamoeba dispar
EEKELRTLVKYHGSDEKIR

SEQ ID NO: 2478487 - protein, 19 aa, Entamoeba dispar
EEKEVRMLFILAPHSHLLF

SEQ ID NO: 2478488 - protein, 19 aa, Entamoeba dispar
EEKGLSCTMFKEYYEKNNG

SEQ ID NO: 2478489 - protein, 21 aa, Entamoeba dispar
EEKKCLLNRLGKISNVTGLMT

SEQ ID NO: 2478490 - protein, 26 aa, Entamoeba dispar
EEKKLDGIVLEGEWKKGFDSGNIISN

SEQ ID NO: 2478491 - protein, 21 aa, Entamoeba dispar
EEKKPILPKYLIKKIERQEEI

SEQ ID NO: 2478492 - protein, 34 aa, Entamoeba dispar
EEKKWYEFFSFKGKRIGGKIGIESNWNCNIKKMS

SEQ ID NO: 2478493 - protein, 33 aa, Entamoeba dispar
EEKLIIDWFSRFGIEVGDFKTSFNDGLLICQVI

SEQ ID NO: 2478494 - protein, 24 aa, Entamoeba dispar
EEKPEELGRVISFSADGTVQSNET

SEQ ID NO: 2478495 - protein, 22 aa, Entamoeba dispar
EEKRNAAIFDRVFDRMNEKRDT

SEQ ID NO: 2478496 - protein, 23 aa, Entamoeba dispar
EEKRPNTRITIKMNDRPSLKFQI

SEQ ID NO: 2478497 - protein, 25 aa, Entamoeba dispar
EEKYRYLVNYFNKYVNFIKVTRKVR

SEQ ID NO: 2478498 - protein, 23 aa, Entamoeba dispar
EELAFKALNKIAGHKIEAKIETL

SEQ ID NO: 2478499 - protein, 21 aa, Entamoeba dispar
EELCQVISPHVLKAFNSRIRN

SEQ ID NO: 2478500 - protein, 17 aa, Entamoeba dispar
EELCTFKQNYKYLRAYL

SEQ ID NO: 2478501 - protein, 28 aa, Entamoeba dispar
EELEMEKKRMLIKLTLKDYIFARHDIGK

SEQ ID NO: 2478502 - protein, 28 aa, Entamoeba dispar
EELFNCLQLYGLEEVPCFININSNGIKI

SEQ ID NO: 2478503 - protein, 20 aa, Entamoeba dispar
EELGIKYVVEPAFGEFLSIN

SEQ ID NO: 2478504 - protein, 24 aa, Entamoeba dispar
EELICSLLKFEVNTLILSNYHYGL

SEQ ID NO: 2478505 - protein, 21 aa, Entamoeba dispar
EELIFFLLFVDFTIYCSKQPI

SEQ ID NO: 2478506 - protein, 21 aa, Entamoeba dispar
EELKDLLKRYQITKYHGTNKA

SEQ ID NO: 2478507 - protein, 19 aa, Entamoeba dispar
EELKENCPIETQISKDKYF

SEQ ID NO: 2478508 - protein, 20 aa, Entamoeba dispar
EELKKFFGRDTLVVGIEANT

SEQ ID NO: 2478509 - protein, 20 aa, Entamoeba dispar
EELKKNSFIDDTIRELEDDN

SEQ ID NO: 2478510 - protein, 22 aa, Entamoeba dispar
EELKNRIKAVKYIECSAKTSEN

SEQ ID NO: 2478511 - protein, 19 aa, Entamoeba dispar
EELKRINIIQSQEEELIYD

SEQ ID NO: 2478512 - protein, 17 aa, Entamoeba dispar
EELKRLVEVSTNNYNET

SEQ ID NO: 2478513 - protein, 26 aa, Entamoeba dispar
EELLRMRRARYGNAKKPIPSGVSSAR

SEQ ID NO: 2478514 - protein, 33 aa, Entamoeba dispar
EELMKEFINAFFIIKNYFSVLSIHNGNRTMFHF

SEQ ID NO: 2478515 - protein, 24 aa, Entamoeba dispar
EELNEIIKMVGFITKTDFCNIENK

SEQ ID NO: 2478516 - protein, 23 aa, Entamoeba dispar
EELPDTPLFYALDRAAHFFKITV

SEQ ID NO: 2478517 - protein, 24 aa, Entamoeba dispar
EELPFERRGYFALPGISQKSIQGI

SEQ ID NO: 2478518 - protein, 22 aa, Entamoeba dispar
EELPINSLVMFWDRILANLKSR

SEQ ID NO: 2478519 - protein, 27 aa, Entamoeba dispar
EELQAICCSHGLIIRKDIKKIIEKYKE

SEQ ID NO: 2478520 - protein, 25 aa, Entamoeba dispar
EELRRDCDQVARLLYALDQSNITTV

SEQ ID NO: 2478521 - protein, 22 aa, Entamoeba dispar
EELRVDVIICVFSLGNKESFST

SEQ ID NO: 2478522 - protein, 19 aa, Entamoeba dispar
EELSDLFKFEEELKKSSTK

SEQ ID NO: 2478523 - protein, 23 aa, Entamoeba dispar
EELSFKVGDIITILEKDEGWWKG

SEQ ID NO: 2478524 - protein, 22 aa, Entamoeba dispar
EELSNMIALKILRIGFNKLSGN

SEQ ID NO: 2478525 - protein, 21 aa, Entamoeba dispar
EELSVLAKVMVLREIIVNAPS

SEQ ID NO: 2478526 - protein, 17 aa, Entamoeba dispar
EELTLKRMDNIRSMLNE

SEQ ID NO: 2478527 - protein, 20 aa, Entamoeba dispar
EELTNFIFEKYITSLPQNED

SEQ ID NO: 2478528 - protein, 23 aa, Entamoeba dispar
EELVKMYCIPFIQWQDLHRLNKN

SEQ ID NO: 2478529 - protein, 25 aa, Entamoeba dispar
EELWIDEVYHPFNIINEDLSPNYHI

SEQ ID NO: 2478530 - protein, 24 aa, Entamoeba dispar
EELYKKDCMDHIGFFAKCLGCSEN

SEQ ID NO: 2478531 - protein, 22 aa, Entamoeba dispar
EELYRCLCDSFITRQEEYYYLF

SEQ ID NO: 2478532 - protein, 25 aa, Entamoeba dispar
EEMAQALYIYWKSRDIVKAGECDYE

SEQ ID NO: 2478533 - protein, 18 aa, Entamoeba dispar
EEMIEVKEIRTWIKKALE

SEQ ID NO: 2478534 - protein, 18 aa, Entamoeba dispar
EEMIKKLKSSIQMKVQQD

SEQ ID NO: 2478535 - protein, 19 aa, Entamoeba dispar
EEMIKKLKSSIQMKVQQDI

SEQ ID NO: 2478536 - protein, 17 aa, Entamoeba dispar
EEMKNIFTRTLKESKNE

SEQ ID NO: 2478537 - protein, 20 aa, Entamoeba dispar
EEMKTIGILVKYMKRHNNQL

SEQ ID NO: 2478538 - protein, 27 aa, Entamoeba dispar
EEMMFNTSCCIIDPKVIDKILFDAERE

SEQ ID NO: 2478539 - protein, 27 aa, Entamoeba dispar
EENKCKYSERMTCLLIAIIFEIPDIDK

SEQ ID NO: 2478540 - protein, 24 aa, Entamoeba dispar
EENKFLWDYMVEYGISNAKIFNGF

SEQ ID NO: 2478541 - protein, 21 aa, Entamoeba dispar
EENTRLTNLLINRDEKIKLVE

SEQ ID NO: 2478542 - protein, 23 aa, Entamoeba dispar
EENYKVLLMRDIIKGGKELAKDA

SEQ ID NO: 2478543 - protein, 23 aa, Entamoeba dispar
EEPFPDVIVIGGFPEQCDSFDFM

SEQ ID NO: 2478544 - protein, 21 aa, Entamoeba dispar
EEPKLKGVICEVSLSNELENR

SEQ ID NO: 2478545 - protein, 18 aa, Entamoeba dispar
EEPKVSSIFILIKMQQKQ

SEQ ID NO: 2478546 - protein, 25 aa, Entamoeba dispar
EEQEYKGEITFRILKEFIEEGKYPK

SEQ ID NO: 2478547 - protein, 17 aa, Entamoeba dispar
EEQIKIGYNVSLMNRND

SEQ ID NO: 2478548 - protein, 21 aa, Entamoeba dispar
EEQNYRFILFDDINYDKNLIR

SEQ ID NO: 2478549 - protein, 17 aa, Entamoeba dispar
EEQPLLVCRCIKAMPDE

SEQ ID NO: 2478550 - protein, 27 aa, Entamoeba dispar
EEQQVLSLRCPISFQTIEIPVRGKRCS

SEQ ID NO: 2478551 - protein, 23 aa, Entamoeba dispar
EEQTLSLLFSMLGHNFNANQLSH

SEQ ID NO: 2478552 - protein, 17 aa, Entamoeba dispar
EEQVKWSVGVSLPSFGI

SEQ ID NO: 2478553 - protein, 23 aa, Entamoeba dispar
EERDVWESVLFDQIVGRRKTLEN

SEQ ID NO: 2478554 - protein, 22 aa, Entamoeba dispar
EERKCCEVLRYVFAEEDATVAL

SEQ ID NO: 2478555 - protein, 23 aa, Entamoeba dispar
EERMKRLGVQSILTYDCPCAIIL

SEQ ID NO: 2478556 - protein, 25 aa, Entamoeba dispar
EERNQLYGLVVFCRNFTHLFFGSKQ

SEQ ID NO: 2478557 - protein, 19 aa, Entamoeba dispar
EERRELAIYFEEILQRSWA

SEQ ID NO: 2478558 - protein, 20 aa, Entamoeba dispar
EERVDGCIIHDRIIKQLNTL

SEQ ID NO: 2478559 - protein, 22 aa, Entamoeba dispar
EESDIKGAERLYQGVDDLHELD

SEQ ID NO: 2478560 - protein, 22 aa, Entamoeba dispar
EESEKWVECGIDEPEKEIQLLV

SEQ ID NO: 2478561 - protein, 23 aa, Entamoeba dispar
EESELNIPPGKIVKEIIISIVNL

SEQ ID NO: 2478562 - protein, 24 aa, Entamoeba dispar
EESFEMIDKMGILYDGNYSKVLEM

SEQ ID NO: 2478563 - protein, 23 aa, Entamoeba dispar
EESFKPKRLGGTIERRRGEDKRR

SEQ ID NO: 2478564 - protein, 22 aa, Entamoeba dispar
EESIKALPIIILFDNITDNNFN

SEQ ID NO: 2478565 - protein, 24 aa, Entamoeba dispar
EESKAWPDYVFLKGTSFSSSNKDK

SEQ ID NO: 2478566 - protein, 23 aa, Entamoeba dispar
EESKPSELLKLFTPQQTQKQQSS

SEQ ID NO: 2478567 - protein, 21 aa, Entamoeba dispar
EESKTICLLYHDYYSICTDKE

SEQ ID NO: 2478568 - protein, 29 aa, Entamoeba dispar
EESLKLIRMRCLKCQKSSEVWTLRESVYS

SEQ ID NO: 2478569 - protein, 29 aa, Entamoeba dispar
EESPKLNVMVDITMCFPWLSMKADTKCFE

SEQ ID NO: 2478570 - protein, 24 aa, Entamoeba dispar
EESQFIKICIGTPVESFDDFVSYL

SEQ ID NO: 2478571 - protein, 24 aa, Entamoeba dispar
EESRRVKFVFISWAGEAIKKPKLR

SEQ ID NO: 2478572 - protein, 24 aa, Entamoeba dispar
EESSWSELNIPYSEKTTLIRSKYT

SEQ ID NO: 2478573 - protein, 23 aa, Entamoeba dispar
EESWPGVTKMVNWSNRFPKFKGK

SEQ ID NO: 2478574 - protein, 18 aa, Entamoeba dispar
EETCLKYASKIEEDQSSY

SEQ ID NO: 2478575 - protein, 19 aa, Entamoeba dispar
EETDLFPSDILDRTKDVRD

SEQ ID NO: 2478576 - protein, 21 aa, Entamoeba dispar
EETEEFQLKKFNEMIDSTNVQ

SEQ ID NO: 2478577 - protein, 18 aa, Entamoeba dispar
EETEMGVIMQEEENEEES

SEQ ID NO: 2478578 - protein, 17 aa, Entamoeba dispar
EETKKLLMSTFCNASPE

SEQ ID NO: 2478579 - protein, 22 aa, Entamoeba dispar
EETLKTALNFVLMKYKKNKDYA

SEQ ID NO: 2478580 - protein, 31 aa, Entamoeba dispar
EETLPFLIQFIPLFFERCLLTEEIIYKINEE

SEQ ID NO: 2478581 - protein, 17 aa, Entamoeba dispar
EETLVYNGLLYLLVKMG

SEQ ID NO: 2478582 - protein, 23 aa, Entamoeba dispar
EETNCLYYSFINEFKNLLTETSK

SEQ ID NO: 2478583 - protein, 29 aa, Entamoeba dispar
EETPKTRYNCYAHIWDAHLRTELSKPGKN

SEQ ID NO: 2478584 - protein, 22 aa, Entamoeba dispar
EETRFLEGLKDNWQNTQLKEYS

SEQ ID NO: 2478585 - protein, 23 aa, Entamoeba dispar
EETRFLEGLKDNWQNTQLKEYSL

SEQ ID NO: 2478586 - protein, 25 aa, Entamoeba dispar
EETRGIPLRSIFCVKDLTKKNYIEG

SEQ ID NO: 2478587 - protein, 21 aa, Entamoeba dispar
EETYKRRAFEREFDKQMITNE

SEQ ID NO: 2478588 - protein, 26 aa, Entamoeba dispar
EEVEELSNYCILTLKNFKNFKNNEII

SEQ ID NO: 2478589 - protein, 18 aa, Entamoeba dispar
EEVFKIYSSDSVIWVKSN

SEQ ID NO: 2478590 - protein, 24 aa, Entamoeba dispar
EEVFRGVFMLEGKYYIVDEEGDGG

SEQ ID NO: 2478591 - protein, 18 aa, Entamoeba dispar
EEVIKYAYVEMDSIENKN

SEQ ID NO: 2478592 - protein, 23 aa, Entamoeba dispar
EEVKAHPFFKGFDFNCIEKNIPP

SEQ ID NO: 2478593 - protein, 24 aa, Entamoeba dispar
EEVKAHPFFKGFDFNCIEKNIPPY

SEQ ID NO: 2478594 - protein, 17 aa, Entamoeba dispar
EEVKCSYLEGFMTLFIR

SEQ ID NO: 2478595 - protein, 21 aa, Entamoeba dispar
EEVKFESVVPFTNFNHHFYYD

SEQ ID NO: 2478596 - protein, 26 aa, Entamoeba dispar
EEVKGKICKECIGLPLQDAEQEYIDY

SEQ ID NO: 2478597 - protein, 24 aa, Entamoeba dispar
EEVKKEIKTVVLIDVSMNRIQEIP

SEQ ID NO: 2478598 - protein, 25 aa, Entamoeba dispar
EEVKKEIKTVVLIDVSMNRIQEIPS

SEQ ID NO: 2478599 - protein, 28 aa, Entamoeba dispar
EEVLDMICTKCGLFESNFIRSLSKTNDN

SEQ ID NO: 2478600 - protein, 25 aa, Entamoeba dispar
EEVLFDFIEHFTIASLVPIKERVEL

SEQ ID NO: 2478601 - protein, 22 aa, Entamoeba dispar
EEVNGKLTKKVNGMERKIEKME

SEQ ID NO: 2478602 - protein, 24 aa, Entamoeba dispar
EEVPLPILKAMYGIYFTPRSLEGV

SEQ ID NO: 2478603 - protein, 26 aa, Entamoeba dispar
EEVPRFNGRYPYDFTAQTNLERIGEK

SEQ ID NO: 2478604 - protein, 43 aa, Entamoeba dispar
EEVQCPGFLFEWYMVWFCRILPCDFCYAIIDLCLLYGQQAIYT

SEQ ID NO: 2478605 - protein, 19 aa, Entamoeba dispar
EEVRKCIDLGNGAGGKGRY

SEQ ID NO: 2478606 - protein, 18 aa, Entamoeba dispar
EEVSCFLVRALIDVVKGT

SEQ ID NO: 2478607 - protein, 23 aa, Entamoeba dispar
EEVSTVMSFACYFLQVFDKTDSG

SEQ ID NO: 2478608 - protein, 23 aa, Entamoeba dispar
EEVVKTLNEMGMKYSEDKDHGFV

SEQ ID NO: 2478609 - protein, 18 aa, Entamoeba dispar
EEVVSMEIFYDIFIELCV

SEQ ID NO: 2478610 - protein, 20 aa, Entamoeba dispar
EEVYKSSAFFIKTEKGIFNG

SEQ ID NO: 2478611 - protein, 20 aa, Entamoeba dispar
EEVYPLTSFLQSSKCNEDMI

SEQ ID NO: 2478612 - protein, 17 aa, Entamoeba dispar
EEWKVKEKEWKEQLEKS

SEQ ID NO: 2478613 - protein, 17 aa, Entamoeba dispar
EEWLPKEHWSYFSKATI

SEQ ID NO: 2478614 - protein, 20 aa, Entamoeba dispar
EEWLYDCISEMKFINPKSYL

SEQ ID NO: 2478615 - protein, 23 aa, Entamoeba dispar
EEWSNYFFNCLDLESIKNKEESI

SEQ ID NO: 2478616 - protein, 26 aa, Entamoeba dispar
EEYCLVKWGGGLSYLEATWEKKSEIK

SEQ ID NO: 2478617 - protein, 21 aa, Entamoeba dispar
EEYFGELNHQIGIENIYLECS

SEQ ID NO: 2478618 - protein, 24 aa, Entamoeba dispar
EEYGLDLPSRWDLFNKQQQDIFRD

SEQ ID NO: 2478619 - protein, 48 aa, Entamoeba dispar
EEYHLKLCLCPLCKHGMEVFGVKRPVSWILICRVILYSLMELHKGTVY

SEQ ID NO: 2478620 - protein, 26 aa, Entamoeba dispar
EEYKKCFLQQLALKLLCNVVYGYTGA

SEQ ID NO: 2478621 - protein, 18 aa, Entamoeba dispar
EEYKMCGLKNSLNKQELK

SEQ ID NO: 2478622 - protein, 21 aa, Entamoeba dispar
EEYLKILTLYTFGKKKKEGKE

SEQ ID NO: 2478623 - protein, 19 aa, Entamoeba dispar
EEYLWLLTERKFMKVKMLQ

SEQ ID NO: 2478624 - protein, 21 aa, Entamoeba dispar
EEYQKMLIKLRMEQKSMTEIK

SEQ ID NO: 2478625 - protein, 31 aa, Entamoeba dispar
EEYQRKYFPYRKVHKRVRGWVNNAPRSKYKP

SEQ ID NO: 2478626 - protein, 24 aa, Entamoeba dispar
EEYSELLNMPSLVKKNYFEIYNMI

SEQ ID NO: 2478627 - protein, 20 aa, Entamoeba dispar
EEYYECFDRAVMGFDLPVIL

SEQ ID NO: 2478628 - protein, 30 aa, Entamoeba dispar
EEYYFYCLVDFTICCSKQPIGQHGIYQNDV

SEQ ID NO: 2478629 - protein, 20 aa, Entamoeba dispar
EFAEVSTLFCMINLLTNIRD

SEQ ID NO: 2478630 - protein, 17 aa, Entamoeba dispar
EFAFEYFNNAELSICNI

SEQ ID NO: 2478631 - protein, 20 aa, Entamoeba dispar
EFAGLMGARVVRICTHPDVT

SEQ ID NO: 2478632 - protein, 23 aa, Entamoeba dispar
EFAILLIKFLWLRINSNCIIQTH

SEQ ID NO: 2478633 - protein, 23 aa, Entamoeba dispar
EFCCNITEGVLLRKVLSDLIKQS

SEQ ID NO: 2478634 - protein, 18 aa, Entamoeba dispar
EFCIKENVPYILIHENSN

SEQ ID NO: 2478635 - protein, 24 aa, Entamoeba dispar
EFCNYPIQLGCRLSRATTIKYNHN

SEQ ID NO: 2478636 - protein, 18 aa, Entamoeba dispar
EFDAEKRSTIGVEFATRS

SEQ ID NO: 2478637 - protein, 29 aa, Entamoeba dispar
EFDILYFFKSDIELFKWNIEQIEYLSKKF

SEQ ID NO: 2478638 - protein, 20 aa, Entamoeba dispar
EFDLVKQWLKTGIGAHNAGL

SEQ ID NO: 2478639 - protein, 22 aa, Entamoeba dispar
EFDPDKRSTIGVEFATRSINYC

SEQ ID NO: 2478640 - protein, 17 aa, Entamoeba dispar
EFDPEKKSTIGVEFSSK

SEQ ID NO: 2478641 - protein, 21 aa, Entamoeba dispar
EFDRIQKLRIVSEYLEPSLRE

SEQ ID NO: 2478642 - protein, 17 aa, Entamoeba dispar
EFDVWECIGKCESDGDL

SEQ ID NO: 2478643 - protein, 25 aa, Entamoeba dispar
EFEAMKYTTHKAAFDEVQIYETEED

SEQ ID NO: 2478644 - protein, 18 aa, Entamoeba dispar
EFECNLVNMIIWNKNNYN

SEQ ID NO: 2478645 - protein, 19 aa, Entamoeba dispar
EFEDCNQKEFDRCMKCVDD

SEQ ID NO: 2478646 - protein, 24 aa, Entamoeba dispar
EFEEALELMKKCIKEIQKRVIVSS

SEQ ID NO: 2478647 - protein, 24 aa, Entamoeba dispar
EFEEIPETIQLFSSLKKISFASNK

SEQ ID NO: 2478648 - protein, 17 aa, Entamoeba dispar
EFEEIVHYFKPRNMNKA

SEQ ID NO: 2478649 - protein, 25 aa, Entamoeba dispar
EFEENRCGIGLAKPEPKKLEFNGLQ

SEQ ID NO: 2478650 - protein, 19 aa, Entamoeba dispar
EFEKEVAMLDKFRSEYIIQ

SEQ ID NO: 2478651 - protein, 22 aa, Entamoeba dispar
EFEKEVRRAKGISYLHSNGIMH

SEQ ID NO: 2478652 - protein, 25 aa, Entamoeba dispar
EFENLPATWVAFFKKAGIKKKDLSD

SEQ ID NO: 2478653 - protein, 24 aa, Entamoeba dispar
EFFDICRIKDALALAHKLDVMKKE

SEQ ID NO: 2478654 - protein, 18 aa, Entamoeba dispar
EFFEKVISTFSVVPSPIV

SEQ ID NO: 2478655 - protein, 18 aa, Entamoeba dispar
EFFIVDFPEMVKAYGENG

SEQ ID NO: 2478656 - protein, 25 aa, Entamoeba dispar
EFFTDEMKEFIPVIIKGSISNIETS

SEQ ID NO: 2478657 - protein, 17 aa, Entamoeba dispar
EFFVKMSALKIIHVKII

SEQ ID NO: 2478658 - protein, 17 aa, Entamoeba dispar
EFFYMIYTIPGYITPLI

SEQ ID NO: 2478659 - protein, 26 aa, Entamoeba dispar
EFIAIYRYLEICYALFNAYNGSGSEI

SEQ ID NO: 2478660 - protein, 24 aa, Entamoeba dispar
EFIDFLKKCFVFNPEERWSAIQLL

SEQ ID NO: 2478661 - protein, 25 aa, Entamoeba dispar
EFIDIPFKFNTSIFTIYQPDPMVLT

SEQ ID NO: 2478662 - protein, 23 aa, Entamoeba dispar
EFIESGCLKEVIEIIKSSTKEDI

SEQ ID NO: 2478663 - protein, 20 aa, Entamoeba dispar
EFIKDVLYERVNIYQYVIRD

SEQ ID NO: 2478664 - protein, 20 aa, Entamoeba dispar
EFIKNAHLFINWTNYSITAE

SEQ ID NO: 2478665 - protein, 17 aa, Entamoeba dispar
EFIMKGRYKEVFETQSF

SEQ ID NO: 2478666 - protein, 25 aa, Entamoeba dispar
EFINRCVGFNVGIEEFWRRYDDEES

SEQ ID NO: 2478667 - protein, 19 aa, Entamoeba dispar
EFINSIPFIVFDESHLPKV

SEQ ID NO: 2478668 - protein, 19 aa, Entamoeba dispar
EFIPYIPTLSKFLSYQKCH

SEQ ID NO: 2478669 - protein, 18 aa, Entamoeba dispar
EFIQCIDVKQPLPIINTI

SEQ ID NO: 2478670 - protein, 25 aa, Entamoeba dispar
EFIVKALELHFVYFHAIETQEIVWH

SEQ ID NO: 2478671 - protein, 25 aa, Entamoeba dispar
EFKCNRIIEGFEFFDKNNPLTFFFK

SEQ ID NO: 2478672 - protein, 22 aa, Entamoeba dispar
EFKENIESISILFNQPIEINKK

SEQ ID NO: 2478673 - protein, 22 aa, Entamoeba dispar
EFKESCWRVAFNGDVLAVSLSN

SEQ ID NO: 2478674 - protein, 26 aa, Entamoeba dispar
EFKGKEWKLCLLFNDILLIAKIDVTE

SEQ ID NO: 2478675 - protein, 19 aa, Entamoeba dispar
EFKIVEFERTLKMSTYLIA

SEQ ID NO: 2478676 - protein, 20 aa, Entamoeba dispar
EFKKEFKGNGCYLVKVVDGI

SEQ ID NO: 2478677 - protein, 19 aa, Entamoeba dispar
EFKKKCQEKGILINEKIEI

SEQ ID NO: 2478678 - protein, 23 aa, Entamoeba dispar
EFKKLFESYSICFLNGEDLTTSM

SEQ ID NO: 2478679 - protein, 21 aa, Entamoeba dispar
EFKTFCNEIIFKMQENKEYEN

SEQ ID NO: 2478680 - protein, 26 aa, Entamoeba dispar
EFKTSSIYIRYCFNIYNELSSYKLYE

SEQ ID NO: 2478681 - protein, 25 aa, Entamoeba dispar
EFLDLCGVGNFALVRKVKDIQTGEI

SEQ ID NO: 2478682 - protein, 19 aa, Entamoeba dispar
EFLEEDYSKLMFLLTDKTI

SEQ ID NO: 2478683 - protein, 31 aa, Entamoeba dispar
EFLHEGRVYVLREFRCCFILYYGDTTIISKR

SEQ ID NO: 2478684 - protein, 20 aa, Entamoeba dispar
EFLKRNGIELLCRAHQVVEE

SEQ ID NO: 2478685 - protein, 18 aa, Entamoeba dispar
EFLSFYVVLMKFINYKLY

SEQ ID NO: 2478686 - protein, 19 aa, Entamoeba dispar
EFLSTYVIIMIDESNDIVL

SEQ ID NO: 2478687 - protein, 18 aa, Entamoeba dispar
EFMKKQEVITCIKASQNQ

SEQ ID NO: 2478688 - protein, 19 aa, Entamoeba dispar
EFMYKDHYCIVLEKMDMSL

SEQ ID NO: 2478689 - protein, 20 aa, Entamoeba dispar
EFMYKDHYCIVLEKMDMSLR

SEQ ID NO: 2478690 - protein, 19 aa, Entamoeba dispar
EFNENLSLFNEGKGTLILD

SEQ ID NO: 2478691 - protein, 19 aa, Entamoeba dispar
EFNFAYPLLYKEYDEKMSF

SEQ ID NO: 2478692 - protein, 24 aa, Entamoeba dispar
EFNKKRCLPFKAVVVNMKRSELLQ

SEQ ID NO: 2478693 - protein, 18 aa, Entamoeba dispar
EFNLPEKHFIAFEKVKWW

SEQ ID NO: 2478694 - protein, 26 aa, Entamoeba dispar
EFNLTVLRCCCSILANVGPYIINLEC

SEQ ID NO: 2478695 - protein, 22 aa, Entamoeba dispar
EFPENLKSIFGIIKEVVEENFK

SEQ ID NO: 2478696 - protein, 29 aa, Entamoeba dispar
EFPFNKTFWCSSLFYPVEFHEDKIFECLT

SEQ ID NO: 2478697 - protein, 19 aa, Entamoeba dispar
EFPIAPTLARVLIGSEQYQ

SEQ ID NO: 2478698 - protein, 21 aa, Entamoeba dispar
EFPLDILKLTSLTNLYLTNNY

SEQ ID NO: 2478699 - protein, 19 aa, Entamoeba dispar
EFPNVLDAMVYLISNNNEK

SEQ ID NO: 2478700 - protein, 23 aa, Entamoeba dispar
EFPYKAVDVCTTYEKVISRDGRA

SEQ ID NO: 2478701 - protein, 24 aa, Entamoeba dispar
EFQTLKLLLSISIYEEQHYYKNKN

SEQ ID NO: 2478702 - protein, 29 aa, Entamoeba dispar
EFRKRKSKEVFFNEIAPFQMKKYVISERS

SEQ ID NO: 2478703 - protein, 20 aa, Entamoeba dispar
EFRVAEQYRLVHKIGGGSFG

SEQ ID NO: 2478704 - protein, 17 aa, Entamoeba dispar
EFSCGCLEMVPLKDLRK

SEQ ID NO: 2478705 - protein, 19 aa, Entamoeba dispar
EFSGTAIGRLCIGKDDQSH

SEQ ID NO: 2478706 - protein, 20 aa, Entamoeba dispar
EFSHPYPFIRTREFLWQEGH

SEQ ID NO: 2478707 - protein, 18 aa, Entamoeba dispar
EFSKLIQMRLHRTNTRTV

SEQ ID NO: 2478708 - protein, 23 aa, Entamoeba dispar
EFSKQYLVFSLLCFYVDCEKTGS

SEQ ID NO: 2478709 - protein, 18 aa, Entamoeba dispar
EFSLSYSILETFKHNYKY

SEQ ID NO: 2478710 - protein, 26 aa, Entamoeba dispar
EFSNYLKFRFTDGIGVKKSDEIIFTL

SEQ ID NO: 2478711 - protein, 18 aa, Entamoeba dispar
EFSPGHQFVALKCGCVIS

SEQ ID NO: 2478712 - protein, 18 aa, Entamoeba dispar
EFSPLFAAPQMFEQTTYS

SEQ ID NO: 2478713 - protein, 19 aa, Entamoeba dispar
EFSRLGITSSNGFKVIDNR

SEQ ID NO: 2478714 - protein, 21 aa, Entamoeba dispar
EFSSVLVCIDITESVINEAIN

SEQ ID NO: 2478715 - protein, 20 aa, Entamoeba dispar
EFSTLYSFNSITIYGLRYLS

SEQ ID NO: 2478716 - protein, 22 aa, Entamoeba dispar
EFTECVYGFNAFYSKKPGKDYF

SEQ ID NO: 2478717 - protein, 18 aa, Entamoeba dispar
EFTEKFTTIFLGETNDEL

SEQ ID NO: 2478718 - protein, 18 aa, Entamoeba dispar
EFTKQHIFISGSIAVGKT

SEQ ID NO: 2478719 - protein, 23 aa, Entamoeba dispar
EFTNPCFFLPPHAFDTMKSLTKI

SEQ ID NO: 2478720 - protein, 26 aa, Entamoeba dispar
EFTQMFWELGMKSFDEFIKKLIKLPR

SEQ ID NO: 2478721 - protein, 26 aa, Entamoeba dispar
EFTQMFWKLGMKSFDDFIKKLINLPR

SEQ ID NO: 2478722 - protein, 25 aa, Entamoeba dispar
EFTQMFWQLGMKNFDEFIKKLIKLP

SEQ ID NO: 2478723 - protein, 29 aa, Entamoeba dispar
EFVAPDCGICLLKDSIFAFGSFDKNISVL

SEQ ID NO: 2478724 - protein, 18 aa, Entamoeba dispar
EFVDGYDLFHIVFTNNLL

SEQ ID NO: 2478725 - protein, 28 aa, Entamoeba dispar
EFVIWKRVRKCLTITFLSIDTLVHVNYI

SEQ ID NO: 2478726 - protein, 19 aa, Entamoeba dispar
EFVNVKFGSIFSSLHPGAS

SEQ ID NO: 2478727 - protein, 18 aa, Entamoeba dispar
EFVPLLYKVIAFDDIQQI

SEQ ID NO: 2478728 - protein, 19 aa, Entamoeba dispar
EFYIPGYWKAQATGYASDA

SEQ ID NO: 2478729 - protein, 18 aa, Entamoeba dispar
EFYIQSMEYCLNFFCKVM

SEQ ID NO: 2478730 - protein, 19 aa, Entamoeba dispar
EFYLFPSNLRSRRIVFNSP

SEQ ID NO: 2478731 - protein, 27 aa, Entamoeba dispar
EFYQFAVLLETEFPKLVTELSCDDAKA

SEQ ID NO: 2478732 - protein, 19 aa, Entamoeba dispar
EGAFIFMQLLEGMNYLHSQ

SEQ ID NO: 2478733 - protein, 19 aa, Entamoeba dispar
EGAFSIVVPGEIIKTKERV

SEQ ID NO: 2478734 - protein, 21 aa, Entamoeba dispar
EGAIFARALSEIGIDTTYILP

SEQ ID NO: 2478735 - protein, 17 aa, Entamoeba dispar
EGAMCVYDVSKKDSFDA

SEQ ID NO: 2478736 - protein, 19 aa, Entamoeba dispar
EGCCGKWIEWYEEYKTLKE

SEQ ID NO: 2478737 - protein, 19 aa, Entamoeba dispar
EGCFYKCGCEEILKMDKRI

SEQ ID NO: 2478738 - protein, 22 aa, Entamoeba dispar
EGCIIKMLFNRNNISALDMSDI

SEQ ID NO: 2478739 - protein, 17 aa, Entamoeba dispar
EGCNIFYDTIISAINKY

SEQ ID NO: 2478740 - protein, 24 aa, Entamoeba dispar
EGCPSSRIISDFMRIVHAIFPNDQ

SEQ ID NO: 2478741 - protein, 18 aa, Entamoeba dispar
EGCSIDPFVCIYQPIERN

SEQ ID NO: 2478742 - protein, 26 aa, Entamoeba dispar
EGCSSFIRMLYEFDDLSPPIAKEISL

SEQ ID NO: 2478743 - protein, 17 aa, Entamoeba dispar
EGDCLYIGCKRSGWNSD

SEQ ID NO: 2478744 - protein, 18 aa, Entamoeba dispar
EGDIFILLYCSDLKEQFD

SEQ ID NO: 2478745 - protein, 24 aa, Entamoeba dispar
EGDRFAKLIKKWYFHRQNKAPSSI

SEQ ID NO: 2478746 - protein, 21 aa, Entamoeba dispar
EGEASMTAHCNLLGKFELTGI

SEQ ID NO: 2478747 - protein, 21 aa, Entamoeba dispar
EGEASMTSHCNLLGKFELTGI

SEQ ID NO: 2478748 - protein, 22 aa, Entamoeba dispar
EGEASMTSHCNLLGKFELTGIP

SEQ ID NO: 2478749 - protein, 22 aa, Entamoeba dispar
EGEERIQYGLSIAEDKMEIPAI

SEQ ID NO: 2478750 - protein, 39 aa, Entamoeba dispar
EGEEYYLIWFKRELFSSKGRLFGIPFMKVAKPQMRVIIN

SEQ ID NO: 2478751 - protein, 32 aa, Entamoeba dispar
EGEFCPLKEIIALKKAYGFYLYIDEAHSIGAL

SEQ ID NO: 2478752 - protein, 31 aa, Entamoeba dispar
EGEFCPLKEIIALKKAYGFYLYVDEAHSIGA

SEQ ID NO: 2478753 - protein, 19 aa, Entamoeba dispar
EGEICRIGNGITLYDEIPH

SEQ ID NO: 2478754 - protein, 24 aa, Entamoeba dispar
  misc_feature (16)..(17): Xaa can be any naturally occurring amino acid
EGENLATEMLWKWIFXXVIYSPQW

SEQ ID NO: 2478755 - protein, 22 aa, Entamoeba dispar
EGESKINGIIWVEETLKEENKG

SEQ ID NO: 2478756 - protein, 21 aa, Entamoeba dispar
EGESTILFADFEWFTNSDYHK

SEQ ID NO: 2478757 - protein, 19 aa, Entamoeba dispar
EGEVKFRVTCRVELDGRVG

SEQ ID NO: 2478758 - protein, 23 aa, Entamoeba dispar
EGEWRKVSVKDIVLYRNQPLQEI

SEQ ID NO: 2478759 - protein, 18 aa, Entamoeba dispar
EGFCNRLVKITSERKTYV

SEQ ID NO: 2478760 - protein, 21 aa, Entamoeba dispar
EGFDIRSWCIQFGHGNIKLHY

SEQ ID NO: 2478761 - protein, 17 aa, Entamoeba dispar
EGFDVAKFGDARVGMVG

SEQ ID NO: 2478762 - protein, 30 aa, Entamoeba dispar
EGFIGKVIDGYNCTFFAYGQTGTGKTYTME

SEQ ID NO: 2478763 - protein, 20 aa, Entamoeba dispar
EGFKFCFNKNVLTLFSAPNY

SEQ ID NO: 2478764 - protein, 23 aa, Entamoeba dispar
EGFNKKEFNSICERRKLTESDLR

SEQ ID NO: 2478765 - protein, 25 aa, Entamoeba dispar
EGFSGSDLFALGQMVAMRPIKEYLA

SEQ ID NO: 2478766 - protein, 17 aa, Entamoeba dispar
EGFSIYRRSLVMVFATA

SEQ ID NO: 2478767 - protein, 19 aa, Entamoeba dispar
EGFSLPHAILRLDLAGRDL

SEQ ID NO: 2478768 - protein, 20 aa, Entamoeba dispar
EGFTTLKTIGFICSEEITSQ

SEQ ID NO: 2478769 - protein, 19 aa, Entamoeba dispar
EGGELYYLILTQKALDITT

SEQ ID NO: 2478770 - protein, 17 aa, Entamoeba dispar
EGGFCGIPPEWENMFIA

SEQ ID NO: 2478771 - protein, 25 aa, Entamoeba dispar
EGGGCNLYIEGIEFNNSPKFLNLTM

SEQ ID NO: 2478772 - protein, 18 aa, Entamoeba dispar
EGGIKLFSNNDCLYQIGN

SEQ ID NO: 2478773 - protein, 24 aa, Entamoeba dispar
EGGVIKTIRIVASRIFSLKVVKTT

SEQ ID NO: 2478774 - protein, 22 aa, Entamoeba dispar
EGGYACEFEIFITIKCTTKIKE

SEQ ID NO: 2478775 - protein, 25 aa, Entamoeba dispar
EGGYACEFEIFITIKCTTKIKEQIM

SEQ ID NO: 2478776 - protein, 22 aa, Entamoeba dispar
EGGYACEFEIFITIKCTTKLKN

SEQ ID NO: 2478777 - protein, 20 aa, Entamoeba dispar
EGIATAYVRFISSVYESVCQ

SEQ ID NO: 2478778 - protein, 38 aa, Entamoeba dispar
EGICSKCKGKVHLKQGLLCEYCNTILHNNCVNFNNWVD

SEQ ID NO: 2478779 - protein, 18 aa, Entamoeba dispar
EGIFGDSLITLNVKEDGY

SEQ ID NO: 2478780 - protein, 17 aa, Entamoeba dispar
EGIGKQYAYLVISKSYF

SEQ ID NO: 2478781 - protein, 22 aa, Entamoeba dispar
EGIHPRLLVEGIELARQHLFDY

SEQ ID NO: 2478782 - protein, 23 aa, Entamoeba dispar
EGIHPRLLVEGIELARQHLFDYL

SEQ ID NO: 2478783 - protein, 20 aa, Entamoeba dispar
EGIIKLKQLFNGLITDYEFQ

SEQ ID NO: 2478784 - protein, 17 aa, Entamoeba dispar
EGIIRKSSLVPDNKKPV

SEQ ID NO: 2478785 - protein, 18 aa, Entamoeba dispar
EGILRFVFDENMGVDAST

SEQ ID NO: 2478786 - protein, 17 aa, Entamoeba dispar
EGINDLQKVIGRFPRIH

SEQ ID NO: 2478787 - protein, 30 aa, Entamoeba dispar
EGINLYRYGCFIYNCFMIPCIDPMEYPKYF

SEQ ID NO: 2478788 - protein, 21 aa, Entamoeba dispar
EGINNYWSFHFQEDHSSLKDL

SEQ ID NO: 2478789 - protein, 25 aa, Entamoeba dispar
EGINYIENWCGLKNHLILFDSSLPN

SEQ ID NO: 2478790 - protein, 17 aa, Entamoeba dispar
EGISMKSILEHKKGLFR

SEQ ID NO: 2478791 - protein, 21 aa, Entamoeba dispar
EGISRIIYLDVFRTLKSPVYQ

SEQ ID NO: 2478792 - protein, 21 aa, Entamoeba dispar
EGITKLGKYSFYRCTSLTSIQ

SEQ ID NO: 2478793 - protein, 24 aa, Entamoeba dispar
EGIWRSMRRVVIYLEERWSIDMTS

SEQ ID NO: 2478794 - protein, 25 aa, Entamoeba dispar
EGKAMWIMNSMRLFSFDPVLGRRLD

SEQ ID NO: 2478795 - protein, 18 aa, Entamoeba dispar
EGKARRPVEFKDEVDDGD

SEQ ID NO: 2478796 - protein, 24 aa, Entamoeba dispar
EGKDCSFMFMDVLKIIQTNDVSLK

SEQ ID NO: 2478797 - protein, 19 aa, Entamoeba dispar
EGKFSIEIIKENKVKSPIS

SEQ ID NO: 2478798 - protein, 17 aa, Entamoeba dispar
EGKHILFHLGMNDFESD

SEQ ID NO: 2478799 - protein, 25 aa, Entamoeba dispar
EGKIKSRWLRKNARRIDMENYTKPN

SEQ ID NO: 2478800 - protein, 27 aa, Entamoeba dispar
EGKISSYDRRKCVLKMAYIEVLGYEVD

SEQ ID NO: 2478801 - protein, 17 aa, Entamoeba dispar
EGKKGYGGNGFKFDIKE

SEQ ID NO: 2478802 - protein, 19 aa, Entamoeba dispar
EGKKQWPYSSIAVAMEVIP

SEQ ID NO: 2478803 - protein, 24 aa, Entamoeba dispar
EGKLKIYLYPNEEFNTIDESDAIA

SEQ ID NO: 2478804 - protein, 20 aa, Entamoeba dispar
EGKLKIYLYPNEPFNQKDES

SEQ ID NO: 2478805 - protein, 20 aa, Entamoeba dispar
EGKQKVVVVIPVATRADKVH

SEQ ID NO: 2478806 - protein, 20 aa, Entamoeba dispar
EGKSLVYAIASWTRQVSFIK

SEQ ID NO: 2478807 - protein, 24 aa, Entamoeba dispar
EGKTHEECIKKICINNNENYLDLI

SEQ ID NO: 2478808 - protein, 22 aa, Entamoeba dispar
EGKTKGVPCDSFIIYDTKTDDI

SEQ ID NO: 2478809 - protein, 23 aa, Entamoeba dispar
EGKVEPFVRPTMTSPVVKDNLDF

SEQ ID NO: 2478810 - protein, 24 aa, Entamoeba dispar
EGKVREAINFGSYNYLGFGGRHPI

SEQ ID NO: 2478811 - protein, 21 aa, Entamoeba dispar
EGLANRLAKYGTRKLGHLMEY

SEQ ID NO: 2478812 - protein, 21 aa, Entamoeba dispar
EGLDPKLVEMLLEDAAEQISE

SEQ ID NO: 2478813 - protein, 18 aa, Entamoeba dispar
EGLEKEYLIKCSFPTLSL

SEQ ID NO: 2478814 - protein, 26 aa, Entamoeba dispar
EGLEMKFCYEREEFGKTIIDDLIPNG

SEQ ID NO: 2478815 - protein, 20 aa, Entamoeba dispar
EGLFRIPGNMLVVNNLKKEY

SEQ ID NO: 2478816 - protein, 31 aa, Entamoeba dispar
EGLIKITRFCYSCIRIGNFYTNPECRNIDFL

SEQ ID NO: 2478817 - protein, 17 aa, Entamoeba dispar
EGLKKQRVKEVFNNDII

SEQ ID NO: 2478818 - protein, 18 aa, Entamoeba dispar
EGLLKKTVDTMVVLLNSI

SEQ ID NO: 2478819 - protein, 20 aa, Entamoeba dispar
EGLMCKTLVYDAEYIPDKRT

SEQ ID NO: 2478820 - protein, 30 aa, Entamoeba dispar
EGLNWLVFNWCRGKGCILADEMGLGKTVQV

SEQ ID NO: 2478821 - protein, 22 aa, Entamoeba dispar
EGLPKFFYIWTEIRPRMKEGAR

SEQ ID NO: 2478822 - protein, 19 aa, Entamoeba dispar
EGLQGIVIVLNCTNDRLSA

SEQ ID NO: 2478823 - protein, 18 aa, Entamoeba dispar
EGLRIAEYLTEIFESPSI

SEQ ID NO: 2478824 - protein, 20 aa, Entamoeba dispar
EGLSSIFLMEGRKTDLMRLR

SEQ ID NO: 2478825 - protein, 17 aa, Entamoeba dispar
EGLSTFGGGLVLISHHQ

SEQ ID NO: 2478826 - protein, 24 aa, Entamoeba dispar
EGMASAEATLAILKKEYDKIKIEC

SEQ ID NO: 2478827 - protein, 19 aa, Entamoeba dispar
EGMLTQFGSILGLGIVNAG

SEQ ID NO: 2478828 - protein, 22 aa, Entamoeba dispar
EGMYKYIVVYDIDYKQYLEFPE

SEQ ID NO: 2478829 - protein, 18 aa, Entamoeba dispar
EGNCIRAKGIQILLEIIK

SEQ ID NO: 2478830 - protein, 40 aa, Entamoeba dispar
EGNCVCADCGATTPKWSSVNLGIFICIRCAGIHRSMGTHI

SEQ ID NO: 2478831 - protein, 25 aa, Entamoeba dispar
EGNDTWDLLYVGLLMCGYDDLAERC

SEQ ID NO: 2478832 - protein, 24 aa, Entamoeba dispar
EGNECKKRRGIARSIYDHLKSQNA

SEQ ID NO: 2478833 - protein, 25 aa, Entamoeba dispar
EGNIRYCGLKLLGLMMTKHPKAVIE

SEQ ID NO: 2478834 - protein, 22 aa, Entamoeba dispar
EGNKIILVRDVLTIIDILSEFP

SEQ ID NO: 2478835 - protein, 20 aa, Entamoeba dispar
EGNNIILLCSFKDTLNNKNF

SEQ ID NO: 2478836 - protein, 24 aa, Entamoeba dispar
EGNQIEALICWKQAIDITPFHASK

SEQ ID NO: 2478837 - protein, 17 aa, Entamoeba dispar
EGNRGYNAAQNFKEGKQ

SEQ ID NO: 2478838 - protein, 23 aa, Entamoeba dispar
EGNSKLRIVETIKQSIPQTEDTV

SEQ ID NO: 2478839 - protein, 24 aa, Entamoeba dispar
EGPGKCLYCGERLEIIRKNEGYDE

SEQ ID NO: 2478840 - protein, 20 aa, Entamoeba dispar
EGQDLMVAWHLSKKKDPNNP

SEQ ID NO: 2478841 - protein, 30 aa, Entamoeba dispar
EGQPLVYRLIWICFVERKLRLVRHRKIKEE

SEQ ID NO: 2478842 - protein, 31 aa, Entamoeba dispar
EGQPLVYRLIWICFVERKLRLVRHRKIKEEY

SEQ ID NO: 2478843 - protein, 19 aa, Entamoeba dispar
EGRIARLTGGVAVISVGGS

SEQ ID NO: 2478844 - protein, 17 aa, Entamoeba dispar
EGRKCGILINKADLMTD

SEQ ID NO: 2478845 - protein, 27 aa, Entamoeba dispar
EGRRFKGRLHPYVSIPNKHVVDALIEA

SEQ ID NO: 2478846 - protein, 25 aa, Entamoeba dispar
EGSEFKVSFFNAMVDKFYSSIIEEQ

SEQ ID NO: 2478847 - protein, 20 aa, Entamoeba dispar
EGSFGIVYIGEFRGNQVAIK

SEQ ID NO: 2478848 - protein, 29 aa, Entamoeba dispar
EGSGRKGLPQSFLNRFTEVYVNKMTTNDM

SEQ ID NO: 2478849 - protein, 18 aa, Entamoeba dispar
EGSKELDEFFSFTQQNYF

SEQ ID NO: 2478850 - protein, 26 aa, Entamoeba dispar
EGSSYKSINFMSQFKNKSLIEIRTED

SEQ ID NO: 2478851 - protein, 29 aa, Entamoeba dispar
EGSVGKSALCLLFVKGEFNIEYNPTIEDS

SEQ ID NO: 2478852 - protein, 30 aa, Entamoeba dispar
EGTKLSFFSWNSWNGWIPTWVVNKATKSMI

SEQ ID NO: 2478853 - protein, 21 aa, Entamoeba dispar
EGTKVFLCLIQKLPEIKTSLI

SEQ ID NO: 2478854 - protein, 19 aa, Entamoeba dispar
EGTLSRLQSFLKIGKKDAN

SEQ ID NO: 2478855 - protein, 18 aa, Entamoeba dispar
EGTNCFQGLLSLKHISNY

SEQ ID NO: 2478856 - protein, 25 aa, Entamoeba dispar
EGTSISFIRDLLCFFEGKNKTLMFM

SEQ ID NO: 2478857 - protein, 20 aa, Entamoeba dispar
EGTTQCMFWGLGSDGTVGAN

SEQ ID NO: 2478858 - protein, 24 aa, Entamoeba dispar
EGVAEWLLKCQTYEGGFSGCPGGE

SEQ ID NO: 2478859 - protein, 21 aa, Entamoeba dispar
EGVAFKKCFSYAGFEQQPKLF

SEQ ID NO: 2478860 - protein, 21 aa, Entamoeba dispar
EGVFFADHRLKIIELPLKDGK

SEQ ID NO: 2478861 - protein, 20 aa, Entamoeba dispar
EGVIKLKQLFNGLITDYEFQ

SEQ ID NO: 2478862 - protein, 25 aa, Entamoeba dispar
EGVIKRRKENEASMRLLEKEIEVIS

SEQ ID NO: 2478863 - protein, 20 aa, Entamoeba dispar
EGVIPSVYGTKGYMKEFKKQ

SEQ ID NO: 2478864 - protein, 24 aa, Entamoeba dispar
EGVLEYPNDLLIALKALFNSITVK

SEQ ID NO: 2478865 - protein, 30 aa, Entamoeba dispar
EGVQRCCMEYKLKLPRMTKILFTSSDWSCW

SEQ ID NO: 2478866 - protein, 27 aa, Entamoeba dispar
EGVSSFKVFMVYDFFVTDGLFYKILKK

SEQ ID NO: 2478867 - protein, 23 aa, Entamoeba dispar
EGVTAIDLSKLVIRSIKDDCIGH

SEQ ID NO: 2478868 - protein, 18 aa, Entamoeba dispar
EGVYNFISQLLIIELKNR

SEQ ID NO: 2478869 - protein, 17 aa, Entamoeba dispar
EGWKQDLCKCIAHNTFS

SEQ ID NO: 2478870 - protein, 19 aa, Entamoeba dispar
EGWLRGFIDYESLVYSCSQ

SEQ ID NO: 2478871 - protein, 17 aa, Entamoeba dispar
EGWYEWWEKEGFFKPEY

SEQ ID NO: 2478872 - protein, 19 aa, Entamoeba dispar
EGYEEVIAAFYSRRIERKK

SEQ ID NO: 2478873 - protein, 19 aa, Entamoeba dispar
EGYEKCFNKPVSIGQLVTP

SEQ ID NO: 2478874 - protein, 18 aa, Entamoeba dispar
EGYERFLQKYFKTQTEQN

SEQ ID NO: 2478875 - protein, 30 aa, Entamoeba dispar
EGYEYSNYFILFLLCINFLYRQNNYAFEFD

SEQ ID NO: 2478876 - protein, 23 aa, Entamoeba dispar
EGYGRRIKFSKEFEQLISNNIVA

SEQ ID NO: 2478877 - protein, 20 aa, Entamoeba dispar
EGYHGLNCDIIVWNDVLQQS

SEQ ID NO: 2478878 - protein, 19 aa, Entamoeba dispar
EGYIDFCVKNDKYFVPFLQ

SEQ ID NO: 2478879 - protein, 21 aa, Entamoeba dispar
EGYPFRIAAVFQSPKQLLSSA

SEQ ID NO: 2478880 - protein, 18 aa, Entamoeba dispar
EGYYLTKDMKCLKCDDKC

SEQ ID NO: 2478881 - protein, 22 aa, Entamoeba dispar
EHCFCKCFLIKSESIPNNFIDL

SEQ ID NO: 2478882 - protein, 27 aa, Entamoeba dispar
EHELRRKVEIMVLEWAEKNCKTMDEKS

SEQ ID NO: 2478883 - protein, 19 aa, Entamoeba dispar
EHFKCGIKNVIVQLDDDEL

SEQ ID NO: 2478884 - protein, 30 aa, Entamoeba dispar
EHFMKKCHGYWPELFCCQDGVSLTEGILKP

SEQ ID NO: 2478885 - protein, 27 aa, Entamoeba dispar
EHFSNFFKRYIIQELIGRGSFGQVRKA

SEQ ID NO: 2478886 - protein, 25 aa, Entamoeba dispar
EHGLCPKYKLTEGFDGNDYYGIQIA

SEQ ID NO: 2478887 - protein, 21 aa, Entamoeba dispar
EHHNECFFCKTKIEGLKKRSE

SEQ ID NO: 2478888 - protein, 25 aa, Entamoeba dispar
EHICWNKFNLNECLLNKLWFNKLLD

SEQ ID NO: 2478889 - protein, 25 aa, Entamoeba dispar
EHIKEYLQKRIELIEKDIEKDIEEG

SEQ ID NO: 2478890 - protein, 18 aa, Entamoeba dispar
EHIYLLSVVQAFQLYEEF

SEQ ID NO: 2478891 - protein, 20 aa, Entamoeba dispar
EHIYNIFLYNDIRLTSNPVL

SEQ ID NO: 2478892 - protein, 27 aa, Entamoeba dispar
EHKIEWKLLIKKAENWLSNKPTLTEDI

SEQ ID NO: 2478893 - protein, 18 aa, Entamoeba dispar
EHKIKFHLSQSYVTSNPH

SEQ ID NO: 2478894 - protein, 21 aa, Entamoeba dispar
EHKLKGNEYLNAKDYSKAIDE

SEQ ID NO: 2478895 - protein, 26 aa, Entamoeba dispar
EHLAGKWPFWLSPRQVMVCTVSEKYN

SEQ ID NO: 2478896 - protein, 21 aa, Entamoeba dispar
EHLCLSSAKMIVMEKLVEKHL

SEQ ID NO: 2478897 - protein, 22 aa, Entamoeba dispar
EHLEMGKSLSVEQLMKIFELNT

SEQ ID NO: 2478898 - protein, 18 aa, Entamoeba dispar
EHLGCSFDDVDILMGTFS

SEQ ID NO: 2478899 - protein, 17 aa, Entamoeba dispar
EHLKICTLAVSLGCVDT

SEQ ID NO: 2478900 - protein, 21 aa, Entamoeba dispar
EHLRSRFNITSRMARKNIEYL

SEQ ID NO: 2478901 - protein, 21 aa, Entamoeba dispar
EHLYKNIIISPGYRMLSTQHV

SEQ ID NO: 2478902 - protein, 29 aa, Entamoeba dispar
EHNIGLATYKAWCKKFNKKSGKSVVNGTI

SEQ ID NO: 2478903 - protein, 30 aa, Entamoeba dispar
EHNKCGKLFCKKCLYQWWDIQRMMTCPFCR

SEQ ID NO: 2478904 - protein, 23 aa, Entamoeba dispar
EHPFYKYFMRGMLVTLATDSPMH

SEQ ID NO: 2478905 - protein, 20 aa, Entamoeba dispar
EHPLMYPDFVIGDRDKNADL

SEQ ID NO: 2478906 - protein, 21 aa, Entamoeba dispar
EHQFVGTILFTLSANKQAFIT

SEQ ID NO: 2478907 - protein, 18 aa, Entamoeba dispar
EHRGFRGTLQYASVNAHL

SEQ ID NO: 2478908 - protein, 20 aa, Entamoeba dispar
EHRQEIIDRFEIIQQIAETK

SEQ ID NO: 2478909 - protein, 17 aa, Entamoeba dispar
EHSKRKVLSTIILDEDG

SEQ ID NO: 2478910 - protein, 27 aa, Entamoeba dispar
EHSLLKRIICLPDVFFERRKLWEQLIN

SEQ ID NO: 2478911 - protein, 25 aa, Entamoeba dispar
EHSPEMYSWFPLFFPLISPIEVKRG

SEQ ID NO: 2478912 - protein, 28 aa, Entamoeba dispar
EHSVFGCCPCMKCNRYPLLPLGLYDNPG

SEQ ID NO: 2478913 - protein, 17 aa, Entamoeba dispar
EHVLSFFTHKLIPSIPR

SEQ ID NO: 2478914 - protein, 25 aa, Entamoeba dispar
EHVMNKPNICFFNFDENENIFGVFT

SEQ ID NO: 2478915 - protein, 18 aa, Entamoeba dispar
EHVPRLSLQQQTSISRLT

SEQ ID NO: 2478916 - protein, 24 aa, Entamoeba dispar
EHYQEFLDEIYIGIVSLPNVQQKK

SEQ ID NO: 2478917 - protein, 26 aa, Entamoeba dispar
EIAAICSRAGIYPNMLLSLVTSPPLF

SEQ ID NO: 2478918 - protein, 21 aa, Entamoeba dispar
EIAHGRFGSVFVAEVKKEFDV

SEQ ID NO: 2478919 - protein, 31 aa, Entamoeba dispar
EIAQKISKMLGCIVSGLMIISASKFVQDQMN

SEQ ID NO: 2478920 - protein, 18 aa, Entamoeba dispar
EIARCLLVSLASWKLTSK

SEQ ID NO: 2478921 - protein, 19 aa, Entamoeba dispar
EIASKLGIWTSRGKEKFDV

SEQ ID NO: 2478922 - protein, 18 aa, Entamoeba dispar
EIAYKCFYKCSSLQTINI

SEQ ID NO: 2478923 - protein, 19 aa, Entamoeba dispar
EICEIRLPLFGRLPTEKKE

SEQ ID NO: 2478924 - protein, 27 aa, Entamoeba dispar
EICIPSSLKKLGLTHCINLTKIKGLTH

SEQ ID NO: 2478925 - protein, 29 aa, Entamoeba dispar
EICKRRKCIRASIVFGEYQKICKLQLVNE

SEQ ID NO: 2478926 - protein, 27 aa, Entamoeba dispar
EICKTLLNDVPVCFVLNKADLSSQMNR

SEQ ID NO: 2478927 - protein, 21 aa, Entamoeba dispar
EICTLKRGNLKIIVKNEDIEI

SEQ ID NO: 2478928 - protein, 18 aa, Entamoeba dispar
EIDDFLSAFTVVKQEGDS

SEQ ID NO: 2478929 - protein, 24 aa, Entamoeba dispar
EIDGQWECCVSVKVSVKNTKTGVI

SEQ ID NO: 2478930 - protein, 20 aa, Entamoeba dispar
EIDIPITQICEFVGKRIMSK

SEQ ID NO: 2478931 - protein, 24 aa, Entamoeba dispar
EIDKEKELKRRKILEKFNQTNQSL

SEQ ID NO: 2478932 - protein, 19 aa, Entamoeba dispar
EIDKGFAKIVVENQKIYIE

SEQ ID NO: 2478933 - protein, 24 aa, Entamoeba dispar
EIDRLECKLHVYLPKEHKGEVFPD

SEQ ID NO: 2478934 - protein, 22 aa, Entamoeba dispar
EIDSSCFYGCLSLTSITIPITV

SEQ ID NO: 2478935 - protein, 28 aa, Entamoeba dispar
EIDTLKVLRSPYIIRYYTSVLRQEEFWI

SEQ ID NO: 2478936 - protein, 20 aa, Entamoeba dispar
EIDVKLGFNVSEFIEKMKPM

SEQ ID NO: 2478937 - protein, 20 aa, Entamoeba dispar
EIEDSCFDRCYSLKYINIPS

SEQ ID NO: 2478938 - protein, 26 aa, Entamoeba dispar
EIEECFRTPSSIFRRNSIFTRIIRIF

SEQ ID NO: 2478939 - protein, 19 aa, Entamoeba dispar
EIEEIKEFNIEALQRNVID

SEQ ID NO: 2478940 - protein, 18 aa, Entamoeba dispar
EIEELKLELDKMRRERDF

SEQ ID NO: 2478941 - protein, 21 aa, Entamoeba dispar
EIEELKLVFEYNTIFVEQELP

SEQ ID NO: 2478942 - protein, 19 aa, Entamoeba dispar
EIEEVKEWIGKKEYHTIYD

SEQ ID NO: 2478943 - protein, 19 aa, Entamoeba dispar
EIEEVKEWIGKKEYRTIYD

SEQ ID NO: 2478944 - protein, 20 aa, Entamoeba dispar
EIEEVMKLNLNESISYGVNV

SEQ ID NO: 2478945 - protein, 23 aa, Entamoeba dispar
EIEGNPVCSLCYVANHVPKCETC

SEQ ID NO: 2478946 - protein, 18 aa, Entamoeba dispar
EIEKCISINISLCPINTN

SEQ ID NO: 2478947 - protein, 23 aa, Entamoeba dispar
EIEKKNRFGLIITSKHQNICMLF

SEQ ID NO: 2478948 - protein, 22 aa, Entamoeba dispar
EIEKLKHDVTFTKQVTGDDAND

SEQ ID NO: 2478949 - protein, 18 aa, Entamoeba dispar
EIELIENVEIFGGTHPIF

SEQ ID NO: 2478950 - protein, 18 aa, Entamoeba dispar
EIELLKGDLELYRGKQKE

SEQ ID NO: 2478951 - protein, 18 aa, Entamoeba dispar
EIELPKSVVFIGQGALPE

SEQ ID NO: 2478952 - protein, 22 aa, Entamoeba dispar
EIEPRLNWKEFGKNYNLSKSNV

SEQ ID NO: 2478953 - protein, 21 aa, Entamoeba dispar
EIESRTSPYFVRLVNQRPPLR

SEQ ID NO: 2478954 - protein, 24 aa, Entamoeba dispar
EIEVILKEIMEWENSISQKMYEEF

SEQ ID NO: 2478955 - protein, 18 aa, Entamoeba dispar
EIEVQKEYLMKRVVELTQ

SEQ ID NO: 2478956 - protein, 23 aa, Entamoeba dispar
EIEYPTTIWDRWRPNTITDDIIT

SEQ ID NO: 2478957 - protein, 29 aa, Entamoeba dispar
EIFERIVPIYYRRSDIICIFVDLSKEIEV

SEQ ID NO: 2478958 - protein, 23 aa, Entamoeba dispar
EIFFSEKDLQGFGKITNHRINEF

SEQ ID NO: 2478959 - protein, 34 aa, Entamoeba dispar
EIFMKARQNAPCVIFFDEIDGMLGVASERGKVGY

SEQ ID NO: 2478960 - protein, 18 aa, Entamoeba dispar
EIFNNKLFERHNFNCTIK

SEQ ID NO: 2478961 - protein, 17 aa, Entamoeba dispar
EIFQFHFDLYVDSIIPR

SEQ ID NO: 2478962 - protein, 19 aa, Entamoeba dispar
EIGAFCFSKCLSLTNINLP

SEQ ID NO: 2478963 - protein, 25 aa, Entamoeba dispar
EIGCWCFEGCKLLTSITIPSTITEI

SEQ ID NO: 2478964 - protein, 23 aa, Entamoeba dispar
EIGDDCFYGCLSLTSINIPSTIS

SEQ ID NO: 2478965 - protein, 20 aa, Entamoeba dispar
EIGDGCFYECYSLTSINIPS

SEQ ID NO: 2478966 - protein, 22 aa, Entamoeba dispar
EIGDGCFYKCSLLTSINIPSSI

SEQ ID NO: 2478967 - protein, 24 aa, Entamoeba dispar
EIGDLCFCKCTSLTSITLPSSISK

SEQ ID NO: 2478968 - protein, 21 aa, Entamoeba dispar
EIGDSCFDECISLKSINVPSS

SEQ ID NO: 2478969 - protein, 20 aa, Entamoeba dispar
EIGDSCFDECITLKSINVPS

SEQ ID NO: 2478970 - protein, 20 aa, Entamoeba dispar
EIGDYCFYKCSSLKSINIPS

SEQ ID NO: 2478971 - protein, 19 aa, Entamoeba dispar
EIGDYCFYKCSSLKSINLP

SEQ ID NO: 2478972 - protein, 21 aa, Entamoeba dispar
EIGDYILSPNICIERKSAIDL

SEQ ID NO: 2478973 - protein, 25 aa, Entamoeba dispar
EIGECLRYGTLNSLYLLPKYSEKLR

SEQ ID NO: 2478974 - protein, 19 aa, Entamoeba dispar
EIGEYCFYGCTSLTRIEIP

SEQ ID NO: 2478975 - protein, 23 aa, Entamoeba dispar
EIGGYCFNGCLSLTSITIPSSIS

SEQ ID NO: 2478976 - protein, 18 aa, Entamoeba dispar
EIGGYCFSGCSSLQSINI

SEQ ID NO: 2478977 - protein, 17 aa, Entamoeba dispar
EIGLKMKTTFSLGNLEI

SEQ ID NO: 2478978 - protein, 22 aa, Entamoeba dispar
EIGNECFECCFSLTEIDIPTTI

SEQ ID NO: 2478979 - protein, 23 aa, Entamoeba dispar
EIGNGCFCKCTSLQSINIPTSIN

SEQ ID NO: 2478980 - protein, 23 aa, Entamoeba dispar
EIGNLRSLYELDLSNNQMDLLPE

SEQ ID NO: 2478981 - protein, 18 aa, Entamoeba dispar
EIGNRISLQKELIKAGVI

SEQ ID NO: 2478982 - protein, 21 aa, Entamoeba dispar
EIGNSCFLRCLSLTRINIPST

SEQ ID NO: 2478983 - protein, 21 aa, Entamoeba dispar
EIGNYCFYECISLTSINIPSS

SEQ ID NO: 2478984 - protein, 18 aa, Entamoeba dispar
EIGNYCFYGCSSLTSINI

SEQ ID NO: 2478985 - protein, 19 aa, Entamoeba dispar
EIGNYCFYGCSSLTTINIP

SEQ ID NO: 2478986 - protein, 21 aa, Entamoeba dispar
EIGNYCFYGCYSLKSINIPSS

SEQ ID NO: 2478987 - protein, 29 aa, Entamoeba dispar
EIGRYSIVIDEGWRKYAVDSLHKLIEKTD

SEQ ID NO: 2478988 - protein, 25 aa, Entamoeba dispar
EIGSELKLASAQVMALFNKAIRKVV

SEQ ID NO: 2478989 - protein, 17 aa, Entamoeba dispar
EIGTCCFYKCSSLTSIN

SEQ ID NO: 2478990 - protein, 25 aa, Entamoeba dispar
EIGTKLKIIVPYGTYPDEIEVETNY

SEQ ID NO: 2478991 - protein, 20 aa, Entamoeba dispar
EIGVRGCQDFMVSHKYFFES

SEQ ID NO: 2478992 - protein, 19 aa, Entamoeba dispar
EIGYCCFCECYSLRSINIS

SEQ ID NO: 2478993 - protein, 17 aa, Entamoeba dispar
EIGYEITNQIGIQYQRY

SEQ ID NO: 2478994 - protein, 25 aa, Entamoeba dispar
EIGYGCFKRCLLKSINIPSSINEIG

SEQ ID NO: 2478995 - protein, 25 aa, Entamoeba dispar
EIHIARLEYKYGSLIKEDQFKQKLN

SEQ ID NO: 2478996 - protein, 25 aa, Entamoeba dispar
EIHKTECMYCPISIGTEINDKLYIC

SEQ ID NO: 2478997 - protein, 17 aa, Entamoeba dispar
EIHRELKMKIAIKPEDF

SEQ ID NO: 2478998 - protein, 17 aa, Entamoeba dispar
EIIDIGITFEPRIINNI

SEQ ID NO: 2478999 - protein, 19 aa, Entamoeba dispar
EIIDRHSLPSAKVKHSQHK

SEQ ID NO: 2479000 - protein, 18 aa, Entamoeba dispar
EIIEFYKFNTNELLEIQI

SEQ ID NO: 2479001 - protein, 18 aa, Entamoeba dispar
EIIEGITSFDIRKITENY

SEQ ID NO: 2479002 - protein, 18 aa, Entamoeba dispar
EIIEKGYGMYKSYFNNVA

SEQ ID NO: 2479003 - protein, 17 aa, Entamoeba dispar
EIIFCKKNSKPIILSNK

SEQ ID NO: 2479004 - protein, 18 aa, Entamoeba dispar
EIIFKLVMNSSYGKTIQK

SEQ ID NO: 2479005 - protein, 17 aa, Entamoeba dispar
EIIFPRYSIHSISNLLK

SEQ ID NO: 2479006 - protein, 17 aa, Entamoeba dispar
EIIIFGSIDKFINTRKC

SEQ ID NO: 2479007 - protein, 20 aa, Entamoeba dispar
EIIIGLPYSPAIDMWSFGCV

SEQ ID NO: 2479008 - protein, 21 aa, Entamoeba dispar
EIIKDHCTLMMGIQIQMLLGI

SEQ ID NO: 2479009 - protein, 19 aa, Entamoeba dispar
EIIKLPTTVRTILTNDIEW

SEQ ID NO: 2479010 - protein, 24 aa, Entamoeba dispar
EIIKYSFEFEVKRLSNISISLLGK

SEQ ID NO: 2479011 - protein, 20 aa, Entamoeba dispar
EIILGLPYSCAIDMWSFGCV

SEQ ID NO: 2479012 - protein, 21 aa, Entamoeba dispar
EIILGLPYSCSIDMWSFGCVI

SEQ ID NO: 2479013 - protein, 18 aa, Entamoeba dispar
EIILHLFLLDSVDSDHPS

SEQ ID NO: 2479014 - protein, 18 aa, Entamoeba dispar
EIIMHCFNKRFLSSGNEV

SEQ ID NO: 2479015 - protein, 19 aa, Entamoeba dispar
EIINGFVLQTTPSGSILEV

SEQ ID NO: 2479016 - protein, 35 aa, Entamoeba dispar
EIINIGKECSLTFIDHSPFCRIHTFDGIIDSNNIV

SEQ ID NO: 2479017 - protein, 20 aa, Entamoeba dispar
EIINRMSVTNFKLLEPKELS

SEQ ID NO: 2479018 - protein, 27 aa, Entamoeba dispar
EIIPSSDFFPLFWQIASQFINNPLPGV

SEQ ID NO: 2479019 - protein, 18 aa, Entamoeba dispar
EIIQNVIFIISGKKTEYD

SEQ ID NO: 2479020 - protein, 20 aa, Entamoeba dispar
EIIQQLKLLFPEEHYFIQNQ

SEQ ID NO: 2479021 - protein, 24 aa, Entamoeba dispar
EIIRLKRKESQVIDLEKELNQLES

SEQ ID NO: 2479022 - protein, 23 aa, Entamoeba dispar
EIIRLLKEICEGIGMTVETIPTK

SEQ ID NO: 2479023 - protein, 31 aa, Entamoeba dispar
EIITIKTQDAWKMARATVKYDGIMCGMSSGA

SEQ ID NO: 2479024 - protein, 19 aa, Entamoeba dispar
EIIVDGLLYSLSIWDTAGH

SEQ ID NO: 2479025 - protein, 24 aa, Entamoeba dispar
EIIVIFIMKEWDTIWFTFSEDIIR

SEQ ID NO: 2479026 - protein, 26 aa, Entamoeba dispar
EIIYDIIKYLPIKRQIVLCSATLTGD

SEQ ID NO: 2479027 - protein, 18 aa, Entamoeba dispar
EIKECFRNLQSRSITCLN

SEQ ID NO: 2479028 - protein, 20 aa, Entamoeba dispar
EIKEHPLFVFNIYINSYTPQ

SEQ ID NO: 2479029 - protein, 31 aa, Entamoeba dispar
EIKEKSFIIGCAIRCGISLELERKTKNDEGL

SEQ ID NO: 2479030 - protein, 26 aa, Entamoeba dispar
EIKELFKSIPIAPLLVSNKKEKINNK

SEQ ID NO: 2479031 - protein, 21 aa, Entamoeba dispar
EIKELSAYMEVLFNQQVQIEK

SEQ ID NO: 2479032 - protein, 21 aa, Entamoeba dispar
EIKERGIVQGIFRECGKVSEI

SEQ ID NO: 2479033 - protein, 24 aa, Entamoeba dispar
EIKEWKSQINYIRKGDINFTSNTR

SEQ ID NO: 2479034 - protein, 22 aa, Entamoeba dispar
EIKGDLEAFLARENRFALLGRK

SEQ ID NO: 2479035 - protein, 18 aa, Entamoeba dispar
EIKGEGVLAIGGDVEEFT

SEQ ID NO: 2479036 - protein, 29 aa, Entamoeba dispar
EIKGKRVAIDISEIIIRCMKKKEDVNTMM

SEQ ID NO: 2479037 - protein, 17 aa, Entamoeba dispar
EIKKAYRKLAIKYHPDK

SEQ ID NO: 2479038 - protein, 18 aa, Entamoeba dispar
EIKKELDKNLAFETTQQI

SEQ ID NO: 2479039 - protein, 19 aa, Entamoeba dispar
EIKKIVIIKDLKGINKGYA

SEQ ID NO: 2479040 - protein, 19 aa, Entamoeba dispar
EIKKTYEVFYLNRDKVNNN

SEQ ID NO: 2479041 - protein, 21 aa, Entamoeba dispar
EIKLINKLFEVMKKTKYGITF

SEQ ID NO: 2479042 - protein, 27 aa, Entamoeba dispar
EIKLKECKGIEVISCNILPSFEDYVYE

SEQ ID NO: 2479043 - protein, 21 aa, Entamoeba dispar
EIKLRNMENLIQMKDTKIEQI

SEQ ID NO: 2479044 - protein, 31 aa, Entamoeba dispar
EIKNLLLSLRWRLFLKCLPEDSSLWTSVINE

SEQ ID NO: 2479045 - protein, 20 aa, Entamoeba dispar
EIKQKGFRLPQPGDNIDSPT

SEQ ID NO: 2479046 - protein, 23 aa, Entamoeba dispar
EIKQTATWCLSNILGGKDSSPAE

SEQ ID NO: 2479047 - protein, 18 aa, Entamoeba dispar
EIKQTYEVFYLNRDKINN

SEQ ID NO: 2479048 - protein, 19 aa, Entamoeba dispar
EIKQTYEVFYLNRDKINNN

SEQ ID NO: 2479049 - protein, 19 aa, Entamoeba dispar
EIKRLLKKKYVTTINSINM

SEQ ID NO: 2479050 - protein, 18 aa, Entamoeba dispar
EIKRQKCSKILKETELEE

SEQ ID NO: 2479051 - protein, 22 aa, Entamoeba dispar
EIKSNCFDGCLSIFEINLPPTI

SEQ ID NO: 2479052 - protein, 28 aa, Entamoeba dispar
EIKTTNCNLEMRFEELQCENDFLKGSNE

SEQ ID NO: 2479053 - protein, 19 aa, Entamoeba dispar
EILEKHPSVLKGRNQLDEF

SEQ ID NO: 2479054 - protein, 20 aa, Entamoeba dispar
EILESIKINIKGYFQNRKID

SEQ ID NO: 2479055 - protein, 31 aa, Entamoeba dispar
EILIKYMFSLKYGFKYLYYIIPKIISLSNSI

SEQ ID NO: 2479056 - protein, 18 aa, Entamoeba dispar
EILKDLGLQIGIVNINLM

SEQ ID NO: 2479057 - protein, 21 aa, Entamoeba dispar
EILKDQWLKGIKDYRPKSTVF

SEQ ID NO: 2479058 - protein, 30 aa, Entamoeba dispar
EILKEIAQEIYIRWKVRKLLREQSYDVERA

SEQ ID NO: 2479059 - protein, 25 aa, Entamoeba dispar
EILKKKGCQIEEIFEDPHYLLELKS

SEQ ID NO: 2479060 - protein, 24 aa, Entamoeba dispar
EILKLKISNEEGYKQKIHELSTKQ

SEQ ID NO: 2479061 - protein, 28 aa, Entamoeba dispar
EILKRTLLCKGNLLILFEGNEGNVFGIS

SEQ ID NO: 2479062 - protein, 26 aa, Entamoeba dispar
EILKTIPSLIGIIGMISIFHLYSKFQ

SEQ ID NO: 2479063 - protein, 18 aa, Entamoeba dispar
EILLGRIFSIVGHVVSCK

SEQ ID NO: 2479064 - protein, 20 aa, Entamoeba dispar
EILLTQLFAVCFYKEILTKT

SEQ ID NO: 2479065 - protein, 25 aa, Entamoeba dispar
EILNGKQQWRDVCIQIQNYYHNLIN

SEQ ID NO: 2479066 - protein, 18 aa, Entamoeba dispar
EILNIASLYEKETIYPPK

SEQ ID NO: 2479067 - protein, 29 aa, Entamoeba dispar
EILNMYKGDIESLISYSKRNELIRDNRSS

SEQ ID NO: 2479068 - protein, 20 aa, Entamoeba dispar
EILNYKIVFVVLLNDSLYED

SEQ ID NO: 2479069 - protein, 23 aa, Entamoeba dispar
EILPCGLCIELLGALHEMKHLNQ

SEQ ID NO: 2479070 - protein, 24 aa, Entamoeba dispar
EILPSYPSFFNYKVIKVPDLPTTN

SEQ ID NO: 2479071 - protein, 19 aa, Entamoeba dispar
EILQERFAPFLPTVLQIVL

SEQ ID NO: 2479072 - protein, 21 aa, Entamoeba dispar
EILRKGFLKYREMIKTHFNCD

SEQ ID NO: 2479073 - protein, 21 aa, Entamoeba dispar
EILRSMCGQIQLTDSITTKIV

SEQ ID NO: 2479074 - protein, 19 aa, Entamoeba dispar
EILSFTIYELLNFDPEIVF

SEQ ID NO: 2479075 - protein, 25 aa, Entamoeba dispar
EILSRPEIIENIKFDQSVKESLKNG

SEQ ID NO: 2479076 - protein, 18 aa, Entamoeba dispar
EILTVGLFAKENQLEDVF

SEQ ID NO: 2479077 - protein, 20 aa, Entamoeba dispar
EILWRWYVKKGMYEEAIKCI

SEQ ID NO: 2479078 - protein, 19 aa, Entamoeba dispar
EILYGYKLLEKLLPEIKTG

SEQ ID NO: 2479079 - protein, 24 aa, Entamoeba dispar
EILYSTLISIDFIERMFVNSTINY

SEQ ID NO: 2479080 - protein, 19 aa, Entamoeba dispar
EIMKKECTGKRFIENFIMP

SEQ ID NO: 2479081 - protein, 23 aa, Entamoeba dispar
EIMKRCCNIKYKIIISNSQINDI

SEQ ID NO: 2479082 - protein, 31 aa, Entamoeba dispar
EIMKTSFTLINWRSVIPTAPAHGLFLDQCHF

SEQ ID NO: 2479083 - protein, 22 aa, Entamoeba dispar
EIMNQSFRRRAFTVKKDGKTVG

SEQ ID NO: 2479084 - protein, 25 aa, Entamoeba dispar
EIMTRGVAGIKMLGNAAMDCCYVAC

SEQ ID NO: 2479085 - protein, 22 aa, Entamoeba dispar
EIMYGRERIDSIQIRKVNNKQK

SEQ ID NO: 2479086 - protein, 23 aa, Entamoeba dispar
EINECLNYILGIEINPLIIEILI

SEQ ID NO: 2479087 - protein, 17 aa, Entamoeba dispar
EINELLESFSIRDRELS

SEQ ID NO: 2479088 - protein, 18 aa, Entamoeba dispar
EINFKVSYHVSQLLEETG

SEQ ID NO: 2479089 - protein, 20 aa, Entamoeba dispar
EINICWCGNALEGYLGCKHH

SEQ ID NO: 2479090 - protein, 33 aa, Entamoeba dispar
EINKKIGAINCFFYPIIPFKWIADETVTSPMMN

SEQ ID NO: 2479091 - protein, 24 aa, Entamoeba dispar
EINLGYKIKLAIYKKENEKPFNLF

SEQ ID NO: 2479092 - protein, 22 aa, Entamoeba dispar
EINNLFVGMYIIEFDNVSGEKI

SEQ ID NO: 2479093 - protein, 22 aa, Entamoeba dispar
EINNRFNVLWVSGKMKGIDPVN

SEQ ID NO: 2479094 - protein, 24 aa, Entamoeba dispar
EINYELLQRLALSLHSFSKSFVKE

SEQ ID NO: 2479095 - protein, 20 aa, Entamoeba dispar
EIPENLKLINKRDFIKQGID

SEQ ID NO: 2479096 - protein, 23 aa, Entamoeba dispar
EIPHEGAFCDLMWSDPDDSVDGM

SEQ ID NO: 2479097 - protein, 20 aa, Entamoeba dispar
EIPILQPLHVYVCQNHLDEI

SEQ ID NO: 2479098 - protein, 25 aa, Entamoeba dispar
EIPKEVLDSCLGSRVMVKVVTSEDG

SEQ ID NO: 2479099 - protein, 20 aa, Entamoeba dispar
EIPNCCFFRCYSLSQINIPK

SEQ ID NO: 2479100 - protein, 22 aa, Entamoeba dispar
EIPNKIKIKFMLDGAKGISYLH

SEQ ID NO: 2479101 - protein, 24 aa, Entamoeba dispar
EIPSLLKLDLCRNYILEIPSCLSL

SEQ ID NO: 2479102 - protein, 18 aa, Entamoeba dispar
EIPSLMKSTSISRKPPPS

SEQ ID NO: 2479103 - protein, 23 aa, Entamoeba dispar
EIPSNSKIILTFQIGKKVKSVQF

SEQ ID NO: 2479104 - protein, 26 aa, Entamoeba dispar
EIPSNTSLFLVEWKGFSILRSTWVLR

SEQ ID NO: 2479105 - protein, 20 aa, Entamoeba dispar
EIPYSLSFIRSVARQTVQFL

SEQ ID NO: 2479106 - protein, 18 aa, Entamoeba dispar
EIQCLTFSTKDIFLVSGS

SEQ ID NO: 2479107 - protein, 21 aa, Entamoeba dispar
EIQGIVICSDFNYLRSSNLKR

SEQ ID NO: 2479108 - protein, 17 aa, Entamoeba dispar
EIQKMDELCVSKQEEKK

SEQ ID NO: 2479109 - protein, 19 aa, Entamoeba dispar
EIQLFKGILQRDGTLDKEK

SEQ ID NO: 2479110 - protein, 22 aa, Entamoeba dispar
EIQMKLEHQEFVEIQKLKNDKK

SEQ ID NO: 2479111 - protein, 22 aa, Entamoeba dispar
EIQPYLLRRVKGNVEKSIPPKE

SEQ ID NO: 2479112 - protein, 23 aa, Entamoeba dispar
EIQRIKDAISEFERNHAQVEEKI

SEQ ID NO: 2479113 - protein, 22 aa, Entamoeba dispar
EIQSGKICAIFIEKNFNGKSEY

SEQ ID NO: 2479114 - protein, 25 aa, Entamoeba dispar
EIRDLPIEIGELFNLEDLNLNNNQI

SEQ ID NO: 2479115 - protein, 19 aa, Entamoeba dispar
EIREKEITENIAFTLLFAD

SEQ ID NO: 2479116 - protein, 23 aa, Entamoeba dispar
EIREKFITCGRISRMMMQYYPNG

SEQ ID NO: 2479117 - protein, 19 aa, Entamoeba dispar
EIREKFKWYYEKFGQYMPN

SEQ ID NO: 2479118 - protein, 21 aa, Entamoeba dispar
EIRFNLPQWQKFPIFAKIRES

SEQ ID NO: 2479119 - protein, 22 aa, Entamoeba dispar
EIRKELKLLDAPSWALQLKHDD

SEQ ID NO: 2479120 - protein, 23 aa, Entamoeba dispar
EIRKRKECYDFKTLCSPKKIIGA

SEQ ID NO: 2479121 - protein, 18 aa, Entamoeba dispar
EIRLKKQISSWLINTLFS

SEQ ID NO: 2479122 - protein, 20 aa, Entamoeba dispar
EIRNWKAFVRFMEENQKILQ

SEQ ID NO: 2479123 - protein, 21 aa, Entamoeba dispar
EIRTSPLIFHVIEVPKKVCCS

SEQ ID NO: 2479124 - protein, 21 aa, Entamoeba dispar
EIRVVSCRQVRNLSVITLDNN

SEQ ID NO: 2479125 - protein, 21 aa, Entamoeba dispar
EISASNGFIGYILTSARTCHN

SEQ ID NO: 2479126 - protein, 24 aa, Entamoeba dispar
EISEIPLGCNFSLLTHLDLSQNNL

SEQ ID NO: 2479127 - protein, 18 aa, Entamoeba dispar
EISLEWKKETGYKRKYQF

SEQ ID NO: 2479128 - protein, 21 aa, Entamoeba dispar
EISLFPNIETLRCDIETIKIL

SEQ ID NO: 2479129 - protein, 20 aa, Entamoeba dispar
EISLIRKIMESINNEEEMSP

SEQ ID NO: 2479130 - protein, 25 aa, Entamoeba dispar
EISSEMMNWLGLRNDQLGGIVPTFG

SEQ ID NO: 2479131 - protein, 22 aa, Entamoeba dispar
EISVIVPSCCGIINYPKSCDGV

SEQ ID NO: 2479132 - protein, 17 aa, Entamoeba dispar
EITEFFINYFKNIKPKL

SEQ ID NO: 2479133 - protein, 23 aa, Entamoeba dispar
EITEKKYWMGINEKQFYSTLNTY

SEQ ID NO: 2479134 - protein, 19 aa, Entamoeba dispar
EITELKIKVIENGCRVIYA

SEQ ID NO: 2479135 - protein, 31 aa, Entamoeba dispar
EITELKQLVPVECKFLLLKRINKTKINLLKC

SEQ ID NO: 2479136 - protein, 19 aa, Entamoeba dispar
EITENIAFTLLFADFECMI

SEQ ID NO: 2479137 - protein, 18 aa, Entamoeba dispar
EITEVCENYAFVICNNTT

SEQ ID NO: 2479138 - protein, 22 aa, Entamoeba dispar
EITEWCCIVCEKSFKSENQLKS

SEQ ID NO: 2479139 - protein, 25 aa, Entamoeba dispar
EITEWGYGWELLRGIGSVVLNSIKF

SEQ ID NO: 2479140 - protein, 18 aa, Entamoeba dispar
EITGRLNAYAGKNHPPEI

SEQ ID NO: 2479141 - protein, 23 aa, Entamoeba dispar
EITHPTLLFIQNWFSYDPFLFIK

SEQ ID NO: 2479142 - protein, 18 aa, Entamoeba dispar
EITIKLKCEKQVIETTVS

SEQ ID NO: 2479143 - protein, 24 aa, Entamoeba dispar
EITKQKLDCYFIMKGTVICEKKKD

SEQ ID NO: 2479144 - protein, 25 aa, Entamoeba dispar
EITKSGRTPFHYAVLGGHLGLVRKI

SEQ ID NO: 2479145 - protein, 21 aa, Entamoeba dispar
EITLSLAQFACLIISKCSNFN

SEQ ID NO: 2479146 - protein, 17 aa, Entamoeba dispar
EITNYEYLIYLNFIAGR

SEQ ID NO: 2479147 - protein, 39 aa, Entamoeba dispar
EITPSIIKNDICEIQKLLGYFANNFVTRSEIVTCSILER

SEQ ID NO: 2479148 - protein, 22 aa, Entamoeba dispar
EITQQIFCEWSKINKNESIPDF

SEQ ID NO: 2479149 - protein, 17 aa, Entamoeba dispar
EITRFLNNILKSFDNEN

SEQ ID NO: 2479150 - protein, 20 aa, Entamoeba dispar
EITSAMSIVGYEIKRQLNLR

SEQ ID NO: 2479151 - protein, 18 aa, Entamoeba dispar
EITSLIPSMEHFTRKIQE

SEQ ID NO: 2479152 - protein, 17 aa, Entamoeba dispar
EIVEFCNLIVGTWKLNE

SEQ ID NO: 2479153 - protein, 18 aa, Entamoeba dispar
EIVIDHFYFIKGCNHCSH

SEQ ID NO: 2479154 - protein, 19 aa, Entamoeba dispar
EIVKEMFSYVDGFCISLKK

SEQ ID NO: 2479155 - protein, 21 aa, Entamoeba dispar
EIVKFIMILFESFILNKVKVQ

SEQ ID NO: 2479156 - protein, 20 aa, Entamoeba dispar
EIVKILIPFTSNFKMPNKKI

SEQ ID NO: 2479157 - protein, 18 aa, Entamoeba dispar
EIVMARQQISLLLKQLEI

SEQ ID NO: 2479158 - protein, 20 aa, Entamoeba dispar
EIVQFFYKYCNDIINYSKST

SEQ ID NO: 2479159 - protein, 24 aa, Entamoeba dispar
EIVVKRGKQVIVFVHTRRETVLTA

SEQ ID NO: 2479160 - protein, 18 aa, Entamoeba dispar
EIVWDNLDLILIGILLRK

SEQ ID NO: 2479161 - protein, 19 aa, Entamoeba dispar
EIWNIPNYFEIIKTPMDLG

SEQ ID NO: 2479162 - protein, 21 aa, Entamoeba dispar
EIWQNRFNILIQFPDSIDLLL

SEQ ID NO: 2479163 - protein, 17 aa, Entamoeba dispar
EIWRECTEFCTSKTCLI

SEQ ID NO: 2479164 - protein, 27 aa, Entamoeba dispar
EIYCQECGKRFCIKCYKKTHKGIYHSL

SEQ ID NO: 2479165 - protein, 23 aa, Entamoeba dispar
EIYDCRRTIKVIFNQDEHNYWND

SEQ ID NO: 2479166 - protein, 19 aa, Entamoeba dispar
EIYDRIFTMLVQKVNIALQ

SEQ ID NO: 2479167 - protein, 25 aa, Entamoeba dispar
EIYEFVKEFKISSTIEHNMLTKLNS

SEQ ID NO: 2479168 - protein, 18 aa, Entamoeba dispar
EIYEKEGYQIISSSLFLF

SEQ ID NO: 2479169 - protein, 19 aa, Entamoeba dispar
EIYLYSFGDSISRGTSTCN

SEQ ID NO: 2479170 - protein, 19 aa, Entamoeba dispar
EIYNFPWDIADAITSGKRP

SEQ ID NO: 2479171 - protein, 25 aa, Entamoeba dispar
EIYNFPWDIADAITSGKRPPIIQEV

SEQ ID NO: 2479172 - protein, 24 aa, Entamoeba dispar
EIYNFPWDIAESITSGKRPPIIQE

SEQ ID NO: 2479173 - protein, 22 aa, Entamoeba dispar
EIYSDIVNRYGLVIFDYNGDSR

SEQ ID NO: 2479174 - protein, 26 aa, Entamoeba dispar
EIYTMFVKRSLLASGLSEEEAEKKVD

SEQ ID NO: 2479175 - protein, 25 aa, Entamoeba dispar
EIYYKRLRFLQIKLFNTSLKSYSKL

SEQ ID NO: 2479176 - protein, 21 aa, Entamoeba dispar
EKAIIVGVFKICVNRYRETTQ

SEQ ID NO: 2479177 - protein, 18 aa, Entamoeba dispar
EKAIKMSLEDNIKPNQSQ

SEQ ID NO: 2479178 - protein, 17 aa, Entamoeba dispar
EKAKCIKSPLFHSLVGY

SEQ ID NO: 2479179 - protein, 28 aa, Entamoeba dispar
EKAKELKRRVPLLIGEVWFGGCERRILQ

SEQ ID NO: 2479180 - protein, 21 aa, Entamoeba dispar
EKAQHIVYFWQGRDASIMDMG

SEQ ID NO: 2479181 - protein, 28 aa, Entamoeba dispar
EKATLIKRRVVIALKYFCSDALDECNQG

SEQ ID NO: 2479182 - protein, 17 aa, Entamoeba dispar
EKAYRLIEYYPKLYKNL

SEQ ID NO: 2479183 - protein, 28 aa, Entamoeba dispar
EKCKGVPKSFIFCIGNFGGILDLYKPPR

SEQ ID NO: 2479184 - protein, 23 aa, Entamoeba dispar
EKCKNKLLIRICDKKINVIGIVT

SEQ ID NO: 2479185 - protein, 19 aa, Entamoeba dispar
EKDCGKTSLITRYINDIYF

SEQ ID NO: 2479186 - protein, 18 aa, Entamoeba dispar
EKDDIVWILSEQGDFAII

SEQ ID NO: 2479187 - protein, 25 aa, Entamoeba dispar
EKDGKEVIDTICLLFPEFDNKVNII

SEQ ID NO: 2479188 - protein, 26 aa, Entamoeba dispar
EKDHPYVLKCCGGFFASPYNTLEYWM

SEQ ID NO: 2479189 - protein, 23 aa, Entamoeba dispar
EKDILYTIKSCFIGDPSTIEDRK

SEQ ID NO: 2479190 - protein, 23 aa, Entamoeba dispar
EKDIPVSFEVPFRELKFGGTIKR

SEQ ID NO: 2479191 - protein, 20 aa, Entamoeba dispar
EKDKIIIRIINIIRINNTTE

SEQ ID NO: 2479192 - protein, 19 aa, Entamoeba dispar
EKDKIIIRIINIIRTNNTT

SEQ ID NO: 2479193 - protein, 19 aa, Entamoeba dispar
EKDKRILMDVTIASFLCKV

SEQ ID NO: 2479194 - protein, 32 aa, Entamoeba dispar
EKDKVNCAFFFKIGACRHGDSCTRNHFQPEIS

SEQ ID NO: 2479195 - protein, 20 aa, Entamoeba dispar
EKDLKEKKLSIFLDNAILKR

SEQ ID NO: 2479196 - protein, 23 aa, Entamoeba dispar
EKDNWEFGEFLSFQDIAIYGTLI

SEQ ID NO: 2479197 - protein, 24 aa, Entamoeba dispar
EKEAFWEKKKMWLIEDEEDKKVLF

SEQ ID NO: 2479198 - protein, 20 aa, Entamoeba dispar
EKECGVGVIVTREQIIEGVK

SEQ ID NO: 2479199 - protein, 18 aa, Entamoeba dispar
EKECYEIQNKLAEAEKII

SEQ ID NO: 2479200 - protein, 21 aa, Entamoeba dispar
EKEEFKRKTEQYILELERSLS

SEQ ID NO: 2479201 - protein, 24 aa, Entamoeba dispar
EKEELKGDIQWREEAITIREELSL

SEQ ID NO: 2479202 - protein, 25 aa, Entamoeba dispar
EKEEYEGTTCCKFLVKLKGIESKDR

SEQ ID NO: 2479203 - protein, 24 aa, Entamoeba dispar
EKEGMKVFDVMAIIYQHITMLHDY

SEQ ID NO: 2479204 - protein, 18 aa, Entamoeba dispar
EKEIECTIIVTPTALLLV

SEQ ID NO: 2479205 - protein, 18 aa, Entamoeba dispar
EKEIIQFCSYYKELLKKQ

SEQ ID NO: 2479206 - protein, 18 aa, Entamoeba dispar
EKEIIVGEVIGNNTKELK

SEQ ID NO: 2479207 - protein, 33 aa, Entamoeba dispar
EKEIKKRHSATLSFEELISWITPLQHQFFEVLK

SEQ ID NO: 2479208 - protein, 25 aa, Entamoeba dispar
EKEKCCIKGDESLFDLLFGYEQSLL

SEQ ID NO: 2479209 - protein, 22 aa, Entamoeba dispar
EKEKEGKKELQIEINKINTQMK

SEQ ID NO: 2479210 - protein, 19 aa, Entamoeba dispar
EKEKGFIVDNLLSVNRMRS

SEQ ID NO: 2479211 - protein, 23 aa, Entamoeba dispar
EKEKGICLEYCILPSHVCGIERR

SEQ ID NO: 2479212 - protein, 25 aa, Entamoeba dispar
EKEKHISLNLGDFVDDFIKEVNSKA

SEQ ID NO: 2479213 - protein, 18 aa, Entamoeba dispar
EKEKLSLDLTNGNDGINQ

SEQ ID NO: 2479214 - protein, 20 aa, Entamoeba dispar
EKELIPLARIERKYDYDSIN

SEQ ID NO: 2479215 - protein, 28 aa, Entamoeba dispar
EKELKIKEIELLNSQLFELQKESRRKEN

SEQ ID NO: 2479216 - protein, 23 aa, Entamoeba dispar
EKELKIRLCGSETNWDLFKMWTG

SEQ ID NO: 2479217 - protein, 20 aa, Entamoeba dispar
EKELSLKLKDIIRVYEYPNK

SEQ ID NO: 2479218 - protein, 22 aa, Entamoeba dispar
EKEMFVIGTAFAKPNEVEPSSG

SEQ ID NO: 2479219 - protein, 31 aa, Entamoeba dispar
EKENALRLIKLRKIRESNLKKIQSQRDNLEA

SEQ ID NO: 2479220 - protein, 18 aa, Entamoeba dispar
EKEPIVFTQRSFKRNRMN

SEQ ID NO: 2479221 - protein, 20 aa, Entamoeba dispar
EKEPLRWSWAENKEKSKEMF

SEQ ID NO: 2479222 - protein, 24 aa, Entamoeba dispar
EKEPNKRYIRCVTDYLETYVRVNP

SEQ ID NO: 2479223 - protein, 23 aa, Entamoeba dispar
EKEQWLPPRKRVSINTTEDKKED

SEQ ID NO: 2479224 - protein, 21 aa, Entamoeba dispar
EKERCVPTSMIGKMFLIEYSP

SEQ ID NO: 2479225 - protein, 17 aa, Entamoeba dispar
EKEREAEQFKKHVEEVL

SEQ ID NO: 2479226 - protein, 24 aa, Entamoeba dispar
EKERLEILTVLQLIIFSKSEQLMN

SEQ ID NO: 2479227 - protein, 17 aa, Entamoeba dispar
EKERRTVFVRGLTTEAS

SEQ ID NO: 2479228 - protein, 26 aa, Entamoeba dispar
EKERSLRVGIIDFIRTYTWDKQLESV

SEQ ID NO: 2479229 - protein, 23 aa, Entamoeba dispar
EKESMYLCYFNAMLQNNFFRKEY

SEQ ID NO: 2479230 - protein, 32 aa, Entamoeba dispar
EKESRKFAEMIVSYLLRFGNDINTWNSGNEFN

SEQ ID NO: 2479231 - protein, 22 aa, Entamoeba dispar
EKEVFQGFTGCEMYGIFKHGHI

SEQ ID NO: 2479232 - protein, 21 aa, Entamoeba dispar
EKEVSMFLFNFHHQKISRKNE

SEQ ID NO: 2479233 - protein, 22 aa, Entamoeba dispar
EKEVYRCILYYYELFQQSLNEL

SEQ ID NO: 2479234 - protein, 20 aa, Entamoeba dispar
EKEYEIFKKSLVSSIEDPFI

SEQ ID NO: 2479235 - protein, 19 aa, Entamoeba dispar
EKFAQIAVDAIEKIGDADI

SEQ ID NO: 2479236 - protein, 20 aa, Entamoeba dispar
EKFFEAIEPYLISLENKEKT

SEQ ID NO: 2479237 - protein, 24 aa, Entamoeba dispar
EKFFKSRYFGGIVVRQMEKNVRDE

SEQ ID NO: 2479238 - protein, 17 aa, Entamoeba dispar
EKFKFSNSFFTLNDLDN

SEQ ID NO: 2479239 - protein, 20 aa, Entamoeba dispar
EKFLSERKQIITSFINEVSE

SEQ ID NO: 2479240 - protein, 17 aa, Entamoeba dispar
EKFNVIGKYCFQKCYDF

SEQ ID NO: 2479241 - protein, 17 aa, Entamoeba dispar
EKFNVIGKYCFQKCYNV

SEQ ID NO: 2479242 - protein, 25 aa, Entamoeba dispar
EKFNVIGKYCFRKCYDFVDFDIPTH

SEQ ID NO: 2479243 - protein, 25 aa, Entamoeba dispar
EKFRCITRGYFRGSIGAIIVYDISN

SEQ ID NO: 2479244 - protein, 19 aa, Entamoeba dispar
EKFTTIFLGETNDELRKYL

SEQ ID NO: 2479245 - protein, 24 aa, Entamoeba dispar
EKFVFELFNRIQLVDEVTYDLKRK

SEQ ID NO: 2479246 - protein, 23 aa, Entamoeba dispar
EKGEFTFWNGLQFNFACLSGAHD

SEQ ID NO: 2479247 - protein, 32 aa, Entamoeba dispar
EKGILERLKHPFIVHLEWDFETPFYYIFVMTY

SEQ ID NO: 2479248 - protein, 21 aa, Entamoeba dispar
EKGKKSFEYAWVMDTDDEERN

SEQ ID NO: 2479249 - protein, 24 aa, Entamoeba dispar
EKGLKYIIKCLIIGYPENDSKKEE

SEQ ID NO: 2479250 - protein, 18 aa, Entamoeba dispar
EKGLRMIHITSLKDPQIF

SEQ ID NO: 2479251 - protein, 25 aa, Entamoeba dispar
EKGPSLQIGKTFLVSSYLFDLYELF

SEQ ID NO: 2479252 - protein, 17 aa, Entamoeba dispar
EKGRQGVFVREKPVFCV

SEQ ID NO: 2479253 - protein, 25 aa, Entamoeba dispar
EKGSIQCDWLFDSICSNCQLETKDY

SEQ ID NO: 2479254 - protein, 23 aa, Entamoeba dispar
EKGVRVFHIQNIINIFSGIETLQ

SEQ ID NO: 2479255 - protein, 23 aa, Entamoeba dispar
EKGYTRWQLKNGVLYAYLQEEKN

SEQ ID NO: 2479256 - protein, 20 aa, Entamoeba dispar
EKHIKFYTIDAIKIGQEVKL

SEQ ID NO: 2479257 - protein, 23 aa, Entamoeba dispar
EKHKCNARGWFVNVWKMVQEYIT

SEQ ID NO: 2479258 - protein, 17 aa, Entamoeba dispar
EKHKTKRIITGFRSDDI

SEQ ID NO: 2479259 - protein, 17 aa, Entamoeba dispar
EKHLKVLTIIKKQNDLI

SEQ ID NO: 2479260 - protein, 19 aa, Entamoeba dispar
EKHLYLIFEYCNTDLHKFL

SEQ ID NO: 2479261 - protein, 20 aa, Entamoeba dispar
EKHLYLIFEYCNTDLHKFLK

SEQ ID NO: 2479262 - protein, 30 aa, Entamoeba dispar
EKHNFKECLTSVIIELCIKLLDSNEFDQSL

SEQ ID NO: 2479263 - protein, 19 aa, Entamoeba dispar
EKIARSCIGTGDQEEIKGI

SEQ ID NO: 2479264 - protein, 24 aa, Entamoeba dispar
EKICCSKGFQIKYVMSYMDMYSCD

SEQ ID NO: 2479265 - protein, 26 aa, Entamoeba dispar
EKIEEMKRKVICITFSTNEKTKEFEK

SEQ ID NO: 2479266 - protein, 24 aa, Entamoeba dispar
EKIEFLKYITCRYLDVLSSEVYYK

SEQ ID NO: 2479267 - protein, 22 aa, Entamoeba dispar
EKIELRISVSINLPKEDGNFIT

SEQ ID NO: 2479268 - protein, 25 aa, Entamoeba dispar
EKIGRPESISNFMIKYDLNKNDFIQ

SEQ ID NO: 2479269 - protein, 22 aa, Entamoeba dispar
EKIGSHCFFCCNNLSKVTFSDK

SEQ ID NO: 2479270 - protein, 27 aa, Entamoeba dispar
EKIGTPIYSFLCSYLLKTNTPQSKGLF

SEQ ID NO: 2479271 - protein, 19 aa, Entamoeba dispar
EKIHGVALIGGMVIDEVSR

SEQ ID NO: 2479272 - protein, 23 aa, Entamoeba dispar
EKIHKKELIDFIVSSLPKRGSIK

SEQ ID NO: 2479273 - protein, 18 aa, Entamoeba dispar
EKIICLWDSRKLDHYFAS

SEQ ID NO: 2479274 - protein, 19 aa, Entamoeba dispar
EKIIKGGINLGTQELEITC

SEQ ID NO: 2479275 - protein, 24 aa, Entamoeba dispar
EKIIKRMINISIVFECKKSGDENA

SEQ ID NO: 2479276 - protein, 19 aa, Entamoeba dispar
EKIKAVVLPNNLGSYSREQ

SEQ ID NO: 2479277 - protein, 17 aa, Entamoeba dispar
EKIKGIKSADDIKRKNR

SEQ ID NO: 2479278 - protein, 23 aa, Entamoeba dispar
EKIKLEGFGAYSGGLDTKFNETG

SEQ ID NO: 2479279 - protein, 28 aa, Entamoeba dispar
EKIKNCIELLMKCWILYDLDKGYQQGMS

SEQ ID NO: 2479280 - protein, 23 aa, Entamoeba dispar
EKIKRIGYDVGNRLTERFTDFEK

SEQ ID NO: 2479281 - protein, 27 aa, Entamoeba dispar
EKIKSFLPDDVKLFQFNALTQKEDIQS

SEQ ID NO: 2479282 - protein, 17 aa, Entamoeba dispar
EKINLSSLEEWSEKIKK

SEQ ID NO: 2479283 - protein, 25 aa, Entamoeba dispar
EKIPEGKRLCVISTDIAETSITIPN

SEQ ID NO: 2479284 - protein, 26 aa, Entamoeba dispar
EKIPEGKRLCVISTDIAETSITIPNI

SEQ ID NO: 2479285 - protein, 25 aa, Entamoeba dispar
EKIPYEMYKRKEGKIETQVTLPSTM

SEQ ID NO: 2479286 - protein, 23 aa, Entamoeba dispar
EKIQKKTLCKRSYSNKQEKENNV

SEQ ID NO: 2479287 - protein, 24 aa, Entamoeba dispar
EKIRAKICFDIVKALFYMHENGGI

SEQ ID NO: 2479288 - protein, 17 aa, Entamoeba dispar
EKIRFLIHNVEKTKEKM

SEQ ID NO: 2479289 - protein, 24 aa, Entamoeba dispar
EKIRKMMIEICLEYPSKDKLFSIL

SEQ ID NO: 2479290 - protein, 19 aa, Entamoeba dispar
EKIRTNVCELCQERKTLTN

SEQ ID NO: 2479291 - protein, 25 aa, Entamoeba dispar
EKITLCIIEPLLFPLKITAYYFVDN

SEQ ID NO: 2479292 - protein, 17 aa, Entamoeba dispar
EKIYMLVIRQIHDIYNE

SEQ ID NO: 2479293 - protein, 19 aa, Entamoeba dispar
EKKARMGPMKKDLERQRAE

SEQ ID NO: 2479294 - protein, 20 aa, Entamoeba dispar
EKKEGSVLIACIPSNSSITQ

SEQ ID NO: 2479295 - protein, 18 aa, Entamoeba dispar
EKKEWLIEKEELKGDIQW

SEQ ID NO: 2479296 - protein, 17 aa, Entamoeba dispar
EKKFIKKECQLNIENEI

SEQ ID NO: 2479297 - protein, 23 aa, Entamoeba dispar
EKKFPKVRVTLEAFEELQDFRKK

SEQ ID NO: 2479298 - protein, 22 aa, Entamoeba dispar
EKKGVNEFILFSDMVAIYQKQF

SEQ ID NO: 2479299 - protein, 24 aa, Entamoeba dispar
EKKHPKFSGGMFSRERDSYDDDSD

SEQ ID NO: 2479300 - protein, 25 aa, Entamoeba dispar
EKKIIIRPSQDFSIETCKKYIEIIK

SEQ ID NO: 2479301 - protein, 23 aa, Entamoeba dispar
EKKIPLEGSIGIDQSIVYPSWIS

SEQ ID NO: 2479302 - protein, 20 aa, Entamoeba dispar
  misc_feature (15)..(16): Xaa can be any naturally occurring amino acid
EKKKMIIILLLMRMXXSKKK

SEQ ID NO: 2479303 - protein, 23 aa, Entamoeba dispar
EKKKNAMILLSFYNACNKIPELI

SEQ ID NO: 2479304 - protein, 20 aa, Entamoeba dispar
EKKKRIKIIAVEPEESAVLE

SEQ ID NO: 2479305 - protein, 21 aa, Entamoeba dispar
EKKLKHLSEWKEFKYMRRLSQ

SEQ ID NO: 2479306 - protein, 22 aa, Entamoeba dispar
EKKLNGPVFIIGKRVVAHTKKV

SEQ ID NO: 2479307 - protein, 21 aa, Entamoeba dispar
EKKMIKSCFGVSTITEIANNS

SEQ ID NO: 2479308 - protein, 17 aa, Entamoeba dispar
EKKMMGMDINKIGISLI

SEQ ID NO: 2479309 - protein, 29 aa, Entamoeba dispar
EKKMPIDIAKDVSYDFGQKILTPDFPREL

SEQ ID NO: 2479310 - protein, 22 aa, Entamoeba dispar
EKKMTFEVFEKLQIKPIKMKIP

SEQ ID NO: 2479311 - protein, 27 aa, Entamoeba dispar
EKKNFRKSFKLPFSRNSLGINLDLCHS

SEQ ID NO: 2479312 - protein, 23 aa, Entamoeba dispar
EKKRDCIEKCGLFEHKKGLVWSQ

SEQ ID NO: 2479313 - protein, 22 aa, Entamoeba dispar
EKKREAFMCPALYLISPTKESV

SEQ ID NO: 2479314 - protein, 25 aa, Entamoeba dispar
EKKSIPTEMTIYILTKLKEQNPNYF

SEQ ID NO: 2479315 - protein, 21 aa, Entamoeba dispar
EKKSWKTGIDINSLTLDSLQV

SEQ ID NO: 2479316 - protein, 22 aa, Entamoeba dispar
EKKTEFPQIHLNTIDIQKEKHQ

SEQ ID NO: 2479317 - protein, 26 aa, Entamoeba dispar
EKKVSRERLLSFMFKRKTNEKTTISE

SEQ ID NO: 2479318 - protein, 19 aa, Entamoeba dispar
EKKYWLYLIVSEAGEINVV

SEQ ID NO: 2479319 - protein, 17 aa, Entamoeba dispar
EKLCPTVLYVPGNHDPT

SEQ ID NO: 2479320 - protein, 24 aa, Entamoeba dispar
EKLEPPKPIILNGIEIKQKGSEDE

SEQ ID NO: 2479321 - protein, 17 aa, Entamoeba dispar
EKLGLSRGSLKFEKKQF

SEQ ID NO: 2479322 - protein, 19 aa, Entamoeba dispar
EKLIAAGIMKQSDLPIEEI

SEQ ID NO: 2479323 - protein, 18 aa, Entamoeba dispar
EKLIEIMQKWKLFLENTK

SEQ ID NO: 2479324 - protein, 19 aa, Entamoeba dispar
EKLIFVFKTENGFIGFYQS

SEQ ID NO: 2479325 - protein, 25 aa, Entamoeba dispar
EKLIHPKRYECVLSNASTFSENTIS

SEQ ID NO: 2479326 - protein, 18 aa, Entamoeba dispar
EKLIKFSSIPPITGNSLI

SEQ ID NO: 2479327 - protein, 24 aa, Entamoeba dispar
EKLIRMAKSFGLEVTCSASAITQP

SEQ ID NO: 2479328 - protein, 19 aa, Entamoeba dispar
EKLKEFKKRGTLYTNTGGA

SEQ ID NO: 2479329 - protein, 21 aa, Entamoeba dispar
EKLKKSMTFPENFYQKVDFNK

SEQ ID NO: 2479330 - protein, 25 aa, Entamoeba dispar
EKLKTMPYFCCISAAQGIGLDKLKE

SEQ ID NO: 2479331 - protein, 22 aa, Entamoeba dispar
EKLLKETFCDWDDNDFRKWKTA

SEQ ID NO: 2479332 - protein, 17 aa, Entamoeba dispar
EKLLKWARGLPSIDKEE

SEQ ID NO: 2479333 - protein, 21 aa, Entamoeba dispar
EKLLLFPSMPYLVWSTQTDSL

SEQ ID NO: 2479334 - protein, 24 aa, Entamoeba dispar
EKLLPREVILWVLLPADEEAYNYP

SEQ ID NO: 2479335 - protein, 17 aa, Entamoeba dispar
EKLLRLNKLCGASVVGE

SEQ ID NO: 2479336 - protein, 19 aa, Entamoeba dispar
EKLNIWKALMQLEANHGDE

SEQ ID NO: 2479337 - protein, 18 aa, Entamoeba dispar
EKLNRGVLTEFSRTDDPG

SEQ ID NO: 2479338 - protein, 22 aa, Entamoeba dispar
EKLQNVCRVFSASVISSEEEKR

SEQ ID NO: 2479339 - protein, 22 aa, Entamoeba dispar
EKLRGVYAKWILSIAYKKLDNF

SEQ ID NO: 2479340 - protein, 20 aa, Entamoeba dispar
EKLRKAGAGARLERIKAEAD

SEQ ID NO: 2479341 - protein, 18 aa, Entamoeba dispar
EKLWRRRNAGENKSKWDF

SEQ ID NO: 2479342 - protein, 19 aa, Entamoeba dispar
EKLYRFFDDTALNFIALAQ

SEQ ID NO: 2479343 - protein, 27 aa, Entamoeba dispar
EKMFDIIAKDIKIVISIYPSNSPTEQP

SEQ ID NO: 2479344 - protein, 18 aa, Entamoeba dispar
EKMIEMFIDFNIVDWNCT

SEQ ID NO: 2479345 - protein, 18 aa, Entamoeba dispar
EKMIPYNSIFSLYCQYAV

SEQ ID NO: 2479346 - protein, 22 aa, Entamoeba dispar
EKMKDYCFAKLKGSTFTPFILE

SEQ ID NO: 2479347 - protein, 25 aa, Entamoeba dispar
EKMKGKKGITMLFTFDCNDTHDQLP

SEQ ID NO: 2479348 - protein, 17 aa, Entamoeba dispar
EKMKLVFNQVKPIYDII

SEQ ID NO: 2479349 - protein, 25 aa, Entamoeba dispar
EKMKRRFIKKYSFEPTRDEFLLFLS

SEQ ID NO: 2479350 - protein, 23 aa, Entamoeba dispar
EKMLIKKEMRGIGYRMKILSVTG

SEQ ID NO: 2479351 - protein, 27 aa, Entamoeba dispar
EKMLLSLFISVATKFVPLGILHMRSVN

SEQ ID NO: 2479352 - protein, 21 aa, Entamoeba dispar
EKMVGFKYECIIGCKKDPLFG

SEQ ID NO: 2479353 - protein, 35 aa, Entamoeba dispar
EKMVRVSGKFFMKWRIIELKPEYLNSGDVFIIDKV

SEQ ID NO: 2479354 - protein, 25 aa, Entamoeba dispar
EKNEYSELLSLLMSMIILIVPPTPK

SEQ ID NO: 2479355 - protein, 23 aa, Entamoeba dispar
EKNPDYAIIMAFDVTVDKEARDY

SEQ ID NO: 2479356 - protein, 20 aa, Entamoeba dispar
EKNSELESVMKRSIDDKTTI

SEQ ID NO: 2479357 - protein, 20 aa, Entamoeba dispar
EKNSLCFSCVTLQQVKKITT

SEQ ID NO: 2479358 - protein, 20 aa, Entamoeba dispar
EKNVWALSLIDYMKDVIQVE

SEQ ID NO: 2479359 - protein, 22 aa, Entamoeba dispar
EKNYKNLCEFLINKGANVNACD

SEQ ID NO: 2479360 - protein, 35 aa, Entamoeba dispar
EKNYPFAIGELIYFLKEVISWQFGEKIRDKLNEYI

SEQ ID NO: 2479361 - protein, 23 aa, Entamoeba dispar
EKPFQIEGVWVFKGTEMPKELND

SEQ ID NO: 2479362 - protein, 19 aa, Entamoeba dispar
EKPIGLAIFYYQRRKVKEQ

SEQ ID NO: 2479363 - protein, 25 aa, Entamoeba dispar
EKPLFPLFLCDAGLIIISRFPIVES

SEQ ID NO: 2479364 - protein, 25 aa, Entamoeba dispar
EKPLFPLFLCDAGLVIISRFPIVEN

SEQ ID NO: 2479365 - protein, 21 aa, Entamoeba dispar
EKPRKARFSLVSSSMEDLESL

SEQ ID NO: 2479366 - protein, 18 aa, Entamoeba dispar
EKPRVVAVSSLAHLFTSN

SEQ ID NO: 2479367 - protein, 28 aa, Entamoeba dispar
EKPVCEFFYKIGACRHGDACNKTHIKPE

SEQ ID NO: 2479368 - protein, 19 aa, Entamoeba dispar
EKQEFSWKENIKKCNNAVF

SEQ ID NO: 2479369 - protein, 23 aa, Entamoeba dispar
EKQETLKSIVFDKVHTQKLQRDE

SEQ ID NO: 2479370 - protein, 20 aa, Entamoeba dispar
EKQFCSEFIHFIERTLISVI

SEQ ID NO: 2479371 - protein, 24 aa, Entamoeba dispar
EKQIKGWSVLCQMINEGIQRFNDS

SEQ ID NO: 2479372 - protein, 29 aa, Entamoeba dispar
EKQKFVDLIEICRLFCLGGASKEKTKEKY

SEQ ID NO: 2479373 - protein, 17 aa, Entamoeba dispar
EKQKLLFSGIKEKVIDI

SEQ ID NO: 2479374 - protein, 19 aa, Entamoeba dispar
EKQKWNICENIEYTKEDRN

SEQ ID NO: 2479375 - protein, 22 aa, Entamoeba dispar
EKQLPIYFEFLINPNGPPTYSN

SEQ ID NO: 2479376 - protein, 24 aa, Entamoeba dispar
EKQNDLSFEWQIPKQVILGQLLII

SEQ ID NO: 2479377 - protein, 26 aa, Entamoeba dispar
EKQVHLKYPIKKCVLQAPVSDRDSVR

SEQ ID NO: 2479378 - protein, 20 aa, Entamoeba dispar
EKRASDRKIIEGLIKLLNNV

SEQ ID NO: 2479379 - protein, 31 aa, Entamoeba dispar
EKREFMRELLLFPTIRELTCDNYFLDTFFSG

SEQ ID NO: 2479380 - protein, 22 aa, Entamoeba dispar
EKRFRLKPMLIDRYGETHRQDV

SEQ ID NO: 2479381 - protein, 20 aa, Entamoeba dispar
EKRIESRQQYLPKREFQKLR

SEQ ID NO: 2479382 - protein, 23 aa, Entamoeba dispar
EKRIIKWLNNIYVIEKNKEGIKE

SEQ ID NO: 2479383 - protein, 20 aa, Entamoeba dispar
EKRIRIEAAENYLNYINECI

SEQ ID NO: 2479384 - protein, 20 aa, Entamoeba dispar
EKRMLVKRVGWISNEDLQIC

SEQ ID NO: 2479385 - protein, 18 aa, Entamoeba dispar
EKRRETYLEFKRKYEEHG

SEQ ID NO: 2479386 - protein, 23 aa, Entamoeba dispar
EKRRLKYLASNSHVIGLENPELV

SEQ ID NO: 2479387 - protein, 25 aa, Entamoeba dispar
EKRSLPRPHLELMKEMNKNIPSKDQ

SEQ ID NO: 2479388 - protein, 22 aa, Entamoeba dispar
EKRSRAATLRRVMHLQKKEQTQ

SEQ ID NO: 2479389 - protein, 20 aa, Entamoeba dispar
EKRYSEALKAFKTMNNLDGK

SEQ ID NO: 2479390 - protein, 22 aa, Entamoeba dispar
EKSEINFVWLYEAYFIHMSFHT

SEQ ID NO: 2479391 - protein, 21 aa, Entamoeba dispar
EKSEKIYVCFTQRKIEFRSQW

SEQ ID NO: 2479392 - protein, 26 aa, Entamoeba dispar
EKSGKFSLGHFFIAINVEAFRDLNDF

SEQ ID NO: 2479393 - protein, 27 aa, Entamoeba dispar
EKSGKFSLGHFFIAINVEAFRDLNDFK

SEQ ID NO: 2479394 - protein, 19 aa, Entamoeba dispar
EKSGKLILSIVPTVCDPEI

SEQ ID NO: 2479395 - protein, 20 aa, Entamoeba dispar
EKSIAFPMFFVDSQPDEDED

SEQ ID NO: 2479396 - protein, 22 aa, Entamoeba dispar
EKSKEFFPQIAQKFDSRPCGVY

SEQ ID NO: 2479397 - protein, 23 aa, Entamoeba dispar
EKSKLGVMKKRIIGTAEIKQIIA

SEQ ID NO: 2479398 - protein, 22 aa, Entamoeba dispar
EKSKLRRYAIKITSKYFNDIED

SEQ ID NO: 2479399 - protein, 20 aa, Entamoeba dispar
EKSLLETKEKYMLVEYQGKL

SEQ ID NO: 2479400 - protein, 21 aa, Entamoeba dispar
EKSQQRKGFLSRRSETQNQTN

SEQ ID NO: 2479401 - protein, 20 aa, Entamoeba dispar
EKSSTLPAFHPFSISLLQIN

SEQ ID NO: 2479402 - protein, 25 aa, Entamoeba dispar
EKTANHIEYVWKFITKQLHQSPSRI

SEQ ID NO: 2479403 - protein, 24 aa, Entamoeba dispar
EKTDTIADCFAFLETKGYKKREIE

SEQ ID NO: 2479404 - protein, 26 aa, Entamoeba dispar
EKTIKEKIFKICSSFEEEFNGLSDQI

SEQ ID NO: 2479405 - protein, 18 aa, Entamoeba dispar
EKTIQMSIIFEVMSIVIK

SEQ ID NO: 2479406 - protein, 20 aa, Entamoeba dispar
EKTLFMFSNICIMNNDYLIE

SEQ ID NO: 2479407 - protein, 35 aa, Entamoeba dispar
EKTPGYSGCDLFNLCCAAAMRPIRDYIAKENKEKE

SEQ ID NO: 2479408 - protein, 35 aa, Entamoeba dispar
EKTPMIMKCGDWICSDCAIGCKKCPVCNTSTGGVF

SEQ ID NO: 2479409 - protein, 20 aa, Entamoeba dispar
EKTQTISCLVTWNKRPIELK

SEQ ID NO: 2479410 - protein, 24 aa, Entamoeba dispar
EKTREFILRKAINGERTAMFSTAF

SEQ ID NO: 2479411 - protein, 23 aa, Entamoeba dispar
EKTRRIREAREFTSTEIEAVEIA

SEQ ID NO: 2479412 - protein, 21 aa, Entamoeba dispar
EKTVFRKKLIKLKKEAERIKI

SEQ ID NO: 2479413 - protein, 17 aa, Entamoeba dispar
EKVDLSKMSFVQRQRYL

SEQ ID NO: 2479414 - protein, 31 aa, Entamoeba dispar
EKVESGLILNVLIEILCKGDGREEHPIVETC

SEQ ID NO: 2479415 - protein, 20 aa, Entamoeba dispar
EKVIKLGCCCSDINEMNMAH

SEQ ID NO: 2479416 - protein, 24 aa, Entamoeba dispar
EKVIPDRRAVLLAGAPGVGKTTVS

SEQ ID NO: 2479417 - protein, 30 aa, Entamoeba dispar
EKVKDCKLISCGLLKMKLKKRDVMERTLKV

SEQ ID NO: 2479418 - protein, 23 aa, Entamoeba dispar
EKVLKASISSLLLSSSSEEEELV

SEQ ID NO: 2479419 - protein, 22 aa, Entamoeba dispar
EKVRPICMGAVLRGITFTEESY

SEQ ID NO: 2479420 - protein, 25 aa, Entamoeba dispar
EKVTNKAGWCFEDFEGSGSIKPKIY

SEQ ID NO: 2479421 - protein, 26 aa, Entamoeba dispar
EKWAPNIPWFKEYIPTVIQAKKKTRE

SEQ ID NO: 2479422 - protein, 17 aa, Entamoeba dispar
EKWEMKYPKNWQEQSLV

SEQ ID NO: 2479423 - protein, 24 aa, Entamoeba dispar
EKWEMKYPNGWEQQSLIFAKTIED

SEQ ID NO: 2479424 - protein, 17 aa, Entamoeba dispar
EKWHRRTKYYAQGKTKE

SEQ ID NO: 2479425 - protein, 23 aa, Entamoeba dispar
EKWLNKLLCLDASNTLMHITSTP

SEQ ID NO: 2479426 - protein, 19 aa, Entamoeba dispar
EKYDEAFSLLGSDEKDKVL

SEQ ID NO: 2479427 - protein, 19 aa, Entamoeba dispar
EKYDFLILVLLVLFCKVPK

SEQ ID NO: 2479428 - protein, 26 aa, Entamoeba dispar
EKYDISKLIAIAKFFSSLCIGGVSSQ

SEQ ID NO: 2479429 - protein, 27 aa, Entamoeba dispar
EKYEFCCKITEGVLLRKVLSDLIKQSQ

SEQ ID NO: 2479430 - protein, 17 aa, Entamoeba dispar
EKYEMKKVKGITLRVGE

SEQ ID NO: 2479431 - protein, 22 aa, Entamoeba dispar
EKYEWLKEELIEDTNKLCKDFQ

SEQ ID NO: 2479432 - protein, 29 aa, Entamoeba dispar
EKYFNRIRHTFKILTGILMSEAGDQTILL

SEQ ID NO: 2479433 - protein, 22 aa, Entamoeba dispar
EKYFQFNLYFGQRMESLINCIK

SEQ ID NO: 2479434 - protein, 20 aa, Entamoeba dispar
EKYIPGACSIDYINNRYRLN

SEQ ID NO: 2479435 - protein, 17 aa, Entamoeba dispar
EKYKEWSEPQILKNKIV

SEQ ID NO: 2479436 - protein, 19 aa, Entamoeba dispar
EKYLKGAAQALTLKFMGML

SEQ ID NO: 2479437 - protein, 19 aa, Entamoeba dispar
EKYLKYKGYFYERLDGSIK

SEQ ID NO: 2479438 - protein, 22 aa, Entamoeba dispar
EKYLMIRKTIIGLFSNDTIITR

SEQ ID NO: 2479439 - protein, 24 aa, Entamoeba dispar
EKYPESLISFEFITSKFVADLTDV

SEQ ID NO: 2479440 - protein, 17 aa, Entamoeba dispar
EKYPGKFSFSISHTTRK

SEQ ID NO: 2479441 - protein, 23 aa, Entamoeba dispar
EKYSKKNGFPWDAQVVYGDTDSV

SEQ ID NO: 2479442 - protein, 25 aa, Entamoeba dispar
ELAGKRLNVKFAKPKDGRPYLQKPF

SEQ ID NO: 2479443 - protein, 18 aa, Entamoeba dispar
ELAIKRIFLNGQISIDGS

SEQ ID NO: 2479444 - protein, 17 aa, Entamoeba dispar
ELAKKCCLMKNERSIML

SEQ ID NO: 2479445 - protein, 23 aa, Entamoeba dispar
ELAKKWVDCINISKNEILSHEFD

SEQ ID NO: 2479446 - protein, 18 aa, Entamoeba dispar
ELALCYNGMGLVDESINT

SEQ ID NO: 2479447 - protein, 27 aa, Entamoeba dispar
ELAVKIFKTSILIFKDRERYVTGDYRY

SEQ ID NO: 2479448 - protein, 25 aa, Entamoeba dispar
ELCKRARLAKANAYITSYLREQMPT

SEQ ID NO: 2479449 - protein, 21 aa, Entamoeba dispar
ELCSLVIKIKSEFIVELIGVE

SEQ ID NO: 2479450 - protein, 23 aa, Entamoeba dispar
ELDAHLYFLIPISIYLNNLTQDI

SEQ ID NO: 2479451 - protein, 20 aa, Entamoeba dispar
ELDAVISAILCFRISDGGKS

SEQ ID NO: 2479452 - protein, 19 aa, Entamoeba dispar
ELDCKTCSIQLIKSFISVA

SEQ ID NO: 2479453 - protein, 23 aa, Entamoeba dispar
ELDCSCFRECYSLTTINIPTSVK

SEQ ID NO: 2479454 - protein, 23 aa, Entamoeba dispar
ELDDTKVLLFIKLCGKTQIILQS

SEQ ID NO: 2479455 - protein, 17 aa, Entamoeba dispar
ELDDVFNEFDIPKERKK

SEQ ID NO: 2479456 - protein, 28 aa, Entamoeba dispar
ELDGLKSLHWKYLDFIFICPKNIENIKL

SEQ ID NO: 2479457 - protein, 23 aa, Entamoeba dispar
ELDKRLGDEGGFFKRIDKQQKRI

SEQ ID NO: 2479458 - protein, 26 aa, Entamoeba dispar
ELDNFIRRFDCTFNFDGTSGSIAKMV

SEQ ID NO: 2479459 - protein, 18 aa, Entamoeba dispar
ELDRFKRSQPQNVATDLF

SEQ ID NO: 2479460 - protein, 18 aa, Entamoeba dispar
ELDRRLSQHVLKMHRHFD

SEQ ID NO: 2479461 - protein, 19 aa, Entamoeba dispar
ELDSMRVIEHIFKPQMSEE

SEQ ID NO: 2479462 - protein, 20 aa, Entamoeba dispar
ELEEKVKMNAVLKKENKNKQ

SEQ ID NO: 2479463 - protein, 23 aa, Entamoeba dispar
ELEFACKKLGIEVNKTKKEKVIE

SEQ ID NO: 2479464 - protein, 18 aa, Entamoeba dispar
ELEFIVANMVYKGLMKCQ

SEQ ID NO: 2479465 - protein, 20 aa, Entamoeba dispar
ELEGRPIILKWDRGLQSKVS

SEQ ID NO: 2479466 - protein, 26 aa, Entamoeba dispar
ELEIWKRTKSILSFKSPLKLRKLLLS

SEQ ID NO: 2479467 - protein, 21 aa, Entamoeba dispar
ELELLPDLLYINLTQLQDLQV

SEQ ID NO: 2479468 - protein, 27 aa, Entamoeba dispar
ELELPRCEICNLPGTMGTFCPNTTCQT

SEQ ID NO: 2479469 - protein, 31 aa, Entamoeba dispar
ELELSELFYHFRISEIIDIWSEIIVSERIVF

SEQ ID NO: 2479470 - protein, 18 aa, Entamoeba dispar
ELEMTFPTLLKGAIDYIE

SEQ ID NO: 2479471 - protein, 26 aa, Entamoeba dispar
ELENELYIGGVFIRILNKNPTCPLNN

SEQ ID NO: 2479472 - protein, 33 aa, Entamoeba dispar
ELENKVMGLLRFELSKAKSAVCEMVPCHFEILR

SEQ ID NO: 2479473 - protein, 24 aa, Entamoeba dispar
ELENSIFCLFYLKNANHFVKSKFN

SEQ ID NO: 2479474 - protein, 18 aa, Entamoeba dispar
ELERSVVFSFVIHSFQEL

SEQ ID NO: 2479475 - protein, 23 aa, Entamoeba dispar
ELESAYCIEKSCIHLFCENQELD

SEQ ID NO: 2479476 - protein, 18 aa, Entamoeba dispar
ELEWLSWGELSKRNKQTF

SEQ ID NO: 2479477 - protein, 29 aa, Entamoeba dispar
ELFELNSALLKRIIAQYIQYASAFPNSPQ

SEQ ID NO: 2479478 - protein, 19 aa, Entamoeba dispar
ELFFSKSQTQFYVFRDNVT

SEQ ID NO: 2479479 - protein, 20 aa, Entamoeba dispar
ELFHRLSVSDISSFPWETLA

SEQ ID NO: 2479480 - protein, 20 aa, Entamoeba dispar
ELFILKDIYESIGSKLESTL

SEQ ID NO: 2479481 - protein, 20 aa, Entamoeba dispar
ELFIRGVLKVLPRTHKEYKG

SEQ ID NO: 2479482 - protein, 19 aa, Entamoeba dispar
ELFNLRIVVKRGNYKDTIV

SEQ ID NO: 2479483 - protein, 26 aa, Entamoeba dispar
ELFQIIKSRMTSIIIGKIKTFLVYPI

SEQ ID NO: 2479484 - protein, 17 aa, Entamoeba dispar
ELFRRKLLEIKPSTEPI

SEQ ID NO: 2479485 - protein, 20 aa, Entamoeba dispar
ELFTKLEIETSLCDRILRLI

SEQ ID NO: 2479486 - protein, 19 aa, Entamoeba dispar
ELFVKFPELVIVSMYEHSL

SEQ ID NO: 2479487 - protein, 24 aa, Entamoeba dispar
ELFWIYYCSLPLFTSKVPVVDFWL

SEQ ID NO: 2479488 - protein, 18 aa, Entamoeba dispar
ELFWKVIIFDQFNSDLLS

SEQ ID NO: 2479489 - protein, 20 aa, Entamoeba dispar
ELGDGCFCRCSSLKSINILS

SEQ ID NO: 2479490 - protein, 28 aa, Entamoeba dispar
ELGDYCFECCSSLKSIIIPTTVSRIGKW

SEQ ID NO: 2479491 - protein, 22 aa, Entamoeba dispar
ELGEYCFDRCLSLTSIIIPTPI

SEQ ID NO: 2479492 - protein, 24 aa, Entamoeba dispar
ELGFSRSMATEAYIVSNKNKEVAA

SEQ ID NO: 2479493 - protein, 20 aa, Entamoeba dispar
ELGKSCFYKCTSLTSINIKD

SEQ ID NO: 2479494 - protein, 20 aa, Entamoeba dispar
ELGNYCFYKCSSLKSINISS

SEQ ID NO: 2479495 - protein, 23 aa, Entamoeba dispar
ELGYCCFYECSLLTSINIPSSIK

SEQ ID NO: 2479496 - protein, 21 aa, Entamoeba dispar
ELGYECFHRMTSLTKIALPET

SEQ ID NO: 2479497 - protein, 21 aa, Entamoeba dispar
ELGYECFHRMTSLTKIVLPET

SEQ ID NO: 2479498 - protein, 24 aa, Entamoeba dispar
ELGYKRTILVSIDYHRRVNDIKEI

SEQ ID NO: 2479499 - protein, 18 aa, Entamoeba dispar
ELHDCVFSFIKKEFNSCS

SEQ ID NO: 2479500 - protein, 18 aa, Entamoeba dispar
ELHKLKCVLVQSSDEYIK

SEQ ID NO: 2479501 - protein, 32 aa, Entamoeba dispar
ELHLERCMKDLKELFARVPFTYTDPIVSYRET

SEQ ID NO: 2479502 - protein, 28 aa, Entamoeba dispar
ELHNHRALFHIGMCFFNGIGKPLDVDKA

SEQ ID NO: 2479503 - protein, 23 aa, Entamoeba dispar
ELHYGCFYLCLSLTSINIPSSIT

SEQ ID NO: 2479504 - protein, 20 aa, Entamoeba dispar
ELIAKITLFKIMNELSSSLK

SEQ ID NO: 2479505 - protein, 18 aa, Entamoeba dispar
ELIDRFAGPTNNLQYAHI

SEQ ID NO: 2479506 - protein, 23 aa, Entamoeba dispar
ELIEAFPKMCRRRHFNEIMQVVI

SEQ ID NO: 2479507 - protein, 24 aa, Entamoeba dispar
ELIEFRMREVIRKLIVGKKFECKE

SEQ ID NO: 2479508 - protein, 20 aa, Entamoeba dispar
ELIEGGSLLQWIEINQCIPI

SEQ ID NO: 2479509 - protein, 21 aa, Entamoeba dispar
ELIEIRTLYFTSLGMLLYSLP

SEQ ID NO: 2479510 - protein, 30 aa, Entamoeba dispar
ELIELPIQHFGRLGALLFYLMSKTSEPSQI

SEQ ID NO: 2479511 - protein, 24 aa, Entamoeba dispar
ELIEMKAIYLKYTENIKINEESVN

SEQ ID NO: 2479512 - protein, 18 aa, Entamoeba dispar
ELIERGGDESLLFVIMNL

SEQ ID NO: 2479513 - protein, 17 aa, Entamoeba dispar
ELIERYRASNTIRVKLK

SEQ ID NO: 2479514 - protein, 24 aa, Entamoeba dispar
ELIGLGCGCLCNLLLDSPLILKYS

SEQ ID NO: 2479515 - protein, 30 aa, Entamoeba dispar
ELIIGIKYPTSFKITYHFRSFILNIKTKSN

SEQ ID NO: 2479516 - protein, 19 aa, Entamoeba dispar
ELIKGLVMDHGTRHPGMPH

SEQ ID NO: 2479517 - protein, 19 aa, Entamoeba dispar
ELIKNMIFVLVCEEKIIKG

SEQ ID NO: 2479518 - protein, 30 aa, Entamoeba dispar
ELIKTCESRNRLIILLPWLEQRLSEGSPDV

SEQ ID NO: 2479519 - protein, 19 aa, Entamoeba dispar
ELIKYIPLNERKGIETQLS

SEQ ID NO: 2479520 - protein, 21 aa, Entamoeba dispar
ELILKRRKKLSLTVVSSTPTD

SEQ ID NO: 2479521 - protein, 25 aa, Entamoeba dispar
ELINKREAHKWKLITFEEKKIEEIK

SEQ ID NO: 2479522 - protein, 25 aa, Entamoeba dispar
ELIPEFFYFPEFLKNFDHFDLKKRN

SEQ ID NO: 2479523 - protein, 21 aa, Entamoeba dispar
ELIPRIIYCEENIKINEQTTS

SEQ ID NO: 2479524 - protein, 26 aa, Entamoeba dispar
ELITPPNRIIVCLEQSTTEWANSVSR

SEQ ID NO: 2479525 - protein, 26 aa, Entamoeba dispar
ELKEFLKDKLVPFSIPTYIFAIEDMP

SEQ ID NO: 2479526 - protein, 23 aa, Entamoeba dispar
ELKEGQCSVGLPLEEIHIRITEV

SEQ ID NO: 2479527 - protein, 21 aa, Entamoeba dispar
ELKEIVKIQMGEVIKMIKKRY

SEQ ID NO: 2479528 - protein, 26 aa, Entamoeba dispar
ELKELKELMKIIGMSIVVERNRDLMK

SEQ ID NO: 2479529 - protein, 25 aa, Entamoeba dispar
ELKGDYCSECGNIILQEVDKVLKLP

SEQ ID NO: 2479530 - protein, 20 aa, Entamoeba dispar
ELKGTAGYVRLNFENATDAA

SEQ ID NO: 2479531 - protein, 19 aa, Entamoeba dispar
ELKIKVAVAKKAYAQTKDA

SEQ ID NO: 2479532 - protein, 21 aa, Entamoeba dispar
ELKIKVHSYHSFFGSIKNLIK

SEQ ID NO: 2479533 - protein, 21 aa, Entamoeba dispar
ELKISNSKVILFQQENKQLKN

SEQ ID NO: 2479534 - protein, 24 aa, Entamoeba dispar
ELKIYPSEMENVWYRWLENIHDWC

SEQ ID NO: 2479535 - protein, 18 aa, Entamoeba dispar
ELKKCKHPQLKAEAQLYS

SEQ ID NO: 2479536 - protein, 27 aa, Entamoeba dispar
ELKKLLEGCLSCLKKNKLFASFISAVN

SEQ ID NO: 2479537 - protein, 36 aa, Entamoeba dispar
ELKKLPGIGPKLAKIICAIGFKKIEGITVDQRSLLL

SEQ ID NO: 2479538 - protein, 22 aa, Entamoeba dispar
ELKKVLFLSLFIRITNINQQDK

SEQ ID NO: 2479539 - protein, 21 aa, Entamoeba dispar
ELKLERCFNLDINIPSKKLKS

SEQ ID NO: 2479540 - protein, 22 aa, Entamoeba dispar
ELKLIISCGYYNYLSYTKGPLI

SEQ ID NO: 2479541 - protein, 21 aa, Entamoeba dispar
ELKLILPPFLWSVCSSSDIGK

SEQ ID NO: 2479542 - protein, 24 aa, Entamoeba dispar
ELKLKAICTLGRALGKATKLENAE

SEQ ID NO: 2479543 - protein, 17 aa, Entamoeba dispar
ELKLNQLTFPRLKTIYC

SEQ ID NO: 2479544 - protein, 18 aa, Entamoeba dispar
ELKNLIIHIISFVDDPND

SEQ ID NO: 2479545 - protein, 24 aa, Entamoeba dispar
ELKQIKSGIIPKGIEEIKEINKNE

SEQ ID NO: 2479546 - protein, 29 aa, Entamoeba dispar
ELKQLEWKWGICMAIGFQEFIECKVKGIP

SEQ ID NO: 2479547 - protein, 23 aa, Entamoeba dispar
ELKQVPLGLSFTSLFNIKHYPFS

SEQ ID NO: 2479548 - protein, 21 aa, Entamoeba dispar
ELKRRMQQFLAKRNQKMEIEE

SEQ ID NO: 2479549 - protein, 24 aa, Entamoeba dispar
ELKVIPCLRKGRVLSKSIKLNELP

SEQ ID NO: 2479550 - protein, 20 aa, Entamoeba dispar
ELKVLLSTLNRVIIKLVIDL

SEQ ID NO: 2479551 - protein, 21 aa, Entamoeba dispar
ELKVPKYKQYYIFFTSPINES

SEQ ID NO: 2479552 - protein, 20 aa, Entamoeba dispar
ELLDQAFIMGFNLNEISSSP

SEQ ID NO: 2479553 - protein, 21 aa, Entamoeba dispar
ELLEGYPPHYELRGEELMKAI

SEQ ID NO: 2479554 - protein, 19 aa, Entamoeba dispar
ELLEIGFDFSQPSEKDLQI

SEQ ID NO: 2479555 - protein, 24 aa, Entamoeba dispar
ELLEILKARIVYFAHKLTVLFRDQ

SEQ ID NO: 2479556 - protein, 18 aa, Entamoeba dispar
ELLHWKPHSVVVKYPNVM

SEQ ID NO: 2479557 - protein, 19 aa, Entamoeba dispar
ELLIGIKYLHDAGIVYRDL

SEQ ID NO: 2479558 - protein, 17 aa, Entamoeba dispar
ELLKICKDILIGERAFS

SEQ ID NO: 2479559 - protein, 20 aa, Entamoeba dispar
ELLNIIIIATIRYLDCPNGS

SEQ ID NO: 2479560 - protein, 24 aa, Entamoeba dispar
ELLRNTHLLERIYIYLESHPNNIN

SEQ ID NO: 2479561 - protein, 24 aa, Entamoeba dispar
ELLSEWKASLFGDESEQCNRDMLT

SEQ ID NO: 2479562 - protein, 21 aa, Entamoeba dispar
ELLSINLYDALKMNDYKGLPY

SEQ ID NO: 2479563 - protein, 20 aa, Entamoeba dispar
ELLSKLGFAHFAAAEAFVRY

SEQ ID NO: 2479564 - protein, 19 aa, Entamoeba dispar
ELLTSPGLINNDFNRVFMC

SEQ ID NO: 2479565 - protein, 18 aa, Entamoeba dispar
ELLVMMGALLGMPPNSMI

SEQ ID NO: 2479566 - protein, 17 aa, Entamoeba dispar
ELLYFIANIIYDNTNLI

SEQ ID NO: 2479567 - protein, 24 aa, Entamoeba dispar
ELLYNDIDIVIGFTDETKWKKLIL

SEQ ID NO: 2479568 - protein, 20 aa, Entamoeba dispar
ELMIKIFEEYFINEIKVNIL

SEQ ID NO: 2479569 - protein, 18 aa, Entamoeba dispar
ELMIRVAQRYQQINLLSY

SEQ ID NO: 2479570 - protein, 33 aa, Entamoeba dispar
ELMKRYDVFLVEIRVCHLLSVLFNGRIRSNNIF

SEQ ID NO: 2479571 - protein, 19 aa, Entamoeba dispar
ELMPMLLQICKELRGQEEI

SEQ ID NO: 2479572 - protein, 24 aa, Entamoeba dispar
ELNELRLAQKSMCSNMTMCAAVEI

SEQ ID NO: 2479573 - protein, 20 aa, Entamoeba dispar
ELNFLKGKCEILENENNELK

SEQ ID NO: 2479574 - protein, 26 aa, Entamoeba dispar
ELNGKKLKIEFSRPGGRETGFITEEL

SEQ ID NO: 2479575 - protein, 18 aa, Entamoeba dispar
ELNICLWSSLPEHIQFYL

SEQ ID NO: 2479576 - protein, 18 aa, Entamoeba dispar
ELNKGTAISGGLKHVTAD

SEQ ID NO: 2479577 - protein, 30 aa, Entamoeba dispar
ELNKLRLSKRIKIIIINGVIDMMKNDILLD

SEQ ID NO: 2479578 - protein, 23 aa, Entamoeba dispar
ELNLKKEKRRLIVQEMYTTEKTY

SEQ ID NO: 2479579 - protein, 26 aa, Entamoeba dispar
ELNLLRCNFCGEPIFNQFKNASIDQS

SEQ ID NO: 2479580 - protein, 23 aa, Entamoeba dispar
ELNNALMSRCQLVTLKKLTDENV

SEQ ID NO: 2479581 - protein, 18 aa, Entamoeba dispar
ELNNKPIFIFGYLDQGYW

SEQ ID NO: 2479582 - protein, 18 aa, Entamoeba dispar
ELNNNSFRIFPWKKRSKL

SEQ ID NO: 2479583 - protein, 22 aa, Entamoeba dispar
ELNSFYFEWNKLTVGEEIINPF

SEQ ID NO: 2479584 - protein, 23 aa, Entamoeba dispar
ELNSIYFSSFLVRYLGALRPLLD

SEQ ID NO: 2479585 - protein, 22 aa, Entamoeba dispar
ELNTYVGFFYRVSFYGQAFTNI

SEQ ID NO: 2479586 - protein, 23 aa, Entamoeba dispar
ELNVFQPPSKIDTFINSLSQLFN

SEQ ID NO: 2479587 - protein, 21 aa, Entamoeba dispar
ELNVLKYLGCSSICNILGVQV

SEQ ID NO: 2479588 - protein, 20 aa, Entamoeba dispar
ELNVNSIIFFQCTFAKKIFV

SEQ ID NO: 2479589 - protein, 17 aa, Entamoeba dispar
ELNWMLVDTEFKMNNLI

SEQ ID NO: 2479590 - protein, 20 aa, Entamoeba dispar
ELNYGKTLIKFFDDVKPQTV

SEQ ID NO: 2479591 - protein, 20 aa, Entamoeba dispar
ELPEPLITFESYDLFIDCAK

SEQ ID NO: 2479592 - protein, 22 aa, Entamoeba dispar
ELPETNFLPSYFIVTFTTPSGT

SEQ ID NO: 2479593 - protein, 17 aa, Entamoeba dispar
ELPFSKMKLEKIIQFGG

SEQ ID NO: 2479594 - protein, 20 aa, Entamoeba dispar
ELPGSYKLWYHYLQTIITNA

SEQ ID NO: 2479595 - protein, 20 aa, Entamoeba dispar
ELPIFFKKKEIIRSIKENQI

SEQ ID NO: 2479596 - protein, 23 aa, Entamoeba dispar
ELPKEYKGSCDNIIKSLKADLVQ

SEQ ID NO: 2479597 - protein, 30 aa, Entamoeba dispar
ELPKYFFCFRFIKTPDLIELHWSKKHYDNE

SEQ ID NO: 2479598 - protein, 26 aa, Entamoeba dispar
ELPNLFKRKNELSKRKKQYKTKDSSK

SEQ ID NO: 2479599 - protein, 24 aa, Entamoeba dispar
ELPSFNYDRIELIKYLYSNLSTSK

SEQ ID NO: 2479600 - protein, 18 aa, Entamoeba dispar
ELPTSVTKLGFRSFSGCK

SEQ ID NO: 2479601 - protein, 26 aa, Entamoeba dispar
ELPYKISNCEFIQRISFIDVSNLNNW

SEQ ID NO: 2479602 - protein, 18 aa, Entamoeba dispar
ELQEGLRQAGLESSNLII

SEQ ID NO: 2479603 - protein, 19 aa, Entamoeba dispar
ELQFALDIIQQLMVTVEGA

SEQ ID NO: 2479604 - protein, 24 aa, Entamoeba dispar
ELQFKEIIDRLGGATSNIQYAHIS

SEQ ID NO: 2479605 - protein, 17 aa, Entamoeba dispar
ELQINYTDIKRMDEAIW

SEQ ID NO: 2479606 - protein, 20 aa, Entamoeba dispar
ELQKAKAILHRVERGDFYQI

SEQ ID NO: 2479607 - protein, 26 aa, Entamoeba dispar
ELQKTYNWKKSFGVIKKTKKIVTPID

SEQ ID NO: 2479608 - protein, 24 aa, Entamoeba dispar
ELQLIGCSNLNISLVLNKLKSIEI

SEQ ID NO: 2479609 - protein, 20 aa, Entamoeba dispar
ELQQLFPFVDPEIIKTALID

SEQ ID NO: 2479610 - protein, 25 aa, Entamoeba dispar
ELQQPCSLLKAYSKFYSKFQIIKES

SEQ ID NO: 2479611 - protein, 27 aa, Entamoeba dispar
ELQQRAIEFSQFFSYDDLRLDAVNRMP

SEQ ID NO: 2479612 - protein, 20 aa, Entamoeba dispar
ELRAFGVIFETEITQKKPGM

SEQ ID NO: 2479613 - protein, 26 aa, Entamoeba dispar
ELRDADEIGCRFAVIFGGSELEEKKV

SEQ ID NO: 2479614 - protein, 21 aa, Entamoeba dispar
ELRDNCFERFKGFISKTLETS

SEQ ID NO: 2479615 - protein, 19 aa, Entamoeba dispar
ELREIYYLLHPLKYTSKGI

SEQ ID NO: 2479616 - protein, 30 aa, Entamoeba dispar
ELRFEDISPLIIMLIFEWNDVVEELNNAIT

SEQ ID NO: 2479617 - protein, 24 aa, Entamoeba dispar
ELRFQRDAILALHFIAEDFLVKLF

SEQ ID NO: 2479618 - protein, 20 aa, Entamoeba dispar
ELRKYLFGFVAHLIQYNEII

SEQ ID NO: 2479619 - protein, 25 aa, Entamoeba dispar
ELRLNRFALNTSLIFLSKHREFLPF

SEQ ID NO: 2479620 - protein, 17 aa, Entamoeba dispar
ELRRFCLDIINWIDTNK

SEQ ID NO: 2479621 - protein, 24 aa, Entamoeba dispar
ELRRHIKTDFTIDHAAAYRYAKLL

SEQ ID NO: 2479622 - protein, 24 aa, Entamoeba dispar
ELRRHIRTDFTIDHAAAYRYAKLL

SEQ ID NO: 2479623 - protein, 20 aa, Entamoeba dispar
ELRSNNDLIEFCSEPYNLKR

SEQ ID NO: 2479624 - protein, 18 aa, Entamoeba dispar
ELRTAFVDDHTWVAELNS

SEQ ID NO: 2479625 - protein, 24 aa, Entamoeba dispar
ELSDELKLGEPGYIQRYYNVKFKI

SEQ ID NO: 2479626 - protein, 23 aa, Entamoeba dispar
ELSEINEGFSCFISGENGNLKQP

SEQ ID NO: 2479627 - protein, 33 aa, Entamoeba dispar
ELSEQRLPQPPSFELQKKWYFPIIQSIKPQQFS

SEQ ID NO: 2479628 - protein, 23 aa, Entamoeba dispar
ELSIPEQMKFVVDRWNTPSNTAK

SEQ ID NO: 2479629 - protein, 18 aa, Entamoeba dispar
ELSIPLTEILNVINVNIK

SEQ ID NO: 2479630 - protein, 23 aa, Entamoeba dispar
ELSKKLTDLYARVLTVSKQTESP

SEQ ID NO: 2479631 - protein, 21 aa, Entamoeba dispar
ELSLSQFIPEYSIVIFNNKIH

SEQ ID NO: 2479632 - protein, 17 aa, Entamoeba dispar
ELSLWDIGGTASFRNVW

SEQ ID NO: 2479633 - protein, 19 aa, Entamoeba dispar
ELSNKMVVVLCDDKTVNIY

SEQ ID NO: 2479634 - protein, 22 aa, Entamoeba dispar
ELSPGCFSHCISLKDISIPQSV

SEQ ID NO: 2479635 - protein, 20 aa, Entamoeba dispar
ELSPMDVMQMIGRAGRPQFD

SEQ ID NO: 2479636 - protein, 23 aa, Entamoeba dispar
ELSQSGDLLIPFIENLINQNAEV

SEQ ID NO: 2479637 - protein, 19 aa, Entamoeba dispar
ELSVVRFGEDVKCVQKFGT

SEQ ID NO: 2479638 - protein, 17 aa, Entamoeba dispar
ELTEFDYEWMIPLKSIH

SEQ ID NO: 2479639 - protein, 23 aa, Entamoeba dispar
ELTGELYYLGIIDILMDYTARKK

SEQ ID NO: 2479640 - protein, 18 aa, Entamoeba dispar
ELTIPSGIHLLMLLSEEK

SEQ ID NO: 2479641 - protein, 30 aa, Entamoeba dispar
ELTKICTIERRLKISCLIEESRQKNILVRM

SEQ ID NO: 2479642 - protein, 19 aa, Entamoeba dispar
ELTKSKWKIPYQLIDSFGF

SEQ ID NO: 2479643 - protein, 26 aa, Entamoeba dispar
ELTKSVNEALRFLGYTTVSQLILLLE

SEQ ID NO: 2479644 - protein, 31 aa, Entamoeba dispar
ELTMIMLDFIKRGIKRLGVLLSGYHLYHKLA

SEQ ID NO: 2479645 - protein, 26 aa, Entamoeba dispar
ELTPVKLPKVFRILEEYVTKNFTNEV

SEQ ID NO: 2479646 - protein, 17 aa, Entamoeba dispar
ELTRLDLPSTLTYLKIK

SEQ ID NO: 2479647 - protein, 19 aa, Entamoeba dispar
ELTSGVGIISLRFRERLTT

SEQ ID NO: 2479648 - protein, 21 aa, Entamoeba dispar
ELTVRLKQEFNKYDLERRGFL

SEQ ID NO: 2479649 - protein, 20 aa, Entamoeba dispar
ELTVTIPVSTEWKGAMKHLG

SEQ ID NO: 2479650 - protein, 25 aa, Entamoeba dispar
ELTVTIPVSTEWKGAMKHLSGRDYS

SEQ ID NO: 2479651 - protein, 24 aa, Entamoeba dispar
ELVDVVSFIHFISKYPIIPFKITD

SEQ ID NO: 2479652 - protein, 27 aa, Entamoeba dispar
ELVECPFCSLQFCSLECKEKMNNQHQH

SEQ ID NO: 2479653 - protein, 20 aa, Entamoeba dispar
ELVEFTLKYFEHLKEKLQSQ

SEQ ID NO: 2479654 - protein, 19 aa, Entamoeba dispar
ELVEYPLLHPEIYKHLGIE

SEQ ID NO: 2479655 - protein, 27 aa, Entamoeba dispar
ELVFTEFMFCVKLQIFQEIERIIKNEI

SEQ ID NO: 2479656 - protein, 21 aa, Entamoeba dispar
ELVKAILRGKVEFPLSLPSLF

SEQ ID NO: 2479657 - protein, 26 aa, Entamoeba dispar
ELVLRQCDNCSFILSLNNLKNFNMSQ

SEQ ID NO: 2479658 - protein, 19 aa, Entamoeba dispar
ELVLTPGLVMFMNGLAHPS

SEQ ID NO: 2479659 - protein, 24 aa, Entamoeba dispar
ELVMECLKRLIGNVNWVNNIKSGW

SEQ ID NO: 2479660 - protein, 19 aa, Entamoeba dispar
ELVNEVCCIVAIINDTVKD

SEQ ID NO: 2479661 - protein, 18 aa, Entamoeba dispar
ELVPNFKTPLSIDKLQKI

SEQ ID NO: 2479662 - protein, 17 aa, Entamoeba dispar
ELVQWFECIAEFDRCKK

SEQ ID NO: 2479663 - protein, 25 aa, Entamoeba dispar
ELVRAIKENVCYVALDYDAEMKRKP

SEQ ID NO: 2479664 - protein, 19 aa, Entamoeba dispar
ELVSHYSFFFGGFSNSILS

SEQ ID NO: 2479665 - protein, 24 aa, Entamoeba dispar
ELVSLFIKKYETFVLYSVDLKLVI

SEQ ID NO: 2479666 - protein, 25 aa, Entamoeba dispar
ELWDYLRQRMQAIAPNLSTLLGELI

SEQ ID NO: 2479667 - protein, 18 aa, Entamoeba dispar
ELWEVFMNQNIVQEFKSQ

SEQ ID NO: 2479668 - protein, 19 aa, Entamoeba dispar
ELWNGAMGREARQRAMDHF

SEQ ID NO: 2479669 - protein, 17 aa, Entamoeba dispar
ELWYLEANYTCIIFIGE

SEQ ID NO: 2479670 - protein, 19 aa, Entamoeba dispar
ELYAKFFTPEMCSRFTENS

SEQ ID NO: 2479671 - protein, 19 aa, Entamoeba dispar
ELYDYYLYWNKKDEQIEKL

SEQ ID NO: 2479672 - protein, 17 aa, Entamoeba dispar
ELYLCYFNAMLQNNSFK

SEQ ID NO: 2479673 - protein, 26 aa, Entamoeba dispar
ELYMDCCSITSNLFSLCFKGSESDEI

SEQ ID NO: 2479674 - protein, 19 aa, Entamoeba dispar
ELYSLASNGFFKALVRTNY

SEQ ID NO: 2479675 - protein, 27 aa, Entamoeba dispar
ELYTLKRLECPNVIPPYGVEQIVSGSV

SEQ ID NO: 2479676 - protein, 36 aa, Entamoeba dispar
ELYVFLWRFERDGKFDVWRCFYEIDKKITAEYQALS

SEQ ID NO: 2479677 - protein, 18 aa, Entamoeba dispar
ELYYGEKPLCPALYSTVF

SEQ ID NO: 2479678 - protein, 31 aa, Entamoeba dispar
EMAEMYPPYFEMYPMRVLMLIAQNPPPKLKN

SEQ ID NO: 2479679 - protein, 24 aa, Entamoeba dispar
EMATGKTCILHRWITNEFTNQTAT

SEQ ID NO: 2479680 - protein, 19 aa, Entamoeba dispar
EMDEVMKDIVLDDVVAQQE

SEQ ID NO: 2479681 - protein, 18 aa, Entamoeba dispar
EMEFKFGSMIIYSPPDEC

SEQ ID NO: 2479682 - protein, 26 aa, Entamoeba dispar
EMEKRFKVKEVIMAKVVHIDKKKHRV

SEQ ID NO: 2479683 - protein, 20 aa, Entamoeba dispar
EMEKYFAVFGKIKSCILMTQ

SEQ ID NO: 2479684 - protein, 19 aa, Entamoeba dispar
EMELCCKLKQWAETLKGEY

SEQ ID NO: 2479685 - protein, 18 aa, Entamoeba dispar
EMERGIWTAAEQLVHKAM

SEQ ID NO: 2479686 - protein, 26 aa, Entamoeba dispar
EMERSKIMLQLAFKRNQMLQNEKKRL

SEQ ID NO: 2479687 - protein, 21 aa, Entamoeba dispar
EMFDTCIFPAISEIVSEDITL

SEQ ID NO: 2479688 - protein, 23 aa, Entamoeba dispar
EMFTVKWKYCGDVFLSTEEPSFF

SEQ ID NO: 2479689 - protein, 19 aa, Entamoeba dispar
EMFYQRIIEKISNENNTIH

SEQ ID NO: 2479690 - protein, 18 aa, Entamoeba dispar
EMGAFKVLTHFRMMANKV

SEQ ID NO: 2479691 - protein, 19 aa, Entamoeba dispar
EMGNDCFSWCLTLTSINIP

SEQ ID NO: 2479692 - protein, 17 aa, Entamoeba dispar
EMIFKRKLDEIIITPSP

SEQ ID NO: 2479693 - protein, 24 aa, Entamoeba dispar
EMIIKGEVYIGGELEHAINVDDST

SEQ ID NO: 2479694 - protein, 17 aa, Entamoeba dispar
EMIIYGRVNNNWIKARE

SEQ ID NO: 2479695 - protein, 22 aa, Entamoeba dispar
EMIRKSLKINKFVLSKEEAEKR

SEQ ID NO: 2479696 - protein, 20 aa, Entamoeba dispar
EMIRLYDLKLLNSMLTSVSY

SEQ ID NO: 2479697 - protein, 18 aa, Entamoeba dispar
EMISCDYLTPLQLLPDEY

SEQ ID NO: 2479698 - protein, 18 aa, Entamoeba dispar
EMISICFFFVLKNMDDKT

SEQ ID NO: 2479699 - protein, 18 aa, Entamoeba dispar
EMISIRFSLIKTNKREII

SEQ ID NO: 2479700 - protein, 20 aa, Entamoeba dispar
EMKECLELLHFIQKNWINEP

SEQ ID NO: 2479701 - protein, 21 aa, Entamoeba dispar
EMKELMVYSYFLFDGTCNISL

SEQ ID NO: 2479702 - protein, 23 aa, Entamoeba dispar
EMKEQISSFSFFFSNEFSNHLGP

SEQ ID NO: 2479703 - protein, 19 aa, Entamoeba dispar
EMKIIESIYLNKLIFVESN

SEQ ID NO: 2479704 - protein, 25 aa, Entamoeba dispar
EMKKAQMILLEFINRSDTYLKVPGI

SEQ ID NO: 2479705 - protein, 20 aa, Entamoeba dispar
EMKQLKSLRLEYIEETKNVK

SEQ ID NO: 2479706 - protein, 20 aa, Entamoeba dispar
EMKSLMIMYQEILKEQEMKD

SEQ ID NO: 2479707 - protein, 22 aa, Entamoeba dispar
EMLEVAKGYKLNKDHSNKTSNL

SEQ ID NO: 2479708 - protein, 21 aa, Entamoeba dispar
EMLEYPISEKVRRHYIHFVIV

SEQ ID NO: 2479709 - protein, 20 aa, Entamoeba dispar
EMLFRCLSPSLPMSLLQREV

SEQ ID NO: 2479710 - protein, 19 aa, Entamoeba dispar
EMLLKYGANIGQVYKGKPL

SEQ ID NO: 2479711 - protein, 21 aa, Entamoeba dispar
EMLLSIGDHCFDFCVNLTSLS

SEQ ID NO: 2479712 - protein, 24 aa, Entamoeba dispar
EMMKEGKRSLAFRLFSCKITGKQM

SEQ ID NO: 2479713 - protein, 18 aa, Entamoeba dispar
EMMYRCWDIEPQKRPTFK

SEQ ID NO: 2479714 - protein, 18 aa, Entamoeba dispar
EMNKLNIRLAQRQQENQV

SEQ ID NO: 2479715 - protein, 18 aa, Entamoeba dispar
EMNKTIMEWVRDGTDITN

SEQ ID NO: 2479716 - protein, 21 aa, Entamoeba dispar
EMNNQTIFGWFLTTTIPLMES

SEQ ID NO: 2479717 - protein, 19 aa, Entamoeba dispar
EMNRYSSIIRRNKVADTVV

SEQ ID NO: 2479718 - protein, 24 aa, Entamoeba dispar
EMPDCSVSLTLRDTCGQEQYKSLA

SEQ ID NO: 2479719 - protein, 17 aa, Entamoeba dispar
EMPEGIVPENGRKIPFG

SEQ ID NO: 2479720 - protein, 18 aa, Entamoeba dispar
EMPPAMIRPSNPLIEQAA

SEQ ID NO: 2479721 - protein, 25 aa, Entamoeba dispar
EMPPFCGGTTRTGDLCKNKKFVQCG

SEQ ID NO: 2479722 - protein, 17 aa, Entamoeba dispar
EMQRRVAELLTELEGVK

SEQ ID NO: 2479723 - protein, 20 aa, Entamoeba dispar
EMRRNEMEYISSLPERDPDK

SEQ ID NO: 2479724 - protein, 25 aa, Entamoeba dispar
EMSDYCKGAAYLAYLKRGNYAHEVI

SEQ ID NO: 2479725 - protein, 17 aa, Entamoeba dispar
EMSVKRGDTVIVSEKHL

SEQ ID NO: 2479726 - protein, 25 aa, Entamoeba dispar
EMTDCSAWYFGEVELQFEDEDQFVH

SEQ ID NO: 2479727 - protein, 22 aa, Entamoeba dispar
EMTLNQLFICFCCEKEKEKIQS

SEQ ID NO: 2479728 - protein, 18 aa, Entamoeba dispar
EMTNELFKQYCVDESLIG

SEQ ID NO: 2479729 - protein, 20 aa, Entamoeba dispar
EMTSFLLSFDEIKGIVNDKN

SEQ ID NO: 2479730 - protein, 19 aa, Entamoeba dispar
EMVGLFFGMIAKYLERDNP

SEQ ID NO: 2479731 - protein, 19 aa, Entamoeba dispar
EMVLIGLFLHFLLSGVSHP

SEQ ID NO: 2479732 - protein, 23 aa, Entamoeba dispar
EMWKCVGEVCGIDLKDIVQEWTY

SEQ ID NO: 2479733 - protein, 17 aa, Entamoeba dispar
EMYLEYIDNPIIKYYLL

SEQ ID NO: 2479734 - protein, 19 aa, Entamoeba dispar
EMYQIKTTLTFEGITEIIK

SEQ ID NO: 2479735 - protein, 22 aa, Entamoeba dispar
ENAAALAKEWHMLFYEVSAKTN

SEQ ID NO: 2479736 - protein, 22 aa, Entamoeba dispar
ENACLPRYPIPLIEQVMVGGKS

SEQ ID NO: 2479737 - protein, 19 aa, Entamoeba dispar
ENAEGKRTTPSCVSFTPTG

SEQ ID NO: 2479738 - protein, 25 aa, Entamoeba dispar
ENAEGKRTTPSCVSFTPTGILVGEA

SEQ ID NO: 2479739 - protein, 25 aa, Entamoeba dispar
ENAEGKRTTPSCVSFTPTGILVGEP

SEQ ID NO: 2479740 - protein, 17 aa, Entamoeba dispar
ENAREALGLIVEMVKAK

SEQ ID NO: 2479741 - protein, 24 aa, Entamoeba dispar
ENATLFLLFAHALIDYIFYHSSYI

SEQ ID NO: 2479742 - protein, 20 aa, Entamoeba dispar
ENCCKLSSIHFPSSLTHIQS

SEQ ID NO: 2479743 - protein, 21 aa, Entamoeba dispar
ENDATDGIIVFFAEGVSLKTD

SEQ ID NO: 2479744 - protein, 23 aa, Entamoeba dispar
ENDFKPRDALAIFKDMTDEDVRA

SEQ ID NO: 2479745 - protein, 25 aa, Entamoeba dispar
ENDKCFICGKFSSIVDVHTGKFYCT

SEQ ID NO: 2479746 - protein, 22 aa, Entamoeba dispar
ENDKTYYDWFAYNGDGIHSIDQ

SEQ ID NO: 2479747 - protein, 41 aa, Entamoeba dispar
ENDLECLTFIRDVWKSSSVRWQMARNFILWVPLTAIANNYS

SEQ ID NO: 2479748 - protein, 18 aa, Entamoeba dispar
ENDMPFELETRWATASKE

SEQ ID NO: 2479749 - protein, 23 aa, Entamoeba dispar
ENDNVCLFEDEFIRERSVDEHSF

SEQ ID NO: 2479750 - protein, 24 aa, Entamoeba dispar
ENDSFPSIHSFILAGNNIHNNLKE

SEQ ID NO: 2479751 - protein, 17 aa, Entamoeba dispar
ENECFKYCYSLTSINIP

SEQ ID NO: 2479752 - protein, 24 aa, Entamoeba dispar
ENEECTRCWTIVYSHGNSQDLGMC

SEQ ID NO: 2479753 - protein, 26 aa, Entamoeba dispar
ENEESRLSGNFKREYEDNGQTIIDHQ

SEQ ID NO: 2479754 - protein, 17 aa, Entamoeba dispar
ENEHILFVQYLKQELEE

SEQ ID NO: 2479755 - protein, 24 aa, Entamoeba dispar
ENEIFRLNGEWRGVTAGGCHVFPS

SEQ ID NO: 2479756 - protein, 19 aa, Entamoeba dispar
ENEILKLQLSESIEKNSEL

SEQ ID NO: 2479757 - protein, 22 aa, Entamoeba dispar
ENEKKPFLSLDKRIDELKQKQH

SEQ ID NO: 2479758 - protein, 25 aa, Entamoeba dispar
ENEKKVKEKKAFKLVEEHNKMVVKY

SEQ ID NO: 2479759 - protein, 22 aa, Entamoeba dispar
ENEKLDLIGVDWRDEDEKKTKS

SEQ ID NO: 2479760 - protein, 27 aa, Entamoeba dispar
ENEKWLKIHLQHVIWKQSGYYFHNRNI

SEQ ID NO: 2479761 - protein, 25 aa, Entamoeba dispar
ENELKTSPIRLALFKQPDFLNNPKI

SEQ ID NO: 2479762 - protein, 23 aa, Entamoeba dispar
ENELPLACCSHINKNLKEVSVSI

SEQ ID NO: 2479763 - protein, 23 aa, Entamoeba dispar
ENEMRTICGIVEKVDGAEVALRI

SEQ ID NO: 2479764 - protein, 20 aa, Entamoeba dispar
ENENECYYCSQSPNELNAIK

SEQ ID NO: 2479765 - protein, 22 aa, Entamoeba dispar
ENEPPFVYILLGWLTHLIVMNP

SEQ ID NO: 2479766 - protein, 21 aa, Entamoeba dispar
ENEQLKRGNGIIIGADKLEKA

SEQ ID NO: 2479767 - protein, 27 aa, Entamoeba dispar
ENETKEGSGLIFTEWNNKPSYTEVKPI

SEQ ID NO: 2479768 - protein, 17 aa, Entamoeba dispar
ENEYKQATQIGGKQYIR

SEQ ID NO: 2479769 - protein, 18 aa, Entamoeba dispar
ENEYKQATQIGGKQYIRL

SEQ ID NO: 2479770 - protein, 26 aa, Entamoeba dispar
ENFDLQRPKGVIVICNKIKEGKEMKK

SEQ ID NO: 2479771 - protein, 23 aa, Entamoeba dispar
ENFDVMLEFVVHFLFSSNKSDIF

SEQ ID NO: 2479772 - protein, 27 aa, Entamoeba dispar
ENFFTYKRYKFGVLYAAPGQTKEMEFF

SEQ ID NO: 2479773 - protein, 27 aa, Entamoeba dispar
ENFFTYKRYKFGVLYAAVGQTKEMEFF

SEQ ID NO: 2479774 - protein, 19 aa, Entamoeba dispar
ENFIQIFANVLLKIKIEKL

SEQ ID NO: 2479775 - protein, 32 aa, Entamoeba dispar
ENFKRVGMLHFLTYYYGMDWHKVANAPQGDNT

SEQ ID NO: 2479776 - protein, 19 aa, Entamoeba dispar
ENFNWIKTNFFQKFKQNDD

SEQ ID NO: 2479777 - protein, 19 aa, Entamoeba dispar
ENFRSFSLLGELISTIESF

SEQ ID NO: 2479778 - protein, 24 aa, Entamoeba dispar
ENGDGIFFKDEWLSIKKCEGFIDI

SEQ ID NO: 2479779 - protein, 17 aa, Entamoeba dispar
ENGFGYIPTNYVIFEKE

SEQ ID NO: 2479780 - protein, 17 aa, Entamoeba dispar
ENGGYSWWRRNSLTVFL

SEQ ID NO: 2479781 - protein, 18 aa, Entamoeba dispar
ENGIGLNSFNVWNRKFTK

SEQ ID NO: 2479782 - protein, 24 aa, Entamoeba dispar
ENGIRKLDLEYGDFPDDGYDYSQH

SEQ ID NO: 2479783 - protein, 24 aa, Entamoeba dispar
ENGISLNSYNAWVKRKYGKTAKKD

SEQ ID NO: 2479784 - protein, 23 aa, Entamoeba dispar
ENGKKASFFGVFDGHGGDQVAEY

SEQ ID NO: 2479785 - protein, 17 aa, Entamoeba dispar
ENGKPVFSRYGDETRMS

SEQ ID NO: 2479786 - protein, 24 aa, Entamoeba dispar
ENGLCKREVEVICQRMFKRDRKTG

SEQ ID NO: 2479787 - protein, 28 aa, Entamoeba dispar
ENGLFLDMCTLVLKTLRHNKSVIISLTN

SEQ ID NO: 2479788 - protein, 27 aa, Entamoeba dispar
ENGLKKYIRLMLSLDFSCHQYYLFDSI

SEQ ID NO: 2479789 - protein, 24 aa, Entamoeba dispar
ENGLPFSVHGCDPGWISVDEYYEN

SEQ ID NO: 2479790 - protein, 28 aa, Entamoeba dispar
ENGLWKSFYGLHCAKDFIEYISTMETPI

SEQ ID NO: 2479791 - protein, 18 aa, Entamoeba dispar
ENGQRLAIQNSLRNQRRQ

SEQ ID NO: 2479792 - protein, 22 aa, Entamoeba dispar
ENGRCTVCGCSHSDHENESYKW

SEQ ID NO: 2479793 - protein, 23 aa, Entamoeba dispar
ENGSGEGCLFVFSKTQTNYFISH

SEQ ID NO: 2479794 - protein, 17 aa, Entamoeba dispar
ENGVCYWQVPSMYTGQM

SEQ ID NO: 2479795 - protein, 18 aa, Entamoeba dispar
ENHFPQERMAILQQVADY

SEQ ID NO: 2479796 - protein, 19 aa, Entamoeba dispar
ENIAPISLKPVIEKNFLGS

SEQ ID NO: 2479797 - protein, 20 aa, Entamoeba dispar
ENIHLFVLILNYFMIHFTTN

SEQ ID NO: 2479798 - protein, 26 aa, Entamoeba dispar
ENIIDYKGCWIKLNIHKDEKYDFFTN

SEQ ID NO: 2479799 - protein, 19 aa, Entamoeba dispar
ENIKALCKQTIEIVEYREE

SEQ ID NO: 2479800 - protein, 25 aa, Entamoeba dispar
ENIKFVVQCLYRFVTHSTSLDIKQI

SEQ ID NO: 2479801 - protein, 23 aa, Entamoeba dispar
ENIKRMVKLLCNIFPVDDFWKHV

SEQ ID NO: 2479802 - protein, 20 aa, Entamoeba dispar
ENIMAGGAMKRRGEFMYGSR

SEQ ID NO: 2479803 - protein, 30 aa, Entamoeba dispar
ENIPESLALHLFRFRHYYLHHYFNKIGFFV

SEQ ID NO: 2479804 - protein, 26 aa, Entamoeba dispar
ENIRSDAFFGTFLRQKVEAFNQTLPR

SEQ ID NO: 2479805 - protein, 17 aa, Entamoeba dispar
ENIRTNALWVISNIATT

SEQ ID NO: 2479806 - protein, 17 aa, Entamoeba dispar
ENIRYIPTYIFVIDITC

SEQ ID NO: 2479807 - protein, 19 aa, Entamoeba dispar
ENISPLIIACIARLREEEM

SEQ ID NO: 2479808 - protein, 19 aa, Entamoeba dispar
ENIYCLLPNYLFEQKELGK

SEQ ID NO: 2479809 - protein, 19 aa, Entamoeba dispar
ENIYGISLEPSMEVNVKLA

SEQ ID NO: 2479810 - protein, 19 aa, Entamoeba dispar
ENIYYIQGLNTFYQLIPID

SEQ ID NO: 2479811 - protein, 24 aa, Entamoeba dispar
ENKEFSSLTSYVVYSSGKIKKDVV

SEQ ID NO: 2479812 - protein, 24 aa, Entamoeba dispar
ENKEIIRQIVFRILKIPLIEERTG

SEQ ID NO: 2479813 - protein, 21 aa, Entamoeba dispar
ENKEKCLWYLLDNVGISVIYS

SEQ ID NO: 2479814 - protein, 23 aa, Entamoeba dispar
ENKEVLGTIGIDIFKQGYAKVLL

SEQ ID NO: 2479815 - protein, 25 aa, Entamoeba dispar
ENKFLAYSVGYDWHQGVEGLLQQQV

SEQ ID NO: 2479816 - protein, 25 aa, Entamoeba dispar
ENKHIKEQLKAGGLQHQQINQMVRE

SEQ ID NO: 2479817 - protein, 25 aa, Entamoeba dispar
ENKIEWKLLVKKAEKWLEMKQPLPE

SEQ ID NO: 2479818 - protein, 23 aa, Entamoeba dispar
ENKKPSGLGRVFIEFKTIDGAIR

SEQ ID NO: 2479819 - protein, 25 aa, Entamoeba dispar
ENKLRKVFDYDASVMQAYRWLQEHK

SEQ ID NO: 2479820 - protein, 20 aa, Entamoeba dispar
ENKNFRIAIDAVKTENSLLE

SEQ ID NO: 2479821 - protein, 24 aa, Entamoeba dispar
ENKRKCKSIVNCLEIHCYKKGDDG

SEQ ID NO: 2479822 - protein, 26 aa, Entamoeba dispar
ENKRVRLYGCKDYRDLSQWNSSYEEI

SEQ ID NO: 2479823 - protein, 23 aa, Entamoeba dispar
ENKSFYDCVLFFSPSKKRCIKNP

SEQ ID NO: 2479824 - protein, 18 aa, Entamoeba dispar
ENKSIWLKHIKKIIKGVC

SEQ ID NO: 2479825 - protein, 27 aa, Entamoeba dispar
ENKVEWKLIVKKSENWLASKPAISEEI

SEQ ID NO: 2479826 - protein, 27 aa, Entamoeba dispar
ENKVRGCSYCYGFQGVDEFLKKNEITS

SEQ ID NO: 2479827 - protein, 19 aa, Entamoeba dispar
ENLCKKFPFAQEDTLYLLQ

SEQ ID NO: 2479828 - protein, 26 aa, Entamoeba dispar
ENLEAKCALIYLCGEFVTKITNAKEF

SEQ ID NO: 2479829 - protein, 19 aa, Entamoeba dispar
ENLEYPSNIIIYRKANKTS

SEQ ID NO: 2479830 - protein, 19 aa, Entamoeba dispar
ENLIGFPKEVFRILHDCSG

SEQ ID NO: 2479831 - protein, 26 aa, Entamoeba dispar
ENLKRKIANGLIFIKWGYSDIVDVMQ

SEQ ID NO: 2479832 - protein, 19 aa, Entamoeba dispar
ENLKTPKIEVEHLILELQK

SEQ ID NO: 2479833 - protein, 22 aa, Entamoeba dispar
ENLKYIIKYITIWNKSHTKTIE

SEQ ID NO: 2479834 - protein, 29 aa, Entamoeba dispar
ENLNGIPTRLRVVLLRIKGSNSIEEVLKQ

SEQ ID NO: 2479835 - protein, 23 aa, Entamoeba dispar
ENLNPLKKFFVIRDPDLGAPQGK

SEQ ID NO: 2479836 - protein, 20 aa, Entamoeba dispar
ENLNRRFVRFHMGDKTDQDD

SEQ ID NO: 2479837 - protein, 18 aa, Entamoeba dispar
ENLRICYLAKKPLKNHLL

SEQ ID NO: 2479838 - protein, 22 aa, Entamoeba dispar
ENLRRLRFIIVKTKGNCIDTLI

SEQ ID NO: 2479839 - protein, 17 aa, Entamoeba dispar
ENLSIIFGNIIDIEKYH

SEQ ID NO: 2479840 - protein, 19 aa, Entamoeba dispar
ENLSVIICSFVSSQHICHS

SEQ ID NO: 2479841 - protein, 25 aa, Entamoeba dispar
ENLWQFDISNLIWRKLGNLENFKLG

SEQ ID NO: 2479842 - protein, 24 aa, Entamoeba dispar
ENMCDGCAVDFIPLIDAISQTFSS

SEQ ID NO: 2479843 - protein, 22 aa, Entamoeba dispar
ENNCIAVICADGSVSLIDKRSG

SEQ ID NO: 2479844 - protein, 20 aa, Entamoeba dispar
ENNITMGIAPNYDVDLVGSK

SEQ ID NO: 2479845 - protein, 22 aa, Entamoeba dispar
ENNKGAIDWNYGVIAFGSRTNV

SEQ ID NO: 2479846 - protein, 25 aa, Entamoeba dispar
ENNKLSDLEIIGWTPVESNALRVII

SEQ ID NO: 2479847 - protein, 21 aa, Entamoeba dispar
ENNQRFARYVIFIKKPKRFVV

SEQ ID NO: 2479848 - protein, 17 aa, Entamoeba dispar
ENNRLHQLISLNDSQNK

SEQ ID NO: 2479849 - protein, 26 aa, Entamoeba dispar
ENNVIIKLLLCQQVFRIINNKIIELQ

SEQ ID NO: 2479850 - protein, 23 aa, Entamoeba dispar
ENNYSIAVGVNYKNGVISNSGKF

SEQ ID NO: 2479851 - protein, 24 aa, Entamoeba dispar
ENPAYKRRLTCVLHGHTHDSQGLV

SEQ ID NO: 2479852 - protein, 18 aa, Entamoeba dispar
ENPEKCVFVQGNLVNAAS

SEQ ID NO: 2479853 - protein, 25 aa, Entamoeba dispar
ENPELIKQICFFLIPSVSLGYKDCF

SEQ ID NO: 2479854 - protein, 24 aa, Entamoeba dispar
ENPHQIILELFDFSNPLISLTQIW

SEQ ID NO: 2479855 - protein, 21 aa, Entamoeba dispar
ENPQNPILFIAPSIPYLPTTA

SEQ ID NO: 2479856 - protein, 23 aa, Entamoeba dispar
ENPTSDVIFCLNTDHITKIKQTI

SEQ ID NO: 2479857 - protein, 23 aa, Entamoeba dispar
ENQIKLFYLYLINKLDQYVNQEY

SEQ ID NO: 2479858 - protein, 23 aa, Entamoeba dispar
ENQKEFLKPFVVIISDHPSVNVR

SEQ ID NO: 2479859 - protein, 17 aa, Entamoeba dispar
ENQKGFKILTDDEQSLK

SEQ ID NO: 2479860 - protein, 18 aa, Entamoeba dispar
ENQKGFKILTDDEQSLKL

SEQ ID NO: 2479861 - protein, 23 aa, Entamoeba dispar
ENQKLGIPETISFNPIDLPLQNP

SEQ ID NO: 2479862 - protein, 19 aa, Entamoeba dispar
ENQPLLSVVENLQPPTINE

SEQ ID NO: 2479863 - protein, 24 aa, Entamoeba dispar
ENQRESWWLAYIMDQIEEEKSKGI

SEQ ID NO: 2479864 - protein, 30 aa, Entamoeba dispar
ENQRIKGICLLLLESCCEILKYYKEGKVFN

SEQ ID NO: 2479865 - protein, 24 aa, Entamoeba dispar
ENQTKFRVIMIFDADHLTNDAQQS

SEQ ID NO: 2479866 - protein, 26 aa, Entamoeba dispar
ENRIPSWCDRVLWKTENRHFVDAKEY

SEQ ID NO: 2479867 - protein, 25 aa, Entamoeba dispar
ENRIPSWCDRVLWKTENRHYVEVKE

SEQ ID NO: 2479868 - protein, 25 aa, Entamoeba dispar
ENRLYKLLCWTGKDIWACIKPTNNK

SEQ ID NO: 2479869 - protein, 22 aa, Entamoeba dispar
ENRPKSGMILIALQEMKKDFKS

SEQ ID NO: 2479870 - protein, 31 aa, Entamoeba dispar
ENSAPMATLFFARLGPMMKEEILKKVCNQYG

SEQ ID NO: 2479871 - protein, 19 aa, Entamoeba dispar
ENSDDILIVLGRNSQAGVR

SEQ ID NO: 2479872 - protein, 28 aa, Entamoeba dispar
ENSEEIMNFVALCLIKNSRQRATINQLK

SEQ ID NO: 2479873 - protein, 23 aa, Entamoeba dispar
ENSFKFLPQNTIFILKDLIFNIQ

SEQ ID NO: 2479874 - protein, 20 aa, Entamoeba dispar
ENSGKCTFNGKEFCATLVRL

SEQ ID NO: 2479875 - protein, 30 aa, Entamoeba dispar
ENSPICLHFALGKCFKGKECPYKHQLPQEE

SEQ ID NO: 2479876 - protein, 22 aa, Entamoeba dispar
ENSPKLSINFTFSDIQKKYQWS

SEQ ID NO: 2479877 - protein, 27 aa, Entamoeba dispar
ENSRLVIKLCNQMNAIAMTKELTNLAG

SEQ ID NO: 2479878 - protein, 25 aa, Entamoeba dispar
ENSRPCPSCKTFIEKNGGCQWMSCY

SEQ ID NO: 2479879 - protein, 24 aa, Entamoeba dispar
ENSWIIRPCHGFEEIYTCLNNMML

SEQ ID NO: 2479880 - protein, 23 aa, Entamoeba dispar
ENSYELCIIFILINEGFPENIIR

SEQ ID NO: 2479881 - protein, 21 aa, Entamoeba dispar
ENTDGGFKRKSNYNTEDTGKH

SEQ ID NO: 2479882 - protein, 27 aa, Entamoeba dispar
ENTDPVIAFHFCVKAKTLIEEQYQGED

SEQ ID NO: 2479883 - protein, 19 aa, Entamoeba dispar
ENTEFWQHLCIIWTNCYYH

SEQ ID NO: 2479884 - protein, 24 aa, Entamoeba dispar
ENTFSLACELVRLAPTPLHPRIQD

SEQ ID NO: 2479885 - protein, 32 aa, Entamoeba dispar
ENTKIPSLLSHYIQLYFLPAVRSLVIEEIRRS

SEQ ID NO: 2479886 - protein, 23 aa, Entamoeba dispar
ENTKKVVFDICINKLSKSREENK

SEQ ID NO: 2479887 - protein, 18 aa, Entamoeba dispar
ENTMKWYHTFCGDCLSNG

SEQ ID NO: 2479888 - protein, 19 aa, Entamoeba dispar
ENTNEILKSTGLYKTIKEH

SEQ ID NO: 2479889 - protein, 24 aa, Entamoeba dispar
ENTPFTCFSVHPGIYNSNLHNSYW

SEQ ID NO: 2479890 - protein, 25 aa, Entamoeba dispar
ENTSPRIAVCHEVSPTLGNVEELSK

SEQ ID NO: 2479891 - protein, 17 aa, Entamoeba dispar
ENVDGMIFLVGNKIDVI

SEQ ID NO: 2479892 - protein, 25 aa, Entamoeba dispar
ENVKAMWPRKGFYLGNFDIDYRHET

SEQ ID NO: 2479893 - protein, 17 aa, Entamoeba dispar
ENVRCFDSNSVVTLPCE

SEQ ID NO: 2479894 - protein, 19 aa, Entamoeba dispar
ENVRQMYQDGCTWTTHFNR

SEQ ID NO: 2479895 - protein, 18 aa, Entamoeba dispar
ENVWDYCNKFGEFDPENH

SEQ ID NO: 2479896 - protein, 18 aa, Entamoeba dispar
ENYAAVKLIRQAADIFRS

SEQ ID NO: 2479897 - protein, 24 aa, Entamoeba dispar
ENYFLFTCFCAFWVTSDGQLRIHQ

SEQ ID NO: 2479898 - protein, 22 aa, Entamoeba dispar
ENYKSRVEICVHNFSRLKPTSL

SEQ ID NO: 2479899 - protein, 25 aa, Entamoeba dispar
ENYLDPRVSDLIKMIFDTDMMKNTL

SEQ ID NO: 2479900 - protein, 25 aa, Entamoeba dispar
ENYPHLKIGYKFDSLIHQCIKDIIK

SEQ ID NO: 2479901 - protein, 19 aa, Entamoeba dispar
ENYSLFFYITVLIRQIVES

SEQ ID NO: 2479902 - protein, 21 aa, Entamoeba dispar
ENYTFKFFSKFNELIINNDDL

SEQ ID NO: 2479903 - protein, 22 aa, Entamoeba dispar
ENYTRTDLLPWREDMEEIQTIR

SEQ ID NO: 2479904 - protein, 21 aa, Entamoeba dispar
ENYWECIEKILYALQGQIEKY

SEQ ID NO: 2479905 - protein, 23 aa, Entamoeba dispar
EPAAKERLASIALVKPEKARQVG

SEQ ID NO: 2479906 - protein, 20 aa, Entamoeba dispar
EPAHFFPGFIEMLKEFRKLG

SEQ ID NO: 2479907 - protein, 17 aa, Entamoeba dispar
EPALIKLNAIAAATEAA

SEQ ID NO: 2479908 - protein, 17 aa, Entamoeba dispar
EPAPFVLTESMIYVFAG

SEQ ID NO: 2479909 - protein, 17 aa, Entamoeba dispar
EPASCKELSEWESLYQE

SEQ ID NO: 2479910 - protein, 20 aa, Entamoeba dispar
EPDCHIVAKMVLYDFQRGRL

SEQ ID NO: 2479911 - protein, 19 aa, Entamoeba dispar
EPDGSSFPNGGLRQTYQAR

SEQ ID NO: 2479912 - protein, 31 aa, Entamoeba dispar
EPDLMEIEICFFKGLEMRSKYQDERQVELIS

SEQ ID NO: 2479913 - protein, 21 aa, Entamoeba dispar
EPDNEWAIAEWNRYKQRNDSI

SEQ ID NO: 2479914 - protein, 26 aa, Entamoeba dispar
EPEAKPKYRSVYLFLFNDTIILTKII

SEQ ID NO: 2479915 - protein, 23 aa, Entamoeba dispar
EPEDISGVLPLFANRGRVPKVIE

SEQ ID NO: 2479916 - protein, 18 aa, Entamoeba dispar
EPEKRPVFKQIENHPFFS

SEQ ID NO: 2479917 - protein, 19 aa, Entamoeba dispar
EPESVCCGMHCASNLKYRE

SEQ ID NO: 2479918 - protein, 27 aa, Entamoeba dispar
EPFDIKGKCILPKFQIEISPKKFLIIN

SEQ ID NO: 2479919 - protein, 27 aa, Entamoeba dispar
EPFKPKKGKTCVLMMVGLQGAGKTTTI

SEQ ID NO: 2479920 - protein, 19 aa, Entamoeba dispar
EPFPWALISVGSIDCIVDI

SEQ ID NO: 2479921 - protein, 19 aa, Entamoeba dispar
EPFSSPMIEEPVSIPEDNK

SEQ ID NO: 2479922 - protein, 23 aa, Entamoeba dispar
EPGCGKTSLILAYIDESFSLEIV

SEQ ID NO: 2479923 - protein, 17 aa, Entamoeba dispar
EPICKDLIRLIELSELR

SEQ ID NO: 2479924 - protein, 20 aa, Entamoeba dispar
EPICKTFKMKGAGSCCLVLQ

SEQ ID NO: 2479925 - protein, 24 aa, Entamoeba dispar
EPIELSAKYLPRFFKHNNFSSFVR

SEQ ID NO: 2479926 - protein, 19 aa, Entamoeba dispar
EPIIIPVRIKRSKPKYYCF

SEQ ID NO: 2479927 - protein, 25 aa, Entamoeba dispar
EPIISRFDLIMIVRDVVDYEKDYKL

SEQ ID NO: 2479928 - protein, 23 aa, Entamoeba dispar
EPIKSIKKVIEWEIPEIDEDIQN

SEQ ID NO: 2479929 - protein, 18 aa, Entamoeba dispar
EPILLPYYVDALLTSNQQ

SEQ ID NO: 2479930 - protein, 18 aa, Entamoeba dispar
EPILTALLQLVTRKPSDE

SEQ ID NO: 2479931 - protein, 22 aa, Entamoeba dispar
EPINIKLPFLLKFLSIKNPLSL

SEQ ID NO: 2479932 - protein, 21 aa, Entamoeba dispar
EPIPKIKLRVSIDPFIAQLSK

SEQ ID NO: 2479933 - protein, 19 aa, Entamoeba dispar
EPIPQLGFENEFICNFHET

SEQ ID NO: 2479934 - protein, 26 aa, Entamoeba dispar
EPIRFLPPIEKHWFPNYSGVSSYLTM

SEQ ID NO: 2479935 - protein, 19 aa, Entamoeba dispar
EPIYKLICGCWKQNPKDRL

SEQ ID NO: 2479936 - protein, 20 aa, Entamoeba dispar
EPIYRSNVEIIRAMKKSIPV

SEQ ID NO: 2479937 - protein, 20 aa, Entamoeba dispar
EPKERIRIEEVVRMLERVQS

SEQ ID NO: 2479938 - protein, 18 aa, Entamoeba dispar
EPKFIPFQYEMFIGSSSL

SEQ ID NO: 2479939 - protein, 23 aa, Entamoeba dispar
EPKICTYTHFAMINPFITIDHTT

SEQ ID NO: 2479940 - protein, 25 aa, Entamoeba dispar
EPKKMIKLLPCIKTFEFDRINVIII

SEQ ID NO: 2479941 - protein, 23 aa, Entamoeba dispar
EPKKSILPRLSMTRRPRNKILYG

SEQ ID NO: 2479942 - protein, 22 aa, Entamoeba dispar
EPKKSPRIAIDIEENKPNQKEE

SEQ ID NO: 2479943 - protein, 20 aa, Entamoeba dispar
EPKRRIILTNKIERTPLFNS

SEQ ID NO: 2479944 - protein, 19 aa, Entamoeba dispar
EPKTLVSYLSFCQIDGNHL

SEQ ID NO: 2479945 - protein, 23 aa, Entamoeba dispar
EPKYYCPIIPTVLVNGADGIGTG

SEQ ID NO: 2479946 - protein, 17 aa, Entamoeba dispar
EPLEEGVSFIDLNASSK

SEQ ID NO: 2479947 - protein, 19 aa, Entamoeba dispar
EPLIPFSIVEIIINIFKKL

SEQ ID NO: 2479948 - protein, 20 aa, Entamoeba dispar
EPLLKPRTFLIWQNSSYPSS

SEQ ID NO: 2479949 - protein, 17 aa, Entamoeba dispar
EPLMVGCSVVDGKKNNV

SEQ ID NO: 2479950 - protein, 19 aa, Entamoeba dispar
EPLNSYIAIKSFPLPEDIL

SEQ ID NO: 2479951 - protein, 25 aa, Entamoeba dispar
EPLPSSKDSHCWWINHRSHYPKLYE

SEQ ID NO: 2479952 - protein, 28 aa, Entamoeba dispar
EPLRGLRVLNFNGCKNFSEYALKEMEDL

SEQ ID NO: 2479953 - protein, 25 aa, Entamoeba dispar
EPLRLESFSTIPISITELLSLFFHV

SEQ ID NO: 2479954 - protein, 27 aa, Entamoeba dispar
EPLYTYLFDLCYLPVIGNPGEDSYQRK

SEQ ID NO: 2479955 - protein, 25 aa, Entamoeba dispar
EPNASRKIIRFGIITIYEPEAKPKY

SEQ ID NO: 2479956 - protein, 21 aa, Entamoeba dispar
EPNKIKYGFIAQEVQEVIPDL

SEQ ID NO: 2479957 - protein, 31 aa, Entamoeba dispar
EPNTFKTSLKRFSYCPVLFSNNDENIKEIKE

SEQ ID NO: 2479958 - protein, 22 aa, Entamoeba dispar
EPNYLEPWLIVDFDSDIVVASV

SEQ ID NO: 2479959 - protein, 20 aa, Entamoeba dispar
EPPCELLDCGTSYLLKFEVP

SEQ ID NO: 2479960 - protein, 21 aa, Entamoeba dispar
EPPHSGLFCDLLWSDPTNDSF

SEQ ID NO: 2479961 - protein, 22 aa, Entamoeba dispar
EPPNCYTPHFSLLQPQIEEDPE

SEQ ID NO: 2479962 - protein, 17 aa, Entamoeba dispar
EPPRLQIDYHFNSTSIN

SEQ ID NO: 2479963 - protein, 21 aa, Entamoeba dispar
EPPSEGSLCDLLWSDPVSEWD

SEQ ID NO: 2479964 - protein, 19 aa, Entamoeba dispar
EPPSKGIICDLLWSDPITE

SEQ ID NO: 2479965 - protein, 24 aa, Entamoeba dispar
EPPTRYSDIYSFSIVIWEIVTFKH

SEQ ID NO: 2479966 - protein, 23 aa, Entamoeba dispar
EPPTSGAMCDLLWSDPLDQPHPE

SEQ ID NO: 2479967 - protein, 22 aa, Entamoeba dispar
EPRIKPQWWVNCKDMAKRAVEA

SEQ ID NO: 2479968 - protein, 23 aa, Entamoeba dispar
EPSFLDWRLNVSGKVNDDAERAS

SEQ ID NO: 2479969 - protein, 18 aa, Entamoeba dispar
EPSGLPIDYLQAGSPLVC

SEQ ID NO: 2479970 - protein, 17 aa, Entamoeba dispar
EPSKSYEIAICQSIGRR

SEQ ID NO: 2479971 - protein, 20 aa, Entamoeba dispar
EPSLFWLFQSVMTMLQGFYC

SEQ ID NO: 2479972 - protein, 28 aa, Entamoeba dispar
EPSLRENWYCKGRSVIEMNKDALCGLVY

SEQ ID NO: 2479973 - protein, 28 aa, Entamoeba dispar
EPSNSFVCICCNTLFFAEKNVLRYCSFG

SEQ ID NO: 2479974 - protein, 21 aa, Entamoeba dispar
EPSSIEWCHMIGLNYVSCSSY

SEQ ID NO: 2479975 - protein, 20 aa, Entamoeba dispar
EPTEHIIIVMKYIVKYLQSK

SEQ ID NO: 2479976 - protein, 23 aa, Entamoeba dispar
EPTYPCAIINNFATLSFDQPYIS

SEQ ID NO: 2479977 - protein, 24 aa, Entamoeba dispar
EPTYRTEKYWDYSKTVLSMWNIVS

SEQ ID NO: 2479978 - protein, 23 aa, Entamoeba dispar
  misc_feature (16)..(17): Xaa can be any naturally occurring amino acid
EPVDEFKSAFYLLLNXXFLISDD

SEQ ID NO: 2479979 - protein, 23 aa, Entamoeba dispar
EPVEEIKSAFYLLDNARARYLGD

SEQ ID NO: 2479980 - protein, 25 aa, Entamoeba dispar
EPVLKRNPHLFLMGFNQPGDLFHFE

SEQ ID NO: 2479981 - protein, 23 aa, Entamoeba dispar
EPYELFPQLGRFTLRDAGKTIAF

SEQ ID NO: 2479982 - protein, 20 aa, Entamoeba dispar
EPYFRAPASFLPIRERREET

SEQ ID NO: 2479983 - protein, 22 aa, Entamoeba dispar
EPYKEFKSLFEIKQYVEEGKRL

SEQ ID NO: 2479984 - protein, 21 aa, Entamoeba dispar
EPYMKCLNEFISKETVALQFA

SEQ ID NO: 2479985 - protein, 18 aa, Entamoeba dispar
EPYSIPINVSRLLVVLTD

SEQ ID NO: 2479986 - protein, 18 aa, Entamoeba dispar
EPYTLFYNNYEKVKFTQN

SEQ ID NO: 2479987 - protein, 23 aa, Entamoeba dispar
EPYYYCFEDGILTTKQERFEIRY

SEQ ID NO: 2479988 - protein, 26 aa, Entamoeba dispar
EQALESTCIVIGKMFMVIEVHCQPIF

SEQ ID NO: 2479989 - protein, 21 aa, Entamoeba dispar
EQALSHPWFKGIAQPSVTEGV

SEQ ID NO: 2479990 - protein, 19 aa, Entamoeba dispar
EQATHIILFEMISQVIDDF

SEQ ID NO: 2479991 - protein, 18 aa, Entamoeba dispar
EQCARPESPVTFQEAVEN

SEQ ID NO: 2479992 - protein, 17 aa, Entamoeba dispar
EQCCKGVQWLHNGMNLI

SEQ ID NO: 2479993 - protein, 22 aa, Entamoeba dispar
EQCGSLKFSEEMVSFDESHIIM

SEQ ID NO: 2479994 - protein, 19 aa, Entamoeba dispar
EQCINYKPINSFLNFLESN

SEQ ID NO: 2479995 - protein, 33 aa, Entamoeba dispar
EQDIKITELRGGNGEEALKIKAQIKQIEEENDK

SEQ ID NO: 2479996 - protein, 25 aa, Entamoeba dispar
EQDKLKYYFAVAVFDSIETANEVYN

SEQ ID NO: 2479997 - protein, 17 aa, Entamoeba dispar
EQDNAFHFYGYGDERNV

SEQ ID NO: 2479998 - protein, 26 aa, Entamoeba dispar
EQDSMKCCIKGYVVHKSRINEFGNEE

SEQ ID NO: 2479999 - protein, 17 aa, Entamoeba dispar
EQECFSYAGFEQQPKLF

SEQ ID NO: 2480000 - protein, 24 aa, Entamoeba dispar
EQEILLKCDELYFNEKLDSINVKI

SEQ ID NO: 2480001 - protein, 26 aa, Entamoeba dispar
EQELKPNGVFALHWDEFTGDDDFKDL

SEQ ID NO: 2480002 - protein, 17 aa, Entamoeba dispar
EQENEWSVLASLIAFDK

SEQ ID NO: 2480003 - protein, 25 aa, Entamoeba dispar
EQENIKGIKIKGSFKQEMKSGEESY

SEQ ID NO: 2480004 - protein, 21 aa, Entamoeba dispar
EQENYKWVLLEDSFAQKDYIK

SEQ ID NO: 2480005 - protein, 25 aa, Entamoeba dispar
EQETWKLISGIVCKDNNAVIKITGF

SEQ ID NO: 2480006 - protein, 17 aa, Entamoeba dispar
EQFAKDRLCQFYEISTE

SEQ ID NO: 2480007 - protein, 20 aa, Entamoeba dispar
EQFHSFAINDFILFEDFKTQ

SEQ ID NO: 2480008 - protein, 20 aa, Entamoeba dispar
EQFIELCREQPQIIEPFLQH

SEQ ID NO: 2480009 - protein, 17 aa, Entamoeba dispar
EQFKLTLCCLPIFELYG

SEQ ID NO: 2480010 - protein, 24 aa, Entamoeba dispar
EQFLKLIKSFECQDYANVLIGQIF

SEQ ID NO: 2480011 - protein, 17 aa, Entamoeba dispar
EQFPTPEMIALKQSNHT

SEQ ID NO: 2480012 - protein, 24 aa, Entamoeba dispar
EQFRKICILKGISPRLPSKGLNTL

SEQ ID NO: 2480013 - protein, 24 aa, Entamoeba dispar
EQGEIGVKFHVIWNNSPSMKTVSG

SEQ ID NO: 2480014 - protein, 18 aa, Entamoeba dispar
EQHKELIFTISKLSPKCP

SEQ ID NO: 2480015 - protein, 21 aa, Entamoeba dispar
EQHLRNEIEIGRIIKMKVINY

SEQ ID NO: 2480016 - protein, 19 aa, Entamoeba dispar
EQHPPPEYITLKSVVSKFV

SEQ ID NO: 2480017 - protein, 24 aa, Entamoeba dispar
EQIAELATVWGMYGIPLKSAIKKS

SEQ ID NO: 2480018 - protein, 25 aa, Entamoeba dispar
EQIAELATVWGMYGIPLKSAIKKSQ

SEQ ID NO: 2480019 - protein, 22 aa, Entamoeba dispar
EQIELLATIVVQYKLSHQQVYE

SEQ ID NO: 2480020 - protein, 24 aa, Entamoeba dispar
EQIHCFPQGMLPVVDFNGKILYEE

SEQ ID NO: 2480021 - protein, 18 aa, Entamoeba dispar
EQIIKFWRIDLDDDFSKD

SEQ ID NO: 2480022 - protein, 17 aa, Entamoeba dispar
EQIIRLKQENMVLKEEI

SEQ ID NO: 2480023 - protein, 23 aa, Entamoeba dispar
EQIKKPTSWVIGKSVVRGRDWKW

SEQ ID NO: 2480024 - protein, 17 aa, Entamoeba dispar
EQIKLIFGGVSVIYGVN

SEQ ID NO: 2480025 - protein, 32 aa, Entamoeba dispar
EQIKNKKIPLCQWPLYVSTSFDNEINGGNEDD

SEQ ID NO: 2480026 - protein, 23 aa, Entamoeba dispar
EQILCSKGSMKVIRKMYETTQSE

SEQ ID NO: 2480027 - protein, 24 aa, Entamoeba dispar
EQIPFEMYSGLRIHTVKNQTLGEI

SEQ ID NO: 2480028 - protein, 18 aa, Entamoeba dispar
EQIPSCVNLSQLNSSGFA

SEQ ID NO: 2480029 - protein, 25 aa, Entamoeba dispar
EQIRYRLRLSYGMVDGVCILSNENS

SEQ ID NO: 2480030 - protein, 24 aa, Entamoeba dispar
EQISCSGLDKYSFPITINQQSNQL

SEQ ID NO: 2480031 - protein, 17 aa, Entamoeba dispar
EQITSIIKQCWQQDKDE

SEQ ID NO: 2480032 - protein, 17 aa, Entamoeba dispar
EQIVACSSFPSFQNIYV

SEQ ID NO: 2480033 - protein, 24 aa, Entamoeba dispar
EQIWCKLLCYCIGEIFNQHEDVNG

SEQ ID NO: 2480034 - protein, 25 aa, Entamoeba dispar
EQIWCKLLCYCIGEIFSQHQFVNGV

SEQ ID NO: 2480035 - protein, 23 aa, Entamoeba dispar
EQKEELRRMSIEIDNHQLHEEFE

SEQ ID NO: 2480036 - protein, 23 aa, Entamoeba dispar
EQKEIRIRNGIKEDKKTSEDEEL

SEQ ID NO: 2480037 - protein, 27 aa, Entamoeba dispar
EQKINLVQCRLFLTKLIAVFNRGDTFT

SEQ ID NO: 2480038 - protein, 22 aa, Entamoeba dispar
EQKKLEGMLAEFLHKEAAVVVP

SEQ ID NO: 2480039 - protein, 24 aa, Entamoeba dispar
EQKLHLKGYIPLAFGTITRSPEMK

SEQ ID NO: 2480040 - protein, 20 aa, Entamoeba dispar
EQKLKFMIDCCKGMTMMHSF

SEQ ID NO: 2480041 - protein, 21 aa, Entamoeba dispar
EQKQARVISSFNCKTEELSLE

SEQ ID NO: 2480042 - protein, 21 aa, Entamoeba dispar
EQKRIAKGLSRNLVITKDKTS

SEQ ID NO: 2480043 - protein, 21 aa, Entamoeba dispar
EQKRLHALIVQAFKDHQKDII

SEQ ID NO: 2480044 - protein, 24 aa, Entamoeba dispar
EQKRYDLILERVIKKDMDIDKEEL

SEQ ID NO: 2480045 - protein, 20 aa, Entamoeba dispar
EQKYALKIALVMNTLIRGIV

SEQ ID NO: 2480046 - protein, 23 aa, Entamoeba dispar
EQLDRKNLVVVDCEQLKQELEEV

SEQ ID NO: 2480047 - protein, 25 aa, Entamoeba dispar
EQLGFPRVKIFLENLLQKKYKEALI

SEQ ID NO: 2480048 - protein, 18 aa, Entamoeba dispar
EQLGWKIVLKNTKSSSVT

SEQ ID NO: 2480049 - protein, 19 aa, Entamoeba dispar
EQLIFTGMRFEQGKYEIEI

SEQ ID NO: 2480050 - protein, 24 aa, Entamoeba dispar
EQLKFVKYKKYRFMTIEPIKKNGY

SEQ ID NO: 2480051 - protein, 27 aa, Entamoeba dispar
EQLKLSNGKLWFTIGILNENEELYDEA

SEQ ID NO: 2480052 - protein, 33 aa, Entamoeba dispar
EQLLPFMLTNQFKRDICWVFANLASENIKLRDE

SEQ ID NO: 2480053 - protein, 28 aa, Entamoeba dispar
EQLLSSFLRFHCCLLLLDYFDYINRIQE

SEQ ID NO: 2480054 - protein, 22 aa, Entamoeba dispar
EQLRSIFPPSRSIKVIFDLIQD

SEQ ID NO: 2480055 - protein, 24 aa, Entamoeba dispar
EQLSKDESIHFGDTVISTQPSFEV

SEQ ID NO: 2480056 - protein, 19 aa, Entamoeba dispar
EQNKLIPICNEIFGKSGIR

SEQ ID NO: 2480057 - protein, 29 aa, Entamoeba dispar
EQPFIISVLNICFEFLKIDPIKTEEVFTT

SEQ ID NO: 2480058 - protein, 19 aa, Entamoeba dispar
EQPIRFYVIKNKQFIAKVA

SEQ ID NO: 2480059 - protein, 26 aa, Entamoeba dispar
EQPLFLRRFNQTFNSPYRGNGMVPLI

SEQ ID NO: 2480060 - protein, 18 aa, Entamoeba dispar
EQPRKVIPTCYCTIEDED

SEQ ID NO: 2480061 - protein, 18 aa, Entamoeba dispar
EQPRKVIPTCYCVIEDEE

SEQ ID NO: 2480062 - protein, 17 aa, Entamoeba dispar
EQPRLPITQTQKIEDKS

SEQ ID NO: 2480063 - protein, 23 aa, Entamoeba dispar
EQQEYKEAFQLFDKDNDNKLTAE

SEQ ID NO: 2480064 - protein, 25 aa, Entamoeba dispar
EQQNEMMGGFGMMRGFGGGNMPMER

SEQ ID NO: 2480065 - protein, 24 aa, Entamoeba dispar
EQQNRMMGGFGMMGGFPHNNMPMR

SEQ ID NO: 2480066 - protein, 18 aa, Entamoeba dispar
EQQPALADICLIGKKEII

SEQ ID NO: 2480067 - protein, 21 aa, Entamoeba dispar
EQQTLKYAFFVRRKKENKITS

SEQ ID NO: 2480068 - protein, 20 aa, Entamoeba dispar
EQRICCSLIKVMESQNEEIT

SEQ ID NO: 2480069 - protein, 18 aa, Entamoeba dispar
EQRIELIKSCQIALWDVC

SEQ ID NO: 2480070 - protein, 20 aa, Entamoeba dispar
EQRLKDVIRDAVGCPWTPFD

SEQ ID NO: 2480071 - protein, 17 aa, Entamoeba dispar
EQSIDCIIIVLKESSNQ

SEQ ID NO: 2480072 - protein, 23 aa, Entamoeba dispar
EQSLKLSSILVENRVNITTKVVS

SEQ ID NO: 2480073 - protein, 25 aa, Entamoeba dispar
EQTELKLKALLIIRELNNLRVTTFN

SEQ ID NO: 2480074 - protein, 24 aa, Entamoeba dispar
EQTMKYKHAHIVFYASSFMLNYSN

SEQ ID NO: 2480075 - protein, 18 aa, Entamoeba dispar
EQTRYKRNMIFIITDNQL

SEQ ID NO: 2480076 - protein, 18 aa, Entamoeba dispar
EQTYDFLSVIFTRLLFSI

SEQ ID NO: 2480077 - protein, 18 aa, Entamoeba dispar
EQVEKVFLAEKVDVIVSE

SEQ ID NO: 2480078 - protein, 18 aa, Entamoeba dispar
EQVHCFTQGMLPVVDFNS

SEQ ID NO: 2480079 - protein, 18 aa, Entamoeba dispar
EQVICVICRLTSYNYMYI

SEQ ID NO: 2480080 - protein, 20 aa, Entamoeba dispar
EQVNAFKIMEMIKHIYDVIE

SEQ ID NO: 2480081 - protein, 27 aa, Entamoeba dispar
EQVPKRWWKFAFDSLLIEVKKKNYKES

SEQ ID NO: 2480082 - protein, 19 aa, Entamoeba dispar
EQWGLKHFCEALCVVGCTS

SEQ ID NO: 2480083 - protein, 25 aa, Entamoeba dispar
EQYDSFREANSFLFKPINSNEQKII

SEQ ID NO: 2480084 - protein, 22 aa, Entamoeba dispar
EQYEVIKSTSLREYSFDEEYLI

SEQ ID NO: 2480085 - protein, 19 aa, Entamoeba dispar
EQYIKIMPFEVIVLNAYLH

SEQ ID NO: 2480086 - protein, 22 aa, Entamoeba dispar
EQYRKSCFERDFSLVYQGILDE

SEQ ID NO: 2480087 - protein, 25 aa, Entamoeba dispar
EQYYIKGDGFVLVYSIDNKNSFHAL

SEQ ID NO: 2480088 - protein, 25 aa, Entamoeba dispar
EQYYLKGDGFVLVYSIENKSSFMAI

SEQ ID NO: 2480089 - protein, 25 aa, Entamoeba dispar
ERAIMYFIECVDFGKNLDRQMTFYS

SEQ ID NO: 2480090 - protein, 19 aa, Entamoeba dispar
ERASMKLGLDQAILSNINN

SEQ ID NO: 2480091 - protein, 25 aa, Entamoeba dispar
ERATYRKGRFGGLVNQGSTCYMNSV

SEQ ID NO: 2480092 - protein, 18 aa, Entamoeba dispar
ERDDIALKALKEAEKCTD

SEQ ID NO: 2480093 - protein, 17 aa, Entamoeba dispar
ERDFKVKTLEEFKRTIK

SEQ ID NO: 2480094 - protein, 24 aa, Entamoeba dispar
ERDPDKDYPIFAIRCKQGYEKDIC

SEQ ID NO: 2480095 - protein, 27 aa, Entamoeba dispar
ERDPECLKEVFDLIKLVSQKNEIDADS

SEQ ID NO: 2480096 - protein, 19 aa, Entamoeba dispar
ERDSTVIWIYYHLINELEE

SEQ ID NO: 2480097 - protein, 18 aa, Entamoeba dispar
ERDSWSPDLVKLVESCLM

SEQ ID NO: 2480098 - protein, 24 aa, Entamoeba dispar
EREDLKIVVMSATLEATKFKEYFD

SEQ ID NO: 2480099 - protein, 20 aa, Entamoeba dispar
EREECIKEAKSLPKIDISSR

SEQ ID NO: 2480100 - protein, 21 aa, Entamoeba dispar
EREECIKEAKSLPKIDISSRE

SEQ ID NO: 2480101 - protein, 18 aa, Entamoeba dispar
ERELHGIIIVFNFSQNKF

SEQ ID NO: 2480102 - protein, 17 aa, Entamoeba dispar
ERELHGIIIVFNYNQDR

SEQ ID NO: 2480103 - protein, 18 aa, Entamoeba dispar
ERELKKGILQQRESEEKS

SEQ ID NO: 2480104 - protein, 32 aa, Entamoeba dispar
EREMDLANAMWLKSCTSEIWLERRTNFTRSVA

SEQ ID NO: 2480105 - protein, 18 aa, Entamoeba dispar
ERENKCVLTPQDIIELST

SEQ ID NO: 2480106 - protein, 24 aa, Entamoeba dispar
EREPFEFDLCSFIEELVANHCQKQ

SEQ ID NO: 2480107 - protein, 18 aa, Entamoeba dispar
ERERRKSGIKSIDRRVNI

SEQ ID NO: 2480108 - protein, 24 aa, Entamoeba dispar
EREVNDFIVYWIAKLNKNYYKVTI

SEQ ID NO: 2480109 - protein, 28 aa, Entamoeba dispar
EREYWKALLRVYILNSIDNFGYQKREVT

SEQ ID NO: 2480110 - protein, 17 aa, Entamoeba dispar
ERFDYYLSQAMNIQKLF

SEQ ID NO: 2480111 - protein, 19 aa, Entamoeba dispar
ERFEKEKKEWAEKEKKYNE

SEQ ID NO: 2480112 - protein, 18 aa, Entamoeba dispar
ERFHLPIISLFYPSVEFV

SEQ ID NO: 2480113 - protein, 21 aa, Entamoeba dispar
ERFIRIYPLCQFNSISEMYDS

SEQ ID NO: 2480114 - protein, 24 aa, Entamoeba dispar
ERFKKFSIQFEDIFVDYSKNLIDE

SEQ ID NO: 2480115 - protein, 22 aa, Entamoeba dispar
ERFKTISLSLLFFIIQHPNEKK

SEQ ID NO: 2480116 - protein, 26 aa, Entamoeba dispar
ERFNFLSPFAKNVMKTDGELVLIPSR

SEQ ID NO: 2480117 - protein, 20 aa, Entamoeba dispar
ERFNWIGDTIVNCFNECPKG

SEQ ID NO: 2480118 - protein, 24 aa, Entamoeba dispar
ERFSVRYAECNAALNMTPEQIYLL

SEQ ID NO: 2480119 - protein, 24 aa, Entamoeba dispar
ERFTCPKCGIELSKSEFVSYKRDD

SEQ ID NO: 2480120 - protein, 17 aa, Entamoeba dispar
ERFTHPGGLPIHEKRVS

SEQ ID NO: 2480121 - protein, 25 aa, Entamoeba dispar
ERFTRENCLSILKNKTDIIILLETE

SEQ ID NO: 2480122 - protein, 19 aa, Entamoeba dispar
ERGDLYIYFEVKFPTTTEI

SEQ ID NO: 2480123 - protein, 19 aa, Entamoeba dispar
ERHPIEALEIFCSGTEGIT

SEQ ID NO: 2480124 - protein, 19 aa, Entamoeba dispar
ERHRRSFLQDIKDIMMVCN

SEQ ID NO: 2480125 - protein, 18 aa, Entamoeba dispar
ERIDCLQKQLARGKKEAQ

SEQ ID NO: 2480126 - protein, 18 aa, Entamoeba dispar
ERIDGCVVYDRIIKQLNT

SEQ ID NO: 2480127 - protein, 24 aa, Entamoeba dispar
ERIECPKCGVIVLKRTLQQHMRKA

SEQ ID NO: 2480128 - protein, 19 aa, Entamoeba dispar
ERIECQKGIEEWRNACDHL

SEQ ID NO: 2480129 - protein, 19 aa, Entamoeba dispar
ERIEIMKCILNKNGNSKYN

SEQ ID NO: 2480130 - protein, 26 aa, Entamoeba dispar
ERIEMNGGVVFGMFGVKRVNGQIMVT

SEQ ID NO: 2480131 - protein, 19 aa, Entamoeba dispar
ERIFDCISFTPAGENPVKC

SEQ ID NO: 2480132 - protein, 18 aa, Entamoeba dispar
ERIGQGSFGQVYKAFHQN

SEQ ID NO: 2480133 - protein, 23 aa, Entamoeba dispar
ERIKECVNILSSIALNNKVTSSN

SEQ ID NO: 2480134 - protein, 22 aa, Entamoeba dispar
ERIKERLSYVAFDYKEESTLAS

SEQ ID NO: 2480135 - protein, 23 aa, Entamoeba dispar
ERIKERLSYVAFDYKEESTLASL

SEQ ID NO: 2480136 - protein, 20 aa, Entamoeba dispar
ERIKILAMQVLEDYDNDNTI

SEQ ID NO: 2480137 - protein, 32 aa, Entamoeba dispar
ERIKKFKVAVIFSYVGRGYFGLMYLNNNPKTI

SEQ ID NO: 2480138 - protein, 23 aa, Entamoeba dispar
ERIKKRCCVLLEYISFDLKNICG

SEQ ID NO: 2480139 - protein, 23 aa, Entamoeba dispar
ERIKTEIIPGMIIEKEPTEHIII

SEQ ID NO: 2480140 - protein, 19 aa, Entamoeba dispar
ERIMYKKHIIIIIEDTNGN

SEQ ID NO: 2480141 - protein, 18 aa, Entamoeba dispar
ERIQYGLSIAEDKMEIPA

SEQ ID NO: 2480142 - protein, 29 aa, Entamoeba dispar
ERIRFRATSLLTYCLIKYPLKEESKNVFI

SEQ ID NO: 2480143 - protein, 24 aa, Entamoeba dispar
ERIRTEATMLLCLISNKKKGTEEV

SEQ ID NO: 2480144 - protein, 19 aa, Entamoeba dispar
ERISGCNYIKCVCGCGYCY

SEQ ID NO: 2480145 - protein, 20 aa, Entamoeba dispar
ERISNPCCYFHNLGYDGRFL

SEQ ID NO: 2480146 - protein, 17 aa, Entamoeba dispar
ERISRYLDENSIGLNSF

SEQ ID NO: 2480147 - protein, 27 aa, Entamoeba dispar
ERKDRITKKLARPHEMIQFNDGNQVIS

SEQ ID NO: 2480148 - protein, 25 aa, Entamoeba dispar
ERKEIYKRIYDVVDITDYIKEEPVE

SEQ ID NO: 2480149 - protein, 20 aa, Entamoeba dispar
ERKIHSSLMYRTEHLKDSYD

SEQ ID NO: 2480150 - protein, 25 aa, Entamoeba dispar
ERKKFKKPLKRTFKVSSPQKKVVDL

SEQ ID NO: 2480151 - protein, 24 aa, Entamoeba dispar
ERKKLTPLELFWLLNEFADLLGPS

SEQ ID NO: 2480152 - protein, 37 aa, Entamoeba dispar
ERKKWKFMQKYYHIGSFFRDGGKWDVSKGNWDFDAAT

SEQ ID NO: 2480153 - protein, 22 aa, Entamoeba dispar
ERKRIHLVWFVINSAVGRLQPF

SEQ ID NO: 2480154 - protein, 29 aa, Entamoeba dispar
ERKRVVLNLEQWKGIILKYENEKWLKIHL

SEQ ID NO: 2480155 - protein, 26 aa, Entamoeba dispar
ERKWKDFITIGMKWALVCRPKEILNN

SEQ ID NO: 2480156 - protein, 22 aa, Entamoeba dispar
ERLIKFIIEKMGKMKSISIERG

SEQ ID NO: 2480157 - protein, 18 aa, Entamoeba dispar
ERLKIQIEYLCKRYQIPS

SEQ ID NO: 2480158 - protein, 21 aa, Entamoeba dispar
ERLLKEKKLSLILDLDGTIVF

SEQ ID NO: 2480159 - protein, 25 aa, Entamoeba dispar
ERLLKEVRGLGAIEIYRDLETKGSE

SEQ ID NO: 2480160 - protein, 19 aa, Entamoeba dispar
ERLPLTCLQELSKDVNDMK

SEQ ID NO: 2480161 - protein, 17 aa, Entamoeba dispar
ERLRQKKLEYLFSQLIR

SEQ ID NO: 2480162 - protein, 18 aa, Entamoeba dispar
ERLSIGIGLISIIINHQI

SEQ ID NO: 2480163 - protein, 22 aa, Entamoeba dispar
ERLSLRQKQSFFRQLEKNPDCD

SEQ ID NO: 2480164 - protein, 20 aa, Entamoeba dispar
ERLSNACVIGLYVVLGNSVT

SEQ ID NO: 2480165 - protein, 17 aa, Entamoeba dispar
ERLYQIHCDEFFQCELE

SEQ ID NO: 2480166 - protein, 24 aa, Entamoeba dispar
ERMIFETIFFNGCMNKVYKELALE

SEQ ID NO: 2480167 - protein, 23 aa, Entamoeba dispar
ERMLEMTPPLFLYGTHYSTPAYV

SEQ ID NO: 2480168 - protein, 20 aa, Entamoeba dispar
ERMMNVCKSINWYEQVKLRI

SEQ ID NO: 2480169 - protein, 17 aa, Entamoeba dispar
ERNALRLQIDSLKSENE

SEQ ID NO: 2480170 - protein, 25 aa, Entamoeba dispar
ERNDKLEWKRLIVVLENAPIEPVKV

SEQ ID NO: 2480171 - protein, 21 aa, Entamoeba dispar
ERNELKFNIETQIKKLTQKRV

SEQ ID NO: 2480172 - protein, 22 aa, Entamoeba dispar
ERNLKSIIFLKIISVEEGALQN

SEQ ID NO: 2480173 - protein, 26 aa, Entamoeba dispar
ERNNVFFKWSCFEYNYNHQPISRNGI

SEQ ID NO: 2480174 - protein, 28 aa, Entamoeba dispar
ERNRMLEGACPISLPKLIYIKELGEVMT

SEQ ID NO: 2480175 - protein, 21 aa, Entamoeba dispar
ERNWMCREFKEIVYDPRDDID

SEQ ID NO: 2480176 - protein, 20 aa, Entamoeba dispar
ERNYCLKCSNGYKIENNQCN

SEQ ID NO: 2480177 - protein, 24 aa, Entamoeba dispar
ERNYCLKCSNGYKIENNQCNGDKE

SEQ ID NO: 2480178 - protein, 20 aa, Entamoeba dispar
ERNYCLKCSNGYKIQNNQCN

SEQ ID NO: 2480179 - protein, 22 aa, Entamoeba dispar
ERNYCLKCSNGYKIQNNQCNGD

SEQ ID NO: 2480180 - protein, 32 aa, Entamoeba dispar
ERNYYIPCWIKIRYYQSFTFDVFKLCRSHNCH

SEQ ID NO: 2480181 - protein, 22 aa, Entamoeba dispar
ERPKEVTKRKVEEVSTKTEDKT

SEQ ID NO: 2480182 - protein, 24 aa, Entamoeba dispar
ERQAACVLYQLVSAITYLHKNNIA

SEQ ID NO: 2480183 - protein, 19 aa, Entamoeba dispar
ERQELTRALKVVSDINKHL

SEQ ID NO: 2480184 - protein, 22 aa, Entamoeba dispar
ERQGIKYDGFDFGNSPTELINN

SEQ ID NO: 2480185 - protein, 17 aa, Entamoeba dispar
ERRCFKMCVSLKSINVP

SEQ ID NO: 2480186 - protein, 21 aa, Entamoeba dispar
ERRFVNLVLKEEGNGLNNTSP

SEQ ID NO: 2480187 - protein, 17 aa, Entamoeba dispar
ERRLHRMEERMLNSYKE

SEQ ID NO: 2480188 - protein, 19 aa, Entamoeba dispar
ERRLWTCKLWDIEERLREA

SEQ ID NO: 2480189 - protein, 23 aa, Entamoeba dispar
ERRRKKFERPLESPKRSNSTFST

SEQ ID NO: 2480190 - protein, 19 aa, Entamoeba dispar
ERSAFKWVNPASRSIQQEP

SEQ ID NO: 2480191 - protein, 20 aa, Entamoeba dispar
ERSFGIVYIGEFRGNQVAIK

SEQ ID NO: 2480192 - protein, 20 aa, Entamoeba dispar
ERSFIRYNFGNWMQRTLKYL

SEQ ID NO: 2480193 - protein, 27 aa, Entamoeba dispar
ERSRIRAVYLCKWFIKNGSNQNVISFV

SEQ ID NO: 2480194 - protein, 18 aa, Entamoeba dispar
ERSYAFLEFRTLEEAVKA

SEQ ID NO: 2480195 - protein, 23 aa, Entamoeba dispar
ERTCDSCFKKMCIENKDIISTQE

SEQ ID NO: 2480196 - protein, 22 aa, Entamoeba dispar
ERTKEVYKNITISKAIKNLQKE

SEQ ID NO: 2480197 - protein, 25 aa, Entamoeba dispar
ERTNMISSFRFLRLDDLDKIKFLES

SEQ ID NO: 2480198 - protein, 17 aa, Entamoeba dispar
ERTRYLVKWQKLPYTEC

SEQ ID NO: 2480199 - protein, 24 aa, Entamoeba dispar
ERTTIIFRLNWLRDEDIPIIQQVS

SEQ ID NO: 2480200 - protein, 17 aa, Entamoeba dispar
ERTVCLICANPKSYMKE

SEQ ID NO: 2480201 - protein, 24 aa, Entamoeba dispar
ERVDLLLKIAHLFKKLSSGESKHL

SEQ ID NO: 2480202 - protein, 18 aa, Entamoeba dispar
ERVICCLNEMVELPKFND

SEQ ID NO: 2480203 - protein, 23 aa, Entamoeba dispar
ERVKEALSLLLIWQTRQILPVQI

SEQ ID NO: 2480204 - protein, 20 aa, Entamoeba dispar
ERVKVVVIQMEYCSGSNLSR

SEQ ID NO: 2480205 - protein, 20 aa, Entamoeba dispar
ERVLASLLHITSYVKKIESK

SEQ ID NO: 2480206 - protein, 25 aa, Entamoeba dispar
ERVLRIGYTAIYIIDPRNRKISEKL

SEQ ID NO: 2480207 - protein, 25 aa, Entamoeba dispar
ERVNQCFPLVFRYQVSIPNVESPTE

SEQ ID NO: 2480208 - protein, 17 aa, Entamoeba dispar
ERVSIYLAMLQTENEEM

SEQ ID NO: 2480209 - protein, 18 aa, Entamoeba dispar
ERWIKEVSSAGFLPPHAS

SEQ ID NO: 2480210 - protein, 27 aa, Entamoeba dispar
ERYEECYESFLWLFGKLLQKEELDLIR

SEQ ID NO: 2480211 - protein, 29 aa, Entamoeba dispar
ERYKELPETLVFHLKRFVYNDQYEIVKYN

SEQ ID NO: 2480212 - protein, 28 aa, Entamoeba dispar
ERYPPKIWSSAILRHFFQHAFDGSGSDG

SEQ ID NO: 2480213 - protein, 20 aa, Entamoeba dispar
ERYPSKYLTLLSFLSHSLTI

SEQ ID NO: 2480214 - protein, 19 aa, Entamoeba dispar
ERYQHVIDAFYERRVHRME

SEQ ID NO: 2480215 - protein, 21 aa, Entamoeba dispar
ESACTILACSMDQTGLMEMRK

SEQ ID NO: 2480216 - protein, 26 aa, Entamoeba dispar
ESALEAGICKLEYHFCKQVSQVAVSI

SEQ ID NO: 2480217 - protein, 28 aa, Entamoeba dispar
ESALSLLISCCYLCFDSFVEPIGINKKH

SEQ ID NO: 2480218 - protein, 19 aa, Entamoeba dispar
ESATTWWAYGNNLLSIEEK

SEQ ID NO: 2480219 - protein, 19 aa, Entamoeba dispar
ESAWVLSSLIRDIAYNNGC

SEQ ID NO: 2480220 - protein, 20 aa, Entamoeba dispar
ESDFKSPYFAVVAKNADPSK

SEQ ID NO: 2480221 - protein, 22 aa, Entamoeba dispar
ESDGIIVYCIDTSGSMAINIEV

SEQ ID NO: 2480222 - protein, 17 aa, Entamoeba dispar
ESDKCVLLLLQIVLKEP

SEQ ID NO: 2480223 - protein, 28 aa, Entamoeba dispar
ESDLLKRKLEILEWFNKELALLINEKER

SEQ ID NO: 2480224 - protein, 24 aa, Entamoeba dispar
ESDNRFVYCAVLALTLIGKLDVIN

SEQ ID NO: 2480225 - protein, 17 aa, Entamoeba dispar
ESEFSEMPGVKATIVER

SEQ ID NO: 2480226 - protein, 29 aa, Entamoeba dispar
ESEHALKNDICYQQAFLILLLNQYLAITL

SEQ ID NO: 2480227 - protein, 21 aa, Entamoeba dispar
ESEIIKKLHLTRVVMKEIQDI

SEQ ID NO: 2480228 - protein, 21 aa, Entamoeba dispar
ESEILYGMCYLLHGLIKTQWS

SEQ ID NO: 2480229 - protein, 45 aa, Entamoeba dispar
ESELLGLVCLKKYMMYRAFCDGCLRVTKQIYSWLFNKGQKSEQIK

SEQ ID NO: 2480230 - protein, 22 aa, Entamoeba dispar
ESELNIPPGKIVKEIIISIVKP

SEQ ID NO: 2480231 - protein, 23 aa, Entamoeba dispar
ESELRKIIFDFVKKGKIFNYEYI

SEQ ID NO: 2480232 - protein, 24 aa, Entamoeba dispar
ESELYCPQCHKFIQLPFGSPEILP

SEQ ID NO: 2480233 - protein, 20 aa, Entamoeba dispar
ESEMKFDLVESLKYYESALK

SEQ ID NO: 2480234 - protein, 25 aa, Entamoeba dispar
ESERMIRLNPPFKLVRTTPEKAIEF

SEQ ID NO: 2480235 - protein, 21 aa, Entamoeba dispar
ESERRLALFRMKKVLTNYSAF

SEQ ID NO: 2480236 - protein, 20 aa, Entamoeba dispar
ESETHCYIALVNDIQYSSEK

SEQ ID NO: 2480237 - protein, 22 aa, Entamoeba dispar
ESEWRALSFTKEFSRLGITSSN

SEQ ID NO: 2480238 - protein, 24 aa, Entamoeba dispar
ESFIKIFNEKCGFPKKLQTMKSIT

SEQ ID NO: 2480239 - protein, 18 aa, Entamoeba dispar
ESFKEIIIPSSSTKQRKT

SEQ ID NO: 2480240 - protein, 30 aa, Entamoeba dispar
ESFKKLRSLLMKEYHVITVFMGNPENKLLN

SEQ ID NO: 2480241 - protein, 30 aa, Entamoeba dispar
ESFKKRAPKAIKIIRFLAIKTMKTHNVKFD

SEQ ID NO: 2480242 - protein, 17 aa, Entamoeba dispar
ESFMKIQLIDLSHDLPA

SEQ ID NO: 2480243 - protein, 25 aa, Entamoeba dispar
ESFPNKLPPAISIISAISEDRNESE

SEQ ID NO: 2480244 - protein, 19 aa, Entamoeba dispar
ESFRQLGGFEFYKRLYKYW

SEQ ID NO: 2480245 - protein, 22 aa, Entamoeba dispar
ESGFDIELRAAVLHEINEIMPE

SEQ ID NO: 2480246 - protein, 19 aa, Entamoeba dispar
ESGKGKGYRGIQSGVAIEW

SEQ ID NO: 2480247 - protein, 24 aa, Entamoeba dispar
ESGVTPLLMKPVIKKDLRQQTQEM

SEQ ID NO: 2480248 - protein, 27 aa, Entamoeba dispar
ESHAIDLLKRIFLIASRPDRQNDREEA

SEQ ID NO: 2480249 - protein, 23 aa, Entamoeba dispar
ESHRRKYCECIKHIQSKNTKPQC

SEQ ID NO: 2480250 - protein, 25 aa, Entamoeba dispar
ESIADCPSHPLLDVIECSIQALMAN

SEQ ID NO: 2480251 - protein, 25 aa, Entamoeba dispar
ESIDVIASFIKKLLIKSLYSSPSFI

SEQ ID NO: 2480252 - protein, 19 aa, Entamoeba dispar
ESIEFPMYFVDSQPEEGED

SEQ ID NO: 2480253 - protein, 19 aa, Entamoeba dispar
ESIEHLFETPLYFIADNNT

SEQ ID NO: 2480254 - protein, 21 aa, Entamoeba dispar
ESIEYLAPILPSGVIDVNVTC

SEQ ID NO: 2480255 - protein, 23 aa, Entamoeba dispar
ESIFHCINCKLLNDINYEITDKQ

SEQ ID NO: 2480256 - protein, 27 aa, Entamoeba dispar
ESIFKLKEIVGIFIARIIDTINLWPES

SEQ ID NO: 2480257 - protein, 18 aa, Entamoeba dispar
ESIFSFIIDFIEKKIESD

SEQ ID NO: 2480258 - protein, 19 aa, Entamoeba dispar
ESIIRKGLFYKGVDNDCRC

SEQ ID NO: 2480259 - protein, 20 aa, Entamoeba dispar
ESIKALLTFEECNFPQSILD

SEQ ID NO: 2480260 - protein, 24 aa, Entamoeba dispar
ESIKDVFLNNSFNCIVERVINVCK

SEQ ID NO: 2480261 - protein, 20 aa, Entamoeba dispar
ESIKEICGDIIKEKGNEKRI

SEQ ID NO: 2480262 - protein, 34 aa, Entamoeba dispar
ESIKTAKGEELRRGCDQLARLLYALDQSKITTVT

SEQ ID NO: 2480263 - protein, 24 aa, Entamoeba dispar
ESIKTLSVAFQWFVGDSTEQNIPP

SEQ ID NO: 2480264 - protein, 19 aa, Entamoeba dispar
ESILIIIVWFFHYEEKEVL

SEQ ID NO: 2480265 - protein, 19 aa, Entamoeba dispar
ESIMSPKIQSPIMASSPTS

SEQ ID NO: 2480266 - protein, 19 aa, Entamoeba dispar
ESINILKIQLGNNENDLQV

SEQ ID NO: 2480267 - protein, 19 aa, Entamoeba dispar
ESIPAWYHALSLIRLLCSD

SEQ ID NO: 2480268 - protein, 18 aa, Entamoeba dispar
ESIPDFKVIQTIQNILSI

SEQ ID NO: 2480269 - protein, 19 aa, Entamoeba dispar
ESIPGYYKRKRGMTQKEKI

SEQ ID NO: 2480270 - protein, 24 aa, Entamoeba dispar
ESIPPEIGSLLSLQYLNISENNLK

SEQ ID NO: 2480271 - protein, 19 aa, Entamoeba dispar
ESIPTIIIFNEGQYTSFLN

SEQ ID NO: 2480272 - protein, 23 aa, Entamoeba dispar
ESISMVCRFCNLLITGEDPCSQR

SEQ ID NO: 2480273 - protein, 21 aa, Entamoeba dispar
ESITMRYGCYKSLKPITECEC

SEQ ID NO: 2480274 - protein, 24 aa, Entamoeba dispar
ESITQLTCLSSFNVASNPIKTLPT

SEQ ID NO: 2480275 - protein, 19 aa, Entamoeba dispar
ESIVSLNMLCIDIESYLKD

SEQ ID NO: 2480276 - protein, 22 aa, Entamoeba dispar
ESKAQFLGYMTNHFLSVYTGKR

SEQ ID NO: 2480277 - protein, 24 aa, Entamoeba dispar
ESKELIKLINNWKIESVEGNVIDA

SEQ ID NO: 2480278 - protein, 24 aa, Entamoeba dispar
ESKFFTGEIIKIFGSLNEDTIKQC

SEQ ID NO: 2480279 - protein, 21 aa, Entamoeba dispar
ESKFIFDFYQFFKSLHFKLKE

SEQ ID NO: 2480280 - protein, 18 aa, Entamoeba dispar
ESKFPINIYQIIDGEDKR

SEQ ID NO: 2480281 - protein, 25 aa, Entamoeba dispar
ESKFSLNCDIVLKWLKNGKEDIEKK

SEQ ID NO: 2480282 - protein, 19 aa, Entamoeba dispar
ESKGKIGIFPSHYVERDVK

SEQ ID NO: 2480283 - protein, 20 aa, Entamoeba dispar
ESKGKIGIFPSHYVERDVKI

SEQ ID NO: 2480284 - protein, 26 aa, Entamoeba dispar
ESKIKKKLFLTFVHHINQFFDNYGDA

SEQ ID NO: 2480285 - protein, 25 aa, Entamoeba dispar
ESKIRGMKGVMALISVNSHVFGVFT

SEQ ID NO: 2480286 - protein, 21 aa, Entamoeba dispar
ESKITIPLYFGEFVVANESKK

SEQ ID NO: 2480287 - protein, 24 aa, Entamoeba dispar
ESKPIFRRDHRGLTTMTGFTPKGL

SEQ ID NO: 2480288 - protein, 21 aa, Entamoeba dispar
ESKRILVTLTNDFGKILSGLH

SEQ ID NO: 2480289 - protein, 25 aa, Entamoeba dispar
ESKRKEIIDSFEFYADRLLDLYTLS

SEQ ID NO: 2480290 - protein, 24 aa, Entamoeba dispar
ESKRMKGIYIRDLYLNLSTSAVPI

SEQ ID NO: 2480291 - protein, 19 aa, Entamoeba dispar
ESKRSVLFNQFLTYQKGNC

SEQ ID NO: 2480292 - protein, 20 aa, Entamoeba dispar
ESKRSVLFNQFLTYQKGNCH

SEQ ID NO: 2480293 - protein, 23 aa, Entamoeba dispar
ESLAPPLLHLAANLSFLSQSFSD

SEQ ID NO: 2480294 - protein, 19 aa, Entamoeba dispar
ESLEGWYTDLMKVASSDIS

SEQ ID NO: 2480295 - protein, 21 aa, Entamoeba dispar
ESLELHLTWYEKLIVNQEKRD

SEQ ID NO: 2480296 - protein, 21 aa, Entamoeba dispar
ESLELYFIIWGNLCLLGGNAI

SEQ ID NO: 2480297 - protein, 30 aa, Entamoeba dispar
ESLERFSYIPIRRMKSCFDYLKYDKTLERI

SEQ ID NO: 2480298 - protein, 19 aa, Entamoeba dispar
ESLGDIEAFVILLKQMIEL

SEQ ID NO: 2480299 - protein, 17 aa, Entamoeba dispar
ESLHFRAAMKNYFLETN

SEQ ID NO: 2480300 - protein, 22 aa, Entamoeba dispar
ESLKEFTVYMSDLYIVGFQQFK

SEQ ID NO: 2480301 - protein, 17 aa, Entamoeba dispar
ESLKGITPHRIDISHND

SEQ ID NO: 2480302 - protein, 17 aa, Entamoeba dispar
ESLKIELTPEIKLKLCT

SEQ ID NO: 2480303 - protein, 22 aa, Entamoeba dispar
ESLKKSNTHIVVFGNTDHRDTI

SEQ ID NO: 2480304 - protein, 30 aa, Entamoeba dispar
ESLKNIPKDFVFKDQEGFEIPTDEEQSYKL

SEQ ID NO: 2480305 - protein, 25 aa, Entamoeba dispar
ESLKNKELHIVFSSRIIPELISGIF

SEQ ID NO: 2480306 - protein, 20 aa, Entamoeba dispar
ESLMKFYIYFDKAEKIKAGD

SEQ ID NO: 2480307 - protein, 25 aa, Entamoeba dispar
ESLNALCKIASLFNQSKKETEEANI

SEQ ID NO: 2480308 - protein, 18 aa, Entamoeba dispar
ESLNCLMQAVLETLKNKR

SEQ ID NO: 2480309 - protein, 20 aa, Entamoeba dispar
ESLQKWVGKNECELIYSVHQ

SEQ ID NO: 2480310 - protein, 18 aa, Entamoeba dispar
ESLRKLYINYGFNVNEQS

SEQ ID NO: 2480311 - protein, 26 aa, Entamoeba dispar
ESLRNILWGEHFINMKTGKTFKTQID

SEQ ID NO: 2480312 - protein, 17 aa, Entamoeba dispar
ESLRNLLLILKDNLNVL

SEQ ID NO: 2480313 - protein, 21 aa, Entamoeba dispar
ESLSKFVFVPLLYQEVFIYSC

SEQ ID NO: 2480314 - protein, 26 aa, Entamoeba dispar
ESLSKRFKKGFLIYYYREMIYSKRNR

SEQ ID NO: 2480315 - protein, 21 aa, Entamoeba dispar
ESLSSKLLLDRFALKKLVKGQ

SEQ ID NO: 2480316 - protein, 17 aa, Entamoeba dispar
ESLVFKEIYNILIKNQY

SEQ ID NO: 2480317 - protein, 23 aa, Entamoeba dispar
ESMDVGIHYLPLICMAEKDSNEH

SEQ ID NO: 2480318 - protein, 20 aa, Entamoeba dispar
ESMIRLSEALARLYLDKQVR

SEQ ID NO: 2480319 - protein, 19 aa, Entamoeba dispar
ESMKRILSLWAARHPASGY

SEQ ID NO: 2480320 - protein, 27 aa, Entamoeba dispar
ESMMESILICYSRLYKGSDQSIINFID

SEQ ID NO: 2480321 - protein, 31 aa, Entamoeba dispar
ESNDRCPIMLVCQDCFWRCTLQGGCEYICNN

SEQ ID NO: 2480322 - protein, 17 aa, Entamoeba dispar
ESNEIYCYDEITMCQPL

SEQ ID NO: 2480323 - protein, 22 aa, Entamoeba dispar
ESNICVLTLLATNSILIEQVKK

SEQ ID NO: 2480324 - protein, 24 aa, Entamoeba dispar
ESNIPKSRNIFVFQIFNSEDDQKK

SEQ ID NO: 2480325 - protein, 26 aa, Entamoeba dispar
ESNKSPAEYLLRKAVMLLQSSDKQLK

SEQ ID NO: 2480326 - protein, 17 aa, Entamoeba dispar
ESNLIVDIIETFSKIFS

SEQ ID NO: 2480327 - protein, 20 aa, Entamoeba dispar
ESNNKILIERCLSIDEENVI

SEQ ID NO: 2480328 - protein, 25 aa, Entamoeba dispar
ESNRADCALMLLSLNIDNLSETIHP

SEQ ID NO: 2480329 - protein, 23 aa, Entamoeba dispar
ESNRCIYCKSPVHITGPVWLDNY

SEQ ID NO: 2480330 - protein, 25 aa, Entamoeba dispar
ESNSLIFERPRYWTLTNYLTTNEEI

SEQ ID NO: 2480331 - protein, 29 aa, Entamoeba dispar
ESPKKFFSLKGDMLWFVVDHWFLFGKLYQ

SEQ ID NO: 2480332 - protein, 17 aa, Entamoeba dispar
ESPSDFYPANGLPDKET

SEQ ID NO: 2480333 - protein, 28 aa, Entamoeba dispar
ESQIRGLVNLVWKELLKSIGKSIKNVID

SEQ ID NO: 2480334 - protein, 20 aa, Entamoeba dispar
ESQKKWGFGSIKSSIVSGMS

SEQ ID NO: 2480335 - protein, 24 aa, Entamoeba dispar
ESQLRRYYSEFVFSLNSLSNILEN

SEQ ID NO: 2480336 - protein, 20 aa, Entamoeba dispar
ESQPYFGIDALYIIHIRESI

SEQ ID NO: 2480337 - protein, 24 aa, Entamoeba dispar
ESQRYKQKALMLLKQKKQHEQHRD

SEQ ID NO: 2480338 - protein, 24 aa, Entamoeba dispar
ESRCKQHDMGVCPKHSGCNYLHVL

SEQ ID NO: 2480339 - protein, 21 aa, Entamoeba dispar
ESRIKSILTGLQFTQKDFERP

SEQ ID NO: 2480340 - protein, 33 aa, Entamoeba dispar
ESRKLEYRKAFYDFLKRILVWNPHHRLRPIQAL

SEQ ID NO: 2480341 - protein, 24 aa, Entamoeba dispar
ESRLRYILVVDALNFCFWPTEGFE

SEQ ID NO: 2480342 - protein, 24 aa, Entamoeba dispar
ESRNGLFLPKLPPKIKEINETTSN

SEQ ID NO: 2480343 - protein, 21 aa, Entamoeba dispar
ESRRLRVELDQLEMEKNEYKN

SEQ ID NO: 2480344 - protein, 19 aa, Entamoeba dispar
ESRYRWFFRPLRKISPYHM

SEQ ID NO: 2480345 - protein, 22 aa, Entamoeba dispar
ESSDFLLEKGCECCERDPKTYG

SEQ ID NO: 2480346 - protein, 23 aa, Entamoeba dispar
ESSETRIKYEFIIDPSAFHELQT

SEQ ID NO: 2480347 - protein, 18 aa, Entamoeba dispar
ESSFRKTRNVQANQQSVF

SEQ ID NO: 2480348 - protein, 24 aa, Entamoeba dispar
ESSGDLSPLCNFSLSLDPSKSPLK

SEQ ID NO: 2480349 - protein, 18 aa, Entamoeba dispar
ESSIKCVSLIKEVCGIDI

SEQ ID NO: 2480350 - protein, 21 aa, Entamoeba dispar
ESSLKNAIPMPDFGGKHPDPN

SEQ ID NO: 2480351 - protein, 23 aa, Entamoeba dispar
ESSLKVGFSLCYSTLSDEFVDIR

SEQ ID NO: 2480352 - protein, 24 aa, Entamoeba dispar
ESSNFVACHFARILKKHLMTENNL

SEQ ID NO: 2480353 - protein, 24 aa, Entamoeba dispar
ESSPKFIPLMNCVFAAQRIKTTID

SEQ ID NO: 2480354 - protein, 26 aa, Entamoeba dispar
ESSRRLKTEFLVRLDGAGTDDERILV

SEQ ID NO: 2480355 - protein, 21 aa, Entamoeba dispar
ESSSFPELSKQGAFNQENVLN

SEQ ID NO: 2480356 - protein, 26 aa, Entamoeba dispar
ESSYDIRDVWNFPRLTQIKSETPMKK

SEQ ID NO: 2480357 - protein, 25 aa, Entamoeba dispar
ESSYSFPVIIKWIYELTPWEILIFP

SEQ ID NO: 2480358 - protein, 28 aa, Entamoeba dispar
ESTESKWKLLVFDKFCSELIENHFVVSD

SEQ ID NO: 2480359 - protein, 17 aa, Entamoeba dispar
ESTKILLDFIAKTETVE

SEQ ID NO: 2480360 - protein, 20 aa, Entamoeba dispar
ESTKSGFFGLSFKKKNKRKL

SEQ ID NO: 2480361 - protein, 20 aa, Entamoeba dispar
ESTLTGWLAELCYLVNGALV

SEQ ID NO: 2480362 - protein, 20 aa, Entamoeba dispar
ESTTRFKFVLYEESKELPVT

SEQ ID NO: 2480363 - protein, 31 aa, Entamoeba dispar
ESVELIVEIFNLWKQFFLCFNGQGKAKMENL

SEQ ID NO: 2480364 - protein, 26 aa, Entamoeba dispar
ESVIQRFDPSYVFLCDEFGINLIGCG

SEQ ID NO: 2480365 - protein, 18 aa, Entamoeba dispar
ESVKNWDDILSYFDNKIE

SEQ ID NO: 2480366 - protein, 29 aa, Entamoeba dispar
ESVNFKFVMKSVVAKIVCYGRYCMERNLY

SEQ ID NO: 2480367 - protein, 17 aa, Entamoeba dispar
ESVRCHFIESSAKRNEN

SEQ ID NO: 2480368 - protein, 36 aa, Entamoeba dispar
ESVVSLMKYNGGYNWWKRNSLTVFINKKLYKDPEES

SEQ ID NO: 2480369 - protein, 23 aa, Entamoeba dispar
ESVWKDFFKTITLQCDLKNQLEN

SEQ ID NO: 2480370 - protein, 24 aa, Entamoeba dispar
ESYASDLQRSLCLALDDFYKNILH

SEQ ID NO: 2480371 - protein, 17 aa, Entamoeba dispar
ESYDWKPTISIKQILVG

SEQ ID NO: 2480372 - protein, 26 aa, Entamoeba dispar
ESYHKRVLEPLGFYNMMLRTKQQKYT

SEQ ID NO: 2480373 - protein, 19 aa, Entamoeba dispar
ESYKWDNEIEVIKETAQEV

SEQ ID NO: 2480374 - protein, 20 aa, Entamoeba dispar
ESYNGVSLIIAYCPCKEQGV

SEQ ID NO: 2480375 - protein, 26 aa, Entamoeba dispar
ESYQKEGKCTIKFVFVTPERITQSKS

SEQ ID NO: 2480376 - protein, 28 aa, Entamoeba dispar
ESYQLLLVLCNYFQQWLIQNNIKFIQDV

SEQ ID NO: 2480377 - protein, 18 aa, Entamoeba dispar
ESYREIFNDIFLLADGKG

SEQ ID NO: 2480378 - protein, 21 aa, Entamoeba dispar
ESYVKFLGVVYDWVDIMLKDL

SEQ ID NO: 2480379 - protein, 19 aa, Entamoeba dispar
ESYYIKYNRELVGNDIGQF

SEQ ID NO: 2480380 - protein, 19 aa, Entamoeba dispar
ETAARVAIWEDVFIETLTM

SEQ ID NO: 2480381 - protein, 29 aa, Entamoeba dispar
ETAIGLICGKKFITQKWFSAIQDIEHSFP

SEQ ID NO: 2480382 - protein, 19 aa, Entamoeba dispar
ETALHLACLVGNVKAIQLL

SEQ ID NO: 2480383 - protein, 19 aa, Entamoeba dispar
ETAPIPMQVPLAVDSFNEP

SEQ ID NO: 2480384 - protein, 28 aa, Entamoeba dispar
ETCVPRCFKCGKPLDGKYLVVDDHNYHP

SEQ ID NO: 2480385 - protein, 18 aa, Entamoeba dispar
ETDGMPFKETFAKQNEDT

SEQ ID NO: 2480386 - protein, 17 aa, Entamoeba dispar
ETDIFEGFVQRGELDQI

SEQ ID NO: 2480387 - protein, 18 aa, Entamoeba dispar
ETDWKVIGINVNDPLAQT

SEQ ID NO: 2480388 - protein, 22 aa, Entamoeba dispar
ETEDLKVSSIHFGDKDKMFSVS

SEQ ID NO: 2480389 - protein, 30 aa, Entamoeba dispar
ETEETKECKDCGFVLMDIDDVKIQDLRQKE

SEQ ID NO: 2480390 - protein, 18 aa, Entamoeba dispar
ETEFLERPVEGWKDLIPI

SEQ ID NO: 2480391 - protein, 22 aa, Entamoeba dispar
ETEIYKILKLKKEDYPFEYLFQ

SEQ ID NO: 2480392 - protein, 23 aa, Entamoeba dispar
ETEPRPVVILDVGHCNTTCSVIS

SEQ ID NO: 2480393 - protein, 21 aa, Entamoeba dispar
ETERFKASLLDSSTKTSSSPS

SEQ ID NO: 2480394 - protein, 18 aa, Entamoeba dispar
ETESFFWNKVLELETPFN

SEQ ID NO: 2480395 - protein, 23 aa, Entamoeba dispar
ETEVLDLNAICFVAKSSNARLTL

SEQ ID NO: 2480396 - protein, 24 aa, Entamoeba dispar
ETFCQKFFTAIGIHVFPFCLQFDV

SEQ ID NO: 2480397 - protein, 24 aa, Entamoeba dispar
ETFEDFKKLILCNKKIAKLMNEIT

SEQ ID NO: 2480398 - protein, 18 aa, Entamoeba dispar
ETFFCIGDILTSKQFTLF

SEQ ID NO: 2480399 - protein, 23 aa, Entamoeba dispar
ETFKELENIIGYIDCIQSFATNE

SEQ ID NO: 2480400 - protein, 23 aa, Entamoeba dispar
ETFKELENIIGYIDCIQSFATVS

SEQ ID NO: 2480401 - protein, 17 aa, Entamoeba dispar
ETFRTMKAFEGVEGLND

SEQ ID NO: 2480402 - protein, 17 aa, Entamoeba dispar
ETFSPSTSFDWNTINID

SEQ ID NO: 2480403 - protein, 18 aa, Entamoeba dispar
ETFSVIIRYSKLFDQLDF

SEQ ID NO: 2480404 - protein, 21 aa, Entamoeba dispar
ETGCFKNCLSLRSINIPSSIS

SEQ ID NO: 2480405 - protein, 18 aa, Entamoeba dispar
ETGEVFGVYIQEEISAEL

SEQ ID NO: 2480406 - protein, 19 aa, Entamoeba dispar
ETGEVFGVYIQEEISAELP

SEQ ID NO: 2480407 - protein, 24 aa, Entamoeba dispar
ETGKNFKLRASFRIRSKTANDNKS

SEQ ID NO: 2480408 - protein, 22 aa, Entamoeba dispar
ETGKNVPKGFIFEDQKGSKIEK

SEQ ID NO: 2480409 - protein, 24 aa, Entamoeba dispar
ETGKYKLPKPLAILNNNFQRLDGF

SEQ ID NO: 2480410 - protein, 18 aa, Entamoeba dispar
ETGLRLAQVVFKNDPKKC

SEQ ID NO: 2480411 - protein, 28 aa, Entamoeba dispar
ETGTFPKNFPFIIGVVVKKGEEDKESSL

SEQ ID NO: 2480412 - protein, 27 aa, Entamoeba dispar
ETHKKRLSFLGRKSFSKRSSTENTGHS

SEQ ID NO: 2480413 - protein, 19 aa, Entamoeba dispar
ETIAAYITGDWMIKSAVKV

SEQ ID NO: 2480414 - protein, 18 aa, Entamoeba dispar
ETICLKNKVPIICGGTSY

SEQ ID NO: 2480415 - protein, 18 aa, Entamoeba dispar
ETICSGIIEIGEMKEICF

SEQ ID NO: 2480416 - protein, 23 aa, Entamoeba dispar
ETIDIKSHFGFVTFTNAEDGKKI

SEQ ID NO: 2480417 - protein, 26 aa, Entamoeba dispar
ETIDLWKKLRERAGITRDEHDQQTQK

SEQ ID NO: 2480418 - protein, 25 aa, Entamoeba dispar
ETIEDMMVMLGRYLDYLIDIVRPRK

SEQ ID NO: 2480419 - protein, 23 aa, Entamoeba dispar
ETIERYGLDMLKRIGDYKTLIEC

SEQ ID NO: 2480420 - protein, 17 aa, Entamoeba dispar
ETIFTCSLFESLWPPSY

SEQ ID NO: 2480421 - protein, 26 aa, Entamoeba dispar
ETIIKGFEIIPIILMEELYDIVYNQI

SEQ ID NO: 2480422 - protein, 20 aa, Entamoeba dispar
ETIKILSLFIHQLGSQKDKI

SEQ ID NO: 2480423 - protein, 24 aa, Entamoeba dispar
ETIKLLCVLPEEFIKKNENLIIKN

SEQ ID NO: 2480424 - protein, 17 aa, Entamoeba dispar
ETIKRLKTRNGLSEEQA

SEQ ID NO: 2480425 - protein, 20 aa, Entamoeba dispar
ETILFLLSLVPGVFFGKPEN

SEQ ID NO: 2480426 - protein, 27 aa, Entamoeba dispar
ETILLISRMGYIYGFYSGDGTLFFQGR

SEQ ID NO: 2480427 - protein, 20 aa, Entamoeba dispar
ETINGLDFIGYESKKWSQAL

SEQ ID NO: 2480428 - protein, 19 aa, Entamoeba dispar
ETINSWKNEESLTVALQLK

SEQ ID NO: 2480429 - protein, 20 aa, Entamoeba dispar
ETIRAILLLSIGNFIKQDVL

SEQ ID NO: 2480430 - protein, 19 aa, Entamoeba dispar
ETISLGIPVNLMLLKKNQE

SEQ ID NO: 2480431 - protein, 19 aa, Entamoeba dispar
ETIYYCISMAPDGVTSPLL

SEQ ID NO: 2480432 - protein, 22 aa, Entamoeba dispar
ETKEVRLPPIMLQEKQNKSNGI

SEQ ID NO: 2480433 - protein, 25 aa, Entamoeba dispar
ETKGYKKREIELLNSLKRTPLNDEK

SEQ ID NO: 2480434 - protein, 23 aa, Entamoeba dispar
ETKMLKDQLQWVVFTEGSNMAGL

SEQ ID NO: 2480435 - protein, 24 aa, Entamoeba dispar
ETKPTCRRTFKIVFKNKEECRTWN

SEQ ID NO: 2480436 - protein, 20 aa, Entamoeba dispar
ETKRTFFFWNQENDINIFYK

SEQ ID NO: 2480437 - protein, 18 aa, Entamoeba dispar
ETKSGFLENEFIFTNAFP

SEQ ID NO: 2480438 - protein, 23 aa, Entamoeba dispar
ETKSLISSVLIQFAKTSRSSFID

SEQ ID NO: 2480439 - protein, 25 aa, Entamoeba dispar
ETKSSILSVFIQWTKSFFGDFEKKP

SEQ ID NO: 2480440 - protein, 32 aa, Entamoeba dispar
ETKSWGQAHCQARFALFKTVEKSGAVEIIGEN

SEQ ID NO: 2480441 - protein, 25 aa, Entamoeba dispar
ETKTKWKWRYDRYDLIFYISQVPCG

SEQ ID NO: 2480442 - protein, 20 aa, Entamoeba dispar
ETKTPAPFKIVTRNRAGEQL

SEQ ID NO: 2480443 - protein, 21 aa, Entamoeba dispar
ETKTPAPFKIVTRNRAGEQLK

SEQ ID NO: 2480444 - protein, 22 aa, Entamoeba dispar
ETKTPAPFKIVTRNRAGEQLKK

SEQ ID NO: 2480445 - protein, 25 aa, Entamoeba dispar
ETKVSDLNAICFVAKSSNTRLTENQ

SEQ ID NO: 2480446 - protein, 25 aa, Entamoeba dispar
ETKWKEIFEKFVLKEYVPTVLIPNK

SEQ ID NO: 2480447 - protein, 22 aa, Entamoeba dispar
ETKYGKKYPEAMMNLFEDTVVK

SEQ ID NO: 2480448 - protein, 20 aa, Entamoeba dispar
ETKYKCSFHANIKTRSFCCC

SEQ ID NO: 2480449 - protein, 23 aa, Entamoeba dispar
ETLCDNCDCIARNINKVLESNQE

SEQ ID NO: 2480450 - protein, 18 aa, Entamoeba dispar
ETLCRFKQSNNWKDSLEK

SEQ ID NO: 2480451 - protein, 20 aa, Entamoeba dispar
ETLEFAFKYFITPYVVEQLK

SEQ ID NO: 2480452 - protein, 19 aa, Entamoeba dispar
ETLETCIRIVGKYYLDAGE

SEQ ID NO: 2480453 - protein, 35 aa, Entamoeba dispar
ETLIEIMCNVFPFSDFWKHVCIVWTKCYCYTPKNI

SEQ ID NO: 2480454 - protein, 27 aa, Entamoeba dispar
ETLIYRCISKVYNRVCANSSTQIYDSN

SEQ ID NO: 2480455 - protein, 26 aa, Entamoeba dispar
ETLKALGANLRWASCNIFSTQDHAAA

SEQ ID NO: 2480456 - protein, 23 aa, Entamoeba dispar
ETLKPLVCIGSCYALCKPSQFPV

SEQ ID NO: 2480457 - protein, 19 aa, Entamoeba dispar
ETLKSILMKNIKNIEEDND

SEQ ID NO: 2480458 - protein, 17 aa, Entamoeba dispar
ETLLEINEGIIINITNT

SEQ ID NO: 2480459 - protein, 24 aa, Entamoeba dispar
ETLLEITSPIPLQYNEEIKLSSDH

SEQ ID NO: 2480460 - protein, 24 aa, Entamoeba dispar
ETLLWGLACHLHLLVIQKKQNDLA

SEQ ID NO: 2480461 - protein, 20 aa, Entamoeba dispar
ETLMGFPYCVIDLTNGEVYL

SEQ ID NO: 2480462 - protein, 20 aa, Entamoeba dispar
ETLNSLWPTVKPLPGAIRIL

SEQ ID NO: 2480463 - protein, 17 aa, Entamoeba dispar
ETLSLELLGEVNVGGCV

SEQ ID NO: 2480464 - protein, 19 aa, Entamoeba dispar
ETLSLLGLNNKYALTLYIR

SEQ ID NO: 2480465 - protein, 30 aa, Entamoeba dispar
ETLSSFIVKLFPEFSLLFNGAELEKLKPNK

SEQ ID NO: 2480466 - protein, 23 aa, Entamoeba dispar
ETMLKSEHLVAIGYEDVTKANEM

SEQ ID NO: 2480467 - protein, 19 aa, Entamoeba dispar
ETMNIRLTVVNGKQLKAKD

SEQ ID NO: 2480468 - protein, 25 aa, Entamoeba dispar
ETNEYWKKLHLEVLEKDTIQFDPMH

SEQ ID NO: 2480469 - protein, 25 aa, Entamoeba dispar
ETPFLNRIIHLIRLFSNPSDNKSLQ

SEQ ID NO: 2480470 - protein, 20 aa, Entamoeba dispar
ETPLHLACLCGIIDNVELLL

SEQ ID NO: 2480471 - protein, 18 aa, Entamoeba dispar
ETPLMYAARFHRNDFLIY

SEQ ID NO: 2480472 - protein, 26 aa, Entamoeba dispar
ETPPVPVEIQILWKLENDDLVPAIMK

SEQ ID NO: 2480473 - protein, 19 aa, Entamoeba dispar
ETPQTLHLLAFDSLVDSAK

SEQ ID NO: 2480474 - protein, 21 aa, Entamoeba dispar
ETPSKRKFIFETNDFNDEIES

SEQ ID NO: 2480475 - protein, 20 aa, Entamoeba dispar
ETPTGWKFFGNLMDSGKISL

SEQ ID NO: 2480476 - protein, 19 aa, Entamoeba dispar
ETQFKRIVKRGRQVELEMY

SEQ ID NO: 2480477 - protein, 22 aa, Entamoeba dispar
ETQGRKAFLGMGFQERSEAFDF

SEQ ID NO: 2480478 - protein, 21 aa, Entamoeba dispar
ETQNFICWSNEFNKKAIMIPD

SEQ ID NO: 2480479 - protein, 26 aa, Entamoeba dispar
ETQRPKGCGFVKFMTHEDAKLCVEEA

SEQ ID NO: 2480480 - protein, 27 aa, Entamoeba dispar
ETQRPKGCGFVKFMTHEDAKLCVEEAP

SEQ ID NO: 2480481 - protein, 18 aa, Entamoeba dispar
ETRCKIGITATPIREDYK

SEQ ID NO: 2480482 - protein, 18 aa, Entamoeba dispar
ETRECIECEKGYYLNSTK

SEQ ID NO: 2480483 - protein, 18 aa, Entamoeba dispar
ETRFQIITGPNMGGKSTY

SEQ ID NO: 2480484 - protein, 23 aa, Entamoeba dispar
ETRLMPKVLHHIFDALELTAPST

SEQ ID NO: 2480485 - protein, 23 aa, Entamoeba dispar
ETRRRTVVLSIEITRLLNEFQNI

SEQ ID NO: 2480486 - protein, 19 aa, Entamoeba dispar
ETRYHFAVQLYPFAEQIKD

SEQ ID NO: 2480487 - protein, 25 aa, Entamoeba dispar
ETRYLRPGEYIQMSGRAGRRGKDEQ

SEQ ID NO: 2480488 - protein, 17 aa, Entamoeba dispar
ETSDLIVHLGVIKVLLH

SEQ ID NO: 2480489 - protein, 24 aa, Entamoeba dispar
ETSEVMLDSVLVKFSEDYNKLKRD

SEQ ID NO: 2480490 - protein, 28 aa, Entamoeba dispar
ETSFRTPCLFCKEFLDIDFLLKHMNERH

SEQ ID NO: 2480491 - protein, 21 aa, Entamoeba dispar
ETSGRGALMFVRAVEPDTFPI

SEQ ID NO: 2480492 - protein, 25 aa, Entamoeba dispar
ETSKMAAVVLRFFLDTESESSLDME

SEQ ID NO: 2480493 - protein, 18 aa, Entamoeba dispar
ETSLKVVSMLAEVLSIIC

SEQ ID NO: 2480494 - protein, 23 aa, Entamoeba dispar
ETSLWRFSSLVSISECSIPKEDS

SEQ ID NO: 2480495 - protein, 24 aa, Entamoeba dispar
ETSPFFIPQRMNSYYHLKTFVETP

SEQ ID NO: 2480496 - protein, 18 aa, Entamoeba dispar
ETSVHLKGAVAAAVSNFA

SEQ ID NO: 2480497 - protein, 31 aa, Entamoeba dispar
ETSYFPFKGIHILCVVFDFSNDSIKNIGNWI

SEQ ID NO: 2480498 - protein, 18 aa, Entamoeba dispar
ETTCAKYSPSGYYICSGD

SEQ ID NO: 2480499 - protein, 19 aa, Entamoeba dispar
ETTCAKYSPSGYYICSGDV

SEQ ID NO: 2480500 - protein, 24 aa, Entamoeba dispar
ETTQTGLFSYFFGKTDEYDEPPKY

SEQ ID NO: 2480501 - protein, 22 aa, Entamoeba dispar
ETVIKLLIGNKCDLEDERAVTV

SEQ ID NO: 2480502 - protein, 29 aa, Entamoeba dispar
ETVKEGKLLFGERFLRVDPILPGQILLDN

SEQ ID NO: 2480503 - protein, 25 aa, Entamoeba dispar
ETVRMLKEKFCYVGYDLAVENRLGT

SEQ ID NO: 2480504 - protein, 24 aa, Entamoeba dispar
ETVRNFLKRIGLEQLTEQFIGFGY

SEQ ID NO: 2480505 - protein, 17 aa, Entamoeba dispar
ETVSNFVAATFDEPFGI

SEQ ID NO: 2480506 - protein, 23 aa, Entamoeba dispar
ETWVEEFVRYYSLLIIQNANCIP

SEQ ID NO: 2480507 - protein, 29 aa, Entamoeba dispar
ETWVLNPRATSIGIEICKYLNNSIKIVNS

SEQ ID NO: 2480508 - protein, 18 aa, Entamoeba dispar
ETYFGSAKEFINLTDREV

SEQ ID NO: 2480509 - protein, 22 aa, Entamoeba dispar
ETYGNAALIMLRKGEITKAESY

SEQ ID NO: 2480510 - protein, 23 aa, Entamoeba dispar
ETYIRPYFSDVFRPVKKGDHFLC

SEQ ID NO: 2480511 - protein, 20 aa, Entamoeba dispar
ETYLEFKRKYEEHGKNKDYY

SEQ ID NO: 2480512 - protein, 24 aa, Entamoeba dispar
ETYLKKEFDFGVVVNVEKKDIAEQ

SEQ ID NO: 2480513 - protein, 22 aa, Entamoeba dispar
ETYRFFTTFNYLYAIDNFFDYS

SEQ ID NO: 2480514 - protein, 19 aa, Entamoeba dispar
ETYYQASGCSSKISEHATR

SEQ ID NO: 2480515 - protein, 24 aa, Entamoeba dispar
EVAAAYRRLIERGSVPDINKAPFF

SEQ ID NO: 2480516 - protein, 25 aa, Entamoeba dispar
EVAIKLELLKCKHPQLKDEFELYQK

SEQ ID NO: 2480517 - protein, 17 aa, Entamoeba dispar
EVAKVVVEDVCINTRLV

SEQ ID NO: 2480518 - protein, 17 aa, Entamoeba dispar
EVANWKRKLYVYGNQIQ

SEQ ID NO: 2480519 - protein, 31 aa, Entamoeba dispar
EVAQKKFPFIPLILKYIEAMTFYSNDFNEFE

SEQ ID NO: 2480520 - protein, 23 aa, Entamoeba dispar
EVCCSNPAKLFGIYPEKGCLGIG

SEQ ID NO: 2480521 - protein, 24 aa, Entamoeba dispar
EVCDRKKIMLHMIHIYKEKKEVEE

SEQ ID NO: 2480522 - protein, 25 aa, Entamoeba dispar
EVCNEKITGLCYVKENIIVGTPSGQ

SEQ ID NO: 2480523 - protein, 20 aa, Entamoeba dispar
EVCPKCKGKGVVVNEKDLCK

SEQ ID NO: 2480524 - protein, 22 aa, Entamoeba dispar
EVDALYKIIFELSKEMIKKYQT

SEQ ID NO: 2480525 - protein, 34 aa, Entamoeba dispar
EVDGVPVYINHLWRKCYGDESCKNYLNIRYPLPE

SEQ ID NO: 2480526 - protein, 19 aa, Entamoeba dispar
EVDKTIPLEKLLLVHSKEY

SEQ ID NO: 2480527 - protein, 25 aa, Entamoeba dispar
EVEDKLRVGLLYALKYEDKAQDIIE

SEQ ID NO: 2480528 - protein, 26 aa, Entamoeba dispar
EVEDKLRVGLLYALKYEDKAQDIIEE

SEQ ID NO: 2480529 - protein, 34 aa, Entamoeba dispar
EVEENNRYLLLNGICVALKMGNPDYERTHLSVST

SEQ ID NO: 2480530 - protein, 23 aa, Entamoeba dispar
EVEFNRFYSIFSRVYSLQEINEF

SEQ ID NO: 2480531 - protein, 21 aa, Entamoeba dispar
EVEGTLLHFVDNCFTAFGKRM

SEQ ID NO: 2480532 - protein, 29 aa, Entamoeba dispar
EVEKQPCYFVPELMRLTGMSDDMRADNQF

SEQ ID NO: 2480533 - protein, 23 aa, Entamoeba dispar
EVEPLPSWSYDGLNLIYKLSQEE

SEQ ID NO: 2480534 - protein, 19 aa, Entamoeba dispar
EVESRIGIFDTDHKFISGV

SEQ ID NO: 2480535 - protein, 23 aa, Entamoeba dispar
EVEWLDGKLRYMIQLEAEDLMGV

SEQ ID NO: 2480536 - protein, 24 aa, Entamoeba dispar
EVFEIAFQVGFTMIKKEMIQSLNY

SEQ ID NO: 2480537 - protein, 20 aa, Entamoeba dispar
EVFEMAAKVALGMEDETRDK

SEQ ID NO: 2480538 - protein, 20 aa, Entamoeba dispar
EVFGNVKYKKIDIITNDFCP

SEQ ID NO: 2480539 - protein, 19 aa, Entamoeba dispar
EVFIKRNNNILTIIKEYPI

SEQ ID NO: 2480540 - protein, 22 aa, Entamoeba dispar
EVFPDLDMLPLFLTKKKILSRV

SEQ ID NO: 2480541 - protein, 19 aa, Entamoeba dispar
EVFSTGFGEHLEKLAHSNG

SEQ ID NO: 2480542 - protein, 19 aa, Entamoeba dispar
EVFTSPLLVDKIVLNVDFW

SEQ ID NO: 2480543 - protein, 17 aa, Entamoeba dispar
EVGENMQGLALNSMTKT

SEQ ID NO: 2480544 - protein, 23 aa, Entamoeba dispar
EVGNKVCLVIGEKGLVGRSKTKE

SEQ ID NO: 2480545 - protein, 18 aa, Entamoeba dispar
EVHIKWLTLSIHKPLPSG

SEQ ID NO: 2480546 - protein, 18 aa, Entamoeba dispar
EVHRENYNTFAISYNCRH

SEQ ID NO: 2480547 - protein, 19 aa, Entamoeba dispar
EVHSIDCELERLKISLELL

SEQ ID NO: 2480548 - protein, 29 aa, Entamoeba dispar
EVIELPIKHPELFESLGIAQPKGVLLYGP

SEQ ID NO: 2480549 - protein, 30 aa, Entamoeba dispar
EVIELPIKHPELFESLGIAQPKGVLLYGPP

SEQ ID NO: 2480550 - protein, 18 aa, Entamoeba dispar
EVIGCGFTLPVDDHKTIA

SEQ ID NO: 2480551 - protein, 22 aa, Entamoeba dispar
EVIGDAAFWGCCSIRRILFPSS

SEQ ID NO: 2480552 - protein, 19 aa, Entamoeba dispar
EVIGGAVFANNNFNPLTAV

SEQ ID NO: 2480553 - protein, 25 aa, Entamoeba dispar
EVIIDRIIPELSLLDVNEIKDNQIY

SEQ ID NO: 2480554 - protein, 20 aa, Entamoeba dispar
EVIIHYNIWDFPNWEVNNNL

SEQ ID NO: 2480555 - protein, 25 aa, Entamoeba dispar
EVIIPIDDLLPFAAMKMFPNALFGN

SEQ ID NO: 2480556 - protein, 21 aa, Entamoeba dispar
EVINTLKYVFEKLAKEKEIVK

SEQ ID NO: 2480557 - protein, 25 aa, Entamoeba dispar
EVIPFRLPPELVQASIQQEKPSRTL

SEQ ID NO: 2480558 - protein, 19 aa, Entamoeba dispar
EVISDPIGVMKRIYQKVGM

SEQ ID NO: 2480559 - protein, 28 aa, Entamoeba dispar
EVITPYVYHLRLLISTMHQALNSYRPYQ

SEQ ID NO: 2480560 - protein, 18 aa, Entamoeba dispar
EVITYVSLYELDAANIKS

SEQ ID NO: 2480561 - protein, 25 aa, Entamoeba dispar
EVIYSRWVPHNSKVLKIKFNKDNTM

SEQ ID NO: 2480562 - protein, 27 aa, Entamoeba dispar
EVKDIFTTPCLPFIGTYLTDYTFLDDG

SEQ ID NO: 2480563 - protein, 20 aa, Entamoeba dispar
EVKEIRKGLDELIQLEKEKK

SEQ ID NO: 2480564 - protein, 21 aa, Entamoeba dispar
EVKELKEGCVCEVQTMPVQKG

SEQ ID NO: 2480565 - protein, 21 aa, Entamoeba dispar
EVKGMMNLCGLILSKQLERKV

SEQ ID NO: 2480566 - protein, 22 aa, Entamoeba dispar
EVKMKCLYEMGDWEALDEVANK

SEQ ID NO: 2480567 - protein, 17 aa, Entamoeba dispar
EVKMVKCHQMKIVDTSN

SEQ ID NO: 2480568 - protein, 19 aa, Entamoeba dispar
EVKSLGDNCFEYCNELTSI

SEQ ID NO: 2480569 - protein, 25 aa, Entamoeba dispar
EVKSLGHGCFCYCASLTSIDIPSSI

SEQ ID NO: 2480570 - protein, 22 aa, Entamoeba dispar
EVKSLGNGCFKQCYELTTINIP

SEQ ID NO: 2480571 - protein, 27 aa, Entamoeba dispar
EVKSLGNSCFKHCYELRSINIPSSVSK

SEQ ID NO: 2480572 - protein, 25 aa, Entamoeba dispar
EVKSLGYKCFKYCSSLTSINIPTTI

SEQ ID NO: 2480573 - protein, 23 aa, Entamoeba dispar
EVKSLGYKCFKYCSSLTTINIPS

SEQ ID NO: 2480574 - protein, 24 aa, Entamoeba dispar
EVKSLRDWCFKNCDELSSITIPTP

SEQ ID NO: 2480575 - protein, 23 aa, Entamoeba dispar
EVKSRALFYLNIINSEITITLEK

SEQ ID NO: 2480576 - protein, 25 aa, Entamoeba dispar
EVLETAILHCLKKILEKSSGVSDIS

SEQ ID NO: 2480577 - protein, 18 aa, Entamoeba dispar
EVLEYGFEFAQKKMGIDR

SEQ ID NO: 2480578 - protein, 20 aa, Entamoeba dispar
EVLFRRSLFGYCIRTNTSSL

SEQ ID NO: 2480579 - protein, 19 aa, Entamoeba dispar
EVLIIKQIVDGLLKNKVKE

SEQ ID NO: 2480580 - protein, 21 aa, Entamoeba dispar
EVLKIFDIKTSMMFGKADQQE

SEQ ID NO: 2480581 - protein, 20 aa, Entamoeba dispar
EVLKRMPGITTNQLFDIEHN

SEQ ID NO: 2480582 - protein, 28 aa, Entamoeba dispar
EVLLDKISLFFGFPITFYKAHCPLQTNG

SEQ ID NO: 2480583 - protein, 20 aa, Entamoeba dispar
EVLLHKRIKDILPNEIPEII

SEQ ID NO: 2480584 - protein, 20 aa, Entamoeba dispar
EVLNCLYLTQYVVQRQSSFR

SEQ ID NO: 2480585 - protein, 18 aa, Entamoeba dispar
EVLQKCNEYCIMIDNLCQ

SEQ ID NO: 2480586 - protein, 20 aa, Entamoeba dispar
EVLQRRVAETKGHITPKVVW

SEQ ID NO: 2480587 - protein, 18 aa, Entamoeba dispar
EVLTYKGPVPSYVDQVLI

SEQ ID NO: 2480588 - protein, 30 aa, Entamoeba dispar
EVMFNKRLGSYYQLECEPEGFDKEDSEKVT

SEQ ID NO: 2480589 - protein, 17 aa, Entamoeba dispar
EVMKKTKYGITFIDGKR

SEQ ID NO: 2480590 - protein, 19 aa, Entamoeba dispar
EVMLLYNIVYSICASQDDR

SEQ ID NO: 2480591 - protein, 24 aa, Entamoeba dispar
EVMNRIINILIYFIKDNTEQAMFV

SEQ ID NO: 2480592 - protein, 20 aa, Entamoeba dispar
EVMPKLALELKRKYYSQTKT

SEQ ID NO: 2480593 - protein, 32 aa, Entamoeba dispar
EVMVLTWGNLKGEFRAVPGYDVSTPKTFNAPT

SEQ ID NO: 2480594 - protein, 22 aa, Entamoeba dispar
EVMYAHAMKEGFVMSNSIGDRI

SEQ ID NO: 2480595 - protein, 26 aa, Entamoeba dispar
EVMYLLGVDVGQAFGYSIMKLLFEGK

SEQ ID NO: 2480596 - protein, 25 aa, Entamoeba dispar
EVNANEIILSFGPKTKVKKWNIKNM

SEQ ID NO: 2480597 - protein, 21 aa, Entamoeba dispar
EVNATQRLSLNKIINRLYDSY

SEQ ID NO: 2480598 - protein, 19 aa, Entamoeba dispar
EVNDVCWSKSNSNWIAASI

SEQ ID NO: 2480599 - protein, 17 aa, Entamoeba dispar
EVNELFEQIKLFQQCID

SEQ ID NO: 2480600 - protein, 22 aa, Entamoeba dispar
EVNGKWTCCGRVRQHSHTVKSL

SEQ ID NO: 2480601 - protein, 24 aa, Entamoeba dispar
EVNGRCPLCKQLIPTHDLKQIRNL

SEQ ID NO: 2480602 - protein, 32 aa, Entamoeba dispar
EVNGRWRFELHRGVIYEGMIGMYLGKNDSEKK

SEQ ID NO: 2480603 - protein, 20 aa, Entamoeba dispar
EVNIRYLALDTFVLLGQANY

SEQ ID NO: 2480604 - protein, 22 aa, Entamoeba dispar
EVNKEIRELICIGNENKEKKKI

SEQ ID NO: 2480605 - protein, 18 aa, Entamoeba dispar
EVNKYSKSLCLSGSKSST

SEQ ID NO: 2480606 - protein, 18 aa, Entamoeba dispar
EVNLPIVVKFISVSNKKL

SEQ ID NO: 2480607 - protein, 24 aa, Entamoeba dispar
EVNPKIYRFRPFIIKLTINTSFGI

SEQ ID NO: 2480608 - protein, 20 aa, Entamoeba dispar
EVNSLGNFCFYSCALLKSIN

SEQ ID NO: 2480609 - protein, 29 aa, Entamoeba dispar
EVNTFLFCYRDLYEAQEFILKYGKGYKKY

SEQ ID NO: 2480610 - protein, 19 aa, Entamoeba dispar
EVPHEGPMCDLLWSDPEEK

SEQ ID NO: 2480611 - protein, 21 aa, Entamoeba dispar
EVPILPIRKSLILAQENNENT

SEQ ID NO: 2480612 - protein, 20 aa, Entamoeba dispar
EVPPPIQVNTDFKFSIAEQN

SEQ ID NO: 2480613 - protein, 22 aa, Entamoeba dispar
EVPRTVTVILERYLVVGLTAGQ

SEQ ID NO: 2480614 - protein, 24 aa, Entamoeba dispar
EVPSRLETLIKIMTRFCLLYSYFP

SEQ ID NO: 2480615 - protein, 17 aa, Entamoeba dispar
EVPWMCFKNLGCVNENN

SEQ ID NO: 2480616 - protein, 21 aa, Entamoeba dispar
EVQEGIYWCGHKIDTFSKEIE

SEQ ID NO: 2480617 - protein, 24 aa, Entamoeba dispar
EVQERACFMLAIVRQFESLREQGI

SEQ ID NO: 2480618 - protein, 27 aa, Entamoeba dispar
EVQIIQRICLYWLKYDESTEEVIMEKT

SEQ ID NO: 2480619 - protein, 18 aa, Entamoeba dispar
EVQILTGIVGNRAKHVIN

SEQ ID NO: 2480620 - protein, 21 aa, Entamoeba dispar
EVQLLNKLHCYLRGSTEQAEQ

SEQ ID NO: 2480621 - protein, 21 aa, Entamoeba dispar
EVQQWWKIILAIFASSIKMCR

SEQ ID NO: 2480622 - protein, 19 aa, Entamoeba dispar
EVQYLPPHFNVLIQKIINR

SEQ ID NO: 2480623 - protein, 17 aa, Entamoeba dispar
EVRFFFETFKKLRVGAV

SEQ ID NO: 2480624 - protein, 19 aa, Entamoeba dispar
EVRFKRIVSELGEQSYEID

SEQ ID NO: 2480625 - protein, 20 aa, Entamoeba dispar
EVRKRLVVINATPNKLKVPS

SEQ ID NO: 2480626 - protein, 23 aa, Entamoeba dispar
EVRLTEIIKLLKTMMDYVESAKI

SEQ ID NO: 2480627 - protein, 19 aa, Entamoeba dispar
EVRPVFKGIDITSSDISDK

SEQ ID NO: 2480628 - protein, 24 aa, Entamoeba dispar
EVRSEVWKLLLLKDLDYKTLQDEF

SEQ ID NO: 2480629 - protein, 24 aa, Entamoeba dispar
EVRSWALLCLSKLWEGTIEIKIRA

SEQ ID NO: 2480630 - protein, 25 aa, Entamoeba dispar
EVSCMDKSRLDYMFHWKKPNENPII

SEQ ID NO: 2480631 - protein, 18 aa, Entamoeba dispar
EVSEAYAVLSDHEKREMY

SEQ ID NO: 2480632 - protein, 24 aa, Entamoeba dispar
EVSENGEYCCFEYESWNTVSKSHF

SEQ ID NO: 2480633 - protein, 26 aa, Entamoeba dispar
EVSGLLFHRAVFFTAALLRFHINTLV

SEQ ID NO: 2480634 - protein, 19 aa, Entamoeba dispar
EVSGMILKYLYGIAQNKLG

SEQ ID NO: 2480635 - protein, 18 aa, Entamoeba dispar
EVSNALIRFITKINNDVP

SEQ ID NO: 2480636 - protein, 21 aa, Entamoeba dispar
EVSQRILIDGINWINKRRTGI

SEQ ID NO: 2480637 - protein, 20 aa, Entamoeba dispar
EVSVSEFYYLVFKNSGILDY

SEQ ID NO: 2480638 - protein, 18 aa, Entamoeba dispar
EVTKMSVSLLNMLDSRQE

SEQ ID NO: 2480639 - protein, 23 aa, Entamoeba dispar
EVTMGISCIEFKPETTEAIRTSV

SEQ ID NO: 2480640 - protein, 27 aa, Entamoeba dispar
EVTSLGYECFARMYGLLTIIIPTMIKR

SEQ ID NO: 2480641 - protein, 25 aa, Entamoeba dispar
EVVCCRFSPCLYKSVNFDGKKRAFS

SEQ ID NO: 2480642 - protein, 18 aa, Entamoeba dispar
EVVCVGSIDPERRKLEGI

SEQ ID NO: 2480643 - protein, 21 aa, Entamoeba dispar
EVVDGIPYWDTELFMMKDLHI

SEQ ID NO: 2480644 - protein, 24 aa, Entamoeba dispar
EVVEHINESFSIYMSQINCRGSVE

SEQ ID NO: 2480645 - protein, 19 aa, Entamoeba dispar
EVVEIFLAQWHQFSPNNQK

SEQ ID NO: 2480646 - protein, 17 aa, Entamoeba dispar
EVVKELFTNGVINKLIE

SEQ ID NO: 2480647 - protein, 18 aa, Entamoeba dispar
EVVPVDLLDPEKVYQYEQ

SEQ ID NO: 2480648 - protein, 26 aa, Entamoeba dispar
EVVSGSIDALIRWAVNPNIDNNIKFI

SEQ ID NO: 2480649 - protein, 21 aa, Entamoeba dispar
EVVVTFGGHLYRGNRVQKLKA

SEQ ID NO: 2480650 - protein, 18 aa, Entamoeba dispar
EVVWDCFGDIKKQGGAPC

SEQ ID NO: 2480651 - protein, 22 aa, Entamoeba dispar
EVYCLRMLKSIGVCVVPGSGFG

SEQ ID NO: 2480652 - protein, 19 aa, Entamoeba dispar
EVYEVFSCYFGDKSMAPVL

SEQ ID NO: 2480653 - protein, 18 aa, Entamoeba dispar
EVYIKDIFLMPTESVNPS

SEQ ID NO: 2480654 - protein, 24 aa, Entamoeba dispar
EVYKRGIKYVMHFGEELPTSLSLT

SEQ ID NO: 2480655 - protein, 19 aa, Entamoeba dispar
EVYLFPYYSVHDFINTNTF

SEQ ID NO: 2480656 - protein, 18 aa, Entamoeba dispar
EVYLQYSSAPAFFRISNL

SEQ ID NO: 2480657 - protein, 23 aa, Entamoeba dispar
EVYRIKMNFPNSVSMTHLTMYNI

SEQ ID NO: 2480658 - protein, 19 aa, Entamoeba dispar
EVYRKKIAIELLTTERTYV

SEQ ID NO: 2480659 - protein, 17 aa, Entamoeba dispar
EVYSLLISCLFDLHVIL

SEQ ID NO: 2480660 - protein, 26 aa, Entamoeba dispar
EVYWEHKKGWAIGGINGRYGMFPLAK

SEQ ID NO: 2480661 - protein, 26 aa, Entamoeba dispar
EWAEELGASCFAHWFQPLSQTTARKY

SEQ ID NO: 2480662 - protein, 18 aa, Entamoeba dispar
EWALEGGALVLADEGVCL

SEQ ID NO: 2480663 - protein, 28 aa, Entamoeba dispar
EWCDGEFNVICATIAFGMGIDKPDVRFV

SEQ ID NO: 2480664 - protein, 21 aa, Entamoeba dispar
EWCGNLIVVEFSETIESKRNR

SEQ ID NO: 2480665 - protein, 22 aa, Entamoeba dispar
EWCGNLIVVEFSETIESKRNRR

SEQ ID NO: 2480666 - protein, 23 aa, Entamoeba dispar
EWDKKLFNCITCLDHIPNCSYPT

SEQ ID NO: 2480667 - protein, 25 aa, Entamoeba dispar
EWELNFPLVECICSLMVLNDIESNE

SEQ ID NO: 2480668 - protein, 27 aa, Entamoeba dispar
EWFPPQWKVNFAKRLPIGNVKKYPPGN

SEQ ID NO: 2480669 - protein, 26 aa, Entamoeba dispar
EWHIQAVCAITVWLKERNYNFWMDET

SEQ ID NO: 2480670 - protein, 20 aa, Entamoeba dispar
EWIKLMQCFIQRKEIDEARK

SEQ ID NO: 2480671 - protein, 23 aa, Entamoeba dispar
EWIVKRLEQINSIEGIELIGKIY

SEQ ID NO: 2480672 - protein, 24 aa, Entamoeba dispar
EWKVPECVKHLMFIGLTIQTLPKI

SEQ ID NO: 2480673 - protein, 20 aa, Entamoeba dispar
EWLKECIEYIKGNVKLITEF

SEQ ID NO: 2480674 - protein, 19 aa, Entamoeba dispar
EWLYAMKMQSYRAALELFI

SEQ ID NO: 2480675 - protein, 19 aa, Entamoeba dispar
EWNECKSIIYTKHEREKYG

SEQ ID NO: 2480676 - protein, 25 aa, Entamoeba dispar
EWSFCECPRLSIIEYNSHNTMKTQI

SEQ ID NO: 2480677 - protein, 22 aa, Entamoeba dispar
EWTGRIKMNIIFDSDIDDQNVV

SEQ ID NO: 2480678 - protein, 19 aa, Entamoeba dispar
EWVFNRSFIPLKFSLDKKN

SEQ ID NO: 2480679 - protein, 21 aa, Entamoeba dispar
EWVKQCEILLYRGAWQEWEIE

SEQ ID NO: 2480680 - protein, 20 aa, Entamoeba dispar
EWVLEGGALVLADMGICCID

SEQ ID NO: 2480681 - protein, 23 aa, Entamoeba dispar
EWVRCMIRQLKLTDFKKEKFYYI

SEQ ID NO: 2480682 - protein, 19 aa, Entamoeba dispar
EWVYLYLQLLRKIFKYNPR

SEQ ID NO: 2480683 - protein, 17 aa, Entamoeba dispar
EWYFIKTKKEVIALSTY

SEQ ID NO: 2480684 - protein, 25 aa, Entamoeba dispar
EYAQKYPFVCFAKITWEDSNKPFPE

SEQ ID NO: 2480685 - protein, 26 aa, Entamoeba dispar
EYCFIPFKYRDGYLLSILKETEGKSI

SEQ ID NO: 2480686 - protein, 25 aa, Entamoeba dispar
EYCFNKWDGIFIMKRTINEYLAQVA

SEQ ID NO: 2480687 - protein, 17 aa, Entamoeba dispar
EYCFRLQKDRVYYVRLS

SEQ ID NO: 2480688 - protein, 26 aa, Entamoeba dispar
EYCLDIPKEFKIGSIHKGRIMYYSAF

SEQ ID NO: 2480689 - protein, 21 aa, Entamoeba dispar
EYCLMIKKWFSSIKNGTEQVT

SEQ ID NO: 2480690 - protein, 18 aa, Entamoeba dispar
EYCVSIFNGHFIFYDKNN

SEQ ID NO: 2480691 - protein, 17 aa, Entamoeba dispar
EYDDMFLNELKKLIEKK

SEQ ID NO: 2480692 - protein, 33 aa, Entamoeba dispar
EYDKIETIIFPFSSKNKYGLIVYVNKINIIRKE

SEQ ID NO: 2480693 - protein, 24 aa, Entamoeba dispar
EYEAFKLAASYFLYNQYFVNGKWP

SEQ ID NO: 2480694 - protein, 18 aa, Entamoeba dispar
EYEKEFKEATKLGDQLAL

SEQ ID NO: 2480695 - protein, 19 aa, Entamoeba dispar
EYEKRIEIFKTYIHDDIKC

SEQ ID NO: 2480696 - protein, 17 aa, Entamoeba dispar
EYEQIYKLFNFRQKKDI

SEQ ID NO: 2480697 - protein, 18 aa, Entamoeba dispar
EYEVFGPIGEFIRLKDNK

SEQ ID NO: 2480698 - protein, 19 aa, Entamoeba dispar
EYFCVCGFNTRKIQLEVGE

SEQ ID NO: 2480699 - protein, 18 aa, Entamoeba dispar
EYFETALMNIQKRTSFSY

SEQ ID NO: 2480700 - protein, 17 aa, Entamoeba dispar
EYFGGAVTAICSCQNNM

SEQ ID NO: 2480701 - protein, 18 aa, Entamoeba dispar
EYFRNALFKYFDKYLREI

SEQ ID NO: 2480702 - protein, 17 aa, Entamoeba dispar
EYGEIKKIVIIKDLKGI

SEQ ID NO: 2480703 - protein, 27 aa, Entamoeba dispar
EYGFIKRVCPFVQSYYRSLIQTKQMKE

SEQ ID NO: 2480704 - protein, 28 aa, Entamoeba dispar
EYHLKLCLCPLCKHGIEVFGSKRPVSWI

SEQ ID NO: 2480705 - protein, 22 aa, Entamoeba dispar
EYHSGEKFRVLSLDGGGVKCIY

SEQ ID NO: 2480706 - protein, 19 aa, Entamoeba dispar
EYICRVRGKLEKTVVTSKI

SEQ ID NO: 2480707 - protein, 26 aa, Entamoeba dispar
EYIDYSFLKICFNGVIEFNFNPMTKI

SEQ ID NO: 2480708 - protein, 25 aa, Entamoeba dispar
EYIEEFPPLLSQVGMGARIRNYCRR

SEQ ID NO: 2480709 - protein, 18 aa, Entamoeba dispar
EYIFSAYCDREYCKTTKT

SEQ ID NO: 2480710 - protein, 19 aa, Entamoeba dispar
EYIHCLELLPSNEYLVDAF

SEQ ID NO: 2480711 - protein, 17 aa, Entamoeba dispar
EYIIHFYGAVFIPNKIC

SEQ ID NO: 2480712 - protein, 19 aa, Entamoeba dispar
EYIIKCSKIKPINKKDIEN

SEQ ID NO: 2480713 - protein, 31 aa, Entamoeba dispar
EYIIMVELLARRIIPNFVVHEGREEQTLSLL

SEQ ID NO: 2480714 - protein, 17 aa, Entamoeba dispar
EYIKRKYSLFIVDAQFT

SEQ ID NO: 2480715 - protein, 25 aa, Entamoeba dispar
EYIMHSSMKNWSFIPVTLADYPYLP

SEQ ID NO: 2480716 - protein, 25 aa, Entamoeba dispar
EYIQPLIIGCWRLCNEDKCQKEFIE

SEQ ID NO: 2480717 - protein, 25 aa, Entamoeba dispar
EYITCLELFPFDCNSVLVGSSNGLV

SEQ ID NO: 2480718 - protein, 18 aa, Entamoeba dispar
EYITLKSVVSKFVVNCLQ

SEQ ID NO: 2480719 - protein, 25 aa, Entamoeba dispar
EYKEAIKIYQECAAELHNLIDDINY

SEQ ID NO: 2480720 - protein, 21 aa, Entamoeba dispar
EYKEKILTFDGINLGGNKIEV

SEQ ID NO: 2480721 - protein, 21 aa, Entamoeba dispar
EYKKLEAISRMPASVTVLNAE

SEQ ID NO: 2480722 - protein, 19 aa, Entamoeba dispar
EYKLNIILRYYNKSKIVIN

SEQ ID NO: 2480723 - protein, 26 aa, Entamoeba dispar
EYKPIETKPSFGMLMRFTHNTKTSQI

SEQ ID NO: 2480724 - protein, 21 aa, Entamoeba dispar
EYLCAAWGQKVGSYYGRGTAQ

SEQ ID NO: 2480725 - protein, 21 aa, Entamoeba dispar
EYLDYRLENKLDQQGVNDVIN

SEQ ID NO: 2480726 - protein, 25 aa, Entamoeba dispar
EYLEKASVFKIDYKIELIVSSLLEE

SEQ ID NO: 2480727 - protein, 17 aa, Entamoeba dispar
EYLIPFCEFQKICEEHG

SEQ ID NO: 2480728 - protein, 19 aa, Entamoeba dispar
EYLIRAGVTNLTLYYPEMN

SEQ ID NO: 2480729 - protein, 17 aa, Entamoeba dispar
EYLKEVFGLNSEINSCV

SEQ ID NO: 2480730 - protein, 17 aa, Entamoeba dispar
EYLNTPITIKWKNEEKV

SEQ ID NO: 2480731 - protein, 18 aa, Entamoeba dispar
EYLRPCEVMQIFKELLEK

SEQ ID NO: 2480732 - protein, 17 aa, Entamoeba dispar
EYLTCAVITGSVMVIPR

SEQ ID NO: 2480733 - protein, 25 aa, Entamoeba dispar
EYLTIGIAIDCRRVDVIKEILRKTK

SEQ ID NO: 2480734 - protein, 27 aa, Entamoeba dispar
EYMKCSYCLNCGAFVCDNQECFINHKS

SEQ ID NO: 2480735 - protein, 17 aa, Entamoeba dispar
EYMKFEIFDNGELNYYN

SEQ ID NO: 2480736 - protein, 21 aa, Entamoeba dispar
EYMSRLLRACGYIYTTSAQME

SEQ ID NO: 2480737 - protein, 24 aa, Entamoeba dispar
EYMVNRLNVLLLQHIQKCLPGLKQ

SEQ ID NO: 2480738 - protein, 23 aa, Entamoeba dispar
EYMYCVNRIYNLLKRSHGNYFGD

SEQ ID NO: 2480739 - protein, 20 aa, Entamoeba dispar
EYNCFRREIELIKILIHPNI

SEQ ID NO: 2480740 - protein, 19 aa, Entamoeba dispar
EYNFYPQFCYVNNQVTVQG

SEQ ID NO: 2480741 - protein, 26 aa, Entamoeba dispar
EYNLLWWKNKVYVIDVGQSIELSHPQ

SEQ ID NO: 2480742 - protein, 26 aa, Entamoeba dispar
EYNLRPTKYLLMWLDFLIKDIESNLL

SEQ ID NO: 2480743 - protein, 26 aa, Entamoeba dispar
EYNLRPTKYLLMWLDFLIKDVDSNLM

SEQ ID NO: 2480744 - protein, 25 aa, Entamoeba dispar
EYNRCKRAKLKKSDFETIKVIGRGG

SEQ ID NO: 2480745 - protein, 22 aa, Entamoeba dispar
EYNRIRENGGYVINDRTNGILA

SEQ ID NO: 2480746 - protein, 23 aa, Entamoeba dispar
EYPFFKMIRNWINALGDLANILG

SEQ ID NO: 2480747 - protein, 25 aa, Entamoeba dispar
EYPKIYNILCAINYVLEISNDQIER

SEQ ID NO: 2480748 - protein, 17 aa, Entamoeba dispar
EYPRVYNINAWDETNND

SEQ ID NO: 2480749 - protein, 29 aa, Entamoeba dispar
EYPSLKRLVLRPIGWLSLSQLFIDKSHRI

SEQ ID NO: 2480750 - protein, 36 aa, Entamoeba dispar
EYQLSAEVGDIFYVEKIIGSWAIVIVDQERFIFPSS

SEQ ID NO: 2480751 - protein, 24 aa, Entamoeba dispar
EYQNALRLYIDWDKANLKEVPKTC

SEQ ID NO: 2480752 - protein, 26 aa, Entamoeba dispar
EYQNGIPCFWLHVLKNSGIFDGLSGN

SEQ ID NO: 2480753 - protein, 19 aa, Entamoeba dispar
EYQNRINLDHIRRTFEGII

SEQ ID NO: 2480754 - protein, 17 aa, Entamoeba dispar
EYRITDFGVDSIVMTQI

SEQ ID NO: 2480755 - protein, 22 aa, Entamoeba dispar
EYRMLYFNFKTRKIFFLRHAKV

SEQ ID NO: 2480756 - protein, 18 aa, Entamoeba dispar
EYSFLKCPFNEMIQTPPL

SEQ ID NO: 2480757 - protein, 20 aa, Entamoeba dispar
EYSKRILYEYIRKSERSIID

SEQ ID NO: 2480758 - protein, 33 aa, Entamoeba dispar
EYSLFKERIELMKTLFPIIKFDSISFFFRTWEV

SEQ ID NO: 2480759 - protein, 25 aa, Entamoeba dispar
EYSPILFKLVFRADLIVEYITIFNG

SEQ ID NO: 2480760 - protein, 21 aa, Entamoeba dispar
EYSQLTAPCFGKGEMIIPDSI

SEQ ID NO: 2480761 - protein, 27 aa, Entamoeba dispar
EYSVDIIACLLKCFLQKMPTHIIDTMK

SEQ ID NO: 2480762 - protein, 17 aa, Entamoeba dispar
EYTDCIQEFLAPLNLFD

SEQ ID NO: 2480763 - protein, 21 aa, Entamoeba dispar
EYTNTFAFNLCINMCDSINLI

SEQ ID NO: 2480764 - protein, 27 aa, Entamoeba dispar
EYVFLIDAGKIWLWFGSKALNETKKFS

SEQ ID NO: 2480765 - protein, 20 aa, Entamoeba dispar
EYVIKCGIQGLVIEGQRGKN

SEQ ID NO: 2480766 - protein, 19 aa, Entamoeba dispar
EYVKYIGIIDFQLTDYILL

SEQ ID NO: 2480767 - protein, 20 aa, Entamoeba dispar
EYVYRFLISSLHRIIISPND

SEQ ID NO: 2480768 - protein, 25 aa, Entamoeba dispar
EYVYRSSLRSGEFVEFMKNSYKRTP

SEQ ID NO: 2480769 - protein, 20 aa, Entamoeba dispar
EYYDGGSLFDLIGDLTQPIL

SEQ ID NO: 2480770 - protein, 32 aa, Entamoeba dispar
EYYETPSFYGRRVGTCFVKIVLQLSLPLTIII

SEQ ID NO: 2480771 - protein, 22 aa, Entamoeba dispar
EYYGESSHSIFVASQAGCIDNV

SEQ ID NO: 2480772 - protein, 23 aa, Entamoeba dispar
EYYKKADVVPAYYRVADKESGEP

SEQ ID NO: 2480773 - protein, 18 aa, Entamoeba dispar
EYYLVKWKDYSILECSWV

SEQ ID NO: 2480774 - protein, 20 aa, Entamoeba dispar
EYYMHLGCIEEWCVRTFNEG

SEQ ID NO: 2480775 - protein, 25 aa, Entamoeba dispar
EYYQGRGTLEIEYGKKLLGLTTYLN

SEQ ID NO: 2480776 - protein, 19 aa, Entamoeba dispar
FAACRAIENGCWVFCPNRI

SEQ ID NO: 2480777 - protein, 18 aa, Entamoeba dispar
FAAQSRSAYQMIFMNPYY

SEQ ID NO: 2480778 - protein, 17 aa, Entamoeba dispar
FACKLRYIIELDEIRND

SEQ ID NO: 2480779 - protein, 21 aa, Entamoeba dispar
FACSRGRRDLVELFLGKWKEG

SEQ ID NO: 2480780 - protein, 23 aa, Entamoeba dispar
FADCPIKPVFDDILIAELQPHQH

SEQ ID NO: 2480781 - protein, 27 aa, Entamoeba dispar
FADERIKSFKNILCEWSQKKDMKLIYD

SEQ ID NO: 2480782 - protein, 24 aa, Entamoeba dispar
FADMNNRVAMMMKFIEVANELESL

SEQ ID NO: 2480783 - protein, 20 aa, Entamoeba dispar
FADNKIKGIIFTLESMIGVE

SEQ ID NO: 2480784 - protein, 22 aa, Entamoeba dispar
FADSKLEKIIPCSPRPHCSIIN

SEQ ID NO: 2480785 - protein, 17 aa, Entamoeba dispar
FAEFLKTRCYEHFRYDI

SEQ ID NO: 2480786 - protein, 18 aa, Entamoeba dispar
FAEGKAKIIARAIEGEST

SEQ ID NO: 2480787 - protein, 18 aa, Entamoeba dispar
FAEIVMEFCDGGTLKSFK

SEQ ID NO: 2480788 - protein, 19 aa, Entamoeba dispar
FAFCARLKEVVLQGSLYTL

SEQ ID NO: 2480789 - protein, 17 aa, Entamoeba dispar
FAFCGCSSLRSVNIPCI

SEQ ID NO: 2480790 - protein, 18 aa, Entamoeba dispar
FAFMKALYTKGFPTPIPV

SEQ ID NO: 2480791 - protein, 25 aa, Entamoeba dispar
FAFSFSNPYGHGAIRYICDEPETTL

SEQ ID NO: 2480792 - protein, 22 aa, Entamoeba dispar
FAGHKEYTGWVIPDPLCLMCYL

SEQ ID NO: 2480793 - protein, 27 aa, Entamoeba dispar
FAGKVFPYNEFHVFESLFSLFENYLSI

SEQ ID NO: 2480794 - protein, 18 aa, Entamoeba dispar
FAGLIIISTELLYLEDNA

SEQ ID NO: 2480795 - protein, 18 aa, Entamoeba dispar
FAGLPSLSSICIPSSVTK

SEQ ID NO: 2480796 - protein, 18 aa, Entamoeba dispar
FAGSSKEVILRWRRGKKE

SEQ ID NO: 2480797 - protein, 24 aa, Entamoeba dispar
FAGTSEGVIFGWIKKQKKFELIFA

SEQ ID NO: 2480798 - protein, 17 aa, Entamoeba dispar
FAGVKGVLTVDRLDMTE

SEQ ID NO: 2480799 - protein, 17 aa, Entamoeba dispar
FAIDFIKEIIYKYIEEN

SEQ ID NO: 2480800 - protein, 27 aa, Entamoeba dispar
FAIPDEYRHLFFYLISFLKKLIEMGED

SEQ ID NO: 2480801 - protein, 20 aa, Entamoeba dispar
FAIPRSCLQKPIALKSAISV

SEQ ID NO: 2480802 - protein, 25 aa, Entamoeba dispar
FAIQRCDPAPFYLFDEIDSNLDTLY

SEQ ID NO: 2480803 - protein, 17 aa, Entamoeba dispar
FAIRHACDLIRKGELKV

SEQ ID NO: 2480804 - protein, 18 aa, Entamoeba dispar
FAISSSWDHTLRLWDLTK

SEQ ID NO: 2480805 - protein, 19 aa, Entamoeba dispar
FAIVSACCYAISLRYAGTL

SEQ ID NO: 2480806 - protein, 25 aa, Entamoeba dispar
FAKEIIFGSIFGFKCIGGINEEIAL

SEQ ID NO: 2480807 - protein, 19 aa, Entamoeba dispar
FAKGITSEMLINFLQPNLP

SEQ ID NO: 2480808 - protein, 19 aa, Entamoeba dispar
FAKLKGSTFTPFILEKSTS

SEQ ID NO: 2480809 - protein, 28 aa, Entamoeba dispar
FAKPTPTIARRVFNVLMGESMEIKKRER

SEQ ID NO: 2480810 - protein, 17 aa, Entamoeba dispar
FAKSSCRTFLRTTLKNV

SEQ ID NO: 2480811 - protein, 23 aa, Entamoeba dispar
FAKTNAVQLFIPFRPMLAKPKKS

SEQ ID NO: 2480812 - protein, 27 aa, Entamoeba dispar
FALDFLDGYALFMACSLCNHSCRENMG

SEQ ID NO: 2480813 - protein, 18 aa, Entamoeba dispar
FALIRNMTPPIIPRLNGR

SEQ ID NO: 2480814 - protein, 18 aa, Entamoeba dispar
FALKCLDAMDDAELIMFL

SEQ ID NO: 2480815 - protein, 21 aa, Entamoeba dispar
FALKKRKLKKLTHDQNTSCLE

SEQ ID NO: 2480816 - protein, 17 aa, Entamoeba dispar
FALLKSRMLGMLEEYNR

SEQ ID NO: 2480817 - protein, 18 aa, Entamoeba dispar
FALLSVCVPNGGKLESVS

SEQ ID NO: 2480818 - protein, 24 aa, Entamoeba dispar
FALRNLCILRDQIIPFTEVDVSLR

SEQ ID NO: 2480819 - protein, 23 aa, Entamoeba dispar
FALTSHIYFPFHVIVITETSLFI

SEQ ID NO: 2480820 - protein, 22 aa, Entamoeba dispar
FANDLKSIFYPFAQPCLEVVLK

SEQ ID NO: 2480821 - protein, 17 aa, Entamoeba dispar
FANHFGVGIAFIRKSRS

SEQ ID NO: 2480822 - protein, 25 aa, Entamoeba dispar
FAPKGKKLPIGFLGVYSNAHENQRI

SEQ ID NO: 2480823 - protein, 25 aa, Entamoeba dispar
FAPKILCVELAHLDVPLSLEKSIIV

SEQ ID NO: 2480824 - protein, 17 aa, Entamoeba dispar
FAPMLDVFGKLEDKNYF

SEQ ID NO: 2480825 - protein, 17 aa, Entamoeba dispar
FAPPPVKPFINYTNPFL

SEQ ID NO: 2480826 - protein, 21 aa, Entamoeba dispar
FAPSACNYRPIKFMVINRPKL

SEQ ID NO: 2480827 - protein, 17 aa, Entamoeba dispar
FAPVHSVLPPQRVGVTP

SEQ ID NO: 2480828 - protein, 23 aa, Entamoeba dispar
FAQDAINDMVHWIDDISAVIESI

SEQ ID NO: 2480829 - protein, 18 aa, Entamoeba dispar
FAQMREGIQWVIQNKDIS

SEQ ID NO: 2480830 - protein, 17 aa, Entamoeba dispar
FARGCSSDELGIMCKNF

SEQ ID NO: 2480831 - protein, 19 aa, Entamoeba dispar
FARILNYYKPNIIAYNTLT

SEQ ID NO: 2480832 - protein, 26 aa, Entamoeba dispar
FARPTECLPKVLPFPGHIETKGTVQF

SEQ ID NO: 2480833 - protein, 17 aa, Entamoeba dispar
FASHYYLADSFNHNSDI

SEQ ID NO: 2480834 - protein, 25 aa, Entamoeba dispar
FASLKSIFPICKFQYAIAQLLGIGT

SEQ ID NO: 2480835 - protein, 26 aa, Entamoeba dispar
FASYSMLNRVVELWKQQGVYTQLNKL

SEQ ID NO: 2480836 - protein, 20 aa, Entamoeba dispar
FATDELKHWTGSKLEIASQL

SEQ ID NO: 2480837 - protein, 25 aa, Entamoeba dispar
FATETCFYFIMDYCSGGDFYHTLKE

SEQ ID NO: 2480838 - protein, 22 aa, Entamoeba dispar
FATYLDICKKLGFDQTPDYLQL

SEQ ID NO: 2480839 - protein, 29 aa, Entamoeba dispar
FAVASCYERSVIFIDEIDSLLSARSESEH

SEQ ID NO: 2480840 - protein, 26 aa, Entamoeba dispar
FAVEACKIGLEFQKKVFCVLGGYGLF

SEQ ID NO: 2480841 - protein, 25 aa, Entamoeba dispar
FAVFCIADGCGMGKRPAVSAHVACE

SEQ ID NO: 2480842 - protein, 24 aa, Entamoeba dispar
FAVLKGMCDGGVYVPHSATRFAGA

SEQ ID NO: 2480843 - protein, 23 aa, Entamoeba dispar
FAYPENKLYFFIAASLLVQHKEI

SEQ ID NO: 2480844 - protein, 28 aa, Entamoeba dispar
FCAKHIQPRCCYECLISLECLKNAKCPL

SEQ ID NO: 2480845 - protein, 23 aa, Entamoeba dispar
FCDDKRIPVCKINNSDNNFHRVK

SEQ ID NO: 2480846 - protein, 17 aa, Entamoeba dispar
FCDGGTLQSFFEKSYPV

SEQ ID NO: 2480847 - protein, 22 aa, Entamoeba dispar
FCDMDPQSAFQFNFFCEEKSIC

SEQ ID NO: 2480848 - protein, 19 aa, Entamoeba dispar
FCDNINFTNCKINSMRCDV

SEQ ID NO: 2480849 - protein, 21 aa, Entamoeba dispar
FCDSLCIIYLFFPNIKENQIQ

SEQ ID NO: 2480850 - protein, 23 aa, Entamoeba dispar
FCEAAIKFAPTFKIKIGKQGIYE

SEQ ID NO: 2480851 - protein, 19 aa, Entamoeba dispar
FCEDCVRAYHVLRQNASLI

SEQ ID NO: 2480852 - protein, 18 aa, Entamoeba dispar
FCEFKTSVAVLINQSTLY

SEQ ID NO: 2480853 - protein, 17 aa, Entamoeba dispar
FCEKGNETFKIIVQIGR

SEQ ID NO: 2480854 - protein, 25 aa, Entamoeba dispar
FCENIKRYAVETARSTKSFATGNRY

SEQ ID NO: 2480855 - protein, 26 aa, Entamoeba dispar
FCEPPSKGIICDLLWSDPITEEFLNE

SEQ ID NO: 2480856 - protein, 26 aa, Entamoeba dispar
FCETKPTECLGCFFTGITNVDSSSSN

SEQ ID NO: 2480857 - protein, 18 aa, Entamoeba dispar
FCFEGCSSLTSITIPPLV

SEQ ID NO: 2480858 - protein, 17 aa, Entamoeba dispar
FCFKDCINLQSIVIPSS

SEQ ID NO: 2480859 - protein, 27 aa, Entamoeba dispar
FCFLKYKDPRSCVLAIDNFNGIELNGR

SEQ ID NO: 2480860 - protein, 17 aa, Entamoeba dispar
FCFSEGETLLTQRNLLF

SEQ ID NO: 2480861 - protein, 19 aa, Entamoeba dispar
FCFYSCALLKSINIPTRVT

SEQ ID NO: 2480862 - protein, 17 aa, Entamoeba dispar
FCGCSSLTYINIPSSIN

SEQ ID NO: 2480863 - protein, 25 aa, Entamoeba dispar
FCGIPPEWENMFIALGITKEEIKSN

SEQ ID NO: 2480864 - protein, 23 aa, Entamoeba dispar
FCGRAECIEVFSALNEFSKIGEI

SEQ ID NO: 2480865 - protein, 18 aa, Entamoeba dispar
FCGRYLYVQFGYQVISNL

SEQ ID NO: 2480866 - protein, 23 aa, Entamoeba dispar
FCGTPDYLAPEILTAKGYGIEVD

SEQ ID NO: 2480867 - protein, 25 aa, Entamoeba dispar
FCGTPEYLAPEILLGNGYGFAVDWW

SEQ ID NO: 2480868 - protein, 22 aa, Entamoeba dispar
FCGTPEYLAPEVVIGKDYSEPV

SEQ ID NO: 2480869 - protein, 22 aa, Entamoeba dispar
FCGTPEYLAPEVVKGLDYNEYI

SEQ ID NO: 2480870 - protein, 21 aa, Entamoeba dispar
FCHECQIPIIGLVENMSGYLC

SEQ ID NO: 2480871 - protein, 20 aa, Entamoeba dispar
FCHFICKNFIERLILMNSNE

SEQ ID NO: 2480872 - protein, 25 aa, Entamoeba dispar
FCHIPSIRVIPNWNDSISMYASDGD

SEQ ID NO: 2480873 - protein, 21 aa, Entamoeba dispar
FCKEKKKQIEIRIMYNVENNC

SEQ ID NO: 2480874 - protein, 18 aa, Entamoeba dispar
FCKMFVVHYDRLVFNNLM

SEQ ID NO: 2480875 - protein, 18 aa, Entamoeba dispar
FCLHLGEGHWHNERLREF

SEQ ID NO: 2480876 - protein, 18 aa, Entamoeba dispar
FCNCKELTRIDIPTTVSE

SEQ ID NO: 2480877 - protein, 20 aa, Entamoeba dispar
FCNKQGLNMSSVRFLSDGVR

SEQ ID NO: 2480878 - protein, 25 aa, Entamoeba dispar
FCPLLTTVELRMCVNVTDSGIQMLL

SEQ ID NO: 2480879 - protein, 23 aa, Entamoeba dispar
FCPNPQCGRAIIVLSSERASDNI

SEQ ID NO: 2480880 - protein, 23 aa, Entamoeba dispar
FCPSGLPRNEFTSLTQLTGLTIT

SEQ ID NO: 2480881 - protein, 17 aa, Entamoeba dispar
FCPYNFQVSSKMTADPR

SEQ ID NO: 2480882 - protein, 25 aa, Entamoeba dispar
FCQSLCLLSKMFLDHKTLYYDVEPF

SEQ ID NO: 2480883 - protein, 20 aa, Entamoeba dispar
FCQTEIMVLVVTKVDQKEGR

SEQ ID NO: 2480884 - protein, 19 aa, Entamoeba dispar
FCSCFYDDKILFLGDKNGR

SEQ ID NO: 2480885 - protein, 22 aa, Entamoeba dispar
FCSDLIKGCSRFNINTTIGNIF

SEQ ID NO: 2480886 - protein, 17 aa, Entamoeba dispar
FCSGGTLKSMLKPRNQG

SEQ ID NO: 2480887 - protein, 29 aa, Entamoeba dispar
FCSKIRKLRISIDFCMKFQLKHPEYFTQL

SEQ ID NO: 2480888 - protein, 26 aa, Entamoeba dispar
FCSKIRKLRMEGYYCKKVIEKHPEYF

SEQ ID NO: 2480889 - protein, 21 aa, Entamoeba dispar
FCSSLRRINIPTSISSFGKSC

SEQ ID NO: 2480890 - protein, 22 aa, Entamoeba dispar
FCTASIKTHCFGVDSDKLISNP

SEQ ID NO: 2480891 - protein, 30 aa, Entamoeba dispar
FCTEEEPTFACPFCGTDMGNSSKLQKHVSQ

SEQ ID NO: 2480892 - protein, 18 aa, Entamoeba dispar
FCTPDFRVALQHSDVVTD

SEQ ID NO: 2480893 - protein, 21 aa, Entamoeba dispar
FCTSPLITVIIPIAYHQEIEV

SEQ ID NO: 2480894 - protein, 17 aa, Entamoeba dispar
FCVGRYCDWIHNYAPTF

SEQ ID NO: 2480895 - protein, 17 aa, Entamoeba dispar
FCVHGGLSPDLITIQTI

SEQ ID NO: 2480896 - protein, 24 aa, Entamoeba dispar
FCVTRGRLSEGINFTNHLARAVLI

SEQ ID NO: 2480897 - protein, 19 aa, Entamoeba dispar
FCVYAKMAYVNIFKSSQKC

SEQ ID NO: 2480898 - protein, 20 aa, Entamoeba dispar
FCYAMIIFGIIVIRDDMLDN

SEQ ID NO: 2480899 - protein, 17 aa, Entamoeba dispar
FCYIGDSPIYIKSNKQV

SEQ ID NO: 2480900 - protein, 21 aa, Entamoeba dispar
FCYSACSVFTKGLKEWGSAIL

SEQ ID NO: 2480901 - protein, 19 aa, Entamoeba dispar
FDAARDWMTLFSKIATHIL

SEQ ID NO: 2480902 - protein, 18 aa, Entamoeba dispar
FDAEFPLTLEPKIEKLTF

SEQ ID NO: 2480903 - protein, 23 aa, Entamoeba dispar
FDAEKYTGAGYVQWATCVTDLFK

SEQ ID NO: 2480904 - protein, 17 aa, Entamoeba dispar
FDAIERWMNELKNGCDS

SEQ ID NO: 2480905 - protein, 17 aa, Entamoeba dispar
FDALPLAALVEGNSLGR

SEQ ID NO: 2480906 - protein, 19 aa, Entamoeba dispar
FDAVKMLRINPGLKPQNMI

SEQ ID NO: 2480907 - protein, 19 aa, Entamoeba dispar
FDCFKGCKSLKSITIDKLQ

SEQ ID NO: 2480908 - protein, 30 aa, Entamoeba dispar
FDCPYSERLFKWFIKRNEIIKKQNKKGGEY

SEQ ID NO: 2480909 - protein, 19 aa, Entamoeba dispar
FDCSVSLKQIGRIRGHKVA

SEQ ID NO: 2480910 - protein, 26 aa, Entamoeba dispar
FDDANLAAMDWFEFKAIVSTNGEKIT

SEQ ID NO: 2480911 - protein, 23 aa, Entamoeba dispar
FDDDRLIPTYGFGDVTTTNKSLF

SEQ ID NO: 2480912 - protein, 28 aa, Entamoeba dispar
FDDIHMIPFLWIQLTFGCDGCIGYYERP

SEQ ID NO: 2480913 - protein, 26 aa, Entamoeba dispar
FDDMKWKLEILLILKVKNDTFDSNDI

SEQ ID NO: 2480914 - protein, 25 aa, Entamoeba dispar
FDDRRVFKYVIWYLVSYSEYLKKKE

SEQ ID NO: 2480915 - protein, 18 aa, Entamoeba dispar
FDDRSCVDLKDKWRNIEN

SEQ ID NO: 2480916 - protein, 18 aa, Entamoeba dispar
FDDRSCVDLKDKWRNLEF

SEQ ID NO: 2480917 - protein, 20 aa, Entamoeba dispar
FDDTDTFLLPKGITVLSEII

SEQ ID NO: 2480918 - protein, 24 aa, Entamoeba dispar
FDEALRLLQHYPLKNFNDLDLNAK

SEQ ID NO: 2480919 - protein, 27 aa, Entamoeba dispar
FDEDLIKHCIKPMIHDGDYVNGIEYLY

SEQ ID NO: 2480920 - protein, 17 aa, Entamoeba dispar
FDEEFPLTLEPKIEKLT

SEQ ID NO: 2480921 - protein, 17 aa, Entamoeba dispar
FDEFSKLVSCQNIGELS

SEQ ID NO: 2480922 - protein, 17 aa, Entamoeba dispar
FDEKELQHFVQIMNENG

SEQ ID NO: 2480923 - protein, 22 aa, Entamoeba dispar
FDELFKFILKCLSVYKNQKMIT

SEQ ID NO: 2480924 - protein, 22 aa, Entamoeba dispar
FDELIEILKGFDLSNVKQSHKL

SEQ ID NO: 2480925 - protein, 19 aa, Entamoeba dispar
FDENVEINKFIKPPEFTQN

SEQ ID NO: 2480926 - protein, 18 aa, Entamoeba dispar
FDEPFGIDIEKTMEEFEK

SEQ ID NO: 2480927 - protein, 19 aa, Entamoeba dispar
FDEPFGIDIEKTMEEFEKK

SEQ ID NO: 2480928 - protein, 24 aa, Entamoeba dispar
FDEPRLMCMYVDKVLSGSHAVQTL

SEQ ID NO: 2480929 - protein, 19 aa, Entamoeba dispar
FDEQWKLCIYNKTLEYALR

SEQ ID NO: 2480930 - protein, 17 aa, Entamoeba dispar
FDFDPYYLYSVYNPIIY

SEQ ID NO: 2480931 - protein, 19 aa, Entamoeba dispar
FDFIFKIIISSIECKNKEA

SEQ ID NO: 2480932 - protein, 26 aa, Entamoeba dispar
FDFIKKSFDGDGLFYLADSNEELNTN

SEQ ID NO: 2480933 - protein, 24 aa, Entamoeba dispar
FDFKYLLERAKVLKVKDFSSFSKL

SEQ ID NO: 2480934 - protein, 21 aa, Entamoeba dispar
FDFPYATFNWHKKAITSVEWC

SEQ ID NO: 2480935 - protein, 23 aa, Entamoeba dispar
FDFRPSDLPSIIFPDTSKFIIKS

SEQ ID NO: 2480936 - protein, 18 aa, Entamoeba dispar
FDFSDMFINRCYNVETVC

SEQ ID NO: 2480937 - protein, 24 aa, Entamoeba dispar
FDFVPSTIMYLEFKERETPLPKHI

SEQ ID NO: 2480938 - protein, 18 aa, Entamoeba dispar
FDGAGQRPLFSLRTLCLA

SEQ ID NO: 2480939 - protein, 17 aa, Entamoeba dispar
FDGFVFVDGRSHKEINN

SEQ ID NO: 2480940 - protein, 18 aa, Entamoeba dispar
FDGKIKFFNGNFEFDGKF

SEQ ID NO: 2480941 - protein, 17 aa, Entamoeba dispar
FDGLKIGVSPYHYQLVN

SEQ ID NO: 2480942 - protein, 18 aa, Entamoeba dispar
FDGVPLILENSFRFIEKV

SEQ ID NO: 2480943 - protein, 20 aa, Entamoeba dispar
FDGYGNVIGFEIEGMNKLNY

SEQ ID NO: 2480944 - protein, 18 aa, Entamoeba dispar
FDHFKNSFSMIMGTIVSK

SEQ ID NO: 2480945 - protein, 26 aa, Entamoeba dispar
FDHFPLLYKACLDFDGVSFDFSDMFI

SEQ ID NO: 2480946 - protein, 17 aa, Entamoeba dispar
FDHGLIYMKHRPYPDHR

SEQ ID NO: 2480947 - protein, 17 aa, Entamoeba dispar
FDHKKFDIFKFTRQVAT

SEQ ID NO: 2480948 - protein, 18 aa, Entamoeba dispar
FDIEFVCRMVHSHEVMEF

SEQ ID NO: 2480949 - protein, 25 aa, Entamoeba dispar
FDIEIGDDCFWGCPDNLKKNKVLRE

SEQ ID NO: 2480950 - protein, 20 aa, Entamoeba dispar
FDIEYHRYLLSRAFTKIICK

SEQ ID NO: 2480951 - protein, 17 aa, Entamoeba dispar
FDIFIETLIKWIINSKD

SEQ ID NO: 2480952 - protein, 19 aa, Entamoeba dispar
FDIFLEKYLDGLSNNALYK

SEQ ID NO: 2480953 - protein, 20 aa, Entamoeba dispar
FDIIKEWSYEVFFNTNGTSN

SEQ ID NO: 2480954 - protein, 19 aa, Entamoeba dispar
FDIIQWLFFGIPFTKDTII

SEQ ID NO: 2480955 - protein, 20 aa, Entamoeba dispar
FDIKDPQYAFGLYNQLDGGL

SEQ ID NO: 2480956 - protein, 17 aa, Entamoeba dispar
FDIKIIRQIKEAFETKV

SEQ ID NO: 2480957 - protein, 24 aa, Entamoeba dispar
FDIKKCCFSYCNETAIGTLKFIHP

SEQ ID NO: 2480958 - protein, 20 aa, Entamoeba dispar
FDIKTFVWKQHPVVLEDFQD

SEQ ID NO: 2480959 - protein, 22 aa, Entamoeba dispar
FDIPQCMGMIGGKPGYAHYFHT

SEQ ID NO: 2480960 - protein, 20 aa, Entamoeba dispar
FDIYIRKLNESWNNAITNAS

SEQ ID NO: 2480961 - protein, 24 aa, Entamoeba dispar
FDKAQRIELFISFYNESVKPELKK

SEQ ID NO: 2480962 - protein, 23 aa, Entamoeba dispar
FDKAYGCCGFPICESKSFKPSYI

SEQ ID NO: 2480963 - protein, 25 aa, Entamoeba dispar
FDKCKKLCIDECENCQFIIDKNQIK

SEQ ID NO: 2480964 - protein, 25 aa, Entamoeba dispar
FDKCKKLCIDECENCQFIINKNQIK

SEQ ID NO: 2480965 - protein, 26 aa, Entamoeba dispar
FDKCKKMCSVVRNFDKINSIPYVISH

SEQ ID NO: 2480966 - protein, 20 aa, Entamoeba dispar
FDKCKVDALNLPKEVNHITL

SEQ ID NO: 2480967 - protein, 20 aa, Entamoeba dispar
FDKELFRLKFFFKRDFQEID

SEQ ID NO: 2480968 - protein, 18 aa, Entamoeba dispar
FDKLDLSNIISIKDLSLY

SEQ ID NO: 2480969 - protein, 23 aa, Entamoeba dispar
FDKLNCKWSDFMKRVISGKRDDC

SEQ ID NO: 2480970 - protein, 18 aa, Entamoeba dispar
FDKYCNRLRRIINERYSN

SEQ ID NO: 2480971 - protein, 19 aa, Entamoeba dispar
FDKYLREITLNKGMVKMSL

SEQ ID NO: 2480972 - protein, 19 aa, Entamoeba dispar
FDLFRRFNIATSKKEIQSV

SEQ ID NO: 2480973 - protein, 19 aa, Entamoeba dispar
FDLIVRFVEMLGMPSDEII

SEQ ID NO: 2480974 - protein, 23 aa, Entamoeba dispar
FDLKDHTIHFGAYKNQWFNITPQ

SEQ ID NO: 2480975 - protein, 18 aa, Entamoeba dispar
FDLKFKYDSIKDSLIVTP

SEQ ID NO: 2480976 - protein, 24 aa, Entamoeba dispar
FDLKIKIMEDIVVGLAFLHENQII

SEQ ID NO: 2480977 - protein, 26 aa, Entamoeba dispar
FDLKKELSEGILFAKLINYLQNDLIN

SEQ ID NO: 2480978 - protein, 25 aa, Entamoeba dispar
FDLKKELSEGVLLAKLLNYLQKDII

SEQ ID NO: 2480979 - protein, 18 aa, Entamoeba dispar
FDLLPPGVKLLARIFNEY

SEQ ID NO: 2480980 - protein, 17 aa, Entamoeba dispar
FDLPQQFKQASVQHYFI

SEQ ID NO: 2480981 - protein, 20 aa, Entamoeba dispar
FDLTAICFVAPSSNARLTAN

SEQ ID NO: 2480982 - protein, 18 aa, Entamoeba dispar
FDLVESLKYYESALKLLP

SEQ ID NO: 2480983 - protein, 18 aa, Entamoeba dispar
FDLVKDLSQLTCILNNGN

SEQ ID NO: 2480984 - protein, 22 aa, Entamoeba dispar
FDLYIFEYYLMIQLYSITKDDL

SEQ ID NO: 2480985 - protein, 31 aa, Entamoeba dispar
FDMCSTSLALLWVFYIRQSFIGSYDHEETHL

SEQ ID NO: 2480986 - protein, 17 aa, Entamoeba dispar
FDMDLTHTLPILVDLIL

SEQ ID NO: 2480987 - protein, 21 aa, Entamoeba dispar
FDMGFGPQIKRIIEGIRPDKQ

SEQ ID NO: 2480988 - protein, 19 aa, Entamoeba dispar
FDMKEVYEHESLRNNKIYK

SEQ ID NO: 2480989 - protein, 29 aa, Entamoeba dispar
FDMTKMFCPKCGYHDLRRISYYVLANGLI

SEQ ID NO: 2480990 - protein, 23 aa, Entamoeba dispar
FDNCFFNEIEVFKRCKLIRNPLF

SEQ ID NO: 2480991 - protein, 24 aa, Entamoeba dispar
FDNEELKELIGVGIGIHHAGMNKE

SEQ ID NO: 2480992 - protein, 23 aa, Entamoeba dispar
FDNEIRLTALWLLANLLGLAPSL

SEQ ID NO: 2480993 - protein, 19 aa, Entamoeba dispar
FDNGEYFTYLKLFKEAIPK

SEQ ID NO: 2480994 - protein, 25 aa, Entamoeba dispar
FDNGEYRWAATILNHLVFANPSNEE

SEQ ID NO: 2480995 - protein, 25 aa, Entamoeba dispar
FDNHKKTLLSICEYLIDSGINCELY

SEQ ID NO: 2480996 - protein, 27 aa, Entamoeba dispar
FDNIDAFWLQRIIKGVVEDDNTAQEYA

SEQ ID NO: 2480997 - protein, 20 aa, Entamoeba dispar
FDNKFSKYTLERVPKEFANV

SEQ ID NO: 2480998 - protein, 22 aa, Entamoeba dispar
FDNKSSILLHSIFNHPKNNFLS

SEQ ID NO: 2480999 - protein, 18 aa, Entamoeba dispar
FDNSDGFFHGYDYSEDLR

SEQ ID NO: 2481000 - protein, 26 aa, Entamoeba dispar
FDNSSHWIKIDWNDIVCILKRRYLLQ

SEQ ID NO: 2481001 - protein, 23 aa, Entamoeba dispar
FDNYKRMCECFKDVEDGVEEGTY

SEQ ID NO: 2481002 - protein, 24 aa, Entamoeba dispar
FDPMRRTGQFYGRGEYFGKTADIS

SEQ ID NO: 2481003 - protein, 18 aa, Entamoeba dispar
FDPRQYLGPARQALKELY

SEQ ID NO: 2481004 - protein, 22 aa, Entamoeba dispar
FDPRYDPRFERFDLRYDPRYDR

SEQ ID NO: 2481005 - protein, 23 aa, Entamoeba dispar
FDPRYDPRFERFDLRYDPRYDRY

SEQ ID NO: 2481006 - protein, 17 aa, Entamoeba dispar
FDPSLESCYLKIQKEKQ

SEQ ID NO: 2481007 - protein, 18 aa, Entamoeba dispar
FDPSLPRSGSLSPKPGSR

SEQ ID NO: 2481008 - protein, 17 aa, Entamoeba dispar
FDQFKGVLPQLVELMCD

SEQ ID NO: 2481009 - protein, 26 aa, Entamoeba dispar
FDQLVLQICILFLCPFNQNVIQISQL

SEQ ID NO: 2481010 - protein, 17 aa, Entamoeba dispar
FDQLYRATIGVDFAVKF

SEQ ID NO: 2481011 - protein, 21 aa, Entamoeba dispar
FDQMRVTKVFINIFVEDLLRE

SEQ ID NO: 2481012 - protein, 17 aa, Entamoeba dispar
FDREPIRSFGRIKKITA

SEQ ID NO: 2481013 - protein, 17 aa, Entamoeba dispar
FDRHWSLTSINIENLQF

SEQ ID NO: 2481014 - protein, 21 aa, Entamoeba dispar
FDRLEPFFDGILVSMKSFSLT

SEQ ID NO: 2481015 - protein, 27 aa, Entamoeba dispar
FDRLKRLRPLLEISVKKVDSNICIVEK

SEQ ID NO: 2481016 - protein, 24 aa, Entamoeba dispar
  misc_feature (19)..(21): Xaa can be any naturally occurring amino acid
FDRTDELFLRRGRITSHVXXXWYN

SEQ ID NO: 2481017 - protein, 18 aa, Entamoeba dispar
FDSFIKFLPHNMKHRLLQ

SEQ ID NO: 2481018 - protein, 21 aa, Entamoeba dispar
FDSFIRWQFLKLKEMGKIQFG

SEQ ID NO: 2481019 - protein, 19 aa, Entamoeba dispar
FDSISFFFRTWEVEENGTY

SEQ ID NO: 2481020 - protein, 18 aa, Entamoeba dispar
FDSKRIQLIPTLNGCLLL

SEQ ID NO: 2481021 - protein, 20 aa, Entamoeba dispar
FDSLGSVFGGYMNKPIQTTD

SEQ ID NO: 2481022 - protein, 23 aa, Entamoeba dispar
FDSLVCIMQIFLTSPIYRLKNTI

SEQ ID NO: 2481023 - protein, 20 aa, Entamoeba dispar
FDSLWLSPYANFNFQSFSMN

SEQ ID NO: 2481024 - protein, 27 aa, Entamoeba dispar
FDSQQYPGYNVPQGMQQYGQMNGVPRF

SEQ ID NO: 2481025 - protein, 18 aa, Entamoeba dispar
FDSWEHGKLFLTNYRIKF

SEQ ID NO: 2481026 - protein, 20 aa, Entamoeba dispar
FDTCSLLKSILLPSTISELH

SEQ ID NO: 2481027 - protein, 19 aa, Entamoeba dispar
FDTLIGEGLNESFYLVTSL

SEQ ID NO: 2481028 - protein, 18 aa, Entamoeba dispar
FDVAVGFNKRTEYRMLWF

SEQ ID NO: 2481029 - protein, 19 aa, Entamoeba dispar
FDVCHLNCIPNICECEEDI

SEQ ID NO: 2481030 - protein, 18 aa, Entamoeba dispar
FDVFKLCRSHNCHNCLTK

SEQ ID NO: 2481031 - protein, 23 aa, Entamoeba dispar
FDVKCNLLTLLNFFVKTGHFNDQ

SEQ ID NO: 2481032 - protein, 19 aa, Entamoeba dispar
FDVLCSFNDNYKALRTEIS

SEQ ID NO: 2481033 - protein, 19 aa, Entamoeba dispar
FDVLFDIVVDLSKTNISEN

SEQ ID NO: 2481034 - protein, 19 aa, Entamoeba dispar
FDVPLTCPIGLNRIENPVR

SEQ ID NO: 2481035 - protein, 18 aa, Entamoeba dispar
FDVPRVSIRPSLQPPLRQ

SEQ ID NO: 2481036 - protein, 18 aa, Entamoeba dispar
FDVQIYVYSIKFGDKRYL

SEQ ID NO: 2481037 - protein, 26 aa, Entamoeba dispar
FDVSLKYPLHPNAMYSLISVRGKQQQ

SEQ ID NO: 2481038 - protein, 25 aa, Entamoeba dispar
FDVVDCPLRQLYKILQYLGTIESNL

SEQ ID NO: 2481039 - protein, 23 aa, Entamoeba dispar
FDVVKGWELIDYILKFQPSLYQS

SEQ ID NO: 2481040 - protein, 27 aa, Entamoeba dispar
FDWSKCMGCGICATKCTFGVLVKQPPK

SEQ ID NO: 2481041 - protein, 17 aa, Entamoeba dispar
FDYCISALTIFENMISF

SEQ ID NO: 2481042 - protein, 17 aa, Entamoeba dispar
FDYFVPYNLKDFYEDAT

SEQ ID NO: 2481043 - protein, 18 aa, Entamoeba dispar
FDYGDARVGIVGMSGVGK

SEQ ID NO: 2481044 - protein, 18 aa, Entamoeba dispar
FDYILCSKLDGMKDMQTI

SEQ ID NO: 2481045 - protein, 17 aa, Entamoeba dispar
FDYKKHINYIVPIQGDV

SEQ ID NO: 2481046 - protein, 25 aa, Entamoeba dispar
FDYRLAMSCPDLWVEYLKTKKDEEW

SEQ ID NO: 2481047 - protein, 27 aa, Entamoeba dispar
FEAIDRGRYYVMYTRIKGMRDEDIDVH

SEQ ID NO: 2481048 - protein, 18 aa, Entamoeba dispar
FEALFKPGCALKVREGKL

SEQ ID NO: 2481049 - protein, 18 aa, Entamoeba dispar
FEASIHWMNFARYNELND

SEQ ID NO: 2481050 - protein, 24 aa, Entamoeba dispar
FECFSTFVRKGVVFIAAVDTKKKS

SEQ ID NO: 2481051 - protein, 23 aa, Entamoeba dispar
FEDCKGSALGYIVCDVDHLTYIT

SEQ ID NO: 2481052 - protein, 17 aa, Entamoeba dispar
FEDCNQKEFDRCMKCVD

SEQ ID NO: 2481053 - protein, 17 aa, Entamoeba dispar
FEDEEGICTISKDKIPS

SEQ ID NO: 2481054 - protein, 18 aa, Entamoeba dispar
FEDEYCVGRCEDNEKKPK

SEQ ID NO: 2481055 - protein, 19 aa, Entamoeba dispar
FEDIRYCRMEKLRAGLRTI

SEQ ID NO: 2481056 - protein, 17 aa, Entamoeba dispar
FEDKWNIVKSIFFNSKV

SEQ ID NO: 2481057 - protein, 20 aa, Entamoeba dispar
FEDNAEYGFGMFKANEQRRL

SEQ ID NO: 2481058 - protein, 26 aa, Entamoeba dispar
FEDNCARAALHGIDFSKDKITFYGIH

SEQ ID NO: 2481059 - protein, 17 aa, Entamoeba dispar
FEEANRKTNFSFRYSMP

SEQ ID NO: 2481060 - protein, 18 aa, Entamoeba dispar
FEEARIFINNRIDVDDIY

SEQ ID NO: 2481061 - protein, 17 aa, Entamoeba dispar
FEECFYNFFNKIKTNKT

SEQ ID NO: 2481062 - protein, 17 aa, Entamoeba dispar
FEEEICKTLLNDVPVCF

SEQ ID NO: 2481063 - protein, 25 aa, Entamoeba dispar
FEEEMPMHIDIRWLFTDSYFQKTTL

SEQ ID NO: 2481064 - protein, 24 aa, Entamoeba dispar
FEEEVYGPICVELNVAKDEYTNFV

SEQ ID NO: 2481065 - protein, 22 aa, Entamoeba dispar
FEEFDPHYNIIIGRNGTGKSNF

SEQ ID NO: 2481066 - protein, 25 aa, Entamoeba dispar
FEEGRKLILEQGITKNLIEGFKKNR

SEQ ID NO: 2481067 - protein, 18 aa, Entamoeba dispar
FEEICMNAFIIIRKHGPL

SEQ ID NO: 2481068 - protein, 25 aa, Entamoeba dispar
FEEIRISDEFRCFVVHRELIIISQR

SEQ ID NO: 2481069 - protein, 19 aa, Entamoeba dispar
FEEIYTCLNNMMLEQKVIG

SEQ ID NO: 2481070 - protein, 20 aa, Entamoeba dispar
FEEKRLYSTVFVIMNNLENS

SEQ ID NO: 2481071 - protein, 35 aa, Entamoeba dispar
FEEKYKSIICELYFELHPIFIKSCTLNKVKSLGEL

SEQ ID NO: 2481072 - protein, 23 aa, Entamoeba dispar
FEELKTFVGVFYGRYATLEQKVQ

SEQ ID NO: 2481073 - protein, 26 aa, Entamoeba dispar
FEELNLYCCCSLLEIFSNTILQKDFT

SEQ ID NO: 2481074 - protein, 25 aa, Entamoeba dispar
FEERDERLALLKLFLPEPVLSTSII

SEQ ID NO: 2481075 - protein, 17 aa, Entamoeba dispar
FEERGDVKLSHMGCTIQ

SEQ ID NO: 2481076 - protein, 25 aa, Entamoeba dispar
FEESPMRIQFCKYSIPNNYYSKKVT

SEQ ID NO: 2481077 - protein, 36 aa, Entamoeba dispar
FEETLKEIARYCNMYQFFGYECKEDKVIVTNALSQI

SEQ ID NO: 2481078 - protein, 25 aa, Entamoeba dispar
FEEYQRFHLIPSLVHKNYYQLFNLV

SEQ ID NO: 2481079 - protein, 17 aa, Entamoeba dispar
FEFANISLISKRLSELS

SEQ ID NO: 2481080 - protein, 17 aa, Entamoeba dispar
FEFCVYAIQFGQWETTR

SEQ ID NO: 2481081 - protein, 17 aa, Entamoeba dispar
FEFGARLLDCVVIAIHH

SEQ ID NO: 2481082 - protein, 17 aa, Entamoeba dispar
FEFKDKCSFDELSQDKK

SEQ ID NO: 2481083 - protein, 25 aa, Entamoeba dispar
FEFKSMSAVDAFKLVQCKNKDNTVS

SEQ ID NO: 2481084 - protein, 17 aa, Entamoeba dispar
FEFRRPERFAIKTIQYL

SEQ ID NO: 2481085 - protein, 17 aa, Entamoeba dispar
FEGCPTLTSINIPSSIT

SEQ ID NO: 2481086 - protein, 30 aa, Entamoeba dispar
FEGITPILLTWDFPTPRVLPLIDSLKKAVS

SEQ ID NO: 2481087 - protein, 21 aa, Entamoeba dispar
FEGLKRGKYCVRVFLDNTKTE

SEQ ID NO: 2481088 - protein, 18 aa, Entamoeba dispar
FEGSREWFVQKIMKVVEF

SEQ ID NO: 2481089 - protein, 31 aa, Entamoeba dispar
FEGTIKMGLTFPHGRYVMKWFEEDTHKHSTP

SEQ ID NO: 2481090 - protein, 18 aa, Entamoeba dispar
FEHFILIEIFTQMGAPLK

SEQ ID NO: 2481091 - protein, 23 aa, Entamoeba dispar
FEHICAHKDIYLALPNEPVNGEN

SEQ ID NO: 2481092 - protein, 18 aa, Entamoeba dispar
FEHIFDWEFEIKQIAPEA

SEQ ID NO: 2481093 - protein, 23 aa, Entamoeba dispar
FEHLEVWRKEFISGGNPSDPESF

SEQ ID NO: 2481094 - protein, 17 aa, Entamoeba dispar
FEHPKGMFVLPFEIPKS

SEQ ID NO: 2481095 - protein, 26 aa, Entamoeba dispar
FEHQRIGVKWMYELFKQHAGGIVGDE

SEQ ID NO: 2481096 - protein, 23 aa, Entamoeba dispar
FEIDELKLLPGQILGCNLAALQS

SEQ ID NO: 2481097 - protein, 20 aa, Entamoeba dispar
FEIECWNEHLGFGIFSKKWF

SEQ ID NO: 2481098 - protein, 17 aa, Entamoeba dispar
FEIERLRQIASGWGEQP

SEQ ID NO: 2481099 - protein, 17 aa, Entamoeba dispar
FEIFITIKCTTKIKEQI

SEQ ID NO: 2481100 - protein, 19 aa, Entamoeba dispar
FEIGLRFFFTDVKLLIDFA

SEQ ID NO: 2481101 - protein, 17 aa, Entamoeba dispar
FEIGTAQTIGKRVYMED

SEQ ID NO: 2481102 - protein, 20 aa, Entamoeba dispar
FEIISKKILRERYNHAPKNR

SEQ ID NO: 2481103 - protein, 21 aa, Entamoeba dispar
FEIISKKILRERYNHAPKNRI

SEQ ID NO: 2481104 - protein, 25 aa, Entamoeba dispar
FEIISPSNVCISDFGSDFSKMCHDQ

SEQ ID NO: 2481105 - protein, 25 aa, Entamoeba dispar
FEILFSEQAIVCWVNNILCVKGNCD

SEQ ID NO: 2481106 - protein, 21 aa, Entamoeba dispar
FEILIRFYETFGLIEDKLTPS

SEQ ID NO: 2481107 - protein, 21 aa, Entamoeba dispar
FEILSDLSLTYVMLEKIMQDI

SEQ ID NO: 2481108 - protein, 22 aa, Entamoeba dispar
FEIMGKEIKSVFDSLTKDNNDI

SEQ ID NO: 2481109 - protein, 20 aa, Entamoeba dispar
FEINDKFKLAIKQIDKLPLR

SEQ ID NO: 2481110 - protein, 20 aa, Entamoeba dispar
FEINKLPILLKVWEVDCSES

SEQ ID NO: 2481111 - protein, 19 aa, Entamoeba dispar
FEINSCAIYGIDIMIDSHF

SEQ ID NO: 2481112 - protein, 17 aa, Entamoeba dispar
FEIPRCVSPLREHPPSS

SEQ ID NO: 2481113 - protein, 26 aa, Entamoeba dispar
FEIPTIKLPVMFSLSESRLECLKKIS

SEQ ID NO: 2481114 - protein, 17 aa, Entamoeba dispar
FEIQRFIEFSALKNSLN

SEQ ID NO: 2481115 - protein, 23 aa, Entamoeba dispar
FEKAEKFIGLAHINGMKINMNKI

SEQ ID NO: 2481116 - protein, 17 aa, Entamoeba dispar
FEKAVDDACGWPAEPNN

SEQ ID NO: 2481117 - protein, 17 aa, Entamoeba dispar
FEKEEYKHLLIQYQNSP

SEQ ID NO: 2481118 - protein, 17 aa, Entamoeba dispar
FEKEFQRELNLFPNIET

SEQ ID NO: 2481119 - protein, 17 aa, Entamoeba dispar
FEKEPFKYEKYKEAIIM

SEQ ID NO: 2481120 - protein, 18 aa, Entamoeba dispar
FEKEQRILDFFSYGVVKH

SEQ ID NO: 2481121 - protein, 18 aa, Entamoeba dispar
FEKERRKQQYIKIRKDLK

SEQ ID NO: 2481122 - protein, 25 aa, Entamoeba dispar
FEKEVDSVRALSCITTMLDARVCIA

SEQ ID NO: 2481123 - protein, 19 aa, Entamoeba dispar
FEKKAFCYAMIIFGIIVIR

SEQ ID NO: 2481124 - protein, 22 aa, Entamoeba dispar
FEKKLLKRKVFFLMDKKTYIEQ

SEQ ID NO: 2481125 - protein, 19 aa, Entamoeba dispar
FEKKYRAVINQECWGFISC

SEQ ID NO: 2481126 - protein, 20 aa, Entamoeba dispar
FEKLKKIAIEEGLSKALRPL

SEQ ID NO: 2481127 - protein, 18 aa, Entamoeba dispar
FEKLPPIIKDFIENLTKL

SEQ ID NO: 2481128 - protein, 24 aa, Entamoeba dispar
FEKVKEQAHRAAFKEVQIYMVDED

SEQ ID NO: 2481129 - protein, 21 aa, Entamoeba dispar
FEKVKWWLDDKALDGNFVLLT

SEQ ID NO: 2481130 - protein, 24 aa, Entamoeba dispar
FEKVLLRYHGLYWVTMILVDNNLI

SEQ ID NO: 2481131 - protein, 24 aa, Entamoeba dispar
FEKYKILRKEFLQKAQIFEPKAEA

SEQ ID NO: 2481132 - protein, 19 aa, Entamoeba dispar
FELCCGLCEMIKLLNIEIN

SEQ ID NO: 2481133 - protein, 20 aa, Entamoeba dispar
FELEHCINRYGIIIDETRNY

SEQ ID NO: 2481134 - protein, 22 aa, Entamoeba dispar
FELELLKKAYLDSVKCSDSVNM

SEQ ID NO: 2481135 - protein, 18 aa, Entamoeba dispar
FELETRWATASKEISHSF

SEQ ID NO: 2481136 - protein, 19 aa, Entamoeba dispar
FELHFYPLLQQYLYSTHEY

SEQ ID NO: 2481137 - protein, 28 aa, Entamoeba dispar
FELKKNISRRCLVDYFLYSTMIYNDSIE

SEQ ID NO: 2481138 - protein, 21 aa, Entamoeba dispar
FELKSVFIGIDIQLLFHDLSE

SEQ ID NO: 2481139 - protein, 18 aa, Entamoeba dispar
FELLYFIHCVGGFFHNVF

SEQ ID NO: 2481140 - protein, 26 aa, Entamoeba dispar
FELPRLPEYIKYLCVYSTNSNIVINQ

SEQ ID NO: 2481141 - protein, 24 aa, Entamoeba dispar
FELSIEFMTLLLLDDDTEKINQSI

SEQ ID NO: 2481142 - protein, 25 aa, Entamoeba dispar
FELSWKLTRPNGIVALVAMYESNQS

SEQ ID NO: 2481143 - protein, 24 aa, Entamoeba dispar
FEMCRVTGIPLSYLLPRGQQVKVI

SEQ ID NO: 2481144 - protein, 19 aa, Entamoeba dispar
FEMINCFYDTELELLISGM

SEQ ID NO: 2481145 - protein, 22 aa, Entamoeba dispar
FEMYCMKSNMLELLRIIKDPQQ

SEQ ID NO: 2481146 - protein, 24 aa, Entamoeba dispar
FENAHMYREFGGRINGFKHNEKQK

SEQ ID NO: 2481147 - protein, 23 aa, Entamoeba dispar
FENEFICNFHETFNQVNPNFGSF

SEQ ID NO: 2481148 - protein, 24 aa, Entamoeba dispar
FENFTKWKFVPFIKQHEGNKNQQQ

SEQ ID NO: 2481149 - protein, 23 aa, Entamoeba dispar
FENIRVGAMSGALANKGGVAYRM

SEQ ID NO: 2481150 - protein, 22 aa, Entamoeba dispar
FENLRIKDYFSIEYTSYQLTTQ

SEQ ID NO: 2481151 - protein, 23 aa, Entamoeba dispar
FENSCVRGVFKLSNENFYSTETA

SEQ ID NO: 2481152 - protein, 20 aa, Entamoeba dispar
FENVSNWVEQCCKYNGKHII

SEQ ID NO: 2481153 - protein, 22 aa, Entamoeba dispar
FENYYRHCIRKLNYHLKEENNL

SEQ ID NO: 2481154 - protein, 24 aa, Entamoeba dispar
FEPEEISGMILKYLYEIAQAKLGN

SEQ ID NO: 2481155 - protein, 22 aa, Entamoeba dispar
FEPEEISGMILKYLYEIAQEKL

SEQ ID NO: 2481156 - protein, 23 aa, Entamoeba dispar
FEPEEISGMILKYLYEIAQKKLG

SEQ ID NO: 2481157 - protein, 25 aa, Entamoeba dispar
FEPEEISGMILRYLYENAQAKLGNH

SEQ ID NO: 2481158 - protein, 19 aa, Entamoeba dispar
FEPEEVSGMILKYLYGIAQ

SEQ ID NO: 2481159 - protein, 17 aa, Entamoeba dispar
FEPEKWYNFPKTIQTKR

SEQ ID NO: 2481160 - protein, 18 aa, Entamoeba dispar
FEPFDFNKFEEVKPVPQQ

SEQ ID NO: 2481161 - protein, 18 aa, Entamoeba dispar
FEPFTLVPYCSRLIDISL

SEQ ID NO: 2481162 - protein, 17 aa, Entamoeba dispar
FEPKYKKMRLFSQEAIN

SEQ ID NO: 2481163 - protein, 26 aa, Entamoeba dispar
FEPLTCNWCYRTVCFPEDSIKIISRK

SEQ ID NO: 2481164 - protein, 17 aa, Entamoeba dispar
FEPSGLVQQESFLGGTP

SEQ ID NO: 2481165 - protein, 18 aa, Entamoeba dispar
FEPSSARKAFPCFDEPNY

SEQ ID NO: 2481166 - protein, 19 aa, Entamoeba dispar
FEPYLPIEGSYIPKEFIRE

SEQ ID NO: 2481167 - protein, 26 aa, Entamoeba dispar
FEPYPFCGGCVLCSTFNCTTLKGTNK

SEQ ID NO: 2481168 - protein, 17 aa, Entamoeba dispar
FEQASAIFLTASNNIKL

SEQ ID NO: 2481169 - protein, 17 aa, Entamoeba dispar
FEQKRRVIINSMKEDEE

SEQ ID NO: 2481170 - protein, 21 aa, Entamoeba dispar
FEQKYCILIRCDSEKKLTFNL

SEQ ID NO: 2481171 - protein, 30 aa, Entamoeba dispar
FEQLWEIKGSIEWNRIGVAYELSFRHQEAI

SEQ ID NO: 2481172 - protein, 23 aa, Entamoeba dispar
FEQMDCSNFLPPTSLMYKNIPGF

SEQ ID NO: 2481173 - protein, 18 aa, Entamoeba dispar
FEQMKKKLDNLLISKEFI

SEQ ID NO: 2481174 - protein, 19 aa, Entamoeba dispar
FERDIWRRDFYFWEGKKST

SEQ ID NO: 2481175 - protein, 23 aa, Entamoeba dispar
FERELLTIRSLYTFNTSCAIFIQ

SEQ ID NO: 2481176 - protein, 27 aa, Entamoeba dispar
FERVVCFPGKFFKFYLLSCPCLFHQND

SEQ ID NO: 2481177 - protein, 20 aa, Entamoeba dispar
FERYVIPIKLFKDVEKKIPE

SEQ ID NO: 2481178 - protein, 20 aa, Entamoeba dispar
FESDLNLPLWSSFPSHIELL

SEQ ID NO: 2481179 - protein, 17 aa, Entamoeba dispar
FESGDALSGDFCKGLFS

SEQ ID NO: 2481180 - protein, 17 aa, Entamoeba dispar
FESKLVPSDIVFLKGWI

SEQ ID NO: 2481181 - protein, 17 aa, Entamoeba dispar
FESLDRWLSELRDNADK

SEQ ID NO: 2481182 - protein, 20 aa, Entamoeba dispar
FESLIQLPLIGLTININEKI

SEQ ID NO: 2481183 - protein, 18 aa, Entamoeba dispar
FESLKIPYRVVNIVSGAL

SEQ ID NO: 2481184 - protein, 23 aa, Entamoeba dispar
FESRLLWRVYVFIADMHKKYVVT

SEQ ID NO: 2481185 - protein, 24 aa, Entamoeba dispar
FESYTCSSLALFLLKRALKNRGDM

SEQ ID NO: 2481186 - protein, 28 aa, Entamoeba dispar
FETEELKYFGIFMSQSFLFIKESSIEIV

SEQ ID NO: 2481187 - protein, 21 aa, Entamoeba dispar
FETIFNWRQVNGLKHDDYTRY

SEQ ID NO: 2481188 - protein, 19 aa, Entamoeba dispar
FETKVFDLNAICFVAQSSN

SEQ ID NO: 2481189 - protein, 19 aa, Entamoeba dispar
FETKVFDLTAICFVAPSSN

SEQ ID NO: 2481190 - protein, 17 aa, Entamoeba dispar
FETPLYFIADNNTSLPF

SEQ ID NO: 2481191 - protein, 18 aa, Entamoeba dispar
FETVNIVQRPLCPRYMLL

SEQ ID NO: 2481192 - protein, 26 aa, Entamoeba dispar
FEVCLKSSPLNTIWKSYVLMARHFMN

SEQ ID NO: 2481193 - protein, 25 aa, Entamoeba dispar
FEVFEKYFMMFGAFVECWPDDAFIQ

SEQ ID NO: 2481194 - protein, 29 aa, Entamoeba dispar
FEVIAAINISKGFKIEYSKVLGQVNITDM

SEQ ID NO: 2481195 - protein, 26 aa, Entamoeba dispar
FEVIIPIDDLLPFAAMKMFPNALFGN

SEQ ID NO: 2481196 - protein, 17 aa, Entamoeba dispar
FEVLRRINIPDDILMRK

SEQ ID NO: 2481197 - protein, 24 aa, Entamoeba dispar
FEWAYSAQILLSFEPPEPNDYLSI

SEQ ID NO: 2481198 - protein, 19 aa, Entamoeba dispar
FEWKNEYDQQIVLAVQKNG

SEQ ID NO: 2481199 - protein, 25 aa, Entamoeba dispar
FEWLAESHINEFCQFGREINENPPV

SEQ ID NO: 2481200 - protein, 22 aa, Entamoeba dispar
FEWVKRRFDYGLYISGEIKTPI

SEQ ID NO: 2481201 - protein, 27 aa, Entamoeba dispar
FEWVSDFYCSLGFVLTTYIDKIDSNQF

SEQ ID NO: 2481202 - protein, 17 aa, Entamoeba dispar
FEYDWEFAGQKIKLTGT

SEQ ID NO: 2481203 - protein, 17 aa, Entamoeba dispar
FEYKLKNLLVLKDNLII

SEQ ID NO: 2481204 - protein, 28 aa, Entamoeba dispar
FEYKVPEIKKLIQFGNGFGNILRLTGKE

SEQ ID NO: 2481205 - protein, 17 aa, Entamoeba dispar
FEYKYFMKKTEVVWEDG

SEQ ID NO: 2481206 - protein, 25 aa, Entamoeba dispar
FEYLLESLGFAFALPMESSQTIGNT

SEQ ID NO: 2481207 - protein, 19 aa, Entamoeba dispar
FEYSLFVYTLFFERSTQLV

SEQ ID NO: 2481208 - protein, 31 aa, Entamoeba dispar
FEYSNLIPREWLTKFDIVFQCGIPEETFYTT

SEQ ID NO: 2481209 - protein, 19 aa, Entamoeba dispar
FEYYETFIVKSSVYKAFVI

SEQ ID NO: 2481210 - protein, 25 aa, Entamoeba dispar
FFALPIEMSKALLLSTIENKESIKL

SEQ ID NO: 2481211 - protein, 18 aa, Entamoeba dispar
FFDHIARLIPSMKRPEEI

SEQ ID NO: 2481212 - protein, 20 aa, Entamoeba dispar
FFDIPSEITSLIPSMEHFTR

SEQ ID NO: 2481213 - protein, 23 aa, Entamoeba dispar
FFDKEFTQYIPLQIYELLQTIGT

SEQ ID NO: 2481214 - protein, 18 aa, Entamoeba dispar
FFDPSEIEYCDGLLSLRP

SEQ ID NO: 2481215 - protein, 22 aa, Entamoeba dispar
FFECGYELHGYCLVFELHIINL

SEQ ID NO: 2481216 - protein, 23 aa, Entamoeba dispar
FFECGYELHGYCLVFELHIINLN

SEQ ID NO: 2481217 - protein, 18 aa, Entamoeba dispar
FFEDGFRRVIPYYKEFKV

SEQ ID NO: 2481218 - protein, 18 aa, Entamoeba dispar
FFEILKFGVNLEEAINYT

SEQ ID NO: 2481219 - protein, 19 aa, Entamoeba dispar
FFEKIFVVDPFERINTFQL

SEQ ID NO: 2481220 - protein, 18 aa, Entamoeba dispar
FFENCGFIQVSLPSTLRS

SEQ ID NO: 2481221 - protein, 25 aa, Entamoeba dispar
FFENCSKAQCSLELQMKGEVNKEED

SEQ ID NO: 2481222 - protein, 19 aa, Entamoeba dispar
FFERHWDIVCHLKEFKKES

SEQ ID NO: 2481223 - protein, 21 aa, Entamoeba dispar
FFERIRWNTLLSESREDIFVP

SEQ ID NO: 2481224 - protein, 27 aa, Entamoeba dispar
FFFETFKKLRVGAVLYLLYGRQSQNSR

SEQ ID NO: 2481225 - protein, 27 aa, Entamoeba dispar
FFGCDELEFPLCFTVFSASLYSLNNQS

SEQ ID NO: 2481226 - protein, 17 aa, Entamoeba dispar
FFGEVIIHYNIWDFPNW

SEQ ID NO: 2481227 - protein, 26 aa, Entamoeba dispar
FFGKCLRGGFMPLEKDFLFKTLTMQD

SEQ ID NO: 2481228 - protein, 27 aa, Entamoeba dispar
FFGYYLKEEWECIASIFEKYQIYTKNT

SEQ ID NO: 2481229 - protein, 20 aa, Entamoeba dispar
FFIHKLCKHQQLTFDVTENY

SEQ ID NO: 2481230 - protein, 18 aa, Entamoeba dispar
FFIKYSYDDLVNKKFPKG

SEQ ID NO: 2481231 - protein, 21 aa, Entamoeba dispar
FFIPKEIYRLIDYIIQHYEPN

SEQ ID NO: 2481232 - protein, 26 aa, Entamoeba dispar
FFISLCTSLVYRCHNYFASYIIFSTL

SEQ ID NO: 2481233 - protein, 20 aa, Entamoeba dispar
FFKIQVDIIIAVFIKLSRGT

SEQ ID NO: 2481234 - protein, 17 aa, Entamoeba dispar
FFLAEGILLPENIKIHG

SEQ ID NO: 2481235 - protein, 17 aa, Entamoeba dispar
FFLECFSPEYSFEEPIY

SEQ ID NO: 2481236 - protein, 17 aa, Entamoeba dispar
FFLLCVDDPVPNVRIHL

SEQ ID NO: 2481237 - protein, 18 aa, Entamoeba dispar
FFLMNAMKEAVKYVDQSE

SEQ ID NO: 2481238 - protein, 32 aa, Entamoeba dispar
FFLNIFGSLLLKFNIYGGWTFIYQILYSVLKY

SEQ ID NO: 2481239 - protein, 19 aa, Entamoeba dispar
FFLRRLGEAQAKYETMLPL

SEQ ID NO: 2481240 - protein, 17 aa, Entamoeba dispar
FFMITVIRELLKDCTDQ

SEQ ID NO: 2481241 - protein, 18 aa, Entamoeba dispar
FFNFIMKTAERFYEQRNF

SEQ ID NO: 2481242 - protein, 26 aa, Entamoeba dispar
FFNILKKREEVWEKLEVLKLSNCEIT

SEQ ID NO: 2481243 - protein, 19 aa, Entamoeba dispar
FFNKNIKVFFNKIKKETMY

SEQ ID NO: 2481244 - protein, 17 aa, Entamoeba dispar
FFNQRGNVMPYLIQNKL

SEQ ID NO: 2481245 - protein, 21 aa, Entamoeba dispar
FFNVPCSFDPLKQNEQINGIV

SEQ ID NO: 2481246 - protein, 18 aa, Entamoeba dispar
FFPDSRQIVLKTFEELCN

SEQ ID NO: 2481247 - protein, 21 aa, Entamoeba dispar
FFPTYRDVYRFIKVNRKCLET

SEQ ID NO: 2481248 - protein, 23 aa, Entamoeba dispar
FFQMYPFEIIVQFDALGIFELSI

SEQ ID NO: 2481249 - protein, 24 aa, Entamoeba dispar
FFQMYPFEIIVQFDALGIFELSIS

SEQ ID NO: 2481250 - protein, 23 aa, Entamoeba dispar
FFREFNRPLAMSFDGIRHDSESP

SEQ ID NO: 2481251 - protein, 17 aa, Entamoeba dispar
FFRSLCEIILEQIDQRS

SEQ ID NO: 2481252 - protein, 23 aa, Entamoeba dispar
FFRSVKFQLIRNIPPPIIPEVNG

SEQ ID NO: 2481253 - protein, 23 aa, Entamoeba dispar
FFSAPNPLFSRLQTLSPEPLNTQ

SEQ ID NO: 2481254 - protein, 20 aa, Entamoeba dispar
FFSIELMNFMLMAKKDDFNL

SEQ ID NO: 2481255 - protein, 24 aa, Entamoeba dispar
FFSMKEMFIEFKVSKTQINQIVGY

SEQ ID NO: 2481256 - protein, 18 aa, Entamoeba dispar
FFSQPIPVKCSILDQPLS

SEQ ID NO: 2481257 - protein, 17 aa, Entamoeba dispar
FFSRKDMHIGFISNTFM

SEQ ID NO: 2481258 - protein, 17 aa, Entamoeba dispar
FFSRQRELVISKPNALF

SEQ ID NO: 2481259 - protein, 18 aa, Entamoeba dispar
FFSTDFYSAFNYVMNQTF

SEQ ID NO: 2481260 - protein, 23 aa, Entamoeba dispar
FFTCQRFKEPTLLTCEKGIYLMV

SEQ ID NO: 2481261 - protein, 18 aa, Entamoeba dispar
FFTHLVVEACHRTLHGYE

SEQ ID NO: 2481262 - protein, 24 aa, Entamoeba dispar
FFTKEQLYHYGISVIQKCYYVPQL

SEQ ID NO: 2481263 - protein, 18 aa, Entamoeba dispar
FFTSESLSMNCPRVTQTF

SEQ ID NO: 2481264 - protein, 17 aa, Entamoeba dispar
FFVFTLRNPHNIQPIKF

SEQ ID NO: 2481265 - protein, 18 aa, Entamoeba dispar
FFVNKTLITLCISKDENL

SEQ ID NO: 2481266 - protein, 19 aa, Entamoeba dispar
FFVTDGLFYKILKKTKASG

SEQ ID NO: 2481267 - protein, 21 aa, Entamoeba dispar
FFWDYKALKKFCQSGPARTFC

SEQ ID NO: 2481268 - protein, 20 aa, Entamoeba dispar
FFWMAYCPIKPKSEKLSQII

SEQ ID NO: 2481269 - protein, 29 aa, Entamoeba dispar
FFYDLPSTLFKYLLYPIIFKDSFSQQSII

SEQ ID NO: 2481270 - protein, 21 aa, Entamoeba dispar
FFYDQRTIFYFFKKNFENKAC

SEQ ID NO: 2481271 - protein, 25 aa, Entamoeba dispar
FFYKIKRKPSLILNIGYYQLRLVFN

SEQ ID NO: 2481272 - protein, 19 aa, Entamoeba dispar
FGAEPKAVPGVPNLSVMEV

SEQ ID NO: 2481273 - protein, 17 aa, Entamoeba dispar
FGAKATFTNRGKRVSDI

SEQ ID NO: 2481274 - protein, 17 aa, Entamoeba dispar
FGARAMMLQVRVSNKPA

SEQ ID NO: 2481275 - protein, 17 aa, Entamoeba dispar
FGCDGCIGYYERPLSNV

SEQ ID NO: 2481276 - protein, 19 aa, Entamoeba dispar
FGCGSCGPRAFYGTTTEHL

SEQ ID NO: 2481277 - protein, 26 aa, Entamoeba dispar
FGCIAAELILGIPIFPGSSEYNQLER

SEQ ID NO: 2481278 - protein, 25 aa, Entamoeba dispar
FGCVAAELFLGIPLFPGENEYNQLT

SEQ ID NO: 2481279 - protein, 18 aa, Entamoeba dispar
FGDCFEVAMNREKFPEKI

SEQ ID NO: 2481280 - protein, 17 aa, Entamoeba dispar
FGDCKVGVLTKDLTVIF

SEQ ID NO: 2481281 - protein, 21 aa, Entamoeba dispar
FGDDMARVVIIVGIPYPSLGD

SEQ ID NO: 2481282 - protein, 26 aa, Entamoeba dispar
FGDDQFYHRFGFETSTKYGIKTDIPC

SEQ ID NO: 2481283 - protein, 25 aa, Entamoeba dispar
FGDFKDFLVKMANVRKDYAKSMLRM

SEQ ID NO: 2481284 - protein, 17 aa, Entamoeba dispar
FGDGCFCECGCEEELMK

SEQ ID NO: 2481285 - protein, 26 aa, Entamoeba dispar
FGDIELYKFIGRVVAKTVYDGEFLDV

SEQ ID NO: 2481286 - protein, 22 aa, Entamoeba dispar
FGDIKISVVLVRPMHEDNIGAV

SEQ ID NO: 2481287 - protein, 26 aa, Entamoeba dispar
FGDYNIAKCRIITFKGKSESRGFGYL

SEQ ID NO: 2481288 - protein, 21 aa, Entamoeba dispar
FGEDLSHTGIRLSLSRFNTEE

SEQ ID NO: 2481289 - protein, 18 aa, Entamoeba dispar
FGEKPIKSQYLIQNADYT

SEQ ID NO: 2481290 - protein, 26 aa, Entamoeba dispar
FGELYRRAANMGSWKQVLIKNYSRIQ

SEQ ID NO: 2481291 - protein, 18 aa, Entamoeba dispar
FGENMTVLCVMNGKIDPA

SEQ ID NO: 2481292 - protein, 24 aa, Entamoeba dispar
FGEVGSLIPFCDFSNHCTQAKVTY

SEQ ID NO: 2481293 - protein, 17 aa, Entamoeba dispar
FGFLKTKHEFLIKLFTK

SEQ ID NO: 2481294 - protein, 26 aa, Entamoeba dispar
FGFPLQFKIPLAFSLSVVANIKDYQA

SEQ ID NO: 2481295 - protein, 18 aa, Entamoeba dispar
FGGCYQLRPLVSLPDQCY

SEQ ID NO: 2481296 - protein, 17 aa, Entamoeba dispar
FGGDAYEYIKLTKTKTP

SEQ ID NO: 2481297 - protein, 27 aa, Entamoeba dispar
FGGDCNRIRFIPSTSFIVTQQSLISTN

SEQ ID NO: 2481298 - protein, 19 aa, Entamoeba dispar
FGGFCTAAPGLHDDNHTSV

SEQ ID NO: 2481299 - protein, 19 aa, Entamoeba dispar
FGGFCTAAPGLHDDNLTSI

SEQ ID NO: 2481300 - protein, 20 aa, Entamoeba dispar
FGGGILYVSCCKIVNDNVII

SEQ ID NO: 2481301 - protein, 18 aa, Entamoeba dispar
FGGKRGWVPNEFIKPMGL

SEQ ID NO: 2481302 - protein, 23 aa, Entamoeba dispar
FGHFLGNIIKLGFYNKESAPFVL

SEQ ID NO: 2481303 - protein, 36 aa, Entamoeba dispar
FGHQFEKRSGIGVVCPHGQYSPIFFQFLDCVNILLH

SEQ ID NO: 2481304 - protein, 22 aa, Entamoeba dispar
FGHRVKSVSLAIFSMAEVDAIK

SEQ ID NO: 2481305 - protein, 23 aa, Entamoeba dispar
FGIEGLCHSGIFHAGKRRFVSLA

SEQ ID NO: 2481306 - protein, 20 aa, Entamoeba dispar
FGIEICKNVYLGSAAAGANI

SEQ ID NO: 2481307 - protein, 17 aa, Entamoeba dispar
FGIELLDIIITDHFESL

SEQ ID NO: 2481308 - protein, 17 aa, Entamoeba dispar
FGIKPTLSDHPLFAVSR

SEQ ID NO: 2481309 - protein, 30 aa, Entamoeba dispar
FGILIFKLLTGFCPFELIQMDPFTAIHVQA

SEQ ID NO: 2481310 - protein, 28 aa, Entamoeba dispar
FGIPDTLRLEIWKLFLQPKKEIVEEKTA

SEQ ID NO: 2481311 - protein, 17 aa, Entamoeba dispar
FGIPLLSMHSIREIGGI

SEQ ID NO: 2481312 - protein, 26 aa, Entamoeba dispar
FGIPLQRLNQIPTIITLICQRLASHQ

SEQ ID NO: 2481313 - protein, 19 aa, Entamoeba dispar
FGIQLCVGNSLLAAKACQV

SEQ ID NO: 2481314 - protein, 25 aa, Entamoeba dispar
FGITKKAINEWILKSLIKNIQKKRE

SEQ ID NO: 2481315 - protein, 24 aa, Entamoeba dispar
FGIYLKSRIGLVGPNGTGKSTLMK

SEQ ID NO: 2481316 - protein, 17 aa, Entamoeba dispar
FGKDATRQEIIDALNKF

SEQ ID NO: 2481317 - protein, 26 aa, Entamoeba dispar
FGKDVKKNFIAILTFCDGQTPKILSS

SEQ ID NO: 2481318 - protein, 21 aa, Entamoeba dispar
FGKDVKKNFIAMLTFCDAEDP

SEQ ID NO: 2481319 - protein, 23 aa, Entamoeba dispar
FGKEYIRLRCPHAQFTEAKSSES

SEQ ID NO: 2481320 - protein, 24 aa, Entamoeba dispar
FGKEYIRLRCPHAQFTEAKSSESD

SEQ ID NO: 2481321 - protein, 28 aa, Entamoeba dispar
FGKKEKLPCPFTYLQLSEMCGWNDTDKK

SEQ ID NO: 2481322 - protein, 25 aa, Entamoeba dispar
FGKKVKYCMIMKKIPLINPLSLFSL

SEQ ID NO: 2481323 - protein, 21 aa, Entamoeba dispar
FGKNRSGIIQTIFKDKGMEAT

SEQ ID NO: 2481324 - protein, 17 aa, Entamoeba dispar
FGKYYEVEHAISSGINE

SEQ ID NO: 2481325 - protein, 18 aa, Entamoeba dispar
FGLEKEIWDEMVKIGISL

SEQ ID NO: 2481326 - protein, 24 aa, Entamoeba dispar
FGLESIACCIPLGVDTIEFVFNLV

SEQ ID NO: 2481327 - protein, 21 aa, Entamoeba dispar
FGLRNNPRIILYVNNPNTGEM

SEQ ID NO: 2481328 - protein, 30 aa, Entamoeba dispar
FGNDFMAKFNGAYCNLPLLEHMTFIDSPGV

SEQ ID NO: 2481329 - protein, 31 aa, Entamoeba dispar
FGNDFMAKFNGSFCNLPLLEHLTFIDSPGVL

SEQ ID NO: 2481330 - protein, 31 aa, Entamoeba dispar
FGNEFMAKFNGSFCNLPLLEHLTFIDSPGVL

SEQ ID NO: 2481331 - protein, 23 aa, Entamoeba dispar
FGNKCLSCSTSNFDTEEIITTEK

SEQ ID NO: 2481332 - protein, 18 aa, Entamoeba dispar
FGNKHSINKLILLCSQKV

SEQ ID NO: 2481333 - protein, 18 aa, Entamoeba dispar
FGNKVRSIHVNKMIANII

SEQ ID NO: 2481334 - protein, 24 aa, Entamoeba dispar
FGNLFPFLKICCGMNDDLIQQSMN

SEQ ID NO: 2481335 - protein, 28 aa, Entamoeba dispar
FGNNQLNFPLCFTIFGATHYSFKNKAAV

SEQ ID NO: 2481336 - protein, 25 aa, Entamoeba dispar
FGNSMYFQNCGFLGNILNKAFKQNI

SEQ ID NO: 2481337 - protein, 19 aa, Entamoeba dispar
FGNSMYIDFALNQNEENIN

SEQ ID NO: 2481338 - protein, 18 aa, Entamoeba dispar
FGNSNFFSIDKKPENVNG

SEQ ID NO: 2481339 - protein, 18 aa, Entamoeba dispar
FGPACVRNPDLTWEQCAN

SEQ ID NO: 2481340 - protein, 21 aa, Entamoeba dispar
FGPFKRFVLKGIQMLEHQPGF

SEQ ID NO: 2481341 - protein, 17 aa, Entamoeba dispar
FGPSGEEPRTFEIHCGT

SEQ ID NO: 2481342 - protein, 23 aa, Entamoeba dispar
FGPSLKPFTCMIAGSYWANLTVI

SEQ ID NO: 2481343 - protein, 19 aa, Entamoeba dispar
FGPSWIKFNGLTVVRTSVE

SEQ ID NO: 2481344 - protein, 24 aa, Entamoeba dispar
FGQKARKALSDSLDIIYECIGASD

SEQ ID NO: 2481345 - protein, 18 aa, Entamoeba dispar
FGQSNGWINKVSNLEDYQ

SEQ ID NO: 2481346 - protein, 18 aa, Entamoeba dispar
FGQWGFLIYYILSKGGSV

SEQ ID NO: 2481347 - protein, 25 aa, Entamoeba dispar
FGQYIRIDWDYGFVEGRQYGRGDGG

SEQ ID NO: 2481348 - protein, 25 aa, Entamoeba dispar
FGRIYKKVMNLWDLKYKLIDWKSYF

SEQ ID NO: 2481349 - protein, 19 aa, Entamoeba dispar
FGSCWNDGRVVTAIIHSLF

SEQ ID NO: 2481350 - protein, 22 aa, Entamoeba dispar
FGSDWKRSYLFCYYEITTDQLT

SEQ ID NO: 2481351 - protein, 19 aa, Entamoeba dispar
FGSFLAGAVNYVLPSVDEQ

SEQ ID NO: 2481352 - protein, 20 aa, Entamoeba dispar
FGSHHWPTWGNQRVNEYWEK

SEQ ID NO: 2481353 - protein, 23 aa, Entamoeba dispar
FGSNTCWHLYGIILRTEKHYEEA

SEQ ID NO: 2481354 - protein, 17 aa, Entamoeba dispar
FGSTMGGFGNNNTFGNT

SEQ ID NO: 2481355 - protein, 22 aa, Entamoeba dispar
FGTACFYKCGCEEMLKPNKTIP

SEQ ID NO: 2481356 - protein, 22 aa, Entamoeba dispar
FGTACFYKCGCEEMLKQNKTIP

SEQ ID NO: 2481357 - protein, 18 aa, Entamoeba dispar
FGTCYEIENGDGIFFKDE

SEQ ID NO: 2481358 - protein, 25 aa, Entamoeba dispar
FGTHNWPTWGNKRIVEYYEKQRDMY

SEQ ID NO: 2481359 - protein, 28 aa, Entamoeba dispar
FGTKETNMWIKIPIDQGIIKEIDNRTYL

SEQ ID NO: 2481360 - protein, 19 aa, Entamoeba dispar
FGTKNDFKQLCEVAHQNNI

SEQ ID NO: 2481361 - protein, 17 aa, Entamoeba dispar
FGTQALKKLIVVSMNDN

SEQ ID NO: 2481362 - protein, 17 aa, Entamoeba dispar
FGTTNNLSFNVFNSDLQ

SEQ ID NO: 2481363 - protein, 17 aa, Entamoeba dispar
FGVIMPQCTLFRNSNGY

SEQ ID NO: 2481364 - protein, 25 aa, Entamoeba dispar
FGVKEMLNIYGFRNSISLLPYSKRK

SEQ ID NO: 2481365 - protein, 23 aa, Entamoeba dispar
FGYCKKEVKTQISYSANLYGFAE

SEQ ID NO: 2481366 - protein, 33 aa, Entamoeba dispar
FGYLRYEMDQTKKFLCVCWCGQAAPDNLKTKFV

SEQ ID NO: 2481367 - protein, 18 aa, Entamoeba dispar
FGYVFGAFVSVPIHETNK

SEQ ID NO: 2481368 - protein, 24 aa, Entamoeba dispar
FHADTCIGDLLSLLITYITPYLSF

SEQ ID NO: 2481369 - protein, 23 aa, Entamoeba dispar
FHANPRSFCGYVYPDKFESTRVI

SEQ ID NO: 2481370 - protein, 22 aa, Entamoeba dispar
FHATWCKDCINVRPLYRKLITE

SEQ ID NO: 2481371 - protein, 18 aa, Entamoeba dispar
FHDIIKVKGSIYLMGLAL

SEQ ID NO: 2481372 - protein, 19 aa, Entamoeba dispar
FHEGCFVCSVCGIPLNENF

SEQ ID NO: 2481373 - protein, 18 aa, Entamoeba dispar
FHFIRDGKIEDIKKMIDT

SEQ ID NO: 2481374 - protein, 18 aa, Entamoeba dispar
FHFNPIQFKSLFKNPQKK

SEQ ID NO: 2481375 - protein, 31 aa, Entamoeba dispar
FHFPFYFEYLSKWPEMCFIAKDCNGRVEGYH

SEQ ID NO: 2481376 - protein, 18 aa, Entamoeba dispar
FHIGFFRPIIQVLQCVCK

SEQ ID NO: 2481377 - protein, 22 aa, Entamoeba dispar
FHIHFCTIHSPLFQSLNSVIGR

SEQ ID NO: 2481378 - protein, 18 aa, Entamoeba dispar
FHIIPSIQAMSNYLNESV

SEQ ID NO: 2481379 - protein, 17 aa, Entamoeba dispar
FHIPRLIIPNDRINISP

SEQ ID NO: 2481380 - protein, 23 aa, Entamoeba dispar
FHKEITIIIKLIIPKILEDNPTN

SEQ ID NO: 2481381 - protein, 19 aa, Entamoeba dispar
FHKKLTWLKKFPKEQEELA

SEQ ID NO: 2481382 - protein, 23 aa, Entamoeba dispar
FHKKVINGQDCFVHESFDPTDFS

SEQ ID NO: 2481383 - protein, 32 aa, Entamoeba dispar
FHKLEYKTGICFKHEFFVRDAPEFLDKIKRKK

SEQ ID NO: 2481384 - protein, 17 aa, Entamoeba dispar
FHKLLCQKEYYLNELEQ

SEQ ID NO: 2481385 - protein, 25 aa, Entamoeba dispar
FHKSAVKALCFEINRNNVILSGGGI

SEQ ID NO: 2481386 - protein, 19 aa, Entamoeba dispar
FHPEHFVCSFCVNPLTESS

SEQ ID NO: 2481387 - protein, 18 aa, Entamoeba dispar
FHPFLPWIYSTGADGTIQ

SEQ ID NO: 2481388 - protein, 18 aa, Entamoeba dispar
FHPHEFARQITLMQNDLF

SEQ ID NO: 2481389 - protein, 17 aa, Entamoeba dispar
FHPIEYFSPKETKLGEV

SEQ ID NO: 2481390 - protein, 18 aa, Entamoeba dispar
FHPLITRIVAERKMIFNE

SEQ ID NO: 2481391 - protein, 18 aa, Entamoeba dispar
FHPNVFKDGRICLDILQD

SEQ ID NO: 2481392 - protein, 26 aa, Entamoeba dispar
FHQMKQWSVCIPKLNAKTMIREEVVK

SEQ ID NO: 2481393 - protein, 28 aa, Entamoeba dispar
FHQMLLKGELPLSIGGGIGQSRLCMFYL

SEQ ID NO: 2481394 - protein, 18 aa, Entamoeba dispar
FHRKEYQEGITFGLKQRE

SEQ ID NO: 2481395 - protein, 17 aa, Entamoeba dispar
FHRPLFIEIHTISVFVP

SEQ ID NO: 2481396 - protein, 22 aa, Entamoeba dispar
FHRVKGRFKRRDQIFEIESIIQ

SEQ ID NO: 2481397 - protein, 26 aa, Entamoeba dispar
FHRVYFKILESIGYYHCKVITINNNK

SEQ ID NO: 2481398 - protein, 18 aa, Entamoeba dispar
FHSELALFRDREIPSNTT

SEQ ID NO: 2481399 - protein, 23 aa, Entamoeba dispar
FHSHLPSTLLLTLLDRNKTQLII

SEQ ID NO: 2481400 - protein, 24 aa, Entamoeba dispar
FHSSLRPVPLIAHIDGFPTKAYCP

SEQ ID NO: 2481401 - protein, 24 aa, Entamoeba dispar
FHVFNCIWNKFIFKASPHIVNNEI

SEQ ID NO: 2481402 - protein, 20 aa, Entamoeba dispar
FHVIYIPLLRHPIIFPTMKL

SEQ ID NO: 2481403 - protein, 25 aa, Entamoeba dispar
FHVQANCLICHKPLTPRDLICRYCQ

SEQ ID NO: 2481404 - protein, 27 aa, Entamoeba dispar
FHYHMYFKDNCLLSDFTIHSINTIVFT

SEQ ID NO: 2481405 - protein, 17 aa, Entamoeba dispar
FHYKEFSRQISFQQNEL

SEQ ID NO: 2481406 - protein, 19 aa, Entamoeba dispar
FHYLFGVKEAGFYGIVKMD

SEQ ID NO: 2481407 - protein, 23 aa, Entamoeba dispar
FHYLHRHILRFISSVEEINSNVF

SEQ ID NO: 2481408 - protein, 17 aa, Entamoeba dispar
FIAGGSCDNSYSVYSIE

SEQ ID NO: 2481409 - protein, 26 aa, Entamoeba dispar
FIAKDMWRVMFGYGVDVGRVKGKTNE

SEQ ID NO: 2481410 - protein, 20 aa, Entamoeba dispar
FICDLCASLHTECKHTKQTY

SEQ ID NO: 2481411 - protein, 19 aa, Entamoeba dispar
FICGPCSRSHMKLSHKQLK

SEQ ID NO: 2481412 - protein, 19 aa, Entamoeba dispar
FICPCCHKESSIFPPTHGG

SEQ ID NO: 2481413 - protein, 19 aa, Entamoeba dispar
FICSTCCIQFSSSEERTTH

SEQ ID NO: 2481414 - protein, 22 aa, Entamoeba dispar
FIDCELPFSISLYPHHLKNIKG

SEQ ID NO: 2481415 - protein, 24 aa, Entamoeba dispar
FIDDGEKLFLHGLHLYSKKLQDME

SEQ ID NO: 2481416 - protein, 17 aa, Entamoeba dispar
FIDEINDVIKLFVIEEI

SEQ ID NO: 2481417 - protein, 25 aa, Entamoeba dispar
FIDESLRLKIKYALKLSTGKRDLIK

SEQ ID NO: 2481418 - protein, 22 aa, Entamoeba dispar
FIDESYIIFDLLLFKEIIEKGY

SEQ ID NO: 2481419 - protein, 34 aa, Entamoeba dispar
FIDGYQFCIGFYFSIQSVKEWEWIVVGQNSFAFM

SEQ ID NO: 2481420 - protein, 18 aa, Entamoeba dispar
FIDHCEAIANLLLPSSMT

SEQ ID NO: 2481421 - protein, 20 aa, Entamoeba dispar
FIDIVIDLRSDYSPLLETLN

SEQ ID NO: 2481422 - protein, 21 aa, Entamoeba dispar
FIDKCKLLYPKGNIKGKKEQW

SEQ ID NO: 2481423 - protein, 22 aa, Entamoeba dispar
FIDKCKLLYPKGNIKGKKEQWI

SEQ ID NO: 2481424 - protein, 22 aa, Entamoeba dispar
FIDKLNCYYLNTSHIQNLREIS

SEQ ID NO: 2481425 - protein, 24 aa, Entamoeba dispar
FIDKLNCYYLNVSHIQNLRDLSTI

SEQ ID NO: 2481426 - protein, 23 aa, Entamoeba dispar
FIDKLNCYYLNVSHIQNLREIST

SEQ ID NO: 2481427 - protein, 24 aa, Entamoeba dispar
FIDKLNCYYLNVSHIQNLRELSTI

SEQ ID NO: 2481428 - protein, 24 aa, Entamoeba dispar
FIDKVAQCTIVIACNGDDNALYDI

SEQ ID NO: 2481429 - protein, 25 aa, Entamoeba dispar
FIDKVLTKQGYLRRIIIQNDNGSKT

SEQ ID NO: 2481430 - protein, 17 aa, Entamoeba dispar
FIDNFIIYNPWKEFDLS

SEQ ID NO: 2481431 - protein, 18 aa, Entamoeba dispar
FIDYDFKDIHSLKRQYDE

SEQ ID NO: 2481432 - protein, 17 aa, Entamoeba dispar
FIEDKWYYHSIDFSDFL

SEQ ID NO: 2481433 - protein, 24 aa, Entamoeba dispar
FIEFFNWKEVYDVYVRYLVEADDG

SEQ ID NO: 2481434 - protein, 20 aa, Entamoeba dispar
FIEFGFGCFYRCGCEETLRK

SEQ ID NO: 2481435 - protein, 27 aa, Entamoeba dispar
FIEGDLITALRNGYWILLDEINLASHD

SEQ ID NO: 2481436 - protein, 26 aa, Entamoeba dispar
FIEKIKEYFLSFFIKQEPSFDTKTLS

SEQ ID NO: 2481437 - protein, 25 aa, Entamoeba dispar
FIELLRIIKWSSIQKHIILVLNKQH

SEQ ID NO: 2481438 - protein, 18 aa, Entamoeba dispar
FIERSLIYTEEVSKASGL

SEQ ID NO: 2481439 - protein, 25 aa, Entamoeba dispar
FIESSSWILKTKFADIPVLLMIPWK

SEQ ID NO: 2481440 - protein, 19 aa, Entamoeba dispar
FIEYCLKNNYWNCPLCEKK

SEQ ID NO: 2481441 - protein, 25 aa, Entamoeba dispar
FIEYLSNFKNPICYFHNLGYDGRFL

SEQ ID NO: 2481442 - protein, 20 aa, Entamoeba dispar
FIFCGLEGNNFVILKHFEKE

SEQ ID NO: 2481443 - protein, 28 aa, Entamoeba dispar
FIFDTMSRWLLCYGKNMFSIRLLDETTH

SEQ ID NO: 2481444 - protein, 18 aa, Entamoeba dispar
FIFERDYIYIGGRYRKYS

SEQ ID NO: 2481445 - protein, 19 aa, Entamoeba dispar
FIFHILLNCQINFSSKNDK

SEQ ID NO: 2481446 - protein, 19 aa, Entamoeba dispar
FIFSFDDLKMLLGCGKTLK

SEQ ID NO: 2481447 - protein, 19 aa, Entamoeba dispar
FIGDDCFSGCLSLTSMNID

SEQ ID NO: 2481448 - protein, 18 aa, Entamoeba dispar
FIGIGGIIPLLSNNLSEP

SEQ ID NO: 2481449 - protein, 17 aa, Entamoeba dispar
FIGKNRLASQAFNDFKQ

SEQ ID NO: 2481450 - protein, 18 aa, Entamoeba dispar
FIGLLPLYIELLEHWYIK

SEQ ID NO: 2481451 - protein, 25 aa, Entamoeba dispar
FIGNQVLRFYRRIVRDYLTRNYTAS

SEQ ID NO: 2481452 - protein, 18 aa, Entamoeba dispar
FIGRIEVFLFQKIFNCSQ

SEQ ID NO: 2481453 - protein, 20 aa, Entamoeba dispar
FIGTGCGIGAKGHKITIDEA

SEQ ID NO: 2481454 - protein, 17 aa, Entamoeba dispar
FIGYRNDLYISLIKTTC

SEQ ID NO: 2481455 - protein, 17 aa, Entamoeba dispar
FIHAFGYVKEATAYANC

SEQ ID NO: 2481456 - protein, 18 aa, Entamoeba dispar
FIHCGGLVGHIEDIVVTS

SEQ ID NO: 2481457 - protein, 24 aa, Entamoeba dispar
FIHKRHIDKLKQWTGLTKYRIIYN

SEQ ID NO: 2481458 - protein, 17 aa, Entamoeba dispar
FIHLFIICLENHRDIDF

SEQ ID NO: 2481459 - protein, 18 aa, Entamoeba dispar
FIHQLFYETFDFENYTIC

SEQ ID NO: 2481460 - protein, 21 aa, Entamoeba dispar
FIIECGNSVWVGLNTNQLNVI

SEQ ID NO: 2481461 - protein, 18 aa, Entamoeba dispar
FIIGDIVYPMLMGEYDFN

SEQ ID NO: 2481462 - protein, 26 aa, Entamoeba dispar
FIIITKTGYAFGCFCHKKIPYPKKSY

SEQ ID NO: 2481463 - protein, 22 aa, Entamoeba dispar
FIIKNKCKPFISFIQIKQEESS

SEQ ID NO: 2481464 - protein, 17 aa, Entamoeba dispar
FIILRPHQYGILIEIYR

SEQ ID NO: 2481465 - protein, 18 aa, Entamoeba dispar
FIINICIYLLRNISLNTQ

SEQ ID NO: 2481466 - protein, 17 aa, Entamoeba dispar
FIIPPKQYKAIKPMDDD

SEQ ID NO: 2481467 - protein, 22 aa, Entamoeba dispar
FIIPPSITKLGEYCFSGCSTLT

SEQ ID NO: 2481468 - protein, 28 aa, Entamoeba dispar
FIIPSSINKLGYRCFNGCLSLTTINIPT

SEQ ID NO: 2481469 - protein, 28 aa, Entamoeba dispar
FIIPSSITKLGYRCFKECSTLKSINIPS

SEQ ID NO: 2481470 - protein, 28 aa, Entamoeba dispar
FIIPSSITKLGYRCFNGCISLTSINIPS

SEQ ID NO: 2481471 - protein, 27 aa, Entamoeba dispar
FIIPSSITKLGYRCFNGCISLTTINIP

SEQ ID NO: 2481472 - protein, 26 aa, Entamoeba dispar
FIIPSSITKLGYRCFSKCSTLKSINI

SEQ ID NO: 2481473 - protein, 27 aa, Entamoeba dispar
FIIPSSITKLGYRCFSKCSTLKSINIP

SEQ ID NO: 2481474 - protein, 30 aa, Entamoeba dispar
FIIPTTITKLGWKCFEYCTSLTSIDIPTTI

SEQ ID NO: 2481475 - protein, 24 aa, Entamoeba dispar
FIIPTTITKLGWNCFEGCTSLKSI

SEQ ID NO: 2481476 - protein, 17 aa, Entamoeba dispar
FIISIFSKIKWTDSELV

SEQ ID NO: 2481477 - protein, 24 aa, Entamoeba dispar
FIITCKLLPLIRKTLNSRIIEVGS

SEQ ID NO: 2481478 - protein, 17 aa, Entamoeba dispar
FIITTICLIPYLTESEL

SEQ ID NO: 2481479 - protein, 17 aa, Entamoeba dispar
FIIYGKCLLYYYQFEEA

SEQ ID NO: 2481480 - protein, 22 aa, Entamoeba dispar
FIKAECLEKIIGAVQLLSHRQE

SEQ ID NO: 2481481 - protein, 21 aa, Entamoeba dispar
FIKCLQTLEILHRVSPTVFHH

SEQ ID NO: 2481482 - protein, 23 aa, Entamoeba dispar
FIKEDFLKVLHFLLVKKKLPTKP

SEQ ID NO: 2481483 - protein, 25 aa, Entamoeba dispar
FIKEICIDIPFLLRKPFSKNNWVIN

SEQ ID NO: 2481484 - protein, 23 aa, Entamoeba dispar
FIKIDKEEVCIASISGKNLNSPV

SEQ ID NO: 2481485 - protein, 19 aa, Entamoeba dispar
FIKIMKDNTAFIGIGDTGI

SEQ ID NO: 2481486 - protein, 17 aa, Entamoeba dispar
FIKNKMEPYGLVQKITI

SEQ ID NO: 2481487 - protein, 18 aa, Entamoeba dispar
FIKPCSLTPSQIFNSSYS

SEQ ID NO: 2481488 - protein, 19 aa, Entamoeba dispar
FIKPKSRFNLLLLEPGEQY

SEQ ID NO: 2481489 - protein, 22 aa, Entamoeba dispar
FIKQDINEFIIPPSITELGDNC

SEQ ID NO: 2481490 - protein, 25 aa, Entamoeba dispar
FIKRPEMFWKMCSELRKYTEGKKPT

SEQ ID NO: 2481491 - protein, 24 aa, Entamoeba dispar
FIKRSIRFQMNLHLALAQNNDLNV

SEQ ID NO: 2481492 - protein, 17 aa, Entamoeba dispar
FIKTFKPFIKSIPTNII

SEQ ID NO: 2481493 - protein, 21 aa, Entamoeba dispar
FIKTTFCFIQTIGIQCLQFPF

SEQ ID NO: 2481494 - protein, 17 aa, Entamoeba dispar
FIKTYSITLEFMIRVKM

SEQ ID NO: 2481495 - protein, 19 aa, Entamoeba dispar
FIKVMGRSASHIALEAALE

SEQ ID NO: 2481496 - protein, 19 aa, Entamoeba dispar
FILDFSWFSTEEVTENIVI

SEQ ID NO: 2481497 - protein, 17 aa, Entamoeba dispar
FILLKYQLEKDEQEAEA

SEQ ID NO: 2481498 - protein, 26 aa, Entamoeba dispar
FILLTPKTKFIWKGKFRNEKYVEFAV

SEQ ID NO: 2481499 - protein, 19 aa, Entamoeba dispar
FILTQKIVDTFSRYVQNPL

SEQ ID NO: 2481500 - protein, 22 aa, Entamoeba dispar
FILTTRVGGLGINLTGADRVIM

SEQ ID NO: 2481501 - protein, 18 aa, Entamoeba dispar
FILTTSIPSLIHPCLPPS

SEQ ID NO: 2481502 - protein, 19 aa, Entamoeba dispar
FINDLICLITTLTKSHFNI

SEQ ID NO: 2481503 - protein, 31 aa, Entamoeba dispar
FINGFCKTKGFFEWKKSLTLSGKAKKMTELF

SEQ ID NO: 2481504 - protein, 17 aa, Entamoeba dispar
FINHSFKSVSWNDPRPK

SEQ ID NO: 2481505 - protein, 19 aa, Entamoeba dispar
FINIICTFSRFGQTPEVNE

SEQ ID NO: 2481506 - protein, 23 aa, Entamoeba dispar
FINKLPLTLSIFIVHQNTFLSNP

SEQ ID NO: 2481507 - protein, 24 aa, Entamoeba dispar
FINKQECLDIVPPESPIENIQNTV

SEQ ID NO: 2481508 - protein, 29 aa, Entamoeba dispar
FINKRIENMLEWFNKMLFFVDLLKEKRDK

SEQ ID NO: 2481509 - protein, 25 aa, Entamoeba dispar
FINKYIECGYCYDKAGAYGIQDNAG

SEQ ID NO: 2481510 - protein, 17 aa, Entamoeba dispar
FINNCVDSLTSLLILRQ

SEQ ID NO: 2481511 - protein, 18 aa, Entamoeba dispar
FINPGEMVGSIAAQSIGA

SEQ ID NO: 2481512 - protein, 18 aa, Entamoeba dispar
FINPKSYLVNGVLKKEKE

SEQ ID NO: 2481513 - protein, 23 aa, Entamoeba dispar
FIPDKIICVRLIKGDAFEKQNDK

SEQ ID NO: 2481514 - protein, 29 aa, Entamoeba dispar
FIPIFKQKWILKLKEMMLFVVDLTEIKDK

SEQ ID NO: 2481515 - protein, 25 aa, Entamoeba dispar
FIPKCYKMIAKLCGGYNLEGINRYS

SEQ ID NO: 2481516 - protein, 26 aa, Entamoeba dispar
FIPLRMMRICRASFEKVIEALEKKLN

SEQ ID NO: 2481517 - protein, 18 aa, Entamoeba dispar
FIPPIGVKLDDEFANKLY

SEQ ID NO: 2481518 - protein, 23 aa, Entamoeba dispar
FIPSGLYMICLPYIDDVLTPLLS

SEQ ID NO: 2481519 - protein, 17 aa, Entamoeba dispar
FIPYLKVYYQFIGNSGV

SEQ ID NO: 2481520 - protein, 25 aa, Entamoeba dispar
FIQEMFEFRIQNFLDIYLHESSQST

SEQ ID NO: 2481521 - protein, 17 aa, Entamoeba dispar
FIQKKMMLISWMESILK

SEQ ID NO: 2481522 - protein, 23 aa, Entamoeba dispar
FIQNCLEQLTLMRVINQNIYDAY

SEQ ID NO: 2481523 - protein, 27 aa, Entamoeba dispar
FIQSLERSNCYLLKPRKSFSKNIPQEY

SEQ ID NO: 2481524 - protein, 20 aa, Entamoeba dispar
FIQYPACLYYLEQLQNPDFR

SEQ ID NO: 2481525 - protein, 21 aa, Entamoeba dispar
FIRCECNKLTLSQFGEEEIKI

SEQ ID NO: 2481526 - protein, 23 aa, Entamoeba dispar
FIRCGDVAQCDWISATHENEYIQ

SEQ ID NO: 2481527 - protein, 22 aa, Entamoeba dispar
FIRDWKKYYPTKVMLYSCKTTT

SEQ ID NO: 2481528 - protein, 19 aa, Entamoeba dispar
FIREFRVPVNTMVWQLAAG

SEQ ID NO: 2481529 - protein, 24 aa, Entamoeba dispar
FIRIKEIYSILGNDIFVILRNIAL

SEQ ID NO: 2481530 - protein, 23 aa, Entamoeba dispar
FIRKNFQLANLWVGKLNHQSVTE

SEQ ID NO: 2481531 - protein, 17 aa, Entamoeba dispar
FIRLKQPIICVSVRVNE

SEQ ID NO: 2481532 - protein, 18 aa, Entamoeba dispar
FIRMVSGFETCQKLINEL

SEQ ID NO: 2481533 - protein, 30 aa, Entamoeba dispar
FIRNNVNYLFCYRWIVLLFKRDFNSRDCLN

SEQ ID NO: 2481534 - protein, 19 aa, Entamoeba dispar
FIRNYPAVVSLLFELLDRL

SEQ ID NO: 2481535 - protein, 19 aa, Entamoeba dispar
FIRSEEWYFIKTKKEVIAL

SEQ ID NO: 2481536 - protein, 25 aa, Entamoeba dispar
FIRTNCGDWLKKVLEYLFENVQAKD

SEQ ID NO: 2481537 - protein, 25 aa, Entamoeba dispar
FIRVYDLRKGLIISDDIKKPLTSLS

SEQ ID NO: 2481538 - protein, 19 aa, Entamoeba dispar
FIRYKLRGSAEFAKVAMSD

SEQ ID NO: 2481539 - protein, 25 aa, Entamoeba dispar
FISAHKKYICRVIGYMGSCIVNKPI

SEQ ID NO: 2481540 - protein, 17 aa, Entamoeba dispar
FISCPIEYITCALSSRI

SEQ ID NO: 2481541 - protein, 23 aa, Entamoeba dispar
FISCVFPKVKRLYIQKRMIECDD

SEQ ID NO: 2481542 - protein, 19 aa, Entamoeba dispar
FISDIQWKPEVFGDSAIFA

SEQ ID NO: 2481543 - protein, 23 aa, Entamoeba dispar
FISEFKGSLQIIGIGKFNGKEFG

SEQ ID NO: 2481544 - protein, 19 aa, Entamoeba dispar
FISEQCNFIIEKMESLLKT

SEQ ID NO: 2481545 - protein, 24 aa, Entamoeba dispar
FISFNDIQTILSFVDNLNKTIPIT

SEQ ID NO: 2481546 - protein, 19 aa, Entamoeba dispar
FISGSADRTVHLWDIRSSS

SEQ ID NO: 2481547 - protein, 17 aa, Entamoeba dispar
FISKEIPSFYNVMKALL

SEQ ID NO: 2481548 - protein, 18 aa, Entamoeba dispar
FISLNVWEVVSSLSNDPE

SEQ ID NO: 2481549 - protein, 26 aa, Entamoeba dispar
FISNSMPFQFLSLHLSKSVIYIPSVG

SEQ ID NO: 2481550 - protein, 23 aa, Entamoeba dispar
FISRNRYEWYIAQYAMQKNGIIP

SEQ ID NO: 2481551 - protein, 18 aa, Entamoeba dispar
FISYEPWLNKLSKSKSNI

SEQ ID NO: 2481552 - protein, 27 aa, Entamoeba dispar
FITCDYCLPELLSLVAECVTNDSMNSL

SEQ ID NO: 2481553 - protein, 19 aa, Entamoeba dispar
FITINLCSVKILLLSNCTN

SEQ ID NO: 2481554 - protein, 25 aa, Entamoeba dispar
FITKSDMNDLCWFLPQIAIATNSGV

SEQ ID NO: 2481555 - protein, 17 aa, Entamoeba dispar
FITQKLQCVFVHINQFF

SEQ ID NO: 2481556 - protein, 18 aa, Entamoeba dispar
FITQKLQCVFVHINQFFV

SEQ ID NO: 2481557 - protein, 22 aa, Entamoeba dispar
FITRPIPTISFQILDMRPRPIP

SEQ ID NO: 2481558 - protein, 24 aa, Entamoeba dispar
FITSGKHKVLIASFIPGICEQVKL

SEQ ID NO: 2481559 - protein, 29 aa, Entamoeba dispar
FITSLQPCFPRYLSLLFPNDLPTTFWQRC

SEQ ID NO: 2481560 - protein, 20 aa, Entamoeba dispar
FITTKATSITSCFAQMELIR

SEQ ID NO: 2481561 - protein, 23 aa, Entamoeba dispar
FITVLRGTRGMRGGYRGNNRGNL

SEQ ID NO: 2481562 - protein, 18 aa, Entamoeba dispar
FIVCAKCNKKVCNTCATT

SEQ ID NO: 2481563 - protein, 17 aa, Entamoeba dispar
FIVEKMISYGILDILKE

SEQ ID NO: 2481564 - protein, 18 aa, Entamoeba dispar
FIVSKLLFWYFPSYSKKF

SEQ ID NO: 2481565 - protein, 22 aa, Entamoeba dispar
FIWMSIKRSFNFISSLIDGESK

SEQ ID NO: 2481566 - protein, 17 aa, Entamoeba dispar
FIWQENDSILFIKNDGT

SEQ ID NO: 2481567 - protein, 25 aa, Entamoeba dispar
FIWSWKKGKILKVFEHAHKGCVTDV

SEQ ID NO: 2481568 - protein, 17 aa, Entamoeba dispar
FIYFLRFHDEPTIVECL

SEQ ID NO: 2481569 - protein, 17 aa, Entamoeba dispar
FIYLKNFYQRINKIRYK

SEQ ID NO: 2481570 - protein, 17 aa, Entamoeba dispar
FKAAKKMLSKDSTKKKR

SEQ ID NO: 2481571 - protein, 34 aa, Entamoeba dispar
FKADVPAGYYDIRICTYSGLTRLAVYTRVFEVSK

SEQ ID NO: 2481572 - protein, 17 aa, Entamoeba dispar
FKANGYIQTKWMNELYL

SEQ ID NO: 2481573 - protein, 17 aa, Entamoeba dispar
FKAPPLITDQMILNIHL

SEQ ID NO: 2481574 - protein, 23 aa, Entamoeba dispar
FKASKYISCKIINYFTNNSVQMI

SEQ ID NO: 2481575 - protein, 17 aa, Entamoeba dispar
FKAVITVPANFSSEQRD

SEQ ID NO: 2481576 - protein, 18 aa, Entamoeba dispar
FKCGCGQLTECVCVTCRK

SEQ ID NO: 2481577 - protein, 20 aa, Entamoeba dispar
FKCHICKKICDPMMIRSIKF

SEQ ID NO: 2481578 - protein, 22 aa, Entamoeba dispar
FKCPIEFCECIANCLLPKEKRL

SEQ ID NO: 2481579 - protein, 35 aa, Entamoeba dispar
FKCRDEMKWAEFEYCILFPFNVLKMKSIKIMIKYP

SEQ ID NO: 2481580 - protein, 21 aa, Entamoeba dispar
FKCYPLYDFGVSIIDSIEGVT

SEQ ID NO: 2481581 - protein, 21 aa, Entamoeba dispar
FKDACLAAFQLGRQRIKEPMY

SEQ ID NO: 2481582 - protein, 20 aa, Entamoeba dispar
FKDCSFYSGESCDTDNGMVA

SEQ ID NO: 2481583 - protein, 25 aa, Entamoeba dispar
FKDDDAPIVYGFRPYMKEFIRKIDQ

SEQ ID NO: 2481584 - protein, 25 aa, Entamoeba dispar
FKDEEIPVVRSLSSFEGKDCGKNSY

SEQ ID NO: 2481585 - protein, 23 aa, Entamoeba dispar
FKDGIIFKHVIWYPVNRDKYGNT

SEQ ID NO: 2481586 - protein, 26 aa, Entamoeba dispar
FKDGKVFCALIHRHRPDLLDWETVGE

SEQ ID NO: 2481587 - protein, 20 aa, Entamoeba dispar
FKDGRICLDILQDKWSSVYS

SEQ ID NO: 2481588 - protein, 17 aa, Entamoeba dispar
FKDKCSFDELSQDKKQL

SEQ ID NO: 2481589 - protein, 21 aa, Entamoeba dispar
FKDKLKQLFNLIVPTIKNLKG

SEQ ID NO: 2481590 - protein, 24 aa, Entamoeba dispar
FKDLKEFYFNYNTIMEVSQAIASP

SEQ ID NO: 2481591 - protein, 23 aa, Entamoeba dispar
FKDPIKVRASHEYLFVNDSETKI

SEQ ID NO: 2481592 - protein, 21 aa, Entamoeba dispar
FKDVKHWKYWNLMKWVVEHKL

SEQ ID NO: 2481593 - protein, 21 aa, Entamoeba dispar
FKDYKLRIVDHKEIFPNNKDL

SEQ ID NO: 2481594 - protein, 19 aa, Entamoeba dispar
FKEAIRAGVNYKDSLFSKP

SEQ ID NO: 2481595 - protein, 25 aa, Entamoeba dispar
FKEAPHVFHVLKAMISVIDYNQNIP

SEQ ID NO: 2481596 - protein, 18 aa, Entamoeba dispar
FKEATKLGDQLALLNKEI

SEQ ID NO: 2481597 - protein, 18 aa, Entamoeba dispar
FKEEESPTLIQNVQTNLA

SEQ ID NO: 2481598 - protein, 26 aa, Entamoeba dispar
FKEESKELLIEIGFNKYAVQKQDIAD

SEQ ID NO: 2481599 - protein, 17 aa, Entamoeba dispar
FKEFIIEALQKPTKARI

SEQ ID NO: 2481600 - protein, 24 aa, Entamoeba dispar
FKEGFYSIIPFEMINCFYDTELEL

SEQ ID NO: 2481601 - protein, 20 aa, Entamoeba dispar
FKEGLKKLAAALAVGAKLGG

SEQ ID NO: 2481602 - protein, 21 aa, Entamoeba dispar
FKEIFKEKGFNNLKIVFDTED

SEQ ID NO: 2481603 - protein, 19 aa, Entamoeba dispar
FKEIFSFDDSATFERIKPI

SEQ ID NO: 2481604 - protein, 28 aa, Entamoeba dispar
FKEISDIGKIEWKKNIFDLLEKQIQEVV

SEQ ID NO: 2481605 - protein, 21 aa, Entamoeba dispar
FKEKYIWTDIINFEKEEQPFA

SEQ ID NO: 2481606 - protein, 18 aa, Entamoeba dispar
FKELAHAVIKYSSKGYLK

SEQ ID NO: 2481607 - protein, 21 aa, Entamoeba dispar
FKELCSSALLSLRKQGSLFIY

SEQ ID NO: 2481608 - protein, 24 aa, Entamoeba dispar
FKELIKILEIRKGILESSYLDECI

SEQ ID NO: 2481609 - protein, 17 aa, Entamoeba dispar
FKEMFKTKGQYQELPEN

SEQ ID NO: 2481610 - protein, 17 aa, Entamoeba dispar
FKENVFIYTNMVKSNKI

SEQ ID NO: 2481611 - protein, 21 aa, Entamoeba dispar
FKEQRRVIVEFSIDDMVKLHK

SEQ ID NO: 2481612 - protein, 17 aa, Entamoeba dispar
FKERVMAVYMRNYQAIV

SEQ ID NO: 2481613 - protein, 23 aa, Entamoeba dispar
FKESKDAWRIFGDKWYLRDEEYL

SEQ ID NO: 2481614 - protein, 21 aa, Entamoeba dispar
FKESPFSLIVQLFPCYIDLLI

SEQ ID NO: 2481615 - protein, 17 aa, Entamoeba dispar
FKESVISFRHCDDDDTR

SEQ ID NO: 2481616 - protein, 21 aa, Entamoeba dispar
FKEVIWYPVSYLTYLKEKEAG

SEQ ID NO: 2481617 - protein, 21 aa, Entamoeba dispar
FKEVVDRLAGATNNVQYAHIS

SEQ ID NO: 2481618 - protein, 25 aa, Entamoeba dispar
FKEYTRLKGINIYDGIKGEKERKNH

SEQ ID NO: 2481619 - protein, 17 aa, Entamoeba dispar
FKFLEGFEKRILNIHLY

SEQ ID NO: 2481620 - protein, 22 aa, Entamoeba dispar
FKFTPVHIRKGKYRFPGTDLWY

SEQ ID NO: 2481621 - protein, 17 aa, Entamoeba dispar
FKFTRQVATKFFDLAVS

SEQ ID NO: 2481622 - protein, 20 aa, Entamoeba dispar
FKFVLYEESKELPVTTDINN

SEQ ID NO: 2481623 - protein, 18 aa, Entamoeba dispar
FKGCISCDLDECFECPNG

SEQ ID NO: 2481624 - protein, 18 aa, Entamoeba dispar
FKGDEKLSLAKVLHSVEV

SEQ ID NO: 2481625 - protein, 20 aa, Entamoeba dispar
FKGDTGLLVYSLKDWVFTSI

SEQ ID NO: 2481626 - protein, 17 aa, Entamoeba dispar
FKGEIQMKFKEQQKLIE

SEQ ID NO: 2481627 - protein, 20 aa, Entamoeba dispar
FKGKASYGIYLFLEKNNIHC

SEQ ID NO: 2481628 - protein, 17 aa, Entamoeba dispar
FKGKIAIKEALLCTEDS

SEQ ID NO: 2481629 - protein, 17 aa, Entamoeba dispar
FKGNYLIEECLTIASKI

SEQ ID NO: 2481630 - protein, 18 aa, Entamoeba dispar
FKGTLMDVCCTFTSATEL

SEQ ID NO: 2481631 - protein, 26 aa, Entamoeba dispar
FKGTRSARKTIKMYRIKKMESPTKVI

SEQ ID NO: 2481632 - protein, 21 aa, Entamoeba dispar
FKGYCTKGNVQLPKFDFNVVV

SEQ ID NO: 2481633 - protein, 27 aa, Entamoeba dispar
FKGYPFTEWFWMIEFQDKYFGFQTIFT

SEQ ID NO: 2481634 - protein, 17 aa, Entamoeba dispar
FKHFYAFCRQYKMLGKE

SEQ ID NO: 2481635 - protein, 19 aa, Entamoeba dispar
FKHIRELLHIAEIHEEDEY

SEQ ID NO: 2481636 - protein, 17 aa, Entamoeba dispar
FKHISVIQALAKSGLIK

SEQ ID NO: 2481637 - protein, 17 aa, Entamoeba dispar
FKHKIGASWKKEYFWLS

SEQ ID NO: 2481638 - protein, 22 aa, Entamoeba dispar
FKHKVFSLKGAEFGWHSSGKKL

SEQ ID NO: 2481639 - protein, 19 aa, Entamoeba dispar
FKHRIIIQFENIFQLINTI

SEQ ID NO: 2481640 - protein, 21 aa, Entamoeba dispar
FKHTYGLPICKITAGKNADIH

SEQ ID NO: 2481641 - protein, 25 aa, Entamoeba dispar
FKIAYDYRCSLGMGITGYAAQEYIE

SEQ ID NO: 2481642 - protein, 19 aa, Entamoeba dispar
FKICIHCIQSTQLICACCN

SEQ ID NO: 2481643 - protein, 19 aa, Entamoeba dispar
FKIDEVYKNLTRVEQVEPN

SEQ ID NO: 2481644 - protein, 19 aa, Entamoeba dispar
FKIDVSILCKKDNLTRRSV

SEQ ID NO: 2481645 - protein, 18 aa, Entamoeba dispar
FKIFEDIANGVAACHRFD

SEQ ID NO: 2481646 - protein, 19 aa, Entamoeba dispar
FKIGMTYTSNGWYIMQCEP

SEQ ID NO: 2481647 - protein, 34 aa, Entamoeba dispar
FKIHELRCRKMYKICPFCGKKLLINSEELQKHLD

SEQ ID NO: 2481648 - protein, 20 aa, Entamoeba dispar
FKIKDILDYMLTQNKITNNS

SEQ ID NO: 2481649 - protein, 20 aa, Entamoeba dispar
FKIKLPRLTINKMDEVLEYE

SEQ ID NO: 2481650 - protein, 17 aa, Entamoeba dispar
FKIKRFGKKPIEVGSII

SEQ ID NO: 2481651 - protein, 20 aa, Entamoeba dispar
FKIPTSLLYLYLPKPKNYYQ

SEQ ID NO: 2481652 - protein, 19 aa, Entamoeba dispar
FKIQIQPAINHLKSAAYIF

SEQ ID NO: 2481653 - protein, 20 aa, Entamoeba dispar
FKIQVATIIIFKGYSKENFN

SEQ ID NO: 2481654 - protein, 19 aa, Entamoeba dispar
FKIRRYEKFLGVKEEEVSE

SEQ ID NO: 2481655 - protein, 20 aa, Entamoeba dispar
FKITKDIQCSLYYFHSVLLN

SEQ ID NO: 2481656 - protein, 29 aa, Entamoeba dispar
FKIYYNKEMFKLVCCPLFVGFFSRNICLS

SEQ ID NO: 2481657 - protein, 18 aa, Entamoeba dispar
FKKAISICINDCYETVIR

SEQ ID NO: 2481658 - protein, 17 aa, Entamoeba dispar
FKKALSDSFVKSVNQGV

SEQ ID NO: 2481659 - protein, 21 aa, Entamoeba dispar
FKKDFYVESPITLNRNIEEVS

SEQ ID NO: 2481660 - protein, 20 aa, Entamoeba dispar
FKKDINEFIIPSSINKLGYR

SEQ ID NO: 2481661 - protein, 20 aa, Entamoeba dispar
FKKDINEFIIPSSISELGFS

SEQ ID NO: 2481662 - protein, 20 aa, Entamoeba dispar
FKKDINEFIIPSSISKLGDS

SEQ ID NO: 2481663 - protein, 20 aa, Entamoeba dispar
FKKDINEFIIPSSITKIGYG

SEQ ID NO: 2481664 - protein, 20 aa, Entamoeba dispar
FKKDINEFIIPSSITKLDRQ

SEQ ID NO: 2481665 - protein, 20 aa, Entamoeba dispar
FKKDINEFIIPSSITKLGDR

SEQ ID NO: 2481666 - protein, 20 aa, Entamoeba dispar
FKKDINEFIIPSSITKLGSG

SEQ ID NO: 2481667 - protein, 20 aa, Entamoeba dispar
FKKDINEFIIPSSITKLGYG

SEQ ID NO: 2481668 - protein, 20 aa, Entamoeba dispar
FKKDINEFIIPSSITKLGYR

SEQ ID NO: 2481669 - protein, 21 aa, Entamoeba dispar
FKKDINEFIIPSSITKVGSGC

SEQ ID NO: 2481670 - protein, 20 aa, Entamoeba dispar
FKKDINKFIIPSSITKLDDW

SEQ ID NO: 2481671 - protein, 20 aa, Entamoeba dispar
FKKDINKFIIPSSITKVGDY

SEQ ID NO: 2481672 - protein, 22 aa, Entamoeba dispar
FKKEEESCCEILFSSIIKGYQV

SEQ ID NO: 2481673 - protein, 21 aa, Entamoeba dispar
FKKEEKFEERQLKQLKPKEKP

SEQ ID NO: 2481674 - protein, 18 aa, Entamoeba dispar
FKKGEIVIIIGNIENGWI

SEQ ID NO: 2481675 - protein, 20 aa, Entamoeba dispar
FKKGSSMLSVECVDGDIKAM

SEQ ID NO: 2481676 - protein, 35 aa, Entamoeba dispar
FKKINCKIADFILRESRYLKAHFIIIYDSPINCQL

SEQ ID NO: 2481677 - protein, 26 aa, Entamoeba dispar
FKKISMINFLIFIYGYDLHEVVNAPQ

SEQ ID NO: 2481678 - protein, 17 aa, Entamoeba dispar
FKKKEFIVDGTHIVSQI

SEQ ID NO: 2481679 - protein, 22 aa, Entamoeba dispar
FKKKPFPPARIRKITKINTNNK

SEQ ID NO: 2481680 - protein, 19 aa, Entamoeba dispar
FKKKQCFISSQVKHYKKMK

SEQ ID NO: 2481681 - protein, 23 aa, Entamoeba dispar
FKKLGIRPSHGVLLYGPSGCAKT

SEQ ID NO: 2481682 - protein, 18 aa, Entamoeba dispar
FKKLIKYLPQFTSSVIVG

SEQ ID NO: 2481683 - protein, 27 aa, Entamoeba dispar
FKKLKITPFSGGFIFMYDIRYITDLIR

SEQ ID NO: 2481684 - protein, 17 aa, Entamoeba dispar
FKKLYLLRDKIARIEDE

SEQ ID NO: 2481685 - protein, 21 aa, Entamoeba dispar
FKKMGELDCSLFPLQEEEIEF

SEQ ID NO: 2481686 - protein, 20 aa, Entamoeba dispar
FKKNAKWSINKNVPNFGDET

SEQ ID NO: 2481687 - protein, 24 aa, Entamoeba dispar
FKKNLKSKCKFILKRGNDKKTITQ

SEQ ID NO: 2481688 - protein, 21 aa, Entamoeba dispar
FKKQILMYLVPLKLRCGMYLP

SEQ ID NO: 2481689 - protein, 19 aa, Entamoeba dispar
FKKVWRAYANYARRRKNIP

SEQ ID NO: 2481690 - protein, 19 aa, Entamoeba dispar
FKLDITLRYYKGDKIESSR

SEQ ID NO: 2481691 - protein, 19 aa, Entamoeba dispar
FKLDLEIVKQLLGTASSCG

SEQ ID NO: 2481692 - protein, 19 aa, Entamoeba dispar
FKLEVKIIRCIDNQEKTTL

SEQ ID NO: 2481693 - protein, 18 aa, Entamoeba dispar
FKLFTIERIKTKSPSNQK

SEQ ID NO: 2481694 - protein, 18 aa, Entamoeba dispar
FKLHCYIAKDNEYSVRIR

SEQ ID NO: 2481695 - protein, 21 aa, Entamoeba dispar
FKLKLPISCTCFEDLSDSLTP

SEQ ID NO: 2481696 - protein, 33 aa, Entamoeba dispar
FKLLASSCVYFFLKEFIPIFQFNPCLIFGETFT

SEQ ID NO: 2481697 - protein, 17 aa, Entamoeba dispar
FKLLRLASQTDNVGVVN

SEQ ID NO: 2481698 - protein, 19 aa, Entamoeba dispar
FKLLVGRLPFELMQMDSLS

SEQ ID NO: 2481699 - protein, 17 aa, Entamoeba dispar
FKLPDNYKIIIQTESIK

SEQ ID NO: 2481700 - protein, 19 aa, Entamoeba dispar
FKLQKHFKDFVGQFAEQKC

SEQ ID NO: 2481701 - protein, 20 aa, Entamoeba dispar
FKLSEKVIPIYGSIEPGSNI

SEQ ID NO: 2481702 - protein, 25 aa, Entamoeba dispar
FKLSLKRPIPLVGFCTYFEADISNH

SEQ ID NO: 2481703 - protein, 19 aa, Entamoeba dispar
FKLSLQLLVKEVSNLWDDF

SEQ ID NO: 2481704 - protein, 20 aa, Entamoeba dispar
FKLTLCCLPIFELYGIFLLQ

SEQ ID NO: 2481705 - protein, 21 aa, Entamoeba dispar
FKLVSHFPSIIAYDANKIFII

SEQ ID NO: 2481706 - protein, 18 aa, Entamoeba dispar
FKLYENPSRISISVNKHL

SEQ ID NO: 2481707 - protein, 17 aa, Entamoeba dispar
FKLYRKLFDILASPLKF

SEQ ID NO: 2481708 - protein, 18 aa, Entamoeba dispar
FKMIGKFDGKIKFFNGNF

SEQ ID NO: 2481709 - protein, 17 aa, Entamoeba dispar
FKMKGAGSCCLVLQSLL

SEQ ID NO: 2481710 - protein, 22 aa, Entamoeba dispar
FKMKNNEMISNFLVDEESPFFN

SEQ ID NO: 2481711 - protein, 21 aa, Entamoeba dispar
FKMPCKEILHGVGPIGENAIQ

SEQ ID NO: 2481712 - protein, 33 aa, Entamoeba dispar
FKMTEPQMAYVLREVMKGLLYLHQRHKIHRDIK

SEQ ID NO: 2481713 - protein, 22 aa, Entamoeba dispar
FKNASKVFLTYSLTNGDSVRTL

SEQ ID NO: 2481714 - protein, 22 aa, Entamoeba dispar
FKNCLRLSSIYLPSRLLKLKSN

SEQ ID NO: 2481715 - protein, 19 aa, Entamoeba dispar
FKNDLFSAFIYSFEHDITI

SEQ ID NO: 2481716 - protein, 24 aa, Entamoeba dispar
FKNEFKLKVLNFLTLLLDTNQTEE

SEQ ID NO: 2481717 - protein, 17 aa, Entamoeba dispar
FKNEKGIVGEKEYLNER

SEQ ID NO: 2481718 - protein, 21 aa, Entamoeba dispar
FKNGCKIGNETYCYQCKEEFI

SEQ ID NO: 2481719 - protein, 31 aa, Entamoeba dispar
FKNGCKIGNETYCYQCKEGFIKENGECKKID

SEQ ID NO: 2481720 - protein, 21 aa, Entamoeba dispar
FKNGCKIGNETYCYQCKEGYI

SEQ ID NO: 2481721 - protein, 18 aa, Entamoeba dispar
FKNICSLLPTETKQTDVI

SEQ ID NO: 2481722 - protein, 25 aa, Entamoeba dispar
FKNIGIKPPRGILLYGPPGCGKTMI

SEQ ID NO: 2481723 - protein, 20 aa, Entamoeba dispar
FKNKVPHDFSKKGVDYEIND

SEQ ID NO: 2481724 - protein, 18 aa, Entamoeba dispar
FKNPEEWINNLVESDELI

SEQ ID NO: 2481725 - protein, 20 aa, Entamoeba dispar
FKNPKLWTTQLVDFVAQCLI

SEQ ID NO: 2481726 - protein, 23 aa, Entamoeba dispar
FKNRPKRRFNRRPGYANRNNRGR

SEQ ID NO: 2481727 - protein, 19 aa, Entamoeba dispar
FKNSFCFEQGVLLYLLNQY

SEQ ID NO: 2481728 - protein, 19 aa, Entamoeba dispar
FKNSFSMIMGTIVSKEPNK

SEQ ID NO: 2481729 - protein, 20 aa, Entamoeba dispar
FKNSLDLFKLHSLPSSSFSI

SEQ ID NO: 2481730 - protein, 18 aa, Entamoeba dispar
FKNTIKAMRTMNITDDEQ

SEQ ID NO: 2481731 - protein, 20 aa, Entamoeba dispar
FKNYFSRYGELFDYTILIDK

SEQ ID NO: 2481732 - protein, 30 aa, Entamoeba dispar
FKPEIQNGRFIPTILYGARASIPGVKNNSD

SEQ ID NO: 2481733 - protein, 30 aa, Entamoeba dispar
FKPEIQNGRFIPTILYGARASIPGVKNNTE

SEQ ID NO: 2481734 - protein, 26 aa, Entamoeba dispar
FKPELQNGRFIPCVLYGAKAQLPGMN

SEQ ID NO: 2481735 - protein, 27 aa, Entamoeba dispar
FKPELQNGRFIPCVLYGAKAQLPGMTG

SEQ ID NO: 2481736 - protein, 17 aa, Entamoeba dispar
FKPFPFNLKYVLQGVTY

SEQ ID NO: 2481737 - protein, 22 aa, Entamoeba dispar
FKPFYFRIFLMYRKLTWTSGHI

SEQ ID NO: 2481738 - protein, 25 aa, Entamoeba dispar
FKPGMHPRIRLDILHEVEKRIPGFP

SEQ ID NO: 2481739 - protein, 19 aa, Entamoeba dispar
FKPIKCFSIDRVFRNETVD

SEQ ID NO: 2481740 - protein, 21 aa, Entamoeba dispar
FKPILGEKVSEIFEGKHTRFV

SEQ ID NO: 2481741 - protein, 20 aa, Entamoeba dispar
FKPIPSYSINLWSVLITGFK

SEQ ID NO: 2481742 - protein, 17 aa, Entamoeba dispar
FKPKILNIRNKTVKMQI

SEQ ID NO: 2481743 - protein, 19 aa, Entamoeba dispar
FKPKPRVGPKGKLAKKETP

SEQ ID NO: 2481744 - protein, 22 aa, Entamoeba dispar
FKPNLKTSFPLTDEELQTIKPK

SEQ ID NO: 2481745 - protein, 25 aa, Entamoeba dispar
FKPSIPEQQLEPFINYLFNISNQDN

SEQ ID NO: 2481746 - protein, 17 aa, Entamoeba dispar
FKPVIKQKYIEASLGLV

SEQ ID NO: 2481747 - protein, 22 aa, Entamoeba dispar
FKQELVKILTLKTPASYWSFQK

SEQ ID NO: 2481748 - protein, 20 aa, Entamoeba dispar
FKQIFQFMKTYFHYHDTDVQ

SEQ ID NO: 2481749 - protein, 18 aa, Entamoeba dispar
FKQIYKLFEKCPYYEKYF

SEQ ID NO: 2481750 - protein, 23 aa, Entamoeba dispar
FKQQRFLEYNAELGAHEGRVHKN

SEQ ID NO: 2481751 - protein, 23 aa, Entamoeba dispar
FKQQRFLEYNAERGLFDEVNKVF

SEQ ID NO: 2481752 - protein, 23 aa, Entamoeba dispar
FKQQRFLEYNAERGLFDEVYKIF

SEQ ID NO: 2481753 - protein, 23 aa, Entamoeba dispar
FKQQRFLEYNSERGLFDEVYKIF

SEQ ID NO: 2481754 - protein, 22 aa, Entamoeba dispar
FKQRVSFEERKAFAIQLRQKKP

SEQ ID NO: 2481755 - protein, 17 aa, Entamoeba dispar
FKQTILKRIKKIDELND

SEQ ID NO: 2481756 - protein, 17 aa, Entamoeba dispar
FKQTITFFKSSILENRL

SEQ ID NO: 2481757 - protein, 21 aa, Entamoeba dispar
FKQVIWYLVNYSIYFKEKEQG

SEQ ID NO: 2481758 - protein, 20 aa, Entamoeba dispar
FKQVIWYQVEYWRYLFEKKQ

SEQ ID NO: 2481759 - protein, 25 aa, Entamoeba dispar
FKQYCVDESLIGRLWSHFSQEFYPK

SEQ ID NO: 2481760 - protein, 18 aa, Entamoeba dispar
FKQYLPTIIPILLSELTK

SEQ ID NO: 2481761 - protein, 20 aa, Entamoeba dispar
FKRDSAFRDWLLQKLVNGER

SEQ ID NO: 2481762 - protein, 27 aa, Entamoeba dispar
FKREYPEIKISYGLVKKVLEQQGLLPP

SEQ ID NO: 2481763 - protein, 20 aa, Entamoeba dispar
FKRISYVHALEEKFGEKIPR

SEQ ID NO: 2481764 - protein, 24 aa, Entamoeba dispar
FKRKKRLSGLSSLFTKRKPDRSVT

SEQ ID NO: 2481765 - protein, 17 aa, Entamoeba dispar
FKRKKYDDWSIPKCVLT

SEQ ID NO: 2481766 - protein, 17 aa, Entamoeba dispar
FKRLFFGNQELKRRNEV

SEQ ID NO: 2481767 - protein, 26 aa, Entamoeba dispar
FKRLQWAHQSFWSRAFLVIYPQPFGE

SEQ ID NO: 2481768 - protein, 21 aa, Entamoeba dispar
FKRNDCKIALNPFNFMNRLEE

SEQ ID NO: 2481769 - protein, 23 aa, Entamoeba dispar
FKRRTDICMRRAFTVDSDKTKIR

SEQ ID NO: 2481770 - protein, 17 aa, Entamoeba dispar
FKRSEVKINSYLNSMMR

SEQ ID NO: 2481771 - protein, 22 aa, Entamoeba dispar
FKRVKIYECYHSYDELVAVLKQ

SEQ ID NO: 2481772 - protein, 29 aa, Entamoeba dispar
FKSCHCVECLYWLAPEVIETSTFELESDV

SEQ ID NO: 2481773 - protein, 28 aa, Entamoeba dispar
FKSDCWSVGCVLYCLITGNFYKLSYNKT

SEQ ID NO: 2481774 - protein, 19 aa, Entamoeba dispar
FKSDLRQIGPLPPPPENYE

SEQ ID NO: 2481775 - protein, 19 aa, Entamoeba dispar
FKSHFNSIFVIVKKIPSEL

SEQ ID NO: 2481776 - protein, 18 aa, Entamoeba dispar
FKSHLCIVFELLSINLYD

SEQ ID NO: 2481777 - protein, 18 aa, Entamoeba dispar
FKSKREFEEDNNIYTEPN

SEQ ID NO: 2481778 - protein, 24 aa, Entamoeba dispar
FKSKYIEILGCLISSNSLMVKLEV

SEQ ID NO: 2481779 - protein, 19 aa, Entamoeba dispar
FKSKYNIIGNNELGEGAFS

SEQ ID NO: 2481780 - protein, 26 aa, Entamoeba dispar
FKSLDTWKKEFLNGANVTNPNDFPFV

SEQ ID NO: 2481781 - protein, 22 aa, Entamoeba dispar
FKSLEKFEVIKILIEIIKKNLS

SEQ ID NO: 2481782 - protein, 22 aa, Entamoeba dispar
FKSLKKMKVLNCNNINCNNLNS

SEQ ID NO: 2481783 - protein, 29 aa, Entamoeba dispar
FKSNGIKWVFWDVCGQAKFRSLWKSYYTN

SEQ ID NO: 2481784 - protein, 20 aa, Entamoeba dispar
FKSNGKYAIILGKILNECNL

SEQ ID NO: 2481785 - protein, 24 aa, Entamoeba dispar
FKSNLEQIKCLILNQQPPASSSIQ

SEQ ID NO: 2481786 - protein, 28 aa, Entamoeba dispar
FKSNYCIPLILAKCFKIIDEYQYQPSSP

SEQ ID NO: 2481787 - protein, 22 aa, Entamoeba dispar
FKSSFADGIYGFVIDVPSHRSA

SEQ ID NO: 2481788 - protein, 18 aa, Entamoeba dispar
FKSYARKTTIGKFDSKFN

SEQ ID NO: 2481789 - protein, 20 aa, Entamoeba dispar
FKTACSSIWGLIKPTIDKLN

SEQ ID NO: 2481790 - protein, 18 aa, Entamoeba dispar
FKTAGVALADEFSKVLFG

SEQ ID NO: 2481791 - protein, 17 aa, Entamoeba dispar
FKTAITIWDVLSNKLLF

SEQ ID NO: 2481792 - protein, 21 aa, Entamoeba dispar
FKTALSNLIDLVFEIDKELLN

SEQ ID NO: 2481793 - protein, 17 aa, Entamoeba dispar
FKTATIGAMGLRNPTKV

SEQ ID NO: 2481794 - protein, 19 aa, Entamoeba dispar
FKTIGKFCVSQHDRVCAVL

SEQ ID NO: 2481795 - protein, 20 aa, Entamoeba dispar
FKTKCFNDGRIFEYSGCLRD

SEQ ID NO: 2481796 - protein, 24 aa, Entamoeba dispar
FKTKIIYLALMVNWILKADETGEL

SEQ ID NO: 2481797 - protein, 25 aa, Entamoeba dispar
FKTKRSCKEIIDILKKCQEPINVNE

SEQ ID NO: 2481798 - protein, 24 aa, Entamoeba dispar
FKTKRSQIEYCFNQYPLYAEKLLQ

SEQ ID NO: 2481799 - protein, 18 aa, Entamoeba dispar
FKTKSLIECEQFSSRIEK

SEQ ID NO: 2481800 - protein, 18 aa, Entamoeba dispar
FKTLCSPKKIIGADLPCN

SEQ ID NO: 2481801 - protein, 21 aa, Entamoeba dispar
FKTLPVQVLLKLQQRKLDIDT

SEQ ID NO: 2481802 - protein, 27 aa, Entamoeba dispar
FKTPEECTSKCCCFYVSLNHQQLPMKV

SEQ ID NO: 2481803 - protein, 23 aa, Entamoeba dispar
FKTPRVSFMGMITPYVPPKNENN

SEQ ID NO: 2481804 - protein, 21 aa, Entamoeba dispar
FKTSKVCLQFFKIETLKFSDT

SEQ ID NO: 2481805 - protein, 20 aa, Entamoeba dispar
FKTTCSSIWGLIKPTIDKLN

SEQ ID NO: 2481806 - protein, 19 aa, Entamoeba dispar
FKTYLSRISAIDAMVNSFI

SEQ ID NO: 2481807 - protein, 25 aa, Entamoeba dispar
FKVDVWSCGVLMYTLAVGRNPFEFN

SEQ ID NO: 2481808 - protein, 17 aa, Entamoeba dispar
FKVGDIPVICEGFEKGV

SEQ ID NO: 2481809 - protein, 20 aa, Entamoeba dispar
FKVGEIYEGIVVAKREKIML

SEQ ID NO: 2481810 - protein, 20 aa, Entamoeba dispar
FKVNSSFVVKHFLDVTFKEP

SEQ ID NO: 2481811 - protein, 17 aa, Entamoeba dispar
FKWCESLTSLSIPSNIK

SEQ ID NO: 2481812 - protein, 20 aa, Entamoeba dispar
FKYCFEVIRVDVLRNVKKLG

SEQ ID NO: 2481813 - protein, 19 aa, Entamoeba dispar
FKYCPKCGNNKFLIETFKS

SEQ ID NO: 2481814 - protein, 19 aa, Entamoeba dispar
FKYGTAFGGDKLDDMSKIL

SEQ ID NO: 2481815 - protein, 20 aa, Entamoeba dispar
FKYIEACARSGQFQELARVV

SEQ ID NO: 2481816 - protein, 21 aa, Entamoeba dispar
FKYIIGEAFLIKNYPRIQTVI

SEQ ID NO: 2481817 - protein, 20 aa, Entamoeba dispar
FKYISNFSWNVQKKIFIELI

SEQ ID NO: 2481818 - protein, 18 aa, Entamoeba dispar
FKYLNKVQIKSLYNKHHR

SEQ ID NO: 2481819 - protein, 19 aa, Entamoeba dispar
FKYPLDFASVTSMVPAKGS

SEQ ID NO: 2481820 - protein, 21 aa, Entamoeba dispar
FKYSPYESFIFRSNLGNDISS

SEQ ID NO: 2481821 - protein, 19 aa, Entamoeba dispar
FKYVIWYDISYSIYLKEKG

SEQ ID NO: 2481822 - protein, 22 aa, Entamoeba dispar
FKYVIWYKVRYSTYLKEKEQGN

SEQ ID NO: 2481823 - protein, 20 aa, Entamoeba dispar
FKYVRAIGAFYLRLVGSSKE

SEQ ID NO: 2481824 - protein, 21 aa, Entamoeba dispar
FKYYRLNTLRTKVFPSISNKV

SEQ ID NO: 2481825 - protein, 21 aa, Entamoeba dispar
FLADEIKVLLKGNNEIIELDH

SEQ ID NO: 2481826 - protein, 18 aa, Entamoeba dispar
FLAIAGFGNLPGDVEIYD

SEQ ID NO: 2481827 - protein, 19 aa, Entamoeba dispar
FLAPELFFNPEIFSSDFTT

SEQ ID NO: 2481828 - protein, 18 aa, Entamoeba dispar
FLAVAGFGNCPGEVDVYE

SEQ ID NO: 2481829 - protein, 24 aa, Entamoeba dispar
FLCIQCAGLHRGLGVHLTFVRSVD

SEQ ID NO: 2481830 - protein, 18 aa, Entamoeba dispar
FLCRDCSNCHKNQLKSTI

SEQ ID NO: 2481831 - protein, 20 aa, Entamoeba dispar
FLCYFKVELYYGEKPLCPAL

SEQ ID NO: 2481832 - protein, 18 aa, Entamoeba dispar
FLDARPINPCISSSNEQL

SEQ ID NO: 2481833 - protein, 21 aa, Entamoeba dispar
FLDEIPFALTLPEPTQTIQSS

SEQ ID NO: 2481834 - protein, 25 aa, Entamoeba dispar
FLDRLGNDLPLIIFLSTKVEYREYA

SEQ ID NO: 2481835 - protein, 19 aa, Entamoeba dispar
FLDRLNLRIDQSNERIKVL

SEQ ID NO: 2481836 - protein, 24 aa, Entamoeba dispar
FLDYSQCIPLSITGSYEYPIESDT

SEQ ID NO: 2481837 - protein, 19 aa, Entamoeba dispar
FLEEMMSTVGIDFEFKELK

SEQ ID NO: 2481838 - protein, 27 aa, Entamoeba dispar
FLEGKTFYGICIQRNPLQFIGFGNRIL

SEQ ID NO: 2481839 - protein, 21 aa, Entamoeba dispar
FLEKMGFLMVGEYDYIELYKK

SEQ ID NO: 2481840 - protein, 17 aa, Entamoeba dispar
FLEKVFPLIEKYTRISK

SEQ ID NO: 2481841 - protein, 28 aa, Entamoeba dispar
FLELQPSLDYPTLHLIIYNVPKTFDKSQ

SEQ ID NO: 2481842 - protein, 18 aa, Entamoeba dispar
FLEYMKGIHNTILESCNQ

SEQ ID NO: 2481843 - protein, 20 aa, Entamoeba dispar
FLEYRHCELLDEISVLREMN

SEQ ID NO: 2481844 - protein, 19 aa, Entamoeba dispar
FLFCSYLSNRFSEFNEKTI

SEQ ID NO: 2481845 - protein, 17 aa, Entamoeba dispar
FLFDFTLDQQRLIKNFL

SEQ ID NO: 2481846 - protein, 19 aa, Entamoeba dispar
FLFHGHVCIVTELLSINLY

SEQ ID NO: 2481847 - protein, 17 aa, Entamoeba dispar
FLFIGPIYGNYIKGELK

SEQ ID NO: 2481848 - protein, 17 aa, Entamoeba dispar
FLFNIERLLNMIIQTKA

SEQ ID NO: 2481849 - protein, 23 aa, Entamoeba dispar
FLFTRRSHLNWSKFDKNESSLIK

SEQ ID NO: 2481850 - protein, 25 aa, Entamoeba dispar
FLFVLNGKGAYPFKLERKDTLRSFT

SEQ ID NO: 2481851 - protein, 17 aa, Entamoeba dispar
FLGDIALGLRYLHFTKG

SEQ ID NO: 2481852 - protein, 25 aa, Entamoeba dispar
FLGEGWRPLYQRTFTTFAKLWKLQQ

SEQ ID NO: 2481853 - protein, 21 aa, Entamoeba dispar
FLGERYMRFDPVLPDNLDLDC

SEQ ID NO: 2481854 - protein, 18 aa, Entamoeba dispar
FLHDKHLKHFGLLQLIMF

SEQ ID NO: 2481855 - protein, 18 aa, Entamoeba dispar
FLHESPWERLRLLRKRIP

SEQ ID NO: 2481856 - protein, 26 aa, Entamoeba dispar
FLHLFVIKKDKCFPIGDKSLDQPIEL

SEQ ID NO: 2481857 - protein, 21 aa, Entamoeba dispar
FLHTSVFCVGRYCDWIHNYAP

SEQ ID NO: 2481858 - protein, 19 aa, Entamoeba dispar
FLICPFCGSEFVVEQPFVM

SEQ ID NO: 2481859 - protein, 17 aa, Entamoeba dispar
FLIDCLREFNYQFDSKY

SEQ ID NO: 2481860 - protein, 29 aa, Entamoeba dispar
FLIEGKFNCCWKVTVKDVRIIIWQMKECK

SEQ ID NO: 2481861 - protein, 17 aa, Entamoeba dispar
FLIEIPLFYNSFDSNWN

SEQ ID NO: 2481862 - protein, 18 aa, Entamoeba dispar
FLIIGYDLNQPFSLTPKY

SEQ ID NO: 2481863 - protein, 17 aa, Entamoeba dispar
FLIKEFKEDCELNQIYT

SEQ ID NO: 2481864 - protein, 17 aa, Entamoeba dispar
FLINYSAGNVLRPHVFA

SEQ ID NO: 2481865 - protein, 17 aa, Entamoeba dispar
FLIPEIDFSPLFDPTQI

SEQ ID NO: 2481866 - protein, 17 aa, Entamoeba dispar
FLIRGIGSLLFENIKGV

SEQ ID NO: 2481867 - protein, 23 aa, Entamoeba dispar
FLKAKCKKVKEYFINYFDKKVQV

SEQ ID NO: 2481868 - protein, 24 aa, Entamoeba dispar
FLKCVSTIHPRCIYTSGKASSAAG

SEQ ID NO: 2481869 - protein, 21 aa, Entamoeba dispar
FLKDGCIIGGNLLGKIITKVQ

SEQ ID NO: 2481870 - protein, 27 aa, Entamoeba dispar
FLKDNDFSYDWIASIQVPIQDNLENEN

SEQ ID NO: 2481871 - protein, 24 aa, Entamoeba dispar
FLKGYYKACIEVNYILPSEFLEYH

SEQ ID NO: 2481872 - protein, 19 aa, Entamoeba dispar
FLKKMGYNFQSRLTEGKKD

SEQ ID NO: 2481873 - protein, 25 aa, Entamoeba dispar
FLKNARIADQIPFIIVCDKHGYVEE

SEQ ID NO: 2481874 - protein, 19 aa, Entamoeba dispar
FLKNVIIKKEIVPFRKHNG

SEQ ID NO: 2481875 - protein, 19 aa, Entamoeba dispar
FLKTLKYIHDYGFSYLTQE

SEQ ID NO: 2481876 - protein, 20 aa, Entamoeba dispar
FLKVIKPQASEEWIETMNKQ

SEQ ID NO: 2481877 - protein, 18 aa, Entamoeba dispar
FLKVNLWNFDYCDSCYNL

SEQ ID NO: 2481878 - protein, 21 aa, Entamoeba dispar
FLLHRLNTLSSLPFVEDPLTL

SEQ ID NO: 2481879 - protein, 32 aa, Entamoeba dispar
FLLKKAFECCVIKSQFKALVEVLSQAILNMDF

SEQ ID NO: 2481880 - protein, 19 aa, Entamoeba dispar
FLLKMVAAAREFMGSTTID

SEQ ID NO: 2481881 - protein, 20 aa, Entamoeba dispar
FLLNIAFYFETVQDLITLSF

SEQ ID NO: 2481882 - protein, 18 aa, Entamoeba dispar
FLLPEIFNMKELDEIFES

SEQ ID NO: 2481883 - protein, 19 aa, Entamoeba dispar
FLLSNVKYYAEEFGFDGFR

SEQ ID NO: 2481884 - protein, 24 aa, Entamoeba dispar
FLLSTRAGGLGINLTTADTVIIYD

SEQ ID NO: 2481885 - protein, 22 aa, Entamoeba dispar
FLLSTRSGGLGINLQSADTVIL

SEQ ID NO: 2481886 - protein, 18 aa, Entamoeba dispar
FLLTSIEWGCGEGMMGYP

SEQ ID NO: 2481887 - protein, 17 aa, Entamoeba dispar
FLLVGWTPFLRCLFEIE

SEQ ID NO: 2481888 - protein, 19 aa, Entamoeba dispar
FLMDRSCKVKQDLKSKRNV

SEQ ID NO: 2481889 - protein, 18 aa, Entamoeba dispar
FLMGCKAKLFGDDETFKL

SEQ ID NO: 2481890 - protein, 21 aa, Entamoeba dispar
FLMNIKEVFFQKEGKEYKGHI

SEQ ID NO: 2481891 - protein, 17 aa, Entamoeba dispar
FLMPKSKALALVEFEIA

SEQ ID NO: 2481892 - protein, 23 aa, Entamoeba dispar
FLMQYPTRLAWRPFDLSQVKEVR

SEQ ID NO: 2481893 - protein, 21 aa, Entamoeba dispar
FLMTKPINWYWERLMSEDQVT

SEQ ID NO: 2481894 - protein, 17 aa, Entamoeba dispar
FLNCSSLKSIELPTSLI

SEQ ID NO: 2481895 - protein, 24 aa, Entamoeba dispar
FLNELLDLLHLIAMNKEITKMNIE

SEQ ID NO: 2481896 - protein, 25 aa, Entamoeba dispar
FLNELLDLLHLIAMNKEITKMNIEN

SEQ ID NO: 2481897 - protein, 17 aa, Entamoeba dispar
FLNEQFISFIKLNSQDN

SEQ ID NO: 2481898 - protein, 22 aa, Entamoeba dispar
FLNGGFWLSVDIFNKLLPHQRT

SEQ ID NO: 2481899 - protein, 20 aa, Entamoeba dispar
FLNGGGCMHCSGQINQHTTS

SEQ ID NO: 2481900 - protein, 23 aa, Entamoeba dispar
FLNGKTCIFFRWTSDMKQPHIDR

SEQ ID NO: 2481901 - protein, 19 aa, Entamoeba dispar
FLNINCGQALDFRLISLYV

SEQ ID NO: 2481902 - protein, 18 aa, Entamoeba dispar
FLNIVYITCFLKEQDEQF

SEQ ID NO: 2481903 - protein, 20 aa, Entamoeba dispar
FLNKILVKPWIYRDIYDRAR

SEQ ID NO: 2481904 - protein, 18 aa, Entamoeba dispar
FLNNKYLFQFSRLTDEVH

SEQ ID NO: 2481905 - protein, 19 aa, Entamoeba dispar
FLNPPLILQRCMTLTNKEL

SEQ ID NO: 2481906 - protein, 23 aa, Entamoeba dispar
FLNQRFLLKMVIQAADAFKKQNL

SEQ ID NO: 2481907 - protein, 19 aa, Entamoeba dispar
FLNRLNLRIDQSNERIKVL

SEQ ID NO: 2481908 - protein, 17 aa, Entamoeba dispar
FLNSLKTVIMTEINTLS

SEQ ID NO: 2481909 - protein, 18 aa, Entamoeba dispar
FLNTSSLTFKDYKLRIVD

SEQ ID NO: 2481910 - protein, 28 aa, Entamoeba dispar
FLNVLKKWTGLEHFDIVFEYAVDGYDRT

SEQ ID NO: 2481911 - protein, 30 aa, Entamoeba dispar
FLNVLKQGYLSFIIKLKMECLEKLMDDFDA

SEQ ID NO: 2481912 - protein, 21 aa, Entamoeba dispar
FLPIEIINSFASIKMKKSDYQ

SEQ ID NO: 2481913 - protein, 19 aa, Entamoeba dispar
FLPISAYLLAPVSHFSVYP

SEQ ID NO: 2481914 - protein, 22 aa, Entamoeba dispar
FLPNEIMTLPIPLSESGSLQLR

SEQ ID NO: 2481915 - protein, 25 aa, Entamoeba dispar
FLPRRIGDDLIDLVGACHFVLDDYQ

SEQ ID NO: 2481916 - protein, 17 aa, Entamoeba dispar
FLQDRIRDFLNSNNGMT

SEQ ID NO: 2481917 - protein, 17 aa, Entamoeba dispar
FLQEAGKKIDLGVVSGS

SEQ ID NO: 2481918 - protein, 18 aa, Entamoeba dispar
FLQHYIIYDCVMVTLDAL

SEQ ID NO: 2481919 - protein, 23 aa, Entamoeba dispar
FLQIKGETFINGKLSKLVKKNDC

SEQ ID NO: 2481920 - protein, 17 aa, Entamoeba dispar
FLQKGYYKECDYWSVGC

SEQ ID NO: 2481921 - protein, 17 aa, Entamoeba dispar
FLQKKLDKIINLKKLIT

SEQ ID NO: 2481922 - protein, 17 aa, Entamoeba dispar
FLQKRFISEQCNFIIEK

SEQ ID NO: 2481923 - protein, 23 aa, Entamoeba dispar
FLQNFPFPFLDLMQPFIETDAPY

SEQ ID NO: 2481924 - protein, 21 aa, Entamoeba dispar
FLQRSSMLLSIFNSNMERSMI

SEQ ID NO: 2481925 - protein, 24 aa, Entamoeba dispar
FLQSDYYKIGLFGLNGEYYESQLS

SEQ ID NO: 2481926 - protein, 34 aa, Entamoeba dispar
FLQSSFPCLELKVIKEIWKKNNYNMVRTTDDLME

SEQ ID NO: 2481927 - protein, 26 aa, Entamoeba dispar
FLQYPPRIVQSLKRHFADICKEPLEE

SEQ ID NO: 2481928 - protein, 18 aa, Entamoeba dispar
FLRCLKSFGRLESVEEVG

SEQ ID NO: 2481929 - protein, 18 aa, Entamoeba dispar
FLRCYCAEFVKGKMAPEC

SEQ ID NO: 2481930 - protein, 23 aa, Entamoeba dispar
FLRHLEKGFPLFLIAEKYYRETN

SEQ ID NO: 2481931 - protein, 24 aa, Entamoeba dispar
FLRKGIYTCQALVMKSETISKEFV

SEQ ID NO: 2481932 - protein, 19 aa, Entamoeba dispar
FLRNLPIHIFDRITTKKIF

SEQ ID NO: 2481933 - protein, 25 aa, Entamoeba dispar
FLRVIKIVLPSCSFYNKYVNIQYCS

SEQ ID NO: 2481934 - protein, 17 aa, Entamoeba dispar
FLSFIASEAADVPKGSV

SEQ ID NO: 2481935 - protein, 23 aa, Entamoeba dispar
FLSMFKRKAFLHLYTEEGMEESE

SEQ ID NO: 2481936 - protein, 17 aa, Entamoeba dispar
FLSPKGHYDVKIYEDSV

SEQ ID NO: 2481937 - protein, 31 aa, Entamoeba dispar
FLSSSKFTILLNRELLNNLVIMATAQTDEPS

SEQ ID NO: 2481938 - protein, 18 aa, Entamoeba dispar
FLTFRVVVINSLCSFMMV

SEQ ID NO: 2481939 - protein, 24 aa, Entamoeba dispar
FLTKESFYKFGRDVCELIKEKLVH

SEQ ID NO: 2481940 - protein, 20 aa, Entamoeba dispar
FLTKEVQNECLIIKEKLNEI

SEQ ID NO: 2481941 - protein, 17 aa, Entamoeba dispar
FLTKLKTVFGEFVNNKS

SEQ ID NO: 2481942 - protein, 17 aa, Entamoeba dispar
FLTRMLLCCIIENGVDN

SEQ ID NO: 2481943 - protein, 18 aa, Entamoeba dispar
FLTSLCIGGVSCAHYSPI

SEQ ID NO: 2481944 - protein, 35 aa, Entamoeba dispar
FLTSQFIKQFSFRLLEIITLVSMCRDIQKQQLLAT

SEQ ID NO: 2481945 - protein, 19 aa, Entamoeba dispar
FLTVYRDFITPIELLNKFI

SEQ ID NO: 2481946 - protein, 19 aa, Entamoeba dispar
FLVAQGLGDIVLLGEKGKL

SEQ ID NO: 2481947 - protein, 18 aa, Entamoeba dispar
FLVDDGCVNPYPPLSDCH

SEQ ID NO: 2481948 - protein, 26 aa, Entamoeba dispar
FLVDILSEFGYFFQVSRTIGKNGTPT

SEQ ID NO: 2481949 - protein, 20 aa, Entamoeba dispar
FLVDLICSFIKKYKHFGNTF

SEQ ID NO: 2481950 - protein, 18 aa, Entamoeba dispar
FLVELDCQNNQGILELPP

SEQ ID NO: 2481951 - protein, 19 aa, Entamoeba dispar
FLVEVMLSYIYPNFAEEAQ

SEQ ID NO: 2481952 - protein, 25 aa, Entamoeba dispar
FLVFDEIAHVFGVFVNEILQPGQWL

SEQ ID NO: 2481953 - protein, 27 aa, Entamoeba dispar
FLVKTKRIVSVPKKWSIKKSINCAISI

SEQ ID NO: 2481954 - protein, 24 aa, Entamoeba dispar
FLYCNHLCIVFELLGTNLYQMLQI

SEQ ID NO: 2481955 - protein, 21 aa, Entamoeba dispar
FLYEMLKSIGYNASLKSTRAT

SEQ ID NO: 2481956 - protein, 26 aa, Entamoeba dispar
FLYNKLFRYLWPPSISQLENIDYTDS

SEQ ID NO: 2481957 - protein, 24 aa, Entamoeba dispar
FLYPKEPWWDGYFKSETEEDISKW

SEQ ID NO: 2481958 - protein, 19 aa, Entamoeba dispar
FLYSGYWGNVIARLDNEMK

SEQ ID NO: 2481959 - protein, 17 aa, Entamoeba dispar
FLYTGDPCYPIQDLIVV

SEQ ID NO: 2481960 - protein, 37 aa, Entamoeba dispar
FMAECKMKYSLILYRQFCSLFDSLPLVCIVHRDIGDF

SEQ ID NO: 2481961 - protein, 22 aa, Entamoeba dispar
FMANLRLEKIGFVFQTYNLLST

SEQ ID NO: 2481962 - protein, 18 aa, Entamoeba dispar
FMANVLLYFTKFSDVKSF

SEQ ID NO: 2481963 - protein, 19 aa, Entamoeba dispar
FMCGGLGCLLNEIQDCQPD

SEQ ID NO: 2481964 - protein, 19 aa, Entamoeba dispar
FMCHKHLILELSPQVNFIV

SEQ ID NO: 2481965 - protein, 24 aa, Entamoeba dispar
FMEPSPKMLLFYRALKLDDMNYNE

SEQ ID NO: 2481966 - protein, 18 aa, Entamoeba dispar
FMEVIGMFDGHHGQDAAI

SEQ ID NO: 2481967 - protein, 18 aa, Entamoeba dispar
FMFGPTIYYSELFTNLEL

SEQ ID NO: 2481968 - protein, 19 aa, Entamoeba dispar
FMGGIYLEKIRLVPSKSTT

SEQ ID NO: 2481969 - protein, 25 aa, Entamoeba dispar
FMGRTFKFLTELGIPTEHIRFRQHL

SEQ ID NO: 2481970 - protein, 17 aa, Entamoeba dispar
FMHWKGPAVKRMVMVKA

SEQ ID NO: 2481971 - protein, 20 aa, Entamoeba dispar
FMIFAGILIRNSPQQPPLFL

SEQ ID NO: 2481972 - protein, 17 aa, Entamoeba dispar
FMKAKEKTITLSWDEFI

SEQ ID NO: 2481973 - protein, 30 aa, Entamoeba dispar
FMKEKPIRLECVLNLPLKHYFKNHKRSYLF

SEQ ID NO: 2481974 - protein, 17 aa, Entamoeba dispar
FMKGERFVFLLCTRAGG

SEQ ID NO: 2481975 - protein, 19 aa, Entamoeba dispar
FMKHTRLTLQPSTQIEIIQ

SEQ ID NO: 2481976 - protein, 22 aa, Entamoeba dispar
FMKSLKRQPCDEGVLSCLLNST

SEQ ID NO: 2481977 - protein, 24 aa, Entamoeba dispar
FMKTKEAWQVIPLLLTSEPNVPFY

SEQ ID NO: 2481978 - protein, 20 aa, Entamoeba dispar
FMLTEGVKLSFEKTPLNMLT

SEQ ID NO: 2481979 - protein, 18 aa, Entamoeba dispar
FMMLLWDVLEKELPEEEF

SEQ ID NO: 2481980 - protein, 35 aa, Entamoeba dispar
FMNPEMNRFIFLLCTRAGGFGINLSEADTVIIYDS

SEQ ID NO: 2481981 - protein, 24 aa, Entamoeba dispar
FMNTWNDILCKLAIEAVTICAGGD

SEQ ID NO: 2481982 - protein, 26 aa, Entamoeba dispar
FMPEGFKTRTAFCLETQHFPDSPHHP

SEQ ID NO: 2481983 - protein, 18 aa, Entamoeba dispar
FMPERRVLEHIILSKEWN

SEQ ID NO: 2481984 - protein, 23 aa, Entamoeba dispar
FMPNKVKHCYLTYLCINKQCIVF

SEQ ID NO: 2481985 - protein, 17 aa, Entamoeba dispar
FMQFLVLRIFTAKPEIK

SEQ ID NO: 2481986 - protein, 25 aa, Entamoeba dispar
FMQIPMLIESCARCVAKHLVGKSPA

SEQ ID NO: 2481987 - protein, 24 aa, Entamoeba dispar
FMSKEEFRVLTAIEMGMRNHELVP

SEQ ID NO: 2481988 - protein, 28 aa, Entamoeba dispar
FMSKEMNWIRLGGKYICGYCRHNNEKFY

SEQ ID NO: 2481989 - protein, 19 aa, Entamoeba dispar
FMSSCKAVKFYSDLLNYID

SEQ ID NO: 2481990 - protein, 20 aa, Entamoeba dispar
FMTCVFIFVKALLFISDNQL

SEQ ID NO: 2481991 - protein, 18 aa, Entamoeba dispar
FMTPIPFFNIMCSDEIEP

SEQ ID NO: 2481992 - protein, 20 aa, Entamoeba dispar
FMTSADCALELQELTQLQSI

SEQ ID NO: 2481993 - protein, 32 aa, Entamoeba dispar
FMVKRGHIVRNWLQRWFVLTNDILYYFDEQKL

SEQ ID NO: 2481994 - protein, 24 aa, Entamoeba dispar
FMVLDCVHAIDIICQDPKIGPSTK

SEQ ID NO: 2481995 - protein, 22 aa, Entamoeba dispar
FNAALKKTFKFTEAGEMVTENE

SEQ ID NO: 2481996 - protein, 20 aa, Entamoeba dispar
FNACCLLKNQIELMINILPT

SEQ ID NO: 2481997 - protein, 18 aa, Entamoeba dispar
FNAVLRGDMAKIVIGENS

SEQ ID NO: 2481998 - protein, 32 aa, Entamoeba dispar
FNAYFFRILLKIFRVYLKIARYQTIGLGLSER

SEQ ID NO: 2481999 - protein, 37 aa, Entamoeba dispar
FNCGHCCYCYCCSESLGLTFKCPKCNKINVKPVYFEE

SEQ ID NO: 2482000 - protein, 17 aa, Entamoeba dispar
FNCKEIWHSGLTCSQYQ

SEQ ID NO: 2482001 - protein, 19 aa, Entamoeba dispar
FNCLVVALVFDVEMNSKIT

SEQ ID NO: 2482002 - protein, 25 aa, Entamoeba dispar
FNDEFKLELPFPLNENYQLIFNVQE

SEQ ID NO: 2482003 - protein, 24 aa, Entamoeba dispar
FNDGKAILALCHAYTRLTGENGFE

SEQ ID NO: 2482004 - protein, 17 aa, Entamoeba dispar
FNDHIYFSDMMTYVHTV

SEQ ID NO: 2482005 - protein, 21 aa, Entamoeba dispar
FNDHPIRVVLSNKVIKSKNES

SEQ ID NO: 2482006 - protein, 30 aa, Entamoeba dispar
FNDIQCKSMLLSIFSKFTFPEANQIIPKIL

SEQ ID NO: 2482007 - protein, 17 aa, Entamoeba dispar
FNDKICCIVKRKETRNP

SEQ ID NO: 2482008 - protein, 18 aa, Entamoeba dispar
FNDLKVELLRDFYNDMND

SEQ ID NO: 2482009 - protein, 44 aa, Entamoeba dispar
FNDLVQFRIKECLRKLLVGKKFEAKECYRRSFTKEEKTIEEIFY

SEQ ID NO: 2482010 - protein, 18 aa, Entamoeba dispar
FNDNFLLIQRIIKEENTF

SEQ ID NO: 2482011 - protein, 18 aa, Entamoeba dispar
FNDQAINRVVPWFETTFV

SEQ ID NO: 2482012 - protein, 18 aa, Entamoeba dispar
FNDRIIWFAVSKGSKIGK

SEQ ID NO: 2482013 - protein, 22 aa, Entamoeba dispar
FNEAFLRLVLGLTNQLEHLDSI

SEQ ID NO: 2482014 - protein, 17 aa, Entamoeba dispar
FNECYSLKSINVENIKY

SEQ ID NO: 2482015 - protein, 21 aa, Entamoeba dispar
FNEFKHCIVPRDFNDTAHPVL

SEQ ID NO: 2482016 - protein, 18 aa, Entamoeba dispar
FNEIKGGYECFVRLNEFS

SEQ ID NO: 2482017 - protein, 26 aa, Entamoeba dispar
FNEISEPFLFLGIGMKDGYCYGYKIN

SEQ ID NO: 2482018 - protein, 17 aa, Entamoeba dispar
FNELIEFRMREVIRKLI

SEQ ID NO: 2482019 - protein, 24 aa, Entamoeba dispar
FNELPCVVHEILLFLYHSLLFENE

SEQ ID NO: 2482020 - protein, 18 aa, Entamoeba dispar
FNELRSGDTFKKVMNKLT

SEQ ID NO: 2482021 - protein, 18 aa, Entamoeba dispar
FNEMSEWLWGIYNKNFLK

SEQ ID NO: 2482022 - protein, 19 aa, Entamoeba dispar
FNENIELLIKFITGSESLA

SEQ ID NO: 2482023 - protein, 17 aa, Entamoeba dispar
FNEPMMRNCVGISHFFV

SEQ ID NO: 2482024 - protein, 18 aa, Entamoeba dispar
FNETGNLLFSTSADGSIT

SEQ ID NO: 2482025 - protein, 25 aa, Entamoeba dispar
FNFEIVYHVAPLLPYYNGEEQLERK

SEQ ID NO: 2482026 - protein, 22 aa, Entamoeba dispar
FNFLNIPAIVFAKQVTLIEYDL

SEQ ID NO: 2482027 - protein, 22 aa, Entamoeba dispar
FNFPETDLSPFIHKLSNDLLHH

SEQ ID NO: 2482028 - protein, 17 aa, Entamoeba dispar
FNFRVVEIISCDINELL

SEQ ID NO: 2482029 - protein, 18 aa, Entamoeba dispar
FNGFFGINSESIRFSNLG

SEQ ID NO: 2482030 - protein, 23 aa, Entamoeba dispar
FNGKEFCATLVRLPCVVETHKSY

SEQ ID NO: 2482031 - protein, 18 aa, Entamoeba dispar
FNGKGIVTGGYRGEKIIE

SEQ ID NO: 2482032 - protein, 27 aa, Entamoeba dispar
FNGKKFGIPLLIGFTYEYPISAPEMIC

SEQ ID NO: 2482033 - protein, 23 aa, Entamoeba dispar
FNGLNIGEKMFKYMDSHPATVKE

SEQ ID NO: 2482034 - protein, 20 aa, Entamoeba dispar
FNGNFEFDGKFDGTVESNQN

SEQ ID NO: 2482035 - protein, 24 aa, Entamoeba dispar
FNGNSTCCFLPLSFNADLQTNHPD

SEQ ID NO: 2482036 - protein, 30 aa, Entamoeba dispar
FNGVNKRGCDRCMKKTLAMNKIIIDDEICK

SEQ ID NO: 2482037 - protein, 17 aa, Entamoeba dispar
FNHAISLVRNGEIPLDQ

SEQ ID NO: 2482038 - protein, 17 aa, Entamoeba dispar
FNHFYLRYYNGHNNQYG

SEQ ID NO: 2482039 - protein, 26 aa, Entamoeba dispar
FNHKHLLLPYCELFIKNVLNQLEIVF

SEQ ID NO: 2482040 - protein, 25 aa, Entamoeba dispar
FNIDFIPLFSCICGNDFTKPFSHKL

SEQ ID NO: 2482041 - protein, 19 aa, Entamoeba dispar
FNIDYYKTFDVVINALDNL

SEQ ID NO: 2482042 - protein, 18 aa, Entamoeba dispar
FNIESLWLTPNMVDSILS

SEQ ID NO: 2482043 - protein, 24 aa, Entamoeba dispar
FNIIWELINLFGKIDFGINQSTVL

SEQ ID NO: 2482044 - protein, 19 aa, Entamoeba dispar
FNIKLGKLNSEESLKELQE

SEQ ID NO: 2482045 - protein, 18 aa, Entamoeba dispar
FNILKYLKLEYGNINNWN

SEQ ID NO: 2482046 - protein, 17 aa, Entamoeba dispar
FNILKYSSKFYIQLQLY

SEQ ID NO: 2482047 - protein, 21 aa, Entamoeba dispar
FNIQTYRCFINFLIDAKTNCH

SEQ ID NO: 2482048 - protein, 17 aa, Entamoeba dispar
FNIRKCQKFHKLCKKIV

SEQ ID NO: 2482049 - protein, 17 aa, Entamoeba dispar
FNIYKGFNEYVNSPEME

SEQ ID NO: 2482050 - protein, 27 aa, Entamoeba dispar
FNKCIGCLQCVRICPTKVLTSTHMKST

SEQ ID NO: 2482051 - protein, 19 aa, Entamoeba dispar
FNKDMREMASFIKEFLGDK

SEQ ID NO: 2482052 - protein, 21 aa, Entamoeba dispar
FNKEAYFSLVLDKLQMIVNSK

SEQ ID NO: 2482053 - protein, 24 aa, Entamoeba dispar
FNKEVVEYTELFKLKEEVTALLYS

SEQ ID NO: 2482054 - protein, 24 aa, Entamoeba dispar
FNKFIKTCLKYIGIDEFLSTHYYW

SEQ ID NO: 2482055 - protein, 18 aa, Entamoeba dispar
FNKFLWGLLNSHPSFLKF

SEQ ID NO: 2482056 - protein, 24 aa, Entamoeba dispar
FNKFRLSHNLKYIVKFISDIFPLK

SEQ ID NO: 2482057 - protein, 21 aa, Entamoeba dispar
FNKGIAVVREILCDLYNGRQT

SEQ ID NO: 2482058 - protein, 17 aa, Entamoeba dispar
FNKGIEINKRYVFDKEI

SEQ ID NO: 2482059 - protein, 21 aa, Entamoeba dispar
FNKITYIRLVNFESFNSSLKV

SEQ ID NO: 2482060 - protein, 18 aa, Entamoeba dispar
FNKLIIPSEFTKPGDVET

SEQ ID NO: 2482061 - protein, 19 aa, Entamoeba dispar
FNKLLLFTRDYFRIKNIPH

SEQ ID NO: 2482062 - protein, 21 aa, Entamoeba dispar
FNKMAICYRAINIEIENKNIY

SEQ ID NO: 2482063 - protein, 24 aa, Entamoeba dispar
FNKNTWKLMPLQSLIINCIEELNG

SEQ ID NO: 2482064 - protein, 26 aa, Entamoeba dispar
FNKQWEIPITKLFGSAPVKILMITPK

SEQ ID NO: 2482065 - protein, 22 aa, Entamoeba dispar
FNKRNDAALAMKALDRTQVFGQ

SEQ ID NO: 2482066 - protein, 20 aa, Entamoeba dispar
FNKTLFYDGFIFKTYKMSQL

SEQ ID NO: 2482067 - protein, 17 aa, Entamoeba dispar
FNKVILPNNLEILGDSC

SEQ ID NO: 2482068 - protein, 26 aa, Entamoeba dispar
FNLLSRYPKYLTFEAKAQVFRKQIKK

SEQ ID NO: 2482069 - protein, 25 aa, Entamoeba dispar
FNLNCTVRVVGGWVRDKILKKNSHD

SEQ ID NO: 2482070 - protein, 20 aa, Entamoeba dispar
FNLQCYITCSFDRYICTPTE

SEQ ID NO: 2482071 - protein, 22 aa, Entamoeba dispar
FNLSIETVRFMLSIHKQCENVS

SEQ ID NO: 2482072 - protein, 17 aa, Entamoeba dispar
FNMLCLMDYVCKRNVSF

SEQ ID NO: 2482073 - protein, 17 aa, Entamoeba dispar
FNNCESIEFNMYKIRNL

SEQ ID NO: 2482074 - protein, 22 aa, Entamoeba dispar
FNNCLIVLGIDGCSYVKKVLRI

SEQ ID NO: 2482075 - protein, 18 aa, Entamoeba dispar
FNNEINWFLKKSVPQRIL

SEQ ID NO: 2482076 - protein, 23 aa, Entamoeba dispar
FNNIEVLSCDECIIDISSVPDPI

SEQ ID NO: 2482077 - protein, 17 aa, Entamoeba dispar
FNNKALQPEYLKYLSQS

SEQ ID NO: 2482078 - protein, 22 aa, Entamoeba dispar
FNNSCCEVGYWLSPKFQHQGIM

SEQ ID NO: 2482079 - protein, 25 aa, Entamoeba dispar
FNNSKEVFNQLGIIRTNCIDCLDRT

SEQ ID NO: 2482080 - protein, 19 aa, Entamoeba dispar
FNPEERWSAIQLLEHPFLK

SEQ ID NO: 2482081 - protein, 20 aa, Entamoeba dispar
FNPEVRGVIQVCLVEPTSQI

SEQ ID NO: 2482082 - protein, 23 aa, Entamoeba dispar
FNPKRILLVGGVLRSEEQLTVMQ

SEQ ID NO: 2482083 - protein, 22 aa, Entamoeba dispar
FNPKWLTSQFNHIFIVVQPEIN

SEQ ID NO: 2482084 - protein, 17 aa, Entamoeba dispar
FNPLSIIKEEGFDNSDT

SEQ ID NO: 2482085 - protein, 23 aa, Entamoeba dispar
FNPMYITTVGIDFRVKNIELDNK

SEQ ID NO: 2482086 - protein, 24 aa, Entamoeba dispar
FNPSRHLSEVFTIFSAPNYCDYYK

SEQ ID NO: 2482087 - protein, 29 aa, Entamoeba dispar
FNQELNCSVYLGRKYLLIFKDNTNPLTDI

SEQ ID NO: 2482088 - protein, 18 aa, Entamoeba dispar
FNQLSEKQKLLFSGIKEK

SEQ ID NO: 2482089 - protein, 24 aa, Entamoeba dispar
FNQRKIIKGKRMFIGIIGELINGH

SEQ ID NO: 2482090 - protein, 23 aa, Entamoeba dispar
FNREFPSHRKLNLDGKKILDELI

SEQ ID NO: 2482091 - protein, 20 aa, Entamoeba dispar
FNREICLLAAKSIEQSITDI

SEQ ID NO: 2482092 - protein, 17 aa, Entamoeba dispar
FNREILILQDLRDGPNI

SEQ ID NO: 2482093 - protein, 18 aa, Entamoeba dispar
FNRIEIMSQLVIPEMVIQ

SEQ ID NO: 2482094 - protein, 17 aa, Entamoeba dispar
FNRKGNDSGGSWELNPT

SEQ ID NO: 2482095 - protein, 22 aa, Entamoeba dispar
FNRKKKFRMISIDGGGIKCILQ

SEQ ID NO: 2482096 - protein, 25 aa, Entamoeba dispar
FNRLFKYQAALILFAMASRTEVYAQ

SEQ ID NO: 2482097 - protein, 20 aa, Entamoeba dispar
FNRQFPYLFIDCRRQESFDL

SEQ ID NO: 2482098 - protein, 22 aa, Entamoeba dispar
FNRVFMCSFPYFTNSKTVLQKL

SEQ ID NO: 2482099 - protein, 17 aa, Entamoeba dispar
FNSFFKEEWNNGRAQGC

SEQ ID NO: 2482100 - protein, 18 aa, Entamoeba dispar
FNSFPILFGKQITCSEIM

SEQ ID NO: 2482101 - protein, 17 aa, Entamoeba dispar
FNSITVKYPRWFEFYDM

SEQ ID NO: 2482102 - protein, 21 aa, Entamoeba dispar
FNSKVCCCSNVLVIVITEDGS

SEQ ID NO: 2482103 - protein, 18 aa, Entamoeba dispar
FNSMTWEPPCELLDCGTS

SEQ ID NO: 2482104 - protein, 22 aa, Entamoeba dispar
FNSPKKIPFVFHYDTQNILISL

SEQ ID NO: 2482105 - protein, 30 aa, Entamoeba dispar
FNSPYRGNGMVPLIRPSYINNPTQRQSIYS

SEQ ID NO: 2482106 - protein, 20 aa, Entamoeba dispar
FNSQCPLRQIPGVPNDICKR

SEQ ID NO: 2482107 - protein, 18 aa, Entamoeba dispar
FNSSYGFATINYDQNHKI

SEQ ID NO: 2482108 - protein, 18 aa, Entamoeba dispar
FNSVETFLLLVALKVKYP

SEQ ID NO: 2482109 - protein, 26 aa, Entamoeba dispar
FNSVRGCSYCYGFAAVRRFLIKNDLV

SEQ ID NO: 2482110 - protein, 17 aa, Entamoeba dispar
FNTISFSYNSQFLAIAG

SEQ ID NO: 2482111 - protein, 18 aa, Entamoeba dispar
FNTLISIIVFRYDDKESF

SEQ ID NO: 2482112 - protein, 20 aa, Entamoeba dispar
FNTLQFPAAVHFCVTEKTIG

SEQ ID NO: 2482113 - protein, 21 aa, Entamoeba dispar
FNTLQFPAAVHFCVTEKTIGC

SEQ ID NO: 2482114 - protein, 24 aa, Entamoeba dispar
FNTNCGPIRFEVWDTAGQEKFGGL

SEQ ID NO: 2482115 - protein, 23 aa, Entamoeba dispar
FNTNELYYIWDILFAHNNPLSLL

SEQ ID NO: 2482116 - protein, 17 aa, Entamoeba dispar
FNTQLVINCLKKTAQTT

SEQ ID NO: 2482117 - protein, 19 aa, Entamoeba dispar
FNVACAKYKLYNDTRLLNI

SEQ ID NO: 2482118 - protein, 19 aa, Entamoeba dispar
FNVLECVRTLQTYQEEEVA

SEQ ID NO: 2482119 - protein, 21 aa, Entamoeba dispar
FNVLHEFLSFYVVLMKFINYK

SEQ ID NO: 2482120 - protein, 20 aa, Entamoeba dispar
FNVSKMEWKLRGIKDKDIPF

SEQ ID NO: 2482121 - protein, 17 aa, Entamoeba dispar
FNWIGDTIVDCFNECPK

SEQ ID NO: 2482122 - protein, 27 aa, Entamoeba dispar
FNYFVYCISDSYLKCSTSSVVSLRHLV

SEQ ID NO: 2482123 - protein, 19 aa, Entamoeba dispar
FNYICCIENNRIIGIVITR

SEQ ID NO: 2482124 - protein, 17 aa, Entamoeba dispar
FNYIIPIFNYLKENEEI

SEQ ID NO: 2482125 - protein, 18 aa, Entamoeba dispar
FNYISIRFTMAGLIEEDD

SEQ ID NO: 2482126 - protein, 17 aa, Entamoeba dispar
FNYKTCGQIHTMTIVQT

SEQ ID NO: 2482127 - protein, 17 aa, Entamoeba dispar
FNYLPLGVIIKRKIGKF

SEQ ID NO: 2482128 - protein, 23 aa, Entamoeba dispar
FNYRTAYPGMVHFIVIDHFRNQT

SEQ ID NO: 2482129 - protein, 17 aa, Entamoeba dispar
FNYSLPTLMESIVTVLS

SEQ ID NO: 2482130 - protein, 17 aa, Entamoeba dispar
FNYYAVVLSDKFSSMHI

SEQ ID NO: 2482131 - protein, 27 aa, Entamoeba dispar
FPACTPTSCRVRFCISAAHTDEDIEKA

SEQ ID NO: 2482132 - protein, 17 aa, Entamoeba dispar
FPAEKYVNGSIFLQKPP

SEQ ID NO: 2482133 - protein, 22 aa, Entamoeba dispar
FPALHYRMAQVLFREKNYIQVE

SEQ ID NO: 2482134 - protein, 21 aa, Entamoeba dispar
FPAPMNCYFEKVKTAKTNRYD

SEQ ID NO: 2482135 - protein, 21 aa, Entamoeba dispar
FPCIVSYPLSIKYHIMIIKRY

SEQ ID NO: 2482136 - protein, 22 aa, Entamoeba dispar
FPDFLDCFNYSLPTLMESIVTV

SEQ ID NO: 2482137 - protein, 21 aa, Entamoeba dispar
FPDGESILKFVGAGKRLEIPS

SEQ ID NO: 2482138 - protein, 30 aa, Entamoeba dispar
FPDGFYLYFYKRFPGLLILVYNIVKKHYPN

SEQ ID NO: 2482139 - protein, 18 aa, Entamoeba dispar
FPDKLMARPETVQFMTQH

SEQ ID NO: 2482140 - protein, 22 aa, Entamoeba dispar
FPDLKGSVLSLIKSELGDKILT

SEQ ID NO: 2482141 - protein, 17 aa, Entamoeba dispar
FPDYSRLIKVSSEIQKV

SEQ ID NO: 2482142 - protein, 29 aa, Entamoeba dispar
FPEFKNPLVRRLVEMILLKNVSWDYTYED

SEQ ID NO: 2482143 - protein, 28 aa, Entamoeba dispar
FPEIDFYECYKLNSINVVMEYVDGEIRQ

SEQ ID NO: 2482144 - protein, 26 aa, Entamoeba dispar
FPEIVLKCLPLLPFEITDDYLKGRYD

SEQ ID NO: 2482145 - protein, 17 aa, Entamoeba dispar
FPEKIVGIAQSPDVDIH

SEQ ID NO: 2482146 - protein, 25 aa, Entamoeba dispar
FPEKSLPGLLIYKGDCMVKSLFGSE

SEQ ID NO: 2482147 - protein, 20 aa, Entamoeba dispar
FPELKKWWNDECNKDLVIGV

SEQ ID NO: 2482148 - protein, 22 aa, Entamoeba dispar
FPERKCLNSVITKSVKRQSTTN

SEQ ID NO: 2482149 - protein, 19 aa, Entamoeba dispar
FPERYEVKDPLILEANSPI

SEQ ID NO: 2482150 - protein, 25 aa, Entamoeba dispar
FPERYEVKDPLILEANSPIDREKIQ

SEQ ID NO: 2482151 - protein, 20 aa, Entamoeba dispar
FPESAIRSIAIIIFHRLITP

SEQ ID NO: 2482152 - protein, 25 aa, Entamoeba dispar
FPESLLSRFDLIFIILDSSTEELDR

SEQ ID NO: 2482153 - protein, 19 aa, Entamoeba dispar
FPETVCRIPSLTQLELDNN

SEQ ID NO: 2482154 - protein, 23 aa, Entamoeba dispar
FPFEEIYNNLALSIAPEIYGLED

SEQ ID NO: 2482155 - protein, 19 aa, Entamoeba dispar
FPFEIVLPENCCVTVVMGN

SEQ ID NO: 2482156 - protein, 18 aa, Entamoeba dispar
FPFKGNKIGESYCLYSAE

SEQ ID NO: 2482157 - protein, 25 aa, Entamoeba dispar
FPFTKYNVLKVIQLRVYPELINLLP

SEQ ID NO: 2482158 - protein, 25 aa, Entamoeba dispar
FPFYPFWKHVCIVWTKCYCYTPKNI

SEQ ID NO: 2482159 - protein, 21 aa, Entamoeba dispar
FPGIKEKQALIILEKNNWDMK

SEQ ID NO: 2482160 - protein, 22 aa, Entamoeba dispar
FPGILKGALIVRARKITDNMAI

SEQ ID NO: 2482161 - protein, 26 aa, Entamoeba dispar
FPGINKCAFVAMKVMKKYHPKIFYHL

SEQ ID NO: 2482162 - protein, 19 aa, Entamoeba dispar
FPGKCGGLLQIIQSLIQNP

SEQ ID NO: 2482163 - protein, 22 aa, Entamoeba dispar
FPGNALDCFNSWIQNLDVSISL

SEQ ID NO: 2482164 - protein, 20 aa, Entamoeba dispar
FPGQVVDTWLGLSKKGEIHI

SEQ ID NO: 2482165 - protein, 17 aa, Entamoeba dispar
FPGTKPIFISRQHYKIL

SEQ ID NO: 2482166 - protein, 19 aa, Entamoeba dispar
FPHTTDLVIGTLLNSSVGY

SEQ ID NO: 2482167 - protein, 24 aa, Entamoeba dispar
FPIDRRLREVLIYLFSQEYSEADK

SEQ ID NO: 2482168 - protein, 24 aa, Entamoeba dispar
FPIESLDLTRFVKHYDPTTPPIYN

SEQ ID NO: 2482169 - protein, 20 aa, Entamoeba dispar
FPIKSIQLIHKWRDNSVEFW

SEQ ID NO: 2482170 - protein, 20 aa, Entamoeba dispar
FPILFGKQITCSEIMDIVNQ

SEQ ID NO: 2482171 - protein, 18 aa, Entamoeba dispar
FPIQTKVSINPIFISQNV

SEQ ID NO: 2482172 - protein, 19 aa, Entamoeba dispar
FPIRSFNILYESIKRSITL

SEQ ID NO: 2482173 - protein, 25 aa, Entamoeba dispar
FPISDFWEHVCIVWTKCFNYTPLKK

SEQ ID NO: 2482174 - protein, 26 aa, Entamoeba dispar
FPISKIRLRQQIIWDAEQEDLKDKSS

SEQ ID NO: 2482175 - protein, 18 aa, Entamoeba dispar
FPIVQPLNGYLQQLTSLP

SEQ ID NO: 2482176 - protein, 18 aa, Entamoeba dispar
FPKDKHVRKLICSCSTEQ

SEQ ID NO: 2482177 - protein, 24 aa, Entamoeba dispar
FPKEIYKYPWDIANTISTGKRPPI

SEQ ID NO: 2482178 - protein, 23 aa, Entamoeba dispar
FPKEVFRILHDCSGEKSIAKEES

SEQ ID NO: 2482179 - protein, 24 aa, Entamoeba dispar
FPKGCPCGYDLLKEVRECMKKDIV

SEQ ID NO: 2482180 - protein, 19 aa, Entamoeba dispar
FPKIRDSSQVMSFIKTQSD

SEQ ID NO: 2482181 - protein, 24 aa, Entamoeba dispar
FPKKMKQCIKKYVFELIGDNITEV

SEQ ID NO: 2482182 - protein, 20 aa, Entamoeba dispar
FPKLTNQFLYSRNDNKIKGV

SEQ ID NO: 2482183 - protein, 19 aa, Entamoeba dispar
FPKMHRYKVSKDAKDLIKE

SEQ ID NO: 2482184 - protein, 18 aa, Entamoeba dispar
FPKNTPPAIREFISDLLQ

SEQ ID NO: 2482185 - protein, 18 aa, Entamoeba dispar
FPLFPRDAFTYYINTEKH

SEQ ID NO: 2482186 - protein, 26 aa, Entamoeba dispar
FPLKDNDCYLCLKGVNHFATMAPMLD

SEQ ID NO: 2482187 - protein, 20 aa, Entamoeba dispar
FPLKLYSFIHIRGELEIPSN

SEQ ID NO: 2482188 - protein, 17 aa, Entamoeba dispar
FPLNCFNEVLVNARILY

SEQ ID NO: 2482189 - protein, 21 aa, Entamoeba dispar
FPLQDILSLKLKYIEGRDPKL

SEQ ID NO: 2482190 - protein, 19 aa, Entamoeba dispar
FPLQGMTLVLRHLALEGDQ

SEQ ID NO: 2482191 - protein, 22 aa, Entamoeba dispar
FPLQSKLSLFITFYNEYSKLFL

SEQ ID NO: 2482192 - protein, 22 aa, Entamoeba dispar
FPNDLPTTFWQRCNISHIESLA

SEQ ID NO: 2482193 - protein, 18 aa, Entamoeba dispar
FPNFLQRYTTQYYVPNID

SEQ ID NO: 2482194 - protein, 19 aa, Entamoeba dispar
FPNIETFYIYIISDEEFDD

SEQ ID NO: 2482195 - protein, 18 aa, Entamoeba dispar
FPNIETFYIYNYNDEIFK

SEQ ID NO: 2482196 - protein, 28 aa, Entamoeba dispar
FPNILLKGSEIALPFGEIMQMEKVKDAV

SEQ ID NO: 2482197 - protein, 18 aa, Entamoeba dispar
FPNLKVQKLYAWNDTQIP

SEQ ID NO: 2482198 - protein, 21 aa, Entamoeba dispar
FPNNNVTLWIDEYGIKLVSEQ

SEQ ID NO: 2482199 - protein, 19 aa, Entamoeba dispar
FPNVITAWDRNGIDKATAN

SEQ ID NO: 2482200 - protein, 17 aa, Entamoeba dispar
FPNYICPAIEQTIVNQQ

SEQ ID NO: 2482201 - protein, 18 aa, Entamoeba dispar
FPPFKLKDTINVPIYQAL

SEQ ID NO: 2482202 - protein, 17 aa, Entamoeba dispar
FPPLKPIFYEFNLSIKQ

SEQ ID NO: 2482203 - protein, 21 aa, Entamoeba dispar
FPPRGEFFCCGKIEKSSFSND

SEQ ID NO: 2482204 - protein, 17 aa, Entamoeba dispar
FPPSPKSKFTMIKEIGK

SEQ ID NO: 2482205 - protein, 20 aa, Entamoeba dispar
FPQNRFGIAPDYKWDGVDRG

SEQ ID NO: 2482206 - protein, 27 aa, Entamoeba dispar
FPQSDLSYCIKFFNKLEETIKRIEQYG

SEQ ID NO: 2482207 - protein, 24 aa, Entamoeba dispar
FPRCSIKRNLCIKINKTKLEIGEK

SEQ ID NO: 2482208 - protein, 25 aa, Entamoeba dispar
FPRDRSFVDWLLCKTINGERASLES

SEQ ID NO: 2482209 - protein, 19 aa, Entamoeba dispar
FPRELKILQIYKCPLISFE

SEQ ID NO: 2482210 - protein, 17 aa, Entamoeba dispar
FPRKFFTYYQQLSNSFV

SEQ ID NO: 2482211 - protein, 21 aa, Entamoeba dispar
FPRKILKIAAAQIAMSAGYTD

SEQ ID NO: 2482212 - protein, 22 aa, Entamoeba dispar
FPRLLEEVNLFCGVSASSFICA

SEQ ID NO: 2482213 - protein, 27 aa, Entamoeba dispar
FPRQYLIQRLQPIFDVFEIVDIGIQIE

SEQ ID NO: 2482214 - protein, 20 aa, Entamoeba dispar
FPRSSCVMCHGCNRYYHEKC

SEQ ID NO: 2482215 - protein, 18 aa, Entamoeba dispar
FPSALLILQLLINVLLNQ

SEQ ID NO: 2482216 - protein, 17 aa, Entamoeba dispar
FPSFEPIQQQPQQNQFP

SEQ ID NO: 2482217 - protein, 17 aa, Entamoeba dispar
FPSHIELLFKSICSSWT

SEQ ID NO: 2482218 - protein, 19 aa, Entamoeba dispar
FPSIIAYDANKIFIIEPEK

SEQ ID NO: 2482219 - protein, 23 aa, Entamoeba dispar
FPSILYKKLLGIPLTFDDYNILD

SEQ ID NO: 2482220 - protein, 17 aa, Entamoeba dispar
FPSINIKIREWLGLSPT

SEQ ID NO: 2482221 - protein, 17 aa, Entamoeba dispar
FPSITSRNLKSITNSND

SEQ ID NO: 2482222 - protein, 22 aa, Entamoeba dispar
FPSKQFYSGELIDGRDESILPC

SEQ ID NO: 2482223 - protein, 18 aa, Entamoeba dispar
FPSLSVLDLSCNNLSVIP

SEQ ID NO: 2482224 - protein, 20 aa, Entamoeba dispar
FPSNYLIHFTEVILTSLTMN

SEQ ID NO: 2482225 - protein, 38 aa, Entamoeba dispar
FPSQIFYERCKRIKKIAIFICCDEYLFGVYHHSQLIPS

SEQ ID NO: 2482226 - protein, 28 aa, Entamoeba dispar
FPSSELVKGCVFNCKKNQIRISLWVGEH

SEQ ID NO: 2482227 - protein, 24 aa, Entamoeba dispar
FPSSLKELHICFTNTKNYTYKNES

SEQ ID NO: 2482228 - protein, 25 aa, Entamoeba dispar
FPSYGGKVDFDWFVEKIALCYIEVA

SEQ ID NO: 2482229 - protein, 25 aa, Entamoeba dispar
FPTDISEQFCRFMVAIGEHKDKLDF

SEQ ID NO: 2482230 - protein, 23 aa, Entamoeba dispar
FPTKAKREKCLFEEKKKTDEIEK

SEQ ID NO: 2482231 - protein, 23 aa, Entamoeba dispar
FPTMKLKILELLNFVCEKNVFCE

SEQ ID NO: 2482232 - protein, 26 aa, Entamoeba dispar
FPTNMRERARFIPLRITQPERKMLRL

SEQ ID NO: 2482233 - protein, 17 aa, Entamoeba dispar
FPTPLYQANKFCKMLND

SEQ ID NO: 2482234 - protein, 24 aa, Entamoeba dispar
FPTYLIELANAFNIQVDVYQPYNY

SEQ ID NO: 2482235 - protein, 25 aa, Entamoeba dispar
FPVDDFWKHVCIVWTNCSYNKSENE

SEQ ID NO: 2482236 - protein, 23 aa, Entamoeba dispar
FPVETFRPIKLIAVDSRNSVILV

SEQ ID NO: 2482237 - protein, 26 aa, Entamoeba dispar
FPVYEFWEHVCVVWSKCYCYTPQNVI

SEQ ID NO: 2482238 - protein, 18 aa, Entamoeba dispar
FPYDSRCITIQDFCTTNT

SEQ ID NO: 2482239 - protein, 20 aa, Entamoeba dispar
FPYSQPNLFTPNPTTSYQQY

SEQ ID NO: 2482240 - protein, 19 aa, Entamoeba dispar
FQALLSVIVGHKFKYPLDF

SEQ ID NO: 2482241 - protein, 18 aa, Entamoeba dispar
FQAPILFEVKSKSQKFTK

SEQ ID NO: 2482242 - protein, 25 aa, Entamoeba dispar
FQCDDLFKLLLEWCDREEESTMVLK

SEQ ID NO: 2482243 - protein, 18 aa, Entamoeba dispar
FQCIPFILLQARLSQVLE

SEQ ID NO: 2482244 - protein, 20 aa, Entamoeba dispar
FQCIPFILLQARLSQVLEGF

SEQ ID NO: 2482245 - protein, 18 aa, Entamoeba dispar
FQDSIYIFKCENSAVKVN

SEQ ID NO: 2482246 - protein, 25 aa, Entamoeba dispar
FQEALQFVFYCWQDIPGNVKQLLND

SEQ ID NO: 2482247 - protein, 18 aa, Entamoeba dispar
FQEFKNVLEKVCNSKPSA

SEQ ID NO: 2482248 - protein, 19 aa, Entamoeba dispar
FQEFPELTMDLQIIIQSAT

SEQ ID NO: 2482249 - protein, 25 aa, Entamoeba dispar
FQENILFRFYLKFIGSPIATKIFEK

SEQ ID NO: 2482250 - protein, 25 aa, Entamoeba dispar
FQERPEPFVQFTVKIQKNYFDYLKQ

SEQ ID NO: 2482251 - protein, 21 aa, Entamoeba dispar
FQFISQLAFSLPIILTQQQQQ

SEQ ID NO: 2482252 - protein, 19 aa, Entamoeba dispar
FQFKSVFESVTIYKPESSR

SEQ ID NO: 2482253 - protein, 18 aa, Entamoeba dispar
FQFLDCVNILLHQFPDDF

SEQ ID NO: 2482254 - protein, 18 aa, Entamoeba dispar
FQFTRVEGTLSRLQSFLK

SEQ ID NO: 2482255 - protein, 17 aa, Entamoeba dispar
FQFYLVSHVPRKGLVKP

SEQ ID NO: 2482256 - protein, 23 aa, Entamoeba dispar
FQGHLRLLFLENMLDLGSYERKC

SEQ ID NO: 2482257 - protein, 18 aa, Entamoeba dispar
FQGNIERFHFNPIPLDKY

SEQ ID NO: 2482258 - protein, 18 aa, Entamoeba dispar
FQGNMERFHFNPIPLNEH

SEQ ID NO: 2482259 - protein, 18 aa, Entamoeba dispar
FQGNMERFHFNPIPLNEY

SEQ ID NO: 2482260 - protein, 18 aa, Entamoeba dispar
FQGNMERFHFNPIPLNYY

SEQ ID NO: 2482261 - protein, 19 aa, Entamoeba dispar
FQGNMERFRFNPIPLNHYS

SEQ ID NO: 2482262 - protein, 18 aa, Entamoeba dispar
FQGSIELIDIHSIIPNGR

SEQ ID NO: 2482263 - protein, 25 aa, Entamoeba dispar
FQHFHIPHILSIYSLRQLDTSEFLK

SEQ ID NO: 2482264 - protein, 17 aa, Entamoeba dispar
FQHGHPVLTCFNSTQHL

SEQ ID NO: 2482265 - protein, 23 aa, Entamoeba dispar
FQHIMRYKIQLNRIMETLPKYDS

SEQ ID NO: 2482266 - protein, 23 aa, Entamoeba dispar
FQIDIRYAFSITNLLPRTIYIGN

SEQ ID NO: 2482267 - protein, 17 aa, Entamoeba dispar
FQIFTGPVVEKLLITLK

SEQ ID NO: 2482268 - protein, 22 aa, Entamoeba dispar
FQIHSYCLWDDKKIRTTLTYPS

SEQ ID NO: 2482269 - protein, 23 aa, Entamoeba dispar
FQIIDILFVRKGENGLGQLQIQQ

SEQ ID NO: 2482270 - protein, 17 aa, Entamoeba dispar
FQILFCIYDVNDKESIQ

SEQ ID NO: 2482271 - protein, 17 aa, Entamoeba dispar
FQIRAFVGKGSRSSLKI

SEQ ID NO: 2482272 - protein, 18 aa, Entamoeba dispar
FQKAVQFDREHNITSSIK

SEQ ID NO: 2482273 - protein, 19 aa, Entamoeba dispar
FQKELKLFPQIETVRIDEN

SEQ ID NO: 2482274 - protein, 21 aa, Entamoeba dispar
FQKFNMHYKIENCMFEEAQNL

SEQ ID NO: 2482275 - protein, 18 aa, Entamoeba dispar
FQKIHCHDFYLSRKNNTL

SEQ ID NO: 2482276 - protein, 19 aa, Entamoeba dispar
FQKIWRYLVPFYIRCGLHP

SEQ ID NO: 2482277 - protein, 25 aa, Entamoeba dispar
FQKKVFCVLGGYGLFDSTQVQIKNI

SEQ ID NO: 2482278 - protein, 26 aa, Entamoeba dispar
FQKLAHFLKTYCSYVNSTDAITEHEN

SEQ ID NO: 2482279 - protein, 23 aa, Entamoeba dispar
FQKRCFPGLKLSHRLNTQEYYDI

SEQ ID NO: 2482280 - protein, 25 aa, Entamoeba dispar
FQKTYWKWFISLSEIPRPSYHCELF

SEQ ID NO: 2482281 - protein, 19 aa, Entamoeba dispar
FQLFFFKIFHNYFQCFKAN

SEQ ID NO: 2482282 - protein, 18 aa, Entamoeba dispar
FQLPERALDMILSNLSNE

SEQ ID NO: 2482283 - protein, 20 aa, Entamoeba dispar
FQLQPMKFVITFKLGSGLDV

SEQ ID NO: 2482284 - protein, 17 aa, Entamoeba dispar
FQLRKDFFPAAKLQMED

SEQ ID NO: 2482285 - protein, 23 aa, Entamoeba dispar
FQLYEEFGKQWVIYQLSMFKSLK

SEQ ID NO: 2482286 - protein, 17 aa, Entamoeba dispar
FQMKGMEDDARRLLIRR

SEQ ID NO: 2482287 - protein, 20 aa, Entamoeba dispar
FQNDCILIFKICDVKDPEVT

SEQ ID NO: 2482288 - protein, 23 aa, Entamoeba dispar
FQNESHFLFSNHSFYSEPLYSYQ

SEQ ID NO: 2482289 - protein, 18 aa, Entamoeba dispar
FQNGMALDITKYVMPKTI

SEQ ID NO: 2482290 - protein, 26 aa, Entamoeba dispar
FQNICVPRKIVLFAQKHHCFVTLYTR

SEQ ID NO: 2482291 - protein, 18 aa, Entamoeba dispar
FQNVLSVFIPLFFQVLFE

SEQ ID NO: 2482292 - protein, 17 aa, Entamoeba dispar
FQNYYLRVCHATVSLII

SEQ ID NO: 2482293 - protein, 18 aa, Entamoeba dispar
FQPGKFIFSFDDLKMLLG

SEQ ID NO: 2482294 - protein, 17 aa, Entamoeba dispar
FQPLFGRGNCGGLDIVI

SEQ ID NO: 2482295 - protein, 18 aa, Entamoeba dispar
FQQAVLIYLLSRAGVTVE

SEQ ID NO: 2482296 - protein, 23 aa, Entamoeba dispar
FQQCKSQCKLMLIFHHSPQSPLS

SEQ ID NO: 2482297 - protein, 26 aa, Entamoeba dispar
FQQHLLPKRCLLNFQQQNFEIATPYI

SEQ ID NO: 2482298 - protein, 17 aa, Entamoeba dispar
FQQIGRLLVQNNLLITT

SEQ ID NO: 2482299 - protein, 18 aa, Entamoeba dispar
FQQIGRLLVQNNLLITTN

SEQ ID NO: 2482300 - protein, 19 aa, Entamoeba dispar
FQQKFTRKQYSHFLYFIFR

SEQ ID NO: 2482301 - protein, 24 aa, Entamoeba dispar
FQQMPLCLELSKLLMLDDPQTLKD

SEQ ID NO: 2482302 - protein, 17 aa, Entamoeba dispar
FQQRGNTEIEYAKHLIQ

SEQ ID NO: 2482303 - protein, 24 aa, Entamoeba dispar
FQQVKNFIVLSHFIPEGVTLVKDI

SEQ ID NO: 2482304 - protein, 17 aa, Entamoeba dispar
FQRAASGSFALAECLTG

SEQ ID NO: 2482305 - protein, 23 aa, Entamoeba dispar
FQRMKNLFLEEIRSFSIQINTLV

SEQ ID NO: 2482306 - protein, 34 aa, Entamoeba dispar
FQRVYKWKDCGKIWRMRACCVIYVNFANKKENTC

SEQ ID NO: 2482307 - protein, 22 aa, Entamoeba dispar
FQSEIKPKIKLTNYESEDDQLI

SEQ ID NO: 2482308 - protein, 35 aa, Entamoeba dispar
FQSIIRGYLTRRVFGLKLMIKRKAALMEFLTTEES

SEQ ID NO: 2482309 - protein, 22 aa, Entamoeba dispar
FQSISLFFFVACCHPMAEIRQN

SEQ ID NO: 2482310 - protein, 32 aa, Entamoeba dispar
FQSLDLAWSLLRTFPRDMLKRISNETLDKYYD

SEQ ID NO: 2482311 - protein, 24 aa, Entamoeba dispar
FQSMCLQLNLLKKRIIANTYLESK

SEQ ID NO: 2482312 - protein, 17 aa, Entamoeba dispar
FQTALNFFQAVPENIQY

SEQ ID NO: 2482313 - protein, 18 aa, Entamoeba dispar
FQTKIKILEWLNSSHQMT

SEQ ID NO: 2482314 - protein, 22 aa, Entamoeba dispar
FQTLQYWTGFNHIQIIYDSNKN

SEQ ID NO: 2482315 - protein, 17 aa, Entamoeba dispar
FQTPFSGFVEVATPTTN

SEQ ID NO: 2482316 - protein, 17 aa, Entamoeba dispar
FQVCPKCQAKYIDKCPI

SEQ ID NO: 2482317 - protein, 25 aa, Entamoeba dispar
FQVIKNLYLLLGSVDFLGNPVGLVS

SEQ ID NO: 2482318 - protein, 18 aa, Entamoeba dispar
FQVSDRGNNVIVYGTIAG

SEQ ID NO: 2482319 - protein, 17 aa, Entamoeba dispar
FQYIKSLIDKIIISDEL

SEQ ID NO: 2482320 - protein, 27 aa, Entamoeba dispar
FQYSRFPPHFKCCIEDFELGKIDIEID

SEQ ID NO: 2482321 - protein, 17 aa, Entamoeba dispar
FRALLNGGRLEDILNGF

SEQ ID NO: 2482322 - protein, 17 aa, Entamoeba dispar
FRDAWREKHANDKTERI

SEQ ID NO: 2482323 - protein, 20 aa, Entamoeba dispar
FRDFILRKLINGERTAMFSP

SEQ ID NO: 2482324 - protein, 17 aa, Entamoeba dispar
FRDGKKIGNPICDKGKG

SEQ ID NO: 2482325 - protein, 17 aa, Entamoeba dispar
FRDILLAHFQCPYCHYE

SEQ ID NO: 2482326 - protein, 19 aa, Entamoeba dispar
FRDLIKRMLVYDPNKRISL

SEQ ID NO: 2482327 - protein, 20 aa, Entamoeba dispar
FREDFVYGFSTWFDVSFPQS

SEQ ID NO: 2482328 - protein, 17 aa, Entamoeba dispar
FREDVEFFSKLEMEIKN

SEQ ID NO: 2482329 - protein, 18 aa, Entamoeba dispar
FREEFGDYNIAKCRIITF

SEQ ID NO: 2482330 - protein, 17 aa, Entamoeba dispar
FREGIIKTIFLTFNEIE

SEQ ID NO: 2482331 - protein, 22 aa, Entamoeba dispar
FREKITRMCYIFAKDHKDKNYQ

SEQ ID NO: 2482332 - protein, 23 aa, Entamoeba dispar
FREMKGRITDFYVQRTEVEAITK

SEQ ID NO: 2482333 - protein, 23 aa, Entamoeba dispar
FREPPEDGLFCDLLWSDPLQYEV

SEQ ID NO: 2482334 - protein, 26 aa, Entamoeba dispar
FRERFKRTLKGGVGIIELYHKSNMLA

SEQ ID NO: 2482335 - protein, 17 aa, Entamoeba dispar
FRFDTIKALNEVFEGAV

SEQ ID NO: 2482336 - protein, 20 aa, Entamoeba dispar
FRFEELKQMYLFMTITQPSY

SEQ ID NO: 2482337 - protein, 27 aa, Entamoeba dispar
FRFGSWPHAGCGIGLERITMLYLGIPN

SEQ ID NO: 2482338 - protein, 19 aa, Entamoeba dispar
FRGDRAIEISKAFYQGEEF

SEQ ID NO: 2482339 - protein, 17 aa, Entamoeba dispar
FRGETVLLKGKRRKETV

SEQ ID NO: 2482340 - protein, 17 aa, Entamoeba dispar
FRGIVHISGENNSVFSG

SEQ ID NO: 2482341 - protein, 20 aa, Entamoeba dispar
FRGNGQWLKEFRVNEIDPGD

SEQ ID NO: 2482342 - protein, 17 aa, Entamoeba dispar
FRGNIERFHFNPIPLDE

SEQ ID NO: 2482343 - protein, 18 aa, Entamoeba dispar
FRGNIERFHFNPIPLNEH

SEQ ID NO: 2482344 - protein, 18 aa, Entamoeba dispar
FRGNIERFHFNPIPLNEY

SEQ ID NO: 2482345 - protein, 18 aa, Entamoeba dispar
FRGNIERFHFNPIPLNNY

SEQ ID NO: 2482346 - protein, 18 aa, Entamoeba dispar
FRGNMERFHFNPIPLNEY

SEQ ID NO: 2482347 - protein, 17 aa, Entamoeba dispar
FRGTRPFRLITTGEDNY

SEQ ID NO: 2482348 - protein, 31 aa, Entamoeba dispar
FRGTYGQLFECFRKLFICKTDTDSKSQLIIS

SEQ ID NO: 2482349 - protein, 17 aa, Entamoeba dispar
FRHCGIAKKKTPTQYDA

SEQ ID NO: 2482350 - protein, 23 aa, Entamoeba dispar
FRIKENYKEFKICVHPKNCNSDL

SEQ ID NO: 2482351 - protein, 21 aa, Entamoeba dispar
FRIPLPDILHWMNIDISSPSG

SEQ ID NO: 2482352 - protein, 22 aa, Entamoeba dispar
FRIPLPDILHWMNIDISSSGKT

SEQ ID NO: 2482353 - protein, 24 aa, Entamoeba dispar
FRIQVSAMDCTGCEVCTTACPVKC

SEQ ID NO: 2482354 - protein, 18 aa, Entamoeba dispar
FRITEGIAGSSGDDMGTG

SEQ ID NO: 2482355 - protein, 17 aa, Entamoeba dispar
FRITSMDGIDEITKNEC

SEQ ID NO: 2482356 - protein, 17 aa, Entamoeba dispar
FRIVSHNILKHGITPTS

SEQ ID NO: 2482357 - protein, 28 aa, Entamoeba dispar
FRIYIKHYRIIKTYVDLVLKKHLQTDTL

SEQ ID NO: 2482358 - protein, 26 aa, Entamoeba dispar
FRKAKMTWFGVEVCLMLKEFFENNNM

SEQ ID NO: 2482359 - protein, 20 aa, Entamoeba dispar
FRKENVCSIDPPGCTDIDDA

SEQ ID NO: 2482360 - protein, 17 aa, Entamoeba dispar
FRKGEKRVLITTDVWAR

SEQ ID NO: 2482361 - protein, 18 aa, Entamoeba dispar
FRKGISGNTFYFGNNDIL

SEQ ID NO: 2482362 - protein, 20 aa, Entamoeba dispar
FRKGNYACIAEMIRGNKTLK

SEQ ID NO: 2482363 - protein, 32 aa, Entamoeba dispar
FRKHHCRKCGLCICSNCSKQTIIINGKKERVC

SEQ ID NO: 2482364 - protein, 20 aa, Entamoeba dispar
FRKLEPEQAILVLQDLLRTN

SEQ ID NO: 2482365 - protein, 17 aa, Entamoeba dispar
FRKPLLIEVINENKIAK

SEQ ID NO: 2482366 - protein, 18 aa, Entamoeba dispar
FRKRCDNEPLGIDQSTEI

SEQ ID NO: 2482367 - protein, 17 aa, Entamoeba dispar
FRKRKSKELFFNEIEPF

SEQ ID NO: 2482368 - protein, 19 aa, Entamoeba dispar
FRKRLGLKPKTIKQPYNIL

SEQ ID NO: 2482369 - protein, 19 aa, Entamoeba dispar
FRKRVFPLKSPQRIEKSND

SEQ ID NO: 2482370 - protein, 20 aa, Entamoeba dispar
FRKTSSFYLFRKCIDVLGNS

SEQ ID NO: 2482371 - protein, 21 aa, Entamoeba dispar
FRKVFEVGPVFRAENSNTRRH

SEQ ID NO: 2482372 - protein, 20 aa, Entamoeba dispar
FRLKTGILRIEKAFFCENNQ

SEQ ID NO: 2482373 - protein, 20 aa, Entamoeba dispar
FRLNNCAHIHVGECINVMCK

SEQ ID NO: 2482374 - protein, 19 aa, Entamoeba dispar
FRLTTNMIDCFGPQSENGL

SEQ ID NO: 2482375 - protein, 19 aa, Entamoeba dispar
FRLTVDAVIERYLQIVLKL

SEQ ID NO: 2482376 - protein, 24 aa, Entamoeba dispar
FRLYLTEGLPYFLLYKEVPKEILE

SEQ ID NO: 2482377 - protein, 17 aa, Entamoeba dispar
FRMTCEIVMTVLRENKD

SEQ ID NO: 2482378 - protein, 18 aa, Entamoeba dispar
FRNEVSILASQGVVRKVC

SEQ ID NO: 2482379 - protein, 17 aa, Entamoeba dispar
FRNGRWKPVKEVKCHDA

SEQ ID NO: 2482380 - protein, 21 aa, Entamoeba dispar
FRNGVLMVIAKLAIKNIQIKN

SEQ ID NO: 2482381 - protein, 17 aa, Entamoeba dispar
FRNIHFASFRSPLRKVH

SEQ ID NO: 2482382 - protein, 18 aa, Entamoeba dispar
FRNLQSRSITCLNEIDKQ

SEQ ID NO: 2482383 - protein, 17 aa, Entamoeba dispar
FRNYLYLCRKLQNVYRL

SEQ ID NO: 2482384 - protein, 25 aa, Entamoeba dispar
FRPEGPIASSFFSYNYCDFELVEDI

SEQ ID NO: 2482385 - protein, 20 aa, Entamoeba dispar
FRPLSYRDTDCFVIVFSYID

SEQ ID NO: 2482386 - protein, 22 aa, Entamoeba dispar
FRPYLNDCIEIVKALISIQHSF

SEQ ID NO: 2482387 - protein, 17 aa, Entamoeba dispar
FRQCGIMDQSLPFFMFE

SEQ ID NO: 2482388 - protein, 17 aa, Entamoeba dispar
FRQELPPHIFALSEETY

SEQ ID NO: 2482389 - protein, 20 aa, Entamoeba dispar
FRQESNFHYLFGVKEAGFYG

SEQ ID NO: 2482390 - protein, 18 aa, Entamoeba dispar
FRQTLRWLTEEPNKEKKS

SEQ ID NO: 2482391 - protein, 22 aa, Entamoeba dispar
FRRDEISVIFCSKIGDVGLDLP

SEQ ID NO: 2482392 - protein, 18 aa, Entamoeba dispar
FRRGEFGACPRVLCDNHA

SEQ ID NO: 2482393 - protein, 18 aa, Entamoeba dispar
FRSEDFLQEIAIMSLLHN

SEQ ID NO: 2482394 - protein, 20 aa, Entamoeba dispar
FRSEYIIQFYGVFIHNKICM

SEQ ID NO: 2482395 - protein, 18 aa, Entamoeba dispar
FRSIPMEEIVSVASRIPI

SEQ ID NO: 2482396 - protein, 24 aa, Entamoeba dispar
FRSKGRIPAATWWNREKGVIMRSS

SEQ ID NO: 2482397 - protein, 24 aa, Entamoeba dispar
FRSKGRIPIVSWISEGNGLLVRSS

SEQ ID NO: 2482398 - protein, 18 aa, Entamoeba dispar
FRSMHGYVTINLKENDKL

SEQ ID NO: 2482399 - protein, 30 aa, Entamoeba dispar
FRSMIDLYFRKAVGAFIVYDVMLRDSFQHL

SEQ ID NO: 2482400 - protein, 23 aa, Entamoeba dispar
FRSRLSCLYCLKCYKEQGETEEL

SEQ ID NO: 2482401 - protein, 19 aa, Entamoeba dispar
FRSVMPVYFRGADCAIIVY

SEQ ID NO: 2482402 - protein, 20 aa, Entamoeba dispar
FRTECLFANIKELVFSSLSD

SEQ ID NO: 2482403 - protein, 17 aa, Entamoeba dispar
FRTIKHPNIINYLDHIV

SEQ ID NO: 2482404 - protein, 17 aa, Entamoeba dispar
FRTLPLPIQGKRNVEQC

SEQ ID NO: 2482405 - protein, 19 aa, Entamoeba dispar
FRTNELLRREKMKEMIKEI

SEQ ID NO: 2482406 - protein, 18 aa, Entamoeba dispar
FRTNESLRREKMKEMIKE

SEQ ID NO: 2482407 - protein, 23 aa, Entamoeba dispar
FRTPKLTKFFKIIITERNDLREM

SEQ ID NO: 2482408 - protein, 19 aa, Entamoeba dispar
FRTPPKYLQQLLVDAGPID

SEQ ID NO: 2482409 - protein, 19 aa, Entamoeba dispar
FRTSASYKIVGRVKSILDG

SEQ ID NO: 2482410 - protein, 18 aa, Entamoeba dispar
FRVGMINGVLSMVKNESV

SEQ ID NO: 2482411 - protein, 19 aa, Entamoeba dispar
FRVKVSIAQHLPILRTMSF

SEQ ID NO: 2482412 - protein, 18 aa, Entamoeba dispar
FRVLMMIPKRDSYFTSLN

SEQ ID NO: 2482413 - protein, 20 aa, Entamoeba dispar
FRVTYLLNCVVIPWLHETNV

SEQ ID NO: 2482414 - protein, 20 aa, Entamoeba dispar
FRVVEIISCDINELLIGNVI

SEQ ID NO: 2482415 - protein, 20 aa, Entamoeba dispar
FRVVVINSLCSFMMVNQRYC

SEQ ID NO: 2482416 - protein, 20 aa, Entamoeba dispar
FRYDISHGVALKTAKRRYQT

SEQ ID NO: 2482417 - protein, 19 aa, Entamoeba dispar
FRYELKCHCKSIASTSVTI

SEQ ID NO: 2482418 - protein, 17 aa, Entamoeba dispar
FRYEYVTETKEQTAKEV

SEQ ID NO: 2482419 - protein, 23 aa, Entamoeba dispar
FRYFESKLAIGMFIHQFAKEHPD

SEQ ID NO: 2482420 - protein, 22 aa, Entamoeba dispar
FRYFNCIGNILSFKICSIDDKS

SEQ ID NO: 2482421 - protein, 17 aa, Entamoeba dispar
FRYKEDINRLNPNGKLE

SEQ ID NO: 2482422 - protein, 17 aa, Entamoeba dispar
FSADEINEFMEIVKSSH

SEQ ID NO: 2482423 - protein, 23 aa, Entamoeba dispar
FSAHCTTEWYWTYDSKALVFCGC

SEQ ID NO: 2482424 - protein, 25 aa, Entamoeba dispar
FSAKFCTNCGTPVKSTPSNNLKTAS

SEQ ID NO: 2482425 - protein, 18 aa, Entamoeba dispar
FSAPTLFTPRMNHLGYIT

SEQ ID NO: 2482426 - protein, 19 aa, Entamoeba dispar
FSATFPKQIQRLAADFLDN

SEQ ID NO: 2482427 - protein, 26 aa, Entamoeba dispar
FSATFPKQIQRLAADFLDNYVFITVG

SEQ ID NO: 2482428 - protein, 20 aa, Entamoeba dispar
FSCDTCGYRSNEVKCGGPVS

SEQ ID NO: 2482429 - protein, 30 aa, Entamoeba dispar
FSCIKRISLKSCTIKQLLFQKNIFESIELI

SEQ ID NO: 2482430 - protein, 23 aa, Entamoeba dispar
FSCKEIQDILSLTLQRSSIVCKR

SEQ ID NO: 2482431 - protein, 21 aa, Entamoeba dispar
FSCKNPSRVIFRIEEYTRAVW

SEQ ID NO: 2482432 - protein, 27 aa, Entamoeba dispar
FSCLCKPKNNIIGLNWIHCSPATSNHL

SEQ ID NO: 2482433 - protein, 23 aa, Entamoeba dispar
FSDCSRSYLHLVGYEEVTDSIKE

SEQ ID NO: 2482434 - protein, 23 aa, Entamoeba dispar
FSDECSRLLFFIERHAFDVCKIL

SEQ ID NO: 2482435 - protein, 24 aa, Entamoeba dispar
FSDECSRLLFFIERHAFDVCKILL

SEQ ID NO: 2482436 - protein, 17 aa, Entamoeba dispar
FSDGLIQRKWYDDVVFK

SEQ ID NO: 2482437 - protein, 19 aa, Entamoeba dispar
FSDRKSLRLSSCRKSYHQR

SEQ ID NO: 2482438 - protein, 27 aa, Entamoeba dispar
FSECFNLRFVPFPPSVHQIERFAFSRC

SEQ ID NO: 2482439 - protein, 25 aa, Entamoeba dispar
FSEEHGAVCPINWKTGKDTIEPTPE

SEQ ID NO: 2482440 - protein, 25 aa, Entamoeba dispar
FSEEHGAVCPINWKTGKDTIEQTPE

SEQ ID NO: 2482441 - protein, 30 aa, Entamoeba dispar
FSEETTCAISLFVFEGWLNTFIKFINNQRK

SEQ ID NO: 2482442 - protein, 17 aa, Entamoeba dispar
FSEICQKISNLLFGTML

SEQ ID NO: 2482443 - protein, 17 aa, Entamoeba dispar
FSEKIFPIEIGISSYSL

SEQ ID NO: 2482444 - protein, 20 aa, Entamoeba dispar
FSEKLPILINKERPKYQIKE

SEQ ID NO: 2482445 - protein, 19 aa, Entamoeba dispar
FSEMGYPLFEYGINSLYQT

SEQ ID NO: 2482446 - protein, 25 aa, Entamoeba dispar
FSENCIKPEGRNLVSCKMYNEVVFH

SEQ ID NO: 2482447 - protein, 24 aa, Entamoeba dispar
FSESIRISWDQAIKEALECPDYLE

SEQ ID NO: 2482448 - protein, 27 aa, Entamoeba dispar
FSEVPRRVSDCFVICACDGVWDVFSNE

SEQ ID NO: 2482449 - protein, 19 aa, Entamoeba dispar
FSFAPFPFHPAVPLFQELC

SEQ ID NO: 2482450 - protein, 18 aa, Entamoeba dispar
FSFDSSRIDMSWIEHGKT

SEQ ID NO: 2482451 - protein, 18 aa, Entamoeba dispar
FSFDSSRIDMSWIEYGKT

SEQ ID NO: 2482452 - protein, 30 aa, Entamoeba dispar
FSFIIRSTYSYTFELWFIFKNEDNSLRMSF

SEQ ID NO: 2482453 - protein, 24 aa, Entamoeba dispar
FSFIPRLREPFITSILTDFIDKDE

SEQ ID NO: 2482454 - protein, 18 aa, Entamoeba dispar
FSFQWKKEDRLVLLNIVN

SEQ ID NO: 2482455 - protein, 17 aa, Entamoeba dispar
FSFSHCSSLRQIKLPPL

SEQ ID NO: 2482456 - protein, 25 aa, Entamoeba dispar
FSFYEFWEHVCIVWTKCYCYIPQKE

SEQ ID NO: 2482457 - protein, 17 aa, Entamoeba dispar
FSGAKGCIAVFDYSSPD

SEQ ID NO: 2482458 - protein, 19 aa, Entamoeba dispar
FSGCIRNIIIAKLIMRIGF

SEQ ID NO: 2482459 - protein, 26 aa, Entamoeba dispar
FSGCNARPSVCPCWSVEPKLGTNPLV

SEQ ID NO: 2482460 - protein, 24 aa, Entamoeba dispar
FSGGRDGKLCFWKMDKKPSYYNIY

SEQ ID NO: 2482461 - protein, 26 aa, Entamoeba dispar
FSGGWRMRISIAKAIYMHPDLLLLDE

SEQ ID NO: 2482462 - protein, 17 aa, Entamoeba dispar
FSGKEYLPSVIDIKNPS

SEQ ID NO: 2482463 - protein, 18 aa, Entamoeba dispar
FSGMIHYLLQGLKNKNNE

SEQ ID NO: 2482464 - protein, 18 aa, Entamoeba dispar
FSGNVWLNHIKRCLQRTK

SEQ ID NO: 2482465 - protein, 19 aa, Entamoeba dispar
FSGQNCGIVGLTLNNDNIR

SEQ ID NO: 2482466 - protein, 25 aa, Entamoeba dispar
FSHEMAKFYIAELLLAIDSIHQLNY

SEQ ID NO: 2482467 - protein, 18 aa, Entamoeba dispar
FSHNYIIQYIPLFSKLFS

SEQ ID NO: 2482468 - protein, 33 aa, Entamoeba dispar
FSHTKIGQFLSELKVELPFPLKKTHHLLFTITD

SEQ ID NO: 2482469 - protein, 20 aa, Entamoeba dispar
FSIFHYIDLSKCVPLKMDVL

SEQ ID NO: 2482470 - protein, 23 aa, Entamoeba dispar
FSIGYCPFITKIPYLGYDGYFLK

SEQ ID NO: 2482471 - protein, 20 aa, Entamoeba dispar
FSIKIPLKDLVLFFDSIISE

SEQ ID NO: 2482472 - protein, 28 aa, Entamoeba dispar
FSIKKICDLAEALLLAVIEYLNKRKEYK

SEQ ID NO: 2482473 - protein, 23 aa, Entamoeba dispar
FSIKTGVIVGSLFHHTARVHTLI

SEQ ID NO: 2482474 - protein, 18 aa, Entamoeba dispar
FSILSKFFIKLSNKLPNP

SEQ ID NO: 2482475 - protein, 17 aa, Entamoeba dispar
FSILYGLINRLVKYSSI

SEQ ID NO: 2482476 - protein, 18 aa, Entamoeba dispar
FSINPPLYGIAWFNKYNF

SEQ ID NO: 2482477 - protein, 23 aa, Entamoeba dispar
FSIPVDLNPSFTLKMNNGLKNEE

SEQ ID NO: 2482478 - protein, 20 aa, Entamoeba dispar
FSKDGMRIGGNPSYIDLDPR

SEQ ID NO: 2482479 - protein, 23 aa, Entamoeba dispar
FSKIWPCNLFPPSLPTPNIENEE

SEQ ID NO: 2482480 - protein, 17 aa, Entamoeba dispar
FSKKGERTISLFDQRKE

SEQ ID NO: 2482481 - protein, 23 aa, Entamoeba dispar
FSKLREVMKIAVPPCLPFIGSTM

SEQ ID NO: 2482482 - protein, 21 aa, Entamoeba dispar
FSKLVSCQNIGELSIEQQKKV

SEQ ID NO: 2482483 - protein, 19 aa, Entamoeba dispar
FSKMFPHTTDLVIGTLLNS

SEQ ID NO: 2482484 - protein, 21 aa, Entamoeba dispar
FSKNEIDERMLLNLQKKKWTD

SEQ ID NO: 2482485 - protein, 34 aa, Entamoeba dispar
FSKQILPKFFKHSNICSFVRQLNIYGFRKLETQT

SEQ ID NO: 2482486 - protein, 17 aa, Entamoeba dispar
FSKVMKCYDQLRNCQVA

SEQ ID NO: 2482487 - protein, 19 aa, Entamoeba dispar
FSLAKSFLYDQFEYYSSTP

SEQ ID NO: 2482488 - protein, 18 aa, Entamoeba dispar
FSLENRWFTFPILLHQYI

SEQ ID NO: 2482489 - protein, 17 aa, Entamoeba dispar
FSLFELKLMTSLEKVTI

SEQ ID NO: 2482490 - protein, 19 aa, Entamoeba dispar
FSLGKYRIFGETIDIAVGN

SEQ ID NO: 2482491 - protein, 19 aa, Entamoeba dispar
FSLIHCNLCNTDVCCYIPR

SEQ ID NO: 2482492 - protein, 27 aa, Entamoeba dispar
FSLIIPEIDKPWYLKFNNAAIYDDDIK

SEQ ID NO: 2482493 - protein, 18 aa, Entamoeba dispar
FSLINSKCLKAIHCLLRN

SEQ ID NO: 2482494 - protein, 26 aa, Entamoeba dispar
FSLIRSVVFETCIPKLITNEFDKINI

SEQ ID NO: 2482495 - protein, 25 aa, Entamoeba dispar
FSLLFVFPMSGFIPICVEYLQQHQK

SEQ ID NO: 2482496 - protein, 23 aa, Entamoeba dispar
FSLLMPIFRWVISKKDKTTEIVK

SEQ ID NO: 2482497 - protein, 18 aa, Entamoeba dispar
FSLLTNLYLPYIISEELF

SEQ ID NO: 2482498 - protein, 17 aa, Entamoeba dispar
FSLNGFYNFIKRRRFST

SEQ ID NO: 2482499 - protein, 20 aa, Entamoeba dispar
FSLNNAKAFYSLYSKESKEE

SEQ ID NO: 2482500 - protein, 17 aa, Entamoeba dispar
FSLPYLLEHCVRILQDL

SEQ ID NO: 2482501 - protein, 17 aa, Entamoeba dispar
FSLQQFVVIPRDLFITH

SEQ ID NO: 2482502 - protein, 22 aa, Entamoeba dispar
FSLQTICPFTLAKLASFGKEVL

SEQ ID NO: 2482503 - protein, 18 aa, Entamoeba dispar
FSLQYFLIINVHLKDTSN

SEQ ID NO: 2482504 - protein, 28 aa, Entamoeba dispar
FSLSESRLECLKKISTIIQMLNYAPINK

SEQ ID NO: 2482505 - protein, 20 aa, Entamoeba dispar
FSLSNIRGVNKWRKDPFNIN

SEQ ID NO: 2482506 - protein, 20 aa, Entamoeba dispar
FSLSRAHSFIQPKHIGTKIK

SEQ ID NO: 2482507 - protein, 17 aa, Entamoeba dispar
FSLSSFSTYPCFKNVKQ

SEQ ID NO: 2482508 - protein, 21 aa, Entamoeba dispar
FSMINKRCGQVLLLFEENPIP

SEQ ID NO: 2482509 - protein, 27 aa, Entamoeba dispar
FSMVREIRSGFHFPMRTNEVVLSTQLK

SEQ ID NO: 2482510 - protein, 25 aa, Entamoeba dispar
FSNALLYQFHLKKGDAIGFISRNRY

SEQ ID NO: 2482511 - protein, 23 aa, Entamoeba dispar
FSNDCIYCDGEVDFNLKNECIVN

SEQ ID NO: 2482512 - protein, 22 aa, Entamoeba dispar
FSNEPVEFILFIHCVEAIIRQN

SEQ ID NO: 2482513 - protein, 17 aa, Entamoeba dispar
FSNGGKIVGCIMSSYLL

SEQ ID NO: 2482514 - protein, 18 aa, Entamoeba dispar
FSNICIMNNDYLIEGKLE

SEQ ID NO: 2482515 - protein, 17 aa, Entamoeba dispar
FSNIKFALIRNMTPPII

SEQ ID NO: 2482516 - protein, 17 aa, Entamoeba dispar
FSNLEELFILKDIYESI

SEQ ID NO: 2482517 - protein, 22 aa, Entamoeba dispar
FSNLKSIYSYCGSKINVSSLKS

SEQ ID NO: 2482518 - protein, 19 aa, Entamoeba dispar
FSNNLKYIIKFIYDILPFS

SEQ ID NO: 2482519 - protein, 19 aa, Entamoeba dispar
FSNPLISLTQIWIYHDSLK

SEQ ID NO: 2482520 - protein, 17 aa, Entamoeba dispar
FSNSFFTLNDLDNIVND

SEQ ID NO: 2482521 - protein, 18 aa, Entamoeba dispar
FSNSGKIIPQYLYDDQLS

SEQ ID NO: 2482522 - protein, 19 aa, Entamoeba dispar
FSNSGKIIPQYLYDDQLSL

SEQ ID NO: 2482523 - protein, 25 aa, Entamoeba dispar
FSNSPVKCLRWHKNATNIFISLFEN

SEQ ID NO: 2482524 - protein, 26 aa, Entamoeba dispar
FSNYGWSLTCELSFLQSLYQYGNNME

SEQ ID NO: 2482525 - protein, 17 aa, Entamoeba dispar
FSPAFSCVTRYHNDSYI

SEQ ID NO: 2482526 - protein, 20 aa, Entamoeba dispar
FSPAIPFVCKTNADIQFKPL

SEQ ID NO: 2482527 - protein, 19 aa, Entamoeba dispar
FSPCPSGIMNELIYLCEDM

SEQ ID NO: 2482528 - protein, 17 aa, Entamoeba dispar
FSPDGSMCVCVSSDKSI

SEQ ID NO: 2482529 - protein, 18 aa, Entamoeba dispar
FSPDGSMCVCVSSDKSIS

SEQ ID NO: 2482530 - protein, 17 aa, Entamoeba dispar
FSPEQGIRLFDTLISDQ

SEQ ID NO: 2482531 - protein, 19 aa, Entamoeba dispar
FSPIELTTPIATFVFSHPN

SEQ ID NO: 2482532 - protein, 19 aa, Entamoeba dispar
FSPSIGMPSSIMDELQYSP

SEQ ID NO: 2482533 - protein, 29 aa, Entamoeba dispar
FSPSSKFFKKWFEKYSMLSNFPFVYIVDV

SEQ ID NO: 2482534 - protein, 17 aa, Entamoeba dispar
FSPSTSFDWNTINIDRK

SEQ ID NO: 2482535 - protein, 24 aa, Entamoeba dispar
FSPYDSGLVFSIFFPERNRFPGVI

SEQ ID NO: 2482536 - protein, 23 aa, Entamoeba dispar
FSQANIFSGSTLIYLIKGDGKTM

SEQ ID NO: 2482537 - protein, 17 aa, Entamoeba dispar
FSQIIAWFNQVDKDHSG

SEQ ID NO: 2482538 - protein, 23 aa, Entamoeba dispar
FSQKGYLSTISMFLDDKETTKQE

SEQ ID NO: 2482539 - protein, 19 aa, Entamoeba dispar
FSQLFLDLFGRYFAFFEQQ

SEQ ID NO: 2482540 - protein, 21 aa, Entamoeba dispar
FSQPRFNDMPSVTVSIEDIIN

SEQ ID NO: 2482541 - protein, 17 aa, Entamoeba dispar
FSQPRFNDMSSVTVNIE

SEQ ID NO: 2482542 - protein, 17 aa, Entamoeba dispar
FSQVIGNGIKIRKEDIF

SEQ ID NO: 2482543 - protein, 24 aa, Entamoeba dispar
FSRESHKLYAIKIIKNSSVKRTTM

SEQ ID NO: 2482544 - protein, 17 aa, Entamoeba dispar
FSREWDILLDKIVVDQL

SEQ ID NO: 2482545 - protein, 28 aa, Entamoeba dispar
FSRGQAFVQSWFDHWGIVPGDPLDKEIK

SEQ ID NO: 2482546 - protein, 17 aa, Entamoeba dispar
FSRICPKEIKEISENID

SEQ ID NO: 2482547 - protein, 20 aa, Entamoeba dispar
FSRLRVAALKNLKASSLTIT

SEQ ID NO: 2482548 - protein, 21 aa, Entamoeba dispar
FSRNICLSINTFLMFSKYLDD

SEQ ID NO: 2482549 - protein, 18 aa, Entamoeba dispar
FSRSVLRNRPSEYIQQEK

SEQ ID NO: 2482550 - protein, 20 aa, Entamoeba dispar
FSRVVDFEFLATLVGKKGEK

SEQ ID NO: 2482551 - protein, 19 aa, Entamoeba dispar
FSSCCLICKIQCECDSNNH

SEQ ID NO: 2482552 - protein, 20 aa, Entamoeba dispar
FSSCCLICKIQCECDSNNHQ

SEQ ID NO: 2482553 - protein, 19 aa, Entamoeba dispar
FSSDLIIKYCNILKGIDAG

SEQ ID NO: 2482554 - protein, 20 aa, Entamoeba dispar
FSSDVLKTLCEFINKTQQRK

SEQ ID NO: 2482555 - protein, 17 aa, Entamoeba dispar
FSSFITDRCRKRKSNDI

SEQ ID NO: 2482556 - protein, 30 aa, Entamoeba dispar
FSSIIPEIDEPWYLKFNNSAIFANKTTDEF

SEQ ID NO: 2482557 - protein, 27 aa, Entamoeba dispar
FSSIIPEIDKPWYLKFNNSAIYDDDIK

SEQ ID NO: 2482558 - protein, 20 aa, Entamoeba dispar
FSSIIPEINEPWYLKFNNSA

SEQ ID NO: 2482559 - protein, 18 aa, Entamoeba dispar
FSSIIPYIDEPWYLKFNN

SEQ ID NO: 2482560 - protein, 19 aa, Entamoeba dispar
FSSIIPYIDKPWYLKFNNS

SEQ ID NO: 2482561 - protein, 17 aa, Entamoeba dispar
FSSLLAIQNDFEEELFI

SEQ ID NO: 2482562 - protein, 17 aa, Entamoeba dispar
FSSLTFLDISFNKLNLI

SEQ ID NO: 2482563 - protein, 25 aa, Entamoeba dispar
FSSLYQLIFHPIKFFTPTEKKVGEV

SEQ ID NO: 2482564 - protein, 21 aa, Entamoeba dispar
FSSMKTFVVFIVLDNPSNESI

SEQ ID NO: 2482565 - protein, 25 aa, Entamoeba dispar
FSSNLKFIGSYAFVGCAFNKVILPN

SEQ ID NO: 2482566 - protein, 17 aa, Entamoeba dispar
FSSPARCLVLDSIKNVQ

SEQ ID NO: 2482567 - protein, 18 aa, Entamoeba dispar
FSSPSLSIIRHFSHLFNL

SEQ ID NO: 2482568 - protein, 24 aa, Entamoeba dispar
FSSRNIQCIIKRNAVYTGTPDEMK

SEQ ID NO: 2482569 - protein, 22 aa, Entamoeba dispar
FSSSELDSGFVSPMVSVTREIP

SEQ ID NO: 2482570 - protein, 17 aa, Entamoeba dispar
FSSSVKEHSECPVCKSP

SEQ ID NO: 2482571 - protein, 20 aa, Entamoeba dispar
FSTIIPEIDEPWYLKFNNSA

SEQ ID NO: 2482572 - protein, 33 aa, Entamoeba dispar
FSTIIPEIDKPWYLKFNCLYIYKDNTENPLTQN

SEQ ID NO: 2482573 - protein, 21 aa, Entamoeba dispar
FSTIIPEIDKPWYLKFNNSAI

SEQ ID NO: 2482574 - protein, 19 aa, Entamoeba dispar
FSTIIPYIDKPWYLKFNNS

SEQ ID NO: 2482575 - protein, 20 aa, Entamoeba dispar
FSTNCLKTNLLIKTKNQGEF

SEQ ID NO: 2482576 - protein, 21 aa, Entamoeba dispar
FSTRLQRISQFFLTQPGISKE

SEQ ID NO: 2482577 - protein, 22 aa, Entamoeba dispar
FSTRVRLLRFIQFSKNETSDVK

SEQ ID NO: 2482578 - protein, 27 aa, Entamoeba dispar
FSTSHRIWLWIVNMPQIIHAMNVLAPP

SEQ ID NO: 2482579 - protein, 17 aa, Entamoeba dispar
FSTYKGILHISATSVSL

SEQ ID NO: 2482580 - protein, 25 aa, Entamoeba dispar
FSTYYPYWRFEIIYMSHNNSFHFFN

SEQ ID NO: 2482581 - protein, 24 aa, Entamoeba dispar
FSVECTYAGTAFRGNARTFLQKTQ

SEQ ID NO: 2482582 - protein, 25 aa, Entamoeba dispar
FSVFTKPHWKKILLDTFNHCTNIET

SEQ ID NO: 2482583 - protein, 22 aa, Entamoeba dispar
FSVLPPFVPWVLLSTATTTFEL

SEQ ID NO: 2482584 - protein, 21 aa, Entamoeba dispar
FSVNVLPQYAGKLYISLTPYD

SEQ ID NO: 2482585 - protein, 17 aa, Entamoeba dispar
FSVQRIIAFETEADNIL

SEQ ID NO: 2482586 - protein, 20 aa, Entamoeba dispar
FSVRGAELLSKYVGETEKNI

SEQ ID NO: 2482587 - protein, 25 aa, Entamoeba dispar
FSVSLELQGLLNLKGKYQIDELTER

SEQ ID NO: 2482588 - protein, 24 aa, Entamoeba dispar
FSVTVEIFGKMAFKQITEQKYFDV

SEQ ID NO: 2482589 - protein, 19 aa, Entamoeba dispar
FSYGIILWEMTYRTIHQKY

SEQ ID NO: 2482590 - protein, 25 aa, Entamoeba dispar
FSYRKELLEATGFSTFNVVYDSKIN

SEQ ID NO: 2482591 - protein, 29 aa, Entamoeba dispar
FSYTFPELIKIRSEFKFFNVIQLKLQMAD

SEQ ID NO: 2482592 - protein, 27 aa, Entamoeba dispar
FTAFGKRMLRERFLLKPLMDVNKILHR

SEQ ID NO: 2482593 - protein, 17 aa, Entamoeba dispar
FTAICIVWVQCLVDLHF

SEQ ID NO: 2482594 - protein, 18 aa, Entamoeba dispar
FTAIDTWINEYSRALNGK

SEQ ID NO: 2482595 - protein, 24 aa, Entamoeba dispar
FTAQIKASCGIAQGPFYPQPEKNK

SEQ ID NO: 2482596 - protein, 24 aa, Entamoeba dispar
FTARGCSCISLGRCTVCGCSCSEH

SEQ ID NO: 2482597 - protein, 17 aa, Entamoeba dispar
FTAVFVFASSMTQQQVM

SEQ ID NO: 2482598 - protein, 23 aa, Entamoeba dispar
FTCGINICMTGDNLLLMSDGIYD

SEQ ID NO: 2482599 - protein, 25 aa, Entamoeba dispar
FTCKCADCISLGVPLEFTQKDMPKW

SEQ ID NO: 2482600 - protein, 17 aa, Entamoeba dispar
FTDCVISVPGYFTENQR

SEQ ID NO: 2482601 - protein, 18 aa, Entamoeba dispar
FTDFWNGYGSCITPDKIV

SEQ ID NO: 2482602 - protein, 21 aa, Entamoeba dispar
FTDIKGIFIVFSLDNMESLNH

SEQ ID NO: 2482603 - protein, 22 aa, Entamoeba dispar
FTDIKGIFIVFSLDNMESLNHC

SEQ ID NO: 2482604 - protein, 20 aa, Entamoeba dispar
FTDIKPFYSSFHIEDDNSSS

SEQ ID NO: 2482605 - protein, 20 aa, Entamoeba dispar
FTDKELSHFGRLGSTSDDGR

SEQ ID NO: 2482606 - protein, 24 aa, Entamoeba dispar
FTDKRKPWTGILLFGPPGTGKSFL

SEQ ID NO: 2482607 - protein, 18 aa, Entamoeba dispar
FTDPRFFWNESLVSILQP

SEQ ID NO: 2482608 - protein, 26 aa, Entamoeba dispar
FTDTYQRMVFLWMIWLIMNQHPQVFG

SEQ ID NO: 2482609 - protein, 23 aa, Entamoeba dispar
FTEFMKMKFNFEGTKEELQSFSN

SEQ ID NO: 2482610 - protein, 23 aa, Entamoeba dispar
FTEKLEFDEMLFSNNHILLEVLS

SEQ ID NO: 2482611 - protein, 22 aa, Entamoeba dispar
FTEKNEIFFMDNFMMPIYLHDS

SEQ ID NO: 2482612 - protein, 26 aa, Entamoeba dispar
FTEMFMCGVIYKLTQQYILMNIHQKQ

SEQ ID NO: 2482613 - protein, 18 aa, Entamoeba dispar
FTENKIIVIVAIDDREES

SEQ ID NO: 2482614 - protein, 25 aa, Entamoeba dispar
FTERKCYYGVIFVLKYMMILDLMRK

SEQ ID NO: 2482615 - protein, 24 aa, Entamoeba dispar
FTETARIAALFGMNQILRRETSEL

SEQ ID NO: 2482616 - protein, 18 aa, Entamoeba dispar
FTFDQIINAFDFFQNKPT

SEQ ID NO: 2482617 - protein, 24 aa, Entamoeba dispar
FTFKILKGQMEWNGCELSNGTAQP

SEQ ID NO: 2482618 - protein, 19 aa, Entamoeba dispar
FTFNFPIVQPLNGYLQQLT

SEQ ID NO: 2482619 - protein, 24 aa, Entamoeba dispar
FTFRFPLIHSSIYCHVLFIQIPHI

SEQ ID NO: 2482620 - protein, 17 aa, Entamoeba dispar
FTGDILWTTLKIVNSIV

SEQ ID NO: 2482621 - protein, 19 aa, Entamoeba dispar
FTGEVSPLPVIFKAGDDIR

SEQ ID NO: 2482622 - protein, 17 aa, Entamoeba dispar
FTGYNIMNFDFKYLLER

SEQ ID NO: 2482623 - protein, 27 aa, Entamoeba dispar
FTHEDLDIILSFCLCINVTIDQNIKNS

SEQ ID NO: 2482624 - protein, 23 aa, Entamoeba dispar
FTHKTPCLVIINGIKEGVNYNDP

SEQ ID NO: 2482625 - protein, 27 aa, Entamoeba dispar
FTHPQLSFRFIEWCILNYSEIIHQCQI

SEQ ID NO: 2482626 - protein, 19 aa, Entamoeba dispar
FTICDPCFFTEFRDACMAA

SEQ ID NO: 2482627 - protein, 21 aa, Entamoeba dispar
FTIEMINILLKRREYDKQTAS

SEQ ID NO: 2482628 - protein, 18 aa, Entamoeba dispar
FTIKEFRNEVSILASQGV

SEQ ID NO: 2482629 - protein, 24 aa, Entamoeba dispar
FTIKKIKMIRCFNLSLKDHDISPF

SEQ ID NO: 2482630 - protein, 17 aa, Entamoeba dispar
FTILQRICEIIGASLDT

SEQ ID NO: 2482631 - protein, 23 aa, Entamoeba dispar
FTILRPFGTEMWDIEMINFCDMT

SEQ ID NO: 2482632 - protein, 27 aa, Entamoeba dispar
FTIMDSRFLPFRELQGFEGNIINSISH

SEQ ID NO: 2482633 - protein, 17 aa, Entamoeba dispar
FTINGGIYPVHNLVDED

SEQ ID NO: 2482634 - protein, 18 aa, Entamoeba dispar
FTIPFGYYEVKVIEAKTM

SEQ ID NO: 2482635 - protein, 18 aa, Entamoeba dispar
FTIYCSKQPIGQHGIYQN

SEQ ID NO: 2482636 - protein, 25 aa, Entamoeba dispar
FTKGLKEWGSAILVGFNGDPNGKDE

SEQ ID NO: 2482637 - protein, 18 aa, Entamoeba dispar
FTKLPPYNSPIIDIPFFL

SEQ ID NO: 2482638 - protein, 24 aa, Entamoeba dispar
FTKLRASWNSNRMAGAKIIATKLA

SEQ ID NO: 2482639 - protein, 20 aa, Entamoeba dispar
FTKLRIFFPNIIDLKHVTNQ

SEQ ID NO: 2482640 - protein, 18 aa, Entamoeba dispar
FTKPERNEYIFGSVIDVS

SEQ ID NO: 2482641 - protein, 18 aa, Entamoeba dispar
FTKPQQWKLIDNILSSHS

SEQ ID NO: 2482642 - protein, 19 aa, Entamoeba dispar
FTKRIVCGVESFSSPDFTY

SEQ ID NO: 2482643 - protein, 17 aa, Entamoeba dispar
FTLADGTFWPIPITMSV

SEQ ID NO: 2482644 - protein, 30 aa, Entamoeba dispar
FTLIKNVQCFKLSLKLLQPFDLIRIKEYDI

SEQ ID NO: 2482645 - protein, 30 aa, Entamoeba dispar
FTLKPEYAIELKFIIKMICTAFVNDEIGII

SEQ ID NO: 2482646 - protein, 17 aa, Entamoeba dispar
FTLLGRVGAAACSQQLS

SEQ ID NO: 2482647 - protein, 26 aa, Entamoeba dispar
FTMFKVDSGFCYLSCPDCKKKIADGS

SEQ ID NO: 2482648 - protein, 18 aa, Entamoeba dispar
FTMPSLQSIQFNKNRITS

SEQ ID NO: 2482649 - protein, 19 aa, Entamoeba dispar
FTNAGLIPRSINALIEELK

SEQ ID NO: 2482650 - protein, 17 aa, Entamoeba dispar
FTNCSIGIIADGCGWGF

SEQ ID NO: 2482651 - protein, 19 aa, Entamoeba dispar
FTNHLARAVLIIGAPYLQS

SEQ ID NO: 2482652 - protein, 22 aa, Entamoeba dispar
FTNKEFKTWFIENLMIHIERRK

SEQ ID NO: 2482653 - protein, 18 aa, Entamoeba dispar
FTNLYRPVLAYKEIQENF

SEQ ID NO: 2482654 - protein, 23 aa, Entamoeba dispar
FTNQRLCKSVQFDKQLGLDSSFD

SEQ ID NO: 2482655 - protein, 28 aa, Entamoeba dispar
FTNRCGHSFCKQCILEQILTGMRENGKS

SEQ ID NO: 2482656 - protein, 17 aa, Entamoeba dispar
FTPEILPGITAGNCVVS

SEQ ID NO: 2482657 - protein, 20 aa, Entamoeba dispar
FTPELSRCHLKDLKLFDCEN

SEQ ID NO: 2482658 - protein, 26 aa, Entamoeba dispar
FTPIIDECYPLWVYKSTPGLFCIQSF

SEQ ID NO: 2482659 - protein, 18 aa, Entamoeba dispar
FTPNEIKKIHGFSSEFTT

SEQ ID NO: 2482660 - protein, 19 aa, Entamoeba dispar
FTQHYADLMGYKDGVESKD

SEQ ID NO: 2482661 - protein, 34 aa, Entamoeba dispar
FTQIQHCILNIFSLTRFNLITGLLSIELFLEALD

SEQ ID NO: 2482662 - protein, 28 aa, Entamoeba dispar
FTQKEIRLPFCIKILEIFVEYLTDIEIV

SEQ ID NO: 2482663 - protein, 18 aa, Entamoeba dispar
FTQKVKDYIIFKASEQGV

SEQ ID NO: 2482664 - protein, 22 aa, Entamoeba dispar
FTQLGDGCFERCSSLANIHIPT

SEQ ID NO: 2482665 - protein, 22 aa, Entamoeba dispar
FTRKTNGYSLWVFGSIDNLLSV

SEQ ID NO: 2482666 - protein, 26 aa, Entamoeba dispar
FTRLKIEKYPALKVWIQQLCPTYPPC

SEQ ID NO: 2482667 - protein, 17 aa, Entamoeba dispar
FTRLKIELLKSYFSPDR

SEQ ID NO: 2482668 - protein, 18 aa, Entamoeba dispar
FTRLPTKHIQEFKTSTEY

SEQ ID NO: 2482669 - protein, 19 aa, Entamoeba dispar
FTRRSFLSSITKTSLPSLF

SEQ ID NO: 2482670 - protein, 22 aa, Entamoeba dispar
FTRSVALMSMVGYILGLGDRHP

SEQ ID NO: 2482671 - protein, 20 aa, Entamoeba dispar
FTRTFFRKTLAYFVIVDSTI

SEQ ID NO: 2482672 - protein, 21 aa, Entamoeba dispar
FTRVGKRYDVCLVSEHKGTVL

SEQ ID NO: 2482673 - protein, 18 aa, Entamoeba dispar
FTSDCLDILIDSELWDLR

SEQ ID NO: 2482674 - protein, 24 aa, Entamoeba dispar
FTSDFHLALFVLRLLLSKKNELKD

SEQ ID NO: 2482675 - protein, 19 aa, Entamoeba dispar
FTSEPSLWINPQFIQGLDA

SEQ ID NO: 2482676 - protein, 17 aa, Entamoeba dispar
FTSFNACCLLKNQIELM

SEQ ID NO: 2482677 - protein, 18 aa, Entamoeba dispar
FTSGNEFIFKSFKVTLID

SEQ ID NO: 2482678 - protein, 18 aa, Entamoeba dispar
FTSPFKIKAFREDFVYGF

SEQ ID NO: 2482679 - protein, 18 aa, Entamoeba dispar
FTSQHWIVRIYKVNKPNP

SEQ ID NO: 2482680 - protein, 23 aa, Entamoeba dispar
FTSSIPLVLCKSTIEFQQPKKKG

SEQ ID NO: 2482681 - protein, 20 aa, Entamoeba dispar
FTTLKIKFKNHLTSFHKAFY

SEQ ID NO: 2482682 - protein, 17 aa, Entamoeba dispar
FTTLPFDSSFFIGLLDL

SEQ ID NO: 2482683 - protein, 20 aa, Entamoeba dispar
FTTRLNNVFVIGKGTETLVN

SEQ ID NO: 2482684 - protein, 21 aa, Entamoeba dispar
FTTSCIFRNLYSQQKVVIFYC

SEQ ID NO: 2482685 - protein, 19 aa, Entamoeba dispar
FTTTITLSTSWREYHHLSS

SEQ ID NO: 2482686 - protein, 20 aa, Entamoeba dispar
FTVCIDWKSDSLIKYDQSIA

SEQ ID NO: 2482687 - protein, 18 aa, Entamoeba dispar
FTVEKVIVIWDRFISDPR

SEQ ID NO: 2482688 - protein, 17 aa, Entamoeba dispar
FTVKKKKYFKLLVILST

SEQ ID NO: 2482689 - protein, 17 aa, Entamoeba dispar
FTVKLPWEFTTSETPIK

SEQ ID NO: 2482690 - protein, 21 aa, Entamoeba dispar
FTVKYNKRYIGYIDIDLNLLP

SEQ ID NO: 2482691 - protein, 23 aa, Entamoeba dispar
FTVYCSKQPIGQHGIYQNDVNMK

SEQ ID NO: 2482692 - protein, 25 aa, Entamoeba dispar
FTVYNFVQGFGFDGFVFVDGRSHKE

SEQ ID NO: 2482693 - protein, 17 aa, Entamoeba dispar
FTYLKLFKEAIPKFKVI

SEQ ID NO: 2482694 - protein, 17 aa, Entamoeba dispar
FVACDKFGEDANTQICT

SEQ ID NO: 2482695 - protein, 20 aa, Entamoeba dispar
FVALAVRLYVKLMKKAGLEY

SEQ ID NO: 2482696 - protein, 26 aa, Entamoeba dispar
FVALKCGCVISKLALDEIKSINGHKC

SEQ ID NO: 2482697 - protein, 19 aa, Entamoeba dispar
FVALYARKFLQQELHPKLL

SEQ ID NO: 2482698 - protein, 17 aa, Entamoeba dispar
FVAQTAFSNLINTLKLM

SEQ ID NO: 2482699 - protein, 18 aa, Entamoeba dispar
FVARKEWIIVGSDDMMIR

SEQ ID NO: 2482700 - protein, 22 aa, Entamoeba dispar
FVCKNCKKPLGTNPFHNVENSP

SEQ ID NO: 2482701 - protein, 22 aa, Entamoeba dispar
FVCNLKPSKLRGIPSEAMILAA

SEQ ID NO: 2482702 - protein, 17 aa, Entamoeba dispar
FVCRENKTYIKIIDGKL

SEQ ID NO: 2482703 - protein, 24 aa, Entamoeba dispar
FVCTNCGAPIQGSYMIKNGKIVCK

SEQ ID NO: 2482704 - protein, 20 aa, Entamoeba dispar
FVDFESIRPLIPIIQSNTNS

SEQ ID NO: 2482705 - protein, 19 aa, Entamoeba dispar
FVDKVIFIYRFQKETLQRL

SEQ ID NO: 2482706 - protein, 22 aa, Entamoeba dispar
FVDLIFILYIKWERTNDDWVQL

SEQ ID NO: 2482707 - protein, 29 aa, Entamoeba dispar
FVDLNYGCFLCCACGRAHMLFPKVQNTSN

SEQ ID NO: 2482708 - protein, 18 aa, Entamoeba dispar
FVDNTIRIYRGEVSEMPK

SEQ ID NO: 2482709 - protein, 23 aa, Entamoeba dispar
FVDWLSKHYKEFGAHLEFVTDKS

SEQ ID NO: 2482710 - protein, 24 aa, Entamoeba dispar
FVDWNLPKTIRCCADIIQENETTR

SEQ ID NO: 2482711 - protein, 23 aa, Entamoeba dispar
FVDYDWDSLISISFNRINFSGVF

SEQ ID NO: 2482712 - protein, 19 aa, Entamoeba dispar
FVEELWGLCQMGEKSKDGI

SEQ ID NO: 2482713 - protein, 23 aa, Entamoeba dispar
FVEMCVPISVLKGFVVTNKKDED

SEQ ID NO: 2482714 - protein, 19 aa, Entamoeba dispar
FVFCSCSLDNLDYDVYIPE

SEQ ID NO: 2482715 - protein, 24 aa, Entamoeba dispar
FVFESKCWKEVIKKCVILHTQHRQ

SEQ ID NO: 2482716 - protein, 25 aa, Entamoeba dispar
FVFYDLKPLDRWTAIVPSQCMSEFN

SEQ ID NO: 2482717 - protein, 18 aa, Entamoeba dispar
FVGCCKAFKRKHDLKKHI

SEQ ID NO: 2482718 - protein, 25 aa, Entamoeba dispar
FVGKTSDVSYLWSLGIILLRFWLGY

SEQ ID NO: 2482719 - protein, 17 aa, Entamoeba dispar
FVGSEWPTTFSLSRLLC

SEQ ID NO: 2482720 - protein, 17 aa, Entamoeba dispar
FVHQLKIVVELWKKQEI

SEQ ID NO: 2482721 - protein, 17 aa, Entamoeba dispar
FVHSISLTSINIPSTIT

SEQ ID NO: 2482722 - protein, 33 aa, Entamoeba dispar
FVHVLHAWFHIKILRLFTDSVLHYGLPTKYDLI

SEQ ID NO: 2482723 - protein, 24 aa, Entamoeba dispar
FVIFPEHIVKIIAMQYILLIEALT

SEQ ID NO: 2482724 - protein, 20 aa, Entamoeba dispar
FVILMKGIVNFFREKLREAP

SEQ ID NO: 2482725 - protein, 18 aa, Entamoeba dispar
FVINFLFVKGCNDYFDSP

SEQ ID NO: 2482726 - protein, 21 aa, Entamoeba dispar
FVINLRPKFDANRFAIPTIIR

SEQ ID NO: 2482727 - protein, 20 aa, Entamoeba dispar
FVKACSQLIEGCEKESAVAL

SEQ ID NO: 2482728 - protein, 23 aa, Entamoeba dispar
FVKEVKKQPTLVLFPVSTIAQMR

SEQ ID NO: 2482729 - protein, 25 aa, Entamoeba dispar
FVKFECYQTFSARYRLSHFKCIRKA

SEQ ID NO: 2482730 - protein, 17 aa, Entamoeba dispar
FVKHVPKEFVFEDQEGF

SEQ ID NO: 2482731 - protein, 22 aa, Entamoeba dispar
FVKKLFHTMKEPSFLDWKLNVS

SEQ ID NO: 2482732 - protein, 23 aa, Entamoeba dispar
FVKMFKGSDLIIKGCEETLISLI

SEQ ID NO: 2482733 - protein, 19 aa, Entamoeba dispar
FVKRMGYILSNTVGVDLFH

SEQ ID NO: 2482734 - protein, 21 aa, Entamoeba dispar
FVKYQCVYHILDLLKSSNKSP

SEQ ID NO: 2482735 - protein, 27 aa, Entamoeba dispar
FVLCAFDGFFSFMCAAKNYAKTNSMKI

SEQ ID NO: 2482736 - protein, 28 aa, Entamoeba dispar
FVLDALSAYCRYLPPAGTLFQPLVASLL

SEQ ID NO: 2482737 - protein, 17 aa, Entamoeba dispar
FVLHYLHSILLSVTGCY

SEQ ID NO: 2482738 - protein, 25 aa, Entamoeba dispar
FVLLSENKRQCEFYIYGTKPNSIEK

SEQ ID NO: 2482739 - protein, 27 aa, Entamoeba dispar
FVLSECFSCCYIAGEIKCSSKIMKKLM

SEQ ID NO: 2482740 - protein, 18 aa, Entamoeba dispar
FVLTESMIYVFAGERGTP

SEQ ID NO: 2482741 - protein, 26 aa, Entamoeba dispar
FVLYSVDLKLVIALTIYLCKNNQTNT

SEQ ID NO: 2482742 - protein, 25 aa, Entamoeba dispar
FVMELCLGGSLAEHVAISPFSIPVA

SEQ ID NO: 2482743 - protein, 22 aa, Entamoeba dispar
FVMGESWVGVYVVNREKNEHYH

SEQ ID NO: 2482744 - protein, 25 aa, Entamoeba dispar
FVMNCKSQVIGLILFTDTRKNTTTI

SEQ ID NO: 2482745 - protein, 26 aa, Entamoeba dispar
FVNKRIIRKAIEFLINKGLLERVEKN

SEQ ID NO: 2482746 - protein, 23 aa, Entamoeba dispar
FVNSFQMNCCTFSSNTGIFQTLF

SEQ ID NO: 2482747 - protein, 18 aa, Entamoeba dispar
FVPAFGGRIKKGLYGFSI

SEQ ID NO: 2482748 - protein, 19 aa, Entamoeba dispar
FVPEMRRLISSSLDEKNKD

SEQ ID NO: 2482749 - protein, 17 aa, Entamoeba dispar
FVPGNMVSCLDFVESVF

SEQ ID NO: 2482750 - protein, 18 aa, Entamoeba dispar
FVPGVCIECGEAGVKGLI

SEQ ID NO: 2482751 - protein, 22 aa, Entamoeba dispar
FVPSRLIESFVIFHKSNYVFCV

SEQ ID NO: 2482752 - protein, 17 aa, Entamoeba dispar
FVQASVCMRDIKQELMD

SEQ ID NO: 2482753 - protein, 25 aa, Entamoeba dispar
FVQELLEKFLFVAIEDFSGTKGMLS

SEQ ID NO: 2482754 - protein, 24 aa, Entamoeba dispar
FVQFFPQYIAYTFFQIPEFRLELL

SEQ ID NO: 2482755 - protein, 17 aa, Entamoeba dispar
FVQKKCRNDTFPVICCG

SEQ ID NO: 2482756 - protein, 21 aa, Entamoeba dispar
FVQKQFICYEPDPKKLKDVIP

SEQ ID NO: 2482757 - protein, 18 aa, Entamoeba dispar
FVQSLVLHNCPIKRIDSF

SEQ ID NO: 2482758 - protein, 24 aa, Entamoeba dispar
FVQSPRYSPLGLHVQGSPTTSIYS

SEQ ID NO: 2482759 - protein, 30 aa, Entamoeba dispar
FVQVNKKCKRAICSLRYSQWYNEGSNKIFH

SEQ ID NO: 2482760 - protein, 23 aa, Entamoeba dispar
FVRAWSYKSGYYMKTTEKGTMFY

SEQ ID NO: 2482761 - protein, 24 aa, Entamoeba dispar
FVRAWSYKSGYYMKTTEKGTMFYY

SEQ ID NO: 2482762 - protein, 20 aa, Entamoeba dispar
FVRFNIATAVSKEQALPIMP

SEQ ID NO: 2482763 - protein, 18 aa, Entamoeba dispar
FVRINVGNFNKCITKLES

SEQ ID NO: 2482764 - protein, 21 aa, Entamoeba dispar
FVSACSITRLNIQDLKVFVNM

SEQ ID NO: 2482765 - protein, 22 aa, Entamoeba dispar
FVSEKCIRLWDAIIAYPKNKFH

SEQ ID NO: 2482766 - protein, 24 aa, Entamoeba dispar
FVSFKELHQLLSPQFSMVHTIGSA

SEQ ID NO: 2482767 - protein, 25 aa, Entamoeba dispar
FVSKEVVNMVCEIPRGTNAKMEIST

SEQ ID NO: 2482768 - protein, 19 aa, Entamoeba dispar
FVSKSMRIVDDMIVDMDVK

SEQ ID NO: 2482769 - protein, 23 aa, Entamoeba dispar
FVSMLRKKAFIYLYTEEGMEESE

SEQ ID NO: 2482770 - protein, 25 aa, Entamoeba dispar
FVSSEYTYVIGLKICSKFFEEPLSK

SEQ ID NO: 2482771 - protein, 20 aa, Entamoeba dispar
FVSVRPGARELLKNLVGKYE

SEQ ID NO: 2482772 - protein, 22 aa, Entamoeba dispar
FVTHCARYKAGIYGDVLNDPDV

SEQ ID NO: 2482773 - protein, 25 aa, Entamoeba dispar
FVTHKLKISVLMYMKLLMDNGIKGP

SEQ ID NO: 2482774 - protein, 24 aa, Entamoeba dispar
FVVEMGMKFSQRYTDSSLAGDTLF

SEQ ID NO: 2482775 - protein, 17 aa, Entamoeba dispar
FVVETYLALTFKSKNVK

SEQ ID NO: 2482776 - protein, 26 aa, Entamoeba dispar
FVVNEICMLCLPLIESVQGKLQLIDQ

SEQ ID NO: 2482777 - protein, 21 aa, Entamoeba dispar
FVYEPPPGYSVFIEQTTEQKE

SEQ ID NO: 2482778 - protein, 19 aa, Entamoeba dispar
FVYFDFIPIKMEPIFDLLS

SEQ ID NO: 2482779 - protein, 27 aa, Entamoeba dispar
FVYLISFLKKMICLGENEVLLITRFTP

SEQ ID NO: 2482780 - protein, 18 aa, Entamoeba dispar
FVYTLAGKPVFSRYGNDI

SEQ ID NO: 2482781 - protein, 26 aa, Entamoeba dispar
FVYVISIAPGELWKTLYSNLILFLNH

SEQ ID NO: 2482782 - protein, 18 aa, Entamoeba dispar
FWELKNRLPRSLTTLNWE

SEQ ID NO: 2482783 - protein, 25 aa, Entamoeba dispar
FWGDEWKNHIEILQQFWDKNVNEKD

SEQ ID NO: 2482784 - protein, 25 aa, Entamoeba dispar
FWLSQCPNGFCPNSIEGWKQDLCKC

SEQ ID NO: 2482785 - protein, 19 aa, Entamoeba dispar
FWPTEGFEYDDLTKGLSHL

SEQ ID NO: 2482786 - protein, 18 aa, Entamoeba dispar
FWQHLCIIWTNCYYHIPK

SEQ ID NO: 2482787 - protein, 23 aa, Entamoeba dispar
FWRVRLQIASSFSRVVQSVGESV

SEQ ID NO: 2482788 - protein, 19 aa, Entamoeba dispar
FWSRDRCGDSLEIKKYQGT

SEQ ID NO: 2482789 - protein, 18 aa, Entamoeba dispar
FYALEIIPSSSFGPCNVV

SEQ ID NO: 2482790 - protein, 26 aa, Entamoeba dispar
FYASWCGPCKMISPVFIELAQDYPLI

SEQ ID NO: 2482791 - protein, 18 aa, Entamoeba dispar
FYCLEDFTVYCSKQPIGQ

SEQ ID NO: 2482792 - protein, 19 aa, Entamoeba dispar
FYCTECGKKKRNASLIETS

SEQ ID NO: 2482793 - protein, 17 aa, Entamoeba dispar
FYDKYFKGELDDEMEEE

SEQ ID NO: 2482794 - protein, 17 aa, Entamoeba dispar
FYEAFGKNLKLGIHEDS

SEQ ID NO: 2482795 - protein, 27 aa, Entamoeba dispar
FYEIHLYNRFQIISSLPYKTNYHLKSN

SEQ ID NO: 2482796 - protein, 17 aa, Entamoeba dispar
FYEIKRPQDYYMSQVNV

SEQ ID NO: 2482797 - protein, 19 aa, Entamoeba dispar
FYEITDAFLTLLDNNHLTV

SEQ ID NO: 2482798 - protein, 28 aa, Entamoeba dispar
FYEKYLCVWDYAAASLIVKEAGGIIRTI

SEQ ID NO: 2482799 - protein, 20 aa, Entamoeba dispar
FYEMLSRDSGTLSIIDALYQ

SEQ ID NO: 2482800 - protein, 28 aa, Entamoeba dispar
FYERRLHRMEARMLKAFSEVEKKPRKPK

SEQ ID NO: 2482801 - protein, 17 aa, Entamoeba dispar
FYERRLHRMEARMMKAF

SEQ ID NO: 2482802 - protein, 25 aa, Entamoeba dispar
FYEYYPGKHLFPFCIPLKNFPHSIN

SEQ ID NO: 2482803 - protein, 19 aa, Entamoeba dispar
FYFQFNFIDTLNLFKNGSF

SEQ ID NO: 2482804 - protein, 25 aa, Entamoeba dispar
FYFQKCHGCALVFDRTSQESFDALQ

SEQ ID NO: 2482805 - protein, 24 aa, Entamoeba dispar
FYHPKIMNLIICCYSIIKKNEYEN

SEQ ID NO: 2482806 - protein, 20 aa, Entamoeba dispar
FYHQFILSRSPENVWFIVSE

SEQ ID NO: 2482807 - protein, 27 aa, Entamoeba dispar
FYHRLEWLCGFSGFTGEIVITQKRACL

SEQ ID NO: 2482808 - protein, 19 aa, Entamoeba dispar
FYINQGVKCSKGMEAKDQK

SEQ ID NO: 2482809 - protein, 17 aa, Entamoeba dispar
FYIPYGILDNSDPINSL

SEQ ID NO: 2482810 - protein, 18 aa, Entamoeba dispar
FYKACIDVPFMSILTEYI

SEQ ID NO: 2482811 - protein, 21 aa, Entamoeba dispar
FYKCNCFRDGDSMSNHLTDFL

SEQ ID NO: 2482812 - protein, 19 aa, Entamoeba dispar
FYKEVNFDKSYFVQIEYFC

SEQ ID NO: 2482813 - protein, 21 aa, Entamoeba dispar
FYKFFGERNLTGFGDTLQELM

SEQ ID NO: 2482814 - protein, 21 aa, Entamoeba dispar
FYKKDWDCFNSVDVEMTDKQM

SEQ ID NO: 2482815 - protein, 29 aa, Entamoeba dispar
FYKKHLDKLFEIINKYLLHQHPRVRNMAL

SEQ ID NO: 2482816 - protein, 20 aa, Entamoeba dispar
FYKLFKIIREYIIQQLNDLL

SEQ ID NO: 2482817 - protein, 17 aa, Entamoeba dispar
FYKLRGIGNLIKEIQMK

SEQ ID NO: 2482818 - protein, 26 aa, Entamoeba dispar
FYKWTKLNQCRLVFDSTIEYDPDEHE

SEQ ID NO: 2482819 - protein, 18 aa, Entamoeba dispar
FYLAEVLLALEYLHLNGI

SEQ ID NO: 2482820 - protein, 24 aa, Entamoeba dispar
FYMDAISLITSWQHKPWICCFCKQ

SEQ ID NO: 2482821 - protein, 20 aa, Entamoeba dispar
FYNDEFILALNRNDLNMAYH

SEQ ID NO: 2482822 - protein, 19 aa, Entamoeba dispar
FYNELTKLFIVLASQQNSK

SEQ ID NO: 2482823 - protein, 19 aa, Entamoeba dispar
FYNKIFTCFFKEQCNAKQI

SEQ ID NO: 2482824 - protein, 28 aa, Entamoeba dispar
FYNQFAITIRYAWISSQFVPSKKDKEDY

SEQ ID NO: 2482825 - protein, 18 aa, Entamoeba dispar
FYNQFVRYYFKNYLLDTF

SEQ ID NO: 2482826 - protein, 35 aa, Entamoeba dispar
FYNQRLFFFDVCQSFPRSSICFLNNKYLFQFSRLT

SEQ ID NO: 2482827 - protein, 24 aa, Entamoeba dispar
FYPKGGINPFCYINFNNPTTEQII

SEQ ID NO: 2482828 - protein, 17 aa, Entamoeba dispar
FYPLKFSLELRSVKNLK

SEQ ID NO: 2482829 - protein, 18 aa, Entamoeba dispar
FYPPFSMQGFAQLSQGQF

SEQ ID NO: 2482830 - protein, 24 aa, Entamoeba dispar
FYQELKHGKKLLVQKRTKGQSQNS

SEQ ID NO: 2482831 - protein, 17 aa, Entamoeba dispar
FYQKIRLVNYIIDDDGS

SEQ ID NO: 2482832 - protein, 21 aa, Entamoeba dispar
FYQKRINILTEEIFKLNQIIE

SEQ ID NO: 2482833 - protein, 18 aa, Entamoeba dispar
FYQLVAHRVMRILKKYFI

SEQ ID NO: 2482834 - protein, 23 aa, Entamoeba dispar
FYQSLKSLLMFSRLYPKNLKQYF

SEQ ID NO: 2482835 - protein, 18 aa, Entamoeba dispar
FYSCRSLKSIKIPKYVQF

SEQ ID NO: 2482836 - protein, 25 aa, Entamoeba dispar
FYSDSRPSLMLLNKMIQKWGITDSC

SEQ ID NO: 2482837 - protein, 22 aa, Entamoeba dispar
FYSGDGTLFFQGRVIDDIIFLT

SEQ ID NO: 2482838 - protein, 19 aa, Entamoeba dispar
FYSNINFLNNKEHVYFGFR

SEQ ID NO: 2482839 - protein, 17 aa, Entamoeba dispar
FYSPLLLENIDNVIIGS

SEQ ID NO: 2482840 - protein, 17 aa, Entamoeba dispar
FYSQFQYLFISQKDPLL

SEQ ID NO: 2482841 - protein, 18 aa, Entamoeba dispar
FYSQFQYLFISQKYPLLS

SEQ ID NO: 2482842 - protein, 18 aa, Entamoeba dispar
FYTLRLKIINGYPSSMNS

SEQ ID NO: 2482843 - protein, 21 aa, Entamoeba dispar
FYTSITRARFEEINIDLFKST

SEQ ID NO: 2482844 - protein, 24 aa, Entamoeba dispar
FYTSITRARFEEINIDLFKSTIGP

SEQ ID NO: 2482845 - protein, 24 aa, Entamoeba dispar
FYVNEGFPIIFVFIRNEEVVSMEI

SEQ ID NO: 2482846 - protein, 17 aa, Entamoeba dispar
FYYNSFNIIIGKQGAGK

SEQ ID NO: 2482847 - protein, 18 aa, Entamoeba dispar
GAAFKPLFNQAIQMHLKR

SEQ ID NO: 2482848 - protein, 25 aa, Entamoeba dispar
GAATQLSCVMIAFGTAMTMGNGVTG

SEQ ID NO: 2482849 - protein, 18 aa, Entamoeba dispar
GACIPYVNTYLRKIVEIN

SEQ ID NO: 2482850 - protein, 24 aa, Entamoeba dispar
GADENWPITGMKPFFEGLISAMQG

SEQ ID NO: 2482851 - protein, 28 aa, Entamoeba dispar
GADFHTWKKRWFVMKDQYIWYFPKNTGS

SEQ ID NO: 2482852 - protein, 23 aa, Entamoeba dispar
GADKCIRGGIALYHNYPCVVIAT

SEQ ID NO: 2482853 - protein, 20 aa, Entamoeba dispar
GADRKFLEKCCSVHSTNQHF

SEQ ID NO: 2482854 - protein, 21 aa, Entamoeba dispar
GADSFAPTWTKSGLRELRFLK

SEQ ID NO: 2482855 - protein, 20 aa, Entamoeba dispar
GAEGISIYKTKQAVIIGYFS

SEQ ID NO: 2482856 - protein, 18 aa, Entamoeba dispar
GAERACSRDGSIIDKQYI

SEQ ID NO: 2482857 - protein, 20 aa, Entamoeba dispar
GAFKNCAKVSHLILSTNITS

SEQ ID NO: 2482858 - protein, 18 aa, Entamoeba dispar
GAGNFGMVKVLLEFGKMN

SEQ ID NO: 2482859 - protein, 18 aa, Entamoeba dispar
GAIAEVITLLYRSRNKMV

SEQ ID NO: 2482860 - protein, 19 aa, Entamoeba dispar
GAIARPSYDLGESCDASKY

SEQ ID NO: 2482861 - protein, 22 aa, Entamoeba dispar
GAKRLANIYQWVVKREEFNWSE

SEQ ID NO: 2482862 - protein, 20 aa, Entamoeba dispar
GAKVRSGKVWSQYIDNTIVK

SEQ ID NO: 2482863 - protein, 23 aa, Entamoeba dispar
GALHGVCGNGWIKETQQQRNKYQ

SEQ ID NO: 2482864 - protein, 21 aa, Entamoeba dispar
GALKRGTEIVVCTPGRMIDIL

SEQ ID NO: 2482865 - protein, 17 aa, Entamoeba dispar
GALLEKAYDYFHKLPEP

SEQ ID NO: 2482866 - protein, 19 aa, Entamoeba dispar
GALNYYADIIFKQPAKKSI

SEQ ID NO: 2482867 - protein, 19 aa, Entamoeba dispar
GALQSIFAKYAIKIGEQYY

SEQ ID NO: 2482868 - protein, 22 aa, Entamoeba dispar
GALRTTAPYTLYFAAGTNAASG

SEQ ID NO: 2482869 - protein, 18 aa, Entamoeba dispar
GALSRKSNFYDLGGDSFV

SEQ ID NO: 2482870 - protein, 19 aa, Entamoeba dispar
GAMEIFIEWMYLQRSPLLE

SEQ ID NO: 2482871 - protein, 18 aa, Entamoeba dispar
GAMFNYYLDEHWKPLKHI

SEQ ID NO: 2482872 - protein, 23 aa, Entamoeba dispar
GAMFNYYLDEHWKPLKHILKKYQ

SEQ ID NO: 2482873 - protein, 34 aa, Entamoeba dispar
GAMLVDGICSIYCSKGIYHICGYYDSLHNIVCKE

SEQ ID NO: 2482874 - protein, 22 aa, Entamoeba dispar
GAPEMSLGFCIGKEGNVNLDQV

SEQ ID NO: 2482875 - protein, 19 aa, Entamoeba dispar
GAPYPKDIFPFPWNIAEFI

SEQ ID NO: 2482876 - protein, 25 aa, Entamoeba dispar
GAQLKAVCVEAGMIALRREALEIKH

SEQ ID NO: 2482877 - protein, 25 aa, Entamoeba dispar
GAQSPEVMAQFLIDNNFNILFTLGG

SEQ ID NO: 2482878 - protein, 20 aa, Entamoeba dispar
GAQSYPACNTQQPIPQFPNN

SEQ ID NO: 2482879 - protein, 18 aa, Entamoeba dispar
GASAKLVPFDGHSIFNGI

SEQ ID NO: 2482880 - protein, 18 aa, Entamoeba dispar
GASALAHLIKAKVIPDCV

SEQ ID NO: 2482881 - protein, 24 aa, Entamoeba dispar
GASNLSICFAPSVITSPDINPTLE

SEQ ID NO: 2482882 - protein, 19 aa, Entamoeba dispar
GASTLPILMTLVGYDIDTV

SEQ ID NO: 2482883 - protein, 23 aa, Entamoeba dispar
GATFKVRLTPLVNIMVHVKGSIP

SEQ ID NO: 2482884 - protein, 23 aa, Entamoeba dispar
GAVESFSFLLTHFDEMFCEIEKR

SEQ ID NO: 2482885 - protein, 20 aa, Entamoeba dispar
GAVGKTCLLVSYTTNAFPTE

SEQ ID NO: 2482886 - protein, 18 aa, Entamoeba dispar
GAVGRLCANYGINKLYIV

SEQ ID NO: 2482887 - protein, 28 aa, Entamoeba dispar
GAVICLNCGDTICEKCLEKGVCPSCNEE

SEQ ID NO: 2482888 - protein, 18 aa, Entamoeba dispar
GAYEQLQMNAKRAGVPFF

SEQ ID NO: 2482889 - protein, 17 aa, Entamoeba dispar
GAYFASSFIEFNKDIPN

SEQ ID NO: 2482890 - protein, 20 aa, Entamoeba dispar
GAYGCWLSYSYNGNAIFASY

SEQ ID NO: 2482891 - protein, 18 aa, Entamoeba dispar
GAYQMCIGRLVDIILSKM

SEQ ID NO: 2482892 - protein, 21 aa, Entamoeba dispar
GCAILSLREAFKMKEKGIDKT

SEQ ID NO: 2482893 - protein, 20 aa, Entamoeba dispar
GCDCSFHLQCACPPIASDKI

SEQ ID NO: 2482894 - protein, 21 aa, Entamoeba dispar
GCDFDMIWLSYNFGLYVVNCI

SEQ ID NO: 2482895 - protein, 21 aa, Entamoeba dispar
GCDVGVCYGDASVGRVFLGYL

SEQ ID NO: 2482896 - protein, 22 aa, Entamoeba dispar
GCFGESRISKSFIFPSSIKEIG

SEQ ID NO: 2482897 - protein, 23 aa, Entamoeba dispar
GCFNGCNQLSCIILPKTIASIQE

SEQ ID NO: 2482898 - protein, 24 aa, Entamoeba dispar
GCFRCSVCGCRLDGYLIKNHDLCC

SEQ ID NO: 2482899 - protein, 17 aa, Entamoeba dispar
GCFYGCGCVEELKKNET

SEQ ID NO: 2482900 - protein, 17 aa, Entamoeba dispar
GCFYGCSSLTSITVPSP

SEQ ID NO: 2482901 - protein, 20 aa, Entamoeba dispar
GCGEKARKQGIRYTIGEKMK

SEQ ID NO: 2482902 - protein, 17 aa, Entamoeba dispar
GCGICKNGYYRNGKGCS

SEQ ID NO: 2482903 - protein, 19 aa, Entamoeba dispar
GCGKTMIARAIANETGAFF

SEQ ID NO: 2482904 - protein, 17 aa, Entamoeba dispar
GCGLKTVKYYKIYYSLR

SEQ ID NO: 2482905 - protein, 20 aa, Entamoeba dispar
GCGNEGYNSQILIQKALDDW

SEQ ID NO: 2482906 - protein, 21 aa, Entamoeba dispar
GCGSLKVKTREGAETIIKKVD

SEQ ID NO: 2482907 - protein, 21 aa, Entamoeba dispar
GCHEGCWCWKHANQLENEGYK

SEQ ID NO: 2482908 - protein, 17 aa, Entamoeba dispar
GCIEIITFILIDYPHIY

SEQ ID NO: 2482909 - protein, 19 aa, Entamoeba dispar
GCIFAEMARGEILFAGNDS

SEQ ID NO: 2482910 - protein, 18 aa, Entamoeba dispar
GCIKNAWCKDMKIPKEDI

SEQ ID NO: 2482911 - protein, 18 aa, Entamoeba dispar
GCLECTRRECTKCNKGYE

SEQ ID NO: 2482912 - protein, 19 aa, Entamoeba dispar
GCNFTCQFCQNWDISQCTL

SEQ ID NO: 2482913 - protein, 17 aa, Entamoeba dispar
GCNKLSVIEFPSSLHHI

SEQ ID NO: 2482914 - protein, 17 aa, Entamoeba dispar
GCNPDIIGILSKDNKTI

SEQ ID NO: 2482915 - protein, 24 aa, Entamoeba dispar
GCNVSRVLMGWGVQNITFVDNGII

SEQ ID NO: 2482916 - protein, 19 aa, Entamoeba dispar
GCQKFMILYQLNSGELFGT

SEQ ID NO: 2482917 - protein, 20 aa, Entamoeba dispar
GCQLLKNFIESSVTFSDITE

SEQ ID NO: 2482918 - protein, 19 aa, Entamoeba dispar
GCQQPEYNTQQPIPQQPIQ

SEQ ID NO: 2482919 - protein, 24 aa, Entamoeba dispar
GCQYCPPQNSFMVFEINGTFWYFT

SEQ ID NO: 2482920 - protein, 23 aa, Entamoeba dispar
GCQYHGIVPYFFLVERKAVIQYA

SEQ ID NO: 2482921 - protein, 25 aa, Entamoeba dispar
GCSCISSGRCTVCGCSCSEHKRVSY

SEQ ID NO: 2482922 - protein, 20 aa, Entamoeba dispar
GCSDSSIRLYDFKKTQIVNG

SEQ ID NO: 2482923 - protein, 19 aa, Entamoeba dispar
GCTPNIFSFDEDLQFEQHQ

SEQ ID NO: 2482924 - protein, 26 aa, Entamoeba dispar
GCTSLQRIQLPLGIDIIEDESFMNCI

SEQ ID NO: 2482925 - protein, 18 aa, Entamoeba dispar
GCVCEMSSLVTLNVSGND

SEQ ID NO: 2482926 - protein, 21 aa, Entamoeba dispar
GCVGASFGGYSVYWLAGHHQK

SEQ ID NO: 2482927 - protein, 19 aa, Entamoeba dispar
GCVGIKRKPNEPVLETKRK

SEQ ID NO: 2482928 - protein, 22 aa, Entamoeba dispar
GCVIRCGISLELERKTKNDEEG

SEQ ID NO: 2482929 - protein, 19 aa, Entamoeba dispar
GCVMGKDSFSTAFLPMILN

SEQ ID NO: 2482930 - protein, 26 aa, Entamoeba dispar
GCYENVMMIGCGFSDKTIIYEYGKEI

SEQ ID NO: 2482931 - protein, 18 aa, Entamoeba dispar
GCYLSNFVQIPYYYNLNL

SEQ ID NO: 2482932 - protein, 24 aa, Entamoeba dispar
GCYSSKLRSPMSLRDNDFDVRDDN

SEQ ID NO: 2482933 - protein, 25 aa, Entamoeba dispar
GCYVNSCIQLLFSMKSFVSYLSFNS

SEQ ID NO: 2482934 - protein, 21 aa, Entamoeba dispar
GDAAISIAVVHHFSTFERRVA

SEQ ID NO: 2482935 - protein, 22 aa, Entamoeba dispar
GDALSGDFCKGLFSFLNEQENF

SEQ ID NO: 2482936 - protein, 20 aa, Entamoeba dispar
GDALVKCIELMAPLAEYTLL

SEQ ID NO: 2482937 - protein, 18 aa, Entamoeba dispar
GDCDKSWRRQIISNEENG

SEQ ID NO: 2482938 - protein, 17 aa, Entamoeba dispar
GDCGVAVGMHSFGASAP

SEQ ID NO: 2482939 - protein, 26 aa, Entamoeba dispar
GDCLKELSLLCGLSLSHMLCADAPGS

SEQ ID NO: 2482940 - protein, 19 aa, Entamoeba dispar
GDDCFDWCLSLTSMNIDNI

SEQ ID NO: 2482941 - protein, 20 aa, Entamoeba dispar
GDDKALIVLLTFINSVGLML

SEQ ID NO: 2482942 - protein, 22 aa, Entamoeba dispar
GDDVSPFGMLIIFKTSFRSSFC

SEQ ID NO: 2482943 - protein, 20 aa, Entamoeba dispar
GDECFKNCVSLTHINIPTSI

SEQ ID NO: 2482944 - protein, 17 aa, Entamoeba dispar
GDEIILCSDGIWDVTTP

SEQ ID NO: 2482945 - protein, 17 aa, Entamoeba dispar
GDEKASIAWDIRTGKML

SEQ ID NO: 2482946 - protein, 26 aa, Entamoeba dispar
GDEKCGKTSLTRRFIGEEFKEEVEPF

SEQ ID NO: 2482947 - protein, 23 aa, Entamoeba dispar
GDEKQIIALLGFLMKKEKSTIRK

SEQ ID NO: 2482948 - protein, 17 aa, Entamoeba dispar
GDELIKIPMFYVDSCPD

SEQ ID NO: 2482949 - protein, 17 aa, Entamoeba dispar
GDESINLNQRIKLIDIV

SEQ ID NO: 2482950 - protein, 20 aa, Entamoeba dispar
GDEVINVFHKYAIIKRLRRK

SEQ ID NO: 2482951 - protein, 37 aa, Entamoeba dispar
GDFAIIEFGKKMKFKWYKLKIPSFITSACVLKKMLHV

SEQ ID NO: 2482952 - protein, 17 aa, Entamoeba dispar
GDFCFDRCISLTTINIP

SEQ ID NO: 2482953 - protein, 17 aa, Entamoeba dispar
GDFKKPPTFEVLNENNI

SEQ ID NO: 2482954 - protein, 22 aa, Entamoeba dispar
GDFNSSCLIYSILSIFCSDVRN

SEQ ID NO: 2482955 - protein, 17 aa, Entamoeba dispar
GDFRKVFEVGPVFRAEN

SEQ ID NO: 2482956 - protein, 24 aa, Entamoeba dispar
GDFSRLIKDISLINEKCKILTGGC

SEQ ID NO: 2482957 - protein, 21 aa, Entamoeba dispar
GDGCFYKCSSLEYINIPTTIT

SEQ ID NO: 2482958 - protein, 20 aa, Entamoeba dispar
GDGILHSVNYFDILRSVQPP

SEQ ID NO: 2482959 - protein, 21 aa, Entamoeba dispar
GDGKFCLGGIVEPLKATEKEV

SEQ ID NO: 2482960 - protein, 22 aa, Entamoeba dispar
GDGKGARPLCCVKEIVKKQMTL

SEQ ID NO: 2482961 - protein, 20 aa, Entamoeba dispar
GDGKSSLGNFILKKDVFSVS

SEQ ID NO: 2482962 - protein, 19 aa, Entamoeba dispar
GDGKSSLGNFILKKKSNGF

SEQ ID NO: 2482963 - protein, 20 aa, Entamoeba dispar
GDGKSSLGNFILKKNAFAVG

SEQ ID NO: 2482964 - protein, 20 aa, Entamoeba dispar
GDGKSSLGNFILKKNAFKVS

SEQ ID NO: 2482965 - protein, 20 aa, Entamoeba dispar
GDGKSSLGNFILKKNVFKVS

SEQ ID NO: 2482966 - protein, 21 aa, Entamoeba dispar
GDGKSSLGNFILKNDVFKVSD

SEQ ID NO: 2482967 - protein, 21 aa, Entamoeba dispar
GDGKSSLGNFVLKNDVFKVSD

SEQ ID NO: 2482968 - protein, 20 aa, Entamoeba dispar
GDGKSSLGNYILKKRVFGER

SEQ ID NO: 2482969 - protein, 24 aa, Entamoeba dispar
GDGLVCGRYLSLFGYEVTIYYPKQ

SEQ ID NO: 2482970 - protein, 17 aa, Entamoeba dispar
GDGSLRMFDLRSLEHST

SEQ ID NO: 2482971 - protein, 18 aa, Entamoeba dispar
GDGTVGWVMNELRKAELK

SEQ ID NO: 2482972 - protein, 18 aa, Entamoeba dispar
GDGYELSDSILLDGPMII

SEQ ID NO: 2482973 - protein, 25 aa, Entamoeba dispar
GDHCIAFALNCWDVLVHKLEMKKEP

SEQ ID NO: 2482974 - protein, 23 aa, Entamoeba dispar
GDHFKIAEIIKMRIYHSQTKEDK

SEQ ID NO: 2482975 - protein, 20 aa, Entamoeba dispar
GDIHIFDIINSYPLNITPYE

SEQ ID NO: 2482976 - protein, 25 aa, Entamoeba dispar
GDIHLKFIYQPFLHWPDTMITLIEE

SEQ ID NO: 2482977 - protein, 17 aa, Entamoeba dispar
GDIKIMIDETGIGKREI

SEQ ID NO: 2482978 - protein, 30 aa, Entamoeba dispar
GDIKKGCACIGAKECCEVCGCHYTEHANST

SEQ ID NO: 2482979 - protein, 25 aa, Entamoeba dispar
GDIKWKEGCLNKIRKAIKIITDQTK

SEQ ID NO: 2482980 - protein, 17 aa, Entamoeba dispar
GDILSMLPLIKTPSALP

SEQ ID NO: 2482981 - protein, 23 aa, Entamoeba dispar
GDIPLEVFNCVIVKHIDIIDLIF

SEQ ID NO: 2482982 - protein, 18 aa, Entamoeba dispar
GDISAIIKYITKKGNGMS

SEQ ID NO: 2482983 - protein, 18 aa, Entamoeba dispar
GDITSTYSLFSFGVQMFD

SEQ ID NO: 2482984 - protein, 18 aa, Entamoeba dispar
GDITSTYSLFSFSIQMFD

SEQ ID NO: 2482985 - protein, 26 aa, Entamoeba dispar
GDKCVKEYLKGNAFLYDEIDIRQDEQ

SEQ ID NO: 2482986 - protein, 27 aa, Entamoeba dispar
GDKGEWSTKCVLAYCDSGYKFDYNKNK

SEQ ID NO: 2482987 - protein, 17 aa, Entamoeba dispar
GDKISEQIAFAVLEGTV

SEQ ID NO: 2482988 - protein, 20 aa, Entamoeba dispar
GDKVGKAPYEVCVGEGVDNQ

SEQ ID NO: 2482989 - protein, 24 aa, Entamoeba dispar
GDKVGKAPYEVCVGEGVDNQKSGV

SEQ ID NO: 2482990 - protein, 18 aa, Entamoeba dispar
GDLAKTAKRQRIISKEYP

SEQ ID NO: 2482991 - protein, 19 aa, Entamoeba dispar
GDLEIESYILLLVVIACLD

SEQ ID NO: 2482992 - protein, 17 aa, Entamoeba dispar
GDLHWFKVPPKVFFEPF

SEQ ID NO: 2482993 - protein, 23 aa, Entamoeba dispar
GDLKMKFETLFDFSEQIAKGLEY

SEQ ID NO: 2482994 - protein, 17 aa, Entamoeba dispar
GDLLKRFIEAKMETNPV

SEQ ID NO: 2482995 - protein, 19 aa, Entamoeba dispar
GDLNSCRKIGESLSLEDIG

SEQ ID NO: 2482996 - protein, 19 aa, Entamoeba dispar
GDLSQVCLYDIRKISENQN

SEQ ID NO: 2482997 - protein, 27 aa, Entamoeba dispar
GDLSRFIKKRMGDLISEDLVWNIFLQI

SEQ ID NO: 2482998 - protein, 17 aa, Entamoeba dispar
GDMFLTMHSNMYYNVVI

SEQ ID NO: 2482999 - protein, 17 aa, Entamoeba dispar
GDMGQLFYWLLVGENEK

SEQ ID NO: 2483000 - protein, 20 aa, Entamoeba dispar
GDMQTLRCESDLVYLKVPPK

SEQ ID NO: 2483001 - protein, 18 aa, Entamoeba dispar
GDMSQFAIDFIKEIIYKY

SEQ ID NO: 2483002 - protein, 17 aa, Entamoeba dispar
GDMYEVAERGANLSGGQ

SEQ ID NO: 2483003 - protein, 17 aa, Entamoeba dispar
GDNASCQMLVNFISNPK

SEQ ID NO: 2483004 - protein, 20 aa, Entamoeba dispar
GDNCFRGCSSLTSINIPSST

SEQ ID NO: 2483005 - protein, 25 aa, Entamoeba dispar
GDNDKTQCLSIWKGLENKNNQIVNS

SEQ ID NO: 2483006 - protein, 26 aa, Entamoeba dispar
GDNGEWSTKCVLSYCDEGYKFDYNNN

SEQ ID NO: 2483007 - protein, 27 aa, Entamoeba dispar
GDNRAHRRGVSFGKFGNSGLFGKHDSN

SEQ ID NO: 2483008 - protein, 18 aa, Entamoeba dispar
GDNVVGLLSGHRSFGEIF

SEQ ID NO: 2483009 - protein, 23 aa, Entamoeba dispar
GDPKRGLASIALKTLIQIIKNIK

SEQ ID NO: 2483010 - protein, 27 aa, Entamoeba dispar
GDPVADAYGFYRCRNFLIYSVNDGCGW

SEQ ID NO: 2483011 - protein, 25 aa, Entamoeba dispar
GDPYPLYLKHVFNIEQQRMNRLAMY

SEQ ID NO: 2483012 - protein, 29 aa, Entamoeba dispar
GDQFYLYEPMLAYHCYEFGSQSKMQNDIV

SEQ ID NO: 2483013 - protein, 17 aa, Entamoeba dispar
GDRCFKYCTLLTSITIS

SEQ ID NO: 2483014 - protein, 33 aa, Entamoeba dispar
GDRLGINTLKLFKICYNSTTFNNYRDWLLQYIK

SEQ ID NO: 2483015 - protein, 25 aa, Entamoeba dispar
GDRLIGRIKFELFREVCPKTVENFR

SEQ ID NO: 2483016 - protein, 18 aa, Entamoeba dispar
GDSCFCKCSSLQSINIPS

SEQ ID NO: 2483017 - protein, 18 aa, Entamoeba dispar
GDSCFFECVSLEYFSVPS

SEQ ID NO: 2483018 - protein, 17 aa, Entamoeba dispar
GDSCTRNHFQPEISRTI

SEQ ID NO: 2483019 - protein, 36 aa, Entamoeba dispar
GDSIISFLMKYKFAELALLFVRDVHAKFAIALQCGN

SEQ ID NO: 2483020 - protein, 17 aa, Entamoeba dispar
GDSIMTIKVFDLSKKNF

SEQ ID NO: 2483021 - protein, 20 aa, Entamoeba dispar
GDSPILICTLICDKEANVVI

SEQ ID NO: 2483022 - protein, 19 aa, Entamoeba dispar
GDSPLHYAVNIALNNIEAG

SEQ ID NO: 2483023 - protein, 17 aa, Entamoeba dispar
GDSYLAIDVIVMSLMEE

SEQ ID NO: 2483024 - protein, 19 aa, Entamoeba dispar
GDTHYLLYIIDQLRNECID

SEQ ID NO: 2483025 - protein, 17 aa, Entamoeba dispar
GDVIGCGYIHQLNCPFY

SEQ ID NO: 2483026 - protein, 24 aa, Entamoeba dispar
GDVKCKTFVSCIPEFSEVPRRVSD

SEQ ID NO: 2483027 - protein, 30 aa, Entamoeba dispar
GDVLRKMCKNELLKDCALLILGNKKDIKGA

SEQ ID NO: 2483028 - protein, 36 aa, Entamoeba dispar
GDVRRNSEYMKWLKKRVVDLMAVFPSYMRIKRFIIV

SEQ ID NO: 2483029 - protein, 27 aa, Entamoeba dispar
GDVSAIIKYITKKGVGMFKGDPSNKED

SEQ ID NO: 2483030 - protein, 19 aa, Entamoeba dispar
GDVYYEVVFNLVIFSPFQG

SEQ ID NO: 2483031 - protein, 21 aa, Entamoeba dispar
GDYCFYGCTSLESINIPSSVS

SEQ ID NO: 2483032 - protein, 19 aa, Entamoeba dispar
GDYCFYKCTSLTNITIPST

SEQ ID NO: 2483033 - protein, 28 aa, Entamoeba dispar
GDYHLKLCFCPFCQSGIKSMGLDKKDNK

SEQ ID NO: 2483034 - protein, 29 aa, Entamoeba dispar
GDYLPFRPGSFDGCISISAIQWLCQADKK

SEQ ID NO: 2483035 - protein, 24 aa, Entamoeba dispar
GDYNWAVTVLNHLVFYNPQNLRAR

SEQ ID NO: 2483036 - protein, 28 aa, Entamoeba dispar
GDYQFGKTKIFFRVGILAEIEEVREAKI

SEQ ID NO: 2483037 - protein, 17 aa, Entamoeba dispar
GDYRRSFSIVEAVHDAE

SEQ ID NO: 2483038 - protein, 34 aa, Entamoeba dispar
GDYSAEVLFYLLAHKICYPERVFMLRGNHETRLM

SEQ ID NO: 2483039 - protein, 18 aa, Entamoeba dispar
GDYYRYFAEFTVDEKRKE

SEQ ID NO: 2483040 - protein, 19 aa, Entamoeba dispar
GEACEFKLTVTPLCSSKLN

SEQ ID NO: 2483041 - protein, 17 aa, Entamoeba dispar
GEAENAFELFLSTTEIK

SEQ ID NO: 2483042 - protein, 23 aa, Entamoeba dispar
GEAHGGYSYCAVAALALLGRIDE

SEQ ID NO: 2483043 - protein, 27 aa, Entamoeba dispar
GEAIKKPKLRAVMSILKGDVKNIINYF

SEQ ID NO: 2483044 - protein, 25 aa, Entamoeba dispar
GEAKIKVPEMMTGEYWHDCLSISKR

SEQ ID NO: 2483045 - protein, 20 aa, Entamoeba dispar
GEALKSLSTPFGYIYRSQKP

SEQ ID NO: 2483046 - protein, 17 aa, Entamoeba dispar
GEALSCMTYVSKVTIIS

SEQ ID NO: 2483047 - protein, 30 aa, Entamoeba dispar
GEARITFSLFPKLIICRGFGMYTLNILTKE

SEQ ID NO: 2483048 - protein, 22 aa, Entamoeba dispar
GEAVMFPFGFHCTGMPIKACAD

SEQ ID NO: 2483049 - protein, 17 aa, Entamoeba dispar
GEAYYMLGECSLNGDGV

SEQ ID NO: 2483050 - protein, 17 aa, Entamoeba dispar
GECCIKNGTIYGYLFFN

SEQ ID NO: 2483051 - protein, 24 aa, Entamoeba dispar
GECGKRGGMFACTNIPEFARLMMY

SEQ ID NO: 2483052 - protein, 18 aa, Entamoeba dispar
GECKAYVSFINKLPDSQR

SEQ ID NO: 2483053 - protein, 24 aa, Entamoeba dispar
GECVGNSFKSCLVKNKITDEGDEK

SEQ ID NO: 2483054 - protein, 17 aa, Entamoeba dispar
GEDALILTHNFTSDTLI

SEQ ID NO: 2483055 - protein, 18 aa, Entamoeba dispar
GEDGFKWNGKTFNTTDRL

SEQ ID NO: 2483056 - protein, 29 aa, Entamoeba dispar
GEDKKVVILCFKEFVGALLELKNNESPTQ

SEQ ID NO: 2483057 - protein, 22 aa, Entamoeba dispar
GEDPLKLDYWIKGKKKNTKKEF

SEQ ID NO: 2483058 - protein, 25 aa, Entamoeba dispar
GEDVLLTCRWFFYIREKDSSISSSF

SEQ ID NO: 2483059 - protein, 22 aa, Entamoeba dispar
GEDVNPIFIRQMVNNIKKKINS

SEQ ID NO: 2483060 - protein, 18 aa, Entamoeba dispar
GEEEVWEVLNDVVQPIIA

SEQ ID NO: 2483061 - protein, 22 aa, Entamoeba dispar
GEEIISKLLSIYLIKKNNSSIY

SEQ ID NO: 2483062 - protein, 22 aa, Entamoeba dispar
GEEIPPLLLVCIDTIKEHANDM

SEQ ID NO: 2483063 - protein, 23 aa, Entamoeba dispar
GEEKDEWEIEDWMLMNEDDERNA

SEQ ID NO: 2483064 - protein, 17 aa, Entamoeba dispar
GEELMKAIVNEGIPEPK

SEQ ID NO: 2483065 - protein, 20 aa, Entamoeba dispar
GEELPCKQICEILFNKFTGR

SEQ ID NO: 2483066 - protein, 20 aa, Entamoeba dispar
GEEPFKYDVYHFKTKEEIKE

SEQ ID NO: 2483067 - protein, 17 aa, Entamoeba dispar
GEERIQYGLSIAEDKME

SEQ ID NO: 2483068 - protein, 29 aa, Entamoeba dispar
GEESVKLFCPRCGDLYIPMPPYDSHIDGA

SEQ ID NO: 2483069 - protein, 20 aa, Entamoeba dispar
GEEYLDCKNFYYKGTEIIIS

SEQ ID NO: 2483070 - protein, 25 aa, Entamoeba dispar
GEEYTLVCAVYFILKYCGKKGNVCK

SEQ ID NO: 2483071 - protein, 25 aa, Entamoeba dispar
GEFAHKPGIVYRDFEEIKKEIENET

SEQ ID NO: 2483072 - protein, 26 aa, Entamoeba dispar
GEFKWLPKHQSYFLSVVKGFSFQLVV

SEQ ID NO: 2483073 - protein, 20 aa, Entamoeba dispar
GEGAFGMVFEGSYRGQKVAV

SEQ ID NO: 2483074 - protein, 21 aa, Entamoeba dispar
GEGDAAWVVLVKCEKKDGTPD

SEQ ID NO: 2483075 - protein, 20 aa, Entamoeba dispar
GEGDCSLLLRHFKWNVNKMN

SEQ ID NO: 2483076 - protein, 23 aa, Entamoeba dispar
GEGGLPYIFSVMGIYLASQGIDS

SEQ ID NO: 2483077 - protein, 17 aa, Entamoeba dispar
GEGIKELYEHIMKMLFE

SEQ ID NO: 2483078 - protein, 21 aa, Entamoeba dispar
GEGIPDLVAVLIAMTQRLMLE

SEQ ID NO: 2483079 - protein, 20 aa, Entamoeba dispar
GEGKLKMAKDIVGQNCYCVG

SEQ ID NO: 2483080 - protein, 21 aa, Entamoeba dispar
GEGKLKMAKDIVGQNCYCVGM

SEQ ID NO: 2483081 - protein, 25 aa, Entamoeba dispar
GEGKRAGVYGAFLLACRDEDSGDFE

SEQ ID NO: 2483082 - protein, 21 aa, Entamoeba dispar
GEGLQAIVVVLNFNEDRFQKI

SEQ ID NO: 2483083 - protein, 19 aa, Entamoeba dispar
GEGMSGVVFHCYETSTNKE

SEQ ID NO: 2483084 - protein, 17 aa, Entamoeba dispar
GEGPIGIVFAPIRELAE

SEQ ID NO: 2483085 - protein, 25 aa, Entamoeba dispar
GEGSVGKSALCLQFVREVFSVEYSP

SEQ ID NO: 2483086 - protein, 23 aa, Entamoeba dispar
GEHPSRILCVFNILSQYDPKELL

SEQ ID NO: 2483087 - protein, 17 aa, Entamoeba dispar
GEIAKLTLCVSADTNKL

SEQ ID NO: 2483088 - protein, 19 aa, Entamoeba dispar
GEIDINEYLGIIVTEDNEH

SEQ ID NO: 2483089 - protein, 33 aa, Entamoeba dispar
GEIDKAVEFCIKTKRFADALIMTENNKEIHSKV

SEQ ID NO: 2483090 - protein, 17 aa, Entamoeba dispar
GEIEFENLPATWVAFFK

SEQ ID NO: 2483091 - protein, 21 aa, Entamoeba dispar
GEIEGGIPFLALSDLTGMPVK

SEQ ID NO: 2483092 - protein, 24 aa, Entamoeba dispar
GEIERARQIYLFGIDNIKEENKKI

SEQ ID NO: 2483093 - protein, 18 aa, Entamoeba dispar
GEIGCIDYVIKHSYSTDT

SEQ ID NO: 2483094 - protein, 18 aa, Entamoeba dispar
GEIIRYSQLPSFYEDGSL

SEQ ID NO: 2483095 - protein, 17 aa, Entamoeba dispar
GEIKAIIIGESSVGKTS

SEQ ID NO: 2483096 - protein, 19 aa, Entamoeba dispar
GEIKECFRNLQSRSITCLN

SEQ ID NO: 2483097 - protein, 20 aa, Entamoeba dispar
GEIKRLKTGQSFDENEEDQL

SEQ ID NO: 2483098 - protein, 21 aa, Entamoeba dispar
GEIKRTLKLRNCYGEIKKVCC

SEQ ID NO: 2483099 - protein, 24 aa, Entamoeba dispar
GEIKVLRINGKIVSIIDNKNEKQK

SEQ ID NO: 2483100 - protein, 17 aa, Entamoeba dispar
GEILCIMGESFTTNFVQ

SEQ ID NO: 2483101 - protein, 19 aa, Entamoeba dispar
GEIPWPSIIKKIYDQRTVI

SEQ ID NO: 2483102 - protein, 31 aa, Entamoeba dispar
GEISKDWKMCILCTDILIIARPFAFGKKTAK

SEQ ID NO: 2483103 - protein, 18 aa, Entamoeba dispar
GEIVVLLIHQWIENGGTG

SEQ ID NO: 2483104 - protein, 21 aa, Entamoeba dispar
GEIWLGFYSQLIISFILTIDE

SEQ ID NO: 2483105 - protein, 21 aa, Entamoeba dispar
GEKAVSFKGLMYNAVQDGLSI

SEQ ID NO: 2483106 - protein, 25 aa, Entamoeba dispar
GEKINAKLGEVWRAMSKEEKQPFFD

SEQ ID NO: 2483107 - protein, 20 aa, Entamoeba dispar
GEKLPVLIVLKDERTKTSII

SEQ ID NO: 2483108 - protein, 27 aa, Entamoeba dispar
GEKRCCKRIKLLLAQYYIDIQNNEQAK

SEQ ID NO: 2483109 - protein, 37 aa, Entamoeba dispar
GEKSLSMSCSDKILKWEVLGIQGGILANHFEMIIPSL

SEQ ID NO: 2483110 - protein, 20 aa, Entamoeba dispar
GEKSMCCIESTYLTEESHLL

SEQ ID NO: 2483111 - protein, 18 aa, Entamoeba dispar
GEKTLSSLALIFALHHYK

SEQ ID NO: 2483112 - protein, 17 aa, Entamoeba dispar
GEKVIEKAIKFGYHVNI

SEQ ID NO: 2483113 - protein, 18 aa, Entamoeba dispar
GEKVIVFDVGGMRVLSGH

SEQ ID NO: 2483114 - protein, 21 aa, Entamoeba dispar
GEKYKVECPFCDGNKENIKEM

SEQ ID NO: 2483115 - protein, 20 aa, Entamoeba dispar
GELEDIRIEWESKRIEKTYP

SEQ ID NO: 2483116 - protein, 25 aa, Entamoeba dispar
GELHKYDSALCLEEMLLQAVLFNDI

SEQ ID NO: 2483117 - protein, 17 aa, Entamoeba dispar
GELIKAKKQVLIDLKKL

SEQ ID NO: 2483118 - protein, 18 aa, Entamoeba dispar
GELILRKLNDTVLTLNKD

SEQ ID NO: 2483119 - protein, 31 aa, Entamoeba dispar
GELKIKDEVFRKFICCGPMYFIENVNTPPSK

SEQ ID NO: 2483120 - protein, 17 aa, Entamoeba dispar
GELKIVITQSEEFAIDQ

SEQ ID NO: 2483121 - protein, 22 aa, Entamoeba dispar
GELKTKACGLLKETVTQDRFSG

SEQ ID NO: 2483122 - protein, 26 aa, Entamoeba dispar
GELLETGNDIIFFWVARMVMMSLELM

SEQ ID NO: 2483123 - protein, 18 aa, Entamoeba dispar
GELLVTCDDKGYLANVFR

SEQ ID NO: 2483124 - protein, 18 aa, Entamoeba dispar
GELPEIPKIFFTATTFKE

SEQ ID NO: 2483125 - protein, 23 aa, Entamoeba dispar
GELPMLGANFVKNIQFLKMAATY

SEQ ID NO: 2483126 - protein, 18 aa, Entamoeba dispar
GELQKLYLNIQPLEENLR

SEQ ID NO: 2483127 - protein, 17 aa, Entamoeba dispar
GELQLSVEIKKKLINEI

SEQ ID NO: 2483128 - protein, 20 aa, Entamoeba dispar
GELRKDLFLFELEKIEKNEY

SEQ ID NO: 2483129 - protein, 23 aa, Entamoeba dispar
GELRQHMAALYFANPEEIKLSEK

SEQ ID NO: 2483130 - protein, 17 aa, Entamoeba dispar
GELRSEYERLEIMKNEI

SEQ ID NO: 2483131 - protein, 28 aa, Entamoeba dispar
GELSELEFAGACVCRQLINPIAEFVHIC

SEQ ID NO: 2483132 - protein, 20 aa, Entamoeba dispar
GELSGCPVVEAFNPAEKTTR

SEQ ID NO: 2483133 - protein, 22 aa, Entamoeba dispar
GELSKKCCLFLSSPQKQEFITS

SEQ ID NO: 2483134 - protein, 25 aa, Entamoeba dispar
GELSKRNKQTFSFGVLNILKYLTKQ

SEQ ID NO: 2483135 - protein, 21 aa, Entamoeba dispar
GELTFEQFQLFMIVYERSLNP

SEQ ID NO: 2483136 - protein, 20 aa, Entamoeba dispar
GELTIHRIIHQFNLTVKREE

SEQ ID NO: 2483137 - protein, 19 aa, Entamoeba dispar
GELVETYYILIIKLMTKCT

SEQ ID NO: 2483138 - protein, 19 aa, Entamoeba dispar
GEMERDCMISHGVSSLLKE

SEQ ID NO: 2483139 - protein, 30 aa, Entamoeba dispar
GENDPNRCCKACVFNNFIPGYDCKISDACL

SEQ ID NO: 2483140 - protein, 21 aa, Entamoeba dispar
GENIVSYKLLHSLLVFQSAVL

SEQ ID NO: 2483141 - protein, 19 aa, Entamoeba dispar
GENMQGLALNSMTKTAVAR

SEQ ID NO: 2483142 - protein, 21 aa, Entamoeba dispar
GENSLDLLSCEQCDFNDKIYE

SEQ ID NO: 2483143 - protein, 18 aa, Entamoeba dispar
GEPSLLIQIKGRRRLRSY

SEQ ID NO: 2483144 - protein, 19 aa, Entamoeba dispar
GEQTIDFTIKVNQNGMMEL

SEQ ID NO: 2483145 - protein, 20 aa, Entamoeba dispar
GEQTIDFTIKVNRNGMMELS

SEQ ID NO: 2483146 - protein, 18 aa, Entamoeba dispar
GERCFKRCRCEPKLIEQG

SEQ ID NO: 2483147 - protein, 24 aa, Entamoeba dispar
GERKFKIEVNEGISVAFPLDEVAE

SEQ ID NO: 2483148 - protein, 25 aa, Entamoeba dispar
GERKKRIKFVLQLRHSNKNGELIQI

SEQ ID NO: 2483149 - protein, 22 aa, Entamoeba dispar
GERLQGFLLINVKKRVIVNQLH

SEQ ID NO: 2483150 - protein, 17 aa, Entamoeba dispar
GERNSTVVFEFDTKTQF

SEQ ID NO: 2483151 - protein, 28 aa, Entamoeba dispar
GERTINLFLIRWKNNFHYVIDEKVAITA

SEQ ID NO: 2483152 - protein, 28 aa, Entamoeba dispar
GERTINLFLIRWKNNFHYVIDEKVPITS

SEQ ID NO: 2483153 - protein, 30 aa, Entamoeba dispar
GERTINLFLIRWKNNFHYVIDEKVPITSYF

SEQ ID NO: 2483154 - protein, 20 aa, Entamoeba dispar
GESCFFKCVSLKLITMSSSL

SEQ ID NO: 2483155 - protein, 19 aa, Entamoeba dispar
GESCFKECTGLTCVNIPTR

SEQ ID NO: 2483156 - protein, 19 aa, Entamoeba dispar
GESCFYGCGYVEELSQNKR

SEQ ID NO: 2483157 - protein, 24 aa, Entamoeba dispar
GESFKCRICGAKIHPSCKDNFVIP

SEQ ID NO: 2483158 - protein, 18 aa, Entamoeba dispar
GESIGDVCLRVYVHKVEI

SEQ ID NO: 2483159 - protein, 20 aa, Entamoeba dispar
GESKLSKIIFKNSYSTTTTP

SEQ ID NO: 2483160 - protein, 17 aa, Entamoeba dispar
GESLEKYGLLKETEQKI

SEQ ID NO: 2483161 - protein, 22 aa, Entamoeba dispar
GESLKGITLLPKRAVHVRDCEI

SEQ ID NO: 2483162 - protein, 23 aa, Entamoeba dispar
GESPAGALWWLARELEEAKKYKP

SEQ ID NO: 2483163 - protein, 24 aa, Entamoeba dispar
GESPLHIACLCGYKNIVESLELFG

SEQ ID NO: 2483164 - protein, 17 aa, Entamoeba dispar
GESSLIFYEEDINDKYI

SEQ ID NO: 2483165 - protein, 19 aa, Entamoeba dispar
GESTILFADFECFTNSDYH

SEQ ID NO: 2483166 - protein, 20 aa, Entamoeba dispar
GESTILFADFECFTNSDYHK

SEQ ID NO: 2483167 - protein, 21 aa, Entamoeba dispar
GESVIFNYKLVNSHSKEIELC

SEQ ID NO: 2483168 - protein, 22 aa, Entamoeba dispar
GESYLCKACSYDKRVVIAEYQL

SEQ ID NO: 2483169 - protein, 25 aa, Entamoeba dispar
GESYLKGRIEQVRYFGYELAKRNIP

SEQ ID NO: 2483170 - protein, 24 aa, Entamoeba dispar
GETCFTFDCSPDFIHFDMDFVHKA

SEQ ID NO: 2483171 - protein, 17 aa, Entamoeba dispar
GETGFSHCFCKGVSVGV

SEQ ID NO: 2483172 - protein, 23 aa, Entamoeba dispar
GETKIKLSVKFIKEEITLKELQK

SEQ ID NO: 2483173 - protein, 24 aa, Entamoeba dispar
GETKYKLVGIVIHSGGAHGGHYFS

SEQ ID NO: 2483174 - protein, 25 aa, Entamoeba dispar
GETLQFRLVINIGDAAIFRNNNEIQ

SEQ ID NO: 2483175 - protein, 21 aa, Entamoeba dispar
GETRTRYTVNFIQILDSIASG

SEQ ID NO: 2483176 - protein, 17 aa, Entamoeba dispar
GETRYKGEVDMWSVGCV

SEQ ID NO: 2483177 - protein, 20 aa, Entamoeba dispar
GETTEGIFRIPGKQEEVDGY

SEQ ID NO: 2483178 - protein, 24 aa, Entamoeba dispar
GEVEQLKLDIVFSQGEIISISNEG

SEQ ID NO: 2483179 - protein, 17 aa, Entamoeba dispar
GEVFCWDTQSKKLETVL

SEQ ID NO: 2483180 - protein, 19 aa, Entamoeba dispar
GEVFRCMWEDPKSKSKTHY

SEQ ID NO: 2483181 - protein, 21 aa, Entamoeba dispar
GEVLIIKHIVGGLLKNKVKEN

SEQ ID NO: 2483182 - protein, 21 aa, Entamoeba dispar
GEVLKLCKTEYLTYRTFLQQQ

SEQ ID NO: 2483183 - protein, 32 aa, Entamoeba dispar
GEVNRAKESFWCASGKGVNVCRVLQQQSIPHI

SEQ ID NO: 2483184 - protein, 20 aa, Entamoeba dispar
GEVRIEVILSLMIKSYLEEI

SEQ ID NO: 2483185 - protein, 20 aa, Entamoeba dispar
GEVSFKDVITFNLDEYYPMK

SEQ ID NO: 2483186 - protein, 17 aa, Entamoeba dispar
GEVSQTWNSRIIKDQAL

SEQ ID NO: 2483187 - protein, 18 aa, Entamoeba dispar
GEVSRYCGSHGILQTIIV

SEQ ID NO: 2483188 - protein, 20 aa, Entamoeba dispar
GEYEECFNLDIFIQAIEHWK

SEQ ID NO: 2483189 - protein, 24 aa, Entamoeba dispar
GEYGEGDLFLGVPLPSIRKETKVF

SEQ ID NO: 2483190 - protein, 25 aa, Entamoeba dispar
GEYICLMNPFKFFPSLTEIKSCVWA

SEQ ID NO: 2483191 - protein, 18 aa, Entamoeba dispar
GEYKPVRIINQMTTTSSK

SEQ ID NO: 2483192 - protein, 24 aa, Entamoeba dispar
GEYKVVPVAGLFYAIGHSPNSKFL

SEQ ID NO: 2483193 - protein, 20 aa, Entamoeba dispar
GEYQLYIGWYDGNPAHLDQL

SEQ ID NO: 2483194 - protein, 22 aa, Entamoeba dispar
GEYWKDSFRKLINQVRKSKGLP

SEQ ID NO: 2483195 - protein, 26 aa, Entamoeba dispar
GEYYYRCKHGPLVPCPQEVGDIFEYS

SEQ ID NO: 2483196 - protein, 24 aa, Entamoeba dispar
GFAELPLFLCVALINKYSSELQQK

SEQ ID NO: 2483197 - protein, 24 aa, Entamoeba dispar
GFAKGEVVTLTYKYPKEVNEIIDK

SEQ ID NO: 2483198 - protein, 25 aa, Entamoeba dispar
GFAKWQMPFKFLVDDGCVNPYPPLS

SEQ ID NO: 2483199 - protein, 18 aa, Entamoeba dispar
GFAQNVSDEIAIQNNMHR

SEQ ID NO: 2483200 - protein, 22 aa, Entamoeba dispar
GFCKEGEMYYRIEGKRIEIYSK

SEQ ID NO: 2483201 - protein, 17 aa, Entamoeba dispar
GFDCFRDNTSLTSINID

SEQ ID NO: 2483202 - protein, 20 aa, Entamoeba dispar
GFDGFRFDGVTSMIYTHHGV

SEQ ID NO: 2483203 - protein, 25 aa, Entamoeba dispar
GFDTRFKAKVCKFKDSSSAFVKLIE

SEQ ID NO: 2483204 - protein, 25 aa, Entamoeba dispar
GFEFYKRLYKYWNWSLESIPINGVT

SEQ ID NO: 2483205 - protein, 18 aa, Entamoeba dispar
GFEHPKGMFVLPFETPKS

SEQ ID NO: 2483206 - protein, 27 aa, Entamoeba dispar
GFEIECGECKKVFTYRAYQERDMKCRC

SEQ ID NO: 2483207 - protein, 22 aa, Entamoeba dispar
GFEVYLRLIPMNYFTMLNGISK

SEQ ID NO: 2483208 - protein, 19 aa, Entamoeba dispar
GFFCPHGVRGSLKVVVKLI

SEQ ID NO: 2483209 - protein, 17 aa, Entamoeba dispar
GFFGLSFKKKNKRKLMR

SEQ ID NO: 2483210 - protein, 24 aa, Entamoeba dispar
GFGETRKGILHDIGIITGATVISN

SEQ ID NO: 2483211 - protein, 25 aa, Entamoeba dispar
GFGKYISSIGMEFITTLRVDGIPSG

SEQ ID NO: 2483212 - protein, 23 aa, Entamoeba dispar
GFHCTGMPIKACADKLKTEIEKY

SEQ ID NO: 2483213 - protein, 24 aa, Entamoeba dispar
GFIINGVLLKPAFIGITQTELYPI

SEQ ID NO: 2483214 - protein, 17 aa, Entamoeba dispar
GFIPICVEYLQQHQKEY

SEQ ID NO: 2483215 - protein, 18 aa, Entamoeba dispar
GFIPNNMPMGGFIPDNMP

SEQ ID NO: 2483216 - protein, 23 aa, Entamoeba dispar
GFIRGYVNFSGFVFRKQGKDCLC

SEQ ID NO: 2483217 - protein, 19 aa, Entamoeba dispar
GFISVSIGFLLPEKGEINY

SEQ ID NO: 2483218 - protein, 21 aa, Entamoeba dispar
GFKEIKENLEIIIKNEIKGEG

SEQ ID NO: 2483219 - protein, 19 aa, Entamoeba dispar
GFLDEIRRQNGLKKEWEDC

SEQ ID NO: 2483220 - protein, 19 aa, Entamoeba dispar
GFLENEFIFTNAFPSVRTN

SEQ ID NO: 2483221 - protein, 29 aa, Entamoeba dispar
GFMKKEDWFSVCKNFTLADGTFWPIPITM

SEQ ID NO: 2483222 - protein, 25 aa, Entamoeba dispar
GFMKTSGCMSICLSATKDIIFTGHV

SEQ ID NO: 2483223 - protein, 18 aa, Entamoeba dispar
GFMKYCGQIQRIELPQSI

SEQ ID NO: 2483224 - protein, 24 aa, Entamoeba dispar
GFNEKVCGRKNLLIIVVSGKSIFG

SEQ ID NO: 2483225 - protein, 18 aa, Entamoeba dispar
GFNILFDVIQVFYKNIDD

SEQ ID NO: 2483226 - protein, 28 aa, Entamoeba dispar
GFNKLYHCIVALGYLHIVKFLVSTFPNE

SEQ ID NO: 2483227 - protein, 23 aa, Entamoeba dispar
GFNKNALCLKRVIKKFTDKTYIL

SEQ ID NO: 2483228 - protein, 25 aa, Entamoeba dispar
GFNLELDITYSYAIRIQPEVMSNAF

SEQ ID NO: 2483229 - protein, 18 aa, Entamoeba dispar
GFNLLTEFCKEKKKQIEI

SEQ ID NO: 2483230 - protein, 19 aa, Entamoeba dispar
GFNPLSIIKEEGFDNSDTM

SEQ ID NO: 2483231 - protein, 25 aa, Entamoeba dispar
GFNSTECYVCLLSNLKSICLAKGRC

SEQ ID NO: 2483232 - protein, 22 aa, Entamoeba dispar
GFPETIRVVTSCYVYIQCIGDQ

SEQ ID NO: 2483233 - protein, 19 aa, Entamoeba dispar
GFQFIGAIIHRGSYTCGHY

SEQ ID NO: 2483234 - protein, 20 aa, Entamoeba dispar
GFRIECGSLVNSLIEDTEKV

SEQ ID NO: 2483235 - protein, 17 aa, Entamoeba dispar
GFSLYLRNVKNTVVDVK

SEQ ID NO: 2483236 - protein, 23 aa, Entamoeba dispar
GFTQMFWQLGMKNFDDFIEKLIK

SEQ ID NO: 2483237 - protein, 19 aa, Entamoeba dispar
GFVDASLSSIEWDYLDYAF

SEQ ID NO: 2483238 - protein, 17 aa, Entamoeba dispar
GFYEEKLLQFIVESIEG

SEQ ID NO: 2483239 - protein, 33 aa, Entamoeba dispar
GFYKKEETYNCSFCPFTFCVECYKHLCLTLGTP

SEQ ID NO: 2483240 - protein, 20 aa, Entamoeba dispar
GFYYERRVVPLIKQEREYDC

SEQ ID NO: 2483241 - protein, 21 aa, Entamoeba dispar
GGAFIKFVPFLKSYTQYATNQ

SEQ ID NO: 2483242 - protein, 18 aa, Entamoeba dispar
GGAIFELLMDGFGVNKIL

SEQ ID NO: 2483243 - protein, 17 aa, Entamoeba dispar
GGAKIFDIFENVYRPII

SEQ ID NO: 2483244 - protein, 20 aa, Entamoeba dispar
GGALCHRLFYQSFKAKDTQF

SEQ ID NO: 2483245 - protein, 19 aa, Entamoeba dispar
GGALFELIMNGFGVNRILG

SEQ ID NO: 2483246 - protein, 17 aa, Entamoeba dispar
GGALVLADEGVCLIDEF

SEQ ID NO: 2483247 - protein, 19 aa, Entamoeba dispar
GGAPALPPPRRGTKNVPPP

SEQ ID NO: 2483248 - protein, 17 aa, Entamoeba dispar
GGCCYCKESGNAYIGFN

SEQ ID NO: 2483249 - protein, 19 aa, Entamoeba dispar
GGCRYCGDVNHFAKDCPNK

SEQ ID NO: 2483250 - protein, 17 aa, Entamoeba dispar
GGDKLLFFSHNSIKANF

SEQ ID NO: 2483251 - protein, 27 aa, Entamoeba dispar
GGDNVCFNCGKPGHMSRECPEPRKDNR

SEQ ID NO: 2483252 - protein, 19 aa, Entamoeba dispar
GGDVLCFNNLFGYIQQSIP

SEQ ID NO: 2483253 - protein, 24 aa, Entamoeba dispar
GGEKTIAALALLFAVQSYYPSPFF

SEQ ID NO: 2483254 - protein, 21 aa, Entamoeba dispar
GGERLAFRAINGYGERIVLKR

SEQ ID NO: 2483255 - protein, 24 aa, Entamoeba dispar
GGESALRLWYCFYSLLSDINEHPK

SEQ ID NO: 2483256 - protein, 17 aa, Entamoeba dispar
GGESVVHIWDERKVTDP

SEQ ID NO: 2483257 - protein, 19 aa, Entamoeba dispar
GGFTFIIIDYFSLGQLSDY

SEQ ID NO: 2483258 - protein, 25 aa, Entamoeba dispar
GGGLSPRCWWGFYGKLLNRQQLNKF

SEQ ID NO: 2483259 - protein, 17 aa, Entamoeba dispar
GGGRYDNLVGIFGANKI

SEQ ID NO: 2483260 - protein, 22 aa, Entamoeba dispar
GGGTFWGLCCLLTNYKSFDEML

SEQ ID NO: 2483261 - protein, 25 aa, Entamoeba dispar
GGGWKNWKHRWFVLDGTTLTYYKDQ

SEQ ID NO: 2483262 - protein, 27 aa, Entamoeba dispar
GGHCYKVGNTWRVEGVIALSRSLGDRA

SEQ ID NO: 2483263 - protein, 24 aa, Entamoeba dispar
GGHNIWPAEICDIMIAHPKIQEAA

SEQ ID NO: 2483264 - protein, 17 aa, Entamoeba dispar
GGIEALFKLLEKQKNKL

SEQ ID NO: 2483265 - protein, 20 aa, Entamoeba dispar
GGIFKKGNVDRLEWEKEEKE

SEQ ID NO: 2483266 - protein, 22 aa, Entamoeba dispar
GGIGGILRYQLSMDELDDNFNM

SEQ ID NO: 2483267 - protein, 19 aa, Entamoeba dispar
GGIINCRYCHSLGRILKVS

SEQ ID NO: 2483268 - protein, 30 aa, Entamoeba dispar
GGKCLPIGNICYLYKCCQMNPYQIKLNDDV

SEQ ID NO: 2483269 - protein, 18 aa, Entamoeba dispar
GGKFFVRYYAPWCGFCKM

SEQ ID NO: 2483270 - protein, 23 aa, Entamoeba dispar
GGKLRFGVPLAKAECIWKNLILM

SEQ ID NO: 2483271 - protein, 22 aa, Entamoeba dispar
GGKRGGRGRPAAAVRQKVESFF

SEQ ID NO: 2483272 - protein, 20 aa, Entamoeba dispar
GGKYPESKRMIFKDYVRCAM

SEQ ID NO: 2483273 - protein, 17 aa, Entamoeba dispar
GGLDIGWTAYLIGAISE

SEQ ID NO: 2483274 - protein, 18 aa, Entamoeba dispar
GGLDVKTGTTGVHSYISH

SEQ ID NO: 2483275 - protein, 18 aa, Entamoeba dispar
GGLKNELLNYLDGIDESY

SEQ ID NO: 2483276 - protein, 27 aa, Entamoeba dispar
GGLQACARAFAARKHFSVLREQQVAVI

SEQ ID NO: 2483277 - protein, 19 aa, Entamoeba dispar
GGLQFPELGLNRFDDMIND

SEQ ID NO: 2483278 - protein, 20 aa, Entamoeba dispar
GGMIGKIEIEYCCIREIIGN

SEQ ID NO: 2483279 - protein, 17 aa, Entamoeba dispar
GGMPKGFSFNVGGMPGG

SEQ ID NO: 2483280 - protein, 26 aa, Entamoeba dispar
GGNKIEVCSGVDGFKHLPKASLNELF

SEQ ID NO: 2483281 - protein, 17 aa, Entamoeba dispar
GGNLGPSIEMFVKGLEV

SEQ ID NO: 2483282 - protein, 18 aa, Entamoeba dispar
GGNTLYPGFAERLASGVQ

SEQ ID NO: 2483283 - protein, 17 aa, Entamoeba dispar
GGNVGGIHELVFKEEGQ

SEQ ID NO: 2483284 - protein, 18 aa, Entamoeba dispar
GGPLKKGQSLNFIIEKRK

SEQ ID NO: 2483285 - protein, 18 aa, Entamoeba dispar
GGPQCAVSQFWSYRWNFL

SEQ ID NO: 2483286 - protein, 19 aa, Entamoeba dispar
GGQSLDCIYPYVKSLVRSY

SEQ ID NO: 2483287 - protein, 28 aa, Entamoeba dispar
GGRVSDGFISRSLPHFALHSRTPQAKGF

SEQ ID NO: 2483288 - protein, 20 aa, Entamoeba dispar
GGSDALFFFQYTKLPMNILS

SEQ ID NO: 2483289 - protein, 18 aa, Entamoeba dispar
GGSDYYLVCRDFDGYVKV

SEQ ID NO: 2483290 - protein, 25 aa, Entamoeba dispar
GGSSDFKQALLVAKLALANRVDKIY

SEQ ID NO: 2483291 - protein, 33 aa, Entamoeba dispar
GGSVKNWKKRWFVLKPTRLWYFKAKNSTSAQGY

SEQ ID NO: 2483292 - protein, 22 aa, Entamoeba dispar
GGSVRLEPRFQFIVTSNYSLAE

SEQ ID NO: 2483293 - protein, 18 aa, Entamoeba dispar
GGTFKKFTKVQMECKNDC

SEQ ID NO: 2483294 - protein, 26 aa, Entamoeba dispar
GGTIFRCIWCSLFVHNTCQPKLLNCC

SEQ ID NO: 2483295 - protein, 17 aa, Entamoeba dispar
GGTIGKYEDCVWVNKMA

SEQ ID NO: 2483296 - protein, 19 aa, Entamoeba dispar
GGTMTKIVFWIPGDTDIDL

SEQ ID NO: 2483297 - protein, 17 aa, Entamoeba dispar
GGTSLKKSTDRVLQPPK

SEQ ID NO: 2483298 - protein, 25 aa, Entamoeba dispar
GGVEKIPFIAPKPVWAKEEKKSTKK

SEQ ID NO: 2483299 - protein, 18 aa, Entamoeba dispar
GGVGARFWPLSRESKPKQ

SEQ ID NO: 2483300 - protein, 18 aa, Entamoeba dispar
GGVKCIYQCILLKRIIKE

SEQ ID NO: 2483301 - protein, 18 aa, Entamoeba dispar
GGVSCAHYSPILNDDKSF

SEQ ID NO: 2483302 - protein, 24 aa, Entamoeba dispar
GGVSRSDCMLQFQADICNCTVVRL

SEQ ID NO: 2483303 - protein, 20 aa, Entamoeba dispar
GGVTLHSFAGIGLGDQSVDM

SEQ ID NO: 2483304 - protein, 23 aa, Entamoeba dispar
GGWRMRISLATALFLQPDLLILD

SEQ ID NO: 2483305 - protein, 18 aa, Entamoeba dispar
GGWYFSDNKDLPFDSNEW

SEQ ID NO: 2483306 - protein, 25 aa, Entamoeba dispar
GGWYVPLPLYRLIPFLEESNYYITP

SEQ ID NO: 2483307 - protein, 27 aa, Entamoeba dispar
GGYKNWKKRYFVLKDKKLWYFDSKDSV

SEQ ID NO: 2483308 - protein, 23 aa, Entamoeba dispar
GHDLDLTIIDWLRLQDYRIQPKK

SEQ ID NO: 2483309 - protein, 17 aa, Entamoeba dispar
GHDSGMIIFKLNEERIP

SEQ ID NO: 2483310 - protein, 23 aa, Entamoeba dispar
GHEAGVCCVCYLINDTRPYLLSG

SEQ ID NO: 2483311 - protein, 25 aa, Entamoeba dispar
GHENIKKGILLLLFGGVHKTTKEGI

SEQ ID NO: 2483312 - protein, 25 aa, Entamoeba dispar
GHGPGVDWWSLGILIYEMIVGIPPF

SEQ ID NO: 2483313 - protein, 21 aa, Entamoeba dispar
GHGSFGIVFEGVYNSMKCAIK

SEQ ID NO: 2483314 - protein, 18 aa, Entamoeba dispar
GHHFDLKKGIQLSQGISL

SEQ ID NO: 2483315 - protein, 21 aa, Entamoeba dispar
GHIFHPSCIKKEFINNKTPFA

SEQ ID NO: 2483316 - protein, 22 aa, Entamoeba dispar
GHIKLTDFGLCTGFHKDHEGSY

SEQ ID NO: 2483317 - protein, 18 aa, Entamoeba dispar
GHIVLTFTPLLRVYSDYC

SEQ ID NO: 2483318 - protein, 17 aa, Entamoeba dispar
GHKALIFCQTRQMLNII

SEQ ID NO: 2483319 - protein, 26 aa, Entamoeba dispar
GHLCPCAPSTFPCFPASTDPFILEEP

SEQ ID NO: 2483320 - protein, 21 aa, Entamoeba dispar
GHLIHIDFGFMFDRSPGGDMG

SEQ ID NO: 2483321 - protein, 23 aa, Entamoeba dispar
GHLQRSAIMAIQIAKKRKDKKEK

SEQ ID NO: 2483322 - protein, 18 aa, Entamoeba dispar
GHMFCWECLREWLSRQET

SEQ ID NO: 2483323 - protein, 17 aa, Entamoeba dispar
GHNYLRVTRIFNSLHAF

SEQ ID NO: 2483324 - protein, 24 aa, Entamoeba dispar
GHQRVKSAFSQRPIFFSEINEVQK

SEQ ID NO: 2483325 - protein, 21 aa, Entamoeba dispar
GHSENILFILFDNGKIRVYRT

SEQ ID NO: 2483326 - protein, 19 aa, Entamoeba dispar
GHSFCKECVIEHILTCMKE

SEQ ID NO: 2483327 - protein, 22 aa, Entamoeba dispar
GHSFEILDAVAFSKEILPKYYK

SEQ ID NO: 2483328 - protein, 23 aa, Entamoeba dispar
GHSFEILDAVAFSKEILPKYYKH

SEQ ID NO: 2483329 - protein, 19 aa, Entamoeba dispar
GHSGAFVEIDMLGGVDEEV

SEQ ID NO: 2483330 - protein, 25 aa, Entamoeba dispar
GHSGSVDWWTFGIFMYEILYGRTPF

SEQ ID NO: 2483331 - protein, 20 aa, Entamoeba dispar
GHSPLIPPHCLKVASMYIPV

SEQ ID NO: 2483332 - protein, 23 aa, Entamoeba dispar
GHTDFLMKTIDAMNEADVAVVVV

SEQ ID NO: 2483333 - protein, 21 aa, Entamoeba dispar
GHVDGGAGWRMSDQGNRIIVA

SEQ ID NO: 2483334 - protein, 19 aa, Entamoeba dispar
GHVIFDFCNTGILFKTIQQ

SEQ ID NO: 2483335 - protein, 17 aa, Entamoeba dispar
GHVTYFWNGNKSGYFDD

SEQ ID NO: 2483336 - protein, 17 aa, Entamoeba dispar
GHVYLQFQSIIQSEITG

SEQ ID NO: 2483337 - protein, 25 aa, Entamoeba dispar
GHYGLECLLLLVALKLRFPQRISLL

SEQ ID NO: 2483338 - protein, 20 aa, Entamoeba dispar
GIAAPLMVCAVVARTLSIIW

SEQ ID NO: 2483339 - protein, 19 aa, Entamoeba dispar
GIACPQFIIIQSYQEMMRF

SEQ ID NO: 2483340 - protein, 18 aa, Entamoeba dispar
GIAEEGLVYLLESLCQNT

SEQ ID NO: 2483341 - protein, 23 aa, Entamoeba dispar
GIAPRIICAAVYKYTKKKMEFLW

SEQ ID NO: 2483342 - protein, 19 aa, Entamoeba dispar
GIARPTFVQLLLKVNPAMY

SEQ ID NO: 2483343 - protein, 19 aa, Entamoeba dispar
GICAYACHAHLLKKDNVQI

SEQ ID NO: 2483344 - protein, 20 aa, Entamoeba dispar
GICCFYKCASLTSMNIDNIQ

SEQ ID NO: 2483345 - protein, 17 aa, Entamoeba dispar
GICLFEMVSRRIFNPLN

SEQ ID NO: 2483346 - protein, 25 aa, Entamoeba dispar
GIDAFFKMFNKLMMNPHFKVTEIPE

SEQ ID NO: 2483347 - protein, 23 aa, Entamoeba dispar
GIDFRASLLTNLFNICEQCGLDL

SEQ ID NO: 2483348 - protein, 20 aa, Entamoeba dispar
GIDGCSYVKKVLRIAMNGSM

SEQ ID NO: 2483349 - protein, 23 aa, Entamoeba dispar
GIDLLKFLCNSFVLLNGTFTQQF

SEQ ID NO: 2483350 - protein, 22 aa, Entamoeba dispar
GIDLLNKMLCCYPNKRIDAKEA

SEQ ID NO: 2483351 - protein, 27 aa, Entamoeba dispar
GIDNLCIVVAPTFFWKKGEIQRQNGFE

SEQ ID NO: 2483352 - protein, 17 aa, Entamoeba dispar
GIDNLSLDSLVLLHRLM

SEQ ID NO: 2483353 - protein, 28 aa, Entamoeba dispar
GIEALKELLLKIQICRATADIEYAQSFF

SEQ ID NO: 2483354 - protein, 18 aa, Entamoeba dispar
GIECIGIEGKEEYIKAMK

SEQ ID NO: 2483355 - protein, 19 aa, Entamoeba dispar
GIECIGIEGKEEYIKAMKE

SEQ ID NO: 2483356 - protein, 19 aa, Entamoeba dispar
GIEDLLRWVKNIPPMSVQN

SEQ ID NO: 2483357 - protein, 20 aa, Entamoeba dispar
GIEEGELYTLLPSGSLLKDS

SEQ ID NO: 2483358 - protein, 25 aa, Entamoeba dispar
GIEELNIWSKMEMSGVLKKTGEKSR

SEQ ID NO: 2483359 - protein, 23 aa, Entamoeba dispar
GIEEYRILVSMEHACYPRYTSPP

SEQ ID NO: 2483360 - protein, 25 aa, Entamoeba dispar
GIEFCCKITEGVLLRKVLSDLIKQS

SEQ ID NO: 2483361 - protein, 29 aa, Entamoeba dispar
GIEFCCKITEGVLLRMVLSDLIKQSQSKL

SEQ ID NO: 2483362 - protein, 25 aa, Entamoeba dispar
GIEIFLTFLCGSWKKNGISRISKQN

SEQ ID NO: 2483363 - protein, 24 aa, Entamoeba dispar
GIEPSLILSRAIKLFKAVIRNNKV

SEQ ID NO: 2483364 - protein, 18 aa, Entamoeba dispar
GIEQLCWSKDSRKIAYTC

SEQ ID NO: 2483365 - protein, 22 aa, Entamoeba dispar
GIESWLVRSMFVFKKMKTRQMV

SEQ ID NO: 2483366 - protein, 18 aa, Entamoeba dispar
GIESYYRNNMVDVAMLLN

SEQ ID NO: 2483367 - protein, 24 aa, Entamoeba dispar
GIEYSGCCGLLCIIEIKEKKRIIH

SEQ ID NO: 2483368 - protein, 20 aa, Entamoeba dispar
GIFDPSCKSTLGVNFLTKTC

SEQ ID NO: 2483369 - protein, 26 aa, Entamoeba dispar
GIFKALMPHVCDFEKVFTTRKVGSIT

SEQ ID NO: 2483370 - protein, 20 aa, Entamoeba dispar
GIFLNCKKENVFVFGSEYRP

SEQ ID NO: 2483371 - protein, 25 aa, Entamoeba dispar
GIFPLKDTIDAIGFYNLPYSVTVRK

SEQ ID NO: 2483372 - protein, 25 aa, Entamoeba dispar
GIFRIWDFRTMKTIKAFQAPNKSSI

SEQ ID NO: 2483373 - protein, 25 aa, Entamoeba dispar
GIFRNGGFNCCKKHLPLINNKEKIL

SEQ ID NO: 2483374 - protein, 17 aa, Entamoeba dispar
GIFTARALQSCKMHGMK

SEQ ID NO: 2483375 - protein, 20 aa, Entamoeba dispar
GIGCFKGCSSIMSINIPSPV

SEQ ID NO: 2483376 - protein, 26 aa, Entamoeba dispar
GIGEEMLKVLGWSEGKGAGKFEQGIE

SEQ ID NO: 2483377 - protein, 22 aa, Entamoeba dispar
GIGEGRKALEIFDKNLQKYYEI

SEQ ID NO: 2483378 - protein, 18 aa, Entamoeba dispar
GIGFHVADILLLELTIAF

SEQ ID NO: 2483379 - protein, 18 aa, Entamoeba dispar
GIGLKKALKIVGSCKTIK

SEQ ID NO: 2483380 - protein, 20 aa, Entamoeba dispar
GIGLPRKYPLICIDREEKYF

SEQ ID NO: 2483381 - protein, 26 aa, Entamoeba dispar
GIGMDRGEMYFINWNKKYTTWMDPRS

SEQ ID NO: 2483382 - protein, 20 aa, Entamoeba dispar
GIGVYELYLNDSLLDYSLTM

SEQ ID NO: 2483383 - protein, 20 aa, Entamoeba dispar
GIHPSLIITNDWFTGMVPAY

SEQ ID NO: 2483384 - protein, 24 aa, Entamoeba dispar
GIHVFPFCLQFDVMDKFIRGGRKF

SEQ ID NO: 2483385 - protein, 21 aa, Entamoeba dispar
GIICAEVNWDKKLIVTGSEDN

SEQ ID NO: 2483386 - protein, 18 aa, Entamoeba dispar
GIIEIAVVLIRFKCDYTI

SEQ ID NO: 2483387 - protein, 17 aa, Entamoeba dispar
GIIKFLNIKSEIKDIKY

SEQ ID NO: 2483388 - protein, 18 aa, Entamoeba dispar
GIIKLVVSDIIKYIEEEF

SEQ ID NO: 2483389 - protein, 19 aa, Entamoeba dispar
GIIKRNWKPLPGYIKQESS

SEQ ID NO: 2483390 - protein, 25 aa, Entamoeba dispar
GIIPKNKLDVIFLHFPDVQSMNSSF

SEQ ID NO: 2483391 - protein, 23 aa, Entamoeba dispar
GIIREVPKLINTVYHELKDVFNK

SEQ ID NO: 2483392 - protein, 24 aa, Entamoeba dispar
GIIREVPKLINTVYHELKDVFNKR

SEQ ID NO: 2483393 - protein, 21 aa, Entamoeba dispar
GIISNMLLGIVLRLIDDNDSI

SEQ ID NO: 2483394 - protein, 24 aa, Entamoeba dispar
GIISYMNFERIEGIIKILNEEEQE

SEQ ID NO: 2483395 - protein, 23 aa, Entamoeba dispar
GIKCILQAIIFSRLVEKFPTLLE

SEQ ID NO: 2483396 - protein, 23 aa, Entamoeba dispar
GIKELRAGYLSYWNLINQKKREA

SEQ ID NO: 2483397 - protein, 17 aa, Entamoeba dispar
GIKIRTYEVCAKKFDEI

SEQ ID NO: 2483398 - protein, 21 aa, Entamoeba dispar
GIKKSENVLVHFVKTNFIDIP

SEQ ID NO: 2483399 - protein, 20 aa, Entamoeba dispar
GIKLLYEIFCLFIRAETKVY

SEQ ID NO: 2483400 - protein, 22 aa, Entamoeba dispar
GIKQVCLFNQYVLYFTHSYSKT

SEQ ID NO: 2483401 - protein, 20 aa, Entamoeba dispar
GIKYEGYCSVLIGDEVPGKF

SEQ ID NO: 2483402 - protein, 22 aa, Entamoeba dispar
GIKYRGKVFSLKLSQPNKEEKG

SEQ ID NO: 2483403 - protein, 24 aa, Entamoeba dispar
GILCSCIKGIEPLPMDKDIEWLKS

SEQ ID NO: 2483404 - protein, 17 aa, Entamoeba dispar
GILEMKIGGGIIRVITC

SEQ ID NO: 2483405 - protein, 28 aa, Entamoeba dispar
GILMTRISLLLPLFLEFIKQNKLNERYH

SEQ ID NO: 2483406 - protein, 18 aa, Entamoeba dispar
GILNRFIGLSSREVKLIH

SEQ ID NO: 2483407 - protein, 19 aa, Entamoeba dispar
GILPEILENLLAARKQAKK

SEQ ID NO: 2483408 - protein, 23 aa, Entamoeba dispar
GILYQPRLTKIIPARDLVPEKIL

SEQ ID NO: 2483409 - protein, 23 aa, Entamoeba dispar
GIMENCNGLILGSVLRAVTPNVK

SEQ ID NO: 2483410 - protein, 24 aa, Entamoeba dispar
GIMKSWKRKWVRLTKTDVYVFDNP

SEQ ID NO: 2483411 - protein, 23 aa, Entamoeba dispar
GIMNRCKIRLAFISKNNIGYLEE

SEQ ID NO: 2483412 - protein, 19 aa, Entamoeba dispar
GIMPKKVIDCLAEVKKSMW

SEQ ID NO: 2483413 - protein, 26 aa, Entamoeba dispar
GIMVSMGVCSHGEYGINTGLFYSMPV

SEQ ID NO: 2483414 - protein, 26 aa, Entamoeba dispar
GINAVRWVGGVELELLAIATGARIVP

SEQ ID NO: 2483415 - protein, 19 aa, Entamoeba dispar
GINCKLTDFGKPFPKEIYK

SEQ ID NO: 2483416 - protein, 17 aa, Entamoeba dispar
GINCKLTDFGSSRHDDN

SEQ ID NO: 2483417 - protein, 19 aa, Entamoeba dispar
GINDIEILSGALLHDTVED

SEQ ID NO: 2483418 - protein, 17 aa, Entamoeba dispar
GINDLILEYAYQNKDKW

SEQ ID NO: 2483419 - protein, 19 aa, Entamoeba dispar
GINGFLKKFYYTMKEPSYI

SEQ ID NO: 2483420 - protein, 20 aa, Entamoeba dispar
GINGVEVFMLLIALKVKYPR

SEQ ID NO: 2483421 - protein, 18 aa, Entamoeba dispar
GINGYVIGMMCSKIKENQ

SEQ ID NO: 2483422 - protein, 18 aa, Entamoeba dispar
GINKLGEMMRGMMLNENI

SEQ ID NO: 2483423 - protein, 18 aa, Entamoeba dispar
GINKSICNEQFKSIMKDY

SEQ ID NO: 2483424 - protein, 18 aa, Entamoeba dispar
GINLRTLTDILIKTEIGS

SEQ ID NO: 2483425 - protein, 19 aa, Entamoeba dispar
GINPPNYPAVVPHPAAPYE

SEQ ID NO: 2483426 - protein, 18 aa, Entamoeba dispar
GINYIIRLLYDGYPNTRY

SEQ ID NO: 2483427 - protein, 22 aa, Entamoeba dispar
GIPEYTAREWLIPKIQEDNINK

SEQ ID NO: 2483428 - protein, 19 aa, Entamoeba dispar
GIPIMTIWMHDIVNINCIP

SEQ ID NO: 2483429 - protein, 24 aa, Entamoeba dispar
GIPKGGRSKRSFNMGGMPREFGGF

SEQ ID NO: 2483430 - protein, 26 aa, Entamoeba dispar
GIPKRKTGKCVIEFTTQVNENGIMEL

SEQ ID NO: 2483431 - protein, 21 aa, Entamoeba dispar
GIPLKSAIKKSQWRVPLPIFR

SEQ ID NO: 2483432 - protein, 25 aa, Entamoeba dispar
GIPWIGIGKVAVWPLEKSGKMIDPI

SEQ ID NO: 2483433 - protein, 18 aa, Entamoeba dispar
GIQPRAFYLQDNESKTLC

SEQ ID NO: 2483434 - protein, 19 aa, Entamoeba dispar
GIQVTLNFTDSVFIDQCYF

SEQ ID NO: 2483435 - protein, 18 aa, Entamoeba dispar
GIQYDYFIGRYINGNEQY

SEQ ID NO: 2483436 - protein, 18 aa, Entamoeba dispar
GIRCISKCDFYLKQTRSQ

SEQ ID NO: 2483437 - protein, 22 aa, Entamoeba dispar
GIRETDRWYYGGGLYMGKKMPE

SEQ ID NO: 2483438 - protein, 19 aa, Entamoeba dispar
GIRIFRKKEMPIVGPLLNG

SEQ ID NO: 2483439 - protein, 25 aa, Entamoeba dispar
GIRQGKTGKCYADFEDEETWKNVKA

SEQ ID NO: 2483440 - protein, 22 aa, Entamoeba dispar
GIRRILCSLMERISSYVTANPQ

SEQ ID NO: 2483441 - protein, 19 aa, Entamoeba dispar
GISANCNKITFSTTTNEPY

SEQ ID NO: 2483442 - protein, 19 aa, Entamoeba dispar
GISDLDLVGTNWKFFSLER

SEQ ID NO: 2483443 - protein, 33 aa, Entamoeba dispar
GISEKSWKLVWVVIKYTFIFVFKSRDDTTLIET

SEQ ID NO: 2483444 - protein, 41 aa, Entamoeba dispar
GISFLDVKYSLLFEYNMYLAYYCWIKSSGSNVERHKAIERL

SEQ ID NO: 2483445 - protein, 18 aa, Entamoeba dispar
GISKSNEKKIILLTQSGL

SEQ ID NO: 2483446 - protein, 23 aa, Entamoeba dispar
GISLGELNKYYCLVYSCFEDISY

SEQ ID NO: 2483447 - protein, 23 aa, Entamoeba dispar
GISNAKIFNGFRLDNCHSVPLEA

SEQ ID NO: 2483448 - protein, 18 aa, Entamoeba dispar
GISNIPIVSEQWLIDTIK

SEQ ID NO: 2483449 - protein, 17 aa, Entamoeba dispar
GITELGFHSPYITKEDI

SEQ ID NO: 2483450 - protein, 22 aa, Entamoeba dispar
GITGIGKVRFITGLGKHSSRQG

SEQ ID NO: 2483451 - protein, 23 aa, Entamoeba dispar
GITHLRLLIQVSKEVKRCVESID

SEQ ID NO: 2483452 - protein, 18 aa, Entamoeba dispar
GITKIPPKVFNQIHFPKL

SEQ ID NO: 2483453 - protein, 18 aa, Entamoeba dispar
GITLDSIGYKNCNILIYK

SEQ ID NO: 2483454 - protein, 18 aa, Entamoeba dispar
GITPLMYAIELGFDDIAL

SEQ ID NO: 2483455 - protein, 20 aa, Entamoeba dispar
GITTLEIWIPVYVINNSIIP

SEQ ID NO: 2483456 - protein, 24 aa, Entamoeba dispar
GIVIQCLSCVISLLKAEPTPSKII

SEQ ID NO: 2483457 - protein, 23 aa, Entamoeba dispar
GIVKEKYNSIVIGLINTSAECIF

SEQ ID NO: 2483458 - protein, 22 aa, Entamoeba dispar
GIVKVWDILGVESLEVMRSKVT

SEQ ID NO: 2483459 - protein, 26 aa, Entamoeba dispar
GIVTSLKARCSVIAAANPKTGKYNPN

SEQ ID NO: 2483460 - protein, 26 aa, Entamoeba dispar
GIVVKCMQRGYWLMMENVNFCNPTVL

SEQ ID NO: 2483461 - protein, 20 aa, Entamoeba dispar
GIVYFKYFFDLSDLTLEQLR

SEQ ID NO: 2483462 - protein, 18 aa, Entamoeba dispar
GIYGCCECPITPDIYTAV

SEQ ID NO: 2483463 - protein, 19 aa, Entamoeba dispar
GIYGCCECPITPDIYTAVF

SEQ ID NO: 2483464 - protein, 27 aa, Entamoeba dispar
GIYGYVYCFLNGISIEILVAQVISENY

SEQ ID NO: 2483465 - protein, 23 aa, Entamoeba dispar
GIYKVGGIALLLALILKSDTKIK

SEQ ID NO: 2483466 - protein, 18 aa, Entamoeba dispar
GIYLKKFKDTFSVVREYL

SEQ ID NO: 2483467 - protein, 20 aa, Entamoeba dispar
GKAEGLIRILSIEEHGDIID

SEQ ID NO: 2483468 - protein, 23 aa, Entamoeba dispar
GKAGEQIIDFTIKVNQNGMMELS

SEQ ID NO: 2483469 - protein, 30 aa, Entamoeba dispar
GKCCSCNRSVVKRTLFKCGHCMCDQCLEKL

SEQ ID NO: 2483470 - protein, 31 aa, Entamoeba dispar
GKCLKKEAKKRCKISEIFVDEWIKDNLCESE

SEQ ID NO: 2483471 - protein, 34 aa, Entamoeba dispar
GKCLKKEAKKRCKISEIFVHEWIKDNLCESEVLD

SEQ ID NO: 2483472 - protein, 19 aa, Entamoeba dispar
GKCNTGYVCSKGSVCVIKP

SEQ ID NO: 2483473 - protein, 18 aa, Entamoeba dispar
GKCSTTLLDKAPTKIESL

SEQ ID NO: 2483474 - protein, 19 aa, Entamoeba dispar
GKCVGCAAANGATKEKIQT

SEQ ID NO: 2483475 - protein, 20 aa, Entamoeba dispar
GKCYHMYPRAFARELGRYSE

SEQ ID NO: 2483476 - protein, 19 aa, Entamoeba dispar
GKDHGDFGLKLNMSNGGPA

SEQ ID NO: 2483477 - protein, 21 aa, Entamoeba dispar
GKDIICSKTIYSNKIKAFHSV

SEQ ID NO: 2483478 - protein, 19 aa, Entamoeba dispar
GKDIIKIGLPIIQLSSIDI

SEQ ID NO: 2483479 - protein, 18 aa, Entamoeba dispar
GKDIKELLEMGIGVHNAG

SEQ ID NO: 2483480 - protein, 18 aa, Entamoeba dispar
GKDIPIYHMYTFEDQFII

SEQ ID NO: 2483481 - protein, 17 aa, Entamoeba dispar
GKDKAAELGVKYIETSA

SEQ ID NO: 2483482 - protein, 20 aa, Entamoeba dispar
GKDKSKCYMLGYIPPQYKNG

SEQ ID NO: 2483483 - protein, 23 aa, Entamoeba dispar
GKDLCKNKAFGVKYLLKTNKKHP

SEQ ID NO: 2483484 - protein, 30 aa, Entamoeba dispar
GKDMLQELCVLKGKLCWIIYVDVVVVEDDG

SEQ ID NO: 2483485 - protein, 19 aa, Entamoeba dispar
GKDNTIWMVDPFMMRVVKK

SEQ ID NO: 2483486 - protein, 26 aa, Entamoeba dispar
GKDYDCLIDVWSLGIMCREMMEGYPP

SEQ ID NO: 2483487 - protein, 21 aa, Entamoeba dispar
GKEFMKQLCLDGIQFSFLSSE

SEQ ID NO: 2483488 - protein, 21 aa, Entamoeba dispar
GKEGISLYGCLNKCMTKGGSK

SEQ ID NO: 2483489 - protein, 24 aa, Entamoeba dispar
GKEGRFKILVELFGKTDDSELKAT

SEQ ID NO: 2483490 - protein, 22 aa, Entamoeba dispar
GKEHGWKVIVADWGAEACGDAV

SEQ ID NO: 2483491 - protein, 18 aa, Entamoeba dispar
GKEIPKVNPIEFEKDDDN

SEQ ID NO: 2483492 - protein, 29 aa, Entamoeba dispar
GKEKGRIRLCSTCLQFIVNEIYIRYLKIF

SEQ ID NO: 2483493 - protein, 18 aa, Entamoeba dispar
GKELKGRNSHIIELIRNW

SEQ ID NO: 2483494 - protein, 18 aa, Entamoeba dispar
GKENILLMVFTKKGYVFG

SEQ ID NO: 2483495 - protein, 23 aa, Entamoeba dispar
GKENKERVFSIGLCNDNGTEEAK

SEQ ID NO: 2483496 - protein, 22 aa, Entamoeba dispar
GKERKRSGIVIKVSLRDSDNNI

SEQ ID NO: 2483497 - protein, 20 aa, Entamoeba dispar
GKESILFICIADGIRFGCFH

SEQ ID NO: 2483498 - protein, 18 aa, Entamoeba dispar
GKESIVLVIFDSEGNVFG

SEQ ID NO: 2483499 - protein, 19 aa, Entamoeba dispar
GKETLKRKEYIQIIRANEI

SEQ ID NO: 2483500 - protein, 19 aa, Entamoeba dispar
GKEVCLFENIGFLSPKGHY

SEQ ID NO: 2483501 - protein, 20 aa, Entamoeba dispar
GKEVKFVFESKCWKEVIKKC

SEQ ID NO: 2483502 - protein, 18 aa, Entamoeba dispar
GKEVKMIRCHNMKMIDTS

SEQ ID NO: 2483503 - protein, 19 aa, Entamoeba dispar
GKEVKMVRCHNIKIIDTSN

SEQ ID NO: 2483504 - protein, 24 aa, Entamoeba dispar
GKEVLTILSEMWKKLDPVEKDKYN

SEQ ID NO: 2483505 - protein, 23 aa, Entamoeba dispar
GKEWCGNLIIVEFSETIESKRNR

SEQ ID NO: 2483506 - protein, 18 aa, Entamoeba dispar
GKEYVCICKFHEAISDEQ

SEQ ID NO: 2483507 - protein, 19 aa, Entamoeba dispar
GKFFDRNWYSLYFINSMRE

SEQ ID NO: 2483508 - protein, 20 aa, Entamoeba dispar
GKFFGFKHINEIGCHFNQII

SEQ ID NO: 2483509 - protein, 26 aa, Entamoeba dispar
GKFGIEVMCLLYLFKIQFPNQFFLLR

SEQ ID NO: 2483510 - protein, 19 aa, Entamoeba dispar
GKFKLHITALPYLAQYCQS

SEQ ID NO: 2483511 - protein, 19 aa, Entamoeba dispar
GKFKVGVTAVIRVTLKNGV

SEQ ID NO: 2483512 - protein, 19 aa, Entamoeba dispar
GKFLHAAETVMVFKATSTT

SEQ ID NO: 2483513 - protein, 17 aa, Entamoeba dispar
GKFLKYISGYLKQNKIS

SEQ ID NO: 2483514 - protein, 18 aa, Entamoeba dispar
GKFSIEIIKENKVKSPIS

SEQ ID NO: 2483515 - protein, 19 aa, Entamoeba dispar
GKFSMYYNINMENAVNIFS

SEQ ID NO: 2483516 - protein, 17 aa, Entamoeba dispar
GKFTVKLPWEFTTSETP

SEQ ID NO: 2483517 - protein, 23 aa, Entamoeba dispar
GKGADFPPYAFVKFTDEKSAGLA

SEQ ID NO: 2483518 - protein, 25 aa, Entamoeba dispar
GKGAVLLCVIRGRLSEGIDFTNHLA

SEQ ID NO: 2483519 - protein, 25 aa, Entamoeba dispar
GKGEARICKVYDSPCLPESEASFAI

SEQ ID NO: 2483520 - protein, 24 aa, Entamoeba dispar
GKGEGSSLFGLKPFDIEITITVIQ

SEQ ID NO: 2483521 - protein, 24 aa, Entamoeba dispar
GKGFEVKDAIALLRMDDIFVDSFE

SEQ ID NO: 2483522 - protein, 21 aa, Entamoeba dispar
GKGFLVSWCGRIEKLFIVGFN

SEQ ID NO: 2483523 - protein, 22 aa, Entamoeba dispar
GKGKIKYQAKRPFEEKLTSTFF

SEQ ID NO: 2483524 - protein, 23 aa, Entamoeba dispar
GKGKIKYQAKRPFEEKLTSTFFN

SEQ ID NO: 2483525 - protein, 17 aa, Entamoeba dispar
GKGKILITGFHFEFDEQ

SEQ ID NO: 2483526 - protein, 24 aa, Entamoeba dispar
GKGNKKYDVKFMRADVKKSFLKGK

SEQ ID NO: 2483527 - protein, 17 aa, Entamoeba dispar
GKGPVNFTIHCVNKVGT

SEQ ID NO: 2483528 - protein, 18 aa, Entamoeba dispar
GKGPYVFASELNKIKVNS

SEQ ID NO: 2483529 - protein, 20 aa, Entamoeba dispar
GKGRGVICCRPIKAGELVFK

SEQ ID NO: 2483530 - protein, 23 aa, Entamoeba dispar
GKGYGSKLVECFIQKVKEKGIRK

SEQ ID NO: 2483531 - protein, 19 aa, Entamoeba dispar
GKGYIFIFPKNTWSYVNEY

SEQ ID NO: 2483532 - protein, 19 aa, Entamoeba dispar
GKHGRFRGNLLGKRVDFSG

SEQ ID NO: 2483533 - protein, 23 aa, Entamoeba dispar
GKHIISRCGACMTLIGPSNTPFQ

SEQ ID NO: 2483534 - protein, 30 aa, Entamoeba dispar
GKHPKWMERTSGCTFGFGGKMGIFKGKEVL

SEQ ID NO: 2483535 - protein, 17 aa, Entamoeba dispar
GKHVFSKLRHQAKAEYR

SEQ ID NO: 2483536 - protein, 25 aa, Entamoeba dispar
GKIAMSRKVERRWRLVGWGEVVKGT

SEQ ID NO: 2483537 - protein, 25 aa, Entamoeba dispar
GKIDLKYKANFCINWLNSMENNKEK

SEQ ID NO: 2483538 - protein, 17 aa, Entamoeba dispar
GKIEELFLWAFKEENCN

SEQ ID NO: 2483539 - protein, 23 aa, Entamoeba dispar
GKIEGFLPLTGTAFVAWGDKVQL

SEQ ID NO: 2483540 - protein, 19 aa, Entamoeba dispar
GKIFGELSLALNNNALVSD

SEQ ID NO: 2483541 - protein, 25 aa, Entamoeba dispar
GKIFKEVIWYKVDYSTYLKEKETGN

SEQ ID NO: 2483542 - protein, 24 aa, Entamoeba dispar
GKIFKKIIWYKVDYSTYLKEKEQG

SEQ ID NO: 2483543 - protein, 20 aa, Entamoeba dispar
GKIFKKRKKNEISVNIEYTQ

SEQ ID NO: 2483544 - protein, 23 aa, Entamoeba dispar
GKIFKKVIWYKVSYSTYLQEKEQ

SEQ ID NO: 2483545 - protein, 20 aa, Entamoeba dispar
GKIFKKVIWYLVDYSTYLKE

SEQ ID NO: 2483546 - protein, 20 aa, Entamoeba dispar
GKIFKKVIWYLVKDRYTYGN

SEQ ID NO: 2483547 - protein, 20 aa, Entamoeba dispar
GKIFKKVIWYLVNYSTYLKE

SEQ ID NO: 2483548 - protein, 18 aa, Entamoeba dispar
GKIFKQLIWYPVSYDEFL

SEQ ID NO: 2483549 - protein, 20 aa, Entamoeba dispar
GKIFKQVIWYQVDYLTYLQE

SEQ ID NO: 2483550 - protein, 18 aa, Entamoeba dispar
GKIFKYIIWYKVSYSTHL

SEQ ID NO: 2483551 - protein, 19 aa, Entamoeba dispar
GKIFKYVIWYEVNYSTYLK

SEQ ID NO: 2483552 - protein, 23 aa, Entamoeba dispar
GKIFKYVIWYLVEYSKYLQEKEK

SEQ ID NO: 2483553 - protein, 20 aa, Entamoeba dispar
GKIFKYVIWYTIGYSRYLQE

SEQ ID NO: 2483554 - protein, 18 aa, Entamoeba dispar
GKIFRILDDINWSEVKST

SEQ ID NO: 2483555 - protein, 17 aa, Entamoeba dispar
GKIGYKNAISYLDLPLN

SEQ ID NO: 2483556 - protein, 18 aa, Entamoeba dispar
GKIHLLEFFAIKAEYVQE

SEQ ID NO: 2483557 - protein, 20 aa, Entamoeba dispar
GKIIFCCYNLTDLNIYSKFL

SEQ ID NO: 2483558 - protein, 25 aa, Entamoeba dispar
GKIIKQVIWYKVEYSRYSKEKEQGN

SEQ ID NO: 2483559 - protein, 22 aa, Entamoeba dispar
GKIINQYLCELFVSSRITVKKN

SEQ ID NO: 2483560 - protein, 23 aa, Entamoeba dispar
GKIKARWMRKNARRLDIEHYTRT

SEQ ID NO: 2483561 - protein, 23 aa, Entamoeba dispar
GKIKARWMRKNARRLDIETYARS

SEQ ID NO: 2483562 - protein, 25 aa, Entamoeba dispar
GKIKARWMRKNARRLDVEQYTRTDL

SEQ ID NO: 2483563 - protein, 29 aa, Entamoeba dispar
GKIKDICRICLKGGVAVVGVGFPACTPTS

SEQ ID NO: 2483564 - protein, 24 aa, Entamoeba dispar
GKIKSRWLRKNARRIDMENYTKED

SEQ ID NO: 2483565 - protein, 24 aa, Entamoeba dispar
GKIKSRWMRKNARRLDIENYTRND

SEQ ID NO: 2483566 - protein, 21 aa, Entamoeba dispar
GKILPKLLIRTLFYNIDQVMT

SEQ ID NO: 2483567 - protein, 24 aa, Entamoeba dispar
GKILSELHIDCNFNGKLIGIEENP

SEQ ID NO: 2483568 - protein, 24 aa, Entamoeba dispar
GKIMRSCIGSNCFESLIEHMPEQL

SEQ ID NO: 2483569 - protein, 20 aa, Entamoeba dispar
GKIPLISKFFRDVSLIDPQS

SEQ ID NO: 2483570 - protein, 17 aa, Entamoeba dispar
GKIRYNLIHNIKGTILA

SEQ ID NO: 2483571 - protein, 18 aa, Entamoeba dispar
GKISENVGCLRDVTQSKL

SEQ ID NO: 2483572 - protein, 23 aa, Entamoeba dispar
GKISRQSFFYIILEFIKNQTNCE

SEQ ID NO: 2483573 - protein, 34 aa, Entamoeba dispar
GKISRRTVSGPKGRRRPTMKKVQFDEHTERLIKE

SEQ ID NO: 2483574 - protein, 25 aa, Entamoeba dispar
GKISYEEFCSIILKNSENIGEKLTI

SEQ ID NO: 2483575 - protein, 23 aa, Entamoeba dispar
GKITCSVLFFLKSIVLSLEKECN

SEQ ID NO: 2483576 - protein, 22 aa, Entamoeba dispar
GKIYDCLSMETSYFTKISLKDQ

SEQ ID NO: 2483577 - protein, 21 aa, Entamoeba dispar
GKKCFYKCSSITRIDIAKIHY

SEQ ID NO: 2483578 - protein, 17 aa, Entamoeba dispar
GKKCSRKEWELLKMLAN

SEQ ID NO: 2483579 - protein, 17 aa, Entamoeba dispar
GKKECPEGYRVINNIGE

SEQ ID NO: 2483580 - protein, 22 aa, Entamoeba dispar
GKKGICKIDIAYKVYNKNKLMF

SEQ ID NO: 2483581 - protein, 17 aa, Entamoeba dispar
GKKGVASAEAMLKKLEE

SEQ ID NO: 2483582 - protein, 27 aa, Entamoeba dispar
GKKIIGNSCTLMICLDSFIVKKGNEIE

SEQ ID NO: 2483583 - protein, 17 aa, Entamoeba dispar
GKKKIAWKEEEDTRLIQ

SEQ ID NO: 2483584 - protein, 27 aa, Entamoeba dispar
GKKLHINFSYISRLCDMDGSYQNIRNY

SEQ ID NO: 2483585 - protein, 24 aa, Entamoeba dispar
GKKQFHASEPIEWDNVKKVSHPVE

SEQ ID NO: 2483586 - protein, 25 aa, Entamoeba dispar
GKKRAFSCFVIGGLDNSLSVWVARK

SEQ ID NO: 2483587 - protein, 28 aa, Entamoeba dispar
GKKRKPVVGCFFELLVLKTQGVIDLQQQ

SEQ ID NO: 2483588 - protein, 19 aa, Entamoeba dispar
GKKVGKLEVGYILFNAFKS

SEQ ID NO: 2483589 - protein, 19 aa, Entamoeba dispar
GKKVYCGLLKQRTNPKGIN

SEQ ID NO: 2483590 - protein, 24 aa, Entamoeba dispar
GKLFKEIIWYKVDYSTYLKEKEAG

SEQ ID NO: 2483591 - protein, 17 aa, Entamoeba dispar
GKLFYVYHNNIYLNEPI

SEQ ID NO: 2483592 - protein, 20 aa, Entamoeba dispar
GKLGKGIYMYRTYKEAIKKN

SEQ ID NO: 2483593 - protein, 23 aa, Entamoeba dispar
GKLIKKLMIRYSKYNNKYDNNIP

SEQ ID NO: 2483594 - protein, 23 aa, Entamoeba dispar
GKLKKSECGFIPQSVTALTVLCG

SEQ ID NO: 2483595 - protein, 17 aa, Entamoeba dispar
GKLKYILNGGAPLTEEL

SEQ ID NO: 2483596 - protein, 21 aa, Entamoeba dispar
GKLLHYKREYFGGAVTAICSC

SEQ ID NO: 2483597 - protein, 18 aa, Entamoeba dispar
GKLLKPISLLISGMENSI

SEQ ID NO: 2483598 - protein, 18 aa, Entamoeba dispar
GKLLLKGYKPGMKVCTRF

SEQ ID NO: 2483599 - protein, 17 aa, Entamoeba dispar
GKLRGNVYYVDCNNEDI

SEQ ID NO: 2483600 - protein, 20 aa, Entamoeba dispar
GKLVEQWYQLLIKYWSGYST

SEQ ID NO: 2483601 - protein, 18 aa, Entamoeba dispar
GKMAPECNTNARLLVEYF

SEQ ID NO: 2483602 - protein, 18 aa, Entamoeba dispar
GKMIELMAIFNSKLNPQF

SEQ ID NO: 2483603 - protein, 23 aa, Entamoeba dispar
GKMPLQRLGDLLSIVEEGAKTIG

SEQ ID NO: 2483604 - protein, 17 aa, Entamoeba dispar
GKMRILNTLQEYLDYRL

SEQ ID NO: 2483605 - protein, 20 aa, Entamoeba dispar
GKNAFGVLCEFAVRLYSTDL

SEQ ID NO: 2483606 - protein, 21 aa, Entamoeba dispar
GKNCFYECICADMLKENGAVP

SEQ ID NO: 2483607 - protein, 19 aa, Entamoeba dispar
GKNIFEYNYIFLPFHQNSH

SEQ ID NO: 2483608 - protein, 24 aa, Entamoeba dispar
GKNKKEIGCIISSMKQKEKLKVIK

SEQ ID NO: 2483609 - protein, 17 aa, Entamoeba dispar
GKNLILFNEKKGESIVT

SEQ ID NO: 2483610 - protein, 23 aa, Entamoeba dispar
GKNNTCPVCDILMNGADYMNVTC

SEQ ID NO: 2483611 - protein, 20 aa, Entamoeba dispar
GKNSELMWCKLIGNDPVVFG

SEQ ID NO: 2483612 - protein, 24 aa, Entamoeba dispar
GKNSIEVITLLLLYKLKYPHSIFL

SEQ ID NO: 2483613 - protein, 18 aa, Entamoeba dispar
GKNSYYKRESCASVCIAG

SEQ ID NO: 2483614 - protein, 19 aa, Entamoeba dispar
GKPFVMCLINSDPSSNKIH

SEQ ID NO: 2483615 - protein, 25 aa, Entamoeba dispar
GKPIPPPRPGNRDALSHHHSDVPLP

SEQ ID NO: 2483616 - protein, 18 aa, Entamoeba dispar
GKPLELWNIDSLEDTTPL

SEQ ID NO: 2483617 - protein, 24 aa, Entamoeba dispar
GKPLNPIMLWYSEHRYRETYITSN

SEQ ID NO: 2483618 - protein, 17 aa, Entamoeba dispar
GKQCYLLNMLLETKEWT

SEQ ID NO: 2483619 - protein, 19 aa, Entamoeba dispar
GKQGWTISFLPLTSSVTNV

SEQ ID NO: 2483620 - protein, 17 aa, Entamoeba dispar
GKQIVLWMTEIAQEMKA

SEQ ID NO: 2483621 - protein, 22 aa, Entamoeba dispar
GKQKIRMVKDLKSELKKSKISG

SEQ ID NO: 2483622 - protein, 25 aa, Entamoeba dispar
GKQKVFKVNQEWTVSQIYALVKKET

SEQ ID NO: 2483623 - protein, 17 aa, Entamoeba dispar
GKQLIVFYGKDASKAKR

SEQ ID NO: 2483624 - protein, 31 aa, Entamoeba dispar
GKQLKAMDIRSSDPYVIVSVGIEQRKTKTVT

SEQ ID NO: 2483625 - protein, 18 aa, Entamoeba dispar
GKQLWSYCHKNFISDIQW

SEQ ID NO: 2483626 - protein, 19 aa, Entamoeba dispar
GKQTFRLLFDSSRDGLLPA

SEQ ID NO: 2483627 - protein, 18 aa, Entamoeba dispar
GKQTKFRCVVTDKDNNQI

SEQ ID NO: 2483628 - protein, 18 aa, Entamoeba dispar
GKQYIRLAGLRDDISNNN

SEQ ID NO: 2483629 - protein, 22 aa, Entamoeba dispar
GKRIEECSGHFAVINLELPVFH

SEQ ID NO: 2483630 - protein, 26 aa, Entamoeba dispar
GKRLEIPSGCLFSEVIERCWQQDPRD

SEQ ID NO: 2483631 - protein, 19 aa, Entamoeba dispar
GKRRIGYNEIMITSKYFND

SEQ ID NO: 2483632 - protein, 22 aa, Entamoeba dispar
GKRRKETVCLVEVLEDYPDNHV

SEQ ID NO: 2483633 - protein, 22 aa, Entamoeba dispar
GKRWSKSVMDMGYEVLVVSQFT

SEQ ID NO: 2483634 - protein, 29 aa, Entamoeba dispar
GKSAEELWNYVELFGSLELENGKEGNDLD

SEQ ID NO: 2483635 - protein, 24 aa, Entamoeba dispar
GKSESRGFGYLDFFNINEAQRCID

SEQ ID NO: 2483636 - protein, 17 aa, Entamoeba dispar
GKSGGTIFRCIWCSLFV

SEQ ID NO: 2483637 - protein, 27 aa, Entamoeba dispar
GKSIFKLELPQIISFTINCSILAISTS

SEQ ID NO: 2483638 - protein, 20 aa, Entamoeba dispar
GKSKGYGFVTFIRKEDAETA
